United States Patent 10,706,955 (BIOINFORMATIC PROCESSES FOR DETERMINATION OF PEPTIDE BINDING) - sequence listing, part 70

SEQ ID NO: 2669583 - protein, 20 aa, Entamoeba histolytica
AKYAPKMGIMIRIMENDTSA

SEQ ID NO: 2669584 - protein, 25 aa, Entamoeba histolytica
AKYKISPRNTFKSCMEEASNRLKKQ

SEQ ID NO: 2669585 - protein, 17 aa, Entamoeba histolytica
AKYSDSCFPPFDKELNI

SEQ ID NO: 2669586 - protein, 19 aa, Entamoeba histolytica
ALAASGLRSVRYAKELPQD

SEQ ID NO: 2669587 - protein, 33 aa, Entamoeba histolytica
ALAHLIKAKVIPDCVSSIWVCCVDKRYENGRNG

SEQ ID NO: 2669588 - protein, 18 aa, Entamoeba histolytica
ALAHPFFQSGIIKEINPL

SEQ ID NO: 2669589 - protein, 19 aa, Entamoeba histolytica
ALANLHIILFDILKNPVHF

SEQ ID NO: 2669590 - protein, 22 aa, Entamoeba histolytica
ALASELFSKWLTRNSRLSRSSI

SEQ ID NO: 2669591 - protein, 19 aa, Entamoeba histolytica
ALCGKEYPNHFTPKRIIVI

SEQ ID NO: 2669592 - protein, 17 aa, Entamoeba histolytica
ALCHRLFYQPFKAKDIQ

SEQ ID NO: 2669593 - protein, 23 aa, Entamoeba histolytica
ALCKHKSYLCIHEINESKKRINE

SEQ ID NO: 2669594 - protein, 19 aa, Entamoeba histolytica
ALCKIWEIEFPICSKCYQV

SEQ ID NO: 2669595 - protein, 31 aa, Entamoeba histolytica; identical to SEQ ID NO: 2475082

SEQ ID NO: 2669596 - protein, 21 aa, Entamoeba histolytica
ALCRKYLKNPFEVFIDDGEKL

SEQ ID NO: 2669597 - protein, 23 aa, Entamoeba histolytica
ALCVESFSDLPARVLPESIKHAS

SEQ ID NO: 2669598 - protein, 21 aa, Entamoeba histolytica
ALDAECFTITSGVTLEKSQRL

SEQ ID NO: 2669599 - protein, 25 aa, Entamoeba histolytica
ALDEEIKYIYTIIKGIRSLNGIYSQ

SEQ ID NO: 2669600 - protein, 25 aa, Entamoeba histolytica
ALDETLRLVVFLNNISAEYKKYLEN

SEQ ID NO: 2669601 - protein, 26 aa, Entamoeba histolytica
ALDIYEVHGLLPLFTKIYQFVGKEKL

SEQ ID NO: 2669602 - protein, 19 aa, Entamoeba histolytica
ALDKYSRKSIRELKEEVCG

SEQ ID NO: 2669603 - protein, 21 aa, Entamoeba histolytica
ALDMYKPVVWEFNRLNITYTV

SEQ ID NO: 2669604 - protein, 19 aa, Entamoeba histolytica
ALDPLGWTGHSGMAILAPH

SEQ ID NO: 2669605 - protein, 25 aa, Entamoeba histolytica
ALDSFPIYRLEHLFLQLNENDKENF

SEQ ID NO: 2669606 - protein, 27 aa, Entamoeba histolytica
ALDSTGKICLCIGKKYMKVVDLYRGKV

SEQ ID NO: 2669607 - protein, 19 aa, Entamoeba histolytica
ALEEYITLEFARYLQDAFN

SEQ ID NO: 2669608 - protein, 19 aa, Entamoeba histolytica
ALELFARKRSKIMKGATSP

SEQ ID NO: 2669609 - protein, 17 aa, Entamoeba histolytica
ALELLDFRFPDEQVRLF

SEQ ID NO: 2669610 - protein, 17 aa, Entamoeba histolytica
ALERKGRDLEKEIDEIQ

SEQ ID NO: 2669611 - protein, 19 aa, Entamoeba histolytica
ALESYQIVINGFAKINNYW

SEQ ID NO: 2669612 - protein, 21 aa, Entamoeba histolytica
ALESYTKLIGVIDVQATDVVN

SEQ ID NO: 2669613 - protein, 18 aa, Entamoeba histolytica
ALETWPVDLFGQLLPRHL

SEQ ID NO: 2669614 - protein, 25 aa, Entamoeba histolytica
ALFMKSNVVLLPFCPYNFQVSSKMT

SEQ ID NO: 2669615 - protein, 31 aa, Entamoeba histolytica
ALFVASLLNELPIEFIGLYLLVKTILNIFNL

SEQ ID NO: 2669616 - protein, 19 aa, Entamoeba histolytica
ALGCAHLIMHINAVAQGKS

SEQ ID NO: 2669617 - protein, 21 aa, Entamoeba histolytica
ALGCMLYEFVVGYPPFNASTP

SEQ ID NO: 2669618 - protein, 19 aa, Entamoeba histolytica
ALGDELKKLLLLSLSAGKA

SEQ ID NO: 2669619 - protein, 18 aa, Entamoeba histolytica
ALGNCIACNDYVALVHPE

SEQ ID NO: 2669620 - protein, 18 aa, Entamoeba histolytica
ALHAYIFIGPVYYQKLKH

SEQ ID NO: 2669621 - protein, 18 aa, Entamoeba histolytica
ALHICNFSISMGYVKTIG

SEQ ID NO: 2669622 - protein, 17 aa, Entamoeba histolytica
ALIDHFNSITNWVISTI

SEQ ID NO: 2669623 - protein, 25 aa, Entamoeba histolytica
ALIEGKWVVSKNWIINGMKKDEFKY

SEQ ID NO: 2669624 - protein, 25 aa, Entamoeba histolytica
ALIKELPSYCFFKCTSLQQIFFYPK

SEQ ID NO: 2669625 - protein, 22 aa, Entamoeba histolytica
ALILKFRFIKDSTKIRIITALM

SEQ ID NO: 2669626 - protein, 17 aa, Entamoeba histolytica
ALINFGPTFKIKIGENN

SEQ ID NO: 2669627 - protein, 23 aa, Entamoeba histolytica
ALISELVSLIAGINTSVQTDPQQ

SEQ ID NO: 2669628 - protein, 23 aa, Entamoeba histolytica
ALISLQCICEIMGDIFEPYIIDI

SEQ ID NO: 2669629 - protein, 19 aa, Entamoeba histolytica
ALKGIIFKKRFVLTQCSVR

SEQ ID NO: 2669630 - protein, 19 aa, Entamoeba histolytica
ALKIIPIKNKVQMIKNERE

SEQ ID NO: 2669631 - protein, 19 aa, Entamoeba histolytica
ALKKTFKFTETGEMVTENE

SEQ ID NO: 2669632 - protein, 32 aa, Entamoeba histolytica; identical to SEQ ID NO: 2475125

SEQ ID NO: 2669633 - protein, 17 aa, Entamoeba histolytica
ALKNRGDMGQLFYWLLV

SEQ ID NO: 2669634 - protein, 17 aa, Entamoeba histolytica
ALKRKWGSYGSIHNDQY

SEQ ID NO: 2669635 - protein, 18 aa, Entamoeba histolytica
ALKSLSTPFGYIYRSQKP

SEQ ID NO: 2669636 - protein, 22 aa, Entamoeba histolytica
ALKTISSFLFYYKCSQCTNEQK

SEQ ID NO: 2669637 - protein, 20 aa, Entamoeba histolytica
ALLCSSQEGFSYVPDVVKID

SEQ ID NO: 2669638 - protein, 17 aa, Entamoeba histolytica
ALLDSVRIKFGDIPQSS

SEQ ID NO: 2669639 - protein, 19 aa, Entamoeba histolytica
ALLDVIEMLEGYHLSHSRK

SEQ ID NO: 2669640 - protein, 34 aa, Entamoeba histolytica
ALLGAPLPIEFKWKIPITKKKTGLFSIIETTEVT

SEQ ID NO: 2669641 - protein, 17 aa, Entamoeba histolytica
ALLKRVATESVHIKAVL

SEQ ID NO: 2669642 - protein, 25 aa, Entamoeba histolytica
ALLNRLMKLCYRISLNHEDTQMDSL

SEQ ID NO: 2669643 - protein, 24 aa, Entamoeba histolytica
ALLPYPECSLKFWDCSCDIELLQL

SEQ ID NO: 2669644 - protein, 17 aa, Entamoeba histolytica
ALLSFLVHLLLEKDNDS

SEQ ID NO: 2669645 - protein, 17 aa, Entamoeba histolytica
ALMSRFDLFFVVLDEPN

SEQ ID NO: 2669646 - protein, 20 aa, Entamoeba histolytica
ALNCCSSCNVSEAIEEWDIE

SEQ ID NO: 2669647 - protein, 21 aa, Entamoeba histolytica
ALNCIVEGFEIIFDKGLDKKI

SEQ ID NO: 2669648 - protein, 17 aa, Entamoeba histolytica
ALNDHYTPCLTPRIYRD

SEQ ID NO: 2669649 - protein, 19 aa, Entamoeba histolytica
ALNFCFWPTEGFEYDDLTK

SEQ ID NO: 2669650 - protein, 34 aa, Entamoeba histolytica
ALNRNDLNMAYHILRNSYQIIYEVIQSTAPKSVA

SEQ ID NO: 2669651 - protein, 26 aa, Entamoeba histolytica
ALPEDNVCFCLISLRMTYDGVPNIAR

SEQ ID NO: 2669652 - protein, 17 aa, Entamoeba histolytica
ALPELACQCISSLKKIT

SEQ ID NO: 2669653 - protein, 20 aa, Entamoeba histolytica
ALPSSYKIVSKVLFPNCDQS

SEQ ID NO: 2669654 - protein, 20 aa, Entamoeba histolytica
ALQEKTCCICGKKSSDWKKG

SEQ ID NO: 2669655 - protein, 26 aa, Entamoeba histolytica
ALQKDIEMALGYSMKIPQRPSQINDL

SEQ ID NO: 2669656 - protein, 18 aa, Entamoeba histolytica
ALQSIFAKYAIKIGEQYY

SEQ ID NO: 2669657 - protein, 18 aa, Entamoeba histolytica
ALQYKRLFTQEEFLKYLR

SEQ ID NO: 2669658 - protein, 26 aa, Entamoeba histolytica
ALRAIRFSGKMGFVLDEELEQEMKTK

SEQ ID NO: 2669659 - protein, 17 aa, Entamoeba histolytica
ALREICLLRQLNHRNIV

SEQ ID NO: 2669660 - protein, 19 aa, Entamoeba histolytica
ALRQVKVRRGVLYLNNSNI

SEQ ID NO: 2669661 - protein, 20 aa, Entamoeba histolytica
ALSAPRCYTKIPAKIQKQMT

SEQ ID NO: 2669662 - protein, 20 aa, Entamoeba histolytica
ALSDFKSGAVNYLIATDVAS

SEQ ID NO: 2669663 - protein, 27 aa, Entamoeba histolytica
ALSKKGVTVAYEFKRFIGKSFDDKVIE

SEQ ID NO: 2669664 - protein, 24 aa, Entamoeba histolytica
ALSLEIINLLLLESSDFVTGFINE

SEQ ID NO: 2669665 - protein, 19 aa, Entamoeba histolytica
ALSQFLVKFGYHPQQITVD

SEQ ID NO: 2669666 - protein, 29 aa, Entamoeba histolytica
ALSSEKARCALRWGVPVLNFQWLFDCLKE

SEQ ID NO: 2669667 - protein, 17 aa, Entamoeba histolytica
ALTIGFCIESVLVNSIK

SEQ ID NO: 2669668 - protein, 26 aa, Entamoeba histolytica
ALTPEIVSLIPLRLHLLIKALGDEYG

SEQ ID NO: 2669669 - protein, 36 aa, Entamoeba histolytica
ALTTLQHYLPLFKLADHLKRCYEDGTNTSVVQDNEQ

SEQ ID NO: 2669670 - protein, 26 aa, Entamoeba histolytica
ALVEVFKKALTVEGVYDTTKQLLQQY

SEQ ID NO: 2669671 - protein, 19 aa, Entamoeba histolytica
ALVMCTNLFLTKLLQTDTP

SEQ ID NO: 2669672 - protein, 18 aa, Entamoeba histolytica
ALVPSVVKGKIVLDVGCG

SEQ ID NO: 2669673 - protein, 18 aa, Entamoeba histolytica
ALWSMGRINGYDLFDNKL

SEQ ID NO: 2669674 - protein, 24 aa, Entamoeba histolytica
ALYDILRFWGIYSLYSSIDPSSTD

SEQ ID NO: 2669675 - protein, 17 aa, Entamoeba histolytica
ALYLARAPKSCAVFETM

SEQ ID NO: 2669676 - protein, 22 aa, Entamoeba histolytica
AMACAKRYLIDWDKETSNYHEN

SEQ ID NO: 2669677 - protein, 23 aa, Entamoeba histolytica
AMAKRIGAVEYIEWNDSDKEDVV

SEQ ID NO: 2669678 - protein, 19 aa, Entamoeba histolytica
AMCPCLKTIGLEGVNSLTR

SEQ ID NO: 2669679 - protein, 18 aa, Entamoeba histolytica
AMCVPDPVKVILTNVPDD

SEQ ID NO: 2669680 - protein, 18 aa, Entamoeba histolytica
AMEISPECIIEWENQGAK

SEQ ID NO: 2669681 - protein, 20 aa, Entamoeba histolytica
AMEKAEHAYHDMLKKPENKQ

SEQ ID NO: 2669682 - protein, 18 aa, Entamoeba histolytica
AMEKMKVGVNKFLEGYPN

SEQ ID NO: 2669683 - protein, 21 aa, Entamoeba histolytica
AMILPVKFIVNLAKHKQRVSI

SEQ ID NO: 2669684 - protein, 23 aa, Entamoeba histolytica
AMIPEIVSAYTIKVVAPGSSGIG

SEQ ID NO: 2669685 - protein, 18 aa, Entamoeba histolytica
AMITRPSNNQMYWVRFGP

SEQ ID NO: 2669686 - protein, 21 aa, Entamoeba histolytica
AMKAIEMSGMFFKESSPIYVS

SEQ ID NO: 2669687 - protein, 19 aa, Entamoeba histolytica
AMNCCANFAFANRGMITYR

SEQ ID NO: 2669688 - protein, 24 aa, Entamoeba histolytica
AMNRQRGEGGRFCSKKKIEQSQVS

SEQ ID NO: 2669689 - protein, 26 aa, Entamoeba histolytica
AMNWGNCAICLFNLGKKEIGIELAEK

SEQ ID NO: 2669690 - protein, 20 aa, Entamoeba histolytica
AMPAYSCVAYKYGEKEDKAQ

SEQ ID NO: 2669691 - protein, 17 aa, Entamoeba histolytica
AMRKLWGEKRIRSTNEL

SEQ ID NO: 2669692 - protein, 18 aa, Entamoeba histolytica
AMSLIGFNDVVIIGEDVA

SEQ ID NO: 2669693 - protein, 20 aa, Entamoeba histolytica
AMVLRTLYNILIKKIGNRTI

SEQ ID NO: 2669694 - protein, 22 aa, Entamoeba histolytica
AMVLRTLYNILIKRIGNRKIGK

SEQ ID NO: 2669695 - protein, 23 aa, Entamoeba histolytica
AMVLRTLYNILIKRIGNRKIGKV

SEQ ID NO: 2669696 - protein, 27 aa, Entamoeba histolytica
AMVTYKKKHCYAFLFSDELVFAKEQAV

SEQ ID NO: 2669697 - protein, 28 aa, Entamoeba histolytica
ANAEELWNYVELFGSLELENGKEGSDLD

SEQ ID NO: 2669698 - protein, 25 aa, Entamoeba histolytica
ANAELLISYYNTRIEVLKTNIEMTR

SEQ ID NO: 2669699 - protein, 23 aa, Entamoeba histolytica
ANAKQIGVLACTWNVNQSVFTRR

SEQ ID NO: 2669700 - protein, 18 aa, Entamoeba histolytica
ANARKDYAKSMLRMVQEF

SEQ ID NO: 2669701 - protein, 17 aa, Entamoeba histolytica
ANATLLRNLAKGAVEYS

SEQ ID NO: 2669702 - protein, 20 aa, Entamoeba histolytica
ANCMPGLITPFTDILSICGV

SEQ ID NO: 2669703 - protein, 25 aa, Entamoeba histolytica
ANDMKWKTEMLDFKESLQIEQKKEI

SEQ ID NO: 2669704 - protein, 18 aa, Entamoeba histolytica
ANEGIDFDKRMMDLLEMK

SEQ ID NO: 2669705 - protein, 19 aa, Entamoeba histolytica
ANEKINFYFKQIITGIQYI

SEQ ID NO: 2669706 - protein, 27 aa, Entamoeba histolytica
ANETIRLALWQLYLTWTNVFPAQTLNQ

SEQ ID NO: 2669707 - protein, 24 aa, Entamoeba histolytica
ANEVCKRVGQIIPYNKSTSKLWRN

SEQ ID NO: 2669708 - protein, 24 aa, Entamoeba histolytica
ANEYKGGQCIYAIVDYLQSEEFLQ

SEQ ID NO: 2669709 - protein, 18 aa, Entamoeba histolytica
ANEYPVYSPIISFNQKIT

SEQ ID NO: 2669710 - protein, 18 aa, Entamoeba histolytica
ANFAFANRGMITYRIRQA

SEQ ID NO: 2669711 - protein, 19 aa, Entamoeba histolytica
ANFCLPLTRLLWNMENEIM

SEQ ID NO: 2669712 - protein, 17 aa, Entamoeba histolytica
ANFDEWAFCISSTSNAN

SEQ ID NO: 2669713 - protein, 17 aa, Entamoeba histolytica
ANFKMSLNSSLLSENFP

SEQ ID NO: 2669714 - protein, 17 aa, Entamoeba histolytica
ANGKIRNCCPSKVISIS

SEQ ID NO: 2669715 - protein, 20 aa, Entamoeba histolytica
ANGLPICFSDSTQIPLRKRG

SEQ ID NO: 2669716 - protein, 17 aa, Entamoeba histolytica
ANGMCLEALQLIFKNLV

SEQ ID NO: 2669717 - protein, 17 aa, Entamoeba histolytica
ANGSVLDEAYCIECIPS

SEQ ID NO: 2669718 - protein, 24 aa, Entamoeba histolytica
ANHQWKIEGNQIIFELPKVDKKKE

SEQ ID NO: 2669719 - protein, 18 aa, Entamoeba histolytica
ANHRPATCEQWRLWQELL

SEQ ID NO: 2669720 - protein, 25 aa, Entamoeba histolytica
ANHVLRYGGIYTIGLAYCGTANEKA

SEQ ID NO: 2669721 - protein, 19 aa, Entamoeba histolytica
ANIFQKCIVDWKYDSCFGK

SEQ ID NO: 2669722 - protein, 20 aa, Entamoeba histolytica
ANIFSGSTLIYLIKGDGKTM

SEQ ID NO: 2669723 - protein, 17 aa, Entamoeba histolytica
ANIILSKGVTISESNLS

SEQ ID NO: 2669724 - protein, 24 aa, Entamoeba histolytica
ANIKKYLDGIGWKEIEIHEKKKDD

SEQ ID NO: 2669725 - protein, 17 aa, Entamoeba histolytica
ANIMADCRLNINVNKYI

SEQ ID NO: 2669726 - protein, 22 aa, Entamoeba histolytica
ANINRSLVVFGRVIHGLVQAST

SEQ ID NO: 2669727 - protein, 26 aa, Entamoeba histolytica
ANIQICILHIRTAYHLIVKTGFQLIR

SEQ ID NO: 2669728 - protein, 22 aa, Entamoeba histolytica
ANKCLPLGRSRDWHNALMDYGA

SEQ ID NO: 2669729 - protein, 21 aa, Entamoeba histolytica
ANKKCGVACFLAQHKDRLTCG

SEQ ID NO: 2669730 - protein, 18 aa, Entamoeba histolytica
ANKLLKYESLMIINDFSN

SEQ ID NO: 2669731 - protein, 17 aa, Entamoeba histolytica
ANKRPEILVKIAVITER

SEQ ID NO: 2669732 - protein, 17 aa, Entamoeba histolytica
ANKYIHGEDENSSDYDI

SEQ ID NO: 2669733 - protein, 17 aa, Entamoeba histolytica
ANLTYYAWGSKYSPSRN

SEQ ID NO: 2669734 - protein, 18 aa, Entamoeba histolytica
ANLYGRLMMELEQKIEEE

SEQ ID NO: 2669735 - protein, 19 aa, Entamoeba histolytica
ANNLIELLLIFSSKKKMSK

SEQ ID NO: 2669736 - protein, 17 aa, Entamoeba histolytica
ANPIKREEVLAVSSGFE

SEQ ID NO: 2669737 - protein, 18 aa, Entamoeba histolytica
ANQPFKCVPVKNLTEEEL

SEQ ID NO: 2669738 - protein, 23 aa, Entamoeba histolytica
ANRRRTVQCIAHLSKYADDKQLE

SEQ ID NO: 2669739 - protein, 19 aa, Entamoeba histolytica
ANRYLAGKVTLAARADSCR

SEQ ID NO: 2669740 - protein, 19 aa, Entamoeba histolytica
ANSCWKYLEDFSISLSHLL

SEQ ID NO: 2669741 - protein, 25 aa, Entamoeba histolytica
ANSNGFKGMLLVSAKTGFHVEETME

SEQ ID NO: 2669742 - protein, 16 aa, Entamoeba histolytica
ANSSLLLEKSFIIERT

SEQ ID NO: 2669743 - protein, 24 aa, Entamoeba histolytica
ANSVLISLCSLFIVTRKVFTMKDF

SEQ ID NO: 2669744 - protein, 19 aa, Entamoeba histolytica
ANTLFKIAYYYKSNAVHNK

SEQ ID NO: 2669745 - protein, 22 aa, Entamoeba histolytica
ANTQKIRDCFNFYDRDYDGKID

SEQ ID NO: 2669746 - protein, 27 aa, Entamoeba histolytica
ANVKVEGFWPIVMAKALANADIEDLIM

SEQ ID NO: 2669747 - protein, 21 aa, Entamoeba histolytica
ANVLINFCNQLGIGFGGSAED

SEQ ID NO: 2669748 - protein, 19 aa, Entamoeba histolytica
ANVLKCIDTGAVIICGKNK

SEQ ID NO: 2669749 - protein, 19 aa, Entamoeba histolytica
ANVPLVIAGCVPQADPKAC

SEQ ID NO: 2669750 - protein, 25 aa, Entamoeba histolytica
ANVYNPLGWDSCVYMNPGPTGDSKV

SEQ ID NO: 2669751 - protein, 17 aa, Entamoeba histolytica
ANYDLRFNVKLSNDDNN

SEQ ID NO: 2669752 - protein, 21 aa, Entamoeba histolytica
ANYKCMCELQMLRNEKGFDYE

SEQ ID NO: 2669753 - protein, 21 aa, Entamoeba histolytica
ANYKIEMAKVIPSLQYGMDCY

SEQ ID NO: 2669754 - protein, 26 aa, Entamoeba histolytica
APAFPESFPHLFGKQKIRCLIPCAID

SEQ ID NO: 2669755 - protein, 18 aa, Entamoeba histolytica
APAGVMAVIVWRKKGSDQ

SEQ ID NO: 2669756 - protein, 26 aa, Entamoeba histolytica
APAIALEVFIRFFPIIPLKNTKTQRD

SEQ ID NO: 2669757 - protein, 28 aa, Entamoeba histolytica
APALKILVRLCSLFPLIKKYVLACEFFR

SEQ ID NO: 2669758 - protein, 17 aa, Entamoeba histolytica
APDIFIRAAELCGEKDM

SEQ ID NO: 2669759 - protein, 28 aa, Entamoeba histolytica
APDNLKTKFVYYSRDWEDFLKSNNHSIS

SEQ ID NO: 2669760 - protein, 22 aa, Entamoeba histolytica
APEARYGKKLCFYVNGHVFAAP

SEQ ID NO: 2669761 - protein, 24 aa, Entamoeba histolytica
APEKCKPYAFPVLDVLEKYHLEKK

SEQ ID NO: 2669762 - protein, 18 aa, Entamoeba histolytica
APELLYCVPERVVISDKK

SEQ ID NO: 2669763 - protein, 19 aa, Entamoeba histolytica
APELLYCVPERVVISDKKQ

SEQ ID NO: 2669764 - protein, 19 aa, Entamoeba histolytica
APEPIKLMIDPTRYVIIPR

SEQ ID NO: 2669765 - protein, 19 aa, Entamoeba histolytica
APEPLRFILSVYDSNSREK

SEQ ID NO: 2669766 - protein, 23 aa, Entamoeba histolytica
APFCTASIKTHCFGVDSDKLISN

SEQ ID NO: 2669767 - protein, 17 aa, Entamoeba histolytica
APFNLLICKQTLGEIED

SEQ ID NO: 2669768 - protein, 19 aa, Entamoeba histolytica
APGMVVGGWTSVRVASEII

SEQ ID NO: 2669769 - protein, 26 aa, Entamoeba histolytica
APHSIAHSFALYLGWVKTEAIPSTIY

SEQ ID NO: 2669770 - protein, 33 aa, Entamoeba histolytica
APIGQGNVCYVEFGGPVPPQAPMGIGNNGYMGF

SEQ ID NO: 2669771 - protein, 18 aa, Entamoeba histolytica
APIIPICAQLKYNMDVVC

SEQ ID NO: 2669772 - protein, 29 aa, Entamoeba histolytica
APIMGRRADYMWGLGYRKALMMEKLKMEG

SEQ ID NO: 2669773 - protein, 21 aa, Entamoeba histolytica
APKLMWKVRILQGNIDASVKE

SEQ ID NO: 2669774 - protein, 26 aa, Entamoeba histolytica
APKTRYNCYAHVWDAHLRTELSKPGK

SEQ ID NO: 2669775 - protein, 18 aa, Entamoeba histolytica
APLIKCNLILSQSLNEEC

SEQ ID NO: 2669776 - protein, 21 aa, Entamoeba histolytica
APLLDTWCLFRTEVRKEAIKS

SEQ ID NO: 2669777 - protein, 18 aa, Entamoeba histolytica
APLQAMLFGLQLKPLPTV

SEQ ID NO: 2669778 - protein, 18 aa, Entamoeba histolytica
APLRCLYTTFTDTITSHL

SEQ ID NO: 2669779 - protein, 20 aa, Entamoeba histolytica
APLTYGLYEWLRVCTGAYIM

SEQ ID NO: 2669780 - protein, 42 aa, Entamoeba histolytica
APNRRGLPGFGMEWLEEISLDYGGLCMKDLLTSVDIMKEESY

SEQ ID NO: 2669781 - protein, 20 aa, Entamoeba histolytica
APNYCSRCGNIASIMKVDES

SEQ ID NO: 2669782 - protein, 20 aa, Entamoeba histolytica
APNYCSRCGNIASIMKVNEN

SEQ ID NO: 2669783 - protein, 23 aa, Entamoeba histolytica
APNYCYKCNNLAAIMELSDTGEY

SEQ ID NO: 2669784 - protein, 22 aa, Entamoeba histolytica
APNYCYRCTNDAAIFVIKGENK

SEQ ID NO: 2669785 - protein, 21 aa, Entamoeba histolytica
APPCGTELFSGLRNDKFVAQK

SEQ ID NO: 2669786 - protein, 21 aa, Entamoeba histolytica
APPFTRKCIVATNIAETSITI

SEQ ID NO: 2669787 - protein, 18 aa, Entamoeba histolytica
APPHIFHHFKLYSEGLTF

SEQ ID NO: 2669788 - protein, 17 aa, Entamoeba histolytica
APPLWLSQNSIRPEDIL

SEQ ID NO: 2669789 - protein, 23 aa, Entamoeba histolytica
APQPPAIICREILDTFIKQTKAN

SEQ ID NO: 2669790 - protein, 18 aa, Entamoeba histolytica
APQYLLLQLNRFSIASDH

SEQ ID NO: 2669791 - protein, 20 aa, Entamoeba histolytica
APRGAPRGRGGMMPPTQAPE

SEQ ID NO: 2669792 - protein, 19 aa, Entamoeba histolytica
APRVMKKPIQWYLEHLMGE

SEQ ID NO: 2669793 - protein, 20 aa, Entamoeba histolytica
APSACNYRPIKFMVINRPKL

SEQ ID NO: 2669794 - protein, 17 aa, Entamoeba histolytica
APSEIIIFCPKKHKFTI

SEQ ID NO: 2669795 - protein, 18 aa, Entamoeba histolytica
APSGILALIHHPSFSTEK

SEQ ID NO: 2669796 - protein, 18 aa, Entamoeba histolytica
APSLPTREPILLKEQDRM

SEQ ID NO: 2669797 - protein, 26 aa, Entamoeba histolytica
APTGCGKTLTALLCMLREVKVHQHDM

SEQ ID NO: 2669798 - protein, 17 aa, Entamoeba histolytica
APTGMLARGEYKSNVKF

SEQ ID NO: 2669799 - protein, 19 aa, Entamoeba histolytica
APTVKRIYEELIIPRKKRS

SEQ ID NO: 2669800 - protein, 19 aa, Entamoeba histolytica
APVEIFKPEMKQFHENCQI

SEQ ID NO: 2669801 - protein, 17 aa, Entamoeba histolytica
APVKILMISPKVGVPQL

SEQ ID NO: 2669802 - protein, 21 aa, Entamoeba histolytica
APVTCVNWSLTNNFLFCSGDE

SEQ ID NO: 2669803 - protein, 23 aa, Entamoeba histolytica
APYCLPLIPKTVEWLNTELPPNI

SEQ ID NO: 2669804 - protein, 22 aa, Entamoeba histolytica
AQAVECLRTIKALTGVTFQAQW

SEQ ID NO: 2669805 - protein, 20 aa, Entamoeba histolytica
AQCHPACKAKEISIQIVVDQ

SEQ ID NO: 2669806 - protein, 27 aa, Entamoeba histolytica
AQCKGLNCAFGRWPVKSAQFILKLLKN

SEQ ID NO: 2669807 - protein, 24 aa, Entamoeba histolytica
AQDLAKREGFEFIETSAKSNNNVD

SEQ ID NO: 2669808 - protein, 19 aa, Entamoeba histolytica
AQDPMNWYVCDDACVTNEE

SEQ ID NO: 2669809 - protein, 18 aa, Entamoeba histolytica
AQETLKYVFPSLEKARNE

SEQ ID NO: 2669810 - protein, 23 aa, Entamoeba histolytica
AQEVDEALNISGAIGTARQQINN

SEQ ID NO: 2669811 - protein, 23 aa, Entamoeba histolytica
AQFFPGMAGMGGFEQRSRGPRKG

SEQ ID NO: 2669812 - protein, 32 aa, Entamoeba histolytica
AQFYIPIARECECFGCFGIPLDIAVQRGEWKV

SEQ ID NO: 2669813 - protein, 24 aa, Entamoeba histolytica
AQGDRYRMGNLFIVGPTKTGKTEF

SEQ ID NO: 2669814 - protein, 22 aa, Entamoeba histolytica
AQGFPKVIGCLTHLDKVKNNKL

SEQ ID NO: 2669815 - protein, 26 aa, Entamoeba histolytica
AQGGIVCDIYGNPLCYPSSKKESMRH

SEQ ID NO: 2669816 - protein, 26 aa, Entamoeba histolytica
AQHFSQTRYKGWPKVEEFLNGLENHS

SEQ ID NO: 2669817 - protein, 26 aa, Entamoeba histolytica
AQINLALCYLWGCGVKKSIDDAKKCY

SEQ ID NO: 2669818 - protein, 21 aa, Entamoeba histolytica
AQISSLCRLILSKGYRTTKGF

SEQ ID NO: 2669819 - protein, 28 aa, Entamoeba histolytica
AQITKWTQSCIVLPNFLILPVQRLPRYI

SEQ ID NO: 2669820 - protein, 25 aa, Entamoeba histolytica
AQIVKDLKIVFGIEDDLKCYLRKES

SEQ ID NO: 2669821 - protein, 20 aa, Entamoeba histolytica
AQKMQMGFSQIKSSLQKLPV

SEQ ID NO: 2669822 - protein, 19 aa, Entamoeba histolytica
AQKSFFCGNITMVRETKTT

SEQ ID NO: 2669823 - protein, 19 aa, Entamoeba histolytica
AQKTVRMKKIIMVKKDNKP

SEQ ID NO: 2669824 - protein, 18 aa, Entamoeba histolytica
AQLARIDAVLAMKEPELY

SEQ ID NO: 2669825 - protein, 24 aa, Entamoeba histolytica
AQLKAVCVEAGMIALRREAIEIRH

SEQ ID NO: 2669826 - protein, 23 aa, Entamoeba histolytica
AQLKRGEIPIVFIDKIDQEIIRL

SEQ ID NO: 2669827 - protein, 24 aa, Entamoeba histolytica
AQLSSPNRITCDVRILVLSSQHED

SEQ ID NO: 2669828 - protein, 20 aa, Entamoeba histolytica
AQLVHCLRLVGFDYVFDINS

SEQ ID NO: 2669829 - protein, 21 aa, Entamoeba histolytica
AQNAFSGQVLWDLYNFSSTKK

SEQ ID NO: 2669830 - protein, 19 aa, Entamoeba histolytica
AQNGMLWQRTFFRWLRRWL

SEQ ID NO: 2669831 - protein, 21 aa, Entamoeba histolytica
AQNKNIYFCVFIDQDESLEKV

SEQ ID NO: 2669832 - protein, 24 aa, Entamoeba histolytica
AQNMLRLYMEPDLISGKGKLCKDL

SEQ ID NO: 2669833 - protein, 18 aa, Entamoeba histolytica
AQPSLPQRQPSNSNIQRT

SEQ ID NO: 2669834 - protein, 23 aa, Entamoeba histolytica
AQQLCKLNHAISLPLVKLNLSNL

SEQ ID NO: 2669835 - protein, 19 aa, Entamoeba histolytica
AQQSFLFRILVDNGFTVCL

SEQ ID NO: 2669836 - protein, 17 aa, Entamoeba histolytica
AQRAIDEPIVFREDSSI

SEQ ID NO: 2669837 - protein, 21 aa, Entamoeba histolytica
AQRALGFYIKYVEKGYALLAG

SEQ ID NO: 2669838 - protein, 18 aa, Entamoeba histolytica
AQRLETFQTHLTMPDLQN

SEQ ID NO: 2669839 - protein, 24 aa, Entamoeba histolytica
AQSGRLYALGLIFGGHGKEILTTI

SEQ ID NO: 2669840 - protein, 19 aa, Entamoeba histolytica
AQSIIRGFLYHKRYLTYKA

SEQ ID NO: 2669841 - protein, 23 aa, Entamoeba histolytica
AQSPEVMAQFLIDNNFNILFTLG

SEQ ID NO: 2669842 - protein, 25 aa, Entamoeba histolytica
AQSSRSHSIFMMDLCGRNIGSNEQR

SEQ ID NO: 2669843 - protein, 21 aa, Entamoeba histolytica
AQTCGTCRGKGFRFVQIQQGF

SEQ ID NO: 2669844 - protein, 25 aa, Entamoeba histolytica
AQTLRVYLNYILRCPYFVDHFPVFS

SEQ ID NO: 2669845 - protein, 27 aa, Entamoeba histolytica
AQVKGSALVFCSAFSSFPRDTEFISIL

SEQ ID NO: 2669846 - protein, 18 aa, Entamoeba histolytica
AQVLGIRETDRWYYGGGL

SEQ ID NO: 2669847 - protein, 25 aa, Entamoeba histolytica
AQVLSRLTFTSALAYLRKISSPVEG

SEQ ID NO: 2669848 - protein, 18 aa, Entamoeba histolytica
AQYILPKIINSIHDTPIL

SEQ ID NO: 2669849 - protein, 22 aa, Entamoeba histolytica
ARAAEEKELKERVGREEEARAK

SEQ ID NO: 2669850 - protein, 19 aa, Entamoeba histolytica
ARAATPCIIFIDEIDTVVG

SEQ ID NO: 2669851 - protein, 23 aa, Entamoeba histolytica
ARATFCYAATVALNYSLACGVEQ

SEQ ID NO: 2669852 - protein, 22 aa, Entamoeba histolytica
ARDCSVAVPFVSKGINICVDIV

SEQ ID NO: 2669853 - protein, 18 aa, Entamoeba histolytica
ARDIKRLIHIKGKRNPFA

SEQ ID NO: 2669854 - protein, 18 aa, Entamoeba histolytica
ARDPRLEQNYSLVCIELI

SEQ ID NO: 2669855 - protein, 17 aa, Entamoeba histolytica
AREALGLIVEMVKAKRM

SEQ ID NO: 2669856 - protein, 23 aa, Entamoeba histolytica
AREFLKKPIEIICGGRSQVSNTI

SEQ ID NO: 2669857 - protein, 25 aa, Entamoeba histolytica
AREGKKCQPGWVCDRSGKVLSEPGP

SEQ ID NO: 2669858 - protein, 18 aa, Entamoeba histolytica
ARETKLWVDYFKIELNEE

SEQ ID NO: 2669859 - protein, 25 aa, Entamoeba histolytica
ARFNKEMIVPGYGLRSKKGTGKLIL

SEQ ID NO: 2669860 - protein, 24 aa, Entamoeba histolytica
ARFQLPQSILLSGISIKNEPYNNS

SEQ ID NO: 2669861 - protein, 17 aa, Entamoeba histolytica
ARGGKKTNLSNLVKGSR

SEQ ID NO: 2669862 - protein, 21 aa, Entamoeba histolytica
ARGLIKMGIKKGDNLGFFSRR

SEQ ID NO: 2669863 - protein, 18 aa, Entamoeba histolytica
ARGLKKKDIRLFARAVIP

SEQ ID NO: 2669864 - protein, 22 aa, Entamoeba histolytica
ARGQALLARHGILGCLFKDKFN

SEQ ID NO: 2669865 - protein, 42 aa, Entamoeba histolytica
ARIFRALFELLLIKRWARPALKALELCKSVTRRLFNSQCPLR

SEQ ID NO: 2669866 - protein, 20 aa, Entamoeba histolytica
ARIKNMCQCCLKDIEYNIPY

SEQ ID NO: 2669867 - protein, 18 aa, Entamoeba histolytica
ARILNYYKPNIIAYNTLT

SEQ ID NO: 2669868 - protein, 17 aa, Entamoeba histolytica
ARISSLIAGKSPQQCKA

SEQ ID NO: 2669869 - protein, 17 aa, Entamoeba histolytica
ARITIWIKTNEYTILTN

SEQ ID NO: 2669870 - protein, 23 aa, Entamoeba histolytica
ARIVLKDYCCGKLVYCKPPPGIT

SEQ ID NO: 2669871 - protein, 18 aa, Entamoeba histolytica
ARIYFLLAASYTNYKNIE

SEQ ID NO: 2669872 - protein, 19 aa, Entamoeba histolytica
ARKAFPCFDEPNYKATFDI

SEQ ID NO: 2669873 - protein, 19 aa, Entamoeba histolytica
ARLAASLNQSSPRTKSVQP

SEQ ID NO: 2669874 - protein, 20 aa, Entamoeba histolytica
ARLAKANAYITSYLREQMPT

SEQ ID NO: 2669875 - protein, 21 aa, Entamoeba histolytica
ARLKSIIPQLTFDSHKGACGK

SEQ ID NO: 2669876 - protein, 17 aa, Entamoeba histolytica
ARLLIKYLKNGKIQSLH

SEQ ID NO: 2669877 - protein, 22 aa, Entamoeba histolytica
ARLPIEQHIECIGRKVLTVNQV

SEQ ID NO: 2669878 - protein, 17 aa, Entamoeba histolytica
ARLQKMKKLESDAAKGG

SEQ ID NO: 2669879 - protein, 19 aa, Entamoeba histolytica
ARMQCVIDALLVPENRVSW

SEQ ID NO: 2669880 - protein, 18 aa, Entamoeba histolytica
ARNFLVFQGDVIQVASKS

SEQ ID NO: 2669881 - protein, 19 aa, Entamoeba histolytica
ARNIHCIDSTFIITKDYFS

SEQ ID NO: 2669882 - protein, 22 aa, Entamoeba histolytica
ARNILPYISVFLVDDHKNVRNK

SEQ ID NO: 2669883 - protein, 19 aa, Entamoeba histolytica
ARNLFLLLREVFFVHSPPK

SEQ ID NO: 2669884 - protein, 29 aa, Entamoeba histolytica
ARNTFLTLFFLRYCFRPFSKVPSVLKILH

SEQ ID NO: 2669885 - protein, 25 aa, Entamoeba histolytica
ARPIMSSLLVCYTKYLNSVSKGWKQ

SEQ ID NO: 2669886 - protein, 20 aa, Entamoeba histolytica
ARPIPKLNIPPLEVQQNENI

SEQ ID NO: 2669887 - protein, 19 aa, Entamoeba histolytica
ARPIPQQQIHFDNLSSNSS

SEQ ID NO: 2669888 - protein, 20 aa, Entamoeba histolytica
ARPIPTISFQILDMRPRSIP

SEQ ID NO: 2669889 - protein, 22 aa, Entamoeba histolytica
ARPKNGRSLNIFQRRTNCTVLV

SEQ ID NO: 2669890 - protein, 25 aa, Entamoeba histolytica
ARPTECLPKVLPFPGHIETKGIVQF

SEQ ID NO: 2669891 - protein, 20 aa, Entamoeba histolytica
ARQFTTKKGIPFFETSALQR

SEQ ID NO: 2669892 - protein, 18 aa, Entamoeba histolytica
ARQLTLIASKIFNKIGRQ

SEQ ID NO: 2669893 - protein, 18 aa, Entamoeba histolytica
ARQMIFDRFLQIKDVTKL

SEQ ID NO: 2669894 - protein, 25 aa, Entamoeba histolytica
ARQSALRILHCLNSNFNENLLQEFI

SEQ ID NO: 2669895 - protein, 23 aa, Entamoeba histolytica
ARRFCNKENVFAYVIGIFPNEES

SEQ ID NO: 2669896 - protein, 20 aa, Entamoeba histolytica
ARRIKCRFYIETSALHKEGI

SEQ ID NO: 2669897 - protein, 25 aa, Entamoeba histolytica
ARRKAGKKILKIQCGMGHHNTVGYS

SEQ ID NO: 2669898 - protein, 19 aa, Entamoeba histolytica
ARRLAVGLLNGFDQPIKSI

SEQ ID NO: 2669899 - protein, 23 aa, Entamoeba histolytica
ARSALNTLEKVFVHFNLMSEKVL

SEQ ID NO: 2669900 - protein, 17 aa, Entamoeba histolytica
ARSLSVYRYRNDIEHLD

SEQ ID NO: 2669901 - protein, 19 aa, Entamoeba histolytica
ARSLVQYEPFFGEFAIYEV

SEQ ID NO: 2669902 - protein, 24 aa, Entamoeba histolytica
ARTKKQCVKSIIAHNCDVNVVNWN

SEQ ID NO: 2669903 - protein, 17 aa, Entamoeba histolytica
ARVDRFPEEPVFGYRHK

SEQ ID NO: 2669904 - protein, 26 aa, Entamoeba histolytica
ARVILFFFDLTRVMTLNNIKDWYKEA

SEQ ID NO: 2669905 - protein, 18 aa, Entamoeba histolytica
ARVLEPYSSIELSHVSKL

SEQ ID NO: 2669906 - protein, 20 aa, Entamoeba histolytica
ARVMKLCVHPNVVEFHDYFE

SEQ ID NO: 2669907 - protein, 21 aa, Entamoeba histolytica
ARVVAVEGFGRIIANQPLCCK

SEQ ID NO: 2669908 - protein, 21 aa, Entamoeba histolytica
ARYVKELYLKKNIHDTSPKQF

SEQ ID NO: 2669909 - protein, 21 aa, Entamoeba histolytica
ASAAGFFACQGRFVFEENHPT

SEQ ID NO: 2669910 - protein, 17 aa, Entamoeba histolytica
ASAEVSRPNVLLESLEK

SEQ ID NO: 2669911 - protein, 18 aa, Entamoeba histolytica
ASAEVSRPNVLLESLEKR

SEQ ID NO: 2669912 - protein, 19 aa, Entamoeba histolytica
ASAEWWKESICLSCAIHAP

SEQ ID NO: 2669913 - protein, 25 aa, Entamoeba histolytica
ASAKTCGVVFGMLKQLERFRDKENT

SEQ ID NO: 2669914 - protein, 20 aa, Entamoeba histolytica
ASALKQLYKKFGYSNDNPKV

SEQ ID NO: 2669915 - protein, 19 aa, Entamoeba histolytica
ASAQNVFKEMFKTKGQYQE

SEQ ID NO: 2669916 - protein, 17 aa, Entamoeba histolytica
ASCLMKMTPFEKQYWNI

SEQ ID NO: 2669917 - protein, 34 aa, Entamoeba histolytica
ASCLVKLPLILPFIKKKMHYRILGLNAIPHENEL

SEQ ID NO: 2669918 - protein, 24 aa, Entamoeba histolytica
ASDEFKGKCVLAINSKDKKGDRRY

SEQ ID NO: 2669919 - protein, 34 aa, Entamoeba histolytica
ASDIWSCGVMLYNMLFLFPFKKPKNMYELQITDD

SEQ ID NO: 2669920 - protein, 21 aa, Entamoeba histolytica
ASDYCSFKIFNYLVSNPHFPE

SEQ ID NO: 2669921 - protein, 17 aa, Entamoeba histolytica
ASESILTFNCFDWDNAF

SEQ ID NO: 2669922 - protein, 24 aa, Entamoeba histolytica
ASFGCIRVGGWINKYNSLVSTITP

SEQ ID NO: 2669923 - protein, 19 aa, Entamoeba histolytica
ASFKISRLLRMNDLAQIST

SEQ ID NO: 2669924 - protein, 24 aa, Entamoeba histolytica
ASFKTQIATIIIFKGYSKENFGYI

SEQ ID NO: 2669925 - protein, 19 aa, Entamoeba histolytica
ASFLERHVDKFIKGERKFV

SEQ ID NO: 2669926 - protein, 23 aa, Entamoeba histolytica
ASFPSLRCWDKFDSPAFVCSKIR

SEQ ID NO: 2669927 - protein, 17 aa, Entamoeba histolytica
ASFYERAGMVECLGSPK

SEQ ID NO: 2669928 - protein, 23 aa, Entamoeba histolytica
ASGDEKGSVILWDIKYGEHVKKI

SEQ ID NO: 2669929 - protein, 23 aa, Entamoeba histolytica
ASGDKYRMGNLFIVGPTKTGKTE

SEQ ID NO: 2669930 - protein, 18 aa, Entamoeba histolytica
ASGISTPTGSAVTTQEGN

SEQ ID NO: 2669931 - protein, 20 aa, Entamoeba histolytica
ASGKLGYPHRGFPEKFIERV

SEQ ID NO: 2669932 - protein, 17 aa, Entamoeba histolytica
ASGKTCLYNIWRGLNIP

SEQ ID NO: 2669933 - protein, 31 aa, Entamoeba histolytica
ASGKYTPYCQYMFYDCLEILPDNYLELPKEE

SEQ ID NO: 2669934 - protein, 24 aa, Entamoeba histolytica
ASGLMAKERYGLLIIDSATALYRT

SEQ ID NO: 2669935 - protein, 23 aa, Entamoeba histolytica
ASGNKYRMGNLFIVGPTKTGKTE

SEQ ID NO: 2669936 - protein, 19 aa, Entamoeba histolytica
ASGNYAWNAGIFLWTAKTI

SEQ ID NO: 2669937 - protein, 24 aa, Entamoeba histolytica
ASGTRPCLYVPQSAFENLISKQVR

SEQ ID NO: 2669938 - protein, 19 aa, Entamoeba histolytica
ASHALRWGVPVLSHQWLFD

SEQ ID NO: 2669939 - protein, 19 aa, Entamoeba histolytica
ASHVSELFSGVLDSLDMKF

SEQ ID NO: 2669940 - protein, 24 aa, Entamoeba histolytica
ASIFPKVKLSNFALCDQIENSIIP

SEQ ID NO: 2669941 - protein, 25 aa, Entamoeba histolytica
ASIFPKVKLSNFGLCDQFEQTIPNE

SEQ ID NO: 2669942 - protein, 25 aa, Entamoeba histolytica
ASIKDWLSVLAEIFKANIVAWEYPG

SEQ ID NO: 2669943 - protein, 18 aa, Entamoeba histolytica
ASIKGHFFIDHGVGVVIG

SEQ ID NO: 2669944 - protein, 19 aa, Entamoeba histolytica
ASIKGHFFIDHGVGVVIGE

SEQ ID NO: 2669945 - protein, 19 aa, Entamoeba histolytica
ASIPSMLKSDVCRLKRCVT

SEQ ID NO: 2669946 - protein, 32 aa, Entamoeba histolytica
ASIVSKCFFLKVGKTFIKRYFSKYFSQLLAEK

SEQ ID NO: 2669947 - protein, 20 aa, Entamoeba histolytica
ASIVSLREARFWGIFIGDLM

SEQ ID NO: 2669948 - protein, 17 aa, Entamoeba histolytica
ASKEFNDPAPVFNMPRD

SEQ ID NO: 2669949 - protein, 27 aa, Entamoeba histolytica
ASKEGKRVVGVLLGFIRKGIVDVMNSF

SEQ ID NO: 2669950 - protein, 19 aa, Entamoeba histolytica
ASKHCKTVEHHAMSVYADA

SEQ ID NO: 2669951 - protein, 25 aa, Entamoeba histolytica
ASKIDFKCIIYGKGFHVGITCDYAS

SEQ ID NO: 2669952 - protein, 21 aa, Entamoeba histolytica
ASKKLGVSISHCIVFEDTISG

SEQ ID NO: 2669953 - protein, 19 aa, Entamoeba histolytica
ASKLTRWNLIFEETKEFIN

SEQ ID NO: 2669954 - protein, 23 aa, Entamoeba histolytica
ASLARKLGAFFIETSCLNGSNVD

SEQ ID NO: 2669955 - protein, 17 aa, Entamoeba histolytica
ASLERRTLTSFKLLLSS

SEQ ID NO: 2669956 - protein, 22 aa, Entamoeba histolytica
ASLEVVESLAALTKGKKKEEPK

SEQ ID NO: 2669957 - protein, 17 aa, Entamoeba histolytica
ASLFSVHNTIGILPIQI

SEQ ID NO: 2669958 - protein, 18 aa, Entamoeba histolytica
ASLGEFSFEEKIRRDIKK

SEQ ID NO: 2669959 - protein, 18 aa, Entamoeba histolytica
ASLINGEEIIDCIYNTAN

SEQ ID NO: 2669960 - protein, 29 aa, Entamoeba histolytica
ASLKHFNNLCLRFHFFQSILNKVIVNSDG

SEQ ID NO: 2669961 - protein, 18 aa, Entamoeba histolytica
ASLLKKFLIQSNVSVTSR

SEQ ID NO: 2669962 - protein, 19 aa, Entamoeba histolytica
ASLLVKWDNVKEVSEMFKK

SEQ ID NO: 2669963 - protein, 18 aa, Entamoeba histolytica
ASLPYLILERQFKGKVLM

SEQ ID NO: 2669964 - protein, 18 aa, Entamoeba histolytica
ASLVIQKLPPGQMATNEL

SEQ ID NO: 2669965 - protein, 20 aa, Entamoeba histolytica
ASLVLGFIWMLFDKFQEKDI

SEQ ID NO: 2669966 - protein, 18 aa, Entamoeba histolytica
ASLYAGKGDLEFNDPIPK

SEQ ID NO: 2669967 - protein, 18 aa, Entamoeba histolytica
ASNFFLAEGILLPENIKI

SEQ ID NO: 2669968 - protein, 19 aa, Entamoeba histolytica
ASNKKAQWNTFTIDIKNGI

SEQ ID NO: 2669969 - protein, 20 aa, Entamoeba histolytica
ASPAGYRTATRLMLLAEQFA

SEQ ID NO: 2669970 - protein, 25 aa, Entamoeba histolytica
ASQARKGDCQIAIIGDEDSVTGFLL

SEQ ID NO: 2669971 - protein, 20 aa, Entamoeba histolytica
ASQCSLPIIASGGIRNGLEI

SEQ ID NO: 2669972 - protein, 24 aa, Entamoeba histolytica
ASQIECYGEFPLYYTKTSVPLCID

SEQ ID NO: 2669973 - protein, 19 aa, Entamoeba histolytica
ASQKYIFGNIIDLFGKDVK

SEQ ID NO: 2669974 - protein, 19 aa, Entamoeba histolytica
ASQKYIFGNIVDLFGKDVK

SEQ ID NO: 2669975 - protein, 19 aa, Entamoeba histolytica
ASQLYKLIASILHLEPTDI

SEQ ID NO: 2669976 - protein, 23 aa, Entamoeba histolytica
ASQMLELELGLLILKIGLNGTKT

SEQ ID NO: 2669977 - protein, 26 aa, Entamoeba histolytica
ASQNAEFKRLTLLMTNLPNKRLRDVS

SEQ ID NO: 2669978 - protein, 18 aa, Entamoeba histolytica
ASRGWLDSKRPCMLTIEN

SEQ ID NO: 2669979 - protein, 26 aa, Entamoeba histolytica
ASRLIKRSMDAIAFGKLLEVAEKASI

SEQ ID NO: 2669980 - protein, 21 aa, Entamoeba histolytica
ASRLPLVVDVNHMMTHLIECA

SEQ ID NO: 2669981 - protein, 22 aa, Entamoeba histolytica
ASRLSWREFFAHQFVYRAMQHH

SEQ ID NO: 2669982 - protein, 18 aa, Entamoeba histolytica
ASSCQRSRSHSKPSSTSN

SEQ ID NO: 2669983 - protein, 20 aa, Entamoeba histolytica
ASSFPQLLFCDIQDCFSEFC

SEQ ID NO: 2669984 - protein, 23 aa, Entamoeba histolytica
ASSIKPHLVSMVFCCSTCKANKE

SEQ ID NO: 2669985 - protein, 24 aa, Entamoeba histolytica
ASSKEPSCISSLPLSKSSGDFIEV

SEQ ID NO: 2669986 - protein, 19 aa, Entamoeba histolytica
ASSMKRLSQMINEKEVSQK

SEQ ID NO: 2669987 - protein, 24 aa, Entamoeba histolytica
ASSRRYKKWLPFILAVLDAEKKTF

SEQ ID NO: 2669988 - protein, 20 aa, Entamoeba histolytica
ASSVSYLFNRYCITQLEIKG

SEQ ID NO: 2669989 - protein, 23 aa, Entamoeba histolytica
ASTLQCNFIRIGIDDYSISDTLT

SEQ ID NO: 2669990 - protein, 21 aa, Entamoeba histolytica
ASTTRLYLRKGKGEQRIVKIY

SEQ ID NO: 2669991 - protein, 28 aa, Entamoeba histolytica
ASVYHCKVILRFVFNLIQIAFTSQHKLL

SEQ ID NO: 2669992 - protein, 17 aa, Entamoeba histolytica
ATAECFENILFPTEVWT

SEQ ID NO: 2669993 - protein, 25 aa, Entamoeba histolytica
ATAICVLHPSKFVIDRLVEELKVPK

SEQ ID NO: 2669994 - protein, 26 aa, Entamoeba histolytica
ATAIELPHSLSFLGKTAFIDCTNLQS

SEQ ID NO: 2669995 - protein, 17 aa, Entamoeba histolytica
ATASRLRTMKFDPKGEL

SEQ ID NO: 2669996 - protein, 19 aa, Entamoeba histolytica
ATCDLRPTIPPSTPQKMAT

SEQ ID NO: 2669997 - protein, 27 aa, Entamoeba histolytica
ATCFYPFLNSDVIRFIRNIPEDFLVKL

SEQ ID NO: 2669998 - protein, 23 aa, Entamoeba histolytica
ATCKICESFVGIALDYITKGETV

SEQ ID NO: 2669999 - protein, 17 aa, Entamoeba histolytica
ATCLNEKYIKENVLNTR

SEQ ID NO: 2670000 - protein, 29 aa, Entamoeba histolytica
ATCSSIDVIVPWTHLYSKPIILRLGEVIV

SEQ ID NO: 2670001 - protein, 19 aa, Entamoeba histolytica
ATDICYIYEWFVEKKQSIP

SEQ ID NO: 2670002 - protein, 21 aa, Entamoeba histolytica
ATDIHSLFDFPKPRQLDFLPY

SEQ ID NO: 2670003 - protein, 18 aa, Entamoeba histolytica
ATEFYLLLLDHLHEAIIG

SEQ ID NO: 2670004 - protein, 18 aa, Entamoeba histolytica
ATELLVKAVNAISGLKEE

SEQ ID NO: 2670005 - protein, 24 aa, Entamoeba histolytica
ATFIALADGCGWGDKPSFAAKLAV

SEQ ID NO: 2670006 - protein, 24 aa, Entamoeba histolytica
ATFTQEFHKIYGLNNLETNIPLQI

SEQ ID NO: 2670007 - protein, 20 aa, Entamoeba histolytica
ATGCGDGIVRLFKIGVTIDE

SEQ ID NO: 2670008 - protein, 20 aa, Entamoeba histolytica
ATIHYVFVVTLILANKKQYH

SEQ ID NO: 2670009 - protein, 18 aa, Entamoeba histolytica
ATILHIFNGSSFTRLFSE

SEQ ID NO: 2670010 - protein, 20 aa, Entamoeba histolytica
ATILLPLIVASTFAQKEEPT

SEQ ID NO: 2670011 - protein, 23 aa, Entamoeba histolytica
ATILRIVKEYVDNGSVLSSDQIS

SEQ ID NO: 2670012 - protein, 18 aa, Entamoeba histolytica
ATIPHLRLSDIDKKGQDF

SEQ ID NO: 2670013 - protein, 25 aa, Entamoeba histolytica
ATIPNAFEFASWIANIHKQACHVVY

SEQ ID NO: 2670014 - protein, 25 aa, Entamoeba histolytica
ATIQYRAKTFLPYYIQPLLSLIPVD

SEQ ID NO: 2670015 - protein, 17 aa, Entamoeba histolytica
ATIWIPCLFEIPQESPV

SEQ ID NO: 2670016 - protein, 24 aa, Entamoeba histolytica
ATKALPFLQIRSINFGNGDVFNFN

SEQ ID NO: 2670017 - protein, 23 aa, Entamoeba histolytica
ATKGGAEAITTVPADTAQQSTPT

SEQ ID NO: 2670018 - protein, 19 aa, Entamoeba histolytica
ATKIVCLRIFNDLFETFIE

SEQ ID NO: 2670019 - protein, 30 aa, Entamoeba histolytica
ATKRIRIGKFPKYLLIKLERQIALSYEDVR

SEQ ID NO: 2670020 - protein, 21 aa, Entamoeba histolytica
ATLCRNKLKQVYGSCHGNIND

SEQ ID NO: 2670021 - protein, 22 aa, Entamoeba histolytica
ATLFQRLCSLEIPIMLKVQYRC

SEQ ID NO: 2670022 - protein, 24 aa, Entamoeba histolytica
ATLHAFSHWSWCISNHQLIIVDLQ

SEQ ID NO: 2670023 - protein, 24 aa, Entamoeba histolytica
ATLKFLRPCEIEALKYTCEIPFVH

SEQ ID NO: 2670024 - protein, 17 aa, Entamoeba histolytica
ATLSLAEMIAAKQGKLK

SEQ ID NO: 2670025 - protein, 22 aa, Entamoeba histolytica
ATLVPTVKCLINISDAPYKVIE

SEQ ID NO: 2670026 - protein, 18 aa, Entamoeba histolytica
ATLVWKKVIINAGRALSD

SEQ ID NO: 2670027 - protein, 19 aa, Entamoeba histolytica
ATMPKELNKFVIAGCRNPY

SEQ ID NO: 2670028 - protein, 24 aa, Entamoeba histolytica
ATNECVLCPVCIEEGIPDVGEMLV

SEQ ID NO: 2670029 - protein, 25 aa, Entamoeba histolytica
ATNIEGADLFAVFDGHNGHEAATLC

SEQ ID NO: 2670030 - protein, 27 aa, Entamoeba histolytica
ATPDEYRRLFFYLISFLKKLIEMGEDK

SEQ ID NO: 2670031 - protein, 22 aa, Entamoeba histolytica
ATPTSKCLRLFGTHKDGLIRPF

SEQ ID NO: 2670032 - protein, 18 aa, Entamoeba histolytica
ATQKFGFPPIPNPILNIF

SEQ ID NO: 2670033 - protein, 18 aa, Entamoeba histolytica
ATQTSLRFTLQMLTPTSI

SEQ ID NO: 2670034 - protein, 23 aa, Entamoeba histolytica
ATRHPQMFPGFLEMLIEYKKQGG

SEQ ID NO: 2670035 - protein, 24 aa, Entamoeba histolytica
ATRLLKKLTCEWVKEDLNKHSLLE

SEQ ID NO: 2670036 - protein, 25 aa, Entamoeba histolytica
ATRVAKSFLAKVGRKYLLDIYKPFV

SEQ ID NO: 2670037 - protein, 24 aa, Entamoeba histolytica
ATSISLMPSFRSLEWNHMYITFET

SEQ ID NO: 2670038 - protein, 23 aa, Entamoeba histolytica
ATSLKIPYVLVGQRVVDKYLNLL

SEQ ID NO: 2670039 - protein, 18 aa, Entamoeba histolytica
ATSLKNLILEGGNKTDQQ

SEQ ID NO: 2670040 - protein, 25 aa, Entamoeba histolytica
ATSYFPFSGAHGIFLVYRNDDDMSF

SEQ ID NO: 2670041 - protein, 17 aa, Entamoeba histolytica
ATTLFLSRNRTFTRLIT

SEQ ID NO: 2670042 - protein, 18 aa, Entamoeba histolytica
ATTLVGTLFKLRLKVLVA

SEQ ID NO: 2670043 - protein, 29 aa, Entamoeba histolytica
ATTSMPPLYQARVLFDFESKNGECLNVKT

SEQ ID NO: 2670044 - protein, 19 aa, Entamoeba histolytica
ATVLFPKEEAGAFYNPVQE

SEQ ID NO: 2670045 - protein, 23 aa, Entamoeba histolytica
ATVLYLGCEIVKIAYVGDCSVYL

SEQ ID NO: 2670046 - protein, 17 aa, Entamoeba histolytica
ATVTRFGLYCFKDCKHL

SEQ ID NO: 2670047 - protein, 29 aa, Entamoeba histolytica
ATWKKPQEWNHKCVMCVSKMGKFSSDRSM

SEQ ID NO: 2670048 - protein, 21 aa, Entamoeba histolytica
ATYFVCGSAEQFIRSYNSESG

SEQ ID NO: 2670049 - protein, 21 aa, Entamoeba histolytica
ATYNILFEYIRNIALSTKNCN

SEQ ID NO: 2670050 - protein, 20 aa, Entamoeba histolytica
ATYVPRYYVPALKDKNGNAA

SEQ ID NO: 2670051 - protein, 27 aa, Entamoeba histolytica
AVAHSCTKLGIRFIVIRSLSDVPSEDG

SEQ ID NO: 2670052 - protein, 17 aa, Entamoeba histolytica
AVAYYKSKLDELLRTVV

SEQ ID NO: 2670053 - protein, 19 aa, Entamoeba histolytica
AVCEMVPCHFEILRMELID

SEQ ID NO: 2670054 - protein, 20 aa, Entamoeba histolytica
AVCKELKNVFGEVMSTIETK

SEQ ID NO: 2670055 - protein, 26 aa, Entamoeba histolytica
AVCNKGTYVNGWKRMPAIEEVTEFGH

SEQ ID NO: 2670056 - protein, 18 aa, Entamoeba histolytica
AVDGFVIDSAITKIKGNV

SEQ ID NO: 2670057 - protein, 24 aa, Entamoeba histolytica
AVDKLKELFGLNVINGSDDAKKAV

SEQ ID NO: 2670058 - protein, 18 aa, Entamoeba histolytica
AVDLLMKVYREFLPHGGY

SEQ ID NO: 2670059 - protein, 24 aa, Entamoeba histolytica
AVDRCCSQGLPPVIPEQIIEMMDL

SEQ ID NO: 2670060 - protein, 23 aa, Entamoeba histolytica
AVECCSKAGIIHCDVKPENILMT

SEQ ID NO: 2670061 - protein, 21 aa, Entamoeba histolytica
AVECEGCRLYYPKCYQEEHEK

SEQ ID NO: 2670062 - protein, 19 aa, Entamoeba histolytica
AVEFFGEYEDAIPLISDMK

SEQ ID NO: 2670063 - protein, 21 aa, Entamoeba histolytica
AVEIKKAPKHIGFKGEGDDDD

SEQ ID NO: 2670064 - protein, 19 aa, Entamoeba histolytica
AVELYSFYNSLPIVKTQTL

SEQ ID NO: 2670065 - protein, 18 aa, Entamoeba histolytica
AVENCIKKSTLASFVVRT

SEQ ID NO: 2670066 - protein, 22 aa, Entamoeba histolytica
AVESFSFLLTHFDEMFCEIEKR

SEQ ID NO: 2670067 - protein, 21 aa, Entamoeba histolytica
AVESIYNYLYDKGFTVPGIFR

SEQ ID NO: 2670068 - protein, 17 aa, Entamoeba histolytica
AVFPDRKGIVYGGADGR

SEQ ID NO: 2670069 - protein, 25 aa, Entamoeba histolytica
AVFVSCSLIKFGVSIENALEYGIKH

SEQ ID NO: 2670070 - protein, 21 aa, Entamoeba histolytica
AVGCACPPPPPGNSSIVMGQE

SEQ ID NO: 2670071 - protein, 18 aa, Entamoeba histolytica
AVGKTCLLVSYTTNAFPT

SEQ ID NO: 2670072 - protein, 25 aa, Entamoeba histolytica
AVGRGRLHEMFYFRGNYESPIYYDK

SEQ ID NO: 2670073 - protein, 27 aa, Entamoeba histolytica
AVICLNCGDTICEKCLEKGICPSCNEE

SEQ ID NO: 2670074 - protein, 19 aa, Entamoeba histolytica
AVIKKELASIRFLKEDYCT

SEQ ID NO: 2670075 - protein, 24 aa, Entamoeba histolytica
AVIKSGYMLLKYVNEKKIQFDRKY

SEQ ID NO: 2670076 - protein, 20 aa, Entamoeba histolytica
AVILLKRYGINEMFRSSFDD

SEQ ID NO: 2670077 - protein, 19 aa, Entamoeba histolytica
AVINLCKDFHSVNMMTYKE

SEQ ID NO: 2670078 - protein, 17 aa, Entamoeba histolytica
AVIPTQKYFAGSRPTFA

SEQ ID NO: 2670079 - protein, 18 aa, Entamoeba histolytica
AVIREFFTKMGLPDVRFK

SEQ ID NO: 2670080 - protein, 17 aa, Entamoeba histolytica
AVIRVLIKHGADVNVQT

SEQ ID NO: 2670081 - protein, 18 aa, Entamoeba histolytica
AVKEGKCDQSVLDQLTAT

SEQ ID NO: 2670082 - protein, 29 aa, Entamoeba histolytica
AVKKSSWRFPIPVFRSLQYLLTHEGKELE

SEQ ID NO: 2670083 - protein, 27 aa, Entamoeba histolytica
AVKQNCCEESLPLLKYILEDAIQGNEN

SEQ ID NO: 2670084 - protein, 22 aa, Entamoeba histolytica
AVKREYLIYSWIFINTLDEKPF

SEQ ID NO: 2670085 - protein, 17 aa, Entamoeba histolytica
AVKSAVCKVNIDSDGRL

SEQ ID NO: 2670086 - protein, 39 aa, Entamoeba histolytica
AVKTMIEIICNIFPIYDFWKHVCVVWTMCYNYTPLKKLK

SEQ ID NO: 2670087 - protein, 21 aa, Entamoeba histolytica
AVLCQCTICRKVRFFTTEKPK

SEQ ID NO: 2670088 - protein, 17 aa, Entamoeba histolytica
AVLFKKELSAMKLSTTQ

SEQ ID NO: 2670089 - protein, 17 aa, Entamoeba histolytica
AVLKEYISHLFSQIRTY

SEQ ID NO: 2670090 - protein, 25 aa, Entamoeba histolytica
AVLRMFYQICHAVAFMHSQNPPLCH

SEQ ID NO: 2670091 - protein, 19 aa, Entamoeba histolytica
AVMKRLSVMWKNLSDKERE

SEQ ID NO: 2670092 - protein, 19 aa, Entamoeba histolytica
AVNEIGGFLAVASGNELEL

SEQ ID NO: 2670093 - protein, 20 aa, Entamoeba histolytica
AVNMSGHIIAFVAGPCTEGP

SEQ ID NO: 2670094 - protein, 17 aa, Entamoeba histolytica
AVPQHSCEIPITGETVK

SEQ ID NO: 2670095 - protein, 17 aa, Entamoeba histolytica
AVSLLLYYLVFNLPINK

SEQ ID NO: 2670096 - protein, 28 aa, Entamoeba histolytica
AVSRAYYPGARWGITRRSFASSLQEKSI

SEQ ID NO: 2670097 - protein, 24 aa, Entamoeba histolytica
AVTPLLIKMFLKYQLKCSSIQEAI

SEQ ID NO: 2670098 - protein, 24 aa, Entamoeba histolytica
AVVECPYWLAPEVINGEPFTQKSD

SEQ ID NO: 2670099 - protein, 19 aa, Entamoeba histolytica
AVVGLGFHKAAITGLAVTR

SEQ ID NO: 2670100 - protein, 19 aa, Entamoeba histolytica
AVVQDIMLGNAMGKKRRQG

SEQ ID NO: 2670101 - protein, 18 aa, Entamoeba histolytica
AVVSLLFELLDRLEKMQQ

SEQ ID NO: 2670102 - protein, 26 aa, Entamoeba histolytica
AVYCLKKCQKGIVAFINRNVHVIEKK

SEQ ID NO: 2670103 - protein, 21 aa, Entamoeba histolytica
AVYIRIGFQQTFTSLEVKKVE

SEQ ID NO: 2670104 - protein, 24 aa, Entamoeba histolytica
AVYKLLENIPMPWEEIKMVDVMYH

SEQ ID NO: 2670105 - protein, 17 aa, Entamoeba histolytica
AVYVVADGCGWGVASCK

SEQ ID NO: 2670106 - protein, 23 aa, Entamoeba histolytica
AWENWPPHVVTFFKKMSADWDAE

SEQ ID NO: 2670107 - protein, 18 aa, Entamoeba histolytica
AWGTEFGRLKKKVFVFEL

SEQ ID NO: 2670108 - protein, 17 aa, Entamoeba histolytica
AWIGCGAIILPGVTIGE

SEQ ID NO: 2670109 - protein, 21 aa, Entamoeba histolytica
AWIGCGAKILPGVRIGKNAVV

SEQ ID NO: 2670110 - protein, 18 aa, Entamoeba histolytica
AWKNYPSLIPQIVQDICI

SEQ ID NO: 2670111 - protein, 25 aa, Entamoeba histolytica
AWNVLPAELFMKLFRQDIAVASLFR

SEQ ID NO: 2670112 - protein, 22 aa, Entamoeba histolytica
AYAKEFLMNYLLASLKPSLEEL

SEQ ID NO: 2670113 - protein, 17 aa, Entamoeba histolytica
AYCIPRLTENASNKLSN

SEQ ID NO: 2670114 - protein, 17 aa, Entamoeba histolytica
AYCKMQVTIAGSDDHLF

SEQ ID NO: 2670115 - protein, 36 aa, Entamoeba histolytica; identical to SEQ ID NO: 2475628

SEQ ID NO: 2670116 - protein, 27 aa, Entamoeba histolytica
AYCQVGYRFGYVPIKYLEKVNLAKELG

SEQ ID NO: 2670117 - protein, 23 aa, Entamoeba histolytica
AYDLNFRKKLFLKLEEITGIKYP

SEQ ID NO: 2670118 - protein, 24 aa, Entamoeba histolytica
AYDSYRRFVSLFGKIALNVDDEVY

SEQ ID NO: 2670119 - protein, 25 aa, Entamoeba histolytica
AYDSYRRFVSLFGKIALNVDDEVYD

SEQ ID NO: 2670120 - protein, 23 aa, Entamoeba histolytica
AYDYRCLIGMGISGYAAAIYLEN

SEQ ID NO: 2670121 - protein, 20 aa, Entamoeba histolytica
AYEKIPHIIFHFNEITPKEK

SEQ ID NO: 2670122 - protein, 24 aa, Entamoeba histolytica
AYERGEIPWSEYMKEREKYILDND

SEQ ID NO: 2670123 - protein, 24 aa, Entamoeba histolytica
AYESCNACACFSAIVNESLARDLA

SEQ ID NO: 2670124 - protein, 24 aa, Entamoeba histolytica
AYHFKRYPITPSFITIERNDLQEI

SEQ ID NO: 2670125 - protein, 20 aa, Entamoeba histolytica
AYHPLCFEGVTGLEKEITYT

SEQ ID NO: 2670126 - protein, 18 aa, Entamoeba histolytica
AYHSGVCIFGREYSFSDG

SEQ ID NO: 2670127 - protein, 22 aa, Entamoeba histolytica
AYKEINLQGAVVMATVFYEKEN

SEQ ID NO: 2670128 - protein, 18 aa, Entamoeba histolytica
AYKKMAIKYHPDKNPGDT

SEQ ID NO: 2670129 - protein, 27 aa, Entamoeba histolytica
AYKMLHELSLEWSCLSFDIIPDTLGAL

SEQ ID NO: 2670130 - protein, 26 aa, Entamoeba histolytica
AYKVIKRIDAFEIINSIIPSYSSGLF

SEQ ID NO: 2670131 - protein, 19 aa, Entamoeba histolytica
AYLDGCTYVEFRFAPIQST

SEQ ID NO: 2670132 - protein, 18 aa, Entamoeba histolytica
AYLKSVSLKGYMNTVQNF

SEQ ID NO: 2670133 - protein, 23 aa, Entamoeba histolytica
AYLSRTGYVDVVICEDSDMIPYG

SEQ ID NO: 2670134 - protein, 18 aa, Entamoeba histolytica
AYMKRVLSTMSYNKQVII

SEQ ID NO: 2670135 - protein, 18 aa, Entamoeba histolytica
AYNICYSTCLGYVDDINI

SEQ ID NO: 2670136 - protein, 17 aa, Entamoeba histolytica
AYPDLTMDIFGKKVEPI

SEQ ID NO: 2670137 - protein, 23 aa, Entamoeba histolytica
AYPFCLPVPLSLPKKNYNKLFEH

SEQ ID NO: 2670138 - protein, 23 aa, Entamoeba histolytica
AYPHKKCMTKSRIVKLDNVGKAV

SEQ ID NO: 2670139 - protein, 20 aa, Entamoeba histolytica
AYPINFFNFFQMFNPNVIVP

SEQ ID NO: 2670140 - protein, 18 aa, Entamoeba histolytica
AYQNMGMVFSKQYDDLNS

SEQ ID NO: 2670141 - protein, 17 aa, Entamoeba histolytica
AYRKLAIKYHPDKNPGN

SEQ ID NO: 2670142 - protein, 17 aa, Entamoeba histolytica
AYSIGFAAMLTGRYVCY

SEQ ID NO: 2670143 - protein, 23 aa, Entamoeba histolytica
AYYADGFGEIFSLVKGNQYIGTS

SEQ ID NO: 2670144 - protein, 17 aa, Entamoeba histolytica
AYYTLFVKPVFEIYQKT

SEQ ID NO: 2670145 - protein, 22 aa, Entamoeba histolytica
AYYTLFVKPVFEIYQKTSKIRD

SEQ ID NO: 2670146 - protein, 21 aa, Entamoeba histolytica
CAACFKRIIEHSIYPYEYFHQ

SEQ ID NO: 2670147 - protein, 17 aa, Entamoeba histolytica
CAAKGTVLILGKEKHFL

SEQ ID NO: 2670148 - protein, 20 aa, Entamoeba histolytica
CAAMLKISLSCEGVRRKLSK

SEQ ID NO: 2670149 - protein, 21 aa, Entamoeba histolytica
CAASLKELMILSSNLITIKKE

SEQ ID NO: 2670150 - protein, 22 aa, Entamoeba histolytica
CAATEYFSLRFKEMGLRTYQPI

SEQ ID NO: 2670151 - protein, 28 aa, Entamoeba histolytica
CAAVPMVRAGVCFEAVHPCCFEAVHPCC

SEQ ID NO: 2670152 - protein, 27 aa, Entamoeba histolytica
CAAVPMVRAGVCFEAVHPCCFEEARGV

SEQ ID NO: 2670153 - protein, 20 aa, Entamoeba histolytica
CACKINYPHRFFLLRGNHEN

SEQ ID NO: 2670154 - protein, 20 aa, Entamoeba histolytica
CACKINYPHRFFLLRGNHES

SEQ ID NO: 2670155 - protein, 24 aa, Entamoeba histolytica
CAGKLYFCTLCLLQHKDFDINSLT

SEQ ID NO: 2670156 - protein, 20 aa, Entamoeba histolytica
CAIELIKRGKAYVCHQTPDQ

SEQ ID NO: 2670157 - protein, 18 aa, Entamoeba histolytica
CAIKRINGSLDLIEKELQ

SEQ ID NO: 2670158 - protein, 18 aa, Entamoeba histolytica
CAILELLKVHSRVLYIDI

SEQ ID NO: 2670159 - protein, 18 aa, Entamoeba histolytica
CAILQRILDKFPDFFEKI

SEQ ID NO: 2670160 - protein, 19 aa, Entamoeba histolytica
CAILVAGMPRKVGMERKEL

SEQ ID NO: 2670161 - protein, 21 aa, Entamoeba histolytica
CAINFKNLGCFNRDYKLNNIF

SEQ ID NO: 2670162 - protein, 19 aa, Entamoeba histolytica
CAKCNKKVCNTCATTKIAL

SEQ ID NO: 2670163 - protein, 21 aa, Entamoeba histolytica
CAKFFFDCFSPEYSFEEPIYS

SEQ ID NO: 2670164 - protein, 27 aa, Entamoeba histolytica
CAKHIQPRCCYECLISLECLKNAKCPL

SEQ ID NO: 2670165 - protein, 18 aa, Entamoeba histolytica
CAKKIIFEFETEKKKEEK

SEQ ID NO: 2670166 - protein, 25 aa, Entamoeba histolytica
CALCVKKCPFEAIKIINLPKNLEQC

SEQ ID NO: 2670167 - protein, 21 aa, Entamoeba histolytica
CALHGNDFFWVHGYNKGVPKD

SEQ ID NO: 2670168 - protein, 18 aa, Entamoeba histolytica
CAMRHGLIPNLLDGGDHS

SEQ ID NO: 2670169 - protein, 18 aa, Entamoeba histolytica
CANVLFKIVNRAYNIFNQ

SEQ ID NO: 2670170 - protein, 19 aa, Entamoeba histolytica
CARIKGELPEDVIPYSKDQ

SEQ ID NO: 2670171 - protein, 24 aa, Entamoeba histolytica
CASGNKYRMGNLFIVGPTKTGKTE

SEQ ID NO: 2670172 - protein, 25 aa, Entamoeba histolytica
CAVARLYLMCIVGSAAVKSKKVGIV

SEQ ID NO: 2670173 - protein, 21 aa, Entamoeba histolytica
CAVCRKCFYKDGATLKTQRSV

SEQ ID NO: 2670174 - protein, 17 aa, Entamoeba histolytica
CAVTIFAEVSKKEKKND

SEQ ID NO: 2670175 - protein, 18 aa, Entamoeba histolytica
CCASVCPVGAIIFNGISP

SEQ ID NO: 2670176 - protein, 21 aa, Entamoeba histolytica
CCCFGCKNISFLHLSFTCLSH

SEQ ID NO: 2670177 - protein, 18 aa, Entamoeba histolytica
CCCGNSYIIPLLIKKYPS

SEQ ID NO: 2670178 - protein, 19 aa, Entamoeba histolytica
CCCPIEIIQQLKLLFPEVH

SEQ ID NO: 2670179 - protein, 23 aa, Entamoeba histolytica
CCECSCYKPELYGELKTKACGLL

SEQ ID NO: 2670180 - protein, 19 aa, Entamoeba histolytica
CCELGDFNIGFIMYSCVVQ

SEQ ID NO: 2670181 - protein, 25 aa, Entamoeba histolytica
CCELYKCSSALRVSQFGQQNKTNDG

SEQ ID NO: 2670182 - protein, 26 aa, Entamoeba histolytica
CCFGIPRKVRGFVWYALLLRPKTTQE

SEQ ID NO: 2670183 - protein, 26 aa, Entamoeba histolytica
CCFVIKRISDGIIYLHVGDFRFDSTL

SEQ ID NO: 2670184 - protein, 17 aa, Entamoeba histolytica
CCGGTKIFINGRFPYSG

SEQ ID NO: 2670185 - protein, 18 aa, Entamoeba histolytica
CCICNVGFGIPEFPKLLP

SEQ ID NO: 2670186 - protein, 17 aa, Entamoeba histolytica
CCKDLIFDYSYIPKSES

SEQ ID NO: 2670187 - protein, 30 aa, Entamoeba histolytica
CCKGKRFICTLCLLFHPKFNLGKCELYCDV

SEQ ID NO: 2670188 - protein, 25 aa, Entamoeba histolytica
CCLSWKQLKKVIGLKVLEKIEQSAF

SEQ ID NO: 2670189 - protein, 27 aa, Entamoeba histolytica
CCNHISCIPGLCGCHDGCWCWKHINQL

SEQ ID NO: 2670190 - protein, 19 aa, Entamoeba histolytica
CCNSLILRGNFLVSKLFLV

SEQ ID NO: 2670191 - protein, 22 aa, Entamoeba histolytica
CCNYPIQLGCRLAKKAKIIKFK

SEQ ID NO: 2670192 - protein, 18 aa, Entamoeba histolytica
CCPIYDKFLYDIIEHPFY

SEQ ID NO: 2670193 - protein, 23 aa, Entamoeba histolytica
CCSGFGMTELCGLMYKMPSKATH

SEQ ID NO: 2670194 - protein, 18 aa, Entamoeba histolytica
CDAKQRMLRFPGNSMNLL

SEQ ID NO: 2670195 - protein, 26 aa, Entamoeba histolytica
CDAVEILRINPLFSIKPPIGPKDFIY

SEQ ID NO: 2670196 - protein, 20 aa, Entamoeba histolytica
CDAVRFVKTLFVKTIEIPDG

SEQ ID NO: 2670197 - protein, 19 aa, Entamoeba histolytica
CDDKGYLANVFRVHPNGYL

SEQ ID NO: 2670198 - protein, 19 aa, Entamoeba histolytica
CDDKSMIGLIAYRNDLVGG

SEQ ID NO: 2670199 - protein, 23 aa, Entamoeba histolytica
CDDVLKIITEFLLKNSTSIESKV

SEQ ID NO: 2670200 - protein, 27 aa, Entamoeba histolytica
CDDYVRRCIHSMGINQIQIIKVNHHGS

SEQ ID NO: 2670201 - protein, 23 aa, Entamoeba histolytica
CDEILEILTYLIVQCQPPMLYSN

SEQ ID NO: 2670202 - protein, 17 aa, Entamoeba histolytica
CDELFSWIANTFDNEKV

SEQ ID NO: 2670203 - protein, 17 aa, Entamoeba histolytica
CDFDKMIKIIQERNKAV

SEQ ID NO: 2670204 - protein, 17 aa, Entamoeba histolytica
CDFLANELFKYLQKNCY

SEQ ID NO: 2670205 - protein, 26 aa, Entamoeba histolytica
CDIDVRRCLFNNILCAGGNTLYPGFA

SEQ ID NO: 2670206 - protein, 19 aa, Entamoeba histolytica
CDKKIKLPLPVLSLDDGCK

SEQ ID NO: 2670207 - protein, 20 aa, Entamoeba histolytica
CDKKSKLLLELTVGTELQNP

SEQ ID NO: 2670208 - protein, 17 aa, Entamoeba histolytica
CDLDKVIQLALKFKDER

SEQ ID NO: 2670209 - protein, 20 aa, Entamoeba histolytica
CDLKNAFTFKKHLASTHSSF

SEQ ID NO: 2670210 - protein, 17 aa, Entamoeba histolytica
CDLLWSDPVSEWDPDSP

SEQ ID NO: 2670211 - protein, 17 aa, Entamoeba histolytica
CDLNCWIALCAFAAQTR

SEQ ID NO: 2670212 - protein, 19 aa, Entamoeba histolytica
CDLSKLLVIPVQYLSIPKN

SEQ ID NO: 2670213 - protein, 18 aa, Entamoeba histolytica
CDLSKYGPHFIIERDFKV

SEQ ID NO: 2670214 - protein, 19 aa, Entamoeba histolytica
CDLSRGWFENVLMMYMHPS

SEQ ID NO: 2670215 - protein, 17 aa, Entamoeba histolytica
CDNEFYQKLEAMLYKIM

SEQ ID NO: 2670216 - protein, 18 aa, Entamoeba histolytica
CDNPKFIISSTHPTSLFI

SEQ ID NO: 2670217 - protein, 18 aa, Entamoeba histolytica
CDPLFKRIQQTIERALNK

SEQ ID NO: 2670218 - protein, 26 aa, Entamoeba histolytica
CDPQTGVNCKLFLNGEAVTSIIRTFL

SEQ ID NO: 2670219 - protein, 23 aa, Entamoeba histolytica
CDPSCSGSGILERQLTKEKRDPA

SEQ ID NO: 2670220 - protein, 22 aa, Entamoeba histolytica
CDQIDIYGGMIFIHNKETFSCW

SEQ ID NO: 2670221 - protein, 28 aa, Entamoeba histolytica
CDQLMCFPAGLPAIFSFSNSNSIRYAKD

SEQ ID NO: 2670222 - protein, 19 aa, Entamoeba histolytica
CDRHGFCNFLHVIEPNHSL

SEQ ID NO: 2670223 - protein, 20 aa, Entamoeba histolytica
CDRKIFVGALDILKLLVKQN

SEQ ID NO: 2670224 - protein, 24 aa, Entamoeba histolytica
CDRVKLRLTSVPELEYFVEDKVPC

SEQ ID NO: 2670225 - protein, 18 aa, Entamoeba histolytica
CDRYLLGHDYPMIKIATI

SEQ ID NO: 2670226 - protein, 17 aa, Entamoeba histolytica
CDSLSSISIEFTFQKLT

SEQ ID NO: 2670227 - protein, 20 aa, Entamoeba histolytica
CDVSCKKLNIEGEAYNLQLW

SEQ ID NO: 2670228 - protein, 20 aa, Entamoeba histolytica
CDYISFEMIDDMFLSLISIT

SEQ ID NO: 2670229 - protein, 21 aa, Entamoeba histolytica
CEAAMKPGVKWYNIHELSNKL

SEQ ID NO: 2670230 - protein, 26 aa, Entamoeba histolytica
CEAGICCVHIALYLGLPESVDKRKLK

SEQ ID NO: 2670231 - protein, 17 aa, Entamoeba histolytica
CEARGLYERFINKIKQI

SEQ ID NO: 2670232 - protein, 25 aa, Entamoeba histolytica
CEAYECFKSLCGIISILSNVSDISI

SEQ ID NO: 2670233 - protein, 25 aa, Entamoeba histolytica
CECVPLDAALIIALQCNGDLKQTTI

SEQ ID NO: 2670234 - protein, 17 aa, Entamoeba histolytica
CEEDVIVILGYNKMMYQ

SEQ ID NO: 2670235 - protein, 24 aa, Entamoeba histolytica
CEEHGLKLIGFWDFHQFYREWIKF

SEQ ID NO: 2670236 - protein, 18 aa, Entamoeba histolytica
CEEKWAVVRDEIHKVKQL

SEQ ID NO: 2670237 - protein, 18 aa, Entamoeba histolytica
CEEMIFPKGIIKIDDSYI

SEQ ID NO: 2670238 - protein, 25 aa, Entamoeba histolytica
CEEVNYWKNKFVTLQEEVNNHYNAA

SEQ ID NO: 2670239 - protein, 22 aa, Entamoeba histolytica
CEGEWQCSLETIAIVQDPISFP

SEQ ID NO: 2670240 - protein, 17 aa, Entamoeba histolytica
CEGIKTIGIIGKHCKDR

SEQ ID NO: 2670241 - protein, 19 aa, Entamoeba histolytica
CEGYKKWKQELVVYDINEQ

SEQ ID NO: 2670242 - protein, 19 aa, Entamoeba histolytica
CEICQQFGKMTHVFHSIIP

SEQ ID NO: 2670243 - protein, 26 aa, Entamoeba histolytica
CEIHLKRRATILIALLLDYIDTPKGV

SEQ ID NO: 2670244 - protein, 21 aa, Entamoeba histolytica
CEIHPALVMGVLGSIIPFPDH

SEQ ID NO: 2670245 - protein, 21 aa, Entamoeba histolytica
CEILKRLDHPNIIKLKEVYQT

SEQ ID NO: 2670246 - protein, 24 aa, Entamoeba histolytica
CEIPFVHPELIKFTKSITSLYRTL

SEQ ID NO: 2670247 - protein, 18 aa, Entamoeba histolytica
CEIRLKKDIINMVDFSSH

SEQ ID NO: 2670248 - protein, 20 aa, Entamoeba histolytica
CEKATILFENFIKLLNEQNE

SEQ ID NO: 2670249 - protein, 17 aa, Entamoeba histolytica
CEKCKKPIAGRSVQACG

SEQ ID NO: 2670250 - protein, 19 aa, Entamoeba histolytica
CEKDNPFLIKCFDVDSPPE

SEQ ID NO: 2670251 - protein, 19 aa, Entamoeba histolytica
CEKFSEYITFEVPKEKTVD

SEQ ID NO: 2670252 - protein, 18 aa, Entamoeba histolytica
CEKMLKDDLNSFVSVVDW

SEQ ID NO: 2670253 - protein, 20 aa, Entamoeba histolytica
CEKYIERWCEILSTKPKSVI

SEQ ID NO: 2670254 - protein, 17 aa, Entamoeba histolytica
CELASFTKYFTINDIQF

SEQ ID NO: 2670255 - protein, 17 aa, Entamoeba histolytica
CELCGRNAFQKMKADGW

SEQ ID NO: 2670256 - protein, 28 aa, Entamoeba histolytica
CELFIKDLTTRAGYITSYSKRKVIKKDD

SEQ ID NO: 2670257 - protein, 20 aa, Entamoeba histolytica
CELKGVIVMSVPSLTTPKVQ

SEQ ID NO: 2670258 - protein, 17 aa, Entamoeba histolytica
CELKSIHLLSLINKKYH

SEQ ID NO: 2670259 - protein, 18 aa, Entamoeba histolytica
CEMCINNEGLKCVRNNGI

SEQ ID NO: 2670260 - protein, 19 aa, Entamoeba histolytica
CEMGLQFIQMVKKHKESGL

SEQ ID NO: 2670261 - protein, 17 aa, Entamoeba histolytica
CENCKFAVNSEEERDVW

SEQ ID NO: 2670262 - protein, 17 aa, Entamoeba histolytica
CENDVSLIWNCLGTLIT

SEQ ID NO: 2670263 - protein, 29 aa, Entamoeba histolytica
CENVSLLHLIRWGKYVGNYGVEALKEGFN

SEQ ID NO: 2670264 - protein, 22 aa, Entamoeba histolytica
CEPEFIPIMKYVFGNVLIAEDA

SEQ ID NO: 2670265 - protein, 24 aa, Entamoeba histolytica
CEPITKCVRDLLVLDGKEEQGDLD

SEQ ID NO: 2670266 - protein, 20 aa, Entamoeba histolytica
CEQFIPLIMNILMEPLNTQE

SEQ ID NO: 2670267 - protein, 21 aa, Entamoeba histolytica
CEQNGYLGFHLLKQFYKTNYY

SEQ ID NO: 2670268 - protein, 25 aa, Entamoeba histolytica
CERERIIRMGGHVFAGRVNGELAIS

SEQ ID NO: 2670269 - protein, 26 aa, Entamoeba histolytica
CESKKQLTVELVIPIGSFCVLDSIKI

SEQ ID NO: 2670270 - protein, 23 aa, Entamoeba histolytica
CETIKGVGPITAFELIQQYKSIE

SEQ ID NO: 2670271 - protein, 17 aa, Entamoeba histolytica
CETKCRTKDEFLKHIPT

SEQ ID NO: 2670272 - protein, 20 aa, Entamoeba histolytica
CEVDEKPILLSPLYTFLPEE

SEQ ID NO: 2670273 - protein, 18 aa, Entamoeba histolytica
CEVKELIFSKDLKKKSED

SEQ ID NO: 2670274 - protein, 26 aa, Entamoeba histolytica
CEVKSCINLYFDEIFFKSNKEIGATL

SEQ ID NO: 2670275 - protein, 25 aa, Entamoeba histolytica
CEWGIPCDLLLLKEVKKYGLEPPKL

SEQ ID NO: 2670276 - protein, 20 aa, Entamoeba histolytica
CEWYKRGFCKHGKKCKHGHV

SEQ ID NO: 2670277 - protein, 18 aa, Entamoeba histolytica
CEYLKKEKELIINGISYL

SEQ ID NO: 2670278 - protein, 18 aa, Entamoeba histolytica
CFCGCSSLTSIIIPSTVS

SEQ ID NO: 2670279 - protein, 18 aa, Entamoeba histolytica
CFCYDIISINSLVNINVM

SEQ ID NO: 2670280 - protein, 25 aa, Entamoeba histolytica
CFDCRKNYCKHCFKEAHKDQYHSIR

SEQ ID NO: 2670281 - protein, 20 aa, Entamoeba histolytica
CFDCSWDKDCCGCILTDKIL

SEQ ID NO: 2670282 - protein, 19 aa, Entamoeba histolytica
CFDFCLGLQKCKFEEPCQI

SEQ ID NO: 2670283 - protein, 20 aa, Entamoeba histolytica
CFDKEHLRKISAVTVTNIKK

SEQ ID NO: 2670284 - protein, 18 aa, Entamoeba histolytica
CFDMRNGCYYNKKEKSLI

SEQ ID NO: 2670285 - protein, 18 aa, Entamoeba histolytica
CFEEGFHYNEFWDILHGV

SEQ ID NO: 2670286 - protein, 17 aa, Entamoeba histolytica
CFEGELVIPTIEEEKKI

SEQ ID NO: 2670287 - protein, 18 aa, Entamoeba histolytica
CFEIFLNYEHPFELKHSQ

SEQ ID NO: 2670288 - protein, 20 aa, Entamoeba histolytica
CFELPLKRMQEGLTPTTYTD

SEQ ID NO: 2670289 - protein, 19 aa, Entamoeba histolytica
CFEYHNFDTLLCILLLFNT

SEQ ID NO: 2670290 - protein, 25 aa, Entamoeba histolytica
CFGLLSLLHPLSWQGVFLPMVPHSH

SEQ ID NO: 2670291 - protein, 19 aa, Entamoeba histolytica
CFIACSFHPYSKVSYLSLD

SEQ ID NO: 2670292 - protein, 18 aa, Entamoeba histolytica
CFIEGASILYDIREHNVQ

SEQ ID NO: 2670293 - protein, 17 aa, Entamoeba histolytica
CFISTGFGNNEKPKEET

SEQ ID NO: 2670294 - protein, 21 aa, Entamoeba histolytica
CFKPKLILTNRSVFTPVKKDL

SEQ ID NO: 2670295 - protein, 17 aa, Entamoeba histolytica
CFMCANLKGRQEILKEI

SEQ ID NO: 2670296 - protein, 22 aa, Entamoeba histolytica
CFMSCLKLSSIILPTTLCSLPH

SEQ ID NO: 2670297 - protein, 19 aa, Entamoeba histolytica
CFNFGSLLLENQFYKHTIL

SEQ ID NO: 2670298 - protein, 17 aa, Entamoeba histolytica
CFNFKLFEEYEVTFNHI

SEQ ID NO: 2670299 - protein, 20 aa, Entamoeba histolytica
CFNMYYLGVCSCININGLRI

SEQ ID NO: 2670300 - protein, 30 aa, Entamoeba histolytica
CFNQEFICSVYLGRKCILIFKDKTSPLQNP

SEQ ID NO: 2670301 - protein, 35 aa, Entamoeba histolytica
CFQFAFRWFNCFLLREMSLEKGLRLWDTYLSDEDG

SEQ ID NO: 2670302 - protein, 22 aa, Entamoeba histolytica
CFRCSVCKKILNGANFAKNHGV

SEQ ID NO: 2670303 - protein, 18 aa, Entamoeba histolytica
CFSFVRDIIHAPIIKHFF

SEQ ID NO: 2670304 - protein, 21 aa, Entamoeba histolytica
CFSTFVRKGVVFIAAVDTKKK

SEQ ID NO: 2670305 - protein, 31 aa, Entamoeba histolytica
CFSYPGKLQSIIGLYLCREIENKFNKSKYHS

SEQ ID NO: 2670306 - protein, 25 aa, Entamoeba histolytica
CFTSYRYEGELNYVLINAVSGEVYG

SEQ ID NO: 2670307 - protein, 18 aa, Entamoeba histolytica
CFVHESFDPTNFSCIKTI

SEQ ID NO: 2670308 - protein, 18 aa, Entamoeba histolytica
CFWSEHWRPSSYYPKIKI

SEQ ID NO: 2670309 - protein, 17 aa, Entamoeba histolytica
CFYHCGHITEIILSDAI

SEQ ID NO: 2670310 - protein, 24 aa, Entamoeba histolytica
CGAGSRQSINWAKSDGKLEVLRKE

SEQ ID NO: 2670311 - protein, 21 aa, Entamoeba histolytica
CGAHVSFKKKQCFISSQVKHY

SEQ ID NO: 2670312 - protein, 25 aa, Entamoeba histolytica
CGALDTRLSGILEHIDTVLIDESTQ

SEQ ID NO: 2670313 - protein, 19 aa, Entamoeba histolytica
CGANIYPGHGMMFVRNDAK

SEQ ID NO: 2670314 - protein, 17 aa, Entamoeba histolytica
CGAPPPPPPPAFDTGCG

SEQ ID NO: 2670315 - protein, 17 aa, Entamoeba histolytica
CGATCYINSVIQQLHNN

SEQ ID NO: 2670316 - protein, 20 aa, Entamoeba histolytica
CGDCGCVLAGIRHIRPHQYG

SEQ ID NO: 2670317 - protein, 21 aa, Entamoeba histolytica
CGDKGDQLMAVFQSFDSDCSL

SEQ ID NO: 2670318 - protein, 20 aa, Entamoeba histolytica
CGDVPKAVQAFKELIEEYLK

SEQ ID NO: 2670319 - protein, 20 aa, Entamoeba histolytica
CGDYFFNWFNMVLKDTNKTK

SEQ ID NO: 2670320 - protein, 17 aa, Entamoeba histolytica
CGECSKWKMPIPPNNTL

SEQ ID NO: 2670321 - protein, 32 aa, Entamoeba histolytica
CGEICNYFLKTFCPSGLQVLRDFVFDDKSQNE

SEQ ID NO: 2670322 - protein, 17 aa, Entamoeba histolytica
CGETIKKSKAKAHASKC

SEQ ID NO: 2670323 - protein, 29 aa, Entamoeba histolytica
CGFDVNIWVCLPGTLTVSISIDGHMIKGF

SEQ ID NO: 2670324 - protein, 20 aa, Entamoeba histolytica
CGFGESKSSVLSLVVGDFNV

SEQ ID NO: 2670325 - protein, 17 aa, Entamoeba histolytica
CGGDGTVGWVMNELRKA

SEQ ID NO: 2670326 - protein, 20 aa, Entamoeba histolytica
CGGLCPGLNNVIRGLVLNLY

SEQ ID NO: 2670327 - protein, 20 aa, Entamoeba histolytica
CGGLYKIYIADWFAQLNHKM

SEQ ID NO: 2670328 - protein, 19 aa, Entamoeba histolytica
CGGMGGLLEQIRQGKKLKK

SEQ ID NO: 2670329 - protein, 19 aa, Entamoeba histolytica
CGGQSGINRQFVCYVEDGI

SEQ ID NO: 2670330 - protein, 20 aa, Entamoeba histolytica
CGGSLPSFLVNSQAKNVLPK

SEQ ID NO: 2670331 - protein, 23 aa, Entamoeba histolytica
CGHLYCSDCLNIIFDTPGIHYCP

SEQ ID NO: 2670332 - protein, 20 aa, Entamoeba histolytica
CGHPPVQHNCHFGSCPKCTS

SEQ ID NO: 2670333 - protein, 25 aa, Entamoeba histolytica
CGHSFCKECIFEYILTSMKENGKGI

SEQ ID NO: 2670334 - protein, 23 aa, Entamoeba histolytica
CGHSFICCFCSFKRRFFDKDMTC

SEQ ID NO: 2670335 - protein, 18 aa, Entamoeba histolytica
CGIAELKSIVSRFNFKKN

SEQ ID NO: 2670336 - protein, 22 aa, Entamoeba histolytica
CGIDQCWGAHRIGHEITAYYGL

SEQ ID NO: 2670337 - protein, 21 aa, Entamoeba histolytica
CGIDVPEVYVIHSLKHIPKEV

SEQ ID NO: 2670338 - protein, 33 aa, Entamoeba histolytica
CGIKLKYRIIEMIKKFICLFPNDFFVSENSGTL

SEQ ID NO: 2670339 - protein, 18 aa, Entamoeba histolytica
CGINNLIAAQTRIENKTA

SEQ ID NO: 2670340 - protein, 22 aa, Entamoeba histolytica
CGKNRRRALLEYAKEHGYTSIA

SEQ ID NO: 2670341 - protein, 20 aa, Entamoeba histolytica
CGKPIGMSFLEVFGKKWHEG

SEQ ID NO: 2670342 - protein, 20 aa, Entamoeba histolytica
CGKSAYPLERITAGGKDYHN

SEQ ID NO: 2670343 - protein, 25 aa, Entamoeba histolytica
CGKSGCGKTSLAQRFFSNKLQVGEV

SEQ ID NO: 2670344 - protein, 20 aa, Entamoeba histolytica
CGLAHGVAKEPTRINLDVPM

SEQ ID NO: 2670345 - protein, 19 aa, Entamoeba histolytica
CGLARLPYELQKRGNKCYA

SEQ ID NO: 2670346 - protein, 25 aa, Entamoeba histolytica
CGLDKTAFVKYQWTSEIFDPAYFIV

SEQ ID NO: 2670347 - protein, 20 aa, Entamoeba histolytica
CGLTALSRFKNRLHEWPTYC

SEQ ID NO: 2670348 - protein, 17 aa, Entamoeba histolytica
CGMNGPIVTQIRALLLP

SEQ ID NO: 2670349 - protein, 22 aa, Entamoeba histolytica
CGNEVSEFICDLEVFTLKDIID

SEQ ID NO: 2670350 - protein, 25 aa, Entamoeba histolytica
CGNISCWCSVVFSGYVLENSITQLN

SEQ ID NO: 2670351 - protein, 25 aa, Entamoeba histolytica
CGQIICSDCVDSLLLGGSELECPLC

SEQ ID NO: 2670352 - protein, 19 aa, Entamoeba histolytica
CGQKVCMPQVLKILIPYLP

SEQ ID NO: 2670353 - protein, 27 aa, Entamoeba histolytica
CGRITFIDLPCCWEESNHKGSLLNGLN

SEQ ID NO: 2670354 - protein, 20 aa, Entamoeba histolytica
CGRSECIEVFSALNEFSKIG

SEQ ID NO: 2670355 - protein, 18 aa, Entamoeba histolytica
CGRYLYVQFGYQIISNLP

SEQ ID NO: 2670356 - protein, 28 aa, Entamoeba histolytica
CGSATDMALRMGISLTKTKRLRGIGIAL

SEQ ID NO: 2670357 - protein, 21 aa, Entamoeba histolytica
CGSCGPRGFYGGTLEHLKIED

SEQ ID NO: 2670358 - protein, 17 aa, Entamoeba histolytica
CGSFTSLGFTFSPYAEP

SEQ ID NO: 2670359 - protein, 19 aa, Entamoeba histolytica
CGSGNFGMVKVLLEFGKMN

SEQ ID NO: 2670360 - protein, 19 aa, Entamoeba histolytica
CGSLEMKTTFIKFIVHLSY

SEQ ID NO: 2670361 - protein, 18 aa, Entamoeba histolytica
CGSYDILQTIIVGMFPDE

SEQ ID NO: 2670362 - protein, 18 aa, Entamoeba histolytica
CGTPEYLAPEVVEGLDYN

SEQ ID NO: 2670363 - protein, 21 aa, Entamoeba histolytica
CGTPEYLAPEVVVGKDYSEPV

SEQ ID NO: 2670364 - protein, 18 aa, Entamoeba histolytica
CGTTPFWDETMAFYSGYS

SEQ ID NO: 2670365 - protein, 19 aa, Entamoeba histolytica
CGTYFCYNCGKKIDGYEHF

SEQ ID NO: 2670366 - protein, 19 aa, Entamoeba histolytica
CGVEQCWGAHMIGHEITAY

SEQ ID NO: 2670367 - protein, 25 aa, Entamoeba histolytica
CGVNELPLHLILSWYEQKAVAVLLA

SEQ ID NO: 2670368 - protein, 18 aa, Entamoeba histolytica
CGVVPIKKPFRGGFDSCW

SEQ ID NO: 2670369 - protein, 22 aa, Entamoeba histolytica
CGYCSNPEYYSRSYSWLPLLYG

SEQ ID NO: 2670370 - protein, 18 aa, Entamoeba histolytica
CGYTAPTLMGIISDKEIQ

SEQ ID NO: 2670371 - protein, 21 aa, Entamoeba histolytica
CHAYTRLTGENGFDYEEIANK

SEQ ID NO: 2670372 - protein, 18 aa, Entamoeba histolytica
CHCPETFFDSFIKFLPHN

SEQ ID NO: 2670373 - protein, 19 aa, Entamoeba histolytica
CHFICKNFIERLILMNSNE

SEQ ID NO: 2670374 - protein, 17 aa, Entamoeba histolytica
CHGCGKPFELTQAKEIF

SEQ ID NO: 2670375 - protein, 25 aa, Entamoeba histolytica
CHLLECVKYLSPYMIYVSDSENSIK

SEQ ID NO: 2670376 - protein, 17 aa, Entamoeba histolytica
CHLPKQRRTGLFSATMP

SEQ ID NO: 2670377 - protein, 24 aa, Entamoeba histolytica
CHLREELKFYYSLYQTCIPMINKL

SEQ ID NO: 2670378 - protein, 26 aa, Entamoeba histolytica
CHPCMLNKLPKCARCNNPIKGNYVVV

SEQ ID NO: 2670379 - protein, 23 aa, Entamoeba histolytica
CHQEAFLKCPLKIITFNEGNYFR

SEQ ID NO: 2670380 - protein, 17 aa, Entamoeba histolytica
CHSLREFIIPPSVCLME

SEQ ID NO: 2670381 - protein, 19 aa, Entamoeba histolytica
CHSQVPFSLSWFNDEGKFI

SEQ ID NO: 2670382 - protein, 20 aa, Entamoeba histolytica
CHYYDILTIISMINLSCEIH

SEQ ID NO: 2670383 - protein, 25 aa, Entamoeba histolytica
CIAEYEILKNYSLTICKSPSPNELV

SEQ ID NO: 2670384 - protein, 17 aa, Entamoeba histolytica
CIALGSILEKYAQTLRV

SEQ ID NO: 2670385 - protein, 26 aa, Entamoeba histolytica
CIAPQWLMKRLNLVDGDYIDLQTVNL

SEQ ID NO: 2670386 - protein, 23 aa, Entamoeba histolytica
CICGCGYCYKCHKKVKHFSPHIL

SEQ ID NO: 2670387 - protein, 22 aa, Entamoeba histolytica
CICKYIELWPKAWGISVEEMLQ

SEQ ID NO: 2670388 - protein, 19 aa, Entamoeba histolytica
CICTGRCIYYSKKDLIIPS

SEQ ID NO: 2670389 - protein, 20 aa, Entamoeba histolytica
CIDCCCVVYIALTRLYVSTE

SEQ ID NO: 2670390 - protein, 23 aa, Entamoeba histolytica
CIDIKCPMTIPFYEEYINNSNYR

SEQ ID NO: 2670391 - protein, 25 aa, Entamoeba histolytica
CIDILDRIKLSLSIDPTNQTIKRLI

SEQ ID NO: 2670392 - protein, 20 aa, Entamoeba histolytica
CIEEITFKPIFKQINDVKNH

SEQ ID NO: 2670393 - protein, 24 aa, Entamoeba histolytica
CIEIDCPDKVIIKGLDLRNTESKV

SEQ ID NO: 2670394 - protein, 19 aa, Entamoeba histolytica
CIEKLPSTCFLGRLRKFIL

SEQ ID NO: 2670395 - protein, 25 aa, Entamoeba histolytica
CIENKLCRVCGCHHTEHVNESCKYE

SEQ ID NO: 2670396 - protein, 20 aa, Entamoeba histolytica
CIEYKCGCIQRDHRKEDVQC

SEQ ID NO: 2670397 - protein, 18 aa, Entamoeba histolytica
CIEYLKTNPLPILNYKCR

SEQ ID NO: 2670398 - protein, 19 aa, Entamoeba histolytica
CIFYNTRLTITILNSLGIL

SEQ ID NO: 2670399 - protein, 19 aa, Entamoeba histolytica
CIGDLLSLLITYITPYLSF

SEQ ID NO: 2670400 - protein, 20 aa, Entamoeba histolytica
CIGESYAFGPGVEGGVTIDK

SEQ ID NO: 2670401 - protein, 17 aa, Entamoeba histolytica
CIGGICAGVHSILDPYD

SEQ ID NO: 2670402 - protein, 17 aa, Entamoeba histolytica
CIGKDSYIDYLFPSHYK

SEQ ID NO: 2670403 - protein, 17 aa, Entamoeba histolytica
CIHAVSVIHHLLHEDYE

SEQ ID NO: 2670404 - protein, 18 aa, Entamoeba histolytica
CIIASEFSIEPDLIGITV

SEQ ID NO: 2670405 - protein, 17 aa, Entamoeba histolytica
CIIDCTISLNKKPGILT

SEQ ID NO: 2670406 - protein, 18 aa, Entamoeba histolytica
CIIIVSFLVLQSTTIDQS

SEQ ID NO: 2670407 - protein, 24 aa, Entamoeba histolytica
CIIKCIKHYPKMFDDFLKIHASNV

SEQ ID NO: 2670408 - protein, 17 aa, Entamoeba histolytica
CIIQNILACCVYSGDLC

SEQ ID NO: 2670409 - protein, 19 aa, Entamoeba histolytica
CIISLQPQLCCFGHCHYST

SEQ ID NO: 2670410 - protein, 22 aa, Entamoeba histolytica
CIKCNKYFCNGPVYNSSNCQVI

SEQ ID NO: 2670411 - protein, 19 aa, Entamoeba histolytica
CIKELQLLKVNPVVVQNTM

SEQ ID NO: 2670412 - protein, 23 aa, Entamoeba histolytica
CIKHIKTWVLHDIFEYKNELRLR

SEQ ID NO: 2670413 - protein, 23 aa, Entamoeba histolytica
CIKKEGLMKAVFVSCSLIKFGVS

SEQ ID NO: 2670414 - protein, 18 aa, Entamoeba histolytica
CIKVIEFDDPITLVDGWR

SEQ ID NO: 2670415 - protein, 19 aa, Entamoeba histolytica
CILILPGHEHYVMSAFFHP

SEQ ID NO: 2670416 - protein, 22 aa, Entamoeba histolytica
CIMACCGNDTIGCFIRKPIEST

SEQ ID NO: 2670417 - protein, 18 aa, Entamoeba histolytica
CIMGESFTTNFVQADQQG

SEQ ID NO: 2670418 - protein, 17 aa, Entamoeba histolytica
CIMLFKKMHHQVNQSIE

SEQ ID NO: 2670419 - protein, 31 aa, Entamoeba histolytica
CINCGGCMRACPFGAILPRSNLIDVLKILPT

SEQ ID NO: 2670420 - protein, 28 aa, Entamoeba histolytica
CIPTRWRPINEFCTYILFFLKAVRLVPE

SEQ ID NO: 2670421 - protein, 19 aa, Entamoeba histolytica
CIQDITWLPGGLRMMACSV

SEQ ID NO: 2670422 - protein, 19 aa, Entamoeba histolytica
CIQKVRIGKTIIRINTNLT

SEQ ID NO: 2670423 - protein, 17 aa, Entamoeba histolytica
CIQSAVQHAEFLRSNPL

SEQ ID NO: 2670424 - protein, 26 aa, Entamoeba histolytica
CIRQYELFPHFGLILIHGGSGVGKTT

SEQ ID NO: 2670425 - protein, 27 aa, Entamoeba histolytica
CISDFSRRLCTGLSLDWNTSFSLYSFD

SEQ ID NO: 2670426 - protein, 17 aa, Entamoeba histolytica
CISEIFYSSPACVHLLI

SEQ ID NO: 2670427 - protein, 22 aa, Entamoeba histolytica
CISGDLKLLVNFFKNYSYNGTN

SEQ ID NO: 2670428 - protein, 25 aa, Entamoeba histolytica
CISTFRGIPDWDWFYQFNAPPEITD

SEQ ID NO: 2670429 - protein, 27 aa, Entamoeba histolytica
CITPAIMFCDSIGFLSANFYAKNLFDE

SEQ ID NO: 2670430 - protein, 19 aa, Entamoeba histolytica
CITSCPCYFTCYYFTESIT

SEQ ID NO: 2670431 - protein, 25 aa, Entamoeba histolytica
CIVEKKVSEWFARSISSALISLSTH

SEQ ID NO: 2670432 - protein, 18 aa, Entamoeba histolytica
CIVERRFVSINNYILSLS

SEQ ID NO: 2670433 - protein, 25 aa, Entamoeba histolytica
CIVSFKLEKGVVMKIQYQEEVEENS

SEQ ID NO: 2670434 - protein, 24 aa, Entamoeba histolytica
CIYCGKRYTSLWSLESDCGGHDHS

SEQ ID NO: 2670435 - protein, 18 aa, Entamoeba histolytica
CIYQCAILQRILDKFPDF

SEQ ID NO: 2670436 - protein, 26 aa, Entamoeba histolytica
CIYTSIKSFHWQFLITKSKRSSQRML

SEQ ID NO: 2670437 - protein, 21 aa, Entamoeba histolytica
CKAFNRYLFNLIDTKKCGKID

SEQ ID NO: 2670438 - protein, 19 aa, Entamoeba histolytica
CKAMMLCGKVDGPIKNGEI

SEQ ID NO: 2670439 - protein, 19 aa, Entamoeba histolytica
CKARCQAFRAEVIKRTIKN

SEQ ID NO: 2670440 - protein, 17 aa, Entamoeba histolytica
CKCASLAGCTSKIRDDK

SEQ ID NO: 2670441 - protein, 18 aa, Entamoeba histolytica
CKCKMYFDEHNGISEKTA

SEQ ID NO: 2670442 - protein, 18 aa, Entamoeba histolytica
CKDFCSFEDKSGCCEYYF

SEQ ID NO: 2670443 - protein, 18 aa, Entamoeba histolytica
CKDFHSVNMMTYKEELTN

SEQ ID NO: 2670444 - protein, 25 aa, Entamoeba histolytica
CKDIIRWLMCVDGKRVCKLVIEEYS

SEQ ID NO: 2670445 - protein, 19 aa, Entamoeba histolytica
CKDLQKALVEELYKSDKIN

SEQ ID NO: 2670446 - protein, 22 aa, Entamoeba histolytica
CKDMFRELMKRDGIGEWTNYTV

SEQ ID NO: 2670447 - protein, 17 aa, Entamoeba histolytica
CKECFSLLHNDMDIGFE

SEQ ID NO: 2670448 - protein, 18 aa, Entamoeba histolytica
CKEELVLKRMNDIRFRRQ

SEQ ID NO: 2670449 - protein, 18 aa, Entamoeba histolytica
CKEELVLKRMNDIRFRTD

SEQ ID NO: 2670450 - protein, 18 aa, Entamoeba histolytica
CKEELVLKRMNDIRFRTN

SEQ ID NO: 2670451 - protein, 19 aa, Entamoeba histolytica
CKEELVLKRMNDIRFRTNA

SEQ ID NO: 2670452 - protein, 18 aa, Entamoeba histolytica
CKEFLMKEISCVEMCNLK

SEQ ID NO: 2670453 - protein, 17 aa, Entamoeba histolytica
CKEGLTFFEDIPKTSVF

SEQ ID NO: 2670454 - protein, 19 aa, Entamoeba histolytica
CKEIYSFLSNLLVKSNQLN

SEQ ID NO: 2670455 - protein, 19 aa, Entamoeba histolytica
CKELFKHAKDILLSDKPTP

SEQ ID NO: 2670456 - protein, 20 aa, Entamoeba histolytica
CKEMKVCGALGPLTSGNKKT

SEQ ID NO: 2670457 - protein, 18 aa, Entamoeba histolytica
CKENIGLPLQDAEQEYID

SEQ ID NO: 2670458 - protein, 19 aa, Entamoeba histolytica
CKEYMKPKYNEVLQMFLNV

SEQ ID NO: 2670459 - protein, 22 aa, Entamoeba histolytica
CKFCPKCEAGLLMTDNKVKAQC

SEQ ID NO: 2670460 - protein, 17 aa, Entamoeba histolytica
CKGIISGIGKIEHVPFN

SEQ ID NO: 2670461 - protein, 18 aa, Entamoeba histolytica
CKGNISVTILSLDSFIET

SEQ ID NO: 2670462 - protein, 19 aa, Entamoeba histolytica
CKHPNIVSFFGSYLEEGYV

SEQ ID NO: 2670463 - protein, 27 aa, Entamoeba histolytica
CKIADACLRSSAAVGYYPPYQGYADGG

SEQ ID NO: 2670464 - protein, 22 aa, Entamoeba histolytica
CKIELMSFYLITPIQRIPRYEL

SEQ ID NO: 2670465 - protein, 20 aa, Entamoeba histolytica
CKIERLPIILPLVQEDVLSM

SEQ ID NO: 2670466 - protein, 27 aa, Entamoeba histolytica
CKIGDACLRSAAAVGYYPPYQGYADGG

SEQ ID NO: 2670467 - protein, 19 aa, Entamoeba histolytica
CKIINRVGGTLTVQMKTKT

SEQ ID NO: 2670468 - protein, 24 aa, Entamoeba histolytica
CKILKNVLMTYSFFNMRVGYGQGM

SEQ ID NO: 2670469 - protein, 25 aa, Entamoeba histolytica
CKIMIKGCDLVESRVHCKLLIRYAT

SEQ ID NO: 2670470 - protein, 21 aa, Entamoeba histolytica
CKIVSDWYCIYRWASTVEIVS

SEQ ID NO: 2670471 - protein, 19 aa, Entamoeba histolytica
CKKGALFFSTLKRAFFLQE

SEQ ID NO: 2670472 - protein, 19 aa, Entamoeba histolytica
CKKIRFLLKRNEEGCDLSE

SEQ ID NO: 2670473 - protein, 19 aa, Entamoeba histolytica
CKKNTALLLDCKTHQTINE

SEQ ID NO: 2670474 - protein, 19 aa, Entamoeba histolytica
CKKSYFAMKEINEIQQRYD

SEQ ID NO: 2670475 - protein, 18 aa, Entamoeba histolytica
CKLAEKLAKEPNERLAKE

SEQ ID NO: 2670476 - protein, 19 aa, Entamoeba histolytica
CKLCDRPFDVYKWRMEESN

SEQ ID NO: 2670477 - protein, 17 aa, Entamoeba histolytica
CKLKEKINNTIVFKQSI

SEQ ID NO: 2670478 - protein, 27 aa, Entamoeba histolytica
CKLKKKWKLRFVIVNGSTLYYYKTELD

SEQ ID NO: 2670479 - protein, 20 aa, Entamoeba histolytica
CKLSEIWINSQTFQWVASKF

SEQ ID NO: 2670480 - protein, 19 aa, Entamoeba histolytica
CKLTNPLHFKRYYHGKDIV

SEQ ID NO: 2670481 - protein, 21 aa, Entamoeba histolytica
CKNCGSINHWTYQCTVEIEEK

SEQ ID NO: 2670482 - protein, 20 aa, Entamoeba histolytica
CKNHKEVYCSQNDRCSELMK

SEQ ID NO: 2670483 - protein, 17 aa, Entamoeba histolytica
CKNILCWEETGNIDFID

SEQ ID NO: 2670484 - protein, 28 aa, Entamoeba histolytica
CKNLHKHIWRCTGPCRNKPPFYGYVKRS

SEQ ID NO: 2670485 - protein, 18 aa, Entamoeba histolytica
CKQIKFDLQKIIETIGSR

SEQ ID NO: 2670486 - protein, 17 aa, Entamoeba histolytica
CKQQCTHLLSYIKEVDD

SEQ ID NO: 2670487 - protein, 23 aa, Entamoeba histolytica
CKQYRSTLKMIIYLESLIDIDQL

SEQ ID NO: 2670488 - protein, 21 aa, Entamoeba histolytica
CKRKFGIFCFKYHCERCGFVV

SEQ ID NO: 2670489 - protein, 18 aa, Entamoeba histolytica
CKRNHKPLILSNKHSPNN

SEQ ID NO: 2670490 - protein, 19 aa, Entamoeba histolytica
CKRSYSVSSNGGRTPRSSK

SEQ ID NO: 2670491 - protein, 17 aa, Entamoeba histolytica
CKSDLGCFGLFQSNTIK

SEQ ID NO: 2670492 - protein, 17 aa, Entamoeba histolytica
CKSKFELFLPLSNQISI

SEQ ID NO: 2670493 - protein, 19 aa, Entamoeba histolytica
CKSLARIISRSKRLVVLTG

SEQ ID NO: 2670494 - protein, 25 aa, Entamoeba histolytica
CKTAKYLNETIICYKEMNVNINELI

SEQ ID NO: 2670495 - protein, 17 aa, Entamoeba histolytica
CKTFFIKNEQNVWTTED

SEQ ID NO: 2670496 - protein, 25 aa, Entamoeba histolytica
CKTGDFKPSPGFKMPCKEILHGVGP

SEQ ID NO: 2670497 - protein, 17 aa, Entamoeba histolytica
CKTGLAIHKSSMKLEFA

SEQ ID NO: 2670498 - protein, 24 aa, Entamoeba histolytica
CKTKSCFLPSSLVSLQILGMKSME

SEQ ID NO: 2670499 - protein, 17 aa, Entamoeba histolytica
CKTLLPVIPSTCLSWDI

SEQ ID NO: 2670500 - protein, 20 aa, Entamoeba histolytica
CKTNELYFCMHELDTSELPK

SEQ ID NO: 2670501 - protein, 18 aa, Entamoeba histolytica
CKTPQYSVFLTLRNPSVI

SEQ ID NO: 2670502 - protein, 19 aa, Entamoeba histolytica
CKTSGIPPEHITALTRLDQ

SEQ ID NO: 2670503 - protein, 17 aa, Entamoeba histolytica
CKVCVNLAEFILRQARN

SEQ ID NO: 2670504 - protein, 23 aa, Entamoeba histolytica
CKVLDSLRKPLFLTFKNEDPEGD

SEQ ID NO: 2670505 - protein, 18 aa, Entamoeba histolytica
CKWLNSFKELLTQFFNIP

SEQ ID NO: 2670506 - protein, 23 aa, Entamoeba histolytica
CKYAPEFPGDYTVDIKLNGDKVG

SEQ ID NO: 2670507 - protein, 18 aa, Entamoeba histolytica
CKYFYSIQSISVYPINDT

SEQ ID NO: 2670508 - protein, 19 aa, Entamoeba histolytica
CKYQRVAIKVLKQQNLSKE

SEQ ID NO: 2670509 - protein, 31 aa, Entamoeba histolytica
CLDDKELNQMLSLKRLAPYDERKITQAEKER

SEQ ID NO: 2670510 - protein, 19 aa, Entamoeba histolytica
CLDKEIYLSNVFIIIPVEE

SEQ ID NO: 2670511 - protein, 18 aa, Entamoeba histolytica
CLDSFSLFSKIHGRKNIH

SEQ ID NO: 2670512 - protein, 25 aa, Entamoeba histolytica
CLDSLCVYDSYFIFYERIVSLMPKI

SEQ ID NO: 2670513 - protein, 18 aa, Entamoeba histolytica
CLEALQLIFKNLVNGYNG

SEQ ID NO: 2670514 - protein, 20 aa, Entamoeba histolytica
CLEITKSTIARMFTDGKLLG

SEQ ID NO: 2670515 - protein, 24 aa, Entamoeba histolytica
CLENKFKNCPSITEIVREENQRYI

SEQ ID NO: 2670516 - protein, 18 aa, Entamoeba histolytica
CLESLKKLQLEYLDLYII

SEQ ID NO: 2670517 - protein, 19 aa, Entamoeba histolytica
CLESLKKLQLEYLDLYIIH

SEQ ID NO: 2670518 - protein, 21 aa, Entamoeba histolytica
CLFLIATSSLYCFDINTKQFV

SEQ ID NO: 2670519 - protein, 26 aa, Entamoeba histolytica
CLFLLCVSFKGFIGVSGRICKVFFFG

SEQ ID NO: 2670520 - protein, 23 aa, Entamoeba histolytica
CLFPALRSPRLVLLGDIQQLKPV

SEQ ID NO: 2670521 - protein, 25 aa, Entamoeba histolytica
CLFSLGLCYDQNCIFDFDEQHVGWP

SEQ ID NO: 2670522 - protein, 19 aa, Entamoeba histolytica
CLFVKNSSIFEFSKNVDGC

SEQ ID NO: 2670523 - protein, 20 aa, Entamoeba histolytica
CLFVKNSSIFEFSKNVDGCN

SEQ ID NO: 2670524 - protein, 19 aa, Entamoeba histolytica
CLFYKCYHLTKIVLPEVSC

SEQ ID NO: 2670525 - protein, 18 aa, Entamoeba histolytica
CLGGTMIRRMSNLAHSLK

SEQ ID NO: 2670526 - protein, 24 aa, Entamoeba histolytica
CLGTNKEKIVCMGVYSEGQYGIPK

SEQ ID NO: 2670527 - protein, 18 aa, Entamoeba histolytica
CLHSVLTLGYIISNKTSA

SEQ ID NO: 2670528 - protein, 19 aa, Entamoeba histolytica
CLIDELGPRFILKLRSIQR

SEQ ID NO: 2670529 - protein, 20 aa, Entamoeba histolytica
CLIELELLKKEIGSYQKGIR

SEQ ID NO: 2670530 - protein, 19 aa, Entamoeba histolytica
CLINKLWFNKLLDIDIKNT

SEQ ID NO: 2670531 - protein, 25 aa, Entamoeba histolytica
CLIREFPINLSLILWDGYISEPNGN

SEQ ID NO: 2670532 - protein, 25 aa, Entamoeba histolytica
CLKCNKTCHYPCGIAGDVKDGCACI

SEQ ID NO: 2670533 - protein, 26 aa, Entamoeba histolytica
CLKCNKTCHYPCGIAGDVKDGCACID

SEQ ID NO: 2670534 - protein, 19 aa, Entamoeba histolytica
CLKEITVDFFNVFNSSYLN

SEQ ID NO: 2670535 - protein, 22 aa, Entamoeba histolytica
CLKGCNVKPVLDKGPNVMTISR

SEQ ID NO: 2670536 - protein, 29 aa, Entamoeba histolytica
CLKHFSVFTKPHWKKILLDTFNHCTNIET

SEQ ID NO: 2670537 - protein, 19 aa, Entamoeba histolytica
CLKHRRPLNNMSILDFVSK

SEQ ID NO: 2670538 - protein, 18 aa, Entamoeba histolytica
CLKNIIFINEFEVEQPSK

SEQ ID NO: 2670539 - protein, 21 aa, Entamoeba histolytica
CLKTIHCLLRNPNIVNVEGES

SEQ ID NO: 2670540 - protein, 19 aa, Entamoeba histolytica
CLLENRKVIGISFHNQPSI

SEQ ID NO: 2670541 - protein, 24 aa, Entamoeba histolytica
CLLFFTDKGFIFGVCHKRIELNIT

SEQ ID NO: 2670542 - protein, 20 aa, Entamoeba histolytica
CLLIIIECYNKPVALQYSIE

SEQ ID NO: 2670543 - protein, 19 aa, Entamoeba histolytica
CLLLHGGIDQIDRQNTIQE

SEQ ID NO: 2670544 - protein, 24 aa, Entamoeba histolytica
CLLLKKRFVPKMKDILETEDQVSH

SEQ ID NO: 2670545 - protein, 19 aa, Entamoeba histolytica
CLLYALKIKYPEHIYLIRG

SEQ ID NO: 2670546 - protein, 18 aa, Entamoeba histolytica
CLLYLFKIQFPNQFFLLR

SEQ ID NO: 2670547 - protein, 20 aa, Entamoeba histolytica
CLMKPLPSYKDRVFTTNEVG

SEQ ID NO: 2670548 - protein, 26 aa, Entamoeba histolytica
CLNFSNPNCEEAFSLFQQRSANMNAK

SEQ ID NO: 2670549 - protein, 17 aa, Entamoeba histolytica
CLNTWVGGKLYLTNYRL

SEQ ID NO: 2670550 - protein, 28 aa, Entamoeba histolytica
CLNYTNDWIDGRMIKLILGPEDPLGKMK

SEQ ID NO: 2670551 - protein, 21 aa, Entamoeba histolytica
CLPFDDFCLLAILQSTPPLET

SEQ ID NO: 2670552 - protein, 26 aa, Entamoeba histolytica
CLPIFELYGIFLLQLFCSNDFLIQTL

SEQ ID NO: 2670553 - protein, 18 aa, Entamoeba histolytica
CLQTLEILHRVSPTVFHH

SEQ ID NO: 2670554 - protein, 20 aa, Entamoeba histolytica
CLSGSEWYSIQALRAVNQAV

SEQ ID NO: 2670555 - protein, 24 aa, Entamoeba histolytica
CLSKPENKALHYARKAVEIAEDMA

SEQ ID NO: 2670556 - protein, 21 aa, Entamoeba histolytica
CLSTLRLDKDWSPVSTLNHVV

SEQ ID NO: 2670557 - protein, 18 aa, Entamoeba histolytica
CLTSLEICQKAKSYTLPN

SEQ ID NO: 2670558 - protein, 19 aa, Entamoeba histolytica
CLVDLHFLMIQEILNVEKV

SEQ ID NO: 2670559 - protein, 27 aa, Entamoeba histolytica
CLVMVGGKPIIQWQLEVLEKLNVKELE

SEQ ID NO: 2670560 - protein, 20 aa, Entamoeba histolytica
CLVTRSPEHCIIKFVENNDI

SEQ ID NO: 2670561 - protein, 17 aa, Entamoeba histolytica
CLVVLGIDGHSYVKKVL

SEQ ID NO: 2670562 - protein, 17 aa, Entamoeba histolytica
CLYDETISYTVINNLVM

SEQ ID NO: 2670563 - protein, 18 aa, Entamoeba histolytica
CLYKEVLEKRLQDFIEIY

SEQ ID NO: 2670564 - protein, 22 aa, Entamoeba histolytica
CLYPSQTGVIIAFDLAYNTYSA

SEQ ID NO: 2670565 - protein, 20 aa, Entamoeba histolytica
CLYVKDTRVYIGFKTGNFTC

SEQ ID NO: 2670566 - protein, 17 aa, Entamoeba histolytica
CMDAKYPYITFHTPNKV

SEQ ID NO: 2670567 - protein, 18 aa, Entamoeba histolytica
CMDKSRLDYIFQLKRPNE

SEQ ID NO: 2670568 - protein, 21 aa, Entamoeba histolytica
CMECIKQYGDCLNNISSTSTN

SEQ ID NO: 2670569 - protein, 21 aa, Entamoeba histolytica
CMIEIFKKLHSSWVGVQLLLN

SEQ ID NO: 2670570 - protein, 25 aa, Entamoeba histolytica
CMKCKVCNCNLSISSYKLLKGTNEI

SEQ ID NO: 2670571 - protein, 17 aa, Entamoeba histolytica
CMLGELGVGKTSIVLRY

SEQ ID NO: 2670572 - protein, 17 aa, Entamoeba histolytica
CMRLCKHPNLVEYKDFF

SEQ ID NO: 2670573 - protein, 30 aa, Entamoeba histolytica; identical to SEQ ID NO: 2476164

SEQ ID NO: 2670574 - protein, 24 aa, Entamoeba histolytica
CNCLYRGLYPYTIVQFDYFFIAFD

SEQ ID NO: 2670575 - protein, 24 aa, Entamoeba histolytica
CNCWMEEDNLLGLCLCTDETKIIL

SEQ ID NO: 2670576 - protein, 27 aa, Entamoeba histolytica
CNDRIKEMIKRGASPYQYYDSWDQLTV

SEQ ID NO: 2670577 - protein, 19 aa, Entamoeba histolytica
CNECIKKIDQTIIFQTNTN

SEQ ID NO: 2670578 - protein, 19 aa, Entamoeba histolytica
CNEQLKILLNTSSMDVIDF

SEQ ID NO: 2670579 - protein, 19 aa, Entamoeba histolytica
CNFDYRTNRILNVVDQLLE

SEQ ID NO: 2670580 - protein, 18 aa, Entamoeba histolytica
CNFTCQFCQNWDISQCAL

SEQ ID NO: 2670581 - protein, 25 aa, Entamoeba histolytica
CNFVSLVSGFCCSSFNDTKLVCGTT

SEQ ID NO: 2670582 - protein, 31 aa, Entamoeba histolytica
CNGFLPKKEMYYCLCLADFLVKQCPEFRPQM

SEQ ID NO: 2670583 - protein, 20 aa, Entamoeba histolytica
CNGKEPYIKHGILGADILRE

SEQ ID NO: 2670584 - protein, 20 aa, Entamoeba histolytica
CNGKNVLKCNDCNRHCHEFC

SEQ ID NO: 2670585 - protein, 19 aa, Entamoeba histolytica
CNGLVLWLDCDREGENICF

SEQ ID NO: 2670586 - protein, 25 aa, Entamoeba histolytica
CNGPIRWYCCGPTVYDDSHLGHART

SEQ ID NO: 2670587 - protein, 20 aa, Entamoeba histolytica
CNGYLKILMERKFIPEFKQT

SEQ ID NO: 2670588 - protein, 17 aa, Entamoeba histolytica
CNHKEMFEHAIKGGFAV

SEQ ID NO: 2670589 - protein, 19 aa, Entamoeba histolytica
CNHKEMFEHAIKGGFAVPG

SEQ ID NO: 2670590 - protein, 31 aa, Entamoeba histolytica
CNHMTCPRCHGEWCWMCRGDWKTHGTKTGGF

SEQ ID NO: 2670591 - protein, 17 aa, Entamoeba histolytica
CNHVIKRLQSIKHVSSL

SEQ ID NO: 2670592 - protein, 17 aa, Entamoeba histolytica
CNIKDVILDTTTERILK

SEQ ID NO: 2670593 - protein, 26 aa, Entamoeba histolytica
CNILPIKRMLSPLIRVEVSKALSLSG

SEQ ID NO: 2670594 - protein, 22 aa, Entamoeba histolytica
CNINGTFYHKSCMKCKVCNCNL

SEQ ID NO: 2670595 - protein, 19 aa, Entamoeba histolytica
CNIPFTIATSSDWGNVQVF

SEQ ID NO: 2670596 - protein, 18 aa, Entamoeba histolytica
CNKCHQILEVSSWDLNDK

SEQ ID NO: 2670597 - protein, 20 aa, Entamoeba histolytica
CNKEECNVFELCGGRCMYAN

SEQ ID NO: 2670598 - protein, 28 aa, Entamoeba histolytica
CNKILDIKWVGNVICCIGGLYDGKEYKD

SEQ ID NO: 2670599 - protein, 18 aa, Entamoeba histolytica
CNLIMTWPAFSNKAQFPD

SEQ ID NO: 2670600 - protein, 17 aa, Entamoeba histolytica
CNLPTGVAMITVDKTAQ

SEQ ID NO: 2670601 - protein, 17 aa, Entamoeba histolytica
CNLSTNEGFLFPMSDSF

SEQ ID NO: 2670602 - protein, 18 aa, Entamoeba histolytica
CNNSPLQKRLMPFDYEKI

SEQ ID NO: 2670603 - protein, 19 aa, Entamoeba histolytica
CNPLVEFPVCITKCQSLKI

SEQ ID NO: 2670604 - protein, 19 aa, Entamoeba histolytica
CNQLRRLGSSLDWSREVFT

SEQ ID NO: 2670605 - protein, 19 aa, Entamoeba histolytica
CNQSVRWAIENAKEHDKES

SEQ ID NO: 2670606 - protein, 18 aa, Entamoeba histolytica
CNRNWCHCIILSNPIQLY

SEQ ID NO: 2670607 - protein, 24 aa, Entamoeba histolytica
CNRTIEFVEQLGFTIEQRGTRSTK

SEQ ID NO: 2670608 - protein, 24 aa, Entamoeba histolytica
CNSCNEKEIWICLHCLHIGCSRYC

SEQ ID NO: 2670609 - protein, 21 aa, Entamoeba histolytica
CNSIKEFYIPPLAKVVEVSHC

SEQ ID NO: 2670610 - protein, 21 aa, Entamoeba histolytica
CNSIPFATKVMINFKEPPPQD

SEQ ID NO: 2670611 - protein, 19 aa, Entamoeba histolytica
CNSISWIILSFISPNNIYG

SEQ ID NO: 2670612 - protein, 19 aa, Entamoeba histolytica
CNSLKSGTILCYLAKTIDD

SEQ ID NO: 2670613 - protein, 27 aa, Entamoeba histolytica
CNSNFSFYWDLLKICQRKIKESQLPFE

SEQ ID NO: 2670614 - protein, 31 aa, Entamoeba histolytica
CNTAKFKGIPCFWGRIIKRLPYFTPNTKEYP

SEQ ID NO: 2670615 - protein, 18 aa, Entamoeba histolytica
CNTFNLILLKANIIASLL

SEQ ID NO: 2670616 - protein, 17 aa, Entamoeba histolytica
CNVFDSFDNLKEGMISV

SEQ ID NO: 2670617 - protein, 18 aa, Entamoeba histolytica
CNVGVCYGDVSVGRIFLG

SEQ ID NO: 2670618 - protein, 19 aa, Entamoeba histolytica
CNVLKKYTFDYEVYSSLMQ

SEQ ID NO: 2670619 - protein, 22 aa, Entamoeba histolytica
CNWTEDELINWLGEGLEEEDKI

SEQ ID NO: 2670620 - protein, 17 aa, Entamoeba histolytica
CNYKITITFNINQNTQN

SEQ ID NO: 2670621 - protein, 26 aa, Entamoeba histolytica
CPADYVCVGVCALFNLAITPSVRTLL

SEQ ID NO: 2670622 - protein, 27 aa, Entamoeba histolytica
CPAPHKCPVCNALIYSPFTICDIVIQP

SEQ ID NO: 2670623 - protein, 21 aa, Entamoeba histolytica
CPDCTTPYCCSLHCLYDREEH

SEQ ID NO: 2670624 - protein, 22 aa, Entamoeba histolytica
CPECISEPALTLFLNCISNKNE

SEQ ID NO: 2670625 - protein, 19 aa, Entamoeba histolytica
CPECKSLDTELIKENRINF

SEQ ID NO: 2670626 - protein, 19 aa, Entamoeba histolytica
CPEGYRVVNNIGEDAGQTV

SEQ ID NO: 2670627 - protein, 19 aa, Entamoeba histolytica
CPELIDLYSTSAWQDCFIT

SEQ ID NO: 2670628 - protein, 19 aa, Entamoeba histolytica
CPENLKLGNFEIQIDKPQP

SEQ ID NO: 2670629 - protein, 28 aa, Entamoeba histolytica
CPEWFLHHKHMFVYTLAGKPAFSRYGND

SEQ ID NO: 2670630 - protein, 22 aa, Entamoeba histolytica
CPFNRLPPKESYGFVDCGFVME

SEQ ID NO: 2670631 - protein, 17 aa, Entamoeba histolytica
CPGHCVMFASKKRSYRE

SEQ ID NO: 2670632 - protein, 17 aa, Entamoeba histolytica
CPGREFVMETTVVLTWE

SEQ ID NO: 2670633 - protein, 21 aa, Entamoeba histolytica
CPGYKIEKGTILKIIVPYGTY

SEQ ID NO: 2670634 - protein, 21 aa, Entamoeba histolytica
CPHCLTKLVSVDNCYCISMDE

SEQ ID NO: 2670635 - protein, 25 aa, Entamoeba histolytica
CPHLEDWTSICICVIHILDDLFTSS

SEQ ID NO: 2670636 - protein, 20 aa, Entamoeba histolytica
CPICRTRFSKKLRHKKEIDL

SEQ ID NO: 2670637 - protein, 19 aa, Entamoeba histolytica
CPIDCRRDLYKNIILSGGS

SEQ ID NO: 2670638 - protein, 19 aa, Entamoeba histolytica
CPITCVFDLLFVNKKIKKA

SEQ ID NO: 2670639 - protein, 20 aa, Entamoeba histolytica
CPKCGRRKCRHCDAYGISVE

SEQ ID NO: 2670640 - protein, 19 aa, Entamoeba histolytica
CPKKHKFTIRSLKQKAKIT

SEQ ID NO: 2670641 - protein, 23 aa, Entamoeba histolytica
CPKNELRFGYFKNEDIAISVYGN

SEQ ID NO: 2670642 - protein, 20 aa, Entamoeba histolytica
CPLCRHKNPIVIYTKKPMLF

SEQ ID NO: 2670643 - protein, 24 aa, Entamoeba histolytica
CPLELKSACGAILYASPYFPDHTE

SEQ ID NO: 2670644 - protein, 17 aa, Entamoeba histolytica
CPLGPDGKRDWECIEAL

SEQ ID NO: 2670645 - protein, 18 aa, Entamoeba histolytica
CPLKVEIDDCVFIHNDPP

SEQ ID NO: 2670646 - protein, 20 aa, Entamoeba histolytica
CPLLTSVELRMCSGVTDNGI

SEQ ID NO: 2670647 - protein, 24 aa, Entamoeba histolytica
CPLLTTVELRMCVNVTDSGIQMLL

SEQ ID NO: 2670648 - protein, 17 aa, Entamoeba histolytica
CPMEMTFAEVILVLKAN

SEQ ID NO: 2670649 - protein, 43 aa, Entamoeba histolytica
CPNYIEYSTWLNIIPLKMRCNEVFGVPLSVGVKKSGWRFPLPI

SEQ ID NO: 2670650 - protein, 17 aa, Entamoeba histolytica
CPPIYGHYIVKTAIVLV

SEQ ID NO: 2670651 - protein, 18 aa, Entamoeba histolytica
CPQCHKHMKYYCYNCRKQ

SEQ ID NO: 2670652 - protein, 20 aa, Entamoeba histolytica
CPRCHQGVCSVKCYQTHNNG

SEQ ID NO: 2670653 - protein, 19 aa, Entamoeba histolytica
CPSDLCGMTSLRSLDLSYN

SEQ ID NO: 2670654 - protein, 18 aa, Entamoeba histolytica
CPSNLQVLNLSSYTKNFK

SEQ ID NO: 2670655 - protein, 20 aa, Entamoeba histolytica
CPTCSLKFNLPQNASYSQQT

SEQ ID NO: 2670656 - protein, 21 aa, Entamoeba histolytica
CPTVRSLLVVLIFKIMSSGYN

SEQ ID NO: 2670657 - protein, 19 aa, Entamoeba histolytica
CPVDTCGRAIHYFDTSRNE

SEQ ID NO: 2670658 - protein, 19 aa, Entamoeba histolytica
CPVLGKTALPYSLTTLNVM

SEQ ID NO: 2670659 - protein, 18 aa, Entamoeba histolytica
CPVVKNIINSVMLQLGEM

SEQ ID NO: 2670660 - protein, 21 aa, Entamoeba histolytica
CQCRGRYDAILKFLKVTTKPS

SEQ ID NO: 2670661 - protein, 22 aa, Entamoeba histolytica
CQEKLCFRFVNKTKLYREVTPE

SEQ ID NO: 2670662 - protein, 19 aa, Entamoeba histolytica
CQFAVSFQGGVVMLIEPRT

SEQ ID NO: 2670663 - protein, 23 aa, Entamoeba histolytica
CQHLSVLRLRKLEAITKDELINW

SEQ ID NO: 2670664 - protein, 19 aa, Entamoeba histolytica
CQHRIPLILNKFPQQKISE

SEQ ID NO: 2670665 - protein, 19 aa, Entamoeba histolytica
CQIAICVKGSVSISVAKKF

SEQ ID NO: 2670666 - protein, 19 aa, Entamoeba histolytica
CQINGAIPFRQESFIEEME

SEQ ID NO: 2670667 - protein, 17 aa, Entamoeba histolytica
CQISRKFYDNNIKSLTN

SEQ ID NO: 2670668 - protein, 18 aa, Entamoeba histolytica
CQIYHQFKAFVLPPSNAF

SEQ ID NO: 2670669 - protein, 18 aa, Entamoeba histolytica
CQKFMMIYQLNSGELFGT

SEQ ID NO: 2670670 - protein, 31 aa, Entamoeba histolytica
CQKRYLERRKEVWVAPLYFEFPGYEQAMFKE

SEQ ID NO: 2670671 - protein, 22 aa, Entamoeba histolytica
CQLHSLRLISTWLDTFSPTLRS

SEQ ID NO: 2670672 - protein, 18 aa, Entamoeba histolytica
CQLLKNFIESSVTFSDIT

SEQ ID NO: 2670673 - protein, 18 aa, Entamoeba histolytica
CQLNRIHGLFEVLKDKIY

SEQ ID NO: 2670674 - protein, 19 aa, Entamoeba histolytica
CQMSKKMAIGDGIKRAFRL

SEQ ID NO: 2670675 - protein, 35 aa, Entamoeba histolytica
CQNIQDCLNLLVSSWKNTESMIINNVNMEIEKELK

SEQ ID NO: 2670676 - protein, 19 aa, Entamoeba histolytica
CQNYLFKIIETCLQDNSTE

SEQ ID NO: 2670677 - protein, 27 aa, Entamoeba histolytica
CQPGKVGFVRYNWIYPFLTKESFYKFG

SEQ ID NO: 2670678 - protein, 22 aa, Entamoeba histolytica
CQRCKQMLYSHIDLSKTINDVI

SEQ ID NO: 2670679 - protein, 24 aa, Entamoeba histolytica
CQRLRKFAKPEMKVLIEGFEKIII

SEQ ID NO: 2670680 - protein, 19 aa, Entamoeba histolytica
CQRVFGVIRDSFWRNARSK

SEQ ID NO: 2670681 - protein, 21 aa, Entamoeba histolytica
CQSCLKKTKCSGICPICTDCC

SEQ ID NO: 2670682 - protein, 17 aa, Entamoeba histolytica
CQSEIISAISIDTGIEN

SEQ ID NO: 2670683 - protein, 20 aa, Entamoeba histolytica
CQSLPLNLFLFVDKKPIIDI

SEQ ID NO: 2670684 - protein, 20 aa, Entamoeba histolytica
CQSNYICLHHWRENRREYLE

SEQ ID NO: 2670685 - protein, 19 aa, Entamoeba histolytica
CQTFYHLLCLKRLGRENHL

SEQ ID NO: 2670686 - protein, 18 aa, Entamoeba histolytica
CQTIKGLVVAIADKLSLH

SEQ ID NO: 2670687 - protein, 24 aa, Entamoeba histolytica
CQVCGAKFTTLFRKHHCRKCGLCI

SEQ ID NO: 2670688 - protein, 17 aa, Entamoeba histolytica
CQVLVLWLDCDREGENI

SEQ ID NO: 2670689 - protein, 30 aa, Entamoeba histolytica
CQYEPEVFPGLVYRMASPKVTLLVFSTGKV

SEQ ID NO: 2670690 - protein, 31 aa, Entamoeba histolytica; identical to SEQ ID NO: 2476279

SEQ ID NO: 2670691 - protein, 19 aa, Entamoeba histolytica
CRCEADGKECCPNRHNGCR

SEQ ID NO: 2670692 - protein, 17 aa, Entamoeba histolytica
CRCKGVCDKNCVCVKHG

SEQ ID NO: 2670693 - protein, 17 aa, Entamoeba histolytica
CRCKIIPEEVYMDDADE

SEQ ID NO: 2670694 - protein, 29 aa, Entamoeba histolytica
CRCLDYLTVRICLWVLYQLLCKIKTIIEM

SEQ ID NO: 2670695 - protein, 32 aa, Entamoeba histolytica
CRDEVKWAEFEYCVLFPFNVLKMTNTKVMIKY

SEQ ID NO: 2670696 - protein, 19 aa, Entamoeba histolytica
CRDVLELFSTSLIDFNTNR

SEQ ID NO: 2670697 - protein, 18 aa, Entamoeba histolytica
CREMADGTPPYMDFPPMK

SEQ ID NO: 2670698 - protein, 21 aa, Entamoeba histolytica
CRFTDSCKNILCWEETGNIDF

SEQ ID NO: 2670699 - protein, 18 aa, Entamoeba histolytica
CRICECYVHSKCVHGLSH

SEQ ID NO: 2670700 - protein, 21 aa, Entamoeba histolytica
CRIGVCRVLFVGAHFSANMGP

SEQ ID NO: 2670701 - protein, 27 aa, Entamoeba histolytica
CRKAPKPRYFVLCTDILFYTRPKKREV

SEQ ID NO: 2670702 - protein, 33 aa, Entamoeba histolytica
CRKIIPPQFKCCLCSICGIKLHEECITLIRCGC

SEQ ID NO: 2670703 - protein, 24 aa, Entamoeba histolytica
CRKTPKPRYFILFNDQLIYGTETM

SEQ ID NO: 2670704 - protein, 17 aa, Entamoeba histolytica
CRLKIDKIYCGKGIKKV

SEQ ID NO: 2670705 - protein, 19 aa, Entamoeba histolytica
CRLVNEIMDVPLYISADET

SEQ ID NO: 2670706 - protein, 17 aa, Entamoeba histolytica
CRNRHLEKNISILYRLI

SEQ ID NO: 2670707 - protein, 17 aa, Entamoeba histolytica
CRSHLSALPPSEQSMNL

SEQ ID NO: 2670708 - protein, 18 aa, Entamoeba histolytica
CRTIYQLTFDTHRDQLDP

SEQ ID NO: 2670709 - protein, 25 aa, Entamoeba histolytica
CRTMKQRPGIVGLWGEDGNVYIYDM

SEQ ID NO: 2670710 - protein, 17 aa, Entamoeba histolytica
CRYFSKESGDGIFSKSY

SEQ ID NO: 2670711 - protein, 21 aa, Entamoeba histolytica
CSAIYMKIVISKILNGLETTF

SEQ ID NO: 2670712 - protein, 19 aa, Entamoeba histolytica
CSCAGRIITWCKKYAQSKQ

SEQ ID NO: 2670713 - protein, 17 aa, Entamoeba histolytica
CSCDITLLQLIIENGLN

SEQ ID NO: 2670714 - protein, 20 aa, Entamoeba histolytica
CSCEYEDLFSALLCVSYAAE

SEQ ID NO: 2670715 - protein, 26 aa, Entamoeba histolytica
CSCGKFKVICVYGGVDIQGQINKLQS

SEQ ID NO: 2670716 - protein, 20 aa, Entamoeba histolytica
CSCNKWKKYVNNILNYLISF

SEQ ID NO: 2670717 - protein, 22 aa, Entamoeba histolytica
CSCPTLYLIPRIITFTEHQLIL

SEQ ID NO: 2670718 - protein, 19 aa, Entamoeba histolytica
CSDAGIAVQCMDNSHVSLV

SEQ ID NO: 2670719 - protein, 25 aa, Entamoeba histolytica
CSDSSIRLYDFKKTQVVNGMNPQAK

SEQ ID NO: 2670720 - protein, 19 aa, Entamoeba histolytica
CSDTSDMFCMAIISNGCNV

SEQ ID NO: 2670721 - protein, 23 aa, Entamoeba histolytica
CSEEIATICAMLQISGELFYRPK

SEQ ID NO: 2670722 - protein, 26 aa, Entamoeba histolytica
CSEFMGELYLKCFDQFNEQIRSTEGF

SEQ ID NO: 2670723 - protein, 21 aa, Entamoeba histolytica
CSENFCGLIANCAKDQSIHYE

SEQ ID NO: 2670724 - protein, 21 aa, Entamoeba histolytica
CSFDSFNLKCKNLQSIVAEST

SEQ ID NO: 2670725 - protein, 20 aa, Entamoeba histolytica
CSFETFPIAGDLPRLLKHLS

SEQ ID NO: 2670726 - protein, 18 aa, Entamoeba histolytica
CSFFLRSNFVKTWENYFY

SEQ ID NO: 2670727 - protein, 19 aa, Entamoeba histolytica
CSGIHREFGHRVKSISMAT

SEQ ID NO: 2670728 - protein, 19 aa, Entamoeba histolytica
CSGKTTFANQLVKYINENY

SEQ ID NO: 2670729 - protein, 17 aa, Entamoeba histolytica
CSGLDKYSFPITVNQGS

SEQ ID NO: 2670730 - protein, 25 aa, Entamoeba histolytica
CSHLKSSQCYILFDSNTLPELTDKI

SEQ ID NO: 2670731 - protein, 17 aa, Entamoeba histolytica
CSHPQFIEYEKFNIEEY

SEQ ID NO: 2670732 - protein, 26 aa, Entamoeba histolytica
CSIGIIADGCGWGFRSKKASSNAVSG

SEQ ID NO: 2670733 - protein, 17 aa, Entamoeba histolytica
CSIKPEILVVGNKIDSE

SEQ ID NO: 2670734 - protein, 17 aa, Entamoeba histolytica
CSIPFGIENENIPLDYN

SEQ ID NO: 2670735 - protein, 22 aa, Entamoeba histolytica
CSIRKFSTIYLFNFPEMDLSPF

SEQ ID NO: 2670736 - protein, 27 aa, Entamoeba histolytica
CSKIRKIRINIDFSMKFQLKHPNYFIQ

SEQ ID NO: 2670737 - protein, 24 aa, Entamoeba histolytica
CSKNESACLCALCFNGSDHKGHDY

SEQ ID NO: 2670738 - protein, 19 aa, Entamoeba histolytica
CSKSFEAIQQAFILSLLNN

SEQ ID NO: 2670739 - protein, 19 aa, Entamoeba histolytica
CSLGRVPSLLLIENETMIG

SEQ ID NO: 2670740 - protein, 19 aa, Entamoeba histolytica
CSLKSLVIERSTCPFPFSL

SEQ ID NO: 2670741 - protein, 17 aa, Entamoeba histolytica
CSLPTIIFMHRGVEEKR

SEQ ID NO: 2670742 - protein, 28 aa, Entamoeba histolytica
CSLYPSAIARLYLPLSSPNRMVQPIEWY

SEQ ID NO: 2670743 - protein, 24 aa, Entamoeba histolytica
CSLYPSAVARQFLPSGAPRVMKKP

SEQ ID NO: 2670744 - protein, 17 aa, Entamoeba histolytica
CSMLLSLLGEEENKNTF

SEQ ID NO: 2670745 - protein, 19 aa, Entamoeba histolytica
CSNISDFIFNPYLVDVNVI

SEQ ID NO: 2670746 - protein, 25 aa, Entamoeba histolytica
CSNKDIKMSWCAKLDSQISQTQEQT

SEQ ID NO: 2670747 - protein, 19 aa, Entamoeba histolytica
CSNLTLIDFGYGWNTIKEG

SEQ ID NO: 2670748 - protein, 20 aa, Entamoeba histolytica
CSPAFWKFLDLIGNKIELNG

SEQ ID NO: 2670749 - protein, 22 aa, Entamoeba histolytica
CSPEACGFVTMNRPGFIEENTA

SEQ ID NO: 2670750 - protein, 17 aa, Entamoeba histolytica
CSQRYCREELSIIEKEN

SEQ ID NO: 2670751 - protein, 23 aa, Entamoeba histolytica
CSRHYRAPELVFRTSKYNSSIDI

SEQ ID NO: 2670752 - protein, 26 aa, Entamoeba histolytica
CSRKDMFKKLVICILVTIKDGVCEQK

SEQ ID NO: 2670753 - protein, 24 aa, Entamoeba histolytica
CSRKEWELLKMLANKVIMKMVDRP

SEQ ID NO: 2670754 - protein, 18 aa, Entamoeba histolytica
CSRKIILKSIVDKETLRN

SEQ ID NO: 2670755 - protein, 18 aa, Entamoeba histolytica
CSSACNFGAIKPVSHIER

SEQ ID NO: 2670756 - protein, 17 aa, Entamoeba histolytica
CSSCFGIYCEKQKGRCP

SEQ ID NO: 2670757 - protein, 19 aa, Entamoeba histolytica
CSSCSSIEELELFLKSTCR

SEQ ID NO: 2670758 - protein, 17 aa, Entamoeba histolytica
CSSDLHFKFLNQEETLE

SEQ ID NO: 2670759 - protein, 19 aa, Entamoeba histolytica
CSSEELWSLALDPFLPDYL

SEQ ID NO: 2670760 - protein, 21 aa, Entamoeba histolytica
CSSFNCLFLPQLRELEIKSSI

SEQ ID NO: 2670761 - protein, 20 aa, Entamoeba histolytica
CSSKAVIYMHEYFKQFFTEY

SEQ ID NO: 2670762 - protein, 18 aa, Entamoeba histolytica
CSSLCPLNLPTTISELSF

SEQ ID NO: 2670763 - protein, 18 aa, Entamoeba histolytica
CSSLERIDIPTSVRRIRE

SEQ ID NO: 2670764 - protein, 21 aa, Entamoeba histolytica
CSSLRCLSRLMTPQIAPAIER

SEQ ID NO: 2670765 - protein, 25 aa, Entamoeba histolytica
CSSLSKLVLCSSLIHLGISSFENCK

SEQ ID NO: 2670766 - protein, 18 aa, Entamoeba histolytica
CSSLVKFGDSCFYQCHYR

SEQ ID NO: 2670767 - protein, 21 aa, Entamoeba histolytica
CSSNENWKWKYLTHLSSYLTP

SEQ ID NO: 2670768 - protein, 19 aa, Entamoeba histolytica
CSSNSFIVGVGCFNGNVFE

SEQ ID NO: 2670769 - protein, 19 aa, Entamoeba histolytica
CSSPGRIISCTPLDEYNYI

SEQ ID NO: 2670770 - protein, 21 aa, Entamoeba histolytica
CSSVCSCIPQITCHERGIDDI

SEQ ID NO: 2670771 - protein, 20 aa, Entamoeba histolytica
CSTCLREILVSDVTLNVYFH

SEQ ID NO: 2670772 - protein, 19 aa, Entamoeba histolytica
CSTFGFPPISNTLEEVICN

SEQ ID NO: 2670773 - protein, 19 aa, Entamoeba histolytica
CSTILKFVFINKKCGEVPK

SEQ ID NO: 2670774 - protein, 29 aa, Entamoeba histolytica
CSTLSLCTSSIMLKQKFFASIVDEAAQSL

SEQ ID NO: 2670775 - protein, 17 aa, Entamoeba histolytica
CSTLTICTRSIMLKQKF

SEQ ID NO: 2670776 - protein, 17 aa, Entamoeba histolytica
CSVIELEFQIGKMKMIK

SEQ ID NO: 2670777 - protein, 18 aa, Entamoeba histolytica
CSVNCPKKCISFGEDGRA

SEQ ID NO: 2670778 - protein, 19 aa, Entamoeba histolytica
CSVPFNRVKEAGIGGGNKS

SEQ ID NO: 2670779 - protein, 27 aa, Entamoeba histolytica
CSYEPQNDCALWFIKVFPGNREFMMRA

SEQ ID NO: 2670780 - protein, 30 aa, Entamoeba histolytica
CSYFIEYNYYYPIVIPFSIKVIKEVIVLNN

SEQ ID NO: 2670781 - protein, 18 aa, Entamoeba histolytica
CSYFKQSDPFLLSNISII

SEQ ID NO: 2670782 - protein, 30 aa, Entamoeba histolytica; identical to SEQ ID NO: 2476400

SEQ ID NO: 2670783 - protein, 17 aa, Entamoeba histolytica
CSYHSLNVARVLLINGI

SEQ ID NO: 2670784 - protein, 19 aa, Entamoeba histolytica
CSYKIPKKYAEKLLKECKE

SEQ ID NO: 2670785 - protein, 18 aa, Entamoeba histolytica
CSYNHSLYMVYQGMNQSC

SEQ ID NO: 2670786 - protein, 17 aa, Entamoeba histolytica
CSYRLGITKLDIPENDP

SEQ ID NO: 2670787 - protein, 21 aa, Entamoeba histolytica
CSYYALSCGKYVQYYGPLPSV

SEQ ID NO: 2670788 - protein, 26 aa, Entamoeba histolytica
CTAILDWAANQHVGFSYFVSIGSSID

SEQ ID NO: 2670789 - protein, 27 aa, Entamoeba histolytica
CTDKMILPILKFIHGIVSIELVDEIEN

SEQ ID NO: 2670790 - protein, 18 aa, Entamoeba histolytica
CTEAGMFAIRARRKVVTE

SEQ ID NO: 2670791 - protein, 19 aa, Entamoeba histolytica
CTEAGMFAIRARRKVVTER

SEQ ID NO: 2670792 - protein, 17 aa, Entamoeba histolytica
CTEDSYHLVSLKVLSTV

SEQ ID NO: 2670793 - protein, 19 aa, Entamoeba histolytica
CTEEALTIAAMLTVPNVFL

SEQ ID NO: 2670794 - protein, 17 aa, Entamoeba histolytica
CTEFRERVLLTFIHTNG

SEQ ID NO: 2670795 - protein, 17 aa, Entamoeba histolytica
CTERLIRILKLEYDGFV

SEQ ID NO: 2670796 - protein, 25 aa, Entamoeba histolytica
CTEVTKAIVVKGVIQIEINGMFFAI

SEQ ID NO: 2670797 - protein, 25 aa, Entamoeba histolytica
CTFLFCLKLQYPNRVHLLRGNHECR

SEQ ID NO: 2670798 - protein, 18 aa, Entamoeba histolytica
CTFRDCLLSLGATSQASR

SEQ ID NO: 2670799 - protein, 20 aa, Entamoeba histolytica
CTGLQGFFIYNSVGGGTGSG

SEQ ID NO: 2670800 - protein, 18 aa, Entamoeba histolytica
CTGNFCRNRNNVMGECRR

SEQ ID NO: 2670801 - protein, 19 aa, Entamoeba histolytica
CTHYSTAVDIWAFGCVVAE

SEQ ID NO: 2670802 - protein, 18 aa, Entamoeba histolytica
CTIFKLSKPPLVLFPNKQ

SEQ ID NO: 2670803 - protein, 18 aa, Entamoeba histolytica
CTIFNLDCVPPIYRQIMF

SEQ ID NO: 2670804 - protein, 18 aa, Entamoeba histolytica
CTIFSRELPHHYCFVIAQ

SEQ ID NO: 2670805 - protein, 18 aa, Entamoeba histolytica
CTIHGGKIIDGKKNNVQE

SEQ ID NO: 2670806 - protein, 22 aa, Entamoeba histolytica
CTIMRRAVRLVKSCGRFVYSTC

SEQ ID NO: 2670807 - protein, 19 aa, Entamoeba histolytica
CTIQRFSKIIKEIEIGVIN

SEQ ID NO: 2670808 - protein, 24 aa, Entamoeba histolytica
CTKEKMLSIKLHWLQNTLNESEQN

SEQ ID NO: 2670809 - protein, 19 aa, Entamoeba histolytica
CTKPHFICICGDQDSDENT

SEQ ID NO: 2670810 - protein, 20 aa, Entamoeba histolytica
CTKPHFICICGDQYIDENTN

SEQ ID NO: 2670811 - protein, 21 aa, Entamoeba histolytica
CTKQILCIVLQMVYNNVQIIG

SEQ ID NO: 2670812 - protein, 19 aa, Entamoeba histolytica
CTKRQCGINSFPLKITAEK

SEQ ID NO: 2670813 - protein, 19 aa, Entamoeba histolytica
CTKYKLPINKTRVLLFGKS

SEQ ID NO: 2670814 - protein, 21 aa, Entamoeba histolytica
CTLTIHWQFDVTLRGLRKVLV

SEQ ID NO: 2670815 - protein, 17 aa, Entamoeba histolytica
CTLTRAFCGSNVADVIR

SEQ ID NO: 2670816 - protein, 20 aa, Entamoeba histolytica
CTLTSLELVSCVKAGFVLPN

SEQ ID NO: 2670817 - protein, 20 aa, Entamoeba histolytica
CTNKTWKQYIEWLKEKDLII

SEQ ID NO: 2670818 - protein, 25 aa, Entamoeba histolytica
CTNPNCPKPGCYRSYGSAKEDNPIC

SEQ ID NO: 2670819 - protein, 18 aa, Entamoeba histolytica
CTPNIFSFDEDLQFDQHQ

SEQ ID NO: 2670820 - protein, 19 aa, Entamoeba histolytica
CTQLILADCESLKNPIFPK

SEQ ID NO: 2670821 - protein, 22 aa, Entamoeba histolytica
CTQPRRVAAISVAQRVAEEMDV

SEQ ID NO: 2670822 - protein, 20 aa, Entamoeba histolytica
CTQPRRVAAISVSQRVAEEM

SEQ ID NO: 2670823 - protein, 19 aa, Entamoeba histolytica
CTQPVFRPTINSSHENIIM

SEQ ID NO: 2670824 - protein, 26 aa, Entamoeba histolytica
CTQRMCFAESFTGYYDKTMKRITTKS

SEQ ID NO: 2670825 - protein, 18 aa, Entamoeba histolytica
CTQRMCFANKLNIVGNGK

SEQ ID NO: 2670826 - protein, 17 aa, Entamoeba histolytica
CTSKKYLEEVIKIMKDI

SEQ ID NO: 2670827 - protein, 21 aa, Entamoeba histolytica
CTSNIFFGKIFPVACFNNEGT

SEQ ID NO: 2670828 - protein, 20 aa, Entamoeba histolytica
CTSQLPYLYVYITNNPVSIP

SEQ ID NO: 2670829 - protein, 19 aa, Entamoeba histolytica
CTSSIKKRIFILLRLLTLS

SEQ ID NO: 2670830 - protein, 25 aa, Entamoeba histolytica
CTSYLCLQPKFFGYDGPIEFLNKIL

SEQ ID NO: 2670831 - protein, 18 aa, Entamoeba histolytica
CTVCQSKGPFSIDVQNTI

SEQ ID NO: 2670832 - protein, 23 aa, Entamoeba histolytica
CTVDECKKVIAAKEEISKEIGEA

SEQ ID NO: 2670833 - protein, 18 aa, Entamoeba histolytica
CTVEDGFLFGLNNLKSIL

SEQ ID NO: 2670834 - protein, 18 aa, Entamoeba histolytica
CTVERRLEISRLIEELRQ

SEQ ID NO: 2670835 - protein, 19 aa, Entamoeba histolytica
CTVFNEFFLQRLLSTLLNF

SEQ ID NO: 2670836 - protein, 19 aa, Entamoeba histolytica
CTWMAKPRNQFKVTVTQNT

SEQ ID NO: 2670837 - protein, 20 aa, Entamoeba histolytica
CTYVEFRFAPIQSTNKGLSM

SEQ ID NO: 2670838 - protein, 18 aa, Entamoeba histolytica
CTYYLKALVPSTSYELQY

SEQ ID NO: 2670839 - protein, 29 aa, Entamoeba histolytica
CVAPRAAEIIWLLCFMNYVSKQSVSTTRD

SEQ ID NO: 2670840 - protein, 23 aa, Entamoeba histolytica
CVASEFMKAIVLPGIGFIGIADK

SEQ ID NO: 2670841 - protein, 18 aa, Entamoeba histolytica
CVCCQKVVHSTCLNKMLP

SEQ ID NO: 2670842 - protein, 20 aa, Entamoeba histolytica
CVDCSINLLHVLSHIPSIII

SEQ ID NO: 2670843 - protein, 20 aa, Entamoeba histolytica
CVDDFIFFCFLVGNDFLPHI

SEQ ID NO: 2670844 - protein, 25 aa, Entamoeba histolytica
CVDINWKYVTPRSFISASNDIDSLT

SEQ ID NO: 2670845 - protein, 20 aa, Entamoeba histolytica
CVDLKRLGVIDEIIDEVDKE

SEQ ID NO: 2670846 - protein, 41 aa, Entamoeba histolytica
CVDMDFGCFLCLKCGMIHKNFLKKLGICKIEDIQKHSMNDI

SEQ ID NO: 2670847 - protein, 21 aa, Entamoeba histolytica
CVEDCICIGLYYWTYDIPSFN

SEQ ID NO: 2670848 - protein, 25 aa, Entamoeba histolytica
CVEEVDCWRNVFNTEYDKNGPIING

SEQ ID NO: 2670849 - protein, 27 aa, Entamoeba histolytica
CVEGIAICLKTFLKMREFPKYTVKSSG

SEQ ID NO: 2670850 - protein, 18 aa, Entamoeba histolytica
CVEHFAVLCEILRAITKK

SEQ ID NO: 2670851 - protein, 20 aa, Entamoeba histolytica
CVEITRLIFEKMREENEVPC

SEQ ID NO: 2670852 - protein, 25 aa, Entamoeba histolytica
CVEPTIRRDILFSLLHGIKLKNLDY

SEQ ID NO: 2670853 - protein, 19 aa, Entamoeba histolytica
CVFKVIKALILNIDSKLAS

SEQ ID NO: 2670854 - protein, 28 aa, Entamoeba histolytica
CVFQYNCYGLYFAHCMALPQYKDVVCNL

SEQ ID NO: 2670855 - protein, 18 aa, Entamoeba histolytica
CVGIKRKPNEPILETKRK

SEQ ID NO: 2670856 - protein, 18 aa, Entamoeba histolytica
CVHCCTSAQRDNFIDEIC

SEQ ID NO: 2670857 - protein, 17 aa, Entamoeba histolytica
CVHPVLYFNPLSHSEPH

SEQ ID NO: 2670858 - protein, 24 aa, Entamoeba histolytica
CVHRYSEIISFHFFNSFNYLPIAC

SEQ ID NO: 2670859 - protein, 21 aa, Entamoeba histolytica
CVIAKGAALVAVQVGTKLRLL

SEQ ID NO: 2670860 - protein, 20 aa, Entamoeba histolytica
CVIEHLWDILSPKGIGYIVI

SEQ ID NO: 2670861 - protein, 17 aa, Entamoeba histolytica
CVIFYSFTDSDLVLNDQ

SEQ ID NO: 2670862 - protein, 18 aa, Entamoeba histolytica
CVIGDMSVGKTCISNRLI

SEQ ID NO: 2670863 - protein, 17 aa, Entamoeba histolytica
CVILKRNVPLLPVDDKF

SEQ ID NO: 2670864 - protein, 22 aa, Entamoeba histolytica
CVKETCNWRCLYWTLNDEGIAY

SEQ ID NO: 2670865 - protein, 18 aa, Entamoeba histolytica
CVKEYALFQNTQLVHTNF

SEQ ID NO: 2670866 - protein, 26 aa, Entamoeba histolytica
CVKHFRIVAVLLKYWLKIRNLNCPFK

SEQ ID NO: 2670867 - protein, 21 aa, Entamoeba histolytica
CVLLHYPFILDYMIIKIIHNT

SEQ ID NO: 2670868 - protein, 17 aa, Entamoeba histolytica
CVLPIGGSCCIPIVKKT

SEQ ID NO: 2670869 - protein, 19 aa, Entamoeba histolytica
CVLSGCLKISPMAYCTIVN

SEQ ID NO: 2670870 - protein, 19 aa, Entamoeba histolytica
CVMVSRWFGGILLGPDRFK

SEQ ID NO: 2670871 - protein, 21 aa, Entamoeba histolytica
CVNCGKKAAFSLRTSSEESIE

SEQ ID NO: 2670872 - protein, 19 aa, Entamoeba histolytica
CVNCYKQGTTRLMLTEIPY

SEQ ID NO: 2670873 - protein, 19 aa, Entamoeba histolytica
CVQNELYLANALMKDKQFQ

SEQ ID NO: 2670874 - protein, 26 aa, Entamoeba histolytica
CVQNGLVEMVNWLLAKGAYVNAADKF

SEQ ID NO: 2670875 - protein, 17 aa, Entamoeba histolytica
CVRHCLNYPANNCYGYI

SEQ ID NO: 2670876 - protein, 18 aa, Entamoeba histolytica
CVRQIFRKDNICPTCQKP

SEQ ID NO: 2670877 - protein, 26 aa, Entamoeba histolytica
CVSKLPFKFTLSFRSGNNIKIGAVVG

SEQ ID NO: 2670878 - protein, 32 aa, Entamoeba histolytica
CVSPRRHPFYGGSPMPCMMIAEELNKRNKREP

SEQ ID NO: 2670879 - protein, 19 aa, Entamoeba histolytica
CVSSMCFANCVSLTSLHLQ

SEQ ID NO: 2670880 - protein, 25 aa, Entamoeba histolytica
CVSTEFKEQMLLILGDFIEDCQYEQ

SEQ ID NO: 2670881 - protein, 17 aa, Entamoeba histolytica
CVSTGFNEESKWINETT

SEQ ID NO: 2670882 - protein, 22 aa, Entamoeba histolytica
CVTNSFKSCLVKNKITNEGDEK

SEQ ID NO: 2670883 - protein, 24 aa, Entamoeba histolytica
CVVCGCPLLFTGHLFDPPEDSFLS

SEQ ID NO: 2670884 - protein, 30 aa, Entamoeba histolytica; identical to SEQ ID NO: 2476489

SEQ ID NO: 2670885 - protein, 26 aa, Entamoeba histolytica
CVVKRIFDIAFYFKLNALRSNTTTYI

SEQ ID NO: 2670886 - protein, 21 aa, Entamoeba histolytica
CVVLMLLPRSKICSGDGVNVF

SEQ ID NO: 2670887 - protein, 20 aa, Entamoeba histolytica
CVVSGPGVDGGEDLDDCNDA

SEQ ID NO: 2670888 - protein, 17 aa, Entamoeba histolytica
CVYYSIKMLHSQYQEAQ

SEQ ID NO: 2670889 - protein, 20 aa, Entamoeba histolytica
CWDPDLRLTPTQAMQHPFLL

SEQ ID NO: 2670890 - protein, 17 aa, Entamoeba histolytica
CWFELAKNWNKYGTYKI

SEQ ID NO: 2670891 - protein, 24 aa, Entamoeba histolytica
CWGKEIWMKNYIIREDGVVEVPVK

SEQ ID NO: 2670892 - protein, 23 aa, Entamoeba histolytica
CWPAEAQNGLTLSMSYEATQELK

SEQ ID NO: 2670893 - protein, 22 aa, Entamoeba histolytica
CYAASGVQLIFGISEVRNKLKQ

SEQ ID NO: 2670894 - protein, 24 aa, Entamoeba histolytica
CYAKIAWCPYRWCSHYGQKRFTAN

SEQ ID NO: 2670895 - protein, 19 aa, Entamoeba histolytica
CYAYDFPLLCGGAVDGWKK

SEQ ID NO: 2670896 - protein, 18 aa, Entamoeba histolytica
CYCSMKRFPNDVINSVGT

SEQ ID NO: 2670897 - protein, 22 aa, Entamoeba histolytica
CYDGENKFEMKVLVTENEKQPF

SEQ ID NO: 2670898 - protein, 17 aa, Entamoeba histolytica
CYDMFHWGHANVIRQAC

SEQ ID NO: 2670899 - protein, 17 aa, Entamoeba histolytica
CYEETCVPRCFKCGKPL

SEQ ID NO: 2670900 - protein, 17 aa, Entamoeba histolytica
CYEILKTLQCYDLSPAV

SEQ ID NO: 2670901 - protein, 17 aa, Entamoeba histolytica
CYENCLNVANQLQSEVL

SEQ ID NO: 2670902 - protein, 17 aa, Entamoeba histolytica
CYFELRLSINGKNENEW

SEQ ID NO: 2670903 - protein, 22 aa, Entamoeba histolytica
CYFGNFLFNCVEPINPRPESLW

SEQ ID NO: 2670904 - protein, 22 aa, Entamoeba histolytica
CYGDCKMYVYGGWIDSEKKYNS

SEQ ID NO: 2670905 - protein, 22 aa, Entamoeba histolytica
CYGMHFFHTFKLFAVAQEKRLH

SEQ ID NO: 2670906 - protein, 19 aa, Entamoeba histolytica
CYHPFHFDSILKLAIQNKY

SEQ ID NO: 2670907 - protein, 19 aa, Entamoeba histolytica
CYIGNILFGILIYLLDEFD

SEQ ID NO: 2670908 - protein, 30 aa, Entamoeba histolytica
CYKCWNSTGKCCLKCYFLEKEKANQKKLEP

SEQ ID NO: 2670909 - protein, 25 aa, Entamoeba histolytica
CYKYNSRGLYKCPILIPNADLLYEY

SEQ ID NO: 2670910 - protein, 26 aa, Entamoeba histolytica
CYLILLSDFYRSVVLLLFKPYDYTVI

SEQ ID NO: 2670911 - protein, 20 aa, Entamoeba histolytica
CYLKTCPKCDLCLKPITGAY

SEQ ID NO: 2670912 - protein, 19 aa, Entamoeba histolytica
CYLNPGYGYEVYKEGADVL

SEQ ID NO: 2670913 - protein, 26 aa, Entamoeba histolytica
CYNYHKYKKIYIVEWARSPIHRASQA

SEQ ID NO: 2670914 - protein, 18 aa, Entamoeba histolytica
CYNYIPPKKIDEGKKEKE

SEQ ID NO: 2670915 - protein, 21 aa, Entamoeba histolytica
CYPVGWDKTYSLNYIKNKYSH

SEQ ID NO: 2670916 - protein, 20 aa, Entamoeba histolytica
CYQCNNICHDPCHCPHGIKD

SEQ ID NO: 2670917 - protein, 21 aa, Entamoeba histolytica
CYQLPSYFIKGITLVVSPLVS

SEQ ID NO: 2670918 - protein, 17 aa, Entamoeba histolytica
CYQNYYHCLSLFNQNKL

SEQ ID NO: 2670919 - protein, 25 aa, Entamoeba histolytica
CYQRERLPLPAARDFENASDNYLRA

SEQ ID NO: 2670920 - protein, 21 aa, Entamoeba histolytica
CYSLPPKVHLNLNCDMKEDPD

SEQ ID NO: 2670921 - protein, 25 aa, Entamoeba histolytica
CYSQLPSLLGNYAIKVPGRIWPLMV

SEQ ID NO: 2670922 - protein, 22 aa, Entamoeba histolytica
CYSSKLRSPISLRDNDFDVMND

SEQ ID NO: 2670923 - protein, 19 aa, Entamoeba histolytica
CYSYPCLKVDASNGSTQLS

SEQ ID NO: 2670924 - protein, 24 aa, Entamoeba histolytica
CYTYHNWNNCYSLSLSLLGLKSLI

SEQ ID NO: 2670925 - protein, 18 aa, Entamoeba histolytica
CYYCRRGLIPELPQVNLP

SEQ ID NO: 2670926 - protein, 20 aa, Entamoeba histolytica
CYYPYFYSIIIEDELVTKEV

SEQ ID NO: 2670927 - protein, 23 aa, Entamoeba histolytica
CYYYCKELFLHTMFSFFYEGDSS

SEQ ID NO: 2670928 - protein, 18 aa, Entamoeba histolytica
CYYYLNSMLLNFKTDGNR

SEQ ID NO: 2670929 - protein, 17 aa, Entamoeba histolytica
DAALDFEPEVIGISNTM

SEQ ID NO: 2670930 - protein, 24 aa, Entamoeba histolytica
DACGEFYKSLPLAAVVANSAFCAH

SEQ ID NO: 2670931 - protein, 24 aa, Entamoeba histolytica
DAEASCIECISACSSQSLEKKEGI

SEQ ID NO: 2670932 - protein, 21 aa, Entamoeba histolytica
DAEKYTGAGYVQWATCVTDLF

SEQ ID NO: 2670933 - protein, 38 aa, Entamoeba histolytica
DAEMCIKIKPDFIKGYNRKAFSHFCMKEYNKALTEYER

SEQ ID NO: 2670934 - protein, 18 aa, Entamoeba histolytica
DAEMCVQENLALKPDYDY

SEQ ID NO: 2670935 - protein, 17 aa, Entamoeba histolytica
DAETGRDAMRWLDRALL

SEQ ID NO: 2670936 - protein, 24 aa, Entamoeba histolytica
DAFIKAAPFFLYMREFIGNNSNAL

SEQ ID NO: 2670937 - protein, 22 aa, Entamoeba histolytica
DAFKAIFIETVTNFAQKVGQPT

SEQ ID NO: 2670938 - protein, 23 aa, Entamoeba histolytica
DAFRIPPKYLQQLLVDARPIDDP

SEQ ID NO: 2670939 - protein, 22 aa, Entamoeba histolytica
DAFYCVMEFVIKAQCCGHFYSS

SEQ ID NO: 2670940 - protein, 20 aa, Entamoeba histolytica
DAIAAFWWDDFCDGDLEDLE

SEQ ID NO: 2670941 - protein, 19 aa, Entamoeba histolytica
DAIFIWLNLLHEMNLNIPL

SEQ ID NO: 2670942 - protein, 27 aa, Entamoeba histolytica
DAIPPNKRWGALLPVGLIPPEITTPVS

SEQ ID NO: 2670943 - protein, 18 aa, Entamoeba histolytica
DAITNCFENLLKVFTSTK

SEQ ID NO: 2670944 - protein, 22 aa, Entamoeba histolytica
DAITSFKKRDWYESSNHIILIM

SEQ ID NO: 2670945 - protein, 23 aa, Entamoeba histolytica
DAKETLTCLTLEWIDELTDRKGE

SEQ ID NO: 2670946 - protein, 31 aa, Entamoeba histolytica
DAKKAFSVMHLRWFNMHLLRVEYYPESKVPI

SEQ ID NO: 2670947 - protein, 18 aa, Entamoeba histolytica
DAKLRKKDISDVVLVGGM

SEQ ID NO: 2670948 - protein, 20 aa, Entamoeba histolytica
DAKTAFKRLVYSRYRGIPLY

SEQ ID NO: 2670949 - protein, 18 aa, Entamoeba histolytica
DALFILSCHLDRSSNREI

SEQ ID NO: 2670950 - protein, 26 aa, Entamoeba histolytica
DALKPGKDALHWGVLRPFDSSYPGID

SEQ ID NO: 2670951 - protein, 23 aa, Entamoeba histolytica
DALKRLPFGYIELMNNCPSQPML

SEQ ID NO: 2670952 - protein, 19 aa, Entamoeba histolytica
DALLDRKAFKEAMDSTTKK

SEQ ID NO: 2670953 - protein, 19 aa, Entamoeba histolytica
DALNCTAEGEGLENAETKT

SEQ ID NO: 2670954 - protein, 17 aa, Entamoeba histolytica
DALRDILDASGILYSVL

SEQ ID NO: 2670955 - protein, 24 aa, Entamoeba histolytica
DALVKIKLSFRPGAVDAEKAVAPH

SEQ ID NO: 2670956 - protein, 18 aa, Entamoeba histolytica
DANEITMPTIIVLNPGSF

SEQ ID NO: 2670957 - protein, 19 aa, Entamoeba histolytica
DAPFPSAIIECYKNQHENL

SEQ ID NO: 2670958 - protein, 18 aa, Entamoeba histolytica
DAPHYRTGTQFKCYPLYD

SEQ ID NO: 2670959 - protein, 21 aa, Entamoeba histolytica
DAPRFKWRGLMVDPSRNPLSP

SEQ ID NO: 2670960 - protein, 24 aa, Entamoeba histolytica
DAQEIMDRINLFSGVTNGLKKSFL

SEQ ID NO: 2670961 - protein, 20 aa, Entamoeba histolytica
DAQGIIICYDVTSPKSLTSI

SEQ ID NO: 2670962 - protein, 30 aa, Entamoeba histolytica
DAQKKFPFIPLILKYIEAMTFYSNDFSEFE

SEQ ID NO: 2670963 - protein, 17 aa, Entamoeba histolytica
DAQLPVDQPNFFKKENK

SEQ ID NO: 2670964 - protein, 18 aa, Entamoeba histolytica
DARIQEGQLKKWEIKYYK

SEQ ID NO: 2670965 - protein, 27 aa, Entamoeba histolytica
DARLKKGFPETIRVVTSCYVYIQCIGD

SEQ ID NO: 2670966 - protein, 23 aa, Entamoeba histolytica
DATIHLKIIRIMYRHYSLDELKN

SEQ ID NO: 2670967 - protein, 24 aa, Entamoeba histolytica
DATKRIAIVNCDWENTSARDLFAL

SEQ ID NO: 2670968 - protein, 22 aa, Entamoeba histolytica
DATMKLTVVDFLSSAIVLLETT

SEQ ID NO: 2670969 - protein, 17 aa, Entamoeba histolytica
DAYECFETIWKQVAHEN

SEQ ID NO: 2670970 - protein, 26 aa, Entamoeba histolytica
DCAVFCIADGCGMGKRPATSAHVACE

SEQ ID NO: 2670971 - protein, 20 aa, Entamoeba histolytica
DCCDYCKNKRAIQAKYLGQI

SEQ ID NO: 2670972 - protein, 25 aa, Entamoeba histolytica
DCCKKICAIGGITFSLPLFKPTYPM

SEQ ID NO: 2670973 - protein, 24 aa, Entamoeba histolytica
DCDRRGHFFFPISVAVNHKKNDIY

SEQ ID NO: 2670974 - protein, 24 aa, Entamoeba histolytica
DCEEWAREVFYFALRDTLVCENLT

SEQ ID NO: 2670975 - protein, 18 aa, Entamoeba histolytica
DCEYKRCLTKYCIPLQGI

SEQ ID NO: 2670976 - protein, 19 aa, Entamoeba histolytica
DCFGDVKKQGGAPCNFAMH

SEQ ID NO: 2670977 - protein, 22 aa, Entamoeba histolytica
DCFIKMRNALFIRDTLTPLSYY

SEQ ID NO: 2670978 - protein, 19 aa, Entamoeba histolytica
DCGCFSQWVVCTQTSTELR

SEQ ID NO: 2670979 - protein, 33 aa, Entamoeba histolytica
DCGKNKVVCLLFPWVIRPQQNIMFINSTMIKSL

SEQ ID NO: 2670980 - protein, 18 aa, Entamoeba histolytica
DCGLMSYLINVIKKPPSI

SEQ ID NO: 2670981 - protein, 21 aa, Entamoeba histolytica
DCGLPKPDIVFFLELSLEDAE

SEQ ID NO: 2670982 - protein, 20 aa, Entamoeba histolytica
DCGNYCFSHCVGLTSIPLIY

SEQ ID NO: 2670983 - protein, 22 aa, Entamoeba histolytica
DCGYETCYLEEEFLVIHIQIFV

SEQ ID NO: 2670984 - protein, 21 aa, Entamoeba histolytica
DCGYETCYLVAIKNHRTTIVL

SEQ ID NO: 2670985 - protein, 20 aa, Entamoeba histolytica
DCIAEIFAKAVREEIMDQCQ

SEQ ID NO: 2670986 - protein, 18 aa, Entamoeba histolytica
DCILPIYNILFGKFEEQE

SEQ ID NO: 2670987 - protein, 17 aa, Entamoeba histolytica
DCIYGKEGPVWKKIKED

SEQ ID NO: 2670988 - protein, 20 aa, Entamoeba histolytica
DCIYLFKTAGYLVTKKFLKE

SEQ ID NO: 2670989 - protein, 25 aa, Entamoeba histolytica
DCKADLFTFALLVTKIWTGKLPYSP

SEQ ID NO: 2670990 - protein, 17 aa, Entamoeba histolytica
DCKEIIQNIIFIISGKK

SEQ ID NO: 2670991 - protein, 23 aa, Entamoeba histolytica
DCKKEFNIIITLDYSVFMDVLEY

SEQ ID NO: 2670992 - protein, 28 aa, Entamoeba histolytica
DCKLNDLIELIQLFPNCEIISQTTLLSP

SEQ ID NO: 2670993 - protein, 20 aa, Entamoeba histolytica
DCKNYNPYIRHCMYGLDADL

SEQ ID NO: 2670994 - protein, 18 aa, Entamoeba histolytica
DCKTWLSKCKGFNKLYHC

SEQ ID NO: 2670995 - protein, 17 aa, Entamoeba histolytica
DCLCCKKGNGLTKSALH

SEQ ID NO: 2670996 - protein, 26 aa, Entamoeba histolytica
DCLCNCGRCQCKIKECKHETCIHKKN

SEQ ID NO: 2670997 - protein, 17 aa, Entamoeba histolytica
DCLFNKNQINAMKDLGF

SEQ ID NO: 2670998 - protein, 23 aa, Entamoeba histolytica
DCLPFKEVLFHSIVRDAQGRKMS

SEQ ID NO: 2670999 - protein, 17 aa, Entamoeba histolytica
DCLPLSALIDQRYFCVH

SEQ ID NO: 2671000 - protein, 18 aa, Entamoeba histolytica
DCLSMVFMFASYRVSKGE

SEQ ID NO: 2671001 - protein, 26 aa, Entamoeba histolytica
DCMTFGMNLFEEFMSLISFILSSQFK

SEQ ID NO: 2671002 - protein, 21 aa, Entamoeba histolytica
DCQLKRKRGRSRSKSKEKQSR

SEQ ID NO: 2671003 - protein, 19 aa, Entamoeba histolytica
DCQPDHLIAVPRVLQRIKM

SEQ ID NO: 2671004 - protein, 17 aa, Entamoeba histolytica
DCQPRLVSTESARQWCE

SEQ ID NO: 2671005 - protein, 19 aa, Entamoeba histolytica
DCRALKTIHIPSSITQIGN

SEQ ID NO: 2671006 - protein, 22 aa, Entamoeba histolytica
DCSCRLLRLGFFLFDCTNALRH

SEQ ID NO: 2671007 - protein, 24 aa, Entamoeba histolytica
DCSLILKTDVYSIIFLTKNNNKIL

SEQ ID NO: 2671008 - protein, 18 aa, Entamoeba histolytica
DCSLIRLPQPPLNTFERA

SEQ ID NO: 2671009 - protein, 21 aa, Entamoeba histolytica
DCSVGKTCIIGRFTSKNFDMS

SEQ ID NO: 2671010 - protein, 23 aa, Entamoeba histolytica
DCTSEILKEFSFLIELLDKDMQR

SEQ ID NO: 2671011 - protein, 17 aa, Entamoeba histolytica
DCVFKSCSHLSICSKCL

SEQ ID NO: 2671012 - protein, 19 aa, Entamoeba histolytica
DCVIQWKVPTVGLTVKLSK

SEQ ID NO: 2671013 - protein, 26 aa, Entamoeba histolytica
DCWDAEIRLSYGWVECVGHADRGDFD

SEQ ID NO: 2671014 - protein, 21 aa, Entamoeba histolytica
DCWIVPIYIGHCIDLTFFWDS

SEQ ID NO: 2671015 - protein, 25 aa, Entamoeba histolytica
DCYIKLDICLIYGVMVLCKKRGNYY

SEQ ID NO: 2671016 - protein, 20 aa, Entamoeba histolytica
DCYNKFEISYLEAMKEILKN

SEQ ID NO: 2671017 - protein, 26 aa, Entamoeba histolytica
DDAMDVIEIFKIASLTGLGGISNSPV

SEQ ID NO: 2671018 - protein, 22 aa, Entamoeba histolytica
DDCKYPNSFDKFLSCFSSAMKV

SEQ ID NO: 2671019 - protein, 24 aa, Entamoeba histolytica
DDCMFKGCTSLSVIKSKNPKNLQI

SEQ ID NO: 2671020 - protein, 22 aa, Entamoeba histolytica
DDCQKVKLFFEALQSQVDTLQS

SEQ ID NO: 2671021 - protein, 18 aa, Entamoeba histolytica
DDCYRNEILLGDFTLDLR

SEQ ID NO: 2671022 - protein, 26 aa, Entamoeba histolytica
DDDLFLVVGCVNGFINIFSIKTGVIV

SEQ ID NO: 2671023 - protein, 27 aa, Entamoeba histolytica
DDDMIFKIRFDAGVTDLIWRNQTNFLA

SEQ ID NO: 2671024 - protein, 24 aa, Entamoeba histolytica
DDDMSFRHVYNWLSEARRFCNKEN

SEQ ID NO: 2671025 - protein, 20 aa, Entamoeba histolytica
DDEFKGVFRMERSEFNMLPR

SEQ ID NO: 2671026 - protein, 21 aa, Entamoeba histolytica
DDEIANFVWNYFCRHLVRQEE

SEQ ID NO: 2671027 - protein, 20 aa, Entamoeba histolytica
DDEIIFCLNTKPFIEIKLIT

SEQ ID NO: 2671028 - protein, 23 aa, Entamoeba histolytica
DDEITVYMDIDFDDITKFEDDDD

SEQ ID NO: 2671029 - protein, 23 aa, Entamoeba histolytica
DDELKMVLFKGSKRFDSLKLIFD

SEQ ID NO: 2671030 - protein, 24 aa, Entamoeba histolytica
DDEMKAFLSWKYVRLERLVLSWLD

SEQ ID NO: 2671031 - protein, 26 aa, Entamoeba histolytica
DDEYRNPMVYDMCGTCTYKHQSDYDI

SEQ ID NO: 2671032 - protein, 23 aa, Entamoeba histolytica
DDFANDVRLVFKNAMKYNPPRNT

SEQ ID NO: 2671033 - protein, 25 aa, Entamoeba histolytica
DDFCCCSVCKIAYCEQHKNKLEIII

SEQ ID NO: 2671034 - protein, 23 aa, Entamoeba histolytica
DDFDWEEALGLVQSNLNKEEEKE

SEQ ID NO: 2671035 - protein, 29 aa, Entamoeba histolytica
DDFQFTKQFLWKWFNEQFIKKVNQTREKL

SEQ ID NO: 2671036 - protein, 26 aa, Entamoeba histolytica
DDFYGYVTWINCLTRENFIEVIIQNF

SEQ ID NO: 2671037 - protein, 25 aa, Entamoeba histolytica
DDFYHLPDCINVIPIQTISSTLVFV

SEQ ID NO: 2671038 - protein, 24 aa, Entamoeba histolytica
DDGAGLACLLALMELHPKFEHAPI

SEQ ID NO: 2671039 - protein, 23 aa, Entamoeba histolytica
DDGISLLRWSLLRPSDYKGVSPL

SEQ ID NO: 2671040 - protein, 25 aa, Entamoeba histolytica
DDGLWTVRHGHDFRRRQPKKDREED

SEQ ID NO: 2671041 - protein, 26 aa, Entamoeba histolytica
DDGTGVACGLAYMELRDKFQHPALEL

SEQ ID NO: 2671042 - protein, 26 aa, Entamoeba histolytica
DDGWVCPHCQAICPATNVISLYSMPI

SEQ ID NO: 2671043 - protein, 22 aa, Entamoeba histolytica
DDGWVMRKFTSSIEWTKKDLMS

SEQ ID NO: 2671044 - protein, 24 aa, Entamoeba histolytica
DDHEIKESPLFHKKKVIKKTISLN

SEQ ID NO: 2671045 - protein, 27 aa, Entamoeba histolytica
DDIFTRISRRAELTLSGFDEKCNGEKS

SEQ ID NO: 2671046 - protein, 19 aa, Entamoeba histolytica
DDIHFPCLCQHYINHNNKI

SEQ ID NO: 2671047 - protein, 22 aa, Entamoeba histolytica
DDIHMIPFLWIQLTFGCDGCVG

SEQ ID NO: 2671048 - protein, 17 aa, Entamoeba histolytica
DDIIPLFYIFYQNITGI

SEQ ID NO: 2671049 - protein, 22 aa, Entamoeba histolytica
DDIKIHIWKTLIGTKYLLQQRN

SEQ ID NO: 2671050 - protein, 22 aa, Entamoeba histolytica
DDIKTSVVLTERIEELTQGINE

SEQ ID NO: 2671051 - protein, 19 aa, Entamoeba histolytica
DDIPDFDFDEMINQTEECS

SEQ ID NO: 2671052 - protein, 20 aa, Entamoeba histolytica
DDISPFGMLIIFKTSFRSSF

SEQ ID NO: 2671053 - protein, 17 aa, Entamoeba histolytica
DDITDVIGIDSDINGFV

SEQ ID NO: 2671054 - protein, 24 aa, Entamoeba histolytica
DDITKCFCCIPALQCNCDNTLLYA

SEQ ID NO: 2671055 - protein, 20 aa, Entamoeba histolytica
DDKKITSQDIIKKDDQKKPP

SEQ ID NO: 2671056 - protein, 24 aa, Entamoeba histolytica
DDKLIPALVYRLTHKDTYLTEDPE

SEQ ID NO: 2671057 - protein, 27 aa, Entamoeba histolytica
DDKNVKGIITWFSLHNCQTRFEGTRKE

SEQ ID NO: 2671058 - protein, 25 aa, Entamoeba histolytica
DDKNYWCTAKPNLLLKLKHINPCPY

SEQ ID NO: 2671059 - protein, 17 aa, Entamoeba histolytica
DDKRLELNVSLASCESS

SEQ ID NO: 2671060 - protein, 20 aa, Entamoeba histolytica
DDLAIVFALFSVDPTNFKIP

SEQ ID NO: 2671061 - protein, 30 aa, Entamoeba histolytica
DDLDSFIILMKKWWCDGQPHIELNVLPMIM

SEQ ID NO: 2671062 - protein, 17 aa, Entamoeba histolytica
DDLIENIILTISDKEGG

SEQ ID NO: 2671063 - protein, 25 aa, Entamoeba histolytica
DDLIKSDFCSFVFSESDNSSESKRF

SEQ ID NO: 2671064 - protein, 20 aa, Entamoeba histolytica
DDLKGKVLITLRDPSKQIQH

SEQ ID NO: 2671065 - protein, 20 aa, Entamoeba histolytica
DDLKMKFGLISDTTNTETDD

SEQ ID NO: 2671066 - protein, 18 aa, Entamoeba histolytica
DDLLNLLTFEMIKDISNN

SEQ ID NO: 2671067 - protein, 28 aa, Entamoeba histolytica
DDLLWTRHFPIAFLMRQHMLLLGRSEEI

SEQ ID NO: 2671068 - protein, 19 aa, Entamoeba histolytica
DDLPGFGTNELRVFDEKKG

SEQ ID NO: 2671069 - protein, 17 aa, Entamoeba histolytica
DDLRRLVTMGINEEYFK

SEQ ID NO: 2671070 - protein, 21 aa, Entamoeba histolytica
DDLTLKLSRLNEEINEMSYVP

SEQ ID NO: 2671071 - protein, 18 aa, Entamoeba histolytica
DDMICFIVKMSQQQPSEE

SEQ ID NO: 2671072 - protein, 29 aa, Entamoeba histolytica
DDMKSRMYLNFTICFSSRISSELLQYFAN

SEQ ID NO: 2671073 - protein, 17 aa, Entamoeba histolytica
DDNCFIIFTQLQKFIKQ

SEQ ID NO: 2671074 - protein, 20 aa, Entamoeba histolytica
DDNEIFKDEVITLTQKIFKK

SEQ ID NO: 2671075 - protein, 25 aa, Entamoeba histolytica
DDNIKWIFELAMKFTELEDIQNAVI

SEQ ID NO: 2671076 - protein, 21 aa, Entamoeba histolytica
DDPCLFDFGYGSSRVYVHKPT

SEQ ID NO: 2671077 - protein, 24 aa, Entamoeba histolytica
DDPEFKFDLAVSLHKIDLAREMAD

SEQ ID NO: 2671078 - protein, 29 aa, Entamoeba histolytica
DDQIKGHQWFAGIDWDLLLQKKVPVPWKP

SEQ ID NO: 2671079 - protein, 24 aa, Entamoeba histolytica
DDREMVIVPLILGQGTDWDKINPE

SEQ ID NO: 2671080 - protein, 20 aa, Entamoeba histolytica
DDRIPAWCDRVLCRTQNAYP

SEQ ID NO: 2671081 - protein, 19 aa, Entamoeba histolytica
DDRIRVVGEYGGIGKSIPQ

SEQ ID NO: 2671082 - protein, 25 aa, Entamoeba histolytica
DDSPRRRLPMAITEMNCCEEAVKSD

SEQ ID NO: 2671083 - protein, 24 aa, Entamoeba histolytica
DDSVFKICLMCIIDSDGFTGAMKW

SEQ ID NO: 2671084 - protein, 18 aa, Entamoeba histolytica
DDSYPYENCIRVDPHEDH

SEQ ID NO: 2671085 - protein, 25 aa, Entamoeba histolytica
DDTINCWDISTGVPSKRITFEQTMN

SEQ ID NO: 2671086 - protein, 22 aa, Entamoeba histolytica
DDTRVRFSILLNLPIIHSFPLP

SEQ ID NO: 2671087 - protein, 20 aa, Entamoeba histolytica
DDTVVKCMICNKPFSFFIRR

SEQ ID NO: 2671088 - protein, 18 aa, Entamoeba histolytica
DDVAVVLILRYKHMNSET

SEQ ID NO: 2671089 - protein, 24 aa, Entamoeba histolytica
DDVCNRLRIAVPGISIATDIICGF

SEQ ID NO: 2671090 - protein, 19 aa, Entamoeba histolytica
DDVICKLSDYWNIQQITGV

SEQ ID NO: 2671091 - protein, 25 aa, Entamoeba histolytica
DDVLKEVISFRCAMARVKVEFKESE

SEQ ID NO: 2671092 - protein, 18 aa, Entamoeba histolytica
DDWLETVSSYTAFHRAVL

SEQ ID NO: 2671093 - protein, 27 aa, Entamoeba histolytica
DDYAWWKGRLSQMAQYFSAYRIDHILG

SEQ ID NO: 2671094 - protein, 27 aa, Entamoeba histolytica
DDYAWWKGRLSQMSQYFNAYRIDHILG

SEQ ID NO: 2671095 - protein, 23 aa, Entamoeba histolytica
DDYLKPYLRRTTLIKEIIDKNDS

SEQ ID NO: 2671096 - protein, 23 aa, Entamoeba histolytica
DDYLKPYLRRTTLIQDIIDKNKG

SEQ ID NO: 2671097 - protein, 23 aa, Entamoeba histolytica
DDYTVRVVDVFAMPQNGTGVSVE

SEQ ID NO: 2671098 - protein, 22 aa, Entamoeba histolytica
DEAAIKFKTRFVELKFDNKNTL

SEQ ID NO: 2671099 - protein, 26 aa, Entamoeba histolytica
DEAAIKFKTRFVELKFDNKNTLKFYT

SEQ ID NO: 2671100 - protein, 23 aa, Entamoeba histolytica
DEAEIPLLFIISSVLPPKRKLFN

SEQ ID NO: 2671101 - protein, 19 aa, Entamoeba histolytica
DEAFPYCFDGATSISPTGR

SEQ ID NO: 2671102 - protein, 20 aa, Entamoeba histolytica
DEALFKINLLKRMDEIKRRN

SEQ ID NO: 2671103 - protein, 25 aa, Entamoeba histolytica
DEARVSILAFQFFKQVYKLFEKCPY

SEQ ID NO: 2671104 - protein, 26 aa, Entamoeba histolytica
DECFRYCKNLEKVECYRNYSFSGRKF

SEQ ID NO: 2671105 - protein, 18 aa, Entamoeba histolytica
DECIKRIKNHLCGRGNIF

SEQ ID NO: 2671106 - protein, 18 aa, Entamoeba histolytica
DECLRKYGNLYIWNAFIS

SEQ ID NO: 2671107 - protein, 21 aa, Entamoeba histolytica
DECRDFRATLARILQEKIVLF

SEQ ID NO: 2671108 - protein, 19 aa, Entamoeba histolytica
DECSGEYALLPDLLFNISK

SEQ ID NO: 2671109 - protein, 18 aa, Entamoeba histolytica
DECYPLWFYKSTPSLFCV

SEQ ID NO: 2671110 - protein, 18 aa, Entamoeba histolytica
DEDDEFYGDYSISVEYDE

SEQ ID NO: 2671111 - protein, 26 aa, Entamoeba histolytica
DEDPDFFWKYLFKCYDAYDQITNSFV

SEQ ID NO: 2671112 - protein, 25 aa, Entamoeba histolytica
DEDRIFRLAYHVYKTKELIEKYGSE

SEQ ID NO: 2671113 - protein, 24 aa, Entamoeba histolytica
DEDRIIRIAYHIYKTKDEIQTGKI

SEQ ID NO: 2671114 - protein, 26 aa, Entamoeba histolytica
DEEFLKRVALLITCCVDNQTKFNEEF

SEQ ID NO: 2671115 - protein, 18 aa, Entamoeba histolytica
DEEGWKLFGDIFNYEEFK

SEQ ID NO: 2671116 - protein, 21 aa, Entamoeba histolytica
DEEIRELVKFCFNGISDKYYY

SEQ ID NO: 2671117 - protein, 18 aa, Entamoeba histolytica
DEELIKHHIKPMIHEGDY

SEQ ID NO: 2671118 - protein, 23 aa, Entamoeba histolytica
DEEMPEDIQLLLIQLNSTQPCLN

SEQ ID NO: 2671119 - protein, 19 aa, Entamoeba histolytica
DEEPFGQVGLICIKNQNYF

SEQ ID NO: 2671120 - protein, 20 aa, Entamoeba histolytica
DEERRAVLMLSVHALLDDGM

SEQ ID NO: 2671121 - protein, 27 aa, Entamoeba histolytica
DEESLKIVGAFVFLRLINPVLLTPLKF

SEQ ID NO: 2671122 - protein, 18 aa, Entamoeba histolytica
DEEYCLAGVIVHSGNCTG

SEQ ID NO: 2671123 - protein, 24 aa, Entamoeba histolytica
DEEYRYVVMNNLFPNDNFPLQYKF

SEQ ID NO: 2671124 - protein, 20 aa, Entamoeba histolytica
DEFAMMLQVALIYCKKEEIE

SEQ ID NO: 2671125 - protein, 24 aa, Entamoeba histolytica
DEFDIFIKVLIKWITNSKDIMLKY

SEQ ID NO: 2671126 - protein, 20 aa, Entamoeba histolytica
DEFDPHYNVVIGRNGSGKSN

SEQ ID NO: 2671127 - protein, 20 aa, Entamoeba histolytica
DEFERCRVLFITRIDQVYEN

SEQ ID NO: 2671128 - protein, 19 aa, Entamoeba histolytica
DEFFWRRRPSPKIVQHENG

SEQ ID NO: 2671129 - protein, 23 aa, Entamoeba histolytica
DEFIIRKMIRKFIKGEEIDNVKV

SEQ ID NO: 2671130 - protein, 27 aa, Entamoeba histolytica
DEFIYSIPFFFHLKKLKIGYSTYFDFS

SEQ ID NO: 2671131 - protein, 25 aa, Entamoeba histolytica
DEFKYGFQKFNLFKGKKVFATELFT

SEQ ID NO: 2671132 - protein, 21 aa, Entamoeba histolytica
DEFNIPPCISNWKNNRGYTIS

SEQ ID NO: 2671133 - protein, 17 aa, Entamoeba histolytica
DEFNLYGLRAFIEHYEE

SEQ ID NO: 2671134 - protein, 27 aa, Entamoeba histolytica
DEFTQMFWKLGMRNFDDFISKSVTLPR

SEQ ID NO: 2671135 - protein, 18 aa, Entamoeba histolytica
DEFWDFMNSLGKKVELKG

SEQ ID NO: 2671136 - protein, 19 aa, Entamoeba histolytica
DEGDFCFTEILYGQFRREV

SEQ ID NO: 2671137 - protein, 17 aa, Entamoeba histolytica
DEGISMKSILEHKKGLF

SEQ ID NO: 2671138 - protein, 21 aa, Entamoeba histolytica
DEGKKYISVCVQGIPKQWNTR

SEQ ID NO: 2671139 - protein, 18 aa, Entamoeba histolytica
DEGLNMKCSYRVYVYPFE

SEQ ID NO: 2671140 - protein, 21 aa, Entamoeba histolytica
DEGYVGMFVDVCIQNLCQMIE

SEQ ID NO: 2671141 - protein, 17 aa, Entamoeba histolytica
DEHFWEKLINYFRVDSV

SEQ ID NO: 2671142 - protein, 18 aa, Entamoeba histolytica
DEHICMVLCGNKCDMESD

SEQ ID NO: 2671143 - protein, 17 aa, Entamoeba histolytica
DEHKVFIIDGFPRNAEN

SEQ ID NO: 2671144 - protein, 20 aa, Entamoeba histolytica
DEHTFEWLANVLKHKGKSLD

SEQ ID NO: 2671145 - protein, 22 aa, Entamoeba histolytica
DEIDCLHPTLDIGILNKPTLIS

SEQ ID NO: 2671146 - protein, 37 aa, Entamoeba histolytica
DEIESCPSIPSNIDFGFRPKFGKIHLVNGKIVEEFPQ

SEQ ID NO: 2671147 - protein, 21 aa, Entamoeba histolytica
DEIIKLWRVSLLQHQIVLNDE

SEQ ID NO: 2671148 - protein, 18 aa, Entamoeba histolytica
DEIIRISEELQKEKVKGI

SEQ ID NO: 2671149 - protein, 27 aa, Entamoeba histolytica
DEIIRLACKFYYLSRLESIDAILNGVL

SEQ ID NO: 2671150 - protein, 22 aa, Entamoeba histolytica
DEILKKILDGVGIEDDDETIQI

SEQ ID NO: 2671151 - protein, 20 aa, Entamoeba histolytica
DEILKKMGLVNGFCSTKGKH

SEQ ID NO: 2671152 - protein, 19 aa, Entamoeba histolytica
DEINIGLASFNSWNRKFAK

SEQ ID NO: 2671153 - protein, 20 aa, Entamoeba histolytica
DEIPHLHVTEVYKRATHIVC

SEQ ID NO: 2671154 - protein, 24 aa, Entamoeba histolytica
DEIPKRFYELMFLIAEKIKLEGFG

SEQ ID NO: 2671155 - protein, 17 aa, Entamoeba histolytica
DEIPLYVPDTFFDMIFD

SEQ ID NO: 2671156 - protein, 18 aa, Entamoeba histolytica
DEIPRFKARQIEAMNYQA

SEQ ID NO: 2671157 - protein, 17 aa, Entamoeba histolytica
DEIREWYRVYKVAEGKK

SEQ ID NO: 2671158 - protein, 21 aa, Entamoeba histolytica
DEIRRAQFCFVINRVNYYLTR

SEQ ID NO: 2671159 - protein, 17 aa, Entamoeba histolytica
DEISAEVPLGFDNYVLW

SEQ ID NO: 2671160 - protein, 24 aa, Entamoeba histolytica
DEISHWIGTMILMFPDVEMRAKLM

SEQ ID NO: 2671161 - protein, 22 aa, Entamoeba histolytica
DEISKCDIALIGEKENKPIDYR

SEQ ID NO: 2671162 - protein, 21 aa, Entamoeba histolytica
DEIYKKVLIFLNEIPKDEKYK

SEQ ID NO: 2671163 - protein, 23 aa, Entamoeba histolytica
DEKCIGCALCSSVCPVNAIEYVK

SEQ ID NO: 2671164 - protein, 27 aa, Entamoeba histolytica
DEKDRLLRVGIIDFIRTYTWDKQLESV

SEQ ID NO: 2671165 - protein, 18 aa, Entamoeba histolytica
DEKGVTVEVCIRSTNTLI

SEQ ID NO: 2671166 - protein, 17 aa, Entamoeba histolytica
DEKIWIGIYDRYETNSH

SEQ ID NO: 2671167 - protein, 28 aa, Entamoeba histolytica
DEKKIILLTSCGLREIECKNKLDRDLWL

SEQ ID NO: 2671168 - protein, 21 aa, Entamoeba histolytica
DEKKKLFVFEDCSSESNDENN

SEQ ID NO: 2671169 - protein, 27 aa, Entamoeba histolytica
DEKKLGWFEGFKIKGEILEKIHTAGTI

SEQ ID NO: 2671170 - protein, 29 aa, Entamoeba histolytica
DEKKLWLPPRKRISTYITEDQKKEKLEDK

SEQ ID NO: 2671171 - protein, 26 aa, Entamoeba histolytica
DEKLVSNELWEWILLPKEKFQKRKKT

SEQ ID NO: 2671172 - protein, 23 aa, Entamoeba histolytica
DEKSKDLICWSREQNRPGFVVLE

SEQ ID NO: 2671173 - protein, 26 aa, Entamoeba histolytica
DEKYKSIICELYFELHPIFNKSCALN

SEQ ID NO: 2671174 - protein, 26 aa, Entamoeba histolytica
DELEADVYWSFCWILQSIQSHYTYDQ

SEQ ID NO: 2671175 - protein, 23 aa, Entamoeba histolytica
DELEKRYRLLAKDISLNYKPTQK

SEQ ID NO: 2671176 - protein, 23 aa, Entamoeba histolytica
DELFKKKVSSIFLTLTRCITSSS

SEQ ID NO: 2671177 - protein, 18 aa, Entamoeba histolytica
DELKKAKFPGGIKLDENA

SEQ ID NO: 2671178 - protein, 17 aa, Entamoeba histolytica
DELKKKCLEISNIQEEK

SEQ ID NO: 2671179 - protein, 21 aa, Entamoeba histolytica
DELKQGCSFKTALKRTEGHKI

SEQ ID NO: 2671180 - protein, 17 aa, Entamoeba histolytica
DELKRVAKKKIIMCASG

SEQ ID NO: 2671181 - protein, 24 aa, Entamoeba histolytica
DELKSTILEIGYFYTITLEEICSL

SEQ ID NO: 2671182 - protein, 22 aa, Entamoeba histolytica
DELNLKISYLLQQTKKLNQIAI

SEQ ID NO: 2671183 - protein, 21 aa, Entamoeba histolytica
DELPIKIVIIGDLGVGKTSLI

SEQ ID NO: 2671184 - protein, 19 aa, Entamoeba histolytica
DELSYCIPFTPSIQDKVIN

SEQ ID NO: 2671185 - protein, 22 aa, Entamoeba histolytica
DELWMELIRVCGNDEKEIEVVF

SEQ ID NO: 2671186 - protein, 19 aa, Entamoeba histolytica
DELYCIYIKTLVELCQTII

SEQ ID NO: 2671187 - protein, 36 aa, Entamoeba histolytica
DELYIFLWRFERDGKFDVWRCFYEIDKKITAEYQAL

SEQ ID NO: 2671188 - protein, 20 aa, Entamoeba histolytica
DELYMRVLVDYSTRLKNKYP

SEQ ID NO: 2671189 - protein, 23 aa, Entamoeba histolytica
DEMKEMYYENSLSILFNTDNKEL

SEQ ID NO: 2671190 - protein, 20 aa, Entamoeba histolytica
DEMKEYIISFGGNVATSISG

SEQ ID NO: 2671191 - protein, 20 aa, Entamoeba histolytica
DEMKFMAFDFLKIVKDLDDI

SEQ ID NO: 2671192 - protein, 22 aa, Entamoeba histolytica
DEMWKLGVPVCTIHNEVAPAQY

SEQ ID NO: 2671193 - protein, 23 aa, Entamoeba histolytica
DENEKYLLLNGIIVTLKMANPDY

SEQ ID NO: 2671194 - protein, 29 aa, Entamoeba histolytica
DENGVCYWKIPSMYSGQIIYDILDIDKKG

SEQ ID NO: 2671195 - protein, 24 aa, Entamoeba histolytica
DENIKRNRAVLVHCECGVSRSASV

SEQ ID NO: 2671196 - protein, 19 aa, Entamoeba histolytica
DENIKSFFYSRPVFKPSTI

SEQ ID NO: 2671197 - protein, 18 aa, Entamoeba histolytica
DENKKECWGFRRHPTYIA

SEQ ID NO: 2671198 - protein, 22 aa, Entamoeba histolytica
DENKRWVLSMLLSYDEKQRKQG

SEQ ID NO: 2671199 - protein, 22 aa, Entamoeba histolytica
DENLRKEFDRYLLSHSPDSIKD

SEQ ID NO: 2671200 - protein, 23 aa, Entamoeba histolytica
DENLRKEFDRYLLSHSPDSIKDY

SEQ ID NO: 2671201 - protein, 24 aa, Entamoeba histolytica
DEPEWKKKIGYSLFEQVKALETEI

SEQ ID NO: 2671202 - protein, 22 aa, Entamoeba histolytica
DEPRLMCMYVDKVLSGSHAVQT

SEQ ID NO: 2671203 - protein, 21 aa, Entamoeba histolytica
DEQHYRFILLDDINYDKNTVR

SEQ ID NO: 2671204 - protein, 20 aa, Entamoeba histolytica
DEQKRFTIQQCLNHEFVSLK

SEQ ID NO: 2671205 - protein, 27 aa, Entamoeba histolytica
DEQVEILFYLCEFCDDFKYFEPTFIYI

SEQ ID NO: 2671206 - protein, 18 aa, Entamoeba histolytica
DERFEYFTKIFLQGYSDG

SEQ ID NO: 2671207 - protein, 23 aa, Entamoeba histolytica
DERHQCTIFRQIVYDIINTIVQR

SEQ ID NO: 2671208 - protein, 23 aa, Entamoeba histolytica
DERIYRLAYHVYKTKELIEKYGS

SEQ ID NO: 2671209 - protein, 24 aa, Entamoeba histolytica
DERIYRLAYHVYKTKELIEKYGSK

SEQ ID NO: 2671210 - protein, 24 aa, Entamoeba histolytica
DERKHLFNQWSFIGGDENTTGLVR

SEQ ID NO: 2671211 - protein, 21 aa, Entamoeba histolytica
DERLKRCTIYLGFTSEMMTSG

SEQ ID NO: 2671212 - protein, 20 aa, Entamoeba histolytica
DERYIRFSFNERNRILIALT

SEQ ID NO: 2671213 - protein, 26 aa, Entamoeba histolytica
DESILPCSIDKGFGPVVFYDACGGLE

SEQ ID NO: 2671214 - protein, 25 aa, Entamoeba histolytica
DESVWKRFNATFAYLPILALINKKI

SEQ ID NO: 2671215 - protein, 22 aa, Entamoeba histolytica
DETERRRKLVIEKSQETINQIE

SEQ ID NO: 2671216 - protein, 32 aa, Entamoeba histolytica
DEVEIGRCYRYNCLPIQFCMMLYSLLSVKYAV

SEQ ID NO: 2671217 - protein, 21 aa, Entamoeba histolytica
DEVFPSLSVSLISKTLRSFRL

SEQ ID NO: 2671218 - protein, 21 aa, Entamoeba histolytica
DEVHRLEILITRRTFSLQDLK

SEQ ID NO: 2671219 - protein, 24 aa, Entamoeba histolytica
DEVKRIVADLCDFDPTELIKETMH

SEQ ID NO: 2671220 - protein, 23 aa, Entamoeba histolytica
DEVQRIRKLNGFIDHSKVNGEIV

SEQ ID NO: 2671221 - protein, 17 aa, Entamoeba histolytica
DEVVKCKCGMSYCNTKC

SEQ ID NO: 2671222 - protein, 20 aa, Entamoeba histolytica
DEVVKSLNMAGGDKKVISRL

SEQ ID NO: 2671223 - protein, 23 aa, Entamoeba histolytica
DEWKKRMEELYNKKDVVPKSQLV

SEQ ID NO: 2671224 - protein, 21 aa, Entamoeba histolytica
DEWSSPVVPIEKWEMKYSNGW

SEQ ID NO: 2671225 - protein, 19 aa, Entamoeba histolytica
DEYANGVKFTYDVKKQLMG

SEQ ID NO: 2671226 - protein, 25 aa, Entamoeba histolytica
DEYDERIGKCIISPEVIPPNIIVNF

SEQ ID NO: 2671227 - protein, 18 aa, Entamoeba histolytica
DEYSESGSPFYGEADKPF

SEQ ID NO: 2671228 - protein, 21 aa, Entamoeba histolytica
DEYYCTPCSLNFTKKGDENRM

SEQ ID NO: 2671229 - protein, 17 aa, Entamoeba histolytica
DFAKRGVKRVSIMQEGF

SEQ ID NO: 2671230 - protein, 23 aa, Entamoeba histolytica
DFAYCLFSAKSIRNKKKEELYLS

SEQ ID NO: 2671231 - protein, 26 aa, Entamoeba histolytica
DFCKDKTLIRPQRIVTITKCPSHSSS

SEQ ID NO: 2671232 - protein, 22 aa, Entamoeba histolytica
DFCPSEGTFLLFQAAKCGNENA

SEQ ID NO: 2671233 - protein, 20 aa, Entamoeba histolytica
DFDFLWKKINTFIKSNMSKY

SEQ ID NO: 2671234 - protein, 19 aa, Entamoeba histolytica
DFDGVCSPGSILNPGSIYL

SEQ ID NO: 2671235 - protein, 25 aa, Entamoeba histolytica
DFDIRFYSMELLKGMIKNRQENVRM

SEQ ID NO: 2671236 - protein, 25 aa, Entamoeba histolytica
DFDLLVCKGCALCAQSIGEDISNIL

SEQ ID NO: 2671237 - protein, 20 aa, Entamoeba histolytica
DFDSCWKPFLDTDELFGREI

SEQ ID NO: 2671238 - protein, 17 aa, Entamoeba histolytica
DFECLGFKGDGKGTLHY

SEQ ID NO: 2671239 - protein, 19 aa, Entamoeba histolytica
DFEDFKWILTETNENTNNV

SEQ ID NO: 2671240 - protein, 18 aa, Entamoeba histolytica
DFELWKYLNKLNVDVTCY

SEQ ID NO: 2671241 - protein, 25 aa, Entamoeba histolytica
DFERCLDDFIFFCFLVGNDFLPHIP

SEQ ID NO: 2671242 - protein, 18 aa, Entamoeba histolytica
DFFDDLIENIILTISDKE

SEQ ID NO: 2671243 - protein, 25 aa, Entamoeba histolytica
DFFTDEMKEFLPVIINCSISNIETS

SEQ ID NO: 2671244 - protein, 22 aa, Entamoeba histolytica
DFGHCLFCVNPTSLTVKKYNCI

SEQ ID NO: 2671245 - protein, 18 aa, Entamoeba histolytica
DFGHSVVVVSDWDFVESA

SEQ ID NO: 2671246 - protein, 19 aa, Entamoeba histolytica
DFGLFPCRCQTTACLESNC

SEQ ID NO: 2671247 - protein, 19 aa, Entamoeba histolytica
DFGSACFQDSPLYTYIQSR

SEQ ID NO: 2671248 - protein, 20 aa, Entamoeba histolytica
DFHHSYNLFIQFIIRHIEHS

SEQ ID NO: 2671249 - protein, 17 aa, Entamoeba histolytica
DFHIVRISGKLMYIPHN

SEQ ID NO: 2671250 - protein, 24 aa, Entamoeba histolytica
DFHPKEPWVLAALHTGTIYILNYQ

SEQ ID NO: 2671251 - protein, 21 aa, Entamoeba histolytica
DFHVFEIDNAFTLETNGYIHV

SEQ ID NO: 2671252 - protein, 19 aa, Entamoeba histolytica
DFIEKCFVFDFKKRPQCEE

SEQ ID NO: 2671253 - protein, 19 aa, Entamoeba histolytica
DFIGSPLFMSPEVIKKSFY

SEQ ID NO: 2671254 - protein, 22 aa, Entamoeba histolytica
DFIKICTSIEWVVERTQHFTIL

SEQ ID NO: 2671255 - protein, 18 aa, Entamoeba histolytica
DFIKSMLSANGFEEMSDE

SEQ ID NO: 2671256 - protein, 19 aa, Entamoeba histolytica
DFINIPIKWEESSFEGCSK

SEQ ID NO: 2671257 - protein, 25 aa, Entamoeba histolytica
DFIRKRVEYDPGIKQGDFIVGNMTK

SEQ ID NO: 2671258 - protein, 17 aa, Entamoeba histolytica
DFITYVFESDNDFLVEQ

SEQ ID NO: 2671259 - protein, 18 aa, Entamoeba histolytica
DFITYVFESDNDFLVEQC

SEQ ID NO: 2671260 - protein, 24 aa, Entamoeba histolytica
DFIVCPFCSYSGIMVDPIVYKKST

SEQ ID NO: 2671261 - protein, 21 aa, Entamoeba histolytica
DFKELAQSEVHLFEQASSIFL

SEQ ID NO: 2671262 - protein, 21 aa, Entamoeba histolytica
DFKFLEWRDTNYLPGLHQLID

SEQ ID NO: 2671263 - protein, 24 aa, Entamoeba histolytica
DFKLKGCPVSAILTQNLLAISNKE

SEQ ID NO: 2671264 - protein, 23 aa, Entamoeba histolytica
DFKPDEIVIRYKVHNDAKSFFIT

SEQ ID NO: 2671265 - protein, 17 aa, Entamoeba histolytica
DFKRRIDLLELKIKALP

SEQ ID NO: 2671266 - protein, 24 aa, Entamoeba histolytica
DFLIDIRYAFSITNLLPRIICIGN

SEQ ID NO: 2671267 - protein, 25 aa, Entamoeba histolytica
DFLKIHASNVFSMFKDCPIVKKAVS

SEQ ID NO: 2671268 - protein, 19 aa, Entamoeba histolytica
DFLKKCFFFNPEERWSATQ

SEQ ID NO: 2671269 - protein, 21 aa, Entamoeba histolytica
DFLLFGRTKLLGKIKISKYIE

SEQ ID NO: 2671270 - protein, 18 aa, Entamoeba histolytica
DFLQDYCHLVKMVSCKKH

SEQ ID NO: 2671271 - protein, 17 aa, Entamoeba histolytica
DFMLKKLINAERMTMYN

SEQ ID NO: 2671272 - protein, 19 aa, Entamoeba histolytica
DFNFLFTFIRELRSKFNEY

SEQ ID NO: 2671273 - protein, 20 aa, Entamoeba histolytica
DFNKNCYLDGKSLILKNELK

SEQ ID NO: 2671274 - protein, 20 aa, Entamoeba histolytica
DFNSSCLIYSVLSIFCSDIR

SEQ ID NO: 2671275 - protein, 28 aa, Entamoeba histolytica
DFNSTIPKSQPASVIKSRTNAFNFDQPK

SEQ ID NO: 2671276 - protein, 27 aa, Entamoeba histolytica
DFNSTIPKSQPASVIKSRTNAFNFDQQ

SEQ ID NO: 2671277 - protein, 23 aa, Entamoeba histolytica
DFPELIQLICIWDKEALKRRIYN

SEQ ID NO: 2671278 - protein, 27 aa, Entamoeba histolytica
DFPKTKLICCWVEKSTCNNLIDLAHHS

SEQ ID NO: 2671279 - protein, 25 aa, Entamoeba histolytica
DFPPVKGKPSWSIKSIFLGKKSYLD

SEQ ID NO: 2671280 - protein, 19 aa, Entamoeba histolytica
DFRGWSVVHHAIYEDKVEF

SEQ ID NO: 2671281 - protein, 22 aa, Entamoeba histolytica
DFRIFLDVFFEGVRSPSFIIYT

SEQ ID NO: 2671282 - protein, 19 aa, Entamoeba histolytica
DFRSFGGYGNEPGKFNEPM

SEQ ID NO: 2671283 - protein, 23 aa, Entamoeba histolytica
DFRSPRTGLYFNLQKYNLPYPEA

SEQ ID NO: 2671284 - protein, 19 aa, Entamoeba histolytica
DFRSRNGMWKRYEPKVYAS

SEQ ID NO: 2671285 - protein, 21 aa, Entamoeba histolytica
DFSDCKGLLLGTPTIVGDALP

SEQ ID NO: 2671286 - protein, 24 aa, Entamoeba histolytica
DFSSIIEFLGNINLHLINKEYSSN

SEQ ID NO: 2671287 - protein, 23 aa, Entamoeba histolytica
DFSSMKTFVVFIVLDNPSNESIL

SEQ ID NO: 2671288 - protein, 22 aa, Entamoeba histolytica
DFTCLHLHFVVVQFDSVSDSIV

SEQ ID NO: 2671289 - protein, 23 aa, Entamoeba histolytica
DFTDEEKRLLGLSQETTQTGLFN

SEQ ID NO: 2671290 - protein, 24 aa, Entamoeba histolytica
DFTNQRLCKSVQFDKQLGLDSSFD

SEQ ID NO: 2671291 - protein, 20 aa, Entamoeba histolytica
DFTRRSFLSSITKTSLPSLF

SEQ ID NO: 2671292 - protein, 25 aa, Entamoeba histolytica
DFTTNRVEGFFGHLKKIINHNNLPL

SEQ ID NO: 2671293 - protein, 20 aa, Entamoeba histolytica
DFVRCPQCQGYIPKNNTKSI

SEQ ID NO: 2671294 - protein, 25 aa, Entamoeba histolytica
DFVTIKGIVKVRWISYNIDEIPELE

SEQ ID NO: 2671295 - protein, 25 aa, Entamoeba histolytica
DFYVPDIIGALILSMSKRIMNELIY

SEQ ID NO: 2671296 - protein, 24 aa, Entamoeba histolytica
DFYVPDIIGSLILSMSKRIMNELI

SEQ ID NO: 2671297 - protein, 23 aa, Entamoeba histolytica
DGAPCGLLNHFAVSCRINARKHP

SEQ ID NO: 2671298 - protein, 26 aa, Entamoeba histolytica
DGAVYVWNLTTSKFACCVYPEVNVQQ

SEQ ID NO: 2671299 - protein, 20 aa, Entamoeba histolytica
DGCFIKCLLEKGEITLSDPR

SEQ ID NO: 2671300 - protein, 21 aa, Entamoeba histolytica
DGCPAFYKFLDLLGTKIELQG

SEQ ID NO: 2671301 - protein, 22 aa, Entamoeba histolytica
DGDFLLKWSFSNMKGVIENLKC

SEQ ID NO: 2671302 - protein, 23 aa, Entamoeba histolytica
DGDGWKPTSKFVHSREQEEGIYR

SEQ ID NO: 2671303 - protein, 26 aa, Entamoeba histolytica
DGDKALELWYNFYYLFEGIFNHSLNE

SEQ ID NO: 2671304 - protein, 22 aa, Entamoeba histolytica
DGDKINVLFSFIRTHTNSKMIV

SEQ ID NO: 2671305 - protein, 29 aa, Entamoeba histolytica
DGDKRINIIIKCLNKIILDKKEIDSVALQ

SEQ ID NO: 2671306 - protein, 24 aa, Entamoeba histolytica
DGEFKLKLLHDGLISNFEFQNYIL

SEQ ID NO: 2671307 - protein, 22 aa, Entamoeba histolytica
DGEMLNCLILANYVVQNSPNFR

SEQ ID NO: 2671308 - protein, 23 aa, Entamoeba histolytica
DGEPADCILYYNYRDKYTYERFF

SEQ ID NO: 2671309 - protein, 20 aa, Entamoeba histolytica
DGESPIIMFLKAINQKIIGP

SEQ ID NO: 2671310 - protein, 30 aa, Entamoeba histolytica
DGESYPDFFLNDWFSLKEFQNFEGQIKQSS

SEQ ID NO: 2671311 - protein, 19 aa, Entamoeba histolytica
DGETIREKRVKEKESKNQE

SEQ ID NO: 2671312 - protein, 18 aa, Entamoeba histolytica
DGFGYRPTLDKLPELSLP

SEQ ID NO: 2671313 - protein, 17 aa, Entamoeba histolytica
DGFHSEGVFRLAGQAGL

SEQ ID NO: 2671314 - protein, 18 aa, Entamoeba histolytica
DGFRACNSLEYLNLSNNS

SEQ ID NO: 2671315 - protein, 18 aa, Entamoeba histolytica
DGFYLRTGKKREVLGAEQ

SEQ ID NO: 2671316 - protein, 21 aa, Entamoeba histolytica
DGGHLIWCIVFEKLANTQFRV

SEQ ID NO: 2671317 - protein, 20 aa, Entamoeba histolytica
DGGIELYKILPSFKNVKKLD

SEQ ID NO: 2671318 - protein, 25 aa, Entamoeba histolytica
DGGVSRSDCMLQFQADICNCTVIRL

SEQ ID NO: 2671319 - protein, 20 aa, Entamoeba histolytica
DGHLLWRINEVLANRYQLIK

SEQ ID NO: 2671320 - protein, 36 aa, Entamoeba histolytica; identical to SEQ ID NO: 2476964

SEQ ID NO: 2671321 - protein, 20 aa, Entamoeba histolytica
DGHVKLADFGYAAQLNQKQK

SEQ ID NO: 2671322 - protein, 25 aa, Entamoeba histolytica
DGICASELRDFCSMLNDHDELTLMY

SEQ ID NO: 2671323 - protein, 24 aa, Entamoeba histolytica
DGIIKHFACVSIRERDSWVEALLD

SEQ ID NO: 2671324 - protein, 26 aa, Entamoeba histolytica
DGILDKLEFRSCLSSMGLIDIDFTGG

SEQ ID NO: 2671325 - protein, 21 aa, Entamoeba histolytica
DGILPGDRIKAVTNRVTIDVD

SEQ ID NO: 2671326 - protein, 17 aa, Entamoeba histolytica
DGIRFNPDIVVCGMQEL

SEQ ID NO: 2671327 - protein, 19 aa, Entamoeba histolytica
DGISRKIFERWCTDKKNGV

SEQ ID NO: 2671328 - protein, 22 aa, Entamoeba histolytica
DGITRPPFVQLLLKVNPAMYLY

SEQ ID NO: 2671329 - protein, 25 aa, Entamoeba histolytica
DGIWAALCWVSILAAESERAQRLVG

SEQ ID NO: 2671330 - protein, 19 aa, Entamoeba histolytica
DGKAGYLFMRSQKTGKMKR

SEQ ID NO: 2671331 - protein, 25 aa, Entamoeba histolytica
DGKELMKLGAKFIYLSNGSFMQKSG

SEQ ID NO: 2671332 - protein, 25 aa, Entamoeba histolytica
DGKIFKYVIWYKVEYSRYLEEKEEM

SEQ ID NO: 2671333 - protein, 19 aa, Entamoeba histolytica
DGKIKIWNVRSLYEDNVED

SEQ ID NO: 2671334 - protein, 18 aa, Entamoeba histolytica
DGKLFALRNLCILRDQII

SEQ ID NO: 2671335 - protein, 20 aa, Entamoeba histolytica
DGKQLWSYCHKNFISDIQWK

SEQ ID NO: 2671336 - protein, 26 aa, Entamoeba histolytica
DGKRFHLTEGFLFYPNSEYIPFTNNY

SEQ ID NO: 2671337 - protein, 18 aa, Entamoeba histolytica
DGKRRIRYFGGLKFVTPG

SEQ ID NO: 2671338 - protein, 21 aa, Entamoeba histolytica
DGKRYFKQCEFKLWRKQPQPI

SEQ ID NO: 2671339 - protein, 19 aa, Entamoeba histolytica
DGKSIIWEILKQLRPGMSL

SEQ ID NO: 2671340 - protein, 18 aa, Entamoeba histolytica
DGKSSLGNFILKDNKFET

SEQ ID NO: 2671341 - protein, 23 aa, Entamoeba histolytica
DGKVCYCDSCKGLVKPDIVFFGE

SEQ ID NO: 2671342 - protein, 20 aa, Entamoeba histolytica
DGKVFCALIHRHRPDLLDWE

SEQ ID NO: 2671343 - protein, 18 aa, Entamoeba histolytica
DGKYYLKNHCEINEDIKF

SEQ ID NO: 2671344 - protein, 25 aa, Entamoeba histolytica
DGLISDIWSCGVILYVMAFGLMPFD

SEQ ID NO: 2671345 - protein, 26 aa, Entamoeba histolytica
DGLKSGMGGNGFAREGGFPGGTYTFT

SEQ ID NO: 2671346 - protein, 17 aa, Entamoeba histolytica
DGLKWLELFEDELIGRV

SEQ ID NO: 2671347 - protein, 28 aa, Entamoeba histolytica
DGLVIIRGKLVWKITVCVHIINDCGNLM

SEQ ID NO: 2671348 - protein, 20 aa, Entamoeba histolytica
DGNWLIKRNVTLGEKDIGIY

SEQ ID NO: 2671349 - protein, 20 aa, Entamoeba histolytica
DGPESVTCAFDCAVNLGYRG

SEQ ID NO: 2671350 - protein, 17 aa, Entamoeba histolytica
DGPIEFLNKILAIPIKF

SEQ ID NO: 2671351 - protein, 24 aa, Entamoeba histolytica
DGPMIIEMVRLLQITPVEEFIPDD

SEQ ID NO: 2671352 - protein, 20 aa, Entamoeba histolytica
DGPSGLRIGSKLFIKNSTSF

SEQ ID NO: 2671353 - protein, 24 aa, Entamoeba histolytica
DGQFLGATGMYPPRIRMFELDQLS

SEQ ID NO: 2671354 - protein, 18 aa, Entamoeba histolytica
DGQPSLDNGEYWDQIISR

SEQ ID NO: 2671355 - protein, 22 aa, Entamoeba histolytica
DGQYKITNWKSPKIMCTNEGGV

SEQ ID NO: 2671356 - protein, 18 aa, Entamoeba histolytica
DGRFFHIDFGHFLGHFKS

SEQ ID NO: 2671357 - protein, 22 aa, Entamoeba histolytica
DGRIIKYVIWYKVNYSRYLKEK

SEQ ID NO: 2671358 - protein, 20 aa, Entamoeba histolytica
DGRITYPLVLIYSSPTGINP

SEQ ID NO: 2671359 - protein, 18 aa, Entamoeba histolytica
DGRLEIIFEKDVNGAVYS

SEQ ID NO: 2671360 - protein, 17 aa, Entamoeba histolytica
DGRRRYCHCKREVYQRS

SEQ ID NO: 2671361 - protein, 27 aa, Entamoeba histolytica
DGSVMAVSFKTAITIWDVLSNKLLFSL

SEQ ID NO: 2671362 - protein, 19 aa, Entamoeba histolytica
DGTCIRDYIHVVDLAQGHV

SEQ ID NO: 2671363 - protein, 25 aa, Entamoeba histolytica
DGTIPVFRIDVSKWVEQTYFDKQIP

SEQ ID NO: 2671364 - protein, 23 aa, Entamoeba histolytica
DGTKLLYNFALIVAHNAAATVSE

SEQ ID NO: 2671365 - protein, 22 aa, Entamoeba histolytica
DGVEFKSKFIPIIYNEENGQEL

SEQ ID NO: 2671366 - protein, 31 aa, Entamoeba histolytica
DGVGIIPLDCPWYICYFMGRPQAHFVCTTQN

SEQ ID NO: 2671367 - protein, 20 aa, Entamoeba histolytica
DGVGRIGYPLAKKVLNEYKR

SEQ ID NO: 2671368 - protein, 19 aa, Entamoeba histolytica
DGVLFECAMRKLWGEKRIR

SEQ ID NO: 2671369 - protein, 24 aa, Entamoeba histolytica
DGWICFKNSQLLSGQIEKSIIGSG

SEQ ID NO: 2671370 - protein, 17 aa, Entamoeba histolytica
DGWSNYITSFSIDSIEY

SEQ ID NO: 2671371 - protein, 30 aa, Entamoeba histolytica
DGYEYSNYFILFLLCINFLYRQNNYAFEFD

SEQ ID NO: 2671372 - protein, 26 aa, Entamoeba histolytica
DGYHPYRVILCRVVLGREGRDYVVKY

SEQ ID NO: 2671373 - protein, 19 aa, Entamoeba histolytica
DGYISYWRLFRNGRWKPVK

SEQ ID NO: 2671374 - protein, 20 aa, Entamoeba histolytica
DGYLWVAMEYMDGGCLTDLL

SEQ ID NO: 2671375 - protein, 19 aa, Entamoeba histolytica
DGYLYILIREFGFSAKLKQ

SEQ ID NO: 2671376 - protein, 20 aa, Entamoeba histolytica
DGYYSKIMCCNKIQLTKTKE

SEQ ID NO: 2671377 - protein, 22 aa, Entamoeba histolytica
DHFLCHGGMRTVEFKVVDIDPS

SEQ ID NO: 2671378 - protein, 18 aa, Entamoeba histolytica
DHFYEVLSNNALKRFNNF

SEQ ID NO: 2671379 - protein, 18 aa, Entamoeba histolytica
DHGKKYMFSLTWNAPLEA

SEQ ID NO: 2671380 - protein, 21 aa, Entamoeba histolytica
DHHNPSLIVLCHIVDDMYKYY

SEQ ID NO: 2671381 - protein, 21 aa, Entamoeba histolytica
DHHPPRFNHLLKIVGDIVDYV

SEQ ID NO: 2671382 - protein, 19 aa, Entamoeba histolytica
DHHPPRFNHLLKVVGEIVK

SEQ ID NO: 2671383 - protein, 19 aa, Entamoeba histolytica
DHIKKWLNKCEIKSYETVQ

SEQ ID NO: 2671384 - protein, 18 aa, Entamoeba histolytica
DHISEFELPGPLPLPKEF

SEQ ID NO: 2671385 - protein, 22 aa, Entamoeba histolytica
DHIVICAPFLKNQYVSYSLKKL

SEQ ID NO: 2671386 - protein, 22 aa, Entamoeba histolytica
DHKIACSFKPYGLYDGNKNVIG

SEQ ID NO: 2671387 - protein, 21 aa, Entamoeba histolytica
DHKMYIFQFMFMINNDADMPK

SEQ ID NO: 2671388 - protein, 21 aa, Entamoeba histolytica
DHKMYIFQFMFMINNDTDTPK

SEQ ID NO: 2671389 - protein, 18 aa, Entamoeba histolytica
DHLISLGNHCFVNCNKLL

SEQ ID NO: 2671390 - protein, 23 aa, Entamoeba histolytica
DHLKRCFQAGFGFALTKTYPLEK

SEQ ID NO: 2671391 - protein, 17 aa, Entamoeba histolytica
DHLPEFKESCWRVAFNG

SEQ ID NO: 2671392 - protein, 22 aa, Entamoeba histolytica
DHLPVRCIAIIKPRKINTSLLK

SEQ ID NO: 2671393 - protein, 22 aa, Entamoeba histolytica
DHMGRTALHYCALYGNAVMANI

SEQ ID NO: 2671394 - protein, 22 aa, Entamoeba histolytica
DHMPRYESVVLLVSCVGTISRT

SEQ ID NO: 2671395 - protein, 19 aa, Entamoeba histolytica
DHMYRMAILAMIFCPSHLD

SEQ ID NO: 2671396 - protein, 23 aa, Entamoeba histolytica
DHPIIGDLLRWLIDIRNYSVRCV

SEQ ID NO: 2671397 - protein, 25 aa, Entamoeba histolytica
DHPNLIKMIGCWLFGNQVFISMEYC

SEQ ID NO: 2671398 - protein, 22 aa, Entamoeba histolytica
DHPNLIKTIGCFLYDHKVYIGM

SEQ ID NO: 2671399 - protein, 19 aa, Entamoeba histolytica
DHPYIIKLYDVFDGNDGKL

SEQ ID NO: 2671400 - protein, 26 aa, Entamoeba histolytica
DHQPIIFKFFFKDDVKLGNVIIVCRP

SEQ ID NO: 2671401 - protein, 23 aa, Entamoeba histolytica
DHRMPIHLFTYIHGISYHLLEIV

SEQ ID NO: 2671402 - protein, 19 aa, Entamoeba histolytica
DHSMLCLHAGISPDLKNIG

SEQ ID NO: 2671403 - protein, 18 aa, Entamoeba histolytica
DHSSIFEHFLLRSKEKEM

SEQ ID NO: 2671404 - protein, 18 aa, Entamoeba histolytica
DHSVFKIQIIIDVDPVFT

SEQ ID NO: 2671405 - protein, 26 aa, Entamoeba histolytica
DHVIPGQKVSFCICKIRKGKCPGGSV

SEQ ID NO: 2671406 - protein, 25 aa, Entamoeba histolytica
DHVSGIIALLFNWILNDCDVYLPEG

SEQ ID NO: 2671407 - protein, 23 aa, Entamoeba histolytica
DHYKKRKGYKHKRHSISSYDQSS

SEQ ID NO: 2671408 - protein, 25 aa, Entamoeba histolytica
DIACGLRKCATCNQTNLPLIGKTQY

SEQ ID NO: 2671409 - protein, 24 aa, Entamoeba histolytica
DIAGLRKQYDYVFVGCGRQKPYTF

SEQ ID NO: 2671410 - protein, 26 aa, Entamoeba histolytica
DIAKIIYRLAYHVYKTKELIEKYGSE

SEQ ID NO: 2671411 - protein, 26 aa, Entamoeba histolytica
DIALSLIGGFVFLRLFCPALAAPEGS

SEQ ID NO: 2671412 - protein, 24 aa, Entamoeba histolytica
DIASCIRYLFFFIGSSIVDFTQTI

SEQ ID NO: 2671413 - protein, 23 aa, Entamoeba histolytica
DICILKKGIKWFIQLYGNLINSN

SEQ ID NO: 2671414 - protein, 22 aa, Entamoeba histolytica
DICKNCDLMDNFIEEIKDDKIN

SEQ ID NO: 2671415 - protein, 20 aa, Entamoeba histolytica
DICSNVDSFFEKGVIIKSII

SEQ ID NO: 2671416 - protein, 30 aa, Entamoeba histolytica
DIDEQWKLTEIKGIEFIKESNGMIICNKHK

SEQ ID NO: 2671417 - protein, 23 aa, Entamoeba histolytica
DIDKEIPAIVNVLKPSSEKLSIM

SEQ ID NO: 2671418 - protein, 27 aa, Entamoeba histolytica
DIDLLLKKCQSEGGLQSFMSDYEQTMK

SEQ ID NO: 2671419 - protein, 18 aa, Entamoeba histolytica
DIDVSFQLLNIFSSDNAQ

SEQ ID NO: 2671420 - protein, 41 aa, Entamoeba histolytica; identical to SEQ ID NO: 2477083

SEQ ID NO: 2671421 - protein, 21 aa, Entamoeba histolytica
DIEAAALCLKTMHSVEKKNVL

SEQ ID NO: 2671422 - protein, 25 aa, Entamoeba histolytica
DIEELSHAVYIYWRAKEMVKTKEYE

SEQ ID NO: 2671423 - protein, 24 aa, Entamoeba histolytica
DIEFVRKSVQAFGKCALKLEKVAD

SEQ ID NO: 2671424 - protein, 21 aa, Entamoeba histolytica
DIEGAWEIFFRIYKRIHKSIN

SEQ ID NO: 2671425 - protein, 24 aa, Entamoeba histolytica
DIEGYPFRIAVVFQSPQQLLSSAL

SEQ ID NO: 2671426 - protein, 24 aa, Entamoeba histolytica
DIEHYTRTDLFPWREEMPEVQTIR

SEQ ID NO: 2671427 - protein, 25 aa, Entamoeba histolytica
DIEKEMVCHVLTFKYPFNSEITKFD

SEQ ID NO: 2671428 - protein, 18 aa, Entamoeba histolytica
DIEKGICITNAFNNAFLT

SEQ ID NO: 2671429 - protein, 24 aa, Entamoeba histolytica
DIEKIKIALELSRYNHLHDLRKYI

SEQ ID NO: 2671430 - protein, 20 aa, Entamoeba histolytica
DIELGKKLYEFARYWNERNV

SEQ ID NO: 2671431 - protein, 28 aa, Entamoeba histolytica
DIEYLCGVLQMIVSFSMPSFLYHIENVE

SEQ ID NO: 2671432 - protein, 17 aa, Entamoeba histolytica
DIFGCFQKEPLPFSNEY

SEQ ID NO: 2671433 - protein, 27 aa, Entamoeba histolytica
DIFKLEDICFQFSMKIHSLTIPQIQYP

SEQ ID NO: 2671434 - protein, 23 aa, Entamoeba histolytica
DIFKSSHPLPSRPKSLSRSVPTL

SEQ ID NO: 2671435 - protein, 25 aa, Entamoeba histolytica
DIFSVNYYLSFDFIDEEGMKYNCAT

SEQ ID NO: 2671436 - protein, 24 aa, Entamoeba histolytica
DIFTQMFWELSMKNFDDFITKLVT

SEQ ID NO: 2671437 - protein, 20 aa, Entamoeba histolytica
DIGCTCTLIYIWEEDNKVYI

SEQ ID NO: 2671438 - protein, 19 aa, Entamoeba histolytica
DIGDFFCCHGGISPDMTTI

SEQ ID NO: 2671439 - protein, 25 aa, Entamoeba histolytica
DIGDNIEVVLKWRRGDKKENKGTIE

SEQ ID NO: 2671440 - protein, 19 aa, Entamoeba histolytica
DIGGSFAIKNIKYNDKYDS

SEQ ID NO: 2671441 - protein, 17 aa, Entamoeba histolytica
DIGKALRMPDLEEAHAY

SEQ ID NO: 2671442 - protein, 18 aa, Entamoeba histolytica
DIGYTKLRVPKLVKAENI

SEQ ID NO: 2671443 - protein, 18 aa, Entamoeba histolytica
DIHFLVSVVYTLPRLDLD

SEQ ID NO: 2671444 - protein, 19 aa, Entamoeba histolytica
DIHIFDIINSYPLKITPCE

SEQ ID NO: 2671445 - protein, 25 aa, Entamoeba histolytica
DIHPLATPCLFSFNANNYYFSLSID

SEQ ID NO: 2671446 - protein, 33 aa, Entamoeba histolytica
DIHQFCIGFYFSIQSIKEWEWISVGQNSFAFIS

SEQ ID NO: 2671447 - protein, 27 aa, Entamoeba histolytica
DIHRVIRCGFILSGGPAAGGHNVVAGL

SEQ ID NO: 2671448 - protein, 18 aa, Entamoeba histolytica
DIIEIAVVLVRFKCDYTI

SEQ ID NO: 2671449 - protein, 20 aa, Entamoeba histolytica
DIIFIKNLYIKNSFYEIRIF

SEQ ID NO: 2671450 - protein, 19 aa, Entamoeba histolytica
DIIICDWMGINLYYDSLLN

SEQ ID NO: 2671451 - protein, 18 aa, Entamoeba histolytica
DIIIPCFSFVRDIIHAPI

SEQ ID NO: 2671452 - protein, 20 aa, Entamoeba histolytica
DIIIPPRINTSIMVTPTEIQ

SEQ ID NO: 2671453 - protein, 25 aa, Entamoeba histolytica
DIINRLPSLPLYRIEVLCDDNNYSI

SEQ ID NO: 2671454 - protein, 27 aa, Entamoeba histolytica
DIIPLYDSVCIRFREGYQMEYWYYYLK

SEQ ID NO: 2671455 - protein, 18 aa, Entamoeba histolytica
DIIPRGYAFPNSNTCTKE

SEQ ID NO: 2671456 - protein, 21 aa, Entamoeba histolytica
DIIPVVFRYYEKVIITKPNKY

SEQ ID NO: 2671457 - protein, 24 aa, Entamoeba histolytica
DIIQVCLKACKFIAQHDLMENVDM

SEQ ID NO: 2671458 - protein, 18 aa, Entamoeba histolytica
DIIRLKKLVEECSNKMPL

SEQ ID NO: 2671459 - protein, 18 aa, Entamoeba histolytica
DIITCFIYSYTNKKTNQL

SEQ ID NO: 2671460 - protein, 23 aa, Entamoeba histolytica
DIIWPEFKSLISTRGEQITINIK

SEQ ID NO: 2671461 - protein, 32 aa, Entamoeba histolytica
DIIYKLTELFITFNFSNTFLYFMSRALVELHA

SEQ ID NO: 2671462 - protein, 22 aa, Entamoeba histolytica
DIKAVCYMECSALTRSGLNQVF

SEQ ID NO: 2671463 - protein, 27 aa, Entamoeba histolytica
DIKCASLALKITKIWMQKSINKEVAEL

SEQ ID NO: 2671464 - protein, 20 aa, Entamoeba histolytica
DIKDLRCFGLGIGPITWMKG

SEQ ID NO: 2671465 - protein, 25 aa, Entamoeba histolytica
DIKDSEAYLYLLHHLNNNCSLEALN

SEQ ID NO: 2671466 - protein, 22 aa, Entamoeba histolytica
DIKKCCFSYCTETAIGTLKFIH

SEQ ID NO: 2671467 - protein, 19 aa, Entamoeba histolytica
DIKKEFKDILDAFRIRATE

SEQ ID NO: 2671468 - protein, 19 aa, Entamoeba histolytica
DIKPKRVVFKLVEEYIKVP

SEQ ID NO: 2671469 - protein, 19 aa, Entamoeba histolytica
DIKSVFTAVFRLLDIKDQG

SEQ ID NO: 2671470 - protein, 19 aa, Entamoeba histolytica
DIKTFVWKQHPVVLEDFQD

SEQ ID NO: 2671471 - protein, 22 aa, Entamoeba histolytica
DIKVMYLCMFFVLKNISYSTMK

SEQ ID NO: 2671472 - protein, 26 aa, Entamoeba histolytica
DILDRLIEIVAFPRLYYKTIPLPFDY

SEQ ID NO: 2671473 - protein, 20 aa, Entamoeba histolytica
DILFEYPHTFIWQENDSILF

SEQ ID NO: 2671474 - protein, 24 aa, Entamoeba histolytica
DILGRLKKGLIYNFGSNTCWHLYG

SEQ ID NO: 2671475 - protein, 23 aa, Entamoeba histolytica
DILKDLQDGIILSRYLQIETGKV

SEQ ID NO: 2671476 - protein, 20 aa, Entamoeba histolytica
DILKEPRYNPHIDFLTVPHP

SEQ ID NO: 2671477 - protein, 17 aa, Entamoeba histolytica
DILKGFYPETIFNEENN

SEQ ID NO: 2671478 - protein, 17 aa, Entamoeba histolytica
DILNGFRIIGDLGEENG

SEQ ID NO: 2671479 - protein, 20 aa, Entamoeba histolytica
DILPCFYDSIELLHYLYSLT

SEQ ID NO: 2671480 - protein, 23 aa, Entamoeba histolytica
DILPFVCPDNIVVGGWDISKVNM

SEQ ID NO: 2671481 - protein, 22 aa, Entamoeba histolytica
DILRRAFMSRMFPSETIKKLGI

SEQ ID NO: 2671482 - protein, 22 aa, Entamoeba histolytica
DILTEYGYYFTAHPMKGKSETK

SEQ ID NO: 2671483 - protein, 25 aa, Entamoeba histolytica
DILVKRIIPLMGICDDEFIKMIMDI

SEQ ID NO: 2671484 - protein, 17 aa, Entamoeba histolytica
DIMKCLPPDATIEQIEY

SEQ ID NO: 2671485 - protein, 24 aa, Entamoeba histolytica
DIMLKYHVITVFVLIAQKKLVPHL

SEQ ID NO: 2671486 - protein, 24 aa, Entamoeba histolytica
DIMPFERLSILIKYIHARNHHQIL

SEQ ID NO: 2671487 - protein, 26 aa, Entamoeba histolytica
DINEFSRLMLVPLKRLSSGDEKVIEV

SEQ ID NO: 2671488 - protein, 27 aa, Entamoeba histolytica
DINEYKVDFCFRDCIGIKYKQTRKSSL

SEQ ID NO: 2671489 - protein, 22 aa, Entamoeba histolytica
DINKFCRIFNPPTCNCNLLPVD

SEQ ID NO: 2671490 - protein, 23 aa, Entamoeba histolytica
DINKLIIRRIIRTEYKVAYPNLY

SEQ ID NO: 2671491 - protein, 20 aa, Entamoeba histolytica
DINTLCSFYGFNILSKKGLS

SEQ ID NO: 2671492 - protein, 23 aa, Entamoeba histolytica
DIPEDRKRYFTSFYAIVNDPSVA

SEQ ID NO: 2671493 - protein, 17 aa, Entamoeba histolytica
DIPEIYPNFEFHGKYAK

SEQ ID NO: 2671494 - protein, 26 aa, Entamoeba histolytica
DIPENIFWCKYFRFLYTKCGKEKQYQ

SEQ ID NO: 2671495 - protein, 18 aa, Entamoeba histolytica
DIPFIPFAPFIEQVENLC

SEQ ID NO: 2671496 - protein, 19 aa, Entamoeba histolytica
DIPPSVTFSKDFQFISEYQ

SEQ ID NO: 2671497 - protein, 22 aa, Entamoeba histolytica
DIQDCFSEFCDLILSINEQTLF

SEQ ID NO: 2671498 - protein, 17 aa, Entamoeba histolytica
DIQELISHIFVIDPEQR

SEQ ID NO: 2671499 - protein, 20 aa, Entamoeba histolytica
DIQFFNGIIVIAFKKEIYRI

SEQ ID NO: 2671500 - protein, 32 aa, Entamoeba histolytica
DIQFKQDVVIKICWLTDKFGPDIKWKFDSMLE

SEQ ID NO: 2671501 - protein, 20 aa, Entamoeba histolytica
DIQHYFEIFSQYDSKACKWL

SEQ ID NO: 2671502 - protein, 24 aa, Entamoeba histolytica
DIQKSARVKQVFLLLKSLPEENYT

SEQ ID NO: 2671503 - protein, 25 aa, Entamoeba histolytica
DIQLPEYLICPSLSLDQWYIIILCF

SEQ ID NO: 2671504 - protein, 25 aa, Entamoeba histolytica
DIQNSWIFGVGYGFHIRGEDKSYIG

SEQ ID NO: 2671505 - protein, 18 aa, Entamoeba histolytica
DIQQGCLGDCYFLAALAS

SEQ ID NO: 2671506 - protein, 18 aa, Entamoeba histolytica
DIQYFWKNYILQLTDIKD

SEQ ID NO: 2671507 - protein, 21 aa, Entamoeba histolytica
DIREGHALLAIMKQITHTNVK

SEQ ID NO: 2671508 - protein, 23 aa, Entamoeba histolytica
DIRKSPDLLIWAVYNLVRGVDYL

SEQ ID NO: 2671509 - protein, 19 aa, Entamoeba histolytica
DIRMERCGYTIPAHSTIVT

SEQ ID NO: 2671510 - protein, 24 aa, Entamoeba histolytica
DIRNEVKCDLSLASRIVEIGSEKG

SEQ ID NO: 2671511 - protein, 22 aa, Entamoeba histolytica
DIRQFARLIAILNRGFGKDIKS

SEQ ID NO: 2671512 - protein, 18 aa, Entamoeba histolytica
DISGSFGRTTKKQSDTST

SEQ ID NO: 2671513 - protein, 18 aa, Entamoeba histolytica
DISSFPWETLASTLKRFV

SEQ ID NO: 2671514 - protein, 17 aa, Entamoeba histolytica
DISSLAWYFNQLTPNGV

SEQ ID NO: 2671515 - protein, 21 aa, Entamoeba histolytica
DITGILEAYVSFKTNRTEKQT

SEQ ID NO: 2671516 - protein, 18 aa, Entamoeba histolytica
DITLYKYIWKCITNSRLN

SEQ ID NO: 2671517 - protein, 20 aa, Entamoeba histolytica
DITNGYKWLLLAYIPDRAKV

SEQ ID NO: 2671518 - protein, 19 aa, Entamoeba histolytica
DITVIAWGFGLERPTMISY

SEQ ID NO: 2671519 - protein, 25 aa, Entamoeba histolytica
DIVGKDDKRTCCFTKSYTKIVEGTG

SEQ ID NO: 2671520 - protein, 24 aa, Entamoeba histolytica
DIVHSYFEGMNWVLGYYYKGCQSW

SEQ ID NO: 2671521 - protein, 17 aa, Entamoeba histolytica
DIVIWMGDLNYRIEMSD

SEQ ID NO: 2671522 - protein, 26 aa, Entamoeba histolytica
DIVLCKYCDFIYIAVTEDIVFSNNIK

SEQ ID NO: 2671523 - protein, 23 aa, Entamoeba histolytica
DIVLEKYFPVYLLIRQYLLISQK

SEQ ID NO: 2671524 - protein, 21 aa, Entamoeba histolytica
DIVNLPIEELVSLMNDKYQQV

SEQ ID NO: 2671525 - protein, 18 aa, Entamoeba histolytica
DIVNRYGLVIFDYNGDSR

SEQ ID NO: 2671526 - protein, 19 aa, Entamoeba histolytica
DIVPIPIGIEVEGGKFEVL

SEQ ID NO: 2671527 - protein, 19 aa, Entamoeba histolytica
DIVRPRKLLYIAIDGVAPR

SEQ ID NO: 2671528 - protein, 19 aa, Entamoeba histolytica
DIWLHVIPQIIARIQSNVP

SEQ ID NO: 2671529 - protein, 25 aa, Entamoeba histolytica
DIWQEIKILLDITMKYFPQIVSTCD

SEQ ID NO: 2671530 - protein, 25 aa, Entamoeba histolytica
DIWSYGCILAEMFLGKPLFPGSSTS

SEQ ID NO: 2671531 - protein, 17 aa, Entamoeba histolytica
DIYDEDHFIFSLENHNR

SEQ ID NO: 2671532 - protein, 18 aa, Entamoeba histolytica
DIYIKKLLLRISENDDFT

SEQ ID NO: 2671533 - protein, 19 aa, Entamoeba histolytica
DIYLKKGVILLFYTDYYLQ

SEQ ID NO: 2671534 - protein, 17 aa, Entamoeba histolytica
DIYPEWDNEITITPQNI

SEQ ID NO: 2671535 - protein, 19 aa, Entamoeba histolytica
DIYSGYFFHVEFVGEALKS

SEQ ID NO: 2671536 - protein, 21 aa, Entamoeba histolytica
DIYSLGLVIWFVFESKGTDPF

SEQ ID NO: 2671537 - protein, 18 aa, Entamoeba histolytica
DIYTVGIMPCIAKKVESQ

SEQ ID NO: 2671538 - protein, 19 aa, Entamoeba histolytica
DKAMSTCQYFFPEMSADFF

SEQ ID NO: 2671539 - protein, 26 aa, Entamoeba histolytica
DKARGAAPCVLFFDELDSIAQSRGSN

SEQ ID NO: 2671540 - protein, 25 aa, Entamoeba histolytica
DKARQAAPCVLFFDELDSIGRARGG

SEQ ID NO: 2671541 - protein, 27 aa, Entamoeba histolytica
DKCKERVLKMVLVWCKKCDSLWLSMNS

SEQ ID NO: 2671542 - protein, 28 aa, Entamoeba histolytica
DKCKERVLKMVLVWCKKCDSLWLSMNSF

SEQ ID NO: 2671543 - protein, 24 aa, Entamoeba histolytica
DKCKKMCSVVRNFDKINSIHYSIS

SEQ ID NO: 2671544 - protein, 28 aa, Entamoeba histolytica
DKDAIIRLRFVPNFFGSGNFVSILSIKI

SEQ ID NO: 2671545 - protein, 21 aa, Entamoeba histolytica
DKDGFLSFNGFIKIFEKAMIF

SEQ ID NO: 2671546 - protein, 26 aa, Entamoeba histolytica
DKDLFICGSSQKLVICDFTENVKILY

SEQ ID NO: 2671547 - protein, 19 aa, Entamoeba histolytica
DKDLKGRIITTLQLLELLL

SEQ ID NO: 2671548 - protein, 20 aa, Entamoeba histolytica
DKDLPVCFILTKSDQLQQTV

SEQ ID NO: 2671549 - protein, 26 aa, Entamoeba histolytica
DKDLRSLLLTDLRFSPDGSYLSVADD

SEQ ID NO: 2671550 - protein, 24 aa, Entamoeba histolytica
DKDPSQHIPICLVGNKSDLESERI

SEQ ID NO: 2671551 - protein, 17 aa, Entamoeba histolytica
DKDVFGIHYKIPKVDVQ

SEQ ID NO: 2671552 - protein, 25 aa, Entamoeba histolytica
DKDWGRCVCNLSDLAPVLVNGVKVK

SEQ ID NO: 2671553 - protein, 18 aa, Entamoeba histolytica
DKECIKNAEILMKYFHAH

SEQ ID NO: 2671554 - protein, 24 aa, Entamoeba histolytica
DKEDLKDVILVGGSTFIPFVQKIA

SEQ ID NO: 2671555 - protein, 26 aa, Entamoeba histolytica
DKEEILKLYTGIMKYGADFGLIELMF

SEQ ID NO: 2671556 - protein, 35 aa, Entamoeba histolytica
DKEELFEEVMCCGSFGASLFSAWMKTSSGSNLSIR

SEQ ID NO: 2671557 - protein, 24 aa, Entamoeba histolytica
DKEGGVCSNTKLAKLLSSKLGFPY

SEQ ID NO: 2671558 - protein, 25 aa, Entamoeba histolytica
DKEHKPSCYFCADIVAPTDSLSRRT

SEQ ID NO: 2671559 - protein, 18 aa, Entamoeba histolytica
DKEIMLFNRIKNIFNNEE

SEQ ID NO: 2671560 - protein, 19 aa, Entamoeba histolytica
DKEIQRFATNSADVKRLQE

SEQ ID NO: 2671561 - protein, 24 aa, Entamoeba histolytica
DKEMKEMIEAIVLPMTQKEKFEKL

SEQ ID NO: 2671562 - protein, 19 aa, Entamoeba histolytica
DKERVGCSQLLIEEGKEPE

SEQ ID NO: 2671563 - protein, 23 aa, Entamoeba histolytica
DKESWKAIPTMKLMPVLETALNY

SEQ ID NO: 2671564 - protein, 22 aa, Entamoeba histolytica
DKEVSAEIAFYVCAQVSDDTIH

SEQ ID NO: 2671565 - protein, 20 aa, Entamoeba histolytica
DKFETTVLWCLDTILEIEKI

SEQ ID NO: 2671566 - protein, 25 aa, Entamoeba histolytica
DKFTQMFWELGMKNFDDFITKLLKL

SEQ ID NO: 2671567 - protein, 24 aa, Entamoeba histolytica
DKFWKESIANIILKGGFDNQPIDE

SEQ ID NO: 2671568 - protein, 20 aa, Entamoeba histolytica
DKFWRIIRHEHIANASPYVV

SEQ ID NO: 2671569 - protein, 24 aa, Entamoeba histolytica
DKGELRPELILAINGLLQDLNHPN

SEQ ID NO: 2671570 - protein, 18 aa, Entamoeba histolytica
DKGHFVFSLVNPYGTKPV

SEQ ID NO: 2671571 - protein, 24 aa, Entamoeba histolytica
DKHNLKLSEFIGETLMVLPNANEY

SEQ ID NO: 2671572 - protein, 17 aa, Entamoeba histolytica
DKHVRKLICSCSTEQYC

SEQ ID NO: 2671573 - protein, 25 aa, Entamoeba histolytica
DKIISRGCGFLQNISDFEEGRKAIL

SEQ ID NO: 2671574 - protein, 20 aa, Entamoeba histolytica
DKIKEGFQVTKDFYKNGQSM

SEQ ID NO: 2671575 - protein, 19 aa, Entamoeba histolytica
DKIKILNKKGDWWQGECQG

SEQ ID NO: 2671576 - protein, 31 aa, Entamoeba histolytica
DKILEGLSGPNLRNELRIENEESYEEEDDDD

SEQ ID NO: 2671577 - protein, 20 aa, Entamoeba histolytica
DKILKVCVEPNIPIENVSKI

SEQ ID NO: 2671578 - protein, 31 aa, Entamoeba histolytica
DKIPITFFVLRNELFVPCSYHIASVDVERIG

SEQ ID NO: 2671579 - protein, 24 aa, Entamoeba histolytica
DKIQKCREMFKEVLNIVMDDNPPA

SEQ ID NO: 2671580 - protein, 20 aa, Entamoeba histolytica
DKIVLDFFVWWKCPIQTINT

SEQ ID NO: 2671581 - protein, 17 aa, Entamoeba histolytica
DKIYSIELTPNMTVMEF

SEQ ID NO: 2671582 - protein, 17 aa, Entamoeba histolytica
DKKADGFILVYSKQIEK

SEQ ID NO: 2671583 - protein, 23 aa, Entamoeba histolytica
DKKERMDFLLVQFRIALECEDYL

SEQ ID NO: 2671584 - protein, 17 aa, Entamoeba histolytica
DKKIQECHKRRIDMDRI

SEQ ID NO: 2671585 - protein, 18 aa, Entamoeba histolytica
DKKLLVELENIFYKPPNI

SEQ ID NO: 2671586 - protein, 17 aa, Entamoeba histolytica
DKKSIIEGINFEEFNQQ

SEQ ID NO: 2671587 - protein, 21 aa, Entamoeba histolytica
DKKVEVAQCEAEVSQVKKRLA

SEQ ID NO: 2671588 - protein, 26 aa, Entamoeba histolytica
DKKWKKRYLIWKGMVLYFYDKKGSKD

SEQ ID NO: 2671589 - protein, 22 aa, Entamoeba histolytica
DKKYKVIFERSLNEINCQVPEW

SEQ ID NO: 2671590 - protein, 25 aa, Entamoeba histolytica
DKLAIGFRLNPHFLDQIPEFDRTTK

SEQ ID NO: 2671591 - protein, 19 aa, Entamoeba histolytica
DKLDIDEEIKRVEISNKDS

SEQ ID NO: 2671592 - protein, 17 aa, Entamoeba histolytica
DKLDLSNIISIKDLSLS

SEQ ID NO: 2671593 - protein, 17 aa, Entamoeba histolytica
DKLIQIYPINKFQYSLQ

SEQ ID NO: 2671594 - protein, 19 aa, Entamoeba histolytica
DKLKEVFASVGEIKNSRVA

SEQ ID NO: 2671595 - protein, 19 aa, Entamoeba histolytica
DKLLYYLKMEHSIISSFLY

SEQ ID NO: 2671596 - protein, 21 aa, Entamoeba histolytica
DKLNKWLGLESNYLLYRNHLS

SEQ ID NO: 2671597 - protein, 35 aa, Entamoeba histolytica
DKLPERPQGEFILWQPTRHTLFLPNQILAAAGYDS

SEQ ID NO: 2671598 - protein, 19 aa, Entamoeba histolytica
DKLPKCLVMVGGKPIIQWQ

SEQ ID NO: 2671599 - protein, 22 aa, Entamoeba histolytica
DKLRLYIKTMVEYLKANSGRKI

SEQ ID NO: 2671600 - protein, 25 aa, Entamoeba histolytica
DKLSARLFFKSTIIYVGENDMSVEK

SEQ ID NO: 2671601 - protein, 29 aa, Entamoeba histolytica
DKLSSIGFELNYFITWFADLFIDVFPVRL

SEQ ID NO: 2671602 - protein, 21 aa, Entamoeba histolytica
DKLVECYQLILDVAAWINEKK

SEQ ID NO: 2671603 - protein, 20 aa, Entamoeba histolytica
DKLYICLMDGQSFCEECLHI

SEQ ID NO: 2671604 - protein, 29 aa, Entamoeba histolytica
DKMFYYKLYCSLSKCLTSSNIIVITNAVS

SEQ ID NO: 2671605 - protein, 21 aa, Entamoeba histolytica
DKMTICIKKNMGIIDDYLVND

SEQ ID NO: 2671606 - protein, 18 aa, Entamoeba histolytica
DKNFKSPYINYLSAIGEA

SEQ ID NO: 2671607 - protein, 25 aa, Entamoeba histolytica
DKNGLKVMLFSGINNCSTYLVYSQE

SEQ ID NO: 2671608 - protein, 26 aa, Entamoeba histolytica
DKNVLGTVCWALFFVVTRAAKQNPTF

SEQ ID NO: 2671609 - protein, 19 aa, Entamoeba histolytica
DKNWCGVLFSYFNDSDCFE

SEQ ID NO: 2671610 - protein, 22 aa, Entamoeba histolytica
DKPCYDGLDLIKGEIRNNLEAG

SEQ ID NO: 2671611 - protein, 22 aa, Entamoeba histolytica
DKPDVRFVIHHSLPKSLEGYYQ

SEQ ID NO: 2671612 - protein, 20 aa, Entamoeba histolytica
DKPKELDEIVTLINQLNDSN

SEQ ID NO: 2671613 - protein, 17 aa, Entamoeba histolytica
DKPKKKKARSWITDEDV

SEQ ID NO: 2671614 - protein, 21 aa, Entamoeba histolytica
DKPPLKRKVVDLQLIKNDDSQ

SEQ ID NO: 2671615 - protein, 22 aa, Entamoeba histolytica
DKPSCFPAFILNPPENSICIDA

SEQ ID NO: 2671616 - protein, 23 aa, Entamoeba histolytica
DKPSHGKLTMFGTEINEKTKESF

SEQ ID NO: 2671617 - protein, 27 aa, Entamoeba histolytica
DKPVEIEFFKPLTLITGPNGAGKTTII

SEQ ID NO: 2671618 - protein, 22 aa, Entamoeba histolytica
DKRCSCLAPWCEGEECEKCIKT

SEQ ID NO: 2671619 - protein, 26 aa, Entamoeba histolytica
DKREGIIMKIIESMIRNEVVVTTNPN

SEQ ID NO: 2671620 - protein, 21 aa, Entamoeba histolytica
DKRFPPVSGLVRAFFHISGYM

SEQ ID NO: 2671621 - protein, 23 aa, Entamoeba histolytica
DKRIKRSKSMPIIFFEEDNDKEE

SEQ ID NO: 2671622 - protein, 17 aa, Entamoeba histolytica
DKRKCIFKLNQIQTKFN

SEQ ID NO: 2671623 - protein, 21 aa, Entamoeba histolytica
DKRWKIRVKGYKELDQLIQTK

SEQ ID NO: 2671624 - protein, 21 aa, Entamoeba histolytica
DKSDGLKLCIQKFMNNLQGTV

SEQ ID NO: 2671625 - protein, 20 aa, Entamoeba histolytica
DKSGSLKISVIDFNNDVEQQ

SEQ ID NO: 2671626 - protein, 26 aa, Entamoeba histolytica
DKSGSNVFSIKELSFGTSNEKSTTNL

SEQ ID NO: 2671627 - protein, 25 aa, Entamoeba histolytica
DKSKGEVIITWYSMYQNILKQKLRI

SEQ ID NO: 2671628 - protein, 24 aa, Entamoeba histolytica
DKSKTAGWRLDYFFVSKDLVDSVT

SEQ ID NO: 2671629 - protein, 28 aa, Entamoeba histolytica
DKSPIPIRLPYSMAIKLFPLPTELHNKQ

SEQ ID NO: 2671630 - protein, 19 aa, Entamoeba histolytica
DKSQDEFIRPVFVPDSDSP

SEQ ID NO: 2671631 - protein, 17 aa, Entamoeba histolytica
DKTECLTMWKRLENKNN

SEQ ID NO: 2671632 - protein, 26 aa, Entamoeba histolytica
DKTFGDLWVEFLLRESGSLDAQQPTN

SEQ ID NO: 2671633 - protein, 20 aa, Entamoeba histolytica
DKTIECLSKAVAHCLTKDKK

SEQ ID NO: 2671634 - protein, 19 aa, Entamoeba histolytica
DKTRICWFNAGSQQLNDYK

SEQ ID NO: 2671635 - protein, 28 aa, Entamoeba histolytica
DKTRPETFFKLASCYFQGILVEKNEKLA

SEQ ID NO: 2671636 - protein, 22 aa, Entamoeba histolytica
DKTSVDPFAAFTSSTTTTNQLG

SEQ ID NO: 2671637 - protein, 19 aa, Entamoeba histolytica
DKTVRCVNFLNDLQTEVID

SEQ ID NO: 2671638 - protein, 22 aa, Entamoeba histolytica
DKVDLLIFFTELRRFCLDIINW

SEQ ID NO: 2671639 - protein, 20 aa, Entamoeba histolytica
DKVQEIKPSISLFQNNRKAA

SEQ ID NO: 2671640 - protein, 21 aa, Entamoeba histolytica
DKWITGIHCGYYLGIEDSSFV

SEQ ID NO: 2671641 - protein, 23 aa, Entamoeba histolytica
DKWSIKISLDYIDQIYKSMINAV

SEQ ID NO: 2671642 - protein, 24 aa, Entamoeba histolytica
DKYALKVISSFCGMDDLLNADILD

SEQ ID NO: 2671643 - protein, 26 aa, Entamoeba histolytica
DKYDSVFRFVLNNTLLVDTLDNARKI

SEQ ID NO: 2671644 - protein, 18 aa, Entamoeba histolytica
DKYLKLARKATFLEFRSK

SEQ ID NO: 2671645 - protein, 25 aa, Entamoeba histolytica
DKYNICVLSEAFVLYIQAMGGIFTP

SEQ ID NO: 2671646 - protein, 17 aa, Entamoeba histolytica
DKYPLEFSDSILQQRFI

SEQ ID NO: 2671647 - protein, 23 aa, Entamoeba histolytica
DKYPLLRKINCRLSCLPTKTALP

SEQ ID NO: 2671648 - protein, 24 aa, Entamoeba histolytica
DKYQLKFVGAIPIEPKICLAGETG

SEQ ID NO: 2671649 - protein, 18 aa, Entamoeba histolytica
DKYVICPLVPSSGPNQSS

SEQ ID NO: 2671650 - protein, 28 aa, Entamoeba histolytica
DKYYLSSRLHHISLWKTIFSDFLSEKVE

SEQ ID NO: 2671651 - protein, 19 aa, Entamoeba histolytica
DLADVNWAFNIRAHDIPFS

SEQ ID NO: 2671652 - protein, 22 aa, Entamoeba histolytica
DLAKTCIHYQLTHETMLYGYSR

SEQ ID NO: 2671653 - protein, 18 aa, Entamoeba histolytica
DLAPGIKSRFHPIQFDEI

SEQ ID NO: 2671654 - protein, 18 aa, Entamoeba histolytica
DLAQLPVRLFQFLPNDFE

SEQ ID NO: 2671655 - protein, 20 aa, Entamoeba histolytica
DLDIAFSKRLGILIDKKPEN

SEQ ID NO: 2671656 - protein, 25 aa, Entamoeba histolytica
DLDKLRISFRLKIIVSGVNSFLRTK

SEQ ID NO: 2671657 - protein, 23 aa, Entamoeba histolytica
DLDRQIRQNIEMSHKTTGAESQR

SEQ ID NO: 2671658 - protein, 20 aa, Entamoeba histolytica
DLDRRIGLEPVLPSEFHMMR

SEQ ID NO: 2671659 - protein, 25 aa, Entamoeba histolytica
DLDRWEYAKSAILVLFKPLDYAMGN

SEQ ID NO: 2671660 - protein, 19 aa, Entamoeba histolytica
DLDVFLVFMNNVLSRFMKV

SEQ ID NO: 2671661 - protein, 24 aa, Entamoeba histolytica
DLDWIDCLFTRFSSIPQLHQQLIQ

SEQ ID NO: 2671662 - protein, 17 aa, Entamoeba histolytica
DLEGFKIPIDDEQSLKL

SEQ ID NO: 2671663 - protein, 21 aa, Entamoeba histolytica
DLEIFRKSLDLSREPNQQEVP

SEQ ID NO: 2671664 - protein, 19 aa, Entamoeba histolytica
DLEIQQCRQTIVGHRAAIK

SEQ ID NO: 2671665 - protein, 32 aa, Entamoeba histolytica
DLEKLRLCCLPKVPYFVEMHASEFILLTKQEH

SEQ ID NO: 2671666 - protein, 31 aa, Entamoeba histolytica
DLEKYGARAVINWATLLGVLISKDFLGLRVL

SEQ ID NO: 2671667 - protein, 35 aa, Entamoeba histolytica
DLEPGEYVTNCFYCHKTCHYRCYIPGDMKRECYCI

SEQ ID NO: 2671668 - protein, 22 aa, Entamoeba histolytica
DLESLGYLFVYLLKGSLPWQDL

SEQ ID NO: 2671669 - protein, 20 aa, Entamoeba histolytica
DLFDVPKTISLNAIIPYNQE

SEQ ID NO: 2671670 - protein, 18 aa, Entamoeba histolytica
DLFEGSIIRGMRRLEELL

SEQ ID NO: 2671671 - protein, 27 aa, Entamoeba histolytica
DLFGKKVKYCMVMKKIPLINPLSLFSL

SEQ ID NO: 2671672 - protein, 26 aa, Entamoeba histolytica
DLFIDSRLKYYLSFVPESIKKVLFIG

SEQ ID NO: 2671673 - protein, 18 aa, Entamoeba histolytica
DLFIKLGTFLELCKQKES

SEQ ID NO: 2671674 - protein, 19 aa, Entamoeba histolytica
DLFILKDIYESIGSQLEST

SEQ ID NO: 2671675 - protein, 24 aa, Entamoeba histolytica
DLFMKIHISELYSWNNSNRENTAS

SEQ ID NO: 2671676 - protein, 18 aa, Entamoeba histolytica
DLFNCTFYSVYIAQDQKQ

SEQ ID NO: 2671677 - protein, 19 aa, Entamoeba histolytica
DLGARCLCYSIIGYYKLLL

SEQ ID NO: 2671678 - protein, 20 aa, Entamoeba histolytica
DLGARCLCYSIIGYYKLLLK

SEQ ID NO: 2671679 - protein, 26 aa, Entamoeba histolytica
DLGNLKWIVVGKLFGLRAIIGNSSDS

SEQ ID NO: 2671680 - protein, 19 aa, Entamoeba histolytica
DLGTTFCCCHFFNTQTNKY

SEQ ID NO: 2671681 - protein, 17 aa, Entamoeba histolytica
DLHADLYFLIHAMYQDN

SEQ ID NO: 2671682 - protein, 17 aa, Entamoeba histolytica
DLICAAKNLGIICYLIP

SEQ ID NO: 2671683 - protein, 19 aa, Entamoeba histolytica
DLIDPLLIELKENGKNIYA

SEQ ID NO: 2671684 - protein, 26 aa, Entamoeba histolytica
DLIFKLCILAEKYLKGKEYVDIMMSI

SEQ ID NO: 2671685 - protein, 20 aa, Entamoeba histolytica
DLIGCTALHCSIKTLDRVLR

SEQ ID NO: 2671686 - protein, 17 aa, Entamoeba histolytica
DLIIRRGTLMSFYCSTG

SEQ ID NO: 2671687 - protein, 17 aa, Entamoeba histolytica
DLIKLRSLFSLTSNYKR

SEQ ID NO: 2671688 - protein, 21 aa, Entamoeba histolytica
DLILEPKFEGCILPRIPQVYY

SEQ ID NO: 2671689 - protein, 19 aa, Entamoeba histolytica
DLINFPSFSSQPFKEQLKK

SEQ ID NO: 2671690 - protein, 19 aa, Entamoeba histolytica
DLIRSRIKLFRFTKNKKWR

SEQ ID NO: 2671691 - protein, 23 aa, Entamoeba histolytica
DLISINLNSCFALTAIALTVLGD

SEQ ID NO: 2671692 - protein, 27 aa, Entamoeba histolytica
DLISLKKLWIILGWYYFYETMKENELE

SEQ ID NO: 2671693 - protein, 26 aa, Entamoeba histolytica
DLKISEIGKKIGVEWKELPEEQKKKY

SEQ ID NO: 2671694 - protein, 21 aa, Entamoeba histolytica
DLKKKVDILAYWVSQSLYESV

SEQ ID NO: 2671695 - protein, 37 aa, Entamoeba histolytica
DLKTMIEIICNIFPFYKFWEHVCVVWTNCYNYTPQKQ

SEQ ID NO: 2671696 - protein, 25 aa, Entamoeba histolytica
DLKTRAIRFGAYKNQWFNITPQKNI

SEQ ID NO: 2671697 - protein, 30 aa, Entamoeba histolytica; identical to SEQ ID NO: 2477435

SEQ ID NO: 2671698 - protein, 27 aa, Entamoeba histolytica
DLKYKLIDWKSYFIITINELQSEAFKI

SEQ ID NO: 2671699 - protein, 24 aa, Entamoeba histolytica
DLLDLPWNRCWIDGNLVEGKKRKE

SEQ ID NO: 2671700 - protein, 25 aa, Entamoeba histolytica
DLLFNLIIRDSWQFLFSHSPIDLKQ

SEQ ID NO: 2671701 - protein, 17 aa, Entamoeba histolytica
DLLFYGIGYNAEQWKRN

SEQ ID NO: 2671702 - protein, 30 aa, Entamoeba histolytica; identical to SEQ ID NO: 2477443

SEQ ID NO: 2671703 - protein, 17 aa, Entamoeba histolytica
DLLIFMLQKLFALVHGE

SEQ ID NO: 2671704 - protein, 29 aa, Entamoeba histolytica
DLLLPTVCQYEIWYPVSICEALKYKNTIK

SEQ ID NO: 2671705 - protein, 17 aa, Entamoeba histolytica
DLLNALSKDCIELKKSI

SEQ ID NO: 2671706 - protein, 24 aa, Entamoeba histolytica
DLLNARGGTIISVCGTKCGLGKGV

SEQ ID NO: 2671707 - protein, 23 aa, Entamoeba histolytica
DLLNCLKTIYRASSDLDQSCLVL

SEQ ID NO: 2671708 - protein, 23 aa, Entamoeba histolytica
DLLPFLRKPILLIIDSDKQNSFI

SEQ ID NO: 2671709 - protein, 23 aa, Entamoeba histolytica
DLLQRYFCFIGNYELPNWTKEYK

SEQ ID NO: 2671710 - protein, 22 aa, Entamoeba histolytica
DLLREEVQNCYNAEDKSFEVEN

SEQ ID NO: 2671711 - protein, 21 aa, Entamoeba histolytica
DLLSRIGVIRAVGGIHFTLVE

SEQ ID NO: 2671712 - protein, 19 aa, Entamoeba histolytica
DLLSRVIARREVICLPFYS

SEQ ID NO: 2671713 - protein, 17 aa, Entamoeba histolytica
DLLVKIAEEATCPTTIT

SEQ ID NO: 2671714 - protein, 24 aa, Entamoeba histolytica
DLMRMFLELRASMIKKKLIPTLAI

SEQ ID NO: 2671715 - protein, 25 aa, Entamoeba histolytica
DLNAFKSVCSFGCIKTFEIIAICLK

SEQ ID NO: 2671716 - protein, 19 aa, Entamoeba histolytica
DLNAICFVAPSSNVRLTAS

SEQ ID NO: 2671717 - protein, 17 aa, Entamoeba histolytica
DLNCPIIELPNSLEELT

SEQ ID NO: 2671718 - protein, 24 aa, Entamoeba histolytica
DLNGVPLKFCDDFEYHDSVDGSVT

SEQ ID NO: 2671719 - protein, 18 aa, Entamoeba histolytica
DLNISLPLYTVNACCSES

SEQ ID NO: 2671720 - protein, 18 aa, Entamoeba histolytica
DLNKIILVNQFKEEINRR

SEQ ID NO: 2671721 - protein, 18 aa, Entamoeba histolytica
DLNNFPFVIVGNKSDCSD

SEQ ID NO: 2671722 - protein, 23 aa, Entamoeba histolytica
DLNRLTRDIPFLFHNKIQQLMKR

SEQ ID NO: 2671723 - protein, 30 aa, Entamoeba histolytica
DLNRYVKEEVYFPRMFMKIEDDCVRVLQNS

SEQ ID NO: 2671724 - protein, 39 aa, Entamoeba histolytica; identical to SEQ ID NO: 2477472

SEQ ID NO: 2671725 - protein, 20 aa, Entamoeba histolytica
DLPSPRFIESLEFQPTDPKI

SEQ ID NO: 2671726 - protein, 30 aa, Entamoeba histolytica
DLQDGIIFRDLLRTLGIPCGNSLEDVITAS

SEQ ID NO: 2671727 - protein, 23 aa, Entamoeba histolytica
DLQEAYFLFDQCITTPSKEITPQ

SEQ ID NO: 2671728 - protein, 17 aa, Entamoeba histolytica
DLQKALVEELYKSDKIN

SEQ ID NO: 2671729 - protein, 24 aa, Entamoeba histolytica
DLQPDLVAAVFKRFLRDLPTHVID

SEQ ID NO: 2671730 - protein, 20 aa, Entamoeba histolytica
DLQTLAGNKGDRDWLDKNTV

SEQ ID NO: 2671731 - protein, 26 aa, Entamoeba histolytica
DLRALAAKCVFKLLKVLESGKMKEIK

SEQ ID NO: 2671732 - protein, 17 aa, Entamoeba histolytica
DLRCLNENKLINVYIIE

SEQ ID NO: 2671733 - protein, 21 aa, Entamoeba histolytica
DLRGYSVLHYAVFINSSEFLD

SEQ ID NO: 2671734 - protein, 23 aa, Entamoeba histolytica
DLRIGKKLIRYGFAPRISFLTSR

SEQ ID NO: 2671735 - protein, 25 aa, Entamoeba histolytica
DLRLWKIDFTQFIPLTKVQLQYIVD

SEQ ID NO: 2671736 - protein, 20 aa, Entamoeba histolytica
DLRMIKPFLTYFHNAAVKAI

SEQ ID NO: 2671737 - protein, 28 aa, Entamoeba histolytica
DLRMKQMCRRYGIPNIRDKSVAVLNVDT

SEQ ID NO: 2671738 - protein, 23 aa, Entamoeba histolytica
DLRRLHVETVLTLWVFLQESKKN

SEQ ID NO: 2671739 - protein, 18 aa, Entamoeba histolytica
DLSIPKEHLMIIKTPNTS

SEQ ID NO: 2671740 - protein, 18 aa, Entamoeba histolytica
DLSKISWLVTVVDEAHRL

SEQ ID NO: 2671741 - protein, 29 aa, Entamoeba histolytica
DLSLGIDPLYCFKCIVEGNIETIEEIEKE

SEQ ID NO: 2671742 - protein, 23 aa, Entamoeba histolytica
DLSRYKPFIKEIVERMANNEVPE

SEQ ID NO: 2671743 - protein, 23 aa, Entamoeba histolytica
DLTCLSCSMTDPNLYFMSTKSGV

SEQ ID NO: 2671744 - protein, 19 aa, Entamoeba histolytica
DLTKSCKGQKAHTKEDEKK

SEQ ID NO: 2671745 - protein, 25 aa, Entamoeba histolytica
DLTSMLRKAMEVRRNDIADDEDDDD

SEQ ID NO: 2671746 - protein, 24 aa, Entamoeba histolytica
DLTTEIPCCLNFDKIQQHHITSQH

SEQ ID NO: 2671747 - protein, 17 aa, Entamoeba histolytica
DLVCFIIEKSIDKEYKL

SEQ ID NO: 2671748 - protein, 23 aa, Entamoeba histolytica
DLVCGCSVGSILVSMLAIGITPR

SEQ ID NO: 2671749 - protein, 24 aa, Entamoeba histolytica
DLVESIRFILERLIPFNQQLNPRR

SEQ ID NO: 2671750 - protein, 18 aa, Entamoeba histolytica
DLVIVLFIEIFRAIDSDM

SEQ ID NO: 2671751 - protein, 34 aa, Entamoeba histolytica
DLVKPRLSGTLLKNEISFIVSFTLNMFIKPVHLN

SEQ ID NO: 2671752 - protein, 23 aa, Entamoeba histolytica
DLVPIFLERLLAFPLDKLTISYK

SEQ ID NO: 2671753 - protein, 25 aa, Entamoeba histolytica
DLVQELGIFLGRYISQYLYKIYGEY

SEQ ID NO: 2671754 - protein, 18 aa, Entamoeba histolytica
DLVTMKWWNDLWLNEGFA

SEQ ID NO: 2671755 - protein, 28 aa, Entamoeba histolytica
DLVVGLNCKQIKTGAPCRSERLCKYNQL

SEQ ID NO: 2671756 - protein, 18 aa, Entamoeba histolytica
DLVVKRFKELYAEDKIQI

SEQ ID NO: 2671757 - protein, 19 aa, Entamoeba histolytica
DLVYWYCLFNEPLDRLHYI

SEQ ID NO: 2671758 - protein, 17 aa, Entamoeba histolytica
DLYKIARTIPFTRALEC

SEQ ID NO: 2671759 - protein, 21 aa, Entamoeba histolytica
DLYMKTGQGFVLVYSIIAQST

SEQ ID NO: 2671760 - protein, 22 aa, Entamoeba histolytica
DLYMKTGQGFVLVYSIIAQSTY

SEQ ID NO: 2671761 - protein, 24 aa, Entamoeba histolytica
DLYNEILLFPGLPASIQNEIGNAT

SEQ ID NO: 2671762 - protein, 23 aa, Entamoeba histolytica
DLYNRILANFVEFVHMLGEEVNP

SEQ ID NO: 2671763 - protein, 28 aa, Entamoeba histolytica
DLYSIGVCLYRLITCRFPFATTKTEFIQ

SEQ ID NO: 2671764 - protein, 18 aa, Entamoeba histolytica
DLYSLGVVLYRLATNEYP

SEQ ID NO: 2671765 - protein, 22 aa, Entamoeba histolytica
DMAKYRTITSFTTMTYTLNDLF

SEQ ID NO: 2671766 - protein, 17 aa, Entamoeba histolytica
DMARYLVDVAIKRKTLD

SEQ ID NO: 2671767 - protein, 23 aa, Entamoeba histolytica
DMELVKEFMQLYSLLPLTQSSQL

SEQ ID NO: 2671768 - protein, 26 aa, Entamoeba histolytica
DMENGICWECWKIYFPDEKWPDLEHD

SEQ ID NO: 2671769 - protein, 17 aa, Entamoeba histolytica
DMERFREQFAYIMKNNL

SEQ ID NO: 2671770 - protein, 18 aa, Entamoeba histolytica
DMIEWSKSGLVVYDSQVP

SEQ ID NO: 2671771 - protein, 19 aa, Entamoeba histolytica
DMIIRGGHNIWPAEICDIM

SEQ ID NO: 2671772 - protein, 26 aa, Entamoeba histolytica
DMKKRCLYCQLQYPFECISTQCPISF

SEQ ID NO: 2671773 - protein, 22 aa, Entamoeba histolytica
DMKKYFQIISFCFTDSFREYIE

SEQ ID NO: 2671774 - protein, 22 aa, Entamoeba histolytica
DMKRKAICIQKLTYLEMLGQET

SEQ ID NO: 2671775 - protein, 17 aa, Entamoeba histolytica
DMKSYGYEIPRDFEKNK

SEQ ID NO: 2671776 - protein, 19 aa, Entamoeba histolytica
DMKVIIKKKHKIFATEACR

SEQ ID NO: 2671777 - protein, 24 aa, Entamoeba histolytica
DMKVNCCLCNIRLGQKEESQKCIE

SEQ ID NO: 2671778 - protein, 26 aa, Entamoeba histolytica
DMLCKAIKLSPNLSHIIQLESLLFQL

SEQ ID NO: 2671779 - protein, 24 aa, Entamoeba histolytica
DMLCSYCLPFLFYKQTILFNRDLI

SEQ ID NO: 2671780 - protein, 20 aa, Entamoeba histolytica
DMLLFLKLVDYFQDDNDKEL

SEQ ID NO: 2671781 - protein, 19 aa, Entamoeba histolytica
DMMNCQYLSFVKEEKPIKH

SEQ ID NO: 2671782 - protein, 20 aa, Entamoeba histolytica
DMMQWACWFHNAGTEIDLPT

SEQ ID NO: 2671783 - protein, 19 aa, Entamoeba histolytica
DMNLLLRYIFGLIGYVPTV

SEQ ID NO: 2671784 - protein, 17 aa, Entamoeba histolytica
DMSKIFEILLAYEKTNL

SEQ ID NO: 2671785 - protein, 18 aa, Entamoeba histolytica
DMTFKGKPVMKIAEETGQ

SEQ ID NO: 2671786 - protein, 23 aa, Entamoeba histolytica
DMTKMFCPKCGYHDLRRISYYVL

SEQ ID NO: 2671787 - protein, 17 aa, Entamoeba histolytica
DMVDVFLSTPFDGMQHT

SEQ ID NO: 2671788 - protein, 26 aa, Entamoeba histolytica
DMVMIQLCFLLPFNCFASLFTTDIES

SEQ ID NO: 2671789 - protein, 30 aa, Entamoeba histolytica; identical to SEQ ID NO: 2477532

SEQ ID NO: 2671790 - protein, 23 aa, Entamoeba histolytica
DNAELRETIKLMKQQIEANNELM

SEQ ID NO: 2671791 - protein, 17 aa, Entamoeba histolytica
DNCFGCYVSKAPSYIGI

SEQ ID NO: 2671792 - protein, 22 aa, Entamoeba histolytica
DNCPPIVRRVLRKVYDELNNKF

SEQ ID NO: 2671793 - protein, 23 aa, Entamoeba histolytica
DNCVKECLKELWKRVQKKHIKRK

SEQ ID NO: 2671794 - protein, 22 aa, Entamoeba histolytica
DNDCRCSLWSKCLGNSIDKNIF

SEQ ID NO: 2671795 - protein, 23 aa, Entamoeba histolytica
DNDCVYPVFKKMGLLDSLQTGLQ

SEQ ID NO: 2671796 - protein, 25 aa, Entamoeba histolytica
DNEFAECIYGFNAFYSKKPCKDYFK

SEQ ID NO: 2671797 - protein, 20 aa, Entamoeba histolytica
DNEIEIAYYIMKVINDTIKR

SEQ ID NO: 2671798 - protein, 24 aa, Entamoeba histolytica
DNEIFRLNGEWRGVTAGGCHVFPS

SEQ ID NO: 2671799 - protein, 23 aa, Entamoeba histolytica
DNELKGLILQTFHMVQKQVNDLK

SEQ ID NO: 2671800 - protein, 34 aa, Entamoeba histolytica; identical to SEQ ID NO: 2477547

SEQ ID NO: 2671801 - protein, 23 aa, Entamoeba histolytica
DNESKYGICIDSIHIFNNNQEYM

SEQ ID NO: 2671802 - protein, 23 aa, Entamoeba histolytica
DNETKFNLFFSYHYYVDLLCESM

SEQ ID NO: 2671803 - protein, 28 aa, Entamoeba histolytica
DNEWSLPAFLPKRIRSISKEEVIKLDKN

SEQ ID NO: 2671804 - protein, 17 aa, Entamoeba histolytica
DNFFCYRGLPRNEFTTL

SEQ ID NO: 2671805 - protein, 19 aa, Entamoeba histolytica
DNFKAVITVPANFSSEQRD

SEQ ID NO: 2671806 - protein, 25 aa, Entamoeba histolytica
DNFKCGIKFCSAGSVIALMTDGVCD

SEQ ID NO: 2671807 - protein, 22 aa, Entamoeba histolytica
DNFKINLPFKQEIIRENEELTE

SEQ ID NO: 2671808 - protein, 21 aa, Entamoeba histolytica
DNGFFLPLRHYHNIVSQLKNM

SEQ ID NO: 2671809 - protein, 19 aa, Entamoeba histolytica
DNGKLLFPQNPVSSIPDYV

SEQ ID NO: 2671810 - protein, 23 aa, Entamoeba histolytica
DNGRVRYAICEMALTLKNFPPQD

SEQ ID NO: 2671811 - protein, 41 aa, Entamoeba histolytica
DNGVMFLQFAFRWINCCLLREFKLGTALRLWDSYMSVEDGT

SEQ ID NO: 2671812 - protein, 25 aa, Entamoeba histolytica
DNGYALELFTLFVKYKCFIEVTYRS

SEQ ID NO: 2671813 - protein, 18 aa, Entamoeba histolytica
DNHINLFHFIRDGKIEEI

SEQ ID NO: 2671814 - protein, 25 aa, Entamoeba histolytica
DNIAIILSVFYNWSESGQLPTSFFS

SEQ ID NO: 2671815 - protein, 23 aa, Entamoeba histolytica
DNIALQIVCFYFINYFNLLEKSN

SEQ ID NO: 2671816 - protein, 18 aa, Entamoeba histolytica
DNIFCLCGQRFCFKCLGE

SEQ ID NO: 2671817 - protein, 26 aa, Entamoeba histolytica
DNIFYFKWRYCFIDDINIKDRLQELV

SEQ ID NO: 2671818 - protein, 23 aa, Entamoeba histolytica
DNIKEVILFPTMRPEDELEKKAR

SEQ ID NO: 2671819 - protein, 23 aa, Entamoeba histolytica
DNISLELKDLISHMLIVNPKQRY

SEQ ID NO: 2671820 - protein, 22 aa, Entamoeba histolytica
DNIWKRKIYQTVLIHLLSQNNK

SEQ ID NO: 2671821 - protein, 24 aa, Entamoeba histolytica
DNKENFCRYEVLPSLIKQLNELLT

SEQ ID NO: 2671822 - protein, 23 aa, Entamoeba histolytica
DNKIKGIIFTFELMIGVEKEVGE

SEQ ID NO: 2671823 - protein, 24 aa, Entamoeba histolytica
DNKKEVLAMYGVYCMDRIMITKVL

SEQ ID NO: 2671824 - protein, 25 aa, Entamoeba histolytica
DNKKLIGTLPCKVDGNIFMVDDLII

SEQ ID NO: 2671825 - protein, 18 aa, Entamoeba histolytica
DNKMCYCRGLNYFDKICL

SEQ ID NO: 2671826 - protein, 24 aa, Entamoeba histolytica
DNKNIKIGFSYILLEINKIAEMID

SEQ ID NO: 2671827 - protein, 17 aa, Entamoeba histolytica
DNKSAEHLSFYKRVTNL

SEQ ID NO: 2671828 - protein, 18 aa, Entamoeba histolytica
DNLIKEFVFQAAKNGMDV

SEQ ID NO: 2671829 - protein, 17 aa, Entamoeba histolytica
DNLKTPKIRNGTINQIT

SEQ ID NO: 2671830 - protein, 25 aa, Entamoeba histolytica
DNLLYIKSCYEINCSEAQVKEVIIL

SEQ ID NO: 2671831 - protein, 20 aa, Entamoeba histolytica
DNLNIVNLMNFCIKKIDINE

SEQ ID NO: 2671832 - protein, 17 aa, Entamoeba histolytica
DNLPTILPETAAQGPLP

SEQ ID NO: 2671833 - protein, 24 aa, Entamoeba histolytica
DNLVYRKSRVLKRTTKIMRSTDAD

SEQ ID NO: 2671834 - protein, 17 aa, Entamoeba histolytica
DNMIISFSLHDNNCSLF

SEQ ID NO: 2671835 - protein, 25 aa, Entamoeba histolytica
DNNCSLFTLGNRIGFIHIAKTKNKR

SEQ ID NO: 2671836 - protein, 25 aa, Entamoeba histolytica
DNNDIIWDCPLNQLEQFKPQVTEEN

SEQ ID NO: 2671837 - protein, 24 aa, Entamoeba histolytica
DNNLSLPCDLSFSTSLIPLIYQGR

SEQ ID NO: 2671838 - protein, 20 aa, Entamoeba histolytica
DNNTVVLCPSLVHYYEVSIK

SEQ ID NO: 2671839 - protein, 18 aa, Entamoeba histolytica
DNNYAVVMPKSYHLISEK

SEQ ID NO: 2671840 - protein, 23 aa, Entamoeba histolytica
DNPEDCKMALSIRNRISTIGIDT

SEQ ID NO: 2671841 - protein, 18 aa, Entamoeba histolytica
DNPGFKLKLPISCTCFED

SEQ ID NO: 2671842 - protein, 18 aa, Entamoeba histolytica
DNQCLKLILKQSKLFDPT

SEQ ID NO: 2671843 - protein, 17 aa, Entamoeba histolytica
DNQFMRKLADLFSADPQ

SEQ ID NO: 2671844 - protein, 17 aa, Entamoeba histolytica
DNQGPDALVEWIRNQKE

SEQ ID NO: 2671845 - protein, 26 aa, Entamoeba histolytica
DNQITLKFIRMYRLFINFLGGDIVDL

SEQ ID NO: 2671846 - protein, 26 aa, Entamoeba histolytica
DNRAHRRGVSFGKFGNSGLFGKHDSS

SEQ ID NO: 2671847 - protein, 22 aa, Entamoeba histolytica
DNRFGLKMECVILKRNVPLLPV

SEQ ID NO: 2671848 - protein, 20 aa, Entamoeba histolytica
DNRKFASWLGANLLDKENIG

SEQ ID NO: 2671849 - protein, 24 aa, Entamoeba histolytica
DNRLSAFHYCYLNLINLIKTKHPK

SEQ ID NO: 2671850 - protein, 24 aa, Entamoeba histolytica
DNSAWKTSIAVVKICDFGSSRIQV

SEQ ID NO: 2671851 - protein, 24 aa, Entamoeba histolytica
DNSFLIKYKKVYLIPNYSQTPYYV

SEQ ID NO: 2671852 - protein, 24 aa, Entamoeba histolytica
DNSIKRLIPVYGENFDALVSNGFV

SEQ ID NO: 2671853 - protein, 19 aa, Entamoeba histolytica
DNSKCAFTQGVVNYDGRYY

SEQ ID NO: 2671854 - protein, 24 aa, Entamoeba histolytica
DNSLILPCFDHIFFGNKSLSISFT

SEQ ID NO: 2671855 - protein, 23 aa, Entamoeba histolytica
DNSLVLYLSYFIIKDNRFGPSDM

SEQ ID NO: 2671856 - protein, 20 aa, Entamoeba histolytica
DNSSLGEDVLMHMLRQKDDM

SEQ ID NO: 2671857 - protein, 20 aa, Entamoeba histolytica
DNSVCTRAILDVGYYHTSIV

SEQ ID NO: 2671858 - protein, 28 aa, Entamoeba histolytica
DNTIRRIGLRYVLMKVKGFNLENSNDVI

SEQ ID NO: 2671859 - protein, 20 aa, Entamoeba histolytica
DNTLYFAFRSLNIIRYISDI

SEQ ID NO: 2671860 - protein, 23 aa, Entamoeba histolytica
DNTRKRKGLVLDEKIVEFVDKQS

SEQ ID NO: 2671861 - protein, 21 aa, Entamoeba histolytica
DNTRVVLFEGLALTINQTINK

SEQ ID NO: 2671862 - protein, 23 aa, Entamoeba histolytica
DNVIKELKIFGGMTNYQGTNVIS

SEQ ID NO: 2671863 - protein, 24 aa, Entamoeba histolytica
DNVIKELKIFGGMTNYQGTNVISS

SEQ ID NO: 2671864 - protein, 23 aa, Entamoeba histolytica
DNVPCGVAWPYLIGAKGIGIDPK

SEQ ID NO: 2671865 - protein, 24 aa, Entamoeba histolytica
DNVWEMYYLLFGMMEQEQLDSMLN

SEQ ID NO: 2671866 - protein, 19 aa, Entamoeba histolytica
DNVWKESSSEEVIIMKKGK

SEQ ID NO: 2671867 - protein, 23 aa, Entamoeba histolytica
DNYDCMFHVAPLIPRNKNDEQSL

SEQ ID NO: 2671868 - protein, 25 aa, Entamoeba histolytica
DNYDFAKEQLKQWILTLKHLYEHVD

SEQ ID NO: 2671869 - protein, 18 aa, Entamoeba histolytica
DNYGQLALHYAAAVGCDI

SEQ ID NO: 2671870 - protein, 29 aa, Entamoeba histolytica
DNYKKEKSFRMFIELGKKILPPPQLRTKL

SEQ ID NO: 2671871 - protein, 21 aa, Entamoeba histolytica
DNYLLRIWDSIFAFPTSKFYY

SEQ ID NO: 2671872 - protein, 23 aa, Entamoeba histolytica
DNYPLKRPSVFPHIEVSVEELIR

SEQ ID NO: 2671873 - protein, 17 aa, Entamoeba histolytica
DPALLRSGRFDRKIEFP

SEQ ID NO: 2671874 - protein, 22 aa, Entamoeba histolytica
DPCNPNHPITLPLRDPEEEING

SEQ ID NO: 2671875 - protein, 20 aa, Entamoeba histolytica
DPEDPKRCYIERIIEMDPRG

SEQ ID NO: 2671876 - protein, 22 aa, Entamoeba histolytica
DPEEMSVYIGVCLDHIDDEEII

SEQ ID NO: 2671877 - protein, 19 aa, Entamoeba histolytica
DPENRLCRIKYDKEHTISP

SEQ ID NO: 2671878 - protein, 18 aa, Entamoeba histolytica
DPEQRYSIEQVIDSSFAK

SEQ ID NO: 2671879 - protein, 22 aa, Entamoeba histolytica
DPERYITGIGFFINMTLLALDQ

SEQ ID NO: 2671880 - protein, 25 aa, Entamoeba histolytica
DPESYKYWHHWALINFEIVSYIELD

SEQ ID NO: 2671881 - protein, 24 aa, Entamoeba histolytica
DPETFKVMMMLKYNKSLINPGEPV

SEQ ID NO: 2671882 - protein, 17 aa, Entamoeba histolytica
DPETGVKKHPYCDFCNI

SEQ ID NO: 2671883 - protein, 25 aa, Entamoeba histolytica
DPFRFFEEMFSGFGMFERGQNFQRK

SEQ ID NO: 2671884 - protein, 19 aa, Entamoeba histolytica
DPFVFKRKGDGKIINKIIP

SEQ ID NO: 2671885 - protein, 24 aa, Entamoeba histolytica
DPGKGTRVIYHWQGKKSNRMEKGK

SEQ ID NO: 2671886 - protein, 25 aa, Entamoeba histolytica
DPIIKNDFFILVRVYGIYGSCYNLD

SEQ ID NO: 2671887 - protein, 22 aa, Entamoeba histolytica
DPIKLISFKSLQRATIILQGEN

SEQ ID NO: 2671888 - protein, 24 aa, Entamoeba histolytica
DPIKRRYLIFMLNLYYSITQQQEI

SEQ ID NO: 2671889 - protein, 17 aa, Entamoeba histolytica
DPIKVRASHDYLFVNDS

SEQ ID NO: 2671890 - protein, 19 aa, Entamoeba histolytica
DPILLKLFRFEELKQMYLF

SEQ ID NO: 2671891 - protein, 26 aa, Entamoeba histolytica
DPIVQRFRLSFLALFKIITELCDCFD

SEQ ID NO: 2671892 - protein, 20 aa, Entamoeba histolytica
DPKLVEMLLENEVEEDVSLD

SEQ ID NO: 2671893 - protein, 19 aa, Entamoeba histolytica
DPKTVICLNNTIEIDEELL

SEQ ID NO: 2671894 - protein, 19 aa, Entamoeba histolytica
DPKVGPILNKLMSKFGQNA

SEQ ID NO: 2671895 - protein, 21 aa, Entamoeba histolytica
DPKWLTSQFNHIFIVVQPDVN

SEQ ID NO: 2671896 - protein, 19 aa, Entamoeba histolytica
DPLFCKGHSGSIIDIIACP

SEQ ID NO: 2671897 - protein, 21 aa, Entamoeba histolytica
DPLHWLQYFPPLGVEDLKLMG

SEQ ID NO: 2671898 - protein, 23 aa, Entamoeba histolytica
DPLRECYCLHLIDSFQHRGLNGI

SEQ ID NO: 2671899 - protein, 30 aa, Entamoeba histolytica
DPNAKMLLELKFNKLYGLLDSFYKISKKVS

SEQ ID NO: 2671900 - protein, 25 aa, Entamoeba histolytica
DPNAQWQWYSDKGWINYEDKQNKLI

SEQ ID NO: 2671901 - protein, 26 aa, Entamoeba histolytica
DPNRCCKACVFNNFIPGHDCKIADAC

SEQ ID NO: 2671902 - protein, 33 aa, Entamoeba histolytica
DPNRIKSHCWFKGFDWEGLFKKKLTPPFVPVLK

SEQ ID NO: 2671903 - protein, 32 aa, Entamoeba histolytica
DPNRIKSHCWFKGFDWEGLFQKKLSPPFVPVL

SEQ ID NO: 2671904 - protein, 25 aa, Entamoeba histolytica
DPNSFKLSPNFSIYPQFMFHLRRSH

SEQ ID NO: 2671905 - protein, 17 aa, Entamoeba histolytica
DPNYCIVTGLIGESNSG

SEQ ID NO: 2671906 - protein, 22 aa, Entamoeba histolytica
DPRIILVGTKCDIRDSQKLIDT

SEQ ID NO: 2671907 - protein, 19 aa, Entamoeba histolytica
DPRKVLSIFRSLIREDIET

SEQ ID NO: 2671908 - protein, 19 aa, Entamoeba histolytica
DPRSCVLAIDNFNGIELNG

SEQ ID NO: 2671909 - protein, 21 aa, Entamoeba histolytica
DPSIYHPIKIVGKGSYGTVIY

SEQ ID NO: 2671910 - protein, 25 aa, Entamoeba histolytica
DPSKCVMSGPGLKTGEVLVPQEFTV

SEQ ID NO: 2671911 - protein, 23 aa, Entamoeba histolytica
DPSRIVDIAKFLASFNLSGVSSE

SEQ ID NO: 2671912 - protein, 19 aa, Entamoeba histolytica
DPSSFKFKLLEESGGKRRV

SEQ ID NO: 2671913 - protein, 17 aa, Entamoeba histolytica
DPTEKWVAILALLQKNN

SEQ ID NO: 2671914 - protein, 25 aa, Entamoeba histolytica
DPTGDFICCLCVSMLVEIKKQLLNG

SEQ ID NO: 2671915 - protein, 25 aa, Entamoeba histolytica
DPTLIRLFLQNGLFKEFFEKHPEME

SEQ ID NO: 2671916 - protein, 18 aa, Entamoeba histolytica
DPVCGWTAYNVVLSKTDL

SEQ ID NO: 2671917 - protein, 21 aa, Entamoeba histolytica
DPVHLFNYFHSVCFDFNEVLI

SEQ ID NO: 2671918 - protein, 19 aa, Entamoeba histolytica
DPVMKRARERQERLKQIQA

SEQ ID NO: 2671919 - protein, 18 aa, Entamoeba histolytica
DPVSFLIQFEEIKNVDKC

SEQ ID NO: 2671920 - protein, 17 aa, Entamoeba histolytica
DPVSLPAIDYFLRVGDI

SEQ ID NO: 2671921 - protein, 19 aa, Entamoeba histolytica
DPVYVARLINCISQTESDV

SEQ ID NO: 2671922 - protein, 22 aa, Entamoeba histolytica
DPYFVFTVCSAFWILQDGTVSF

SEQ ID NO: 2671923 - protein, 25 aa, Entamoeba histolytica
DPYSILSSPLIKFPYIIDSTKNLIF

SEQ ID NO: 2671924 - protein, 25 aa, Entamoeba histolytica
DQCYKIIQYYSLKCVLIDKSEAVPK

SEQ ID NO: 2671925 - protein, 17 aa, Entamoeba histolytica
DQEGFKISSGDEQTLKL

SEQ ID NO: 2671926 - protein, 23 aa, Entamoeba histolytica
DQEILRLTKLINLDQSKLCLSNQ

SEQ ID NO: 2671927 - protein, 23 aa, Entamoeba histolytica
DQELRIEIMPTYTIENKLPYEMN

SEQ ID NO: 2671928 - protein, 18 aa, Entamoeba histolytica
DQERLFRRSQQLRGTKIY

SEQ ID NO: 2671929 - protein, 25 aa, Entamoeba histolytica
DQFLCLRPAKHFPGIPTPLKKCEID

SEQ ID NO: 2671930 - protein, 17 aa, Entamoeba histolytica
DQGCPEIEEPFGYTSIF

SEQ ID NO: 2671931 - protein, 24 aa, Entamoeba histolytica
DQHVSRIIIIFNMVYPEDLTDQQR

SEQ ID NO: 2671932 - protein, 17 aa, Entamoeba histolytica
DQICPIHIAIQSGVNKS

SEQ ID NO: 2671933 - protein, 17 aa, Entamoeba histolytica
DQIFGRIHFRDHSEDTF

SEQ ID NO: 2671934 - protein, 17 aa, Entamoeba histolytica
DQIIIFDGTSHWSISLK

SEQ ID NO: 2671935 - protein, 18 aa, Entamoeba histolytica
DQINICVLTLVITFTSIR

SEQ ID NO: 2671936 - protein, 17 aa, Entamoeba histolytica
DQIQRWLDVDPNDIAIY

SEQ ID NO: 2671937 - protein, 22 aa, Entamoeba histolytica
DQIRIKKLLKMRDTIVCQISRK

SEQ ID NO: 2671938 - protein, 26 aa, Entamoeba histolytica
DQKYQLPSCGFDWCNQNPDLLCTWYL

SEQ ID NO: 2671939 - protein, 25 aa, Entamoeba histolytica
DQLDGLIIECIGLMGMYAVDDMTED

SEQ ID NO: 2671940 - protein, 18 aa, Entamoeba histolytica
DQLECIIHIYSVLELFFN

SEQ ID NO: 2671941 - protein, 21 aa, Entamoeba histolytica
DQLELRASFVATHNYKTTNVN

SEQ ID NO: 2671942 - protein, 21 aa, Entamoeba histolytica
DQLKSAMNYIHLKRQNEIELK

SEQ ID NO: 2671943 - protein, 26 aa, Entamoeba histolytica
DQLLIRLKKRFYFRDRNVNDTDQQQL

SEQ ID NO: 2671944 - protein, 18 aa, Entamoeba histolytica
DQLLKGYFGISVLNVANE

SEQ ID NO: 2671945 - protein, 37 aa, Entamoeba histolytica; identical to SEQ ID NO: 2477670

SEQ ID NO: 2671946 - protein, 20 aa, Entamoeba histolytica
DQLTYTGIISYDLVTLYWSK

SEQ ID NO: 2671947 - protein, 22 aa, Entamoeba histolytica
DQMKEYCDFIAYKVSDIAEFIG

SEQ ID NO: 2671948 - protein, 23 aa, Entamoeba histolytica
DQMKRKSHRGGRRVRRIREMYGM

SEQ ID NO: 2671949 - protein, 23 aa, Entamoeba histolytica
DQMLHFYVLISHVILLKDTLLKA

SEQ ID NO: 2671950 - protein, 20 aa, Entamoeba histolytica
DQNYRFIIFDDINYDKNLLR

SEQ ID NO: 2671951 - protein, 19 aa, Entamoeba histolytica
DQRPCHVIYSNTFPKEIQP

SEQ ID NO: 2671952 - protein, 22 aa, Entamoeba histolytica
DQRRVELCYGKLINLTANVRIN

SEQ ID NO: 2671953 - protein, 24 aa, Entamoeba histolytica
DQRSLLLLHRLEWILKDTSNDNDA

SEQ ID NO: 2671954 - protein, 17 aa, Entamoeba histolytica
DQSICYLLLQKIGVVEH

SEQ ID NO: 2671955 - protein, 17 aa, Entamoeba histolytica
DQSIFIQLIHSYKRSEF

SEQ ID NO: 2671956 - protein, 24 aa, Entamoeba histolytica
DQSVWKKRNFCLSQVLQVVPCGVF

SEQ ID NO: 2671957 - protein, 23 aa, Entamoeba histolytica
DQWKRLATELYLLKKQVPTQIKT

SEQ ID NO: 2671958 - protein, 18 aa, Entamoeba histolytica
DQYFKLRTNDFFSKGTSI

SEQ ID NO: 2671959 - protein, 25 aa, Entamoeba histolytica
DQYFLMKCVCHFMTPIPFFNIMCSD

SEQ ID NO: 2671960 - protein, 26 aa, Entamoeba histolytica
DREHIRFLVCIKFLKATKCSGLPVKQ

SEQ ID NO: 2671961 - protein, 26 aa, Entamoeba histolytica
DREIFIPLEIYCKLIDLSINTKKEHM

SEQ ID NO: 2671962 - protein, 24 aa, Entamoeba histolytica
DRELFKRRCKRCGEFGHLPKECKN

SEQ ID NO: 2671963 - protein, 20 aa, Entamoeba histolytica
DRETFNWGEKTVEVRYIKHP

SEQ ID NO: 2671964 - protein, 17 aa, Entamoeba histolytica
DRFAIMDFTCLFSTKTD

SEQ ID NO: 2671965 - protein, 19 aa, Entamoeba histolytica
DRFEEDVSLLLKLPSKIKG

SEQ ID NO: 2671966 - protein, 19 aa, Entamoeba histolytica
DRFGECYQLTKGQKKRFGY

SEQ ID NO: 2671967 - protein, 22 aa, Entamoeba histolytica
DRFIEHIGLKKVIERIYDEYLP

SEQ ID NO: 2671968 - protein, 38 aa, Entamoeba histolytica
DRFQRSYFYYRFDFKRCSEPLVIILVDHFVCIYQSGTS

SEQ ID NO: 2671969 - protein, 27 aa, Entamoeba histolytica
DRGLTYTIRLIFCGDEIIQTQARRLAV

SEQ ID NO: 2671970 - protein, 20 aa, Entamoeba histolytica
DRIEEIGIEHKICYGPYKTG

SEQ ID NO: 2671971 - protein, 21 aa, Entamoeba histolytica
DRIKRLGIEFRTNAKVDNIPS

SEQ ID NO: 2671972 - protein, 19 aa, Entamoeba histolytica
DRIRFPWYVAGGSYNEKSA

SEQ ID NO: 2671973 - protein, 25 aa, Entamoeba histolytica
DRKAFCFKTPQGCFVTPTVIENKLS

SEQ ID NO: 2671974 - protein, 24 aa, Entamoeba histolytica
DRKEIKASLYSASIWDDVINMTEF

SEQ ID NO: 2671975 - protein, 20 aa, Entamoeba histolytica
DRKKIMLHMIHIYKEKKEVE

SEQ ID NO: 2671976 - protein, 25 aa, Entamoeba histolytica
DRKRAARCLGELVDLFESKIVQELI

SEQ ID NO: 2671977 - protein, 22 aa, Entamoeba histolytica
DRKTAEGIMVHFKKGFEGKDNR

SEQ ID NO: 2671978 - protein, 23 aa, Entamoeba histolytica
DRLCCYPSYDFVHCLVDSFEDIT

SEQ ID NO: 2671979 - protein, 21 aa, Entamoeba histolytica
DRLGNDLPLIIFLSTKPEYRE

SEQ ID NO: 2671980 - protein, 20 aa, Entamoeba histolytica
DRLICDLLYEDALEYINSAT

SEQ ID NO: 2671981 - protein, 21 aa, Entamoeba histolytica
DRLKELPKRMPNPKQAYGDSG

SEQ ID NO: 2671982 - protein, 26 aa, Entamoeba histolytica
DRLKRLRPLLEISVKKVDSNICIVEK

SEQ ID NO: 2671983 - protein, 19 aa, Entamoeba histolytica
DRLLWLTSIICHSQQSNIY

SEQ ID NO: 2671984 - protein, 33 aa, Entamoeba histolytica
DRLNPTFSWPKEWRGMYGYELKKIIGNGVICCD

SEQ ID NO: 2671985 - protein, 20 aa, Entamoeba histolytica
DRLQELVKRNCLLFNRVNAL

SEQ ID NO: 2671986 - protein, 31 aa, Entamoeba histolytica
DRLQLSIKVLECLSLNCHHGVILKTSTDKES

SEQ ID NO: 2671987 - protein, 24 aa, Entamoeba histolytica
DRNRCSFEGITFRHYQLIDETHLE

SEQ ID NO: 2671988 - protein, 26 aa, Entamoeba histolytica
DRNYHAICGIVFAFVRIPEIEQLKLQ

SEQ ID NO: 2671989 - protein, 21 aa, Entamoeba histolytica
DRRAGDFIIYYNTNFYIGKPE

SEQ ID NO: 2671990 - protein, 26 aa, Entamoeba histolytica
DRRHIVCPNPAFIMQLYEWQRKYHSC

SEQ ID NO: 2671991 - protein, 24 aa, Entamoeba histolytica
DRRMQFKILMGFVNEFVDQAISYF

SEQ ID NO: 2671992 - protein, 21 aa, Entamoeba histolytica
DRRRKIMSISIKRNEYDFLHH

SEQ ID NO: 2671993 - protein, 20 aa, Entamoeba histolytica
DRSLIKMCQRFGDFRKDDPN

SEQ ID NO: 2671994 - protein, 17 aa, Entamoeba histolytica
DRSTACYGHISKANPFL

SEQ ID NO: 2671995 - protein, 42 aa, Entamoeba histolytica
DRSVIYWDIPFSEYKLGRNLALIKEHVDGIILMTNKDIESSF

SEQ ID NO: 2671996 - protein, 17 aa, Entamoeba histolytica
DRTLRWWDMAHSRCKLS

SEQ ID NO: 2671997 - protein, 17 aa, Entamoeba histolytica
DRTQFLLTFNKRKKELN

SEQ ID NO: 2671998 - protein, 17 aa, Entamoeba histolytica
DRVAKLIKKWYFHRQNK

SEQ ID NO: 2671999 - protein, 19 aa, Entamoeba histolytica
DRVSEDMMRIIKNMRRRGY

SEQ ID NO: 2672000 - protein, 17 aa, Entamoeba histolytica
DRVSFINNFWHGVSSDG

SEQ ID NO: 2672001 - protein, 19 aa, Entamoeba histolytica
DRVSMKMCLECSKQNINAK

SEQ ID NO: 2672002 - protein, 19 aa, Entamoeba histolytica
DRVVISLNCPFSKCRMNNP

SEQ ID NO: 2672003 - protein, 21 aa, Entamoeba histolytica
DRVYNSWATKVFAGLDNVACV

SEQ ID NO: 2672004 - protein, 20 aa, Entamoeba histolytica
DRYEADWSMVERGWKAHVRG

SEQ ID NO: 2672005 - protein, 17 aa, Entamoeba histolytica
DRYEFPRELDLYPYCIE

SEQ ID NO: 2672006 - protein, 22 aa, Entamoeba histolytica
DRYEGYYNYLLFESYKKLHPSI

SEQ ID NO: 2672007 - protein, 17 aa, Entamoeba histolytica
DRYKHPSTSVLACALTK

SEQ ID NO: 2672008 - protein, 26 aa, Entamoeba histolytica
DSAKYVSAVLCCLSVMTSLEIPHLNV

SEQ ID NO: 2672009 - protein, 20 aa, Entamoeba histolytica
DSAPIKKAWEAEARKKKKLQ

SEQ ID NO: 2672010 - protein, 17 aa, Entamoeba histolytica
DSASNINTWGYYASDGY

SEQ ID NO: 2672011 - protein, 17 aa, Entamoeba histolytica
DSAVISMSWPEMENQQR

SEQ ID NO: 2672012 - protein, 18 aa, Entamoeba histolytica
DSCEVVRGMMASVMKYLL

SEQ ID NO: 2672013 - protein, 20 aa, Entamoeba histolytica
DSCIPKCPKCGKEMTQNLRS

SEQ ID NO: 2672014 - protein, 22 aa, Entamoeba histolytica
DSDFKFGKPCNKEWKIVTYNKE

SEQ ID NO: 2672015 - protein, 18 aa, Entamoeba histolytica
DSDIYSCLLENLRTDYAI

SEQ ID NO: 2672016 - protein, 19 aa, Entamoeba histolytica
DSDNIVWLCIVAKTENPRQ

SEQ ID NO: 2672017 - protein, 39 aa, Entamoeba histolytica
DSEEFCGHYMFPYCILNKHLPFWGGYVGSHFEIEWDDRS

SEQ ID NO: 2672018 - protein, 23 aa, Entamoeba histolytica
DSELWDLRMLKLKKTTDLLNGCY

SEQ ID NO: 2672019 - protein, 26 aa, Entamoeba histolytica
DSENILCFAGAFLISGNCGENEESRL

SEQ ID NO: 2672020 - protein, 19 aa, Entamoeba histolytica
DSEQICALLPETTSRLLRI

SEQ ID NO: 2672021 - protein, 24 aa, Entamoeba histolytica
DSERLDDILLFSGFKDIKQRELAT

SEQ ID NO: 2672022 - protein, 37 aa, Entamoeba histolytica
DSESGYKFILGMMFSLYRKYCICRSVSDESNNFKTGN

SEQ ID NO: 2672023 - protein, 20 aa, Entamoeba histolytica
DSESIIFPFLYENEIIQWLT

SEQ ID NO: 2672024 - protein, 22 aa, Entamoeba histolytica
DSEVWKEYDLVLKKGYKAIKFE

SEQ ID NO: 2672025 - protein, 28 aa, Entamoeba histolytica
DSEVYHWAVKLKKQFETLWKNAFKEKKP

SEQ ID NO: 2672026 - protein, 17 aa, Entamoeba histolytica
DSFAPTWTKSGLRELRF

SEQ ID NO: 2672027 - protein, 24 aa, Entamoeba histolytica
DSFDLRKCIPLNIVGNGAYGTIIK

SEQ ID NO: 2672028 - protein, 23 aa, Entamoeba histolytica
DSFEYAKLLQLFSENDFVLIRNE

SEQ ID NO: 2672029 - protein, 17 aa, Entamoeba histolytica
DSFFASELWEAFDDEKR

SEQ ID NO: 2672030 - protein, 19 aa, Entamoeba histolytica
DSFLHKISGLSILNYGTIN

SEQ ID NO: 2672031 - protein, 18 aa, Entamoeba histolytica
DSFLSSSYFYHYQVSSNN

SEQ ID NO: 2672032 - protein, 17 aa, Entamoeba histolytica
DSFPAELFVDKKYIKVL

SEQ ID NO: 2672033 - protein, 23 aa, Entamoeba histolytica
DSFSTAFLPMILNLAFDSTSNVR

SEQ ID NO: 2672034 - protein, 25 aa, Entamoeba histolytica
DSFVDGKAFLALLCSLDKDQKTFDK

SEQ ID NO: 2672035 - protein, 18 aa, Entamoeba histolytica
DSFYRQLISFGIHPWHCG

SEQ ID NO: 2672036 - protein, 18 aa, Entamoeba histolytica
DSFYYFMKKIRSINEKTT

SEQ ID NO: 2672037 - protein, 17 aa, Entamoeba histolytica
DSGCILLKHISYNNFDE

SEQ ID NO: 2672038 - protein, 23 aa, Entamoeba histolytica
DSGDSIFTYFGYRKFSKGNYKGF

SEQ ID NO: 2672039 - protein, 25 aa, Entamoeba histolytica
DSGKRIWKELVFKPNSFEIISECLS

SEQ ID NO: 2672040 - protein, 25 aa, Entamoeba histolytica
DSGLMAKMHLIDYSMLVGVHNLTEE

SEQ ID NO: 2672041 - protein, 23 aa, Entamoeba histolytica
DSGQCARALKLQHFSLKYLLQKY

SEQ ID NO: 2672042 - protein, 23 aa, Entamoeba histolytica
DSHKVFIKNGSIYFNELTYTNPF

SEQ ID NO: 2672043 - protein, 24 aa, Entamoeba histolytica
DSHSELRPILPSLDTFQSTPSPIK

SEQ ID NO: 2672044 - protein, 19 aa, Entamoeba histolytica
DSIDIPILVPIPVVKNQSC

SEQ ID NO: 2672045 - protein, 24 aa, Entamoeba histolytica
DSIHRCVNELLKLVNVTAQPINEK

SEQ ID NO: 2672046 - protein, 32 aa, Entamoeba histolytica; identical to SEQ ID NO: 2477776

SEQ ID NO: 2672047 - protein, 17 aa, Entamoeba histolytica
DSIIHFIVEMVIVKKMI

SEQ ID NO: 2672048 - protein, 31 aa, Entamoeba histolytica; identical to SEQ ID NO: 2521198

SEQ ID NO: 2672049 - protein, 25 aa, Entamoeba histolytica
DSIKLIGKYAFKSSILLQPPNIPNG

SEQ ID NO: 2672050 - protein, 25 aa, Entamoeba histolytica
DSIKTRSSFTIKRSKYFNPITNKLS

SEQ ID NO: 2672051 - protein, 18 aa, Entamoeba histolytica
DSILSIPLTNSFQSSESV

SEQ ID NO: 2672052 - protein, 24 aa, Entamoeba histolytica
DSINKFCSFDWWCQAIESGEKLCL

SEQ ID NO: 2672053 - protein, 19 aa, Entamoeba histolytica
DSIPEPKDCIPFVPFSLHS

SEQ ID NO: 2672054 - protein, 20 aa, Entamoeba histolytica
DSIPLFGFVGRICEQKGVFL

SEQ ID NO: 2672055 - protein, 27 aa, Entamoeba histolytica
DSIRFVSKRIFYCFIHQLPKCNLEILS

SEQ ID NO: 2672056 - protein, 19 aa, Entamoeba histolytica
DSISFWYGNNDCRCLDYLT

SEQ ID NO: 2672057 - protein, 21 aa, Entamoeba histolytica
DSIVAKGRFHLFTAKGELKDK

SEQ ID NO: 2672058 - protein, 19 aa, Entamoeba histolytica
DSKILATLCEQGNTNQFIP

SEQ ID NO: 2672059 - protein, 19 aa, Entamoeba histolytica
DSKKKCEIVLDIQCLSYHV

SEQ ID NO: 2672060 - protein, 27 aa, Entamoeba histolytica
DSKVKAPMILKCFLTFAERLNIDDSLY

SEQ ID NO: 2672061 - protein, 21 aa, Entamoeba histolytica
DSKYSAILCGNKIDSEDRIVT

SEQ ID NO: 2672062 - protein, 24 aa, Entamoeba histolytica
DSLAPTIIKLCIGFNEDSIKKRAI

SEQ ID NO: 2672063 - protein, 21 aa, Entamoeba histolytica
DSLCGNLKPAVYASLHDYITS

SEQ ID NO: 2672064 - protein, 24 aa, Entamoeba histolytica
DSLETCLWIFINITSMSDVYVFHV

SEQ ID NO: 2672065 - protein, 24 aa, Entamoeba histolytica
DSLGGNCKTVIIGTVSPSLSSIKE

SEQ ID NO: 2672066 - protein, 35 aa, Entamoeba histolytica
DSLIDKITWWAGRLFFNEFEMLMKVLKESNENSGQ

SEQ ID NO: 2672067 - protein, 19 aa, Entamoeba histolytica
DSLIPVPILYDIIRTAIDH

SEQ ID NO: 2672068 - protein, 19 aa, Entamoeba histolytica
DSLLFLYIEFIIKLNEMLS

SEQ ID NO: 2672069 - protein, 23 aa, Entamoeba histolytica
DSLPEFLPDGILKKLTKKVGAKM

SEQ ID NO: 2672070 - protein, 20 aa, Entamoeba histolytica
DSLRSLLLKNERVIDQLFQY

SEQ ID NO: 2672071 - protein, 18 aa, Entamoeba histolytica
DSMARKVAIQTLMETTKS

SEQ ID NO: 2672072 - protein, 24 aa, Entamoeba histolytica
DSNAHPILLCFQSSPIFSQQETRF

SEQ ID NO: 2672073 - protein, 22 aa, Entamoeba histolytica
DSNDIFSGLSYSSSKKQHNSNS

SEQ ID NO: 2672074 - protein, 18 aa, Entamoeba histolytica
DSNIPYFIDHINRVVYDD

SEQ ID NO: 2672075 - protein, 24 aa, Entamoeba histolytica
DSNLKRTLDFGGFGSESGKFNEPT

SEQ ID NO: 2672076 - protein, 21 aa, Entamoeba histolytica
DSNPIPFGSVDFSNFHVDFTS

SEQ ID NO: 2672077 - protein, 25 aa, Entamoeba histolytica
DSPECALCKVKFTFVNRRHHCRKCG

SEQ ID NO: 2672078 - protein, 22 aa, Entamoeba histolytica
DSPIKRRPVINMTQRGQRNSPL

SEQ ID NO: 2672079 - protein, 18 aa, Entamoeba histolytica
DSPILICTLVCDKEANVV

SEQ ID NO: 2672080 - protein, 23 aa, Entamoeba histolytica
DSPNSLHCFRILSLSSSEVDITF

SEQ ID NO: 2672081 - protein, 24 aa, Entamoeba histolytica
DSQCCKLSLLSPIISQCIKTLKEN

SEQ ID NO: 2672082 - protein, 26 aa, Entamoeba histolytica
DSQCKYMAIASGRADVYLRLPRNLSY

SEQ ID NO: 2672083 - protein, 31 aa, Entamoeba histolytica
DSQLNIIEFFIAMACLNHYILFKKLPIKIPV

SEQ ID NO: 2672084 - protein, 24 aa, Entamoeba histolytica
DSQLRKSTILDLAKYFKQVYVWQG

SEQ ID NO: 2672085 - protein, 24 aa, Entamoeba histolytica
DSQRKSEMTGIVFPSQRMRGGPLK

SEQ ID NO: 2672086 - protein, 22 aa, Entamoeba histolytica
DSQRLETCIVCNKRIEGEFVSA

SEQ ID NO: 2672087 - protein, 18 aa, Entamoeba histolytica
DSRLTLMEIELSKKTVAY

SEQ ID NO: 2672088 - protein, 17 aa, Entamoeba histolytica
DSRMFSIDIEIGKDKQI

SEQ ID NO: 2672089 - protein, 25 aa, Entamoeba histolytica
DSRMKEFINDLVLAKKRVEKGVPNS

SEQ ID NO: 2672090 - protein, 27 aa, Entamoeba histolytica
DSSEIQKCIKGYSYILIFLKFNYGNIL

SEQ ID NO: 2672091 - protein, 23 aa, Entamoeba histolytica
DSSFKQPLCDIIMKIFPHVQSLL

SEQ ID NO: 2672092 - protein, 23 aa, Entamoeba histolytica
DSSILKHQKDFFVLVKSQLEQQQ

SEQ ID NO: 2672093 - protein, 24 aa, Entamoeba histolytica
DSSKAFIKREFHALKINPKGKAQD

SEQ ID NO: 2672094 - protein, 25 aa, Entamoeba histolytica
DSSRSKLLYDFTINFTIENQEESLV

SEQ ID NO: 2672095 - protein, 22 aa, Entamoeba histolytica
DSSVGKTCIIGRFMNGDFNTGY

SEQ ID NO: 2672096 - protein, 22 aa, Entamoeba histolytica
DSSVGKTCIIGRFMTGDFNTGY

SEQ ID NO: 2672097 - protein, 18 aa, Entamoeba histolytica
DSTCNSNFSFYWDLLKIC

SEQ ID NO: 2672098 - protein, 24 aa, Entamoeba histolytica
DSTIKGEILIALTKLSARIPSQFN

SEQ ID NO: 2672099 - protein, 23 aa, Entamoeba histolytica
DSTKKRYGFQFKYGKHTQKLLTD

SEQ ID NO: 2672100 - protein, 22 aa, Entamoeba histolytica
DSTKWTIVPALSFNPSQADFMT

SEQ ID NO: 2672101 - protein, 17 aa, Entamoeba histolytica
DSVFEAIAMEYPDVTAE

SEQ ID NO: 2672102 - protein, 19 aa, Entamoeba histolytica
DSVIIWDAIFAYGNSLKLC

SEQ ID NO: 2672103 - protein, 26 aa, Entamoeba histolytica
DSVIRFGKIQRIICMNSHRPDMPHSL

SEQ ID NO: 2672104 - protein, 17 aa, Entamoeba histolytica
DSVYEGLYWILFKNQSN

SEQ ID NO: 2672105 - protein, 24 aa, Entamoeba histolytica
DSWIEIENGFKLYQEKSGTVFTIP

SEQ ID NO: 2672106 - protein, 24 aa, Entamoeba histolytica
DSYGCLFLPSFNLRSYLSQEEDCK

SEQ ID NO: 2672107 - protein, 19 aa, Entamoeba histolytica
DSYHTLGMIYLDLGDTKTA

SEQ ID NO: 2672108 - protein, 23 aa, Entamoeba histolytica
DSYINFSPFWKKKDGTKIPEGTK

SEQ ID NO: 2672109 - protein, 18 aa, Entamoeba histolytica
DSYIPFRSSPLTRILQDA

SEQ ID NO: 2672110 - protein, 23 aa, Entamoeba histolytica
DSYKYSICLTNLSSFYLYESYDS

SEQ ID NO: 2672111 - protein, 25 aa, Entamoeba histolytica
DSYYKICKMIQSFWEGEKCLYLQIF

SEQ ID NO: 2672112 - protein, 24 aa, Entamoeba histolytica
DTCGICGASFGLITRRHHCRRCGK

SEQ ID NO: 2672113 - protein, 18 aa, Entamoeba histolytica
DTDFSRNNWIWSRVIELN

SEQ ID NO: 2672114 - protein, 25 aa, Entamoeba histolytica
DTDILFKFNEAFAVAKTKGSDELHL

SEQ ID NO: 2672115 - protein, 26 aa, Entamoeba histolytica
DTDILFKFNEAFAVAKTKGSDELHLH

SEQ ID NO: 2672116 - protein, 25 aa, Entamoeba histolytica
DTDKLVECYQLILDVAAWINEKKLY

SEQ ID NO: 2672117 - protein, 18 aa, Entamoeba histolytica
DTEDCIKPLYSMEKTMGM

SEQ ID NO: 2672118 - protein, 33 aa, Entamoeba histolytica
DTEFKGEILDFIGESKWNIIRIIIYNKSLKSST

SEQ ID NO: 2672119 - protein, 21 aa, Entamoeba histolytica
DTEGIFRISVSVKDLEETMTK

SEQ ID NO: 2672120 - protein, 20 aa, Entamoeba histolytica
DTEIMFCKRNHKPLILSNKH

SEQ ID NO: 2672121 - protein, 24 aa, Entamoeba histolytica
DTEKPETFTVFFGKKQQNQVSKSK

SEQ ID NO: 2672122 - protein, 25 aa, Entamoeba histolytica
DTELCPYCNGHIKKANFKIHELRCR

SEQ ID NO: 2672123 - protein, 24 aa, Entamoeba histolytica
DTELIELGKWIGINEKLIFESKEV

SEQ ID NO: 2672124 - protein, 19 aa, Entamoeba histolytica
DTFLRRQSRSFQRAITPKH

SEQ ID NO: 2672125 - protein, 22 aa, Entamoeba histolytica
DTFLRRQSRSFQRAITPRKTGK

SEQ ID NO: 2672126 - protein, 23 aa, Entamoeba histolytica
DTGQKYFHWEFEGEMKKSMIEQE

SEQ ID NO: 2672127 - protein, 19 aa, Entamoeba histolytica
DTHLSTVVSSCFQKTIHLS

SEQ ID NO: 2672128 - protein, 28 aa, Entamoeba histolytica
DTIIARKFLCCGPLFIVEKVTEIPQKWM

SEQ ID NO: 2672129 - protein, 24 aa, Entamoeba histolytica
DTIIKCGKLLYGEKYIDNGEQNTS

SEQ ID NO: 2672130 - protein, 25 aa, Entamoeba histolytica
DTKGDGEGCWWGCVIKGDHVIDVKR

SEQ ID NO: 2672131 - protein, 24 aa, Entamoeba histolytica
DTKKRIIGLLKIWTSTVSPNIIQA

SEQ ID NO: 2672132 - protein, 19 aa, Entamoeba histolytica
DTKLWKYIIPYVNIAIKQK

SEQ ID NO: 2672133 - protein, 27 aa, Entamoeba histolytica
DTKMICGGGCVEMELSLAVEEAAKKTE

SEQ ID NO: 2672134 - protein, 17 aa, Entamoeba histolytica
DTKPGMVQLKCEGQTIN

SEQ ID NO: 2672135 - protein, 27 aa, Entamoeba histolytica
DTKRELIHILRIMLPLKKENNNNNKEE

SEQ ID NO: 2672136 - protein, 20 aa, Entamoeba histolytica
DTKTQFPVVFGRGKEGTRDG

SEQ ID NO: 2672137 - protein, 18 aa, Entamoeba histolytica
DTKTVFILQMANYIEAEW

SEQ ID NO: 2672138 - protein, 20 aa, Entamoeba histolytica
DTLCKLIKRDIDIENGDIEI

SEQ ID NO: 2672139 - protein, 23 aa, Entamoeba histolytica
DTLEMKLYRLSETVMPSLNYGSM

SEQ ID NO: 2672140 - protein, 19 aa, Entamoeba histolytica
DTLGNIVIEFMKRMNELTP

SEQ ID NO: 2672141 - protein, 26 aa, Entamoeba histolytica
DTLKEETRIKILMLLKNITKCNDHQL

SEQ ID NO: 2672142 - protein, 24 aa, Entamoeba histolytica
DTLLSILLRLDFDVKYQSKEDRCY

SEQ ID NO: 2672143 - protein, 21 aa, Entamoeba histolytica
DTLPCLRYLFDSDAPKYHVPL

SEQ ID NO: 2672144 - protein, 21 aa, Entamoeba histolytica
DTLPEGFSFSFNKQNNKEEYS

SEQ ID NO: 2672145 - protein, 21 aa, Entamoeba histolytica
DTLTYILLSWIIKGIPLEHAV

SEQ ID NO: 2672146 - protein, 17 aa, Entamoeba histolytica
DTMTVIIYQTVVDYLNS

SEQ ID NO: 2672147 - protein, 20 aa, Entamoeba histolytica
DTNICYLNLVSPHHEATPEA

SEQ ID NO: 2672148 - protein, 19 aa, Entamoeba histolytica
DTPFTFNLLEEIKHVDPEN

SEQ ID NO: 2672149 - protein, 17 aa, Entamoeba histolytica
DTPLPITVESLCNILLP

SEQ ID NO: 2672150 - protein, 19 aa, Entamoeba histolytica
DTRKSFVRGSLAFVYCTIF

SEQ ID NO: 2672151 - protein, 20 aa, Entamoeba histolytica
DTSFISFKILTLLYPQPIWN

SEQ ID NO: 2672152 - protein, 28 aa, Entamoeba histolytica
DTSITLIIKMLCEWGLFYHPNNKNQGNI

SEQ ID NO: 2672153 - protein, 25 aa, Entamoeba histolytica
DTTEIKNAMSFMFASLYEKIINIEV

SEQ ID NO: 2672154 - protein, 19 aa, Entamoeba histolytica
DTTICLVGSHLAAHQPEIN

SEQ ID NO: 2672155 - protein, 21 aa, Entamoeba histolytica
DTVHPLFQFKTLPVQVLLKLQ

SEQ ID NO: 2672156 - protein, 17 aa, Entamoeba histolytica
DTVYDGWERKSFNKHVM

SEQ ID NO: 2672157 - protein, 19 aa, Entamoeba histolytica
DTYLACVRCCKDYANSPYK

SEQ ID NO: 2672158 - protein, 23 aa, Entamoeba histolytica
DVACVINFDCPISIVSYTHRIGR

SEQ ID NO: 2672159 - protein, 23 aa, Entamoeba histolytica
DVAPKKVMYCLSIFIESTKHLTS

SEQ ID NO: 2672160 - protein, 18 aa, Entamoeba histolytica
DVATIFKVLIPKGKSVTF

SEQ ID NO: 2672161 - protein, 20 aa, Entamoeba histolytica
DVDCLWKKEFKRFAQTRSLL

SEQ ID NO: 2672162 - protein, 19 aa, Entamoeba histolytica
DVDKVECKGAKEMLLMIPE

SEQ ID NO: 2672163 - protein, 29 aa, Entamoeba histolytica
DVDMLFKKYQHALSFLAEIKFISKDRNPF

SEQ ID NO: 2672164 - protein, 24 aa, Entamoeba histolytica
DVDRIPIRFNKHIIRNKRFTTTVL

SEQ ID NO: 2672165 - protein, 21 aa, Entamoeba histolytica
DVDRTVALYGYVRGTNMRPNA

SEQ ID NO: 2672166 - protein, 21 aa, Entamoeba histolytica
DVDSWTSIVCEGKFVNEICPQ

SEQ ID NO: 2672167 - protein, 21 aa, Entamoeba histolytica
DVDYCRTLFESPMWNADDVKL

SEQ ID NO: 2672168 - protein, 24 aa, Entamoeba histolytica
DVDYNTAMAFVQSWLNVTSQNLSR

SEQ ID NO: 2672169 - protein, 25 aa, Entamoeba histolytica
DVEGFACGFLKQTHKAVIISMANSE

SEQ ID NO: 2672170 - protein, 34 aa, Entamoeba histolytica
DVEGVPVYINHLWRKCYGDESCKNYLNIRYPLPE

SEQ ID NO: 2672171 - protein, 24 aa, Entamoeba histolytica
DVEMWKKQEIIDGFVDLDGMSVGA

SEQ ID NO: 2672172 - protein, 25 aa, Entamoeba histolytica
DVFDWAMKRISAFTHNIVYHDPVEG

SEQ ID NO: 2672173 - protein, 25 aa, Entamoeba histolytica
DVFGMPSALSFPFDVIFRQPSTSSF

SEQ ID NO: 2672174 - protein, 29 aa, Entamoeba histolytica
DVFKIKDIWKRVCIVWTKCFNHFSKDEIK

SEQ ID NO: 2672175 - protein, 29 aa, Entamoeba histolytica
DVFTIKDIWKRVCIVWNKCDIDEVRGIGK

SEQ ID NO: 2672176 - protein, 25 aa, Entamoeba histolytica
DVFTSIKCLLQLKMNDVLTAENEVA

SEQ ID NO: 2672177 - protein, 18 aa, Entamoeba histolytica
DVFYQYELDNHKNDILKF

SEQ ID NO: 2672178 - protein, 17 aa, Entamoeba histolytica
DVGCGTGILSMFAARNG

SEQ ID NO: 2672179 - protein, 17 aa, Entamoeba histolytica
DVGEFYFRVLKSEELLT

SEQ ID NO: 2672180 - protein, 18 aa, Entamoeba histolytica
DVGIKFGVGDDISDDEIN

SEQ ID NO: 2672181 - protein, 24 aa, Entamoeba histolytica
DVHAKFAIALQCGNFKAALEAAKQ

SEQ ID NO: 2672182 - protein, 20 aa, Entamoeba histolytica
DVICELRKVTILMLQQNRIK

SEQ ID NO: 2672183 - protein, 24 aa, Entamoeba histolytica
DVICELRKVTILMLQQNRIKEVPD

SEQ ID NO: 2672184 - protein, 20 aa, Entamoeba histolytica
DVICGVLLGKAFIPFGAPEH

SEQ ID NO: 2672185 - protein, 23 aa, Entamoeba histolytica
DVICPECIVRPSYVSEVRKDDED

SEQ ID NO: 2672186 - protein, 23 aa, Entamoeba histolytica
DVIDFAKRCYYWIHFGFTELGDL

SEQ ID NO: 2672187 - protein, 25 aa, Entamoeba histolytica
DVIEFKNIIKFICECYNMKIFAEEF

SEQ ID NO: 2672188 - protein, 17 aa, Entamoeba histolytica
DVIEMINEFLIFNDGVF

SEQ ID NO: 2672189 - protein, 26 aa, Entamoeba histolytica
DVIEPKSYMCVIGEGFTIKHHPEEHG

SEQ ID NO: 2672190 - protein, 24 aa, Entamoeba histolytica
DVIFDPKKDWTFDSLSTCFSKSER

SEQ ID NO: 2672191 - protein, 19 aa, Entamoeba histolytica
DVIKEWSYEVFFNTNGTSN

SEQ ID NO: 2672192 - protein, 23 aa, Entamoeba histolytica
DVIKKEKRYTFSLDKSIMNCKYV

SEQ ID NO: 2672193 - protein, 24 aa, Entamoeba histolytica
DVILKDELRGMRRVLKRLGYVSED

SEQ ID NO: 2672194 - protein, 17 aa, Entamoeba histolytica
DVIMSSYFINYIGLGVK

SEQ ID NO: 2672195 - protein, 24 aa, Entamoeba histolytica
DVINGCFNFQIPEYNLINFSMEHS

SEQ ID NO: 2672196 - protein, 18 aa, Entamoeba histolytica
DVIPIVVICSQFVKEDHR

SEQ ID NO: 2672197 - protein, 23 aa, Entamoeba histolytica
DVIRLREKLTYSHTFGIYVDLQL

SEQ ID NO: 2672198 - protein, 23 aa, Entamoeba histolytica
DVISKFAPYCCLLNLDECKDVNK

SEQ ID NO: 2672199 - protein, 34 aa, Entamoeba histolytica
DVISPLRLKIMNFVRIWIKNAWRDFEGQTELIEK

SEQ ID NO: 2672200 - protein, 22 aa, Entamoeba histolytica
DVKKKGIIKYSRKPKVEDKEED

SEQ ID NO: 2672201 - protein, 18 aa, Entamoeba histolytica
DVKKNFIAMLTFCDGEEP

SEQ ID NO: 2672202 - protein, 18 aa, Entamoeba histolytica
DVKKNFVAMLTFCDGEKP

SEQ ID NO: 2672203 - protein, 22 aa, Entamoeba histolytica
DVKRNFLILLNFFVKTGHFNDQ

SEQ ID NO: 2672204 - protein, 24 aa, Entamoeba histolytica
DVKYSTQTSFGFCVASNNSIVLLS

SEQ ID NO: 2672205 - protein, 17 aa, Entamoeba histolytica
DVLEKSGVLIFKDSSAN

SEQ ID NO: 2672206 - protein, 18 aa, Entamoeba histolytica
DVLFKECINQFLSNDYSF

SEQ ID NO: 2672207 - protein, 18 aa, Entamoeba histolytica
DVLKHLSQFTYFYECNAP

SEQ ID NO: 2672208 - protein, 21 aa, Entamoeba histolytica
DVLKKYCYDKILMKQNKDLSN

SEQ ID NO: 2672209 - protein, 25 aa, Entamoeba histolytica
DVLKTCSITKSFKLYYDIVSQSTIR

SEQ ID NO: 2672210 - protein, 20 aa, Entamoeba histolytica
DVLKYMCLILSIQPIYSKFI

SEQ ID NO: 2672211 - protein, 17 aa, Entamoeba histolytica
DVLPTRNLIGVTILYGP

SEQ ID NO: 2672212 - protein, 23 aa, Entamoeba histolytica
DVLSGSLATFVAWSKLNQDFQDE

SEQ ID NO: 2672213 - protein, 17 aa, Entamoeba histolytica
DVLYTIKIVFVGDPCTL

SEQ ID NO: 2672214 - protein, 25 aa, Entamoeba histolytica
DVMLEKTLMEFSRRSVVDCIQGSVV

SEQ ID NO: 2672215 - protein, 28 aa, Entamoeba histolytica
DVNALNCLILFPCLKFVEFCLIEEKQNS

SEQ ID NO: 2672216 - protein, 41 aa, Entamoeba histolytica; identical to SEQ ID NO: 2477962

SEQ ID NO: 2672217 - protein, 18 aa, Entamoeba histolytica
DVNECKICQSEIKKKKKY

SEQ ID NO: 2672218 - protein, 25 aa, Entamoeba histolytica
DVNELRMKATSFKAVNIEEITSALS

SEQ ID NO: 2672219 - protein, 17 aa, Entamoeba histolytica
DVNGCGINKLGDMMRGM

SEQ ID NO: 2672220 - protein, 17 aa, Entamoeba histolytica
DVNGGIIYNIVARNDEQ

SEQ ID NO: 2672221 - protein, 25 aa, Entamoeba histolytica
DVNVFKILIISSIKLGKDVMQFEET

SEQ ID NO: 2672222 - protein, 31 aa, Entamoeba histolytica
DVPAGYYDIRICTYSGMTRFAVYTRVCEVSK

SEQ ID NO: 2672223 - protein, 25 aa, Entamoeba histolytica
DVPLKEGLPLPVYDSLKYFKENPTL

SEQ ID NO: 2672224 - protein, 26 aa, Entamoeba histolytica
DVPLSGICLYFDCTFLKKSYLTTKPD

SEQ ID NO: 2672225 - protein, 17 aa, Entamoeba histolytica
DVQIYVYSIKFGDKKYL

SEQ ID NO: 2672226 - protein, 19 aa, Entamoeba histolytica
DVQKLLIIREHCWQKNFEF

SEQ ID NO: 2672227 - protein, 20 aa, Entamoeba histolytica
DVQLPLLMSLVRTFTNRSTG

SEQ ID NO: 2672228 - protein, 24 aa, Entamoeba histolytica
DVRTPEFLNAIALGDIVIVEVPNI

SEQ ID NO: 2672229 - protein, 27 aa, Entamoeba histolytica
DVRVAYEATRILCNLINLKSEYANTIM

SEQ ID NO: 2672230 - protein, 19 aa, Entamoeba histolytica
DVRVQRMIIHLLANIAGDS

SEQ ID NO: 2672231 - protein, 26 aa, Entamoeba histolytica
DVSAVCYIELIAFMSFVNYQKEIPIV

SEQ ID NO: 2672232 - protein, 25 aa, Entamoeba histolytica
DVSIRETICAWDWKMREQAGSDKYG

SEQ ID NO: 2672233 - protein, 22 aa, Entamoeba histolytica
DVSLIWNCLGTLITSFTSTSNG

SEQ ID NO: 2672234 - protein, 24 aa, Entamoeba histolytica
DVSLKYPLHPNAMYSLISVRGKQQ

SEQ ID NO: 2672235 - protein, 23 aa, Entamoeba histolytica
DVSRVSMNWLIKLRLMHINSQLK

SEQ ID NO: 2672236 - protein, 17 aa, Entamoeba histolytica
DVSRYLIDIALKRQSFD

SEQ ID NO: 2672237 - protein, 24 aa, Entamoeba histolytica
DVTCYSFRWVSMLFIDDFSIKDVI

SEQ ID NO: 2672238 - protein, 17 aa, Entamoeba histolytica
DVTHYIQGLPFIAQTAL

SEQ ID NO: 2672239 - protein, 20 aa, Entamoeba histolytica
DVTIPIEFEEQGIKISGIVS

SEQ ID NO: 2672240 - protein, 21 aa, Entamoeba histolytica
DVTPCLIHFGIPPEGCTAYYS

SEQ ID NO: 2672241 - protein, 25 aa, Entamoeba histolytica
DVTVMIEIFYRGLGVSFVEGEVLKK

SEQ ID NO: 2672242 - protein, 22 aa, Entamoeba histolytica
DVVGLTGWKIFESRKYKSEPKY

SEQ ID NO: 2672243 - protein, 20 aa, Entamoeba histolytica
DVVILWDAIFAFGHQLKLVD

SEQ ID NO: 2672244 - protein, 21 aa, Entamoeba histolytica
DVVKGWELIDYILKFQPSLYQ

SEQ ID NO: 2672245 - protein, 17 aa, Entamoeba histolytica
DVVQVEGGFTFIIIDYF

SEQ ID NO: 2672246 - protein, 20 aa, Entamoeba histolytica
DVVRYLVYWGKAKVIEAVFL

SEQ ID NO: 2672247 - protein, 23 aa, Entamoeba histolytica
DVVTSVSVNEIWKGITDNTNEYT

SEQ ID NO: 2672248 - protein, 25 aa, Entamoeba histolytica
DVYISFKGSIPFLRKTSPMHLTHDQ

SEQ ID NO: 2672249 - protein, 37 aa, Entamoeba histolytica
DVYLASILICLPLLPPHRRVVLRIAKNIFIKENIQLP

SEQ ID NO: 2672250 - protein, 19 aa, Entamoeba histolytica
DVYLFKPYMDKIFENINPL

SEQ ID NO: 2672251 - protein, 19 aa, Entamoeba histolytica
DVYSFGILVFHVLTQLVNT

SEQ ID NO: 2672252 - protein, 24 aa, Entamoeba histolytica
DVYYVYNCIDLIFIHLQGSEEVVF

SEQ ID NO: 2672253 - protein, 19 aa, Entamoeba histolytica
DWAEVVNAPQGGNVEGIEK

SEQ ID NO: 2672254 - protein, 30 aa, Entamoeba histolytica; identical to SEQ ID NO: 2478004

SEQ ID NO: 2672255 - protein, 26 aa, Entamoeba histolytica
DWCISRQLWWGHRIPAYLIKSKKEKE

SEQ ID NO: 2672256 - protein, 22 aa, Entamoeba histolytica
DWENSIHCYYVFEQAIFSLIEL

SEQ ID NO: 2672257 - protein, 19 aa, Entamoeba histolytica
DWIDVEAFVNKRCQDRITF

SEQ ID NO: 2672258 - protein, 18 aa, Entamoeba histolytica
DWIHLTLEVGKWSLETMK

SEQ ID NO: 2672259 - protein, 21 aa, Entamoeba histolytica
DWIYIRAAAIARKVYLNNGIG

SEQ ID NO: 2672260 - protein, 20 aa, Entamoeba histolytica
DWLKECLEYIKGNVKLITEF

SEQ ID NO: 2672261 - protein, 20 aa, Entamoeba histolytica
DWLTERIILSYLEYFEFVAS

SEQ ID NO: 2672262 - protein, 26 aa, Entamoeba histolytica
DWSKCMGCGMCAMRCNYGVLHKSGPR

SEQ ID NO: 2672263 - protein, 27 aa, Entamoeba histolytica
DWSKCMGCGMCATKCTFGVLVKQPPKI

SEQ ID NO: 2672264 - protein, 25 aa, Entamoeba histolytica
DWTFYCHKCDGMASLRTCPHTKKDR

SEQ ID NO: 2672265 - protein, 22 aa, Entamoeba histolytica
DYAEALIFCISHKVQLSNHDIT

SEQ ID NO: 2672266 - protein, 19 aa, Entamoeba histolytica
DYAIYCVQTLAAKGAEEKM

SEQ ID NO: 2672267 - protein, 37 aa, Entamoeba histolytica
DYAKSMLRMVQEFRQKRICGQTTLYYGTVKDALETYL

SEQ ID NO: 2672268 - protein, 19 aa, Entamoeba histolytica
DYCVFALNNICLKYQDYEL

SEQ ID NO: 2672269 - protein, 19 aa, Entamoeba histolytica
DYDPLPVFLVRSTYGSETA

SEQ ID NO: 2672270 - protein, 29 aa, Entamoeba histolytica
DYEGDVVLCSLSWCEIKQQRQCEHAGERY

SEQ ID NO: 2672271 - protein, 22 aa, Entamoeba histolytica
DYEGKVSWLMERSMYEEAFKFL

SEQ ID NO: 2672272 - protein, 25 aa, Entamoeba histolytica
DYEIPSGKFNNEWAITLYNSTDKDI

SEQ ID NO: 2672273 - protein, 19 aa, Entamoeba histolytica
DYEVLEYLTDISISNIHSK

SEQ ID NO: 2672274 - protein, 27 aa, Entamoeba histolytica
DYFFCYKWNALLFKRFFINEDLIRIWD

SEQ ID NO: 2672275 - protein, 25 aa, Entamoeba histolytica
DYFIFPFPLCLIVTKQLSVETMKEV

SEQ ID NO: 2672276 - protein, 23 aa, Entamoeba histolytica
DYFKSLSQLCLKEIINKKDYSFV

SEQ ID NO: 2672277 - protein, 17 aa, Entamoeba histolytica
DYFPKNRVEILTKLKTI

SEQ ID NO: 2672278 - protein, 27 aa, Entamoeba histolytica
DYGLKFWLRILHCCGNPSSISDNKVFA

SEQ ID NO: 2672279 - protein, 18 aa, Entamoeba histolytica
DYGYEMPVSLVAKKTADF

SEQ ID NO: 2672280 - protein, 17 aa, Entamoeba histolytica
DYHIIRYIIEMSGLDDL

SEQ ID NO: 2672281 - protein, 17 aa, Entamoeba histolytica
DYHKPYCIIVMNEVGAW

SEQ ID NO: 2672282 - protein, 19 aa, Entamoeba histolytica
DYIESFRFGSWPHAGCGIG

SEQ ID NO: 2672283 - protein, 19 aa, Entamoeba histolytica
DYILYSISMLFDFKTNPDV

SEQ ID NO: 2672284 - protein, 26 aa, Entamoeba histolytica
DYIMKPELFQTCPLHIRNQIYSYTAL

SEQ ID NO: 2672285 - protein, 17 aa, Entamoeba histolytica
DYIRTSGGYGITKSYAE

SEQ ID NO: 2672286 - protein, 17 aa, Entamoeba histolytica
DYKDCPNMNNFIEHSVE

SEQ ID NO: 2672287 - protein, 26 aa, Entamoeba histolytica
DYKITFPFREIIAFSYIQTKTTTTIT

SEQ ID NO: 2672288 - protein, 18 aa, Entamoeba histolytica
DYLIARRIGMNFGAMIKG

SEQ ID NO: 2672289 - protein, 19 aa, Entamoeba histolytica
DYLIGPILYQESWKELIKE

SEQ ID NO: 2672290 - protein, 33 aa, Entamoeba histolytica
DYLIIRSKFLRRRFCTFVIMKLGGLCSVEDMKE

SEQ ID NO: 2672291 - protein, 19 aa, Entamoeba histolytica
DYLKQAIEFSTHISHEVKT

SEQ ID NO: 2672292 - protein, 20 aa, Entamoeba histolytica
DYLLNGINLFNCYKLHKLTL

SEQ ID NO: 2672293 - protein, 25 aa, Entamoeba histolytica
DYLRIIFDISHSFQREELVIVPRTK

SEQ ID NO: 2672294 - protein, 24 aa, Entamoeba histolytica
DYNFEFNHLASLYFIDKKKEGYFN

SEQ ID NO: 2672295 - protein, 22 aa, Entamoeba histolytica
DYNWAVTVLNHLVFCNPKNLRA

SEQ ID NO: 2672296 - protein, 23 aa, Entamoeba histolytica
DYPAPFNALITRKKDKKSGQSQL

SEQ ID NO: 2672297 - protein, 23 aa, Entamoeba histolytica
DYPKMEISMYIPIQPDSGSPLKH

SEQ ID NO: 2672298 - protein, 23 aa, Entamoeba histolytica
DYQKLLDWRAHFPVLNDADYCEL

SEQ ID NO: 2672299 - protein, 25 aa, Entamoeba histolytica
DYQVCVQCTLIALLNEQYSFLIQRP

SEQ ID NO: 2672300 - protein, 25 aa, Entamoeba histolytica
DYREWRLVSELVIKTMSYFSHVNVR

SEQ ID NO: 2672301 - protein, 24 aa, Entamoeba histolytica
DYRILYWKRILGIEEISQELKEEF

SEQ ID NO: 2672302 - protein, 23 aa, Entamoeba histolytica
DYRIQPKKGCMVLPGQIHPGLGI

SEQ ID NO: 2672303 - protein, 19 aa, Entamoeba histolytica
DYSEAFPKYVEVLNISKML

SEQ ID NO: 2672304 - protein, 26 aa, Entamoeba histolytica
DYSELRAFCLFSPYTNKQRSSLCGNI

SEQ ID NO: 2672305 - protein, 18 aa, Entamoeba histolytica
DYSKLSVIAFTFELTERY

SEQ ID NO: 2672306 - protein, 19 aa, Entamoeba histolytica
DYSTIDGWLLLSIPGIHKG

SEQ ID NO: 2672307 - protein, 33 aa, Entamoeba histolytica
DYTCKKLTWTSGHIWKGTITLVRPRTLKWSYSL

SEQ ID NO: 2672308 - protein, 24 aa, Entamoeba histolytica
DYTIEFKHIKGLDIGDNIEVVLKW

SEQ ID NO: 2672309 - protein, 19 aa, Entamoeba histolytica
DYTLIPVTVTNNFKDINDM

SEQ ID NO: 2672310 - protein, 24 aa, Entamoeba histolytica
DYVCLKCYDELQVETKRRNSLTTS

SEQ ID NO: 2672311 - protein, 17 aa, Entamoeba histolytica
DYWIRYESKNQITFSII

SEQ ID NO: 2672312 - protein, 17 aa, Entamoeba histolytica
DYWRVVGANVKGVEKEF

SEQ ID NO: 2672313 - protein, 23 aa, Entamoeba histolytica
DYYFILLRKVHLYAHSVGPNISV

SEQ ID NO: 2672314 - protein, 26 aa, Entamoeba histolytica
DYYYFFVPIEWCCKTKLYEKKSAKHF

SEQ ID NO: 2672315 - protein, 32 aa, Entamoeba histolytica
DYYYQRLKSWIGLEKYKIILNEKVTSLTNERI

SEQ ID NO: 2672316 - protein, 19 aa, Entamoeba histolytica
EAAAFEYRLTGKIENLYWR

SEQ ID NO: 2672317 - protein, 17 aa, Entamoeba histolytica
EAAGLPMEMYEDAPDDD

SEQ ID NO: 2672318 - protein, 19 aa, Entamoeba histolytica
EACECLQGFQVTHSLGGGT

SEQ ID NO: 2672319 - protein, 31 aa, Entamoeba histolytica
EADAVARIFSILCSFKPYPIVTSNNTIQFTG

SEQ ID NO: 2672320 - protein, 17 aa, Entamoeba histolytica
EAEEWQTTFEILQENAE

SEQ ID NO: 2672321 - protein, 19 aa, Entamoeba histolytica
EAEGIFRISGKLNDINIIK

SEQ ID NO: 2672322 - protein, 17 aa, Entamoeba histolytica
EAEKEKRLGEAERLARE

SEQ ID NO: 2672323 - protein, 18 aa, Entamoeba histolytica
EAEKGKYHVIGFYCRDFS

SEQ ID NO: 2672324 - protein, 28 aa, Entamoeba histolytica
EAELLSYTGYFMFYRFVGNYIASSSNET

SEQ ID NO: 2672325 - protein, 22 aa, Entamoeba histolytica
EAEMKLAPIGVVAKAQMHPHVD

SEQ ID NO: 2672326 - protein, 25 aa, Entamoeba histolytica
EAEQECALICLLIYEGFNMQFSVPR

SEQ ID NO: 2672327 - protein, 19 aa, Entamoeba histolytica
EAEQFKKHVEEVLKQEKER

SEQ ID NO: 2672328 - protein, 23 aa, Entamoeba histolytica
EAERVKIELSRNVDCEINLSHIL

SEQ ID NO: 2672329 - protein, 25 aa, Entamoeba histolytica
EAESCFKLASEKGVSSISKYFSQEY

SEQ ID NO: 2672330 - protein, 21 aa, Entamoeba histolytica
EAESKLVRRMKLRHKEVHTDG

SEQ ID NO: 2672331 - protein, 23 aa, Entamoeba histolytica
EAFACKLEFPVKLSEILPDIKKV

SEQ ID NO: 2672332 - protein, 18 aa, Entamoeba histolytica
EAFIYKSAIGRTFSINKK

SEQ ID NO: 2672333 - protein, 24 aa, Entamoeba histolytica
EAFKRGEGIFDRMDETERRRKLVI

SEQ ID NO: 2672334 - protein, 19 aa, Entamoeba histolytica
EAFKYATGCANNLDNYLVY

SEQ ID NO: 2672335 - protein, 18 aa, Entamoeba histolytica
EAFNECYDIFLTQDETMS

SEQ ID NO: 2672336 - protein, 19 aa, Entamoeba histolytica
EAFVPRKVSHEEHRHENNE

SEQ ID NO: 2672337 - protein, 18 aa, Entamoeba histolytica
EAHYCSRKQCGVCNKDLM

SEQ ID NO: 2672338 - protein, 22 aa, Entamoeba histolytica
EAIDKRGILSLEYPMQKEPIDY

SEQ ID NO: 2672339 - protein, 20 aa, Entamoeba histolytica
EAIFKRIRMNDYHWPTETSD

SEQ ID NO: 2672340 - protein, 21 aa, Entamoeba histolytica
EAIFTKTIQGFVDFSLKVVSR

SEQ ID NO: 2672341 - protein, 18 aa, Entamoeba histolytica
EAIIQYKDVNQMGIGNIA

SEQ ID NO: 2672342 - protein, 19 aa, Entamoeba histolytica
EAIIQYKDVNQMGIGNIAV

SEQ ID NO: 2672343 - protein, 18 aa, Entamoeba histolytica
EAINSIDVVLLREVCREF

SEQ ID NO: 2672344 - protein, 20 aa, Entamoeba histolytica
EAIQRLIALRIQQGNNDEAI

SEQ ID NO: 2672345 - protein, 17 aa, Entamoeba histolytica
EAIRACLKKSKENSTGN

SEQ ID NO: 2672346 - protein, 18 aa, Entamoeba histolytica
EAIRCFESALTIDSNLIS

SEQ ID NO: 2672347 - protein, 23 aa, Entamoeba histolytica
EAIRLGKEAAVFVTTKFPRPINL

SEQ ID NO: 2672348 - protein, 18 aa, Entamoeba histolytica
EAIVYFFKGLCGAATKEL

SEQ ID NO: 2672349 - protein, 18 aa, Entamoeba histolytica
EAKECINIKYKYGKNSMC

SEQ ID NO: 2672350 - protein, 32 aa, Entamoeba histolytica
EAKESIYITDWRIDPEIILIRRGVHWLKGKTL

SEQ ID NO: 2672351 - protein, 17 aa, Entamoeba histolytica
EAKKLLYIPTVNLDEDC

SEQ ID NO: 2672352 - protein, 25 aa, Entamoeba histolytica
EAKKVEILLPFDFVACDKFGEDANT

SEQ ID NO: 2672353 - protein, 25 aa, Entamoeba histolytica
EAKRKEVIDSFEFYADRLLDLYTLS

SEQ ID NO: 2672354 - protein, 20 aa, Entamoeba histolytica
EAKRKNCPVIAYTYNEPTVF

SEQ ID NO: 2672355 - protein, 24 aa, Entamoeba histolytica
EAKTKYRSVYLFLFNDTVILTKIN

SEQ ID NO: 2672356 - protein, 20 aa, Entamoeba histolytica
EALCVFRIAQAVLLCCDGQV

SEQ ID NO: 2672357 - protein, 21 aa, Entamoeba histolytica
EALETWPVPMFENLLPRHLQI

SEQ ID NO: 2672358 - protein, 24 aa, Entamoeba histolytica
EALFKHASEFISIFENVLSVQVLS

SEQ ID NO: 2672359 - protein, 25 aa, Entamoeba histolytica
EALFSLDDTEYWLKEQAVVSLNRLM

SEQ ID NO: 2672360 - protein, 19 aa, Entamoeba histolytica
EALILWDYYFAKGCFNVVY

SEQ ID NO: 2672361 - protein, 19 aa, Entamoeba histolytica
EALISLTIVIYEFMVMTGN

SEQ ID NO: 2672362 - protein, 17 aa, Entamoeba histolytica
EALKELFNTASKECNEA

SEQ ID NO: 2672363 - protein, 22 aa, Entamoeba histolytica
EALKPLIKCELIGWDNEISQSK

SEQ ID NO: 2672364 - protein, 19 aa, Entamoeba histolytica
EALKRLDVINTQILEQQTL

SEQ ID NO: 2672365 - protein, 17 aa, Entamoeba histolytica
EALKYCQEMNCIHRDLK

SEQ ID NO: 2672366 - protein, 20 aa, Entamoeba histolytica
EALLKGRPFISVSKVCQLIP

SEQ ID NO: 2672367 - protein, 22 aa, Entamoeba histolytica
EALPIHDMFQALLTLINEVIPA

SEQ ID NO: 2672368 - protein, 29 aa, Entamoeba histolytica
EALQEAVILPIKFPQLFTDKRKPWTGILL

SEQ ID NO: 2672369 - protein, 23 aa, Entamoeba histolytica
EALSLIFKCKVIKWDNLVSTNKD

SEQ ID NO: 2672370 - protein, 19 aa, Entamoeba histolytica
EALTALTLLSFIGAAKPSL

SEQ ID NO: 2672371 - protein, 18 aa, Entamoeba histolytica
EALYQLKSWKELHALAMK

SEQ ID NO: 2672372 - protein, 20 aa, Entamoeba histolytica
EAMKFLLARYYAGRMIQPSY

SEQ ID NO: 2672373 - protein, 17 aa, Entamoeba histolytica
EAMKIVLETEGNVLIAM

SEQ ID NO: 2672374 - protein, 30 aa, Entamoeba histolytica
EAMRMRVDWFFKECIFKRVNISGSEALITA

SEQ ID NO: 2672375 - protein, 21 aa, Entamoeba histolytica
EANCYYVDLFVRKSNETAIGM

SEQ ID NO: 2672376 - protein, 51 aa, Entamoeba histolytica; identical to SEQ ID NO: 2478157

SEQ ID NO: 2672377 - protein, 24 aa, Entamoeba histolytica
EANPFIVIILLKYFFLSLPQSFFC

SEQ ID NO: 2672378 - protein, 18 aa, Entamoeba histolytica
EAPFNLRIDEQRVVGLYC

SEQ ID NO: 2672379 - protein, 18 aa, Entamoeba histolytica
EAPITFLPTYKFEKGTKN

SEQ ID NO: 2672380 - protein, 26 aa, Entamoeba histolytica
EAPPPVPAPRRGLMLGRRSSSISSEE

SEQ ID NO: 2672381 - protein, 30 aa, Entamoeba histolytica
EAPVPEHRERKASFLTRPKKGVNTNDSEQQ

SEQ ID NO: 2672382 - protein, 22 aa, Entamoeba histolytica
EAQGRKAFLGMGFQERSEAFDF

SEQ ID NO: 2672383 - protein, 27 aa, Entamoeba histolytica
EAQPHKSDIPFGWFDFESSFSTSTLGL

SEQ ID NO: 2672384 - protein, 23 aa, Entamoeba histolytica
EAQRWWVRDQKPSVEFNVGFIET

SEQ ID NO: 2672385 - protein, 20 aa, Entamoeba histolytica
EAQWKFDCLLNTAMESDKYI

SEQ ID NO: 2672386 - protein, 20 aa, Entamoeba histolytica
EARLKISEMIIGQVTSEGKD

SEQ ID NO: 2672387 - protein, 31 aa, Entamoeba histolytica; identical to SEQ ID NO: 2478170

SEQ ID NO: 2672388 - protein, 24 aa, Entamoeba histolytica
EARTNICPHLSLAKITSILENLIV

SEQ ID NO: 2672389 - protein, 21 aa, Entamoeba histolytica
EARYISQMELGLFKYKEPIEK

SEQ ID NO: 2672390 - protein, 23 aa, Entamoeba histolytica
EASWSELNIPYSEETTLVKSSHT

SEQ ID NO: 2672391 - protein, 19 aa, Entamoeba histolytica
EATFKTMIHISMGVETNMS

SEQ ID NO: 2672392 - protein, 19 aa, Entamoeba histolytica
EATIYWLQRLIEMGENPKY

SEQ ID NO: 2672393 - protein, 23 aa, Entamoeba histolytica
EAVFPNMDIVDAMFYNKNIVLIG

SEQ ID NO: 2672394 - protein, 18 aa, Entamoeba histolytica
EAVKQGPVSLVLVLVQGQ

SEQ ID NO: 2672395 - protein, 19 aa, Entamoeba histolytica
EAVLREFIKSYQLEDEESV

SEQ ID NO: 2672396 - protein, 21 aa, Entamoeba histolytica
EAVMFPFGFHCTGMPIKACAD

SEQ ID NO: 2672397 - protein, 19 aa, Entamoeba histolytica
EAVNRGCSSHERVGEVEMN

SEQ ID NO: 2672398 - protein, 18 aa, Entamoeba histolytica
EAVRMCVIKSIKITLTGL

SEQ ID NO: 2672399 - protein, 18 aa, Entamoeba histolytica
EAVSFCLKAGTFANELIV

SEQ ID NO: 2672400 - protein, 21 aa, Entamoeba histolytica
EAYCCKDCRNNSFIYCYLSNL

SEQ ID NO: 2672401 - protein, 28 aa, Entamoeba histolytica
EAYSVIKYSFVFEFFIKDYEIIYKLFNF

SEQ ID NO: 2672402 - protein, 19 aa, Entamoeba histolytica
ECAIKEGICAKCREKKQIV

SEQ ID NO: 2672403 - protein, 21 aa, Entamoeba histolytica
ECCGKCEKKAKKEAKKAQKKS

SEQ ID NO: 2672404 - protein, 23 aa, Entamoeba histolytica
ECCKECCCPRIKAFKKFINTFEK

SEQ ID NO: 2672405 - protein, 21 aa, Entamoeba histolytica
ECDICKIPILREITKSDVEKI

SEQ ID NO: 2672406 - protein, 17 aa, Entamoeba histolytica
ECENCQIIIKKNENNEM

SEQ ID NO: 2672407 - protein, 20 aa, Entamoeba histolytica
ECENEIKIGVWMNQKNNSIM

SEQ ID NO: 2672408 - protein, 21 aa, Entamoeba histolytica
ECERDELKIPLQNSLTTVLLN

SEQ ID NO: 2672409 - protein, 24 aa, Entamoeba histolytica
ECFKECTRLSIIFIPTSVSEIGNG

SEQ ID NO: 2672410 - protein, 17 aa, Entamoeba histolytica
ECFKECYSLTSFNIPTT

SEQ ID NO: 2672411 - protein, 23 aa, Entamoeba histolytica
ECGEYLLYFVRIFLQYKPKTIKE

SEQ ID NO: 2672412 - protein, 18 aa, Entamoeba histolytica
ECGFAIGIITRIKREGVF

SEQ ID NO: 2672413 - protein, 19 aa, Entamoeba histolytica
ECGFNPYLVELLKTLFESF

SEQ ID NO: 2672414 - protein, 18 aa, Entamoeba histolytica
ECGKLEPEWISLNLGIVI

SEQ ID NO: 2672415 - protein, 21 aa, Entamoeba histolytica
ECGPLDALVRPLALAPCTSDT

SEQ ID NO: 2672416 - protein, 24 aa, Entamoeba histolytica
ECHEILELYASVYEDLLAVPVIRG

SEQ ID NO: 2672417 - protein, 25 aa, Entamoeba histolytica
ECHRKAVGATLPYLGMFLTDLLFTE

SEQ ID NO: 2672418 - protein, 24 aa, Entamoeba histolytica
ECKCYLCLNKEKIIGKKRVPWTII

SEQ ID NO: 2672419 - protein, 17 aa, Entamoeba histolytica
ECKDIIILLSQFIGASG

SEQ ID NO: 2672420 - protein, 24 aa, Entamoeba histolytica
ECKKAEEELGWKAKLTLEDMCKDS

SEQ ID NO: 2672421 - protein, 19 aa, Entamoeba histolytica
ECKKTCPINRAGGLCIEVL

SEQ ID NO: 2672422 - protein, 21 aa, Entamoeba histolytica
ECKLSICYYQLLKQLVYSLRD

SEQ ID NO: 2672423 - protein, 19 aa, Entamoeba histolytica
ECKNLFIPVLLKLQDDSSI

SEQ ID NO: 2672424 - protein, 28 aa, Entamoeba histolytica
ECLEQILDILITFCFYQINIPINEDYEF

SEQ ID NO: 2672425 - protein, 21 aa, Entamoeba histolytica
ECLNSPNIIWFFKFSLQTICP

SEQ ID NO: 2672426 - protein, 24 aa, Entamoeba histolytica
ECMTFPFFCLLKIKITEHNGVCYT

SEQ ID NO: 2672427 - protein, 24 aa, Entamoeba histolytica
ECNDFRDSWNRGWIHQFFGKEIAY

SEQ ID NO: 2672428 - protein, 25 aa, Entamoeba histolytica
ECNGIELKKIISILNKFEWNKIRVI

SEQ ID NO: 2672429 - protein, 25 aa, Entamoeba histolytica
ECNNKEFIEFIPLLIEGAGNLYNKS

SEQ ID NO: 2672430 - protein, 21 aa, Entamoeba histolytica
ECPRCSIKRNLFIKINKTKLE

SEQ ID NO: 2672431 - protein, 22 aa, Entamoeba histolytica
ECQFKINSIDVIYQKSKIKLND

SEQ ID NO: 2672432 - protein, 22 aa, Entamoeba histolytica
ECQICKKVSPLICHEPSDETIL

SEQ ID NO: 2672433 - protein, 27 aa, Entamoeba histolytica
ECRLEIIKEIILFIKFVCQKHNIIKEE

SEQ ID NO: 2672434 - protein, 17 aa, Entamoeba histolytica
ECSSFAFTEKHRGVIAS

SEQ ID NO: 2672435 - protein, 26 aa, Entamoeba histolytica
ECSSVFWKFMDLIASKKEQLNWNRFI

SEQ ID NO: 2672436 - protein, 24 aa, Entamoeba histolytica
ECSYLFNRINAVIQRSSLLTTKFK

SEQ ID NO: 2672437 - protein, 24 aa, Entamoeba histolytica
ECTGKRFIENFIMPKTYSAKRILL

SEQ ID NO: 2672438 - protein, 20 aa, Entamoeba histolytica
ECTRLSIITIPTCVNEIGYW

SEQ ID NO: 2672439 - protein, 19 aa, Entamoeba histolytica
ECVNPFIPISFRPPLLTKQ

SEQ ID NO: 2672440 - protein, 20 aa, Entamoeba histolytica
ECVSILLLDLHKFIQKKTTI

SEQ ID NO: 2672441 - protein, 21 aa, Entamoeba histolytica
ECVSVAFNIIQYVFYSPETKS

SEQ ID NO: 2672442 - protein, 21 aa, Entamoeba histolytica
ECYPQYGKGEFARIDDKSGQV

SEQ ID NO: 2672443 - protein, 18 aa, Entamoeba histolytica
ECYVHSGMIFKKKGDRLI

SEQ ID NO: 2672444 - protein, 27 aa, Entamoeba histolytica
EDADPAQCWAEGPGVEGGCKTCDMAEF

SEQ ID NO: 2672445 - protein, 24 aa, Entamoeba histolytica
EDAIKYVCSPPMKTEESRQALWSA

SEQ ID NO: 2672446 - protein, 19 aa, Entamoeba histolytica
EDAIWKWKEDCSNSEDYSR

SEQ ID NO: 2672447 - protein, 24 aa, Entamoeba histolytica
EDAIYLLRCQIINSCISYMEEYAT

SEQ ID NO: 2672448 - protein, 23 aa, Entamoeba histolytica
EDARLIKAVQEFGTDNWIAIQST

SEQ ID NO: 2672449 - protein, 23 aa, Entamoeba histolytica
EDARPVAEGRFHRLLGKLKEKPF

SEQ ID NO: 2672450 - protein, 17 aa, Entamoeba histolytica
EDCELNQIYTCKNLEEI

SEQ ID NO: 2672451 - protein, 22 aa, Entamoeba histolytica
EDCTGYCYLPCFLPQNQSQSNS

SEQ ID NO: 2672452 - protein, 18 aa, Entamoeba histolytica
EDCVSALDTLNCISPYRG

SEQ ID NO: 2672453 - protein, 24 aa, Entamoeba histolytica
EDDIMKWTCVIFGPDDTIWESGIF

SEQ ID NO: 2672454 - protein, 23 aa, Entamoeba histolytica
EDEELLKCFLFNIERLLNMVIQI

SEQ ID NO: 2672455 - protein, 22 aa, Entamoeba histolytica
EDEGIKLFALHISAQLAQYGSQ

SEQ ID NO: 2672456 - protein, 27 aa, Entamoeba histolytica
EDEGMIFRNGERFFFGKNVDDDEAIET

SEQ ID NO: 2672457 - protein, 36 aa, Entamoeba histolytica; identical to SEQ ID NO: 2478263

SEQ ID NO: 2672458 - protein, 22 aa, Entamoeba histolytica
EDEKICRMYGFFNECSRFKDDQ

SEQ ID NO: 2672459 - protein, 25 aa, Entamoeba histolytica
EDEPIREFNILKSFLDKYVVFLHKH

SEQ ID NO: 2672460 - protein, 17 aa, Entamoeba histolytica
EDEYCVGHFEDNEKKPK

SEQ ID NO: 2672461 - protein, 31 aa, Entamoeba histolytica
EDFEGITPILLKWDFPTPRVLPLIDSLEKAV

SEQ ID NO: 2672462 - protein, 17 aa, Entamoeba histolytica
EDFFVFNVQKFIKTRAS

SEQ ID NO: 2672463 - protein, 19 aa, Entamoeba histolytica
EDFHIVAAQKSFFCGNITM

SEQ ID NO: 2672464 - protein, 23 aa, Entamoeba histolytica
EDFKKDMKLIFENAKIYNSSENS

SEQ ID NO: 2672465 - protein, 18 aa, Entamoeba histolytica
EDFSRSPFVLEIREIAKI

SEQ ID NO: 2672466 - protein, 22 aa, Entamoeba histolytica
EDGARIVKEFQFNQNNTDMVKL

SEQ ID NO: 2672467 - protein, 26 aa, Entamoeba histolytica
EDGCLVSILSNGFWDTVVLHIKNGEI

SEQ ID NO: 2672468 - protein, 20 aa, Entamoeba histolytica
EDGELFCIDCFIEGKSMSYH

SEQ ID NO: 2672469 - protein, 25 aa, Entamoeba histolytica
EDGELWVSGWCVLTFQNKATNKSYC

SEQ ID NO: 2672470 - protein, 25 aa, Entamoeba histolytica
EDGFGELQGGWAFSVPQSMCRRIMG

SEQ ID NO: 2672471 - protein, 18 aa, Entamoeba histolytica
EDGINYLINCMKIEDKEI

SEQ ID NO: 2672472 - protein, 23 aa, Entamoeba histolytica
EDGKRYFKQCEFKLWRKQPQPIK

SEQ ID NO: 2672473 - protein, 22 aa, Entamoeba histolytica
EDGNFGVKSWILNNNTQDNALA

SEQ ID NO: 2672474 - protein, 23 aa, Entamoeba histolytica
EDGRIFKYVIWYDVSYSRYLKEK

SEQ ID NO: 2672475 - protein, 25 aa, Entamoeba histolytica
EDGRIFKYVIWYKVDYSRYLEEKEE

SEQ ID NO: 2672476 - protein, 24 aa, Entamoeba histolytica
EDGRIIKYVIWYKVSYSRYLKEKE

SEQ ID NO: 2672477 - protein, 26 aa, Entamoeba histolytica
EDHIKLLKFVTGQVRAPVGGFANLKT

SEQ ID NO: 2672478 - protein, 27 aa, Entamoeba histolytica
EDIDKRYECITMFFQLLIKLIQKKNFN

SEQ ID NO: 2672479 - protein, 17 aa, Entamoeba histolytica
EDIEFKVLMKKGRDELE

SEQ ID NO: 2672480 - protein, 20 aa, Entamoeba histolytica
EDIEIFILKYIIGKITENEL

SEQ ID NO: 2672481 - protein, 24 aa, Entamoeba histolytica
EDIELKKRMSIIGSPITDINVQET

SEQ ID NO: 2672482 - protein, 25 aa, Entamoeba histolytica
EDIFKQMFWELSMKSFDDFITKLVT

SEQ ID NO: 2672483 - protein, 20 aa, Entamoeba histolytica
EDIIKCLHKFMPKNQRILSL

SEQ ID NO: 2672484 - protein, 21 aa, Entamoeba histolytica
EDIIPHKKESVTRISDGSRFS

SEQ ID NO: 2672485 - protein, 26 aa, Entamoeba histolytica
EDILKEDWTTIKLYQFLIPIIFHYQE

SEQ ID NO: 2672486 - protein, 30 aa, Entamoeba histolytica
EDILKQRDGILFYKKFNSIEHSSQVDSDFK

SEQ ID NO: 2672487 - protein, 22 aa, Entamoeba histolytica
EDILRRKLESIKRCERISQSLD

SEQ ID NO: 2672488 - protein, 25 aa, Entamoeba histolytica
EDILRYESRLEKICYTDLYENDILA

SEQ ID NO: 2672489 - protein, 20 aa, Entamoeba histolytica
EDINGVLPLFADRGRVPKVV

SEQ ID NO: 2672490 - protein, 21 aa, Entamoeba histolytica
EDINWRVSVTLGSDKMANIEE

SEQ ID NO: 2672491 - protein, 19 aa, Entamoeba histolytica
EDIPILIHLLKQFNEENIE

SEQ ID NO: 2672492 - protein, 18 aa, Entamoeba histolytica
EDIQRIEILTGKTAGEVI

SEQ ID NO: 2672493 - protein, 24 aa, Entamoeba histolytica
EDIRLRLCPHIPLDDIKTFLYLNI

SEQ ID NO: 2672494 - protein, 33 aa, Entamoeba histolytica
EDITKYCSVKGWKLSSLEIKLIMTLRVDFSKQK

SEQ ID NO: 2672495 - protein, 18 aa, Entamoeba histolytica
EDIVKALTLSGGSISKEL

SEQ ID NO: 2672496 - protein, 27 aa, Entamoeba histolytica
EDKEHIIFAFNFFKGIGLVELAKPLQQ

SEQ ID NO: 2672497 - protein, 28 aa, Entamoeba histolytica
EDKKGVILCFKEFVGALLELKNKETPTQ

SEQ ID NO: 2672498 - protein, 26 aa, Entamoeba histolytica
EDKRKEQLLLHRQRLKEMIESAEDIQ

SEQ ID NO: 2672499 - protein, 19 aa, Entamoeba histolytica
EDKTWGEIITRLRHLKTTI

SEQ ID NO: 2672500 - protein, 29 aa, Entamoeba histolytica
EDKVFSWFSLTVIDHWVCMKPQQLPLEQM

SEQ ID NO: 2672501 - protein, 18 aa, Entamoeba histolytica
EDKYKFFLEATQLDMIKE

SEQ ID NO: 2672502 - protein, 23 aa, Entamoeba histolytica
EDKYLIHIGNYFEREKHQATERI

SEQ ID NO: 2672503 - protein, 26 aa, Entamoeba histolytica
EDLAIDAFCSMKCKYKNEQLILNLCQ

SEQ ID NO: 2672504 - protein, 26 aa, Entamoeba histolytica
EDLGNLKWIVVGKLFGLRTIVNKRPK

SEQ ID NO: 2672505 - protein, 21 aa, Entamoeba histolytica
EDLITIPFNMFLKPLSLSPTT

SEQ ID NO: 2672506 - protein, 27 aa, Entamoeba histolytica
EDLIYRPFLRLTYKEAIEMLRASGETI

SEQ ID NO: 2672507 - protein, 23 aa, Entamoeba histolytica
EDLKEIFKEFNVVSAKVVTYNHR

SEQ ID NO: 2672508 - protein, 21 aa, Entamoeba histolytica
EDLKTGVNLILLVEKLTNKHC

SEQ ID NO: 2672509 - protein, 17 aa, Entamoeba histolytica
EDLLFRVHVKLLLGDSV

SEQ ID NO: 2672510 - protein, 25 aa, Entamoeba histolytica
EDLNEKICYSRFVSYQWNDEITIFV

SEQ ID NO: 2672511 - protein, 33 aa, Entamoeba histolytica
EDLRFEQMVKCFLKFVDVFKLYSSFVNNYDNAR

SEQ ID NO: 2672512 - protein, 17 aa, Entamoeba histolytica
EDLRGTFLVTEPNNEGP

SEQ ID NO: 2672513 - protein, 26 aa, Entamoeba histolytica
EDLRIKIFLWKTIQCDKALGTVRGGK

SEQ ID NO: 2672514 - protein, 17 aa, Entamoeba histolytica
EDLSHTGIRLSLSRFNT

SEQ ID NO: 2672515 - protein, 25 aa, Entamoeba histolytica
EDLTYPLNCRRFMHMLFTYTEELFN

SEQ ID NO: 2672516 - protein, 30 aa, Entamoeba histolytica
EDLYNFIMEMCIDIPFVLRKPFGKNNWVIN

SEQ ID NO: 2672517 - protein, 21 aa, Entamoeba histolytica
EDMKELLPFAIKKLTNDEEPI

SEQ ID NO: 2672518 - protein, 23 aa, Entamoeba histolytica
EDMKIELNDVWNLDIILTTGAAK

SEQ ID NO: 2672519 - protein, 22 aa, Entamoeba histolytica
EDMLFRIKFDLYNPQREKIETL

SEQ ID NO: 2672520 - protein, 23 aa, Entamoeba histolytica
EDMLFRIKFDLYNPQREKIETLY

SEQ ID NO: 2672521 - protein, 23 aa, Entamoeba histolytica
EDMLMLCCYDINQHQSEYNQIVD

SEQ ID NO: 2672522 - protein, 19 aa, Entamoeba histolytica
EDMVLWGLFSLANAIHFLN

SEQ ID NO: 2672523 - protein, 19 aa, Entamoeba histolytica
EDNAEYGFGMFKANEQRRL

SEQ ID NO: 2672524 - protein, 19 aa, Entamoeba histolytica
EDNDIFLARQVLRNLTHNT

SEQ ID NO: 2672525 - protein, 25 aa, Entamoeba histolytica
EDNYPCWFEGPPFKFKKSMKDIHSR

SEQ ID NO: 2672526 - protein, 17 aa, Entamoeba histolytica
EDPELAMNYLLQNLQIG

SEQ ID NO: 2672527 - protein, 18 aa, Entamoeba histolytica
EDPLHRIIDELGDVEQYN

SEQ ID NO: 2672528 - protein, 20 aa, Entamoeba histolytica
EDPLKLDYWIKGKKKSTKKE

SEQ ID NO: 2672529 - protein, 21 aa, Entamoeba histolytica
EDPQGLLIFYNFINDLICLLT

SEQ ID NO: 2672530 - protein, 24 aa, Entamoeba histolytica
EDPSCKISVLLQVYIGRLTLPGFV

SEQ ID NO: 2672531 - protein, 22 aa, Entamoeba histolytica
EDPSLIKIKAMIDTNTKLVEQL

SEQ ID NO: 2672532 - protein, 22 aa, Entamoeba histolytica
EDRAKASKFIKVNQELRSQFGL

SEQ ID NO: 2672533 - protein, 21 aa, Entamoeba histolytica
EDRFTQYFLPKKIFNTDSDYE

SEQ ID NO: 2672534 - protein, 21 aa, Entamoeba histolytica
EDRIFRLAYHVYKTKELIEKY

SEQ ID NO: 2672535 - protein, 23 aa, Entamoeba histolytica
EDRIFRLAYHVYKTKELIEKYGS

SEQ ID NO: 2672536 - protein, 28 aa, Entamoeba histolytica
EDRIKRIEGIYKRKEKIIGKNEIIRNKL

SEQ ID NO: 2672537 - protein, 24 aa, Entamoeba histolytica
EDRIYRLAHHVYKTKELIEKYGSE

SEQ ID NO: 2672538 - protein, 24 aa, Entamoeba histolytica
EDRIYRLAYHVYKTKELIEKYGSE

SEQ ID NO: 2672539 - protein, 26 aa, Entamoeba histolytica
EDRQIDLWPNFQIFLNEQAKEKYGDA

SEQ ID NO: 2672540 - protein, 21 aa, Entamoeba histolytica
EDRYLPMNMLFSGKNHLPNLP

SEQ ID NO: 2672541 - protein, 17 aa, Entamoeba histolytica
EDSALKCVEVFHNSNQV

SEQ ID NO: 2672542 - protein, 19 aa, Entamoeba histolytica
EDSIFCNKKGSFLVEEFVG

SEQ ID NO: 2672543 - protein, 21 aa, Entamoeba histolytica
EDSLEMKECLNYVVERIVDAT

SEQ ID NO: 2672544 - protein, 29 aa, Entamoeba histolytica
EDSVGELFLKFSPFFIVYRNFLINHNKAF

SEQ ID NO: 2672545 - protein, 24 aa, Entamoeba histolytica
EDSYINFSPFWKKKDGTKIPEGTK

SEQ ID NO: 2672546 - protein, 20 aa, Entamoeba histolytica
EDTGSLWVGMSLYEIKEGRI

SEQ ID NO: 2672547 - protein, 18 aa, Entamoeba histolytica
EDTRAFFLELYDSLLKDE

SEQ ID NO: 2672548 - protein, 17 aa, Entamoeba histolytica
EDVCLMPKLEVLTLSNN

SEQ ID NO: 2672549 - protein, 17 aa, Entamoeba histolytica
EDVECFNEKVSVLSESL

SEQ ID NO: 2672550 - protein, 21 aa, Entamoeba histolytica
EDVEKIVGWAFAHEIEKRPDK

SEQ ID NO: 2672551 - protein, 20 aa, Entamoeba histolytica
EDVILKYGWCHSELEMLVNE

SEQ ID NO: 2672552 - protein, 22 aa, Entamoeba histolytica
EDVKARCDLVNWIYAITERYRL

SEQ ID NO: 2672553 - protein, 20 aa, Entamoeba histolytica
EDVKRVGMKEVIEAINKKFV

SEQ ID NO: 2672554 - protein, 27 aa, Entamoeba histolytica
EDVPLKEGLPLPVYDSLKYFKENPTLL

SEQ ID NO: 2672555 - protein, 18 aa, Entamoeba histolytica
EDVRELALLCPPEEIEGK

SEQ ID NO: 2672556 - protein, 22 aa, Entamoeba histolytica
EDVVEIWDAIFAYGENLKLVDG

SEQ ID NO: 2672557 - protein, 25 aa, Entamoeba histolytica
EDYECLRKILYMNANFFVICYSIDK

SEQ ID NO: 2672558 - protein, 23 aa, Entamoeba histolytica
EDYEGTTCCKFLVKLKGIESKER

SEQ ID NO: 2672559 - protein, 18 aa, Entamoeba histolytica
EDYFPNRRSHIIELIHEI

SEQ ID NO: 2672560 - protein, 25 aa, Entamoeba histolytica
EDYKIFATEFFKEGVHGFLPQAKQF

SEQ ID NO: 2672561 - protein, 27 aa, Entamoeba histolytica
EDYKIHFYYRFLIILTNHRMYIYNIRK

SEQ ID NO: 2672562 - protein, 26 aa, Entamoeba histolytica
EDYYNCCGFCLKTLYSKDPTNKYNKV

SEQ ID NO: 2672563 - protein, 21 aa, Entamoeba histolytica
EEAFKFLKNLCMNKRDKDIGE

SEQ ID NO: 2672564 - protein, 17 aa, Entamoeba histolytica
EEAKASLAISVAAEATL

SEQ ID NO: 2672565 - protein, 21 aa, Entamoeba histolytica
EEAKEIIGRFGCGNNIKWIGV

SEQ ID NO: 2672566 - protein, 17 aa, Entamoeba histolytica
EEAKIAWILQRKGLGDF

SEQ ID NO: 2672567 - protein, 19 aa, Entamoeba histolytica
EEAKRKAAEERKRLEEEKK

SEQ ID NO: 2672568 - protein, 20 aa, Entamoeba histolytica
EEAKVVVGDVCINNHLVQLG

SEQ ID NO: 2672569 - protein, 24 aa, Entamoeba histolytica
EEALIRKECFLFIFYSIQQHYIPL

SEQ ID NO: 2672570 - protein, 25 aa, Entamoeba histolytica
EEARAKETWKVRALEAENASTKANE

SEQ ID NO: 2672571 - protein, 23 aa, Entamoeba histolytica
EEARKEKEWGKWRNEKRERKTLL

SEQ ID NO: 2672572 - protein, 29 aa, Entamoeba histolytica
EEASKHVLETLIFLRFILPPLAQTPQLLK

SEQ ID NO: 2672573 - protein, 25 aa, Entamoeba histolytica
EEASNRLKKQFGFELKEIKSGNSGK

SEQ ID NO: 2672574 - protein, 21 aa, Entamoeba histolytica
EEAVKALSLDGLTIKGASVKV

SEQ ID NO: 2672575 - protein, 18 aa, Entamoeba histolytica
EEAVKYIISKGVDTESKN

SEQ ID NO: 2672576 - protein, 17 aa, Entamoeba histolytica
EEAWKVISSQADIINEF

SEQ ID NO: 2672577 - protein, 18 aa, Entamoeba histolytica
EEAYKEFMEHSSDYEDEE

SEQ ID NO: 2672578 - protein, 19 aa, Entamoeba histolytica
EECDLCGAKVSLKQMQYHK

SEQ ID NO: 2672579 - protein, 21 aa, Entamoeba histolytica
EECGTALILFKANDQSKETQA

SEQ ID NO: 2672580 - protein, 18 aa, Entamoeba histolytica
EECKECFSKIINNCITKQ

SEQ ID NO: 2672581 - protein, 17 aa, Entamoeba histolytica
EECKGIISGIGKIEHVP

SEQ ID NO: 2672582 - protein, 19 aa, Entamoeba histolytica
EECQCKIAFASSDDTPDLV

SEQ ID NO: 2672583 - protein, 17 aa, Entamoeba histolytica
EECVWFYQSNFRLLEKY

SEQ ID NO: 2672584 - protein, 22 aa, Entamoeba histolytica
EEDCFKFGKLLKESCHSLENDS

SEQ ID NO: 2672585 - protein, 17 aa, Entamoeba histolytica
EEDELKTEFNVEPKKSP

SEQ ID NO: 2672586 - protein, 23 aa, Entamoeba histolytica
EEDICVPHDKIVIVNPAACSYMV

SEQ ID NO: 2672587 - protein, 23 aa, Entamoeba histolytica
EEDIKKILPFLLDRRNIKKFFKS

SEQ ID NO: 2672588 - protein, 24 aa, Entamoeba histolytica
EEDIKLAFKFGCHAIDQLLNKGTF

SEQ ID NO: 2672589 - protein, 30 aa, Entamoeba histolytica
EEDRFGKFCLWFSYVCDFLMIYENYIYNLP

SEQ ID NO: 2672590 - protein, 24 aa, Entamoeba histolytica
EEDRKWDISGCVLRVYELLSQIYQ

SEQ ID NO: 2672591 - protein, 24 aa, Entamoeba histolytica
EEDSRKFIISKYVESVGKDITPLI

SEQ ID NO: 2672592 - protein, 22 aa, Entamoeba histolytica
EEECESCYDFLDIDYYNDDLIP

SEQ ID NO: 2672593 - protein, 29 aa, Entamoeba histolytica
EEECWKALIPRVDVLYEFYEFSNQLKDRF

SEQ ID NO: 2672594 - protein, 19 aa, Entamoeba histolytica
EEEDDWLSLILDITSYICK

SEQ ID NO: 2672595 - protein, 57 aa, Entamoeba histolytica
EEEDIYRIVKEMIKGTCLEKYLTPEIIKDCKHYEKEEVVKLLQTMGLEEIIQKNQYY

SEQ ID NO: 2672596 - protein, 22 aa, Entamoeba histolytica
EEEEFRKKRKCDTVLSEAVNST

SEQ ID NO: 2672597 - protein, 24 aa, Entamoeba histolytica
EEEFCIISTKLFHFFSKKEISYED

SEQ ID NO: 2672598 - protein, 18 aa, Entamoeba histolytica
EEEFTCLFELVDHVKDML

SEQ ID NO: 2672599 - protein, 23 aa, Entamoeba histolytica
EEEFTCVSLGKTIYLGGKEGVFE

SEQ ID NO: 2672600 - protein, 17 aa, Entamoeba histolytica
EEEICMQTIIKSKEQEK

SEQ ID NO: 2672601 - protein, 24 aa, Entamoeba histolytica
EEEKESKSGLFGMLKDKKKKEEKK

SEQ ID NO: 2672602 - protein, 24 aa, Entamoeba histolytica
EEEKKLKECIDMEKEIKELQESHL

SEQ ID NO: 2672603 - protein, 23 aa, Entamoeba histolytica
EEEMKASLLFCKQRIEKLGNEIE

SEQ ID NO: 2672604 - protein, 23 aa, Entamoeba histolytica
EEEPRFLKGKIKEIINSKINEVE

SEQ ID NO: 2672605 - protein, 17 aa, Entamoeba histolytica
EEERKKKEEAIKRKKEE

SEQ ID NO: 2672606 - protein, 23 aa, Entamoeba histolytica
EEERKRKEEEAKRKIEQERQRKI

SEQ ID NO: 2672607 - protein, 21 aa, Entamoeba histolytica
EEERLSFYSGLLLEKSSAVTL

SEQ ID NO: 2672608 - protein, 31 aa, Entamoeba histolytica
EEERTAAVLACEWVDEVVDGIVWWCTPYDFV

SEQ ID NO: 2672609 - protein, 23 aa, Entamoeba histolytica
EEESFEQWAIIFDECARKLFNMS

SEQ ID NO: 2672610 - protein, 23 aa, Entamoeba histolytica
EEESGLSYMNWIFEDGERTLLLL

SEQ ID NO: 2672611 - protein, 19 aa, Entamoeba histolytica
EEEVIALICQYLKEQKLQE

SEQ ID NO: 2672612 - protein, 23 aa, Entamoeba histolytica
EEFGIDIPQNFAIKALGDKCFES

SEQ ID NO: 2672613 - protein, 26 aa, Entamoeba histolytica
EEFIIRRLKEINVRDISNGVSSKTAS

SEQ ID NO: 2672614 - protein, 19 aa, Entamoeba histolytica
EEFKKCDELADTLESINEN

SEQ ID NO: 2672615 - protein, 24 aa, Entamoeba histolytica
EEFKKTLLKMMAYECEKRATWDDV

SEQ ID NO: 2672616 - protein, 17 aa, Entamoeba histolytica
EEFKYVRVIGAFYLRLI

SEQ ID NO: 2672617 - protein, 18 aa, Entamoeba histolytica
EEFLKFRKTSSFYLFRKC

SEQ ID NO: 2672618 - protein, 22 aa, Entamoeba histolytica
EEFNCMLTFTDFLLFGRTKLLG

SEQ ID NO: 2672619 - protein, 21 aa, Entamoeba histolytica
EEFNSFLLKFTNWEQWENYNF

SEQ ID NO: 2672620 - protein, 25 aa, Entamoeba histolytica
EEFPLKGEDGFLCLKAVNHFATMVP

SEQ ID NO: 2672621 - protein, 21 aa, Entamoeba histolytica
EEFQKQPVIEKFIKVVEKTGG

SEQ ID NO: 2672622 - protein, 21 aa, Entamoeba histolytica
EEFSSLISLMIDEFDVIKEWS

SEQ ID NO: 2672623 - protein, 19 aa, Entamoeba histolytica
EEFVKCYDELMGSSYPPTK

SEQ ID NO: 2672624 - protein, 18 aa, Entamoeba histolytica
EEGFTEIITIPFVVEEDY

SEQ ID NO: 2672625 - protein, 25 aa, Entamoeba histolytica
EEGHIIKGNVLIISDDVKHTNSSEF

SEQ ID NO: 2672626 - protein, 27 aa, Entamoeba histolytica
EEGKVNMCALNIKMGYDNLYEFVLGKQ

SEQ ID NO: 2672627 - protein, 22 aa, Entamoeba histolytica
EEGLAFKALNKIAGHKIEGKIE

SEQ ID NO: 2672628 - protein, 20 aa, Entamoeba histolytica
EEGRKAILEQGITKNLIEGF

SEQ ID NO: 2672629 - protein, 32 aa, Entamoeba histolytica
EEGVFKGKLLLVWKWTPSVILNIECKEESERY

SEQ ID NO: 2672630 - protein, 17 aa, Entamoeba histolytica
EEGYRIYTLEELGLDKN

SEQ ID NO: 2672631 - protein, 21 aa, Entamoeba histolytica
EEGYVWVVMEFMDSGCLTEVL

SEQ ID NO: 2672632 - protein, 26 aa, Entamoeba histolytica
EEHQKSIPGWGNWVGEGIEKKVKKSK

SEQ ID NO: 2672633 - protein, 20 aa, Entamoeba histolytica
EEHSDLSFSYGVMTDESFTD

SEQ ID NO: 2672634 - protein, 27 aa, Entamoeba histolytica
EEHTKFIKAITWLGCTSTRRLPVKLIS

SEQ ID NO: 2672635 - protein, 17 aa, Entamoeba histolytica
EEIEMKYFPSLGNNDKI

SEQ ID NO: 2672636 - protein, 20 aa, Entamoeba histolytica
EEIGCLGAAGLVPGELLTEK

SEQ ID NO: 2672637 - protein, 19 aa, Entamoeba histolytica
EEIIDCIYNTANIDIIAFI

SEQ ID NO: 2672638 - protein, 23 aa, Entamoeba histolytica
EEIKFEPLKCDHEMTGNEVIEHF

SEQ ID NO: 2672639 - protein, 24 aa, Entamoeba histolytica
EEIKKAYRKLALKLHPDKLIDVDP

SEQ ID NO: 2672640 - protein, 17 aa, Entamoeba histolytica
EEIKKGIEIQEKQVKEI

SEQ ID NO: 2672641 - protein, 22 aa, Entamoeba histolytica
EEIKKWVKMMKEIKNTKEEQKQ

SEQ ID NO: 2672642 - protein, 17 aa, Entamoeba histolytica
EEIKLSFEIVFDKEYYF

SEQ ID NO: 2672643 - protein, 20 aa, Entamoeba histolytica
EEIKMVKEVERLEQEKAKIK

SEQ ID NO: 2672644 - protein, 33 aa, Entamoeba histolytica; identical to SEQ ID NO: 2478469

SEQ ID NO: 2672645 - protein, 18 aa, Entamoeba histolytica
EEIMRKWYIKEHPNRKVD

SEQ ID NO: 2672646 - protein, 18 aa, Entamoeba histolytica
EEINEEFSFISTFQYSKG

SEQ ID NO: 2672647 - protein, 23 aa, Entamoeba histolytica
EEINRISLYLMVGLVSRLDLDAN

SEQ ID NO: 2672648 - protein, 17 aa, Entamoeba histolytica
EEIPSLCCLPKTEIEEL

SEQ ID NO: 2672649 - protein, 21 aa, Entamoeba histolytica
EEITEWCCVVCEKTFKSENQL

SEQ ID NO: 2672650 - protein, 18 aa, Entamoeba histolytica
EEITRLALTGLDVSDNYI

SEQ ID NO: 2672651 - protein, 20 aa, Entamoeba histolytica
EEIYESLGIISKYLPIERVK

SEQ ID NO: 2672652 - protein, 21 aa, Entamoeba histolytica
EEIYNLYPLFDILLGAPEINI

SEQ ID NO: 2672653 - protein, 24 aa, Entamoeba histolytica
EEKCSAEGKICCFKLPELAEEAKI

SEQ ID NO: 2672654 - protein, 23 aa, Entamoeba histolytica
EEKEAWKSIIYDQFRYIDEIIEN

SEQ ID NO: 2672655 - protein, 19 aa, Entamoeba histolytica
EEKECFVENLLDFIDESLY

SEQ ID NO: 2672656 - protein, 24 aa, Entamoeba histolytica
EEKEGKCYVEMNVAVGILEEKKNE

SEQ ID NO: 2672657 - protein, 18 aa, Entamoeba histolytica
EEKERKIAEEKRKKEEEE

SEQ ID NO: 2672658 - protein, 19 aa, Entamoeba histolytica
EEKEVRMLFILAPHSHLLF

SEQ ID NO: 2672659 - protein, 19 aa, Entamoeba histolytica
EEKGLSFKSFEEYYEKNSD

SEQ ID NO: 2672660 - protein, 19 aa, Entamoeba histolytica
EEKGRIFGGYDDDVKQLRR

SEQ ID NO: 2672661 - protein, 22 aa, Entamoeba histolytica
EEKHNCKGKMQHKPEPSEDNKY

SEQ ID NO: 2672662 - protein, 20 aa, Entamoeba histolytica
EEKIRIIGISLKDVVDELKE

SEQ ID NO: 2672663 - protein, 27 aa, Entamoeba histolytica
EEKKLDGIVLEGEWKKGFDAGNIISNP

SEQ ID NO: 2672664 - protein, 17 aa, Entamoeba histolytica
EEKKPKKKWDVVNEDFL

SEQ ID NO: 2672665 - protein, 34 aa, Entamoeba histolytica
EEKKWYEFFSFKGKRIGGKISIESTWNCNIKKMN

SEQ ID NO: 2672666 - protein, 33 aa, Entamoeba histolytica
EEKLIIDWFGRFGIEVGDFKTSFNDGLLICQVI

SEQ ID NO: 2672667 - protein, 20 aa, Entamoeba histolytica
EEKLNIWKALMQLEANHGDE

SEQ ID NO: 2672668 - protein, 18 aa, Entamoeba histolytica
EEKMKWMQLFTGIDGIVV

SEQ ID NO: 2672669 - protein, 20 aa, Entamoeba histolytica
EEKNRIITIIEKVPDLVTEN

SEQ ID NO: 2672670 - protein, 23 aa, Entamoeba histolytica
EEKRIKKPVIVKKERKLKEVKKF

SEQ ID NO: 2672671 - protein, 24 aa, Entamoeba histolytica
EEKRIKKPVIVKKERKLKEVKKID

SEQ ID NO: 2672672 - protein, 20 aa, Entamoeba histolytica
EEKSFLFSMMNNFVPIAKTI

SEQ ID NO: 2672673 - protein, 25 aa, Entamoeba histolytica
EEKYRYLVNYFNKYVNFIKVTRKVR

SEQ ID NO: 2672674 - protein, 22 aa, Entamoeba histolytica
EELCKGCNIIQNLEIYKGIIPF

SEQ ID NO: 2672675 - protein, 18 aa, Entamoeba histolytica
EELCSFKQNYKYLRAYLS

SEQ ID NO: 2672676 - protein, 28 aa, Entamoeba histolytica
EELELFLKSTCRVLGLNWDEMKQFFNTE

SEQ ID NO: 2672677 - protein, 24 aa, Entamoeba histolytica
EELERRFGEEMAHDKSIRKELIDS

SEQ ID NO: 2672678 - protein, 25 aa, Entamoeba histolytica
EELEVACKRLGIEVNKTKKEKVIEN

SEQ ID NO: 2672679 - protein, 17 aa, Entamoeba histolytica
EELFEFKSSYEVEKFHR

SEQ ID NO: 2672680 - protein, 20 aa, Entamoeba histolytica
EELGIKYVVEPAFGEFLSIN

SEQ ID NO: 2672681 - protein, 22 aa, Entamoeba histolytica
EELIRITALAKIAAREGEKERS

SEQ ID NO: 2672682 - protein, 23 aa, Entamoeba histolytica
EELKEKLHPLGLFKNIESLSITK

SEQ ID NO: 2672683 - protein, 23 aa, Entamoeba histolytica
EELKELYTSLVVDRLKKRPSFIL

SEQ ID NO: 2672684 - protein, 24 aa, Entamoeba histolytica
EELKHSRRGIGIFSKFSKSNDLLT

SEQ ID NO: 2672685 - protein, 21 aa, Entamoeba histolytica
EELKIKVIHLEKEIDISNERL

SEQ ID NO: 2672686 - protein, 17 aa, Entamoeba histolytica
EELKKFFGRDTLVVGIE

SEQ ID NO: 2672687 - protein, 26 aa, Entamoeba histolytica
EELKKRFCKRIEFGTAGLRGKMCAGF

SEQ ID NO: 2672688 - protein, 19 aa, Entamoeba histolytica
EELKKSIGRELTLKEQWYK

SEQ ID NO: 2672689 - protein, 30 aa, Entamoeba histolytica
EELKMKDSFTVGKIKAAQGIEEDKNWEGKI

SEQ ID NO: 2672690 - protein, 20 aa, Entamoeba histolytica
EELKNKLTETQRLLEEEKKE

SEQ ID NO: 2672691 - protein, 17 aa, Entamoeba histolytica
EELKPIIKKEEPKPIIK

SEQ ID NO: 2672692 - protein, 25 aa, Entamoeba histolytica
EELLPSICLHQVIIPLPAHRVTMPK

SEQ ID NO: 2672693 - protein, 18 aa, Entamoeba histolytica
EELLPSYHSVPILVEPIK

SEQ ID NO: 2672694 - protein, 17 aa, Entamoeba histolytica
EELLTLYGSVYSPPVEL

SEQ ID NO: 2672695 - protein, 26 aa, Entamoeba histolytica
EELNLYCCCSLLEIFSTTILQKDFAE

SEQ ID NO: 2672696 - protein, 23 aa, Entamoeba histolytica
EELPDTPLFYALDRAAHFFKITV

SEQ ID NO: 2672697 - protein, 27 aa, Entamoeba histolytica
EELQVICCSHGLIIRKDIKKIIEKYKE

SEQ ID NO: 2672698 - protein, 23 aa, Entamoeba histolytica
EELSFKVGDIITILEKDEGWWKG

SEQ ID NO: 2672699 - protein, 17 aa, Entamoeba histolytica
EELSIETKINWYNSVIN

SEQ ID NO: 2672700 - protein, 22 aa, Entamoeba histolytica
EELSNMIALKILRIGFNKLSGN

SEQ ID NO: 2672701 - protein, 17 aa, Entamoeba histolytica
EELSRQIPTLGNILTVH

SEQ ID NO: 2672702 - protein, 29 aa, Entamoeba histolytica
EELTQLLLCLYQRIQIIIPTILQCHETIK

SEQ ID NO: 2672703 - protein, 19 aa, Entamoeba histolytica
EELVKCIINSMSLECLFQQ

SEQ ID NO: 2672704 - protein, 19 aa, Entamoeba histolytica
EELYFLIDYIKCLKDKTEL

SEQ ID NO: 2672705 - protein, 22 aa, Entamoeba histolytica
EELYRCLCDSFITRQEEYYYLF

SEQ ID NO: 2672706 - protein, 24 aa, Entamoeba histolytica
EEMAQALFIYWKSKELMRSKDIQY

SEQ ID NO: 2672707 - protein, 25 aa, Entamoeba histolytica
EEMAQALYIYWKSRDIVKAGECDYD

SEQ ID NO: 2672708 - protein, 20 aa, Entamoeba histolytica
EEMGCNYCAECGVEIQKLFK

SEQ ID NO: 2672709 - protein, 25 aa, Entamoeba histolytica
EEMIEVKEIRMWIKKALERREKRVP

SEQ ID NO: 2672710 - protein, 24 aa, Entamoeba histolytica
EEMIHSKLNRKMIELIKKKEMEQL

SEQ ID NO: 2672711 - protein, 18 aa, Entamoeba histolytica
EEMIKFSIDLIGCTALHC

SEQ ID NO: 2672712 - protein, 18 aa, Entamoeba histolytica
EEMKIVIRRVQMIIESGA

SEQ ID NO: 2672713 - protein, 17 aa, Entamoeba histolytica
EEMKTEIFSIINEQQKT

SEQ ID NO: 2672714 - protein, 20 aa, Entamoeba histolytica
EEMLKVLGWSEGKGAGKFEQ

SEQ ID NO: 2672715 - protein, 24 aa, Entamoeba histolytica
EEMNRTFSRLSLQGTTEFNNEIDK

SEQ ID NO: 2672716 - protein, 23 aa, Entamoeba histolytica
EEMSSYYLLCFNPTQKFKVEVSP

SEQ ID NO: 2672717 - protein, 24 aa, Entamoeba histolytica
EENCTSLAQQLCSLLESQGKLSNF

SEQ ID NO: 2672718 - protein, 25 aa, Entamoeba histolytica
EENDGVGFLYGWYLYLVDIVNDFDI

SEQ ID NO: 2672719 - protein, 22 aa, Entamoeba histolytica
EENKFLWDYMGEYGMSNAKIFN

SEQ ID NO: 2672720 - protein, 31 aa, Entamoeba histolytica
EENNKYLLLNGICVALKMGNPDYEKTHLSVS

SEQ ID NO: 2672721 - protein, 25 aa, Entamoeba histolytica
EENRIPSWCDRVLWKTENRHNVEVK

SEQ ID NO: 2672722 - protein, 23 aa, Entamoeba histolytica
EENYKVLLMRDIIKGGKELAKDA

SEQ ID NO: 2672723 - protein, 18 aa, Entamoeba histolytica
EEPFKYDVYHFKTKDEVK

SEQ ID NO: 2672724 - protein, 22 aa, Entamoeba histolytica
EEPFPDVIVIGGFPEQCDSFNF

SEQ ID NO: 2672725 - protein, 21 aa, Entamoeba histolytica
EEPKLKGVICEVSLSNELEER

SEQ ID NO: 2672726 - protein, 21 aa, Entamoeba histolytica
EEQCKVLKSYVDKFNDKKWLC

SEQ ID NO: 2672727 - protein, 18 aa, Entamoeba histolytica
EEQEEIYESLGIISKYLP

SEQ ID NO: 2672728 - protein, 25 aa, Entamoeba histolytica
EEQEYKGEITFRILKEFIEEGKYPK

SEQ ID NO: 2672729 - protein, 21 aa, Entamoeba histolytica
EEQNYRFILFDDINYDKNLIR

SEQ ID NO: 2672730 - protein, 27 aa, Entamoeba histolytica
EEQQVLSLRCPISFQTIEIPVRGKRCS

SEQ ID NO: 2672731 - protein, 23 aa, Entamoeba histolytica
EEQTLSLLFSMLGHNFNANQLSH

SEQ ID NO: 2672732 - protein, 22 aa, Entamoeba histolytica
EERDVWESVLFDQIVGRRKTLE

SEQ ID NO: 2672733 - protein, 28 aa, Entamoeba histolytica
EERGCARSLKWLCQCIYYNELIIPDEEG

SEQ ID NO: 2672734 - protein, 17 aa, Entamoeba histolytica
EERIKLSNVQFRTQVII

SEQ ID NO: 2672735 - protein, 22 aa, Entamoeba histolytica
EERKCCEVLRYVFAEEDATVAL

SEQ ID NO: 2672736 - protein, 19 aa, Entamoeba histolytica
EERRELAIYFEEILQRSWA

SEQ ID NO: 2672737 - protein, 17 aa, Entamoeba histolytica
EERSEGVVILKRNETNQ

SEQ ID NO: 2672738 - protein, 23 aa, Entamoeba histolytica
EERVDSCIIHDRIIKQLNTLNWR

SEQ ID NO: 2672739 - protein, 19 aa, Entamoeba histolytica
EESEKWVECGIDDPEKEIQ

SEQ ID NO: 2672740 - protein, 27 aa, Entamoeba histolytica
EESFIIGCAIKVGIHLLLERKTKKSES

SEQ ID NO: 2672741 - protein, 23 aa, Entamoeba histolytica
EESIKALPIIILFDNITDINYNI

SEQ ID NO: 2672742 - protein, 29 aa, Entamoeba histolytica
EESPKLNVMVDITMCFPWLSMKSDTKCFE

SEQ ID NO: 2672743 - protein, 23 aa, Entamoeba histolytica
EESQFIKICIGTPVESFDDFVSY

SEQ ID NO: 2672744 - protein, 24 aa, Entamoeba histolytica
EESRLNFAKKGWKTIAALQLRNPM

SEQ ID NO: 2672745 - protein, 29 aa, Entamoeba histolytica
EESYQLLLILCNYFQQWLIQNDIPFIQDV

SEQ ID NO: 2672746 - protein, 18 aa, Entamoeba histolytica
EETCLKYASKIDEDQNSY

SEQ ID NO: 2672747 - protein, 22 aa, Entamoeba histolytica
EETKPSKSLMLNKSRCSEFKRK

SEQ ID NO: 2672748 - protein, 22 aa, Entamoeba histolytica
EETLKTALNFVLMKYKKNKDYA

SEQ ID NO: 2672749 - protein, 20 aa, Entamoeba histolytica
EETLPFLIQFIPLFFERCLL

SEQ ID NO: 2672750 - protein, 24 aa, Entamoeba histolytica
EETRFLEGLKDNWQNTQLKEYSLP

SEQ ID NO: 2672751 - protein, 17 aa, Entamoeba histolytica
EETRFSRGFSGEMKGET

SEQ ID NO: 2672752 - protein, 25 aa, Entamoeba histolytica
EETRGIPLRSIFCVKDLTKKNYIEG

SEQ ID NO: 2672753 - protein, 17 aa, Entamoeba histolytica
EETVKWLGHTPCAVTYS

SEQ ID NO: 2672754 - protein, 28 aa, Entamoeba histolytica
EEVFLVDAGKLWLWFGSKAINETKRFSL

SEQ ID NO: 2672755 - protein, 25 aa, Entamoeba histolytica
EEVGTRLGGMVGYTVRFEDVTSDRT

SEQ ID NO: 2672756 - protein, 24 aa, Entamoeba histolytica
EEVIPFRLPPELVQVSVQQEKPSK

SEQ ID NO: 2672757 - protein, 23 aa, Entamoeba histolytica
EEVKCLYDPIIKLYAIVEGECSN

SEQ ID NO: 2672758 - protein, 26 aa, Entamoeba histolytica
EEVKGILPWIINFNCHSSLKEYHEIN

SEQ ID NO: 2672759 - protein, 25 aa, Entamoeba histolytica
EEVKKELKTVVLIDVSMNRIQEIPS

SEQ ID NO: 2672760 - protein, 24 aa, Entamoeba histolytica
EEVLFDFIEHFTITSLIPIKERVE

SEQ ID NO: 2672761 - protein, 25 aa, Entamoeba histolytica
EEVLSTMCSMTWSNFSLKTKDWTMG

SEQ ID NO: 2672762 - protein, 17 aa, Entamoeba histolytica
EEVNGKLTKKVNGMERK

SEQ ID NO: 2672763 - protein, 24 aa, Entamoeba histolytica
EEVPLPILKAMYGIYFTPRSLEGV

SEQ ID NO: 2672764 - protein, 43 aa, Entamoeba histolytica; identical to SEQ ID NO: 2478604

SEQ ID NO: 2672765 - protein, 20 aa, Entamoeba histolytica
EEVYPLTSFLQSSKCNEDMV

SEQ ID NO: 2672766 - protein, 23 aa, Entamoeba histolytica
EEWEHIIFYCCFLMMIQNNRIMM

SEQ ID NO: 2672767 - protein, 19 aa, Entamoeba histolytica
EEWLYDCISEMKFINPKSY

SEQ ID NO: 2672768 - protein, 26 aa, Entamoeba histolytica
EEYCLVKWGGGLSYLEATWEKKSEIK

SEQ ID NO: 2672769 - protein, 18 aa, Entamoeba histolytica
EEYEMLKQLFPKYRLALE

SEQ ID NO: 2672770 - protein, 25 aa, Entamoeba histolytica
EEYFRFLWELRMVFNRDLTQLESLV

SEQ ID NO: 2672771 - protein, 21 aa, Entamoeba histolytica
EEYHPRINFVINTYYILPKSI

SEQ ID NO: 2672772 - protein, 21 aa, Entamoeba histolytica
EEYKGVINLTMTQCNKEERII

SEQ ID NO: 2672773 - protein, 20 aa, Entamoeba histolytica
EEYLKILTLYTFGKKKQEGK

SEQ ID NO: 2672774 - protein, 19 aa, Entamoeba histolytica
EEYLWLLTERKFMKVKMLQ

SEQ ID NO: 2672775 - protein, 24 aa, Entamoeba histolytica
EEYNEVICLLVQRIIEITQKRINL

SEQ ID NO: 2672776 - protein, 23 aa, Entamoeba histolytica
EEYVFDCFHFFGIDYYTNNSHLL

SEQ ID NO: 2672777 - protein, 19 aa, Entamoeba histolytica
EEYYECFDRAVMGFDAPVI

SEQ ID NO: 2672778 - protein, 25 aa, Entamoeba histolytica
EFAKFPPLGRFAVRDMKQTVAVGVV

SEQ ID NO: 2672779 - protein, 26 aa, Entamoeba histolytica
EFAPYRMYTCYAIPKRVHDIRAGAVE

SEQ ID NO: 2672780 - protein, 18 aa, Entamoeba histolytica
EFCCRNLYGTLNFNIKSQ

SEQ ID NO: 2672781 - protein, 18 aa, Entamoeba histolytica
EFDAEKRSTIGVEFATRS

SEQ ID NO: 2672782 - protein, 21 aa, Entamoeba histolytica
EFDCSIPLTTFDQIRSYDKIA

SEQ ID NO: 2672783 - protein, 19 aa, Entamoeba histolytica
EFDEVCFQYGIELDDVVEE

SEQ ID NO: 2672784 - protein, 19 aa, Entamoeba histolytica
EFDGFLRICFLRKHKTLSS

SEQ ID NO: 2672785 - protein, 25 aa, Entamoeba histolytica
EFDGQWECCVSIKVSLKNTKTGVVH

SEQ ID NO: 2672786 - protein, 24 aa, Entamoeba histolytica
EFDIPRVSLRPSLQPPLRQSLSVI

SEQ ID NO: 2672787 - protein, 18 aa, Entamoeba histolytica
EFDPDKRSTIGVEFATRS

SEQ ID NO: 2672788 - protein, 17 aa, Entamoeba histolytica
EFDPEKKSTIGVEFSSK

SEQ ID NO: 2672789 - protein, 22 aa, Entamoeba histolytica
EFDYLLRNSILFRKETFDSASD

SEQ ID NO: 2672790 - protein, 25 aa, Entamoeba histolytica
EFEAMKYTTHKAAFDEVQIYEIEED

SEQ ID NO: 2672791 - protein, 24 aa, Entamoeba histolytica
EFEEALELMKKCIKEIQKRVIVSS

SEQ ID NO: 2672792 - protein, 23 aa, Entamoeba histolytica
EFEEIPETIQLFSSLKKISFASN

SEQ ID NO: 2672793 - protein, 26 aa, Entamoeba histolytica
EFEENRCGIGLVKPEPKKLEFNGLQA

SEQ ID NO: 2672794 - protein, 19 aa, Entamoeba histolytica
EFEKEVAILDKFRDEYIIQ

SEQ ID NO: 2672795 - protein, 19 aa, Entamoeba histolytica
EFEKEVAMLDKFRDEYIIH

SEQ ID NO: 2672796 - protein, 19 aa, Entamoeba histolytica
EFEKEVAMLDKFRNEYIIH

SEQ ID NO: 2672797 - protein, 18 aa, Entamoeba histolytica
EFENGVFIGRFTQKDDDE

SEQ ID NO: 2672798 - protein, 25 aa, Entamoeba histolytica
EFENLPSTWVAFFKKAGIRKKDLSD

SEQ ID NO: 2672799 - protein, 18 aa, Entamoeba histolytica
EFETEALISLTIVIYEFM

SEQ ID NO: 2672800 - protein, 24 aa, Entamoeba histolytica
EFFDICRIKDALALAHKLDVMKKE

SEQ ID NO: 2672801 - protein, 18 aa, Entamoeba histolytica
EFFEKVISTFSVVPSPTV

SEQ ID NO: 2672802 - protein, 19 aa, Entamoeba histolytica
EFFIVDFPEMVKAYGENGV

SEQ ID NO: 2672803 - protein, 20 aa, Entamoeba histolytica
EFFNTIPLAALFKCSLGSFL

SEQ ID NO: 2672804 - protein, 18 aa, Entamoeba histolytica
EFFRLKLIQNKKKKAIAI

SEQ ID NO: 2672805 - protein, 17 aa, Entamoeba histolytica
EFGICYSGEINIADFPF

SEQ ID NO: 2672806 - protein, 24 aa, Entamoeba histolytica
EFGKAMNSICRFHGRFNSPTEIFL

SEQ ID NO: 2672807 - protein, 28 aa, Entamoeba histolytica
EFHEKGNEAFRIVVQVGRNNDKQRVMAL

SEQ ID NO: 2672808 - protein, 26 aa, Entamoeba histolytica
EFIAIYRYLEICYALFNAYNGSGPEI

SEQ ID NO: 2672809 - protein, 24 aa, Entamoeba histolytica
EFIIYNYLIYYILKLNTESPNTGI

SEQ ID NO: 2672810 - protein, 23 aa, Entamoeba histolytica
EFIKDKDILTGFVAFVQSLKLPK

SEQ ID NO: 2672811 - protein, 23 aa, Entamoeba histolytica
EFIKSLQPKKTYIGIDEIFGTSS

SEQ ID NO: 2672812 - protein, 24 aa, Entamoeba histolytica
EFINFLHLHYKGVILGYIKELFND

SEQ ID NO: 2672813 - protein, 20 aa, Entamoeba histolytica
EFIPELQCYFNGDELEKQRP

SEQ ID NO: 2672814 - protein, 20 aa, Entamoeba histolytica
EFIPMSLIDFYGEHCESVDE

SEQ ID NO: 2672815 - protein, 20 aa, Entamoeba histolytica
EFIRKKCLENKTLTFFIPLS

SEQ ID NO: 2672816 - protein, 24 aa, Entamoeba histolytica
EFIVKSGLIPYMIKPLQDLNSSLL

SEQ ID NO: 2672817 - protein, 17 aa, Entamoeba histolytica
EFIWPDFKGQESVDITL

SEQ ID NO: 2672818 - protein, 23 aa, Entamoeba histolytica
EFKENIESISLLFNKSIEINKKE

SEQ ID NO: 2672819 - protein, 22 aa, Entamoeba histolytica
EFKESCWRVAFNGDVLAVSLSN

SEQ ID NO: 2672820 - protein, 26 aa, Entamoeba histolytica
EFKGKEWKLCLLFNDILLIAKIDVTE

SEQ ID NO: 2672821 - protein, 19 aa, Entamoeba histolytica
EFKIVEFERTLKMSTYLIA

SEQ ID NO: 2672822 - protein, 20 aa, Entamoeba histolytica
EFKKEFKGNGCYLVKVVDGI

SEQ ID NO: 2672823 - protein, 23 aa, Entamoeba histolytica
EFKNEAWKKMVYITLSTSDYFQN

SEQ ID NO: 2672824 - protein, 19 aa, Entamoeba histolytica
EFKPVIKQKYIEASLGLVA

SEQ ID NO: 2672825 - protein, 22 aa, Entamoeba histolytica
EFLDLCGVGNFAVVRKVKEIQT

SEQ ID NO: 2672826 - protein, 20 aa, Entamoeba histolytica
EFLKKYILEKKWEEIEDGKE

SEQ ID NO: 2672827 - protein, 24 aa, Entamoeba histolytica
EFLNKILAIPIKFFRKLDAVRSPS

SEQ ID NO: 2672828 - protein, 23 aa, Entamoeba histolytica
EFLNLYNEFLFKLNYSDKFKQEI

SEQ ID NO: 2672829 - protein, 17 aa, Entamoeba histolytica
EFLSLLINYPFYNLFDW

SEQ ID NO: 2672830 - protein, 24 aa, Entamoeba histolytica
EFNKKRCLPFKAVVVNMKRSELLQ

SEQ ID NO: 2672831 - protein, 22 aa, Entamoeba histolytica
EFNPTLQFIGRRAFYNCKKITH

SEQ ID NO: 2672832 - protein, 20 aa, Entamoeba histolytica
EFNRLCCSHPQFIEYEKFNI

SEQ ID NO: 2672833 - protein, 24 aa, Entamoeba histolytica
EFNTLQFPAAVHFCVTEKTIGCEK

SEQ ID NO: 2672834 - protein, 22 aa, Entamoeba histolytica
EFPENLKSIFGIIKEVVEENFQ

SEQ ID NO: 2672835 - protein, 24 aa, Entamoeba histolytica
EFPIKTLDVSNHWRRPSWSDDGSM

SEQ ID NO: 2672836 - protein, 30 aa, Entamoeba histolytica
EFPKKGPRLCFLMSDMLLITVIKKVNDVPV

SEQ ID NO: 2672837 - protein, 23 aa, Entamoeba histolytica
EFPYKAVDVCTTYEKVISRDGRA

SEQ ID NO: 2672838 - protein, 20 aa, Entamoeba histolytica
EFRIKPKLGRSVMDRMVQQQ

SEQ ID NO: 2672839 - protein, 21 aa, Entamoeba histolytica
EFRKLLPRLSKKVDIKSYEEN

SEQ ID NO: 2672840 - protein, 18 aa, Entamoeba histolytica
EFSCGCLEMVPLKDLRKC

SEQ ID NO: 2672841 - protein, 25 aa, Entamoeba histolytica
EFSEACASYGRLVIIAALDGTFQRK

SEQ ID NO: 2672842 - protein, 19 aa, Entamoeba histolytica
EFSGTAIGRLCIGKDDQSH

SEQ ID NO: 2672843 - protein, 18 aa, Entamoeba histolytica
EFSKLIQMRLHRSNTRTV

SEQ ID NO: 2672844 - protein, 25 aa, Entamoeba histolytica
EFSLKRMGTKFVIHDPAVYKLPSSE

SEQ ID NO: 2672845 - protein, 26 aa, Entamoeba histolytica
EFSNYLKFRFPDGIGVKKSDEIIFTL

SEQ ID NO: 2672846 - protein, 18 aa, Entamoeba histolytica
EFSPGHQFVALKCGCVIS

SEQ ID NO: 2672847 - protein, 22 aa, Entamoeba histolytica
EFSRRELNDVWDYDDYYYDDCC

SEQ ID NO: 2672848 - protein, 20 aa, Entamoeba histolytica
EFSSVLPFSIPTYQFESSEG

SEQ ID NO: 2672849 - protein, 26 aa, Entamoeba histolytica
EFSYFIPEFMYMTGLSSKMKSDKKLL

SEQ ID NO: 2672850 - protein, 22 aa, Entamoeba histolytica
EFTNPCFFLPPHAFDTIKSLTK

SEQ ID NO: 2672851 - protein, 26 aa, Entamoeba histolytica
EFTQMFWKLGMKNFDDFISKLLKLPR

SEQ ID NO: 2672852 - protein, 25 aa, Entamoeba histolytica
EFTQMFWKLGMKNFDDFITKLLNLP

SEQ ID NO: 2672853 - protein, 25 aa, Entamoeba histolytica
EFTQMFWKLGMKNFDDFITKLVKLP

SEQ ID NO: 2672854 - protein, 25 aa, Entamoeba histolytica
EFTQMFWKLGMKNFDDFITKLVTLP

SEQ ID NO: 2672855 - protein, 22 aa, Entamoeba histolytica
EFTRATTLFCATIFREFKNPDG

SEQ ID NO: 2672856 - protein, 18 aa, Entamoeba histolytica
EFVPLLYKVIAFDDVQQT

SEQ ID NO: 2672857 - protein, 18 aa, Entamoeba histolytica
EFVSAIINYCVFEDSSEL

SEQ ID NO: 2672858 - protein, 25 aa, Entamoeba histolytica
EFYQFAVLLETEFPKLVTELSRDDA

SEQ ID NO: 2672859 - protein, 19 aa, Entamoeba histolytica
EFYQLVAHRIMRILKKDFI

SEQ ID NO: 2672860 - protein, 25 aa, Entamoeba histolytica
EFYYNLYLFPYLVFIGFTRCHLPIS

SEQ ID NO: 2672861 - protein, 24 aa, Entamoeba histolytica
EGAEFKMRVTFRVQHQPVLGLRIL

SEQ ID NO: 2672862 - protein, 25 aa, Entamoeba histolytica
EGARKHILYLAGMMKGEVVMIRVRL

SEQ ID NO: 2672863 - protein, 24 aa, Entamoeba histolytica
EGCPSSRIISDFMRIVHAIFPNDQ

SEQ ID NO: 2672864 - protein, 19 aa, Entamoeba histolytica
EGDCSLLLRHFKWNVNKMN

SEQ ID NO: 2672865 - protein, 26 aa, Entamoeba histolytica
EGDYSEFKRLTLLLTKLPRKRLRDVS

SEQ ID NO: 2672866 - protein, 22 aa, Entamoeba histolytica
EGEAFVPRKAPTEFREHELREP

SEQ ID NO: 2672867 - protein, 22 aa, Entamoeba histolytica
EGEAFVPRKAPTEFREHEQREP

SEQ ID NO: 2672868 - protein, 22 aa, Entamoeba histolytica
EGEERIQYGLSIAEDKMEIPAI

SEQ ID NO: 2672869 - protein, 32 aa, Entamoeba histolytica; identical to SEQ ID NO: 2478751

SEQ ID NO: 2672870 - protein, 31 aa, Entamoeba histolytica; identical to SEQ ID NO: 2478752

SEQ ID NO: 2672871 - protein, 18 aa, Entamoeba histolytica
EGEISWKKITNGIVSLEL

SEQ ID NO: 2672872 - protein, 30 aa, Entamoeba histolytica
EGEQECLCMALLMRHGVNFVLLKPRKIKQK

SEQ ID NO: 2672873 - protein, 20 aa, Entamoeba histolytica
EGFHYNEFWDILHGVEKGYL

SEQ ID NO: 2672874 - protein, 19 aa, Entamoeba histolytica
EGFIGCGLGQAGCQGSKSH

SEQ ID NO: 2672875 - protein, 30 aa, Entamoeba histolytica; identical to SEQ ID NO: 2478762

SEQ ID NO: 2672876 - protein, 20 aa, Entamoeba histolytica
EGFKFCFNKKVLTLFSAPNY

SEQ ID NO: 2672877 - protein, 24 aa, Entamoeba histolytica
EGFSGSDLFALGQMVAMRPIKEYL

SEQ ID NO: 2672878 - protein, 17 aa, Entamoeba histolytica
EGGFCGIPPEWENMFIA

SEQ ID NO: 2672879 - protein, 23 aa, Entamoeba histolytica
EGGQTALHWAVYMQRVDLLSILL

SEQ ID NO: 2672880 - protein, 24 aa, Entamoeba histolytica
EGGRIFKYVIWYKVSYSRYLEEKE

SEQ ID NO: 2672881 - protein, 26 aa, Entamoeba histolytica
EGGYACEFEVFIIIKCTTKIKDKIMI

SEQ ID NO: 2672882 - protein, 22 aa, Entamoeba histolytica
EGGYACEFEVFITIKCTTKIKD

SEQ ID NO: 2672883 - protein, 18 aa, Entamoeba histolytica
EGHKALIFCQTRQMLNII

SEQ ID NO: 2672884 - protein, 24 aa, Entamoeba histolytica
EGHKANVCGIGISREGQYIYTCSE

SEQ ID NO: 2672885 - protein, 31 aa, Entamoeba histolytica
EGHNTLKCPACLGVTGGLFSRFKRGEVKENK

SEQ ID NO: 2672886 - protein, 23 aa, Entamoeba histolytica
EGHRFKGKIRPYVSVPNSLVVEA

SEQ ID NO: 2672887 - protein, 23 aa, Entamoeba histolytica
EGIAICLKTFLKMREFPKYTVKS

SEQ ID NO: 2672888 - protein, 24 aa, Entamoeba histolytica
EGIDAIMVSIRLGRIGTESASTNY

SEQ ID NO: 2672889 - protein, 28 aa, Entamoeba histolytica
EGIDSYFKLKANFLAVALKTRTAEKSST

SEQ ID NO: 2672890 - protein, 30 aa, Entamoeba histolytica
EGIEISSIALCFKSKMLKNNDETLDKIGYA

SEQ ID NO: 2672891 - protein, 24 aa, Entamoeba histolytica
EGIIIPIFLIRWNKSPHYIFNEKV

SEQ ID NO: 2672892 - protein, 17 aa, Entamoeba histolytica
EGIKMKYRYGKPSYKKK

SEQ ID NO: 2672893 - protein, 33 aa, Entamoeba histolytica
EGINLYRYGCFIYNCFMMPCIDPMEYPKYFIEV

SEQ ID NO: 2672894 - protein, 25 aa, Entamoeba histolytica
EGINYIENWCGLKNHLILFDSSLPN

SEQ ID NO: 2672895 - protein, 17 aa, Entamoeba histolytica
EGIPSTALREIAILRDI

SEQ ID NO: 2672896 - protein, 25 aa, Entamoeba histolytica
EGIQGPYERYGMPIGTTGKRGDLYL

SEQ ID NO: 2672897 - protein, 19 aa, Entamoeba histolytica
EGISLYGCLNKCMTKGGSK

SEQ ID NO: 2672898 - protein, 21 aa, Entamoeba histolytica
EGITKLGKYSFYRCTSLTSIQ

SEQ ID NO: 2672899 - protein, 19 aa, Entamoeba histolytica
EGITPEQQRLVFGGRQLGD

SEQ ID NO: 2672900 - protein, 23 aa, Entamoeba histolytica
EGIWRSMRRVVIYLEERWSIDMT

SEQ ID NO: 2672901 - protein, 17 aa, Entamoeba histolytica
EGIYNFISQLLVIELTN

SEQ ID NO: 2672902 - protein, 24 aa, Entamoeba histolytica
EGKDCSFMFMDVLKIIQTNDVSLK

SEQ ID NO: 2672903 - protein, 18 aa, Entamoeba histolytica
EGKGIRMLEDFTSIENYK

SEQ ID NO: 2672904 - protein, 23 aa, Entamoeba histolytica
EGKIEFTEFLYGTFRREIPLPTD

SEQ ID NO: 2672905 - protein, 21 aa, Entamoeba histolytica
EGKIFKYVIWYKVSYSRYLKE

SEQ ID NO: 2672906 - protein, 26 aa, Entamoeba histolytica
EGKIKARWLRKNARRLDIEHYTRTDL

SEQ ID NO: 2672907 - protein, 23 aa, Entamoeba histolytica
EGKIKNIFVVGGCDGAKAGRNYY

SEQ ID NO: 2672908 - protein, 25 aa, Entamoeba histolytica
EGKIKSRWLRKNARRIDMETYTRTD

SEQ ID NO: 2672909 - protein, 27 aa, Entamoeba histolytica
EGKISSYDRRKCVLKMAYIEVLGYEVD

SEQ ID NO: 2672910 - protein, 18 aa, Entamoeba histolytica
EGKKGMASAESMLKKLEE

SEQ ID NO: 2672911 - protein, 18 aa, Entamoeba histolytica
EGKKGYGGNGFKFDIKEE

SEQ ID NO: 2672912 - protein, 31 aa, Entamoeba histolytica
EGKNIKLPIGFVSACSITRLHIQDLKVFVNM

SEQ ID NO: 2672913 - protein, 22 aa, Entamoeba histolytica
EGKSSFRWTPPQQFFQSDYNKL

SEQ ID NO: 2672914 - protein, 24 aa, Entamoeba histolytica
EGKTHEECIKKICINNNENYIDLI

SEQ ID NO: 2672915 - protein, 19 aa, Entamoeba histolytica
EGKTSTLSIMFKKKELGED

SEQ ID NO: 2672916 - protein, 25 aa, Entamoeba histolytica
EGKVMWIMNSMRLFSFDPVLGRRLD

SEQ ID NO: 2672917 - protein, 24 aa, Entamoeba histolytica
EGKVREAINFGSYNYLGFGGRHPI

SEQ ID NO: 2672918 - protein, 22 aa, Entamoeba histolytica
EGKYISMCDFFQGDVSYDEINE

SEQ ID NO: 2672919 - protein, 19 aa, Entamoeba histolytica
EGLDLWTFSRNEIVQHYDT

SEQ ID NO: 2672920 - protein, 19 aa, Entamoeba histolytica
EGLEKEYLIKCSFPTLSLI

SEQ ID NO: 2672921 - protein, 19 aa, Entamoeba histolytica
EGLELLKCFFSMENEKAPE

SEQ ID NO: 2672922 - protein, 25 aa, Entamoeba histolytica
EGLEWLVKKGLAWKEDLVYCEENGR

SEQ ID NO: 2672923 - protein, 21 aa, Entamoeba histolytica
EGLKGRLGDLGSIEKKYDIAI

SEQ ID NO: 2672924 - protein, 22 aa, Entamoeba histolytica
EGLKKSNTHIVVFGNTDHRDAV

SEQ ID NO: 2672925 - protein, 21 aa, Entamoeba histolytica
EGLKKYMAILGNMGKIKSTLM

SEQ ID NO: 2672926 - protein, 17 aa, Entamoeba histolytica
EGLLKKTVDTMVILLNS

SEQ ID NO: 2672927 - protein, 30 aa, Entamoeba histolytica; identical to SEQ ID NO: 2472741

SEQ ID NO: 2672928 - protein, 23 aa, Entamoeba histolytica
EGLPKLFYIWTEIRPNMKELKER

SEQ ID NO: 2672929 - protein, 26 aa, Entamoeba histolytica
EGLPQMIFECIKKCPLTSRRPLLNHI

SEQ ID NO: 2672930 - protein, 25 aa, Entamoeba histolytica
EGLYKKDCMDHIGFFAKCLGCSEND

SEQ ID NO: 2672931 - protein, 19 aa, Entamoeba histolytica
EGMLTQFGSILGLGIVNAG

SEQ ID NO: 2672932 - protein, 25 aa, Entamoeba histolytica
EGMQGPYKGYGMPIGTTGKRGDLYL

SEQ ID NO: 2672933 - protein, 18 aa, Entamoeba histolytica
EGMSCNRAAGAMYLFPRI

SEQ ID NO: 2672934 - protein, 18 aa, Entamoeba histolytica
EGNCIRAKGIQILLEVIK

SEQ ID NO: 2672935 - protein, 42 aa, Entamoeba histolytica
EGNCVCADCGATTPKWSSVNLGIFICIRCAGIHRSMGTHISK

SEQ ID NO: 2672936 - protein, 19 aa, Entamoeba histolytica
EGNDIILLCSFKDTLNNKN

SEQ ID NO: 2672937 - protein, 18 aa, Entamoeba histolytica
EGNDLYKVISTKIEEVEK

SEQ ID NO: 2672938 - protein, 23 aa, Entamoeba histolytica
EGNEKIPLLTFIMHYAQSKLYGD

SEQ ID NO: 2672939 - protein, 25 aa, Entamoeba histolytica
EGNIRYCGLKLLGLMMTKHPKAVIE

SEQ ID NO: 2672940 - protein, 23 aa, Entamoeba histolytica
EGNSKLRIVENIKQNIPQTEDTV

SEQ ID NO: 2672941 - protein, 23 aa, Entamoeba histolytica
EGPFGVVYVGEFRRNKVAIKKMK

SEQ ID NO: 2672942 - protein, 24 aa, Entamoeba histolytica
EGPGKCLYCGERLEIIRKNEGYDE

SEQ ID NO: 2672943 - protein, 20 aa, Entamoeba histolytica
EGQDLMVAWHLSKKKDPNNP

SEQ ID NO: 2672944 - protein, 30 aa, Entamoeba histolytica; identical to SEQ ID NO: 2478841

SEQ ID NO: 2672945 - protein, 31 aa, Entamoeba histolytica; identical to SEQ ID NO: 2478842

SEQ ID NO: 2672946 - protein, 23 aa, Entamoeba histolytica
EGRGKYKLERLVVSYLYDETIGD

SEQ ID NO: 2672947 - protein, 17 aa, Entamoeba histolytica
EGRKCGILINKADLMTD

SEQ ID NO: 2672948 - protein, 20 aa, Entamoeba histolytica
EGRLSIDCALELVRKAKKLL

SEQ ID NO: 2672949 - protein, 26 aa, Entamoeba histolytica
EGRRFKGRLHPYVSIPNKCVVDALIE

SEQ ID NO: 2672950 - protein, 19 aa, Entamoeba histolytica
EGRVPRPLPRSVGVSNQRT

SEQ ID NO: 2672951 - protein, 25 aa, Entamoeba histolytica
EGSEFKVSFFNAMVDKFYSSIIEEQ

SEQ ID NO: 2672952 - protein, 20 aa, Entamoeba histolytica
EGSGILYVIMSFDLKTHTIH

SEQ ID NO: 2672953 - protein, 21 aa, Entamoeba histolytica
EGSGILYVVMSFDLKTHAIHF

SEQ ID NO: 2672954 - protein, 21 aa, Entamoeba histolytica
EGSGILYVVMSFDLKTHTIHF

SEQ ID NO: 2672955 - protein, 20 aa, Entamoeba histolytica
EGSGILYVVMSFDLKTRAIR

SEQ ID NO: 2672956 - protein, 28 aa, Entamoeba histolytica
EGSGRKGLPQSFLNRFTEVYVNKMTTND

SEQ ID NO: 2672957 - protein, 21 aa, Entamoeba histolytica
EGSILPFIEKFVINKRIGEKY

SEQ ID NO: 2672958 - protein, 29 aa, Entamoeba histolytica
EGSVGKSALCLLFVKGEFNIEYNPTIEDS

SEQ ID NO: 2672959 - protein, 24 aa, Entamoeba histolytica
EGSVGKSALCLQFVREVFSVEYSP

SEQ ID NO: 2672960 - protein, 18 aa, Entamoeba histolytica
EGTGSFGYDVRKNVYCDL

SEQ ID NO: 2672961 - protein, 29 aa, Entamoeba histolytica
EGTKLSFFSWNAWNGWIPNWCVNKATKTM

SEQ ID NO: 2672962 - protein, 30 aa, Entamoeba histolytica; identical to SEQ ID NO: 2478852

SEQ ID NO: 2672963 - protein, 23 aa, Entamoeba histolytica
EGTMKMDVGGVIINFSNQREKHS

SEQ ID NO: 2672964 - protein, 18 aa, Entamoeba histolytica
EGTNCFQGLLSLKHISNY

SEQ ID NO: 2672965 - protein, 17 aa, Entamoeba histolytica
EGTSQFSAILLKNLLNL

SEQ ID NO: 2672966 - protein, 20 aa, Entamoeba histolytica
EGTTSMCGVLVDIDYKPAGV

SEQ ID NO: 2672967 - protein, 20 aa, Entamoeba histolytica
EGVKKWKANIDDRVLFNNEK

SEQ ID NO: 2672968 - protein, 17 aa, Entamoeba histolytica
EGVKMELADCCFPLVKG

SEQ ID NO: 2672969 - protein, 24 aa, Entamoeba histolytica
EGVLEYPNELLIALKALFNSITVK

SEQ ID NO: 2672970 - protein, 19 aa, Entamoeba histolytica
EGVNNHWSFNFQEDHSSLK

SEQ ID NO: 2672971 - protein, 30 aa, Entamoeba histolytica; identical to SEQ ID NO: 2478865

SEQ ID NO: 2672972 - protein, 27 aa, Entamoeba histolytica
EGVSSFKVFMVYDFFVTDGLFYKILKK

SEQ ID NO: 2672973 - protein, 26 aa, Entamoeba histolytica
EGWLKKKGYDFHTWKKRYFIIKNEFI

SEQ ID NO: 2672974 - protein, 22 aa, Entamoeba histolytica
EGYEPFLQKYFRTETEQSNNNN

SEQ ID NO: 2672975 - protein, 19 aa, Entamoeba histolytica
EGYHGLNCDIIVWNDVLQQ

SEQ ID NO: 2672976 - protein, 22 aa, Entamoeba histolytica
EGYLVVLECNGIVKVYNNQFEL

SEQ ID NO: 2672977 - protein, 18 aa, Entamoeba histolytica
EGYPIFAETCIQYLELTN

SEQ ID NO: 2672978 - protein, 24 aa, Entamoeba histolytica
EGYVDFCIKYDKYFVPFLQEALID

SEQ ID NO: 2672979 - protein, 25 aa, Entamoeba histolytica
EHAIKGGFAVPGFNFNNLEQMQAII

SEQ ID NO: 2672980 - protein, 25 aa, Entamoeba histolytica
EHAIPAEMGHVWVIPKDCQIGQEVT

SEQ ID NO: 2672981 - protein, 20 aa, Entamoeba histolytica
EHAPSIIFMDEIDSIGSSRI

SEQ ID NO: 2672982 - protein, 19 aa, Entamoeba histolytica
EHDGPVWDVQYCPLEYYML

SEQ ID NO: 2672983 - protein, 17 aa, Entamoeba histolytica
EHFKCGIKNVIVQMEDD

SEQ ID NO: 2672984 - protein, 23 aa, Entamoeba histolytica
EHFSMKYKYGWYSSHIKNLCKEI

SEQ ID NO: 2672985 - protein, 21 aa, Entamoeba histolytica
EHGCGPALQYATVLAERKKEK

SEQ ID NO: 2672986 - protein, 18 aa, Entamoeba histolytica
EHGDLYIYFEIKFPNNAE

SEQ ID NO: 2672987 - protein, 18 aa, Entamoeba histolytica
EHISCALSSRIVLNELPI

SEQ ID NO: 2672988 - protein, 23 aa, Entamoeba histolytica
EHIVRICVCLMKDYDINEIELIS

SEQ ID NO: 2672989 - protein, 19 aa, Entamoeba histolytica
EHKFKLMGYKCGFCGEMID

SEQ ID NO: 2672990 - protein, 23 aa, Entamoeba histolytica
EHKIELKEALDFIKQKIGLEQGT

SEQ ID NO: 2672991 - protein, 26 aa, Entamoeba histolytica
EHLAGKWPFWLSPRQVMVCTVSEKYN

SEQ ID NO: 2672992 - protein, 21 aa, Entamoeba histolytica
EHLCLSSAKMIVMEKLVEKHL

SEQ ID NO: 2672993 - protein, 24 aa, Entamoeba histolytica
EHLHLFKGDIPFVVVQQTKDAIDA

SEQ ID NO: 2672994 - protein, 21 aa, Entamoeba histolytica
EHLRSRFNITSRMARKNIEYL

SEQ ID NO: 2672995 - protein, 26 aa, Entamoeba histolytica
EHLVFRQTRCAACGQEFKDTEADYPI

SEQ ID NO: 2672996 - protein, 17 aa, Entamoeba histolytica
EHNGVCYTFYFKDCQII

SEQ ID NO: 2672997 - protein, 30 aa, Entamoeba histolytica
EHNTCGKLFCKKCLYQWWDIQRMMTCPFCR

SEQ ID NO: 2672998 - protein, 23 aa, Entamoeba histolytica
EHPFYKYFMRGMLVTLATDSPMH

SEQ ID NO: 2672999 - protein, 26 aa, Entamoeba histolytica
EHPLFKYLTDPGWRQVLEPVFKKYVN

SEQ ID NO: 2673000 - protein, 21 aa, Entamoeba histolytica
EHPTHFVKPCTTKGMKNDTEI

SEQ ID NO: 2673001 - protein, 19 aa, Entamoeba histolytica
EHQGIKIDFIGSIEYSYDR

SEQ ID NO: 2673002 - protein, 19 aa, Entamoeba histolytica
EHQPIISLNLDQLVRPNYE

SEQ ID NO: 2673003 - protein, 22 aa, Entamoeba histolytica
EHRKEIIDRFEIIQQIAETKAG

SEQ ID NO: 2673004 - protein, 26 aa, Entamoeba histolytica
EHSLLKRIICLPDVFFERRKLWEQLI

SEQ ID NO: 2673005 - protein, 25 aa, Entamoeba histolytica
EHSPEMYSWFPLFFPLISPIEVKRG

SEQ ID NO: 2673006 - protein, 23 aa, Entamoeba histolytica
EHTRFMVCLCFLNATACKGLPVL

SEQ ID NO: 2673007 - protein, 29 aa, Entamoeba histolytica
EHTTAYIVPRSRFLPVKACNDLFIIQSTL

SEQ ID NO: 2673008 - protein, 18 aa, Entamoeba histolytica
EHVCEFCGKAFLRKSECE

SEQ ID NO: 2673009 - protein, 25 aa, Entamoeba histolytica
EHVMNKPNICFFNFDENENVFGVFT

SEQ ID NO: 2673010 - protein, 23 aa, Entamoeba histolytica
EHWRREINEWTDMNVVVYLGTKE

SEQ ID NO: 2673011 - protein, 26 aa, Entamoeba histolytica
EHYAVRKINCGEFINFLHLHYKGVIL

SEQ ID NO: 2673012 - protein, 24 aa, Entamoeba histolytica
EHYINCFKPILFDEIRATIQKSLI

SEQ ID NO: 2673013 - protein, 19 aa, Entamoeba histolytica
EHYQEFLDEIYIGTVSLSN

SEQ ID NO: 2673014 - protein, 18 aa, Entamoeba histolytica
EIAAPFLIHRVNSNVQVY

SEQ ID NO: 2673015 - protein, 26 aa, Entamoeba histolytica
EIADYVWIKFCRNLIRLEEIHVKDQL

SEQ ID NO: 2673016 - protein, 24 aa, Entamoeba histolytica
EIAISFIYCCLNRIKGTKNEYYEL

SEQ ID NO: 2673017 - protein, 25 aa, Entamoeba histolytica
EIALVDMKICKKIVKETLTFSYQYF

SEQ ID NO: 2673018 - protein, 17 aa, Entamoeba histolytica
EIAQGWEVYDIDNIETI

SEQ ID NO: 2673019 - protein, 18 aa, Entamoeba histolytica
EIARCLLVSLASWKLTSK

SEQ ID NO: 2673020 - protein, 26 aa, Entamoeba histolytica
EIASGLWYLHFCKHIIHRDLKLENFL

SEQ ID NO: 2673021 - protein, 21 aa, Entamoeba histolytica
EIAVIVPSCCGIINYPKSCDG

SEQ ID NO: 2673022 - protein, 19 aa, Entamoeba histolytica
EICEIRLPLFGRLPTEKKE

SEQ ID NO: 2673023 - protein, 23 aa, Entamoeba histolytica
EICITFGKDCFILVLKMILKNAH

SEQ ID NO: 2673024 - protein, 29 aa, Entamoeba histolytica
EICKRRKCIRASIVFSEYQKICKLQLVNE

SEQ ID NO: 2673025 - protein, 27 aa, Entamoeba histolytica
EICKTLLNDVPVCFVLNKADLSSQMNR

SEQ ID NO: 2673026 - protein, 19 aa, Entamoeba histolytica
EIDCISRTIASYSEENPRK

SEQ ID NO: 2673027 - protein, 24 aa, Entamoeba histolytica
EIDEGLRMVFNLFVMGGESQVVDR

SEQ ID NO: 2673028 - protein, 21 aa, Entamoeba histolytica
EIDELKILPGQILGSNLAALQ

SEQ ID NO: 2673029 - protein, 25 aa, Entamoeba histolytica
EIDELRKKLLYLFYKIIKPTATENY

SEQ ID NO: 2673030 - protein, 20 aa, Entamoeba histolytica
EIDIPITQICEFVGKRIMSK

SEQ ID NO: 2673031 - protein, 32 aa, Entamoeba histolytica
EIDKAVEFCIKTKRFADALVMTENNKEMHSKV

SEQ ID NO: 2673032 - protein, 18 aa, Entamoeba histolytica
EIDKEKELKRRKILEKFN

SEQ ID NO: 2673033 - protein, 23 aa, Entamoeba histolytica
EIDRLECKLHVYLPKENKGEVFP

SEQ ID NO: 2673034 - protein, 28 aa, Entamoeba histolytica
EIDTLKVLRSPYIIRYYTSVLRQEEFWI

SEQ ID NO: 2673035 - protein, 20 aa, Entamoeba histolytica
EIDVKLGFNVSEFIEKMKPM

SEQ ID NO: 2673036 - protein, 17 aa, Entamoeba histolytica
EIDYKYHKTLSITSYYS

SEQ ID NO: 2673037 - protein, 18 aa, Entamoeba histolytica
EIEDWLFISGEMTAADPE

SEQ ID NO: 2673038 - protein, 31 aa, Entamoeba histolytica
EIEERLKGLQSRLKILTAENEKLRKAGAGAR

SEQ ID NO: 2673039 - protein, 20 aa, Entamoeba histolytica
EIEFSLDIIHSFYEAQQVNS

SEQ ID NO: 2673040 - protein, 19 aa, Entamoeba histolytica
EIEGELKILTNNILRHKED

SEQ ID NO: 2673041 - protein, 23 aa, Entamoeba histolytica
EIEGNPVCSLCYVANHVPKCETC

SEQ ID NO: 2673042 - protein, 25 aa, Entamoeba histolytica
EIEIKEINYFLSLKTHEEYETSNEK

SEQ ID NO: 2673043 - protein, 21 aa, Entamoeba histolytica
EIEILRAYELYNQHLLLSLQQ

SEQ ID NO: 2673044 - protein, 24 aa, Entamoeba histolytica
EIEKLENVCRVFSASIISSEEEKR

SEQ ID NO: 2673045 - protein, 19 aa, Entamoeba histolytica
EIEKRRRVVELGKEKEEEI

SEQ ID NO: 2673046 - protein, 17 aa, Entamoeba histolytica
EIELLKGDLELYRGKQK

SEQ ID NO: 2673047 - protein, 18 aa, Entamoeba histolytica
EIEQCPQLSSLAIPSNLL

SEQ ID NO: 2673048 - protein, 20 aa, Entamoeba histolytica
EIFCGDPIKVKQMLNTFYSF

SEQ ID NO: 2673049 - protein, 23 aa, Entamoeba histolytica
EIFEIAFQVGFTMIKKEMIHSLN

SEQ ID NO: 2673050 - protein, 23 aa, Entamoeba histolytica
EIFIQTLLNAFAFVPSEKGNDKY

SEQ ID NO: 2673051 - protein, 31 aa, Entamoeba histolytica
EIFLRCTSPLSELRTVIEFFNQVGSPEEQIE

SEQ ID NO: 2673052 - protein, 21 aa, Entamoeba histolytica
EIFMFKPGHFEIAPEARYGKK

SEQ ID NO: 2673053 - protein, 34 aa, Entamoeba histolytica; identical to SEQ ID NO: 2478959

SEQ ID NO: 2673054 - protein, 18 aa, Entamoeba histolytica
EIFRCGKKLDEILANKED

SEQ ID NO: 2673055 - protein, 23 aa, Entamoeba histolytica
EIGDGCFVCCPSLTSINIPTSVI

SEQ ID NO: 2673056 - protein, 17 aa, Entamoeba histolytica
EIGDLCFGECFQLTSLE

SEQ ID NO: 2673057 - protein, 20 aa, Entamoeba histolytica
EIGDSCFYKCTSLTSIEILT

SEQ ID NO: 2673058 - protein, 21 aa, Entamoeba histolytica
EIGDYILSPNICIERKSAIDL

SEQ ID NO: 2673059 - protein, 25 aa, Entamoeba histolytica
EIGECLRYGTLNSLYLLPKYSEKLR

SEQ ID NO: 2673060 - protein, 18 aa, Entamoeba histolytica
EIGEKWLVERGLCERCLE

SEQ ID NO: 2673061 - protein, 22 aa, Entamoeba histolytica
EIGKGCFNRCYSLRTIEIPTSV

SEQ ID NO: 2673062 - protein, 23 aa, Entamoeba histolytica
EIGNLRSLYELDLSNNQMDLLPE

SEQ ID NO: 2673063 - protein, 19 aa, Entamoeba histolytica
EIGNRCFYECLSLKSIEIP

SEQ ID NO: 2673064 - protein, 21 aa, Entamoeba histolytica
EIGNYLGSGGFSIVREAISKE

SEQ ID NO: 2673065 - protein, 20 aa, Entamoeba histolytica
EIGPQLKRVLELHVPVNNYA

SEQ ID NO: 2673066 - protein, 22 aa, Entamoeba histolytica
EIGQYCFYKCKALTTINIPISV

SEQ ID NO: 2673067 - protein, 26 aa, Entamoeba histolytica
EIGRYSIIIDESWRKYAVDSLHKLIE

SEQ ID NO: 2673068 - protein, 25 aa, Entamoeba histolytica
EIGSELKLASAQVMALFNKAIRKVV

SEQ ID NO: 2673069 - protein, 23 aa, Entamoeba histolytica
EIGYECFRECSLLKSINIPTSVS

SEQ ID NO: 2673070 - protein, 17 aa, Entamoeba histolytica
EIGYEITNQLGIQYQRY

SEQ ID NO: 2673071 - protein, 18 aa, Entamoeba histolytica
EIHEMAAIFSVFVFEPSN

SEQ ID NO: 2673072 - protein, 18 aa, Entamoeba histolytica
EIHIKWLTLSIHKPLPSG

SEQ ID NO: 2673073 - protein, 23 aa, Entamoeba histolytica
EIIDMNKKIACFINENANLKDEI

SEQ ID NO: 2673074 - protein, 24 aa, Entamoeba histolytica
EIIDQLYLFPPIFIIQLSFTIDGN

SEQ ID NO: 2673075 - protein, 20 aa, Entamoeba histolytica
EIIEIDILYLLISQINRLNH

SEQ ID NO: 2673076 - protein, 38 aa, Entamoeba histolytica
EIIEYFYRLCSALLRSSCSELNIFNCLIKTIHTWRNLY

SEQ ID NO: 2673077 - protein, 18 aa, Entamoeba histolytica
EIIFKLVMNSSYGKTIQK

SEQ ID NO: 2673078 - protein, 21 aa, Entamoeba histolytica
EIIGNYCFEGCCSLSAVTIPT

SEQ ID NO: 2673079 - protein, 18 aa, Entamoeba histolytica
EIIIDFEGLISLKRLRID

SEQ ID NO: 2673080 - protein, 20 aa, Entamoeba histolytica
EIIIFCPKKHKFTIRSLKQK

SEQ ID NO: 2673081 - protein, 20 aa, Entamoeba histolytica
EIIIGLPYSPAIDMWSFGCV

SEQ ID NO: 2673082 - protein, 23 aa, Entamoeba histolytica
EIIIPMLGIFFNFSQTDSKEVEV

SEQ ID NO: 2673083 - protein, 19 aa, Entamoeba histolytica
EIIKKCNKIPMKQHATDIR

SEQ ID NO: 2673084 - protein, 25 aa, Entamoeba histolytica
EIIKYSFEFEVKRLANISISLLGKL

SEQ ID NO: 2673085 - protein, 20 aa, Entamoeba histolytica
EIILGLPYSCAIDMWSFGCV

SEQ ID NO: 2673086 - protein, 20 aa, Entamoeba histolytica
EIILGLPYSCSIDMWSFGCV

SEQ ID NO: 2673087 - protein, 18 aa, Entamoeba histolytica
EIIMDCYTYHNWNNCYSL

SEQ ID NO: 2673088 - protein, 19 aa, Entamoeba histolytica
EIIMKVFSFIGEEGPHSKK

SEQ ID NO: 2673089 - protein, 27 aa, Entamoeba histolytica
EIINLCFSFKNPLRVIFRIEEYTRAVW

SEQ ID NO: 2673090 - protein, 24 aa, Entamoeba histolytica
EIIPIKKDDIWKVCHVKKEVCTLK

SEQ ID NO: 2673091 - protein, 26 aa, Entamoeba histolytica
EIIPSSDFFPLFWQIASQFVNNPLPG

SEQ ID NO: 2673092 - protein, 21 aa, Entamoeba histolytica
EIIQSLPLIISKGYFDFLIDI

SEQ ID NO: 2673093 - protein, 19 aa, Entamoeba histolytica
EIISIRFSLIKAKQSIKEF

SEQ ID NO: 2673094 - protein, 26 aa, Entamoeba histolytica
EIISIRFSLIKAKQSIKEFCEETKVN

SEQ ID NO: 2673095 - protein, 20 aa, Entamoeba histolytica
EIISMELKEIVIGVIEKSGI

SEQ ID NO: 2673096 - protein, 20 aa, Entamoeba histolytica
EIISYSALLERIIKDLCFGN

SEQ ID NO: 2673097 - protein, 19 aa, Entamoeba histolytica
EIIVDGLLYSLSIWDTAGH

SEQ ID NO: 2673098 - protein, 19 aa, Entamoeba histolytica
EIIVKVVMKNCGSYFVKNL

SEQ ID NO: 2673099 - protein, 19 aa, Entamoeba histolytica
EIKAPVVINKPIEKPKKGI

SEQ ID NO: 2673100 - protein, 21 aa, Entamoeba histolytica
EIKEGRIETGISILEEAMNEV

SEQ ID NO: 2673101 - protein, 20 aa, Entamoeba histolytica
EIKEHPLFVFNIYINSYTPQ

SEQ ID NO: 2673102 - protein, 22 aa, Entamoeba histolytica
EIKEISKFFNLRELNLSNNDIY

SEQ ID NO: 2673103 - protein, 17 aa, Entamoeba histolytica
EIKELFPKVPSKSINEI

SEQ ID NO: 2673104 - protein, 23 aa, Entamoeba histolytica
EIKELKELPKFIGEETEETKKTA

SEQ ID NO: 2673105 - protein, 22 aa, Entamoeba histolytica
EIKEVYELFSCYFGDKSMDPVL

SEQ ID NO: 2673106 - protein, 24 aa, Entamoeba histolytica
EIKGKRFNSDLVRFNVFKDTMERW

SEQ ID NO: 2673107 - protein, 24 aa, Entamoeba histolytica
EIKLFPSSIFKSSECVFGGNITSS

SEQ ID NO: 2673108 - protein, 20 aa, Entamoeba histolytica
EIKLITKLFEAMKKTKYGIT

SEQ ID NO: 2673109 - protein, 26 aa, Entamoeba histolytica
EIKLKECKGIEVISCNILPSFEEYVY

SEQ ID NO: 2673110 - protein, 25 aa, Entamoeba histolytica
EIKMFIHNRLFKWKLKEITAKQLDK

SEQ ID NO: 2673111 - protein, 23 aa, Entamoeba histolytica
EIKNKRLTAEFFVSDSTKKVIDQ

SEQ ID NO: 2673112 - protein, 21 aa, Entamoeba histolytica
EIKPPTTVTRSHIGINPKTGE

SEQ ID NO: 2673113 - protein, 20 aa, Entamoeba histolytica
EIKQRGFRLPQPGDKPGDKS

SEQ ID NO: 2673114 - protein, 18 aa, Entamoeba histolytica
EIKQWLSVNFNSIEIEIN

SEQ ID NO: 2673115 - protein, 19 aa, Entamoeba histolytica
EIKRIEWDKILYIDEHTFK

SEQ ID NO: 2673116 - protein, 28 aa, Entamoeba histolytica
EIKSGAFASCCLICKIRCECESTNHQLC

SEQ ID NO: 2673117 - protein, 25 aa, Entamoeba histolytica
EIKSRIRYAQSIIINKCENMKFDID

SEQ ID NO: 2673118 - protein, 24 aa, Entamoeba histolytica
EIKTICYKERIVMNKEISSIEEME

SEQ ID NO: 2673119 - protein, 28 aa, Entamoeba histolytica
EIKTTNCNLEMRFEELQCENDFLKGSNE

SEQ ID NO: 2673120 - protein, 19 aa, Entamoeba histolytica
EILASCGLVNYISPKSFEE

SEQ ID NO: 2673121 - protein, 21 aa, Entamoeba histolytica
EILEAIQPYGKVIGIEDAGEF

SEQ ID NO: 2673122 - protein, 18 aa, Entamoeba histolytica
EILFEFIMSCRSYDFAFG

SEQ ID NO: 2673123 - protein, 18 aa, Entamoeba histolytica
EILFGYKLLEKLIPEIKT

SEQ ID NO: 2673124 - protein, 22 aa, Entamoeba histolytica
EILKKLIKYTLKWILILELINQ

SEQ ID NO: 2673125 - protein, 19 aa, Entamoeba histolytica
EILKQLTVLPVESPVLLSG

SEQ ID NO: 2673126 - protein, 19 aa, Entamoeba histolytica
EILKRTIMILDDMNKNNKI

SEQ ID NO: 2673127 - protein, 26 aa, Entamoeba histolytica
EILKSIPSLIGIIGMISIFHLYSKFQ

SEQ ID NO: 2673128 - protein, 26 aa, Entamoeba histolytica
EILKTLQCYDLSPAVMTTALYQEIIS

SEQ ID NO: 2673129 - protein, 26 aa, Entamoeba histolytica
EILLLPCRHITMCAGCYEEVKERTHQ

SEQ ID NO: 2673130 - protein, 27 aa, Entamoeba histolytica
EILLNKISLYFGFPIAFHKAHCPLQTN

SEQ ID NO: 2673131 - protein, 23 aa, Entamoeba histolytica
EILLTQLFAICFYKEILTKTKLV

SEQ ID NO: 2673132 - protein, 18 aa, Entamoeba histolytica
EILNIAAIYEKENIYPPK

SEQ ID NO: 2673133 - protein, 32 aa, Entamoeba histolytica
EILNNCPLYQLLPLQAFCDLLSVSVNPQIIDG

SEQ ID NO: 2673134 - protein, 19 aa, Entamoeba histolytica
EILPGITAGNCVVSGPGVD

SEQ ID NO: 2673135 - protein, 30 aa, Entamoeba histolytica
EILPIYHINCIFLHRFERYYGTINSIDRTE

SEQ ID NO: 2673136 - protein, 18 aa, Entamoeba histolytica
EILQERFAPFLPTVLQIV

SEQ ID NO: 2673137 - protein, 18 aa, Entamoeba histolytica
EILSKRLGKEIKISYMRA

SEQ ID NO: 2673138 - protein, 19 aa, Entamoeba histolytica
EILSRACELFIKDLTTRAG

SEQ ID NO: 2673139 - protein, 25 aa, Entamoeba histolytica
EILSRPEIIENIKFDQSVKESLKNG

SEQ ID NO: 2673140 - protein, 21 aa, Entamoeba histolytica
EIMGKEIKSVFDSLMKDNNDI

SEQ ID NO: 2673141 - protein, 18 aa, Entamoeba histolytica
EIMKEILEGKGYQFRLIK

SEQ ID NO: 2673142 - protein, 18 aa, Entamoeba histolytica
EIMKKECTGKRFIENFIM

SEQ ID NO: 2673143 - protein, 31 aa, Entamoeba histolytica; identical to SEQ ID NO: 2479082

SEQ ID NO: 2673144 - protein, 18 aa, Entamoeba histolytica
EIMLKYPNLPRINITSKD

SEQ ID NO: 2673145 - protein, 21 aa, Entamoeba histolytica
EIMNQSFRRRAFTVKKDGKKV

SEQ ID NO: 2673146 - protein, 20 aa, Entamoeba histolytica
EIMSKIFPSQDFLKHICIVW

SEQ ID NO: 2673147 - protein, 27 aa, Entamoeba histolytica
EIMYFLGEICNGLWYLHFTKKLIHRDL

SEQ ID NO: 2673148 - protein, 23 aa, Entamoeba histolytica
EINCSPIGVNVLWSDGSLSWYSS

SEQ ID NO: 2673149 - protein, 24 aa, Entamoeba histolytica
EINDIRFGIRFGQESATAFIQNTE

SEQ ID NO: 2673150 - protein, 36 aa, Entamoeba histolytica
EINEISISVVHKWRVQGYFYDFIGYVLFPVKEINGK

SEQ ID NO: 2673151 - protein, 18 aa, Entamoeba histolytica
EINFKVSYHVSQLLEENG

SEQ ID NO: 2673152 - protein, 19 aa, Entamoeba histolytica
EINICWCGNALEGYLGCKD

SEQ ID NO: 2673153 - protein, 23 aa, Entamoeba histolytica
EINIPFPTFIKKIQLVVVSCFTG

SEQ ID NO: 2673154 - protein, 26 aa, Entamoeba histolytica
EINKILNRWLEIEFSEHGFIMPDIVK

SEQ ID NO: 2673155 - protein, 33 aa, Entamoeba histolytica; identical to SEQ ID NO: 2479090

SEQ ID NO: 2673156 - protein, 18 aa, Entamoeba histolytica
EINKLISDVISIRRKQEE

SEQ ID NO: 2673157 - protein, 19 aa, Entamoeba histolytica
EINLGIVMGTFAIHLNDKE

SEQ ID NO: 2673158 - protein, 24 aa, Entamoeba histolytica
EINNYCIEWIFKYLDEINSIEGID

SEQ ID NO: 2673159 - protein, 26 aa, Entamoeba histolytica
EINQMKVLIINSIQKAKEEIMKKDNE

SEQ ID NO: 2673160 - protein, 19 aa, Entamoeba histolytica
EINVSVCMRNKINPQEIPI

SEQ ID NO: 2673161 - protein, 24 aa, Entamoeba histolytica
EINYELLQRLALSLHSFSKSFVKE

SEQ ID NO: 2673162 - protein, 24 aa, Entamoeba histolytica
EINYRLAEIGQMFYTIVDTQAIEM

SEQ ID NO: 2673163 - protein, 20 aa, Entamoeba histolytica
EIPGLGCDGCLVRATNGSKK

SEQ ID NO: 2673164 - protein, 23 aa, Entamoeba histolytica
EIPHEGAFCDLMWSDPDENVEGM

SEQ ID NO: 2673165 - protein, 24 aa, Entamoeba histolytica
EIPHEGAFCDLMWSDPDESVEGMV

SEQ ID NO: 2673166 - protein, 30 aa, Entamoeba histolytica
EIPIALRISGHLLLGICRIYSRKVKYLLQD

SEQ ID NO: 2673167 - protein, 25 aa, Entamoeba histolytica
EIPKEVLDSCLGSRVMVKVVTSEDG

SEQ ID NO: 2673168 - protein, 20 aa, Entamoeba histolytica
EIPLSLNWIYYDISDPDLLS

SEQ ID NO: 2673169 - protein, 21 aa, Entamoeba histolytica
EIPNALIAADIIKIYLRNLPE

SEQ ID NO: 2673170 - protein, 20 aa, Entamoeba histolytica
EIPNCCFFRCYSLSQINIPN

SEQ ID NO: 2673171 - protein, 20 aa, Entamoeba histolytica
EIPSLLKLDLCRNYIVEIPT

SEQ ID NO: 2673172 - protein, 27 aa, Entamoeba histolytica
EIPSQIPTLRGCVVSRIFCGGFCSACI

SEQ ID NO: 2673173 - protein, 29 aa, Entamoeba histolytica
EIQCKIALETLKIALEYPFSNGYEEEEDI

SEQ ID NO: 2673174 - protein, 18 aa, Entamoeba histolytica
EIQCLTFSTKDIFLVSGS

SEQ ID NO: 2673175 - protein, 19 aa, Entamoeba histolytica
EIQEVIKILSNYNWSDIKE

SEQ ID NO: 2673176 - protein, 18 aa, Entamoeba histolytica
EIQFPYCGVQLELTGANG

SEQ ID NO: 2673177 - protein, 23 aa, Entamoeba histolytica
EIQMKLEHQEFIEIQKLKNDKKS

SEQ ID NO: 2673178 - protein, 22 aa, Entamoeba histolytica
EIQQWWKIMLAIFASSIKMCRY

SEQ ID NO: 2673179 - protein, 23 aa, Entamoeba histolytica
EIQRIKDAISEFERNHAQVEEKI

SEQ ID NO: 2673180 - protein, 25 aa, Entamoeba histolytica
EIQSGKICAICIEKNFNGKSECMTD

SEQ ID NO: 2673181 - protein, 25 aa, Entamoeba histolytica
EIQTGKICAICIEKNFNGKSEYITS

SEQ ID NO: 2673182 - protein, 24 aa, Entamoeba histolytica
EIQYFKQYCKIVGEYGVNSEVDVV

SEQ ID NO: 2673183 - protein, 24 aa, Entamoeba histolytica
EIRCIEIPESIILNNNEHRYEKKN

SEQ ID NO: 2673184 - protein, 26 aa, Entamoeba histolytica
EIRDLPIEIGELFNLEDLNLNNNQIK

SEQ ID NO: 2673185 - protein, 17 aa, Entamoeba histolytica
EIREKFITCGRISRMMM

SEQ ID NO: 2673186 - protein, 19 aa, Entamoeba histolytica
EIREKLGSCGEIYSLQVKY

SEQ ID NO: 2673187 - protein, 21 aa, Entamoeba histolytica
EIRFNLPQWQKFPIFAKIRES

SEQ ID NO: 2673188 - protein, 22 aa, Entamoeba histolytica
EIRKELKLLNAPSWTLQLKHDE

SEQ ID NO: 2673189 - protein, 23 aa, Entamoeba histolytica
EIRKEMKTILSSDSFDDSFVDIK

SEQ ID NO: 2673190 - protein, 19 aa, Entamoeba histolytica
EIRNWKAFVRFMEENQKIL

SEQ ID NO: 2673191 - protein, 30 aa, Entamoeba histolytica
EIRRMEFCFVINRVNSYLTREEELLSDKSY

SEQ ID NO: 2673192 - protein, 25 aa, Entamoeba histolytica
EIRSGKICAICIEKNFNGKSEYITS

SEQ ID NO: 2673193 - protein, 24 aa, Entamoeba histolytica
EIRSGKICAICIEKNFNGKSNYII

SEQ ID NO: 2673194 - protein, 19 aa, Entamoeba histolytica
EIRTIPNSTKFVIILPQRQ

SEQ ID NO: 2673195 - protein, 21 aa, Entamoeba histolytica
EIRVVSCRQVRNLSVITLDNN

SEQ ID NO: 2673196 - protein, 17 aa, Entamoeba histolytica
EISAIILNKVKKTIIEQ

SEQ ID NO: 2673197 - protein, 25 aa, Entamoeba histolytica
EISALRGLFFIRLLGNYLVSNLESK

SEQ ID NO: 2673198 - protein, 19 aa, Entamoeba histolytica
EISCGGLMQPVLLTINTSF

SEQ ID NO: 2673199 - protein, 27 aa, Entamoeba histolytica
EISIPRLMSCVEITFSLVPPKDTNVPG

SEQ ID NO: 2673200 - protein, 19 aa, Entamoeba histolytica
EISLCPTIQSISFPSSICS

SEQ ID NO: 2673201 - protein, 22 aa, Entamoeba histolytica
EITDQFKIICENLVNDSTNLPK

SEQ ID NO: 2673202 - protein, 17 aa, Entamoeba histolytica
EITEFFINYFKNIKPKL

SEQ ID NO: 2673203 - protein, 17 aa, Entamoeba histolytica
EITEKKYWMGISEEQFY

SEQ ID NO: 2673204 - protein, 22 aa, Entamoeba histolytica
EITESWDVWGLGVIIIEMMNGT

SEQ ID NO: 2673205 - protein, 18 aa, Entamoeba histolytica
EITEVCENYAFVICNNTT

SEQ ID NO: 2673206 - protein, 17 aa, Entamoeba histolytica
EITEWFKNQPIYEDILM

SEQ ID NO: 2673207 - protein, 25 aa, Entamoeba histolytica
EITEWGYGWELFRGIGSVILNSIKF

SEQ ID NO: 2673208 - protein, 22 aa, Entamoeba histolytica
EITGIGKVRFITGVGKHSSRRG

SEQ ID NO: 2673209 - protein, 17 aa, Entamoeba histolytica
EITGIKLVPNRKEEYKI

SEQ ID NO: 2673210 - protein, 22 aa, Entamoeba histolytica
EITHPTLLFIQNWFSYDPFLFI

SEQ ID NO: 2673211 - protein, 22 aa, Entamoeba histolytica
EITKLIIPSAIHFNPHVLEVCN

SEQ ID NO: 2673212 - protein, 24 aa, Entamoeba histolytica
EITKQKLDCYFIMKGTVICEKKKD

SEQ ID NO: 2673213 - protein, 20 aa, Entamoeba histolytica
EITLFPNIETLRCDIETIKK

SEQ ID NO: 2673214 - protein, 19 aa, Entamoeba histolytica
EITLTFKFSRECDEWYQMV

SEQ ID NO: 2673215 - protein, 18 aa, Entamoeba histolytica
EITMSYLIPALDKYLQDY

SEQ ID NO: 2673216 - protein, 18 aa, Entamoeba histolytica
EITPDIIYNDVFNIQQLL

SEQ ID NO: 2673217 - protein, 26 aa, Entamoeba histolytica
EITSIPIKLSFTMGFAETHHYSHPLI

SEQ ID NO: 2673218 - protein, 18 aa, Entamoeba histolytica
EIVECINTLSAIALNDKI

SEQ ID NO: 2673219 - protein, 18 aa, Entamoeba histolytica
EIVEFCNLIVGTWKLNER

SEQ ID NO: 2673220 - protein, 18 aa, Entamoeba histolytica
EIVGELLKLYGYQENSVI

SEQ ID NO: 2673221 - protein, 20 aa, Entamoeba histolytica
EIVGEWKLISTRTITENKRN

SEQ ID NO: 2673222 - protein, 26 aa, Entamoeba histolytica
EIVHSIRINPFRICFKEISQYKHIFT

SEQ ID NO: 2673223 - protein, 18 aa, Entamoeba histolytica
EIVKEMFSYVDGFCISLK

SEQ ID NO: 2673224 - protein, 24 aa, Entamoeba histolytica
EIVKHMNCIVCPRGCPIEVKIDAK

SEQ ID NO: 2673225 - protein, 25 aa, Entamoeba histolytica
EIVKHMNCIVCPRGCPIEVKIDAKS

SEQ ID NO: 2673226 - protein, 17 aa, Entamoeba histolytica
EIVKLAISDVLPWICDN

SEQ ID NO: 2673227 - protein, 20 aa, Entamoeba histolytica
EIVKQIVLVLLNFSSIIELD

SEQ ID NO: 2673228 - protein, 24 aa, Entamoeba histolytica
EIVNRLSNLIIHNLIMYGRNVEEW

SEQ ID NO: 2673229 - protein, 26 aa, Entamoeba histolytica
EIVRTEVPILPLFFLQYCAIEELQFE

SEQ ID NO: 2673230 - protein, 24 aa, Entamoeba histolytica
EIVVKRGKQVIVFVHTRRETVLTA

SEQ ID NO: 2673231 - protein, 19 aa, Entamoeba histolytica
EIWNIPNYFDIIKTPMDLG

SEQ ID NO: 2673232 - protein, 19 aa, Entamoeba histolytica
EIWVISKIARYAVGKNVFI

SEQ ID NO: 2673233 - protein, 26 aa, Entamoeba histolytica
EIYCQECGKRFCIKCYKKTHKGIYHS

SEQ ID NO: 2673234 - protein, 19 aa, Entamoeba histolytica
EIYDRIFTMLVQKVNIALQ

SEQ ID NO: 2673235 - protein, 23 aa, Entamoeba histolytica
EIYEFVKEFKISSTIEHNMLTKL

SEQ ID NO: 2673236 - protein, 18 aa, Entamoeba histolytica
EIYEKEGYQIISSSLFLF

SEQ ID NO: 2673237 - protein, 23 aa, Entamoeba histolytica
EIYKECNCHTIASLFKLFLRELP

SEQ ID NO: 2673238 - protein, 27 aa, Entamoeba histolytica
EIYKMKGMFRTICLFGSSNNNFIVELN

SEQ ID NO: 2673239 - protein, 42 aa, Entamoeba histolytica
EIYQTLGKKCCIFCHKANISTKCPVCNKTVCDECKNDKSCYS

SEQ ID NO: 2673240 - protein, 26 aa, Entamoeba histolytica
EIYTMFVKRSLLASGLSEEEAEKKVD

SEQ ID NO: 2673241 - protein, 27 aa, Entamoeba histolytica
EIYTMLPPRLQMLIPEQIFTSSIDGLS

SEQ ID NO: 2673242 - protein, 23 aa, Entamoeba histolytica
EIYYKRLRFLQVKLFNTSLKSYS

SEQ ID NO: 2673243 - protein, 23 aa, Entamoeba histolytica
EKAEVLRTCIDYQLNDFLDIIKT

SEQ ID NO: 2673244 - protein, 18 aa, Entamoeba histolytica
EKAFCIHGGISPQLNSLD

SEQ ID NO: 2673245 - protein, 21 aa, Entamoeba histolytica
EKAFTRLAGVLKDDIQPYLNT

SEQ ID NO: 2673246 - protein, 25 aa, Entamoeba histolytica
EKAGIDHYFCFGISSLIKLLQSVHD

SEQ ID NO: 2673247 - protein, 28 aa, Entamoeba histolytica
EKAKELKRRVPLLIGEVWFGGCERRILQ

SEQ ID NO: 2673248 - protein, 29 aa, Entamoeba histolytica
EKARWQRIHIAKFNKCIIELEKQRKKDGL

SEQ ID NO: 2673249 - protein, 22 aa, Entamoeba histolytica
EKATYRKGQFGGLVNQGTTCYM

SEQ ID NO: 2673250 - protein, 21 aa, Entamoeba histolytica
EKAWWKFAVEAIKNKRMNEEN

SEQ ID NO: 2673251 - protein, 26 aa, Entamoeba histolytica
EKCILWPDYCDLLLIALERSHNKPEE

SEQ ID NO: 2673252 - protein, 28 aa, Entamoeba histolytica
EKCKEVPKSFIFCIGNFGGILDLYKSPR

SEQ ID NO: 2673253 - protein, 23 aa, Entamoeba histolytica
EKCKNKLLIRICDKKINVIGIVT

SEQ ID NO: 2673254 - protein, 18 aa, Entamoeba histolytica
EKCTFTLKPEDAFGSCGD

SEQ ID NO: 2673255 - protein, 21 aa, Entamoeba histolytica
EKCYTYYKRIIEIDYKYHKTL

SEQ ID NO: 2673256 - protein, 20 aa, Entamoeba histolytica
EKDAILALCSQFLLFGIKNE

SEQ ID NO: 2673257 - protein, 18 aa, Entamoeba histolytica
EKDCGKTSLITRYINDIY

SEQ ID NO: 2673258 - protein, 26 aa, Entamoeba histolytica
EKDFRDGVLLIKLCSKITHTKKSTYK

SEQ ID NO: 2673259 - protein, 26 aa, Entamoeba histolytica
EKDHPYVLKCCGGFFASPYNTLEYWM

SEQ ID NO: 2673260 - protein, 23 aa, Entamoeba histolytica
EKDIPVSFEVPFRELKFGGTIKR

SEQ ID NO: 2673261 - protein, 23 aa, Entamoeba histolytica
EKDKEKKKQIELMIEEDPELAVE

SEQ ID NO: 2673262 - protein, 21 aa, Entamoeba histolytica
EKDKRVINNIVNILIGLNKRE

SEQ ID NO: 2673263 - protein, 32 aa, Entamoeba histolytica; identical to SEQ ID NO: 2479194

SEQ ID NO: 2673264 - protein, 20 aa, Entamoeba histolytica
EKDLLFIKQFVKTQMFENFK

SEQ ID NO: 2673265 - protein, 24 aa, Entamoeba histolytica
EKDNWEFGEFLSFQDIAIYGTLIG

SEQ ID NO: 2673266 - protein, 27 aa, Entamoeba histolytica
EKDSLFYILGCWDIKTNDCVIDSVKYS

SEQ ID NO: 2673267 - protein, 22 aa, Entamoeba histolytica
EKEAKSAVLVIVEDIDRLLEEE

SEQ ID NO: 2673268 - protein, 22 aa, Entamoeba histolytica
EKECGDMPWSEVFFGEEEDESY

SEQ ID NO: 2673269 - protein, 18 aa, Entamoeba histolytica
EKECGVGVVVTREQIIEG

SEQ ID NO: 2673270 - protein, 18 aa, Entamoeba histolytica
EKECRIVIKQIFYGLKYL

SEQ ID NO: 2673271 - protein, 19 aa, Entamoeba histolytica
EKECYEIKKELDNIHQNEI

SEQ ID NO: 2673272 - protein, 21 aa, Entamoeba histolytica
EKEEFKRKTEQYILELERSLS

SEQ ID NO: 2673273 - protein, 27 aa, Entamoeba histolytica
EKEGKQIEALVCWKQAIDITPFHASKV

SEQ ID NO: 2673274 - protein, 24 aa, Entamoeba histolytica
EKEGMKVFDVMAFVYQHIRMLHDY

SEQ ID NO: 2673275 - protein, 22 aa, Entamoeba histolytica
EKEGRIQLNLMDFKEIKKIEFI

SEQ ID NO: 2673276 - protein, 21 aa, Entamoeba histolytica
EKEGWRVVIGKIRKEEMPDGE

SEQ ID NO: 2673277 - protein, 24 aa, Entamoeba histolytica
EKEHIKGINIKGSFKQEMGSGEES

SEQ ID NO: 2673278 - protein, 17 aa, Entamoeba histolytica
EKEIKMVDAYGIKGQQH

SEQ ID NO: 2673279 - protein, 19 aa, Entamoeba histolytica
EKEKGFIVDNLLSVYRMKS

SEQ ID NO: 2673280 - protein, 23 aa, Entamoeba histolytica
EKEKGICLEYCILPSHVCGIERR

SEQ ID NO: 2673281 - protein, 25 aa, Entamoeba histolytica
EKEKHISLNLGDLVDDFIKEVNSKA

SEQ ID NO: 2673282 - protein, 20 aa, Entamoeba histolytica
EKELKRRKILEKFNQTNQSL

SEQ ID NO: 2673283 - protein, 20 aa, Entamoeba histolytica
EKELKTKEIESLNSQLGDLQ

SEQ ID NO: 2673284 - protein, 27 aa, Entamoeba histolytica
EKEMCCCFYTKYQIIKFIGSGSFGKVF

SEQ ID NO: 2673285 - protein, 19 aa, Entamoeba histolytica
EKEMILPLLKWKGKDIDLS

SEQ ID NO: 2673286 - protein, 22 aa, Entamoeba histolytica
EKEMKNTIIILNKVIICLEQMK

SEQ ID NO: 2673287 - protein, 18 aa, Entamoeba histolytica
EKEMRNGNEWKDGMKEFE

SEQ ID NO: 2673288 - protein, 24 aa, Entamoeba histolytica
EKEPNKRYIRCVTDYLETYVRVNP

SEQ ID NO: 2673289 - protein, 19 aa, Entamoeba histolytica
EKERIKWLLNEEETRKEDV

SEQ ID NO: 2673290 - protein, 17 aa, Entamoeba histolytica
EKERRKQQYIKIRKDLK

SEQ ID NO: 2673291 - protein, 22 aa, Entamoeba histolytica
EKESMYLCYFNAMLQNNFFRKE

SEQ ID NO: 2673292 - protein, 31 aa, Entamoeba histolytica
EKETIPRAHLQWRCGYIQYITSIIIKDVYVV

SEQ ID NO: 2673293 - protein, 17 aa, Entamoeba histolytica
EKEVDACMGIVTNELID

SEQ ID NO: 2673294 - protein, 18 aa, Entamoeba histolytica
EKEVLLAQLTKLKEVREQ

SEQ ID NO: 2673295 - protein, 18 aa, Entamoeba histolytica
EKEWKVKVEEKVVEINNL

SEQ ID NO: 2673296 - protein, 19 aa, Entamoeba histolytica
EKEWVCIYIEDKIIKKEFN

SEQ ID NO: 2673297 - protein, 18 aa, Entamoeba histolytica
EKFFEAIEPYLISLENKR

SEQ ID NO: 2673298 - protein, 21 aa, Entamoeba histolytica
EKFNILQGLFIQPFLHYTEVL

SEQ ID NO: 2673299 - protein, 17 aa, Entamoeba histolytica
EKFNLHPFCFILNQPED

SEQ ID NO: 2673300 - protein, 25 aa, Entamoeba histolytica
EKFRKCKCAKIPIMQSHVYAYICRA

SEQ ID NO: 2673301 - protein, 24 aa, Entamoeba histolytica
EKFTCPKCGIELSKSEFVSYKRDD

SEQ ID NO: 2673302 - protein, 24 aa, Entamoeba histolytica
EKFVFELFNRIQLVDEVTYDLKRK

SEQ ID NO: 2673303 - protein, 20 aa, Entamoeba histolytica
EKGIPIWSEDDVFNYVKQKL

SEQ ID NO: 2673304 - protein, 21 aa, Entamoeba histolytica
EKGKKSFEYAWVMDTDDEERN

SEQ ID NO: 2673305 - protein, 23 aa, Entamoeba histolytica
EKGNEAFRIVVQVGRNNDKQRVM

SEQ ID NO: 2673306 - protein, 25 aa, Entamoeba histolytica
EKGPSLQIGKTFLVSSYLFDLYELF

SEQ ID NO: 2673307 - protein, 22 aa, Entamoeba histolytica
EKGTILKIIVPYGTYPYEIEVE

SEQ ID NO: 2673308 - protein, 18 aa, Entamoeba histolytica
EKGVRAFHIQNILNIFSG

SEQ ID NO: 2673309 - protein, 20 aa, Entamoeba histolytica
EKGVTWSDLFDAFINSKGYS

SEQ ID NO: 2673310 - protein, 25 aa, Entamoeba histolytica
EKHKSLRSAKTISFSKRDKKKDKKE

SEQ ID NO: 2673311 - protein, 20 aa, Entamoeba histolytica
EKHLYLIFEYCNTDLHKFLK

SEQ ID NO: 2673312 - protein, 24 aa, Entamoeba histolytica
EKICCSKGFQIKYVMSYMDMYSSD

SEQ ID NO: 2673313 - protein, 17 aa, Entamoeba histolytica
EKIDCVIEHLWDILSPK

SEQ ID NO: 2673314 - protein, 21 aa, Entamoeba histolytica
EKIDLRFAIVEYKDHQPNQQQ

SEQ ID NO: 2673315 - protein, 26 aa, Entamoeba histolytica
EKIEEMKRKVVCITFSTKEKTNEFEK

SEQ ID NO: 2673316 - protein, 21 aa, Entamoeba histolytica
EKIEGLFPFIDRMLDSGKTVV

SEQ ID NO: 2673317 - protein, 25 aa, Entamoeba histolytica
EKIEIAQAIYIRWKTKKLINERLLT

SEQ ID NO: 2673318 - protein, 22 aa, Entamoeba histolytica
EKIEICSNCYHLLGEMDLSQNI

SEQ ID NO: 2673319 - protein, 21 aa, Entamoeba histolytica
EKIEMPEGWEFQSEKHSKQCI

SEQ ID NO: 2673320 - protein, 19 aa, Entamoeba histolytica
EKIGAVGYCECSALTQEGL

SEQ ID NO: 2673321 - protein, 19 aa, Entamoeba histolytica
EKIHGVALIGGMVIDEVSR

SEQ ID NO: 2673322 - protein, 23 aa, Entamoeba histolytica
EKIHKKELIDFIVSSLPKRDSIK

SEQ ID NO: 2673323 - protein, 24 aa, Entamoeba histolytica
EKIIKRMINISIVFECKKSGDENA

SEQ ID NO: 2673324 - protein, 17 aa, Entamoeba histolytica
EKIKGIKSADDIKRKMR

SEQ ID NO: 2673325 - protein, 19 aa, Entamoeba histolytica
EKIKPFCKGSDKSVQEIYV

SEQ ID NO: 2673326 - protein, 29 aa, Entamoeba histolytica
EKIKTCIELLMKCWIIYDLDKGYQQGMSD

SEQ ID NO: 2673327 - protein, 26 aa, Entamoeba histolytica
EKIKTHPWWNSFDWDALYQKKIPAPF

SEQ ID NO: 2673328 - protein, 21 aa, Entamoeba histolytica
EKIKVLKFHLILCNKLTEMNV

SEQ ID NO: 2673329 - protein, 21 aa, Entamoeba histolytica
EKILHQFKDTEICLTEESDTS

SEQ ID NO: 2673330 - protein, 24 aa, Entamoeba histolytica
EKILPRYIVDKLLEKIGRPESILN

SEQ ID NO: 2673331 - protein, 24 aa, Entamoeba histolytica
EKIMCIYCALKAVEQTCYYISLKC

SEQ ID NO: 2673332 - protein, 19 aa, Entamoeba histolytica
EKIPEGLGLLAEDIPDFSL

SEQ ID NO: 2673333 - protein, 29 aa, Entamoeba histolytica
EKIPLKLRRLCELENIFPQIDSGLLEMLL

SEQ ID NO: 2673334 - protein, 25 aa, Entamoeba histolytica
EKIRAKICFDVAKALFYMHENGGIH

SEQ ID NO: 2673335 - protein, 17 aa, Entamoeba histolytica
EKIRFLIHNVEKTKEKM

SEQ ID NO: 2673336 - protein, 24 aa, Entamoeba histolytica
EKIRKERFKNFNWSGHNYLRVTRI

SEQ ID NO: 2673337 - protein, 18 aa, Entamoeba histolytica
EKIRKMMIEICLEYPSKD

SEQ ID NO: 2673338 - protein, 23 aa, Entamoeba histolytica
EKISGIHSHVFWAIVRNKKLCYY

SEQ ID NO: 2673339 - protein, 18 aa, Entamoeba histolytica
EKKAFCYAMIIFGIIVIR

SEQ ID NO: 2673340 - protein, 18 aa, Entamoeba histolytica
EKKCRHFLTKVRKICQYY

SEQ ID NO: 2673341 - protein, 22 aa, Entamoeba histolytica
EKKDCKCLFKCEGEWQCSLETI

SEQ ID NO: 2673342 - protein, 25 aa, Entamoeba histolytica
EKKDKKIKCFFRLEQTLKKKNGFIT

SEQ ID NO: 2673343 - protein, 23 aa, Entamoeba histolytica
EKKEALTYIIAGGCSMKINDEEK

SEQ ID NO: 2673344 - protein, 20 aa, Entamoeba histolytica
EKKEFVWKLYHEFEEKCGTT

SEQ ID NO: 2673345 - protein, 18 aa, Entamoeba histolytica
EKKEWLIEKEELKGDIQW

SEQ ID NO: 2673346 - protein, 23 aa, Entamoeba histolytica
EKKFPKVRVTLEAFEELQDFRKK

SEQ ID NO: 2673347 - protein, 23 aa, Entamoeba histolytica
EKKKAYPRLILRDGDSFSDKGMK

SEQ ID NO: 2673348 - protein, 24 aa, Entamoeba histolytica
EKKKGFFRYKFNKRNESVPLSLSQ

SEQ ID NO: 2673349 - protein, 25 aa, Entamoeba histolytica
EKKKIDIIKVFKIMWAKNSPKKQKT

SEQ ID NO: 2673350 - protein, 21 aa, Entamoeba histolytica
EKKKWLLWKEYIDTMLKLNRI

SEQ ID NO: 2673351 - protein, 19 aa, Entamoeba histolytica
EKKLDVILGSYKWMSPERF

SEQ ID NO: 2673352 - protein, 22 aa, Entamoeba histolytica
EKKLKHLSEWKEFRHMRRFSQT

SEQ ID NO: 2673353 - protein, 22 aa, Entamoeba histolytica
EKKLNGPVFIIGKRVVAHTKKV

SEQ ID NO: 2673354 - protein, 27 aa, Entamoeba histolytica
EKKNFRKSFKLPFSRNSLGINLDLCHS

SEQ ID NO: 2673355 - protein, 19 aa, Entamoeba histolytica
EKKNLCIFCINEEVKNKGL

SEQ ID NO: 2673356 - protein, 19 aa, Entamoeba histolytica
EKKPGCDGHGGCHRQGGCC

SEQ ID NO: 2673357 - protein, 24 aa, Entamoeba histolytica
EKKREPFMCPALYLISPTKESVDT

SEQ ID NO: 2673358 - protein, 19 aa, Entamoeba histolytica
EKKRILVEIEKKVQIYENN

SEQ ID NO: 2673359 - protein, 24 aa, Entamoeba histolytica
EKKRKSRNGFVLHFNALLYLLLKK

SEQ ID NO: 2673360 - protein, 19 aa, Entamoeba histolytica
EKKRLLNVLQNFADIIEER

SEQ ID NO: 2673361 - protein, 25 aa, Entamoeba histolytica
EKKSIPTEMTIYILTKLKEQNPNYF

SEQ ID NO: 2673362 - protein, 20 aa, Entamoeba histolytica
EKKSWKTGIDINSLTLDSLQ

SEQ ID NO: 2673363 - protein, 24 aa, Entamoeba histolytica
EKKTFKSGLVMRNELYQSLFEHQR

SEQ ID NO: 2673364 - protein, 25 aa, Entamoeba histolytica
EKKYGCGKCEDKVKTICPGNTPSGD

SEQ ID NO: 2673365 - protein, 19 aa, Entamoeba histolytica
EKKYWMGISEEQFYSTLTT

SEQ ID NO: 2673366 - protein, 29 aa, Entamoeba histolytica
EKLDKIMKVTEKWGDFDAHFTCSTLSGNK

SEQ ID NO: 2673367 - protein, 25 aa, Entamoeba histolytica
EKLEPPKPIILNGIEIKQKCSEDEP

SEQ ID NO: 2673368 - protein, 28 aa, Entamoeba histolytica
EKLILLPMDRFRRFIPIIDAFVHNTPDC

SEQ ID NO: 2673369 - protein, 19 aa, Entamoeba histolytica
EKLKEFKKRGTLYTNTGGA

SEQ ID NO: 2673370 - protein, 23 aa, Entamoeba histolytica
EKLKEMFSKFGVVEITLIKTHRK

SEQ ID NO: 2673371 - protein, 23 aa, Entamoeba histolytica
EKLKIKFCLDAAKGIEYLHSNGI

SEQ ID NO: 2673372 - protein, 17 aa, Entamoeba histolytica
EKLKINVFIGSNYIATQ

SEQ ID NO: 2673373 - protein, 21 aa, Entamoeba histolytica
EKLKKSMTFPENFYQKVDFKK

SEQ ID NO: 2673374 - protein, 24 aa, Entamoeba histolytica
EKLLPREVILWVLLPADEESYNYP

SEQ ID NO: 2673375 - protein, 20 aa, Entamoeba histolytica
EKLLQCMRINSTNSKQQSFP

SEQ ID NO: 2673376 - protein, 32 aa, Entamoeba histolytica
EKLLQRLLGLIVFRIDIHISKRDIRGVFELNL

SEQ ID NO: 2673377 - protein, 22 aa, Entamoeba histolytica
EKLLQSRKRLIRPFEEDKEINK

SEQ ID NO: 2673378 - protein, 22 aa, Entamoeba histolytica
EKLRKAGAGARLERIKAEADDK

SEQ ID NO: 2673379 - protein, 17 aa, Entamoeba histolytica
EKLRPVTFDIPPFITLN

SEQ ID NO: 2673380 - protein, 21 aa, Entamoeba histolytica
EKLYINYCGITSFKKNSFTPF

SEQ ID NO: 2673381 - protein, 17 aa, Entamoeba histolytica
EKLYRFFDDTVLNFISL

SEQ ID NO: 2673382 - protein, 31 aa, Entamoeba histolytica
EKMISGIYMGWLARLAIRELIEKKVIFERYA

SEQ ID NO: 2673383 - protein, 17 aa, Entamoeba histolytica
EKMKGDIGGLIRKEKMN

SEQ ID NO: 2673384 - protein, 17 aa, Entamoeba histolytica
EKMKKRCIGTKFEQINW

SEQ ID NO: 2673385 - protein, 25 aa, Entamoeba histolytica
EKMKRRFIKKYGFEPTRDEFLLFLS

SEQ ID NO: 2673386 - protein, 17 aa, Entamoeba histolytica
EKMKVLMSFGMRSVDNI

SEQ ID NO: 2673387 - protein, 17 aa, Entamoeba histolytica
EKMKWMQLFTGIDGIVV

SEQ ID NO: 2673388 - protein, 17 aa, Entamoeba histolytica
EKMPIYEYMLKLKIKKQ

SEQ ID NO: 2673389 - protein, 20 aa, Entamoeba histolytica
EKMVGFKYECIIGCKKDPLF

SEQ ID NO: 2673390 - protein, 17 aa, Entamoeba histolytica
EKNCDYLIFTRVTKGNY

SEQ ID NO: 2673391 - protein, 19 aa, Entamoeba histolytica
EKNEIFFMDNFMMPIYLHD

SEQ ID NO: 2673392 - protein, 20 aa, Entamoeba histolytica
EKNKRLPVDSGIKDMIASNE

SEQ ID NO: 2673393 - protein, 18 aa, Entamoeba histolytica
EKNLIIWGNLPRRRIDLM

SEQ ID NO: 2673394 - protein, 23 aa, Entamoeba histolytica
EKNNELESVMKRSIDDKTTIIQT

SEQ ID NO: 2673395 - protein, 23 aa, Entamoeba histolytica
EKNPDYAIIMAFDVTVDKEARDY

SEQ ID NO: 2673396 - protein, 20 aa, Entamoeba histolytica
EKNPSLKLVAFDKLTEKELE

SEQ ID NO: 2673397 - protein, 20 aa, Entamoeba histolytica
EKNSLCFSCVTLQQVKKITA

SEQ ID NO: 2673398 - protein, 18 aa, Entamoeba histolytica
EKNSRLLYSYSQALISKS

SEQ ID NO: 2673399 - protein, 28 aa, Entamoeba histolytica
EKNYIKECFKDIYVTLTSCFELYRQKKI

SEQ ID NO: 2673400 - protein, 23 aa, Entamoeba histolytica
EKPEELGRVISFSADGTIQSNET

SEQ ID NO: 2673401 - protein, 22 aa, Entamoeba histolytica
EKPFQIEGVWVFKGTEMPKELN

SEQ ID NO: 2673402 - protein, 26 aa, Entamoeba histolytica
EKPIYRLVERIGFIRRNIGIKTEKII

SEQ ID NO: 2673403 - protein, 24 aa, Entamoeba histolytica
EKPKILPCRATVKQLYQPHSDKEI

SEQ ID NO: 2673404 - protein, 25 aa, Entamoeba histolytica
EKPLFPLFLCDAGLIIISRFPIVEN

SEQ ID NO: 2673405 - protein, 25 aa, Entamoeba histolytica
EKPLFPLFLCDAGLVIISRFPIVEN

SEQ ID NO: 2673406 - protein, 26 aa, Entamoeba histolytica
EKPLSSPFSLNGFSFGKSTEKQQDTF

SEQ ID NO: 2673407 - protein, 28 aa, Entamoeba histolytica
EKPVCEFFYKIGACRHGDACNKTHIKPE

SEQ ID NO: 2673408 - protein, 20 aa, Entamoeba histolytica
EKPWYLKFNNSAIYDDNTED

SEQ ID NO: 2673409 - protein, 20 aa, Entamoeba histolytica
EKQEEVCIKQKIHQNTVDKE

SEQ ID NO: 2673410 - protein, 19 aa, Entamoeba histolytica
EKQEFSWKENIKKCNNTVF

SEQ ID NO: 2673411 - protein, 20 aa, Entamoeba histolytica
EKQFCSEFIHFIERTLVSVI

SEQ ID NO: 2673412 - protein, 18 aa, Entamoeba histolytica
EKQFVAFEKVKWWLDDKA

SEQ ID NO: 2673413 - protein, 19 aa, Entamoeba histolytica
EKQIKFYTIDAIKIGQEVK

SEQ ID NO: 2673414 - protein, 24 aa, Entamoeba histolytica
EKQIKGWGVLCQMINEGVQRFNDS

SEQ ID NO: 2673415 - protein, 29 aa, Entamoeba histolytica
EKQKFVDLIELCRLFCLAGASKEKTKEKY

SEQ ID NO: 2673416 - protein, 23 aa, Entamoeba histolytica
EKQLPIYFEFLINPYGPSTYSNE

SEQ ID NO: 2673417 - protein, 23 aa, Entamoeba histolytica
EKQTKFRVIMIFDADHLTNEAQQ

SEQ ID NO: 2673418 - protein, 20 aa, Entamoeba histolytica
EKRDFERGIYLEELQQFLPI

SEQ ID NO: 2673419 - protein, 26 aa, Entamoeba histolytica
EKREFMRELLLFPVIRELTCDNYFLD

SEQ ID NO: 2673420 - protein, 19 aa, Entamoeba histolytica
EKRERCLKRKGPYEALRSN

SEQ ID NO: 2673421 - protein, 27 aa, Entamoeba histolytica
EKREVAYRIPILTIWIHDMLSSLEEET

SEQ ID NO: 2673422 - protein, 21 aa, Entamoeba histolytica
EKRFRLKSILVDRYGETHRQD

SEQ ID NO: 2673423 - protein, 23 aa, Entamoeba histolytica
EKRHPKFSGGMFSRERDSYDDDD

SEQ ID NO: 2673424 - protein, 20 aa, Entamoeba histolytica
EKRIESRQQYLPKREFQKLR

SEQ ID NO: 2673425 - protein, 25 aa, Entamoeba histolytica
EKRIIQNLFYIWSMFNKEKVLKAIT

SEQ ID NO: 2673426 - protein, 22 aa, Entamoeba histolytica
EKRIKKPVIVKKERKLKEVKKI

SEQ ID NO: 2673427 - protein, 19 aa, Entamoeba histolytica
EKRKRKSIKQEGTPQPKVG

SEQ ID NO: 2673428 - protein, 20 aa, Entamoeba histolytica
EKRLIRKYQHAMKIDIDQHA

SEQ ID NO: 2673429 - protein, 20 aa, Entamoeba histolytica
EKRMLVKRVGWISNEDLQIC

SEQ ID NO: 2673430 - protein, 20 aa, Entamoeba histolytica
EKRNAAIFDRVFERMNEKRD

SEQ ID NO: 2673431 - protein, 21 aa, Entamoeba histolytica
EKRRLKYLASNSHVIGLENPE

SEQ ID NO: 2673432 - protein, 22 aa, Entamoeba histolytica
EKRSRAATLRRVMHLQKKEQTQ

SEQ ID NO: 2673433 - protein, 19 aa, Entamoeba histolytica
EKRSTIGVEFATRSIQHEG

SEQ ID NO: 2673434 - protein, 17 aa, Entamoeba histolytica
EKRTAKEVFERYNEGKK

SEQ ID NO: 2673435 - protein, 22 aa, Entamoeba histolytica
EKRVIPFLIFYSSRGKITQLLC

SEQ ID NO: 2673436 - protein, 18 aa, Entamoeba histolytica
EKRVKILDERGKAMEKAE

SEQ ID NO: 2673437 - protein, 22 aa, Entamoeba histolytica
EKRVLVKRVRLIANKDLQMCIS

SEQ ID NO: 2673438 - protein, 19 aa, Entamoeba histolytica
EKRYGFSLYQGGVVAGNEV

SEQ ID NO: 2673439 - protein, 32 aa, Entamoeba histolytica
EKSCKLNELELVFGTDCSMIGKYIDMLKKTQK

SEQ ID NO: 2673440 - protein, 27 aa, Entamoeba histolytica
EKSGKFSLGHFFIAINVECFRDLNEFK

SEQ ID NO: 2673441 - protein, 28 aa, Entamoeba histolytica
EKSGKFSLGHFFIAINVECFRDLNEFKK

SEQ ID NO: 2673442 - protein, 17 aa, Entamoeba histolytica
EKSHKPKVCDLKLTEEE

SEQ ID NO: 2673443 - protein, 21 aa, Entamoeba histolytica
EKSIVEWKINCNIINNLITKK

SEQ ID NO: 2673444 - protein, 17 aa, Entamoeba histolytica
EKSNVYIWSEWLKDDIG

SEQ ID NO: 2673445 - protein, 21 aa, Entamoeba histolytica
EKSQETINQIEILKNKMSRII

SEQ ID NO: 2673446 - protein, 21 aa, Entamoeba histolytica
EKSSYIKAGISLVSDIKMKQG

SEQ ID NO: 2673447 - protein, 24 aa, Entamoeba histolytica
EKTANHIEYVWKFITKQLHQSPSR

SEQ ID NO: 2673448 - protein, 17 aa, Entamoeba histolytica
EKTICLIGTTTQVPSFC

SEQ ID NO: 2673449 - protein, 20 aa, Entamoeba histolytica
EKTIGCILAKIYFYQKNQII

SEQ ID NO: 2673450 - protein, 17 aa, Entamoeba histolytica
EKTLSSLALIFALHHYK

SEQ ID NO: 2673451 - protein, 35 aa, Entamoeba histolytica; identical to SEQ ID NO: 2479407

SEQ ID NO: 2673452 - protein, 35 aa, Entamoeba histolytica
EKTPMIMKCGDWICSDCAIGCKKCPVCNNSTGGVF

SEQ ID NO: 2673453 - protein, 23 aa, Entamoeba histolytica
EKTQKFLCMFFGEIKQIQNSIKL

SEQ ID NO: 2673454 - protein, 24 aa, Entamoeba histolytica
EKTREFILRKAINGERTAMFSTAF

SEQ ID NO: 2673455 - protein, 25 aa, Entamoeba histolytica
EKTRIKATPYWGYKSEGGKKVFGNY

SEQ ID NO: 2673456 - protein, 22 aa, Entamoeba histolytica
EKVELLVLRMIFDNTLKAKINQ

SEQ ID NO: 2673457 - protein, 27 aa, Entamoeba histolytica
EKVESGLILNVLIEILCKGDGREEHPI

SEQ ID NO: 2673458 - protein, 17 aa, Entamoeba histolytica
EKVFLKTIIQYFTDCST

SEQ ID NO: 2673459 - protein, 18 aa, Entamoeba histolytica
EKVIGCMCPSLSLDEIEW

SEQ ID NO: 2673460 - protein, 19 aa, Entamoeba histolytica
EKVIGKLCCYYALSTNKIH

SEQ ID NO: 2673461 - protein, 20 aa, Entamoeba histolytica
EKVIKLGCCCSDINEMNMAH

SEQ ID NO: 2673462 - protein, 24 aa, Entamoeba histolytica
EKVIPDRRAVLLAGAPGVGKTTVS

SEQ ID NO: 2673463 - protein, 24 aa, Entamoeba histolytica
EKVKDCKLVSCGLLKDEKKKRDVM

SEQ ID NO: 2673464 - protein, 23 aa, Entamoeba histolytica
EKVKEDKNSLVIGKKERLSDKIE

SEQ ID NO: 2673465 - protein, 23 aa, Entamoeba histolytica
EKVLKASISSLLLSSSSEEEELV

SEQ ID NO: 2673466 - protein, 23 aa, Entamoeba histolytica
EKVLLRYHGLYWVTMVLVDNNLI

SEQ ID NO: 2673467 - protein, 34 aa, Entamoeba histolytica
EKVMYEMYVIFFIRKGRTSTHFSYNVKKNGADIG

SEQ ID NO: 2673468 - protein, 22 aa, Entamoeba histolytica
EKVRPICMGAVLRGITFTEESY

SEQ ID NO: 2673469 - protein, 31 aa, Entamoeba histolytica
EKVRRVFHILFPYFLKQSFRRIIILLWKSID

SEQ ID NO: 2673470 - protein, 19 aa, Entamoeba histolytica
EKVRVCAKQASIIKEMGFN

SEQ ID NO: 2673471 - protein, 22 aa, Entamoeba histolytica
EKVTEIPLFFTQEILPESTQQR

SEQ ID NO: 2673472 - protein, 17 aa, Entamoeba histolytica
EKWHRRTKYYAQGKTKE

SEQ ID NO: 2673473 - protein, 27 aa, Entamoeba histolytica
EKWKIKEVYTLCDWKVLEIINEKIQFF

SEQ ID NO: 2673474 - protein, 23 aa, Entamoeba histolytica
EKWLNKLLCLDASNTLMHITSTP

SEQ ID NO: 2673475 - protein, 18 aa, Entamoeba histolytica
EKYDFLILVLLVLFCKVP

SEQ ID NO: 2673476 - protein, 26 aa, Entamoeba histolytica
EKYDISKLIAIAKFLSSLCIGGVSSQ

SEQ ID NO: 2673477 - protein, 20 aa, Entamoeba histolytica
EKYERIIWRTFQVFESIYQY

SEQ ID NO: 2673478 - protein, 22 aa, Entamoeba histolytica
EKYEWLKQELIEDTNKLCKDFQ

SEQ ID NO: 2673479 - protein, 28 aa, Entamoeba histolytica
EKYFNRIRHSFKILTGILMSEVGDQTIL

SEQ ID NO: 2673480 - protein, 21 aa, Entamoeba histolytica
EKYIKQVIEWTATHKAEVVYN

SEQ ID NO: 2673481 - protein, 20 aa, Entamoeba histolytica
EKYIPGACSIDYINNRYRLN

SEQ ID NO: 2673482 - protein, 19 aa, Entamoeba histolytica
EKYLKYKGYFYERLDGSIK

SEQ ID NO: 2673483 - protein, 21 aa, Entamoeba histolytica
EKYLMIRKTIIGQFSNDTIIA

SEQ ID NO: 2673484 - protein, 23 aa, Entamoeba histolytica
EKYNEFFIAITFTTKVSKNEKFQ

SEQ ID NO: 2673485 - protein, 24 aa, Entamoeba histolytica
EKYPESLISFEFITSKFVADLTDV

SEQ ID NO: 2673486 - protein, 23 aa, Entamoeba histolytica
EKYSKKNGFPWDAQVVYGDTDSV

SEQ ID NO: 2673487 - protein, 20 aa, Entamoeba histolytica
ELAEIIFKTIWRRYTPSTIE

SEQ ID NO: 2673488 - protein, 24 aa, Entamoeba histolytica
ELAGKRLNVKFAKPKDGRPYLQKP

SEQ ID NO: 2673489 - protein, 26 aa, Entamoeba histolytica
ELAGYLANYCIPHFKQELIKTIEEEV

SEQ ID NO: 2673490 - protein, 23 aa, Entamoeba histolytica
ELAKKWVDCINITKNEILSHEYD

SEQ ID NO: 2673491 - protein, 18 aa, Entamoeba histolytica
ELALELLLEIAKEFTLMN

SEQ ID NO: 2673492 - protein, 26 aa, Entamoeba histolytica
ELAVKIFKTSILIFKDRERYVTGDYR

SEQ ID NO: 2673493 - protein, 21 aa, Entamoeba histolytica
ELAVSFYTLFCHTVGPFLLYE

SEQ ID NO: 2673494 - protein, 26 aa, Entamoeba histolytica
ELCHKSAEIIRMFPTDISEQFCRFMV

SEQ ID NO: 2673495 - protein, 18 aa, Entamoeba histolytica
ELCIGGVFIRIFNQNPTC

SEQ ID NO: 2673496 - protein, 17 aa, Entamoeba histolytica
ELCIGGVFIRILNKNPT

SEQ ID NO: 2673497 - protein, 18 aa, Entamoeba histolytica
ELCIGGVFIRILNKNPTC

SEQ ID NO: 2673498 - protein, 20 aa, Entamoeba histolytica
ELCKRARLAKANAYITSYLR

SEQ ID NO: 2673499 - protein, 21 aa, Entamoeba histolytica
ELCKRARLAKTNAYITSYLRE

SEQ ID NO: 2673500 - protein, 22 aa, Entamoeba histolytica
ELCKRARLAKTNAYITSYLREQ

SEQ ID NO: 2673501 - protein, 21 aa, Entamoeba histolytica
ELCLDHIKPLNEWMMEIEDIN

SEQ ID NO: 2673502 - protein, 24 aa, Entamoeba histolytica
ELCQKSRDGTICYYADAQYEYVFE

SEQ ID NO: 2673503 - protein, 20 aa, Entamoeba histolytica
ELCQVISPHVLKVFNSRIRN

SEQ ID NO: 2673504 - protein, 19 aa, Entamoeba histolytica
ELCTIPIGGLPAIYKNLVK

SEQ ID NO: 2673505 - protein, 31 aa, Entamoeba histolytica
ELCVECSCRRKCLLKYFGETTFKPNKRCCDL

SEQ ID NO: 2673506 - protein, 20 aa, Entamoeba histolytica
ELDAVISAILCFRISDGGKS

SEQ ID NO: 2673507 - protein, 18 aa, Entamoeba histolytica
ELDCKTCSIQLIKSFISI

SEQ ID NO: 2673508 - protein, 17 aa, Entamoeba histolytica
ELDDVFNEFDIPKERKK

SEQ ID NO: 2673509 - protein, 27 aa, Entamoeba histolytica
ELDGLKSLHWKYLDFIFICPKNIESIK

SEQ ID NO: 2673510 - protein, 20 aa, Entamoeba histolytica
ELDGNIELILYVLTDGRDDL

SEQ ID NO: 2673511 - protein, 23 aa, Entamoeba histolytica
ELDKAKCISYFELFVFLFDKSKT

SEQ ID NO: 2673512 - protein, 22 aa, Entamoeba histolytica
ELDKRLGEEGSFYKENNKLQKR

SEQ ID NO: 2673513 - protein, 28 aa, Entamoeba histolytica
ELECIIITGSLLRKEIFTILQKKFIEEG

SEQ ID NO: 2673514 - protein, 22 aa, Entamoeba histolytica
ELECNKKILLFDTIQFKSLGYK

SEQ ID NO: 2673515 - protein, 18 aa, Entamoeba histolytica
ELECSLLTLPMIWNENRF

SEQ ID NO: 2673516 - protein, 26 aa, Entamoeba histolytica
ELEDVCGIKGSIFCHSSGFLACNETY

SEQ ID NO: 2673517 - protein, 17 aa, Entamoeba histolytica
ELEEEGINVFSKEEREI

SEQ ID NO: 2673518 - protein, 20 aa, Entamoeba histolytica
ELEEEIDIALNHNYDMDQKL

SEQ ID NO: 2673519 - protein, 18 aa, Entamoeba histolytica
ELEHCINRYGIIIEETRN

SEQ ID NO: 2673520 - protein, 17 aa, Entamoeba histolytica
ELEKRLRVPSIEDDEEL

SEQ ID NO: 2673521 - protein, 21 aa, Entamoeba histolytica
ELEKRYRLLAKDISLNYKPTQ

SEQ ID NO: 2673522 - protein, 23 aa, Entamoeba histolytica
ELEKRYRLLTKDALHNYKPTQKK

SEQ ID NO: 2673523 - protein, 20 aa, Entamoeba histolytica
ELEKRYRLLTKDILHNYKPT

SEQ ID NO: 2673524 - protein, 22 aa, Entamoeba histolytica
ELEKRYRLLTKDILLNYKPTQK

SEQ ID NO: 2673525 - protein, 24 aa, Entamoeba histolytica
ELELKLALSGMASYTPQILIYKKL

SEQ ID NO: 2673526 - protein, 21 aa, Entamoeba histolytica
ELELLPDLLYINLTQLQDLQV

SEQ ID NO: 2673527 - protein, 37 aa, Entamoeba histolytica
ELELSELFYHFRISEIIDIWSEIILCERIIFTCKNYN

SEQ ID NO: 2673528 - protein, 27 aa, Entamoeba histolytica
ELEMEKKRMLIKLTLKDYIFARHDIGK

SEQ ID NO: 2673529 - protein, 18 aa, Entamoeba histolytica
ELEMKYQVIVKEINDIQQ

SEQ ID NO: 2673530 - protein, 30 aa, Entamoeba histolytica
ELENKVMALLRFELSKAKNAVCEMVPCHFE

SEQ ID NO: 2673531 - protein, 19 aa, Entamoeba histolytica
ELEQILPLIYQAIMNKLNH

SEQ ID NO: 2673532 - protein, 19 aa, Entamoeba histolytica
ELERPWKALVNEDAKMEKI

SEQ ID NO: 2673533 - protein, 19 aa, Entamoeba histolytica
ELESIKKFYTLLIITKYFN

SEQ ID NO: 2673534 - protein, 24 aa, Entamoeba histolytica
ELFAKRGMCYYSLGKYMEAFTDGV

SEQ ID NO: 2673535 - protein, 20 aa, Entamoeba histolytica
ELFCICPTIVLSLLYENGFK

SEQ ID NO: 2673536 - protein, 21 aa, Entamoeba histolytica
ELFEFIIKDSFELMTDLFGNY

SEQ ID NO: 2673537 - protein, 21 aa, Entamoeba histolytica
ELFEQIKLFQQCIDRLPKAMR

SEQ ID NO: 2673538 - protein, 25 aa, Entamoeba histolytica
ELFGREEINVCKKISSLRKKLWMEH

SEQ ID NO: 2673539 - protein, 17 aa, Entamoeba histolytica
ELFHLKFFFKRDFQEID

SEQ ID NO: 2673540 - protein, 23 aa, Entamoeba histolytica
ELFIKKIGGLFIESSSGRKNAYD

SEQ ID NO: 2673541 - protein, 20 aa, Entamoeba histolytica
ELFIRGVLKVLPRTHKEYKG

SEQ ID NO: 2673542 - protein, 19 aa, Entamoeba histolytica
ELFNKASICGDVYGINNSG

SEQ ID NO: 2673543 - protein, 17 aa, Entamoeba histolytica
ELFRVKDLIPEDFINPS

SEQ ID NO: 2673544 - protein, 25 aa, Entamoeba histolytica
ELFSKRYLQCNIKYKDILTEEKVEQ

SEQ ID NO: 2673545 - protein, 36 aa, Entamoeba histolytica
ELFTKIQHCLLNIFSLTRFNLITGLLSIELFLETLD

SEQ ID NO: 2673546 - protein, 20 aa, Entamoeba histolytica
ELFTKLEIETSLCDRILRLI

SEQ ID NO: 2673547 - protein, 20 aa, Entamoeba histolytica
ELFTSIPIAPLLVSNKKERI

SEQ ID NO: 2673548 - protein, 19 aa, Entamoeba histolytica
ELFYQINIIDGLRNRKIPI

SEQ ID NO: 2673549 - protein, 20 aa, Entamoeba histolytica
ELGDSCFDECYSLTTINIPP

SEQ ID NO: 2673550 - protein, 19 aa, Entamoeba histolytica
ELGEFKGVIKNAVDTQDKK

SEQ ID NO: 2673551 - protein, 24 aa, Entamoeba histolytica
ELGYKRTILVSIDYHRRVNDIEEI

SEQ ID NO: 2673552 - protein, 18 aa, Entamoeba histolytica
ELHFYPLLQQYLYSTHEY

SEQ ID NO: 2673553 - protein, 18 aa, Entamoeba histolytica
ELHINYGQEPFVYNIYNE

SEQ ID NO: 2673554 - protein, 25 aa, Entamoeba histolytica
ELHITLKQSRFFGIKSIEINRIAIE

SEQ ID NO: 2673555 - protein, 30 aa, Entamoeba histolytica
ELHKPRLSKRIKFIIINGVIDMMKNDILLD

SEQ ID NO: 2673556 - protein, 32 aa, Entamoeba histolytica; identical to SEQ ID NO: 2479501

SEQ ID NO: 2673557 - protein, 19 aa, Entamoeba histolytica
ELHLRNCSIPATVLKEVIE

SEQ ID NO: 2673558 - protein, 27 aa, Entamoeba histolytica
ELHNHRALFHIGMCFFRGIGKPLDVDK

SEQ ID NO: 2673559 - protein, 18 aa, Entamoeba histolytica
ELHRTRLSLLQPLQKEDQ

SEQ ID NO: 2673560 - protein, 19 aa, Entamoeba histolytica
ELIDAFPILIKEEPSYEEF

SEQ ID NO: 2673561 - protein, 22 aa, Entamoeba histolytica
ELIEAFPKMCRRRHFNEIMQVV

SEQ ID NO: 2673562 - protein, 24 aa, Entamoeba histolytica
ELIEKREAHKWKLITFEEKKIEEI

SEQ ID NO: 2673563 - protein, 22 aa, Entamoeba histolytica
ELIEMKAIYIKYTENVKMNEGI

SEQ ID NO: 2673564 - protein, 25 aa, Entamoeba histolytica
ELIEPLPRFAIGIAQTRGVRENMED

SEQ ID NO: 2673565 - protein, 19 aa, Entamoeba histolytica
ELIEQIPITTQPLIKKEIS

SEQ ID NO: 2673566 - protein, 18 aa, Entamoeba histolytica
ELIERGGDESLLFVIMNL

SEQ ID NO: 2673567 - protein, 26 aa, Entamoeba histolytica
ELIHKMDLHPTFGLSYQNIILETNRP

SEQ ID NO: 2673568 - protein, 20 aa, Entamoeba histolytica
ELIIYRIVIQLLQLYIEQTK

SEQ ID NO: 2673569 - protein, 19 aa, Entamoeba histolytica
ELIKGLVMDHGTRHPGMPH

SEQ ID NO: 2673570 - protein, 19 aa, Entamoeba histolytica
ELIKNMIFVLVCEEKITKG

SEQ ID NO: 2673571 - protein, 30 aa, Entamoeba histolytica; identical to SEQ ID NO: 2479518

SEQ ID NO: 2673572 - protein, 21 aa, Entamoeba histolytica
ELILKKRKKLSLTVVSSTPTN

SEQ ID NO: 2673573 - protein, 21 aa, Entamoeba histolytica
ELINALNFIICLSDSHERVDD

SEQ ID NO: 2673574 - protein, 19 aa, Entamoeba histolytica
ELIPIISILFDMEINHCFI

SEQ ID NO: 2673575 - protein, 27 aa, Entamoeba histolytica
ELIRFFNQIWICYQPTEIELWKVLTNC

SEQ ID NO: 2673576 - protein, 17 aa, Entamoeba histolytica
ELISLPLTLLDVSNNQI

SEQ ID NO: 2673577 - protein, 18 aa, Entamoeba histolytica
ELITRMSNEPELIYEMKS

SEQ ID NO: 2673578 - protein, 25 aa, Entamoeba histolytica
ELKAICCSHGPVLRTNIKENIERYK

SEQ ID NO: 2673579 - protein, 34 aa, Entamoeba histolytica
ELKCVKYMECSALTRKGLKEVFETAVKYVLENNA

SEQ ID NO: 2673580 - protein, 18 aa, Entamoeba histolytica
ELKECLPLAPIHNPSSFG

SEQ ID NO: 2673581 - protein, 17 aa, Entamoeba histolytica
ELKECPSLSSLVSLSDA

SEQ ID NO: 2673582 - protein, 23 aa, Entamoeba histolytica
ELKEGQCAVGLPLEEIYIRITEV

SEQ ID NO: 2673583 - protein, 21 aa, Entamoeba histolytica
ELKEVVQYPVEFPDKFRKFGM

SEQ ID NO: 2673584 - protein, 25 aa, Entamoeba histolytica
ELKGDYCSECGNIILQEVDKVLKLP

SEQ ID NO: 2673585 - protein, 22 aa, Entamoeba histolytica
ELKGNPLENFDMFQPTEETQNE

SEQ ID NO: 2673586 - protein, 26 aa, Entamoeba histolytica
ELKGNVRVFCRVRPPLKNEGISVGVT

SEQ ID NO: 2673587 - protein, 20 aa, Entamoeba histolytica
ELKGTAGYVRLNFENATDAA

SEQ ID NO: 2673588 - protein, 20 aa, Entamoeba histolytica
ELKIKVLIKGNRIGYIHYCD

SEQ ID NO: 2673589 - protein, 17 aa, Entamoeba histolytica
ELKKAYRKLAIKYHPDK

SEQ ID NO: 2673590 - protein, 18 aa, Entamoeba histolytica
ELKKCKHPQLKAEAQLYA

SEQ ID NO: 2673591 - protein, 30 aa, Entamoeba histolytica
ELKKEGYILKRWVARYVLVKRNYLIYFVSD

SEQ ID NO: 2673592 - protein, 23 aa, Entamoeba histolytica
ELKKENVDGIIFLVGNKIDVTNS

SEQ ID NO: 2673593 - protein, 33 aa, Entamoeba histolytica
ELKKKCDAQDSLLKTKMKSEMEAKKKVEILENE

SEQ ID NO: 2673594 - protein, 36 aa, Entamoeba histolytica; identical to SEQ ID NO: 2479537

SEQ ID NO: 2673595 - protein, 23 aa, Entamoeba histolytica
ELKKTDCFKRLIEVSDAAIRIMG

SEQ ID NO: 2673596 - protein, 21 aa, Entamoeba histolytica
ELKLERCFNLDINIPSKKLKS

SEQ ID NO: 2673597 - protein, 24 aa, Entamoeba histolytica
ELKLKAICTLGRALGKAIKLDNAE

SEQ ID NO: 2673598 - protein, 20 aa, Entamoeba histolytica
ELKNRIKAVKYIECSAKTSE

SEQ ID NO: 2673599 - protein, 23 aa, Entamoeba histolytica
ELKQIKSGIIPKAIEEIKDINEN

SEQ ID NO: 2673600 - protein, 29 aa, Entamoeba histolytica
ELKQLEWKWGICMAIGFQEFIECKLKGTP

SEQ ID NO: 2673601 - protein, 23 aa, Entamoeba histolytica
ELKQMPLGLSFTSLFNIKHYPFT

SEQ ID NO: 2673602 - protein, 21 aa, Entamoeba histolytica
ELKRRMQQFLAKRNQKMEIEE

SEQ ID NO: 2673603 - protein, 20 aa, Entamoeba histolytica
ELKRSLKLLEEIKMIQVNEI

SEQ ID NO: 2673604 - protein, 23 aa, Entamoeba histolytica
ELKSNETLIQFVLKEENIEKCIK

SEQ ID NO: 2673605 - protein, 20 aa, Entamoeba histolytica
ELKTKACGLLKETVAQDRFS

SEQ ID NO: 2673606 - protein, 24 aa, Entamoeba histolytica
ELKVIPCLRKGRVLSKSIKLNELP

SEQ ID NO: 2673607 - protein, 21 aa, Entamoeba histolytica
ELLEGYPPHYELRGEELMKAI

SEQ ID NO: 2673608 - protein, 24 aa, Entamoeba histolytica
ELLEILKARIVYFAHKLTILFRNQ

SEQ ID NO: 2673609 - protein, 23 aa, Entamoeba histolytica
ELLEKGKNCFFEIVKSYRKMIRT

SEQ ID NO: 2673610 - protein, 21 aa, Entamoeba histolytica
ELLEKWKQFQSWLKGKNIFEY

SEQ ID NO: 2673611 - protein, 19 aa, Entamoeba histolytica
ELLGVVWEIIHFKPKDEGK

SEQ ID NO: 2673612 - protein, 17 aa, Entamoeba histolytica
ELLKICKDILIGERAFS

SEQ ID NO: 2673613 - protein, 21 aa, Entamoeba histolytica
ELLKVLFVLHIQWTQYEGDWI

SEQ ID NO: 2673614 - protein, 19 aa, Entamoeba histolytica
ELLLGCTSRCRTIFDAYVK

SEQ ID NO: 2673615 - protein, 21 aa, Entamoeba histolytica
ELLNIIKWNGIQKHIILVLNK

SEQ ID NO: 2673616 - protein, 19 aa, Entamoeba histolytica
ELLNRYPIIPNKNESFKRL

SEQ ID NO: 2673617 - protein, 19 aa, Entamoeba histolytica
ELLQLPHFILKNKEQRKSE

SEQ ID NO: 2673618 - protein, 25 aa, Entamoeba histolytica
ELLRKTGKPKFCFKKENCLIAACQV

SEQ ID NO: 2673619 - protein, 24 aa, Entamoeba histolytica
ELLRMRRARYGNAKKPIPSSASSA

SEQ ID NO: 2673620 - protein, 20 aa, Entamoeba histolytica
ELLSKLGFAHFAAAEAFVRY

SEQ ID NO: 2673621 - protein, 19 aa, Entamoeba histolytica
ELLTNIFIKKIISLLTQEH

SEQ ID NO: 2673622 - protein, 20 aa, Entamoeba histolytica
ELMIKKGVLKEEWLNRINPL

SEQ ID NO: 2673623 - protein, 22 aa, Entamoeba histolytica
ELMKRYDVFLVEIRVCHLISIL

SEQ ID NO: 2673624 - protein, 19 aa, Entamoeba histolytica
ELNCSKGFDSFIIDMYFPS

SEQ ID NO: 2673625 - protein, 25 aa, Entamoeba histolytica
ELNELVETIPLIGYMSKRIQKLDAK

SEQ ID NO: 2673626 - protein, 24 aa, Entamoeba histolytica
ELNEPDLLFVKSFDELIALCQKHK

SEQ ID NO: 2673627 - protein, 21 aa, Entamoeba histolytica
ELNFLKGKCEILENENEELRR

SEQ ID NO: 2673628 - protein, 21 aa, Entamoeba histolytica
ELNHFKLLLQENIQYKSKEQE

SEQ ID NO: 2673629 - protein, 20 aa, Entamoeba histolytica
ELNIHKGKIDNMMLEAMELV

SEQ ID NO: 2673630 - protein, 22 aa, Entamoeba histolytica
ELNKKLWVGIFVVMRQFSNQYC

SEQ ID NO: 2673631 - protein, 23 aa, Entamoeba histolytica
ELNLKKEKRRLIVQEMYTTEKTY

SEQ ID NO: 2673632 - protein, 19 aa, Entamoeba histolytica
ELNLKWIRTNSRPCPACGT

SEQ ID NO: 2673633 - protein, 26 aa, Entamoeba histolytica
ELNLLRCNFCGEPIFNQFKNGSIDQS

SEQ ID NO: 2673634 - protein, 25 aa, Entamoeba histolytica
ELNLRLEVLKHFNFVDEHNLLTLKG

SEQ ID NO: 2673635 - protein, 24 aa, Entamoeba histolytica
ELNMARQDFKFYTAVNNEASKKVE

SEQ ID NO: 2673636 - protein, 23 aa, Entamoeba histolytica
ELNNALMSRCQLVTLKKLTDEDV

SEQ ID NO: 2673637 - protein, 24 aa, Entamoeba histolytica
ELNSIVNLVCEFRTIGPFKTLILN

SEQ ID NO: 2673638 - protein, 22 aa, Entamoeba histolytica
ELNTYVGFFYRVSFYGQAFTNI

SEQ ID NO: 2673639 - protein, 27 aa, Entamoeba histolytica
ELNVFGWREIVDPNIIFYHDLKNYNIE

SEQ ID NO: 2673640 - protein, 33 aa, Entamoeba histolytica
ELNVKLKVIDFFKEKYHGFEFSVQMSECDVIAE

SEQ ID NO: 2673641 - protein, 19 aa, Entamoeba histolytica
ELNVLKYLGCSSICNVLGV

SEQ ID NO: 2673642 - protein, 23 aa, Entamoeba histolytica
ELNVWKNTISFRLDENYIDNRLI

SEQ ID NO: 2673643 - protein, 21 aa, Entamoeba histolytica
ELPDPLIPFQYYNEFVILGRL

SEQ ID NO: 2673644 - protein, 32 aa, Entamoeba histolytica
ELPEGYLPKRIFKSTCKHIVEVSGTSFNLKYI

SEQ ID NO: 2673645 - protein, 25 aa, Entamoeba histolytica
ELPELPKHIKYLFIRTKKTKLIINQ

SEQ ID NO: 2673646 - protein, 20 aa, Entamoeba histolytica
ELPEPLITFESYDLFIDCAK

SEQ ID NO: 2673647 - protein, 23 aa, Entamoeba histolytica
ELPETDFLPSYFIVTFTTPSGTQ

SEQ ID NO: 2673648 - protein, 22 aa, Entamoeba histolytica
ELPFERRGYFTLPGISQKSIQG

SEQ ID NO: 2673649 - protein, 23 aa, Entamoeba histolytica
ELPFERRGYFTLPGISQKSIQGI

SEQ ID NO: 2673650 - protein, 20 aa, Entamoeba histolytica
ELPIASTVLHYFIELAVKIA

SEQ ID NO: 2673651 - protein, 21 aa, Entamoeba histolytica
ELPINSLVMFWDRILANLRSR

SEQ ID NO: 2673652 - protein, 25 aa, Entamoeba histolytica
ELPSSLTSIICRNCKTKSCFLPSSL

SEQ ID NO: 2673653 - protein, 26 aa, Entamoeba histolytica
ELPYKISNCEFIQRISFIDVSNLSNW

SEQ ID NO: 2673654 - protein, 19 aa, Entamoeba histolytica
ELQFFPLLETLKLTFFSPL

SEQ ID NO: 2673655 - protein, 17 aa, Entamoeba histolytica
ELQINYTDIKRMDEAIW

SEQ ID NO: 2673656 - protein, 17 aa, Entamoeba histolytica
ELQKLYLNIQPLEENLR

SEQ ID NO: 2673657 - protein, 21 aa, Entamoeba histolytica
ELQQLFPFVDPDIIKTALIDC

SEQ ID NO: 2673658 - protein, 27 aa, Entamoeba histolytica
ELQQRAIEFSQFFSYDDLRLDAVNRMP

SEQ ID NO: 2673659 - protein, 17 aa, Entamoeba histolytica
ELQRAKVGIPLYFVYTP

SEQ ID NO: 2673660 - protein, 20 aa, Entamoeba histolytica
ELQRVALVLCLGKPADVYLI

SEQ ID NO: 2673661 - protein, 20 aa, Entamoeba histolytica
ELRAFGVIFETEITQKKPGM

SEQ ID NO: 2673662 - protein, 26 aa, Entamoeba histolytica
ELRDADEIGCRFAVIFGGSELEEKKV

SEQ ID NO: 2673663 - protein, 20 aa, Entamoeba histolytica
ELRDNCFERFKGFISKTLET

SEQ ID NO: 2673664 - protein, 18 aa, Entamoeba histolytica
ELRDQLNDERKEWKEEKE

SEQ ID NO: 2673665 - protein, 24 aa, Entamoeba histolytica
ELRFQRDAILALHFIAEDFLVKLF

SEQ ID NO: 2673666 - protein, 19 aa, Entamoeba histolytica
ELRKDLFLFELEKIEKNEY

SEQ ID NO: 2673667 - protein, 20 aa, Entamoeba histolytica
ELRKKLCLIEKKIGLCQNLF

SEQ ID NO: 2673668 - protein, 25 aa, Entamoeba histolytica
ELRKPLSGKQLVFWRKLDSIENIKS

SEQ ID NO: 2673669 - protein, 21 aa, Entamoeba histolytica
ELRKSRRERRLEVKRIQGTNS

SEQ ID NO: 2673670 - protein, 23 aa, Entamoeba histolytica
ELRSECQKLLTLLTELDKSNITT

SEQ ID NO: 2673671 - protein, 18 aa, Entamoeba histolytica
ELRTAFVDDHTWVAELNS

SEQ ID NO: 2673672 - protein, 19 aa, Entamoeba histolytica
ELSECFKPLLEVFKSISCQ

SEQ ID NO: 2673673 - protein, 23 aa, Entamoeba histolytica
ELSEINEGFSCFLSGKNGNLKQS

SEQ ID NO: 2673674 - protein, 21 aa, Entamoeba histolytica
ELSEKCLKNEILLSDTPLETF

SEQ ID NO: 2673675 - protein, 19 aa, Entamoeba histolytica
ELSELMLILINDAKENTDE

SEQ ID NO: 2673676 - protein, 33 aa, Entamoeba histolytica; identical to SEQ ID NO: 2479627

SEQ ID NO: 2673677 - protein, 24 aa, Entamoeba histolytica
ELSFEICAHCLRSSERFVQLGVGC

SEQ ID NO: 2673678 - protein, 22 aa, Entamoeba histolytica
ELSFKEGDIITVLKKEGDWWLG

SEQ ID NO: 2673679 - protein, 18 aa, Entamoeba histolytica
ELSFKEGDVITVLEKSGD

SEQ ID NO: 2673680 - protein, 24 aa, Entamoeba histolytica
ELSIKIKELENIISGKEEEMNKIK

SEQ ID NO: 2673681 - protein, 23 aa, Entamoeba histolytica
ELSKKLTDLYARVLTVSKQTTES

SEQ ID NO: 2673682 - protein, 23 aa, Entamoeba histolytica
ELSLHMYGCRVVQKAIEFVDDID

SEQ ID NO: 2673683 - protein, 19 aa, Entamoeba histolytica
ELSLKKETKGFISSVLIQF

SEQ ID NO: 2673684 - protein, 22 aa, Entamoeba histolytica
ELSLQPQVCGALVMALNGEMTD

SEQ ID NO: 2673685 - protein, 22 aa, Entamoeba histolytica
ELSPILFKLIWKTENEIDHLTI

SEQ ID NO: 2673686 - protein, 20 aa, Entamoeba histolytica
ELSPMDVMQMIGRAGRPQFD

SEQ ID NO: 2673687 - protein, 21 aa, Entamoeba histolytica
ELSSGCFSHCISLKDISIPHS

SEQ ID NO: 2673688 - protein, 23 aa, Entamoeba histolytica
ELTGELYYLGIIDILMDYTARKK

SEQ ID NO: 2673689 - protein, 31 aa, Entamoeba histolytica
ELTIKAGDVIKILSKEGDWWIGELNGQTGQF

SEQ ID NO: 2673690 - protein, 25 aa, Entamoeba histolytica
ELTMIMLDFIKRGIKRLSVLLSGYH

SEQ ID NO: 2673691 - protein, 18 aa, Entamoeba histolytica
ELTNFIFEKYITSLPQNE

SEQ ID NO: 2673692 - protein, 25 aa, Entamoeba histolytica
ELTPVKLPKVFRILEDYITKNFTNE

SEQ ID NO: 2673693 - protein, 19 aa, Entamoeba histolytica
ELTVEGGDRIYIYGTVDSV

SEQ ID NO: 2673694 - protein, 20 aa, Entamoeba histolytica
ELTVTIPVSTEWKGAMRHNG

SEQ ID NO: 2673695 - protein, 24 aa, Entamoeba histolytica
ELTYKASNLFSLSFVINKINIKPF

SEQ ID NO: 2673696 - protein, 19 aa, Entamoeba histolytica
ELVAILKLMEFIKDYGVVI

SEQ ID NO: 2673697 - protein, 26 aa, Entamoeba histolytica
ELVCHKGEVCGIDFNGSGTYIGTGAN

SEQ ID NO: 2673698 - protein, 18 aa, Entamoeba histolytica
ELVDRLGGATSNIQYAHI

SEQ ID NO: 2673699 - protein, 26 aa, Entamoeba histolytica
ELVDVVSFIHFISRYPIIPCNITDYI

SEQ ID NO: 2673700 - protein, 27 aa, Entamoeba histolytica
ELVECPFCSLKFCSLECKEKMNNQHQH

SEQ ID NO: 2673701 - protein, 19 aa, Entamoeba histolytica
ELVEYPLLHPEIYKHLGIE

SEQ ID NO: 2673702 - protein, 19 aa, Entamoeba histolytica
ELVGVLYYCISRDIQSWKG

SEQ ID NO: 2673703 - protein, 21 aa, Entamoeba histolytica
ELVKAILRGKVEFPLSLPSLF

SEQ ID NO: 2673704 - protein, 18 aa, Entamoeba histolytica
ELVKEIIHNVKIPTEKKI

SEQ ID NO: 2673705 - protein, 20 aa, Entamoeba histolytica
ELVKTEFIWPDFKGQESVDI

SEQ ID NO: 2673706 - protein, 17 aa, Entamoeba histolytica
ELVQLMSIISYLSQPSL

SEQ ID NO: 2673707 - protein, 25 aa, Entamoeba histolytica
ELVRAIKENVCYVALDYDAEMKRKP

SEQ ID NO: 2673708 - protein, 23 aa, Entamoeba histolytica
ELVRLALICVINISSSDNVEEYI

SEQ ID NO: 2673709 - protein, 25 aa, Entamoeba histolytica
ELWEYLRQRMQAIAPNLSTLLGELI

SEQ ID NO: 2673710 - protein, 19 aa, Entamoeba histolytica
ELYAKFFTPEMCNRFTENS

SEQ ID NO: 2673711 - protein, 19 aa, Entamoeba histolytica
ELYFHVWMNSFFKESIGTL

SEQ ID NO: 2673712 - protein, 19 aa, Entamoeba histolytica
ELYKKPATMSLTYEFMTIT

SEQ ID NO: 2673713 - protein, 20 aa, Entamoeba histolytica
ELYLPSCLTSIGFCAFNECE

SEQ ID NO: 2673714 - protein, 18 aa, Entamoeba histolytica
ELYQRIETMIEKKLNEYK

SEQ ID NO: 2673715 - protein, 17 aa, Entamoeba histolytica
ELYSLASNGFFKALVKA

SEQ ID NO: 2673716 - protein, 25 aa, Entamoeba histolytica
ELYSRGYKRVGIMVGGYKMYHKYFI

SEQ ID NO: 2673717 - protein, 27 aa, Entamoeba histolytica
ELYTLKRLECPNVIPPYGVEQIVSESI

SEQ ID NO: 2673718 - protein, 17 aa, Entamoeba histolytica
EMAKQLLEIRDIIRENN

SEQ ID NO: 2673719 - protein, 26 aa, Entamoeba histolytica
EMCELFRIDLFGSIVYSILIEKTRKL

SEQ ID NO: 2673720 - protein, 18 aa, Entamoeba histolytica
EMCHGFKELTLLDLSNNK

SEQ ID NO: 2673721 - protein, 22 aa, Entamoeba histolytica
EMDEFKRSPILIHRDKSGSYLF

SEQ ID NO: 2673722 - protein, 17 aa, Entamoeba histolytica
EMDEVMKDIVLDDVVEQ

SEQ ID NO: 2673723 - protein, 17 aa, Entamoeba histolytica
EMDFSSFTFIKSIKSTT

SEQ ID NO: 2673724 - protein, 18 aa, Entamoeba histolytica
EMDFSSFTFIKSIKSTTS

SEQ ID NO: 2673725 - protein, 22 aa, Entamoeba histolytica
EMDPKFTFQWGYDQTLLNYLYY

SEQ ID NO: 2673726 - protein, 19 aa, Entamoeba histolytica
EMELCCKLKQWAETLKGEY

SEQ ID NO: 2673727 - protein, 23 aa, Entamoeba histolytica
EMELRKLVCMYIVNHSEKDPTNA

SEQ ID NO: 2673728 - protein, 17 aa, Entamoeba histolytica
EMEWTLSNFCFGATNQM

SEQ ID NO: 2673729 - protein, 21 aa, Entamoeba histolytica
EMFDTCIFPAISEIVSEDITL

SEQ ID NO: 2673730 - protein, 23 aa, Entamoeba histolytica
EMFTVKWKYCGNVFISTEEPSFF

SEQ ID NO: 2673731 - protein, 19 aa, Entamoeba histolytica
EMGESLKSLSIVQNGTEEL

SEQ ID NO: 2673732 - protein, 17 aa, Entamoeba histolytica
EMGFFDEEENLRALQRV

SEQ ID NO: 2673733 - protein, 31 aa, Entamoeba histolytica
EMGHRFPLRTGCGVKWDIDVLPFLTTYYGTF

SEQ ID NO: 2673734 - protein, 21 aa, Entamoeba histolytica
EMGNYCFSFCSSLTSITIPTS

SEQ ID NO: 2673735 - protein, 17 aa, Entamoeba histolytica
EMGPFKVLTHFRMMANK

SEQ ID NO: 2673736 - protein, 22 aa, Entamoeba histolytica
EMGSLRQVLEIISLRTETAPIP

SEQ ID NO: 2673737 - protein, 19 aa, Entamoeba histolytica
EMHGYPVATYCRGKLVFKD

SEQ ID NO: 2673738 - protein, 26 aa, Entamoeba histolytica
EMICLFKKKCKSYVSQIFQVIKQSFS

SEQ ID NO: 2673739 - protein, 31 aa, Entamoeba histolytica
EMIELLKLYIKTSCMPFFIMVNQHDLISFSQ

SEQ ID NO: 2673740 - protein, 18 aa, Entamoeba histolytica
EMIFKRKVDEIIVTPPTT

SEQ ID NO: 2673741 - protein, 19 aa, Entamoeba histolytica
EMIGDLPFAEIKPLENVLF

SEQ ID NO: 2673742 - protein, 23 aa, Entamoeba histolytica
EMIGMSCIENGYKTYGIQCLKNG

SEQ ID NO: 2673743 - protein, 24 aa, Entamoeba histolytica
EMIIKGEVYIGGELEHAINVDDST

SEQ ID NO: 2673744 - protein, 19 aa, Entamoeba histolytica
EMIKLYLTTILKIFIAGDE

SEQ ID NO: 2673745 - protein, 24 aa, Entamoeba histolytica
EMIKQLSAIFLDRISKGICVENTL

SEQ ID NO: 2673746 - protein, 22 aa, Entamoeba histolytica
EMIKRLNTRLEGKEGDVVGMVL

SEQ ID NO: 2673747 - protein, 17 aa, Entamoeba histolytica
EMIMKKKIQAVIDGHQK

SEQ ID NO: 2673748 - protein, 22 aa, Entamoeba histolytica
EMIRKSLKINKFVLSKEEAEKR

SEQ ID NO: 2673749 - protein, 20 aa, Entamoeba histolytica
EMIRLYDLKLLNSMLTSVSY

SEQ ID NO: 2673750 - protein, 18 aa, Entamoeba histolytica
EMISCDYLTPLQLLPDEY

SEQ ID NO: 2673751 - protein, 20 aa, Entamoeba histolytica
EMKECLELLHFIQKNWINEP

SEQ ID NO: 2673752 - protein, 17 aa, Entamoeba histolytica
EMKEFRENCGFAQTTAR

SEQ ID NO: 2673753 - protein, 20 aa, Entamoeba histolytica
EMKIFRGLETLHIDINSLEK

SEQ ID NO: 2673754 - protein, 36 aa, Entamoeba histolytica
EMKIHYKLRNCVVGCLMCGCEILPPSIYYICSECED

SEQ ID NO: 2673755 - protein, 24 aa, Entamoeba histolytica
EMKKAQMILLEFINRNDTYLKVPG

SEQ ID NO: 2673756 - protein, 20 aa, Entamoeba histolytica
EMKLIWKLRYTVKKTKPKNL

SEQ ID NO: 2673757 - protein, 20 aa, Entamoeba histolytica
EMKLRCHEMFQWNEDEYDQI

SEQ ID NO: 2673758 - protein, 19 aa, Entamoeba histolytica
EMKTIGILVKYMKRHNNQL

SEQ ID NO: 2673759 - protein, 17 aa, Entamoeba histolytica
EMLKIIIKKMEEIIISE

SEQ ID NO: 2673760 - protein, 19 aa, Entamoeba histolytica
EMLLKYGANIGQVYKGKPL

SEQ ID NO: 2673761 - protein, 20 aa, Entamoeba histolytica
EMLMTFKLYYSYDLDITLTL

SEQ ID NO: 2673762 - protein, 19 aa, Entamoeba histolytica
EMLNKEVLLKLTTKALTVF

SEQ ID NO: 2673763 - protein, 22 aa, Entamoeba histolytica
EMLSNKIGERIKVQEEKKEKIV

SEQ ID NO: 2673764 - protein, 24 aa, Entamoeba histolytica
EMLYCAHSGFISHLICCPHLEDWT

SEQ ID NO: 2673765 - protein, 25 aa, Entamoeba histolytica
EMMFNTSCCIIDPKVIDKILFDAER

SEQ ID NO: 2673766 - protein, 24 aa, Entamoeba histolytica
EMMKEGKRSLAFRLFSCKITGKQM

SEQ ID NO: 2673767 - protein, 25 aa, Entamoeba histolytica
EMNKLEGLKQKWTLYEDEMKKEVQE

SEQ ID NO: 2673768 - protein, 18 aa, Entamoeba histolytica
EMNKTIMEWVRDGTDITN

SEQ ID NO: 2673769 - protein, 23 aa, Entamoeba histolytica
EMPDCSVSLTLRDTCGQEQYKSL

SEQ ID NO: 2673770 - protein, 22 aa, Entamoeba histolytica
EMPEVQTIRKWLKCAAGNKYRM

SEQ ID NO: 2673771 - protein, 17 aa, Entamoeba histolytica
EMRCGITKSIIYKFHPF

SEQ ID NO: 2673772 - protein, 19 aa, Entamoeba histolytica
EMRKCCDKYHTGQVTARQI

SEQ ID NO: 2673773 - protein, 19 aa, Entamoeba histolytica
EMRRNEMEYISSLPERDPD

SEQ ID NO: 2673774 - protein, 19 aa, Entamoeba histolytica
EMSEDLSIDLEKDDEVSTG

SEQ ID NO: 2673775 - protein, 25 aa, Entamoeba histolytica
EMSELKEVYGCIGNVIKYEDHESSI

SEQ ID NO: 2673776 - protein, 22 aa, Entamoeba histolytica
EMSIQFSNLYSFLRNEPKTPRL

SEQ ID NO: 2673777 - protein, 18 aa, Entamoeba histolytica
EMSLPLDARFRIKKPIPN

SEQ ID NO: 2673778 - protein, 25 aa, Entamoeba histolytica
EMTDCSAWYFGEVELQFEDEDQFVH

SEQ ID NO: 2673779 - protein, 20 aa, Entamoeba histolytica
EMTEPQIAYVCRETLRALNF

SEQ ID NO: 2673780 - protein, 22 aa, Entamoeba histolytica
EMTLNQLFICFCCEKEKEKIQS

SEQ ID NO: 2673781 - protein, 21 aa, Entamoeba histolytica
EMTMPVPCFNVINGGAHAGNA

SEQ ID NO: 2673782 - protein, 22 aa, Entamoeba histolytica
EMVHYRLPIGINTSIFGYLNFG

SEQ ID NO: 2673783 - protein, 20 aa, Entamoeba histolytica
EMVIVPLILGQGTDWDKINP

SEQ ID NO: 2673784 - protein, 17 aa, Entamoeba histolytica
EMVKAYGENGVSLFDGE

SEQ ID NO: 2673785 - protein, 26 aa, Entamoeba histolytica
EMVKELADFLFAPKLLKRDFKLSCIE

SEQ ID NO: 2673786 - protein, 19 aa, Entamoeba histolytica
EMVLCCIDYLIKQEKTPIV

SEQ ID NO: 2673787 - protein, 18 aa, Entamoeba histolytica
EMVLELFSVLNYGQILDM

SEQ ID NO: 2673788 - protein, 19 aa, Entamoeba histolytica
EMVLELFSVLNYGQILDMS

SEQ ID NO: 2673789 - protein, 23 aa, Entamoeba histolytica
EMWRECTEFCTSKTCLIADKLMD

SEQ ID NO: 2673790 - protein, 17 aa, Entamoeba histolytica
EMYCYTCQCVICSVCQR

SEQ ID NO: 2673791 - protein, 21 aa, Entamoeba histolytica
EMYLKPIVRRNDIIIKQQKPK

SEQ ID NO: 2673792 - protein, 17 aa, Entamoeba histolytica
EMYYEYLNNPIISYYLM

SEQ ID NO: 2673793 - protein, 22 aa, Entamoeba histolytica
ENAAALAKEWHMLFYEVSAKTN

SEQ ID NO: 2673794 - protein, 25 aa, Entamoeba histolytica
ENAEGKRTTPSCVSFTPTGILVGEA

SEQ ID NO: 2673795 - protein, 24 aa, Entamoeba histolytica
ENAKIGVCQFCISPPKTNMDGNVV

SEQ ID NO: 2673796 - protein, 24 aa, Entamoeba histolytica
ENALFLFRWMSLLLTEELPINSLV

SEQ ID NO: 2673797 - protein, 17 aa, Entamoeba histolytica
ENAREALGLIVEMVKAK

SEQ ID NO: 2673798 - protein, 17 aa, Entamoeba histolytica
ENARLRLNASNALSDLL

SEQ ID NO: 2673799 - protein, 17 aa, Entamoeba histolytica
ENCRLLWKYRYLVEKTK

SEQ ID NO: 2673800 - protein, 21 aa, Entamoeba histolytica
ENDATDGIIVFFAEGVSLKTD

SEQ ID NO: 2673801 - protein, 20 aa, Entamoeba histolytica
ENDFILPITKLIISIITHPS

SEQ ID NO: 2673802 - protein, 23 aa, Entamoeba histolytica
ENDFKPRDALAIFKDMTDEDVRV

SEQ ID NO: 2673803 - protein, 25 aa, Entamoeba histolytica
ENDKCFLCGKFSSMVDARTGKFYCN

SEQ ID NO: 2673804 - protein, 30 aa, Entamoeba histolytica
ENDLECLTFIRDVWKSSSVRWQMARNYILW

SEQ ID NO: 2673805 - protein, 20 aa, Entamoeba histolytica
ENDLLIGLLRLRLPTNEKFM

SEQ ID NO: 2673806 - protein, 29 aa, Entamoeba histolytica
ENDPNRCCKACVFNNFIPGYDCKIGDACL

SEQ ID NO: 2673807 - protein, 23 aa, Entamoeba histolytica
ENDSFPSIHSFILAGNGVHNNLK

SEQ ID NO: 2673808 - protein, 18 aa, Entamoeba histolytica
ENEECKGINIEKDVKGKD

SEQ ID NO: 2673809 - protein, 25 aa, Entamoeba histolytica
ENEESRLSGNFKREYEDNGQTIIDH

SEQ ID NO: 2673810 - protein, 17 aa, Entamoeba histolytica
ENEHILFVQYLKQELEE

SEQ ID NO: 2673811 - protein, 18 aa, Entamoeba histolytica
ENEIKELERLITTIKEEI

SEQ ID NO: 2673812 - protein, 43 aa, Entamoeba histolytica
ENEIRYCLNPTFLNTLLYEWYELRKLKAIDCRKIKSLINQFTH

SEQ ID NO: 2673813 - protein, 41 aa, Entamoeba histolytica
ENEIRYCLTPTFLNTLLYEWYELRKLKAIDYRVLKKQIDQF

SEQ ID NO: 2673814 - protein, 25 aa, Entamoeba histolytica
ENEKEIPKDFSFEDQDGFKISSDDE

SEQ ID NO: 2673815 - protein, 21 aa, Entamoeba histolytica
ENELEYCLSLLYSTLSIRCNF

SEQ ID NO: 2673816 - protein, 22 aa, Entamoeba histolytica
ENELPMSCCSYINTNLKEVSIS

SEQ ID NO: 2673817 - protein, 20 aa, Entamoeba histolytica
ENENECYYCSQSPNELNAIK

SEQ ID NO: 2673818 - protein, 20 aa, Entamoeba histolytica
ENEQLKRGNGIIIGADKLEK

SEQ ID NO: 2673819 - protein, 24 aa, Entamoeba histolytica
ENERGIVRLAGIILINAQVEKNSL

SEQ ID NO: 2673820 - protein, 20 aa, Entamoeba histolytica
ENFCEFKASVAVLINQSTLY

SEQ ID NO: 2673821 - protein, 17 aa, Entamoeba histolytica
ENFDFSLNFLLNEGERI

SEQ ID NO: 2673822 - protein, 27 aa, Entamoeba histolytica
ENFFTYKRYKFGVLYAAPGQTKEMEFF

SEQ ID NO: 2673823 - protein, 32 aa, Entamoeba histolytica
ENFKRVGMLHFLTYYYGMDWHKVANAPQGDNS

SEQ ID NO: 2673824 - protein, 29 aa, Entamoeba histolytica
ENGAWKSFYGLHCAYDFIEYISTIDSPIC

SEQ ID NO: 2673825 - protein, 17 aa, Entamoeba histolytica
ENGGYSWWRRNSLTVFL

SEQ ID NO: 2673826 - protein, 24 aa, Entamoeba histolytica
ENGIRKLDLEYGDFPDDGYDYSQH

SEQ ID NO: 2673827 - protein, 22 aa, Entamoeba histolytica
ENGKKASFFGVFDGHGGDQVAE

SEQ ID NO: 2673828 - protein, 17 aa, Entamoeba histolytica
ENGLFLDMCTVVLKTLR

SEQ ID NO: 2673829 - protein, 26 aa, Entamoeba histolytica
ENGLKKYIRLMLSLDFSCHQYYLFDS

SEQ ID NO: 2673830 - protein, 20 aa, Entamoeba histolytica
ENGQRLAIHNSLRKQRRQKL

SEQ ID NO: 2673831 - protein, 18 aa, Entamoeba histolytica
ENHGFFLYDKQLFVDYIL

SEQ ID NO: 2673832 - protein, 26 aa, Entamoeba histolytica
ENHNRIISLMKWYKIKKMTFLKNWKV

SEQ ID NO: 2673833 - protein, 19 aa, Entamoeba histolytica
ENIFLKGMVKVLSYKKERQ

SEQ ID NO: 2673834 - protein, 17 aa, Entamoeba histolytica
ENIKIKCMFSDLKDDNE

SEQ ID NO: 2673835 - protein, 20 aa, Entamoeba histolytica
ENIKSLSKETTWWRNRTAII

SEQ ID NO: 2673836 - protein, 24 aa, Entamoeba histolytica
ENIKSYLGHVFKCRDEVKWAEFEY

SEQ ID NO: 2673837 - protein, 19 aa, Entamoeba histolytica
ENIRRIGDCAFKLCKSLSS

SEQ ID NO: 2673838 - protein, 26 aa, Entamoeba histolytica
ENIRSDAFFGTFLRQKVEAFNQTLPR

SEQ ID NO: 2673839 - protein, 24 aa, Entamoeba histolytica
ENISSYFTECFKFIDNALKPVLVH

SEQ ID NO: 2673840 - protein, 21 aa, Entamoeba histolytica
ENKEKCLWYLLDNVGISIIYS

SEQ ID NO: 2673841 - protein, 25 aa, Entamoeba histolytica
ENKEKRRRECLTISILNEENLKLLQ

SEQ ID NO: 2673842 - protein, 24 aa, Entamoeba histolytica
ENKELKAKLSREVKSLIDELIQQI

SEQ ID NO: 2673843 - protein, 19 aa, Entamoeba histolytica
ENKELKNSVLENTEKIKEK

SEQ ID NO: 2673844 - protein, 17 aa, Entamoeba histolytica
ENKEVVEGIYVIFNLII

SEQ ID NO: 2673845 - protein, 28 aa, Entamoeba histolytica
ENKFINEFNHQYILFSYGKHDRYKHPST

SEQ ID NO: 2673846 - protein, 25 aa, Entamoeba histolytica
ENKFLAYSVGYDWHQGVEGLLQQQV

SEQ ID NO: 2673847 - protein, 17 aa, Entamoeba histolytica
ENKGLTYEQVFQAVAAL

SEQ ID NO: 2673848 - protein, 31 aa, Entamoeba histolytica
ENKHKRAYKEYKIYLKGEDISKVTEEPSNPS

SEQ ID NO: 2673849 - protein, 20 aa, Entamoeba histolytica
ENKHTFHVMIWRNKDVGTFK

SEQ ID NO: 2673850 - protein, 19 aa, Entamoeba histolytica
ENKKKIVKRTRRVTSVQEL

SEQ ID NO: 2673851 - protein, 22 aa, Entamoeba histolytica
ENKKPSGLGRVFIEFKTIEGAI

SEQ ID NO: 2673852 - protein, 20 aa, Entamoeba histolytica
ENKNFRIAIDAIKTENSLLE

SEQ ID NO: 2673853 - protein, 18 aa, Entamoeba histolytica
ENKNLFNFEESAEEPTKE

SEQ ID NO: 2673854 - protein, 26 aa, Entamoeba histolytica
ENKPVCFDLLFSFMTDYIYFPRVLSE

SEQ ID NO: 2673855 - protein, 24 aa, Entamoeba histolytica
ENKRKCKSIVNCLEIHCYKKGDND

SEQ ID NO: 2673856 - protein, 23 aa, Entamoeba histolytica
ENKSFYDCVLFFSPSKKCCIKNP

SEQ ID NO: 2673857 - protein, 17 aa, Entamoeba histolytica
ENKVFDLNAICFVTLPN

SEQ ID NO: 2673858 - protein, 17 aa, Entamoeba histolytica
ENKVLDLNAICFVAQSS

SEQ ID NO: 2673859 - protein, 26 aa, Entamoeba histolytica
ENKVRGCSYCYGFQGVDEFLKKNEIT

SEQ ID NO: 2673860 - protein, 35 aa, Entamoeba histolytica
ENLAVKADNKFCFDCGKGGATFVVSNFNIFVCPTC

SEQ ID NO: 2673861 - protein, 17 aa, Entamoeba histolytica
ENLCKKFPFAQEDTLYL

SEQ ID NO: 2673862 - protein, 25 aa, Entamoeba histolytica
ENLDFSYKLLRGIINYCNYPDPDIR

SEQ ID NO: 2673863 - protein, 20 aa, Entamoeba histolytica
ENLISSKPQTKFAIYNTEKI

SEQ ID NO: 2673864 - protein, 17 aa, Entamoeba histolytica
ENLKKEKEEIIQNQQRK

SEQ ID NO: 2673865 - protein, 22 aa, Entamoeba histolytica
ENLKKIIQFEGFVEQEYLIMAN

SEQ ID NO: 2673866 - protein, 17 aa, Entamoeba histolytica
ENLKLIVENGVSKVPHS

SEQ ID NO: 2673867 - protein, 21 aa, Entamoeba histolytica
ENLKNAIKEEGVDNTIPVIEE

SEQ ID NO: 2673868 - protein, 22 aa, Entamoeba histolytica
ENLKNAIKEEGVDNTIPVIEER

SEQ ID NO: 2673869 - protein, 21 aa, Entamoeba histolytica
ENLKYITPFISKWNEAESKLV

SEQ ID NO: 2673870 - protein, 19 aa, Entamoeba histolytica
ENLLKCTIVRIMKHSKVMS

SEQ ID NO: 2673871 - protein, 29 aa, Entamoeba histolytica
ENLLSLCSCLPCISLGMNCKLNNKIITPT

SEQ ID NO: 2673872 - protein, 30 aa, Entamoeba histolytica
ENLLSLSLQQIMKFSGSFAAALNGTDTNIH

SEQ ID NO: 2673873 - protein, 23 aa, Entamoeba histolytica
ENLMKYRDVIVIGTDLLFDTTTF

SEQ ID NO: 2673874 - protein, 19 aa, Entamoeba histolytica
ENLNPLKNFFVIRDPDLGA

SEQ ID NO: 2673875 - protein, 18 aa, Entamoeba histolytica
ENLRCFVWSPSFVSMQKL

SEQ ID NO: 2673876 - protein, 22 aa, Entamoeba histolytica
ENLRRLRFIIVKTKGNCIDTLI

SEQ ID NO: 2673877 - protein, 21 aa, Entamoeba histolytica
ENLRVLPLCIYNIIFNMKKKR

SEQ ID NO: 2673878 - protein, 23 aa, Entamoeba histolytica
ENLYFSLPFPFCVIDPLKQTIAR

SEQ ID NO: 2673879 - protein, 17 aa, Entamoeba histolytica
ENMILLLKKGVFHPKFV

SEQ ID NO: 2673880 - protein, 23 aa, Entamoeba histolytica
ENMIVKLIENVSCSMYSENSTCS

SEQ ID NO: 2673881 - protein, 20 aa, Entamoeba histolytica
ENMMKTMFCVIYREANTKNF

SEQ ID NO: 2673882 - protein, 32 aa, Entamoeba histolytica
ENNEKEYCWCYKRKGTTRSSLVIFNNDSETIY

SEQ ID NO: 2673883 - protein, 22 aa, Entamoeba histolytica
ENNKGAIDWNYGVIAFGSRTNV

SEQ ID NO: 2673884 - protein, 25 aa, Entamoeba histolytica
ENNKLSDLEIIGWTPIESNALRVII

SEQ ID NO: 2673885 - protein, 19 aa, Entamoeba histolytica
ENNKPVFGLILKKYINEGE

SEQ ID NO: 2673886 - protein, 23 aa, Entamoeba histolytica
ENNLKLILEFIKSQNIKVTTTVQ

SEQ ID NO: 2673887 - protein, 25 aa, Entamoeba histolytica
ENNLYRLLCWTGKDIWACTKPTNNK

SEQ ID NO: 2673888 - protein, 20 aa, Entamoeba histolytica
ENNNVFGWYFPQGINENGIG

SEQ ID NO: 2673889 - protein, 25 aa, Entamoeba histolytica
ENNRIISYVPWWTIVEMANNIFGDD

SEQ ID NO: 2673890 - protein, 17 aa, Entamoeba histolytica
ENNTWIATKLVELIPKY

SEQ ID NO: 2673891 - protein, 24 aa, Entamoeba histolytica
ENPAYKRRLTCVLHGHTHDSQGLV

SEQ ID NO: 2673892 - protein, 24 aa, Entamoeba histolytica
ENPDVKISYGLVKKVLEQQALLPA

SEQ ID NO: 2673893 - protein, 25 aa, Entamoeba histolytica
ENPELIKQICFFLIPSVSLGYKDCF

SEQ ID NO: 2673894 - protein, 17 aa, Entamoeba histolytica
ENPKRWVMDYVNAGASL

SEQ ID NO: 2673895 - protein, 30 aa, Entamoeba histolytica
ENPSFRLEPAFPQWQRRGIAIDDSYPYENC

SEQ ID NO: 2673896 - protein, 18 aa, Entamoeba histolytica
ENQARCIDVAMRLTEVAV

SEQ ID NO: 2673897 - protein, 19 aa, Entamoeba histolytica
ENQARCIDVAMRLTEVAVK

SEQ ID NO: 2673898 - protein, 23 aa, Entamoeba histolytica
ENQKLGIPETISFDPIDLPLENP

SEQ ID NO: 2673899 - protein, 24 aa, Entamoeba histolytica
ENQRESWWLAYIMDQIEEEKSKGI

SEQ ID NO: 2673900 - protein, 26 aa, Entamoeba histolytica
ENQVLKQKALCLFYERYPEAVSEVMF

SEQ ID NO: 2673901 - protein, 27 aa, Entamoeba histolytica
ENQVLKQKALCLFYERYPEAVSEVMFP

SEQ ID NO: 2673902 - protein, 26 aa, Entamoeba histolytica
ENRIPSWCDRVLWKTENRHFVEAKEY

SEQ ID NO: 2673903 - protein, 17 aa, Entamoeba histolytica
ENRNGWMNIGMVDGKSQ

SEQ ID NO: 2673904 - protein, 21 aa, Entamoeba histolytica
ENSERFLVKHPKLLIDDISLV

SEQ ID NO: 2673905 - protein, 24 aa, Entamoeba histolytica
ENSLDLLSCEQCDFSDKIYEALTS

SEQ ID NO: 2673906 - protein, 21 aa, Entamoeba histolytica
ENSLYWGRHKAALAFLATYTG

SEQ ID NO: 2673907 - protein, 24 aa, Entamoeba histolytica
ENSYELCIIFILINEGFPENIVRE

SEQ ID NO: 2673908 - protein, 18 aa, Entamoeba histolytica
ENTCSSFLFTTEPTLFDF

SEQ ID NO: 2673909 - protein, 26 aa, Entamoeba histolytica
ENTDPVIAFHFCVKAKTLTEEQYQGE

SEQ ID NO: 2673910 - protein, 22 aa, Entamoeba histolytica
ENTFDFILCIIRMISCKRFFLL

SEQ ID NO: 2673911 - protein, 18 aa, Entamoeba histolytica
ENTFLQDRIRDFLNSNNG

SEQ ID NO: 2673912 - protein, 33 aa, Entamoeba histolytica
ENTKIPSLLSHYIQLYFLPAVRSLVIDEIRRSF

SEQ ID NO: 2673913 - protein, 23 aa, Entamoeba histolytica
ENTKKVVFDICINKLSKSREENK

SEQ ID NO: 2673914 - protein, 18 aa, Entamoeba histolytica
ENTMRWYHTFCGDCLSNG

SEQ ID NO: 2673915 - protein, 24 aa, Entamoeba histolytica
ENTSLKRALLFAHFQRRVITDGRM

SEQ ID NO: 2673916 - protein, 26 aa, Entamoeba histolytica
ENVEAKCALIYLCGEFVTKITNAKEF

SEQ ID NO: 2673917 - protein, 20 aa, Entamoeba histolytica
ENVFYYYAYNAFGGWVPTWV

SEQ ID NO: 2673918 - protein, 19 aa, Entamoeba histolytica
ENVLHIVEIMSLYTNGMVF

SEQ ID NO: 2673919 - protein, 25 aa, Entamoeba histolytica
ENVMKYSWILFTILFKGIVMMTNSG

SEQ ID NO: 2673920 - protein, 23 aa, Entamoeba histolytica
ENVSKIITCLAFITNNNFKTKEY

SEQ ID NO: 2673921 - protein, 18 aa, Entamoeba histolytica
ENVSNWIDACNKIEEKRV

SEQ ID NO: 2673922 - protein, 18 aa, Entamoeba histolytica
ENVWDYCNKFGEFDPENH

SEQ ID NO: 2673923 - protein, 17 aa, Entamoeba histolytica
ENWCCSNQFNILYNSSI

SEQ ID NO: 2673924 - protein, 18 aa, Entamoeba histolytica
ENWCKLGYSKIILFETSK

SEQ ID NO: 2673925 - protein, 19 aa, Entamoeba histolytica
ENYLSEGLYLFNYNGREIP

SEQ ID NO: 2673926 - protein, 19 aa, Entamoeba histolytica
ENYSLFFYITVLIRQIVES

SEQ ID NO: 2673927 - protein, 25 aa, Entamoeba histolytica
ENYTEFKRLALLLTNLPTKRLRDIS

SEQ ID NO: 2673928 - protein, 21 aa, Entamoeba histolytica
ENYTRNDLLPWREEMEEVQTI

SEQ ID NO: 2673929 - protein, 20 aa, Entamoeba histolytica
EPAHFFPGFIEMLKEFRRLG

SEQ ID NO: 2673930 - protein, 17 aa, Entamoeba histolytica
EPASCKELSEWESLYQE

SEQ ID NO: 2673931 - protein, 20 aa, Entamoeba histolytica
EPDCHIVAKMVLYDFQRGRL

SEQ ID NO: 2673932 - protein, 17 aa, Entamoeba histolytica
EPDEHICMVLCGNKCDM

SEQ ID NO: 2673933 - protein, 31 aa, Entamoeba histolytica; identical to SEQ ID NO: 2479912

SEQ ID NO: 2673934 - protein, 22 aa, Entamoeba histolytica
EPEEISGMILKYIYDIVKRRIG

SEQ ID NO: 2673935 - protein, 20 aa, Entamoeba histolytica
EPEIKKEVIVMKKDIIQVDD

SEQ ID NO: 2673936 - protein, 27 aa, Entamoeba histolytica
EPFDIKGKCILPKFQFEISPKKFLIIN

SEQ ID NO: 2673937 - protein, 22 aa, Entamoeba histolytica
EPGRYMASNAFHLVSSLHGKRV

SEQ ID NO: 2673938 - protein, 28 aa, Entamoeba histolytica
EPICKDLIRLIELFKLRYNYLKKSSNED

SEQ ID NO: 2673939 - protein, 21 aa, Entamoeba histolytica
EPIDIKLPFLLKFLSIKNPLS

SEQ ID NO: 2673940 - protein, 20 aa, Entamoeba histolytica
EPIELSAKYLPRFFKHNNFS

SEQ ID NO: 2673941 - protein, 26 aa, Entamoeba histolytica
EPIGNIKSAILLYWNVRARYEHDIGL

SEQ ID NO: 2673942 - protein, 25 aa, Entamoeba histolytica
EPIISRFDLIMIVRDVVDYEKDYKL

SEQ ID NO: 2673943 - protein, 24 aa, Entamoeba histolytica
EPINPRPESLWNILNNKEIQCRFV

SEQ ID NO: 2673944 - protein, 19 aa, Entamoeba histolytica
EPIPQLGFENEFLCNFHET

SEQ ID NO: 2673945 - protein, 26 aa, Entamoeba histolytica
EPIRFLPPVEKHWFPNYSGVSSYLTM

SEQ ID NO: 2673946 - protein, 19 aa, Entamoeba histolytica
EPISFLFIDTLTFNTINSK

SEQ ID NO: 2673947 - protein, 24 aa, Entamoeba histolytica
EPIVKNKYDILAQIQLEQQQQQSS

SEQ ID NO: 2673948 - protein, 23 aa, Entamoeba histolytica
EPIVKNKYDILAQIQLEQQQQSS

SEQ ID NO: 2673949 - protein, 22 aa, Entamoeba histolytica
EPKAKCKKTERVLDKCKEAVLC

SEQ ID NO: 2673950 - protein, 18 aa, Entamoeba histolytica
EPKFKEDIIKEIETTRGK

SEQ ID NO: 2673951 - protein, 23 aa, Entamoeba histolytica
EPKICTYTHFAMINPFITIDHTT

SEQ ID NO: 2673952 - protein, 23 aa, Entamoeba histolytica
EPKINTITPLDWVKGKDPRFKIT

SEQ ID NO: 2673953 - protein, 24 aa, Entamoeba histolytica
EPKINTITPLDWVKGKDPRFKITR

SEQ ID NO: 2673954 - protein, 17 aa, Entamoeba histolytica
EPKRFLIDILPSVPPTI

SEQ ID NO: 2673955 - protein, 27 aa, Entamoeba histolytica
EPLRGLRVLNFNGCKNFSEYSLKEMED

SEQ ID NO: 2673956 - protein, 19 aa, Entamoeba histolytica
EPMNLLLKIADFNTSREIS

SEQ ID NO: 2673957 - protein, 23 aa, Entamoeba histolytica
EPNAFNLHSFILVYTSLSSLNNY

SEQ ID NO: 2673958 - protein, 22 aa, Entamoeba histolytica
EPNEVYHLLEIIRILVSSQNTQ

SEQ ID NO: 2673959 - protein, 24 aa, Entamoeba histolytica
EPNIPIEGSIKFDISLHNTKMEVA

SEQ ID NO: 2673960 - protein, 17 aa, Entamoeba histolytica
EPNSKWVLFTMVELYQI

SEQ ID NO: 2673961 - protein, 31 aa, Entamoeba histolytica
EPNTFKSSLKRFSYCPVLFSNNDENIKEIKE

SEQ ID NO: 2673962 - protein, 21 aa, Entamoeba histolytica
EPPHSGLFCDLLWSDPTSDSF

SEQ ID NO: 2673963 - protein, 21 aa, Entamoeba histolytica
EPPNCYTPHFSLLQPQIEEDP

SEQ ID NO: 2673964 - protein, 20 aa, Entamoeba histolytica
EPPSEGSLCDLLWSDPVSEW

SEQ ID NO: 2673965 - protein, 21 aa, Entamoeba histolytica
EPPTSGAMCDLLWSDPLDQPH

SEQ ID NO: 2673966 - protein, 23 aa, Entamoeba histolytica
EPQCGKTSLLFAYIKNEFLDEFT

SEQ ID NO: 2673967 - protein, 18 aa, Entamoeba histolytica
EPQKRPTFKEIYKILEKV

SEQ ID NO: 2673968 - protein, 24 aa, Entamoeba histolytica
EPQQQAFEPFDFNKFEEVKPVPQQ

SEQ ID NO: 2673969 - protein, 21 aa, Entamoeba histolytica
EPRIKPQWWVNCKNMARRAVE

SEQ ID NO: 2673970 - protein, 20 aa, Entamoeba histolytica
EPRRQWLRRMEIIHLEDEPA

SEQ ID NO: 2673971 - protein, 28 aa, Entamoeba histolytica
EPSNSFVCICCNTLFFAEKNILRYCSFG

SEQ ID NO: 2673972 - protein, 22 aa, Entamoeba histolytica
EPTYPCAIINNFATLSLDQPYI

SEQ ID NO: 2673973 - protein, 24 aa, Entamoeba histolytica
EPVDEFKSAFYLLLNARARYQGDI

SEQ ID NO: 2673974 - protein, 23 aa, Entamoeba histolytica
EPVDEIKSAFYLLDNARARYLGD

SEQ ID NO: 2673975 - protein, 19 aa, Entamoeba histolytica
EPVEFILFIHCVEAIIRQN

SEQ ID NO: 2673976 - protein, 20 aa, Entamoeba histolytica
EPYDGIEVFVEKIIVNVDDP

SEQ ID NO: 2673977 - protein, 23 aa, Entamoeba histolytica
EPYELFPQLGRFTLRDAGKTIAF

SEQ ID NO: 2673978 - protein, 22 aa, Entamoeba histolytica
EPYKEFKSLFDIKQYVEEGKRL

SEQ ID NO: 2673979 - protein, 25 aa, Entamoeba histolytica
EPYPFCGGCVLCSTFNCTTLKGTNK

SEQ ID NO: 2673980 - protein, 20 aa, Entamoeba histolytica
EPYSKPGWDNMTLLVVKFKS

SEQ ID NO: 2673981 - protein, 19 aa, Entamoeba histolytica
EQAIACIIKGVVNGLEALH

SEQ ID NO: 2673982 - protein, 19 aa, Entamoeba histolytica
EQATHIILFEMISQVIDDF

SEQ ID NO: 2673983 - protein, 17 aa, Entamoeba histolytica
EQCARPESQVTFQEAVE

SEQ ID NO: 2673984 - protein, 19 aa, Entamoeba histolytica
EQDDIILHQGIYVNTNNIK

SEQ ID NO: 2673985 - protein, 24 aa, Entamoeba histolytica
EQDELRSMAIIFLKQCAAMADKIS

SEQ ID NO: 2673986 - protein, 25 aa, Entamoeba histolytica
EQDKLKYYFAVAVFDSIETANEVYN

SEQ ID NO: 2673987 - protein, 17 aa, Entamoeba histolytica
EQDNAFHFYGYGDERNV

SEQ ID NO: 2673988 - protein, 26 aa, Entamoeba histolytica
EQDSMKCCIKGYVVHKSRINEFGNEE

SEQ ID NO: 2673989 - protein, 26 aa, Entamoeba histolytica
EQEFIFCAFCSFWITNKGRIGIHPLM

SEQ ID NO: 2673990 - protein, 26 aa, Entamoeba histolytica
EQELKPNGVFALHWDEFTGDDDFKDL

SEQ ID NO: 2673991 - protein, 25 aa, Entamoeba histolytica
EQETWKLISGIVCKDDKAVMKITGF

SEQ ID NO: 2673992 - protein, 17 aa, Entamoeba histolytica
EQFKLTLCCLPIFELYG

SEQ ID NO: 2673993 - protein, 24 aa, Entamoeba histolytica
EQFLKLIKSFECQDYANVLIGQIF

SEQ ID NO: 2673994 - protein, 31 aa, Entamoeba histolytica
EQFRETCFFRLSVTLSKMIDWVSYFYSNFNI

SEQ ID NO: 2673995 - protein, 24 aa, Entamoeba histolytica
EQGEIGVKFHVIWNNSPTMKTVSG

SEQ ID NO: 2673996 - protein, 20 aa, Entamoeba histolytica
EQGKSLANERGWLYKETSAS

SEQ ID NO: 2673997 - protein, 20 aa, Entamoeba histolytica
EQHLRNEIEIGRIIKMKVIN

SEQ ID NO: 2673998 - protein, 22 aa, Entamoeba histolytica
EQIELLATIVVQYKLSHQQVYE

SEQ ID NO: 2673999 - protein, 24 aa, Entamoeba histolytica
EQIHCFPQGMLPVVDFNDKPLYEK

SEQ ID NO: 2674000 - protein, 24 aa, Entamoeba histolytica
EQIHCFPQGMLPVVDFNGKILYEK

SEQ ID NO: 2674001 - protein, 19 aa, Entamoeba histolytica
EQIIKFWRIELDDDLSKDD

SEQ ID NO: 2674002 - protein, 17 aa, Entamoeba histolytica
EQIKEAFETKVLDLNAI

SEQ ID NO: 2674003 - protein, 35 aa, Entamoeba histolytica
EQILHLKFDIGLLLRLILCLSKSLSYDGDKRINII

SEQ ID NO: 2674004 - protein, 24 aa, Entamoeba histolytica
EQIPFEMYSGLRIHTVKNQTLGEI

SEQ ID NO: 2674005 - protein, 24 aa, Entamoeba histolytica
EQIWCKLLCYCIGEIFNQHEDVNG

SEQ ID NO: 2674006 - protein, 25 aa, Entamoeba histolytica
EQIWCKLLCYCIGEIFSQHQLVNGV

SEQ ID NO: 2674007 - protein, 24 aa, Entamoeba histolytica
EQKAEIHIGPKLLQPFKEQVEKDS

SEQ ID NO: 2674008 - protein, 23 aa, Entamoeba histolytica
EQKEELRRMSIEIDNHQLHEEFE

SEQ ID NO: 2674009 - protein, 20 aa, Entamoeba histolytica
EQKERFNVLCADLKNTDEEL

SEQ ID NO: 2674010 - protein, 27 aa, Entamoeba histolytica
EQKINLVQCRLFLTKLIAVFNRGDTFT

SEQ ID NO: 2674011 - protein, 21 aa, Entamoeba histolytica
EQKKLEGMLAEFLHKEAAVVV

SEQ ID NO: 2674012 - protein, 23 aa, Entamoeba histolytica
EQKKRLDQFLSIKKLEPFACELL

SEQ ID NO: 2674013 - protein, 28 aa, Entamoeba histolytica
EQKLGHDFCLKHLLNLPGNFTATKLAWI

SEQ ID NO: 2674014 - protein, 24 aa, Entamoeba histolytica
EQKLHLKGYIPLAFGTITRSPEMK

SEQ ID NO: 2674015 - protein, 19 aa, Entamoeba histolytica
EQKLKDLIRDAVGCPWTPF

SEQ ID NO: 2674016 - protein, 24 aa, Entamoeba histolytica
EQKRVPNLFYIKRGNGIEKGNDGS

SEQ ID NO: 2674017 - protein, 24 aa, Entamoeba histolytica
EQKRYDLILERVIKKDMDIDKEEL

SEQ ID NO: 2674018 - protein, 20 aa, Entamoeba histolytica
EQKYALKIALVMNTLIRGIV

SEQ ID NO: 2674019 - protein, 20 aa, Entamoeba histolytica
EQLCNLLLYLPSELSINEML

SEQ ID NO: 2674020 - protein, 24 aa, Entamoeba histolytica
EQLEKELKESGAIPMEEEQKSAGY

SEQ ID NO: 2674021 - protein, 17 aa, Entamoeba histolytica
EQLGWKIVLKNTKNSSV

SEQ ID NO: 2674022 - protein, 25 aa, Entamoeba histolytica
EQLKFVKYKKYRFMTIEPIKKNGYN

SEQ ID NO: 2674023 - protein, 17 aa, Entamoeba histolytica
EQLKLNKINALIYSYEL

SEQ ID NO: 2674024 - protein, 27 aa, Entamoeba histolytica
EQLKLSNGKLWFTIGILNENEELYDEA

SEQ ID NO: 2674025 - protein, 24 aa, Entamoeba histolytica
EQLNELGLPFAICCHPMNGTSQPP

SEQ ID NO: 2674026 - protein, 21 aa, Entamoeba histolytica
EQLPPLYSYLLFKSKYPNVYS

SEQ ID NO: 2674027 - protein, 22 aa, Entamoeba histolytica
EQLRSIFPPSRSIKVIFDLIQD

SEQ ID NO: 2674028 - protein, 25 aa, Entamoeba histolytica
EQLSKCPVIYKLLSILIINNLPIDI

SEQ ID NO: 2674029 - protein, 30 aa, Entamoeba histolytica
EQMLKQQTWRWFVCLFSREFPVEKVIVIWD

SEQ ID NO: 2674030 - protein, 19 aa, Entamoeba histolytica
EQMRVTKVFINIFVEDLLR

SEQ ID NO: 2674031 - protein, 19 aa, Entamoeba histolytica
EQNAAWPITVLNTVVAESI

SEQ ID NO: 2674032 - protein, 17 aa, Entamoeba histolytica
EQNCGFDGEVTISYRNK

SEQ ID NO: 2674033 - protein, 23 aa, Entamoeba histolytica
EQPKLNIIKKRKLSIGRVESEVN

SEQ ID NO: 2674034 - protein, 24 aa, Entamoeba histolytica
EQPLFLRRFNQTFNSPYRRNGMVP

SEQ ID NO: 2674035 - protein, 20 aa, Entamoeba histolytica
EQPLFVIHVLWLRVLYNISL

SEQ ID NO: 2674036 - protein, 18 aa, Entamoeba histolytica
EQPRKVIPTCYCTIEDED

SEQ ID NO: 2674037 - protein, 18 aa, Entamoeba histolytica
EQPRKVIPTCYCVIEDEE

SEQ ID NO: 2674038 - protein, 17 aa, Entamoeba histolytica
EQPRLPITQTQKIEDKS

SEQ ID NO: 2674039 - protein, 19 aa, Entamoeba histolytica
EQPVEMNLIDFIGKESTTE

SEQ ID NO: 2674040 - protein, 17 aa, Entamoeba histolytica
EQQEDLMSFSFTSFDSI

SEQ ID NO: 2674041 - protein, 23 aa, Entamoeba histolytica
EQQEYKEAFQLFDKDNDNKLTAE

SEQ ID NO: 2674042 - protein, 25 aa, Entamoeba histolytica
EQQIRSELMGFFNHLTKSKEMKKAL

SEQ ID NO: 2674043 - protein, 20 aa, Entamoeba histolytica
EQQKLITIKAVIKKFHFISH

SEQ ID NO: 2674044 - protein, 20 aa, Entamoeba histolytica
EQQLRYVLNETLKGLVYLHS

SEQ ID NO: 2674045 - protein, 19 aa, Entamoeba histolytica
EQRFDVIDPCILLYMKLVI

SEQ ID NO: 2674046 - protein, 20 aa, Entamoeba histolytica
EQRLLCLLQLVNICDDDIHV

SEQ ID NO: 2674047 - protein, 24 aa, Entamoeba histolytica
EQRRLKILELKLHREAEERRKREN

SEQ ID NO: 2674048 - protein, 19 aa, Entamoeba histolytica
EQSDIILLNIFALIHPEIK

SEQ ID NO: 2674049 - protein, 20 aa, Entamoeba histolytica
EQSPRGAGFIFGKDASDQFN

SEQ ID NO: 2674050 - protein, 20 aa, Entamoeba histolytica
EQTEMKWKEIIQERQTALEN

SEQ ID NO: 2674051 - protein, 25 aa, Entamoeba histolytica
EQTKRASFMNYLWRGYSVDGLPQNV

SEQ ID NO: 2674052 - protein, 20 aa, Entamoeba histolytica
EQTKRISITKCSKCHNEYDK

SEQ ID NO: 2674053 - protein, 18 aa, Entamoeba histolytica
EQTYDFLSVIFTRLLFSI

SEQ ID NO: 2674054 - protein, 24 aa, Entamoeba histolytica
EQVIECMKIIKTIIIKSFNYISSN

SEQ ID NO: 2674055 - protein, 18 aa, Entamoeba histolytica
EQVIPWIISHQEILIQDE

SEQ ID NO: 2674056 - protein, 20 aa, Entamoeba histolytica
EQVNAFKIMEMIKHIYDVIE

SEQ ID NO: 2674057 - protein, 27 aa, Entamoeba histolytica
EQVPKKWWKFAFDSLLIEVKKKNYKES

SEQ ID NO: 2674058 - protein, 25 aa, Entamoeba histolytica
EQVRLRIGNILIYRTILEEAAVQRL

SEQ ID NO: 2674059 - protein, 19 aa, Entamoeba histolytica
EQWGLKHFCEALCVVGCTS

SEQ ID NO: 2674060 - protein, 22 aa, Entamoeba histolytica
EQYEVIKVTSLREYSFDEEFII

SEQ ID NO: 2674061 - protein, 19 aa, Entamoeba histolytica
EQYIKIMPFEVIVLNAYLH

SEQ ID NO: 2674062 - protein, 17 aa, Entamoeba histolytica
EQYNFLNKILFKLNLNK

SEQ ID NO: 2674063 - protein, 25 aa, Entamoeba histolytica
EQYYIKGDGFVLVYSIDNKNSFHAL

SEQ ID NO: 2674064 - protein, 25 aa, Entamoeba histolytica
EQYYLKGDGFVLVYSIENKSSFMAI

SEQ ID NO: 2674065 - protein, 18 aa, Entamoeba histolytica
ERASLENEYGKGIHTQST

SEQ ID NO: 2674066 - protein, 17 aa, Entamoeba histolytica
ERCKNPGMCLSLFSFSH

SEQ ID NO: 2674067 - protein, 24 aa, Entamoeba histolytica
ERDEVFKYLKKVQIKSLYNKRHRN

SEQ ID NO: 2674068 - protein, 24 aa, Entamoeba histolytica
ERDPDKDYPIFAIRCKQGYEKDIC

SEQ ID NO: 2674069 - protein, 21 aa, Entamoeba histolytica
ERDVYKYSLYFNILKEKTAKE

SEQ ID NO: 2674070 - protein, 21 aa, Entamoeba histolytica
EREDLKIVVMSATLEATKFKE

SEQ ID NO: 2674071 - protein, 18 aa, Entamoeba histolytica
EREFLIFVESETDLKGFL

SEQ ID NO: 2674072 - protein, 25 aa, Entamoeba histolytica
EREPFEFDLCSFVEDLVAHHCQKQN

SEQ ID NO: 2674073 - protein, 17 aa, Entamoeba histolytica
ERERLVFEYLFQLQEIK

SEQ ID NO: 2674074 - protein, 23 aa, Entamoeba histolytica
EREWKAKNKLLRQEQAKSKSTVE

SEQ ID NO: 2674075 - protein, 25 aa, Entamoeba histolytica
EREYWKALLRVCILNSIDNFGYQKR

SEQ ID NO: 2674076 - protein, 17 aa, Entamoeba histolytica
ERFCDFYDNSNNIKKNP

SEQ ID NO: 2674077 - protein, 19 aa, Entamoeba histolytica
ERFEKEKKEWAEKEKKYTE

SEQ ID NO: 2674078 - protein, 18 aa, Entamoeba histolytica
ERFHLPIISLFYPSVEFV

SEQ ID NO: 2674079 - protein, 25 aa, Entamoeba histolytica
ERFIFPSLIVSFNINKIEFVLSSEF

SEQ ID NO: 2674080 - protein, 20 aa, Entamoeba histolytica
ERFKNNFLQIVDRYNENLVK

SEQ ID NO: 2674081 - protein, 24 aa, Entamoeba histolytica
ERFKTISLSLLFFVVQHPNQKKDF

SEQ ID NO: 2674082 - protein, 20 aa, Entamoeba histolytica
ERFLTSLIPIYGQYQEIRCY

SEQ ID NO: 2674083 - protein, 20 aa, Entamoeba histolytica
ERFNWIGDTVVNCFNECPKG

SEQ ID NO: 2674084 - protein, 24 aa, Entamoeba histolytica
ERFRCPEALFQPSFLGMECNGIHE

SEQ ID NO: 2674085 - protein, 17 aa, Entamoeba histolytica
ERFRLIRRINLRYRFSL

SEQ ID NO: 2674086 - protein, 25 aa, Entamoeba histolytica
ERFTRENCLSILKNKTDIIILLETE

SEQ ID NO: 2674087 - protein, 25 aa, Entamoeba histolytica
ERIDFPFERLVSLTSVQLGELIRLP

SEQ ID NO: 2674088 - protein, 24 aa, Entamoeba histolytica
ERIECPKCGVVVLKRTLQQHMRKA

SEQ ID NO: 2674089 - protein, 25 aa, Entamoeba histolytica
ERIEILRSMCGHIQLTDSITTKIVE

SEQ ID NO: 2674090 - protein, 25 aa, Entamoeba histolytica
ERIEMNGGVVFGMFGVKRVNGQIMV

SEQ ID NO: 2674091 - protein, 19 aa, Entamoeba histolytica
ERIFDCISFTPAGENLVKC

SEQ ID NO: 2674092 - protein, 20 aa, Entamoeba histolytica
ERIKILAMQVLEDYDNDNTI

SEQ ID NO: 2674093 - protein, 31 aa, Entamoeba histolytica
ERIKKFKVAVIFSYVGRGYFGLMYLNNNPKT

SEQ ID NO: 2674094 - protein, 23 aa, Entamoeba histolytica
ERIKKRCCVLLEYISFELKNICG

SEQ ID NO: 2674095 - protein, 19 aa, Entamoeba histolytica
ERIKLMKTLFPIIKFDSIS

SEQ ID NO: 2674096 - protein, 24 aa, Entamoeba histolytica
ERIKSEIIPGMIIEKEPPEHIIIV

SEQ ID NO: 2674097 - protein, 17 aa, Entamoeba histolytica
ERILAGLKQFKSHCSQL

SEQ ID NO: 2674098 - protein, 23 aa, Entamoeba histolytica
ERILMPISLCLQRPQTECYLDSQ

SEQ ID NO: 2674099 - protein, 20 aa, Entamoeba histolytica
ERINTFQLMDMIAKEVNLPN

SEQ ID NO: 2674100 - protein, 17 aa, Entamoeba histolytica
ERIQYGLSIAEDKMEIP

SEQ ID NO: 2674101 - protein, 23 aa, Entamoeba histolytica
ERIRRACKVKESPDKDFDITTEV

SEQ ID NO: 2674102 - protein, 24 aa, Entamoeba histolytica
ERIRTEATMLLCLISNKKKGSEEV

SEQ ID NO: 2674103 - protein, 23 aa, Entamoeba histolytica
ERIRVNFNNCFSLEKITQKWGSK

SEQ ID NO: 2674104 - protein, 18 aa, Entamoeba histolytica
ERITLKIISSFGVCNLNF

SEQ ID NO: 2674105 - protein, 20 aa, Entamoeba histolytica
ERIVMHLLWLMANIASDGVI

SEQ ID NO: 2674106 - protein, 23 aa, Entamoeba histolytica
ERKEQQKRLALLSLNTHEDTSKE

SEQ ID NO: 2674107 - protein, 30 aa, Entamoeba histolytica
ERKFELRFIVLMKYDVMWKSQKPDIYLYDR

SEQ ID NO: 2674108 - protein, 25 aa, Entamoeba histolytica
ERKFKIEVNEGVSIAFPLDEVAEYP

SEQ ID NO: 2674109 - protein, 22 aa, Entamoeba histolytica
ERKFSFHSFFILGMTKNQIIQH

SEQ ID NO: 2674110 - protein, 20 aa, Entamoeba histolytica
ERKFYGVMYFYKMAEQDIED

SEQ ID NO: 2674111 - protein, 27 aa, Entamoeba histolytica
ERKKFKKSSLKRTVKVSSPKKKVVDLN

SEQ ID NO: 2674112 - protein, 37 aa, Entamoeba histolytica; identical to SEQ ID NO: 2480152

SEQ ID NO: 2674113 - protein, 42 aa, Entamoeba histolytica
ERKLGEFPLHWDRFNIKDVEIIKSYSLLKCRNKTIKELIQLG

SEQ ID NO: 2674114 - protein, 22 aa, Entamoeba histolytica
ERKRIHLVWFVINSAVGRLQPF

SEQ ID NO: 2674115 - protein, 26 aa, Entamoeba histolytica
ERKSLGWMAPLYKEYPGGEEVMFKER

SEQ ID NO: 2674116 - protein, 20 aa, Entamoeba histolytica
ERKWKDFVSVGMKWALVCRP

SEQ ID NO: 2674117 - protein, 17 aa, Entamoeba histolytica
ERLCLESFMKIQLIDLS

SEQ ID NO: 2674118 - protein, 18 aa, Entamoeba histolytica
ERLCLESFMKIQLIDLSH

SEQ ID NO: 2674119 - protein, 22 aa, Entamoeba histolytica
ERLEILTVLQLIIFSKSEQLIN

SEQ ID NO: 2674120 - protein, 18 aa, Entamoeba histolytica
ERLEKLGVPMLVDEEDLG

SEQ ID NO: 2674121 - protein, 17 aa, Entamoeba histolytica
ERLEMEIGTKKSIIQDI

SEQ ID NO: 2674122 - protein, 19 aa, Entamoeba histolytica
ERLIECGRELELIDEEEIK

SEQ ID NO: 2674123 - protein, 20 aa, Entamoeba histolytica
ERLIEWAKELELIDEKEIKK

SEQ ID NO: 2674124 - protein, 21 aa, Entamoeba histolytica
ERLQKIVMRFSSLPINVSSYI

SEQ ID NO: 2674125 - protein, 18 aa, Entamoeba histolytica
ERLQYCGLVNNAIQLANK

SEQ ID NO: 2674126 - protein, 18 aa, Entamoeba histolytica
ERLSIGIGLISIIINHQV

SEQ ID NO: 2674127 - protein, 22 aa, Entamoeba histolytica
ERLSLRQKQSFFRQLEKNPDCD

SEQ ID NO: 2674128 - protein, 24 aa, Entamoeba histolytica
ERLTEKKLRFGVGQYEYIIQFSIS

SEQ ID NO: 2674129 - protein, 20 aa, Entamoeba histolytica
ERMAKEWIEENIKSIDFWEN

SEQ ID NO: 2674130 - protein, 23 aa, Entamoeba histolytica
ERMLEMTPPLFLYGTHYSTPAYV

SEQ ID NO: 2674131 - protein, 27 aa, Entamoeba histolytica
ERMLKGEIFPFLEFFPHDSSDLNPLND

SEQ ID NO: 2674132 - protein, 23 aa, Entamoeba histolytica
ERMYHCKKCKRCIDMKDHHCSWS

SEQ ID NO: 2674133 - protein, 29 aa, Entamoeba histolytica
ERNDITIGICLNGKPMLKKQFNKTNSLSD

SEQ ID NO: 2674134 - protein, 26 aa, Entamoeba histolytica
ERNNVFFKWSCLDYNYNHQPISKTGI

SEQ ID NO: 2674135 - protein, 28 aa, Entamoeba histolytica
ERNRMLEGACPISLPKLIYIKELGEVMG

SEQ ID NO: 2674136 - protein, 20 aa, Entamoeba histolytica
ERNTEIGFLFELETKKIIEE

SEQ ID NO: 2674137 - protein, 32 aa, Entamoeba histolytica
ERNYYIPCWIKIRYYQSFTFDAFKLCRSHNCH

SEQ ID NO: 2674138 - protein, 21 aa, Entamoeba histolytica
ERQGIKYDGFDFGNSPTELIN

SEQ ID NO: 2674139 - protein, 25 aa, Entamoeba histolytica
ERQLIRLSRRGNFMAKKRIIEIDDE

SEQ ID NO: 2674140 - protein, 17 aa, Entamoeba histolytica
ERQRRRRVEISKELSKK

SEQ ID NO: 2674141 - protein, 26 aa, Entamoeba histolytica
ERRDMLWKKRCIRFRKTANMKQNEEL

SEQ ID NO: 2674142 - protein, 24 aa, Entamoeba histolytica
ERREIVCPNPGFIIQLYEFQLKLG

SEQ ID NO: 2674143 - protein, 18 aa, Entamoeba histolytica
ERREKRRSSEISIKKEKK

SEQ ID NO: 2674144 - protein, 20 aa, Entamoeba histolytica
ERRRFCFFLAAVIQGVDNHA

SEQ ID NO: 2674145 - protein, 17 aa, Entamoeba histolytica
ERRRKKFERPLESPKRS

SEQ ID NO: 2674146 - protein, 18 aa, Entamoeba histolytica
ERSFRIEGKINIMKEVMI

SEQ ID NO: 2674147 - protein, 19 aa, Entamoeba histolytica
ERSIMLAVKILRTVLKKRN

SEQ ID NO: 2674148 - protein, 27 aa, Entamoeba histolytica
ERSRIRVVYLCKWFIKNGSNQNVILFV

SEQ ID NO: 2674149 - protein, 21 aa, Entamoeba histolytica
ERTGKEWFKKVREIMEISRCN

SEQ ID NO: 2674150 - protein, 26 aa, Entamoeba histolytica
ERTHQCPICRTPITAAINFSRKSVTP

SEQ ID NO: 2674151 - protein, 17 aa, Entamoeba histolytica
ERTIKLLELVGLQDRMN

SEQ ID NO: 2674152 - protein, 24 aa, Entamoeba histolytica
ERTNMISSFRFLRLDDLDKIKFLE

SEQ ID NO: 2674153 - protein, 24 aa, Entamoeba histolytica
ERTTIIFRLNWLRDEDIPTIQQVS

SEQ ID NO: 2674154 - protein, 17 aa, Entamoeba histolytica
ERVGQLFTGKKKDAQEE

SEQ ID NO: 2674155 - protein, 17 aa, Entamoeba histolytica
ERVKANMGKLAKQKQEK

SEQ ID NO: 2674156 - protein, 22 aa, Entamoeba histolytica
ERVKRALDEKAIKEGKKPKFNT

SEQ ID NO: 2674157 - protein, 20 aa, Entamoeba histolytica
ERVKVVVIQMEYCSGSNLSR

SEQ ID NO: 2674158 - protein, 17 aa, Entamoeba histolytica
ERVLLVFIDPHYTVENL

SEQ ID NO: 2674159 - protein, 25 aa, Entamoeba histolytica
ERVLRIGYTAIYIIDPRNRKISEKL

SEQ ID NO: 2674160 - protein, 19 aa, Entamoeba histolytica
ERVRTCLLGTISPWERMSR

SEQ ID NO: 2674161 - protein, 26 aa, Entamoeba histolytica
ERYEECYESFLWLFGKLLQKEELDLI

SEQ ID NO: 2674162 - protein, 29 aa, Entamoeba histolytica
ERYKELPETLVFHLKRFVYNDQFEIVKYN

SEQ ID NO: 2674163 - protein, 20 aa, Entamoeba histolytica
ERYPSKYLTLLSFLSHSLTI

SEQ ID NO: 2674164 - protein, 17 aa, Entamoeba histolytica
ERYRPTYYSPRRSRSIS

SEQ ID NO: 2674165 - protein, 18 aa, Entamoeba histolytica
ERYVIPMKLFKDVEKKIP

SEQ ID NO: 2674166 - protein, 19 aa, Entamoeba histolytica
ESACTILACSMDQTGLMEM

SEQ ID NO: 2674167 - protein, 21 aa, Entamoeba histolytica
ESADLKVEYIAKMDNDLWPIP

SEQ ID NO: 2674168 - protein, 18 aa, Entamoeba histolytica
ESAIKMNGNLRWNLWDEV

SEQ ID NO: 2674169 - protein, 24 aa, Entamoeba histolytica
ESAKRLNVALTRARNNLIFIMHKN

SEQ ID NO: 2674170 - protein, 24 aa, Entamoeba histolytica
ESALPRATKLLLLLGDAPTPTFEE

SEQ ID NO: 2674171 - protein, 28 aa, Entamoeba histolytica
ESALSLLISCCYLCFDSFVEPIGINKSH

SEQ ID NO: 2674172 - protein, 20 aa, Entamoeba histolytica
ESALTGWLAELCYLVNGALV

SEQ ID NO: 2674173 - protein, 28 aa, Entamoeba histolytica
ESDFLKRKVEILEWFDKELASLINEKER

SEQ ID NO: 2674174 - protein, 20 aa, Entamoeba histolytica
ESDKALGYKRIKLILNADFN

SEQ ID NO: 2674175 - protein, 18 aa, Entamoeba histolytica
ESDLFVWEAVIIGPEGTE

SEQ ID NO: 2674176 - protein, 24 aa, Entamoeba histolytica
ESDMRICLFSGEIVRETIQIDIEQ

SEQ ID NO: 2674177 - protein, 24 aa, Entamoeba histolytica
ESDNRFVYCAVLALTLIGKLDVIN

SEQ ID NO: 2674178 - protein, 19 aa, Entamoeba histolytica
ESEDAWRIFGDKWYLKDEE

SEQ ID NO: 2674179 - protein, 29 aa, Entamoeba histolytica
ESEHALKNDICYQQAFLILLLNQYLAITL

SEQ ID NO: 2674180 - protein, 19 aa, Entamoeba histolytica
ESEIKRYRVLKIVGRGTFG

SEQ ID NO: 2674181 - protein, 17 aa, Entamoeba histolytica
ESEIPVSWLEEFNTVSL

SEQ ID NO: 2674182 - protein, 18 aa, Entamoeba histolytica
ESEIRNMLLSFIFLLNCF

SEQ ID NO: 2674183 - protein, 21 aa, Entamoeba histolytica
ESEKLDLIGVDWRDEDEKKIK

SEQ ID NO: 2674184 - protein, 19 aa, Entamoeba histolytica
ESEKLRLNSMFEENSKEER

SEQ ID NO: 2674185 - protein, 45 aa, Entamoeba histolytica
ESELLGLVYLKKYIMYRAFCDGCLRITKQIYSWLFNKGQKSEQIK

SEQ ID NO: 2674186 - protein, 20 aa, Entamoeba histolytica
ESELPCQWVESHIDYINEKF

SEQ ID NO: 2674187 - protein, 17 aa, Entamoeba histolytica
ESELTKRNHHITDIDDV

SEQ ID NO: 2674188 - protein, 20 aa, Entamoeba histolytica
ESERMVRLNPPFKLVKTSPE

SEQ ID NO: 2674189 - protein, 22 aa, Entamoeba histolytica
ESEWRALSFTKEFSRLGITSSN

SEQ ID NO: 2674190 - protein, 23 aa, Entamoeba histolytica
ESFDDCRVAAAILKDYLRQLPEP

SEQ ID NO: 2674191 - protein, 19 aa, Entamoeba histolytica
ESFGEAMLRGMGWKEKTSK

SEQ ID NO: 2674192 - protein, 17 aa, Entamoeba histolytica
ESFIKSKMEVYGLIQKI

SEQ ID NO: 2674193 - protein, 24 aa, Entamoeba histolytica
ESFIKVFNEKGGFPKKAQLMKSIT

SEQ ID NO: 2674194 - protein, 19 aa, Entamoeba histolytica
ESFILFKKYSEGPFDVTFK

SEQ ID NO: 2674195 - protein, 30 aa, Entamoeba histolytica; identical to SEQ ID NO: 2480241

SEQ ID NO: 2674196 - protein, 27 aa, Entamoeba histolytica
ESFLKLLLEMFKKFEIELTNVQLIGST

SEQ ID NO: 2674197 - protein, 20 aa, Entamoeba histolytica
ESFPINILLLDFIQINDPFI

SEQ ID NO: 2674198 - protein, 22 aa, Entamoeba histolytica
ESFWKAFGCLPSLELLQDQKVS

SEQ ID NO: 2674199 - protein, 20 aa, Entamoeba histolytica
ESGCFNCNYTLKSIQIPEGI

SEQ ID NO: 2674200 - protein, 24 aa, Entamoeba histolytica
ESGVKCGFCGDSSHATCDCPLKKQ

SEQ ID NO: 2674201 - protein, 27 aa, Entamoeba histolytica
ESHFEIVLWISYCINLLKPLNSSKSFV

SEQ ID NO: 2674202 - protein, 25 aa, Entamoeba histolytica
ESIDVIASFIKKLLIKSLYSSPSFI

SEQ ID NO: 2674203 - protein, 18 aa, Entamoeba histolytica
ESIELFEFYEKKKEIKEK

SEQ ID NO: 2674204 - protein, 21 aa, Entamoeba histolytica
ESIEYLAPILPSGVIDVNITC

SEQ ID NO: 2674205 - protein, 23 aa, Entamoeba histolytica
ESIFHCINCKLLNDIKYEITDKQ

SEQ ID NO: 2674206 - protein, 19 aa, Entamoeba histolytica
ESIIKCLIIGYPENDSKKE

SEQ ID NO: 2674207 - protein, 19 aa, Entamoeba histolytica
ESIIRKGLFYKGVDNDCRC

SEQ ID NO: 2674208 - protein, 20 aa, Entamoeba histolytica
ESIKALLTFEECNFPQSILD

SEQ ID NO: 2674209 - protein, 24 aa, Entamoeba histolytica
ESIKDVFLNNSFNCIVERVINVCK

SEQ ID NO: 2674210 - protein, 17 aa, Entamoeba histolytica
ESIKGKVFIQMGNIKKP

SEQ ID NO: 2674211 - protein, 24 aa, Entamoeba histolytica
ESIKTLSVAFQWFVGDSTEQNIPP

SEQ ID NO: 2674212 - protein, 23 aa, Entamoeba histolytica
ESILQKHRIEVMYINESIANFCL

SEQ ID NO: 2674213 - protein, 25 aa, Entamoeba histolytica
ESILTFNCFDWDNAFKFSSDDFLGK

SEQ ID NO: 2674214 - protein, 17 aa, Entamoeba histolytica
ESIRKSCDEERDIEKRI

SEQ ID NO: 2674215 - protein, 23 aa, Entamoeba histolytica
ESISMVCRFCNLLITGEDPCSQR

SEQ ID NO: 2674216 - protein, 22 aa, Entamoeba histolytica
ESITQLTCLSFFNAASNPIKTL

SEQ ID NO: 2674217 - protein, 24 aa, Entamoeba histolytica
ESITVFPKKCYKEIVDSLKNYTSE

SEQ ID NO: 2674218 - protein, 19 aa, Entamoeba histolytica
ESIYKRYSMIIGTMKEKER

SEQ ID NO: 2674219 - protein, 17 aa, Entamoeba histolytica
ESKGSKNLWSFISVLSS

SEQ ID NO: 2674220 - protein, 26 aa, Entamoeba histolytica
ESKIKKKLFLTFVHHINQFFDNYGDA

SEQ ID NO: 2674221 - protein, 21 aa, Entamoeba histolytica
ESKIRGMKGVMALISVSSHVF

SEQ ID NO: 2674222 - protein, 21 aa, Entamoeba histolytica
ESKKFTAVICYQVKLMKQRKD

SEQ ID NO: 2674223 - protein, 22 aa, Entamoeba histolytica
ESKLPKQCQFFGREYGKFDKII

SEQ ID NO: 2674224 - protein, 19 aa, Entamoeba histolytica
ESKMKWTNLTRRIDQLDQM

SEQ ID NO: 2674225 - protein, 24 aa, Entamoeba histolytica
ESKPIFRRDHRGLTTMTGFTPKGL

SEQ ID NO: 2674226 - protein, 22 aa, Entamoeba histolytica
ESKPSELLKLFTPQQTQKQQSS

SEQ ID NO: 2674227 - protein, 24 aa, Entamoeba histolytica
ESKRMKGIYIRDLYLNLSTSAVPI

SEQ ID NO: 2674228 - protein, 19 aa, Entamoeba histolytica
ESKRVKFVFISWAGEGIKK

SEQ ID NO: 2674229 - protein, 24 aa, Entamoeba histolytica
ESKSLWLIALRNAFAKFNIATAVS

SEQ ID NO: 2674230 - protein, 20 aa, Entamoeba histolytica
ESKTSFPLALPLNNISLEMK

SEQ ID NO: 2674231 - protein, 20 aa, Entamoeba histolytica
ESLARLLVNVRIDIRRVEQF

SEQ ID NO: 2674232 - protein, 21 aa, Entamoeba histolytica
ESLCIAILCTYAEITIRKPAG

SEQ ID NO: 2674233 - protein, 28 aa, Entamoeba histolytica
ESLCLDSKIKLFCWSDGKLFKQLKNLEN

SEQ ID NO: 2674234 - protein, 23 aa, Entamoeba histolytica
ESLCVDGAVVYEVCKKVNEFIDE

SEQ ID NO: 2674235 - protein, 19 aa, Entamoeba histolytica
ESLEGWYTDLMKVASSDIS

SEQ ID NO: 2674236 - protein, 17 aa, Entamoeba histolytica
ESLEIISNNVIKPLLFS

SEQ ID NO: 2674237 - protein, 21 aa, Entamoeba histolytica
ESLELHLTWYEKLIVNQEKRD

SEQ ID NO: 2674238 - protein, 21 aa, Entamoeba histolytica
ESLELYFIIWGNLCLLGGNAI

SEQ ID NO: 2674239 - protein, 23 aa, Entamoeba histolytica
ESLERFSYIPIRRIKSCFDYLKY

SEQ ID NO: 2674240 - protein, 18 aa, Entamoeba histolytica
ESLGDIEAFVILLKQMIE

SEQ ID NO: 2674241 - protein, 21 aa, Entamoeba histolytica
ESLKEVIRHGINIFQEKEKKD

SEQ ID NO: 2674242 - protein, 28 aa, Entamoeba histolytica
ESLKLIRMRCLKCQKSSEVWTLRESIYS

SEQ ID NO: 2674243 - protein, 23 aa, Entamoeba histolytica
ESLKVIHFYVWDSIITPGGHEIS

SEQ ID NO: 2674244 - protein, 19 aa, Entamoeba histolytica
ESLLKCLPEYLDETKKIKT

SEQ ID NO: 2674245 - protein, 17 aa, Entamoeba histolytica
ESLLRNGAYGAFKDDEE

SEQ ID NO: 2674246 - protein, 19 aa, Entamoeba histolytica
ESLMFYGLLENQSEKSEKK

SEQ ID NO: 2674247 - protein, 18 aa, Entamoeba histolytica
ESLNPSKSTNCIISAPPS

SEQ ID NO: 2674248 - protein, 25 aa, Entamoeba histolytica
ESLRNILWGEHFINMKTGKTFKTQI

SEQ ID NO: 2674249 - protein, 23 aa, Entamoeba histolytica
ESLSDRFKLLFLILEDNKCDEMS

SEQ ID NO: 2674250 - protein, 20 aa, Entamoeba histolytica
ESLSKFVFVPLLYQEVFIFS

SEQ ID NO: 2674251 - protein, 20 aa, Entamoeba histolytica
ESLSSKLLLDRFALKKLIKD

SEQ ID NO: 2674252 - protein, 25 aa, Entamoeba histolytica
ESLSSLKICFYCRISYQRSLKEIKK

SEQ ID NO: 2674253 - protein, 17 aa, Entamoeba histolytica
ESLSTLVYGHLKAIDNI

SEQ ID NO: 2674254 - protein, 23 aa, Entamoeba histolytica
ESLWREIVKFYTLKDKNFNIKYD

SEQ ID NO: 2674255 - protein, 22 aa, Entamoeba histolytica
ESMDVGIHYLPLICMAEKDNNE

SEQ ID NO: 2674256 - protein, 18 aa, Entamoeba histolytica
ESMGRILLQIAYASPLDR

SEQ ID NO: 2674257 - protein, 19 aa, Entamoeba histolytica
ESMIRLSEALARLYLDKEV

SEQ ID NO: 2674258 - protein, 26 aa, Entamoeba histolytica
ESMKDLTFCQLMEGMSSLPNPANKTP

SEQ ID NO: 2674259 - protein, 27 aa, Entamoeba histolytica
ESMMESILICYSRLYKGSDQTIINFID

SEQ ID NO: 2674260 - protein, 18 aa, Entamoeba histolytica
ESNAARYLNIFKEVIYTL

SEQ ID NO: 2674261 - protein, 22 aa, Entamoeba histolytica
ESNIKKWKGIRKEVKEIRRGLD

SEQ ID NO: 2674262 - protein, 24 aa, Entamoeba histolytica
ESNRCVYCKSPIHITGPVWLDNYV

SEQ ID NO: 2674263 - protein, 19 aa, Entamoeba histolytica
ESPFRPIQFSKLRCGSLSR

SEQ ID NO: 2674264 - protein, 24 aa, Entamoeba histolytica
ESPLCPRSSVLLSSSAKVVTIKSL

SEQ ID NO: 2674265 - protein, 18 aa, Entamoeba histolytica
ESPNPSPNFVHWGDSSQQ

SEQ ID NO: 2674266 - protein, 25 aa, Entamoeba histolytica
ESPNTGIFRFCKGTTAEEAIELISY

SEQ ID NO: 2674267 - protein, 21 aa, Entamoeba histolytica
ESPNTGLIRFCKGTTIEEAIK

SEQ ID NO: 2674268 - protein, 19 aa, Entamoeba histolytica
ESPYKKYSLFFDYSACIIG

SEQ ID NO: 2674269 - protein, 21 aa, Entamoeba histolytica
ESQEFMFKKAFYSKINNQSDR

SEQ ID NO: 2674270 - protein, 32 aa, Entamoeba histolytica
ESQIRGLVNLVWKELLKTIGKCIKNVIDAVIN

SEQ ID NO: 2674271 - protein, 20 aa, Entamoeba histolytica
ESQPYFGIDALYIIHIRESI

SEQ ID NO: 2674272 - protein, 22 aa, Entamoeba histolytica
ESRIGSLYLEKYLKGTGEERNV

SEQ ID NO: 2674273 - protein, 23 aa, Entamoeba histolytica
ESRIKRPIIKVVLLDDIYYYIFI

SEQ ID NO: 2674274 - protein, 19 aa, Entamoeba histolytica
ESRKSYKDLVAKRNEEVAK

SEQ ID NO: 2674275 - protein, 21 aa, Entamoeba histolytica
ESRNKALWCLTNLLCHKKLSY

SEQ ID NO: 2674276 - protein, 26 aa, Entamoeba histolytica
ESRNRRPAYKFGLVVATQGQKFEQQF

SEQ ID NO: 2674277 - protein, 19 aa, Entamoeba histolytica
ESRNTLKIIEKMRQINVTQ

SEQ ID NO: 2674278 - protein, 22 aa, Entamoeba histolytica
ESRRLRVELDQLEMEKKEYKNM

SEQ ID NO: 2674279 - protein, 23 aa, Entamoeba histolytica
ESRYRWFFRPLRKMSPYHMYLFK

SEQ ID NO: 2674280 - protein, 18 aa, Entamoeba histolytica
ESSFRKTRNVQANQQSVF

SEQ ID NO: 2674281 - protein, 24 aa, Entamoeba histolytica
ESSGDLSPFCNFSLSLDPSKSPLK

SEQ ID NO: 2674282 - protein, 22 aa, Entamoeba histolytica
ESSGKLLFVEKLINLFQLTEKK

SEQ ID NO: 2674283 - protein, 18 aa, Entamoeba histolytica
ESSHKIKLLTLLQTIFAT

SEQ ID NO: 2674284 - protein, 20 aa, Entamoeba histolytica
ESSIFLLLCCGDDVLESFFE

SEQ ID NO: 2674285 - protein, 21 aa, Entamoeba histolytica
ESSLKNAIPMPDFGGKHPDPN

SEQ ID NO: 2674286 - protein, 32 aa, Entamoeba histolytica
ESSLQKFSIEYLKILIPLCCVHSFDDESIVTR

SEQ ID NO: 2674287 - protein, 26 aa, Entamoeba histolytica
ESSRRLKTEFLVRLDGAGTDDERILV

SEQ ID NO: 2674288 - protein, 25 aa, Entamoeba histolytica
ESSSKPIIFCSSVGGVGNFYVTNIN

SEQ ID NO: 2674289 - protein, 17 aa, Entamoeba histolytica
ESSYLIYFIRPGYSNDY

SEQ ID NO: 2674290 - protein, 25 aa, Entamoeba histolytica
ESSYSFPVIIKWIYELTPWEILIFP

SEQ ID NO: 2674291 - protein, 27 aa, Entamoeba histolytica
ESTESKWKLLVFDKFCSELIESHLVVS

SEQ ID NO: 2674292 - protein, 23 aa, Entamoeba histolytica
ESTFKRILPYALLKYLEEEEEPP

SEQ ID NO: 2674293 - protein, 29 aa, Entamoeba histolytica
ESTKELLLFIRIQWIFIHLCNCKNPYEPN

SEQ ID NO: 2674294 - protein, 19 aa, Entamoeba histolytica
ESTKFLKNVENLFKEGQSD

SEQ ID NO: 2674295 - protein, 20 aa, Entamoeba histolytica
ESTKSGFFGLSFKKKNKRKL

SEQ ID NO: 2674296 - protein, 26 aa, Entamoeba histolytica
ESTKSPAEYLLRKAVMLLQNSDKQLK

SEQ ID NO: 2674297 - protein, 20 aa, Entamoeba histolytica
ESTNEYGLFPGEDFATTLVD

SEQ ID NO: 2674298 - protein, 26 aa, Entamoeba histolytica
ESTVLYEFLTNFARQMMQKVVSLHFD

SEQ ID NO: 2674299 - protein, 17 aa, Entamoeba histolytica
ESVASCKPAEGEFLKTH

SEQ ID NO: 2674300 - protein, 23 aa, Entamoeba histolytica
ESVESVILKHCRSTSVIFHSKKI

SEQ ID NO: 2674301 - protein, 21 aa, Entamoeba histolytica
ESVIITRIIKYMGVADELKKV

SEQ ID NO: 2674302 - protein, 25 aa, Entamoeba histolytica
ESVIQRFDPSYVFLCDEFGMNLIGC

SEQ ID NO: 2674303 - protein, 17 aa, Entamoeba histolytica
ESVKDIFLLIQQYISYK

SEQ ID NO: 2674304 - protein, 27 aa, Entamoeba histolytica
ESVPILRSVCINPVLKGKRTEGVLEAH

SEQ ID NO: 2674305 - protein, 35 aa, Entamoeba histolytica
ESVVSLMKYNGGYNWWKRNSLTVFINKKLYKDPEE

SEQ ID NO: 2674306 - protein, 21 aa, Entamoeba histolytica
ESYFLFTCFCAFWVTLDGQLR

SEQ ID NO: 2674307 - protein, 25 aa, Entamoeba histolytica
ESYHKRVLEPLGFYNMMLRTKQQKY

SEQ ID NO: 2674308 - protein, 20 aa, Entamoeba histolytica
ESYLCKTCSYDKRIVIAECQ

SEQ ID NO: 2674309 - protein, 20 aa, Entamoeba histolytica
ESYLKECNWYNLRKDLNKEE

SEQ ID NO: 2674310 - protein, 20 aa, Entamoeba histolytica
ESYNGVSLIIAYCPCKEQGV

SEQ ID NO: 2674311 - protein, 26 aa, Entamoeba histolytica
ESYQKEGKCTIKFVFVTPERITQSKS

SEQ ID NO: 2674312 - protein, 18 aa, Entamoeba histolytica
ESYREIFNDIFLLADGKG

SEQ ID NO: 2674313 - protein, 20 aa, Entamoeba histolytica
ESYSTWKYFMWAKWDRKEHK

SEQ ID NO: 2674314 - protein, 21 aa, Entamoeba histolytica
ESYTFKFFSKFNELIINIDEL

SEQ ID NO: 2674315 - protein, 21 aa, Entamoeba histolytica
ESYVKFLGVVYDWVDIMLKEL

SEQ ID NO: 2674316 - protein, 19 aa, Entamoeba histolytica
ETAARVAIWEDVFVETLAM

SEQ ID NO: 2674317 - protein, 18 aa, Entamoeba histolytica
ETAFKVRAFSPEIIFISF

SEQ ID NO: 2674318 - protein, 19 aa, Entamoeba histolytica
ETALHLACLVGNIKAIQLL

SEQ ID NO: 2674319 - protein, 23 aa, Entamoeba histolytica
ETASVEGFIKIHFHNGEVTDENG

SEQ ID NO: 2674320 - protein, 18 aa, Entamoeba histolytica
ETAVVWKGPKKNSLIRQF

SEQ ID NO: 2674321 - protein, 20 aa, Entamoeba histolytica
ETCPIIEHFGKINKLLRVSG

SEQ ID NO: 2674322 - protein, 25 aa, Entamoeba histolytica
ETCQKIPYSLIWLIRCISSKVHDEK

SEQ ID NO: 2674323 - protein, 18 aa, Entamoeba histolytica
ETDGMPFKETFAKQNEDT

SEQ ID NO: 2674324 - protein, 17 aa, Entamoeba histolytica
ETDIFEGFVQRGELDQI

SEQ ID NO: 2674325 - protein, 20 aa, Entamoeba histolytica
ETDKFLPFYTPIFSSNLSEI

SEQ ID NO: 2674326 - protein, 17 aa, Entamoeba histolytica
ETDMWKKIGCQPTKFNP

SEQ ID NO: 2674327 - protein, 19 aa, Entamoeba histolytica
ETDWKLYQINSEWNNKNNG

SEQ ID NO: 2674328 - protein, 18 aa, Entamoeba histolytica
ETDWKVIGINVNDPLAQT

SEQ ID NO: 2674329 - protein, 19 aa, Entamoeba histolytica
ETEEFQLKKFNEMIDSTNV

SEQ ID NO: 2674330 - protein, 24 aa, Entamoeba histolytica
ETEELKYFGIFMNKSFFFLNDSMI

SEQ ID NO: 2674331 - protein, 19 aa, Entamoeba histolytica
ETEENGCLVSFEYGGGIMQ

SEQ ID NO: 2674332 - protein, 18 aa, Entamoeba histolytica
ETEFLRRPVERWKDLIPI

SEQ ID NO: 2674333 - protein, 20 aa, Entamoeba histolytica
ETEIIKKLHLTRVVMKEIQD

SEQ ID NO: 2674334 - protein, 22 aa, Entamoeba histolytica
ETEIQLSIVLLLFKTMKLKEEQ

SEQ ID NO: 2674335 - protein, 24 aa, Entamoeba histolytica
ETEKCKYFYVSFLNKRGLTIKGFQ

SEQ ID NO: 2674336 - protein, 21 aa, Entamoeba histolytica
ETELPLSLVVRPFLHEVQHIP

SEQ ID NO: 2674337 - protein, 23 aa, Entamoeba histolytica
ETEPRPVVILDVGHCNTTCSVIS

SEQ ID NO: 2674338 - protein, 27 aa, Entamoeba histolytica
ETERAIMYFIECVDFGKNLDRQMTFYS

SEQ ID NO: 2674339 - protein, 20 aa, Entamoeba histolytica
ETERFKASLLDSSAKTSSPS

SEQ ID NO: 2674340 - protein, 18 aa, Entamoeba histolytica
ETESFFWNKVLELETPFN

SEQ ID NO: 2674341 - protein, 24 aa, Entamoeba histolytica
ETETKWKWRYDKYDLIFYISQVPC

SEQ ID NO: 2674342 - protein, 21 aa, Entamoeba histolytica
ETEVGEIFIAQWHQCSPNNQK

SEQ ID NO: 2674343 - protein, 19 aa, Entamoeba histolytica
ETFCQKFFTAIGIHVFPFC

SEQ ID NO: 2674344 - protein, 29 aa, Entamoeba histolytica
ETFMKLKITPFSGGFIFMYDIRYLTDLIR

SEQ ID NO: 2674345 - protein, 20 aa, Entamoeba histolytica
ETFNSMPFQLYFNPMNIKKI

SEQ ID NO: 2674346 - protein, 19 aa, Entamoeba histolytica
ETFNTSALLSFICVSPPLD

SEQ ID NO: 2674347 - protein, 18 aa, Entamoeba histolytica
ETFPHLFPSFSNNQIKVE

SEQ ID NO: 2674348 - protein, 23 aa, Entamoeba histolytica
ETGCFKGCLSLGSINIPSSIIKL

SEQ ID NO: 2674349 - protein, 24 aa, Entamoeba histolytica
ETGEYKLPKPLAILNNNFQRLDGF

SEQ ID NO: 2674350 - protein, 28 aa, Entamoeba histolytica
ETGTFPKNFPFILGVIVKKGEEDKESSL

SEQ ID NO: 2674351 - protein, 17 aa, Entamoeba histolytica
ETHEFDCSIPLTTFDQI

SEQ ID NO: 2674352 - protein, 19 aa, Entamoeba histolytica
ETIAAYITGDWMIKSAVKV

SEQ ID NO: 2674353 - protein, 18 aa, Entamoeba histolytica
ETICSGIIEIGEMKESCF

SEQ ID NO: 2674354 - protein, 23 aa, Entamoeba histolytica
ETIDIKSHFGFVTFTNAEDGKKI

SEQ ID NO: 2674355 - protein, 25 aa, Entamoeba histolytica
ETIEDMMVMLGRYLDYLIDIVRPRK

SEQ ID NO: 2674356 - protein, 19 aa, Entamoeba histolytica
ETIHQWLVNMSMMLHSNII

SEQ ID NO: 2674357 - protein, 20 aa, Entamoeba histolytica
ETINGLDFIGYESKKWSQAL

SEQ ID NO: 2674358 - protein, 19 aa, Entamoeba histolytica
ETINSWKNEESLTVALQLK

SEQ ID NO: 2674359 - protein, 20 aa, Entamoeba histolytica
ETIPSILVFDEIDNLKNKCN

SEQ ID NO: 2674360 - protein, 20 aa, Entamoeba histolytica
ETIRAILLLSIGNFIKQDVL

SEQ ID NO: 2674361 - protein, 24 aa, Entamoeba histolytica
ETIYEWLRKMSLLLHSVVVGYEYP

SEQ ID NO: 2674362 - protein, 19 aa, Entamoeba histolytica
ETIYYCISMAPDGVTSPLL

SEQ ID NO: 2674363 - protein, 20 aa, Entamoeba histolytica
ETKDIIPFKICHNQDRINGN

SEQ ID NO: 2674364 - protein, 30 aa, Entamoeba histolytica
ETKGEMSELEFAGACVCRQLINPIAEFVHI

SEQ ID NO: 2674365 - protein, 25 aa, Entamoeba histolytica
ETKGYKKREIELLNSLKRTPLNDEK

SEQ ID NO: 2674366 - protein, 32 aa, Entamoeba histolytica
ETKKHLYKIKWFLPSLRELFRKNNRRYSKKRL

SEQ ID NO: 2674367 - protein, 25 aa, Entamoeba histolytica
ETKKSKGCAFVSFKTPLEAQKCFSN

SEQ ID NO: 2674368 - protein, 23 aa, Entamoeba histolytica
ETKMLRDQLQWVVFTEGSNMAGL

SEQ ID NO: 2674369 - protein, 24 aa, Entamoeba histolytica
ETKPTCRRTFKIIFKNKEECRTWN

SEQ ID NO: 2674370 - protein, 28 aa, Entamoeba histolytica
ETKQIGICWKELLIVPSEVVDPNSFGGS

SEQ ID NO: 2674371 - protein, 24 aa, Entamoeba histolytica
ETKSSILSVFIQWTKSFFSDFEKK

SEQ ID NO: 2674372 - protein, 32 aa, Entamoeba histolytica
ETKSWGQAHCQARFALFKAVEKSGAVEVVGEN

SEQ ID NO: 2674373 - protein, 22 aa, Entamoeba histolytica
ETKTPAPFKIVTRNRAGEQLKN

SEQ ID NO: 2674374 - protein, 23 aa, Entamoeba histolytica
ETKVESFFDLFYPQELALNNDIN

SEQ ID NO: 2674375 - protein, 25 aa, Entamoeba histolytica
ETKWKEIFEEFVLKEYVSTVLIPNK

SEQ ID NO: 2674376 - protein, 22 aa, Entamoeba histolytica
ETLCDNCDCIARNINKVLESNQ

SEQ ID NO: 2674377 - protein, 18 aa, Entamoeba histolytica
ETLCRFKQSNNWKDSLEK

SEQ ID NO: 2674378 - protein, 19 aa, Entamoeba histolytica
ETLEFAFKYFITPYVVEQL

SEQ ID NO: 2674379 - protein, 19 aa, Entamoeba histolytica
ETLETCIRIVGKYYLDAGE

SEQ ID NO: 2674380 - protein, 26 aa, Entamoeba histolytica
ETLKALGANLRWASCNIFSTQDHAAA

SEQ ID NO: 2674381 - protein, 18 aa, Entamoeba histolytica
ETLLCPISAFTQHNNVMV

SEQ ID NO: 2674382 - protein, 20 aa, Entamoeba histolytica
ETLMGFPYCVIDLTNGEVYL

SEQ ID NO: 2674383 - protein, 29 aa, Entamoeba histolytica
ETLSSFIVKLFPEFSLLFNGAELEKMKPN

SEQ ID NO: 2674384 - protein, 17 aa, Entamoeba histolytica
ETLWIDTFDQFEIKFKL

SEQ ID NO: 2674385 - protein, 18 aa, Entamoeba histolytica
ETMFPPPVFYEMKNGALL

SEQ ID NO: 2674386 - protein, 24 aa, Entamoeba histolytica
ETMLKSEHLVAIGYEDIIKANEVN

SEQ ID NO: 2674387 - protein, 22 aa, Entamoeba histolytica
ETMRTPLHYLCRNRHLEKNISI

SEQ ID NO: 2674388 - protein, 22 aa, Entamoeba histolytica
ETNFGLSETVIFVRNLPFSMDS

SEQ ID NO: 2674389 - protein, 18 aa, Entamoeba histolytica
ETNIPFMEVIGLFDGHHG

SEQ ID NO: 2674390 - protein, 21 aa, Entamoeba histolytica
ETNKIKEELGWEPQQETTQDN

SEQ ID NO: 2674391 - protein, 24 aa, Entamoeba histolytica
ETNLKKRALLIIRELNNLRVSTFN

SEQ ID NO: 2674392 - protein, 28 aa, Entamoeba histolytica
ETNPKSISLEMIWYMRALYQKHGNNVTA

SEQ ID NO: 2674393 - protein, 26 aa, Entamoeba histolytica
ETNWIYYFFIKEFKKILVEMNNPCND

SEQ ID NO: 2674394 - protein, 25 aa, Entamoeba histolytica
ETPEYWLEAGNPWEIVRKDVNHEVR

SEQ ID NO: 2674395 - protein, 20 aa, Entamoeba histolytica
ETPLHLACLCGIIDNVELLL

SEQ ID NO: 2674396 - protein, 19 aa, Entamoeba histolytica
ETPPIIEIFNNFNGEKLPV

SEQ ID NO: 2674397 - protein, 26 aa, Entamoeba histolytica
ETPPVPVEIQILWKLENDDLVPATMK

SEQ ID NO: 2674398 - protein, 20 aa, Entamoeba histolytica
ETPTGWKFFGNLMDSGKISL

SEQ ID NO: 2674399 - protein, 20 aa, Entamoeba histolytica
ETQDSLPILRYVNIPLSDKT

SEQ ID NO: 2674400 - protein, 22 aa, Entamoeba histolytica
ETQLKLDEEALMKCISEGQMKE

SEQ ID NO: 2674401 - protein, 21 aa, Entamoeba histolytica
ETRFLEGLKDNWQNTQLKEYS

SEQ ID NO: 2674402 - protein, 18 aa, Entamoeba histolytica
ETRFTEIEKPAVEMKYIN

SEQ ID NO: 2674403 - protein, 20 aa, Entamoeba histolytica
ETRLPGIFNALLPHVKDFEN

SEQ ID NO: 2674404 - protein, 20 aa, Entamoeba histolytica
ETRWIKKCFSDISILINSIE

SEQ ID NO: 2674405 - protein, 23 aa, Entamoeba histolytica
ETRYEWMAFLLAATRQGIVIVTV

SEQ ID NO: 2674406 - protein, 19 aa, Entamoeba histolytica
ETRYHFAVQLYPFAEQMKE

SEQ ID NO: 2674407 - protein, 25 aa, Entamoeba histolytica
ETRYLRPGEYIQMSGRAGRRGKDDQ

SEQ ID NO: 2674408 - protein, 23 aa, Entamoeba histolytica
ETSCLPSFIKNGMIYSYRKDPEP

SEQ ID NO: 2674409 - protein, 19 aa, Entamoeba histolytica
ETSCSLFTNNICTIPTTKQ

SEQ ID NO: 2674410 - protein, 20 aa, Entamoeba histolytica
ETSDSLIIFPNRGINLFTIF

SEQ ID NO: 2674411 - protein, 28 aa, Entamoeba histolytica
ETSFRTPCLFCKEFLDIDLLLKHMNEKH

SEQ ID NO: 2674412 - protein, 18 aa, Entamoeba histolytica
ETSFYCVSRFKETIEKIF

SEQ ID NO: 2674413 - protein, 25 aa, Entamoeba histolytica
ETSKMAAVVLRFFLDTESESSLDME

SEQ ID NO: 2674414 - protein, 24 aa, Entamoeba histolytica
ETSLRYRIIDILTQIIQIYPNVIT

SEQ ID NO: 2674415 - protein, 21 aa, Entamoeba histolytica
ETSNCFIQFKCMKYINLALFT

SEQ ID NO: 2674416 - protein, 21 aa, Entamoeba histolytica
ETSVFFRNLILNIIVDKIELG

SEQ ID NO: 2674417 - protein, 19 aa, Entamoeba histolytica
ETSVQCLWGATNYVIDSND

SEQ ID NO: 2674418 - protein, 31 aa, Entamoeba histolytica
ETSYFPFKGINILCVVFDFSNDSIKNIGNWI

SEQ ID NO: 2674419 - protein, 22 aa, Entamoeba histolytica
ETTALLCYNSEYARTEEGKQDP

SEQ ID NO: 2674420 - protein, 23 aa, Entamoeba histolytica
ETTCGKLPMNYAIESPHVDIIIK

SEQ ID NO: 2674421 - protein, 25 aa, Entamoeba histolytica
ETTDIKRPPALVIVSETKLGKTEFI

SEQ ID NO: 2674422 - protein, 27 aa, Entamoeba histolytica
ETTKIKCVLSPSIFDRIHIKEGVYITS

SEQ ID NO: 2674423 - protein, 26 aa, Entamoeba histolytica
ETTLPLRWKVFLSFLPPTPELWKKID

SEQ ID NO: 2674424 - protein, 24 aa, Entamoeba histolytica
ETTQTGLFNYFFGKTDEYDEPPKY

SEQ ID NO: 2674425 - protein, 19 aa, Entamoeba histolytica
ETVDYRFSPNVFDKHLEEI

SEQ ID NO: 2674426 - protein, 21 aa, Entamoeba histolytica
ETVGLGIPVSLMLLKKNQELI

SEQ ID NO: 2674427 - protein, 21 aa, Entamoeba histolytica
ETVIKLLIGNKCDLDDERAVT

SEQ ID NO: 2674428 - protein, 28 aa, Entamoeba histolytica
ETVKEGKLLFGERFLRVDPILPGQILLD

SEQ ID NO: 2674429 - protein, 18 aa, Entamoeba histolytica
ETVKEIWRNGKIILEKND

SEQ ID NO: 2674430 - protein, 20 aa, Entamoeba histolytica
ETVLFLLSLVPGVFFGKPAN

SEQ ID NO: 2674431 - protein, 29 aa, Entamoeba histolytica
ETWKRAEERKGRRENPYTSVIGKLQQKLF

SEQ ID NO: 2674432 - protein, 20 aa, Entamoeba histolytica
ETWRKMKSQTDEMKKLQEQI

SEQ ID NO: 2674433 - protein, 22 aa, Entamoeba histolytica
ETYGNAALIMLRKGEITKAESY

SEQ ID NO: 2674434 - protein, 22 aa, Entamoeba histolytica
ETYIRPYFSDVFRPIKKDDHFL

SEQ ID NO: 2674435 - protein, 25 aa, Entamoeba histolytica
ETYKTNFAGLLWRPQPTNIIKPEMA

SEQ ID NO: 2674436 - protein, 26 aa, Entamoeba histolytica
ETYKTNFAGLLWRPQPTNIIKPEMAK

SEQ ID NO: 2674437 - protein, 24 aa, Entamoeba histolytica
ETYNCIRIKYGIIDSNQFILDSFK

SEQ ID NO: 2674438 - protein, 27 aa, Entamoeba histolytica
ETYRISRLIKEYGLIPLVELVFGGRRR

SEQ ID NO: 2674439 - protein, 23 aa, Entamoeba histolytica
EVAAAYRRLIERGSVPDINKAPF

SEQ ID NO: 2674440 - protein, 25 aa, Entamoeba histolytica
EVAIKLELLKCKHPQLKDEFELYQK

SEQ ID NO: 2674441 - protein, 24 aa, Entamoeba histolytica
EVCDRKKIMLHMIHIYKEKKEVEE

SEQ ID NO: 2674442 - protein, 23 aa, Entamoeba histolytica
EVCGIYFCYNEWFERARCIKSPY

SEQ ID NO: 2674443 - protein, 20 aa, Entamoeba histolytica
EVCPKCKGKGVVVNEKDLCK

SEQ ID NO: 2674444 - protein, 24 aa, Entamoeba histolytica
EVCVDGCFIRCLLEKGEITLSDPR

SEQ ID NO: 2674445 - protein, 17 aa, Entamoeba histolytica
EVDMRHAIKAIKVNGKK

SEQ ID NO: 2674446 - protein, 19 aa, Entamoeba histolytica
EVDVKFYAAQIVLALEHMH

SEQ ID NO: 2674447 - protein, 21 aa, Entamoeba histolytica
EVDVKMGFLLLKNYLLNLPVP

SEQ ID NO: 2674448 - protein, 21 aa, Entamoeba histolytica
EVEFNRFYSIFNRVYSLQEVN

SEQ ID NO: 2674449 - protein, 21 aa, Entamoeba histolytica
EVEGTLLHFVDNCFTAFGKRM

SEQ ID NO: 2674450 - protein, 23 aa, Entamoeba histolytica
EVEKKNRFGLIITSKHQNICMLF

SEQ ID NO: 2674451 - protein, 19 aa, Entamoeba histolytica
EVEMFSKLVKCENLRCFVW

SEQ ID NO: 2674452 - protein, 26 aa, Entamoeba histolytica
EVESYLKYKVIWIVCGTMADLPKHID

SEQ ID NO: 2674453 - protein, 23 aa, Entamoeba histolytica
EVEWLDGKLRYMIQLEAEDLMGV

SEQ ID NO: 2674454 - protein, 20 aa, Entamoeba histolytica
EVFEMAAKVALGMEDETGDK

SEQ ID NO: 2674455 - protein, 20 aa, Entamoeba histolytica
EVFGGYCSDVPVVDDIARGV

SEQ ID NO: 2674456 - protein, 20 aa, Entamoeba histolytica
EVFHPKRGFFGNLYQMIFHP

SEQ ID NO: 2674457 - protein, 21 aa, Entamoeba histolytica
EVFPDLDMLPLFLTKKKILSR

SEQ ID NO: 2674458 - protein, 19 aa, Entamoeba histolytica
EVFQGFTGCEMYGIFKHGH

SEQ ID NO: 2674459 - protein, 19 aa, Entamoeba histolytica
EVFSTGFGEHLEKLAHPNG

SEQ ID NO: 2674460 - protein, 19 aa, Entamoeba histolytica
EVFTSPLLVDKIVLNVDFW

SEQ ID NO: 2674461 - protein, 17 aa, Entamoeba histolytica
EVGELEFIRHMQILAKF

SEQ ID NO: 2674462 - protein, 20 aa, Entamoeba histolytica
EVGKACGFQGNDLEILKQIH

SEQ ID NO: 2674463 - protein, 18 aa, Entamoeba histolytica
EVGNKVCLVIGEKGLLGR

SEQ ID NO: 2674464 - protein, 17 aa, Entamoeba histolytica
EVHKLRFPDSLKNLLEH

SEQ ID NO: 2674465 - protein, 19 aa, Entamoeba histolytica
EVIEGINIELPQITFPPTI

SEQ ID NO: 2674466 - protein, 23 aa, Entamoeba histolytica
EVIEGITSFDIMKITENYEQQMS

SEQ ID NO: 2674467 - protein, 18 aa, Entamoeba histolytica
EVIEHINESFSVYMNQIN

SEQ ID NO: 2674468 - protein, 20 aa, Entamoeba histolytica
EVIIHYNIWDFPNWEINKDI

SEQ ID NO: 2674469 - protein, 26 aa, Entamoeba histolytica
EVIKTIPKFWYYALKNSGYLDIVFAN

SEQ ID NO: 2674470 - protein, 25 aa, Entamoeba histolytica
EVILGLPYSSAIDMWSFGCMAAELF

SEQ ID NO: 2674471 - protein, 26 aa, Entamoeba histolytica
EVILVLKANYEWSYPQYVCEYICEEL

SEQ ID NO: 2674472 - protein, 33 aa, Entamoeba histolytica
EVIMKSCSLPFLFKPYGNCISGMVIQPNPSNYA

SEQ ID NO: 2674473 - protein, 19 aa, Entamoeba histolytica
EVINEINLHCQFKLILNNN

SEQ ID NO: 2674474 - protein, 19 aa, Entamoeba histolytica
EVIQTYCGIVVNKDKSMQW

SEQ ID NO: 2674475 - protein, 18 aa, Entamoeba histolytica
EVISDPIGVMKRIYQKVG

SEQ ID NO: 2674476 - protein, 19 aa, Entamoeba histolytica
EVISILLQKYMNIFSGHVL

SEQ ID NO: 2674477 - protein, 19 aa, Entamoeba histolytica
EVISVPSFFFIFSDATSYI

SEQ ID NO: 2674478 - protein, 27 aa, Entamoeba histolytica
EVITPYVYHLRLLISTMHQALNSYRPY

SEQ ID NO: 2674479 - protein, 20 aa, Entamoeba histolytica
EVKEIRRGLDELIQQEKEKK

SEQ ID NO: 2674480 - protein, 30 aa, Entamoeba histolytica
EVKELQKIIEEWKVKEKEWKEQVEENQKEK

SEQ ID NO: 2674481 - protein, 25 aa, Entamoeba histolytica
EVKFNRLIIPISFGNHFSPAFSCIT

SEQ ID NO: 2674482 - protein, 17 aa, Entamoeba histolytica
EVKKELEIEILKDNGNE

SEQ ID NO: 2674483 - protein, 28 aa, Entamoeba histolytica
EVKKIDSKFNYKELFGDVKNRKHEVDEL

SEQ ID NO: 2674484 - protein, 17 aa, Entamoeba histolytica
EVKMVKCHQMKIVDTSN

SEQ ID NO: 2674485 - protein, 20 aa, Entamoeba histolytica
EVKNAVITCPAYFNDSQRQA

SEQ ID NO: 2674486 - protein, 23 aa, Entamoeba histolytica
EVKPMVNDEIIVFESSAVGGAET

SEQ ID NO: 2674487 - protein, 23 aa, Entamoeba histolytica
EVKRINLEYGKGVFSKKKYQKEE

SEQ ID NO: 2674488 - protein, 23 aa, Entamoeba histolytica
EVKSLGFRCFYRCYDIQSINIPT

SEQ ID NO: 2674489 - protein, 18 aa, Entamoeba histolytica
EVKSYGEIVIAYSQKEMI

SEQ ID NO: 2674490 - protein, 24 aa, Entamoeba histolytica
EVKTKEYYLPFVFLDGKADQQQID

SEQ ID NO: 2674491 - protein, 26 aa, Entamoeba histolytica
EVKTLLNTRMHLWLEYYTINQAMSSN

SEQ ID NO: 2674492 - protein, 24 aa, Entamoeba histolytica
EVKTPISIICCDTFILTQYNNQIQ

SEQ ID NO: 2674493 - protein, 19 aa, Entamoeba histolytica
EVKYILKLLEELLEQNDFN

SEQ ID NO: 2674494 - protein, 17 aa, Entamoeba histolytica
EVLAWYGAACTGALSSI

SEQ ID NO: 2674495 - protein, 20 aa, Entamoeba histolytica
EVLETAILHCLKKILEKESG

SEQ ID NO: 2674496 - protein, 18 aa, Entamoeba histolytica
EVLEYGFDFAQKKMGIDR

SEQ ID NO: 2674497 - protein, 17 aa, Entamoeba histolytica
EVLKLLMTRVKRLYEFI

SEQ ID NO: 2674498 - protein, 17 aa, Entamoeba histolytica
EVLKNILLIGFKHLEVI

SEQ ID NO: 2674499 - protein, 24 aa, Entamoeba histolytica
EVLKSEIIYILAIIDKTKRTGVKF

SEQ ID NO: 2674500 - protein, 21 aa, Entamoeba histolytica
EVLLRKVYKKELIDQNINKIK

SEQ ID NO: 2674501 - protein, 22 aa, Entamoeba histolytica
EVLMNRRIYLMEGVVNGISIAN

SEQ ID NO: 2674502 - protein, 19 aa, Entamoeba histolytica
EVLMTCVFLNYGEQTLPPI

SEQ ID NO: 2674503 - protein, 20 aa, Entamoeba histolytica
EVLNCLYLTQYVVKRQSSFR

SEQ ID NO: 2674504 - protein, 24 aa, Entamoeba histolytica
EVLPEHFEVFKLLCKLFTEIINRK

SEQ ID NO: 2674505 - protein, 18 aa, Entamoeba histolytica
EVLQKCNEYCIMIDNLCQ

SEQ ID NO: 2674506 - protein, 24 aa, Entamoeba histolytica
EVLQRRVAETKGHIIPKVVWGTEY

SEQ ID NO: 2674507 - protein, 26 aa, Entamoeba histolytica
EVLSSFNYAFYWALTTIKPFPLITSS

SEQ ID NO: 2674508 - protein, 18 aa, Entamoeba histolytica
EVLTYKGPVPSYVDQVLI

SEQ ID NO: 2674509 - protein, 17 aa, Entamoeba histolytica
EVLYKMLICSPPDSLHF

SEQ ID NO: 2674510 - protein, 25 aa, Entamoeba histolytica
EVMDIPEGYEILFFGGGASLQFLMV

SEQ ID NO: 2674511 - protein, 27 aa, Entamoeba histolytica
EVMFNKRLGSYYQLECEPEGFDKDDNE

SEQ ID NO: 2674512 - protein, 24 aa, Entamoeba histolytica
EVMKCSNLHFIGIMTIGMVGDSKK

SEQ ID NO: 2674513 - protein, 25 aa, Entamoeba histolytica
EVMKEIWIGLYFWYWHSDGRDYQEK

SEQ ID NO: 2674514 - protein, 17 aa, Entamoeba histolytica
EVMKKLLTPLGLEQYAE

SEQ ID NO: 2674515 - protein, 19 aa, Entamoeba histolytica
EVMLLYNIVYSICASQDDR

SEQ ID NO: 2674516 - protein, 19 aa, Entamoeba histolytica
EVMQAMLFGIITNLFSNDQ

SEQ ID NO: 2674517 - protein, 33 aa, Entamoeba histolytica
EVMTVLHFKLSTIIRVVGGWVRDKLLGKESHDI

SEQ ID NO: 2674518 - protein, 22 aa, Entamoeba histolytica
EVMYAHAMKEGFVMSNNIGDRI

SEQ ID NO: 2674519 - protein, 26 aa, Entamoeba histolytica
EVMYLLGVDVGQAFGYSIMKLLFEGK

SEQ ID NO: 2674520 - protein, 29 aa, Entamoeba histolytica
EVNALKSIGFKMGIDLAFNTHFHLPCVEN

SEQ ID NO: 2674521 - protein, 19 aa, Entamoeba histolytica
EVNDVCWSKSNTNWIAASI

SEQ ID NO: 2674522 - protein, 17 aa, Entamoeba histolytica
EVNELFEQIKLFQQCID

SEQ ID NO: 2674523 - protein, 22 aa, Entamoeba histolytica
EVNGKWTCCGRVRQHSHTVKSL

SEQ ID NO: 2674524 - protein, 32 aa, Entamoeba histolytica; identical to SEQ ID NO: 2480602

SEQ ID NO: 2674525 - protein, 20 aa, Entamoeba histolytica
EVNIRYLALDTFVLLGQANY

SEQ ID NO: 2674526 - protein, 28 aa, Entamoeba histolytica
EVNRAKESFWCASGKGVNVCRVLQQQSI

SEQ ID NO: 2674527 - protein, 24 aa, Entamoeba histolytica
EVNSLGDICFRWCDDIQSINIPIN

SEQ ID NO: 2674528 - protein, 29 aa, Entamoeba histolytica
EVNTFLFCYRDLYEAQEFILKYGKGYKKY

SEQ ID NO: 2674529 - protein, 20 aa, Entamoeba histolytica
EVPTSWVLQILGNIDDPFMG

SEQ ID NO: 2674530 - protein, 26 aa, Entamoeba histolytica
EVQIIQRICLYWLRYDESTEEVIMEK

SEQ ID NO: 2674531 - protein, 21 aa, Entamoeba histolytica
EVQLFPRLLAIKISKFSSFLL

SEQ ID NO: 2674532 - protein, 21 aa, Entamoeba histolytica
EVQLLNKLHCYLRGSTEQAEQ

SEQ ID NO: 2674533 - protein, 28 aa, Entamoeba histolytica
EVREAAFNFVIDCVFKYGEQEQLTDMFM

SEQ ID NO: 2674534 - protein, 20 aa, Entamoeba histolytica
EVRFKRIVSEFGDENYEIDN

SEQ ID NO: 2674535 - protein, 19 aa, Entamoeba histolytica
EVRKRLVVINATPNKLKVP

SEQ ID NO: 2674536 - protein, 23 aa, Entamoeba histolytica
EVRPVCQKACHMYLSAVDVEVQQ

SEQ ID NO: 2674537 - protein, 31 aa, Entamoeba histolytica
EVRQSIYKMMKWWFDKGIDGFRMDVINLISK

SEQ ID NO: 2674538 - protein, 22 aa, Entamoeba histolytica
EVRSRALFYLNIINSQITTTLE

SEQ ID NO: 2674539 - protein, 24 aa, Entamoeba histolytica
EVRSWALLCLSKLWEGSVEIKIRA

SEQ ID NO: 2674540 - protein, 19 aa, Entamoeba histolytica
EVRTTPAYYSFKSDCWSVG

SEQ ID NO: 2674541 - protein, 25 aa, Entamoeba histolytica
EVSCMDKSRLDYMFHWKKPNENPVI

SEQ ID NO: 2674542 - protein, 19 aa, Entamoeba histolytica
EVSDRMSFDLKRLSTNAKA

SEQ ID NO: 2674543 - protein, 26 aa, Entamoeba histolytica
EVSGLLFHRAVFFTAALLRFHINTLV

SEQ ID NO: 2674544 - protein, 20 aa, Entamoeba histolytica
EVSIPMGYFSRVFLDNDTDF

SEQ ID NO: 2674545 - protein, 29 aa, Entamoeba histolytica
EVSRSVGMIACASFKKTAIQFGTRMAKLL

SEQ ID NO: 2674546 - protein, 20 aa, Entamoeba histolytica
EVSVSEFYYLVFKNSGILDY

SEQ ID NO: 2674547 - protein, 24 aa, Entamoeba histolytica
EVTKKYFDWFWKEENQVIIEQIVY

SEQ ID NO: 2674548 - protein, 24 aa, Entamoeba histolytica
EVTKSGRTPFHYAVLGGHLSLVRQ

SEQ ID NO: 2674549 - protein, 22 aa, Entamoeba histolytica
EVTMGISCIEFKPETTEAIRTS

SEQ ID NO: 2674550 - protein, 23 aa, Entamoeba histolytica
EVTPEIFPYLLVNVGSGVSILKV

SEQ ID NO: 2674551 - protein, 17 aa, Entamoeba histolytica
EVTRICKEFEIKKQTSE

SEQ ID NO: 2674552 - protein, 25 aa, Entamoeba histolytica
EVVCCRFSPCLYKSVNFDGKKRAFS

SEQ ID NO: 2674553 - protein, 21 aa, Entamoeba histolytica
EVVDGIPYWDTELFMMKDLHI

SEQ ID NO: 2674554 - protein, 19 aa, Entamoeba histolytica
EVVDRLAGATNNVQYAHIS

SEQ ID NO: 2674555 - protein, 20 aa, Entamoeba histolytica
EVVVTFGGHLYRGNRVQKLK

SEQ ID NO: 2674556 - protein, 23 aa, Entamoeba histolytica
EVYGLDLPSRWNLFNKEQQDRFR

SEQ ID NO: 2674557 - protein, 20 aa, Entamoeba histolytica
EVYRCILHYHELFQKSINEL

SEQ ID NO: 2674558 - protein, 27 aa, Entamoeba histolytica
EVYYNGLPLRFGYSIEDFCERQYQMEQ

SEQ ID NO: 2674559 - protein, 26 aa, Entamoeba histolytica
EWAEELGASCFAHWFQPLSQTTARKY

SEQ ID NO: 2674560 - protein, 18 aa, Entamoeba histolytica
EWALEGGALVLADEGVCL

SEQ ID NO: 2674561 - protein, 28 aa, Entamoeba histolytica
EWCDGEFNVICATIAFGMGIDKPDVRFV

SEQ ID NO: 2674562 - protein, 21 aa, Entamoeba histolytica
EWCGNLIVVEFSETIESKRNR

SEQ ID NO: 2674563 - protein, 17 aa, Entamoeba histolytica
EWCKKKALECLRKAYDY

SEQ ID NO: 2674564 - protein, 26 aa, Entamoeba histolytica
EWELNFPLVECICSLMFLNDIESNEK

SEQ ID NO: 2674565 - protein, 28 aa, Entamoeba histolytica
EWFERARCIKSPYFHPLIGYQEKILNVL

SEQ ID NO: 2674566 - protein, 26 aa, Entamoeba histolytica
EWHMQAVCAITVWLKERNYNFWMNET

SEQ ID NO: 2674567 - protein, 22 aa, Entamoeba histolytica
EWINKMRLVIGAEVDEIAPKIF

SEQ ID NO: 2674568 - protein, 20 aa, Entamoeba histolytica
EWKGKKLIHFGAVDYEATVY

SEQ ID NO: 2674569 - protein, 18 aa, Entamoeba histolytica
EWKNEYDQQIVLAVQKNG

SEQ ID NO: 2674570 - protein, 23 aa, Entamoeba histolytica
EWKVYYKRINIMKNRKIDMDRHF

SEQ ID NO: 2674571 - protein, 25 aa, Entamoeba histolytica
EWMIPLKSIHSFSVIANKITVVKND

SEQ ID NO: 2674572 - protein, 20 aa, Entamoeba histolytica
EWNYCIFNDTLILLSQQPDN

SEQ ID NO: 2674573 - protein, 22 aa, Entamoeba histolytica
EWRERVEVCVHSFSRLKPTSLN

SEQ ID NO: 2674574 - protein, 21 aa, Entamoeba histolytica
EWRKLGIQQSVGWVHYDIFKP

SEQ ID NO: 2674575 - protein, 17 aa, Entamoeba histolytica
EWSILYEKLENIVKSGA

SEQ ID NO: 2674576 - protein, 20 aa, Entamoeba histolytica
EWSSPVVPNEKWEMNYSNGW

SEQ ID NO: 2674577 - protein, 19 aa, Entamoeba histolytica
EWVFNRSFIPLKFSLDKKN

SEQ ID NO: 2674578 - protein, 19 aa, Entamoeba histolytica
EWVLEGGALVLADMGICCI

SEQ ID NO: 2674579 - protein, 17 aa, Entamoeba histolytica
EWYDCWSKMERKLIKGL

SEQ ID NO: 2674580 - protein, 17 aa, Entamoeba histolytica
EYAELVMKFNDREMVCV

SEQ ID NO: 2674581 - protein, 24 aa, Entamoeba histolytica
EYAQAMKFLGIRPQKRVIGNEKAW

SEQ ID NO: 2674582 - protein, 25 aa, Entamoeba histolytica
EYAQKYPFVCFAKITWEDSNKPFPE

SEQ ID NO: 2674583 - protein, 19 aa, Entamoeba histolytica
EYCEKHPKFIILLPSKNEA

SEQ ID NO: 2674584 - protein, 25 aa, Entamoeba histolytica
EYCFIPFKYRDGYLISILKETEGKT

SEQ ID NO: 2674585 - protein, 19 aa, Entamoeba histolytica
EYCISKGLDFEKFIEDYNP

SEQ ID NO: 2674586 - protein, 17 aa, Entamoeba histolytica
EYDEVWPSIKEQVSSGV

SEQ ID NO: 2674587 - protein, 26 aa, Entamoeba histolytica
EYDKYGIIIKTMFRKEGSLQQLNAHT

SEQ ID NO: 2674588 - protein, 24 aa, Entamoeba histolytica
EYEAFKLAASYFLYNQYFVNGKWP

SEQ ID NO: 2674589 - protein, 23 aa, Entamoeba histolytica
EYEENYCVFWCERENTLGKYVSM

SEQ ID NO: 2674590 - protein, 17 aa, Entamoeba histolytica
EYEGVIDLMKYSGGYNW

SEQ ID NO: 2674591 - protein, 18 aa, Entamoeba histolytica
EYEKGCFEGCETLKEIVE

SEQ ID NO: 2674592 - protein, 24 aa, Entamoeba histolytica
EYEKKFGLDLHQFFTSMPEKPIST

SEQ ID NO: 2674593 - protein, 24 aa, Entamoeba histolytica
EYETWKSNAIYLYSFLTTYETSFP

SEQ ID NO: 2674594 - protein, 22 aa, Entamoeba histolytica
EYEVFKTFLSFSCNTTIQDYIL

SEQ ID NO: 2674595 - protein, 20 aa, Entamoeba histolytica
EYFFVPLIKRKCIVKQDYLV

SEQ ID NO: 2674596 - protein, 17 aa, Entamoeba histolytica
EYFKTAEIMIWRPIELE

SEQ ID NO: 2674597 - protein, 17 aa, Entamoeba histolytica
EYFRNALFKYFDKYLRE

SEQ ID NO: 2674598 - protein, 23 aa, Entamoeba histolytica
EYGEGDLFLGVSLPLIRKETKVF

SEQ ID NO: 2674599 - protein, 28 aa, Entamoeba histolytica
EYHLKLCLCPLCKHGIEVFGSKRPVSWI

SEQ ID NO: 2674600 - protein, 47 aa, Entamoeba histolytica
EYHLKLCLCPLCKHGMEVFGVKRPVSWILICRVILYSLMELHKGTVY

SEQ ID NO: 2674601 - protein, 25 aa, Entamoeba histolytica
EYIEEFPPLLSQVGMGARIRNYCRR

SEQ ID NO: 2674602 - protein, 18 aa, Entamoeba histolytica
EYIEIVLSTTPKFFERMY

SEQ ID NO: 2674603 - protein, 18 aa, Entamoeba histolytica
EYIFSAYCDREYCKTTKT

SEQ ID NO: 2674604 - protein, 24 aa, Entamoeba histolytica
EYIGLKGQHCYGCMGMGIPNITYH

SEQ ID NO: 2674605 - protein, 19 aa, Entamoeba histolytica
EYIIKCSKIKPINKKDIEN

SEQ ID NO: 2674606 - protein, 18 aa, Entamoeba histolytica
EYIILFLKYDKRILDSLK

SEQ ID NO: 2674607 - protein, 17 aa, Entamoeba histolytica
EYIIMVELLARRIIPNF

SEQ ID NO: 2674608 - protein, 24 aa, Entamoeba histolytica
EYIMHSSMKNWSFVPVTLADYLYL

SEQ ID NO: 2674609 - protein, 24 aa, Entamoeba histolytica
EYINCLNLSWDKVPEMLRNMNTGD

SEQ ID NO: 2674610 - protein, 20 aa, Entamoeba histolytica
EYINELWILLVDTIAISFKD

SEQ ID NO: 2674611 - protein, 17 aa, Entamoeba histolytica
EYINYGGYFIEKGDEEI

SEQ ID NO: 2674612 - protein, 25 aa, Entamoeba histolytica
EYIQPLIIGCWRLCNEDKCQKEFIE

SEQ ID NO: 2674613 - protein, 20 aa, Entamoeba histolytica
EYIYNIFLYNDIRLTSNPVL

SEQ ID NO: 2674614 - protein, 20 aa, Entamoeba histolytica
EYKEKILTFDGINLGGNKIE

SEQ ID NO: 2674615 - protein, 17 aa, Entamoeba histolytica
EYKEKKQILDLKKEIKA

SEQ ID NO: 2674616 - protein, 23 aa, Entamoeba histolytica
EYKIQLMKLWKLKIGIGSEDCVR

SEQ ID NO: 2674617 - protein, 20 aa, Entamoeba histolytica
EYKLPVYTYDGTTGYMTSTD

SEQ ID NO: 2674618 - protein, 22 aa, Entamoeba histolytica
EYKMTVYLSKILPRFVTDINNE

SEQ ID NO: 2674619 - protein, 19 aa, Entamoeba histolytica
EYLCRVRGRLEKTTVTSKI

SEQ ID NO: 2674620 - protein, 24 aa, Entamoeba histolytica
EYLEKASVFKIDYTIELIVSSLLE

SEQ ID NO: 2674621 - protein, 21 aa, Entamoeba histolytica
EYLICYNGAMICHGNEIVFES

SEQ ID NO: 2674622 - protein, 21 aa, Entamoeba histolytica
EYLIRAGVINLTLYYPEINND

SEQ ID NO: 2674623 - protein, 25 aa, Entamoeba histolytica
EYLPDLKGSVLLLIKSEIGDKILTV

SEQ ID NO: 2674624 - protein, 17 aa, Entamoeba histolytica
EYLPSYVCNETIQKQFE

SEQ ID NO: 2674625 - protein, 18 aa, Entamoeba histolytica
EYLRPCEVMQVFKELLEK

SEQ ID NO: 2674626 - protein, 17 aa, Entamoeba histolytica
EYLTEIFESPSISRSAY

SEQ ID NO: 2674627 - protein, 26 aa, Entamoeba histolytica
EYLTIGIALDCRRVDVIKEILGKTKE

SEQ ID NO: 2674628 - protein, 21 aa, Entamoeba histolytica
EYMSRLLRACGYIYTTSAQME

SEQ ID NO: 2674629 - protein, 23 aa, Entamoeba histolytica
EYMYCVNRIYNLLKRSHGNYFGD

SEQ ID NO: 2674630 - protein, 18 aa, Entamoeba histolytica
EYNHLLLSIVESYKQRIK

SEQ ID NO: 2674631 - protein, 17 aa, Entamoeba histolytica
EYNKENHGFFLYDKQLF

SEQ ID NO: 2674632 - protein, 25 aa, Entamoeba histolytica
EYNLLWWKNKVYVIDVGQSIELSHP

SEQ ID NO: 2674633 - protein, 26 aa, Entamoeba histolytica
EYNLTVLRCCCSILANVGPYIIDLEC

SEQ ID NO: 2674634 - protein, 25 aa, Entamoeba histolytica
EYNMLFKFINMLGMPPRNLLDKGSK

SEQ ID NO: 2674635 - protein, 24 aa, Entamoeba histolytica
EYNPKRFGALIIRITNPKTTALVF

SEQ ID NO: 2674636 - protein, 25 aa, Entamoeba histolytica
EYNRCKRAKLKKSDFETIKVIGRGG

SEQ ID NO: 2674637 - protein, 29 aa, Entamoeba histolytica
EYPSLKRLVLRPIGWLSLSQLFIDKTHRI

SEQ ID NO: 2674638 - protein, 22 aa, Entamoeba histolytica
EYPYGYCIIIGCCTDKNDVLGS

SEQ ID NO: 2674639 - protein, 25 aa, Entamoeba histolytica
EYQFARVAKDCRLVNEIMDVPLYIS

SEQ ID NO: 2674640 - protein, 24 aa, Entamoeba histolytica
EYQKAFESSRKWRCIAKRDTALQS

SEQ ID NO: 2674641 - protein, 22 aa, Entamoeba histolytica
EYQKPSFDWKVFEKELKGDKKE

SEQ ID NO: 2674642 - protein, 24 aa, Entamoeba histolytica
EYQNALRLYIDWDKANLKEVPKTC

SEQ ID NO: 2674643 - protein, 26 aa, Entamoeba histolytica
EYQNGVPCFWLHVLKNSGIFDGLSGN

SEQ ID NO: 2674644 - protein, 19 aa, Entamoeba histolytica
EYQNIVSFRAYVTAALFLG

SEQ ID NO: 2674645 - protein, 28 aa, Entamoeba histolytica
EYRMLYFNFNLRKIFFLRHAKVREEILF

SEQ ID NO: 2674646 - protein, 22 aa, Entamoeba histolytica
EYRREVWKILLQCHPLDQSKKE

SEQ ID NO: 2674647 - protein, 19 aa, Entamoeba histolytica
EYSCICEECFKNGNHEGHD

SEQ ID NO: 2674648 - protein, 18 aa, Entamoeba histolytica
EYSFLKCPFNEMIQIPQL

SEQ ID NO: 2674649 - protein, 24 aa, Entamoeba histolytica
EYSPILFKLVFRADLVVEYITIFN

SEQ ID NO: 2674650 - protein, 21 aa, Entamoeba histolytica
EYSQLTAPCFGKGEMIIPDSI

SEQ ID NO: 2674651 - protein, 28 aa, Entamoeba histolytica
EYSVDIIACLLKCFLQKMPIHIIDTMKS

SEQ ID NO: 2674652 - protein, 17 aa, Entamoeba histolytica
EYTAREWLIPQTQEDNT

SEQ ID NO: 2674653 - protein, 17 aa, Entamoeba histolytica
EYTEFLQNFVIPNGELV

SEQ ID NO: 2674654 - protein, 17 aa, Entamoeba histolytica
EYVGIMVSLGSYNSTNT

SEQ ID NO: 2674655 - protein, 21 aa, Entamoeba histolytica
EYVRLKGYKSIAFPCISTGIF

SEQ ID NO: 2674656 - protein, 24 aa, Entamoeba histolytica
EYVSRLYIGPKIAPLFVNKFEHCT

SEQ ID NO: 2674657 - protein, 20 aa, Entamoeba histolytica
EYVSTVGVYILNYTDGTLTY

SEQ ID NO: 2674658 - protein, 17 aa, Entamoeba histolytica
EYWYHLMNWKIPEEHIV

SEQ ID NO: 2674659 - protein, 20 aa, Entamoeba histolytica
EYYDGGSLFDLIGDFTQPIP

SEQ ID NO: 2674660 - protein, 26 aa, Entamoeba histolytica
EYYFNLTDWYIGYLIQLYKNGDKSIE

SEQ ID NO: 2674661 - protein, 20 aa, Entamoeba histolytica
EYYFVKFIGIEWGELENKEY

SEQ ID NO: 2674662 - protein, 23 aa, Entamoeba histolytica
EYYKKADVVPAYYRVADKESGEP

SEQ ID NO: 2674663 - protein, 20 aa, Entamoeba histolytica
EYYMHLGCIEEWCVRTFNEG

SEQ ID NO: 2674664 - protein, 29 aa, Entamoeba histolytica
EYYQGRGTLEIEYGKKLLGLITYVNTPSF

SEQ ID NO: 2674665 - protein, 23 aa, Entamoeba histolytica
EYYQIAKYCTKFTIFHQDYIMRE

SEQ ID NO: 2674666 - protein, 17 aa, Entamoeba histolytica
EYYRIINEFNEVYIKNI

SEQ ID NO: 2674667 - protein, 25 aa, Entamoeba histolytica
EYYYRCKHGPLIPCPQEVGDVFEYS

SEQ ID NO: 2674668 - protein, 19 aa, Entamoeba histolytica
FAACRAIENGCWVFCPNRI

SEQ ID NO: 2674669 - protein, 17 aa, Entamoeba histolytica
FAALFVPDEPIRFLPPV

SEQ ID NO: 2674670 - protein, 19 aa, Entamoeba histolytica
FAAMLSRPLKNVSLPLFIT

SEQ ID NO: 2674671 - protein, 17 aa, Entamoeba histolytica
FADFKIPSQGDFNGVSS

SEQ ID NO: 2674672 - protein, 25 aa, Entamoeba histolytica
FADKNSRGFSLFLIDGRKREMYLSG

SEQ ID NO: 2674673 - protein, 19 aa, Entamoeba histolytica
FADSFPLTLLNTRLKQYFS

SEQ ID NO: 2674674 - protein, 17 aa, Entamoeba histolytica
FAEFLKIRCYEHYSYDI

SEQ ID NO: 2674675 - protein, 19 aa, Entamoeba histolytica
FAEIVMEFCDGGTLKSFKE

SEQ ID NO: 2674676 - protein, 21 aa, Entamoeba histolytica
FAEMAELLKLFQEVNAKIPLP

SEQ ID NO: 2674677 - protein, 25 aa, Entamoeba histolytica
FAFESNCWNKVIPYCYYLTTVHRQN

SEQ ID NO: 2674678 - protein, 17 aa, Entamoeba histolytica
FAFSNCRSLTKVELPSF

SEQ ID NO: 2674679 - protein, 17 aa, Entamoeba histolytica
FAGIDGFTHAGIYKAAL

SEQ ID NO: 2674680 - protein, 18 aa, Entamoeba histolytica
FAGLIIISTELLYLEDNA

SEQ ID NO: 2674681 - protein, 18 aa, Entamoeba histolytica
FAGLMGARVVRICTHPDV

SEQ ID NO: 2674682 - protein, 24 aa, Entamoeba histolytica
FAGTSEGVIFGWIKKQKKFELIFA

SEQ ID NO: 2674683 - protein, 21 aa, Entamoeba histolytica
FAHLSKHFFVISSIKKGINEF

SEQ ID NO: 2674684 - protein, 18 aa, Entamoeba histolytica
FAILVTRRFFDGMDSRIL

SEQ ID NO: 2674685 - protein, 20 aa, Entamoeba histolytica
FAIPRSCLQKPVALKSAISV

SEQ ID NO: 2674686 - protein, 25 aa, Entamoeba histolytica
FAKEILFGSIFGFKCIGGINEEIAL

SEQ ID NO: 2674687 - protein, 19 aa, Entamoeba histolytica
FAKGITSEMLINFLQPNLP

SEQ ID NO: 2674688 - protein, 25 aa, Entamoeba histolytica
FAKSFALCCVLNYALMLRDRHGDNY

SEQ ID NO: 2674689 - protein, 25 aa, Entamoeba histolytica
FAKTPKLSFIDGIKILKNHLLPIAK

SEQ ID NO: 2674690 - protein, 27 aa, Entamoeba histolytica
FALDFLDGYALFMACSLCNHSCRENMG

SEQ ID NO: 2674691 - protein, 18 aa, Entamoeba histolytica
FALKCLDAMDDAELIMFL

SEQ ID NO: 2674692 - protein, 19 aa, Entamoeba histolytica
FALKICYPNNIKMLRGNHE

SEQ ID NO: 2674693 - protein, 22 aa, Entamoeba histolytica
FALKKRKLKKLTHDQNTSSLEE

SEQ ID NO: 2674694 - protein, 17 aa, Entamoeba histolytica
FALRLDGNPNWQATQYP

SEQ ID NO: 2674695 - protein, 24 aa, Entamoeba histolytica
FALRNLCILRDQIIPFTEVDTSLR

SEQ ID NO: 2674696 - protein, 17 aa, Entamoeba histolytica
FANHFGVGIAFIRKSRS

SEQ ID NO: 2674697 - protein, 24 aa, Entamoeba histolytica
FANWISGRIEIHFANRVLEDCWIS

SEQ ID NO: 2674698 - protein, 24 aa, Entamoeba histolytica
FAPKILCVELAHLDVPLNLGKSIV

SEQ ID NO: 2674699 - protein, 17 aa, Entamoeba histolytica
FAPMLDVFGKLEDKNYF

SEQ ID NO: 2674700 - protein, 27 aa, Entamoeba histolytica
FAPTWTKSGLRELRFLKTKEEKAQSLR

SEQ ID NO: 2674701 - protein, 21 aa, Entamoeba histolytica
FARNAFPCYSISQNSFIQPPQ

SEQ ID NO: 2674702 - protein, 22 aa, Entamoeba histolytica
FASDLKSIFYPFAQPCLEVVLK

SEQ ID NO: 2674703 - protein, 25 aa, Entamoeba histolytica
FASLKSIFPICKFQYAIAQLLGIGT

SEQ ID NO: 2674704 - protein, 25 aa, Entamoeba histolytica
FATETCFYFIMDYCSGGDFYHTLKE

SEQ ID NO: 2674705 - protein, 18 aa, Entamoeba histolytica
FATKVYHPNISFFGKICL

SEQ ID NO: 2674706 - protein, 21 aa, Entamoeba histolytica
FATYLDICKKLGFDQTPDYLQ

SEQ ID NO: 2674707 - protein, 29 aa, Entamoeba histolytica
FAVASCYERSVIFIDEIDSLLSARSESEH

SEQ ID NO: 2674708 - protein, 25 aa, Entamoeba histolytica
FAVDACKIGLEFQKKVFCVLGGYGL

SEQ ID NO: 2674709 - protein, 18 aa, Entamoeba histolytica
FAVEKVRLIGLTKAARFL

SEQ ID NO: 2674710 - protein, 17 aa, Entamoeba histolytica
FAVESLQLLGYVAYDIA

SEQ ID NO: 2674711 - protein, 17 aa, Entamoeba histolytica
FAVRDMKQTVAVGVVKA

SEQ ID NO: 2674712 - protein, 22 aa, Entamoeba histolytica
FAYPENKLYFFIAASLLIQHKE

SEQ ID NO: 2674713 - protein, 20 aa, Entamoeba histolytica
FAYTCDMHVLVILTDMSSYA

SEQ ID NO: 2674714 - protein, 17 aa, Entamoeba histolytica
FCCKSLMKKIPIDTLLA

SEQ ID NO: 2674715 - protein, 19 aa, Entamoeba histolytica
FCDCVLAAAVIKDYLRLLP

SEQ ID NO: 2674716 - protein, 23 aa, Entamoeba histolytica
FCDDKRIPVCKINNSDTNFHRVK

SEQ ID NO: 2674717 - protein, 17 aa, Entamoeba histolytica
FCDGGTLQSFFEKNYPI

SEQ ID NO: 2674718 - protein, 21 aa, Entamoeba histolytica
FCDMDPQAAFQFNFFCEEKSI

SEQ ID NO: 2674719 - protein, 23 aa, Entamoeba histolytica
FCEAAIKFAPTFKIKIGKQGMYE

SEQ ID NO: 2674720 - protein, 19 aa, Entamoeba histolytica
FCEDCVRAYHVLRQNASLI

SEQ ID NO: 2674721 - protein, 18 aa, Entamoeba histolytica
FCEFKASVAVLINQSTLY

SEQ ID NO: 2674722 - protein, 24 aa, Entamoeba histolytica
FCEGRNYLKCFYKPHNGEHSAENE

SEQ ID NO: 2674723 - protein, 17 aa, Entamoeba histolytica
FCEHGFITMLLNSFLEE

SEQ ID NO: 2674724 - protein, 26 aa, Entamoeba histolytica
FCETKPTECLGCFFSGIINIDSSASN

SEQ ID NO: 2674725 - protein, 28 aa, Entamoeba histolytica
FCFLLKTKRIISVPKKWNIKKSINCAIS

SEQ ID NO: 2674726 - protein, 25 aa, Entamoeba histolytica
FCGIPPEWENMFIALGITKEEIKSN

SEQ ID NO: 2674727 - protein, 23 aa, Entamoeba histolytica
FCGTPDYLAPEILTAKGYGIEVD

SEQ ID NO: 2674728 - protein, 24 aa, Entamoeba histolytica
FCGTPEYLAPEILLGNGYGFAVDW

SEQ ID NO: 2674729 - protein, 23 aa, Entamoeba histolytica
FCGTPEYLAPEVIQNVAYTNAID

SEQ ID NO: 2674730 - protein, 22 aa, Entamoeba histolytica
FCGTPEYLAPEVVVGKDYSEPV

SEQ ID NO: 2674731 - protein, 25 aa, Entamoeba histolytica
FCHIPSIRVIPNWNDSISMYASDGD

SEQ ID NO: 2674732 - protein, 19 aa, Entamoeba histolytica
FCIDCFIEGKSMSYHFNLK

SEQ ID NO: 2674733 - protein, 17 aa, Entamoeba histolytica
FCIERDIYLKYDDLNTY

SEQ ID NO: 2674734 - protein, 18 aa, Entamoeba histolytica
FCIKKIDINEDFWLRQTF

SEQ ID NO: 2674735 - protein, 18 aa, Entamoeba histolytica
FCKLIKRHFEKSFIELDG

SEQ ID NO: 2674736 - protein, 23 aa, Entamoeba histolytica
FCLLMPIFRWVISKKDKTTEIVK

SEQ ID NO: 2674737 - protein, 17 aa, Entamoeba histolytica
FCLVTSHKNIISTLEEF

SEQ ID NO: 2674738 - protein, 24 aa, Entamoeba histolytica
FCMKEGIYSKIYFCDLNKKEIEST

SEQ ID NO: 2674739 - protein, 20 aa, Entamoeba histolytica
FCNECQIPIIGLVENMSGYL

SEQ ID NO: 2674740 - protein, 20 aa, Entamoeba histolytica
FCNKQGLNMSSVRFLSDGVR

SEQ ID NO: 2674741 - protein, 17 aa, Entamoeba histolytica
FCPNCGAKVSITETTTP

SEQ ID NO: 2674742 - protein, 23 aa, Entamoeba histolytica
FCPNPQCGRAIIVLSSERASDNI

SEQ ID NO: 2674743 - protein, 29 aa, Entamoeba histolytica
FCPNSIKGWKQDLCKCIAHNTFSNEEPIF

SEQ ID NO: 2674744 - protein, 19 aa, Entamoeba histolytica
FCQRQCSLLDKLTDLVHLL

SEQ ID NO: 2674745 - protein, 25 aa, Entamoeba histolytica
FCQSLCLLSKMFLDHKTLYYDVEPF

SEQ ID NO: 2674746 - protein, 18 aa, Entamoeba histolytica
FCRGKIVVDVGCGTGILS

SEQ ID NO: 2674747 - protein, 24 aa, Entamoeba histolytica
FCSDKSCSFIAVYNSQEMNVEENQ

SEQ ID NO: 2674748 - protein, 17 aa, Entamoeba histolytica
FCSGGTLKSMLKPRNQG

SEQ ID NO: 2674749 - protein, 19 aa, Entamoeba histolytica
FCSKEIFRIKNYQIIAKGV

SEQ ID NO: 2674750 - protein, 26 aa, Entamoeba histolytica
FCSKIRKIRIDGYYCKKVIEKHPNYF

SEQ ID NO: 2674751 - protein, 19 aa, Entamoeba histolytica
FCSLLHFGFSYEKFNTSNI

SEQ ID NO: 2674752 - protein, 18 aa, Entamoeba histolytica
FCSNINYLSGKGEINEIS

SEQ ID NO: 2674753 - protein, 19 aa, Entamoeba histolytica
FCSTIKRLIINGDKVTLPM

SEQ ID NO: 2674754 - protein, 18 aa, Entamoeba histolytica
FCSVFNCIKGSSLKEQSI

SEQ ID NO: 2674755 - protein, 20 aa, Entamoeba histolytica
FCTNCGAKLSGGKFCSECGA

SEQ ID NO: 2674756 - protein, 19 aa, Entamoeba histolytica
FCTPDFRIALQHSDVVTDP

SEQ ID NO: 2674757 - protein, 22 aa, Entamoeba histolytica
FCVTRGRLSEGINFTNHLARAV

SEQ ID NO: 2674758 - protein, 17 aa, Entamoeba histolytica
FCVVTWYSLCSQYPNVY

SEQ ID NO: 2674759 - protein, 19 aa, Entamoeba histolytica
FCVYAKMAYVNIFKSSPKC

SEQ ID NO: 2674760 - protein, 20 aa, Entamoeba histolytica
FCYAMIIFGIIVIRDDMLDN

SEQ ID NO: 2674761 - protein, 23 aa, Entamoeba histolytica
FCYRGLPRNEFTTLTQLTGLTIT

SEQ ID NO: 2674762 - protein, 19 aa, Entamoeba histolytica
FDAARDWMTLFAKIATHIL

SEQ ID NO: 2674763 - protein, 38 aa, Entamoeba histolytica
FDAFKRRNHTSLSLQLCYRAICRLVNRHYVRFTNELYS

SEQ ID NO: 2674764 - protein, 22 aa, Entamoeba histolytica
FDALLTMCERFTPVFKQNKTML

SEQ ID NO: 2674765 - protein, 23 aa, Entamoeba histolytica
FDCGHKFCLDCCYEHIHEKIFSG

SEQ ID NO: 2674766 - protein, 23 aa, Entamoeba histolytica
FDCKEAKTLLGYERNENINGINC

SEQ ID NO: 2674767 - protein, 24 aa, Entamoeba histolytica
FDCLLKMVLIDSVKFFPHQYQSKE

SEQ ID NO: 2674768 - protein, 29 aa, Entamoeba histolytica
FDCPYSERLFKWFTKRNEIIKKQHKKVAE

SEQ ID NO: 2674769 - protein, 19 aa, Entamoeba histolytica
FDCVIQFAKSLNVRIVGID

SEQ ID NO: 2674770 - protein, 17 aa, Entamoeba histolytica
FDCYDVFCLDSLDDRMI

SEQ ID NO: 2674771 - protein, 17 aa, Entamoeba histolytica
FDDANLKEVQWFEFKAL

SEQ ID NO: 2674772 - protein, 23 aa, Entamoeba histolytica
FDDDRLIPTYGFGDVTTTNKSIF

SEQ ID NO: 2674773 - protein, 17 aa, Entamoeba histolytica
FDDLFIWTLKLEHKIPL

SEQ ID NO: 2674774 - protein, 22 aa, Entamoeba histolytica
FDDLKVELLLDFYNDMNDLHDL

SEQ ID NO: 2674775 - protein, 18 aa, Entamoeba histolytica
FDDNKLRPFILVSDKLVS

SEQ ID NO: 2674776 - protein, 24 aa, Entamoeba histolytica
FDDRIINFFPDYTNPIMFINCDGT

SEQ ID NO: 2674777 - protein, 18 aa, Entamoeba histolytica
FDDRSCVDLKDKWRNLEF

SEQ ID NO: 2674778 - protein, 24 aa, Entamoeba histolytica
FDEALRLLQHYPLKNFNDLDLNAK

SEQ ID NO: 2674779 - protein, 17 aa, Entamoeba histolytica
FDEFSLDHLEVLNESTA

SEQ ID NO: 2674780 - protein, 24 aa, Entamoeba histolytica
FDEIFSVLSPFIFSSEKFRNYRFN

SEQ ID NO: 2674781 - protein, 31 aa, Entamoeba histolytica
FDEIPYGLPPKYECLCPKGIETIYTMDNQVI

SEQ ID NO: 2674782 - protein, 22 aa, Entamoeba histolytica
FDELFKFILKCLSVYKNQKMIT

SEQ ID NO: 2674783 - protein, 17 aa, Entamoeba histolytica
FDELGRIVSSQFEISNN

SEQ ID NO: 2674784 - protein, 21 aa, Entamoeba histolytica
FDERKGCNIKDVILDTTTERI

SEQ ID NO: 2674785 - protein, 17 aa, Entamoeba histolytica
FDFDEMINQTEECSDTK

SEQ ID NO: 2674786 - protein, 18 aa, Entamoeba histolytica
FDFKNEVVVLELKHTNED

SEQ ID NO: 2674787 - protein, 24 aa, Entamoeba histolytica
FDFKYLLERAKVLKVKDFSSFSKL

SEQ ID NO: 2674788 - protein, 22 aa, Entamoeba histolytica
FDFPPEIHFSEMISLKYLSITF

SEQ ID NO: 2674789 - protein, 18 aa, Entamoeba histolytica
FDFSEMFINRCYNVELVR

SEQ ID NO: 2674790 - protein, 17 aa, Entamoeba histolytica
FDFVRTCLLHKREIESF

SEQ ID NO: 2674791 - protein, 17 aa, Entamoeba histolytica
FDGAGQRPLFSLRTLCL

SEQ ID NO: 2674792 - protein, 18 aa, Entamoeba histolytica
FDGATSISPTGRFEKYVR

SEQ ID NO: 2674793 - protein, 24 aa, Entamoeba histolytica
FDGIESINSLSLFNSLKVFTKQYI

SEQ ID NO: 2674794 - protein, 22 aa, Entamoeba histolytica
FDGKSVMEYAFFAKNNSGNIIQ

SEQ ID NO: 2674795 - protein, 18 aa, Entamoeba histolytica
FDGVPLVLENSFRFIEKV

SEQ ID NO: 2674796 - protein, 20 aa, Entamoeba histolytica
FDGYGNVIGFEIEGMNKLNY

SEQ ID NO: 2674797 - protein, 18 aa, Entamoeba histolytica
FDHKIAFVDEWFLAFSKQ

SEQ ID NO: 2674798 - protein, 27 aa, Entamoeba histolytica
FDIFHFFKSDIELFKWNIEQTEYLSKR

SEQ ID NO: 2674799 - protein, 17 aa, Entamoeba histolytica
FDIGTAQTIGKRVYMED

SEQ ID NO: 2674800 - protein, 17 aa, Entamoeba histolytica
FDIKPQFSRVIYDSAEV

SEQ ID NO: 2674801 - protein, 17 aa, Entamoeba histolytica
FDIKYCDRWAYEQQMTN

SEQ ID NO: 2674802 - protein, 17 aa, Entamoeba histolytica
FDINGKWIKCSGSNDKG

SEQ ID NO: 2674803 - protein, 22 aa, Entamoeba histolytica
FDIPQCMGMIGGKPGYAHYFHT

SEQ ID NO: 2674804 - protein, 17 aa, Entamoeba histolytica
FDISHSFQREELVIVPR

SEQ ID NO: 2674805 - protein, 24 aa, Entamoeba histolytica
FDKAVEIQKAWKGYRNRKRALSQR

SEQ ID NO: 2674806 - protein, 23 aa, Entamoeba histolytica
FDKAYGCCGFPICESKSFKPSYI

SEQ ID NO: 2674807 - protein, 32 aa, Entamoeba histolytica
FDKCKKLYIDECENCQFIIKKNEINEMKITRC

SEQ ID NO: 2674808 - protein, 27 aa, Entamoeba histolytica
FDKCKKLYIDECENCQFIIKKNENNEM

SEQ ID NO: 2674809 - protein, 25 aa, Entamoeba histolytica
FDKCKKLYIDECENCQIIIKKNENN

SEQ ID NO: 2674810 - protein, 27 aa, Entamoeba histolytica
FDKCKKLYIDECENCQIIIKKNENNEM

SEQ ID NO: 2674811 - protein, 17 aa, Entamoeba histolytica
FDKDSKCSFSIALFSMV

SEQ ID NO: 2674812 - protein, 17 aa, Entamoeba histolytica
FDKEPMIFFINRKSGNL

SEQ ID NO: 2674813 - protein, 24 aa, Entamoeba histolytica
FDKFLRLSVELDISSKVFNQILKD

SEQ ID NO: 2674814 - protein, 23 aa, Entamoeba histolytica
FDKIRSATTFMLLLLDPDWYNSE

SEQ ID NO: 2674815 - protein, 22 aa, Entamoeba histolytica
FDKKTGICCKVFDNIKMFLHLK

SEQ ID NO: 2674816 - protein, 22 aa, Entamoeba histolytica
FDKLNCKWSDFMKRVISGKRDD

SEQ ID NO: 2674817 - protein, 18 aa, Entamoeba histolytica
FDKNEWKTKEKINKISKI

SEQ ID NO: 2674818 - protein, 27 aa, Entamoeba histolytica
FDKWIRCGDIVQCLWVDASDMPSRRLN

SEQ ID NO: 2674819 - protein, 18 aa, Entamoeba histolytica
FDKYCNQLRKIINDRYSN

SEQ ID NO: 2674820 - protein, 20 aa, Entamoeba histolytica
FDLFFNRIYLTDSIDSKNLI

SEQ ID NO: 2674821 - protein, 23 aa, Entamoeba histolytica
FDLFRRFNIATSRKEIQSVLDLL

SEQ ID NO: 2674822 - protein, 19 aa, Entamoeba histolytica
FDLIVRFVEMLGMPSDEII

SEQ ID NO: 2674823 - protein, 26 aa, Entamoeba histolytica
FDLKKELSEGILFAKLINYLQNDLIN

SEQ ID NO: 2674824 - protein, 25 aa, Entamoeba histolytica
FDLKKELSEGVLLAKLLNYLQKDII

SEQ ID NO: 2674825 - protein, 27 aa, Entamoeba histolytica
FDLKTEFSDGILFARILNYYKPNIIAY

SEQ ID NO: 2674826 - protein, 17 aa, Entamoeba histolytica
FDLLCIINSSNCMLTSV

SEQ ID NO: 2674827 - protein, 20 aa, Entamoeba histolytica
FDLLKHSWLSNAQVRLDTEE

SEQ ID NO: 2674828 - protein, 23 aa, Entamoeba histolytica
FDLLNNRFLILQGEVERIALMPT

SEQ ID NO: 2674829 - protein, 19 aa, Entamoeba histolytica
FDLNAICFVAQSSNVKLTA

SEQ ID NO: 2674830 - protein, 21 aa, Entamoeba histolytica
FDLNAICFVASSSNVKLTVSQ

SEQ ID NO: 2674831 - protein, 21 aa, Entamoeba histolytica
FDLNAICFVTLPNHVKITAGQ

SEQ ID NO: 2674832 - protein, 17 aa, Entamoeba histolytica
FDLPLKRKEPILNAEDS

SEQ ID NO: 2674833 - protein, 17 aa, Entamoeba histolytica
FDLPLKRKEPILTTEES

SEQ ID NO: 2674834 - protein, 20 aa, Entamoeba histolytica
FDLRDCKRIPRNISKKTLNQ

SEQ ID NO: 2674835 - protein, 17 aa, Entamoeba histolytica
FDLRNRRVFTIDNKETK

SEQ ID NO: 2674836 - protein, 19 aa, Entamoeba histolytica
FDLTLKLVEDVLFAASKRN

SEQ ID NO: 2674837 - protein, 33 aa, Entamoeba histolytica
FDMCCTSLALLWVFYIRQSFIGSYDFEETHLDL

SEQ ID NO: 2674838 - protein, 21 aa, Entamoeba histolytica
FDMGFGPQIKRIIEGIRPDKQ

SEQ ID NO: 2674839 - protein, 24 aa, Entamoeba histolytica
FDMSYRAVPMSTKFIVLPEDEKEN

SEQ ID NO: 2674840 - protein, 21 aa, Entamoeba histolytica
FDNALYMLLTFANLSNNYIVK

SEQ ID NO: 2674841 - protein, 24 aa, Entamoeba histolytica
FDNEELKELIGVGIGIHHAGMNKE

SEQ ID NO: 2674842 - protein, 24 aa, Entamoeba histolytica
FDNELRLTALWLLANLLGLAPSLS

SEQ ID NO: 2674843 - protein, 19 aa, Entamoeba histolytica
FDNGEYFTYLKLFKEAIPK

SEQ ID NO: 2674844 - protein, 25 aa, Entamoeba histolytica
FDNGEYRWAATVLNHLVFANPSNEE

SEQ ID NO: 2674845 - protein, 26 aa, Entamoeba histolytica
FDNIDAFWLQRIIKGVVEDDNTAQEY

SEQ ID NO: 2674846 - protein, 18 aa, Entamoeba histolytica
FDNSDGFFHGYDYSEDLR

SEQ ID NO: 2674847 - protein, 23 aa, Entamoeba histolytica
FDNYKRMCECFKDVEDGVEEGTY

SEQ ID NO: 2674848 - protein, 26 aa, Entamoeba histolytica
FDPGKGAKCIYVWLGKSSNKMEKGKA

SEQ ID NO: 2674849 - protein, 17 aa, Entamoeba histolytica
FDPPTYCVKYDCESADT

SEQ ID NO: 2674850 - protein, 17 aa, Entamoeba histolytica
FDPRQYLGPARQALKEL

SEQ ID NO: 2674851 - protein, 18 aa, Entamoeba histolytica
FDPRYDPRFERFDMRYDP

SEQ ID NO: 2674852 - protein, 20 aa, Entamoeba histolytica
FDPRYDPRFERFDMRYDPRY

SEQ ID NO: 2674853 - protein, 17 aa, Entamoeba histolytica
FDPSADMVIRIDFIRAI

SEQ ID NO: 2674854 - protein, 26 aa, Entamoeba histolytica
FDQLVLQICILFLCPFNQNVIQTSQL

SEQ ID NO: 2674855 - protein, 17 aa, Entamoeba histolytica
FDQLYRATIGVDFAVKF

SEQ ID NO: 2674856 - protein, 25 aa, Entamoeba histolytica
FDQSECSYKLFLHQLHNILNYGPEI

SEQ ID NO: 2674857 - protein, 17 aa, Entamoeba histolytica
FDREIALGIPSESQRRQ

SEQ ID NO: 2674858 - protein, 17 aa, Entamoeba histolytica
FDREPIRSFGRIKKITA

SEQ ID NO: 2674859 - protein, 18 aa, Entamoeba histolytica
FDSAIPISVRHSQQLTVT

SEQ ID NO: 2674860 - protein, 26 aa, Entamoeba histolytica
FDSCCWGWRRGFNMTFREKNEFTIYN

SEQ ID NO: 2674861 - protein, 21 aa, Entamoeba histolytica
FDSFIRWQFLKLKEMGKIQFG

SEQ ID NO: 2674862 - protein, 18 aa, Entamoeba histolytica
FDSISFFFRTWEVEENGT

SEQ ID NO: 2674863 - protein, 18 aa, Entamoeba histolytica
FDSISITSKHLEEFILKD

SEQ ID NO: 2674864 - protein, 18 aa, Entamoeba histolytica
FDSISITSKHLEEFILKE

SEQ ID NO: 2674865 - protein, 19 aa, Entamoeba histolytica
FDSLVCIMQIFLTSPIYRL

SEQ ID NO: 2674866 - protein, 25 aa, Entamoeba histolytica
FDSNRANEVFKIFSQYLKTHTLTKM

SEQ ID NO: 2674867 - protein, 19 aa, Entamoeba histolytica
FDSQLKLYLKRMELSGYEK

SEQ ID NO: 2674868 - protein, 26 aa, Entamoeba histolytica
FDSQRIKFLFDCIGDIISYYSLNNTP

SEQ ID NO: 2674869 - protein, 24 aa, Entamoeba histolytica
FDSQRPKGVFIICNKISEGKQMKK

SEQ ID NO: 2674870 - protein, 18 aa, Entamoeba histolytica
FDSSRDGLLPAAFNTTTS

SEQ ID NO: 2674871 - protein, 17 aa, Entamoeba histolytica
FDTFKKLYLLRDKIARI

SEQ ID NO: 2674872 - protein, 24 aa, Entamoeba histolytica
FDTHYSKKCHFVGMKPNEQNMDIQ

SEQ ID NO: 2674873 - protein, 19 aa, Entamoeba histolytica
FDTLIGEGLNESFYLVTSL

SEQ ID NO: 2674874 - protein, 20 aa, Entamoeba histolytica
FDTLLCILLLFNTSSIHRLK

SEQ ID NO: 2674875 - protein, 18 aa, Entamoeba histolytica
FDTTIAYINMNSHEAALQ

SEQ ID NO: 2674876 - protein, 18 aa, Entamoeba histolytica
FDVAVGFNKRTEYRMLWF

SEQ ID NO: 2674877 - protein, 18 aa, Entamoeba histolytica
FDVCHLNCIPNICECEED

SEQ ID NO: 2674878 - protein, 27 aa, Entamoeba histolytica
FDVFCIECKSIRTCPHAFLCCIKNLND

SEQ ID NO: 2674879 - protein, 20 aa, Entamoeba histolytica
FDVIKFDSLHPHDIINDLSI

SEQ ID NO: 2674880 - protein, 19 aa, Entamoeba histolytica
FDVLCSFNDNYKALRTEIS

SEQ ID NO: 2674881 - protein, 21 aa, Entamoeba histolytica
FDVMLEFVVHFLFSSNKSDIF

SEQ ID NO: 2674882 - protein, 26 aa, Entamoeba histolytica
FDYIRKCIHLKLPIDVVLFNRENMHH

SEQ ID NO: 2674883 - protein, 19 aa, Entamoeba histolytica
FDYLQDWIDDVSMYCPQGV

SEQ ID NO: 2674884 - protein, 28 aa, Entamoeba histolytica
FDYSACIIGARLLRKWNNIIIASEAYFK

SEQ ID NO: 2674885 - protein, 17 aa, Entamoeba histolytica
FEAIEPYLISLENKRKP

SEQ ID NO: 2674886 - protein, 26 aa, Entamoeba histolytica
FECEKEWKVNAGWKLVQTKGTEEVPF

SEQ ID NO: 2674887 - protein, 25 aa, Entamoeba histolytica
FECFCDICIAPLLEEFCLACCDLCD

SEQ ID NO: 2674888 - protein, 17 aa, Entamoeba histolytica
FECTEEALTIAAMLTVP

SEQ ID NO: 2674889 - protein, 18 aa, Entamoeba histolytica
FECVEAIIHSPLWYEDFQ

SEQ ID NO: 2674890 - protein, 25 aa, Entamoeba histolytica
FEDGRIIKYVIWYKVSYSRYLKEKE

SEQ ID NO: 2674891 - protein, 19 aa, Entamoeba histolytica
FEDIRYCRMEKLRAGLRTI

SEQ ID NO: 2674892 - protein, 17 aa, Entamoeba histolytica
FEDRYRNDLKRADSNLA

SEQ ID NO: 2674893 - protein, 17 aa, Entamoeba histolytica
FEDVYFFDEINCVEDDG

SEQ ID NO: 2674894 - protein, 24 aa, Entamoeba histolytica
FEECHCLLCQRGFIKFEKKPTWNT

SEQ ID NO: 2674895 - protein, 24 aa, Entamoeba histolytica
FEEEVYGPICVELNVSKDEYTNFV

SEQ ID NO: 2674896 - protein, 23 aa, Entamoeba histolytica
FEEHCFCKCFLIKGKSIPHSFID

SEQ ID NO: 2674897 - protein, 21 aa, Entamoeba histolytica
FEEIEELKLELDKMRRERDFL

SEQ ID NO: 2674898 - protein, 25 aa, Entamoeba histolytica
FEEIRISDEFRCFVVHKELIIISQR

SEQ ID NO: 2674899 - protein, 20 aa, Entamoeba histolytica
FEEKRLYSTVFVIMNNLENS

SEQ ID NO: 2674900 - protein, 23 aa, Entamoeba histolytica
FEELKTFVGVFYGRYATLEQKVQ

SEQ ID NO: 2674901 - protein, 18 aa, Entamoeba histolytica
FEELVKYWIETIEFEEYF

SEQ ID NO: 2674902 - protein, 17 aa, Entamoeba histolytica
FEERGDVKLSHMGCTIQ

SEQ ID NO: 2674903 - protein, 17 aa, Entamoeba histolytica
FEESIEMKGLLKVKNFI

SEQ ID NO: 2674904 - protein, 25 aa, Entamoeba histolytica
FEESPMRIQFCKYSIPNNYYSKKVT

SEQ ID NO: 2674905 - protein, 35 aa, Entamoeba histolytica
FEETLKEIARYCNMYQFFCYECKEDKVIVTNALSQ

SEQ ID NO: 2674906 - protein, 19 aa, Entamoeba histolytica
FEEYAYFINLYKRIMNDYE

SEQ ID NO: 2674907 - protein, 25 aa, Entamoeba histolytica
FEEYQRFHLIPSLVHKNYYQLFNLV

SEQ ID NO: 2674908 - protein, 17 aa, Entamoeba histolytica
FEFGVFWQKSQLIKRLT

SEQ ID NO: 2674909 - protein, 19 aa, Entamoeba histolytica
FEFIGMLQAQGFPKVIGCL

SEQ ID NO: 2674910 - protein, 24 aa, Entamoeba histolytica
FEFKSMNAVDAFKLVQCKNKDSSV

SEQ ID NO: 2674911 - protein, 23 aa, Entamoeba histolytica
FEFKYKKSIPFRPFEQLMSVLPP

SEQ ID NO: 2674912 - protein, 20 aa, Entamoeba histolytica
FEFPYFQLALCSVLSGNTLK

SEQ ID NO: 2674913 - protein, 17 aa, Entamoeba histolytica
FEFRYFKNCSSIANTTA

SEQ ID NO: 2674914 - protein, 17 aa, Entamoeba histolytica
FEGDKSLGRYVISNIPK

SEQ ID NO: 2674915 - protein, 24 aa, Entamoeba histolytica
FEGLKELEVLGAKIGELQMEKRIV

SEQ ID NO: 2674916 - protein, 22 aa, Entamoeba histolytica
FEGLKRGKYCVRVFLDNTKTEV

SEQ ID NO: 2674917 - protein, 18 aa, Entamoeba histolytica
FEGSREWFVQKIMKVVEF

SEQ ID NO: 2674918 - protein, 31 aa, Entamoeba histolytica
FEGTIKMGISFPHGKYVMKWFEEDIHKHYTP

SEQ ID NO: 2674919 - protein, 25 aa, Entamoeba histolytica
FEGVQKWYKKAVILIHPDKNQFRSA

SEQ ID NO: 2674920 - protein, 18 aa, Entamoeba histolytica
FEHFILIEIFTQIGAPLK

SEQ ID NO: 2674921 - protein, 23 aa, Entamoeba histolytica
FEHICAHKDIYLALPNEPVNGDN

SEQ ID NO: 2674922 - protein, 23 aa, Entamoeba histolytica
FEHLEVWRKEFISGGNPSDPESF

SEQ ID NO: 2674923 - protein, 17 aa, Entamoeba histolytica
FEHPKGMFVLPFEIPKS

SEQ ID NO: 2674924 - protein, 23 aa, Entamoeba histolytica
FEHPPRSSVTVDRFLRISKPNVL

SEQ ID NO: 2674925 - protein, 25 aa, Entamoeba histolytica
FEHQRIGVKWMYELFKQHAGGIVGD

SEQ ID NO: 2674926 - protein, 17 aa, Entamoeba histolytica
FEHWNYLSLAANEDDPY

SEQ ID NO: 2674927 - protein, 24 aa, Entamoeba histolytica
FEIALEKGLQMINGININEGKNFV

SEQ ID NO: 2674928 - protein, 26 aa, Entamoeba histolytica
FEICLKSSPLNTIWKSYVLMARHFMN

SEQ ID NO: 2674929 - protein, 18 aa, Entamoeba histolytica
FEIFDNGELKYCNQSRYR

SEQ ID NO: 2674930 - protein, 20 aa, Entamoeba histolytica
FEIIKPKTQIVWGNGDESSS

SEQ ID NO: 2674931 - protein, 21 aa, Entamoeba histolytica
FEIKDGMVLDSHFIATFTQEF

SEQ ID NO: 2674932 - protein, 22 aa, Entamoeba histolytica
FEILIRFYESFGLIEDKLTPSL

SEQ ID NO: 2674933 - protein, 21 aa, Entamoeba histolytica
FEILSDLSLTYVVLEKIMQDI

SEQ ID NO: 2674934 - protein, 21 aa, Entamoeba histolytica
FEIPIQPSLTFILRKYNSFIK

SEQ ID NO: 2674935 - protein, 25 aa, Entamoeba histolytica
FEIPTLKLPIMFNSTDNRLECLKRI

SEQ ID NO: 2674936 - protein, 17 aa, Entamoeba histolytica
FEIQRFIEFSALKNSLN

SEQ ID NO: 2674937 - protein, 17 aa, Entamoeba histolytica
FEIVVQFDSLGIFELSI

SEQ ID NO: 2674938 - protein, 23 aa, Entamoeba histolytica
FEKAEKFIGLAHINGMKINMNKI

SEQ ID NO: 2674939 - protein, 17 aa, Entamoeba histolytica
FEKAVDDACGWPAEPNN

SEQ ID NO: 2674940 - protein, 19 aa, Entamoeba histolytica
FEKDGRLEFERHKEILNLE

SEQ ID NO: 2674941 - protein, 17 aa, Entamoeba histolytica
FEKEEYKHLLIQYQNSP

SEQ ID NO: 2674942 - protein, 17 aa, Entamoeba histolytica
FEKEGLKQVNEEVNAIK

SEQ ID NO: 2674943 - protein, 17 aa, Entamoeba histolytica
FEKEVAMLDKFQDEYII

SEQ ID NO: 2674944 - protein, 19 aa, Entamoeba histolytica
FEKGEDVVIYKGYPSVLTL

SEQ ID NO: 2674945 - protein, 24 aa, Entamoeba histolytica
FEKGEFQWAITLLNHLIFANPKNT

SEQ ID NO: 2674946 - protein, 20 aa, Entamoeba histolytica
FEKGLCIIQNILACCVYSGD

SEQ ID NO: 2674947 - protein, 25 aa, Entamoeba histolytica
FEKGSIQCDWLFDSICNNCQLETQD

SEQ ID NO: 2674948 - protein, 20 aa, Entamoeba histolytica
FEKIIECQKANGEFVGVEEI

SEQ ID NO: 2674949 - protein, 19 aa, Entamoeba histolytica
FEKKMFLEKGYSIFTNWVV

SEQ ID NO: 2674950 - protein, 20 aa, Entamoeba histolytica
FEKKQAKELFYYNNYSNEEE

SEQ ID NO: 2674951 - protein, 20 aa, Entamoeba histolytica
FEKLKKIAIEEGLNKALRPL

SEQ ID NO: 2674952 - protein, 32 aa, Entamoeba histolytica
FEKMISGIYMGWLARLAIRELIEKKVIFERYA

SEQ ID NO: 2674953 - protein, 24 aa, Entamoeba histolytica
FEKVKEQAHRAAFKEVQIYMVDED

SEQ ID NO: 2674954 - protein, 30 aa, Entamoeba histolytica
FEKVKFKECLTSVIIELCIKLLDINEFDQS

SEQ ID NO: 2674955 - protein, 18 aa, Entamoeba histolytica
FEKVKWWLDDKALDGNFV

SEQ ID NO: 2674956 - protein, 17 aa, Entamoeba histolytica
FEKWRKVEVLLIDEISM

SEQ ID NO: 2674957 - protein, 25 aa, Entamoeba histolytica
FEKYKDILLRISILIKTIQPMANSE

SEQ ID NO: 2674958 - protein, 22 aa, Entamoeba histolytica
FELELLKKAYLDSIKCSDSVNI

SEQ ID NO: 2674959 - protein, 18 aa, Entamoeba histolytica
FELETRWATASKEISHSF

SEQ ID NO: 2674960 - protein, 17 aa, Entamoeba histolytica
FELFITIKCTTKIKDKI

SEQ ID NO: 2674961 - protein, 23 aa, Entamoeba histolytica
FELFSRLLMIKDYLIKEIIQKQC

SEQ ID NO: 2674962 - protein, 18 aa, Entamoeba histolytica
FELIFAVYATDRLREVKY

SEQ ID NO: 2674963 - protein, 17 aa, Entamoeba histolytica
FELISLIDKKISLPSCR

SEQ ID NO: 2674964 - protein, 28 aa, Entamoeba histolytica
FELKKNISRRCLVDYFLYSTMIYNDSIE

SEQ ID NO: 2674965 - protein, 17 aa, Entamoeba histolytica
FELKRIIGNIVKEKPLQ

SEQ ID NO: 2674966 - protein, 20 aa, Entamoeba histolytica
FELKSVFIGIDIQLLFHDLS

SEQ ID NO: 2674967 - protein, 17 aa, Entamoeba histolytica
FELRLTFSDEYPIKPPH

SEQ ID NO: 2674968 - protein, 20 aa, Entamoeba histolytica
FELRSSVINSEILEEDDLIT

SEQ ID NO: 2674969 - protein, 23 aa, Entamoeba histolytica
FELSIEFMTLLLLDDDTEKINQS

SEQ ID NO: 2674970 - protein, 17 aa, Entamoeba histolytica
FELSPPIQKLTFGHQYA

SEQ ID NO: 2674971 - protein, 25 aa, Entamoeba histolytica
FELSWKLTRPNGIVALVAMYESNQP

SEQ ID NO: 2674972 - protein, 17 aa, Entamoeba histolytica
FEMCRVTGIPLSYLLPR

SEQ ID NO: 2674973 - protein, 17 aa, Entamoeba histolytica
FEMIDDMFLSLISITIS

SEQ ID NO: 2674974 - protein, 23 aa, Entamoeba histolytica
FENELKLQWNPIAYNNPDVKLYD

SEQ ID NO: 2674975 - protein, 23 aa, Entamoeba histolytica
FENFAKWKFVPFIKQQEGNKNQQ

SEQ ID NO: 2674976 - protein, 19 aa, Entamoeba histolytica
FENIPNWVEQCCKSDGKHI

SEQ ID NO: 2674977 - protein, 23 aa, Entamoeba histolytica
FENIRVGAMSGALANKGGVAYRM

SEQ ID NO: 2674978 - protein, 19 aa, Entamoeba histolytica
FENKHCILIRCDSEKKLTF

SEQ ID NO: 2674979 - protein, 19 aa, Entamoeba histolytica
FENKHLYCSLGNIQELDFG

SEQ ID NO: 2674980 - protein, 18 aa, Entamoeba histolytica
FENKVLDLNAICFVAQSS

SEQ ID NO: 2674981 - protein, 29 aa, Entamoeba histolytica
FENLFLPSFFKKFGMDYSISAFDAAHAIG

SEQ ID NO: 2674982 - protein, 22 aa, Entamoeba histolytica
FENLRIKDYFSIEYTSYKLTTQ

SEQ ID NO: 2674983 - protein, 18 aa, Entamoeba histolytica
FENRLKSTIADFAAQGIN

SEQ ID NO: 2674984 - protein, 20 aa, Entamoeba histolytica
FENTRQLLISRFKDVNKYIK

SEQ ID NO: 2674985 - protein, 20 aa, Entamoeba histolytica
FENTRQLLISRFKDVNRYIK

SEQ ID NO: 2674986 - protein, 19 aa, Entamoeba histolytica
FENVDLFIKYGSYKKPTSW

SEQ ID NO: 2674987 - protein, 17 aa, Entamoeba histolytica
FEPAPPFTRKCIVATNI

SEQ ID NO: 2674988 - protein, 20 aa, Entamoeba histolytica
FEPEEISGMILKHLYNNAQM

SEQ ID NO: 2674989 - protein, 17 aa, Entamoeba histolytica
FEPEEISGMILKHMYDI

SEQ ID NO: 2674990 - protein, 23 aa, Entamoeba histolytica
FEPEEISGMILKHMYDIAQASLK

SEQ ID NO: 2674991 - protein, 23 aa, Entamoeba histolytica
FEPEEISGMILKYMYDIAQASLK

SEQ ID NO: 2674992 - protein, 18 aa, Entamoeba histolytica
FEPFTLVPYCSRLIDISL

SEQ ID NO: 2674993 - protein, 26 aa, Entamoeba histolytica
FEPLTCNLCYRMLRFPDDSIKIISRK

SEQ ID NO: 2674994 - protein, 17 aa, Entamoeba histolytica
FEPMGFTYFQGGKGKKI

SEQ ID NO: 2674995 - protein, 17 aa, Entamoeba histolytica
FEPNIPIEGSIRLKSHE

SEQ ID NO: 2674996 - protein, 20 aa, Entamoeba histolytica
FEPPTSFSIINYCDDNKEKI

SEQ ID NO: 2674997 - protein, 19 aa, Entamoeba histolytica
FEPTRLAFCKRFEYDSEGR

SEQ ID NO: 2674998 - protein, 17 aa, Entamoeba histolytica
FEQFKGVLPQLVELMCD

SEQ ID NO: 2674999 - protein, 30 aa, Entamoeba histolytica
FEQFWEIKGSIEWNRIGVAYELSFKHQEAI

SEQ ID NO: 2675000 - protein, 19 aa, Entamoeba histolytica
FEQRNEIIFKPKIGTEQLL

SEQ ID NO: 2675001 - protein, 18 aa, Entamoeba histolytica
FEQSQMLCNYCGRLILRD

SEQ ID NO: 2675002 - protein, 33 aa, Entamoeba histolytica
FEQVKNKKIPLCQWPLYVSTTFDNEVNERNESD

SEQ ID NO: 2675003 - protein, 33 aa, Entamoeba histolytica
FERCKYKKRLAIFICYGEYLFGVYYHSQLIPSG

SEQ ID NO: 2675004 - protein, 18 aa, Entamoeba histolytica
FERDIWRRDFYFWEGKKS

SEQ ID NO: 2675005 - protein, 23 aa, Entamoeba histolytica
FERELLTIRSLYTFNTSCAIFIQ

SEQ ID NO: 2675006 - protein, 17 aa, Entamoeba histolytica
FERIEGIIKILNEEEQE

SEQ ID NO: 2675007 - protein, 17 aa, Entamoeba histolytica
FERKPKRSFYRQIYNKD

SEQ ID NO: 2675008 - protein, 21 aa, Entamoeba histolytica
FESDCFIIGDGMSDIVQIDSD

SEQ ID NO: 2675009 - protein, 25 aa, Entamoeba histolytica
FESDLKLPLWHLFPSHIELLFKSIC

SEQ ID NO: 2675010 - protein, 24 aa, Entamoeba histolytica
FESFYNCISLIYSNQLDQWANNYI

SEQ ID NO: 2675011 - protein, 27 aa, Entamoeba histolytica
FESKFCIYCSSYGYWPTFTLVKVEQCT

SEQ ID NO: 2675012 - protein, 17 aa, Entamoeba histolytica
FESLKIPYRVVNIVSGA

SEQ ID NO: 2675013 - protein, 18 aa, Entamoeba histolytica
FESLKYYYNRFCQQFPLL

SEQ ID NO: 2675014 - protein, 18 aa, Entamoeba histolytica
FESPTVACLYDLNNHQFV

SEQ ID NO: 2675015 - protein, 23 aa, Entamoeba histolytica
FESRLLWRVYVFIADMHKKYVVT

SEQ ID NO: 2675016 - protein, 20 aa, Entamoeba histolytica
FESYTCSSLALFLLKRALKN

SEQ ID NO: 2675017 - protein, 19 aa, Entamoeba histolytica
FETKVFDLNAICFVAQSSN

SEQ ID NO: 2675018 - protein, 19 aa, Entamoeba histolytica
FETKVLDLNAICFVAPSSN

SEQ ID NO: 2675019 - protein, 18 aa, Entamoeba histolytica
FETKVLDLNAICFVAQSS

SEQ ID NO: 2675020 - protein, 18 aa, Entamoeba histolytica
FETLPSFISSVLLSHSSN

SEQ ID NO: 2675021 - protein, 20 aa, Entamoeba histolytica
FETRIIKQIAIIGAGLSGIE

SEQ ID NO: 2675022 - protein, 27 aa, Entamoeba histolytica
FEVCRREIQMLPKLIIRKEEFLRAEDI

SEQ ID NO: 2675023 - protein, 21 aa, Entamoeba histolytica
FEVGNGEFWGGMRFGMMELII

SEQ ID NO: 2675024 - protein, 27 aa, Entamoeba histolytica
FEVIIPLDDLLPFAAMKMFPNGIYGNL

SEQ ID NO: 2675025 - protein, 19 aa, Entamoeba histolytica
FEVKGKYFIVTGVKDTENV

SEQ ID NO: 2675026 - protein, 17 aa, Entamoeba histolytica
FEVMDGAPIKGEKIPIR

SEQ ID NO: 2675027 - protein, 22 aa, Entamoeba histolytica
FEVPKYIGKILIRITESAIYQR

SEQ ID NO: 2675028 - protein, 25 aa, Entamoeba histolytica
FEVYEKYFMMFGAFVECWPDDAFTQ

SEQ ID NO: 2675029 - protein, 18 aa, Entamoeba histolytica
FEVYLRLIPMNYFTMLNG

SEQ ID NO: 2675030 - protein, 24 aa, Entamoeba histolytica
FEWAYSAQILLSFEPPEPNDYLSI

SEQ ID NO: 2675031 - protein, 18 aa, Entamoeba histolytica
FEWLAESHITEFCQFGRE

SEQ ID NO: 2675032 - protein, 27 aa, Entamoeba histolytica
FEWVSDFYCSLGFVLTTYIDKIDSNQF

SEQ ID NO: 2675033 - protein, 17 aa, Entamoeba histolytica
FEYENAIDVSAFTGNKE

SEQ ID NO: 2675034 - protein, 17 aa, Entamoeba histolytica
FEYKYFMKKTEVVWEDG

SEQ ID NO: 2675035 - protein, 17 aa, Entamoeba histolytica
FEYLQDWVNDVSNYCPQ

SEQ ID NO: 2675036 - protein, 36 aa, Entamoeba histolytica
FEYLSSLTISCCELYFLPQCIEKMNLICLDVSCNLI

SEQ ID NO: 2675037 - protein, 17 aa, Entamoeba histolytica
FEYLYASALNEFKRENL

SEQ ID NO: 2675038 - protein, 31 aa, Entamoeba histolytica
FEYSNLIPREWLMKFDIVFQCGIPEETFYTT

SEQ ID NO: 2675039 - protein, 22 aa, Entamoeba histolytica
FEYTFAIGLCPLHYKKDKFIGW

SEQ ID NO: 2675040 - protein, 18 aa, Entamoeba histolytica
FEYYETFIVKSSVYKAFV

SEQ ID NO: 2675041 - protein, 19 aa, Entamoeba histolytica
FFALPIEMSKALLLNTIEN

SEQ ID NO: 2675042 - protein, 25 aa, Entamoeba histolytica
FFATWCGPCRSISPYFEELAGQYNN

SEQ ID NO: 2675043 - protein, 18 aa, Entamoeba histolytica
FFDHIARLIPSMKRPEEI

SEQ ID NO: 2675044 - protein, 24 aa, Entamoeba histolytica
FFDIFKHFITIHFKDPSVFSNTPL

SEQ ID NO: 2675045 - protein, 23 aa, Entamoeba histolytica
FFDKEFTQYIPLQIYELLQTIGT

SEQ ID NO: 2675046 - protein, 18 aa, Entamoeba histolytica
FFDPSEIEYCDGLLSLRP

SEQ ID NO: 2675047 - protein, 18 aa, Entamoeba histolytica
FFEELRSLQLNDFLEGKK

SEQ ID NO: 2675048 - protein, 17 aa, Entamoeba histolytica
FFEILKFGIDLKEAIAY

SEQ ID NO: 2675049 - protein, 19 aa, Entamoeba histolytica
FFEKIFVIDPFERINTFQL

SEQ ID NO: 2675050 - protein, 18 aa, Entamoeba histolytica
FFERHWDIVCHLKEFKNE

SEQ ID NO: 2675051 - protein, 20 aa, Entamoeba histolytica
FFERIRWNTLLSESREDIFV

SEQ ID NO: 2675052 - protein, 18 aa, Entamoeba histolytica
FFEVLKYLHSLHIVHRDI

SEQ ID NO: 2675053 - protein, 18 aa, Entamoeba histolytica
FFEVLRRINIPDDMLMRK

SEQ ID NO: 2675054 - protein, 26 aa, Entamoeba histolytica
FFFCDELMFKRWTKYINDSVEGKDLE

SEQ ID NO: 2675055 - protein, 27 aa, Entamoeba histolytica
FFFETFKKLRVGAVLYLLYGRQSQNSR

SEQ ID NO: 2675056 - protein, 18 aa, Entamoeba histolytica
FFFNYQIPKQTTIYQQTV

SEQ ID NO: 2675057 - protein, 19 aa, Entamoeba histolytica
FFFPIKMRVQNGLFEIDAN

SEQ ID NO: 2675058 - protein, 23 aa, Entamoeba histolytica
FFGDASSLFGIFDGHGGDYGSCF

SEQ ID NO: 2675059 - protein, 18 aa, Entamoeba histolytica
FFGIVPIIHIEGRTFPVS

SEQ ID NO: 2675060 - protein, 25 aa, Entamoeba histolytica
FFGKCLRGGFMPLEKDFLFKTLTMQ

SEQ ID NO: 2675061 - protein, 29 aa, Entamoeba histolytica
FFGKICLDTLKPQGWVCAMQISSVLQTIQ

SEQ ID NO: 2675062 - protein, 18 aa, Entamoeba histolytica
FFGLEKFIRVCGDEVVPL

SEQ ID NO: 2675063 - protein, 17 aa, Entamoeba histolytica
FFGSGNFVSILSIKIDL

SEQ ID NO: 2675064 - protein, 27 aa, Entamoeba histolytica
FFGYYLKEEWECIASIFEKYQIYTKNT

SEQ ID NO: 2675065 - protein, 17 aa, Entamoeba histolytica
FFHCKLLAFHISEDSYE

SEQ ID NO: 2675066 - protein, 24 aa, Entamoeba histolytica
FFIEIFGKYIFRYPVPPLLKQLSI

SEQ ID NO: 2675067 - protein, 19 aa, Entamoeba histolytica
FFIFSLKGYNLYDSPKKFM

SEQ ID NO: 2675068 - protein, 20 aa, Entamoeba histolytica
FFIHKLCKHQQLTFNVTENH

SEQ ID NO: 2675069 - protein, 17 aa, Entamoeba histolytica
FFIKIERILLVKLFTKE

SEQ ID NO: 2675070 - protein, 27 aa, Entamoeba histolytica
FFIKITLRLPKYVPLLRHILQETQRVN

SEQ ID NO: 2675071 - protein, 22 aa, Entamoeba histolytica
FFIKSPLPFISHKLFLVNEMQK

SEQ ID NO: 2675072 - protein, 17 aa, Entamoeba histolytica
FFIKYSYDDLVNKKFPK

SEQ ID NO: 2675073 - protein, 21 aa, Entamoeba histolytica
FFIPKEIYRLIDYIIQHYEPN

SEQ ID NO: 2675074 - protein, 18 aa, Entamoeba histolytica
FFIYPFIYYQRIKNNPRS

SEQ ID NO: 2675075 - protein, 20 aa, Entamoeba histolytica
FFKIAKDWDLLYVVGEGKEF

SEQ ID NO: 2675076 - protein, 29 aa, Entamoeba histolytica
FFKSKNPVNGFPLFPKRSISYPMRDTALC

SEQ ID NO: 2675077 - protein, 17 aa, Entamoeba histolytica
FFKTEIEPVKNYKEQGE

SEQ ID NO: 2675078 - protein, 20 aa, Entamoeba histolytica
FFLQPELPMLMIIRTSHSQT

SEQ ID NO: 2675079 - protein, 24 aa, Entamoeba histolytica
FFLQRMKMLFLEEIRSFSVQINTL

SEQ ID NO: 2675080 - protein, 18 aa, Entamoeba histolytica
FFLRRLGEAQAKYETMLP

SEQ ID NO: 2675081 - protein, 21 aa, Entamoeba histolytica
FFLVEVMLSYLYPNFAEEAQY

SEQ ID NO: 2675082 - protein, 18 aa, Entamoeba histolytica
FFMFSREQVELFGKNYHN

SEQ ID NO: 2675083 - protein, 17 aa, Entamoeba histolytica
FFMPFFLLCVDDPVPNV

SEQ ID NO: 2675084 - protein, 17 aa, Entamoeba histolytica
FFNAPSIPYLPTTAEKH

SEQ ID NO: 2675085 - protein, 18 aa, Entamoeba histolytica
FFNFIMKTAERFYEQRNF

SEQ ID NO: 2675086 - protein, 25 aa, Entamoeba histolytica
FFNILKKREEVWENLEVLKLSNCEI

SEQ ID NO: 2675087 - protein, 24 aa, Entamoeba histolytica
FFNIPCSFDPLTLNKQINRPIDLD

SEQ ID NO: 2675088 - protein, 25 aa, Entamoeba histolytica
FFNRFIKTCLKYIGIDEFLSTHYYW

SEQ ID NO: 2675089 - protein, 18 aa, Entamoeba histolytica
FFPDSRQIVLKTFEELCN

SEQ ID NO: 2675090 - protein, 24 aa, Entamoeba histolytica
FFPIEKRVSLSFAPLYTTTGHIIV

SEQ ID NO: 2675091 - protein, 19 aa, Entamoeba histolytica
FFQEDFVPLSPKFQCSKIR

SEQ ID NO: 2675092 - protein, 24 aa, Entamoeba histolytica
FFQIIDVLFIRKGENGLGQLQVQQ

SEQ ID NO: 2675093 - protein, 21 aa, Entamoeba histolytica
FFQKECKDYKGYIKVIEIQDI

SEQ ID NO: 2675094 - protein, 21 aa, Entamoeba histolytica
FFREFDRPLAMSFDGIRHDSE

SEQ ID NO: 2675095 - protein, 19 aa, Entamoeba histolytica
FFRSVKFQLIRNIPPPIVP

SEQ ID NO: 2675096 - protein, 18 aa, Entamoeba histolytica
FFSEFFKHFEKWFSESEW

SEQ ID NO: 2675097 - protein, 19 aa, Entamoeba histolytica
FFSGSAWKYDEERKEYYLH

SEQ ID NO: 2675098 - protein, 17 aa, Entamoeba histolytica
FFSRKDMHIGFISNTFM

SEQ ID NO: 2675099 - protein, 20 aa, Entamoeba histolytica
FFSRKQPKGVLTFESDLIPF

SEQ ID NO: 2675100 - protein, 20 aa, Entamoeba histolytica
FFSVRGCDLISINLNSCFAL

SEQ ID NO: 2675101 - protein, 26 aa, Entamoeba histolytica
FFTDEIRVQLPFPLREKYHLLITVLF

SEQ ID NO: 2675102 - protein, 18 aa, Entamoeba histolytica
FFTGKFSLPNGITLPSLQ

SEQ ID NO: 2675103 - protein, 17 aa, Entamoeba histolytica
FFTHLVVEACHRTLHGY

SEQ ID NO: 2675104 - protein, 17 aa, Entamoeba histolytica
FFTNFRVKDSVGINKST

SEQ ID NO: 2675105 - protein, 27 aa, Entamoeba histolytica
FFTVETRKRLLLCSIARSGKDAVKEMR

SEQ ID NO: 2675106 - protein, 17 aa, Entamoeba histolytica
FFVCPLINCLLTHNNKL

SEQ ID NO: 2675107 - protein, 19 aa, Entamoeba histolytica
FFVTDGLFYKILKKTKSSG

SEQ ID NO: 2675108 - protein, 21 aa, Entamoeba histolytica
FFWDYKALKKFCQSGPARTFC

SEQ ID NO: 2675109 - protein, 29 aa, Entamoeba histolytica
FFYDLPSTLFKYLLYPIIFKDSFAQQSII

SEQ ID NO: 2675110 - protein, 17 aa, Entamoeba histolytica
FFYDLTIETHSSIDITV

SEQ ID NO: 2675111 - protein, 22 aa, Entamoeba histolytica
FFYHIECGFTLKFDEESKKVTG

SEQ ID NO: 2675112 - protein, 25 aa, Entamoeba histolytica
FFYKIKRKPSLILNIGYYQLRLVFN

SEQ ID NO: 2675113 - protein, 19 aa, Entamoeba histolytica
FGAALYAHQRISGASPVQD

SEQ ID NO: 2675114 - protein, 18 aa, Entamoeba histolytica
FGARAMMLQVRVSNQPAL

SEQ ID NO: 2675115 - protein, 25 aa, Entamoeba histolytica
FGAVEPMGGNIYPPGHPLYGVNTTT

SEQ ID NO: 2675116 - protein, 25 aa, Entamoeba histolytica
FGCFNKLIIPFEFTKPGDVDTGIGF

SEQ ID NO: 2675117 - protein, 21 aa, Entamoeba histolytica
FGCFVCKAALKGKPYKDIGGE

SEQ ID NO: 2675118 - protein, 19 aa, Entamoeba histolytica
FGCGSCGPRAFYGTTTEHL

SEQ ID NO: 2675119 - protein, 26 aa, Entamoeba histolytica
FGCIAAELILGIPIFPGSSEYNQLER

SEQ ID NO: 2675120 - protein, 25 aa, Entamoeba histolytica
FGCVAAELFLGIPLFPGENEYNQLA

SEQ ID NO: 2675121 - protein, 17 aa, Entamoeba histolytica
FGDCFEVAMNREKFPEK

SEQ ID NO: 2675122 - protein, 18 aa, Entamoeba histolytica
FGDFKDFLVKMANARKDY

SEQ ID NO: 2675123 - protein, 17 aa, Entamoeba histolytica
FGDSSKNLFGIFYGYWL

SEQ ID NO: 2675124 - protein, 26 aa, Entamoeba histolytica
FGDYNIAKCRIITFKGKSESRGFGYL

SEQ ID NO: 2675125 - protein, 17 aa, Entamoeba histolytica
FGEDLSHTGIRLSLSRF

SEQ ID NO: 2675126 - protein, 26 aa, Entamoeba histolytica
FGELYRRAANMGSWKQVLIKNYSRIQ

SEQ ID NO: 2675127 - protein, 18 aa, Entamoeba histolytica
FGENMTVLCVMNGKIDPA

SEQ ID NO: 2675128 - protein, 17 aa, Entamoeba histolytica
FGERLIFNKEGNPQIKL

SEQ ID NO: 2675129 - protein, 17 aa, Entamoeba histolytica
FGFEFDVILSLTLLRNV

SEQ ID NO: 2675130 - protein, 17 aa, Entamoeba histolytica
FGGCYQLKPLISLPDQC

SEQ ID NO: 2675131 - protein, 17 aa, Entamoeba histolytica
FGGDAYEYIKLTKTKTP

SEQ ID NO: 2675132 - protein, 27 aa, Entamoeba histolytica
FGGDCNRIRFIPSTSFIIIQQSFLLTN

SEQ ID NO: 2675133 - protein, 19 aa, Entamoeba histolytica
FGGFCTAAPGLHDDNHTSV

SEQ ID NO: 2675134 - protein, 19 aa, Entamoeba histolytica
FGGFCTAAPGLHDDNLTSI

SEQ ID NO: 2675135 - protein, 17 aa, Entamoeba histolytica
FGGFGSFGQTNQQQNGF

SEQ ID NO: 2675136 - protein, 17 aa, Entamoeba histolytica
FGGLLLMLYGKPEKLSA

SEQ ID NO: 2675137 - protein, 19 aa, Entamoeba histolytica
FGGLRNWNLRGLLVYQEST

SEQ ID NO: 2675138 - protein, 17 aa, Entamoeba histolytica
FGGMMGMNINFNELKPK

SEQ ID NO: 2675139 - protein, 30 aa, Entamoeba histolytica
FGGPERYYAFPGFLTCLYKTITIGTTDNWG

SEQ ID NO: 2675140 - protein, 20 aa, Entamoeba histolytica
FGGPVPPQAPMGIGNNGYMG

SEQ ID NO: 2675141 - protein, 17 aa, Entamoeba histolytica
FGGQCLHTINPQDPIFN

SEQ ID NO: 2675142 - protein, 22 aa, Entamoeba histolytica
FGHFLGNIIKLGFYNKESAPFV

SEQ ID NO: 2675143 - protein, 36 aa, Entamoeba histolytica
FGHQFEKRSGIGVVCPHGQYSPIFFQFLDCVNILIH

SEQ ID NO: 2675144 - protein, 37 aa, Entamoeba histolytica
FGHQFEKRSGIGVVCPHGQYSPIFFQFLDCVNILIHQ

SEQ ID NO: 2675145 - protein, 21 aa, Entamoeba histolytica
FGHRVKSVSLAIFSMAEVDAI

SEQ ID NO: 2675146 - protein, 20 aa, Entamoeba histolytica
FGIEICKNVYLGSAAAGANI

SEQ ID NO: 2675147 - protein, 20 aa, Entamoeba histolytica
FGIILWEIAHRLYPYEKNKQ

SEQ ID NO: 2675148 - protein, 25 aa, Entamoeba histolytica
FGILPIPFIVNYSFIIEIIGHKFEK

SEQ ID NO: 2675149 - protein, 25 aa, Entamoeba histolytica
FGITKKALNEWILKSLIKNIQKKRE

SEQ ID NO: 2675150 - protein, 42 aa, Entamoeba histolytica
FGIVFEFGKKLPIPEIVPFRLTREILDPMGVLKYDGPFKRCC

SEQ ID NO: 2675151 - protein, 24 aa, Entamoeba histolytica
FGIYLKSRIGLVGPNGTGKSTLMK

SEQ ID NO: 2675152 - protein, 28 aa, Entamoeba histolytica
FGKKEKLPCPFTYLQLSEMCGWNDTDKK

SEQ ID NO: 2675153 - protein, 21 aa, Entamoeba histolytica
FGKNRSGIIQTIFKDKGMEAT

SEQ ID NO: 2675154 - protein, 20 aa, Entamoeba histolytica
FGKSRWVEIAEFVGSRSRKQ

SEQ ID NO: 2675155 - protein, 17 aa, Entamoeba histolytica
FGKTIVDALLDYKEKEE

SEQ ID NO: 2675156 - protein, 17 aa, Entamoeba histolytica
FGKYYEVEHAISSGINE

SEQ ID NO: 2675157 - protein, 18 aa, Entamoeba histolytica
FGLEKEIWDEMVKIGISL

SEQ ID NO: 2675158 - protein, 23 aa, Entamoeba histolytica
FGLESIACCIPLGVDTTEFVFNL

SEQ ID NO: 2675159 - protein, 26 aa, Entamoeba histolytica
FGLKPYMVSLFSFFKENIQHFKNCRD

SEQ ID NO: 2675160 - protein, 24 aa, Entamoeba histolytica
FGLQRILGDFTFSNVLSIVSYDYN

SEQ ID NO: 2675161 - protein, 18 aa, Entamoeba histolytica
FGLQRILGNFTFSNVLSI

SEQ ID NO: 2675162 - protein, 21 aa, Entamoeba histolytica
FGLRNNPRIILYVNNPNTGEM

SEQ ID NO: 2675163 - protein, 30 aa, Entamoeba histolytica
FGNEFMAKFNGSFCNLPLLEHLTFIDSPGV

SEQ ID NO: 2675164 - protein, 18 aa, Entamoeba histolytica
FGNIPLKEIILIDKSPFI

SEQ ID NO: 2675165 - protein, 23 aa, Entamoeba histolytica
FGNKCLSCSTSTFDTEEVITTEN

SEQ ID NO: 2675166 - protein, 19 aa, Entamoeba histolytica
FGNLRAGDRQFLLYEGNGE

SEQ ID NO: 2675167 - protein, 18 aa, Entamoeba histolytica
FGNSNGYSRDKITTFVDF

SEQ ID NO: 2675168 - protein, 19 aa, Entamoeba histolytica
FGNYLYIILCKQCLEQCLL

SEQ ID NO: 2675169 - protein, 18 aa, Entamoeba histolytica
FGPACVRNPDLTWEQSAN

SEQ ID NO: 2675170 - protein, 21 aa, Entamoeba histolytica
FGPFKRFVLKGIQTLENQPGF

SEQ ID NO: 2675171 - protein, 19 aa, Entamoeba histolytica
FGPSWIKFNGLTVVRTSVE

SEQ ID NO: 2675172 - protein, 21 aa, Entamoeba histolytica
FGQEDFGIFCVTKQANVFGIF

SEQ ID NO: 2675173 - protein, 24 aa, Entamoeba histolytica
FGQKARKALSDSLDIIYECIGASD

SEQ ID NO: 2675174 - protein, 28 aa, Entamoeba histolytica
FGQKILTPDCPKELMTLTLDKKDNEYLY

SEQ ID NO: 2675175 - protein, 18 aa, Entamoeba histolytica
FGQKPIKSQYLIQNADYT

SEQ ID NO: 2675176 - protein, 25 aa, Entamoeba histolytica
FGQYIRIDWDYGFVEGRQYGRGDGG

SEQ ID NO: 2675177 - protein, 17 aa, Entamoeba histolytica
FGRICDRTGLNPGNNAA

SEQ ID NO: 2675178 - protein, 21 aa, Entamoeba histolytica
FGRTYKKVMNLWDLKYKLIDW

SEQ ID NO: 2675179 - protein, 19 aa, Entamoeba histolytica
FGSAISLKAIIENKVIEQM

SEQ ID NO: 2675180 - protein, 21 aa, Entamoeba histolytica
FGSHHWPTWGNKRVNEYWEKQ

SEQ ID NO: 2675181 - protein, 25 aa, Entamoeba histolytica
FGSLHNCGVVIPKGIDTLKGIISES

SEQ ID NO: 2675182 - protein, 17 aa, Entamoeba histolytica
FGSTGFYYERRVVPLIK

SEQ ID NO: 2675183 - protein, 18 aa, Entamoeba histolytica
FGSVDFSNFHVDFTSPTQ

SEQ ID NO: 2675184 - protein, 18 aa, Entamoeba histolytica
FGTPQLFDINGKWIKCSG

SEQ ID NO: 2675185 - protein, 17 aa, Entamoeba histolytica
FGTQALKKLIVVSLNDN

SEQ ID NO: 2675186 - protein, 25 aa, Entamoeba histolytica
FGVKEMLNIYGFRNSISLLPYSKRK

SEQ ID NO: 2675187 - protein, 32 aa, Entamoeba histolytica
FGVLIFKLLTGFCPFELIQIDPFTAIQVQACV

SEQ ID NO: 2675188 - protein, 19 aa, Entamoeba histolytica
FGVRCGKLEILEWDIYGDK

SEQ ID NO: 2675189 - protein, 17 aa, Entamoeba histolytica
FGYEIPKQIKIVKKNCF

SEQ ID NO: 2675190 - protein, 20 aa, Entamoeba histolytica
FGYSNCDKLVYKEDLTQCNH

SEQ ID NO: 2675191 - protein, 17 aa, Entamoeba histolytica
FGYVFGAFVSVPILETN

SEQ ID NO: 2675192 - protein, 23 aa, Entamoeba histolytica
FHANPRSFCGYVYPDKFESTRVI

SEQ ID NO: 2675193 - protein, 22 aa, Entamoeba histolytica
FHATWCKDCINVRPLYRKLITQ

SEQ ID NO: 2675194 - protein, 17 aa, Entamoeba histolytica
FHCFLGFVDEELLRFQM

SEQ ID NO: 2675195 - protein, 19 aa, Entamoeba histolytica
FHCTGMPIKACADKLKTEI

SEQ ID NO: 2675196 - protein, 18 aa, Entamoeba histolytica
FHDIIKVKGSIYLMGLAL

SEQ ID NO: 2675197 - protein, 19 aa, Entamoeba histolytica
FHEGCFVCSVCGIPLNENF

SEQ ID NO: 2675198 - protein, 17 aa, Entamoeba histolytica
FHEKGNEAFRIVVQVGR

SEQ ID NO: 2675199 - protein, 25 aa, Entamoeba histolytica
FHENKHSFGSLFLENPKNVQQILKQ

SEQ ID NO: 2675200 - protein, 28 aa, Entamoeba histolytica
FHFDLFIRDWKKYYPMKTLFYLSKPFND

SEQ ID NO: 2675201 - protein, 19 aa, Entamoeba histolytica
FHFEMKYSRTKGATKTVKM

SEQ ID NO: 2675202 - protein, 22 aa, Entamoeba histolytica
FHFNSSTPFNFSNQSTPSKQEE

SEQ ID NO: 2675203 - protein, 31 aa, Entamoeba histolytica
FHFPFYFEYLSKWPEMCFIARDCNGRVEGYH

SEQ ID NO: 2675204 - protein, 23 aa, Entamoeba histolytica
FHFPGRYNLVQTLACEESGAGGY

SEQ ID NO: 2675205 - protein, 23 aa, Entamoeba histolytica
FHFPGRYYLVQTLACEESGIGGY

SEQ ID NO: 2675206 - protein, 24 aa, Entamoeba histolytica
FHGEGKIYICEGVVNKQTILPTKL

SEQ ID NO: 2675207 - protein, 18 aa, Entamoeba histolytica
FHGKGFKTPSHVSDKDTN

SEQ ID NO: 2675208 - protein, 37 aa, Entamoeba histolytica
FHHLYKCPSCGFGVCSDCLKKGPTCRCNHGIPPLTEE

SEQ ID NO: 2675209 - protein, 23 aa, Entamoeba histolytica
FHIHFCTIHSPLFQSLNSVIGRA

SEQ ID NO: 2675210 - protein, 23 aa, Entamoeba histolytica
FHKEIPFNKGEMIIGRKAYEFLS

SEQ ID NO: 2675211 - protein, 19 aa, Entamoeba histolytica
FHKKLTWLKKFPKEQEELA

SEQ ID NO: 2675212 - protein, 23 aa, Entamoeba histolytica
FHKKVIDGQDCFVHESFDPTNFS

SEQ ID NO: 2675213 - protein, 30 aa, Entamoeba histolytica
FHKLEYKTGICFKHEFFIRDTPEFLDKIKR

SEQ ID NO: 2675214 - protein, 23 aa, Entamoeba histolytica
FHKSAVKALCFEINRNNVILSGG

SEQ ID NO: 2675215 - protein, 22 aa, Entamoeba histolytica
FHLKSMGFIGVIITINGKRIYH

SEQ ID NO: 2675216 - protein, 17 aa, Entamoeba histolytica
FHLLVFCLDYGVFSSLH

SEQ ID NO: 2675217 - protein, 17 aa, Entamoeba histolytica
FHNEIIQSLPLIISKGY

SEQ ID NO: 2675218 - protein, 18 aa, Entamoeba histolytica
FHPHEFARQITLMQNDLF

SEQ ID NO: 2675219 - protein, 21 aa, Entamoeba histolytica
FHPKLIFRLYKGVPCNKRKDL

SEQ ID NO: 2675220 - protein, 17 aa, Entamoeba histolytica
FHPSKHCAIGCIDGSVH

SEQ ID NO: 2675221 - protein, 18 aa, Entamoeba histolytica
FHQMKQWSVCVPKLNAKT

SEQ ID NO: 2675222 - protein, 22 aa, Entamoeba histolytica
FHRVKGRFKRREQIFEVESIIQ

SEQ ID NO: 2675223 - protein, 20 aa, Entamoeba histolytica
FHRVYFKILESIGYYHCKVI

SEQ ID NO: 2675224 - protein, 18 aa, Entamoeba histolytica
FHSELALFRDREIPSNTT

SEQ ID NO: 2675225 - protein, 23 aa, Entamoeba histolytica
FHSHLPSTLLLTLFDTNKTQLII

SEQ ID NO: 2675226 - protein, 24 aa, Entamoeba histolytica
FHSSLRPVPLIAHIDGFPTKAYCP

SEQ ID NO: 2675227 - protein, 21 aa, Entamoeba histolytica
FHVFNCIWNKFIFKASPHIVN

SEQ ID NO: 2675228 - protein, 18 aa, Entamoeba histolytica
FHVGCKLLRTGINELTSH

SEQ ID NO: 2675229 - protein, 18 aa, Entamoeba histolytica
FHVIPSIQAMSNYLNESV

SEQ ID NO: 2675230 - protein, 19 aa, Entamoeba histolytica
FHYLFGVKEAGFYGIVKMD

SEQ ID NO: 2675231 - protein, 17 aa, Entamoeba histolytica
FIAGGSCDNSYSVYSIE

SEQ ID NO: 2675232 - protein, 23 aa, Entamoeba histolytica
FIAHYFKIWCDRYPFIAEKKGGA

SEQ ID NO: 2675233 - protein, 17 aa, Entamoeba histolytica
FIAKCNVIAGVGISAFI

SEQ ID NO: 2675234 - protein, 26 aa, Entamoeba histolytica
FIAKDMWRVMFGYGVDVGRVKGKTNE

SEQ ID NO: 2675235 - protein, 19 aa, Entamoeba histolytica
FIALYNWVKLCVATFKHFD

SEQ ID NO: 2675236 - protein, 17 aa, Entamoeba histolytica
FIATLFVNCCPSEKSIS

SEQ ID NO: 2675237 - protein, 22 aa, Entamoeba histolytica
FICADHFIGIFYGIKNTGIKSK

SEQ ID NO: 2675238 - protein, 17 aa, Entamoeba histolytica
FICKRKFGIFCFKYHCE

SEQ ID NO: 2675239 - protein, 21 aa, Entamoeba histolytica
FICPCCHKESTIFPPTHGGAK

SEQ ID NO: 2675240 - protein, 17 aa, Entamoeba histolytica
FICPNYIEYSTWLNIIP

SEQ ID NO: 2675241 - protein, 18 aa, Entamoeba histolytica
FICPSSIELKVIILSSLL

SEQ ID NO: 2675242 - protein, 19 aa, Entamoeba histolytica
FICSTCCIQFSSSEERATH

SEQ ID NO: 2675243 - protein, 20 aa, Entamoeba histolytica
FIDCELPFSISLYPHHLKNI

SEQ ID NO: 2675244 - protein, 17 aa, Entamoeba histolytica
FIDDGYDYSLPRCTVRP

SEQ ID NO: 2675245 - protein, 24 aa, Entamoeba histolytica
FIDFTGKGPYVFASDLNKIKVNSF

SEQ ID NO: 2675246 - protein, 20 aa, Entamoeba histolytica
FIDIVIDLRSDYSPLLETLN

SEQ ID NO: 2675247 - protein, 21 aa, Entamoeba histolytica
FIDKCKLLYPKGNIEGKKEQW

SEQ ID NO: 2675248 - protein, 25 aa, Entamoeba histolytica
FIDKVLTKQGYLRRIIIQNDNGSKT

SEQ ID NO: 2675249 - protein, 17 aa, Entamoeba histolytica
FIDTAFDIVNYIKSIKS

SEQ ID NO: 2675250 - protein, 20 aa, Entamoeba histolytica
FIDWKCIVGKLTVKQRNIIA

SEQ ID NO: 2675251 - protein, 18 aa, Entamoeba histolytica
FIDYDFKDIHSLKRQYDE

SEQ ID NO: 2675252 - protein, 17 aa, Entamoeba histolytica
FIDYMMFEYRKNIKDLF

SEQ ID NO: 2675253 - protein, 19 aa, Entamoeba histolytica
FIEALKTLFSNGATETTIF

SEQ ID NO: 2675254 - protein, 17 aa, Entamoeba histolytica
FIECRFHLICKKDEYNG

SEQ ID NO: 2675255 - protein, 17 aa, Entamoeba histolytica
FIEDKWYCHSIEFSDFL

SEQ ID NO: 2675256 - protein, 30 aa, Entamoeba histolytica
FIEEISHSKCKFPYPKIIKTPFQSMEAANV

SEQ ID NO: 2675257 - protein, 25 aa, Entamoeba histolytica
FIEESLRLKVKYALKLSTGKRDLIK

SEQ ID NO: 2675258 - protein, 18 aa, Entamoeba histolytica
FIEIFFKLYTAYCQFGEL

SEQ ID NO: 2675259 - protein, 21 aa, Entamoeba histolytica
FIEISLSFVIPYFLEEPLPIR

SEQ ID NO: 2675260 - protein, 25 aa, Entamoeba histolytica
FIERMKEYFLSFFIKQEPSFDTKTL

SEQ ID NO: 2675261 - protein, 17 aa, Entamoeba histolytica
FIERNAVIYPEQKEECI

SEQ ID NO: 2675262 - protein, 18 aa, Entamoeba histolytica
FIERSLIYTEEVSKASGL

SEQ ID NO: 2675263 - protein, 23 aa, Entamoeba histolytica
FIESFKGYHFVKPIITPRFAVSC

SEQ ID NO: 2675264 - protein, 18 aa, Entamoeba histolytica
FIESGALVQIFWSLCLLL

SEQ ID NO: 2675265 - protein, 24 aa, Entamoeba histolytica
FIEVTALFLRHSPQAFQFKEDLLV

SEQ ID NO: 2675266 - protein, 17 aa, Entamoeba histolytica
FIEWVLKTTCDEECYLK

SEQ ID NO: 2675267 - protein, 19 aa, Entamoeba histolytica
FIEYCLKNNYWNCPLCEKK

SEQ ID NO: 2675268 - protein, 25 aa, Entamoeba histolytica
FIEYLSNFKNPICYFHNLGYDGRFL

SEQ ID NO: 2675269 - protein, 28 aa, Entamoeba histolytica
FIFADDHPFELFSQFGITQVIQEQNLGK

SEQ ID NO: 2675270 - protein, 19 aa, Entamoeba histolytica
FIFCGLEGNNFVILKHFEK

SEQ ID NO: 2675271 - protein, 20 aa, Entamoeba histolytica
FIFENEWEYWINVLYECCTI

SEQ ID NO: 2675272 - protein, 17 aa, Entamoeba histolytica
FIFEPMMYYINDSSPFK

SEQ ID NO: 2675273 - protein, 19 aa, Entamoeba histolytica
FIFVKGVPLNFERYSQVKE

SEQ ID NO: 2675274 - protein, 31 aa, Entamoeba histolytica
FIFWEIARMYDFYLLRLLIRHSSATVTEFWD

SEQ ID NO: 2675275 - protein, 18 aa, Entamoeba histolytica
FIGFRYYFDRDELISMDE

SEQ ID NO: 2675276 - protein, 32 aa, Entamoeba histolytica
FIGHSLGGLYFRLAIPILFNRNIFNNSNYIPF

SEQ ID NO: 2675277 - protein, 25 aa, Entamoeba histolytica
FIGKADAIVAVFSFDDYKSFEDTEG

SEQ ID NO: 2675278 - protein, 24 aa, Entamoeba histolytica
FIGKARLLLFKDLLIDKWFMKLFN

SEQ ID NO: 2675279 - protein, 17 aa, Entamoeba histolytica
FIGKINTFLVGGVQSIN

SEQ ID NO: 2675280 - protein, 20 aa, Entamoeba histolytica
FIGLSSKEVRLIHQWIATLV

SEQ ID NO: 2675281 - protein, 23 aa, Entamoeba histolytica
FIGRDIGDWVGLSLKSKRTKKHI

SEQ ID NO: 2675282 - protein, 19 aa, Entamoeba histolytica
FIGSGSFGKVFQIKRKSNN

SEQ ID NO: 2675283 - protein, 19 aa, Entamoeba histolytica
FIGTGCGIGAKGHKITIDE

SEQ ID NO: 2675284 - protein, 18 aa, Entamoeba histolytica
FIHCGGLVGHIEDIVVTN

SEQ ID NO: 2675285 - protein, 18 aa, Entamoeba histolytica
FIHFFSINVTQGHVQFSF

SEQ ID NO: 2675286 - protein, 31 aa, Entamoeba histolytica
FIHIAKTKNKRCCVSRLSELYKEMNDNDLFN

SEQ ID NO: 2675287 - protein, 23 aa, Entamoeba histolytica
FIHIKSITFLLHLFKVINSISSI

SEQ ID NO: 2675288 - protein, 24 aa, Entamoeba histolytica
FIHKRHIDKLKQWIGLTKYRIIYN

SEQ ID NO: 2675289 - protein, 17 aa, Entamoeba histolytica
FIHLALRIRGGKPVILL

SEQ ID NO: 2675290 - protein, 18 aa, Entamoeba histolytica
FIHLKRIKLISINVKLNL

SEQ ID NO: 2675291 - protein, 19 aa, Entamoeba histolytica
FIHPLQIPVCYTHQKIITK

SEQ ID NO: 2675292 - protein, 18 aa, Entamoeba histolytica
FIHQLFYETFDFENYTIC

SEQ ID NO: 2675293 - protein, 26 aa, Entamoeba histolytica
FIHYSKYYANVCFSTYPVMNGAKFGK

SEQ ID NO: 2675294 - protein, 22 aa, Entamoeba histolytica
FIIDKIDKIYVWIGKDSSRLKR

SEQ ID NO: 2675295 - protein, 18 aa, Entamoeba histolytica
FIIEPSVVGAFKTRVYDM

SEQ ID NO: 2675296 - protein, 19 aa, Entamoeba histolytica
FIIFPKKYGFFIVPNPNYI

SEQ ID NO: 2675297 - protein, 20 aa, Entamoeba histolytica
FIIFQLCDFMTSIIQIGGYD

SEQ ID NO: 2675298 - protein, 26 aa, Entamoeba histolytica
FIIITKTGYAFGCFCHKKIPYPKKSY

SEQ ID NO: 2675299 - protein, 24 aa, Entamoeba histolytica
FIIKDYKFGVLYATEGQTLESELF

SEQ ID NO: 2675300 - protein, 18 aa, Entamoeba histolytica
FIILKSSSLFHIFHLSSI

SEQ ID NO: 2675301 - protein, 23 aa, Entamoeba histolytica
FIINGVLLKPAFVGITQTELYPI

SEQ ID NO: 2675302 - protein, 22 aa, Entamoeba histolytica
FIINIPVPRVFALIHKTFPTLL

SEQ ID NO: 2675303 - protein, 18 aa, Entamoeba histolytica
FIINLALASCMWFEQPLI

SEQ ID NO: 2675304 - protein, 20 aa, Entamoeba histolytica
FIIQTARPIPKLNIPPLEVQ

SEQ ID NO: 2675305 - protein, 17 aa, Entamoeba histolytica
FIISIFSKIKWTDNELV

SEQ ID NO: 2675306 - protein, 19 aa, Entamoeba histolytica
FIITKAGSIIIYRIFLDDR

SEQ ID NO: 2675307 - protein, 22 aa, Entamoeba histolytica
FIIYNYLIYYILKLNTESPNTG

SEQ ID NO: 2675308 - protein, 25 aa, Entamoeba histolytica
FIKDIKIQLNMSFKRDQNGHVICVD

SEQ ID NO: 2675309 - protein, 17 aa, Entamoeba histolytica
FIKDSTKIRIITALMKL

SEQ ID NO: 2675310 - protein, 18 aa, Entamoeba histolytica
FIKHPGFTTVEINLPKAI

SEQ ID NO: 2675311 - protein, 23 aa, Entamoeba histolytica
FIKKLRIFFPNIIDLKYVTNQIS

SEQ ID NO: 2675312 - protein, 28 aa, Entamoeba histolytica
FIKKLYESCFYRSMLDNNCLIVYAENIS

SEQ ID NO: 2675313 - protein, 17 aa, Entamoeba histolytica
FIKKPFKIPTINILIKG

SEQ ID NO: 2675314 - protein, 19 aa, Entamoeba histolytica
FIKNRLLTSLTLKTLSQTS

SEQ ID NO: 2675315 - protein, 26 aa, Entamoeba histolytica
FIKPFPHCHYCILKTDIHTGTKENTI

SEQ ID NO: 2675316 - protein, 19 aa, Entamoeba histolytica
FIKPKSRFNLLLLEPGEQY

SEQ ID NO: 2675317 - protein, 20 aa, Entamoeba histolytica
FIKRREILQRIVGHLGENSN

SEQ ID NO: 2675318 - protein, 22 aa, Entamoeba histolytica
FIKRSIRFQMNLHLALVQNNDL

SEQ ID NO: 2675319 - protein, 23 aa, Entamoeba histolytica
FIKSKDFSVVKCIIYSEIFKTIR

SEQ ID NO: 2675320 - protein, 17 aa, Entamoeba histolytica
FIKTFKPFIKSIPTNVI

SEQ ID NO: 2675321 - protein, 22 aa, Entamoeba histolytica
FIKTTFCFIQTIGIQCLKFPFT

SEQ ID NO: 2675322 - protein, 19 aa, Entamoeba histolytica
FIKVMGRSASHIALEAALE

SEQ ID NO: 2675323 - protein, 26 aa, Entamoeba histolytica
FIKYKVIEGLLQFVIQTFVNKQYGAS

SEQ ID NO: 2675324 - protein, 19 aa, Entamoeba histolytica
FILDFSWFSTEEVTENIII

SEQ ID NO: 2675325 - protein, 24 aa, Entamoeba histolytica
FILDHLKRYLFFRYKSVGFSVQKI

SEQ ID NO: 2675326 - protein, 24 aa, Entamoeba histolytica
FILEKKFTVSRLKLLKTLDQDVVE

SEQ ID NO: 2675327 - protein, 17 aa, Entamoeba histolytica
FILHFPDKLMARPETVQ

SEQ ID NO: 2675328 - protein, 17 aa, Entamoeba histolytica
FILLKYQLEKDEREAEA

SEQ ID NO: 2675329 - protein, 26 aa, Entamoeba histolytica
FILLTPKTKFIWKGKFRNEKYVEFAV

SEQ ID NO: 2675330 - protein, 19 aa, Entamoeba histolytica
FILNKCYFNFYQLPKSICH

SEQ ID NO: 2675331 - protein, 19 aa, Entamoeba histolytica
FILTQKIVDTFSRYVQNPL

SEQ ID NO: 2675332 - protein, 17 aa, Entamoeba histolytica
FILTRKSYLQQFTVLME

SEQ ID NO: 2675333 - protein, 21 aa, Entamoeba histolytica
FILTTRVGGLGINLTGADRVI

SEQ ID NO: 2675334 - protein, 22 aa, Entamoeba histolytica
FIMNRYGINVIDVLNGEKSITK

SEQ ID NO: 2675335 - protein, 24 aa, Entamoeba histolytica
FINAYKKYICRVIGYMDSCIVNKP

SEQ ID NO: 2675336 - protein, 19 aa, Entamoeba histolytica
FINCGRFSPDGSLCVCVSS

SEQ ID NO: 2675337 - protein, 34 aa, Entamoeba histolytica
FINEWNEIRKWVGLSPCVGCWIPFNESWGQFNTK

SEQ ID NO: 2675338 - protein, 24 aa, Entamoeba histolytica
FINEWVMRYSEMFDSAVEQNGMIK

SEQ ID NO: 2675339 - protein, 21 aa, Entamoeba histolytica
FINKLPLTLSIFITHQSTFLS

SEQ ID NO: 2675340 - protein, 26 aa, Entamoeba histolytica
FINLLKFKIVLKREWLFDEIDINEYL

SEQ ID NO: 2675341 - protein, 27 aa, Entamoeba histolytica
FINLLKLKIVLQREWLFDEIDINEYLG

SEQ ID NO: 2675342 - protein, 17 aa, Entamoeba histolytica
FINNEEILFIKRMIVSE

SEQ ID NO: 2675343 - protein, 19 aa, Entamoeba histolytica
FINNFKLPNEFSLKPLHRM

SEQ ID NO: 2675344 - protein, 18 aa, Entamoeba histolytica
FINPGEMVGSIAAQSIGA

SEQ ID NO: 2675345 - protein, 18 aa, Entamoeba histolytica
FINSIPFILFDELHLPKV

SEQ ID NO: 2675346 - protein, 19 aa, Entamoeba histolytica
FINSYVCQRLEFPKNHSIS

SEQ ID NO: 2675347 - protein, 20 aa, Entamoeba histolytica
FIPEALRVMKHSDQIVTRNK

SEQ ID NO: 2675348 - protein, 25 aa, Entamoeba histolytica
FIPGRAPNSIKNRFYSHLSKIRNKY

SEQ ID NO: 2675349 - protein, 23 aa, Entamoeba histolytica
FIPHSYYISQWVYCRDAHSLPSS

SEQ ID NO: 2675350 - protein, 22 aa, Entamoeba histolytica
FIPIWDILHIIYGNQLINELFD

SEQ ID NO: 2675351 - protein, 18 aa, Entamoeba histolytica
FIPPIGVKLDDEFATKLY

SEQ ID NO: 2675352 - protein, 19 aa, Entamoeba histolytica
FIPQYDWFLSSVCNNLNIV

SEQ ID NO: 2675353 - protein, 17 aa, Entamoeba histolytica
FIPSITCTQPFKKESST

SEQ ID NO: 2675354 - protein, 22 aa, Entamoeba histolytica
FIPYKFGQLRSIILTSTPSKIP

SEQ ID NO: 2675355 - protein, 17 aa, Entamoeba histolytica
FIPYLKVYYQFIGNSGV

SEQ ID NO: 2675356 - protein, 17 aa, Entamoeba histolytica
FIQCIQNAFTLFFKEKI

SEQ ID NO: 2675357 - protein, 26 aa, Entamoeba histolytica
FIQEIPSKRKFIFEMNDFNDEIESCP

SEQ ID NO: 2675358 - protein, 18 aa, Entamoeba histolytica
FIQEKMIRSYEVNQSENN

SEQ ID NO: 2675359 - protein, 25 aa, Entamoeba histolytica
FIQEMFEFRIQNFLDIYLHESSQST

SEQ ID NO: 2675360 - protein, 24 aa, Entamoeba histolytica
FIQIRGNIPLIWKTKEKDLFKPRG

SEQ ID NO: 2675361 - protein, 19 aa, Entamoeba histolytica
FIQKQILYQRMMYQYPYYY

SEQ ID NO: 2675362 - protein, 21 aa, Entamoeba histolytica
FIQKQVRLMLGKKVDSPPILC

SEQ ID NO: 2675363 - protein, 23 aa, Entamoeba histolytica
FIQNCLEQLTLMRVINQNIYDAY

SEQ ID NO: 2675364 - protein, 25 aa, Entamoeba histolytica
FIQQIRFNKFISHSCIYDEKLYISQ

SEQ ID NO: 2675365 - protein, 29 aa, Entamoeba histolytica
FIQTIGIQCLKFPFTLSIHQQPLQFFSHF

SEQ ID NO: 2675366 - protein, 20 aa, Entamoeba histolytica
FIQYPACLYYLEQLQNPDFR

SEQ ID NO: 2675367 - protein, 18 aa, Entamoeba histolytica
FIREFRVPVNTMVWQLAA

SEQ ID NO: 2675368 - protein, 30 aa, Entamoeba histolytica
FIRNNVNYLFCYRWIVLLFKRDFSSRDCLN

SEQ ID NO: 2675369 - protein, 19 aa, Entamoeba histolytica
FIRNYPAVVSLLFELLDRL

SEQ ID NO: 2675370 - protein, 20 aa, Entamoeba histolytica
FIRRFDRTFNFDGTSGSIAK

SEQ ID NO: 2675371 - protein, 22 aa, Entamoeba histolytica
FIRSLKCGYVMNILHINPFHFK

SEQ ID NO: 2675372 - protein, 19 aa, Entamoeba histolytica
FIRYKLRGSAEFAKVAMAD

SEQ ID NO: 2675373 - protein, 18 aa, Entamoeba histolytica
FISCCNVYGSVLVSEEEY

SEQ ID NO: 2675374 - protein, 18 aa, Entamoeba histolytica
FISDIQWKPEVFGDSAIF

SEQ ID NO: 2675375 - protein, 26 aa, Entamoeba histolytica
FISDVMISFYLYCGWMDQLTEKLADK

SEQ ID NO: 2675376 - protein, 24 aa, Entamoeba histolytica
FISEFKGNLQIIGIGKFNGKEFGE

SEQ ID NO: 2675377 - protein, 24 aa, Entamoeba histolytica
FISFNDIQTILSFVDNLNKSILIT

SEQ ID NO: 2675378 - protein, 25 aa, Entamoeba histolytica
FISIKGPELLTMWYGESEANVRDVF

SEQ ID NO: 2675379 - protein, 25 aa, Entamoeba histolytica
FISLCTSLVYRCHNYFASYIIFSTL

SEQ ID NO: 2675380 - protein, 18 aa, Entamoeba histolytica
FISLNVWEIVSSLSNDPD

SEQ ID NO: 2675381 - protein, 18 aa, Entamoeba histolytica
FISLVCRGKIKGIKLNGP

SEQ ID NO: 2675382 - protein, 23 aa, Entamoeba histolytica
FISRNRYEWYIAQYAMQKNGIIP

SEQ ID NO: 2675383 - protein, 25 aa, Entamoeba histolytica
FISVKGPELLTMWFGESEANVRNIF

SEQ ID NO: 2675384 - protein, 28 aa, Entamoeba histolytica
FITCDYCLPELLSLVAECITNDSMNSLI

SEQ ID NO: 2675385 - protein, 21 aa, Entamoeba histolytica
FITILKSLRKSILLKDNLNIV

SEQ ID NO: 2675386 - protein, 22 aa, Entamoeba histolytica
FITVLRGTRGMRGGYRGNSRGN

SEQ ID NO: 2675387 - protein, 18 aa, Entamoeba histolytica
FIVCAKCNKKVCNTCATT

SEQ ID NO: 2675388 - protein, 19 aa, Entamoeba histolytica
FIVDTGYSFKSTFSSLKPL

SEQ ID NO: 2675389 - protein, 17 aa, Entamoeba histolytica
FIVEKMISYGILDILKE

SEQ ID NO: 2675390 - protein, 19 aa, Entamoeba histolytica
FIVLMPIALQLFGKIMNSG

SEQ ID NO: 2675391 - protein, 21 aa, Entamoeba histolytica
FIVPCLRECYLKGILSLQSPI

SEQ ID NO: 2675392 - protein, 25 aa, Entamoeba histolytica
FIWSWKKGKILKVFEHAHKGCVTDV

SEQ ID NO: 2675393 - protein, 20 aa, Entamoeba histolytica
FIYTGIKFYLEDNIPESFTK

SEQ ID NO: 2675394 - protein, 19 aa, Entamoeba histolytica
FIYYYPYQFGFNSTLIHFL

SEQ ID NO: 2675395 - protein, 21 aa, Entamoeba histolytica
FKAACSSSWGLIKPTIDKLNK

SEQ ID NO: 2675396 - protein, 21 aa, Entamoeba histolytica
FKAACSSSWGLIKPTIDTLNE

SEQ ID NO: 2675397 - protein, 17 aa, Entamoeba histolytica
FKAAKKMLSKDSTKKKR

SEQ ID NO: 2675398 - protein, 20 aa, Entamoeba histolytica
FKAIFIETVTNFAQKVGQPT

SEQ ID NO: 2675399 - protein, 17 aa, Entamoeba histolytica
FKAKELLSFPNEVINNS

SEQ ID NO: 2675400 - protein, 23 aa, Entamoeba histolytica
FKASKYISCKIINYFTNDSVQMI

SEQ ID NO: 2675401 - protein, 18 aa, Entamoeba histolytica
FKCFIPSIHDIYILNKIN

SEQ ID NO: 2675402 - protein, 20 aa, Entamoeba histolytica
FKCHICKKICDPMMIRSIKF

SEQ ID NO: 2675403 - protein, 25 aa, Entamoeba histolytica
FKCHQMKASSLFFVLDDIGNENLIE

SEQ ID NO: 2675404 - protein, 19 aa, Entamoeba histolytica
FKCILSHPIKKDVFPITYQ

SEQ ID NO: 2675405 - protein, 19 aa, Entamoeba histolytica
FKCKKRMDGKKCQKGYDSH

SEQ ID NO: 2675406 - protein, 21 aa, Entamoeba histolytica
FKCYPLYDFGVSIIDSIEGVT

SEQ ID NO: 2675407 - protein, 20 aa, Entamoeba histolytica
FKDCSFYSGESCDTDNGMVA

SEQ ID NO: 2675408 - protein, 25 aa, Entamoeba histolytica
FKDDEPPIVYGFRPYMKEFIRKIDQ

SEQ ID NO: 2675409 - protein, 17 aa, Entamoeba histolytica
FKDERTVLMIRRKKGEI

SEQ ID NO: 2675410 - protein, 18 aa, Entamoeba histolytica
FKDEVITLTQKIFKKHDL

SEQ ID NO: 2675411 - protein, 26 aa, Entamoeba histolytica
FKDGKVFCALIHRHRPDLLDWETVGE

SEQ ID NO: 2675412 - protein, 19 aa, Entamoeba histolytica
FKDGRICLDILQDKWSSVY

SEQ ID NO: 2675413 - protein, 25 aa, Entamoeba histolytica
FKDGRIIKYVIWYKVSYSRYLEEKK

SEQ ID NO: 2675414 - protein, 20 aa, Entamoeba histolytica
FKDIKSIETFSYINKKCFDV

SEQ ID NO: 2675415 - protein, 20 aa, Entamoeba histolytica
FKDKHMFVFSLKNSNKTGEV

SEQ ID NO: 2675416 - protein, 20 aa, Entamoeba histolytica
FKDKLNQLFSLIVPTIKNLK

SEQ ID NO: 2675417 - protein, 17 aa, Entamoeba histolytica
FKDTEICLTEESDTSSS

SEQ ID NO: 2675418 - protein, 20 aa, Entamoeba histolytica
FKDVECAILVAGMPRKVGME

SEQ ID NO: 2675419 - protein, 24 aa, Entamoeba histolytica
FKDVECAILVAGMPRKVGMERKEL

SEQ ID NO: 2675420 - protein, 19 aa, Entamoeba histolytica
FKEAIRAGVNYKDSLFSKP

SEQ ID NO: 2675421 - protein, 25 aa, Entamoeba histolytica
FKEAPHVFHVLKAMISVIDYNQNIP

SEQ ID NO: 2675422 - protein, 17 aa, Entamoeba histolytica
FKECYIEINECIEYFYN

SEQ ID NO: 2675423 - protein, 20 aa, Entamoeba histolytica
FKEEGRFIIATIRKERINNN

SEQ ID NO: 2675424 - protein, 23 aa, Entamoeba histolytica
FKEESILGLLMKWVDIELQVFKR

SEQ ID NO: 2675425 - protein, 26 aa, Entamoeba histolytica
FKEESKELLIEIGFNKYAVQKQEIAD

SEQ ID NO: 2675426 - protein, 22 aa, Entamoeba histolytica
FKEGLKKLAATLAIGAKLGGNV

SEQ ID NO: 2675427 - protein, 24 aa, Entamoeba histolytica
FKEGRIFKYVIWYDVSYSKYLEEK

SEQ ID NO: 2675428 - protein, 23 aa, Entamoeba histolytica
FKEGRIIKYVIWYDVSYSRYLKE

SEQ ID NO: 2675429 - protein, 21 aa, Entamoeba histolytica
FKEGRINKYVIWYKMSYSRYL

SEQ ID NO: 2675430 - protein, 19 aa, Entamoeba histolytica
FKEIFSFDDSATFERIKPI

SEQ ID NO: 2675431 - protein, 23 aa, Entamoeba histolytica
FKEIPYYLLHPFHSLLIREYPSS

SEQ ID NO: 2675432 - protein, 26 aa, Entamoeba histolytica
FKEISDIGKIEWKKNIFDLLEKQIQE

SEQ ID NO: 2675433 - protein, 25 aa, Entamoeba histolytica
FKEKPFPPARIRKLTKINIDNKQLK

SEQ ID NO: 2675434 - protein, 26 aa, Entamoeba histolytica
FKEKVSFRVIRCLEPFVKESETEYMI

SEQ ID NO: 2675435 - protein, 21 aa, Entamoeba histolytica
FKELCSSALLSLRKQGSLFIY

SEQ ID NO: 2675436 - protein, 17 aa, Entamoeba histolytica
FKEPILYDLFGIVNHQG

SEQ ID NO: 2675437 - protein, 20 aa, Entamoeba histolytica
FKEQAIWMLNALWPTYKDTM

SEQ ID NO: 2675438 - protein, 28 aa, Entamoeba histolytica
FKEQVCYRIGEMIRRGGIKCTNVVLEQD

SEQ ID NO: 2675439 - protein, 24 aa, Entamoeba histolytica
FKESKKVKCITGMISLQGKRPTNE

SEQ ID NO: 2675440 - protein, 17 aa, Entamoeba histolytica
FKEVLFHSIVRDAQGRK

SEQ ID NO: 2675441 - protein, 17 aa, Entamoeba histolytica
FKEVVDRLAGATNNVQY

SEQ ID NO: 2675442 - protein, 22 aa, Entamoeba histolytica
FKEYLTQCSFIKCVNYLMKKTN

SEQ ID NO: 2675443 - protein, 25 aa, Entamoeba histolytica
FKFIKESEFLYLLCSFYNKSIENPF

SEQ ID NO: 2675444 - protein, 17 aa, Entamoeba histolytica
FKFINVMLNEYRDYIGY

SEQ ID NO: 2675445 - protein, 24 aa, Entamoeba histolytica
FKFKQEILENACFVRRKKENKEEN

SEQ ID NO: 2675446 - protein, 23 aa, Entamoeba histolytica
FKFPNELEEYVFLYNKYKQRGVF

SEQ ID NO: 2675447 - protein, 18 aa, Entamoeba histolytica
FKFVTVIIDRVFIKMQVW

SEQ ID NO: 2675448 - protein, 20 aa, Entamoeba histolytica
FKGCCSLESITIPTSVSQIG

SEQ ID NO: 2675449 - protein, 18 aa, Entamoeba histolytica
FKGDEKLSLAKVLHSVEV

SEQ ID NO: 2675450 - protein, 21 aa, Entamoeba histolytica
FKGDYMSTIGMDFNTKTISVN

SEQ ID NO: 2675451 - protein, 32 aa, Entamoeba histolytica
FKGKQYVLTFPRKVVKIYPLNVPFSLEYVVMV

SEQ ID NO: 2675452 - protein, 24 aa, Entamoeba histolytica
FKGMIKCVKDIVGIHAKELLVDSV

SEQ ID NO: 2675453 - protein, 19 aa, Entamoeba histolytica
FKGNDSFITKDIPKRLFED

SEQ ID NO: 2675454 - protein, 20 aa, Entamoeba histolytica
FKGRRVVTFHSQRDFIFFRH

SEQ ID NO: 2675455 - protein, 18 aa, Entamoeba histolytica
FKGTLMDVCCTFTNATEL

SEQ ID NO: 2675456 - protein, 17 aa, Entamoeba histolytica
FKGVIAGYAQMKQVDEF

SEQ ID NO: 2675457 - protein, 20 aa, Entamoeba histolytica
FKGVLPQLVELMCDEVDAIR

SEQ ID NO: 2675458 - protein, 19 aa, Entamoeba histolytica
FKHIRELLHIAEIHEEDEY

SEQ ID NO: 2675459 - protein, 18 aa, Entamoeba histolytica
FKHKKYGPAKVNVDIAKR

SEQ ID NO: 2675460 - protein, 17 aa, Entamoeba histolytica
FKHKKYGPAKVNVDVAK

SEQ ID NO: 2675461 - protein, 19 aa, Entamoeba histolytica
FKHRIIIQLESRFQLISTI

SEQ ID NO: 2675462 - protein, 17 aa, Entamoeba histolytica
FKHYIKLIWENLNEEPK

SEQ ID NO: 2675463 - protein, 19 aa, Entamoeba histolytica
FKIDEVYKNLTRVEQVEPN

SEQ ID NO: 2675464 - protein, 17 aa, Entamoeba histolytica
FKIFEDIANGVAACHRF

SEQ ID NO: 2675465 - protein, 19 aa, Entamoeba histolytica
FKIGMTYTSNGWYIMQCEP

SEQ ID NO: 2675466 - protein, 34 aa, Entamoeba histolytica
FKIHELRCRKMYKVCPFCGKKLLINSEESQKHLD

SEQ ID NO: 2675467 - protein, 20 aa, Entamoeba histolytica
FKIKAFREDFVYGFSTWFDV

SEQ ID NO: 2675468 - protein, 21 aa, Entamoeba histolytica
FKIKNCITENILSESLSILNL

SEQ ID NO: 2675469 - protein, 21 aa, Entamoeba histolytica
FKILESIGYYHCKVITINNNN

SEQ ID NO: 2675470 - protein, 26 aa, Entamoeba histolytica
FKILYTKGCYTKGIFRENSLANKDTI

SEQ ID NO: 2675471 - protein, 21 aa, Entamoeba histolytica
FKINRLTVSFGKEGTHVLIPS

SEQ ID NO: 2675472 - protein, 20 aa, Entamoeba histolytica
FKIPNYRVVMEKELRNYSTL

SEQ ID NO: 2675473 - protein, 17 aa, Entamoeba histolytica
FKISRLLRMNDLAQIST

SEQ ID NO: 2675474 - protein, 17 aa, Entamoeba histolytica
FKISSTIEHNMLTKLNS

SEQ ID NO: 2675475 - protein, 19 aa, Entamoeba histolytica
FKITKDIQCSLYYFHSVLL

SEQ ID NO: 2675476 - protein, 29 aa, Entamoeba histolytica
FKIYYNKEMFKLVCCPLFVGFFSRNICLS

SEQ ID NO: 2675477 - protein, 18 aa, Entamoeba histolytica
FKKAISLCINDCYETVIR

SEQ ID NO: 2675478 - protein, 19 aa, Entamoeba histolytica
FKKDVMKTLIMKEKNPDYA

SEQ ID NO: 2675479 - protein, 20 aa, Entamoeba histolytica
FKKDVPIPHFDFKYSSIYYK

SEQ ID NO: 2675480 - protein, 22 aa, Entamoeba histolytica
FKKEFLPLVDLMFFEQRYNRDI

SEQ ID NO: 2675481 - protein, 22 aa, Entamoeba histolytica
FKKEKSGTLVIDFESVLFYGFE

SEQ ID NO: 2675482 - protein, 25 aa, Entamoeba histolytica
FKKENKVSRKGFFTQRRRKAKPEVD

SEQ ID NO: 2675483 - protein, 21 aa, Entamoeba histolytica
FKKERINNHICLKKHVMVLVF

SEQ ID NO: 2675484 - protein, 19 aa, Entamoeba histolytica
FKKERLAQLCEEVKPFPKA

SEQ ID NO: 2675485 - protein, 24 aa, Entamoeba histolytica
FKKGCKKFPVGTEGRYRRIATYMK

SEQ ID NO: 2675486 - protein, 22 aa, Entamoeba histolytica
FKKGDTTPCYWVLTRSVLSLYS

SEQ ID NO: 2675487 - protein, 17 aa, Entamoeba histolytica
FKKGEIVIIIGNIENGW

SEQ ID NO: 2675488 - protein, 30 aa, Entamoeba histolytica
FKKGTFPKFCEFLKQLGIHFCNGNISIDKR

SEQ ID NO: 2675489 - protein, 17 aa, Entamoeba histolytica
FKKIFQKEIKTIPKKEI

SEQ ID NO: 2675490 - protein, 31 aa, Entamoeba histolytica
FKKISMINFLIFIYGYDWAEVVNAPQGGNVE

SEQ ID NO: 2675491 - protein, 18 aa, Entamoeba histolytica
FKKKCQEKGILINEKIEI

SEQ ID NO: 2675492 - protein, 18 aa, Entamoeba histolytica
FKKKEFIVDGTHIVSQIW

SEQ ID NO: 2675493 - protein, 22 aa, Entamoeba histolytica
FKKLGIRPSHGVLLYGPSGCAK

SEQ ID NO: 2675494 - protein, 17 aa, Entamoeba histolytica
FKKLTLVKPPECKGLPI

SEQ ID NO: 2675495 - protein, 20 aa, Entamoeba histolytica
FKKNAKWSINKNVPDFGDET

SEQ ID NO: 2675496 - protein, 19 aa, Entamoeba histolytica
FKKNDFRGVGIVWGSKQSN

SEQ ID NO: 2675497 - protein, 24 aa, Entamoeba histolytica
FKKNLKSKCKFILKRGNDKKIITQ

SEQ ID NO: 2675498 - protein, 25 aa, Entamoeba histolytica
FKKQICEFKERVGIVHKGIDEMHSV

SEQ ID NO: 2675499 - protein, 20 aa, Entamoeba histolytica
FKKQILMYLVPLKLRCGMYL

SEQ ID NO: 2675500 - protein, 18 aa, Entamoeba histolytica
FKKRVVCDVVGRLYNKDG

SEQ ID NO: 2675501 - protein, 25 aa, Entamoeba histolytica
FKKTRSTRIIVKMKRVSSLKGNGIN

SEQ ID NO: 2675502 - protein, 20 aa, Entamoeba histolytica
FKKVGVWRLNSFLKEEVINE

SEQ ID NO: 2675503 - protein, 22 aa, Entamoeba histolytica
FKKVNIEVMRAWITSKIIDILE

SEQ ID NO: 2675504 - protein, 19 aa, Entamoeba histolytica
FKKVWRAYANYARRRKNIP

SEQ ID NO: 2675505 - protein, 19 aa, Entamoeba histolytica
FKLEVKIIRYFDNQEKTTL

SEQ ID NO: 2675506 - protein, 19 aa, Entamoeba histolytica
FKLFKKLKKVMDLGFKGPF

SEQ ID NO: 2675507 - protein, 27 aa, Entamoeba histolytica
FKLFLRELPTPIIPPIYYDKFVNEDVV

SEQ ID NO: 2675508 - protein, 24 aa, Entamoeba histolytica
FKLFRKKEAKVFSLIKSSMEKENN

SEQ ID NO: 2675509 - protein, 18 aa, Entamoeba histolytica
FKLHCYIAKDNEYSVRIR

SEQ ID NO: 2675510 - protein, 26 aa, Entamoeba histolytica
FKLKEIVQIFITRIIDTINLWPESYR

SEQ ID NO: 2675511 - protein, 21 aa, Entamoeba histolytica
FKLKLPISCTCFEDLSDSLTP

SEQ ID NO: 2675512 - protein, 17 aa, Entamoeba histolytica
FKLKYLNLANCFGINGD

SEQ ID NO: 2675513 - protein, 26 aa, Entamoeba histolytica
FKLLASSCVYFFLKEFIPIVQINLCL

SEQ ID NO: 2675514 - protein, 17 aa, Entamoeba histolytica
FKLLDRRDEVISVILDL

SEQ ID NO: 2675515 - protein, 17 aa, Entamoeba histolytica
FKLLFDHIRCHPLCSWV

SEQ ID NO: 2675516 - protein, 17 aa, Entamoeba histolytica
FKLLGEFHQLIYCDISE

SEQ ID NO: 2675517 - protein, 24 aa, Entamoeba histolytica
FKLLPKLILVDVINSFNNFEESEY

SEQ ID NO: 2675518 - protein, 19 aa, Entamoeba histolytica
FKLLVGRLPFELMQMDSFS

SEQ ID NO: 2675519 - protein, 19 aa, Entamoeba histolytica
FKLNITLRYYKGDKIESSQ

SEQ ID NO: 2675520 - protein, 17 aa, Entamoeba histolytica
FKLPDNYKIIIQTENIE

SEQ ID NO: 2675521 - protein, 25 aa, Entamoeba histolytica
FKLSLKRPIPLVGFCTYFEADISNH

SEQ ID NO: 2675522 - protein, 20 aa, Entamoeba histolytica
FKLTLCCLPIFELYGIFLLQ

SEQ ID NO: 2675523 - protein, 24 aa, Entamoeba histolytica
FKLTNHLYIIFSMNGESYYVHLLS

SEQ ID NO: 2675524 - protein, 21 aa, Entamoeba histolytica
FKLVSHFPSIIAYDANKIFII

SEQ ID NO: 2675525 - protein, 18 aa, Entamoeba histolytica
FKLYENPSRISISVNKHL

SEQ ID NO: 2675526 - protein, 20 aa, Entamoeba histolytica
FKMYCRDASGVICTIIADNY

SEQ ID NO: 2675527 - protein, 24 aa, Entamoeba histolytica
FKNEFKLKVLNFLTSLLDTNQTEE

SEQ ID NO: 2675528 - protein, 18 aa, Entamoeba histolytica
FKNEKGVIGEKEYINERN

SEQ ID NO: 2675529 - protein, 19 aa, Entamoeba histolytica
FKNGKWRKSILDALNHSAL

SEQ ID NO: 2675530 - protein, 18 aa, Entamoeba histolytica
FKNIGIKPPRGILLYGPP

SEQ ID NO: 2675531 - protein, 25 aa, Entamoeba histolytica
FKNIIRYVKIKGYGRGIQFNKEFEH

SEQ ID NO: 2675532 - protein, 33 aa, Entamoeba histolytica
FKNKLGLLPKLWRNEEMKEIPKLFIHSNQNYIL

SEQ ID NO: 2675533 - protein, 21 aa, Entamoeba histolytica
FKNKRFEAQTAISSNIQNVGN

SEQ ID NO: 2675534 - protein, 20 aa, Entamoeba histolytica
FKNKVPHDFSKKGVDYEIND

SEQ ID NO: 2675535 - protein, 22 aa, Entamoeba histolytica
FKNLQRRSTTCLNELDKQSQKE

SEQ ID NO: 2675536 - protein, 33 aa, Entamoeba histolytica
FKNNECKLFLTRLFELIHFPSLIISQHIISALQ

SEQ ID NO: 2675537 - protein, 31 aa, Entamoeba histolytica
FKNNLALVSCEVYGGGIWHTWIDRDLGISGR

SEQ ID NO: 2675538 - protein, 18 aa, Entamoeba histolytica
FKNPEEWINNLIESDELI

SEQ ID NO: 2675539 - protein, 19 aa, Entamoeba histolytica
FKNPKLWTTQLVDFVAQCL

SEQ ID NO: 2675540 - protein, 20 aa, Entamoeba histolytica
FKNPKLWTTQLVDFVAQCLV

SEQ ID NO: 2675541 - protein, 19 aa, Entamoeba histolytica
FKNSFSMIMGTVVSKEHNK

SEQ ID NO: 2675542 - protein, 20 aa, Entamoeba histolytica
FKNSKLILQHDILYPKKPKS

SEQ ID NO: 2675543 - protein, 20 aa, Entamoeba histolytica
FKNSLDLFKLHSLPSSSVSI

SEQ ID NO: 2675544 - protein, 21 aa, Entamoeba histolytica
FKNYKMLYSIPKYYHPKEKGI

SEQ ID NO: 2675545 - protein, 17 aa, Entamoeba histolytica
FKPFGHLVVKLQNKSEM

SEQ ID NO: 2675546 - protein, 28 aa, Entamoeba histolytica
FKPIETFPFFIPQRMNSYYHLRTFIETP

SEQ ID NO: 2675547 - protein, 19 aa, Entamoeba histolytica
FKPIIFEDSLHPGIVDFFS

SEQ ID NO: 2675548 - protein, 18 aa, Entamoeba histolytica
FKPIKCFSIDRVFRNETV

SEQ ID NO: 2675549 - protein, 17 aa, Entamoeba histolytica
FKPKILNIRNKTVKMQI

SEQ ID NO: 2675550 - protein, 19 aa, Entamoeba histolytica
FKPKPRVGPKGKLAKKEEE

SEQ ID NO: 2675551 - protein, 20 aa, Entamoeba histolytica
FKPNDLYSIYQMSLNVLGGR

SEQ ID NO: 2675552 - protein, 22 aa, Entamoeba histolytica
FKPNLKTSFPLTDEELQTIKPK

SEQ ID NO: 2675553 - protein, 25 aa, Entamoeba histolytica
FKPSIPEQQLEPFINYLFNISNQDN

SEQ ID NO: 2675554 - protein, 18 aa, Entamoeba histolytica
FKPTRRFLTAVKKSFPEE

SEQ ID NO: 2675555 - protein, 22 aa, Entamoeba histolytica
FKPVKFMVGRCPLSEVPCYNCP

SEQ ID NO: 2675556 - protein, 17 aa, Entamoeba histolytica
FKPYMDKIFENINPLTF

SEQ ID NO: 2675557 - protein, 17 aa, Entamoeba histolytica
FKQFLTRKLLNAERTAM

SEQ ID NO: 2675558 - protein, 22 aa, Entamoeba histolytica
FKQILSQDAFEFGKGVTSAIEN

SEQ ID NO: 2675559 - protein, 21 aa, Entamoeba histolytica
FKQIYWFEINVLTTINLINSQ

SEQ ID NO: 2675560 - protein, 21 aa, Entamoeba histolytica
FKQNGGFDWKTSLNRKKEWRV

SEQ ID NO: 2675561 - protein, 22 aa, Entamoeba histolytica
FKQRVSFEERKAFAIQLRQKKP

SEQ ID NO: 2675562 - protein, 17 aa, Entamoeba histolytica
FKQTITFFKSSILENRL

SEQ ID NO: 2675563 - protein, 18 aa, Entamoeba histolytica
FKQVYKLFEKCPYYEKYF

SEQ ID NO: 2675564 - protein, 18 aa, Entamoeba histolytica
FKQYGYKLGLTVRETCRF

SEQ ID NO: 2675565 - protein, 19 aa, Entamoeba histolytica
FKQYGYKLGLTVRETCRFN

SEQ ID NO: 2675566 - protein, 18 aa, Entamoeba histolytica
FKQYLPTIIPILLSELTK

SEQ ID NO: 2675567 - protein, 18 aa, Entamoeba histolytica
FKREEIRTTPLIQSVENL

SEQ ID NO: 2675568 - protein, 26 aa, Entamoeba histolytica
FKREFWSKEVLRLWDSFISFPKDKLY

SEQ ID NO: 2675569 - protein, 27 aa, Entamoeba histolytica
FKREYPEIKISYGLVKKVLEQQGLLPP

SEQ ID NO: 2675570 - protein, 22 aa, Entamoeba histolytica
FKRGDETAAMLLDRFHKYFAGN

SEQ ID NO: 2675571 - protein, 23 aa, Entamoeba histolytica
FKRKKYSVMVATNILSRGIDIES

SEQ ID NO: 2675572 - protein, 25 aa, Entamoeba histolytica
FKRLQWAHQSFWSRAFLVIYPQPFG

SEQ ID NO: 2675573 - protein, 23 aa, Entamoeba histolytica
FKRRTDICMRRAFTVDSDKTKIR

SEQ ID NO: 2675574 - protein, 19 aa, Entamoeba histolytica
FKRTLDIIQQYGLNKNSEL

SEQ ID NO: 2675575 - protein, 29 aa, Entamoeba histolytica
FKSCHCVECLYWLAPEVIETSTFELESDV

SEQ ID NO: 2675576 - protein, 26 aa, Entamoeba histolytica
FKSDCWSVGCVLYCLITGNFYKLSYN

SEQ ID NO: 2675577 - protein, 20 aa, Entamoeba histolytica
FKSDSWKYIGEIAKEASKTL

SEQ ID NO: 2675578 - protein, 18 aa, Entamoeba histolytica
FKSGRFIEDIDKLPTILT

SEQ ID NO: 2675579 - protein, 21 aa, Entamoeba histolytica
FKSIKQIIGRKIDVNLEDGFG

SEQ ID NO: 2675580 - protein, 19 aa, Entamoeba histolytica
FKSKCFNDGRIFEYNGVLR

SEQ ID NO: 2675581 - protein, 17 aa, Entamoeba histolytica
FKSKHLPFITVFQDPTF

SEQ ID NO: 2675582 - protein, 18 aa, Entamoeba histolytica
FKSKKGFVQKGVDDLVML

SEQ ID NO: 2675583 - protein, 20 aa, Entamoeba histolytica
FKSKKKPSFLKMKDISNEPQ

SEQ ID NO: 2675584 - protein, 17 aa, Entamoeba histolytica
FKSKREFEEDNNIYTEP

SEQ ID NO: 2675585 - protein, 24 aa, Entamoeba histolytica
FKSKYIEILGCLISSNSLMVKLEV

SEQ ID NO: 2675586 - protein, 26 aa, Entamoeba histolytica
FKSLDTWKKEFLNGANVTNPNDFPFV

SEQ ID NO: 2675587 - protein, 21 aa, Entamoeba histolytica
FKSNENYVLLLRNCIDENGLS

SEQ ID NO: 2675588 - protein, 30 aa, Entamoeba histolytica
FKSNGIKWVFWDVCGQAKFRGLWKSYYTNV

SEQ ID NO: 2675589 - protein, 17 aa, Entamoeba histolytica
FKSNTFLEGILLDNRLS

SEQ ID NO: 2675590 - protein, 20 aa, Entamoeba histolytica
FKSSDLLKQIEIFQEQLVKI

SEQ ID NO: 2675591 - protein, 20 aa, Entamoeba histolytica
FKSTLLGILVTNNLKEGLKI

SEQ ID NO: 2675592 - protein, 21 aa, Entamoeba histolytica
FKSYCAKGNIQLPKFDFNVVV

SEQ ID NO: 2675593 - protein, 28 aa, Entamoeba histolytica
FKTAEIMIWRPIELEMKSVEEIRNEKYD

SEQ ID NO: 2675594 - protein, 22 aa, Entamoeba histolytica
FKTFPKYFIMSVKLFEMGYYGC

SEQ ID NO: 2675595 - protein, 20 aa, Entamoeba histolytica
FKTGELNGQVIITAAFFSLD

SEQ ID NO: 2675596 - protein, 20 aa, Entamoeba histolytica
FKTGKWRKSILDALNHSLEV

SEQ ID NO: 2675597 - protein, 27 aa, Entamoeba histolytica
FKTIEGAIKCWKEIIKKRYDNRSLLVG

SEQ ID NO: 2675598 - protein, 25 aa, Entamoeba histolytica
FKTIEGFSLQYFLIINIHLKDTSNS

SEQ ID NO: 2675599 - protein, 21 aa, Entamoeba histolytica
FKTIFFLRFLFPALNSAEKYV

SEQ ID NO: 2675600 - protein, 23 aa, Entamoeba histolytica
FKTILEMCINCLLKMTTDSQALV

SEQ ID NO: 2675601 - protein, 25 aa, Entamoeba histolytica
FKTISCKVADFILKESINVKMQFII

SEQ ID NO: 2675602 - protein, 18 aa, Entamoeba histolytica
FKTISKFQLFNKVKINAS

SEQ ID NO: 2675603 - protein, 19 aa, Entamoeba histolytica
FKTKCFNDGRIFEYSGCLR

SEQ ID NO: 2675604 - protein, 22 aa, Entamoeba histolytica
FKTKIIYIALMVNWILKADETG

SEQ ID NO: 2675605 - protein, 29 aa, Entamoeba histolytica
FKTLKELIMRIPLKLGGGMKEEITNLTEI

SEQ ID NO: 2675606 - protein, 20 aa, Entamoeba histolytica
FKTLPVQVLLKLQQRKLDID

SEQ ID NO: 2675607 - protein, 27 aa, Entamoeba histolytica
FKTPEECTSKCCCFYVSLNHQQLPMKI

SEQ ID NO: 2675608 - protein, 27 aa, Entamoeba histolytica
FKTPRELQVWIWKEIFQETSPFSVVDF

SEQ ID NO: 2675609 - protein, 22 aa, Entamoeba histolytica
FKTSFRSSFCASLSNVYECIKD

SEQ ID NO: 2675610 - protein, 19 aa, Entamoeba histolytica
FKTSKEWISCLTNSDDLIL

SEQ ID NO: 2675611 - protein, 22 aa, Entamoeba histolytica
FKTSTIYIRNCFSIYNELSSYK

SEQ ID NO: 2675612 - protein, 24 aa, Entamoeba histolytica
FKVDVWSCGVLMYTLAVGRNPFEF

SEQ ID NO: 2675613 - protein, 28 aa, Entamoeba histolytica
FKVHDDIIRVCFLFNTMFIITKIKTFQG

SEQ ID NO: 2675614 - protein, 22 aa, Entamoeba histolytica
FKVIEGMIPFNMDQAIPLVALN

SEQ ID NO: 2675615 - protein, 19 aa, Entamoeba histolytica
FKVLIPKGKSVTFKPLQST

SEQ ID NO: 2675616 - protein, 18 aa, Entamoeba histolytica
FKVLMKKGRDELETSKGQ

SEQ ID NO: 2675617 - protein, 21 aa, Entamoeba histolytica
FKVNIDISDGLILFEDNQERC

SEQ ID NO: 2675618 - protein, 29 aa, Entamoeba histolytica
FKVNTPVDEKWGFAKPFFSNDEEFNDETI

SEQ ID NO: 2675619 - protein, 23 aa, Entamoeba histolytica
FKVRAFSPEIIFISFHCEICNFN

SEQ ID NO: 2675620 - protein, 20 aa, Entamoeba histolytica
FKVTQCLLDAVDIELERAKE

SEQ ID NO: 2675621 - protein, 21 aa, Entamoeba histolytica
FKYAKGNLFSFVLQDKDGAEI

SEQ ID NO: 2675622 - protein, 18 aa, Entamoeba histolytica
FKYCPKCGNNQFLVETFK

SEQ ID NO: 2675623 - protein, 19 aa, Entamoeba histolytica
FKYEKYREAIIMAIQDKSD

SEQ ID NO: 2675624 - protein, 21 aa, Entamoeba histolytica
FKYIIGEAFLIKNYPRIQTVI

SEQ ID NO: 2675625 - protein, 19 aa, Entamoeba histolytica
FKYLCQFLTNVGILIRYTY

SEQ ID NO: 2675626 - protein, 17 aa, Entamoeba histolytica
FKYLRDMGSDLYVKSMS

SEQ ID NO: 2675627 - protein, 20 aa, Entamoeba histolytica
FKYLSTHSFVSLTRKVASKT

SEQ ID NO: 2675628 - protein, 17 aa, Entamoeba histolytica
FKYLWPPMIALKEGQCI

SEQ ID NO: 2675629 - protein, 19 aa, Entamoeba histolytica
FKYPLDFASVTSMVPAKGS

SEQ ID NO: 2675630 - protein, 20 aa, Entamoeba histolytica
FKYQIKGVEDVKCIEDKIYI

SEQ ID NO: 2675631 - protein, 21 aa, Entamoeba histolytica
FKYSPYESFIFRSNLGNDISS

SEQ ID NO: 2675632 - protein, 25 aa, Entamoeba histolytica
FKYTIKALIFECIGKFLEFVDSKFP

SEQ ID NO: 2675633 - protein, 21 aa, Entamoeba histolytica
FKYVRVIGAFYLRLIGSSKEC

SEQ ID NO: 2675634 - protein, 37 aa, Entamoeba histolytica
FLAAGEKALLVPILFANAINWGSIFFIASNSDDEMAQ

SEQ ID NO: 2675635 - protein, 37 aa, Entamoeba histolytica
FLAAGEKALLVPILVANAINWGSIFFIASNSDDEMAQ

SEQ ID NO: 2675636 - protein, 19 aa, Entamoeba histolytica
FLAESIAKFLSLGPIHTRK

SEQ ID NO: 2675637 - protein, 18 aa, Entamoeba histolytica
FLAIAGFGNLPGDVEIYD

SEQ ID NO: 2675638 - protein, 17 aa, Entamoeba histolytica
FLAKYGIINIVKKGKMI

SEQ ID NO: 2675639 - protein, 19 aa, Entamoeba histolytica
FLAPELFFNPEIFSSDFTT

SEQ ID NO: 2675640 - protein, 17 aa, Entamoeba histolytica
FLAQYGIIGIVKKGHNI

SEQ ID NO: 2675641 - protein, 18 aa, Entamoeba histolytica
FLARNGCFMKYVNTTENH

SEQ ID NO: 2675642 - protein, 18 aa, Entamoeba histolytica
FLAVAGFGNCPGEVDVYE

SEQ ID NO: 2675643 - protein, 20 aa, Entamoeba histolytica
FLCGGWKKNRLSGTSKPSDD

SEQ ID NO: 2675644 - protein, 17 aa, Entamoeba histolytica
FLCSHCLKSQSKINKQS

SEQ ID NO: 2675645 - protein, 17 aa, Entamoeba histolytica
FLCSHCLKSQSKINKRL

SEQ ID NO: 2675646 - protein, 18 aa, Entamoeba histolytica
FLDAKLFKDFNLKQSLDE

SEQ ID NO: 2675647 - protein, 18 aa, Entamoeba histolytica
FLDCGYTSMQGWRRTMED

SEQ ID NO: 2675648 - protein, 17 aa, Entamoeba histolytica
FLDEIYIGTVSLSNVQQ

SEQ ID NO: 2675649 - protein, 27 aa, Entamoeba histolytica
FLDLHPSLDYPTLHLIIYNVPKIFDKS

SEQ ID NO: 2675650 - protein, 20 aa, Entamoeba histolytica
FLDVPFKVIIKVEYLNSFDL

SEQ ID NO: 2675651 - protein, 21 aa, Entamoeba histolytica
FLEDRMEVLNNLPLYFSPTTF

SEQ ID NO: 2675652 - protein, 17 aa, Entamoeba histolytica
FLEEDYSKLMFLLTDKT

SEQ ID NO: 2675653 - protein, 20 aa, Entamoeba histolytica
FLEEFKRRGGIICICSHGLK

SEQ ID NO: 2675654 - protein, 22 aa, Entamoeba histolytica
FLEGKTFYGICIQRNPLQFIGF

SEQ ID NO: 2675655 - protein, 17 aa, Entamoeba histolytica
FLEISSQVIEQIEESIS

SEQ ID NO: 2675656 - protein, 25 aa, Entamoeba histolytica
FLEKGYSIFTNWVVSFYSFIISNIN

SEQ ID NO: 2675657 - protein, 23 aa, Entamoeba histolytica
FLEMKMARLRTDFDDSINKFCSF

SEQ ID NO: 2675658 - protein, 19 aa, Entamoeba histolytica
FLFCSYLSNRFSEFNEKII

SEQ ID NO: 2675659 - protein, 17 aa, Entamoeba histolytica
FLFMSRGTTYASSLAIM

SEQ ID NO: 2675660 - protein, 22 aa, Entamoeba histolytica
FLGCGFKFLSLPSTIVKLGVGC

SEQ ID NO: 2675661 - protein, 17 aa, Entamoeba histolytica
FLGDIALGLRYLHFTKG

SEQ ID NO: 2675662 - protein, 25 aa, Entamoeba histolytica
FLGEGWRPLYQRTFTTFAKLWKLQQ

SEQ ID NO: 2675663 - protein, 17 aa, Entamoeba histolytica
FLGPSGVGKTELAKALA

SEQ ID NO: 2675664 - protein, 19 aa, Entamoeba histolytica
FLHDKHLKHFGLLQLIMFL

SEQ ID NO: 2675665 - protein, 30 aa, Entamoeba histolytica
FLHEGKVYVLREFRCCFILYYGDSTIVSKR

SEQ ID NO: 2675666 - protein, 18 aa, Entamoeba histolytica
FLHESPWERLRLLRKRIP

SEQ ID NO: 2675667 - protein, 22 aa, Entamoeba histolytica
FLHLPLYLNRIYELRKDHSKTI

SEQ ID NO: 2675668 - protein, 17 aa, Entamoeba histolytica
FLIDCLREFNYQFDSKY

SEQ ID NO: 2675669 - protein, 22 aa, Entamoeba histolytica
FLIDGCDIIGTFGFTSFNACCL

SEQ ID NO: 2675670 - protein, 20 aa, Entamoeba histolytica
FLIECYLEYSKLPGEDELNA

SEQ ID NO: 2675671 - protein, 19 aa, Entamoeba histolytica
FLIEDFIRQFVKVISQNQL

SEQ ID NO: 2675672 - protein, 27 aa, Entamoeba histolytica
FLIEGKFNCCWKVTVKDIRIIVWQMKE

SEQ ID NO: 2675673 - protein, 18 aa, Entamoeba histolytica
FLIFIYGYDLHEVVNAPQ

SEQ ID NO: 2675674 - protein, 19 aa, Entamoeba histolytica
FLIIGYDLSQPFSLTPKYD

SEQ ID NO: 2675675 - protein, 26 aa, Entamoeba histolytica
FLIMKRKRIEINKVLHEVASRYMKEY

SEQ ID NO: 2675676 - protein, 24 aa, Entamoeba histolytica
FLITKELTYLVACESMEDKSKYMN

SEQ ID NO: 2675677 - protein, 17 aa, Entamoeba histolytica
FLIVYSIVDEKTFETAK

SEQ ID NO: 2675678 - protein, 24 aa, Entamoeba histolytica
FLKCVSTIHPRCIYTSGKASSAAG

SEQ ID NO: 2675679 - protein, 17 aa, Entamoeba histolytica
FLKEAGKKIDLGVVSGS

SEQ ID NO: 2675680 - protein, 17 aa, Entamoeba histolytica
FLKECSECLTTNFHFKK

SEQ ID NO: 2675681 - protein, 17 aa, Entamoeba histolytica
FLKKFFYTMREPSYIDW

SEQ ID NO: 2675682 - protein, 18 aa, Entamoeba histolytica
FLKQKGLKVAIATSSAKT

SEQ ID NO: 2675683 - protein, 19 aa, Entamoeba histolytica
FLKRNGIELLCRAHQVVEE

SEQ ID NO: 2675684 - protein, 19 aa, Entamoeba histolytica
FLKTGVEKLVLPALHVIGQ

SEQ ID NO: 2675685 - protein, 18 aa, Entamoeba histolytica
FLKVNLWNFDYCDSCYNL

SEQ ID NO: 2675686 - protein, 21 aa, Entamoeba histolytica
FLLESFLKLYQPINLRIDCMN

SEQ ID NO: 2675687 - protein, 21 aa, Entamoeba histolytica
FLLHRLNTLSSLPFVEDPLTL

SEQ ID NO: 2675688 - protein, 24 aa, Entamoeba histolytica
FLLIKEYIKSLFINTALHSEELIN

SEQ ID NO: 2675689 - protein, 32 aa, Entamoeba histolytica; identical to SEQ ID NO: 2481879

SEQ ID NO: 2675690 - protein, 19 aa, Entamoeba histolytica
FLLKREINGSVVVKISDYG

SEQ ID NO: 2675691 - protein, 20 aa, Entamoeba histolytica
FLLNIAFYFETVQDLITLSF

SEQ ID NO: 2675692 - protein, 19 aa, Entamoeba histolytica
FLLNISRIRLDIMPFAMKR

SEQ ID NO: 2675693 - protein, 17 aa, Entamoeba histolytica
FLLPICSTNDPTYNIII

SEQ ID NO: 2675694 - protein, 19 aa, Entamoeba histolytica
FLLSNVKYYAEEFGFDGFR

SEQ ID NO: 2675695 - protein, 23 aa, Entamoeba histolytica
FLLSTRAGGLGINLTTADTVIIY

SEQ ID NO: 2675696 - protein, 21 aa, Entamoeba histolytica
FLLSTRSGGLGINLQSADTVI

SEQ ID NO: 2675697 - protein, 17 aa, Entamoeba histolytica
FLMAGLLSQPIMKLNKL

SEQ ID NO: 2675698 - protein, 21 aa, Entamoeba histolytica
FLMGCKAKLFGDDQIFKLILD

SEQ ID NO: 2675699 - protein, 20 aa, Entamoeba histolytica
FLMNGLKDSLSMFRGTYGQL

SEQ ID NO: 2675700 - protein, 21 aa, Entamoeba histolytica
FLMNIKEVFFQKECKDYKGYI

SEQ ID NO: 2675701 - protein, 17 aa, Entamoeba histolytica
FLMPKSKALALVEFEVA

SEQ ID NO: 2675702 - protein, 23 aa, Entamoeba histolytica
FLMQYPTRLAWRPFDLSQVKEVR

SEQ ID NO: 2675703 - protein, 26 aa, Entamoeba histolytica
FLNAELKPGIELILDLFQFDQIIEDA

SEQ ID NO: 2675704 - protein, 17 aa, Entamoeba histolytica
FLNCSSLKSIELPTSLL

SEQ ID NO: 2675705 - protein, 20 aa, Entamoeba histolytica
FLNGGGCMHCSGQINQHTTS

SEQ ID NO: 2675706 - protein, 24 aa, Entamoeba histolytica
FLNIPCTPFLISEPLNSYIATKPF

SEQ ID NO: 2675707 - protein, 18 aa, Entamoeba histolytica
FLNIVYITCFLKEQDEQF

SEQ ID NO: 2675708 - protein, 18 aa, Entamoeba histolytica
FLNKCLNPDASKRASAEE

SEQ ID NO: 2675709 - protein, 22 aa, Entamoeba histolytica
FLNKGPLQFCCVSNTKEQPEII

SEQ ID NO: 2675710 - protein, 20 aa, Entamoeba histolytica
FLNKILFKLNLNKQSKTFDA

SEQ ID NO: 2675711 - protein, 20 aa, Entamoeba histolytica
FLNKILVKPWIYRDIYDRAR

SEQ ID NO: 2675712 - protein, 18 aa, Entamoeba histolytica
FLNNKYLFQFSRLTDEVH

SEQ ID NO: 2675713 - protein, 19 aa, Entamoeba histolytica
FLNPPLILQRCMTLTNREL

SEQ ID NO: 2675714 - protein, 20 aa, Entamoeba histolytica
FLPDPRKSDIIRIGNISLQR

SEQ ID NO: 2675715 - protein, 17 aa, Entamoeba histolytica
FLPHGGYITESGSLNVT

SEQ ID NO: 2675716 - protein, 17 aa, Entamoeba histolytica
FLPMIGINNLKFIIKST

SEQ ID NO: 2675717 - protein, 21 aa, Entamoeba histolytica
FLPNEIMTLPIPLSESGSLQL

SEQ ID NO: 2675718 - protein, 24 aa, Entamoeba histolytica
FLPNEITKLLPHVEHNLRNISKGL

SEQ ID NO: 2675719 - protein, 25 aa, Entamoeba histolytica
FLPRRIGDDLIDLVGACHFVLDDYQ

SEQ ID NO: 2675720 - protein, 17 aa, Entamoeba histolytica
FLQFVYRSFEGSKKPIL

SEQ ID NO: 2675721 - protein, 23 aa, Entamoeba histolytica
FLQIKGETFINGKLSKLVKKNDC

SEQ ID NO: 2675722 - protein, 30 aa, Entamoeba histolytica
FLQKHICNNVCFKLKLNGIDTFEADEEAET

SEQ ID NO: 2675723 - protein, 17 aa, Entamoeba histolytica
FLQKKLDKIINLKKLIT

SEQ ID NO: 2675724 - protein, 19 aa, Entamoeba histolytica
FLQKMPIHIIDTMKSLEMI

SEQ ID NO: 2675725 - protein, 32 aa, Entamoeba histolytica
FLQPECPWKQLKKLALRNCGITKIPPKVFNQT

SEQ ID NO: 2675726 - protein, 21 aa, Entamoeba histolytica
FLQRSSMLLSIFNSNMERSMI

SEQ ID NO: 2675727 - protein, 25 aa, Entamoeba histolytica
FLQSLEIPKPADFIFTDYEGGLLAR

SEQ ID NO: 2675728 - protein, 22 aa, Entamoeba histolytica
FLQTKLIQLLGILGHDDKANSS

SEQ ID NO: 2675729 - protein, 26 aa, Entamoeba histolytica
FLQYPPRIVQSLKRHFADLCKEPLEE

SEQ ID NO: 2675730 - protein, 18 aa, Entamoeba histolytica
FLRCLKSFGRLESVEEVG

SEQ ID NO: 2675731 - protein, 18 aa, Entamoeba histolytica
FLRCYCAEFVKGKMAPEC

SEQ ID NO: 2675732 - protein, 22 aa, Entamoeba histolytica
FLRETYESYLLRISDENGVADD

SEQ ID NO: 2675733 - protein, 19 aa, Entamoeba histolytica
FLRGKQCINPDCTYLHQLV

SEQ ID NO: 2675734 - protein, 23 aa, Entamoeba histolytica
FLRKGIYTCQALVMKSETISKEF

SEQ ID NO: 2675735 - protein, 21 aa, Entamoeba histolytica
FLRKPRFIIQSLLRPYIQKCN

SEQ ID NO: 2675736 - protein, 20 aa, Entamoeba histolytica
FLRVICPSLAAPEASGIEMT

SEQ ID NO: 2675737 - protein, 25 aa, Entamoeba histolytica
FLRYRNLCSVQHLLEQIHSCSNLLE

SEQ ID NO: 2675738 - protein, 17 aa, Entamoeba histolytica
FLSAFIFSVHLNDKNLI

SEQ ID NO: 2675739 - protein, 18 aa, Entamoeba histolytica
FLSCELLENIFLPNIQLI

SEQ ID NO: 2675740 - protein, 24 aa, Entamoeba histolytica
FLSKADLLGGYGFNVKLEDVINGN

SEQ ID NO: 2675741 - protein, 24 aa, Entamoeba histolytica
  misc_feature (19)..(24): Xaa can be any naturally occurring amino acid
FLSKADLLGGYGFNVKLEXXXXXX

SEQ ID NO: 2675742 - protein, 23 aa, Entamoeba histolytica
FLSKVCGLNNLLIIVTTPSDECF

SEQ ID NO: 2675743 - protein, 23 aa, Entamoeba histolytica
FLSMFKRKAFLHLYTEEGMEESE

SEQ ID NO: 2675744 - protein, 18 aa, Entamoeba histolytica
FLSNCLVKTPQVRPSAYT

SEQ ID NO: 2675745 - protein, 17 aa, Entamoeba histolytica
FLSNFIIIKDYAIYCVQ

SEQ ID NO: 2675746 - protein, 28 aa, Entamoeba histolytica
FLSSSGCFKHWFESGAYEMKILFDTQEK

SEQ ID NO: 2675747 - protein, 23 aa, Entamoeba histolytica
FLSSSKFTILLNRELLNNLVSMA

SEQ ID NO: 2675748 - protein, 17 aa, Entamoeba histolytica
FLSTFIVKSQKEGTYKE

SEQ ID NO: 2675749 - protein, 18 aa, Entamoeba histolytica
FLTKESFYKFGRNVCELI

SEQ ID NO: 2675750 - protein, 20 aa, Entamoeba histolytica
FLTKEVQNECLIIKEKLNEI

SEQ ID NO: 2675751 - protein, 18 aa, Entamoeba histolytica
FLTRLFLINNEIIKKRIL

SEQ ID NO: 2675752 - protein, 17 aa, Entamoeba histolytica
FLTYFLRNGGVIFTSYI

SEQ ID NO: 2675753 - protein, 19 aa, Entamoeba histolytica
FLVAQGLGDIVLLGEKGKL

SEQ ID NO: 2675754 - protein, 19 aa, Entamoeba histolytica
FLVDLICSFIKKYKHFGNI

SEQ ID NO: 2675755 - protein, 18 aa, Entamoeba histolytica
FLVELDCQNNQGILELPP

SEQ ID NO: 2675756 - protein, 29 aa, Entamoeba histolytica
FLVLYRYYLRHVPKNIAKLCSIGMTDEIE

SEQ ID NO: 2675757 - protein, 17 aa, Entamoeba histolytica
FLWTFILNNDTEYDETR

SEQ ID NO: 2675758 - protein, 24 aa, Entamoeba histolytica
FLYCNHLCIVFELLGTNLYQMLQK

SEQ ID NO: 2675759 - protein, 18 aa, Entamoeba histolytica
FLYQRYPTVFPNDYIYYV

SEQ ID NO: 2675760 - protein, 19 aa, Entamoeba histolytica
FLYSGYWGNIIARLDNEMK

SEQ ID NO: 2675761 - protein, 17 aa, Entamoeba histolytica
FLYYSGCIALYNRDLQE

SEQ ID NO: 2675762 - protein, 20 aa, Entamoeba histolytica
FMANLRLEKIGFVFQTYNLL

SEQ ID NO: 2675763 - protein, 22 aa, Entamoeba histolytica
FMANLRLEKIGFVFQTYNLLST

SEQ ID NO: 2675764 - protein, 17 aa, Entamoeba histolytica
FMCFSENFVQKGNYFAA

SEQ ID NO: 2675765 - protein, 24 aa, Entamoeba histolytica
FMELFKRAIRSMAMGHVVTLKSFD

SEQ ID NO: 2675766 - protein, 24 aa, Entamoeba histolytica
FMEPSPKMLLFYRALKLDDMNYNE

SEQ ID NO: 2675767 - protein, 18 aa, Entamoeba histolytica
FMEVIGLFDGHHGQDAAI

SEQ ID NO: 2675768 - protein, 20 aa, Entamoeba histolytica
FMFTLSVFGACFYDGIRSDT

SEQ ID NO: 2675769 - protein, 26 aa, Entamoeba histolytica
FMIDGAKGISCLHLNGILHRDIKPDN

SEQ ID NO: 2675770 - protein, 19 aa, Entamoeba histolytica
FMIEIKPSPQFVIEGDIVY

SEQ ID NO: 2675771 - protein, 19 aa, Entamoeba histolytica
FMIKRLIKTILNPQVKTEA

SEQ ID NO: 2675772 - protein, 24 aa, Entamoeba histolytica
FMKTKEAWQVIPLLLTSEPTVAFY

SEQ ID NO: 2675773 - protein, 24 aa, Entamoeba histolytica
FMKTSSCMSICLSATKDIIFTGHV

SEQ ID NO: 2675774 - protein, 17 aa, Entamoeba histolytica
FMLSEKLKKLEMEECSG

SEQ ID NO: 2675775 - protein, 27 aa, Entamoeba histolytica
FMMDSFECTRAIYSCISINGEDVIPIV

SEQ ID NO: 2675776 - protein, 18 aa, Entamoeba histolytica
FMMKFFFKPAEKVSDEIE

SEQ ID NO: 2675777 - protein, 18 aa, Entamoeba histolytica
FMMLLWDVLEKELPEEEF

SEQ ID NO: 2675778 - protein, 35 aa, Entamoeba histolytica
FMNPEMNRFIFLLCTRAGGFGINLSEADTVIIFDS

SEQ ID NO: 2675779 - protein, 26 aa, Entamoeba histolytica
FMPEGFKTRSAFCLETQHFPDSPHHP

SEQ ID NO: 2675780 - protein, 18 aa, Entamoeba histolytica
FMPERRILEHIILSKEWN

SEQ ID NO: 2675781 - protein, 17 aa, Entamoeba histolytica
FMQFLVLRIFTAKPEIK

SEQ ID NO: 2675782 - protein, 24 aa, Entamoeba histolytica
FMRDLPEPIFPSSAYKEIIEATRE

SEQ ID NO: 2675783 - protein, 17 aa, Entamoeba histolytica
FMRYFLYNSLNSCDPLY

SEQ ID NO: 2675784 - protein, 19 aa, Entamoeba histolytica
FMSLISFILSSQFKMETPD

SEQ ID NO: 2675785 - protein, 22 aa, Entamoeba histolytica
FMSMCPDEIDFLGLEENDKTTF

SEQ ID NO: 2675786 - protein, 20 aa, Entamoeba histolytica
FMSSCKAVKFYSDLLNYIDI

SEQ ID NO: 2675787 - protein, 19 aa, Entamoeba histolytica
FMVDSGLVGCSWVKVPAKR

SEQ ID NO: 2675788 - protein, 32 aa, Entamoeba histolytica; identical to SEQ ID NO: 2481993

SEQ ID NO: 2675789 - protein, 17 aa, Entamoeba histolytica
FMYQVLLKVGSDEENAR

SEQ ID NO: 2675790 - protein, 17 aa, Entamoeba histolytica
FNAALKKTFKFTETGEM

SEQ ID NO: 2675791 - protein, 21 aa, Entamoeba histolytica
FNASCSLSMYYSDYYSYQQGF

SEQ ID NO: 2675792 - protein, 30 aa, Entamoeba histolytica
FNCGHCCYCYCCSKTLGLTFKCPKCNKISV

SEQ ID NO: 2675793 - protein, 17 aa, Entamoeba histolytica
FNCMRLSKINLVTSLKE

SEQ ID NO: 2675794 - protein, 17 aa, Entamoeba histolytica
FNCVEPINPRPESLWNI

SEQ ID NO: 2675795 - protein, 27 aa, Entamoeba histolytica
FNCYATECPICGEHSVNLIEYPYTSTR

SEQ ID NO: 2675796 - protein, 24 aa, Entamoeba histolytica
FNDEFKLELPFPLNENYQLIFNVQ

SEQ ID NO: 2675797 - protein, 22 aa, Entamoeba histolytica
FNDFFYALSVILPRSTIGSFKQ

SEQ ID NO: 2675798 - protein, 23 aa, Entamoeba histolytica
FNDGKAILALCHAYTRLTGENGF

SEQ ID NO: 2675799 - protein, 21 aa, Entamoeba histolytica
FNDHPIRVVLSNKVIKSKNEH

SEQ ID NO: 2675800 - protein, 42 aa, Entamoeba histolytica
FNDLVQFRIKECLRKLIVGKKFEAKECYKRSFTKEDKTIEEV

SEQ ID NO: 2675801 - protein, 17 aa, Entamoeba histolytica
FNDMLMYGIGDERKLSV

SEQ ID NO: 2675802 - protein, 22 aa, Entamoeba histolytica
FNDYLLPIFPLSSIQKGKLLHG

SEQ ID NO: 2675803 - protein, 21 aa, Entamoeba histolytica
FNEAFLRLVLGLTNQLENLDY

SEQ ID NO: 2675804 - protein, 18 aa, Entamoeba histolytica
FNEIKGGYECFVRLNEFS

SEQ ID NO: 2675805 - protein, 23 aa, Entamoeba histolytica
FNEILCVSLSHFLLKKVVDCNTA

SEQ ID NO: 2675806 - protein, 25 aa, Entamoeba histolytica
FNEISEPFLFLGIGMKDGCCYGYKV

SEQ ID NO: 2675807 - protein, 17 aa, Entamoeba histolytica
FNEKKMHSLAVILETPQ

SEQ ID NO: 2675808 - protein, 17 aa, Entamoeba histolytica
FNEKLTLFNEGKGTKIV

SEQ ID NO: 2675809 - protein, 17 aa, Entamoeba histolytica
FNEKQMEMCINKIQIQY

SEQ ID NO: 2675810 - protein, 19 aa, Entamoeba histolytica
FNELFPRYADPINQQKVPR

SEQ ID NO: 2675811 - protein, 18 aa, Entamoeba histolytica
FNELLLFTRDYFRIKNIP

SEQ ID NO: 2675812 - protein, 25 aa, Entamoeba histolytica
FNELNIPCPKVFYCNNLDIVMEYID

SEQ ID NO: 2675813 - protein, 21 aa, Entamoeba histolytica
FNELPCVVHEILLFLYHSLLF

SEQ ID NO: 2675814 - protein, 19 aa, Entamoeba histolytica
FNENIELLIEFIIGNESLA

SEQ ID NO: 2675815 - protein, 17 aa, Entamoeba histolytica
FNENILVPFGLESSLSG

SEQ ID NO: 2675816 - protein, 19 aa, Entamoeba histolytica
FNEPMCIAIDSFDNVYVAD

SEQ ID NO: 2675817 - protein, 18 aa, Entamoeba histolytica
FNEPMMRNCVGISHFFVF

SEQ ID NO: 2675818 - protein, 22 aa, Entamoeba histolytica
FNEQAINRVVPWFETTFVPNWV

SEQ ID NO: 2675819 - protein, 23 aa, Entamoeba histolytica
FNESRISVGLTITYSMEGMLGNL

SEQ ID NO: 2675820 - protein, 23 aa, Entamoeba histolytica
FNFEIVYHVAPLLPYYNGEEQLE

SEQ ID NO: 2675821 - protein, 21 aa, Entamoeba histolytica
FNFNLRLTYDHFIKSHKTELT

SEQ ID NO: 2675822 - protein, 24 aa, Entamoeba histolytica
FNFPEMDLSPFILKLSNDLLLHNI

SEQ ID NO: 2675823 - protein, 20 aa, Entamoeba histolytica
FNFVMAYRELRIEGTSDAEW

SEQ ID NO: 2675824 - protein, 25 aa, Entamoeba histolytica
FNFYDLKPLDRWTAIVPSQCMSEFN

SEQ ID NO: 2675825 - protein, 18 aa, Entamoeba histolytica
FNFYHSLNPNGLYEKVEI

SEQ ID NO: 2675826 - protein, 17 aa, Entamoeba histolytica
FNGKGIVTGGYRGEGII

SEQ ID NO: 2675827 - protein, 17 aa, Entamoeba histolytica
FNGKSEYMTVCDNEFYQ

SEQ ID NO: 2675828 - protein, 17 aa, Entamoeba histolytica
FNGKSQYKTVCDNEFYQ

SEQ ID NO: 2675829 - protein, 27 aa, Entamoeba histolytica
FNGRKFGIPLLIGFPYDYPLSPPEIIC

SEQ ID NO: 2675830 - protein, 23 aa, Entamoeba histolytica
FNGTRIGKNEVMVVTKRMNVAGF

SEQ ID NO: 2675831 - protein, 23 aa, Entamoeba histolytica
FNHCKHHSPTLIIREGILERAFG

SEQ ID NO: 2675832 - protein, 24 aa, Entamoeba histolytica
FNHKHLLLPYCESFIKNVLNQFKI

SEQ ID NO: 2675833 - protein, 19 aa, Entamoeba histolytica
FNHLASLYFIDKKKEGYFN

SEQ ID NO: 2675834 - protein, 22 aa, Entamoeba histolytica
FNHLQMKYEPLIKEFPIQTKVF

SEQ ID NO: 2675835 - protein, 20 aa, Entamoeba histolytica
FNHLSCISLILEQEKQQVNQ

SEQ ID NO: 2675836 - protein, 27 aa, Entamoeba histolytica
FNHNCTIFRQIAFDIISFIINQSVEPL

SEQ ID NO: 2675837 - protein, 20 aa, Entamoeba histolytica
FNIAMGKLVLGIYLMGKKII

SEQ ID NO: 2675838 - protein, 17 aa, Entamoeba histolytica
FNIATAVSKEQALPIMP

SEQ ID NO: 2675839 - protein, 19 aa, Entamoeba histolytica
FNIEYDAFCSDVLPFIEIL

SEQ ID NO: 2675840 - protein, 23 aa, Entamoeba histolytica
FNIKKGESLIIYDTYFIPRQEIV

SEQ ID NO: 2675841 - protein, 17 aa, Entamoeba histolytica
FNIPFPPIVGRAYRPSV

SEQ ID NO: 2675842 - protein, 20 aa, Entamoeba histolytica
FNIQTYRCFINFLIDAKNNC

SEQ ID NO: 2675843 - protein, 18 aa, Entamoeba histolytica
FNKCISFDTVIQLNQLSI

SEQ ID NO: 2675844 - protein, 24 aa, Entamoeba histolytica
FNKELKSLIAGAGIKDIPFIDKNE

SEQ ID NO: 2675845 - protein, 21 aa, Entamoeba histolytica
FNKESYFSLVLDKLQMIVNSK

SEQ ID NO: 2675846 - protein, 19 aa, Entamoeba histolytica
FNKGIAVVREILCDLYNGR

SEQ ID NO: 2675847 - protein, 19 aa, Entamoeba histolytica
FNKHCDLLSIAIIPFKFLS

SEQ ID NO: 2675848 - protein, 25 aa, Entamoeba histolytica
FNKKEGEPCILLLLDRSIDGYTPLY

SEQ ID NO: 2675849 - protein, 18 aa, Entamoeba histolytica
FNKKFLMRFTQTQHFNTW

SEQ ID NO: 2675850 - protein, 17 aa, Entamoeba histolytica
FNKKNWLREGLKRLESI

SEQ ID NO: 2675851 - protein, 20 aa, Entamoeba histolytica
FNKLPQWISLLLQDDSYKEI

SEQ ID NO: 2675852 - protein, 26 aa, Entamoeba histolytica
FNKLYHCIVALGHLHIVKFLVSTFPN

SEQ ID NO: 2675853 - protein, 17 aa, Entamoeba histolytica
FNKNALCLKRVIKEFTD

SEQ ID NO: 2675854 - protein, 20 aa, Entamoeba histolytica
FNKTLFYDGFIFKTYKMSQL

SEQ ID NO: 2675855 - protein, 24 aa, Entamoeba histolytica
FNKTQCIFIIDYLMKERILSCFNY

SEQ ID NO: 2675856 - protein, 19 aa, Entamoeba histolytica
FNLSLKLLQPFDLIKIKEY

SEQ ID NO: 2675857 - protein, 18 aa, Entamoeba histolytica
FNLTGLFGSSTPSTLLQK

SEQ ID NO: 2675858 - protein, 17 aa, Entamoeba histolytica
FNLVILKHIEIIDEIYE

SEQ ID NO: 2675859 - protein, 17 aa, Entamoeba histolytica
FNLVILKHIEVIEELYE

SEQ ID NO: 2675860 - protein, 19 aa, Entamoeba histolytica
FNMMDYGIRMRQLINGEFF

SEQ ID NO: 2675861 - protein, 17 aa, Entamoeba histolytica
FNNCLRLSEVSFYSPIQ

SEQ ID NO: 2675862 - protein, 18 aa, Entamoeba histolytica
FNNDFPFQVGMTTSIEPG

SEQ ID NO: 2675863 - protein, 18 aa, Entamoeba histolytica
FNNEINWFLKKSIPQRIL

SEQ ID NO: 2675864 - protein, 20 aa, Entamoeba histolytica
FNNGLYLPACEYALKTQNPQ

SEQ ID NO: 2675865 - protein, 24 aa, Entamoeba histolytica
FNNSKELFNQLGIIRTNCIDCLDR

SEQ ID NO: 2675866 - protein, 18 aa, Entamoeba histolytica
FNNYRDWLLQYIKGEISI

SEQ ID NO: 2675867 - protein, 21 aa, Entamoeba histolytica
FNPENAIIIPIDYTLNEEWES

SEQ ID NO: 2675868 - protein, 23 aa, Entamoeba histolytica
FNPKRILLVGGVLRSEEQLTVMQ

SEQ ID NO: 2675869 - protein, 17 aa, Entamoeba histolytica
FNPQLCAMNCSGISQMI

SEQ ID NO: 2675870 - protein, 24 aa, Entamoeba histolytica
FNPSRHLSEVFTIFSAPNYCDYYK

SEQ ID NO: 2675871 - protein, 23 aa, Entamoeba histolytica
FNQTHFPKLEWLDLSYNSISVLE

SEQ ID NO: 2675872 - protein, 19 aa, Entamoeba histolytica
FNREFPSHRKLNLDGKKIL

SEQ ID NO: 2675873 - protein, 20 aa, Entamoeba histolytica
FNREICLLAAKSIEQSITDI

SEQ ID NO: 2675874 - protein, 17 aa, Entamoeba histolytica
FNREILILQDLRDGPNI

SEQ ID NO: 2675875 - protein, 17 aa, Entamoeba histolytica
FNRKGNDSGGSWELNPT

SEQ ID NO: 2675876 - protein, 21 aa, Entamoeba histolytica
FNRKKKFRMISIDGGGIKCIL

SEQ ID NO: 2675877 - protein, 22 aa, Entamoeba histolytica
FNRVFMCSFPYFTNSKTVLQKL

SEQ ID NO: 2675878 - protein, 17 aa, Entamoeba histolytica
FNSAFGIFDGLLHISIV

SEQ ID NO: 2675879 - protein, 24 aa, Entamoeba histolytica
FNSIKLKYILPQSLIRLIQLDISI

SEQ ID NO: 2675880 - protein, 25 aa, Entamoeba histolytica
FNSLLLKHLLALCGKIAQTSSSKMD

SEQ ID NO: 2675881 - protein, 17 aa, Entamoeba histolytica
FNSLRNIPPTIIELPQL

SEQ ID NO: 2675882 - protein, 18 aa, Entamoeba histolytica
FNSMTWEPPCELLDCGTN

SEQ ID NO: 2675883 - protein, 20 aa, Entamoeba histolytica
FNSQCPLRQIPGVPDDICKR

SEQ ID NO: 2675884 - protein, 18 aa, Entamoeba histolytica
FNSVETFLLLVALKVKYP

SEQ ID NO: 2675885 - protein, 18 aa, Entamoeba histolytica
FNSVKEMIQDATSTSGFT

SEQ ID NO: 2675886 - protein, 26 aa, Entamoeba histolytica
FNSVRGCSYCYGFAAVRRFLIKNDLV

SEQ ID NO: 2675887 - protein, 17 aa, Entamoeba histolytica
FNTEVPEGISIKNIHDS

SEQ ID NO: 2675888 - protein, 26 aa, Entamoeba histolytica
FNTHKIIPIFVFDGATLPSKKGVEEE

SEQ ID NO: 2675889 - protein, 17 aa, Entamoeba histolytica
FNTISFSYNSQFLAIAG

SEQ ID NO: 2675890 - protein, 17 aa, Entamoeba histolytica
FNTKFRILNEVMGRSRT

SEQ ID NO: 2675891 - protein, 18 aa, Entamoeba histolytica
FNTLISIIVFRYDDKESF

SEQ ID NO: 2675892 - protein, 20 aa, Entamoeba histolytica
FNTLQFPAAVHFCVTEKTIG

SEQ ID NO: 2675893 - protein, 22 aa, Entamoeba histolytica
FNTLRCCKICGLIKSQEQFQRD

SEQ ID NO: 2675894 - protein, 24 aa, Entamoeba histolytica
FNTNCGPIRFEVWDTAGQEKFGGL

SEQ ID NO: 2675895 - protein, 23 aa, Entamoeba histolytica
FNTNELYYIWDILFAHNNPLSLL

SEQ ID NO: 2675896 - protein, 17 aa, Entamoeba histolytica
FNTSSSGGFGFNQNQQN

SEQ ID NO: 2675897 - protein, 18 aa, Entamoeba histolytica
FNVCKGIIHQNDYLVLYI

SEQ ID NO: 2675898 - protein, 40 aa, Entamoeba histolytica
FNVGQGDCALLLIKNYNGNKWIVRKRVLIDAGNQNKLKER

SEQ ID NO: 2675899 - protein, 20 aa, Entamoeba histolytica
FNVKEGIYWDGGKASLFKEK

SEQ ID NO: 2675900 - protein, 19 aa, Entamoeba histolytica
FNVLECVRTLQTYQEEEVA

SEQ ID NO: 2675901 - protein, 27 aa, Entamoeba histolytica
FNVLNIPYKRVMLFKSKSIIVAEKEPP

SEQ ID NO: 2675902 - protein, 17 aa, Entamoeba histolytica
FNVLWMKSSFLAHPTAF

SEQ ID NO: 2675903 - protein, 27 aa, Entamoeba histolytica
FNVSFNLYSMEAFKVLLDPSVGGNEKF

SEQ ID NO: 2675904 - protein, 23 aa, Entamoeba histolytica
FNVSHIHPLSALVTLSNLIFAQH

SEQ ID NO: 2675905 - protein, 17 aa, Entamoeba histolytica
FNYFSEFVMQKSLDKFV

SEQ ID NO: 2675906 - protein, 18 aa, Entamoeba histolytica
FNYICCIENNRIIGIVVT

SEQ ID NO: 2675907 - protein, 18 aa, Entamoeba histolytica
FNYISIRFTMAGLIEEDD

SEQ ID NO: 2675908 - protein, 19 aa, Entamoeba histolytica
FNYLCFLPPAIGSLTKLKL

SEQ ID NO: 2675909 - protein, 22 aa, Entamoeba histolytica
FNYRTAYPGMVHFVVIDHFRNQ

SEQ ID NO: 2675910 - protein, 17 aa, Entamoeba histolytica
FNYSLPTLMESIVTVLS

SEQ ID NO: 2675911 - protein, 27 aa, Entamoeba histolytica
FPACTPTSCRVRFCISAAHTDEDMEKT

SEQ ID NO: 2675912 - protein, 17 aa, Entamoeba histolytica
FPAEKYVNGSIFLQKPP

SEQ ID NO: 2675913 - protein, 22 aa, Entamoeba histolytica
FPAHLREIIKNIFFKIKSNRGE

SEQ ID NO: 2675914 - protein, 22 aa, Entamoeba histolytica
FPALHYRMAQVLFREKNYIQVE

SEQ ID NO: 2675915 - protein, 21 aa, Entamoeba histolytica
FPAPMNCYFEKVKTPKTNSYD

SEQ ID NO: 2675916 - protein, 17 aa, Entamoeba histolytica
FPATGFSQQWRNSRNDV

SEQ ID NO: 2675917 - protein, 18 aa, Entamoeba histolytica
FPAWDISLSIPSGYINLT

SEQ ID NO: 2675918 - protein, 17 aa, Entamoeba histolytica
FPCADIALSPNQFKLLL

SEQ ID NO: 2675919 - protein, 17 aa, Entamoeba histolytica
FPCRCQTTACLESNCSC

SEQ ID NO: 2675920 - protein, 18 aa, Entamoeba histolytica
FPDDKIPIHFTKITVEIV

SEQ ID NO: 2675921 - protein, 20 aa, Entamoeba histolytica
FPDFFTRRDKRTFNNVLERL

SEQ ID NO: 2675922 - protein, 24 aa, Entamoeba histolytica
FPDHTRPVSVIPIIQFNPHELTIL

SEQ ID NO: 2675923 - protein, 18 aa, Entamoeba histolytica
FPDKLMARPETVQFMTQH

SEQ ID NO: 2675924 - protein, 21 aa, Entamoeba histolytica
FPDRKGIVYGGADGRANVLHF

SEQ ID NO: 2675925 - protein, 17 aa, Entamoeba histolytica
FPDRYQAVHSYSIHSEL

SEQ ID NO: 2675926 - protein, 21 aa, Entamoeba histolytica
FPDYANYHFLLPIKESVHSTN

SEQ ID NO: 2675927 - protein, 19 aa, Entamoeba histolytica
FPEFYKPRDKFIAEVVDML

SEQ ID NO: 2675928 - protein, 21 aa, Entamoeba histolytica
FPEKMTQCIDVYVFELIRNNI

SEQ ID NO: 2675929 - protein, 21 aa, Entamoeba histolytica
FPEKQHLMLLFSDIVLFIPAT

SEQ ID NO: 2675930 - protein, 25 aa, Entamoeba histolytica
FPEKSLPGLLIYKGDCMVKSLFGSE

SEQ ID NO: 2675931 - protein, 19 aa, Entamoeba histolytica
FPELKKWWNDECNKDLVIG

SEQ ID NO: 2675932 - protein, 30 aa, Entamoeba histolytica
FPELSNFKMIGKFEGKIKFFNGNFEFDGKF

SEQ ID NO: 2675933 - protein, 19 aa, Entamoeba histolytica
FPERYEVKDPLILEADSQI

SEQ ID NO: 2675934 - protein, 24 aa, Entamoeba histolytica
FPERYEVKDPLILEADSQIDREKV

SEQ ID NO: 2675935 - protein, 25 aa, Entamoeba histolytica
FPESLLSRFDLIFIILDSSTEELDR

SEQ ID NO: 2675936 - protein, 20 aa, Entamoeba histolytica
FPFEEIYNNLALSIAPEIYG

SEQ ID NO: 2675937 - protein, 19 aa, Entamoeba histolytica
FPFEIVLPENCCVTVVMGN

SEQ ID NO: 2675938 - protein, 20 aa, Entamoeba histolytica
FPFGVSFRPFECEPPFPCGE

SEQ ID NO: 2675939 - protein, 20 aa, Entamoeba histolytica
FPFIVFHSSPLIPFNSEIIP

SEQ ID NO: 2675940 - protein, 21 aa, Entamoeba histolytica
FPFQTSLNFFKALPENIKYLL

SEQ ID NO: 2675941 - protein, 30 aa, Entamoeba histolytica
FPFRKSRLTRLLICWTKIFKEVIPNVYDSL

SEQ ID NO: 2675942 - protein, 25 aa, Entamoeba histolytica
FPFRKWSDKEIPEFHEGEKVQLNCF

SEQ ID NO: 2675943 - protein, 23 aa, Entamoeba histolytica
FPFSICQNTIKFIRIMKDNTAFI

SEQ ID NO: 2675944 - protein, 24 aa, Entamoeba histolytica
FPFTKYNVLKVIQLRVYPELINLL

SEQ ID NO: 2675945 - protein, 23 aa, Entamoeba histolytica
FPGIKEKQALIVLEKNNWDMKKT

SEQ ID NO: 2675946 - protein, 26 aa, Entamoeba histolytica
FPGINKCAFVAMKVMKKYHPKIFYHL

SEQ ID NO: 2675947 - protein, 19 aa, Entamoeba histolytica
FPGKCGGLLQIIQSLIQNP

SEQ ID NO: 2675948 - protein, 22 aa, Entamoeba histolytica
FPGNALDCFNSWIQNLDISISL

SEQ ID NO: 2675949 - protein, 25 aa, Entamoeba histolytica
FPGNREFMMRASFELPSIRDEETDK

SEQ ID NO: 2675950 - protein, 17 aa, Entamoeba histolytica
FPGQMPFSTRQQLPPQI

SEQ ID NO: 2675951 - protein, 17 aa, Entamoeba histolytica
FPIAPTLARVLIGSEQY

SEQ ID NO: 2675952 - protein, 19 aa, Entamoeba histolytica
FPIDFGISEMKGRRPSMQD

SEQ ID NO: 2675953 - protein, 24 aa, Entamoeba histolytica
FPIDRRLREVLIYLFSQEYSEADK

SEQ ID NO: 2675954 - protein, 24 aa, Entamoeba histolytica
FPIESLDLTRFVKHYDPTTPPIYN

SEQ ID NO: 2675955 - protein, 19 aa, Entamoeba histolytica
FPIKSIQLVQKWKDNCVEF

SEQ ID NO: 2675956 - protein, 29 aa, Entamoeba histolytica
FPIMKRSFYAFRIEGEIKLFGNNIETGIN

SEQ ID NO: 2675957 - protein, 21 aa, Entamoeba histolytica
FPIQICNFSKLQALIISNNNL

SEQ ID NO: 2675958 - protein, 19 aa, Entamoeba histolytica
FPIQTKVFISPVFISQNIF

SEQ ID NO: 2675959 - protein, 17 aa, Entamoeba histolytica
FPIRSFNILYESIKHSI

SEQ ID NO: 2675960 - protein, 24 aa, Entamoeba histolytica
FPISDFWEHVCIVWTKCFCYTPKK

SEQ ID NO: 2675961 - protein, 28 aa, Entamoeba histolytica
FPISDFWEHVCIVWTRCYCCTPEKKLVR

SEQ ID NO: 2675962 - protein, 25 aa, Entamoeba histolytica
FPISRLEEYVKFFAATIKQSAPINN

SEQ ID NO: 2675963 - protein, 17 aa, Entamoeba histolytica
FPIVQPLNGYLQQLTSL

SEQ ID NO: 2675964 - protein, 20 aa, Entamoeba histolytica
FPKIPILSLWMHDIVNINEQ

SEQ ID NO: 2675965 - protein, 20 aa, Entamoeba histolytica
FPKNRVEILTKLKTIGGDGY

SEQ ID NO: 2675966 - protein, 18 aa, Entamoeba histolytica
FPKNTPPAIREFISALLQ

SEQ ID NO: 2675967 - protein, 17 aa, Entamoeba histolytica
FPLFPRDAFTYYINTEK

SEQ ID NO: 2675968 - protein, 19 aa, Entamoeba histolytica
FPLITNLYLPYIISEDLFD

SEQ ID NO: 2675969 - protein, 18 aa, Entamoeba histolytica
FPLKEGFGTPQLFDINGK

SEQ ID NO: 2675970 - protein, 18 aa, Entamoeba histolytica
FPLKLYSFIHIKGELEIP

SEQ ID NO: 2675971 - protein, 17 aa, Entamoeba histolytica
FPLNILKLTSLTNLYLT

SEQ ID NO: 2675972 - protein, 17 aa, Entamoeba histolytica
FPLPENILSCLYQSIKG

SEQ ID NO: 2675973 - protein, 21 aa, Entamoeba histolytica
FPLPSSIKFELIKCNGCEPTQ

SEQ ID NO: 2675974 - protein, 17 aa, Entamoeba histolytica
FPLQFILLEVISINQYQ

SEQ ID NO: 2675975 - protein, 19 aa, Entamoeba histolytica
FPLQGMTLVLRHLALEGDQ

SEQ ID NO: 2675976 - protein, 25 aa, Entamoeba histolytica
FPLSYEKSSQCQLKMTTLQFNRYYN

SEQ ID NO: 2675977 - protein, 17 aa, Entamoeba histolytica
FPLYHFFVKNTRLYPIE

SEQ ID NO: 2675978 - protein, 18 aa, Entamoeba histolytica
FPNFLQRYTTQYYVPNID

SEQ ID NO: 2675979 - protein, 26 aa, Entamoeba histolytica
FPNQIGLLTWKIGYKNNLFTFQLIKS

SEQ ID NO: 2675980 - protein, 17 aa, Entamoeba histolytica
FPPCSFPTISSDSNKFG

SEQ ID NO: 2675981 - protein, 22 aa, Entamoeba histolytica
FPQIIIPRRYYIGGDNYLVCCI

SEQ ID NO: 2675982 - protein, 20 aa, Entamoeba histolytica
FPQNRFGIAPDYKWDGIDRG

SEQ ID NO: 2675983 - protein, 17 aa, Entamoeba histolytica
FPQQVFSMFSIIISTEI

SEQ ID NO: 2675984 - protein, 17 aa, Entamoeba histolytica
FPRAKIFLENLLQKKYK

SEQ ID NO: 2675985 - protein, 25 aa, Entamoeba histolytica
FPRDRSFVDWLLCKTINGERASLES

SEQ ID NO: 2675986 - protein, 17 aa, Entamoeba histolytica
FPRIIEISLPRITQSQC

SEQ ID NO: 2675987 - protein, 23 aa, Entamoeba histolytica
FPRIQHFSNLIKLLTVMKEAVEK

SEQ ID NO: 2675988 - protein, 18 aa, Entamoeba histolytica
FPRKFFTYYQKLSNSFVI

SEQ ID NO: 2675989 - protein, 21 aa, Entamoeba histolytica
FPRKILKIAAAQIAMSAGYTD

SEQ ID NO: 2675990 - protein, 22 aa, Entamoeba histolytica
FPRLKTIRCSYQLLCSLPSLSF

SEQ ID NO: 2675991 - protein, 17 aa, Entamoeba histolytica
FPSALLILQLLINVLLN

SEQ ID NO: 2675992 - protein, 17 aa, Entamoeba histolytica
FPSFKYQLFSISKYEEE

SEQ ID NO: 2675993 - protein, 20 aa, Entamoeba histolytica
FPSHRFCQSCLKKTKCSGIC

SEQ ID NO: 2675994 - protein, 19 aa, Entamoeba histolytica
FPSHRKLNLDGKKILDELI

SEQ ID NO: 2675995 - protein, 19 aa, Entamoeba histolytica
FPSIIAYDANKIFIIEPEK

SEQ ID NO: 2675996 - protein, 20 aa, Entamoeba histolytica
FPSLELKVIEETWKNNNYNM

SEQ ID NO: 2675997 - protein, 17 aa, Entamoeba histolytica
FPSLVNVAFDFPISTLF

SEQ ID NO: 2675998 - protein, 17 aa, Entamoeba histolytica
FPSSDFIIFGPGTVEQM

SEQ ID NO: 2675999 - protein, 27 aa, Entamoeba histolytica
FPSSELVKGCVFNCKKNQIRISLWVGE

SEQ ID NO: 2676000 - protein, 21 aa, Entamoeba histolytica
FPSSICSIYLESCRGLTSINL

SEQ ID NO: 2676001 - protein, 24 aa, Entamoeba histolytica
FPSYGGKVDFDWFVEKVALCYTEV

SEQ ID NO: 2676002 - protein, 25 aa, Entamoeba histolytica
FPTDISEQFCRFMVAIGEHKDKLDF

SEQ ID NO: 2676003 - protein, 25 aa, Entamoeba histolytica
FPTFPCKDYLYHILEFTGNGIALHF

SEQ ID NO: 2676004 - protein, 18 aa, Entamoeba histolytica
FPTLKGKQTQFWCVVTDK

SEQ ID NO: 2676005 - protein, 27 aa, Entamoeba histolytica
FPTLRTRSQIMWLFCSLVRRSENKQID

SEQ ID NO: 2676006 - protein, 23 aa, Entamoeba histolytica
FPTMKLKILELLNFVCEKNAFCE

SEQ ID NO: 2676007 - protein, 26 aa, Entamoeba histolytica
FPTNMRERARFIPLRITQPERKMLRL

SEQ ID NO: 2676008 - protein, 18 aa, Entamoeba histolytica
FPTRVELFNLVKRSSSTE

SEQ ID NO: 2676009 - protein, 26 aa, Entamoeba histolytica
FPTSIKNCYLRQNHPSLTYAPNIDNL

SEQ ID NO: 2676010 - protein, 21 aa, Entamoeba histolytica
FPTYLIELAKAFNVQVDVCQP

SEQ ID NO: 2676011 - protein, 24 aa, Entamoeba histolytica
FPVETFRPIKLIAIDSRNSVILVI

SEQ ID NO: 2676012 - protein, 19 aa, Entamoeba histolytica
FPVIIHRNAVFNVFANYDF

SEQ ID NO: 2676013 - protein, 22 aa, Entamoeba histolytica
FPVQRIPRYILLMKEYIKNTEK

SEQ ID NO: 2676014 - protein, 19 aa, Entamoeba histolytica
FPVVFGRGKEGTRDGSFIY

SEQ ID NO: 2676015 - protein, 18 aa, Entamoeba histolytica
FPYATFNWHKKAITSVEW

SEQ ID NO: 2676016 - protein, 18 aa, Entamoeba histolytica
FPYSVSFVSKYQSKGKNS

SEQ ID NO: 2676017 - protein, 19 aa, Entamoeba histolytica
FQALLSVIVGHKFKYPLDF

SEQ ID NO: 2676018 - protein, 18 aa, Entamoeba histolytica
FQAPILFEVSNKSQTFKK

SEQ ID NO: 2676019 - protein, 19 aa, Entamoeba histolytica
FQATLILKETFFIDIDERI

SEQ ID NO: 2676020 - protein, 25 aa, Entamoeba histolytica
FQAYKCRKEHMVGGVILVNPLVNMS

SEQ ID NO: 2676021 - protein, 25 aa, Entamoeba histolytica
FQCDDLFKLLLEWCDREEESTMVLK

SEQ ID NO: 2676022 - protein, 17 aa, Entamoeba histolytica
FQCITTFIESADIVSSC

SEQ ID NO: 2676023 - protein, 21 aa, Entamoeba histolytica
FQCLGKYCYFKDDILLQPQII

SEQ ID NO: 2676024 - protein, 23 aa, Entamoeba histolytica
FQDGCGRTPLHIAVIKNDALAVS

SEQ ID NO: 2676025 - protein, 17 aa, Entamoeba histolytica
FQDSIYIFKCENSAVKV

SEQ ID NO: 2676026 - protein, 19 aa, Entamoeba histolytica
FQDSIYIFKCENSAVKVNG

SEQ ID NO: 2676027 - protein, 24 aa, Entamoeba histolytica
FQEALQFVFYCWQDTPGNVKQLLN

SEQ ID NO: 2676028 - protein, 19 aa, Entamoeba histolytica
FQEFPELTMDLQIIIQSAT

SEQ ID NO: 2676029 - protein, 20 aa, Entamoeba histolytica
FQENLGSVVITKKSYFESDG

SEQ ID NO: 2676030 - protein, 21 aa, Entamoeba histolytica
FQEQAIWMLNAMWPKDQGANA

SEQ ID NO: 2676031 - protein, 21 aa, Entamoeba histolytica
FQEQAIWMLNAMWPKDQGKSA

SEQ ID NO: 2676032 - protein, 20 aa, Entamoeba histolytica
FQETRAVLTPTKLVDFIVTK

SEQ ID NO: 2676033 - protein, 20 aa, Entamoeba histolytica
FQFDFADPFINSNYDTLPEE

SEQ ID NO: 2676034 - protein, 17 aa, Entamoeba histolytica
FQFKSNENYVLLLRNCI

SEQ ID NO: 2676035 - protein, 20 aa, Entamoeba histolytica
FQFMAALKCAKGLRDMIAPF

SEQ ID NO: 2676036 - protein, 18 aa, Entamoeba histolytica
FQFTRVEGTLSRIQSFLK

SEQ ID NO: 2676037 - protein, 17 aa, Entamoeba histolytica
FQGDLYIASPVNLKVLR

SEQ ID NO: 2676038 - protein, 23 aa, Entamoeba histolytica
FQGHLRLLFLENMLDLGSYERKC

SEQ ID NO: 2676039 - protein, 27 aa, Entamoeba histolytica
FQGKRSTCWVFSTIFQLEYAYNKDLSN

SEQ ID NO: 2676040 - protein, 18 aa, Entamoeba histolytica
FQGNMERFHFNPIPLNQY

SEQ ID NO: 2676041 - protein, 25 aa, Entamoeba histolytica
FQGYEYKSLNAIILLIRIFQQIGDF

SEQ ID NO: 2676042 - protein, 21 aa, Entamoeba histolytica
FQHATLKPKFNFFERAEEERK

SEQ ID NO: 2676043 - protein, 21 aa, Entamoeba histolytica
FQHIMRYKIQLNRIMETLPKY

SEQ ID NO: 2676044 - protein, 17 aa, Entamoeba histolytica
FQKAVQFDREHNITSSI

SEQ ID NO: 2676045 - protein, 21 aa, Entamoeba histolytica
FQKELKLFPQIETIRIDENLL

SEQ ID NO: 2676046 - protein, 18 aa, Entamoeba histolytica
FQKIHCHDFYLSRKNNTL

SEQ ID NO: 2676047 - protein, 23 aa, Entamoeba histolytica
FQKIWKYLVPFYIRCGLHPIEDV

SEQ ID NO: 2676048 - protein, 25 aa, Entamoeba histolytica
FQKKVFCVLGGYGLFDSTQIQIKNI

SEQ ID NO: 2676049 - protein, 19 aa, Entamoeba histolytica
FQKLFLKFIKNLIERDDIK

SEQ ID NO: 2676050 - protein, 23 aa, Entamoeba histolytica
FQKRCFPGLKLSHRLNTQEYYDI

SEQ ID NO: 2676051 - protein, 27 aa, Entamoeba histolytica
FQKRLIMKNGRWKKERLKQYQLNNQLV

SEQ ID NO: 2676052 - protein, 25 aa, Entamoeba histolytica
FQKTYWKWFISLSEIPRPSYHCKLF

SEQ ID NO: 2676053 - protein, 18 aa, Entamoeba histolytica
FQLANLWVGKLNHQSVTE

SEQ ID NO: 2676054 - protein, 24 aa, Entamoeba histolytica
FQLDCFEDMHFWLNGMKFQQIFIE

SEQ ID NO: 2676055 - protein, 24 aa, Entamoeba histolytica
FQLEPSAYATMLFRELLKMPTDLD

SEQ ID NO: 2676056 - protein, 19 aa, Entamoeba histolytica
FQLFFFKIFHNYFQCFKAN

SEQ ID NO: 2676057 - protein, 29 aa, Entamoeba histolytica
FQLKSIIDLLGKVYFSFELNNSLFTVKFQ

SEQ ID NO: 2676058 - protein, 19 aa, Entamoeba histolytica
FQLQPMKFVITFKLGSGLD

SEQ ID NO: 2676059 - protein, 18 aa, Entamoeba histolytica
FQLYPFEIVVQFDSLGIF

SEQ ID NO: 2676060 - protein, 20 aa, Entamoeba histolytica
FQLYPFEIVVQFDSLGIFEL

SEQ ID NO: 2676061 - protein, 18 aa, Entamoeba histolytica
FQMNSLWLTIKDMIEIKT

SEQ ID NO: 2676062 - protein, 20 aa, Entamoeba histolytica
FQNDCILIFKICDVKNPKVT

SEQ ID NO: 2676063 - protein, 18 aa, Entamoeba histolytica
FQNGMALDITRYVMPKTI

SEQ ID NO: 2676064 - protein, 21 aa, Entamoeba histolytica
FQNKCNCIWDTIILNEIGQCK

SEQ ID NO: 2676065 - protein, 27 aa, Entamoeba histolytica
FQNKIKLCSLLTCFRRSNALQIDTMIE

SEQ ID NO: 2676066 - protein, 22 aa, Entamoeba histolytica
FQNSNFIKGHMELLKNVQRKKP

SEQ ID NO: 2676067 - protein, 17 aa, Entamoeba histolytica
FQPRNGILLCINGTGCL

SEQ ID NO: 2676068 - protein, 17 aa, Entamoeba histolytica
FQQAVLIYLLSRAGVTV

SEQ ID NO: 2676069 - protein, 25 aa, Entamoeba histolytica
FQQHLLPKRCLLNFQQQNFEIATPY

SEQ ID NO: 2676070 - protein, 19 aa, Entamoeba histolytica
FQQKFTRKQYSHFLYFIFR

SEQ ID NO: 2676071 - protein, 26 aa, Entamoeba histolytica
FQQLDYIKLLLVNAYKKLNDSSVLEK

SEQ ID NO: 2676072 - protein, 21 aa, Entamoeba histolytica
FQQNPHFFNAPSIPYLPTTAE

SEQ ID NO: 2676073 - protein, 22 aa, Entamoeba histolytica
FQQPNLVCPCYPQADNQRLCSN

SEQ ID NO: 2676074 - protein, 24 aa, Entamoeba histolytica
FQQVKNFIVLSHFIPEGVSLVKDV

SEQ ID NO: 2676075 - protein, 19 aa, Entamoeba histolytica
FQQYNVFAPFNCTRGNFID

SEQ ID NO: 2676076 - protein, 25 aa, Entamoeba histolytica
FQRHFSDIWKFIERNAVIYPEQKEE

SEQ ID NO: 2676077 - protein, 17 aa, Entamoeba histolytica
FQRRINNTVPYWDKTLI

SEQ ID NO: 2676078 - protein, 23 aa, Entamoeba histolytica
FQRSETYISMLFEHYFNVNDYPD

SEQ ID NO: 2676079 - protein, 21 aa, Entamoeba histolytica
FQRYVFQRSFYVNRIGILYGT

SEQ ID NO: 2676080 - protein, 21 aa, Entamoeba histolytica
FQSFKGIKSWLSIALSSAPES

SEQ ID NO: 2676081 - protein, 21 aa, Entamoeba histolytica
FQSISLFFFVACCHPTAEIRQ

SEQ ID NO: 2676082 - protein, 20 aa, Entamoeba histolytica
FQSLCSRYNLVFQSNDQVVE

SEQ ID NO: 2676083 - protein, 32 aa, Entamoeba histolytica; identical to SEQ ID NO: 2482310

SEQ ID NO: 2676084 - protein, 24 aa, Entamoeba histolytica
FQSMCLQLNLLKKRIIANTYLESK

SEQ ID NO: 2676085 - protein, 18 aa, Entamoeba histolytica
FQSRPVVRPQVKSAVRHD

SEQ ID NO: 2676086 - protein, 20 aa, Entamoeba histolytica
FQTKEFLIILPFLSSLNTIT

SEQ ID NO: 2676087 - protein, 22 aa, Entamoeba histolytica
FQTLQYWTGFNHIQIIYDSNKN

SEQ ID NO: 2676088 - protein, 20 aa, Entamoeba histolytica
FQTSSVLIKLYIGEVENGVC

SEQ ID NO: 2676089 - protein, 18 aa, Entamoeba histolytica
FQVCPKCQAKYIDRCPIC

SEQ ID NO: 2676090 - protein, 18 aa, Entamoeba histolytica
FQVSDRGNSVIVYGTIAG

SEQ ID NO: 2676091 - protein, 21 aa, Entamoeba histolytica
FQWKSPLAIALTSSIQLNVKS

SEQ ID NO: 2676092 - protein, 27 aa, Entamoeba histolytica
FQYFGLNWKSINSFKHPIIIKESDILI

SEQ ID NO: 2676093 - protein, 17 aa, Entamoeba histolytica
FRAFDGFITVIELMKQH

SEQ ID NO: 2676094 - protein, 25 aa, Entamoeba histolytica
FRAGNEKRYFGVIIEPLDNGSMVYY

SEQ ID NO: 2676095 - protein, 17 aa, Entamoeba histolytica
FRAIQILKEEGAFEEIS

SEQ ID NO: 2676096 - protein, 23 aa, Entamoeba histolytica
FRAKEIRGNSMIIKKMKQVGVKG

SEQ ID NO: 2676097 - protein, 21 aa, Entamoeba histolytica
FRAVVELEMKKRDGVNEALSI

SEQ ID NO: 2676098 - protein, 18 aa, Entamoeba histolytica
FRCITRGYFRGSVGAIIV

SEQ ID NO: 2676099 - protein, 17 aa, Entamoeba histolytica
FRCSKGRFITIGNNTVI

SEQ ID NO: 2676100 - protein, 20 aa, Entamoeba histolytica
FRDFILRKLINGERTAMFSP

SEQ ID NO: 2676101 - protein, 18 aa, Entamoeba histolytica
FRDIKILQMISIQEVMLA

SEQ ID NO: 2676102 - protein, 19 aa, Entamoeba histolytica
FRDKECVNLAMTNIESPCG

SEQ ID NO: 2676103 - protein, 20 aa, Entamoeba histolytica
FREDFVYGFSTWFDVSFPQS

SEQ ID NO: 2676104 - protein, 17 aa, Entamoeba histolytica
FREDVEFFSKLEMEIKN

SEQ ID NO: 2676105 - protein, 18 aa, Entamoeba histolytica
FREEFGDYNIAKCRIITF

SEQ ID NO: 2676106 - protein, 26 aa, Entamoeba histolytica
FRERFKRTLKGGVGIIELYHKSNMLA

SEQ ID NO: 2676107 - protein, 28 aa, Entamoeba histolytica
FRERPSALELLKCDFMKPNGNRKRITDL

SEQ ID NO: 2676108 - protein, 20 aa, Entamoeba histolytica
FRFEELKQMYLFMTVTQPCY

SEQ ID NO: 2676109 - protein, 27 aa, Entamoeba histolytica
FRFGSWPHAGCGIGLERITMLYLGIPN

SEQ ID NO: 2676110 - protein, 22 aa, Entamoeba histolytica
FRFTKNKKWRKGAVLNLLGIDL

SEQ ID NO: 2676111 - protein, 18 aa, Entamoeba histolytica
FRGAKGCVIVYDITSFQS

SEQ ID NO: 2676112 - protein, 19 aa, Entamoeba histolytica
FRGDRAIEISKAFYQGEEF

SEQ ID NO: 2676113 - protein, 17 aa, Entamoeba histolytica
FRGHLRLLLNKQDNSHA

SEQ ID NO: 2676114 - protein, 21 aa, Entamoeba histolytica
FRGSDELFPAVSIDQMRNEKT

SEQ ID NO: 2676115 - protein, 19 aa, Entamoeba histolytica
FRHLLEINLPLNVVTPNLC

SEQ ID NO: 2676116 - protein, 19 aa, Entamoeba histolytica
FRIECGSLVNSLIEEKETK

SEQ ID NO: 2676117 - protein, 19 aa, Entamoeba histolytica
FRIFDCFNDVSSMVTCVKA

SEQ ID NO: 2676118 - protein, 19 aa, Entamoeba histolytica
FRIQLDMDRRMYSISKKSK

SEQ ID NO: 2676119 - protein, 24 aa, Entamoeba histolytica
FRIQVSAMDCTGCEVCTTACPVKC

SEQ ID NO: 2676120 - protein, 18 aa, Entamoeba histolytica
FRITEGIAGSSGDDMGTG

SEQ ID NO: 2676121 - protein, 28 aa, Entamoeba histolytica
FRIYIKHYRIIKTYVDLVLKKHLQTDTL

SEQ ID NO: 2676122 - protein, 26 aa, Entamoeba histolytica
FRKAKMTWFGVEVCLMLKEFFENNNM

SEQ ID NO: 2676123 - protein, 32 aa, Entamoeba histolytica; identical to SEQ ID NO: 2482363

SEQ ID NO: 2676124 - protein, 20 aa, Entamoeba histolytica
FRKICILKGVSPRLPSKGLN

SEQ ID NO: 2676125 - protein, 18 aa, Entamoeba histolytica
FRKQLSLLQKRQPTVKST

SEQ ID NO: 2676126 - protein, 18 aa, Entamoeba histolytica
FRKRLGLKPKTIKQPYNI

SEQ ID NO: 2676127 - protein, 20 aa, Entamoeba histolytica
FRKTSSFYLFRKCIDVLGNS

SEQ ID NO: 2676128 - protein, 20 aa, Entamoeba histolytica
FRKVKLIGMGNVGRVYLVQL

SEQ ID NO: 2676129 - protein, 22 aa, Entamoeba histolytica
FRKYFRGINVPSFISTVTYQLN

SEQ ID NO: 2676130 - protein, 28 aa, Entamoeba histolytica
FRLGLFSLLLHEVMLEFNMSWNNSHEEE

SEQ ID NO: 2676131 - protein, 17 aa, Entamoeba histolytica
FRLIGTRTLHKGGMKIN

SEQ ID NO: 2676132 - protein, 18 aa, Entamoeba histolytica
FRLLEKYGNFYDDDYKDL

SEQ ID NO: 2676133 - protein, 19 aa, Entamoeba histolytica
FRLNNCAHIHVGECINVMC

SEQ ID NO: 2676134 - protein, 26 aa, Entamoeba histolytica
FRLSNYYDRICFALKLLSTHDPRCLD

SEQ ID NO: 2676135 - protein, 19 aa, Entamoeba histolytica
FRLTVDAVIERYLQIVLKL

SEQ ID NO: 2676136 - protein, 17 aa, Entamoeba histolytica
FRLYKGVPCNKRKDLWK

SEQ ID NO: 2676137 - protein, 23 aa, Entamoeba histolytica
FRLYLTEGLPYFLLYKEVPKEIL

SEQ ID NO: 2676138 - protein, 17 aa, Entamoeba histolytica
FRMKIKLVDEAIAEEKR

SEQ ID NO: 2676139 - protein, 21 aa, Entamoeba histolytica
FRNGVLMVIAKLAIKNIQIKN

SEQ ID NO: 2676140 - protein, 22 aa, Entamoeba histolytica
FRNRLSCLYCLKCYKEQGETEE

SEQ ID NO: 2676141 - protein, 20 aa, Entamoeba histolytica
FRPLSYRDTDCFVIVFSYVD

SEQ ID NO: 2676142 - protein, 17 aa, Entamoeba histolytica
FRPSDLPSITFPDTSKF

SEQ ID NO: 2676143 - protein, 17 aa, Entamoeba histolytica
FRQCGIMDQSLPFFMFE

SEQ ID NO: 2676144 - protein, 19 aa, Entamoeba histolytica
FRQESNFHYLFGVKEAGFY

SEQ ID NO: 2676145 - protein, 18 aa, Entamoeba histolytica
FRQTLRWLTEEPNKEKKS

SEQ ID NO: 2676146 - protein, 17 aa, Entamoeba histolytica
FRRAIGIKITEIKDVYI

SEQ ID NO: 2676147 - protein, 22 aa, Entamoeba histolytica
FRRDEISVIFCSKIGDVGLDLP

SEQ ID NO: 2676148 - protein, 19 aa, Entamoeba histolytica
FRREEVCRILGKPYYGDNV

SEQ ID NO: 2676149 - protein, 19 aa, Entamoeba histolytica
FRREFCEENQFLITEVNKV

SEQ ID NO: 2676150 - protein, 17 aa, Entamoeba histolytica
FRRIKHIKIEPESGEIL

SEQ ID NO: 2676151 - protein, 17 aa, Entamoeba histolytica
FRRKIDMYREFLDNQLS

SEQ ID NO: 2676152 - protein, 21 aa, Entamoeba histolytica
FRRSVICRSNLFFINFDDQGN

SEQ ID NO: 2676153 - protein, 17 aa, Entamoeba histolytica
FRSIPMEEIVSVASRIP

SEQ ID NO: 2676154 - protein, 24 aa, Entamoeba histolytica
FRSKGRIPIVSWISEGNGLLVRSS

SEQ ID NO: 2676155 - protein, 30 aa, Entamoeba histolytica; identical to SEQ ID NO: 2482399

SEQ ID NO: 2676156 - protein, 26 aa, Entamoeba histolytica
FRSTLFRWLEEIEYLNISGCIRLSEE

SEQ ID NO: 2676157 - protein, 17 aa, Entamoeba histolytica
FRSTPLIRHHNASKPRL

SEQ ID NO: 2676158 - protein, 19 aa, Entamoeba histolytica
FRSTPLIRHHNASKPRLIK

SEQ ID NO: 2676159 - protein, 17 aa, Entamoeba histolytica
FRTLPLPIQGKRNVGQC

SEQ ID NO: 2676160 - protein, 18 aa, Entamoeba histolytica
FRTNELLRREKMKEMIKE

SEQ ID NO: 2676161 - protein, 18 aa, Entamoeba histolytica
FRTNESLRREKMKEMIKE

SEQ ID NO: 2676162 - protein, 19 aa, Entamoeba histolytica
FRTSASYKIVGRVKSILDG

SEQ ID NO: 2676163 - protein, 17 aa, Entamoeba histolytica
FRVKKHILTAATEAAEM

SEQ ID NO: 2676164 - protein, 20 aa, Entamoeba histolytica
FRVKVSIAQHLPVLRTMSFY

SEQ ID NO: 2676165 - protein, 21 aa, Entamoeba histolytica
FRVKVSIAQHLPVLRTMSFYD

SEQ ID NO: 2676166 - protein, 21 aa, Entamoeba histolytica
FRVPLEKIRGVIITHSHSDHA

SEQ ID NO: 2676167 - protein, 20 aa, Entamoeba histolytica
FRVTYLLNCVVIPWLHETNV

SEQ ID NO: 2676168 - protein, 23 aa, Entamoeba histolytica
FRYDKTILTRLVKKLYFATQQAN

SEQ ID NO: 2676169 - protein, 19 aa, Entamoeba histolytica
FRYELKCHCKSIASTSVTI

SEQ ID NO: 2676170 - protein, 18 aa, Entamoeba histolytica
FRYFKNCSSIANTTAPSG

SEQ ID NO: 2676171 - protein, 22 aa, Entamoeba histolytica
FRYFNCIGNILSFKICSIDDKS

SEQ ID NO: 2676172 - protein, 17 aa, Entamoeba histolytica
FRYTKPLIFELENKELG

SEQ ID NO: 2676173 - protein, 17 aa, Entamoeba histolytica
FRYYLVPPCELRILGTK

SEQ ID NO: 2676174 - protein, 18 aa, Entamoeba histolytica
FSAEQKVYLTGFDGEKIG

SEQ ID NO: 2676175 - protein, 25 aa, Entamoeba histolytica
FSAKFCTNCGVLVKSTSSNNLKTTN

SEQ ID NO: 2676176 - protein, 18 aa, Entamoeba histolytica
FSATACLLDRLPEFYEQK

SEQ ID NO: 2676177 - protein, 17 aa, Entamoeba histolytica
FSATFPISVEQHAREFL

SEQ ID NO: 2676178 - protein, 19 aa, Entamoeba histolytica
FSATFPKQIQRLAADFLDD

SEQ ID NO: 2676179 - protein, 18 aa, Entamoeba histolytica
FSCDGKFIVCVSKDRCNI

SEQ ID NO: 2676180 - protein, 20 aa, Entamoeba histolytica
FSCDTCGYRSNEVKCGGPVS

SEQ ID NO: 2676181 - protein, 30 aa, Entamoeba histolytica
FSCMKRVSLKSCTIKQLLFQKNIFESIELT

SEQ ID NO: 2676182 - protein, 25 aa, Entamoeba histolytica
FSDEHGAVCPLNWKPGKDTIEPTSD

SEQ ID NO: 2676183 - protein, 20 aa, Entamoeba histolytica
FSDELIKIFQEKVHLKHTQL

SEQ ID NO: 2676184 - protein, 19 aa, Entamoeba histolytica
FSDEMRGIFNKMYSLTNLH

SEQ ID NO: 2676185 - protein, 24 aa, Entamoeba histolytica
FSDFGIPCKTCFNKIKEKYVMNKD

SEQ ID NO: 2676186 - protein, 41 aa, Entamoeba histolytica
FSDFVQNIAGYFCPNSKPTQGIHRMATLPLSSSLSQGISSI

SEQ ID NO: 2676187 - protein, 18 aa, Entamoeba histolytica
FSDILKFIEQNVVIYLEQ

SEQ ID NO: 2676188 - protein, 20 aa, Entamoeba histolytica
FSDKTFKLLGFSTEQREPIR

SEQ ID NO: 2676189 - protein, 19 aa, Entamoeba histolytica
FSDRKSLRLSSCRKSCHER

SEQ ID NO: 2676190 - protein, 26 aa, Entamoeba histolytica
FSDSVLKGNYYLRPRDSRTSVDIYQP

SEQ ID NO: 2676191 - protein, 17 aa, Entamoeba histolytica
FSECFKFHSFELPSQIM

SEQ ID NO: 2676192 - protein, 18 aa, Entamoeba histolytica
FSEFDLKKNCLIIPTNIT

SEQ ID NO: 2676193 - protein, 17 aa, Entamoeba histolytica
FSEFKWKDGSLTTAVKE

SEQ ID NO: 2676194 - protein, 20 aa, Entamoeba histolytica
FSEKLPILINKERPKYQIKD

SEQ ID NO: 2676195 - protein, 18 aa, Entamoeba histolytica
FSEMGYPLFEYGINSLYQ

SEQ ID NO: 2676196 - protein, 25 aa, Entamoeba histolytica
FSENCIKPEGRNLVSCKMYNEVVFH

SEQ ID NO: 2676197 - protein, 17 aa, Entamoeba histolytica
FSEPIKWNAKVGEQGGI

SEQ ID NO: 2676198 - protein, 40 aa, Entamoeba histolytica
FSEVIDLIELWRCIIKYSLFQLIPWLGICVKSVSLNPNKS

SEQ ID NO: 2676199 - protein, 19 aa, Entamoeba histolytica
FSFAPFPFHPAVPLFQELC

SEQ ID NO: 2676200 - protein, 18 aa, Entamoeba histolytica
FSFIPTIELTLRLFGNCP

SEQ ID NO: 2676201 - protein, 30 aa, Entamoeba histolytica
FSFLIRSTYSYTFELWFIFKNEDNSLRMSF

SEQ ID NO: 2676202 - protein, 19 aa, Entamoeba histolytica
FSFNERNRILIALTNMCHL

SEQ ID NO: 2676203 - protein, 18 aa, Entamoeba histolytica
FSFNFKVLKPSTEIKMKL

SEQ ID NO: 2676204 - protein, 19 aa, Entamoeba histolytica
FSFVLNLLIIPGNRICADC

SEQ ID NO: 2676205 - protein, 19 aa, Entamoeba histolytica
FSGANIYSGFPSFKYQLFS

SEQ ID NO: 2676206 - protein, 26 aa, Entamoeba histolytica
FSGCNARPSVCPCWSVEPKLGTNPLV

SEQ ID NO: 2676207 - protein, 24 aa, Entamoeba histolytica
FSGGRDGKLCFWKMDKKPSYYNTY

SEQ ID NO: 2676208 - protein, 25 aa, Entamoeba histolytica
FSGGWRMRISIAKAIYMHPDLLLLD

SEQ ID NO: 2676209 - protein, 18 aa, Entamoeba histolytica
FSGNVWLNHIKRCLQRTK

SEQ ID NO: 2676210 - protein, 18 aa, Entamoeba histolytica
FSGVLQFHYKEFARQISF

SEQ ID NO: 2676211 - protein, 20 aa, Entamoeba histolytica
FSHCGLPVGVFGTRNGIVGF

SEQ ID NO: 2676212 - protein, 25 aa, Entamoeba histolytica
FSHEMARFYIAELLLAIDSIHQLNY

SEQ ID NO: 2676213 - protein, 17 aa, Entamoeba histolytica
FSHLFNLTYCYASGYYS

SEQ ID NO: 2676214 - protein, 19 aa, Entamoeba histolytica
FSHPYPFIRTREFLWQEGH

SEQ ID NO: 2676215 - protein, 33 aa, Entamoeba histolytica; identical to SEQ ID NO: 2482468

SEQ ID NO: 2676216 - protein, 20 aa, Entamoeba histolytica
FSIERTRFYAAELLIGLKYL

SEQ ID NO: 2676217 - protein, 20 aa, Entamoeba histolytica
FSIHFPFFIEKVGGSRASLI

SEQ ID NO: 2676218 - protein, 23 aa, Entamoeba histolytica
FSIKTGVIVGSLFHHTARVHTLI

SEQ ID NO: 2676219 - protein, 18 aa, Entamoeba histolytica
FSINPPLYGIAWFNKYNY

SEQ ID NO: 2676220 - protein, 25 aa, Entamoeba histolytica
FSIPLQRLNQIPTIITLICQRLASH

SEQ ID NO: 2676221 - protein, 29 aa, Entamoeba histolytica
FSKAQVDYMFCWRSIALLFKRELNPQDIK

SEQ ID NO: 2676222 - protein, 22 aa, Entamoeba histolytica
FSKIGIEVARLYHWKHPNIVGF

SEQ ID NO: 2676223 - protein, 22 aa, Entamoeba histolytica
FSKIKLYEFFKWTNDKNACKSI

SEQ ID NO: 2676224 - protein, 25 aa, Entamoeba histolytica
FSKKMKYKWYKLKIPSFTTSACVLK

SEQ ID NO: 2676225 - protein, 17 aa, Entamoeba histolytica
  misc_feature (15)..(17): Xaa can be any naturally occurring amino acid
FSKLALSIHGKIENXXX

SEQ ID NO: 2676226 - protein, 21 aa, Entamoeba histolytica
FSKLPVVFDLIDFSPYNEIFI

SEQ ID NO: 2676227 - protein, 23 aa, Entamoeba histolytica
FSKLREVMKIAVPPCLPFIGSTM

SEQ ID NO: 2676228 - protein, 19 aa, Entamoeba histolytica
FSLAKSFLYDQFEYYSSTP

SEQ ID NO: 2676229 - protein, 17 aa, Entamoeba histolytica
FSLEGCFNNIDFTNAGL

SEQ ID NO: 2676230 - protein, 20 aa, Entamoeba histolytica
FSLGEFSFGLSNEKPKSNST

SEQ ID NO: 2676231 - protein, 19 aa, Entamoeba histolytica
FSLGKYRIFGETIDIAVGN

SEQ ID NO: 2676232 - protein, 19 aa, Entamoeba histolytica
FSLIKAKQSIKEFCEETKV

SEQ ID NO: 2676233 - protein, 25 aa, Entamoeba histolytica
FSLKKSIFKPMKWNPIGDNSSNALF

SEQ ID NO: 2676234 - protein, 17 aa, Entamoeba histolytica
FSLKRLDAVTDKVNLYT

SEQ ID NO: 2676235 - protein, 17 aa, Entamoeba histolytica
FSLNAFYNFIKRRRFST

SEQ ID NO: 2676236 - protein, 17 aa, Entamoeba histolytica
FSLPYLLEHCVRILQDL

SEQ ID NO: 2676237 - protein, 22 aa, Entamoeba histolytica
FSLQTICPFTLAKLASFGKEVL

SEQ ID NO: 2676238 - protein, 17 aa, Entamoeba histolytica
FSLRSFAKLTVWLKTDK

SEQ ID NO: 2676239 - protein, 17 aa, Entamoeba histolytica
FSLSSFSTYPCFKNVKQ

SEQ ID NO: 2676240 - protein, 19 aa, Entamoeba histolytica
FSLSSPYLIEPTKFIGNGI

SEQ ID NO: 2676241 - protein, 25 aa, Entamoeba histolytica
FSLSTLRCCYSYFVTEQLSKCPVIY

SEQ ID NO: 2676242 - protein, 23 aa, Entamoeba histolytica
FSLSVNILLYFNCLYDDNHITID

SEQ ID NO: 2676243 - protein, 21 aa, Entamoeba histolytica
FSMINKRCGQVLLLFEENPIP

SEQ ID NO: 2676244 - protein, 19 aa, Entamoeba histolytica
FSMKEMFIEFKVSKTQINQ

SEQ ID NO: 2676245 - protein, 25 aa, Entamoeba histolytica
FSNALLYQFHLKKGDAIGFISRNRY

SEQ ID NO: 2676246 - protein, 26 aa, Entamoeba histolytica
FSNDFCIFSKFIKRKDIIPITTIKTF

SEQ ID NO: 2676247 - protein, 18 aa, Entamoeba histolytica
FSNDSIKNIGNWIEEGKR

SEQ ID NO: 2676248 - protein, 17 aa, Entamoeba histolytica
FSNGGKIVGCIMSSYLL

SEQ ID NO: 2676249 - protein, 17 aa, Entamoeba histolytica
FSNIKFALIRNMTPPII

SEQ ID NO: 2676250 - protein, 18 aa, Entamoeba histolytica
FSNNRFNIVGDIHNIFNE

SEQ ID NO: 2676251 - protein, 19 aa, Entamoeba histolytica
FSPAIPFVCKTNADIQFKP

SEQ ID NO: 2676252 - protein, 17 aa, Entamoeba histolytica
FSPDGSYLSVADDLGTF

SEQ ID NO: 2676253 - protein, 17 aa, Entamoeba histolytica
FSPNVFDKHLEEIIKKV

SEQ ID NO: 2676254 - protein, 20 aa, Entamoeba histolytica
FSPPTGELERPWKALVNEDA

SEQ ID NO: 2676255 - protein, 28 aa, Entamoeba histolytica
FSPSAKFIKKWFEKYSMLSNFPFVYMVD

SEQ ID NO: 2676256 - protein, 24 aa, Entamoeba histolytica
FSPYDSGLVFGIFFPERNRFPGVI

SEQ ID NO: 2676257 - protein, 24 aa, Entamoeba histolytica
FSQCSHSLCKQCLCEQVKYSIEKK

SEQ ID NO: 2676258 - protein, 23 aa, Entamoeba histolytica
FSQECAVWRNIYLSGAHDLRREP

SEQ ID NO: 2676259 - protein, 22 aa, Entamoeba histolytica
FSQEIKAIVPIGRKNEVQELKE

SEQ ID NO: 2676260 - protein, 17 aa, Entamoeba histolytica
FSQIIAWFNQVDKDHSG

SEQ ID NO: 2676261 - protein, 19 aa, Entamoeba histolytica
FSQLFLDLFGRYFAFFEQQ

SEQ ID NO: 2676262 - protein, 18 aa, Entamoeba histolytica
FSQNCFKDIIVTNQTNLM

SEQ ID NO: 2676263 - protein, 36 aa, Entamoeba histolytica
FSQSGKLFICELHVEKEFASNLVILLTGFFDSIETL

SEQ ID NO: 2676264 - protein, 18 aa, Entamoeba histolytica
FSQSMTRIICHLPKQRRT

SEQ ID NO: 2676265 - protein, 17 aa, Entamoeba histolytica
FSRECDEWYQMVLKTLN

SEQ ID NO: 2676266 - protein, 24 aa, Entamoeba histolytica
FSREFPVEKVIVIWDRFVSDPRGK

SEQ ID NO: 2676267 - protein, 18 aa, Entamoeba histolytica
FSRLGITSSNGFKVIDNR

SEQ ID NO: 2676268 - protein, 18 aa, Entamoeba histolytica
FSRLRVAALKNLKASSLT

SEQ ID NO: 2676269 - protein, 21 aa, Entamoeba histolytica
FSRNICLSINTFLMFSKYLDD

SEQ ID NO: 2676270 - protein, 19 aa, Entamoeba histolytica
FSRSVLRNRPSELIQKEKD

SEQ ID NO: 2676271 - protein, 17 aa, Entamoeba histolytica
FSRSWKTYVKKGIGLNY

SEQ ID NO: 2676272 - protein, 18 aa, Entamoeba histolytica
FSRVCPREIKELSDNIEK

SEQ ID NO: 2676273 - protein, 18 aa, Entamoeba histolytica
FSRVHLLDDFFLLEEGDI

SEQ ID NO: 2676274 - protein, 19 aa, Entamoeba histolytica
FSSDLIIKYCDILKGIDAG

SEQ ID NO: 2676275 - protein, 20 aa, Entamoeba histolytica
FSSDVLKTLCEFINKTQQRK

SEQ ID NO: 2676276 - protein, 17 aa, Entamoeba histolytica
FSSEFKKSFFKLSNLLK

SEQ ID NO: 2676277 - protein, 19 aa, Entamoeba histolytica
FSSGLFPFSVMGWPEQTKD

SEQ ID NO: 2676278 - protein, 26 aa, Entamoeba histolytica
FSSHDFLKHVCIVWNKCYYYISDRQL

SEQ ID NO: 2676279 - protein, 17 aa, Entamoeba histolytica
FSSLLAIQNDFEEELFI

SEQ ID NO: 2676280 - protein, 25 aa, Entamoeba histolytica
FSSLYQLIFHPIKFFTPTEKKVGEV

SEQ ID NO: 2676281 - protein, 24 aa, Entamoeba histolytica
FSSRNIQCIIKRNAVYTGTPDEMK

SEQ ID NO: 2676282 - protein, 26 aa, Entamoeba histolytica
FSSTMRRSVFIFLIEYQLQFGTKENV

SEQ ID NO: 2676283 - protein, 18 aa, Entamoeba histolytica
FSTLYSFNSITIYGLRYL

SEQ ID NO: 2676284 - protein, 21 aa, Entamoeba histolytica
FSTRLQRISQFFLTQPGISKE

SEQ ID NO: 2676285 - protein, 26 aa, Entamoeba histolytica
FSTSHRIWLWIVNMPQIIHAMNALAP

SEQ ID NO: 2676286 - protein, 17 aa, Entamoeba histolytica
FSTSLFTLNNLDTIVND

SEQ ID NO: 2676287 - protein, 25 aa, Entamoeba histolytica
FSTYYPYWRFEIIYMSHNNSFHFFN

SEQ ID NO: 2676288 - protein, 17 aa, Entamoeba histolytica
FSVAIGGYLWVPINHTS

SEQ ID NO: 2676289 - protein, 17 aa, Entamoeba histolytica
FSVIKVTIINQIQSQFP

SEQ ID NO: 2676290 - protein, 22 aa, Entamoeba histolytica
FSVLPPFVPWVLLSTATTTFEL

SEQ ID NO: 2676291 - protein, 25 aa, Entamoeba histolytica
FSVSLELQGLLSLKGKYQIDELTER

SEQ ID NO: 2676292 - protein, 17 aa, Entamoeba histolytica
FSVWDLGGQREYITMLP

SEQ ID NO: 2676293 - protein, 19 aa, Entamoeba histolytica
FSYGIILWEMTYRTIHQKY

SEQ ID NO: 2676294 - protein, 20 aa, Entamoeba histolytica
FSYNLLEQFCFPDVTYRKKR

SEQ ID NO: 2676295 - protein, 19 aa, Entamoeba histolytica
FSYQKYNECITKFNTKYKE

SEQ ID NO: 2676296 - protein, 20 aa, Entamoeba histolytica
FSYTFPELIKIRNEFKYFNV

SEQ ID NO: 2676297 - protein, 24 aa, Entamoeba histolytica
FTAARDFLGIPIIMEPSLVASGFL

SEQ ID NO: 2676298 - protein, 27 aa, Entamoeba histolytica
FTAFGKRMLRERFLLKPLMDVNKILHR

SEQ ID NO: 2676299 - protein, 18 aa, Entamoeba histolytica
FTAIDTWISEYSRALNGK

SEQ ID NO: 2676300 - protein, 23 aa, Entamoeba histolytica
FTCGINICMTGDNLLLMTDGIYD

SEQ ID NO: 2676301 - protein, 22 aa, Entamoeba histolytica
FTDALKRYGVENIPVDTFLTLG

SEQ ID NO: 2676302 - protein, 18 aa, Entamoeba histolytica
FTDFWNGYGSCITPDKIV

SEQ ID NO: 2676303 - protein, 20 aa, Entamoeba histolytica
FTDIKSFYSSFHIEDDNSSP

SEQ ID NO: 2676304 - protein, 18 aa, Entamoeba histolytica
FTDNLLEIQLNFYKTQNK

SEQ ID NO: 2676305 - protein, 26 aa, Entamoeba histolytica
FTDTYQRMVFLWMIWLIMNQHPQVFG

SEQ ID NO: 2676306 - protein, 19 aa, Entamoeba histolytica
FTECLHLLMDILSEFGYFF

SEQ ID NO: 2676307 - protein, 23 aa, Entamoeba histolytica
FTEFMKMKFNFEGTKEELQSFAN

SEQ ID NO: 2676308 - protein, 26 aa, Entamoeba histolytica
FTEMFMCGVIYKLTQQYILMNIRQKQ

SEQ ID NO: 2676309 - protein, 21 aa, Entamoeba histolytica
FTENKIIVIIAINDNEESLVL

SEQ ID NO: 2676310 - protein, 17 aa, Entamoeba histolytica
FTENTFKYDLLESPIPE

SEQ ID NO: 2676311 - protein, 24 aa, Entamoeba histolytica
FTERKCYYGVIFVLKYMMVLDLMR

SEQ ID NO: 2676312 - protein, 23 aa, Entamoeba histolytica
FTETARIAALFGINQTLRRETSE

SEQ ID NO: 2676313 - protein, 24 aa, Entamoeba histolytica
FTFKILKGQMEWNGCELSNGTAQS

SEQ ID NO: 2676314 - protein, 19 aa, Entamoeba histolytica
FTFNFPIVQPLNGYLQQLT

SEQ ID NO: 2676315 - protein, 21 aa, Entamoeba histolytica
FTFPDGHSILLLAEGRLVNLG

SEQ ID NO: 2676316 - protein, 24 aa, Entamoeba histolytica
FTFRFPLIHSSIYCHVLFIQIPHI

SEQ ID NO: 2676317 - protein, 20 aa, Entamoeba histolytica
FTFSKPQQWKLIDNIFSSQS

SEQ ID NO: 2676318 - protein, 18 aa, Entamoeba histolytica
FTGAMKWIKGEWNNKRAE

SEQ ID NO: 2676319 - protein, 23 aa, Entamoeba histolytica
FTGNLYTKFINIISFLLAIRNTE

SEQ ID NO: 2676320 - protein, 17 aa, Entamoeba histolytica
FTGYNIMNFDFKYLLER

SEQ ID NO: 2676321 - protein, 23 aa, Entamoeba histolytica
FTHKPPCLVIVNGIKEGIDYNDP

SEQ ID NO: 2676322 - protein, 18 aa, Entamoeba histolytica
FTIKEFRNEVSILASQGV

SEQ ID NO: 2676323 - protein, 25 aa, Entamoeba histolytica
FTIMDSRFLPFRELQSFEGNIINSI

SEQ ID NO: 2676324 - protein, 17 aa, Entamoeba histolytica
FTIQQCLNHEFVSLKHQ

SEQ ID NO: 2676325 - protein, 17 aa, Entamoeba histolytica
FTITSGVTLEKSQRLKT

SEQ ID NO: 2676326 - protein, 21 aa, Entamoeba histolytica
FTKCCKEILRIFTNMCYNHSF

SEQ ID NO: 2676327 - protein, 26 aa, Entamoeba histolytica
FTKEEFLKSLPLPRTVLTDGSIPSKC

SEQ ID NO: 2676328 - protein, 17 aa, Entamoeba histolytica
FTKPERNEYIFGSVINV

SEQ ID NO: 2676329 - protein, 17 aa, Entamoeba histolytica
FTKSRFPTESIKNRESI

SEQ ID NO: 2676330 - protein, 17 aa, Entamoeba histolytica
FTLADGTFWPIPITMSV

SEQ ID NO: 2676331 - protein, 20 aa, Entamoeba histolytica
FTLEELRVFQNYPIKITELI

SEQ ID NO: 2676332 - protein, 25 aa, Entamoeba histolytica
FTLFLNNSEFCFNQTPKLNFTSILQ

SEQ ID NO: 2676333 - protein, 17 aa, Entamoeba histolytica
FTLGSCTFKPINDTSEV

SEQ ID NO: 2676334 - protein, 19 aa, Entamoeba histolytica
FTLHWELQTWIPLGTYLLP

SEQ ID NO: 2676335 - protein, 26 aa, Entamoeba histolytica
FTMKCSGCTKLVMMLRQMGYAAIPLH

SEQ ID NO: 2676336 - protein, 17 aa, Entamoeba histolytica
FTMPSLQSIQFNKNRIT

SEQ ID NO: 2676337 - protein, 26 aa, Entamoeba histolytica
FTMTLWLKAIFEQHLAYLMSIKDVSK

SEQ ID NO: 2676338 - protein, 19 aa, Entamoeba histolytica
FTNAGLIPRSINALIEELK

SEQ ID NO: 2676339 - protein, 18 aa, Entamoeba histolytica
FTNAITFGLCGSSTIDID

SEQ ID NO: 2676340 - protein, 28 aa, Entamoeba histolytica
FTNEVVDIITFIPYNNWQVFFEPFDNTT

SEQ ID NO: 2676341 - protein, 20 aa, Entamoeba histolytica
FTNKCELDYLGVKNVLCGVD

SEQ ID NO: 2676342 - protein, 18 aa, Entamoeba histolytica
FTNLYDFIFEPMMYYIND

SEQ ID NO: 2676343 - protein, 20 aa, Entamoeba histolytica
FTNPMLYEAMFRLIDNNSNG

SEQ ID NO: 2676344 - protein, 21 aa, Entamoeba histolytica
FTNRCGHSFCNQCVIEQILTG

SEQ ID NO: 2676345 - protein, 21 aa, Entamoeba histolytica
FTNRFCTCIENKRCTTCGCHH

SEQ ID NO: 2676346 - protein, 19 aa, Entamoeba histolytica
FTNRGKRASDIIKIGENYC

SEQ ID NO: 2676347 - protein, 18 aa, Entamoeba histolytica
FTNVSWKYNRTTTISSQY

SEQ ID NO: 2676348 - protein, 20 aa, Entamoeba histolytica
FTPELSRCHLKDLKLFDCEN

SEQ ID NO: 2676349 - protein, 18 aa, Entamoeba histolytica
FTPFGGWSRPTMKQYNGD

SEQ ID NO: 2676350 - protein, 19 aa, Entamoeba histolytica
FTPIIDECYPLWFYKSTPS

SEQ ID NO: 2676351 - protein, 19 aa, Entamoeba histolytica
FTPSCDLVVISSSKTSHLF

SEQ ID NO: 2676352 - protein, 18 aa, Entamoeba histolytica
FTPSIMKVYGNYVFIAGR

SEQ ID NO: 2676353 - protein, 18 aa, Entamoeba histolytica
FTPTAYLGWTPFKNSTIV

SEQ ID NO: 2676354 - protein, 26 aa, Entamoeba histolytica
FTQEELKCLWERRYSLLKTNPHALAR

SEQ ID NO: 2676355 - protein, 34 aa, Entamoeba histolytica
FTQFIPSFIHLLRGCGYLGSLAIICADELVSFYQ

SEQ ID NO: 2676356 - protein, 19 aa, Entamoeba histolytica
FTQHYADLMGYKDGVESKE

SEQ ID NO: 2676357 - protein, 22 aa, Entamoeba histolytica
FTQMFWKLGMKNFDDFITKLLN

SEQ ID NO: 2676358 - protein, 19 aa, Entamoeba histolytica
FTQWCDFLEFSPVSSVSDL

SEQ ID NO: 2676359 - protein, 19 aa, Entamoeba histolytica
FTSELPVEVKSYGEIVIAY

SEQ ID NO: 2676360 - protein, 19 aa, Entamoeba histolytica
FTSEPSLWINPQFIQGLDS

SEQ ID NO: 2676361 - protein, 24 aa, Entamoeba histolytica
FTSESMKGWTLKQLINYTSDFGQQ

SEQ ID NO: 2676362 - protein, 21 aa, Entamoeba histolytica
FTSFEICCFYHCGCEEKLKKN

SEQ ID NO: 2676363 - protein, 26 aa, Entamoeba histolytica
FTSLIDWAFSPSCIFPKALTPELTVN

SEQ ID NO: 2676364 - protein, 18 aa, Entamoeba histolytica
FTSPFKIKAFREDFVYGF

SEQ ID NO: 2676365 - protein, 20 aa, Entamoeba histolytica
FTTLYALRVLDTFDEQTVLY

SEQ ID NO: 2676366 - protein, 17 aa, Entamoeba histolytica
FTTREYVSTVGVYILNY

SEQ ID NO: 2676367 - protein, 19 aa, Entamoeba histolytica
FTTRLNNVFVIGKGTETLV

SEQ ID NO: 2676368 - protein, 17 aa, Entamoeba histolytica
FTTSFIIPNEDDARNLF

SEQ ID NO: 2676369 - protein, 18 aa, Entamoeba histolytica
FTTTITLSTSWREYHHLS

SEQ ID NO: 2676370 - protein, 21 aa, Entamoeba histolytica
FTVCIDWKGNSLIKYDQSIAD

SEQ ID NO: 2676371 - protein, 18 aa, Entamoeba histolytica
FTVSNGYFCLYPYASGVF

SEQ ID NO: 2676372 - protein, 17 aa, Entamoeba histolytica
FTVYRFGKVTEIMSTYQ

SEQ ID NO: 2676373 - protein, 17 aa, Entamoeba histolytica
FTYLKLFKEAIPKFKVI

SEQ ID NO: 2676374 - protein, 19 aa, Entamoeba histolytica
FTYQPLHLFNWSLYILLNK

SEQ ID NO: 2676375 - protein, 18 aa, Entamoeba histolytica
FVALEFVWEITRKHERIF

SEQ ID NO: 2676376 - protein, 17 aa, Entamoeba histolytica
FVARKEWIIVGSDDMMI

SEQ ID NO: 2676377 - protein, 21 aa, Entamoeba histolytica
FVCGPCSRSHIKLSHKQLKKG

SEQ ID NO: 2676378 - protein, 26 aa, Entamoeba histolytica
FVCKEKDNFICFLISFGMTSSPPIWL

SEQ ID NO: 2676379 - protein, 21 aa, Entamoeba histolytica
FVCKNCKKPLGTNPFHNVENS

SEQ ID NO: 2676380 - protein, 19 aa, Entamoeba histolytica
FVCNLKPSKLRGVASEAMI

SEQ ID NO: 2676381 - protein, 24 aa, Entamoeba histolytica
FVCNLKPSKLRGVASEAMILAATS

SEQ ID NO: 2676382 - protein, 19 aa, Entamoeba histolytica
FVCPDNIVVGGWDISKVNM

SEQ ID NO: 2676383 - protein, 23 aa, Entamoeba histolytica
FVCTNCGAPIQGSYMIKNGKIVC

SEQ ID NO: 2676384 - protein, 17 aa, Entamoeba histolytica
FVDCKKHLYPPLIGDKK

SEQ ID NO: 2676385 - protein, 18 aa, Entamoeba histolytica
FVDDVCRIEFSKEFLEQC

SEQ ID NO: 2676386 - protein, 20 aa, Entamoeba histolytica
FVDFESIRPLVPIIQSNINS

SEQ ID NO: 2676387 - protein, 22 aa, Entamoeba histolytica
FVDLIFILYIKWERTNDDWVQL

SEQ ID NO: 2676388 - protein, 23 aa, Entamoeba histolytica
FVDWLSKHYKEFGAHLEFVTDKS

SEQ ID NO: 2676389 - protein, 27 aa, Entamoeba histolytica
FVEECYLCAVFNFPHCHFVCRTVKNLE

SEQ ID NO: 2676390 - protein, 24 aa, Entamoeba histolytica
FVEMCIPISVLKGFVVTNKKDENT

SEQ ID NO: 2676391 - protein, 18 aa, Entamoeba histolytica
FVESRYKSLIGLIEKKVS

SEQ ID NO: 2676392 - protein, 19 aa, Entamoeba histolytica
FVEYCYLNPGYGYEVYKEG

SEQ ID NO: 2676393 - protein, 23 aa, Entamoeba histolytica
FVEYCYLNPGYGYEVYKEGADVL

SEQ ID NO: 2676394 - protein, 24 aa, Entamoeba histolytica
FVFESKCWKEVIKKCVILHTQHRQ

SEQ ID NO: 2676395 - protein, 28 aa, Entamoeba histolytica
FVFLLCTRAGGIGINLSEADTVIIYDSD

SEQ ID NO: 2676396 - protein, 19 aa, Entamoeba histolytica
FVFPSIKDYFYVNSPDDLL

SEQ ID NO: 2676397 - protein, 25 aa, Entamoeba histolytica
FVFTKELLCKLGESIEKTEREQLVG

SEQ ID NO: 2676398 - protein, 21 aa, Entamoeba histolytica
FVHEYPPMYGVGLKVKEGMTT

SEQ ID NO: 2676399 - protein, 25 aa, Entamoeba histolytica
FVHPQCIQYAPAFCYHGVLGKYILS

SEQ ID NO: 2676400 - protein, 18 aa, Entamoeba histolytica
FVIDRLVEELKVPKYKQY

SEQ ID NO: 2676401 - protein, 22 aa, Entamoeba histolytica
FVIFKDRVTKFAEWVDNDNPKN

SEQ ID NO: 2676402 - protein, 17 aa, Entamoeba histolytica
FVIGTAFAKPNEVEPSS

SEQ ID NO: 2676403 - protein, 18 aa, Entamoeba histolytica
FVIKNEFIYYFASASPNS

SEQ ID NO: 2676404 - protein, 17 aa, Entamoeba histolytica
FVINFLFVKGCNDYFDS

SEQ ID NO: 2676405 - protein, 21 aa, Entamoeba histolytica
FVINLRPKFDANRFAIPTIIR

SEQ ID NO: 2676406 - protein, 24 aa, Entamoeba histolytica
FVKDFSYMPPLRMKTSVIPSYSCY

SEQ ID NO: 2676407 - protein, 25 aa, Entamoeba histolytica
FVKDFSYMPPLRMKTSVIPSYSCYF

SEQ ID NO: 2676408 - protein, 19 aa, Entamoeba histolytica
FVKEHMSLFINLKIFKTGK

SEQ ID NO: 2676409 - protein, 24 aa, Entamoeba histolytica
FVKFECYQTFSARYRLSQFKCIRK

SEQ ID NO: 2676410 - protein, 28 aa, Entamoeba histolytica
FVKNKIMLALVFKKWWGDSLVQSIVPPI

SEQ ID NO: 2676411 - protein, 25 aa, Entamoeba histolytica
FVKREINSYSTWLFPDDSENILCFA

SEQ ID NO: 2676412 - protein, 21 aa, Entamoeba histolytica
FVKYQCVYHILDLLKSSNKSP

SEQ ID NO: 2676413 - protein, 27 aa, Entamoeba histolytica
FVLCAFDGFFSFMCAAKNYAKTNSIKI

SEQ ID NO: 2676414 - protein, 27 aa, Entamoeba histolytica
FVLDALSAYCRYLPPAGTLFQPLVASL

SEQ ID NO: 2676415 - protein, 17 aa, Entamoeba histolytica
FVLDKFVERYEPTLDDT

SEQ ID NO: 2676416 - protein, 22 aa, Entamoeba histolytica
FVLEKYPKIVYLQNGSYLQRSG

SEQ ID NO: 2676417 - protein, 17 aa, Entamoeba histolytica
FVLGVKVGLLRGSNLKD

SEQ ID NO: 2676418 - protein, 17 aa, Entamoeba histolytica
FVLHYLHSILLSVTGCY

SEQ ID NO: 2676419 - protein, 17 aa, Entamoeba histolytica
FVLKRGTTTAVITDISF

SEQ ID NO: 2676420 - protein, 18 aa, Entamoeba histolytica
FVLLGSISFVDGWNITSV

SEQ ID NO: 2676421 - protein, 25 aa, Entamoeba histolytica
FVLLSENKRQCEFYIYGTKPNSIEK

SEQ ID NO: 2676422 - protein, 25 aa, Entamoeba histolytica
FVLYAICIHANVALKPVLIVRLGDK

SEQ ID NO: 2676423 - protein, 25 aa, Entamoeba histolytica
FVMELCLGGSLAEHVAISPFSIPVA

SEQ ID NO: 2676424 - protein, 34 aa, Entamoeba histolytica
FVNDYKRLNVALTRAKRGLIIIGNIPTLVTSKVW

SEQ ID NO: 2676425 - protein, 17 aa, Entamoeba histolytica
FVNKTLITLCISKDENL

SEQ ID NO: 2676426 - protein, 23 aa, Entamoeba histolytica
FVNYFQMNCCTFSSNTGIFQTLF

SEQ ID NO: 2676427 - protein, 17 aa, Entamoeba histolytica
FVPAFGGRIKKGLYGFS

SEQ ID NO: 2676428 - protein, 26 aa, Entamoeba histolytica
FVPSTIMIKECIEFLIEKEYMKRKDD

SEQ ID NO: 2676429 - protein, 17 aa, Entamoeba histolytica
FVPVWSKGWEKLSPNKI

SEQ ID NO: 2676430 - protein, 24 aa, Entamoeba histolytica
FVQELLEKFLFVAIEDFSGTKGML

SEQ ID NO: 2676431 - protein, 21 aa, Entamoeba histolytica
FVQFFPQYIAYTFFQIPEFRL

SEQ ID NO: 2676432 - protein, 20 aa, Entamoeba histolytica
FVQKQFICYEPDPKKLKDVI

SEQ ID NO: 2676433 - protein, 27 aa, Entamoeba histolytica
FVQSVKGCSNVMFIFRTIDQHIFGCFN

SEQ ID NO: 2676434 - protein, 25 aa, Entamoeba histolytica
FVRRSCDIVPCPLLLDTISSICVST

SEQ ID NO: 2676435 - protein, 19 aa, Entamoeba histolytica
FVSAPPVPELKIIPMKEEY

SEQ ID NO: 2676436 - protein, 22 aa, Entamoeba histolytica
FVSEKCIRLWDAIIAYPKNKFH

SEQ ID NO: 2676437 - protein, 25 aa, Entamoeba histolytica
FVSKDVVNMVCEIPRGTNAKMEIST

SEQ ID NO: 2676438 - protein, 26 aa, Entamoeba histolytica
FVSKKFSFLLCFMAEIILENKDKLLL

SEQ ID NO: 2676439 - protein, 19 aa, Entamoeba histolytica
FVSKSMRIVDDMIVDMDVK

SEQ ID NO: 2676440 - protein, 23 aa, Entamoeba histolytica
FVSMLRKKAFIYLYTEEGMEESE

SEQ ID NO: 2676441 - protein, 18 aa, Entamoeba histolytica
FVSNALNCIVEGFEIIFD

SEQ ID NO: 2676442 - protein, 18 aa, Entamoeba histolytica
FVSRESARDLLLMRRIII

SEQ ID NO: 2676443 - protein, 25 aa, Entamoeba histolytica
FVSSEYTYVIGLKICSKFFEEPLSK

SEQ ID NO: 2676444 - protein, 24 aa, Entamoeba histolytica
FVSVRPGARELLKSLAGKYELILF

SEQ ID NO: 2676445 - protein, 22 aa, Entamoeba histolytica
FVTHCARYKAGIYGDVLNDPEV

SEQ ID NO: 2676446 - protein, 17 aa, Entamoeba histolytica
FVTIEYFNGGSLYSLIN

SEQ ID NO: 2676447 - protein, 18 aa, Entamoeba histolytica
FVTSFCTTVSIGNKIDFY

SEQ ID NO: 2676448 - protein, 19 aa, Entamoeba histolytica
FVVCGECIGLYAIEENKDP

SEQ ID NO: 2676449 - protein, 24 aa, Entamoeba histolytica
FVVEMGMKFSQRYTDPSLAGDTLF

SEQ ID NO: 2676450 - protein, 17 aa, Entamoeba histolytica
FVVGFSAIQFMKIEPKE

SEQ ID NO: 2676451 - protein, 17 aa, Entamoeba histolytica
FVVLEGAVSSDEPDVSG

SEQ ID NO: 2676452 - protein, 26 aa, Entamoeba histolytica
FVVNEVCMLCLPLIESIQGKLQLIDQ

SEQ ID NO: 2676453 - protein, 18 aa, Entamoeba histolytica
FVVYPFLDSVYFISRTGN

SEQ ID NO: 2676454 - protein, 17 aa, Entamoeba histolytica
FVYFDFIPIKMESIFDL

SEQ ID NO: 2676455 - protein, 19 aa, Entamoeba histolytica
FVYYKHRVKALTLIIFTDV

SEQ ID NO: 2676456 - protein, 20 aa, Entamoeba histolytica
FWDNIKRGFKNTVDKTTNWF

SEQ ID NO: 2676457 - protein, 18 aa, Entamoeba histolytica
FWELKNRLPRSLTTLNWE

SEQ ID NO: 2676458 - protein, 23 aa, Entamoeba histolytica
FWICSKCNKIFWIGSQTKHIIET

SEQ ID NO: 2676459 - protein, 21 aa, Entamoeba histolytica
FWLLNEFADLLGPSPLIVEKK

SEQ ID NO: 2676460 - protein, 19 aa, Entamoeba histolytica
FWLNGMKFQQIFIEEAIDN

SEQ ID NO: 2676461 - protein, 19 aa, Entamoeba histolytica
FWMAYCPIKPKSEKLSQII

SEQ ID NO: 2676462 - protein, 17 aa, Entamoeba histolytica
FWNECKNKIIPDVTDVI

SEQ ID NO: 2676463 - protein, 23 aa, Entamoeba histolytica
FWRVRLQIASSFSRVVQSVGESV

SEQ ID NO: 2676464 - protein, 18 aa, Entamoeba histolytica
FWSRDRCGDSLEIKKYQG

SEQ ID NO: 2676465 - protein, 20 aa, Entamoeba histolytica
FWYSFKSWRDPPLDEMYNIE

SEQ ID NO: 2676466 - protein, 25 aa, Entamoeba histolytica
FYAEWCGPCRFISPLFEQYSRQYPN

SEQ ID NO: 2676467 - protein, 18 aa, Entamoeba histolytica
FYALEIIPSSSFGPCNVV

SEQ ID NO: 2676468 - protein, 19 aa, Entamoeba histolytica
FYCAPELYLNQINENSDIW

SEQ ID NO: 2676469 - protein, 25 aa, Entamoeba histolytica
FYCNCLFKKDSTLIFSKTDIFYTNN

SEQ ID NO: 2676470 - protein, 22 aa, Entamoeba histolytica
FYCPHHLCFRAFSSIQPKQEII

SEQ ID NO: 2676471 - protein, 17 aa, Entamoeba histolytica
FYDKYFKGELDDEMEEE

SEQ ID NO: 2676472 - protein, 17 aa, Entamoeba histolytica
FYDSIELLHYLYSLTTT

SEQ ID NO: 2676473 - protein, 26 aa, Entamoeba histolytica
FYDSIGVICKFCLNNIQPYLLTQLHQ

SEQ ID NO: 2676474 - protein, 27 aa, Entamoeba histolytica
FYEIHLYNRFQIISSLPYKTNYHFKSN

SEQ ID NO: 2676475 - protein, 28 aa, Entamoeba histolytica
FYEKVIKGFEIIPIILMEELYDIVYNQI

SEQ ID NO: 2676476 - protein, 28 aa, Entamoeba histolytica
FYEKYLCVWDYAAASLIVKEAGGITRTI

SEQ ID NO: 2676477 - protein, 24 aa, Entamoeba histolytica
FYELLRRIIQYCISRYNSNQNDSQ

SEQ ID NO: 2676478 - protein, 18 aa, Entamoeba histolytica
FYEQKYIEKFKCEPPPFH

SEQ ID NO: 2676479 - protein, 21 aa, Entamoeba histolytica
FYFLDCYNPQYGDPNEFLVQI

SEQ ID NO: 2676480 - protein, 19 aa, Entamoeba histolytica
FYFQFNFIDTSSLFKNGSF

SEQ ID NO: 2676481 - protein, 25 aa, Entamoeba histolytica
FYFQKCHGCALVFDRTSQESFDALQ

SEQ ID NO: 2676482 - protein, 21 aa, Entamoeba histolytica
FYGSLFKFRKPVHLDINENQV

SEQ ID NO: 2676483 - protein, 19 aa, Entamoeba histolytica
FYHECIYKYGTLHIWNAFV

SEQ ID NO: 2676484 - protein, 24 aa, Entamoeba histolytica
FYHPKIMNLIICCYSIIKKNDCEI

SEQ ID NO: 2676485 - protein, 19 aa, Entamoeba histolytica
FYHQFILSRSSENVWFIVS

SEQ ID NO: 2676486 - protein, 19 aa, Entamoeba histolytica
FYHRLPIFLREEALRKIPG

SEQ ID NO: 2676487 - protein, 19 aa, Entamoeba histolytica
FYIFLCLQPHVMGLVKALK

SEQ ID NO: 2676488 - protein, 25 aa, Entamoeba histolytica
FYINESFPIIFAFIRNEEVILVEIF

SEQ ID NO: 2676489 - protein, 17 aa, Entamoeba histolytica
FYIPGYWKAQATGYASD

SEQ ID NO: 2676490 - protein, 18 aa, Entamoeba histolytica
FYIPPLAKVVEVSHCDSV

SEQ ID NO: 2676491 - protein, 17 aa, Entamoeba histolytica
FYIPYGILDNSDPINSL

SEQ ID NO: 2676492 - protein, 22 aa, Entamoeba histolytica
FYIQSMEYCLNFFFKEMKSEKN

SEQ ID NO: 2676493 - protein, 18 aa, Entamoeba histolytica
FYKACIDVPFMSILTEYI

SEQ ID NO: 2676494 - protein, 23 aa, Entamoeba histolytica
FYKALKNYLPYFLVNGSGNIQKL

SEQ ID NO: 2676495 - protein, 25 aa, Entamoeba histolytica
FYKEFSCALIELFNYPTIIVSLCKN

SEQ ID NO: 2676496 - protein, 18 aa, Entamoeba histolytica
FYKESVKDIFLLIQQYIS

SEQ ID NO: 2676497 - protein, 18 aa, Entamoeba histolytica
FYKEVNFDKSYFVQIEYF

SEQ ID NO: 2676498 - protein, 19 aa, Entamoeba histolytica
FYKKAMCNDTIRLAALHRI

SEQ ID NO: 2676499 - protein, 43 aa, Entamoeba histolytica
FYKKEETYNCSFCPFTFCVECYKRLCLTLGTPQQFISNKARWK

SEQ ID NO: 2676500 - protein, 17 aa, Entamoeba histolytica
FYKLRGIGNLIKEIQMK

SEQ ID NO: 2676501 - protein, 17 aa, Entamoeba histolytica
FYKSFKLVISGLDNLGA

SEQ ID NO: 2676502 - protein, 18 aa, Entamoeba histolytica
FYLAEIICALEYLHMEGV

SEQ ID NO: 2676503 - protein, 17 aa, Entamoeba histolytica
FYLFPSNLRSRRIVFNS

SEQ ID NO: 2676504 - protein, 20 aa, Entamoeba histolytica
FYLISTQTLYCFEVVKRDPS

SEQ ID NO: 2676505 - protein, 18 aa, Entamoeba histolytica
FYLNYPIIIIPHKITLSP

SEQ ID NO: 2676506 - protein, 19 aa, Entamoeba histolytica
FYLPYRLDVDLCYQAKSAA

SEQ ID NO: 2676507 - protein, 18 aa, Entamoeba histolytica
FYLRRMARHFGRDKDIMP

SEQ ID NO: 2676508 - protein, 20 aa, Entamoeba histolytica
FYNDEFILALNRNDLNMAYH

SEQ ID NO: 2676509 - protein, 23 aa, Entamoeba histolytica
FYNEYSKLFLIDYLKHVLTPVLD

SEQ ID NO: 2676510 - protein, 19 aa, Entamoeba histolytica
FYNFYLFFYCNEYLTKTTS

SEQ ID NO: 2676511 - protein, 18 aa, Entamoeba histolytica
FYNKIFTCFFKEQCNAKQ

SEQ ID NO: 2676512 - protein, 19 aa, Entamoeba histolytica
FYNQGRYLLEYETNGEFNQ

SEQ ID NO: 2676513 - protein, 35 aa, Entamoeba histolytica; identical to SEQ ID NO: 2482826

SEQ ID NO: 2676514 - protein, 18 aa, Entamoeba histolytica
FYPHLASLILPHIHSLPQ

SEQ ID NO: 2676515 - protein, 23 aa, Entamoeba histolytica
FYPKGGINPFCYINFNNPTSEEI

SEQ ID NO: 2676516 - protein, 23 aa, Entamoeba histolytica
FYSDSRPSLVLLNKMIQKWGITD

SEQ ID NO: 2676517 - protein, 21 aa, Entamoeba histolytica
FYSGDGTLFFQGRVIDDIVFL

SEQ ID NO: 2676518 - protein, 22 aa, Entamoeba histolytica
FYSGDGTLFFQGRVIDDIVFLT

SEQ ID NO: 2676519 - protein, 38 aa, Entamoeba histolytica
FYSNLIPEFSKYLPSKCNPEYLFGYALKQHFYTLFKIH

SEQ ID NO: 2676520 - protein, 18 aa, Entamoeba histolytica
FYSNVNFLNNKEHVYFGF

SEQ ID NO: 2676521 - protein, 23 aa, Entamoeba histolytica
FYSSESFVSFFKRFQTDTFEVCG

SEQ ID NO: 2676522 - protein, 17 aa, Entamoeba histolytica
FYSSFLSLFFNDSLEEL

SEQ ID NO: 2676523 - protein, 17 aa, Entamoeba histolytica
FYTGFSMQRFPQMPIMP

SEQ ID NO: 2676524 - protein, 18 aa, Entamoeba histolytica
FYTLRLKIINGYPSSMNS

SEQ ID NO: 2676525 - protein, 23 aa, Entamoeba histolytica
FYTSEGEDIFSLVAGYIEIITLK

SEQ ID NO: 2676526 - protein, 18 aa, Entamoeba histolytica
FYTYFARDMSRLDIEAQK

SEQ ID NO: 2676527 - protein, 19 aa, Entamoeba histolytica
FYVNRIGILYGTFKQDRVQ

SEQ ID NO: 2676528 - protein, 27 aa, Entamoeba histolytica
FYYDYLSLLSIENFCLIILKRSIIEPL

SEQ ID NO: 2676529 - protein, 18 aa, Entamoeba histolytica
FYYGEAMLSNIQVLEGLG

SEQ ID NO: 2676530 - protein, 17 aa, Entamoeba histolytica
FYYGQGIGSVFQKLAHF

SEQ ID NO: 2676531 - protein, 17 aa, Entamoeba histolytica
FYYNSFNIIIGKQGAGK

SEQ ID NO: 2676532 - protein, 21 aa, Entamoeba histolytica
FYYSKTYIFTLFFDEKPQMCL

SEQ ID NO: 2676533 - protein, 18 aa, Entamoeba histolytica
GAAFKPLFNQAIQMHLKR

SEQ ID NO: 2676534 - protein, 17 aa, Entamoeba histolytica
GAARYAFEHSKGMIKSI

SEQ ID NO: 2676535 - protein, 22 aa, Entamoeba histolytica
GACCVDDRFTAYIHSDFLVHFG

SEQ ID NO: 2676536 - protein, 18 aa, Entamoeba histolytica
GACKVELKSQLENFKNKR

SEQ ID NO: 2676537 - protein, 24 aa, Entamoeba histolytica
GADENWPITGMKPFFEGLINAMQG

SEQ ID NO: 2676538 - protein, 28 aa, Entamoeba histolytica
GADFHTWKKRWFVMKDQYIWYFPKNTGS

SEQ ID NO: 2676539 - protein, 22 aa, Entamoeba histolytica
GADFKFLEKCCSVHSTNQHFIP

SEQ ID NO: 2676540 - protein, 23 aa, Entamoeba histolytica
GADKCIRGGIALYHNYPCVVIAT

SEQ ID NO: 2676541 - protein, 20 aa, Entamoeba histolytica
GAEGISIYKTKQAVIIGYFS

SEQ ID NO: 2676542 - protein, 26 aa, Entamoeba histolytica
GAELQEWRNLLAYRDECRKASAACIL

SEQ ID NO: 2676543 - protein, 18 aa, Entamoeba histolytica
GAEPFDLIKRSVFKEYVK

SEQ ID NO: 2676544 - protein, 18 aa, Entamoeba histolytica
GAERACSRDGSIIDKQYI

SEQ ID NO: 2676545 - protein, 20 aa, Entamoeba histolytica
GAESEGIFRTSASYKIVGRV

SEQ ID NO: 2676546 - protein, 17 aa, Entamoeba histolytica
GAFIFMQLLEGMNYLHS

SEQ ID NO: 2676547 - protein, 23 aa, Entamoeba histolytica
GAFPDFKTPIVLPARKATVENVS

SEQ ID NO: 2676548 - protein, 20 aa, Entamoeba histolytica
GAGCTGACCAMELSKYKNLK

SEQ ID NO: 2676549 - protein, 18 aa, Entamoeba histolytica
GAGRNCQATESIEIDHIK

SEQ ID NO: 2676550 - protein, 17 aa, Entamoeba histolytica
GAHMAMPLLRKEWKDHM

SEQ ID NO: 2676551 - protein, 18 aa, Entamoeba histolytica
GAIARPSYDLGESCDASK

SEQ ID NO: 2676552 - protein, 19 aa, Entamoeba histolytica
GAIESFKYLRDMGSDLYVK

SEQ ID NO: 2676553 - protein, 20 aa, Entamoeba histolytica
GAINSCLWELTLLQLHHSPQ

SEQ ID NO: 2676554 - protein, 17 aa, Entamoeba histolytica
GAKEHFVNAIICQIAND

SEQ ID NO: 2676555 - protein, 26 aa, Entamoeba histolytica
GAKVRSGKTWSECIDNVIIKYGKDVQ

SEQ ID NO: 2676556 - protein, 18 aa, Entamoeba histolytica
GALFNYYLVEHWAPLEHI

SEQ ID NO: 2676557 - protein, 20 aa, Entamoeba histolytica
GALFNYYLVEHWAPLEHILK

SEQ ID NO: 2676558 - protein, 23 aa, Entamoeba histolytica
GALHGICGNGWIEETQQQRNKYQ

SEQ ID NO: 2676559 - protein, 21 aa, Entamoeba histolytica
GALKPLLDFTPRTTISNSIKN

SEQ ID NO: 2676560 - protein, 21 aa, Entamoeba histolytica
GALKRGTEIVVCTPGRMIDIL

SEQ ID NO: 2676561 - protein, 22 aa, Entamoeba histolytica
GALRTTAPYTLYFAAGTNAASG

SEQ ID NO: 2676562 - protein, 17 aa, Entamoeba histolytica
GALSRKSNFYDLGGDSF

SEQ ID NO: 2676563 - protein, 26 aa, Entamoeba histolytica
GALTLNGSCIFVCFNNHPFSLPKIYP

SEQ ID NO: 2676564 - protein, 19 aa, Entamoeba histolytica
GAMEIFIEWMYLQRSPLLE

SEQ ID NO: 2676565 - protein, 32 aa, Entamoeba histolytica
GAMLVDGICSIYCSKGIYHICGYCDSLHNIVC

SEQ ID NO: 2676566 - protein, 24 aa, Entamoeba histolytica
GANFRIVPEFLFLYKDRFISHRNE

SEQ ID NO: 2676567 - protein, 25 aa, Entamoeba histolytica
GANINRINIIFGLSLIKELYAPFKN

SEQ ID NO: 2676568 - protein, 22 aa, Entamoeba histolytica
GANYVCALKIIFKTKLQESRIG

SEQ ID NO: 2676569 - protein, 21 aa, Entamoeba histolytica
GAPEMSLGFCIGKEGNVNLDQ

SEQ ID NO: 2676570 - protein, 24 aa, Entamoeba histolytica
GAPGKSGICNAMYVGFTYATPDTI

SEQ ID NO: 2676571 - protein, 22 aa, Entamoeba histolytica
GAPRKVCDACILEQFTKQQETN

SEQ ID NO: 2676572 - protein, 20 aa, Entamoeba histolytica
GAPRVMKKPIQWYLEHLMEE

SEQ ID NO: 2676573 - protein, 20 aa, Entamoeba histolytica
GARVTMIFGNGFTISNRPFQ

SEQ ID NO: 2676574 - protein, 18 aa, Entamoeba histolytica
GASTLPILMTLVGYDIDT

SEQ ID NO: 2676575 - protein, 18 aa, Entamoeba histolytica
GATFKVQLTPLINTIVHI

SEQ ID NO: 2676576 - protein, 17 aa, Entamoeba histolytica
GAVEPMGGNIYPPGHPL

SEQ ID NO: 2676577 - protein, 25 aa, Entamoeba histolytica
GAVGKTCLLISYSIRKFPEDYIPTV

SEQ ID NO: 2676578 - protein, 19 aa, Entamoeba histolytica
GAVGKTCMLISYTTNAFPN

SEQ ID NO: 2676579 - protein, 18 aa, Entamoeba histolytica
GAVGRLCANYGINKLYIV

SEQ ID NO: 2676580 - protein, 19 aa, Entamoeba histolytica
GAVIHRGSYMYGHYTTVAL

SEQ ID NO: 2676581 - protein, 20 aa, Entamoeba histolytica
GAWIGCGAIILPGVTIGENA

SEQ ID NO: 2676582 - protein, 17 aa, Entamoeba histolytica
GAYEQLQMNAKRAGVPF

SEQ ID NO: 2676583 - protein, 21 aa, Entamoeba histolytica
GCAVDYLSICVRLFTSSSVSI

SEQ ID NO: 2676584 - protein, 19 aa, Entamoeba histolytica
GCDCSFHLQCACPPIASDK

SEQ ID NO: 2676585 - protein, 21 aa, Entamoeba histolytica
GCDFDMIWLSYNFGLYVVNCI

SEQ ID NO: 2676586 - protein, 24 aa, Entamoeba histolytica
GCDGCKELFLGKSADEIKVIFNKE

SEQ ID NO: 2676587 - protein, 20 aa, Entamoeba histolytica
GCDSCGFINDGVFYGKGKQL

SEQ ID NO: 2676588 - protein, 17 aa, Entamoeba histolytica
GCEALPILHNFFSQSNT

SEQ ID NO: 2676589 - protein, 22 aa, Entamoeba histolytica
GCEVLKTWAMMGLSSGKGLIHI

SEQ ID NO: 2676590 - protein, 18 aa, Entamoeba histolytica
GCFKNCLSLRTITIPSSI

SEQ ID NO: 2676591 - protein, 23 aa, Entamoeba histolytica
GCFNGCNHLSCIVLPKTLESIQE

SEQ ID NO: 2676592 - protein, 24 aa, Entamoeba histolytica
GCFRCSVCGCRLDGYLIKNHELCC

SEQ ID NO: 2676593 - protein, 17 aa, Entamoeba histolytica
GCFYGCKCEEELKKNKT

SEQ ID NO: 2676594 - protein, 18 aa, Entamoeba histolytica
GCGGEANETAELSGEIDK

SEQ ID NO: 2676595 - protein, 17 aa, Entamoeba histolytica
GCGQALPSVLLKKHGIE

SEQ ID NO: 2676596 - protein, 37 aa, Entamoeba histolytica
GCGWYVRKTEWKGMSGKKLFLFEDFNKCISFDTVIQL

SEQ ID NO: 2676597 - protein, 21 aa, Entamoeba histolytica
GCHDGCWCWKHINQLENEGCK

SEQ ID NO: 2676598 - protein, 25 aa, Entamoeba histolytica
GCKADVWSAGVVFFVMATKEYPFMH

SEQ ID NO: 2676599 - protein, 26 aa, Entamoeba histolytica
GCKLNIRLSVKILKQLYSMIKSCSGE

SEQ ID NO: 2676600 - protein, 21 aa, Entamoeba histolytica
GCKSKAVMACLNRTFENNQSN

SEQ ID NO: 2676601 - protein, 17 aa, Entamoeba histolytica
GCLINYYASRGKVIELL

SEQ ID NO: 2676602 - protein, 20 aa, Entamoeba histolytica
GCLRDFIRQAIIGGRNMTNQ

SEQ ID NO: 2676603 - protein, 18 aa, Entamoeba histolytica
GCNKEFNASFSLSSPDRS

SEQ ID NO: 2676604 - protein, 24 aa, Entamoeba histolytica
GCNVSRVLMGWGVQNITFVDNGVI

SEQ ID NO: 2676605 - protein, 23 aa, Entamoeba histolytica
GCPADVWSHACMIFELLTGDFLF

SEQ ID NO: 2676606 - protein, 29 aa, Entamoeba histolytica
GCQWMCCYKCHCFFCWMCMQVTNDHHHKP

SEQ ID NO: 2676607 - protein, 23 aa, Entamoeba histolytica
GCQYHGIVPYFFLVERKAVIQYA

SEQ ID NO: 2676608 - protein, 26 aa, Entamoeba histolytica
GCSDSSIRLYDFKKTQVVNGMNPQAK

SEQ ID NO: 2676609 - protein, 17 aa, Entamoeba histolytica
GCSFYILGVEFKTKQMD

SEQ ID NO: 2676610 - protein, 18 aa, Entamoeba histolytica
GCSLRILDITKLGSQIHN

SEQ ID NO: 2676611 - protein, 18 aa, Entamoeba histolytica
GCSPVIRHKLVFSEPRFK

SEQ ID NO: 2676612 - protein, 17 aa, Entamoeba histolytica
GCTLRSIQMLFLNSLIR

SEQ ID NO: 2676613 - protein, 18 aa, Entamoeba histolytica
GCVFLKFTDEYKHHRVIR

SEQ ID NO: 2676614 - protein, 21 aa, Entamoeba histolytica
GCVGASFGGYSVYWLAGHHQK

SEQ ID NO: 2676615 - protein, 19 aa, Entamoeba histolytica
GCVMGKDSFSTAFLPMILN

SEQ ID NO: 2676616 - protein, 27 aa, Entamoeba histolytica
GCYENVMMIGCGFSDKTIVYSYGNELQ

SEQ ID NO: 2676617 - protein, 17 aa, Entamoeba histolytica
GCYSGVCTMIDIGTVNA

SEQ ID NO: 2676618 - protein, 25 aa, Entamoeba histolytica
GCYTEILKTLILYHILSREGSSNIF

SEQ ID NO: 2676619 - protein, 26 aa, Entamoeba histolytica
GCYVNSCIQLLFSMKSFVSYLSFNPP

SEQ ID NO: 2676620 - protein, 21 aa, Entamoeba histolytica
GDAAISIAVVHHFSTFERRVA

SEQ ID NO: 2676621 - protein, 18 aa, Entamoeba histolytica
GDADIPYTIKDEAELSYP

SEQ ID NO: 2676622 - protein, 24 aa, Entamoeba histolytica
GDAKWKIDPLFNNQWKKFKLQIDK

SEQ ID NO: 2676623 - protein, 19 aa, Entamoeba histolytica
GDALSHYKECLKIIHESNN

SEQ ID NO: 2676624 - protein, 18 aa, Entamoeba histolytica
GDALWDMELSGKTAFLAK

SEQ ID NO: 2676625 - protein, 26 aa, Entamoeba histolytica
GDARNGLNCLEFIFNYFNNLSEEELN

SEQ ID NO: 2676626 - protein, 26 aa, Entamoeba histolytica
GDCLKELSLLCGLSLSHMLCADAPGS

SEQ ID NO: 2676627 - protein, 21 aa, Entamoeba histolytica
GDDGELEWHRALLKNKTEIAL

SEQ ID NO: 2676628 - protein, 20 aa, Entamoeba histolytica
GDDKALIVLLTFINSFGLIL

SEQ ID NO: 2676629 - protein, 33 aa, Entamoeba histolytica
GDDPLLFRFLQIFKEIRELSGMRPNVPKLCTSP

SEQ ID NO: 2676630 - protein, 18 aa, Entamoeba histolytica
GDEEFLVIASDGFWDVFS

SEQ ID NO: 2676631 - protein, 17 aa, Entamoeba histolytica
GDEKASIAWDIRTGKML

SEQ ID NO: 2676632 - protein, 26 aa, Entamoeba histolytica
GDEKCGKTSLTRRFIGEEFKEEVEPF

SEQ ID NO: 2676633 - protein, 23 aa, Entamoeba histolytica
GDEKSVRNFGKWLNKQKAKHKIV

SEQ ID NO: 2676634 - protein, 22 aa, Entamoeba histolytica
GDESYIRHCVRPLETLLTKYKK

SEQ ID NO: 2676635 - protein, 20 aa, Entamoeba histolytica
GDEVINVFHKYAIIKRLRRK

SEQ ID NO: 2676636 - protein, 17 aa, Entamoeba histolytica
GDEYIGMILSPLAQTFV

SEQ ID NO: 2676637 - protein, 26 aa, Entamoeba histolytica
GDFKRLRTIGLLLKRSLTNESLRNYE

SEQ ID NO: 2676638 - protein, 21 aa, Entamoeba histolytica
GDGAVGKTCMLISYTTNSFPN

SEQ ID NO: 2676639 - protein, 21 aa, Entamoeba histolytica
GDGILHSVNYFDVLRDVQPPQ

SEQ ID NO: 2676640 - protein, 20 aa, Entamoeba histolytica
GDGKSSLGNFILKDNKFAVS

SEQ ID NO: 2676641 - protein, 20 aa, Entamoeba histolytica
GDGKSSLGNFILKSNKFDVT

SEQ ID NO: 2676642 - protein, 20 aa, Entamoeba histolytica
GDGLKYFGMYDECGRILGEL

SEQ ID NO: 2676643 - protein, 26 aa, Entamoeba histolytica
GDGLVCGRYLSLFGYEVTVFYPKQSK

SEQ ID NO: 2676644 - protein, 18 aa, Entamoeba histolytica
GDGSLRMFDLRSLEHSTI

SEQ ID NO: 2676645 - protein, 18 aa, Entamoeba histolytica
GDGTVGWVMNELRKAELK

SEQ ID NO: 2676646 - protein, 23 aa, Entamoeba histolytica
GDGYELSDSILLDGPMIIEMVRL

SEQ ID NO: 2676647 - protein, 26 aa, Entamoeba histolytica
GDHCIAFALNCWDVLVNILEMKKEPI

SEQ ID NO: 2676648 - protein, 23 aa, Entamoeba histolytica
GDHFKIAEIIKMRIYHSQTKEDK

SEQ ID NO: 2676649 - protein, 18 aa, Entamoeba histolytica
GDHHIPFCMVVMDNEGVW

SEQ ID NO: 2676650 - protein, 19 aa, Entamoeba histolytica
GDIFGCYDQTLIPYINTHR

SEQ ID NO: 2676651 - protein, 25 aa, Entamoeba histolytica
GDIHLKFIYQPFLHWPDTMITLIEE

SEQ ID NO: 2676652 - protein, 24 aa, Entamoeba histolytica
GDIIPRSRIPRVGNKRRRIMSYNE

SEQ ID NO: 2676653 - protein, 17 aa, Entamoeba histolytica
GDIKMSVILVRPMHEDN

SEQ ID NO: 2676654 - protein, 20 aa, Entamoeba histolytica
GDIRNSICKADFVRTAHIIE

SEQ ID NO: 2676655 - protein, 24 aa, Entamoeba histolytica
GDIVSCLQKISGVILQTQDKEKKI

SEQ ID NO: 2676656 - protein, 17 aa, Entamoeba histolytica
GDKCFSHCISLTSISIP

SEQ ID NO: 2676657 - protein, 24 aa, Entamoeba histolytica
GDKGTVYAVEFAFRPGRDLIGVAK

SEQ ID NO: 2676658 - protein, 29 aa, Entamoeba histolytica
GDKSYIIKHFKCCCELIHNHKECAVEQLC

SEQ ID NO: 2676659 - protein, 22 aa, Entamoeba histolytica
GDKTFKSTLCKVLVGNTFSSSY

SEQ ID NO: 2676660 - protein, 19 aa, Entamoeba histolytica
GDKVGKAPYEVCVGEGVDN

SEQ ID NO: 2676661 - protein, 23 aa, Entamoeba histolytica
GDKYRQCIDLEQFLPKFLNNCQI

SEQ ID NO: 2676662 - protein, 18 aa, Entamoeba histolytica
GDLEIESYILLLVVIACL

SEQ ID NO: 2676663 - protein, 17 aa, Entamoeba histolytica
GDLIKYFNYTDGILEAN

SEQ ID NO: 2676664 - protein, 20 aa, Entamoeba histolytica
GDLIPWTLTQQFLDDEFAGL

SEQ ID NO: 2676665 - protein, 24 aa, Entamoeba histolytica
GDLKEWKYPPLKATEEIELKTGNV

SEQ ID NO: 2676666 - protein, 22 aa, Entamoeba histolytica
GDLKILFEVICHDFIRNKENVI

SEQ ID NO: 2676667 - protein, 27 aa, Entamoeba histolytica
GDLSRFIKKRMGDLISEDLVWNIFLQI

SEQ ID NO: 2676668 - protein, 24 aa, Entamoeba histolytica
GDLVKALRNGYWILLDEINLASHD

SEQ ID NO: 2676669 - protein, 29 aa, Entamoeba histolytica
GDLYIASPVNLKVLRGCIQQSNGDGIALQ

SEQ ID NO: 2676670 - protein, 17 aa, Entamoeba histolytica
GDMFLTMHSNMYYNVVI

SEQ ID NO: 2676671 - protein, 17 aa, Entamoeba histolytica
GDMGQFAIDFIKEIINK

SEQ ID NO: 2676672 - protein, 19 aa, Entamoeba histolytica
GDNCFEGYDSFKMVIPSSV

SEQ ID NO: 2676673 - protein, 25 aa, Entamoeba histolytica
GDNCKMDCTIPLILDSYSLVKDITF

SEQ ID NO: 2676674 - protein, 17 aa, Entamoeba histolytica
GDNGEWSSKCVLAYCDE

SEQ ID NO: 2676675 - protein, 19 aa, Entamoeba histolytica
GDNSPCYRLVYVTHSDEND

SEQ ID NO: 2676676 - protein, 26 aa, Entamoeba histolytica
GDNVCFNCGKPGHMSRECPEPRKDNR

SEQ ID NO: 2676677 - protein, 30 aa, Entamoeba histolytica
GDPTVTHCLFRVVGEMGIPLAEYISLSSDS

SEQ ID NO: 2676678 - protein, 27 aa, Entamoeba histolytica
GDPVADAYGFYRCRNFLIYSVNDGCGW

SEQ ID NO: 2676679 - protein, 24 aa, Entamoeba histolytica
GDPYPLYLKHVFNVEQQRINRLAM

SEQ ID NO: 2676680 - protein, 29 aa, Entamoeba histolytica
GDQLYLYEPMLAYHCYEFGSQSNIQNNIV

SEQ ID NO: 2676681 - protein, 20 aa, Entamoeba histolytica
GDQSLDCIYPYVKNLVRSYK

SEQ ID NO: 2676682 - protein, 25 aa, Entamoeba histolytica
GDRLIGRIKFELFREICPKTVENFR

SEQ ID NO: 2676683 - protein, 17 aa, Entamoeba histolytica
GDRYMRFDPVLPGNLDL

SEQ ID NO: 2676684 - protein, 20 aa, Entamoeba histolytica
GDSAMFMSYEFDKCYYTDEF

SEQ ID NO: 2676685 - protein, 19 aa, Entamoeba histolytica
GDSPYFFNQFNSIEQPLSY

SEQ ID NO: 2676686 - protein, 22 aa, Entamoeba histolytica
GDSTIITFQFLDGRQEEIRLRN

SEQ ID NO: 2676687 - protein, 24 aa, Entamoeba histolytica
GDSYAGTFLAGWLRGIPEDKCAKA

SEQ ID NO: 2676688 - protein, 19 aa, Entamoeba histolytica
GDTHYLLYIIDQLRNECID

SEQ ID NO: 2676689 - protein, 19 aa, Entamoeba histolytica
GDVKLLFGVNDLNVLHLTH

SEQ ID NO: 2676690 - protein, 18 aa, Entamoeba histolytica
GDVLCFNNLFGYIQQSIP

SEQ ID NO: 2676691 - protein, 30 aa, Entamoeba histolytica
GDVLRKMCKNELLKDCALLILGNKKDIEGA

SEQ ID NO: 2676692 - protein, 18 aa, Entamoeba histolytica
GDVRRNSEYMKWLKKRVV

SEQ ID NO: 2676693 - protein, 20 aa, Entamoeba histolytica
GDVYRMMKEYENIQYKEVPT

SEQ ID NO: 2676694 - protein, 25 aa, Entamoeba histolytica
GDYKFKLVGVLVHLGTLDSGHYYSY

SEQ ID NO: 2676695 - protein, 28 aa, Entamoeba histolytica
GDYLPFRPGSFDGCISISAIQWLCQADK

SEQ ID NO: 2676696 - protein, 28 aa, Entamoeba histolytica
GDYQFGKTKIFFRVGILAEIEEVREAKI

SEQ ID NO: 2676697 - protein, 33 aa, Entamoeba histolytica
GDYSAEVLFYLLAHKICYPERVFMLRGNHETRL

SEQ ID NO: 2676698 - protein, 18 aa, Entamoeba histolytica
GDYYRYFAEFTVDEKRKE

SEQ ID NO: 2676699 - protein, 17 aa, Entamoeba histolytica
GEAALPLFEHADIDSIE

SEQ ID NO: 2676700 - protein, 22 aa, Entamoeba histolytica
GEAFKCRICGVKIHPSCKDNFV

SEQ ID NO: 2676701 - protein, 23 aa, Entamoeba histolytica
GEAHGGYSYCAVAALALLGRIDE

SEQ ID NO: 2676702 - protein, 20 aa, Entamoeba histolytica
GEAIMASGLVLNENTHWLTF

SEQ ID NO: 2676703 - protein, 17 aa, Entamoeba histolytica
GEALSRTEMAFLDDNQK

SEQ ID NO: 2676704 - protein, 31 aa, Entamoeba histolytica
GEARITFSLFPKLIICRGFGMYILNILTKEV

SEQ ID NO: 2676705 - protein, 17 aa, Entamoeba histolytica
GEAYNIMEDAGFILSQF

SEQ ID NO: 2676706 - protein, 19 aa, Entamoeba histolytica
GECGCILADEMGLGKTLQT

SEQ ID NO: 2676707 - protein, 24 aa, Entamoeba histolytica
GECGKRGGMFACTNIPEFARLMMY

SEQ ID NO: 2676708 - protein, 17 aa, Entamoeba histolytica
GECKAYISFIDKLPESQ

SEQ ID NO: 2676709 - protein, 17 aa, Entamoeba histolytica
GEDALILTHNFTLDTLI

SEQ ID NO: 2676710 - protein, 19 aa, Entamoeba histolytica
GEDFKLSIQHPFEAEQIVQ

SEQ ID NO: 2676711 - protein, 18 aa, Entamoeba histolytica
GEDGFKWNGKTFNTTDKL

SEQ ID NO: 2676712 - protein, 25 aa, Entamoeba histolytica
GEDIIKKKLDEILLQPKDDFLLTTD

SEQ ID NO: 2676713 - protein, 25 aa, Entamoeba histolytica
GEDVLLTCRWFFYIREKDSSISSSF

SEQ ID NO: 2676714 - protein, 22 aa, Entamoeba histolytica
GEEIPPLLLVCIDTIKEHPNDI

SEQ ID NO: 2676715 - protein, 28 aa, Entamoeba histolytica
GEESVKLFCPRCGDLYIPMPPHDSRIDG

SEQ ID NO: 2676716 - protein, 24 aa, Entamoeba histolytica
GEEYTLVCAVYFVLKYCGKKGNVC

SEQ ID NO: 2676717 - protein, 25 aa, Entamoeba histolytica
GEFAHKPGIVYRDFEEIKKEIENET

SEQ ID NO: 2676718 - protein, 17 aa, Entamoeba histolytica
GEFFSKLAVDTIKKVKR

SEQ ID NO: 2676719 - protein, 17 aa, Entamoeba histolytica
GEFTKRFHRTFRKGISV

SEQ ID NO: 2676720 - protein, 17 aa, Entamoeba histolytica
GEFTYKVLLLSDCYIGL

SEQ ID NO: 2676721 - protein, 21 aa, Entamoeba histolytica
GEFYNEGWCVLTIGDKLNNTT

SEQ ID NO: 2676722 - protein, 21 aa, Entamoeba histolytica
GEGDAAWVVLVKCEKKDGTPD

SEQ ID NO: 2676723 - protein, 23 aa, Entamoeba histolytica
GEGGLPYIFSVMGIYLASQGIDS

SEQ ID NO: 2676724 - protein, 27 aa, Entamoeba histolytica
GEGIKKPKLRAVMSILKGDVKNVINNF

SEQ ID NO: 2676725 - protein, 18 aa, Entamoeba histolytica
GEGIPDLVAVLIAMTQRL

SEQ ID NO: 2676726 - protein, 25 aa, Entamoeba histolytica
GEGKRAGVYGAFLLACRDEDSGDFE

SEQ ID NO: 2676727 - protein, 19 aa, Entamoeba histolytica
GEGMSGVVFHCYETSTNKE

SEQ ID NO: 2676728 - protein, 19 aa, Entamoeba histolytica
GEGPIGIVFAPIRELAEQI

SEQ ID NO: 2676729 - protein, 23 aa, Entamoeba histolytica
GEGSFGVVFLGYFKGNKVAIKKL

SEQ ID NO: 2676730 - protein, 21 aa, Entamoeba histolytica
GEGYCYRLYSSSVYENIFEEF

SEQ ID NO: 2676731 - protein, 24 aa, Entamoeba histolytica
GEHPSRIIFISGIDRNEYETIKNK

SEQ ID NO: 2676732 - protein, 21 aa, Entamoeba histolytica
GEIEGGIPFLALSDLTGMPVK

SEQ ID NO: 2676733 - protein, 19 aa, Entamoeba histolytica
GEIERARQIYLFGIDHSKE

SEQ ID NO: 2676734 - protein, 20 aa, Entamoeba histolytica
GEIGKSIGINIWLQLFTQII

SEQ ID NO: 2676735 - protein, 18 aa, Entamoeba histolytica
GEIIRYSQLPSFYEDGSL

SEQ ID NO: 2676736 - protein, 18 aa, Entamoeba histolytica
GEIKAIIIGESSVGKTSL

SEQ ID NO: 2676737 - protein, 18 aa, Entamoeba histolytica
GEIKRLKTGQSFEENEED

SEQ ID NO: 2676738 - protein, 24 aa, Entamoeba histolytica
GEIKVLRINGKIVSIIDNKNEKQK

SEQ ID NO: 2676739 - protein, 21 aa, Entamoeba histolytica
GEILCDAFAGVGPFAIPAALK

SEQ ID NO: 2676740 - protein, 17 aa, Entamoeba histolytica
GEILTGYIIKSSEEEGV

SEQ ID NO: 2676741 - protein, 19 aa, Entamoeba histolytica
GEINYSFEFEIKKLPIVLK

SEQ ID NO: 2676742 - protein, 19 aa, Entamoeba histolytica
GEIPQNLHFGRSIKVSPSI

SEQ ID NO: 2676743 - protein, 17 aa, Entamoeba histolytica
GEIPWPSIIKKIYDQRT

SEQ ID NO: 2676744 - protein, 17 aa, Entamoeba histolytica
GEIRKLLFQAIFSSTQL

SEQ ID NO: 2676745 - protein, 21 aa, Entamoeba histolytica
GEISGCPVVEAFNPAEKTTRH

SEQ ID NO: 2676746 - protein, 26 aa, Entamoeba histolytica
GEISKEWKMCILFTDILIIARPFAFG

SEQ ID NO: 2676747 - protein, 27 aa, Entamoeba histolytica
GEITTGCPRLFVCSACSEINEVTFSAT

SEQ ID NO: 2676748 - protein, 17 aa, Entamoeba histolytica
GEIVVLLIHQWIENGGT

SEQ ID NO: 2676749 - protein, 20 aa, Entamoeba histolytica
GEKARTIALFQQFFPGTKTM

SEQ ID NO: 2676750 - protein, 21 aa, Entamoeba histolytica
GEKAVSFKGLMYNAVQDGLSI

SEQ ID NO: 2676751 - protein, 28 aa, Entamoeba histolytica
GEKESTIVCLRWLMGAEFIVESCKPLIQ

SEQ ID NO: 2676752 - protein, 19 aa, Entamoeba histolytica
GEKICKLVLQKIDTKYSVI

SEQ ID NO: 2676753 - protein, 25 aa, Entamoeba histolytica
GEKINAKLGEVWRAMSKEEKQPFFD

SEQ ID NO: 2676754 - protein, 18 aa, Entamoeba histolytica
GEKLFCLYNLPFYFDDQT

SEQ ID NO: 2676755 - protein, 23 aa, Entamoeba histolytica
GEKMRLICIINHYGSLDAGHYNC

SEQ ID NO: 2676756 - protein, 23 aa, Entamoeba histolytica
GELEIKSPFILKEYLNNPEANKQ

SEQ ID NO: 2676757 - protein, 17 aa, Entamoeba histolytica
GELFCYFNKTTIIQILN

SEQ ID NO: 2676758 - protein, 17 aa, Entamoeba histolytica
GELKCIIASEFSIEPDL

SEQ ID NO: 2676759 - protein, 31 aa, Entamoeba histolytica; identical to SEQ ID NO: 2483119

SEQ ID NO: 2676760 - protein, 22 aa, Entamoeba histolytica
GELKRIDSVDMRKLRKNFVSNL

SEQ ID NO: 2676761 - protein, 25 aa, Entamoeba histolytica
GELLKGFLKYYGIDFRSDIEGLSVF

SEQ ID NO: 2676762 - protein, 17 aa, Entamoeba histolytica
GELLVTCDDKGYLANVF

SEQ ID NO: 2676763 - protein, 17 aa, Entamoeba histolytica
GELNQYFMKLLKTTQFV

SEQ ID NO: 2676764 - protein, 21 aa, Entamoeba histolytica
GELPENYFLVPAVMTVLDPIS

SEQ ID NO: 2676765 - protein, 23 aa, Entamoeba histolytica
GELPMLGANFVKNIQFLKMAATY

SEQ ID NO: 2676766 - protein, 22 aa, Entamoeba histolytica
GELSKKCCLFLSSPQKEEFITS

SEQ ID NO: 2676767 - protein, 26 aa, Entamoeba histolytica
GELSKRNKQTFSFGVLNILKYLTKQE

SEQ ID NO: 2676768 - protein, 31 aa, Entamoeba histolytica
GELTEFKWKIPYQLIESLGFDGNNIVIALKV

SEQ ID NO: 2676769 - protein, 20 aa, Entamoeba histolytica
GELTIHRIIHQFNLTIKREE

SEQ ID NO: 2676770 - protein, 17 aa, Entamoeba histolytica
GELYLFEPTKWYELPST

SEQ ID NO: 2676771 - protein, 19 aa, Entamoeba histolytica
GEMERDCMISHGVSSLLKE

SEQ ID NO: 2676772 - protein, 17 aa, Entamoeba histolytica
GENKFEMKVLVTENEKQ

SEQ ID NO: 2676773 - protein, 26 aa, Entamoeba histolytica
GENMLKNCYEWLYDRIISSQMDLTLL

SEQ ID NO: 2676774 - protein, 17 aa, Entamoeba histolytica
GENMQGLALNSMTKTAV

SEQ ID NO: 2676775 - protein, 21 aa, Entamoeba histolytica
GENSGKCIFNGKEFCATLVRL

SEQ ID NO: 2676776 - protein, 29 aa, Entamoeba histolytica
GEQQPPFPYPNWRSVVLPQGYVMYYYQNE

SEQ ID NO: 2676777 - protein, 19 aa, Entamoeba histolytica
GEQSFKFTIQINNNGMMDI

SEQ ID NO: 2676778 - protein, 21 aa, Entamoeba histolytica
GERLQGFLLINVTKRVIVNQL

SEQ ID NO: 2676779 - protein, 24 aa, Entamoeba histolytica
GESALKLWYYFYSLLSDINEHPKD

SEQ ID NO: 2676780 - protein, 19 aa, Entamoeba histolytica
GESAYTFFKLNEAYINAPT

SEQ ID NO: 2676781 - protein, 21 aa, Entamoeba histolytica
GESISIYLEKVMNFLSLKTTL

SEQ ID NO: 2676782 - protein, 23 aa, Entamoeba histolytica
GESKESFLRRKRKQQRLLQRYEK

SEQ ID NO: 2676783 - protein, 21 aa, Entamoeba histolytica
GESKVDVIICVFSLGNKESFN

SEQ ID NO: 2676784 - protein, 23 aa, Entamoeba histolytica
GESPAGALWWLARELEEAKKYKP

SEQ ID NO: 2676785 - protein, 19 aa, Entamoeba histolytica
GESQKSGIIIWMTEGETTF

SEQ ID NO: 2676786 - protein, 20 aa, Entamoeba histolytica
GESRIKLFVEFLTKKWFFTL

SEQ ID NO: 2676787 - protein, 21 aa, Entamoeba histolytica
GESSVGKTCCMNRYVSNEFAE

SEQ ID NO: 2676788 - protein, 25 aa, Entamoeba histolytica
GESYLKGRIEQVRYFGYELAKRNIP

SEQ ID NO: 2676789 - protein, 24 aa, Entamoeba histolytica
GETCFTFDCSPDFIHFDMDFVHKA

SEQ ID NO: 2676790 - protein, 23 aa, Entamoeba histolytica
GETFVPIVICLSFRRGVQCIENL

SEQ ID NO: 2676791 - protein, 23 aa, Entamoeba histolytica
GETKIKLSVKFIKKEITLKELQK

SEQ ID NO: 2676792 - protein, 20 aa, Entamoeba histolytica
GETTEGIFRIPGKQEEIDGY

SEQ ID NO: 2676793 - protein, 21 aa, Entamoeba histolytica
GETVVAFVVIKKGCSFDNLEK

SEQ ID NO: 2676794 - protein, 29 aa, Entamoeba histolytica
GEVENIRMFIKACFVEKQWSAENTQYTQQ

SEQ ID NO: 2676795 - protein, 30 aa, Entamoeba histolytica
GEVENIRMFIKACFVEKQWSAENTQYTQQQ

SEQ ID NO: 2676796 - protein, 25 aa, Entamoeba histolytica
GEVEQLKLDIVFGQGEIVSISNEGN

SEQ ID NO: 2676797 - protein, 19 aa, Entamoeba histolytica
GEVFRCMWEDPKSKSKTHY

SEQ ID NO: 2676798 - protein, 17 aa, Entamoeba histolytica
GEVFRFLDAALQDPESV

SEQ ID NO: 2676799 - protein, 23 aa, Entamoeba histolytica
GEVGSLIPFCDFSNHCTQAKVTY

SEQ ID NO: 2676800 - protein, 21 aa, Entamoeba histolytica
GEVGVRYRLQATLQIVPLKIK

SEQ ID NO: 2676801 - protein, 17 aa, Entamoeba histolytica
GEVHLSGVLFFFDSKKE

SEQ ID NO: 2676802 - protein, 27 aa, Entamoeba histolytica
GEVIFNLEMFKARIGANIKNQTLINAM

SEQ ID NO: 2676803 - protein, 17 aa, Entamoeba histolytica
GEVMILLDILQKEKNYK

SEQ ID NO: 2676804 - protein, 21 aa, Entamoeba histolytica
GEVPSRVKVIVNIIRRSLLLL

SEQ ID NO: 2676805 - protein, 20 aa, Entamoeba histolytica
GEVSFKDVITFNLDEYYPMK

SEQ ID NO: 2676806 - protein, 20 aa, Entamoeba histolytica
GEVSIEVILSMMIKSYLEEL

SEQ ID NO: 2676807 - protein, 19 aa, Entamoeba histolytica
GEVVWDCFGDVKKQGGAPC

SEQ ID NO: 2676808 - protein, 20 aa, Entamoeba histolytica
GEVYLFPYYSVHDFINTNTF

SEQ ID NO: 2676809 - protein, 18 aa, Entamoeba histolytica
GEYALLPDLLFNISKALE

SEQ ID NO: 2676810 - protein, 20 aa, Entamoeba histolytica
GEYEECFNLDIFIQAIEHWK

SEQ ID NO: 2676811 - protein, 23 aa, Entamoeba histolytica
GEYFSSQIIFLAFPDRIQVNEII

SEQ ID NO: 2676812 - protein, 25 aa, Entamoeba histolytica
GEYICLMNPFKFFPSLNEIKSCVWA

SEQ ID NO: 2676813 - protein, 17 aa, Entamoeba histolytica
GEYKPVRIINQMTTESS

SEQ ID NO: 2676814 - protein, 20 aa, Entamoeba histolytica
GEYNISYIISCSLKNKSTTY

SEQ ID NO: 2676815 - protein, 20 aa, Entamoeba histolytica
GEYQLYIGWYDGNPAHLDQL

SEQ ID NO: 2676816 - protein, 22 aa, Entamoeba histolytica
GEYWKDSFRKLINQVRKSKGLP

SEQ ID NO: 2676817 - protein, 24 aa, Entamoeba histolytica
GFAELPLFLCVALINKYSSELQQK

SEQ ID NO: 2676818 - protein, 24 aa, Entamoeba histolytica
GFAGHKEYTGWVIPDPLCLMCYLF

SEQ ID NO: 2676819 - protein, 25 aa, Entamoeba histolytica
GFAKWQMPFKFLVDDGCVNAYPPLS

SEQ ID NO: 2676820 - protein, 17 aa, Entamoeba histolytica
GFAQNVSDEIAIQNNMH

SEQ ID NO: 2676821 - protein, 17 aa, Entamoeba histolytica
GFCKTKGFYEWKKSLML

SEQ ID NO: 2676822 - protein, 17 aa, Entamoeba histolytica
GFCNRLVKITSERKTYV

SEQ ID NO: 2676823 - protein, 18 aa, Entamoeba histolytica
GFDDYRAQAILSIGLTRK

SEQ ID NO: 2676824 - protein, 20 aa, Entamoeba histolytica
GFDGFRFDGVTSMIYTHHGV

SEQ ID NO: 2676825 - protein, 26 aa, Entamoeba histolytica
GFEIECSECKKVFTYRAYQERDMKCR

SEQ ID NO: 2676826 - protein, 20 aa, Entamoeba histolytica
GFELTKYSTLLPFMKTATNG

SEQ ID NO: 2676827 - protein, 18 aa, Entamoeba histolytica
GFFVYGIEQTRLRERFKR

SEQ ID NO: 2676828 - protein, 23 aa, Entamoeba histolytica
GFGETRKGILHDIGIITGATVIS

SEQ ID NO: 2676829 - protein, 22 aa, Entamoeba histolytica
GFGSFGKTGFNAFGNNNTQNTT

SEQ ID NO: 2676830 - protein, 18 aa, Entamoeba histolytica
GFIKEVLNNHLFIYKLLE

SEQ ID NO: 2676831 - protein, 23 aa, Entamoeba histolytica
GFIKNDPGHFVFTLQNPFNIAPT

SEQ ID NO: 2676832 - protein, 21 aa, Entamoeba histolytica
GFIPRSYQVFFTKNGKKIKNS

SEQ ID NO: 2676833 - protein, 19 aa, Entamoeba histolytica
GFISVSIGFLLPEKGEINY

SEQ ID NO: 2676834 - protein, 20 aa, Entamoeba histolytica
GFLDEIRRQNGLKREWEDCQ

SEQ ID NO: 2676835 - protein, 18 aa, Entamoeba histolytica
GFLGSSFDFIIDAFEKEI

SEQ ID NO: 2676836 - protein, 22 aa, Entamoeba histolytica
GFLKGAGIGLIPGYGQYQGIRG

SEQ ID NO: 2676837 - protein, 17 aa, Entamoeba histolytica
GFLNFYGSLFKMRMTAV

SEQ ID NO: 2676838 - protein, 22 aa, Entamoeba histolytica
GFLYHKRYLTYKAFSATKFQQY

SEQ ID NO: 2676839 - protein, 29 aa, Entamoeba histolytica
GFMKKEDWFSVCKNFTLADGTFWPIPITM

SEQ ID NO: 2676840 - protein, 25 aa, Entamoeba histolytica
GFNEKVCGRKNLLIIVVSGKSIFGS

SEQ ID NO: 2676841 - protein, 18 aa, Entamoeba histolytica
GFNLLTEFCKEKKKQVEI

SEQ ID NO: 2676842 - protein, 20 aa, Entamoeba histolytica
GFPCIGYHAFSHCNELQNII

SEQ ID NO: 2676843 - protein, 25 aa, Entamoeba histolytica
GFPLQFKIPLAFSLSIVANIKDYQA

SEQ ID NO: 2676844 - protein, 18 aa, Entamoeba histolytica
GFPSFKFCEHLIEVVKKY

SEQ ID NO: 2676845 - protein, 17 aa, Entamoeba histolytica
GFQLKIFDDNIVVRTND

SEQ ID NO: 2676846 - protein, 21 aa, Entamoeba histolytica
GFQLWKLIHKIPIISLNDNAQ

SEQ ID NO: 2676847 - protein, 20 aa, Entamoeba histolytica
GFQTKDLWKVGGVKQSPMDK

SEQ ID NO: 2676848 - protein, 18 aa, Entamoeba histolytica
GFSSVALNGCICGKENIM

SEQ ID NO: 2676849 - protein, 18 aa, Entamoeba histolytica
GFTAALCEKLADKYTKKT

SEQ ID NO: 2676850 - protein, 21 aa, Entamoeba histolytica
GFTCDSRSTIQLSTESQKSTK

SEQ ID NO: 2676851 - protein, 19 aa, Entamoeba histolytica
GFTDYQLLINILKSVLIGN

SEQ ID NO: 2676852 - protein, 19 aa, Entamoeba histolytica
GFTRLKIELLKGYFSPDRI

SEQ ID NO: 2676853 - protein, 19 aa, Entamoeba histolytica
GFTTLKTIGFICSEEITSQ

SEQ ID NO: 2676854 - protein, 19 aa, Entamoeba histolytica
GFVDASLSSIEWDYLDYAF

SEQ ID NO: 2676855 - protein, 17 aa, Entamoeba histolytica
GFYKLLESITIPSPIFE

SEQ ID NO: 2676856 - protein, 25 aa, Entamoeba histolytica
GFYKSCTEYGIIPAFELIERSQAEK

SEQ ID NO: 2676857 - protein, 19 aa, Entamoeba histolytica
GFYYERRVVPLIKQEREYD

SEQ ID NO: 2676858 - protein, 17 aa, Entamoeba histolytica
GGAAKVILKAFQMGEKQ

SEQ ID NO: 2676859 - protein, 21 aa, Entamoeba histolytica
GGAFIKFVPFLKSYTQYATNQ

SEQ ID NO: 2676860 - protein, 17 aa, Entamoeba histolytica
GGALVLADEGVCLIDEF

SEQ ID NO: 2676861 - protein, 19 aa, Entamoeba histolytica
GGAPALPPPRRGTKNAPPP

SEQ ID NO: 2676862 - protein, 24 aa, Entamoeba histolytica
GGCKTCDMAEFVIHAVNPNGEPCT

SEQ ID NO: 2676863 - protein, 19 aa, Entamoeba histolytica
GGCRYCGDVNHFAKDCPNK

SEQ ID NO: 2676864 - protein, 24 aa, Entamoeba histolytica
GGDFDVLKLLGFTELKLNKINETI

SEQ ID NO: 2676865 - protein, 23 aa, Entamoeba histolytica
GGDIFVIHFGYRMGVESLEEKNC

SEQ ID NO: 2676866 - protein, 19 aa, Entamoeba histolytica
GGDVPEFEPYLPVEGSYIP

SEQ ID NO: 2676867 - protein, 17 aa, Entamoeba histolytica
GGEIFYRINDPSRLISV

SEQ ID NO: 2676868 - protein, 24 aa, Entamoeba histolytica
GGEKTIAALALLFAVQSYYPSPFF

SEQ ID NO: 2676869 - protein, 18 aa, Entamoeba histolytica
GGESCCFALRSKNGILIV

SEQ ID NO: 2676870 - protein, 19 aa, Entamoeba histolytica
GGGMPMGGGNPMMAAIAAR

SEQ ID NO: 2676871 - protein, 18 aa, Entamoeba histolytica
GGGNPMMAAIAARGNRGG

SEQ ID NO: 2676872 - protein, 22 aa, Entamoeba histolytica
GGGTFWGLCCLLTNYKSFDEML

SEQ ID NO: 2676873 - protein, 25 aa, Entamoeba histolytica
GGGWKNWKHRWFVLDGTTLTYYKDQ

SEQ ID NO: 2676874 - protein, 20 aa, Entamoeba histolytica
GGHNIWPAEICDIMVAHPKI

SEQ ID NO: 2676875 - protein, 19 aa, Entamoeba histolytica
GGICAECQKAFKSKESVVK

SEQ ID NO: 2676876 - protein, 22 aa, Entamoeba histolytica
GGIGESAIFVFGCQGTTLFFLD

SEQ ID NO: 2676877 - protein, 19 aa, Entamoeba histolytica
GGIVGDWNASILLYTKNTE

SEQ ID NO: 2676878 - protein, 30 aa, Entamoeba histolytica
GGKCLPIGNICYLYKCCQMNPYQIKLNDDI

SEQ ID NO: 2676879 - protein, 18 aa, Entamoeba histolytica
GGKKLKKVQLEEGTSGNV

SEQ ID NO: 2676880 - protein, 23 aa, Entamoeba histolytica
GGKLRFGVPLAKAECVWKNLILM

SEQ ID NO: 2676881 - protein, 22 aa, Entamoeba histolytica
GGKRGGRGRPAAAVRQKVESFF

SEQ ID NO: 2676882 - protein, 22 aa, Entamoeba histolytica
GGKYEVGNGFIIAGAHLDSPSL

SEQ ID NO: 2676883 - protein, 18 aa, Entamoeba histolytica
GGLKNELLNYLDGIDESY

SEQ ID NO: 2676884 - protein, 21 aa, Entamoeba histolytica
GGLLGIKGIKFVNAVISVMYN

SEQ ID NO: 2676885 - protein, 19 aa, Entamoeba histolytica
GGLLKECYSSFIKEINEGK

SEQ ID NO: 2676886 - protein, 23 aa, Entamoeba histolytica
GGLNCNGFPFGTEIIVSTFSNDQ

SEQ ID NO: 2676887 - protein, 26 aa, Entamoeba histolytica
GGLQACARAFAARKHFSVLREQQVAV

SEQ ID NO: 2676888 - protein, 19 aa, Entamoeba histolytica
GGLQFPELGLNRFDDMIND

SEQ ID NO: 2676889 - protein, 18 aa, Entamoeba histolytica
GGLVQWAPVLADLFMLAR

SEQ ID NO: 2676890 - protein, 19 aa, Entamoeba histolytica
GGNDVYLWIGTRASSTLRK

SEQ ID NO: 2676891 - protein, 35 aa, Entamoeba histolytica
GGNGHFIKPMMMRCAKPMMMECAKPMIMKHSEKMK

SEQ ID NO: 2676892 - protein, 26 aa, Entamoeba histolytica
GGNKIEVCSGVDGFKHLPKASLNELF

SEQ ID NO: 2676893 - protein, 18 aa, Entamoeba histolytica
GGPLKKGQSINFLIEKRK

SEQ ID NO: 2676894 - protein, 21 aa, Entamoeba histolytica
GGPRGAPRGRGGMMPPTQAPE

SEQ ID NO: 2676895 - protein, 17 aa, Entamoeba histolytica
GGRIHGAINIWNEQLLN

SEQ ID NO: 2676896 - protein, 27 aa, Entamoeba histolytica
GGRVSDGFISRSLPHFALHSRTPQAKG

SEQ ID NO: 2676897 - protein, 25 aa, Entamoeba histolytica
GGSCCIPLVKKTICDMFGEKKIIGF

SEQ ID NO: 2676898 - protein, 20 aa, Entamoeba histolytica
GGSDALFFFQYTKLPMNVLS

SEQ ID NO: 2676899 - protein, 18 aa, Entamoeba histolytica
GGSDYYLVCRDFDGYVKI

SEQ ID NO: 2676900 - protein, 18 aa, Entamoeba histolytica
GGSFYCFDFLRGQNDNGY

SEQ ID NO: 2676901 - protein, 18 aa, Entamoeba histolytica
GGSRLGCIKTIIENKLHL

SEQ ID NO: 2676902 - protein, 33 aa, Entamoeba histolytica; identical to SEQ ID NO: 2483291

SEQ ID NO: 2676903 - protein, 23 aa, Entamoeba histolytica
GGSVRLEPRFQFIVTSNYSLAEC

SEQ ID NO: 2676904 - protein, 18 aa, Entamoeba histolytica
GGTFKKFTKVQMECKNDY

SEQ ID NO: 2676905 - protein, 17 aa, Entamoeba histolytica
GGTIGKYEDCVWVNKMA

SEQ ID NO: 2676906 - protein, 21 aa, Entamoeba histolytica
GGTLDVACCKIISDNSVNVES

SEQ ID NO: 2676907 - protein, 19 aa, Entamoeba histolytica
GGTMTKIVFWIPGDTDIDL

SEQ ID NO: 2676908 - protein, 19 aa, Entamoeba histolytica
GGTSLCITFHFDLRLSNLL

SEQ ID NO: 2676909 - protein, 18 aa, Entamoeba histolytica
GGVGARFWPLSRESKPKQ

SEQ ID NO: 2676910 - protein, 26 aa, Entamoeba histolytica
GGVLLQCIHSGFGLGRYGEELTGPEY

SEQ ID NO: 2676911 - protein, 21 aa, Entamoeba histolytica
GGVRSNVTWKCRSIGAYYGEP

SEQ ID NO: 2676912 - protein, 18 aa, Entamoeba histolytica
GGVSCAHYSPVLNDDKSF

SEQ ID NO: 2676913 - protein, 23 aa, Entamoeba histolytica
GGWRMRISLATALFLQPDLLILD

SEQ ID NO: 2676914 - protein, 21 aa, Entamoeba histolytica
GGYACEFELFITIKCTTKIKD

SEQ ID NO: 2676915 - protein, 23 aa, Entamoeba histolytica
GGYACEFELFITIKCTTKIKDKI

SEQ ID NO: 2676916 - protein, 26 aa, Entamoeba histolytica
GGYKNWKKRYFVLKDKKLWYFDNKDS

SEQ ID NO: 2676917 - protein, 19 aa, Entamoeba histolytica
GGYYRQTIIYSRYQTPLLN

SEQ ID NO: 2676918 - protein, 26 aa, Entamoeba histolytica
GHCYKVGNTWRVEGVIALSRSLGDRT

SEQ ID NO: 2676919 - protein, 23 aa, Entamoeba histolytica
GHEAGVCCVCYLINDTRPYLLSG

SEQ ID NO: 2676920 - protein, 26 aa, Entamoeba histolytica
GHELEFLESGLIYELFNYLDYPFNEQ

SEQ ID NO: 2676921 - protein, 25 aa, Entamoeba histolytica
GHENIKKGILLLLFGGVHKTTKEGI

SEQ ID NO: 2676922 - protein, 23 aa, Entamoeba histolytica
GHEVKRIEQFYCSALEVEHYQTI

SEQ ID NO: 2676923 - protein, 25 aa, Entamoeba histolytica
GHGPGVDWWSLGILIYEMIVGIPPF

SEQ ID NO: 2676924 - protein, 20 aa, Entamoeba histolytica
GHIFHPSCIKKEFTNNKTPF

SEQ ID NO: 2676925 - protein, 18 aa, Entamoeba histolytica
GHLGHSNIYIGYSQGYEV

SEQ ID NO: 2676926 - protein, 21 aa, Entamoeba histolytica
GHLIHIDFGFMFDRSPGGDMG

SEQ ID NO: 2676927 - protein, 24 aa, Entamoeba histolytica
GHLNPSPIPIAFFLDDMDDEDREV

SEQ ID NO: 2676928 - protein, 23 aa, Entamoeba histolytica
GHMEQTVGVLLSFTDDTIPTQNQ

SEQ ID NO: 2676929 - protein, 27 aa, Entamoeba histolytica
GHNWLVFNWCRGKGCILADEMGLGKTV

SEQ ID NO: 2676930 - protein, 17 aa, Entamoeba histolytica
GHNYLRVTRIFNSLHAF

SEQ ID NO: 2676931 - protein, 25 aa, Entamoeba histolytica
GHPRRWKMKKERLGKLILGDNDMLF

SEQ ID NO: 2676932 - protein, 26 aa, Entamoeba histolytica
GHPSILSNVLWSLGIIIQRYTNDMQS

SEQ ID NO: 2676933 - protein, 23 aa, Entamoeba histolytica
GHQRVKSAFSQRPIFLSEMNEVQ

SEQ ID NO: 2676934 - protein, 21 aa, Entamoeba histolytica
GHRGRGGYRNNYRNGEKRDYK

SEQ ID NO: 2676935 - protein, 22 aa, Entamoeba histolytica
GHSASVDWWTLGVLMYEFLYGC

SEQ ID NO: 2676936 - protein, 19 aa, Entamoeba histolytica
GHSGSIIDIIACPFNDNLI

SEQ ID NO: 2676937 - protein, 24 aa, Entamoeba histolytica
GHSGSVDWWTFGIFMYEILYGRTP

SEQ ID NO: 2676938 - protein, 17 aa, Entamoeba histolytica
GHSGYCKFCESSLYCTN

SEQ ID NO: 2676939 - protein, 18 aa, Entamoeba histolytica
GHVFAGRVNGELAISRSF

SEQ ID NO: 2676940 - protein, 19 aa, Entamoeba histolytica
GHVIFDFCNTGILFKTIQQ

SEQ ID NO: 2676941 - protein, 23 aa, Entamoeba histolytica
GHYFNRLVPVLILEIAEKYPRNL

SEQ ID NO: 2676942 - protein, 25 aa, Entamoeba histolytica
GHYGLECLLLLVALKLRFPQRISLL

SEQ ID NO: 2676943 - protein, 20 aa, Entamoeba histolytica
GIAAPLMVCAVVARTLSIIW

SEQ ID NO: 2676944 - protein, 18 aa, Entamoeba histolytica
GIAELIPGVLFIDEVHML

SEQ ID NO: 2676945 - protein, 20 aa, Entamoeba histolytica
GIAIVPKRRIHQLIPSIKTG

SEQ ID NO: 2676946 - protein, 23 aa, Entamoeba histolytica
GIAPRIICAAVYKYTKKKMEFLW

SEQ ID NO: 2676947 - protein, 23 aa, Entamoeba histolytica
GIAVGVIGKEEWVWVVDKGNNRV

SEQ ID NO: 2676948 - protein, 19 aa, Entamoeba histolytica
GICAYVCHAHLLKKDNVQI

SEQ ID NO: 2676949 - protein, 22 aa, Entamoeba histolytica
GICDEHYISLIFVREGINPSRK

SEQ ID NO: 2676950 - protein, 18 aa, Entamoeba histolytica
GICIQRNPLQFIGFGNRI

SEQ ID NO: 2676951 - protein, 17 aa, Entamoeba histolytica
GIDEGWISTLQEWIGSK

SEQ ID NO: 2676952 - protein, 23 aa, Entamoeba histolytica
GIDLLKFLCNSFVLLNGTFTQQF

SEQ ID NO: 2676953 - protein, 22 aa, Entamoeba histolytica
GIDLLNKMLCCYPNKRIDAKEA

SEQ ID NO: 2676954 - protein, 20 aa, Entamoeba histolytica
GIEAFSMEPLFSILSIAEKK

SEQ ID NO: 2676955 - protein, 18 aa, Entamoeba histolytica
GIECIGIEGKEEYVKAMK

SEQ ID NO: 2676956 - protein, 24 aa, Entamoeba histolytica
GIEELNIWSKMEMAGILKKTGEKS

SEQ ID NO: 2676957 - protein, 18 aa, Entamoeba histolytica
GIEEYRILVSMEHACYPR

SEQ ID NO: 2676958 - protein, 24 aa, Entamoeba histolytica
GIEGEGYSSLMLLLTNMGRTDETI

SEQ ID NO: 2676959 - protein, 22 aa, Entamoeba histolytica
GIEGLCHSGIFHAGKRRFVALA

SEQ ID NO: 2676960 - protein, 21 aa, Entamoeba histolytica
GIEIFLTFLCGGWKKNRLSGT

SEQ ID NO: 2676961 - protein, 32 aa, Entamoeba histolytica
GIEKYIYPPAIPKLKGNWLIDKEKSGSSSLFI

SEQ ID NO: 2676962 - protein, 25 aa, Entamoeba histolytica
GIELYEYYMKLILNIDQYVGLEETR

SEQ ID NO: 2676963 - protein, 20 aa, Entamoeba histolytica
GIEYLKPMLTTCGIILLENT

SEQ ID NO: 2676964 - protein, 19 aa, Entamoeba histolytica
GIFERKGKLVLQMEEIIPP

SEQ ID NO: 2676965 - protein, 26 aa, Entamoeba histolytica
GIFKALMPHVCDFEKVFTTRKVGSIT

SEQ ID NO: 2676966 - protein, 27 aa, Entamoeba histolytica
GIFLRNYILDCVKSILPSSTTEEPSEG

SEQ ID NO: 2676967 - protein, 18 aa, Entamoeba histolytica
GIFMARLDFIIANEQEFN

SEQ ID NO: 2676968 - protein, 24 aa, Entamoeba histolytica
GIFPLKDTIDAIGFYNLPTSVTVR

SEQ ID NO: 2676969 - protein, 18 aa, Entamoeba histolytica
GIGFAGLFNVTPYVILQS

SEQ ID NO: 2676970 - protein, 18 aa, Entamoeba histolytica
GIGFHVADILLLELTIAF

SEQ ID NO: 2676971 - protein, 18 aa, Entamoeba histolytica
GIGFPRKYPLMCIDRKEK

SEQ ID NO: 2676972 - protein, 21 aa, Entamoeba histolytica
GIGGILRYQLSMDELDDNFNM

SEQ ID NO: 2676973 - protein, 19 aa, Entamoeba histolytica
GIGKDCFKSSLIRLMTIPN

SEQ ID NO: 2676974 - protein, 20 aa, Entamoeba histolytica
GIGRSSCEPFSYEYNGDKHP

SEQ ID NO: 2676975 - protein, 20 aa, Entamoeba histolytica
GIHPRLLVEGIELARQHLFD

SEQ ID NO: 2676976 - protein, 21 aa, Entamoeba histolytica
GIHPRLLVEGIELARQHLFDY

SEQ ID NO: 2676977 - protein, 18 aa, Entamoeba histolytica
GIHPSLIITNDWFTGMVP

SEQ ID NO: 2676978 - protein, 19 aa, Entamoeba histolytica
GIIDSKCKGGYHFELSKDD

SEQ ID NO: 2676979 - protein, 24 aa, Entamoeba histolytica
GIIGDIQFFNGIIVIAFKKEIYRI

SEQ ID NO: 2676980 - protein, 25 aa, Entamoeba histolytica
GIIPKNKLDVIFLHFPDVQSMNSSF

SEQ ID NO: 2676981 - protein, 18 aa, Entamoeba histolytica
GIISESGVFYNLTTQILK

SEQ ID NO: 2676982 - protein, 18 aa, Entamoeba histolytica
GIISQCKEELVLKRMNDI

SEQ ID NO: 2676983 - protein, 18 aa, Entamoeba histolytica
GIIVCSFYDFGIDILCNI

SEQ ID NO: 2676984 - protein, 23 aa, Entamoeba histolytica
GIKCILQAIIFSRLVEKFPTLLE

SEQ ID NO: 2676985 - protein, 23 aa, Entamoeba histolytica
GIKELRAGYLSYWNLINQKKREA

SEQ ID NO: 2676986 - protein, 21 aa, Entamoeba histolytica
GIKGIDRRGNIFSKRESSRFD

SEQ ID NO: 2676987 - protein, 24 aa, Entamoeba histolytica
GIKHILCVAPLIPSLFPNEFDYKN

SEQ ID NO: 2676988 - protein, 23 aa, Entamoeba histolytica
GIKIEELQQFLPLEEKQEREEAI

SEQ ID NO: 2676989 - protein, 22 aa, Entamoeba histolytica
GIKKASDIAHLIHKVLFGTPGS

SEQ ID NO: 2676990 - protein, 24 aa, Entamoeba histolytica
GIKLKRKPSLLSWFNKEELIDVDN

SEQ ID NO: 2676991 - protein, 21 aa, Entamoeba histolytica
GIKLLYEIFCLFIRAETKVYQ

SEQ ID NO: 2676992 - protein, 21 aa, Entamoeba histolytica
GIKPPRGILLYGPPGCGKTMI

SEQ ID NO: 2676993 - protein, 23 aa, Entamoeba histolytica
GIKQKRIESYRCLESLLEDNETP

SEQ ID NO: 2676994 - protein, 20 aa, Entamoeba histolytica
GIKREEGMELALIPQSDKKT

SEQ ID NO: 2676995 - protein, 22 aa, Entamoeba histolytica
GIKRWPHRKLQRIEGEIKKIDE

SEQ ID NO: 2676996 - protein, 17 aa, Entamoeba histolytica
GILIRRSFHNTGVDIVR

SEQ ID NO: 2676997 - protein, 18 aa, Entamoeba histolytica
GILIRYTYPEGILSINFN

SEQ ID NO: 2676998 - protein, 18 aa, Entamoeba histolytica
GILNTILELCRLNNCQEL

SEQ ID NO: 2676999 - protein, 19 aa, Entamoeba histolytica
GILPEILENLLAARKQAKK

SEQ ID NO: 2677000 - protein, 26 aa, Entamoeba histolytica
GILVSKGKLGLGIRQYYYIKGKNLMI

SEQ ID NO: 2677001 - protein, 23 aa, Entamoeba histolytica
GILYQPRLTKIIPARDLVPEKIL

SEQ ID NO: 2677002 - protein, 23 aa, Entamoeba histolytica
GIMENCNGLILGSVLRAVTPNVK

SEQ ID NO: 2677003 - protein, 19 aa, Entamoeba histolytica
GIMNMRYGDFQKFVLQFIS

SEQ ID NO: 2677004 - protein, 23 aa, Entamoeba histolytica
GIMNRCKIRLAFISKNNIGYLEE

SEQ ID NO: 2677005 - protein, 26 aa, Entamoeba histolytica
GINAVRWVGGVELELLAIATGARIVP

SEQ ID NO: 2677006 - protein, 20 aa, Entamoeba histolytica
GINGVEVFMLLIALKVKYPR

SEQ ID NO: 2677007 - protein, 18 aa, Entamoeba histolytica
GINKLGDMMRGMMLNENI

SEQ ID NO: 2677008 - protein, 17 aa, Entamoeba histolytica
GINRMVLLKCVDLYKDL

SEQ ID NO: 2677009 - protein, 18 aa, Entamoeba histolytica
GIPIMTIWMHDIVNINCI

SEQ ID NO: 2677010 - protein, 20 aa, Entamoeba histolytica
GIPNEWKTDDLLNYFKQYSP

SEQ ID NO: 2677011 - protein, 19 aa, Entamoeba histolytica
GIQKPRFGEKLNKEATIVL

SEQ ID NO: 2677012 - protein, 18 aa, Entamoeba histolytica
GIQQCWAAHMIGHEVTTY

SEQ ID NO: 2677013 - protein, 17 aa, Entamoeba histolytica
GIQQTNPLDAFKNAGLF

SEQ ID NO: 2677014 - protein, 27 aa, Entamoeba histolytica
GIQRNQIRPSLQRHFAELSLNTKKFET

SEQ ID NO: 2677015 - protein, 19 aa, Entamoeba histolytica
GIQVTLSFTDSVFIDQCYF

SEQ ID NO: 2677016 - protein, 19 aa, Entamoeba histolytica
GIRAFIPEALRVMKHSDQI

SEQ ID NO: 2677017 - protein, 18 aa, Entamoeba histolytica
GIRCISKCDFYLKQTRSQ

SEQ ID NO: 2677018 - protein, 21 aa, Entamoeba histolytica
GIRETDRWYYGGGLYMGKKMP

SEQ ID NO: 2677019 - protein, 19 aa, Entamoeba histolytica
GIRICQINGAIPFRQESFI

SEQ ID NO: 2677020 - protein, 18 aa, Entamoeba histolytica
GIRIKRSANLNSLVEELC

SEQ ID NO: 2677021 - protein, 22 aa, Entamoeba histolytica
GIRKEDCVVLSFSNGFEHSEDG

SEQ ID NO: 2677022 - protein, 21 aa, Entamoeba histolytica
GIRRILCSLMERISSYVSANP

SEQ ID NO: 2677023 - protein, 19 aa, Entamoeba histolytica
GISAIPFHPFNFVVTENKR

SEQ ID NO: 2677024 - protein, 19 aa, Entamoeba histolytica
GISELFTLVGDLLADNQII

SEQ ID NO: 2677025 - protein, 40 aa, Entamoeba histolytica
GISFLDVKYSLLFEYNMYLAYYCWIKSSGSNVERHKAIER

SEQ ID NO: 2677026 - protein, 19 aa, Entamoeba histolytica
GISGIPAKVFSCIRTTLEH

SEQ ID NO: 2677027 - protein, 17 aa, Entamoeba histolytica
GISLEWCLNDFFKENIL

SEQ ID NO: 2677028 - protein, 20 aa, Entamoeba histolytica
GISRIIYLDVFRTLKSPVYQ

SEQ ID NO: 2677029 - protein, 24 aa, Entamoeba histolytica
GISRPVGYGGKLINGFNIPPPQPD

SEQ ID NO: 2677030 - protein, 18 aa, Entamoeba histolytica
GISSKLKALLIFDQSYYY

SEQ ID NO: 2677031 - protein, 20 aa, Entamoeba histolytica
GISVFPVHYSDGIIPIELPK

SEQ ID NO: 2677032 - protein, 17 aa, Entamoeba histolytica
GISYSFMYKWIILLFRR

SEQ ID NO: 2677033 - protein, 23 aa, Entamoeba histolytica
GITCAGFLPDARKLFKKANEEAE

SEQ ID NO: 2677034 - protein, 22 aa, Entamoeba histolytica
GITCAGFLPDARKLVKKANEEA

SEQ ID NO: 2677035 - protein, 35 aa, Entamoeba histolytica
GITEECQRMAFLIGLLNYRGVGFIIAKRPKKAEKA

SEQ ID NO: 2677036 - protein, 26 aa, Entamoeba histolytica
GITEPFIWYYYCVGFYGEKAFEKDHK

SEQ ID NO: 2677037 - protein, 23 aa, Entamoeba histolytica
GITHLRLLIQVSKEVKRCVESID

SEQ ID NO: 2677038 - protein, 19 aa, Entamoeba histolytica
GITMHKNCFRCSVCKKTLN

SEQ ID NO: 2677039 - protein, 33 aa, Entamoeba histolytica
GITRKQLSISLLDWCLTQPAGMAMKKAIHTSIS

SEQ ID NO: 2677040 - protein, 19 aa, Entamoeba histolytica
GITRPPFVQLLLKVNPAMY

SEQ ID NO: 2677041 - protein, 25 aa, Entamoeba histolytica
GIVGETYIRMIIHLPISNKEKMEKI

SEQ ID NO: 2677042 - protein, 29 aa, Entamoeba histolytica
GIVRRKSYKKMLVCNDIIFIVVDNCKKSF

SEQ ID NO: 2677043 - protein, 26 aa, Entamoeba histolytica
GIVTSLKARCSVIAAANPKTGKYNPN

SEQ ID NO: 2677044 - protein, 20 aa, Entamoeba histolytica
GIVVKCMQRGYWLMMENVNF

SEQ ID NO: 2677045 - protein, 25 aa, Entamoeba histolytica
GIVVWPCIAEILPQYVFNDRNPIIC

SEQ ID NO: 2677046 - protein, 17 aa, Entamoeba histolytica
GIVYDFTPGRTMDYNEF

SEQ ID NO: 2677047 - protein, 19 aa, Entamoeba histolytica
GIVYFKYFFDLSDLTLEQL

SEQ ID NO: 2677048 - protein, 20 aa, Entamoeba histolytica
GIWKECNKSSFLFINNNQIN

SEQ ID NO: 2677049 - protein, 18 aa, Entamoeba histolytica
GIYMKWKGRELVRENPTL

SEQ ID NO: 2677050 - protein, 20 aa, Entamoeba histolytica
GKADRKYVVMIFNDSIIIIK

SEQ ID NO: 2677051 - protein, 20 aa, Entamoeba histolytica
GKAEGLIRILSIEEHGDIID

SEQ ID NO: 2677052 - protein, 22 aa, Entamoeba histolytica
GKAGEQIIEFTIQINQNGMMKL

SEQ ID NO: 2677053 - protein, 26 aa, Entamoeba histolytica
GKAIMYCFRYAFSLLDEGEQNNGLVD

SEQ ID NO: 2677054 - protein, 21 aa, Entamoeba histolytica
GKALSELHIDCNFNGKLIGVG

SEQ ID NO: 2677055 - protein, 20 aa, Entamoeba histolytica
GKASEYGIPFGLNEDEVHIV

SEQ ID NO: 2677056 - protein, 17 aa, Entamoeba histolytica
GKASYGIYLFLEKNNIR

SEQ ID NO: 2677057 - protein, 21 aa, Entamoeba histolytica
GKCLNTKYPKCCECNQEMKPM

SEQ ID NO: 2677058 - protein, 19 aa, Entamoeba histolytica
GKCRLECKKTCPINRAGGL

SEQ ID NO: 2677059 - protein, 21 aa, Entamoeba histolytica
GKCVCGDCSLIRLPQPPLNTF

SEQ ID NO: 2677060 - protein, 17 aa, Entamoeba histolytica
GKCYRLYTEKAYLNEMP

SEQ ID NO: 2677061 - protein, 20 aa, Entamoeba histolytica
GKDEIKGSCLENINVDNCLT

SEQ ID NO: 2677062 - protein, 18 aa, Entamoeba histolytica
GKDIDLSTSMFIIKSNII

SEQ ID NO: 2677063 - protein, 24 aa, Entamoeba histolytica
GKDKKEIGCIISSMKQKEKLKVIK

SEQ ID NO: 2677064 - protein, 20 aa, Entamoeba histolytica
GKDKSKCYMLGYIPPQYKNG

SEQ ID NO: 2677065 - protein, 23 aa, Entamoeba histolytica
GKDLCKNKAFGVKYLLKTNKKHP

SEQ ID NO: 2677066 - protein, 29 aa, Entamoeba histolytica
GKDMLQELCVLKGKLCWIIYVDVVVVEDD

SEQ ID NO: 2677067 - protein, 19 aa, Entamoeba histolytica
GKDNTIWMVDPFMMRVVQK

SEQ ID NO: 2677068 - protein, 25 aa, Entamoeba histolytica
GKDSRNFHCWGYYLWVLEQGKISQE

SEQ ID NO: 2677069 - protein, 19 aa, Entamoeba histolytica
GKDVVSIDCEICIDEKYVW

SEQ ID NO: 2677070 - protein, 26 aa, Entamoeba histolytica
GKDYNCLIDVWSLGIMCREMMEGYPP

SEQ ID NO: 2677071 - protein, 17 aa, Entamoeba histolytica
GKECFLSCELLENIFLP

SEQ ID NO: 2677072 - protein, 25 aa, Entamoeba histolytica
GKECWEYAKELECIDTLIEYTPKEQ

SEQ ID NO: 2677073 - protein, 17 aa, Entamoeba histolytica
GKEFFDQIAQKFDSRPC

SEQ ID NO: 2677074 - protein, 24 aa, Entamoeba histolytica
GKEFKPDSVFKFNMSFKPKMTKLS

SEQ ID NO: 2677075 - protein, 24 aa, Entamoeba histolytica
GKEGRFKILVELFGKTDDSELKAT

SEQ ID NO: 2677076 - protein, 23 aa, Entamoeba histolytica
GKEIKCIVHRKGATRAFAPLNPV

SEQ ID NO: 2677077 - protein, 18 aa, Entamoeba histolytica
GKEIKERKILKEKEEENK

SEQ ID NO: 2677078 - protein, 29 aa, Entamoeba histolytica
GKEKGRIRLCSTCLQFIVNEIYIRYLKIF

SEQ ID NO: 2677079 - protein, 20 aa, Entamoeba histolytica
GKESILFICIADGIRFGCFH

SEQ ID NO: 2677080 - protein, 19 aa, Entamoeba histolytica
GKEVCLFENIGFLSPKGHY

SEQ ID NO: 2677081 - protein, 19 aa, Entamoeba histolytica
GKEVKFVFESKCWKEVIKK

SEQ ID NO: 2677082 - protein, 19 aa, Entamoeba histolytica
GKEVLTILSEMWKKLDPVE

SEQ ID NO: 2677083 - protein, 18 aa, Entamoeba histolytica
GKEYVCICKFHEAISDEQ

SEQ ID NO: 2677084 - protein, 17 aa, Entamoeba histolytica
GKFFVRYYAPWCGFCKM

SEQ ID NO: 2677085 - protein, 23 aa, Entamoeba histolytica
GKFGIEVMCLLYLFKIQFPNQFF

SEQ ID NO: 2677086 - protein, 19 aa, Entamoeba histolytica
GKFKVGVTAVIRVTLKNGV

SEQ ID NO: 2677087 - protein, 19 aa, Entamoeba histolytica
GKFLHAAETVMVFKATSTT

SEQ ID NO: 2677088 - protein, 21 aa, Entamoeba histolytica
GKGAFGKVFLCNKINTKEEVA

SEQ ID NO: 2677089 - protein, 23 aa, Entamoeba histolytica
GKGANFPPYAFVKFTDEKSAGLA

SEQ ID NO: 2677090 - protein, 19 aa, Entamoeba histolytica
GKGARPLCCVKEIVKKQMT

SEQ ID NO: 2677091 - protein, 18 aa, Entamoeba histolytica
GKGDLEFNDPIPKKNIIT

SEQ ID NO: 2677092 - protein, 24 aa, Entamoeba histolytica
GKGFEVKDAIALLRMDDIFVDSFE

SEQ ID NO: 2677093 - protein, 19 aa, Entamoeba histolytica
GKGFGFVTEYLRGEEVSEI

SEQ ID NO: 2677094 - protein, 21 aa, Entamoeba histolytica
GKGGESVWLGIIDLELNQNHL

SEQ ID NO: 2677095 - protein, 28 aa, Entamoeba histolytica
GKGKVCKSLFMKYLRQQPNWNIKVETKV

SEQ ID NO: 2677096 - protein, 17 aa, Entamoeba histolytica
GKGPVKFTIHCVNKVGT

SEQ ID NO: 2677097 - protein, 39 aa, Entamoeba histolytica
GKGRFKYVPEFLFKFLLWLRKWLYPRNFLGGLFVDNHDM

SEQ ID NO: 2677098 - protein, 31 aa, Entamoeba histolytica
GKGRGVICCRPIKAGELVFKERASILYIGPE

SEQ ID NO: 2677099 - protein, 21 aa, Entamoeba histolytica
GKGWCEVCGNKLLSKSMYCTQ

SEQ ID NO: 2677100 - protein, 20 aa, Entamoeba histolytica
GKGYIFIFPKNTWGYVNEYC

SEQ ID NO: 2677101 - protein, 26 aa, Entamoeba histolytica
GKHDIAIKIALRIGIEDLSKMLLTLI

SEQ ID NO: 2677102 - protein, 19 aa, Entamoeba histolytica
GKHGRFRGNLLGKRVDFSG

SEQ ID NO: 2677103 - protein, 18 aa, Entamoeba histolytica
GKHLKLTLPNSLQSCSLN

SEQ ID NO: 2677104 - protein, 40 aa, Entamoeba histolytica
GKHPKWMERTSGCTFGFGGRMGIFKGKEVLLKKMVGTVSI

SEQ ID NO: 2677105 - protein, 20 aa, Entamoeba histolytica
GKIALDLMKKFSLLTPDNVE

SEQ ID NO: 2677106 - protein, 21 aa, Entamoeba histolytica
GKICSAFSVLFNIDLTRQCIQ

SEQ ID NO: 2677107 - protein, 25 aa, Entamoeba histolytica
GKIDFKYKANFCINWLNIMENDKEK

SEQ ID NO: 2677108 - protein, 19 aa, Entamoeba histolytica
GKIDNMMLEAMELVKEESS

SEQ ID NO: 2677109 - protein, 17 aa, Entamoeba histolytica
GKIEELFLWAFKEENCN

SEQ ID NO: 2677110 - protein, 23 aa, Entamoeba histolytica
GKIEGFLPLTGTAFVAWGDKVQL

SEQ ID NO: 2677111 - protein, 19 aa, Entamoeba histolytica
GKIFKQIIWYDVSYSRYLE

SEQ ID NO: 2677112 - protein, 19 aa, Entamoeba histolytica
GKIFKQIIWYKVNYSRYLL

SEQ ID NO: 2677113 - protein, 23 aa, Entamoeba histolytica
GKIFKQIIWYKVSYSRYLKEKEE

SEQ ID NO: 2677114 - protein, 24 aa, Entamoeba histolytica
GKIFKQMIWYKVEYSTYLKEKEQG

SEQ ID NO: 2677115 - protein, 23 aa, Entamoeba histolytica
GKIGKGLLLYFGINEEDKESDID

SEQ ID NO: 2677116 - protein, 18 aa, Entamoeba histolytica
GKIIKGFIKAFSNNSNPD

SEQ ID NO: 2677117 - protein, 18 aa, Entamoeba histolytica
GKIIKYVIWYKVEYSRYL

SEQ ID NO: 2677118 - protein, 29 aa, Entamoeba histolytica
GKIKDICRICLKGGVAVVGVGFPACTPTS

SEQ ID NO: 2677119 - protein, 25 aa, Entamoeba histolytica
GKIKEVMCCLELSQIDMVLEFLIKN

SEQ ID NO: 2677120 - protein, 19 aa, Entamoeba histolytica
GKILLPIIQNFSLIKNQQM

SEQ ID NO: 2677121 - protein, 20 aa, Entamoeba histolytica
GKILPKLLIRTLFHNIDQVM

SEQ ID NO: 2677122 - protein, 17 aa, Entamoeba histolytica
GKINAALEIAKKKKEEK

SEQ ID NO: 2677123 - protein, 19 aa, Entamoeba histolytica
GKIPLEYAVQLQLPLLVKL

SEQ ID NO: 2677124 - protein, 19 aa, Entamoeba histolytica
GKIPVINKFFRDVSLIDPQ

SEQ ID NO: 2677125 - protein, 17 aa, Entamoeba histolytica
GKIRLVRFYNHMKEEEQ

SEQ ID NO: 2677126 - protein, 17 aa, Entamoeba histolytica
GKISRQALFSIFLDFIQ

SEQ ID NO: 2677127 - protein, 20 aa, Entamoeba histolytica
GKITCLYCTFDADKKEKPKG

SEQ ID NO: 2677128 - protein, 17 aa, Entamoeba histolytica
GKIYQFRGYDIANMTFI

SEQ ID NO: 2677129 - protein, 17 aa, Entamoeba histolytica
GKKECPEGYRVVNNIGE

SEQ ID NO: 2677130 - protein, 25 aa, Entamoeba histolytica
GKKEKIKFGFDRAFDSDSTQQDVFE

SEQ ID NO: 2677131 - protein, 17 aa, Entamoeba histolytica
GKKFFVVIVLPVFSEGQ

SEQ ID NO: 2677132 - protein, 17 aa, Entamoeba histolytica
GKKGMASAESMLKKLEE

SEQ ID NO: 2677133 - protein, 17 aa, Entamoeba histolytica
GKKGVANAEAMLKKLED

SEQ ID NO: 2677134 - protein, 17 aa, Entamoeba histolytica
GKKHLNIPKLEVQKTED

SEQ ID NO: 2677135 - protein, 17 aa, Entamoeba histolytica
GKKIMKDFVRYYPEYLW

SEQ ID NO: 2677136 - protein, 27 aa, Entamoeba histolytica
GKKKISLWVVCELLRIVVSSNLQEFDL

SEQ ID NO: 2677137 - protein, 24 aa, Entamoeba histolytica
GKKQFHASEPIEWDNVKKVSHPVE

SEQ ID NO: 2677138 - protein, 18 aa, Entamoeba histolytica
GKKQWPYSSIAVAMEVIP

SEQ ID NO: 2677139 - protein, 25 aa, Entamoeba histolytica
GKKRAFSCFVIGGLDNSLSVWVARK

SEQ ID NO: 2677140 - protein, 28 aa, Entamoeba histolytica
GKKRKPVVGCFFELLVLKTQGVIDLQQQ

SEQ ID NO: 2677141 - protein, 27 aa, Entamoeba histolytica
GKKRVPWTIICKYILKALAFINEKQYY

SEQ ID NO: 2677142 - protein, 20 aa, Entamoeba histolytica
GKKTFGFGFVNEKMEVVEKD

SEQ ID NO: 2677143 - protein, 26 aa, Entamoeba histolytica
GKKYGLIFMNRIRRVLGLSNTKENVF

SEQ ID NO: 2677144 - protein, 24 aa, Entamoeba histolytica
GKLAVLGCSVSLKVESFAQADTFM

SEQ ID NO: 2677145 - protein, 27 aa, Entamoeba histolytica
GKLCECCKEKTCFKCLKEISIEVQKEK

SEQ ID NO: 2677146 - protein, 26 aa, Entamoeba histolytica
GKLEPRFIFEGEIFLAAGEKALLVPI

SEQ ID NO: 2677147 - protein, 21 aa, Entamoeba histolytica
GKLGKGIYMYRTYKEAIEKNC

SEQ ID NO: 2677148 - protein, 23 aa, Entamoeba histolytica
GKLIKKLMIRYSKYNNKYENNIP

SEQ ID NO: 2677149 - protein, 17 aa, Entamoeba histolytica
GKLINGFNIPPPQPDSA

SEQ ID NO: 2677150 - protein, 18 aa, Entamoeba histolytica
GKLIPGHLKFHVLLTTYE

SEQ ID NO: 2677151 - protein, 29 aa, Entamoeba histolytica
GKLKEIKRLPGESFLHFLQRKAKQQKKIE

SEQ ID NO: 2677152 - protein, 25 aa, Entamoeba histolytica
GKLKKSECNFIPQSVTALTVLCGTT

SEQ ID NO: 2677153 - protein, 18 aa, Entamoeba histolytica
GKLLKPISLLISGMENSI

SEQ ID NO: 2677154 - protein, 18 aa, Entamoeba histolytica
GKLLLKGYKPGMKVCTRF

SEQ ID NO: 2677155 - protein, 28 aa, Entamoeba histolytica
GKLRIAYTCINLLIRGCSHSYNFYTQNN

SEQ ID NO: 2677156 - protein, 23 aa, Entamoeba histolytica
GKLRKEIANELGLVEDIPITYRA

SEQ ID NO: 2677157 - protein, 17 aa, Entamoeba histolytica
GKLSAWYHYESRPEFVE

SEQ ID NO: 2677158 - protein, 20 aa, Entamoeba histolytica
GKLTISRKLGVSINLGKTKF

SEQ ID NO: 2677159 - protein, 17 aa, Entamoeba histolytica
GKLVLWLANGTHYETDG

SEQ ID NO: 2677160 - protein, 17 aa, Entamoeba histolytica
GKLVLWLGNGTHYETDG

SEQ ID NO: 2677161 - protein, 18 aa, Entamoeba histolytica
GKLVLWLGNGTHYETDGY

SEQ ID NO: 2677162 - protein, 17 aa, Entamoeba histolytica
GKLYGVFEIHPQPSATR

SEQ ID NO: 2677163 - protein, 18 aa, Entamoeba histolytica
GKMAPECNTNARLLVEYF

SEQ ID NO: 2677164 - protein, 21 aa, Entamoeba histolytica
GKMGHFFKPDSFIFGHGGAGN

SEQ ID NO: 2677165 - protein, 18 aa, Entamoeba histolytica
GKMIELMAIFNSKLNPQF

SEQ ID NO: 2677166 - protein, 22 aa, Entamoeba histolytica
GKMPLQRLGDLLSIVEEGAKTI

SEQ ID NO: 2677167 - protein, 20 aa, Entamoeba histolytica
GKNAFGVLCEFAVRLYSNDL

SEQ ID NO: 2677168 - protein, 17 aa, Entamoeba histolytica
GKNAGVFVYENGKGLFA

SEQ ID NO: 2677169 - protein, 22 aa, Entamoeba histolytica
GKNGRQTIEFTIQYDQNGMMKL

SEQ ID NO: 2677170 - protein, 19 aa, Entamoeba histolytica
GKNIFEYNYIFLPFHQNSH

SEQ ID NO: 2677171 - protein, 19 aa, Entamoeba histolytica
GKNKRIIAVNIKRTEEIEK

SEQ ID NO: 2677172 - protein, 24 aa, Entamoeba histolytica
GKNSIEVITLLLLYKLKYPQSIFL

SEQ ID NO: 2677173 - protein, 19 aa, Entamoeba histolytica
GKPGNEVIVSFDEKIVNIM

SEQ ID NO: 2677174 - protein, 17 aa, Entamoeba histolytica
GKPILIETFKCYEVNND

SEQ ID NO: 2677175 - protein, 26 aa, Entamoeba histolytica
GKPQGRNELKFNIETQIKKLTQKRVN

SEQ ID NO: 2677176 - protein, 21 aa, Entamoeba histolytica
GKPYPLLYLWGEFFGTYEDVQ

SEQ ID NO: 2677177 - protein, 17 aa, Entamoeba histolytica
GKQGMASAESMLIRLEE

SEQ ID NO: 2677178 - protein, 19 aa, Entamoeba histolytica
GKQGWTISFIPLTLSVTNV

SEQ ID NO: 2677179 - protein, 19 aa, Entamoeba histolytica
GKQKIRMVKDLKSELKKGK

SEQ ID NO: 2677180 - protein, 22 aa, Entamoeba histolytica
GKQKIRMVKDLKSELKKGKISG

SEQ ID NO: 2677181 - protein, 18 aa, Entamoeba histolytica
GKQKIYWYNQSKLTDITP

SEQ ID NO: 2677182 - protein, 31 aa, Entamoeba histolytica
GKQLKAMDLRSSDPYVIVSVGIEQRKTKTVM

SEQ ID NO: 2677183 - protein, 34 aa, Entamoeba histolytica
GKQMKKRLEMMFGKIKIGILGLEEMKEEGKEDGY

SEQ ID NO: 2677184 - protein, 19 aa, Entamoeba histolytica
GKQTFRLLFDSSRDGLLPA

SEQ ID NO: 2677185 - protein, 29 aa, Entamoeba histolytica
GKQWQIECPMCFYRHSCNLSKQVIQLDKL

SEQ ID NO: 2677186 - protein, 25 aa, Entamoeba histolytica
GKRCECCKCHKDGITAFMLRCPGCL

SEQ ID NO: 2677187 - protein, 26 aa, Entamoeba histolytica
GKRGKKSVTISICFNTIATVGLTGSV

SEQ ID NO: 2677188 - protein, 23 aa, Entamoeba histolytica
GKRHKTHILKFYLVSSKMEMSVY

SEQ ID NO: 2677189 - protein, 18 aa, Entamoeba histolytica
GKRNELFAIGLRKKRFMS

SEQ ID NO: 2677190 - protein, 20 aa, Entamoeba histolytica
GKRNPFARLVECSWESLNSG

SEQ ID NO: 2677191 - protein, 28 aa, Entamoeba histolytica
GKRSGVEGFVPRSFVKIQKFVKPYRKEY

SEQ ID NO: 2677192 - protein, 30 aa, Entamoeba histolytica
GKSAEELWNYVELFASLDLENGKEGSDLDE

SEQ ID NO: 2677193 - protein, 30 aa, Entamoeba histolytica; identical to SEQ ID NO: 2473347

SEQ ID NO: 2677194 - protein, 17 aa, Entamoeba histolytica
GKSEMYLKPIVRRNDII

SEQ ID NO: 2677195 - protein, 24 aa, Entamoeba histolytica
GKSESRGFGYLDFFNVNEAQRCID

SEQ ID NO: 2677196 - protein, 20 aa, Entamoeba histolytica
GKSKGYGFVTFIRKEDAETA

SEQ ID NO: 2677197 - protein, 35 aa, Entamoeba histolytica
GKSLCIWCSSCRVYAFTVKRFMRITNETAKSHFIS

SEQ ID NO: 2677198 - protein, 22 aa, Entamoeba histolytica
GKSNLLLRFTRDEFDPEKKSTI

SEQ ID NO: 2677199 - protein, 23 aa, Entamoeba histolytica
GKSNLLLRFTRNEFDAEKRSTIG

SEQ ID NO: 2677200 - protein, 22 aa, Entamoeba histolytica
GKSNLLLRFTRNEFDPDKRSTI

SEQ ID NO: 2677201 - protein, 23 aa, Entamoeba histolytica
GKSNLLLRFTRNEFEPEKKFTIG

SEQ ID NO: 2677202 - protein, 20 aa, Entamoeba histolytica
GKSQYKTVCDNEFYQKLEAM

SEQ ID NO: 2677203 - protein, 19 aa, Entamoeba histolytica
GKSSLLKYIAEQQHMKMLS

SEQ ID NO: 2677204 - protein, 18 aa, Entamoeba histolytica
GKSTLMRVIATRNVAIPD

SEQ ID NO: 2677205 - protein, 24 aa, Entamoeba histolytica
GKSVEELRSTFGIINDFTKEEEAE

SEQ ID NO: 2677206 - protein, 18 aa, Entamoeba histolytica
GKSWRLLIQNSPFQSVVN

SEQ ID NO: 2677207 - protein, 20 aa, Entamoeba histolytica
GKTAAFSIGVLQQIDTNSKV

SEQ ID NO: 2677208 - protein, 22 aa, Entamoeba histolytica
GKTCLYNIWRGLNIPEEYIKTT

SEQ ID NO: 2677209 - protein, 22 aa, Entamoeba histolytica
GKTEEITRVISLVKSIQNDMNS

SEQ ID NO: 2677210 - protein, 28 aa, Entamoeba histolytica
GKTEFAIQEIFLKFNTFMLRGDSLFDAY

SEQ ID NO: 2677211 - protein, 24 aa, Entamoeba histolytica
GKTEFAIQEIFMKYPTFMLRGDSL

SEQ ID NO: 2677212 - protein, 19 aa, Entamoeba histolytica
GKTEFAIQEVFMKYNTFML

SEQ ID NO: 2677213 - protein, 17 aa, Entamoeba histolytica
GKTGLVLSSAGKGWINV

SEQ ID NO: 2677214 - protein, 20 aa, Entamoeba histolytica
GKTKGVPCDSFIIYDTKTDD

SEQ ID NO: 2677215 - protein, 19 aa, Entamoeba histolytica
GKTLAFLIPIVEILNKIHF

SEQ ID NO: 2677216 - protein, 18 aa, Entamoeba histolytica
GKTLAKNVKGWAVNKAAG

SEQ ID NO: 2677217 - protein, 19 aa, Entamoeba histolytica
GKTLFSYVNHVIGSKEIEV

SEQ ID NO: 2677218 - protein, 18 aa, Entamoeba histolytica
GKTLPQWLSQKKKKELRK

SEQ ID NO: 2677219 - protein, 27 aa, Entamoeba histolytica
GKTPRIIPKQCRLLMRSFEELHDSVRP

SEQ ID NO: 2677220 - protein, 19 aa, Entamoeba histolytica
GKTSLGHKMFELFQEYTNI

SEQ ID NO: 2677221 - protein, 20 aa, Entamoeba histolytica
GKTTCLNMIGLIDKPSHGKL

SEQ ID NO: 2677222 - protein, 23 aa, Entamoeba histolytica
GKTYVCTLNGLYVFTQCDNESIQ

SEQ ID NO: 2677223 - protein, 24 aa, Entamoeba histolytica
GKVEFPLSLPSLFIKMERSLLNPN

SEQ ID NO: 2677224 - protein, 17 aa, Entamoeba histolytica
GKVEIVTILAKRDQYKT

SEQ ID NO: 2677225 - protein, 17 aa, Entamoeba histolytica
GKVFIDCDYEELMEEKD

SEQ ID NO: 2677226 - protein, 20 aa, Entamoeba histolytica
GKVFLFSSCYHYQPFNYDIF

SEQ ID NO: 2677227 - protein, 23 aa, Entamoeba histolytica
GKVIELLEAIAFKEIDETSYCNE

SEQ ID NO: 2677228 - protein, 25 aa, Entamoeba histolytica
GKVIPNCLGNIWVYVRDWSEEDGRC

SEQ ID NO: 2677229 - protein, 23 aa, Entamoeba histolytica
GKVKKARLFIKISSTEGVVTGQS

SEQ ID NO: 2677230 - protein, 20 aa, Entamoeba histolytica
GKVKVLAKVGEMKRSVMVQS

SEQ ID NO: 2677231 - protein, 20 aa, Entamoeba histolytica
GKVPRALFHRVYKFVPLNKR

SEQ ID NO: 2677232 - protein, 19 aa, Entamoeba histolytica
GKVQVCSWNPVDGSILATG

SEQ ID NO: 2677233 - protein, 24 aa, Entamoeba histolytica
GKVSMLGFCKKYKFLEEKQKEEAN

SEQ ID NO: 2677234 - protein, 20 aa, Entamoeba histolytica
GKVSVHVIVKFAGQKEAKKE

SEQ ID NO: 2677235 - protein, 32 aa, Entamoeba histolytica
GKVWHHECFVCAKCGGKISGGFVNWDGKPVCK

SEQ ID NO: 2677236 - protein, 24 aa, Entamoeba histolytica
GKVWRMRACCIAFVNLAKVGAMTE

SEQ ID NO: 2677237 - protein, 25 aa, Entamoeba histolytica
GKYDFFTNCFWDIGVTLNIYIDKDL

SEQ ID NO: 2677238 - protein, 19 aa, Entamoeba histolytica
GKYEEAIELFKKCHKKEQK

SEQ ID NO: 2677239 - protein, 23 aa, Entamoeba histolytica
GKYFIEVFKACGIQEGAAEFIWA

SEQ ID NO: 2677240 - protein, 20 aa, Entamoeba histolytica
GKYFTSSCIIRGKVSTHDVE

SEQ ID NO: 2677241 - protein, 17 aa, Entamoeba histolytica
GKYGRFFHDSCPQVVPQ

SEQ ID NO: 2677242 - protein, 19 aa, Entamoeba histolytica
GKYHVIGFYCRDFSRVCPR

SEQ ID NO: 2677243 - protein, 24 aa, Entamoeba histolytica
GKYKEVKKQITNHNYAEVKEGENK

SEQ ID NO: 2677244 - protein, 27 aa, Entamoeba histolytica
GKYKLAMKTLDRLAGINIENHLEELQP

SEQ ID NO: 2677245 - protein, 17 aa, Entamoeba histolytica
GKYPRIIFRKRKEQQRC

SEQ ID NO: 2677246 - protein, 24 aa, Entamoeba histolytica
GKYQKCLCASLFFCQNRNGVIGIG

SEQ ID NO: 2677247 - protein, 18 aa, Entamoeba histolytica
GKYYGVWWGCKLVFDCMK

SEQ ID NO: 2677248 - protein, 20 aa, Entamoeba histolytica
GKYYVMYARIKGMRDEDIDV

SEQ ID NO: 2677249 - protein, 20 aa, Entamoeba histolytica
GKYYVWKLGEFLKRNPGAQK

SEQ ID NO: 2677250 - protein, 18 aa, Entamoeba histolytica
GLAAASFFARCNFKKIVV

SEQ ID NO: 2677251 - protein, 34 aa, Entamoeba histolytica
GLAHLIKAKVIPDCVSSIWVCCVDKRYENGRNGK

SEQ ID NO: 2677252 - protein, 18 aa, Entamoeba histolytica
GLALKGLVLYLNYKREFY

SEQ ID NO: 2677253 - protein, 18 aa, Entamoeba histolytica
GLANSWKLFAEALKKNTE

SEQ ID NO: 2677254 - protein, 18 aa, Entamoeba histolytica
GLASERLCVLHILYKNLF

SEQ ID NO: 2677255 - protein, 18 aa, Entamoeba histolytica
GLCSASIALSSKRFIDAD

SEQ ID NO: 2677256 - protein, 19 aa, Entamoeba histolytica
GLCYKSGKYKLAMKTLDRL

SEQ ID NO: 2677257 - protein, 17 aa, Entamoeba histolytica
GLDEKWCNSADCGLPKP

SEQ ID NO: 2677258 - protein, 29 aa, Entamoeba histolytica
GLDEMRESIKYIYELILSPPLSDRFTTFM

SEQ ID NO: 2677259 - protein, 26 aa, Entamoeba histolytica
GLDPFKVLRLHTAAVRAVDVHKILPL

SEQ ID NO: 2677260 - protein, 17 aa, Entamoeba histolytica
GLDVIVIEGIIPIKTIE

SEQ ID NO: 2677261 - protein, 17 aa, Entamoeba histolytica
GLEACVWENTTQIKVLE

SEQ ID NO: 2677262 - protein, 22 aa, Entamoeba histolytica
GLEDLKKALLLTVVGAPTRRMK

SEQ ID NO: 2677263 - protein, 17 aa, Entamoeba histolytica
GLEELKGMFPNIDSKLI

SEQ ID NO: 2677264 - protein, 17 aa, Entamoeba histolytica
GLEKRLPDIKKYFPENC

SEQ ID NO: 2677265 - protein, 17 aa, Entamoeba histolytica
GLEQLTGFADYRIPQVL

SEQ ID NO: 2677266 - protein, 17 aa, Entamoeba histolytica
GLETLKYLDGIFICTKY

SEQ ID NO: 2677267 - protein, 23 aa, Entamoeba histolytica
GLETSKLFPICVEYLHEHTLTGN

SEQ ID NO: 2677268 - protein, 24 aa, Entamoeba histolytica
GLETSKLFPICVEYLHEHTLTGNE

SEQ ID NO: 2677269 - protein, 20 aa, Entamoeba histolytica
GLFFYNEFNGAYLIYNILSN

SEQ ID NO: 2677270 - protein, 25 aa, Entamoeba histolytica
GLFGGDWRRSCILFEEECSSDWYVE

SEQ ID NO: 2677271 - protein, 19 aa, Entamoeba histolytica
GLFKPQMAKPFMNAMKEVT

SEQ ID NO: 2677272 - protein, 20 aa, Entamoeba histolytica
GLFLDMCTVVLKTLRHNQSV

SEQ ID NO: 2677273 - protein, 23 aa, Entamoeba histolytica
GLFLRWLKFTRFFESEDTLGSFL

SEQ ID NO: 2677274 - protein, 25 aa, Entamoeba histolytica
GLFNFSKLRAIGSIITLLHSLQKIQ

SEQ ID NO: 2677275 - protein, 17 aa, Entamoeba histolytica
GLFRIPGNMSVVNNLKK

SEQ ID NO: 2677276 - protein, 20 aa, Entamoeba histolytica
GLFYNCGFKEFDVPKGVSAI

SEQ ID NO: 2677277 - protein, 25 aa, Entamoeba histolytica
GLGPQRLTSIMPHYITPKDIMYVGI

SEQ ID NO: 2677278 - protein, 19 aa, Entamoeba histolytica
GLGRFLCTHGGISPQLQKL

SEQ ID NO: 2677279 - protein, 17 aa, Entamoeba histolytica
GLGRLAYEIASLGFQCE

SEQ ID NO: 2677280 - protein, 18 aa, Entamoeba histolytica
GLHAPAFSIFDIKWDDQS

SEQ ID NO: 2677281 - protein, 20 aa, Entamoeba histolytica
GLHCNNLCYSRNDFLLLNKI

SEQ ID NO: 2677282 - protein, 22 aa, Entamoeba histolytica
GLHGSFGCCIWFEKQKSCECIT

SEQ ID NO: 2677283 - protein, 17 aa, Entamoeba histolytica
GLIKESVSFIKSIDSVY

SEQ ID NO: 2677284 - protein, 21 aa, Entamoeba histolytica
GLIKIFCRIINGININCGYYE

SEQ ID NO: 2677285 - protein, 31 aa, Entamoeba histolytica
GLIKITRFCYSCLRIGSFYTNPECRNVDFLS

SEQ ID NO: 2677286 - protein, 18 aa, Entamoeba histolytica
GLINKGSIDIILFKRNCR

SEQ ID NO: 2677287 - protein, 18 aa, Entamoeba histolytica
GLIQCASLQSLDLENNQL

SEQ ID NO: 2677288 - protein, 20 aa, Entamoeba histolytica
GLIRHAALNYSRPVYLAPTT

SEQ ID NO: 2677289 - protein, 25 aa, Entamoeba histolytica
GLISFQFSYSYGMLCNVLLSDPLTL

SEQ ID NO: 2677290 - protein, 19 aa, Entamoeba histolytica
GLISFVLKAGISFEMGNGW

SEQ ID NO: 2677291 - protein, 25 aa, Entamoeba histolytica
GLKENVRGFGWKKCLGGSYEELYFP

SEQ ID NO: 2677292 - protein, 20 aa, Entamoeba histolytica
GLKEVMIQAVRVCVGNGHTK

SEQ ID NO: 2677293 - protein, 20 aa, Entamoeba histolytica
GLKRSIKYLLLKYGFECVRA

SEQ ID NO: 2677294 - protein, 24 aa, Entamoeba histolytica
GLLAEIMRSLSLFNDDMINKENYY

SEQ ID NO: 2677295 - protein, 18 aa, Entamoeba histolytica
GLLATFGYELKINKLYKK

SEQ ID NO: 2677296 - protein, 21 aa, Entamoeba histolytica
GLLKERISKIILNQFGTASPH

SEQ ID NO: 2677297 - protein, 17 aa, Entamoeba histolytica
GLLKLKIIDANMRITEH

SEQ ID NO: 2677298 - protein, 21 aa, Entamoeba histolytica
GLLNEVFHVIYIPLLRHPIIF

SEQ ID NO: 2677299 - protein, 19 aa, Entamoeba histolytica
GLLQLSSWRSYLHQIAMIV

SEQ ID NO: 2677300 - protein, 20 aa, Entamoeba histolytica
GLLSCAKKIVEWAQYISSAL

SEQ ID NO: 2677301 - protein, 23 aa, Entamoeba histolytica
GLLYCIKPTMFSTIKHRYFYIEK

SEQ ID NO: 2677302 - protein, 18 aa, Entamoeba histolytica
GLLYLLRSSGYSFTIRKT

SEQ ID NO: 2677303 - protein, 23 aa, Entamoeba histolytica
GLMLPETTGFCLMQKKNLYVPGS

SEQ ID NO: 2677304 - protein, 17 aa, Entamoeba histolytica
GLNDLGVRELVYKLSFI

SEQ ID NO: 2677305 - protein, 34 aa, Entamoeba histolytica
GLNKALRPLAWKIFLKIIKPQASEEWIEVMNKQR

SEQ ID NO: 2677306 - protein, 23 aa, Entamoeba histolytica
GLNKFKISICPQILQHFKEAYKS

SEQ ID NO: 2677307 - protein, 19 aa, Entamoeba histolytica
GLNLCLFETIFNWRQVNGL

SEQ ID NO: 2677308 - protein, 21 aa, Entamoeba histolytica
GLNSFNAWNRKFAKKKGLKSV

SEQ ID NO: 2677309 - protein, 22 aa, Entamoeba histolytica
GLNWDEMKQFFNTESLGKMKES

SEQ ID NO: 2677310 - protein, 28 aa, Entamoeba histolytica
GLNWLVFNWCRGKGCILADEMGLGKTVQ

SEQ ID NO: 2677311 - protein, 19 aa, Entamoeba histolytica
GLPDVRFKPAYNPYTEPSM

SEQ ID NO: 2677312 - protein, 17 aa, Entamoeba histolytica
GLPLKWGDIEFSKYFKK

SEQ ID NO: 2677313 - protein, 24 aa, Entamoeba histolytica
GLQMSIPCYERGFGCHSIDNSVCM

SEQ ID NO: 2677314 - protein, 20 aa, Entamoeba histolytica
GLQYGECIKTFKGHEGLITG

SEQ ID NO: 2677315 - protein, 25 aa, Entamoeba histolytica
GLSGPNLRNELRIENEESYEEEDDD

SEQ ID NO: 2677316 - protein, 20 aa, Entamoeba histolytica
GLSPQFYFDICMIYNEDSSI

SEQ ID NO: 2677317 - protein, 17 aa, Entamoeba histolytica
GLSQFAVIVSHLEPVCM

SEQ ID NO: 2677318 - protein, 26 aa, Entamoeba histolytica
GLSRFVVCGTAFVWHQVRYMVGALFA

SEQ ID NO: 2677319 - protein, 19 aa, Entamoeba histolytica
GLSSDPYCKVISRQCTQQT

SEQ ID NO: 2677320 - protein, 24 aa, Entamoeba histolytica
GLSSRWKCGIIIGTEITLNLVRYK

SEQ ID NO: 2677321 - protein, 19 aa, Entamoeba histolytica
GLTACSFNTLLKGKENILL

SEQ ID NO: 2677322 - protein, 17 aa, Entamoeba histolytica
GLTCRLGDFGFAKCFQN

SEQ ID NO: 2677323 - protein, 25 aa, Entamoeba histolytica
GLTFKCPKCNKISVKPVYFEEFQFE

SEQ ID NO: 2677324 - protein, 17 aa, Entamoeba histolytica
GLTKGPDSILFRSSEPF

SEQ ID NO: 2677325 - protein, 23 aa, Entamoeba histolytica
GLTTFLGCVILKIKGDDDKYAVA

SEQ ID NO: 2677326 - protein, 26 aa, Entamoeba histolytica
GLVDEFMLCVSIYGFGNMEPILKNNA

SEQ ID NO: 2677327 - protein, 25 aa, Entamoeba histolytica
GLVFVCPTCESFCCNRLASKKDGKL

SEQ ID NO: 2677328 - protein, 24 aa, Entamoeba histolytica
GLVGCSWVKVPAKRYVLVKDEANK

SEQ ID NO: 2677329 - protein, 24 aa, Entamoeba histolytica
GLVIEMIRMYGIRACELGPFGFEW

SEQ ID NO: 2677330 - protein, 26 aa, Entamoeba histolytica
GLVKPSVLVLFPFKTPAIIFIKTLLT

SEQ ID NO: 2677331 - protein, 25 aa, Entamoeba histolytica
GLVKSALPVLCMNQLVNGGLIALEA

SEQ ID NO: 2677332 - protein, 17 aa, Entamoeba histolytica
GLVMRWDYFNKPEIINT

SEQ ID NO: 2677333 - protein, 23 aa, Entamoeba histolytica
GLVNRLVKYSSIHMMTLKNFAMI

SEQ ID NO: 2677334 - protein, 20 aa, Entamoeba histolytica
GLVPLLRLAWNHFDPNFIAT

SEQ ID NO: 2677335 - protein, 23 aa, Entamoeba histolytica
GLVPRCLELLFQKKSKTASVSLS

SEQ ID NO: 2677336 - protein, 22 aa, Entamoeba histolytica
GLVSFKSYWSGVIAEELLNSTE

SEQ ID NO: 2677337 - protein, 19 aa, Entamoeba histolytica
GLVTIRIENEFGQSDSCVD

SEQ ID NO: 2677338 - protein, 26 aa, Entamoeba histolytica
GLVVGRRDFVHFRRIRGPEGIDKKKE

SEQ ID NO: 2677339 - protein, 17 aa, Entamoeba histolytica
GLYELASQLYVISNDET

SEQ ID NO: 2677340 - protein, 18 aa, Entamoeba histolytica
GLYGFSIGTIEGMYNSHG

SEQ ID NO: 2677341 - protein, 17 aa, Entamoeba histolytica
GLYQGIRGWGCNIFPTL

SEQ ID NO: 2677342 - protein, 19 aa, Entamoeba histolytica
GMCKGDPSTKEDLKQTWIN

SEQ ID NO: 2677343 - protein, 18 aa, Entamoeba histolytica
GMCLVKMPKIQEVKRMGI

SEQ ID NO: 2677344 - protein, 23 aa, Entamoeba histolytica
GMDFKGIFRFSPFANLKEIEEGT

SEQ ID NO: 2677345 - protein, 18 aa, Entamoeba histolytica
GMEDWKILKDITVLKWAL

SEQ ID NO: 2677346 - protein, 21 aa, Entamoeba histolytica
GMEFHCLITLLLQIIQTPPVS

SEQ ID NO: 2677347 - protein, 30 aa, Entamoeba histolytica
GMEFLKEWLAAPSFQEWKEHVVVDKALKFN

SEQ ID NO: 2677348 - protein, 19 aa, Entamoeba histolytica
GMEGLMMWVNALLDGSGIE

SEQ ID NO: 2677349 - protein, 18 aa, Entamoeba histolytica
GMELSRVYCLQVAVHSGE

SEQ ID NO: 2677350 - protein, 17 aa, Entamoeba histolytica
GMFNYKVFQEMKKNVII

SEQ ID NO: 2677351 - protein, 18 aa, Entamoeba histolytica
GMFRSCVPSGASTGVHEA

SEQ ID NO: 2677352 - protein, 30 aa, Entamoeba histolytica; identical to SEQ ID NO: 2483800

SEQ ID NO: 2677353 - protein, 18 aa, Entamoeba histolytica
GMIKMFNPRLHEVDLQKE

SEQ ID NO: 2677354 - protein, 17 aa, Entamoeba histolytica
GMISLGFEKMWTKLVNS

SEQ ID NO: 2677355 - protein, 29 aa, Entamoeba histolytica
GMKLMPGSIYVFKTIKGIEVIEGKDSNEE

SEQ ID NO: 2677356 - protein, 20 aa, Entamoeba histolytica
GMKQRFIKEITVLSPPTIQI

SEQ ID NO: 2677357 - protein, 21 aa, Entamoeba histolytica
GMKRFECREAVIEKLKEKGLY

SEQ ID NO: 2677358 - protein, 26 aa, Entamoeba histolytica
GMKRKEEWHPYLLFCKEHREELKQEG

SEQ ID NO: 2677359 - protein, 21 aa, Entamoeba histolytica
GMKTLPIRMQIHMENGLKVAK

SEQ ID NO: 2677360 - protein, 26 aa, Entamoeba histolytica
GMLHFLTYYYGMDWHKVANAPQGDNT

SEQ ID NO: 2677361 - protein, 19 aa, Entamoeba histolytica
GMMKCLYYNKAYPMPIRMF

SEQ ID NO: 2677362 - protein, 17 aa, Entamoeba histolytica
GMMYNCICLGNDGIEDI

SEQ ID NO: 2677363 - protein, 17 aa, Entamoeba histolytica
GMNECVDIVFGQQRQSQ

SEQ ID NO: 2677364 - protein, 27 aa, Entamoeba histolytica
GMNHPCVLDLKMGCRTWFEDSSPEKIK

SEQ ID NO: 2677365 - protein, 17 aa, Entamoeba histolytica
GMNKLHSNFAFSGSLDG

SEQ ID NO: 2677366 - protein, 18 aa, Entamoeba histolytica
GMNRSCLKSAKLGYEAKD

SEQ ID NO: 2677367 - protein, 20 aa, Entamoeba histolytica
GMNSICSKFIYDIVPTPIGI

SEQ ID NO: 2677368 - protein, 31 aa, Entamoeba histolytica
GMPGMPPPPPGFGFRPPGAPALKVQTTLSKL

SEQ ID NO: 2677369 - protein, 17 aa, Entamoeba histolytica
GMPGMPPPPPGMPGMPP

SEQ ID NO: 2677370 - protein, 20 aa, Entamoeba histolytica
GMPHDIRNVFVLTCNVSMEY

SEQ ID NO: 2677371 - protein, 18 aa, Entamoeba histolytica
GMPIKACADKLKTEIEKY

SEQ ID NO: 2677372 - protein, 21 aa, Entamoeba histolytica
GMPPPPPGMPGMPGMPPPPPG

SEQ ID NO: 2677373 - protein, 19 aa, Entamoeba histolytica
GMPPPPPGMPGMPPPPPGF

SEQ ID NO: 2677374 - protein, 21 aa, Entamoeba histolytica
GMSDLCGFLILILQEEEEVYW

SEQ ID NO: 2677375 - protein, 24 aa, Entamoeba histolytica
GMSKCFKGEQSGLVPTSNLMTIKD

SEQ ID NO: 2677376 - protein, 24 aa, Entamoeba histolytica
GMTPSIVGNPQFGMARTPIMRTNY

SEQ ID NO: 2677377 - protein, 26 aa, Entamoeba histolytica
GMYGFKFKLAFSEAYKIKVRSFKIPI

SEQ ID NO: 2677378 - protein, 18 aa, Entamoeba histolytica
GMYLKALPLLLNNIENLE

SEQ ID NO: 2677379 - protein, 27 aa, Entamoeba histolytica
GNARGILRLPTVFQMSTGCFYSTKDML

SEQ ID NO: 2677380 - protein, 17 aa, Entamoeba histolytica
GNARLTTRLNHSQFTKL

SEQ ID NO: 2677381 - protein, 19 aa, Entamoeba histolytica
GNCCICLEPITPSASSIQL

SEQ ID NO: 2677382 - protein, 24 aa, Entamoeba histolytica
GNCHQRQALAYAFVAVSKGNEEYT

SEQ ID NO: 2677383 - protein, 18 aa, Entamoeba histolytica
GNCQNCFHKESPFFSKEL

SEQ ID NO: 2677384 - protein, 25 aa, Entamoeba histolytica
GNDELPNLRTGVVAPNPMAMKYGRI

SEQ ID NO: 2677385 - protein, 29 aa, Entamoeba histolytica
GNDFMAKFNGSFCNLPLLEHLTFIDSPGV

SEQ ID NO: 2677386 - protein, 27 aa, Entamoeba histolytica
GNDGLEISCCREIIQPQIVVFDNLLND

SEQ ID NO: 2677387 - protein, 24 aa, Entamoeba histolytica
GNDIRLVGRYELQRKLGEGSEGCV

SEQ ID NO: 2677388 - protein, 24 aa, Entamoeba histolytica
GNDIWEMICRCWDIEPQKRPTFKE

SEQ ID NO: 2677389 - protein, 24 aa, Entamoeba histolytica
GNDIYRIFSDILYQTIIYKDHRLF

SEQ ID NO: 2677390 - protein, 24 aa, Entamoeba histolytica
GNDTWDLLYVALLMCGYDDLAERC

SEQ ID NO: 2677391 - protein, 25 aa, Entamoeba histolytica
GNEECLKMLIKRGCKMNEKNNKGIT

SEQ ID NO: 2677392 - protein, 18 aa, Entamoeba histolytica
GNEELLGIETLQLAFTRF

SEQ ID NO: 2677393 - protein, 18 aa, Entamoeba histolytica
GNEFKFVLQGFLNSLDGT

SEQ ID NO: 2677394 - protein, 22 aa, Entamoeba histolytica
GNEIGFYFSETYLFKFHYCDGT

SEQ ID NO: 2677395 - protein, 18 aa, Entamoeba histolytica
GNELFTLAGCSLKCLEDE

SEQ ID NO: 2677396 - protein, 18 aa, Entamoeba histolytica
GNEMIWYFMKYIRESNKI

SEQ ID NO: 2677397 - protein, 17 aa, Entamoeba histolytica
GNEMKKMNNVFNEMSLK

SEQ ID NO: 2677398 - protein, 18 aa, Entamoeba histolytica
GNENIKLIGVLATGYNNV

SEQ ID NO: 2677399 - protein, 18 aa, Entamoeba histolytica
GNERKFCYSISRRFILMF

SEQ ID NO: 2677400 - protein, 25 aa, Entamoeba histolytica
GNERRIREFMKLKYQDKKWFDQAAY

SEQ ID NO: 2677401 - protein, 17 aa, Entamoeba histolytica
GNFEFDGKFDGTVESNQ

SEQ ID NO: 2677402 - protein, 25 aa, Entamoeba histolytica
GNFIKKIPIEFTKLQTLHMFSIAYN

SEQ ID NO: 2677403 - protein, 18 aa, Entamoeba histolytica
GNFNEMIELLKLYIKTSC

SEQ ID NO: 2677404 - protein, 25 aa, Entamoeba histolytica
GNGAFGVVCKGMWLGTTPVAMKAID

SEQ ID NO: 2677405 - protein, 25 aa, Entamoeba histolytica
GNGAFGVVCKGMWLGTTPVAMKAVN

SEQ ID NO: 2677406 - protein, 19 aa, Entamoeba histolytica
GNGCYLVKVVDGILQGNYY

SEQ ID NO: 2677407 - protein, 19 aa, Entamoeba histolytica
GNGGVMLPDVHIGRDAMVA

SEQ ID NO: 2677408 - protein, 30 aa, Entamoeba histolytica
GNGIKIRKEDIFTIGGSVMKYIKGTFGKNE

SEQ ID NO: 2677409 - protein, 20 aa, Entamoeba histolytica
GNGKSSVGNFILKKNVFEVS

SEQ ID NO: 2677410 - protein, 21 aa, Entamoeba histolytica
GNGLTIQWIYSLLIKLISSPH

SEQ ID NO: 2677411 - protein, 24 aa, Entamoeba histolytica
GNGNSALDVLVQWAEQHGMNSIIS

SEQ ID NO: 2677412 - protein, 20 aa, Entamoeba histolytica
GNGTLCCSFYITKYQMIDKI

SEQ ID NO: 2677413 - protein, 18 aa, Entamoeba histolytica
GNGWVKVQWESSRNENRY

SEQ ID NO: 2677414 - protein, 20 aa, Entamoeba histolytica
GNGYCFPPLCCVQTEQMSKE

SEQ ID NO: 2677415 - protein, 24 aa, Entamoeba histolytica
GNHLNILNSLHLCVQISEGEEAKM

SEQ ID NO: 2677416 - protein, 21 aa, Entamoeba histolytica
GNHNPLDCKLQYDYIIKSQVY

SEQ ID NO: 2677417 - protein, 28 aa, Entamoeba histolytica
GNICLCDQEYKILLILRSFTFDKTGDKV

SEQ ID NO: 2677418 - protein, 26 aa, Entamoeba histolytica
GNIDIAFHISTWLPFMETNDQQLDKK

SEQ ID NO: 2677419 - protein, 24 aa, Entamoeba histolytica
GNIDRLGGFEAPPSFISVFVGEKL

SEQ ID NO: 2677420 - protein, 25 aa, Entamoeba histolytica
GNIFVYEIINLVQIRSYGRMEISSV

SEQ ID NO: 2677421 - protein, 28 aa, Entamoeba histolytica
GNIIACGGHSLFNWSFSPPSTFISNVSS

SEQ ID NO: 2677422 - protein, 23 aa, Entamoeba histolytica
GNIIKRWYGITLISVRGNLFYPR

SEQ ID NO: 2677423 - protein, 17 aa, Entamoeba histolytica
GNIILWDYFNNTPLISY

SEQ ID NO: 2677424 - protein, 21 aa, Entamoeba histolytica
GNIKFTLPMISSFTSVKTDQL

SEQ ID NO: 2677425 - protein, 20 aa, Entamoeba histolytica
GNILLAEAAAFEYRLTGKIE

SEQ ID NO: 2677426 - protein, 26 aa, Entamoeba histolytica
GNILPPSSIHPVLKVRKSDSRMKQLK

SEQ ID NO: 2677427 - protein, 18 aa, Entamoeba histolytica
GNINIVFICDRSGSMYGE

SEQ ID NO: 2677428 - protein, 17 aa, Entamoeba histolytica
GNKGAFALANLLKITKT

SEQ ID NO: 2677429 - protein, 23 aa, Entamoeba histolytica
GNKKEFRQFVVFKLCDTEEQDVI

SEQ ID NO: 2677430 - protein, 20 aa, Entamoeba histolytica
GNKRHIIFGGVRQKYVEYYD

SEQ ID NO: 2677431 - protein, 17 aa, Entamoeba histolytica
GNLFINYLYLLLKEYTY

SEQ ID NO: 2677432 - protein, 18 aa, Entamoeba histolytica
GNLHFPNWNLFEENDIIF

SEQ ID NO: 2677433 - protein, 17 aa, Entamoeba histolytica
GNLLKVVFIPNYSVSLA

SEQ ID NO: 2677434 - protein, 17 aa, Entamoeba histolytica
GNLSQIHIIFYDKVIIR

SEQ ID NO: 2677435 - protein, 27 aa, Entamoeba histolytica
GNLTLILGLLWTLILKYQIAQNKMDAS

SEQ ID NO: 2677436 - protein, 23 aa, Entamoeba histolytica
GNMNIKFGIFDKVKGILSIDKSN

SEQ ID NO: 2677437 - protein, 18 aa, Entamoeba histolytica
GNMTYQMFTINNVKKDDK

SEQ ID NO: 2677438 - protein, 17 aa, Entamoeba histolytica
GNNGGDGLVCGRYLSLF

SEQ ID NO: 2677439 - protein, 19 aa, Entamoeba histolytica
GNNIFGFNGEHHFLVMEYC

SEQ ID NO: 2677440 - protein, 23 aa, Entamoeba histolytica
GNNKLRKAIGLVQVLHSSFPELQ

SEQ ID NO: 2677441 - protein, 24 aa, Entamoeba histolytica
GNNLEFVDYLFLAMMVQIREPILE

SEQ ID NO: 2677442 - protein, 24 aa, Entamoeba histolytica
GNNNMGFGGGFGMTNTATGIGNNG

SEQ ID NO: 2677443 - protein, 18 aa, Entamoeba histolytica
GNNYGFPCLIGSRKLKED

SEQ ID NO: 2677444 - protein, 18 aa, Entamoeba histolytica
GNPPSAIFQFWASTDDLQ

SEQ ID NO: 2677445 - protein, 22 aa, Entamoeba histolytica
GNQCSCGKWISPALQIAISKVD

SEQ ID NO: 2677446 - protein, 21 aa, Entamoeba histolytica
GNRGRGRASFGGRDQQPSGEL

SEQ ID NO: 2677447 - protein, 18 aa, Entamoeba histolytica
GNRIKSIQVINNINKIYP

SEQ ID NO: 2677448 - protein, 19 aa, Entamoeba histolytica
GNRIKSIQVINNINKIYPI

SEQ ID NO: 2677449 - protein, 21 aa, Entamoeba histolytica
GNRKLLFEKKSDYNGNVLVEE

SEQ ID NO: 2677450 - protein, 18 aa, Entamoeba histolytica
GNRKRLYEGRDIVVLTYA

SEQ ID NO: 2677451 - protein, 22 aa, Entamoeba histolytica
GNRTYILGMVWTMILKYKINAN

SEQ ID NO: 2677452 - protein, 17 aa, Entamoeba histolytica
GNSCPRGAAYVRQEHIE

SEQ ID NO: 2677453 - protein, 18 aa, Entamoeba histolytica
GNSDIGGVVPKWIVNSMA

SEQ ID NO: 2677454 - protein, 24 aa, Entamoeba histolytica
GNSEIKSQVLSFFSSILKIYSGSG

SEQ ID NO: 2677455 - protein, 20 aa, Entamoeba histolytica
GNSIFKLYGNYLFSVIIRLD

SEQ ID NO: 2677456 - protein, 23 aa, Entamoeba histolytica
GNSNKIILCIGGLTNNLFNHQLF

SEQ ID NO: 2677457 - protein, 24 aa, Entamoeba histolytica
GNSSWILGAHCCFYIGSKDNSFIS

SEQ ID NO: 2677458 - protein, 24 aa, Entamoeba histolytica
GNTCYMNAVIQCIAHTKQFLEYSL

SEQ ID NO: 2677459 - protein, 18 aa, Entamoeba histolytica
GNTLFSRIYSLYLTEYCS

SEQ ID NO: 2677460 - protein, 17 aa, Entamoeba histolytica
GNTLYPGFAERLASGVQ

SEQ ID NO: 2677461 - protein, 20 aa, Entamoeba histolytica
GNTPFTRIFNSYTFKFCDEL

SEQ ID NO: 2677462 - protein, 25 aa, Entamoeba histolytica
GNTPLHLACAFGFLESVQKLIELGA

SEQ ID NO: 2677463 - protein, 32 aa, Entamoeba histolytica
GNVDSFCYFSFNKEKYFLVGDHSGRIILFNYM

SEQ ID NO: 2677464 - protein, 18 aa, Entamoeba histolytica
GNVGKTCMLMCYTSDEFP

SEQ ID NO: 2677465 - protein, 22 aa, Entamoeba histolytica
GNVKLTLGLVWTLILRFAISEL

SEQ ID NO: 2677466 - protein, 24 aa, Entamoeba histolytica
GNVKRYHKQIGMGFVTPAEAIKGT

SEQ ID NO: 2677467 - protein, 17 aa, Entamoeba histolytica
GNVLKENTSIVFGNIID

SEQ ID NO: 2677468 - protein, 17 aa, Entamoeba histolytica
GNVLKKYLNLMPNKLPI

SEQ ID NO: 2677469 - protein, 27 aa, Entamoeba histolytica
GNVLQVCVRKSLKMRGQAFVIYDTKES

SEQ ID NO: 2677470 - protein, 28 aa, Entamoeba histolytica
GNVLRLTLHMYGCRVVQKAVEYASMKDR

SEQ ID NO: 2677471 - protein, 22 aa, Entamoeba histolytica
GNVPRTKDVILLGDLIDKAQPG

SEQ ID NO: 2677472 - protein, 17 aa, Entamoeba histolytica
GNVQLVLLIGGTCEMPR

SEQ ID NO: 2677473 - protein, 18 aa, Entamoeba histolytica
GNVRVGLIGNEFKFGFIP

SEQ ID NO: 2677474 - protein, 19 aa, Entamoeba histolytica
GNVSAFASKFTQYAQKDQE

SEQ ID NO: 2677475 - protein, 24 aa, Entamoeba histolytica
GNVTCPMCKKLFVVPITLSCGHTF

SEQ ID NO: 2677476 - protein, 26 aa, Entamoeba histolytica
GNWEKEFKKWLGVERISVQTGSSDSS

SEQ ID NO: 2677477 - protein, 23 aa, Entamoeba histolytica
GNYKFPISYNEYLLFKSLGIHCN

SEQ ID NO: 2677478 - protein, 21 aa, Entamoeba histolytica
GNYPLHLSGYIVVDMTEATAA

SEQ ID NO: 2677479 - protein, 17 aa, Entamoeba histolytica
GNYSQWIEKILSPYDDV

SEQ ID NO: 2677480 - protein, 17 aa, Entamoeba histolytica
GNYSRVIDRLNILSNEA

SEQ ID NO: 2677481 - protein, 17 aa, Entamoeba histolytica
GNYVIQHLLEFGNDTIR

SEQ ID NO: 2677482 - protein, 19 aa, Entamoeba histolytica
GPCLVELLDSIKLVMGNPN

SEQ ID NO: 2677483 - protein, 23 aa, Entamoeba histolytica
GPDKQLMYFVKWVGLQYGECSWE

SEQ ID NO: 2677484 - protein, 25 aa, Entamoeba histolytica
GPEIIKSRLTGLGFVGTTQCTVDIL

SEQ ID NO: 2677485 - protein, 26 aa, Entamoeba histolytica
GPEIIKSRLTGLGFVGTTQCTVDILS

SEQ ID NO: 2677486 - protein, 23 aa, Entamoeba histolytica
GPEWIWPYGYYVMAMLMYNPDNL

SEQ ID NO: 2677487 - protein, 18 aa, Entamoeba histolytica
GPGIRGKYGRLAVGAING

SEQ ID NO: 2677488 - protein, 17 aa, Entamoeba histolytica
GPHYVVGCRSCIDKKKI

SEQ ID NO: 2677489 - protein, 17 aa, Entamoeba histolytica
GPIKGQIKFEQDEDFAL

SEQ ID NO: 2677490 - protein, 26 aa, Entamoeba histolytica
GPLQKFLIRRITLLRAHESDSELEEE

SEQ ID NO: 2677491 - protein, 17 aa, Entamoeba histolytica
GPLYRFFDWIFNKSPLM

SEQ ID NO: 2677492 - protein, 23 aa, Entamoeba histolytica
GPPGCGKTLLAKAVASQCKANFI

SEQ ID NO: 2677493 - protein, 23 aa, Entamoeba histolytica
GPPGCGKTLMARQIGKMVSSVEP

SEQ ID NO: 2677494 - protein, 22 aa, Entamoeba histolytica
GPPGCGKTTFIQALVKTYTKQN

SEQ ID NO: 2677495 - protein, 20 aa, Entamoeba histolytica
GPQLRRDCSIIMNKQGFEEP

SEQ ID NO: 2677496 - protein, 19 aa, Entamoeba histolytica
GPRMVRDVFRLARENAPSI

SEQ ID NO: 2677497 - protein, 17 aa, Entamoeba histolytica
GPSASWTNPVLTTPIYS

SEQ ID NO: 2677498 - protein, 22 aa, Entamoeba histolytica
GPSCFQPFSQRMMDTRLPNQCV

SEQ ID NO: 2677499 - protein, 18 aa, Entamoeba histolytica
GPSLKPFTCMIAGSYWAN

SEQ ID NO: 2677500 - protein, 26 aa, Entamoeba histolytica
GPSNMKLTYLESWKAVELSNALFGFD

SEQ ID NO: 2677501 - protein, 18 aa, Entamoeba histolytica
GPSYIYVCGCEGTWNIQF

SEQ ID NO: 2677502 - protein, 17 aa, Entamoeba histolytica
GPVSLVLVLVQGQYIIQ

SEQ ID NO: 2677503 - protein, 24 aa, Entamoeba histolytica
GPYIFWKEYSMKSISEVKCVNALF

SEQ ID NO: 2677504 - protein, 21 aa, Entamoeba histolytica
GQALDFRLISMYVKTRTPTQV

SEQ ID NO: 2677505 - protein, 24 aa, Entamoeba histolytica
GQCCFKRCYFLKEVICDQIQEIDK

SEQ ID NO: 2677506 - protein, 28 aa, Entamoeba histolytica
GQCIDALKMYKDRVNLLEQQLQEKQVTS

SEQ ID NO: 2677507 - protein, 20 aa, Entamoeba histolytica
GQEDFGIFCVTKQANVFGIF

SEQ ID NO: 2677508 - protein, 22 aa, Entamoeba histolytica
GQELRLKQEYFFSSATILDVMR

SEQ ID NO: 2677509 - protein, 23 aa, Entamoeba histolytica
GQESFQSIIPMYFRNASCIILVF

SEQ ID NO: 2677510 - protein, 20 aa, Entamoeba histolytica
GQGFLIAIGCISSINQQETI

SEQ ID NO: 2677511 - protein, 18 aa, Entamoeba histolytica
GQGTMWWIQRELDEKKKY

SEQ ID NO: 2677512 - protein, 17 aa, Entamoeba histolytica
GQIDWKNARQLLFLEFT

SEQ ID NO: 2677513 - protein, 20 aa, Entamoeba histolytica
GQIEVFTWSASGQVISEALS

SEQ ID NO: 2677514 - protein, 18 aa, Entamoeba histolytica
GQIPEGITDIGYKAFNGS

SEQ ID NO: 2677515 - protein, 24 aa, Entamoeba histolytica
GQKLHFYWMWWFYGRDEAFKLTQY

SEQ ID NO: 2677516 - protein, 18 aa, Entamoeba histolytica
GQKRKLEIIKECTEHGYF

SEQ ID NO: 2677517 - protein, 31 aa, Entamoeba histolytica; identical to SEQ ID NO: 2483986

SEQ ID NO: 2677518 - protein, 18 aa, Entamoeba histolytica
GQKVACGLLREIETGGCI

SEQ ID NO: 2677519 - protein, 25 aa, Entamoeba histolytica
GQLCKHPKELICFNKYFFDAVWRDS

SEQ ID NO: 2677520 - protein, 17 aa, Entamoeba histolytica
GQLKFQKKIVEWTNMRN

SEQ ID NO: 2677521 - protein, 23 aa, Entamoeba histolytica
GQLPRFILIKIIPYLKNISNVLH

SEQ ID NO: 2677522 - protein, 26 aa, Entamoeba histolytica
GQLVKGDIVPLRFFLKNLQLTPTLTN

SEQ ID NO: 2677523 - protein, 33 aa, Entamoeba histolytica; identical to SEQ ID NO: 2483998

SEQ ID NO: 2677524 - protein, 20 aa, Entamoeba histolytica
GQPGAYPGYPPQGGYPPQQP

SEQ ID NO: 2677525 - protein, 23 aa, Entamoeba histolytica
GQPMYQPRVGYQSEYIQPQVQQP

SEQ ID NO: 2677526 - protein, 31 aa, Entamoeba histolytica; identical to SEQ ID NO: 2484001

SEQ ID NO: 2677527 - protein, 21 aa, Entamoeba histolytica
GQSCIFGVCACSDRDCSNIRD

SEQ ID NO: 2677528 - protein, 21 aa, Entamoeba histolytica
GQSELCLRWQSLIELSLPPKT

SEQ ID NO: 2677529 - protein, 25 aa, Entamoeba histolytica
GQSFPINFSDSISFRGKDEKKDKLL

SEQ ID NO: 2677530 - protein, 17 aa, Entamoeba histolytica
GQSMCFCNLASSIFKGY

SEQ ID NO: 2677531 - protein, 18 aa, Entamoeba histolytica
GQSSMHWAAHSGYPNTIE

SEQ ID NO: 2677532 - protein, 27 aa, Entamoeba histolytica
GQSVFKLELPQIISFTLNNTLLAISTS

SEQ ID NO: 2677533 - protein, 31 aa, Entamoeba histolytica; identical to SEQ ID NO: 2484006

SEQ ID NO: 2677534 - protein, 20 aa, Entamoeba histolytica
GQTLMVLPFKNMIVATETKM

SEQ ID NO: 2677535 - protein, 18 aa, Entamoeba histolytica
GQTPPPVTHHPVVQENIP

SEQ ID NO: 2677536 - protein, 25 aa, Entamoeba histolytica
GQTPTLQRYAAWRGGAMIADTKSIQ

SEQ ID NO: 2677537 - protein, 27 aa, Entamoeba histolytica
GQVNSCYKIILDCSSSVLPFYEKCGLS

SEQ ID NO: 2677538 - protein, 18 aa, Entamoeba histolytica
GQVRLCLQTEDFSFIKTF

SEQ ID NO: 2677539 - protein, 20 aa, Entamoeba histolytica
GQVYFKVVRLPLASMELQIQ

SEQ ID NO: 2677540 - protein, 21 aa, Entamoeba histolytica
GQVYFKVVRLPLASMELQIQR

SEQ ID NO: 2677541 - protein, 22 aa, Entamoeba histolytica
GQYKGNCSKEFVTLTLNSIPNT

SEQ ID NO: 2677542 - protein, 19 aa, Entamoeba histolytica
GRAMKGFMIPLLKNIIKDF

SEQ ID NO: 2677543 - protein, 19 aa, Entamoeba histolytica
GRANLREKYNKRQELLNGE

SEQ ID NO: 2677544 - protein, 17 aa, Entamoeba histolytica
GRCAECLLYEVMSQCLG

SEQ ID NO: 2677545 - protein, 17 aa, Entamoeba histolytica
GRCRIGRMINERFICDS

SEQ ID NO: 2677546 - protein, 25 aa, Entamoeba histolytica
GRCYKFCPYGAIISKSVPCVKACPC

SEQ ID NO: 2677547 - protein, 19 aa, Entamoeba histolytica
GRDAMRWLDRALLRTCNKF

SEQ ID NO: 2677548 - protein, 18 aa, Entamoeba histolytica
GRDVFSLNAARFVFDGSI

SEQ ID NO: 2677549 - protein, 20 aa, Entamoeba histolytica
GREDAEFDPSVTMQTSVKPT

SEQ ID NO: 2677550 - protein, 19 aa, Entamoeba histolytica
GREEMKKIISRLVGLNKPW

SEQ ID NO: 2677551 - protein, 24 aa, Entamoeba histolytica
GRELLNQLVAISWKDEIIKSQVII

SEQ ID NO: 2677552 - protein, 26 aa, Entamoeba histolytica
GREVGRSCFILKYMGHNIMLDCGVHP

SEQ ID NO: 2677553 - protein, 30 aa, Entamoeba histolytica
GRFCYIFQRCFLDYHFLIFFIDNNGLSLLK

SEQ ID NO: 2677554 - protein, 17 aa, Entamoeba histolytica
GRFDHPNLLAVDHRRQE

SEQ ID NO: 2677555 - protein, 19 aa, Entamoeba histolytica
GRFLAKYGIINIVKKGKMI

SEQ ID NO: 2677556 - protein, 18 aa, Entamoeba histolytica
GRFMIVQSGFVFLTEQEL

SEQ ID NO: 2677557 - protein, 20 aa, Entamoeba histolytica
GRGGAAFIFKGKLKTKDNEE

SEQ ID NO: 2677558 - protein, 21 aa, Entamoeba histolytica
GRGGFSVVHRAIYKKTHEVVA

SEQ ID NO: 2677559 - protein, 20 aa, Entamoeba histolytica
GRGIYQRYFIKEVDMSKIKI

SEQ ID NO: 2677560 - protein, 21 aa, Entamoeba histolytica
GRGSFGIVFEGVYNSMKCAIK

SEQ ID NO: 2677561 - protein, 17 aa, Entamoeba histolytica
GRGSFWDIYCVRDPDDG

SEQ ID NO: 2677562 - protein, 17 aa, Entamoeba histolytica
GRHLSSCSFRNKSIENS

SEQ ID NO: 2677563 - protein, 18 aa, Entamoeba histolytica
GRHYKIFEYYGAADAERV

SEQ ID NO: 2677564 - protein, 17 aa, Entamoeba histolytica
GRIARLTGGVAVISVGG

SEQ ID NO: 2677565 - protein, 25 aa, Entamoeba histolytica
GRIDEWKLSLSFAEYLENQEDIEGA

SEQ ID NO: 2677566 - protein, 24 aa, Entamoeba histolytica
GRIFKQIIWYKVEYSRYLKEKNEM

SEQ ID NO: 2677567 - protein, 18 aa, Entamoeba histolytica
GRIIKHCQNVLNQITQKY

SEQ ID NO: 2677568 - protein, 17 aa, Entamoeba histolytica
GRIILFNYMTGVEIKSV

SEQ ID NO: 2677569 - protein, 19 aa, Entamoeba histolytica
GRIKKGLYGFSIGTIEGMY

SEQ ID NO: 2677570 - protein, 17 aa, Entamoeba histolytica
GRIKRVTECSMCHYSSD

SEQ ID NO: 2677571 - protein, 25 aa, Entamoeba histolytica
GRIKVWDMRQQKCVVVFNEHHDYIS

SEQ ID NO: 2677572 - protein, 19 aa, Entamoeba histolytica
GRIKYIFKQPFEYEMENAV

SEQ ID NO: 2677573 - protein, 19 aa, Entamoeba histolytica
GRIPASFNIIYISTKKGEE

SEQ ID NO: 2677574 - protein, 19 aa, Entamoeba histolytica
GRISIGRKGGRNSFSRRGR

SEQ ID NO: 2677575 - protein, 18 aa, Entamoeba histolytica
GRKCAKKIIFEFETEKKK

SEQ ID NO: 2677576 - protein, 21 aa, Entamoeba histolytica
GRKCAKKIIFEFETEKKKEEK

SEQ ID NO: 2677577 - protein, 17 aa, Entamoeba histolytica
GRKEYNARFIWIHREPI

SEQ ID NO: 2677578 - protein, 17 aa, Entamoeba histolytica
GRKGSFPVPELDPVIQI

SEQ ID NO: 2677579 - protein, 17 aa, Entamoeba histolytica
GRKGVAIDFITTEEMDT

SEQ ID NO: 2677580 - protein, 21 aa, Entamoeba histolytica
GRKSPFGLLCIKEEGIEANSD

SEQ ID NO: 2677581 - protein, 18 aa, Entamoeba histolytica
GRKVFMTEMLKHINQMLC

SEQ ID NO: 2677582 - protein, 21 aa, Entamoeba histolytica
GRLDELIGLACISPTIYKEFI

SEQ ID NO: 2677583 - protein, 20 aa, Entamoeba histolytica
GRLFNVPFMKIAKPNMKVII

SEQ ID NO: 2677584 - protein, 20 aa, Entamoeba histolytica
GRLIPHRSFTEAEWNEIAGN

SEQ ID NO: 2677585 - protein, 17 aa, Entamoeba histolytica
GRLVLDMWHIYKECSKF

SEQ ID NO: 2677586 - protein, 20 aa, Entamoeba histolytica
GRMNSLFTWAFEKELCNKGQ

SEQ ID NO: 2677587 - protein, 20 aa, Entamoeba histolytica
GRNCFKNCHSLREFIIPPSV

SEQ ID NO: 2677588 - protein, 19 aa, Entamoeba histolytica
GRNCLHYLCLNKLVNENLL

SEQ ID NO: 2677589 - protein, 22 aa, Entamoeba histolytica
GRNGCGKTTFLKLLIDALTPVE

SEQ ID NO: 2677590 - protein, 22 aa, Entamoeba histolytica
GRNRAPALLIAYLIQNNKMSFI

SEQ ID NO: 2677591 - protein, 17 aa, Entamoeba histolytica
GRPFISVSKVCQLIPIV

SEQ ID NO: 2677592 - protein, 17 aa, Entamoeba histolytica
GRPLGAPPRKPAAKPKH

SEQ ID NO: 2677593 - protein, 21 aa, Entamoeba histolytica
GRPTINWYKLFKNTSIGNYSI

SEQ ID NO: 2677594 - protein, 23 aa, Entamoeba histolytica
GRPYYQLPRIIENILIYLYNKGC

SEQ ID NO: 2677595 - protein, 25 aa, Entamoeba histolytica
GRQLKISMINLFKFISSQIKDVQEE

SEQ ID NO: 2677596 - protein, 24 aa, Entamoeba histolytica
GRQTRPELLVGICGEHGGEPSSIE

SEQ ID NO: 2677597 - protein, 25 aa, Entamoeba histolytica
GRQVFFYKRAQIVVSDIQGMCGCIK

SEQ ID NO: 2677598 - protein, 23 aa, Entamoeba histolytica
GRRDFTKTTGFYGAHFRMPPSYQ

SEQ ID NO: 2677599 - protein, 26 aa, Entamoeba histolytica
GRREYWRIVNNKVRIWDRSGKIEELS

SEQ ID NO: 2677600 - protein, 22 aa, Entamoeba histolytica
GRRGYPGYMYTDLASIYERAGR

SEQ ID NO: 2677601 - protein, 24 aa, Entamoeba histolytica
GRRKIPLRRLCDVCYQVTYDKKYY

SEQ ID NO: 2677602 - protein, 21 aa, Entamoeba histolytica
GRRNIFLALQYKRLFTQEEFL

SEQ ID NO: 2677603 - protein, 25 aa, Entamoeba histolytica
GRRSHKLFFINAIARIWKEVLQYDL

SEQ ID NO: 2677604 - protein, 21 aa, Entamoeba histolytica
GRRSLKRTGSCAELQPSLNVS

SEQ ID NO: 2677605 - protein, 20 aa, Entamoeba histolytica
GRRVLRYQNIKGRKRTYPIW

SEQ ID NO: 2677606 - protein, 19 aa, Entamoeba histolytica
GRSLLSYKNGTKIKTTPLN

SEQ ID NO: 2677607 - protein, 21 aa, Entamoeba histolytica
GRSRSATIVTAFIMKKYKIKL

SEQ ID NO: 2677608 - protein, 21 aa, Entamoeba histolytica
GRSSIILRFVLDKFVERYEPT

SEQ ID NO: 2677609 - protein, 18 aa, Entamoeba histolytica
GRSYDFNEVVRWFAERAD

SEQ ID NO: 2677610 - protein, 20 aa, Entamoeba histolytica
GRTDCFYEKYLCVWDYAAAS

SEQ ID NO: 2677611 - protein, 20 aa, Entamoeba histolytica
GRTLVALPFLQVVRIQLSEE

SEQ ID NO: 2677612 - protein, 20 aa, Entamoeba histolytica
GRVAGILLPHIIRYNAKAPI

SEQ ID NO: 2677613 - protein, 20 aa, Entamoeba histolytica
GRVAKILHIYQFTKIFVQCP

SEQ ID NO: 2677614 - protein, 17 aa, Entamoeba histolytica
GRVAPRSSLAIKYGIDI

SEQ ID NO: 2677615 - protein, 19 aa, Entamoeba histolytica
GRVGLKAEIVEPLDCNERG

SEQ ID NO: 2677616 - protein, 18 aa, Entamoeba histolytica
GRVLYCIGMKDSWEEMIE

SEQ ID NO: 2677617 - protein, 23 aa, Entamoeba histolytica
GRVYPLKLGYIGVLNRSQHDIDT

SEQ ID NO: 2677618 - protein, 18 aa, Entamoeba histolytica
GRYDALRSQYPMYQQQPQ

SEQ ID NO: 2677619 - protein, 22 aa, Entamoeba histolytica
GRYSSLYIRLLPVLKEVLDTKG

SEQ ID NO: 2677620 - protein, 24 aa, Entamoeba histolytica
GSAELKLLLKWRDIIVKKIKKEQE

SEQ ID NO: 2677621 - protein, 19 aa, Entamoeba histolytica
GSALLVLDIHCRLIENPVG

SEQ ID NO: 2677622 - protein, 26 aa, Entamoeba histolytica
GSAPPRLRSIPDLGFVDSEIPSPKHE

SEQ ID NO: 2677623 - protein, 26 aa, Entamoeba histolytica
GSASCLRIESKIHPIQTFYLDDIISF

SEQ ID NO: 2677624 - protein, 25 aa, Entamoeba histolytica
GSCCFENCSALRSFFIPLTVTSLNK

SEQ ID NO: 2677625 - protein, 24 aa, Entamoeba histolytica
GSCCIPLVKKTICDMFGEKKIIGF

SEQ ID NO: 2677626 - protein, 24 aa, Entamoeba histolytica
GSCIDGRLTSAWNWCSSVDKKEYY

SEQ ID NO: 2677627 - protein, 23 aa, Entamoeba histolytica
GSCKCPAIKAMLVDFFGKDKVDQ

SEQ ID NO: 2677628 - protein, 18 aa, Entamoeba histolytica
GSCWNDGRVVTAIIHSLF

SEQ ID NO: 2677629 - protein, 18 aa, Entamoeba histolytica
GSDAFFKFHSNSVYEEKS

SEQ ID NO: 2677630 - protein, 18 aa, Entamoeba histolytica
GSDCCCIVQSILKNKTLK

SEQ ID NO: 2677631 - protein, 25 aa, Entamoeba histolytica
GSDELEFPLCFTVFSASLYSLNNKS

SEQ ID NO: 2677632 - protein, 31 aa, Entamoeba histolytica
GSDKALVEFIFWKYVEPESIVEDDIIKTFLE

SEQ ID NO: 2677633 - protein, 24 aa, Entamoeba histolytica
GSDMKELVKDAAYGPIRELNSLQM

SEQ ID NO: 2677634 - protein, 17 aa, Entamoeba histolytica
GSDNFIELCCLILGEYG

SEQ ID NO: 2677635 - protein, 17 aa, Entamoeba histolytica
GSECVNKSIGVLLAPAI

SEQ ID NO: 2677636 - protein, 21 aa, Entamoeba histolytica
GSELLKVMGTPGVIGEETTSN

SEQ ID NO: 2677637 - protein, 23 aa, Entamoeba histolytica
GSFDMKVKLWDLGSKSNTPLMSL

SEQ ID NO: 2677638 - protein, 21 aa, Entamoeba histolytica
GSFDYLLKVDHTFIIRNLLLS

SEQ ID NO: 2677639 - protein, 23 aa, Entamoeba histolytica
GSFFQRCVPIFNSLPIYINSIPV

SEQ ID NO: 2677640 - protein, 28 aa, Entamoeba histolytica
GSFHLKCFKCDNCGKQLGGKFGLKGQKK

SEQ ID NO: 2677641 - protein, 17 aa, Entamoeba histolytica
GSGCTNTSRFQLLLDKS

SEQ ID NO: 2677642 - protein, 18 aa, Entamoeba histolytica
GSGFDFECLGFKGDGKGT

SEQ ID NO: 2677643 - protein, 19 aa, Entamoeba histolytica
GSGGDLFVSFAVDSNLDID

SEQ ID NO: 2677644 - protein, 20 aa, Entamoeba histolytica
GSGHELHFFCWIVLLVQLKV

SEQ ID NO: 2677645 - protein, 23 aa, Entamoeba histolytica
GSGKGNEGSNEWVFGEMTNYILS

SEQ ID NO: 2677646 - protein, 17 aa, Entamoeba histolytica
GSGTITFSVSFYGVSAW

SEQ ID NO: 2677647 - protein, 19 aa, Entamoeba histolytica
GSHKAQSLKIWNEISNDTK

SEQ ID NO: 2677648 - protein, 18 aa, Entamoeba histolytica
GSHSRLPSFLFGTNEPID

SEQ ID NO: 2677649 - protein, 22 aa, Entamoeba histolytica
GSIDAKGGFTIKAKLQPHQLEN

SEQ ID NO: 2677650 - protein, 23 aa, Entamoeba histolytica
GSIELSEFKILMKFLSKNFDNFS

SEQ ID NO: 2677651 - protein, 19 aa, Entamoeba histolytica
GSIHRCTRAAHSAAVTSLA

SEQ ID NO: 2677652 - protein, 25 aa, Entamoeba histolytica
GSIKSIRYEIELGKQGFSRTRFIKL

SEQ ID NO: 2677653 - protein, 20 aa, Entamoeba histolytica
GSILPLLVERSVRPTAANLL

SEQ ID NO: 2677654 - protein, 25 aa, Entamoeba histolytica
GSINRCEYCRAFINPFVEWQVPGTR

SEQ ID NO: 2677655 - protein, 19 aa, Entamoeba histolytica
GSIPKELILWASTKNVPIV

SEQ ID NO: 2677656 - protein, 22 aa, Entamoeba histolytica
GSIRRYLAEHPKDFDPRQYLGP

SEQ ID NO: 2677657 - protein, 23 aa, Entamoeba histolytica
GSISELIWKLSQYDYNQHVQMIC

SEQ ID NO: 2677658 - protein, 22 aa, Entamoeba histolytica
GSIYCPIEPHFIPVKKAEDLLN

SEQ ID NO: 2677659 - protein, 18 aa, Entamoeba histolytica
GSKNLWSFISVLSSKGNK

SEQ ID NO: 2677660 - protein, 35 aa, Entamoeba histolytica
GSKVYWKWFLALDEIPRRSGAREAPSNWLIEIAKK

SEQ ID NO: 2677661 - protein, 22 aa, Entamoeba histolytica
GSLICENCGLVIDNSRALIAEL

SEQ ID NO: 2677662 - protein, 18 aa, Entamoeba histolytica
GSLKNGKLTIVFQSREPL

SEQ ID NO: 2677663 - protein, 17 aa, Entamoeba histolytica
GSLKRVFAKDETISGKI

SEQ ID NO: 2677664 - protein, 21 aa, Entamoeba histolytica
GSLLNGLNCYVESNREQRMRL

SEQ ID NO: 2677665 - protein, 18 aa, Entamoeba histolytica
GSLQNFLNAITFPDHTMY

SEQ ID NO: 2677666 - protein, 28 aa, Entamoeba histolytica
GSLRYKQFMRCLGWYQSLEGLICDPELC

SEQ ID NO: 2677667 - protein, 17 aa, Entamoeba histolytica
GSLSADVQWKVYLEVAL

SEQ ID NO: 2677668 - protein, 18 aa, Entamoeba histolytica
GSLSLKHIFIKDDEIKLA

SEQ ID NO: 2677669 - protein, 20 aa, Entamoeba histolytica
GSNIKRVFMLAVDVIMKNMA

SEQ ID NO: 2677670 - protein, 26 aa, Entamoeba histolytica
GSNPQQQPYCQMGGYVNQQQYPGYGI

SEQ ID NO: 2677671 - protein, 19 aa, Entamoeba histolytica
GSNRKTCLSERIIYVQPND

SEQ ID NO: 2677672 - protein, 22 aa, Entamoeba histolytica
GSNTCWHLYGIILRTEKHYEEA

SEQ ID NO: 2677673 - protein, 25 aa, Entamoeba histolytica
GSNYKSINFMSQFKNKSLIEIRTED

SEQ ID NO: 2677674 - protein, 22 aa, Entamoeba histolytica
GSPFVLCYLQKGVVSIKKATSN

SEQ ID NO: 2677675 - protein, 17 aa, Entamoeba histolytica
GSPMSSPFHSPRENHTR

SEQ ID NO: 2677676 - protein, 24 aa, Entamoeba histolytica
GSQEAKLRFAFQVYDVDNDGFISN

SEQ ID NO: 2677677 - protein, 21 aa, Entamoeba histolytica
GSQQYPGYNMPQGIQQYGQIN

SEQ ID NO: 2677678 - protein, 24 aa, Entamoeba histolytica
GSRGGVLQVRCDIIGENRQILRNV

SEQ ID NO: 2677679 - protein, 23 aa, Entamoeba histolytica
GSRGGVLQVRCDIMGENRQILRN

SEQ ID NO: 2677680 - protein, 21 aa, Entamoeba histolytica
GSSELVGGCILNIENPEKHLS

SEQ ID NO: 2677681 - protein, 24 aa, Entamoeba histolytica
GSSHTFCQLCIFDGNEILLVSRRS

SEQ ID NO: 2677682 - protein, 23 aa, Entamoeba histolytica
GSSIEFRLVMSLVSSNFKNKKLQ

SEQ ID NO: 2677683 - protein, 31 aa, Entamoeba histolytica
GSSLALTDFRCCYCGMFVHPQCIQYAPAFCY

SEQ ID NO: 2677684 - protein, 22 aa, Entamoeba histolytica
GSSLFFKEITSVTNLTIKVVEE

SEQ ID NO: 2677685 - protein, 22 aa, Entamoeba histolytica
GSSLKISIWYSGSNETMLSDVV

SEQ ID NO: 2677686 - protein, 28 aa, Entamoeba histolytica
GSSNECKMCLQALFDAAFMLAEKMKEMM

SEQ ID NO: 2677687 - protein, 21 aa, Entamoeba histolytica
GSSPCVFARIFFSGIQDVKVR

SEQ ID NO: 2677688 - protein, 36 aa, Entamoeba histolytica
GSSPYYRDICLSYGFFNSFLRLCDRFLSLRTDPTMP

SEQ ID NO: 2677689 - protein, 25 aa, Entamoeba histolytica
GSTFSLNAMEYIKYSYLSYMIQPRV

SEQ ID NO: 2677690 - protein, 18 aa, Entamoeba histolytica
GSTTWWAYGNNLLSIEER

SEQ ID NO: 2677691 - protein, 25 aa, Entamoeba histolytica
GSVKRYHKQIGMGFVTPAEAIRGTY

SEQ ID NO: 2677692 - protein, 26 aa, Entamoeba histolytica
GSVKTWKKRWFVLKDNRLWYFASKTA

SEQ ID NO: 2677693 - protein, 20 aa, Entamoeba histolytica
GSVRLEPRFQFIVTSNYSLA

SEQ ID NO: 2677694 - protein, 18 aa, Entamoeba histolytica
GSYCEIVIVIKPNANGMY

SEQ ID NO: 2677695 - protein, 27 aa, Entamoeba histolytica
GSYEKVFSCKSIEEMFITLSPLLNKYY

SEQ ID NO: 2677696 - protein, 25 aa, Entamoeba histolytica
GSYELPFELELMYKDGWERSCDVCL

SEQ ID NO: 2677697 - protein, 18 aa, Entamoeba histolytica
GSYGTIFENFKKVYDVKV

SEQ ID NO: 2677698 - protein, 21 aa, Entamoeba histolytica
GSYLFKLQYIFCKDHTTSQLK

SEQ ID NO: 2677699 - protein, 30 aa, Entamoeba histolytica
GSYPGCIRLSPQTALRFMRIFDTSRTGHLN

SEQ ID NO: 2677700 - protein, 18 aa, Entamoeba histolytica
GSYQSCYCSCWNPLSSQL

SEQ ID NO: 2677701 - protein, 24 aa, Entamoeba histolytica
GSYTAEILARCGIGQLTIVDADTI

SEQ ID NO: 2677702 - protein, 27 aa, Entamoeba histolytica
GTAEAHRACMKYCKPGMYEFELEAEFY

SEQ ID NO: 2677703 - protein, 23 aa, Entamoeba histolytica
GTAFKNGFWYLLEKSGIIFDKFI

SEQ ID NO: 2677704 - protein, 25 aa, Entamoeba histolytica
GTAGCGMYWMFGLLLSAGFKQVGVI

SEQ ID NO: 2677705 - protein, 24 aa, Entamoeba histolytica
GTAHRPSALIGYSMLLKDQKDPVY

SEQ ID NO: 2677706 - protein, 19 aa, Entamoeba histolytica
GTANSWRWCTEVFDYLNIA

SEQ ID NO: 2677707 - protein, 24 aa, Entamoeba histolytica
GTANSYRWCMEVFDYLNIAALIDG

SEQ ID NO: 2677708 - protein, 23 aa, Entamoeba histolytica
GTARAKCHGFSFNTLQKLSDTKT

SEQ ID NO: 2677709 - protein, 17 aa, Entamoeba histolytica
GTCTYKHQSDYDIVIPD

SEQ ID NO: 2677710 - protein, 24 aa, Entamoeba histolytica
GTDLSSLMPYNFNEILCVSLSHFL

SEQ ID NO: 2677711 - protein, 19 aa, Entamoeba histolytica
GTESLLLHSIHGISSTAAS

SEQ ID NO: 2677712 - protein, 18 aa, Entamoeba histolytica
GTEVKIGIRIKINDKVLT

SEQ ID NO: 2677713 - protein, 18 aa, Entamoeba histolytica
GTFFTYFYDKFQALDNGI

SEQ ID NO: 2677714 - protein, 18 aa, Entamoeba histolytica
GTFIILFRIYEHHFYSAL

SEQ ID NO: 2677715 - protein, 17 aa, Entamoeba histolytica
GTFTYTWPPVTSEGCLK

SEQ ID NO: 2677716 - protein, 17 aa, Entamoeba histolytica
GTGAIPYIVTHDGRTIR

SEQ ID NO: 2677717 - protein, 27 aa, Entamoeba histolytica
GTGDVYYEVVFNFIIFSPFQGELIEGR

SEQ ID NO: 2677718 - protein, 17 aa, Entamoeba histolytica
GTGGTWPLKPSENIELP

SEQ ID NO: 2677719 - protein, 29 aa, Entamoeba histolytica
GTGICSILSSLCCILCDDYFRTIKGFIAL

SEQ ID NO: 2677720 - protein, 17 aa, Entamoeba histolytica
GTGILSMFAARNGAKRV

SEQ ID NO: 2677721 - protein, 25 aa, Entamoeba histolytica
GTGLKKLRIAGGLKQTQQLGTSIVP

SEQ ID NO: 2677722 - protein, 17 aa, Entamoeba histolytica
GTGNVVFSVKFEAIVQK

SEQ ID NO: 2677723 - protein, 18 aa, Entamoeba histolytica
GTGPLYHSFCQLPKKEKS

SEQ ID NO: 2677724 - protein, 19 aa, Entamoeba histolytica
GTGSGFTAALCEKLADKYT

SEQ ID NO: 2677725 - protein, 22 aa, Entamoeba histolytica
GTGSGFTAALCEKLADKYTKKT

SEQ ID NO: 2677726 - protein, 22 aa, Entamoeba histolytica
GTGSTCSVYRGIYKKINSEGGT

SEQ ID NO: 2677727 - protein, 19 aa, Entamoeba histolytica
GTHNWPTWGNKKIIEYYEK

SEQ ID NO: 2677728 - protein, 23 aa, Entamoeba histolytica
GTIDISSLMGMFGGQNGMSSMAR

SEQ ID NO: 2677729 - protein, 19 aa, Entamoeba histolytica
GTIDVCVYYSIKMLHSHYQ

SEQ ID NO: 2677730 - protein, 23 aa, Entamoeba histolytica
GTIDVCVYYSIKMLHSQYQEAQI

SEQ ID NO: 2677731 - protein, 25 aa, Entamoeba histolytica
GTIISEIFICFSRLLSDETICEKIL

SEQ ID NO: 2677732 - protein, 17 aa, Entamoeba histolytica
GTINGFYIFDINNPSKA

SEQ ID NO: 2677733 - protein, 24 aa, Entamoeba histolytica
GTITMPIKIMFIKFLANSFITTPP

SEQ ID NO: 2677734 - protein, 25 aa, Entamoeba histolytica
GTKAFKDTDWIGAIRMYSSALGHVE

SEQ ID NO: 2677735 - protein, 24 aa, Entamoeba histolytica
GTKCLGCGLMDFLPIKCSYCHNPF

SEQ ID NO: 2677736 - protein, 20 aa, Entamoeba histolytica
GTKKKVVLVCQCSGKYRSCS

SEQ ID NO: 2677737 - protein, 26 aa, Entamoeba histolytica
GTKLVDCVHLLPSHFHQLLRFISVEV

SEQ ID NO: 2677738 - protein, 22 aa, Entamoeba histolytica
GTKRKHPQFARRKQKKTEQKEN

SEQ ID NO: 2677739 - protein, 21 aa, Entamoeba histolytica
GTKRRIFVIPYLMYSTMERAV

SEQ ID NO: 2677740 - protein, 31 aa, Entamoeba histolytica
GTKRWKCLLKGRNGLKIDTVFKNKDTVTELH

SEQ ID NO: 2677741 - protein, 20 aa, Entamoeba histolytica
GTKVFLCLIQKLPEIKMYLV

SEQ ID NO: 2677742 - protein, 19 aa, Entamoeba histolytica
GTKYIALAMEWTATEDPFD

SEQ ID NO: 2677743 - protein, 22 aa, Entamoeba histolytica
GTLELRCKIIFENLNRLQKDSL

SEQ ID NO: 2677744 - protein, 17 aa, Entamoeba histolytica
GTLFIERKFIWNGGLVG

SEQ ID NO: 2677745 - protein, 22 aa, Entamoeba histolytica
GTLFKLRLKVLVAQNRQQAIAA

SEQ ID NO: 2677746 - protein, 17 aa, Entamoeba histolytica
GTLFKNKHRLFIGPIQV

SEQ ID NO: 2677747 - protein, 18 aa, Entamoeba histolytica
GTLLRKKSLCEIEQMIVL

SEQ ID NO: 2677748 - protein, 18 aa, Entamoeba histolytica
GTLMYKLSSKDIVAKASV

SEQ ID NO: 2677749 - protein, 22 aa, Entamoeba histolytica
GTLPYLRVYRMFVGNNSVGLQA

SEQ ID NO: 2677750 - protein, 19 aa, Entamoeba histolytica
GTLRFTDLRMMVEDTHMTM

SEQ ID NO: 2677751 - protein, 20 aa, Entamoeba histolytica
GTLRGNIYYVDYISENISIK

SEQ ID NO: 2677752 - protein, 27 aa, Entamoeba histolytica
GTMKVGCPITLPSRNNMDLGRVTGIEL

SEQ ID NO: 2677753 - protein, 19 aa, Entamoeba histolytica
GTMQEYLYELLKIYPEFLK

SEQ ID NO: 2677754 - protein, 19 aa, Entamoeba histolytica
GTMRASSMMLEFLGYSEES

SEQ ID NO: 2677755 - protein, 17 aa, Entamoeba histolytica
GTMRENRTIPRRTVASK

SEQ ID NO: 2677756 - protein, 20 aa, Entamoeba histolytica
GTNFLFKKLLGLLYFELNRR

SEQ ID NO: 2677757 - protein, 24 aa, Entamoeba histolytica
GTNICEKCWTLLVAAVQVLNYILH

SEQ ID NO: 2677758 - protein, 32 aa, Entamoeba histolytica
GTNIISLRCPLSFCPITIPVKGVLCKHSTVVN

SEQ ID NO: 2677759 - protein, 24 aa, Entamoeba histolytica
GTNYEFSRYGTLCIERITNTNVGA

SEQ ID NO: 2677760 - protein, 20 aa, Entamoeba histolytica
GTPFSIPFVQFIKSKPLIVY

SEQ ID NO: 2677761 - protein, 21 aa, Entamoeba histolytica
GTPHIHCLVLFNAAKRNIIYE

SEQ ID NO: 2677762 - protein, 24 aa, Entamoeba histolytica
GTPIMKGESLGVMMSKREYKVIKL

SEQ ID NO: 2677763 - protein, 26 aa, Entamoeba histolytica
GTPTLLFKYNVNFLFGNNPYLRNNQI

SEQ ID NO: 2677764 - protein, 20 aa, Entamoeba histolytica
GTPYWMAPELIRGHDYGVKI

SEQ ID NO: 2677765 - protein, 20 aa, Entamoeba histolytica
GTQFKCVKEYALFQNTQLVH

SEQ ID NO: 2677766 - protein, 20 aa, Entamoeba histolytica
GTRSFFHGKFSLKYKSKDHQ

SEQ ID NO: 2677767 - protein, 23 aa, Entamoeba histolytica
GTRYRVLCLLGQGAFGQVVKCFD

SEQ ID NO: 2677768 - protein, 25 aa, Entamoeba histolytica
GTSISFIRDLLCFFEGRNKTLIFMN

SEQ ID NO: 2677769 - protein, 19 aa, Entamoeba histolytica
GTTHRATCFCYDIISINSL

SEQ ID NO: 2677770 - protein, 26 aa, Entamoeba histolytica
GTTLDEFARRLTVRKVGNSVSEEKKP

SEQ ID NO: 2677771 - protein, 18 aa, Entamoeba histolytica
GTTQCMFWGLGSDGTVGA

SEQ ID NO: 2677772 - protein, 19 aa, Entamoeba histolytica
GTVGKTCLLISYTKNSFPK

SEQ ID NO: 2677773 - protein, 17 aa, Entamoeba histolytica
GTVTYMDIILKFENTTA

SEQ ID NO: 2677774 - protein, 18 aa, Entamoeba histolytica
GTVVRRLCNTWVDVNKEI

SEQ ID NO: 2677775 - protein, 17 aa, Entamoeba histolytica
GTWCVPDLLDGEEINAK

SEQ ID NO: 2677776 - protein, 24 aa, Entamoeba histolytica
GTYLKGICMPSDWLELDNKKWLEE

SEQ ID NO: 2677777 - protein, 29 aa, Entamoeba histolytica
GTYMRTLCVHLGYLMGCGAHMEELRRVRS

SEQ ID NO: 2677778 - protein, 22 aa, Entamoeba histolytica
GVADMKKAAVIMVSQNKYAIDG

SEQ ID NO: 2677779 - protein, 17 aa, Entamoeba histolytica
GVAEWLLKCQTYEGGFS

SEQ ID NO: 2677780 - protein, 23 aa, Entamoeba histolytica
GVAMDRRCVYMFGQNLPQSKEGF

SEQ ID NO: 2677781 - protein, 18 aa, Entamoeba histolytica
GVCFYRILTNKLPFGQTA

SEQ ID NO: 2677782 - protein, 18 aa, Entamoeba histolytica
GVCIKSIYMETSYSQYKY

SEQ ID NO: 2677783 - protein, 18 aa, Entamoeba histolytica
GVCNSKSPIAFNLSNAFT

SEQ ID NO: 2677784 - protein, 25 aa, Entamoeba histolytica
GVCYTFYFKDCQIITLSAYEPSTPC

SEQ ID NO: 2677785 - protein, 23 aa, Entamoeba histolytica
GVDCFKCEALELLLIQKEKGIEV

SEQ ID NO: 2677786 - protein, 23 aa, Entamoeba histolytica
GVDDCWKQYCTLSQQSRDLLDWL

SEQ ID NO: 2677787 - protein, 20 aa, Entamoeba histolytica
GVDFKPMILNVGERTIKLQI

SEQ ID NO: 2677788 - protein, 21 aa, Entamoeba histolytica
GVDMKKFLSFFSLFSKSKSEK

SEQ ID NO: 2677789 - protein, 23 aa, Entamoeba histolytica
GVDVKKIRSMIEDFGERIVQPPW

SEQ ID NO: 2677790 - protein, 18 aa, Entamoeba histolytica
GVEAALLIRANWSIVNVI

SEQ ID NO: 2677791 - protein, 26 aa, Entamoeba histolytica
GVEIPACVVVKFLAMNGIIMEKMGYY

SEQ ID NO: 2677792 - protein, 17 aa, Entamoeba histolytica
GVEQCWGAHMIGHEITA

SEQ ID NO: 2677793 - protein, 23 aa, Entamoeba histolytica
GVFDDACIYEWIKSKNLEEKDLK

SEQ ID NO: 2677794 - protein, 21 aa, Entamoeba histolytica
GVGKHSSRRGFSVIKDKMQLY

SEQ ID NO: 2677795 - protein, 19 aa, Entamoeba histolytica
GVGKSCLLLRFADDTYTDT

SEQ ID NO: 2677796 - protein, 23 aa, Entamoeba histolytica
GVGKSCLLLRFSDDVFSDTYITT

SEQ ID NO: 2677797 - protein, 27 aa, Entamoeba histolytica
GVGRTGVYCLLSRIVEMVTYEILEKSE

SEQ ID NO: 2677798 - protein, 19 aa, Entamoeba histolytica
GVGVARTLANHFVKNLNIG

SEQ ID NO: 2677799 - protein, 19 aa, Entamoeba histolytica
GVGVYELYLNDSLLNYSLT

SEQ ID NO: 2677800 - protein, 26 aa, Entamoeba histolytica
GVIDLMKYSGGYNWWRRNSLTVFLDK

SEQ ID NO: 2677801 - protein, 17 aa, Entamoeba histolytica
GVIFLHFSSIQEATYFH

SEQ ID NO: 2677802 - protein, 23 aa, Entamoeba histolytica
GVIHSVGLFSILAVLEKEEFVNC

SEQ ID NO: 2677803 - protein, 17 aa, Entamoeba histolytica
GVIKCNICHLEYQSTIE

SEQ ID NO: 2677804 - protein, 23 aa, Entamoeba histolytica
GVIKEKYNSIVIGLINASAECVF

SEQ ID NO: 2677805 - protein, 17 aa, Entamoeba histolytica
GVIKGMFKTAVYGAEGL

SEQ ID NO: 2677806 - protein, 29 aa, Entamoeba histolytica
GVIKRRKENEAAMKLLEREIEVISKDIID

SEQ ID NO: 2677807 - protein, 31 aa, Entamoeba histolytica; identical to SEQ ID NO: 2484352

SEQ ID NO: 2677808 - protein, 23 aa, Entamoeba histolytica
GVKEAEDIFEFLLVSCNNNIHTF

SEQ ID NO: 2677809 - protein, 18 aa, Entamoeba histolytica
GVKKRFAKKEVQVDSLIG

SEQ ID NO: 2677810 - protein, 26 aa, Entamoeba histolytica
GVKNFKGIHYLGGRFIPLELKDKLHL

SEQ ID NO: 2677811 - protein, 20 aa, Entamoeba histolytica
GVLESKRISPYYLADSFNHN

SEQ ID NO: 2677812 - protein, 28 aa, Entamoeba histolytica
GVLKEEWLNRINPLYPFLQPELQEQLKI

SEQ ID NO: 2677813 - protein, 25 aa, Entamoeba histolytica
GVLKKYCYSKCDSCDSFISDVLLSR

SEQ ID NO: 2677814 - protein, 17 aa, Entamoeba histolytica
GVLNKFYDIRIEKPKLN

SEQ ID NO: 2677815 - protein, 25 aa, Entamoeba histolytica
GVLTLNSTCIFVCYNNRPFSLPHIY

SEQ ID NO: 2677816 - protein, 24 aa, Entamoeba histolytica
GVMKRIYQKVGMEFTREVETKINE

SEQ ID NO: 2677817 - protein, 18 aa, Entamoeba histolytica
GVMTCTFGLLKTQNDPRI

SEQ ID NO: 2677818 - protein, 17 aa, Entamoeba histolytica
GVNDWAKLFKPRHLFCG

SEQ ID NO: 2677819 - protein, 17 aa, Entamoeba histolytica
GVPECADETRIREEFGK

SEQ ID NO: 2677820 - protein, 25 aa, Entamoeba histolytica
GVPEKGKYPLGLSFEIVNQSEMTFE

SEQ ID NO: 2677821 - protein, 24 aa, Entamoeba histolytica
GVPKGGRGKRSFNMGGMPRDFGGF

SEQ ID NO: 2677822 - protein, 24 aa, Entamoeba histolytica
GVPLSLIICCDVYEPPNLKKSSGW

SEQ ID NO: 2677823 - protein, 18 aa, Entamoeba histolytica
GVPPHLPLTIKLENVQSF

SEQ ID NO: 2677824 - protein, 18 aa, Entamoeba histolytica
GVPQIEVTFDIDANGILN

SEQ ID NO: 2677825 - protein, 22 aa, Entamoeba histolytica
GVQFHICMALELTLRTIPLLNA

SEQ ID NO: 2677826 - protein, 25 aa, Entamoeba histolytica
GVRLDETWNNIGLKDFEIIKRINGG

SEQ ID NO: 2677827 - protein, 19 aa, Entamoeba histolytica
GVRYFDLRIQKFKDDIYTV

SEQ ID NO: 2677828 - protein, 24 aa, Entamoeba histolytica
GVSACAICDGAVPIFRNKVLMVVG

SEQ ID NO: 2677829 - protein, 18 aa, Entamoeba histolytica
GVSDEIFEDITLKVDPRT

SEQ ID NO: 2677830 - protein, 23 aa, Entamoeba histolytica
GVSGVTLYIQWKCGKESGILPRS

SEQ ID NO: 2677831 - protein, 19 aa, Entamoeba histolytica
GVSHFVSFAPMLDVFGKLE

SEQ ID NO: 2677832 - protein, 22 aa, Entamoeba histolytica
GVSIPIQINEHINVDKKINIVE

SEQ ID NO: 2677833 - protein, 22 aa, Entamoeba histolytica
GVSKEWFSLIVKELFKVDFGMF

SEQ ID NO: 2677834 - protein, 17 aa, Entamoeba histolytica
GVSLNFNDIKAFNRCAI

SEQ ID NO: 2677835 - protein, 25 aa, Entamoeba histolytica
GVSMPWLVIVLIKLIPLICIEKREI

SEQ ID NO: 2677836 - protein, 24 aa, Entamoeba histolytica
GVSRRIYEKFGMPFTDELAQKIKD

SEQ ID NO: 2677837 - protein, 27 aa, Entamoeba histolytica
GVSTLNFKVCFIKSISLQVSIDNGSNW

SEQ ID NO: 2677838 - protein, 28 aa, Entamoeba histolytica
GVTAPCQVRYVYYFDCYHRTFSEYIPIP

SEQ ID NO: 2677839 - protein, 19 aa, Entamoeba histolytica
GVTEGQWWGPSFASDIAAE

SEQ ID NO: 2677840 - protein, 18 aa, Entamoeba histolytica
GVTFCFDNEALFKIASDI

SEQ ID NO: 2677841 - protein, 20 aa, Entamoeba histolytica
GVTRPVKKPTAGMNSTTSGS

SEQ ID NO: 2677842 - protein, 26 aa, Entamoeba histolytica
GVTVHFLRLPYFFNYLQIAAGEEEVW

SEQ ID NO: 2677843 - protein, 20 aa, Entamoeba histolytica
GVTYRLTLGVIKNIMPAIAS

SEQ ID NO: 2677844 - protein, 24 aa, Entamoeba histolytica
GVVADNLVKYCCHQFGGYTVQKIA

SEQ ID NO: 2677845 - protein, 25 aa, Entamoeba histolytica
GVVADNLVKYCCHQFGGYTVQKIAP

SEQ ID NO: 2677846 - protein, 31 aa, Entamoeba histolytica
GVVGSLAMPDAHSGYGFSIGGVVAMRLDDPE

SEQ ID NO: 2677847 - protein, 17 aa, Entamoeba histolytica
GVVNISINSFKGCSAIT

SEQ ID NO: 2677848 - protein, 17 aa, Entamoeba histolytica
GVVSELFTNGVINKFIE

SEQ ID NO: 2677849 - protein, 18 aa, Entamoeba histolytica
GVYKVTAIYDWIKNNKTA

SEQ ID NO: 2677850 - protein, 17 aa, Entamoeba histolytica
GVYSGRVAKILHIYQFT

SEQ ID NO: 2677851 - protein, 20 aa, Entamoeba histolytica
GWFNDNLICYQIEYIKKEFP

SEQ ID NO: 2677852 - protein, 20 aa, Entamoeba histolytica
GWKGGKFGDYSCNGEKIDRN

SEQ ID NO: 2677853 - protein, 18 aa, Entamoeba histolytica
GWKLFGDIFNYEEFKKSK

SEQ ID NO: 2677854 - protein, 26 aa, Entamoeba histolytica
GWLKKKGYEVHSWKRRYFVIKNEFIY

SEQ ID NO: 2677855 - protein, 33 aa, Entamoeba histolytica
GWSKERVKGTLVWLLNIGMLWVDDQFPLDGKTT

SEQ ID NO: 2677856 - protein, 19 aa, Entamoeba histolytica
GWSSYNIYNEFSRMRLEGE

SEQ ID NO: 2677857 - protein, 20 aa, Entamoeba histolytica
GWWIGKKGGVPGIFPSNFVQ

SEQ ID NO: 2677858 - protein, 19 aa, Entamoeba histolytica
GWWKGELNGQEGWIPNNYV

SEQ ID NO: 2677859 - protein, 24 aa, Entamoeba histolytica
GWYHSHPGFGCWLSSIDISTQQSF

SEQ ID NO: 2677860 - protein, 21 aa, Entamoeba histolytica
GYADILWIFQWHFVELQSTGF

SEQ ID NO: 2677861 - protein, 20 aa, Entamoeba histolytica
GYAELCLRAISILRAIGTRY

SEQ ID NO: 2677862 - protein, 17 aa, Entamoeba histolytica
GYAPCNVSGEFEMSLEI

SEQ ID NO: 2677863 - protein, 17 aa, Entamoeba histolytica
GYCKSAVIIGMDGTENA

SEQ ID NO: 2677864 - protein, 21 aa, Entamoeba histolytica
GYDCFYYNLFKSIDLSHVLQI

SEQ ID NO: 2677865 - protein, 24 aa, Entamoeba histolytica
GYDGENRGGVLFVGNDGMKVKLYN

SEQ ID NO: 2677866 - protein, 22 aa, Entamoeba histolytica
GYDGRFLAQYGIIGITRKGSNI

SEQ ID NO: 2677867 - protein, 20 aa, Entamoeba histolytica
GYDGRFLAQYGIIGIVKKGH

SEQ ID NO: 2677868 - protein, 18 aa, Entamoeba histolytica
GYDLKCSMDIDMFDDVGD

SEQ ID NO: 2677869 - protein, 19 aa, Entamoeba histolytica
GYDSFKMVIPSSVTKLGMK

SEQ ID NO: 2677870 - protein, 18 aa, Entamoeba histolytica
GYDSKRLVGRKVDEIMDW

SEQ ID NO: 2677871 - protein, 30 aa, Entamoeba histolytica
GYDYSLPRCTVRPEIRIENAEKVQRLTAKR

SEQ ID NO: 2677872 - protein, 18 aa, Entamoeba histolytica
GYFKGCTSLTRIDIPTTV

SEQ ID NO: 2677873 - protein, 19 aa, Entamoeba histolytica
GYFKINSQIVSFVPNSSQI

SEQ ID NO: 2677874 - protein, 28 aa, Entamoeba histolytica
GYFNKEFIRQKCMTLGDVVGVSLKDQMC

SEQ ID NO: 2677875 - protein, 18 aa, Entamoeba histolytica
GYFQECFVLAYRLVTTPE

SEQ ID NO: 2677876 - protein, 34 aa, Entamoeba histolytica
GYFSIFFYVFALKYIPKFFQSIIHLLYDQQQLID

SEQ ID NO: 2677877 - protein, 21 aa, Entamoeba histolytica
GYGEHQCKYIFAIKKLVYNEV

SEQ ID NO: 2677878 - protein, 24 aa, Entamoeba histolytica
GYGKELLEATGFSSFNVVYDSKIN

SEQ ID NO: 2677879 - protein, 30 aa, Entamoeba histolytica
GYGQYQGIRGWGCIFARALSSKAKEDEDRI

SEQ ID NO: 2677880 - protein, 24 aa, Entamoeba histolytica
GYGRGLCANKEFKKDEVIMSIPYS

SEQ ID NO: 2677881 - protein, 19 aa, Entamoeba histolytica
GYHLYKHLLWLIDHSHINH

SEQ ID NO: 2677882 - protein, 18 aa, Entamoeba histolytica
GYIGEWKEMELVLTNDLM

SEQ ID NO: 2677883 - protein, 29 aa, Entamoeba histolytica
GYINEECFLLWLFDEVIPFATEQRKKTGN

SEQ ID NO: 2677884 - protein, 17 aa, Entamoeba histolytica
GYINGCIKILCQKAQEI

SEQ ID NO: 2677885 - protein, 17 aa, Entamoeba histolytica
GYIPFIGVIIQDLTFID

SEQ ID NO: 2677886 - protein, 18 aa, Entamoeba histolytica
GYISKYRIRLDLFQYCDD

SEQ ID NO: 2677887 - protein, 17 aa, Entamoeba histolytica
GYITLTFDKPIFIKNIL

SEQ ID NO: 2677888 - protein, 17 aa, Entamoeba histolytica
GYIWNGVPVPLEDFTTP

SEQ ID NO: 2677889 - protein, 29 aa, Entamoeba histolytica
GYKKMFECLSEIPIYVGLEKAGFCSQESK

SEQ ID NO: 2677890 - protein, 23 aa, Entamoeba histolytica
GYKPGMKVCTRFPPEPSGYLHIG

SEQ ID NO: 2677891 - protein, 19 aa, Entamoeba histolytica
GYKVKRRYTKSSFKTLRME

SEQ ID NO: 2677892 - protein, 17 aa, Entamoeba histolytica
GYLKRGIAVVGVGAPAC

SEQ ID NO: 2677893 - protein, 24 aa, Entamoeba histolytica
GYLMLRRNVGFLTRIISLLFSFDE

SEQ ID NO: 2677894 - protein, 30 aa, Entamoeba histolytica
GYLQITLKVEGFEFERCVDDFIFFCFLVGN

SEQ ID NO: 2677895 - protein, 32 aa, Entamoeba histolytica
GYLRYEMDQTKKFLCVCWCGQAAPDNLKTKFV

SEQ ID NO: 2677896 - protein, 24 aa, Entamoeba histolytica
GYNAFKGCGLTSIELPPNEDGIGC

SEQ ID NO: 2677897 - protein, 34 aa, Entamoeba histolytica; identical to SEQ ID NO: 2484468

SEQ ID NO: 2677898 - protein, 18 aa, Entamoeba histolytica
GYPAEGIESYYRNNMVDV

SEQ ID NO: 2677899 - protein, 18 aa, Entamoeba histolytica
GYPSDVDTIKWMKCQYDP

SEQ ID NO: 2677900 - protein, 24 aa, Entamoeba histolytica
GYPSIRSSILFTDYCKAIGVKFPS

SEQ ID NO: 2677901 - protein, 20 aa, Entamoeba histolytica
GYQPNGRIVPIKPFDKDFQK

SEQ ID NO: 2677902 - protein, 23 aa, Entamoeba histolytica
GYQQLVDGCRICGTNCIKLLQIV

SEQ ID NO: 2677903 - protein, 19 aa, Entamoeba histolytica
GYSAWDYNSPVFIIKDEFG

SEQ ID NO: 2677904 - protein, 18 aa, Entamoeba histolytica
GYSILTCGSLEMKTTFIK

SEQ ID NO: 2677905 - protein, 18 aa, Entamoeba histolytica
GYSKSGLLLPHSKKSKQT

SEQ ID NO: 2677906 - protein, 18 aa, Entamoeba histolytica
GYSLKRGSGYGIGFIYLN

SEQ ID NO: 2677907 - protein, 19 aa, Entamoeba histolytica
GYSSLMLLLTNMGRTDETI

SEQ ID NO: 2677908 - protein, 21 aa, Entamoeba histolytica
GYWIKRKCYVDYALRTPYLFM

SEQ ID NO: 2677909 - protein, 26 aa, Entamoeba histolytica
GYYDPNVACIWGWWGTLMSNHELKRY

SEQ ID NO: 2677910 - protein, 18 aa, Entamoeba histolytica
GYYEEKLVQFILENINGK

SEQ ID NO: 2677911 - protein, 30 aa, Entamoeba histolytica
GYYKECDYWSVGCILFEMLAGYPPFVSDDS

SEQ ID NO: 2677912 - protein, 22 aa, Entamoeba histolytica
GYYKFKGIEGISKITDVKPYSE

SEQ ID NO: 2677913 - protein, 20 aa, Entamoeba histolytica
GYYKSCIEVNYILPSEFLEY

SEQ ID NO: 2677914 - protein, 20 aa, Entamoeba histolytica
GYYLKEEWEDIAPLLEKYQV

SEQ ID NO: 2677915 - protein, 18 aa, Entamoeba histolytica
GYYNGSVTPNNWYPRQLY

SEQ ID NO: 2677916 - protein, 22 aa, Entamoeba histolytica
GYYQLCGVVLYVFFNTKIQNEI

SEQ ID NO: 2677917 - protein, 22 aa, Entamoeba histolytica
GYYSKILCCNKIQLTKTKEITY

SEQ ID NO: 2677918 - protein, 23 aa, Entamoeba histolytica
GYYYGQGIGSVFQKLSDFLKTYC

SEQ ID NO: 2677919 - protein, 17 aa, Entamoeba histolytica
HAALICYIASGNVNKLI

SEQ ID NO: 2677920 - protein, 17 aa, Entamoeba histolytica
HAAVSIIACCMSKVAND

SEQ ID NO: 2677921 - protein, 20 aa, Entamoeba histolytica
HAAVVARGMGKPCVSGAEGI

SEQ ID NO: 2677922 - protein, 19 aa, Entamoeba histolytica
HACMIFELLTGDFLFAPKQ

SEQ ID NO: 2677923 - protein, 21 aa, Entamoeba histolytica
HADFGNCFISTGFGNNEKPKE

SEQ ID NO: 2677924 - protein, 24 aa, Entamoeba histolytica
HADFLIKSIISYHCNHHVLEQLIK

SEQ ID NO: 2677925 - protein, 18 aa, Entamoeba histolytica
HAFKGIYPNAQFTFNGDV

SEQ ID NO: 2677926 - protein, 21 aa, Entamoeba histolytica
HAFYWKCMCGCGVKPSEQLIA

SEQ ID NO: 2677927 - protein, 24 aa, Entamoeba histolytica
HAGVKLALNVGREFIDMSDLTFNI

SEQ ID NO: 2677928 - protein, 24 aa, Entamoeba histolytica
HAIKGGFAVPGFNFNNLEQMQAII

SEQ ID NO: 2677929 - protein, 33 aa, Entamoeba histolytica
HAIKRLRFTNPQLSFRFIEWCILNYSEITHHSQ

SEQ ID NO: 2677930 - protein, 17 aa, Entamoeba histolytica
HAIPSLVHLFRTKDDEF

SEQ ID NO: 2677931 - protein, 17 aa, Entamoeba histolytica
HALFLFKNPEEWINNLI

SEQ ID NO: 2677932 - protein, 27 aa, Entamoeba histolytica
HAMEITHCELLRCFIKILKKIKDVNEN

SEQ ID NO: 2677933 - protein, 28 aa, Entamoeba histolytica
HANIKVEGFWPIIMAKALTNANIEDLIM

SEQ ID NO: 2677934 - protein, 21 aa, Entamoeba histolytica
HAPIIKHFFTTLGYPNQPYQS

SEQ ID NO: 2677935 - protein, 24 aa, Entamoeba histolytica
HASEFKRTPLFIVGDMDSVNQETI

SEQ ID NO: 2677936 - protein, 17 aa, Entamoeba histolytica
HASEIEAALMVKMSTER

SEQ ID NO: 2677937 - protein, 26 aa, Entamoeba histolytica
HASTNICGRCGKPIAPGVSFISAMGQ

SEQ ID NO: 2677938 - protein, 18 aa, Entamoeba histolytica
HATIRCIAGLIKSVNNVE

SEQ ID NO: 2677939 - protein, 17 aa, Entamoeba histolytica
HAVIKYSSKGYLKRKRI

SEQ ID NO: 2677940 - protein, 17 aa, Entamoeba histolytica
HAVSVIHHLLHEDYEQY

SEQ ID NO: 2677941 - protein, 22 aa, Entamoeba histolytica
HCFERYKQLWEYVSADFDDFDR

SEQ ID NO: 2677942 - protein, 18 aa, Entamoeba histolytica
HCFYGCSSLRTINIPSSI

SEQ ID NO: 2677943 - protein, 24 aa, Entamoeba histolytica
HCHIPRNCFRNCGTIKEVIIHDWV

SEQ ID NO: 2677944 - protein, 19 aa, Entamoeba histolytica
HCHSSHGVSLFGKTLCVNS

SEQ ID NO: 2677945 - protein, 24 aa, Entamoeba histolytica
HCIIYRVIKDYAIQFGDTTMGKGG

SEQ ID NO: 2677946 - protein, 25 aa, Entamoeba histolytica
HCIQKSICKEGFFLFTHNYTTIEKM

SEQ ID NO: 2677947 - protein, 24 aa, Entamoeba histolytica
HCKLLIRYATGYGLLREVLSSLGK

SEQ ID NO: 2677948 - protein, 25 aa, Entamoeba histolytica
HCLAGRGRTGTVITSFLQYIKLCAT

SEQ ID NO: 2677949 - protein, 20 aa, Entamoeba histolytica
HCLKDDCYLAFEEILQQANQ

SEQ ID NO: 2677950 - protein, 25 aa, Entamoeba histolytica
HCLRIICKDLRVLSFRIVGPIQPYE

SEQ ID NO: 2677951 - protein, 21 aa, Entamoeba histolytica
HCPVCGESICLMCFEQSVEVN

SEQ ID NO: 2677952 - protein, 22 aa, Entamoeba histolytica
HCQGGLDIGWTAYLIGAVSEYR

SEQ ID NO: 2677953 - protein, 18 aa, Entamoeba histolytica
HCQYRLGRVDSYTLADGI

SEQ ID NO: 2677954 - protein, 25 aa, Entamoeba histolytica
HCRAGRGRTGIVVCSVLLALGKAKN

SEQ ID NO: 2677955 - protein, 18 aa, Entamoeba histolytica
HCRREMLAAIDLRGYSVL

SEQ ID NO: 2677956 - protein, 26 aa, Entamoeba histolytica
HCSRYVQCFGTYGWSCEGVRNLSVRI

SEQ ID NO: 2677957 - protein, 24 aa, Entamoeba histolytica
HCVHLKRKILEILVKNFLETLDEE

SEQ ID NO: 2677958 - protein, 19 aa, Entamoeba histolytica
HDEHFSVLPIEITKQKTLE

SEQ ID NO: 2677959 - protein, 19 aa, Entamoeba histolytica
HDFCFYRCSSLVFVSIPST

SEQ ID NO: 2677960 - protein, 20 aa, Entamoeba histolytica
HDFIIEKICNKVIESNKKNG

SEQ ID NO: 2677961 - protein, 18 aa, Entamoeba histolytica
HDFMDGGKEALLPLLDQF

SEQ ID NO: 2677962 - protein, 17 aa, Entamoeba histolytica
HDFQDCIDEGYSVSEEY

SEQ ID NO: 2677963 - protein, 25 aa, Entamoeba histolytica
HDIASFPSISIVFPFNGVSGQLLTV

SEQ ID NO: 2677964 - protein, 17 aa, Entamoeba histolytica
HDIHCKIEGPAVHDIER

SEQ ID NO: 2677965 - protein, 30 aa, Entamoeba histolytica
HDIIPSVFGIRWIKMLFAREFHIEDVVEIW

SEQ ID NO: 2677966 - protein, 21 aa, Entamoeba histolytica
HDIYPLGVCFYRILTNKLPFG

SEQ ID NO: 2677967 - protein, 19 aa, Entamoeba histolytica
HDKMYWKESIIFTQTGVLN

SEQ ID NO: 2677968 - protein, 22 aa, Entamoeba histolytica
HDLDLTVIDWLRLQDYRIQPKK

SEQ ID NO: 2677969 - protein, 17 aa, Entamoeba histolytica
HDPFILLRVIYLCKTAN

SEQ ID NO: 2677970 - protein, 27 aa, Entamoeba histolytica
HDPRKKDLILNVVMYKNGFIVNDGPLR

SEQ ID NO: 2677971 - protein, 18 aa, Entamoeba histolytica
HDRCLISTGIAVQIPHSC

SEQ ID NO: 2677972 - protein, 33 aa, Entamoeba histolytica
HDSKALVFCGCFPRRHFDNFIKVCPINAPELPS

SEQ ID NO: 2677973 - protein, 27 aa, Entamoeba histolytica
HDSTLCIVNSCRRGIGFNLKIKVDNQE

SEQ ID NO: 2677974 - protein, 17 aa, Entamoeba histolytica
HDVCKAMMLCGKVDGPI

SEQ ID NO: 2677975 - protein, 21 aa, Entamoeba histolytica
HDWPQGIVMKGNYKQLYRFQP

SEQ ID NO: 2677976 - protein, 20 aa, Entamoeba histolytica
HDYIIWMGDLNYRIEMEDSV

SEQ ID NO: 2677977 - protein, 29 aa, Entamoeba histolytica
HDYVQWVFPTFVKSMFNWNSYTLDKEEAN

SEQ ID NO: 2677978 - protein, 19 aa, Entamoeba histolytica
HECPICHEHYWSTATTRVK

SEQ ID NO: 2677979 - protein, 23 aa, Entamoeba histolytica
HEDHFFRVKVTVLLEGKNIGDVL

SEQ ID NO: 2677980 - protein, 26 aa, Entamoeba histolytica
HEDMLFKVIFKLTNKKGEQIATLHSF

SEQ ID NO: 2677981 - protein, 25 aa, Entamoeba histolytica
HEEFLELLPKLAHGEKVDKKCFEGE

SEQ ID NO: 2677982 - protein, 26 aa, Entamoeba histolytica
HEETLEFIQWLYSLGISIISLHGRHH

SEQ ID NO: 2677983 - protein, 21 aa, Entamoeba histolytica
HEGSPLIKRDEFVTIKLEEDN

SEQ ID NO: 2677984 - protein, 18 aa, Entamoeba histolytica
HEHGIFGKLCECCKEKTC

SEQ ID NO: 2677985 - protein, 18 aa, Entamoeba histolytica
HEIDSTKLLIQMLLCSTQ

SEQ ID NO: 2677986 - protein, 24 aa, Entamoeba histolytica
HEIFLEVYNVFSLKEEEREVLMPF

SEQ ID NO: 2677987 - protein, 20 aa, Entamoeba histolytica
HEIKMLKKVHHLYIISYLGD

SEQ ID NO: 2677988 - protein, 18 aa, Entamoeba histolytica
HEINSVACLLDYIIDSFP

SEQ ID NO: 2677989 - protein, 24 aa, Entamoeba histolytica
HEKEFDCLKSLEIEEKINVVKFVH

SEQ ID NO: 2677990 - protein, 24 aa, Entamoeba histolytica
HEKNFKKELPFFANIIRNNGTSGD

SEQ ID NO: 2677991 - protein, 29 aa, Entamoeba histolytica
HEKTYGLDIFKVRIRKVGKAKEIPKIFGI

SEQ ID NO: 2677992 - protein, 20 aa, Entamoeba histolytica
HELLITQKLWSAFPNADEYI

SEQ ID NO: 2677993 - protein, 22 aa, Entamoeba histolytica
HELTVQFILRTNISISSFVISD

SEQ ID NO: 2677994 - protein, 19 aa, Entamoeba histolytica
HEMKIQSSITLFFDNKLNM

SEQ ID NO: 2677995 - protein, 23 aa, Entamoeba histolytica
HEPITFSALLPYAEELDCSIFRS

SEQ ID NO: 2677996 - protein, 24 aa, Entamoeba histolytica
HEPKRDKLIILLRLVEKCNENQID

SEQ ID NO: 2677997 - protein, 20 aa, Entamoeba histolytica
HEPVSCGVHYGRENNVDLYF

SEQ ID NO: 2677998 - protein, 18 aa, Entamoeba histolytica
HEQFKIIYIAPMKSLVQE

SEQ ID NO: 2677999 - protein, 17 aa, Entamoeba histolytica
HESFTEMMRVLKTVLVE

SEQ ID NO: 2678000 - protein, 20 aa, Entamoeba histolytica
HESTKLQCSNLIKEMDKQNT

SEQ ID NO: 2678001 - protein, 18 aa, Entamoeba histolytica
HETKHILEAIQFNDILIS

SEQ ID NO: 2678002 - protein, 21 aa, Entamoeba histolytica
HEVIIKAIFVDKVKRIITRIK

SEQ ID NO: 2678003 - protein, 20 aa, Entamoeba histolytica
HEVKLKRLDKKGISQSDNNQ

SEQ ID NO: 2678004 - protein, 21 aa, Entamoeba histolytica
HEVLLKLKKEREIMENEIKTL

SEQ ID NO: 2678005 - protein, 26 aa, Entamoeba histolytica
HEVPKVFKIIIHFDISYFQLLNYQKQ

SEQ ID NO: 2678006 - protein, 24 aa, Entamoeba histolytica
HEYFPGTHAVPFSIIIPIVPHPSL

SEQ ID NO: 2678007 - protein, 22 aa, Entamoeba histolytica
HEYLKRKEMEALQGDVEKNQAQ

SEQ ID NO: 2678008 - protein, 23 aa, Entamoeba histolytica
HFAAPEHYLFAGIDGHSGKYVSY

SEQ ID NO: 2678009 - protein, 21 aa, Entamoeba histolytica
HFCPDCHQIMLPRSCGDDLYF

SEQ ID NO: 2678010 - protein, 18 aa, Entamoeba histolytica
HFCYGRVAPGSSLAIKYG

SEQ ID NO: 2678011 - protein, 19 aa, Entamoeba histolytica
HFCYGRVAPRSSLAIKYGI

SEQ ID NO: 2678012 - protein, 23 aa, Entamoeba histolytica
HFCYGRVAPRSSLAIKYGIDIGG

SEQ ID NO: 2678013 - protein, 23 aa, Entamoeba histolytica
HFDELIKRYPLKNCFPEYDGSIS

SEQ ID NO: 2678014 - protein, 30 aa, Entamoeba histolytica
HFDPDCKYHTLRMYDHFVFYNHVCIVTELL

SEQ ID NO: 2678015 - protein, 25 aa, Entamoeba histolytica
HFEEEFPYQIVFGVIQKDPTNVLGL

SEQ ID NO: 2678016 - protein, 22 aa, Entamoeba histolytica
HFERAFSVPMQNDFLAPFITPE

SEQ ID NO: 2678017 - protein, 18 aa, Entamoeba histolytica
HFFKNGPIVWKWGNDSIK

SEQ ID NO: 2678018 - protein, 17 aa, Entamoeba histolytica
HFFPCANVFVISSSEIK

SEQ ID NO: 2678019 - protein, 33 aa, Entamoeba histolytica
HFIGHSLGGLYLRFAIPILFKRGIFNNLNWIPF

SEQ ID NO: 2678020 - protein, 18 aa, Entamoeba histolytica
HFIIICFMLDDCFLPLLQ

SEQ ID NO: 2678021 - protein, 18 aa, Entamoeba histolytica
HFIPELIEQIPITTQPLI

SEQ ID NO: 2678022 - protein, 19 aa, Entamoeba histolytica
HFISIPLCNSSFSLSQMKC

SEQ ID NO: 2678023 - protein, 24 aa, Entamoeba histolytica
HFKDFKLTYYPGDYDTFEATMQKR

SEQ ID NO: 2678024 - protein, 17 aa, Entamoeba histolytica
HFKEAYKSLLLLPETSF

SEQ ID NO: 2678025 - protein, 18 aa, Entamoeba histolytica
HFKEFNLGPIDAKVEDGT

SEQ ID NO: 2678026 - protein, 19 aa, Entamoeba histolytica
HFKLIYQMSYRKPNNLKKT

SEQ ID NO: 2678027 - protein, 18 aa, Entamoeba histolytica
HFLAPEIVDETGYNEKVD

SEQ ID NO: 2678028 - protein, 22 aa, Entamoeba histolytica
HFLKQCRLLRRHGRLGKKVSLH

SEQ ID NO: 2678029 - protein, 25 aa, Entamoeba histolytica
HFLPRIISSLPNCRFILNTNTIDGP

SEQ ID NO: 2678030 - protein, 27 aa, Entamoeba histolytica
HFLSEICSGLWYLHFNKHLLHRDLKLD

SEQ ID NO: 2678031 - protein, 24 aa, Entamoeba histolytica
HFLSYLIPHMSKFLSVEYIPTIND

SEQ ID NO: 2678032 - protein, 19 aa, Entamoeba histolytica
HFLTTGWTYWFDLGINQVF

SEQ ID NO: 2678033 - protein, 23 aa, Entamoeba histolytica
HFNISWLKITFIEFSIHSIYQII

SEQ ID NO: 2678034 - protein, 24 aa, Entamoeba histolytica
HFNKFLWDLLYSHPSFIKFKETLA

SEQ ID NO: 2678035 - protein, 21 aa, Entamoeba histolytica
HFNMLKEMYGEITVINLLNNN

SEQ ID NO: 2678036 - protein, 22 aa, Entamoeba histolytica
HFPAVNWNISFSKYIKSLDSYY

SEQ ID NO: 2678037 - protein, 23 aa, Entamoeba histolytica
HFQPEISRTILLTHLYDNPYIHK

SEQ ID NO: 2678038 - protein, 17 aa, Entamoeba histolytica
HFSPLCHSFGLPMNCLQ

SEQ ID NO: 2678039 - protein, 20 aa, Entamoeba histolytica
HFTANCKINNLWYHFDDETV

SEQ ID NO: 2678040 - protein, 22 aa, Entamoeba histolytica
HFTEAKCRIIIRQIFSALEYLH

SEQ ID NO: 2678041 - protein, 17 aa, Entamoeba histolytica
HFTNIVVQSVMHLDDKL

SEQ ID NO: 2678042 - protein, 18 aa, Entamoeba histolytica
HFTNIVVQSVMHLDDKLD

SEQ ID NO: 2678043 - protein, 18 aa, Entamoeba histolytica
HFVSFDFLDKEDRIELLR

SEQ ID NO: 2678044 - protein, 25 aa, Entamoeba histolytica
HFWEKLINYFRVDSVLEKEFTNDPK

SEQ ID NO: 2678045 - protein, 18 aa, Entamoeba histolytica
HFYICVLELIWYVTENKC

SEQ ID NO: 2678046 - protein, 29 aa, Entamoeba histolytica
HGANWKMVKYALETGIKEDYCRRLINSIK

SEQ ID NO: 2678047 - protein, 20 aa, Entamoeba histolytica
HGASCPIGIGVSCSADRNIK

SEQ ID NO: 2678048 - protein, 18 aa, Entamoeba histolytica
HGAYKFKPGMHPRIRLDI

SEQ ID NO: 2678049 - protein, 21 aa, Entamoeba histolytica
HGEIPELLIPFVIQSKKASHA

SEQ ID NO: 2678050 - protein, 19 aa, Entamoeba histolytica
HGEPRLCLSVNTGFGNMFD

SEQ ID NO: 2678051 - protein, 19 aa, Entamoeba histolytica
HGFNKYRGGLDVSSGSTGI

SEQ ID NO: 2678052 - protein, 18 aa, Entamoeba histolytica
HGGLAMFIFIKQIMKNEI

SEQ ID NO: 2678053 - protein, 23 aa, Entamoeba histolytica
HGGVVIEKGRREYWRIVNNKVRI

SEQ ID NO: 2678054 - protein, 24 aa, Entamoeba histolytica
HGIISVGRGSLWAYESNIFTRWEV

SEQ ID NO: 2678055 - protein, 21 aa, Entamoeba histolytica
HGINVPFGFIDRSRIERSDRI

SEQ ID NO: 2678056 - protein, 22 aa, Entamoeba histolytica
HGIPGDFLDRLIIVKTQEYTSD

SEQ ID NO: 2678057 - protein, 24 aa, Entamoeba histolytica
HGIQRFKTVYIDRIKKGMINPTAK

SEQ ID NO: 2678058 - protein, 19 aa, Entamoeba histolytica
HGKTFWARRSLNIYNGLIA

SEQ ID NO: 2678059 - protein, 18 aa, Entamoeba histolytica
HGKYKGDNVFIFKLDTKE

SEQ ID NO: 2678060 - protein, 26 aa, Entamoeba histolytica
HGLLDKIMFCYGVGYKKARKENGPHY

SEQ ID NO: 2678061 - protein, 24 aa, Entamoeba histolytica
HGLSWRLQCRVKHHISLIDGLEEY

SEQ ID NO: 2678062 - protein, 24 aa, Entamoeba histolytica
HGPPGCGKTLLAKAIAGEVGVAFI

SEQ ID NO: 2678063 - protein, 21 aa, Entamoeba histolytica
HGPQVRQFFMQKIINAERTAL

SEQ ID NO: 2678064 - protein, 20 aa, Entamoeba histolytica
HGRVKECIDEPISKTFNKKN

SEQ ID NO: 2678065 - protein, 18 aa, Entamoeba histolytica
HGSINSFSSSPCHIEIIL

SEQ ID NO: 2678066 - protein, 24 aa, Entamoeba histolytica
HGSKECTGNGYAIYGTIEDARLAK

SEQ ID NO: 2678067 - protein, 26 aa, Entamoeba histolytica
HGSLQPFGGLIAWLRMYATDEFLNVK

SEQ ID NO: 2678068 - protein, 25 aa, Entamoeba histolytica
HGVIKGMFKTAAFGAQYLRDETKAI

SEQ ID NO: 2678069 - protein, 17 aa, Entamoeba histolytica
HGVKLILGLLYTLYRKY

SEQ ID NO: 2678070 - protein, 19 aa, Entamoeba histolytica
HGYLKMVGISYSFMYKWII

SEQ ID NO: 2678071 - protein, 17 aa, Entamoeba histolytica
HGYYRKPTFSLKAPYVV

SEQ ID NO: 2678072 - protein, 17 aa, Entamoeba histolytica
HHFDLKKGIQLSQGISL

SEQ ID NO: 2678073 - protein, 23 aa, Entamoeba histolytica
HHFFPCANVFVISSSEIKTSQRV

SEQ ID NO: 2678074 - protein, 27 aa, Entamoeba histolytica
HHHSRLCLVINGLPGGPYYSAPFVLQA

SEQ ID NO: 2678075 - protein, 26 aa, Entamoeba histolytica
HHHYCPSCKHLLEAGWMDNCLHTPTA

SEQ ID NO: 2678076 - protein, 23 aa, Entamoeba histolytica
HHIIYFLRCDSTDFSIEEKRINY

SEQ ID NO: 2678077 - protein, 26 aa, Entamoeba histolytica
HHIWSSCFALGCLHFTKGLDFNQIEI

SEQ ID NO: 2678078 - protein, 25 aa, Entamoeba histolytica
HHKKEVKGSLAQRKQIKTQKEVETS

SEQ ID NO: 2678079 - protein, 23 aa, Entamoeba histolytica
HHKTLIGTPHFLAPEIVDETGYN

SEQ ID NO: 2678080 - protein, 36 aa, Entamoeba histolytica
HHKTNLSCFIKLFQRFGEIYSIWGSSNGKIFFVEYY

SEQ ID NO: 2678081 - protein, 20 aa, Entamoeba histolytica
HHLHRHVLRYISSVEEINSN

SEQ ID NO: 2678082 - protein, 17 aa, Entamoeba histolytica
HHLIKQCYQRIMNDVEV

SEQ ID NO: 2678083 - protein, 23 aa, Entamoeba histolytica
HHMFCVDIGYPVRYCNKCQKIKK

SEQ ID NO: 2678084 - protein, 22 aa, Entamoeba histolytica
HHVPNRFDLYLSTGGYKTKNYT

SEQ ID NO: 2678085 - protein, 24 aa, Entamoeba histolytica
HIANARFFLFYDYMMKHRSEIDRV

SEQ ID NO: 2678086 - protein, 19 aa, Entamoeba histolytica
HICGRVCPHYCEKTCVKAK

SEQ ID NO: 2678087 - protein, 18 aa, Entamoeba histolytica
HICLKKHVMVLVFTTDGN

SEQ ID NO: 2678088 - protein, 17 aa, Entamoeba histolytica
HIDCNFNGKLIGVGEDP

SEQ ID NO: 2678089 - protein, 18 aa, Entamoeba histolytica
HIFIYKNLCKEVMEYCFV

SEQ ID NO: 2678090 - protein, 17 aa, Entamoeba histolytica
HIGEALRYSPERNIFRN

SEQ ID NO: 2678091 - protein, 17 aa, Entamoeba histolytica
HIGFFRPIIQVLQCVCK

SEQ ID NO: 2678092 - protein, 18 aa, Entamoeba histolytica
HIIFSRRNSMEISISPIL

SEQ ID NO: 2678093 - protein, 20 aa, Entamoeba histolytica
HIIHYKIGIQIKWNNETYCL

SEQ ID NO: 2678094 - protein, 23 aa, Entamoeba histolytica
HIITYPLLQPFSSIPISSIQSKI

SEQ ID NO: 2678095 - protein, 24 aa, Entamoeba histolytica
HIKGLEILKEVYLFPITKSTNSES

SEQ ID NO: 2678096 - protein, 21 aa, Entamoeba histolytica
HIKLTDFGLCTGFHKDHESSY

SEQ ID NO: 2678097 - protein, 24 aa, Entamoeba histolytica
HIKNSELLQCIYIICKKLIINNSA

SEQ ID NO: 2678098 - protein, 23 aa, Entamoeba histolytica
HIKQAKRNWSMLIYQIHQQHRRA

SEQ ID NO: 2678099 - protein, 25 aa, Entamoeba histolytica
HILIDLCAAPGGWCQVATKEMPVES

SEQ ID NO: 2678100 - protein, 18 aa, Entamoeba histolytica
HILIPILPLFLSSYLSSI

SEQ ID NO: 2678101 - protein, 25 aa, Entamoeba histolytica
HILIQHIVCLNINRLEIFWEQFLLS

SEQ ID NO: 2678102 - protein, 19 aa, Entamoeba histolytica
HINLKLGNLKQIYTINSSV

SEQ ID NO: 2678103 - protein, 25 aa, Entamoeba histolytica
HINLLDRMVVEFDKKDALTLVYNHL

SEQ ID NO: 2678104 - protein, 27 aa, Entamoeba histolytica
HINNLKLEFIRFFKVRQVNINEVIEMT

SEQ ID NO: 2678105 - protein, 20 aa, Entamoeba histolytica
HIPKEVVTIIHGFEKSSLKE

SEQ ID NO: 2678106 - protein, 23 aa, Entamoeba histolytica
HIPQGRVALIGTLFKKSKKIPTL

SEQ ID NO: 2678107 - protein, 17 aa, Entamoeba histolytica
HIPSFLKKKQLQIQKSK

SEQ ID NO: 2678108 - protein, 24 aa, Entamoeba histolytica
HIQANCLICHKPLTPHDLICRYCQ

SEQ ID NO: 2678109 - protein, 18 aa, Entamoeba histolytica
HIQLIFVFDGMTQPIKFH

SEQ ID NO: 2678110 - protein, 24 aa, Entamoeba histolytica
HIRGLEIMKEVYLIPISKCVSKSD

SEQ ID NO: 2678111 - protein, 20 aa, Entamoeba histolytica
HIRLIPRIIPIITKLQSLQS

SEQ ID NO: 2678112 - protein, 24 aa, Entamoeba histolytica
HISAKDYLECHPLRSSAEDSIDKL

SEQ ID NO: 2678113 - protein, 20 aa, Entamoeba histolytica
HITCCDLKNVISCCLYTNVW

SEQ ID NO: 2678114 - protein, 19 aa, Entamoeba histolytica
HITEWCGVIMDWNKYPTKE

SEQ ID NO: 2678115 - protein, 23 aa, Entamoeba histolytica
HITSCAFIALGRFLIKGYDHLSE

SEQ ID NO: 2678116 - protein, 17 aa, Entamoeba histolytica
HIVRILDHFLFNRHICI

SEQ ID NO: 2678117 - protein, 25 aa, Entamoeba histolytica
HIYIYMLEQGYRDAAKVFKKEAKVD

SEQ ID NO: 2678118 - protein, 17 aa, Entamoeba histolytica
HIYNYVVIRKIMIPFPI

SEQ ID NO: 2678119 - protein, 20 aa, Entamoeba histolytica
HIYQSIPYWVWMIMKEDNNE

SEQ ID NO: 2678120 - protein, 17 aa, Entamoeba histolytica
HKCRHLGCDKTYVSLRY

SEQ ID NO: 2678121 - protein, 19 aa, Entamoeba histolytica
HKDFVCLHPVFGIPNLQVF

SEQ ID NO: 2678122 - protein, 18 aa, Entamoeba histolytica
HKDGVALSYFIQALKKQP

SEQ ID NO: 2678123 - protein, 21 aa, Entamoeba histolytica
HKDYCGYYFFPYDIVEQQQSY

SEQ ID NO: 2678124 - protein, 22 aa, Entamoeba histolytica
HKEITIIIKLIIPKILEDNPTN

SEQ ID NO: 2678125 - protein, 20 aa, Entamoeba histolytica
HKELRIYTDAGRCTRPLFTV

SEQ ID NO: 2678126 - protein, 26 aa, Entamoeba histolytica
HKEPHMWLRRGLFFCHRDINAVLDDV

SEQ ID NO: 2678127 - protein, 17 aa, Entamoeba histolytica
HKFEFRYFKNCSSIANT

SEQ ID NO: 2678128 - protein, 25 aa, Entamoeba histolytica
HKFPRIDAQTLLPVCTELNGRKEEW

SEQ ID NO: 2678129 - protein, 22 aa, Entamoeba histolytica
HKGENILMLAIQLGFNDIAFEI

SEQ ID NO: 2678130 - protein, 24 aa, Entamoeba histolytica
HKGFMKHVLGYTIEFLLRSICDKV

SEQ ID NO: 2678131 - protein, 25 aa, Entamoeba histolytica
HKGKYSWHCPGHMGGVAFLRSPPGK

SEQ ID NO: 2678132 - protein, 21 aa, Entamoeba histolytica
HKHIHGGLTPGGRVRMEKLAS

SEQ ID NO: 2678133 - protein, 19 aa, Entamoeba histolytica
HKHYRCFYNSSLDGLYSAK

SEQ ID NO: 2678134 - protein, 28 aa, Entamoeba histolytica
HKIFVQGCIWNVNSFDQWGVELGKQLAK

SEQ ID NO: 2678135 - protein, 22 aa, Entamoeba histolytica
HKIGEYPGSVYIEIPIEIKNKI

SEQ ID NO: 2678136 - protein, 17 aa, Entamoeba histolytica
HKIKFHLSQSYVTSNPH

SEQ ID NO: 2678137 - protein, 20 aa, Entamoeba histolytica
HKIKRKQLFNVYKLINDYGT

SEQ ID NO: 2678138 - protein, 17 aa, Entamoeba histolytica
HKINEEIGVAKIVVEIG

SEQ ID NO: 2678139 - protein, 25 aa, Entamoeba histolytica
HKINGVIVGSFFDYFVPYNIKDFYE

SEQ ID NO: 2678140 - protein, 17 aa, Entamoeba histolytica
HKIRIWRKQSIRQFGPL

SEQ ID NO: 2678141 - protein, 19 aa, Entamoeba histolytica
HKISGLSILNYGTINICVP

SEQ ID NO: 2678142 - protein, 25 aa, Entamoeba histolytica
HKISIELKIPFGLNQPSNVQSFLSD

SEQ ID NO: 2678143 - protein, 17 aa, Entamoeba histolytica
HKISLPRINQCMLGSYF

SEQ ID NO: 2678144 - protein, 18 aa, Entamoeba histolytica
HKKALKLCADVVTCDPNP

SEQ ID NO: 2678145 - protein, 19 aa, Entamoeba histolytica
HKKGLFDLFSRIKHTTNEE

SEQ ID NO: 2678146 - protein, 22 aa, Entamoeba histolytica
HKKKENKRAFSLEEINTVRKGT

SEQ ID NO: 2678147 - protein, 23 aa, Entamoeba histolytica
HKKSCCSKLRYSIITLDTALNST

SEQ ID NO: 2678148 - protein, 22 aa, Entamoeba histolytica
HKKSWLCFDKKRILFNPENAII

SEQ ID NO: 2678149 - protein, 20 aa, Entamoeba histolytica
HKKTLISICEYLIDSGINCE

SEQ ID NO: 2678150 - protein, 25 aa, Entamoeba histolytica
HKKYLPCVSKKLFTLKDVSKRILQW

SEQ ID NO: 2678151 - protein, 19 aa, Entamoeba histolytica
HKLCLERYGSNKFQAMEQL

SEQ ID NO: 2678152 - protein, 28 aa, Entamoeba histolytica
HKLIKRFWPGALTIIFPRNEAVPNEVTA

SEQ ID NO: 2678153 - protein, 19 aa, Entamoeba histolytica
HKLKGNEYLNAKDYSKAID

SEQ ID NO: 2678154 - protein, 17 aa, Entamoeba histolytica
HKLKRKEVETDWNDDDF

SEQ ID NO: 2678155 - protein, 17 aa, Entamoeba histolytica
HKLLGCVGQHDFPIERL

SEQ ID NO: 2678156 - protein, 25 aa, Entamoeba histolytica
HKLTLRIGNVFQIHYLKKYIEEIKT

SEQ ID NO: 2678157 - protein, 23 aa, Entamoeba histolytica
HKMKVTLLRFILENTQYLDEDSI

SEQ ID NO: 2678158 - protein, 18 aa, Entamoeba histolytica
HKNHGCWIKKIGETDGEL

SEQ ID NO: 2678159 - protein, 19 aa, Entamoeba histolytica
HKNYKACGVLSEKKKDHDK

SEQ ID NO: 2678160 - protein, 17 aa, Entamoeba histolytica
HKRDIPFVSSIINALTE

SEQ ID NO: 2678161 - protein, 24 aa, Entamoeba histolytica
HKREEFKFKGFRQLLKEMTVSSIH

SEQ ID NO: 2678162 - protein, 25 aa, Entamoeba histolytica
HKSDDGRSWFNYKGNNIIVVDLNKY

SEQ ID NO: 2678163 - protein, 17 aa, Entamoeba histolytica
HKSFRNIYEYVQQIKEY

SEQ ID NO: 2678164 - protein, 23 aa, Entamoeba histolytica
HKSLCSTPSFLSSVIQSIIFEYL

SEQ ID NO: 2678165 - protein, 22 aa, Entamoeba histolytica
HKSQPIECPLLYSQRTINDYSP

SEQ ID NO: 2678166 - protein, 28 aa, Entamoeba histolytica
HKSWKKRWFQTTPRNPFRLDYYTNDSCS

SEQ ID NO: 2678167 - protein, 25 aa, Entamoeba histolytica
HKTEFSRQTFFRLGLFSLLLHEVML

SEQ ID NO: 2678168 - protein, 34 aa, Entamoeba histolytica
HKTILKILFMLSKWMSSFPHDFMDGGKEALLPLL

SEQ ID NO: 2678169 - protein, 26 aa, Entamoeba histolytica
HKTMKWKEWYEKDLITLTRIERKYDY

SEQ ID NO: 2678170 - protein, 25 aa, Entamoeba histolytica
HKTPRLMNELEIDMLRGFQCNSSYV

SEQ ID NO: 2678171 - protein, 27 aa, Entamoeba histolytica
HKTQEPTVIGFPFTIKFKEFQQNPHFF

SEQ ID NO: 2678172 - protein, 19 aa, Entamoeba histolytica
HKTRIEMGSLRQVLEIISL

SEQ ID NO: 2678173 - protein, 25 aa, Entamoeba histolytica
HKTYDCWSSLLLPEELWTDNVYHPF

SEQ ID NO: 2678174 - protein, 17 aa, Entamoeba histolytica
HKYFDPFGPIIGVDIVY

SEQ ID NO: 2678175 - protein, 20 aa, Entamoeba histolytica
HKYQLKHMLYIKFLENPELL

SEQ ID NO: 2678176 - protein, 18 aa, Entamoeba histolytica
HLAKRKVSVLSDQEKKAI

SEQ ID NO: 2678177 - protein, 25 aa, Entamoeba histolytica
HLAKSSKLLAQWIVLCPSSVIPIFS

SEQ ID NO: 2678178 - protein, 17 aa, Entamoeba histolytica
HLALRIRGGKPVILLYD

SEQ ID NO: 2678179 - protein, 25 aa, Entamoeba histolytica
HLCPCAPSTFPCFPASSDPFILEEP

SEQ ID NO: 2678180 - protein, 19 aa, Entamoeba histolytica
HLCTHRFVHIDFGYILNKK

SEQ ID NO: 2678181 - protein, 21 aa, Entamoeba histolytica
HLDKLFEIINKYLLHQHPRVR

SEQ ID NO: 2678182 - protein, 20 aa, Entamoeba histolytica
HLDKRYPKGFVIDKETELPA

SEQ ID NO: 2678183 - protein, 23 aa, Entamoeba histolytica
HLDRNCQWIRLFEEIYSCDLEGL

SEQ ID NO: 2678184 - protein, 28 aa, Entamoeba histolytica
HLEDIYIKLPFYFERPFTDWTLSLLQKS

SEQ ID NO: 2678185 - protein, 21 aa, Entamoeba histolytica
HLEEEFDWITLFEKVHSTIIK

SEQ ID NO: 2678186 - protein, 20 aa, Entamoeba histolytica
HLEEGRWYPDTGFDDNENIC

SEQ ID NO: 2678187 - protein, 21 aa, Entamoeba histolytica
HLEKIRLPYNLSKIGNQAFCY

SEQ ID NO: 2678188 - protein, 20 aa, Entamoeba histolytica
HLEMGKSLSVEQLMKIFELN

SEQ ID NO: 2678189 - protein, 18 aa, Entamoeba histolytica
HLEYGCWYIKPTLLADNS

SEQ ID NO: 2678190 - protein, 19 aa, Entamoeba histolytica
HLFCISGEIISYIHHTNKP

SEQ ID NO: 2678191 - protein, 17 aa, Entamoeba histolytica
HLFLEKLNRGILTEFSR

SEQ ID NO: 2678192 - protein, 17 aa, Entamoeba histolytica
HLFLQKFISAYLLTHNK

SEQ ID NO: 2678193 - protein, 18 aa, Entamoeba histolytica
HLGCDKTYVSLRYLRAHE

SEQ ID NO: 2678194 - protein, 24 aa, Entamoeba histolytica
HLGEGKYFIRYSLPAEKGEYHINC

SEQ ID NO: 2678195 - protein, 23 aa, Entamoeba histolytica
HLHELSIRPSLLLEISLTLNSPI

SEQ ID NO: 2678196 - protein, 23 aa, Entamoeba histolytica
HLILDCSQFLYSTIIPNYSSDSY

SEQ ID NO: 2678197 - protein, 26 aa, Entamoeba histolytica
HLILLKGRCGLVSLCYGLLERTVEFD

SEQ ID NO: 2678198 - protein, 17 aa, Entamoeba histolytica
HLIRIGCIKESKANGGV

SEQ ID NO: 2678199 - protein, 17 aa, Entamoeba histolytica
HLISFKPLNSFEAYQYL

SEQ ID NO: 2678200 - protein, 24 aa, Entamoeba histolytica
HLKDFSIIHSFEFLAKVKKMDKNY

SEQ ID NO: 2678201 - protein, 20 aa, Entamoeba histolytica
HLKDLKLFDCENVPLSLIPV

SEQ ID NO: 2678202 - protein, 21 aa, Entamoeba histolytica
HLKLLDKLMIYDARPNVLSTL

SEQ ID NO: 2678203 - protein, 18 aa, Entamoeba histolytica
HLKNCNFVSLVSGFCCSS

SEQ ID NO: 2678204 - protein, 23 aa, Entamoeba histolytica
HLKNEFKNYVYLTSKVECIGDAN

SEQ ID NO: 2678205 - protein, 20 aa, Entamoeba histolytica
HLKRIRRYEGELEIIICKIK

SEQ ID NO: 2678206 - protein, 26 aa, Entamoeba histolytica
HLKTTIIVNLHIWKALNASFKTQVAT

SEQ ID NO: 2678207 - protein, 20 aa, Entamoeba histolytica
HLLCLKRLGRENHLCSSCKT

SEQ ID NO: 2678208 - protein, 22 aa, Entamoeba histolytica
HLLCVFPVPIILEKDEYYVIYH

SEQ ID NO: 2678209 - protein, 17 aa, Entamoeba histolytica
HLLDLNLPYKLIKNKIF

SEQ ID NO: 2678210 - protein, 19 aa, Entamoeba histolytica
HLLFFYELIGSCFSLPLSH

SEQ ID NO: 2678211 - protein, 18 aa, Entamoeba histolytica
HLLFPNYICPAIEQTIVN

SEQ ID NO: 2678212 - protein, 24 aa, Entamoeba histolytica
HLLIDLLIIRGGYEFESKYAEGKA

SEQ ID NO: 2678213 - protein, 17 aa, Entamoeba histolytica
HLLLCGQPGIGKTTSIH

SEQ ID NO: 2678214 - protein, 25 aa, Entamoeba histolytica
HLLLDMLRMYGITFNTTFSSGKHNS

SEQ ID NO: 2678215 - protein, 17 aa, Entamoeba histolytica
HLLPKHVLENVLMVSTQ

SEQ ID NO: 2678216 - protein, 21 aa, Entamoeba histolytica
HLLPSKIFRKVMSIMLHGFTE

SEQ ID NO: 2678217 - protein, 19 aa, Entamoeba histolytica
HLLSLKIVQSFPVCDPSFF

SEQ ID NO: 2678218 - protein, 17 aa, Entamoeba histolytica
HLLSLRFRFPSTCDLRF

SEQ ID NO: 2678219 - protein, 25 aa, Entamoeba histolytica
HLMCNKKLGRYCIGLIDYHVECNQN

SEQ ID NO: 2678220 - protein, 19 aa, Entamoeba histolytica
HLNELRIAQNLDKQIEQEL

SEQ ID NO: 2678221 - protein, 20 aa, Entamoeba histolytica
HLNELRIAQNLDKQIEQELE

SEQ ID NO: 2678222 - protein, 24 aa, Entamoeba histolytica
HLNKEFCCYCGIGIDAYQLRTKEN

SEQ ID NO: 2678223 - protein, 18 aa, Entamoeba histolytica
HLNVWRYGEIDDDEEKDK

SEQ ID NO: 2678224 - protein, 26 aa, Entamoeba histolytica
HLPLLKRMRFEVLKYINSITGLKEEE

SEQ ID NO: 2678225 - protein, 19 aa, Entamoeba histolytica
HLPSNFILHVVFDLLNTCS

SEQ ID NO: 2678226 - protein, 22 aa, Entamoeba histolytica
HLSICLEEINKLISDVISIRRK

SEQ ID NO: 2678227 - protein, 17 aa, Entamoeba histolytica
HLSRAFRNRFIELHFDE

SEQ ID NO: 2678228 - protein, 17 aa, Entamoeba histolytica
HLSSCSFRNKSIENSLY

SEQ ID NO: 2678229 - protein, 23 aa, Entamoeba histolytica
HLSTDPYTGFALVLTPTRELASQ

SEQ ID NO: 2678230 - protein, 20 aa, Entamoeba histolytica
HLTCFDVFPKNMFKPKRRHQ

SEQ ID NO: 2678231 - protein, 25 aa, Entamoeba histolytica
HLTEKTTRCLLFYLMYFLGHSQMFD

SEQ ID NO: 2678232 - protein, 22 aa, Entamoeba histolytica
HLTKLELSNCFNIRTLNSITSL

SEQ ID NO: 2678233 - protein, 21 aa, Entamoeba histolytica
HLTNVCIFIKGKIETPTRTNV

SEQ ID NO: 2678234 - protein, 29 aa, Entamoeba histolytica
HLTQSFYQYARWAWEKVKELSQNIITLFT

SEQ ID NO: 2678235 - protein, 19 aa, Entamoeba histolytica
HLTSLYLPNSLTFLGGGCF

SEQ ID NO: 2678236 - protein, 19 aa, Entamoeba histolytica
HLVEKMEYCVVKYAKSLLC

SEQ ID NO: 2678237 - protein, 17 aa, Entamoeba histolytica
HLVKIFFKHIVRVQNYY

SEQ ID NO: 2678238 - protein, 20 aa, Entamoeba histolytica
HLVNRILFCQEITLMNEKNL

SEQ ID NO: 2678239 - protein, 24 aa, Entamoeba histolytica
HLWYCTPLERIFRNITNDIILKDI

SEQ ID NO: 2678240 - protein, 24 aa, Entamoeba histolytica
HLYGPAMLACFPLQDILSLKLKYI

SEQ ID NO: 2678241 - protein, 17 aa, Entamoeba histolytica
HLYLCPSNILISRDPAS

SEQ ID NO: 2678242 - protein, 18 aa, Entamoeba histolytica
HMCKRLGVNLEEFTLNQL

SEQ ID NO: 2678243 - protein, 22 aa, Entamoeba histolytica
HMELSFYLVLHFLFHEEMILSP

SEQ ID NO: 2678244 - protein, 22 aa, Entamoeba histolytica
HMKQIKFKLVIGNTINADVEKS

SEQ ID NO: 2678245 - protein, 18 aa, Entamoeba histolytica
HMLYPSCVRMNYKDQLLI

SEQ ID NO: 2678246 - protein, 25 aa, Entamoeba histolytica
HMNKDLVICSSILGAIMNNQESEPF

SEQ ID NO: 2678247 - protein, 25 aa, Entamoeba histolytica
HMNTELRKAIFIALMGAMDYVDGYQ

SEQ ID NO: 2678248 - protein, 17 aa, Entamoeba histolytica
HMQQSLETLNWVIKVVM

SEQ ID NO: 2678249 - protein, 26 aa, Entamoeba histolytica
HMTCANCGYQFCWLCMQEYTSSHFKN

SEQ ID NO: 2678250 - protein, 26 aa, Entamoeba histolytica
HMTCKCGYQFCWLCGVKYSSDHWTNN

SEQ ID NO: 2678251 - protein, 26 aa, Entamoeba histolytica
HMTCPKCHGEWCWMCRGDWKTHGEKT

SEQ ID NO: 2678252 - protein, 17 aa, Entamoeba histolytica
HNACFKCKECGLHLTLK

SEQ ID NO: 2678253 - protein, 26 aa, Entamoeba histolytica
HNAFKEHFMYPILIVRVSRIIDNSLW

SEQ ID NO: 2678254 - protein, 22 aa, Entamoeba histolytica
HNELKPYLLRRMKKDVEKSLPP

SEQ ID NO: 2678255 - protein, 25 aa, Entamoeba histolytica
HNELKRLVVGAVQYPSLYKKFGVDT

SEQ ID NO: 2678256 - protein, 24 aa, Entamoeba histolytica
HNELWKVVMKFVITLNTPLLFEKL

SEQ ID NO: 2678257 - protein, 18 aa, Entamoeba histolytica
HNFFRSVAYITSITTQGG

SEQ ID NO: 2678258 - protein, 19 aa, Entamoeba histolytica
HNFSLLIDECTSFRDKLQY

SEQ ID NO: 2678259 - protein, 21 aa, Entamoeba histolytica
HNFVKCIGYILSNTVGVDLFQ

SEQ ID NO: 2678260 - protein, 19 aa, Entamoeba histolytica
HNGEWTLDSDKEFLEYIKE

SEQ ID NO: 2678261 - protein, 18 aa, Entamoeba histolytica
HNGIKMELLGIIENDSSK

SEQ ID NO: 2678262 - protein, 24 aa, Entamoeba histolytica
HNGNCKLSDFGLCVTKQHAEKIKE

SEQ ID NO: 2678263 - protein, 22 aa, Entamoeba histolytica
HNHALEILKTLGYEVDQTHIDQ

SEQ ID NO: 2678264 - protein, 20 aa, Entamoeba histolytica
HNIGLLAITCIKRYLIDWDK

SEQ ID NO: 2678265 - protein, 27 aa, Entamoeba histolytica
HNIILKEYFVHYSFMISYYAPCELNKI

SEQ ID NO: 2678266 - protein, 23 aa, Entamoeba histolytica
HNIPFLICIKQNCTIKELKRKIE

SEQ ID NO: 2678267 - protein, 26 aa, Entamoeba histolytica
HNIPWKERIQIAISIAKGMTVFTSQK

SEQ ID NO: 2678268 - protein, 17 aa, Entamoeba histolytica
HNISQCIQEIVVGSDVK

SEQ ID NO: 2678269 - protein, 29 aa, Entamoeba histolytica
HNIVPAVFGLRWIRMLYAREFHIDDVVIL

SEQ ID NO: 2678270 - protein, 24 aa, Entamoeba histolytica
HNKQIIKYIIWYKVSYTYYMKHKS

SEQ ID NO: 2678271 - protein, 24 aa, Entamoeba histolytica
HNLDIPLDIIIPFISNEWSRKYVI

SEQ ID NO: 2678272 - protein, 20 aa, Entamoeba histolytica
HNLNKSVLLYSLYNSIHNSD

SEQ ID NO: 2678273 - protein, 20 aa, Entamoeba histolytica
HNNLGLSYQALNMWTEAVEH

SEQ ID NO: 2678274 - protein, 17 aa, Entamoeba histolytica
HNNPIIKYQLEENNGIR

SEQ ID NO: 2678275 - protein, 19 aa, Entamoeba histolytica
HNNVKWFPFPDHHNPSLIV

SEQ ID NO: 2678276 - protein, 20 aa, Entamoeba histolytica
HNRGSARFMQLQSLQERNEL

SEQ ID NO: 2678277 - protein, 18 aa, Entamoeba histolytica
HNSLKFTYNEAIGTYTKS

SEQ ID NO: 2678278 - protein, 31 aa, Entamoeba histolytica
HNYHPNCFVCTRCGKPFNGSYMLINGQPVCK

SEQ ID NO: 2678279 - protein, 24 aa, Entamoeba histolytica
HPAPEFLEALQFSIGSFGTIYPFN

SEQ ID NO: 2678280 - protein, 22 aa, Entamoeba histolytica
HPATFIIKARIKIIKTNDLTYY

SEQ ID NO: 2678281 - protein, 20 aa, Entamoeba histolytica
HPDFRFGEFNSLLRLFQVKC

SEQ ID NO: 2678282 - protein, 30 aa, Entamoeba histolytica
HPDQCKTIQAAKYWRQMIIKEMGQKVSEIQ

SEQ ID NO: 2678283 - protein, 28 aa, Entamoeba histolytica
HPDSLYILGVMYYKGKYVFEDKTLAMEY

SEQ ID NO: 2678284 - protein, 23 aa, Entamoeba histolytica
HPEFPSTYLKRGDVYHHVCVYQF

SEQ ID NO: 2678285 - protein, 17 aa, Entamoeba histolytica
HPEHFVCSFCVNPLTES

SEQ ID NO: 2678286 - protein, 18 aa, Entamoeba histolytica
HPEIIKAVIVSFENEDAF

SEQ ID NO: 2678287 - protein, 19 aa, Entamoeba histolytica
HPEYFYGSRINRKSTSLPR

SEQ ID NO: 2678288 - protein, 29 aa, Entamoeba histolytica
HPEYRLKLTTLLPAFDFGMDIFIDKLPLT

SEQ ID NO: 2678289 - protein, 19 aa, Entamoeba histolytica
HPFAKLVLEYRKISKLLSG

SEQ ID NO: 2678290 - protein, 21 aa, Entamoeba histolytica
HPFFDSLRVQPKFTKSMSVYS

SEQ ID NO: 2678291 - protein, 18 aa, Entamoeba histolytica
HPFIPTSLTGIIIEAWEC

SEQ ID NO: 2678292 - protein, 25 aa, Entamoeba histolytica
HPIEIPKLPWGLGMANKTIRGGMTP

SEQ ID NO: 2678293 - protein, 21 aa, Entamoeba histolytica
HPIFERKGSDLIMSKTITLNE

SEQ ID NO: 2678294 - protein, 23 aa, Entamoeba histolytica
HPIKRFGSGDFWEKMSVESENYN

SEQ ID NO: 2678295 - protein, 23 aa, Entamoeba histolytica
HPKPRPGGGYYLIMQKFKTNAIL

SEQ ID NO: 2678296 - protein, 19 aa, Entamoeba histolytica
HPLLLKSSLFLLFNEAVTK

SEQ ID NO: 2678297 - protein, 26 aa, Entamoeba histolytica
HPLQLPRTCRILHIKSLIKTESLDLS

SEQ ID NO: 2678298 - protein, 25 aa, Entamoeba histolytica
HPNDFNKWLSTIFGREVYVEKEYMD

SEQ ID NO: 2678299 - protein, 18 aa, Entamoeba histolytica
HPNISFFGKICLDTLKPQ

SEQ ID NO: 2678300 - protein, 30 aa, Entamoeba histolytica
HPNQFPKFTCQWIELFSHRSLLLSLSKPSE

SEQ ID NO: 2678301 - protein, 17 aa, Entamoeba histolytica
HPNVFKDGRICLDILQD

SEQ ID NO: 2678302 - protein, 17 aa, Entamoeba histolytica
HPNVITMYGLYKNEESL

SEQ ID NO: 2678303 - protein, 18 aa, Entamoeba histolytica
HPNVLAGYLGRGSAKAML

SEQ ID NO: 2678304 - protein, 36 aa, Entamoeba histolytica
HPQCFVANVNCKLCGKPFTFPKMEFKIYNDQAYHPL

SEQ ID NO: 2678305 - protein, 17 aa, Entamoeba histolytica
HPQFFISENLTMNCPRV

SEQ ID NO: 2678306 - protein, 18 aa, Entamoeba histolytica
HPQNCFWSIISSLKSMTN

SEQ ID NO: 2678307 - protein, 24 aa, Entamoeba histolytica
HPRKRSKITLPFFNVIRISTEKEV

SEQ ID NO: 2678308 - protein, 17 aa, Entamoeba histolytica
HPSHLPILLPVIQLIPF

SEQ ID NO: 2678309 - protein, 19 aa, Entamoeba histolytica
HPTLLPIGIGHDFFIDSHQ

SEQ ID NO: 2678310 - protein, 18 aa, Entamoeba histolytica
HPVFGIPNLQVFMLMKGL

SEQ ID NO: 2678311 - protein, 19 aa, Entamoeba histolytica
HPVGHLLASCAHDQTTKFW

SEQ ID NO: 2678312 - protein, 20 aa, Entamoeba histolytica
HPVNFRISIRSNQNGQPTTR

SEQ ID NO: 2678313 - protein, 17 aa, Entamoeba histolytica
HPYGCRVIQRLIEKNSQ

SEQ ID NO: 2678314 - protein, 17 aa, Entamoeba histolytica
HPYIIKLYDVFDGNDGK

SEQ ID NO: 2678315 - protein, 19 aa, Entamoeba histolytica
HPYILKSLQKCVSEWIREG

SEQ ID NO: 2678316 - protein, 25 aa, Entamoeba histolytica
HQAKPRGAIGYQFMKETIKLLTLEE

SEQ ID NO: 2678317 - protein, 26 aa, Entamoeba histolytica
HQDYQARITFCYAATVALNMSLLCGV

SEQ ID NO: 2678318 - protein, 26 aa, Entamoeba histolytica
HQFDIIECIILIGSIINVFMNKSKLH

SEQ ID NO: 2678319 - protein, 17 aa, Entamoeba histolytica
HQFHLRVQPFGSTNSLK

SEQ ID NO: 2678320 - protein, 17 aa, Entamoeba histolytica
HQHMLIVLKRPRSFKAR

SEQ ID NO: 2678321 - protein, 27 aa, Entamoeba histolytica
HQIGASWKIECFWLSSRRNCYIKGGIN

SEQ ID NO: 2678322 - protein, 24 aa, Entamoeba histolytica
HQIKDCGDVNCIGRIHTFLEQMQW

SEQ ID NO: 2678323 - protein, 22 aa, Entamoeba histolytica
HQKEECCSSCDEECHCECKHNQ

SEQ ID NO: 2678324 - protein, 26 aa, Entamoeba histolytica
HQKLGFKGSLKFASPNQHLGKKSIPI

SEQ ID NO: 2678325 - protein, 18 aa, Entamoeba histolytica
HQKREVITHVSLYELDAA

SEQ ID NO: 2678326 - protein, 17 aa, Entamoeba histolytica
HQLCVTCQLGIENGGTE

SEQ ID NO: 2678327 - protein, 22 aa, Entamoeba histolytica
HQLSDCWELWVDEMSESFSSSE

SEQ ID NO: 2678328 - protein, 27 aa, Entamoeba histolytica
HQMLLKGELPLSIGGGIGQSRLCMFYL

SEQ ID NO: 2678329 - protein, 21 aa, Entamoeba histolytica
HQQMAEFFLGYANGSSIDYKF

SEQ ID NO: 2678330 - protein, 24 aa, Entamoeba histolytica
HQSLIICGVEFFMINKNKIVNSNF

SEQ ID NO: 2678331 - protein, 17 aa, Entamoeba histolytica
HQSLRCAQISSFMYAIP

SEQ ID NO: 2678332 - protein, 17 aa, Entamoeba histolytica
HQTNCLCFLLPSYSHPS

SEQ ID NO: 2678333 - protein, 18 aa, Entamoeba histolytica
HQTNCLCFLLPSYSHPSP

SEQ ID NO: 2678334 - protein, 24 aa, Entamoeba histolytica
HQYIPIELFCIVSTQLLKALHYIH

SEQ ID NO: 2678335 - protein, 17 aa, Entamoeba histolytica
HRAAIAFLAAYTGPITI

SEQ ID NO: 2678336 - protein, 19 aa, Entamoeba histolytica
HRECLLKWIQMIDRLEEGE

SEQ ID NO: 2678337 - protein, 17 aa, Entamoeba histolytica
HREIKFGEGKNVYITGF

SEQ ID NO: 2678338 - protein, 23 aa, Entamoeba histolytica
HRFIEFFDLRSAEKALKTMNKSE

SEQ ID NO: 2678339 - protein, 25 aa, Entamoeba histolytica
HRFVMRRFASIFVIVGFDEEENELA

SEQ ID NO: 2678340 - protein, 26 aa, Entamoeba histolytica
HRGLKKFWWKAMDYLSFKTLNKRKKE

SEQ ID NO: 2678341 - protein, 24 aa, Entamoeba histolytica
HRHELPVPYLLPIIYEDNDVIVVN

SEQ ID NO: 2678342 - protein, 22 aa, Entamoeba histolytica
HRHLQLDLCSQVNFIVGENGSG

SEQ ID NO: 2678343 - protein, 21 aa, Entamoeba histolytica
HRIGLIPIPLYATLGVQSINY

SEQ ID NO: 2678344 - protein, 22 aa, Entamoeba histolytica
HRIPSLVYLCVMYICEPEHITQ

SEQ ID NO: 2678345 - protein, 29 aa, Entamoeba histolytica
HRKDISLKPFRTGYICRECFEILHYKKFK

SEQ ID NO: 2678346 - protein, 17 aa, Entamoeba histolytica
HRKTMVFNNEIHLLKYN

SEQ ID NO: 2678347 - protein, 24 aa, Entamoeba histolytica
HRLEWLCGFSGFTGEIVITQKQAC

SEQ ID NO: 2678348 - protein, 19 aa, Entamoeba histolytica
HRLVLPKTDFIFTVNYKKV

SEQ ID NO: 2678349 - protein, 19 aa, Entamoeba histolytica
HRMAICGKNVPITYQDCSC

SEQ ID NO: 2678350 - protein, 24 aa, Entamoeba histolytica
HRMKAWNTLCDFLKSRYIEAERNC

SEQ ID NO: 2678351 - protein, 20 aa, Entamoeba histolytica
HRMKRVKCEGSQMFVVTNQM

SEQ ID NO: 2678352 - protein, 33 aa, Entamoeba histolytica
HRNANKMSVSFNWILDRCLSYGYEFKKRSTKPT

SEQ ID NO: 2678353 - protein, 24 aa, Entamoeba histolytica
HRPQFRSAVLMFQREFAMRLVAKP

SEQ ID NO: 2678354 - protein, 23 aa, Entamoeba histolytica
HRQCARCIICNKFSDRKKCLLCG

SEQ ID NO: 2678355 - protein, 19 aa, Entamoeba histolytica
HRQRLKEMIERAEDIQKEL

SEQ ID NO: 2678356 - protein, 25 aa, Entamoeba histolytica
HRREVLKKRMELFAPKTRAKPKRTD

SEQ ID NO: 2678357 - protein, 27 aa, Entamoeba histolytica
HRSFDCATPLLIQWTYQAMIHEFLGIN

SEQ ID NO: 2678358 - protein, 24 aa, Entamoeba histolytica
HRVFKRKGNDLVMDKKITLNEALT

SEQ ID NO: 2678359 - protein, 18 aa, Entamoeba histolytica
HRVLFKGLLNEVFHVIYI

SEQ ID NO: 2678360 - protein, 27 aa, Entamoeba histolytica
HRVWVTCFRYLINIIKHLYIDNKPLFY

SEQ ID NO: 2678361 - protein, 17 aa, Entamoeba histolytica
HSARKWFVEKTGNEEAV

SEQ ID NO: 2678362 - protein, 23 aa, Entamoeba histolytica
HSCAGYCVATYLLGIGDRHSDNV

SEQ ID NO: 2678363 - protein, 21 aa, Entamoeba histolytica
HSCQLDHAFSMEMWGGATFDV

SEQ ID NO: 2678364 - protein, 19 aa, Entamoeba histolytica
HSCYGRIAPGSSLAIKYGI

SEQ ID NO: 2678365 - protein, 20 aa, Entamoeba histolytica
HSCYGRIAPRSSLAIKYGID

SEQ ID NO: 2678366 - protein, 25 aa, Entamoeba histolytica
HSEIKELFVQFLIDNDFICFLCIAI

SEQ ID NO: 2678367 - protein, 19 aa, Entamoeba histolytica
HSENILFILFDNGKIRVYR

SEQ ID NO: 2678368 - protein, 18 aa, Entamoeba histolytica
HSFDWPLVPPEFLKTLGN

SEQ ID NO: 2678369 - protein, 17 aa, Entamoeba histolytica
HSFEIPIQPSLTFILRK

SEQ ID NO: 2678370 - protein, 33 aa, Entamoeba histolytica
HSFFYCFAEDQFFWVYKFLKGVQEREVFRISYD

SEQ ID NO: 2678371 - protein, 18 aa, Entamoeba histolytica
HSFGATMFDSVLSGKKVH

SEQ ID NO: 2678372 - protein, 19 aa, Entamoeba histolytica
HSFNDGKVYLALAHVISNK

SEQ ID NO: 2678373 - protein, 25 aa, Entamoeba histolytica
HSFRKGASYTPYFNVLGVILCFDYQ

SEQ ID NO: 2678374 - protein, 25 aa, Entamoeba histolytica
HSFYSCKLLESLFIPSSVQSYGSYV

SEQ ID NO: 2678375 - protein, 21 aa, Entamoeba histolytica
HSGTGISCYVFYEEKDGEEVG

SEQ ID NO: 2678376 - protein, 22 aa, Entamoeba histolytica
HSIAQKYGIFFNYNLVNELNVF

SEQ ID NO: 2678377 - protein, 17 aa, Entamoeba histolytica
HSIGVMDMLVDRELSNQ

SEQ ID NO: 2678378 - protein, 20 aa, Entamoeba histolytica
HSIHSPMCRFAHSQLSDHKR

SEQ ID NO: 2678379 - protein, 27 aa, Entamoeba histolytica
HSIKLWSLKNWNWKLVCKYEEHSKPVV

SEQ ID NO: 2678380 - protein, 17 aa, Entamoeba histolytica
HSILNFFTELSMLNENL

SEQ ID NO: 2678381 - protein, 23 aa, Entamoeba histolytica
HSIYHLRAGVRILQRASKLNLPM

SEQ ID NO: 2678382 - protein, 20 aa, Entamoeba histolytica
HSIYKLDLNEFVKLSEEKQK

SEQ ID NO: 2678383 - protein, 18 aa, Entamoeba histolytica
HSLCIPYIGSVLESIEEI

SEQ ID NO: 2678384 - protein, 17 aa, Entamoeba histolytica
HSLCNQCNISIKQLNTW

SEQ ID NO: 2678385 - protein, 23 aa, Entamoeba histolytica
HSLDGYDEFEWVQFHPMGHVVIA

SEQ ID NO: 2678386 - protein, 20 aa, Entamoeba histolytica
HSLDIVRYGHYLSVVVDKSR

SEQ ID NO: 2678387 - protein, 17 aa, Entamoeba histolytica
HSLDLLIQIIDLLNKNI

SEQ ID NO: 2678388 - protein, 25 aa, Entamoeba histolytica
HSLETCPQCHIKCELLSMDRHINGS

SEQ ID NO: 2678389 - protein, 23 aa, Entamoeba histolytica
HSLFKMICVFNIDSIFSPSDSFP

SEQ ID NO: 2678390 - protein, 19 aa, Entamoeba histolytica
HSLGKLLVVTRWLGRNPVL

SEQ ID NO: 2678391 - protein, 19 aa, Entamoeba histolytica
HSLGLYVILDGVFGHHKSG

SEQ ID NO: 2678392 - protein, 19 aa, Entamoeba histolytica
HSLIPLSLALLFESSICNS

SEQ ID NO: 2678393 - protein, 20 aa, Entamoeba histolytica
HSLIPLSLALLFESSICNSK

SEQ ID NO: 2678394 - protein, 17 aa, Entamoeba histolytica
HSLLCNKIKGLFNYCKK

SEQ ID NO: 2678395 - protein, 18 aa, Entamoeba histolytica
HSNEKFYLRYKFMERDGV

SEQ ID NO: 2678396 - protein, 25 aa, Entamoeba histolytica
HSNELFKNAYHMIPSTTLQNGVHQV

SEQ ID NO: 2678397 - protein, 23 aa, Entamoeba histolytica
HSNEPCGFCFVEFNKRNDAALAM

SEQ ID NO: 2678398 - protein, 18 aa, Entamoeba histolytica
HSNFAFSGSLDGIIRMYD

SEQ ID NO: 2678399 - protein, 17 aa, Entamoeba histolytica
HSNKLLANYCVSKIIEL

SEQ ID NO: 2678400 - protein, 19 aa, Entamoeba histolytica
HSPIPLMIGFEGIITNIQI

SEQ ID NO: 2678401 - protein, 17 aa, Entamoeba histolytica
HSPKFIVNLNKFTVLTK

SEQ ID NO: 2678402 - protein, 19 aa, Entamoeba histolytica
HSPLIPPHCLKVASMYIPV

SEQ ID NO: 2678403 - protein, 28 aa, Entamoeba histolytica
HSPRMKKERSWRTAQIFQKEKVLNVVGS

SEQ ID NO: 2678404 - protein, 18 aa, Entamoeba histolytica
HSQLKAMIYELNKENNCL

SEQ ID NO: 2678405 - protein, 27 aa, Entamoeba histolytica
HSQQIYPCISISFGLQVYSMNESTEIT

SEQ ID NO: 2678406 - protein, 18 aa, Entamoeba histolytica
HSQYSPVFHQFIECVFIL

SEQ ID NO: 2678407 - protein, 24 aa, Entamoeba histolytica
HSRNSLEFLSHFPGVEDKVSPINC

SEQ ID NO: 2678408 - protein, 26 aa, Entamoeba histolytica
HSSELFPERWFDLIVVLRTDNTVLYD

SEQ ID NO: 2678409 - protein, 21 aa, Entamoeba histolytica
HSSICKICQRVFGVIRDSFWR

SEQ ID NO: 2678410 - protein, 20 aa, Entamoeba histolytica
HSSKGRFIIRKVDNINLLPP

SEQ ID NO: 2678411 - protein, 25 aa, Entamoeba histolytica
HSSPKIPVTALWMGEIIRYSQLPSF

SEQ ID NO: 2678412 - protein, 17 aa, Entamoeba histolytica
HSSPRYKMEKLRNRKSC

SEQ ID NO: 2678413 - protein, 23 aa, Entamoeba histolytica
HSSRKESLRKFPMKQKRFSKQSS

SEQ ID NO: 2678414 - protein, 25 aa, Entamoeba histolytica
HSSTISFEELISWITPLQYQFFEVL

SEQ ID NO: 2678415 - protein, 27 aa, Entamoeba histolytica
HSTYDAFLVCIFRPYRVDVIGYNSTFR

SEQ ID NO: 2678416 - protein, 24 aa, Entamoeba histolytica
HSVFQLPSIITHLSYFRIPLPDIL

SEQ ID NO: 2678417 - protein, 22 aa, Entamoeba histolytica
HSVKTLQLYSCDELLSTKKIEK

SEQ ID NO: 2678418 - protein, 18 aa, Entamoeba histolytica
HSVYCWDIDDGFAVCVLM

SEQ ID NO: 2678419 - protein, 20 aa, Entamoeba histolytica
HSVYCWDINDGFAVCVLMKK

SEQ ID NO: 2678420 - protein, 19 aa, Entamoeba histolytica
HSWNNKITFIRTIQSCAVF

SEQ ID NO: 2678421 - protein, 18 aa, Entamoeba histolytica
HSYCKICSVFNNISPFLI

SEQ ID NO: 2678422 - protein, 19 aa, Entamoeba histolytica
HSYHILLIICDGQVDNEKD

SEQ ID NO: 2678423 - protein, 17 aa, Entamoeba histolytica
HTAGNILRVMLLRNPHV

SEQ ID NO: 2678424 - protein, 23 aa, Entamoeba histolytica
HTALNARCSILAAANPSNGNYDV

SEQ ID NO: 2678425 - protein, 20 aa, Entamoeba histolytica
HTDFLMKTIDAMNEADVAVV

SEQ ID NO: 2678426 - protein, 17 aa, Entamoeba histolytica
HTFSRLIYPFTWQHVLI

SEQ ID NO: 2678427 - protein, 17 aa, Entamoeba histolytica
HTGKLYGVFEIHPQPSA

SEQ ID NO: 2678428 - protein, 21 aa, Entamoeba histolytica
HTGTQLICICIEKIERSESKE

SEQ ID NO: 2678429 - protein, 17 aa, Entamoeba histolytica
HTHLLTKFTCMNLSQLC

SEQ ID NO: 2678430 - protein, 17 aa, Entamoeba histolytica
HTIHFGAYENQWFNITP

SEQ ID NO: 2678431 - protein, 18 aa, Entamoeba histolytica
HTIHLWKGKVIEEKEVTY

SEQ ID NO: 2678432 - protein, 26 aa, Entamoeba histolytica
HTILPPKPSQWILRDKGHFVFSLVNP

SEQ ID NO: 2678433 - protein, 17 aa, Entamoeba histolytica
HTISCQLVWVTKTDGRD

SEQ ID NO: 2678434 - protein, 22 aa, Entamoeba histolytica
HTKCKYKGLLEYFKQMKNQYSS

SEQ ID NO: 2678435 - protein, 21 aa, Entamoeba histolytica
HTKNAISAFEFVLNNYEPIFF

SEQ ID NO: 2678436 - protein, 24 aa, Entamoeba histolytica
HTLFRATFFPTWEGLFWEKSSGFE

SEQ ID NO: 2678437 - protein, 24 aa, Entamoeba histolytica
HTLFRKECKGVFATSLEEEGEYDI

SEQ ID NO: 2678438 - protein, 24 aa, Entamoeba histolytica
HTLNKLPIKTIVPIDKQNIKQPIN

SEQ ID NO: 2678439 - protein, 19 aa, Entamoeba histolytica
HTTFRIRSVPDMGYLTSND

SEQ ID NO: 2678440 - protein, 25 aa, Entamoeba histolytica
HTTGDFGSIGWRSDWKVEEAQKTIL

SEQ ID NO: 2678441 - protein, 18 aa, Entamoeba histolytica
HTTRFLQMASEFPENLKS

SEQ ID NO: 2678442 - protein, 28 aa, Entamoeba histolytica
HTYEGSEHWLLMKSALYIIQFLSMMCSF

SEQ ID NO: 2678443 - protein, 19 aa, Entamoeba histolytica
HTYFPSFSCEIIKGQTPTL

SEQ ID NO: 2678444 - protein, 19 aa, Entamoeba histolytica
HTYGLPICNIVAGKNADIH

SEQ ID NO: 2678445 - protein, 30 aa, Entamoeba histolytica
HTYTFPLSTLMSWGTDSSKTFKNTSTDHKM

SEQ ID NO: 2678446 - protein, 24 aa, Entamoeba histolytica
HVDSESSAHVYLRMKDGDTIETLP

SEQ ID NO: 2678447 - protein, 22 aa, Entamoeba histolytica
HVDYVHRFGRDMGDQPPYNTEF

SEQ ID NO: 2678448 - protein, 25 aa, Entamoeba histolytica
HVELLFALCDSLRNLFKVKGTSSID

SEQ ID NO: 2678449 - protein, 22 aa, Entamoeba histolytica
HVFDIVCPCFEYQNCQTTINVS

SEQ ID NO: 2678450 - protein, 17 aa, Entamoeba histolytica
HVFFKKFMEVEGVEEQQ

SEQ ID NO: 2678451 - protein, 27 aa, Entamoeba histolytica
HVFPHSKLFFCRIHIERSLTKYFKNDH

SEQ ID NO: 2678452 - protein, 18 aa, Entamoeba histolytica
HVGDFRFDSTLQNDKNWK

SEQ ID NO: 2678453 - protein, 25 aa, Entamoeba histolytica
HVGTIGGVFRTEFPPTPKSKFTMIK

SEQ ID NO: 2678454 - protein, 19 aa, Entamoeba histolytica
HVICRDCIMSLIQSQKSHN

SEQ ID NO: 2678455 - protein, 17 aa, Entamoeba histolytica
HVKCVLRCGDQTLSCPM

SEQ ID NO: 2678456 - protein, 24 aa, Entamoeba histolytica
HVKYPQFRVDTWTSRISGKQLLVL

SEQ ID NO: 2678457 - protein, 26 aa, Entamoeba histolytica
HVLKCVCPICKRIYCHGDERVKNIKS

SEQ ID NO: 2678458 - protein, 20 aa, Entamoeba histolytica
HVNKKAKDQYKGFIEQQEGL

SEQ ID NO: 2678459 - protein, 18 aa, Entamoeba histolytica
HVNRMCVCANVPLIDGGT

SEQ ID NO: 2678460 - protein, 19 aa, Entamoeba histolytica
HVPCECLTTGFQTRLGVMV

SEQ ID NO: 2678461 - protein, 18 aa, Entamoeba histolytica
HVPLEILNTLSYETMKYC

SEQ ID NO: 2678462 - protein, 26 aa, Entamoeba histolytica
HVSAPHCWSFMLGSLTWLKDAGDVVC

SEQ ID NO: 2678463 - protein, 17 aa, Entamoeba histolytica
HVSVLYNKVEFIESLIV

SEQ ID NO: 2678464 - protein, 17 aa, Entamoeba histolytica
HVTACTKPSINPFPPFI

SEQ ID NO: 2678465 - protein, 19 aa, Entamoeba histolytica
HVVCSLLKHYLRSLPTPLL

SEQ ID NO: 2678466 - protein, 17 aa, Entamoeba histolytica
HVVELSLHTYGCRVIQK

SEQ ID NO: 2678467 - protein, 27 aa, Entamoeba histolytica
HVVREGWQKLCWYCMQLPEHYKTSQII

SEQ ID NO: 2678468 - protein, 18 aa, Entamoeba histolytica
HVYKDFIISPGYRMLSTE

SEQ ID NO: 2678469 - protein, 17 aa, Entamoeba histolytica
HVYLNCHYHFVFNLLNS

SEQ ID NO: 2678470 - protein, 23 aa, Entamoeba histolytica
HWESLFPWPSLDVSRFIYTGIKF

SEQ ID NO: 2678471 - protein, 23 aa, Entamoeba histolytica
HWGCPVDIWSHGCMIFEMLTGDY

SEQ ID NO: 2678472 - protein, 25 aa, Entamoeba histolytica
HWHLLGRLKLCLGFYKLKNKYDNNA

SEQ ID NO: 2678473 - protein, 21 aa, Entamoeba histolytica
HWKKRKSSHCESFPHYLEING

SEQ ID NO: 2678474 - protein, 21 aa, Entamoeba histolytica
HWKQTCFYFDLPFDNAAPGDI

SEQ ID NO: 2678475 - protein, 20 aa, Entamoeba histolytica
HWKRKCPLTTAALQAVYVGS

SEQ ID NO: 2678476 - protein, 17 aa, Entamoeba histolytica
HWLCYNGEKERVCKAIS

SEQ ID NO: 2678477 - protein, 27 aa, Entamoeba histolytica
HWLTFHSGYDFGYLLRLLTCEKLPSSI

SEQ ID NO: 2678478 - protein, 29 aa, Entamoeba histolytica
HWLTFHSGYDFGYMLKLLTCEKLPSTVDG

SEQ ID NO: 2678479 - protein, 17 aa, Entamoeba histolytica
HWNYLSLAANEDDPYKR

SEQ ID NO: 2678480 - protein, 21 aa, Entamoeba histolytica
HWQLDVCWDAPAYVSWDFKFL

SEQ ID NO: 2678481 - protein, 28 aa, Entamoeba histolytica
HWQLQKDCEFCFSLRSLFSKEPLMLLCK

SEQ ID NO: 2678482 - protein, 19 aa, Entamoeba histolytica
HYCLKWIDVLHQIYPDTRI

SEQ ID NO: 2678483 - protein, 23 aa, Entamoeba histolytica
HYDEVISMFKRLIVELPNKEETF

SEQ ID NO: 2678484 - protein, 23 aa, Entamoeba histolytica
HYDGCIRPSSIIEIAKEQNIELP

SEQ ID NO: 2678485 - protein, 21 aa, Entamoeba histolytica
HYEKTKRPLVVKIGTISSDGT

SEQ ID NO: 2678486 - protein, 21 aa, Entamoeba histolytica
HYEPKCKMMVVGTKTDCRNDE

SEQ ID NO: 2678487 - protein, 18 aa, Entamoeba histolytica
HYETFKAVLDQFVVTHIE

SEQ ID NO: 2678488 - protein, 17 aa, Entamoeba histolytica
HYFAMKILIKKQMEERN

SEQ ID NO: 2678489 - protein, 19 aa, Entamoeba histolytica
HYFKEEIPDLLELSIASNQ

SEQ ID NO: 2678490 - protein, 23 aa, Entamoeba histolytica
HYFMDREKFNVLYNSQQSVIQQL

SEQ ID NO: 2678491 - protein, 26 aa, Entamoeba histolytica
HYIFCGELLNLYSAWCLNTCNRYFDL

SEQ ID NO: 2678492 - protein, 26 aa, Entamoeba histolytica
HYIIPNRISDEWITLGIRDYLAEQFI

SEQ ID NO: 2678493 - protein, 18 aa, Entamoeba histolytica
HYIISSIFIQFFRDSLEQ

SEQ ID NO: 2678494 - protein, 27 aa, Entamoeba histolytica
HYKDIKHLYKFINIRKLIVIELDSLNK

SEQ ID NO: 2678495 - protein, 17 aa, Entamoeba histolytica
HYKTNFGEELFLNLDDS

SEQ ID NO: 2678496 - protein, 19 aa, Entamoeba histolytica
HYKVHFDFEPNEYFTNETI

SEQ ID NO: 2678497 - protein, 18 aa, Entamoeba histolytica
HYLICKKLIVIGLNSELP

SEQ ID NO: 2678498 - protein, 18 aa, Entamoeba histolytica
HYLPHVGDQFISYMKSSS

SEQ ID NO: 2678499 - protein, 25 aa, Entamoeba histolytica
HYLPKDFDKGLGMKDGTAYLLSNKR

SEQ ID NO: 2678500 - protein, 23 aa, Entamoeba histolytica
HYLSPNVIISGRILDGIEDLMKA

SEQ ID NO: 2678501 - protein, 19 aa, Entamoeba histolytica
HYNPAFVMPLFRKTIIRLL

SEQ ID NO: 2678502 - protein, 17 aa, Entamoeba histolytica
HYPQFKSSSSIVVNKLS

SEQ ID NO: 2678503 - protein, 18 aa, Entamoeba histolytica
HYPSFKQTITFFKSSILE

SEQ ID NO: 2678504 - protein, 19 aa, Entamoeba histolytica
HYRAPEIILGLPYNNAIDM

SEQ ID NO: 2678505 - protein, 19 aa, Entamoeba histolytica
HYRAPEIILGLPYSCSIDM

SEQ ID NO: 2678506 - protein, 23 aa, Entamoeba histolytica
HYRAPEVILGLPYSCGIDVWSAG

SEQ ID NO: 2678507 - protein, 19 aa, Entamoeba histolytica
HYRSPEIIIGLPYSPAIDM

SEQ ID NO: 2678508 - protein, 19 aa, Entamoeba histolytica
HYRSPEVILGLPYSSAIDM

SEQ ID NO: 2678509 - protein, 17 aa, Entamoeba histolytica
HYSDGIIPIELPKNDTT

SEQ ID NO: 2678510 - protein, 27 aa, Entamoeba histolytica
HYTYPWKNLFRHALFFWLGKNASILHR

SEQ ID NO: 2678511 - protein, 18 aa, Entamoeba histolytica
HYVMKGVSHFVSFAPMLD

SEQ ID NO: 2678512 - protein, 21 aa, Entamoeba histolytica
HYVVGCRSCIDKKKITQGTRV

SEQ ID NO: 2678513 - protein, 23 aa, Entamoeba histolytica
IAAELVLGIPLFPGSSEFNQLFK

SEQ ID NO: 2678514 - protein, 17 aa, Entamoeba histolytica
IAAQICRQAGLVKHKGL

SEQ ID NO: 2678515 - protein, 33 aa, Entamoeba histolytica
IAASFLKLYLREMLEPLIPFNLYEQFIQLPKGG

SEQ ID NO: 2678516 - protein, 18 aa, Entamoeba histolytica
IACFKKNNFLGSIEMKTL

SEQ ID NO: 2678517 - protein, 20 aa, Entamoeba histolytica
IACLKRLIGNVNWLNNIKSG

SEQ ID NO: 2678518 - protein, 28 aa, Entamoeba histolytica
IADDAVLVFDCGSSFIKVGVAGEEQPRK

SEQ ID NO: 2678519 - protein, 17 aa, Entamoeba histolytica
IADFLTSLCIGGVSCAH

SEQ ID NO: 2678520 - protein, 17 aa, Entamoeba histolytica
IADGCGMGSRPAKSARI

SEQ ID NO: 2678521 - protein, 23 aa, Entamoeba histolytica
IADHVCDYCPYEGMTYRVFNALH

SEQ ID NO: 2678522 - protein, 23 aa, Entamoeba histolytica
IADIWSLGVVFYVMIFGLMPFPG

SEQ ID NO: 2678523 - protein, 25 aa, Entamoeba histolytica
IADKAETFFSLRLRGEDGVFGVDPT

SEQ ID NO: 2678524 - protein, 25 aa, Entamoeba histolytica
IADLATVCGMYGIPLKHAIKKSQWR

SEQ ID NO: 2678525 - protein, 22 aa, Entamoeba histolytica
IADTRGEPLLSLMKEHPEIIKP

SEQ ID NO: 2678526 - protein, 22 aa, Entamoeba histolytica
IADVSLNKVLNCKTIEETLKEH

SEQ ID NO: 2678527 - protein, 20 aa, Entamoeba histolytica
IAEASLFCFRSLARVLSEYK

SEQ ID NO: 2678528 - protein, 36 aa, Entamoeba histolytica
IAEKKIPCLNSIVNIDCEFNETIILNCQIVQQLSFN

SEQ ID NO: 2678529 - protein, 21 aa, Entamoeba histolytica
IAESLRKKLVVFIVGNTTVEC

SEQ ID NO: 2678530 - protein, 17 aa, Entamoeba histolytica
IAETCIRELSPHSPRST

SEQ ID NO: 2678531 - protein, 20 aa, Entamoeba histolytica
IAFGMKEWAEELGASCFAHW

SEQ ID NO: 2678532 - protein, 17 aa, Entamoeba histolytica
IAFKSSYCIPLILVRCF

SEQ ID NO: 2678533 - protein, 24 aa, Entamoeba histolytica
IAGEDKLILVYGISLSAFLCIFET

SEQ ID NO: 2678534 - protein, 25 aa, Entamoeba histolytica
IAGNIKEGIDLVGIFDGHNGSDAAK

SEQ ID NO: 2678535 - protein, 20 aa, Entamoeba histolytica
IAGVPILVTINGYRYPRNEN

SEQ ID NO: 2678536 - protein, 25 aa, Entamoeba histolytica
IAHHCKKCGYPYIQLDGSVAATKRT

SEQ ID NO: 2678537 - protein, 27 aa, Entamoeba histolytica
IAIEGCSYCSIELKFSPIESVILQDVE

SEQ ID NO: 2678538 - protein, 17 aa, Entamoeba histolytica
IAIEIPVSAYICSDITL

SEQ ID NO: 2678539 - protein, 21 aa, Entamoeba histolytica
IAIENELTRAFGIAIRKLLSK

SEQ ID NO: 2678540 - protein, 17 aa, Entamoeba histolytica
IAIKGNLKVDHNDIPII

SEQ ID NO: 2678541 - protein, 19 aa, Entamoeba histolytica
IAKFASTLQQVWTVKNKPK

SEQ ID NO: 2678542 - protein, 24 aa, Entamoeba histolytica
IAKFFRIVIVDALFIGYGLTETTG

SEQ ID NO: 2678543 - protein, 19 aa, Entamoeba histolytica
IAKQIAFGMNEIHSYKMPL

SEQ ID NO: 2678544 - protein, 17 aa, Entamoeba histolytica
IAKQLAQHQNGMVLPIQ

SEQ ID NO: 2678545 - protein, 21 aa, Entamoeba histolytica
IALDAELSSLVGEVYERSYST

SEQ ID NO: 2678546 - protein, 25 aa, Entamoeba histolytica
IALDFCAILTWIFKRYRDTFIGLIE

SEQ ID NO: 2678547 - protein, 34 aa, Entamoeba histolytica; identical to SEQ ID NO: 2485152

SEQ ID NO: 2678548 - protein, 17 aa, Entamoeba histolytica
IALINAIASKKTSLFYD

SEQ ID NO: 2678549 - protein, 18 aa, Entamoeba histolytica
IALKAAQEKLETMQFDVS

SEQ ID NO: 2678550 - protein, 27 aa, Entamoeba histolytica
IALKLRHCTRLVLKDFYSPLLLENTDE

SEQ ID NO: 2678551 - protein, 17 aa, Entamoeba histolytica
IALNILDYYKIVKHPMD

SEQ ID NO: 2678552 - protein, 26 aa, Entamoeba histolytica
IALQRQMMFLTRFFKTLVDLPSNISD

SEQ ID NO: 2678553 - protein, 19 aa, Entamoeba histolytica
IALSDAFRNFGNIISSVKI

SEQ ID NO: 2678554 - protein, 18 aa, Entamoeba histolytica
IALVKEVLSKHPQYQLLH

SEQ ID NO: 2678555 - protein, 17 aa, Entamoeba histolytica
IALVKFADRMLRKGGMN

SEQ ID NO: 2678556 - protein, 18 aa, Entamoeba histolytica
IALYNWVKLCVATFKHFD

SEQ ID NO: 2678557 - protein, 31 aa, Entamoeba histolytica
IAMAELKAGKIPFIIRRRLPNGSYEDWKVSE

SEQ ID NO: 2678558 - protein, 20 aa, Entamoeba histolytica
IAMMPYYLVIDGDEGQDIPK

SEQ ID NO: 2678559 - protein, 30 aa, Entamoeba histolytica
IANIGESCRRWCFLRINMVSTVPESFYQKY

SEQ ID NO: 2678560 - protein, 26 aa, Entamoeba histolytica
IANLTALKGQTGWIIIDCMSTIDSSN

SEQ ID NO: 2678561 - protein, 17 aa, Entamoeba histolytica
IANSIFKASNFLVNENL

SEQ ID NO: 2678562 - protein, 18 aa, Entamoeba histolytica
IANSLFFVSINQPDKNSQ

SEQ ID NO: 2678563 - protein, 26 aa, Entamoeba histolytica
IAPTRFSRKRLSTTLRICPSDGDIVV

SEQ ID NO: 2678564 - protein, 17 aa, Entamoeba histolytica
IAPYLPWSDNNPQQLDK

SEQ ID NO: 2678565 - protein, 25 aa, Entamoeba histolytica
IAQECCKTILPLLFCSTYSQIELLD

SEQ ID NO: 2678566 - protein, 21 aa, Entamoeba histolytica
IAQKRVPLMTIKQVEDKEKEL

SEQ ID NO: 2678567 - protein, 35 aa, Entamoeba histolytica
IAQYYKTDWPLLVICPSSLRTNWKNEIVTNCKCYD

SEQ ID NO: 2678568 - protein, 23 aa, Entamoeba histolytica
IARKRVSESWFRGKKETGDLIPW

SEQ ID NO: 2678569 - protein, 21 aa, Entamoeba histolytica
IARLIPRNLVFVSALEPNGIE

SEQ ID NO: 2678570 - protein, 21 aa, Entamoeba histolytica
IARMALWKHEFLIQIDKCYLF

SEQ ID NO: 2678571 - protein, 21 aa, Entamoeba histolytica
IARNIFTEWIKRENIENETFH

SEQ ID NO: 2678572 - protein, 21 aa, Entamoeba histolytica
IARNIFTEWVKRENIENETFH

SEQ ID NO: 2678573 - protein, 18 aa, Entamoeba histolytica
IARREVICLPFYSFIVRY

SEQ ID NO: 2678574 - protein, 24 aa, Entamoeba histolytica
IARVCYKAPWPVTAREFVGVQNWF

SEQ ID NO: 2678575 - protein, 19 aa, Entamoeba histolytica
IASAFWILADRTVHIHPSL

SEQ ID NO: 2678576 - protein, 23 aa, Entamoeba histolytica
IASEWNELLINMFTLGNDLDIEI

SEQ ID NO: 2678577 - protein, 26 aa, Entamoeba histolytica
IASFIPGICEQVRLDLVVGEEIIFSN

SEQ ID NO: 2678578 - protein, 18 aa, Entamoeba histolytica
IASKLGIWTSRGKEKFDV

SEQ ID NO: 2678579 - protein, 21 aa, Entamoeba histolytica
IASPENFGLLGVESKVSPKAR

SEQ ID NO: 2678580 - protein, 20 aa, Entamoeba histolytica
IASPLFIKVELLRYERKVPL

SEQ ID NO: 2678581 - protein, 24 aa, Entamoeba histolytica
IASPQSAPVLGEFLSQLYILYTDY

SEQ ID NO: 2678582 - protein, 18 aa, Entamoeba histolytica
IATAYVRFISSVYESVCK

SEQ ID NO: 2678583 - protein, 17 aa, Entamoeba histolytica
IATITLFKIMNKLSSSL

SEQ ID NO: 2678584 - protein, 20 aa, Entamoeba histolytica
IATLHSFPIRVISKADGKKK

SEQ ID NO: 2678585 - protein, 18 aa, Entamoeba histolytica
IATLLSMKLFNTMIENKC

SEQ ID NO: 2678586 - protein, 18 aa, Entamoeba histolytica
IATLQFKSLNYLQDGIEW

SEQ ID NO: 2678587 - protein, 25 aa, Entamoeba histolytica
IATPTLEFYQWFASMVEQFSDFGIP

SEQ ID NO: 2678588 - protein, 33 aa, Entamoeba histolytica
IATTMCPKCRELLCEECLMKGIKENGCCYKCKQ

SEQ ID NO: 2678589 - protein, 24 aa, Entamoeba histolytica
IAVEKWLARCLPFENEKEIYEFVK

SEQ ID NO: 2678590 - protein, 19 aa, Entamoeba histolytica
IAVRSCQWVDEVVDGIPYW

SEQ ID NO: 2678591 - protein, 19 aa, Entamoeba histolytica
IAVYCLKDTYLPIKLLEKL

SEQ ID NO: 2678592 - protein, 17 aa, Entamoeba histolytica
IAWIQRMIEEYVSYKMY

SEQ ID NO: 2678593 - protein, 17 aa, Entamoeba histolytica
IAYEDNSIFLLPNSILS

SEQ ID NO: 2678594 - protein, 21 aa, Entamoeba histolytica
IAYLKEYYPQNLVQFHKIGVK

SEQ ID NO: 2678595 - protein, 27 aa, Entamoeba histolytica
IAYLMYKKMWRYKEAVTFVKKKRPIIS

SEQ ID NO: 2678596 - protein, 18 aa, Entamoeba histolytica
IAYRKYWFEGNIEQNDDS

SEQ ID NO: 2678597 - protein, 20 aa, Entamoeba histolytica
IAYVCKRVLQGLVYLHKMGI

SEQ ID NO: 2678598 - protein, 26 aa, Entamoeba histolytica
ICADDSFKMNISTVMPIFQTGITADI

SEQ ID NO: 2678599 - protein, 18 aa, Entamoeba histolytica
ICAEVNWDKKLIVTGSED

SEQ ID NO: 2678600 - protein, 18 aa, Entamoeba histolytica
ICAFFDYYVDVQCYLVME

SEQ ID NO: 2678601 - protein, 17 aa, Entamoeba histolytica
ICALEYLHMEGVVYRDL

SEQ ID NO: 2678602 - protein, 25 aa, Entamoeba histolytica
ICCSKGFQFKFFMTYMDMLSLDDEY

SEQ ID NO: 2678603 - protein, 30 aa, Entamoeba histolytica; identical to SEQ ID NO: 2485213

SEQ ID NO: 2678604 - protein, 25 aa, Entamoeba histolytica
ICDEISRLGSVPVFVSNWHDAYAEL

SEQ ID NO: 2678605 - protein, 19 aa, Entamoeba histolytica
ICDLWDCAHVLATQNIPQN

SEQ ID NO: 2678606 - protein, 23 aa, Entamoeba histolytica
ICDSYYFQDCVDFILELLTKDKL

SEQ ID NO: 2678607 - protein, 17 aa, Entamoeba histolytica
ICECPKCRCEMITFEKE

SEQ ID NO: 2678608 - protein, 22 aa, Entamoeba histolytica
ICECPKCRCEMITFEKEYKTTC

SEQ ID NO: 2678609 - protein, 23 aa, Entamoeba histolytica
ICEIKKCRILFSRKYNYLQAHKL

SEQ ID NO: 2678610 - protein, 26 aa, Entamoeba histolytica
ICEKMIEMFLDFNIVDWNCTGNYITT

SEQ ID NO: 2678611 - protein, 18 aa, Entamoeba histolytica
ICEKYGFRVELKYYRDKE

SEQ ID NO: 2678612 - protein, 18 aa, Entamoeba histolytica
ICETNIYPAPTLSGVICN

SEQ ID NO: 2678613 - protein, 17 aa, Entamoeba histolytica
ICFQCLGKYCYFKDDIL

SEQ ID NO: 2678614 - protein, 18 aa, Entamoeba histolytica
ICFQEVFKELNWRREKLL

SEQ ID NO: 2678615 - protein, 19 aa, Entamoeba histolytica
ICFQEVFKELNWRREKLLK

SEQ ID NO: 2678616 - protein, 17 aa, Entamoeba histolytica
ICGIIKDKFGPFVNNTF

SEQ ID NO: 2678617 - protein, 24 aa, Entamoeba histolytica
ICGIKDGSTCLCIFICDKKLYIAN

SEQ ID NO: 2678618 - protein, 27 aa, Entamoeba histolytica
ICGTNCIKLLQIVYGATFKKLAAEQEK

SEQ ID NO: 2678619 - protein, 17 aa, Entamoeba histolytica
ICHEHYWSTATTRVKTC

SEQ ID NO: 2678620 - protein, 22 aa, Entamoeba histolytica
ICHFQPIALPLQMVMNYYSQIQ

SEQ ID NO: 2678621 - protein, 20 aa, Entamoeba histolytica
ICHTNFKIFMELINEVYPMA

SEQ ID NO: 2678622 - protein, 18 aa, Entamoeba histolytica
ICIAPGFIRKSAINDLTQ

SEQ ID NO: 2678623 - protein, 17 aa, Entamoeba histolytica
ICICGQPKILATTLSAW

SEQ ID NO: 2678624 - protein, 20 aa, Entamoeba histolytica
ICIGYLCIWCSGETSSFHSY

SEQ ID NO: 2678625 - protein, 30 aa, Entamoeba histolytica
ICIPLRADVSLWFIAHSCLSKIPPANNPFI

SEQ ID NO: 2678626 - protein, 18 aa, Entamoeba histolytica
ICITNAFNNAFLTSYDPY

SEQ ID NO: 2678627 - protein, 25 aa, Entamoeba histolytica
ICIVEEIKAAIVLYKETPPIIEIFN

SEQ ID NO: 2678628 - protein, 22 aa, Entamoeba histolytica
ICKCGQKFCFKCGREMHKPVSC

SEQ ID NO: 2678629 - protein, 17 aa, Entamoeba histolytica
ICKGEGLEKEYLIKCSF

SEQ ID NO: 2678630 - protein, 17 aa, Entamoeba histolytica
ICKGKPKEETICLVNKE

SEQ ID NO: 2678631 - protein, 28 aa, Entamoeba histolytica
ICKIFPRSNFWEHVCIVWTKCSCDTPEK

SEQ ID NO: 2678632 - protein, 22 aa, Entamoeba histolytica
ICKSYFCTNCLCEYHDGYTCEQ

SEQ ID NO: 2678633 - protein, 18 aa, Entamoeba histolytica
ICKTLKYVVLYDNTGLTL

SEQ ID NO: 2678634 - protein, 21 aa, Entamoeba histolytica
ICLDVSCNLISLFPKNLPTTL

SEQ ID NO: 2678635 - protein, 17 aa, Entamoeba histolytica
ICLEECIILIKSKKIAE

SEQ ID NO: 2678636 - protein, 19 aa, Entamoeba histolytica
ICLKIKKEKKVLVQFKIDI

SEQ ID NO: 2678637 - protein, 18 aa, Entamoeba histolytica
ICLLNDCQLMELAIDNGM

SEQ ID NO: 2678638 - protein, 20 aa, Entamoeba histolytica
ICLNEGLAPVNALKEGFNRM

SEQ ID NO: 2678639 - protein, 20 aa, Entamoeba histolytica
ICLVRSLTISDGWKRITQSA

SEQ ID NO: 2678640 - protein, 17 aa, Entamoeba histolytica
ICNDILLCSLKIGTIQY

SEQ ID NO: 2678641 - protein, 48 aa, Entamoeba histolytica
ICNILKTNSLTSIPFKLDINSSPQIFGFEHCFKQLIQFIENIQKSQFT

SEQ ID NO: 2678642 - protein, 24 aa, Entamoeba histolytica
ICNITGRGFNRCLAILSLIQCQGN

SEQ ID NO: 2678643 - protein, 26 aa, Entamoeba histolytica
ICPELCGLRMCKLAVMLVATGGISRI

SEQ ID NO: 2678644 - protein, 20 aa, Entamoeba histolytica
ICPKMPESLSILVKPKTKET

SEQ ID NO: 2678645 - protein, 25 aa, Entamoeba histolytica
ICPLNEIKKGALLVNINNIKNDIKL

SEQ ID NO: 2678646 - protein, 18 aa, Entamoeba histolytica
ICRNYYGKQCYLLNMLLE

SEQ ID NO: 2678647 - protein, 17 aa, Entamoeba histolytica
ICRTQFIATIGISKNFI

SEQ ID NO: 2678648 - protein, 23 aa, Entamoeba histolytica
ICSEFGWSDVGTWGSLHTLQQKD

SEQ ID NO: 2678649 - protein, 20 aa, Entamoeba histolytica
ICSFLSLNITRQFINISNNL

SEQ ID NO: 2678650 - protein, 19 aa, Entamoeba histolytica
ICSINSYIIPLKRIIIGAF

SEQ ID NO: 2678651 - protein, 17 aa, Entamoeba histolytica
ICSISVCQCQQLKEFKV

SEQ ID NO: 2678652 - protein, 20 aa, Entamoeba histolytica
ICSQPKLLYQLKFKNKDNEI

SEQ ID NO: 2678653 - protein, 19 aa, Entamoeba histolytica
ICSTPQLLTSLSIHDQFQL

SEQ ID NO: 2678654 - protein, 17 aa, Entamoeba histolytica
ICSVCQRDIHRKHNITQ

SEQ ID NO: 2678655 - protein, 24 aa, Entamoeba histolytica
ICTETLKALTYLHSFHCVHRDIKS

SEQ ID NO: 2678656 - protein, 18 aa, Entamoeba histolytica
ICTGETYKNIANCIRKII

SEQ ID NO: 2678657 - protein, 17 aa, Entamoeba histolytica
ICTLKGHGDWVLNLDWH

SEQ ID NO: 2678658 - protein, 20 aa, Entamoeba histolytica
ICTNTAYILFYKKRNVNPED

SEQ ID NO: 2678659 - protein, 20 aa, Entamoeba histolytica
ICVDQKWIAEEICIICTGET

SEQ ID NO: 2678660 - protein, 17 aa, Entamoeba histolytica
ICVFTLLATNSILMEQI

SEQ ID NO: 2678661 - protein, 19 aa, Entamoeba histolytica
ICVHVALCTKMEEFKRTKM

SEQ ID NO: 2678662 - protein, 20 aa, Entamoeba histolytica
ICVNENYPSIVLDLSNVNKL

SEQ ID NO: 2678663 - protein, 17 aa, Entamoeba histolytica
ICVYESKNVIVLATPTT

SEQ ID NO: 2678664 - protein, 21 aa, Entamoeba histolytica
ICWLKLKIYNTFVLPIDAGDN

SEQ ID NO: 2678665 - protein, 22 aa, Entamoeba histolytica
ICYGKSNGCVIRLSEGILKYRS

SEQ ID NO: 2678666 - protein, 17 aa, Entamoeba histolytica
IDACNKIEEKRVLVLAG

SEQ ID NO: 2678667 - protein, 30 aa, Entamoeba histolytica; identical to SEQ ID NO: 2485275

SEQ ID NO: 2678668 - protein, 22 aa, Entamoeba histolytica
IDAEGVPSMLFSTIKKCPLTSR

SEQ ID NO: 2678669 - protein, 22 aa, Entamoeba histolytica
IDAELKYQCVLNKLKDLSHAAR

SEQ ID NO: 2678670 - protein, 24 aa, Entamoeba histolytica
IDAFFKMFNKLMMNPHFKVTEIPE

SEQ ID NO: 2678671 - protein, 19 aa, Entamoeba histolytica
IDAGLKVIACIGETEAQRI

SEQ ID NO: 2678672 - protein, 22 aa, Entamoeba histolytica
IDALPKCTACGQPISVYAYEFC

SEQ ID NO: 2678673 - protein, 21 aa, Entamoeba histolytica
IDASLLIYSYRVDDIYQAFAN

SEQ ID NO: 2678674 - protein, 20 aa, Entamoeba histolytica
IDATFNLGMNLLKFTRLWNG

SEQ ID NO: 2678675 - protein, 21 aa, Entamoeba histolytica
IDCHKSFKTEPEFDAHKQCIT

SEQ ID NO: 2678676 - protein, 21 aa, Entamoeba histolytica
IDCSDRWKEWLIVEDNYHDGW

SEQ ID NO: 2678677 - protein, 17 aa, Entamoeba histolytica
IDCVIEHLWDILSPKGI

SEQ ID NO: 2678678 - protein, 24 aa, Entamoeba histolytica
IDDCFKRRVNDVITPPIYHDIFFN

SEQ ID NO: 2678679 - protein, 24 aa, Entamoeba histolytica
IDDEICKQCFACIQNQVTKHFNKY

SEQ ID NO: 2678680 - protein, 25 aa, Entamoeba histolytica
IDDGEKLFLHGLHLYFKKLGDNDKR

SEQ ID NO: 2678681 - protein, 23 aa, Entamoeba histolytica
IDDGEKLFLHGLHLYSKKLQDME

SEQ ID NO: 2678682 - protein, 18 aa, Entamoeba histolytica
IDDIIPLFYIFYQNITGI

SEQ ID NO: 2678683 - protein, 24 aa, Entamoeba histolytica
IDDLLKREWGFIIFDEVHGSTTDN

SEQ ID NO: 2678684 - protein, 21 aa, Entamoeba histolytica
IDEALLCYCESLLCYGQLILR

SEQ ID NO: 2678685 - protein, 25 aa, Entamoeba histolytica
IDEGYKNIVLCGGIGTRFDHSLSNV

SEQ ID NO: 2678686 - protein, 17 aa, Entamoeba histolytica
IDEGYSVSEEYEKEKQM

SEQ ID NO: 2678687 - protein, 24 aa, Entamoeba histolytica
IDEHTFKSLCIFKKEEHPDIHSTG

SEQ ID NO: 2678688 - protein, 35 aa, Entamoeba histolytica
IDEKFKVAPHLVPRGSVCDFTFIPYSSIQQILNTN

SEQ ID NO: 2678689 - protein, 22 aa, Entamoeba histolytica
IDEKLRALIMHKIKELDDDDVK

SEQ ID NO: 2678690 - protein, 25 aa, Entamoeba histolytica
IDEKQRGKLQFGFKQKPKQEEQEKK

SEQ ID NO: 2678691 - protein, 18 aa, Entamoeba histolytica
IDELGWVDVMNQFQNKEI

SEQ ID NO: 2678692 - protein, 19 aa, Entamoeba histolytica
IDEMIKMKINKEGNDKEII

SEQ ID NO: 2678693 - protein, 22 aa, Entamoeba histolytica
IDEMKTNQGIMVFNKEQPIQRM

SEQ ID NO: 2678694 - protein, 21 aa, Entamoeba histolytica
IDEPWYLKFNNSAIYDDNTED

SEQ ID NO: 2678695 - protein, 18 aa, Entamoeba histolytica
IDESCSFWEKQMKFSKAV

SEQ ID NO: 2678696 - protein, 20 aa, Entamoeba histolytica
IDESIKIFKKNNVLLINKIK

SEQ ID NO: 2678697 - protein, 17 aa, Entamoeba histolytica
IDFAIVLKDLFNFDEQG

SEQ ID NO: 2678698 - protein, 28 aa, Entamoeba histolytica
IDFDYFPLLYKLCLDFDGVSFDFSEMFI

SEQ ID NO: 2678699 - protein, 17 aa, Entamoeba histolytica
IDFDYPPLLAPFLPPPL

SEQ ID NO: 2678700 - protein, 20 aa, Entamoeba histolytica
IDFESDFPFYKEFFYGNDQV

SEQ ID NO: 2678701 - protein, 24 aa, Entamoeba histolytica
IDFFISVFHGLFFYNEFNGAYLIY

SEQ ID NO: 2678702 - protein, 24 aa, Entamoeba histolytica
IDFGDDMARLVIVVGIPYPSLGDI

SEQ ID NO: 2678703 - protein, 18 aa, Entamoeba histolytica
IDFGFVINLRPKFDANRF

SEQ ID NO: 2678704 - protein, 26 aa, Entamoeba histolytica
IDFITACTNIRCAIFNLQRISRFEVQ

SEQ ID NO: 2678705 - protein, 17 aa, Entamoeba histolytica
IDFNYFNYISIRFTMAG

SEQ ID NO: 2678706 - protein, 21 aa, Entamoeba histolytica
IDFPKQWPDMINLIQQTYQSG

SEQ ID NO: 2678707 - protein, 25 aa, Entamoeba histolytica
IDFRMKRIECNGSPYKLQIWDTAGQ

SEQ ID NO: 2678708 - protein, 24 aa, Entamoeba histolytica
IDFSFKCIRHGNYLFIKIDRHRKK

SEQ ID NO: 2678709 - protein, 17 aa, Entamoeba histolytica
IDFSVNRIKGLLEVVDS

SEQ ID NO: 2678710 - protein, 20 aa, Entamoeba histolytica
IDFYCLMPSTYISSLSSNIN

SEQ ID NO: 2678711 - protein, 27 aa, Entamoeba histolytica
IDGEGIFDVSMLFSLKICNEDIDIVTA

SEQ ID NO: 2678712 - protein, 19 aa, Entamoeba histolytica
IDGGAGWRMSDQGNRIIVA

SEQ ID NO: 2678713 - protein, 22 aa, Entamoeba histolytica
IDGKSGVLTNVFSLEIDCFNAD

SEQ ID NO: 2678714 - protein, 22 aa, Entamoeba histolytica
IDGKVSGFGKCFGMRYEKGGLY

SEQ ID NO: 2678715 - protein, 22 aa, Entamoeba histolytica
IDGNMKAIFYFFVVNGKVLELM

SEQ ID NO: 2678716 - protein, 24 aa, Entamoeba histolytica
IDGRGIYQRYFIKEVDMSKIKIEG

SEQ ID NO: 2678717 - protein, 22 aa, Entamoeba histolytica
IDGVCPIAKMIQQRKRRFTTDC

SEQ ID NO: 2678718 - protein, 17 aa, Entamoeba histolytica
IDHPNFRVSEFFAIQLE

SEQ ID NO: 2678719 - protein, 17 aa, Entamoeba histolytica
IDIAHTFGLENPTIVNT

SEQ ID NO: 2678720 - protein, 18 aa, Entamoeba histolytica
IDICCLRASDYCDNDEEK

SEQ ID NO: 2678721 - protein, 17 aa, Entamoeba histolytica
IDICISSFSTLRILDLS

SEQ ID NO: 2678722 - protein, 18 aa, Entamoeba histolytica
IDICSTLTLIPEQMKNNF

SEQ ID NO: 2678723 - protein, 18 aa, Entamoeba histolytica
IDIELFKKIQSSPERFIV

SEQ ID NO: 2678724 - protein, 17 aa, Entamoeba histolytica
IDIGKGWESLIESYIKN

SEQ ID NO: 2678725 - protein, 18 aa, Entamoeba histolytica
IDIGNYVFFNCFNLTRIE

SEQ ID NO: 2678726 - protein, 26 aa, Entamoeba histolytica
IDIIYNLVKRPSLGRYFTPEVSHEII

SEQ ID NO: 2678727 - protein, 20 aa, Entamoeba histolytica
IDIKGLKTVINFDCPVSTQL

SEQ ID NO: 2678728 - protein, 17 aa, Entamoeba histolytica
IDIKGTLHLPRKSAFLL

SEQ ID NO: 2678729 - protein, 22 aa, Entamoeba histolytica
IDILHPLVVCGFDYIINQLKQL

SEQ ID NO: 2678730 - protein, 25 aa, Entamoeba histolytica
IDIPISISKIGYWCFCECSSLTSIN

SEQ ID NO: 2678731 - protein, 26 aa, Entamoeba histolytica
IDIPRSEWGVGMGHKHIHGGLTPGGR

SEQ ID NO: 2678732 - protein, 21 aa, Entamoeba histolytica
IDIQGMLCFYKKNTFNGKENE

SEQ ID NO: 2678733 - protein, 22 aa, Entamoeba histolytica
IDIQLIGCDGMIAFENNPLPSE

SEQ ID NO: 2678734 - protein, 18 aa, Entamoeba histolytica
IDISLTFKLNSYGLVDIS

SEQ ID NO: 2678735 - protein, 26 aa, Entamoeba histolytica
IDISRLKDDFIYRKSIMQEYISDTDY

SEQ ID NO: 2678736 - protein, 30 aa, Entamoeba histolytica
IDITSKVLLRFLKERGCRSVNSNELLRELT

SEQ ID NO: 2678737 - protein, 17 aa, Entamoeba histolytica
IDIWSLGIMCREMMEGV

SEQ ID NO: 2678738 - protein, 25 aa, Entamoeba histolytica
IDIWSVGCVLFECIIGDVLFPADND

SEQ ID NO: 2678739 - protein, 17 aa, Entamoeba histolytica
IDIYLPDVLEFDKNLHK

SEQ ID NO: 2678740 - protein, 20 aa, Entamoeba histolytica
IDKCKTYPGGTFVVGLDTAV

SEQ ID NO: 2678741 - protein, 23 aa, Entamoeba histolytica
IDKFLNSIIIEFSQTRSFPPSQI

SEQ ID NO: 2678742 - protein, 24 aa, Entamoeba histolytica
IDKHLPKEWTIICLTIDEIEKAIV

SEQ ID NO: 2678743 - protein, 17 aa, Entamoeba histolytica
IDKICGGKVRPIGIKTW

SEQ ID NO: 2678744 - protein, 22 aa, Entamoeba histolytica
IDKIEKIKGWGLLICDEGHRLK

SEQ ID NO: 2678745 - protein, 17 aa, Entamoeba histolytica
IDKILPIECEIEDDGDD

SEQ ID NO: 2678746 - protein, 19 aa, Entamoeba histolytica
IDKIYCGKGIKKVRIYKVK

SEQ ID NO: 2678747 - protein, 21 aa, Entamoeba histolytica
IDKKCLTLAKAINQLIRDRNI

SEQ ID NO: 2678748 - protein, 17 aa, Entamoeba histolytica
IDKKIHYIMNCMATSEI

SEQ ID NO: 2678749 - protein, 24 aa, Entamoeba histolytica
IDKKSGITELGFHSPYLTKEDIPK

SEQ ID NO: 2678750 - protein, 24 aa, Entamoeba histolytica
IDKLEEIFNFIVCPSRPNCDEQID

SEQ ID NO: 2678751 - protein, 18 aa, Entamoeba histolytica
IDKLKCHSFILQIRIPSL

SEQ ID NO: 2678752 - protein, 22 aa, Entamoeba histolytica
IDKNFFRFFFPIAPSYLHSSFL

SEQ ID NO: 2678753 - protein, 25 aa, Entamoeba histolytica
IDKPFLEYDLEWFPPQWKVNFAKRL

SEQ ID NO: 2678754 - protein, 24 aa, Entamoeba histolytica
IDKQKAAGIIIDWDDNGDEEDPSG

SEQ ID NO: 2678755 - protein, 20 aa, Entamoeba histolytica
IDKVFFFSYTFPELIKIRNE

SEQ ID NO: 2678756 - protein, 18 aa, Entamoeba histolytica
IDKVSWVGLYTVDGPIGR

SEQ ID NO: 2678757 - protein, 20 aa, Entamoeba histolytica
IDKWFMKLFNHWNNTVRQIF

SEQ ID NO: 2678758 - protein, 18 aa, Entamoeba histolytica
IDKWLFTNLYDFIFEPMM

SEQ ID NO: 2678759 - protein, 21 aa, Entamoeba histolytica
IDKYGYCPIHYTIIQNNKELF

SEQ ID NO: 2678760 - protein, 19 aa, Entamoeba histolytica
IDLFARYRYLKEITALILD

SEQ ID NO: 2678761 - protein, 17 aa, Entamoeba histolytica
IDLGICVAQATVVLEAN

SEQ ID NO: 2678762 - protein, 17 aa, Entamoeba histolytica
IDLINTWNGSFPNEIIQ

SEQ ID NO: 2678763 - protein, 19 aa, Entamoeba histolytica
IDLKELRQVSGEEIPPLLL

SEQ ID NO: 2678764 - protein, 18 aa, Entamoeba histolytica
IDLLKKWSNKTHYQIIYR

SEQ ID NO: 2678765 - protein, 29 aa, Entamoeba histolytica
IDLLRKDGLWWFGELNGIKGYFPSNYVQI

SEQ ID NO: 2678766 - protein, 24 aa, Entamoeba histolytica
IDLLTRIRVVYGIDAIRPYQKNVI

SEQ ID NO: 2678767 - protein, 21 aa, Entamoeba histolytica
IDLNIDCLKEITVDFFNVFNS

SEQ ID NO: 2678768 - protein, 17 aa, Entamoeba histolytica
IDLPQIVVVGSQSAGKS

SEQ ID NO: 2678769 - protein, 17 aa, Entamoeba histolytica
IDLRLENFQQNFIKEVQ

SEQ ID NO: 2678770 - protein, 34 aa, Entamoeba histolytica
IDLSRCFISKLIIRRCKFIEGILLPFQCQAIHIE

SEQ ID NO: 2678771 - protein, 17 aa, Entamoeba histolytica
IDLSTIITLHLPDRWFI

SEQ ID NO: 2678772 - protein, 17 aa, Entamoeba histolytica
IDLTKAIVSRTIEMEIP

SEQ ID NO: 2678773 - protein, 17 aa, Entamoeba histolytica
IDLYQPLLVYKQIQENF

SEQ ID NO: 2678774 - protein, 17 aa, Entamoeba histolytica
IDMIVKIDINRIYVNLF

SEQ ID NO: 2678775 - protein, 20 aa, Entamoeba histolytica
IDMKGDWSYQSYFCKDNKSM

SEQ ID NO: 2678776 - protein, 25 aa, Entamoeba histolytica
IDMLKEIPLSWYHRIIMFTFSNLAL

SEQ ID NO: 2678777 - protein, 18 aa, Entamoeba histolytica
IDMRIITQFMCKKFPNAV

SEQ ID NO: 2678778 - protein, 17 aa, Entamoeba histolytica
IDMWSLGCILPELLTTE

SEQ ID NO: 2678779 - protein, 20 aa, Entamoeba histolytica
IDNDFICFLCIAIENKQNIH

SEQ ID NO: 2678780 - protein, 25 aa, Entamoeba histolytica
IDNEITQQIFFEWSKINKNESIPEL

SEQ ID NO: 2678781 - protein, 18 aa, Entamoeba histolytica
IDNFFGIASIVSLREARF

SEQ ID NO: 2678782 - protein, 23 aa, Entamoeba histolytica
IDNFISCVCRILMIEGIPFQPQA

SEQ ID NO: 2678783 - protein, 17 aa, Entamoeba histolytica
IDNFVLFVDYIRLREKL

SEQ ID NO: 2678784 - protein, 25 aa, Entamoeba histolytica
IDNIFLRMDIRTELICLGAEKFIAN

SEQ ID NO: 2678785 - protein, 17 aa, Entamoeba histolytica
IDNILSLLRIEKHMEEE

SEQ ID NO: 2678786 - protein, 26 aa, Entamoeba histolytica
IDNLCIVVAPTFFWKKGEMQRQNGFE

SEQ ID NO: 2678787 - protein, 23 aa, Entamoeba histolytica
IDNLCSLPTLYSDFLIFMNKENN

SEQ ID NO: 2678788 - protein, 25 aa, Entamoeba histolytica
IDNLIELFPSIKLLFNDIYEKDILF

SEQ ID NO: 2678789 - protein, 20 aa, Entamoeba histolytica
IDNLKGLDFEDGENEFFNIT

SEQ ID NO: 2678790 - protein, 24 aa, Entamoeba histolytica
IDNLREFLVSGGSVVWKQLQYLTI

SEQ ID NO: 2678791 - protein, 20 aa, Entamoeba histolytica
IDNPWYLKFNNSAIYDDITE

SEQ ID NO: 2678792 - protein, 21 aa, Entamoeba histolytica
IDNSLDFHCCIKPNGHQVDMI

SEQ ID NO: 2678793 - protein, 17 aa, Entamoeba histolytica
IDNTFNFDNKKEEYVDN

SEQ ID NO: 2678794 - protein, 19 aa, Entamoeba histolytica
IDNVEIWFDPDIANSVIEE

SEQ ID NO: 2678795 - protein, 23 aa, Entamoeba histolytica
IDPCILLYMKLVIGLTGEKIGSF

SEQ ID NO: 2678796 - protein, 24 aa, Entamoeba histolytica
IDPILQCLNVIKSRIDNQFIAYKR

SEQ ID NO: 2678797 - protein, 22 aa, Entamoeba histolytica
IDPKAPRSFKTVFRHVIDNDMV

SEQ ID NO: 2678798 - protein, 29 aa, Entamoeba histolytica
IDPLKRYSVKECLSHEFFTRKSKTTQFEL

SEQ ID NO: 2678799 - protein, 20 aa, Entamoeba histolytica
IDPMLKDLICHLITHKEADR

SEQ ID NO: 2678800 - protein, 22 aa, Entamoeba histolytica
IDPPRGCLLYGPPGTGKTMLAK

SEQ ID NO: 2678801 - protein, 28 aa, Entamoeba histolytica
IDPQKRFTVKQCLSHEFFSRKRDKTKNK

SEQ ID NO: 2678802 - protein, 25 aa, Entamoeba histolytica
IDPRLIAATCVFFSSKVEGCLISPH

SEQ ID NO: 2678803 - protein, 18 aa, Entamoeba histolytica
IDPRNIITPDEWNIDENP

SEQ ID NO: 2678804 - protein, 20 aa, Entamoeba histolytica
IDPTKRFNSIQAINHTFFTQ

SEQ ID NO: 2678805 - protein, 21 aa, Entamoeba histolytica
IDPWSCGIILIEMTQKSSNIQ

SEQ ID NO: 2678806 - protein, 17 aa, Entamoeba histolytica
IDQFPCIILCSRGFPDN

SEQ ID NO: 2678807 - protein, 26 aa, Entamoeba histolytica
IDQIGLKSDELFPFGDTLTTKNDSEP

SEQ ID NO: 2678808 - protein, 26 aa, Entamoeba histolytica
IDQLLLKYADNFAVMALDVPCVKDVI

SEQ ID NO: 2678809 - protein, 29 aa, Entamoeba histolytica
IDQPLPFFIFDWHYTWFINAFNFELVLRI

SEQ ID NO: 2678810 - protein, 24 aa, Entamoeba histolytica
IDQSRIVGYYGLFPALINLKQSFC

SEQ ID NO: 2678811 - protein, 18 aa, Entamoeba histolytica
IDQYFAKCFSFMETIIEG

SEQ ID NO: 2678812 - protein, 20 aa, Entamoeba histolytica
IDRCYQWKETDGMPFKETFA

SEQ ID NO: 2678813 - protein, 36 aa, Entamoeba histolytica; identical to SEQ ID NO: 2485427

SEQ ID NO: 2678814 - protein, 27 aa, Entamoeba histolytica
IDRFNKFIRRYFQVSAQQQVIQQQPQQ

SEQ ID NO: 2678815 - protein, 19 aa, Entamoeba histolytica
IDRGLFRSMAFKTFSEDAK

SEQ ID NO: 2678816 - protein, 26 aa, Entamoeba histolytica
IDRGYGRCFVYRKAECVIKKYKNGAC

SEQ ID NO: 2678817 - protein, 19 aa, Entamoeba histolytica
IDRINMFSHLTVFTESPYY

SEQ ID NO: 2678818 - protein, 18 aa, Entamoeba histolytica
IDRLIAEMKLCYEEIEKK

SEQ ID NO: 2678819 - protein, 17 aa, Entamoeba histolytica
IDRLLFYIDDWWLRDGI

SEQ ID NO: 2678820 - protein, 17 aa, Entamoeba histolytica
IDRMEMERYFNILHTPF

SEQ ID NO: 2678821 - protein, 24 aa, Entamoeba histolytica
IDRNWTCIELKSFIFKLGEINDQS

SEQ ID NO: 2678822 - protein, 17 aa, Entamoeba histolytica
IDRRSIVIGDFIDLLTG

SEQ ID NO: 2678823 - protein, 17 aa, Entamoeba histolytica
IDSACLMYCRYERFFQR

SEQ ID NO: 2678824 - protein, 25 aa, Entamoeba histolytica
IDSAIRLFIGFVVEGEIPRYGATRI

SEQ ID NO: 2678825 - protein, 22 aa, Entamoeba histolytica
IDSEIMNVYGLKKEQVKMKECG

SEQ ID NO: 2678826 - protein, 17 aa, Entamoeba histolytica
IDSFAVELYSFYNSLPI

SEQ ID NO: 2678827 - protein, 18 aa, Entamoeba histolytica
IDSFNSFLINMEEIEDRI

SEQ ID NO: 2678828 - protein, 42 aa, Entamoeba histolytica
IDSIETCYKFSMINKKCLESMKFLKINPCFTRNFNKNQSTQE

SEQ ID NO: 2678829 - protein, 20 aa, Entamoeba histolytica
IDSLLKCIKEKLNQNMQFSD

SEQ ID NO: 2678830 - protein, 25 aa, Entamoeba histolytica
IDSNIRIALCLNIEKLSALLFSKDA

SEQ ID NO: 2678831 - protein, 19 aa, Entamoeba histolytica
IDSPIRWFGRDDKPSTCFF

SEQ ID NO: 2678832 - protein, 23 aa, Entamoeba histolytica
IDSPSCLTALFFNVLKERTISLT

SEQ ID NO: 2678833 - protein, 18 aa, Entamoeba histolytica
IDSPSLHLPLMIKNLQLR

SEQ ID NO: 2678834 - protein, 21 aa, Entamoeba histolytica
IDSQLANNVLDDFCTDQIMSQ

SEQ ID NO: 2678835 - protein, 17 aa, Entamoeba histolytica
IDSRSSFGNISQRWLPE

SEQ ID NO: 2678836 - protein, 23 aa, Entamoeba histolytica
IDSSECSCLFNMIESDEVESGKY

SEQ ID NO: 2678837 - protein, 24 aa, Entamoeba histolytica
IDSSKLLVCRLCEHQYKLSQFCDH

SEQ ID NO: 2678838 - protein, 23 aa, Entamoeba histolytica
IDTAKEMFKWLMSNNPEGVLDFL

SEQ ID NO: 2678839 - protein, 17 aa, Entamoeba histolytica
IDTCAFKKCTSLTQIGL

SEQ ID NO: 2678840 - protein, 23 aa, Entamoeba histolytica
IDTELFIPCLTFIGNLTIDNIST

SEQ ID NO: 2678841 - protein, 18 aa, Entamoeba histolytica
IDTGAVIICGKNKLKPIT

SEQ ID NO: 2678842 - protein, 17 aa, Entamoeba histolytica
IDTLGNIPLEWYNELEH

SEQ ID NO: 2678843 - protein, 21 aa, Entamoeba histolytica
IDTLGNIVIEFMKRMNELTPE

SEQ ID NO: 2678844 - protein, 18 aa, Entamoeba histolytica
IDTLKGIISESGVFYNLT

SEQ ID NO: 2678845 - protein, 18 aa, Entamoeba histolytica
IDTLKLVLRYQPFLNASK

SEQ ID NO: 2678846 - protein, 18 aa, Entamoeba histolytica
IDTLKYEKLTAIFDILNK

SEQ ID NO: 2678847 - protein, 23 aa, Entamoeba histolytica
IDTLRIGRIMKLSRITEVLKSSE

SEQ ID NO: 2678848 - protein, 24 aa, Entamoeba histolytica
IDTMKSLEMISIFLKNKTEPTELK

SEQ ID NO: 2678849 - protein, 17 aa, Entamoeba histolytica
IDTSVFGLYINDKTQIN

SEQ ID NO: 2678850 - protein, 17 aa, Entamoeba histolytica
IDVAMRLTEVAVKVFDP

SEQ ID NO: 2678851 - protein, 18 aa, Entamoeba histolytica
IDVIQMVCWPWKYYHDSN

SEQ ID NO: 2678852 - protein, 17 aa, Entamoeba histolytica
IDVIRLYLYTGHVEMAA

SEQ ID NO: 2678853 - protein, 17 aa, Entamoeba histolytica
IDVKGYLYIIAKCISGG

SEQ ID NO: 2678854 - protein, 27 aa, Entamoeba histolytica
IDVKQAVAVALKFGLEKEIWDEMVKIG

SEQ ID NO: 2678855 - protein, 23 aa, Entamoeba histolytica
IDVLKRLANVLLISPSDNYLTVV

SEQ ID NO: 2678856 - protein, 18 aa, Entamoeba histolytica
IDVNGIFVAVELHHFKLY

SEQ ID NO: 2678857 - protein, 24 aa, Entamoeba histolytica
IDVPEIKKRIWFGCESTEEFKSCV

SEQ ID NO: 2678858 - protein, 17 aa, Entamoeba histolytica
IDVSVLCKKDNLTRRSV

SEQ ID NO: 2678859 - protein, 19 aa, Entamoeba histolytica
IDVVSGLCNLKILDISNNH

SEQ ID NO: 2678860 - protein, 19 aa, Entamoeba histolytica
IDWELSQSRVREMKKKKNQ

SEQ ID NO: 2678861 - protein, 24 aa, Entamoeba histolytica
IDYDSSQNFLTWSALPQPFRYNKL

SEQ ID NO: 2678862 - protein, 17 aa, Entamoeba histolytica
IDYFITVAYKCFKLGDF

SEQ ID NO: 2678863 - protein, 19 aa, Entamoeba histolytica
IDYIREFWEWESPQNQKRR

SEQ ID NO: 2678864 - protein, 24 aa, Entamoeba histolytica
IDYLEPYCICINDAFTKGKRIVDK

SEQ ID NO: 2678865 - protein, 20 aa, Entamoeba histolytica
IDYLMAFLMYLNQNQKEIIH

SEQ ID NO: 2678866 - protein, 19 aa, Entamoeba histolytica
IDYNKEWKFFEDSKKWTQT

SEQ ID NO: 2678867 - protein, 20 aa, Entamoeba histolytica
IDYRSMVFVFTFDPITHQAQ

SEQ ID NO: 2678868 - protein, 18 aa, Entamoeba histolytica
IDYRVLKKQIDQFTYKQS

SEQ ID NO: 2678869 - protein, 19 aa, Entamoeba histolytica
IEAIEWPMTHSKEFKKLGI

SEQ ID NO: 2678870 - protein, 26 aa, Entamoeba histolytica
IEAKDRFRLLYTFLRKNKNKKTIVFM

SEQ ID NO: 2678871 - protein, 23 aa, Entamoeba histolytica
IEAKFKGGNNFNINGRVIKFRAG

SEQ ID NO: 2678872 - protein, 20 aa, Entamoeba histolytica
IEAKIVKGYSEYHMVNTVHF

SEQ ID NO: 2678873 - protein, 17 aa, Entamoeba histolytica
IEAKTMRVILGKSNVFV

SEQ ID NO: 2678874 - protein, 25 aa, Entamoeba histolytica
IEALKELLLKIQVCRATADTEYAHS

SEQ ID NO: 2678875 - protein, 21 aa, Entamoeba histolytica
IEALNLISLNFKFTTTLYFPT

SEQ ID NO: 2678876 - protein, 24 aa, Entamoeba histolytica
IEARKRFYEYSSLDVEPYQPRRGF

SEQ ID NO: 2678877 - protein, 20 aa, Entamoeba histolytica
IEASAIVFLNFGRVVILTDD

SEQ ID NO: 2678878 - protein, 19 aa, Entamoeba histolytica
IEATEKWFKSIGMKTRLSE

SEQ ID NO: 2678879 - protein, 18 aa, Entamoeba histolytica
IEATYTCIIFIKEKMKRI

SEQ ID NO: 2678880 - protein, 18 aa, Entamoeba histolytica
IECAGRKGSFPVPELDPV

SEQ ID NO: 2678881 - protein, 17 aa, Entamoeba histolytica
IECARTLSQEQERRNSK

SEQ ID NO: 2678882 - protein, 25 aa, Entamoeba histolytica
IECMKHKEPALLIGETGCGKTTVCQ

SEQ ID NO: 2678883 - protein, 23 aa, Entamoeba histolytica
IEDARYPLKYRMLVDMVDVIFAD

SEQ ID NO: 2678884 - protein, 24 aa, Entamoeba histolytica
IEDCLDLGGGVGRVTKDVLSRYYK

SEQ ID NO: 2678885 - protein, 22 aa, Entamoeba histolytica
IEDETRCYIALVNDIQYSSEKK

SEQ ID NO: 2678886 - protein, 22 aa, Entamoeba histolytica
IEDFFPELLLLDLSNNEIEVLE

SEQ ID NO: 2678887 - protein, 17 aa, Entamoeba histolytica
IEDGYCIEIGKEACTQN

SEQ ID NO: 2678888 - protein, 17 aa, Entamoeba histolytica
IEDITCFGALEKFTELE

SEQ ID NO: 2678889 - protein, 31 aa, Entamoeba histolytica
IEDKPIFIDLSWRLDIVLAYKNVYKLIQPQF

SEQ ID NO: 2678890 - protein, 24 aa, Entamoeba histolytica
IEDMPRTSFGKVYAPKLKEIVKDC

SEQ ID NO: 2678891 - protein, 23 aa, Entamoeba histolytica
IEDYGELIPFCYDGMANLYRDEA

SEQ ID NO: 2678892 - protein, 19 aa, Entamoeba histolytica
IEEAIKMSLEDNAKSNQSK

SEQ ID NO: 2678893 - protein, 30 aa, Entamoeba histolytica
IEEALKGSQIFDCFTCKFDDVISSLDKNVP

SEQ ID NO: 2678894 - protein, 23 aa, Entamoeba histolytica
IEECFRTPQAIFKRNSTYLRVLK

SEQ ID NO: 2678895 - protein, 24 aa, Entamoeba histolytica
IEECFRTPSSIFRRNSIFTRIIRI

SEQ ID NO: 2678896 - protein, 17 aa, Entamoeba histolytica
IEECSFELISLIDKKIS

SEQ ID NO: 2678897 - protein, 18 aa, Entamoeba histolytica
IEEEKSKLITELSNGSDG

SEQ ID NO: 2678898 - protein, 25 aa, Entamoeba histolytica
IEEFKECACAAAIIKEYLRELPDPL

SEQ ID NO: 2678899 - protein, 18 aa, Entamoeba histolytica
IEEFTRIGLVSYIRKIFQ

SEQ ID NO: 2678900 - protein, 17 aa, Entamoeba histolytica
IEEGCIECEHLKGDPIQ

SEQ ID NO: 2678901 - protein, 17 aa, Entamoeba histolytica
IEEHIFELFPFPHSYEI

SEQ ID NO: 2678902 - protein, 19 aa, Entamoeba histolytica
IEEIAGFFIDYLKEMKPKL

SEQ ID NO: 2678903 - protein, 35 aa, Entamoeba histolytica
IEEIERGWIWNSYIKRWCEMNEKYVMIFNNRDDPV

SEQ ID NO: 2678904 - protein, 19 aa, Entamoeba histolytica
IEEIFKILYTKGCYTKGIF

SEQ ID NO: 2678905 - protein, 18 aa, Entamoeba histolytica
IEEIFVFIAQQFIQRIKS

SEQ ID NO: 2678906 - protein, 23 aa, Entamoeba histolytica
IEEINLRAGITPPNYPAVVPHPS

SEQ ID NO: 2678907 - protein, 24 aa, Entamoeba histolytica
IEEKAEGLKICLILKTDLAKTYDL

SEQ ID NO: 2678908 - protein, 34 aa, Entamoeba histolytica; identical to SEQ ID NO: 2485512

SEQ ID NO: 2678909 - protein, 22 aa, Entamoeba histolytica
IEEKKLKSGVVIPNNVIYQTPE

SEQ ID NO: 2678910 - protein, 24 aa, Entamoeba histolytica
IEEKRINYSLIYGQLVPILASPLQ

SEQ ID NO: 2678911 - protein, 17 aa, Entamoeba histolytica
IEELCMRMSVTNFNEIP

SEQ ID NO: 2678912 - protein, 17 aa, Entamoeba histolytica
IEELECEEKWAVVRDEI

SEQ ID NO: 2678913 - protein, 17 aa, Entamoeba histolytica
IEELIYYYNLYRHANDP

SEQ ID NO: 2678914 - protein, 17 aa, Entamoeba histolytica
IEELIYYYNLYRYANDP

SEQ ID NO: 2678915 - protein, 18 aa, Entamoeba histolytica
IEELKKIKFNDGRSNLDE

SEQ ID NO: 2678916 - protein, 17 aa, Entamoeba histolytica
IEELVSLMNDKYQQVKP

SEQ ID NO: 2678917 - protein, 18 aa, Entamoeba histolytica
IEELYNFFERHWDIVCHL

SEQ ID NO: 2678918 - protein, 27 aa, Entamoeba histolytica
IEERIKELQKDAGVSFDQHFMDEDFDE

SEQ ID NO: 2678919 - protein, 25 aa, Entamoeba histolytica
IEESKKSLCFEVVYDKQFVFFCKDD

SEQ ID NO: 2678920 - protein, 23 aa, Entamoeba histolytica
IEEVIKYAKFISGTVAQQPPYPK

SEQ ID NO: 2678921 - protein, 18 aa, Entamoeba histolytica
IEEYVSFRLGEKELSTIR

SEQ ID NO: 2678922 - protein, 22 aa, Entamoeba histolytica
IEFDDPITLVDGWRMVDNNNQL

SEQ ID NO: 2678923 - protein, 25 aa, Entamoeba histolytica
IEFICKTCDFIIIFIDISVELNQYE

SEQ ID NO: 2678924 - protein, 20 aa, Entamoeba histolytica
IEFIPIDYNKEWKFFEDSKK

SEQ ID NO: 2678925 - protein, 24 aa, Entamoeba histolytica
IEFLDCIPELYLQHCMIHCYGFSP

SEQ ID NO: 2678926 - protein, 26 aa, Entamoeba histolytica
IEFLNYRQFPLLAFTDFMSLFVKHFN

SEQ ID NO: 2678927 - protein, 17 aa, Entamoeba histolytica
IEFNVKEGIYWDGGKAS

SEQ ID NO: 2678928 - protein, 19 aa, Entamoeba histolytica
IEFPLHCNKVLLLNNSNAL

SEQ ID NO: 2678929 - protein, 20 aa, Entamoeba histolytica
IEFPYFCFGININKKITSSL

SEQ ID NO: 2678930 - protein, 19 aa, Entamoeba histolytica
IEFSGCSNLTIIDTPGFRL

SEQ ID NO: 2678931 - protein, 27 aa, Entamoeba histolytica
IEFSLKRAGSKFVINQPAVYKLPSSEH

SEQ ID NO: 2678932 - protein, 17 aa, Entamoeba histolytica
IEFTNAITFGLCGSSTI

SEQ ID NO: 2678933 - protein, 28 aa, Entamoeba histolytica
IEFVPLKGCLFGLQICREKTNETITIKS

SEQ ID NO: 2678934 - protein, 17 aa, Entamoeba histolytica
IEGAIMMMKEEVAARRK

SEQ ID NO: 2678935 - protein, 17 aa, Entamoeba histolytica
IEGEFVSALGYNYHPQC

SEQ ID NO: 2678936 - protein, 17 aa, Entamoeba histolytica
IEGEGYSSLMLLLTNMG

SEQ ID NO: 2678937 - protein, 18 aa, Entamoeba histolytica
IEGFPTLKLFDGTSLISE

SEQ ID NO: 2678938 - protein, 17 aa, Entamoeba histolytica
IEGIFRMAGSKQRIEQL

SEQ ID NO: 2678939 - protein, 21 aa, Entamoeba histolytica
IEGLQSIIILTHLLYEVAKTW

SEQ ID NO: 2678940 - protein, 21 aa, Entamoeba histolytica
IEGMIRIILFFQYAQFQEASI

SEQ ID NO: 2678941 - protein, 25 aa, Entamoeba histolytica
IEGMKITKFPVMWMNQIHALHSSYE

SEQ ID NO: 2678942 - protein, 28 aa, Entamoeba histolytica
IEGVFKCLDCGWESPPIPQQFKYTQPMR

SEQ ID NO: 2678943 - protein, 26 aa, Entamoeba histolytica
IEHAIPAEMGHVWVIPKDCQIGQEVT

SEQ ID NO: 2678944 - protein, 27 aa, Entamoeba histolytica
IEHELRRKIEIMVLEWVEKNCKTMDEK

SEQ ID NO: 2678945 - protein, 17 aa, Entamoeba histolytica
IEHFAIFSIFIIDPLLF

SEQ ID NO: 2678946 - protein, 20 aa, Entamoeba histolytica
IEHIKELILIATEDPSIEKR

SEQ ID NO: 2678947 - protein, 34 aa, Entamoeba histolytica; identical to SEQ ID NO: 2485562

SEQ ID NO: 2678948 - protein, 18 aa, Entamoeba histolytica
IEIADGCERCRQKIRQVQ

SEQ ID NO: 2678949 - protein, 20 aa, Entamoeba histolytica
IEIADLIVSIYIIKDYYYGI

SEQ ID NO: 2678950 - protein, 18 aa, Entamoeba histolytica
IEICTKETVSFIIQIIMF

SEQ ID NO: 2678951 - protein, 18 aa, Entamoeba histolytica
IEIEIQRRLNIKDNISLR

SEQ ID NO: 2678952 - protein, 17 aa, Entamoeba histolytica
IEIEPKLTINQLLDVTK

SEQ ID NO: 2678953 - protein, 20 aa, Entamoeba histolytica
IEIEYLPKIISNVIQIYCSD

SEQ ID NO: 2678954 - protein, 21 aa, Entamoeba histolytica
IEIFNLWKQFFHCFNCKGKAK

SEQ ID NO: 2678955 - protein, 24 aa, Entamoeba histolytica
IEIGDDCFEKCLSLQSINIPTSIS

SEQ ID NO: 2678956 - protein, 23 aa, Entamoeba histolytica
IEIGDGCFKWCYSLTTINIPTSV

SEQ ID NO: 2678957 - protein, 17 aa, Entamoeba histolytica
IEIGKYCFVGCSLTTIN

SEQ ID NO: 2678958 - protein, 17 aa, Entamoeba histolytica
IEIGRKRIDEMDKADEE

SEQ ID NO: 2678959 - protein, 28 aa, Entamoeba histolytica
IEIGSSMIPFKFILPKNIKKITVIGDLN

SEQ ID NO: 2678960 - protein, 17 aa, Entamoeba histolytica
IEIGYGCFAYCTSLTTI

SEQ ID NO: 2678961 - protein, 20 aa, Entamoeba histolytica
IEIIASIGLTGLDDDIQYVK

SEQ ID NO: 2678962 - protein, 17 aa, Entamoeba histolytica
IEIKASHIIYDLLGVLI

SEQ ID NO: 2678963 - protein, 23 aa, Entamoeba histolytica
IEIKHPERLAAKTVQFLIVTELF

SEQ ID NO: 2678964 - protein, 17 aa, Entamoeba histolytica
IEIKKPIYIVALPRSGS

SEQ ID NO: 2678965 - protein, 22 aa, Entamoeba histolytica
IEIKMNYIQRGWIDKIEKQQQT

SEQ ID NO: 2678966 - protein, 24 aa, Entamoeba histolytica
IEIKSCAIHTTFVCPSSVSHFSLS

SEQ ID NO: 2678967 - protein, 19 aa, Entamoeba histolytica
IEILCKGDGREEHPIVETC

SEQ ID NO: 2678968 - protein, 24 aa, Entamoeba histolytica
IEILKRGGKCLIPVFSLGRAQEFE

SEQ ID NO: 2678969 - protein, 26 aa, Entamoeba histolytica
IEILKYEFTFILAIIHKVRTVGIESL

SEQ ID NO: 2678970 - protein, 18 aa, Entamoeba histolytica
IEINKRYVFDKEIGSGSF

SEQ ID NO: 2678971 - protein, 20 aa, Entamoeba histolytica
IEIPCTLIVISKGNEIPNSI

SEQ ID NO: 2678972 - protein, 22 aa, Entamoeba histolytica
IEIPTVRWSDIGGCNGAKKQIK

SEQ ID NO: 2678973 - protein, 17 aa, Entamoeba histolytica
IEIQKEYLMKRVVELTQ

SEQ ID NO: 2678974 - protein, 17 aa, Entamoeba histolytica
IEIRHRLKIQPNVLPDS

SEQ ID NO: 2678975 - protein, 23 aa, Entamoeba histolytica
IEIVYHIAPYLPFMETNDQQLDK

SEQ ID NO: 2678976 - protein, 24 aa, Entamoeba histolytica
IEKAKILRDAYCVIENIVKQLIKL

SEQ ID NO: 2678977 - protein, 17 aa, Entamoeba histolytica
IEKCIKYICDGESGEKG

SEQ ID NO: 2678978 - protein, 24 aa, Entamoeba histolytica
IEKCSLCEHKKGLIWSQVKRRNEC

SEQ ID NO: 2678979 - protein, 19 aa, Entamoeba histolytica
IEKCYEVIEAKDIIKMIRD

SEQ ID NO: 2678980 - protein, 25 aa, Entamoeba histolytica
IEKEELKGDIQWREEAITIRKELSL

SEQ ID NO: 2678981 - protein, 17 aa, Entamoeba histolytica
IEKEFEVIIPLDDLLPF

SEQ ID NO: 2678982 - protein, 19 aa, Entamoeba histolytica
IEKEFKLNQLINYKQNQIQ

SEQ ID NO: 2678983 - protein, 26 aa, Entamoeba histolytica
IEKEPFKLVTKCCGCGGEANETAELS

SEQ ID NO: 2678984 - protein, 19 aa, Entamoeba histolytica
IEKERRLEELPPINTTNKN

SEQ ID NO: 2678985 - protein, 24 aa, Entamoeba histolytica
IEKFIKVVEKTGGEEYAEKYKELR

SEQ ID NO: 2678986 - protein, 25 aa, Entamoeba histolytica
IEKFPLPSKHPIVMMKLNASQSSLM

SEQ ID NO: 2678987 - protein, 17 aa, Entamoeba histolytica
IEKGGEIFYRINDPSRL

SEQ ID NO: 2678988 - protein, 17 aa, Entamoeba histolytica
IEKGIKLICRISSQKVT

SEQ ID NO: 2678989 - protein, 18 aa, Entamoeba histolytica
IEKGLPYDILLFNDLNTV

SEQ ID NO: 2678990 - protein, 33 aa, Entamoeba histolytica; identical to SEQ ID NO: 2485610

SEQ ID NO: 2678991 - protein, 21 aa, Entamoeba histolytica
IEKIILQLTFVFAHNPSSQEQ

SEQ ID NO: 2678992 - protein, 18 aa, Entamoeba histolytica
IEKIKEIEHCISVNVSLC

SEQ ID NO: 2678993 - protein, 23 aa, Entamoeba histolytica
IEKIKLIGNQVWILQKTGDIKIY

SEQ ID NO: 2678994 - protein, 19 aa, Entamoeba histolytica
IEKIVPVFTKIIFKTSTKF

SEQ ID NO: 2678995 - protein, 25 aa, Entamoeba histolytica
IEKKLKYKAEFVFKDENDMTWTHSP

SEQ ID NO: 2678996 - protein, 17 aa, Entamoeba histolytica
IEKKPLEAYHCSFLNLA

SEQ ID NO: 2678997 - protein, 20 aa, Entamoeba histolytica
IEKLSGKAPHHYLSRGVFLA

SEQ ID NO: 2678998 - protein, 28 aa, Entamoeba histolytica
IEKNVRIGWLYCQRGFETGYIPQNFTSL

SEQ ID NO: 2678999 - protein, 17 aa, Entamoeba histolytica
IEKRCIEEEGTVQYYVN

SEQ ID NO: 2679000 - protein, 25 aa, Entamoeba histolytica
IEKRKELYKNGGIFFVTTRILISDL

SEQ ID NO: 2679001 - protein, 23 aa, Entamoeba histolytica
IEKRTYIYFTILKKYQLPMENED

SEQ ID NO: 2679002 - protein, 22 aa, Entamoeba histolytica
IEKSDAKWCVFDINKKEIIIQE

SEQ ID NO: 2679003 - protein, 18 aa, Entamoeba histolytica
IEKTCYILLSSYLFITLI

SEQ ID NO: 2679004 - protein, 26 aa, Entamoeba histolytica
IEKWEMKYSNGWEQQSLIFAKTIEDG

SEQ ID NO: 2679005 - protein, 17 aa, Entamoeba histolytica
IEKYCMKSIEIYLMTNG

SEQ ID NO: 2679006 - protein, 17 aa, Entamoeba histolytica
IEKYLLEMNHLFERKLK

SEQ ID NO: 2679007 - protein, 22 aa, Entamoeba histolytica
IELAENEISFFFSGAAGTGKSY

SEQ ID NO: 2679008 - protein, 25 aa, Entamoeba histolytica
IELCGAICNHSRYLRDRFVSTAYGS

SEQ ID NO: 2679009 - protein, 17 aa, Entamoeba histolytica
IELDDMNFEKDLEEFTK

SEQ ID NO: 2679010 - protein, 23 aa, Entamoeba histolytica
IELDKILHVYSFGFITNKNITMT

SEQ ID NO: 2679011 - protein, 31 aa, Entamoeba histolytica
IELERSMGVPSFFRWLSQKFPKIIDGCQGSF

SEQ ID NO: 2679012 - protein, 27 aa, Entamoeba histolytica
IELFIKTLIKINVFNAYYDLVELPELF

SEQ ID NO: 2679013 - protein, 25 aa, Entamoeba histolytica
IELGKEWGEHFGIAFQMRDDLLDID

SEQ ID NO: 2679014 - protein, 25 aa, Entamoeba histolytica
IELKGSTTFVKFGVLTLYDAEPKAK

SEQ ID NO: 2679015 - protein, 18 aa, Entamoeba histolytica
IELKKMVYMYLCTYSEKY

SEQ ID NO: 2679016 - protein, 17 aa, Entamoeba histolytica
IELKNLISFANKNSQFY

SEQ ID NO: 2679017 - protein, 23 aa, Entamoeba histolytica
IELKTFFDKDGFSYLFKAINYLD

SEQ ID NO: 2679018 - protein, 19 aa, Entamoeba histolytica
IELLLGELVAEDFEVQTVN

SEQ ID NO: 2679019 - protein, 17 aa, Entamoeba histolytica
IELLPMIIEQFWNDTNQ

SEQ ID NO: 2679020 - protein, 39 aa, Entamoeba histolytica
IELQEFYLKSEWKFADDLRLMIQIAKYGVGVYELYLNDS

SEQ ID NO: 2679021 - protein, 24 aa, Entamoeba histolytica
IELQRKTYNIGFSRRINGTPISWP

SEQ ID NO: 2679022 - protein, 25 aa, Entamoeba histolytica
IELRDIIFYRSLYRCLSTDLPSNSP

SEQ ID NO: 2679023 - protein, 22 aa, Entamoeba histolytica
IELRLEDISPLIIMLILECNDV

SEQ ID NO: 2679024 - protein, 42 aa, Entamoeba histolytica
IELVTHPFKFPGLILHDIILRFIPEQNEFFLTKGSKSDFDIL

SEQ ID NO: 2679025 - protein, 19 aa, Entamoeba histolytica
IELYIKYHRPLLIHMKDSL

SEQ ID NO: 2679026 - protein, 19 aa, Entamoeba histolytica
IEMALKISMNDEIYVDVAK

SEQ ID NO: 2679027 - protein, 19 aa, Entamoeba histolytica
IEMDFSSFTFIKSIKSTTS

SEQ ID NO: 2679028 - protein, 19 aa, Entamoeba histolytica
IEMFEGIFASYPVVLSQIY

SEQ ID NO: 2679029 - protein, 18 aa, Entamoeba histolytica
IEMIKEWNEYLLEHVVPL

SEQ ID NO: 2679030 - protein, 19 aa, Entamoeba histolytica
IEMKGLLKVKNFIKNIKKQ

SEQ ID NO: 2679031 - protein, 27 aa, Entamoeba histolytica
IEMLKEFRRLGGIIGVVSFSDEQNILR

SEQ ID NO: 2679032 - protein, 28 aa, Entamoeba histolytica
IEMLLTWACSLLPINVERVVKNGLENEK

SEQ ID NO: 2679033 - protein, 26 aa, Entamoeba histolytica
IEMNKDALCGLVYSITTDYIVIGERK

SEQ ID NO: 2679034 - protein, 24 aa, Entamoeba histolytica
IEMPESLFELSIISCINLNITNLF

SEQ ID NO: 2679035 - protein, 26 aa, Entamoeba histolytica
IEMQLFLLRWVRLLFCQVYPIKTIKP

SEQ ID NO: 2679036 - protein, 21 aa, Entamoeba histolytica
IEMTSPIGVLLKSIKFTENTT

SEQ ID NO: 2679037 - protein, 17 aa, Entamoeba histolytica
IEMVDSMGIEKDDPNNY

SEQ ID NO: 2679038 - protein, 17 aa, Entamoeba histolytica
IEMWKKNRFEERRIEIV

SEQ ID NO: 2679039 - protein, 18 aa, Entamoeba histolytica
IEMYWTCYNLHHQNLDCP

SEQ ID NO: 2679040 - protein, 30 aa, Entamoeba histolytica
IENAARFGIKELCKKVGLKAGSVFDTISVD

SEQ ID NO: 2679041 - protein, 31 aa, Entamoeba histolytica
IENAARFGIKELCKKVGLKAGSVFDTISVDI

SEQ ID NO: 2679042 - protein, 19 aa, Entamoeba histolytica
IENACHNFFRSVAYITSIT

SEQ ID NO: 2679043 - protein, 24 aa, Entamoeba histolytica
IENCIRTGVIYYFGIKQIDRLANC

SEQ ID NO: 2679044 - protein, 24 aa, Entamoeba histolytica
IENDPALCRICFQLQGKKEIGVDD

SEQ ID NO: 2679045 - protein, 26 aa, Entamoeba histolytica
IENEKEIPKDFSFEDQDGFKISINDE

SEQ ID NO: 2679046 - protein, 18 aa, Entamoeba histolytica
IENELNIDLDVKQKMCKY

SEQ ID NO: 2679047 - protein, 18 aa, Entamoeba histolytica
IENGCFCECSSLTSINIP

SEQ ID NO: 2679048 - protein, 19 aa, Entamoeba histolytica
IENIREAFEYKYFMKKTEV

SEQ ID NO: 2679049 - protein, 25 aa, Entamoeba histolytica
IENIRWEIGTALPVNIRASMTNDEI

SEQ ID NO: 2679050 - protein, 28 aa, Entamoeba histolytica
IENKCIYLLCSIYDPRSSIMPFRDGGHL

SEQ ID NO: 2679051 - protein, 34 aa, Entamoeba histolytica
IENKIEWKLLVKKAEKWLATKLPLPEEIKAQIIS

SEQ ID NO: 2679052 - protein, 22 aa, Entamoeba histolytica
IENLQYGFEFFINEASHQTFPT

SEQ ID NO: 2679053 - protein, 19 aa, Entamoeba histolytica
IENNRIIGIVVTRILNKTH

SEQ ID NO: 2679054 - protein, 17 aa, Entamoeba histolytica
IENNRPLLFIALMESDI

SEQ ID NO: 2679055 - protein, 31 aa, Entamoeba histolytica
IENTCLFSHFSIDEVYGWQSFVSKKEYDEVW

SEQ ID NO: 2679056 - protein, 23 aa, Entamoeba histolytica
IENWKKDMVKTFPGQLVKNLQDA

SEQ ID NO: 2679057 - protein, 21 aa, Entamoeba histolytica
IEPDEFWDCIIGKKQLIMIIQ

SEQ ID NO: 2679058 - protein, 25 aa, Entamoeba histolytica
IEPELYRKRLLSFINSVFMVMPDDS

SEQ ID NO: 2679059 - protein, 21 aa, Entamoeba histolytica
IEPFKSFKIQHEIECMAFSPT

SEQ ID NO: 2679060 - protein, 20 aa, Entamoeba histolytica
IEPMLLIPILRFNPKCIVCV

SEQ ID NO: 2679061 - protein, 20 aa, Entamoeba histolytica
IEPPPWRPTRRMEINNNRPI

SEQ ID NO: 2679062 - protein, 17 aa, Entamoeba histolytica
IEPRFNVMESRHDYVQW

SEQ ID NO: 2679063 - protein, 19 aa, Entamoeba histolytica
IEPRIKDSLILSELELIDE

SEQ ID NO: 2679064 - protein, 18 aa, Entamoeba histolytica
IEPSELILNQCKEILERS

SEQ ID NO: 2679065 - protein, 24 aa, Entamoeba histolytica
IEQIKHGIKLFGTDVSKWNINFNI

SEQ ID NO: 2679066 - protein, 18 aa, Entamoeba histolytica
IEQRKLRGNVFGKEIIQF

SEQ ID NO: 2679067 - protein, 22 aa, Entamoeba histolytica
IERCVKSVVDSANWKINDVNYV

SEQ ID NO: 2679068 - protein, 27 aa, Entamoeba histolytica
IERGVEKRGRMTWTYDIFQTLRRMKLY

SEQ ID NO: 2679069 - protein, 25 aa, Entamoeba histolytica
IERLFYLRILMERCKPIEKKLKYQI

SEQ ID NO: 2679070 - protein, 27 aa, Entamoeba histolytica
IERNKCGKYLFTLGMISSWNNGEIETA

SEQ ID NO: 2679071 - protein, 18 aa, Entamoeba histolytica
IERPPLKYLFQTNAFTTI

SEQ ID NO: 2679072 - protein, 21 aa, Entamoeba histolytica
IERRIKEIVSFEVSMNVPLKV

SEQ ID NO: 2679073 - protein, 17 aa, Entamoeba histolytica
IERSWKGLLENAFGTLS

SEQ ID NO: 2679074 - protein, 17 aa, Entamoeba histolytica
IESAYEFAEKNKLAYDN

SEQ ID NO: 2679075 - protein, 17 aa, Entamoeba histolytica
IESCNALGIDVSPLEIE

SEQ ID NO: 2679076 - protein, 21 aa, Entamoeba histolytica
IESFHLYIGYLIGRNEFGKAM

SEQ ID NO: 2679077 - protein, 17 aa, Entamoeba histolytica
IESFTKWLNTLIEHQRF

SEQ ID NO: 2679078 - protein, 19 aa, Entamoeba histolytica
IESGYCYDKAGGYGIQSGF

SEQ ID NO: 2679079 - protein, 17 aa, Entamoeba histolytica
IESHYLPFIDFDYPPLL

SEQ ID NO: 2679080 - protein, 24 aa, Entamoeba histolytica
IESIPFTPLRSAYLSIPFGVLSQS

SEQ ID NO: 2679081 - protein, 18 aa, Entamoeba histolytica
IESIPMWIEEVLNDKDLF

SEQ ID NO: 2679082 - protein, 23 aa, Entamoeba histolytica
IESIWKEGINCFNIDLIGNIPGD

SEQ ID NO: 2679083 - protein, 22 aa, Entamoeba histolytica
IESLIKEKNRAIVTLATSAALR

SEQ ID NO: 2679084 - protein, 18 aa, Entamoeba histolytica
IESLSFYVCECEKNGTSS

SEQ ID NO: 2679085 - protein, 22 aa, Entamoeba histolytica
IESNGLTCCITFSTERKQINLA

SEQ ID NO: 2679086 - protein, 20 aa, Entamoeba histolytica
IESNLSLSQIRQFSMKNYLP

SEQ ID NO: 2679087 - protein, 26 aa, Entamoeba histolytica
IESNYWPKYVEYYLFCCEKHLSGTRV

SEQ ID NO: 2679088 - protein, 19 aa, Entamoeba histolytica
IESQGIFMVGFKFTSIDEK

SEQ ID NO: 2679089 - protein, 20 aa, Entamoeba histolytica
IESQGIFMVGFKFTSIDEKM

SEQ ID NO: 2679090 - protein, 17 aa, Entamoeba histolytica
IESQPIIFDDIHMIPFL

SEQ ID NO: 2679091 - protein, 18 aa, Entamoeba histolytica
IESSGLIVSARIQLPLTH

SEQ ID NO: 2679092 - protein, 23 aa, Entamoeba histolytica
IESVIEIFLKYQIFLLSNEQKIE

SEQ ID NO: 2679093 - protein, 21 aa, Entamoeba histolytica
IESWLVRSMFVFKKMKTRQMV

SEQ ID NO: 2679094 - protein, 20 aa, Entamoeba histolytica
IESYILLLVVIACLDNQKYP

SEQ ID NO: 2679095 - protein, 21 aa, Entamoeba histolytica
IESYLNYGWMFEIKNKYKEAM

SEQ ID NO: 2679096 - protein, 23 aa, Entamoeba histolytica
IETDCPYCGIKKTSAGFKYLKEK

SEQ ID NO: 2679097 - protein, 21 aa, Entamoeba histolytica
IETFFLIGLLAQYATITFSIL

SEQ ID NO: 2679098 - protein, 25 aa, Entamoeba histolytica
IETHLGQIFKLFTPFFKVYFLYISH

SEQ ID NO: 2679099 - protein, 25 aa, Entamoeba histolytica
IETHPTMTWSDFCKDKTLIRPQRIV

SEQ ID NO: 2679100 - protein, 18 aa, Entamoeba histolytica
IETIFKCVIVPITLSSSI

SEQ ID NO: 2679101 - protein, 21 aa, Entamoeba histolytica
IETKLLYGLIHQRFIVTVPGL

SEQ ID NO: 2679102 - protein, 19 aa, Entamoeba histolytica
IETKNKFKLPFSIEEEEIQ

SEQ ID NO: 2679103 - protein, 18 aa, Entamoeba histolytica
IETLISILIRKRSTTTNI

SEQ ID NO: 2679104 - protein, 25 aa, Entamoeba histolytica
IETLKHLMLKSAVKIRIEEEQVSVE

SEQ ID NO: 2679105 - protein, 17 aa, Entamoeba histolytica
IETQLSVLIFLSSKDKK

SEQ ID NO: 2679106 - protein, 22 aa, Entamoeba histolytica
IETRITVLMSSRIYMKYSSQIT

SEQ ID NO: 2679107 - protein, 17 aa, Entamoeba histolytica
IETRKLNGINILNKQRL

SEQ ID NO: 2679108 - protein, 17 aa, Entamoeba histolytica
IETSLCDRILRLINAEE

SEQ ID NO: 2679109 - protein, 19 aa, Entamoeba histolytica
IETVINWLYENPFTSIKKV

SEQ ID NO: 2679110 - protein, 17 aa, Entamoeba histolytica
IETYSLTVIETIKTHQT

SEQ ID NO: 2679111 - protein, 26 aa, Entamoeba histolytica
IEVCKEKITGLCYVKENIIVGTPSGQ

SEQ ID NO: 2679112 - protein, 21 aa, Entamoeba histolytica
IEVEAPCVIFGDLHGQFYDLA

SEQ ID NO: 2679113 - protein, 32 aa, Entamoeba histolytica
IEVFGSKRPVSWILICRIIIYSLMEIHKGVSY

SEQ ID NO: 2679114 - protein, 20 aa, Entamoeba histolytica
IEVFTLLMLYKVMYPTRIAL

SEQ ID NO: 2679115 - protein, 21 aa, Entamoeba histolytica
IEVFTLLMLYKVMYPTRISLM

SEQ ID NO: 2679116 - protein, 22 aa, Entamoeba histolytica
IEVGLSCNFKYGKRTEIYVPSL

SEQ ID NO: 2679117 - protein, 19 aa, Entamoeba histolytica
IEVGQYIKCVGKIKKFSQE

SEQ ID NO: 2679118 - protein, 18 aa, Entamoeba histolytica
IEVICIGIGDGPFETFRN

SEQ ID NO: 2679119 - protein, 23 aa, Entamoeba histolytica
IEVICLLLALKIIAPDTVYLLRG

SEQ ID NO: 2679120 - protein, 23 aa, Entamoeba histolytica
IEVILDCIQSIIITMGENSLEPQ

SEQ ID NO: 2679121 - protein, 18 aa, Entamoeba histolytica
IEVILKIIEPMNVKEIGI

SEQ ID NO: 2679122 - protein, 26 aa, Entamoeba histolytica
IEVIVCADLRGWIVGYVVTKFLYQQV

SEQ ID NO: 2679123 - protein, 26 aa, Entamoeba histolytica
IEVKKKKIIICWKLTKEVKERNEYNY

SEQ ID NO: 2679124 - protein, 25 aa, Entamoeba histolytica
IEVKMKCFYCVVNSFIRYKNNDFLQ

SEQ ID NO: 2679125 - protein, 19 aa, Entamoeba histolytica
IEVLCLVYALKARYPQQFF

SEQ ID NO: 2679126 - protein, 26 aa, Entamoeba histolytica
IEVNSLGDICFRWCDDIQSINIPTNV

SEQ ID NO: 2679127 - protein, 23 aa, Entamoeba histolytica
IEVPNLPPLPTFNVNDEERKLYL

SEQ ID NO: 2679128 - protein, 18 aa, Entamoeba histolytica
IEVTSLGNYCFYKCDDIQ

SEQ ID NO: 2679129 - protein, 18 aa, Entamoeba histolytica
IEWDKILYIDEHTFKSLC

SEQ ID NO: 2679130 - protein, 26 aa, Entamoeba histolytica
IEWPKSMKELTCLRHLDLSNNKIQFI

SEQ ID NO: 2679131 - protein, 18 aa, Entamoeba histolytica
IEYARGDTHYLLYIIDQL

SEQ ID NO: 2679132 - protein, 22 aa, Entamoeba histolytica
IEYEIGKIIGVIGAISPSRIHQ

SEQ ID NO: 2679133 - protein, 30 aa, Entamoeba histolytica
IEYHSKYHLKYCFFNKLGFLIEIPSFSTSL

SEQ ID NO: 2679134 - protein, 23 aa, Entamoeba histolytica
IEYKGCITCNSLVIDALELSNKM

SEQ ID NO: 2679135 - protein, 18 aa, Entamoeba histolytica
IEYLPPHFNILMQKIINR

SEQ ID NO: 2679136 - protein, 23 aa, Entamoeba histolytica
IEYLRLTSLGVIGAMSKTRDPQI

SEQ ID NO: 2679137 - protein, 17 aa, Entamoeba histolytica
IEYQKICSLKTQIENES

SEQ ID NO: 2679138 - protein, 25 aa, Entamoeba histolytica
IEYVEILIMRALSLGLVKGYISQTT

SEQ ID NO: 2679139 - protein, 27 aa, Entamoeba histolytica
IFAFPERHLYYFISMCIIKEYSDIIIS

SEQ ID NO: 2679140 - protein, 19 aa, Entamoeba histolytica
IFAKYAIKIGEQYYERLKN

SEQ ID NO: 2679141 - protein, 17 aa, Entamoeba histolytica
IFAPKGRKLPITFEGVR

SEQ ID NO: 2679142 - protein, 27 aa, Entamoeba histolytica
IFCFKYHCERCGFVVCDSCSKNRKIVP

SEQ ID NO: 2679143 - protein, 23 aa, Entamoeba histolytica
IFCIKCSAIHRSLGVAYSRVKST

SEQ ID NO: 2679144 - protein, 21 aa, Entamoeba histolytica
IFCKHFNMTIGLLTGGIDIST

SEQ ID NO: 2679145 - protein, 18 aa, Entamoeba histolytica
IFCRCIRLIETIQKASCR

SEQ ID NO: 2679146 - protein, 27 aa, Entamoeba histolytica
IFCSLCKTKRVCILYPSFSDIYYAFSQ

SEQ ID NO: 2679147 - protein, 25 aa, Entamoeba histolytica
IFCYSLTIFEIFIERSLIYTEEVSK

SEQ ID NO: 2679148 - protein, 24 aa, Entamoeba histolytica
IFDGIKHVLIWTIGKHDPKIIPTI

SEQ ID NO: 2679149 - protein, 19 aa, Entamoeba histolytica
IFDGLSVILNPDIQRTQTA

SEQ ID NO: 2679150 - protein, 24 aa, Entamoeba histolytica
IFDGYWNCIGKLFNERKLEHGIIS

SEQ ID NO: 2679151 - protein, 18 aa, Entamoeba histolytica
IFDHCSRLTKLNASYNQL

SEQ ID NO: 2679152 - protein, 20 aa, Entamoeba histolytica
IFDIRWWPNDSLRVEYIKEL

SEQ ID NO: 2679153 - protein, 17 aa, Entamoeba histolytica
IFDKSIRIINIADKSLF

SEQ ID NO: 2679154 - protein, 24 aa, Entamoeba histolytica
IFDLHPPAVPAWELSEQRLPQPPS

SEQ ID NO: 2679155 - protein, 25 aa, Entamoeba histolytica
IFDLHPPAVPAWELSEQRLPQPPSF

SEQ ID NO: 2679156 - protein, 19 aa, Entamoeba histolytica
IFDPSCKSTLGVNFLTKTC

SEQ ID NO: 2679157 - protein, 27 aa, Entamoeba histolytica
IFDQICLAFRSVLRRESNLIVDIVEMF

SEQ ID NO: 2679158 - protein, 18 aa, Entamoeba histolytica
IFDREFELILKQCIELTP

SEQ ID NO: 2679159 - protein, 17 aa, Entamoeba histolytica
IFDRIHIKEGVYITSVD

SEQ ID NO: 2679160 - protein, 20 aa, Entamoeba histolytica
IFDSRGCFVVFAMEGNVYIW

SEQ ID NO: 2679161 - protein, 27 aa, Entamoeba histolytica
IFDTMSRWLLCYGKNMFSIRLLDETTH

SEQ ID NO: 2679162 - protein, 18 aa, Entamoeba histolytica
IFDVHKCVVSQFHLPNNL

SEQ ID NO: 2679163 - protein, 25 aa, Entamoeba histolytica
IFDYYRVCSSEELILKDQERKSNEE

SEQ ID NO: 2679164 - protein, 19 aa, Entamoeba histolytica
IFEELGTFLSHYHVGKLPR

SEQ ID NO: 2679165 - protein, 18 aa, Entamoeba histolytica
IFEIQRFIEFSALKNSLN

SEQ ID NO: 2679166 - protein, 18 aa, Entamoeba histolytica
IFEKCIKCIERMFEDKTM

SEQ ID NO: 2679167 - protein, 24 aa, Entamoeba histolytica
IFEKSNQVFKTWIDSTKGFYFINV

SEQ ID NO: 2679168 - protein, 19 aa, Entamoeba histolytica
IFEKVAITVLNKVPISSYK

SEQ ID NO: 2679169 - protein, 18 aa, Entamoeba histolytica
IFELFPFPHSYEIEQIVN

SEQ ID NO: 2679170 - protein, 18 aa, Entamoeba histolytica
IFENELIKVFDHIKNSTK

SEQ ID NO: 2679171 - protein, 20 aa, Entamoeba histolytica
IFESLFWKTLYGKIVSGKIK

SEQ ID NO: 2679172 - protein, 21 aa, Entamoeba histolytica
IFETKLPYWAQPNVDISQEIN

SEQ ID NO: 2679173 - protein, 18 aa, Entamoeba histolytica
IFEVKRLIGKRMSSQDIK

SEQ ID NO: 2679174 - protein, 19 aa, Entamoeba histolytica
IFFDEIDAIASERKGGSVF

SEQ ID NO: 2679175 - protein, 18 aa, Entamoeba histolytica
IFFGEVIIHYNIWDFPNW

SEQ ID NO: 2679176 - protein, 17 aa, Entamoeba histolytica
IFFKLYTAYCQFGELNR

SEQ ID NO: 2679177 - protein, 26 aa, Entamoeba histolytica
IFFKQLEDVECLLLLLNKIIPYSYDY

SEQ ID NO: 2679178 - protein, 20 aa, Entamoeba histolytica
IFFLHCKKWGLNPNAATQWC

SEQ ID NO: 2679179 - protein, 17 aa, Entamoeba histolytica
IFFLRFLFPALNHAEKY

SEQ ID NO: 2679180 - protein, 24 aa, Entamoeba histolytica
IFFPERNRFPGVIDLYRKEIGKPC

SEQ ID NO: 2679181 - protein, 17 aa, Entamoeba histolytica
IFFQFLEAVHHLRKNAS

SEQ ID NO: 2679182 - protein, 22 aa, Entamoeba histolytica
IFFSEKDLQGFGKITNHRINEF

SEQ ID NO: 2679183 - protein, 21 aa, Entamoeba histolytica
IFFYYNSFNIIIGKQGAGKTT

SEQ ID NO: 2679184 - protein, 17 aa, Entamoeba histolytica
IFGEGDAAWVVLVKCEK

SEQ ID NO: 2679185 - protein, 25 aa, Entamoeba histolytica
IFGIQLCVGNSMLAAKACQVLNSVD

SEQ ID NO: 2679186 - protein, 18 aa, Entamoeba histolytica
IFGLEYLSEFSSLNNSPF

SEQ ID NO: 2679187 - protein, 21 aa, Entamoeba histolytica
IFGRGGAVVHITCDCREIVVQ

SEQ ID NO: 2679188 - protein, 24 aa, Entamoeba histolytica
IFGTEIKSSVIAREEESTLIPNVI

SEQ ID NO: 2679189 - protein, 26 aa, Entamoeba histolytica
IFGVDLEPILPIPRCTTYVGDITTGM

SEQ ID NO: 2679190 - protein, 32 aa, Entamoeba histolytica
IFHFCSFDVILKVKPSERWSYKGIDLTYCLSQ

SEQ ID NO: 2679191 - protein, 23 aa, Entamoeba histolytica
IFHIDFGYVFGKLVPRKENEPEI

SEQ ID NO: 2679192 - protein, 21 aa, Entamoeba histolytica
IFHIIQPRFLIQIKDNDGKIP

SEQ ID NO: 2679193 - protein, 23 aa, Entamoeba histolytica
IFHIPSMKGCPIAWEDLNKEKTF

SEQ ID NO: 2679194 - protein, 17 aa, Entamoeba histolytica
IFHKINFDESLFQVECS

SEQ ID NO: 2679195 - protein, 17 aa, Entamoeba histolytica
IFHPNVLLIMGIIAEKG

SEQ ID NO: 2679196 - protein, 19 aa, Entamoeba histolytica
IFIELFLPYINRLLTSDSL

SEQ ID NO: 2679197 - protein, 18 aa, Entamoeba histolytica
IFIGGEWVGKHLVGPMRQ

SEQ ID NO: 2679198 - protein, 18 aa, Entamoeba histolytica
IFIGQKFFMYDSLTILEW

SEQ ID NO: 2679199 - protein, 21 aa, Entamoeba histolytica
IFIKECIDFKPNIGKKMLEET

SEQ ID NO: 2679200 - protein, 18 aa, Entamoeba histolytica
IFIQCLLGYFPKEISLID

SEQ ID NO: 2679201 - protein, 21 aa, Entamoeba histolytica
IFIRYCLKSKQLNIVISTLSS

SEQ ID NO: 2679202 - protein, 25 aa, Entamoeba histolytica
IFKALMPHVCDFEKVFTTRKVGSIT

SEQ ID NO: 2679203 - protein, 17 aa, Entamoeba histolytica
IFKCNKLPLLNLPQCIT

SEQ ID NO: 2679204 - protein, 17 aa, Entamoeba histolytica
IFKEVTEVLASFNNSHE

SEQ ID NO: 2679205 - protein, 18 aa, Entamoeba histolytica
IFKGIFKQNINSMKLIQY

SEQ ID NO: 2679206 - protein, 17 aa, Entamoeba histolytica
IFKGKFIVHLGGYSEYY

SEQ ID NO: 2679207 - protein, 19 aa, Entamoeba histolytica
IFKIRTYLHLPRNTEQDII

SEQ ID NO: 2679208 - protein, 19 aa, Entamoeba histolytica
IFKKPVKRRCKYFNSTPLV

SEQ ID NO: 2679209 - protein, 20 aa, Entamoeba histolytica
IFKLSIGDIQCCINQSLFEM

SEQ ID NO: 2679210 - protein, 38 aa, Entamoeba histolytica
IFLAAGEKALLVPILVANAINWGSIFFIASNSDDEMAQ

SEQ ID NO: 2679211 - protein, 17 aa, Entamoeba histolytica
IFLCLSNKIFGGDDKIE

SEQ ID NO: 2679212 - protein, 17 aa, Entamoeba histolytica
IFLKFNYGNILGIFFQK

SEQ ID NO: 2679213 - protein, 21 aa, Entamoeba histolytica
IFLLFIKEKVFGISLNKPITL

SEQ ID NO: 2679214 - protein, 19 aa, Entamoeba histolytica
IFLNCKKENVFVFGSEYRP

SEQ ID NO: 2679215 - protein, 23 aa, Entamoeba histolytica
IFLNSTACLINFSCYNELHPLLL

SEQ ID NO: 2679216 - protein, 24 aa, Entamoeba histolytica
IFLPIQYLLIYSFDPLFGKSLDTF

SEQ ID NO: 2679217 - protein, 19 aa, Entamoeba histolytica
IFMALRLADLSRRSISTQT

SEQ ID NO: 2679218 - protein, 24 aa, Entamoeba histolytica
IFMIHFPSKMKAFYMSKVPGHPDL

SEQ ID NO: 2679219 - protein, 23 aa, Entamoeba histolytica
IFMKLTNCLLWYFEKILYQKDTT

SEQ ID NO: 2679220 - protein, 18 aa, Entamoeba histolytica
IFMSFYFNYIKFIYFTIK

SEQ ID NO: 2679221 - protein, 18 aa, Entamoeba histolytica
IFMSIEILSKFHSIQIQL

SEQ ID NO: 2679222 - protein, 25 aa, Entamoeba histolytica
IFNGEKKGILSFMYQILSKYRLGNC

SEQ ID NO: 2679223 - protein, 17 aa, Entamoeba histolytica
IFNGIEWIHKQFSVVDK

SEQ ID NO: 2679224 - protein, 18 aa, Entamoeba histolytica
IFNIPEGVQRCCMEYKLK

SEQ ID NO: 2679225 - protein, 17 aa, Entamoeba histolytica
IFNNKLFERYNFNCTIK

SEQ ID NO: 2679226 - protein, 17 aa, Entamoeba histolytica
IFPLRGASDYVPFGHKK

SEQ ID NO: 2679227 - protein, 28 aa, Entamoeba histolytica
IFPNRGINLFTIFGCYQIGQFECSPMKK

SEQ ID NO: 2679228 - protein, 25 aa, Entamoeba histolytica
IFPSKHSCCAACWSDTTLFVGGTTK

SEQ ID NO: 2679229 - protein, 22 aa, Entamoeba histolytica
IFPSMIGRPLLRSEEKIGGVEI

SEQ ID NO: 2679230 - protein, 23 aa, Entamoeba histolytica
IFPSQDFLKHICIVWNKCYYYIS

SEQ ID NO: 2679231 - protein, 17 aa, Entamoeba histolytica
IFQEGILVEAVRKGYWI

SEQ ID NO: 2679232 - protein, 17 aa, Entamoeba histolytica
IFQLRIFLESGQFPISS

SEQ ID NO: 2679233 - protein, 21 aa, Entamoeba histolytica
IFRELQCIVNVILLYSEDNVD

SEQ ID NO: 2679234 - protein, 23 aa, Entamoeba histolytica
IFRHVPFSIEFSAPPLWLSQNSI

SEQ ID NO: 2679235 - protein, 24 aa, Entamoeba histolytica
IFRIWDFRTMKTIKAFQAPNKSSI

SEQ ID NO: 2679236 - protein, 28 aa, Entamoeba histolytica
IFRKDHRGLCVMTGYTIGDGMRLSVITH

SEQ ID NO: 2679237 - protein, 25 aa, Entamoeba histolytica
IFRRCKCLYIPYVGNLVLEAVQLFD

SEQ ID NO: 2679238 - protein, 27 aa, Entamoeba histolytica
IFSEYKEKCVFMIKYSLELRQWKEMKN

SEQ ID NO: 2679239 - protein, 25 aa, Entamoeba histolytica
IFSGDCIYCDGEVDFNLKHECIVNG

SEQ ID NO: 2679240 - protein, 25 aa, Entamoeba histolytica
IFSLFGRGRFDPAFVDDRCKKLDAW

SEQ ID NO: 2679241 - protein, 17 aa, Entamoeba histolytica
IFSYKMELDNCVVSLTL

SEQ ID NO: 2679242 - protein, 26 aa, Entamoeba histolytica
IFTIKDIWKHVCIVWTKCYSLIQQKQ

SEQ ID NO: 2679243 - protein, 27 aa, Entamoeba histolytica
IFTIKDIWKHVCIVWTKCYSLIQQKQL

SEQ ID NO: 2679244 - protein, 18 aa, Entamoeba histolytica
IFTPCLLLPEKGEMGISP

SEQ ID NO: 2679245 - protein, 18 aa, Entamoeba histolytica
IFVIKELMKESAKERTYG

SEQ ID NO: 2679246 - protein, 18 aa, Entamoeba histolytica
IFYTGGFVAHNPVVWEAI

SEQ ID NO: 2679247 - protein, 18 aa, Entamoeba histolytica
IGACEAGIEKYMYFFKNA

SEQ ID NO: 2679248 - protein, 17 aa, Entamoeba histolytica
IGACNGFVEVIRKSSLT

SEQ ID NO: 2679249 - protein, 23 aa, Entamoeba histolytica
IGADWRINLFFDDVKENYCVIVK

SEQ ID NO: 2679250 - protein, 17 aa, Entamoeba histolytica
IGAHLLKQMGWDESNIC

SEQ ID NO: 2679251 - protein, 17 aa, Entamoeba histolytica
IGANCWITQNIDQDQIV

SEQ ID NO: 2679252 - protein, 19 aa, Entamoeba histolytica
IGAPLKIFIPVTIITSQDN

SEQ ID NO: 2679253 - protein, 23 aa, Entamoeba histolytica
IGARAMGCVAAFAKSKHGREILI

SEQ ID NO: 2679254 - protein, 17 aa, Entamoeba histolytica
IGCALCVKKCPFEAIKI

SEQ ID NO: 2679255 - protein, 18 aa, Entamoeba histolytica
IGCDGLWNVISYDFCADI

SEQ ID NO: 2679256 - protein, 19 aa, Entamoeba histolytica
IGCEVCLTSNMVSRSIKGY

SEQ ID NO: 2679257 - protein, 21 aa, Entamoeba histolytica
IGCGPTLWLANQIQLDKLKKY

SEQ ID NO: 2679258 - protein, 18 aa, Entamoeba histolytica
IGCGVGNSMVPLLRVNPS

SEQ ID NO: 2679259 - protein, 20 aa, Entamoeba histolytica
IGCLTCGYEDIIFIATNYEV

SEQ ID NO: 2679260 - protein, 33 aa, Entamoeba histolytica
IGCPRGGYINEERCLFCIDILLKYFEILTKSRT

SEQ ID NO: 2679261 - protein, 18 aa, Entamoeba histolytica
IGDCAFKLCKSLSSISFK

SEQ ID NO: 2679262 - protein, 26 aa, Entamoeba histolytica
IGDDGRPIPFWLYKLHGLGTEFKCEI

SEQ ID NO: 2679263 - protein, 20 aa, Entamoeba histolytica
IGDGCFKECYSLKSINIPTR

SEQ ID NO: 2679264 - protein, 21 aa, Entamoeba histolytica
IGDGCFKQCFNLTKVEINKSV

SEQ ID NO: 2679265 - protein, 21 aa, Entamoeba histolytica
IGDGIKRAFRLFGNNLGNNLE

SEQ ID NO: 2679266 - protein, 23 aa, Entamoeba histolytica
IGDGKSSLGNFILKDNKFAVSSG

SEQ ID NO: 2679267 - protein, 18 aa, Entamoeba histolytica
IGDLMYKRQSELPPQSQI

SEQ ID NO: 2679268 - protein, 17 aa, Entamoeba histolytica
IGDRCFLQCSSLKSIKI

SEQ ID NO: 2679269 - protein, 25 aa, Entamoeba histolytica
IGDSLCCGYGMFPLSQCDSVPLQSD

SEQ ID NO: 2679270 - protein, 20 aa, Entamoeba histolytica
IGDTVVNCFNECPKGDKIQF

SEQ ID NO: 2679271 - protein, 18 aa, Entamoeba histolytica
IGDYCFKECLSLKSIDIP

SEQ ID NO: 2679272 - protein, 20 aa, Entamoeba histolytica
IGDYCFYECLSLKSIEIPTS

SEQ ID NO: 2679273 - protein, 23 aa, Entamoeba histolytica
IGDYCFYGCYSLRTIDIPTNVSK

SEQ ID NO: 2679274 - protein, 17 aa, Entamoeba histolytica
IGEALTFEKEKTAEEKA

SEQ ID NO: 2679275 - protein, 17 aa, Entamoeba histolytica
IGEEINEEFSFISTFQY

SEQ ID NO: 2679276 - protein, 23 aa, Entamoeba histolytica
IGEELPDLVAPIIGNICSQLLSS

SEQ ID NO: 2679277 - protein, 17 aa, Entamoeba histolytica
IGEEMLKVLGWSEGKGA

SEQ ID NO: 2679278 - protein, 28 aa, Entamoeba histolytica
IGEGEDYYLIWFKRELFSSKGRLFNVPF

SEQ ID NO: 2679279 - protein, 21 aa, Entamoeba histolytica
IGEGWKYIFTLLSRIEQVLLT

SEQ ID NO: 2679280 - protein, 17 aa, Entamoeba histolytica
IGEINVSVCMRNKINPQ

SEQ ID NO: 2679281 - protein, 24 aa, Entamoeba histolytica
IGEIPLEFSNLMKRFNVIEVPSDI

SEQ ID NO: 2679282 - protein, 18 aa, Entamoeba histolytica
IGEKEWICSIQFISSISK

SEQ ID NO: 2679283 - protein, 20 aa, Entamoeba histolytica
IGEKGMFAAVIKKELASIRF

SEQ ID NO: 2679284 - protein, 20 aa, Entamoeba histolytica
IGELMKKYLDNFNVFTEYFS

SEQ ID NO: 2679285 - protein, 18 aa, Entamoeba histolytica
IGELQFSVDIKRNLVTVI

SEQ ID NO: 2679286 - protein, 23 aa, Entamoeba histolytica
IGELSMIGLDFAKRGVKRVSIMQ

SEQ ID NO: 2679287 - protein, 23 aa, Entamoeba histolytica
IGEMVGDIFGKIGRDGAVDIETG

SEQ ID NO: 2679288 - protein, 21 aa, Entamoeba histolytica
IGEWCKSYRGNVFKGNYLLEK

SEQ ID NO: 2679289 - protein, 17 aa, Entamoeba histolytica
IGFDVMDGCILDKRNKV

SEQ ID NO: 2679290 - protein, 22 aa, Entamoeba histolytica
IGFIKDVFREMVLLPSQIEVTT

SEQ ID NO: 2679291 - protein, 24 aa, Entamoeba histolytica
IGFLKGAGIGLIPGYGLYQGIRGW

SEQ ID NO: 2679292 - protein, 19 aa, Entamoeba histolytica
IGFNKTGSFCDFNGIPAID

SEQ ID NO: 2679293 - protein, 22 aa, Entamoeba histolytica
IGFSEVRPIIVLKPVSIDENKI

SEQ ID NO: 2679294 - protein, 18 aa, Entamoeba histolytica
IGFSKCLPYLCRKEEYIN

SEQ ID NO: 2679295 - protein, 24 aa, Entamoeba histolytica
IGGCKSTYGTGCFVVKNIGDTIKE

SEQ ID NO: 2679296 - protein, 21 aa, Entamoeba histolytica
IGGELSLDAGALVLADGGVCC

SEQ ID NO: 2679297 - protein, 17 aa, Entamoeba histolytica
IGGEWCFIPPNTIIEQI

SEQ ID NO: 2679298 - protein, 20 aa, Entamoeba histolytica
IGGIERYHGPGIVLGTSKII

SEQ ID NO: 2679299 - protein, 24 aa, Entamoeba histolytica
IGGLGSGCGHGIFEYLKVMIIDEV

SEQ ID NO: 2679300 - protein, 17 aa, Entamoeba histolytica
IGGNPWNPGADSFSKLT

SEQ ID NO: 2679301 - protein, 17 aa, Entamoeba histolytica
IGGSCFSECYSLTSLNI

SEQ ID NO: 2679302 - protein, 25 aa, Entamoeba histolytica
IGGSSDFKQALLVAKLALANRVDKI

SEQ ID NO: 2679303 - protein, 21 aa, Entamoeba histolytica
IGGYFIINGIERYLRMIVYAK

SEQ ID NO: 2679304 - protein, 18 aa, Entamoeba histolytica
IGHIKWTIEQEGKKVYCG

SEQ ID NO: 2679305 - protein, 18 aa, Entamoeba histolytica
IGHWKLILNNFKFDDRSC

SEQ ID NO: 2679306 - protein, 21 aa, Entamoeba histolytica
IGIEHKICYGPYKTGIRNSGN

SEQ ID NO: 2679307 - protein, 17 aa, Entamoeba histolytica
IGIGGIIPLLSNNLSDG

SEQ ID NO: 2679308 - protein, 18 aa, Entamoeba histolytica
IGIGHDFFIDSHQYQPPK

SEQ ID NO: 2679309 - protein, 23 aa, Entamoeba histolytica
IGIIKRLFDFYGTDNLVDTCTDH

SEQ ID NO: 2679310 - protein, 19 aa, Entamoeba histolytica
IGIIPMNEIICGRTKIDTI

SEQ ID NO: 2679311 - protein, 20 aa, Entamoeba histolytica
IGIITRIKREGVFNLTPADF

SEQ ID NO: 2679312 - protein, 17 aa, Entamoeba histolytica
IGIKTWELRVMKIQDTS

SEQ ID NO: 2679313 - protein, 29 aa, Entamoeba histolytica
IGIPNKLGYRLIQIAIRYEDYVLRGTDKT

SEQ ID NO: 2679314 - protein, 25 aa, Entamoeba histolytica
IGIPYYFNKEMHLFSMGICHEEYEE

SEQ ID NO: 2679315 - protein, 22 aa, Entamoeba histolytica
IGIRRWLLVDSLLRAKSRTKEE

SEQ ID NO: 2679316 - protein, 19 aa, Entamoeba histolytica
IGISPDWKTNIEGIDIDKC

SEQ ID NO: 2679317 - protein, 23 aa, Entamoeba histolytica
IGIYAYELFNFYGVKRIIRIGSA

SEQ ID NO: 2679318 - protein, 21 aa, Entamoeba histolytica
IGKACFLGCSGIVNVNVKGRV

SEQ ID NO: 2679319 - protein, 22 aa, Entamoeba histolytica
IGKECYCNSPSLSIFEVPYSIV

SEQ ID NO: 2679320 - protein, 22 aa, Entamoeba histolytica
IGKEEYKGIIDILRKYLRKTNE

SEQ ID NO: 2679321 - protein, 21 aa, Entamoeba histolytica
IGKGCFNRCYSLRSIEIPSTI

SEQ ID NO: 2679322 - protein, 26 aa, Entamoeba histolytica
IGKIKEIIQCLGMKEWQKVLNWLTRN

SEQ ID NO: 2679323 - protein, 25 aa, Entamoeba histolytica
IGKKGKELCKGYVDLAHYADLNGVG

SEQ ID NO: 2679324 - protein, 22 aa, Entamoeba histolytica
IGKRVLSAFGDNVFNTRINVII

SEQ ID NO: 2679325 - protein, 17 aa, Entamoeba histolytica
IGKWEQQKVLSFIPPDG

SEQ ID NO: 2679326 - protein, 19 aa, Entamoeba histolytica
IGLCEKIWRDGGCQAAPNG

SEQ ID NO: 2679327 - protein, 23 aa, Entamoeba histolytica
IGLDECMNRLNLKNNILMRKTEC

SEQ ID NO: 2679328 - protein, 19 aa, Entamoeba histolytica
IGLELPIPLILNTSKIYHM

SEQ ID NO: 2679329 - protein, 19 aa, Entamoeba histolytica
IGLEPVLPSEFHMMRAVLC

SEQ ID NO: 2679330 - protein, 19 aa, Entamoeba histolytica
IGLIKEYWDGNILGEACAF

SEQ ID NO: 2679331 - protein, 20 aa, Entamoeba histolytica
IGLINRYAKIILKRRTVKAT

SEQ ID NO: 2679332 - protein, 17 aa, Entamoeba histolytica
IGLKKALKIVGSCKTIK

SEQ ID NO: 2679333 - protein, 23 aa, Entamoeba histolytica
IGLLDCTKNWFGNYQVLYTHQTP

SEQ ID NO: 2679334 - protein, 18 aa, Entamoeba histolytica
IGLNFPIVSTTWFQTYIR

SEQ ID NO: 2679335 - protein, 23 aa, Entamoeba histolytica
IGLRGHGGIAIRPVPQPMSRGQV

SEQ ID NO: 2679336 - protein, 22 aa, Entamoeba histolytica
IGLTRFEGFLNVLKQGYSSFII

SEQ ID NO: 2679337 - protein, 25 aa, Entamoeba histolytica
IGMDRGEMYFINWNKKYTTWIDPRS

SEQ ID NO: 2679338 - protein, 23 aa, Entamoeba histolytica
IGMHINVVWIHRSGWAIGIDERG

SEQ ID NO: 2679339 - protein, 19 aa, Entamoeba histolytica
IGMSLKYIAISGISVSIAI

SEQ ID NO: 2679340 - protein, 26 aa, Entamoeba histolytica
IGNCEGCFPVMLLVESCRKQKLSISG

SEQ ID NO: 2679341 - protein, 18 aa, Entamoeba histolytica
IGNCLSCGRIHCSEEGPG

SEQ ID NO: 2679342 - protein, 19 aa, Entamoeba histolytica
IGNDFIMQIMIQDGGVFFV

SEQ ID NO: 2679343 - protein, 27 aa, Entamoeba histolytica
IGNEIRFILRILKGVFRIGFTDRSLPP

SEQ ID NO: 2679344 - protein, 18 aa, Entamoeba histolytica
IGNELGMSLDFAENESGQ

SEQ ID NO: 2679345 - protein, 24 aa, Entamoeba histolytica
IGNFKIGLMHGHQVIPWGDREALA

SEQ ID NO: 2679346 - protein, 20 aa, Entamoeba histolytica
IGNGCCKLVIGKEGTKNSYS

SEQ ID NO: 2679347 - protein, 19 aa, Entamoeba histolytica
IGNIFNGIHYIEFLVELIS

SEQ ID NO: 2679348 - protein, 19 aa, Entamoeba histolytica
IGNKISGWVRIRSKTQSLA

SEQ ID NO: 2679349 - protein, 26 aa, Entamoeba histolytica
IGNNFKCVIEKAISLTVYLVYIPEKN

SEQ ID NO: 2679350 - protein, 22 aa, Entamoeba histolytica
IGNQVLRFYRRIVRDYLTRNYT

SEQ ID NO: 2679351 - protein, 17 aa, Entamoeba histolytica
IGNRTIGKVVITIPVSF

SEQ ID NO: 2679352 - protein, 21 aa, Entamoeba histolytica
IGNSCFEKCLSLKSLIIPDCI

SEQ ID NO: 2679353 - protein, 25 aa, Entamoeba histolytica
IGNSCILMICLDSFIVKKGNEIELS

SEQ ID NO: 2679354 - protein, 22 aa, Entamoeba histolytica
IGNSLVNFFGLVPYCKKTKIIT

SEQ ID NO: 2679355 - protein, 20 aa, Entamoeba histolytica
IGPMGYWPDAVCRPQEKQKA

SEQ ID NO: 2679356 - protein, 24 aa, Entamoeba histolytica
IGPTEIDYLWAYMAGKLPSGGDME

SEQ ID NO: 2679357 - protein, 23 aa, Entamoeba histolytica
IGQCLKEVYCLLEQSNIPIDSQS

SEQ ID NO: 2679358 - protein, 17 aa, Entamoeba histolytica
IGQEFKETEVLSFQTLD

SEQ ID NO: 2679359 - protein, 21 aa, Entamoeba histolytica
IGQEVKLGRRINMIMQTVFFK

SEQ ID NO: 2679360 - protein, 17 aa, Entamoeba histolytica
IGQEVVKIFSSVPNNTT

SEQ ID NO: 2679361 - protein, 18 aa, Entamoeba histolytica
IGQLLKVRIISFDKQLLL

SEQ ID NO: 2679362 - protein, 22 aa, Entamoeba histolytica
IGRRKEALEAFKKGGKNLWCKK

SEQ ID NO: 2679363 - protein, 17 aa, Entamoeba histolytica
IGRRSFKNQNVFGSNTA

SEQ ID NO: 2679364 - protein, 28 aa, Entamoeba histolytica
IGRTKDQRVCLVKTLYRPVPLEHYVFCK

SEQ ID NO: 2679365 - protein, 17 aa, Entamoeba histolytica
IGSDVYFGGLYFNMNLM

SEQ ID NO: 2679366 - protein, 17 aa, Entamoeba histolytica
IGSEFVKNIQFLKMEAT

SEQ ID NO: 2679367 - protein, 25 aa, Entamoeba histolytica
IGSEYLRPYMHGYFMHIKLYQRAMA

SEQ ID NO: 2679368 - protein, 27 aa, Entamoeba histolytica
IGSFERINGLILIRFIEEISHSKCKFP

SEQ ID NO: 2679369 - protein, 18 aa, Entamoeba histolytica
IGSIISFIGIDCPEYVNN

SEQ ID NO: 2679370 - protein, 22 aa, Entamoeba histolytica
IGSKVFDFTTSFIIPNEDDARN

SEQ ID NO: 2679371 - protein, 23 aa, Entamoeba histolytica
IGSYCYAELDFLAFENATKKSKP

SEQ ID NO: 2679372 - protein, 26 aa, Entamoeba histolytica
IGTEYCKYLKYADSLYRCKQLKRAAL

SEQ ID NO: 2679373 - protein, 24 aa, Entamoeba histolytica
IGTGRIIVLNGMMLISGRESSIVN

SEQ ID NO: 2679374 - protein, 17 aa, Entamoeba histolytica
IGTSFTFKCHGKFDKGS

SEQ ID NO: 2679375 - protein, 21 aa, Entamoeba histolytica
IGVAKIVVEIGGLLLGLEKQQ

SEQ ID NO: 2679376 - protein, 17 aa, Entamoeba histolytica
IGVDLLNSLIFPNVSID

SEQ ID NO: 2679377 - protein, 17 aa, Entamoeba histolytica
IGVLGFPLLVAIRKSGW

SEQ ID NO: 2679378 - protein, 19 aa, Entamoeba histolytica
IGYDGSVTYSDWEVIKTKD

SEQ ID NO: 2679379 - protein, 18 aa, Entamoeba histolytica
IGYDGSVTYSEWELIKIK

SEQ ID NO: 2679380 - protein, 19 aa, Entamoeba histolytica
IGYDIVICIHSNFIQINDQ

SEQ ID NO: 2679381 - protein, 18 aa, Entamoeba histolytica
IGYECFNECYSLKSINIE

SEQ ID NO: 2679382 - protein, 19 aa, Entamoeba histolytica
IGYEFSDELIKIFQEKVHL

SEQ ID NO: 2679383 - protein, 19 aa, Entamoeba histolytica
IGYSRGFAFIEFATPQEAE

SEQ ID NO: 2679384 - protein, 17 aa, Entamoeba histolytica
IGYWCFCESKSLQSINI

SEQ ID NO: 2679385 - protein, 18 aa, Entamoeba histolytica
IGYYCFFQCTSLTTINIP

SEQ ID NO: 2679386 - protein, 24 aa, Entamoeba histolytica
IHAEKMKFCLWKKLKDNEHITQKY

SEQ ID NO: 2679387 - protein, 17 aa, Entamoeba histolytica
IHAMTFIDFVEQYYPND

SEQ ID NO: 2679388 - protein, 21 aa, Entamoeba histolytica
IHATIPFKLETKYVIENIKLL

SEQ ID NO: 2679389 - protein, 26 aa, Entamoeba histolytica
IHCCCHCPICMKGTFFQTKNPKMKTT

SEQ ID NO: 2679390 - protein, 26 aa, Entamoeba histolytica
IHCNDFRLTPMWKYLTQLQIKEQFEQ

SEQ ID NO: 2679391 - protein, 26 aa, Entamoeba histolytica
IHCNDFRLTPMWNYLTQLQIKEQFEQ

SEQ ID NO: 2679392 - protein, 24 aa, Entamoeba histolytica
IHERDNIELLIGFMKRNKVDVRIV

SEQ ID NO: 2679393 - protein, 17 aa, Entamoeba histolytica
IHEYKRQSLAILGTIAQ

SEQ ID NO: 2679394 - protein, 17 aa, Entamoeba histolytica
IHFDLHHKSFRNIYEYV

SEQ ID NO: 2679395 - protein, 18 aa, Entamoeba histolytica
IHGAINIWNEQLLNEHFP

SEQ ID NO: 2679396 - protein, 26 aa, Entamoeba histolytica
IHGCEKPILRRVCVNLKEECEKYSEW

SEQ ID NO: 2679397 - protein, 19 aa, Entamoeba histolytica
IHGDLKPGNILKEKDTMKI

SEQ ID NO: 2679398 - protein, 23 aa, Entamoeba histolytica
IHGVKLILGLLYTLYRKYRLSVL

SEQ ID NO: 2679399 - protein, 17 aa, Entamoeba histolytica
IHHPHLVKKLSLHHKGS

SEQ ID NO: 2679400 - protein, 18 aa, Entamoeba histolytica
IHHYFPKRLKVIKKLIPL

SEQ ID NO: 2679401 - protein, 19 aa, Entamoeba histolytica
IHIELWKDNELELILSITS

SEQ ID NO: 2679402 - protein, 19 aa, Entamoeba histolytica
IHIMYPVSSVYFIGDIKTP

SEQ ID NO: 2679403 - protein, 19 aa, Entamoeba histolytica
IHINKGLMCIIDLIEHKEN

SEQ ID NO: 2679404 - protein, 17 aa, Entamoeba histolytica
IHIQIIFQTGAPAPGMV

SEQ ID NO: 2679405 - protein, 17 aa, Entamoeba histolytica
IHKDSFSYYSIKEIHIP

SEQ ID NO: 2679406 - protein, 33 aa, Entamoeba histolytica
IHKGQELVKVLLFYQLCSFCLKCFYKELTSATL

SEQ ID NO: 2679407 - protein, 25 aa, Entamoeba histolytica
IHKRNFLYQNVFDWFDEIIPDKKLI

SEQ ID NO: 2679408 - protein, 18 aa, Entamoeba histolytica
IHKSISFFKECTGKSSYK

SEQ ID NO: 2679409 - protein, 23 aa, Entamoeba histolytica
IHKTDCMYCPVSIGTQNNDKLYI

SEQ ID NO: 2679410 - protein, 24 aa, Entamoeba histolytica
IHKTLPIILPIILRTIDCSIIEQY

SEQ ID NO: 2679411 - protein, 18 aa, Entamoeba histolytica
IHLEELQQFLPLEEKQER

SEQ ID NO: 2679412 - protein, 17 aa, Entamoeba histolytica
IHLFVLILNYFMIHFTT

SEQ ID NO: 2679413 - protein, 18 aa, Entamoeba histolytica
IHLKEFITYLNVFCEGDD

SEQ ID NO: 2679414 - protein, 17 aa, Entamoeba histolytica
IHLKIQFFNEIFQKYPN

SEQ ID NO: 2679415 - protein, 17 aa, Entamoeba histolytica
IHLKKEFIEEKVEEGIK

SEQ ID NO: 2679416 - protein, 17 aa, Entamoeba histolytica
IHLKVTKTLLLFDETFR

SEQ ID NO: 2679417 - protein, 19 aa, Entamoeba histolytica
IHLLQWPYWSCIKCLEMKN

SEQ ID NO: 2679418 - protein, 17 aa, Entamoeba histolytica
IHLLRLSSFHDKFYCNE

SEQ ID NO: 2679419 - protein, 18 aa, Entamoeba histolytica
IHLLRLSSFHDKFYCNES

SEQ ID NO: 2679420 - protein, 20 aa, Entamoeba histolytica
IHLPLSIPKEQKVIFEDNSD

SEQ ID NO: 2679421 - protein, 24 aa, Entamoeba histolytica
IHLSEGVIHLGIRSFKNCYSLSNI

SEQ ID NO: 2679422 - protein, 18 aa, Entamoeba histolytica
IHNKRLTDRFDITEKGFN

SEQ ID NO: 2679423 - protein, 18 aa, Entamoeba histolytica
IHQKCIMKLKVLLKQTQQ

SEQ ID NO: 2679424 - protein, 23 aa, Entamoeba histolytica
IHRDLKLANIFIHNMNVKIGDFG

SEQ ID NO: 2679425 - protein, 25 aa, Entamoeba histolytica
IHRFTKPIYCYSILEGSQFQLNSKF

SEQ ID NO: 2679426 - protein, 24 aa, Entamoeba histolytica
IHSELLLRAFRVIFDATLLLNIHE

SEQ ID NO: 2679427 - protein, 18 aa, Entamoeba histolytica
IHSLHCFELPLKRMQEGL

SEQ ID NO: 2679428 - protein, 20 aa, Entamoeba histolytica
IHSLLIKPTFDWINEAVQRD

SEQ ID NO: 2679429 - protein, 18 aa, Entamoeba histolytica
IHSLPDTIQFCFIEHCEV

SEQ ID NO: 2679430 - protein, 18 aa, Entamoeba histolytica
IHSLQLIKFIPIPNNSNE

SEQ ID NO: 2679431 - protein, 17 aa, Entamoeba histolytica
IHSRFINCGRFSPDGSL

SEQ ID NO: 2679432 - protein, 18 aa, Entamoeba histolytica
IHSYKYPPIRPLNPILAD

SEQ ID NO: 2679433 - protein, 26 aa, Entamoeba histolytica
IHTCPQRIGIMLSFFLEALTRNDKVS

SEQ ID NO: 2679434 - protein, 18 aa, Entamoeba histolytica
IHTIKMLIVEEIKYRPTG

SEQ ID NO: 2679435 - protein, 17 aa, Entamoeba histolytica
IHVAGEINELCNILVDV

SEQ ID NO: 2679436 - protein, 17 aa, Entamoeba histolytica
IHVDFSQSIGKYGVQYD

SEQ ID NO: 2679437 - protein, 23 aa, Entamoeba histolytica
IHVFPFCLQFDVMDKFIRGGRKF

SEQ ID NO: 2679438 - protein, 17 aa, Entamoeba histolytica
IHVKFLQMWQSLLEHPE

SEQ ID NO: 2679439 - protein, 18 aa, Entamoeba histolytica
IHYAALFGNEAVIRVLIK

SEQ ID NO: 2679440 - protein, 25 aa, Entamoeba histolytica
IHYFVFCYELPYSTAIRLKEKLVTC

SEQ ID NO: 2679441 - protein, 19 aa, Entamoeba histolytica
IHYHFNIIISPFFPPYPLH

SEQ ID NO: 2679442 - protein, 17 aa, Entamoeba histolytica
IHYPCYLEFMKTRPNDH

SEQ ID NO: 2679443 - protein, 22 aa, Entamoeba histolytica
IHYSPIPMRAFEFNEEEDDEYC

SEQ ID NO: 2679444 - protein, 20 aa, Entamoeba histolytica
IIAAEPYQSIAFKIPNMEVE

SEQ ID NO: 2679445 - protein, 18 aa, Entamoeba histolytica
IIACVARLREEEMICLEE

SEQ ID NO: 2679446 - protein, 24 aa, Entamoeba histolytica
IIADGYRTGLKFFNEHCEELVLST

SEQ ID NO: 2679447 - protein, 22 aa, Entamoeba histolytica
IIAELLTGQILFRGMTTSDQLV

SEQ ID NO: 2679448 - protein, 19 aa, Entamoeba histolytica
IIAIALRIDSLAQQYTDQY

SEQ ID NO: 2679449 - protein, 18 aa, Entamoeba histolytica
IIAICLKANVDEKVTQLY

SEQ ID NO: 2679450 - protein, 24 aa, Entamoeba histolytica
IIAKLLRSSFDWLKSIKDSQVDQK

SEQ ID NO: 2679451 - protein, 18 aa, Entamoeba histolytica
IIAPGEAEAQCYQLEHDG

SEQ ID NO: 2679452 - protein, 22 aa, Entamoeba histolytica
IIARNIFTEWIKRENIENETFH

SEQ ID NO: 2679453 - protein, 25 aa, Entamoeba histolytica
IIASGGHSLFNWSFASHTTLPFHKT

SEQ ID NO: 2679454 - protein, 20 aa, Entamoeba histolytica
IICAEVNWDKKLIVTGSEDN

SEQ ID NO: 2679455 - protein, 17 aa, Entamoeba histolytica
IICENLVNDSTNLPKEL

SEQ ID NO: 2679456 - protein, 19 aa, Entamoeba histolytica
IICFSIDSRSSFGNISQRW

SEQ ID NO: 2679457 - protein, 21 aa, Entamoeba histolytica
IICSCCKKPVQQFELVECPFC

SEQ ID NO: 2679458 - protein, 23 aa, Entamoeba histolytica
IIDCKNYPTGFSYFMHKVSIELH

SEQ ID NO: 2679459 - protein, 18 aa, Entamoeba histolytica
IIDDFPFDNIEIALNQYI

SEQ ID NO: 2679460 - protein, 18 aa, Entamoeba histolytica
IIDGMRWVVPYLYWFEVM

SEQ ID NO: 2679461 - protein, 29 aa, Entamoeba histolytica
IIDGSLQLCKMCFEIAFQSIHIVLLSDFL

SEQ ID NO: 2679462 - protein, 24 aa, Entamoeba histolytica
IIDGTNLFTDWRKVLISNLERGEY

SEQ ID NO: 2679463 - protein, 20 aa, Entamoeba histolytica
IIDIIACPFNDNLIFSSSQD

SEQ ID NO: 2679464 - protein, 18 aa, Entamoeba histolytica
IIDIPFFLKEDQIKQADN

SEQ ID NO: 2679465 - protein, 24 aa, Entamoeba histolytica
IIDKNGFHYSDFISFKEKLTSFKR

SEQ ID NO: 2679466 - protein, 19 aa, Entamoeba histolytica
IIDNGKWKEKKEVIEKITE

SEQ ID NO: 2679467 - protein, 18 aa, Entamoeba histolytica
IIDSFKNRMSILPLSSSS

SEQ ID NO: 2679468 - protein, 17 aa, Entamoeba histolytica
IIDSVLFTEELKTYFVN

SEQ ID NO: 2679469 - protein, 26 aa, Entamoeba histolytica
IIEAFPNLRLVGISAYANLFESCEKL

SEQ ID NO: 2679470 - protein, 17 aa, Entamoeba histolytica
IIEEIKQRGFRLPQPGD

SEQ ID NO: 2679471 - protein, 18 aa, Entamoeba histolytica
IIEEVKIRGKSTREASKQ

SEQ ID NO: 2679472 - protein, 24 aa, Entamoeba histolytica
IIEGIKCLDSIIVHEGQRRRQYTI

SEQ ID NO: 2679473 - protein, 25 aa, Entamoeba histolytica
IIEGRKVNMFWSLRDYKLRTQSETN

SEQ ID NO: 2679474 - protein, 25 aa, Entamoeba histolytica
IIEKEIYSIISIIWERGINDCTNKN

SEQ ID NO: 2679475 - protein, 25 aa, Entamoeba histolytica
IIEKGICITTAFYKENESILEYIKK

SEQ ID NO: 2679476 - protein, 24 aa, Entamoeba histolytica
IIEKSFFHKFYEPLKEWTSKQTFK

SEQ ID NO: 2679477 - protein, 25 aa, Entamoeba histolytica
IIERHPREAIEVFCEIDKIMTEKER

SEQ ID NO: 2679478 - protein, 24 aa, Entamoeba histolytica
IIEVFSRMNFSYVLLSKRNLNTFV

SEQ ID NO: 2679479 - protein, 20 aa, Entamoeba histolytica
IIEYVKHSYILVESSSLNIS

SEQ ID NO: 2679480 - protein, 22 aa, Entamoeba histolytica
IIFCNELKPAGFYKEKLKLQKC

SEQ ID NO: 2679481 - protein, 25 aa, Entamoeba histolytica
IIFDECARKLFNMSADEMNVLDEDD

SEQ ID NO: 2679482 - protein, 27 aa, Entamoeba histolytica
IIFEKRYKPVINQECWGFINCLCNNED

SEQ ID NO: 2679483 - protein, 19 aa, Entamoeba histolytica
IIFFQCTFAKKTFVKANSI

SEQ ID NO: 2679484 - protein, 18 aa, Entamoeba histolytica
IIFKEWFPSNKIVLSDIK

SEQ ID NO: 2679485 - protein, 34 aa, Entamoeba histolytica
IIFKQNRWFPKYSIYPVDEITIFFNYAQIDVNYL

SEQ ID NO: 2679486 - protein, 17 aa, Entamoeba histolytica
IIFKTIIKLFKIANDDC

SEQ ID NO: 2679487 - protein, 18 aa, Entamoeba histolytica
IIFLRSISNYFLRCTEDS

SEQ ID NO: 2679488 - protein, 24 aa, Entamoeba histolytica
IIFNGSKKAFGFVFHSLTIEGKWL

SEQ ID NO: 2679489 - protein, 25 aa, Entamoeba histolytica
IIFPFSSKNKYGFIAYVNRINITGK

SEQ ID NO: 2679490 - protein, 25 aa, Entamoeba histolytica
IIFPTCLRILITAIQNRMYVHTRLC

SEQ ID NO: 2679491 - protein, 26 aa, Entamoeba histolytica
IIFTMWCVLMGLKIMNIYDLVHLDVK

SEQ ID NO: 2679492 - protein, 27 aa, Entamoeba histolytica
IIFYEYQCGLAMMLFTMIGRNELFRYR

SEQ ID NO: 2679493 - protein, 17 aa, Entamoeba histolytica
IIGDSGVGKTCISSRLV

SEQ ID NO: 2679494 - protein, 21 aa, Entamoeba histolytica
IIGINRYVHYIGMEESLETLY

SEQ ID NO: 2679495 - protein, 26 aa, Entamoeba histolytica
IIGKGEFPIPVMYVIDGNGNYRSVTL

SEQ ID NO: 2679496 - protein, 23 aa, Entamoeba histolytica
IIGMCKIFDIWADGKVSRLESIK

SEQ ID NO: 2679497 - protein, 17 aa, Entamoeba histolytica
IIHDIFPLYEFWEHVCV

SEQ ID NO: 2679498 - protein, 17 aa, Entamoeba histolytica
IIHKPMLLETIQQVLEQ

SEQ ID NO: 2679499 - protein, 21 aa, Entamoeba histolytica
IIHLKRFGNSNGYSRDKITTF

SEQ ID NO: 2679500 - protein, 24 aa, Entamoeba histolytica
IIHLPELIENISFNTKQLYYEFDQ

SEQ ID NO: 2679501 - protein, 20 aa, Entamoeba histolytica
IIHLPPKFVDFALTPFGCII

SEQ ID NO: 2679502 - protein, 24 aa, Entamoeba histolytica
IIHLVSRSDLFGLLTSLSILLDSQ

SEQ ID NO: 2679503 - protein, 18 aa, Entamoeba histolytica
IIHRDIQNSWIFGVGYGF

SEQ ID NO: 2679504 - protein, 22 aa, Entamoeba histolytica
IIHRLASNYVHGLFHVKFWIIL

SEQ ID NO: 2679505 - protein, 25 aa, Entamoeba histolytica
IIHYPKLLPVIINFMSLKICPLDLF

SEQ ID NO: 2679506 - protein, 23 aa, Entamoeba histolytica
IIIAFGGYKLKSGDMPLQKIAEI

SEQ ID NO: 2679507 - protein, 21 aa, Entamoeba histolytica
IIICDFAWVVLNQVDAIADFV

SEQ ID NO: 2679508 - protein, 17 aa, Entamoeba histolytica
IIIDLVMLIKTNALPMK

SEQ ID NO: 2679509 - protein, 17 aa, Entamoeba histolytica
IIIKEIGRVLVLNQKNL

SEQ ID NO: 2679510 - protein, 20 aa, Entamoeba histolytica
IIINEILALKCIDIETRTVK

SEQ ID NO: 2679511 - protein, 21 aa, Entamoeba histolytica
IIINEILALKCIDVKTRTPKA

SEQ ID NO: 2679512 - protein, 18 aa, Entamoeba histolytica
IIIRCMRDDITTLTNTLH

SEQ ID NO: 2679513 - protein, 18 aa, Entamoeba histolytica
IIISRASMNPEITVGDKE

SEQ ID NO: 2679514 - protein, 24 aa, Entamoeba histolytica
IIKALKLLFPPSFNKDQTDKEKAF

SEQ ID NO: 2679515 - protein, 19 aa, Entamoeba histolytica
IIKDNRFGPSDMKVAEKIF

SEQ ID NO: 2679516 - protein, 17 aa, Entamoeba histolytica
IIKELKIIDKETYIEIQ

SEQ ID NO: 2679517 - protein, 27 aa, Entamoeba histolytica
IIKEMFPELLQRILLANKISFEKSKEG

SEQ ID NO: 2679518 - protein, 25 aa, Entamoeba histolytica
IIKESIPIHLTVVFHFIGLDHKENK

SEQ ID NO: 2679519 - protein, 18 aa, Entamoeba histolytica
IIKGIRKENKYIKFISEI

SEQ ID NO: 2679520 - protein, 21 aa, Entamoeba histolytica
IIKHYAEKSIDAYIYSLTKMH

SEQ ID NO: 2679521 - protein, 24 aa, Entamoeba histolytica
IIKIEGQCPCGYKHQIGNQIYDMV

SEQ ID NO: 2679522 - protein, 20 aa, Entamoeba histolytica
IIKIKGIGIASGIEAFCKQK

SEQ ID NO: 2679523 - protein, 21 aa, Entamoeba histolytica
IIKKRILKRVGYLSELIGDIV

SEQ ID NO: 2679524 - protein, 21 aa, Entamoeba histolytica
IIKKYKFGVIYVKDGQKEENE

SEQ ID NO: 2679525 - protein, 17 aa, Entamoeba histolytica
IIKLPTTIRTILTSDSE

SEQ ID NO: 2679526 - protein, 21 aa, Entamoeba histolytica
IIKMKVINYKAINLIISILML

SEQ ID NO: 2679527 - protein, 23 aa, Entamoeba histolytica
IIKNMRRRGYKAKEISILTDLTK

SEQ ID NO: 2679528 - protein, 21 aa, Entamoeba histolytica
IIKQKLETMVGLIDKKQVEFI

SEQ ID NO: 2679529 - protein, 22 aa, Entamoeba histolytica
IIKRLRRKPIGLMRGKTDILNI

SEQ ID NO: 2679530 - protein, 18 aa, Entamoeba histolytica
IIKRNWKPLPGYIKQESS

SEQ ID NO: 2679531 - protein, 23 aa, Entamoeba histolytica
IIKSFSIPTSFFIYLSNKLPIEK

SEQ ID NO: 2679532 - protein, 18 aa, Entamoeba histolytica
IIKTIGLITKTDFCNVEN

SEQ ID NO: 2679533 - protein, 23 aa, Entamoeba histolytica
IIKVKTVQGYYRYKQQEQDDSEL

SEQ ID NO: 2679534 - protein, 18 aa, Entamoeba histolytica
IILDCKDRVKGFYEKCGM

SEQ ID NO: 2679535 - protein, 28 aa, Entamoeba histolytica
IILEKRSLIPPSYCKKLVNVLKDLEKQR

SEQ ID NO: 2679536 - protein, 26 aa, Entamoeba histolytica
IILFDILKNPVHFFKGTMGQYEPKEE

SEQ ID NO: 2679537 - protein, 25 aa, Entamoeba histolytica
IILFTFKSHLLKSVRIITTPSTDHS

SEQ ID NO: 2679538 - protein, 26 aa, Entamoeba histolytica
IILFTFKSHLLKSVRIITTPSTDHSL

SEQ ID NO: 2679539 - protein, 22 aa, Entamoeba histolytica
IILHILNYLLLWNKINNETNNS

SEQ ID NO: 2679540 - protein, 19 aa, Entamoeba histolytica
IILKSVEKIGVLKTTEALQ

SEQ ID NO: 2679541 - protein, 21 aa, Entamoeba histolytica
IILKWLQDILNLYEIDLSTTN

SEQ ID NO: 2679542 - protein, 29 aa, Entamoeba histolytica
IILLFRRDFPHMACVRLWDAIFAYPENKL

SEQ ID NO: 2679543 - protein, 23 aa, Entamoeba histolytica
IILNCTLLSFAKMLELEKYDLPE

SEQ ID NO: 2679544 - protein, 17 aa, Entamoeba histolytica
IILRHIFDIRWWPNDSL

SEQ ID NO: 2679545 - protein, 20 aa, Entamoeba histolytica
IILVIPRFVQKTLTCLEQIV

SEQ ID NO: 2679546 - protein, 20 aa, Entamoeba histolytica
IILYECPHIVRGIPLSKKKE

SEQ ID NO: 2679547 - protein, 18 aa, Entamoeba histolytica
IIMFKDIKSVDILRMNAS

SEQ ID NO: 2679548 - protein, 17 aa, Entamoeba histolytica
IIMHCFNKRFLSSGNEV

SEQ ID NO: 2679549 - protein, 27 aa, Entamoeba histolytica
IIMKLESCLHPYTFIRGYLTISLIGII

SEQ ID NO: 2679550 - protein, 19 aa, Entamoeba histolytica
IIMNIAVGILQEYTNYTVM

SEQ ID NO: 2679551 - protein, 24 aa, Entamoeba histolytica
IIMRGKMIYKMVVEYKGKKIIFKD

SEQ ID NO: 2679552 - protein, 28 aa, Entamoeba histolytica
IIMVELLARRIIPNFVVHEGREEQTLSL

SEQ ID NO: 2679553 - protein, 18 aa, Entamoeba histolytica
IINAGIVLGGYDQMLKYM

SEQ ID NO: 2679554 - protein, 18 aa, Entamoeba histolytica
IINDIGFVEKQRFLKMCE

SEQ ID NO: 2679555 - protein, 18 aa, Entamoeba histolytica
IINDVLFSIVTLYLESTS

SEQ ID NO: 2679556 - protein, 17 aa, Entamoeba histolytica
IINEHLHLFKGDIPFVV

SEQ ID NO: 2679557 - protein, 24 aa, Entamoeba histolytica
IINEIAMAYSCMRTQLYTKEVRIL

SEQ ID NO: 2679558 - protein, 27 aa, Entamoeba histolytica
IINERYRLNIVFNLCKSQLIFKNNEGN

SEQ ID NO: 2679559 - protein, 17 aa, Entamoeba histolytica
IINGFVLQTTPSGSILE

SEQ ID NO: 2679560 - protein, 18 aa, Entamoeba histolytica
IINGVIFSKVRRILSGYA

SEQ ID NO: 2679561 - protein, 17 aa, Entamoeba histolytica
IINICIYLLRNISLNTQ

SEQ ID NO: 2679562 - protein, 18 aa, Entamoeba histolytica
IINIFKILFSQSYCEKFA

SEQ ID NO: 2679563 - protein, 34 aa, Entamoeba histolytica
IINIGKECSLTFIDYSPFCRIHMFDGIIDSKNSI

SEQ ID NO: 2679564 - protein, 18 aa, Entamoeba histolytica
IINIYFTRIHVITIQSFY

SEQ ID NO: 2679565 - protein, 18 aa, Entamoeba histolytica
IINKAKDSMQIGAIEKTK

SEQ ID NO: 2679566 - protein, 35 aa, Entamoeba histolytica
IINKEFKLLLNDSFSIPLLNFFNRKELTDISIGYN

SEQ ID NO: 2679567 - protein, 18 aa, Entamoeba histolytica
IINKYLLHQHPRVRNMAF

SEQ ID NO: 2679568 - protein, 32 aa, Entamoeba histolytica
IINNCCNCKYVAWCLNPPCGKSKSAHFASASK

SEQ ID NO: 2679569 - protein, 17 aa, Entamoeba histolytica
IINPILKDVIRLREKLT

SEQ ID NO: 2679570 - protein, 20 aa, Entamoeba histolytica
IINPLPFILSPIHLFNECST

SEQ ID NO: 2679571 - protein, 23 aa, Entamoeba histolytica
IINQPRIVFVVPPQFFTHHQITP

SEQ ID NO: 2679572 - protein, 18 aa, Entamoeba histolytica
IINQYLCELFVSSRITVK

SEQ ID NO: 2679573 - protein, 24 aa, Entamoeba histolytica
IINRKVFNGMKFKNDLFSAFIYSF

SEQ ID NO: 2679574 - protein, 19 aa, Entamoeba histolytica
IINRMSVTNFKLLEPKELS

SEQ ID NO: 2679575 - protein, 27 aa, Entamoeba histolytica
IINTAGWKSGFGLELLELELSLSRTMF

SEQ ID NO: 2679576 - protein, 28 aa, Entamoeba histolytica
IINVMSSVVWRWLLGCMASDFPLYTTIE

SEQ ID NO: 2679577 - protein, 18 aa, Entamoeba histolytica
IINYCNYPDPDIRTNATS

SEQ ID NO: 2679578 - protein, 19 aa, Entamoeba histolytica
IIPALRILGFFVNQRTAIV

SEQ ID NO: 2679579 - protein, 19 aa, Entamoeba histolytica
IIPCKSIKKEQLQMCFELV

SEQ ID NO: 2679580 - protein, 26 aa, Entamoeba histolytica
IIPCSLLKELFIRFQDEMNKKIQQKL

SEQ ID NO: 2679581 - protein, 17 aa, Entamoeba histolytica
IIPELKEVIPLLKTLGE

SEQ ID NO: 2679582 - protein, 17 aa, Entamoeba histolytica
IIPEPMNLHLLLNLVSS

SEQ ID NO: 2679583 - protein, 25 aa, Entamoeba histolytica
IIPIKTIELYKFFLHFETYVQYLPF

SEQ ID NO: 2679584 - protein, 20 aa, Entamoeba histolytica
IIPINNIIEIILFHEKEMKE

SEQ ID NO: 2679585 - protein, 23 aa, Entamoeba histolytica
IIPLCERVKIYLNYFVENNDESN

SEQ ID NO: 2679586 - protein, 21 aa, Entamoeba histolytica
IIPLFPNLQTFYVRRCPSRLY

SEQ ID NO: 2679587 - protein, 24 aa, Entamoeba histolytica
IIPLFPNLQTFYVRRCPSRLYKIT

SEQ ID NO: 2679588 - protein, 21 aa, Entamoeba histolytica
IIPLFPNLQTFYVRRCSERLY

SEQ ID NO: 2679589 - protein, 20 aa, Entamoeba histolytica
IIPPEILFSSIIKLMKLLLL

SEQ ID NO: 2679590 - protein, 33 aa, Entamoeba histolytica
IIPPHLKSLIIKNCKASIDISKCHLKKIIISNY

SEQ ID NO: 2679591 - protein, 22 aa, Entamoeba histolytica
IIPPTYPAIIPISSISSEMISD

SEQ ID NO: 2679592 - protein, 18 aa, Entamoeba histolytica
IIPQELLCKYFYSIQSIS

SEQ ID NO: 2679593 - protein, 18 aa, Entamoeba histolytica
IIPSCSFDSILNKAISIP

SEQ ID NO: 2679594 - protein, 21 aa, Entamoeba histolytica
IIPTRMDYQLSQVFEEAGIII

SEQ ID NO: 2679595 - protein, 22 aa, Entamoeba histolytica
IIPTRMDYQLSQVFEEVGIIIT

SEQ ID NO: 2679596 - protein, 17 aa, Entamoeba histolytica
IIQFCSFYEELLKKQEH

SEQ ID NO: 2679597 - protein, 25 aa, Entamoeba histolytica
IIQFCVNLRLLLGLTDSTAKPNKLP

SEQ ID NO: 2679598 - protein, 22 aa, Entamoeba histolytica
IIQFLSMMCSFDIFSDNETLPK

SEQ ID NO: 2679599 - protein, 19 aa, Entamoeba histolytica
IIQILTLLKDNLCSIYSLI

SEQ ID NO: 2679600 - protein, 18 aa, Entamoeba histolytica
IIQLILLILFKASNEINL

SEQ ID NO: 2679601 - protein, 22 aa, Entamoeba histolytica
IIQLLKLLSKWEFESLNEEEKN

SEQ ID NO: 2679602 - protein, 19 aa, Entamoeba histolytica
IIQNWLCTKISMNENQTIT

SEQ ID NO: 2679603 - protein, 19 aa, Entamoeba histolytica
IIQPIPWLQSNDINESLER

SEQ ID NO: 2679604 - protein, 17 aa, Entamoeba histolytica
IIQPRCRETSLTTLADY

SEQ ID NO: 2679605 - protein, 23 aa, Entamoeba histolytica
IIQQLKLLFPEVHYFIQNQFGIT

SEQ ID NO: 2679606 - protein, 18 aa, Entamoeba histolytica
IIQRVINIMGEIGPECNN

SEQ ID NO: 2679607 - protein, 28 aa, Entamoeba histolytica
IIQTLKGECKFTFKEMQTLNVKRDKLKL

SEQ ID NO: 2679608 - protein, 29 aa, Entamoeba histolytica
IIQTLKGECKFTFKEMQTLNVKRDKLKLK

SEQ ID NO: 2679609 - protein, 19 aa, Entamoeba histolytica
IIREVPKLINTVYHELKDV

SEQ ID NO: 2679610 - protein, 20 aa, Entamoeba histolytica
IIREVPKLINTVYHELKDVF

SEQ ID NO: 2679611 - protein, 27 aa, Entamoeba histolytica
IIRFFECGYELYGYCLVFELHIMNLNQ

SEQ ID NO: 2679612 - protein, 18 aa, Entamoeba histolytica
IIRHEHIANASPYVVKEF

SEQ ID NO: 2679613 - protein, 19 aa, Entamoeba histolytica
IIRHFSHLFNLTYCYASGY

SEQ ID NO: 2679614 - protein, 24 aa, Entamoeba histolytica
IIRHLKAAGIGLIPGYGQYQAIRM

SEQ ID NO: 2679615 - protein, 25 aa, Entamoeba histolytica
IIRHLKAAGIGLIPGYGQYQAIRMW

SEQ ID NO: 2679616 - protein, 23 aa, Entamoeba histolytica
IIRKDWRDSIFFFGSNKVMQVAL

SEQ ID NO: 2679617 - protein, 24 aa, Entamoeba histolytica
IIRKDWRDSIFFFGSNKVMQVALG

SEQ ID NO: 2679618 - protein, 18 aa, Entamoeba histolytica
IIRKGKTSLGHKMFELFQ

SEQ ID NO: 2679619 - protein, 18 aa, Entamoeba histolytica
IIRLNYLIICMLEDLIHF

SEQ ID NO: 2679620 - protein, 23 aa, Entamoeba histolytica
IIRNKLKEGMMMIDNLNIVYQRI

SEQ ID NO: 2679621 - protein, 19 aa, Entamoeba histolytica
IIRPIIPVRNSHPCSTGKV

SEQ ID NO: 2679622 - protein, 27 aa, Entamoeba histolytica
IIRRELSELKSLLVNAVEDIDHFLYYF

SEQ ID NO: 2679623 - protein, 21 aa, Entamoeba histolytica
IIRRLKGKRIQTIVHGPLMEQ

SEQ ID NO: 2679624 - protein, 27 aa, Entamoeba histolytica
IIRRTCFKYFFQLCFEDYIQVIDSTGI

SEQ ID NO: 2679625 - protein, 22 aa, Entamoeba histolytica
IIRSLTEIHILYGTKAMFMNPF

SEQ ID NO: 2679626 - protein, 23 aa, Entamoeba histolytica
IIRSYPGIHVMMIQRVAHILYMN

SEQ ID NO: 2679627 - protein, 17 aa, Entamoeba histolytica
IIRTRYGKQIFTMKMHD

SEQ ID NO: 2679628 - protein, 18 aa, Entamoeba histolytica
IIRYQLRIINNIQHKNQQ

SEQ ID NO: 2679629 - protein, 17 aa, Entamoeba histolytica
IISAISIDTGIENGIVI

SEQ ID NO: 2679630 - protein, 18 aa, Entamoeba histolytica
IISCGGLKGMVNDTNSTE

SEQ ID NO: 2679631 - protein, 17 aa, Entamoeba histolytica
IISCINLNITNLFDLSL

SEQ ID NO: 2679632 - protein, 19 aa, Entamoeba histolytica
IISCNGKKGFSLTPNDMNG

SEQ ID NO: 2679633 - protein, 25 aa, Entamoeba histolytica
IISDIPRFGSLIIEKMTASECGQSE

SEQ ID NO: 2679634 - protein, 25 aa, Entamoeba histolytica
IISDIPRFGSLIIERMTIAENGQIE

SEQ ID NO: 2679635 - protein, 19 aa, Entamoeba histolytica
IISEVRFNVDIFILESNEI

SEQ ID NO: 2679636 - protein, 29 aa, Entamoeba histolytica
IISFDCQRLGIKESVEFDVNYIPKFPTFN

SEQ ID NO: 2679637 - protein, 17 aa, Entamoeba histolytica
IISFKYDGKKTIKIIED

SEQ ID NO: 2679638 - protein, 24 aa, Entamoeba histolytica
IISHLEIEISLCIVIFDGYGNVIG

SEQ ID NO: 2679639 - protein, 17 aa, Entamoeba histolytica
IISHLRKFIEGNIPPIT

SEQ ID NO: 2679640 - protein, 22 aa, Entamoeba histolytica
IISILIKLENSMQIPMKDIETS

SEQ ID NO: 2679641 - protein, 17 aa, Entamoeba histolytica
IISKGYFDFLIDITIMQ

SEQ ID NO: 2679642 - protein, 29 aa, Entamoeba histolytica
IISKKQIKRICHFCATASRLRTMKFDPKG

SEQ ID NO: 2679643 - protein, 17 aa, Entamoeba histolytica
IISKRYEDKIQIIEKEN

SEQ ID NO: 2679644 - protein, 21 aa, Entamoeba histolytica
IISKYRFGVVYAGPGQSSENE

SEQ ID NO: 2679645 - protein, 19 aa, Entamoeba histolytica
IISLGDTKDGYWIEIGEGE

SEQ ID NO: 2679646 - protein, 18 aa, Entamoeba histolytica
IISNLPLNFIRLKHLLNT

SEQ ID NO: 2679647 - protein, 19 aa, Entamoeba histolytica
IISNMLLGIVLRLIDDNDS

SEQ ID NO: 2679648 - protein, 23 aa, Entamoeba histolytica
IISPEVIPPNIIVNFDNSYVYVE

SEQ ID NO: 2679649 - protein, 17 aa, Entamoeba histolytica
IISPGYRMLSTEHVVPP

SEQ ID NO: 2679650 - protein, 17 aa, Entamoeba histolytica
IISQCKEELVLKRMNDI

SEQ ID NO: 2679651 - protein, 24 aa, Entamoeba histolytica
IISQLYWLRHNLLATLGLSIGFSS

SEQ ID NO: 2679652 - protein, 18 aa, Entamoeba histolytica
IISSHPSFTLFSNILDFL

SEQ ID NO: 2679653 - protein, 21 aa, Entamoeba histolytica
IISSIPFKKLISYVGTTDEFL

SEQ ID NO: 2679654 - protein, 20 aa, Entamoeba histolytica
IISSMPQWIVDALEKRFTDI

SEQ ID NO: 2679655 - protein, 17 aa, Entamoeba histolytica
IITECLIENGILDLLNV

SEQ ID NO: 2679656 - protein, 20 aa, Entamoeba histolytica
IITHFKFGVIYVKPNQNDEN

SEQ ID NO: 2679657 - protein, 20 aa, Entamoeba histolytica
IITKHGYVFGSFNSLKLPIP

SEQ ID NO: 2679658 - protein, 24 aa, Entamoeba histolytica
IITLKRLKIGIGEDKQYFTVLQRL

SEQ ID NO: 2679659 - protein, 25 aa, Entamoeba histolytica
IITLKSIRNVCRFCDDNKVSINDVA

SEQ ID NO: 2679660 - protein, 24 aa, Entamoeba histolytica
IITPRFAVSCTRDLMKKLGQLAQE

SEQ ID NO: 2679661 - protein, 23 aa, Entamoeba histolytica
IITQFMCKKFPNAVREVRPALLN

SEQ ID NO: 2679662 - protein, 34 aa, Entamoeba histolytica
IITQQWRSLGVSFKRKYPTVILNISVAEYDPNVS

SEQ ID NO: 2679663 - protein, 18 aa, Entamoeba histolytica
IITVCSSNSFIVGVGCFN

SEQ ID NO: 2679664 - protein, 25 aa, Entamoeba histolytica
IITVILNYPEYCLAPPKTNEEDVFV

SEQ ID NO: 2679665 - protein, 31 aa, Entamoeba histolytica
IITVRIFNIPFTWKEHDVLEYFKEFHPVKAL

SEQ ID NO: 2679666 - protein, 17 aa, Entamoeba histolytica
IIVEGWQLTLSVASTIF

SEQ ID NO: 2679667 - protein, 18 aa, Entamoeba histolytica
IIVGSPIYVHSKCIIVDD

SEQ ID NO: 2679668 - protein, 17 aa, Entamoeba histolytica
IIVKVVMKNCGSYFVKN

SEQ ID NO: 2679669 - protein, 25 aa, Entamoeba histolytica
IIVQLKLIPLQSIPFYFLPSSSNTI

SEQ ID NO: 2679670 - protein, 24 aa, Entamoeba histolytica
IIVRCFTCKWNQWIKENIKVNTVF

SEQ ID NO: 2679671 - protein, 22 aa, Entamoeba histolytica
IIWNGSVSFERLIKFETTPSLN

SEQ ID NO: 2679672 - protein, 25 aa, Entamoeba histolytica
IIWNRMCLFYTHYLYSFNITKTKIF

SEQ ID NO: 2679673 - protein, 25 aa, Entamoeba histolytica
IIYEAKRFIGRRVKPNEIENDKSLL

SEQ ID NO: 2679674 - protein, 19 aa, Entamoeba histolytica
IIYKFDFFDFVLTELRDSF

SEQ ID NO: 2679675 - protein, 23 aa, Entamoeba histolytica
IIYRKTYCGFALSNAFDSFETNN

SEQ ID NO: 2679676 - protein, 17 aa, Entamoeba histolytica
IIYSAKLLSKWSELLNT

SEQ ID NO: 2679677 - protein, 18 aa, Entamoeba histolytica
IIYSCLKLHGRWINEGPL

SEQ ID NO: 2679678 - protein, 18 aa, Entamoeba histolytica
IIYSIKINECIGQIKHNG

SEQ ID NO: 2679679 - protein, 20 aa, Entamoeba histolytica
IIYSYRFLQVNSLSLTLTTG

SEQ ID NO: 2679680 - protein, 21 aa, Entamoeba histolytica
IIYTTLAWRNVKYGNCSQFVW

SEQ ID NO: 2679681 - protein, 24 aa, Entamoeba histolytica
IKAAEPYDSFPIIMNGFVKDWSET

SEQ ID NO: 2679682 - protein, 18 aa, Entamoeba histolytica
IKACPFELINKVVVTICT

SEQ ID NO: 2679683 - protein, 21 aa, Entamoeba histolytica
IKAECLEKIIGAVQLLSHRQE

SEQ ID NO: 2679684 - protein, 24 aa, Entamoeba histolytica
IKAHGVTCFVSRQLIYPIPEQFFN

SEQ ID NO: 2679685 - protein, 17 aa, Entamoeba histolytica
IKAHMFLGKCLIDKDLQ

SEQ ID NO: 2679686 - protein, 21 aa, Entamoeba histolytica
IKAICYMECSALTRSGLNQVF

SEQ ID NO: 2679687 - protein, 17 aa, Entamoeba histolytica
IKAISYLVRLNRLNKVE

SEQ ID NO: 2679688 - protein, 17 aa, Entamoeba histolytica
IKALCKQTIEIVEYREE

SEQ ID NO: 2679689 - protein, 17 aa, Entamoeba histolytica
IKALIAINNEFEEYENS

SEQ ID NO: 2679690 - protein, 17 aa, Entamoeba histolytica
IKALRNMLQLFLRQLPL

SEQ ID NO: 2679691 - protein, 21 aa, Entamoeba histolytica
IKAMRCIEDIFIDITCNESTK

SEQ ID NO: 2679692 - protein, 24 aa, Entamoeba histolytica
IKAQLPVAESFGFTDDMLGQTSGA

SEQ ID NO: 2679693 - protein, 22 aa, Entamoeba histolytica
IKASHIIYDLLGVLIRRSSTNT

SEQ ID NO: 2679694 - protein, 19 aa, Entamoeba histolytica
IKASLILRQKINKNFRVNL

SEQ ID NO: 2679695 - protein, 17 aa, Entamoeba histolytica
IKATRYFPENGIEQKYG

SEQ ID NO: 2679696 - protein, 17 aa, Entamoeba histolytica
IKCEVSEEVSKGTTEER

SEQ ID NO: 2679697 - protein, 20 aa, Entamoeba histolytica
IKCHEEFPIIASASEDSTIR

SEQ ID NO: 2679698 - protein, 18 aa, Entamoeba histolytica
IKCKSGYYLNSNNKCQEN

SEQ ID NO: 2679699 - protein, 17 aa, Entamoeba histolytica
IKCNLILSQSLNEECDA

SEQ ID NO: 2679700 - protein, 17 aa, Entamoeba histolytica
IKCNYKYPIVATTCSVV

SEQ ID NO: 2679701 - protein, 30 aa, Entamoeba histolytica
IKCPVDYPTNICLLSSLELFIIDSTNQTSV

SEQ ID NO: 2679702 - protein, 21 aa, Entamoeba histolytica
IKCQIAAFCELLRDYSNDSYE

SEQ ID NO: 2679703 - protein, 20 aa, Entamoeba histolytica
IKCVCALKKVVKLDITGLNF

SEQ ID NO: 2679704 - protein, 17 aa, Entamoeba histolytica
IKDFEVMNLMIKEKEEK

SEQ ID NO: 2679705 - protein, 17 aa, Entamoeba histolytica
IKDFMIQGGDFTRHNGT

SEQ ID NO: 2679706 - protein, 19 aa, Entamoeba histolytica
IKDFSKYVINLSYLCIMAC

SEQ ID NO: 2679707 - protein, 20 aa, Entamoeba histolytica
IKDFVDAFAKLRNMKKVEEL

SEQ ID NO: 2679708 - protein, 26 aa, Entamoeba histolytica
IKDGDEFPFHISVPIDLPPTIKNDCV

SEQ ID NO: 2679709 - protein, 17 aa, Entamoeba histolytica
IKDGETIREKRVKEKES

SEQ ID NO: 2679710 - protein, 23 aa, Entamoeba histolytica
IKDGRLKPGMEIIEATSGNTGIG

SEQ ID NO: 2679711 - protein, 30 aa, Entamoeba histolytica
IKDGTKFLFKSEGYALCITVYLQDNTSNLK

SEQ ID NO: 2679712 - protein, 18 aa, Entamoeba histolytica
IKDIKYILLKIIRKITKK

SEQ ID NO: 2679713 - protein, 23 aa, Entamoeba histolytica
IKDIPEFGALLVYSCEHCFNGTE

SEQ ID NO: 2679714 - protein, 20 aa, Entamoeba histolytica
IKDIPSLYLYTISDAQHACS

SEQ ID NO: 2679715 - protein, 20 aa, Entamoeba histolytica
IKDIVCTGKVFIDCDYEELM

SEQ ID NO: 2679716 - protein, 18 aa, Entamoeba histolytica
IKDKECKTAKYLNETIIC

SEQ ID NO: 2679717 - protein, 20 aa, Entamoeba histolytica
IKDLICLLDDLKIIEDKELD

SEQ ID NO: 2679718 - protein, 22 aa, Entamoeba histolytica
IKDNVKYLMTWVEMNKMRILYD

SEQ ID NO: 2679719 - protein, 21 aa, Entamoeba histolytica
IKDNYAFTSVCTFKPIETFPF

SEQ ID NO: 2679720 - protein, 20 aa, Entamoeba histolytica
IKDRRTMSLHSFHQRCSEEL

SEQ ID NO: 2679721 - protein, 19 aa, Entamoeba histolytica
IKDRSPISLFYSNQQKNQL

SEQ ID NO: 2679722 - protein, 24 aa, Entamoeba histolytica
IKDSLRPLLFIFREIDPLCTLQLE

SEQ ID NO: 2679723 - protein, 27 aa, Entamoeba histolytica
IKDTLFYYRMMWNLNVGPSYSLPPKST

SEQ ID NO: 2679724 - protein, 26 aa, Entamoeba histolytica
IKDWKCELESPLKLTIEFTHQQLRED

SEQ ID NO: 2679725 - protein, 25 aa, Entamoeba histolytica
IKEAIHLLMRLGYKDIKLIMKELYD

SEQ ID NO: 2679726 - protein, 26 aa, Entamoeba histolytica
IKEAKLMIFRGYSRGFAFVEYETEED

SEQ ID NO: 2679727 - protein, 18 aa, Entamoeba histolytica
IKEDCTLAVDGIVMDFIL

SEQ ID NO: 2679728 - protein, 30 aa, Entamoeba histolytica
IKEDEKFLPKVAVDLKNRIGMIEEKENEEK

SEQ ID NO: 2679729 - protein, 21 aa, Entamoeba histolytica
IKEDYCRRLINSIKRGDDITT

SEQ ID NO: 2679730 - protein, 22 aa, Entamoeba histolytica
IKEEKADTAINVGENLNEQMKM

SEQ ID NO: 2679731 - protein, 18 aa, Entamoeba histolytica
IKEEKYYGLIPFNNCWPA

SEQ ID NO: 2679732 - protein, 21 aa, Entamoeba histolytica
IKEEMKTALIWWNNHSDEERR

SEQ ID NO: 2679733 - protein, 21 aa, Entamoeba histolytica
IKEFIRFGFIEMSQRCERDKR

SEQ ID NO: 2679734 - protein, 29 aa, Entamoeba histolytica
IKEGGSWKTWKRRMFKLSEGKIEYFKDEG

SEQ ID NO: 2679735 - protein, 23 aa, Entamoeba histolytica
IKEGIMCKYFFTIFFNDLTIYGT

SEQ ID NO: 2679736 - protein, 23 aa, Entamoeba histolytica
IKEGMYRYIIAYDINYKQYLEFP

SEQ ID NO: 2679737 - protein, 17 aa, Entamoeba histolytica
IKEICLCTDSQGVAIIK

SEQ ID NO: 2679738 - protein, 23 aa, Entamoeba histolytica
IKEIEHCISVNVSLCPINNNEYS

SEQ ID NO: 2679739 - protein, 23 aa, Entamoeba histolytica
IKEIGGGCFYECLSLTSMNIPTT

SEQ ID NO: 2679740 - protein, 22 aa, Entamoeba histolytica
IKEIIKDYFFSQEWDVLLDKIV

SEQ ID NO: 2679741 - protein, 21 aa, Entamoeba histolytica
IKEIIQKQCDIIFIQFLKEMS

SEQ ID NO: 2679742 - protein, 22 aa, Entamoeba histolytica
IKEIKATLEASLASNQMIQNKI

SEQ ID NO: 2679743 - protein, 25 aa, Entamoeba histolytica
IKEIKEILNGFGLRQPMETRIIVGT

SEQ ID NO: 2679744 - protein, 23 aa, Entamoeba histolytica
IKEIKILFLQLIKAVNYIHSKNI

SEQ ID NO: 2679745 - protein, 22 aa, Entamoeba histolytica
IKEIKNKNEVLVNKLEIETIRK

SEQ ID NO: 2679746 - protein, 23 aa, Entamoeba histolytica
IKEIQRRVIGHLSRVSSHSTMRL

SEQ ID NO: 2679747 - protein, 21 aa, Entamoeba histolytica
IKEISVFGILHFNNQPINFTR

SEQ ID NO: 2679748 - protein, 21 aa, Entamoeba histolytica
IKEKEKVLSVEDWMIKEEEED

SEQ ID NO: 2679749 - protein, 21 aa, Entamoeba histolytica
IKEKFYKPNWFELSKRSFQRE

SEQ ID NO: 2679750 - protein, 26 aa, Entamoeba histolytica
IKEKHLRLLWIALIPCLNVSSLTPIN

SEQ ID NO: 2679751 - protein, 18 aa, Entamoeba histolytica
IKEKRLAEMRAIAEKNKY

SEQ ID NO: 2679752 - protein, 20 aa, Entamoeba histolytica
IKEKVELFRKGSWDYTEDEY

SEQ ID NO: 2679753 - protein, 18 aa, Entamoeba histolytica
IKELCKVSIYGKISAAKL

SEQ ID NO: 2679754 - protein, 24 aa, Entamoeba histolytica
IKELGEVMGKLGYEDFDIINDIGF

SEQ ID NO: 2679755 - protein, 25 aa, Entamoeba histolytica
IKELILRGCSCFKMGTKLKTKGILK

SEQ ID NO: 2679756 - protein, 25 aa, Entamoeba histolytica
IKELKMPVFIAHGLNDTIIHVSHAT

SEQ ID NO: 2679757 - protein, 21 aa, Entamoeba histolytica
IKELLPHKLFPGNRPTNSIVF

SEQ ID NO: 2679758 - protein, 20 aa, Entamoeba histolytica
IKELMVKQAVPYPIQHYDAL

SEQ ID NO: 2679759 - protein, 23 aa, Entamoeba histolytica
IKELRIKGIEGIESFEGLPDKNL

SEQ ID NO: 2679760 - protein, 19 aa, Entamoeba histolytica
IKELSAYMEVLFNQQVQIE

SEQ ID NO: 2679761 - protein, 31 aa, Entamoeba histolytica
IKEMFMERFRIIKEFTEYMIQYINWYNWLER

SEQ ID NO: 2679762 - protein, 18 aa, Entamoeba histolytica
IKEMGFNEPIGYHQILYP

SEQ ID NO: 2679763 - protein, 19 aa, Entamoeba histolytica
IKEMVCQAWETDKYLPEYL

SEQ ID NO: 2679764 - protein, 27 aa, Entamoeba histolytica
IKENGCCYKCKQPLTLEEIKLKRRGST

SEQ ID NO: 2679765 - protein, 26 aa, Entamoeba histolytica
IKENMLYCCFIHWIGHLFVQQKLDIV

SEQ ID NO: 2679766 - protein, 28 aa, Entamoeba histolytica
IKENPWYFDARIRRCYHLWDEKQYNLAS

SEQ ID NO: 2679767 - protein, 26 aa, Entamoeba histolytica
IKEQWWYPLCMSLRIEEFRPLQEWFE

SEQ ID NO: 2679768 - protein, 19 aa, Entamoeba histolytica
IKERGIVQGIFRECGKVSE

SEQ ID NO: 2679769 - protein, 21 aa, Entamoeba histolytica
IKERIEGYITLTFDKPIFIKN

SEQ ID NO: 2679770 - protein, 20 aa, Entamoeba histolytica
IKERLIHRQIFFYYNSFNII

SEQ ID NO: 2679771 - protein, 21 aa, Entamoeba histolytica
IKERVELMINLIFKDDESIIR

SEQ ID NO: 2679772 - protein, 24 aa, Entamoeba histolytica
IKESIKYGTCRSCHEHGIFGKLCE

SEQ ID NO: 2679773 - protein, 24 aa, Entamoeba histolytica
IKESLESFVPIPLHSYEKIKRSNS

SEQ ID NO: 2679774 - protein, 23 aa, Entamoeba histolytica
IKESLKYFYKWTELSQCQLIFDS

SEQ ID NO: 2679775 - protein, 22 aa, Entamoeba histolytica
IKESRLLCTPDYVAPESLRDYY

SEQ ID NO: 2679776 - protein, 17 aa, Entamoeba histolytica
IKESSLHFIGYSKLIIL

SEQ ID NO: 2679777 - protein, 25 aa, Entamoeba histolytica
IKETSSTIKFCFSSRNIQCIIKRNA

SEQ ID NO: 2679778 - protein, 20 aa, Entamoeba histolytica
IKEVRELFRTYGTLRGVRLP

SEQ ID NO: 2679779 - protein, 24 aa, Entamoeba histolytica
IKFELSEGSVLVFGDLWNVIKRQL

SEQ ID NO: 2679780 - protein, 25 aa, Entamoeba histolytica
IKFGSHFDGWFDLKGSPFGNEYVCG

SEQ ID NO: 2679781 - protein, 17 aa, Entamoeba histolytica
IKFILECSKVIHNNYND

SEQ ID NO: 2679782 - protein, 17 aa, Entamoeba histolytica
IKFIPNRLHLLIQTLGD

SEQ ID NO: 2679783 - protein, 19 aa, Entamoeba histolytica
IKFIRPLIEVPVVLIQEWT

SEQ ID NO: 2679784 - protein, 22 aa, Entamoeba histolytica
IKFLNINCGQALDFRLISMYVK

SEQ ID NO: 2679785 - protein, 28 aa, Entamoeba histolytica
IKFLSAKKKWDGIVNMTVPLDFPSCFDF

SEQ ID NO: 2679786 - protein, 17 aa, Entamoeba histolytica
IKFPDPVIKIFYQPYEA

SEQ ID NO: 2679787 - protein, 23 aa, Entamoeba histolytica
IKFPKLPKVYIYKTQEHIIKESI

SEQ ID NO: 2679788 - protein, 19 aa, Entamoeba histolytica
IKFRDEVLIDSTLNKIFSW

SEQ ID NO: 2679789 - protein, 19 aa, Entamoeba histolytica
IKFSPLFAAPQMFEQTTYS

SEQ ID NO: 2679790 - protein, 19 aa, Entamoeba histolytica
IKFTFSLSPICDSYYFQDC

SEQ ID NO: 2679791 - protein, 22 aa, Entamoeba histolytica
IKFVCKKGDCHLVDNKKMKKIK

SEQ ID NO: 2679792 - protein, 17 aa, Entamoeba histolytica
IKGAERLYQGVDDLHEL

SEQ ID NO: 2679793 - protein, 18 aa, Entamoeba histolytica
IKGALNLWNEDLLLNHFP

SEQ ID NO: 2679794 - protein, 19 aa, Entamoeba histolytica
IKGDAIAVHLNWEQELVQA

SEQ ID NO: 2679795 - protein, 26 aa, Entamoeba histolytica
IKGDCYTCQCDIWSIGVITYLVLSGN

SEQ ID NO: 2679796 - protein, 20 aa, Entamoeba histolytica
IKGDHIYNIVIPRYTLHPTS

SEQ ID NO: 2679797 - protein, 19 aa, Entamoeba histolytica
IKGDIKRECSCIGDNGNCK

SEQ ID NO: 2679798 - protein, 17 aa, Entamoeba histolytica
IKGEGVLAIGGDVEEFT

SEQ ID NO: 2679799 - protein, 23 aa, Entamoeba histolytica
IKGESKGDVCLRVYVHKVEIGAS

SEQ ID NO: 2679800 - protein, 18 aa, Entamoeba histolytica
IKGETSIDIDTLIEEKMN

SEQ ID NO: 2679801 - protein, 17 aa, Entamoeba histolytica
IKGEYQLYIGWYDGNPA

SEQ ID NO: 2679802 - protein, 24 aa, Entamoeba histolytica
IKGGELKPGKGFNLQPHPFVQNQL

SEQ ID NO: 2679803 - protein, 17 aa, Entamoeba histolytica
IKGGKFTKDDYIIYNSD

SEQ ID NO: 2679804 - protein, 26 aa, Entamoeba histolytica
IKGKHFKKLKQWIGLSKYKIIFDSYF

SEQ ID NO: 2679805 - protein, 24 aa, Entamoeba histolytica
IKGKKGVMMLFTFDCNDTHDQLPK

SEQ ID NO: 2679806 - protein, 31 aa, Entamoeba histolytica
IKGKKISCAVLYCWCVSLLLEKLNNTEKVSN

SEQ ID NO: 2679807 - protein, 21 aa, Entamoeba histolytica
IKGKSEYCWISVGLSSTKTMI

SEQ ID NO: 2679808 - protein, 18 aa, Entamoeba histolytica
IKGKVFIQMGNIKKPIMH

SEQ ID NO: 2679809 - protein, 29 aa, Entamoeba histolytica
IKGKVVLDVGCGLGILSLFAARAGAKHVY

SEQ ID NO: 2679810 - protein, 17 aa, Entamoeba histolytica
IKGLIILYHYIKVDPLP

SEQ ID NO: 2679811 - protein, 18 aa, Entamoeba histolytica
IKGLLINYFHTFWPSLLK

SEQ ID NO: 2679812 - protein, 17 aa, Entamoeba histolytica
IKGLVVAIADKLSLHHA

SEQ ID NO: 2679813 - protein, 21 aa, Entamoeba histolytica
IKGMSTLCCECSCYKPELYGE

SEQ ID NO: 2679814 - protein, 21 aa, Entamoeba histolytica
IKGSDIILVVRVLRKSGDDIV

SEQ ID NO: 2679815 - protein, 22 aa, Entamoeba histolytica
IKGSLNIINIISGLKFIPSKNI

SEQ ID NO: 2679816 - protein, 18 aa, Entamoeba histolytica
IKHEFNCLETDYKNLMND

SEQ ID NO: 2679817 - protein, 23 aa, Entamoeba histolytica
IKHEKEEYFEILLPLLGTLVEDK

SEQ ID NO: 2679818 - protein, 20 aa, Entamoeba histolytica
IKHHIKPMIHEGDYVHGVEC

SEQ ID NO: 2679819 - protein, 18 aa, Entamoeba histolytica
IKHPFIISYYNDYNINNN

SEQ ID NO: 2679820 - protein, 17 aa, Entamoeba histolytica
IKHWCKNTHVFSVEIDE

SEQ ID NO: 2679821 - protein, 22 aa, Entamoeba histolytica
IKIATYNVASWNAAMKKGLNEF

SEQ ID NO: 2679822 - protein, 18 aa, Entamoeba histolytica
IKIEIQRRLNIKDNISLR

SEQ ID NO: 2679823 - protein, 19 aa, Entamoeba histolytica
IKIEIQRRLNIKDNISLRA

SEQ ID NO: 2679824 - protein, 24 aa, Entamoeba histolytica
IKIELIKVFGIIGAIDPYKYKLLT

SEQ ID NO: 2679825 - protein, 17 aa, Entamoeba histolytica
IKIENVLIFNGEYKLTD

SEQ ID NO: 2679826 - protein, 17 aa, Entamoeba histolytica
IKIEPSRPGGIRQQLIL

SEQ ID NO: 2679827 - protein, 23 aa, Entamoeba histolytica
IKIERKLGDLGFRISNDNDSVFG

SEQ ID NO: 2679828 - protein, 20 aa, Entamoeba histolytica
IKIETLRILSSYFKLQTTQS

SEQ ID NO: 2679829 - protein, 18 aa, Entamoeba histolytica
IKIFSYESLEEFTQVDAF

SEQ ID NO: 2679830 - protein, 23 aa, Entamoeba histolytica
IKIGENYCKIIVYLRNRGESSLN

SEQ ID NO: 2679831 - protein, 17 aa, Entamoeba histolytica
IKIGRGDCIIEMKQGNT

SEQ ID NO: 2679832 - protein, 17 aa, Entamoeba histolytica
IKIICKGNHDYWFKSRT

SEQ ID NO: 2679833 - protein, 22 aa, Entamoeba histolytica
IKIILCKNCMAVFDSMKERKLL

SEQ ID NO: 2679834 - protein, 20 aa, Entamoeba histolytica
IKIILIVEGLTFYQKGIDAV

SEQ ID NO: 2679835 - protein, 17 aa, Entamoeba histolytica
IKIKCMFSDLKDDNEIF

SEQ ID NO: 2679836 - protein, 22 aa, Entamoeba histolytica
IKIKDYRIAKLRNWVGKSNYNI

SEQ ID NO: 2679837 - protein, 19 aa, Entamoeba histolytica
IKIKENRLFQDIKPPKYQY

SEQ ID NO: 2679838 - protein, 24 aa, Entamoeba histolytica
IKILESKTMWGFDCSPINNEIERI

SEQ ID NO: 2679839 - protein, 25 aa, Entamoeba histolytica
IKILFTCKWYNPIFQYFIYNNDYNN

SEQ ID NO: 2679840 - protein, 20 aa, Entamoeba histolytica
IKILKNHLLPIAKFFDEKYK

SEQ ID NO: 2679841 - protein, 20 aa, Entamoeba histolytica
IKILPRRLFIQSDTNELFKN

SEQ ID NO: 2679842 - protein, 26 aa, Entamoeba histolytica
IKIMTRFCLLYSYFPLQETIDVYEEI

SEQ ID NO: 2679843 - protein, 20 aa, Entamoeba histolytica
IKINDFMKFCKYIETDQEYL

SEQ ID NO: 2679844 - protein, 18 aa, Entamoeba histolytica
IKINIKYSSVILESIPTI

SEQ ID NO: 2679845 - protein, 26 aa, Entamoeba histolytica
IKIPHCSVCNCVICTINENLDVFSFL

SEQ ID NO: 2679846 - protein, 22 aa, Entamoeba histolytica
IKISDFGLSFFVSDNEVGHKTS

SEQ ID NO: 2679847 - protein, 26 aa, Entamoeba histolytica
IKITKKENCQFILFTLTNSDGLFIYE

SEQ ID NO: 2679848 - protein, 20 aa, Entamoeba histolytica
IKITRNYLFIVFENMVSIMD

SEQ ID NO: 2679849 - protein, 18 aa, Entamoeba histolytica
IKIYLKFLPENGYITENG

SEQ ID NO: 2679850 - protein, 17 aa, Entamoeba histolytica
IKKALPYITSAVGNITF

SEQ ID NO: 2679851 - protein, 27 aa, Entamoeba histolytica
IKKATVKCLKRVIPMLNETDFRGYVYS

SEQ ID NO: 2679852 - protein, 22 aa, Entamoeba histolytica
IKKAYKKMCLIYHPDKNNGDDS

SEQ ID NO: 2679853 - protein, 24 aa, Entamoeba histolytica
IKKEFPLKGILIIDPLGFVLLSLG

SEQ ID NO: 2679854 - protein, 17 aa, Entamoeba histolytica
IKKELDKNLAFETTQQI

SEQ ID NO: 2679855 - protein, 22 aa, Entamoeba histolytica
IKKEVSSLEFCKNIKNYFIEYF

SEQ ID NO: 2679856 - protein, 19 aa, Entamoeba histolytica
IKKFCTGMVDVIKHVLDIV

SEQ ID NO: 2679857 - protein, 30 aa, Entamoeba histolytica
IKKFQEIRKYCSFLEFIGKIAGNPIIQLQQ

SEQ ID NO: 2679858 - protein, 19 aa, Entamoeba histolytica
IKKGCVSEIPLLSHSEKEL

SEQ ID NO: 2679859 - protein, 25 aa, Entamoeba histolytica
IKKIKEIYQIKSLLIIKDNKITQIS

SEQ ID NO: 2679860 - protein, 28 aa, Entamoeba histolytica
IKKIKLRFTVRYDLLLTIFCDKLEKRED

SEQ ID NO: 2679861 - protein, 21 aa, Entamoeba histolytica
IKKILFKPLKAFGSAAKLTVE

SEQ ID NO: 2679862 - protein, 22 aa, Entamoeba histolytica
IKKLDCYCFYHCKKLKRIKISA

SEQ ID NO: 2679863 - protein, 21 aa, Entamoeba histolytica
IKKLEPMDASLAQKVNDAQER

SEQ ID NO: 2679864 - protein, 23 aa, Entamoeba histolytica
IKKLGIKHVKGILLYGPPGCGKT

SEQ ID NO: 2679865 - protein, 33 aa, Entamoeba histolytica; identical to SEQ ID NO: 2486633

SEQ ID NO: 2679866 - protein, 21 aa, Entamoeba histolytica
IKKLKNLNCPALPKIYETNES

SEQ ID NO: 2679867 - protein, 20 aa, Entamoeba histolytica
IKKLLLRISENDDFTYCRIV

SEQ ID NO: 2679868 - protein, 18 aa, Entamoeba histolytica
IKKLYTKLFEIIKKDLQK

SEQ ID NO: 2679869 - protein, 18 aa, Entamoeba histolytica
IKKMGSMVAASSFYLDKW

SEQ ID NO: 2679870 - protein, 23 aa, Entamoeba histolytica
IKKMKINALIPARMQCVIDALLV

SEQ ID NO: 2679871 - protein, 31 aa, Entamoeba histolytica
IKKNKEYCKIFRIIFRFISKVITERIDEDNE

SEQ ID NO: 2679872 - protein, 20 aa, Entamoeba histolytica
IKKNRLFVCDSLNHRIQQFD

SEQ ID NO: 2679873 - protein, 18 aa, Entamoeba histolytica
IKKPERRSQKTLQLMLVE

SEQ ID NO: 2679874 - protein, 19 aa, Entamoeba histolytica
IKKPIVCYLHNKFFIECYN

SEQ ID NO: 2679875 - protein, 29 aa, Entamoeba histolytica
IKKPKRFVVESLFDIPLMKSLEPNITEMK

SEQ ID NO: 2679876 - protein, 21 aa, Entamoeba histolytica
IKKPTSWVIGKSVIRGRDWKW

SEQ ID NO: 2679877 - protein, 23 aa, Entamoeba histolytica
IKKQFPRVFGFDDMFDLLDEDEN

SEQ ID NO: 2679878 - protein, 17 aa, Entamoeba histolytica
IKKRAIVTLSKLYKIQP

SEQ ID NO: 2679879 - protein, 22 aa, Entamoeba histolytica
IKKREIDLLFSYEDNVMSQIPV

SEQ ID NO: 2679880 - protein, 20 aa, Entamoeba histolytica
IKKSENVLVHFVKTNFIDIP

SEQ ID NO: 2679881 - protein, 17 aa, Entamoeba histolytica
IKKSIIGSIKFNTTLKT

SEQ ID NO: 2679882 - protein, 17 aa, Entamoeba histolytica
IKKSIKIAKECFEESDF

SEQ ID NO: 2679883 - protein, 26 aa, Entamoeba histolytica
IKKSKEWKVDTLILKKYPALVDEILS

SEQ ID NO: 2679884 - protein, 25 aa, Entamoeba histolytica
IKKSQWRVPLPIFRAMQYLEEHKGD

SEQ ID NO: 2679885 - protein, 26 aa, Entamoeba histolytica
IKKSQWRVPLPIFRAMQYLEEHKGDE

SEQ ID NO: 2679886 - protein, 23 aa, Entamoeba histolytica
IKKSSLVQFVIELLKYFENGEVI

SEQ ID NO: 2679887 - protein, 21 aa, Entamoeba histolytica
IKKSTLASFVVRTENDKKKLR

SEQ ID NO: 2679888 - protein, 18 aa, Entamoeba histolytica
IKKTLKLRNCYGEIKKVC

SEQ ID NO: 2679889 - protein, 17 aa, Entamoeba histolytica
IKKTMKSNCSVLSLKGT

SEQ ID NO: 2679890 - protein, 19 aa, Entamoeba histolytica
IKKVTSFMELFKRAIRSMA

SEQ ID NO: 2679891 - protein, 23 aa, Entamoeba histolytica
IKKYEFAFCPLFCVGLTEEIDTN

SEQ ID NO: 2679892 - protein, 31 aa, Entamoeba histolytica
IKKYKMTVFIPMHFPRFSTMQGNRCKENLEL

SEQ ID NO: 2679893 - protein, 25 aa, Entamoeba histolytica
IKKYPTCRMLLKHCVDLTIRCLEEM

SEQ ID NO: 2679894 - protein, 18 aa, Entamoeba histolytica
IKKYYKIQEEQLRKLEEE

SEQ ID NO: 2679895 - protein, 20 aa, Entamoeba histolytica
IKLDSSLKQNVIYSYTDSVR

SEQ ID NO: 2679896 - protein, 18 aa, Entamoeba histolytica
IKLDVQIILKSATLNLRP

SEQ ID NO: 2679897 - protein, 22 aa, Entamoeba histolytica
IKLFKKKCTLIIAQSYSDAAHY

SEQ ID NO: 2679898 - protein, 18 aa, Entamoeba histolytica
IKLFNGLSEIECHVKDIE

SEQ ID NO: 2679899 - protein, 24 aa, Entamoeba histolytica
IKLFSRIIEVLREFVVSKRAVYIC

SEQ ID NO: 2679900 - protein, 17 aa, Entamoeba histolytica
IKLGPFDIACFQFSLYK

SEQ ID NO: 2679901 - protein, 17 aa, Entamoeba histolytica
IKLICRISSQKVTSKTM

SEQ ID NO: 2679902 - protein, 24 aa, Entamoeba histolytica
IKLIDFGSACFERSTLYTYIQSRH

SEQ ID NO: 2679903 - protein, 18 aa, Entamoeba histolytica
IKLIKLRRQMFINILKGD

SEQ ID NO: 2679904 - protein, 19 aa, Entamoeba histolytica
IKLIMTLRVDFSKQKIRSL

SEQ ID NO: 2679905 - protein, 22 aa, Entamoeba histolytica
IKLKGTGCIIQYGGDRTITAMS

SEQ ID NO: 2679906 - protein, 22 aa, Entamoeba histolytica
IKLKTEFASFIMNRYGINVIDV

SEQ ID NO: 2679907 - protein, 20 aa, Entamoeba histolytica
IKLLCVLPDEFIKMNESLII

SEQ ID NO: 2679908 - protein, 23 aa, Entamoeba histolytica
IKLLKEICEGIGMIVETIPTKNN

SEQ ID NO: 2679909 - protein, 23 aa, Entamoeba histolytica
IKLLNEYSFKHRIIIQLESRFQL

SEQ ID NO: 2679910 - protein, 20 aa, Entamoeba histolytica
IKLLPYHSLPFAWINPIKER

SEQ ID NO: 2679911 - protein, 19 aa, Entamoeba histolytica
IKLLQKIQLMFTEQRDQMI

SEQ ID NO: 2679912 - protein, 18 aa, Entamoeba histolytica
IKLLTEFQSIVNYESNFK

SEQ ID NO: 2679913 - protein, 19 aa, Entamoeba histolytica
IKLPCKKKFEFVVSNENQK

SEQ ID NO: 2679914 - protein, 25 aa, Entamoeba histolytica
IKLPTEFLPYAFNWLLQFTSVPDQD

SEQ ID NO: 2679915 - protein, 17 aa, Entamoeba histolytica
IKLRKAFDKLYKNLISQ

SEQ ID NO: 2679916 - protein, 27 aa, Entamoeba histolytica
IKLRSEGVFDESHWVPVKVNPEIKTSI

SEQ ID NO: 2679917 - protein, 17 aa, Entamoeba histolytica
IKLRSLFSLTSNYKRYR

SEQ ID NO: 2679918 - protein, 19 aa, Entamoeba histolytica
IKLSFEIVFDKEYYFICKD

SEQ ID NO: 2679919 - protein, 23 aa, Entamoeba histolytica
IKLSKKLYQVFKMNKKVNKILDI

SEQ ID NO: 2679920 - protein, 19 aa, Entamoeba histolytica
IKLTFFIPNEIKVEDKIIE

SEQ ID NO: 2679921 - protein, 20 aa, Entamoeba histolytica
IKLVTTIGVHPTRTNELKQE

SEQ ID NO: 2679922 - protein, 17 aa, Entamoeba histolytica
IKLYLLFYEKSYEMIKY

SEQ ID NO: 2679923 - protein, 21 aa, Entamoeba histolytica
IKLYNKFVVSRVLQDFKREYP

SEQ ID NO: 2679924 - protein, 23 aa, Entamoeba histolytica
IKMERSRIKSECGIRHNDNKPVS

SEQ ID NO: 2679925 - protein, 19 aa, Entamoeba histolytica
IKMESIFDLLSRHWQNPVN

SEQ ID NO: 2679926 - protein, 18 aa, Entamoeba histolytica
IKMICSRYPKVIKGSCIS

SEQ ID NO: 2679927 - protein, 23 aa, Entamoeba histolytica
IKMKDLRLAAEIQKKKLGDKVEK

SEQ ID NO: 2679928 - protein, 20 aa, Entamoeba histolytica
IKMKEAFTNVSWKYNRTTTI

SEQ ID NO: 2679929 - protein, 26 aa, Entamoeba histolytica
IKMKELLEGIFLRLFSFKMIPDSFKS

SEQ ID NO: 2679930 - protein, 24 aa, Entamoeba histolytica
IKMKHSKILVCAPSNAAVDEIVLR

SEQ ID NO: 2679931 - protein, 18 aa, Entamoeba histolytica
IKMKYRYGKPSYKKKEKE

SEQ ID NO: 2679932 - protein, 22 aa, Entamoeba histolytica
IKMLLLKCKICVNNKVSSDINS

SEQ ID NO: 2679933 - protein, 22 aa, Entamoeba histolytica
IKMLRLVDPYVTYGYPTLETVQ

SEQ ID NO: 2679934 - protein, 17 aa, Entamoeba histolytica
IKMQTLIRVLKESKDKK

SEQ ID NO: 2679935 - protein, 21 aa, Entamoeba histolytica
IKMRIRKAYYELYAMIKSAQM

SEQ ID NO: 2679936 - protein, 23 aa, Entamoeba histolytica
IKMSELKEGNLFVELFEKLSQSK

SEQ ID NO: 2679937 - protein, 17 aa, Entamoeba histolytica
IKMYLQYLEEYYGINED

SEQ ID NO: 2679938 - protein, 19 aa, Entamoeba histolytica
IKNAEILMKYFHAHGRLEE

SEQ ID NO: 2679939 - protein, 19 aa, Entamoeba histolytica
IKNDMLISIDISLRSLEKR

SEQ ID NO: 2679940 - protein, 22 aa, Entamoeba histolytica
IKNDPYIKLILTYMEKKSNQLI

SEQ ID NO: 2679941 - protein, 22 aa, Entamoeba histolytica
IKNFVDRTVCLFDMKTYGIKPS

SEQ ID NO: 2679942 - protein, 19 aa, Entamoeba histolytica
IKNGIIPPMVELLLSILSE

SEQ ID NO: 2679943 - protein, 19 aa, Entamoeba histolytica
IKNGLSLDNLGDWLRTVAY

SEQ ID NO: 2679944 - protein, 26 aa, Entamoeba histolytica
IKNIDSIKVRRCELFRCFVNDQDKLI

SEQ ID NO: 2679945 - protein, 23 aa, Entamoeba histolytica
IKNKEVLGTIGIDIFKTKYAKVL

SEQ ID NO: 2679946 - protein, 29 aa, Entamoeba histolytica
IKNKGYGDFVIIRGWRSIGSFDSEAANSY

SEQ ID NO: 2679947 - protein, 18 aa, Entamoeba histolytica
IKNKIGIETIYPNGTIMI

SEQ ID NO: 2679948 - protein, 32 aa, Entamoeba histolytica
IKNKRLSGMTLDLLCKVLSSLLIPIQSKEFVL

SEQ ID NO: 2679949 - protein, 17 aa, Entamoeba histolytica
IKNLIIKVFDTIKYRHL

SEQ ID NO: 2679950 - protein, 24 aa, Entamoeba histolytica
IKNLKGQPLLNVCDLLSSVIETLG

SEQ ID NO: 2679951 - protein, 17 aa, Entamoeba histolytica
IKNLLLFKENSNGSTPS

SEQ ID NO: 2679952 - protein, 30 aa, Entamoeba histolytica
IKNLLLSLRWRLFLKCLPENSSLWTSVINE

SEQ ID NO: 2679953 - protein, 19 aa, Entamoeba histolytica
IKNNIPIKFVKREINSYST

SEQ ID NO: 2679954 - protein, 18 aa, Entamoeba histolytica
IKNQIGWVAKGIGSIKWW

SEQ ID NO: 2679955 - protein, 19 aa, Entamoeba histolytica
IKNQLNLKLKEEEICMQTI

SEQ ID NO: 2679956 - protein, 18 aa, Entamoeba histolytica
IKNRTAFEKWRKVEVLLI

SEQ ID NO: 2679957 - protein, 22 aa, Entamoeba histolytica
IKNTIKQICCKDNFSSKLVINS

SEQ ID NO: 2679958 - protein, 19 aa, Entamoeba histolytica
IKNTLDWMTSIARTNYRTP

SEQ ID NO: 2679959 - protein, 18 aa, Entamoeba histolytica
IKNVQCFNLSLKLLQPFD

SEQ ID NO: 2679960 - protein, 27 aa, Entamoeba histolytica
IKPFQFLHCHILRGYLQITLKVEGFEF

SEQ ID NO: 2679961 - protein, 25 aa, Entamoeba histolytica
IKPIESLSAFIYRLPHSSSLFDYKV

SEQ ID NO: 2679962 - protein, 18 aa, Entamoeba histolytica
IKPLCKLFDIECEEKDEM

SEQ ID NO: 2679963 - protein, 20 aa, Entamoeba histolytica
IKPLRVVCMTSDYTMQNVMM

SEQ ID NO: 2679964 - protein, 18 aa, Entamoeba histolytica
IKPLYSMEKTMGMMEKEE

SEQ ID NO: 2679965 - protein, 22 aa, Entamoeba histolytica
IKPMYIYFKRIEIEIQAIQKAF

SEQ ID NO: 2679966 - protein, 19 aa, Entamoeba histolytica
IKPNHNFIFCGLEGNNFVI

SEQ ID NO: 2679967 - protein, 25 aa, Entamoeba histolytica
IKPQELKECFEWDINCQNIKTFWKR

SEQ ID NO: 2679968 - protein, 17 aa, Entamoeba histolytica
IKPQFSRVIYDSAEVIK

SEQ ID NO: 2679969 - protein, 19 aa, Entamoeba histolytica
IKPRFHLHPSRPLECSYRQ

SEQ ID NO: 2679970 - protein, 18 aa, Entamoeba histolytica
IKPSISLFQNNRKAAEIF

SEQ ID NO: 2679971 - protein, 17 aa, Entamoeba histolytica
IKPSLDCLTEYLQTNKI

SEQ ID NO: 2679972 - protein, 22 aa, Entamoeba histolytica
IKPWKGGDMIGLVSGGKDKQVR

SEQ ID NO: 2679973 - protein, 17 aa, Entamoeba histolytica
IKQAFSFPGETKYYSII

SEQ ID NO: 2679974 - protein, 19 aa, Entamoeba histolytica
IKQAIKICVSHIDGFINND

SEQ ID NO: 2679975 - protein, 17 aa, Entamoeba histolytica
IKQEIKNDVEIIPTTEF

SEQ ID NO: 2679976 - protein, 26 aa, Entamoeba histolytica
IKQEPKLWFQLGCLYEKAGLFEQAEA

SEQ ID NO: 2679977 - protein, 19 aa, Entamoeba histolytica
IKQFKKWFSTEQCIESEEV

SEQ ID NO: 2679978 - protein, 24 aa, Entamoeba histolytica
IKQIHVVGPLAYVEFKTHQQALKV

SEQ ID NO: 2679979 - protein, 22 aa, Entamoeba histolytica
IKQIVYFLFKFKNLTEELKKEY

SEQ ID NO: 2679980 - protein, 22 aa, Entamoeba histolytica
IKQKRNGIDFGPFDVTKVMEFE

SEQ ID NO: 2679981 - protein, 22 aa, Entamoeba histolytica
IKQKWAKITIFMKIWTDLLPYD

SEQ ID NO: 2679982 - protein, 17 aa, Entamoeba histolytica
IKQLFLDNNFQLLKENN

SEQ ID NO: 2679983 - protein, 18 aa, Entamoeba histolytica
IKQLLPTQWKIVLDDPLL

SEQ ID NO: 2679984 - protein, 17 aa, Entamoeba histolytica
IKQRAMLLLPLVGNEIE

SEQ ID NO: 2679985 - protein, 25 aa, Entamoeba histolytica
IKQRLKEAVQWPLRFKEQLDKFHVR

SEQ ID NO: 2679986 - protein, 26 aa, Entamoeba histolytica
IKQSFYDKIHIKQHFLDSQKNKNITC

SEQ ID NO: 2679987 - protein, 24 aa, Entamoeba histolytica
IKQSSFKFIQWVSSSNDADFIRLF

SEQ ID NO: 2679988 - protein, 21 aa, Entamoeba histolytica
IKQTATWCLSNILGGKDSFPA

SEQ ID NO: 2679989 - protein, 28 aa, Entamoeba histolytica
IKQVFSSLFFLRYCFLPLVKYPSLLKIL

SEQ ID NO: 2679990 - protein, 18 aa, Entamoeba histolytica
IKRAFNLSLSDGDRIFYD

SEQ ID NO: 2679991 - protein, 17 aa, Entamoeba histolytica
IKREGVFNLAPADFKLV

SEQ ID NO: 2679992 - protein, 21 aa, Entamoeba histolytica
IKREIIPNYIILIDDQLIKLN

SEQ ID NO: 2679993 - protein, 23 aa, Entamoeba histolytica
IKRELKRGQEIVHEFSSEGVNDW

SEQ ID NO: 2679994 - protein, 17 aa, Entamoeba histolytica
IKREMKRYCVVAQNPEM

SEQ ID NO: 2679995 - protein, 28 aa, Entamoeba histolytica
IKRFFQFIRKLVRTYGDYLFKENLDFSY

SEQ ID NO: 2679996 - protein, 27 aa, Entamoeba histolytica
IKRFTRLPVKHVQEFKTSNGYSTTACF

SEQ ID NO: 2679997 - protein, 20 aa, Entamoeba histolytica
IKRGKYTVRIFVSETNEGNF

SEQ ID NO: 2679998 - protein, 21 aa, Entamoeba histolytica
IKRIELCKLPPISKNINLSIG

SEQ ID NO: 2679999 - protein, 17 aa, Entamoeba histolytica
IKRIEMLHIDRFSVSPS

SEQ ID NO: 2680000 - protein, 17 aa, Entamoeba histolytica
IKRIKCVDIVNEINLDE

SEQ ID NO: 2680001 - protein, 19 aa, Entamoeba histolytica
IKRILNKRVQVLSGGELQL

SEQ ID NO: 2680002 - protein, 25 aa, Entamoeba histolytica
IKRKIATGLIFIKWGYSDIVDVIQE

SEQ ID NO: 2680003 - protein, 19 aa, Entamoeba histolytica
IKRLESIPKSSDLSIECGD

SEQ ID NO: 2680004 - protein, 20 aa, Entamoeba histolytica
IKRLNELIEQLQLDSHQKDL

SEQ ID NO: 2680005 - protein, 21 aa, Entamoeba histolytica
IKRLPTFTITFGQLELLLNPE

SEQ ID NO: 2680006 - protein, 31 aa, Entamoeba histolytica
IKRLQIKYPKLKIGITLSKYSSHQYISLEGF

SEQ ID NO: 2680007 - protein, 22 aa, Entamoeba histolytica
IKRNCKEIIEILKKCQEPINVN

SEQ ID NO: 2680008 - protein, 22 aa, Entamoeba histolytica
IKRNVIETVDLYSILSDLTDSG

SEQ ID NO: 2680009 - protein, 19 aa, Entamoeba histolytica
IKRQCLVINTLKYIYFRIE

SEQ ID NO: 2680010 - protein, 19 aa, Entamoeba histolytica
IKRRGRKPKTQPITVLQNT

SEQ ID NO: 2680011 - protein, 19 aa, Entamoeba histolytica
IKRRWFVLTTNKLFYFTSQ

SEQ ID NO: 2680012 - protein, 21 aa, Entamoeba histolytica
IKRSTLASFIVRSENDKKKLR

SEQ ID NO: 2680013 - protein, 21 aa, Entamoeba histolytica
IKRVLSSTIKPHFDFKYTTIV

SEQ ID NO: 2680014 - protein, 18 aa, Entamoeba histolytica
IKRVRTWQSLHPSMEKED

SEQ ID NO: 2680015 - protein, 20 aa, Entamoeba histolytica
IKRYTVEVVTMWYRPPELIQ

SEQ ID NO: 2680016 - protein, 18 aa, Entamoeba histolytica
IKSAHILDPNVTLGTVVK

SEQ ID NO: 2680017 - protein, 25 aa, Entamoeba histolytica
IKSAMKEWYDGGAVQMSPMKQKAKE

SEQ ID NO: 2680018 - protein, 19 aa, Entamoeba histolytica
IKSCIKIVLDAANDCEIEC

SEQ ID NO: 2680019 - protein, 18 aa, Entamoeba histolytica
IKSCQKIEFLALKVMDIL

SEQ ID NO: 2680020 - protein, 17 aa, Entamoeba histolytica
IKSDEPYAFQIRFAGVK

SEQ ID NO: 2680021 - protein, 21 aa, Entamoeba histolytica
IKSEACWLLANTIFKINDSMY

SEQ ID NO: 2680022 - protein, 22 aa, Entamoeba histolytica
IKSECKGLGVIWLNTLKQVRTE

SEQ ID NO: 2680023 - protein, 19 aa, Entamoeba histolytica
IKSECLSAISGIQISDSSL

SEQ ID NO: 2680024 - protein, 19 aa, Entamoeba histolytica
IKSFCSIAAHAPTIDLSPF

SEQ ID NO: 2680025 - protein, 18 aa, Entamoeba histolytica
IKSFGVFQRYEFCIYSQE

SEQ ID NO: 2680026 - protein, 23 aa, Entamoeba histolytica
IKSFMGSSLLTFKERLHDLDAND

SEQ ID NO: 2680027 - protein, 24 aa, Entamoeba histolytica
IKSFTSKSCSIDWVTETDKGVEQY

SEQ ID NO: 2680028 - protein, 19 aa, Entamoeba histolytica
IKSGDKFIVKNGVFYHIQC

SEQ ID NO: 2680029 - protein, 22 aa, Entamoeba histolytica
IKSHPWFEGINWNTLLNESRED

SEQ ID NO: 2680030 - protein, 19 aa, Entamoeba histolytica
IKSKTCYKELECYIPKNLK

SEQ ID NO: 2680031 - protein, 18 aa, Entamoeba histolytica
IKSLCSMAIRVIAQEPSL

SEQ ID NO: 2680032 - protein, 25 aa, Entamoeba histolytica
IKSLFKEIEMIYSFNHKQEHPFELT

SEQ ID NO: 2680033 - protein, 19 aa, Entamoeba histolytica
IKSLPFFKVKTLYNVYESI

SEQ ID NO: 2680034 - protein, 20 aa, Entamoeba histolytica
IKSLYLYCSSIRIFNKNDIQ

SEQ ID NO: 2680035 - protein, 20 aa, Entamoeba histolytica
IKSRIITVICNYEGRRICEG

SEQ ID NO: 2680036 - protein, 21 aa, Entamoeba histolytica
IKSRVGVLLCGKSGCGKTSLA

SEQ ID NO: 2680037 - protein, 21 aa, Entamoeba histolytica
IKSSIKKGIRYKFEEEKKQEQ

SEQ ID NO: 2680038 - protein, 19 aa, Entamoeba histolytica
IKSSIPYFKTIKNTFLTKT

SEQ ID NO: 2680039 - protein, 21 aa, Entamoeba histolytica
IKSTRISLCDRVIGITDDEKV

SEQ ID NO: 2680040 - protein, 19 aa, Entamoeba histolytica
IKSWISFTGIIDKMGEEGL

SEQ ID NO: 2680041 - protein, 18 aa, Entamoeba histolytica
IKSYLNFVYPNGGYEKEQ

SEQ ID NO: 2680042 - protein, 17 aa, Entamoeba histolytica
IKTAIEAACTLLRVDDV

SEQ ID NO: 2680043 - protein, 22 aa, Entamoeba histolytica
IKTAIRLFELITKYVFIRRIGG

SEQ ID NO: 2680044 - protein, 24 aa, Entamoeba histolytica
IKTCKSCWGCMKTGKCWQKDPVMD

SEQ ID NO: 2680045 - protein, 17 aa, Entamoeba histolytica
IKTCLSKIRSIANEINE

SEQ ID NO: 2680046 - protein, 18 aa, Entamoeba histolytica
IKTFPLYHFFVKNTRLYP

SEQ ID NO: 2680047 - protein, 21 aa, Entamoeba histolytica
IKTFWKRMKRYGFKKRRIGGI

SEQ ID NO: 2680048 - protein, 24 aa, Entamoeba histolytica
IKTGDYYGMLGLGTVRWEASDDDI

SEQ ID NO: 2680049 - protein, 30 aa, Entamoeba histolytica
IKTGLTPTCFKEFAEILVGKSIGKKLNNGN

SEQ ID NO: 2680050 - protein, 22 aa, Entamoeba histolytica
IKTHCPDTPFLLIGTKSDIRDD

SEQ ID NO: 2680051 - protein, 21 aa, Entamoeba histolytica
IKTIFCPTENIFSISTSGISS

SEQ ID NO: 2680052 - protein, 29 aa, Entamoeba histolytica
IKTIKRKKVKRQRKGNEYKPMKNNSEVFK

SEQ ID NO: 2680053 - protein, 25 aa, Entamoeba histolytica
IKTKRSIVFRKGISGNTFYFGSNEI

SEQ ID NO: 2680054 - protein, 18 aa, Entamoeba histolytica
IKTLIKAFEMMIKNRSLI

SEQ ID NO: 2680055 - protein, 20 aa, Entamoeba histolytica
IKTLSSYCCVTGITHYPLHT

SEQ ID NO: 2680056 - protein, 20 aa, Entamoeba histolytica
IKTNLSALCTTPINTNGQSV

SEQ ID NO: 2680057 - protein, 18 aa, Entamoeba histolytica
IKTNSEFKGDTHIVDAIP

SEQ ID NO: 2680058 - protein, 18 aa, Entamoeba histolytica
IKTSIMFGKADQQEREIN

SEQ ID NO: 2680059 - protein, 19 aa, Entamoeba histolytica
IKTSPFFSVQKAMDDIKLV

SEQ ID NO: 2680060 - protein, 27 aa, Entamoeba histolytica
IKTVGCWGEKGIVCISKENKVTFFNVL

SEQ ID NO: 2680061 - protein, 21 aa, Entamoeba histolytica
IKTYILCIVPSFIEEIKSKLQ

SEQ ID NO: 2680062 - protein, 17 aa, Entamoeba histolytica
IKVDNLFEDIEIQSNSQ

SEQ ID NO: 2680063 - protein, 20 aa, Entamoeba histolytica
IKVELLRYERKVPLNDIRTI

SEQ ID NO: 2680064 - protein, 21 aa, Entamoeba histolytica
IKVHVGRGIVVGGFQGSDAAD

SEQ ID NO: 2680065 - protein, 22 aa, Entamoeba histolytica
IKVHVRRGIVVGGFEGADAGVF

SEQ ID NO: 2680066 - protein, 24 aa, Entamoeba histolytica
IKVIDFGSACFDNYTLYTYVQSRH

SEQ ID NO: 2680067 - protein, 20 aa, Entamoeba histolytica
IKVIELKGSLRCGILYLSNT

SEQ ID NO: 2680068 - protein, 17 aa, Entamoeba histolytica
IKVNYSLEEIIEICQKT

SEQ ID NO: 2680069 - protein, 19 aa, Entamoeba histolytica
IKVPGRIWPLMVNPTTVII

SEQ ID NO: 2680070 - protein, 28 aa, Entamoeba histolytica
IKVRRSFRLSSRESLGFETVPEGLYEVP

SEQ ID NO: 2680071 - protein, 21 aa, Entamoeba histolytica
IKVSSSLPFYSFTFDAILKDK

SEQ ID NO: 2680072 - protein, 20 aa, Entamoeba histolytica
IKVTEEFSRTGVGAYFTSFN

SEQ ID NO: 2680073 - protein, 19 aa, Entamoeba histolytica
IKVTMPISMWYPQFIEAMK

SEQ ID NO: 2680074 - protein, 25 aa, Entamoeba histolytica
IKVVDRMSNGLWKGTLNNQTGLFHI

SEQ ID NO: 2680075 - protein, 18 aa, Entamoeba histolytica
IKVWNRKIVFGGNDRQIG

SEQ ID NO: 2680076 - protein, 20 aa, Entamoeba histolytica
IKWKVKEEIVDFDACSLYPS

SEQ ID NO: 2680077 - protein, 21 aa, Entamoeba histolytica
IKWLAENDIELAIKIGISPIQ

SEQ ID NO: 2680078 - protein, 20 aa, Entamoeba histolytica
IKWRIIKLTFFIPNEIKVED

SEQ ID NO: 2680079 - protein, 20 aa, Entamoeba histolytica
IKYAELTKVFNELIRDQKNL

SEQ ID NO: 2680080 - protein, 17 aa, Entamoeba histolytica
IKYFIQRLNYFLFKASQ

SEQ ID NO: 2680081 - protein, 24 aa, Entamoeba histolytica
IKYIEQFPGLAFFVSKEESLAGDK

SEQ ID NO: 2680082 - protein, 19 aa, Entamoeba histolytica
IKYITKKGEGMFRGNPNDK

SEQ ID NO: 2680083 - protein, 20 aa, Entamoeba histolytica
IKYKCKELVSSIYLQNNPNL

SEQ ID NO: 2680084 - protein, 21 aa, Entamoeba histolytica
IKYKKRKTLCTVVLMNNVCFF

SEQ ID NO: 2680085 - protein, 24 aa, Entamoeba histolytica
IKYKLCSIEKEFSLGDEEVMEIEM

SEQ ID NO: 2680086 - protein, 16 aa, Entamoeba histolytica
IKYKMKVIRHVELMFN

SEQ ID NO: 2680087 - protein, 18 aa, Entamoeba histolytica
IKYKMKVIRHVELMFNLL

SEQ ID NO: 2680088 - protein, 17 aa, Entamoeba histolytica
IKYMELQMSAPQKEIEE

SEQ ID NO: 2680089 - protein, 19 aa, Entamoeba histolytica
IKYNCVLLLPPASLVKDLV

SEQ ID NO: 2680090 - protein, 17 aa, Entamoeba histolytica
IKYPILKGLFDNGELLD

SEQ ID NO: 2680091 - protein, 20 aa, Entamoeba histolytica
IKYRGKVFSLKLSQPNKEEQ

SEQ ID NO: 2680092 - protein, 17 aa, Entamoeba histolytica
IKYSKAIVTARPCIHLL

SEQ ID NO: 2680093 - protein, 19 aa, Entamoeba histolytica
IKYSKAIVTARPCIHLLNQ

SEQ ID NO: 2680094 - protein, 20 aa, Entamoeba histolytica
IKYTTLHIEYDITLNNFVYT

SEQ ID NO: 2680095 - protein, 25 aa, Entamoeba histolytica
IKYWNCPEEGRILGYMERNEYLNRI

SEQ ID NO: 2680096 - protein, 21 aa, Entamoeba histolytica
IKYYHLILHYSFLNDFVTTKI

SEQ ID NO: 2680097 - protein, 17 aa, Entamoeba histolytica
IKYYPFTVYRFGKVTEI

SEQ ID NO: 2680098 - protein, 18 aa, Entamoeba histolytica
ILALEYIHSLGCIHRDLK

SEQ ID NO: 2680099 - protein, 19 aa, Entamoeba histolytica
ILATCPWKEIEQDGKVVYK

SEQ ID NO: 2680100 - protein, 23 aa, Entamoeba histolytica
ILCDCKVSLMVFKDDKLVVYSTN

SEQ ID NO: 2680101 - protein, 19 aa, Entamoeba histolytica
ILCGVPYDPSIPINSSVYQ

SEQ ID NO: 2680102 - protein, 17 aa, Entamoeba histolytica
ILCIKKRSFDVISSVIE

SEQ ID NO: 2680103 - protein, 25 aa, Entamoeba histolytica
ILCSQFKLKFLNIFEQAANGIGNIM

SEQ ID NO: 2680104 - protein, 19 aa, Entamoeba histolytica
ILDDCKLAEKLAKEPNERL

SEQ ID NO: 2680105 - protein, 17 aa, Entamoeba histolytica
ILDEIEEELTIEKGIIK

SEQ ID NO: 2680106 - protein, 25 aa, Entamoeba histolytica
ILDILKYFFGFSFEECVKKKPEKNF

SEQ ID NO: 2680107 - protein, 19 aa, Entamoeba histolytica
ILDKTLCTFTFPDHDFSSS

SEQ ID NO: 2680108 - protein, 23 aa, Entamoeba histolytica
ILDLACSPWDMSIFATASSDRSA

SEQ ID NO: 2680109 - protein, 24 aa, Entamoeba histolytica
ILDLYFRLLSTFKLLRQESIENNE

SEQ ID NO: 2680110 - protein, 19 aa, Entamoeba histolytica
ILDMGFKKDLTAILEHLPK

SEQ ID NO: 2680111 - protein, 19 aa, Entamoeba histolytica
ILDNLFVICLSKNYCIVLI

SEQ ID NO: 2680112 - protein, 25 aa, Entamoeba histolytica
ILDPALLRPGRLDQLLFIPLPDKAS

SEQ ID NO: 2680113 - protein, 18 aa, Entamoeba histolytica
ILDRVKPDYIRKMYDVKQ

SEQ ID NO: 2680114 - protein, 19 aa, Entamoeba histolytica
ILDSMRLGLIVGNINDIVN

SEQ ID NO: 2680115 - protein, 24 aa, Entamoeba histolytica
ILDSSCFYKCFGLTSIHIPSNVKS

SEQ ID NO: 2680116 - protein, 20 aa, Entamoeba histolytica
ILDYCSKKSIDEMILKKMKG

SEQ ID NO: 2680117 - protein, 21 aa, Entamoeba histolytica
ILEEFILFKLDEIIEDILKNQ

SEQ ID NO: 2680118 - protein, 24 aa, Entamoeba histolytica
ILEGGCSLKNLIVQNIPSIVQIYS

SEQ ID NO: 2680119 - protein, 22 aa, Entamoeba histolytica
ILEKYCKARNLTYIPDDGNFED

SEQ ID NO: 2680120 - protein, 20 aa, Entamoeba histolytica
ILELIKYLEHIGADPTSIKL

SEQ ID NO: 2680121 - protein, 19 aa, Entamoeba histolytica
ILEMLKVGISQGVMIDVKS

SEQ ID NO: 2680122 - protein, 26 aa, Entamoeba histolytica
ILENELKPFFNKAMEIVLVIIEENKS

SEQ ID NO: 2680123 - protein, 20 aa, Entamoeba histolytica
ILENRIRGCMQLQRDIEKAM

SEQ ID NO: 2680124 - protein, 18 aa, Entamoeba histolytica
ILENYCAIDQLDKRITNY

SEQ ID NO: 2680125 - protein, 27 aa, Entamoeba histolytica
ILESEGRLYYQLPRIIENILVYLYNKG

SEQ ID NO: 2680126 - protein, 18 aa, Entamoeba histolytica
ILESFRKYFRGINVPSFI

SEQ ID NO: 2680127 - protein, 20 aa, Entamoeba histolytica
ILFECLMKQLGFVYEIKREQ

SEQ ID NO: 2680128 - protein, 17 aa, Entamoeba histolytica
ILFGGGFPEQERATHKS

SEQ ID NO: 2680129 - protein, 24 aa, Entamoeba histolytica
ILFIKRMIVSEVIAETIALESKSQ

SEQ ID NO: 2680130 - protein, 17 aa, Entamoeba histolytica
ILFKEIQDIQGYDLKPK

SEQ ID NO: 2680131 - protein, 30 aa, Entamoeba histolytica
ILFKKLPIKIPVYFISFLKKKFGATENDIF

SEQ ID NO: 2680132 - protein, 17 aa, Entamoeba histolytica
ILFLLLHIVETISKMNT

SEQ ID NO: 2680133 - protein, 23 aa, Entamoeba histolytica
ILFRLSIFPFHFNFYNYCVISLE

SEQ ID NO: 2680134 - protein, 22 aa, Entamoeba histolytica
ILFYECPKKSLLSLTRKSNEGQ

SEQ ID NO: 2680135 - protein, 27 aa, Entamoeba histolytica
ILGEYKFCRFCEGEPYETNVCYLPIIN

SEQ ID NO: 2680136 - protein, 27 aa, Entamoeba histolytica
ILGLRTGRKTIMVMAGNKCDLEEQRQI

SEQ ID NO: 2680137 - protein, 18 aa, Entamoeba histolytica
ILGNFTFSNVLSIVSYDY

SEQ ID NO: 2680138 - protein, 17 aa, Entamoeba histolytica
ILGYEVYLPSVIKEKKW

SEQ ID NO: 2680139 - protein, 19 aa, Entamoeba histolytica
ILHCLKKILEKESGVSDIS

SEQ ID NO: 2680140 - protein, 20 aa, Entamoeba histolytica
ILHLKRFEFDYETLQRIKIN

SEQ ID NO: 2680141 - protein, 28 aa, Entamoeba histolytica
ILHPKVWYLIFINFELKNTLPIIHLIIY

SEQ ID NO: 2680142 - protein, 17 aa, Entamoeba histolytica
ILIAAHRTLNLYSFVNK

SEQ ID NO: 2680143 - protein, 25 aa, Entamoeba histolytica
ILIFYAQEIFKIYPSVIVHLLDKFL

SEQ ID NO: 2680144 - protein, 25 aa, Entamoeba histolytica
ILIISCYCYGKLIPKYSKSLSLIRT

SEQ ID NO: 2680145 - protein, 18 aa, Entamoeba histolytica
ILIKQLGAIVSFRRTKKT

SEQ ID NO: 2680146 - protein, 24 aa, Entamoeba histolytica
ILIKSLSSLLLWNLSDEISDNDDI

SEQ ID NO: 2680147 - protein, 18 aa, Entamoeba histolytica
ILILFANVCNDMVQKGIF

SEQ ID NO: 2680148 - protein, 17 aa, Entamoeba histolytica
ILINCQINFSSKSDKFR

SEQ ID NO: 2680149 - protein, 17 aa, Entamoeba histolytica
ILISPKELRNVCELLND

SEQ ID NO: 2680150 - protein, 25 aa, Entamoeba histolytica
ILISYKEQWYLISFNQNILESLERE

SEQ ID NO: 2680151 - protein, 19 aa, Entamoeba histolytica
ILIYFPKTFGFYISSQPNC

SEQ ID NO: 2680152 - protein, 18 aa, Entamoeba histolytica
ILKDDITDVIGIDSDING

SEQ ID NO: 2680153 - protein, 17 aa, Entamoeba histolytica
ILKDLGLQIGIVNINLM

SEQ ID NO: 2680154 - protein, 17 aa, Entamoeba histolytica
ILKDQERLFRRSQQLRG

SEQ ID NO: 2680155 - protein, 19 aa, Entamoeba histolytica
ILKDQWLKGIKNYRPKSTV

SEQ ID NO: 2680156 - protein, 17 aa, Entamoeba histolytica
ILKDTLHGLAYLHKMHM

SEQ ID NO: 2680157 - protein, 23 aa, Entamoeba histolytica
ILKEAKALYGNRWTLIKMKLPGR

SEQ ID NO: 2680158 - protein, 40 aa, Entamoeba histolytica
ILKEEIKDVILVGGPTKLCCFKKMIKEFFGKQPLTTIDTM

SEQ ID NO: 2680159 - protein, 19 aa, Entamoeba histolytica
ILKEVKASVKILKANVSQS

SEQ ID NO: 2680160 - protein, 25 aa, Entamoeba histolytica
ILKEYCYLCNGFNYVHSVFILSASS

SEQ ID NO: 2680161 - protein, 24 aa, Entamoeba histolytica
ILKFMNTYCSLVFDSECINVAVAD

SEQ ID NO: 2680162 - protein, 19 aa, Entamoeba histolytica
ILKGVGHGPGVDWWSLGIL

SEQ ID NO: 2680163 - protein, 20 aa, Entamoeba histolytica
ILKILEAYSYEDERYFNHFI

SEQ ID NO: 2680164 - protein, 19 aa, Entamoeba histolytica
ILKILNFNGTIAIKEALLC

SEQ ID NO: 2680165 - protein, 22 aa, Entamoeba histolytica
ILKKIYCLYLITSRLIPNINIQ

SEQ ID NO: 2680166 - protein, 26 aa, Entamoeba histolytica
ILKKYEEILAQIVYFIISYNFIDCFD

SEQ ID NO: 2680167 - protein, 17 aa, Entamoeba histolytica
ILKLCSKIDSMSDINAM

SEQ ID NO: 2680168 - protein, 19 aa, Entamoeba histolytica
ILKMTKIVVDAHCQYRLGR

SEQ ID NO: 2680169 - protein, 17 aa, Entamoeba histolytica
ILKQCLKQISQRKFDLI

SEQ ID NO: 2680170 - protein, 21 aa, Entamoeba histolytica
ILKRCLEGISFLSEEEQRSFI

SEQ ID NO: 2680171 - protein, 22 aa, Entamoeba histolytica
ILKRKKCIDFSYNKKSKETKIS

SEQ ID NO: 2680172 - protein, 17 aa, Entamoeba histolytica
ILKRNVPLLPVDDKFSG

SEQ ID NO: 2680173 - protein, 23 aa, Entamoeba histolytica
ILLDPFALPAIQDFHSNKMTINI

SEQ ID NO: 2680174 - protein, 17 aa, Entamoeba histolytica
ILLEGFTAMFSVSDTIF

SEQ ID NO: 2680175 - protein, 18 aa, Entamoeba histolytica
ILLELRINQVERFVEVCK

SEQ ID NO: 2680176 - protein, 32 aa, Entamoeba histolytica
ILLEMCMSCVTRSEFILGIELIKKRQINETVS

SEQ ID NO: 2680177 - protein, 17 aa, Entamoeba histolytica
ILLEWINTKVWIILKSQ

SEQ ID NO: 2680178 - protein, 30 aa, Entamoeba histolytica
ILLEYFQIIFVLRKSFFERIGLADEYEQLN

SEQ ID NO: 2680179 - protein, 17 aa, Entamoeba histolytica
ILLGLLNVYCTIPSSLQ

SEQ ID NO: 2680180 - protein, 25 aa, Entamoeba histolytica
ILLGNGYGFAVDWWSYGTLIYEMLL

SEQ ID NO: 2680181 - protein, 17 aa, Entamoeba histolytica
ILLGRIFSIVGHVVSCK

SEQ ID NO: 2680182 - protein, 25 aa, Entamoeba histolytica
ILLKIFRVYMKIARYQTIGLGLSER

SEQ ID NO: 2680183 - protein, 18 aa, Entamoeba histolytica
ILLKKGNCQNCFHKESPF

SEQ ID NO: 2680184 - protein, 23 aa, Entamoeba histolytica
ILLKRIGEEVIYEIFNKKDFDYF

SEQ ID NO: 2680185 - protein, 19 aa, Entamoeba histolytica
ILLPCGIDINKWYNTSLTT

SEQ ID NO: 2680186 - protein, 23 aa, Entamoeba histolytica
ILLQRLSAEFPDMFVNCNLFCGC

SEQ ID NO: 2680187 - protein, 17 aa, Entamoeba histolytica
ILLSIRIPENIKEINRN

SEQ ID NO: 2680188 - protein, 17 aa, Entamoeba histolytica
ILLSKKIVEEFIRITQS

SEQ ID NO: 2680189 - protein, 23 aa, Entamoeba histolytica
ILLSSGICSKGYCIDDNYYEQEE

SEQ ID NO: 2680190 - protein, 19 aa, Entamoeba histolytica
ILLTKSFIMRNVNLMGVIK

SEQ ID NO: 2680191 - protein, 19 aa, Entamoeba histolytica
ILLWKSIDWGKVPLDQLQK

SEQ ID NO: 2680192 - protein, 17 aa, Entamoeba histolytica
ILLYKPSPLYILDEVDA

SEQ ID NO: 2680193 - protein, 19 aa, Entamoeba histolytica
ILLYKYMLHYLIFRKVSND

SEQ ID NO: 2680194 - protein, 21 aa, Entamoeba histolytica
ILMDPYLRGVREIPECCSPYE

SEQ ID NO: 2680195 - protein, 20 aa, Entamoeba histolytica
ILMNCLKYNGGDFDVLKLLG

SEQ ID NO: 2680196 - protein, 18 aa, Entamoeba histolytica
ILMNGGLFLGGINKIIEL

SEQ ID NO: 2680197 - protein, 17 aa, Entamoeba histolytica
ILMTLNLINKGIKVQKW

SEQ ID NO: 2680198 - protein, 19 aa, Entamoeba histolytica
ILNELKRKIEIELKVIVEE

SEQ ID NO: 2680199 - protein, 18 aa, Entamoeba histolytica
ILNERRKDVVVGLSDQKS

SEQ ID NO: 2680200 - protein, 20 aa, Entamoeba histolytica
ILNFQYYVAQVMDFSSQLAK

SEQ ID NO: 2680201 - protein, 24 aa, Entamoeba histolytica
ILNICPYSLLLHSISFDKTNYLIT

SEQ ID NO: 2680202 - protein, 26 aa, Entamoeba histolytica
ILNKFEWNKIRVIIKCFDLREEHITW

SEQ ID NO: 2680203 - protein, 20 aa, Entamoeba histolytica
ILNKKGDWWQGECQGNIGFF

SEQ ID NO: 2680204 - protein, 17 aa, Entamoeba histolytica
ILNLCEFMEREGIKVPI

SEQ ID NO: 2680205 - protein, 31 aa, Entamoeba histolytica
ILNLYWLVRLDCFEISSLQCPACRVDLSIAN

SEQ ID NO: 2680206 - protein, 17 aa, Entamoeba histolytica
ILNNFKFDDRSCVDLKD

SEQ ID NO: 2680207 - protein, 18 aa, Entamoeba histolytica
ILNPRMVYANALRQRLKD

SEQ ID NO: 2680208 - protein, 18 aa, Entamoeba histolytica
ILNQIGIYEKLRGEDDAK

SEQ ID NO: 2680209 - protein, 25 aa, Entamoeba histolytica
ILNRYRLELLSGKVPIFCSGGITGI

SEQ ID NO: 2680210 - protein, 22 aa, Entamoeba histolytica
ILPCGLCIELLGAIHEMKHLNQ

SEQ ID NO: 2680211 - protein, 19 aa, Entamoeba histolytica
ILPDVIPFARKTRNEFNNE

SEQ ID NO: 2680212 - protein, 23 aa, Entamoeba histolytica
ILPEEQTLLIGYTLSFEFKQNPY

SEQ ID NO: 2680213 - protein, 17 aa, Entamoeba histolytica
ILPFPPFLETSVFHHDI

SEQ ID NO: 2680214 - protein, 18 aa, Entamoeba histolytica
ILPFVKEHMSLFINLKIF

SEQ ID NO: 2680215 - protein, 27 aa, Entamoeba histolytica
ILPHLSQSLMCWKELNTILKDEEFKSQ

SEQ ID NO: 2680216 - protein, 23 aa, Entamoeba histolytica
ILPKEPLIWIAAARIEEIKGHNP

SEQ ID NO: 2680217 - protein, 17 aa, Entamoeba histolytica
ILPSAINPLIGGRILHG

SEQ ID NO: 2680218 - protein, 21 aa, Entamoeba histolytica
ILPSSLQKLFIFSSKFTIPNL

SEQ ID NO: 2680219 - protein, 21 aa, Entamoeba histolytica
ILPSYPSLFNYKVIKVPDLPT

SEQ ID NO: 2680220 - protein, 24 aa, Entamoeba histolytica
ILPTKLEAVIPLIFHDASVTKSVG

SEQ ID NO: 2680221 - protein, 23 aa, Entamoeba histolytica
ILPVQRLPRYILLLETLLKSTPE

SEQ ID NO: 2680222 - protein, 23 aa, Entamoeba histolytica
ILPVQRLPRYVLLLESLLKATPP

SEQ ID NO: 2680223 - protein, 17 aa, Entamoeba histolytica
ILQDLRDGPNIIQLYDV

SEQ ID NO: 2680224 - protein, 17 aa, Entamoeba histolytica
ILQFSIVDDRIWMRNYQ

SEQ ID NO: 2680225 - protein, 28 aa, Entamoeba histolytica
ILQKCSYFEVIIPFLLFADCRLIVTSNT

SEQ ID NO: 2680226 - protein, 30 aa, Entamoeba histolytica
ILQLKALYREYGVVVPLVLMNSFSTNVETE

SEQ ID NO: 2680227 - protein, 18 aa, Entamoeba histolytica
ILQLKFKGLLISTRKYSF

SEQ ID NO: 2680228 - protein, 30 aa, Entamoeba histolytica
ILQPKQDIVFCYPPPPLFIAERGQFSNYLD

SEQ ID NO: 2680229 - protein, 27 aa, Entamoeba histolytica
ILQPRGTRTKTLPCLNSNGRLCSLETD

SEQ ID NO: 2680230 - protein, 17 aa, Entamoeba histolytica
ILQQMIAGFQQEANELW

SEQ ID NO: 2680231 - protein, 25 aa, Entamoeba histolytica
ILQSLDFSNCLQLKQLSNFNVYCKS

SEQ ID NO: 2680232 - protein, 21 aa, Entamoeba histolytica
ILRDPRPLQQMIALDTLQASV

SEQ ID NO: 2680233 - protein, 17 aa, Entamoeba histolytica
ILRGLYTIRGELTTTSQ

SEQ ID NO: 2680234 - protein, 19 aa, Entamoeba histolytica
ILRHPKTKYSRVILIRDQI

SEQ ID NO: 2680235 - protein, 20 aa, Entamoeba histolytica
ILRIFKKPYLTFGDKTGIIQ

SEQ ID NO: 2680236 - protein, 23 aa, Entamoeba histolytica
ILRLKRKESKVIDLEKELNQLEL

SEQ ID NO: 2680237 - protein, 19 aa, Entamoeba histolytica
ILRRFSRRILVDLPTKEDR

SEQ ID NO: 2680238 - protein, 22 aa, Entamoeba histolytica
ILRSRLNQLAIKYKHLYLTNTE

SEQ ID NO: 2680239 - protein, 27 aa, Entamoeba histolytica
ILRSRLNQLAIKYKYLYLTNTEILLGI

SEQ ID NO: 2680240 - protein, 25 aa, Entamoeba histolytica
ILRVGGKICCFCPCIEQIQKSCQEL

SEQ ID NO: 2680241 - protein, 19 aa, Entamoeba histolytica
ILSALCYIHSNGIGHRDLK

SEQ ID NO: 2680242 - protein, 18 aa, Entamoeba histolytica
ILSDIPYPDWKEGEEPPH

SEQ ID NO: 2680243 - protein, 17 aa, Entamoeba histolytica
ILSDYCFYLEELYGTAD

SEQ ID NO: 2680244 - protein, 34 aa, Entamoeba histolytica
ILSELWMCGLIQYETPILCFWNNDKTLAIHLFSS

SEQ ID NO: 2680245 - protein, 20 aa, Entamoeba histolytica
ILSILQLSSIRIIYNNNEIN

SEQ ID NO: 2680246 - protein, 18 aa, Entamoeba histolytica
ILSKGYRTTKGFCDLIYQ

SEQ ID NO: 2680247 - protein, 24 aa, Entamoeba histolytica
ILSKKFDLCDLVLSKAYAQFSGRD

SEQ ID NO: 2680248 - protein, 25 aa, Entamoeba histolytica
ILSKQRFASLTGMNVEWDFVELPSQ

SEQ ID NO: 2680249 - protein, 17 aa, Entamoeba histolytica
ILSLDGFSDNPILQIYI

SEQ ID NO: 2680250 - protein, 18 aa, Entamoeba histolytica
ILSLYLKLFKTCTISVRP

SEQ ID NO: 2680251 - protein, 19 aa, Entamoeba histolytica
ILSNLNHRFCVYYDDGREA

SEQ ID NO: 2680252 - protein, 17 aa, Entamoeba histolytica
ILSQWYLILCELSKILQ

SEQ ID NO: 2680253 - protein, 19 aa, Entamoeba histolytica
ILTAKGYGIEVDWWSLGVV

SEQ ID NO: 2680254 - protein, 26 aa, Entamoeba histolytica
ILTDLKDGLILIRFLTNLSGKEILKT

SEQ ID NO: 2680255 - protein, 17 aa, Entamoeba histolytica
ILTGCFILIQGKTVSVI

SEQ ID NO: 2680256 - protein, 20 aa, Entamoeba histolytica
ILTIISMINLSCEIHLYVDE

SEQ ID NO: 2680257 - protein, 30 aa, Entamoeba histolytica
ILTKNKWCYRDLTFKMAHPSSHISSFNIKL

SEQ ID NO: 2680258 - protein, 20 aa, Entamoeba histolytica
ILTLPGCLIILPTLIECLNT

SEQ ID NO: 2680259 - protein, 24 aa, Entamoeba histolytica
ILTRISTREIVGFVQTTISLAPSL

SEQ ID NO: 2680260 - protein, 18 aa, Entamoeba histolytica
ILTTDPWSSVYYTSEDWT

SEQ ID NO: 2680261 - protein, 21 aa, Entamoeba histolytica
ILVCQKCSGVHRGLGVQISKV

SEQ ID NO: 2680262 - protein, 18 aa, Entamoeba histolytica
ILVEYGLMNLVFRHQYEN

SEQ ID NO: 2680263 - protein, 26 aa, Entamoeba histolytica
ILVHICEYGTICLRTLNIIENHSKKM

SEQ ID NO: 2680264 - protein, 23 aa, Entamoeba histolytica
ILVNGFLKRGDRIVVCGMNGPIV

SEQ ID NO: 2680265 - protein, 25 aa, Entamoeba histolytica
ILWAILRIVNSVAFIIETTEGDVFG

SEQ ID NO: 2680266 - protein, 31 aa, Entamoeba histolytica; identical to SEQ ID NO: 2487060

SEQ ID NO: 2680267 - protein, 18 aa, Entamoeba histolytica
ILYKKLLDIPLTFDDYNI

SEQ ID NO: 2680268 - protein, 18 aa, Entamoeba histolytica
ILYKPGIVNGGNFQHTCN

SEQ ID NO: 2680269 - protein, 19 aa, Entamoeba histolytica
ILYTRNQKYIFAFEKTSRS

SEQ ID NO: 2680270 - protein, 23 aa, Entamoeba histolytica
ILYWIKAELISTINYSLYQYNKT

SEQ ID NO: 2680271 - protein, 18 aa, Entamoeba histolytica
IMCTKDCRCQLLEQLTSR

SEQ ID NO: 2680272 - protein, 18 aa, Entamoeba histolytica
IMDQSLPFFMFEWNYLWF

SEQ ID NO: 2680273 - protein, 24 aa, Entamoeba histolytica
IMEDKRALYALAIHLLKNQDVNHA

SEQ ID NO: 2680274 - protein, 20 aa, Entamoeba histolytica
IMELCNAGSLKDIIKTLNTP

SEQ ID NO: 2680275 - protein, 29 aa, Entamoeba histolytica
IMELSKGCFRVCDFLKSFTFNSIIVSIPD

SEQ ID NO: 2680276 - protein, 19 aa, Entamoeba histolytica
IMFHSDLRESVGIMENCNG

SEQ ID NO: 2680277 - protein, 19 aa, Entamoeba histolytica
IMFKNGLLQRFFSYFSSGT

SEQ ID NO: 2680278 - protein, 25 aa, Entamoeba histolytica
IMFTRLVCLTNLLIDDIVSIPSVMK

SEQ ID NO: 2680279 - protein, 26 aa, Entamoeba histolytica
IMFVDACVRKGILPIMLEEMLSTRQH

SEQ ID NO: 2680280 - protein, 21 aa, Entamoeba histolytica
IMGGGDGFPGLGFNRSLEGQT

SEQ ID NO: 2680281 - protein, 19 aa, Entamoeba histolytica
IMGGPAPIRPKPVEQKNEE

SEQ ID NO: 2680282 - protein, 18 aa, Entamoeba histolytica
IMGLKLSDPLLRLDALVS

SEQ ID NO: 2680283 - protein, 20 aa, Entamoeba histolytica
IMGRIDLPFIQRIYNSYMGF

SEQ ID NO: 2680284 - protein, 25 aa, Entamoeba histolytica
IMGYKKEKRVCIVYLVVGNCTQKVN

SEQ ID NO: 2680285 - protein, 17 aa, Entamoeba histolytica
IMIGLLVTNNFREGMKV

SEQ ID NO: 2680286 - protein, 17 aa, Entamoeba histolytica
IMIGYKVKPCGIISSLI

SEQ ID NO: 2680287 - protein, 23 aa, Entamoeba histolytica
IMIKLSPLYLSSGFIPVDYFTQF

SEQ ID NO: 2680288 - protein, 19 aa, Entamoeba histolytica
IMISGGFMRTFGVDLFIKL

SEQ ID NO: 2680289 - protein, 34 aa, Entamoeba histolytica
IMKAEKEIEELKKFVQQMSVVKDQMIDVVTQIEK

SEQ ID NO: 2680290 - protein, 30 aa, Entamoeba histolytica
IMKDFVRYYPEYLWYPFLTLIISKLEEPNF

SEQ ID NO: 2680291 - protein, 22 aa, Entamoeba histolytica
IMKDPYVIYAILDLIHSHYQIL

SEQ ID NO: 2680292 - protein, 21 aa, Entamoeba histolytica
IMKDPYVIYAILDSIHSHYQI

SEQ ID NO: 2680293 - protein, 18 aa, Entamoeba histolytica
IMKDRKIDWELSQSRVRE

SEQ ID NO: 2680294 - protein, 29 aa, Entamoeba histolytica
IMKFPGLLPDIYIKHFLGDIALGLRYLHF

SEQ ID NO: 2680295 - protein, 32 aa, Entamoeba histolytica
IMKGGCSILTLCFCKSPLTSQMIIQFIGSSLQ

SEQ ID NO: 2680296 - protein, 24 aa, Entamoeba histolytica
IMKLVAKCYMEWQHKNISNEQIYA

SEQ ID NO: 2680297 - protein, 19 aa, Entamoeba histolytica
IMLKNAFAAREQWIAQNPE

SEQ ID NO: 2680298 - protein, 22 aa, Entamoeba histolytica
IMLVCQDCFWRCTVQGGCEYIC

SEQ ID NO: 2680299 - protein, 19 aa, Entamoeba histolytica
IMLYRDFHHSYNLFIQFII

SEQ ID NO: 2680300 - protein, 19 aa, Entamoeba histolytica
IMNCYKRLKNNLIQPKSVE

SEQ ID NO: 2680301 - protein, 54 aa, Entamoeba histolytica
IMNGEPKPIITLMFYLMYRFRLNDTPVRIIDFSKWIKCILKINNPLFDLKTEFS

SEQ ID NO: 2680302 - protein, 17 aa, Entamoeba histolytica
IMNIFWVSFFNKIFHSV

SEQ ID NO: 2680303 - protein, 18 aa, Entamoeba histolytica
IMPKLALELKRKYYSQTK

SEQ ID NO: 2680304 - protein, 18 aa, Entamoeba histolytica
IMPLELRALISGLPFCVV

SEQ ID NO: 2680305 - protein, 24 aa, Entamoeba histolytica
IMPVQRLPRYSLLLTDLLKHTPTN

SEQ ID NO: 2680306 - protein, 24 aa, Entamoeba histolytica
IMQCDNCMGAIIGRYANRIYKGDL

SEQ ID NO: 2680307 - protein, 30 aa, Entamoeba histolytica; identical to SEQ ID NO: 2487106

SEQ ID NO: 2680308 - protein, 21 aa, Entamoeba histolytica
IMRHPRNVLEITTSIRRILLH

SEQ ID NO: 2680309 - protein, 17 aa, Entamoeba histolytica
IMSCYNFEECVHKLLSL

SEQ ID NO: 2680310 - protein, 25 aa, Entamoeba histolytica
IMSDLICLSPELKLCKSKDEQIKFF

SEQ ID NO: 2680311 - protein, 20 aa, Entamoeba histolytica
IMSKSLKPTAMIEPPKLPKR

SEQ ID NO: 2680312 - protein, 17 aa, Entamoeba histolytica
IMTKCILDNLFVICLSK

SEQ ID NO: 2680313 - protein, 20 aa, Entamoeba histolytica
IMTNEFLKGAVKLIFLNKMD

SEQ ID NO: 2680314 - protein, 24 aa, Entamoeba histolytica
IMTRGVAGIKMLGNAAMDCCYVAC

SEQ ID NO: 2680315 - protein, 21 aa, Entamoeba histolytica
IMTRNRYEWYILQFAMQRQGI

SEQ ID NO: 2680316 - protein, 17 aa, Entamoeba histolytica
IMTSLEYSSQFVNTKKS

SEQ ID NO: 2680317 - protein, 20 aa, Entamoeba histolytica
IMVKQAIGYPVKRYNEIMNF

SEQ ID NO: 2680318 - protein, 22 aa, Entamoeba histolytica
IMWGDCGIANFFINTEDLKASN

SEQ ID NO: 2680319 - protein, 23 aa, Entamoeba histolytica
IMWGDCGIANFFINTEDLKASNF

SEQ ID NO: 2680320 - protein, 23 aa, Entamoeba histolytica
IMYYRLLDQFTCIRSIRNITRIT

SEQ ID NO: 2680321 - protein, 25 aa, Entamoeba histolytica
INAGDCLKILQTVCMIFESDELAQH

SEQ ID NO: 2680322 - protein, 28 aa, Entamoeba histolytica
INAHPAWLKGCELMHIKPIIISADKRNA

SEQ ID NO: 2680323 - protein, 28 aa, Entamoeba histolytica
INALEWYSKELICYGMYIEKIKKIRELI

SEQ ID NO: 2680324 - protein, 18 aa, Entamoeba histolytica
INALIRYRALTLASSIIK

SEQ ID NO: 2680325 - protein, 24 aa, Entamoeba histolytica
INALKKSYLIEALTEIRSCDCSHN

SEQ ID NO: 2680326 - protein, 18 aa, Entamoeba histolytica
INALPRITSFSMQGITYS

SEQ ID NO: 2680327 - protein, 30 aa, Entamoeba histolytica
INALYKRAIEINSKFNILFVEFMQKSTDTS

SEQ ID NO: 2680328 - protein, 21 aa, Entamoeba histolytica
INARANLISKFIDVAKIMYEQ

SEQ ID NO: 2680329 - protein, 20 aa, Entamoeba histolytica
INASPFYTGFSMQRFPQMPI

SEQ ID NO: 2680330 - protein, 21 aa, Entamoeba histolytica
INCGLRHGYLTAITKEPAVIS

SEQ ID NO: 2680331 - protein, 27 aa, Entamoeba histolytica
INCIKRKCYIEYIFAYSVVDMNVMAKM

SEQ ID NO: 2680332 - protein, 18 aa, Entamoeba histolytica
INCNETLQFPDDVEIHDD

SEQ ID NO: 2680333 - protein, 20 aa, Entamoeba histolytica
INCYEEFRRSVICRSNLFFI

SEQ ID NO: 2680334 - protein, 24 aa, Entamoeba histolytica
INDADWCRYVHLFCIYCGKRYTSL

SEQ ID NO: 2680335 - protein, 17 aa, Entamoeba histolytica
INDDYAFCPTYPREIIV

SEQ ID NO: 2680336 - protein, 17 aa, Entamoeba histolytica
INDEVGKRFKAKKAQGD

SEQ ID NO: 2680337 - protein, 17 aa, Entamoeba histolytica
INDLICLLTTLTKSHSN

SEQ ID NO: 2680338 - protein, 24 aa, Entamoeba histolytica
INDLPRNCCIQSFLIDTGKDDTKR

SEQ ID NO: 2680339 - protein, 29 aa, Entamoeba histolytica
INDVPLPLCKEINQIFSLIDHYCKKVIIP

SEQ ID NO: 2680340 - protein, 25 aa, Entamoeba histolytica
INDWMICDALANKVVTQFLRSHEDY

SEQ ID NO: 2680341 - protein, 20 aa, Entamoeba histolytica
INDYRMSIATILEVSEEEDF

SEQ ID NO: 2680342 - protein, 25 aa, Entamoeba histolytica
INEFEPRFLFKVIEKEANQMVGKQN

SEQ ID NO: 2680343 - protein, 21 aa, Entamoeba histolytica
INELKQSISDIDVLKTENQTL

SEQ ID NO: 2680344 - protein, 17 aa, Entamoeba histolytica
INELLEFVMREAEKNQR

SEQ ID NO: 2680345 - protein, 18 aa, Entamoeba histolytica
INELLIKRLESIPKSSDL

SEQ ID NO: 2680346 - protein, 25 aa, Entamoeba histolytica
INELLPISTLWKWNEIVRKRQILEF

SEQ ID NO: 2680347 - protein, 23 aa, Entamoeba histolytica
INELRMTWKTNRYKYLTKALITK

SEQ ID NO: 2680348 - protein, 18 aa, Entamoeba histolytica
INEMLWLVMEYMDGGCLT

SEQ ID NO: 2680349 - protein, 18 aa, Entamoeba histolytica
INEMYLFNPISISSLNLF

SEQ ID NO: 2680350 - protein, 25 aa, Entamoeba histolytica
INEPKFASLYVEFFIQVKRNPKIYD

SEQ ID NO: 2680351 - protein, 24 aa, Entamoeba histolytica
INEQRLNGLLNMFTGIVYEHQIIS

SEQ ID NO: 2680352 - protein, 23 aa, Entamoeba histolytica
INESKKRINEMVNKKTEIQCTLQ

SEQ ID NO: 2680353 - protein, 26 aa, Entamoeba histolytica
INETKRFSLQFALKCAEERGLKEVKI

SEQ ID NO: 2680354 - protein, 31 aa, Entamoeba histolytica; identical to SEQ ID NO: 2487160

SEQ ID NO: 2680355 - protein, 18 aa, Entamoeba histolytica
INFAMFLTAIQRWLHLKM

SEQ ID NO: 2680356 - protein, 27 aa, Entamoeba histolytica
INFCKEYSIPLAHKGYCEVKMLDTANQ

SEQ ID NO: 2680357 - protein, 22 aa, Entamoeba histolytica
INFIEQCYRKSMKDFNEINNRE

SEQ ID NO: 2680358 - protein, 17 aa, Entamoeba histolytica
INFIKCQKLSAIAQNVL

SEQ ID NO: 2680359 - protein, 21 aa, Entamoeba histolytica
INFKIVKRFLHLVGKEEKQLL

SEQ ID NO: 2680360 - protein, 23 aa, Entamoeba histolytica
INFKKRGDVIVSIGSPKSSSTSG

SEQ ID NO: 2680361 - protein, 17 aa, Entamoeba histolytica
INFLDERFVLHYLHSIL

SEQ ID NO: 2680362 - protein, 23 aa, Entamoeba histolytica
INFPMHFSNLFIDHCESLTTLLL

SEQ ID NO: 2680363 - protein, 27 aa, Entamoeba histolytica
INFPTEFPEEPAVFVFHLSVTGTSSKV

SEQ ID NO: 2680364 - protein, 21 aa, Entamoeba histolytica
INFTEIFPRLGDNLELVNFVE

SEQ ID NO: 2680365 - protein, 21 aa, Entamoeba histolytica
INFYFKQIITGIQYIHSKNII

SEQ ID NO: 2680366 - protein, 21 aa, Entamoeba histolytica
INGDCSIAWNKRFELKINEIS

SEQ ID NO: 2680367 - protein, 26 aa, Entamoeba histolytica
INGEIKYSKALFQFGLSYITSDGSKR

SEQ ID NO: 2680368 - protein, 25 aa, Entamoeba histolytica
INGEMKKIIGGFIIHENLKFKEMEC

SEQ ID NO: 2680369 - protein, 18 aa, Entamoeba histolytica
INGFFLIPEKGSWNYSLS

SEQ ID NO: 2680370 - protein, 17 aa, Entamoeba histolytica
INGGISAVSPGLFDEIW

SEQ ID NO: 2680371 - protein, 26 aa, Entamoeba histolytica
INGGRKATVGLGFVDRSNAFDFSAVL

SEQ ID NO: 2680372 - protein, 22 aa, Entamoeba histolytica
INGISGMMLIEYYINMNYLDGI

SEQ ID NO: 2680373 - protein, 25 aa, Entamoeba histolytica
INGIWCECGKIIPVDFENVPQALDL

SEQ ID NO: 2680374 - protein, 17 aa, Entamoeba histolytica
INGKITYALEGTVMTAG

SEQ ID NO: 2680375 - protein, 22 aa, Entamoeba histolytica
INGKTPLHFAVQGGRLTLTRIL

SEQ ID NO: 2680376 - protein, 27 aa, Entamoeba histolytica
INGKVIPNCLGNIWVCVKDWSEEDGRC

SEQ ID NO: 2680377 - protein, 32 aa, Entamoeba histolytica
INGKVIPNCLGNIWVYVRDWSEEDGRCGKFNV

SEQ ID NO: 2680378 - protein, 19 aa, Entamoeba histolytica
INGKYSILFDLTGVNYNLK

SEQ ID NO: 2680379 - protein, 18 aa, Entamoeba histolytica
INGLRIVGVSGIYKSFDE

SEQ ID NO: 2680380 - protein, 25 aa, Entamoeba histolytica
INGMSKYIVWYGCGLKTVKYYQIYY

SEQ ID NO: 2680381 - protein, 22 aa, Entamoeba histolytica
INGNLLGLCYGNFLNHMGSLVE

SEQ ID NO: 2680382 - protein, 19 aa, Entamoeba histolytica
INGPLRLETKIHHKNKEIM

SEQ ID NO: 2680383 - protein, 20 aa, Entamoeba histolytica
INGQNKIFCKVKEEEVVCEK

SEQ ID NO: 2680384 - protein, 18 aa, Entamoeba histolytica
INGSRFAIPRSCLQKPVA

SEQ ID NO: 2680385 - protein, 18 aa, Entamoeba histolytica
INHCFICLLDNNSFHYLI

SEQ ID NO: 2680386 - protein, 19 aa, Entamoeba histolytica
INHPTVPLMRERGGKKCIC

SEQ ID NO: 2680387 - protein, 24 aa, Entamoeba histolytica
INHRPATCTMWKKWQELIQKDGLN

SEQ ID NO: 2680388 - protein, 20 aa, Entamoeba histolytica
INHWKDVSSMVLGRTRKQCR

SEQ ID NO: 2680389 - protein, 22 aa, Entamoeba histolytica
INHYKALFVQNVFTQGKEPIGF

SEQ ID NO: 2680390 - protein, 17 aa, Entamoeba histolytica
INICGKLAKGLPRSPRI

SEQ ID NO: 2680391 - protein, 25 aa, Entamoeba histolytica
INIDKVKSLPIFKWIISGGTMPEKG

SEQ ID NO: 2680392 - protein, 17 aa, Entamoeba histolytica
INIEGSIYFKTGDIGEI

SEQ ID NO: 2680393 - protein, 19 aa, Entamoeba histolytica
INIGYRNRMDYTFGDGYIG

SEQ ID NO: 2680394 - protein, 17 aa, Entamoeba histolytica
INIIMRGKMIYKMVVEY

SEQ ID NO: 2680395 - protein, 25 aa, Entamoeba histolytica
INIKREWSDDFDLFFQNKEGLLSYS

SEQ ID NO: 2680396 - protein, 25 aa, Entamoeba histolytica
INIMKEVMIITKLIKCSDLMKRRTD

SEQ ID NO: 2680397 - protein, 22 aa, Entamoeba histolytica
INIMLEKHVHVFLGDKQLNLKG

SEQ ID NO: 2680398 - protein, 19 aa, Entamoeba histolytica
INIPFKRPSVESIRGHPLI

SEQ ID NO: 2680399 - protein, 17 aa, Entamoeba histolytica
INIPINCSVIFVTKRDY

SEQ ID NO: 2680400 - protein, 18 aa, Entamoeba histolytica
INIPNERYSLSFQQDNSI

SEQ ID NO: 2680401 - protein, 23 aa, Entamoeba histolytica
INIQEKLGKYFGFKKNYNNLQVV

SEQ ID NO: 2680402 - protein, 22 aa, Entamoeba histolytica
INISLPCFVGLFNFVDSHIITT

SEQ ID NO: 2680403 - protein, 26 aa, Entamoeba histolytica
INKAFFDEKFHLMITNVLRTPPGYHC

SEQ ID NO: 2680404 - protein, 17 aa, Entamoeba histolytica
INKAISEISCWIENNSC

SEQ ID NO: 2680405 - protein, 22 aa, Entamoeba histolytica
INKCGQIPLYLLVRGDTEKELN

SEQ ID NO: 2680406 - protein, 22 aa, Entamoeba histolytica
INKDKMALLFIEEIKTSILEHL

SEQ ID NO: 2680407 - protein, 17 aa, Entamoeba histolytica
INKDRLGTCSLDTTVTV

SEQ ID NO: 2680408 - protein, 26 aa, Entamoeba histolytica
INKEAKQEAVVLFDYVSKGESQLSAE

SEQ ID NO: 2680409 - protein, 23 aa, Entamoeba histolytica
INKEEFTTFCGKNIIFPFNQNYK

SEQ ID NO: 2680410 - protein, 20 aa, Entamoeba histolytica
INKEVNCQMILSSKNERYII

SEQ ID NO: 2680411 - protein, 17 aa, Entamoeba histolytica
INKFSYWIEPIMSNFLY

SEQ ID NO: 2680412 - protein, 18 aa, Entamoeba histolytica
INKGKGGESVWLGIIDLE

SEQ ID NO: 2680413 - protein, 25 aa, Entamoeba histolytica
INKHKMEILPLIIIVTTLFEMYGDQ

SEQ ID NO: 2680414 - protein, 19 aa, Entamoeba histolytica
INKIEFYKPTQLSYSYQEK

SEQ ID NO: 2680415 - protein, 24 aa, Entamoeba histolytica
INKIFPFSFCENLLNDANFVCFCL

SEQ ID NO: 2680416 - protein, 17 aa, Entamoeba histolytica
INKINILMCESLTSINA

SEQ ID NO: 2680417 - protein, 17 aa, Entamoeba histolytica
INKKIGEKGMFAAVIKK

SEQ ID NO: 2680418 - protein, 25 aa, Entamoeba histolytica
INKKSEEGYLCYFKIELNYIHKIKQ

SEQ ID NO: 2680419 - protein, 20 aa, Entamoeba histolytica
INKKVVWRVPLMDSMKSAGD

SEQ ID NO: 2680420 - protein, 24 aa, Entamoeba histolytica
INKLCSMNKVEPLKVFLKSQQDGN

SEQ ID NO: 2680421 - protein, 33 aa, Entamoeba histolytica
INKLKLWLEMSIVRPRHCTIAFTGSINLNSQTE

SEQ ID NO: 2680422 - protein, 21 aa, Entamoeba histolytica
INKLLRWLIQRQKPIEGGFDG

SEQ ID NO: 2680423 - protein, 23 aa, Entamoeba histolytica
INKNTLWLIMRFLSKVIQNTSVN

SEQ ID NO: 2680424 - protein, 17 aa, Entamoeba histolytica
INKRKGIDMKNIENEKY

SEQ ID NO: 2680425 - protein, 18 aa, Entamoeba histolytica
INKVRWNKNGKWFLTCSK

SEQ ID NO: 2680426 - protein, 22 aa, Entamoeba histolytica
INLCIPEFIHFFSINVTQGHVQ

SEQ ID NO: 2680427 - protein, 17 aa, Entamoeba histolytica
INLEFEKVFFPYLLISK

SEQ ID NO: 2680428 - protein, 20 aa, Entamoeba histolytica
INLFNCYKLHKLTLRIGNVF

SEQ ID NO: 2680429 - protein, 23 aa, Entamoeba histolytica
INLFNYLPLCVLLLQPIGTFFLC

SEQ ID NO: 2680430 - protein, 27 aa, Entamoeba histolytica
INLFRGRKCKGCVNVSCDEVSIFINKD

SEQ ID NO: 2680431 - protein, 17 aa, Entamoeba histolytica
INLHSWESLNELWIETS

SEQ ID NO: 2680432 - protein, 19 aa, Entamoeba histolytica
INLIISILMLKYTVHSYWK

SEQ ID NO: 2680433 - protein, 24 aa, Entamoeba histolytica
INLKVLNALLIEWTSTSEGKAISH

SEQ ID NO: 2680434 - protein, 18 aa, Entamoeba histolytica
INLLRINHCKDYKKLYGL

SEQ ID NO: 2680435 - protein, 17 aa, Entamoeba histolytica
INLNHCISNDKSISSFF

SEQ ID NO: 2680436 - protein, 18 aa, Entamoeba histolytica
INLNHIWPEVKLPKFNEG

SEQ ID NO: 2680437 - protein, 30 aa, Entamoeba histolytica
INLNYTWGFSPGVFIEGRIAVKLTNETIRN

SEQ ID NO: 2680438 - protein, 21 aa, Entamoeba histolytica
INLQPLRGMNWKVYDNFDSFT

SEQ ID NO: 2680439 - protein, 17 aa, Entamoeba histolytica
INLRTLTDILIKTEIGS

SEQ ID NO: 2680440 - protein, 17 aa, Entamoeba histolytica
INLTSVFYKLDYTNNTT

SEQ ID NO: 2680441 - protein, 20 aa, Entamoeba histolytica
INLYFKELWGKSVEHKINNE

SEQ ID NO: 2680442 - protein, 25 aa, Entamoeba histolytica
INLYKWRKVYELTQQFLDARPTNPC

SEQ ID NO: 2680443 - protein, 17 aa, Entamoeba histolytica
INMKCGITHQIFPLFQS

SEQ ID NO: 2680444 - protein, 18 aa, Entamoeba histolytica
INMLQLIYQVPRKNEEQR

SEQ ID NO: 2680445 - protein, 18 aa, Entamoeba histolytica
INMPTSFKSSETLSLELL

SEQ ID NO: 2680446 - protein, 20 aa, Entamoeba histolytica
INNDDCKLHQKMFDEFRQLI

SEQ ID NO: 2680447 - protein, 24 aa, Entamoeba histolytica
INNFDMRPGMIIKELGLTRPIFQK

SEQ ID NO: 2680448 - protein, 23 aa, Entamoeba histolytica
INNIFKSSRIKSIHQLINQKYQP

SEQ ID NO: 2680449 - protein, 20 aa, Entamoeba histolytica
INNIPFYLNYPIIIIPHKIT

SEQ ID NO: 2680450 - protein, 20 aa, Entamoeba histolytica
INNKFNVLWVSGKMKGIDPV

SEQ ID NO: 2680451 - protein, 18 aa, Entamoeba histolytica
INNLIILLCECVESMNDI

SEQ ID NO: 2680452 - protein, 23 aa, Entamoeba histolytica
INNLPIDIIISFSNYHITIPPSQ

SEQ ID NO: 2680453 - protein, 22 aa, Entamoeba histolytica
INNQHSLWCCFYYSTNKISGSP

SEQ ID NO: 2680454 - protein, 24 aa, Entamoeba histolytica
INNRWLPSFLIEIELTRCKFESRL

SEQ ID NO: 2680455 - protein, 19 aa, Entamoeba histolytica
INNTVPYWDKTLIKYSTYT

SEQ ID NO: 2680456 - protein, 19 aa, Entamoeba histolytica
INNWTGLRCKEIIMDSKYD

SEQ ID NO: 2680457 - protein, 26 aa, Entamoeba histolytica
INNYKISYLLGVTHQFNYSHFQYDDN

SEQ ID NO: 2680458 - protein, 25 aa, Entamoeba histolytica
INPFEFHSFFYLRTVELSDEIKEIP

SEQ ID NO: 2680459 - protein, 17 aa, Entamoeba histolytica
INPHKLLGCVGQHDFPI

SEQ ID NO: 2680460 - protein, 26 aa, Entamoeba histolytica
INPIYQRLWFALGICCMQISDIAGAK

SEQ ID NO: 2680461 - protein, 19 aa, Entamoeba histolytica
INPMANFFIGVGIQQEEIE

SEQ ID NO: 2680462 - protein, 19 aa, Entamoeba histolytica
INPQEWFKTFRIQFVGEQG

SEQ ID NO: 2680463 - protein, 17 aa, Entamoeba histolytica
INQAKCLGEGLKVVTIY

SEQ ID NO: 2680464 - protein, 24 aa, Entamoeba histolytica
INQCVKPIIQYLVLCLIEKAKGAI

SEQ ID NO: 2680465 - protein, 23 aa, Entamoeba histolytica
INQEITVLNGYYVNDFVQLSEGV

SEQ ID NO: 2680466 - protein, 28 aa, Entamoeba histolytica
INQKCIYCLDGHCKRCSKEECYECEEGY

SEQ ID NO: 2680467 - protein, 24 aa, Entamoeba histolytica
INQKDRTMHLFSVFVPKEKTGIVY

SEQ ID NO: 2680468 - protein, 28 aa, Entamoeba histolytica
INQKSVRCHPCLPLTIVLQQQSSKLYYE

SEQ ID NO: 2680469 - protein, 22 aa, Entamoeba histolytica
INQKYSCIIIQPFSSGSFNDIG

SEQ ID NO: 2680470 - protein, 26 aa, Entamoeba histolytica
INQPAVYKLPSSEHYVVYGEPRNEYM

SEQ ID NO: 2680471 - protein, 18 aa, Entamoeba histolytica
INQPTALQFIGYHCFSGC

SEQ ID NO: 2680472 - protein, 26 aa, Entamoeba histolytica
INQQPILLKRIEFVRNLHEQYIVGLS

SEQ ID NO: 2680473 - protein, 18 aa, Entamoeba histolytica
INQTCKDLQKALVEELYK

SEQ ID NO: 2680474 - protein, 19 aa, Entamoeba histolytica
INQVIGFRSKGRIPAATWW

SEQ ID NO: 2680475 - protein, 21 aa, Entamoeba histolytica
INREIIKSLKLNSPELEEESL

SEQ ID NO: 2680476 - protein, 23 aa, Entamoeba histolytica
INRKDPFCQVIIIVNTRELARQT

SEQ ID NO: 2680477 - protein, 38 aa, Entamoeba histolytica
INRKQFCIHCGLCVCNGCYRGRFIFNGVNKRGCDRCMK

SEQ ID NO: 2680478 - protein, 19 aa, Entamoeba histolytica
INRLRLVLLTEEYMTTSSF

SEQ ID NO: 2680479 - protein, 18 aa, Entamoeba histolytica
INRNYSLKFISEVASHAV

SEQ ID NO: 2680480 - protein, 22 aa, Entamoeba histolytica
INRPNETTAYAFVKYDNTLSPS

SEQ ID NO: 2680481 - protein, 25 aa, Entamoeba histolytica
INRSKELFKYVLMYLTEGEVICNDK

SEQ ID NO: 2680482 - protein, 18 aa, Entamoeba histolytica
INRVFGFYDECIRRYDES

SEQ ID NO: 2680483 - protein, 22 aa, Entamoeba histolytica
INRWCNCTINFLSSSGCFKHWF

SEQ ID NO: 2680484 - protein, 24 aa, Entamoeba histolytica
INSDLLELRVRMDTVEKGSIVNDV

SEQ ID NO: 2680485 - protein, 18 aa, Entamoeba histolytica
INSDLSLLRQWTGKQTFR

SEQ ID NO: 2680486 - protein, 19 aa, Entamoeba histolytica
INSINFWSVETMKCIQSIP

SEQ ID NO: 2680487 - protein, 22 aa, Entamoeba histolytica
INSIWFSFVFPQIDPKNYITDP

SEQ ID NO: 2680488 - protein, 21 aa, Entamoeba histolytica
INSKGPKGYRLFVIICDNETD

SEQ ID NO: 2680489 - protein, 20 aa, Entamoeba histolytica
INSKIEFKDPIKVRASHDYL

SEQ ID NO: 2680490 - protein, 19 aa, Entamoeba histolytica
INSKSSFILQKLVAFHILF

SEQ ID NO: 2680491 - protein, 17 aa, Entamoeba histolytica
INSLPLYLFDKIVLEFD

SEQ ID NO: 2680492 - protein, 25 aa, Entamoeba histolytica
INSMKEVMGSLPFVETPFGLKTLYK

SEQ ID NO: 2680493 - protein, 18 aa, Entamoeba histolytica
INSNAFRQCVSLNNINIP

SEQ ID NO: 2680494 - protein, 18 aa, Entamoeba histolytica
INSPYLLQYRNWIYQQPE

SEQ ID NO: 2680495 - protein, 22 aa, Entamoeba histolytica
INSRYQSILQFIIQKQWIDYCI

SEQ ID NO: 2680496 - protein, 18 aa, Entamoeba histolytica
INSSSFFNVFIQELVNEE

SEQ ID NO: 2680497 - protein, 25 aa, Entamoeba histolytica
INSTEIQNHFPLFQIRDIFILPIQE

SEQ ID NO: 2680498 - protein, 22 aa, Entamoeba histolytica
INSTPLFIARLIQMRKELKEAL

SEQ ID NO: 2680499 - protein, 23 aa, Entamoeba histolytica
INSVIYFRLLSPFCISIGDIDSC

SEQ ID NO: 2680500 - protein, 20 aa, Entamoeba histolytica
INSWCSRDTSIWVCPICNSR

SEQ ID NO: 2680501 - protein, 18 aa, Entamoeba histolytica
INTDFLLLLIKKLITRNK

SEQ ID NO: 2680502 - protein, 28 aa, Entamoeba histolytica
INTKCFIYRNLKCLVIDEADRIMEVGFE

SEQ ID NO: 2680503 - protein, 24 aa, Entamoeba histolytica
INTKLIRTGICDHLIAVARENCDI

SEQ ID NO: 2680504 - protein, 23 aa, Entamoeba histolytica
INTPLRLICKGKILDPHKSLEQN

SEQ ID NO: 2680505 - protein, 17 aa, Entamoeba histolytica
INTQGSLVSDVHQETSE

SEQ ID NO: 2680506 - protein, 25 aa, Entamoeba histolytica
INTQIVRYMVRSCGSEEAYSTYCDC

SEQ ID NO: 2680507 - protein, 17 aa, Entamoeba histolytica
INTSCSIQIPKNEDYLN

SEQ ID NO: 2680508 - protein, 19 aa, Entamoeba histolytica
INTSLLRFGHSPEQQVYVL

SEQ ID NO: 2680509 - protein, 17 aa, Entamoeba histolytica
INVCETINFSKISVSEL

SEQ ID NO: 2680510 - protein, 23 aa, Entamoeba histolytica
INVDGKVCVLDILDTAGREEYQT

SEQ ID NO: 2680511 - protein, 19 aa, Entamoeba histolytica
INVGCHWLTVEGVQPLIPQ

SEQ ID NO: 2680512 - protein, 17 aa, Entamoeba histolytica
INVGFLLEHWRKVPRAF

SEQ ID NO: 2680513 - protein, 17 aa, Entamoeba histolytica
INVLPFIHNQKNLNDEN

SEQ ID NO: 2680514 - protein, 21 aa, Entamoeba histolytica
INVPRSSYKFTEDEINSKRSF

SEQ ID NO: 2680515 - protein, 19 aa, Entamoeba histolytica
INVRPLYRKLITQAPTTTY

SEQ ID NO: 2680516 - protein, 20 aa, Entamoeba histolytica
INVRWTDITAGFTVTDMDWI

SEQ ID NO: 2680517 - protein, 17 aa, Entamoeba histolytica
INVVPIETFFRIKNTND

SEQ ID NO: 2680518 - protein, 18 aa, Entamoeba histolytica
INWCKQIQFDCIQKINKN

SEQ ID NO: 2680519 - protein, 23 aa, Entamoeba histolytica
INYCSCGAVLTSSPCPFCGKTSS

SEQ ID NO: 2680520 - protein, 24 aa, Entamoeba histolytica
INYFFQCGNSIPNLDRNNYYEVYI

SEQ ID NO: 2680521 - protein, 18 aa, Entamoeba histolytica
INYLDLYLSDDFSQNTSV

SEQ ID NO: 2680522 - protein, 25 aa, Entamoeba histolytica
INYLVWKYSFEKRGIYLTKESYLKE

SEQ ID NO: 2680523 - protein, 23 aa, Entamoeba histolytica
INYPNALCSLSLINDTQLDSTLL

SEQ ID NO: 2680524 - protein, 19 aa, Entamoeba histolytica
INYSSKWIEIFISYLCQEL

SEQ ID NO: 2680525 - protein, 18 aa, Entamoeba histolytica
IPAIEPFLSTKIQDINDT

SEQ ID NO: 2680526 - protein, 17 aa, Entamoeba histolytica
IPAQRLETFQTHLTMPD

SEQ ID NO: 2680527 - protein, 21 aa, Entamoeba histolytica
IPCLYYCGLDMLKRMKNYSKL

SEQ ID NO: 2680528 - protein, 19 aa, Entamoeba histolytica
IPCPEEIKTLLIQLKDQCT

SEQ ID NO: 2680529 - protein, 17 aa, Entamoeba histolytica
IPCTYCYSEHSLLQSKY

SEQ ID NO: 2680530 - protein, 18 aa, Entamoeba histolytica
IPDGMEWEVFVKDVISPL

SEQ ID NO: 2680531 - protein, 22 aa, Entamoeba histolytica
IPDKSFYGYSVIFEKKDYNDYL

SEQ ID NO: 2680532 - protein, 23 aa, Entamoeba histolytica
IPDLELLEALRLENGNFSWASQS

SEQ ID NO: 2680533 - protein, 17 aa, Entamoeba histolytica
IPDLVAVLIAMTQRLML

SEQ ID NO: 2680534 - protein, 22 aa, Entamoeba histolytica
IPDNHPVLSPRSKAQSNQTIFT

SEQ ID NO: 2680535 - protein, 24 aa, Entamoeba histolytica
IPDSISWKTLCETISVYELPTQNC

SEQ ID NO: 2680536 - protein, 18 aa, Entamoeba histolytica
IPEATIAGIPVDKSPIDD

SEQ ID NO: 2680537 - protein, 26 aa, Entamoeba histolytica
IPEECRDFRSSLARVRQEEFEWATNN

SEQ ID NO: 2680538 - protein, 24 aa, Entamoeba histolytica
IPEEMRYGYDIINGCKHNDILEND

SEQ ID NO: 2680539 - protein, 21 aa, Entamoeba histolytica
IPEGKRLCVVSTDVAETSITI

SEQ ID NO: 2680540 - protein, 17 aa, Entamoeba histolytica
IPEGMLWENFVKDVISP

SEQ ID NO: 2680541 - protein, 27 aa, Entamoeba histolytica
IPEGRKFQIPLWLAITLQNYGYVRIIV

SEQ ID NO: 2680542 - protein, 26 aa, Entamoeba histolytica
IPEIKHFCPDVPFIIVATKSDLRQSQ

SEQ ID NO: 2680543 - protein, 24 aa, Entamoeba histolytica
IPELCLSPRVIRIGVHPKRAVSNG

SEQ ID NO: 2680544 - protein, 18 aa, Entamoeba histolytica
IPELTKIVQDWIRKLLKS

SEQ ID NO: 2680545 - protein, 23 aa, Entamoeba histolytica
IPENCFRMCDKLVSFNIPSSIEI

SEQ ID NO: 2680546 - protein, 26 aa, Entamoeba histolytica
IPENKRMEASILLDEFNKFNENEHIL

SEQ ID NO: 2680547 - protein, 28 aa, Entamoeba histolytica
IPENLALHLFRFRHYYLHHYFNTIGFFV

SEQ ID NO: 2680548 - protein, 23 aa, Entamoeba histolytica
IPEQNAKVFIRFRDGIVTFMEKV

SEQ ID NO: 2680549 - protein, 17 aa, Entamoeba histolytica
IPERVGVLLKISHLLNK

SEQ ID NO: 2680550 - protein, 21 aa, Entamoeba histolytica
IPESFTKFIIKRGLIETFIRR

SEQ ID NO: 2680551 - protein, 17 aa, Entamoeba histolytica
IPFDDSLLEIPRTLNSF

SEQ ID NO: 2680552 - protein, 21 aa, Entamoeba histolytica
IPFDKVHNGLCDCEDGSDENK

SEQ ID NO: 2680553 - protein, 25 aa, Entamoeba histolytica
IPFDYVSFYFFRIFFSNSILHLSFS

SEQ ID NO: 2680554 - protein, 25 aa, Entamoeba histolytica
IPFEFKTIHLFECFNPTLQINDSMN

SEQ ID NO: 2680555 - protein, 21 aa, Entamoeba histolytica
IPFFVSTGMIEQCINLGKKWM

SEQ ID NO: 2680556 - protein, 25 aa, Entamoeba histolytica
IPFHRKKEALLDFCRTENEPIEASM

SEQ ID NO: 2680557 - protein, 18 aa, Entamoeba histolytica
IPFIKFLSNLVFSNHEIR

SEQ ID NO: 2680558 - protein, 22 aa, Entamoeba histolytica
IPFLTRCCINLVTALQYLSSQN

SEQ ID NO: 2680559 - protein, 20 aa, Entamoeba histolytica
IPFNKCIISNDLLISLLNKI

SEQ ID NO: 2680560 - protein, 23 aa, Entamoeba histolytica
IPFNNCWPAKLFVQKIFTACNRL

SEQ ID NO: 2680561 - protein, 19 aa, Entamoeba histolytica
IPFSSFKLVSEFITKTPQT

SEQ ID NO: 2680562 - protein, 22 aa, Entamoeba histolytica
IPFTVCKLNQLRNFKLLMNEKL

SEQ ID NO: 2680563 - protein, 21 aa, Entamoeba histolytica
IPGDDPLFCICITRRELLQFP

SEQ ID NO: 2680564 - protein, 23 aa, Entamoeba histolytica
IPGDMKINCLCIGDDGNCTGCKC

SEQ ID NO: 2680565 - protein, 17 aa, Entamoeba histolytica
IPGIYGIIGLPLVLSVK

SEQ ID NO: 2680566 - protein, 17 aa, Entamoeba histolytica
IPGKICRSGPFFMNPDV

SEQ ID NO: 2680567 - protein, 20 aa, Entamoeba histolytica
IPGKYIFKTTMSDLMKIVLK

SEQ ID NO: 2680568 - protein, 20 aa, Entamoeba histolytica
IPGLNDLVCNQISFCHNQIE

SEQ ID NO: 2680569 - protein, 17 aa, Entamoeba histolytica
IPGNNRCAECGKLEPEW

SEQ ID NO: 2680570 - protein, 37 aa, Entamoeba histolytica
IPGVDPMYYFQIFKLFFKKYINSYEPLLNMLKEMNSE

SEQ ID NO: 2680571 - protein, 19 aa, Entamoeba histolytica
IPHDKAWIIRREFVRSMEY

SEQ ID NO: 2680572 - protein, 23 aa, Entamoeba histolytica
IPHEGAMCDLLWSDPDPATNDWK

SEQ ID NO: 2680573 - protein, 21 aa, Entamoeba histolytica
IPHFDFKYSSIYYKQLLIDLL

SEQ ID NO: 2680574 - protein, 17 aa, Entamoeba histolytica
IPHFDRYQKIILLSLSI

SEQ ID NO: 2680575 - protein, 20 aa, Entamoeba histolytica
IPHLTICLNHFSEPYYSNEI

SEQ ID NO: 2680576 - protein, 25 aa, Entamoeba histolytica
IPHQKIPFCRLTGMIKTTIKKDSDL

SEQ ID NO: 2680577 - protein, 27 aa, Entamoeba histolytica
IPHRSLPPKPLRSSVITSPLTNTSSQP

SEQ ID NO: 2680578 - protein, 26 aa, Entamoeba histolytica
IPHTIKCLICQQLIGIDSIFSHIVEH

SEQ ID NO: 2680579 - protein, 19 aa, Entamoeba histolytica
IPHYEFPEIVLKCLPVLPF

SEQ ID NO: 2680580 - protein, 17 aa, Entamoeba histolytica
IPICKRNDFEYTQGTEE

SEQ ID NO: 2680581 - protein, 17 aa, Entamoeba histolytica
IPIDISQFHFLKKCRIE

SEQ ID NO: 2680582 - protein, 19 aa, Entamoeba histolytica
IPIDLCILNNTISWEFDKG

SEQ ID NO: 2680583 - protein, 26 aa, Entamoeba histolytica
IPIGSFCVLDSIKIESSPTFLIVNKS

SEQ ID NO: 2680584 - protein, 22 aa, Entamoeba histolytica
IPIIIDSGYKFNCDGLIDFTVE

SEQ ID NO: 2680585 - protein, 17 aa, Entamoeba histolytica
IPIILDYQVHILNNSMY

SEQ ID NO: 2680586 - protein, 20 aa, Entamoeba histolytica
IPIIRARNGSLEDVIAKELT

SEQ ID NO: 2680587 - protein, 21 aa, Entamoeba histolytica
IPIKISSHYLLPKGIPFITFL

SEQ ID NO: 2680588 - protein, 19 aa, Entamoeba histolytica
IPILCSFRPDTFSLIYSIK

SEQ ID NO: 2680589 - protein, 28 aa, Entamoeba histolytica
IPILKEIIKSCFVIINILPQYFIQQQFI

SEQ ID NO: 2680590 - protein, 19 aa, Entamoeba histolytica
IPILQPLHVYVCQNHLDEI

SEQ ID NO: 2680591 - protein, 24 aa, Entamoeba histolytica
IPIMLNEWYSIYLLHKNDGSFQIQ

SEQ ID NO: 2680592 - protein, 20 aa, Entamoeba histolytica
IPINCSVIFVTKRDYNEDMI

SEQ ID NO: 2680593 - protein, 21 aa, Entamoeba histolytica
IPIQSCVISRECGFDVNIWVC

SEQ ID NO: 2680594 - protein, 18 aa, Entamoeba histolytica
IPIRDDIKMEKALTPFSS

SEQ ID NO: 2680595 - protein, 20 aa, Entamoeba histolytica
IPIRLKVMGLLRMWIQNRKF

SEQ ID NO: 2680596 - protein, 33 aa, Entamoeba histolytica
IPITIEVSLCFACQFHLLRLLYYKNLSIPIENA

SEQ ID NO: 2680597 - protein, 18 aa, Entamoeba histolytica
IPIVAGIDELVQFGKQHQ

SEQ ID NO: 2680598 - protein, 18 aa, Entamoeba histolytica
IPIVAGIDELVQFGKQHR

SEQ ID NO: 2680599 - protein, 17 aa, Entamoeba histolytica
IPIVKKTICDMFGEKKI

SEQ ID NO: 2680600 - protein, 21 aa, Entamoeba histolytica
IPIVVCGSCDGTMRIYKIENG

SEQ ID NO: 2680601 - protein, 21 aa, Entamoeba histolytica
IPIYNMIYDWVLQGTFNDPFH

SEQ ID NO: 2680602 - protein, 19 aa, Entamoeba histolytica
IPKDFAFEDQEGFKISSGD

SEQ ID NO: 2680603 - protein, 26 aa, Entamoeba histolytica
IPKDFVFEDLEGFKIPIDDEQSLKLT

SEQ ID NO: 2680604 - protein, 19 aa, Entamoeba histolytica
IPKECCVFCEKELEKEEDI

SEQ ID NO: 2680605 - protein, 22 aa, Entamoeba histolytica
IPKEIWRLCDYVLPFMHDPTFI

SEQ ID NO: 2680606 - protein, 22 aa, Entamoeba histolytica
IPKEPSQALSMLKTNKKKVKER

SEQ ID NO: 2680607 - protein, 19 aa, Entamoeba histolytica
IPKETPINSSFNITQSTST

SEQ ID NO: 2680608 - protein, 21 aa, Entamoeba histolytica
IPKHLFLSTCLHRFKFSQQKL

SEQ ID NO: 2680609 - protein, 20 aa, Entamoeba histolytica
IPKIKLGINIDPFIAQLSKR

SEQ ID NO: 2680610 - protein, 34 aa, Entamoeba histolytica
IPKLLKCKKCGGLLTQACFMRCCKNTLCEECLNE

SEQ ID NO: 2680611 - protein, 22 aa, Entamoeba histolytica
IPKLYCNGALDGDEVSISILSP

SEQ ID NO: 2680612 - protein, 22 aa, Entamoeba histolytica
IPKPFTQRIFSIFPEKISFETV

SEQ ID NO: 2680613 - protein, 24 aa, Entamoeba histolytica
IPKSNKFVAPFSFKTLIETTKKGL

SEQ ID NO: 2680614 - protein, 17 aa, Entamoeba histolytica
IPKSRYVILNKLHSARF

SEQ ID NO: 2680615 - protein, 22 aa, Entamoeba histolytica
IPKTSVFNIEFAKAKLAGYAPN

SEQ ID NO: 2680616 - protein, 21 aa, Entamoeba histolytica
IPKVDGIECKAQREIGELTTI

SEQ ID NO: 2680617 - protein, 32 aa, Entamoeba histolytica
IPKYKTCYFTVWRYYGIFLIPMCCYISQGAKD

SEQ ID NO: 2680618 - protein, 19 aa, Entamoeba histolytica
IPLACSIGTTVIVNNLFDK

SEQ ID NO: 2680619 - protein, 17 aa, Entamoeba histolytica
IPLDFTNKCELDYLGVK

SEQ ID NO: 2680620 - protein, 19 aa, Entamoeba histolytica
IPLDQMRVEISQFKGNIDE

SEQ ID NO: 2680621 - protein, 18 aa, Entamoeba histolytica
IPLELATCIEPVRRYKKH

SEQ ID NO: 2680622 - protein, 17 aa, Entamoeba histolytica
IPLELKDKLHLILPYKE

SEQ ID NO: 2680623 - protein, 18 aa, Entamoeba histolytica
IPLFAYKLIKETSPTFQL

SEQ ID NO: 2680624 - protein, 19 aa, Entamoeba histolytica
IPLFPNLQTFYVRRCPSRL

SEQ ID NO: 2680625 - protein, 20 aa, Entamoeba histolytica
IPLGCNFSLLTHLDLSQNNL

SEQ ID NO: 2680626 - protein, 17 aa, Entamoeba histolytica
IPLKIMGFRLERPQLIF

SEQ ID NO: 2680627 - protein, 23 aa, Entamoeba histolytica
IPLKKRKEQIIVITHQAKDEDSM

SEQ ID NO: 2680628 - protein, 18 aa, Entamoeba histolytica
IPLKRISLSYLDDFDPHF

SEQ ID NO: 2680629 - protein, 17 aa, Entamoeba histolytica
IPLLSSNYHEWFSSISS

SEQ ID NO: 2680630 - protein, 19 aa, Entamoeba histolytica
IPLNECFVSTTLQLDNEFR

SEQ ID NO: 2680631 - protein, 21 aa, Entamoeba histolytica
IPLNHYKMFSSNFFSNNNEQT

SEQ ID NO: 2680632 - protein, 38 aa, Entamoeba histolytica
IPLNRMLMFISIFYLECFRCSQLRFEYITDYLDDSVVE

SEQ ID NO: 2680633 - protein, 20 aa, Entamoeba histolytica
IPLQCIKVHFCNEIFCQVQT

SEQ ID NO: 2680634 - protein, 25 aa, Entamoeba histolytica
IPLRMMRICRASFEKVIEALEKKLN

SEQ ID NO: 2680635 - protein, 22 aa, Entamoeba histolytica
IPLRNLCLLGNPLPQVDSLFLI

SEQ ID NO: 2680636 - protein, 19 aa, Entamoeba histolytica
IPLTPSILGKQCFSGNTKL

SEQ ID NO: 2680637 - protein, 24 aa, Entamoeba histolytica
IPLVALNCLVEYGSFDERYGDIDL

SEQ ID NO: 2680638 - protein, 19 aa, Entamoeba histolytica
IPLVSSMGAGGRFDPTKIQ

SEQ ID NO: 2680639 - protein, 25 aa, Entamoeba histolytica
IPMPAILKPIPKWTGKQVVTAILMH

SEQ ID NO: 2680640 - protein, 22 aa, Entamoeba histolytica
IPNAIVGYSSMQGWRKTMEDAH

SEQ ID NO: 2680641 - protein, 25 aa, Entamoeba histolytica
IPNLNILNGLQIINGFQFFGQSFPF

SEQ ID NO: 2680642 - protein, 17 aa, Entamoeba histolytica
IPNLQVFMLMKGLATKK

SEQ ID NO: 2680643 - protein, 24 aa, Entamoeba histolytica
IPNPQSFGTFLFRKEQSIHDKKLY

SEQ ID NO: 2680644 - protein, 17 aa, Entamoeba histolytica
IPNRLLPPNVCISNATI

SEQ ID NO: 2680645 - protein, 21 aa, Entamoeba histolytica
IPNSFTGIGTYCFSECTNLTQ

SEQ ID NO: 2680646 - protein, 17 aa, Entamoeba histolytica
IPNSTKFVIILPQRQYI

SEQ ID NO: 2680647 - protein, 41 aa, Entamoeba histolytica
IPNSYPKFDEFFTQLHLYCLKNPFFYYEIDNEYLYVKTRLN

SEQ ID NO: 2680648 - protein, 19 aa, Entamoeba histolytica
IPPDITYLFLGDYVDRGKF

SEQ ID NO: 2680649 - protein, 23 aa, Entamoeba histolytica
IPPKEEILIEVELTLVQKKYYRA

SEQ ID NO: 2680650 - protein, 22 aa, Entamoeba histolytica
IPPNCFLECISLQNIVIPEGIN

SEQ ID NO: 2680651 - protein, 20 aa, Entamoeba histolytica
IPPPILPKVDGIGIENTLSS

SEQ ID NO: 2680652 - protein, 18 aa, Entamoeba histolytica
IPPRHAFLPLYQAHFDSD

SEQ ID NO: 2680653 - protein, 20 aa, Entamoeba histolytica
IPPSPLLPIIANLAAQKQLS

SEQ ID NO: 2680654 - protein, 17 aa, Entamoeba histolytica
IPPTGAYCELLWSDPDE

SEQ ID NO: 2680655 - protein, 20 aa, Entamoeba histolytica
IPPTKFVKKSIFGPSVGINF

SEQ ID NO: 2680656 - protein, 20 aa, Entamoeba histolytica
IPQCLDFIGDIGLGSFVDPV

SEQ ID NO: 2680657 - protein, 22 aa, Entamoeba histolytica
IPQCPIVYCGTFNPFHKAHKKI

SEQ ID NO: 2680658 - protein, 20 aa, Entamoeba histolytica
IPQEGIIDVIGWIDNNRKNS

SEQ ID NO: 2680659 - protein, 20 aa, Entamoeba histolytica
IPQFPEFLVIRSNIQSKKFD

SEQ ID NO: 2680660 - protein, 31 aa, Entamoeba histolytica
IPQFPFKCFPLNRLERVCISFHKSFGYYYDF

SEQ ID NO: 2680661 - protein, 17 aa, Entamoeba histolytica
IPQHSVDIPLYLDEVTF

SEQ ID NO: 2680662 - protein, 19 aa, Entamoeba histolytica
IPQIFCKEVALNVFPSFMK

SEQ ID NO: 2680663 - protein, 24 aa, Entamoeba histolytica
IPQIICFIKNYYFDDGILTDEKLK

SEQ ID NO: 2680664 - protein, 23 aa, Entamoeba histolytica
IPQKCFKNCRSLSSISFNGKITE

SEQ ID NO: 2680665 - protein, 17 aa, Entamoeba histolytica
IPQKEWPYPSYETLWNT

SEQ ID NO: 2680666 - protein, 20 aa, Entamoeba histolytica
IPQKSEWSFSVQTCGNCGGT

SEQ ID NO: 2680667 - protein, 22 aa, Entamoeba histolytica
IPQLPEYIKYLYVQTRDSNIII

SEQ ID NO: 2680668 - protein, 19 aa, Entamoeba histolytica
IPQLPHLIISTSLIPQFVD

SEQ ID NO: 2680669 - protein, 18 aa, Entamoeba histolytica
IPQRGYGYGEGSLFPSEE

SEQ ID NO: 2680670 - protein, 26 aa, Entamoeba histolytica
IPQTGEVLLRIQWEGDVLPVQPERVL

SEQ ID NO: 2680671 - protein, 17 aa, Entamoeba histolytica
IPRNSIRGIKRMLYSSH

SEQ ID NO: 2680672 - protein, 23 aa, Entamoeba histolytica
IPSDTFWSRVVHVLMFNGVIDAN

SEQ ID NO: 2680673 - protein, 25 aa, Entamoeba histolytica
IPSKLKELYCFSSIVTIQNPNESLL

SEQ ID NO: 2680674 - protein, 19 aa, Entamoeba histolytica
IPSLCCLPKTEIEELKLVF

SEQ ID NO: 2680675 - protein, 17 aa, Entamoeba histolytica
IPSLHFPLLSSDWGADE

SEQ ID NO: 2680676 - protein, 23 aa, Entamoeba histolytica
IPSLHPFTQIFVIVNPIQGFIPS

SEQ ID NO: 2680677 - protein, 18 aa, Entamoeba histolytica
IPSLLFKYTPSKYEPCTE

SEQ ID NO: 2680678 - protein, 22 aa, Entamoeba histolytica
IPSLLYRVLCSPTPDIMAAFIR

SEQ ID NO: 2680679 - protein, 22 aa, Entamoeba histolytica
IPSNSRIILTFQVGKKVKHVEF

SEQ ID NO: 2680680 - protein, 24 aa, Entamoeba histolytica
IPSQGDFNGVSSFGSGTKQNQSNP

SEQ ID NO: 2680681 - protein, 25 aa, Entamoeba histolytica
IPSQIPTLRGCVVSRIFCGGFCSAC

SEQ ID NO: 2680682 - protein, 23 aa, Entamoeba histolytica
IPSSEFQWIYNILNGTAEQNNVL

SEQ ID NO: 2680683 - protein, 19 aa, Entamoeba histolytica
IPSSFYLVMVDIAYKKSIE

SEQ ID NO: 2680684 - protein, 19 aa, Entamoeba histolytica
IPSSIILNNLYNYWKFNKT

SEQ ID NO: 2680685 - protein, 19 aa, Entamoeba histolytica
IPSSITKLGDYCFKGSTSL

SEQ ID NO: 2680686 - protein, 26 aa, Entamoeba histolytica
IPSSQRPKVILDIFKQIILSSQDESV

SEQ ID NO: 2680687 - protein, 17 aa, Entamoeba histolytica
IPSTALREIAILRDISH

SEQ ID NO: 2680688 - protein, 23 aa, Entamoeba histolytica
IPSTDCVHFFPVIMNGLLNVNKI

SEQ ID NO: 2680689 - protein, 17 aa, Entamoeba histolytica
IPSTSSIIFNDIIYAIT

SEQ ID NO: 2680690 - protein, 19 aa, Entamoeba histolytica
IPTEILGMIVKEFSENCIK

SEQ ID NO: 2680691 - protein, 17 aa, Entamoeba histolytica
IPTETFYTLLLPIQKIE

SEQ ID NO: 2680692 - protein, 18 aa, Entamoeba histolytica
IPTFFKKTIEFINREGIT

SEQ ID NO: 2680693 - protein, 25 aa, Entamoeba histolytica
IPTIKVGGCIFYFFVSSIVGSRLVT

SEQ ID NO: 2680694 - protein, 18 aa, Entamoeba histolytica
IPTIPLKNTIVINDYQPS

SEQ ID NO: 2680695 - protein, 19 aa, Entamoeba histolytica
IPTKIRASKSYLFVQDIGT

SEQ ID NO: 2680696 - protein, 24 aa, Entamoeba histolytica
IPTKRCTISPCYIRCVEGQNMARR

SEQ ID NO: 2680697 - protein, 20 aa, Entamoeba histolytica
IPTKTSWISGEWNELTAGGC

SEQ ID NO: 2680698 - protein, 18 aa, Entamoeba histolytica
IPTLSPSNVIDWVVEITG

SEQ ID NO: 2680699 - protein, 30 aa, Entamoeba histolytica
IPTNVSKIGNWCFYDCKSLTSINIPSSITS

SEQ ID NO: 2680700 - protein, 21 aa, Entamoeba histolytica
IPTPEFIVSHLIRRHPKSKAF

SEQ ID NO: 2680701 - protein, 28 aa, Entamoeba histolytica
IPTSVIEIGDWCFYKCSSLISINIPSSI

SEQ ID NO: 2680702 - protein, 25 aa, Entamoeba histolytica
IPTSVSKIGDWCFYECTSLTTINIP

SEQ ID NO: 2680703 - protein, 26 aa, Entamoeba histolytica
IPTSVSKIGNWCFIYCSSLQTIKIPT

SEQ ID NO: 2680704 - protein, 17 aa, Entamoeba histolytica
IPTSVTEIGYWCFCECS

SEQ ID NO: 2680705 - protein, 18 aa, Entamoeba histolytica
IPVARSLSSFEGKDKDGG

SEQ ID NO: 2680706 - protein, 17 aa, Entamoeba histolytica
IPVASYIEDGIKLIAKQ

SEQ ID NO: 2680707 - protein, 18 aa, Entamoeba histolytica
IPVCYTHQKIITKLLRKA

SEQ ID NO: 2680708 - protein, 17 aa, Entamoeba histolytica
IPVDLNPPFTLKMANGI

SEQ ID NO: 2680709 - protein, 20 aa, Entamoeba histolytica
IPVDVPIQMSPMYSQTNSVI

SEQ ID NO: 2680710 - protein, 25 aa, Entamoeba histolytica
IPVELKKVLFLSLFIRITNINQQDK

SEQ ID NO: 2680711 - protein, 17 aa, Entamoeba histolytica
IPVEQRRTFTFKHSFNQ

SEQ ID NO: 2680712 - protein, 24 aa, Entamoeba histolytica
IPVGFCNEVPMATTHSVLRIYDNL

SEQ ID NO: 2680713 - protein, 19 aa, Entamoeba histolytica
IPVIETVVMNYDFSTGDST

SEQ ID NO: 2680714 - protein, 17 aa, Entamoeba histolytica
IPVNSFIEKRCEKRMKQ

SEQ ID NO: 2680715 - protein, 25 aa, Entamoeba histolytica
IPVSGVGLGPIFKKDVMKTLIMKEK

SEQ ID NO: 2680716 - protein, 23 aa, Entamoeba histolytica
IPWKSNGDGLMYVGIMNKAERIS

SEQ ID NO: 2680717 - protein, 21 aa, Entamoeba histolytica
IPWQLDTAIRRRFEKRIYIGL

SEQ ID NO: 2680718 - protein, 22 aa, Entamoeba histolytica
IPWTGIGKVAVWPLEKSGKMID

SEQ ID NO: 2680719 - protein, 26 aa, Entamoeba histolytica
IPYEMWKEAIELASKEFYINKNFKQM

SEQ ID NO: 2680720 - protein, 27 aa, Entamoeba histolytica
IPYLSHYREVFTFIQINKKFMSTLKEV

SEQ ID NO: 2680721 - protein, 17 aa, Entamoeba histolytica
IPYQYFLPGNVMPFAQT

SEQ ID NO: 2680722 - protein, 18 aa, Entamoeba histolytica
IPYSLSFIRSVARQTVQF

SEQ ID NO: 2680723 - protein, 30 aa, Entamoeba histolytica; identical to SEQ ID NO: 2487634

SEQ ID NO: 2680724 - protein, 19 aa, Entamoeba histolytica
IQAAREFQSYMTIKKKEYL

SEQ ID NO: 2680725 - protein, 24 aa, Entamoeba histolytica
IQAELKIAGILLHGSDKIQADKPR

SEQ ID NO: 2680726 - protein, 27 aa, Entamoeba histolytica
IQAFLQILIPFEWQGVLIPMLPIEESY

SEQ ID NO: 2680727 - protein, 19 aa, Entamoeba histolytica
IQAIEHWKTLTLQNKQSLL

SEQ ID NO: 2680728 - protein, 25 aa, Entamoeba histolytica
IQCCVKKEKEKCCIKGIESLFDSFF

SEQ ID NO: 2680729 - protein, 21 aa, Entamoeba histolytica
IQCEREGFFPVDYSVSRQRQV

SEQ ID NO: 2680730 - protein, 23 aa, Entamoeba histolytica
IQCIRSVYHNVFPQFIPQDNDFI

SEQ ID NO: 2680731 - protein, 27 aa, Entamoeba histolytica
IQCNLCKTRNPFVLGFIQVKQNSDMTT

SEQ ID NO: 2680732 - protein, 22 aa, Entamoeba histolytica
IQCQGIWYKVIVKKIIEELYDY

SEQ ID NO: 2680733 - protein, 26 aa, Entamoeba histolytica
IQCQHGFCSFKTKACTGNFCRNRNNV

SEQ ID NO: 2680734 - protein, 18 aa, Entamoeba histolytica
IQDEAKCNYNDFRMVVWG

SEQ ID NO: 2680735 - protein, 21 aa, Entamoeba histolytica
IQDGGVFFVEIIFKISQTSFG

SEQ ID NO: 2680736 - protein, 24 aa, Entamoeba histolytica
IQDLYKFRIDNNIIQLSPIQAATL

SEQ ID NO: 2680737 - protein, 19 aa, Entamoeba histolytica
IQDRDRFKSIAKNFTTQFT

SEQ ID NO: 2680738 - protein, 19 aa, Entamoeba histolytica
IQEDVLFNVCKLCKILMTD

SEQ ID NO: 2680739 - protein, 24 aa, Entamoeba histolytica
IQEHPHKVFLIDGFPRNEENKNVW

SEQ ID NO: 2680740 - protein, 20 aa, Entamoeba histolytica
IQEIIKKCCTIIDSSSQIQA

SEQ ID NO: 2680741 - protein, 19 aa, Entamoeba histolytica
IQEIKWYHNGILLKENNIY

SEQ ID NO: 2680742 - protein, 22 aa, Entamoeba histolytica
IQEKLRNISVWETSLKKSKGVK

SEQ ID NO: 2680743 - protein, 18 aa, Entamoeba histolytica
IQELKLSGLDSIKSISFP

SEQ ID NO: 2680744 - protein, 21 aa, Entamoeba histolytica
IQELRSIRSSKEIEMIKQIHI

SEQ ID NO: 2680745 - protein, 17 aa, Entamoeba histolytica
IQEVCIIGSSGRISLYR

SEQ ID NO: 2680746 - protein, 17 aa, Entamoeba histolytica
IQEVFMKYNTFMLRGDS

SEQ ID NO: 2680747 - protein, 20 aa, Entamoeba histolytica
IQFANCSIGIIADGCGWGFR

SEQ ID NO: 2680748 - protein, 22 aa, Entamoeba histolytica
IQFDTLFIFSLFELITLTYNNH

SEQ ID NO: 2680749 - protein, 20 aa, Entamoeba histolytica
IQFEKTCFNISQYNEMYCGE

SEQ ID NO: 2680750 - protein, 24 aa, Entamoeba histolytica
IQFFPHYLAFMFFQIPEFRSQLLK

SEQ ID NO: 2680751 - protein, 20 aa, Entamoeba histolytica
IQFFSRLFIIKRVVKEDDLT

SEQ ID NO: 2680752 - protein, 17 aa, Entamoeba histolytica
IQFHMIKMFPMLRRMKF

SEQ ID NO: 2680753 - protein, 22 aa, Entamoeba histolytica
IQFIRYHMDIEVWMNLLEHYFG

SEQ ID NO: 2680754 - protein, 22 aa, Entamoeba histolytica
IQFKEGREIILFVGSPASGKTS

SEQ ID NO: 2680755 - protein, 18 aa, Entamoeba histolytica
IQFLKLMKPNSFKVFDVN

SEQ ID NO: 2680756 - protein, 17 aa, Entamoeba histolytica
IQFLKPTSVIFLHESTE

SEQ ID NO: 2680757 - protein, 17 aa, Entamoeba histolytica
IQFLTEICEDFLSEDKV

SEQ ID NO: 2680758 - protein, 17 aa, Entamoeba histolytica
IQFMKTLILLPSRDIFE

SEQ ID NO: 2680759 - protein, 17 aa, Entamoeba histolytica
IQFPNQFFLLRGNHESF

SEQ ID NO: 2680760 - protein, 23 aa, Entamoeba histolytica
IQFPTIAVLLSFGKGKVIVPISS

SEQ ID NO: 2680761 - protein, 21 aa, Entamoeba histolytica
IQFPTLLTFTFLNKWNFEELK

SEQ ID NO: 2680762 - protein, 21 aa, Entamoeba histolytica
IQGALFIPGFVVSVGDDGLVK

SEQ ID NO: 2680763 - protein, 19 aa, Entamoeba histolytica
IQGGLKSTVYSVGVKSIQF

SEQ ID NO: 2680764 - protein, 25 aa, Entamoeba histolytica
IQGKRDLKQILSILLSSGRETMPSI

SEQ ID NO: 2680765 - protein, 23 aa, Entamoeba histolytica
IQGPFSFPIEYEFGKRPHHESLH

SEQ ID NO: 2680766 - protein, 19 aa, Entamoeba histolytica
IQGVFPFFTNFRVKDSVGI

SEQ ID NO: 2680767 - protein, 26 aa, Entamoeba histolytica
IQHICWNKFNLNECLINKLWFNKLLD

SEQ ID NO: 2680768 - protein, 24 aa, Entamoeba histolytica
IQHWLKPYHALRFLMYQPSFCSAQ

SEQ ID NO: 2680769 - protein, 18 aa, Entamoeba histolytica
IQIASSKLNGFIELMIKD

SEQ ID NO: 2680770 - protein, 18 aa, Entamoeba histolytica
IQIDVVISQMFCNLNKME

SEQ ID NO: 2680771 - protein, 18 aa, Entamoeba histolytica
IQIGNCFYLTDPAILSIS

SEQ ID NO: 2680772 - protein, 25 aa, Entamoeba histolytica
IQIKQCIEFLKPIMNTIIQFIHLIW

SEQ ID NO: 2680773 - protein, 25 aa, Entamoeba histolytica
IQIKSEFSINEFVTYSLDNPEVYEA

SEQ ID NO: 2680774 - protein, 18 aa, Entamoeba histolytica
IQILLRLGQHLDSKTRIE

SEQ ID NO: 2680775 - protein, 26 aa, Entamoeba histolytica
IQIPKKLLCIGAHCFENCIFLESVLF

SEQ ID NO: 2680776 - protein, 20 aa, Entamoeba histolytica
IQIQWLWELLSEWGKEDHIK

SEQ ID NO: 2680777 - protein, 18 aa, Entamoeba histolytica
IQISFIRLSSYHQFIPQM

SEQ ID NO: 2680778 - protein, 24 aa, Entamoeba histolytica
IQISKRFQVVLSYFQSNPISVNSL

SEQ ID NO: 2680779 - protein, 17 aa, Entamoeba histolytica
IQITFIPGRTIPVDIKP

SEQ ID NO: 2680780 - protein, 24 aa, Entamoeba histolytica
IQIYDCRDYYSALGNKAFKQAGFE

SEQ ID NO: 2680781 - protein, 23 aa, Entamoeba histolytica
IQKALLSWKEMKEKLNEFSPGII

SEQ ID NO: 2680782 - protein, 23 aa, Entamoeba histolytica
IQKCFRCGKDIYGQVIDIKGKKY

SEQ ID NO: 2680783 - protein, 17 aa, Entamoeba histolytica
IQKCNSKPLFIFKSTSE

SEQ ID NO: 2680784 - protein, 27 aa, Entamoeba histolytica
IQKDEHICIINEGFPVKIHLCENKEQI

SEQ ID NO: 2680785 - protein, 17 aa, Entamoeba histolytica
IQKELKDRIDAIKQIGG

SEQ ID NO: 2680786 - protein, 17 aa, Entamoeba histolytica
IQKEVIRLITLNVTQRI

SEQ ID NO: 2680787 - protein, 25 aa, Entamoeba histolytica
IQKIGSKCYTRLFEIINLKFHKAWE

SEQ ID NO: 2680788 - protein, 27 aa, Entamoeba histolytica
IQKKCCQCEFVCQLYLSAAFSNPRKEV

SEQ ID NO: 2680789 - protein, 17 aa, Entamoeba histolytica
IQKKCGDVQFLVISLKD

SEQ ID NO: 2680790 - protein, 22 aa, Entamoeba histolytica
IQKLELISCNSFYTLNIPTSLI

SEQ ID NO: 2680791 - protein, 24 aa, Entamoeba histolytica
IQKLSKFVVGNPFQSSRNQCTTQK

SEQ ID NO: 2680792 - protein, 21 aa, Entamoeba histolytica
IQKMESLTCVSFLPEQLIEVV

SEQ ID NO: 2680793 - protein, 25 aa, Entamoeba histolytica
IQKNEWKIDLFIQIITKYIEKLQTN

SEQ ID NO: 2680794 - protein, 22 aa, Entamoeba histolytica
IQKRFNISFIGQVFLTLTKNKG

SEQ ID NO: 2680795 - protein, 17 aa, Entamoeba histolytica
IQKRLGDHITRRDVSVK

SEQ ID NO: 2680796 - protein, 26 aa, Entamoeba histolytica
IQKSFYKGCLMGGVHGGIYNICEISK

SEQ ID NO: 2680797 - protein, 18 aa, Entamoeba histolytica
IQKSIWRIIDPVSEPVVQ

SEQ ID NO: 2680798 - protein, 27 aa, Entamoeba histolytica
IQKVCFKCGKPGHIGRDCSQPDDKVCF

SEQ ID NO: 2680799 - protein, 23 aa, Entamoeba histolytica
IQKVKKWKDGIGIYSEDKKKFEL

SEQ ID NO: 2680800 - protein, 17 aa, Entamoeba histolytica
IQKWRSWQLKSWNKLSD

SEQ ID NO: 2680801 - protein, 19 aa, Entamoeba histolytica
IQLCFFKAVIQLLLNYKQY

SEQ ID NO: 2680802 - protein, 19 aa, Entamoeba histolytica
IQLEQQYYLSIISILQQQK

SEQ ID NO: 2680803 - protein, 23 aa, Entamoeba histolytica
IQLFHDIMRDFPIRRDIIDMALT

SEQ ID NO: 2680804 - protein, 20 aa, Entamoeba histolytica
IQLFIRCDHTLFIWSSKSFS

SEQ ID NO: 2680805 - protein, 32 aa, Entamoeba histolytica
IQLKKKPTIIVKFPVTVGWGKSTVEGNRARAA

SEQ ID NO: 2680806 - protein, 24 aa, Entamoeba histolytica
IQLKLMQRLGVFEIIGGNSHRSLL

SEQ ID NO: 2680807 - protein, 18 aa, Entamoeba histolytica
IQLMTELKNKGELSKINT

SEQ ID NO: 2680808 - protein, 17 aa, Entamoeba histolytica
IQLPCLNGLPPIPTSIL

SEQ ID NO: 2680809 - protein, 21 aa, Entamoeba histolytica
IQLPLMVKISRYFTKEDITAL

SEQ ID NO: 2680810 - protein, 21 aa, Entamoeba histolytica
IQLPSLLPPIQFVYEIVPNNT

SEQ ID NO: 2680811 - protein, 20 aa, Entamoeba histolytica
IQLSIYRSMIAFKLDATEVG

SEQ ID NO: 2680812 - protein, 17 aa, Entamoeba histolytica
IQMKVFLLSGSSVHLPT

SEQ ID NO: 2680813 - protein, 28 aa, Entamoeba histolytica
IQMKYFQFISQFAFSLPIILSQQEQQLF

SEQ ID NO: 2680814 - protein, 23 aa, Entamoeba histolytica
IQMPPSLLSRFDLIYLILDQPNP

SEQ ID NO: 2680815 - protein, 22 aa, Entamoeba histolytica
IQMVCWPWKYYHDSNQFTLGNI

SEQ ID NO: 2680816 - protein, 18 aa, Entamoeba histolytica
IQNAFTLFFKEKISFGVN

SEQ ID NO: 2680817 - protein, 18 aa, Entamoeba histolytica
IQNELFCCESFYKELSKK

SEQ ID NO: 2680818 - protein, 29 aa, Entamoeba histolytica
IQNFKTDWRDGYAMKFIFADDHPFELFSQ

SEQ ID NO: 2680819 - protein, 18 aa, Entamoeba histolytica
IQNLPAILSHQIINQPKE

SEQ ID NO: 2680820 - protein, 23 aa, Entamoeba histolytica
IQNRNNLYLSFKCETYPSKIILP

SEQ ID NO: 2680821 - protein, 17 aa, Entamoeba histolytica
IQNRWSSKMCRDKKRDK

SEQ ID NO: 2680822 - protein, 18 aa, Entamoeba histolytica
IQNVAYTNAIDWWGLGVL

SEQ ID NO: 2680823 - protein, 18 aa, Entamoeba histolytica
IQNVFKVSLAKVFGLTLN

SEQ ID NO: 2680824 - protein, 21 aa, Entamoeba histolytica
IQNVGNCKLIITSKKQAIAQI

SEQ ID NO: 2680825 - protein, 22 aa, Entamoeba histolytica
IQPEMLHSLEFILKYEGDDMEE

SEQ ID NO: 2680826 - protein, 19 aa, Entamoeba histolytica
IQPERAFVFKFLMNEINFH

SEQ ID NO: 2680827 - protein, 17 aa, Entamoeba histolytica
IQPFKVFEYKREGKQSI

SEQ ID NO: 2680828 - protein, 20 aa, Entamoeba histolytica
IQPIEVCLVNDLQGRTLPLL

SEQ ID NO: 2680829 - protein, 20 aa, Entamoeba histolytica
IQPMRRFIVRASIADSTSSI

SEQ ID NO: 2680830 - protein, 17 aa, Entamoeba histolytica
IQPTSVIDPICFQPQPI

SEQ ID NO: 2680831 - protein, 21 aa, Entamoeba histolytica
IQPYLLRRVKGNVEKSIPPKE

SEQ ID NO: 2680832 - protein, 17 aa, Entamoeba histolytica
IQQFLSLVFFIAKKSNT

SEQ ID NO: 2680833 - protein, 24 aa, Entamoeba histolytica
IQQKILVERGVHVILMRNSIIRNG

SEQ ID NO: 2680834 - protein, 29 aa, Entamoeba histolytica
IQQKIRDALKFILQYYGINGIIIDNFTDE

SEQ ID NO: 2680835 - protein, 22 aa, Entamoeba histolytica
IQQLCIPPLLSFHNVLGGAETG

SEQ ID NO: 2680836 - protein, 23 aa, Entamoeba histolytica
IQRCDPAPFYLFDEIDSNLDTVY

SEQ ID NO: 2680837 - protein, 18 aa, Entamoeba histolytica
IQRKCTIYQPFVSQQKPI

SEQ ID NO: 2680838 - protein, 18 aa, Entamoeba histolytica
IQRKVAEYMKNYNYDEYV

SEQ ID NO: 2680839 - protein, 23 aa, Entamoeba histolytica
IQRLPRYRLLLKDLLKHLRPSDV

SEQ ID NO: 2680840 - protein, 18 aa, Entamoeba histolytica
IQRNLCRYRNAMKKIPLE

SEQ ID NO: 2680841 - protein, 30 aa, Entamoeba histolytica
IQRNSFCFFFVCLFLLYKTYPTQFEFNESL

SEQ ID NO: 2680842 - protein, 20 aa, Entamoeba histolytica
IQRRCGRCLEEIVKEDPVFQ

SEQ ID NO: 2680843 - protein, 24 aa, Entamoeba histolytica
IQSGKICAICIEKNFNGKSECMTD

SEQ ID NO: 2680844 - protein, 23 aa, Entamoeba histolytica
IQSGKICAICIEKNFNGKSQYKT

SEQ ID NO: 2680845 - protein, 26 aa, Entamoeba histolytica
IQSGKICAICIEKSFNGKSEYITDCD

SEQ ID NO: 2680846 - protein, 26 aa, Entamoeba histolytica
IQSGKICAICIEKSFNGKSEYMTVCD

SEQ ID NO: 2680847 - protein, 20 aa, Entamoeba histolytica
IQSIGSLLLFNSGVNVYADY

SEQ ID NO: 2680848 - protein, 23 aa, Entamoeba histolytica
IQSKCYVPMHWGIIIGDKAMAEH

SEQ ID NO: 2680849 - protein, 24 aa, Entamoeba histolytica
IQSKKGAVFLGVFRGKLSEGIDFG

SEQ ID NO: 2680850 - protein, 26 aa, Entamoeba histolytica
IQSLERSKCYLLKPRKSFKKNIPQEY

SEQ ID NO: 2680851 - protein, 20 aa, Entamoeba histolytica
IQSLKREIFILGESKGDEVK

SEQ ID NO: 2680852 - protein, 21 aa, Entamoeba histolytica
IQSNCLREIAILKKLNHNNII

SEQ ID NO: 2680853 - protein, 22 aa, Entamoeba histolytica
IQSPCTRILFINGTPGTGKTMM

SEQ ID NO: 2680854 - protein, 23 aa, Entamoeba histolytica
IQSRCAKMRFGPLSPDALTKIVE

SEQ ID NO: 2680855 - protein, 18 aa, Entamoeba histolytica
IQSSLFLCGCPSVNEVHS

SEQ ID NO: 2680856 - protein, 26 aa, Entamoeba histolytica
IQSVDRFPPQIGFLFYTLRLKIINGY

SEQ ID NO: 2680857 - protein, 20 aa, Entamoeba histolytica
IQTFNIMRIILLDASETLCD

SEQ ID NO: 2680858 - protein, 23 aa, Entamoeba histolytica
IQTGKICAICIEKNFNGKSECMT

SEQ ID NO: 2680859 - protein, 24 aa, Entamoeba histolytica
IQTGKICAICIEKNFNGKSEYMTV

SEQ ID NO: 2680860 - protein, 24 aa, Entamoeba histolytica
IQTGKICAICIEKNFNGKSQYKTV

SEQ ID NO: 2680861 - protein, 29 aa, Entamoeba histolytica
IQTGVLLLEILLRFYGAQHISIFMDLLNY

SEQ ID NO: 2680862 - protein, 20 aa, Entamoeba histolytica
IQTKEIFALPKSNRNDVEPE

SEQ ID NO: 2680863 - protein, 25 aa, Entamoeba histolytica
IQTKFNFIILLKFLIVKEIIEDYKE

SEQ ID NO: 2680864 - protein, 19 aa, Entamoeba histolytica
IQTRICALTTAIANVDDMM

SEQ ID NO: 2680865 - protein, 25 aa, Entamoeba histolytica
IQTTLCAADRLFLRERKVIHIGPNI

SEQ ID NO: 2680866 - protein, 18 aa, Entamoeba histolytica
IQVLESIQAYIWKNEETP

SEQ ID NO: 2680867 - protein, 29 aa, Entamoeba histolytica
IQVPLESSLSFNLNDSFFLFGENSYSSLT

SEQ ID NO: 2680868 - protein, 18 aa, Entamoeba histolytica
IQVYEIHSDISLENNDVS

SEQ ID NO: 2680869 - protein, 18 aa, Entamoeba histolytica
IQVYPPFVTMKWEEVIEY

SEQ ID NO: 2680870 - protein, 22 aa, Entamoeba histolytica
IQYKRLRAINYIRIEKLFEEPF

SEQ ID NO: 2680871 - protein, 17 aa, Entamoeba histolytica
IQYLAAFGIGKLVIVDN

SEQ ID NO: 2680872 - protein, 18 aa, Entamoeba histolytica
IRAASLLNNPTFLPIIHS

SEQ ID NO: 2680873 - protein, 22 aa, Entamoeba histolytica
IRACELGPFGFEWDNKDEEDRK

SEQ ID NO: 2680874 - protein, 18 aa, Entamoeba histolytica
IRCDIIFDLYCGTGTITQ

SEQ ID NO: 2680875 - protein, 19 aa, Entamoeba histolytica
IRCDSEKKLTFNLIKNDQI

SEQ ID NO: 2680876 - protein, 23 aa, Entamoeba histolytica
IRCMAFLLRCRLLIVTHQQETFR

SEQ ID NO: 2680877 - protein, 24 aa, Entamoeba histolytica
IRCSEWFRVMFVKYQCVYHILDLL

SEQ ID NO: 2680878 - protein, 18 aa, Entamoeba histolytica
IRCYPGFQAVIVYRIAHV

SEQ ID NO: 2680879 - protein, 25 aa, Entamoeba histolytica
IRDAVGCPWTPFDLSTTPLASRSYL

SEQ ID NO: 2680880 - protein, 22 aa, Entamoeba histolytica
IRDLEFMIGPMLYEASWQELAK

SEQ ID NO: 2680881 - protein, 23 aa, Entamoeba histolytica
IRDMLGDSCCIVIVGNKMDLVQQ

SEQ ID NO: 2680882 - protein, 23 aa, Entamoeba histolytica
IRDNRSSFDLTNFQYIKLLIDKI

SEQ ID NO: 2680883 - protein, 20 aa, Entamoeba histolytica
IRDRTIERWNYLTNERSYVE

SEQ ID NO: 2680884 - protein, 18 aa, Entamoeba histolytica
IRDSFWRNARSKLNAYFL

SEQ ID NO: 2680885 - protein, 19 aa, Entamoeba histolytica
IRDSYFLIYLYYDQGCKNL

SEQ ID NO: 2680886 - protein, 23 aa, Entamoeba histolytica
IRDYMIKKWIEQIGGKFATRAKY

SEQ ID NO: 2680887 - protein, 20 aa, Entamoeba histolytica
IREEFGKYGKVEIVTILAKR

SEQ ID NO: 2680888 - protein, 24 aa, Entamoeba histolytica
IREEKELKEKLAILQGLQTDNFFD

SEQ ID NO: 2680889 - protein, 19 aa, Entamoeba histolytica
IREEVSNLFGQVIFSNNNF

SEQ ID NO: 2680890 - protein, 19 aa, Entamoeba histolytica
IREFAWLLCIGYYNYRSTT

SEQ ID NO: 2680891 - protein, 24 aa, Entamoeba histolytica
IREFGKKYLGLKCPHAQFTEAKSA

SEQ ID NO: 2680892 - protein, 25 aa, Entamoeba histolytica
IREFGKKYLGLKCPHAQFTEAKSAI

SEQ ID NO: 2680893 - protein, 17 aa, Entamoeba histolytica
IREFKLFPYIDVLTLNC

SEQ ID NO: 2680894 - protein, 26 aa, Entamoeba histolytica
IREFNEWNTTIGKDFSQIDIFVKKIK

SEQ ID NO: 2680895 - protein, 24 aa, Entamoeba histolytica
IREGWGCLTMNSKIIERVSQYHWK

SEQ ID NO: 2680896 - protein, 18 aa, Entamoeba histolytica
IREKFKWYYEKFGQYMPN

SEQ ID NO: 2680897 - protein, 17 aa, Entamoeba histolytica
IREKMLYSATKATIKQA

SEQ ID NO: 2680898 - protein, 19 aa, Entamoeba histolytica
IRELPPFCFDRCGIKQLDL

SEQ ID NO: 2680899 - protein, 18 aa, Entamoeba histolytica
IREMIDWSKMKMSVKFQV

SEQ ID NO: 2680900 - protein, 17 aa, Entamoeba histolytica
IREMINFQMMIQQMRRR

SEQ ID NO: 2680901 - protein, 17 aa, Entamoeba histolytica
IREMLRMSKPIRLMLVL

SEQ ID NO: 2680902 - protein, 19 aa, Entamoeba histolytica
IRENYLVNMPMGIFMARLD

SEQ ID NO: 2680903 - protein, 22 aa, Entamoeba histolytica
IRERCGHPMKPIYVKITGNNVI

SEQ ID NO: 2680904 - protein, 20 aa, Entamoeba histolytica
IRESIPFRIIDLCQVTSSRN

SEQ ID NO: 2680905 - protein, 18 aa, Entamoeba histolytica
IRFIYSLCATCYLLNDWG

SEQ ID NO: 2680906 - protein, 18 aa, Entamoeba histolytica
IRFLFLLELAHWYYMDNW

SEQ ID NO: 2680907 - protein, 25 aa, Entamoeba histolytica
IRFNFKGSPYARAFHNITIEEYHPR

SEQ ID NO: 2680908 - protein, 19 aa, Entamoeba histolytica
IRFNKWAERIQVELSNLVR

SEQ ID NO: 2680909 - protein, 17 aa, Entamoeba histolytica
IRFPAFLRNLKLEYDVI

SEQ ID NO: 2680910 - protein, 20 aa, Entamoeba histolytica
IRFRSDLKLIIASATLETQK

SEQ ID NO: 2680911 - protein, 27 aa, Entamoeba histolytica
IRGDIFLLKEVKAFIDKKEKMIIEIYH

SEQ ID NO: 2680912 - protein, 25 aa, Entamoeba histolytica
IRGEICATLPVLCEGGIAENEHLHI

SEQ ID NO: 2680913 - protein, 24 aa, Entamoeba histolytica
IRGGKNSYYMWSINFSQINAILLS

SEQ ID NO: 2680914 - protein, 20 aa, Entamoeba histolytica
IRGGNILFIGKYLRIEKDGE

SEQ ID NO: 2680915 - protein, 19 aa, Entamoeba histolytica
IRGGNQYMRTLWGKEVWMK

SEQ ID NO: 2680916 - protein, 25 aa, Entamoeba histolytica
IRGICLLLLESCCEILKYYKEGKVF

SEQ ID NO: 2680917 - protein, 25 aa, Entamoeba histolytica
IRGITCLNESIILYGVEKRNKSEYS

SEQ ID NO: 2680918 - protein, 19 aa, Entamoeba histolytica
IRGITLKFLCHVSEKEIIQ

SEQ ID NO: 2680919 - protein, 25 aa, Entamoeba histolytica
IRGKPMFNALCKFENFFTYKRYKFG

SEQ ID NO: 2680920 - protein, 23 aa, Entamoeba histolytica
IRGKVAAFFLFIAPPSMEILEQR

SEQ ID NO: 2680921 - protein, 18 aa, Entamoeba histolytica
IRGPFIFISMNNKDKSIS

SEQ ID NO: 2680922 - protein, 17 aa, Entamoeba histolytica
IRGQMQRKVWINVNDVI

SEQ ID NO: 2680923 - protein, 17 aa, Entamoeba histolytica
IRGRLHGKVSVFDKSKF

SEQ ID NO: 2680924 - protein, 21 aa, Entamoeba histolytica
IRHINDYGAFLLFDKRYSTNS

SEQ ID NO: 2680925 - protein, 17 aa, Entamoeba histolytica
IRIAEGTGNVVFSVKFE

SEQ ID NO: 2680926 - protein, 19 aa, Entamoeba histolytica
IRIAMGCGIAGERRNPLSD

SEQ ID NO: 2680927 - protein, 19 aa, Entamoeba histolytica
IRIEGKLRIAYTCINLLIR

SEQ ID NO: 2680928 - protein, 17 aa, Entamoeba histolytica
IRIFRKKEMPIVGPLLN

SEQ ID NO: 2680929 - protein, 19 aa, Entamoeba histolytica
IRIFWSNKVPKGYFNKEFI

SEQ ID NO: 2680930 - protein, 20 aa, Entamoeba histolytica
IRIIAQQMLFGFDIEPSLIS

SEQ ID NO: 2680931 - protein, 23 aa, Entamoeba histolytica
IRIKEGCKWRTGYKVVCCATKRK

SEQ ID NO: 2680932 - protein, 23 aa, Entamoeba histolytica
IRIKEIYSILGNDIFVILRNIAL

SEQ ID NO: 2680933 - protein, 17 aa, Entamoeba histolytica
IRIKFMIDGAKGISYLH

SEQ ID NO: 2680934 - protein, 18 aa, Entamoeba histolytica
IRIKMERFLTYDSVEVFP

SEQ ID NO: 2680935 - protein, 24 aa, Entamoeba histolytica
IRILKLEYDGFVFTKELLCKLGES

SEQ ID NO: 2680936 - protein, 18 aa, Entamoeba histolytica
IRITQPIIIVGLPRSGST

SEQ ID NO: 2680937 - protein, 28 aa, Entamoeba histolytica
IRIWNYLSFKCIAILTGHDHYVLSAHFH

SEQ ID NO: 2680938 - protein, 21 aa, Entamoeba histolytica
IRIWRKQSIRQFGPLIDGMIV

SEQ ID NO: 2680939 - protein, 19 aa, Entamoeba histolytica
IRKCICININIGEDVGLLV

SEQ ID NO: 2680940 - protein, 17 aa, Entamoeba histolytica
IRKEDFSSSVMDKNSTS

SEQ ID NO: 2680941 - protein, 23 aa, Entamoeba histolytica
IRKEKLIVLELFNQIKGNSNITI

SEQ ID NO: 2680942 - protein, 24 aa, Entamoeba histolytica
IRKFPGQYGNLIVHFNIQNPTYLS

SEQ ID NO: 2680943 - protein, 20 aa, Entamoeba histolytica
IRKGKTFYGVDEMKQVTGIQ

SEQ ID NO: 2680944 - protein, 21 aa, Entamoeba histolytica
IRKIIEWSKTEMYVFIRTIKL

SEQ ID NO: 2680945 - protein, 18 aa, Entamoeba histolytica
IRKIKKYIIYHINCSAHL

SEQ ID NO: 2680946 - protein, 22 aa, Entamoeba histolytica
IRKKLEIVTCVTKGFVFKDQEG

SEQ ID NO: 2680947 - protein, 17 aa, Entamoeba histolytica
IRKMPLENVTLLRSILK

SEQ ID NO: 2680948 - protein, 19 aa, Entamoeba histolytica
IRKNFQLANLWVGKLNHQS

SEQ ID NO: 2680949 - protein, 19 aa, Entamoeba histolytica
IRKNHVKNIIALVGAGMST

SEQ ID NO: 2680950 - protein, 24 aa, Entamoeba histolytica
IRKRIEEFEKIMIHEAQVIIHKKD

SEQ ID NO: 2680951 - protein, 22 aa, Entamoeba histolytica
IRKRKECYDFKTLCSPKKLIGA

SEQ ID NO: 2680952 - protein, 19 aa, Entamoeba histolytica
IRKSLPVYQKREEFLKLVR

SEQ ID NO: 2680953 - protein, 22 aa, Entamoeba histolytica
IRKTELFNGLQVQRLYSVEDVI

SEQ ID NO: 2680954 - protein, 24 aa, Entamoeba histolytica
IRKVEEIYMRMSVTNFEDIPVDVI

SEQ ID NO: 2680955 - protein, 18 aa, Entamoeba histolytica
IRLADLISRKLLRDEGLL

SEQ ID NO: 2680956 - protein, 19 aa, Entamoeba histolytica
IRLANTFIHAHAVKDVFNN

SEQ ID NO: 2680957 - protein, 19 aa, Entamoeba histolytica
IRLDCYFDDLCQWTKLNAI

SEQ ID NO: 2680958 - protein, 24 aa, Entamoeba histolytica
IRLIDFGSSCFENSTLYTYIQSRH

SEQ ID NO: 2680959 - protein, 21 aa, Entamoeba histolytica
IRLITCNCVPQVYASQKIYSG

SEQ ID NO: 2680960 - protein, 17 aa, Entamoeba histolytica
IRLKIPICVSPKKSFDL

SEQ ID NO: 2680961 - protein, 25 aa, Entamoeba histolytica
IRLLPEQVSALILLKIKDIILKVHP

SEQ ID NO: 2680962 - protein, 19 aa, Entamoeba histolytica
IRLRNENLISSKPQTKFAI

SEQ ID NO: 2680963 - protein, 19 aa, Entamoeba histolytica
IRLSQCKISLNSNELPSSL

SEQ ID NO: 2680964 - protein, 18 aa, Entamoeba histolytica
IRLWSVKSLSALRTLQGH

SEQ ID NO: 2680965 - protein, 24 aa, Entamoeba histolytica
IRLYYVCLLNNFPVDEINQLMNEK

SEQ ID NO: 2680966 - protein, 18 aa, Entamoeba histolytica
IRMFEVGDTVSLQEGSLT

SEQ ID NO: 2680967 - protein, 18 aa, Entamoeba histolytica
IRMHSICDGIYLLIGKLL

SEQ ID NO: 2680968 - protein, 23 aa, Entamoeba histolytica
IRMISCKRFFLLPKLQQKNDVDM

SEQ ID NO: 2680969 - protein, 17 aa, Entamoeba histolytica
IRMMDHFMFKSHLCIVC

SEQ ID NO: 2680970 - protein, 18 aa, Entamoeba histolytica
IRMVKDLKSELKKGKISG

SEQ ID NO: 2680971 - protein, 17 aa, Entamoeba histolytica
IRNELELHLSKKHYEEE

SEQ ID NO: 2680972 - protein, 22 aa, Entamoeba histolytica
IRNFSIKGFGQIIVHSYIEQLA

SEQ ID NO: 2680973 - protein, 17 aa, Entamoeba histolytica
IRNGLLEQRLEVFQTNY

SEQ ID NO: 2680974 - protein, 23 aa, Entamoeba histolytica
IRNKRFTTTVLLNLIKEKILEDL

SEQ ID NO: 2680975 - protein, 19 aa, Entamoeba histolytica
IRNMMLIRLRRIYDEACNS

SEQ ID NO: 2680976 - protein, 19 aa, Entamoeba histolytica
IRNNSAWSHRFYTLKSLNL

SEQ ID NO: 2680977 - protein, 29 aa, Entamoeba histolytica
IRNSGSIEWVVYHVNFKNGDLIEDDTGTT

SEQ ID NO: 2680978 - protein, 19 aa, Entamoeba histolytica
IRNTFFASIESVQSYFAYK

SEQ ID NO: 2680979 - protein, 18 aa, Entamoeba histolytica
IRNVFVLTCNVSMEYEKS

SEQ ID NO: 2680980 - protein, 24 aa, Entamoeba histolytica
IRPADGKSKCTILYSHDSTERLET

SEQ ID NO: 2680981 - protein, 17 aa, Entamoeba histolytica
IRPCDRIETKNFKENKP

SEQ ID NO: 2680982 - protein, 22 aa, Entamoeba histolytica
IRPDKQIVMFSATFPISVEQHA

SEQ ID NO: 2680983 - protein, 17 aa, Entamoeba histolytica
IRPETLGQLTLVALGLV

SEQ ID NO: 2680984 - protein, 19 aa, Entamoeba histolytica
IRPFHCFSLAEAESQGLVM

SEQ ID NO: 2680985 - protein, 25 aa, Entamoeba histolytica
IRPHLKVHFIVSLGIEINFFRTIDY

SEQ ID NO: 2680986 - protein, 21 aa, Entamoeba histolytica
IRPKLTWASIDVFRKRSVTIY

SEQ ID NO: 2680987 - protein, 19 aa, Entamoeba histolytica
IRPLSYPSTDVFLLCYSVV

SEQ ID NO: 2680988 - protein, 20 aa, Entamoeba histolytica
IRPPRYCPEQLICFDYLQSQ

SEQ ID NO: 2680989 - protein, 17 aa, Entamoeba histolytica
IRPSVLFNKYEEECPWK

SEQ ID NO: 2680990 - protein, 17 aa, Entamoeba histolytica
IRQGITCITTKNEKLTE

SEQ ID NO: 2680991 - protein, 21 aa, Entamoeba histolytica
IRQRSVYIIMRILNSMPDNYT

SEQ ID NO: 2680992 - protein, 19 aa, Entamoeba histolytica
IRQYGFEMNELISIEEKLK

SEQ ID NO: 2680993 - protein, 20 aa, Entamoeba histolytica
IRRFKLKSLLIASSLNETSS

SEQ ID NO: 2680994 - protein, 19 aa, Entamoeba histolytica
IRRIKSCFDYLKYDKTVER

SEQ ID NO: 2680995 - protein, 18 aa, Entamoeba histolytica
IRRIKYRDISSISRLNNN

SEQ ID NO: 2680996 - protein, 17 aa, Entamoeba histolytica
IRRINLRYRFSLGTELD

SEQ ID NO: 2680997 - protein, 21 aa, Entamoeba histolytica
IRRKHLDNSFVIYSSDEIDPE

SEQ ID NO: 2680998 - protein, 22 aa, Entamoeba histolytica
IRRKKISTVLYCRIEEEIKGLK

SEQ ID NO: 2680999 - protein, 17 aa, Entamoeba histolytica
IRRQNGLKREWEDCQKL

SEQ ID NO: 2681000 - protein, 24 aa, Entamoeba histolytica
IRRRFEKRIYIGLPDASARAKMIK

SEQ ID NO: 2681001 - protein, 21 aa, Entamoeba histolytica
IRRRIKEQSWDDVVRKTLVQK

SEQ ID NO: 2681002 - protein, 27 aa, Entamoeba histolytica
IRRSFRGKWPISYIKKILVFSTDEECA

SEQ ID NO: 2681003 - protein, 24 aa, Entamoeba histolytica
IRRVAKPLHYCIKTIEGGSIALQH

SEQ ID NO: 2681004 - protein, 21 aa, Entamoeba histolytica
IRRYCFSECFSLTSIDIPAEI

SEQ ID NO: 2681005 - protein, 19 aa, Entamoeba histolytica
IRSDAKFNIYFNYWDDTFR

SEQ ID NO: 2681006 - protein, 25 aa, Entamoeba histolytica
IRSFLLKPGCIISGSISDNSFYGLF

SEQ ID NO: 2681007 - protein, 17 aa, Entamoeba histolytica
IRSGTHWANEQNLVVDD

SEQ ID NO: 2681008 - protein, 20 aa, Entamoeba histolytica
IRSIVFFSERLEDIKELTDI

SEQ ID NO: 2681009 - protein, 20 aa, Entamoeba histolytica
IRSLKRGNVTWCYNSLQFKF

SEQ ID NO: 2681010 - protein, 24 aa, Entamoeba histolytica
IRSNSVKVIREFLFGSDEVITQQT

SEQ ID NO: 2681011 - protein, 19 aa, Entamoeba histolytica
IRSRCVMIRVPLPNKQEMT

SEQ ID NO: 2681012 - protein, 20 aa, Entamoeba histolytica
IRSSGKLVLLDKLLPKLYAD

SEQ ID NO: 2681013 - protein, 17 aa, Entamoeba histolytica
IRSVPTFVSYVNGVSTK

SEQ ID NO: 2681014 - protein, 18 aa, Entamoeba histolytica
IRTAALVDDSLWIGTFAG

SEQ ID NO: 2681015 - protein, 18 aa, Entamoeba histolytica
IRTCCSIASIKHFDIMIH

SEQ ID NO: 2681016 - protein, 22 aa, Entamoeba histolytica
IRTCFWEICYSNRYCPTGIEVK

SEQ ID NO: 2681017 - protein, 17 aa, Entamoeba histolytica
IRTEFKRYQIQKLNPFW

SEQ ID NO: 2681018 - protein, 19 aa, Entamoeba histolytica
IRTILDAMERWRMRTEELM

SEQ ID NO: 2681019 - protein, 19 aa, Entamoeba histolytica
IRTILDAMERWRMRTEEPM

SEQ ID NO: 2681020 - protein, 17 aa, Entamoeba histolytica
IRTIPFTVCKLNQLRNF

SEQ ID NO: 2681021 - protein, 25 aa, Entamoeba histolytica
IRTIQSCAVFYSFIKPFNTNQIELL

SEQ ID NO: 2681022 - protein, 24 aa, Entamoeba histolytica
IRTLFRKDFLALDWQEKIKTFNCT

SEQ ID NO: 2681023 - protein, 18 aa, Entamoeba histolytica
IRTLLTLLEVCGKQGVTF

SEQ ID NO: 2681024 - protein, 18 aa, Entamoeba histolytica
IRTMEIIGIIFINNKKQP

SEQ ID NO: 2681025 - protein, 19 aa, Entamoeba histolytica
IRTNWYWKHQKRIIRFSKD

SEQ ID NO: 2681026 - protein, 19 aa, Entamoeba histolytica
IRTSLPIFLANLMPCSSSS

SEQ ID NO: 2681027 - protein, 17 aa, Entamoeba histolytica
IRTTPLIQSVENLKYIN

SEQ ID NO: 2681028 - protein, 26 aa, Entamoeba histolytica
IRVGKAEILPGVLFIDEVHMLDLECF

SEQ ID NO: 2681029 - protein, 19 aa, Entamoeba histolytica
IRVIDGLIEYCQFLEMKMA

SEQ ID NO: 2681030 - protein, 18 aa, Entamoeba histolytica
IRVKRTALLILNQKLTAL

SEQ ID NO: 2681031 - protein, 19 aa, Entamoeba histolytica
IRVKTCFIEIWKFIFEKQK

SEQ ID NO: 2681032 - protein, 18 aa, Entamoeba histolytica
IRVMRLKNKIMNQLDAIQ

SEQ ID NO: 2681033 - protein, 17 aa, Entamoeba histolytica
IRVPVKLTKPVPRSKIF

SEQ ID NO: 2681034 - protein, 23 aa, Entamoeba histolytica
IRVYDLRKGLVVSDDIKKPLTSL

SEQ ID NO: 2681035 - protein, 23 aa, Entamoeba histolytica
IRWAAPGSCVIGSFYGYITYPPA

SEQ ID NO: 2681036 - protein, 19 aa, Entamoeba histolytica
IRWVGSLKLITCVEKPNGN

SEQ ID NO: 2681037 - protein, 17 aa, Entamoeba histolytica
IRYDAIQDFLFHSLKSS

SEQ ID NO: 2681038 - protein, 18 aa, Entamoeba histolytica
IRYEELQYALGTHRLGLN

SEQ ID NO: 2681039 - protein, 17 aa, Entamoeba histolytica
IRYFEKIGTPGFSITKQ

SEQ ID NO: 2681040 - protein, 22 aa, Entamoeba histolytica
IRYIIWKYLLRYIPVEHKRVEL

SEQ ID NO: 2681041 - protein, 20 aa, Entamoeba histolytica
IRYILRAMAVASKFTESLAE

SEQ ID NO: 2681042 - protein, 21 aa, Entamoeba histolytica
IRYSIKCKKMDMIGKVKEDIM

SEQ ID NO: 2681043 - protein, 17 aa, Entamoeba histolytica
IRYSLDFIPPTRKVNLQ

SEQ ID NO: 2681044 - protein, 18 aa, Entamoeba histolytica
ISAADALKHPFFDPLNKP

SEQ ID NO: 2681045 - protein, 17 aa, Entamoeba histolytica
ISADVVILFDSIFEQQY

SEQ ID NO: 2681046 - protein, 18 aa, Entamoeba histolytica
ISAGFGIVTTIRFVYTQG

SEQ ID NO: 2681047 - protein, 20 aa, Entamoeba histolytica
ISALPQRTSVDFKVSNTNLL

SEQ ID NO: 2681048 - protein, 18 aa, Entamoeba histolytica
ISALRRVRKNDNLRLVRA

SEQ ID NO: 2681049 - protein, 24 aa, Entamoeba histolytica
ISALRVGCDLAHIFCHQDAAIAIK

SEQ ID NO: 2681050 - protein, 18 aa, Entamoeba histolytica
ISASLLRAEIYGIKNELS

SEQ ID NO: 2681051 - protein, 19 aa, Entamoeba histolytica
ISASNGFSGYILTSARTSH

SEQ ID NO: 2681052 - protein, 27 aa, Entamoeba histolytica
ISATCYPLEIDLWLAYSEYATMGLKLQ

SEQ ID NO: 2681053 - protein, 19 aa, Entamoeba histolytica
ISAVLLISSLCIHHNLIQQ

SEQ ID NO: 2681054 - protein, 19 aa, Entamoeba histolytica
ISAVSPGLFDEIWNKYFNK

SEQ ID NO: 2681055 - protein, 19 aa, Entamoeba histolytica
ISCGLLILRGDEIMVIGGL

SEQ ID NO: 2681056 - protein, 18 aa, Entamoeba histolytica
ISCKHFFNGTALQRIPQG

SEQ ID NO: 2681057 - protein, 26 aa, Entamoeba histolytica
ISCLTLFESGCFLFKTPAFSIQSVRG

SEQ ID NO: 2681058 - protein, 24 aa, Entamoeba histolytica
ISCNEAMGALYLFPKITFPNKYID

SEQ ID NO: 2681059 - protein, 17 aa, Entamoeba histolytica
ISCNGGDIRSCCFEEIS

SEQ ID NO: 2681060 - protein, 18 aa, Entamoeba histolytica
ISCPINKNPSIIIVNVNE

SEQ ID NO: 2681061 - protein, 17 aa, Entamoeba histolytica
ISCQLVWVTKTDGRDSV

SEQ ID NO: 2681062 - protein, 17 aa, Entamoeba histolytica
ISCSAPLSSIVFGPDYL

SEQ ID NO: 2681063 - protein, 21 aa, Entamoeba histolytica
ISCSESFVIKDVIMILPKFIN

SEQ ID NO: 2681064 - protein, 22 aa, Entamoeba histolytica
ISDDCKDFILGLLTVKASSRLS

SEQ ID NO: 2681065 - protein, 21 aa, Entamoeba histolytica
ISDEIHCDLLLTKQHLHTASL

SEQ ID NO: 2681066 - protein, 25 aa, Entamoeba histolytica
ISDEIRTTLDYTFRLVKQITTKQIH

SEQ ID NO: 2681067 - protein, 24 aa, Entamoeba histolytica
ISDGKWILSEDWIDAIIKSNNIVE

SEQ ID NO: 2681068 - protein, 25 aa, Entamoeba histolytica
ISDHRKTKCKHEYYIDCKVLSPNEF

SEQ ID NO: 2681069 - protein, 17 aa, Entamoeba histolytica
ISDLDLVGTNWKFFSLE

SEQ ID NO: 2681070 - protein, 20 aa, Entamoeba histolytica
ISDLLRYFFHFVKSTCPYIV

SEQ ID NO: 2681071 - protein, 25 aa, Entamoeba histolytica
ISDNFWKIICEEIGNHNPLDCKLQY

SEQ ID NO: 2681072 - protein, 19 aa, Entamoeba histolytica
ISDSKSMREWLGITQNNCY

SEQ ID NO: 2681073 - protein, 19 aa, Entamoeba histolytica
ISDTEVFIGGLGVFTDKRN

SEQ ID NO: 2681074 - protein, 18 aa, Entamoeba histolytica
ISDVFKGRIKRVTECSMC

SEQ ID NO: 2681075 - protein, 30 aa, Entamoeba histolytica; identical to SEQ ID NO: 2488014

SEQ ID NO: 2681076 - protein, 23 aa, Entamoeba histolytica
ISDVSCPWCYVGRKRMLNAISTI

SEQ ID NO: 2681077 - protein, 26 aa, Entamoeba histolytica
ISDYKPILVDGFKLSLQLLVKEVSNL

SEQ ID NO: 2681078 - protein, 18 aa, Entamoeba histolytica
ISDYRQLLEIGFDETKYH

SEQ ID NO: 2681079 - protein, 21 aa, Entamoeba histolytica
ISEALAKMQLREKVEARDVKE

SEQ ID NO: 2681080 - protein, 23 aa, Entamoeba histolytica
ISEDEIKKVVGFAKALVSNTPIS

SEQ ID NO: 2681081 - protein, 17 aa, Entamoeba histolytica
ISEEVLLKISEDVAKAI

SEQ ID NO: 2681082 - protein, 18 aa, Entamoeba histolytica
ISEFWFQIQKDFEAVELS

SEQ ID NO: 2681083 - protein, 21 aa, Entamoeba histolytica
ISEIHPYIFPKGEFASEKIGD

SEQ ID NO: 2681084 - protein, 24 aa, Entamoeba histolytica
ISEIVRFAPPLSIIIIKPGTYEET

SEQ ID NO: 2681085 - protein, 19 aa, Entamoeba histolytica
ISEKMCIKVKQNTFFTCQR

SEQ ID NO: 2681086 - protein, 32 aa, Entamoeba histolytica
ISEKSWKLVWVVIKYTFIFVFKSRDDTTLIEI

SEQ ID NO: 2681087 - protein, 19 aa, Entamoeba histolytica
ISEMLGGLQACARAFAARK

SEQ ID NO: 2681088 - protein, 19 aa, Entamoeba histolytica
ISERCEAVKVFLKEFTDVE

SEQ ID NO: 2681089 - protein, 35 aa, Entamoeba histolytica; identical to SEQ ID NO: 2488035

SEQ ID NO: 2681090 - protein, 18 aa, Entamoeba histolytica
ISEVFKMKSTIIKDNKDT

SEQ ID NO: 2681091 - protein, 24 aa, Entamoeba histolytica
ISEYCKLGLLNLITEWIQVYPNTI

SEQ ID NO: 2681092 - protein, 18 aa, Entamoeba histolytica
ISEYSWLKFIASCPQLRV

SEQ ID NO: 2681093 - protein, 25 aa, Entamoeba histolytica
ISFALRLINSHSFLSIRNIILRHIF

SEQ ID NO: 2681094 - protein, 17 aa, Entamoeba histolytica
ISFEWRECYKKYKPIMF

SEQ ID NO: 2681095 - protein, 19 aa, Entamoeba histolytica
ISFFIFACDCRLRYTQKLS

SEQ ID NO: 2681096 - protein, 17 aa, Entamoeba histolytica
ISFKCMTNLKWVEVKKM

SEQ ID NO: 2681097 - protein, 24 aa, Entamoeba histolytica
ISFKEIDQLPILVFINKNYEKEHF

SEQ ID NO: 2681098 - protein, 23 aa, Entamoeba histolytica
ISFKGPIDIIGKYCFYNCNSLKY

SEQ ID NO: 2681099 - protein, 17 aa, Entamoeba histolytica
ISFLAPIDHCFLIEDFI

SEQ ID NO: 2681100 - protein, 22 aa, Entamoeba histolytica
ISFLLDCVNIEFSNRDLDTTIK

SEQ ID NO: 2681101 - protein, 22 aa, Entamoeba histolytica
ISFPLFPQIVVLMRELYLLIIK

SEQ ID NO: 2681102 - protein, 17 aa, Entamoeba histolytica
ISFRRRVNRRQTLAEFL

SEQ ID NO: 2681103 - protein, 18 aa, Entamoeba histolytica
ISFYEFRKVFIQFILVIQ

SEQ ID NO: 2681104 - protein, 19 aa, Entamoeba histolytica
ISGDDWGDDFGFPEDQKDG

SEQ ID NO: 2681105 - protein, 19 aa, Entamoeba histolytica
ISGFNRKTLYRKIIGEKNI

SEQ ID NO: 2681106 - protein, 17 aa, Entamoeba histolytica
ISGGILLTTYNLVQNDE

SEQ ID NO: 2681107 - protein, 19 aa, Entamoeba histolytica
ISGILTFGPCYLVSEEASE

SEQ ID NO: 2681108 - protein, 17 aa, Entamoeba histolytica
ISGKLNDINIIKAKYDN

SEQ ID NO: 2681109 - protein, 33 aa, Entamoeba histolytica
ISGLNVEFLKGFILEEVDRCFITDHIIISLIQN

SEQ ID NO: 2681110 - protein, 28 aa, Entamoeba histolytica
ISGLPRMKKGLVKFKVTFNVDINGMLSV

SEQ ID NO: 2681111 - protein, 17 aa, Entamoeba histolytica
ISGSADRTVHLWDIRSS

SEQ ID NO: 2681112 - protein, 25 aa, Entamoeba histolytica
ISGTKFILYCWSRPDLRGYLNSQGV

SEQ ID NO: 2681113 - protein, 21 aa, Entamoeba histolytica
ISGVLSGSIWGMANNEDKNGL

SEQ ID NO: 2681114 - protein, 24 aa, Entamoeba histolytica
ISHFPYGPTAYFGLYNVVSRHETK

SEQ ID NO: 2681115 - protein, 19 aa, Entamoeba histolytica
ISHSFYARAKKGVVEKEST

SEQ ID NO: 2681116 - protein, 17 aa, Entamoeba histolytica
ISHSPIITTSRPSSGNT

SEQ ID NO: 2681117 - protein, 25 aa, Entamoeba histolytica
ISHVWEVNGTIWACKKVEGNKSMIS

SEQ ID NO: 2681118 - protein, 20 aa, Entamoeba histolytica
ISIELCSKLDEWGLIKEKER

SEQ ID NO: 2681119 - protein, 26 aa, Entamoeba histolytica
ISIELNQIWETLPFYLDEDKPLHGTN

SEQ ID NO: 2681120 - protein, 26 aa, Entamoeba histolytica
ISIFQKMERDAARYQGLMNELATPLR

SEQ ID NO: 2681121 - protein, 20 aa, Entamoeba histolytica
ISIFSKIKWTDNELVAQSIS

SEQ ID NO: 2681122 - protein, 17 aa, Entamoeba histolytica
ISIICIGVGDGPFDKME

SEQ ID NO: 2681123 - protein, 17 aa, Entamoeba histolytica
ISIICVGVGDGPFGVME

SEQ ID NO: 2681124 - protein, 19 aa, Entamoeba histolytica
ISIIDCRPKLNASANLIKG

SEQ ID NO: 2681125 - protein, 21 aa, Entamoeba histolytica
ISIITRIKREGVFNLAPADFK

SEQ ID NO: 2681126 - protein, 26 aa, Entamoeba histolytica
ISIKGWASTCGWAEEIVRYHSEELKK

SEQ ID NO: 2681127 - protein, 17 aa, Entamoeba histolytica
ISIKYLYLESMENIKSI

SEQ ID NO: 2681128 - protein, 18 aa, Entamoeba histolytica
ISINCCDVIEPLIVPMSI

SEQ ID NO: 2681129 - protein, 17 aa, Entamoeba histolytica
ISINEVFGKFIVDPQTW

SEQ ID NO: 2681130 - protein, 17 aa, Entamoeba histolytica
ISIPICSTPQLLTSLSI

SEQ ID NO: 2681131 - protein, 17 aa, Entamoeba histolytica
ISIWKQPLFSFVENVLK

SEQ ID NO: 2681132 - protein, 17 aa, Entamoeba histolytica
ISKAVCINEFNIIPINQ

SEQ ID NO: 2681133 - protein, 23 aa, Entamoeba histolytica
ISKCCKNLIIGEGERKFKIEVNE

SEQ ID NO: 2681134 - protein, 22 aa, Entamoeba histolytica
ISKCYLKMAELYNMKNDKSLMY

SEQ ID NO: 2681135 - protein, 19 aa, Entamoeba histolytica
ISKDCPFQHSYPFKLEDYQ

SEQ ID NO: 2681136 - protein, 19 aa, Entamoeba histolytica
ISKDRLKIVQFKVNGESYM

SEQ ID NO: 2681137 - protein, 23 aa, Entamoeba histolytica
ISKECLKELLFKPEGSKKLDELF

SEQ ID NO: 2681138 - protein, 17 aa, Entamoeba histolytica
ISKICFVDTVSIPLKDQ

SEQ ID NO: 2681139 - protein, 17 aa, Entamoeba histolytica
ISKIGSFSFEGCYNLTH

SEQ ID NO: 2681140 - protein, 18 aa, Entamoeba histolytica
ISKIKGHKSGIVGLEQIS

SEQ ID NO: 2681141 - protein, 26 aa, Entamoeba histolytica
ISKISLKRNVCCTLSEEYEGISDLDL

SEQ ID NO: 2681142 - protein, 20 aa, Entamoeba histolytica
ISKKGIKLILDKGDEKEGYY

SEQ ID NO: 2681143 - protein, 20 aa, Entamoeba histolytica
ISKKKRFSLKDDLQPSNVLN

SEQ ID NO: 2681144 - protein, 17 aa, Entamoeba histolytica
ISKKLKERLEFRKEYIK

SEQ ID NO: 2681145 - protein, 17 aa, Entamoeba histolytica
ISKQIKFHALITTYEMI

SEQ ID NO: 2681146 - protein, 17 aa, Entamoeba histolytica
ISKRIKLFNGLSEIECH

SEQ ID NO: 2681147 - protein, 18 aa, Entamoeba histolytica
ISKSCSFFTVETRKRLLL

SEQ ID NO: 2681148 - protein, 29 aa, Entamoeba histolytica
ISKSILRRLPHVFFYKRVFSGNDTDFQLF

SEQ ID NO: 2681149 - protein, 24 aa, Entamoeba histolytica
ISKSLSWPTILYVIGSIVKGWLQK

SEQ ID NO: 2681150 - protein, 18 aa, Entamoeba histolytica
ISKTPDLNISFRRRVNRR

SEQ ID NO: 2681151 - protein, 18 aa, Entamoeba histolytica
ISKYEWICNQQRDSYASY

SEQ ID NO: 2681152 - protein, 17 aa, Entamoeba histolytica
ISLCLQRPQTECYLDSQ

SEQ ID NO: 2681153 - protein, 23 aa, Entamoeba histolytica
ISLCSSITCLSIFIEKIVVVDDF

SEQ ID NO: 2681154 - protein, 17 aa, Entamoeba histolytica
ISLEWKKETGYKRKYQF

SEQ ID NO: 2681155 - protein, 17 aa, Entamoeba histolytica
ISLIFKWVLDGQYDVDC

SEQ ID NO: 2681156 - protein, 24 aa, Entamoeba histolytica
ISLIRWKVEDGLFYCEKRSTMFVP

SEQ ID NO: 2681157 - protein, 21 aa, Entamoeba histolytica
ISLIYKSRMLKDNAQNLGGLG

SEQ ID NO: 2681158 - protein, 19 aa, Entamoeba histolytica
ISLKKDDIVLVYRKDGDWW

SEQ ID NO: 2681159 - protein, 17 aa, Entamoeba histolytica
ISLLETLCHRFDDVFNN

SEQ ID NO: 2681160 - protein, 17 aa, Entamoeba histolytica
ISLLIPEIWSKMRRYEQ

SEQ ID NO: 2681161 - protein, 20 aa, Entamoeba histolytica
ISLLKKYYCKVEYTCDTSKL

SEQ ID NO: 2681162 - protein, 19 aa, Entamoeba histolytica
ISLNCGHYFCIKCWEERIK

SEQ ID NO: 2681163 - protein, 17 aa, Entamoeba histolytica
ISLNIGFSKMNEINQIC

SEQ ID NO: 2681164 - protein, 19 aa, Entamoeba histolytica
ISLNLAHRLMNRMCYGNNT

SEQ ID NO: 2681165 - protein, 17 aa, Entamoeba histolytica
ISLPHTLLLGLLHKDPI

SEQ ID NO: 2681166 - protein, 17 aa, Entamoeba histolytica
ISLPLKGKVPATVDMKI

SEQ ID NO: 2681167 - protein, 22 aa, Entamoeba histolytica
ISLPRINQCMLGSYFEVELYQL

SEQ ID NO: 2681168 - protein, 18 aa, Entamoeba histolytica
ISLRAVVTVPAYFDDSQK

SEQ ID NO: 2681169 - protein, 18 aa, Entamoeba histolytica
ISLRAVVTVPAYFDNSQK

SEQ ID NO: 2681170 - protein, 21 aa, Entamoeba histolytica
ISLRHYICIITYNTSITLYQI

SEQ ID NO: 2681171 - protein, 21 aa, Entamoeba histolytica
ISLSDKGGCDAGWNIIAEQDS

SEQ ID NO: 2681172 - protein, 25 aa, Entamoeba histolytica
ISLSGICDYLINLFRGRKCKGCVNV

SEQ ID NO: 2681173 - protein, 20 aa, Entamoeba histolytica
ISLSHFLPHLDIFGYKIEVT

SEQ ID NO: 2681174 - protein, 30 aa, Entamoeba histolytica
ISLSLNNICFLKLPILNEIKRCFPNELLTM

SEQ ID NO: 2681175 - protein, 27 aa, Entamoeba histolytica
ISLSYLDDFDPHFALLSINNKYVFLSH

SEQ ID NO: 2681176 - protein, 26 aa, Entamoeba histolytica
ISLTIKQLYHFLAYYVLDTLFTQPEK

SEQ ID NO: 2681177 - protein, 20 aa, Entamoeba histolytica
ISLYLRSGFYGRVNDVDIES

SEQ ID NO: 2681178 - protein, 17 aa, Entamoeba histolytica
ISLYRTLIESIGLTPLM

SEQ ID NO: 2681179 - protein, 17 aa, Entamoeba histolytica
ISMDIFNEFIIINDLYT

SEQ ID NO: 2681180 - protein, 20 aa, Entamoeba histolytica
ISMFTGFFVVEFDLEDGEVV

SEQ ID NO: 2681181 - protein, 24 aa, Entamoeba histolytica
ISMIPNVFLTRLELMKCGSFKFID

SEQ ID NO: 2681182 - protein, 18 aa, Entamoeba histolytica
ISMLFDFKTNPDVQISIQ

SEQ ID NO: 2681183 - protein, 23 aa, Entamoeba histolytica
ISMLRSNCYSYVYGSPMSPVEAQ

SEQ ID NO: 2681184 - protein, 21 aa, Entamoeba histolytica
ISMMHVVDFIPILGQEKSVTI

SEQ ID NO: 2681185 - protein, 19 aa, Entamoeba histolytica
ISMRCYEKIFNIMTNCSTD

SEQ ID NO: 2681186 - protein, 19 aa, Entamoeba histolytica
ISMSECYTLLKQAWEPLLS

SEQ ID NO: 2681187 - protein, 22 aa, Entamoeba histolytica
ISNAVETWGTLNFARNTKNIKM

SEQ ID NO: 2681188 - protein, 17 aa, Entamoeba histolytica
ISNCKRIQCNKEMKELI

SEQ ID NO: 2681189 - protein, 19 aa, Entamoeba histolytica
ISNDGKFIAGGSCDNSYSV

SEQ ID NO: 2681190 - protein, 23 aa, Entamoeba histolytica
ISNDISHIINLYFKELWGKSVEH

SEQ ID NO: 2681191 - protein, 27 aa, Entamoeba histolytica
ISNELWELLELKGCYCSMKRFPNDVIN

SEQ ID NO: 2681192 - protein, 18 aa, Entamoeba histolytica
ISNFPFSICQNTIKFIRI

SEQ ID NO: 2681193 - protein, 17 aa, Entamoeba histolytica
ISNFYGMTTCYIQCNEE

SEQ ID NO: 2681194 - protein, 18 aa, Entamoeba histolytica
ISNHIVCALSQLQSLMKN

SEQ ID NO: 2681195 - protein, 27 aa, Entamoeba histolytica
ISNILPLSNFYGLERLWLANNQIKYFT

SEQ ID NO: 2681196 - protein, 18 aa, Entamoeba histolytica
ISNILRLLYKFPSLNKGY

SEQ ID NO: 2681197 - protein, 23 aa, Entamoeba histolytica
ISNKKWIIEPLIEPFDIKGKCIL

SEQ ID NO: 2681198 - protein, 26 aa, Entamoeba histolytica
ISNKNCEKGLCVLSGLIQLVVDPHYR

SEQ ID NO: 2681199 - protein, 28 aa, Entamoeba histolytica
ISNKPNIILPFQFCNFVHLKQLIIENLH

SEQ ID NO: 2681200 - protein, 33 aa, Entamoeba histolytica
ISNLIKLWFRELPRPILNVLSCDQIFYSTEPAE

SEQ ID NO: 2681201 - protein, 18 aa, Entamoeba histolytica
ISNLKLFSYDIFNDENEK

SEQ ID NO: 2681202 - protein, 24 aa, Entamoeba histolytica
ISNMKYKTVFVVPVIQSITDVVIT

SEQ ID NO: 2681203 - protein, 21 aa, Entamoeba histolytica
ISNRDSFEYLQDWVNDVSNYC

SEQ ID NO: 2681204 - protein, 20 aa, Entamoeba histolytica
ISNSIHSQVFLSSKINIEQN

SEQ ID NO: 2681205 - protein, 26 aa, Entamoeba histolytica
ISNSLYFDCLKSFLIQNQSNQMVVES

SEQ ID NO: 2681206 - protein, 24 aa, Entamoeba histolytica
ISNSMPFQFLSLHLSKSVIYIPSV

SEQ ID NO: 2681207 - protein, 17 aa, Entamoeba histolytica
ISNYGLGVTELYLNDFV

SEQ ID NO: 2681208 - protein, 18 aa, Entamoeba histolytica
ISPAHEFYDTVIEKVMSR

SEQ ID NO: 2681209 - protein, 24 aa, Entamoeba histolytica
ISPDLRWIWRTNTFEMKATTLKST

SEQ ID NO: 2681210 - protein, 17 aa, Entamoeba histolytica
ISPECIIEWENQGAKKV

SEQ ID NO: 2681211 - protein, 21 aa, Entamoeba histolytica
ISPKELRNVCELLNDKGKYVG

SEQ ID NO: 2681212 - protein, 22 aa, Entamoeba histolytica
ISPKLCSGNGYIYLQGGSLRKI

SEQ ID NO: 2681213 - protein, 26 aa, Entamoeba histolytica
ISPLYYKIRACIGLIQHQELMPMLLQ

SEQ ID NO: 2681214 - protein, 21 aa, Entamoeba histolytica
ISPRCLCCICEQEDTLIKENK

SEQ ID NO: 2681215 - protein, 26 aa, Entamoeba histolytica
ISPRSPRKFIPWGLSPSPTFSRSPSP

SEQ ID NO: 2681216 - protein, 28 aa, Entamoeba histolytica
ISPSILEAFYKFKIPKATDFLHDFIDCF

SEQ ID NO: 2681217 - protein, 17 aa, Entamoeba histolytica
ISPTLDHWECKRRLQQK

SEQ ID NO: 2681218 - protein, 19 aa, Entamoeba histolytica
ISPVELRFNPGQTNDFKPE

SEQ ID NO: 2681219 - protein, 18 aa, Entamoeba histolytica
ISQCKEELVLKRMNDIRF

SEQ ID NO: 2681220 - protein, 24 aa, Entamoeba histolytica
ISQCLKIKSLEFLNKCSVLTSLEL

SEQ ID NO: 2681221 - protein, 17 aa, Entamoeba histolytica
ISQHWKEFGNIQINMSF

SEQ ID NO: 2681222 - protein, 24 aa, Entamoeba histolytica
ISQITEFFNNIVLIPVINNVKKSD

SEQ ID NO: 2681223 - protein, 20 aa, Entamoeba histolytica
ISQLYWLRHNLLATLGLSIG

SEQ ID NO: 2681224 - protein, 28 aa, Entamoeba histolytica
ISQNLYQHMCFNYKFSYDQFLELLKGIN

SEQ ID NO: 2681225 - protein, 18 aa, Entamoeba histolytica
ISQRCEFDVQIYVYSIKF

SEQ ID NO: 2681226 - protein, 26 aa, Entamoeba histolytica
ISQYLYKIYGEYALVISVGNQLVTQF

SEQ ID NO: 2681227 - protein, 21 aa, Entamoeba histolytica
ISRAKRLSMIPTLSLKKTEIS

SEQ ID NO: 2681228 - protein, 19 aa, Entamoeba histolytica
ISRCRGCKGYMNKYNNWIV

SEQ ID NO: 2681229 - protein, 19 aa, Entamoeba histolytica
ISRECGFDVNIWVCLPGTL

SEQ ID NO: 2681230 - protein, 27 aa, Entamoeba histolytica
ISREHFRYIIKYVFSFISKDKQHEQLM

SEQ ID NO: 2681231 - protein, 17 aa, Entamoeba histolytica
ISRFNIDTQRWFECSNF

SEQ ID NO: 2681232 - protein, 25 aa, Entamoeba histolytica
ISRKIRRGSEFTGIYSPLMLNVGST

SEQ ID NO: 2681233 - protein, 21 aa, Entamoeba histolytica
ISRQALFSIFLDFIQKQTNCE

SEQ ID NO: 2681234 - protein, 22 aa, Entamoeba histolytica
ISRYNEIIQLYLATSAQQEQIP

SEQ ID NO: 2681235 - protein, 25 aa, Entamoeba histolytica
ISSFDYPSCLLELQGIRKEGKRVIC

SEQ ID NO: 2681236 - protein, 28 aa, Entamoeba histolytica
ISSFLQRIRIILKYCYPDGSFNDNTLKQ

SEQ ID NO: 2681237 - protein, 24 aa, Entamoeba histolytica
ISSHPSYGFHVFQYCHLLKEILIT

SEQ ID NO: 2681238 - protein, 17 aa, Entamoeba histolytica
ISSILSFFSTENRVKAT

SEQ ID NO: 2681239 - protein, 19 aa, Entamoeba histolytica
ISSINGFQWACNILNNCSK

SEQ ID NO: 2681240 - protein, 19 aa, Entamoeba histolytica
ISSIQPWDVQFCEELEKDV

SEQ ID NO: 2681241 - protein, 24 aa, Entamoeba histolytica
ISSKSPRPKAVIVDKDNLKEEFEK

SEQ ID NO: 2681242 - protein, 18 aa, Entamoeba histolytica
ISSLPEWAQKSLMPLKYL

SEQ ID NO: 2681243 - protein, 18 aa, Entamoeba histolytica
ISSLPGFGLLLFNNYDCD

SEQ ID NO: 2681244 - protein, 17 aa, Entamoeba histolytica
ISSLRKKLWMEHLGFKE

SEQ ID NO: 2681245 - protein, 24 aa, Entamoeba histolytica
ISSLVYHLSCSTAISVKPYIIQCG

SEQ ID NO: 2681246 - protein, 21 aa, Entamoeba histolytica
ISSPEEMKSFLLKTTSINSNE

SEQ ID NO: 2681247 - protein, 17 aa, Entamoeba histolytica
ISSPLIEDNINEFKIED

SEQ ID NO: 2681248 - protein, 18 aa, Entamoeba histolytica
ISSVFGDGFETVFDIVKG

SEQ ID NO: 2681249 - protein, 30 aa, Entamoeba histolytica
ISSVLNRPIMNWDLKGMFYLIDNGDNYVNN

SEQ ID NO: 2681250 - protein, 22 aa, Entamoeba histolytica
ISSYKLPLNYLKQTEQIALKEF

SEQ ID NO: 2681251 - protein, 18 aa, Entamoeba histolytica
ISSYPFIGKIEVVLFQKI

SEQ ID NO: 2681252 - protein, 23 aa, Entamoeba histolytica
ISTIIDGPMKWDCTNPQEFYFRR

SEQ ID NO: 2681253 - protein, 26 aa, Entamoeba histolytica
ISTKSMFCFNALYTIWGMSEETIQSS

SEQ ID NO: 2681254 - protein, 25 aa, Entamoeba histolytica
ISTLKRIGMEECITVFTLSSIIDSK

SEQ ID NO: 2681255 - protein, 18 aa, Entamoeba histolytica
ISTLKYWVEQSNGRKKRY

SEQ ID NO: 2681256 - protein, 25 aa, Entamoeba histolytica
ISTLWRICQTYDYFFVKTVVREYTD

SEQ ID NO: 2681257 - protein, 20 aa, Entamoeba histolytica
ISTRRRWILLTSLKTIHNIN

SEQ ID NO: 2681258 - protein, 22 aa, Entamoeba histolytica
ISVAVPIPFKPGVIGGLSCEKS

SEQ ID NO: 2681259 - protein, 26 aa, Entamoeba histolytica
ISVDFKTGIVLINFFELISKKILRER

SEQ ID NO: 2681260 - protein, 18 aa, Entamoeba histolytica
ISVEQHAREFLKKPIEII

SEQ ID NO: 2681261 - protein, 29 aa, Entamoeba histolytica
ISVGPFKLGMPLFEILKSLDIGPSATNSA

SEQ ID NO: 2681262 - protein, 17 aa, Entamoeba histolytica
ISVGYGPKQCLSEIRSN

SEQ ID NO: 2681263 - protein, 24 aa, Entamoeba histolytica
ISVIPDYIRYLSLVEIDISYNQLV

SEQ ID NO: 2681264 - protein, 30 aa, Entamoeba histolytica; identical to SEQ ID NO: 2488251

SEQ ID NO: 2681265 - protein, 26 aa, Entamoeba histolytica
ISVLRLCVFNNIYLPENFIEEIKQST

SEQ ID NO: 2681266 - protein, 23 aa, Entamoeba histolytica
ISVLWPCVHFLLSVFQDETVISM

SEQ ID NO: 2681267 - protein, 30 aa, Entamoeba histolytica
ISVNQDFSCFAIGTTFGFRVFGIENGRFRE

SEQ ID NO: 2681268 - protein, 19 aa, Entamoeba histolytica
ISVPYKFFKLFLSSHNFHK

SEQ ID NO: 2681269 - protein, 25 aa, Entamoeba histolytica
ISVRGNLFYPRSLKLSDYDSLCNLP

SEQ ID NO: 2681270 - protein, 21 aa, Entamoeba histolytica
ISVVQKCYYVPQLKDILIIPK

SEQ ID NO: 2681271 - protein, 25 aa, Entamoeba histolytica
ISYGHLRCANIFINLEGKVKCFGIF

SEQ ID NO: 2681272 - protein, 17 aa, Entamoeba histolytica
ISYRNKLLYSIKDINRK

SEQ ID NO: 2681273 - protein, 28 aa, Entamoeba histolytica
ISYSEMRVAYELSEKLKINVFIGSNYIA

SEQ ID NO: 2681274 - protein, 25 aa, Entamoeba histolytica
ISYYKSRSSYFLNIINKRLKVNTNV

SEQ ID NO: 2681275 - protein, 24 aa, Entamoeba histolytica
ITACGALFYCSYLPSGIKRSKQTF

SEQ ID NO: 2681276 - protein, 24 aa, Entamoeba histolytica
ITACGFPDSATKYFINLLISSNQQ

SEQ ID NO: 2681277 - protein, 17 aa, Entamoeba histolytica
ITAIEILQHQSIAMFKQ

SEQ ID NO: 2681278 - protein, 17 aa, Entamoeba histolytica
ITAIKFQDNYPFEIPYS

SEQ ID NO: 2681279 - protein, 24 aa, Entamoeba histolytica
ITAKGLQCLLKLLKTQKGSDLIGK

SEQ ID NO: 2681280 - protein, 17 aa, Entamoeba histolytica
ITALFFCGEHKNSFVNR

SEQ ID NO: 2681281 - protein, 19 aa, Entamoeba histolytica
ITATALKYAQAMKASCVFC

SEQ ID NO: 2681282 - protein, 24 aa, Entamoeba histolytica
ITATVRPSLLLARNQLEQKHKEKE

SEQ ID NO: 2681283 - protein, 21 aa, Entamoeba histolytica
ITCAACCSVDLMPFLNKANGE

SEQ ID NO: 2681284 - protein, 19 aa, Entamoeba histolytica
ITCCECGYSSESFDPFNCI

SEQ ID NO: 2681285 - protein, 20 aa, Entamoeba histolytica
ITCIKRYLIDWDKETSNYHE

SEQ ID NO: 2681286 - protein, 17 aa, Entamoeba histolytica
ITCKLGIQEQFYKNSRK

SEQ ID NO: 2681287 - protein, 25 aa, Entamoeba histolytica
ITCRCGFQFCWLCMQPYTKDHWRVN

SEQ ID NO: 2681288 - protein, 18 aa, Entamoeba histolytica
ITDCSFETFPIAGDLPRL

SEQ ID NO: 2681289 - protein, 17 aa, Entamoeba histolytica
ITDFKFFVETFVREVKW

SEQ ID NO: 2681290 - protein, 25 aa, Entamoeba histolytica
ITDITSRFKFPFTAEYKYDGERGQI

SEQ ID NO: 2681291 - protein, 19 aa, Entamoeba histolytica
ITDIVKLIAKIQCKGGIIK

SEQ ID NO: 2681292 - protein, 23 aa, Entamoeba histolytica
ITDLKIKFPPSITNFNILSSVTK

SEQ ID NO: 2681293 - protein, 26 aa, Entamoeba histolytica
ITDLPSCVKFSCDFRQSVLELLLWCN

SEQ ID NO: 2681294 - protein, 18 aa, Entamoeba histolytica
ITEFPCADIALSPNQFKL

SEQ ID NO: 2681295 - protein, 21 aa, Entamoeba histolytica
ITEIGDWCFRESSNLVDIVIP

SEQ ID NO: 2681296 - protein, 23 aa, Entamoeba histolytica
ITEKGITPMGGFPHYGVVKNDFL

SEQ ID NO: 2681297 - protein, 22 aa, Entamoeba histolytica
ITEKHSSGWWFATNSQGQSGFV

SEQ ID NO: 2681298 - protein, 19 aa, Entamoeba histolytica
ITELKRGIYECRYFSKESG

SEQ ID NO: 2681299 - protein, 25 aa, Entamoeba histolytica
ITEMCPGTFKYAFFIHTNENFHITS

SEQ ID NO: 2681300 - protein, 17 aa, Entamoeba histolytica
ITEPPVRAIIGGKKKIE

SEQ ID NO: 2681301 - protein, 21 aa, Entamoeba histolytica
ITETNLWIPQRERVDDYTKQE

SEQ ID NO: 2681302 - protein, 21 aa, Entamoeba histolytica
ITFCGNCWFCQHGYINNCEYG

SEQ ID NO: 2681303 - protein, 23 aa, Entamoeba histolytica
ITFCYKECYCTISNDGIIHNKRL

SEQ ID NO: 2681304 - protein, 22 aa, Entamoeba histolytica
ITFDLCHLHYSVLSSIYTPAHL

SEQ ID NO: 2681305 - protein, 23 aa, Entamoeba histolytica
ITFEPYDEFEWFLFNGNEMIVLR

SEQ ID NO: 2681306 - protein, 17 aa, Entamoeba histolytica
ITFKKILVREVVKPKTE

SEQ ID NO: 2681307 - protein, 20 aa, Entamoeba histolytica
ITFKLLPLIRKTQNSRVIEV

SEQ ID NO: 2681308 - protein, 20 aa, Entamoeba histolytica
ITFKTVEGILNENDFIPSNK

SEQ ID NO: 2681309 - protein, 18 aa, Entamoeba histolytica
ITFQTEIQRHLHLIKETS

SEQ ID NO: 2681310 - protein, 25 aa, Entamoeba histolytica
ITFTLLFDCLKCIQKHFPLNMPQLE

SEQ ID NO: 2681311 - protein, 19 aa, Entamoeba histolytica
ITFVKKINHEFGINPYIVG

SEQ ID NO: 2681312 - protein, 18 aa, Entamoeba histolytica
ITFWDTPRQISFFGPTPY

SEQ ID NO: 2681313 - protein, 23 aa, Entamoeba histolytica
ITGACGYLGVYIVDAVAKNKNIK

SEQ ID NO: 2681314 - protein, 25 aa, Entamoeba histolytica
ITGLLKIAKLLLPKVEIIPEKIDLT

SEQ ID NO: 2681315 - protein, 18 aa, Entamoeba histolytica
ITGPCTFGPGMIVSDDLK

SEQ ID NO: 2681316 - protein, 17 aa, Entamoeba histolytica
ITGRLNAYAGKNHPPEI

SEQ ID NO: 2681317 - protein, 25 aa, Entamoeba histolytica
ITGTLKICSFSIFFASNEQSFPIRR

SEQ ID NO: 2681318 - protein, 20 aa, Entamoeba histolytica
ITGVIKRLIQENGKLQFQID

SEQ ID NO: 2681319 - protein, 27 aa, Entamoeba histolytica
ITGVLLRKKISVVWAKLTPEIQEQIEN

SEQ ID NO: 2681320 - protein, 27 aa, Entamoeba histolytica
ITGYIEKTKMGIQLDRKKTDTGLSNLL

SEQ ID NO: 2681321 - protein, 18 aa, Entamoeba histolytica
ITHAMTLMQERMIGLDTT

SEQ ID NO: 2681322 - protein, 19 aa, Entamoeba histolytica
ITHCFVCNCLYRGLYPYTI

SEQ ID NO: 2681323 - protein, 18 aa, Entamoeba histolytica
ITHFSFSLAKSFLYDQFE

SEQ ID NO: 2681324 - protein, 22 aa, Entamoeba histolytica
ITHKYGSIDIELVPLQSIEEGI

SEQ ID NO: 2681325 - protein, 19 aa, Entamoeba histolytica
ITHPIFRSLITTNISILQD

SEQ ID NO: 2681326 - protein, 23 aa, Entamoeba histolytica
ITHPILCGYYYILYEEKDSTETC

SEQ ID NO: 2681327 - protein, 22 aa, Entamoeba histolytica
ITHPTIPLLYILEGDNNSCKVG

SEQ ID NO: 2681328 - protein, 19 aa, Entamoeba histolytica
ITICIKAISGNDCEWITSD

SEQ ID NO: 2681329 - protein, 23 aa, Entamoeba histolytica
ITIGICLNGKPLIKKQFNKNISL

SEQ ID NO: 2681330 - protein, 24 aa, Entamoeba histolytica
ITIGICLNGKPLIKKQFNKTNSLS

SEQ ID NO: 2681331 - protein, 25 aa, Entamoeba histolytica
ITIGICLNGKPLIKKQFNKTNSLSD

SEQ ID NO: 2681332 - protein, 23 aa, Entamoeba histolytica
ITIKEGFLYIECGINTPSLITTP

SEQ ID NO: 2681333 - protein, 17 aa, Entamoeba histolytica
ITIPCYHSPFAFPVPEE

SEQ ID NO: 2681334 - protein, 17 aa, Entamoeba histolytica
ITIPIAIPVDLINEIDI

SEQ ID NO: 2681335 - protein, 17 aa, Entamoeba histolytica
ITIPKDSSMIFFNDAYL

SEQ ID NO: 2681336 - protein, 26 aa, Entamoeba histolytica
ITIQKVCLNICSLLFEKIDEYKMTVY

SEQ ID NO: 2681337 - protein, 22 aa, Entamoeba histolytica
ITISCISRVLSVLMNLPTSNVF

SEQ ID NO: 2681338 - protein, 27 aa, Entamoeba histolytica
ITISIKFPICNNSLPWSWKMKPSQFSS

SEQ ID NO: 2681339 - protein, 17 aa, Entamoeba histolytica
ITIVTLIGNIAGDRAET

SEQ ID NO: 2681340 - protein, 18 aa, Entamoeba histolytica
ITKFYVNELIQLLKSKTM

SEQ ID NO: 2681341 - protein, 24 aa, Entamoeba histolytica
ITKIGSCCFFNCYSLTKLKIPKGI

SEQ ID NO: 2681342 - protein, 24 aa, Entamoeba histolytica
ITKIQVLCFEYCGFYEGSTYSKEV

SEQ ID NO: 2681343 - protein, 24 aa, Entamoeba histolytica
ITKKASFSSISGWLREFQQNQNPS

SEQ ID NO: 2681344 - protein, 25 aa, Entamoeba histolytica
ITKKTSFESVEKWLAELHENADKKV

SEQ ID NO: 2681345 - protein, 17 aa, Entamoeba histolytica
ITKLLGIVEECDTINDL

SEQ ID NO: 2681346 - protein, 24 aa, Entamoeba histolytica
ITKNYGIKCILTYNSVSASAAYLK

SEQ ID NO: 2681347 - protein, 22 aa, Entamoeba histolytica
ITKPFIFVDCHVLRQYLNNTIK

SEQ ID NO: 2681348 - protein, 29 aa, Entamoeba histolytica
ITKRLSPCLCQFALCVPNQVCWKPLNHQL

SEQ ID NO: 2681349 - protein, 18 aa, Entamoeba histolytica
ITKSCIVALLRGIWIMPI

SEQ ID NO: 2681350 - protein, 18 aa, Entamoeba histolytica
ITKYPLFIREIKPLLVSI

SEQ ID NO: 2681351 - protein, 24 aa, Entamoeba histolytica
ITLAKCYYFKYVISLYNKESKNSE

SEQ ID NO: 2681352 - protein, 28 aa, Entamoeba histolytica
ITLDDFCGGSMGLLAVRQSELLIVLSNE

SEQ ID NO: 2681353 - protein, 20 aa, Entamoeba histolytica
ITLDFLRYSFYTNINAIKTA

SEQ ID NO: 2681354 - protein, 19 aa, Entamoeba histolytica
ITLFPTIKYNLRETMIKIQ

SEQ ID NO: 2681355 - protein, 17 aa, Entamoeba histolytica
ITLITYGMLNFEDIFAV

SEQ ID NO: 2681356 - protein, 24 aa, Entamoeba histolytica
ITLLKDEKSIFCIVKSQIGIDEAN

SEQ ID NO: 2681357 - protein, 24 aa, Entamoeba histolytica
ITLPGCIGCTVVSNTFSPTTQLDY

SEQ ID NO: 2681358 - protein, 27 aa, Entamoeba histolytica
ITLPLLKRKDEIFSIPDFLWITKQKCW

SEQ ID NO: 2681359 - protein, 17 aa, Entamoeba histolytica
ITLPLSIIKVGSRCFER

SEQ ID NO: 2681360 - protein, 23 aa, Entamoeba histolytica
ITLPQYYLSFLISGGLHVLLDYG

SEQ ID NO: 2681361 - protein, 19 aa, Entamoeba histolytica
ITLQRRIIIQTGKSSSEKN

SEQ ID NO: 2681362 - protein, 29 aa, Entamoeba histolytica
ITLQTPLVFWKWANEHILAIVTSTSVFHF

SEQ ID NO: 2681363 - protein, 24 aa, Entamoeba histolytica
ITLRLPIKQAKVFEQILVVDSISR

SEQ ID NO: 2681364 - protein, 25 aa, Entamoeba histolytica
ITLSCGHTFCYTCDLEYSMKYGNCY

SEQ ID NO: 2681365 - protein, 17 aa, Entamoeba histolytica
ITMAIGVLTTLKLTKED

SEQ ID NO: 2681366 - protein, 18 aa, Entamoeba histolytica
ITMAIGVLTTLKLTKEDF

SEQ ID NO: 2681367 - protein, 18 aa, Entamoeba histolytica
ITMALKYLHSLNIIHRDL

SEQ ID NO: 2681368 - protein, 17 aa, Entamoeba histolytica
ITMKNIRIDDVVYGLYE

SEQ ID NO: 2681369 - protein, 22 aa, Entamoeba histolytica
ITMTCLKKSIVIAGVDKDTKCE

SEQ ID NO: 2681370 - protein, 33 aa, Entamoeba histolytica
ITMTGFKGVLLIVFKTKIEFIDIASFTIISTVN

SEQ ID NO: 2681371 - protein, 25 aa, Entamoeba histolytica
ITNLCPFGIFLQLRYLSIKNNLIED

SEQ ID NO: 2681372 - protein, 35 aa, Entamoeba histolytica
ITNLKEIYRLFGELPKDITGLCALQHRKDNPQRVR

SEQ ID NO: 2681373 - protein, 34 aa, Entamoeba histolytica
ITNLPRYLTYIIETCVPFLESITCFPLMEHPKQT

SEQ ID NO: 2681374 - protein, 35 aa, Entamoeba histolytica
ITNLPRYLTYIIETCVPFLESITCFPLMEHPKQTK

SEQ ID NO: 2681375 - protein, 24 aa, Entamoeba histolytica
ITNNHIHFGYLIKKIKEIYQIKSL

SEQ ID NO: 2681376 - protein, 18 aa, Entamoeba histolytica
ITNQLGIQYQRYCTPTVS

SEQ ID NO: 2681377 - protein, 17 aa, Entamoeba histolytica
ITNRYYIQIPFSQLDKY

SEQ ID NO: 2681378 - protein, 17 aa, Entamoeba histolytica
ITNTVLQKRSDFGDTTT

SEQ ID NO: 2681379 - protein, 27 aa, Entamoeba histolytica
ITNVLRTPPGYHCIFSQSGKLFICELH

SEQ ID NO: 2681380 - protein, 17 aa, Entamoeba histolytica
ITNWLNYTLKSCYKKKI

SEQ ID NO: 2681381 - protein, 25 aa, Entamoeba histolytica
ITPAIMFCDSIGFLSANFYAKNLFD

SEQ ID NO: 2681382 - protein, 18 aa, Entamoeba histolytica
ITPISGGFIFMYDVSAIC

SEQ ID NO: 2681383 - protein, 24 aa, Entamoeba histolytica
ITPKMRQKLVDWIAEISTVLTLLS

SEQ ID NO: 2681384 - protein, 24 aa, Entamoeba histolytica
ITPKRFNSIEMMKICQRINDEISY

SEQ ID NO: 2681385 - protein, 19 aa, Entamoeba histolytica
ITPLLGCPLLQTLVLAHNN

SEQ ID NO: 2681386 - protein, 17 aa, Entamoeba histolytica
ITPLMYAIELGFDDISL

SEQ ID NO: 2681387 - protein, 18 aa, Entamoeba histolytica
ITPLWEFHAQNKLEEYEQ

SEQ ID NO: 2681388 - protein, 18 aa, Entamoeba histolytica
ITPPMPKDGLVWEKQGED

SEQ ID NO: 2681389 - protein, 20 aa, Entamoeba histolytica
ITPPWYLKFNNSAIYDDNTE

SEQ ID NO: 2681390 - protein, 17 aa, Entamoeba histolytica
ITPQCVAAWKKEALLCL

SEQ ID NO: 2681391 - protein, 23 aa, Entamoeba histolytica
ITPRIPVYSFWINDMNGFEISSI

SEQ ID NO: 2681392 - protein, 20 aa, Entamoeba histolytica
ITPSLCKLTKLSVLDVSANP

SEQ ID NO: 2681393 - protein, 17 aa, Entamoeba histolytica
ITQCLSHSFYLTLSEAT

SEQ ID NO: 2681394 - protein, 19 aa, Entamoeba histolytica
ITQEFFGWNQNKVIDDIIA

SEQ ID NO: 2681395 - protein, 17 aa, Entamoeba histolytica
ITQHFKNQLNIIVIYSK

SEQ ID NO: 2681396 - protein, 19 aa, Entamoeba histolytica
ITQIIPIYEGYVISSCVHK

SEQ ID NO: 2681397 - protein, 31 aa, Entamoeba histolytica
ITQLKMELHLEWKRLACEVVNIPTGSFFSKS

SEQ ID NO: 2681398 - protein, 22 aa, Entamoeba histolytica
ITQPRRIAATAIAKRVEEEMGE

SEQ ID NO: 2681399 - protein, 17 aa, Entamoeba histolytica
ITQSIVWISLLLDENTW

SEQ ID NO: 2681400 - protein, 19 aa, Entamoeba histolytica
ITQTPGKILLRRKLSRLSE

SEQ ID NO: 2681401 - protein, 17 aa, Entamoeba histolytica
ITQVKVWCFEYHNHKDT

SEQ ID NO: 2681402 - protein, 19 aa, Entamoeba histolytica
ITSAMSIVGYEIKRQLNLR

SEQ ID NO: 2681403 - protein, 17 aa, Entamoeba histolytica
ITSFGYGCFYHCGCEKK

SEQ ID NO: 2681404 - protein, 24 aa, Entamoeba histolytica
ITSFRNGCFYGCGCEEELKKNKSI

SEQ ID NO: 2681405 - protein, 23 aa, Entamoeba histolytica
ITSGKHKVLIASFIPGICEQVRL

SEQ ID NO: 2681406 - protein, 19 aa, Entamoeba histolytica
ITSHCSLCNEIIKEKEQFV

SEQ ID NO: 2681407 - protein, 23 aa, Entamoeba histolytica
ITSIRFEGVYGLNLLWKMLMITG

SEQ ID NO: 2681408 - protein, 21 aa, Entamoeba histolytica
ITSKHLEEFILKDIQKIIDDL

SEQ ID NO: 2681409 - protein, 25 aa, Entamoeba histolytica
ITSKRSKLTLPFLKINKIIFTSEDV

SEQ ID NO: 2681410 - protein, 18 aa, Entamoeba histolytica
ITSLCFNGISLQSSSLDG

SEQ ID NO: 2681411 - protein, 19 aa, Entamoeba histolytica
ITSLFKYLSTHSFVSLTRK

SEQ ID NO: 2681412 - protein, 17 aa, Entamoeba histolytica
ITSLIPIKERVELMINL

SEQ ID NO: 2681413 - protein, 19 aa, Entamoeba histolytica
ITSLLKYGAYGLLKDDDDK

SEQ ID NO: 2681414 - protein, 28 aa, Entamoeba histolytica
ITSLQPCFPRHLSLLFPNDLPTTFWQRC

SEQ ID NO: 2681415 - protein, 17 aa, Entamoeba histolytica
ITSMDGIDETTKHEFDL

SEQ ID NO: 2681416 - protein, 21 aa, Entamoeba histolytica
ITSPILFELINACIIGLNKHI

SEQ ID NO: 2681417 - protein, 26 aa, Entamoeba histolytica
ITSPKFRISSSISYIGHFVSDDEYDP

SEQ ID NO: 2681418 - protein, 20 aa, Entamoeba histolytica
ITSSKWLYHINKILKGTYLT

SEQ ID NO: 2681419 - protein, 19 aa, Entamoeba histolytica
ITTEVLMTCTFRTLDKSCS

SEQ ID NO: 2681420 - protein, 26 aa, Entamoeba histolytica
ITTFSDWKLILYFINLLGKFGGETNY

SEQ ID NO: 2681421 - protein, 17 aa, Entamoeba histolytica
ITTIRKFLFQILRALRT

SEQ ID NO: 2681422 - protein, 18 aa, Entamoeba histolytica
ITTKATTITSCFAQMELI

SEQ ID NO: 2681423 - protein, 18 aa, Entamoeba histolytica
ITTLTCKDFCSFEDKSGC

SEQ ID NO: 2681424 - protein, 25 aa, Entamoeba histolytica
ITTPRGWKGKLSYFQATLILKETFF

SEQ ID NO: 2681425 - protein, 24 aa, Entamoeba histolytica
ITTREGFFRINFNVPRETEEGTVY

SEQ ID NO: 2681426 - protein, 23 aa, Entamoeba histolytica
ITTRGGYRPLTIQQVINFSNQSG

SEQ ID NO: 2681427 - protein, 23 aa, Entamoeba histolytica
ITTSCGMLDYIVVESIEGAQKIS

SEQ ID NO: 2681428 - protein, 17 aa, Entamoeba histolytica
ITTVIRWVAENDSVVLF

SEQ ID NO: 2681429 - protein, 18 aa, Entamoeba histolytica
ITVCCKSSVSPFPPFMTT

SEQ ID NO: 2681430 - protein, 27 aa, Entamoeba histolytica
ITVIGFRGSYEFSDWVYDFKLFTESAL

SEQ ID NO: 2681431 - protein, 33 aa, Entamoeba histolytica
ITVIKCSSCKEILEGVCDCVLQLISPLNNNWKK

SEQ ID NO: 2681432 - protein, 26 aa, Entamoeba histolytica
ITVKYPRWFEFYDMIQIVETLHKKVE

SEQ ID NO: 2681433 - protein, 22 aa, Entamoeba histolytica
ITVLKKEGDWWLGELKGQQGYF

SEQ ID NO: 2681434 - protein, 22 aa, Entamoeba histolytica
ITVPGVKVVINFGMEKSMQFDT

SEQ ID NO: 2681435 - protein, 21 aa, Entamoeba histolytica
ITVQLCSGVCLQFSNDEDVQL

SEQ ID NO: 2681436 - protein, 24 aa, Entamoeba histolytica
ITWMHEIDGIFSLQQQKLISRIES

SEQ ID NO: 2681437 - protein, 24 aa, Entamoeba histolytica
ITYFGQDLYVCFNDSECVPMNWTN

SEQ ID NO: 2681438 - protein, 17 aa, Entamoeba histolytica
IVAAGLIQSKCYVPMHW

SEQ ID NO: 2681439 - protein, 19 aa, Entamoeba histolytica
IVACDGFWNVFKYEDAINL

SEQ ID NO: 2681440 - protein, 19 aa, Entamoeba histolytica
IVACWRAEKRHHWITLTTA

SEQ ID NO: 2681441 - protein, 18 aa, Entamoeba histolytica
IVAGIGFGVFKVICDGVE

SEQ ID NO: 2681442 - protein, 17 aa, Entamoeba histolytica
IVAGMLHLGNVEYSQGR

SEQ ID NO: 2681443 - protein, 22 aa, Entamoeba histolytica
IVAVCANSAFVVNEKTVKPLIS

SEQ ID NO: 2681444 - protein, 18 aa, Entamoeba histolytica
IVCDFINIPIKWEESSFE

SEQ ID NO: 2681445 - protein, 22 aa, Entamoeba histolytica
IVCDSSFKKKCFDSQRIKFLFD

SEQ ID NO: 2681446 - protein, 26 aa, Entamoeba histolytica
IVCESCESHIGWKFTTRNDLLKPKVF

SEQ ID NO: 2681447 - protein, 21 aa, Entamoeba histolytica
IVCFQKKNFIGSIEMSELGLV

SEQ ID NO: 2681448 - protein, 24 aa, Entamoeba histolytica
IVCSCARVSLRLIKDTIRLNDLKT

SEQ ID NO: 2681449 - protein, 27 aa, Entamoeba histolytica
IVDEFDLGIDIPNEFIVKEKKDLTSEI

SEQ ID NO: 2681450 - protein, 18 aa, Entamoeba histolytica
IVDHKEIFPNTKDLPVFN

SEQ ID NO: 2681451 - protein, 19 aa, Entamoeba histolytica
IVDHVTRKITPVGVPGEIE

SEQ ID NO: 2681452 - protein, 24 aa, Entamoeba histolytica
IVDIREFRCELPFHLFNQNYKLIP

SEQ ID NO: 2681453 - protein, 18 aa, Entamoeba histolytica
IVDQCLRCIEHVHKKGYI

SEQ ID NO: 2681454 - protein, 22 aa, Entamoeba histolytica
IVDRIKSKFPFDEKRYKSQTEF

SEQ ID NO: 2681455 - protein, 17 aa, Entamoeba histolytica
IVDVVRFSSAVISMDIS

SEQ ID NO: 2681456 - protein, 25 aa, Entamoeba histolytica
IVDWNKIIGWCEEWNKIDIQMNNKE

SEQ ID NO: 2681457 - protein, 26 aa, Entamoeba histolytica
IVDYLNVINLEWWKRVKDNILKDIPR

SEQ ID NO: 2681458 - protein, 18 aa, Entamoeba histolytica
IVECLNYVIGNEIKPLVM

SEQ ID NO: 2681459 - protein, 23 aa, Entamoeba histolytica
IVEGRNGEGWIYINGKTYSPSEI

SEQ ID NO: 2681460 - protein, 20 aa, Entamoeba histolytica
IVEIPLSIFLTGGTVEVSVA

SEQ ID NO: 2681461 - protein, 23 aa, Entamoeba histolytica
IVELWKNNDCIFTVENQKDIVIL

SEQ ID NO: 2681462 - protein, 24 aa, Entamoeba histolytica
IVEMFSKIFSFFIHKLCKHQQLTF

SEQ ID NO: 2681463 - protein, 24 aa, Entamoeba histolytica
IVERKSRILFVRNICFNTNEESIK

SEQ ID NO: 2681464 - protein, 23 aa, Entamoeba histolytica
IVESWCDGMTFAQLIQGSDLFEG

SEQ ID NO: 2681465 - protein, 20 aa, Entamoeba histolytica
IVETCKTYQQLFENIKEITK

SEQ ID NO: 2681466 - protein, 28 aa, Entamoeba histolytica
IVEYSMRLLCRIIKGDGVLITNIVDKEI

SEQ ID NO: 2681467 - protein, 22 aa, Entamoeba histolytica
IVFGESWGVVANSVYAPSMYPN

SEQ ID NO: 2681468 - protein, 37 aa, Entamoeba histolytica
IVFHPCGDHLIACSFDKKCIWYDLQAGLDPFKVLRLH

SEQ ID NO: 2681469 - protein, 17 aa, Entamoeba histolytica
IVFKKSSLYQIIPFSNK

SEQ ID NO: 2681470 - protein, 23 aa, Entamoeba histolytica
IVFLLICDKYCFGFFNSQCLQSY

SEQ ID NO: 2681471 - protein, 22 aa, Entamoeba histolytica
IVFSCGILKITMLLIKKSQVKF

SEQ ID NO: 2681472 - protein, 17 aa, Entamoeba histolytica
IVGEIEGVLSMIENSIA

SEQ ID NO: 2681473 - protein, 19 aa, Entamoeba histolytica
IVGFEGCWIFDNRVYIGME

SEQ ID NO: 2681474 - protein, 19 aa, Entamoeba histolytica
IVGFEGCWLYNNQVYIGME

SEQ ID NO: 2681475 - protein, 19 aa, Entamoeba histolytica
IVGHKFKYPLDFASVTSMV

SEQ ID NO: 2681476 - protein, 20 aa, Entamoeba histolytica
IVGKGKFRLSNVEIKSTLNI

SEQ ID NO: 2681477 - protein, 23 aa, Entamoeba histolytica
IVGKKFECKEAYKSENKKGEETV

SEQ ID NO: 2681478 - protein, 24 aa, Entamoeba histolytica
IVGKLCSAMRFYEERKMYKDELDK

SEQ ID NO: 2681479 - protein, 23 aa, Entamoeba histolytica
IVGLLKLFNYLSINFDRLLDIIE

SEQ ID NO: 2681480 - protein, 18 aa, Entamoeba histolytica
IVGLSEIRRELGMKENTS

SEQ ID NO: 2681481 - protein, 27 aa, Entamoeba histolytica
IVGSPYSDLYCKLLIKKWNKMPDMMEQ

SEQ ID NO: 2681482 - protein, 31 aa, Entamoeba histolytica
IVHIDFDMLFWKGEILPVPETVPFRLTTNMI

SEQ ID NO: 2681483 - protein, 33 aa, Entamoeba histolytica
IVHLINGKVIPNCLGNIWVYVRDWSEEDVGNLM

SEQ ID NO: 2681484 - protein, 17 aa, Entamoeba histolytica
IVHLPRIDGLQVTSHIE

SEQ ID NO: 2681485 - protein, 23 aa, Entamoeba histolytica
IVHSYFEGMNWVLGYYYKGCQSW

SEQ ID NO: 2681486 - protein, 18 aa, Entamoeba histolytica
IVIALKIANPKYEDTKYT

SEQ ID NO: 2681487 - protein, 18 aa, Entamoeba histolytica
IVIDAIFLSNGCNGCKNP

SEQ ID NO: 2681488 - protein, 23 aa, Entamoeba histolytica
IVIDEFDTIFGIYLHYPLMSPFK

SEQ ID NO: 2681489 - protein, 31 aa, Entamoeba histolytica
IVIDLSNLIPFAFDCAIRLRQPNFINIDYVN

SEQ ID NO: 2681490 - protein, 24 aa, Entamoeba histolytica
IVIGNCQFFYFGLKQSICAYESVL

SEQ ID NO: 2681491 - protein, 25 aa, Entamoeba histolytica
IVIKEPLYRIATCAPHLDKRYPKGF

SEQ ID NO: 2681492 - protein, 21 aa, Entamoeba histolytica
IVINIAPLISFNFFNEKFGEY

SEQ ID NO: 2681493 - protein, 32 aa, Entamoeba histolytica
IVIPCPIVKLKSMRFIKCSSLKSVDISAPIAK

SEQ ID NO: 2681494 - protein, 24 aa, Entamoeba histolytica
IVIQPRIAGSFTITHSFSSQLQTF

SEQ ID NO: 2681495 - protein, 18 aa, Entamoeba histolytica
IVIVCPQSLIGNWEKEFK

SEQ ID NO: 2681496 - protein, 22 aa, Entamoeba histolytica
IVKGEITIKFSIPEDYPETHPT

SEQ ID NO: 2681497 - protein, 38 aa, Entamoeba histolytica
IVKIDRLKWVPIRRKMAADNSCLFHCLEYLFYNKSRND

SEQ ID NO: 2681498 - protein, 18 aa, Entamoeba histolytica
IVKKERKLKEVKKFDSKF

SEQ ID NO: 2681499 - protein, 18 aa, Entamoeba histolytica
IVKKERKLKEVKKIDSKF

SEQ ID NO: 2681500 - protein, 19 aa, Entamoeba histolytica
IVKKYCAFKLILSNPSTLQ

SEQ ID NO: 2681501 - protein, 25 aa, Entamoeba histolytica
IVKNSWGSFWGMDGYILMSRNKNNQ

SEQ ID NO: 2681502 - protein, 25 aa, Entamoeba histolytica
IVKQRICETPKYFKEAVESINQMNY

SEQ ID NO: 2681503 - protein, 22 aa, Entamoeba histolytica
IVKSDHCSINFPSIGFEIPSTA

SEQ ID NO: 2681504 - protein, 21 aa, Entamoeba histolytica
IVLECCKHPYGCRVVQRVIES

SEQ ID NO: 2681505 - protein, 18 aa, Entamoeba histolytica
IVLECIGDTISVISEIDV

SEQ ID NO: 2681506 - protein, 19 aa, Entamoeba histolytica
IVLETEGNVLIAMHRRALV

SEQ ID NO: 2681507 - protein, 18 aa, Entamoeba histolytica
IVLFELLEGYPPHYELRG

SEQ ID NO: 2681508 - protein, 18 aa, Entamoeba histolytica
IVLFVLIMEKIMGRIDLP

SEQ ID NO: 2681509 - protein, 25 aa, Entamoeba histolytica
IVLKERIGYKMIQVITINQIKEYIP

SEQ ID NO: 2681510 - protein, 18 aa, Entamoeba histolytica
IVLKGHEKPITKIELTRE

SEQ ID NO: 2681511 - protein, 18 aa, Entamoeba histolytica
IVLLGSGSVGKSAIATRY

SEQ ID NO: 2681512 - protein, 19 aa, Entamoeba histolytica
IVLNEGIIYKIIPLKKRKE

SEQ ID NO: 2681513 - protein, 25 aa, Entamoeba histolytica
IVLPPCFISLSSMCFDSCRATKIVI

SEQ ID NO: 2681514 - protein, 20 aa, Entamoeba histolytica
IVLQQCQLLGAKITLTSDDL

SEQ ID NO: 2681515 - protein, 24 aa, Entamoeba histolytica
IVLRNGGECFGCYHYDTISPSKST

SEQ ID NO: 2681516 - protein, 28 aa, Entamoeba histolytica
IVLVKRGLMEMIYKLLLKDDIKLDLHAD

SEQ ID NO: 2681517 - protein, 17 aa, Entamoeba histolytica
IVMKAGPLLRAGIDIEN

SEQ ID NO: 2681518 - protein, 27 aa, Entamoeba histolytica
IVMNLLIDLLIEFGYLFEIQKETKEGY

SEQ ID NO: 2681519 - protein, 24 aa, Entamoeba histolytica
IVMVKGCVKGCNFKEMDDAIEKIK

SEQ ID NO: 2681520 - protein, 17 aa, Entamoeba histolytica
IVMWGKEKVGKSTIVNV

SEQ ID NO: 2681521 - protein, 18 aa, Entamoeba histolytica
IVNCCYVMAVNREITLFP

SEQ ID NO: 2681522 - protein, 17 aa, Entamoeba histolytica
IVNCKRVVMPNFFENAF

SEQ ID NO: 2681523 - protein, 20 aa, Entamoeba histolytica
IVNEIYIRYLKIFNKQLSVT

SEQ ID NO: 2681524 - protein, 17 aa, Entamoeba histolytica
IVNIKLGDGSIRKGQVL

SEQ ID NO: 2681525 - protein, 18 aa, Entamoeba histolytica
IVNLLRKHLTVIAQKCGL

SEQ ID NO: 2681526 - protein, 26 aa, Entamoeba histolytica
IVNLPNTIKVLYWRQNFAHIGKDVSV

SEQ ID NO: 2681527 - protein, 17 aa, Entamoeba histolytica
IVNPALMALYAEGKETG

SEQ ID NO: 2681528 - protein, 28 aa, Entamoeba histolytica
IVNQCLQQLFQCCRVIPDAQSPNEMLNT

SEQ ID NO: 2681529 - protein, 17 aa, Entamoeba histolytica
IVNTVCRKRTLKELKGI

SEQ ID NO: 2681530 - protein, 18 aa, Entamoeba histolytica
IVNYAVTTIRGWFVELAH

SEQ ID NO: 2681531 - protein, 23 aa, Entamoeba histolytica
IVPEEVTWNFILLIQQNIELQGY

SEQ ID NO: 2681532 - protein, 25 aa, Entamoeba histolytica
IVPEGKKPMRICRMNGSGSSEYLLP

SEQ ID NO: 2681533 - protein, 25 aa, Entamoeba histolytica
IVPQELSLVFIVRKYLSNIVRSLSK

SEQ ID NO: 2681534 - protein, 17 aa, Entamoeba histolytica
IVPQWKSKLDDILNREK

SEQ ID NO: 2681535 - protein, 25 aa, Entamoeba histolytica
IVPRLSLGSFEYFKGMIKCVKDIVG

SEQ ID NO: 2681536 - protein, 26 aa, Entamoeba histolytica
IVQGSRITPDWMALIFKTTQYPGCLH

SEQ ID NO: 2681537 - protein, 24 aa, Entamoeba histolytica
IVQKNVLEFKEFINTIINEAIQPE

SEQ ID NO: 2681538 - protein, 25 aa, Entamoeba histolytica
IVQSFPVCDPSFFTSFRDACMSCRE

SEQ ID NO: 2681539 - protein, 17 aa, Entamoeba histolytica
IVQSILCALKVTPPNSL

SEQ ID NO: 2681540 - protein, 24 aa, Entamoeba histolytica
IVRFECLICDILEIAIKYEHKLPE

SEQ ID NO: 2681541 - protein, 19 aa, Entamoeba histolytica
IVRIFKVEIQRIIVQSVSL

SEQ ID NO: 2681542 - protein, 24 aa, Entamoeba histolytica
IVRLKDTFNLSGHFCMVFELLSYN

SEQ ID NO: 2681543 - protein, 23 aa, Entamoeba histolytica
IVRSEAGIYRCIIISEDSALKCV

SEQ ID NO: 2681544 - protein, 24 aa, Entamoeba histolytica
IVRYVLELMNIIKLIQGGLKHVYD

SEQ ID NO: 2681545 - protein, 27 aa, Entamoeba histolytica
IVSDMFRRIRLYEMLMWSNGEKESCQN

SEQ ID NO: 2681546 - protein, 18 aa, Entamoeba histolytica
IVSFIGADLAQKVIPVIK

SEQ ID NO: 2681547 - protein, 17 aa, Entamoeba histolytica
IVSFQYSRCSDYFSLGS

SEQ ID NO: 2681548 - protein, 27 aa, Entamoeba histolytica
IVSIKEPLFRICGLAIHLDTERKYIID

SEQ ID NO: 2681549 - protein, 18 aa, Entamoeba histolytica
IVSKCGRSTELQSVDLEE

SEQ ID NO: 2681550 - protein, 25 aa, Entamoeba histolytica
IVSLLEIFSPLKWQHLLVPFLPIKY

SEQ ID NO: 2681551 - protein, 23 aa, Entamoeba histolytica
IVSSEGFVKISILVPAPKQDVVD

SEQ ID NO: 2681552 - protein, 24 aa, Entamoeba histolytica
IVSSEGFVKISILVPAPKQDVVDA

SEQ ID NO: 2681553 - protein, 18 aa, Entamoeba histolytica
IVSTTWFQTYIRSNIDQD

SEQ ID NO: 2681554 - protein, 17 aa, Entamoeba histolytica
IVSYFKDICLFKQVVFI

SEQ ID NO: 2681555 - protein, 17 aa, Entamoeba histolytica
IVTRPARDISLNDNCYH

SEQ ID NO: 2681556 - protein, 27 aa, Entamoeba histolytica
IVTRRPRSFKARPIIKHSDGTQQTFWY

SEQ ID NO: 2681557 - protein, 24 aa, Entamoeba histolytica
IVTRSKLRAGLNCISEISNSLYFD

SEQ ID NO: 2681558 - protein, 19 aa, Entamoeba histolytica
IVVALKLAEIFKCGVNELP

SEQ ID NO: 2681559 - protein, 17 aa, Entamoeba histolytica
IVVCIVSLFSTSAIHRL

SEQ ID NO: 2681560 - protein, 18 aa, Entamoeba histolytica
IVVECLQKRMDVEENLRR

SEQ ID NO: 2681561 - protein, 18 aa, Entamoeba histolytica
IVVMSATLEATKFKEYFD

SEQ ID NO: 2681562 - protein, 17 aa, Entamoeba histolytica
IVVRPSANYSFSASTGN

SEQ ID NO: 2681563 - protein, 25 aa, Entamoeba histolytica
IVVYPRKLKYLILLQHSVWNNQQSK

SEQ ID NO: 2681564 - protein, 21 aa, Entamoeba histolytica
IVYEKGCDFDKMIKIIQERNK

SEQ ID NO: 2681565 - protein, 23 aa, Entamoeba histolytica
IVYEKGCDFDKMIKIIQERNKAV

SEQ ID NO: 2681566 - protein, 23 aa, Entamoeba histolytica
IVYRIVDCAFGRFFSQISTHSSN

SEQ ID NO: 2681567 - protein, 18 aa, Entamoeba histolytica
IWDFPNWEINKDIVNRYM

SEQ ID NO: 2681568 - protein, 18 aa, Entamoeba histolytica
IWEEYCKVFEHLEEKNEV

SEQ ID NO: 2681569 - protein, 21 aa, Entamoeba histolytica
IWEICGTPTDLEWPQFKEMKM

SEQ ID NO: 2681570 - protein, 26 aa, Entamoeba histolytica
IWENQCSVVKRPDMDQHQLERFIKDK

SEQ ID NO: 2681571 - protein, 18 aa, Entamoeba histolytica
IWFNTHVQIIQGEVSEQN

SEQ ID NO: 2681572 - protein, 21 aa, Entamoeba histolytica
IWGNLCLLGGNAIKYIDDHKV

SEQ ID NO: 2681573 - protein, 25 aa, Entamoeba histolytica
IWGNLPRRRIDLMDENTLLTEVKLY

SEQ ID NO: 2681574 - protein, 17 aa, Entamoeba histolytica
IWIKRNVIETVDLYSIL

SEQ ID NO: 2681575 - protein, 17 aa, Entamoeba histolytica
IWIPCLFEIPQESPVVF

SEQ ID NO: 2681576 - protein, 19 aa, Entamoeba histolytica
IWLEECRKYSNPNTTIMLV

SEQ ID NO: 2681577 - protein, 18 aa, Entamoeba histolytica
IWLNSALSGKSKRIKTLV

SEQ ID NO: 2681578 - protein, 18 aa, Entamoeba histolytica
IWNKFIFKASPHIVNNEV

SEQ ID NO: 2681579 - protein, 18 aa, Entamoeba histolytica
IWNSRYKKSYIWEPMRVY

SEQ ID NO: 2681580 - protein, 20 aa, Entamoeba histolytica
IWPKELLPSLLNCTKENENN

SEQ ID NO: 2681581 - protein, 20 aa, Entamoeba histolytica
IWPLLEKKLKISGETLDGKE

SEQ ID NO: 2681582 - protein, 19 aa, Entamoeba histolytica
IWPSKFSMNLYSFVPSGIC

SEQ ID NO: 2681583 - protein, 23 aa, Entamoeba histolytica
IWQCIRLNAMITQACGENDDFLQ

SEQ ID NO: 2681584 - protein, 20 aa, Entamoeba histolytica
IWQNRFNILIQFPDSIDLLL

SEQ ID NO: 2681585 - protein, 18 aa, Entamoeba histolytica
IWRNGKIILEKNDIEEIG

SEQ ID NO: 2681586 - protein, 25 aa, Entamoeba histolytica
IWSCGCVLAEMIIRNYPLFEGECLN

SEQ ID NO: 2681587 - protein, 28 aa, Entamoeba histolytica
IWSKNEFIISIGNFYRGWIDIASIGENC

SEQ ID NO: 2681588 - protein, 23 aa, Entamoeba histolytica
IWSLGIMCREMMEGVPPYIDDPP

SEQ ID NO: 2681589 - protein, 18 aa, Entamoeba histolytica
IWYHRKWSISKMEHPKFE

SEQ ID NO: 2681590 - protein, 19 aa, Entamoeba histolytica
IWYPDVFVLNGGYRYFYHL

SEQ ID NO: 2681591 - protein, 18 aa, Entamoeba histolytica
IYCTKCKIEIEAEEFNQL

SEQ ID NO: 2681592 - protein, 18 aa, Entamoeba histolytica
IYCVVGYLIYLRQRILDA

SEQ ID NO: 2681593 - protein, 17 aa, Entamoeba histolytica
IYDCAIELIKRGKAYVC

SEQ ID NO: 2681594 - protein, 18 aa, Entamoeba histolytica
IYDCLSMDTNYYTKIDLK

SEQ ID NO: 2681595 - protein, 22 aa, Entamoeba histolytica
IYDCRRSIKVIFNQDEHNYWND

SEQ ID NO: 2681596 - protein, 26 aa, Entamoeba histolytica
IYDDRNCLSLGFGFIDFYSINDALSL

SEQ ID NO: 2681597 - protein, 24 aa, Entamoeba histolytica
IYDEFVSCFDCLPLCALINQNVNG

SEQ ID NO: 2681598 - protein, 23 aa, Entamoeba histolytica
IYDEHHFAFSFAHKGELSSVCVY

SEQ ID NO: 2681599 - protein, 18 aa, Entamoeba histolytica
IYDIKRIIGKNSKSEGIE

SEQ ID NO: 2681600 - protein, 20 aa, Entamoeba histolytica
IYDNCWPKAIEMLTSMGRLI

SEQ ID NO: 2681601 - protein, 21 aa, Entamoeba histolytica
IYDPIAFCDKLFRDIKGSRNR

SEQ ID NO: 2681602 - protein, 19 aa, Entamoeba histolytica
IYDRVKLDVVKLVDHINYT

SEQ ID NO: 2681603 - protein, 17 aa, Entamoeba histolytica
IYDSFYFSQQPMIDAQL

SEQ ID NO: 2681604 - protein, 23 aa, Entamoeba histolytica
IYEDVASFALRCEGHYLNVLKDM

SEQ ID NO: 2681605 - protein, 24 aa, Entamoeba histolytica
IYESTRGWFGFGYQVPELSEEAIN

SEQ ID NO: 2681606 - protein, 33 aa, Entamoeba histolytica
IYFCDAHSLFYSSSHFVHWVCGSLIQKINAKRK

SEQ ID NO: 2681607 - protein, 23 aa, Entamoeba histolytica
IYFINECNIIDSMSLSSVPLSLK

SEQ ID NO: 2681608 - protein, 17 aa, Entamoeba histolytica
IYFIPFLLESGFKNEQV

SEQ ID NO: 2681609 - protein, 17 aa, Entamoeba histolytica
IYFKGIRTSDVISYFNF

SEQ ID NO: 2681610 - protein, 18 aa, Entamoeba histolytica
IYFLKELFLFEQYLPSYL

SEQ ID NO: 2681611 - protein, 23 aa, Entamoeba histolytica
IYFLKGKLPWQGFNRQNNTEKFD

SEQ ID NO: 2681612 - protein, 25 aa, Entamoeba histolytica
IYFSMKKCVNAFILSHNELTIKEIC

SEQ ID NO: 2681613 - protein, 21 aa, Entamoeba histolytica
IYFTHKHFRREGDDIVYYIND

SEQ ID NO: 2681614 - protein, 17 aa, Entamoeba histolytica
IYGCAWSPDSRMLVSAS

SEQ ID NO: 2681615 - protein, 20 aa, Entamoeba histolytica
IYGCKELFLRLDNKTNNSYI

SEQ ID NO: 2681616 - protein, 31 aa, Entamoeba histolytica
IYGFHKLDCKEGLCFKHEFFQRAHPELLEKI

SEQ ID NO: 2681617 - protein, 34 aa, Entamoeba histolytica; identical to SEQ ID NO: 2488641

SEQ ID NO: 2681618 - protein, 19 aa, Entamoeba histolytica
IYGKEGPVWKKIKEDAFWD

SEQ ID NO: 2681619 - protein, 26 aa, Entamoeba histolytica
IYGKELKEAFEYCLRYEKEYKEGEEI

SEQ ID NO: 2681620 - protein, 19 aa, Entamoeba histolytica
IYGYCLNPLSIVMEYFNGG

SEQ ID NO: 2681621 - protein, 25 aa, Entamoeba histolytica
IYGYCVICKLPGNTLLHLIYSSLVP

SEQ ID NO: 2681622 - protein, 25 aa, Entamoeba histolytica
IYGYVYCFLNGISIEILVAQVISEN

SEQ ID NO: 2681623 - protein, 17 aa, Entamoeba histolytica
IYHGGIEPKGIIQSTDP

SEQ ID NO: 2681624 - protein, 26 aa, Entamoeba histolytica
IYIAMSCFNDSCIGWLRCVDAKEPTK

SEQ ID NO: 2681625 - protein, 25 aa, Entamoeba histolytica
IYICSSCSNVFCAECQRVIAEITKT

SEQ ID NO: 2681626 - protein, 17 aa, Entamoeba histolytica
IYIFSCPDGSGNTKSAP

SEQ ID NO: 2681627 - protein, 19 aa, Entamoeba histolytica
IYINIHYTFLFKENQFLSN

SEQ ID NO: 2681628 - protein, 23 aa, Entamoeba histolytica
IYINPGNGILIAFQKLYTEDFKM

SEQ ID NO: 2681629 - protein, 18 aa, Entamoeba histolytica
IYIPELIFGHLLTSSNYK

SEQ ID NO: 2681630 - protein, 17 aa, Entamoeba histolytica
IYIPLLRHPIIFPTMKL

SEQ ID NO: 2681631 - protein, 17 aa, Entamoeba histolytica
IYIPYVVQQLGKGYYIP

SEQ ID NO: 2681632 - protein, 25 aa, Entamoeba histolytica
IYISLRIVEMTIIFVTGNVSGDSFV

SEQ ID NO: 2681633 - protein, 30 aa, Entamoeba histolytica
IYISRLQQFLDYYLKEVIELLPNDKLLKKC

SEQ ID NO: 2681634 - protein, 17 aa, Entamoeba histolytica
IYKDHRLFSKSINLALM

SEQ ID NO: 2681635 - protein, 18 aa, Entamoeba histolytica
IYKKMRYNPFSIKSKKIF

SEQ ID NO: 2681636 - protein, 20 aa, Entamoeba histolytica
IYKQRLEKMGFNVKQTKDSV

SEQ ID NO: 2681637 - protein, 17 aa, Entamoeba histolytica
IYKSEWIKYIQILLQST

SEQ ID NO: 2681638 - protein, 17 aa, Entamoeba histolytica
IYLARVVGYFPDTIEVN

SEQ ID NO: 2681639 - protein, 22 aa, Entamoeba histolytica
IYLEELQQFLPIEEKEEREEAI

SEQ ID NO: 2681640 - protein, 17 aa, Entamoeba histolytica
IYLFIIFYKEGKLFRTL

SEQ ID NO: 2681641 - protein, 20 aa, Entamoeba histolytica
IYLHAWRYVIDDEIFETKLP

SEQ ID NO: 2681642 - protein, 19 aa, Entamoeba histolytica
IYLHDSLLRAQKFSALSKS

SEQ ID NO: 2681643 - protein, 20 aa, Entamoeba histolytica
IYLIDCPGVVYPSGDTESEV

SEQ ID NO: 2681644 - protein, 17 aa, Entamoeba histolytica
IYLLINMEKCYKNVNKQ

SEQ ID NO: 2681645 - protein, 18 aa, Entamoeba histolytica
IYLLSRAGVTVEIKKQKK

SEQ ID NO: 2681646 - protein, 17 aa, Entamoeba histolytica
IYLLVKSGFEVRVKRLD

SEQ ID NO: 2681647 - protein, 21 aa, Entamoeba histolytica
IYLNIEFDLNFSRTAYTSLPD

SEQ ID NO: 2681648 - protein, 18 aa, Entamoeba histolytica
IYLYAAVSKFCYVLLNEA

SEQ ID NO: 2681649 - protein, 20 aa, Entamoeba histolytica
IYNALCKFENFFTYKRYKFG

SEQ ID NO: 2681650 - protein, 19 aa, Entamoeba histolytica
IYNEWCGYARDCYHTQRMQ

SEQ ID NO: 2681651 - protein, 18 aa, Entamoeba histolytica
IYNIFCSKYLDNDFLKDT

SEQ ID NO: 2681652 - protein, 17 aa, Entamoeba histolytica
IYNIKALMIKKELMKNE

SEQ ID NO: 2681653 - protein, 19 aa, Entamoeba histolytica
IYNNIHLIAETLTEPAPAN

SEQ ID NO: 2681654 - protein, 18 aa, Entamoeba histolytica
IYNNLALSIAPEIYGLED

SEQ ID NO: 2681655 - protein, 17 aa, Entamoeba histolytica
IYNSVYLIRGEEASKHV

SEQ ID NO: 2681656 - protein, 23 aa, Entamoeba histolytica
IYNSYMGFCINLLPRGWHGLLSL

SEQ ID NO: 2681657 - protein, 18 aa, Entamoeba histolytica
IYPEMELFAHWSKDHLPI

SEQ ID NO: 2681658 - protein, 19 aa, Entamoeba histolytica
IYPHPELNKVCFITENGSE

SEQ ID NO: 2681659 - protein, 26 aa, Entamoeba histolytica
IYPKKEIEWLMGISWNKGNQSRYKQD

SEQ ID NO: 2681660 - protein, 19 aa, Entamoeba histolytica
IYPPIPYSTFYPRLLEEAE

SEQ ID NO: 2681661 - protein, 18 aa, Entamoeba histolytica
IYPQYFFTTFGIYNQQFS

SEQ ID NO: 2681662 - protein, 18 aa, Entamoeba histolytica
IYPSASIGFVVFNLDSKV

SEQ ID NO: 2681663 - protein, 17 aa, Entamoeba histolytica
IYPSLDYDSMSYVTLTQ

SEQ ID NO: 2681664 - protein, 17 aa, Entamoeba histolytica
IYPWGTRMRYLYIALEW

SEQ ID NO: 2681665 - protein, 20 aa, Entamoeba histolytica
IYQFNTWIGGMIGKVEIEYC

SEQ ID NO: 2681666 - protein, 27 aa, Entamoeba histolytica
IYQHLYFPCLIPLKETIDILKGFYPET

SEQ ID NO: 2681667 - protein, 17 aa, Entamoeba histolytica
IYRAHLSLVAMYTAPGC

SEQ ID NO: 2681668 - protein, 19 aa, Entamoeba histolytica
IYRLMMKYFNGSRIDDKPP

SEQ ID NO: 2681669 - protein, 21 aa, Entamoeba histolytica
IYRNDCYIFDTGKQLIVFYGK

SEQ ID NO: 2681670 - protein, 18 aa, Entamoeba histolytica
IYRNNVEIIRTMKKSIPV

SEQ ID NO: 2681671 - protein, 21 aa, Entamoeba histolytica
IYRNRLKIIPPTEARIIVFSL

SEQ ID NO: 2681672 - protein, 20 aa, Entamoeba histolytica
IYRVRLCDFLQKIFVIDPAQ

SEQ ID NO: 2681673 - protein, 20 aa, Entamoeba histolytica
IYSCIIRASYKHSDEFENKK

SEQ ID NO: 2681674 - protein, 22 aa, Entamoeba histolytica
IYSCYFTYCYSIMKPAELLFTI

SEQ ID NO: 2681675 - protein, 20 aa, Entamoeba histolytica
IYSFGIILWQLVYKCIYNVY

SEQ ID NO: 2681676 - protein, 18 aa, Entamoeba histolytica
IYSFPPIDICISSFSTLR

SEQ ID NO: 2681677 - protein, 17 aa, Entamoeba histolytica
IYSGWGVWGQVLGSSYV

SEQ ID NO: 2681678 - protein, 19 aa, Entamoeba histolytica
IYSKIADRLGIPYLTKTLN

SEQ ID NO: 2681679 - protein, 18 aa, Entamoeba histolytica
IYSMKNWILIPAKTTSTP

SEQ ID NO: 2681680 - protein, 26 aa, Entamoeba histolytica
IYSMRVREWYGWHFPELSKYINDHMA

SEQ ID NO: 2681681 - protein, 17 aa, Entamoeba histolytica
IYTALRYILQYKPIESV

SEQ ID NO: 2681682 - protein, 17 aa, Entamoeba histolytica
IYTAVFFGWQNSPTTCV

SEQ ID NO: 2681683 - protein, 21 aa, Entamoeba histolytica
IYTCECCEAMLCGECIKKRKY

SEQ ID NO: 2681684 - protein, 25 aa, Entamoeba histolytica
IYTDIMKVVERFSNEALEHISYQSF

SEQ ID NO: 2681685 - protein, 18 aa, Entamoeba histolytica
IYTIPGYITPLIPTNKPI

SEQ ID NO: 2681686 - protein, 24 aa, Entamoeba histolytica
IYTQRIDHMYFIMMDLMKGSIWDL

SEQ ID NO: 2681687 - protein, 23 aa, Entamoeba histolytica
IYTRLSSISRYLCPKDDDQILEY

SEQ ID NO: 2681688 - protein, 18 aa, Entamoeba histolytica
IYTSIPIPFQKKYVDITS

SEQ ID NO: 2681689 - protein, 17 aa, Entamoeba histolytica
IYVCDKCHMPAVANHKA

SEQ ID NO: 2681690 - protein, 24 aa, Entamoeba histolytica
IYVKKEILEFIVGLLNCDNEHSAL

SEQ ID NO: 2681691 - protein, 18 aa, Entamoeba histolytica
IYYHPLIQSCTWDTLAAQ

SEQ ID NO: 2681692 - protein, 25 aa, Entamoeba histolytica
IYYIPSLGIAPSWCSFLENLTEELE

SEQ ID NO: 2681693 - protein, 17 aa, Entamoeba histolytica
IYYKDTWTDDDIRVLVG

SEQ ID NO: 2681694 - protein, 18 aa, Entamoeba histolytica
IYYKDTWTDDDIRVLVGA

SEQ ID NO: 2681695 - protein, 19 aa, Entamoeba histolytica
IYYPSYIEIMGKKEWSSII

SEQ ID NO: 2681696 - protein, 24 aa, Entamoeba histolytica
KAALCIFAEMTFVPGEMLQAEDRI

SEQ ID NO: 2681697 - protein, 18 aa, Entamoeba histolytica
KAASFGVVDQMNFTNSEK

SEQ ID NO: 2681698 - protein, 17 aa, Entamoeba histolytica
KAATIAGVKAGIQAQKQ

SEQ ID NO: 2681699 - protein, 18 aa, Entamoeba histolytica
KADGVKLVNIDAQNIVDG

SEQ ID NO: 2681700 - protein, 18 aa, Entamoeba histolytica
KADIWSIGIMIMEMTEGD

SEQ ID NO: 2681701 - protein, 21 aa, Entamoeba histolytica
KADMEKPLFSNAVEEVDGSDD

SEQ ID NO: 2681702 - protein, 24 aa, Entamoeba histolytica
KAEAKPDMSTFVFVRILTNVDNFK

SEQ ID NO: 2681703 - protein, 24 aa, Entamoeba histolytica
KAECVWKNLILMCIGENFENSEFL

SEQ ID NO: 2681704 - protein, 21 aa, Entamoeba histolytica
KAESLVFSSMINKIMGTKYAL

SEQ ID NO: 2681705 - protein, 19 aa, Entamoeba histolytica
KAEVKRRMKELKEGEKTTT

SEQ ID NO: 2681706 - protein, 17 aa, Entamoeba histolytica
KAEVVDLTISMQHYSRG

SEQ ID NO: 2681707 - protein, 19 aa, Entamoeba histolytica
KAEVYRVGAELKLPDIILG

SEQ ID NO: 2681708 - protein, 17 aa, Entamoeba histolytica
KAEWKVPAMNNGETTYH

SEQ ID NO: 2681709 - protein, 25 aa, Entamoeba histolytica
KAFELSTEELLVWLEQNLEEFIIEM

SEQ ID NO: 2681710 - protein, 27 aa, Entamoeba histolytica
KAFPGKSGDEILKIIAEKGEIQFSSDE

SEQ ID NO: 2681711 - protein, 18 aa, Entamoeba histolytica
KAFRYRIVLSTLLGQTIR

SEQ ID NO: 2681712 - protein, 27 aa, Entamoeba histolytica
KAGEGFLQCVYRLLSTRMGYETFVQNK

SEQ ID NO: 2681713 - protein, 22 aa, Entamoeba histolytica
KAGKRAGNFLDFLRATEGMVHD

SEQ ID NO: 2681714 - protein, 18 aa, Entamoeba histolytica
KAGLKMLMEAEENAKQVV

SEQ ID NO: 2681715 - protein, 24 aa, Entamoeba histolytica
KAGRTKIAVVLARKMSKDQINHQN

SEQ ID NO: 2681716 - protein, 17 aa, Entamoeba histolytica
KAGVLRNNIRHQLLSNN

SEQ ID NO: 2681717 - protein, 18 aa, Entamoeba histolytica
KAGVMKYGKNEWARISSL

SEQ ID NO: 2681718 - protein, 19 aa, Entamoeba histolytica
KAHARFIVRSFKINEMEFF

SEQ ID NO: 2681719 - protein, 28 aa, Entamoeba histolytica
KAHASKCRGFCGYTCIDCHKSFKTEPEF

SEQ ID NO: 2681720 - protein, 21 aa, Entamoeba histolytica
KAIEGKNIFLWGKTGTGKTFT

SEQ ID NO: 2681721 - protein, 18 aa, Entamoeba histolytica
KAIGLAIFYYQRRKIKEQ

SEQ ID NO: 2681722 - protein, 18 aa, Entamoeba histolytica
KAIKQKRLEEVKKKNQIT

SEQ ID NO: 2681723 - protein, 22 aa, Entamoeba histolytica
KAIRMHQLRIGMMHKKLRMIAI

SEQ ID NO: 2681724 - protein, 22 aa, Entamoeba histolytica
KAKACLQMDWTKKGNLTPLINR

SEQ ID NO: 2681725 - protein, 25 aa, Entamoeba histolytica
KAKDLLPRMQVEWRNVVQFVTSESG

SEQ ID NO: 2681726 - protein, 19 aa, Entamoeba histolytica
KAKDVMKEFQVPGNENTSK

SEQ ID NO: 2681727 - protein, 18 aa, Entamoeba histolytica
KAKEIFKQLINCEEDEIT

SEQ ID NO: 2681728 - protein, 21 aa, Entamoeba histolytica
KAKELKLKYFEVSAKTGDGIE

SEQ ID NO: 2681729 - protein, 19 aa, Entamoeba histolytica
KAKFPGGIKLDENACRHLM

SEQ ID NO: 2681730 - protein, 25 aa, Entamoeba histolytica
KAKHHVAYRLLKKCDSVQEMQPILI

SEQ ID NO: 2681731 - protein, 25 aa, Entamoeba histolytica
KAKIIYPRIDPFSCFTYYNPTLHLK

SEQ ID NO: 2681732 - protein, 17 aa, Entamoeba histolytica
KAKLPIVLTPQHHLLFV

SEQ ID NO: 2681733 - protein, 20 aa, Entamoeba histolytica
KAKSIFYYHYFVPELNLNDV

SEQ ID NO: 2681734 - protein, 21 aa, Entamoeba histolytica
KAKTIVYGCIYGIGPFSLADQ

SEQ ID NO: 2681735 - protein, 19 aa, Entamoeba histolytica
KAKVMAIGFLCQMDPSHAD

SEQ ID NO: 2681736 - protein, 21 aa, Entamoeba histolytica
KAKYFISSFIFTQIKEIEQKD

SEQ ID NO: 2681737 - protein, 22 aa, Entamoeba histolytica
KALCLILKSPIALKRIDLSNIG

SEQ ID NO: 2681738 - protein, 19 aa, Entamoeba histolytica
KALDEYLRKVFTTYITVLT

SEQ ID NO: 2681739 - protein, 32 aa, Entamoeba histolytica
KALEIYYIIASCVIKRKLYLLFTKGEITKIDS

SEQ ID NO: 2681740 - protein, 23 aa, Entamoeba histolytica
KALERHKPSLLFSTPRVFEKLNK

SEQ ID NO: 2681741 - protein, 22 aa, Entamoeba histolytica
KALEYAKPLSFPTITTDFTKAL

SEQ ID NO: 2681742 - protein, 32 aa, Entamoeba histolytica
KALFFHPEHHHWLKINFPKAFDNIIKEYDLDK

SEQ ID NO: 2681743 - protein, 18 aa, Entamoeba histolytica
KALFGLCELHLININEID

SEQ ID NO: 2681744 - protein, 28 aa, Entamoeba histolytica
KALKESFAYKKFLGIVVSLGNYLNGGNQ

SEQ ID NO: 2681745 - protein, 26 aa, Entamoeba histolytica
KALLKDVALEIANRAEIKEQQQKELT

SEQ ID NO: 2681746 - protein, 18 aa, Entamoeba histolytica
KALQEIPDQYAFIKEHGY

SEQ ID NO: 2681747 - protein, 18 aa, Entamoeba histolytica
KALTGVTFQAQWDEKTKT

SEQ ID NO: 2681748 - protein, 21 aa, Entamoeba histolytica
KALTVFPELLIKKEKEDIQII

SEQ ID NO: 2681749 - protein, 19 aa, Entamoeba histolytica
KALWITIGFFRLGKDYQSC

SEQ ID NO: 2681750 - protein, 28 aa, Entamoeba histolytica
KALYKRAVELNSKFNVLFVKYINTTTNT

SEQ ID NO: 2681751 - protein, 18 aa, Entamoeba histolytica
KALYRIGVVLNKKEQYSL

SEQ ID NO: 2681752 - protein, 24 aa, Entamoeba histolytica
KAMEKGYCCKVTRFPQSGDSLYIR

SEQ ID NO: 2681753 - protein, 18 aa, Entamoeba histolytica
KAMHSIILPIYCSSNSVK

SEQ ID NO: 2681754 - protein, 17 aa, Entamoeba histolytica
KAMKELKKENGELKKEN

SEQ ID NO: 2681755 - protein, 25 aa, Entamoeba histolytica
KAMKKLYPLFLWILSGLFPQFANIS

SEQ ID NO: 2681756 - protein, 19 aa, Entamoeba histolytica
KAMRYAKVFAMLSQVEKHI

SEQ ID NO: 2681757 - protein, 20 aa, Entamoeba histolytica
KAMTCFAEIITIYPENDYLP

SEQ ID NO: 2681758 - protein, 19 aa, Entamoeba histolytica
KANANVHSAYVLSVELDTT

SEQ ID NO: 2681759 - protein, 20 aa, Entamoeba histolytica
KANGGVRREECYTLKAPIKI

SEQ ID NO: 2681760 - protein, 26 aa, Entamoeba histolytica
KANITWLLEMIVYIALAPNINKETHD

SEQ ID NO: 2681761 - protein, 21 aa, Entamoeba histolytica
KANNDCILFSALILNSKIVVL

SEQ ID NO: 2681762 - protein, 24 aa, Entamoeba histolytica
KANPGGRIKYSFDRDAFVSKLSED

SEQ ID NO: 2681763 - protein, 21 aa, Entamoeba histolytica
KANTEVIAFMASTFGIKKSNV

SEQ ID NO: 2681764 - protein, 18 aa, Entamoeba histolytica
KANYDLRFNVKLSNDDND

SEQ ID NO: 2681765 - protein, 19 aa, Entamoeba histolytica
KANYDLRFNVKLSNDDNDD

SEQ ID NO: 2681766 - protein, 19 aa, Entamoeba histolytica
KANYDLRFNVKLSNDDNND

SEQ ID NO: 2681767 - protein, 17 aa, Entamoeba histolytica
KAPHHYLSRGVFLAEKS

SEQ ID NO: 2681768 - protein, 30 aa, Entamoeba histolytica; identical to SEQ ID NO: 2488815

SEQ ID NO: 2681769 - protein, 18 aa, Entamoeba histolytica
KAPVFEFPDPGDFDTCAV

SEQ ID NO: 2681770 - protein, 17 aa, Entamoeba histolytica
KAPYEVCVGEGVDNQKS

SEQ ID NO: 2681771 - protein, 24 aa, Entamoeba histolytica
KAQEYRKPFGSKRGRKGGYNRRGA

SEQ ID NO: 2681772 - protein, 28 aa, Entamoeba histolytica
KAQITKLPWKAAISYFKAAFISEVKENK

SEQ ID NO: 2681773 - protein, 21 aa, Entamoeba histolytica
KARCPQLRYEYNLYKILMETG

SEQ ID NO: 2681774 - protein, 19 aa, Entamoeba histolytica
KAREAVVMVIGNKVDKSQE

SEQ ID NO: 2681775 - protein, 24 aa, Entamoeba histolytica
KASMKIYLEYFGFNVIYEESNSEY

SEQ ID NO: 2681776 - protein, 21 aa, Entamoeba histolytica
KASQCRESLIHTERLMATVKD

SEQ ID NO: 2681777 - protein, 27 aa, Entamoeba histolytica
KATLIKRRVVIALKYFCSDALDECNQG

SEQ ID NO: 2681778 - protein, 26 aa, Entamoeba histolytica
KATMHHICLLRGKLVKYQKMLAPTKF

SEQ ID NO: 2681779 - protein, 17 aa, Entamoeba histolytica
KATMKRFAQFFGAISSP

SEQ ID NO: 2681780 - protein, 19 aa, Entamoeba histolytica
KATPGILTFNGVPPHLPLT

SEQ ID NO: 2681781 - protein, 19 aa, Entamoeba histolytica
KATVIFIPLRMMRICRASF

SEQ ID NO: 2681782 - protein, 17 aa, Entamoeba histolytica
KAVAFGAALQGASMIGQ

SEQ ID NO: 2681783 - protein, 21 aa, Entamoeba histolytica
KAVDDACGWPAEPNNHLLKTL

SEQ ID NO: 2681784 - protein, 19 aa, Entamoeba histolytica
KAVECVLIMDGFKMGIYKQ

SEQ ID NO: 2681785 - protein, 19 aa, Entamoeba histolytica
KAVQHLRIYITGNFKVSEW

SEQ ID NO: 2681786 - protein, 19 aa, Entamoeba histolytica
KAVQLRWKIPDCTLENSPS

SEQ ID NO: 2681787 - protein, 17 aa, Entamoeba histolytica
KAVQMPISYQLEEKGKG

SEQ ID NO: 2681788 - protein, 17 aa, Entamoeba histolytica
KAVVVSFNDGVLFSIIL

SEQ ID NO: 2681789 - protein, 20 aa, Entamoeba histolytica
KAYLRSMVEPLIPYEYFEYY

SEQ ID NO: 2681790 - protein, 22 aa, Entamoeba histolytica
KAYRNMFPFFILASQINGLPLF

SEQ ID NO: 2681791 - protein, 24 aa, Entamoeba histolytica
KAYSDIVYLIAFFDEKRQIQQGLA

SEQ ID NO: 2681792 - protein, 23 aa, Entamoeba histolytica
KAYTRYIIRHNFLTYSFNPEIHI

SEQ ID NO: 2681793 - protein, 20 aa, Entamoeba histolytica
KCANYSLPLSERVNKIEDKE

SEQ ID NO: 2681794 - protein, 19 aa, Entamoeba histolytica
KCATAIIFTTINPFFSSET

SEQ ID NO: 2681795 - protein, 18 aa, Entamoeba histolytica
KCCFTSDGKYLFIASKED

SEQ ID NO: 2681796 - protein, 19 aa, Entamoeba histolytica
KCCNIKYKIIISNSQINDI

SEQ ID NO: 2681797 - protein, 20 aa, Entamoeba histolytica
KCCSCNRTVVKRTIFKCGHC

SEQ ID NO: 2681798 - protein, 19 aa, Entamoeba histolytica
KCDATLFPQIQTMTDCFIR

SEQ ID NO: 2681799 - protein, 23 aa, Entamoeba histolytica
KCDFAYQFAMDMLKRMNKNNNQI

SEQ ID NO: 2681800 - protein, 19 aa, Entamoeba histolytica
KCDITNFWKVKGNIKMFTI

SEQ ID NO: 2681801 - protein, 21 aa, Entamoeba histolytica
KCDKRCIALVCNCNKIIETIQ

SEQ ID NO: 2681802 - protein, 21 aa, Entamoeba histolytica
KCDQFWRRNYVDIIYGEPLFG

SEQ ID NO: 2681803 - protein, 23 aa, Entamoeba histolytica
KCDRIIEGFEFFDRNNPLTFFFK

SEQ ID NO: 2681804 - protein, 18 aa, Entamoeba histolytica
KCEFLHSRIESIYKCYSI

SEQ ID NO: 2681805 - protein, 20 aa, Entamoeba histolytica
KCEIGRFVLLNSKCDTLYNV

SEQ ID NO: 2681806 - protein, 20 aa, Entamoeba histolytica
KCENRRCLENILGKELPHDY

SEQ ID NO: 2681807 - protein, 23 aa, Entamoeba histolytica
KCETCGKPLDGQYVVVDGKNYHP

SEQ ID NO: 2681808 - protein, 25 aa, Entamoeba histolytica
KCEVKADISGAVIFSGLLEISVRQW

SEQ ID NO: 2681809 - protein, 22 aa, Entamoeba histolytica
KCFDENKIAYWVLENPNSLEEK

SEQ ID NO: 2681810 - protein, 19 aa, Entamoeba histolytica
KCFSVAFQITNAFMNTKVL

SEQ ID NO: 2681811 - protein, 18 aa, Entamoeba histolytica
KCGCGFRKVQVVCGATPE

SEQ ID NO: 2681812 - protein, 22 aa, Entamoeba histolytica
KCGDCGCVLAGIRHIRPHQYGW

SEQ ID NO: 2681813 - protein, 20 aa, Entamoeba histolytica
KCGDNLILPSVKFEGIEVDE

SEQ ID NO: 2681814 - protein, 19 aa, Entamoeba histolytica
KCGDQWIARENKILMLCQH

SEQ ID NO: 2681815 - protein, 30 aa, Entamoeba histolytica; identical to SEQ ID NO: 2488860

SEQ ID NO: 2681816 - protein, 24 aa, Entamoeba histolytica
KCGKVLRVTIPIWRNTNKRRGFAV

SEQ ID NO: 2681817 - protein, 21 aa, Entamoeba histolytica
KCGLGKGVLSKKVNENYFNST

SEQ ID NO: 2681818 - protein, 22 aa, Entamoeba histolytica
KCHICGQKLFSFAKFYNDNGEI

SEQ ID NO: 2681819 - protein, 25 aa, Entamoeba histolytica
KCHKTCHYPCSIKGDIKRECSCIGD

SEQ ID NO: 2681820 - protein, 19 aa, Entamoeba histolytica
KCHPDRCHHPLSNAAISCL

SEQ ID NO: 2681821 - protein, 24 aa, Entamoeba histolytica
KCHSLSAVISIDFMNKMTINYGNT

SEQ ID NO: 2681822 - protein, 20 aa, Entamoeba histolytica
KCIDEIFLRGNVPIPKQIRF

SEQ ID NO: 2681823 - protein, 19 aa, Entamoeba histolytica
KCIETLQFERTVFHFNCLF

SEQ ID NO: 2681824 - protein, 19 aa, Entamoeba histolytica
KCIFNCHKMEITGLAVDSN

SEQ ID NO: 2681825 - protein, 20 aa, Entamoeba histolytica
KCIVCKIYPENIDDCIEYKC

SEQ ID NO: 2681826 - protein, 26 aa, Entamoeba histolytica
KCKDICEHWGIIWLNFEKLIRSHNEN

SEQ ID NO: 2681827 - protein, 19 aa, Entamoeba histolytica
KCKECGLHLTLKNFFFDQG

SEQ ID NO: 2681828 - protein, 25 aa, Entamoeba histolytica
KCKEFAYQWRIYPEMELFAHWSKDH

SEQ ID NO: 2681829 - protein, 21 aa, Entamoeba histolytica
KCLDLCIRRGDILLGPPNLQL

SEQ ID NO: 2681830 - protein, 19 aa, Entamoeba histolytica
KCLKYYCDECDSFIHDVLY

SEQ ID NO: 2681831 - protein, 21 aa, Entamoeba histolytica
KCLRNKCFVNCYSLHSITIPN

SEQ ID NO: 2681832 - protein, 20 aa, Entamoeba histolytica
KCLSAALSGIEEYRILVSME

SEQ ID NO: 2681833 - protein, 24 aa, Entamoeba histolytica
KCLSSGCKCCISIDIVRVLVDDYT

SEQ ID NO: 2681834 - protein, 21 aa, Entamoeba histolytica
KCNINVKALYDYTAEAESELT

SEQ ID NO: 2681835 - protein, 17 aa, Entamoeba histolytica
KCNVASHSSLKLSFMEG

SEQ ID NO: 2681836 - protein, 18 aa, Entamoeba histolytica
KCNVRFALVEYKDHPPQD

SEQ ID NO: 2681837 - protein, 19 aa, Entamoeba histolytica
KCNVRFALVEYKDHPPQDS

SEQ ID NO: 2681838 - protein, 19 aa, Entamoeba histolytica
KCNYGQFNERIHLLEILIK

SEQ ID NO: 2681839 - protein, 20 aa, Entamoeba histolytica
KCPHCKKTGTLQLIHTLSYY

SEQ ID NO: 2681840 - protein, 20 aa, Entamoeba histolytica
KCRCPECKKLYTSTDLVSKG

SEQ ID NO: 2681841 - protein, 24 aa, Entamoeba histolytica
KCRIFCTTLQKFSFVETQLPSDLN

SEQ ID NO: 2681842 - protein, 18 aa, Entamoeba histolytica
KCRRIQRISTNNKPKTSP

SEQ ID NO: 2681843 - protein, 18 aa, Entamoeba histolytica
KCRVPRCSIKICNVSDNK

SEQ ID NO: 2681844 - protein, 22 aa, Entamoeba histolytica
KCSCAIVGCNIKFTDEVKRLNK

SEQ ID NO: 2681845 - protein, 19 aa, Entamoeba histolytica
KCSCGGIIYPEPEGYKCHS

SEQ ID NO: 2681846 - protein, 19 aa, Entamoeba histolytica
KCSCPLPHTPNFEVIICAE

SEQ ID NO: 2681847 - protein, 18 aa, Entamoeba histolytica
KCSEVLFEPNIIGKETSG

SEQ ID NO: 2681848 - protein, 17 aa, Entamoeba histolytica
KCSFDYSDEYSLLLTLL

SEQ ID NO: 2681849 - protein, 29 aa, Entamoeba histolytica
KCSICGNELLYEFEILPSIISLIKDIPEF

SEQ ID NO: 2681850 - protein, 24 aa, Entamoeba histolytica
KCSNCGKPIIGPSLSALGKKYHPE

SEQ ID NO: 2681851 - protein, 20 aa, Entamoeba histolytica
KCSNCLCPKGAANVKRQCNH

SEQ ID NO: 2681852 - protein, 21 aa, Entamoeba histolytica
KCSQCAHAAIGCFQKAMEISP

SEQ ID NO: 2681853 - protein, 17 aa, Entamoeba histolytica
KCSQFIRQCYKYRIKSQ

SEQ ID NO: 2681854 - protein, 23 aa, Entamoeba histolytica
KCSVCNMNVHKKCIKNIKTPCRP

SEQ ID NO: 2681855 - protein, 17 aa, Entamoeba histolytica
KCTEIVCTHGHIDHIAG

SEQ ID NO: 2681856 - protein, 17 aa, Entamoeba histolytica
KCTFPKCEEAPKTRYNC

SEQ ID NO: 2681857 - protein, 29 aa, Entamoeba histolytica
KCTIKHIPKFCGVSSLTIRSFISSVTSLD

SEQ ID NO: 2681858 - protein, 17 aa, Entamoeba histolytica
KCTITLTPIIAVIQMSS

SEQ ID NO: 2681859 - protein, 21 aa, Entamoeba histolytica
KCTLQALIFARLVNKFPTLLE

SEQ ID NO: 2681860 - protein, 17 aa, Entamoeba histolytica
KCTLVFDIGGVYNHKLK

SEQ ID NO: 2681861 - protein, 25 aa, Entamoeba histolytica
KCTYKEYLRLLSIDVSIERYISDRQ

SEQ ID NO: 2681862 - protein, 20 aa, Entamoeba histolytica
KCVKEYLKSNAFLYDEIDIR

SEQ ID NO: 2681863 - protein, 27 aa, Entamoeba histolytica
KCVYISSSYKESWNGFGAIESMNGIVV

SEQ ID NO: 2681864 - protein, 19 aa, Entamoeba histolytica
KCYEAVLFIKTNPLILPTK

SEQ ID NO: 2681865 - protein, 20 aa, Entamoeba histolytica
KCYYHAMSIGITYRQRESTK

SEQ ID NO: 2681866 - protein, 18 aa, Entamoeba histolytica
KDACIRYINEFNNSTSSL

SEQ ID NO: 2681867 - protein, 20 aa, Entamoeba histolytica
KDACLAAFQLGRQRIKEPMY

SEQ ID NO: 2681868 - protein, 27 aa, Entamoeba histolytica
KDADVIICGQLKHHLSLREKKNDNVQI

SEQ ID NO: 2681869 - protein, 21 aa, Entamoeba histolytica
KDAQSIMEVFGWGETFLDINK

SEQ ID NO: 2681870 - protein, 29 aa, Entamoeba histolytica
KDARTMMCCLCQQLVPFLGYFELPYSLSS

SEQ ID NO: 2681871 - protein, 17 aa, Entamoeba histolytica
KDAVLKLSPKGVVPPPS

SEQ ID NO: 2681872 - protein, 17 aa, Entamoeba histolytica
KDCEYKNKLDISRVPFA

SEQ ID NO: 2681873 - protein, 17 aa, Entamoeba histolytica
KDCIPFVPFSLHSTLSI

SEQ ID NO: 2681874 - protein, 21 aa, Entamoeba histolytica
KDCRMTVVLSHCRIPRDDENE

SEQ ID NO: 2681875 - protein, 21 aa, Entamoeba histolytica
KDDGRIFAMKILRKDIVKERK

SEQ ID NO: 2681876 - protein, 25 aa, Entamoeba histolytica
KDDIKRLCEDYMIKLIDKYPPTKIK

SEQ ID NO: 2681877 - protein, 23 aa, Entamoeba histolytica
KDDKRSTVVLAYVDLPRYDAKEK

SEQ ID NO: 2681878 - protein, 21 aa, Entamoeba histolytica
KDDLNSFVSVVDWSMLSSTTT

SEQ ID NO: 2681879 - protein, 25 aa, Entamoeba histolytica
KDDMFKCVFDILKTLKTLSHFVALK

SEQ ID NO: 2681880 - protein, 23 aa, Entamoeba histolytica
KDDNCAVFVIGAFAHGHINIDYT

SEQ ID NO: 2681881 - protein, 20 aa, Entamoeba histolytica
KDDSKVYVLKMMFGMTDKDI

SEQ ID NO: 2681882 - protein, 19 aa, Entamoeba histolytica
KDDVWAFKSKREFEEDNNI

SEQ ID NO: 2681883 - protein, 24 aa, Entamoeba histolytica
KDEEYKKLLTLFTELVIKQSGIKE

SEQ ID NO: 2681884 - protein, 26 aa, Entamoeba histolytica
KDEIKKEDKGSCLILIELENKEKVKE

SEQ ID NO: 2681885 - protein, 25 aa, Entamoeba histolytica
KDEIPLPILKAMYSLYFSRRSLEGV

SEQ ID NO: 2681886 - protein, 29 aa, Entamoeba histolytica
KDEIYNCVFKWIHFFVMKNVKVVRRKEKE

SEQ ID NO: 2681887 - protein, 26 aa, Entamoeba histolytica
KDELIRDIWFSSIIKSICKIQMKEEI

SEQ ID NO: 2681888 - protein, 21 aa, Entamoeba histolytica
KDELKCIINVITRITIVPDTF

SEQ ID NO: 2681889 - protein, 18 aa, Entamoeba histolytica
KDELLFWVEGQKKIDNFM

SEQ ID NO: 2681890 - protein, 25 aa, Entamoeba histolytica
KDELLRSIYSYGFEKPSAIQQRAIV

SEQ ID NO: 2681891 - protein, 26 aa, Entamoeba histolytica
KDEQPITMAHCFRRNRENPEVEMKFK

SEQ ID NO: 2681892 - protein, 23 aa, Entamoeba histolytica
KDEQRLSIMEKWHSKTTMMNISK

SEQ ID NO: 2681893 - protein, 25 aa, Entamoeba histolytica
KDEVFPRILANYSHMLLKKGSKIEP

SEQ ID NO: 2681894 - protein, 22 aa, Entamoeba histolytica
KDEYITFPWIEYFKTFDKLLSN

SEQ ID NO: 2681895 - protein, 19 aa, Entamoeba histolytica
KDEYLIFDAMRTCNQCVGR

SEQ ID NO: 2681896 - protein, 23 aa, Entamoeba histolytica
KDFDFEDLEGFKIQTDDEQSSQL

SEQ ID NO: 2681897 - protein, 23 aa, Entamoeba histolytica
KDFELHSSSLLKYSQRDFLEQVT

SEQ ID NO: 2681898 - protein, 25 aa, Entamoeba histolytica
KDFFEKCKIKGYNLLIQKIVNDAPS

SEQ ID NO: 2681899 - protein, 17 aa, Entamoeba histolytica
KDFHSMAVFATVFNSAD

SEQ ID NO: 2681900 - protein, 23 aa, Entamoeba histolytica
KDFICKSLTYLEERGKFTKIGKL

SEQ ID NO: 2681901 - protein, 20 aa, Entamoeba histolytica
KDFKNKGIGLSFNEPTEMEK

SEQ ID NO: 2681902 - protein, 17 aa, Entamoeba histolytica
KDFKRVCKFASQCTTEW

SEQ ID NO: 2681903 - protein, 24 aa, Entamoeba histolytica
KDFLPRGSGIVTRRPLIVQCVRSN

SEQ ID NO: 2681904 - protein, 23 aa, Entamoeba histolytica
KDFLQRRYLFLCSLKELKLNDYT

SEQ ID NO: 2681905 - protein, 20 aa, Entamoeba histolytica
KDFLVKMANARKDYAKSMLR

SEQ ID NO: 2681906 - protein, 17 aa, Entamoeba histolytica
KDFPNEVMGCLELAANS

SEQ ID NO: 2681907 - protein, 17 aa, Entamoeba histolytica
KDFSLLCHCPETFFDSF

SEQ ID NO: 2681908 - protein, 18 aa, Entamoeba histolytica
KDGALGYIVCDVDHLTYI

SEQ ID NO: 2681909 - protein, 23 aa, Entamoeba histolytica
KDGKEIIDTICLLLPEFDNKVNT

SEQ ID NO: 2681910 - protein, 25 aa, Entamoeba histolytica
KDGKIITSLGCCTLVADTDDDNPNV

SEQ ID NO: 2681911 - protein, 23 aa, Entamoeba histolytica
KDGNCVVCGCYYTHHKYSTYRIV

SEQ ID NO: 2681912 - protein, 23 aa, Entamoeba histolytica
KDGRIFKYVIWYKVSYSKYLEEK

SEQ ID NO: 2681913 - protein, 20 aa, Entamoeba histolytica
KDGRIIKQIIWYDVSYSRYL

SEQ ID NO: 2681914 - protein, 25 aa, Entamoeba histolytica
KDGRIIKYVIWYKVEYSKYLEEKEE

SEQ ID NO: 2681915 - protein, 25 aa, Entamoeba histolytica
KDGRIIKYVIWYKVEYSRYLEEKEE

SEQ ID NO: 2681916 - protein, 23 aa, Entamoeba histolytica
KDGRIIKYVIWYKVSYSRYLEEK

SEQ ID NO: 2681917 - protein, 25 aa, Entamoeba histolytica
KDGWERSCDVCLLKEMERCGLCYFE

SEQ ID NO: 2681918 - protein, 18 aa, Entamoeba histolytica
KDGWRLISRNDCYDLYYD

SEQ ID NO: 2681919 - protein, 17 aa, Entamoeba histolytica
KDGYIISFNSILKGKLN

SEQ ID NO: 2681920 - protein, 17 aa, Entamoeba histolytica
KDHDFEIIARANNIFKL

SEQ ID NO: 2681921 - protein, 17 aa, Entamoeba histolytica
KDHFYHRLMFLHIQNKC

SEQ ID NO: 2681922 - protein, 18 aa, Entamoeba histolytica
KDHIEGVEIIHDIAHLNT

SEQ ID NO: 2681923 - protein, 17 aa, Entamoeba histolytica
KDHLLDLNLPYKLIKNK

SEQ ID NO: 2681924 - protein, 32 aa, Entamoeba histolytica
KDHLPGTVIRFIWDLADPMALPIKGGDEEIKE

SEQ ID NO: 2681925 - protein, 24 aa, Entamoeba histolytica
KDHSVEQFLNLFYEFTKTLLNTTE

SEQ ID NO: 2681926 - protein, 23 aa, Entamoeba histolytica
KDIEVFKYNQLISAKQGFDPDLK

SEQ ID NO: 2681927 - protein, 24 aa, Entamoeba histolytica
KDIFAEKVLVQYSGILTIDDIMKI

SEQ ID NO: 2681928 - protein, 17 aa, Entamoeba histolytica
KDIFRKDHRGLCVMTGY

SEQ ID NO: 2681929 - protein, 21 aa, Entamoeba histolytica
KDIHFLVALAYTLPRLDLDSI

SEQ ID NO: 2681930 - protein, 25 aa, Entamoeba histolytica
KDIIIPFKLKVFFYSKQTQEAKMGI

SEQ ID NO: 2681931 - protein, 18 aa, Entamoeba histolytica
KDIINREVIIKWQEAGGR

SEQ ID NO: 2681932 - protein, 17 aa, Entamoeba histolytica
KDIIPITTIKTFSSSLR

SEQ ID NO: 2681933 - protein, 22 aa, Entamoeba histolytica
KDIKCLYSLILNKVKLEELIVF

SEQ ID NO: 2681934 - protein, 17 aa, Entamoeba histolytica
KDIKELLEMGIGVHNAG

SEQ ID NO: 2681935 - protein, 20 aa, Entamoeba histolytica
KDIKHWKYWNLMKWVVEHKL

SEQ ID NO: 2681936 - protein, 19 aa, Entamoeba histolytica
KDIKIVVSIYANKESTEQP

SEQ ID NO: 2681937 - protein, 24 aa, Entamoeba histolytica
KDIKPLLFSSICRKKSNFGTPSII

SEQ ID NO: 2681938 - protein, 19 aa, Entamoeba histolytica
KDILFLIKMLLLKCKICVN

SEQ ID NO: 2681939 - protein, 25 aa, Entamoeba histolytica
KDILSEYLWFCIVLDEGHKIKNPNA

SEQ ID NO: 2681940 - protein, 20 aa, Entamoeba histolytica
KDILSVPSLLLIPFSISSVH

SEQ ID NO: 2681941 - protein, 17 aa, Entamoeba histolytica
KDIMSFKGLKGNTEAET

SEQ ID NO: 2681942 - protein, 18 aa, Entamoeba histolytica
KDINEFIIPSSITKLGDY

SEQ ID NO: 2681943 - protein, 20 aa, Entamoeba histolytica
KDIPRRCSVDASFNKISEIT

SEQ ID NO: 2681944 - protein, 22 aa, Entamoeba histolytica
KDIPRTEIDGIYFKRESQEFYK

SEQ ID NO: 2681945 - protein, 22 aa, Entamoeba histolytica
KDIQCIPDMYIVGIDSDTTADD

SEQ ID NO: 2681946 - protein, 24 aa, Entamoeba histolytica
KDIQSILHAFSICIYKEPEDIQVI

SEQ ID NO: 2681947 - protein, 19 aa, Entamoeba histolytica
KDISDVVLVGGMTRMPLIQ

SEQ ID NO: 2681948 - protein, 22 aa, Entamoeba histolytica
KDISDVVLVGGMTRMPLIQNTV

SEQ ID NO: 2681949 - protein, 20 aa, Entamoeba histolytica
KDISRKKCKGITKDRIKEIE

SEQ ID NO: 2681950 - protein, 17 aa, Entamoeba histolytica
KDIWKKKLIITTEDSLP

SEQ ID NO: 2681951 - protein, 18 aa, Entamoeba histolytica
KDKALGCNDLVKPYFAIV

SEQ ID NO: 2681952 - protein, 23 aa, Entamoeba histolytica
KDKDGTLFYCYTYLVKNKGGDEH

SEQ ID NO: 2681953 - protein, 18 aa, Entamoeba histolytica
KDKFRPIIPKAPFQYFGK

SEQ ID NO: 2681954 - protein, 17 aa, Entamoeba histolytica
KDKGKPLTFKQMKELYI

SEQ ID NO: 2681955 - protein, 23 aa, Entamoeba histolytica
KDKGLYITVEFEFDGSRIEQYNE

SEQ ID NO: 2681956 - protein, 25 aa, Entamoeba histolytica
KDKIFKCVFISLISFIPLKKDNFEL

SEQ ID NO: 2681957 - protein, 20 aa, Entamoeba histolytica
KDKIWEIIWNCIFEYNKDTI

SEQ ID NO: 2681958 - protein, 24 aa, Entamoeba histolytica
KDKKKLKIVIIIRLIIEIVEKETD

SEQ ID NO: 2681959 - protein, 25 aa, Entamoeba histolytica
KDKLKDLYYFFLFKDIFVQTKVKKL

SEQ ID NO: 2681960 - protein, 24 aa, Entamoeba histolytica
KDKLKEVVSFLVMVWTKVKPPMEN

SEQ ID NO: 2681961 - protein, 19 aa, Entamoeba histolytica
KDKLLERIERCVKSVVDSA

SEQ ID NO: 2681962 - protein, 20 aa, Entamoeba histolytica
KDKNESVEIAKVLKKSNSSN

SEQ ID NO: 2681963 - protein, 21 aa, Entamoeba histolytica
KDKNSVFDDFGFESEDENENK

SEQ ID NO: 2681964 - protein, 24 aa, Entamoeba histolytica
KDKPCPYCKTVSPKIVLNDSKTGF

SEQ ID NO: 2681965 - protein, 27 aa, Entamoeba histolytica
KDKRILMSVTIASFLCKVHYSYFSGSK

SEQ ID NO: 2681966 - protein, 22 aa, Entamoeba histolytica
KDKWSLNCCKEIALHGERREKL

SEQ ID NO: 2681967 - protein, 23 aa, Entamoeba histolytica
KDLCFKCGEPIIGDYIIINGMKC

SEQ ID NO: 2681968 - protein, 25 aa, Entamoeba histolytica
KDLCLEMMKRILTDPSLYKGNNLGC

SEQ ID NO: 2681969 - protein, 17 aa, Entamoeba histolytica
KDLCNPETVKLLIATVE

SEQ ID NO: 2681970 - protein, 20 aa, Entamoeba histolytica
KDLEESFALIITNATRIANI

SEQ ID NO: 2681971 - protein, 19 aa, Entamoeba histolytica
KDLFEFFKDIPMGTISIPH

SEQ ID NO: 2681972 - protein, 19 aa, Entamoeba histolytica
KDLHKLYLMLVEKANIQLQ

SEQ ID NO: 2681973 - protein, 25 aa, Entamoeba histolytica
KDLIDWKGLIPYFFNSFIFNNDTFI

SEQ ID NO: 2681974 - protein, 23 aa, Entamoeba histolytica
KDLKELNVHFTFDEKNCILKAEL

SEQ ID NO: 2681975 - protein, 20 aa, Entamoeba histolytica
KDLLLKRKKRHQLKSLMKQQ

SEQ ID NO: 2681976 - protein, 17 aa, Entamoeba histolytica
KDLLNCRLVCREWKMFL

SEQ ID NO: 2681977 - protein, 17 aa, Entamoeba histolytica
KDLLNEWGNLTGQPEIN

SEQ ID NO: 2681978 - protein, 17 aa, Entamoeba histolytica
KDLLPHIGTDNFESKAQ

SEQ ID NO: 2681979 - protein, 25 aa, Entamoeba histolytica
KDLLTNHCLFCLYTHTAMFGEDKFP

SEQ ID NO: 2681980 - protein, 19 aa, Entamoeba histolytica
KDLMKCRLVCKTWKDYLKT

SEQ ID NO: 2681981 - protein, 22 aa, Entamoeba histolytica
KDLPEKSARYAVYDLEYDTPEG

SEQ ID NO: 2681982 - protein, 20 aa, Entamoeba histolytica
KDLSKSAVWYESALTKGFND

SEQ ID NO: 2681983 - protein, 20 aa, Entamoeba histolytica
KDLTMRRLLYVVLNDMIPLT

SEQ ID NO: 2681984 - protein, 35 aa, Entamoeba histolytica
KDLTVHFVFVSLNILCFRTSYKIIKKGENDIYLDM

SEQ ID NO: 2681985 - protein, 25 aa, Entamoeba histolytica
KDLVPKAVIHFLVFKTRDSLQKELI

SEQ ID NO: 2681986 - protein, 21 aa, Entamoeba histolytica
KDLWIVMEICGAGSVCDIMNI

SEQ ID NO: 2681987 - protein, 18 aa, Entamoeba histolytica
KDMCKRKDININKLTLHK

SEQ ID NO: 2681988 - protein, 19 aa, Entamoeba histolytica
KDMEVGCVIFQIKDANSPI

SEQ ID NO: 2681989 - protein, 19 aa, Entamoeba histolytica
KDMMRWAEFDCGFASQNML

SEQ ID NO: 2681990 - protein, 23 aa, Entamoeba histolytica
KDMPKWRELLVAQVIVGKLIVPR

SEQ ID NO: 2681991 - protein, 24 aa, Entamoeba histolytica
KDMQRYMTSLGIMFNNELLEKRKF

SEQ ID NO: 2681992 - protein, 21 aa, Entamoeba histolytica
KDMRFAFSLVRKVLPKVTLVM

SEQ ID NO: 2681993 - protein, 18 aa, Entamoeba histolytica
KDMYNNIVLCGGSSMFPG

SEQ ID NO: 2681994 - protein, 23 aa, Entamoeba histolytica
KDNCFHSVLNLICVDAAHAIQPI

SEQ ID NO: 2681995 - protein, 25 aa, Entamoeba histolytica
KDNDFRFELQMKKYIRSDLREVLKI

SEQ ID NO: 2681996 - protein, 20 aa, Entamoeba histolytica
KDNGRYSGQIDIIGKTVQQK

SEQ ID NO: 2681997 - protein, 27 aa, Entamoeba histolytica
KDNIFYFKWRYCFIDDINIKDRLQELV

SEQ ID NO: 2681998 - protein, 23 aa, Entamoeba histolytica
KDNIPHPRIMVIFTPDEEIGESC

SEQ ID NO: 2681999 - protein, 20 aa, Entamoeba histolytica
KDNKKVDCYFEQIRQCLPTK

SEQ ID NO: 2682000 - protein, 30 aa, Entamoeba histolytica
KDNKPFGGICFRPFPTQGFVEIVFCAVDST

SEQ ID NO: 2682001 - protein, 28 aa, Entamoeba histolytica
KDNLITCSLCFCCFSCFNYYNPIYTDDT

SEQ ID NO: 2682002 - protein, 21 aa, Entamoeba histolytica
KDNPVIFLLRSHRETLKKEYE

SEQ ID NO: 2682003 - protein, 20 aa, Entamoeba histolytica
KDPFANYVLQRMFTMMNNDQ

SEQ ID NO: 2682004 - protein, 20 aa, Entamoeba histolytica
KDPHIYQMFSALGVEPQLFL

SEQ ID NO: 2682005 - protein, 25 aa, Entamoeba histolytica
KDQQYAFEIWRSCIGTLNTFIQEES

SEQ ID NO: 2682006 - protein, 18 aa, Entamoeba histolytica
KDQTCFTPLLPHLIQLTN

SEQ ID NO: 2682007 - protein, 24 aa, Entamoeba histolytica
KDQVKKMCCGGIVGDWNASILLYT

SEQ ID NO: 2682008 - protein, 20 aa, Entamoeba histolytica
KDRIRLLVLEIYNYCINLFI

SEQ ID NO: 2682009 - protein, 21 aa, Entamoeba histolytica
KDRLKRLVFRLTDSKVVLDRN

SEQ ID NO: 2682010 - protein, 21 aa, Entamoeba histolytica
KDRMKKLVCEKVLNNGEPMDD

SEQ ID NO: 2682011 - protein, 17 aa, Entamoeba histolytica
KDRTTYQFIGLTEVIGQ

SEQ ID NO: 2682012 - protein, 18 aa, Entamoeba histolytica
KDRYCVIDGEELIVYNSV

SEQ ID NO: 2682013 - protein, 20 aa, Entamoeba histolytica
KDSEAYLYLLHHLNNNCSLE

SEQ ID NO: 2682014 - protein, 21 aa, Entamoeba histolytica
KDSKCSFSIALFSMVIGLTHF

SEQ ID NO: 2682015 - protein, 20 aa, Entamoeba histolytica
KDSKLLKALCNIQTNHKVLL

SEQ ID NO: 2682016 - protein, 26 aa, Entamoeba histolytica
KDSVIKRLNGIVSEKETLIGTNIKGL

SEQ ID NO: 2682017 - protein, 22 aa, Entamoeba histolytica
KDTELKVSSFGFSQKKFIVVFK

SEQ ID NO: 2682018 - protein, 17 aa, Entamoeba histolytica
KDTFNHWIRMTHYSIVY

SEQ ID NO: 2682019 - protein, 18 aa, Entamoeba histolytica
KDTHFAFVLLKYFFLCLP

SEQ ID NO: 2682020 - protein, 18 aa, Entamoeba histolytica
KDTIKMTTALLLHENDEN

SEQ ID NO: 2682021 - protein, 20 aa, Entamoeba histolytica
KDTLHGLAYLHKMHMIHRDI

SEQ ID NO: 2682022 - protein, 23 aa, Entamoeba histolytica
KDTLRFILMTKIKDWKCELESPL

SEQ ID NO: 2682023 - protein, 19 aa, Entamoeba histolytica
KDTPFRFITDKELQNQLDN

SEQ ID NO: 2682024 - protein, 20 aa, Entamoeba histolytica
KDTRIFKTLIKCLNSINKME

SEQ ID NO: 2682025 - protein, 23 aa, Entamoeba histolytica
KDTYFKFRLIQVDFPIKQEDVEK

SEQ ID NO: 2682026 - protein, 21 aa, Entamoeba histolytica
KDTYIRSGDGFAIVYSITSLN

SEQ ID NO: 2682027 - protein, 19 aa, Entamoeba histolytica
KDTYLPIKLLEKLMSLVNG

SEQ ID NO: 2682028 - protein, 18 aa, Entamoeba histolytica
KDVAEMILYLTKNRVSKT

SEQ ID NO: 2682029 - protein, 24 aa, Entamoeba histolytica
KDVALECYNRLKAAYEKRKLEEFE

SEQ ID NO: 2682030 - protein, 20 aa, Entamoeba histolytica
KDVFESPDFTSIDIVGFGTS

SEQ ID NO: 2682031 - protein, 21 aa, Entamoeba histolytica
KDVFTQIGIPLVETALNGYNS

SEQ ID NO: 2682032 - protein, 24 aa, Entamoeba histolytica
KDVHKVLSCMTLFYYVSKDKLFKD

SEQ ID NO: 2682033 - protein, 28 aa, Entamoeba histolytica
KDVIPLLKIELNKYIGFTAKFQLEGETT

SEQ ID NO: 2682034 - protein, 30 aa, Entamoeba histolytica; identical to SEQ ID NO: 2489140

SEQ ID NO: 2682035 - protein, 19 aa, Entamoeba histolytica
KDVKKNFIAMFTFCDGEKP

SEQ ID NO: 2682036 - protein, 24 aa, Entamoeba histolytica
KDVKNFIQYDGCKITMVTDKNTGK

SEQ ID NO: 2682037 - protein, 20 aa, Entamoeba histolytica
KDVLNLCLVFSTSNSFNREF

SEQ ID NO: 2682038 - protein, 19 aa, Entamoeba histolytica
KDVNAACVLWRKAKALGSD

SEQ ID NO: 2682039 - protein, 19 aa, Entamoeba histolytica
KDVVLPSCITRIGHSSFEN

SEQ ID NO: 2682040 - protein, 23 aa, Entamoeba histolytica
KDWKELKDYISPEGFHLVEIHMQ

SEQ ID NO: 2682041 - protein, 17 aa, Entamoeba histolytica
KDWTSLFTLCKRTTIYS

SEQ ID NO: 2682042 - protein, 17 aa, Entamoeba histolytica
KDWVCNLIMTWPAFSNK

SEQ ID NO: 2682043 - protein, 21 aa, Entamoeba histolytica
KDWVRMAVVINENYNDYDGFV

SEQ ID NO: 2682044 - protein, 19 aa, Entamoeba histolytica
KDYFTAYEIRVNLNDQIDR

SEQ ID NO: 2682045 - protein, 18 aa, Entamoeba histolytica
KDYFYLCLLNEIPNKDII

SEQ ID NO: 2682046 - protein, 21 aa, Entamoeba histolytica
KDYIEHIGFILDICKNYIELN

SEQ ID NO: 2682047 - protein, 19 aa, Entamoeba histolytica
KDYKLAQFVVESHSINHPE

SEQ ID NO: 2682048 - protein, 29 aa, Entamoeba histolytica
KDYLTLFDLEDIKPCTSQQLPLNVQEQNP

SEQ ID NO: 2682049 - protein, 27 aa, Entamoeba histolytica
KDYSEPVDWWGFGILIYEMIHGHAPFT

SEQ ID NO: 2682050 - protein, 28 aa, Entamoeba histolytica
KDYSEPVDWWGFGILIYEMIHGHAPFTS

SEQ ID NO: 2682051 - protein, 25 aa, Entamoeba histolytica
KDYYPQRLSSMIIKTIYQLTIGTIT

SEQ ID NO: 2682052 - protein, 18 aa, Entamoeba histolytica
KEAALFKRVVESLKSTID

SEQ ID NO: 2682053 - protein, 19 aa, Entamoeba histolytica
KEAANRWTDGIFMIQTYAK

SEQ ID NO: 2682054 - protein, 23 aa, Entamoeba histolytica
KEADSNYRACVQLTNDRIHDYYN

SEQ ID NO: 2682055 - protein, 24 aa, Entamoeba histolytica
KEAEGLLRQASMTWYLNNVKKFRD

SEQ ID NO: 2682056 - protein, 21 aa, Entamoeba histolytica
KEAFGNCLNVCYDYVPTEVAL

SEQ ID NO: 2682057 - protein, 20 aa, Entamoeba histolytica
KEAFREFHCFSKIANERSKM

SEQ ID NO: 2682058 - protein, 22 aa, Entamoeba histolytica
KEAFSLKGTFFTYFYDKFQALD

SEQ ID NO: 2682059 - protein, 18 aa, Entamoeba histolytica
KEAFSRLFNLNSISIENN

SEQ ID NO: 2682060 - protein, 20 aa, Entamoeba histolytica
KEAFWEKKKMWMIEDEEDKK

SEQ ID NO: 2682061 - protein, 20 aa, Entamoeba histolytica
KEAGANVVLCQWGFDDEANH

SEQ ID NO: 2682062 - protein, 17 aa, Entamoeba histolytica
KEAKTPMRLSLAKIPGI

SEQ ID NO: 2682063 - protein, 18 aa, Entamoeba histolytica
KEALRVVRKYLVGPLGMK

SEQ ID NO: 2682064 - protein, 18 aa, Entamoeba histolytica
KEALSHNKAVHFTSRYMY

SEQ ID NO: 2682065 - protein, 21 aa, Entamoeba histolytica
KEALSRLKINPFIDEFNDNEY

SEQ ID NO: 2682066 - protein, 22 aa, Entamoeba histolytica
KEAPHDGAFCDLLWSDPEPEVD

SEQ ID NO: 2682067 - protein, 23 aa, Entamoeba histolytica
KEAPIHFIPTFKIICGKDEYIDD

SEQ ID NO: 2682068 - protein, 21 aa, Entamoeba histolytica
KEARELFLHPDVADFSDYKLE

SEQ ID NO: 2682069 - protein, 28 aa, Entamoeba histolytica
KEARFEVEIVKAIGLPVLGWGCPDPYAC

SEQ ID NO: 2682070 - protein, 17 aa, Entamoeba histolytica
KEATKLGDQLALLNKEI

SEQ ID NO: 2682071 - protein, 18 aa, Entamoeba histolytica
KEAVELPLSHPELYEEIG

SEQ ID NO: 2682072 - protein, 18 aa, Entamoeba histolytica
KEAVLVFNAFNMKEDIKK

SEQ ID NO: 2682073 - protein, 17 aa, Entamoeba histolytica
KECARITSNDAFWKGFT

SEQ ID NO: 2682074 - protein, 19 aa, Entamoeba histolytica
KECFKGCTSLSSITLPSQL

SEQ ID NO: 2682075 - protein, 23 aa, Entamoeba histolytica
KECFNCKMFCQCPNLKNIKFIDS

SEQ ID NO: 2682076 - protein, 19 aa, Entamoeba histolytica
KECGKGIKKDISFIHTDTH

SEQ ID NO: 2682077 - protein, 21 aa, Entamoeba histolytica
KECNEALIAQKGRENETFDDS

SEQ ID NO: 2682078 - protein, 19 aa, Entamoeba histolytica
KECVDMFRANHRNERIRSE

SEQ ID NO: 2682079 - protein, 22 aa, Entamoeba histolytica
KECWGFRRHPTYIAHTLIANCL

SEQ ID NO: 2682080 - protein, 22 aa, Entamoeba histolytica
KEDDLRKVISFMRTTLNIPTSI

SEQ ID NO: 2682081 - protein, 18 aa, Entamoeba histolytica
KEDFDCIHSSSINYHQKC

SEQ ID NO: 2682082 - protein, 19 aa, Entamoeba histolytica
KEDFFGALIHLIKEDNKRL

SEQ ID NO: 2682083 - protein, 27 aa, Entamoeba histolytica
KEDFKVRVPNHFKRNGVFYTGTIQIYD

SEQ ID NO: 2682084 - protein, 19 aa, Entamoeba histolytica
KEDGLFEVIIFCSDKSCSF

SEQ ID NO: 2682085 - protein, 23 aa, Entamoeba histolytica
KEDHLKLLHFLLVKKKLTTKPEN

SEQ ID NO: 2682086 - protein, 28 aa, Entamoeba histolytica
KEDIKKVVPIQCFFCGSTEHLAKDCPKR

SEQ ID NO: 2682087 - protein, 28 aa, Entamoeba histolytica
KEDISCFMPEVFFAWWEEKDLLFIKQFV

SEQ ID NO: 2682088 - protein, 24 aa, Entamoeba histolytica
KEDISIYFEECFQFIEQARNSGGA

SEQ ID NO: 2682089 - protein, 21 aa, Entamoeba histolytica
KEDIVTLLLLNGCNVNTQDEQ

SEQ ID NO: 2682090 - protein, 21 aa, Entamoeba histolytica
KEDKTWGEIITRLRHLKTTII

SEQ ID NO: 2682091 - protein, 23 aa, Entamoeba histolytica
KEDLKKCFPGFGDIHKINQNLII

SEQ ID NO: 2682092 - protein, 20 aa, Entamoeba histolytica
KEDPRYTSIVSVGSQVFLLH

SEQ ID NO: 2682093 - protein, 24 aa, Entamoeba histolytica
KEDRARIVKELQELGVEDIPEQPQ

SEQ ID NO: 2682094 - protein, 23 aa, Entamoeba histolytica
KEDRLVTYLPKLKNICYCDHFVK

SEQ ID NO: 2682095 - protein, 19 aa, Entamoeba histolytica
KEDSILLLHQFFGENNEMV

SEQ ID NO: 2682096 - protein, 25 aa, Entamoeba histolytica
KEDVITPITMNWILYGYRASKNIDG

SEQ ID NO: 2682097 - protein, 17 aa, Entamoeba histolytica
KEDYPICYCCMTNALLF

SEQ ID NO: 2682098 - protein, 18 aa, Entamoeba histolytica
KEEAGAFYNPVQELNRDL

SEQ ID NO: 2682099 - protein, 20 aa, Entamoeba histolytica
KEEARRIGLVYEEMNDKNSE

SEQ ID NO: 2682100 - protein, 19 aa, Entamoeba histolytica
KEECFGCNGKEECLQFQYN

SEQ ID NO: 2682101 - protein, 24 aa, Entamoeba histolytica
KEEEKRIIGWLNNIYVIEKNKEGI

SEQ ID NO: 2682102 - protein, 23 aa, Entamoeba histolytica
KEEELKKQFSIAISKLEKRERVN

SEQ ID NO: 2682103 - protein, 17 aa, Entamoeba histolytica
KEEELLLMIAIGYGDED

SEQ ID NO: 2682104 - protein, 27 aa, Entamoeba histolytica
KEEEREKKEREWKRKLEEDRKVLEEDK

SEQ ID NO: 2682105 - protein, 19 aa, Entamoeba histolytica
KEEEWSYIPSFLKTKPPKP

SEQ ID NO: 2682106 - protein, 20 aa, Entamoeba histolytica
KEEIAQCFQVFKQVHLQMSR

SEQ ID NO: 2682107 - protein, 19 aa, Entamoeba histolytica
KEEIEFWGFIGGVKTFNEK

SEQ ID NO: 2682108 - protein, 18 aa, Entamoeba histolytica
KEEIETIPAKGLYNDIDH

SEQ ID NO: 2682109 - protein, 24 aa, Entamoeba histolytica
KEEIICGSIINGTFAYVTKGKDKY

SEQ ID NO: 2682110 - protein, 20 aa, Entamoeba histolytica
KEEISSIFQLICFSHEIGSY

SEQ ID NO: 2682111 - protein, 17 aa, Entamoeba histolytica
KEEIVFHIFGHVLVTRD

SEQ ID NO: 2682112 - protein, 24 aa, Entamoeba histolytica
KEEKKQKVHIAIRLPNGEIKKEYF

SEQ ID NO: 2682113 - protein, 21 aa, Entamoeba histolytica
KEEKRGIFSPMYSIYNEEMNI

SEQ ID NO: 2682114 - protein, 30 aa, Entamoeba histolytica
KEELEHIKGYLQKRIELIEKEIEKDIEEGK

SEQ ID NO: 2682115 - protein, 19 aa, Entamoeba histolytica
KEELFNLVYERFIESHQVT

SEQ ID NO: 2682116 - protein, 17 aa, Entamoeba histolytica
KEELGLFLRWLKFTRFF

SEQ ID NO: 2682117 - protein, 21 aa, Entamoeba histolytica
KEELNICKSLTNSNSQEIKHP

SEQ ID NO: 2682118 - protein, 19 aa, Entamoeba histolytica
KEELRFTIDSHNLPSIKFE

SEQ ID NO: 2682119 - protein, 22 aa, Entamoeba histolytica
KEELSMNIYLVYLYEKRKEIEA

SEQ ID NO: 2682120 - protein, 22 aa, Entamoeba histolytica
KEEMICSGVLPIDRMQDCLGPI

SEQ ID NO: 2682121 - protein, 19 aa, Entamoeba histolytica
KEENVICSIQRFREVSRCI

SEQ ID NO: 2682122 - protein, 18 aa, Entamoeba histolytica
KEEPFIKAIEVDVQPNAL

SEQ ID NO: 2682123 - protein, 21 aa, Entamoeba histolytica
KEEQLELLVGFNYAPVNSVIG

SEQ ID NO: 2682124 - protein, 18 aa, Entamoeba histolytica
KEERLDFISRDDLILGED

SEQ ID NO: 2682125 - protein, 17 aa, Entamoeba histolytica
KEESIKVLVAGERSIEV

SEQ ID NO: 2682126 - protein, 19 aa, Entamoeba histolytica
KEEYIPLSLVNNLFAEISL

SEQ ID NO: 2682127 - protein, 19 aa, Entamoeba histolytica
KEEYKMCGLKNNLNKLELK

SEQ ID NO: 2682128 - protein, 17 aa, Entamoeba histolytica
KEFAPKSYDLIVEVLET

SEQ ID NO: 2682129 - protein, 17 aa, Entamoeba histolytica
KEFCRIGYYVNNEFEGI

SEQ ID NO: 2682130 - protein, 19 aa, Entamoeba histolytica
KEFDWISSPFHTVFIHTKT

SEQ ID NO: 2682131 - protein, 20 aa, Entamoeba histolytica
KEFEKEVAMLDKFRNEYIIH

SEQ ID NO: 2682132 - protein, 18 aa, Entamoeba histolytica
KEFFCMKCATHFMTPAPF

SEQ ID NO: 2682133 - protein, 19 aa, Entamoeba histolytica
KEFFNLRGGNYEFKEQFQY

SEQ ID NO: 2682134 - protein, 23 aa, Entamoeba histolytica
KEFGKGCFVNCSLAVNTLYVPEE

SEQ ID NO: 2682135 - protein, 24 aa, Entamoeba histolytica
KEFIESGCLKEIIKIIKSNPKEDI

SEQ ID NO: 2682136 - protein, 17 aa, Entamoeba histolytica
KEFIPIVQINLCLLFGE

SEQ ID NO: 2682137 - protein, 20 aa, Entamoeba histolytica
KEFIPRIVQIVQQTFQLREQ

SEQ ID NO: 2682138 - protein, 21 aa, Entamoeba histolytica
KEFIRKKCLENKTLTFFIPLS

SEQ ID NO: 2682139 - protein, 19 aa, Entamoeba histolytica
KEFISDLFVMNCYKTSINT

SEQ ID NO: 2682140 - protein, 20 aa, Entamoeba histolytica
KEFITIGNMLWGWKIETYNK

SEQ ID NO: 2682141 - protein, 22 aa, Entamoeba histolytica
KEFKEVFPMVTSVIINNRSIER

SEQ ID NO: 2682142 - protein, 27 aa, Entamoeba histolytica
KEFKTRESEMFKMNTIESLNNQVSQLQ

SEQ ID NO: 2682143 - protein, 17 aa, Entamoeba histolytica
KEFKVSYSKLLLSSFSK

SEQ ID NO: 2682144 - protein, 24 aa, Entamoeba histolytica
KEFLKEKLVPFSIPTYIFAIEDMP

SEQ ID NO: 2682145 - protein, 20 aa, Entamoeba histolytica
KEFMKQLCLNGIQFSFLSSE

SEQ ID NO: 2682146 - protein, 17 aa, Entamoeba histolytica
KEFNDPAPVFNMPRDPR

SEQ ID NO: 2682147 - protein, 22 aa, Entamoeba histolytica
KEFNGPAMLKTFIEDVNISREI

SEQ ID NO: 2682148 - protein, 22 aa, Entamoeba histolytica
KEFNLLFWKYLMKTKPLPSREV

SEQ ID NO: 2682149 - protein, 22 aa, Entamoeba histolytica
KEFPEKELFLLKYLNKEMLTKE

SEQ ID NO: 2682150 - protein, 21 aa, Entamoeba histolytica
KEFRENCGFAQTTARELKILQ

SEQ ID NO: 2682151 - protein, 20 aa, Entamoeba histolytica
KEFTSGAVFIVKILVPEFAN

SEQ ID NO: 2682152 - protein, 19 aa, Entamoeba histolytica
KEGASALAHLIKAKVIPDC

SEQ ID NO: 2682153 - protein, 19 aa, Entamoeba histolytica
KEGASGLAHLIKAKVIPDC

SEQ ID NO: 2682154 - protein, 22 aa, Entamoeba histolytica
KEGECGLHLIIKMCYNNITKNE

SEQ ID NO: 2682155 - protein, 16 aa, Entamoeba histolytica
KEGEIIGWRSYWYKRI

SEQ ID NO: 2682156 - protein, 19 aa, Entamoeba histolytica
KEGEILTGYIIKSSEEEGV

SEQ ID NO: 2682157 - protein, 19 aa, Entamoeba histolytica
KEGEKVILYRTVYKRKGIS

SEQ ID NO: 2682158 - protein, 20 aa, Entamoeba histolytica
KEGEKVILYRTVYKRKGISN

SEQ ID NO: 2682159 - protein, 20 aa, Entamoeba histolytica
KEGFLPAFIELAKETTGDKI

SEQ ID NO: 2682160 - protein, 20 aa, Entamoeba histolytica
KEGFVCIRFELFGNGIQCYL

SEQ ID NO: 2682161 - protein, 25 aa, Entamoeba histolytica
KEGGKKKSAFCTFATGGMGGDCCIW

SEQ ID NO: 2682162 - protein, 20 aa, Entamoeba histolytica
KEGHLLYLLLDLIGDKEQTV

SEQ ID NO: 2682163 - protein, 20 aa, Entamoeba histolytica
KEGHPELLCKIRRQQPKRAE

SEQ ID NO: 2682164 - protein, 19 aa, Entamoeba histolytica
KEGIQMLHRCCLFKNQLSQ

SEQ ID NO: 2682165 - protein, 26 aa, Entamoeba histolytica
KEGLIPPEYPCVIPHQKIPFCRLTGM

SEQ ID NO: 2682166 - protein, 21 aa, Entamoeba histolytica
KEGNINIVFICDRSGSMYGEG

SEQ ID NO: 2682167 - protein, 29 aa, Entamoeba histolytica
KEGQMWRSVVIVGIIFRQGNSYDFQEQEE

SEQ ID NO: 2682168 - protein, 21 aa, Entamoeba histolytica
KEGRIIKYVIWYDVSYSRYLK

SEQ ID NO: 2682169 - protein, 21 aa, Entamoeba histolytica
KEGRSIEICKRRKCIRASIVF

SEQ ID NO: 2682170 - protein, 19 aa, Entamoeba histolytica
KEGVLYFLHEESVQKAIEY

SEQ ID NO: 2682171 - protein, 18 aa, Entamoeba histolytica
KEGVVYQIYCRSFKDTTG

SEQ ID NO: 2682172 - protein, 17 aa, Entamoeba histolytica
KEGWIEEIGIKREEGME

SEQ ID NO: 2682173 - protein, 21 aa, Entamoeba histolytica
KEGWLTRFVDYNSLVYSYSKT

SEQ ID NO: 2682174 - protein, 20 aa, Entamoeba histolytica
KEGYIKYFSYLIHHPVGSYI

SEQ ID NO: 2682175 - protein, 18 aa, Entamoeba histolytica
KEHGDFGLKLNMSNGGPA

SEQ ID NO: 2682176 - protein, 19 aa, Entamoeba histolytica
KEHGWKVIVADWGAEACGD

SEQ ID NO: 2682177 - protein, 19 aa, Entamoeba histolytica
KEHIPRLSLQQQTSINRLT

SEQ ID NO: 2682178 - protein, 27 aa, Entamoeba histolytica
KEHKEYKGSSILILPHFFKKIIQDQTL

SEQ ID NO: 2682179 - protein, 21 aa, Entamoeba histolytica
KEHKYSFFVIKRIPILLDDKE

SEQ ID NO: 2682180 - protein, 19 aa, Entamoeba histolytica
KEHYHPSNSLTVLYSPLTL

SEQ ID NO: 2682181 - protein, 25 aa, Entamoeba histolytica
KEIAKAEMPAVCGDIAVHFRELAKH

SEQ ID NO: 2682182 - protein, 25 aa, Entamoeba histolytica
KEICKPNILRQFSFEQMNYVLETLK

SEQ ID NO: 2682183 - protein, 21 aa, Entamoeba histolytica
KEICLKYQVPFDEIQIKDQYE

SEQ ID NO: 2682184 - protein, 20 aa, Entamoeba histolytica
KEIDGSIVVVQISRPQDRKR

SEQ ID NO: 2682185 - protein, 17 aa, Entamoeba histolytica
KEIECTIIVTPTALLLV

SEQ ID NO: 2682186 - protein, 24 aa, Entamoeba histolytica
KEIEPRLSWKELGKNYSLSKSNVC

SEQ ID NO: 2682187 - protein, 19 aa, Entamoeba histolytica
KEIERIRCVKLTGEEAKEI

SEQ ID NO: 2682188 - protein, 19 aa, Entamoeba histolytica
KEIERRLIEAINKIKPTNK

SEQ ID NO: 2682189 - protein, 25 aa, Entamoeba histolytica
KEIETIYYWKYYLNLVLPQQMSVFV

SEQ ID NO: 2682190 - protein, 22 aa, Entamoeba histolytica
KEIEVVMKYILDYPLAIYELTK

SEQ ID NO: 2682191 - protein, 23 aa, Entamoeba histolytica
KEIEYDKRIEIFKTYIHNDIKCH

SEQ ID NO: 2682192 - protein, 20 aa, Entamoeba histolytica
KEIFKEKGFNNLKIVFDTED

SEQ ID NO: 2682193 - protein, 21 aa, Entamoeba histolytica
KEIFLELTSPVPLQYNEEIKL

SEQ ID NO: 2682194 - protein, 20 aa, Entamoeba histolytica
KEIFRIDKVFFFSYTFPELI

SEQ ID NO: 2682195 - protein, 26 aa, Entamoeba histolytica
KEIGDEGFLIAKFCKQPKNLKTNLYI

SEQ ID NO: 2682196 - protein, 22 aa, Entamoeba histolytica
KEIGGGCFYECLSLTSMNIPTT

SEQ ID NO: 2682197 - protein, 21 aa, Entamoeba histolytica
KEIIHNVKIPTEKKITELDVL

SEQ ID NO: 2682198 - protein, 22 aa, Entamoeba histolytica
KEIINRDVFWTGIDTNEIGNES

SEQ ID NO: 2682199 - protein, 20 aa, Entamoeba histolytica
KEIIQNIIFIISGKKTEYNE

SEQ ID NO: 2682200 - protein, 17 aa, Entamoeba histolytica
KEIKEEEKVVYKSIKSD

SEQ ID NO: 2682201 - protein, 18 aa, Entamoeba histolytica
KEIKEIGIGFPRKYPLMC

SEQ ID NO: 2682202 - protein, 17 aa, Entamoeba histolytica
KEIKEYKSKIEFSVYST

SEQ ID NO: 2682203 - protein, 17 aa, Entamoeba histolytica
KEIKKALPYITSAVGNI

SEQ ID NO: 2682204 - protein, 20 aa, Entamoeba histolytica
KEIKKPLIQKKERKVKEVKK

SEQ ID NO: 2682205 - protein, 25 aa, Entamoeba histolytica
KEIKRIKIYRTLYSLAKFKDGNWLI

SEQ ID NO: 2682206 - protein, 23 aa, Entamoeba histolytica
KEIKRLINRWDIDKTQRENIQKK

SEQ ID NO: 2682207 - protein, 25 aa, Entamoeba histolytica
KEIKRNEFIPELLRRTEILTGAEET

SEQ ID NO: 2682208 - protein, 22 aa, Entamoeba histolytica
KEIKTKKGIFFYTIYSFIGNTI

SEQ ID NO: 2682209 - protein, 25 aa, Entamoeba histolytica
KEILDILEFRPPRHIDLTQFQPKIP

SEQ ID NO: 2682210 - protein, 21 aa, Entamoeba histolytica
KEILEGKGYQFRLIKSKKTAN

SEQ ID NO: 2682211 - protein, 22 aa, Entamoeba histolytica
KEILESHWAKYGRNYYQRYDFD

SEQ ID NO: 2682212 - protein, 21 aa, Entamoeba histolytica
KEILESVRFFGKHHGNDVDKF

SEQ ID NO: 2682213 - protein, 22 aa, Entamoeba histolytica
KEILKRHNEEIISLKNTAKNNQ

SEQ ID NO: 2682214 - protein, 17 aa, Entamoeba histolytica
KEILLFVRNILLNSNNT

SEQ ID NO: 2682215 - protein, 22 aa, Entamoeba histolytica
KEILNIPIIVACDVNNPFYGKN

SEQ ID NO: 2682216 - protein, 26 aa, Entamoeba histolytica
KEIMNIKYYWYFVVKNSSWISELSPS

SEQ ID NO: 2682217 - protein, 26 aa, Entamoeba histolytica
KEINEIRIKIVFGIFSLIGLDDRILS

SEQ ID NO: 2682218 - protein, 20 aa, Entamoeba histolytica
KEINFCKKIGLPIIGVVENM

SEQ ID NO: 2682219 - protein, 19 aa, Entamoeba histolytica
KEINGKKYVSFFIGYNEAV

SEQ ID NO: 2682220 - protein, 19 aa, Entamoeba histolytica
KEINIPYIIAPGEAEAQCY

SEQ ID NO: 2682221 - protein, 25 aa, Entamoeba histolytica
KEINKRCVGIIYLALGYNENTIEDK

SEQ ID NO: 2682222 - protein, 24 aa, Entamoeba histolytica
KEINKWIEITDEWYIPEAIFVVSE

SEQ ID NO: 2682223 - protein, 17 aa, Entamoeba histolytica
KEIPDRLPAEDVEEKKD

SEQ ID NO: 2682224 - protein, 38 aa, Entamoeba histolytica
KEIPKFSLPTKILKWSVNWSVDSLGHWDDDIIENDSSY

SEQ ID NO: 2682225 - protein, 27 aa, Entamoeba histolytica
KEIPKGLLATVGWEINGKITYALEGTV

SEQ ID NO: 2682226 - protein, 19 aa, Entamoeba histolytica
KEIQMSWNVIENKIEESDK

SEQ ID NO: 2682227 - protein, 22 aa, Entamoeba histolytica
KEIRRIELEGCIVKGKNCPKPI

SEQ ID NO: 2682228 - protein, 22 aa, Entamoeba histolytica
KEIRYYEAFDRLSLLINNPKTI

SEQ ID NO: 2682229 - protein, 19 aa, Entamoeba histolytica
KEISLRGYLIQAVHTGSEK

SEQ ID NO: 2682230 - protein, 18 aa, Entamoeba histolytica
KEITDLFTFMGIDEQGVV

SEQ ID NO: 2682231 - protein, 24 aa, Entamoeba histolytica
KEITELYISIPLGHVIRDSVFIVH

SEQ ID NO: 2682232 - protein, 24 aa, Entamoeba histolytica
KEITRIPFPTGYSLNPKDKILGVV

SEQ ID NO: 2682233 - protein, 26 aa, Entamoeba histolytica
KEIVFEVKYDLVLQIVQQFYKEGRSI

SEQ ID NO: 2682234 - protein, 18 aa, Entamoeba histolytica
KEIVKAMEGMRGFHKDNG

SEQ ID NO: 2682235 - protein, 20 aa, Entamoeba histolytica
KEIYLYSFGDSISRGNSTCN

SEQ ID NO: 2682236 - protein, 19 aa, Entamoeba histolytica
KEIYVEGVVNQFYFNCIDW

SEQ ID NO: 2682237 - protein, 32 aa, Entamoeba histolytica
KEKAIKIGICGSDGFVSLFVRIFIEITSKKLK

SEQ ID NO: 2682238 - protein, 20 aa, Entamoeba histolytica
KEKASGAFGEYGAGTISARL

SEQ ID NO: 2682239 - protein, 21 aa, Entamoeba histolytica
KEKDKFGKFVEEFKKEDSLKK

SEQ ID NO: 2682240 - protein, 17 aa, Entamoeba histolytica
KEKDKREGIIMKIIESM

SEQ ID NO: 2682241 - protein, 18 aa, Entamoeba histolytica
KEKDTIFMILDLAEGSLD

SEQ ID NO: 2682242 - protein, 32 aa, Entamoeba histolytica
KEKEARKFAEMIVSYLLRFGNDIDSWNSGNEF

SEQ ID NO: 2682243 - protein, 22 aa, Entamoeba histolytica
KEKEHAKAFGLFRSRAQSQSKK

SEQ ID NO: 2682244 - protein, 20 aa, Entamoeba histolytica
KEKEISMFFFNFHQQEISTK

SEQ ID NO: 2682245 - protein, 18 aa, Entamoeba histolytica
KEKEYEKVKLLGRGGFGT

SEQ ID NO: 2682246 - protein, 18 aa, Entamoeba histolytica
KEKEYNFLIDVDVSCIQV

SEQ ID NO: 2682247 - protein, 24 aa, Entamoeba histolytica
KEKGCTRWQLKNGILYAYLQEEKG

SEQ ID NO: 2682248 - protein, 29 aa, Entamoeba histolytica
KEKIEMFAKLPFLISNVVEILDLPPEESD

SEQ ID NO: 2682249 - protein, 18 aa, Entamoeba histolytica
KEKIKCFKITYTQNDRIK

SEQ ID NO: 2682250 - protein, 35 aa, Entamoeba histolytica
KEKISFGVNVKAMFLFRECVQRCISQKLEIQDSEA

SEQ ID NO: 2682251 - protein, 20 aa, Entamoeba histolytica
KEKISLNWAFNERLKYIPDE

SEQ ID NO: 2682252 - protein, 23 aa, Entamoeba histolytica
KEKKKGMFSKIFGKKDKKEKKDK

SEQ ID NO: 2682253 - protein, 17 aa, Entamoeba histolytica
KEKKKKFSIFKKKDKNK

SEQ ID NO: 2682254 - protein, 22 aa, Entamoeba histolytica
KEKKLKAPRSSDEIKRKTKIPK

SEQ ID NO: 2682255 - protein, 23 aa, Entamoeba histolytica
KEKKMKEIIERVSKITTSAEKLI

SEQ ID NO: 2682256 - protein, 17 aa, Entamoeba histolytica
KEKKPIPVFVEKPGKNW

SEQ ID NO: 2682257 - protein, 27 aa, Entamoeba histolytica
KEKKPRKDCVCGLDLLHEPKRDKLIIL

SEQ ID NO: 2682258 - protein, 18 aa, Entamoeba histolytica
KEKKRDVLKFVESRKLNS

SEQ ID NO: 2682259 - protein, 21 aa, Entamoeba histolytica
KEKKSGLFLIDLIQEKQNENT

SEQ ID NO: 2682260 - protein, 23 aa, Entamoeba histolytica
KEKKSKIPRVITCTEDVIEICQV

SEQ ID NO: 2682261 - protein, 26 aa, Entamoeba histolytica
KEKKSVGISINWGIRFENDDDVKQFI

SEQ ID NO: 2682262 - protein, 18 aa, Entamoeba histolytica
KEKKVLVQFKIDISQVFK

SEQ ID NO: 2682263 - protein, 18 aa, Entamoeba histolytica
KEKLFKYLDKFIEVSIEG

SEQ ID NO: 2682264 - protein, 23 aa, Entamoeba histolytica
KEKLFLEWCCEIAKKIESYATQY

SEQ ID NO: 2682265 - protein, 19 aa, Entamoeba histolytica
KEKLLKLDINTIKAEAIFT

SEQ ID NO: 2682266 - protein, 18 aa, Entamoeba histolytica
KEKLRRCEKMLKDDLNSF

SEQ ID NO: 2682267 - protein, 18 aa, Entamoeba histolytica
KEKMEIIVSKLLEEMENG

SEQ ID NO: 2682268 - protein, 24 aa, Entamoeba histolytica
KEKMKRIKFVLQLRHSNKNGELIH

SEQ ID NO: 2682269 - protein, 23 aa, Entamoeba histolytica
KEKMRNCDIGFMVVNDPLIEITK

SEQ ID NO: 2682270 - protein, 21 aa, Entamoeba histolytica
KEKNVNCSILLSRIDEYEKEA

SEQ ID NO: 2682271 - protein, 19 aa, Entamoeba histolytica
KEKPKAIDISSFIQDDKQD

SEQ ID NO: 2682272 - protein, 20 aa, Entamoeba histolytica
KEKPKAIDISSFIQDDKQDD

SEQ ID NO: 2682273 - protein, 21 aa, Entamoeba histolytica
KEKRAKGLIEREKGYNKHRQN

SEQ ID NO: 2682274 - protein, 19 aa, Entamoeba histolytica
KEKRIEALKVISNKIQLKR

SEQ ID NO: 2682275 - protein, 21 aa, Entamoeba histolytica
KEKRIRIEAAENYLNYINDCI

SEQ ID NO: 2682276 - protein, 19 aa, Entamoeba histolytica
KEKSIIIQQHFIFVIKELM

SEQ ID NO: 2682277 - protein, 23 aa, Entamoeba histolytica
KEKSSLLGPIGFVSGIVAGVTGV

SEQ ID NO: 2682278 - protein, 21 aa, Entamoeba histolytica
KEKTAKELFSIYFETLESDRE

SEQ ID NO: 2682279 - protein, 20 aa, Entamoeba histolytica
KEKTCPICYEEGVVISLNCG

SEQ ID NO: 2682280 - protein, 21 aa, Entamoeba histolytica
KEKTSKMLLEYGLLDKILDEP

SEQ ID NO: 2682281 - protein, 23 aa, Entamoeba histolytica
KEKVEGISPHFIFNVDEFGFQLK

SEQ ID NO: 2682282 - protein, 25 aa, Entamoeba histolytica
KEKVFPYEVSMYLLKEWQKGRAKTR

SEQ ID NO: 2682283 - protein, 20 aa, Entamoeba histolytica
KEKVPEKKQFVLEKPQVVIK

SEQ ID NO: 2682284 - protein, 26 aa, Entamoeba histolytica
KEKVPIKFDIGAVFDKLLIGVTNTPL

SEQ ID NO: 2682285 - protein, 32 aa, Entamoeba histolytica
KEKYDVIKYTRICQFIDAFIFKYKTFTVAHIA

SEQ ID NO: 2682286 - protein, 21 aa, Entamoeba histolytica
KEKYIDIMVNLLFYVPMTNDY

SEQ ID NO: 2682287 - protein, 17 aa, Entamoeba histolytica
KEKYVDEIIKFMKKPGD

SEQ ID NO: 2682288 - protein, 19 aa, Entamoeba histolytica
KELAKMSSVLKRYQEENTQ

SEQ ID NO: 2682289 - protein, 30 aa, Entamoeba histolytica; identical to SEQ ID NO: 2489422

SEQ ID NO: 2682290 - protein, 17 aa, Entamoeba histolytica
KELARKYIKAFGGEENT

SEQ ID NO: 2682291 - protein, 21 aa, Entamoeba histolytica
KELCEKFFFNYQIPKQTTIYQ

SEQ ID NO: 2682292 - protein, 18 aa, Entamoeba histolytica
KELDSFVKKHYPYVTSYT

SEQ ID NO: 2682293 - protein, 17 aa, Entamoeba histolytica
KELEECKTEITDAKERL

SEQ ID NO: 2682294 - protein, 21 aa, Entamoeba histolytica
KELEELFIFLVQNIEKVLDVV

SEQ ID NO: 2682295 - protein, 21 aa, Entamoeba histolytica
KELEENGCIELEPSDIDGTSS

SEQ ID NO: 2682296 - protein, 25 aa, Entamoeba histolytica
KELELIKANISYLDIIHLYSSCHKT

SEQ ID NO: 2682297 - protein, 23 aa, Entamoeba histolytica
KELELPKVLSCIVFQCRELTKVD

SEQ ID NO: 2682298 - protein, 27 aa, Entamoeba histolytica
KELENCALKFLGEICVKTEDTSIIQTE

SEQ ID NO: 2682299 - protein, 21 aa, Entamoeba histolytica
KELERIKGEIEVLKIKETGDS

SEQ ID NO: 2682300 - protein, 17 aa, Entamoeba histolytica
KELFPKVPSKSINEIIN

SEQ ID NO: 2682301 - protein, 19 aa, Entamoeba histolytica
KELGDFLCCHGGISPDMTN

SEQ ID NO: 2682302 - protein, 23 aa, Entamoeba histolytica
KELGNPCIPYFGSFQNIFEKVLS

SEQ ID NO: 2682303 - protein, 24 aa, Entamoeba histolytica
KELHKEFNVPLNRIVDLDEYDDKK

SEQ ID NO: 2682304 - protein, 18 aa, Entamoeba histolytica
KELHSCCHSIEESKLSVP

SEQ ID NO: 2682305 - protein, 23 aa, Entamoeba histolytica
KELIDPALLRPGRFDCLIEVPKP

SEQ ID NO: 2682306 - protein, 22 aa, Entamoeba histolytica
KELIEIRTLYFTALGMLLYSLP

SEQ ID NO: 2682307 - protein, 18 aa, Entamoeba histolytica
KELIELFDSLFILEQLYF

SEQ ID NO: 2682308 - protein, 29 aa, Entamoeba histolytica
KELILPPLEELRPFPSNRNGVVKVKEVMR

SEQ ID NO: 2682309 - protein, 20 aa, Entamoeba histolytica
KELILTPGLVMFMNGMAHPS

SEQ ID NO: 2682310 - protein, 21 aa, Entamoeba histolytica
KELKASSIGKLICIKGTVIRA

SEQ ID NO: 2682311 - protein, 21 aa, Entamoeba histolytica
KELKIKFIGEVGVDQGGVSKE

SEQ ID NO: 2682312 - protein, 22 aa, Entamoeba histolytica
KELKIKVLIKGNRIGYIHYCDI

SEQ ID NO: 2682313 - protein, 22 aa, Entamoeba histolytica
KELKIRLCGSETNWDLFKMWTG

SEQ ID NO: 2682314 - protein, 25 aa, Entamoeba histolytica
KELKKCWGESVIKELEKTDIIEWLK

SEQ ID NO: 2682315 - protein, 22 aa, Entamoeba histolytica
KELKMRLWKETRSEMRKERKER

SEQ ID NO: 2682316 - protein, 17 aa, Entamoeba histolytica
KELKMSIEELNKNKREL

SEQ ID NO: 2682317 - protein, 18 aa, Entamoeba histolytica
KELKRIPTQLNLKGSSTS

SEQ ID NO: 2682318 - protein, 21 aa, Entamoeba histolytica
KELKTKFGQVVLKCYKHSIFF

SEQ ID NO: 2682319 - protein, 21 aa, Entamoeba histolytica
KELLDQAFIMGFNLNEISSNP

SEQ ID NO: 2682320 - protein, 19 aa, Entamoeba histolytica
KELLGDCLLQSQIQSSMQL

SEQ ID NO: 2682321 - protein, 19 aa, Entamoeba histolytica
KELLKAISNLELRNKNVNL

SEQ ID NO: 2682322 - protein, 25 aa, Entamoeba histolytica
KELNINKGLMCLIDLIQHKENWIPS

SEQ ID NO: 2682323 - protein, 20 aa, Entamoeba histolytica
KELNLSFNLIIEYPNLSQWN

SEQ ID NO: 2682324 - protein, 25 aa, Entamoeba histolytica
KELPFKYGFIEPWYSKNFIFESCSI

SEQ ID NO: 2682325 - protein, 27 aa, Entamoeba histolytica
KELQLPILDCRALRVQGKFNDGNKIIG

SEQ ID NO: 2682326 - protein, 22 aa, Entamoeba histolytica
KELRAPVWYCMATERCSYEEII

SEQ ID NO: 2682327 - protein, 28 aa, Entamoeba histolytica
KELRLSVDCLKKECCILRQKVMELQTNE

SEQ ID NO: 2682328 - protein, 19 aa, Entamoeba histolytica
KELSLKLKDIIRVYEYPNK

SEQ ID NO: 2682329 - protein, 19 aa, Entamoeba histolytica
KELTRLTKLFILRRTSKVN

SEQ ID NO: 2682330 - protein, 21 aa, Entamoeba histolytica
KELVPEFYSNVNFLNNKEHVY

SEQ ID NO: 2682331 - protein, 21 aa, Entamoeba histolytica
KELYHTLKLAYGKEYIKIIPE

SEQ ID NO: 2682332 - protein, 18 aa, Entamoeba histolytica
KEMEEVYILLKENYVEDD

SEQ ID NO: 2682333 - protein, 24 aa, Entamoeba histolytica
KEMEKRFKIKDVIMAKVVHIDKKK

SEQ ID NO: 2682334 - protein, 19 aa, Entamoeba histolytica
KEMEMNLSISKNKLNELLE

SEQ ID NO: 2682335 - protein, 26 aa, Entamoeba histolytica
KEMERCGLCYFEGYVQNDCINYVLTQ

SEQ ID NO: 2682336 - protein, 21 aa, Entamoeba histolytica
KEMIGLYFERSGFKVVDKIES

SEQ ID NO: 2682337 - protein, 18 aa, Entamoeba histolytica
KEMIQDMYAELGVDQPKP

SEQ ID NO: 2682338 - protein, 18 aa, Entamoeba histolytica
KEMKEKLNEFSPGIIVDC

SEQ ID NO: 2682339 - protein, 19 aa, Entamoeba histolytica
KEMKINFSPFTKLDAFDGS

SEQ ID NO: 2682340 - protein, 17 aa, Entamoeba histolytica
KEMKMILSASALHEEEL

SEQ ID NO: 2682341 - protein, 23 aa, Entamoeba histolytica
KEMNELKQRIEIIEEENNVLRKE

SEQ ID NO: 2682342 - protein, 19 aa, Entamoeba histolytica
KEMRMMIVEVIIEGIEWKE

SEQ ID NO: 2682343 - protein, 18 aa, Entamoeba histolytica
KEMSINIGSIEWNIPYEI

SEQ ID NO: 2682344 - protein, 24 aa, Entamoeba histolytica
KEMWEEFKEFLKFKQMLQQEENNK

SEQ ID NO: 2682345 - protein, 22 aa, Entamoeba histolytica
KEMYLKMCETIGYDIVEPQQVY

SEQ ID NO: 2682346 - protein, 23 aa, Entamoeba histolytica
KENCCNKHELNLIFLFVSSHPLI

SEQ ID NO: 2682347 - protein, 25 aa, Entamoeba histolytica
KENDARLGYVSAMAVAPSGEYCIVG

SEQ ID NO: 2682348 - protein, 23 aa, Entamoeba histolytica
KENEPVCAVCFGANKDYPLNLFN

SEQ ID NO: 2682349 - protein, 22 aa, Entamoeba histolytica
KENFPELRLLDVSHNHIKKIKR

SEQ ID NO: 2682350 - protein, 20 aa, Entamoeba histolytica
KENHISIAFVGHRFVHGGSY

SEQ ID NO: 2682351 - protein, 20 aa, Entamoeba histolytica
KENIDALQFLIASIRSKYLK

SEQ ID NO: 2682352 - protein, 21 aa, Entamoeba histolytica
KENIKKGSPFVIYGCVTTLKY

SEQ ID NO: 2682353 - protein, 17 aa, Entamoeba histolytica
KENKYIKFISEIVNNVM

SEQ ID NO: 2682354 - protein, 18 aa, Entamoeba histolytica
KENVCSIDPPGCTDIDDA

SEQ ID NO: 2682355 - protein, 22 aa, Entamoeba histolytica
KENWFQFKMTLRIVDYNLSYCN

SEQ ID NO: 2682356 - protein, 21 aa, Entamoeba histolytica
KEPFEGIYHCSIQNISFNILG

SEQ ID NO: 2682357 - protein, 18 aa, Entamoeba histolytica
KEPFWLNIYHTMLLHGLI

SEQ ID NO: 2682358 - protein, 21 aa, Entamoeba histolytica
KEPGHTCCVLIRAVHSGKFLG

SEQ ID NO: 2682359 - protein, 21 aa, Entamoeba histolytica
KEPILFKEMRAWLNNVPSHYL

SEQ ID NO: 2682360 - protein, 21 aa, Entamoeba histolytica
KEPKVNICIKEKECIAVDLNK

SEQ ID NO: 2682361 - protein, 18 aa, Entamoeba histolytica
KEPLRWSWAENKEKSKEA

SEQ ID NO: 2682362 - protein, 17 aa, Entamoeba histolytica
KEPNAIITKRTHPVGKM

SEQ ID NO: 2682363 - protein, 21 aa, Entamoeba histolytica
KEPPEHIIIVMKYIVKYLQSK

SEQ ID NO: 2682364 - protein, 21 aa, Entamoeba histolytica
KEPPFAYWIYYVYTNVHVLNN

SEQ ID NO: 2682365 - protein, 18 aa, Entamoeba histolytica
KEPPRIRIVKKLAGGVCF

SEQ ID NO: 2682366 - protein, 19 aa, Entamoeba histolytica
KEPSIGIMQPLFRNGNDST

SEQ ID NO: 2682367 - protein, 21 aa, Entamoeba histolytica
KEPWMTNSLPYVMSRGPALQA

SEQ ID NO: 2682368 - protein, 24 aa, Entamoeba histolytica
KEPYFKQTIPFTIEMSAKLNNDIE

SEQ ID NO: 2682369 - protein, 22 aa, Entamoeba histolytica
KEPYQMIDCSLILKTDVYSIIF

SEQ ID NO: 2682370 - protein, 19 aa, Entamoeba histolytica
KEQEQKHRQFVASHQQESE

SEQ ID NO: 2682371 - protein, 19 aa, Entamoeba histolytica
KEQFDCINIQTSLVQSEMK

SEQ ID NO: 2682372 - protein, 29 aa, Entamoeba histolytica
KEQFGGKLKFIFNGGAPLTYGLYEWLRVC

SEQ ID NO: 2682373 - protein, 17 aa, Entamoeba histolytica
KEQIIWVALEQVYPLSR

SEQ ID NO: 2682374 - protein, 23 aa, Entamoeba histolytica
KEQIKVDPFTSLKKLTKSKYYQE

SEQ ID NO: 2682375 - protein, 22 aa, Entamoeba histolytica
KEQKKIYHWYVKRYSEKEPMVL

SEQ ID NO: 2682376 - protein, 27 aa, Entamoeba histolytica
KEQKKWFPEKTCPFILSYLFTEQNNFV

SEQ ID NO: 2682377 - protein, 20 aa, Entamoeba histolytica
KEQMIRIILQHLHVKGYNES

SEQ ID NO: 2682378 - protein, 43 aa, Entamoeba histolytica
KEQMKCIISEILHEIPLNCKSGSYVLSCIELLIELFKSINELN

SEQ ID NO: 2682379 - protein, 37 aa, Entamoeba histolytica; identical to SEQ ID NO: 2489536

SEQ ID NO: 2682380 - protein, 28 aa, Entamoeba histolytica
KEQYPSYQIPESYVLPAHSTEFKPKTFV

SEQ ID NO: 2682381 - protein, 22 aa, Entamoeba histolytica
KERCVPTSIIGKMFLIEYSPIL

SEQ ID NO: 2682382 - protein, 17 aa, Entamoeba histolytica
KERERYKELSFQYKKKI

SEQ ID NO: 2682383 - protein, 18 aa, Entamoeba histolytica
KEREYWVEYIIRELNNTQ

SEQ ID NO: 2682384 - protein, 18 aa, Entamoeba histolytica
KERFEAMKGLSKKSRQKR

SEQ ID NO: 2682385 - protein, 23 aa, Entamoeba histolytica
KERFSANLKFIVKVISDVFTIKD

SEQ ID NO: 2682386 - protein, 24 aa, Entamoeba histolytica
KERFWSNVYGFDFSCVLSDVTVDP

SEQ ID NO: 2682387 - protein, 17 aa, Entamoeba histolytica
KERGCSYLSSLTTSKEE

SEQ ID NO: 2682388 - protein, 26 aa, Entamoeba histolytica
KERINSCIPLEGIFRGIKEYHNYSVI

SEQ ID NO: 2682389 - protein, 18 aa, Entamoeba histolytica
KERIRIDEIVRIIIKENH

SEQ ID NO: 2682390 - protein, 26 aa, Entamoeba histolytica
KERKRSGIVIKVCLRDSDSNIGDESL

SEQ ID NO: 2682391 - protein, 25 aa, Entamoeba histolytica
KERLRRFNHMSSWGVLLMTIRVGAC

SEQ ID NO: 2682392 - protein, 20 aa, Entamoeba histolytica
KERMQWDDFFIHPFIQRCRD

SEQ ID NO: 2682393 - protein, 24 aa, Entamoeba histolytica
KERRLSYNSDILWVINTIEKQLIA

SEQ ID NO: 2682394 - protein, 23 aa, Entamoeba histolytica
KERRRECVDGKTLSLYDLIIQEL

SEQ ID NO: 2682395 - protein, 20 aa, Entamoeba histolytica
KERSFIIVGIILKLDKELKQ

SEQ ID NO: 2682396 - protein, 25 aa, Entamoeba histolytica
KERTILKKICDPYAININELKNNIA

SEQ ID NO: 2682397 - protein, 19 aa, Entamoeba histolytica
KERVFSIGLCNDNGTEEAK

SEQ ID NO: 2682398 - protein, 21 aa, Entamoeba histolytica
KESDECLSHLYSLDNAVKQEV

SEQ ID NO: 2682399 - protein, 17 aa, Entamoeba histolytica
KESFLLFDGDGDGYLTL

SEQ ID NO: 2682400 - protein, 30 aa, Entamoeba histolytica
KESKYQCPKCNILYCSIECYKAHKMNCKKK

SEQ ID NO: 2682401 - protein, 24 aa, Entamoeba histolytica
KESLCAGFPHFNTGYMRNWGRDTF

SEQ ID NO: 2682402 - protein, 17 aa, Entamoeba histolytica
KESLFKQQIEEQNMNLT

SEQ ID NO: 2682403 - protein, 18 aa, Entamoeba histolytica
KESLIELSGGQKSLLALS

SEQ ID NO: 2682404 - protein, 23 aa, Entamoeba histolytica
KESLNALCKIVGLFNQTKKETEE

SEQ ID NO: 2682405 - protein, 21 aa, Entamoeba histolytica
KESLVKKCFPSNFKYDESKDT

SEQ ID NO: 2682406 - protein, 22 aa, Entamoeba histolytica
KESMEAYSYYLLQGFVGLLPDW

SEQ ID NO: 2682407 - protein, 17 aa, Entamoeba histolytica
KESMLFNIDSYKIIGIG

SEQ ID NO: 2682408 - protein, 22 aa, Entamoeba histolytica
KESNQWLDPLRVFYEQINSEDQ

SEQ ID NO: 2682409 - protein, 21 aa, Entamoeba histolytica
KESRHGVAQVLSRLTFTSALA

SEQ ID NO: 2682410 - protein, 20 aa, Entamoeba histolytica
KESSSEEVIIMKKGKKDEVI

SEQ ID NO: 2682411 - protein, 19 aa, Entamoeba histolytica
KESTRLSAISLLINLGNND

SEQ ID NO: 2682412 - protein, 20 aa, Entamoeba histolytica
KESYIGTEYLQMLKKAMPII

SEQ ID NO: 2682413 - protein, 22 aa, Entamoeba histolytica
KETCTMCGKQIDISKDIIIDKK

SEQ ID NO: 2682414 - protein, 23 aa, Entamoeba histolytica
KETDKRLIIYSANEYIYIANEEL

SEQ ID NO: 2682415 - protein, 19 aa, Entamoeba histolytica
KETELMGKLLKPISLLISG

SEQ ID NO: 2682416 - protein, 18 aa, Entamoeba histolytica
KETFEQLEYWLNDVKGNC

SEQ ID NO: 2682417 - protein, 18 aa, Entamoeba histolytica
KETFKVAIDVVRGRAEEK

SEQ ID NO: 2682418 - protein, 17 aa, Entamoeba histolytica
KETGYAIKMYPIGNSSW

SEQ ID NO: 2682419 - protein, 21 aa, Entamoeba histolytica
KETHATLPLFSVKERDQKGFR

SEQ ID NO: 2682420 - protein, 28 aa, Entamoeba histolytica
KETHKKRLSFLGRKSFSKRNSTENTGHS

SEQ ID NO: 2682421 - protein, 20 aa, Entamoeba histolytica
KETIDISAILVDWDQDYVRC

SEQ ID NO: 2682422 - protein, 18 aa, Entamoeba histolytica
KETIGDKSQDEFIRPVFV

SEQ ID NO: 2682423 - protein, 24 aa, Entamoeba histolytica
KETISITSFRAYFVLSLHYGIRCL

SEQ ID NO: 2682424 - protein, 25 aa, Entamoeba histolytica
KETKGFISSVLIQFAKTPKLSFIDG

SEQ ID NO: 2682425 - protein, 17 aa, Entamoeba histolytica
KETKGKIGYELIKKLPY

SEQ ID NO: 2682426 - protein, 20 aa, Entamoeba histolytica
KETKIEFEVYAVFVKPVPYS

SEQ ID NO: 2682427 - protein, 18 aa, Entamoeba histolytica
KETKKLAKKELKDEKKMT

SEQ ID NO: 2682428 - protein, 20 aa, Entamoeba histolytica
KETKNCLYKEVLEKRLQDFI

SEQ ID NO: 2682429 - protein, 21 aa, Entamoeba histolytica
KETKRSFFFWNQENDINSFYK

SEQ ID NO: 2682430 - protein, 24 aa, Entamoeba histolytica
KETLKGFITWCYTNKIEMEMKECL

SEQ ID NO: 2682431 - protein, 18 aa, Entamoeba histolytica
KETLKRKEYIQLIRANEI

SEQ ID NO: 2682432 - protein, 17 aa, Entamoeba histolytica
KETMKLKLKQHFHNILL

SEQ ID NO: 2682433 - protein, 22 aa, Entamoeba histolytica
KETNGKCQFIIGGMAPMDDPYA

SEQ ID NO: 2682434 - protein, 23 aa, Entamoeba histolytica
KETSKLISLRSYLFSIPMFHYLQ

SEQ ID NO: 2682435 - protein, 22 aa, Entamoeba histolytica
KETSNCFIQFKCMKYINLALFT

SEQ ID NO: 2682436 - protein, 26 aa, Entamoeba histolytica
KETTEFRLGAVFSFLNMLQPYFTHLY

SEQ ID NO: 2682437 - protein, 24 aa, Entamoeba histolytica
KETTLQYFAYRPLFEQGKLIVNGE

SEQ ID NO: 2682438 - protein, 19 aa, Entamoeba histolytica
KETVECPFCRTQLTKKDVH

SEQ ID NO: 2682439 - protein, 25 aa, Entamoeba histolytica
KETYDNCPILLKRVNEFITNSLTTL

SEQ ID NO: 2682440 - protein, 18 aa, Entamoeba histolytica
KETYRSTLYGTIEVGNYP

SEQ ID NO: 2682441 - protein, 26 aa, Entamoeba histolytica
KEVAGLMKSNLGVRLPHNSFSLNVIR

SEQ ID NO: 2682442 - protein, 26 aa, Entamoeba histolytica
KEVDSLGNYCFKEFSSLTTINIPTSV

SEQ ID NO: 2682443 - protein, 23 aa, Entamoeba histolytica
KEVEIKRLLPFLEDKFIEKGIDN

SEQ ID NO: 2682444 - protein, 18 aa, Entamoeba histolytica
KEVFNILCDLAMEKQSSY

SEQ ID NO: 2682445 - protein, 17 aa, Entamoeba histolytica
KEVFYSSFLSLFFNDSL

SEQ ID NO: 2682446 - protein, 20 aa, Entamoeba histolytica
KEVILRWRRGKKESNKGKFN

SEQ ID NO: 2682447 - protein, 20 aa, Entamoeba histolytica
KEVIPQIPTRITIDKPNVEE

SEQ ID NO: 2682448 - protein, 20 aa, Entamoeba histolytica
KEVIRLITLNVTQRIGEIGN

SEQ ID NO: 2682449 - protein, 23 aa, Entamoeba histolytica
KEVISDIIIKVVMLYDENLDNIL

SEQ ID NO: 2682450 - protein, 21 aa, Entamoeba histolytica
KEVKLFCKTDLLGGGMNELVH

SEQ ID NO: 2682451 - protein, 23 aa, Entamoeba histolytica
KEVKLSQITVCPKADGLYPVVSA

SEQ ID NO: 2682452 - protein, 21 aa, Entamoeba histolytica
KEVLDGFQLEIRVGKIVEAGP

SEQ ID NO: 2682453 - protein, 19 aa, Entamoeba histolytica
KEVLERKGINNLKIEFDTS

SEQ ID NO: 2682454 - protein, 18 aa, Entamoeba histolytica
KEVLKIIFFDDDCYRNEI

SEQ ID NO: 2682455 - protein, 23 aa, Entamoeba histolytica
KEVLLCSLLDLYQYILRTIKTSQ

SEQ ID NO: 2682456 - protein, 18 aa, Entamoeba histolytica
KEVLLKKMVGTVSIKKME

SEQ ID NO: 2682457 - protein, 17 aa, Entamoeba histolytica
KEVLPSLPTRQEKFVYC

SEQ ID NO: 2682458 - protein, 28 aa, Entamoeba histolytica
KEVLQIPYIQSKFMICCDKWFNGIDDSI

SEQ ID NO: 2682459 - protein, 21 aa, Entamoeba histolytica
KEVNGRMIVGSFSREDLETIK

SEQ ID NO: 2682460 - protein, 20 aa, Entamoeba histolytica
KEVQTMFDLRGMKTEPFKKL

SEQ ID NO: 2682461 - protein, 22 aa, Entamoeba histolytica
KEVSKLKWELSELKTENESMKQ

SEQ ID NO: 2682462 - protein, 21 aa, Entamoeba histolytica
KEVTDYCNINHFFTCEHKDTE

SEQ ID NO: 2682463 - protein, 18 aa, Entamoeba histolytica
KEVTEVLASFNNSHEAIT

SEQ ID NO: 2682464 - protein, 25 aa, Entamoeba histolytica
KEVYCTDGYKGGWCTGTYQTNTINS

SEQ ID NO: 2682465 - protein, 23 aa, Entamoeba histolytica
KEVYSLQVGDFVLGRDFSQNCFK

SEQ ID NO: 2682466 - protein, 17 aa, Entamoeba histolytica
KEWDFSFIPTIELTLRL

SEQ ID NO: 2682467 - protein, 17 aa, Entamoeba histolytica
KEWKCVHLDSFNQINVK

SEQ ID NO: 2682468 - protein, 23 aa, Entamoeba histolytica
KEWKEEGMVFGGYEKGEKERVKK

SEQ ID NO: 2682469 - protein, 26 aa, Entamoeba histolytica
KEWMKGKREFIEYGYCMILETLIEQR

SEQ ID NO: 2682470 - protein, 18 aa, Entamoeba histolytica
KEWNDKIEMVIGDISKED

SEQ ID NO: 2682471 - protein, 22 aa, Entamoeba histolytica
KEWNGKRVVIEFSEAQTSKRNR

SEQ ID NO: 2682472 - protein, 21 aa, Entamoeba histolytica
KEYAKMVALFNLVFNAFNIEG

SEQ ID NO: 2682473 - protein, 19 aa, Entamoeba histolytica
KEYDKMVCQSCGPTSIVKK

SEQ ID NO: 2682474 - protein, 31 aa, Entamoeba histolytica
KEYDSVLNLMKFNGGYSWWRRNSLTVFIDDK

SEQ ID NO: 2682475 - protein, 18 aa, Entamoeba histolytica
KEYFEKASKFEINNQRNK

SEQ ID NO: 2682476 - protein, 21 aa, Entamoeba histolytica
KEYFKGNIIFGECVTNSFKSC

SEQ ID NO: 2682477 - protein, 20 aa, Entamoeba histolytica
KEYFVFTGTTVVKVERVIAL

SEQ ID NO: 2682478 - protein, 19 aa, Entamoeba histolytica
KEYGLIPLVELVFGGRTRR

SEQ ID NO: 2682479 - protein, 21 aa, Entamoeba histolytica
KEYIKEISLEFVHTMKNVFYI

SEQ ID NO: 2682480 - protein, 18 aa, Entamoeba histolytica
KEYIKFEIFDNGELKYCN

SEQ ID NO: 2682481 - protein, 22 aa, Entamoeba histolytica
KEYKEAIELYQECAAELHNLID

SEQ ID NO: 2682482 - protein, 22 aa, Entamoeba histolytica
KEYKRLEWKASRKERKREWKKR

SEQ ID NO: 2682483 - protein, 25 aa, Entamoeba histolytica
KEYLIKCSFPTLSLILNVISIEKCI

SEQ ID NO: 2682484 - protein, 26 aa, Entamoeba histolytica
KEYLKMVIVHFIKRPILFNYFTPSQM

SEQ ID NO: 2682485 - protein, 24 aa, Entamoeba histolytica
KEYLLEVIQSITLPVLTESDEVVE

SEQ ID NO: 2682486 - protein, 29 aa, Entamoeba histolytica
KEYPLTMLLKKIEDISGYTIKYDSFNDAY

SEQ ID NO: 2682487 - protein, 26 aa, Entamoeba histolytica
KEYPRFLIPKYFTAFIKKVYNFIVQR

SEQ ID NO: 2682488 - protein, 17 aa, Entamoeba histolytica
KEYQFYSAHEIDTKNHL

SEQ ID NO: 2682489 - protein, 20 aa, Entamoeba histolytica
KEYTAPELIKMCINHIKDIE

SEQ ID NO: 2682490 - protein, 24 aa, Entamoeba histolytica
KEYTKRYDCCLNVINQAKGLLDRL

SEQ ID NO: 2682491 - protein, 19 aa, Entamoeba histolytica
KEYYLHLFLEEQPDLNWEN

SEQ ID NO: 2682492 - protein, 18 aa, Entamoeba histolytica
KFAECKNLKSIIGSNQLK

SEQ ID NO: 2682493 - protein, 18 aa, Entamoeba histolytica
KFAQIAVDAIEKIGDADI

SEQ ID NO: 2682494 - protein, 25 aa, Entamoeba histolytica
KFAQVECIRMNYGRNKEGQFYLGNA

SEQ ID NO: 2682495 - protein, 18 aa, Entamoeba histolytica
KFASVCVNPTWVPLCAEL

SEQ ID NO: 2682496 - protein, 26 aa, Entamoeba histolytica
KFCKHSLKIIPKVMIDPNIIKRKEMI

SEQ ID NO: 2682497 - protein, 22 aa, Entamoeba histolytica
KFCNKHLMQLIGTMIKFGNDIS

SEQ ID NO: 2682498 - protein, 19 aa, Entamoeba histolytica
KFCRLSGGLRSMRCSAKTG

SEQ ID NO: 2682499 - protein, 29 aa, Entamoeba histolytica
KFCYSISRRFILMFTELIKLTSRIIPSNC

SEQ ID NO: 2682500 - protein, 24 aa, Entamoeba histolytica
KFDDDRLIPVFGFGDSKTGDRSVF

SEQ ID NO: 2682501 - protein, 19 aa, Entamoeba histolytica
KFDIRPRNDIDEIKESFTA

SEQ ID NO: 2682502 - protein, 24 aa, Entamoeba histolytica
KFDQRLITIFSFNLFAGMVGGSKQ

SEQ ID NO: 2682503 - protein, 18 aa, Entamoeba histolytica
KFDSPAFVCSKIRSLLYS

SEQ ID NO: 2682504 - protein, 21 aa, Entamoeba histolytica
KFDTLCEIYDSMTITQSVIFC

SEQ ID NO: 2682505 - protein, 19 aa, Entamoeba histolytica
KFEGIKFPTPNGIGDVAKV

SEQ ID NO: 2682506 - protein, 18 aa, Entamoeba histolytica
KFESRLIQFSTFKSLHSL

SEQ ID NO: 2682507 - protein, 27 aa, Entamoeba histolytica
KFETLLFRCNEILKFEDIHSIEYVYSN

SEQ ID NO: 2682508 - protein, 17 aa, Entamoeba histolytica
KFETSKYYFTIIDAPGH

SEQ ID NO: 2682509 - protein, 18 aa, Entamoeba histolytica
KFEYNICQAIDYLKDYGN

SEQ ID NO: 2682510 - protein, 20 aa, Entamoeba histolytica
KFFDENWYSLYFINSMKEVM

SEQ ID NO: 2682511 - protein, 27 aa, Entamoeba histolytica
KFFKHSNICSFVRQLNIYGFRKLETQT

SEQ ID NO: 2682512 - protein, 22 aa, Entamoeba histolytica
KFFKLEMNGWVFKSRDEYEMEN

SEQ ID NO: 2682513 - protein, 24 aa, Entamoeba histolytica
KFFSEGKVIPWTCEEDQILVSNDT

SEQ ID NO: 2682514 - protein, 19 aa, Entamoeba histolytica
KFFVETFVREVKWKTFDLK

SEQ ID NO: 2682515 - protein, 20 aa, Entamoeba histolytica
KFGAEPKVVPGVPNLSVMEI

SEQ ID NO: 2682516 - protein, 26 aa, Entamoeba histolytica
KFGDSCFYQCHYRLFKDYILPERCFI

SEQ ID NO: 2682517 - protein, 27 aa, Entamoeba histolytica
KFGEMELRAFLVFDVYKEVKKEEKVIE

SEQ ID NO: 2682518 - protein, 20 aa, Entamoeba histolytica
KFGIDLKEAIAYTKIENNIL

SEQ ID NO: 2682519 - protein, 24 aa, Entamoeba histolytica
KFGPDIKWKFDSMLETITLAGDIV

SEQ ID NO: 2682520 - protein, 25 aa, Entamoeba histolytica
KFHAKWNPTCQCVFQTLADIRINDE

SEQ ID NO: 2682521 - protein, 17 aa, Entamoeba histolytica
KFHLTVLDHPDFFIDPE

SEQ ID NO: 2682522 - protein, 26 aa, Entamoeba histolytica
KFICKDIYKHWGLIWYTYHRTLKIKM

SEQ ID NO: 2682523 - protein, 25 aa, Entamoeba histolytica
KFIDFASEIDLNFMIDEIYTRAVEY

SEQ ID NO: 2682524 - protein, 20 aa, Entamoeba histolytica
KFIDFCIISDSQIGVIFDKS

SEQ ID NO: 2682525 - protein, 18 aa, Entamoeba histolytica
KFIGDCGVAVGMHSFGAS

SEQ ID NO: 2682526 - protein, 19 aa, Entamoeba histolytica
KFIHLMEVILLMGNFLNSG

SEQ ID NO: 2682527 - protein, 19 aa, Entamoeba histolytica
KFIKGSKFIAAQIVNGIGL

SEQ ID NO: 2682528 - protein, 17 aa, Entamoeba histolytica
KFIKIFIDLIKTPETFD

SEQ ID NO: 2682529 - protein, 25 aa, Entamoeba histolytica
KFIKKDCYKTMMFWNQPNELDAVIS

SEQ ID NO: 2682530 - protein, 20 aa, Entamoeba histolytica
KFILRLLEKNGFLIQITKDI

SEQ ID NO: 2682531 - protein, 29 aa, Entamoeba histolytica
KFINCSKGLQLKFFFSIMEAELCENRDIF

SEQ ID NO: 2682532 - protein, 19 aa, Entamoeba histolytica
KFIRGGRKFLIQLICSVID

SEQ ID NO: 2682533 - protein, 19 aa, Entamoeba histolytica
KFIRGVEIIMFYSQPPPIY

SEQ ID NO: 2682534 - protein, 23 aa, Entamoeba histolytica
KFIRKLRQWKLYGRLILSNKRLQ

SEQ ID NO: 2682535 - protein, 18 aa, Entamoeba histolytica
KFITQKWFSALQDIEHSF

SEQ ID NO: 2682536 - protein, 23 aa, Entamoeba histolytica
KFKCLKQLHFVNCIFNEEITLPK

SEQ ID NO: 2682537 - protein, 22 aa, Entamoeba histolytica
KFKEITEAYAILSDHNKREIYD

SEQ ID NO: 2682538 - protein, 22 aa, Entamoeba histolytica
KFKPESVPLCVSLIQFEKEFIA

SEQ ID NO: 2682539 - protein, 20 aa, Entamoeba histolytica
KFKTIVPFLKAYKQFVSYNE

SEQ ID NO: 2682540 - protein, 20 aa, Entamoeba histolytica
KFKYESRHLHAMNRQRGEGG

SEQ ID NO: 2682541 - protein, 20 aa, Entamoeba histolytica
KFLCEGCEWKTEIVKKKYHA

SEQ ID NO: 2682542 - protein, 24 aa, Entamoeba histolytica
KFLEKMGFSMVGEYDHMELYKKVL

SEQ ID NO: 2682543 - protein, 17 aa, Entamoeba histolytica
KFLEPLPKLSRPTLKRT

SEQ ID NO: 2682544 - protein, 26 aa, Entamoeba histolytica
KFLFTRRSHLNWARFDKTEVDVYKRQ

SEQ ID NO: 2682545 - protein, 24 aa, Entamoeba histolytica
KFLFTRRSHLNWSKFDKNESSLIK

SEQ ID NO: 2682546 - protein, 19 aa, Entamoeba histolytica
KFLKEYFEKNGVNYYDAAR

SEQ ID NO: 2682547 - protein, 24 aa, Entamoeba histolytica
KFLPEVAEPIASLIEGMLIYDENK

SEQ ID NO: 2682548 - protein, 19 aa, Entamoeba histolytica
KFLPPFPRHLIQPHIKTYV

SEQ ID NO: 2682549 - protein, 17 aa, Entamoeba histolytica
KFLREMKEKVFPYEVSM

SEQ ID NO: 2682550 - protein, 18 aa, Entamoeba histolytica
KFLSERKQMINSFIKEVS

SEQ ID NO: 2682551 - protein, 28 aa, Entamoeba histolytica
KFLSYTINEFIAWMYQRINIYWDDLEVN

SEQ ID NO: 2682552 - protein, 18 aa, Entamoeba histolytica
KFLYELPTPLIPQTNIKY

SEQ ID NO: 2682553 - protein, 30 aa, Entamoeba histolytica
KFMDSRGYAAIPMMYIRNTIIRLMSIDVKQ

SEQ ID NO: 2682554 - protein, 21 aa, Entamoeba histolytica
KFMIDEVVCKFDAILEKMRSK

SEQ ID NO: 2682555 - protein, 32 aa, Entamoeba histolytica; identical to SEQ ID NO: 2553886

SEQ ID NO: 2682556 - protein, 31 aa, Entamoeba histolytica
KFNDIQCRSMLLSIFSKFTFPEANQIIPKIL

SEQ ID NO: 2682557 - protein, 25 aa, Entamoeba histolytica
KFNDKKWLCLMKEEEQIELLATIVV

SEQ ID NO: 2682558 - protein, 27 aa, Entamoeba histolytica
KFNKSLKTFQCMRCMKLTKIELPITVE

SEQ ID NO: 2682559 - protein, 30 aa, Entamoeba histolytica; identical to SEQ ID NO: 2489730

SEQ ID NO: 2682560 - protein, 30 aa, Entamoeba histolytica
KFNLKDVRLRPRYLMKFLDTDGDWVTLTDD

SEQ ID NO: 2682561 - protein, 18 aa, Entamoeba histolytica
KFNMSFKPKMTKLSVMQA

SEQ ID NO: 2682562 - protein, 17 aa, Entamoeba histolytica
KFNVGKQNVTWCGGKYH

SEQ ID NO: 2682563 - protein, 21 aa, Entamoeba histolytica
KFNYGNILGIFFQKSLSEFDV

SEQ ID NO: 2682564 - protein, 25 aa, Entamoeba histolytica
KFPEKIPFRLTRMIVNAMDVSGVEG

SEQ ID NO: 2682565 - protein, 25 aa, Entamoeba histolytica
KFPEKIPFRLTRMIVNAMEVSGIEG

SEQ ID NO: 2682566 - protein, 26 aa, Entamoeba histolytica
KFPERVIHHVCQWLGNRKPSIIKGKE

SEQ ID NO: 2682567 - protein, 18 aa, Entamoeba histolytica
KFPNLRKCHVDLNNEPLK

SEQ ID NO: 2682568 - protein, 27 aa, Entamoeba histolytica
KFPQSDLCYCIKFFNKLEETIIRIRHY

SEQ ID NO: 2682569 - protein, 20 aa, Entamoeba histolytica
KFQHCDRFIQPISFEEVKKM

SEQ ID NO: 2682570 - protein, 18 aa, Entamoeba histolytica
KFQSIKRFIEQLPEDPLV

SEQ ID NO: 2682571 - protein, 19 aa, Entamoeba histolytica
KFQWNSRINKEIQIINERI

SEQ ID NO: 2682572 - protein, 20 aa, Entamoeba histolytica
KFRFVLEMFNSNPISLFEAK

SEQ ID NO: 2682573 - protein, 19 aa, Entamoeba histolytica
KFRPFLDACFGLEIVGKSI

SEQ ID NO: 2682574 - protein, 24 aa, Entamoeba histolytica
KFSDGECYYRIAIPERTSLVGRDV

SEQ ID NO: 2682575 - protein, 18 aa, Entamoeba histolytica
KFSEISFEQKVYYDKATI

SEQ ID NO: 2682576 - protein, 23 aa, Entamoeba histolytica
KFSGEFPFNKSIEHNIKLRKAFD

SEQ ID NO: 2682577 - protein, 21 aa, Entamoeba histolytica
KFSGVVVCPICNNICTCATCK

SEQ ID NO: 2682578 - protein, 19 aa, Entamoeba histolytica
KFSLPNGITLPSLQQNTYS

SEQ ID NO: 2682579 - protein, 27 aa, Entamoeba histolytica
KFSLPRMTVGAFGTCLNTIWKSITNQD

SEQ ID NO: 2682580 - protein, 20 aa, Entamoeba histolytica
KFSPDYPLFALGFEKKVEIW

SEQ ID NO: 2682581 - protein, 18 aa, Entamoeba histolytica
KFSPEKIDTMIIQAVSLL

SEQ ID NO: 2682582 - protein, 18 aa, Entamoeba histolytica
KFSPPTIFNKERLSQKYP

SEQ ID NO: 2682583 - protein, 18 aa, Entamoeba histolytica
KFTAEALWSMGRINGYDL

SEQ ID NO: 2682584 - protein, 24 aa, Entamoeba histolytica
KFTAIKKVRMVSDFMPEEEELLRL

SEQ ID NO: 2682585 - protein, 18 aa, Entamoeba histolytica
KFTKDVLLFFKKQATMKA

SEQ ID NO: 2682586 - protein, 18 aa, Entamoeba histolytica
KFTKWRNYQALQEAFFIG

SEQ ID NO: 2682587 - protein, 25 aa, Entamoeba histolytica
KFTRKADGYSLWVFGSIDNLLSVNG

SEQ ID NO: 2682588 - protein, 18 aa, Entamoeba histolytica
KFTTIFLGETNDELRKFL

SEQ ID NO: 2682589 - protein, 22 aa, Entamoeba histolytica
KFVERIYKWKVLSHFERKDVIE

SEQ ID NO: 2682590 - protein, 19 aa, Entamoeba histolytica
KFVLYEESKELPVTTDINN

SEQ ID NO: 2682591 - protein, 19 aa, Entamoeba histolytica
KFVWLFPVHIGEALRYSPE

SEQ ID NO: 2682592 - protein, 23 aa, Entamoeba histolytica
KFYGECPFFPIPIPERIQQVVIT

SEQ ID NO: 2682593 - protein, 22 aa, Entamoeba histolytica
KGAGSCCLVLQSLLPILISIEG

SEQ ID NO: 2682594 - protein, 21 aa, Entamoeba histolytica
KGAVKLIFLNKMDLFEEKLTK

SEQ ID NO: 2682595 - protein, 21 aa, Entamoeba histolytica
KGCDLTLIIKHGEYDFVIEGY

SEQ ID NO: 2682596 - protein, 19 aa, Entamoeba histolytica
KGCFSGCSSLSQITIPSNI

SEQ ID NO: 2682597 - protein, 18 aa, Entamoeba histolytica
KGCFYHCGCQEGLKKNET

SEQ ID NO: 2682598 - protein, 19 aa, Entamoeba histolytica
KGCFYHCRCEEELKKNKTI

SEQ ID NO: 2682599 - protein, 19 aa, Entamoeba histolytica
KGCFYRCGCEEELKKNKQI

SEQ ID NO: 2682600 - protein, 21 aa, Entamoeba histolytica
KGCWIKLNVHKDGKYDFFTNC

SEQ ID NO: 2682601 - protein, 22 aa, Entamoeba histolytica
KGDAELFTTCLVKAIRTTRAFE

SEQ ID NO: 2682602 - protein, 21 aa, Entamoeba histolytica
KGDIFGCYIKQKIIKGNDIYD

SEQ ID NO: 2682603 - protein, 19 aa, Entamoeba histolytica
KGDITKLKIDSIVNAANNT

SEQ ID NO: 2682604 - protein, 21 aa, Entamoeba histolytica
KGDRVDLVIKMNHEGILNITI

SEQ ID NO: 2682605 - protein, 23 aa, Entamoeba histolytica
KGDVESLISYSKRNELIRDNRSS

SEQ ID NO: 2682606 - protein, 24 aa, Entamoeba histolytica
KGEARICKVYDSPCLPESEASFAI

SEQ ID NO: 2682607 - protein, 22 aa, Entamoeba histolytica
KGEECQTCRGTRTECPGHFGYI

SEQ ID NO: 2682608 - protein, 25 aa, Entamoeba histolytica
KGEEILEKLLSIYFIIRNNSSIYRQ

SEQ ID NO: 2682609 - protein, 22 aa, Entamoeba histolytica
KGEFTFWNGLQFNFACLSGAHD

SEQ ID NO: 2682610 - protein, 17 aa, Entamoeba histolytica
KGEGIDSYFKLKANFLA

SEQ ID NO: 2682611 - protein, 28 aa, Entamoeba histolytica
KGEGMKKNFLFNGDCLISIHVDMHSISP

SEQ ID NO: 2682612 - protein, 24 aa, Entamoeba histolytica
KGEHKTEPLLFVLSSPKDQQHKTK

SEQ ID NO: 2682613 - protein, 21 aa, Entamoeba histolytica
KGEIEWSLAYLNNRSKESYSR

SEQ ID NO: 2682614 - protein, 22 aa, Entamoeba histolytica
KGEIKHKIAFWKLPVVACEYVN

SEQ ID NO: 2682615 - protein, 26 aa, Entamoeba histolytica
KGEKRCCKRIKLLHAQYYIDIQNNEQ

SEQ ID NO: 2682616 - protein, 27 aa, Entamoeba histolytica
KGELIQRPWFFQSLESLRFKEEIERGV

SEQ ID NO: 2682617 - protein, 22 aa, Entamoeba histolytica
KGELPEIPKIFFTATTFKELVD

SEQ ID NO: 2682618 - protein, 20 aa, Entamoeba histolytica
KGELTFDQFQLFMIVYERSL

SEQ ID NO: 2682619 - protein, 28 aa, Entamoeba histolytica
KGERGKAIGYCFLTFTSAEDAYQFVEKV

SEQ ID NO: 2682620 - protein, 22 aa, Entamoeba histolytica
KGEYKWAVELLNHLVFTNPNNE

SEQ ID NO: 2682621 - protein, 18 aa, Entamoeba histolytica
KGEYYFKSLQEILKEESF

SEQ ID NO: 2682622 - protein, 23 aa, Entamoeba histolytica
KGFIRVVELYNRICYEEPNQDTP

SEQ ID NO: 2682623 - protein, 19 aa, Entamoeba histolytica
KGFKGYKILNLNKLFVEEI

SEQ ID NO: 2682624 - protein, 19 aa, Entamoeba histolytica
KGFMKYCGQIEKIQLPQSI

SEQ ID NO: 2682625 - protein, 29 aa, Entamoeba histolytica
KGFMPIIYDIFKYLPIKRQIVLCSATLTP

SEQ ID NO: 2682626 - protein, 20 aa, Entamoeba histolytica
KGFMTTLIVDCYKCYRNRTQ

SEQ ID NO: 2682627 - protein, 24 aa, Entamoeba histolytica
KGFSYCYECNVIYCENHIEQHIKA

SEQ ID NO: 2682628 - protein, 24 aa, Entamoeba histolytica
KGGCGCGFCYACGKEVSHHSAHIL

SEQ ID NO: 2682629 - protein, 23 aa, Entamoeba histolytica
KGGDDGVRWISKRCEVIESILET

SEQ ID NO: 2682630 - protein, 17 aa, Entamoeba histolytica
KGGESLVSHSFVLPETK

SEQ ID NO: 2682631 - protein, 24 aa, Entamoeba histolytica
KGGIFNIWFNTWFIHDNRLEFSKM

SEQ ID NO: 2682632 - protein, 34 aa, Entamoeba histolytica
KGGIYCKNCGRVFICDKCREDIDFISSLTSTELC

SEQ ID NO: 2682633 - protein, 22 aa, Entamoeba histolytica
KGGKNLWCKKELSKIYIEENMY

SEQ ID NO: 2682634 - protein, 23 aa, Entamoeba histolytica
KGGSSKISMFWKLKEENNVIQQP

SEQ ID NO: 2682635 - protein, 27 aa, Entamoeba histolytica
KGGVLSYKYSSKFIKILATKIFQDKKL

SEQ ID NO: 2682636 - protein, 25 aa, Entamoeba histolytica
KGGWYVPLPLYRLIPYLEESNYYIT

SEQ ID NO: 2682637 - protein, 19 aa, Entamoeba histolytica
KGHKGFRAGLDVNSDTTGI

SEQ ID NO: 2682638 - protein, 19 aa, Entamoeba histolytica
KGIDFTTAYRSWGSCDPEE

SEQ ID NO: 2682639 - protein, 21 aa, Entamoeba histolytica
KGIDSFFFRSGIEPKTTENGG

SEQ ID NO: 2682640 - protein, 17 aa, Entamoeba histolytica
KGIKLICRISSQKVTSK

SEQ ID NO: 2682641 - protein, 20 aa, Entamoeba histolytica
KGILDERAMGIVIGNIKKWK

SEQ ID NO: 2682642 - protein, 31 aa, Entamoeba histolytica
KGILERLKHPFIVHLEWDFETPFYYIFVMTY

SEQ ID NO: 2682643 - protein, 20 aa, Entamoeba histolytica
KGINEFILFSDMIAIYQKQF

SEQ ID NO: 2682644 - protein, 22 aa, Entamoeba histolytica
KGIPIQTIISIFALSLNRSILV

SEQ ID NO: 2682645 - protein, 26 aa, Entamoeba histolytica
KGIQELFEWQVECLKTKGVREGTENL

SEQ ID NO: 2682646 - protein, 20 aa, Entamoeba histolytica
KGIRIMAIKALTDISDLKLE

SEQ ID NO: 2682647 - protein, 17 aa, Entamoeba histolytica
KGISELISEGSTPDITK

SEQ ID NO: 2682648 - protein, 19 aa, Entamoeba histolytica
KGISKGCGFVDFENEENAK

SEQ ID NO: 2682649 - protein, 21 aa, Entamoeba histolytica
KGISRGTGFVCFRKRGVAEKV

SEQ ID NO: 2682650 - protein, 25 aa, Entamoeba histolytica
KGKALSLLCRMLFVHIVQKAVEKSV

SEQ ID NO: 2682651 - protein, 17 aa, Entamoeba histolytica
KGKCYAYSIISNVGEPM

SEQ ID NO: 2682652 - protein, 26 aa, Entamoeba histolytica
KGKCYRCLCCASVFHIDCKPLRDCKL

SEQ ID NO: 2682653 - protein, 19 aa, Entamoeba histolytica
KGKELRIITGENFTFKILK

SEQ ID NO: 2682654 - protein, 20 aa, Entamoeba histolytica
KGKENILLMAFTKKGYVFGS

SEQ ID NO: 2682655 - protein, 20 aa, Entamoeba histolytica
KGKESIKVFYPEFNLGCIET

SEQ ID NO: 2682656 - protein, 19 aa, Entamoeba histolytica
KGKFRNEKYVEFAVGLGKV

SEQ ID NO: 2682657 - protein, 26 aa, Entamoeba histolytica
KGKGKLCERCFALAKTIRSAVFEKKK

SEQ ID NO: 2682658 - protein, 19 aa, Entamoeba histolytica
KGKGPKLLDVRMMLPMSVR

SEQ ID NO: 2682659 - protein, 25 aa, Entamoeba histolytica
KGKICKTCNKTLCNCCFNLSEHENH

SEQ ID NO: 2682660 - protein, 20 aa, Entamoeba histolytica
KGKIGYELIKKLPYGGMICN

SEQ ID NO: 2682661 - protein, 26 aa, Entamoeba histolytica
KGKIPPFGVCINRICQRIGEISRFME

SEQ ID NO: 2682662 - protein, 18 aa, Entamoeba histolytica
KGKKAGGFHDVLRTNYLN

SEQ ID NO: 2682663 - protein, 30 aa, Entamoeba histolytica
KGKKCKRCGICFDVECAKTYAGQMESWFIP

SEQ ID NO: 2682664 - protein, 24 aa, Entamoeba histolytica
KGKKCLSCDNFKISFNTETGMLEL

SEQ ID NO: 2682665 - protein, 23 aa, Entamoeba histolytica
KGKKIKHFYLFNDRLISGKPGNE

SEQ ID NO: 2682666 - protein, 25 aa, Entamoeba histolytica
KGKKRIEFLKSFNLEDLTPYTYIEA

SEQ ID NO: 2682667 - protein, 20 aa, Entamoeba histolytica
KGKLCKDLEYELYQFCEKMM

SEQ ID NO: 2682668 - protein, 20 aa, Entamoeba histolytica
KGKLFITQNYFCFRSQYGKK

SEQ ID NO: 2682669 - protein, 25 aa, Entamoeba histolytica
KGKLIEIMCIYSIINTSFFPDSRQI

SEQ ID NO: 2682670 - protein, 25 aa, Entamoeba histolytica
KGKLKKGRWSGMRVYDAEKEGGLIV

SEQ ID NO: 2682671 - protein, 35 aa, Entamoeba histolytica
KGKLYDCIGSIFVEFAHFFKVYKLIVGNSEAVLAV

SEQ ID NO: 2682672 - protein, 17 aa, Entamoeba histolytica
KGKPLTFKQMKELYITR

SEQ ID NO: 2682673 - protein, 19 aa, Entamoeba histolytica
KGKPVMKIAEETGQMEGVV

SEQ ID NO: 2682674 - protein, 25 aa, Entamoeba histolytica
KGKQYQMMFEWGRIGGTLHNTFRNG

SEQ ID NO: 2682675 - protein, 17 aa, Entamoeba histolytica
KGKRIAIKGNLKVDHND

SEQ ID NO: 2682676 - protein, 24 aa, Entamoeba histolytica
KGKTLKAKLLISITSTQGVSTGNS

SEQ ID NO: 2682677 - protein, 20 aa, Entamoeba histolytica
KGKVPRAKKGVILGHEGVGE

SEQ ID NO: 2682678 - protein, 19 aa, Entamoeba histolytica
KGLALKGLVLYLNYKREFY

SEQ ID NO: 2682679 - protein, 23 aa, Entamoeba histolytica
KGLDYWRRIKVIVSGVHVPGEGE

SEQ ID NO: 2682680 - protein, 24 aa, Entamoeba histolytica
KGLFLRSYLLYVIKNYLPTTLIEN

SEQ ID NO: 2682681 - protein, 19 aa, Entamoeba histolytica
KGLFSRKSTLSFSEKKEGD

SEQ ID NO: 2682682 - protein, 22 aa, Entamoeba histolytica
KGLFWLNDIVGVYGIKMKEHSK

SEQ ID NO: 2682683 - protein, 18 aa, Entamoeba histolytica
KGLHQYLHKQPHFNKIES

SEQ ID NO: 2682684 - protein, 32 aa, Entamoeba histolytica
KGLIPWIDIPRCPKCGGLIKLDVVLFGEQLEK

SEQ ID NO: 2682685 - protein, 23 aa, Entamoeba histolytica
KGLKEFVTTCARQILTEQKYLDD

SEQ ID NO: 2682686 - protein, 17 aa, Entamoeba histolytica
KGLNGRIIYEFKTKSEF

SEQ ID NO: 2682687 - protein, 32 aa, Entamoeba histolytica; identical to SEQ ID NO: 2489870

SEQ ID NO: 2682688 - protein, 24 aa, Entamoeba histolytica
KGLPQKYRSLVTMKKQSMINTTWL

SEQ ID NO: 2682689 - protein, 18 aa, Entamoeba histolytica
KGLPVLKISKYVKTRTSV

SEQ ID NO: 2682690 - protein, 19 aa, Entamoeba histolytica
KGLRARYVVDAILYTSEGP

SEQ ID NO: 2682691 - protein, 26 aa, Entamoeba histolytica
KGLRDMIAPFFLRRIKKEVLPSLPTR

SEQ ID NO: 2682692 - protein, 19 aa, Entamoeba histolytica
KGLTIEIIASIGLTGLDDD

SEQ ID NO: 2682693 - protein, 19 aa, Entamoeba histolytica
KGLVSTRYCHSCQHRIPLI

SEQ ID NO: 2682694 - protein, 24 aa, Entamoeba histolytica
KGLYNKICQDLDCITKELNNALSN

SEQ ID NO: 2682695 - protein, 24 aa, Entamoeba histolytica
KGMKRTSYTIMFLFYNKGFVNGMN

SEQ ID NO: 2682696 - protein, 25 aa, Entamoeba histolytica
KGMPEEIFNIVSLQRLDFVGCNITV

SEQ ID NO: 2682697 - protein, 29 aa, Entamoeba histolytica
KGMVKMSLPLAMFLSGISFDVYSENETIK

SEQ ID NO: 2682698 - protein, 19 aa, Entamoeba histolytica
KGMYCLRLHVKQFFETELV

SEQ ID NO: 2682699 - protein, 25 aa, Entamoeba histolytica
KGNCYQRQALAYAFVAVSKGNEEYT

SEQ ID NO: 2682700 - protein, 17 aa, Entamoeba histolytica
KGNECYYDLGEWKEITI

SEQ ID NO: 2682701 - protein, 27 aa, Entamoeba histolytica
KGNEGLLMPYLCCILQRIYVLSSSYLE

SEQ ID NO: 2682702 - protein, 25 aa, Entamoeba histolytica
KGNEIELSIGFAAIERVSVLPYNDL

SEQ ID NO: 2682703 - protein, 32 aa, Entamoeba histolytica
KGNENVMIFFFLKRNIIVGIYFNTPLQPDKQI

SEQ ID NO: 2682704 - protein, 24 aa, Entamoeba histolytica
KGNEYKFLFCVKGGGSANKSYLFQ

SEQ ID NO: 2682705 - protein, 19 aa, Entamoeba histolytica
KGNHIIVKFTPTVDNCTMA

SEQ ID NO: 2682706 - protein, 26 aa, Entamoeba histolytica
KGNNRPCFICGEIGHLDRDCPNKNEK

SEQ ID NO: 2682707 - protein, 18 aa, Entamoeba histolytica
KGNRIIIATGRSIHETKH

SEQ ID NO: 2682708 - protein, 20 aa, Entamoeba histolytica
KGNSCPRGAAYVRQEHIEPF

SEQ ID NO: 2682709 - protein, 19 aa, Entamoeba histolytica
KGNVQLVLLIGGTSKMPRI

SEQ ID NO: 2682710 - protein, 24 aa, Entamoeba histolytica
KGQELRLKQQFFFTSASLQDIVRR

SEQ ID NO: 2682711 - protein, 20 aa, Entamoeba histolytica
KGQERYGFVFIIDRKINANE

SEQ ID NO: 2682712 - protein, 19 aa, Entamoeba histolytica
KGQHIGGIDECEMIQKKDG

SEQ ID NO: 2682713 - protein, 18 aa, Entamoeba histolytica
KGQLPTFIYRGCQVLYQL

SEQ ID NO: 2682714 - protein, 17 aa, Entamoeba histolytica
KGQSIQVPLNCDLEDLY

SEQ ID NO: 2682715 - protein, 19 aa, Entamoeba histolytica
KGRALLFVQPCEIRILEYL

SEQ ID NO: 2682716 - protein, 22 aa, Entamoeba histolytica
KGRHDFKARLFQFYTSEDNELL

SEQ ID NO: 2682717 - protein, 18 aa, Entamoeba histolytica
KGRIDAFVSQYISHLIED

SEQ ID NO: 2682718 - protein, 20 aa, Entamoeba histolytica
KGRRMIKKAATIAGVKAGIQ

SEQ ID NO: 2682719 - protein, 24 aa, Entamoeba histolytica
KGRVRIVSVSLQFICNELYIRYLK

SEQ ID NO: 2682720 - protein, 19 aa, Entamoeba histolytica
KGRYKEVFETQSFEEFLLK

SEQ ID NO: 2682721 - protein, 27 aa, Entamoeba histolytica
KGSCISSLLRMLSIPSIRKDVLQLVMT

SEQ ID NO: 2682722 - protein, 19 aa, Entamoeba histolytica
KGSCLERYSNLINCHCKHY

SEQ ID NO: 2682723 - protein, 29 aa, Entamoeba histolytica
KGSEAYKKCFLQQLALKLLCNVVYGYTGA

SEQ ID NO: 2682724 - protein, 25 aa, Entamoeba histolytica
KGSELRTTLLFNKGRVLEEMKLWDE

SEQ ID NO: 2682725 - protein, 18 aa, Entamoeba histolytica
KGSEYVHCDCIHFSLSKL

SEQ ID NO: 2682726 - protein, 19 aa, Entamoeba histolytica
KGSLLKERIVEYMNKEITF

SEQ ID NO: 2682727 - protein, 20 aa, Entamoeba histolytica
KGSRNRFAVRLMELDLLSRV

SEQ ID NO: 2682728 - protein, 21 aa, Entamoeba histolytica
KGSSCAPVLLHKGLPSRLMEM

SEQ ID NO: 2682729 - protein, 18 aa, Entamoeba histolytica
KGSSVLSRMKGDHCEKFN

SEQ ID NO: 2682730 - protein, 18 aa, Entamoeba histolytica
KGSVFIRCECNKIKLSQF

SEQ ID NO: 2682731 - protein, 20 aa, Entamoeba histolytica
KGSVMYPELEEYFFHANPRS

SEQ ID NO: 2682732 - protein, 17 aa, Entamoeba histolytica
KGTAITFVLNEDKDYIT

SEQ ID NO: 2682733 - protein, 20 aa, Entamoeba histolytica
KGTDAMDVLYGRVYPLKLGY

SEQ ID NO: 2682734 - protein, 17 aa, Entamoeba histolytica
KGTEFITQIGLLSLKDI

SEQ ID NO: 2682735 - protein, 25 aa, Entamoeba histolytica
KGTGIKMRLSAELRDIGIYSHLEQL

SEQ ID NO: 2682736 - protein, 26 aa, Entamoeba histolytica
KGTGVKVCTVIGFPLGATPSEVKAYE

SEQ ID NO: 2682737 - protein, 24 aa, Entamoeba histolytica
KGTHPSDGLALFIATLRYLQSLGS

SEQ ID NO: 2682738 - protein, 19 aa, Entamoeba histolytica
KGTIVRRTYDFHKMLKRKF

SEQ ID NO: 2682739 - protein, 19 aa, Entamoeba histolytica
KGTKDLIAMGIMLGLTTSQ

SEQ ID NO: 2682740 - protein, 29 aa, Entamoeba histolytica
KGTLYELFCSYCLPFLFYKQTILVNRDLL

SEQ ID NO: 2682741 - protein, 25 aa, Entamoeba histolytica
KGTRSARKTIKMYRIKKMESPTKVI

SEQ ID NO: 2682742 - protein, 18 aa, Entamoeba histolytica
KGTYFYPFVIMKYKEQII

SEQ ID NO: 2682743 - protein, 18 aa, Entamoeba histolytica
KGVAIDFITTEEMDTINR

SEQ ID NO: 2682744 - protein, 28 aa, Entamoeba histolytica
KGVEGRAYHFISIIPYNGILLLLDGLSE

SEQ ID NO: 2682745 - protein, 27 aa, Entamoeba histolytica
KGVLKNCALIHILRVILWALREPISSN

SEQ ID NO: 2682746 - protein, 18 aa, Entamoeba histolytica
KGVSLAFERKMKLQEVVE

SEQ ID NO: 2682747 - protein, 20 aa, Entamoeba histolytica
KGVVMINCLHRIVTENEIYF

SEQ ID NO: 2682748 - protein, 21 aa, Entamoeba histolytica
KGVYQRFGLIPLQTLFEEATN

SEQ ID NO: 2682749 - protein, 19 aa, Entamoeba histolytica
KGWIGGIIINMLKKDGHEV

SEQ ID NO: 2682750 - protein, 28 aa, Entamoeba histolytica
KGWLQKDLFCDVFGWVVQKIFIELKTGQ

SEQ ID NO: 2682751 - protein, 30 aa, Entamoeba histolytica
KGWYPEKRLVCGLCQSVICYLKNVKPPSSN

SEQ ID NO: 2682752 - protein, 17 aa, Entamoeba histolytica
KGYIIFHLDNGKYVQDI

SEQ ID NO: 2682753 - protein, 20 aa, Entamoeba histolytica
KGYMLQILQAIQFLHSNNII

SEQ ID NO: 2682754 - protein, 20 aa, Entamoeba histolytica
KGYNSIRYFWDIGTLRIDAE

SEQ ID NO: 2682755 - protein, 25 aa, Entamoeba histolytica
KGYPFTEWFWMIEFQDKYFGFQTIF

SEQ ID NO: 2682756 - protein, 20 aa, Entamoeba histolytica
KGYVKEASMYYLIELQRKTY

SEQ ID NO: 2682757 - protein, 19 aa, Entamoeba histolytica
KHAHQIYLSIGINETEFNS

SEQ ID NO: 2682758 - protein, 24 aa, Entamoeba histolytica
KHAIEFYTKFGFKRIKTIPKAYPR

SEQ ID NO: 2682759 - protein, 20 aa, Entamoeba histolytica
KHAKEIGSYVIVGVYDDVIA

SEQ ID NO: 2682760 - protein, 18 aa, Entamoeba histolytica
KHAYGCRVVQKLIERKEP

SEQ ID NO: 2682761 - protein, 19 aa, Entamoeba histolytica
KHCEYCGETTGIVQCQCGK

SEQ ID NO: 2682762 - protein, 22 aa, Entamoeba histolytica
KHCKDRTLLSLGEDGVYITNCS

SEQ ID NO: 2682763 - protein, 18 aa, Entamoeba histolytica
KHCVDLTIRCLEEMDLSY

SEQ ID NO: 2682764 - protein, 19 aa, Entamoeba histolytica
KHDELFKWWREMKREQRMT

SEQ ID NO: 2682765 - protein, 18 aa, Entamoeba histolytica
KHDVLCSKCKGKGTKSGK

SEQ ID NO: 2682766 - protein, 28 aa, Entamoeba histolytica
KHDYMPLALNLILFLGKRHKLEQEIEKQ

SEQ ID NO: 2682767 - protein, 19 aa, Entamoeba histolytica
KHEVELKMDSLRALDDKIK

SEQ ID NO: 2682768 - protein, 20 aa, Entamoeba histolytica
KHFDISFKFFKDALKMAKTS

SEQ ID NO: 2682769 - protein, 17 aa, Entamoeba histolytica
KHFDTLCEILRSQTKKR

SEQ ID NO: 2682770 - protein, 21 aa, Entamoeba histolytica
KHFIAESLVPPIDFFIPQEAV

SEQ ID NO: 2682771 - protein, 22 aa, Entamoeba histolytica
KHFSACTSFGYMVCSCSSTIAS

SEQ ID NO: 2682772 - protein, 28 aa, Entamoeba histolytica
KHGERIIKIFLIRWENNFHYVPDEKVPL

SEQ ID NO: 2682773 - protein, 23 aa, Entamoeba histolytica
KHGISIDCLLHLEPSKPKESENN

SEQ ID NO: 2682774 - protein, 20 aa, Entamoeba histolytica
KHGLKKCTEIVCTHGHIDHI

SEQ ID NO: 2682775 - protein, 25 aa, Entamoeba histolytica
KHGPLFIYLFRLMLATGIPELQSAK

SEQ ID NO: 2682776 - protein, 24 aa, Entamoeba histolytica
KHGSECKGDEGLIQKYVECLVKIP

SEQ ID NO: 2682777 - protein, 19 aa, Entamoeba histolytica
KHHALRMAAFFHEPITFSA

SEQ ID NO: 2682778 - protein, 18 aa, Entamoeba histolytica
KHHMKFVLERELIIKNQE

SEQ ID NO: 2682779 - protein, 27 aa, Entamoeba histolytica
KHHPEMHGDLYIHFEVVLPSKEEINKN

SEQ ID NO: 2682780 - protein, 24 aa, Entamoeba histolytica
KHIDFRFIDVIVHYVSSFYSMFYP

SEQ ID NO: 2682781 - protein, 23 aa, Entamoeba histolytica
KHIILPFVCDYSLFNTFLMLSYP

SEQ ID NO: 2682782 - protein, 26 aa, Entamoeba histolytica
KHIKRLGKFSFKDCVSLKSITIPSSI

SEQ ID NO: 2682783 - protein, 20 aa, Entamoeba histolytica
KHILEAIQFNDILISSNGAL

SEQ ID NO: 2682784 - protein, 22 aa, Entamoeba histolytica
KHKCNARGWFVNVWKMVQEYIA

SEQ ID NO: 2682785 - protein, 17 aa, Entamoeba histolytica
KHKKKIQEIGARKDVDL

SEQ ID NO: 2682786 - protein, 23 aa, Entamoeba histolytica
KHKPKWVVKDIFKDPIGFSNSIY

SEQ ID NO: 2682787 - protein, 28 aa, Entamoeba histolytica
KHKRKILKRNISPLFSLKLQDNINNNLQ

SEQ ID NO: 2682788 - protein, 20 aa, Entamoeba histolytica
KHKVFSLKGAEFGWHSSGKK

SEQ ID NO: 2682789 - protein, 22 aa, Entamoeba histolytica
KHLALHLLDVFTFEHTETESTF

SEQ ID NO: 2682790 - protein, 20 aa, Entamoeba histolytica
KHLKGCKFFCAEHGLEAVAK

SEQ ID NO: 2682791 - protein, 17 aa, Entamoeba histolytica
KHLLGTYAVFYHKEGPQ

SEQ ID NO: 2682792 - protein, 22 aa, Entamoeba histolytica
KHLNFIKQLLIKRMNLPKKTII

SEQ ID NO: 2682793 - protein, 21 aa, Entamoeba histolytica
KHLPDGAAIYEVDKFKDEVKK

SEQ ID NO: 2682794 - protein, 25 aa, Entamoeba histolytica
KHLSNYTLFFGCGGEIQSLVTGYYR

SEQ ID NO: 2682795 - protein, 19 aa, Entamoeba histolytica
KHMFAFTLSNPFNVPTQKY

SEQ ID NO: 2682796 - protein, 26 aa, Entamoeba histolytica
KHMHVPFPLILIWALNQWRKEKSQTG

SEQ ID NO: 2682797 - protein, 21 aa, Entamoeba histolytica
KHMRNFDRLGVMKMIKIQTEY

SEQ ID NO: 2682798 - protein, 24 aa, Entamoeba histolytica
KHNLRPRIQSSKAVDFIDEIQINR

SEQ ID NO: 2682799 - protein, 24 aa, Entamoeba histolytica
KHPDLAIPLWYSYGTVVILLEEIV

SEQ ID NO: 2682800 - protein, 18 aa, Entamoeba histolytica
KHPFLVNLYCSFQTSVNL

SEQ ID NO: 2682801 - protein, 23 aa, Entamoeba histolytica
KHPNIVGFFGCFELDNYLYISME

SEQ ID NO: 2682802 - protein, 20 aa, Entamoeba histolytica
KHPNLNVTIVEWLRVQDYRH

SEQ ID NO: 2682803 - protein, 20 aa, Entamoeba histolytica
KHPQLKDEFELYQKLIGDKK

SEQ ID NO: 2682804 - protein, 18 aa, Entamoeba histolytica
KHPSGRANLREKYNKRQE

SEQ ID NO: 2682805 - protein, 20 aa, Entamoeba histolytica
KHPYILKSLQKCVSEWIREG

SEQ ID NO: 2682806 - protein, 26 aa, Entamoeba histolytica
KHQIDELYLRMAITSFEDLQPDLVAA

SEQ ID NO: 2682807 - protein, 20 aa, Entamoeba histolytica
KHRKRMGINTILFLDEIHSL

SEQ ID NO: 2682808 - protein, 25 aa, Entamoeba histolytica
KHSFITLRELFKWADRHANSYEELA

SEQ ID NO: 2682809 - protein, 24 aa, Entamoeba histolytica
KHSRLRVEEFFRTILHSNNPCHKL

SEQ ID NO: 2682810 - protein, 24 aa, Entamoeba histolytica
KHSRRGSISRVFSRSTSRRSSPEH

SEQ ID NO: 2682811 - protein, 24 aa, Entamoeba histolytica
KHSTRWFGCYDCWIQATPNGTSTI

SEQ ID NO: 2682812 - protein, 18 aa, Entamoeba histolytica
KHTKSWVHYPRPYMDDVF

SEQ ID NO: 2682813 - protein, 29 aa, Entamoeba histolytica
KHTNFCGFSRQLSLYGFKKFDNEYRFQNS

SEQ ID NO: 2682814 - protein, 18 aa, Entamoeba histolytica
KHTTGVSFHIPRLVMPNE

SEQ ID NO: 2682815 - protein, 31 aa, Entamoeba histolytica
KHTYKLAKVDSKICRLQDTFISLYTKKLNLQ

SEQ ID NO: 2682816 - protein, 19 aa, Entamoeba histolytica
KHVEEVLKQEKERMIKSTE

SEQ ID NO: 2682817 - protein, 19 aa, Entamoeba histolytica
KHVLDIVILTDKWSIKISL

SEQ ID NO: 2682818 - protein, 19 aa, Entamoeba histolytica
KHVLSLVLFGTEISTLENV

SEQ ID NO: 2682819 - protein, 19 aa, Entamoeba histolytica
KHVSSCLLSQYLVYNNRVI

SEQ ID NO: 2682820 - protein, 17 aa, Entamoeba histolytica
KHVTLRNAFSIYQIKDF

SEQ ID NO: 2682821 - protein, 30 aa, Entamoeba histolytica
KHYAKYIQIRFVFHQKHRIFTGSLLVPHEL

SEQ ID NO: 2682822 - protein, 23 aa, Entamoeba histolytica
KHYEPKCKMMVVGTKTDCRNDEA

SEQ ID NO: 2682823 - protein, 21 aa, Entamoeba histolytica
KHYRCSVPMTELLPYNTNHVK

SEQ ID NO: 2682824 - protein, 18 aa, Entamoeba histolytica
KIALDNFLFLYSKELQSK

SEQ ID NO: 2682825 - protein, 17 aa, Entamoeba histolytica
KIALKITLKSFISCQKT

SEQ ID NO: 2682826 - protein, 18 aa, Entamoeba histolytica
KIAMSRKVERRWRLVGWG

SEQ ID NO: 2682827 - protein, 26 aa, Entamoeba histolytica
KIANSIPCIISKYIIEPLLINERKFE

SEQ ID NO: 2682828 - protein, 26 aa, Entamoeba histolytica
KIASDYCWACFEFKKGKQSVVCSQMK

SEQ ID NO: 2682829 - protein, 17 aa, Entamoeba histolytica
KIASLIDRYENNDKKKQ

SEQ ID NO: 2682830 - protein, 18 aa, Entamoeba histolytica
KIAYRCVVIGLANETQDY

SEQ ID NO: 2682831 - protein, 21 aa, Entamoeba histolytica
KICARCGKPITTNCVSALGKT

SEQ ID NO: 2682832 - protein, 20 aa, Entamoeba histolytica
KICEFNPNFCIFGHIHTLPR

SEQ ID NO: 2682833 - protein, 17 aa, Entamoeba histolytica
KICICYEIKNNSDFTKI

SEQ ID NO: 2682834 - protein, 17 aa, Entamoeba histolytica
KICKSIRLIKKGIKIAL

SEQ ID NO: 2682835 - protein, 17 aa, Entamoeba histolytica
KIDAYITLCSKVGEKMM

SEQ ID NO: 2682836 - protein, 17 aa, Entamoeba histolytica
KIDCGPLALTDVQILGL

SEQ ID NO: 2682837 - protein, 24 aa, Entamoeba histolytica
KIDDSICVKFAFIEFIGDKSPRLQ

SEQ ID NO: 2682838 - protein, 18 aa, Entamoeba histolytica
KIDFEPRKDGLIPIEEMQ

SEQ ID NO: 2682839 - protein, 19 aa, Entamoeba histolytica
KIDFIGSIEYSYDRSSTSN

SEQ ID NO: 2682840 - protein, 24 aa, Entamoeba histolytica
KIDIWSLGCCIYWMATGHPIYPID

SEQ ID NO: 2682841 - protein, 20 aa, Entamoeba histolytica
KIDKRLNALFQILTNKYSFS

SEQ ID NO: 2682842 - protein, 21 aa, Entamoeba histolytica
KIDLCPYTKLTESQILSTEDK

SEQ ID NO: 2682843 - protein, 17 aa, Entamoeba histolytica
KIDLKIIKIEGNLYTFT

SEQ ID NO: 2682844 - protein, 27 aa, Entamoeba histolytica
KIDNDCLFLYLGEYWYHLMNWKIPEEH

SEQ ID NO: 2682845 - protein, 20 aa, Entamoeba histolytica
KIDNFLVEFITPIVKVKRGK

SEQ ID NO: 2682846 - protein, 25 aa, Entamoeba histolytica
KIDPFSFKILLPRIVLNQKEELELL

SEQ ID NO: 2682847 - protein, 24 aa, Entamoeba histolytica
KIDPMNNLRMWNRILSGIEKSVKR

SEQ ID NO: 2682848 - protein, 26 aa, Entamoeba histolytica
KIDPRCEIYTFASLICKIFTNQLPYN

SEQ ID NO: 2682849 - protein, 23 aa, Entamoeba histolytica
KIEAFLNVVRFFAAVGKQGVFAI

SEQ ID NO: 2682850 - protein, 24 aa, Entamoeba histolytica
KIEAPKGYPIIPLKPSCLPYPPQF

SEQ ID NO: 2682851 - protein, 21 aa, Entamoeba histolytica
KIECFKIISELSIFDGDILLK

SEQ ID NO: 2682852 - protein, 27 aa, Entamoeba histolytica
KIEFAKEIIGIFPFDQSVLISFIDNTF

SEQ ID NO: 2682853 - protein, 25 aa, Entamoeba histolytica
KIEFLKYIICRYLDVLSSEVYYKVC

SEQ ID NO: 2682854 - protein, 19 aa, Entamoeba histolytica
KIEGFEYTFLNEGFGYDVY

SEQ ID NO: 2682855 - protein, 22 aa, Entamoeba histolytica
KIEGITMHKNCFRCSVCKKILN

SEQ ID NO: 2682856 - protein, 21 aa, Entamoeba histolytica
KIEIKNPMFIVSLPRSGSTYL

SEQ ID NO: 2682857 - protein, 25 aa, Entamoeba histolytica
KIEKEFKKVCPFCHIEQVVKENCYY

SEQ ID NO: 2682858 - protein, 21 aa, Entamoeba histolytica
KIELEWLSWGELSKRNKQTFS

SEQ ID NO: 2682859 - protein, 24 aa, Entamoeba histolytica
KIENCSQCYLANIHVGWGQELISV

SEQ ID NO: 2682860 - protein, 18 aa, Entamoeba histolytica
KIEPFPRQYLIQRLYPIF

SEQ ID NO: 2682861 - protein, 27 aa, Entamoeba histolytica
KIETPKLVNRFSFFSIFKEKESEEDLI

SEQ ID NO: 2682862 - protein, 17 aa, Entamoeba histolytica
KIEVCNKNSFVPFPNEE

SEQ ID NO: 2682863 - protein, 26 aa, Entamoeba histolytica
KIFAIESFSFFELCFNTIVFSLTINV

SEQ ID NO: 2682864 - protein, 21 aa, Entamoeba histolytica
KIFDAVLLKMVEWLRMKSRIL

SEQ ID NO: 2682865 - protein, 19 aa, Entamoeba histolytica
KIFEKAMIFNFKKDVPIPH

SEQ ID NO: 2682866 - protein, 29 aa, Entamoeba histolytica
KIFHVASGLSICWGNLFGHIGMKTAYSGE

SEQ ID NO: 2682867 - protein, 19 aa, Entamoeba histolytica
KIFKQVIWYEVNYQDYLKE

SEQ ID NO: 2682868 - protein, 17 aa, Entamoeba histolytica
KIFKRNGIECINILLDQ

SEQ ID NO: 2682869 - protein, 17 aa, Entamoeba histolytica
KIFLEFTPFLKMYSDYC

SEQ ID NO: 2682870 - protein, 17 aa, Entamoeba histolytica
KIFLNFLKKCQILYDEI

SEQ ID NO: 2682871 - protein, 24 aa, Entamoeba histolytica
KIFQNYYLRICHATVSLIIDELFD

SEQ ID NO: 2682872 - protein, 23 aa, Entamoeba histolytica
KIFSEISYGFPLLSKIDISNNNL

SEQ ID NO: 2682873 - protein, 29 aa, Entamoeba histolytica
KIFSEYKEKCVFMIKYSLELRQWKEMKNN

SEQ ID NO: 2682874 - protein, 18 aa, Entamoeba histolytica
KIGECFNGVICRKLDEND

SEQ ID NO: 2682875 - protein, 18 aa, Entamoeba histolytica
KIGEPLTWSSWFSNEKGR

SEQ ID NO: 2682876 - protein, 22 aa, Entamoeba histolytica
KIGERPDPIILSKHVVDNKKSF

SEQ ID NO: 2682877 - protein, 18 aa, Entamoeba histolytica
KIGGGVIRVITCQPEIKE

SEQ ID NO: 2682878 - protein, 17 aa, Entamoeba histolytica
KIGISLEKVELFKSVST

SEQ ID NO: 2682879 - protein, 19 aa, Entamoeba histolytica
KIGKEAWKQLKKEIKTYIS

SEQ ID NO: 2682880 - protein, 24 aa, Entamoeba histolytica
KIGNDGRCALCFGYNNKKPIYICS

SEQ ID NO: 2682881 - protein, 19 aa, Entamoeba histolytica
KIGNGCFDKCTILTTVNIP

SEQ ID NO: 2682882 - protein, 18 aa, Entamoeba histolytica
KIGNGCFSKCLSLKSINI

SEQ ID NO: 2682883 - protein, 19 aa, Entamoeba histolytica
KIGNKCFSFCTSLTSINIQ

SEQ ID NO: 2682884 - protein, 19 aa, Entamoeba histolytica
KIGNPICDKGKGAFFEDMA

SEQ ID NO: 2682885 - protein, 23 aa, Entamoeba histolytica
KIGRRIEKKLSIKEMEESNEEAT

SEQ ID NO: 2682886 - protein, 18 aa, Entamoeba histolytica
KIGSSCFYGCSSLTTISI

SEQ ID NO: 2682887 - protein, 17 aa, Entamoeba histolytica
KIGTFSLIICDKQNFNE

SEQ ID NO: 2682888 - protein, 24 aa, Entamoeba histolytica
KIGYIRTLLKYFFDKFDRTGAGTF

SEQ ID NO: 2682889 - protein, 21 aa, Entamoeba histolytica
KIHKNEFIWFLNNERSFIYNL

SEQ ID NO: 2682890 - protein, 19 aa, Entamoeba histolytica
KIHLCENKEQIIIPFEDND

SEQ ID NO: 2682891 - protein, 18 aa, Entamoeba histolytica
KIHSSLMYRTEHLKEPYE

SEQ ID NO: 2682892 - protein, 19 aa, Entamoeba histolytica
KIIARHLAVIKTRPIIWRS

SEQ ID NO: 2682893 - protein, 20 aa, Entamoeba histolytica
KIIASCFVDNVARLVRREEL

SEQ ID NO: 2682894 - protein, 17 aa, Entamoeba histolytica
KIICLWDSRKLDHYFAS

SEQ ID NO: 2682895 - protein, 18 aa, Entamoeba histolytica
KIIDMLLIHEVIPNVKQI

SEQ ID NO: 2682896 - protein, 17 aa, Entamoeba histolytica
KIIEIIHLLQWPYWSCI

SEQ ID NO: 2682897 - protein, 19 aa, Entamoeba histolytica
KIIEILGMYLQYFNQNEQK

SEQ ID NO: 2682898 - protein, 20 aa, Entamoeba histolytica
KIIETCLLSPALVVVEYTIQ

SEQ ID NO: 2682899 - protein, 34 aa, Entamoeba histolytica
KIIGDILKLPTFQRLLMTYSFCGNVGNQFDSPNQ

SEQ ID NO: 2682900 - protein, 17 aa, Entamoeba histolytica
KIIGNGVICCDRTGTEI

SEQ ID NO: 2682901 - protein, 26 aa, Entamoeba histolytica
KIIHIVWRKRRVIVFTDENRGLILTS

SEQ ID NO: 2682902 - protein, 18 aa, Entamoeba histolytica
KIIINRPVLAHKMFTTIQ

SEQ ID NO: 2682903 - protein, 25 aa, Entamoeba histolytica
KIIKELYNGMFLKLVFIIKKCFACD

SEQ ID NO: 2682904 - protein, 18 aa, Entamoeba histolytica
KIIKKKVVKTIKQDDLSD

SEQ ID NO: 2682905 - protein, 19 aa, Entamoeba histolytica
KIIPCGNSVEFQGIEDGVS

SEQ ID NO: 2682906 - protein, 22 aa, Entamoeba histolytica
KIIPCTIDGLTIIVKIPPSVPG

SEQ ID NO: 2682907 - protein, 22 aa, Entamoeba histolytica
KIIPNPRLQPITEMVHPQPLLT

SEQ ID NO: 2682908 - protein, 20 aa, Entamoeba histolytica
KIIPRMTFYASRPLPIVTNE

SEQ ID NO: 2682909 - protein, 20 aa, Entamoeba histolytica
KIIQEIKDTINILDKKVSAI

SEQ ID NO: 2682910 - protein, 20 aa, Entamoeba histolytica
KIISELMCLSSIQNNTSKVF

SEQ ID NO: 2682911 - protein, 19 aa, Entamoeba histolytica
KIISFQWKKEDRITLLNIV

SEQ ID NO: 2682912 - protein, 25 aa, Entamoeba histolytica
KIISLRGSIWNGYISFVLVQSKLKE

SEQ ID NO: 2682913 - protein, 19 aa, Entamoeba histolytica
KIISVLEILSRPEIIENIK

SEQ ID NO: 2682914 - protein, 21 aa, Entamoeba histolytica
KIIVGILKFSEPYVIGVVMEL

SEQ ID NO: 2682915 - protein, 22 aa, Entamoeba histolytica
KIIYKIRYNIIFLNEELNEVDI

SEQ ID NO: 2682916 - protein, 19 aa, Entamoeba histolytica
KIKAGLEIIERHLSKEEAE

SEQ ID NO: 2682917 - protein, 22 aa, Entamoeba histolytica
KIKAQCKLGLTATLIREDDRIR

SEQ ID NO: 2682918 - protein, 30 aa, Entamoeba histolytica
KIKDIFLLMKRMLINLDMDQIEFKKELHKE

SEQ ID NO: 2682919 - protein, 25 aa, Entamoeba histolytica
KIKEKMYWLLGHSFTKYGEIYYCKE

SEQ ID NO: 2682920 - protein, 19 aa, Entamoeba histolytica
KIKELKIKKFINGLNGEDT

SEQ ID NO: 2682921 - protein, 26 aa, Entamoeba histolytica
KIKFGSHFDGWFDLKGSPFGNEYVCG

SEQ ID NO: 2682922 - protein, 22 aa, Entamoeba histolytica
KIKGEYCYFPFDDHNAPQFEII

SEQ ID NO: 2682923 - protein, 19 aa, Entamoeba histolytica
KIKGFSCNDRYIIISQPYG

SEQ ID NO: 2682924 - protein, 20 aa, Entamoeba histolytica
KIKLEGFGAYSGGLDTKFNE

SEQ ID NO: 2682925 - protein, 20 aa, Entamoeba histolytica
KIKLGDYIRERVMEVDKKGG

SEQ ID NO: 2682926 - protein, 26 aa, Entamoeba histolytica
KIKNWAYKIILFFPNIQTFRIKDLNV

SEQ ID NO: 2682927 - protein, 23 aa, Entamoeba histolytica
KIKPTLYSFILIKNFETRYEILG

SEQ ID NO: 2682928 - protein, 19 aa, Entamoeba histolytica
KIKQLREIKQLKIIQQALQ

SEQ ID NO: 2682929 - protein, 21 aa, Entamoeba histolytica
KIKRIGYDVGNRLTERFTDFE

SEQ ID NO: 2682930 - protein, 19 aa, Entamoeba histolytica
KIKSEFIVELIGVERCKEI

SEQ ID NO: 2682931 - protein, 22 aa, Entamoeba histolytica
KIKSEVPKFDIRPRNDIDEIKE

SEQ ID NO: 2682932 - protein, 18 aa, Entamoeba histolytica
KIKSRLIEGLSMLVYSCS

SEQ ID NO: 2682933 - protein, 22 aa, Entamoeba histolytica
KIKSRWMRKNARRLDIENYTRN

SEQ ID NO: 2682934 - protein, 19 aa, Entamoeba histolytica
KIKTNCFNKSYNLFGSAYQ

SEQ ID NO: 2682935 - protein, 18 aa, Entamoeba histolytica
KIKTPRSSLRSNLLVDET

SEQ ID NO: 2682936 - protein, 17 aa, Entamoeba histolytica
KIKVGVFCDCFQMSKIQ

SEQ ID NO: 2682937 - protein, 20 aa, Entamoeba histolytica
KIKWLNERIEKIDWEKISQK

SEQ ID NO: 2682938 - protein, 18 aa, Entamoeba histolytica
KILAKQLILFDWRMTENI

SEQ ID NO: 2682939 - protein, 27 aa, Entamoeba histolytica
KILDDFRKAAAVQIVMLGGEYIGNKRK

SEQ ID NO: 2682940 - protein, 18 aa, Entamoeba histolytica
KILDFCTIFSRELPHHYC

SEQ ID NO: 2682941 - protein, 34 aa, Entamoeba histolytica
KILDLKGKLILPSLCTFGNLPFRKVVKRFGCDVT

SEQ ID NO: 2682942 - protein, 17 aa, Entamoeba histolytica
KILEKVIEFMTYHHNHS

SEQ ID NO: 2682943 - protein, 25 aa, Entamoeba histolytica
KILETRLKRGLLPIINGGTFICKID

SEQ ID NO: 2682944 - protein, 19 aa, Entamoeba histolytica
KILFKNLNFALNMESRIAL

SEQ ID NO: 2682945 - protein, 20 aa, Entamoeba histolytica
KILICSDTHLGAGEKSHCLK

SEQ ID NO: 2682946 - protein, 19 aa, Entamoeba histolytica
KILLRRKLSRLSEQPLIEI

SEQ ID NO: 2682947 - protein, 17 aa, Entamoeba histolytica
KILMPLFPLPRKEEEDI

SEQ ID NO: 2682948 - protein, 21 aa, Entamoeba histolytica
KILPKETKLVIGVFQTEEQIG

SEQ ID NO: 2682949 - protein, 20 aa, Entamoeba histolytica
KILQKIGFKEMTVIFDTVYD

SEQ ID NO: 2682950 - protein, 23 aa, Entamoeba histolytica
KILQKKLSEFIVRSEDVIKNASY

SEQ ID NO: 2682951 - protein, 17 aa, Entamoeba histolytica
KILRLDLQHDFYNNHLL

SEQ ID NO: 2682952 - protein, 25 aa, Entamoeba histolytica
KILSFFKREVEEIIKYKKEQTGNSE

SEQ ID NO: 2682953 - protein, 21 aa, Entamoeba histolytica
KILSQSFVIVAEIQKEKTNRE

SEQ ID NO: 2682954 - protein, 18 aa, Entamoeba histolytica
KILTEEFNSFLLKFTNWE

SEQ ID NO: 2682955 - protein, 23 aa, Entamoeba histolytica
KIMADALWGFSFIVSNPQNICKF

SEQ ID NO: 2682956 - protein, 17 aa, Entamoeba histolytica
KIMCTSEGGVFFVTGAN

SEQ ID NO: 2682957 - protein, 32 aa, Entamoeba histolytica
KIMGFRLERPQLIFRDSLLRLSTLKEWKYDIR

SEQ ID NO: 2682958 - protein, 22 aa, Entamoeba histolytica
KIMNCIIIKFIKLHISSPELIE

SEQ ID NO: 2682959 - protein, 21 aa, Entamoeba histolytica
KIMYEQMNFTGFFEFYSGLNS

SEQ ID NO: 2682960 - protein, 20 aa, Entamoeba histolytica
KINAIAIVHLINGKVIPNCL

SEQ ID NO: 2682961 - protein, 25 aa, Entamoeba histolytica
KINCKLSGMPELRLGLNEKINIGDR

SEQ ID NO: 2682962 - protein, 26 aa, Entamoeba histolytica
KINCKLSGMPELRLGLNEKINIGDRM

SEQ ID NO: 2682963 - protein, 18 aa, Entamoeba histolytica
KINDFMKFCKYIETDQEY

SEQ ID NO: 2682964 - protein, 19 aa, Entamoeba histolytica
KINDIKTIIAYSKAIRLST

SEQ ID NO: 2682965 - protein, 19 aa, Entamoeba histolytica
KINEFLMVMYYPCKSAEEM

SEQ ID NO: 2682966 - protein, 23 aa, Entamoeba histolytica
KINEILKELGIVFEHQITVDNIE

SEQ ID NO: 2682967 - protein, 26 aa, Entamoeba histolytica
KINELKIQFGDFIPRNVRTQIKDLTE

SEQ ID NO: 2682968 - protein, 22 aa, Entamoeba histolytica
KINEYGHHWTLISQFIPGRAPN

SEQ ID NO: 2682969 - protein, 19 aa, Entamoeba histolytica
KINFWRNVYGFNMTPMRAE

SEQ ID NO: 2682970 - protein, 27 aa, Entamoeba histolytica
KINKLYFLQKVNRIKEWILTKNDDSDY

SEQ ID NO: 2682971 - protein, 17 aa, Entamoeba histolytica
KINNLIVDYVKTFPNEF

SEQ ID NO: 2682972 - protein, 18 aa, Entamoeba histolytica
KINSVVLKGAIKCAAAQT

SEQ ID NO: 2682973 - protein, 21 aa, Entamoeba histolytica
KINYCYLPSAHVFDQQIALAF

SEQ ID NO: 2682974 - protein, 20 aa, Entamoeba histolytica
KIPEEFKRALNDSFVKSVNQ

SEQ ID NO: 2682975 - protein, 26 aa, Entamoeba histolytica
KIPEKEWFCRVCSYRLGITKLDIPEN

SEQ ID NO: 2682976 - protein, 19 aa, Entamoeba histolytica
KIPFGLNYSERVEGWDDET

SEQ ID NO: 2682977 - protein, 19 aa, Entamoeba histolytica
KIPQLRNDIKYILDAPSLL

SEQ ID NO: 2682978 - protein, 26 aa, Entamoeba histolytica
KIPSQLFCEFIRCVYHRTSDIAKIKA

SEQ ID NO: 2682979 - protein, 22 aa, Entamoeba histolytica
KIPTLIPRLINFMLEHPTLPIA

SEQ ID NO: 2682980 - protein, 23 aa, Entamoeba histolytica
KIPYEMYKRKEGKIETQVTLPPS

SEQ ID NO: 2682981 - protein, 23 aa, Entamoeba histolytica
KIQEIEEEFGITKGRFKFKKTEK

SEQ ID NO: 2682982 - protein, 18 aa, Entamoeba histolytica
KIQFGFNGSTIFHIGNEI

SEQ ID NO: 2682983 - protein, 18 aa, Entamoeba histolytica
KIQFKLPIGPTIQFDNST

SEQ ID NO: 2682984 - protein, 23 aa, Entamoeba histolytica
KIQFPQICVNCMKSYTDYINELN

SEQ ID NO: 2682985 - protein, 24 aa, Entamoeba histolytica
KIQGETLVAFVIVKSGSSFTNLEM

SEQ ID NO: 2682986 - protein, 20 aa, Entamoeba histolytica
KIQHFFDKRLPALRDSARNK

SEQ ID NO: 2682987 - protein, 20 aa, Entamoeba histolytica
KIQLKICSFLQPKHLFSLMQ

SEQ ID NO: 2682988 - protein, 22 aa, Entamoeba histolytica
KIQQCQFQHIMNSLSTHLNVIR

SEQ ID NO: 2682989 - protein, 25 aa, Entamoeba histolytica
KIQSDRLKNALSLKDIKYNNDLDKM

SEQ ID NO: 2682990 - protein, 18 aa, Entamoeba histolytica
KIQSLPFSSTKHVVSVID

SEQ ID NO: 2682991 - protein, 19 aa, Entamoeba histolytica
KIQSQSFIFVKGVPLNFER

SEQ ID NO: 2682992 - protein, 18 aa, Entamoeba histolytica
KIQVDIIIAVFIKLSRGT

SEQ ID NO: 2682993 - protein, 20 aa, Entamoeba histolytica
KIQYRMHPLIREFPSNQFYS

SEQ ID NO: 2682994 - protein, 21 aa, Entamoeba histolytica
KIRDSCFECCSSLTSINIPTS

SEQ ID NO: 2682995 - protein, 18 aa, Entamoeba histolytica
KIRHGRSSSRSCSYDSQD

SEQ ID NO: 2682996 - protein, 20 aa, Entamoeba histolytica
KIRINGRYGTDMSMKTIVHL

SEQ ID NO: 2682997 - protein, 19 aa, Entamoeba histolytica
KIRKIREAREFTSTDIEEV

SEQ ID NO: 2682998 - protein, 26 aa, Entamoeba histolytica
KIRNVPIRLCFDLKKIQSIDISCNNI

SEQ ID NO: 2682999 - protein, 22 aa, Entamoeba histolytica
KIRSNNFKVFGFGDQFIDTLQK

SEQ ID NO: 2683000 - protein, 22 aa, Entamoeba histolytica
KISDLLCEGESDVLLKEPTKKF

SEQ ID NO: 2683001 - protein, 25 aa, Entamoeba histolytica
KISEFGEALDLFFYVLQQSAERVVL

SEQ ID NO: 2683002 - protein, 24 aa, Entamoeba histolytica
KISELDLPIPLCELTLIQCRKLQT

SEQ ID NO: 2683003 - protein, 23 aa, Entamoeba histolytica
KISFKYRIMNRFKDEEYVIYDSN

SEQ ID NO: 2683004 - protein, 27 aa, Entamoeba histolytica
KISIIRFRKFMRINLGIIFTKVINQIL

SEQ ID NO: 2683005 - protein, 18 aa, Entamoeba histolytica
KISKGYAFIYFPTLNEAN

SEQ ID NO: 2683006 - protein, 18 aa, Entamoeba histolytica
KISKIAEQFFVYDIKLIK

SEQ ID NO: 2683007 - protein, 21 aa, Entamoeba histolytica
KISKKTFPLLTIKFVHRCTPD

SEQ ID NO: 2683008 - protein, 22 aa, Entamoeba histolytica
KISKKYGIIVGGGFNLKGDLIV

SEQ ID NO: 2683009 - protein, 28 aa, Entamoeba histolytica
KISKTIICYLLRFGMKIDEENMIIFNKY

SEQ ID NO: 2683010 - protein, 20 aa, Entamoeba histolytica
KISLWIYGSVCSLIHFHSIH

SEQ ID NO: 2683011 - protein, 21 aa, Entamoeba histolytica
KISMINFLIFIYGYDLHEVVN

SEQ ID NO: 2683012 - protein, 20 aa, Entamoeba histolytica
KISNCLFGGNANGIFLKPLY

SEQ ID NO: 2683013 - protein, 26 aa, Entamoeba histolytica
KISNCNPEVQFALNIIQQLLVTVEGA

SEQ ID NO: 2683014 - protein, 24 aa, Entamoeba histolytica
KISQIPYRFSCSTLLESDTWNSII

SEQ ID NO: 2683015 - protein, 33 aa, Entamoeba histolytica
KISRRSVSGPKGRRRPTMKKIQFDEHTERLMKE

SEQ ID NO: 2683016 - protein, 24 aa, Entamoeba histolytica
KISYEEFCSIILKNSENIGEKLTI

SEQ ID NO: 2683017 - protein, 17 aa, Entamoeba histolytica
KITDDFRYIIINEDHLE

SEQ ID NO: 2683018 - protein, 22 aa, Entamoeba histolytica
KITECKYLRFKTPFPSLEHLII

SEQ ID NO: 2683019 - protein, 17 aa, Entamoeba histolytica
KITFIRTIQSCAVFYSF

SEQ ID NO: 2683020 - protein, 17 aa, Entamoeba histolytica
KITFSRTNKRNENITSQ

SEQ ID NO: 2683021 - protein, 24 aa, Entamoeba histolytica
KITIPSCFEKGLFSEDGINAIHLA

SEQ ID NO: 2683022 - protein, 44 aa, Entamoeba histolytica
KITKKENCQFILFRLTKSDGLFIYEMEIEKTFIIYNYLIYYILK

SEQ ID NO: 2683023 - protein, 24 aa, Entamoeba histolytica
KITLCIIEPLLFPLKITAYYFVDN

SEQ ID NO: 2683024 - protein, 20 aa, Entamoeba histolytica
KITLKLQRIDSIQKYLTEFK

SEQ ID NO: 2683025 - protein, 24 aa, Entamoeba histolytica
KITLKRIRELSAYYRRVYLGEGYP

SEQ ID NO: 2683026 - protein, 25 aa, Entamoeba histolytica
KITMYRVKWPGTFELFISEEPDTFF

SEQ ID NO: 2683027 - protein, 26 aa, Entamoeba histolytica
KITNLCLRTGIKLGCSRMKLDQNTSD

SEQ ID NO: 2683028 - protein, 22 aa, Entamoeba histolytica
KITPFILQNPFDLIPVRFDPKV

SEQ ID NO: 2683029 - protein, 24 aa, Entamoeba histolytica
KITPKVEWEEHIFECAKNETSRFN

SEQ ID NO: 2683030 - protein, 19 aa, Entamoeba histolytica
KITSLKLLQQVLFLFDNLS

SEQ ID NO: 2683031 - protein, 25 aa, Entamoeba histolytica
KITTESFGSLSLKGIESLFTNKILE

SEQ ID NO: 2683032 - protein, 19 aa, Entamoeba histolytica
KITYWMLVREKYFAENLPQ

SEQ ID NO: 2683033 - protein, 21 aa, Entamoeba histolytica
KIVCPPSIMPSKFKYQTYTTQ

SEQ ID NO: 2683034 - protein, 17 aa, Entamoeba histolytica
KIVFKYLPIKEIKCVVI

SEQ ID NO: 2683035 - protein, 19 aa, Entamoeba histolytica
KIVKIPMFFVDSCPDEDDD

SEQ ID NO: 2683036 - protein, 19 aa, Entamoeba histolytica
KIVLLPVENKYLFPKSIKR

SEQ ID NO: 2683037 - protein, 22 aa, Entamoeba histolytica
KIVLLRSILIRREIYKKNIKDM

SEQ ID NO: 2683038 - protein, 24 aa, Entamoeba histolytica
KIVRCLKPFLLTAVIQSNRKEDEL

SEQ ID NO: 2683039 - protein, 25 aa, Entamoeba histolytica
KIVRESKSGMGRGIGFVTFTNKEDV

SEQ ID NO: 2683040 - protein, 17 aa, Entamoeba histolytica
KIVSASMKDFIVAYDAK

SEQ ID NO: 2683041 - protein, 24 aa, Entamoeba histolytica
KIVVKRLISAIGYLHSMNIVHRDL

SEQ ID NO: 2683042 - protein, 29 aa, Entamoeba histolytica
KIWAKDMYLLYFWQGRSCAVIDKGTSARL

SEQ ID NO: 2683043 - protein, 20 aa, Entamoeba histolytica
KIWSNEEFESVYLKTDEIIS

SEQ ID NO: 2683044 - protein, 18 aa, Entamoeba histolytica
KIYECYHSYDELVAILKL

SEQ ID NO: 2683045 - protein, 18 aa, Entamoeba histolytica
KIYITIMSCYNFEECVHK

SEQ ID NO: 2683046 - protein, 18 aa, Entamoeba histolytica
KIYLKIPHDKAWIIRREF

SEQ ID NO: 2683047 - protein, 18 aa, Entamoeba histolytica
KIYLVGGLQYEEIMKGID

SEQ ID NO: 2683048 - protein, 17 aa, Entamoeba histolytica
KIYMPPEYFYEGVEENT

SEQ ID NO: 2683049 - protein, 21 aa, Entamoeba histolytica
KIYNIEPFPQIPIEEVKKNLP

SEQ ID NO: 2683050 - protein, 20 aa, Entamoeba histolytica
KIYNQICQEIYLAQSDDLVR

SEQ ID NO: 2683051 - protein, 18 aa, Entamoeba histolytica
KIYQEIDSGFTLTANEII

SEQ ID NO: 2683052 - protein, 19 aa, Entamoeba histolytica
KIYSWNKMEMSIFFDEQQT

SEQ ID NO: 2683053 - protein, 18 aa, Entamoeba histolytica
KIYVEDIVDKCVVDLINK

SEQ ID NO: 2683054 - protein, 17 aa, Entamoeba histolytica
KIYYLIEARCRIGITAT

SEQ ID NO: 2683055 - protein, 23 aa, Entamoeba histolytica
KKAAAAALRIIRKCPSYSDIYVQ

SEQ ID NO: 2683056 - protein, 17 aa, Entamoeba histolytica
KKAAITLKKIEMDESNN

SEQ ID NO: 2683057 - protein, 20 aa, Entamoeba histolytica
KKAAVWCVGEYFDLLKNVVK

SEQ ID NO: 2683058 - protein, 25 aa, Entamoeba histolytica
KKAEFMFRQCCEVPIMKKTASNFGI

SEQ ID NO: 2683059 - protein, 22 aa, Entamoeba histolytica
KKAEILNSIMYCMEQFIINIPV

SEQ ID NO: 2683060 - protein, 20 aa, Entamoeba histolytica
KKAEKCVMCDTSFLFQMHRR

SEQ ID NO: 2683061 - protein, 21 aa, Entamoeba histolytica
KKAEKCVMCDTSFLFQMRRRA

SEQ ID NO: 2683062 - protein, 24 aa, Entamoeba histolytica
KKAERGMSFDIRRDGVMMAGLEED

SEQ ID NO: 2683063 - protein, 25 aa, Entamoeba histolytica
KKAIEYAPLWLPQSIQKCQLCGKAF

SEQ ID NO: 2683064 - protein, 19 aa, Entamoeba histolytica
KKAILLMLVGATPKIRLRS

SEQ ID NO: 2683065 - protein, 19 aa, Entamoeba histolytica
KKAKEELIKLAEQQKEYER

SEQ ID NO: 2683066 - protein, 18 aa, Entamoeba histolytica
KKALFCFIAEDCDNDKYT

SEQ ID NO: 2683067 - protein, 22 aa, Entamoeba histolytica
KKALKEYHFFCTLANERSKMRD

SEQ ID NO: 2683068 - protein, 18 aa, Entamoeba histolytica
  misc_feature (14)..(14): Xaa can be any naturally occurring amino acid
KKAMRYAKVFAMLXEARS

SEQ ID NO: 2683069 - protein, 24 aa, Entamoeba histolytica
KKAQTKLIKSYRALKYEQDHNPKL

SEQ ID NO: 2683070 - protein, 17 aa, Entamoeba histolytica
KKARKALEKVGLVEVPN

SEQ ID NO: 2683071 - protein, 22 aa, Entamoeba histolytica
KKARLEGAEVIKMMKASQSGGV

SEQ ID NO: 2683072 - protein, 21 aa, Entamoeba histolytica
KKARVKDIWGAGVHKKKYHLP

SEQ ID NO: 2683073 - protein, 32 aa, Entamoeba histolytica
KKCCIKNPLQCSSLKWILQVVSKDEFMAYYNE

SEQ ID NO: 2683074 - protein, 17 aa, Entamoeba histolytica
KKCDIVIGRPHRKSRIT

SEQ ID NO: 2683075 - protein, 19 aa, Entamoeba histolytica
KKCFDCINSSCGVGVSLNN

SEQ ID NO: 2683076 - protein, 19 aa, Entamoeba histolytica
KKCGTKLMQRKVFTTTFTQ

SEQ ID NO: 2683077 - protein, 24 aa, Entamoeba histolytica
KKCHLCGSSSFIPMRNTVKVTETQ

SEQ ID NO: 2683078 - protein, 21 aa, Entamoeba histolytica
KKCIFSFNLMLSIKCTDIQKW

SEQ ID NO: 2683079 - protein, 22 aa, Entamoeba histolytica
KKCKAFSIILRYNLNTHSVERV

SEQ ID NO: 2683080 - protein, 23 aa, Entamoeba histolytica
KKCKSCAIHPGEHIFISLKKTMN

SEQ ID NO: 2683081 - protein, 17 aa, Entamoeba histolytica
KKCMDSTRIKYIIDNIK

SEQ ID NO: 2683082 - protein, 28 aa, Entamoeba histolytica
KKCPVCKCPVIKSYGCNKITCICGTYFC

SEQ ID NO: 2683083 - protein, 24 aa, Entamoeba histolytica
KKCQSELFQPLSQIVVKKIFPVSF

SEQ ID NO: 2683084 - protein, 17 aa, Entamoeba histolytica
KKCVMRAKIDMKHKNKA

SEQ ID NO: 2683085 - protein, 18 aa, Entamoeba histolytica
KKDAEALVNLRNKKTASE

SEQ ID NO: 2683086 - protein, 21 aa, Entamoeba histolytica
KKDCLVALDLMDVVRLSSDPD

SEQ ID NO: 2683087 - protein, 17 aa, Entamoeba histolytica
KKDEIYNPTTFSRIGYQ

SEQ ID NO: 2683088 - protein, 20 aa, Entamoeba histolytica
KKDFEGKVYIAWKDTGNDCE

SEQ ID NO: 2683089 - protein, 17 aa, Entamoeba histolytica
KKDFLETKIEVIENNFD

SEQ ID NO: 2683090 - protein, 19 aa, Entamoeba histolytica
KKDGKKVIILFDKSPININ

SEQ ID NO: 2683091 - protein, 18 aa, Entamoeba histolytica
KKDGLNIMFSFVKHRYPR

SEQ ID NO: 2683092 - protein, 20 aa, Entamoeba histolytica
KKDGSLYQLCEFDYIRRCVM

SEQ ID NO: 2683093 - protein, 18 aa, Entamoeba histolytica
KKDGVLYVFDFGGGTLDI

SEQ ID NO: 2683094 - protein, 24 aa, Entamoeba histolytica
KKDIIPHLLTLISLQNIISTEEYH

SEQ ID NO: 2683095 - protein, 20 aa, Entamoeba histolytica
KKDLNGIGISPDWKTNIEGI

SEQ ID NO: 2683096 - protein, 24 aa, Entamoeba histolytica
KKDMKLEIQRNVFAQYEEENQNAV

SEQ ID NO: 2683097 - protein, 26 aa, Entamoeba histolytica
KKDNYVCALKVIFKRQLQQYRREIQM

SEQ ID NO: 2683098 - protein, 23 aa, Entamoeba histolytica
KKDRSKEGFDINGMIENEMNQFD

SEQ ID NO: 2683099 - protein, 21 aa, Entamoeba histolytica
KKDYATAICEYSRAIECDPFN

SEQ ID NO: 2683100 - protein, 22 aa, Entamoeba histolytica
KKEAKMLIREVAKKVVKKAKRH

SEQ ID NO: 2683101 - protein, 18 aa, Entamoeba histolytica
KKEDCVKKLDSLQKEMRD

SEQ ID NO: 2683102 - protein, 23 aa, Entamoeba histolytica
KKEEEKFDRLVAQSHQADEYLDL

SEQ ID NO: 2683103 - protein, 18 aa, Entamoeba histolytica
KKEFKRFAQTRSLLISNW

SEQ ID NO: 2683104 - protein, 24 aa, Entamoeba histolytica
KKEFNIPFELEFFMNLKNKTIIEH

SEQ ID NO: 2683105 - protein, 25 aa, Entamoeba histolytica
KKEFSELNLVFAIGGQISFDCYPVG

SEQ ID NO: 2683106 - protein, 18 aa, Entamoeba histolytica
KKEGKLFMKMRIKNTSGA

SEQ ID NO: 2683107 - protein, 21 aa, Entamoeba histolytica
KKEIYRISLTDFMQLKDNELL

SEQ ID NO: 2683108 - protein, 22 aa, Entamoeba histolytica
KKEIYRISLTDFMQLKDNELLI

SEQ ID NO: 2683109 - protein, 29 aa, Entamoeba histolytica
KKEKCVFKIGFFLSEMKLRCHEMFQWNED

SEQ ID NO: 2683110 - protein, 21 aa, Entamoeba histolytica
KKEKELIINGISYLEIIKIYS

SEQ ID NO: 2683111 - protein, 24 aa, Entamoeba histolytica
KKEKELKERIVLIEKKLDEAIEMM

SEQ ID NO: 2683112 - protein, 23 aa, Entamoeba histolytica
KKEKFKVIIVVPIWSEGELDSII

SEQ ID NO: 2683113 - protein, 26 aa, Entamoeba histolytica
KKEKGLRFGARIFSLFPEASKAKVAS

SEQ ID NO: 2683114 - protein, 20 aa, Entamoeba histolytica
KKEKIKAICYNNQKEMPSKN

SEQ ID NO: 2683115 - protein, 20 aa, Entamoeba histolytica
KKEKKMMMNIEKQFKLLEQQ

SEQ ID NO: 2683116 - protein, 27 aa, Entamoeba histolytica
KKEKKPRKDCICGLDTLKEETRIKILM

SEQ ID NO: 2683117 - protein, 23 aa, Entamoeba histolytica
KKEKYPCGILYGRMEEYLREREF

SEQ ID NO: 2683118 - protein, 19 aa, Entamoeba histolytica
KKELEILEDDDIIYKLEDG

SEQ ID NO: 2683119 - protein, 18 aa, Entamoeba histolytica
KKELELLQKGVKYGEVLK

SEQ ID NO: 2683120 - protein, 22 aa, Entamoeba histolytica
KKELKTNYIIKYCSCNSLKSKT

SEQ ID NO: 2683121 - protein, 28 aa, Entamoeba histolytica
KKEMAIMLSDLYAIYNRARGILISPKEL

SEQ ID NO: 2683122 - protein, 25 aa, Entamoeba histolytica
KKEMRIRVCYDISIALSYLHHLNII

SEQ ID NO: 2683123 - protein, 19 aa, Entamoeba histolytica
KKENEIFEDGRIIKYRKKE

SEQ ID NO: 2683124 - protein, 19 aa, Entamoeba histolytica
KKENEVMSISSWNVVFKSW

SEQ ID NO: 2683125 - protein, 18 aa, Entamoeba histolytica
KKENVFVFGSEYRPVPLQ

SEQ ID NO: 2683126 - protein, 23 aa, Entamoeba histolytica
KKERARCMSPIYDFFVPSEPKSP

SEQ ID NO: 2683127 - protein, 27 aa, Entamoeba histolytica
KKERIAEYFMPFVFDFIDNFERITDIW

SEQ ID NO: 2683128 - protein, 19 aa, Entamoeba histolytica
KKERIFIKECIDFKPNIGK

SEQ ID NO: 2683129 - protein, 25 aa, Entamoeba histolytica
KKESERKKRMVILYERKLDSMRELL

SEQ ID NO: 2683130 - protein, 22 aa, Entamoeba histolytica
KKESWVRYFLHTGHLHINGLKM

SEQ ID NO: 2683131 - protein, 22 aa, Entamoeba histolytica
KKEVVMASIFIQRKISESAEEP

SEQ ID NO: 2683132 - protein, 26 aa, Entamoeba histolytica
KKEVYGNGIAQCFIKEFGKFEEYAYF

SEQ ID NO: 2683133 - protein, 25 aa, Entamoeba histolytica
KKEYLIPMIYSFDGMVFDDTLSTNW

SEQ ID NO: 2683134 - protein, 18 aa, Entamoeba histolytica
KKFAASNPTNVYWENLLY

SEQ ID NO: 2683135 - protein, 30 aa, Entamoeba histolytica
KKFECKVCGAKQSYKHIFGISKQAKDLRQI

SEQ ID NO: 2683136 - protein, 18 aa, Entamoeba histolytica
KKFGWVSNYFILKDGKLI

SEQ ID NO: 2683137 - protein, 25 aa, Entamoeba histolytica
KKFICPIENCGRCFTTKSYLDKHVE

SEQ ID NO: 2683138 - protein, 25 aa, Entamoeba histolytica
KKFIICLNKRNGLLYGFDQHAVHER

SEQ ID NO: 2683139 - protein, 20 aa, Entamoeba histolytica
KKFISILPFDSLKESFDELI

SEQ ID NO: 2683140 - protein, 20 aa, Entamoeba histolytica
KKFKDFTAWVKKLARNTSTH

SEQ ID NO: 2683141 - protein, 17 aa, Entamoeba histolytica
KKFKEQYLPSKTIVKSV

SEQ ID NO: 2683142 - protein, 17 aa, Entamoeba histolytica
KKFKETLSEIITSIVNA

SEQ ID NO: 2683143 - protein, 19 aa, Entamoeba histolytica
KKFKYVVVHASIVIKEDSC

SEQ ID NO: 2683144 - protein, 20 aa, Entamoeba histolytica
KKFLAQKMWNVMVEYSQLTM

SEQ ID NO: 2683145 - protein, 17 aa, Entamoeba histolytica
KKFLELVEGNHDFIISF

SEQ ID NO: 2683146 - protein, 20 aa, Entamoeba histolytica
KKFNCKVGYLNGGIIFDNYH

SEQ ID NO: 2683147 - protein, 17 aa, Entamoeba histolytica
KKFPFAQEDTLYLLQYL

SEQ ID NO: 2683148 - protein, 17 aa, Entamoeba histolytica
KKFPMLDILSIKKSENN

SEQ ID NO: 2683149 - protein, 21 aa, Entamoeba histolytica
KKFTDNGSQMFVHFPTRVELF

SEQ ID NO: 2683150 - protein, 19 aa, Entamoeba histolytica
KKFVGGIVFSKEGMMGVKV

SEQ ID NO: 2683151 - protein, 22 aa, Entamoeba histolytica
KKFYDCQKLYKLFGGTRNEMKH

SEQ ID NO: 2683152 - protein, 19 aa, Entamoeba histolytica
KKGDKTGAAQHLRKKKMHE

SEQ ID NO: 2683153 - protein, 23 aa, Entamoeba histolytica
KKGEKYYPLALKLLIQNVSLHSF

SEQ ID NO: 2683154 - protein, 24 aa, Entamoeba histolytica
KKGELEWLIEIEFIHDGDISSVIM

SEQ ID NO: 2683155 - protein, 28 aa, Entamoeba histolytica
KKGEPRTMFKFILEFLKLSLQNEDTDEG

SEQ ID NO: 2683156 - protein, 20 aa, Entamoeba histolytica
KKGGVPGIFPSNFVQELLEK

SEQ ID NO: 2683157 - protein, 18 aa, Entamoeba histolytica
KKGIKIRSNEMVSKVFNE

SEQ ID NO: 2683158 - protein, 19 aa, Entamoeba histolytica
KKGIYVCISTGRMRNSAIK

SEQ ID NO: 2683159 - protein, 24 aa, Entamoeba histolytica
KKGKILFKNFDVIKTIKCLSIDGD

SEQ ID NO: 2683160 - protein, 23 aa, Entamoeba histolytica
KKGMFKIYMRGVVLALKNIDEPT

SEQ ID NO: 2683161 - protein, 18 aa, Entamoeba histolytica
KKGMKVGMKKGFKKGFHK

SEQ ID NO: 2683162 - protein, 19 aa, Entamoeba histolytica
KKGNTCKFIYYSKEDKKKF

SEQ ID NO: 2683163 - protein, 17 aa, Entamoeba histolytica
KKGRYLIHFGGVKITSK

SEQ ID NO: 2683164 - protein, 25 aa, Entamoeba histolytica
KKGSDKIVICFDRLIIVKGNTISHD

SEQ ID NO: 2683165 - protein, 19 aa, Entamoeba histolytica
KKGSSMLSVECVDGGDIKA

SEQ ID NO: 2683166 - protein, 18 aa, Entamoeba histolytica
KKGTEIISAISYESLSPI

SEQ ID NO: 2683167 - protein, 22 aa, Entamoeba histolytica
KKGVSRTIVLIGYKPKRFSDKV

SEQ ID NO: 2683168 - protein, 26 aa, Entamoeba histolytica
KKGYECKELSSLINQYWKGCVIDIGS

SEQ ID NO: 2683169 - protein, 19 aa, Entamoeba histolytica
KKGYGAKIFDGKVNPQVFN

SEQ ID NO: 2683170 - protein, 18 aa, Entamoeba histolytica
KKGYNCISYPSVMSVAGI

SEQ ID NO: 2683171 - protein, 19 aa, Entamoeba histolytica
KKGYYATGVPVVMKEGDIY

SEQ ID NO: 2683172 - protein, 19 aa, Entamoeba histolytica
KKHGMGMVVVRNGTHYGIA

SEQ ID NO: 2683173 - protein, 19 aa, Entamoeba histolytica
KKHIFCYKLKTSENNNIHQ

SEQ ID NO: 2683174 - protein, 18 aa, Entamoeba histolytica
KKHIPIMKNEIGMKHSLI

SEQ ID NO: 2683175 - protein, 27 aa, Entamoeba histolytica
KKHPYCDFCNIPFFDLESLYNHLNTQH

SEQ ID NO: 2683176 - protein, 24 aa, Entamoeba histolytica
KKIALEFYDKIAIAIDEVIDDGII

SEQ ID NO: 2683177 - protein, 23 aa, Entamoeba histolytica
KKICLPSSVESCFIKTMNYNARL

SEQ ID NO: 2683178 - protein, 24 aa, Entamoeba histolytica
KKICSRSVLIKTVYEIWGEAKTYE

SEQ ID NO: 2683179 - protein, 36 aa, Entamoeba histolytica
KKIDINEDFWLRQTFIEFLSWYVIVLLDEQNPLHIE

SEQ ID NO: 2683180 - protein, 33 aa, Entamoeba histolytica
KKIDVVGIEWIYDCLTCQLKIDRTGYCLNEEDL

SEQ ID NO: 2683181 - protein, 17 aa, Entamoeba histolytica
KKIENRRIFQSCESILP

SEQ ID NO: 2683182 - protein, 18 aa, Entamoeba histolytica
KKIFCVQITPSSITFLPP

SEQ ID NO: 2683183 - protein, 24 aa, Entamoeba histolytica
KKIFDYIHCYTKKPTIVSLSSTNC

SEQ ID NO: 2683184 - protein, 17 aa, Entamoeba histolytica
KKIFVICDKKLILINED

SEQ ID NO: 2683185 - protein, 23 aa, Entamoeba histolytica
KKIGRCCLHLIKPNEKVTIKNDF

SEQ ID NO: 2683186 - protein, 17 aa, Entamoeba histolytica
KKIHIMEYLQFLIKNSR

SEQ ID NO: 2683187 - protein, 20 aa, Entamoeba histolytica
KKIIADFRNGVLMVIAKLAI

SEQ ID NO: 2683188 - protein, 17 aa, Entamoeba histolytica
KKIIDAYIDYKVEKKVN

SEQ ID NO: 2683189 - protein, 22 aa, Entamoeba histolytica
KKIIWSTIIPFKVRSIIATETH

SEQ ID NO: 2683190 - protein, 27 aa, Entamoeba histolytica
KKIKKKKRRLNAIKMIYINILGYEVDV

SEQ ID NO: 2683191 - protein, 17 aa, Entamoeba histolytica
KKIKLQGYNGFAGGLDT

SEQ ID NO: 2683192 - protein, 23 aa, Entamoeba histolytica
KKIKRAVLPIVVYARTPNSRNVD

SEQ ID NO: 2683193 - protein, 20 aa, Entamoeba histolytica
KKIKSMIFMKELSHKNEEKP

SEQ ID NO: 2683194 - protein, 17 aa, Entamoeba histolytica
KKIKTCLSKIRSIANEI

SEQ ID NO: 2683195 - protein, 25 aa, Entamoeba histolytica
KKIKVRTVIALKGLLLDAFEECDES

SEQ ID NO: 2683196 - protein, 19 aa, Entamoeba histolytica
KKIMILSDIKYCILFEQQL

SEQ ID NO: 2683197 - protein, 21 aa, Entamoeba histolytica
KKINHEFGINPYIVGTLLFSL

SEQ ID NO: 2683198 - protein, 26 aa, Entamoeba histolytica
KKINKPRFIYLFNDMLMYGIGDERKL

SEQ ID NO: 2683199 - protein, 20 aa, Entamoeba histolytica
KKINSVVLKGAIKCAAAQTT

SEQ ID NO: 2683200 - protein, 18 aa, Entamoeba histolytica
KKIPCYKESTQIEVENDF

SEQ ID NO: 2683201 - protein, 21 aa, Entamoeba histolytica
KKIQIPYVFRYLAAELSAMNV

SEQ ID NO: 2683202 - protein, 25 aa, Entamoeba histolytica
KKIQPCLTGIFVALMRMFAAYTIIN

SEQ ID NO: 2683203 - protein, 18 aa, Entamoeba histolytica
KKIRFKDSLGLIPTSIAN

SEQ ID NO: 2683204 - protein, 20 aa, Entamoeba histolytica
KKIRLCYINENIVADIMTEL

SEQ ID NO: 2683205 - protein, 30 aa, Entamoeba histolytica
KKIRTETYSGISLRVIFPAFGGDAKTIQQL

SEQ ID NO: 2683206 - protein, 21 aa, Entamoeba histolytica
KKISIAFCGNSAVGKTALFTR

SEQ ID NO: 2683207 - protein, 19 aa, Entamoeba histolytica
KKISKLFSFFHPFTKEEKS

SEQ ID NO: 2683208 - protein, 19 aa, Entamoeba histolytica
KKISKVKCLLEHMEEYIIT

SEQ ID NO: 2683209 - protein, 25 aa, Entamoeba histolytica
KKISLPGLLFKFITIKPCDRKIFVG

SEQ ID NO: 2683210 - protein, 22 aa, Entamoeba histolytica
KKISLPSCRNLLYFNQIEMDED

SEQ ID NO: 2683211 - protein, 19 aa, Entamoeba histolytica
KKIVEEFIRITQSPAGVTL

SEQ ID NO: 2683212 - protein, 19 aa, Entamoeba histolytica
KKIVEWAQYISSALMNGEP

SEQ ID NO: 2683213 - protein, 18 aa, Entamoeba histolytica
KKIVNKRKKVFKVIFNNN

SEQ ID NO: 2683214 - protein, 33 aa, Entamoeba histolytica; identical to SEQ ID NO: 2490484

SEQ ID NO: 2683215 - protein, 18 aa, Entamoeba histolytica
KKIYNIVHVPTFILYHNG

SEQ ID NO: 2683216 - protein, 17 aa, Entamoeba histolytica
KKKAFWSIEEDRIIVKL

SEQ ID NO: 2683217 - protein, 20 aa, Entamoeba histolytica
KKKCAVMKELVLTKETPRKK

SEQ ID NO: 2683218 - protein, 25 aa, Entamoeba histolytica
KKKCDLGDFVLLCLQTLNKDSISSK

SEQ ID NO: 2683219 - protein, 21 aa, Entamoeba histolytica
KKKCSYIIHCYIRKEDTKFHR

SEQ ID NO: 2683220 - protein, 17 aa, Entamoeba histolytica
KKKEIRCVSSTNLDREG

SEQ ID NO: 2683221 - protein, 18 aa, Entamoeba histolytica
KKKELLLNPELDFDPCNP

SEQ ID NO: 2683222 - protein, 20 aa, Entamoeba histolytica
KKKENLLKWNNYKKSKHPLA

SEQ ID NO: 2683223 - protein, 19 aa, Entamoeba histolytica
KKKERKIWKIADDRLEEDL

SEQ ID NO: 2683224 - protein, 27 aa, Entamoeba histolytica
KKKGDPFWNSTFSFSFKNANNINIQIK

SEQ ID NO: 2683225 - protein, 18 aa, Entamoeba histolytica
KKKGLKLLSEAKCVLHLL

SEQ ID NO: 2683226 - protein, 18 aa, Entamoeba histolytica
KKKHKIFATEACRMSIMI

SEQ ID NO: 2683227 - protein, 22 aa, Entamoeba histolytica
KKKHYQLEIGFVYKKVKEIKTT

SEQ ID NO: 2683228 - protein, 19 aa, Entamoeba histolytica
KKKIENLIGKFAKRIIMED

SEQ ID NO: 2683229 - protein, 18 aa, Entamoeba histolytica
KKKIEVLKREEIWAKYRD

SEQ ID NO: 2683230 - protein, 27 aa, Entamoeba histolytica
KKKIKEGFKAKAKESFNIKNNVKKTFS

SEQ ID NO: 2683231 - protein, 20 aa, Entamoeba histolytica
KKKIKIKPLRTCKTGDQDLI

SEQ ID NO: 2683232 - protein, 22 aa, Entamoeba histolytica
KKKIMFEGKVMRNGVITKSEMF

SEQ ID NO: 2683233 - protein, 20 aa, Entamoeba histolytica
KKKKGVLTVDDWIFAMKSYG

SEQ ID NO: 2683234 - protein, 17 aa, Entamoeba histolytica
KKKKITKTISFEEESDD

SEQ ID NO: 2683235 - protein, 20 aa, Entamoeba histolytica
KKKKKGIFSKLFGKKKEETT

SEQ ID NO: 2683236 - protein, 21 aa, Entamoeba histolytica
KKKLIERLSQIKIIEPEQLRK

SEQ ID NO: 2683237 - protein, 20 aa, Entamoeba histolytica
KKKLMGHLNVLRGFSQLLKE

SEQ ID NO: 2683238 - protein, 18 aa, Entamoeba histolytica
KKKLMLVDIRNYKKGMKK

SEQ ID NO: 2683239 - protein, 22 aa, Entamoeba histolytica
KKKLNQVLMAFSPVELKMLTLD

SEQ ID NO: 2683240 - protein, 25 aa, Entamoeba histolytica
KKKLRFSLPNIRRLTGKGLTLKYLS

SEQ ID NO: 2683241 - protein, 26 aa, Entamoeba histolytica
KKKLSPRSSSIIFPKNKMPFLSTQPI

SEQ ID NO: 2683242 - protein, 19 aa, Entamoeba histolytica
KKKMMKIRHEEQKKAADIR

SEQ ID NO: 2683243 - protein, 20 aa, Entamoeba histolytica
KKKPGCSGKIVLDHSKKILD

SEQ ID NO: 2683244 - protein, 18 aa, Entamoeba histolytica
KKKQCFISSQVKHYKKMK

SEQ ID NO: 2683245 - protein, 23 aa, Entamoeba histolytica
KKKRDITELTQSYLIAKQNAEME

SEQ ID NO: 2683246 - protein, 18 aa, Entamoeba histolytica
KKKRLIRVSVQGMDKAYW

SEQ ID NO: 2683247 - protein, 19 aa, Entamoeba histolytica
KKKRSCSPVNIKYKETVSP

SEQ ID NO: 2683248 - protein, 19 aa, Entamoeba histolytica
KKKSGLSINMATAKREELI

SEQ ID NO: 2683249 - protein, 29 aa, Entamoeba histolytica
KKKTPEDFIDLLLEKKVEEKEKKPAKKNR

SEQ ID NO: 2683250 - protein, 19 aa, Entamoeba histolytica
KKKVIKKTICLDDEETDNL

SEQ ID NO: 2683251 - protein, 18 aa, Entamoeba histolytica
KKKVLIMFVNYYIYFFPL

SEQ ID NO: 2683252 - protein, 20 aa, Entamoeba histolytica
KKKVMREYTPKYTVNTKKKF

SEQ ID NO: 2683253 - protein, 19 aa, Entamoeba histolytica
KKKYFKFLVILSTIHELIL

SEQ ID NO: 2683254 - protein, 27 aa, Entamoeba histolytica
KKKYYCKKCLNYICYKCWNSTGKCCLK

SEQ ID NO: 2683255 - protein, 17 aa, Entamoeba histolytica
KKLAKKELKDEKKMTKG

SEQ ID NO: 2683256 - protein, 25 aa, Entamoeba histolytica
KKLELKYLFCSPISKGIELAEKNPS

SEQ ID NO: 2683257 - protein, 20 aa, Entamoeba histolytica
KKLERLTVCGKRCSGINKLK

SEQ ID NO: 2683258 - protein, 21 aa, Entamoeba histolytica
KKLESFAATPIQWNDIKSNYN

SEQ ID NO: 2683259 - protein, 27 aa, Entamoeba histolytica
KKLFEKYGEIKKVFCQIENRGIAFITF

SEQ ID NO: 2683260 - protein, 17 aa, Entamoeba histolytica
KKLFFSIINDFPSIKLK

SEQ ID NO: 2683261 - protein, 35 aa, Entamoeba histolytica
KKLFGRKGSPWEFNLRDILRFCKLYIEYSSNIENE

SEQ ID NO: 2683262 - protein, 18 aa, Entamoeba histolytica
KKLFPAHLREIIKNIFFK

SEQ ID NO: 2683263 - protein, 18 aa, Entamoeba histolytica
KKLFVLEKYPKIVYLQNG

SEQ ID NO: 2683264 - protein, 25 aa, Entamoeba histolytica
KKLGEGMCGKVYLAFHEKTGVKVAI

SEQ ID NO: 2683265 - protein, 25 aa, Entamoeba histolytica
KKLGVGITVKPKFAMDGDEINTNAP

SEQ ID NO: 2683266 - protein, 22 aa, Entamoeba histolytica
KKLHFQEYLALKKAIYRPQAFF

SEQ ID NO: 2683267 - protein, 25 aa, Entamoeba histolytica
KKLHLFIPRVPPFSVTLTFLTSLPK

SEQ ID NO: 2683268 - protein, 18 aa, Entamoeba histolytica
KKLHPMTDYFSLKKDIYL

SEQ ID NO: 2683269 - protein, 19 aa, Entamoeba histolytica
KKLHSSWVGVQLLLNIHDE

SEQ ID NO: 2683270 - protein, 18 aa, Entamoeba histolytica
KKLIEYAERYLLEKQKID

SEQ ID NO: 2683271 - protein, 24 aa, Entamoeba histolytica
KKLISMNCWLSFGRNVLNNNNIKI

SEQ ID NO: 2683272 - protein, 19 aa, Entamoeba histolytica
KKLKCSQAIVGLNQNNEVC

SEQ ID NO: 2683273 - protein, 22 aa, Entamoeba histolytica
KKLKEIPLMFHFNPILYNKQVD

SEQ ID NO: 2683274 - protein, 23 aa, Entamoeba histolytica
KKLKEVKTIFSVKLPVGPIDYQT

SEQ ID NO: 2683275 - protein, 20 aa, Entamoeba histolytica
KKLKRFIASLSKEGIHQLDK

SEQ ID NO: 2683276 - protein, 24 aa, Entamoeba histolytica
KKLKRIKISALLFDSFKQINEEIV

SEQ ID NO: 2683277 - protein, 22 aa, Entamoeba histolytica
KKLLRKIDCYMNEGGIKRKKEE

SEQ ID NO: 2683278 - protein, 21 aa, Entamoeba histolytica
KKLLRLMEVILLIGNYLNQGT

SEQ ID NO: 2683279 - protein, 17 aa, Entamoeba histolytica
KKLLTIYEFSLREFPKN

SEQ ID NO: 2683280 - protein, 18 aa, Entamoeba histolytica
KKLLVCASSNNAVDVICL

SEQ ID NO: 2683281 - protein, 19 aa, Entamoeba histolytica
KKLLVCASSNNAVDVICSK

SEQ ID NO: 2683282 - protein, 21 aa, Entamoeba histolytica
KKLMWMSMEYMDGGCLTDILE

SEQ ID NO: 2683283 - protein, 21 aa, Entamoeba histolytica
KKLNGILDICRANYNSRNIQF

SEQ ID NO: 2683284 - protein, 20 aa, Entamoeba histolytica
KKLNNFEGMKAVFSALESTP

SEQ ID NO: 2683285 - protein, 20 aa, Entamoeba histolytica
KKLNNFEGMKAVLSALESSP

SEQ ID NO: 2683286 - protein, 22 aa, Entamoeba histolytica
KKLPAGGILVFLTGHKEIEEVC

SEQ ID NO: 2683287 - protein, 21 aa, Entamoeba histolytica
KKLPKSFVIRRGKIGKSSKAL

SEQ ID NO: 2683288 - protein, 19 aa, Entamoeba histolytica
KKLPTKVLDSFQFVFLFLH

SEQ ID NO: 2683289 - protein, 20 aa, Entamoeba histolytica
KKLQEQIIKEKQENENYLKQ

SEQ ID NO: 2683290 - protein, 19 aa, Entamoeba histolytica
KKLQLKFALQLISRSYTLK

SEQ ID NO: 2683291 - protein, 17 aa, Entamoeba histolytica
KKLQSQFSLYVSSVNSL

SEQ ID NO: 2683292 - protein, 24 aa, Entamoeba histolytica
KKLRKSNEVIGIKGLKEYCDEVKM

SEQ ID NO: 2683293 - protein, 25 aa, Entamoeba histolytica
KKLTKEPFLNMFIKRTVEQGDDLLF

SEQ ID NO: 2683294 - protein, 26 aa, Entamoeba histolytica
KKLTTKCPICSAITLKDKLNEHAKLH

SEQ ID NO: 2683295 - protein, 18 aa, Entamoeba histolytica
KKLVKFMKGEVEVIQDLD

SEQ ID NO: 2683296 - protein, 28 aa, Entamoeba histolytica
KKLYYYKDLCCFCIEKDQLSSWMTIIKA

SEQ ID NO: 2683297 - protein, 20 aa, Entamoeba histolytica
KKMIKSCFGVSTITEIANNS

SEQ ID NO: 2683298 - protein, 25 aa, Entamoeba histolytica
KKMKKLKLSGGIEEIERGWIWNSYI

SEQ ID NO: 2683299 - protein, 23 aa, Entamoeba histolytica
KKMNNSYCIFVGKVSSITTESTL

SEQ ID NO: 2683300 - protein, 21 aa, Entamoeba histolytica
KKMPLNYAQTILFGEGEEIGE

SEQ ID NO: 2683301 - protein, 18 aa, Entamoeba histolytica
KKMSGCRPLAYQVDDEKG

SEQ ID NO: 2683302 - protein, 21 aa, Entamoeba histolytica
KKMTSFWRRHLEDVIVGEQLH

SEQ ID NO: 2683303 - protein, 18 aa, Entamoeba histolytica
KKNATVCACFITEDFLTF

SEQ ID NO: 2683304 - protein, 22 aa, Entamoeba histolytica
KKNEEMNRLWASSQVQIDEPDG

SEQ ID NO: 2683305 - protein, 18 aa, Entamoeba histolytica
KKNFAMLLKSLIKANPKP

SEQ ID NO: 2683306 - protein, 20 aa, Entamoeba histolytica
KKNFKYHGKKDFKSYKKHQQ

SEQ ID NO: 2683307 - protein, 25 aa, Entamoeba histolytica
KKNGKCLIVNNVLRYLNCEKEYYDA

SEQ ID NO: 2683308 - protein, 27 aa, Entamoeba histolytica
KKNGRLPAIEFMFGLPLETPRNKQRRQ

SEQ ID NO: 2683309 - protein, 21 aa, Entamoeba histolytica
KKNGVGILMEMCFNHKHLLLP

SEQ ID NO: 2683310 - protein, 19 aa, Entamoeba histolytica
KKNIEHILGMIKRLQPIEV

SEQ ID NO: 2683311 - protein, 21 aa, Entamoeba histolytica
KKNIKKICEKYGFRVELKYYR

SEQ ID NO: 2683312 - protein, 21 aa, Entamoeba histolytica
KKNIVRYIFDIGYWIGKNKGN

SEQ ID NO: 2683313 - protein, 18 aa, Entamoeba histolytica
KKNNFLGSIEMKTLGLVG

SEQ ID NO: 2683314 - protein, 26 aa, Entamoeba histolytica
KKNPLQCSLGLMNGCIIFIEAQTPNL

SEQ ID NO: 2683315 - protein, 19 aa, Entamoeba histolytica
KKNQIRISLWVGEHDDSKA

SEQ ID NO: 2683316 - protein, 24 aa, Entamoeba histolytica
KKNRLKFMMRNGLINNVTQCLDML

SEQ ID NO: 2683317 - protein, 20 aa, Entamoeba histolytica
KKNRLSRSFLGLFDKKKKEK

SEQ ID NO: 2683318 - protein, 25 aa, Entamoeba histolytica
KKNRVLFMYFDLFMKYLQFVQPILT

SEQ ID NO: 2683319 - protein, 18 aa, Entamoeba histolytica
KKNSCPRHMKVVTTESRC

SEQ ID NO: 2683320 - protein, 21 aa, Entamoeba histolytica
KKNVFDIEMVDSMGIEKDDPN

SEQ ID NO: 2683321 - protein, 25 aa, Entamoeba histolytica
KKNVGIGMCTIRFSVEVADKNHKQA

SEQ ID NO: 2683322 - protein, 28 aa, Entamoeba histolytica
KKNYLPPVPLVFGIGIMFAVEKEDKENH

SEQ ID NO: 2683323 - protein, 23 aa, Entamoeba histolytica
KKPFETIPYRFSESGNIREPLYS

SEQ ID NO: 2683324 - protein, 18 aa, Entamoeba histolytica
KKPFFISLPCKRNIPMEQ

SEQ ID NO: 2683325 - protein, 26 aa, Entamoeba histolytica
KKPFIKPKEGIVFIVDCHSYDDQPFD

SEQ ID NO: 2683326 - protein, 24 aa, Entamoeba histolytica
KKPFRGGFDSCWLCEKGIESINFF

SEQ ID NO: 2683327 - protein, 19 aa, Entamoeba histolytica
KKPGCKGKIKLDHSKRILD

SEQ ID NO: 2683328 - protein, 23 aa, Entamoeba histolytica
KKPGCVPTCPAHIDIPGFISELK

SEQ ID NO: 2683329 - protein, 22 aa, Entamoeba histolytica
KKPGCVPTCPAHINIPEYIIHL

SEQ ID NO: 2683330 - protein, 20 aa, Entamoeba histolytica
KKPIFKGCVCVASDKESHQP

SEQ ID NO: 2683331 - protein, 26 aa, Entamoeba histolytica
KKPIPPCPSKNLFPLIQYQPPNSSKV

SEQ ID NO: 2683332 - protein, 19 aa, Entamoeba histolytica
KKPIPVFVEKPGKNWGPAC

SEQ ID NO: 2683333 - protein, 25 aa, Entamoeba histolytica
KKPITFKAKIHRKRKNEDVSQEEEE

SEQ ID NO: 2683334 - protein, 20 aa, Entamoeba histolytica
KKPKKKWDVVNEDFLKLLKE

SEQ ID NO: 2683335 - protein, 21 aa, Entamoeba histolytica
KKPKLPLSLRKESDIIQPKQS

SEQ ID NO: 2683336 - protein, 21 aa, Entamoeba histolytica
KKPKVKWEVTVKMTKDIKNMV

SEQ ID NO: 2683337 - protein, 23 aa, Entamoeba histolytica
KKPLRGSCVQLVIQENCSHGRDS

SEQ ID NO: 2683338 - protein, 23 aa, Entamoeba histolytica
KKPMEIPQFVTALKYVSFAQKGI

SEQ ID NO: 2683339 - protein, 19 aa, Entamoeba histolytica
KKPPSIDSIHIFIKSLDFL

SEQ ID NO: 2683340 - protein, 19 aa, Entamoeba histolytica
KKPTKVMRRPIGIQQLKQD

SEQ ID NO: 2683341 - protein, 17 aa, Entamoeba histolytica
KKPVHKFKISKKKRFSL

SEQ ID NO: 2683342 - protein, 18 aa, Entamoeba histolytica
KKPVLKMTISLNHSQKTK

SEQ ID NO: 2683343 - protein, 27 aa, Entamoeba histolytica
KKPYWSLVYRIARKKGLMWDKPQIKKV

SEQ ID NO: 2683344 - protein, 18 aa, Entamoeba histolytica
KKQAIRFNAICAEPQTTA

SEQ ID NO: 2683345 - protein, 24 aa, Entamoeba histolytica
KKQEKRIGLLKGKMKNLTEELDGF

SEQ ID NO: 2683346 - protein, 23 aa, Entamoeba histolytica
KKQFHASEPIEWDNVKKVSHPVE

SEQ ID NO: 2683347 - protein, 25 aa, Entamoeba histolytica
KKQFPAMIIPISLRVNELIKDFPLL

SEQ ID NO: 2683348 - protein, 19 aa, Entamoeba histolytica
KKQFPDLKISEIGKKIGVE

SEQ ID NO: 2683349 - protein, 24 aa, Entamoeba histolytica
KKQGGAPCNFAMHMAQFGFESYAF

SEQ ID NO: 2683350 - protein, 24 aa, Entamoeba histolytica
KKQIKRIIKWFDMVFPKAVQLRWK

SEQ ID NO: 2683351 - protein, 20 aa, Entamoeba histolytica
KKQIPQFILFTTPKNCREVT

SEQ ID NO: 2683352 - protein, 19 aa, Entamoeba histolytica
KKQKEILEGHVSMEELEDY

SEQ ID NO: 2683353 - protein, 24 aa, Entamoeba histolytica
KKQKITSTWSRTFFFLLDGISQYR

SEQ ID NO: 2683354 - protein, 18 aa, Entamoeba histolytica
KKQKKFELIFAVYATDRL

SEQ ID NO: 2683355 - protein, 25 aa, Entamoeba histolytica
KKQKLSFRFRQDFGSAHVIAKIGET

SEQ ID NO: 2683356 - protein, 21 aa, Entamoeba histolytica
KKQLLDCFDVKPPQPSLVDSI

SEQ ID NO: 2683357 - protein, 26 aa, Entamoeba histolytica
KKQLYDCLMMQNIPKGVIFKDKLKTN

SEQ ID NO: 2683358 - protein, 23 aa, Entamoeba histolytica
KKQMKYPILFLTEGMFDNRIVDT

SEQ ID NO: 2683359 - protein, 24 aa, Entamoeba histolytica
KKQNFRLVLINGKYYLQAESQEQM

SEQ ID NO: 2683360 - protein, 19 aa, Entamoeba histolytica
KKQPEVVVMVFTDFQRVLR

SEQ ID NO: 2683361 - protein, 21 aa, Entamoeba histolytica
KKQQQVLCRFELKQLFLQAPM

SEQ ID NO: 2683362 - protein, 18 aa, Entamoeba histolytica
KKQRLKEKYQRLKEQKEE

SEQ ID NO: 2683363 - protein, 20 aa, Entamoeba histolytica
KKQYYCLLKTISQKHFIGVV

SEQ ID NO: 2683364 - protein, 21 aa, Entamoeba histolytica
KKQYYCLLKTISQKHFIGVVG

SEQ ID NO: 2683365 - protein, 21 aa, Entamoeba histolytica
KKRALITLRQLYKFQPNVLSI

SEQ ID NO: 2683366 - protein, 18 aa, Entamoeba histolytica
KKRGEVFDLLKLNEYLTY

SEQ ID NO: 2683367 - protein, 19 aa, Entamoeba histolytica
KKRKGEMNSNDFFENYSKA

SEQ ID NO: 2683368 - protein, 19 aa, Entamoeba histolytica
KKRKLKQSDFVKGGDKAKN

SEQ ID NO: 2683369 - protein, 22 aa, Entamoeba histolytica
KKRKMPIIIKKVNGINQYVNEP

SEQ ID NO: 2683370 - protein, 17 aa, Entamoeba histolytica
KKRLKDISIKREFEDGK

SEQ ID NO: 2683371 - protein, 19 aa, Entamoeba histolytica
KKRNAIIMKGFQVEDLAQH

SEQ ID NO: 2683372 - protein, 20 aa, Entamoeba histolytica
KKRRAGYRAFSMVDILNSEQ

SEQ ID NO: 2683373 - protein, 17 aa, Entamoeba histolytica
KKRRRKFSLFAFSDKKS

SEQ ID NO: 2683374 - protein, 18 aa, Entamoeba histolytica
KKRSCRKLLTIPFLQIQR

SEQ ID NO: 2683375 - protein, 27 aa, Entamoeba histolytica
KKRSSEIKMKLLFPPKVDSEEWKEKPI

SEQ ID NO: 2683376 - protein, 26 aa, Entamoeba histolytica
KKRVSYLMMKMICEWVNEEMINELHI

SEQ ID NO: 2683377 - protein, 20 aa, Entamoeba histolytica
KKSCIIFFDEIDAIGGTRFQ

SEQ ID NO: 2683378 - protein, 22 aa, Entamoeba histolytica
KKSEKFFKVFVPVFIQCFHDQL

SEQ ID NO: 2683379 - protein, 17 aa, Entamoeba histolytica
KKSFLICDYCRDGDSYR

SEQ ID NO: 2683380 - protein, 18 aa, Entamoeba histolytica
KKSIFGPSVGINFNGYKS

SEQ ID NO: 2683381 - protein, 31 aa, Entamoeba histolytica
KKSILPRLPLTRRPRNKILYGSTLGSISEIP

SEQ ID NO: 2683382 - protein, 20 aa, Entamoeba histolytica
KKSKFNLYLSKSINNLSIDA

SEQ ID NO: 2683383 - protein, 19 aa, Entamoeba histolytica
KKSLGYGFIEFETKEGCEN

SEQ ID NO: 2683384 - protein, 20 aa, Entamoeba histolytica
KKSNFHISMKKFEFKKPNLM

SEQ ID NO: 2683385 - protein, 22 aa, Entamoeba histolytica
KKSPCFKDLDFVEQKAEIHIGP

SEQ ID NO: 2683386 - protein, 26 aa, Entamoeba histolytica
KKSSKKINVSFVRFEMDFDNYNDESW

SEQ ID NO: 2683387 - protein, 17 aa, Entamoeba histolytica
KKSVIPWTSNDDEKLLN

SEQ ID NO: 2683388 - protein, 17 aa, Entamoeba histolytica
KKTAMKGVVQLFNAIAE

SEQ ID NO: 2683389 - protein, 24 aa, Entamoeba histolytica
KKTIGIKCPLKIYKEGSPQYFQII

SEQ ID NO: 2683390 - protein, 19 aa, Entamoeba histolytica
KKTITCLWNKLFKQINKMV

SEQ ID NO: 2683391 - protein, 17 aa, Entamoeba histolytica
KKTKRTPPIKIIDTPGF

SEQ ID NO: 2683392 - protein, 20 aa, Entamoeba histolytica
KKTLIKRIKLEKENKIQQQQ

SEQ ID NO: 2683393 - protein, 23 aa, Entamoeba histolytica
KKTLSVKWKYIIDKSTILIPNDN

SEQ ID NO: 2683394 - protein, 26 aa, Entamoeba histolytica
KKTRPCHKTTRLVRVSSLTFGSKTYS

SEQ ID NO: 2683395 - protein, 24 aa, Entamoeba histolytica
KKTSEYKCCYSFKENRDYQSEQES

SEQ ID NO: 2683396 - protein, 18 aa, Entamoeba histolytica
KKVCYNFKEIENFDELFK

SEQ ID NO: 2683397 - protein, 17 aa, Entamoeba histolytica
KKVERIGNLSFVYISTN

SEQ ID NO: 2683398 - protein, 20 aa, Entamoeba histolytica
KKVESIWRVFHSPIVGTKKM

SEQ ID NO: 2683399 - protein, 18 aa, Entamoeba histolytica
KKVFSLDDLPGFGTNELR

SEQ ID NO: 2683400 - protein, 18 aa, Entamoeba histolytica
KKVGKLEVGYILFNAFKN

SEQ ID NO: 2683401 - protein, 35 aa, Entamoeba histolytica
KKVISEALCAISFIALKMKFNFVHYYPEVLQVLKT

SEQ ID NO: 2683402 - protein, 19 aa, Entamoeba histolytica
KKVKKDEWGSIQQKLKEGY

SEQ ID NO: 2683403 - protein, 17 aa, Entamoeba histolytica
KKVLDLIKIKIDEYQLT

SEQ ID NO: 2683404 - protein, 22 aa, Entamoeba histolytica
KKVLRIGMRPLKTIPLKSLSPV

SEQ ID NO: 2683405 - protein, 19 aa, Entamoeba histolytica
KKVLVCAPSNIAVDQLGTK

SEQ ID NO: 2683406 - protein, 27 aa, Entamoeba histolytica
KKVMDLGFKGPFLIITNKENLGFYQEN

SEQ ID NO: 2683407 - protein, 20 aa, Entamoeba histolytica
KKVNMFWSLRDFKQRTQNET

SEQ ID NO: 2683408 - protein, 30 aa, Entamoeba histolytica
KKVPFNVNEMWKNWRVKLAANPKTASYLND

SEQ ID NO: 2683409 - protein, 17 aa, Entamoeba histolytica
KKVPIVFICHTGKERYC

SEQ ID NO: 2683410 - protein, 17 aa, Entamoeba histolytica
KKVREIMEISRCNEEIG

SEQ ID NO: 2683411 - protein, 28 aa, Entamoeba histolytica
KKVRELWCAKYEEDFYCWVKTGEKIKFE

SEQ ID NO: 2683412 - protein, 22 aa, Entamoeba histolytica
KKVSKVSGWKRRWVVLCRGFLF

SEQ ID NO: 2683413 - protein, 18 aa, Entamoeba histolytica
KKVTQFFEKIFVIDPFER

SEQ ID NO: 2683414 - protein, 22 aa, Entamoeba histolytica
KKVVDWCNITGLSLIQTLPVND

SEQ ID NO: 2683415 - protein, 23 aa, Entamoeba histolytica
KKWDNALFWGCIISYNGDEAILG

SEQ ID NO: 2683416 - protein, 17 aa, Entamoeba histolytica
KKWFTEVLSNGWTETTK

SEQ ID NO: 2683417 - protein, 18 aa, Entamoeba histolytica
KKWKIIITKRNKIEEEIK

SEQ ID NO: 2683418 - protein, 19 aa, Entamoeba histolytica
KKWNELKTTVSAFTSQFGQ

SEQ ID NO: 2683419 - protein, 18 aa, Entamoeba histolytica
KKWPIGNIKFETMSLKQQ

SEQ ID NO: 2683420 - protein, 22 aa, Entamoeba histolytica
KKYADQFISVFIDGVNTLCTSD

SEQ ID NO: 2683421 - protein, 17 aa, Entamoeba histolytica
KKYAEKLLKECKEINVI

SEQ ID NO: 2683422 - protein, 19 aa, Entamoeba histolytica
KKYCCDGYNGETMYKLVGI

SEQ ID NO: 2683423 - protein, 18 aa, Entamoeba histolytica
KKYCEGKTILVFDIGGGT

SEQ ID NO: 2683424 - protein, 20 aa, Entamoeba histolytica
KKYCPLLFSKISFKYRIMNR

SEQ ID NO: 2683425 - protein, 27 aa, Entamoeba histolytica
KKYDYVCALKVIFKRQLQKCEMGIQMK

SEQ ID NO: 2683426 - protein, 34 aa, Entamoeba histolytica
KKYDYVCALKVIFKRQLQKCGMGIQMKREIELQS

SEQ ID NO: 2683427 - protein, 24 aa, Entamoeba histolytica
KKYEKKPRRPGLIQHETLQQQMKA

SEQ ID NO: 2683428 - protein, 19 aa, Entamoeba histolytica
KKYFESVKTLPIYQQISDF

SEQ ID NO: 2683429 - protein, 21 aa, Entamoeba histolytica
KKYFGILFIKLPQEFIEFLEE

SEQ ID NO: 2683430 - protein, 18 aa, Entamoeba histolytica
KKYGFFIVPNPNYIIIDF

SEQ ID NO: 2683431 - protein, 24 aa, Entamoeba histolytica
KKYGKENWKSVADCIPNKTRKQCR

SEQ ID NO: 2683432 - protein, 20 aa, Entamoeba histolytica
KKYGLGLPMFSRLLQLGHEP

SEQ ID NO: 2683433 - protein, 33 aa, Entamoeba histolytica
KKYIDLSICERIFKELCCAVQFIQKEFNLIHRD

SEQ ID NO: 2683434 - protein, 17 aa, Entamoeba histolytica
KKYIENLSMITAEDIVS

SEQ ID NO: 2683435 - protein, 26 aa, Entamoeba histolytica
KKYIEPSDWILFYLFNCVDREQHVMN

SEQ ID NO: 2683436 - protein, 19 aa, Entamoeba histolytica
KKYIMPYCYIKILEDYDQK

SEQ ID NO: 2683437 - protein, 19 aa, Entamoeba histolytica
KKYIQFVIENNIRYEINTT

SEQ ID NO: 2683438 - protein, 20 aa, Entamoeba histolytica
KKYKRMVCIESVWYKANAVL

SEQ ID NO: 2683439 - protein, 23 aa, Entamoeba histolytica
KKYKTKLVIMLLKYQCFSSEINQ

SEQ ID NO: 2683440 - protein, 19 aa, Entamoeba histolytica
KKYLCTGFDLFTTHEPCLM

SEQ ID NO: 2683441 - protein, 24 aa, Entamoeba histolytica
KKYLKEFMMSIIINASYTTSISGV

SEQ ID NO: 2683442 - protein, 18 aa, Entamoeba histolytica
KKYLNLMPNKLPISLQTV

SEQ ID NO: 2683443 - protein, 22 aa, Entamoeba histolytica
KKYMVTFPFPYMNGRLHLGHTF

SEQ ID NO: 2683444 - protein, 25 aa, Entamoeba histolytica
KKYNCKMIDFAHNWILSEEECTVED

SEQ ID NO: 2683445 - protein, 25 aa, Entamoeba histolytica
KKYNYVCALKVIFKRQLQQYRMGIQ

SEQ ID NO: 2683446 - protein, 25 aa, Entamoeba histolytica
KKYPNCKEWDIGIVTPYRQQLLLIK

SEQ ID NO: 2683447 - protein, 24 aa, Entamoeba histolytica
KKYQCLSLSLVQIFKGLLTEPNYE

SEQ ID NO: 2683448 - protein, 22 aa, Entamoeba histolytica
KKYQWSELRLPISEIDLKQTKT

SEQ ID NO: 2683449 - protein, 24 aa, Entamoeba histolytica
KKYSCPECGKKFRTMAEVRRHSVT

SEQ ID NO: 2683450 - protein, 22 aa, Entamoeba histolytica
KKYSSLLKKLWENEKLLDKYNL

SEQ ID NO: 2683451 - protein, 22 aa, Entamoeba histolytica
KKYTKKWADIHIKELDMKNYLK

SEQ ID NO: 2683452 - protein, 21 aa, Entamoeba histolytica
KKYVVDFVQMWIEAINPEFHV

SEQ ID NO: 2683453 - protein, 21 aa, Entamoeba histolytica
KKYWKGMIKPVMIRVKTCFIE

SEQ ID NO: 2683454 - protein, 17 aa, Entamoeba histolytica
KKYWLYLVVSEAGEINV

SEQ ID NO: 2683455 - protein, 19 aa, Entamoeba histolytica
KKYYCKSTPNPKPFHQIKF

SEQ ID NO: 2683456 - protein, 21 aa, Entamoeba histolytica
KLAACVVLPLVISSLVQATGK

SEQ ID NO: 2683457 - protein, 21 aa, Entamoeba histolytica
KLADEWKVLFFETSAKAKINI

SEQ ID NO: 2683458 - protein, 19 aa, Entamoeba histolytica
KLAEIFKCGVNELPLHLIL

SEQ ID NO: 2683459 - protein, 17 aa, Entamoeba histolytica
KLAEWIDRWDLRHPQNK

SEQ ID NO: 2683460 - protein, 24 aa, Entamoeba histolytica
KLAGDCINSIILKREDLFDRFIEE

SEQ ID NO: 2683461 - protein, 23 aa, Entamoeba histolytica
KLAHFLKTYCSYVNSTDAINEHE

SEQ ID NO: 2683462 - protein, 19 aa, Entamoeba histolytica
KLALANRVDKIYTQRIILF

SEQ ID NO: 2683463 - protein, 18 aa, Entamoeba histolytica
KLALWKGDITKLCVDAIV

SEQ ID NO: 2683464 - protein, 19 aa, Entamoeba histolytica
KLAQPFICHPDILKSVGNK

SEQ ID NO: 2683465 - protein, 24 aa, Entamoeba histolytica
KLASHSNFFLRPSWSPEGTQLVMV

SEQ ID NO: 2683466 - protein, 20 aa, Entamoeba histolytica
KLASLKAWLKKSLDETARKY

SEQ ID NO: 2683467 - protein, 28 aa, Entamoeba histolytica
KLAYEQFKIPILMDVKDLVCERPDPKSI

SEQ ID NO: 2683468 - protein, 19 aa, Entamoeba histolytica
KLCIDECENCQFIINKNQI

SEQ ID NO: 2683469 - protein, 21 aa, Entamoeba histolytica
KLCKDFQGVVLPVVRALMVNF

SEQ ID NO: 2683470 - protein, 17 aa, Entamoeba histolytica
KLDEASQLKLRMIKLEK

SEQ ID NO: 2683471 - protein, 25 aa, Entamoeba histolytica
KLDEMCYRLNKFIITLFPEYKDVFN

SEQ ID NO: 2683472 - protein, 30 aa, Entamoeba histolytica
KLDGCTGCYACSPKESFYCVIKDGFEEVMQ

SEQ ID NO: 2683473 - protein, 20 aa, Entamoeba histolytica
KLDGYLLEYAKLACAISKKR

SEQ ID NO: 2683474 - protein, 21 aa, Entamoeba histolytica
KLDIKTLMKLFGHIKTTRARR

SEQ ID NO: 2683475 - protein, 19 aa, Entamoeba histolytica
KLDNCQFGYINAKDLVSHI

SEQ ID NO: 2683476 - protein, 29 aa, Entamoeba histolytica
KLDNWKKECAYLRWIYITLNAGKHFYKKH

SEQ ID NO: 2683477 - protein, 19 aa, Entamoeba histolytica
KLDYSHSLLCNKIKGLFNY

SEQ ID NO: 2683478 - protein, 18 aa, Entamoeba histolytica
KLEAITKDELINWLNNEL

SEQ ID NO: 2683479 - protein, 19 aa, Entamoeba histolytica
KLECYKAAISDAERCVEID

SEQ ID NO: 2683480 - protein, 19 aa, Entamoeba histolytica
KLEDYRSIFDELITPIEKE

SEQ ID NO: 2683481 - protein, 19 aa, Entamoeba histolytica
KLEKLSIIVCEKVRRIVLP

SEQ ID NO: 2683482 - protein, 18 aa, Entamoeba histolytica
KLENFKCPVEYNEKLMEV

SEQ ID NO: 2683483 - protein, 21 aa, Entamoeba histolytica
KLENRGWHYLIRKLIKQAHPQ

SEQ ID NO: 2683484 - protein, 19 aa, Entamoeba histolytica
KLENVMLCGVNLKVKLADF

SEQ ID NO: 2683485 - protein, 20 aa, Entamoeba histolytica
KLERFGIALKFLMTDIMSIR

SEQ ID NO: 2683486 - protein, 18 aa, Entamoeba histolytica
KLERNVVCLDPNSYEEGV

SEQ ID NO: 2683487 - protein, 23 aa, Entamoeba histolytica
KLESGNFNELVRWVKEDWFQKKF

SEQ ID NO: 2683488 - protein, 18 aa, Entamoeba histolytica
KLFDLFAKEYINEHPNEK

SEQ ID NO: 2683489 - protein, 17 aa, Entamoeba histolytica
KLFDLGFNIGMRMLEVI

SEQ ID NO: 2683490 - protein, 21 aa, Entamoeba histolytica
KLFDNLWRMNGMDWRMTTFRV

SEQ ID NO: 2683491 - protein, 19 aa, Entamoeba histolytica
KLFEALFGCLKRGTRAVFQ

SEQ ID NO: 2683492 - protein, 27 aa, Entamoeba histolytica
KLFEIKFKFGSMVICSPPIDCLHNEIE

SEQ ID NO: 2683493 - protein, 26 aa, Entamoeba histolytica
KLFEKLSYRSLMLWILYDDIPEFEKE

SEQ ID NO: 2683494 - protein, 25 aa, Entamoeba histolytica
KLFELFGIQCEFYFLFNNEIGENKG

SEQ ID NO: 2683495 - protein, 22 aa, Entamoeba histolytica
KLFEWKVPLPQCGNVYIVCLEK

SEQ ID NO: 2683496 - protein, 25 aa, Entamoeba histolytica
KLFGEPLAQVVLCLDHIRYELAVNV

SEQ ID NO: 2683497 - protein, 22 aa, Entamoeba histolytica
KLFKEGVCNVCNQKVEDPVKHA

SEQ ID NO: 2683498 - protein, 18 aa, Entamoeba histolytica
KLFMCISHTCKEAVGMLH

SEQ ID NO: 2683499 - protein, 17 aa, Entamoeba histolytica
KLFNSKVNQMFDRFKKS

SEQ ID NO: 2683500 - protein, 17 aa, Entamoeba histolytica
KLFNYFSEFVMQKSLDK

SEQ ID NO: 2683501 - protein, 20 aa, Entamoeba histolytica
KLFPEKLDQFNPAFVIVDQE

SEQ ID NO: 2683502 - protein, 27 aa, Entamoeba histolytica
KLFRTFWFYCVVLKFVIKEEYNEIYYT

SEQ ID NO: 2683503 - protein, 20 aa, Entamoeba histolytica
KLFVKCEEWFGLGEATPYEM

SEQ ID NO: 2683504 - protein, 17 aa, Entamoeba histolytica
KLGDFGLSRVFRSESKH

SEQ ID NO: 2683505 - protein, 19 aa, Entamoeba histolytica
KLGDYCFKGSTSLKSINIP

SEQ ID NO: 2683506 - protein, 20 aa, Entamoeba histolytica
KLGDYCFKGSTSLKSINIPT

SEQ ID NO: 2683507 - protein, 17 aa, Entamoeba histolytica
KLGICFRTFSDRLNDVT

SEQ ID NO: 2683508 - protein, 25 aa, Entamoeba histolytica
KLGLPRGSLKFEKKQFITCKSNPEK

SEQ ID NO: 2683509 - protein, 19 aa, Entamoeba histolytica
KLGLTTSRVKKILIDIFQI

SEQ ID NO: 2683510 - protein, 28 aa, Entamoeba histolytica
KLGNEIECLLPITCCVAEKVLEQLKEIH

SEQ ID NO: 2683511 - protein, 21 aa, Entamoeba histolytica
KLGNGCFERCTSLSLINIPRG

SEQ ID NO: 2683512 - protein, 26 aa, Entamoeba histolytica
KLGQLFTVWFNTWFVKGTTLTLTKLE

SEQ ID NO: 2683513 - protein, 25 aa, Entamoeba histolytica
KLGRTKCKFMLIQIDSVRDGIIPCI

SEQ ID NO: 2683514 - protein, 20 aa, Entamoeba histolytica
KLGRYLLRQVYSFILSDKDF

SEQ ID NO: 2683515 - protein, 22 aa, Entamoeba histolytica
KLGYECFYECYSLTSITIPTSV

SEQ ID NO: 2683516 - protein, 18 aa, Entamoeba histolytica
KLHFDLRVVDGSDVVSEG

SEQ ID NO: 2683517 - protein, 19 aa, Entamoeba histolytica
KLHIGHICKSFGIRDTPTS

SEQ ID NO: 2683518 - protein, 17 aa, Entamoeba histolytica
KLHLEVLEKDTIQFDPM

SEQ ID NO: 2683519 - protein, 21 aa, Entamoeba histolytica
KLHLLCTSLNHLIHQYLSHSF

SEQ ID NO: 2683520 - protein, 19 aa, Entamoeba histolytica
KLHPKRFLLIKEYIKSLFI

SEQ ID NO: 2683521 - protein, 17 aa, Entamoeba histolytica
KLIAAGIMKQSDLPIEE

SEQ ID NO: 2683522 - protein, 24 aa, Entamoeba histolytica
KLIAKIQCKGGIIKIHRDYIINYV

SEQ ID NO: 2683523 - protein, 22 aa, Entamoeba histolytica
KLICPLCVKSILEPNKLEKDEE

SEQ ID NO: 2683524 - protein, 25 aa, Entamoeba histolytica
KLICSCSTEQYCVMLYHQLLEKIKK

SEQ ID NO: 2683525 - protein, 18 aa, Entamoeba histolytica
KLIDIFTLLGRVGAAACS

SEQ ID NO: 2683526 - protein, 18 aa, Entamoeba histolytica
KLIECLRKEIQKDRVKEE

SEQ ID NO: 2683527 - protein, 20 aa, Entamoeba histolytica
KLIEEYPVFIGMKNLKGETP

SEQ ID NO: 2683528 - protein, 19 aa, Entamoeba histolytica
KLIEKVIKHSTGFLDEMNH

SEQ ID NO: 2683529 - protein, 27 aa, Entamoeba histolytica
KLIIDWFGRFGIEVGDFKTSFNDGLLI

SEQ ID NO: 2683530 - protein, 20 aa, Entamoeba histolytica
KLIINKSNVRICLLDHTSMT

SEQ ID NO: 2683531 - protein, 20 aa, Entamoeba histolytica
KLIKEIDLNISLPLYTVNAC

SEQ ID NO: 2683532 - protein, 22 aa, Entamoeba histolytica
KLIKISEEFNVAVVITNQVMSD

SEQ ID NO: 2683533 - protein, 17 aa, Entamoeba histolytica
KLILVGCKSDLEGNRQI

SEQ ID NO: 2683534 - protein, 23 aa, Entamoeba histolytica
KLINTCREVFQWIKKSDRYIVRV

SEQ ID NO: 2683535 - protein, 26 aa, Entamoeba histolytica
KLIPQHSVPFAWTNPDGRRLLVINGV

SEQ ID NO: 2683536 - protein, 19 aa, Entamoeba histolytica
KLIPTLAIPPRHAFLPLYQ

SEQ ID NO: 2683537 - protein, 29 aa, Entamoeba histolytica
KLIQWKKYYCEICGIILNGEKEWNIHLIS

SEQ ID NO: 2683538 - protein, 22 aa, Entamoeba histolytica
KLIRMAKSFGLEVTCSASAITQ

SEQ ID NO: 2683539 - protein, 17 aa, Entamoeba histolytica
KLIRSNLYTSFNQSPQE

SEQ ID NO: 2683540 - protein, 29 aa, Entamoeba histolytica
KLISARIEGILDYLISVTMFDSKRSTFEE

SEQ ID NO: 2683541 - protein, 17 aa, Entamoeba histolytica
KLISKGIRFEHIKNCKG

SEQ ID NO: 2683542 - protein, 19 aa, Entamoeba histolytica
KLIVSGIVIALKIANPKYE

SEQ ID NO: 2683543 - protein, 22 aa, Entamoeba histolytica
KLIYEKFKPITPTPHSNQIEIE

SEQ ID NO: 2683544 - protein, 18 aa, Entamoeba histolytica
KLIYRKLLHYDNEQLSLE

SEQ ID NO: 2683545 - protein, 18 aa, Entamoeba histolytica
KLKECVSTLLTISENNEV

SEQ ID NO: 2683546 - protein, 21 aa, Entamoeba histolytica
KLKEEELRIVEEFKQKREKWR

SEQ ID NO: 2683547 - protein, 17 aa, Entamoeba histolytica
KLKEIRKELKLLNAPSW

SEQ ID NO: 2683548 - protein, 18 aa, Entamoeba histolytica
KLKEREVQNLKEELEELK

SEQ ID NO: 2683549 - protein, 19 aa, Entamoeba histolytica
KLKESINCIQLINNELATM

SEQ ID NO: 2683550 - protein, 23 aa, Entamoeba histolytica
KLKFKKKFHEVIGMYTRSDQLSL

SEQ ID NO: 2683551 - protein, 18 aa, Entamoeba histolytica
KLKGNEFLQQKRYKEAKE

SEQ ID NO: 2683552 - protein, 22 aa, Entamoeba histolytica
KLKITGRVPRQFYQSQQLKSIR

SEQ ID NO: 2683553 - protein, 17 aa, Entamoeba histolytica
KLKKFFDPIMCTVSNDI

SEQ ID NO: 2683554 - protein, 18 aa, Entamoeba histolytica
KLKLEKMFLDLQSINPTD

SEQ ID NO: 2683555 - protein, 24 aa, Entamoeba histolytica
KLKLEVFYPSIVIYVVKKKELGVV

SEQ ID NO: 2683556 - protein, 20 aa, Entamoeba histolytica
KLKNFSSILAQFSRLEKGSQ

SEQ ID NO: 2683557 - protein, 20 aa, Entamoeba histolytica
KLKRRVLVIGTKEIDLETSI

SEQ ID NO: 2683558 - protein, 25 aa, Entamoeba histolytica
KLKVECEKCKIILSSQNSYTFTLPQ

SEQ ID NO: 2683559 - protein, 19 aa, Entamoeba histolytica
KLKVGEMVEFLLNSNKLIS

SEQ ID NO: 2683560 - protein, 21 aa, Entamoeba histolytica
KLKYKSKAWIFRKKERQREKG

SEQ ID NO: 2683561 - protein, 21 aa, Entamoeba histolytica
KLKYPQSIFLLRGNHEDEKIC

SEQ ID NO: 2683562 - protein, 32 aa, Entamoeba histolytica
KLLCDRLSLNRMKMPSIELISAEGNKEQLTFV

SEQ ID NO: 2683563 - protein, 19 aa, Entamoeba histolytica
KLLCFNLLTKMVILNPDPM

SEQ ID NO: 2683564 - protein, 25 aa, Entamoeba histolytica
KLLCGMEFFQYYAGMYDQFKIDGVS

SEQ ID NO: 2683565 - protein, 22 aa, Entamoeba histolytica
KLLCYADKFFSKSHLEDTLTQQ

SEQ ID NO: 2683566 - protein, 19 aa, Entamoeba histolytica
KLLDAIFVLAGVPREKFPA

SEQ ID NO: 2683567 - protein, 33 aa, Entamoeba histolytica
KLLDVRMMLPMSVRCQACGEYIYKGKKFNSKKE

SEQ ID NO: 2683568 - protein, 18 aa, Entamoeba histolytica
KLLEGFSSAAPVAAPAAA

SEQ ID NO: 2683569 - protein, 25 aa, Entamoeba histolytica
KLLFIRDCLEYENDICILKKGIKWF

SEQ ID NO: 2683570 - protein, 27 aa, Entamoeba histolytica
KLLFPHSKLFFCRIHIERSLKKYFKND

SEQ ID NO: 2683571 - protein, 19 aa, Entamoeba histolytica
KLLFPRDKKEIFVFRTPEV

SEQ ID NO: 2683572 - protein, 20 aa, Entamoeba histolytica
KLLHYKGEYFGGAVTAICSC

SEQ ID NO: 2683573 - protein, 23 aa, Entamoeba histolytica
KLLIEYCDALGCLDNVEFDMSLV

SEQ ID NO: 2683574 - protein, 20 aa, Entamoeba histolytica
KLLIKSCYNISINNLEDILL

SEQ ID NO: 2683575 - protein, 20 aa, Entamoeba histolytica
KLLIKSCYNISINNLEDVLL

SEQ ID NO: 2683576 - protein, 18 aa, Entamoeba histolytica
KLLINNGIVPMLIQKYII

SEQ ID NO: 2683577 - protein, 18 aa, Entamoeba histolytica
KLLIQRHMIDAQSIPPLF

SEQ ID NO: 2683578 - protein, 19 aa, Entamoeba histolytica
KLLKYCSKIVPSLLLELYH

SEQ ID NO: 2683579 - protein, 18 aa, Entamoeba histolytica
KLLPIVYDSSIFKEVDES

SEQ ID NO: 2683580 - protein, 17 aa, Entamoeba histolytica
KLLPYELLVRGSTPKHE

SEQ ID NO: 2683581 - protein, 37 aa, Entamoeba histolytica
KLLSEAKCVLHLLNTFKRCNFADGICASELRDFCSML

SEQ ID NO: 2683582 - protein, 20 aa, Entamoeba histolytica
KLLTPLLMRKESFDELLNLK

SEQ ID NO: 2683583 - protein, 19 aa, Entamoeba histolytica
KLLVNKRINQFIPSSSVVS

SEQ ID NO: 2683584 - protein, 24 aa, Entamoeba histolytica
KLLYPGKFKNVFARTQMIHGIDAR

SEQ ID NO: 2683585 - protein, 27 aa, Entamoeba histolytica
KLLYPIAPHFCDYVWRDLLGNKTFLWN

SEQ ID NO: 2683586 - protein, 27 aa, Entamoeba histolytica
KLMCKTCACPKCKVCGEAIEGKIVRVE

SEQ ID NO: 2683587 - protein, 23 aa, Entamoeba histolytica
KLMDDLWKKNGIDFRMTIYNVLA

SEQ ID NO: 2683588 - protein, 20 aa, Entamoeba histolytica
KLMDICRKNTDELVKDKIEK

SEQ ID NO: 2683589 - protein, 26 aa, Entamoeba histolytica
KLMDPSGKAPLMWRYDEINAPTCFEV

SEQ ID NO: 2683590 - protein, 22 aa, Entamoeba histolytica
KLMGVAVDWRRSFITTDHNPYF

SEQ ID NO: 2683591 - protein, 21 aa, Entamoeba histolytica
KLMGYKCGFCGEMIDRTDSNS

SEQ ID NO: 2683592 - protein, 24 aa, Entamoeba histolytica
KLMKIRFIIELSKCSIVEPNKEKS

SEQ ID NO: 2683593 - protein, 26 aa, Entamoeba histolytica
KLMQFPQPFLALGIIQIKILDGSSLY

SEQ ID NO: 2683594 - protein, 17 aa, Entamoeba histolytica
KLMQLANAFKVLQSLTF

SEQ ID NO: 2683595 - protein, 18 aa, Entamoeba histolytica
KLMRSSIVIDPRTEVSEM

SEQ ID NO: 2683596 - protein, 24 aa, Entamoeba histolytica
KLNCKSKMAIILHGIIISERIKKD

SEQ ID NO: 2683597 - protein, 19 aa, Entamoeba histolytica
KLNECVMKLLSSNVLNQIS

SEQ ID NO: 2683598 - protein, 18 aa, Entamoeba histolytica
KLNFLNEVTEYLKVNEPK

SEQ ID NO: 2683599 - protein, 20 aa, Entamoeba histolytica
KLNKRRTYLFSSEQQSKLFS

SEQ ID NO: 2683600 - protein, 19 aa, Entamoeba histolytica
KLNKSAVFLEMEKYDECIK

SEQ ID NO: 2683601 - protein, 17 aa, Entamoeba histolytica
KLNMLFQQKWDMFGFLK

SEQ ID NO: 2683602 - protein, 17 aa, Entamoeba histolytica
KLNNFWCITDLVNNSCN

SEQ ID NO: 2683603 - protein, 25 aa, Entamoeba histolytica
KLNTKRNMLICFARIGEELPDLVAP

SEQ ID NO: 2683604 - protein, 21 aa, Entamoeba histolytica
KLNVKEILEKIHVYQPHDIVS

SEQ ID NO: 2683605 - protein, 25 aa, Entamoeba histolytica
KLNYTCCSLHFNVPVNINICVIPPL

SEQ ID NO: 2683606 - protein, 22 aa, Entamoeba histolytica
KLPEQPNSIGFRQMEEKDVDIV

SEQ ID NO: 2683607 - protein, 21 aa, Entamoeba histolytica
KLPESQRTLLIKKISQLPMSI

SEQ ID NO: 2683608 - protein, 23 aa, Entamoeba histolytica
KLPEVKEWFNLIETIFVSVKKAI

SEQ ID NO: 2683609 - protein, 19 aa, Entamoeba histolytica
KLPFMPMILNISPDIITIP

SEQ ID NO: 2683610 - protein, 18 aa, Entamoeba histolytica
KLPHCQYVGVYKRRKFEE

SEQ ID NO: 2683611 - protein, 19 aa, Entamoeba histolytica
KLPKDICTIIFDSIEEYFI

SEQ ID NO: 2683612 - protein, 23 aa, Entamoeba histolytica
KLPKKTITELPKWTKPKPNDTEK

SEQ ID NO: 2683613 - protein, 28 aa, Entamoeba histolytica
KLPLFNVPRLPYPLSYIPLMKEVIINQG

SEQ ID NO: 2683614 - protein, 24 aa, Entamoeba histolytica
KLPLYCDFDLFLARIRKTQKVEEI

SEQ ID NO: 2683615 - protein, 21 aa, Entamoeba histolytica
KLPMYCPVCIQEIDVNQMNIE

SEQ ID NO: 2683616 - protein, 29 aa, Entamoeba histolytica
KLPNEFSLKPLHRMMQPISISSHIGSTND

SEQ ID NO: 2683617 - protein, 21 aa, Entamoeba histolytica
KLPNLCSLIIRSTTLSQFYSI

SEQ ID NO: 2683618 - protein, 33 aa, Entamoeba histolytica
KLPPSLANKFCCREFYGVLSFNIKSQYQLYLGW

SEQ ID NO: 2683619 - protein, 18 aa, Entamoeba histolytica
KLPPSSMLFWVLHPTLNE

SEQ ID NO: 2683620 - protein, 19 aa, Entamoeba histolytica
KLPQCYHTDYLINIEMNSL

SEQ ID NO: 2683621 - protein, 23 aa, Entamoeba histolytica
KLPTECKRQITGHSSDILCFRYN

SEQ ID NO: 2683622 - protein, 25 aa, Entamoeba histolytica
KLPTESWRFYCFKGDEEIEHPFVMN

SEQ ID NO: 2683623 - protein, 23 aa, Entamoeba histolytica
KLQACPPSQVIRQAIEEMILNPS

SEQ ID NO: 2683624 - protein, 23 aa, Entamoeba histolytica
KLQDIRILHYLKNYMFDITNYQI

SEQ ID NO: 2683625 - protein, 18 aa, Entamoeba histolytica
KLQEQIIKEKQENENYLK

SEQ ID NO: 2683626 - protein, 19 aa, Entamoeba histolytica
KLQETRIALVKEVLSKHPQ

SEQ ID NO: 2683627 - protein, 34 aa, Entamoeba histolytica
KLQGLVCTMIPSIKCTDCSLGCRAPLIKSIISHI

SEQ ID NO: 2683628 - protein, 20 aa, Entamoeba histolytica
KLQILTIRFTQKVIQSLSQI

SEQ ID NO: 2683629 - protein, 19 aa, Entamoeba histolytica
KLQIQNCYSLHTIENIDNL

SEQ ID NO: 2683630 - protein, 17 aa, Entamoeba histolytica
KLQKRALRCYLRALDYL

SEQ ID NO: 2683631 - protein, 27 aa, Entamoeba histolytica
KLQPNKVGEFCFELIKSLGHSMKQTIK

SEQ ID NO: 2683632 - protein, 20 aa, Entamoeba histolytica
KLQQLCCLEIYDFRDKSIQS

SEQ ID NO: 2683633 - protein, 27 aa, Entamoeba histolytica
KLQTPSLFRCYRYSSSRLISHSYEVLG

SEQ ID NO: 2683634 - protein, 20 aa, Entamoeba histolytica
KLQTVFGDSFLVNFNSPKKI

SEQ ID NO: 2683635 - protein, 19 aa, Entamoeba histolytica
KLREEVFKLITQIELKEVT

SEQ ID NO: 2683636 - protein, 23 aa, Entamoeba histolytica
KLREINFEDIVQCLNDRKERLMN

SEQ ID NO: 2683637 - protein, 21 aa, Entamoeba histolytica
KLRGIYAKWILSIAYKKLDNF

SEQ ID NO: 2683638 - protein, 18 aa, Entamoeba histolytica
KLRKEHKKQYKIERREKL

SEQ ID NO: 2683639 - protein, 22 aa, Entamoeba histolytica
KLRKIFFPDFFMKHQKITESHI

SEQ ID NO: 2683640 - protein, 25 aa, Entamoeba histolytica
KLRKRFIECCSIINKEKDDIIHDME

SEQ ID NO: 2683641 - protein, 20 aa, Entamoeba histolytica
KLRLDNCKVLELSSIEILNF

SEQ ID NO: 2683642 - protein, 21 aa, Entamoeba histolytica
KLRSIDMFKPFIAQNNIQFEE

SEQ ID NO: 2683643 - protein, 28 aa, Entamoeba histolytica
KLRSPGLKICRFISFERLEEMPFDQWDL

SEQ ID NO: 2683644 - protein, 20 aa, Entamoeba histolytica
KLRTIIMKSKRNWNNEFIDN

SEQ ID NO: 2683645 - protein, 26 aa, Entamoeba histolytica
KLRTRCFYHSIEIYRSVFKDIDKEID

SEQ ID NO: 2683646 - protein, 24 aa, Entamoeba histolytica
KLSFEEILELIPLFHDSLGDSENS

SEQ ID NO: 2683647 - protein, 17 aa, Entamoeba histolytica
KLSGLYLSSNNFGKFPE

SEQ ID NO: 2683648 - protein, 21 aa, Entamoeba histolytica
KLSLLELKFQYTMSCQEIHCL

SEQ ID NO: 2683649 - protein, 18 aa, Entamoeba histolytica
KLSMKEKGVDVSMEEFLL

SEQ ID NO: 2683650 - protein, 20 aa, Entamoeba histolytica
KLSNEMARMLSAVDEESIGN

SEQ ID NO: 2683651 - protein, 17 aa, Entamoeba histolytica
KLSPVFIKQNEETPIDD

SEQ ID NO: 2683652 - protein, 19 aa, Entamoeba histolytica
KLSPYRKYIQPAIEVSGLL

SEQ ID NO: 2683653 - protein, 20 aa, Entamoeba histolytica
KLSSSLFYYCISLKSIEIPS

SEQ ID NO: 2683654 - protein, 20 aa, Entamoeba histolytica
KLSVAEVLPFLKSTNYDSKM

SEQ ID NO: 2683655 - protein, 24 aa, Entamoeba histolytica
KLSVLKSLFVILSYDPLFLSNNRP

SEQ ID NO: 2683656 - protein, 18 aa, Entamoeba histolytica
KLTAIRCASELAASCPEQ

SEQ ID NO: 2683657 - protein, 19 aa, Entamoeba histolytica
KLTDSSLFSTIGYQEGSKI

SEQ ID NO: 2683658 - protein, 23 aa, Entamoeba histolytica
KLTEAGCKYSDFGTRRRFSKEVH

SEQ ID NO: 2683659 - protein, 24 aa, Entamoeba histolytica
KLTECPYLCRTCLSFQSENLHFVM

SEQ ID NO: 2683660 - protein, 18 aa, Entamoeba histolytica
KLTELLNVAFMRNDDDLN

SEQ ID NO: 2683661 - protein, 24 aa, Entamoeba histolytica
KLTGIKEIVERSFAVKNLVEYAFA

SEQ ID NO: 2683662 - protein, 18 aa, Entamoeba histolytica
KLTKECINDALTYTELYR

SEQ ID NO: 2683663 - protein, 28 aa, Entamoeba histolytica
KLTKEIKETMLISSHFIKTLSIEEINSI

SEQ ID NO: 2683664 - protein, 20 aa, Entamoeba histolytica
KLTNAFGVLNVINFAGQDMN

SEQ ID NO: 2683665 - protein, 19 aa, Entamoeba histolytica
KLTNLKASLIIGGSKLSDQ

SEQ ID NO: 2683666 - protein, 17 aa, Entamoeba histolytica
KLTQDFSEANWINKQIT

SEQ ID NO: 2683667 - protein, 25 aa, Entamoeba histolytica
KLTRESRCSPLFIGVDLEGRLVPTL

SEQ ID NO: 2683668 - protein, 24 aa, Entamoeba histolytica
KLVAFGHCHNCYGIITIKDTIYAN

SEQ ID NO: 2683669 - protein, 30 aa, Entamoeba histolytica; identical to SEQ ID NO: 2491024

SEQ ID NO: 2683670 - protein, 17 aa, Entamoeba histolytica
KLVEMNQLIDACGNLVD

SEQ ID NO: 2683671 - protein, 19 aa, Entamoeba histolytica
KLVEQWSQLLRKYWSGYST

SEQ ID NO: 2683672 - protein, 22 aa, Entamoeba histolytica
KLVKCFKRINFSFLAQELDMKE

SEQ ID NO: 2683673 - protein, 25 aa, Entamoeba histolytica
KLVKDCPYDLILNGDICKQEDITKL

SEQ ID NO: 2683674 - protein, 30 aa, Entamoeba histolytica; identical to SEQ ID NO: 2491030

SEQ ID NO: 2683675 - protein, 19 aa, Entamoeba histolytica
KLVNETHLLLGNDIEPSDK

SEQ ID NO: 2683676 - protein, 29 aa, Entamoeba histolytica
KLVPSDIVFLKGWIPVKINKFYNPMTDLT

SEQ ID NO: 2683677 - protein, 19 aa, Entamoeba histolytica
KLVPVNFTLLIIFNEDCGF

SEQ ID NO: 2683678 - protein, 18 aa, Entamoeba histolytica
KLVSNGVRYDHIKICQGS

SEQ ID NO: 2683679 - protein, 19 aa, Entamoeba histolytica
KLVSVRCPCGRSIHDDRNG

SEQ ID NO: 2683680 - protein, 18 aa, Entamoeba histolytica
KLVYECKTLLPVIPSTCL

SEQ ID NO: 2683681 - protein, 24 aa, Entamoeba histolytica
KLWEELPKSWKILIVDKYALKVIS

SEQ ID NO: 2683682 - protein, 19 aa, Entamoeba histolytica
KLYEVHNLLQWLSSISNDF

SEQ ID NO: 2683683 - protein, 20 aa, Entamoeba histolytica
KLYGGSLFKKTLVQDSALEQ

SEQ ID NO: 2683684 - protein, 18 aa, Entamoeba histolytica
KLYKIFENYYRHCIRELN

SEQ ID NO: 2683685 - protein, 25 aa, Entamoeba histolytica
KLYKLPKIDTALGLSDENGYLKGEV

SEQ ID NO: 2683686 - protein, 19 aa, Entamoeba histolytica
KLYLEKGILQKLVEILATT

SEQ ID NO: 2683687 - protein, 30 aa, Entamoeba histolytica
KLYLRNGNKWMCLENGILIDVNPKVWSKIM

SEQ ID NO: 2683688 - protein, 30 aa, Entamoeba histolytica
KLYPKLHHVYRYKVDYSFYLKHREDNCDFR

SEQ ID NO: 2683689 - protein, 19 aa, Entamoeba histolytica
KLYPRVYPQIVLDSKSVSV

SEQ ID NO: 2683690 - protein, 26 aa, Entamoeba histolytica
KLYTAPEMLKFITAKTYKGKKRIEFL

SEQ ID NO: 2683691 - protein, 17 aa, Entamoeba histolytica
KMCECKDNDDIILEIAL

SEQ ID NO: 2683692 - protein, 17 aa, Entamoeba histolytica
KMCKYIFHIPSMKGCPI

SEQ ID NO: 2683693 - protein, 25 aa, Entamoeba histolytica
KMDRVNMGTIFGPYIFWKEYSMKSI

SEQ ID NO: 2683694 - protein, 19 aa, Entamoeba histolytica
KMEDICLIVFTSGTSGTPK

SEQ ID NO: 2683695 - protein, 23 aa, Entamoeba histolytica
KMELADCCFPLVKGVVASNKTEV

SEQ ID NO: 2683696 - protein, 23 aa, Entamoeba histolytica
KMEQKLKKTTDWVSEQLDENSKS

SEQ ID NO: 2683697 - protein, 24 aa, Entamoeba histolytica
KMEQLCGIVIFMFAKPEIVPLMKN

SEQ ID NO: 2683698 - protein, 25 aa, Entamoeba histolytica
KMERSKVLLQLAFKRNQMLQNEKKR

SEQ ID NO: 2683699 - protein, 23 aa, Entamoeba histolytica
KMFGSDWGRTYIIPIISLYYTHP

SEQ ID NO: 2683700 - protein, 17 aa, Entamoeba histolytica
KMFLNYFPLQCSIYSKS

SEQ ID NO: 2683701 - protein, 24 aa, Entamoeba histolytica
KMFNSSIFIRCFYLASSNNQSIKQ

SEQ ID NO: 2683702 - protein, 18 aa, Entamoeba histolytica
KMGAIKFMECSALTQSNL

SEQ ID NO: 2683703 - protein, 19 aa, Entamoeba histolytica
KMGGIPWKTEIDSSFADGM

SEQ ID NO: 2683704 - protein, 27 aa, Entamoeba histolytica
KMHDTHLFLFKAMRKYVSLKSCPNPLE

SEQ ID NO: 2683705 - protein, 26 aa, Entamoeba histolytica
KMHINFSYISRICDMDRSYQNIRNYL

SEQ ID NO: 2683706 - protein, 19 aa, Entamoeba histolytica
KMHKIRAIIGMISYLEKSC

SEQ ID NO: 2683707 - protein, 18 aa, Entamoeba histolytica
KMHNGIKVKCNVNGCQHT

SEQ ID NO: 2683708 - protein, 20 aa, Entamoeba histolytica
KMIEELKKQIEIIKNDNEKE

SEQ ID NO: 2683709 - protein, 18 aa, Entamoeba histolytica
KMIKCKLLQKTLFPSTLK

SEQ ID NO: 2683710 - protein, 20 aa, Entamoeba histolytica
KMINCCFMKLTNTLKEEVIS

SEQ ID NO: 2683711 - protein, 25 aa, Entamoeba histolytica
KMIQCLPSQIAAAAVYFQRRINNTV

SEQ ID NO: 2683712 - protein, 28 aa, Entamoeba histolytica
KMIQKWGITDSCIFYFVQLLQGRNAIKL

SEQ ID NO: 2683713 - protein, 18 aa, Entamoeba histolytica
KMISFIFTELHFHRIELK

SEQ ID NO: 2683714 - protein, 22 aa, Entamoeba histolytica
KMKECGKEIWSKLIEYESRNRR

SEQ ID NO: 2683715 - protein, 20 aa, Entamoeba histolytica
KMKEFGVVEVVERIEDVGVD

SEQ ID NO: 2683716 - protein, 20 aa, Entamoeba histolytica
KMLCELNVRDNIKMKGMPEE

SEQ ID NO: 2683717 - protein, 17 aa, Entamoeba histolytica
KMLCTIPTIVKCIILGE

SEQ ID NO: 2683718 - protein, 17 aa, Entamoeba histolytica
KMLCVHGGLSPYLQRID

SEQ ID NO: 2683719 - protein, 25 aa, Entamoeba histolytica
KMLDFVPWFIVEVTLLKRASDLEFK

SEQ ID NO: 2683720 - protein, 17 aa, Entamoeba histolytica
KMLIKKDMRGIGNRMKI

SEQ ID NO: 2683721 - protein, 31 aa, Entamoeba histolytica; identical to SEQ ID NO: 2491081

SEQ ID NO: 2683722 - protein, 23 aa, Entamoeba histolytica
KMMCAEGYYRLVRLNIFNENFHQ

SEQ ID NO: 2683723 - protein, 19 aa, Entamoeba histolytica
KMMLDVCQTIKGLVVAIAD

SEQ ID NO: 2683724 - protein, 25 aa, Entamoeba histolytica
KMMVTQICSRRGFSDVLIVGAAKEY

SEQ ID NO: 2683725 - protein, 17 aa, Entamoeba histolytica
KMNELKEELSLFKQKCE

SEQ ID NO: 2683726 - protein, 35 aa, Entamoeba histolytica
KMNLANIFICLGPALRGCPFCFNYATVHHSEIFCS

SEQ ID NO: 2683727 - protein, 21 aa, Entamoeba histolytica
KMNLPSLFVIFNVQDIIGLRD

SEQ ID NO: 2683728 - protein, 20 aa, Entamoeba histolytica
KMPCKEILHGVGPIGENAIQ

SEQ ID NO: 2683729 - protein, 19 aa, Entamoeba histolytica
KMPGEVNGMVQYKDKIYIA

SEQ ID NO: 2683730 - protein, 18 aa, Entamoeba histolytica
KMPIIIKKVNGINQYVNE

SEQ ID NO: 2683731 - protein, 26 aa, Entamoeba histolytica
KMQKDEGGVVHFLDLYYDYTKQLLGG

SEQ ID NO: 2683732 - protein, 20 aa, Entamoeba histolytica
KMRKMELPFTLIVDDPMANS

SEQ ID NO: 2683733 - protein, 19 aa, Entamoeba histolytica
KMSEEVRQDFSLSDTEDVV

SEQ ID NO: 2683734 - protein, 23 aa, Entamoeba histolytica
KMSKEFYDTLIIKSIDKYKEISD

SEQ ID NO: 2683735 - protein, 18 aa, Entamoeba histolytica
KMSKIQVLFAGAEHLLHD

SEQ ID NO: 2683736 - protein, 23 aa, Entamoeba histolytica
KMSKRLKLLRTYENTRLEEELQI

SEQ ID NO: 2683737 - protein, 25 aa, Entamoeba histolytica
KMSSPLPFIHRFEKHPSPDTSIASS

SEQ ID NO: 2683738 - protein, 32 aa, Entamoeba histolytica
KMTEPQMAYVLREVMKGLLYLHQRHKIHRDIK

SEQ ID NO: 2683739 - protein, 18 aa, Entamoeba histolytica
KMTFEVFEKLQIKPIKMK

SEQ ID NO: 2683740 - protein, 26 aa, Entamoeba histolytica
KMTFLKNWKVAFKIRDDEYFYSIGDD

SEQ ID NO: 2683741 - protein, 23 aa, Entamoeba histolytica
KMTRARMGEACKLCDRPFDVYKW

SEQ ID NO: 2683742 - protein, 26 aa, Entamoeba histolytica
KMTRMFQVAIHFSVNLILLIPPTALR

SEQ ID NO: 2683743 - protein, 25 aa, Entamoeba histolytica
KMVIPSSVTKLGMKCFSTSEVEDIS

SEQ ID NO: 2683744 - protein, 27 aa, Entamoeba histolytica
KMVTKIFKARCISFDYPGYGLNKNKKD

SEQ ID NO: 2683745 - protein, 18 aa, Entamoeba histolytica
KMVVLLIEHCHHPLVCFT

SEQ ID NO: 2683746 - protein, 24 aa, Entamoeba histolytica
KMVYLLNDMICWEGDKILVDNKVI

SEQ ID NO: 2683747 - protein, 32 aa, Entamoeba histolytica
KMWEHLKTNWKLYGDMGLVITVFRNFSYEMLE

SEQ ID NO: 2683748 - protein, 24 aa, Entamoeba histolytica
KMYYYLVMEYCNFGTLAQYINTHD

SEQ ID NO: 2683749 - protein, 18 aa, Entamoeba histolytica
KNAEYFFVPLIKRKCIVK

SEQ ID NO: 2683750 - protein, 17 aa, Entamoeba histolytica
KNAGISMRKDNKVQGSV

SEQ ID NO: 2683751 - protein, 18 aa, Entamoeba histolytica
KNAGISMRKDNKVQGSVD

SEQ ID NO: 2683752 - protein, 19 aa, Entamoeba histolytica
KNAKCPLCGHELNKKSKII

SEQ ID NO: 2683753 - protein, 21 aa, Entamoeba histolytica
KNALCLKRVIKEFTDKTYILS

SEQ ID NO: 2683754 - protein, 20 aa, Entamoeba histolytica
KNANKIALTFKELLQMSEKL

SEQ ID NO: 2683755 - protein, 19 aa, Entamoeba histolytica
KNAQSIFDLIEYRFDDTLK

SEQ ID NO: 2683756 - protein, 21 aa, Entamoeba histolytica
KNASKVFLTYSLTNGDSVRTL

SEQ ID NO: 2683757 - protein, 20 aa, Entamoeba histolytica
KNAYIMPIHMMNAIVEEESN

SEQ ID NO: 2683758 - protein, 25 aa, Entamoeba histolytica
KNAYPFCLPASLSLPKKNYSKIFEH

SEQ ID NO: 2683759 - protein, 24 aa, Entamoeba histolytica
KNCILDSFYFIGWIGKTTLNHNVS

SEQ ID NO: 2683760 - protein, 21 aa, Entamoeba histolytica
KNCKSELILEEVIPYCNRVLR

SEQ ID NO: 2683761 - protein, 24 aa, Entamoeba histolytica
KNCSSVAFNWIVKILQNIGYSFEF

SEQ ID NO: 2683762 - protein, 20 aa, Entamoeba histolytica
KNDEKMMLAFFTIIAQKYLK

SEQ ID NO: 2683763 - protein, 25 aa, Entamoeba histolytica
KNDGSEYWTYFGTAYKNMCKDFDSI

SEQ ID NO: 2683764 - protein, 22 aa, Entamoeba histolytica
KNDIKLIYCSNVEKFEIQIYNE

SEQ ID NO: 2683765 - protein, 22 aa, Entamoeba histolytica
KNDIVPRLSFDSIKNIQPLINE

SEQ ID NO: 2683766 - protein, 23 aa, Entamoeba histolytica
KNDKRDEIHFVDVLPKNEEKEIS

SEQ ID NO: 2683767 - protein, 24 aa, Entamoeba histolytica
KNDKSWVISLLINLCNGAVPSTWN

SEQ ID NO: 2683768 - protein, 30 aa, Entamoeba histolytica
KNDLPSLLLLPIKFLPQFYSLIKEYHKCLP

SEQ ID NO: 2683769 - protein, 27 aa, Entamoeba histolytica
KNDSVWLKYLVTLPYQFYKEGLEINGN

SEQ ID NO: 2683770 - protein, 18 aa, Entamoeba histolytica
KNDTVGVCEWSHNEQNIL

SEQ ID NO: 2683771 - protein, 25 aa, Entamoeba histolytica
KNEEKTGKVVKLWQPSLSDFKEKVK

SEQ ID NO: 2683772 - protein, 22 aa, Entamoeba histolytica
KNEEMLCWLLDGLYYIFQCFDF

SEQ ID NO: 2683773 - protein, 18 aa, Entamoeba histolytica
KNEIGNMIIRVTKQSKNE

SEQ ID NO: 2683774 - protein, 19 aa, Entamoeba histolytica
KNEINKWLPSIKVALMGGT

SEQ ID NO: 2683775 - protein, 18 aa, Entamoeba histolytica
KNEISELVNYRLGDMENA

SEQ ID NO: 2683776 - protein, 26 aa, Entamoeba histolytica
KNELGKWFKIKIMTFKDGGNVTLDRS

SEQ ID NO: 2683777 - protein, 43 aa, Entamoeba histolytica
KNELKEIVQWPVLHPELFKRYGQPPSRGVLFYGPPGCGKTMMA

SEQ ID NO: 2683778 - protein, 26 aa, Entamoeba histolytica
KNELLFRVGMELGIYFDESYIKKLVI

SEQ ID NO: 2683779 - protein, 19 aa, Entamoeba histolytica
KNELLGICHKELIKKEDKI

SEQ ID NO: 2683780 - protein, 27 aa, Entamoeba histolytica
KNELRLRLCVLFLRTLYEELLKHKASD

SEQ ID NO: 2683781 - protein, 19 aa, Entamoeba histolytica
KNEMCFQAAVSLALLHPFC

SEQ ID NO: 2683782 - protein, 20 aa, Entamoeba histolytica
KNERKMLLDAAMKLSNEMAR

SEQ ID NO: 2683783 - protein, 24 aa, Entamoeba histolytica
KNERKSSLVLLKMVSNKLVRTKGD

SEQ ID NO: 2683784 - protein, 27 aa, Entamoeba histolytica
KNESGSTALHWAVRGDIQIVQMMLDAG

SEQ ID NO: 2683785 - protein, 23 aa, Entamoeba histolytica
KNEVKRKYLDMIQGIEYLPTFCE

SEQ ID NO: 2683786 - protein, 17 aa, Entamoeba histolytica
KNFAMILGPLIIHIPYE

SEQ ID NO: 2683787 - protein, 17 aa, Entamoeba histolytica
KNFCGFKKLVETNKEEI

SEQ ID NO: 2683788 - protein, 17 aa, Entamoeba histolytica
KNFFGANEFSELVQQLK

SEQ ID NO: 2683789 - protein, 19 aa, Entamoeba histolytica
KNFFKELLKIYNITESGWN

SEQ ID NO: 2683790 - protein, 19 aa, Entamoeba histolytica
KNFIGRKVIEKMNIIEYRN

SEQ ID NO: 2683791 - protein, 21 aa, Entamoeba histolytica
KNFIGSIEMSELGLVGAPLGI

SEQ ID NO: 2683792 - protein, 17 aa, Entamoeba histolytica
KNFKLGVEAIKEIEQLL

SEQ ID NO: 2683793 - protein, 19 aa, Entamoeba histolytica
KNFKLREGKYILVPCTSEA

SEQ ID NO: 2683794 - protein, 23 aa, Entamoeba histolytica
KNFSCSASFKLKQIIKDYTLSLE

SEQ ID NO: 2683795 - protein, 17 aa, Entamoeba histolytica
KNGAEKFFKKVPEYIKK

SEQ ID NO: 2683796 - protein, 18 aa, Entamoeba histolytica
KNGFMLYDCFGNLQFETY

SEQ ID NO: 2683797 - protein, 21 aa, Entamoeba histolytica
KNGFSLFELTLMKSLEKITIE

SEQ ID NO: 2683798 - protein, 20 aa, Entamoeba histolytica
KNGGELIFSDLFKLGEWYTN

SEQ ID NO: 2683799 - protein, 17 aa, Entamoeba histolytica
KNGGGLVKLAQTIEKAL

SEQ ID NO: 2683800 - protein, 19 aa, Entamoeba histolytica
KNGIEELSQKIAFIKDESI

SEQ ID NO: 2683801 - protein, 23 aa, Entamoeba histolytica
KNGIEGCDILSARLNELARKKRS

SEQ ID NO: 2683802 - protein, 21 aa, Entamoeba histolytica
KNGKFPFVIIGNKIDKGSVIS

SEQ ID NO: 2683803 - protein, 22 aa, Entamoeba histolytica
KNGKLLYKVMEYLELYCSKETE

SEQ ID NO: 2683804 - protein, 27 aa, Entamoeba histolytica
KNGLASPKWKFTFIQLIATLPAETKMI

SEQ ID NO: 2683805 - protein, 22 aa, Entamoeba histolytica
KNGSEFSFSPLIKEEYDETLSK

SEQ ID NO: 2683806 - protein, 20 aa, Entamoeba histolytica
KNGVCLLTPMVVRRLLEAAK

SEQ ID NO: 2683807 - protein, 30 aa, Entamoeba histolytica; identical to SEQ ID NO: 2473670

SEQ ID NO: 2683808 - protein, 22 aa, Entamoeba histolytica
KNGVEVLCLLYALKIKYPEHIY

SEQ ID NO: 2683809 - protein, 20 aa, Entamoeba histolytica
KNGVYETVDFSFVYKTIDNL

SEQ ID NO: 2683810 - protein, 25 aa, Entamoeba histolytica
KNGYFSLKYDVHWFIVDHWYLFSQL

SEQ ID NO: 2683811 - protein, 20 aa, Entamoeba histolytica
KNHFKEILTSSFVQAKKNLT

SEQ ID NO: 2683812 - protein, 24 aa, Entamoeba histolytica
KNHSIRYNGKMSDLFDVPKTISLN

SEQ ID NO: 2683813 - protein, 17 aa, Entamoeba histolytica
KNIANCIRKIITSIFSS

SEQ ID NO: 2683814 - protein, 29 aa, Entamoeba histolytica
KNIDACALCSIQAYEFMETTLIDIYSISI

SEQ ID NO: 2683815 - protein, 22 aa, Entamoeba histolytica
KNIDGTSCIFVILSIIITFTFF

SEQ ID NO: 2683816 - protein, 19 aa, Entamoeba histolytica
KNIHQISGITLVIDNDYLN

SEQ ID NO: 2683817 - protein, 19 aa, Entamoeba histolytica
KNIHTKLTLIKELAAVLVI

SEQ ID NO: 2683818 - protein, 22 aa, Entamoeba histolytica
KNIKFLFKIYSSIIPKIPKSSY

SEQ ID NO: 2683819 - protein, 21 aa, Entamoeba histolytica
KNIKKIYCIGRSVDLSELNKK

SEQ ID NO: 2683820 - protein, 22 aa, Entamoeba histolytica
KNIKLIIFLMFELYLRKYNELY

SEQ ID NO: 2683821 - protein, 17 aa, Entamoeba histolytica
KNIKRKKKNKLKNQLLL

SEQ ID NO: 2683822 - protein, 24 aa, Entamoeba histolytica
KNIKSCFTITDGSLRYCRTNINGF

SEQ ID NO: 2683823 - protein, 18 aa, Entamoeba histolytica
KNILHRLFVIKTIRNNVF

SEQ ID NO: 2683824 - protein, 30 aa, Entamoeba histolytica
KNILKENNFPFSLKCNGELDIIKKFVRSKT

SEQ ID NO: 2683825 - protein, 18 aa, Entamoeba histolytica
KNILMLYKRENIVTRGQV

SEQ ID NO: 2683826 - protein, 18 aa, Entamoeba histolytica
KNILPEQIKPIIEQEEED

SEQ ID NO: 2683827 - protein, 24 aa, Entamoeba histolytica
KNIPFGCFDLLLARVQLTHTNKGE

SEQ ID NO: 2683828 - protein, 25 aa, Entamoeba histolytica
KNIQFWRQLWRTCEQSDVILQIVDG

SEQ ID NO: 2683829 - protein, 21 aa, Entamoeba histolytica
KNIQRRIYGFLSRKSSKSTMK

SEQ ID NO: 2683830 - protein, 24 aa, Entamoeba histolytica
KNIRKLCPLLIPYNSNPIFETPSS

SEQ ID NO: 2683831 - protein, 19 aa, Entamoeba histolytica
KNITPFRHTISFLQDNISN

SEQ ID NO: 2683832 - protein, 17 aa, Entamoeba histolytica
KNIYGDGFAKQFLQFTM

SEQ ID NO: 2683833 - protein, 17 aa, Entamoeba histolytica
KNIYVVIGTLDYFEFSI

SEQ ID NO: 2683834 - protein, 20 aa, Entamoeba histolytica
KNKDTFILHVFDREINAQTA

SEQ ID NO: 2683835 - protein, 21 aa, Entamoeba histolytica
KNKEIKGIVLTVISQERKEEQ

SEQ ID NO: 2683836 - protein, 23 aa, Entamoeba histolytica
KNKELRIQEILHHQNVIKLKDSF

SEQ ID NO: 2683837 - protein, 17 aa, Entamoeba histolytica
KNKELTKIITLIQNYAL

SEQ ID NO: 2683838 - protein, 17 aa, Entamoeba histolytica
KNKEYWNNVKIIFDDMR

SEQ ID NO: 2683839 - protein, 30 aa, Entamoeba histolytica
KNKFTSLYCVFPLVGSEAIQIPFILNSPDF

SEQ ID NO: 2683840 - protein, 24 aa, Entamoeba histolytica
KNKFYKICVCKYMRDIAITNLKET

SEQ ID NO: 2683841 - protein, 19 aa, Entamoeba histolytica
KNKGFSITTIRKFLFQILR

SEQ ID NO: 2683842 - protein, 22 aa, Entamoeba histolytica
KNKGSILIHCVAGRSRSGTIAI

SEQ ID NO: 2683843 - protein, 23 aa, Entamoeba histolytica
KNKILLFGCNGFVGKFILRELIG

SEQ ID NO: 2683844 - protein, 25 aa, Entamoeba histolytica
KNKILRDICVCGGNSFIHGFIERIQ

SEQ ID NO: 2683845 - protein, 20 aa, Entamoeba histolytica
KNKKEEEAREIIKNMRINST

SEQ ID NO: 2683846 - protein, 31 aa, Entamoeba histolytica
KNKKLLKRITFCYKECYCTISNDGIIHNKRL

SEQ ID NO: 2683847 - protein, 32 aa, Entamoeba histolytica
KNKKLLKRITFCYKECYCTISNDGIIHNKRLV

SEQ ID NO: 2683848 - protein, 22 aa, Entamoeba histolytica
KNKKRKGFIMCADLYQTNTNPL

SEQ ID NO: 2683849 - protein, 18 aa, Entamoeba histolytica
KNKLIGCTDTSTIYDIFN

SEQ ID NO: 2683850 - protein, 17 aa, Entamoeba histolytica
KNKLKAVQWQKIPERQL

SEQ ID NO: 2683851 - protein, 17 aa, Entamoeba histolytica
KNKPVKVVVRFNSISQL

SEQ ID NO: 2683852 - protein, 18 aa, Entamoeba histolytica
KNKQEFLEFLRIVMKATA

SEQ ID NO: 2683853 - protein, 30 aa, Entamoeba histolytica
KNKRAPEVIVAPPGFPAEYLEMFNSADNDT

SEQ ID NO: 2683854 - protein, 17 aa, Entamoeba histolytica
KNKSFFDFFEIFDDDVM

SEQ ID NO: 2683855 - protein, 22 aa, Entamoeba histolytica
KNKSLEIDNVFSLHQAKPRGAI

SEQ ID NO: 2683856 - protein, 19 aa, Entamoeba histolytica
KNKVKIPCYIESASCGQIC

SEQ ID NO: 2683857 - protein, 24 aa, Entamoeba histolytica
KNKVTFPSLFLFNKNGLSTVLTGE

SEQ ID NO: 2683858 - protein, 25 aa, Entamoeba histolytica
KNKYIRFFTKYCVKYYHKLKKGYTI

SEQ ID NO: 2683859 - protein, 18 aa, Entamoeba histolytica
KNKYIWKVLRNVSDRCSP

SEQ ID NO: 2683860 - protein, 23 aa, Entamoeba histolytica
KNKYPFARGGIRNAYHGINKLTK

SEQ ID NO: 2683861 - protein, 18 aa, Entamoeba histolytica
KNLCSHGFGFLSNEDKEE

SEQ ID NO: 2683862 - protein, 21 aa, Entamoeba histolytica
KNLDPLFGDVIIKQHEVQKEE

SEQ ID NO: 2683863 - protein, 20 aa, Entamoeba histolytica
KNLFKELSICICGQPKILAT

SEQ ID NO: 2683864 - protein, 19 aa, Entamoeba histolytica
KNLIARPELVPGGGASEMH

SEQ ID NO: 2683865 - protein, 28 aa, Entamoeba histolytica
KNLKGFIQSCVFHPLKPMIAIATLSKIV

SEQ ID NO: 2683866 - protein, 17 aa, Entamoeba histolytica
KNLKKDFFVISKLFPQA

SEQ ID NO: 2683867 - protein, 18 aa, Entamoeba histolytica
KNLKRYLTVLSTPHYQFL

SEQ ID NO: 2683868 - protein, 19 aa, Entamoeba histolytica
KNLLICLSPSLRIQAKVLS

SEQ ID NO: 2683869 - protein, 23 aa, Entamoeba histolytica
KNLMRYVVHFNIILLLPPLDIIK

SEQ ID NO: 2683870 - protein, 20 aa, Entamoeba histolytica
KNLNEIICLISNFNQKQQLL

SEQ ID NO: 2683871 - protein, 20 aa, Entamoeba histolytica
KNLNFALNMESRIALVGRNG

SEQ ID NO: 2683872 - protein, 25 aa, Entamoeba histolytica
KNLNGLKRLYNLRVLSVKNNLIDRQ

SEQ ID NO: 2683873 - protein, 19 aa, Entamoeba histolytica
KNLRLDMNIIGFSHYTVQK

SEQ ID NO: 2683874 - protein, 19 aa, Entamoeba histolytica
KNLVLQRELDYWKETVELL

SEQ ID NO: 2683875 - protein, 17 aa, Entamoeba histolytica
KNLVTCVAWHPQSAYLL

SEQ ID NO: 2683876 - protein, 23 aa, Entamoeba histolytica
KNMGFGDKGKWILVTEKNNKINL

SEQ ID NO: 2683877 - protein, 18 aa, Entamoeba histolytica
KNMYWTIDPAQQFIDKLV

SEQ ID NO: 2683878 - protein, 18 aa, Entamoeba histolytica
KNNCLTLTSGILLINHIN

SEQ ID NO: 2683879 - protein, 19 aa, Entamoeba histolytica
KNNDEISFGYSIKLPLNNG

SEQ ID NO: 2683880 - protein, 20 aa, Entamoeba histolytica
KNNICPVCDVLMNGADYMNV

SEQ ID NO: 2683881 - protein, 23 aa, Entamoeba histolytica
KNNKEDLWWSRNGMDDISVQMGI

SEQ ID NO: 2683882 - protein, 20 aa, Entamoeba histolytica
KNNPSFWGFRNHPSVEGHHQ

SEQ ID NO: 2683883 - protein, 19 aa, Entamoeba histolytica
KNNVIGLNWIHCSQATSNH

SEQ ID NO: 2683884 - protein, 33 aa, Entamoeba histolytica
KNNYWNCPLCEKKCYFCSLIIDHSLMKIIKEAP

SEQ ID NO: 2683885 - protein, 19 aa, Entamoeba histolytica
KNPDDCIGCGACVDACPQG

SEQ ID NO: 2683886 - protein, 17 aa, Entamoeba histolytica
KNPFIISEMIIKSKKFE

SEQ ID NO: 2683887 - protein, 24 aa, Entamoeba histolytica
KNPIIKGVPIFKYKSVALNNFSVY

SEQ ID NO: 2683888 - protein, 18 aa, Entamoeba histolytica
KNPIPLLIFINTENCHKI

SEQ ID NO: 2683889 - protein, 24 aa, Entamoeba histolytica
KNPIRCVLCDFGLCSEYDSHYVSQ

SEQ ID NO: 2683890 - protein, 20 aa, Entamoeba histolytica
KNPKQFPIILEYTGIIEHLF

SEQ ID NO: 2683891 - protein, 25 aa, Entamoeba histolytica
KNPKRIKLMKGIEEENSVLLKDKSR

SEQ ID NO: 2683892 - protein, 17 aa, Entamoeba histolytica
KNPLKIYLFSLISQSNT

SEQ ID NO: 2683893 - protein, 25 aa, Entamoeba histolytica
KNPYEPNKILLLLTIIEKIINFQSN

SEQ ID NO: 2683894 - protein, 30 aa, Entamoeba histolytica; identical to SEQ ID NO: 2491285

SEQ ID NO: 2683895 - protein, 20 aa, Entamoeba histolytica
KNQIPFCLVTSHKNIISTLE

SEQ ID NO: 2683896 - protein, 60 aa, Entamoeba histolytica; identical to SEQ ID NO: 2491289

SEQ ID NO: 2683897 - protein, 19 aa, Entamoeba histolytica
KNRDPLERDIQQVFIGKDS

SEQ ID NO: 2683898 - protein, 23 aa, Entamoeba histolytica
KNREEIIGRIAIARAPNEEIKEA

SEQ ID NO: 2683899 - protein, 18 aa, Entamoeba histolytica
KNRGIVLHVNRLIIDSIS

SEQ ID NO: 2683900 - protein, 19 aa, Entamoeba histolytica
KNRIAIGDILALKEIEENA

SEQ ID NO: 2683901 - protein, 22 aa, Entamoeba histolytica
KNRIRKHAKQPLLYSNITQDIN

SEQ ID NO: 2683902 - protein, 24 aa, Entamoeba histolytica
KNRKWLLPYIVYKCCGMNGVPTME

SEQ ID NO: 2683903 - protein, 24 aa, Entamoeba histolytica
KNRLHEWPTYCYLLKELKSIETQD

SEQ ID NO: 2683904 - protein, 22 aa, Entamoeba histolytica
KNRNTREWGDLMTTYVMLKYRK

SEQ ID NO: 2683905 - protein, 19 aa, Entamoeba histolytica
KNRVVSMNRPARVVELGRK

SEQ ID NO: 2683906 - protein, 25 aa, Entamoeba histolytica
KNSDEIECLYQIHCDEFFQCELEPN

SEQ ID NO: 2683907 - protein, 24 aa, Entamoeba histolytica
KNSEGFRLFVNLCCDTFLILRKNY

SEQ ID NO: 2683908 - protein, 25 aa, Entamoeba histolytica
KNSEGFRLFVNLCCDTFLILRKNYH

SEQ ID NO: 2683909 - protein, 23 aa, Entamoeba histolytica
KNSIKILTEILLQYQNEINYLEQ

SEQ ID NO: 2683910 - protein, 22 aa, Entamoeba histolytica
KNSLKEPLTFTFSSSLKEGDSI

SEQ ID NO: 2683911 - protein, 20 aa, Entamoeba histolytica
KNSMCRIEYNSPKLLLVPDV

SEQ ID NO: 2683912 - protein, 25 aa, Entamoeba histolytica
KNSMLRPLVILIRYLLHQAGFTSVM

SEQ ID NO: 2683913 - protein, 17 aa, Entamoeba histolytica
KNSPCLKSSELKKHVQV

SEQ ID NO: 2683914 - protein, 19 aa, Entamoeba histolytica
KNSQMILGFFKQIDKLPEF

SEQ ID NO: 2683915 - protein, 18 aa, Entamoeba histolytica
KNSYKESINFVVDLLIEL

SEQ ID NO: 2683916 - protein, 26 aa, Entamoeba histolytica
KNTCLLPPHLRYILRHIYNSVYLIRG

SEQ ID NO: 2683917 - protein, 18 aa, Entamoeba histolytica
KNTCVIKEDCTLAVDGIV

SEQ ID NO: 2683918 - protein, 18 aa, Entamoeba histolytica
KNTEMVFSYYISEGKISQ

SEQ ID NO: 2683919 - protein, 17 aa, Entamoeba histolytica
KNTIKAMRTMNITDDEQ

SEQ ID NO: 2683920 - protein, 19 aa, Entamoeba histolytica
KNTLKGFKLLRLASQIDSV

SEQ ID NO: 2683921 - protein, 20 aa, Entamoeba histolytica
KNTLKGFKLLRLASQIDSVG

SEQ ID NO: 2683922 - protein, 18 aa, Entamoeba histolytica
KNTLPIIHLIIYNNSINP

SEQ ID NO: 2683923 - protein, 17 aa, Entamoeba histolytica
KNTPFHFFCKNFSNPNC

SEQ ID NO: 2683924 - protein, 26 aa, Entamoeba histolytica
KNTPLKKLMEAFCNKQGLNMSSVRFL

SEQ ID NO: 2683925 - protein, 17 aa, Entamoeba histolytica
KNTRPSFEDLLIQPVQR

SEQ ID NO: 2683926 - protein, 25 aa, Entamoeba histolytica
KNTVCNEFALKMIIVTFKYMTNIVI

SEQ ID NO: 2683927 - protein, 19 aa, Entamoeba histolytica
KNVEPKPNVLYCGRSLKEI

SEQ ID NO: 2683928 - protein, 25 aa, Entamoeba histolytica
KNVFGKSIGKKGVKEVIEQVQNVLQ

SEQ ID NO: 2683929 - protein, 25 aa, Entamoeba histolytica
KNVFNPRFKYGRMMTDEDWEAEKRD

SEQ ID NO: 2683930 - protein, 18 aa, Entamoeba histolytica
KNVFYLSAANGWFYKDGK

SEQ ID NO: 2683931 - protein, 23 aa, Entamoeba histolytica
KNVIEGCKWYQFLHSILVGAVSI

SEQ ID NO: 2683932 - protein, 26 aa, Entamoeba histolytica
KNVIPQVVFNLCWWIYTYGYLVEGIF

SEQ ID NO: 2683933 - protein, 23 aa, Entamoeba histolytica
KNVKDMALCLVIFASKKGSLIVD

SEQ ID NO: 2683934 - protein, 21 aa, Entamoeba histolytica
KNVLKGHVALDQFEEMIDHIV

SEQ ID NO: 2683935 - protein, 18 aa, Entamoeba histolytica
KNVQEFGEQVIGRILVGN

SEQ ID NO: 2683936 - protein, 22 aa, Entamoeba histolytica
KNVREVYEIIAQHFSQTRYKGW

SEQ ID NO: 2683937 - protein, 17 aa, Entamoeba histolytica
KNVSLCIKTMIELKTIK

SEQ ID NO: 2683938 - protein, 18 aa, Entamoeba histolytica
KNVWALSLIDYMKDVIQV

SEQ ID NO: 2683939 - protein, 25 aa, Entamoeba histolytica
KNWVDCGCYMLYYIRKIASQPKRTL

SEQ ID NO: 2683940 - protein, 20 aa, Entamoeba histolytica
KNYCKIRFQIDVNEEELNEI

SEQ ID NO: 2683941 - protein, 18 aa, Entamoeba histolytica
KNYCNEFLQLIISPIQEI

SEQ ID NO: 2683942 - protein, 17 aa, Entamoeba histolytica
KNYCYPTFNAIQNLLNE

SEQ ID NO: 2683943 - protein, 24 aa, Entamoeba histolytica
KNYDCAYSIYCGLKSYSWINEKKR

SEQ ID NO: 2683944 - protein, 19 aa, Entamoeba histolytica
KNYFICSAKTGDGCKEALK

SEQ ID NO: 2683945 - protein, 30 aa, Entamoeba histolytica; identical to SEQ ID NO: 2491339

SEQ ID NO: 2683946 - protein, 21 aa, Entamoeba histolytica
KNYKNLCEFLINKGANVNACD

SEQ ID NO: 2683947 - protein, 35 aa, Entamoeba histolytica
KNYPFAIGELIYFLKEVISWQFGEKVREKLNEYIR

SEQ ID NO: 2683948 - protein, 28 aa, Entamoeba histolytica
KPADPRLPKPLFAWNLPKGYESVLKKAF

SEQ ID NO: 2683949 - protein, 23 aa, Entamoeba histolytica
KPAEEWICGGVPLTIMMNMEQRN

SEQ ID NO: 2683950 - protein, 17 aa, Entamoeba histolytica
KPAEMLDIGCGWGGLVR

SEQ ID NO: 2683951 - protein, 17 aa, Entamoeba histolytica
KPAEVIINQQSRMKKSM

SEQ ID NO: 2683952 - protein, 18 aa, Entamoeba histolytica
KPAIPIDFKKIALIGRGN

SEQ ID NO: 2683953 - protein, 19 aa, Entamoeba histolytica
KPAKKNRKIDVLFSDVNEE

SEQ ID NO: 2683954 - protein, 24 aa, Entamoeba histolytica
KPALLQFLQCFAILVENIKSTNFL

SEQ ID NO: 2683955 - protein, 25 aa, Entamoeba histolytica
KPAPKKSNNDWGFDFDSDIGGGNSG

SEQ ID NO: 2683956 - protein, 27 aa, Entamoeba histolytica
KPAYCDRILYKECKGLEIKCLKYTSKK

SEQ ID NO: 2683957 - protein, 24 aa, Entamoeba histolytica
KPCHSGMIPWIIKEIARVKEVDEE

SEQ ID NO: 2683958 - protein, 22 aa, Entamoeba histolytica
KPDLMITISLFVGNLLKLQEFI

SEQ ID NO: 2683959 - protein, 24 aa, Entamoeba histolytica
KPEICIPLSQFHCFLGFVDEELLR

SEQ ID NO: 2683960 - protein, 20 aa, Entamoeba histolytica
KPEIKEMIQNAHIIRNIYIT

SEQ ID NO: 2683961 - protein, 22 aa, Entamoeba histolytica
KPERSVGILLGIENEEEIIVRT

SEQ ID NO: 2683962 - protein, 25 aa, Entamoeba histolytica
KPEYSKRSGKKFVMVIPPPNVTGKL

SEQ ID NO: 2683963 - protein, 19 aa, Entamoeba histolytica
KPFIHSGLQLLFIGTNHER

SEQ ID NO: 2683964 - protein, 17 aa, Entamoeba histolytica
KPFPSLLRNYLRELRSL

SEQ ID NO: 2683965 - protein, 19 aa, Entamoeba histolytica
KPFQEKDVQQNNPLTQQKT

SEQ ID NO: 2683966 - protein, 17 aa, Entamoeba histolytica
KPFTCMIAGSYWANLTV

SEQ ID NO: 2683967 - protein, 20 aa, Entamoeba histolytica
KPGCQEFGGFCNKNEWMYLI

SEQ ID NO: 2683968 - protein, 26 aa, Entamoeba histolytica
KPGEGFLQCLHRLLSTRIGYESFVEN

SEQ ID NO: 2683969 - protein, 27 aa, Entamoeba histolytica
KPGKCRLECKKTCPINRAGGLCIEVLP

SEQ ID NO: 2683970 - protein, 23 aa, Entamoeba histolytica
KPGMHPRIRLDILHEVEKRIPGF

SEQ ID NO: 2683971 - protein, 18 aa, Entamoeba histolytica
KPGWKFSEYEMRGIPIRI

SEQ ID NO: 2683972 - protein, 17 aa, Entamoeba histolytica
KPIAPGVSFISAMGQKF

SEQ ID NO: 2683973 - protein, 21 aa, Entamoeba histolytica
KPIEIVLHLPILCEDKNVPYV

SEQ ID NO: 2683974 - protein, 20 aa, Entamoeba histolytica
KPIETKRKWLYDKMNNKNDS

SEQ ID NO: 2683975 - protein, 28 aa, Entamoeba histolytica
KPIFEEFLMTWGVVLIMKGDYTLIPELT

SEQ ID NO: 2683976 - protein, 21 aa, Entamoeba histolytica
KPIFVGGCSFYILGVEFKTKQ

SEQ ID NO: 2683977 - protein, 21 aa, Entamoeba histolytica
KPIKGRLSIGRVKSDVHEVKP

SEQ ID NO: 2683978 - protein, 22 aa, Entamoeba histolytica
KPIKIRRLSTGRVESNINSIFP

SEQ ID NO: 2683979 - protein, 24 aa, Entamoeba histolytica
KPIKRVTIKYVLTCVEDRNQIISL

SEQ ID NO: 2683980 - protein, 20 aa, Entamoeba histolytica
KPIKSSFVLSNLPPVKFQGK

SEQ ID NO: 2683981 - protein, 19 aa, Entamoeba histolytica
KPILGEKVSEIFEGKHTRF

SEQ ID NO: 2683982 - protein, 19 aa, Entamoeba histolytica
KPILKCIENILKQTQGEMA

SEQ ID NO: 2683983 - protein, 19 aa, Entamoeba histolytica
KPIPRRRPLFQDAFNSEPK

SEQ ID NO: 2683984 - protein, 23 aa, Entamoeba histolytica
KPIPVELFNKLLLVKSQTNVALI

SEQ ID NO: 2683985 - protein, 21 aa, Entamoeba histolytica
KPIPYPKGIICVEFGKESKTK

SEQ ID NO: 2683986 - protein, 25 aa, Entamoeba histolytica
KPISEPWEVQSFFTICDTCISTSPT

SEQ ID NO: 2683987 - protein, 23 aa, Entamoeba histolytica
KPISYFKLRFEASRIVVKENSQL

SEQ ID NO: 2683988 - protein, 17 aa, Entamoeba histolytica
KPISYPILPDASNHYLW

SEQ ID NO: 2683989 - protein, 18 aa, Entamoeba histolytica
KPITCGFKMSVLGKLADT

SEQ ID NO: 2683990 - protein, 18 aa, Entamoeba histolytica
KPITYGIEILRLSHPQRL

SEQ ID NO: 2683991 - protein, 20 aa, Entamoeba histolytica
KPKALCPICNSYLNLSDTYC

SEQ ID NO: 2683992 - protein, 26 aa, Entamoeba histolytica
KPKDIKGHVTVSTWHVPCECLTTGFQ

SEQ ID NO: 2683993 - protein, 20 aa, Entamoeba histolytica
KPKEETICLVNKETILVINQ

SEQ ID NO: 2683994 - protein, 20 aa, Entamoeba histolytica
KPKESMVGLEKEILLNEKKP

SEQ ID NO: 2683995 - protein, 20 aa, Entamoeba histolytica
KPKFKECECHHGIFVDLQQN

SEQ ID NO: 2683996 - protein, 30 aa, Entamoeba histolytica
KPKIYKRRVDGILPTLCLWSNENQENVFSV

SEQ ID NO: 2683997 - protein, 23 aa, Entamoeba histolytica
KPKKPKNAYLLFSSEKYPQYKKQ

SEQ ID NO: 2683998 - protein, 19 aa, Entamoeba histolytica
KPKNSFDVAYTYEHNQEDN

SEQ ID NO: 2683999 - protein, 17 aa, Entamoeba histolytica
KPLFLTFKNEDPEGDPI

SEQ ID NO: 2684000 - protein, 20 aa, Entamoeba histolytica
KPLFRKEKKNEYPFSSQFIS

SEQ ID NO: 2684001 - protein, 32 aa, Entamoeba histolytica
KPLIDDSHCLLLFRKGLSQGILDLCIASIYAL

SEQ ID NO: 2684002 - protein, 18 aa, Entamoeba histolytica
KPLKERRDILHSTFHEVS

SEQ ID NO: 2684003 - protein, 22 aa, Entamoeba histolytica
KPLKIGELCGKVLHKMSDNVSL

SEQ ID NO: 2684004 - protein, 17 aa, Entamoeba histolytica
KPLLHTETVPIITSNPF

SEQ ID NO: 2684005 - protein, 23 aa, Entamoeba histolytica
KPLLKGDGFFLVPDVKWNMKDMN

SEQ ID NO: 2684006 - protein, 19 aa, Entamoeba histolytica
KPLPLKKGDTVRFKNEFIL

SEQ ID NO: 2684007 - protein, 21 aa, Entamoeba histolytica
KPLPSREVVPITLPQPDSEKC

SEQ ID NO: 2684008 - protein, 32 aa, Entamoeba histolytica
KPLSILPCKFFFCFNLPISLGLVHSKLTNEQL

SEQ ID NO: 2684009 - protein, 25 aa, Entamoeba histolytica
KPLTFKQMKELYITRENALSYADTA

SEQ ID NO: 2684010 - protein, 27 aa, Entamoeba histolytica
KPLVMSTAKALRVANEIKEKLVKIEEY

SEQ ID NO: 2684011 - protein, 24 aa, Entamoeba histolytica
KPMGCAILSLREAFKMKEKGIDKA

SEQ ID NO: 2684012 - protein, 19 aa, Entamoeba histolytica
KPMKRSFENEMFIQPITSP

SEQ ID NO: 2684013 - protein, 19 aa, Entamoeba histolytica
KPMNLPLIYSFIIDGKLCF

SEQ ID NO: 2684014 - protein, 20 aa, Entamoeba histolytica
KPMTEKIAFSYTERYGVLDE

SEQ ID NO: 2684015 - protein, 22 aa, Entamoeba histolytica
KPMVEGIFDIRVMYEKSKLIQE

SEQ ID NO: 2684016 - protein, 22 aa, Entamoeba histolytica
KPMVEGIFDIRVMYEKVKLIQE

SEQ ID NO: 2684017 - protein, 18 aa, Entamoeba histolytica
KPNEFIRFIDYYKNNLNV

SEQ ID NO: 2684018 - protein, 18 aa, Entamoeba histolytica
KPNEFTIISPTVKKEFPE

SEQ ID NO: 2684019 - protein, 26 aa, Entamoeba histolytica
KPNGNDWICILLLYIGKGTISQTTKD

SEQ ID NO: 2684020 - protein, 20 aa, Entamoeba histolytica
KPNKCIIHHFSTRYSIEAIN

SEQ ID NO: 2684021 - protein, 18 aa, Entamoeba histolytica
KPNLMSKPLKDRMKDSIK

SEQ ID NO: 2684022 - protein, 24 aa, Entamoeba histolytica
KPNTIAVVTIFFVLRYYNVLNGSI

SEQ ID NO: 2684023 - protein, 24 aa, Entamoeba histolytica
KPNTVAAVVICFVCEIEKCLTQEL

SEQ ID NO: 2684024 - protein, 29 aa, Entamoeba histolytica
KPPEIRLSTAKVFRYRPFSLILTMSSTWR

SEQ ID NO: 2684025 - protein, 20 aa, Entamoeba histolytica
KPPEMLKMDLAGGMPVNASC

SEQ ID NO: 2684026 - protein, 18 aa, Entamoeba histolytica
KPPKRPQHVFDIPKEEKK

SEQ ID NO: 2684027 - protein, 23 aa, Entamoeba histolytica
KPPKSLCKRNFFAALDETHFFYH

SEQ ID NO: 2684028 - protein, 23 aa, Entamoeba histolytica
KPPVKISCCRRLRKKPIFECSPI

SEQ ID NO: 2684029 - protein, 20 aa, Entamoeba histolytica
KPQGDFKIGIIPFNDDDDFD

SEQ ID NO: 2684030 - protein, 26 aa, Entamoeba histolytica
KPQIVVFSCKSFIFKRTAHFKYGIID

SEQ ID NO: 2684031 - protein, 20 aa, Entamoeba histolytica
KPQKARFSLVSSSMEDLESL

SEQ ID NO: 2684032 - protein, 25 aa, Entamoeba histolytica
KPQPKPDVFASLGSYHPKAKTTQPE

SEQ ID NO: 2684033 - protein, 24 aa, Entamoeba histolytica
KPRLIGSKCVGFYQLNMADIKESD

SEQ ID NO: 2684034 - protein, 17 aa, Entamoeba histolytica
KPRRCVGRKRKERKEKP

SEQ ID NO: 2684035 - protein, 22 aa, Entamoeba histolytica
KPRYLMGVGYPVEMLLCVLFGV

SEQ ID NO: 2684036 - protein, 20 aa, Entamoeba histolytica
KPSALKGFLIPVTKTGSPIN

SEQ ID NO: 2684037 - protein, 19 aa, Entamoeba histolytica
KPSEAMLVACAKSVAANAM

SEQ ID NO: 2684038 - protein, 19 aa, Entamoeba histolytica
KPSEHMIFVSLQHKFVFHN

SEQ ID NO: 2684039 - protein, 21 aa, Entamoeba histolytica
KPSHGKLTMFGTEINEKTKES

SEQ ID NO: 2684040 - protein, 20 aa, Entamoeba histolytica
KPSIESHFLGSVTYTTSFQF

SEQ ID NO: 2684041 - protein, 20 aa, Entamoeba histolytica
KPSKLRGVASEAMILAATSL

SEQ ID NO: 2684042 - protein, 31 aa, Entamoeba histolytica
KPSKLRLVKRASPTMGLPLIKLHDFSCGIVL

SEQ ID NO: 2684043 - protein, 18 aa, Entamoeba histolytica
KPSLLIRARVISAVKYWI

SEQ ID NO: 2684044 - protein, 19 aa, Entamoeba histolytica
KPSQFPVGGCCYCKESGNA

SEQ ID NO: 2684045 - protein, 18 aa, Entamoeba histolytica
KPSYSMINLIDPVSSINN

SEQ ID NO: 2684046 - protein, 17 aa, Entamoeba histolytica
KPTKFGKLRSFGDLCHF

SEQ ID NO: 2684047 - protein, 17 aa, Entamoeba histolytica
KPTKFIVLIMKLLMLRP

SEQ ID NO: 2684048 - protein, 20 aa, Entamoeba histolytica
KPTPLPLICSFLIDGKLCFH

SEQ ID NO: 2684049 - protein, 18 aa, Entamoeba histolytica
KPTQWNYFFLFSDRLIGT

SEQ ID NO: 2684050 - protein, 17 aa, Entamoeba histolytica
KPTRSIRPSQSMVSDTD

SEQ ID NO: 2684051 - protein, 18 aa, Entamoeba histolytica
KPTRSIRPSQSMVSDTDS

SEQ ID NO: 2684052 - protein, 21 aa, Entamoeba histolytica
KPTSCLMLQTKIKGLVKNVPK

SEQ ID NO: 2684053 - protein, 20 aa, Entamoeba histolytica
KPTTLTLAFHLYRAGLRDEA

SEQ ID NO: 2684054 - protein, 17 aa, Entamoeba histolytica
KPVKEVKCHDAEVWSVA

SEQ ID NO: 2684055 - protein, 17 aa, Entamoeba histolytica
KPVKRVYRKREKGNKIK

SEQ ID NO: 2684056 - protein, 17 aa, Entamoeba histolytica
KPVKVVVRFNSISQLEI

SEQ ID NO: 2684057 - protein, 21 aa, Entamoeba histolytica
KPVPYNFAGIDGFTHAGIYKA

SEQ ID NO: 2684058 - protein, 19 aa, Entamoeba histolytica
KPVSCCFTLYPSKTLPDKL

SEQ ID NO: 2684059 - protein, 25 aa, Entamoeba histolytica
KPYEEIKIQLFIESVRRKVYFTTTT

SEQ ID NO: 2684060 - protein, 23 aa, Entamoeba histolytica
KPYESCLLDFLTLMDDVPRIMGL

SEQ ID NO: 2684061 - protein, 18 aa, Entamoeba histolytica
KPYIPKRNKKVYDLDEIG

SEQ ID NO: 2684062 - protein, 23 aa, Entamoeba histolytica
KPYQLKFSNLFQSAAIGFGNIIL

SEQ ID NO: 2684063 - protein, 22 aa, Entamoeba histolytica
KPYSIYSFISLNVWEIVSSLSN

SEQ ID NO: 2684064 - protein, 22 aa, Entamoeba histolytica
KPYYERRKAIIMGAPLTDEEIQ

SEQ ID NO: 2684065 - protein, 18 aa, Entamoeba histolytica
KQACLWTDSIYFLQAKKE

SEQ ID NO: 2684066 - protein, 29 aa, Entamoeba histolytica
KQADPSSCYIFDCMTRMYVWMGDESIPLQ

SEQ ID NO: 2684067 - protein, 18 aa, Entamoeba histolytica
KQALRCDFFSRSQVKDVA

SEQ ID NO: 2684068 - protein, 19 aa, Entamoeba histolytica
KQAPKKCYDFIGGKYHDLI

SEQ ID NO: 2684069 - protein, 19 aa, Entamoeba histolytica
KQARVVSSFTCKTEELSLE

SEQ ID NO: 2684070 - protein, 23 aa, Entamoeba histolytica
KQAYSAYERKIRWLNPKDTEKEY

SEQ ID NO: 2684071 - protein, 18 aa, Entamoeba histolytica
KQCIHEITTYIQLLKKVY

SEQ ID NO: 2684072 - protein, 18 aa, Entamoeba histolytica
KQCIVFCGSVLRTEVIFR

SEQ ID NO: 2684073 - protein, 24 aa, Entamoeba histolytica
KQCKKAEVTHQFFRIKLIQFSIED

SEQ ID NO: 2684074 - protein, 20 aa, Entamoeba histolytica
KQCPELFTSVELIIVDEPTN

SEQ ID NO: 2684075 - protein, 17 aa, Entamoeba histolytica
KQCWKLLDSNFCLKTGV

SEQ ID NO: 2684076 - protein, 23 aa, Entamoeba histolytica
KQDALKLFHIFLQRMKDYGMKKQ

SEQ ID NO: 2684077 - protein, 18 aa, Entamoeba histolytica
KQDELKVLGILSEKKAPE

SEQ ID NO: 2684078 - protein, 20 aa, Entamoeba histolytica
KQDVWSLGMILYFIITGDHV

SEQ ID NO: 2684079 - protein, 17 aa, Entamoeba histolytica
KQEEFYIVLNYMQQLNL

SEQ ID NO: 2684080 - protein, 22 aa, Entamoeba histolytica
KQEEKKEICSLKRRTETNQENE

SEQ ID NO: 2684081 - protein, 23 aa, Entamoeba histolytica
KQEGSLRITLKYRNEAQPHKSDI

SEQ ID NO: 2684082 - protein, 20 aa, Entamoeba histolytica
KQEICCAEDLDVLFNAVEYF

SEQ ID NO: 2684083 - protein, 25 aa, Entamoeba histolytica
KQEICGKRLKLLYDELNIQSGEIGL

SEQ ID NO: 2684084 - protein, 19 aa, Entamoeba histolytica
KQEIKEMFDKIMINNNQTF

SEQ ID NO: 2684085 - protein, 25 aa, Entamoeba histolytica
KQELLLFKGIHCFNCGNRIEQLITE

SEQ ID NO: 2684086 - protein, 26 aa, Entamoeba histolytica
KQEPKPKLSRLFLMLKQHTKQSSIYQ

SEQ ID NO: 2684087 - protein, 20 aa, Entamoeba histolytica
KQEQLHIIVVIQFILFGIDN

SEQ ID NO: 2684088 - protein, 18 aa, Entamoeba histolytica
KQEYPELASFVIVYNNSI

SEQ ID NO: 2684089 - protein, 22 aa, Entamoeba histolytica
KQFECLKSIHYGPMDVQCEWIL

SEQ ID NO: 2684090 - protein, 19 aa, Entamoeba histolytica
KQFHCYPESSILINSIEKY

SEQ ID NO: 2684091 - protein, 19 aa, Entamoeba histolytica
KQFIFTMYSAFWLTTDGKV

SEQ ID NO: 2684092 - protein, 22 aa, Entamoeba histolytica
KQFKKQFIREFFQLIDEKQKEV

SEQ ID NO: 2684093 - protein, 27 aa, Entamoeba histolytica
KQFKTPNWRKALLDAFNHCNLIESGKD

SEQ ID NO: 2684094 - protein, 19 aa, Entamoeba histolytica
KQFLEQVIRDSVTYTEHAK

SEQ ID NO: 2684095 - protein, 22 aa, Entamoeba histolytica
KQFNELDYYYSIIQYYSPNPNE

SEQ ID NO: 2684096 - protein, 17 aa, Entamoeba histolytica
KQFSGKIRKRFGKSGLK

SEQ ID NO: 2684097 - protein, 24 aa, Entamoeba histolytica
KQGDKLLINWFKIRSIGNLVKEIM

SEQ ID NO: 2684098 - protein, 25 aa, Entamoeba histolytica
KQGFSRTRFIKLFNNYIFCNTTQNT

SEQ ID NO: 2684099 - protein, 17 aa, Entamoeba histolytica
KQGNGFYILFKEGFVCI

SEQ ID NO: 2684100 - protein, 22 aa, Entamoeba histolytica
KQGRLYCTICKKMFSDSTSFTT

SEQ ID NO: 2684101 - protein, 26 aa, Entamoeba histolytica
KQGYEKDICMRIMKIWINQKDRTMHL

SEQ ID NO: 2684102 - protein, 21 aa, Entamoeba histolytica
KQHCLQCLQKALKDANLSNEN

SEQ ID NO: 2684103 - protein, 24 aa, Entamoeba histolytica
KQHICKVHFGMLFKEKDEWKFNES

SEQ ID NO: 2684104 - protein, 17 aa, Entamoeba histolytica
KQIDAVLGEEQWKNAQK

SEQ ID NO: 2684105 - protein, 27 aa, Entamoeba histolytica
KQIEEVKRLKGLILKQEEAQTEIVSGY

SEQ ID NO: 2684106 - protein, 18 aa, Entamoeba histolytica
KQIFQFMKTYFHYHDTDV

SEQ ID NO: 2684107 - protein, 19 aa, Entamoeba histolytica
KQIFTNKGINHFDEYIHLY

SEQ ID NO: 2684108 - protein, 18 aa, Entamoeba histolytica
KQIGWIISVFSRKALTVK

SEQ ID NO: 2684109 - protein, 19 aa, Entamoeba histolytica
KQIIALIGFLMKKEKSTMR

SEQ ID NO: 2684110 - protein, 17 aa, Entamoeba histolytica
KQIKAKFKAEERIRPKM

SEQ ID NO: 2684111 - protein, 22 aa, Entamoeba histolytica
KQIKEELRIWEPKKLIQEQEEK

SEQ ID NO: 2684112 - protein, 21 aa, Entamoeba histolytica
KQILFKIKMVLDDPYVASEFI

SEQ ID NO: 2684113 - protein, 21 aa, Entamoeba histolytica
KQILKSARLKPSHLANKEIVT

SEQ ID NO: 2684114 - protein, 18 aa, Entamoeba histolytica
KQINLALLKQVYRNNSTL

SEQ ID NO: 2684115 - protein, 23 aa, Entamoeba histolytica
KQINRLFSFILRNILTIFPSSKR

SEQ ID NO: 2684116 - protein, 19 aa, Entamoeba histolytica
KQIPSLECVCFDTKDMNIP

SEQ ID NO: 2684117 - protein, 20 aa, Entamoeba histolytica
KQIQGNELVKFVSEKLQFPN

SEQ ID NO: 2684118 - protein, 23 aa, Entamoeba histolytica
KQISYELSESLIIGINRNKTIEG

SEQ ID NO: 2684119 - protein, 26 aa, Entamoeba histolytica
KQITFAGNCLMSFPVALTNISSLSSL

SEQ ID NO: 2684120 - protein, 21 aa, Entamoeba histolytica
KQIVSYIAIHVIELLIENDKL

SEQ ID NO: 2684121 - protein, 26 aa, Entamoeba histolytica
KQKAVYCTVCNIYLHEKKCIDKFRKE

SEQ ID NO: 2684122 - protein, 23 aa, Entamoeba histolytica
KQKEKYIELSYCQIIGVTSTYVT

SEQ ID NO: 2684123 - protein, 22 aa, Entamoeba histolytica
KQKELPHNLLLLKEIIERKLTF

SEQ ID NO: 2684124 - protein, 23 aa, Entamoeba histolytica
KQKELRSMIYLLFSVSNELTKFN

SEQ ID NO: 2684125 - protein, 25 aa, Entamoeba histolytica
KQKGDGCFLWALIQNFFSEICQKIS

SEQ ID NO: 2684126 - protein, 26 aa, Entamoeba histolytica
KQKGYPWWPAKIIIMDKLNEKTKGQL

SEQ ID NO: 2684127 - protein, 20 aa, Entamoeba histolytica
KQKKGLFDLFSRIKHTTSEE

SEQ ID NO: 2684128 - protein, 26 aa, Entamoeba histolytica
KQKLFEMLGHVFNYCFINYENTFDFI

SEQ ID NO: 2684129 - protein, 19 aa, Entamoeba histolytica
KQKLGERALPGDISCINSE

SEQ ID NO: 2684130 - protein, 24 aa, Entamoeba histolytica
KQKLSFRFRQDFGSAHVIAKIGET

SEQ ID NO: 2684131 - protein, 25 aa, Entamoeba histolytica
KQKNGKWCISETMQIGGDVEITVID

SEQ ID NO: 2684132 - protein, 22 aa, Entamoeba histolytica
KQKRFSSQLGESIFVEDEFFCE

SEQ ID NO: 2684133 - protein, 24 aa, Entamoeba histolytica
KQKRKCLIPLDIEKDGYCIECDES

SEQ ID NO: 2684134 - protein, 19 aa, Entamoeba histolytica
KQKVFKVNQDWTVSQIYAL

SEQ ID NO: 2684135 - protein, 19 aa, Entamoeba histolytica
KQLCRELTNENVIWGVQHV

SEQ ID NO: 2684136 - protein, 21 aa, Entamoeba histolytica
KQLDSPLMWKSLGNAAMISGH

SEQ ID NO: 2684137 - protein, 18 aa, Entamoeba histolytica
KQLELHAEDLQRWSGMLE

SEQ ID NO: 2684138 - protein, 17 aa, Entamoeba histolytica
KQLELLIIEMIKESNDY

SEQ ID NO: 2684139 - protein, 18 aa, Entamoeba histolytica
KQLGTLIRSLGCAPTEDE

SEQ ID NO: 2684140 - protein, 20 aa, Entamoeba histolytica
KQLHCLPWESMPTFDNIMIT

SEQ ID NO: 2684141 - protein, 26 aa, Entamoeba histolytica
KQLICVKWKGLSYLHIEWISEEQFLL

SEQ ID NO: 2684142 - protein, 18 aa, Entamoeba histolytica
KQLINFSCLSNIVREAIL

SEQ ID NO: 2684143 - protein, 19 aa, Entamoeba histolytica
KQLIPCGDTIEMIHMTYYL

SEQ ID NO: 2684144 - protein, 20 aa, Entamoeba histolytica
KQLKFVFFGSDGCGKSNLIN

SEQ ID NO: 2684145 - protein, 19 aa, Entamoeba histolytica
KQLKKIRCSEKIKIGKNCF

SEQ ID NO: 2684146 - protein, 23 aa, Entamoeba histolytica
KQLNLKGLCGIIFMNIPFYQSTK

SEQ ID NO: 2684147 - protein, 23 aa, Entamoeba histolytica
KQLNLLLCKYSCFPNLKSQFMYL

SEQ ID NO: 2684148 - protein, 20 aa, Entamoeba histolytica
KQLRLDPGIYDKLQVEKVAL

SEQ ID NO: 2684149 - protein, 19 aa, Entamoeba histolytica
KQLSRRIQLKLTIGTSDSG

SEQ ID NO: 2684150 - protein, 17 aa, Entamoeba histolytica
KQLSVMKGIMKGINNRW

SEQ ID NO: 2684151 - protein, 19 aa, Entamoeba histolytica
KQNEGTICRNCHEKTGEIY

SEQ ID NO: 2684152 - protein, 23 aa, Entamoeba histolytica
KQNFLHCVNIPKASIPVTPVVNK

SEQ ID NO: 2684153 - protein, 28 aa, Entamoeba histolytica
KQNIFSDICPITFGSFFYFIEKVVSLLV

SEQ ID NO: 2684154 - protein, 19 aa, Entamoeba histolytica
KQNINSFIYNFKWKEHEIN

SEQ ID NO: 2684155 - protein, 17 aa, Entamoeba histolytica
KQNISVYLLHPTKLVIN

SEQ ID NO: 2684156 - protein, 20 aa, Entamoeba histolytica
KQNITWSGGKLKPDIDDEKG

SEQ ID NO: 2684157 - protein, 18 aa, Entamoeba histolytica
KQNLFGIIQGGLQPNLRE

SEQ ID NO: 2684158 - protein, 23 aa, Entamoeba histolytica
KQNREMFTTLVIELFQNISSHLK

SEQ ID NO: 2684159 - protein, 24 aa, Entamoeba histolytica
KQPKFKKILFGAGYWIKRKCYVDY

SEQ ID NO: 2684160 - protein, 19 aa, Entamoeba histolytica
KQPNVFDLKKACETLKVNF

SEQ ID NO: 2684161 - protein, 21 aa, Entamoeba histolytica
KQPYCIGCATAMGMCRIQKCF

SEQ ID NO: 2684162 - protein, 18 aa, Entamoeba histolytica
KQQCEYLASSISQKEITV

SEQ ID NO: 2684163 - protein, 21 aa, Entamoeba histolytica
KQQEFESMLKMAEQSLKELDS

SEQ ID NO: 2684164 - protein, 17 aa, Entamoeba histolytica
KQQEIKKIIPFGLIGKT

SEQ ID NO: 2684165 - protein, 18 aa, Entamoeba histolytica
KQQFEKFGGITDCKVMRT

SEQ ID NO: 2684166 - protein, 23 aa, Entamoeba histolytica
KQQGKRILSSFCDSQTIYIGQCE

SEQ ID NO: 2684167 - protein, 24 aa, Entamoeba histolytica
KQQIYKILVCFFARDLNIHLTSVI

SEQ ID NO: 2684168 - protein, 18 aa, Entamoeba histolytica
KQQLKIIMKPIKQLITNL

SEQ ID NO: 2684169 - protein, 27 aa, Entamoeba histolytica
KQQRLNNVQLLTGLRVYLSSFPKKEVI

SEQ ID NO: 2684170 - protein, 18 aa, Entamoeba histolytica
KQQRVIEITQIYSNKQLE

SEQ ID NO: 2684171 - protein, 19 aa, Entamoeba histolytica
KQRAFGVGCSITKDIYLGS

SEQ ID NO: 2684172 - protein, 18 aa, Entamoeba histolytica
KQRFWYSRVNSYTTRTGD

SEQ ID NO: 2684173 - protein, 19 aa, Entamoeba histolytica
KQRIIKISTALGMNIGARE

SEQ ID NO: 2684174 - protein, 24 aa, Entamoeba histolytica
KQRKWKYHKGYQKWFKKLNDPIYT

SEQ ID NO: 2684175 - protein, 24 aa, Entamoeba histolytica
KQRMKSKGGIVFNGRVYGSMVVSR

SEQ ID NO: 2684176 - protein, 22 aa, Entamoeba histolytica
KQRSENHWAPFWDSLNSLFKKC

SEQ ID NO: 2684177 - protein, 18 aa, Entamoeba histolytica
KQRTQLFITSGKHKVLIA

SEQ ID NO: 2684178 - protein, 19 aa, Entamoeba histolytica
KQRVEDGVEGYYEKKQGMT

SEQ ID NO: 2684179 - protein, 22 aa, Entamoeba histolytica
KQRVIGKCWLVFNKPKYIESVR

SEQ ID NO: 2684180 - protein, 24 aa, Entamoeba histolytica
KQRYDIEECLSHPFITSTKRDNLD

SEQ ID NO: 2684181 - protein, 19 aa, Entamoeba histolytica
KQRYSIIGIDFGNENIVIG

SEQ ID NO: 2684182 - protein, 23 aa, Entamoeba histolytica
KQSAQCIDFIYSLIPSFEGIIQF

SEQ ID NO: 2684183 - protein, 22 aa, Entamoeba histolytica
KQSCFKEVYLLEGGFNELYSLN

SEQ ID NO: 2684184 - protein, 23 aa, Entamoeba histolytica
KQSCVVWRSNIQIVKEGIEQIKR

SEQ ID NO: 2684185 - protein, 20 aa, Entamoeba histolytica
KQSFWMKRVAYLAAQICLHE

SEQ ID NO: 2684186 - protein, 25 aa, Entamoeba histolytica
KQSFWMKRVAYLAAQICLHESDDVL

SEQ ID NO: 2684187 - protein, 26 aa, Entamoeba histolytica
KQSLIKGQEKYTHFYPVTYEQPKLNI

SEQ ID NO: 2684188 - protein, 19 aa, Entamoeba histolytica
KQSLLLLFRSICNDEKIES

SEQ ID NO: 2684189 - protein, 18 aa, Entamoeba histolytica
KQSMAEAAVHSRVNSSID

SEQ ID NO: 2684190 - protein, 24 aa, Entamoeba histolytica
KQSPSKGGFWFWASKASDENEDED

SEQ ID NO: 2684191 - protein, 18 aa, Entamoeba histolytica
KQSTCPEDAILVYSKHST

SEQ ID NO: 2684192 - protein, 28 aa, Entamoeba histolytica
KQTFVNLIEICRLFCLAAASKEKTKEKY

SEQ ID NO: 2684193 - protein, 18 aa, Entamoeba histolytica
KQTFWYSRVNSYTSRTGD

SEQ ID NO: 2684194 - protein, 20 aa, Entamoeba histolytica
KQTIPRLIPTSAIDSSKLLV

SEQ ID NO: 2684195 - protein, 20 aa, Entamoeba histolytica
KQTNNGWKGGKFGDYSCNGE

SEQ ID NO: 2684196 - protein, 22 aa, Entamoeba histolytica
KQTRRLAVKEVEVMNNDNMIKV

SEQ ID NO: 2684197 - protein, 23 aa, Entamoeba histolytica
KQTTTSGFVFGNFGSSNVNPSNE

SEQ ID NO: 2684198 - protein, 18 aa, Entamoeba histolytica
KQVDEFRGRIMIDGHDEN

SEQ ID NO: 2684199 - protein, 25 aa, Entamoeba histolytica
KQVHLKYPIKKCVLQAPVSDRDSMR

SEQ ID NO: 2684200 - protein, 18 aa, Entamoeba histolytica
KQVNANIIYNEYIQDKNH

SEQ ID NO: 2684201 - protein, 17 aa, Entamoeba histolytica
KQVQEFKQILKLLKSGS

SEQ ID NO: 2684202 - protein, 26 aa, Entamoeba histolytica
KQVVKRPRASTVFTEQRVDKNLTNKD

SEQ ID NO: 2684203 - protein, 23 aa, Entamoeba histolytica
KQWIPSIQMKLIYDSSQQFFDSR

SEQ ID NO: 2684204 - protein, 20 aa, Entamoeba histolytica
KQWISLDFAEDIITKVKEKE

SEQ ID NO: 2684205 - protein, 17 aa, Entamoeba histolytica
KQWTNCTQFQIIYDTRV

SEQ ID NO: 2684206 - protein, 17 aa, Entamoeba histolytica
KQYCVDETLIGRLWSHF

SEQ ID NO: 2684207 - protein, 26 aa, Entamoeba histolytica
KQYDDVLRINCQLIEIADGCERCRQK

SEQ ID NO: 2684208 - protein, 23 aa, Entamoeba histolytica
KQYETVCKIVELFEQSTEPPMEI

SEQ ID NO: 2684209 - protein, 23 aa, Entamoeba histolytica
KQYHTVVLPAFYKRFDDQFQSAK

SEQ ID NO: 2684210 - protein, 17 aa, Entamoeba histolytica
KQYIMKGGCSILTLCFC

SEQ ID NO: 2684211 - protein, 22 aa, Entamoeba histolytica
KQYIYRSSLRLKEFGNEIKEMR

SEQ ID NO: 2684212 - protein, 31 aa, Entamoeba histolytica
KQYLIKTMIRYVFKIPFNSLITLLAKESPEH

SEQ ID NO: 2684213 - protein, 26 aa, Entamoeba histolytica
KQYLSDPCKLLFNEFIVDAFKYQIKG

SEQ ID NO: 2684214 - protein, 26 aa, Entamoeba histolytica
KQYSHFLYFIFRCIGTPVKLKCFEIF

SEQ ID NO: 2684215 - protein, 21 aa, Entamoeba histolytica
KQYSLMPSMMIFYETNVATFG

SEQ ID NO: 2684216 - protein, 17 aa, Entamoeba histolytica
KQYSLSEQSRKPIITNE

SEQ ID NO: 2684217 - protein, 20 aa, Entamoeba histolytica
KRAEFALNILEERKELPSSA

SEQ ID NO: 2684218 - protein, 19 aa, Entamoeba histolytica
KRAQQIGALHLSQINQQAQ

SEQ ID NO: 2684219 - protein, 18 aa, Entamoeba histolytica
KRASDRKIIDGLIKLLNN

SEQ ID NO: 2684220 - protein, 27 aa, Entamoeba histolytica
KRASIAAMLDCEWIKKNSVYFPDKKKR

SEQ ID NO: 2684221 - protein, 24 aa, Entamoeba histolytica
KRCKEVLNTIHLWKSGNEEMIKSC

SEQ ID NO: 2684222 - protein, 19 aa, Entamoeba histolytica
KRCRCGKEIIEVPCGYEGE

SEQ ID NO: 2684223 - protein, 19 aa, Entamoeba histolytica
KRDASLCETSRTALSVLAS

SEQ ID NO: 2684224 - protein, 19 aa, Entamoeba histolytica
KRDEIIFAMIENVVNKNGK

SEQ ID NO: 2684225 - protein, 24 aa, Entamoeba histolytica
KRDEQKVFCSIRRNMDFSKESFIN

SEQ ID NO: 2684226 - protein, 23 aa, Entamoeba histolytica
KRDKELKNDEFIEGDAEEAQRIQ

SEQ ID NO: 2684227 - protein, 20 aa, Entamoeba histolytica
KRDLVFWAMYFKSQDMWIKQ

SEQ ID NO: 2684228 - protein, 26 aa, Entamoeba histolytica
KRDMPRAFSKFLARNTFYFGSNEQLM

SEQ ID NO: 2684229 - protein, 29 aa, Entamoeba histolytica
KRDPACPFPRVVLSPLAFILGVLYLSNGD

SEQ ID NO: 2684230 - protein, 20 aa, Entamoeba histolytica
KRDVCTLKDLSILQQLQCIK

SEQ ID NO: 2684231 - protein, 20 aa, Entamoeba histolytica
KRDVIPFSSPIDSLFSNVVL

SEQ ID NO: 2684232 - protein, 19 aa, Entamoeba histolytica
KRECIKAQIEGIRISLNNG

SEQ ID NO: 2684233 - protein, 19 aa, Entamoeba histolytica
KRECIKAQIEGIRISLNSQ

SEQ ID NO: 2684234 - protein, 23 aa, Entamoeba histolytica
KREDAYKTLMNWIKEDPQIYYLR

SEQ ID NO: 2684235 - protein, 39 aa, Entamoeba histolytica
KREFSLTNIFRIWDSIFAYPSRKFHLFIGASILLDHSQK

SEQ ID NO: 2684236 - protein, 28 aa, Entamoeba histolytica
KREIESFKRSRIFVILLMVFNPNSLPTI

SEQ ID NO: 2684237 - protein, 26 aa, Entamoeba histolytica
KREIISFQSLCEEFLQIGFTDFLFGI

SEQ ID NO: 2684238 - protein, 18 aa, Entamoeba histolytica
KRELDEARTFYKENRSNK

SEQ ID NO: 2684239 - protein, 27 aa, Entamoeba histolytica
KRELMELLWPIIKYRSSNELIEAVTSV

SEQ ID NO: 2684240 - protein, 19 aa, Entamoeba histolytica
KREPIHFVCTYEEGAKKGY

SEQ ID NO: 2684241 - protein, 25 aa, Entamoeba histolytica
KRERKTLLEMYGIKGLKEESIKVLV

SEQ ID NO: 2684242 - protein, 21 aa, Entamoeba histolytica
KREVTMLKEINKLKANGEFEK

SEQ ID NO: 2684243 - protein, 19 aa, Entamoeba histolytica
KRFAKKEVQVDSLIGKSFG

SEQ ID NO: 2684244 - protein, 26 aa, Entamoeba histolytica
KRFCFCPKCLHKGIFTPMQFSLDSVR

SEQ ID NO: 2684245 - protein, 18 aa, Entamoeba histolytica
KRFDEVIKILKEDSVYKM

SEQ ID NO: 2684246 - protein, 20 aa, Entamoeba histolytica
KRFDPVLELRKQEVEKVKKR

SEQ ID NO: 2684247 - protein, 17 aa, Entamoeba histolytica
KRFDRYFVVKALLLKEH

SEQ ID NO: 2684248 - protein, 21 aa, Entamoeba histolytica
KRFERMYGCLAKFALVQPIKR

SEQ ID NO: 2684249 - protein, 20 aa, Entamoeba histolytica
KRFEYELDFLQSLANPHYIQ

SEQ ID NO: 2684250 - protein, 18 aa, Entamoeba histolytica
KRFFLEDRMEVLNNLPLY

SEQ ID NO: 2684251 - protein, 19 aa, Entamoeba histolytica
KRFKEEREITEWFKNQPIY

SEQ ID NO: 2684252 - protein, 17 aa, Entamoeba histolytica
KRFKERYNHEYLISMAN

SEQ ID NO: 2684253 - protein, 19 aa, Entamoeba histolytica
KRFLYRCENNIQPTLDEWR

SEQ ID NO: 2684254 - protein, 18 aa, Entamoeba histolytica
KRFQSGIEKIKINLSNLT

SEQ ID NO: 2684255 - protein, 17 aa, Entamoeba histolytica
KRFRKDLLLLLKEKTSI

SEQ ID NO: 2684256 - protein, 26 aa, Entamoeba histolytica
KRFRLDRCMRFLPQLQNTGGFFVAVL

SEQ ID NO: 2684257 - protein, 22 aa, Entamoeba histolytica
KRFWRETYAGAKLFNLSGITHG

SEQ ID NO: 2684258 - protein, 20 aa, Entamoeba histolytica
KRFYLEALDLLQPVEKVTCQ

SEQ ID NO: 2684259 - protein, 18 aa, Entamoeba histolytica
KRGATVIVNGKREPNIVR

SEQ ID NO: 2684260 - protein, 19 aa, Entamoeba histolytica
KRGETKEIFKRKRREKISR

SEQ ID NO: 2684261 - protein, 17 aa, Entamoeba histolytica
KRGGMPKGFSFNVGGMP

SEQ ID NO: 2684262 - protein, 23 aa, Entamoeba histolytica
KRGIPLRIGYSIFSNFVTNCFEV

SEQ ID NO: 2684263 - protein, 21 aa, Entamoeba histolytica
KRGIYECRYFSKESGDGIFSK

SEQ ID NO: 2684264 - protein, 24 aa, Entamoeba histolytica
KRGKTFWNKRVLDIYNGAIYLYEN

SEQ ID NO: 2684265 - protein, 20 aa, Entamoeba histolytica
KRGLRPSVIEVRTNYSTYYS

SEQ ID NO: 2684266 - protein, 19 aa, Entamoeba histolytica
KRGSIQLHEMDDPCLFDFG

SEQ ID NO: 2684267 - protein, 23 aa, Entamoeba histolytica
KRGTICWSPKGNLLAIGTTADTI

SEQ ID NO: 2684268 - protein, 18 aa, Entamoeba histolytica
KRGVTCQYITIPGVKQEL

SEQ ID NO: 2684269 - protein, 18 aa, Entamoeba histolytica
KRGYLDLPNERRNELCSQ

SEQ ID NO: 2684270 - protein, 23 aa, Entamoeba histolytica
KRHGRIAFRLANAYLEVKELENA

SEQ ID NO: 2684271 - protein, 20 aa, Entamoeba histolytica
KRHLFPYGGHIGAYLVVGGY

SEQ ID NO: 2684272 - protein, 18 aa, Entamoeba histolytica
KRHNSRDLLFYGIGYNAE

SEQ ID NO: 2684273 - protein, 20 aa, Entamoeba histolytica
KRHVALLIRRNKWTVQLLTA

SEQ ID NO: 2684274 - protein, 19 aa, Entamoeba histolytica
KRIAHSKTLRTFLGHATEK

SEQ ID NO: 2684275 - protein, 17 aa, Entamoeba histolytica
KRIAIKGNLKVDHNDIP

SEQ ID NO: 2684276 - protein, 21 aa, Entamoeba histolytica
KRIDVKYVMIIGRIKRQTGER

SEQ ID NO: 2684277 - protein, 18 aa, Entamoeba histolytica
KRIDWEEYLLRYSMIHNS

SEQ ID NO: 2684278 - protein, 21 aa, Entamoeba histolytica
KRIEECSGHFAVINLELPVFH

SEQ ID NO: 2684279 - protein, 18 aa, Entamoeba histolytica
KRIFGCSKYLSNQYLWVN

SEQ ID NO: 2684280 - protein, 21 aa, Entamoeba histolytica
KRIGFYLDMELVKEFMQLYSL

SEQ ID NO: 2684281 - protein, 26 aa, Entamoeba histolytica
KRIIIKCSYCSTPFFVGTEKIHQFNS

SEQ ID NO: 2684282 - protein, 22 aa, Entamoeba histolytica
KRIIKEKVFCITDTCLYKINGW

SEQ ID NO: 2684283 - protein, 19 aa, Entamoeba histolytica
KRIKEGIDNLSLDSLILLH

SEQ ID NO: 2684284 - protein, 32 aa, Entamoeba histolytica
KRIKIGTVCSMAQYGWSDYIVCSTYQGDIVLL

SEQ ID NO: 2684285 - protein, 17 aa, Entamoeba histolytica
KRIKINGGVIEYEQKLN

SEQ ID NO: 2684286 - protein, 17 aa, Entamoeba histolytica
KRILREVFIPLDSKKIS

SEQ ID NO: 2684287 - protein, 18 aa, Entamoeba histolytica
KRINGVGVARTLANHFVK

SEQ ID NO: 2684288 - protein, 21 aa, Entamoeba histolytica
KRINKQIFHNLSYYVLDTLIQ

SEQ ID NO: 2684289 - protein, 19 aa, Entamoeba histolytica
KRINLRLTDIEFVGGGSRL

SEQ ID NO: 2684290 - protein, 17 aa, Entamoeba histolytica
KRINTLTEEIFKLNQII

SEQ ID NO: 2684291 - protein, 20 aa, Entamoeba histolytica
KRIRENLQFARERRKKAEYE

SEQ ID NO: 2684292 - protein, 17 aa, Entamoeba histolytica
KRISIACYLIVNGYNLN

SEQ ID NO: 2684293 - protein, 17 aa, Entamoeba histolytica
KRISLSYLDDFDPHFAL

SEQ ID NO: 2684294 - protein, 21 aa, Entamoeba histolytica
KRISPEFQNFCRYLRERQNQM

SEQ ID NO: 2684295 - protein, 19 aa, Entamoeba histolytica
KRISYVHALEEKFGEKIPR

SEQ ID NO: 2684296 - protein, 19 aa, Entamoeba histolytica
KRITFYKADLLNIDEIDQI

SEQ ID NO: 2684297 - protein, 34 aa, Entamoeba histolytica
KRITRDDLVVCWYSRITRSIGFIVNGVQLGPAFV

SEQ ID NO: 2684298 - protein, 19 aa, Entamoeba histolytica
KRIVDKEIDFAIKQLEKRY

SEQ ID NO: 2684299 - protein, 19 aa, Entamoeba histolytica
KRIYDIVDITDYIKEEPVE

SEQ ID NO: 2684300 - protein, 17 aa, Entamoeba histolytica
KRIYEMKEAQKTQKDNA

SEQ ID NO: 2684301 - protein, 24 aa, Entamoeba histolytica
KRKANVYHFACSRGRKDLVELFLS

SEQ ID NO: 2684302 - protein, 23 aa, Entamoeba histolytica
KRKEEYHPYLLFCKENRDRVKAD

SEQ ID NO: 2684303 - protein, 21 aa, Entamoeba histolytica
KRKELAECLILIDVSNQDTIK

SEQ ID NO: 2684304 - protein, 19 aa, Entamoeba histolytica
KRKELTPPWIPPVKSQTET

SEQ ID NO: 2684305 - protein, 21 aa, Entamoeba histolytica
KRKEQDKELLFTISNLPPKCP

SEQ ID NO: 2684306 - protein, 17 aa, Entamoeba histolytica
KRKEQLLLHRQRLKEMI

SEQ ID NO: 2684307 - protein, 20 aa, Entamoeba histolytica
KRKGGLKTLFSFSQSVQPIF

SEQ ID NO: 2684308 - protein, 21 aa, Entamoeba histolytica
KRKGKDYEVTFGREDEQDKII

SEQ ID NO: 2684309 - protein, 20 aa, Entamoeba histolytica
KRKGYLMVEQTIMYKHAHIV

SEQ ID NO: 2684310 - protein, 24 aa, Entamoeba histolytica
KRKIDLNMIFSIPFEIKEIDDTKI

SEQ ID NO: 2684311 - protein, 19 aa, Entamoeba histolytica
KRKIIKCIQEIYSEIITLT

SEQ ID NO: 2684312 - protein, 18 aa, Entamoeba histolytica
KRKKEIEEFKLFSAKKKL

SEQ ID NO: 2684313 - protein, 17 aa, Entamoeba histolytica
KRKKIIVPISLKEYYLG

SEQ ID NO: 2684314 - protein, 23 aa, Entamoeba histolytica
KRKLPSILSKKFIKEEAQKLQQK

SEQ ID NO: 2684315 - protein, 18 aa, Entamoeba histolytica
KRKLRLFKIDEVYKNLTR

SEQ ID NO: 2684316 - protein, 21 aa, Entamoeba histolytica
KRKMPIIIKKVNGINQYINEE

SEQ ID NO: 2684317 - protein, 21 aa, Entamoeba histolytica
KRKMPIIIKKVNGINQYVNEP

SEQ ID NO: 2684318 - protein, 19 aa, Entamoeba histolytica
KRKPNEPILETKRKIEEDT

SEQ ID NO: 2684319 - protein, 26 aa, Entamoeba histolytica
KRKQKVSVGSLVYIPSVTEIKVKSPI

SEQ ID NO: 2684320 - protein, 20 aa, Entamoeba histolytica
KRKQSQLSFEINTFTIKMIN

SEQ ID NO: 2684321 - protein, 17 aa, Entamoeba histolytica
KRKRTEEKVNEKKEEIV

SEQ ID NO: 2684322 - protein, 18 aa, Entamoeba histolytica
KRKTYCGTLEYLSPELVE

SEQ ID NO: 2684323 - protein, 19 aa, Entamoeba histolytica
KRKVDEIIVTPPTTTHLKE

SEQ ID NO: 2684324 - protein, 19 aa, Entamoeba histolytica
KRKVDVIYAKQLFKNKPND

SEQ ID NO: 2684325 - protein, 18 aa, Entamoeba histolytica
KRKVHQLITREMLENTNK

SEQ ID NO: 2684326 - protein, 19 aa, Entamoeba histolytica
KRLAEMRAIAEKNKYKEVV

SEQ ID NO: 2684327 - protein, 24 aa, Entamoeba histolytica
KRLAEPILGIYYFDMKKGLATEDL

SEQ ID NO: 2684328 - protein, 20 aa, Entamoeba histolytica
KRLANIYQWVVKREEFNWSE

SEQ ID NO: 2684329 - protein, 26 aa, Entamoeba histolytica
KRLAWTTLCRLAFLSIYQRTPVDFIN

SEQ ID NO: 2684330 - protein, 28 aa, Entamoeba histolytica
KRLCRILIIPYYMVKSFFVRGDFTKELR

SEQ ID NO: 2684331 - protein, 27 aa, Entamoeba histolytica
KRLDCKIKELYFPRALALFCEYPLFNE

SEQ ID NO: 2684332 - protein, 18 aa, Entamoeba histolytica
KRLDTEMSKRSIFEQQKI

SEQ ID NO: 2684333 - protein, 17 aa, Entamoeba histolytica
KRLESISRIVMSKRYPI

SEQ ID NO: 2684334 - protein, 20 aa, Entamoeba histolytica
KRLFEITRYTIGIYGVMGIK

SEQ ID NO: 2684335 - protein, 19 aa, Entamoeba histolytica
KRLFLMYLSCIKRVDEQGK

SEQ ID NO: 2684336 - protein, 20 aa, Entamoeba histolytica
KRLFNYAFECNVEYRQKLME

SEQ ID NO: 2684337 - protein, 20 aa, Entamoeba histolytica
KRLGDHITRRDVSVKFKRES

SEQ ID NO: 2684338 - protein, 19 aa, Entamoeba histolytica
KRLIGRRFSDPAIQNDMKH

SEQ ID NO: 2684339 - protein, 39 aa, Entamoeba histolytica
KRLILTCLIKLAKEFDCIKPICYKACQMMLSNIDVEVQQ

SEQ ID NO: 2684340 - protein, 18 aa, Entamoeba histolytica
KRLINYLSTSKEPFNKIR

SEQ ID NO: 2684341 - protein, 17 aa, Entamoeba histolytica
KRLIRPFEEDKEINKFI

SEQ ID NO: 2684342 - protein, 20 aa, Entamoeba histolytica
KRLKDLIQFHHLMEEKANLL

SEQ ID NO: 2684343 - protein, 17 aa, Entamoeba histolytica
KRLLEQHISRWTLPEDE

SEQ ID NO: 2684344 - protein, 22 aa, Entamoeba histolytica
KRLLKELEIIFELKKKTQEIKQ

SEQ ID NO: 2684345 - protein, 24 aa, Entamoeba histolytica
KRLLLKENPEAVIIDNEISVTNPY

SEQ ID NO: 2684346 - protein, 18 aa, Entamoeba histolytica
KRLMKIIQRPVCHLNAID

SEQ ID NO: 2684347 - protein, 27 aa, Entamoeba histolytica
KRLNVALTRAKSGLIIIGNIPTLITSK

SEQ ID NO: 2684348 - protein, 20 aa, Entamoeba histolytica
KRLPKIHLKESIKVINVDGE

SEQ ID NO: 2684349 - protein, 20 aa, Entamoeba histolytica
KRLQRVGSTLNLDRKRKYIT

SEQ ID NO: 2684350 - protein, 24 aa, Entamoeba histolytica
KRLSEGYDSCLLIKDISHPITPPP

SEQ ID NO: 2684351 - protein, 20 aa, Entamoeba histolytica
KRLSTSFGSEFTDVIIGNTL

SEQ ID NO: 2684352 - protein, 19 aa, Entamoeba histolytica
KRLTDRFDITEKGFNDDTI

SEQ ID NO: 2684353 - protein, 20 aa, Entamoeba histolytica
KRLWSFEVVEKYGMSALSIY

SEQ ID NO: 2684354 - protein, 21 aa, Entamoeba histolytica
KRLYEIGILCFGKCIIQEPSL

SEQ ID NO: 2684355 - protein, 20 aa, Entamoeba histolytica
KRLYEYFTEIYNDWQNSGSG

SEQ ID NO: 2684356 - protein, 21 aa, Entamoeba histolytica
KRLYIPLPDIEARMTLVKTLL

SEQ ID NO: 2684357 - protein, 20 aa, Entamoeba histolytica
KRMEHKNSYCFDFSEIPGVC

SEQ ID NO: 2684358 - protein, 22 aa, Entamoeba histolytica
KRMKKIVWDRSLAFTNILLNNV

SEQ ID NO: 2684359 - protein, 21 aa, Entamoeba histolytica
KRMLMTGGLMMELFKNSLKRM

SEQ ID NO: 2684360 - protein, 20 aa, Entamoeba histolytica
KRMPSSVNFFSFNSTCKNEN

SEQ ID NO: 2684361 - protein, 40 aa, Entamoeba histolytica
KRMPVGARGIPGMPMGGIRMGIPVGFNPASVQLKATGGRR

SEQ ID NO: 2684362 - protein, 19 aa, Entamoeba histolytica
KRMVELCNGKESSYNEIKM

SEQ ID NO: 2684363 - protein, 20 aa, Entamoeba histolytica
KRNDAALAMKALDRTQVFGQ

SEQ ID NO: 2684364 - protein, 21 aa, Entamoeba histolytica
KRNECKIALNPFNFMNRLEEY

SEQ ID NO: 2684365 - protein, 22 aa, Entamoeba histolytica
KRNEIRVKLKLKQIYDEMKNTI

SEQ ID NO: 2684366 - protein, 22 aa, Entamoeba histolytica
KRNFKASIPVLKLTDKKTLIVL

SEQ ID NO: 2684367 - protein, 20 aa, Entamoeba histolytica
KRNGNVISLAIGKYNKAVVV

SEQ ID NO: 2684368 - protein, 20 aa, Entamoeba histolytica
KRNIPVFLPPGGHAIYIETD

SEQ ID NO: 2684369 - protein, 20 aa, Entamoeba histolytica
KRNKICRYSHVIEMVNRIDE

SEQ ID NO: 2684370 - protein, 20 aa, Entamoeba histolytica
KRNKPQLVRALRITCNSIPF

SEQ ID NO: 2684371 - protein, 24 aa, Entamoeba histolytica
KRNNRLRMDPIFYQKYIKERNAVE

SEQ ID NO: 2684372 - protein, 20 aa, Entamoeba histolytica
KRNSILLSHVPLEILNTLSY

SEQ ID NO: 2684373 - protein, 19 aa, Entamoeba histolytica
KRNWLRQQSLEEIFEPNEI

SEQ ID NO: 2684374 - protein, 21 aa, Entamoeba histolytica
KRPEILVKIAVITERDRRDRE

SEQ ID NO: 2684375 - protein, 18 aa, Entamoeba histolytica
KRPFVRQVECTWKSMNSG

SEQ ID NO: 2684376 - protein, 20 aa, Entamoeba histolytica
KRPLQDFEILHFLSEICSGL

SEQ ID NO: 2684377 - protein, 22 aa, Entamoeba histolytica
KRPNCLTFVRMFDGHVLDMEEM

SEQ ID NO: 2684378 - protein, 19 aa, Entamoeba histolytica
KRPREDVVIEFIDEEQNEL

SEQ ID NO: 2684379 - protein, 19 aa, Entamoeba histolytica
KRPSAMEVMLHDFCKDMFR

SEQ ID NO: 2684380 - protein, 17 aa, Entamoeba histolytica
KRPTFKEIYKILEKVIE

SEQ ID NO: 2684381 - protein, 21 aa, Entamoeba histolytica
KRQDDALKMRKFVERENGTKL

SEQ ID NO: 2684382 - protein, 19 aa, Entamoeba histolytica
KRQIKLRTLYETNLKEIRC

SEQ ID NO: 2684383 - protein, 19 aa, Entamoeba histolytica
KRQIVLCSATLTPDVIEIG

SEQ ID NO: 2684384 - protein, 20 aa, Entamoeba histolytica
KRQNGCFLVRLSSKTVEHPF

SEQ ID NO: 2684385 - protein, 18 aa, Entamoeba histolytica
KRQRFGIEKEQNHDKYSF

SEQ ID NO: 2684386 - protein, 19 aa, Entamoeba histolytica
KRQSMYFTRHRPNQNETKT

SEQ ID NO: 2684387 - protein, 17 aa, Entamoeba histolytica
KRQSVYFTRYKPKQKQG

SEQ ID NO: 2684388 - protein, 18 aa, Entamoeba histolytica
KRRCAHFKDSMKKYNKCL

SEQ ID NO: 2684389 - protein, 17 aa, Entamoeba histolytica
KRRELRAAGIQVSYSHK

SEQ ID NO: 2684390 - protein, 17 aa, Entamoeba histolytica
KRRGIRDGIRIEDFEEG

SEQ ID NO: 2684391 - protein, 18 aa, Entamoeba histolytica
KRRIQARQYREEKKRKED

SEQ ID NO: 2684392 - protein, 20 aa, Entamoeba histolytica
KRRKETVCLVEVLEDYPDNH

SEQ ID NO: 2684393 - protein, 23 aa, Entamoeba histolytica
KRRKIILRFIVSLVEHILKTNFF

SEQ ID NO: 2684394 - protein, 19 aa, Entamoeba histolytica
KRRLDAWLATDFADNHLRQ

SEQ ID NO: 2684395 - protein, 20 aa, Entamoeba histolytica
KRRLEAWLNTDFVDNTLRQT

SEQ ID NO: 2684396 - protein, 25 aa, Entamoeba histolytica
KRRLREMKANFKAEKEVRLKKELAI

SEQ ID NO: 2684397 - protein, 28 aa, Entamoeba histolytica
KRRMDFFSRPPICFKGTSSTARLQTIGE

SEQ ID NO: 2684398 - protein, 20 aa, Entamoeba histolytica
KRRNCDKVKEESVDWIKECG

SEQ ID NO: 2684399 - protein, 18 aa, Entamoeba histolytica
KRRNSLSAFTPVESTLEY

SEQ ID NO: 2684400 - protein, 20 aa, Entamoeba histolytica
KRRPEFKLIITSATLDADKF

SEQ ID NO: 2684401 - protein, 21 aa, Entamoeba histolytica
KRRPKNCIIGLKKLIQVDNNE

SEQ ID NO: 2684402 - protein, 19 aa, Entamoeba histolytica
KRRRNICEFLYSINTQEST

SEQ ID NO: 2684403 - protein, 28 aa, Entamoeba histolytica
KRRSKKTECPFRINLNYRANTNTWNITK

SEQ ID NO: 2684404 - protein, 27 aa, Entamoeba histolytica
KRRSKKTECPFRINLNYRTKTRTWNIT

SEQ ID NO: 2684405 - protein, 17 aa, Entamoeba histolytica
KRRSLRFYEAMGENVEE

SEQ ID NO: 2684406 - protein, 19 aa, Entamoeba histolytica
KRRTVDWLGDRLVEKIDRD

SEQ ID NO: 2684407 - protein, 18 aa, Entamoeba histolytica
KRRVNPFIRPKSILLKEN

SEQ ID NO: 2684408 - protein, 17 aa, Entamoeba histolytica
KRSAITEICEIPDKQTT

SEQ ID NO: 2684409 - protein, 20 aa, Entamoeba histolytica
KRSDIKKVYCVGRSSNKNEL

SEQ ID NO: 2684410 - protein, 24 aa, Entamoeba histolytica
KRSFFKKSIKPMIVQQEHTEENPQ

SEQ ID NO: 2684411 - protein, 18 aa, Entamoeba histolytica
KRSICLICANPKSYMKEK

SEQ ID NO: 2684412 - protein, 21 aa, Entamoeba histolytica
KRSKFKQEIAAVIIDYMVPQM

SEQ ID NO: 2684413 - protein, 22 aa, Entamoeba histolytica
KRSKRGFQLERIIHIFYKNKFI

SEQ ID NO: 2684414 - protein, 18 aa, Entamoeba histolytica
KRSLLLLFLFKEDLTYPL

SEQ ID NO: 2684415 - protein, 24 aa, Entamoeba histolytica
KRSNYKQFLGIGVTDLGEILIGNN

SEQ ID NO: 2684416 - protein, 27 aa, Entamoeba histolytica
KRSPGSYIKILLRSAISSSPYKALEIY

SEQ ID NO: 2684417 - protein, 26 aa, Entamoeba histolytica
KRSSEFKKITCIGGMDKTISSPNVNL

SEQ ID NO: 2684418 - protein, 20 aa, Entamoeba histolytica
KRSSLKFPNTIIIEKSLKDL

SEQ ID NO: 2684419 - protein, 21 aa, Entamoeba histolytica
KRSSPCPRVEVSVEELIRMSG

SEQ ID NO: 2684420 - protein, 18 aa, Entamoeba histolytica
KRSSQRMLAYFPIKKILD

SEQ ID NO: 2684421 - protein, 22 aa, Entamoeba histolytica
KRSVECWMHPDLFHLDKSTGAP

SEQ ID NO: 2684422 - protein, 25 aa, Entamoeba histolytica
KRSYLFCYCEITVEQLISLVLEYAK

SEQ ID NO: 2684423 - protein, 25 aa, Entamoeba histolytica
KRSYRELPLRYAEFGVLHRNELTGA

SEQ ID NO: 2684424 - protein, 25 aa, Entamoeba histolytica
KRTDIVQILLQYGADIDMTFKGKPV

SEQ ID NO: 2684425 - protein, 22 aa, Entamoeba histolytica
KRTDLIESIVCESFIKKELIIS

SEQ ID NO: 2684426 - protein, 19 aa, Entamoeba histolytica
KRTDYQWNINLSIEADGIE

SEQ ID NO: 2684427 - protein, 19 aa, Entamoeba histolytica
KRTGKPIYNAIVWQSKQSG

SEQ ID NO: 2684428 - protein, 24 aa, Entamoeba histolytica
KRTLQLNSCDIVYGLIQNKYNKKC

SEQ ID NO: 2684429 - protein, 21 aa, Entamoeba histolytica
KRTTERWKNSIELFSTGSFLF

SEQ ID NO: 2684430 - protein, 20 aa, Entamoeba histolytica
KRTTFYMPLNMNIGNTIQPG

SEQ ID NO: 2684431 - protein, 19 aa, Entamoeba histolytica
KRTTMSFRLTDAFNKKPQP

SEQ ID NO: 2684432 - protein, 30 aa, Entamoeba histolytica; identical to SEQ ID NO: 2491834

SEQ ID NO: 2684433 - protein, 24 aa, Entamoeba histolytica
KRVCKFASQCTTEWTWSNDNASII

SEQ ID NO: 2684434 - protein, 17 aa, Entamoeba histolytica
KRVEDGVEGYYEKKRGM

SEQ ID NO: 2684435 - protein, 17 aa, Entamoeba histolytica
KRVEQLFQEKERKIREF

SEQ ID NO: 2684436 - protein, 19 aa, Entamoeba histolytica
KRVGYPLILCSSYSGENIT

SEQ ID NO: 2684437 - protein, 23 aa, Entamoeba histolytica
KRVKKMKGLDLFFTVKPRNGESA

SEQ ID NO: 2684438 - protein, 19 aa, Entamoeba histolytica
KRVLQGLVYLHKMGIIHRD

SEQ ID NO: 2684439 - protein, 25 aa, Entamoeba histolytica
KRVLTAMKRLLAVLPAEERLAILRR

SEQ ID NO: 2684440 - protein, 24 aa, Entamoeba histolytica
KRVTDKLVEYVWELSINQYGNYVI

SEQ ID NO: 2684441 - protein, 18 aa, Entamoeba histolytica
KRVYKERVKANMGKLAKQ

SEQ ID NO: 2684442 - protein, 25 aa, Entamoeba histolytica
KRVYWKEFTEAVVSLLMKGKCLSSY

SEQ ID NO: 2684443 - protein, 26 aa, Entamoeba histolytica
KRVYWKEFTEAVVSLLMKGKCLSSYA

SEQ ID NO: 2684444 - protein, 17 aa, Entamoeba histolytica
KRWIIVQQQAFTHWVNE

SEQ ID NO: 2684445 - protein, 17 aa, Entamoeba histolytica
KRWSLYRLMYNEETNSE

SEQ ID NO: 2684446 - protein, 20 aa, Entamoeba histolytica
KRYAGLYFNRADKWDHVDTK

SEQ ID NO: 2684447 - protein, 24 aa, Entamoeba histolytica
KRYCEEEFFEFYPINTLTAKKTGE

SEQ ID NO: 2684448 - protein, 25 aa, Entamoeba histolytica
KRYGFKKRRIGGIDYFINEMFDPND

SEQ ID NO: 2684449 - protein, 18 aa, Entamoeba histolytica
KRYHSGVSSIHCIDILDR

SEQ ID NO: 2684450 - protein, 21 aa, Entamoeba histolytica
KRYIRLLCIVYRLMDVDADGF

SEQ ID NO: 2684451 - protein, 21 aa, Entamoeba histolytica
KRYLLIFNKCIEKLLENPEFM

SEQ ID NO: 2684452 - protein, 19 aa, Entamoeba histolytica
KRYLNYTFLNDKRSSEFKK

SEQ ID NO: 2684453 - protein, 18 aa, Entamoeba histolytica
KRYLTVLSTPHYQFLTFL

SEQ ID NO: 2684454 - protein, 21 aa, Entamoeba histolytica
KRYLYCGNVVKEFITTESTYC

SEQ ID NO: 2684455 - protein, 22 aa, Entamoeba histolytica
KRYLYCGNVVKEFITTESTYCE

SEQ ID NO: 2684456 - protein, 18 aa, Entamoeba histolytica
KRYSEALKAFKTMNNLDG

SEQ ID NO: 2684457 - protein, 17 aa, Entamoeba histolytica
KRYVEAITQNLVPLLNS

SEQ ID NO: 2684458 - protein, 32 aa, Entamoeba histolytica
KRYWTDVECIAFKKAIKYFGYTTARGINTFLI

SEQ ID NO: 2684459 - protein, 24 aa, Entamoeba histolytica
KRYWTKEECLSFEKIIKFLNINCG

SEQ ID NO: 2684460 - protein, 23 aa, Entamoeba histolytica
KSAETFNIFCWYGNNSSVGKKGV

SEQ ID NO: 2684461 - protein, 25 aa, Entamoeba histolytica
KSAGKWLIPYCVYRALIKSVDTPLP

SEQ ID NO: 2684462 - protein, 26 aa, Entamoeba histolytica
KSAIEYKTKILFIFETKSGVVGFYQE

SEQ ID NO: 2684463 - protein, 26 aa, Entamoeba histolytica
KSAKNGIGIVRLMGRDAGFIALYASL

SEQ ID NO: 2684464 - protein, 21 aa, Entamoeba histolytica
KSALDFLNLPISITRGVLGNL

SEQ ID NO: 2684465 - protein, 17 aa, Entamoeba histolytica
KSALPYTSSKIFLREET

SEQ ID NO: 2684466 - protein, 18 aa, Entamoeba histolytica
KSASVWWKKYFSCKGNDI

SEQ ID NO: 2684467 - protein, 17 aa, Entamoeba histolytica
KSCEIPIEKKEFKKEEI

SEQ ID NO: 2684468 - protein, 19 aa, Entamoeba histolytica
KSCFFNCGCEEELKRNTSI

SEQ ID NO: 2684469 - protein, 19 aa, Entamoeba histolytica
KSCIIFFDEIDAIGGTRFQ

SEQ ID NO: 2684470 - protein, 21 aa, Entamoeba histolytica
KSCQIALWDVCCQCERKGSLD

SEQ ID NO: 2684471 - protein, 19 aa, Entamoeba histolytica
KSDENIFLFSLNNHNSPNT

SEQ ID NO: 2684472 - protein, 21 aa, Entamoeba histolytica
KSDIVMSLSFVKRRITIDPVV

SEQ ID NO: 2684473 - protein, 27 aa, Entamoeba histolytica
KSDVCYKTFALIVIKLIKLRRQMFINI

SEQ ID NO: 2684474 - protein, 17 aa, Entamoeba histolytica
KSECSIVEEKVYEIVPK

SEQ ID NO: 2684475 - protein, 23 aa, Entamoeba histolytica
KSEDCILELPLFIEKLSAIQSQI

SEQ ID NO: 2684476 - protein, 18 aa, Entamoeba histolytica
KSEDFFKNFKDFYESYEK

SEQ ID NO: 2684477 - protein, 24 aa, Entamoeba histolytica
KSEEARFNEILLRRKSSNELKKRK

SEQ ID NO: 2684478 - protein, 17 aa, Entamoeba histolytica
KSEGMEGLMMWVNALLD

SEQ ID NO: 2684479 - protein, 17 aa, Entamoeba histolytica
KSEIEWFNQIIERNVQL

SEQ ID NO: 2684480 - protein, 23 aa, Entamoeba histolytica
KSEIFERYLMIIGSGHISIVEVI

SEQ ID NO: 2684481 - protein, 20 aa, Entamoeba histolytica
KSEIKITDFGTARIVGEGEM

SEQ ID NO: 2684482 - protein, 28 aa, Entamoeba histolytica
KSEILKPLPSLIGLTGMITLFYQYVSKK

SEQ ID NO: 2684483 - protein, 32 aa, Entamoeba histolytica
KSEILNKFSPFFIHLIKIVFKRIDQLVEDKEG

SEQ ID NO: 2684484 - protein, 21 aa, Entamoeba histolytica
KSEINFVWLYEAYFIHMSFHT

SEQ ID NO: 2684485 - protein, 19 aa, Entamoeba histolytica
KSEKIYVCFTQRKIEFRSQ

SEQ ID NO: 2684486 - protein, 24 aa, Entamoeba histolytica
KSELQIRISSLIGYENVLPMREMH

SEQ ID NO: 2684487 - protein, 21 aa, Entamoeba histolytica
KSEMKYTAWTNCTEKKYKVIN

SEQ ID NO: 2684488 - protein, 23 aa, Entamoeba histolytica
KSEMRRYICDVLSLDTGRFSDLF

SEQ ID NO: 2684489 - protein, 17 aa, Entamoeba histolytica
KSESLQKFNIIDISVPK

SEQ ID NO: 2684490 - protein, 22 aa, Entamoeba histolytica
KSETVKNYILYFGTVKSNEQLE

SEQ ID NO: 2684491 - protein, 24 aa, Entamoeba histolytica
KSEYKRIRENGGYVINDRTNGILA

SEQ ID NO: 2684492 - protein, 20 aa, Entamoeba histolytica
KSFCSTGVFSHRSITPKITK

SEQ ID NO: 2684493 - protein, 23 aa, Entamoeba histolytica
KSFDHSFCSSSIGRLEEWKKQQS

SEQ ID NO: 2684494 - protein, 18 aa, Entamoeba histolytica
KSFEARKQLYSKLNQMEN

SEQ ID NO: 2684495 - protein, 17 aa, Entamoeba histolytica
KSFGQSWSKNHPMIMPQ

SEQ ID NO: 2684496 - protein, 37 aa, Entamoeba histolytica
KSFIEFEGKYLLGDRFFRLNPKLPYQIDLDYCKDVEL

SEQ ID NO: 2684497 - protein, 19 aa, Entamoeba histolytica
KSFIPLLIATKGRFEYDLG

SEQ ID NO: 2684498 - protein, 28 aa, Entamoeba histolytica
KSFLKESGIELFPPCMYSIYRKFLHDKH

SEQ ID NO: 2684499 - protein, 23 aa, Entamoeba histolytica
KSFLKLLEVILIIGNYMNKASKK

SEQ ID NO: 2684500 - protein, 19 aa, Entamoeba histolytica
KSFLNIVTVMWDWPKESIQ

SEQ ID NO: 2684501 - protein, 23 aa, Entamoeba histolytica
KSFNCPSTMKSIFVSRNKILNLS

SEQ ID NO: 2684502 - protein, 24 aa, Entamoeba histolytica
KSFPLPDHRSSALSAQGSLLTMIL

SEQ ID NO: 2684503 - protein, 19 aa, Entamoeba histolytica
KSFRCLRTQTYLDSIRSKD

SEQ ID NO: 2684504 - protein, 34 aa, Entamoeba histolytica
KSFSAYFFRILLKIFRVYMKIARYQTIGLGLSER

SEQ ID NO: 2684505 - protein, 19 aa, Entamoeba histolytica
KSGEIIPGIVSQFEVIRNN

SEQ ID NO: 2684506 - protein, 27 aa, Entamoeba histolytica
KSGFLPQVLICLLNWLTTVNDDDVEDW

SEQ ID NO: 2684507 - protein, 25 aa, Entamoeba histolytica
KSGHWYLFIVCCQMYKKGEEKSKKS

SEQ ID NO: 2684508 - protein, 17 aa, Entamoeba histolytica
KSGKYKLAMKTLDRLAG

SEQ ID NO: 2684509 - protein, 17 aa, Entamoeba histolytica
KSGRRSLKRTGSCAELQ

SEQ ID NO: 2684510 - protein, 18 aa, Entamoeba histolytica
KSGWKVLIQCVRFAAEYE

SEQ ID NO: 2684511 - protein, 23 aa, Entamoeba histolytica
KSGWRVPNPIYRCIEYLEQNNGI

SEQ ID NO: 2684512 - protein, 19 aa, Entamoeba histolytica
KSGYFMVPSISELRELEED

SEQ ID NO: 2684513 - protein, 28 aa, Entamoeba histolytica
KSHLAGIFIKDKIKVIGKNILKENNFPF

SEQ ID NO: 2684514 - protein, 19 aa, Entamoeba histolytica
KSHPLIEPFESIPQPKISQ

SEQ ID NO: 2684515 - protein, 21 aa, Entamoeba histolytica
KSIDDGIKWLTMTYYYICILR

SEQ ID NO: 2684516 - protein, 19 aa, Entamoeba histolytica
KSIEDCLKEGLIEYLDVNE

SEQ ID NO: 2684517 - protein, 17 aa, Entamoeba histolytica
KSIEDFVPKAIMHFLIN

SEQ ID NO: 2684518 - protein, 19 aa, Entamoeba histolytica
KSIETEGFAKLNILENEKK

SEQ ID NO: 2684519 - protein, 20 aa, Entamoeba histolytica
KSIFWKEMEQDLPLNNLVTT

SEQ ID NO: 2684520 - protein, 20 aa, Entamoeba histolytica
KSIIEGINFEEFNQQWIYKD

SEQ ID NO: 2684521 - protein, 19 aa, Entamoeba histolytica
KSIKASVMAFFSMGDNTQK

SEQ ID NO: 2684522 - protein, 17 aa, Entamoeba histolytica
KSIKNWDQFFLKQKKQK

SEQ ID NO: 2684523 - protein, 25 aa, Entamoeba histolytica
KSIMKDVLEAISFLHKNFIVHRDIK

SEQ ID NO: 2684524 - protein, 17 aa, Entamoeba histolytica
KSIPAIFLINAPPHIFH

SEQ ID NO: 2684525 - protein, 21 aa, Entamoeba histolytica
KSIPLICEFMSSLKHLDLFPT

SEQ ID NO: 2684526 - protein, 20 aa, Entamoeba histolytica
KSIQETIRFIESFKGYHFVK

SEQ ID NO: 2684527 - protein, 17 aa, Entamoeba histolytica
KSIRFIPLPGSALTLGT

SEQ ID NO: 2684528 - protein, 24 aa, Entamoeba histolytica
KSISKLIICNSLDFTSKDFHLVLE

SEQ ID NO: 2684529 - protein, 20 aa, Entamoeba histolytica
KSITLSPAFDESVVVPIRKA

SEQ ID NO: 2684530 - protein, 18 aa, Entamoeba histolytica
KSKDCIFSTIIPEIDEPW

SEQ ID NO: 2684531 - protein, 18 aa, Entamoeba histolytica
KSKDCIFSTIIPEIDNPW

SEQ ID NO: 2684532 - protein, 19 aa, Entamoeba histolytica
KSKECFEKALNMDKGSELR

SEQ ID NO: 2684533 - protein, 20 aa, Entamoeba histolytica
KSKEEMREWVLYSSEMRGLF

SEQ ID NO: 2684534 - protein, 25 aa, Entamoeba histolytica
KSKELKIQLLELQKAKHEEEFKAFA

SEQ ID NO: 2684535 - protein, 28 aa, Entamoeba histolytica
KSKEPIVVSVGWRRYQTIATFSMEDLKG

SEQ ID NO: 2684536 - protein, 28 aa, Entamoeba histolytica
KSKETREAMALGIYGIVKIHIPKTQNAI

SEQ ID NO: 2684537 - protein, 18 aa, Entamoeba histolytica
KSKGTLFFHSIPLSNCSL

SEQ ID NO: 2684538 - protein, 24 aa, Entamoeba histolytica
KSKINSQMFLILEIRKEMKTILSS

SEQ ID NO: 2684539 - protein, 19 aa, Entamoeba histolytica
KSKKPGIVTEKAMRILQTW

SEQ ID NO: 2684540 - protein, 29 aa, Entamoeba histolytica
KSKMSQLLCCICGDGSSFPLYCVVNNDHT

SEQ ID NO: 2684541 - protein, 18 aa, Entamoeba histolytica
KSKNEIIWKGMYFTDKTG

SEQ ID NO: 2684542 - protein, 21 aa, Entamoeba histolytica
KSKQPRLSASLTNEDIPDRSN

SEQ ID NO: 2684543 - protein, 19 aa, Entamoeba histolytica
KSKRSIIHIHYTGWPDFGV

SEQ ID NO: 2684544 - protein, 19 aa, Entamoeba histolytica
KSKVKNFMWQKMNDKNLSG

SEQ ID NO: 2684545 - protein, 30 aa, Entamoeba histolytica
KSKVLKLLHEYGILYSFRKSPFRSLNYPKL

SEQ ID NO: 2684546 - protein, 21 aa, Entamoeba histolytica
KSKWDFTEWIPDYVMVNIGSN

SEQ ID NO: 2684547 - protein, 19 aa, Entamoeba histolytica
KSLCDLAVVSLEVISAQDL

SEQ ID NO: 2684548 - protein, 17 aa, Entamoeba histolytica
KSLCGEKLFRDDEIVEE

SEQ ID NO: 2684549 - protein, 22 aa, Entamoeba histolytica
KSLEELRKFIIVQTEAGVISRQ

SEQ ID NO: 2684550 - protein, 21 aa, Entamoeba histolytica
KSLFLKRDLYCLQMQNHDYNG

SEQ ID NO: 2684551 - protein, 43 aa, Entamoeba histolytica
KSLLDNTDDFILMSLEYLYFDSVWVTLKMELLDEEDLDDSIGD

SEQ ID NO: 2684552 - protein, 19 aa, Entamoeba histolytica
KSLLETKEKYMLVEYQSKL

SEQ ID NO: 2684553 - protein, 23 aa, Entamoeba histolytica
KSLLITNCESIDFSVNRIKGLLE

SEQ ID NO: 2684554 - protein, 30 aa, Entamoeba histolytica
KSLLKTVVDPGCLKAGFEVVSMIYKGLPEN

SEQ ID NO: 2684555 - protein, 22 aa, Entamoeba histolytica
KSLNRCCFIIFTGNHFDVLCLS

SEQ ID NO: 2684556 - protein, 19 aa, Entamoeba histolytica
KSLPKGLAKCVDMNYIELT

SEQ ID NO: 2684557 - protein, 20 aa, Entamoeba histolytica
KSLPKGLAKCVDMNYIELTS

SEQ ID NO: 2684558 - protein, 25 aa, Entamoeba histolytica
KSLPNIFSSITIYFGRDIDQQNRTE

SEQ ID NO: 2684559 - protein, 19 aa, Entamoeba histolytica
KSLPPEIGMLDKLQTLLVN

SEQ ID NO: 2684560 - protein, 23 aa, Entamoeba histolytica
KSLRAYFFCILLKIFRVYMKIAR

SEQ ID NO: 2684561 - protein, 21 aa, Entamoeba histolytica
KSLRSLQHFGRTLGLTPSQSY

SEQ ID NO: 2684562 - protein, 20 aa, Entamoeba histolytica
KSLSGLHMFYITTGWNSFLW

SEQ ID NO: 2684563 - protein, 19 aa, Entamoeba histolytica
KSLYLHAYQSYVWNQVVSK

SEQ ID NO: 2684564 - protein, 17 aa, Entamoeba histolytica
KSMKYKDLLVICWEAYG

SEQ ID NO: 2684565 - protein, 29 aa, Entamoeba histolytica
KSMWQELQGEFKISTIAKVDLENQLESLK

SEQ ID NO: 2684566 - protein, 19 aa, Entamoeba histolytica
KSNAEVIFPIEGLKARDIV

SEQ ID NO: 2684567 - protein, 25 aa, Entamoeba histolytica
KSNCFSCIHCNLMIHTHCVYPLQLQ

SEQ ID NO: 2684568 - protein, 20 aa, Entamoeba histolytica
KSNELHCIESFIEHSVPYVE

SEQ ID NO: 2684569 - protein, 24 aa, Entamoeba histolytica
KSNEWRERRISCLLLGEMAKQTTH

SEQ ID NO: 2684570 - protein, 18 aa, Entamoeba histolytica
KSNFTWSGIEEIKEEEEE

SEQ ID NO: 2684571 - protein, 18 aa, Entamoeba histolytica
KSNFYDLGGDSFVGAQTV

SEQ ID NO: 2684572 - protein, 19 aa, Entamoeba histolytica
KSNGTIHLIMLMSILDRIS

SEQ ID NO: 2684573 - protein, 17 aa, Entamoeba histolytica
KSNIKIIYNPTVSPANE

SEQ ID NO: 2684574 - protein, 18 aa, Entamoeba histolytica
KSNIPLVVSIVDGIEIYQ

SEQ ID NO: 2684575 - protein, 23 aa, Entamoeba histolytica
KSNKLEPRESFIVRTDKKTSSNI

SEQ ID NO: 2684576 - protein, 17 aa, Entamoeba histolytica
KSNKPRYFYLFDDVMVY

SEQ ID NO: 2684577 - protein, 26 aa, Entamoeba histolytica
KSNPRKMVKMWAEKEMRNLKRINTAG

SEQ ID NO: 2684578 - protein, 20 aa, Entamoeba histolytica
KSNRKLFAFTKEFDNLLKES

SEQ ID NO: 2684579 - protein, 21 aa, Entamoeba histolytica
KSNVHKPQKEDLKGQPQQPPS

SEQ ID NO: 2684580 - protein, 25 aa, Entamoeba histolytica
KSNVIDGLLFVFGRRAKQIRQQKVA

SEQ ID NO: 2684581 - protein, 22 aa, Entamoeba histolytica
KSNYKNFLWKILKTLFDDYVDF

SEQ ID NO: 2684582 - protein, 25 aa, Entamoeba histolytica
KSNYVFCVPYAFAIVGSGKSAISPK

SEQ ID NO: 2684583 - protein, 18 aa, Entamoeba histolytica
KSPDFKEWNVITVDIHNV

SEQ ID NO: 2684584 - protein, 33 aa, Entamoeba histolytica; identical to SEQ ID NO: 2492028

SEQ ID NO: 2684585 - protein, 19 aa, Entamoeba histolytica
KSPIAFNLSNAFTALSYNT

SEQ ID NO: 2684586 - protein, 17 aa, Entamoeba histolytica
KSPILFLAPTSFKRHSV

SEQ ID NO: 2684587 - protein, 26 aa, Entamoeba histolytica
KSPIWPEEFLQPLVSCMDSQNKMSLI

SEQ ID NO: 2684588 - protein, 28 aa, Entamoeba histolytica
KSPKDLLTLLSIKDFYLMFMLFFDDDNT

SEQ ID NO: 2684589 - protein, 23 aa, Entamoeba histolytica
KSPNEALRFLGYTTVSQLILLLE

SEQ ID NO: 2684590 - protein, 21 aa, Entamoeba histolytica
KSPQVFSYFIKVARHCLKIGE

SEQ ID NO: 2684591 - protein, 19 aa, Entamoeba histolytica
KSPVLLKMYLINRLRSIYE

SEQ ID NO: 2684592 - protein, 19 aa, Entamoeba histolytica
KSQCKLITQMFIRKCQIKE

SEQ ID NO: 2684593 - protein, 21 aa, Entamoeba histolytica
KSQECPLDILNASLFNQLNIL

SEQ ID NO: 2684594 - protein, 18 aa, Entamoeba histolytica
KSQIEAMKEDKLIKQRSE

SEQ ID NO: 2684595 - protein, 21 aa, Entamoeba histolytica
KSQKKLTAFFNVSKKSETNSQ

SEQ ID NO: 2684596 - protein, 18 aa, Entamoeba histolytica
KSQLFLLIDGRIINSQTG

SEQ ID NO: 2684597 - protein, 19 aa, Entamoeba histolytica
KSQLLRYVMSIAPLAVSTN

SEQ ID NO: 2684598 - protein, 25 aa, Entamoeba histolytica
KSQYKLEKIILYFKTISCKVADFIL

SEQ ID NO: 2684599 - protein, 23 aa, Entamoeba histolytica
KSQYKMYVEFFIKNIDFKEPESR

SEQ ID NO: 2684600 - protein, 19 aa, Entamoeba histolytica
KSQYKTVCDNEFYQKLESK

SEQ ID NO: 2684601 - protein, 19 aa, Entamoeba histolytica
KSRCRLEAESLGATITNDY

SEQ ID NO: 2684602 - protein, 24 aa, Entamoeba histolytica
KSREINVSLHLKKNPIPLLIFINT

SEQ ID NO: 2684603 - protein, 25 aa, Entamoeba histolytica
KSREVLKRRECIKARIEDLKTTLNS

SEQ ID NO: 2684604 - protein, 19 aa, Entamoeba histolytica
KSRIIDIMTQFAHPENWDF

SEQ ID NO: 2684605 - protein, 23 aa, Entamoeba histolytica
KSRKIYLELCDVMGSELQALSFP

SEQ ID NO: 2684606 - protein, 23 aa, Entamoeba histolytica
KSRKRSTKIIPFNIERVTYQGEV

SEQ ID NO: 2684607 - protein, 21 aa, Entamoeba histolytica
KSRTRELMFGTSPFNQTNTSP

SEQ ID NO: 2684608 - protein, 19 aa, Entamoeba histolytica
KSRVEVCVHNFSRLKPTSL

SEQ ID NO: 2684609 - protein, 20 aa, Entamoeba histolytica
KSSEFRFDELLIYLQSLQGL

SEQ ID NO: 2684610 - protein, 24 aa, Entamoeba histolytica
KSSESLKNLLAMCLKKEAKKRCKI

SEQ ID NO: 2684611 - protein, 20 aa, Entamoeba histolytica
KSSEVILDLQGMQFDDEGIN

SEQ ID NO: 2684612 - protein, 19 aa, Entamoeba histolytica
KSSFADGVYGFVVDVPSHR

SEQ ID NO: 2684613 - protein, 25 aa, Entamoeba histolytica
KSSFIEALVGFQFNVVESTIGTRRP

SEQ ID NO: 2684614 - protein, 18 aa, Entamoeba histolytica
KSSGYIFVYSRINKEENE

SEQ ID NO: 2684615 - protein, 18 aa, Entamoeba histolytica
KSSTLPAFHPFSINLLQL

SEQ ID NO: 2684616 - protein, 21 aa, Entamoeba histolytica
KSSVEDLQWSPKEADVFLSCS

SEQ ID NO: 2684617 - protein, 19 aa, Entamoeba histolytica
KSSVGNFILKSNVFKVSDS

SEQ ID NO: 2684618 - protein, 22 aa, Entamoeba histolytica
KSSYCIPLILVRCFKIIDECEY

SEQ ID NO: 2684619 - protein, 23 aa, Entamoeba histolytica
KSTACTILLRGGSKDVLNEVERN

SEQ ID NO: 2684620 - protein, 21 aa, Entamoeba histolytica
KSTAFLEYLFKPVSFKEFNGP

SEQ ID NO: 2684621 - protein, 24 aa, Entamoeba histolytica
KSTCLKIGDELSFSFHILNKSKYD

SEQ ID NO: 2684622 - protein, 20 aa, Entamoeba histolytica
KSTDCLCSWIQYSTISIDYY

SEQ ID NO: 2684623 - protein, 18 aa, Entamoeba histolytica
KSTDFKTALSNLIDLTFE

SEQ ID NO: 2684624 - protein, 19 aa, Entamoeba histolytica
KSTDIIFIYMYKMFTIKHI

SEQ ID NO: 2684625 - protein, 21 aa, Entamoeba histolytica
KSTELKALMNRNISSVDIKYG

SEQ ID NO: 2684626 - protein, 17 aa, Entamoeba histolytica
KSTFFVELLDKTPSDLA

SEQ ID NO: 2684627 - protein, 20 aa, Entamoeba histolytica
KSTGEWSLFTLENELLQTDC

SEQ ID NO: 2684628 - protein, 19 aa, Entamoeba histolytica
KSTHSVFVTSFPVAPTSCF

SEQ ID NO: 2684629 - protein, 21 aa, Entamoeba histolytica
KSTILMFKKMSSITVYHTQHY

SEQ ID NO: 2684630 - protein, 26 aa, Entamoeba histolytica
KSTLLRTVCLAVIMAQMGMRCTGEEI

SEQ ID NO: 2684631 - protein, 19 aa, Entamoeba histolytica
KSTPEWEEKPIDKWKKTTT

SEQ ID NO: 2684632 - protein, 17 aa, Entamoeba histolytica
KSTSFKRRYSSRSRSRS

SEQ ID NO: 2684633 - protein, 24 aa, Entamoeba histolytica
KSTSFLIKLQTIWMSSKDQLEPCL

SEQ ID NO: 2684634 - protein, 23 aa, Entamoeba histolytica
KSTSLPRLNIRSSTVVDRPKNIG

SEQ ID NO: 2684635 - protein, 26 aa, Entamoeba histolytica
KSTTDPCRFMGCGPSSSTSSGYRKGG

SEQ ID NO: 2684636 - protein, 19 aa, Entamoeba histolytica
KSTTIVFCFSYSLESESKQ

SEQ ID NO: 2684637 - protein, 21 aa, Entamoeba histolytica
KSTTSSICFNPPTTLTHLDSK

SEQ ID NO: 2684638 - protein, 28 aa, Entamoeba histolytica
KSVARIKGFPSILAVDVFKEYTQLKGIN

SEQ ID NO: 2684639 - protein, 23 aa, Entamoeba histolytica
KSVKIEYCKKMGVILPEMRNRMK

SEQ ID NO: 2684640 - protein, 21 aa, Entamoeba histolytica
KSVKWFGNMLIVKRQSMIEAD

SEQ ID NO: 2684641 - protein, 22 aa, Entamoeba histolytica
KSVLIVLDCRAMANAVANRLSG

SEQ ID NO: 2684642 - protein, 17 aa, Entamoeba histolytica
KSVLRLISHDKIIVQYL

SEQ ID NO: 2684643 - protein, 19 aa, Entamoeba histolytica
KSVPCAATEYFSLRFKEMG

SEQ ID NO: 2684644 - protein, 24 aa, Entamoeba histolytica
KSVPFKRFYLEAIRLLQPKENFTC

SEQ ID NO: 2684645 - protein, 17 aa, Entamoeba histolytica
KSYARKTTIGKFDSKFN

SEQ ID NO: 2684646 - protein, 22 aa, Entamoeba histolytica
KSYFEDLDTFILEEDIDTGDKD

SEQ ID NO: 2684647 - protein, 19 aa, Entamoeba histolytica
KSYFVCSAKTGDGCKEALK

SEQ ID NO: 2684648 - protein, 22 aa, Entamoeba histolytica
KSYGNGCSRIMKEEINLLQKSI

SEQ ID NO: 2684649 - protein, 19 aa, Entamoeba histolytica
KSYIKEAIIIRIFQILVEK

SEQ ID NO: 2684650 - protein, 18 aa, Entamoeba histolytica
KSYKDMNCINKFNETMLK

SEQ ID NO: 2684651 - protein, 17 aa, Entamoeba histolytica
KSYKNYFICSAKTGDGC

SEQ ID NO: 2684652 - protein, 20 aa, Entamoeba histolytica
KSYLIRCFVTALSECEGIKT

SEQ ID NO: 2684653 - protein, 23 aa, Entamoeba histolytica
KSYLRLSDEIQIIIIAYSHPSNP

SEQ ID NO: 2684654 - protein, 18 aa, Entamoeba histolytica
KSYQILIQKNFKEMLDGF

SEQ ID NO: 2684655 - protein, 21 aa, Entamoeba histolytica
KTAAFALPIIHHLSTDPYTGF

SEQ ID NO: 2684656 - protein, 18 aa, Entamoeba histolytica
KTATFSIGILQNVESNKR

SEQ ID NO: 2684657 - protein, 24 aa, Entamoeba histolytica
KTAYDYRCSLGMGITGYAAQEYIE

SEQ ID NO: 2684658 - protein, 23 aa, Entamoeba histolytica
KTCGGSLIGILFEMLKDDSKKNY

SEQ ID NO: 2684659 - protein, 18 aa, Entamoeba histolytica
KTCMNNCDVQLFVPLIPL

SEQ ID NO: 2684660 - protein, 17 aa, Entamoeba histolytica
KTCQAEMWIGKGSIELS

SEQ ID NO: 2684661 - protein, 25 aa, Entamoeba histolytica
KTCSLYYKMVMSIGVEEEEMDFSEQ

SEQ ID NO: 2684662 - protein, 18 aa, Entamoeba histolytica
KTDRKALDEYLRKVFTTY

SEQ ID NO: 2684663 - protein, 21 aa, Entamoeba histolytica
KTDRSLYRFIITNTLEATKAV

SEQ ID NO: 2684664 - protein, 25 aa, Entamoeba histolytica
KTDTSTCLLCLVNIIKLSTGIKYIT

SEQ ID NO: 2684665 - protein, 19 aa, Entamoeba histolytica
KTEAVSCRPILADPKEVRR

SEQ ID NO: 2684666 - protein, 32 aa, Entamoeba histolytica
KTEDVFTQMFWKLGMKSFDDFITKLEILPRKS

SEQ ID NO: 2684667 - protein, 18 aa, Entamoeba histolytica
KTEFAIQEIFLKYNTFML

SEQ ID NO: 2684668 - protein, 22 aa, Entamoeba histolytica
KTEGKKALAVEAFARALRQLPM

SEQ ID NO: 2684669 - protein, 24 aa, Entamoeba histolytica
KTEHKIKGVLLIYKYAELDPNASK

SEQ ID NO: 2684670 - protein, 32 aa, Entamoeba histolytica
KTEINDFCNYEWSLTCELSFLESLYQYGNNME

SEQ ID NO: 2684671 - protein, 26 aa, Entamoeba histolytica
KTEIPKFLVKVLVDFASTTFTIKSCI

SEQ ID NO: 2684672 - protein, 23 aa, Entamoeba histolytica
KTEKLEELCFIFTSLSLLSEQAE

SEQ ID NO: 2684673 - protein, 23 aa, Entamoeba histolytica
KTEKVFWVCRECGYIFESTQPPK

SEQ ID NO: 2684674 - protein, 20 aa, Entamoeba histolytica
KTELCRSFVETGTCRYGNKC

SEQ ID NO: 2684675 - protein, 26 aa, Entamoeba histolytica
KTELFRIKANYDLRFNVKLSNDDSNN

SEQ ID NO: 2684676 - protein, 23 aa, Entamoeba histolytica
KTELNLTIIEWLRLQDYRIEPKD

SEQ ID NO: 2684677 - protein, 18 aa, Entamoeba histolytica
KTELRLTALESITKLVRS

SEQ ID NO: 2684678 - protein, 18 aa, Entamoeba histolytica
KTEMNLFIEEEYFKNYKE

SEQ ID NO: 2684679 - protein, 20 aa, Entamoeba histolytica
KTEPLPEKKMTVAQQDDLTS

SEQ ID NO: 2684680 - protein, 22 aa, Entamoeba histolytica
KTEPVYKLYISIEEAMNGCHKL

SEQ ID NO: 2684681 - protein, 26 aa, Entamoeba histolytica
KTERIICFTEKWFVERDASSYTVKYA

SEQ ID NO: 2684682 - protein, 26 aa, Entamoeba histolytica
KTEYKRIRENGGFVIGNRTNGGLAVS

SEQ ID NO: 2684683 - protein, 19 aa, Entamoeba histolytica
KTFAEMFLDGEIEEEEMIF

SEQ ID NO: 2684684 - protein, 28 aa, Entamoeba histolytica
KTFEGLRSPCRIVVILLFHYFNKMYELN

SEQ ID NO: 2684685 - protein, 24 aa, Entamoeba histolytica
KTFILRDDIQLIFFGFDKKGSNIN

SEQ ID NO: 2684686 - protein, 18 aa, Entamoeba histolytica
KTFKELRNSKTIPIKIEA

SEQ ID NO: 2684687 - protein, 23 aa, Entamoeba histolytica
KTFLFKIGLIVTDGYGTSETGSL

SEQ ID NO: 2684688 - protein, 18 aa, Entamoeba histolytica
KTFTQFGACEFMKDLQQI

SEQ ID NO: 2684689 - protein, 24 aa, Entamoeba histolytica
KTGDEKLVYCTVGVMLRKVLGNPD

SEQ ID NO: 2684690 - protein, 24 aa, Entamoeba histolytica
KTGEIPPPPPLHMDSSGNPILSSS

SEQ ID NO: 2684691 - protein, 31 aa, Entamoeba histolytica
KTGLKTCLVRKFIVREDFNVFLFTDNSLQVF

SEQ ID NO: 2684692 - protein, 17 aa, Entamoeba histolytica
KTGMCKELAPLNPDWIY

SEQ ID NO: 2684693 - protein, 18 aa, Entamoeba histolytica
KTGMCKELAPLNPDWIYI

SEQ ID NO: 2684694 - protein, 17 aa, Entamoeba histolytica
KTGNVIITKSVIYTNFP

SEQ ID NO: 2684695 - protein, 24 aa, Entamoeba histolytica
KTGTTICGLVCDKGQTVVLACDSR

SEQ ID NO: 2684696 - protein, 18 aa, Entamoeba histolytica
KTHAELVTSFIERITSQT

SEQ ID NO: 2684697 - protein, 25 aa, Entamoeba histolytica
KTHANWKGACWVPTEKTTIVTISDS

SEQ ID NO: 2684698 - protein, 25 aa, Entamoeba histolytica
KTIAEFKKNVELFGVLDEDDRKSLF

SEQ ID NO: 2684699 - protein, 23 aa, Entamoeba histolytica
KTIAEVFYSIGFDGYCDAQDSNF

SEQ ID NO: 2684700 - protein, 18 aa, Entamoeba histolytica
KTIASFLIWTTRNAGVGI

SEQ ID NO: 2684701 - protein, 20 aa, Entamoeba histolytica
KTIDPERWIPLYQRKKKQKK

SEQ ID NO: 2684702 - protein, 25 aa, Entamoeba histolytica
KTIEYCPLKTLYLKDLCQCQNLEYL

SEQ ID NO: 2684703 - protein, 29 aa, Entamoeba histolytica
KTIEYKPDWSRGYSRKAFALLKLERYEEA

SEQ ID NO: 2684704 - protein, 23 aa, Entamoeba histolytica
KTIFEVLKTYPFISDEQKSMVEY

SEQ ID NO: 2684705 - protein, 17 aa, Entamoeba histolytica
KTIHLILTLCLNIGTDS

SEQ ID NO: 2684706 - protein, 25 aa, Entamoeba histolytica
KTIIKEFDFDEGIDFVVKGNRLFIQ

SEQ ID NO: 2684707 - protein, 24 aa, Entamoeba histolytica
KTIIKLKIPIGIGEFSRFVQVKER

SEQ ID NO: 2684708 - protein, 24 aa, Entamoeba histolytica
KTIIKLRKICNIKIGYENKEIIPL

SEQ ID NO: 2684709 - protein, 21 aa, Entamoeba histolytica
KTIIPLSIYLKSIFKNNEVKI

SEQ ID NO: 2684710 - protein, 18 aa, Entamoeba histolytica
KTIIPLYFGEFVVVTESK

SEQ ID NO: 2684711 - protein, 17 aa, Entamoeba histolytica
KTIKAWDLRTKMNNPIQ

SEQ ID NO: 2684712 - protein, 25 aa, Entamoeba histolytica
KTIKEKLFKICSSFEEEFNDLSDQI

SEQ ID NO: 2684713 - protein, 18 aa, Entamoeba histolytica
KTIKFARPTECLPKVLPF

SEQ ID NO: 2684714 - protein, 24 aa, Entamoeba histolytica
KTIKFIDCTICFNKINFYPLQTLT

SEQ ID NO: 2684715 - protein, 23 aa, Entamoeba histolytica
KTIKLERCRNIFLQQNLPNLKTL

SEQ ID NO: 2684716 - protein, 23 aa, Entamoeba histolytica
KTIKSCVYDSSFDEIKPSKFYEK

SEQ ID NO: 2684717 - protein, 24 aa, Entamoeba histolytica
KTIKSQRLISALTFSSSFYESIQP

SEQ ID NO: 2684718 - protein, 18 aa, Entamoeba histolytica
KTIPKVSILFQFENFQRY

SEQ ID NO: 2684719 - protein, 17 aa, Entamoeba histolytica
KTIPMNFTPSIMKVYGN

SEQ ID NO: 2684720 - protein, 17 aa, Entamoeba histolytica
KTIQMSIIFEVMSIVIK

SEQ ID NO: 2684721 - protein, 18 aa, Entamoeba histolytica
KTIREYLLYCLDLNNDSV

SEQ ID NO: 2684722 - protein, 22 aa, Entamoeba histolytica
KTISIDDVCLCLKYCKENKRFI

SEQ ID NO: 2684723 - protein, 21 aa, Entamoeba histolytica
KTKAGVIDLDHPIILSYLTSS

SEQ ID NO: 2684724 - protein, 20 aa, Entamoeba histolytica
KTKAICEIMKCSSEKNAEKV

SEQ ID NO: 2684725 - protein, 18 aa, Entamoeba histolytica
KTKFVITCYFRCTDKDLK

SEQ ID NO: 2684726 - protein, 26 aa, Entamoeba histolytica
KTKGFYEWKKSLMLSGKAKKMTELFE

SEQ ID NO: 2684727 - protein, 21 aa, Entamoeba histolytica
KTKGKYTIRVSYIQVEDKKIS

SEQ ID NO: 2684728 - protein, 17 aa, Entamoeba histolytica
KTKIPKLSEKTIKLPAN

SEQ ID NO: 2684729 - protein, 19 aa, Entamoeba histolytica
KTKISRALFVASLLNELPI

SEQ ID NO: 2684730 - protein, 17 aa, Entamoeba histolytica
KTKKFECKVCGAKQSYK

SEQ ID NO: 2684731 - protein, 23 aa, Entamoeba histolytica
KTKKLEEFCCFLLNDYFLMTKVK

SEQ ID NO: 2684732 - protein, 18 aa, Entamoeba histolytica
KTKKYWSFEQKMFAVEKV

SEQ ID NO: 2684733 - protein, 24 aa, Entamoeba histolytica
KTKLGWGHFSTVWLVEFQNNGKFE

SEQ ID NO: 2684734 - protein, 18 aa, Entamoeba histolytica
KTKLHVFNDMIILVQKQG

SEQ ID NO: 2684735 - protein, 24 aa, Entamoeba histolytica
KTKLKFKIPGLLVMDTPGHEAFNN

SEQ ID NO: 2684736 - protein, 19 aa, Entamoeba histolytica
KTKLNKNCFETKPKKISKI

SEQ ID NO: 2684737 - protein, 20 aa, Entamoeba histolytica
KTKLQILESFIKRNQKKSIS

SEQ ID NO: 2684738 - protein, 17 aa, Entamoeba histolytica
KTKLSLISIPSLKTMKQ

SEQ ID NO: 2684739 - protein, 20 aa, Entamoeba histolytica
KTKQAFDFKFIREGSSSVDD

SEQ ID NO: 2684740 - protein, 20 aa, Entamoeba histolytica
KTKSTSCIPLQPSRNQKRVK

SEQ ID NO: 2684741 - protein, 23 aa, Entamoeba histolytica
KTKTKELLGEWIVALQSSTVIIQ

SEQ ID NO: 2684742 - protein, 18 aa, Entamoeba histolytica
KTKVISFIGLIQGLITDE

SEQ ID NO: 2684743 - protein, 21 aa, Entamoeba histolytica
KTKVKSLLMIISYLEKNQNNG

SEQ ID NO: 2684744 - protein, 19 aa, Entamoeba histolytica
KTLAQRKKRNAIIMKGFQV

SEQ ID NO: 2684745 - protein, 17 aa, Entamoeba histolytica
KTLCSPKKLIGADLPCD

SEQ ID NO: 2684746 - protein, 19 aa, Entamoeba histolytica
KTLEEWSGYSKPTIIFDSD

SEQ ID NO: 2684747 - protein, 23 aa, Entamoeba histolytica
KTLESISLLGYLYHVQDCHGPHI

SEQ ID NO: 2684748 - protein, 17 aa, Entamoeba histolytica
KTLFFGEALQFKLVINI

SEQ ID NO: 2684749 - protein, 18 aa, Entamoeba histolytica
KTLFKQMYPDGVDERKAP

SEQ ID NO: 2684750 - protein, 21 aa, Entamoeba histolytica
KTLFPIIKFDSISFFFRTWEV

SEQ ID NO: 2684751 - protein, 17 aa, Entamoeba histolytica
KTLGEFCFSNSLNTSII

SEQ ID NO: 2684752 - protein, 23 aa, Entamoeba histolytica
KTLGWQFKISVKYVEIYNNNIFD

SEQ ID NO: 2684753 - protein, 21 aa, Entamoeba histolytica
KTLIAKYLFKEISILLMSKAS

SEQ ID NO: 2684754 - protein, 18 aa, Entamoeba histolytica
KTLIAQEHIDTMQPVSKT

SEQ ID NO: 2684755 - protein, 24 aa, Entamoeba histolytica
KTLIDCLICKGRVVEAVRFAEHKK

SEQ ID NO: 2684756 - protein, 23 aa, Entamoeba histolytica
KTLIKRKIPVIDCDKLGHELYQK

SEQ ID NO: 2684757 - protein, 28 aa, Entamoeba histolytica
KTLKTLSHFVALKCCVEVGSAAAQAKYS

SEQ ID NO: 2684758 - protein, 26 aa, Entamoeba histolytica
KTLLDKSCQLFHAIPQPKPRKEGITP

SEQ ID NO: 2684759 - protein, 23 aa, Entamoeba histolytica
KTLLFKEGFLKTLTDVIGRTDNQ

SEQ ID NO: 2684760 - protein, 18 aa, Entamoeba histolytica
KTLLKKYLAMSIEKKLVV

SEQ ID NO: 2684761 - protein, 18 aa, Entamoeba histolytica
KTLRINRTRLVHIYFALQ

SEQ ID NO: 2684762 - protein, 17 aa, Entamoeba histolytica
KTLRLSTINDLLHINPV

SEQ ID NO: 2684763 - protein, 23 aa, Entamoeba histolytica
KTLSVKYANNWVVITGTRQVEGK

SEQ ID NO: 2684764 - protein, 17 aa, Entamoeba histolytica
KTLYEFNNQSSLLSASV

SEQ ID NO: 2684765 - protein, 24 aa, Entamoeba histolytica
KTLYYCFRFINHIMGGYEYYQFQK

SEQ ID NO: 2684766 - protein, 22 aa, Entamoeba histolytica
KTMIFKKFLKGEVNRAKESFWC

SEQ ID NO: 2684767 - protein, 18 aa, Entamoeba histolytica
KTMKPRKITKISMVKDKK

SEQ ID NO: 2684768 - protein, 19 aa, Entamoeba histolytica
KTMKSNCSVLSLKGTCGKI

SEQ ID NO: 2684769 - protein, 24 aa, Entamoeba histolytica
KTMKTPPGYWCIFTQSGKTMHCEL

SEQ ID NO: 2684770 - protein, 20 aa, Entamoeba histolytica
KTMMCCKCMEEFSVDSQESQ

SEQ ID NO: 2684771 - protein, 21 aa, Entamoeba histolytica
KTMPIRWTAPEAAARGIFTIK

SEQ ID NO: 2684772 - protein, 20 aa, Entamoeba histolytica
KTMVRYSLVTDRYLTQEKSS

SEQ ID NO: 2684773 - protein, 25 aa, Entamoeba histolytica
KTMWIPTPVCTLILNNLLSPGSWEV

SEQ ID NO: 2684774 - protein, 19 aa, Entamoeba histolytica
KTNDSIKCVLNDMERMLFF

SEQ ID NO: 2684775 - protein, 20 aa, Entamoeba histolytica
KTNFKKLILNSTIKYLKLDY

SEQ ID NO: 2684776 - protein, 20 aa, Entamoeba histolytica
KTNLDFIIQICTGMKKLHSI

SEQ ID NO: 2684777 - protein, 18 aa, Entamoeba histolytica
KTNLRICYLAKKPLKNHL

SEQ ID NO: 2684778 - protein, 23 aa, Entamoeba histolytica
KTNPKCFHWPYINVLPETYDCPL

SEQ ID NO: 2684779 - protein, 22 aa, Entamoeba histolytica
KTNRISDGVVRIRFVAGDAAYK

SEQ ID NO: 2684780 - protein, 30 aa, Entamoeba histolytica
KTNVICMFIQLLSKFILVWCSIYGDSPSKT

SEQ ID NO: 2684781 - protein, 21 aa, Entamoeba histolytica
KTNVRLSGILSRVKAANKSSS

SEQ ID NO: 2684782 - protein, 18 aa, Entamoeba histolytica
KTNYFYKILKTIREYIIQ

SEQ ID NO: 2684783 - protein, 27 aa, Entamoeba histolytica
KTPALSVLHRVRFIFQPNQLMKTTEAV

SEQ ID NO: 2684784 - protein, 23 aa, Entamoeba histolytica
KTPEEIRKTFGIVNDFTPEEEEQ

SEQ ID NO: 2684785 - protein, 22 aa, Entamoeba histolytica
KTPELKLRIALNKSGILELVDA

SEQ ID NO: 2684786 - protein, 18 aa, Entamoeba histolytica
KTPERICVIDVDAGTEGD

SEQ ID NO: 2684787 - protein, 25 aa, Entamoeba histolytica
KTPEYKGLCASTLYYWIKSSEHKTS

SEQ ID NO: 2684788 - protein, 32 aa, Entamoeba histolytica
KTPGFEIINHIPSVCPLCTPPELAKLTMKITE

SEQ ID NO: 2684789 - protein, 20 aa, Entamoeba histolytica
KTPKTIPLKAIEKVIEQVGN

SEQ ID NO: 2684790 - protein, 19 aa, Entamoeba histolytica
KTPKYGLIFHAALIGQAPA

SEQ ID NO: 2684791 - protein, 17 aa, Entamoeba histolytica
KTPLCTLRCSLQRFLSL

SEQ ID NO: 2684792 - protein, 19 aa, Entamoeba histolytica
KTPLFSIKSWTNCETFEML

SEQ ID NO: 2684793 - protein, 23 aa, Entamoeba histolytica
KTPLFSIKSWTNCETFEMLYDSD

SEQ ID NO: 2684794 - protein, 18 aa, Entamoeba histolytica
KTPREMNQNLSLMMTLYK

SEQ ID NO: 2684795 - protein, 21 aa, Entamoeba histolytica
KTPRIADIACFLRDAAHFNDS

SEQ ID NO: 2684796 - protein, 17 aa, Entamoeba histolytica
KTPSLKFSPPTIFNKER

SEQ ID NO: 2684797 - protein, 22 aa, Entamoeba histolytica
KTPSSCICCQCFDETKHQGHIY

SEQ ID NO: 2684798 - protein, 19 aa, Entamoeba histolytica
KTPTKRLEIEDVPNQKKRS

SEQ ID NO: 2684799 - protein, 19 aa, Entamoeba histolytica
KTQEFSFNFKVLKPSTEIK

SEQ ID NO: 2684800 - protein, 17 aa, Entamoeba histolytica
KTQILIVLKQWMQSYPN

SEQ ID NO: 2684801 - protein, 21 aa, Entamoeba histolytica
KTQKFLCMFFGEIKQIQNSIK

SEQ ID NO: 2684802 - protein, 30 aa, Entamoeba histolytica
KTQNWKLMPITGIFKVCLSTYYGQTTNPGM

SEQ ID NO: 2684803 - protein, 20 aa, Entamoeba histolytica
KTRKADEFYQLHDFMSTSQP

SEQ ID NO: 2684804 - protein, 25 aa, Entamoeba histolytica
KTRLFYLKKYEYFEISYKSNISLQM

SEQ ID NO: 2684805 - protein, 19 aa, Entamoeba histolytica
KTRLMKITTNFSIFESSAK

SEQ ID NO: 2684806 - protein, 19 aa, Entamoeba histolytica
KTRNTMVLLSFYNACNKIP

SEQ ID NO: 2684807 - protein, 17 aa, Entamoeba histolytica
KTRRITKNITHSNGSTT

SEQ ID NO: 2684808 - protein, 24 aa, Entamoeba histolytica
KTSIRYKLLLGKFAMNIPTIGFGV

SEQ ID NO: 2684809 - protein, 24 aa, Entamoeba histolytica
KTSIVDLLPCFAKYSQVIALNDSD

SEQ ID NO: 2684810 - protein, 20 aa, Entamoeba histolytica
KTSKVCLQFFKIETLKFSDT

SEQ ID NO: 2684811 - protein, 28 aa, Entamoeba histolytica
KTSKVESIQEPKPLLHTETVPIINSNPF

SEQ ID NO: 2684812 - protein, 25 aa, Entamoeba histolytica
KTSKVESIQEPKPLLHTETVPIITS

SEQ ID NO: 2684813 - protein, 19 aa, Entamoeba histolytica
KTSLFSLSVCSVLMVNLWS

SEQ ID NO: 2684814 - protein, 18 aa, Entamoeba histolytica
KTSLITRYINDIYFDSKL

SEQ ID NO: 2684815 - protein, 22 aa, Entamoeba histolytica
KTSNCKLSIYGRHKRLDLKKMT

SEQ ID NO: 2684816 - protein, 19 aa, Entamoeba histolytica
KTSNSSCCKMTFNNELKEI

SEQ ID NO: 2684817 - protein, 23 aa, Entamoeba histolytica
KTSSIKGVLTFSFKSTPFADKLY

SEQ ID NO: 2684818 - protein, 19 aa, Entamoeba histolytica
KTSVLIRFFSGYFVQMYDP

SEQ ID NO: 2684819 - protein, 25 aa, Entamoeba histolytica
KTSYTCLTCYGRYVTICGECYNPNE

SEQ ID NO: 2684820 - protein, 18 aa, Entamoeba histolytica
KTTALVFHSGKLVVTGGK

SEQ ID NO: 2684821 - protein, 25 aa, Entamoeba histolytica
KTTASLVLGFIWMLFDKFQEKDIKL

SEQ ID NO: 2684822 - protein, 24 aa, Entamoeba histolytica
KTTGKWKVKLPWEFITSENYPKTI

SEQ ID NO: 2684823 - protein, 25 aa, Entamoeba histolytica
KTTGKWKVKLPWEFITSENYPKTIE

SEQ ID NO: 2684824 - protein, 24 aa, Entamoeba histolytica
KTTILSRFDMIFMIRDKHDAKRDK

SEQ ID NO: 2684825 - protein, 17 aa, Entamoeba histolytica
KTTINLCKDFEPKNYGF

SEQ ID NO: 2684826 - protein, 24 aa, Entamoeba histolytica
KTTPKRFSEFEAFHNLIKYVTNDP

SEQ ID NO: 2684827 - protein, 17 aa, Entamoeba histolytica
KTTRFIVDTGYSFKSTF

SEQ ID NO: 2684828 - protein, 20 aa, Entamoeba histolytica
KTTRLCVLILQSLKEIKPLQ

SEQ ID NO: 2684829 - protein, 17 aa, Entamoeba histolytica
KTVCSIKLKSLQVGEYH

SEQ ID NO: 2684830 - protein, 19 aa, Entamoeba histolytica
KTVCYKCHDQISATSAFVV

SEQ ID NO: 2684831 - protein, 19 aa, Entamoeba histolytica
KTVEHILLFINKQLRDTTT

SEQ ID NO: 2684832 - protein, 18 aa, Entamoeba histolytica
KTVLEMLRDRGYITSEED

SEQ ID NO: 2684833 - protein, 17 aa, Entamoeba histolytica
KTVLMIVDQCLRCIEHV

SEQ ID NO: 2684834 - protein, 17 aa, Entamoeba histolytica
KTVTKFFTSRNYPPLAE

SEQ ID NO: 2684835 - protein, 25 aa, Entamoeba histolytica
KTWGKNVRPGISFEQFVAQLYKLGK

SEQ ID NO: 2684836 - protein, 18 aa, Entamoeba histolytica
KTWPEIKNQINVCKHLHE

SEQ ID NO: 2684837 - protein, 22 aa, Entamoeba histolytica
KTYKGRIIRIILPVEIDSIKKT

SEQ ID NO: 2684838 - protein, 25 aa, Entamoeba histolytica
KTYLFSTLCPTPWTAFAVGYLKTAC

SEQ ID NO: 2684839 - protein, 25 aa, Entamoeba histolytica
KTYYCYTCNEILCPECYMLDHSGDD

SEQ ID NO: 2684840 - protein, 19 aa, Entamoeba histolytica
KTYYDWFAYNGDGIHSIDQ

SEQ ID NO: 2684841 - protein, 19 aa, Entamoeba histolytica
KVAEGFKQTILKRIKKIDE

SEQ ID NO: 2684842 - protein, 28 aa, Entamoeba histolytica
KVAGHRGYYLKGWGFKLNQALINYGTNF

SEQ ID NO: 2684843 - protein, 20 aa, Entamoeba histolytica
KVASHLLELTKIYNTYGTIY

SEQ ID NO: 2684844 - protein, 19 aa, Entamoeba histolytica
KVCGCPSSEHVNESRKFEY

SEQ ID NO: 2684845 - protein, 18 aa, Entamoeba histolytica
KVCGCPSSEHVNESRKYE

SEQ ID NO: 2684846 - protein, 24 aa, Entamoeba histolytica
KVCKKKVIKKSISFEDSDEEKEQT

SEQ ID NO: 2684847 - protein, 21 aa, Entamoeba histolytica
KVCLCSVCGGEMCLSLLQNKY

SEQ ID NO: 2684848 - protein, 18 aa, Entamoeba histolytica
KVCNTCATTKIALVAGGA

SEQ ID NO: 2684849 - protein, 19 aa, Entamoeba histolytica
KVDHDVVYFMDFIEHEEYK

SEQ ID NO: 2684850 - protein, 24 aa, Entamoeba histolytica
KVDIKCGCLLAQTCKKLNELFNRD

SEQ ID NO: 2684851 - protein, 27 aa, Entamoeba histolytica
KVDKKNCFMRNPMKFDGVDDMSQLTHL

SEQ ID NO: 2684852 - protein, 18 aa, Entamoeba histolytica
KVDKRKQSQLSFEINTFT

SEQ ID NO: 2684853 - protein, 24 aa, Entamoeba histolytica
KVDMWAAGIMMYFLATGKHPFEQL

SEQ ID NO: 2684854 - protein, 20 aa, Entamoeba histolytica
KVDTPLLWHQGLLVFVQRYS

SEQ ID NO: 2684855 - protein, 21 aa, Entamoeba histolytica
KVDTPLLWHQGLLVFVQRYSK

SEQ ID NO: 2684856 - protein, 22 aa, Entamoeba histolytica
KVEADLYWCLSLLLEHVQDHYT

SEQ ID NO: 2684857 - protein, 23 aa, Entamoeba histolytica
KVEFKRGLVERTFEFQKKYGNKG

SEQ ID NO: 2684858 - protein, 19 aa, Entamoeba histolytica
KVEIDDCVFIHNDPPIYFI

SEQ ID NO: 2684859 - protein, 26 aa, Entamoeba histolytica
KVEIKKGMGLERFFRITTDMSPAAIE

SEQ ID NO: 2684860 - protein, 17 aa, Entamoeba histolytica
KVEIQRIIVQSVSLEII

SEQ ID NO: 2684861 - protein, 27 aa, Entamoeba histolytica
KVEKSFKILLFFKNEYGGISSRQSYFS

SEQ ID NO: 2684862 - protein, 24 aa, Entamoeba histolytica
KVERSRFKPSFSMGPDDYGVQQLD

SEQ ID NO: 2684863 - protein, 18 aa, Entamoeba histolytica
KVEVCKRCVAAGAEYVKT

SEQ ID NO: 2684864 - protein, 18 aa, Entamoeba histolytica
KVEYCLTVKTIQRETDLT

SEQ ID NO: 2684865 - protein, 25 aa, Entamoeba histolytica
KVFDRVTVCFNYWYSGIDSRIIVLP

SEQ ID NO: 2684866 - protein, 22 aa, Entamoeba histolytica
KVFESFLCCIRSKEVQSRFIDL

SEQ ID NO: 2684867 - protein, 18 aa, Entamoeba histolytica
KVFEVGPVFRAENSNTRR

SEQ ID NO: 2684868 - protein, 23 aa, Entamoeba histolytica
KVFNEFCHSLLLFQGRQKLLLPI

SEQ ID NO: 2684869 - protein, 17 aa, Entamoeba histolytica
KVFYIPYGILDNSDPIN

SEQ ID NO: 2684870 - protein, 23 aa, Entamoeba histolytica
KVGHLFKPDSFIFGNGGAGNNWG

SEQ ID NO: 2684871 - protein, 28 aa, Entamoeba histolytica
KVGKAKEIPKIFGICKDYVLLADEDGGN

SEQ ID NO: 2684872 - protein, 29 aa, Entamoeba histolytica
KVGLKKKYLPVYIVVSPPLLLIFQSQNDY

SEQ ID NO: 2684873 - protein, 25 aa, Entamoeba histolytica
KVGVLSVHLYRPWSAKHFLEQLPKT

SEQ ID NO: 2684874 - protein, 26 aa, Entamoeba histolytica
KVGYRFTFNDCNGDSFLNARTTNNSM

SEQ ID NO: 2684875 - protein, 19 aa, Entamoeba histolytica
KVHFCNEIFCQVQTYNPQT

SEQ ID NO: 2684876 - protein, 17 aa, Entamoeba histolytica
KVHFKRYDVGEIAAKIA

SEQ ID NO: 2684877 - protein, 25 aa, Entamoeba histolytica
KVHINPIVKKECNDIYVYLSGFEDE

SEQ ID NO: 2684878 - protein, 18 aa, Entamoeba histolytica
KVHISLEIAKGIKYLQSL

SEQ ID NO: 2684879 - protein, 18 aa, Entamoeba histolytica
KVHPINFTPPIAKLEVNP

SEQ ID NO: 2684880 - protein, 19 aa, Entamoeba histolytica
KVHSLCYYCLIEYADEEEL

SEQ ID NO: 2684881 - protein, 19 aa, Entamoeba histolytica
KVHVGIVYDGIIVYLSDLI

SEQ ID NO: 2684882 - protein, 21 aa, Entamoeba histolytica
KVIDDWKRMPSSNIIDGSIVE

SEQ ID NO: 2684883 - protein, 19 aa, Entamoeba histolytica
KVIDGGMLLGNRLVGKGMS

SEQ ID NO: 2684884 - protein, 26 aa, Entamoeba histolytica
KVIDLLQKFDCWEGLFYFLSQIVNTT

SEQ ID NO: 2684885 - protein, 23 aa, Entamoeba histolytica
KVIECEKCGWVMFQSDKKSHQSW

SEQ ID NO: 2684886 - protein, 19 aa, Entamoeba histolytica
KVIFYISAMILCNMDSKNV

SEQ ID NO: 2684887 - protein, 17 aa, Entamoeba histolytica
KVIGWGDLVECFSITEP

SEQ ID NO: 2684888 - protein, 20 aa, Entamoeba histolytica
KVIIEQCADLKTLIITSPII

SEQ ID NO: 2684889 - protein, 18 aa, Entamoeba histolytica
KVIKEWKEQTEILKSILF

SEQ ID NO: 2684890 - protein, 18 aa, Entamoeba histolytica
KVIKSNYFPTTVLCSDNK

SEQ ID NO: 2684891 - protein, 17 aa, Entamoeba histolytica
KVINALQSKECVFSTII

SEQ ID NO: 2684892 - protein, 20 aa, Entamoeba histolytica
KVIPEINSLIHLKELYYSNI

SEQ ID NO: 2684893 - protein, 21 aa, Entamoeba histolytica
KVIVEECGLCLIEDSNVVVCN

SEQ ID NO: 2684894 - protein, 21 aa, Entamoeba histolytica
KVIVIDFFATWCGPCRSISPY

SEQ ID NO: 2684895 - protein, 17 aa, Entamoeba histolytica
KVIVIMLEEHRNIDAKK

SEQ ID NO: 2684896 - protein, 24 aa, Entamoeba histolytica
KVIVKLVPRFNIAHFQEIAKKMRL

SEQ ID NO: 2684897 - protein, 17 aa, Entamoeba histolytica
KVKDFISIMIINSKQIS

SEQ ID NO: 2684898 - protein, 17 aa, Entamoeba histolytica
KVKDVSCSVSFNPNAYN

SEQ ID NO: 2684899 - protein, 23 aa, Entamoeba histolytica
KVKEALNLLLIWQTRQILPVQIE

SEQ ID NO: 2684900 - protein, 19 aa, Entamoeba histolytica
KVKEFKVAFPDLSHGDFYK

SEQ ID NO: 2684901 - protein, 23 aa, Entamoeba histolytica
KVKEFLANFMEIWMDYKDIPYLV

SEQ ID NO: 2684902 - protein, 22 aa, Entamoeba histolytica
KVKEKKKKVEFENLFDDKEDVD

SEQ ID NO: 2684903 - protein, 17 aa, Entamoeba histolytica
KVKEMLMTFKLYYSYDL

SEQ ID NO: 2684904 - protein, 24 aa, Entamoeba histolytica
KVKEWIKEHLDLIKGEEDKKTLWR

SEQ ID NO: 2684905 - protein, 19 aa, Entamoeba histolytica
KVKFPERIILLRGNHESRQ

SEQ ID NO: 2684906 - protein, 24 aa, Entamoeba histolytica
KVKIRYEKDLNFQSKTWFPDMPSH

SEQ ID NO: 2684907 - protein, 18 aa, Entamoeba histolytica
KVKKRKGLGNEEMTVTLN

SEQ ID NO: 2684908 - protein, 26 aa, Entamoeba histolytica
KVKNGWRLPLGNSFKFLNEIISQCWD

SEQ ID NO: 2684909 - protein, 17 aa, Entamoeba histolytica
KVLDLFCCVGGDSIQQA

SEQ ID NO: 2684910 - protein, 18 aa, Entamoeba histolytica
KVLGVYEILPKISGLQRN

SEQ ID NO: 2684911 - protein, 20 aa, Entamoeba histolytica
KVLKAITFAQLFSKEIEIDE

SEQ ID NO: 2684912 - protein, 25 aa, Entamoeba histolytica
KVLKEVQSRFAVQMDELPSSLKDIP

SEQ ID NO: 2684913 - protein, 24 aa, Entamoeba histolytica
KVLKEVQSRFAVQMKELPDDLKEI

SEQ ID NO: 2684914 - protein, 25 aa, Entamoeba histolytica
KVLLFKPNCKILIAFTKSDLLNSGI

SEQ ID NO: 2684915 - protein, 25 aa, Entamoeba histolytica
KVLLGKCRVAVEYFKTGRDQALQEV

SEQ ID NO: 2684916 - protein, 21 aa, Entamoeba histolytica
KVLLQRYEKNLPFNKKVVEYQ

SEQ ID NO: 2684917 - protein, 26 aa, Entamoeba histolytica
KVLLQWCNGKSLSIRYDSKYDGESQK

SEQ ID NO: 2684918 - protein, 24 aa, Entamoeba histolytica
KVLMWNCFLALVLNIKGKIGRVTL

SEQ ID NO: 2684919 - protein, 17 aa, Entamoeba histolytica
KVLQSIGSMLSRQRTRA

SEQ ID NO: 2684920 - protein, 23 aa, Entamoeba histolytica
KVMEAVSFLWAYERDRRKQIEIW

SEQ ID NO: 2684921 - protein, 23 aa, Entamoeba histolytica
KVMFKENCFFINFDKKGNVFGAF

SEQ ID NO: 2684922 - protein, 19 aa, Entamoeba histolytica
KVMIDPNIIKRKEMIKTLK

SEQ ID NO: 2684923 - protein, 25 aa, Entamoeba histolytica
KVMNKVTCLKFYKEELIIGTNGDSI

SEQ ID NO: 2684924 - protein, 27 aa, Entamoeba histolytica
KVMQTPECLRVYVSSFWDQPFKDTLFT

SEQ ID NO: 2684925 - protein, 22 aa, Entamoeba histolytica
KVMYPTRISLMRGNHESRQVTQ

SEQ ID NO: 2684926 - protein, 19 aa, Entamoeba histolytica
KVNEIILRNSIAARDEYIR

SEQ ID NO: 2684927 - protein, 21 aa, Entamoeba histolytica
KVNEMLIAVAHRCDHTQVISI

SEQ ID NO: 2684928 - protein, 23 aa, Entamoeba histolytica
KVNGFYLKLWVDGLLSTYEYISV

SEQ ID NO: 2684929 - protein, 17 aa, Entamoeba histolytica
KVNHLISSIPSMWKCLY

SEQ ID NO: 2684930 - protein, 17 aa, Entamoeba histolytica
KVNIKKNIKIENIVNAW

SEQ ID NO: 2684931 - protein, 18 aa, Entamoeba histolytica
KVNQDWTVSQIYALIKKE

SEQ ID NO: 2684932 - protein, 23 aa, Entamoeba histolytica
KVNQELRSQFGLSENEDVVQNYK

SEQ ID NO: 2684933 - protein, 18 aa, Entamoeba histolytica
KVNQMIAVINLCKDFHSV

SEQ ID NO: 2684934 - protein, 18 aa, Entamoeba histolytica
KVNQYRWGEDDCHDVEVI

SEQ ID NO: 2684935 - protein, 20 aa, Entamoeba histolytica
KVNSCFGMSELYGPKGVFNL

SEQ ID NO: 2684936 - protein, 29 aa, Entamoeba histolytica
KVNTECPRCKQSICAECFSLSVKEHSECP

SEQ ID NO: 2684937 - protein, 17 aa, Entamoeba histolytica
KVPEKKAAITLKKIEMD

SEQ ID NO: 2684938 - protein, 18 aa, Entamoeba histolytica
KVPEKKAAITLKKIEMDE

SEQ ID NO: 2684939 - protein, 18 aa, Entamoeba histolytica
KVPMLGEVGELARMSMSI

SEQ ID NO: 2684940 - protein, 29 aa, Entamoeba histolytica
KVPVIKRIKKTNCEILNLFSFGLNKPEED

SEQ ID NO: 2684941 - protein, 21 aa, Entamoeba histolytica
KVQEILESFFTKIFDLKLPDS

SEQ ID NO: 2684942 - protein, 23 aa, Entamoeba histolytica
KVQRIYIPFCFTSYRYEGELNYV

SEQ ID NO: 2684943 - protein, 25 aa, Entamoeba histolytica
KVQTPLFFVDYFRVFVSHYELGKTY

SEQ ID NO: 2684944 - protein, 19 aa, Entamoeba histolytica
KVQYKWDSCVISKGESVNV

SEQ ID NO: 2684945 - protein, 18 aa, Entamoeba histolytica
KVRACISLSEKYMSPDDF

SEQ ID NO: 2684946 - protein, 22 aa, Entamoeba histolytica
KVRGFFVFPYIKSMSLLQREME

SEQ ID NO: 2684947 - protein, 23 aa, Entamoeba histolytica
KVRSFKIPICIELNTKKDVFNGE

SEQ ID NO: 2684948 - protein, 18 aa, Entamoeba histolytica
KVRVEGGAYGSWMSYSYS

SEQ ID NO: 2684949 - protein, 24 aa, Entamoeba histolytica
KVRVKIIVKPGCQKIFHFCSFDVI

SEQ ID NO: 2684950 - protein, 18 aa, Entamoeba histolytica
KVSPKARRNLILVTKVLQ

SEQ ID NO: 2684951 - protein, 24 aa, Entamoeba histolytica
KVTDIQPRISFIEVDIVKEVKEIK

SEQ ID NO: 2684952 - protein, 19 aa, Entamoeba histolytica
KVTICQKLYPNQWKKISTF

SEQ ID NO: 2684953 - protein, 24 aa, Entamoeba histolytica
KVTLKIKQIRAFKKHIRKLTARKE

SEQ ID NO: 2684954 - protein, 20 aa, Entamoeba histolytica
KVTRKVRSELGAYFVKNNDR

SEQ ID NO: 2684955 - protein, 19 aa, Entamoeba histolytica
KVTYFFCHHIPLTTPFHPK

SEQ ID NO: 2684956 - protein, 21 aa, Entamoeba histolytica
KVVDIRLGNELLLNKESVDII

SEQ ID NO: 2684957 - protein, 19 aa, Entamoeba histolytica
KVVERKLDTDSARIRQTIA

SEQ ID NO: 2684958 - protein, 18 aa, Entamoeba histolytica
KVVGRGSFGKVLQVKKKD

SEQ ID NO: 2684959 - protein, 17 aa, Entamoeba histolytica
KVVLLMDYCPVSTINVL

SEQ ID NO: 2684960 - protein, 19 aa, Entamoeba histolytica
KVVNLSFDKYIFIKYSTSK

SEQ ID NO: 2684961 - protein, 24 aa, Entamoeba histolytica
KVVPLKKKMRGLRFEQEIIEKREE

SEQ ID NO: 2684962 - protein, 24 aa, Entamoeba histolytica
KVVQSGCLPLLFGLFDNTDDDQLI

SEQ ID NO: 2684963 - protein, 22 aa, Entamoeba histolytica
KVVWMRHEFDFIGGSLGCAEGE

SEQ ID NO: 2684964 - protein, 17 aa, Entamoeba histolytica
KVYLKPDIPYISTFSHE

SEQ ID NO: 2684965 - protein, 17 aa, Entamoeba histolytica
KVYRANRQFELISLSTC

SEQ ID NO: 2684966 - protein, 17 aa, Entamoeba histolytica
KWAAALMQQCVIMGNLE

SEQ ID NO: 2684967 - protein, 17 aa, Entamoeba histolytica
KWADVFEGYNYNPKHPL

SEQ ID NO: 2684968 - protein, 17 aa, Entamoeba histolytica
KWCFDKKLVTVWSAPNY

SEQ ID NO: 2684969 - protein, 20 aa, Entamoeba histolytica
KWCRSIKSTQECGGRIGNTP

SEQ ID NO: 2684970 - protein, 21 aa, Entamoeba histolytica
KWDALFKYIRVLKYVEMVEDE

SEQ ID NO: 2684971 - protein, 23 aa, Entamoeba histolytica
KWENLKEKIEILISRTFDAGIQT

SEQ ID NO: 2684972 - protein, 20 aa, Entamoeba histolytica
KWFMDKWYFFYFVSIDAEDN

SEQ ID NO: 2684973 - protein, 26 aa, Entamoeba histolytica
KWHPEVIHFAPKVPIILVGTKLDTRN

SEQ ID NO: 2684974 - protein, 19 aa, Entamoeba histolytica
KWIITLLYELSVYKDQLLN

SEQ ID NO: 2684975 - protein, 23 aa, Entamoeba histolytica
KWKFNCKDAEEWKTKTINEVGMT

SEQ ID NO: 2684976 - protein, 25 aa, Entamoeba histolytica
KWKIPYQLIESLGFDGNNIVIRLKN

SEQ ID NO: 2684977 - protein, 25 aa, Entamoeba histolytica
KWKNEIPKWVTIIGIDAFLNTKYST

SEQ ID NO: 2684978 - protein, 20 aa, Entamoeba histolytica
KWKRCFGKNSFIATINSIEN

SEQ ID NO: 2684979 - protein, 23 aa, Entamoeba histolytica
KWLPSIKVALMGGTRESREDCRK

SEQ ID NO: 2684980 - protein, 32 aa, Entamoeba histolytica; identical to SEQ ID NO: 2492481

SEQ ID NO: 2684981 - protein, 17 aa, Entamoeba histolytica
KWMGYEWENKIIVETDI

SEQ ID NO: 2684982 - protein, 22 aa, Entamoeba histolytica
KWMSCGELLYNEFFIKKEGEKY

SEQ ID NO: 2684983 - protein, 30 aa, Entamoeba histolytica
KWNNEYHILYFWQGRKCPILDKGTSARLTV

SEQ ID NO: 2684984 - protein, 26 aa, Entamoeba histolytica
KWPDYQLRPNFLITLVEAPSLFVGHE

SEQ ID NO: 2684985 - protein, 29 aa, Entamoeba histolytica
KWPIYPVDGGVCILSRFPIVSQHQKIYTR

SEQ ID NO: 2684986 - protein, 36 aa, Entamoeba histolytica
KWQIPALCKHQVFVDWNLPNSIRCCADVIQESETIR

SEQ ID NO: 2684987 - protein, 19 aa, Entamoeba histolytica
KWSAGEIEQLITLSRSSMY

SEQ ID NO: 2684988 - protein, 26 aa, Entamoeba histolytica
KWTGKFPSVIICDYCRRQKYDNPKYK

SEQ ID NO: 2684989 - protein, 21 aa, Entamoeba histolytica
KWTRYIEFWVLYARYEEKLQH

SEQ ID NO: 2684990 - protein, 17 aa, Entamoeba histolytica
KWVECGIDDPEKEIQLL

SEQ ID NO: 2684991 - protein, 20 aa, Entamoeba histolytica
KWVGKSECELIYSVHQLGTT

SEQ ID NO: 2684992 - protein, 20 aa, Entamoeba histolytica
KWVSLCDLQKVLVKNKFVKS

SEQ ID NO: 2684993 - protein, 18 aa, Entamoeba histolytica
KWYEIWIGEDIDYKVVDE

SEQ ID NO: 2684994 - protein, 19 aa, Entamoeba histolytica
KYAIPRPLNIPIIPLYWNI

SEQ ID NO: 2684995 - protein, 24 aa, Entamoeba histolytica
KYAKEKKLLLAQKMWNVLLDYSQL

SEQ ID NO: 2684996 - protein, 17 aa, Entamoeba histolytica
KYCAVCRKCFYKDGATL

SEQ ID NO: 2684997 - protein, 26 aa, Entamoeba histolytica
KYCEYYCLRDVLVLREGFLKYRQMVQ

SEQ ID NO: 2684998 - protein, 19 aa, Entamoeba histolytica
KYCKEYKPIEVFLQYLKTY

SEQ ID NO: 2684999 - protein, 17 aa, Entamoeba histolytica
KYCNVLFAPYIIPNDVG

SEQ ID NO: 2685000 - protein, 21 aa, Entamoeba histolytica
KYCTEAFDYLGLAAIIDQKIF

SEQ ID NO: 2685001 - protein, 18 aa, Entamoeba histolytica
KYDFHFIGGCPVPKQHKV

SEQ ID NO: 2685002 - protein, 19 aa, Entamoeba histolytica
KYDGYAIFRSKYRRFELYE

SEQ ID NO: 2685003 - protein, 20 aa, Entamoeba histolytica
KYDRAVLFLLTLGQEKVLLP

SEQ ID NO: 2685004 - protein, 24 aa, Entamoeba histolytica
KYDRLDPKLVEMFMENEVEEDVSL

SEQ ID NO: 2685005 - protein, 19 aa, Entamoeba histolytica
KYEEFDIENAFLWADPQIK

SEQ ID NO: 2685006 - protein, 18 aa, Entamoeba histolytica
KYEEIPWIKELRKEHREN

SEQ ID NO: 2685007 - protein, 20 aa, Entamoeba histolytica
KYEISKLFFRHQGKTSVETN

SEQ ID NO: 2685008 - protein, 20 aa, Entamoeba histolytica
KYEKSYYALLSFIPRSPLNS

SEQ ID NO: 2685009 - protein, 22 aa, Entamoeba histolytica
KYENLKYIPIKNIRKLDIILNK

SEQ ID NO: 2685010 - protein, 19 aa, Entamoeba histolytica
KYEPLFLFDSEDSYIGEIT

SEQ ID NO: 2685011 - protein, 25 aa, Entamoeba histolytica
KYEVHCYWRNGAIVVIEDTDGSGKG

SEQ ID NO: 2685012 - protein, 18 aa, Entamoeba histolytica
KYFAVPITFVKNIHDAAV

SEQ ID NO: 2685013 - protein, 17 aa, Entamoeba histolytica
KYFDVLVLKQLVCAMEH

SEQ ID NO: 2685014 - protein, 25 aa, Entamoeba histolytica
KYFEVSAKTGVGINEMFETLTKEIV

SEQ ID NO: 2685015 - protein, 25 aa, Entamoeba histolytica
KYFHNIEVLSCDECIIDISSVPEPI

SEQ ID NO: 2685016 - protein, 20 aa, Entamoeba histolytica
KYFIGIPIIEKSFFHKFYEP

SEQ ID NO: 2685017 - protein, 20 aa, Entamoeba histolytica
KYFIHELVKITFYDYPLQHC

SEQ ID NO: 2685018 - protein, 24 aa, Entamoeba histolytica
KYFMKYKRCQGGYQGKTLDEILTM

SEQ ID NO: 2685019 - protein, 19 aa, Entamoeba histolytica
KYFTFKKVWRAYANYARRR

SEQ ID NO: 2685020 - protein, 26 aa, Entamoeba histolytica
KYFVGYCIIVMKTLYRCCKLKEKINN

SEQ ID NO: 2685021 - protein, 20 aa, Entamoeba histolytica
KYFYEPYLDILKKWTKKEIC

SEQ ID NO: 2685022 - protein, 21 aa, Entamoeba histolytica
KYGKNEWARISSLIAGKSPQQ

SEQ ID NO: 2685023 - protein, 24 aa, Entamoeba histolytica
KYGKSRSASLLTFYLLKKYQITVN

SEQ ID NO: 2685024 - protein, 22 aa, Entamoeba histolytica
KYGMKIPEKFCGIADECFSGCN

SEQ ID NO: 2685025 - protein, 23 aa, Entamoeba histolytica
KYGNCYECPICFQKARTRTKSIV

SEQ ID NO: 2685026 - protein, 28 aa, Entamoeba histolytica
KYGNSDVWKMCCDLFDLLALSALIDNRI

SEQ ID NO: 2685027 - protein, 23 aa, Entamoeba histolytica
KYGPGCFYGCFSLPPRLDLPPIS

SEQ ID NO: 2685028 - protein, 27 aa, Entamoeba histolytica
KYGSCPHGGYGLGVERLVMWLLGEDHI

SEQ ID NO: 2685029 - protein, 24 aa, Entamoeba histolytica
KYGTSPFILCRYGFGDVAQGFSRS

SEQ ID NO: 2685030 - protein, 17 aa, Entamoeba histolytica
KYHPLIVLLFQLLLEDI

SEQ ID NO: 2685031 - protein, 22 aa, Entamoeba histolytica
KYHVLCKETAFIAVDKTTKKEV

SEQ ID NO: 2685032 - protein, 20 aa, Entamoeba histolytica
KYIDCPQIHIPWFKMIANEH

SEQ ID NO: 2685033 - protein, 19 aa, Entamoeba histolytica
KYIEACARSGQFQELARVV

SEQ ID NO: 2685034 - protein, 18 aa, Entamoeba histolytica
KYIEASLGLVASVSRKYI

SEQ ID NO: 2685035 - protein, 18 aa, Entamoeba histolytica
KYIEEIKTIPFLQLTCIF

SEQ ID NO: 2685036 - protein, 17 aa, Entamoeba histolytica
KYIETFIPPLVKSLSQP

SEQ ID NO: 2685037 - protein, 22 aa, Entamoeba histolytica
KYIGIQFHSVYNFGFGDSDINY

SEQ ID NO: 2685038 - protein, 20 aa, Entamoeba histolytica
KYIHQVLDGLAFIHDQGIVH

SEQ ID NO: 2685039 - protein, 26 aa, Entamoeba histolytica
KYIIPGEFWLYYVIDVNKHKEEYLKY

SEQ ID NO: 2685040 - protein, 22 aa, Entamoeba histolytica
KYIKNDKDFFVFSLHSKKLKQP

SEQ ID NO: 2685041 - protein, 19 aa, Entamoeba histolytica
KYIKRFDFKNEVVVLELKH

SEQ ID NO: 2685042 - protein, 19 aa, Entamoeba histolytica
KYILEYIFKEIKIKDIQCK

SEQ ID NO: 2685043 - protein, 20 aa, Entamoeba histolytica
KYINWCLKETSDLLIGLNNK

SEQ ID NO: 2685044 - protein, 20 aa, Entamoeba histolytica
KYINYAFIRFSRFIGNCITK

SEQ ID NO: 2685045 - protein, 19 aa, Entamoeba histolytica
KYIPCIYVINKIDAMEPSE

SEQ ID NO: 2685046 - protein, 18 aa, Entamoeba histolytica
KYIRLNMLIANVIEEDGN

SEQ ID NO: 2685047 - protein, 27 aa, Entamoeba histolytica
KYIVRMLYKFLTCFTLLDNQIDYLKSL

SEQ ID NO: 2685048 - protein, 18 aa, Entamoeba histolytica
KYIWKCITNSRLNEGNEI

SEQ ID NO: 2685049 - protein, 25 aa, Entamoeba histolytica
KYKAKLLIKRKRVFKELTETEEKLY

SEQ ID NO: 2685050 - protein, 37 aa, Entamoeba histolytica
KYKDYLNCLFIRYFPRAICLNCVMNLKQVSEVENATV

SEQ ID NO: 2685051 - protein, 25 aa, Entamoeba histolytica
KYKEEVRKAIEFVFGNTMICKKGED

SEQ ID NO: 2685052 - protein, 23 aa, Entamoeba histolytica
KYKHGKISISMVITTVMKVNKKI

SEQ ID NO: 2685053 - protein, 19 aa, Entamoeba histolytica
KYKIYKWGIENTVGISAGK

SEQ ID NO: 2685054 - protein, 18 aa, Entamoeba histolytica
KYKKSIIPLIIQNSKAAN

SEQ ID NO: 2685055 - protein, 20 aa, Entamoeba histolytica
KYKLETIPSKNTFLSIFKKN

SEQ ID NO: 2685056 - protein, 27 aa, Entamoeba histolytica
KYKLSTEVKALLNIRIHLLLEYYTINK

SEQ ID NO: 2685057 - protein, 32 aa, Entamoeba histolytica
KYKLSTEVKALLNIRIHLWLEYYTINKAISTS

SEQ ID NO: 2685058 - protein, 18 aa, Entamoeba histolytica
KYKNGACDRVVCPTDEER

SEQ ID NO: 2685059 - protein, 35 aa, Entamoeba histolytica
KYKNVSICFSLIIKECLLIRQMLRTQLTKCSIITA

SEQ ID NO: 2685060 - protein, 31 aa, Entamoeba histolytica
KYKSVIDLVKKWKFVVVENIDIWEFTDDRMV

SEQ ID NO: 2685061 - protein, 17 aa, Entamoeba histolytica
KYLEEVIKIMKDIMKEE

SEQ ID NO: 2685062 - protein, 19 aa, Entamoeba histolytica
KYLEFKRKYEEHGKNKDYY

SEQ ID NO: 2685063 - protein, 17 aa, Entamoeba histolytica
KYLFNFEKTSIILFDEE

SEQ ID NO: 2685064 - protein, 19 aa, Entamoeba histolytica
KYLFYYAVVAYLIQIKDDI

SEQ ID NO: 2685065 - protein, 17 aa, Entamoeba histolytica
KYLIKKIERQEEIKKER

SEQ ID NO: 2685066 - protein, 20 aa, Entamoeba histolytica
KYLINYDDLPSFAFKSKEIK

SEQ ID NO: 2685067 - protein, 25 aa, Entamoeba histolytica
KYLKERGIEVIKMPVNEDGVVDPKD

SEQ ID NO: 2685068 - protein, 21 aa, Entamoeba histolytica
KYLNEACPMEMTFAEVILVLK

SEQ ID NO: 2685069 - protein, 28 aa, Entamoeba histolytica
KYLNEFNLLLIRSVFDFLTTLKDSMATV

SEQ ID NO: 2685070 - protein, 18 aa, Entamoeba histolytica
KYLNIRSVAVFGGTGISN

SEQ ID NO: 2685071 - protein, 19 aa, Entamoeba histolytica
KYLPQLSSYISRMYREENK

SEQ ID NO: 2685072 - protein, 18 aa, Entamoeba histolytica
KYLPTVFDNYLAKVQYKK

SEQ ID NO: 2685073 - protein, 19 aa, Entamoeba histolytica
KYLQSFCALHNIIIHLVYF

SEQ ID NO: 2685074 - protein, 19 aa, Entamoeba histolytica
KYLSTFFPINAIFKSALQT

SEQ ID NO: 2685075 - protein, 24 aa, Entamoeba histolytica
KYLTYVEHYICLADIFQKQAFNQP

SEQ ID NO: 2685076 - protein, 26 aa, Entamoeba histolytica
KYLYDILCKILNGWNEQEFIDFFYKE

SEQ ID NO: 2685077 - protein, 18 aa, Entamoeba histolytica
KYMIFSYQFADFITNFED

SEQ ID NO: 2685078 - protein, 20 aa, Entamoeba histolytica
KYMKHILTYLPLYPKRAKNI

SEQ ID NO: 2685079 - protein, 26 aa, Entamoeba histolytica
KYMNIFYGFELFFIISKQGVIVLNTT

SEQ ID NO: 2685080 - protein, 21 aa, Entamoeba histolytica
KYNEELCMYFGKTIFSVGEFE

SEQ ID NO: 2685081 - protein, 24 aa, Entamoeba histolytica
KYNIPEVLITLSLDKVKIDNLREF

SEQ ID NO: 2685082 - protein, 18 aa, Entamoeba histolytica
KYNIQFPLILNELIIPFN

SEQ ID NO: 2685083 - protein, 25 aa, Entamoeba histolytica
KYNITFEFIVKWLLMLFKREFWSKE

SEQ ID NO: 2685084 - protein, 30 aa, Entamoeba histolytica
KYNPPRNTIHIFASTLLRYFDDQIKEIYDC

SEQ ID NO: 2685085 - protein, 18 aa, Entamoeba histolytica
KYNPRKGVKTGIVINEGS

SEQ ID NO: 2685086 - protein, 18 aa, Entamoeba histolytica
KYNTFAISYNCRHNSNYS

SEQ ID NO: 2685087 - protein, 17 aa, Entamoeba histolytica
KYNTFAISYNGRHNSNY

SEQ ID NO: 2685088 - protein, 17 aa, Entamoeba histolytica
KYNVWAPVYGMTSSLPD

SEQ ID NO: 2685089 - protein, 24 aa, Entamoeba histolytica
KYNWLRPDEDAFKISDTEVFIGGL

SEQ ID NO: 2685090 - protein, 23 aa, Entamoeba histolytica
KYPELPFGIFFIYNKNFFGFQIR

SEQ ID NO: 2685091 - protein, 24 aa, Entamoeba histolytica
KYPHVKIFLGDYVDRGKWSTETII

SEQ ID NO: 2685092 - protein, 27 aa, Entamoeba histolytica
KYPILKNSWKLVLSIFDFNSSNRQNSE

SEQ ID NO: 2685093 - protein, 33 aa, Entamoeba histolytica
KYPLGCAVSKSAWRYPIPIYRAIEYLQKNKGAE

SEQ ID NO: 2685094 - protein, 20 aa, Entamoeba histolytica
KYPLPKCDWIALPDFEAGAM

SEQ ID NO: 2685095 - protein, 25 aa, Entamoeba histolytica
KYPQEFSVAINEYFKQPDVANVELA

SEQ ID NO: 2685096 - protein, 22 aa, Entamoeba histolytica
KYPRLYYTWIDKLVQTQERCGN

SEQ ID NO: 2685097 - protein, 18 aa, Entamoeba histolytica
KYPSLLIESVYKLNEGPI

SEQ ID NO: 2685098 - protein, 20 aa, Entamoeba histolytica
KYPTFKTCFIIRNNSILFNE

SEQ ID NO: 2685099 - protein, 21 aa, Entamoeba histolytica
KYQDYELCLGKNFTKNNQLIG

SEQ ID NO: 2685100 - protein, 20 aa, Entamoeba histolytica
KYQGKCIPMSFNDDVQRIME

SEQ ID NO: 2685101 - protein, 23 aa, Entamoeba histolytica
KYQKMYPAMGFSTAYAVEVNFGH

SEQ ID NO: 2685102 - protein, 26 aa, Entamoeba histolytica
KYQLNYKCGYIPLTHQQGYVVGMEPM

SEQ ID NO: 2685103 - protein, 26 aa, Entamoeba histolytica
KYQMSHYHWFSSFEYYHMINKLSNGI

SEQ ID NO: 2685104 - protein, 18 aa, Entamoeba histolytica
KYQREFIQGTEIENKIFN

SEQ ID NO: 2685105 - protein, 19 aa, Entamoeba histolytica
KYQYYWIKYGIEGDAPKCI

SEQ ID NO: 2685106 - protein, 18 aa, Entamoeba histolytica
KYRGANLSSQYLRVGFER

SEQ ID NO: 2685107 - protein, 19 aa, Entamoeba histolytica
KYRINLCSFLVSIPQIYIE

SEQ ID NO: 2685108 - protein, 25 aa, Entamoeba histolytica
KYRLKEMFQDFNFIKKCWIVTKKLL

SEQ ID NO: 2685109 - protein, 20 aa, Entamoeba histolytica
KYRLKEMFSNFNLLTRCWNI

SEQ ID NO: 2685110 - protein, 21 aa, Entamoeba histolytica
KYRLKEMFSNFNLLTRCWTSL

SEQ ID NO: 2685111 - protein, 25 aa, Entamoeba histolytica
KYRQWQLALRRAISFVDFLKDSSDD

SEQ ID NO: 2685112 - protein, 20 aa, Entamoeba histolytica
KYRSSPLLHLSWLNNIIEKE

SEQ ID NO: 2685113 - protein, 25 aa, Entamoeba histolytica
KYRYYGESYIILNVYYKQYLIPLMD

SEQ ID NO: 2685114 - protein, 22 aa, Entamoeba histolytica
KYSEGPFDVTFKIIKESTGECI

SEQ ID NO: 2685115 - protein, 24 aa, Entamoeba histolytica
KYSELKRYTLLLTNLPHKRLRDVA

SEQ ID NO: 2685116 - protein, 17 aa, Entamoeba histolytica
KYSELYPQVVLVDGNGY

SEQ ID NO: 2685117 - protein, 19 aa, Entamoeba histolytica
KYSGHGFGCRVVQRIIEKR

SEQ ID NO: 2685118 - protein, 20 aa, Entamoeba histolytica
KYSTYRYVYETVKKQETAKD

SEQ ID NO: 2685119 - protein, 18 aa, Entamoeba histolytica
KYTKEIYLYSFGDSISRG

SEQ ID NO: 2685120 - protein, 19 aa, Entamoeba histolytica
KYTMVRDIIKGELKIKDEV

SEQ ID NO: 2685121 - protein, 24 aa, Entamoeba histolytica
KYTSLDHVFKVWVLVTRQTIKTKG

SEQ ID NO: 2685122 - protein, 21 aa, Entamoeba histolytica
KYVCSFHGFPETKGFVAPISK

SEQ ID NO: 2685123 - protein, 17 aa, Entamoeba histolytica
KYVDEIIKFMKKPGDVK

SEQ ID NO: 2685124 - protein, 21 aa, Entamoeba histolytica
KYVECLVKIPVNSGSITEKKE

SEQ ID NO: 2685125 - protein, 23 aa, Entamoeba histolytica
KYVFPSLYLHIFNSEVEMKISEP

SEQ ID NO: 2685126 - protein, 20 aa, Entamoeba histolytica
KYVIDSGLGKWKIYNPKIGM

SEQ ID NO: 2685127 - protein, 19 aa, Entamoeba histolytica
KYVISYVVETLFNKKNHLL

SEQ ID NO: 2685128 - protein, 20 aa, Entamoeba histolytica
KYVIWYKVEYSRYLKEKEEM

SEQ ID NO: 2685129 - protein, 17 aa, Entamoeba histolytica
KYVKALFTLASKLSPCV

SEQ ID NO: 2685130 - protein, 24 aa, Entamoeba histolytica
KYVKELFPRITTFCSDINPYALEC

SEQ ID NO: 2685131 - protein, 17 aa, Entamoeba histolytica
KYVNNILNYLISFIERS

SEQ ID NO: 2685132 - protein, 31 aa, Entamoeba histolytica; identical to SEQ ID NO: 2492660

SEQ ID NO: 2685133 - protein, 20 aa, Entamoeba histolytica
KYVRSNEHLYVFLNKGPLQF

SEQ ID NO: 2685134 - protein, 21 aa, Entamoeba histolytica
KYWKFKDKRDVGFALASLEET

SEQ ID NO: 2685135 - protein, 20 aa, Entamoeba histolytica
KYYGLIPFNNCWPAKLFVQK

SEQ ID NO: 2685136 - protein, 31 aa, Entamoeba histolytica; identical to SEQ ID NO: 2492666

SEQ ID NO: 2685137 - protein, 20 aa, Entamoeba histolytica
KYYNDFTFFIALRNCINETT

SEQ ID NO: 2685138 - protein, 32 aa, Entamoeba histolytica
KYYNLLEPLKWSKCLYYQCIINGNKSYFDHWL

SEQ ID NO: 2685139 - protein, 26 aa, Entamoeba histolytica
KYYQFLKVVYRWLVILINEANKGVKK

SEQ ID NO: 2685140 - protein, 35 aa, Entamoeba histolytica
KYYQIHNLYHKWSVDGIGFCLLKKQFIKFKSFLYQ

SEQ ID NO: 2685141 - protein, 19 aa, Entamoeba histolytica
KYYYNRFCQQFPLLPPIFC

SEQ ID NO: 2685142 - protein, 22 aa, Entamoeba histolytica
KYYYYHLLLWPSITYLAECVDG

SEQ ID NO: 2685143 - protein, 21 aa, Entamoeba histolytica
LAAEIYTHFTSPIRRYADVMV

SEQ ID NO: 2685144 - protein, 27 aa, Entamoeba histolytica
LAALFKCSLGSFLLCHGGISPKLNVLD

SEQ ID NO: 2685145 - protein, 19 aa, Entamoeba histolytica
LAALHRIIQILSIYSNKYY

SEQ ID NO: 2685146 - protein, 17 aa, Entamoeba histolytica
LAALSHYPSIFVFTHDS

SEQ ID NO: 2685147 - protein, 17 aa, Entamoeba histolytica
LACGLGAICIAQLLQTK

SEQ ID NO: 2685148 - protein, 17 aa, Entamoeba histolytica
LADFPIDLTKRVNGRAI

SEQ ID NO: 2685149 - protein, 21 aa, Entamoeba histolytica
LADMGICCIDEFDKMDETDRT

SEQ ID NO: 2685150 - protein, 20 aa, Entamoeba histolytica
LADRGIVCVDEFDKMSIEDR

SEQ ID NO: 2685151 - protein, 28 aa, Entamoeba histolytica
LADVGLPLKMISILEAHSFFTEKGIGYV

SEQ ID NO: 2685152 - protein, 19 aa, Entamoeba histolytica
LADVLEEWNGLGFNSRGKR

SEQ ID NO: 2685153 - protein, 18 aa, Entamoeba histolytica
LADYGFCRAINSGIEHVK

SEQ ID NO: 2685154 - protein, 20 aa, Entamoeba histolytica
LAEEAALLMAQFMGDSSEED

SEQ ID NO: 2685155 - protein, 18 aa, Entamoeba histolytica
LAEEWKIPFFETSAQNNI

SEQ ID NO: 2685156 - protein, 25 aa, Entamoeba histolytica
LAEHLKRTGGIYVTRFPPEPNGYLH

SEQ ID NO: 2685157 - protein, 22 aa, Entamoeba histolytica
LAEKCITALLSQFVTIRELVKQ

SEQ ID NO: 2685158 - protein, 24 aa, Entamoeba histolytica
LAEKLRYPILPVIRKQFSDGELYY

SEQ ID NO: 2685159 - protein, 17 aa, Entamoeba histolytica
LAEQQCELFALQSTTQN

SEQ ID NO: 2685160 - protein, 21 aa, Entamoeba histolytica
LAEQWKVLFFETSAKAKINIT

SEQ ID NO: 2685161 - protein, 20 aa, Entamoeba histolytica
LAESHITEFCQFGREVNENP

SEQ ID NO: 2685162 - protein, 21 aa, Entamoeba histolytica
LAFQFRVNVEFDIAIVDTEPT

SEQ ID NO: 2685163 - protein, 22 aa, Entamoeba histolytica
LAFSTCFVCHQMGHISRDCPNN

SEQ ID NO: 2685164 - protein, 21 aa, Entamoeba histolytica
LAGCIKRGWAKDVGIAVEDLY

SEQ ID NO: 2685165 - protein, 18 aa, Entamoeba histolytica
LAGILPKYQRVVINCTSP

SEQ ID NO: 2685166 - protein, 18 aa, Entamoeba histolytica
LAGVLKDDIQPYLNTIVP

SEQ ID NO: 2685167 - protein, 18 aa, Entamoeba histolytica
LAGYKPGDKIGIFCETRY

SEQ ID NO: 2685168 - protein, 24 aa, Entamoeba histolytica
LAHIFEIGIEFALLMDFGTIGYAG

SEQ ID NO: 2685169 - protein, 29 aa, Entamoeba histolytica
LAHNVNCLRWSKDGKLLACGCDDSSVTIY

SEQ ID NO: 2685170 - protein, 21 aa, Entamoeba histolytica
LAHRLNCWGNINILNCSIDQI

SEQ ID NO: 2685171 - protein, 19 aa, Entamoeba histolytica
LAIDCNLFKTVALSSTVST

SEQ ID NO: 2685172 - protein, 24 aa, Entamoeba histolytica
LAIIKRDKNVFVASFRSPLRKPKD

SEQ ID NO: 2685173 - protein, 17 aa, Entamoeba histolytica
LAIKRIFLNGQISIDGS

SEQ ID NO: 2685174 - protein, 18 aa, Entamoeba histolytica
LAILRIIHHPNIIDYYAS

SEQ ID NO: 2685175 - protein, 20 aa, Entamoeba histolytica
LAILSILSWESPKLVNSILR

SEQ ID NO: 2685176 - protein, 22 aa, Entamoeba histolytica
LAITMYQTWSWKNPYDKDEGSR

SEQ ID NO: 2685177 - protein, 23 aa, Entamoeba histolytica
LAKEFLMKMSYLFNNQTNLKLQK

SEQ ID NO: 2685178 - protein, 25 aa, Entamoeba histolytica
LAKEFLMKMSYSFDTQFPIEEMIGK

SEQ ID NO: 2685179 - protein, 18 aa, Entamoeba histolytica
LAKESVKVILEMKKPQDD

SEQ ID NO: 2685180 - protein, 23 aa, Entamoeba histolytica
LAKKFRHCKEIFFNTNELNLLEE

SEQ ID NO: 2685181 - protein, 25 aa, Entamoeba histolytica
LAKQKTMDWWSCVIIGDEEIDTKKI

SEQ ID NO: 2685182 - protein, 23 aa, Entamoeba histolytica
LAKVSPRILFQMGVTENEEQMKL

SEQ ID NO: 2685183 - protein, 23 aa, Entamoeba histolytica
LAKYFKQVYVWQGGDDINTVVFA

SEQ ID NO: 2685184 - protein, 21 aa, Entamoeba histolytica
LALDICFYGPYGIPVKTPIIA

SEQ ID NO: 2685185 - protein, 18 aa, Entamoeba histolytica
LALEEMRKRSGFCQNYSI

SEQ ID NO: 2685186 - protein, 19 aa, Entamoeba histolytica
LALFQMCPKIHSLEVPSCL

SEQ ID NO: 2685187 - protein, 18 aa, Entamoeba histolytica
LALHPSVVNCLTPNQRNE

SEQ ID NO: 2685188 - protein, 19 aa, Entamoeba histolytica
LALKFKDERTVLMIRRKKG

SEQ ID NO: 2685189 - protein, 23 aa, Entamoeba histolytica
LALLHPFCGFTIRRPIKASTATN

SEQ ID NO: 2685190 - protein, 17 aa, Entamoeba histolytica
LALNKVAIWAIGEYGDL

SEQ ID NO: 2685191 - protein, 17 aa, Entamoeba histolytica
LALPIVFNTPISLREIQ

SEQ ID NO: 2685192 - protein, 18 aa, Entamoeba histolytica
LALSILKAIHCFPNDTSF

SEQ ID NO: 2685193 - protein, 19 aa, Entamoeba histolytica
LALSKTWKRSKPIEHNIMK

SEQ ID NO: 2685194 - protein, 17 aa, Entamoeba histolytica
LALVEGYDSMGFEFSRP

SEQ ID NO: 2685195 - protein, 18 aa, Entamoeba histolytica
LAMFCLQQIIGMGDVQVM

SEQ ID NO: 2685196 - protein, 21 aa, Entamoeba histolytica
LAMTCPGVMRFNKEKNAKKLA

SEQ ID NO: 2685197 - protein, 23 aa, Entamoeba histolytica
LANCERLKCVYCHRSQKPELTIS

SEQ ID NO: 2685198 - protein, 17 aa, Entamoeba histolytica
LANECKANFIAVKGPQL

SEQ ID NO: 2685199 - protein, 18 aa, Entamoeba histolytica
LANERGWLYKETSASENI

SEQ ID NO: 2685200 - protein, 24 aa, Entamoeba histolytica
LANGEIQQFLSLIFFIGQKSGTKI

SEQ ID NO: 2685201 - protein, 17 aa, Entamoeba histolytica
LANKGGVAYRMKVYDST

SEQ ID NO: 2685202 - protein, 18 aa, Entamoeba histolytica
LANSGAIGARYSVGVCFQ

SEQ ID NO: 2685203 - protein, 19 aa, Entamoeba histolytica
LANVLLYFSDYVDFLQFSF

SEQ ID NO: 2685204 - protein, 22 aa, Entamoeba histolytica
LAPADFKLVLPYLDDFWARDGL

SEQ ID NO: 2685205 - protein, 19 aa, Entamoeba histolytica
LAPDVLRNLDVWEAFTQHM

SEQ ID NO: 2685206 - protein, 17 aa, Entamoeba histolytica
LAPEFIKRLLYSLKDVI

SEQ ID NO: 2685207 - protein, 19 aa, Entamoeba histolytica
LAPFAKGGERLAFRAINGR

SEQ ID NO: 2685208 - protein, 18 aa, Entamoeba histolytica
LAPLPPLPPKVHGKRKKA

SEQ ID NO: 2685209 - protein, 18 aa, Entamoeba histolytica
LAQKLCGLDKTAFVKYQW

SEQ ID NO: 2685210 - protein, 18 aa, Entamoeba histolytica
LAQLKPPIFTNEEKDEKR

SEQ ID NO: 2685211 - protein, 19 aa, Entamoeba histolytica
LAQSVARLRFSNEVNSQDV

SEQ ID NO: 2685212 - protein, 22 aa, Entamoeba histolytica
LAREGEIAWKTALKALQQKEPG

SEQ ID NO: 2685213 - protein, 18 aa, Entamoeba histolytica
LARGEYKSNVKFYDDDKV

SEQ ID NO: 2685214 - protein, 18 aa, Entamoeba histolytica
LARKRMLMTGGLMMELFK

SEQ ID NO: 2685215 - protein, 19 aa, Entamoeba histolytica
LARLKGLQTLLSMLDGLCG

SEQ ID NO: 2685216 - protein, 17 aa, Entamoeba histolytica
LASCMWFEQPLIRNLYF

SEQ ID NO: 2685217 - protein, 17 aa, Entamoeba histolytica
LASGIVQCMTRETLNSM

SEQ ID NO: 2685218 - protein, 23 aa, Entamoeba histolytica
LASIRRIAFIIAKTEYNCPYTQG

SEQ ID NO: 2685219 - protein, 17 aa, Entamoeba histolytica
LASIVKMYSFLIRALKR

SEQ ID NO: 2685220 - protein, 30 aa, Entamoeba histolytica
LASTPYLYHYTLRCMKSFIESIRPNVNVIG

SEQ ID NO: 2685221 - protein, 25 aa, Entamoeba histolytica
LATGAKHPVCLYVSGSNTQVIAFSL

SEQ ID NO: 2685222 - protein, 20 aa, Entamoeba histolytica
LATGCANTFVTADGERTFGT

SEQ ID NO: 2685223 - protein, 20 aa, Entamoeba histolytica
LATKKCVKETCNWRCLYWTL

SEQ ID NO: 2685224 - protein, 19 aa, Entamoeba histolytica
LATNIAMSYVQNEYDIDIN

SEQ ID NO: 2685225 - protein, 18 aa, Entamoeba histolytica
LATRKACNTSNCPPKPKH

SEQ ID NO: 2685226 - protein, 18 aa, Entamoeba histolytica
LAVIALKGSDDINTIKKS

SEQ ID NO: 2685227 - protein, 24 aa, Entamoeba histolytica
LAVKRKLFHLDPIYLHDFGYKQYD

SEQ ID NO: 2685228 - protein, 18 aa, Entamoeba histolytica
LAYHVYKTKELIEKYGSE

SEQ ID NO: 2685229 - protein, 18 aa, Entamoeba histolytica
LAYLNSTLSWICIYLTKS

SEQ ID NO: 2685230 - protein, 17 aa, Entamoeba histolytica
LCADAPGSIILNILKDS

SEQ ID NO: 2685231 - protein, 17 aa, Entamoeba histolytica
LCATCYLLNDWGNINKE

SEQ ID NO: 2685232 - protein, 17 aa, Entamoeba histolytica
LCCVHSFDDESIVTRSK

SEQ ID NO: 2685233 - protein, 20 aa, Entamoeba histolytica
LCDELLRQSILIGKYPFDKY

SEQ ID NO: 2685234 - protein, 17 aa, Entamoeba histolytica
LCDFSIPILFTTLPLNI

SEQ ID NO: 2685235 - protein, 25 aa, Entamoeba histolytica
LCDQCPLAKHYVCKYYCKKHNHHIQ

SEQ ID NO: 2685236 - protein, 25 aa, Entamoeba histolytica
LCDSKLPDSMKICYATILHNIHPVI

SEQ ID NO: 2685237 - protein, 19 aa, Entamoeba histolytica
LCDSLNLNHFIECIENSTP

SEQ ID NO: 2685238 - protein, 20 aa, Entamoeba histolytica
LCEAEGEFDEPAVITETPIE

SEQ ID NO: 2685239 - protein, 17 aa, Entamoeba histolytica
LCECFKNQFSQLERINI

SEQ ID NO: 2685240 - protein, 17 aa, Entamoeba histolytica
LCEETRFSRGFSGEMKG

SEQ ID NO: 2685241 - protein, 23 aa, Entamoeba histolytica
LCEIHMICFIASFLEGGEAFNSL

SEQ ID NO: 2685242 - protein, 20 aa, Entamoeba histolytica
LCELLKSTVFERLKVLETIK

SEQ ID NO: 2685243 - protein, 17 aa, Entamoeba histolytica
LCEQECILIDGIFGMCL

SEQ ID NO: 2685244 - protein, 19 aa, Entamoeba histolytica
LCESLRSLIDGELAMVTNG

SEQ ID NO: 2685245 - protein, 18 aa, Entamoeba histolytica
LCETEGLEFIPLNLPLEE

SEQ ID NO: 2685246 - protein, 18 aa, Entamoeba histolytica
LCETSRTALSVLASITKD

SEQ ID NO: 2685247 - protein, 18 aa, Entamoeba histolytica
LCFAVIYEPSFHNLKDKW

SEQ ID NO: 2685248 - protein, 19 aa, Entamoeba histolytica
LCFGKCIIQEPSLFDQAVV

SEQ ID NO: 2685249 - protein, 18 aa, Entamoeba histolytica
LCFLDKVVQIGCYGDAAT

SEQ ID NO: 2685250 - protein, 18 aa, Entamoeba histolytica
LCGCKSLQQLSFKSPLLK

SEQ ID NO: 2685251 - protein, 22 aa, Entamoeba histolytica
LCGEESFGTGCCGIREKDGIWA

SEQ ID NO: 2685252 - protein, 19 aa, Entamoeba histolytica
LCGIPSSGLGNLFMLMDLH

SEQ ID NO: 2685253 - protein, 19 aa, Entamoeba histolytica
LCHSRLYSAILEQFGVALL

SEQ ID NO: 2685254 - protein, 19 aa, Entamoeba histolytica
LCIAIKPEILFLHLEAKYN

SEQ ID NO: 2685255 - protein, 24 aa, Entamoeba histolytica
LCIASIYALSGLKFGYSSLVSLGL

SEQ ID NO: 2685256 - protein, 21 aa, Entamoeba histolytica
LCICNDIRFPAFLRNLKLEYD

SEQ ID NO: 2685257 - protein, 24 aa, Entamoeba histolytica
LCINGTGCLYSFIKKLLDSDYKVM

SEQ ID NO: 2685258 - protein, 22 aa, Entamoeba histolytica
LCIQCAGLHRGLGVHLTFVRSI

SEQ ID NO: 2685259 - protein, 23 aa, Entamoeba histolytica
LCITFHFDLRLSNLLFNSIYPKV

SEQ ID NO: 2685260 - protein, 26 aa, Entamoeba histolytica
LCIYCVARFSFRIGERYYSQSMEDII

SEQ ID NO: 2685261 - protein, 18 aa, Entamoeba histolytica
LCKNYCFTFIPPVLDTIF

SEQ ID NO: 2685262 - protein, 21 aa, Entamoeba histolytica
LCKPALSLLLTFLSKKVISND

SEQ ID NO: 2685263 - protein, 22 aa, Entamoeba histolytica
LCLDHIRYELAVNVAVTTIGTV

SEQ ID NO: 2685264 - protein, 20 aa, Entamoeba histolytica
LCLIFPYSPPHFSYSLDARK

SEQ ID NO: 2685265 - protein, 20 aa, Entamoeba histolytica
LCLKNAIAARDSWVEEKPER

SEQ ID NO: 2685266 - protein, 17 aa, Entamoeba histolytica
LCLSCTNLPNIILSFNF

SEQ ID NO: 2685267 - protein, 17 aa, Entamoeba histolytica
LCMSVMKQLMKVSESEV

SEQ ID NO: 2685268 - protein, 23 aa, Entamoeba histolytica
LCNDGWRGLSVVHMGDQDVPNCL

SEQ ID NO: 2685269 - protein, 29 aa, Entamoeba histolytica
LCNICEQCGLDLCVVMYVFKGLSDAFFEL

SEQ ID NO: 2685270 - protein, 20 aa, Entamoeba histolytica
LCPLHYKKDKFIGWEENSIG

SEQ ID NO: 2685271 - protein, 18 aa, Entamoeba histolytica
LCPQLIVVGYDFDEYEKV

SEQ ID NO: 2685272 - protein, 24 aa, Entamoeba histolytica
LCQFLPQDRVSAFSSLNPAELLRE

SEQ ID NO: 2685273 - protein, 20 aa, Entamoeba histolytica
LCQKCGIIVHYNCSEHAYSY

SEQ ID NO: 2685274 - protein, 19 aa, Entamoeba histolytica
LCQKCHDTIEWKKKFHKYK

SEQ ID NO: 2685275 - protein, 20 aa, Entamoeba histolytica
LCQKEIMVLVVTKVDQKEGR

SEQ ID NO: 2685276 - protein, 17 aa, Entamoeba histolytica
LCQNLKIELPKNELHED

SEQ ID NO: 2685277 - protein, 17 aa, Entamoeba histolytica
LCQPKNNVIGLNWIHCS

SEQ ID NO: 2685278 - protein, 26 aa, Entamoeba histolytica
LCQYKYCSVVPLLERRFISLFMKKGK

SEQ ID NO: 2685279 - protein, 18 aa, Entamoeba histolytica
LCSCIKGIESLPMDKDIE

SEQ ID NO: 2685280 - protein, 23 aa, Entamoeba histolytica
LCSEEGFEIPIPLFYEIKKEKVL

SEQ ID NO: 2685281 - protein, 18 aa, Entamoeba histolytica
LCSGCVEIGDGSFETSTI

SEQ ID NO: 2685282 - protein, 19 aa, Entamoeba histolytica
LCSKCKGKGTKSGKDVKKC

SEQ ID NO: 2685283 - protein, 19 aa, Entamoeba histolytica
LCSLVIKIKSEFIVELIGV

SEQ ID NO: 2685284 - protein, 19 aa, Entamoeba histolytica
LCSNLKELIIPNSVEVLGD

SEQ ID NO: 2685285 - protein, 17 aa, Entamoeba histolytica
LCSQFLLFGIKNENIRI

SEQ ID NO: 2685286 - protein, 17 aa, Entamoeba histolytica
LCSQVNFIVGENGSGKS

SEQ ID NO: 2685287 - protein, 18 aa, Entamoeba histolytica
LCSSELYKSYYQYFNKNS

SEQ ID NO: 2685288 - protein, 17 aa, Entamoeba histolytica
LCTIPFSTKMTAVCWNE

SEQ ID NO: 2685289 - protein, 17 aa, Entamoeba histolytica
LCTLFGIEQRLILTTRR

SEQ ID NO: 2685290 - protein, 20 aa, Entamoeba histolytica
LCTLLQYKRDFYRNKDRNNI

SEQ ID NO: 2685291 - protein, 30 aa, Entamoeba histolytica; identical to SEQ ID NO: 2492839

SEQ ID NO: 2685292 - protein, 18 aa, Entamoeba histolytica
LCVHPNVVEFHDYFECKN

SEQ ID NO: 2685293 - protein, 19 aa, Entamoeba histolytica
LCVIPKVLAQNAAKDASEL

SEQ ID NO: 2685294 - protein, 18 aa, Entamoeba histolytica
LCVSCSLSKLVAVSTNNL

SEQ ID NO: 2685295 - protein, 22 aa, Entamoeba histolytica
LCVYFDEWFKKFHLTNNYEGFK

SEQ ID NO: 2685296 - protein, 19 aa, Entamoeba histolytica
LCYFKVELYYGEKSLCPAL

SEQ ID NO: 2685297 - protein, 18 aa, Entamoeba histolytica
LCYQKILFLQFIIVFNNK

SEQ ID NO: 2685298 - protein, 17 aa, Entamoeba histolytica
LCYYKIIQYAPDSIRFV

SEQ ID NO: 2685299 - protein, 22 aa, Entamoeba histolytica
LDAHLYFLIPISIYLGNLTSDI

SEQ ID NO: 2685300 - protein, 18 aa, Entamoeba histolytica
LDAIGFSTCNQRLTLQRA

SEQ ID NO: 2685301 - protein, 21 aa, Entamoeba histolytica
LDAKLPIVVYKKILGINLQMK

SEQ ID NO: 2685302 - protein, 18 aa, Entamoeba histolytica
LDALRFLFNIIAPEKKLH

SEQ ID NO: 2685303 - protein, 17 aa, Entamoeba histolytica
LDARFRIKKPIPNTGNV

SEQ ID NO: 2685304 - protein, 26 aa, Entamoeba histolytica
LDAVLRFCYLWFNFMPLTRGTAGCGM

SEQ ID NO: 2685305 - protein, 29 aa, Entamoeba histolytica
LDAYRYFAYCRKLKCSITEDVQDIVTNSF

SEQ ID NO: 2685306 - protein, 20 aa, Entamoeba histolytica
LDCVPPIYRQIMFDLLCSSP

SEQ ID NO: 2685307 - protein, 17 aa, Entamoeba histolytica
LDDEKMKIFTINLNKPI

SEQ ID NO: 2685308 - protein, 25 aa, Entamoeba histolytica
LDDEVLTMYLVYYVLNDKNIRDDEE

SEQ ID NO: 2685309 - protein, 24 aa, Entamoeba histolytica
LDDGGRVSILLQRLRSINPDYYNI

SEQ ID NO: 2685310 - protein, 33 aa, Entamoeba histolytica
LDDNCPPEQLPESWKIILREAGVKKKDLQNPET

SEQ ID NO: 2685311 - protein, 21 aa, Entamoeba histolytica
LDDRKKLLWGYYHNHQSQVVK

SEQ ID NO: 2685312 - protein, 24 aa, Entamoeba histolytica
LDDWKKQLFQSLSFEDLNNFPFVI

SEQ ID NO: 2685313 - protein, 17 aa, Entamoeba histolytica
LDEAIEMMTKKDKLTNE

SEQ ID NO: 2685314 - protein, 25 aa, Entamoeba histolytica
LDEALLRPGRFDRILYVGLPDLDTR

SEQ ID NO: 2685315 - protein, 23 aa, Entamoeba histolytica
LDEEIKYIYTIIKGIRSLNGIYS

SEQ ID NO: 2685316 - protein, 17 aa, Entamoeba histolytica
LDEFRLYLTEGLPYFLL

SEQ ID NO: 2685317 - protein, 24 aa, Entamoeba histolytica
LDEFTKRAEVIKSITEFLHPELYE

SEQ ID NO: 2685318 - protein, 19 aa, Entamoeba histolytica
LDEHIRVVISAMIHAPYII

SEQ ID NO: 2685319 - protein, 23 aa, Entamoeba histolytica
LDEIKAGGIDLEISESNAQNKER

SEQ ID NO: 2685320 - protein, 19 aa, Entamoeba histolytica
LDEKVDLLSLRKLSDQSSE

SEQ ID NO: 2685321 - protein, 18 aa, Entamoeba histolytica
LDELCKTILLLIDSYNPH

SEQ ID NO: 2685322 - protein, 23 aa, Entamoeba histolytica
LDELKLIKTIWAITGISGKVVYK

SEQ ID NO: 2685323 - protein, 19 aa, Entamoeba histolytica
LDEMHRVLPPPIPFKPEFG

SEQ ID NO: 2685324 - protein, 22 aa, Entamoeba histolytica
LDEMPSIISSALSLIQQIYEKL

SEQ ID NO: 2685325 - protein, 24 aa, Entamoeba histolytica
LDESEVFWLFKSVMDMMEQFYKPR

SEQ ID NO: 2685326 - protein, 21 aa, Entamoeba histolytica
LDETLCFGQALLTHSSQSNNL

SEQ ID NO: 2685327 - protein, 20 aa, Entamoeba histolytica
LDETSGVFMFLAFVIHLIFF

SEQ ID NO: 2685328 - protein, 24 aa, Entamoeba histolytica
LDEVCLKGELDLVKGIMTVKTTRK

SEQ ID NO: 2685329 - protein, 26 aa, Entamoeba histolytica
LDEVKISGPIPYQINNIFYQGDELER

SEQ ID NO: 2685330 - protein, 18 aa, Entamoeba histolytica
LDFDLNLVGLITLNQMNI

SEQ ID NO: 2685331 - protein, 22 aa, Entamoeba histolytica
LDFGVLLPVVEWLMTKVEEART

SEQ ID NO: 2685332 - protein, 21 aa, Entamoeba histolytica
LDFLRNYIISLGGKIPEPKKE

SEQ ID NO: 2685333 - protein, 17 aa, Entamoeba histolytica
LDFLTELYQHFREVHAK

SEQ ID NO: 2685334 - protein, 24 aa, Entamoeba histolytica
LDFNELHLIFSVFNLLFKIPQNDV

SEQ ID NO: 2685335 - protein, 26 aa, Entamoeba histolytica
LDFRYPDPQIRGFALRCIDTMTDDQL

SEQ ID NO: 2685336 - protein, 19 aa, Entamoeba histolytica
LDFTPRTTISNSIKNSLQR

SEQ ID NO: 2685337 - protein, 18 aa, Entamoeba histolytica
LDFYELINMIGHTKKITQ

SEQ ID NO: 2685338 - protein, 19 aa, Entamoeba histolytica
LDGDYVYCRVVSKENVPQV

SEQ ID NO: 2685339 - protein, 17 aa, Entamoeba histolytica
LDGFGIDKEGPGNCVTL

SEQ ID NO: 2685340 - protein, 18 aa, Entamoeba histolytica
LDGFKKERINNHICLKKH

SEQ ID NO: 2685341 - protein, 18 aa, Entamoeba histolytica
LDGFKRKKYSVMVATNIL

SEQ ID NO: 2685342 - protein, 26 aa, Entamoeba histolytica
LDGRKGSYCVLSLPSRSSFVSQALSF

SEQ ID NO: 2685343 - protein, 17 aa, Entamoeba histolytica
LDGRVGLKAEIVEPLDC

SEQ ID NO: 2685344 - protein, 21 aa, Entamoeba histolytica
LDGYYRKALFVDFVADQVKAL

SEQ ID NO: 2685345 - protein, 21 aa, Entamoeba histolytica
LDHGCKAVVLASHLGRPDGHV

SEQ ID NO: 2685346 - protein, 28 aa, Entamoeba histolytica
LDIASVISICIEYSRYSTIFTLYRSLGK

SEQ ID NO: 2685347 - protein, 17 aa, Entamoeba histolytica
LDICCKRYHSGVSSIHC

SEQ ID NO: 2685348 - protein, 24 aa, Entamoeba histolytica
LDICGGGEYRRAPLVIFDNNGNTS

SEQ ID NO: 2685349 - protein, 20 aa, Entamoeba histolytica
LDICSVPEQPSLEFFIDKVL

SEQ ID NO: 2685350 - protein, 32 aa, Entamoeba histolytica
LDIEMPEALFIFPRLFKIEIAILYDKLSSIGF

SEQ ID NO: 2685351 - protein, 20 aa, Entamoeba histolytica
LDIFQFHLGSHLKYLSIMRG

SEQ ID NO: 2685352 - protein, 20 aa, Entamoeba histolytica
LDIGDLHFQYIVFYENIKYQ

SEQ ID NO: 2685353 - protein, 19 aa, Entamoeba histolytica
LDIGKGCFSSCTSLQSICI

SEQ ID NO: 2685354 - protein, 24 aa, Entamoeba histolytica
LDIIDIPAIEFARQMTLIIHTAFS

SEQ ID NO: 2685355 - protein, 21 aa, Entamoeba histolytica
LDIIHCIRPNNSFTLKLTHLE

SEQ ID NO: 2685356 - protein, 25 aa, Entamoeba histolytica
LDIIPKCCGYPLPSLFEQQEYQPID

SEQ ID NO: 2685357 - protein, 23 aa, Entamoeba histolytica
LDIKRILNKRVQVLSGGELQLFV

SEQ ID NO: 2685358 - protein, 31 aa, Entamoeba histolytica
LDILGLGCALDLLKRIDIDFKLNGCRFEGPF

SEQ ID NO: 2685359 - protein, 19 aa, Entamoeba histolytica
LDIPETRFTEIEKPAVEMK

SEQ ID NO: 2685360 - protein, 24 aa, Entamoeba histolytica
LDISILIKNVEAFGVINDKKDRVF

SEQ ID NO: 2685361 - protein, 20 aa, Entamoeba histolytica
LDIVSTLAYSTVSKIIVAIN

SEQ ID NO: 2685362 - protein, 25 aa, Entamoeba histolytica
LDIYKGSKSWVFGIEKGFWIHSKQN

SEQ ID NO: 2685363 - protein, 30 aa, Entamoeba histolytica
LDKDYKGTVPIDRIKIFLTKTLNGKANLIS

SEQ ID NO: 2685364 - protein, 19 aa, Entamoeba histolytica
LDKFPDFFEKIDVITGVSA

SEQ ID NO: 2685365 - protein, 20 aa, Entamoeba histolytica
LDKGAFGKIFVARRKDDSKV

SEQ ID NO: 2685366 - protein, 22 aa, Entamoeba histolytica
LDKIQKSICLLKIYSGMKTSIL

SEQ ID NO: 2685367 - protein, 19 aa, Entamoeba histolytica
LDKIVIKNPIFITSLPRSG

SEQ ID NO: 2685368 - protein, 22 aa, Entamoeba histolytica
LDKLLCGGFETGSITELFGEFR

SEQ ID NO: 2685369 - protein, 20 aa, Entamoeba histolytica
LDKQFKIVIADECHYLKNSQ

SEQ ID NO: 2685370 - protein, 21 aa, Entamoeba histolytica
LDKQKIGVIINKWDVFEQKRK

SEQ ID NO: 2685371 - protein, 21 aa, Entamoeba histolytica
LDKRLGEEGSFYKENNKLQKK

SEQ ID NO: 2685372 - protein, 21 aa, Entamoeba histolytica
LDKRYPKLIALPIYASLSTEQ

SEQ ID NO: 2685373 - protein, 18 aa, Entamoeba histolytica
LDKSCVRPFHKIGLIYVK

SEQ ID NO: 2685374 - protein, 22 aa, Entamoeba histolytica
LDKVEGKFLIKGDVSTYDNNSP

SEQ ID NO: 2685375 - protein, 24 aa, Entamoeba histolytica
LDLDCFRTIYQIIGQIFNDKRDEL

SEQ ID NO: 2685376 - protein, 17 aa, Entamoeba histolytica
LDLERKKEDVIRIQQPQ

SEQ ID NO: 2685377 - protein, 22 aa, Entamoeba histolytica
LDLESLPLFIHMLKIFIQCEQI

SEQ ID NO: 2685378 - protein, 19 aa, Entamoeba histolytica
LDLFCCVGGDSIQQAVAGS

SEQ ID NO: 2685379 - protein, 17 aa, Entamoeba histolytica
LDLLQPVEKVTCQLSKD

SEQ ID NO: 2685380 - protein, 24 aa, Entamoeba histolytica
LDLLRDILESFGYFFNTKKSSGKK

SEQ ID NO: 2685381 - protein, 18 aa, Entamoeba histolytica
LDLLSLFCNRNLLEPEYS

SEQ ID NO: 2685382 - protein, 28 aa, Entamoeba histolytica
LDLLSPENFPLLFDFIGTYFSFVLPVDK

SEQ ID NO: 2685383 - protein, 20 aa, Entamoeba histolytica
LDLNAICFVAPSSNVKLTAS

SEQ ID NO: 2685384 - protein, 20 aa, Entamoeba histolytica
LDLNAICFVAPSSNVRLTAS

SEQ ID NO: 2685385 - protein, 20 aa, Entamoeba histolytica
LDLNAICFVASSSNVRLTAS

SEQ ID NO: 2685386 - protein, 25 aa, Entamoeba histolytica
LDLNKCIIEGNGIKGGYVNEKQNFT

SEQ ID NO: 2685387 - protein, 17 aa, Entamoeba histolytica
LDLNLPYKLIKNKIFLL

SEQ ID NO: 2685388 - protein, 18 aa, Entamoeba histolytica
LDLPRLFQIKGQKRPFVR

SEQ ID NO: 2685389 - protein, 31 aa, Entamoeba histolytica
LDLRSYLIMPVQRLPRYELLLKDLLKNTKSD

SEQ ID NO: 2685390 - protein, 35 aa, Entamoeba histolytica
LDLRSYLIMPVQRLPRYKLLLTDLIKHTDDDFVDK

SEQ ID NO: 2685391 - protein, 17 aa, Entamoeba histolytica
LDLSNIISIKDLSLSSS

SEQ ID NO: 2685392 - protein, 17 aa, Entamoeba histolytica
LDLVVGEEIIFSNTGLH

SEQ ID NO: 2685393 - protein, 20 aa, Entamoeba histolytica
LDLYLKTALTIYPTDKILKK

SEQ ID NO: 2685394 - protein, 23 aa, Entamoeba histolytica
LDLYLRYSHHCYSITINNVMILD

SEQ ID NO: 2685395 - protein, 19 aa, Entamoeba histolytica
LDLYYDYTKQLLGGVEASI

SEQ ID NO: 2685396 - protein, 33 aa, Entamoeba histolytica
LDMKMFKKRWELPRSGILTMKNGIGIIKDLSTI

SEQ ID NO: 2685397 - protein, 19 aa, Entamoeba histolytica
LDNGDIYWWLKSIGFEDSI

SEQ ID NO: 2685398 - protein, 18 aa, Entamoeba histolytica
LDNGEYWDQIISRISRAE

SEQ ID NO: 2685399 - protein, 19 aa, Entamoeba histolytica
LDNIIKMESVIRGFLIRRE

SEQ ID NO: 2685400 - protein, 28 aa, Entamoeba histolytica
LDNNAIMSMKFMKRARAKEIEEMKDILA

SEQ ID NO: 2685401 - protein, 23 aa, Entamoeba histolytica
LDNYRCGVQFVQPGTSIIIMTDG

SEQ ID NO: 2685402 - protein, 25 aa, Entamoeba histolytica
LDPALLRPGRLDRKIEFPLPDRRQK

SEQ ID NO: 2685403 - protein, 25 aa, Entamoeba histolytica
LDPFLPDYLTSIFVYVAPLFTTLEF

SEQ ID NO: 2685404 - protein, 17 aa, Entamoeba histolytica
LDPHLPIEVDIADAKNI

SEQ ID NO: 2685405 - protein, 24 aa, Entamoeba histolytica
LDPMLRNNWWWNLVQSVSVTQFNS

SEQ ID NO: 2685406 - protein, 23 aa, Entamoeba histolytica
LDPNEFFQFYYLFEYYVDENGEF

SEQ ID NO: 2685407 - protein, 18 aa, Entamoeba histolytica
LDPRLNYDTRYDRLERGI

SEQ ID NO: 2685408 - protein, 19 aa, Entamoeba histolytica
LDPSIRYSIKCKKMDMIGK

SEQ ID NO: 2685409 - protein, 18 aa, Entamoeba histolytica
LDQCFYKVVEAIKSYLNF

SEQ ID NO: 2685410 - protein, 21 aa, Entamoeba histolytica
LDQCSALKYIQLFTKLCNHPS

SEQ ID NO: 2685411 - protein, 24 aa, Entamoeba histolytica
LDQIKYAYPCDREAMVDLVKEIMQ

SEQ ID NO: 2685412 - protein, 19 aa, Entamoeba histolytica
LDRCFYKEKMALVELMSLV

SEQ ID NO: 2685413 - protein, 22 aa, Entamoeba histolytica
LDRPQLISSIISDIVKTDDKTI

SEQ ID NO: 2685414 - protein, 21 aa, Entamoeba histolytica
LDRTLRLVGFYFERSNDIEDY

SEQ ID NO: 2685415 - protein, 24 aa, Entamoeba histolytica
LDRVLRPGGVFFFRDYGEGDMKQD

SEQ ID NO: 2685416 - protein, 17 aa, Entamoeba histolytica
LDSALIRPGRIDRKIEF

SEQ ID NO: 2685417 - protein, 18 aa, Entamoeba histolytica
LDSICYLPTVPSISHSST

SEQ ID NO: 2685418 - protein, 19 aa, Entamoeba histolytica
LDSKRPCMLTIENPFDETS

SEQ ID NO: 2685419 - protein, 26 aa, Entamoeba histolytica
LDSLKGDLLLRVLKLLRLLIRNEGNL

SEQ ID NO: 2685420 - protein, 17 aa, Entamoeba histolytica
LDSLKGMTLYSPNHLMT

SEQ ID NO: 2685421 - protein, 19 aa, Entamoeba histolytica
LDSLKKKKIEELKKSSESS

SEQ ID NO: 2685422 - protein, 29 aa, Entamoeba histolytica
LDSLLELFRIILMYRYSFYKESVKDIFLL

SEQ ID NO: 2685423 - protein, 20 aa, Entamoeba histolytica
LDSLLMKGIDLNSLGIDLST

SEQ ID NO: 2685424 - protein, 18 aa, Entamoeba histolytica
LDSLNALSVIADKHPDLA

SEQ ID NO: 2685425 - protein, 17 aa, Entamoeba histolytica
LDSLYLHYSEFKITNPS

SEQ ID NO: 2685426 - protein, 22 aa, Entamoeba histolytica
LDSNLSFLIECVDSLKKRVVEL

SEQ ID NO: 2685427 - protein, 27 aa, Entamoeba histolytica
LDSSLALKLSVIFLICADFIPEKKDLL

SEQ ID NO: 2685428 - protein, 17 aa, Entamoeba histolytica
LDSSLYFGMPGDEIDAP

SEQ ID NO: 2685429 - protein, 23 aa, Entamoeba histolytica
LDSSTPWILYWTLNPLRLFGYNV

SEQ ID NO: 2685430 - protein, 23 aa, Entamoeba histolytica
LDSYFGSVCELDLIYYFHKVYQV

SEQ ID NO: 2685431 - protein, 19 aa, Entamoeba histolytica
LDTAIQINIFDVCGETVIS

SEQ ID NO: 2685432 - protein, 24 aa, Entamoeba histolytica
LDTFFYIVVFRGEAVADWMKQKLE

SEQ ID NO: 2685433 - protein, 19 aa, Entamoeba histolytica
LDTGIKKKAFWSIEEDRII

SEQ ID NO: 2685434 - protein, 25 aa, Entamoeba histolytica
LDTHYPCEFCCIPPHVPTINIIIFW

SEQ ID NO: 2685435 - protein, 19 aa, Entamoeba histolytica
LDTPGSRVPKAFNEGEDDE

SEQ ID NO: 2685436 - protein, 18 aa, Entamoeba histolytica
LDTSWEILEKFTTNCDEQ

SEQ ID NO: 2685437 - protein, 18 aa, Entamoeba histolytica
LDTWFSSGLFPFSVMGWP

SEQ ID NO: 2685438 - protein, 17 aa, Entamoeba histolytica
LDVACCRIGKDENIQVE

SEQ ID NO: 2685439 - protein, 23 aa, Entamoeba histolytica
LDVCKKAKQVIFLSGTPALSRPM

SEQ ID NO: 2685440 - protein, 26 aa, Entamoeba histolytica
LDVDFLFKIADFDGDGKIGMDDAQQF

SEQ ID NO: 2685441 - protein, 27 aa, Entamoeba histolytica
LDVEFLSIMKFCRGDPIYIESSSESSE

SEQ ID NO: 2685442 - protein, 18 aa, Entamoeba histolytica
LDVFSFLLKDFRLIIYEV

SEQ ID NO: 2685443 - protein, 19 aa, Entamoeba histolytica
LDVPLRYAIPSTKKEIKTV

SEQ ID NO: 2685444 - protein, 25 aa, Entamoeba histolytica
LDVSQKIELLWEVIDPIFNNNVEDM

SEQ ID NO: 2685445 - protein, 19 aa, Entamoeba histolytica
LDVSRFIYTGIKFYLEDNI

SEQ ID NO: 2685446 - protein, 25 aa, Entamoeba histolytica
LDVSSLIGICFLNIPLYGGGAHPWG

SEQ ID NO: 2685447 - protein, 26 aa, Entamoeba histolytica
LDYILMAAVLKRFFRNLPEKVFNRIN

SEQ ID NO: 2685448 - protein, 18 aa, Entamoeba histolytica
LDYKGVLRRSLTCGDSVD

SEQ ID NO: 2685449 - protein, 17 aa, Entamoeba histolytica
LDYLKQLNITSVVLSDF

SEQ ID NO: 2685450 - protein, 20 aa, Entamoeba histolytica
LDYYHNVFGIYLPNGLVESD

SEQ ID NO: 2685451 - protein, 18 aa, Entamoeba histolytica
LEAEYKYDYLISPLMRQA

SEQ ID NO: 2685452 - protein, 23 aa, Entamoeba histolytica
LEAKELFMVFVFLLNSNTSINGP

SEQ ID NO: 2685453 - protein, 23 aa, Entamoeba histolytica
LEALKKKRFDEFMNGLTEISFKL

SEQ ID NO: 2685454 - protein, 17 aa, Entamoeba histolytica
LEALKLKNKYGIDSINI

SEQ ID NO: 2685455 - protein, 17 aa, Entamoeba histolytica
LEANSLDLNKCIIEGNG

SEQ ID NO: 2685456 - protein, 20 aa, Entamoeba histolytica
LEAPIPRIYILQKLVISAEA

SEQ ID NO: 2685457 - protein, 26 aa, Entamoeba histolytica
LEASLPFMHFFDGFRTSHEIQKIHQL

SEQ ID NO: 2685458 - protein, 20 aa, Entamoeba histolytica
LEATGWKRGKGLGKNEDGIT

SEQ ID NO: 2685459 - protein, 17 aa, Entamoeba histolytica
LECNELDPSFVNNYNPE

SEQ ID NO: 2685460 - protein, 40 aa, Entamoeba histolytica
LECPKHIACVHCKAGRGRTGLVCSCVLLSLGKCGDAKKAL

SEQ ID NO: 2685461 - protein, 26 aa, Entamoeba histolytica
LECTPSLYCSPFIKKLVITSSQEFPC

SEQ ID NO: 2685462 - protein, 20 aa, Entamoeba histolytica
LEDFCFAECYSLKSITLPLS

SEQ ID NO: 2685463 - protein, 17 aa, Entamoeba histolytica
LEDGNEIGFYFSETYLF

SEQ ID NO: 2685464 - protein, 19 aa, Entamoeba histolytica
LEDHLRIISKTMHSDKKDS

SEQ ID NO: 2685465 - protein, 17 aa, Entamoeba histolytica
LEDIIGQESAIGIGTPF

SEQ ID NO: 2685466 - protein, 21 aa, Entamoeba histolytica
LEDRHEYKKCIALLNKLQTCY

SEQ ID NO: 2685467 - protein, 18 aa, Entamoeba histolytica
LEDTCCFCQSTLDYCCPC

SEQ ID NO: 2685468 - protein, 19 aa, Entamoeba histolytica
LEDYFGYQVIQCMNITDVD

SEQ ID NO: 2685469 - protein, 24 aa, Entamoeba histolytica
LEEACGEKGALFCHHSGFMLSCSS

SEQ ID NO: 2685470 - protein, 18 aa, Entamoeba histolytica
LEECLITCQILFKASSQL

SEQ ID NO: 2685471 - protein, 24 aa, Entamoeba histolytica
LEEEFPGFLARTSLFCGVSASSLL

SEQ ID NO: 2685472 - protein, 21 aa, Entamoeba histolytica
LEEELKALGIDDISSDEELEK

SEQ ID NO: 2685473 - protein, 17 aa, Entamoeba histolytica
LEEFCLACCDLCDCCDC

SEQ ID NO: 2685474 - protein, 17 aa, Entamoeba histolytica
LEEIFPLHNLEPYKEKF

SEQ ID NO: 2685475 - protein, 27 aa, Entamoeba histolytica
LEEIKRIGLECPKVWIKNPVLQNSMIK

SEQ ID NO: 2685476 - protein, 22 aa, Entamoeba histolytica
LEEIRKKYALIVPRRPAWTPDM

SEQ ID NO: 2685477 - protein, 21 aa, Entamoeba histolytica
LEEIYRFKSLAPLIDLKVAPA

SEQ ID NO: 2685478 - protein, 23 aa, Entamoeba histolytica
LEEKEHWKLVEYDSALRALKNKE

SEQ ID NO: 2685479 - protein, 25 aa, Entamoeba histolytica
LEEKEKRKSAELELENKKDDILELQ

SEQ ID NO: 2685480 - protein, 22 aa, Entamoeba histolytica
LEEKRTAKGLSRNLVITKDKTS

SEQ ID NO: 2685481 - protein, 18 aa, Entamoeba histolytica
LEELLRCFPSLHKQLDTR

SEQ ID NO: 2685482 - protein, 21 aa, Entamoeba histolytica
LEENKRLKNILAQEPSLSNFN

SEQ ID NO: 2685483 - protein, 25 aa, Entamoeba histolytica
LEEPLPIRILVSLPQLSGTCRADIP

SEQ ID NO: 2685484 - protein, 24 aa, Entamoeba histolytica
LEESISSGMFCRFEQRENYLVIME

SEQ ID NO: 2685485 - protein, 24 aa, Entamoeba histolytica
LEESKVGLIYICVIVKERIEKREL

SEQ ID NO: 2685486 - protein, 17 aa, Entamoeba histolytica
LEESVKFLLQILSALKY

SEQ ID NO: 2685487 - protein, 19 aa, Entamoeba histolytica
LEETKFALITKEEETNKKI

SEQ ID NO: 2685488 - protein, 19 aa, Entamoeba histolytica
LEEVGCLKNIIFINEFEVE

SEQ ID NO: 2685489 - protein, 20 aa, Entamoeba histolytica
LEEYLKDFGIIGEVVSKYHL

SEQ ID NO: 2685490 - protein, 19 aa, Entamoeba histolytica
LEEYLRIFAKLPPIIKDFI

SEQ ID NO: 2685491 - protein, 20 aa, Entamoeba histolytica
LEEYLRIFAKLPPIIKDFIE

SEQ ID NO: 2685492 - protein, 23 aa, Entamoeba histolytica
LEFAICAVFRSWMGKRAVDYRRE

SEQ ID NO: 2685493 - protein, 19 aa, Entamoeba histolytica
LEFEEMKLPSSTNQYNELE

SEQ ID NO: 2685494 - protein, 25 aa, Entamoeba histolytica
LEFLHNCAPFIAKLYLLVNSPQSNS

SEQ ID NO: 2685495 - protein, 19 aa, Entamoeba histolytica
LEGALSVYTPYLVNYSESI

SEQ ID NO: 2685496 - protein, 19 aa, Entamoeba histolytica
LEGDWVSAFERIDIIESQT

SEQ ID NO: 2685497 - protein, 20 aa, Entamoeba histolytica
LEGETGIYCVCKINEKKYRT

SEQ ID NO: 2685498 - protein, 20 aa, Entamoeba histolytica
LEGFLPLKDMDFIVWNEKIM

SEQ ID NO: 2685499 - protein, 26 aa, Entamoeba histolytica
LEGFQSGRVLACISSRPGQTGSVEGY

SEQ ID NO: 2685500 - protein, 24 aa, Entamoeba histolytica
LEGIRCPICFDLTRNVMTTKCGHL

SEQ ID NO: 2685501 - protein, 22 aa, Entamoeba histolytica
LEGKKIYFSKIFELKKVNVEVK

SEQ ID NO: 2685502 - protein, 20 aa, Entamoeba histolytica
LEGKVKCFGIFPKGFEKAAG

SEQ ID NO: 2685503 - protein, 26 aa, Entamoeba histolytica
LEGLTIPGFCLTIGKIKEVMCCLELS

SEQ ID NO: 2685504 - protein, 21 aa, Entamoeba histolytica
LEGRIPFDMFQVIQHDYKLRS

SEQ ID NO: 2685505 - protein, 25 aa, Entamoeba histolytica
LEGRKLKRIFVYRCGISDNLMKAIR

SEQ ID NO: 2685506 - protein, 26 aa, Entamoeba histolytica
LEGRSRFARLGLFVHITASFMNPGIS

SEQ ID NO: 2685507 - protein, 23 aa, Entamoeba histolytica
LEGRSVSLGFSFPSLPMEETIKM

SEQ ID NO: 2685508 - protein, 18 aa, Entamoeba histolytica
LEGTWLLIEKVELGSMFS

SEQ ID NO: 2685509 - protein, 29 aa, Entamoeba histolytica
LEHDTKLPAVFFIFSRKLVMDYAKKLAKA

SEQ ID NO: 2685510 - protein, 19 aa, Entamoeba histolytica
LEHETKWFLMVKTSFSLEV

SEQ ID NO: 2685511 - protein, 22 aa, Entamoeba histolytica
LEHFDELCEVLKYIGKKKYATK

SEQ ID NO: 2685512 - protein, 18 aa, Entamoeba histolytica
LEHFIVSSPLRLDGFSPV

SEQ ID NO: 2685513 - protein, 17 aa, Entamoeba histolytica
LEHIEFPDTLDIIGEEC

SEQ ID NO: 2685514 - protein, 17 aa, Entamoeba histolytica
LEHISLYALDVKLYKSY

SEQ ID NO: 2685515 - protein, 20 aa, Entamoeba histolytica
LEHLEWNTAVVLSEHTNTER

SEQ ID NO: 2685516 - protein, 20 aa, Entamoeba histolytica
LEHMLQCVLYAMKYEPTLRI

SEQ ID NO: 2685517 - protein, 21 aa, Entamoeba histolytica
LEHPSTLNGLKAWKLAKPLAE

SEQ ID NO: 2685518 - protein, 26 aa, Entamoeba histolytica
LEHTMCDIIGFGSALIKFNQRFSYCP

SEQ ID NO: 2685519 - protein, 18 aa, Entamoeba histolytica
LEHVKPLDCFQFERVGFF

SEQ ID NO: 2685520 - protein, 17 aa, Entamoeba histolytica
LEIARFIFCETELFQDI

SEQ ID NO: 2685521 - protein, 26 aa, Entamoeba histolytica
LEIEGNICAIIYCNGKVYIGKTNSVI

SEQ ID NO: 2685522 - protein, 18 aa, Entamoeba histolytica
LEIHIARLEYKYGSVDKG

SEQ ID NO: 2685523 - protein, 30 aa, Entamoeba histolytica; identical to SEQ ID NO: 2493114

SEQ ID NO: 2685524 - protein, 21 aa, Entamoeba histolytica
LEIISCLFNGISVECNPNNLN

SEQ ID NO: 2685525 - protein, 19 aa, Entamoeba histolytica
LEIKPDFTKGIIRLATIYE

SEQ ID NO: 2685526 - protein, 24 aa, Entamoeba histolytica
LEIKSLRSSECINIFTKDIDPSLL

SEQ ID NO: 2685527 - protein, 25 aa, Entamoeba histolytica
LEIKTHCQSPCHCSWIMEVIGAGFK

SEQ ID NO: 2685528 - protein, 22 aa, Entamoeba histolytica
LEILIPFEWQHIIITHLPVSMV

SEQ ID NO: 2685529 - protein, 32 aa, Entamoeba histolytica
LEILMKYMFSLKYGFKYLYYIIPKIISLSNSI

SEQ ID NO: 2685530 - protein, 20 aa, Entamoeba histolytica
LEILNTLSYETMKYCTYKFP

SEQ ID NO: 2685531 - protein, 19 aa, Entamoeba histolytica
LEIPACCYDDFLVYNKLIQ

SEQ ID NO: 2685532 - protein, 30 aa, Entamoeba histolytica
LEIPIMLKVQYRCCPPISNIVNRLYYNGNL

SEQ ID NO: 2685533 - protein, 25 aa, Entamoeba histolytica
LEIPKNCRYEDLMKKCWLENTEQRP

SEQ ID NO: 2685534 - protein, 21 aa, Entamoeba histolytica
LEIPQFYQIISLLNFHMSPSM

SEQ ID NO: 2685535 - protein, 25 aa, Entamoeba histolytica
LEIPSERIAISWTFSQEKIVIFQQL

SEQ ID NO: 2685536 - protein, 18 aa, Entamoeba histolytica
LEISGCKHVSDGFFAFHG

SEQ ID NO: 2685537 - protein, 17 aa, Entamoeba histolytica
LEIVKSMTLGASLASIT

SEQ ID NO: 2685538 - protein, 17 aa, Entamoeba histolytica
LEIWGMKDIQKSARVKQ

SEQ ID NO: 2685539 - protein, 21 aa, Entamoeba histolytica
LEKALKYLFLNGLNKEGLFRL

SEQ ID NO: 2685540 - protein, 19 aa, Entamoeba histolytica
LEKEGHPIVGVEAALLIRA

SEQ ID NO: 2685541 - protein, 28 aa, Entamoeba histolytica
LEKEGLEEFGVFCLAKIFSYDSSLISHY

SEQ ID NO: 2685542 - protein, 20 aa, Entamoeba histolytica
LEKERFGERLIFNKEGNPQI

SEQ ID NO: 2685543 - protein, 24 aa, Entamoeba histolytica
LEKESKVVVRKCQNIQDCLNLLVS

SEQ ID NO: 2685544 - protein, 27 aa, Entamoeba histolytica
LEKFKSFCDFFKRRGHTQLIEEFSYLI

SEQ ID NO: 2685545 - protein, 26 aa, Entamoeba histolytica
LEKIGRPESILNFMIKYDLNKKDFIQ

SEQ ID NO: 2685546 - protein, 23 aa, Entamoeba histolytica
LEKIPKMEGKIMFNEKNLEQSIV

SEQ ID NO: 2685547 - protein, 18 aa, Entamoeba histolytica
LEKKICDRLSTPEKIKTH

SEQ ID NO: 2685548 - protein, 18 aa, Entamoeba histolytica
LEKKKGCLVCDMQTMNKS

SEQ ID NO: 2685549 - protein, 22 aa, Entamoeba histolytica
LEKKLNGSVFIIGKRVVAHTKK

SEQ ID NO: 2685550 - protein, 17 aa, Entamoeba histolytica
LEKKPVHKFKISKKKRF

SEQ ID NO: 2685551 - protein, 24 aa, Entamoeba histolytica
LEKKRIPILQSPVVNRPMFTSPLK

SEQ ID NO: 2685552 - protein, 19 aa, Entamoeba histolytica
LEKLCSTVLYVPGNHDPTT

SEQ ID NO: 2685553 - protein, 24 aa, Entamoeba histolytica
LEKLFKRRLISFSKIKEAMMKDPY

SEQ ID NO: 2685554 - protein, 20 aa, Entamoeba histolytica
LEKLNRGILTEFSRTDDPGW

SEQ ID NO: 2685555 - protein, 17 aa, Entamoeba histolytica
LEKLSGLYLSSNNFGKF

SEQ ID NO: 2685556 - protein, 19 aa, Entamoeba histolytica
LEKLSGLYLSSNNFGKFPE

SEQ ID NO: 2685557 - protein, 17 aa, Entamoeba histolytica
LEKMKAFVNLGFDEDML

SEQ ID NO: 2685558 - protein, 19 aa, Entamoeba histolytica
LEKNIYKFVGALVEKRLHE

SEQ ID NO: 2685559 - protein, 24 aa, Entamoeba histolytica
LEKPQVVIKPEFSNFGVDDSSSDN

SEQ ID NO: 2685560 - protein, 19 aa, Entamoeba histolytica
LEKSGIIFDKFIDRDSGII

SEQ ID NO: 2685561 - protein, 24 aa, Entamoeba histolytica
LEKSQRLKTGFKMYDISSFITHFR

SEQ ID NO: 2685562 - protein, 17 aa, Entamoeba histolytica
LEKSRYGNISFRTWHKR

SEQ ID NO: 2685563 - protein, 18 aa, Entamoeba histolytica
LEKYCFAGLPSLSSICIP

SEQ ID NO: 2685564 - protein, 19 aa, Entamoeba histolytica
LELCKRSDIKKVYCVGRSS

SEQ ID NO: 2685565 - protein, 18 aa, Entamoeba histolytica
LELDKMRRERDFLQQTLD

SEQ ID NO: 2685566 - protein, 17 aa, Entamoeba histolytica
LELDYRHAFKKVNNNST

SEQ ID NO: 2685567 - protein, 19 aa, Entamoeba histolytica
LELEMIHKFMGCIKNGNVM

SEQ ID NO: 2685568 - protein, 17 aa, Entamoeba histolytica
LELEQSLFIAFDAYVAR

SEQ ID NO: 2685569 - protein, 17 aa, Entamoeba histolytica
LELFEGTGFQHVADTEL

SEQ ID NO: 2685570 - protein, 25 aa, Entamoeba histolytica
LELFRKAAAVQIVMLGGEFIAQKKK

SEQ ID NO: 2685571 - protein, 18 aa, Entamoeba histolytica
LELHKKYYLVRDDSSLVA

SEQ ID NO: 2685572 - protein, 25 aa, Entamoeba histolytica
LELICCCSHLFPFYIKTGEHDETDP

SEQ ID NO: 2685573 - protein, 19 aa, Entamoeba histolytica
LELIRLGLELSELGTRRRV

SEQ ID NO: 2685574 - protein, 21 aa, Entamoeba histolytica
LELKDKLHLILPYKENELIVK

SEQ ID NO: 2685575 - protein, 17 aa, Entamoeba histolytica
LELKDSFFSKIPNNKDD

SEQ ID NO: 2685576 - protein, 22 aa, Entamoeba histolytica
LELKRVMSLLTKLNKLWDLEDY

SEQ ID NO: 2685577 - protein, 24 aa, Entamoeba histolytica
LELLKEILKTDGFCIELFVNYDCD

SEQ ID NO: 2685578 - protein, 20 aa, Entamoeba histolytica
LELLKNGLIQRMIKEDEKSE

SEQ ID NO: 2685579 - protein, 19 aa, Entamoeba histolytica
LELLLEIAKEFTLMNHLSR

SEQ ID NO: 2685580 - protein, 19 aa, Entamoeba histolytica
LELMEKCILWPDYCDLLLI

SEQ ID NO: 2685581 - protein, 19 aa, Entamoeba histolytica
LELMKCGSFKFIDATPYID

SEQ ID NO: 2685582 - protein, 19 aa, Entamoeba histolytica
LELNVSLASCESSLHKVID

SEQ ID NO: 2685583 - protein, 21 aa, Entamoeba histolytica
LELNVSYQIACLFEENSLSSG

SEQ ID NO: 2685584 - protein, 23 aa, Entamoeba histolytica
LELPPLTFCYLLKPGEDVIKVDG

SEQ ID NO: 2685585 - protein, 24 aa, Entamoeba histolytica
LELSFKKGDIIKIYSTDDEWFEGE

SEQ ID NO: 2685586 - protein, 20 aa, Entamoeba histolytica
LELSFKRGDMIDLLRKDGLW

SEQ ID NO: 2685587 - protein, 25 aa, Entamoeba histolytica
LELTKKYKRVCFVTHRSTQQAFMSK

SEQ ID NO: 2685588 - protein, 28 aa, Entamoeba histolytica
LELVSCVKAGFVLPNLRLFRGDNSNIYI

SEQ ID NO: 2685589 - protein, 22 aa, Entamoeba histolytica
LELYRSLNVLFIKGAHIKSENI

SEQ ID NO: 2685590 - protein, 28 aa, Entamoeba histolytica
LELYSTNILPRFLEQVLLSRDKVTQDYL

SEQ ID NO: 2685591 - protein, 23 aa, Entamoeba histolytica
LEMKEGRELLDYGIQPPSDSNIE

SEQ ID NO: 2685592 - protein, 18 aa, Entamoeba histolytica
LEMLFQFEHVNIGYKNGD

SEQ ID NO: 2685593 - protein, 18 aa, Entamoeba histolytica
LEMLKYKVECKFIGDILR

SEQ ID NO: 2685594 - protein, 23 aa, Entamoeba histolytica
LEMNNLFVGMYIIEFDNVSGEKI

SEQ ID NO: 2685595 - protein, 17 aa, Entamoeba histolytica
LEMTFPTLLKGAIDYIE

SEQ ID NO: 2685596 - protein, 19 aa, Entamoeba histolytica
LEMTFRVLLDGTKITDAIL

SEQ ID NO: 2685597 - protein, 22 aa, Entamoeba histolytica
LEMTIYRLGGVIGLMSQGIPTL

SEQ ID NO: 2685598 - protein, 25 aa, Entamoeba histolytica
LEMTTHFNMCLAFATIHPQIHQSII

SEQ ID NO: 2685599 - protein, 18 aa, Entamoeba histolytica
LENDGIAIANGFRNIQNV

SEQ ID NO: 2685600 - protein, 21 aa, Entamoeba histolytica
LENEMKINVLPFIHNQKNLND

SEQ ID NO: 2685601 - protein, 22 aa, Entamoeba histolytica
LENFPLPLSQQFFLNYGDITLS

SEQ ID NO: 2685602 - protein, 33 aa, Entamoeba histolytica
LENIFSSMLFEYIWPPCYDKFQTSKEVVNDMKL

SEQ ID NO: 2685603 - protein, 23 aa, Entamoeba histolytica
LENIINVLIDFCEYSPEYLANIT

SEQ ID NO: 2685604 - protein, 23 aa, Entamoeba histolytica
LENKIPIICGGTSYYIDALLFRH

SEQ ID NO: 2685605 - protein, 35 aa, Entamoeba histolytica; identical to SEQ ID NO: 2493204

SEQ ID NO: 2685606 - protein, 19 aa, Entamoeba histolytica
LENLFAIGCDTGLKVFKLE

SEQ ID NO: 2685607 - protein, 21 aa, Entamoeba histolytica
LENLQEVFLQLIIKEIPLSSW

SEQ ID NO: 2685608 - protein, 25 aa, Entamoeba histolytica
LENVPTCNGIPYPVYELISYLTEKQ

SEQ ID NO: 2685609 - protein, 19 aa, Entamoeba histolytica
LEPKRSCFEVFEEKVIEGF

SEQ ID NO: 2685610 - protein, 19 aa, Entamoeba histolytica
LEPMKNFIDYDFKDIHSLK

SEQ ID NO: 2685611 - protein, 18 aa, Entamoeba histolytica
LEPRCMECIKQYGDCLNN

SEQ ID NO: 2685612 - protein, 28 aa, Entamoeba histolytica
LEQARAEIYYVQMLKEIEFLVGTDYTKN

SEQ ID NO: 2685613 - protein, 17 aa, Entamoeba histolytica
LEQELRVTKELYSKIQT

SEQ ID NO: 2685614 - protein, 24 aa, Entamoeba histolytica
LEQFGVALLKYAKKYPFQSQFCQD

SEQ ID NO: 2685615 - protein, 20 aa, Entamoeba histolytica
LEQGKSRWSPVEDKIIEQFQ

SEQ ID NO: 2685616 - protein, 23 aa, Entamoeba histolytica
LEQLKHWFTPMIISDGNDFVESN

SEQ ID NO: 2685617 - protein, 25 aa, Entamoeba histolytica
LEQLTEQFIGFGYLSVENILSMDQI

SEQ ID NO: 2685618 - protein, 27 aa, Entamoeba histolytica
LEQPKKWWKFAFIATRDYLREREEEKN

SEQ ID NO: 2685619 - protein, 20 aa, Entamoeba histolytica
LEQREMSVVFIGGGLFHAEA

SEQ ID NO: 2685620 - protein, 20 aa, Entamoeba histolytica
LEQRIWRYYYIHYKQIQCDQ

SEQ ID NO: 2685621 - protein, 24 aa, Entamoeba histolytica
LEQWMIKDLLEGIDVKARGIRVGK

SEQ ID NO: 2685622 - protein, 25 aa, Entamoeba histolytica
LEQWMIKDLLEGIDVKARGIRVGKT

SEQ ID NO: 2685623 - protein, 23 aa, Entamoeba histolytica
LEQYAEVFICFGYISQDDLFSMD

SEQ ID NO: 2685624 - protein, 22 aa, Entamoeba histolytica
LEREPKVNGALIMQQIGLNNQV

SEQ ID NO: 2685625 - protein, 21 aa, Entamoeba histolytica
LERIKNEIGIRVKNEEKAEVL

SEQ ID NO: 2685626 - protein, 19 aa, Entamoeba histolytica
LERILKFVIEKKHQILNEE

SEQ ID NO: 2685627 - protein, 18 aa, Entamoeba histolytica
LERMKLMGSKQLVKMFSP

SEQ ID NO: 2685628 - protein, 19 aa, Entamoeba histolytica
LERNCKGNISVTILSLDSF

SEQ ID NO: 2685629 - protein, 24 aa, Entamoeba histolytica
LERREKRVPILFVVGKTKTGKTEF

SEQ ID NO: 2685630 - protein, 17 aa, Entamoeba histolytica
LERSVVFSFVIHSFQEL

SEQ ID NO: 2685631 - protein, 19 aa, Entamoeba histolytica
LERVIRYAFEASRKRRNHV

SEQ ID NO: 2685632 - protein, 21 aa, Entamoeba histolytica
LERYWGISFANWISGRIEIHF

SEQ ID NO: 2685633 - protein, 23 aa, Entamoeba histolytica
LESCKLEDYFSLVSSIIYLTNDP

SEQ ID NO: 2685634 - protein, 17 aa, Entamoeba histolytica
LESCRRPTIGFSDDLIQ

SEQ ID NO: 2685635 - protein, 18 aa, Entamoeba histolytica
LESCRRPTIGFSDDLIQQ

SEQ ID NO: 2685636 - protein, 19 aa, Entamoeba histolytica
LESEGRPYYQLPRIIENIL

SEQ ID NO: 2685637 - protein, 22 aa, Entamoeba histolytica
LESEHLKHLLSILTSLQQVWNV

SEQ ID NO: 2685638 - protein, 21 aa, Entamoeba histolytica
LESGGTCLNMNWEEVGKKKVE

SEQ ID NO: 2685639 - protein, 18 aa, Entamoeba histolytica
LESGYEMIFHYQFNEPIK

SEQ ID NO: 2685640 - protein, 18 aa, Entamoeba histolytica
LESHKKMAVEPFEPYLMK

SEQ ID NO: 2685641 - protein, 17 aa, Entamoeba histolytica
LESICKWINTQFNTLTE

SEQ ID NO: 2685642 - protein, 19 aa, Entamoeba histolytica
LESIFKKECGKGIKKDISF

SEQ ID NO: 2685643 - protein, 28 aa, Entamoeba histolytica
LESIKKLKAEFPNKVVIASIMCMDNADD

SEQ ID NO: 2685644 - protein, 23 aa, Entamoeba histolytica
LESISLPSSVSFLGSDCFSNCYN

SEQ ID NO: 2685645 - protein, 21 aa, Entamoeba histolytica
LESIVGRDFLPRGSGMVTKRP

SEQ ID NO: 2685646 - protein, 17 aa, Entamoeba histolytica
LESLGHHIFPIFYSLGI

SEQ ID NO: 2685647 - protein, 18 aa, Entamoeba histolytica
LESLKINLNQNVPNSFQI

SEQ ID NO: 2685648 - protein, 20 aa, Entamoeba histolytica
LESLRFKEEIERGVEKRGRM

SEQ ID NO: 2685649 - protein, 23 aa, Entamoeba histolytica
LESNSLRLGKKSKAFSIIFDIDL

SEQ ID NO: 2685650 - protein, 17 aa, Entamoeba histolytica
LESRFLPMRSREKKEVD

SEQ ID NO: 2685651 - protein, 32 aa, Entamoeba histolytica
LESVKPIVLFWGLRICGLMLCSTAEENTEKKG

SEQ ID NO: 2685652 - protein, 23 aa, Entamoeba histolytica
LESYRFRGGAFIQDEKSKKVHFL

SEQ ID NO: 2685653 - protein, 20 aa, Entamoeba histolytica
LETFCLKLDVDIENIRPGVE

SEQ ID NO: 2685654 - protein, 17 aa, Entamoeba histolytica
LETFIGMMNLEGKSLMK

SEQ ID NO: 2685655 - protein, 18 aa, Entamoeba histolytica
LETLKLQLDLFYKTVENK

SEQ ID NO: 2685656 - protein, 23 aa, Entamoeba histolytica
LETNRPLSYYNFENDTLLYVCPT

SEQ ID NO: 2685657 - protein, 21 aa, Entamoeba histolytica
LETRLGITLYAIRKGKKVVIG

SEQ ID NO: 2685658 - protein, 19 aa, Entamoeba histolytica
LETVSIKLSKGLYKTKEDF

SEQ ID NO: 2685659 - protein, 29 aa, Entamoeba histolytica
LETYPDWDIKCFAFAPAAAFSKEIACCKQ

SEQ ID NO: 2685660 - protein, 18 aa, Entamoeba histolytica
LEVCGKQGVTFLFTITSY

SEQ ID NO: 2685661 - protein, 20 aa, Entamoeba histolytica
LEVLKRMPGITTDQLYDIEH

SEQ ID NO: 2685662 - protein, 20 aa, Entamoeba histolytica
LEVLLRVTMEGMKIEKVDAV

SEQ ID NO: 2685663 - protein, 18 aa, Entamoeba histolytica
LEVMIKVLLPISETVLCD

SEQ ID NO: 2685664 - protein, 21 aa, Entamoeba histolytica
LEVMNCVIRTYQFIGALIAIE

SEQ ID NO: 2685665 - protein, 18 aa, Entamoeba histolytica
LEVNNLWLSNPAQAKSNA

SEQ ID NO: 2685666 - protein, 31 aa, Entamoeba histolytica
LEVNRFDPLMCLKLIKYIIVECSTFFVIKEY

SEQ ID NO: 2685667 - protein, 19 aa, Entamoeba histolytica
LEVRSPIMMKEYLNNPEAN

SEQ ID NO: 2685668 - protein, 18 aa, Entamoeba histolytica
LEVTCSASAITQPQAATA

SEQ ID NO: 2685669 - protein, 17 aa, Entamoeba histolytica
LEVTDKIQWIIGDVNVG

SEQ ID NO: 2685670 - protein, 24 aa, Entamoeba histolytica
LEVVDSKVGIFVRPFPCDVKTDTI

SEQ ID NO: 2685671 - protein, 30 aa, Entamoeba histolytica
LEVWQVRKAICDKMKFLGIELDDSLNEKSM

SEQ ID NO: 2685672 - protein, 24 aa, Entamoeba histolytica
LEVYCKLLTLLSNDICKTIIETKC

SEQ ID NO: 2685673 - protein, 26 aa, Entamoeba histolytica
LEWPDELKMPVLKVGVKAIGITGSDD

SEQ ID NO: 2685674 - protein, 25 aa, Entamoeba histolytica
LEYAQKLHCCDWSFNPHNCDIVNEI

SEQ ID NO: 2685675 - protein, 19 aa, Entamoeba histolytica
LEYCIKNGIIPPMVELLLS

SEQ ID NO: 2685676 - protein, 18 aa, Entamoeba histolytica
LEYCKNKLIGCTDTSTIY

SEQ ID NO: 2685677 - protein, 25 aa, Entamoeba histolytica
LEYFKEFHPVKALIIYDKESKISKG

SEQ ID NO: 2685678 - protein, 18 aa, Entamoeba histolytica
LEYFLLIFHGDFTKTTEY

SEQ ID NO: 2685679 - protein, 23 aa, Entamoeba histolytica
LEYIHRMYLKVGFYLTGETTDFN

SEQ ID NO: 2685680 - protein, 17 aa, Entamoeba histolytica
LEYKLWIEYTATRHPQM

SEQ ID NO: 2685681 - protein, 23 aa, Entamoeba histolytica
LEYWIIMEYCSFKSIDEYWKSNA

SEQ ID NO: 2685682 - protein, 26 aa, Entamoeba histolytica
LFAHLIDCLKYIYSVKEQCELLSDNK

SEQ ID NO: 2685683 - protein, 19 aa, Entamoeba histolytica
LFALPFEFQSLPPSTIIHN

SEQ ID NO: 2685684 - protein, 18 aa, Entamoeba histolytica
LFANYVIQKAIEFIPESR

SEQ ID NO: 2685685 - protein, 19 aa, Entamoeba histolytica
LFASILNERRVVVIGQNPS

SEQ ID NO: 2685686 - protein, 17 aa, Entamoeba histolytica
LFCKEHREQLGTKYNGK

SEQ ID NO: 2685687 - protein, 17 aa, Entamoeba histolytica
LFCLGGPGAGKGTQCQK

SEQ ID NO: 2685688 - protein, 18 aa, Entamoeba histolytica
LFCPRCGEVYSIPDGYCG

SEQ ID NO: 2685689 - protein, 23 aa, Entamoeba histolytica
LFCVICGCPLLLDEDIRSMTVQS

SEQ ID NO: 2685690 - protein, 17 aa, Entamoeba histolytica
LFDCENVPLSLIPVSVT

SEQ ID NO: 2685691 - protein, 19 aa, Entamoeba histolytica
LFDCFAVVANIDFPKQWPD

SEQ ID NO: 2685692 - protein, 19 aa, Entamoeba histolytica
LFDCFQWNHCFFVVSEKLC

SEQ ID NO: 2685693 - protein, 27 aa, Entamoeba histolytica
LFDDANLSSIDWEDFKAMISTRGEKVR

SEQ ID NO: 2685694 - protein, 20 aa, Entamoeba histolytica
LFDFDPYYLYSIYNPIIYIF

SEQ ID NO: 2685695 - protein, 17 aa, Entamoeba histolytica
LFDGESMEEIFIAEKES

SEQ ID NO: 2685696 - protein, 21 aa, Entamoeba histolytica
LFDILQFASLVPEASQVIMNE

SEQ ID NO: 2685697 - protein, 27 aa, Entamoeba histolytica
LFDKYKFGKLLGCGSFGKVFQVITTNE

SEQ ID NO: 2685698 - protein, 24 aa, Entamoeba histolytica
LFDNCKKLYIDECENYNLEEVNTI

SEQ ID NO: 2685699 - protein, 25 aa, Entamoeba histolytica
LFDPFLRPYFAIGYIPVTQGDVIQC

SEQ ID NO: 2685700 - protein, 17 aa, Entamoeba histolytica
LFDPSARLDVSLIRGIV

SEQ ID NO: 2685701 - protein, 21 aa, Entamoeba histolytica
LFDQRLQAIVLNIVDVSYGGM

SEQ ID NO: 2685702 - protein, 24 aa, Entamoeba histolytica
LFDQSECSYKFFLHQLYNILNYTP

SEQ ID NO: 2685703 - protein, 19 aa, Entamoeba histolytica
LFDSISITSKHLEEFILKE

SEQ ID NO: 2685704 - protein, 18 aa, Entamoeba histolytica
LFDSLFILEQLYFHGKMW

SEQ ID NO: 2685705 - protein, 18 aa, Entamoeba histolytica
LFDVFPLLLKQTLSLLTS

SEQ ID NO: 2685706 - protein, 24 aa, Entamoeba histolytica
LFDYKLLIDKRIGYICYNEYDKAC

SEQ ID NO: 2685707 - protein, 17 aa, Entamoeba histolytica
LFECLMSDIFQFIIKYH

SEQ ID NO: 2685708 - protein, 20 aa, Entamoeba histolytica
LFECNCKYFITRINDSSLPR

SEQ ID NO: 2685709 - protein, 26 aa, Entamoeba histolytica
LFEECDERLALLNLFLPEPVLSTSII

SEQ ID NO: 2685710 - protein, 18 aa, Entamoeba histolytica
LFEGCVFIQPPTELQENS

SEQ ID NO: 2685711 - protein, 17 aa, Entamoeba histolytica
LFEGTGFQHVADTELLE

SEQ ID NO: 2685712 - protein, 18 aa, Entamoeba histolytica
LFEIVDSPIVIFIDCLEK

SEQ ID NO: 2685713 - protein, 18 aa, Entamoeba histolytica
LFEKAKVMAIGFLCQMDP

SEQ ID NO: 2685714 - protein, 27 aa, Entamoeba histolytica
LFEKCPYYEKYFFLFLRCLKSFGRLES

SEQ ID NO: 2685715 - protein, 18 aa, Entamoeba histolytica
LFEKRGGAATPEMLKALD

SEQ ID NO: 2685716 - protein, 25 aa, Entamoeba histolytica
LFELILACRPEIYQIPIVQEILRNG

SEQ ID NO: 2685717 - protein, 24 aa, Entamoeba histolytica
LFELLQLRCEEITKNLPKVIDSIL

SEQ ID NO: 2685718 - protein, 19 aa, Entamoeba histolytica
LFENIGFLSPKGHYDVKIY

SEQ ID NO: 2685719 - protein, 19 aa, Entamoeba histolytica
LFEPCHSIDASVVYDRDTN

SEQ ID NO: 2685720 - protein, 19 aa, Entamoeba histolytica
LFEQKEMFYVDGLNDVTNI

SEQ ID NO: 2685721 - protein, 24 aa, Entamoeba histolytica
LFEQMDCSHFLPPTSLIYKDIPGF

SEQ ID NO: 2685722 - protein, 19 aa, Entamoeba histolytica
LFEQMKLVFNQVKPIYDII

SEQ ID NO: 2685723 - protein, 17 aa, Entamoeba histolytica
LFERCGVVLKVNIPINQ

SEQ ID NO: 2685724 - protein, 25 aa, Entamoeba histolytica
LFETIFNWRQVNGLKHDDYTRYRRF

SEQ ID NO: 2685725 - protein, 23 aa, Entamoeba histolytica
LFETKNSIFGCFYRLPIPSQPST

SEQ ID NO: 2685726 - protein, 22 aa, Entamoeba histolytica
LFFFPIHPSFPVLNGITKLDLS

SEQ ID NO: 2685727 - protein, 27 aa, Entamoeba histolytica
LFFGEALQFKLVINIGDATIFRNSNEI

SEQ ID NO: 2685728 - protein, 18 aa, Entamoeba histolytica
LFFKTFDEQFLFKELKPP

SEQ ID NO: 2685729 - protein, 19 aa, Entamoeba histolytica
LFFNVEFFERVWSKTDPKD

SEQ ID NO: 2685730 - protein, 25 aa, Entamoeba histolytica
LFFSEKRLPPFGSLKVKPSIIDLMK

SEQ ID NO: 2685731 - protein, 25 aa, Entamoeba histolytica
LFGDDHFYHTFGFETSTKYGIKTDI

SEQ ID NO: 2685732 - protein, 19 aa, Entamoeba histolytica
LFGGFNPAKVSLRKTNYPK

SEQ ID NO: 2685733 - protein, 18 aa, Entamoeba histolytica
LFGLQLKPLPTVKRILED

SEQ ID NO: 2685734 - protein, 18 aa, Entamoeba histolytica
LFHGHVCIVTELLSINLY

SEQ ID NO: 2685735 - protein, 26 aa, Entamoeba histolytica
LFHRALCSRLSLFISSIQIQILPLSN

SEQ ID NO: 2685736 - protein, 19 aa, Entamoeba histolytica
LFHRLSVSDISSFPWETLA

SEQ ID NO: 2685737 - protein, 17 aa, Entamoeba histolytica
LFHRVYKFVPLNKRKKY

SEQ ID NO: 2685738 - protein, 26 aa, Entamoeba histolytica
LFHTECLRCKSCDCFLFEKESFDRQC

SEQ ID NO: 2685739 - protein, 25 aa, Entamoeba histolytica
LFIDVFPVRLVIRIWDYYLYEGKDV

SEQ ID NO: 2685740 - protein, 32 aa, Entamoeba histolytica
LFIETPLIFDGCSWGWVGDGLQPGFLWMECPT

SEQ ID NO: 2685741 - protein, 20 aa, Entamoeba histolytica
LFIGETQSGILLQRIIHKIA

SEQ ID NO: 2685742 - protein, 19 aa, Entamoeba histolytica
LFIIKCAIIALKQKKVSSI

SEQ ID NO: 2685743 - protein, 17 aa, Entamoeba histolytica
LFIKFLLFQNSLNEPYH

SEQ ID NO: 2685744 - protein, 23 aa, Entamoeba histolytica
LFIKNGRYNAQFGDKTKGVTDKD

SEQ ID NO: 2685745 - protein, 17 aa, Entamoeba histolytica
LFIKPNLTILKKVTYTK

SEQ ID NO: 2685746 - protein, 17 aa, Entamoeba histolytica
LFIKSDEPYAFQIRFAG

SEQ ID NO: 2685747 - protein, 27 aa, Entamoeba histolytica
LFIKYGSYKKPTSWLKNSLGLNRKTLS

SEQ ID NO: 2685748 - protein, 25 aa, Entamoeba histolytica
LFIMKIHLIDALIRFIRKKELQYSF

SEQ ID NO: 2685749 - protein, 18 aa, Entamoeba histolytica
LFIPWIPNNMQLAVCDVP

SEQ ID NO: 2685750 - protein, 17 aa, Entamoeba histolytica
LFIQFIIRHIEHSVIFT

SEQ ID NO: 2685751 - protein, 17 aa, Entamoeba histolytica
LFIQRNVIQYDYSKLKD

SEQ ID NO: 2685752 - protein, 17 aa, Entamoeba histolytica
LFISIQIPNPIKINKLK

SEQ ID NO: 2685753 - protein, 19 aa, Entamoeba histolytica
LFITFKLVLLQTSFGKSID

SEQ ID NO: 2685754 - protein, 17 aa, Entamoeba histolytica
LFITLARDVLVKQPKII

SEQ ID NO: 2685755 - protein, 17 aa, Entamoeba histolytica
LFIVRHAVRHDYIDLKW

SEQ ID NO: 2685756 - protein, 22 aa, Entamoeba histolytica
LFIYLFRLMLATGIPELKNEDD

SEQ ID NO: 2685757 - protein, 41 aa, Entamoeba histolytica
LFKEAIPKFKVIMKLAIEKVRLKGLMLLFMSIGGVIEVNDV

SEQ ID NO: 2685758 - protein, 20 aa, Entamoeba histolytica
LFKEVVETLPNIQQSIDDTT

SEQ ID NO: 2685759 - protein, 22 aa, Entamoeba histolytica
LFKGRCKIDQLFKIFSQLGTPT

SEQ ID NO: 2685760 - protein, 17 aa, Entamoeba histolytica
LFKKELSAMKLSTTQIK

SEQ ID NO: 2685761 - protein, 26 aa, Entamoeba histolytica
LFKKGCKKFPVGTEGRYRRIATYMKT

SEQ ID NO: 2685762 - protein, 20 aa, Entamoeba histolytica
LFKNKHRLFIGPIQVDSNAR

SEQ ID NO: 2685763 - protein, 27 aa, Entamoeba histolytica
LFKRNCRKAKPIGTSCRIEINREIDDL

SEQ ID NO: 2685764 - protein, 25 aa, Entamoeba histolytica
LFKRTIPEILYFFDMNQLDIPSNDE

SEQ ID NO: 2685765 - protein, 21 aa, Entamoeba histolytica
LFKRTSFMLTSPVQLRIGSLN

SEQ ID NO: 2685766 - protein, 21 aa, Entamoeba histolytica
LFKTQCKDPIFILKQTNQAFK

SEQ ID NO: 2685767 - protein, 20 aa, Entamoeba histolytica
LFKYIMKLSYKISAYEDINL

SEQ ID NO: 2685768 - protein, 18 aa, Entamoeba histolytica
LFLAPRVNNHFYFEEGKT

SEQ ID NO: 2685769 - protein, 18 aa, Entamoeba histolytica
LFLDEWFHVDSFSIIEFV

SEQ ID NO: 2685770 - protein, 24 aa, Entamoeba histolytica
LFLLEYRVLIIASKEQVAVSSETV

SEQ ID NO: 2685771 - protein, 25 aa, Entamoeba histolytica
LFLNEQKPEWNIHCYGFAPAATLSE

SEQ ID NO: 2685772 - protein, 19 aa, Entamoeba histolytica
LFLNHGIIKKKTGVYGGIV

SEQ ID NO: 2685773 - protein, 34 aa, Entamoeba histolytica
LFLNMFGASLFVDMLSHLLLERKFIFISESLQLL

SEQ ID NO: 2685774 - protein, 19 aa, Entamoeba histolytica
LFLPLRMSVELSLESFFRE

SEQ ID NO: 2685775 - protein, 17 aa, Entamoeba histolytica
LFLRGIEKLVIGSCNNL

SEQ ID NO: 2685776 - protein, 24 aa, Entamoeba histolytica
LFLTRCCVNLATALQYLASESVLH

SEQ ID NO: 2685777 - protein, 19 aa, Entamoeba histolytica
LFNELSIDSFNSFLINMEE

SEQ ID NO: 2685778 - protein, 20 aa, Entamoeba histolytica
LFNFICTFIAHPFNEKIDCS

SEQ ID NO: 2685779 - protein, 17 aa, Entamoeba histolytica
LFNGISVECNPNNLNIP

SEQ ID NO: 2685780 - protein, 17 aa, Entamoeba histolytica
LFNKCVLALEEMRKRSG

SEQ ID NO: 2685781 - protein, 19 aa, Entamoeba histolytica
LFNSLALGIKMVMPKEVLK

SEQ ID NO: 2685782 - protein, 22 aa, Entamoeba histolytica
LFNVCKLCKILMTDSDSDTITI

SEQ ID NO: 2685783 - protein, 26 aa, Entamoeba histolytica
LFPDECSRLLFFVEHHAFDVCKILLE

SEQ ID NO: 2685784 - protein, 21 aa, Entamoeba histolytica
LFPGNRPTNSIVFKKMTPYVL

SEQ ID NO: 2685785 - protein, 26 aa, Entamoeba histolytica
LFPIEGVKQAFLFKQYVLYFTHSYSK

SEQ ID NO: 2685786 - protein, 24 aa, Entamoeba histolytica
LFPKYRESYLKGMWYVINKALDEV

SEQ ID NO: 2685787 - protein, 21 aa, Entamoeba histolytica
LFPRSILSFSGINCILQSLDF

SEQ ID NO: 2685788 - protein, 17 aa, Entamoeba histolytica
LFPSFSNNQIKVEMRDQ

SEQ ID NO: 2685789 - protein, 25 aa, Entamoeba histolytica
LFPSLKKSGSLVVYCQYLDKLARLF

SEQ ID NO: 2685790 - protein, 17 aa, Entamoeba histolytica
LFPWREEMPEVQTIRKW

SEQ ID NO: 2685791 - protein, 20 aa, Entamoeba histolytica
LFQFLQRFEIATSINCSLSK

SEQ ID NO: 2685792 - protein, 17 aa, Entamoeba histolytica
LFQGRQKLLLPINLLEY

SEQ ID NO: 2685793 - protein, 25 aa, Entamoeba histolytica
LFQIIKSRMTSIIIGKIKTFLVYPI

SEQ ID NO: 2685794 - protein, 21 aa, Entamoeba histolytica
LFQNRLVGIDFRKSLLSNLCN

SEQ ID NO: 2685795 - protein, 20 aa, Entamoeba histolytica
LFQRKVKRTSVPYLLTTSTK

SEQ ID NO: 2685796 - protein, 34 aa, Entamoeba histolytica
LFQVFRGAIFMQIPMLIESCARCIAKHLVGKLPA

SEQ ID NO: 2685797 - protein, 27 aa, Entamoeba histolytica
LFRDITIPILFGLYLLKTGIRIELFKK

SEQ ID NO: 2685798 - protein, 17 aa, Entamoeba histolytica
LFRDITQEFFGWNQNKV

SEQ ID NO: 2685799 - protein, 20 aa, Entamoeba histolytica
LFRGETILLKGKRRKETVCL

SEQ ID NO: 2685800 - protein, 24 aa, Entamoeba histolytica
LFRKYPQKYLPVIAKLCDNLNTLD

SEQ ID NO: 2685801 - protein, 17 aa, Entamoeba histolytica
LFSAIIFESIESLEDKS

SEQ ID NO: 2685802 - protein, 17 aa, Entamoeba histolytica
LFSDVCIFAQYKEAMLS

SEQ ID NO: 2685803 - protein, 18 aa, Entamoeba histolytica
LFSEYDFFRNDQVREHIK

SEQ ID NO: 2685804 - protein, 21 aa, Entamoeba histolytica
LFSIIKTRLLEIDDVYDDDID

SEQ ID NO: 2685805 - protein, 18 aa, Entamoeba histolytica
LFSKFPYIDLLALPDDIE

SEQ ID NO: 2685806 - protein, 25 aa, Entamoeba histolytica
LFSLELCSLHQGFLMEPNPNLDLIS

SEQ ID NO: 2685807 - protein, 24 aa, Entamoeba histolytica
LFSQFLRFVSVLSSKLLVGKKSGS

SEQ ID NO: 2685808 - protein, 18 aa, Entamoeba histolytica
LFSQSYCEKFAFLSRDCI

SEQ ID NO: 2685809 - protein, 25 aa, Entamoeba histolytica
LFSSWNSLMDFEWNVYKLNLLRRPM

SEQ ID NO: 2685810 - protein, 24 aa, Entamoeba histolytica
LFSYELARALGYIHSFGMCHRDIK

SEQ ID NO: 2685811 - protein, 18 aa, Entamoeba histolytica
LFTFCEFNHLSCISLILE

SEQ ID NO: 2685812 - protein, 18 aa, Entamoeba histolytica
LFTFKFPEKIVGIAQSPD

SEQ ID NO: 2685813 - protein, 23 aa, Entamoeba histolytica
LFTPFFKVYFLYISHYDDSNQVL

SEQ ID NO: 2685814 - protein, 27 aa, Entamoeba histolytica
LFTQRKLFVSQLFCFYISYEDPINLRI

SEQ ID NO: 2685815 - protein, 20 aa, Entamoeba histolytica
LFTVEMINMLLKRREYDKQT

SEQ ID NO: 2685816 - protein, 19 aa, Entamoeba histolytica
LFVDLCYVCSNMIAMNQSV

SEQ ID NO: 2685817 - protein, 19 aa, Entamoeba histolytica
LFVEHLLRSFGYKLLERIL

SEQ ID NO: 2685818 - protein, 19 aa, Entamoeba histolytica
LFVKANLLPIKYFGFDFHK

SEQ ID NO: 2685819 - protein, 24 aa, Entamoeba histolytica
LFVLNGKGAYPFKLERKDTLRSFT

SEQ ID NO: 2685820 - protein, 26 aa, Entamoeba histolytica
LFWDKPKAIILYNCSLWVTRVLETYV

SEQ ID NO: 2685821 - protein, 23 aa, Entamoeba histolytica
LFWIYYCSLPLFTSKVPVVDFWL

SEQ ID NO: 2685822 - protein, 17 aa, Entamoeba histolytica
LFWKVIIFDQFNSDLLS

SEQ ID NO: 2685823 - protein, 17 aa, Entamoeba histolytica
LFYERLGMVFGDIIKMM

SEQ ID NO: 2685824 - protein, 22 aa, Entamoeba histolytica
LFYPCMQCADIFELGADVCQLG

SEQ ID NO: 2685825 - protein, 19 aa, Entamoeba histolytica
LFYTKRYLLIFNKCIEKLL

SEQ ID NO: 2685826 - protein, 25 aa, Entamoeba histolytica
LGAPQGKCYCLFEYQNPEYKEKILT

SEQ ID NO: 2685827 - protein, 21 aa, Entamoeba histolytica
LGARGAASITRYATGLSKQYQ

SEQ ID NO: 2685828 - protein, 22 aa, Entamoeba histolytica
LGAYKPSLIMSKFFPALQGSMG

SEQ ID NO: 2685829 - protein, 20 aa, Entamoeba histolytica
LGCEVLKALAMVGFQNLTII

SEQ ID NO: 2685830 - protein, 24 aa, Entamoeba histolytica
LGCILYKICYFDTPFEESPMRIQF

SEQ ID NO: 2685831 - protein, 18 aa, Entamoeba histolytica
LGCKTYGVFCFPLEAVVK

SEQ ID NO: 2685832 - protein, 28 aa, Entamoeba histolytica
LGDDLRQDCLILRAFKLFDNLWRMNGMD

SEQ ID NO: 2685833 - protein, 24 aa, Entamoeba histolytica
LGDEIEIRPGFNFRDSKNQQTCKP

SEQ ID NO: 2685834 - protein, 17 aa, Entamoeba histolytica
LGDFYFKGKELYPNGYN

SEQ ID NO: 2685835 - protein, 23 aa, Entamoeba histolytica
LGDLPRNVFFISVCAKAPRMASV

SEQ ID NO: 2685836 - protein, 27 aa, Entamoeba histolytica
LGDPFYFISDALRFALVPFLDAAKGIE

SEQ ID NO: 2685837 - protein, 18 aa, Entamoeba histolytica
LGDYCFYRCSSLSAVSLP

SEQ ID NO: 2685838 - protein, 24 aa, Entamoeba histolytica
LGDYRFEDCTTLRLIIIPTSVSEL

SEQ ID NO: 2685839 - protein, 18 aa, Entamoeba histolytica
LGEDHIRKVCLYPRYLER

SEQ ID NO: 2685840 - protein, 23 aa, Entamoeba histolytica
LGEIGCIDFVIKHSYSTNTAVKR

SEQ ID NO: 2685841 - protein, 19 aa, Entamoeba histolytica
LGELIKILTRTSVSASDFI

SEQ ID NO: 2685842 - protein, 20 aa, Entamoeba histolytica
LGELRCEYERLETMENEIHR

SEQ ID NO: 2685843 - protein, 19 aa, Entamoeba histolytica
LGETYRISQLIKEYGLIPL

SEQ ID NO: 2685844 - protein, 33 aa, Entamoeba histolytica
LGETYRISRLIKEHGLIPLVELVFGGRRRRFII

SEQ ID NO: 2685845 - protein, 22 aa, Entamoeba histolytica
LGEVFCKGSSVLELTLKEGIVK

SEQ ID NO: 2685846 - protein, 26 aa, Entamoeba histolytica
LGEYPQLLGALAMKVASYITKQLPYV

SEQ ID NO: 2685847 - protein, 43 aa, Entamoeba histolytica
LGFFSRRRLEWHYLFIACSYIGARICSLYESLGKEAVKYIIEH

SEQ ID NO: 2685848 - protein, 18 aa, Entamoeba histolytica
LGFGTLIFTGGLREKLAI

SEQ ID NO: 2685849 - protein, 19 aa, Entamoeba histolytica
LGFNIGMRMLEVINIRERE

SEQ ID NO: 2685850 - protein, 17 aa, Entamoeba histolytica
LGGDCTFQGKIGKDANG

SEQ ID NO: 2685851 - protein, 18 aa, Entamoeba histolytica
LGGFCEAWGEAAGFNVPI

SEQ ID NO: 2685852 - protein, 17 aa, Entamoeba histolytica
LGGQREYITMLPMVMDG

SEQ ID NO: 2685853 - protein, 23 aa, Entamoeba histolytica
LGGSELECPLCMNTHNIDDIFTT

SEQ ID NO: 2685854 - protein, 22 aa, Entamoeba histolytica
LGHHIFPIFYSLGINDKYETII

SEQ ID NO: 2685855 - protein, 17 aa, Entamoeba histolytica
LGHVIRDSVFIVHGGIP

SEQ ID NO: 2685856 - protein, 22 aa, Entamoeba histolytica
LGIDLKDVMAIGDAMNDVPMLD

SEQ ID NO: 2685857 - protein, 23 aa, Entamoeba histolytica
LGIFYQIANAISFLHSQSPPIVH

SEQ ID NO: 2685858 - protein, 18 aa, Entamoeba histolytica
LGIKMVMPKEVLKIDNTM

SEQ ID NO: 2685859 - protein, 20 aa, Entamoeba histolytica
LGILGAIIFGKPVSFNKQGT

SEQ ID NO: 2685860 - protein, 21 aa, Entamoeba histolytica
LGILKTHLKFPLSLTSLTISH

SEQ ID NO: 2685861 - protein, 19 aa, Entamoeba histolytica
LGILLNRFFNLSCVRKENW

SEQ ID NO: 2685862 - protein, 24 aa, Entamoeba histolytica
LGILPTCLKSLFINNIPIFELDLK

SEQ ID NO: 2685863 - protein, 26 aa, Entamoeba histolytica
LGILYCIRKNFFLWLLENKPSSALSY

SEQ ID NO: 2685864 - protein, 25 aa, Entamoeba histolytica
LGINGESGYELYLLGFIGGCELYQH

SEQ ID NO: 2685865 - protein, 24 aa, Entamoeba histolytica
LGINSSYCQIIFVLNQIDKFLDKE

SEQ ID NO: 2685866 - protein, 18 aa, Entamoeba histolytica
LGITCREMADGTPPYMDF

SEQ ID NO: 2685867 - protein, 17 aa, Entamoeba histolytica
LGKEQYPSYQIPESYVL

SEQ ID NO: 2685868 - protein, 18 aa, Entamoeba histolytica
LGKRCFDFCLGLQKCKFE

SEQ ID NO: 2685869 - protein, 18 aa, Entamoeba histolytica
LGKWKIYNPKIGMDSLQI

SEQ ID NO: 2685870 - protein, 27 aa, Entamoeba histolytica
LGKYLERFSSFLLNFIKLPTPNVLPYI

SEQ ID NO: 2685871 - protein, 18 aa, Entamoeba histolytica
LGLGCFKNCLSLRTITIP

SEQ ID NO: 2685872 - protein, 24 aa, Entamoeba histolytica
LGLLYRFSGTLGKYAKKLESFAAT

SEQ ID NO: 2685873 - protein, 25 aa, Entamoeba histolytica
LGLSERVLMPISLCLQRPQTECYLD

SEQ ID NO: 2685874 - protein, 18 aa, Entamoeba histolytica
LGLSHNWSSFKIKFSPEK

SEQ ID NO: 2685875 - protein, 19 aa, Entamoeba histolytica
LGLSHSWSSIRVEILQFIE

SEQ ID NO: 2685876 - protein, 27 aa, Entamoeba histolytica
LGMNLLKFTRLWNGKGYIYMYVTVEGS

SEQ ID NO: 2685877 - protein, 18 aa, Entamoeba histolytica
LGNAAMDCCYVACGRTDC

SEQ ID NO: 2685878 - protein, 19 aa, Entamoeba histolytica
LGNICCCERVSEYGIDATV

SEQ ID NO: 2685879 - protein, 19 aa, Entamoeba histolytica
LGNKLKVAGVINREPAPFV

SEQ ID NO: 2685880 - protein, 29 aa, Entamoeba histolytica
LGNLKVIIPWSDLLHKPIEVVLSDIVGLV

SEQ ID NO: 2685881 - protein, 20 aa, Entamoeba histolytica
LGNRVFKVLCNRHDFVKNKI

SEQ ID NO: 2685882 - protein, 18 aa, Entamoeba histolytica
LGNYCFENCYSLTSIKIP

SEQ ID NO: 2685883 - protein, 18 aa, Entamoeba histolytica
LGNYCFNECLSLTSINIS

SEQ ID NO: 2685884 - protein, 19 aa, Entamoeba histolytica
LGNYLKFAPVHTVLPPQRV

SEQ ID NO: 2685885 - protein, 29 aa, Entamoeba histolytica
LGPDGKRDWECIEALRLGLLNDHLCGLMQ

SEQ ID NO: 2685886 - protein, 21 aa, Entamoeba histolytica
LGPFDIACFQFSLYKPHANVR

SEQ ID NO: 2685887 - protein, 23 aa, Entamoeba histolytica
LGPIRTDYIFSHFRQYDFKVTSR

SEQ ID NO: 2685888 - protein, 28 aa, Entamoeba histolytica
LGPSLKCTKCGFVIHKGCKDTFYLKCSG

SEQ ID NO: 2685889 - protein, 17 aa, Entamoeba histolytica
LGQEIARMALWKHEFLI

SEQ ID NO: 2685890 - protein, 17 aa, Entamoeba histolytica
LGQEKLKEQQLFNDNGE

SEQ ID NO: 2685891 - protein, 18 aa, Entamoeba histolytica
LGQITFKHFIILFNQDKT

SEQ ID NO: 2685892 - protein, 18 aa, Entamoeba histolytica
LGRLAACFLDSLATMNLP

SEQ ID NO: 2685893 - protein, 20 aa, Entamoeba histolytica
LGRVVEVKPLQSFQKIDEDG

SEQ ID NO: 2685894 - protein, 26 aa, Entamoeba histolytica
LGSGKSGSLFMFTKDHKFVIKVIPKR

SEQ ID NO: 2685895 - protein, 19 aa, Entamoeba histolytica
LGSHLKYLSIMRGKVPQLI

SEQ ID NO: 2685896 - protein, 20 aa, Entamoeba histolytica
LGSIPLEMFTGTSLTALDLS

SEQ ID NO: 2685897 - protein, 17 aa, Entamoeba histolytica
LGSIVPLITKVIEQIIQ

SEQ ID NO: 2685898 - protein, 19 aa, Entamoeba histolytica
LGSSCFENYTLYSYIQSRH

SEQ ID NO: 2685899 - protein, 25 aa, Entamoeba histolytica
LGSSIAEWQKLIIDYGGNVVKNVAD

SEQ ID NO: 2685900 - protein, 26 aa, Entamoeba histolytica
LGSWEFKLKLGGTMEAIYRAFQDGSI

SEQ ID NO: 2685901 - protein, 18 aa, Entamoeba histolytica
LGTFLSHYHVGKLPRVFK

SEQ ID NO: 2685902 - protein, 23 aa, Entamoeba histolytica
LGTFRVIICTSVGGIKRYLQSVH

SEQ ID NO: 2685903 - protein, 20 aa, Entamoeba histolytica
LGTLPFKLFEKLSYRSLMLW

SEQ ID NO: 2685904 - protein, 23 aa, Entamoeba histolytica
LGTNKEKIVCMGVYSEGQYGIPK

SEQ ID NO: 2685905 - protein, 18 aa, Entamoeba histolytica
LGTTCCYVACIEDGNEPK

SEQ ID NO: 2685906 - protein, 23 aa, Entamoeba histolytica
LGTTFSCMAVWKESSKRVEIITN

SEQ ID NO: 2685907 - protein, 18 aa, Entamoeba histolytica
LGVCNLGVLFQKIIPSGT

SEQ ID NO: 2685908 - protein, 19 aa, Entamoeba histolytica
LGVCSCININGLRIVGVSG

SEQ ID NO: 2685909 - protein, 17 aa, Entamoeba histolytica
LGVCTYLLVSSLQTQLK

SEQ ID NO: 2685910 - protein, 18 aa, Entamoeba histolytica
LGVHCLSGIGRAPTLVAI

SEQ ID NO: 2685911 - protein, 26 aa, Entamoeba histolytica
LGVLGLKAMALILIRLITSNTQSNLV

SEQ ID NO: 2685912 - protein, 25 aa, Entamoeba histolytica
LGVNSRPTMGLGLGGQPGIGMQPAG

SEQ ID NO: 2685913 - protein, 21 aa, Entamoeba histolytica
LGVSLLRPVETVYRYLERKDL

SEQ ID NO: 2685914 - protein, 18 aa, Entamoeba histolytica
LGVTELYLNDFVIGGVLS

SEQ ID NO: 2685915 - protein, 18 aa, Entamoeba histolytica
LGVVEIIHKFVCYSFSLI

SEQ ID NO: 2685916 - protein, 17 aa, Entamoeba histolytica
LGVVVCNFLPPNNDTIS

SEQ ID NO: 2685917 - protein, 19 aa, Entamoeba histolytica
LGVVYDWVDIMLKELQSHQ

SEQ ID NO: 2685918 - protein, 25 aa, Entamoeba histolytica
LGYDGRFLARFGIINIIMRGKMIYK

SEQ ID NO: 2685919 - protein, 17 aa, Entamoeba histolytica
LHAFGLKPYMVSLFSFF

SEQ ID NO: 2685920 - protein, 17 aa, Entamoeba histolytica
LHAYGLFTPLNTEKEVI

SEQ ID NO: 2685921 - protein, 21 aa, Entamoeba histolytica
LHAYQSYVWNQVVSKRFEKYG

SEQ ID NO: 2685922 - protein, 19 aa, Entamoeba histolytica
LHCIFEVIVSSIECNNQEV

SEQ ID NO: 2685923 - protein, 28 aa, Entamoeba histolytica
LHDFKKKGHCNLLGNPVPFDPLKHKPDT

SEQ ID NO: 2685924 - protein, 33 aa, Entamoeba histolytica
LHDIAKYCNANAFFKYDCFEDKIMVSSALSTLY

SEQ ID NO: 2685925 - protein, 23 aa, Entamoeba histolytica
LHDSKRLIGETVKHYNEQKHLLP

SEQ ID NO: 2685926 - protein, 22 aa, Entamoeba histolytica
LHDSKRLIGETVKHYNEQKNLL

SEQ ID NO: 2685927 - protein, 17 aa, Entamoeba histolytica
LHDSLKYNFLVQQLNNP

SEQ ID NO: 2685928 - protein, 17 aa, Entamoeba histolytica
LHECTFASDLHENALKW

SEQ ID NO: 2685929 - protein, 18 aa, Entamoeba histolytica
LHEIPHGKFVPDVDLDND

SEQ ID NO: 2685930 - protein, 66 aa, Entamoeba histolytica
LHELDKCGFIGLYYNQLHQWTGLTAPRVIYSCSNFRRIEVLHLNNAICNKPNIMLIIVTKDGSIFG

SEQ ID NO: 2685931 - protein, 20 aa, Entamoeba histolytica
LHERMGIEGYNEFYCESNGN

SEQ ID NO: 2685932 - protein, 18 aa, Entamoeba histolytica
LHFHRIELKVAITNQPSL

SEQ ID NO: 2685933 - protein, 17 aa, Entamoeba histolytica
LHFKRYYHGKDIVIDVD

SEQ ID NO: 2685934 - protein, 17 aa, Entamoeba histolytica
LHFPDDFYHLPDCINVI

SEQ ID NO: 2685935 - protein, 22 aa, Entamoeba histolytica
LHFTLNCKLFLSKNGLEQKETI

SEQ ID NO: 2685936 - protein, 19 aa, Entamoeba histolytica
LHFTSRYLYLTLWGDEVGN

SEQ ID NO: 2685937 - protein, 32 aa, Entamoeba histolytica; identical to SEQ ID NO: 2493573

SEQ ID NO: 2685938 - protein, 20 aa, Entamoeba histolytica
LHGLQIEGAIMMMKEEVAAR

SEQ ID NO: 2685939 - protein, 29 aa, Entamoeba histolytica
LHGTGKICQCIKCGYQGNADVVLPKGLIP

SEQ ID NO: 2685940 - protein, 18 aa, Entamoeba histolytica
LHGVLKGHTKAVISAEFS

SEQ ID NO: 2685941 - protein, 21 aa, Entamoeba histolytica
LHHINRIFYTGGFVAHNPVVW

SEQ ID NO: 2685942 - protein, 20 aa, Entamoeba histolytica
LHHPFIVKLYYAFQTTDKLY

SEQ ID NO: 2685943 - protein, 19 aa, Entamoeba histolytica
LHHYFNTIGFFVLKSTLQA

SEQ ID NO: 2685944 - protein, 38 aa, Entamoeba histolytica
LHHYKPTPIYVMDEIDAALDFRNVSIIAHYIKERTKNA

SEQ ID NO: 2685945 - protein, 18 aa, Entamoeba histolytica
LHIDLGIVKMLTNERNGI

SEQ ID NO: 2685946 - protein, 22 aa, Entamoeba histolytica
LHIKNVWKYPYQININSTQLIT

SEQ ID NO: 2685947 - protein, 22 aa, Entamoeba histolytica
LHIPIGCLYSPLLPKPLVADRA

SEQ ID NO: 2685948 - protein, 17 aa, Entamoeba histolytica
LHKRLPPNFKEKKDFIE

SEQ ID NO: 2685949 - protein, 19 aa, Entamoeba histolytica
LHKSLCTKYKLPINKTRVL

SEQ ID NO: 2685950 - protein, 18 aa, Entamoeba histolytica
LHKTFKFNQLFYSDELRF

SEQ ID NO: 2685951 - protein, 17 aa, Entamoeba histolytica
LHLFNWSLYILLNKEPY

SEQ ID NO: 2685952 - protein, 18 aa, Entamoeba histolytica
LHLFYPVPISKVIHPSSN

SEQ ID NO: 2685953 - protein, 19 aa, Entamoeba histolytica
LHLKQCSTPSFGNLLIAET

SEQ ID NO: 2685954 - protein, 25 aa, Entamoeba histolytica
LHLLLDFLTEFGYFFEVNTTKGKKG

SEQ ID NO: 2685955 - protein, 25 aa, Entamoeba histolytica
LHLNVFPFKLLQGIASNNNSVTVIS

SEQ ID NO: 2685956 - protein, 22 aa, Entamoeba histolytica
LHLPDRWFISRKVVLQINNISI

SEQ ID NO: 2685957 - protein, 20 aa, Entamoeba histolytica
LHLPLMIKNLQLRWFNKCTS

SEQ ID NO: 2685958 - protein, 17 aa, Entamoeba histolytica
LHLRFNKNNSYYVDISQ

SEQ ID NO: 2685959 - protein, 22 aa, Entamoeba histolytica
LHLRVTTSFNFNFRKILPKAEV

SEQ ID NO: 2685960 - protein, 17 aa, Entamoeba histolytica
LHLSMNVLINYPPEDIK

SEQ ID NO: 2685961 - protein, 19 aa, Entamoeba histolytica
LHNAIPKAFLDCHLMIENP

SEQ ID NO: 2685962 - protein, 20 aa, Entamoeba histolytica
LHNIKFILSKVYYFQTQSKV

SEQ ID NO: 2685963 - protein, 17 aa, Entamoeba histolytica
LHPEATIHYVFVVTLIL

SEQ ID NO: 2685964 - protein, 17 aa, Entamoeba histolytica
LHPPLSFEPEIYSVNVK

SEQ ID NO: 2685965 - protein, 25 aa, Entamoeba histolytica
LHPTLPMKECHIAYVCKRVLQGLVY

SEQ ID NO: 2685966 - protein, 21 aa, Entamoeba histolytica
LHQLFPVILTLVVTKQIGTNS

SEQ ID NO: 2685967 - protein, 27 aa, Entamoeba histolytica
LHQMVLLCIKDIFAIYSLIIELANYHA

SEQ ID NO: 2685968 - protein, 22 aa, Entamoeba histolytica
LHQRPMEFFEIIYVTGTVLRGL

SEQ ID NO: 2685969 - protein, 18 aa, Entamoeba histolytica
LHRCKTNELYFCMHELDT

SEQ ID NO: 2685970 - protein, 19 aa, Entamoeba histolytica
LHREVPFNGISSFFQKDIL

SEQ ID NO: 2685971 - protein, 17 aa, Entamoeba histolytica
LHRISKHVGCCMSGIYA

SEQ ID NO: 2685972 - protein, 20 aa, Entamoeba histolytica
LHRQKYHLVDSIKTKSLDVT

SEQ ID NO: 2685973 - protein, 19 aa, Entamoeba histolytica
LHRRKRKFQNITYDRLLSE

SEQ ID NO: 2685974 - protein, 23 aa, Entamoeba histolytica
LHRVKRIVIDCIKEDTTGNTKNI

SEQ ID NO: 2685975 - protein, 24 aa, Entamoeba histolytica
LHSELGKFFCVHGGISPNLNSLQD

SEQ ID NO: 2685976 - protein, 18 aa, Entamoeba histolytica
LHSFKFKHNIVPVVKECT

SEQ ID NO: 2685977 - protein, 23 aa, Entamoeba histolytica
LHSIFIGHFVEFEYEKEVNLMEP

SEQ ID NO: 2685978 - protein, 24 aa, Entamoeba histolytica
LHSLILCIRGTFSVNDIVSDMILY

SEQ ID NO: 2685979 - protein, 32 aa, Entamoeba histolytica; identical to SEQ ID NO: 2493618

SEQ ID NO: 2685980 - protein, 20 aa, Entamoeba histolytica
LHSNFAFSGSLDGIIRMYDM

SEQ ID NO: 2685981 - protein, 28 aa, Entamoeba histolytica
LHSRIACLRLIIFLLRKDIKMFKFVYAK

SEQ ID NO: 2685982 - protein, 22 aa, Entamoeba histolytica
LHSSDPRRARAATAVVKKVREN

SEQ ID NO: 2685983 - protein, 19 aa, Entamoeba histolytica
LHSSIPIQFTSSFSSSDYS

SEQ ID NO: 2685984 - protein, 25 aa, Entamoeba histolytica
LHSTLSLKINTLWRNNSKYLEMVNT

SEQ ID NO: 2685985 - protein, 22 aa, Entamoeba histolytica
LHTETVPIITSNPFNQIQNPTL

SEQ ID NO: 2685986 - protein, 19 aa, Entamoeba histolytica
LHTSVFCVGRYCDWIHNYA

SEQ ID NO: 2685987 - protein, 17 aa, Entamoeba histolytica
LHVKRKHSIEVFKPGKF

SEQ ID NO: 2685988 - protein, 28 aa, Entamoeba histolytica
LHVTEVYKRATHIVCHNFGRTIKMLKGI

SEQ ID NO: 2685989 - protein, 18 aa, Entamoeba histolytica
LHYACVFKNIPVALFLYN

SEQ ID NO: 2685990 - protein, 17 aa, Entamoeba histolytica
LHYKLLIQTLLTLRHYN

SEQ ID NO: 2685991 - protein, 17 aa, Entamoeba histolytica
LIACGRTLIGKRPSRTQ

SEQ ID NO: 2685992 - protein, 18 aa, Entamoeba histolytica
LIALTQFNNMLIKIPKIR

SEQ ID NO: 2685993 - protein, 18 aa, Entamoeba histolytica
LIANKDLQMCISKDFVAL

SEQ ID NO: 2685994 - protein, 17 aa, Entamoeba histolytica
LIAQRALGFYIKYVEKG

SEQ ID NO: 2685995 - protein, 24 aa, Entamoeba histolytica
LIAREIPWGSTFVADGLSVESQSS

SEQ ID NO: 2685996 - protein, 24 aa, Entamoeba histolytica
LIASALAYISCYVFYSSDTTKHFE

SEQ ID NO: 2685997 - protein, 19 aa, Entamoeba histolytica
LIATKGRFEYDLGKDDIEW

SEQ ID NO: 2685998 - protein, 19 aa, Entamoeba histolytica
LICEGKAKVHAILTPELEE

SEQ ID NO: 2685999 - protein, 20 aa, Entamoeba histolytica
LICPQFCLRFNDLDNIGISG

SEQ ID NO: 2686000 - protein, 18 aa, Entamoeba histolytica
LICQRLASHQIRRLTYQL

SEQ ID NO: 2686001 - protein, 23 aa, Entamoeba histolytica
LICSKPNRNGCMVTYATAPLIKC

SEQ ID NO: 2686002 - protein, 21 aa, Entamoeba histolytica
LICTPCLLNTLSSNGFKISLN

SEQ ID NO: 2686003 - protein, 18 aa, Entamoeba histolytica
LIDDGFKKAISLCINDCY

SEQ ID NO: 2686004 - protein, 24 aa, Entamoeba histolytica
LIDEACIYIRETIMDDCEVKIKDL

SEQ ID NO: 2686005 - protein, 26 aa, Entamoeba histolytica
LIDFKSLYPSIIMEFGVCFLNSQLGG

SEQ ID NO: 2686006 - protein, 17 aa, Entamoeba histolytica
LIDGHLIATLRGHSKGV

SEQ ID NO: 2686007 - protein, 20 aa, Entamoeba histolytica
LIDGKLCFHTYPIVLSALCV

SEQ ID NO: 2686008 - protein, 22 aa, Entamoeba histolytica
LIDILNIYIIHFIRDNSEITAE

SEQ ID NO: 2686009 - protein, 18 aa, Entamoeba histolytica
LIDKIISIEEMVMKNKLF

SEQ ID NO: 2686010 - protein, 17 aa, Entamoeba histolytica
LIDKLLLYQAIKHVEIT

SEQ ID NO: 2686011 - protein, 17 aa, Entamoeba histolytica
LIDMKIPQARASIVWVI

SEQ ID NO: 2686012 - protein, 25 aa, Entamoeba histolytica
LIDPALLRGGRLGDWIYLGLPSDND

SEQ ID NO: 2686013 - protein, 17 aa, Entamoeba histolytica
LIDRFAGPTNNLQYAHI

SEQ ID NO: 2686014 - protein, 20 aa, Entamoeba histolytica
LIDRMSCIQSSCFYDSDNFE

SEQ ID NO: 2686015 - protein, 21 aa, Entamoeba histolytica
LIDSSGSWKKISCLVDGVLEV

SEQ ID NO: 2686016 - protein, 18 aa, Entamoeba histolytica
LIDSTLNKIFSWTESSIP

SEQ ID NO: 2686017 - protein, 20 aa, Entamoeba histolytica
LIEARCRIGITATPIREDCK

SEQ ID NO: 2686018 - protein, 23 aa, Entamoeba histolytica
LIECYPSRVGHGIFLNKKAIELM

SEQ ID NO: 2686019 - protein, 20 aa, Entamoeba histolytica
LIEFRMREVIRKLIVGKKFE

SEQ ID NO: 2686020 - protein, 23 aa, Entamoeba histolytica
LIEGCEKESAVALFHMADENEDG

SEQ ID NO: 2686021 - protein, 19 aa, Entamoeba histolytica
LIEGLAFSSFVIQYYGLIL

SEQ ID NO: 2686022 - protein, 18 aa, Entamoeba histolytica
LIEGLSMLVYSCSKSITK

SEQ ID NO: 2686023 - protein, 23 aa, Entamoeba histolytica
LIEGPFGFVPRKSIPEGKNWLSC

SEQ ID NO: 2686024 - protein, 18 aa, Entamoeba histolytica
LIEHVIRYSFKKDSIQSV

SEQ ID NO: 2686025 - protein, 24 aa, Entamoeba histolytica
LIEIADGCERCRQRIRQVQQPPLD

SEQ ID NO: 2686026 - protein, 19 aa, Entamoeba histolytica
LIEIFKTIGKFCVSQHDRV

SEQ ID NO: 2686027 - protein, 17 aa, Entamoeba histolytica
LIEIIGFTSANHFAVCK

SEQ ID NO: 2686028 - protein, 17 aa, Entamoeba histolytica
LIEKCWDQDQSKRPRFD

SEQ ID NO: 2686029 - protein, 17 aa, Entamoeba histolytica
LIEKDWLSFGHQFQTRS

SEQ ID NO: 2686030 - protein, 18 aa, Entamoeba histolytica
LIEKRCYENRPIGFEEVL

SEQ ID NO: 2686031 - protein, 18 aa, Entamoeba histolytica
LIEKVIKHSTGFLDEMNH

SEQ ID NO: 2686032 - protein, 17 aa, Entamoeba histolytica
LIELFRDLLAGKYPEVD

SEQ ID NO: 2686033 - protein, 23 aa, Entamoeba histolytica
LIELNRCRKLFGQIMIALEYVHD

SEQ ID NO: 2686034 - protein, 29 aa, Entamoeba histolytica
LIELPIQHFGRLGAFLFYLMSKTSEPSQI

SEQ ID NO: 2686035 - protein, 21 aa, Entamoeba histolytica
LIELPSSLCIRLMDENDKITN

SEQ ID NO: 2686036 - protein, 26 aa, Entamoeba histolytica
LIENKELYEILSLLEINNYFILPFNS

SEQ ID NO: 2686037 - protein, 26 aa, Entamoeba histolytica
LIENVKNMIYRAFISLPYKTFPKYQL

SEQ ID NO: 2686038 - protein, 19 aa, Entamoeba histolytica
LIERVKACKTIEEEKILIT

SEQ ID NO: 2686039 - protein, 30 aa, Entamoeba histolytica
LIEVPIKLVLRKDIDLAIRNKNSFIMESKQ

SEQ ID NO: 2686040 - protein, 17 aa, Entamoeba histolytica
LIEVPLDITLKEVSDIL

SEQ ID NO: 2686041 - protein, 18 aa, Entamoeba histolytica
LIEWKVDHDVVYFMDFIE

SEQ ID NO: 2686042 - protein, 23 aa, Entamoeba histolytica
LIFADKHGYKWSDVKDLLIQYSG

SEQ ID NO: 2686043 - protein, 18 aa, Entamoeba histolytica
LIFAKTIEDGYCIEIGKE

SEQ ID NO: 2686044 - protein, 18 aa, Entamoeba histolytica
LIFDSTCDKYETLMNTVS

SEQ ID NO: 2686045 - protein, 18 aa, Entamoeba histolytica
LIFERLQELFSISKNHQN

SEQ ID NO: 2686046 - protein, 19 aa, Entamoeba histolytica
LIFKEYRGKPELIDISSFK

SEQ ID NO: 2686047 - protein, 25 aa, Entamoeba histolytica
LIFKSKYFYLKRYEYLDQIYKSNKP

SEQ ID NO: 2686048 - protein, 17 aa, Entamoeba histolytica
LIFKTNINCIRRGERNE

SEQ ID NO: 2686049 - protein, 19 aa, Entamoeba histolytica
LIFQEGILVEAVRKGYWIV

SEQ ID NO: 2686050 - protein, 24 aa, Entamoeba histolytica
LIFSDLFKLGEWYTNPRIIMYGDV

SEQ ID NO: 2686051 - protein, 18 aa, Entamoeba histolytica
LIFVCKKGIYSIDKHQKK

SEQ ID NO: 2686052 - protein, 24 aa, Entamoeba histolytica
LIFYCNNCVFGSFHSVIPSSRGVW

SEQ ID NO: 2686053 - protein, 21 aa, Entamoeba histolytica
LIGCSRLILFDPDWNPAKDKQ

SEQ ID NO: 2686054 - protein, 24 aa, Entamoeba histolytica
LIGKGCSVGGYSIHLYDSNEKELS

SEQ ID NO: 2686055 - protein, 23 aa, Entamoeba histolytica
LIGLGCGCLCNLLLDSPLILKYS

SEQ ID NO: 2686056 - protein, 18 aa, Entamoeba histolytica
LIGLLLPFLSEQLKSTEW

SEQ ID NO: 2686057 - protein, 18 aa, Entamoeba histolytica
LIGNEFKFGFIPFDVVQP

SEQ ID NO: 2686058 - protein, 17 aa, Entamoeba histolytica
LIGSGYCKSAVIIGMDG

SEQ ID NO: 2686059 - protein, 27 aa, Entamoeba histolytica
LIHCNDFRLTPMWKYLTQLQIKEQFEQ

SEQ ID NO: 2686060 - protein, 19 aa, Entamoeba histolytica
LIHKACGWMLKEIGKKNKK

SEQ ID NO: 2686061 - protein, 19 aa, Entamoeba histolytica
LIHLCKRLESIDLLDAIEL

SEQ ID NO: 2686062 - protein, 24 aa, Entamoeba histolytica
LIHSNMALCWLKLENWNETKQQSE

SEQ ID NO: 2686063 - protein, 29 aa, Entamoeba histolytica
LIHYRSSDNFLIYDLVICTVRLAKNGHEI

SEQ ID NO: 2686064 - protein, 25 aa, Entamoeba histolytica
LIIEKGCSIQKLLARNNEISFIDSS

SEQ ID NO: 2686065 - protein, 19 aa, Entamoeba histolytica
LIIGIKYPTSFKITYHFRS

SEQ ID NO: 2686066 - protein, 20 aa, Entamoeba histolytica
LIIHICDYISFEMIDDMFLS

SEQ ID NO: 2686067 - protein, 25 aa, Entamoeba histolytica
LIIKKEFIKEFSLLNCPIKMNINGI

SEQ ID NO: 2686068 - protein, 20 aa, Entamoeba histolytica
LIILKDFYLQKLLDFNKDEL

SEQ ID NO: 2686069 - protein, 25 aa, Entamoeba histolytica
LIILKRIVENFPHFLDNVDMICSVG

SEQ ID NO: 2686070 - protein, 17 aa, Entamoeba histolytica
LIIPRNSIRGIKRMLYS

SEQ ID NO: 2686071 - protein, 18 aa, Entamoeba histolytica
LIIQIGCSILRKDQNNIN

SEQ ID NO: 2686072 - protein, 18 aa, Entamoeba histolytica
LIIQKVRMGCLAVVAQKS

SEQ ID NO: 2686073 - protein, 24 aa, Entamoeba histolytica
LIKDGGGFNPCIIFVPLRLGPESP

SEQ ID NO: 2686074 - protein, 24 aa, Entamoeba histolytica
LIKEEIRYLPEQPIIIPKAKTEIT

SEQ ID NO: 2686075 - protein, 17 aa, Entamoeba histolytica
LIKEFKEDCELNQIYTC

SEQ ID NO: 2686076 - protein, 17 aa, Entamoeba histolytica
LIKEFPIQTKVFISPVF

SEQ ID NO: 2686077 - protein, 18 aa, Entamoeba histolytica
LIKGKRRKSTVCIVMAEE

SEQ ID NO: 2686078 - protein, 26 aa, Entamoeba histolytica
LIKGTELFQGKGIPLGISKRIKEGID

SEQ ID NO: 2686079 - protein, 18 aa, Entamoeba histolytica
LIKIHGWSTTLVNEIVGM

SEQ ID NO: 2686080 - protein, 26 aa, Entamoeba histolytica
LIKIWEIFCKGCVNKEKIDRIKNEMK

SEQ ID NO: 2686081 - protein, 22 aa, Entamoeba histolytica
LIKKYVLACEFFREKLKEYSGT

SEQ ID NO: 2686082 - protein, 19 aa, Entamoeba histolytica
LIKLKTLFCNSVVNEGTLK

SEQ ID NO: 2686083 - protein, 18 aa, Entamoeba histolytica
LIKLPNCNSINVETITNK

SEQ ID NO: 2686084 - protein, 18 aa, Entamoeba histolytica
LIKLWNLIDGHLIATLRG

SEQ ID NO: 2686085 - protein, 20 aa, Entamoeba histolytica
LIKMEPNDHFGIIVNEMHNI

SEQ ID NO: 2686086 - protein, 25 aa, Entamoeba histolytica
LIKMKDLFFGCCIILKSKEILYTYT

SEQ ID NO: 2686087 - protein, 21 aa, Entamoeba histolytica
LIKMKEAYLKKNTQINSLINE

SEQ ID NO: 2686088 - protein, 21 aa, Entamoeba histolytica
LIKPRIDIVDLITYDIYNLIR

SEQ ID NO: 2686089 - protein, 23 aa, Entamoeba histolytica
LIKPSSDESIIFDMCDVLQEVNE

SEQ ID NO: 2686090 - protein, 20 aa, Entamoeba histolytica
LIKRLVDVKFEIYVIEEEQK

SEQ ID NO: 2686091 - protein, 24 aa, Entamoeba histolytica
LIKSGNCTAFIRGLPLKWGDIEFS

SEQ ID NO: 2686092 - protein, 21 aa, Entamoeba histolytica
LIKSILCCYDFHQPANGGLGT

SEQ ID NO: 2686093 - protein, 30 aa, Entamoeba histolytica
LIKSMKYLELFKIKKFNVFPRIINSQKQKE

SEQ ID NO: 2686094 - protein, 23 aa, Entamoeba histolytica
LIKTPEINGVTFFNDYQVHCLSF

SEQ ID NO: 2686095 - protein, 17 aa, Entamoeba histolytica
LILDFGSAISLKAIIEN

SEQ ID NO: 2686096 - protein, 17 aa, Entamoeba histolytica
LILDLSPQVNFIVGENG

SEQ ID NO: 2686097 - protein, 23 aa, Entamoeba histolytica
LILELPSKIKLPATIQLYCYLYK

SEQ ID NO: 2686098 - protein, 17 aa, Entamoeba histolytica
LILFDWRMTENINVNNI

SEQ ID NO: 2686099 - protein, 18 aa, Entamoeba histolytica
LILGLLYTLYRKYRLSVL

SEQ ID NO: 2686100 - protein, 17 aa, Entamoeba histolytica
LILHTDVIILPDNLCGV

SEQ ID NO: 2686101 - protein, 24 aa, Entamoeba histolytica
LILLKANIIASLLIELNSEAVGEC

SEQ ID NO: 2686102 - protein, 20 aa, Entamoeba histolytica
LILLNCLYDGHLHQFTKPFF

SEQ ID NO: 2686103 - protein, 17 aa, Entamoeba histolytica
LILLYKPLREWGKELYE

SEQ ID NO: 2686104 - protein, 22 aa, Entamoeba histolytica
LILNCIRKLLELGVPSPNDLFD

SEQ ID NO: 2686105 - protein, 18 aa, Entamoeba histolytica
LILNDMFKVLNISFYEEV

SEQ ID NO: 2686106 - protein, 23 aa, Entamoeba histolytica
LILNEQKRIFGMIYGNCSDKIGI

SEQ ID NO: 2686107 - protein, 19 aa, Entamoeba histolytica
LILNNFKFDDRSCVDLKDK

SEQ ID NO: 2686108 - protein, 17 aa, Entamoeba histolytica
LILRFAISELSAEGLSA

SEQ ID NO: 2686109 - protein, 18 aa, Entamoeba histolytica
LILSPPLSDRFTTFMELV

SEQ ID NO: 2686110 - protein, 18 aa, Entamoeba histolytica
LIMARRMALEGAKVLGVY

SEQ ID NO: 2686111 - protein, 17 aa, Entamoeba histolytica
LIMIMDIERSWKGLLEN

SEQ ID NO: 2686112 - protein, 21 aa, Entamoeba histolytica
LINCYLRMVIQPIEKLAEPET

SEQ ID NO: 2686113 - protein, 25 aa, Entamoeba histolytica
LINDFWKRLAGRQIDETWFIREVIL

SEQ ID NO: 2686114 - protein, 25 aa, Entamoeba histolytica
LINEFPKLQWFFLLNCTSPKQERLT

SEQ ID NO: 2686115 - protein, 24 aa, Entamoeba histolytica
LINERVPVIFAFAINGKRKEIFDN

SEQ ID NO: 2686116 - protein, 23 aa, Entamoeba histolytica
LINERYHLNLSYELLGYHKNLEQ

SEQ ID NO: 2686117 - protein, 18 aa, Entamoeba histolytica
LINFFSVRGCDLISINLN

SEQ ID NO: 2686118 - protein, 30 aa, Entamoeba histolytica; identical to SEQ ID NO: 2493759

SEQ ID NO: 2686119 - protein, 18 aa, Entamoeba histolytica
LINIVAIETFFRVKNTNE

SEQ ID NO: 2686120 - protein, 26 aa, Entamoeba histolytica
LINKICPRFDDLPFLQKVEVFEKVLA

SEQ ID NO: 2686121 - protein, 18 aa, Entamoeba histolytica
LINLTDWHDIHKKRESDT

SEQ ID NO: 2686122 - protein, 26 aa, Entamoeba histolytica
LINPPVLRIKVFEPLFIVGKESYAKL

SEQ ID NO: 2686123 - protein, 25 aa, Entamoeba histolytica
LINQYWKGCVIDIGSGKGYLMEELQ

SEQ ID NO: 2686124 - protein, 29 aa, Entamoeba histolytica
LINSLKLMFCRYLKLENPLVALINKTQNK

SEQ ID NO: 2686125 - protein, 23 aa, Entamoeba histolytica
LINSMCVVKSLSVTSCPNISNVA

SEQ ID NO: 2686126 - protein, 26 aa, Entamoeba histolytica
LINSNHLICLPSIIKNIHLIEIDISC

SEQ ID NO: 2686127 - protein, 18 aa, Entamoeba histolytica
LINTTMMIITFVNPYQQP

SEQ ID NO: 2686128 - protein, 18 aa, Entamoeba histolytica
LINVVAIETFFRVKNTNE

SEQ ID NO: 2686129 - protein, 19 aa, Entamoeba histolytica
LIPEFYYLPEFLINENHFN

SEQ ID NO: 2686130 - protein, 23 aa, Entamoeba histolytica
LIPEQFKLVLTKQVIEKMLYCCR

SEQ ID NO: 2686131 - protein, 17 aa, Entamoeba histolytica
LIPFSISSVHEFLSTTS

SEQ ID NO: 2686132 - protein, 24 aa, Entamoeba histolytica
LIPGAPSIFLYSNFMGGLSALIPL

SEQ ID NO: 2686133 - protein, 18 aa, Entamoeba histolytica
LIPGVLFIDEVHMLDAEC

SEQ ID NO: 2686134 - protein, 26 aa, Entamoeba histolytica
LIPKYKIVVERCILFDKAEQQMVKAA

SEQ ID NO: 2686135 - protein, 28 aa, Entamoeba histolytica
LIPLLLDIRLWRGIEYLFEYYIKQIILR

SEQ ID NO: 2686136 - protein, 18 aa, Entamoeba histolytica
LIPSEFDIFHFFKSDIEL

SEQ ID NO: 2686137 - protein, 17 aa, Entamoeba histolytica
LIPTSAIDSSKLLVCRL

SEQ ID NO: 2686138 - protein, 21 aa, Entamoeba histolytica
LIQCGVDWIYIKTLPNLYLNI

SEQ ID NO: 2686139 - protein, 19 aa, Entamoeba histolytica
LIQCLPPEHMTVFKETMKL

SEQ ID NO: 2686140 - protein, 25 aa, Entamoeba histolytica
LIQDSLRWNYSFSGIKFSENLRFTT

SEQ ID NO: 2686141 - protein, 25 aa, Entamoeba histolytica
LIQECFRNHPSFNAGFGRAFREIIN

SEQ ID NO: 2686142 - protein, 17 aa, Entamoeba histolytica
LIQENGKLQFQIDEIEE

SEQ ID NO: 2686143 - protein, 25 aa, Entamoeba histolytica
LIQFIPLFFERCLLTEELIYKINEE

SEQ ID NO: 2686144 - protein, 21 aa, Entamoeba histolytica
LIQKFDIGVAYQEYRSVAAEE

SEQ ID NO: 2686145 - protein, 20 aa, Entamoeba histolytica
LIQKILFPDFFTRRDKRTFN

SEQ ID NO: 2686146 - protein, 19 aa, Entamoeba histolytica
LIQNCWNDYYILNIPFTST

SEQ ID NO: 2686147 - protein, 19 aa, Entamoeba histolytica
LIQNIRFSFQVPYVSASID

SEQ ID NO: 2686148 - protein, 25 aa, Entamoeba histolytica
LIQPIQRLLRYVLLLKELIKATPEI

SEQ ID NO: 2686149 - protein, 21 aa, Entamoeba histolytica
LIQRRGCPYFISFENERTYSI

SEQ ID NO: 2686150 - protein, 22 aa, Entamoeba histolytica
LIQRVCKALALLQTIASHPKTQ

SEQ ID NO: 2686151 - protein, 17 aa, Entamoeba histolytica
LIQRYDLWDSRNTIFNV

SEQ ID NO: 2686152 - protein, 18 aa, Entamoeba histolytica
LIQSCTWDTLAAQVILEA

SEQ ID NO: 2686153 - protein, 18 aa, Entamoeba histolytica
LIQWEDPKMVLFSCLYNG

SEQ ID NO: 2686154 - protein, 18 aa, Entamoeba histolytica
LIQWSISTCFYKLDDERS

SEQ ID NO: 2686155 - protein, 18 aa, Entamoeba histolytica
LIQYVIMWVIQRVGSNIG

SEQ ID NO: 2686156 - protein, 17 aa, Entamoeba histolytica
LIRCEPYTTMFIKMNNG

SEQ ID NO: 2686157 - protein, 18 aa, Entamoeba histolytica
LIRCGCGKYFCNGTGNGK

SEQ ID NO: 2686158 - protein, 19 aa, Entamoeba histolytica
LIRELPFTLGSCTFKPIND

SEQ ID NO: 2686159 - protein, 19 aa, Entamoeba histolytica
LIRKETKVFLNTYVQRKKL

SEQ ID NO: 2686160 - protein, 23 aa, Entamoeba histolytica
LIRNLCKDYLLIVRKSIKDLVPK

SEQ ID NO: 2686161 - protein, 18 aa, Entamoeba histolytica
LIRYKCEDKSLLIPKGRY

SEQ ID NO: 2686162 - protein, 18 aa, Entamoeba histolytica
LISACGKVATTLIAGGIG

SEQ ID NO: 2686163 - protein, 26 aa, Entamoeba histolytica
LISDMIWLKKLRVVSIECVIDQPNLQ

SEQ ID NO: 2686164 - protein, 21 aa, Entamoeba histolytica
LISEYPFGTLFIKEKHLRLLW

SEQ ID NO: 2686165 - protein, 18 aa, Entamoeba histolytica
LISFCCSTLNKENVHHIY

SEQ ID NO: 2686166 - protein, 24 aa, Entamoeba histolytica
LISIGRNCFNCCKQLKEIHLDSAT

SEQ ID NO: 2686167 - protein, 19 aa, Entamoeba histolytica
LISIIVFRYDDKESFKNVV

SEQ ID NO: 2686168 - protein, 32 aa, Entamoeba histolytica
LISKFPRFLCHKSEILGVVLHKIFEFVNDPRL

SEQ ID NO: 2686169 - protein, 18 aa, Entamoeba histolytica
LISKKLEFYYAFVNTQEY

SEQ ID NO: 2686170 - protein, 24 aa, Entamoeba histolytica
LISKRFPQIKVDDFLREIKQQIKM

SEQ ID NO: 2686171 - protein, 18 aa, Entamoeba histolytica
LISLILMIDTFRIAEVKK

SEQ ID NO: 2686172 - protein, 25 aa, Entamoeba histolytica
LISLLDMFFEYGMSTKYLKYRPQNS

SEQ ID NO: 2686173 - protein, 24 aa, Entamoeba histolytica
LISLLNVRLPMYLPPLQQQPMIPQ

SEQ ID NO: 2686174 - protein, 17 aa, Entamoeba histolytica
LISLQGIANDIKTKILT

SEQ ID NO: 2686175 - protein, 17 aa, Entamoeba histolytica
LISMITLMWSWKSDDIE

SEQ ID NO: 2686176 - protein, 19 aa, Entamoeba histolytica
LISMLRPFLSKDILYEPIK

SEQ ID NO: 2686177 - protein, 27 aa, Entamoeba histolytica
LISNCQKFNCNFIKQFQCDINAIENFC

SEQ ID NO: 2686178 - protein, 26 aa, Entamoeba histolytica
LISRFTPPIFRCFDPNKLLPFTHFLE

SEQ ID NO: 2686179 - protein, 26 aa, Entamoeba histolytica
LISSGLKWVRFGAMCMAIANRRLNTF

SEQ ID NO: 2686180 - protein, 24 aa, Entamoeba histolytica
LISSLRAAFPTHRFVGEETDDTHK

SEQ ID NO: 2686181 - protein, 18 aa, Entamoeba histolytica
LISSSMDGKVLLWDFETG

SEQ ID NO: 2686182 - protein, 23 aa, Entamoeba histolytica
LISTLRLIRTFPFNSIVSDITSD

SEQ ID NO: 2686183 - protein, 17 aa, Entamoeba histolytica
LISTRTITENKRNTNQS

SEQ ID NO: 2686184 - protein, 31 aa, Entamoeba histolytica
LITDKYRLAYLIACLRTFLKESIQRKIIVFF

SEQ ID NO: 2686185 - protein, 26 aa, Entamoeba histolytica
LITFLKKLICLGENELLLISRFTPPI

SEQ ID NO: 2686186 - protein, 17 aa, Entamoeba histolytica
LITHCWNADQTLRPTMK

SEQ ID NO: 2686187 - protein, 17 aa, Entamoeba histolytica
LITKLCEGIHSSLKTIP

SEQ ID NO: 2686188 - protein, 17 aa, Entamoeba histolytica
LITKMKAYCNGFLPKKE

SEQ ID NO: 2686189 - protein, 17 aa, Entamoeba histolytica
LITKRASLFSVHNTIGI

SEQ ID NO: 2686190 - protein, 19 aa, Entamoeba histolytica
LITPDNCHLLLKTNDLQKF

SEQ ID NO: 2686191 - protein, 17 aa, Entamoeba histolytica
LITPPSYLLGKKLKSII

SEQ ID NO: 2686192 - protein, 25 aa, Entamoeba histolytica
LITPSNRIIVCLEQSTTEWANSVSR

SEQ ID NO: 2686193 - protein, 25 aa, Entamoeba histolytica
LITQICCADCEALLKDALINIKEDN

SEQ ID NO: 2686194 - protein, 19 aa, Entamoeba histolytica
LITSLKIGMKFHEATNDSE

SEQ ID NO: 2686195 - protein, 25 aa, Entamoeba histolytica
LITTLKIGCLFAFENNKFSVFTEQC

SEQ ID NO: 2686196 - protein, 18 aa, Entamoeba histolytica
LIVENGVSKVPHSLKDCI

SEQ ID NO: 2686197 - protein, 25 aa, Entamoeba histolytica
LIVHGCKRILFKFNKFDETVEEFLS

SEQ ID NO: 2686198 - protein, 26 aa, Entamoeba histolytica
LIVLKRPRSFKARPIITHSDGTRQTF

SEQ ID NO: 2686199 - protein, 17 aa, Entamoeba histolytica
LIVLLTFINSFGLILNQ

SEQ ID NO: 2686200 - protein, 34 aa, Entamoeba histolytica
LIVPSLFALTCWRRIVWHCVLPLALKERKYLTYE

SEQ ID NO: 2686201 - protein, 27 aa, Entamoeba histolytica
LIVSARIQLPLTHAWGLSIHKSQGLTL

SEQ ID NO: 2686202 - protein, 18 aa, Entamoeba histolytica
LIVSYVFEMVIKFEEYMK

SEQ ID NO: 2686203 - protein, 22 aa, Entamoeba histolytica
LIWMSIKRSFNFISSLIDGEPK

SEQ ID NO: 2686204 - protein, 17 aa, Entamoeba histolytica
LIYEMIVGIPPFYDDDV

SEQ ID NO: 2686205 - protein, 20 aa, Entamoeba histolytica
LIYEQVFPLFPRDAFTYYIN

SEQ ID NO: 2686206 - protein, 29 aa, Entamoeba histolytica
LIYGHVRWYENRNVLGIDIIEEYTGKSVC

SEQ ID NO: 2686207 - protein, 17 aa, Entamoeba histolytica
LIYHCLVSLFLQSKQSR

SEQ ID NO: 2686208 - protein, 18 aa, Entamoeba histolytica
LIYKLSVGIFEYCESLQY

SEQ ID NO: 2686209 - protein, 17 aa, Entamoeba histolytica
LIYLNFIAGRSYNDLTQ

SEQ ID NO: 2686210 - protein, 24 aa, Entamoeba histolytica
LIYLTGFVRLKIRVDDNTFTQVIP

SEQ ID NO: 2686211 - protein, 27 aa, Entamoeba histolytica
LIYPFEKIDILTILKCYSKIKYPRIFN

SEQ ID NO: 2686212 - protein, 18 aa, Entamoeba histolytica
LIYQSCSVSPYLSDEELT

SEQ ID NO: 2686213 - protein, 21 aa, Entamoeba histolytica
LKAAYATHVNLIIAINYQSKL

SEQ ID NO: 2686214 - protein, 20 aa, Entamoeba histolytica
LKADVIICSYQVISKEKSLL

SEQ ID NO: 2686215 - protein, 21 aa, Entamoeba histolytica
LKAEELLDMSFRRRDKMEFVI

SEQ ID NO: 2686216 - protein, 19 aa, Entamoeba histolytica
LKAGIPLEFYNEAHRITHF

SEQ ID NO: 2686217 - protein, 29 aa, Entamoeba histolytica
LKAGISFEMGNGWLKVFELLLEKMPIIRL

SEQ ID NO: 2686218 - protein, 22 aa, Entamoeba histolytica
LKAIFKKFGRNRISQDVEGKVL

SEQ ID NO: 2686219 - protein, 23 aa, Entamoeba histolytica
LKAIHCFPNDTSFIYDNQPITLK

SEQ ID NO: 2686220 - protein, 17 aa, Entamoeba histolytica
LKAITFLSNAVGFIETT

SEQ ID NO: 2686221 - protein, 21 aa, Entamoeba histolytica
LKAIYHRLFVFIVNKVNEVMG

SEQ ID NO: 2686222 - protein, 25 aa, Entamoeba histolytica
LKALKKCIICGKIGHTSKDCPQNEN

SEQ ID NO: 2686223 - protein, 17 aa, Entamoeba histolytica
LKALLIFDQSYYYLELL

SEQ ID NO: 2686224 - protein, 17 aa, Entamoeba histolytica
LKAPINIIGDLHGQFTD

SEQ ID NO: 2686225 - protein, 18 aa, Entamoeba histolytica
LKAPYVVTTRILPYPLNY

SEQ ID NO: 2686226 - protein, 17 aa, Entamoeba histolytica
LKASLIIGGSKLSDQFD

SEQ ID NO: 2686227 - protein, 36 aa, Entamoeba histolytica
LKASQLSCVYKVFHEEFSINLKDHITEIEKDRSQYE

SEQ ID NO: 2686228 - protein, 21 aa, Entamoeba histolytica
LKCAQIILRLLTKYISYIKKD

SEQ ID NO: 2686229 - protein, 17 aa, Entamoeba histolytica
LKCDELLLPKKLRIKKL

SEQ ID NO: 2686230 - protein, 22 aa, Entamoeba histolytica
LKCGCVISKLALDEIKSINGNK

SEQ ID NO: 2686231 - protein, 24 aa, Entamoeba histolytica
LKCGKISSIEFFTRTIFVFAKDLP

SEQ ID NO: 2686232 - protein, 21 aa, Entamoeba histolytica
LKCLFVSSRTGYGFDNLLFEI

SEQ ID NO: 2686233 - protein, 18 aa, Entamoeba histolytica
LKCMALEVAETCAVDDND

SEQ ID NO: 2686234 - protein, 19 aa, Entamoeba histolytica
LKCMKDILKDEGHDISISY

SEQ ID NO: 2686235 - protein, 21 aa, Entamoeba histolytica
LKDAGDVVCEGIDAMKQDLLD

SEQ ID NO: 2686236 - protein, 21 aa, Entamoeba histolytica
LKDAVSIFNGIEWIHKQFSVV

SEQ ID NO: 2686237 - protein, 17 aa, Entamoeba histolytica
LKDFKCVCCQKVVHSTC

SEQ ID NO: 2686238 - protein, 17 aa, Entamoeba histolytica
LKDGAIMATTLYGRLLE

SEQ ID NO: 2686239 - protein, 24 aa, Entamoeba histolytica
LKDIDFRSLVPIFKAVTQLKNLTS

SEQ ID NO: 2686240 - protein, 21 aa, Entamoeba histolytica
LKDKFPLYLHFNPEYSISLSP

SEQ ID NO: 2686241 - protein, 23 aa, Entamoeba histolytica
LKDKIYQIRGFDISNMTFVRGEK

SEQ ID NO: 2686242 - protein, 28 aa, Entamoeba histolytica
LKDNDFPYDWIASIPIPIQNDIENENLH

SEQ ID NO: 2686243 - protein, 23 aa, Entamoeba histolytica
LKDNFSKKLFVCISNSAEEGKSI

SEQ ID NO: 2686244 - protein, 19 aa, Entamoeba histolytica
LKDNLCSIYSLINDYDRSE

SEQ ID NO: 2686245 - protein, 17 aa, Entamoeba histolytica
LKDNMIISFSLHDNNCS

SEQ ID NO: 2686246 - protein, 19 aa, Entamoeba histolytica
LKDPSALVRRSAVIVLSEL

SEQ ID NO: 2686247 - protein, 20 aa, Entamoeba histolytica
LKDPSFEPLDPAAYLHTLHQ

SEQ ID NO: 2686248 - protein, 17 aa, Entamoeba histolytica
LKDSIELISPEPIDKIE

SEQ ID NO: 2686249 - protein, 28 aa, Entamoeba histolytica
LKDYCMLRNIEVPKYIPLPVANEEYDID

SEQ ID NO: 2686250 - protein, 23 aa, Entamoeba histolytica
LKEAKYRVTYKVSEHGDYTIHCL

SEQ ID NO: 2686251 - protein, 28 aa, Entamoeba histolytica
LKECGTWIQKFCMWIRGGVDGLTKFLDE

SEQ ID NO: 2686252 - protein, 17 aa, Entamoeba histolytica
LKECLTKLITDETQQQY

SEQ ID NO: 2686253 - protein, 23 aa, Entamoeba histolytica
LKECTFGGYPKGLVYAMLCAYAH

SEQ ID NO: 2686254 - protein, 18 aa, Entamoeba histolytica
LKEDSSWQVSMKNFAEII

SEQ ID NO: 2686255 - protein, 22 aa, Entamoeba histolytica
LKEDYINAGIHAMTFIDFVEQY

SEQ ID NO: 2686256 - protein, 24 aa, Entamoeba histolytica
LKEECPECEVMLIGSKSDLSYRRC

SEQ ID NO: 2686257 - protein, 24 aa, Entamoeba histolytica
LKEELKCSISPPILIDESQLNSKK

SEQ ID NO: 2686258 - protein, 19 aa, Entamoeba histolytica
LKEELSLFKQKCEQLEEEN

SEQ ID NO: 2686259 - protein, 28 aa, Entamoeba histolytica
LKEERAYTLKLCRAIQKSGCNVLLIQKS

SEQ ID NO: 2686260 - protein, 19 aa, Entamoeba histolytica
LKEERGFQIGIEQPFLQCS

SEQ ID NO: 2686261 - protein, 18 aa, Entamoeba histolytica
LKEEVFPTVKYNLLLKIL

SEQ ID NO: 2686262 - protein, 26 aa, Entamoeba histolytica
LKEFEYRSTQSFDILLKDALNYYYQD

SEQ ID NO: 2686263 - protein, 23 aa, Entamoeba histolytica
LKEFSQLRLCASDIIPKLNNETA

SEQ ID NO: 2686264 - protein, 19 aa, Entamoeba histolytica
LKEILKKKFLELVEGNHDF

SEQ ID NO: 2686265 - protein, 19 aa, Entamoeba histolytica
LKEINKLKANGEFEKRKEK

SEQ ID NO: 2686266 - protein, 20 aa, Entamoeba histolytica
LKEINRKEVLAMIEDEKKKI

SEQ ID NO: 2686267 - protein, 24 aa, Entamoeba histolytica
LKEKMKWEQIEGIIESLKENDPTS

SEQ ID NO: 2686268 - protein, 22 aa, Entamoeba histolytica
LKEKREIIWMNQIVPKKEIKTT

SEQ ID NO: 2686269 - protein, 18 aa, Entamoeba histolytica
LKEKREWDEFKDAHPRGS

SEQ ID NO: 2686270 - protein, 17 aa, Entamoeba histolytica
LKEKVGMFSPHKTEINK

SEQ ID NO: 2686271 - protein, 20 aa, Entamoeba histolytica
LKEKYGIQVFGKWPNDGYVN

SEQ ID NO: 2686272 - protein, 18 aa, Entamoeba histolytica
LKEKYQRLKEQKEEEEKS

SEQ ID NO: 2686273 - protein, 21 aa, Entamoeba histolytica
LKELFFVLFVKRKKYYLNKID

SEQ ID NO: 2686274 - protein, 25 aa, Entamoeba histolytica
LKELKELMKIIGMSIVMERNRDLMK

SEQ ID NO: 2686275 - protein, 21 aa, Entamoeba histolytica
LKELRCYWVPFHPINKKIVGE

SEQ ID NO: 2686276 - protein, 17 aa, Entamoeba histolytica
LKEMIKEKEELMKKQKT

SEQ ID NO: 2686277 - protein, 20 aa, Entamoeba histolytica
LKEMIWEQLNLVRVYTKAPG

SEQ ID NO: 2686278 - protein, 17 aa, Entamoeba histolytica
LKEMYIPKINVINLQEI

SEQ ID NO: 2686279 - protein, 19 aa, Entamoeba histolytica
LKENITWNINKKEGESEVN

SEQ ID NO: 2686280 - protein, 27 aa, Entamoeba histolytica
LKESCDIKVPIVHRQGFVFVYCVIIYY

SEQ ID NO: 2686281 - protein, 17 aa, Entamoeba histolytica
LKESIGSLTAFVVSKIL

SEQ ID NO: 2686282 - protein, 25 aa, Entamoeba histolytica
LKESLNALCKIVGLFNQTKKETEEA

SEQ ID NO: 2686283 - protein, 19 aa, Entamoeba histolytica
LKESVCFTTLDTYFETFEE

SEQ ID NO: 2686284 - protein, 20 aa, Entamoeba histolytica
LKEVFKYNDLINFNKIDQNH

SEQ ID NO: 2686285 - protein, 25 aa, Entamoeba histolytica
LKEVIDNICSLIWQYKDSINVTFID

SEQ ID NO: 2686286 - protein, 18 aa, Entamoeba histolytica
LKEVIPLLKTLGEGQQGE

SEQ ID NO: 2686287 - protein, 21 aa, Entamoeba histolytica
LKEVIRRQHEVLLKLKKEREI

SEQ ID NO: 2686288 - protein, 17 aa, Entamoeba histolytica
LKEVKKFDSKFNYKELF

SEQ ID NO: 2686289 - protein, 28 aa, Entamoeba histolytica
LKEVKKFDSKFNYKELFTDVKNRKREVD

SEQ ID NO: 2686290 - protein, 30 aa, Entamoeba histolytica
LKEVKKIDSKFNYKELFGDVKNRKHEVDEL

SEQ ID NO: 2686291 - protein, 17 aa, Entamoeba histolytica
LKEWCFEECTSLTRIDI

SEQ ID NO: 2686292 - protein, 18 aa, Entamoeba histolytica
LKEWCFEECTSLTSINIP

SEQ ID NO: 2686293 - protein, 20 aa, Entamoeba histolytica
LKEYFPYKIEIQGNNFIAHV

SEQ ID NO: 2686294 - protein, 21 aa, Entamoeba histolytica
LKEYIKLYFFDGEKYRNDLLP

SEQ ID NO: 2686295 - protein, 17 aa, Entamoeba histolytica
LKEYKGFSVPDIQQSTP

SEQ ID NO: 2686296 - protein, 24 aa, Entamoeba histolytica
LKEYRIVDITSDFQFFERYISGNP

SEQ ID NO: 2686297 - protein, 18 aa, Entamoeba histolytica
LKFGLDFKFVTVIIDRVF

SEQ ID NO: 2686298 - protein, 25 aa, Entamoeba histolytica
LKFKFSKRSNHFIAFADFDSHENAV

SEQ ID NO: 2686299 - protein, 19 aa, Entamoeba histolytica
LKFPCPLHVLIDGPVEQSE

SEQ ID NO: 2686300 - protein, 28 aa, Entamoeba histolytica
LKFRADIEVSCFAIGGVESVKRALLKGV

SEQ ID NO: 2686301 - protein, 17 aa, Entamoeba histolytica
LKFVQGCQYHGIVPYFF

SEQ ID NO: 2686302 - protein, 18 aa, Entamoeba histolytica
LKGAGIGLIPGYGQYQIV

SEQ ID NO: 2686303 - protein, 17 aa, Entamoeba histolytica
LKGDEFAGFTFQDDAAL

SEQ ID NO: 2686304 - protein, 25 aa, Entamoeba histolytica
LKGESVVGLLSGHRSFGEIFDVMDI

SEQ ID NO: 2686305 - protein, 21 aa, Entamoeba histolytica
LKGIYKIAALLPSLKNSHVVI

SEQ ID NO: 2686306 - protein, 17 aa, Entamoeba histolytica
LKGKIKCYFKGGVPKNL

SEQ ID NO: 2686307 - protein, 20 aa, Entamoeba histolytica
LKGKQTQFWCVVTDKDNNQI

SEQ ID NO: 2686308 - protein, 23 aa, Entamoeba histolytica
LKGLTDYYLLSGINVPETLRDIY

SEQ ID NO: 2686309 - protein, 18 aa, Entamoeba histolytica
LKGNLGINALKKSYLIEA

SEQ ID NO: 2686310 - protein, 22 aa, Entamoeba histolytica
LKGQVLRFLNRETIVILDSLNY

SEQ ID NO: 2686311 - protein, 22 aa, Entamoeba histolytica
LKGWELRLWFGDVTESGYSNIQ

SEQ ID NO: 2686312 - protein, 19 aa, Entamoeba histolytica
LKGYFGISVLNVANENGVI

SEQ ID NO: 2686313 - protein, 17 aa, Entamoeba histolytica
LKHDVNFTKQVTGDDAN

SEQ ID NO: 2686314 - protein, 17 aa, Entamoeba histolytica
LKHGKKLLIQKRTKGQS

SEQ ID NO: 2686315 - protein, 25 aa, Entamoeba histolytica
LKHGLNWMNQWACSRNFGLGTLIPW

SEQ ID NO: 2686316 - protein, 19 aa, Entamoeba histolytica
LKHGMCKITNPEQDYTNAH

SEQ ID NO: 2686317 - protein, 18 aa, Entamoeba histolytica
LKHIKPIVEFGRIEPNPS

SEQ ID NO: 2686318 - protein, 21 aa, Entamoeba histolytica
LKHILLFECDSVYLSNELQRR

SEQ ID NO: 2686319 - protein, 25 aa, Entamoeba histolytica
LKHKASDLNLDWLTERIILSYLEYF

SEQ ID NO: 2686320 - protein, 21 aa, Entamoeba histolytica
LKHKRIGEVCYKILDRLKTNS

SEQ ID NO: 2686321 - protein, 21 aa, Entamoeba histolytica
LKHLDFDCSVFDTFDVNAISF

SEQ ID NO: 2686322 - protein, 18 aa, Entamoeba histolytica
LKHYRIVIQLNPNSYKGW

SEQ ID NO: 2686323 - protein, 18 aa, Entamoeba histolytica
LKIAEMKDETGLKDIDDF

SEQ ID NO: 2686324 - protein, 22 aa, Entamoeba histolytica
LKICRDKRNGIIFLEPPQKGTV

SEQ ID NO: 2686325 - protein, 25 aa, Entamoeba histolytica
LKIDKYHIPHLFPIPYLSDESYSIA

SEQ ID NO: 2686326 - protein, 20 aa, Entamoeba histolytica
LKIELLKGYFSPDRIEEEMP

SEQ ID NO: 2686327 - protein, 20 aa, Entamoeba histolytica
LKIFSYLRIDAIRNVQLLCK

SEQ ID NO: 2686328 - protein, 20 aa, Entamoeba histolytica
LKIGETLVKLQIWDTAGQER

SEQ ID NO: 2686329 - protein, 18 aa, Entamoeba histolytica
LKIGMKFHEATNDSEIKE

SEQ ID NO: 2686330 - protein, 20 aa, Entamoeba histolytica
LKIIHNMYIRGYKAKEIAII

SEQ ID NO: 2686331 - protein, 26 aa, Entamoeba histolytica
LKIIIEFDFGKKLALLSGKKDESHEL

SEQ ID NO: 2686332 - protein, 17 aa, Entamoeba histolytica
LKIIKIETFVALNDSTN

SEQ ID NO: 2686333 - protein, 19 aa, Entamoeba histolytica
LKIITGRELIEYIKEKKDK

SEQ ID NO: 2686334 - protein, 21 aa, Entamoeba histolytica
LKIKELVRGCVGIKRKPNEPI

SEQ ID NO: 2686335 - protein, 19 aa, Entamoeba histolytica
LKIKIHSYHSFFGSIKHLI

SEQ ID NO: 2686336 - protein, 17 aa, Entamoeba histolytica
LKIKLNGLSSVYPQSED

SEQ ID NO: 2686337 - protein, 22 aa, Entamoeba histolytica
LKILEYPAYISTLHFPYYYVTP

SEQ ID NO: 2686338 - protein, 23 aa, Entamoeba histolytica
LKILKEYYLEKILEEREDKTIRN

SEQ ID NO: 2686339 - protein, 26 aa, Entamoeba histolytica
LKILRIYKCPLISFEGIENIHMSTLE

SEQ ID NO: 2686340 - protein, 17 aa, Entamoeba histolytica
LKINAEDGIAWMNLGEC

SEQ ID NO: 2686341 - protein, 20 aa, Entamoeba histolytica
LKINLNQNVPNSFQILAKKS

SEQ ID NO: 2686342 - protein, 21 aa, Entamoeba histolytica
LKIPNGFTIPSLVPGETITSV

SEQ ID NO: 2686343 - protein, 20 aa, Entamoeba histolytica
LKIRKSIHLFLLKKMGKCQD

SEQ ID NO: 2686344 - protein, 24 aa, Entamoeba histolytica
LKISCPSVKMIVPYVSKKRLKKYY

SEQ ID NO: 2686345 - protein, 28 aa, Entamoeba histolytica
LKISLIQIFRAHLWQKIHESIVMDLCQV

SEQ ID NO: 2686346 - protein, 17 aa, Entamoeba histolytica
LKISSSISVLNQTNEKV

SEQ ID NO: 2686347 - protein, 18 aa, Entamoeba histolytica
LKITCLESVYTNVYPTVI

SEQ ID NO: 2686348 - protein, 20 aa, Entamoeba histolytica
LKITPFDLVNKIVMKIITMI

SEQ ID NO: 2686349 - protein, 27 aa, Entamoeba histolytica
LKIVGKIPGAAAWKVNKKVLEFYKEID

SEQ ID NO: 2686350 - protein, 21 aa, Entamoeba histolytica
LKIYFKYCLLTKNINNQKRNK

SEQ ID NO: 2686351 - protein, 19 aa, Entamoeba histolytica
LKKACEALLLLGMFHGNKI

SEQ ID NO: 2686352 - protein, 22 aa, Entamoeba histolytica
LKKASSFAGCIDKIPADIAKQF

SEQ ID NO: 2686353 - protein, 17 aa, Entamoeba histolytica
LKKELIINGVYIRLFNE

SEQ ID NO: 2686354 - protein, 18 aa, Entamoeba histolytica
LKKELIINGVYIRLFNEQ

SEQ ID NO: 2686355 - protein, 18 aa, Entamoeba histolytica
LKKFFGRDTLVVGIEANT

SEQ ID NO: 2686356 - protein, 25 aa, Entamoeba histolytica
LKKFLKTFIESCSDWGTGNDVDITP

SEQ ID NO: 2686357 - protein, 23 aa, Entamoeba histolytica
LKKFPYEPLFNFVLPTERPYRRV

SEQ ID NO: 2686358 - protein, 33 aa, Entamoeba histolytica
LKKGDTVRFKNEFILGTNGIKVGEKENKTIRIL

SEQ ID NO: 2686359 - protein, 17 aa, Entamoeba histolytica
LKKGGVPVLTFKQVYEY

SEQ ID NO: 2686360 - protein, 26 aa, Entamoeba histolytica
LKKGYRVPTPIQRKAIPAILRGNDII

SEQ ID NO: 2686361 - protein, 18 aa, Entamoeba histolytica
LKKIIKIYLKDNKQKELI

SEQ ID NO: 2686362 - protein, 26 aa, Entamoeba histolytica
LKKIPREHLLSLSILYGLVNRLVKYS

SEQ ID NO: 2686363 - protein, 20 aa, Entamoeba histolytica
LKKKCDEFETIGATGRCNEV

SEQ ID NO: 2686364 - protein, 17 aa, Entamoeba histolytica
LKKKCLEISNIQEEKEE

SEQ ID NO: 2686365 - protein, 22 aa, Entamoeba histolytica
LKKKDIRLFARAVIPDRDLVAS

SEQ ID NO: 2686366 - protein, 21 aa, Entamoeba histolytica
LKKKIARAWKSNDVVGCGYDA

SEQ ID NO: 2686367 - protein, 18 aa, Entamoeba histolytica
LKKKIFDNSVIWSIGVIF

SEQ ID NO: 2686368 - protein, 26 aa, Entamoeba histolytica
LKKKKRLSGLSSLFVKRKPDRSVTPP

SEQ ID NO: 2686369 - protein, 24 aa, Entamoeba histolytica
LKKKREERAKRDADFAKLTGSDVD

SEQ ID NO: 2686370 - protein, 18 aa, Entamoeba histolytica
LKKLCNHPILINELMNSE

SEQ ID NO: 2686371 - protein, 21 aa, Entamoeba histolytica
LKKLFPTKVIHFIEIDIQKEI

SEQ ID NO: 2686372 - protein, 26 aa, Entamoeba histolytica
LKKLKELLVYFVESWMNYKNFSPLVI

SEQ ID NO: 2686373 - protein, 21 aa, Entamoeba histolytica
LKKLLEGCLSYLKKNKLFASF

SEQ ID NO: 2686374 - protein, 18 aa, Entamoeba histolytica
LKKLMVVVFPIYYEPFGC

SEQ ID NO: 2686375 - protein, 25 aa, Entamoeba histolytica
LKKLRLERLKDILLIQRDFIENQEQ

SEQ ID NO: 2686376 - protein, 20 aa, Entamoeba histolytica
LKKNCFCVYCDKKFSKETVL

SEQ ID NO: 2686377 - protein, 18 aa, Entamoeba histolytica
LKKNECQIEEIFEDPHYL

SEQ ID NO: 2686378 - protein, 21 aa, Entamoeba histolytica
LKKNFNLSVKIPKEIISPRKK

SEQ ID NO: 2686379 - protein, 19 aa, Entamoeba histolytica
LKKNLRSIDYKYCLFEESR

SEQ ID NO: 2686380 - protein, 31 aa, Entamoeba histolytica; identical to SEQ ID NO: 2494064

SEQ ID NO: 2686381 - protein, 20 aa, Entamoeba histolytica
LKKRILPFHADTCIGDLLSL

SEQ ID NO: 2686382 - protein, 17 aa, Entamoeba histolytica
LKKRKKIIVPISLKEYY

SEQ ID NO: 2686383 - protein, 21 aa, Entamoeba histolytica
LKKRLNEIIREIQFKQQNVIN

SEQ ID NO: 2686384 - protein, 20 aa, Entamoeba histolytica
LKKRNVKVVPIALQDGVGED

SEQ ID NO: 2686385 - protein, 21 aa, Entamoeba histolytica
LKKRVTVSCNVTFDMFDDSKA

SEQ ID NO: 2686386 - protein, 20 aa, Entamoeba histolytica
LKKSELFGSTSANVIASLNI

SEQ ID NO: 2686387 - protein, 21 aa, Entamoeba histolytica
LKKSQRCTVCGMQSSSSLCQA

SEQ ID NO: 2686388 - protein, 18 aa, Entamoeba histolytica
LKKSSGWTTRSGRMRKSE

SEQ ID NO: 2686389 - protein, 21 aa, Entamoeba histolytica
LKKYLELFGCFYCEEKDRIKR

SEQ ID NO: 2686390 - protein, 32 aa, Entamoeba histolytica
LKKYMKCLDPLLEFCRLLTMPMSLEIVQMKDE

SEQ ID NO: 2686391 - protein, 24 aa, Entamoeba histolytica
LKLCDGFFLAMLHYIRNDIVEHDD

SEQ ID NO: 2686392 - protein, 19 aa, Entamoeba histolytica
LKLDKVLCKFISPTTLTKL

SEQ ID NO: 2686393 - protein, 18 aa, Entamoeba histolytica
LKLDVDIENIRPGVELIQ

SEQ ID NO: 2686394 - protein, 22 aa, Entamoeba histolytica
LKLFDWNLCHFIQRERTNIRVI

SEQ ID NO: 2686395 - protein, 18 aa, Entamoeba histolytica
LKLFSGIKVIRTDISNAL

SEQ ID NO: 2686396 - protein, 17 aa, Entamoeba histolytica
LKLGNIFQLSKLNLIDI

SEQ ID NO: 2686397 - protein, 19 aa, Entamoeba histolytica
LKLGSGYDHSFIINENAPH

SEQ ID NO: 2686398 - protein, 18 aa, Entamoeba histolytica
LKLHGRWINEGPLLYHYK

SEQ ID NO: 2686399 - protein, 20 aa, Entamoeba histolytica
LKLIDLGSSCFENYTLYSYI

SEQ ID NO: 2686400 - protein, 18 aa, Entamoeba histolytica
LKLIDNGKLLDVMKQKDI

SEQ ID NO: 2686401 - protein, 19 aa, Entamoeba histolytica
LKLIKQISMARDFRYNYAP

SEQ ID NO: 2686402 - protein, 19 aa, Entamoeba histolytica
LKLILKQSKLFDPTVMGKA

SEQ ID NO: 2686403 - protein, 23 aa, Entamoeba histolytica
LKLKELEGIPLLIYINKDDLLQD

SEQ ID NO: 2686404 - protein, 19 aa, Entamoeba histolytica
LKLKKYRIIVLETTHDYSI

SEQ ID NO: 2686405 - protein, 20 aa, Entamoeba histolytica
LKLKNFPYIFSISTPSRVYN

SEQ ID NO: 2686406 - protein, 27 aa, Entamoeba histolytica
LKLKNYKYLFEWYWKGIWNEEKEQTLQ

SEQ ID NO: 2686407 - protein, 19 aa, Entamoeba histolytica
LKLKRPEISLKYLTIIQNM

SEQ ID NO: 2686408 - protein, 17 aa, Entamoeba histolytica
LKLLCNVVYGYTGAGLS

SEQ ID NO: 2686409 - protein, 23 aa, Entamoeba histolytica
LKLLKINPLERITCEEALKLDLF

SEQ ID NO: 2686410 - protein, 18 aa, Entamoeba histolytica
LKLLLQNIIKNTSVAPII

SEQ ID NO: 2686411 - protein, 20 aa, Entamoeba histolytica
LKLLPRLQLLSVNCEQSTAI

SEQ ID NO: 2686412 - protein, 18 aa, Entamoeba histolytica
LKLLRLLIRNEGNLQKFC

SEQ ID NO: 2686413 - protein, 24 aa, Entamoeba histolytica
LKLLRREIDVMRKLSNHPNVVKLY

SEQ ID NO: 2686414 - protein, 20 aa, Entamoeba histolytica
LKLLRSICMKCHSLKASKQV

SEQ ID NO: 2686415 - protein, 24 aa, Entamoeba histolytica
LKLMKCSFPNLPADEEDLCLKLLK

SEQ ID NO: 2686416 - protein, 20 aa, Entamoeba histolytica
LKLNFLNEVTEYLKVNEPKK

SEQ ID NO: 2686417 - protein, 30 aa, Entamoeba histolytica
LKLNRRDAIQIIPWKNITSITISTTSKEEY

SEQ ID NO: 2686418 - protein, 20 aa, Entamoeba histolytica
LKLPDSFKYFMTTIGSHITE

SEQ ID NO: 2686419 - protein, 23 aa, Entamoeba histolytica
LKLPELTRRIMIDLVPPISTHFH

SEQ ID NO: 2686420 - protein, 18 aa, Entamoeba histolytica
LKLPLTLERIELTNCKSL

SEQ ID NO: 2686421 - protein, 17 aa, Entamoeba histolytica
LKLQSIVSYNHLGNNDG

SEQ ID NO: 2686422 - protein, 27 aa, Entamoeba histolytica
LKLSDPLLRLDALVSIAKNRQWNGEIN

SEQ ID NO: 2686423 - protein, 25 aa, Entamoeba histolytica
LKLSDYDSLCNLPFNLNLFKHIESF

SEQ ID NO: 2686424 - protein, 17 aa, Entamoeba histolytica
LKLSRIVFYIYQPQAQT

SEQ ID NO: 2686425 - protein, 18 aa, Entamoeba histolytica
LKLSYLIDLLKGIVDEED

SEQ ID NO: 2686426 - protein, 25 aa, Entamoeba histolytica
LKLTFFSPLILCCIPTSVKRIYLQK

SEQ ID NO: 2686427 - protein, 21 aa, Entamoeba histolytica
LKLTFFSPLILCYIPTSVKRI

SEQ ID NO: 2686428 - protein, 19 aa, Entamoeba histolytica
LKLYFRCFKTNKKGEITTE

SEQ ID NO: 2686429 - protein, 20 aa, Entamoeba histolytica
LKLYKRKGLYQLTEMKECDK

SEQ ID NO: 2686430 - protein, 26 aa, Entamoeba histolytica
LKMACSQFVAFCRPKAITSIAEVIVY

SEQ ID NO: 2686431 - protein, 17 aa, Entamoeba histolytica
LKMFFKFFSGSNRMIDL

SEQ ID NO: 2686432 - protein, 23 aa, Entamoeba histolytica
LKMGKGKIAAQCGHAVVECVLKS

SEQ ID NO: 2686433 - protein, 17 aa, Entamoeba histolytica
LKMGRTVKELDEIAKGN

SEQ ID NO: 2686434 - protein, 19 aa, Entamoeba histolytica
LKMILEIAKGLKYLHELKI

SEQ ID NO: 2686435 - protein, 19 aa, Entamoeba histolytica
LKMIMGILKKYEEILAQIV

SEQ ID NO: 2686436 - protein, 25 aa, Entamoeba histolytica
LKMKDCGDVNAIGRIHNFLEKAGWI

SEQ ID NO: 2686437 - protein, 17 aa, Entamoeba histolytica
LKMKFETLFDFSEQIAK

SEQ ID NO: 2686438 - protein, 18 aa, Entamoeba histolytica
LKMKVYYFYAHFLETVNQ

SEQ ID NO: 2686439 - protein, 29 aa, Entamoeba histolytica
LKMVEWLRMKSRILFSFMSLGYFQEMDMM

SEQ ID NO: 2686440 - protein, 19 aa, Entamoeba histolytica
LKMVHSFIYYYPYQFGFNS

SEQ ID NO: 2686441 - protein, 27 aa, Entamoeba histolytica
LKNCKAICCSHGPIIRGYIPERVELWR

SEQ ID NO: 2686442 - protein, 23 aa, Entamoeba histolytica
LKNCLLLNEALNFREVIEDALTI

SEQ ID NO: 2686443 - protein, 19 aa, Entamoeba histolytica
LKNELGDPFYFISDALRFA

SEQ ID NO: 2686444 - protein, 23 aa, Entamoeba histolytica
LKNELKIKILMKGEDELINSLPK

SEQ ID NO: 2686445 - protein, 27 aa, Entamoeba histolytica
LKNETVWRLIFNFLARNGCFMKYVNTT

SEQ ID NO: 2686446 - protein, 18 aa, Entamoeba histolytica
LKNFAMILGPLVIHPLPG

SEQ ID NO: 2686447 - protein, 19 aa, Entamoeba histolytica
LKNFCIYAKSNSKIIEENS

SEQ ID NO: 2686448 - protein, 17 aa, Entamoeba histolytica
LKNGKLCYLSVEQEVID

SEQ ID NO: 2686449 - protein, 18 aa, Entamoeba histolytica
LKNGKSFVIDASDIVRKY

SEQ ID NO: 2686450 - protein, 17 aa, Entamoeba histolytica
LKNGMGGAGGFPGGGFS

SEQ ID NO: 2686451 - protein, 18 aa, Entamoeba histolytica
LKNHCEINEDIKFAINNY

SEQ ID NO: 2686452 - protein, 21 aa, Entamoeba histolytica
LKNICLQSASAPGYFDPLNNH

SEQ ID NO: 2686453 - protein, 19 aa, Entamoeba histolytica
LKNICYCDHFVKQVIVVNH

SEQ ID NO: 2686454 - protein, 23 aa, Entamoeba histolytica
LKNIKGTYWGLGDLLYHPFFDSL

SEQ ID NO: 2686455 - protein, 17 aa, Entamoeba histolytica
LKNILAQEPSLSNFNNY

SEQ ID NO: 2686456 - protein, 18 aa, Entamoeba histolytica
LKNKASYMRQAMLEIAVL

SEQ ID NO: 2686457 - protein, 21 aa, Entamoeba histolytica
LKNKELHIVLSSRIIPELINN

SEQ ID NO: 2686458 - protein, 23 aa, Entamoeba histolytica
LKNKPCYFRQGMLEIAMLHAANL

SEQ ID NO: 2686459 - protein, 20 aa, Entamoeba histolytica
LKNKPFFFIYGNRDISLKVG

SEQ ID NO: 2686460 - protein, 18 aa, Entamoeba histolytica
LKNKYPYPIQRAIIKTSS

SEQ ID NO: 2686461 - protein, 17 aa, Entamoeba histolytica
LKNLIIHIISFVDDPND

SEQ ID NO: 2686462 - protein, 17 aa, Entamoeba histolytica
LKNLISFANKNSQFYIS

SEQ ID NO: 2686463 - protein, 22 aa, Entamoeba histolytica
LKNLKTVYVLFQFGCPETVIYD

SEQ ID NO: 2686464 - protein, 19 aa, Entamoeba histolytica
LKNLVDRRCVKVDKNERGK

SEQ ID NO: 2686465 - protein, 18 aa, Entamoeba histolytica
LKNMMKMMRNPQLMNQAL

SEQ ID NO: 2686466 - protein, 20 aa, Entamoeba histolytica
LKNRLPRSLTTLNWEDSCVT

SEQ ID NO: 2686467 - protein, 17 aa, Entamoeba histolytica
LKNSGYLDIVFANQNDE

SEQ ID NO: 2686468 - protein, 26 aa, Entamoeba histolytica
LKNSHIINLGLDFKRILCDKKIKLPL

SEQ ID NO: 2686469 - protein, 17 aa, Entamoeba histolytica
LKNSIEFISVFEEAVDS

SEQ ID NO: 2686470 - protein, 18 aa, Entamoeba histolytica
LKNVIIKKEIVPFRKHNG

SEQ ID NO: 2686471 - protein, 19 aa, Entamoeba histolytica
LKNVWIIQCNCMKYVDNYF

SEQ ID NO: 2686472 - protein, 18 aa, Entamoeba histolytica
LKNYLFKPHETIKEMKDA

SEQ ID NO: 2686473 - protein, 23 aa, Entamoeba histolytica
LKNYLKEIPGFLVNNENKDLFNA

SEQ ID NO: 2686474 - protein, 20 aa, Entamoeba histolytica
LKPDIPYISTFSHERTSYFA

SEQ ID NO: 2686475 - protein, 19 aa, Entamoeba histolytica
LKPFGGIEQLCWSKDSKKI

SEQ ID NO: 2686476 - protein, 18 aa, Entamoeba histolytica
LKPFLSELVNSCYLPNGK

SEQ ID NO: 2686477 - protein, 17 aa, Entamoeba histolytica
LKPFSLIHCNLCNTDVC

SEQ ID NO: 2686478 - protein, 26 aa, Entamoeba histolytica
LKPFTTCTWFYIHSFPEYQTPSVSLF

SEQ ID NO: 2686479 - protein, 29 aa, Entamoeba histolytica
LKPISIWTNEIWFRNRYEALVQHYCEVLD

SEQ ID NO: 2686480 - protein, 17 aa, Entamoeba histolytica
LKPKCKNWNIIAKVMDF

SEQ ID NO: 2686481 - protein, 29 aa, Entamoeba histolytica
LKPKCSLKEELCIVPLRKQLNWKALNNPQ

SEQ ID NO: 2686482 - protein, 22 aa, Entamoeba histolytica
LKPKKLWTGKQLYGLALKPNKH

SEQ ID NO: 2686483 - protein, 18 aa, Entamoeba histolytica
LKPPHPFAKFIGDQMKHA

SEQ ID NO: 2686484 - protein, 17 aa, Entamoeba histolytica
LKPTAMIEPPKLPKRKN

SEQ ID NO: 2686485 - protein, 19 aa, Entamoeba histolytica
LKPTLLDICQKEYKSLTKF

SEQ ID NO: 2686486 - protein, 31 aa, Entamoeba histolytica
LKQAPLVDMVKWFRDSIIALGINETNIRIVT

SEQ ID NO: 2686487 - protein, 24 aa, Entamoeba histolytica
LKQCGVSSPLYAGRNVNDLSTIKQ

SEQ ID NO: 2686488 - protein, 21 aa, Entamoeba histolytica
LKQIFTTICTTEIVFVNSTYN

SEQ ID NO: 2686489 - protein, 23 aa, Entamoeba histolytica
LKQIGYPCGILYGRMDQEIREKE

SEQ ID NO: 2686490 - protein, 19 aa, Entamoeba histolytica
LKQKRIDAGALMLASSEIK

SEQ ID NO: 2686491 - protein, 21 aa, Entamoeba histolytica
LKQLAILCAGYDGIKPDLYDE

SEQ ID NO: 2686492 - protein, 24 aa, Entamoeba histolytica
LKQLPLRYFIIPTILSKNNKAIRM

SEQ ID NO: 2686493 - protein, 18 aa, Entamoeba histolytica
LKQLPSLDESVGFYPVQR

SEQ ID NO: 2686494 - protein, 19 aa, Entamoeba histolytica
LKQLYSIIAEELLDSKKGE

SEQ ID NO: 2686495 - protein, 24 aa, Entamoeba histolytica
LKQMAMKEIRIMKLFHHPNICAFF

SEQ ID NO: 2686496 - protein, 20 aa, Entamoeba histolytica
LKQMGWDESNICDNCVPLTV

SEQ ID NO: 2686497 - protein, 23 aa, Entamoeba histolytica
LKQMKMRVQEMINSLKEYKSIME

SEQ ID NO: 2686498 - protein, 19 aa, Entamoeba histolytica
LKQMVLKFIERPNAIILAV

SEQ ID NO: 2686499 - protein, 18 aa, Entamoeba histolytica
LKQNCPVHCAVYCDKLLI

SEQ ID NO: 2686500 - protein, 18 aa, Entamoeba histolytica
LKQNERFIFPSLIVSFNI

SEQ ID NO: 2686501 - protein, 22 aa, Entamoeba histolytica
LKQPKFIDLLLLRNEPPFLLQP

SEQ ID NO: 2686502 - protein, 17 aa, Entamoeba histolytica
LKQSHFINGKLVIELTR

SEQ ID NO: 2686503 - protein, 26 aa, Entamoeba histolytica
LKQSIPLECKYLWLKNINKTKINLSK

SEQ ID NO: 2686504 - protein, 21 aa, Entamoeba histolytica
LKQSREVLKRRECIKTQIEGL

SEQ ID NO: 2686505 - protein, 24 aa, Entamoeba histolytica
LKRCKGVSSWKVFNKEGEELTIKP

SEQ ID NO: 2686506 - protein, 19 aa, Entamoeba histolytica
LKREILVSDEIPVIKKKQI

SEQ ID NO: 2686507 - protein, 20 aa, Entamoeba histolytica
LKRFRTLKHPNIINYLDHVV

SEQ ID NO: 2686508 - protein, 23 aa, Entamoeba histolytica
LKRIKGCCFFNCKNLSSITIPSS

SEQ ID NO: 2686509 - protein, 20 aa, Entamoeba histolytica
LKRKAEYLCDIFNKCEGMSC

SEQ ID NO: 2686510 - protein, 28 aa, Entamoeba histolytica
LKRKEVPKLKGLVLIPTFVEEKEKQRKK

SEQ ID NO: 2686511 - protein, 17 aa, Entamoeba histolytica
LKRKIEIELKVIVEECG

SEQ ID NO: 2686512 - protein, 17 aa, Entamoeba histolytica
LKRKLRKKMSMEYITHY

SEQ ID NO: 2686513 - protein, 20 aa, Entamoeba histolytica
LKRKVKLLCNILQVEDFWKH

SEQ ID NO: 2686514 - protein, 19 aa, Entamoeba histolytica
LKRLSFTRCVIKIQLDVPS

SEQ ID NO: 2686515 - protein, 20 aa, Entamoeba histolytica
LKRLSFTRCVIKIQLDVPSS

SEQ ID NO: 2686516 - protein, 17 aa, Entamoeba histolytica
LKRLVIKDDLFKRSYSM

SEQ ID NO: 2686517 - protein, 28 aa, Entamoeba histolytica
LKRNKINGMKGFQINYFVSCIQSQVFKK

SEQ ID NO: 2686518 - protein, 19 aa, Entamoeba histolytica
LKRNLLIAITELISLGNIE

SEQ ID NO: 2686519 - protein, 22 aa, Entamoeba histolytica
LKRRIDSSLFSWKHPTTDRNDE

SEQ ID NO: 2686520 - protein, 26 aa, Entamoeba histolytica
LKRVAKKKIIMCASGLSSVNSPLQTD

SEQ ID NO: 2686521 - protein, 18 aa, Entamoeba histolytica
LKRVKIYECYHSYDELVA

SEQ ID NO: 2686522 - protein, 22 aa, Entamoeba histolytica
LKSAYCNQLKLPLSSPQFEENS

SEQ ID NO: 2686523 - protein, 27 aa, Entamoeba histolytica
LKSDLYSVGVMLFRMVCGCFPNEINTS

SEQ ID NO: 2686524 - protein, 18 aa, Entamoeba histolytica
LKSECSIVEEKVYEIVPK

SEQ ID NO: 2686525 - protein, 19 aa, Entamoeba histolytica
LKSFEFSHCIGLRKVEIPS

SEQ ID NO: 2686526 - protein, 17 aa, Entamoeba histolytica
LKSFKIVSGNYSLEIVS

SEQ ID NO: 2686527 - protein, 25 aa, Entamoeba histolytica
LKSFLEKYPKVLFFKTTINDTEGIK

SEQ ID NO: 2686528 - protein, 20 aa, Entamoeba histolytica
LKSFMRGMIEPVVDINTALT

SEQ ID NO: 2686529 - protein, 20 aa, Entamoeba histolytica
LKSGCIVGGNLLGKIITKVQ

SEQ ID NO: 2686530 - protein, 25 aa, Entamoeba histolytica
LKSGGDVVGCIEIITFILVDYPHIY

SEQ ID NO: 2686531 - protein, 17 aa, Entamoeba histolytica
LKSGKKFDKKQKITKGV

SEQ ID NO: 2686532 - protein, 17 aa, Entamoeba histolytica
LKSGLTPPTNRIVNKFQ

SEQ ID NO: 2686533 - protein, 18 aa, Entamoeba histolytica
LKSGTSYVEVHDTSKRKG

SEQ ID NO: 2686534 - protein, 17 aa, Entamoeba histolytica
LKSIEMIDSRECKINVK

SEQ ID NO: 2686535 - protein, 26 aa, Entamoeba histolytica
LKSIFIAELPKMLGLPDTSKLAQVNL

SEQ ID NO: 2686536 - protein, 21 aa, Entamoeba histolytica
LKSIPMKSCLKNEFERKTKVP

SEQ ID NO: 2686537 - protein, 18 aa, Entamoeba histolytica
LKSIYSYCGSKINVSSLK

SEQ ID NO: 2686538 - protein, 25 aa, Entamoeba histolytica
LKSKEILYTYTFKYIATKIVLLWLS

SEQ ID NO: 2686539 - protein, 31 aa, Entamoeba histolytica
LKSKEMWKASIILYCCLNSHFTIPSYPNINF

SEQ ID NO: 2686540 - protein, 20 aa, Entamoeba histolytica
LKSKILNYLSIFIKKQIDDL

SEQ ID NO: 2686541 - protein, 19 aa, Entamoeba histolytica
LKSKLYSKFSGEFPFNKSI

SEQ ID NO: 2686542 - protein, 21 aa, Entamoeba histolytica
LKSKMLEPLLIFAQTQQQLSE

SEQ ID NO: 2686543 - protein, 19 aa, Entamoeba histolytica
LKSKNDLMLFVHNPAITIF

SEQ ID NO: 2686544 - protein, 23 aa, Entamoeba histolytica
LKSKSKWSKAIVNITVPAYFPDD

SEQ ID NO: 2686545 - protein, 21 aa, Entamoeba histolytica
LKSKWLEVIYLRHTKITDKSI

SEQ ID NO: 2686546 - protein, 18 aa, Entamoeba histolytica
LKSLENVYTFTLVNKKCK

SEQ ID NO: 2686547 - protein, 17 aa, Entamoeba histolytica
LKSLESILHQKQKHLLR

SEQ ID NO: 2686548 - protein, 17 aa, Entamoeba histolytica
LKSLIIGNSCDAKQRML

SEQ ID NO: 2686549 - protein, 17 aa, Entamoeba histolytica
LKSLYLPFNELVELCLP

SEQ ID NO: 2686550 - protein, 17 aa, Entamoeba histolytica
LKSNAFLYDEIDIRQDE

SEQ ID NO: 2686551 - protein, 20 aa, Entamoeba histolytica
LKSNCYSYVYGSPMSPVVAQ

SEQ ID NO: 2686552 - protein, 20 aa, Entamoeba histolytica
LKSNEKILGFCMDQQGNRNK

SEQ ID NO: 2686553 - protein, 20 aa, Entamoeba histolytica
LKSNLKYDIHYGGYEYQIKH

SEQ ID NO: 2686554 - protein, 26 aa, Entamoeba histolytica
LKSNRADCALMLLSLNIDNLSETIHP

SEQ ID NO: 2686555 - protein, 18 aa, Entamoeba histolytica
LKSNVIIFTNIPPDQQQQ

SEQ ID NO: 2686556 - protein, 22 aa, Entamoeba histolytica
LKSTDFPTGKLLLFVEEYACQV

SEQ ID NO: 2686557 - protein, 20 aa, Entamoeba histolytica
LKTDCLMSSGYEKKMIMNNR

SEQ ID NO: 2686558 - protein, 18 aa, Entamoeba histolytica
LKTEFNVEPKKSPRIAIE

SEQ ID NO: 2686559 - protein, 21 aa, Entamoeba histolytica
LKTEGIFRLSSSIDETKRIKE

SEQ ID NO: 2686560 - protein, 22 aa, Entamoeba histolytica
LKTEYYKQLLIEGRLEEGLLMN

SEQ ID NO: 2686561 - protein, 18 aa, Entamoeba histolytica
LKTFSFKCECGQLTECVC

SEQ ID NO: 2686562 - protein, 20 aa, Entamoeba histolytica
LKTGIRIELFKKILKHLRND

SEQ ID NO: 2686563 - protein, 18 aa, Entamoeba histolytica
LKTGIVIIKCRFERLNMI

SEQ ID NO: 2686564 - protein, 17 aa, Entamoeba histolytica
LKTGNVYVYGRGSADMK

SEQ ID NO: 2686565 - protein, 19 aa, Entamoeba histolytica
LKTICKRQKVPLADSVNLE

SEQ ID NO: 2686566 - protein, 18 aa, Entamoeba histolytica
LKTIGGYGNETGKFNEPM

SEQ ID NO: 2686567 - protein, 18 aa, Entamoeba histolytica
LKTIKILIHELDKTIESC

SEQ ID NO: 2686568 - protein, 18 aa, Entamoeba histolytica
LKTISSWYEKLSKELNSN

SEQ ID NO: 2686569 - protein, 24 aa, Entamoeba histolytica
LKTKGSQIEYCFNQYPLYAEKLLQ

SEQ ID NO: 2686570 - protein, 18 aa, Entamoeba histolytica
LKTKSVLKAIDFLIDVAV

SEQ ID NO: 2686571 - protein, 25 aa, Entamoeba histolytica
LKTLFKDTGIYFAFARDFDKIDDSI

SEQ ID NO: 2686572 - protein, 25 aa, Entamoeba histolytica
LKTLNCFDCSSLEYISNLPNLVSLS

SEQ ID NO: 2686573 - protein, 18 aa, Entamoeba histolytica
LKTLPDWSVATRKIIDTT

SEQ ID NO: 2686574 - protein, 18 aa, Entamoeba histolytica
LKTLRIVLQQLFPPIQAS

SEQ ID NO: 2686575 - protein, 28 aa, Entamoeba histolytica
LKTNGIEFRKRFAFIDYMMFEYRKNIKD

SEQ ID NO: 2686576 - protein, 17 aa, Entamoeba histolytica
LKTPKIRNGTINQITQE

SEQ ID NO: 2686577 - protein, 23 aa, Entamoeba histolytica
LKTSKLSKVILQFFPVLFEKIIF

SEQ ID NO: 2686578 - protein, 18 aa, Entamoeba histolytica
LKTSRCFSDEKLLEKAAQ

SEQ ID NO: 2686579 - protein, 20 aa, Entamoeba histolytica
LKTTINVNMHIWKSLNASFK

SEQ ID NO: 2686580 - protein, 21 aa, Entamoeba histolytica
LKTVKDIYSFLFISKKCKEAL

SEQ ID NO: 2686581 - protein, 18 aa, Entamoeba histolytica
LKVAVGFNSTLGLIDLST

SEQ ID NO: 2686582 - protein, 19 aa, Entamoeba histolytica
LKVAVIERMERVGGVLLQC

SEQ ID NO: 2686583 - protein, 22 aa, Entamoeba histolytica
LKVDEFRSHFMLNRHNENHITI

SEQ ID NO: 2686584 - protein, 20 aa, Entamoeba histolytica
LKVECPLLIPQLSLIPKFLK

SEQ ID NO: 2686585 - protein, 22 aa, Entamoeba histolytica
LKVELPYFDVCVSNTPYSISSP

SEQ ID NO: 2686586 - protein, 20 aa, Entamoeba histolytica
LKVFIDRTVMMMDWNTFSAK

SEQ ID NO: 2686587 - protein, 23 aa, Entamoeba histolytica
LKVFLPTKCLTSFKSFISLEKLT

SEQ ID NO: 2686588 - protein, 29 aa, Entamoeba histolytica
LKVFLYNKLFRYLWPPSISQLENLDYTDP

SEQ ID NO: 2686589 - protein, 18 aa, Entamoeba histolytica
LKVGGFVVIGTFPCKITE

SEQ ID NO: 2686590 - protein, 20 aa, Entamoeba histolytica
LKVIACIGETEAQRIANQTE

SEQ ID NO: 2686591 - protein, 18 aa, Entamoeba histolytica
LKVINSLVEFCINDAQQC

SEQ ID NO: 2686592 - protein, 25 aa, Entamoeba histolytica
LKVKIFSFPLIRNIIKMMNDKEVTI

SEQ ID NO: 2686593 - protein, 19 aa, Entamoeba histolytica
LKVLLSTLNRVIIKLVIDL

SEQ ID NO: 2686594 - protein, 23 aa, Entamoeba histolytica
LKVMRECPLFILSNNPDLSTTGV

SEQ ID NO: 2686595 - protein, 20 aa, Entamoeba histolytica
LKVNEPWFKEITELPWYNNH

SEQ ID NO: 2686596 - protein, 17 aa, Entamoeba histolytica
LKVPIITVMVGEGGSGG

SEQ ID NO: 2686597 - protein, 17 aa, Entamoeba histolytica
LKVPKYKQYYIFFTSPI

SEQ ID NO: 2686598 - protein, 19 aa, Entamoeba histolytica
LKVRAVGYDLNYKRGLQYS

SEQ ID NO: 2686599 - protein, 17 aa, Entamoeba histolytica
LKVSFTYFDINGKDKQI

SEQ ID NO: 2686600 - protein, 21 aa, Entamoeba histolytica
LKVTKTLLLFDETFRTMKAFE

SEQ ID NO: 2686601 - protein, 17 aa, Entamoeba histolytica
LKWGHSNPQLVIQTLLK

SEQ ID NO: 2686602 - protein, 17 aa, Entamoeba histolytica
LKWIVILNFFETPIEFI

SEQ ID NO: 2686603 - protein, 18 aa, Entamoeba histolytica
LKYFETFGPIKCGADGKK

SEQ ID NO: 2686604 - protein, 25 aa, Entamoeba histolytica
LKYFFLCLPKPMINDSVLKVFEMGL

SEQ ID NO: 2686605 - protein, 30 aa, Entamoeba histolytica; identical to SEQ ID NO: 2494304

SEQ ID NO: 2686606 - protein, 20 aa, Entamoeba histolytica
LKYINRLCSLFIHTDTVIGA

SEQ ID NO: 2686607 - protein, 23 aa, Entamoeba histolytica
LKYIPDEVDFVFVTSLLDPELNK

SEQ ID NO: 2686608 - protein, 20 aa, Entamoeba histolytica
LKYKVECKFIGDILRGNSTT

SEQ ID NO: 2686609 - protein, 21 aa, Entamoeba histolytica
LKYLCRAKHAILDPYDSSLPS

SEQ ID NO: 2686610 - protein, 19 aa, Entamoeba histolytica
LKYLILMKLMQKKINEIDS

SEQ ID NO: 2686611 - protein, 24 aa, Entamoeba histolytica
LKYLLYKKMMVHRDIKLDNVLLTT

SEQ ID NO: 2686612 - protein, 20 aa, Entamoeba histolytica
LKYLNLANCFGINGDSILES

SEQ ID NO: 2686613 - protein, 17 aa, Entamoeba histolytica
LKYLPPFYHCILLLPHL

SEQ ID NO: 2686614 - protein, 19 aa, Entamoeba histolytica
LKYPHKFAPFYSKIQYKQS

SEQ ID NO: 2686615 - protein, 24 aa, Entamoeba histolytica
LKYRIFAIEFFIKVAEYLKKLNNF

SEQ ID NO: 2686616 - protein, 24 aa, Entamoeba histolytica
LKYSGEIRPYFTINDPLIHTEKSL

SEQ ID NO: 2686617 - protein, 17 aa, Entamoeba histolytica
LKYSLDEISQWCSSNNI

SEQ ID NO: 2686618 - protein, 17 aa, Entamoeba histolytica
LKYSPLVARSAELIKQN

SEQ ID NO: 2686619 - protein, 26 aa, Entamoeba histolytica
LKYTPKGVFCLMTFYGPACPSNSGII

SEQ ID NO: 2686620 - protein, 18 aa, Entamoeba histolytica
LKYVCDLLKQFKKEGHKA

SEQ ID NO: 2686621 - protein, 19 aa, Entamoeba histolytica
LLAKLMIFIRYCLKSKQLN

SEQ ID NO: 2686622 - protein, 25 aa, Entamoeba histolytica
LLASCYKYGTGVKMSNELYVQWTLQ

SEQ ID NO: 2686623 - protein, 21 aa, Entamoeba histolytica
LLATICKKGIITLTRLSSMKI

SEQ ID NO: 2686624 - protein, 24 aa, Entamoeba histolytica
LLATIRKWKTLKVFEKTLCEELES

SEQ ID NO: 2686625 - protein, 17 aa, Entamoeba histolytica
LLCDVAFVSGSTDNICV

SEQ ID NO: 2686626 - protein, 18 aa, Entamoeba histolytica
LLCGMEFFQHYAGMYDQF

SEQ ID NO: 2686627 - protein, 20 aa, Entamoeba histolytica
LLCGMEFFQYYAGMYDQFKI

SEQ ID NO: 2686628 - protein, 23 aa, Entamoeba histolytica
LLCGTEFFQHYAGMYDQFKIDGV

SEQ ID NO: 2686629 - protein, 20 aa, Entamoeba histolytica
LLCISSWLNYFIRYSQPLIS

SEQ ID NO: 2686630 - protein, 28 aa, Entamoeba histolytica
LLCKGSLLICHPELCKSVGINIIDMMND

SEQ ID NO: 2686631 - protein, 17 aa, Entamoeba histolytica
LLCKYFYSIQSISVYPI

SEQ ID NO: 2686632 - protein, 19 aa, Entamoeba histolytica
LLCLKRLGRENHLCSRCKT

SEQ ID NO: 2686633 - protein, 23 aa, Entamoeba histolytica
LLCTNKKCFIRSLSEQLFGEEKT

SEQ ID NO: 2686634 - protein, 21 aa, Entamoeba histolytica
LLCVTRGRLSEGIDFTNHLAR

SEQ ID NO: 2686635 - protein, 22 aa, Entamoeba histolytica
LLDAHIPEFILLYKDIVCSMLQ

SEQ ID NO: 2686636 - protein, 20 aa, Entamoeba histolytica
LLDDKLECFIGSDEHIFAAR

SEQ ID NO: 2686637 - protein, 27 aa, Entamoeba histolytica
LLDELWMFCFPNGMKASQYKRPFEKRI

SEQ ID NO: 2686638 - protein, 24 aa, Entamoeba histolytica
LLDFYRYSFGFYISTYREKVNQKT

SEQ ID NO: 2686639 - protein, 26 aa, Entamoeba histolytica
LLDGLLREMMRTELETKLRQANYEKK

SEQ ID NO: 2686640 - protein, 21 aa, Entamoeba histolytica
LLDIEGLEWNQAWEIVVQTFA

SEQ ID NO: 2686641 - protein, 17 aa, Entamoeba histolytica
LLDIYKPFVQEIIHSDI

SEQ ID NO: 2686642 - protein, 19 aa, Entamoeba histolytica
LLDKVSCTLAKAYLGDRNK

SEQ ID NO: 2686643 - protein, 18 aa, Entamoeba histolytica
LLDLPSFNIKPLMNECID

SEQ ID NO: 2686644 - protein, 21 aa, Entamoeba histolytica
LLDLQKWKVIYGLYHLQYNKS

SEQ ID NO: 2686645 - protein, 18 aa, Entamoeba histolytica
LLDPDWYNSESFKKLRSL

SEQ ID NO: 2686646 - protein, 24 aa, Entamoeba histolytica
LLDREIAYNLSLMYYKSGNKNLCI

SEQ ID NO: 2686647 - protein, 22 aa, Entamoeba histolytica
LLDRIFWKKPTNAMIVYQEPNH

SEQ ID NO: 2686648 - protein, 18 aa, Entamoeba histolytica
LLEALDIHHQILIFTNKF

SEQ ID NO: 2686649 - protein, 21 aa, Entamoeba histolytica
LLEHTLCFGTSMPRWEQYRKS

SEQ ID NO: 2686650 - protein, 20 aa, Entamoeba histolytica
LLEIYDVVRYLVYWGKAKVI

SEQ ID NO: 2686651 - protein, 20 aa, Entamoeba histolytica
LLEKCLNIASKIIGKYGVIQ

SEQ ID NO: 2686652 - protein, 28 aa, Entamoeba histolytica
LLEKFFQVYSSWDWLRTPVMLGTNDDFN

SEQ ID NO: 2686653 - protein, 24 aa, Entamoeba histolytica
LLEKIWEIIGLFKVYPKTKAGVID

SEQ ID NO: 2686654 - protein, 18 aa, Entamoeba histolytica
LLENKRMYRCSKCKREFE

SEQ ID NO: 2686655 - protein, 18 aa, Entamoeba histolytica
LLENWMFEKEKLFLDTFF

SEQ ID NO: 2686656 - protein, 20 aa, Entamoeba histolytica
LLEQHISRWTLPEDEDTPAW

SEQ ID NO: 2686657 - protein, 18 aa, Entamoeba histolytica
LLEQIRGGKKLKKVQLEE

SEQ ID NO: 2686658 - protein, 18 aa, Entamoeba histolytica
LLEQIRQGKKLKKVETVD

SEQ ID NO: 2686659 - protein, 19 aa, Entamoeba histolytica
LLEREIEVISKDIIDAKKE

SEQ ID NO: 2686660 - protein, 22 aa, Entamoeba histolytica
LLERQPLQWIFIARLIVYSLKH

SEQ ID NO: 2686661 - protein, 17 aa, Entamoeba histolytica
LLESFNIYDRGLTNISE

SEQ ID NO: 2686662 - protein, 17 aa, Entamoeba histolytica
LLESSGVTFCFDNEALF

SEQ ID NO: 2686663 - protein, 19 aa, Entamoeba histolytica
LLETLKLTFFSPLILCCIP

SEQ ID NO: 2686664 - protein, 19 aa, Entamoeba histolytica
LLEWVKEVTDGYGVTVENF

SEQ ID NO: 2686665 - protein, 20 aa, Entamoeba histolytica
LLEWVKEVTDGYGVTVENFK

SEQ ID NO: 2686666 - protein, 18 aa, Entamoeba histolytica
LLEYDCLLAHLSQALLGA

SEQ ID NO: 2686667 - protein, 23 aa, Entamoeba histolytica
LLEYLSQFWIAMQGLGNCKLTHM

SEQ ID NO: 2686668 - protein, 19 aa, Entamoeba histolytica
LLEYQEIILSVTMNIINKL

SEQ ID NO: 2686669 - protein, 17 aa, Entamoeba histolytica
LLFCKDLRSLQQLMKDQ

SEQ ID NO: 2686670 - protein, 31 aa, Entamoeba histolytica
LLFDHIRCHPLCSWVYILLGHLINNYKDDIQ

SEQ ID NO: 2686671 - protein, 18 aa, Entamoeba histolytica
LLFEMKVQRNFINNFSPR

SEQ ID NO: 2686672 - protein, 24 aa, Entamoeba histolytica
LLFIRLKTQIIYYLVNNISSKNPR

SEQ ID NO: 2686673 - protein, 17 aa, Entamoeba histolytica
LLFITWKHCNELMKNII

SEQ ID NO: 2686674 - protein, 31 aa, Entamoeba histolytica; identical to SEQ ID NO: 2494386

SEQ ID NO: 2686675 - protein, 17 aa, Entamoeba histolytica
LLFRALLNGGRLEDILN

SEQ ID NO: 2686676 - protein, 18 aa, Entamoeba histolytica
LLFRKAFKKDLGEIPKLP

SEQ ID NO: 2686677 - protein, 23 aa, Entamoeba histolytica
LLFRVHVKLLLGDSVIGSIYSHP

SEQ ID NO: 2686678 - protein, 19 aa, Entamoeba histolytica
LLFVLRFMVDSGLVGCSWV

SEQ ID NO: 2686679 - protein, 17 aa, Entamoeba histolytica
LLFVRDVHAKFAIALQC

SEQ ID NO: 2686680 - protein, 24 aa, Entamoeba histolytica
LLFYIDDWWLRDGIYDVYDVATEL

SEQ ID NO: 2686681 - protein, 17 aa, Entamoeba histolytica
LLGDIVEAWKEIEIKGM

SEQ ID NO: 2686682 - protein, 24 aa, Entamoeba histolytica
LLGEKKLGGFATWGIGRLEKKQID

SEQ ID NO: 2686683 - protein, 18 aa, Entamoeba histolytica
LLGILYRMGVKQQQKPIE

SEQ ID NO: 2686684 - protein, 18 aa, Entamoeba histolytica
LLGLPCDNHLLLEGKTEH

SEQ ID NO: 2686685 - protein, 17 aa, Entamoeba histolytica
LLGRCKVAEKRKEDMEF

SEQ ID NO: 2686686 - protein, 18 aa, Entamoeba histolytica
LLGTISPWERMSRPDLIR

SEQ ID NO: 2686687 - protein, 19 aa, Entamoeba histolytica
LLGYFPKEISLIDFICVSK

SEQ ID NO: 2686688 - protein, 17 aa, Entamoeba histolytica
LLHCGLTTQKFETSVQC

SEQ ID NO: 2686689 - protein, 17 aa, Entamoeba histolytica
LLHDYRAKAIKQFIINC

SEQ ID NO: 2686690 - protein, 19 aa, Entamoeba histolytica
LLHFCQRFNTISISLISSY

SEQ ID NO: 2686691 - protein, 17 aa, Entamoeba histolytica
LLHGYKIDMNALPKQPI

SEQ ID NO: 2686692 - protein, 22 aa, Entamoeba histolytica
LLHLHCSRFLSLGNDFPQGIKY

SEQ ID NO: 2686693 - protein, 18 aa, Entamoeba histolytica
LLHRSCLPSTTPRNKRGL

SEQ ID NO: 2686694 - protein, 26 aa, Entamoeba histolytica
LLHSTLKHPFAISILLECFLTDEDFL

SEQ ID NO: 2686695 - protein, 24 aa, Entamoeba histolytica
LLHYELPEPLQLIITDNHIQKYNE

SEQ ID NO: 2686696 - protein, 18 aa, Entamoeba histolytica
LLIASHRKLFASSIDALA

SEQ ID NO: 2686697 - protein, 21 aa, Entamoeba histolytica
LLIDKCIDNFFGIASIVSLRE

SEQ ID NO: 2686698 - protein, 32 aa, Entamoeba histolytica
LLIDKRGRCISLICYDRLMWVIPLGLDKTSYS

SEQ ID NO: 2686699 - protein, 23 aa, Entamoeba histolytica
LLIDLLFELGYIFVSRITKGAQG

SEQ ID NO: 2686700 - protein, 25 aa, Entamoeba histolytica
LLIDLSFVMGYSFRSSFTNGNNHSM

SEQ ID NO: 2686701 - protein, 25 aa, Entamoeba histolytica
LLIDLSTEFGYRFVSKRTSGKKRCS

SEQ ID NO: 2686702 - protein, 26 aa, Entamoeba histolytica
LLIEFAQRCGYNFTIRGTRSSIYTVK

SEQ ID NO: 2686703 - protein, 19 aa, Entamoeba histolytica
LLIFKCLSAALSGIEEYRI

SEQ ID NO: 2686704 - protein, 19 aa, Entamoeba histolytica
LLIGLKYLHDAGIVYRDLK

SEQ ID NO: 2686705 - protein, 22 aa, Entamoeba histolytica
LLIKAGIKKGYAIQLSTAIAKE

SEQ ID NO: 2686706 - protein, 23 aa, Entamoeba histolytica
LLIKKIVILTGIIRQISLQVTKN

SEQ ID NO: 2686707 - protein, 24 aa, Entamoeba histolytica
LLIKSLYSSPSFICSVLGIVSNML

SEQ ID NO: 2686708 - protein, 24 aa, Entamoeba histolytica
LLILHGRFIPCIEVMIKEEFDKSN

SEQ ID NO: 2686709 - protein, 19 aa, Entamoeba histolytica
LLILLELNKICPQDVVDYT

SEQ ID NO: 2686710 - protein, 17 aa, Entamoeba histolytica
LLINGCIIDPLDIEKEY

SEQ ID NO: 2686711 - protein, 19 aa, Entamoeba histolytica
LLINYFHTFWPSLLKIDNF

SEQ ID NO: 2686712 - protein, 19 aa, Entamoeba histolytica
LLIPEIWSKMIRYEQEPKY

SEQ ID NO: 2686713 - protein, 18 aa, Entamoeba histolytica
LLIPEIWSKMRRYEQEPK

SEQ ID NO: 2686714 - protein, 19 aa, Entamoeba histolytica
LLIRANWSIVNVIWETRID

SEQ ID NO: 2686715 - protein, 18 aa, Entamoeba histolytica
LLISLPILNICPYSLLLH

SEQ ID NO: 2686716 - protein, 24 aa, Entamoeba histolytica
LLIVDEWKSKVIIIDAKTGKEVDV

SEQ ID NO: 2686717 - protein, 17 aa, Entamoeba histolytica
LLKECKENLITLMTDKF

SEQ ID NO: 2686718 - protein, 17 aa, Entamoeba histolytica
LLKEIVIIMCDSPLNSC

SEQ ID NO: 2686719 - protein, 19 aa, Entamoeba histolytica
LLKELKKSLTIEPSKTSLI

SEQ ID NO: 2686720 - protein, 17 aa, Entamoeba histolytica
LLKENIDALQFLIASIR

SEQ ID NO: 2686721 - protein, 17 aa, Entamoeba histolytica
LLKEWQKGRAKTRTTAA

SEQ ID NO: 2686722 - protein, 20 aa, Entamoeba histolytica
LLKGICDGVTLLGLARTNIG

SEQ ID NO: 2686723 - protein, 17 aa, Entamoeba histolytica
LLKIEIVKQIVLVLLNF

SEQ ID NO: 2686724 - protein, 26 aa, Entamoeba histolytica
LLKISIPCVYLYPCVIPQEALNNNNY

SEQ ID NO: 2686725 - protein, 20 aa, Entamoeba histolytica
LLKKCGYNFIIRQTKKAKLT

SEQ ID NO: 2686726 - protein, 26 aa, Entamoeba histolytica
LLKKLILNCFYHFNSIFSSFHNEIIQ

SEQ ID NO: 2686727 - protein, 22 aa, Entamoeba histolytica
LLKKQFIKFKSFLYQNIPLSNE

SEQ ID NO: 2686728 - protein, 24 aa, Entamoeba histolytica
LLKLHPTPFIPITFHSQIKEKYKK

SEQ ID NO: 2686729 - protein, 23 aa, Entamoeba histolytica
LLKLKIELQREWLFDEIDINEYL

SEQ ID NO: 2686730 - protein, 24 aa, Entamoeba histolytica
LLKLNIELQREWLFDEIDINEYLG

SEQ ID NO: 2686731 - protein, 17 aa, Entamoeba histolytica
LLKMVSAAREFMGSTTI

SEQ ID NO: 2686732 - protein, 24 aa, Entamoeba histolytica
LLKNQKAGFAIPKKVPSYFNTYVN

SEQ ID NO: 2686733 - protein, 17 aa, Entamoeba histolytica
LLKPFGTELTNILQRLV

SEQ ID NO: 2686734 - protein, 23 aa, Entamoeba histolytica
LLKQPRSTFDFVELQNQQKLSKT

SEQ ID NO: 2686735 - protein, 17 aa, Entamoeba histolytica
LLKRIIKEIPDFFDKID

SEQ ID NO: 2686736 - protein, 17 aa, Entamoeba histolytica
LLKSSSLSPRFTRESFD

SEQ ID NO: 2686737 - protein, 18 aa, Entamoeba histolytica
LLKTRVGVPLNILTQNQI

SEQ ID NO: 2686738 - protein, 20 aa, Entamoeba histolytica
LLKVIGRGSFGKVMMVKKKD

SEQ ID NO: 2686739 - protein, 21 aa, Entamoeba histolytica
LLLDENYRISGIVNQRDRIDQ

SEQ ID NO: 2686740 - protein, 20 aa, Entamoeba histolytica
LLLDYFRLSNYYDRICFALK

SEQ ID NO: 2686741 - protein, 20 aa, Entamoeba histolytica
LLLEALLSFIYPHFADQANY

SEQ ID NO: 2686742 - protein, 23 aa, Entamoeba histolytica
LLLEKEKINCIGIHGGKRQIERT

SEQ ID NO: 2686743 - protein, 17 aa, Entamoeba histolytica
LLLELTVGTELQNPKYS

SEQ ID NO: 2686744 - protein, 17 aa, Entamoeba histolytica
LLLGIREEMKLNMEKVV

SEQ ID NO: 2686745 - protein, 17 aa, Entamoeba histolytica
LLLGYGFVEENNPCDNL

SEQ ID NO: 2686746 - protein, 18 aa, Entamoeba histolytica
LLLIRSIATKGYKKMFEC

SEQ ID NO: 2686747 - protein, 29 aa, Entamoeba histolytica
LLLKLIEIISFYLKEHLTLLYGNNQFYDI

SEQ ID NO: 2686748 - protein, 23 aa, Entamoeba histolytica
LLLKSSNVFSSFTQKVIDFSIKE

SEQ ID NO: 2686749 - protein, 17 aa, Entamoeba histolytica
LLLLDHLHEAIIGKGKN

SEQ ID NO: 2686750 - protein, 26 aa, Entamoeba histolytica
LLLLRKKRYAATMILDGGKKKKELKG

SEQ ID NO: 2686751 - protein, 17 aa, Entamoeba histolytica
LLLNIYKEVLRVCQVLN

SEQ ID NO: 2686752 - protein, 19 aa, Entamoeba histolytica
LLLPEIVSFIGADLAQKVI

SEQ ID NO: 2686753 - protein, 17 aa, Entamoeba histolytica
LLLQFQDKRFQPIHDLT

SEQ ID NO: 2686754 - protein, 24 aa, Entamoeba histolytica
LLLQPIGTFFLCHGGISPSLRYLS

SEQ ID NO: 2686755 - protein, 26 aa, Entamoeba histolytica
LLLQRHIPLYPSYRLVGVLDPYGILE

SEQ ID NO: 2686756 - protein, 17 aa, Entamoeba histolytica
LLLSIPDNFDIIVDTNI

SEQ ID NO: 2686757 - protein, 18 aa, Entamoeba histolytica
LLLSLPIEYFQSIVNEKH

SEQ ID NO: 2686758 - protein, 21 aa, Entamoeba histolytica
LLLSSCFRNEAMFQRWYSQSL

SEQ ID NO: 2686759 - protein, 17 aa, Entamoeba histolytica
LLLTNIVNDIGYRFNSE

SEQ ID NO: 2686760 - protein, 17 aa, Entamoeba histolytica
LLLVPDVINRIWESLKE

SEQ ID NO: 2686761 - protein, 17 aa, Entamoeba histolytica
LLLVQPVQRIMRYPMLI

SEQ ID NO: 2686762 - protein, 17 aa, Entamoeba histolytica
LLLYPKIYHHLKSSLLL

SEQ ID NO: 2686763 - protein, 19 aa, Entamoeba histolytica
LLMKFFDELQLTIDKATDI

SEQ ID NO: 2686764 - protein, 23 aa, Entamoeba histolytica
LLMKQELRVGGGHEEYYPVDPNY

SEQ ID NO: 2686765 - protein, 20 aa, Entamoeba histolytica
LLMKRIVNFFREKLHEAPTK

SEQ ID NO: 2686766 - protein, 23 aa, Entamoeba histolytica
LLMKVYREFLPHGGYITESGSLN

SEQ ID NO: 2686767 - protein, 25 aa, Entamoeba histolytica
LLMKVYREFLPHGGYITESGSLNVT

SEQ ID NO: 2686768 - protein, 17 aa, Entamoeba histolytica
LLMNCINYVIKSNIEPF

SEQ ID NO: 2686769 - protein, 23 aa, Entamoeba histolytica
LLMPGHDELTFLIPEIDFSPLFD

SEQ ID NO: 2686770 - protein, 19 aa, Entamoeba histolytica
LLMQPRASKFVKIQEIRIQ

SEQ ID NO: 2686771 - protein, 21 aa, Entamoeba histolytica
LLMRMSEGIAIVPKRRIHQLI

SEQ ID NO: 2686772 - protein, 19 aa, Entamoeba histolytica
LLMTDILHRGLKKFWWKAM

SEQ ID NO: 2686773 - protein, 25 aa, Entamoeba histolytica
LLNEKKPRISSIVKESSNSLPKKES

SEQ ID NO: 2686774 - protein, 20 aa, Entamoeba histolytica
LLNFHMSPSMFSHIVNDFEL

SEQ ID NO: 2686775 - protein, 17 aa, Entamoeba histolytica
LLNFLALDIQKEVIRLI

SEQ ID NO: 2686776 - protein, 19 aa, Entamoeba histolytica
LLNFPCLFRQNDLVSICGE

SEQ ID NO: 2686777 - protein, 18 aa, Entamoeba histolytica
LLNGCLLKPSAVAISNNK

SEQ ID NO: 2686778 - protein, 18 aa, Entamoeba histolytica
LLNIPFTLIKNVQCFNLS

SEQ ID NO: 2686779 - protein, 25 aa, Entamoeba histolytica
LLNLLPRINRDMFIFIIDFLQFLVP

SEQ ID NO: 2686780 - protein, 23 aa, Entamoeba histolytica
LLNNEITPIFVFDGARLPSKITT

SEQ ID NO: 2686781 - protein, 20 aa, Entamoeba histolytica
LLNNPRIVLSQSTFGQVTSL

SEQ ID NO: 2686782 - protein, 24 aa, Entamoeba histolytica
LLNNPSMRPMIGMVAQMMGMSVEE

SEQ ID NO: 2686783 - protein, 18 aa, Entamoeba histolytica
LLNSCLFSKRSISEYTNS

SEQ ID NO: 2686784 - protein, 19 aa, Entamoeba histolytica
LLNSIGFSFEFRRPERFAI

SEQ ID NO: 2686785 - protein, 18 aa, Entamoeba histolytica
LLNSIILVIPRFVQKTLT

SEQ ID NO: 2686786 - protein, 17 aa, Entamoeba histolytica
LLNSLSLRQEFLPLKYK

SEQ ID NO: 2686787 - protein, 18 aa, Entamoeba histolytica
LLNSRNHFLFAFDNTEDL

SEQ ID NO: 2686788 - protein, 21 aa, Entamoeba histolytica
LLNTQLCLRVTIPPPSVDSKY

SEQ ID NO: 2686789 - protein, 18 aa, Entamoeba histolytica
LLNYGVGCKRDFFIKVKN

SEQ ID NO: 2686790 - protein, 23 aa, Entamoeba histolytica
LLPEEKKRLGAKGSEEVKNHPFF

SEQ ID NO: 2686791 - protein, 20 aa, Entamoeba histolytica
LLPEKGEMGISPSCYQFNKI

SEQ ID NO: 2686792 - protein, 18 aa, Entamoeba histolytica
LLPESKPLPTSQVPIQPI

SEQ ID NO: 2686793 - protein, 25 aa, Entamoeba histolytica
LLPHQRTGIKWLWEHHNETTIHGCI

SEQ ID NO: 2686794 - protein, 26 aa, Entamoeba histolytica
LLPIKYFGFDFHKICANKKYQNIEII

SEQ ID NO: 2686795 - protein, 21 aa, Entamoeba histolytica
LLPLCIDGFLWSRKSMADDVA

SEQ ID NO: 2686796 - protein, 19 aa, Entamoeba histolytica
LLPLCLKNISLYNVKKINL

SEQ ID NO: 2686797 - protein, 24 aa, Entamoeba histolytica
LLPLQLRFIQIFVICEPTVSLESP

SEQ ID NO: 2686798 - protein, 17 aa, Entamoeba histolytica
LLPNDVFFFDIKKNKMQ

SEQ ID NO: 2686799 - protein, 22 aa, Entamoeba histolytica
LLPNPLIPYNLYEEFIELRNNH

SEQ ID NO: 2686800 - protein, 23 aa, Entamoeba histolytica
LLPTGDSYLHWIAASPPSSLKNS

SEQ ID NO: 2686801 - protein, 29 aa, Entamoeba histolytica
LLPTLERYREIIIKFPLLGECALSSAKDM

SEQ ID NO: 2686802 - protein, 18 aa, Entamoeba histolytica
LLPVERYQSFVFKLNNDI

SEQ ID NO: 2686803 - protein, 17 aa, Entamoeba histolytica
LLPWREDMEEIKTIRKW

SEQ ID NO: 2686804 - protein, 17 aa, Entamoeba histolytica
LLQEQVVFISRLLFSIY

SEQ ID NO: 2686805 - protein, 26 aa, Entamoeba histolytica
LLQGWTMLGSCCINHPTVPLMRERGG

SEQ ID NO: 2686806 - protein, 18 aa, Entamoeba histolytica
LLQKCTKISHLVLGGTSI

SEQ ID NO: 2686807 - protein, 25 aa, Entamoeba histolytica
LLQKKKIHYCLAIEDTLYSKYQSFG

SEQ ID NO: 2686808 - protein, 27 aa, Entamoeba histolytica
LLQKKKYRLAYDCLSFIQPAPKDKEKQ

SEQ ID NO: 2686809 - protein, 23 aa, Entamoeba histolytica
LLQLRTRITTVRMKISTFSQDSY

SEQ ID NO: 2686810 - protein, 35 aa, Entamoeba histolytica
LLQRLGDDGKYWRHIYKSLLLIYYIIINGTPEAVE

SEQ ID NO: 2686811 - protein, 30 aa, Entamoeba histolytica; identical to SEQ ID NO: 2494508

SEQ ID NO: 2686812 - protein, 20 aa, Entamoeba histolytica
LLQSFGYKFVFNKSPNKKKI

SEQ ID NO: 2686813 - protein, 24 aa, Entamoeba histolytica
LLQSPKFNTLCKIDEKNEEQQSPK

SEQ ID NO: 2686814 - protein, 18 aa, Entamoeba histolytica
LLQYYLPMDSVDFAGNSI

SEQ ID NO: 2686815 - protein, 19 aa, Entamoeba histolytica
LLRCFLHNPLSPKVRNSMI

SEQ ID NO: 2686816 - protein, 19 aa, Entamoeba histolytica
LLREKGFIFISKFTDGKNG

SEQ ID NO: 2686817 - protein, 19 aa, Entamoeba histolytica
LLRESNRAILTLAIATSLN

SEQ ID NO: 2686818 - protein, 27 aa, Entamoeba histolytica
LLRGIWIMPIEWLFSKGDYFENEELYV

SEQ ID NO: 2686819 - protein, 24 aa, Entamoeba histolytica
LLRGLIPILERWLGNLLARQFEGR

SEQ ID NO: 2686820 - protein, 23 aa, Entamoeba histolytica
LLRIPKCKICSAYFSPLTHWICP

SEQ ID NO: 2686821 - protein, 17 aa, Entamoeba histolytica
LLRKEWKDHMSREEAEH

SEQ ID NO: 2686822 - protein, 17 aa, Entamoeba histolytica
LLRKIGVKFDEIVQKGF

SEQ ID NO: 2686823 - protein, 18 aa, Entamoeba histolytica
LLRNISMVFGDAPRLIEA

SEQ ID NO: 2686824 - protein, 23 aa, Entamoeba histolytica
LLRNTHLLERINIYLESHPNDIN

SEQ ID NO: 2686825 - protein, 18 aa, Entamoeba histolytica
LLRPGRLEVQIEIGLPDE

SEQ ID NO: 2686826 - protein, 17 aa, Entamoeba histolytica
LLRRGASSPALLQRLQH

SEQ ID NO: 2686827 - protein, 18 aa, Entamoeba histolytica
LLRRHGRLGKKVSLHLNE

SEQ ID NO: 2686828 - protein, 21 aa, Entamoeba histolytica
LLRSFGYKLLERILYIESTPY

SEQ ID NO: 2686829 - protein, 23 aa, Entamoeba histolytica
LLSCLELFLEWVGGTKYIKNFAL

SEQ ID NO: 2686830 - protein, 19 aa, Entamoeba histolytica
LLSDLPFGENMTVLCVMNG

SEQ ID NO: 2686831 - protein, 28 aa, Entamoeba histolytica
LLSDRLRFKSARFYNEYVFHLDNVNAIA

SEQ ID NO: 2686832 - protein, 18 aa, Entamoeba histolytica
LLSENGIVYGEKIDNEIL

SEQ ID NO: 2686833 - protein, 22 aa, Entamoeba histolytica
LLSEWKASLFGDESEQCNRDML

SEQ ID NO: 2686834 - protein, 25 aa, Entamoeba histolytica
LLSFLRLQKIGFVFQTFNLIASMTA

SEQ ID NO: 2686835 - protein, 18 aa, Entamoeba histolytica
LLSIIKYFIQRKIIKGKR

SEQ ID NO: 2686836 - protein, 24 aa, Entamoeba histolytica
LLSIKQCMLFKIIGKDGQVKKNAA

SEQ ID NO: 2686837 - protein, 17 aa, Entamoeba histolytica
LLSIKSIFLNIYSHLKY

SEQ ID NO: 2686838 - protein, 19 aa, Entamoeba histolytica
LLSKMSVIIPYIYTQFKCD

SEQ ID NO: 2686839 - protein, 17 aa, Entamoeba histolytica
LLSLLCELVSSLDENVI

SEQ ID NO: 2686840 - protein, 17 aa, Entamoeba histolytica
LLSLLRITVKMNLNQIE

SEQ ID NO: 2686841 - protein, 19 aa, Entamoeba histolytica
LLSLRGFPLTLTKLKAPKW

SEQ ID NO: 2686842 - protein, 18 aa, Entamoeba histolytica
LLSLSINPKEHWAPFANA

SEQ ID NO: 2686843 - protein, 22 aa, Entamoeba histolytica
LLSMITCFGYKVQFVRPKHGCK

SEQ ID NO: 2686844 - protein, 17 aa, Entamoeba histolytica
LLSNGINAVRWVGGVEL

SEQ ID NO: 2686845 - protein, 25 aa, Entamoeba histolytica
LLSPEYFLLQCFVYLNAQEFLEHIY

SEQ ID NO: 2686846 - protein, 22 aa, Entamoeba histolytica
LLSPYCGFVLEYPRKQTTVTAT

SEQ ID NO: 2686847 - protein, 23 aa, Entamoeba histolytica
LLSRKEKLSFWGIEQATLNYLYY

SEQ ID NO: 2686848 - protein, 25 aa, Entamoeba histolytica
LLSRVCLYCGKVICTKRKCLEYHSH

SEQ ID NO: 2686849 - protein, 26 aa, Entamoeba histolytica
LLSSKAGGCGLNLVGGANLVMFDPDW

SEQ ID NO: 2686850 - protein, 29 aa, Entamoeba histolytica
LLSSKLGFPYELLLQINKEVAGLMKSNLG

SEQ ID NO: 2686851 - protein, 26 aa, Entamoeba histolytica
LLSSLLRNKASFAFKEPVDPQLTGAI

SEQ ID NO: 2686852 - protein, 19 aa, Entamoeba histolytica
LLSTKRCISKFIEIGVIDN

SEQ ID NO: 2686853 - protein, 26 aa, Entamoeba histolytica
LLSVKYAVIRGWRGGILCNIAIEESH

SEQ ID NO: 2686854 - protein, 22 aa, Entamoeba histolytica
LLSYGRLWRNINIEDTFESTDN

SEQ ID NO: 2686855 - protein, 20 aa, Entamoeba histolytica
LLTDCYLEYLKIATSDRLNA

SEQ ID NO: 2686856 - protein, 18 aa, Entamoeba histolytica
LLTEDGVYIIWFSHIQFN

SEQ ID NO: 2686857 - protein, 26 aa, Entamoeba histolytica
LLTKHLYCYPIDLQINVITRICTEIY

SEQ ID NO: 2686858 - protein, 24 aa, Entamoeba histolytica
LLTKKGEMPFFQFVLNVKSFGQTV

SEQ ID NO: 2686859 - protein, 18 aa, Entamoeba histolytica
LLTKYAILLVNFFSKSQR

SEQ ID NO: 2686860 - protein, 18 aa, Entamoeba histolytica
LLTLPTLVFLYGMNINQT

SEQ ID NO: 2686861 - protein, 19 aa, Entamoeba histolytica
LLTQLKVLYLNKIIKSVDV

SEQ ID NO: 2686862 - protein, 18 aa, Entamoeba histolytica
LLTSPGLINNDFNRVFMC

SEQ ID NO: 2686863 - protein, 18 aa, Entamoeba histolytica
LLTTYLQRIGHTCSLDDC

SEQ ID NO: 2686864 - protein, 18 aa, Entamoeba histolytica
LLTYYSIVHLPRIDGLQV

SEQ ID NO: 2686865 - protein, 23 aa, Entamoeba histolytica
LLVETLKNFLLYYTETETSKNVV

SEQ ID NO: 2686866 - protein, 18 aa, Entamoeba histolytica
LLVIGGRPTINWYKLFKN

SEQ ID NO: 2686867 - protein, 18 aa, Entamoeba histolytica
LLVKVIARYCEFIETDVF

SEQ ID NO: 2686868 - protein, 24 aa, Entamoeba histolytica
LLVLKEMVIELIILDILLTSPDYH

SEQ ID NO: 2686869 - protein, 24 aa, Entamoeba histolytica
LLVLQAPIYVCGDIHGQFYDLLTI

SEQ ID NO: 2686870 - protein, 18 aa, Entamoeba histolytica
LLVMKKVYCQAAFAEYEK

SEQ ID NO: 2686871 - protein, 18 aa, Entamoeba histolytica
LLVSWNCHSLVVYTEKTE

SEQ ID NO: 2686872 - protein, 17 aa, Entamoeba histolytica
LLWKMLMITGEWSIEQL

SEQ ID NO: 2686873 - protein, 17 aa, Entamoeba histolytica
LLYELYTSKMLFAIADV

SEQ ID NO: 2686874 - protein, 19 aa, Entamoeba histolytica
LLYEYPKESAMKYASDNEY

SEQ ID NO: 2686875 - protein, 23 aa, Entamoeba histolytica
LLYNDIDVIIGFTDETKWKKLIL

SEQ ID NO: 2686876 - protein, 20 aa, Entamoeba histolytica
LLYREKNGWTLVKQGDKIGY

SEQ ID NO: 2686877 - protein, 17 aa, Entamoeba histolytica
LLYSPIIDGSKELQIIL

SEQ ID NO: 2686878 - protein, 22 aa, Entamoeba histolytica
LMAVLGCVLRGASRIFAVGSRE

SEQ ID NO: 2686879 - protein, 18 aa, Entamoeba histolytica
LMDRSCKVKQDLKSKRNV

SEQ ID NO: 2686880 - protein, 26 aa, Entamoeba histolytica
LMEALMLKLKTMRAASNYDANEDDDD

SEQ ID NO: 2686881 - protein, 25 aa, Entamoeba histolytica
LMEALMLKLKTMRANSNYDATDNDG

SEQ ID NO: 2686882 - protein, 24 aa, Entamoeba histolytica
LMEDEHYCGMSFRGDEKKSIFGIF

SEQ ID NO: 2686883 - protein, 18 aa, Entamoeba histolytica
LMEFGKRLDAVVKEQFQK

SEQ ID NO: 2686884 - protein, 23 aa, Entamoeba histolytica
LMEHIVKLEVPLVVTVETGKKWG

SEQ ID NO: 2686885 - protein, 19 aa, Entamoeba histolytica
LMELKQFYILIIKELIQSI

SEQ ID NO: 2686886 - protein, 19 aa, Entamoeba histolytica
LMEMSGLRALSLYCGFEES

SEQ ID NO: 2686887 - protein, 19 aa, Entamoeba histolytica
LMENFRRAIGIKITEIKDV

SEQ ID NO: 2686888 - protein, 19 aa, Entamoeba histolytica
LMEQARIQLMTELKNKGEL

SEQ ID NO: 2686889 - protein, 19 aa, Entamoeba histolytica
LMESIKMFCLRMMSETDEI

SEQ ID NO: 2686890 - protein, 24 aa, Entamoeba histolytica
LMETFPHIMIRSHFDSIVNALILC

SEQ ID NO: 2686891 - protein, 18 aa, Entamoeba histolytica
LMGIYGHCNPTPKNSSPV

SEQ ID NO: 2686892 - protein, 26 aa, Entamoeba histolytica
LMGQKKFYPYCSFTLNGSVYSTYYVD

SEQ ID NO: 2686893 - protein, 25 aa, Entamoeba histolytica
LMGSSYPPTKGWDRLGYLCNIFQVP

SEQ ID NO: 2686894 - protein, 19 aa, Entamoeba histolytica
LMHFFPVIMSNLFGMFNNH

SEQ ID NO: 2686895 - protein, 19 aa, Entamoeba histolytica
LMIEVPIIKHYAEKSIDAY

SEQ ID NO: 2686896 - protein, 21 aa, Entamoeba histolytica
LMIHLCPSRFSHFLMTSYTPL

SEQ ID NO: 2686897 - protein, 25 aa, Entamoeba histolytica
LMIILISFLPRFSMFDFKLLASSCV

SEQ ID NO: 2686898 - protein, 17 aa, Entamoeba histolytica
LMIIRKEIENIMKEVLI

SEQ ID NO: 2686899 - protein, 18 aa, Entamoeba histolytica
LMIKIFEEYFINEMKVNI

SEQ ID NO: 2686900 - protein, 18 aa, Entamoeba histolytica
LMIKLEYSRLIIKIRTIA

SEQ ID NO: 2686901 - protein, 21 aa, Entamoeba histolytica
LMKAFQYLYCHGLFHGNVTKE

SEQ ID NO: 2686902 - protein, 21 aa, Entamoeba histolytica
LMKDFKKKVLDLIKIKIDEYQ

SEQ ID NO: 2686903 - protein, 27 aa, Entamoeba histolytica
LMKEGGSWKSWKKRYFELNNDSLYYYK

SEQ ID NO: 2686904 - protein, 23 aa, Entamoeba histolytica
LMKERILSCFNYIFNDSKSYSFH

SEQ ID NO: 2686905 - protein, 26 aa, Entamoeba histolytica
LMKIMLEQCPLCWIDSVEKDKLKEVV

SEQ ID NO: 2686906 - protein, 19 aa, Entamoeba histolytica
LMKLYCNNISFKISDLYQK

SEQ ID NO: 2686907 - protein, 18 aa, Entamoeba histolytica
LMKQLGFVYEIKREQDRN

SEQ ID NO: 2686908 - protein, 22 aa, Entamoeba histolytica
LMKTFESYRIFTIQTENNKGSF

SEQ ID NO: 2686909 - protein, 18 aa, Entamoeba histolytica
LMLLRHWTLYDSLFHTRE

SEQ ID NO: 2686910 - protein, 32 aa, Entamoeba histolytica
LMLNKSRCSEFKRKLSLVGKKIGEETECQIKK

SEQ ID NO: 2686911 - protein, 25 aa, Entamoeba histolytica
LMLSCGYKYVLEFNRERFIAYLPLA

SEQ ID NO: 2686912 - protein, 17 aa, Entamoeba histolytica
LMLSCIGETIPLRDKVN

SEQ ID NO: 2686913 - protein, 21 aa, Entamoeba histolytica
LMLSRNSFEFITTRNNTIIKY

SEQ ID NO: 2686914 - protein, 24 aa, Entamoeba histolytica
LMMMRETIGLFPPSLLCQATQNVN

SEQ ID NO: 2686915 - protein, 17 aa, Entamoeba histolytica
LMMNMVVKYRSTLFRAV

SEQ ID NO: 2686916 - protein, 19 aa, Entamoeba histolytica
LMNALKFGRTYKKVMNLWD

SEQ ID NO: 2686917 - protein, 24 aa, Entamoeba histolytica
LMNATNLSICWTPVLFDMTTFLMK

SEQ ID NO: 2686918 - protein, 17 aa, Entamoeba histolytica
LMNILLDIFFNFNHNCT

SEQ ID NO: 2686919 - protein, 24 aa, Entamoeba histolytica
LMNKDSVKGFSHLNSNTNDEKVLK

SEQ ID NO: 2686920 - protein, 23 aa, Entamoeba histolytica
LMNSLRNAHPYHFNVETPFLLEE

SEQ ID NO: 2686921 - protein, 23 aa, Entamoeba histolytica
LMNVLICTPGRLLYHLDNTPHFN

SEQ ID NO: 2686922 - protein, 18 aa, Entamoeba histolytica
LMPCEYESWGTKEGGGYK

SEQ ID NO: 2686923 - protein, 18 aa, Entamoeba histolytica
LMPGLGKYFPTPTHYFLT

SEQ ID NO: 2686924 - protein, 23 aa, Entamoeba histolytica
LMPQLPQLIPMFFDLLPHGGDED

SEQ ID NO: 2686925 - protein, 20 aa, Entamoeba histolytica
LMRLIVCLTKTFPESPVDFP

SEQ ID NO: 2686926 - protein, 22 aa, Entamoeba histolytica
LMRREGRRMYTHIIIDEAHERD

SEQ ID NO: 2686927 - protein, 21 aa, Entamoeba histolytica
LMSELIFEILIKKKAFDGKED

SEQ ID NO: 2686928 - protein, 19 aa, Entamoeba histolytica
LMTALIRILTSWFDSGVKL

SEQ ID NO: 2686929 - protein, 30 aa, Entamoeba histolytica
LMTKRYCNNFIYMYQWFKSFVNESERQGDS

SEQ ID NO: 2686930 - protein, 19 aa, Entamoeba histolytica
LMTMVPFFNIMCADEIEAR

SEQ ID NO: 2686931 - protein, 23 aa, Entamoeba histolytica
LMVACFYMNLEMINLLIKAGANI

SEQ ID NO: 2686932 - protein, 17 aa, Entamoeba histolytica
LMVGDEGVGKTCLVRQF

SEQ ID NO: 2686933 - protein, 24 aa, Entamoeba histolytica
LMVKLEVASIFPLITGNAHVVTQS

SEQ ID NO: 2686934 - protein, 21 aa, Entamoeba histolytica
LMVKTSFSLEVMNCVIRTYQF

SEQ ID NO: 2686935 - protein, 24 aa, Entamoeba histolytica
LMVVCKYGEIIFGCYNSNMLSEKD

SEQ ID NO: 2686936 - protein, 23 aa, Entamoeba histolytica
LMYKPKVIRRRKGSFSRPHEDGI

SEQ ID NO: 2686937 - protein, 25 aa, Entamoeba histolytica
LMYYMYKYPFSVLDLNIYKQHTVDD

SEQ ID NO: 2686938 - protein, 19 aa, Entamoeba histolytica
LNACKRRNVIISSLRISED

SEQ ID NO: 2686939 - protein, 22 aa, Entamoeba histolytica
LNADVITLTWKDHINTIKIESI

SEQ ID NO: 2686940 - protein, 17 aa, Entamoeba histolytica
LNAICFVAQSSNVKLTV

SEQ ID NO: 2686941 - protein, 21 aa, Entamoeba histolytica
LNAKTCVFFRWTSDMKQPHID

SEQ ID NO: 2686942 - protein, 17 aa, Entamoeba histolytica
LNALFQILTNKYSFSEL

SEQ ID NO: 2686943 - protein, 17 aa, Entamoeba histolytica
LNANPTISKEIKNQVNS

SEQ ID NO: 2686944 - protein, 18 aa, Entamoeba histolytica
LNAPFIIEVFKIIYDMYI

SEQ ID NO: 2686945 - protein, 23 aa, Entamoeba histolytica
LNARICGRSNILIIVLTTKGYVF

SEQ ID NO: 2686946 - protein, 27 aa, Entamoeba histolytica
LNATFKEDLTFAILKGDSLDPILHPKY

SEQ ID NO: 2686947 - protein, 33 aa, Entamoeba histolytica; identical to SEQ ID NO: 2494660

SEQ ID NO: 2686948 - protein, 32 aa, Entamoeba histolytica
LNAYCYMECSALKRVGLKQIFEQAVRYTLKDR

SEQ ID NO: 2686949 - protein, 31 aa, Entamoeba histolytica
LNCGKNRRRALLKFAKEHGFTSIALGHHMDD

SEQ ID NO: 2686950 - protein, 20 aa, Entamoeba histolytica
LNDCEKGICRTCNEMKLTDD

SEQ ID NO: 2686951 - protein, 20 aa, Entamoeba histolytica
LNDIWRLRRSLFIVCKQNKE

SEQ ID NO: 2686952 - protein, 23 aa, Entamoeba histolytica
LNDLLRWLFGEMIQNECIENNIE

SEQ ID NO: 2686953 - protein, 24 aa, Entamoeba histolytica
LNDNCYRNIIPMFKVLSTNIHSLY

SEQ ID NO: 2686954 - protein, 27 aa, Entamoeba histolytica
LNDYIFCVAHAFGFWKPQLNEGESAYT

SEQ ID NO: 2686955 - protein, 24 aa, Entamoeba histolytica
LNECKTKDFCYNFNMNGKNVTVWE

SEQ ID NO: 2686956 - protein, 18 aa, Entamoeba histolytica
LNEELKIEVYAEVSAKTG

SEQ ID NO: 2686957 - protein, 18 aa, Entamoeba histolytica
LNEFWKLTNKCIQQAKQR

SEQ ID NO: 2686958 - protein, 18 aa, Entamoeba histolytica
LNEGFGYDVYNEGAKTSV

SEQ ID NO: 2686959 - protein, 25 aa, Entamoeba histolytica
LNEIHELFDALPLAALVEGNSLGRF

SEQ ID NO: 2686960 - protein, 22 aa, Entamoeba histolytica
LNEIKRCFPNELLTMNTMNIET

SEQ ID NO: 2686961 - protein, 18 aa, Entamoeba histolytica
LNEIKRKLLSEINNINEL

SEQ ID NO: 2686962 - protein, 26 aa, Entamoeba histolytica
LNEIKSCVWASGSMIYPITDISPPIN

SEQ ID NO: 2686963 - protein, 34 aa, Entamoeba histolytica
LNEIRHFYLYLLWILKNMDLRTLINLINKDSPER

SEQ ID NO: 2686964 - protein, 18 aa, Entamoeba histolytica
LNEKAVFLKQLINGARGK

SEQ ID NO: 2686965 - protein, 18 aa, Entamoeba histolytica
LNELKWYSKAIIYMHEYF

SEQ ID NO: 2686966 - protein, 24 aa, Entamoeba histolytica
LNELKYNKEIGILKEKELIQQNDD

SEQ ID NO: 2686967 - protein, 24 aa, Entamoeba histolytica
LNELRMCKTYEEYFYKRHKGDHDF

SEQ ID NO: 2686968 - protein, 20 aa, Entamoeba histolytica
LNELSFPLQFILLEVISINQ

SEQ ID NO: 2686969 - protein, 17 aa, Entamoeba histolytica
LNENVLKRFRTLKHPNI

SEQ ID NO: 2686970 - protein, 20 aa, Entamoeba histolytica
LNEPELKPINPFIIDDKEED

SEQ ID NO: 2686971 - protein, 26 aa, Entamoeba histolytica
LNESISLLANCRHRIVPPPKIITDTR

SEQ ID NO: 2686972 - protein, 20 aa, Entamoeba histolytica
LNETSKWAAALMQQCVIMGN

SEQ ID NO: 2686973 - protein, 20 aa, Entamoeba histolytica
  misc_feature (16)..(20): Xaa can be any naturally occurring amino acid
LNEVGDSMFGFIMDGXXXXX

SEQ ID NO: 2686974 - protein, 25 aa, Entamoeba histolytica
LNEWRRMCFCFVINRVNYYLTREEE

SEQ ID NO: 2686975 - protein, 32 aa, Entamoeba histolytica; identical to SEQ ID NO: 2494715

SEQ ID NO: 2686976 - protein, 18 aa, Entamoeba histolytica
LNFFSLFHQICFQVNQRH

SEQ ID NO: 2686977 - protein, 27 aa, Entamoeba histolytica
LNFGLMEGVALWALRKPFNEVIDSSAT

SEQ ID NO: 2686978 - protein, 29 aa, Entamoeba histolytica
LNGESLLHYCARYGMALICKEILRHNINI

SEQ ID NO: 2686979 - protein, 22 aa, Entamoeba histolytica
LNGFQAMGGLECLSARRNRITM

SEQ ID NO: 2686980 - protein, 18 aa, Entamoeba histolytica
LNGIYRGFQNLIWKYSDE

SEQ ID NO: 2686981 - protein, 18 aa, Entamoeba histolytica
LNGIYYMFYEIIFNTFVS

SEQ ID NO: 2686982 - protein, 23 aa, Entamoeba histolytica
LNGKDVPIIICGNKVDCQPRLVS

SEQ ID NO: 2686983 - protein, 25 aa, Entamoeba histolytica
LNGKKLKIEFSRPGGRETGFITEEL

SEQ ID NO: 2686984 - protein, 17 aa, Entamoeba histolytica
LNGNVCIGFVTVKEPID

SEQ ID NO: 2686985 - protein, 24 aa, Entamoeba histolytica
LNGTSVLFNWCKKGHILLATTSTD

SEQ ID NO: 2686986 - protein, 20 aa, Entamoeba histolytica
LNHHMQEYWELWNCKSTCAI

SEQ ID NO: 2686987 - protein, 24 aa, Entamoeba histolytica
LNHPFLVHLVWDFETPFYYIFVMT

SEQ ID NO: 2686988 - protein, 24 aa, Entamoeba histolytica
LNHRGEIKLADFGISVQLTKRKSK

SEQ ID NO: 2686989 - protein, 23 aa, Entamoeba histolytica
LNIDASTLFKISKYLASVLSSLL

SEQ ID NO: 2686990 - protein, 27 aa, Entamoeba histolytica
LNIFSWAMPCKRICIEDIHPCLVSVNA

SEQ ID NO: 2686991 - protein, 26 aa, Entamoeba histolytica
LNIGERVMSLLACRYIDNVIIGAPRG

SEQ ID NO: 2686992 - protein, 19 aa, Entamoeba histolytica
LNIILDLFESILLETSVIL

SEQ ID NO: 2686993 - protein, 18 aa, Entamoeba histolytica
LNIITMVILRREEYIELY

SEQ ID NO: 2686994 - protein, 18 aa, Entamoeba histolytica
LNIKNIVNATGYLRGGYD

SEQ ID NO: 2686995 - protein, 17 aa, Entamoeba histolytica
LNILKLTSLTNLYLTHN

SEQ ID NO: 2686996 - protein, 24 aa, Entamoeba histolytica
LNINKCKNLTCIDGIDKLNIPFDE

SEQ ID NO: 2686997 - protein, 17 aa, Entamoeba histolytica
LNIPFKNLLPFYYNLKH

SEQ ID NO: 2686998 - protein, 18 aa, Entamoeba histolytica
LNIPPGKIVNEIIITIVK

SEQ ID NO: 2686999 - protein, 17 aa, Entamoeba histolytica
LNIPPGKLVNEIIITIL

SEQ ID NO: 2687000 - protein, 24 aa, Entamoeba histolytica
LNIPWKNKKWIASSLPLLTPEVGN

SEQ ID NO: 2687001 - protein, 20 aa, Entamoeba histolytica
LNISGCIRLSEEFITTTLIA

SEQ ID NO: 2687002 - protein, 18 aa, Entamoeba histolytica
LNIYHTMLLHGLIYMKHR

SEQ ID NO: 2687003 - protein, 19 aa, Entamoeba histolytica
LNKAIKAGCTSIGFCCIST

SEQ ID NO: 2687004 - protein, 18 aa, Entamoeba histolytica
LNKCLKQLPLRYFIIPTI

SEQ ID NO: 2687005 - protein, 21 aa, Entamoeba histolytica
LNKCVPLKMDVLLNQSNNSIT

SEQ ID NO: 2687006 - protein, 25 aa, Entamoeba histolytica
LNKEEEIIWIITMIEHIKEYEGIDI

SEQ ID NO: 2687007 - protein, 18 aa, Entamoeba histolytica
LNKFKYSPLHTALSQNEI

SEQ ID NO: 2687008 - protein, 17 aa, Entamoeba histolytica
LNKGFGFEVYREGVDVH

SEQ ID NO: 2687009 - protein, 17 aa, Entamoeba histolytica
LNKGTAISGGLKHVTAD

SEQ ID NO: 2687010 - protein, 19 aa, Entamoeba histolytica
LNKINALIYSYELQKAKHD

SEQ ID NO: 2687011 - protein, 20 aa, Entamoeba histolytica
LNKKCFKEQAIWMLNALWPT

SEQ ID NO: 2687012 - protein, 25 aa, Entamoeba histolytica
LNKKCFKEQAIWMLNALWPTHKDTV

SEQ ID NO: 2687013 - protein, 25 aa, Entamoeba histolytica
LNKKESREELGWFINIPKQQFIGTK

SEQ ID NO: 2687014 - protein, 17 aa, Entamoeba histolytica
LNKKPFETIPYRFSESG

SEQ ID NO: 2687015 - protein, 24 aa, Entamoeba histolytica
LNKLRGLPIAAVRAPGFGETRKGI

SEQ ID NO: 2687016 - protein, 24 aa, Entamoeba histolytica
LNKLSIKCFKDFQLCECFKNQFSQ

SEQ ID NO: 2687017 - protein, 17 aa, Entamoeba histolytica
LNKNWKKYGETKIKLSV

SEQ ID NO: 2687018 - protein, 27 aa, Entamoeba histolytica
LNKQYDCIWIQWSILYLRDDDLIDMLK

SEQ ID NO: 2687019 - protein, 24 aa, Entamoeba histolytica
LNKRIPHCLGNNIFAISYCNSKPS

SEQ ID NO: 2687020 - protein, 29 aa, Entamoeba histolytica
LNKYCRKGIKKRVCFLFSDQVLIYGSPVV

SEQ ID NO: 2687021 - protein, 25 aa, Entamoeba histolytica
LNLAPGCHMGRFIIWTESAFKKLNT

SEQ ID NO: 2687022 - protein, 17 aa, Entamoeba histolytica
LNLERFAPWRESNEEKI

SEQ ID NO: 2687023 - protein, 20 aa, Entamoeba histolytica
LNLFDIILPPSFNSTIIFPY

SEQ ID NO: 2687024 - protein, 19 aa, Entamoeba histolytica
LNLFGEVMYLLGVDVGQAF

SEQ ID NO: 2687025 - protein, 17 aa, Entamoeba histolytica
LNLFPSIKTLFLYNQND

SEQ ID NO: 2687026 - protein, 21 aa, Entamoeba histolytica
LNLHKRRFGSYGSIRFNYDGI

SEQ ID NO: 2687027 - protein, 17 aa, Entamoeba histolytica
LNLICVDAAHAIQPILN

SEQ ID NO: 2687028 - protein, 18 aa, Entamoeba histolytica
LNLIDIAHTFGLENPTIV

SEQ ID NO: 2687029 - protein, 17 aa, Entamoeba histolytica
LNLKICPEFVSNIKECK

SEQ ID NO: 2687030 - protein, 22 aa, Entamoeba histolytica
LNLKNAIAIRESWIKENPKRAE

SEQ ID NO: 2687031 - protein, 17 aa, Entamoeba histolytica
LNLLFIPTDIFKKVDEI

SEQ ID NO: 2687032 - protein, 17 aa, Entamoeba histolytica
LNLRLTVNILKQLVESL

SEQ ID NO: 2687033 - protein, 18 aa, Entamoeba histolytica
LNLSESISYGVNVDMSLP

SEQ ID NO: 2687034 - protein, 19 aa, Entamoeba histolytica
LNLSHAVGIALNYMHMRLR

SEQ ID NO: 2687035 - protein, 24 aa, Entamoeba histolytica
LNLSTLPTLFAFALSTQSYKNYLI

SEQ ID NO: 2687036 - protein, 23 aa, Entamoeba histolytica
LNLVPGAILLIVFEDYKSVEKPY

SEQ ID NO: 2687037 - protein, 26 aa, Entamoeba histolytica
LNLYETVPFNIGFEISGGKLDPFIKA

SEQ ID NO: 2687038 - protein, 17 aa, Entamoeba histolytica
LNMKCSYRVYVYPFEQS

SEQ ID NO: 2687039 - protein, 17 aa, Entamoeba histolytica
LNNDFNVFLQQRRIKVI

SEQ ID NO: 2687040 - protein, 20 aa, Entamoeba histolytica
LNNICLDCCDIIEYHFPPNR

SEQ ID NO: 2687041 - protein, 18 aa, Entamoeba histolytica
LNNIIPWKTKSNTQTKTK

SEQ ID NO: 2687042 - protein, 25 aa, Entamoeba histolytica
LNNKIEWSIKLKKWDLRTEELIEPL

SEQ ID NO: 2687043 - protein, 19 aa, Entamoeba histolytica
LNNKKCYYHAMSIGITYRQ

SEQ ID NO: 2687044 - protein, 25 aa, Entamoeba histolytica
LNNLLRPGSWEVIERIESNEKNEIF

SEQ ID NO: 2687045 - protein, 24 aa, Entamoeba histolytica
LNNNYIKIVEPFFVKLFQNDILIR

SEQ ID NO: 2687046 - protein, 18 aa, Entamoeba histolytica
LNNPIISYYLMYQFGAVD

SEQ ID NO: 2687047 - protein, 23 aa, Entamoeba histolytica
LNNQAVFLFKGWGRSLDKRQSFK

SEQ ID NO: 2687048 - protein, 18 aa, Entamoeba histolytica
LNPLRLFGYNVDKYLNEY

SEQ ID NO: 2687049 - protein, 19 aa, Entamoeba histolytica
LNPLWSPNFKTMFQLICSN

SEQ ID NO: 2687050 - protein, 18 aa, Entamoeba histolytica
LNPTWGDSFEFYNVTPGT

SEQ ID NO: 2687051 - protein, 26 aa, Entamoeba histolytica
LNPYESFTIAFPIHLKKEFIEEKVEE

SEQ ID NO: 2687052 - protein, 18 aa, Entamoeba histolytica
LNQFKSIDFLNGKKVTLR

SEQ ID NO: 2687053 - protein, 19 aa, Entamoeba histolytica
LNQFMSLHIGDYIKENGEN

SEQ ID NO: 2687054 - protein, 20 aa, Entamoeba histolytica
LNQIYTCKNLEEIIEDEYHP

SEQ ID NO: 2687055 - protein, 17 aa, Entamoeba histolytica
LNQLAIKYKHLYLTNTQ

SEQ ID NO: 2687056 - protein, 17 aa, Entamoeba histolytica
LNQLIGIVSTWELFCTI

SEQ ID NO: 2687057 - protein, 21 aa, Entamoeba histolytica
LNQMKRGICITVKKMCNHLLL

SEQ ID NO: 2687058 - protein, 22 aa, Entamoeba histolytica
LNQRFLLKMVIQAADAFKKQNL

SEQ ID NO: 2687059 - protein, 24 aa, Entamoeba histolytica
LNQYPNTACCFIKKDVLIMTDSKR

SEQ ID NO: 2687060 - protein, 23 aa, Entamoeba histolytica
LNRAALSFNWLVEYLEQLGYTVE

SEQ ID NO: 2687061 - protein, 18 aa, Entamoeba histolytica
LNRAALTFNYLIKLLESL

SEQ ID NO: 2687062 - protein, 19 aa, Entamoeba histolytica
LNRFIELLTSPGLINNDFN

SEQ ID NO: 2687063 - protein, 19 aa, Entamoeba histolytica
LNRLLRLIMDPLLADYITA

SEQ ID NO: 2687064 - protein, 20 aa, Entamoeba histolytica
LNRNFGFPVFCTVIEANTIE

SEQ ID NO: 2687065 - protein, 24 aa, Entamoeba histolytica
LNRNRLDELIPIFEEKRLYSTVFV

SEQ ID NO: 2687066 - protein, 24 aa, Entamoeba histolytica
LNRSLCNRTNFSIFIVTGTTDVFG

SEQ ID NO: 2687067 - protein, 17 aa, Entamoeba histolytica
LNRTVLNNVQWTDKPVE

SEQ ID NO: 2687068 - protein, 24 aa, Entamoeba histolytica
LNRVLSCRCDIIIKNGQVEAISIV

SEQ ID NO: 2687069 - protein, 24 aa, Entamoeba histolytica
LNSCEIKEGIEFDSPIKNEEKTGK

SEQ ID NO: 2687070 - protein, 20 aa, Entamoeba histolytica
LNSCSLKAHLISELLKKLSA

SEQ ID NO: 2687071 - protein, 17 aa, Entamoeba histolytica
LNSFLIMPVQRVPRYRL

SEQ ID NO: 2687072 - protein, 19 aa, Entamoeba histolytica
LNSFNAWNKKFAKKCNKKT

SEQ ID NO: 2687073 - protein, 22 aa, Entamoeba histolytica
LNSIYFSSFVVHYLGALKPLLD

SEQ ID NO: 2687074 - protein, 21 aa, Entamoeba histolytica
LNSKSQWTRNYCIAICVNISD

SEQ ID NO: 2687075 - protein, 23 aa, Entamoeba histolytica
LNSLKHPVPLLLLMTRHDICPTI

SEQ ID NO: 2687076 - protein, 24 aa, Entamoeba histolytica
LNSLLDHRATVFIPELNIEVKCPP

SEQ ID NO: 2687077 - protein, 18 aa, Entamoeba histolytica
LNSLMIHLCPSRFSHFLM

SEQ ID NO: 2687078 - protein, 24 aa, Entamoeba histolytica
LNSNIYIHYAWEMFGLEDNLKSKR

SEQ ID NO: 2687079 - protein, 24 aa, Entamoeba histolytica
LNSRKKLTLIILYRGVVVTDVPVI

SEQ ID NO: 2687080 - protein, 22 aa, Entamoeba histolytica
LNSSLKRALLIAHFNSIGLHKI

SEQ ID NO: 2687081 - protein, 26 aa, Entamoeba histolytica
LNSTLSWICIYLTKSLRNERNEKVNQ

SEQ ID NO: 2687082 - protein, 18 aa, Entamoeba histolytica
LNSTWYAKLGMWHKALNK

SEQ ID NO: 2687083 - protein, 28 aa, Entamoeba histolytica
LNSVATFYPRLHIIHSFINSDNKETIIE

SEQ ID NO: 2687084 - protein, 18 aa, Entamoeba histolytica
LNSVDIVISFDLLDTTAE

SEQ ID NO: 2687085 - protein, 17 aa, Entamoeba histolytica
LNTCPLPHDSIFTKTQG

SEQ ID NO: 2687086 - protein, 22 aa, Entamoeba histolytica
LNTEGKPVFNILCTNGNNELGG

SEQ ID NO: 2687087 - protein, 29 aa, Entamoeba histolytica
LNTFIPLYTYKYLRPWKIVHYKNIVVTLY

SEQ ID NO: 2687088 - protein, 29 aa, Entamoeba histolytica
LNTFSLKKNWMCSLCICPNTSDDVVVINS

SEQ ID NO: 2687089 - protein, 23 aa, Entamoeba histolytica
LNTLESMDWAILGMRFLFTDMKY

SEQ ID NO: 2687090 - protein, 20 aa, Entamoeba histolytica
LNTLFSLEFSSNVLIGDFHT

SEQ ID NO: 2687091 - protein, 33 aa, Entamoeba histolytica
LNTLGFVITEVFFKGQPLCFGKKIDKYVDEQFQ

SEQ ID NO: 2687092 - protein, 25 aa, Entamoeba histolytica
LNTLKENRFAVGIDSRMKEFINDLV

SEQ ID NO: 2687093 - protein, 24 aa, Entamoeba histolytica
LNTLKPKYWISGHMHCEYHAEEGP

SEQ ID NO: 2687094 - protein, 18 aa, Entamoeba histolytica
LNTLLKKNLRSIDYKYCL

SEQ ID NO: 2687095 - protein, 18 aa, Entamoeba histolytica
LNTLTGHVYLQFQSAIQS

SEQ ID NO: 2687096 - protein, 18 aa, Entamoeba histolytica
LNTTFGFYLEAINKVGLD

SEQ ID NO: 2687097 - protein, 17 aa, Entamoeba histolytica
LNTVLLIKIVPLIKRDV

SEQ ID NO: 2687098 - protein, 24 aa, Entamoeba histolytica
LNTYKYRAFIGFRMHKDDKDTVRI

SEQ ID NO: 2687099 - protein, 18 aa, Entamoeba histolytica
LNVAELFRDLFSVMNKDF

SEQ ID NO: 2687100 - protein, 26 aa, Entamoeba histolytica
LNVALKRAKSGLIIIGNIQTLITSKV

SEQ ID NO: 2687101 - protein, 17 aa, Entamoeba histolytica
LNVALRWIDVAKPMTRL

SEQ ID NO: 2687102 - protein, 26 aa, Entamoeba histolytica
LNVFKSCKKGVLLFRLTINNKPTSFA

SEQ ID NO: 2687103 - protein, 22 aa, Entamoeba histolytica
LNVIFPYQFITSILLACSRKKS

SEQ ID NO: 2687104 - protein, 21 aa, Entamoeba histolytica
LNVITISSPVIFNILIDHINI

SEQ ID NO: 2687105 - protein, 26 aa, Entamoeba histolytica
LNVLKKWTGLEHFDLVFEYAVDGYDR

SEQ ID NO: 2687106 - protein, 17 aa, Entamoeba histolytica
LNVLLGMSLIDIELPLT

SEQ ID NO: 2687107 - protein, 18 aa, Entamoeba histolytica
LNVLSCENITLKIFPLFN

SEQ ID NO: 2687108 - protein, 19 aa, Entamoeba histolytica
LNVPDWLLKEIGTVQRLSN

SEQ ID NO: 2687109 - protein, 24 aa, Entamoeba histolytica
LNVYCSRLPFVQLTCLKQLQVYNS

SEQ ID NO: 2687110 - protein, 23 aa, Entamoeba histolytica
LNVYKLTVLLLISLKKTETANST

SEQ ID NO: 2687111 - protein, 21 aa, Entamoeba histolytica
LNWLIRRHHLGVNSILADEMG

SEQ ID NO: 2687112 - protein, 19 aa, Entamoeba histolytica
LNYCILRGLYTIRGELTTT

SEQ ID NO: 2687113 - protein, 17 aa, Entamoeba histolytica
LNYFKKHHIPIALATST

SEQ ID NO: 2687114 - protein, 19 aa, Entamoeba histolytica
LNYIKSTTFSPVDTNISYT

SEQ ID NO: 2687115 - protein, 19 aa, Entamoeba histolytica
LNYKIPVWFLNRQKDNKDG

SEQ ID NO: 2687116 - protein, 17 aa, Entamoeba histolytica
LNYKQYIGYTWISNENV

SEQ ID NO: 2687117 - protein, 22 aa, Entamoeba histolytica
LNYLDCIIDFCPENSIPEQTMD

SEQ ID NO: 2687118 - protein, 26 aa, Entamoeba histolytica
LNYLKKLKLCLYNYCKDVKAKGNRLL

SEQ ID NO: 2687119 - protein, 25 aa, Entamoeba histolytica
LNYLLDLLREFGFFFDSIYAKKTCK

SEQ ID NO: 2687120 - protein, 17 aa, Entamoeba histolytica
LNYQRMFFVKYTGIESF

SEQ ID NO: 2687121 - protein, 25 aa, Entamoeba histolytica
LNYQVIYCVRHIPLISEFLNELKPD

SEQ ID NO: 2687122 - protein, 17 aa, Entamoeba histolytica
LPAIFDVSHILVFQNKV

SEQ ID NO: 2687123 - protein, 21 aa, Entamoeba histolytica
LPAKEFIEALLAVPNATKVDQ

SEQ ID NO: 2687124 - protein, 18 aa, Entamoeba histolytica
LPAKYVIHVVGPIVDTLK

SEQ ID NO: 2687125 - protein, 17 aa, Entamoeba histolytica
LPCKQICEILFNKFTGR

SEQ ID NO: 2687126 - protein, 17 aa, Entamoeba histolytica
LPCTVCGDIHGQFHDLK

SEQ ID NO: 2687127 - protein, 22 aa, Entamoeba histolytica
LPDCILPCIVSTALELIKRHEP

SEQ ID NO: 2687128 - protein, 24 aa, Entamoeba histolytica
LPDERCSNCFHSIEAHTLPVELFN

SEQ ID NO: 2687129 - protein, 18 aa, Entamoeba histolytica
LPDIKKYFPENCKKKVTA

SEQ ID NO: 2687130 - protein, 44 aa, Entamoeba histolytica
LPDILPGYLPTASAFPFFISLFSEIKWDDEISCLKEIAINIGKY

SEQ ID NO: 2687131 - protein, 20 aa, Entamoeba histolytica
LPDIPLQQTLPMLKQENVSE

SEQ ID NO: 2687132 - protein, 19 aa, Entamoeba histolytica
LPDSLLFSNQLHKISLSHF

SEQ ID NO: 2687133 - protein, 18 aa, Entamoeba histolytica
LPECIQISFIRLSSYHQF

SEQ ID NO: 2687134 - protein, 18 aa, Entamoeba histolytica
LPECQVLLESSEKIDEDI

SEQ ID NO: 2687135 - protein, 24 aa, Entamoeba histolytica
LPEDMKRLQLPQMIQLIVNEFHEK

SEQ ID NO: 2687136 - protein, 26 aa, Entamoeba histolytica
LPEEIKKNEPVICLGQEKLKEQQLFN

SEQ ID NO: 2687137 - protein, 21 aa, Entamoeba histolytica
LPEELYPFISEFHGYLMDSFG

SEQ ID NO: 2687138 - protein, 20 aa, Entamoeba histolytica
LPEFHALCCADNMPQTMHNL

SEQ ID NO: 2687139 - protein, 17 aa, Entamoeba histolytica
LPEIIKKLVMRRRQIVS

SEQ ID NO: 2687140 - protein, 22 aa, Entamoeba histolytica
LPEINELVLWTLKCCGLYYQRL

SEQ ID NO: 2687141 - protein, 17 aa, Entamoeba histolytica
LPEKGEMGISPSCYQFN

SEQ ID NO: 2687142 - protein, 24 aa, Entamoeba histolytica
LPEKLINTKLVFYDRFVKPINKDD

SEQ ID NO: 2687143 - protein, 18 aa, Entamoeba histolytica
LPEKRLSQSEVMLSSLQT

SEQ ID NO: 2687144 - protein, 25 aa, Entamoeba histolytica
LPEMEPGKDWLLFPNMGAYTISMAT

SEQ ID NO: 2687145 - protein, 21 aa, Entamoeba histolytica
LPENILSCLYQSIKGYDQSYF

SEQ ID NO: 2687146 - protein, 21 aa, Entamoeba histolytica
LPEPELIFLQQFYEQYTSSSQ

SEQ ID NO: 2687147 - protein, 18 aa, Entamoeba histolytica
LPEQIKPIIEQEEEDLRV

SEQ ID NO: 2687148 - protein, 22 aa, Entamoeba histolytica
LPERPLNGTLVWDKENTRISLL

SEQ ID NO: 2687149 - protein, 29 aa, Entamoeba histolytica
LPESIILPRGLTFFDCLSIQKSWNALPLS

SEQ ID NO: 2687150 - protein, 17 aa, Entamoeba histolytica
LPFKEVLFHSIVRDAQG

SEQ ID NO: 2687151 - protein, 28 aa, Entamoeba histolytica
LPFNCLDVYVNHCIPVFIVITNGVLSPL

SEQ ID NO: 2687152 - protein, 24 aa, Entamoeba histolytica
LPFSENFTVFSYLYLLNSLVKKYG

SEQ ID NO: 2687153 - protein, 25 aa, Entamoeba histolytica
LPGESKKGTGIIVFRQIMKKGCDVN

SEQ ID NO: 2687154 - protein, 22 aa, Entamoeba histolytica
LPGGPYYSAPFVLQAREKRSIK

SEQ ID NO: 2687155 - protein, 23 aa, Entamoeba histolytica
LPGKKGCTLDCTIQCIRSVYHNV

SEQ ID NO: 2687156 - protein, 19 aa, Entamoeba histolytica
LPGLYWVGVMDYELKNYDV

SEQ ID NO: 2687157 - protein, 18 aa, Entamoeba histolytica
LPGMPIDYSAKVALTRFH

SEQ ID NO: 2687158 - protein, 20 aa, Entamoeba histolytica
LPGQIHPGLGIGHEIEEMLM

SEQ ID NO: 2687159 - protein, 20 aa, Entamoeba histolytica
LPGRPWVVREVCLKHGNGCK

SEQ ID NO: 2687160 - protein, 18 aa, Entamoeba histolytica
LPGSYKLWYHYLQTILIN

SEQ ID NO: 2687161 - protein, 17 aa, Entamoeba histolytica
LPGVIKSLAMPDAHSGY

SEQ ID NO: 2687162 - protein, 21 aa, Entamoeba histolytica
LPHCEICNLPGTIGTFCPNST

SEQ ID NO: 2687163 - protein, 19 aa, Entamoeba histolytica
LPHHCDFVMNNKNDDKGFI

SEQ ID NO: 2687164 - protein, 17 aa, Entamoeba histolytica
LPHIPSLDIRDGAVDLL

SEQ ID NO: 2687165 - protein, 25 aa, Entamoeba histolytica
LPHQLRFLMVYGCKDIVALDNLKNG

SEQ ID NO: 2687166 - protein, 17 aa, Entamoeba histolytica
LPHTLLLGLLHKDPIIN

SEQ ID NO: 2687167 - protein, 23 aa, Entamoeba histolytica
LPHYLFLQLNRFDSFDVNVMKIN

SEQ ID NO: 2687168 - protein, 17 aa, Entamoeba histolytica
LPIACEIIDSFKNRMSI

SEQ ID NO: 2687169 - protein, 25 aa, Entamoeba histolytica
LPIECFKLFLHRKCSNDLQYYKQFL

SEQ ID NO: 2687170 - protein, 20 aa, Entamoeba histolytica
LPIEIINSFASIKMKKTDYQ

SEQ ID NO: 2687171 - protein, 21 aa, Entamoeba histolytica
LPIEILEELPIELFKEKENAV

SEQ ID NO: 2687172 - protein, 23 aa, Entamoeba histolytica
LPIFFKKKEIITSIKENQINIII

SEQ ID NO: 2687173 - protein, 17 aa, Entamoeba histolytica
LPIFLLNKMNSVISYTI

SEQ ID NO: 2687174 - protein, 20 aa, Entamoeba histolytica
LPIHDMFQALLTLINEVIPA

SEQ ID NO: 2687175 - protein, 20 aa, Entamoeba histolytica
LPIIICTPFISSVQCVEFLA

SEQ ID NO: 2687176 - protein, 24 aa, Entamoeba histolytica
LPIIKELKWNGVFNQIPKEEDILK

SEQ ID NO: 2687177 - protein, 17 aa, Entamoeba histolytica
LPIIPLKTKRSICNNTY

SEQ ID NO: 2687178 - protein, 23 aa, Entamoeba histolytica
LPIKCSYCHNPFCNKCIKTHQCD

SEQ ID NO: 2687179 - protein, 24 aa, Entamoeba histolytica
LPIMPFKEPLPFIPDDIKMTEGFS

SEQ ID NO: 2687180 - protein, 19 aa, Entamoeba histolytica
LPINILRYVQPLNQSVEFL

SEQ ID NO: 2687181 - protein, 17 aa, Entamoeba histolytica
LPIPLILNTSKIYHMIE

SEQ ID NO: 2687182 - protein, 30 aa, Entamoeba histolytica; identical to SEQ ID NO: 2494970

SEQ ID NO: 2687183 - protein, 19 aa, Entamoeba histolytica
LPIPMNIVTEINLNEEMNL

SEQ ID NO: 2687184 - protein, 19 aa, Entamoeba histolytica
LPIPPSRFRQLNKFGDLIS

SEQ ID NO: 2687185 - protein, 21 aa, Entamoeba histolytica
LPIRYYQNFIKPFPHCHYCIL

SEQ ID NO: 2687186 - protein, 25 aa, Entamoeba histolytica
  misc_feature (19)..(25): Xaa can be any naturally occurring amino acid
LPITLLRFAQPLKFPKQIXXXXXXX

SEQ ID NO: 2687187 - protein, 21 aa, Entamoeba histolytica
LPIVAIFPCDSTSFITAFPDA

SEQ ID NO: 2687188 - protein, 22 aa, Entamoeba histolytica
LPKEFMKPYVMVFVSGLLTISS

SEQ ID NO: 2687189 - protein, 19 aa, Entamoeba histolytica
LPKETRLTLSIYMTDSPIN

SEQ ID NO: 2687190 - protein, 17 aa, Entamoeba histolytica
LPKEWTLMRQSDLGTIT

SEQ ID NO: 2687191 - protein, 24 aa, Entamoeba histolytica
LPKEYCSILKYIIEHETINLNKQE

SEQ ID NO: 2687192 - protein, 23 aa, Entamoeba histolytica
LPKISKSLFVFPFQTTTTIPHLS

SEQ ID NO: 2687193 - protein, 19 aa, Entamoeba histolytica
LPKKCLEAPQTPVIQDDNA

SEQ ID NO: 2687194 - protein, 18 aa, Entamoeba histolytica
LPKKEYPKIYNILCAINY

SEQ ID NO: 2687195 - protein, 22 aa, Entamoeba histolytica
LPKKIVICGCPYSGKTSLIRRF

SEQ ID NO: 2687196 - protein, 22 aa, Entamoeba histolytica
LPKKSVYRLGNISQHVVMIPEL

SEQ ID NO: 2687197 - protein, 21 aa, Entamoeba histolytica
LPKKTCDIIFAGIKSIYFTNK

SEQ ID NO: 2687198 - protein, 24 aa, Entamoeba histolytica
LPKKTLKGKLGWSGAGSSKTTNQI

SEQ ID NO: 2687199 - protein, 24 aa, Entamoeba histolytica
LPKLPPKRKSGFVKESVQQKQQPD

SEQ ID NO: 2687200 - protein, 18 aa, Entamoeba histolytica
LPKLSNSYLLKRGGSPLK

SEQ ID NO: 2687201 - protein, 18 aa, Entamoeba histolytica
LPKLSRPTLKRTIPGAFS

SEQ ID NO: 2687202 - protein, 31 aa, Entamoeba histolytica
LPKLTNLYCHGISLRRGYSFKGNDDLCISIN

SEQ ID NO: 2687203 - protein, 19 aa, Entamoeba histolytica
LPKRSRLSNVVAIAASTLV

SEQ ID NO: 2687204 - protein, 18 aa, Entamoeba histolytica
LPKYAHVSLKSHGIKLIN

SEQ ID NO: 2687205 - protein, 17 aa, Entamoeba histolytica
LPKYKSLDFDGVCSPGS

SEQ ID NO: 2687206 - protein, 17 aa, Entamoeba histolytica
LPLARIPLLKMKGIQDE

SEQ ID NO: 2687207 - protein, 17 aa, Entamoeba histolytica
LPLCFTIFSAPNYCDQY

SEQ ID NO: 2687208 - protein, 27 aa, Entamoeba histolytica
LPLCLPFKPLFFFNRENYLVILNEKEI

SEQ ID NO: 2687209 - protein, 17 aa, Entamoeba histolytica
LPLDARFRIKKPIPNTG

SEQ ID NO: 2687210 - protein, 18 aa, Entamoeba histolytica
LPLFPGADPREFWQRAEE

SEQ ID NO: 2687211 - protein, 17 aa, Entamoeba histolytica
LPLFTTDISNQWVSNIF

SEQ ID NO: 2687212 - protein, 19 aa, Entamoeba histolytica
LPLHEGLVFVCPTCESFCC

SEQ ID NO: 2687213 - protein, 19 aa, Entamoeba histolytica
LPLHIIEFHSSFSQYLSVV

SEQ ID NO: 2687214 - protein, 26 aa, Entamoeba histolytica
LPLIKLHDFSCGIVLENGKRTNECVG

SEQ ID NO: 2687215 - protein, 19 aa, Entamoeba histolytica
LPLILILRNRLNYALNGRE

SEQ ID NO: 2687216 - protein, 18 aa, Entamoeba histolytica
LPLIRRIPPFHGLPKELE

SEQ ID NO: 2687217 - protein, 19 aa, Entamoeba histolytica
LPLKGKVPATVDMKITSLI

SEQ ID NO: 2687218 - protein, 21 aa, Entamoeba histolytica
LPLKLGALVMLLKNTQPEIGL

SEQ ID NO: 2687219 - protein, 21 aa, Entamoeba histolytica
LPLNECLKNSVDVRQTLTEYR

SEQ ID NO: 2687220 - protein, 18 aa, Entamoeba histolytica
LPLSALIDQRYFCVHGGL

SEQ ID NO: 2687221 - protein, 21 aa, Entamoeba histolytica
LPLSHPELYEEIGIKPPKGVI

SEQ ID NO: 2687222 - protein, 20 aa, Entamoeba histolytica
LPLTICYLSINACYCLNSIV

SEQ ID NO: 2687223 - protein, 18 aa, Entamoeba histolytica
LPLTQIIRPFKVISPIER

SEQ ID NO: 2687224 - protein, 17 aa, Entamoeba histolytica
LPLTSGMIFEDLNYRHW

SEQ ID NO: 2687225 - protein, 19 aa, Entamoeba histolytica
LPLTSITTLMEWNNGKKAH

SEQ ID NO: 2687226 - protein, 18 aa, Entamoeba histolytica
LPLVAGRHGLDYKTSINR

SEQ ID NO: 2687227 - protein, 17 aa, Entamoeba histolytica
LPLYSFVNLLSVSINSE

SEQ ID NO: 2687228 - protein, 20 aa, Entamoeba histolytica
LPMGNCIEISEGRWFEFDNE

SEQ ID NO: 2687229 - protein, 18 aa, Entamoeba histolytica
LPMNCLQLSDASRRKSSS

SEQ ID NO: 2687230 - protein, 19 aa, Entamoeba histolytica
LPMSLSYIGNAVFSNCFNL

SEQ ID NO: 2687231 - protein, 21 aa, Entamoeba histolytica
LPNCGDVGIFLNCKKENVFVF

SEQ ID NO: 2687232 - protein, 29 aa, Entamoeba histolytica
LPNCIRKLGKELFYGCSNLTLIDFGYGWN

SEQ ID NO: 2687233 - protein, 24 aa, Entamoeba histolytica
LPNCLKRLKITGLLVDLLIPNIDT

SEQ ID NO: 2687234 - protein, 21 aa, Entamoeba histolytica
LPNEFSNLISLTTLHCSENKF

SEQ ID NO: 2687235 - protein, 18 aa, Entamoeba histolytica
LPNKRLRDVSLRVKYMKA

SEQ ID NO: 2687236 - protein, 20 aa, Entamoeba histolytica
LPNPLIPYNLYEEFIELRNN

SEQ ID NO: 2687237 - protein, 27 aa, Entamoeba histolytica
LPNPRRVKTGIQFKTYFIHFTGDFVIP

SEQ ID NO: 2687238 - protein, 21 aa, Entamoeba histolytica
LPNSLKFVGGGAFLNCSSLTR

SEQ ID NO: 2687239 - protein, 21 aa, Entamoeba histolytica
LPNTLPLPQIVVVGSQSSGKS

SEQ ID NO: 2687240 - protein, 19 aa, Entamoeba histolytica
LPPDVTAAVYKKFLRELPN

SEQ ID NO: 2687241 - protein, 20 aa, Entamoeba histolytica
LPPEDSYCKIRNIICEVNEI

SEQ ID NO: 2687242 - protein, 28 aa, Entamoeba histolytica
LPPEHLTCLKYLVSFCSHLVKSEKSKMT

SEQ ID NO: 2687243 - protein, 19 aa, Entamoeba histolytica
LPPEIPQPMMSELPYDGEV

SEQ ID NO: 2687244 - protein, 26 aa, Entamoeba histolytica
LPPFYHCILLLPHLIHYIPKSSVIEY

SEQ ID NO: 2687245 - protein, 19 aa, Entamoeba histolytica
LPPGYICNRCHKPGHYIKD

SEQ ID NO: 2687246 - protein, 22 aa, Entamoeba histolytica
LPPHFPDPLILSQFSSPNVLLS

SEQ ID NO: 2687247 - protein, 18 aa, Entamoeba histolytica
LPPHLQHKILFKNKIENR

SEQ ID NO: 2687248 - protein, 27 aa, Entamoeba histolytica
LPPISSRCIKFRFSALPKEIVSNRLQM

SEQ ID NO: 2687249 - protein, 20 aa, Entamoeba histolytica
LPPIYWKYSFEEGIWSDQIP

SEQ ID NO: 2687250 - protein, 25 aa, Entamoeba histolytica
LPPKICKTPEPWTMMKNRHRRLTLD

SEQ ID NO: 2687251 - protein, 29 aa, Entamoeba histolytica
LPPLFDLFGGLCLKCLDSVKYFETISAYS

SEQ ID NO: 2687252 - protein, 21 aa, Entamoeba histolytica
LPPPGTSVVAFISKLYELVNN

SEQ ID NO: 2687253 - protein, 19 aa, Entamoeba histolytica
LPPSTVPSFVPPPPPLSED

SEQ ID NO: 2687254 - protein, 20 aa, Entamoeba histolytica
LPQCKNALISLLLDEQLEEY

SEQ ID NO: 2687255 - protein, 19 aa, Entamoeba histolytica
LPQNIAYKISQRIQSSLAV

SEQ ID NO: 2687256 - protein, 20 aa, Entamoeba histolytica
LPQRLLKVFETCQKIPYSLI

SEQ ID NO: 2687257 - protein, 18 aa, Entamoeba histolytica
LPQVKALYPYTAANDEEL

SEQ ID NO: 2687258 - protein, 23 aa, Entamoeba histolytica
LPRHVLIPSFLIDSGIDSETRHC

SEQ ID NO: 2687259 - protein, 18 aa, Entamoeba histolytica
LPRKFIKFVEGPEVKNKL

SEQ ID NO: 2687260 - protein, 22 aa, Entamoeba histolytica
LPSCKDYIFYCKKCGERCIQIT

SEQ ID NO: 2687261 - protein, 24 aa, Entamoeba histolytica
LPSEARKERSLSYSCVTPRTNRKR

SEQ ID NO: 2687262 - protein, 23 aa, Entamoeba histolytica
LPSFNYDRIELIKYLSSNLSTSK

SEQ ID NO: 2687263 - protein, 20 aa, Entamoeba histolytica
LPSIEIGYFASFDIYSYANG

SEQ ID NO: 2687264 - protein, 27 aa, Entamoeba histolytica
LPSILPIELHFKLLSIKSIFLNIYSHL

SEQ ID NO: 2687265 - protein, 17 aa, Entamoeba histolytica
LPSIPIVNAQQLNKQTP

SEQ ID NO: 2687266 - protein, 17 aa, Entamoeba histolytica
LPSIYIPVLLNGKVIGK

SEQ ID NO: 2687267 - protein, 18 aa, Entamoeba histolytica
LPSIYYIHFDDIEIVEKL

SEQ ID NO: 2687268 - protein, 19 aa, Entamoeba histolytica
LPSKFRVTKPFNFFRKVQT

SEQ ID NO: 2687269 - protein, 19 aa, Entamoeba histolytica
LPSKSRNAFLQHLNQSTTS

SEQ ID NO: 2687270 - protein, 19 aa, Entamoeba histolytica
LPSPIFSYSDRNMFLSAIS

SEQ ID NO: 2687271 - protein, 19 aa, Entamoeba histolytica
LPSPQRVLFLSSLHHLIPL

SEQ ID NO: 2687272 - protein, 20 aa, Entamoeba histolytica
LPSPVIPLNCYDKFVDEQTV

SEQ ID NO: 2687273 - protein, 17 aa, Entamoeba histolytica
LPSRPKTGFGTPTKKKS

SEQ ID NO: 2687274 - protein, 24 aa, Entamoeba histolytica
LPSSFSKPTLVQVFALSKNFYIVY

SEQ ID NO: 2687275 - protein, 19 aa, Entamoeba histolytica
LPSSIQFCSTIKRLIINGD

SEQ ID NO: 2687276 - protein, 19 aa, Entamoeba histolytica
LPSSLLFIGEKSFDGCVVL

SEQ ID NO: 2687277 - protein, 19 aa, Entamoeba histolytica
LPSSLRFLSRSCFEKCTSL

SEQ ID NO: 2687278 - protein, 17 aa, Entamoeba histolytica
LPSTLKFVLKESEPYKG

SEQ ID NO: 2687279 - protein, 17 aa, Entamoeba histolytica
LPTAISWSETYNPELRQ

SEQ ID NO: 2687280 - protein, 25 aa, Entamoeba histolytica
LPTGFFKLKSLRFISLTNTLVDSFN

SEQ ID NO: 2687281 - protein, 23 aa, Entamoeba histolytica
LPTIKRPLTFPSIPTHNNGLDNE

SEQ ID NO: 2687282 - protein, 22 aa, Entamoeba histolytica
LPTKPFSCIVFKKSSLYQIIPF

SEQ ID NO: 2687283 - protein, 26 aa, Entamoeba histolytica
LPTKRLRDISLRLQFMKAKEKTITLT

SEQ ID NO: 2687284 - protein, 21 aa, Entamoeba histolytica
LPTTFNLPLTGKKKSRLRQDV

SEQ ID NO: 2687285 - protein, 20 aa, Entamoeba histolytica
LPTTLPLIFRNIDSRFFQQF

SEQ ID NO: 2687286 - protein, 30 aa, Entamoeba histolytica
LPVDSKVLFKIICFICSFITENEQIQKMVS

SEQ ID NO: 2687287 - protein, 19 aa, Entamoeba histolytica
LPVFVCKQMVGNVVLNMNN

SEQ ID NO: 2687288 - protein, 20 aa, Entamoeba histolytica
LPVLEAPSFSEVGKGQEVYS

SEQ ID NO: 2687289 - protein, 20 aa, Entamoeba histolytica
LPVNICRFSPDGTILAVGND

SEQ ID NO: 2687290 - protein, 27 aa, Entamoeba histolytica
LPVPLVMHMMRCVINALRIPGNQFEFG

SEQ ID NO: 2687291 - protein, 19 aa, Entamoeba histolytica
LPVQTEFPLIQPPQEGILL

SEQ ID NO: 2687292 - protein, 18 aa, Entamoeba histolytica
LPYCHVIDSKVFVVHGGI

SEQ ID NO: 2687293 - protein, 21 aa, Entamoeba histolytica
LPYFAQFDCDSFAPKNEEVIE

SEQ ID NO: 2687294 - protein, 17 aa, Entamoeba histolytica
LPYFKKLFIECNGDDLL

SEQ ID NO: 2687295 - protein, 19 aa, Entamoeba histolytica
LPYFYTFKVNAKGRWIGRT

SEQ ID NO: 2687296 - protein, 21 aa, Entamoeba histolytica
LPYSHPIDMWSLGCILPELLT

SEQ ID NO: 2687297 - protein, 18 aa, Entamoeba histolytica
LQALIKRRVYSLEEKDIK

SEQ ID NO: 2687298 - protein, 18 aa, Entamoeba histolytica
LQCLHTQTGVEFLVIASP

SEQ ID NO: 2687299 - protein, 20 aa, Entamoeba histolytica
LQCMKDAKLRKKDISDVVLV

SEQ ID NO: 2687300 - protein, 28 aa, Entamoeba histolytica
LQCQSELPTIINLCYILSIIGKEEKAPL

SEQ ID NO: 2687301 - protein, 26 aa, Entamoeba histolytica
LQCRSSCAYETVFARNFIGINDFSAN

SEQ ID NO: 2687302 - protein, 17 aa, Entamoeba histolytica
LQCSNLIKEMDKQNTND

SEQ ID NO: 2687303 - protein, 24 aa, Entamoeba histolytica
LQCVCKNCNRILLTNEERDFYLRR

SEQ ID NO: 2687304 - protein, 27 aa, Entamoeba histolytica
LQDALKLNAILILPPVYCINDIDLTKD

SEQ ID NO: 2687305 - protein, 20 aa, Entamoeba histolytica
LQDAVPIRFSQELRAYNCII

SEQ ID NO: 2687306 - protein, 18 aa, Entamoeba histolytica
LQDILSLKLKYIEGRDPK

SEQ ID NO: 2687307 - protein, 20 aa, Entamoeba histolytica
LQDQFLLDGFNFLRGYNDIV

SEQ ID NO: 2687308 - protein, 25 aa, Entamoeba histolytica
LQEGLKSTIILITYMQSFQNFIPPH

SEQ ID NO: 2687309 - protein, 25 aa, Entamoeba histolytica
LQEKGSCNVKLIGLYVKTLGNKILV

SEQ ID NO: 2687310 - protein, 22 aa, Entamoeba histolytica
LQEKLKALSLSVSKIKLSNDQK

SEQ ID NO: 2687311 - protein, 19 aa, Entamoeba histolytica
LQELGDFNSAFGIFDGLLH

SEQ ID NO: 2687312 - protein, 18 aa, Entamoeba histolytica
LQELLRVGCRTDNELIAI

SEQ ID NO: 2687313 - protein, 23 aa, Entamoeba histolytica
LQELYLWLMEPINVIVTNELEYF

SEQ ID NO: 2687314 - protein, 24 aa, Entamoeba histolytica
LQEMPRTSFGKVYVPKLKEIVKDL

SEQ ID NO: 2687315 - protein, 18 aa, Entamoeba histolytica
LQENCLHTFLQNRRASQE

SEQ ID NO: 2687316 - protein, 21 aa, Entamoeba histolytica
LQEQFSLVVYFSYFMNYAKKV

SEQ ID NO: 2687317 - protein, 19 aa, Entamoeba histolytica
LQETLLCLIEKNAQIELFS

SEQ ID NO: 2687318 - protein, 18 aa, Entamoeba histolytica
LQETMKLKLKQHFHNILL

SEQ ID NO: 2687319 - protein, 17 aa, Entamoeba histolytica
LQETRIALVKEVLSKHP

SEQ ID NO: 2687320 - protein, 25 aa, Entamoeba histolytica
LQEWYRMLWDYDYFEYIRDVMKLNK

SEQ ID NO: 2687321 - protein, 20 aa, Entamoeba histolytica
LQFGEDIIDLPLQILETKQT

SEQ ID NO: 2687322 - protein, 19 aa, Entamoeba histolytica
LQFSVDIKRNLVTVIESPD

SEQ ID NO: 2687323 - protein, 18 aa, Entamoeba histolytica
LQGIVLECCKHPYGCRVV

SEQ ID NO: 2687324 - protein, 25 aa, Entamoeba histolytica
LQGPFLIVVPLSMIEHWHREILEWT

SEQ ID NO: 2687325 - protein, 23 aa, Entamoeba histolytica
LQGSGIELRKRFYQETQPSNEVF

SEQ ID NO: 2687326 - protein, 17 aa, Entamoeba histolytica
LQGTIISEEEIMLCEMC

SEQ ID NO: 2687327 - protein, 17 aa, Entamoeba histolytica
LQGTYMFNKHRVDIETW

SEQ ID NO: 2687328 - protein, 23 aa, Entamoeba histolytica
LQHLTDLLISFGYCTVDNFMTMF

SEQ ID NO: 2687329 - protein, 17 aa, Entamoeba histolytica
LQICELTTALFCEKYID

SEQ ID NO: 2687330 - protein, 17 aa, Entamoeba histolytica
LQIKALIAINNEFEEYE

SEQ ID NO: 2687331 - protein, 19 aa, Entamoeba histolytica
LQIKGCNLAIHTFNEITIE

SEQ ID NO: 2687332 - protein, 24 aa, Entamoeba histolytica
LQIKTKVIFIIDWLHKEDIEEVND

SEQ ID NO: 2687333 - protein, 17 aa, Entamoeba histolytica
LQILDVRHCGLPKDIVH

SEQ ID NO: 2687334 - protein, 23 aa, Entamoeba histolytica
LQILELFSVVFKGRLDLSQYSSI

SEQ ID NO: 2687335 - protein, 17 aa, Entamoeba histolytica
LQILINCQINFSSKSDK

SEQ ID NO: 2687336 - protein, 19 aa, Entamoeba histolytica
LQISLKLCRIENIVQEPLC

SEQ ID NO: 2687337 - protein, 19 aa, Entamoeba histolytica
LQKAKAILHRVERGDFYQI

SEQ ID NO: 2687338 - protein, 20 aa, Entamoeba histolytica
LQKEPKFILVTSLRNIIDSL

SEQ ID NO: 2687339 - protein, 24 aa, Entamoeba histolytica
LQKKKAIGSFEWVDGIVVKCMQRG

SEQ ID NO: 2687340 - protein, 23 aa, Entamoeba histolytica
LQKRLMYSFDLFPLNMLNGIKDF

SEQ ID NO: 2687341 - protein, 22 aa, Entamoeba histolytica
LQKTKEWFAPKGQCFPNDYLSL

SEQ ID NO: 2687342 - protein, 26 aa, Entamoeba histolytica
LQKTYNWKKSFGVIKKTKKVVVPIDV

SEQ ID NO: 2687343 - protein, 24 aa, Entamoeba histolytica
LQLDCVCYASLSSMAYAFFVNNCF

SEQ ID NO: 2687344 - protein, 18 aa, Entamoeba histolytica
LQLDIIWTYCNISSETVD

SEQ ID NO: 2687345 - protein, 17 aa, Entamoeba histolytica
LQLFCSNDFLIQTLTRI

SEQ ID NO: 2687346 - protein, 34 aa, Entamoeba histolytica
LQLFKSLELFESFRLRWKGNFIILHSISSLININ

SEQ ID NO: 2687347 - protein, 25 aa, Entamoeba histolytica
LQLHELKIPIGEGIVTDMNAIRPME

SEQ ID NO: 2687348 - protein, 23 aa, Entamoeba histolytica
LQLIKMRLYLTINYNTEFNIVDL

SEQ ID NO: 2687349 - protein, 22 aa, Entamoeba histolytica
LQLKETVSWENYWKTFQRKEQQ

SEQ ID NO: 2687350 - protein, 26 aa, Entamoeba histolytica
LQLKNKKDHIVLCFSSVVDRSQFKSI

SEQ ID NO: 2687351 - protein, 17 aa, Entamoeba histolytica
LQLKSDCVIIYGKEEHL

SEQ ID NO: 2687352 - protein, 22 aa, Entamoeba histolytica
LQLLELLLDFFAQNHVLYSKLE

SEQ ID NO: 2687353 - protein, 17 aa, Entamoeba histolytica
LQLLGYVAYDIASKMDR

SEQ ID NO: 2687354 - protein, 17 aa, Entamoeba histolytica
LQLLSAIFKRNEILRNQ

SEQ ID NO: 2687355 - protein, 18 aa, Entamoeba histolytica
LQLMKWQLFRNLDLPAIQ

SEQ ID NO: 2687356 - protein, 17 aa, Entamoeba histolytica
LQLPGSIIREILKTLDA

SEQ ID NO: 2687357 - protein, 24 aa, Entamoeba histolytica
LQLPTEIFFSFGKIFTLNKIKRII

SEQ ID NO: 2687358 - protein, 42 aa, Entamoeba histolytica
LQLQQCFIASCALYFGMPYSLWRSGVIFKKEIRNEVIDVLIK

SEQ ID NO: 2687359 - protein, 24 aa, Entamoeba histolytica
LQLYPSYIPLSFCELIIQATKLNP

SEQ ID NO: 2687360 - protein, 27 aa, Entamoeba histolytica
LQLYRFGQTVSVCFWSEHWRPSSYYPK

SEQ ID NO: 2687361 - protein, 19 aa, Entamoeba histolytica
LQMADWLSTLQNMRVEDVQ

SEQ ID NO: 2687362 - protein, 17 aa, Entamoeba histolytica
LQMASEFPENLKSIFGI

SEQ ID NO: 2687363 - protein, 19 aa, Entamoeba histolytica
LQMGEVIKVIKKRYPGSEV

SEQ ID NO: 2687364 - protein, 23 aa, Entamoeba histolytica
LQMKKEWLNQLCFALTGEQKTEF

SEQ ID NO: 2687365 - protein, 17 aa, Entamoeba histolytica
LQMLLPYIAPYLNFTTD

SEQ ID NO: 2687366 - protein, 24 aa, Entamoeba histolytica
LQMQEFYRQCCIILDETTKIKENH

SEQ ID NO: 2687367 - protein, 22 aa, Entamoeba histolytica
LQNFPFPFLELMQPFIETDAPY

SEQ ID NO: 2687368 - protein, 23 aa, Entamoeba histolytica
LQNFSLILQRGFNSLASKYTEES

SEQ ID NO: 2687369 - protein, 24 aa, Entamoeba histolytica
LQNKRIGFLNSFFFTKLSKNWSLS

SEQ ID NO: 2687370 - protein, 23 aa, Entamoeba histolytica
LQNLPAPHCCRFLTDSYYICSCT

SEQ ID NO: 2687371 - protein, 21 aa, Entamoeba histolytica
LQNSYAWCFCNICRSVSKQYN

SEQ ID NO: 2687372 - protein, 18 aa, Entamoeba histolytica
LQPLPLPVQTEFPLIQPP

SEQ ID NO: 2687373 - protein, 17 aa, Entamoeba histolytica
LQPRVLINQSIPINSLQ

SEQ ID NO: 2687374 - protein, 24 aa, Entamoeba histolytica
LQPSIEIIQFIYLLKTQTHYYQQI

SEQ ID NO: 2687375 - protein, 17 aa, Entamoeba histolytica
LQQFLPLEEKQEREEAI

SEQ ID NO: 2687376 - protein, 19 aa, Entamoeba histolytica
LQQHYLFHDCILPNQVTLT

SEQ ID NO: 2687377 - protein, 24 aa, Entamoeba histolytica
LQQKYAIKVAYDYAEERMKERKIN

SEQ ID NO: 2687378 - protein, 18 aa, Entamoeba histolytica
LQQLKFYGKEVVVSECTP

SEQ ID NO: 2687379 - protein, 23 aa, Entamoeba histolytica
LQQMLSKMLGFFVIEHQVQQTTE

SEQ ID NO: 2687380 - protein, 23 aa, Entamoeba histolytica
LQQPCSLLKAYSKFYSKFQILKE

SEQ ID NO: 2687381 - protein, 17 aa, Entamoeba histolytica
LQQTLPMLKQENVSEAI

SEQ ID NO: 2687382 - protein, 23 aa, Entamoeba histolytica
LQQYRMGIQMKREIELQSHLNHP

SEQ ID NO: 2687383 - protein, 24 aa, Entamoeba histolytica
LQRFKEYRIMPTIGNVPVIEKSVA

SEQ ID NO: 2687384 - protein, 18 aa, Entamoeba histolytica
LQRGFCLFMDNCKSNHVE

SEQ ID NO: 2687385 - protein, 19 aa, Entamoeba histolytica
LQRKRWEEEERKRLFQINP

SEQ ID NO: 2687386 - protein, 23 aa, Entamoeba histolytica
LQRRIKKNIIYFTQNLLIDFCSE

SEQ ID NO: 2687387 - protein, 19 aa, Entamoeba histolytica
LQRRVDALISKAIEQDKII

SEQ ID NO: 2687388 - protein, 17 aa, Entamoeba histolytica
LQRSAIMATQIAKKRKD

SEQ ID NO: 2687389 - protein, 20 aa, Entamoeba histolytica
LQRSWACYMGDKFNKQVSDE

SEQ ID NO: 2687390 - protein, 18 aa, Entamoeba histolytica
LQRTLCWDPDLRLTPTQA

SEQ ID NO: 2687391 - protein, 18 aa, Entamoeba histolytica
LQRVALVLCLGKPADVYL

SEQ ID NO: 2687392 - protein, 18 aa, Entamoeba histolytica
LQSAVFEGCCSLKEINIP

SEQ ID NO: 2687393 - protein, 19 aa, Entamoeba histolytica
LQSDCLKKWTGKKQCEEIY

SEQ ID NO: 2687394 - protein, 19 aa, Entamoeba histolytica
LQSFYIGVLNKFYDIRIEK

SEQ ID NO: 2687395 - protein, 24 aa, Entamoeba histolytica
LQSKECIFSEIIRYVEKPWYLKFN

SEQ ID NO: 2687396 - protein, 20 aa, Entamoeba histolytica
LQSLCFEKCCNTMTYFFSCL

SEQ ID NO: 2687397 - protein, 19 aa, Entamoeba histolytica
LQSLEGLKIVGKIPGAAAW

SEQ ID NO: 2687398 - protein, 17 aa, Entamoeba histolytica
LQSLFVDSIMKFSEKLF

SEQ ID NO: 2687399 - protein, 24 aa, Entamoeba histolytica
LQSVNLWICPPVENFDKIINQGCE

SEQ ID NO: 2687400 - protein, 24 aa, Entamoeba histolytica
LQSVPFVRLQSMFDMLVQQRNSSA

SEQ ID NO: 2687401 - protein, 26 aa, Entamoeba histolytica
LQSVSVFRLKVSWEMLQQSTKSIFTN

SEQ ID NO: 2687402 - protein, 28 aa, Entamoeba histolytica
LQTFREIKFLQQLRHEKIIKIKNFIVEQ

SEQ ID NO: 2687403 - protein, 30 aa, Entamoeba histolytica
LQTKFLKERFPKLGDSLISFGPCQTPTLGF

SEQ ID NO: 2687404 - protein, 24 aa, Entamoeba histolytica
LQTLKRFSTTDVIQRIIKTEYYYS

SEQ ID NO: 2687405 - protein, 17 aa, Entamoeba histolytica
LQTRLSDLNGIYRGFQN

SEQ ID NO: 2687406 - protein, 23 aa, Entamoeba histolytica
LQTRLYPKIEIFSLPQYKRTVND

SEQ ID NO: 2687407 - protein, 21 aa, Entamoeba histolytica
LQTRTKYSWSSRRGSTVLRPN

SEQ ID NO: 2687408 - protein, 20 aa, Entamoeba histolytica
LQTVCDFFSRLILRHPTSSV

SEQ ID NO: 2687409 - protein, 18 aa, Entamoeba histolytica
LQVAEPWIQKGIHPTIII

SEQ ID NO: 2687410 - protein, 28 aa, Entamoeba histolytica
LQVILKMERLHMLASGWKEESNKVPIKE

SEQ ID NO: 2687411 - protein, 17 aa, Entamoeba histolytica
LQVPTYFSVIKRPMDLG

SEQ ID NO: 2687412 - protein, 20 aa, Entamoeba histolytica
LQVYQQIISLLFPNENSKKA

SEQ ID NO: 2687413 - protein, 23 aa, Entamoeba histolytica
LQYIEVVGLFGIIEVSHKQLLEI

SEQ ID NO: 2687414 - protein, 25 aa, Entamoeba histolytica
LQYKFDLKGSMYGRKANEKERNKKS

SEQ ID NO: 2687415 - protein, 24 aa, Entamoeba histolytica
LQYLRLNPPFKFLNPAYEGIFLSI

SEQ ID NO: 2687416 - protein, 17 aa, Entamoeba histolytica
LQYRWDKNIELVSSQFI

SEQ ID NO: 2687417 - protein, 23 aa, Entamoeba histolytica
LQYSDDCILQYFELIKQSAQCID

SEQ ID NO: 2687418 - protein, 18 aa, Entamoeba histolytica
LRAQCSIVSHVLHSFIPM

SEQ ID NO: 2687419 - protein, 21 aa, Entamoeba histolytica
LRAQDILKLRMSFQDTPLGMI

SEQ ID NO: 2687420 - protein, 19 aa, Entamoeba histolytica
LRCDSCTLTSSLFLDSLHL

SEQ ID NO: 2687421 - protein, 23 aa, Entamoeba histolytica
LRCGDQTLSCPMEKVSFKPVVIT

SEQ ID NO: 2687422 - protein, 20 aa, Entamoeba histolytica
LRCHKSCHPSCSIPGDMKIN

SEQ ID NO: 2687423 - protein, 34 aa, Entamoeba histolytica
LRCHKTCHYPCYIKGDMKKGCACIDNDYCNVCKC

SEQ ID NO: 2687424 - protein, 23 aa, Entamoeba histolytica
LRCIEMVTKIFLGSHIIILEKNK

SEQ ID NO: 2687425 - protein, 24 aa, Entamoeba histolytica
LRCNREFASMVIKSWKNNTFEDSV

SEQ ID NO: 2687426 - protein, 18 aa, Entamoeba histolytica
LRCPINPKHKFCEGCITK

SEQ ID NO: 2687427 - protein, 19 aa, Entamoeba histolytica
LRCTCTRFKKLIDESTDVW

SEQ ID NO: 2687428 - protein, 19 aa, Entamoeba histolytica
LRDCKLCRTSDPLQHHMLH

SEQ ID NO: 2687429 - protein, 21 aa, Entamoeba histolytica
LRDFPCLVELPQLQKLQSLSS

SEQ ID NO: 2687430 - protein, 19 aa, Entamoeba histolytica
LRDGSGYCQCVIFGKELCE

SEQ ID NO: 2687431 - protein, 20 aa, Entamoeba histolytica
LRDLFRKHGANWKMVKYALE

SEQ ID NO: 2687432 - protein, 24 aa, Entamoeba histolytica
LRDRYSEKYGRLHARLLQTYLQAI

SEQ ID NO: 2687433 - protein, 18 aa, Entamoeba histolytica
LRDVRKRNKLNEERRKDI

SEQ ID NO: 2687434 - protein, 17 aa, Entamoeba histolytica
LRDYLQLAIETSGLLVL

SEQ ID NO: 2687435 - protein, 24 aa, Entamoeba histolytica
LREACFKTLLDIILHYGVESTLTS

SEQ ID NO: 2687436 - protein, 20 aa, Entamoeba histolytica
LREARFWGIFIGDLMSFMQS

SEQ ID NO: 2687437 - protein, 17 aa, Entamoeba histolytica
LREIFFITFPKSDYIAQ

SEQ ID NO: 2687438 - protein, 27 aa, Entamoeba histolytica
LREILYISLLNNWGFSFVFVKPKKFNI

SEQ ID NO: 2687439 - protein, 19 aa, Entamoeba histolytica
LREINILFIEEVVNPSKKN

SEQ ID NO: 2687440 - protein, 20 aa, Entamoeba histolytica
LRELIGKEVICIVRGNNYQE

SEQ ID NO: 2687441 - protein, 17 aa, Entamoeba histolytica
LRELLIFSLDIFDKKEI

SEQ ID NO: 2687442 - protein, 21 aa, Entamoeba histolytica
LRELRSLWVSLLVGDCIVVLG

SEQ ID NO: 2687443 - protein, 18 aa, Entamoeba histolytica
LREMSLMFSENVVEFITQ

SEQ ID NO: 2687444 - protein, 22 aa, Entamoeba histolytica
LREQFNVEFDRAFIETFQNHAQ

SEQ ID NO: 2687445 - protein, 26 aa, Entamoeba histolytica
LRERALKLLCRFLDLGPWACDQALAV

SEQ ID NO: 2687446 - protein, 24 aa, Entamoeba histolytica
LRERFKRNFNGGVGIIELLYKSNL

SEQ ID NO: 2687447 - protein, 17 aa, Entamoeba histolytica
LRERIRKALQLYSSEPT

SEQ ID NO: 2687448 - protein, 24 aa, Entamoeba histolytica
LREYHPLCFDLLYYSNINKNNSIP

SEQ ID NO: 2687449 - protein, 20 aa, Entamoeba histolytica
LRFHARFLLVCLLTDKLKMG

SEQ ID NO: 2687450 - protein, 19 aa, Entamoeba histolytica
LRFNDDLLHQFVLNNRQYF

SEQ ID NO: 2687451 - protein, 17 aa, Entamoeba histolytica
LRFVQRFESSNKKNRMQ

SEQ ID NO: 2687452 - protein, 19 aa, Entamoeba histolytica
LRGARKLLAFEKIERPKLI

SEQ ID NO: 2687453 - protein, 19 aa, Entamoeba histolytica
LRGDCIQGYTVLSPPPKRK

SEQ ID NO: 2687454 - protein, 17 aa, Entamoeba histolytica
LRGEAYSELGEYDIVAK

SEQ ID NO: 2687455 - protein, 24 aa, Entamoeba histolytica
LRGGLCGTFRQLIRSCNGILRACI

SEQ ID NO: 2687456 - protein, 18 aa, Entamoeba histolytica
LRGIGIALCCHFKGDGHD

SEQ ID NO: 2687457 - protein, 19 aa, Entamoeba histolytica
LRGIVPKKITVEPITNKEL

SEQ ID NO: 2687458 - protein, 23 aa, Entamoeba histolytica
LRGMKRFGFARIDDIMTIVRSSY

SEQ ID NO: 2687459 - protein, 20 aa, Entamoeba histolytica
LRGNHECRLLTTYFNFRQEC

SEQ ID NO: 2687460 - protein, 19 aa, Entamoeba histolytica
LRGSLPWQGLHVAKGENRY

SEQ ID NO: 2687461 - protein, 17 aa, Entamoeba histolytica
LRGTFLVTEPNNEGPTI

SEQ ID NO: 2687462 - protein, 20 aa, Entamoeba histolytica
LRGTYAYCAPEIYFSQPFTY

SEQ ID NO: 2687463 - protein, 21 aa, Entamoeba histolytica
LRHFFDICGLISQTNFEDIES

SEQ ID NO: 2687464 - protein, 18 aa, Entamoeba histolytica
LRHWTLYDSLFHTREIAS

SEQ ID NO: 2687465 - protein, 18 aa, Entamoeba histolytica
LRICCLEKTEDWNEREPW

SEQ ID NO: 2687466 - protein, 31 aa, Entamoeba histolytica
LRIDRGYRLEHICLLELIAICTSVMNNLRLY

SEQ ID NO: 2687467 - protein, 19 aa, Entamoeba histolytica
LRIFFPKDYVTGERRDYCF

SEQ ID NO: 2687468 - protein, 22 aa, Entamoeba histolytica
LRIGKLPRGPTCLFKVEEYTLR

SEQ ID NO: 2687469 - protein, 19 aa, Entamoeba histolytica
LRILADFTKDHHLIEFFKS

SEQ ID NO: 2687470 - protein, 30 aa, Entamoeba histolytica
LRINHCKDYKKLYGLIRFKKFERIIIEVDE

SEQ ID NO: 2687471 - protein, 34 aa, Entamoeba histolytica
LRITEKGNYQYIVFKFNVVNGLYVSEIEINTPAV

SEQ ID NO: 2687472 - protein, 20 aa, Entamoeba histolytica
LRKASAKYPEWKKANHPEEK

SEQ ID NO: 2687473 - protein, 18 aa, Entamoeba histolytica
LRKEWNFDEIGIICIGYD

SEQ ID NO: 2687474 - protein, 20 aa, Entamoeba histolytica
LRKFRDVLVQSQFIAIMNDY

SEQ ID NO: 2687475 - protein, 33 aa, Entamoeba histolytica
LRKIFKYNPRIGFDFACSEISFASLLGEALTSN

SEQ ID NO: 2687476 - protein, 21 aa, Entamoeba histolytica
LRKILFHNGHINLINFSSEVK

SEQ ID NO: 2687477 - protein, 21 aa, Entamoeba histolytica
LRKIRIELTKAMNLFSVNNTP

SEQ ID NO: 2687478 - protein, 18 aa, Entamoeba histolytica
LRKKSSFCGRQIAVYPST

SEQ ID NO: 2687479 - protein, 26 aa, Entamoeba histolytica
LRKMAAEKIKMYWQNKCENNPCPPST

SEQ ID NO: 2687480 - protein, 36 aa, Entamoeba histolytica
LRKMSQLPGNKRCMDCQAIGPVYVVIDFGTFVCQTC

SEQ ID NO: 2687481 - protein, 26 aa, Entamoeba histolytica
LRKNPDAWGKWNIMRGINLHKTQCTI

SEQ ID NO: 2687482 - protein, 24 aa, Entamoeba histolytica
LRKQPKRTSVVELIGSSKPVVQEK

SEQ ID NO: 2687483 - protein, 19 aa, Entamoeba histolytica
LRKRIIIDGANVAYYKSQG

SEQ ID NO: 2687484 - protein, 24 aa, Entamoeba histolytica
LRKRLNHIAIKYKHLYLTNTQILL

SEQ ID NO: 2687485 - protein, 26 aa, Entamoeba histolytica
LRKRLNQLAIKYKHLYLTNTQILLGI

SEQ ID NO: 2687486 - protein, 18 aa, Entamoeba histolytica
LRKSLFISKQQHCHSVHI

SEQ ID NO: 2687487 - protein, 19 aa, Entamoeba histolytica
LRKTLQLIPPYLVQRPQIE

SEQ ID NO: 2687488 - protein, 18 aa, Entamoeba histolytica
LRKTYWWKNFKVCFFFFS

SEQ ID NO: 2687489 - protein, 20 aa, Entamoeba histolytica
LRKVCNHPFLIPGVEEKEIA

SEQ ID NO: 2687490 - protein, 18 aa, Entamoeba histolytica
LRKVTILMLQQNRIKEVP

SEQ ID NO: 2687491 - protein, 24 aa, Entamoeba histolytica
LRKYCGMENCGATCYINSVIQQLH

SEQ ID NO: 2687492 - protein, 25 aa, Entamoeba histolytica
LRKYKWNVEESIPWIIDNLRTFPKP

SEQ ID NO: 2687493 - protein, 22 aa, Entamoeba histolytica
LRKYNELYLAIFKKVLFELIHP

SEQ ID NO: 2687494 - protein, 17 aa, Entamoeba histolytica
LRLAFAEDDVMNEIEQI

SEQ ID NO: 2687495 - protein, 17 aa, Entamoeba histolytica
LRLDQIFNNKIPVSSDR

SEQ ID NO: 2687496 - protein, 24 aa, Entamoeba histolytica
LRLELLNQFDFIFVDSLTFNEIIL

SEQ ID NO: 2687497 - protein, 27 aa, Entamoeba histolytica
LRLFGNCPYSIILPKTLVKLTIEMWHE

SEQ ID NO: 2687498 - protein, 17 aa, Entamoeba histolytica
LRLFIETPRTSSLRRQF

SEQ ID NO: 2687499 - protein, 17 aa, Entamoeba histolytica
LRLFSFKMIPDSFKSFM

SEQ ID NO: 2687500 - protein, 18 aa, Entamoeba histolytica
LRLHLLIKALGDEYGGRQ

SEQ ID NO: 2687501 - protein, 17 aa, Entamoeba histolytica
LRLIPMNYFTMLNGISK

SEQ ID NO: 2687502 - protein, 23 aa, Entamoeba histolytica
LRLKEELFEGYNLVDSKQKENKT

SEQ ID NO: 2687503 - protein, 27 aa, Entamoeba histolytica
LRLLNEIEENFLYLSIERFIEKESIEI

SEQ ID NO: 2687504 - protein, 17 aa, Entamoeba histolytica
LRLLWHEYWINTLAATA

SEQ ID NO: 2687505 - protein, 19 aa, Entamoeba histolytica
LRLLYKFPSLNKGYELMKE

SEQ ID NO: 2687506 - protein, 19 aa, Entamoeba histolytica
LRLPFTICYSPPSYNVKIE

SEQ ID NO: 2687507 - protein, 20 aa, Entamoeba histolytica
LRLPLQDVYKISGIGTVPVG

SEQ ID NO: 2687508 - protein, 24 aa, Entamoeba histolytica
LRLRELGEPIMLFGEEFESRRERL

SEQ ID NO: 2687509 - protein, 20 aa, Entamoeba histolytica
LRLRNIDIGKGWESLIESYI

SEQ ID NO: 2687510 - protein, 18 aa, Entamoeba histolytica
LRLSNLLFNSIYPKVQQN

SEQ ID NO: 2687511 - protein, 21 aa, Entamoeba histolytica
LRLTKEKKKEVGFAGMMSDMF

SEQ ID NO: 2687512 - protein, 21 aa, Entamoeba histolytica
LRLTLFNEFLLCIKKQKTPTT

SEQ ID NO: 2687513 - protein, 17 aa, Entamoeba histolytica
LRLTSICLPSRLLKLKS

SEQ ID NO: 2687514 - protein, 23 aa, Entamoeba histolytica
LRMLCGALSSKALQSVDVKTELI

SEQ ID NO: 2687515 - protein, 27 aa, Entamoeba histolytica
LRMLFWRIAKREGIEFDGQFDWIQYKG

SEQ ID NO: 2687516 - protein, 17 aa, Entamoeba histolytica
LRMLSSFQTKIVSHAMK

SEQ ID NO: 2687517 - protein, 21 aa, Entamoeba histolytica
LRMQSIIIFYCEFSKTRAPSL

SEQ ID NO: 2687518 - protein, 21 aa, Entamoeba histolytica
LRMRARGVLLSNIKWNENDEL

SEQ ID NO: 2687519 - protein, 25 aa, Entamoeba histolytica
LRNELIQDMCLMMNMVVKYRSTLFR

SEQ ID NO: 2687520 - protein, 25 aa, Entamoeba histolytica
LRNGCFSESGIRMFEITSQFQFIDE

SEQ ID NO: 2687521 - protein, 21 aa, Entamoeba histolytica
LRNLISGIYLWISNEWSQCDW

SEQ ID NO: 2687522 - protein, 18 aa, Entamoeba histolytica
LRNLREWTGLSNYFILYD

SEQ ID NO: 2687523 - protein, 25 aa, Entamoeba histolytica
LRNNLRSATIWHLYGIVCRSEKRYS

SEQ ID NO: 2687524 - protein, 18 aa, Entamoeba histolytica
LRNPHNIQPIKFIKKDCY

SEQ ID NO: 2687525 - protein, 21 aa, Entamoeba histolytica
LRNQIEEYCISKGLDFEKFIE

SEQ ID NO: 2687526 - protein, 20 aa, Entamoeba histolytica
LRNVCTEAGMFAIRDDRDYC

SEQ ID NO: 2687527 - protein, 33 aa, Entamoeba histolytica
LRPETAQGIFTMFKRNLEFNGGKVPFGVTQIGN

SEQ ID NO: 2687528 - protein, 17 aa, Entamoeba histolytica
LRPFTSLVDAQFINCSK

SEQ ID NO: 2687529 - protein, 23 aa, Entamoeba histolytica
LRPIFKRLYLNYTQMKDFHKEEG

SEQ ID NO: 2687530 - protein, 17 aa, Entamoeba histolytica
LRPIQALHHPFITREIF

SEQ ID NO: 2687531 - protein, 21 aa, Entamoeba histolytica
LRPLIDMAVSICDRTSKISSI

SEQ ID NO: 2687532 - protein, 20 aa, Entamoeba histolytica
LRPLPAKPLLPAKPIRSDNV

SEQ ID NO: 2687533 - protein, 20 aa, Entamoeba histolytica
LRPLSYPATDVFIVLFSITD

SEQ ID NO: 2687534 - protein, 20 aa, Entamoeba histolytica
LRPLSYPGTDIFLLCFAVIY

SEQ ID NO: 2687535 - protein, 22 aa, Entamoeba histolytica
LRPLSYPGTDVFIVLFSITDPD

SEQ ID NO: 2687536 - protein, 20 aa, Entamoeba histolytica
LRPLSYPSTDIFLICYSIMS

SEQ ID NO: 2687537 - protein, 20 aa, Entamoeba histolytica
LRPLSYPSTDVFLVCFSVIA

SEQ ID NO: 2687538 - protein, 21 aa, Entamoeba histolytica
LRPLTKEMIEYARGDTHYLLY

SEQ ID NO: 2687539 - protein, 18 aa, Entamoeba histolytica
LRPSGSLVKMGDFGAYKV

SEQ ID NO: 2687540 - protein, 19 aa, Entamoeba histolytica
LRPTIPPSTPQKMATLIRQ

SEQ ID NO: 2687541 - protein, 20 aa, Entamoeba histolytica
LRPVTFDIPPFITLNEQQKQ

SEQ ID NO: 2687542 - protein, 18 aa, Entamoeba histolytica
LRPYGVGLLVIGYDTKPR

SEQ ID NO: 2687543 - protein, 22 aa, Entamoeba histolytica
LRPYWRCYYSGTNAIIFVVDSC

SEQ ID NO: 2687544 - protein, 26 aa, Entamoeba histolytica
LRQGLLCEYCNTILHNNCVSLNWLDK

SEQ ID NO: 2687545 - protein, 19 aa, Entamoeba histolytica
LRQKVEAFNQTLPRSYRIK

SEQ ID NO: 2687546 - protein, 18 aa, Entamoeba histolytica
LRQLYKFQPNVLSINPDF

SEQ ID NO: 2687547 - protein, 23 aa, Entamoeba histolytica
LRQSRREACLAKRRTSFGEESEE

SEQ ID NO: 2687548 - protein, 17 aa, Entamoeba histolytica
LRQVSGEEIPPLLLVCI

SEQ ID NO: 2687549 - protein, 19 aa, Entamoeba histolytica
LRQVWKNGMTYNRVGTLYY

SEQ ID NO: 2687550 - protein, 21 aa, Entamoeba histolytica
LRQWCVTNGYEFFECSAKTGW

SEQ ID NO: 2687551 - protein, 19 aa, Entamoeba histolytica
LRQYALDGLSHWGSDAQGI

SEQ ID NO: 2687552 - protein, 21 aa, Entamoeba histolytica
LRQYPTYKKLYAMQEKIDQME

SEQ ID NO: 2687553 - protein, 19 aa, Entamoeba histolytica
LRRCVEIKLFSGIARLIEY

SEQ ID NO: 2687554 - protein, 34 aa, Entamoeba histolytica; identical to SEQ ID NO: 2495410

SEQ ID NO: 2687555 - protein, 21 aa, Entamoeba histolytica
LRRKISKEWNCFNEEQQMFII

SEQ ID NO: 2687556 - protein, 17 aa, Entamoeba histolytica
LRRLVTMGINEEYFKKV

SEQ ID NO: 2687557 - protein, 19 aa, Entamoeba histolytica
LRRMIALTYIPSFLASVSI

SEQ ID NO: 2687558 - protein, 20 aa, Entamoeba histolytica
LRRQGNDIIQTVFISQPQRN

SEQ ID NO: 2687559 - protein, 17 aa, Entamoeba histolytica
LRRRPIYALTLDISLTY

SEQ ID NO: 2687560 - protein, 19 aa, Entamoeba histolytica
LRRVLPYFYTFKVNAKGRW

SEQ ID NO: 2687561 - protein, 20 aa, Entamoeba histolytica
LRSEFEFCLSSTPEEAIYSR

SEQ ID NO: 2687562 - protein, 17 aa, Entamoeba histolytica
LRSEILGTIKINCKLSG

SEQ ID NO: 2687563 - protein, 21 aa, Entamoeba histolytica
LRSEILGTIKINCKLSGMPEL

SEQ ID NO: 2687564 - protein, 28 aa, Entamoeba histolytica
LRSFLIMPVQRLPRYVLLLKELQKNTPK

SEQ ID NO: 2687565 - protein, 21 aa, Entamoeba histolytica
LRSIIWMICEYCSHYDEVISM

SEQ ID NO: 2687566 - protein, 18 aa, Entamoeba histolytica
LRSIYWNLNTSLIPKNVS

SEQ ID NO: 2687567 - protein, 19 aa, Entamoeba histolytica
LRSKFSYFRQGMLEVAMLS

SEQ ID NO: 2687568 - protein, 17 aa, Entamoeba histolytica
LRSLALFYFITAAETMR

SEQ ID NO: 2687569 - protein, 18 aa, Entamoeba histolytica
LRSLFSLTSNYKRYREVY

SEQ ID NO: 2687570 - protein, 17 aa, Entamoeba histolytica
LRSLLIFSRSYPKNLKQ

SEQ ID NO: 2687571 - protein, 19 aa, Entamoeba histolytica
LRSNNDLIEFCSKPDNLKR

SEQ ID NO: 2687572 - protein, 20 aa, Entamoeba histolytica
LRSRCLDIRIELPTYDEVDR

SEQ ID NO: 2687573 - protein, 20 aa, Entamoeba histolytica
LRSTFIASRYLEFCRDFAEC

SEQ ID NO: 2687574 - protein, 24 aa, Entamoeba histolytica
LRSYKMIICEGFLFFYSSKETFVV

SEQ ID NO: 2687575 - protein, 17 aa, Entamoeba histolytica
LRTEELIEPLLIDEESS

SEQ ID NO: 2687576 - protein, 17 aa, Entamoeba histolytica
LRTIDIFNIEIGTPQFI

SEQ ID NO: 2687577 - protein, 18 aa, Entamoeba histolytica
LRTKINFMQSMDILISKK

SEQ ID NO: 2687578 - protein, 31 aa, Entamoeba histolytica
LRTLCLALQYITDVTPFFGFERALYEGMSMS

SEQ ID NO: 2687579 - protein, 17 aa, Entamoeba histolytica
LRTLKFIHRMISDDKSC

SEQ ID NO: 2687580 - protein, 22 aa, Entamoeba histolytica
LRTLLKEIWGLSLAYPDNTPLE

SEQ ID NO: 2687581 - protein, 22 aa, Entamoeba histolytica
LRTTPKPLLVNRVFGTIDNTNL

SEQ ID NO: 2687582 - protein, 19 aa, Entamoeba histolytica
LRTVIPCLTQKGINDPDFI

SEQ ID NO: 2687583 - protein, 20 aa, Entamoeba histolytica
LRVIARNAGVDWNSCTVNKE

SEQ ID NO: 2687584 - protein, 20 aa, Entamoeba histolytica
LRVIPDLERLLSQCTSSTIT

SEQ ID NO: 2687585 - protein, 23 aa, Entamoeba histolytica
LRVKEATSFPIVFVANKVDLVKD

SEQ ID NO: 2687586 - protein, 23 aa, Entamoeba histolytica
LRVLQEIRLLKYLNHENIIHLEE

SEQ ID NO: 2687587 - protein, 24 aa, Entamoeba histolytica
LRVLYKLYSSFKMPHLPKVGVLYF

SEQ ID NO: 2687588 - protein, 25 aa, Entamoeba histolytica
LRVNYKGCIVIGYPNIEASEVLDIG

SEQ ID NO: 2687589 - protein, 18 aa, Entamoeba histolytica
LRVPNTILVAFKGVEGEA

SEQ ID NO: 2687590 - protein, 19 aa, Entamoeba histolytica
LRVQPKFTKSMSVYSYKFE

SEQ ID NO: 2687591 - protein, 25 aa, Entamoeba histolytica
LRVSFLEGLFFVFAYFMDVTHAEEC

SEQ ID NO: 2687592 - protein, 21 aa, Entamoeba histolytica
LRVVKMVLPSCSFYNKYVNIQ

SEQ ID NO: 2687593 - protein, 24 aa, Entamoeba histolytica
LRVYPELINLLPYTLRHETHRFVA

SEQ ID NO: 2687594 - protein, 26 aa, Entamoeba histolytica
LRYDNRKLLPLFGIKQDTQFFSIKNR

SEQ ID NO: 2687595 - protein, 22 aa, Entamoeba histolytica
LRYFIELPIPIPLFKEYLIFVF

SEQ ID NO: 2687596 - protein, 26 aa, Entamoeba histolytica
LRYKEQEQFVGIEWLSKQCFIDKLLN

SEQ ID NO: 2687597 - protein, 19 aa, Entamoeba histolytica
LRYLSQILRINRFKEPPED

SEQ ID NO: 2687598 - protein, 19 aa, Entamoeba histolytica
LRYLTIILEEEVGWTSTKF

SEQ ID NO: 2687599 - protein, 19 aa, Entamoeba histolytica
LRYNPGFCGCDEITSAEEQ

SEQ ID NO: 2687600 - protein, 20 aa, Entamoeba histolytica
LRYVEGIFDPSCKSTLGVNF

SEQ ID NO: 2687601 - protein, 17 aa, Entamoeba histolytica
LRYYLRVSVNKKYSSGL

SEQ ID NO: 2687602 - protein, 18 aa, Entamoeba histolytica
LSADLFISSKQPIHNNDN

SEQ ID NO: 2687603 - protein, 27 aa, Entamoeba histolytica
LSAFKAKEYRLVYKLLHDLIQTNHVQV

SEQ ID NO: 2687604 - protein, 27 aa, Entamoeba histolytica
LSAFRPEDISAMLLRRFKEIASDAMGR

SEQ ID NO: 2687605 - protein, 24 aa, Entamoeba histolytica
LSALELIEPLSWPHPIVTLLPRCY

SEQ ID NO: 2687606 - protein, 25 aa, Entamoeba histolytica
LSAQKEFAFMKALYAKGFPTPIPVD

SEQ ID NO: 2687607 - protein, 17 aa, Entamoeba histolytica
LSAQQCLCHEFFTSRKL

SEQ ID NO: 2687608 - protein, 18 aa, Entamoeba histolytica
LSCSASIQLKAYLSNEQK

SEQ ID NO: 2687609 - protein, 27 aa, Entamoeba histolytica
LSCTNLPNIILSFNFQQLLTFIGLELP

SEQ ID NO: 2687610 - protein, 17 aa, Entamoeba histolytica
LSDCFGKLISIDAATYV

SEQ ID NO: 2687611 - protein, 18 aa, Entamoeba histolytica
LSDDCNFILLISSSELLM

SEQ ID NO: 2687612 - protein, 23 aa, Entamoeba histolytica
LSDEKRAVLSLYLRQAPEERARI

SEQ ID NO: 2687613 - protein, 21 aa, Entamoeba histolytica
LSDFLKTYCSYVNSTDDINEH

SEQ ID NO: 2687614 - protein, 17 aa, Entamoeba histolytica
LSDGCPICQNKCQCASC

SEQ ID NO: 2687615 - protein, 18 aa, Entamoeba histolytica
LSDGTCSIHQGFKNNYAC

SEQ ID NO: 2687616 - protein, 22 aa, Entamoeba histolytica
LSDICLRSSSAPTYFQPYQNFV

SEQ ID NO: 2687617 - protein, 18 aa, Entamoeba histolytica
LSDIDLVWNNAFKYNAPN

SEQ ID NO: 2687618 - protein, 24 aa, Entamoeba histolytica
LSDIQRYILINAFQFDSGENDPNR

SEQ ID NO: 2687619 - protein, 21 aa, Entamoeba histolytica
LSDKLKWYVENQLKRAKEVKE

SEQ ID NO: 2687620 - protein, 17 aa, Entamoeba histolytica
LSDLWLSTVRLGGVGDE

SEQ ID NO: 2687621 - protein, 19 aa, Entamoeba histolytica
LSDNGFFIFSLNNPHHTMP

SEQ ID NO: 2687622 - protein, 24 aa, Entamoeba histolytica
LSDNKRLFVNVAISSSVRDMKEKI

SEQ ID NO: 2687623 - protein, 25 aa, Entamoeba histolytica
LSDQRRLRVGISFEKELKKCWGESV

SEQ ID NO: 2687624 - protein, 22 aa, Entamoeba histolytica
LSDRFKTLFLILTTKECDKMNM

SEQ ID NO: 2687625 - protein, 26 aa, Entamoeba histolytica
LSDSSVCSSLILSLPSHENNISKEVT

SEQ ID NO: 2687626 - protein, 25 aa, Entamoeba histolytica
LSDYKDWCLYWLGLNNFEPPLTGET

SEQ ID NO: 2687627 - protein, 18 aa, Entamoeba histolytica
LSDYPSMMTIYSAVSNLT

SEQ ID NO: 2687628 - protein, 21 aa, Entamoeba histolytica
LSEALARLYLDKEVRDDYVKE

SEQ ID NO: 2687629 - protein, 28 aa, Entamoeba histolytica
LSEATVLYNLRIRYMEDIIHTYSGLFCV

SEQ ID NO: 2687630 - protein, 20 aa, Entamoeba histolytica
LSECMLWDYKRQEISTEMMN

SEQ ID NO: 2687631 - protein, 21 aa, Entamoeba histolytica
LSEFPIEAELKPFVMTDADGT

SEQ ID NO: 2687632 - protein, 23 aa, Entamoeba histolytica
LSEGDLRYGIGLLQKLSQGINHS

SEQ ID NO: 2687633 - protein, 17 aa, Entamoeba histolytica
LSEGILLELRKKSGEKT

SEQ ID NO: 2687634 - protein, 36 aa, Entamoeba histolytica
LSEINWKIPRRFNMKKGNEMSYVFLLDIISYPEMNS

SEQ ID NO: 2687635 - protein, 18 aa, Entamoeba histolytica
LSEKTIKLPANEIQNNTN

SEQ ID NO: 2687636 - protein, 17 aa, Entamoeba histolytica
LSELLFDVCHLNCIPNI

SEQ ID NO: 2687637 - protein, 18 aa, Entamoeba histolytica
LSELLSFNGSLYGFDDRT

SEQ ID NO: 2687638 - protein, 23 aa, Entamoeba histolytica
LSEPYSIYTYRYFLKSWPHLCFF

SEQ ID NO: 2687639 - protein, 31 aa, Entamoeba histolytica
LSEQRLPQPPSFELQKKWYFPIIQSIKPQQF

SEQ ID NO: 2687640 - protein, 25 aa, Entamoeba histolytica
LSESLGALWKTLPSLPFLPKSNQLK

SEQ ID NO: 2687641 - protein, 24 aa, Entamoeba histolytica
LSESPGECDLIKSMYPECKNYTDV

SEQ ID NO: 2687642 - protein, 23 aa, Entamoeba histolytica
LSEVPCYNCPYSSICSPTNVSCN

SEQ ID NO: 2687643 - protein, 18 aa, Entamoeba histolytica
LSEYLKRRCLELKQDDID

SEQ ID NO: 2687644 - protein, 17 aa, Entamoeba histolytica
LSFSYGVMTDESFTDND

SEQ ID NO: 2687645 - protein, 17 aa, Entamoeba histolytica
LSFVKSIEGRKDIAIVI

SEQ ID NO: 2687646 - protein, 23 aa, Entamoeba histolytica
LSGDAFVGKTCFFKRFSSGEFNP

SEQ ID NO: 2687647 - protein, 22 aa, Entamoeba histolytica
LSGDERYQCTLTFGYNGDNRRI

SEQ ID NO: 2687648 - protein, 26 aa, Entamoeba histolytica
LSGFLQKPHHQFRGLLNYVHRQNNNF

SEQ ID NO: 2687649 - protein, 22 aa, Entamoeba histolytica
LSGFSFLFAEYVRREFRKDNKQ

SEQ ID NO: 2687650 - protein, 19 aa, Entamoeba histolytica
LSGHPWPQVGVERNTISGG

SEQ ID NO: 2687651 - protein, 18 aa, Entamoeba histolytica
LSGLDSIKSISFPKTLTK

SEQ ID NO: 2687652 - protein, 19 aa, Entamoeba histolytica
LSGLFPQFANISGVKSFIS

SEQ ID NO: 2687653 - protein, 26 aa, Entamoeba histolytica
LSGLYLRTIAWRVWLGVLPTPISINW

SEQ ID NO: 2687654 - protein, 24 aa, Entamoeba histolytica
LSGRVTINLQFTWYDTYLQEDSKP

SEQ ID NO: 2687655 - protein, 18 aa, Entamoeba histolytica
LSGSIIYALLSRFKPDNL

SEQ ID NO: 2687656 - protein, 17 aa, Entamoeba histolytica
LSHCDKLQAIYFPRELK

SEQ ID NO: 2687657 - protein, 17 aa, Entamoeba histolytica
LSHEGIETMILGEQEQN

SEQ ID NO: 2687658 - protein, 23 aa, Entamoeba histolytica
LSHNRLTQFPVYLGTQLTSLMIS

SEQ ID NO: 2687659 - protein, 27 aa, Entamoeba histolytica
LSIAIIPFKFLSKFYELSLQYRKINKE

SEQ ID NO: 2687660 - protein, 27 aa, Entamoeba histolytica
LSICQFLLPIELRYSSQLSISLLETLC

SEQ ID NO: 2687661 - protein, 18 aa, Entamoeba histolytica
LSIEKFVIKDCFSLTELK

SEQ ID NO: 2687662 - protein, 20 aa, Entamoeba histolytica
LSIETKINWYNSVINYGRVN

SEQ ID NO: 2687663 - protein, 19 aa, Entamoeba histolytica
LSIETVRFMLDIHKQCENV

SEQ ID NO: 2687664 - protein, 19 aa, Entamoeba histolytica
LSIFFRITKVIQRLIDSLS

SEQ ID NO: 2687665 - protein, 17 aa, Entamoeba histolytica
LSIKGTDPILIEQSHHL

SEQ ID NO: 2687666 - protein, 21 aa, Entamoeba histolytica
LSIKRGQKIIIFDDSDPEGWL

SEQ ID NO: 2687667 - protein, 20 aa, Entamoeba histolytica
LSILCSVTYLQINTSIEPLL

SEQ ID NO: 2687668 - protein, 18 aa, Entamoeba histolytica
LSILNLPIKKVWKYPHQI

SEQ ID NO: 2687669 - protein, 18 aa, Entamoeba histolytica
LSILQLSSIRIIYNNNEI

SEQ ID NO: 2687670 - protein, 21 aa, Entamoeba histolytica
LSINPKEHWAPFANALKNELQ

SEQ ID NO: 2687671 - protein, 21 aa, Entamoeba histolytica
LSIPEQMKFVVDRWNTPCNTA

SEQ ID NO: 2687672 - protein, 25 aa, Entamoeba histolytica
LSIPQRLNVSITRAKYGLVVVGNPE

SEQ ID NO: 2687673 - protein, 17 aa, Entamoeba histolytica
LSIQHPFEAEQIVQAMK

SEQ ID NO: 2687674 - protein, 21 aa, Entamoeba histolytica
LSIQPKLFFCNQQPNSSSHEE

SEQ ID NO: 2687675 - protein, 31 aa, Entamoeba histolytica
LSIQPKQSQICIPENPIPVIEVKPVPTTTYN

SEQ ID NO: 2687676 - protein, 19 aa, Entamoeba histolytica
LSISQILNFQYYVAQVMDF

SEQ ID NO: 2687677 - protein, 27 aa, Entamoeba histolytica
LSIVACREFSVRLGNGFTTPPINSSMN

SEQ ID NO: 2687678 - protein, 18 aa, Entamoeba histolytica
LSIYGICHSIDLYSCTIN

SEQ ID NO: 2687679 - protein, 20 aa, Entamoeba histolytica
LSKAVCRFIAKISAHPLANV

SEQ ID NO: 2687680 - protein, 20 aa, Entamoeba histolytica
LSKDDLKQFITIVDSLSQKH

SEQ ID NO: 2687681 - protein, 21 aa, Entamoeba histolytica
LSKDESIHFGDTVISSQPSFE

SEQ ID NO: 2687682 - protein, 21 aa, Entamoeba histolytica
LSKEDIEKVFGIAGKIIELSI

SEQ ID NO: 2687683 - protein, 21 aa, Entamoeba histolytica
LSKEEIVGIVVQKLIPHVISS

SEQ ID NO: 2687684 - protein, 23 aa, Entamoeba histolytica
LSKELREKYNVIAIPIHKDDEVK

SEQ ID NO: 2687685 - protein, 24 aa, Entamoeba histolytica
LSKELREKYNVIAIPIHKDDEVKI

SEQ ID NO: 2687686 - protein, 17 aa, Entamoeba histolytica
LSKENPYNFTFFVFHSA

SEQ ID NO: 2687687 - protein, 21 aa, Entamoeba histolytica
LSKETTWWRNRTAIISITPEQ

SEQ ID NO: 2687688 - protein, 17 aa, Entamoeba histolytica
LSKGYGFIYFYTSIIAN

SEQ ID NO: 2687689 - protein, 24 aa, Entamoeba histolytica
LSKHIYGCRVIQKIIEYSNTNENE

SEQ ID NO: 2687690 - protein, 20 aa, Entamoeba histolytica
LSKILPRFVTDINNEHLYEI

SEQ ID NO: 2687691 - protein, 24 aa, Entamoeba histolytica
LSKKFCPELTYIFTKVRLAVKERY

SEQ ID NO: 2687692 - protein, 23 aa, Entamoeba histolytica
LSKKTLLRQALGNTIDDRELQIS

SEQ ID NO: 2687693 - protein, 23 aa, Entamoeba histolytica
LSKLRDLFSLFFNVEFFERVWSK

SEQ ID NO: 2687694 - protein, 17 aa, Entamoeba histolytica
LSKMSFVQRQRYLREQQ

SEQ ID NO: 2687695 - protein, 21 aa, Entamoeba histolytica
LSKQIPFIIFQLCDFMTSIIQ

SEQ ID NO: 2687696 - protein, 20 aa, Entamoeba histolytica
LSKTRWDLVSLLQKEVAKSI

SEQ ID NO: 2687697 - protein, 17 aa, Entamoeba histolytica
LSLASLIHRRYSITEDN

SEQ ID NO: 2687698 - protein, 22 aa, Entamoeba histolytica
LSLDFKTDKPFDTKEESKSPSF

SEQ ID NO: 2687699 - protein, 19 aa, Entamoeba histolytica
LSLDWNTSFSLYSFDNYPP

SEQ ID NO: 2687700 - protein, 24 aa, Entamoeba histolytica
LSLEELNMIFTMFADVFESYENST

SEQ ID NO: 2687701 - protein, 26 aa, Entamoeba histolytica
LSLELFTQGNFEWKEKVVVVGVDMSS

SEQ ID NO: 2687702 - protein, 24 aa, Entamoeba histolytica
LSLFIKILCFFVKEWRYRNKNKSN

SEQ ID NO: 2687703 - protein, 18 aa, Entamoeba histolytica
LSLIFAIQRCDPAPFYLF

SEQ ID NO: 2687704 - protein, 26 aa, Entamoeba histolytica
LSLIGPFCYLELPDLLFVDKIQPETI

SEQ ID NO: 2687705 - protein, 17 aa, Entamoeba histolytica
LSLIRTAFWDEVNPMKF

SEQ ID NO: 2687706 - protein, 17 aa, Entamoeba histolytica
LSLLPIEHQTIFKELMK

SEQ ID NO: 2687707 - protein, 17 aa, Entamoeba histolytica
LSLNGCSLRILDITKLG

SEQ ID NO: 2687708 - protein, 17 aa, Entamoeba histolytica
LSLQLLVKEVSNLWDDF

SEQ ID NO: 2687709 - protein, 24 aa, Entamoeba histolytica
LSLRPHPFDPYRVYTIPFEEQDFK

SEQ ID NO: 2687710 - protein, 24 aa, Entamoeba histolytica
LSLSLSGNVSFCLDVFSILFRLSI

SEQ ID NO: 2687711 - protein, 18 aa, Entamoeba histolytica
LSLTCCFAVQCNCPAILR

SEQ ID NO: 2687712 - protein, 24 aa, Entamoeba histolytica
LSLTYKRLLGLPVPSTQFQGYPQQ

SEQ ID NO: 2687713 - protein, 18 aa, Entamoeba histolytica
LSLVRYPLSLDISMMNQH

SEQ ID NO: 2687714 - protein, 19 aa, Entamoeba histolytica
LSLYCGIGACEAGIEKYMY

SEQ ID NO: 2687715 - protein, 17 aa, Entamoeba histolytica
LSLYLPSLYSFNLPSFS

SEQ ID NO: 2687716 - protein, 26 aa, Entamoeba histolytica
LSMRYDLTVPFARYLATNGVKKIKRY

SEQ ID NO: 2687717 - protein, 22 aa, Entamoeba histolytica
LSNCKLNCIPKHFFDSLTQLTY

SEQ ID NO: 2687718 - protein, 23 aa, Entamoeba histolytica
LSNEKIKQFGFYVDGVRQAVLNG

SEQ ID NO: 2687719 - protein, 22 aa, Entamoeba histolytica
LSNELQRRIEILQVVAQTIQIP

SEQ ID NO: 2687720 - protein, 21 aa, Entamoeba histolytica
LSNFKNPICYFHNLGYDGRFL

SEQ ID NO: 2687721 - protein, 17 aa, Entamoeba histolytica
LSNKMVVVLCDDKTVNI

SEQ ID NO: 2687722 - protein, 18 aa, Entamoeba histolytica
LSNKTRCVIFNSPNNPTG

SEQ ID NO: 2687723 - protein, 17 aa, Entamoeba histolytica
LSNLKVSDFGGDEEFEQ

SEQ ID NO: 2687724 - protein, 22 aa, Entamoeba histolytica
LSNSIRVSADFRDVVADCGVEF

SEQ ID NO: 2687725 - protein, 19 aa, Entamoeba histolytica
LSNVEIKSTLNISLDDGGR

SEQ ID NO: 2687726 - protein, 19 aa, Entamoeba histolytica
LSNVICLWQSSSPYRSLLL

SEQ ID NO: 2687727 - protein, 20 aa, Entamoeba histolytica
LSNVPTRWFPSAKRSKYILN

SEQ ID NO: 2687728 - protein, 17 aa, Entamoeba histolytica
LSNVVAIAASTLVFRNA

SEQ ID NO: 2687729 - protein, 27 aa, Entamoeba histolytica
LSNVWPYIRFSIDYNIAQSELKFLKTY

SEQ ID NO: 2687730 - protein, 22 aa, Entamoeba histolytica
LSNYIPKYICESYLPAYKIEVV

SEQ ID NO: 2687731 - protein, 18 aa, Entamoeba histolytica
LSPEGYKMIEIHMTEETN

SEQ ID NO: 2687732 - protein, 17 aa, Entamoeba histolytica
LSPESKPFLGMAAAVER

SEQ ID NO: 2687733 - protein, 19 aa, Entamoeba histolytica
LSPEVKTVCSIKLKSLQVG

SEQ ID NO: 2687734 - protein, 25 aa, Entamoeba histolytica
LSPFKTRGILLLKMNAICRGNTPVQ

SEQ ID NO: 2687735 - protein, 23 aa, Entamoeba histolytica
LSPGSCFWLPHGTRIYNKLVELM

SEQ ID NO: 2687736 - protein, 23 aa, Entamoeba histolytica
LSPNELPSSLNFTSTSKQSLSST

SEQ ID NO: 2687737 - protein, 26 aa, Entamoeba histolytica
LSPPELSCFISQGMEIVKNHPLVKED

SEQ ID NO: 2687738 - protein, 17 aa, Entamoeba histolytica
LSPPITMLNKRDITSPE

SEQ ID NO: 2687739 - protein, 24 aa, Entamoeba histolytica
LSPPLRITRCKTMPKCYSSRTSLI

SEQ ID NO: 2687740 - protein, 18 aa, Entamoeba histolytica
LSPQVNFIVGENGSGKSA

SEQ ID NO: 2687741 - protein, 21 aa, Entamoeba histolytica
LSPRRRGNSSGEYEKLKNENV

SEQ ID NO: 2687742 - protein, 17 aa, Entamoeba histolytica
LSPSIKVILHFTTLSKD

SEQ ID NO: 2687743 - protein, 25 aa, Entamoeba histolytica
LSPTIQMYFSFRFLKQESAEEKRIG

SEQ ID NO: 2687744 - protein, 21 aa, Entamoeba histolytica
LSPYKYLSFVVSWEQEGVNLG

SEQ ID NO: 2687745 - protein, 24 aa, Entamoeba histolytica
LSQCSFKTQLLGIIQQNSYLKVNK

SEQ ID NO: 2687746 - protein, 32 aa, Entamoeba histolytica
LSQFGVIVNVIEWKNGVKVIFADETVVNYLID

SEQ ID NO: 2687747 - protein, 17 aa, Entamoeba histolytica
LSQGLMHGWSYQSLIKE

SEQ ID NO: 2687748 - protein, 18 aa, Entamoeba histolytica
LSQITVCPKADGLYPVVS

SEQ ID NO: 2687749 - protein, 25 aa, Entamoeba histolytica
LSQIYKLHFDYIFIRRAEKIEGLFP

SEQ ID NO: 2687750 - protein, 18 aa, Entamoeba histolytica
LSQIYYRDATVALLVYDI

SEQ ID NO: 2687751 - protein, 33 aa, Entamoeba histolytica
LSQKHIDEFVTWMYNHLLVGYSNEFPLTGEMSG

SEQ ID NO: 2687752 - protein, 17 aa, Entamoeba histolytica
LSQLFSMKLKKRVTVSC

SEQ ID NO: 2687753 - protein, 26 aa, Entamoeba histolytica
LSQLKNLRFCVLPNFMKIYHDQLCDE

SEQ ID NO: 2687754 - protein, 17 aa, Entamoeba histolytica
LSQLSLYNFTYELTHLY

SEQ ID NO: 2687755 - protein, 24 aa, Entamoeba histolytica
LSQMKRIIPRLSTIEIDYIDQLLL

SEQ ID NO: 2687756 - protein, 18 aa, Entamoeba histolytica
LSQSFRYFLSINSVNVEI

SEQ ID NO: 2687757 - protein, 22 aa, Entamoeba histolytica
LSQSGDLLIPFIENLINQNAEV

SEQ ID NO: 2687758 - protein, 17 aa, Entamoeba histolytica
LSQSRVREMKKKKNQKG

SEQ ID NO: 2687759 - protein, 17 aa, Entamoeba histolytica
LSRFCNVFDSFDNLKEG

SEQ ID NO: 2687760 - protein, 17 aa, Entamoeba histolytica
LSRLLFNSCIWTETHNY

SEQ ID NO: 2687761 - protein, 17 aa, Entamoeba histolytica
LSRMGKYQKCLCASLFF

SEQ ID NO: 2687762 - protein, 21 aa, Entamoeba histolytica
LSSDFIIPFVKCEESMFSYLT

SEQ ID NO: 2687763 - protein, 22 aa, Entamoeba histolytica
LSSFILYCSQFFIFDSKYQTLM

SEQ ID NO: 2687764 - protein, 20 aa, Entamoeba histolytica
LSSFPIISICPIPNSRLIAC

SEQ ID NO: 2687765 - protein, 22 aa, Entamoeba histolytica
LSSFSTYPCFKNVKQGEPNCDC

SEQ ID NO: 2687766 - protein, 32 aa, Entamoeba histolytica
LSSGNTLLIRRGCDLAGIVFRILNFQKTSVLP

SEQ ID NO: 2687767 - protein, 28 aa, Entamoeba histolytica
LSSIEVVGKGWLLCCVKDAISSVSNIST

SEQ ID NO: 2687768 - protein, 21 aa, Entamoeba histolytica
LSSIHLLEFILKVKRSSHLNS

SEQ ID NO: 2687769 - protein, 18 aa, Entamoeba histolytica
LSSIKVLYLESIDTMEMQ

SEQ ID NO: 2687770 - protein, 25 aa, Entamoeba histolytica
LSSKAGGVGLNLIGCSRLILFDPDW

SEQ ID NO: 2687771 - protein, 21 aa, Entamoeba histolytica
LSSKETIAYSCHSLNKKYDSV

SEQ ID NO: 2687772 - protein, 23 aa, Entamoeba histolytica
LSSKLRSALGISDNDTPPWAEAI

SEQ ID NO: 2687773 - protein, 20 aa, Entamoeba histolytica
LSSLALIFALHHYKPTPIYV

SEQ ID NO: 2687774 - protein, 18 aa, Entamoeba histolytica
LSSLICYSTPISSDIEIN

SEQ ID NO: 2687775 - protein, 20 aa, Entamoeba histolytica
LSSNFIFFVNLFQRSSLDMA

SEQ ID NO: 2687776 - protein, 19 aa, Entamoeba histolytica
LSSNGSWSSIPIIVTEKIE

SEQ ID NO: 2687777 - protein, 25 aa, Entamoeba histolytica
LSSRFRTPIPLVRRTIESLIEREYI

SEQ ID NO: 2687778 - protein, 24 aa, Entamoeba histolytica
LSSTPRAQPGLGLGGGLGTQPAGL

SEQ ID NO: 2687779 - protein, 20 aa, Entamoeba histolytica
LSSTVEFPSALLILQLLINV

SEQ ID NO: 2687780 - protein, 25 aa, Entamoeba histolytica
LSSWAGVMQLPIPVSYVVDALMYDD

SEQ ID NO: 2687781 - protein, 17 aa, Entamoeba histolytica
LSTATAFLKDMESYRNN

SEQ ID NO: 2687782 - protein, 25 aa, Entamoeba histolytica
LSTESFCLPFYWNGSRNEADFIEFP

SEQ ID NO: 2687783 - protein, 20 aa, Entamoeba histolytica
LSTFGGGLVLISHHQHMIES

SEQ ID NO: 2687784 - protein, 17 aa, Entamoeba histolytica
LSTFGIGLVLINVTSKT

SEQ ID NO: 2687785 - protein, 17 aa, Entamoeba histolytica
LSTILSFDDDNVDFKTK

SEQ ID NO: 2687786 - protein, 20 aa, Entamoeba histolytica
LSTISRGYAQLAMYVKAVNN

SEQ ID NO: 2687787 - protein, 17 aa, Entamoeba histolytica
LSTLILKGYYHVCMDKF

SEQ ID NO: 2687788 - protein, 26 aa, Entamoeba histolytica
LSTLNMLTWKGLKFRVEYANPNILDK

SEQ ID NO: 2687789 - protein, 28 aa, Entamoeba histolytica
LSTLYKDPRTILIFKVNSPINDKWGFPK

SEQ ID NO: 2687790 - protein, 23 aa, Entamoeba histolytica
LSTMKGCVGLVFGNESNGLNTEE

SEQ ID NO: 2687791 - protein, 37 aa, Entamoeba histolytica
LSTNEGFLFPMSDSFIFVFKRIRIIMFKDIKSVDILR

SEQ ID NO: 2687792 - protein, 20 aa, Entamoeba histolytica
LSTQDAFAAMLSRPLKNVSL

SEQ ID NO: 2687793 - protein, 31 aa, Entamoeba histolytica
LSTRLGEAFSQFIPMMNVYKLFLGNSDTSLQ

SEQ ID NO: 2687794 - protein, 17 aa, Entamoeba histolytica
LSTSFLPFVAHYTSLAT

SEQ ID NO: 2687795 - protein, 17 aa, Entamoeba histolytica
LSTSFSQCSELWNKIEK

SEQ ID NO: 2687796 - protein, 24 aa, Entamoeba histolytica
LSVAVKSGNGWRQFTGNEMANLIA

SEQ ID NO: 2687797 - protein, 17 aa, Entamoeba histolytica
LSVIFTRLLFSIQTLSQ

SEQ ID NO: 2687798 - protein, 17 aa, Entamoeba histolytica
LSVKCFIETELKKNEIE

SEQ ID NO: 2687799 - protein, 18 aa, Entamoeba histolytica
LSVKIPKEIISPRKKTLK

SEQ ID NO: 2687800 - protein, 17 aa, Entamoeba histolytica
LSVLCILLASLNYKVLV

SEQ ID NO: 2687801 - protein, 17 aa, Entamoeba histolytica
LSVMAYVSYFRHYEAEK

SEQ ID NO: 2687802 - protein, 19 aa, Entamoeba histolytica
LSWKEVYKHPYVIQSLNLS

SEQ ID NO: 2687803 - protein, 24 aa, Entamoeba histolytica
LSYADTAIFERYIVNKYVKVVNGQ

SEQ ID NO: 2687804 - protein, 19 aa, Entamoeba histolytica
LSYDPSWFVLFAKSLLKTV

SEQ ID NO: 2687805 - protein, 25 aa, Entamoeba histolytica
LSYGACQFPTLGFVVDRYYQIKAFT

SEQ ID NO: 2687806 - protein, 24 aa, Entamoeba histolytica
LSYIPQQRIIYVPMQQVIDPYTGQ

SEQ ID NO: 2687807 - protein, 28 aa, Entamoeba histolytica
LSYKHLLRLYGRMNLLLSQIDKKQQLKQ

SEQ ID NO: 2687808 - protein, 21 aa, Entamoeba histolytica
LSYKTKLMIGSIYQELSYSID

SEQ ID NO: 2687809 - protein, 21 aa, Entamoeba histolytica
LSYQALNMWTEAVEHYCESLL

SEQ ID NO: 2687810 - protein, 22 aa, Entamoeba histolytica
LTAILEFFPSVAMNEPQIAYVA

SEQ ID NO: 2687811 - protein, 17 aa, Entamoeba histolytica
LTAIQRWLHLKMKSPIL

SEQ ID NO: 2687812 - protein, 27 aa, Entamoeba histolytica
LTALELFDIPSKCYLDGSLKYFTHINS

SEQ ID NO: 2687813 - protein, 27 aa, Entamoeba histolytica
LTALKHPFCCLSVLNLLVALRQHTFIR

SEQ ID NO: 2687814 - protein, 18 aa, Entamoeba histolytica
LTALQCLFSKSLVSHEFT

SEQ ID NO: 2687815 - protein, 26 aa, Entamoeba histolytica
LTCIIPTERYCIIVPFEFNLEKLQFD

SEQ ID NO: 2687816 - protein, 22 aa, Entamoeba histolytica
LTCYECLAMGNAVGMIEVVLRS

SEQ ID NO: 2687817 - protein, 28 aa, Entamoeba histolytica
LTDACFCKKELFLLCGTILTSGDNTRKV

SEQ ID NO: 2687818 - protein, 17 aa, Entamoeba histolytica
LTDCIRGRIVFMFEPPK

SEQ ID NO: 2687819 - protein, 25 aa, Entamoeba histolytica
LTDKTSFEMVGYWLSEMEKDNNRPI

SEQ ID NO: 2687820 - protein, 24 aa, Entamoeba histolytica
LTDLPECICEMSSLVTLNVSGNDI

SEQ ID NO: 2687821 - protein, 25 aa, Entamoeba histolytica
LTDLSRSFGEWVISMFNKTLNGFTC

SEQ ID NO: 2687822 - protein, 22 aa, Entamoeba histolytica
LTDPNWIPTFTVVSDDKLEEEN

SEQ ID NO: 2687823 - protein, 17 aa, Entamoeba histolytica
LTDSLVLSITNYINSQR

SEQ ID NO: 2687824 - protein, 17 aa, Entamoeba histolytica
LTEALLNIGERCTTSEV

SEQ ID NO: 2687825 - protein, 22 aa, Entamoeba histolytica
LTECEFKCVLIYDTPDKRLVPF

SEQ ID NO: 2687826 - protein, 19 aa, Entamoeba histolytica
LTECLRAWNYKGNVIDAYL

SEQ ID NO: 2687827 - protein, 18 aa, Entamoeba histolytica
LTEFECFEPLTFSTQAVS

SEQ ID NO: 2687828 - protein, 21 aa, Entamoeba histolytica
LTEGILKPEIKEMIQNAHIIR

SEQ ID NO: 2687829 - protein, 24 aa, Entamoeba histolytica
LTEICFDVAITFGKRTEYRMLYFN

SEQ ID NO: 2687830 - protein, 23 aa, Entamoeba histolytica
LTEIRLSLIHFIEGMLQYDPMKR

SEQ ID NO: 2687831 - protein, 23 aa, Entamoeba histolytica
LTEKRLNNMMLFKNIDYLEPYCI

SEQ ID NO: 2687832 - protein, 18 aa, Entamoeba histolytica
LTELLKMIDMKDVEIDEA

SEQ ID NO: 2687833 - protein, 22 aa, Entamoeba histolytica
LTELRINKRLQKFISGEHVLDQ

SEQ ID NO: 2687834 - protein, 18 aa, Entamoeba histolytica
LTERYYALCVKYRSSPLL

SEQ ID NO: 2687835 - protein, 25 aa, Entamoeba histolytica
LTESCGGCTTCLPGMNDPQILSCGS

SEQ ID NO: 2687836 - protein, 17 aa, Entamoeba histolytica
LTEVCIQSAAAPGYFGS

SEQ ID NO: 2687837 - protein, 20 aa, Entamoeba histolytica
LTFEEICWSLVKMIDDAPNH

SEQ ID NO: 2687838 - protein, 23 aa, Entamoeba histolytica
LTFKHPFESFTFMTSLIGEILNG

SEQ ID NO: 2687839 - protein, 19 aa, Entamoeba histolytica
LTFLKAVEFFGEYEDAIPL

SEQ ID NO: 2687840 - protein, 17 aa, Entamoeba histolytica
LTFLSSSCLMGIPKNQI

SEQ ID NO: 2687841 - protein, 27 aa, Entamoeba histolytica
LTFRSKGRIPAICWRGAGNQTISRSAQ

SEQ ID NO: 2687842 - protein, 25 aa, Entamoeba histolytica
LTFYRYPQAWIICAQYFERRGNIEL

SEQ ID NO: 2687843 - protein, 41 aa, Entamoeba histolytica; identical to SEQ ID NO: 2495783

SEQ ID NO: 2687844 - protein, 25 aa, Entamoeba histolytica
LTGKGRGRCAVRICSRGYHLSDEKK

SEQ ID NO: 2687845 - protein, 29 aa, Entamoeba histolytica
LTGPKRERKVCLIRMDYDIVSKGIEQRHL

SEQ ID NO: 2687846 - protein, 18 aa, Entamoeba histolytica
LTGTTAFISDDFNEFYND

SEQ ID NO: 2687847 - protein, 17 aa, Entamoeba histolytica
LTHFQLNISSGKHLKLT

SEQ ID NO: 2687848 - protein, 23 aa, Entamoeba histolytica
LTHIGAFAFSHCSSLKQIKLPPL

SEQ ID NO: 2687849 - protein, 19 aa, Entamoeba histolytica
LTHLFALNIFESTIKSPEY

SEQ ID NO: 2687850 - protein, 22 aa, Entamoeba histolytica
LTHQWLCGASVYSNPYFANLLK

SEQ ID NO: 2687851 - protein, 19 aa, Entamoeba histolytica
LTHTLPILVDLILGLFKND

SEQ ID NO: 2687852 - protein, 27 aa, Entamoeba histolytica
LTHWICPHSRYYCCVCHQIVADQPQRF

SEQ ID NO: 2687853 - protein, 17 aa, Entamoeba histolytica
LTICTRSIMLKQKFFAS

SEQ ID NO: 2687854 - protein, 18 aa, Entamoeba histolytica
LTIEKGIIKYEEKERIIT

SEQ ID NO: 2687855 - protein, 19 aa, Entamoeba histolytica
LTILSEMWKKLDPVEKDKY

SEQ ID NO: 2687856 - protein, 19 aa, Entamoeba histolytica
LTINSCFIVGLPALNVNSI

SEQ ID NO: 2687857 - protein, 18 aa, Entamoeba histolytica
LTIRCIETLYQDTKDMTP

SEQ ID NO: 2687858 - protein, 26 aa, Entamoeba histolytica
LTIRLKLNCIVFRPVINTYLIATVCQ

SEQ ID NO: 2687859 - protein, 23 aa, Entamoeba histolytica
LTKCLLVSMACWELFSNTELFNF

SEQ ID NO: 2687860 - protein, 18 aa, Entamoeba histolytica
LTKCWKDFGDYAQPMCLV

SEQ ID NO: 2687861 - protein, 21 aa, Entamoeba histolytica
LTKDFFYSHFILLDKESLHFI

SEQ ID NO: 2687862 - protein, 19 aa, Entamoeba histolytica
LTKDMLLFECYKISNFTPI

SEQ ID NO: 2687863 - protein, 23 aa, Entamoeba histolytica
LTKDSLPYAFSMKDTTLIKPKVT

SEQ ID NO: 2687864 - protein, 27 aa, Entamoeba histolytica
LTKEIKETMLISSHFIKTLSIEEINSI

SEQ ID NO: 2687865 - protein, 17 aa, Entamoeba histolytica
LTKEQLYHYGISVVQKC

SEQ ID NO: 2687866 - protein, 26 aa, Entamoeba histolytica
LTKERYREIVGLIMINLGELSKHQDL

SEQ ID NO: 2687867 - protein, 19 aa, Entamoeba histolytica
LTKICTVERRLEISRLIEE

SEQ ID NO: 2687868 - protein, 17 aa, Entamoeba histolytica
LTKIITLIQNYALMLTD

SEQ ID NO: 2687869 - protein, 18 aa, Entamoeba histolytica
LTKIPVQFIHNGTLNYFD

SEQ ID NO: 2687870 - protein, 24 aa, Entamoeba histolytica
LTKKMKLAYLILRYSEIEDHYIRK

SEQ ID NO: 2687871 - protein, 18 aa, Entamoeba histolytica
LTKLRTNLIQELQNASSQ

SEQ ID NO: 2687872 - protein, 23 aa, Entamoeba histolytica
LTKLSARIPSQFNQRIQEFINIY

SEQ ID NO: 2687873 - protein, 28 aa, Entamoeba histolytica
LTKMSVCSVGPILRSSFVKKFSLAAQKR

SEQ ID NO: 2687874 - protein, 19 aa, Entamoeba histolytica
LTKQIKLLISLFDKKKKQE

SEQ ID NO: 2687875 - protein, 24 aa, Entamoeba histolytica
LTKRLDKGVCSWYDGPCLVELLDS

SEQ ID NO: 2687876 - protein, 24 aa, Entamoeba histolytica
LTKSFKDQPPRISITPKPTSNNPF

SEQ ID NO: 2687877 - protein, 18 aa, Entamoeba histolytica
LTKSKWKIPYQLIESLGF

SEQ ID NO: 2687878 - protein, 24 aa, Entamoeba histolytica
LTKTMAELGCEIVVISPYYNMNKK

SEQ ID NO: 2687879 - protein, 18 aa, Entamoeba histolytica
LTKYVLQACGGFSKTVDS

SEQ ID NO: 2687880 - protein, 17 aa, Entamoeba histolytica
LTLAYTLHGNIYKEDYI

SEQ ID NO: 2687881 - protein, 22 aa, Entamoeba histolytica
LTLEGIKQFYIDVVKDEYKIDT

SEQ ID NO: 2687882 - protein, 20 aa, Entamoeba histolytica
LTLFCTIKLHGMKIPSTVYF

SEQ ID NO: 2687883 - protein, 18 aa, Entamoeba histolytica
LTLGVIKNIMPAIASTNS

SEQ ID NO: 2687884 - protein, 17 aa, Entamoeba histolytica
LTLKKPNFWKLRRRDCP

SEQ ID NO: 2687885 - protein, 18 aa, Entamoeba histolytica
LTLLDVFMLYQTSTFPAT

SEQ ID NO: 2687886 - protein, 23 aa, Entamoeba histolytica
LTLNELKRLICNSQKDRDNTEFT

SEQ ID NO: 2687887 - protein, 17 aa, Entamoeba histolytica
LTLPGFVLASDTIFISQ

SEQ ID NO: 2687888 - protein, 25 aa, Entamoeba histolytica
LTLRRKRLNAILSEERLSQTKTLGR

SEQ ID NO: 2687889 - protein, 26 aa, Entamoeba histolytica
LTLSRCIMKKQFPLMTCLTYLNCNKT

SEQ ID NO: 2687890 - protein, 20 aa, Entamoeba histolytica
LTMNCPRVTQNFFSAPNTLF

SEQ ID NO: 2687891 - protein, 23 aa, Entamoeba histolytica
LTMTSCPYNIMSYNTPIEVSTFF

SEQ ID NO: 2687892 - protein, 25 aa, Entamoeba histolytica
LTNEIRPGFTKSWDDFDRIFRDIKN

SEQ ID NO: 2687893 - protein, 18 aa, Entamoeba histolytica
LTNFKFLVELDCQNNQGI

SEQ ID NO: 2687894 - protein, 17 aa, Entamoeba histolytica
LTNFMKWLSSSRLHSRI

SEQ ID NO: 2687895 - protein, 27 aa, Entamoeba histolytica
LTNFSMKVAVPKWIELQLMSPTSNTLQ

SEQ ID NO: 2687896 - protein, 17 aa, Entamoeba histolytica
LTNFVGILSTGLRIAPP

SEQ ID NO: 2687897 - protein, 25 aa, Entamoeba histolytica
LTNGEKKLSTSLCNEQDELQKSKSS

SEQ ID NO: 2687898 - protein, 18 aa, Entamoeba histolytica
LTNLTSLVFQSYERRKRI

SEQ ID NO: 2687899 - protein, 25 aa, Entamoeba histolytica
LTNMKEPACLALDIEEDFYVLRKKD

SEQ ID NO: 2687900 - protein, 17 aa, Entamoeba histolytica
LTNQFLYSRNDKKIKGV

SEQ ID NO: 2687901 - protein, 26 aa, Entamoeba histolytica
LTNVPFSIGIEGRFGNTIFLVEKGND

SEQ ID NO: 2687902 - protein, 27 aa, Entamoeba histolytica
LTNYKVVFVVKCVIFNVSIPLTKIADF

SEQ ID NO: 2687903 - protein, 26 aa, Entamoeba histolytica
LTNYKVVFVVKCVIFNVSISLTKIAD

SEQ ID NO: 2687904 - protein, 22 aa, Entamoeba histolytica
LTPADFKLVLPYLDDFWARDGL

SEQ ID NO: 2687905 - protein, 23 aa, Entamoeba histolytica
LTPADFKLVLPYLDDFWARDGLA

SEQ ID NO: 2687906 - protein, 17 aa, Entamoeba histolytica
LTPDQALAHPFILGTAI

SEQ ID NO: 2687907 - protein, 26 aa, Entamoeba histolytica
LTPEIKLKLCTEMALSVNWLHNVVGM

SEQ ID NO: 2687908 - protein, 25 aa, Entamoeba histolytica
LTPELRGVLKAAGLKRKDLCNPETV

SEQ ID NO: 2687909 - protein, 25 aa, Entamoeba histolytica
LTPELYDWLRVCTGAQIFQGYGMTE

SEQ ID NO: 2687910 - protein, 18 aa, Entamoeba histolytica
LTPFLKFPPFEEAKKMIT

SEQ ID NO: 2687911 - protein, 17 aa, Entamoeba histolytica
LTPKCKRSYSVSSNGGR

SEQ ID NO: 2687912 - protein, 23 aa, Entamoeba histolytica
LTPLHYCCVYGMVHLIDDIIAAA

SEQ ID NO: 2687913 - protein, 22 aa, Entamoeba histolytica
LTPNAEPLIALFQVNLRGDVSI

SEQ ID NO: 2687914 - protein, 21 aa, Entamoeba histolytica
LTPTLLRLSINIPQIKMICAV

SEQ ID NO: 2687915 - protein, 25 aa, Entamoeba histolytica
LTPYNLRFFKNFYWFEKVARINEWL

SEQ ID NO: 2687916 - protein, 30 aa, Entamoeba histolytica; identical to SEQ ID NO: 2495861

SEQ ID NO: 2687917 - protein, 19 aa, Entamoeba histolytica
LTQSELYKQIGIDPPRGCL

SEQ ID NO: 2687918 - protein, 17 aa, Entamoeba histolytica
LTQSTSLEWARNYINNK

SEQ ID NO: 2687919 - protein, 17 aa, Entamoeba histolytica
LTRAFGIAIRKLLSKHI

SEQ ID NO: 2687920 - protein, 29 aa, Entamoeba histolytica
LTRDKIKTVSTCLQLAKSQLNIPILLSAQ

SEQ ID NO: 2687921 - protein, 17 aa, Entamoeba histolytica
LTRICFGNSRLSDEALQ

SEQ ID NO: 2687922 - protein, 19 aa, Entamoeba histolytica
LTRKVCIPSYLTDTGKDDP

SEQ ID NO: 2687923 - protein, 21 aa, Entamoeba histolytica
LTRLKGYRYSLESTFKYLCQF

SEQ ID NO: 2687924 - protein, 25 aa, Entamoeba histolytica
LTRLNLPILDVFWLSQYPAVLLSTG

SEQ ID NO: 2687925 - protein, 17 aa, Entamoeba histolytica
LTRRFQQKFTRKQYSHF

SEQ ID NO: 2687926 - protein, 18 aa, Entamoeba histolytica
LTRSQVEIVYGFFHNDFD

SEQ ID NO: 2687927 - protein, 22 aa, Entamoeba histolytica
LTRVSSLLFKTDRDPIKRQNKK

SEQ ID NO: 2687928 - protein, 20 aa, Entamoeba histolytica
LTSDGGWGCTIRACQMLLAN

SEQ ID NO: 2687929 - protein, 26 aa, Entamoeba histolytica
LTSFINCKRSLYTESIEIFYDKIYIE

SEQ ID NO: 2687930 - protein, 17 aa, Entamoeba histolytica
LTSGGCFNCNSDLVEFN

SEQ ID NO: 2687931 - protein, 19 aa, Entamoeba histolytica
LTSGVGMIQLRFRERLTTF

SEQ ID NO: 2687932 - protein, 19 aa, Entamoeba histolytica
LTSILFEIFNIFLKDVDDN

SEQ ID NO: 2687933 - protein, 18 aa, Entamoeba histolytica
LTSISFLLSQKIISHVIA

SEQ ID NO: 2687934 - protein, 20 aa, Entamoeba histolytica
LTSISFRLTDISAMLRTPIY

SEQ ID NO: 2687935 - protein, 19 aa, Entamoeba histolytica
LTSKIQICYKDVKDPLLNS

SEQ ID NO: 2687936 - protein, 19 aa, Entamoeba histolytica
LTSKRLHMILSSLVTSPYS

SEQ ID NO: 2687937 - protein, 17 aa, Entamoeba histolytica
LTSLCIGGVSCAHYSPV

SEQ ID NO: 2687938 - protein, 19 aa, Entamoeba histolytica
LTSLRVLLQKAITQTHLQQ

SEQ ID NO: 2687939 - protein, 18 aa, Entamoeba histolytica
LTSNPVLRSYSFDTKEDI

SEQ ID NO: 2687940 - protein, 19 aa, Entamoeba histolytica
LTSPVPLQYNEEIKLSSDH

SEQ ID NO: 2687941 - protein, 17 aa, Entamoeba histolytica
LTSSVTVCIIGNNLIDF

SEQ ID NO: 2687942 - protein, 17 aa, Entamoeba histolytica
LTTALFCEKYIDTLFKL

SEQ ID NO: 2687943 - protein, 23 aa, Entamoeba histolytica
LTTARGFIKRICQISRKQRYQRL

SEQ ID NO: 2687944 - protein, 24 aa, Entamoeba histolytica
LTTDVGWGCTIRAMQMMIANAMET

SEQ ID NO: 2687945 - protein, 26 aa, Entamoeba histolytica
LTTETRKLLFNYVALGVKLMNASNSN

SEQ ID NO: 2687946 - protein, 18 aa, Entamoeba histolytica
LTTISIKHPDVWSKVKKS

SEQ ID NO: 2687947 - protein, 18 aa, Entamoeba histolytica
LTTIYKLKKGELIKKSPG

SEQ ID NO: 2687948 - protein, 17 aa, Entamoeba histolytica
LTTVACGSLESFLEDSV

SEQ ID NO: 2687949 - protein, 26 aa, Entamoeba histolytica
LTVALQLKLALAIDELEKSAQVIDKK

SEQ ID NO: 2687950 - protein, 23 aa, Entamoeba histolytica
LTVICSKFPNLVSVNLKESQITS

SEQ ID NO: 2687951 - protein, 23 aa, Entamoeba histolytica
LTVIFKNKFLNFLKNYDHKHDEN

SEQ ID NO: 2687952 - protein, 24 aa, Entamoeba histolytica
LTVKGVPFLLKFVEIQLVGAKGEI

SEQ ID NO: 2687953 - protein, 17 aa, Entamoeba histolytica
LTVKKKKYFKFLVILST

SEQ ID NO: 2687954 - protein, 26 aa, Entamoeba histolytica
LTVMQALVLKHRWFPKLVKSKEPIVV

SEQ ID NO: 2687955 - protein, 26 aa, Entamoeba histolytica
LTVPSKWIKAMLMFVLLIKSLEEKEK

SEQ ID NO: 2687956 - protein, 19 aa, Entamoeba histolytica
LTVRLKQEFNKYDLERRGF

SEQ ID NO: 2687957 - protein, 19 aa, Entamoeba histolytica
LTVTIPVSTEWKGAMRHNG

SEQ ID NO: 2687958 - protein, 18 aa, Entamoeba histolytica
LTVYRDFITPIELLNKFI

SEQ ID NO: 2687959 - protein, 25 aa, Entamoeba histolytica
LTYAKELFPDLGMKFIESRYDQVMN

SEQ ID NO: 2687960 - protein, 20 aa, Entamoeba histolytica
LTYCYASGYYSYKWAEILEA

SEQ ID NO: 2687961 - protein, 17 aa, Entamoeba histolytica
LTYLPLYPKRAKNINQK

SEQ ID NO: 2687962 - protein, 23 aa, Entamoeba histolytica
LTYSGRIKLTITIKENDSNKTIE

SEQ ID NO: 2687963 - protein, 24 aa, Entamoeba histolytica
LTYSKRLALDFVSQMLKEEFETHT

SEQ ID NO: 2687964 - protein, 17 aa, Entamoeba histolytica
LTYYASRYYVDPFAQFF

SEQ ID NO: 2687965 - protein, 18 aa, Entamoeba histolytica
LVAIKNHRTTIVLTLLGG

SEQ ID NO: 2687966 - protein, 25 aa, Entamoeba histolytica
LVALKLRFPQRISLLRGNHECSLQT

SEQ ID NO: 2687967 - protein, 19 aa, Entamoeba histolytica
LVCQCSGKYRSCSYSPRGA

SEQ ID NO: 2687968 - protein, 19 aa, Entamoeba histolytica
LVDCGFKVVAEKVEGTVAK

SEQ ID NO: 2687969 - protein, 23 aa, Entamoeba histolytica
LVDHLKAVGGVFAFSETAVQIAD

SEQ ID NO: 2687970 - protein, 25 aa, Entamoeba histolytica
LVDRGSRGLECIIGVLTLIIEYPTL

SEQ ID NO: 2687971 - protein, 25 aa, Entamoeba histolytica
LVDSWKRERYLIGIIKGIRKENKYI

SEQ ID NO: 2687972 - protein, 17 aa, Entamoeba histolytica
LVEHMILCHKDYPICQP

SEQ ID NO: 2687973 - protein, 30 aa, Entamoeba histolytica
LVEIGPRYCMRCIKILSGCFSGSVVYLNEK

SEQ ID NO: 2687974 - protein, 24 aa, Entamoeba histolytica
LVEILWKLGDSYFADVVDELYNGL

SEQ ID NO: 2687975 - protein, 25 aa, Entamoeba histolytica
LVEIRVCHLISILFLGRIRSKNLFI

SEQ ID NO: 2687976 - protein, 19 aa, Entamoeba histolytica
LVEKHGYKVKRRYTKSSFK

SEQ ID NO: 2687977 - protein, 19 aa, Entamoeba histolytica
LVELIEFAFYVIFHEGPAF

SEQ ID NO: 2687978 - protein, 17 aa, Entamoeba histolytica
LVELVFGGRRRRFIINL

SEQ ID NO: 2687979 - protein, 19 aa, Entamoeba histolytica
LVENEIRKYWNFGGVRIED

SEQ ID NO: 2687980 - protein, 25 aa, Entamoeba histolytica
LVESLKLIVYRNLFDLVQKSLNTNK

SEQ ID NO: 2687981 - protein, 23 aa, Entamoeba histolytica
LVETLRLIVYRNLLEIIFTTKKT

SEQ ID NO: 2687982 - protein, 19 aa, Entamoeba histolytica
LVETWRGGDVPEFEPYLPV

SEQ ID NO: 2687983 - protein, 24 aa, Entamoeba histolytica
LVFDEIAHVFGVFVNEIIQPGQWL

SEQ ID NO: 2687984 - protein, 25 aa, Entamoeba histolytica
LVFDKCGIELLEFILDPLSTHFLPP

SEQ ID NO: 2687985 - protein, 25 aa, Entamoeba histolytica
LVFTEFMFCVKLQIFQEIERIIRNE

SEQ ID NO: 2687986 - protein, 18 aa, Entamoeba histolytica
LVGAAIIPYEMWKEAIEL

SEQ ID NO: 2687987 - protein, 24 aa, Entamoeba histolytica
LVGDFLKFNYADGIFMLSPNPKQP

SEQ ID NO: 2687988 - protein, 24 aa, Entamoeba histolytica
LVGFLNTLGMPFKIGEIAFYDYSI

SEQ ID NO: 2687989 - protein, 17 aa, Entamoeba histolytica
LVGFNLSIETVRFMLDI

SEQ ID NO: 2687990 - protein, 18 aa, Entamoeba histolytica
LVGIGLGFYLEVSINEAK

SEQ ID NO: 2687991 - protein, 17 aa, Entamoeba histolytica
LVGIVIHNGDAHGGHYF

SEQ ID NO: 2687992 - protein, 17 aa, Entamoeba histolytica
LVGRKVDEIMDWEKRLW

SEQ ID NO: 2687993 - protein, 18 aa, Entamoeba histolytica
LVHGYCLAPALVLSLNIA

SEQ ID NO: 2687994 - protein, 18 aa, Entamoeba histolytica
LVHHLIMEYGIYKRLNIY

SEQ ID NO: 2687995 - protein, 18 aa, Entamoeba histolytica
LVHSCLFQSDLFDELFIE

SEQ ID NO: 2687996 - protein, 19 aa, Entamoeba histolytica
LVHSPFWKEIIKCTITLTP

SEQ ID NO: 2687997 - protein, 18 aa, Entamoeba histolytica
LVICTVRLAKNGHEICDD

SEQ ID NO: 2687998 - protein, 28 aa, Entamoeba histolytica
LVIDEPFRWEGCSWEWCWDSVDNWKVNR

SEQ ID NO: 2687999 - protein, 18 aa, Entamoeba histolytica
LVIDHIMNIFKRADRDAV

SEQ ID NO: 2688000 - protein, 27 aa, Entamoeba histolytica
LVIKNMKDALSFLPFLNYITLKHIIFH

SEQ ID NO: 2688001 - protein, 29 aa, Entamoeba histolytica
LVINTLKYIYFRIERLLTVSFGELGEEIK

SEQ ID NO: 2688002 - protein, 17 aa, Entamoeba histolytica
LVIPKEIWRLCDYVLPF

SEQ ID NO: 2688003 - protein, 19 aa, Entamoeba histolytica
LVIQIPEMLLQISNDEQIL

SEQ ID NO: 2688004 - protein, 23 aa, Entamoeba histolytica
LVITIPGAFWVTSDGKVFSNSNI

SEQ ID NO: 2688005 - protein, 25 aa, Entamoeba histolytica
LVIVPRTKGGFSYGYVDSMKQENRC

SEQ ID NO: 2688006 - protein, 19 aa, Entamoeba histolytica
LVIVVGIPYPSLGDINVNL

SEQ ID NO: 2688007 - protein, 26 aa, Entamoeba histolytica
LVKCAEEICEVFADSVSSLVLMLVAL

SEQ ID NO: 2688008 - protein, 17 aa, Entamoeba histolytica
LVKDGHVIFDFCNTGIL

SEQ ID NO: 2688009 - protein, 24 aa, Entamoeba histolytica
LVKKGVIVSSVIPKGMRKMTKIII

SEQ ID NO: 2688010 - protein, 17 aa, Entamoeba histolytica
LVKKIPLILLKKISLKK

SEQ ID NO: 2688011 - protein, 38 aa, Entamoeba histolytica
LVKMFPFKFDLIYKWLRREGKSILKLSSFLNSQKQNTE

SEQ ID NO: 2688012 - protein, 24 aa, Entamoeba histolytica
LVKNSRIWLDSVIKGNKKRVRTLV

SEQ ID NO: 2688013 - protein, 18 aa, Entamoeba histolytica
LVKREKRLSWEMPQSQQE

SEQ ID NO: 2688014 - protein, 22 aa, Entamoeba histolytica
LVKSSHTLRPFYITLPSSKSCL

SEQ ID NO: 2688015 - protein, 23 aa, Entamoeba histolytica
LVKSSHTLRPFYITLPSSKSCLS

SEQ ID NO: 2688016 - protein, 19 aa, Entamoeba histolytica
LVKVWDLEIQQCRQTIVGH

SEQ ID NO: 2688017 - protein, 19 aa, Entamoeba histolytica
LVLFCKVPKTPSIEKSVKE

SEQ ID NO: 2688018 - protein, 25 aa, Entamoeba histolytica
LVLKCLKAIIISNPNLIGFCVDYLC

SEQ ID NO: 2688019 - protein, 26 aa, Entamoeba histolytica
LVLKCTSLGLSTVWLGGTFTVSAFNV

SEQ ID NO: 2688020 - protein, 17 aa, Entamoeba histolytica
LVLKSYFDIIIQPALTP

SEQ ID NO: 2688021 - protein, 17 aa, Entamoeba histolytica
LVLKYSPLVARSAELIK

SEQ ID NO: 2688022 - protein, 18 aa, Entamoeba histolytica
LVLNKCDLVPTWATARWV

SEQ ID NO: 2688023 - protein, 24 aa, Entamoeba histolytica
LVLNPGSWKALPRTTKEYEDFDWL

SEQ ID NO: 2688024 - protein, 25 aa, Entamoeba histolytica
LVLPCIQCQILSLIGDFIIDQLLLK

SEQ ID NO: 2688025 - protein, 20 aa, Entamoeba histolytica
LVLQEIGPRFDLRPYQIKLG

SEQ ID NO: 2688026 - protein, 21 aa, Entamoeba histolytica
LVLSCLLHPFYFITFALDNPI

SEQ ID NO: 2688027 - protein, 18 aa, Entamoeba histolytica
LVNELVKHSTAINIIEES

SEQ ID NO: 2688028 - protein, 18 aa, Entamoeba histolytica
LVNFDIGIEEFWRNYDDE

SEQ ID NO: 2688029 - protein, 23 aa, Entamoeba histolytica
LVNLKLDGCFTFIELPTTLTSLK

SEQ ID NO: 2688030 - protein, 30 aa, Entamoeba histolytica
LVNSWKLCPIRCVMCSNVSIPTHELSKLPF

SEQ ID NO: 2688031 - protein, 25 aa, Entamoeba histolytica
LVPILSRLYVDMALNVKPICITGYP

SEQ ID NO: 2688032 - protein, 25 aa, Entamoeba histolytica
LVPLKLRCGMYLPMEEMKKYGNKIL

SEQ ID NO: 2688033 - protein, 17 aa, Entamoeba histolytica
LVPNFKTPLSIDKLQKI

SEQ ID NO: 2688034 - protein, 18 aa, Entamoeba histolytica
LVPRVKIFAGKAAIGYDM

SEQ ID NO: 2688035 - protein, 17 aa, Entamoeba histolytica
LVPSGVLCIVFLTKDKI

SEQ ID NO: 2688036 - protein, 18 aa, Entamoeba histolytica
LVQHSTISLGGPLVKLHD

SEQ ID NO: 2688037 - protein, 17 aa, Entamoeba histolytica
LVQIFWSLCLLLDRHFK

SEQ ID NO: 2688038 - protein, 29 aa, Entamoeba histolytica
LVQKWKDNCVEFWKIMTFITMKYIQIYSS

SEQ ID NO: 2688039 - protein, 17 aa, Entamoeba histolytica
LVQLKLPLINNIYPSAT

SEQ ID NO: 2688040 - protein, 17 aa, Entamoeba histolytica
LVQRKNVVKELIKTEEV

SEQ ID NO: 2688041 - protein, 17 aa, Entamoeba histolytica
LVQRVMFTLDNMKKNKA

SEQ ID NO: 2688042 - protein, 20 aa, Entamoeba histolytica
LVQSSFPFLVFLLQSPSNEI

SEQ ID NO: 2688043 - protein, 23 aa, Entamoeba histolytica
LVRELKFSFDCDSVVVELPYVRR

SEQ ID NO: 2688044 - protein, 27 aa, Entamoeba histolytica
LVRKHCFSAICHIYRLYPDLVPNASKL

SEQ ID NO: 2688045 - protein, 19 aa, Entamoeba histolytica
LVRRKRSGAINVLQSRFIQ

SEQ ID NO: 2688046 - protein, 17 aa, Entamoeba histolytica
LVRRSAVIVLSELIFHD

SEQ ID NO: 2688047 - protein, 22 aa, Entamoeba histolytica
LVRVADYCFEYHNFDTLLCILL

SEQ ID NO: 2688048 - protein, 27 aa, Entamoeba histolytica
LVSEELVRIAILWHEAWHEALEEASKE

SEQ ID NO: 2688049 - protein, 18 aa, Entamoeba histolytica
LVSGRYSSLYIRLLPVLK

SEQ ID NO: 2688050 - protein, 23 aa, Entamoeba histolytica
LVSHIARFMFPRGCETKNALDLV

SEQ ID NO: 2688051 - protein, 22 aa, Entamoeba histolytica
LVSIKLKWGMEYKGMLVSRDAY

SEQ ID NO: 2688052 - protein, 25 aa, Entamoeba histolytica
LVSILQPYFAHWIVVFMDGFIKSIP

SEQ ID NO: 2688053 - protein, 24 aa, Entamoeba histolytica
LVSLKNSYLRLSFKETQLNRYFLS

SEQ ID NO: 2688054 - protein, 20 aa, Entamoeba histolytica
LVSLKVLSTVFQWIIGDSQI

SEQ ID NO: 2688055 - protein, 18 aa, Entamoeba histolytica
LVSPSFIVPCLRECYLKG

SEQ ID NO: 2688056 - protein, 20 aa, Entamoeba histolytica
LVSSGLKLQSIVSYNHLGNN

SEQ ID NO: 2688057 - protein, 19 aa, Entamoeba histolytica
LVSSLIRIASRNDFEDLNE

SEQ ID NO: 2688058 - protein, 25 aa, Entamoeba histolytica
LVSSYLFDLYELFFPLNDTSKKMQT

SEQ ID NO: 2688059 - protein, 25 aa, Entamoeba histolytica
LVSSYSKEIGLCFQVTDEPHVYEVV

SEQ ID NO: 2688060 - protein, 22 aa, Entamoeba histolytica
LVSTPFCGKSWPEVKNEINVCK

SEQ ID NO: 2688061 - protein, 18 aa, Entamoeba histolytica
LVSTWSFGVILYRMITGY

SEQ ID NO: 2688062 - protein, 17 aa, Entamoeba histolytica
LVSVFVKNIPYGWATND

SEQ ID NO: 2688063 - protein, 26 aa, Entamoeba histolytica
LVSVTTMKGCVFLIGKVKGDNGFISC

SEQ ID NO: 2688064 - protein, 23 aa, Entamoeba histolytica
LVSYTEVFVRLGYTTPQIMSLLT

SEQ ID NO: 2688065 - protein, 18 aa, Entamoeba histolytica
LVTCVAWHPQSAYLLASA

SEQ ID NO: 2688066 - protein, 24 aa, Entamoeba histolytica
LVTDCVLALLPLIQPFQWEGVVLP

SEQ ID NO: 2688067 - protein, 27 aa, Entamoeba histolytica
LVTKGLKEWGGAIIVGFDGDPYGKDEE

SEQ ID NO: 2688068 - protein, 19 aa, Entamoeba histolytica
LVTLSETFVEGSFNKRSSS

SEQ ID NO: 2688069 - protein, 26 aa, Entamoeba histolytica
LVTQNVCSFAFPLIKSTHSVFVTSFP

SEQ ID NO: 2688070 - protein, 23 aa, Entamoeba histolytica
LVTTKYFLCSGLIETETIKEIMG

SEQ ID NO: 2688071 - protein, 17 aa, Entamoeba histolytica
LVTTSCIEDGYYIEIEE

SEQ ID NO: 2688072 - protein, 18 aa, Entamoeba histolytica
LVVCPSFSNIKRKIITKP

SEQ ID NO: 2688073 - protein, 21 aa, Entamoeba histolytica
LVVDMKDAFIIREKAIKNNIN

SEQ ID NO: 2688074 - protein, 17 aa, Entamoeba histolytica
LVVGGLKPQLFEIHGNK

SEQ ID NO: 2688075 - protein, 24 aa, Entamoeba histolytica
LVVKFPATHPGDFVLLNNVVDKIN

SEQ ID NO: 2688076 - protein, 17 aa, Entamoeba histolytica
LVWKEIKENNGVEELER

SEQ ID NO: 2688077 - protein, 24 aa, Entamoeba histolytica
LVYMYRSAYHYSLDNFYNTLQEIK

SEQ ID NO: 2688078 - protein, 26 aa, Entamoeba histolytica
LVYSCVLAGCDYCKNISKVGIKKAMK

SEQ ID NO: 2688079 - protein, 19 aa, Entamoeba histolytica
LVYSYEWYSLLTSGELKRI

SEQ ID NO: 2688080 - protein, 17 aa, Entamoeba histolytica
LWEGHIDGGAGWRMSDQ

SEQ ID NO: 2688081 - protein, 18 aa, Entamoeba histolytica
LWEVIWRNYSVWSNEVET

SEQ ID NO: 2688082 - protein, 23 aa, Entamoeba histolytica
LWIKTLSSYCCVTGITHYPLHTI

SEQ ID NO: 2688083 - protein, 22 aa, Entamoeba histolytica
LWKNNSLIIAQGFRDRYMEDAS

SEQ ID NO: 2688084 - protein, 24 aa, Entamoeba histolytica
LWLTNESMFDWALVHVDKKDMHYY

SEQ ID NO: 2688085 - protein, 22 aa, Entamoeba histolytica
LWNPEIPYVIGTSGDGRDIQFW

SEQ ID NO: 2688086 - protein, 18 aa, Entamoeba histolytica
LWPKLTVLLKLLKMCEKT

SEQ ID NO: 2688087 - protein, 18 aa, Entamoeba histolytica
LWQYIGIERHAQYGYYWM

SEQ ID NO: 2688088 - protein, 21 aa, Entamoeba histolytica
LWRVVENGIEEWFQLKNFGDF

SEQ ID NO: 2688089 - protein, 21 aa, Entamoeba histolytica
LWSQLILKYCECIKKPIMKQS

SEQ ID NO: 2688090 - protein, 24 aa, Entamoeba histolytica
LWTKNEFKGNLNIERAEEFINEKG

SEQ ID NO: 2688091 - protein, 23 aa, Entamoeba histolytica
LWTPEGCKIREKMLYSATKATIK

SEQ ID NO: 2688092 - protein, 20 aa, Entamoeba histolytica
LWVLHCIYQKVLISRGKSDA

SEQ ID NO: 2688093 - protein, 25 aa, Entamoeba histolytica
LYAIRKGKKVVIGFVNTPLFDFQNF

SEQ ID NO: 2688094 - protein, 17 aa, Entamoeba histolytica
LYALGAFNQKGELTQRG

SEQ ID NO: 2688095 - protein, 25 aa, Entamoeba histolytica
LYAMKYEPTLRIGFEPYQYDSVINT

SEQ ID NO: 2688096 - protein, 22 aa, Entamoeba histolytica
LYANGELPSFVSYKDLLSLNLK

SEQ ID NO: 2688097 - protein, 19 aa, Entamoeba histolytica
LYAPYAVGVTSDFPLHTFM

SEQ ID NO: 2688098 - protein, 29 aa, Entamoeba histolytica
LYARDKWLIKGGLILPDKCTMHINGIEDQ

SEQ ID NO: 2688099 - protein, 24 aa, Entamoeba histolytica
LYASSFGRKSCLLTIIKILGKNCL

SEQ ID NO: 2688100 - protein, 19 aa, Entamoeba histolytica
LYCDNPFKLLYVANQLRSC

SEQ ID NO: 2688101 - protein, 18 aa, Entamoeba histolytica
LYCGCCGKLYSTDSEYVL

SEQ ID NO: 2688102 - protein, 18 aa, Entamoeba histolytica
LYCTVKAVLGVIDKIEVK

SEQ ID NO: 2688103 - protein, 20 aa, Entamoeba histolytica
LYCVKLRTIDIFNIEIGTPQ

SEQ ID NO: 2688104 - protein, 26 aa, Entamoeba histolytica
LYDCCLELPLNLILPVLYFAFNNMLN

SEQ ID NO: 2688105 - protein, 25 aa, Entamoeba histolytica
LYDHKVYIGMEFCSGGTLKSMLKPR

SEQ ID NO: 2688106 - protein, 20 aa, Entamoeba histolytica
LYDICLEYGFFFNSVLSKKS

SEQ ID NO: 2688107 - protein, 24 aa, Entamoeba histolytica
LYDKLKEMERILSPPSYIEDLNRI

SEQ ID NO: 2688108 - protein, 20 aa, Entamoeba histolytica
LYDLLRIFLREGYPGEINYL

SEQ ID NO: 2688109 - protein, 20 aa, Entamoeba histolytica
LYDPSSCKQYSLSEQSRKPI

SEQ ID NO: 2688110 - protein, 18 aa, Entamoeba histolytica
LYDQCCPHSKDEEKDFMT

SEQ ID NO: 2688111 - protein, 21 aa, Entamoeba histolytica
LYDRDHYKLALAQLSIAKKLI

SEQ ID NO: 2688112 - protein, 19 aa, Entamoeba histolytica
LYDSLKFDTLIGEGLNESF

SEQ ID NO: 2688113 - protein, 18 aa, Entamoeba histolytica
LYEFARYWNERNVSMAVA

SEQ ID NO: 2688114 - protein, 20 aa, Entamoeba histolytica
LYEKRLYPHMKMVGLTDKIT

SEQ ID NO: 2688115 - protein, 18 aa, Entamoeba histolytica
LYELFTHSFLFTGESNND

SEQ ID NO: 2688116 - protein, 18 aa, Entamoeba histolytica
LYELYKILIQAVVVDKKV

SEQ ID NO: 2688117 - protein, 18 aa, Entamoeba histolytica
LYERKVLVGINFELNIET

SEQ ID NO: 2688118 - protein, 31 aa, Entamoeba histolytica
LYESITLPLLRPELFKKGSLTKRSKGILFFG

SEQ ID NO: 2688119 - protein, 18 aa, Entamoeba histolytica
LYETPFFNEIVDMPPMSQ

SEQ ID NO: 2688120 - protein, 18 aa, Entamoeba histolytica
LYEVHNLLQWLSSISNDF

SEQ ID NO: 2688121 - protein, 20 aa, Entamoeba histolytica
LYFAQCGSIKSYIISNSNIK

SEQ ID NO: 2688122 - protein, 24 aa, Entamoeba histolytica
LYFKPEKEYGIGSHSLCSIRLTPN

SEQ ID NO: 2688123 - protein, 18 aa, Entamoeba histolytica
LYFNNCLLNPDDTIADLI

SEQ ID NO: 2688124 - protein, 20 aa, Entamoeba histolytica
LYFQFPRKKIYSTALAQLVF

SEQ ID NO: 2688125 - protein, 17 aa, Entamoeba histolytica
LYFVLRHLHNIYSNNDF

SEQ ID NO: 2688126 - protein, 18 aa, Entamoeba histolytica
LYGAISFLLEINGNKLTI

SEQ ID NO: 2688127 - protein, 19 aa, Entamoeba histolytica
LYGGVFLKINGKALVDAEW

SEQ ID NO: 2688128 - protein, 18 aa, Entamoeba histolytica
LYGHLLDCEHIFIVSDIR

SEQ ID NO: 2688129 - protein, 26 aa, Entamoeba histolytica
LYGLELRFDSLFGIDIKDWIISFIDH

SEQ ID NO: 2688130 - protein, 17 aa, Entamoeba histolytica
LYGVFEWAYSAQILLSF

SEQ ID NO: 2688131 - protein, 17 aa, Entamoeba histolytica
LYIFEYYLMIQLYSITK

SEQ ID NO: 2688132 - protein, 30 aa, Entamoeba histolytica
LYIHRCGRVARAGRMGKCYNFVQTDEVGYL

SEQ ID NO: 2688133 - protein, 21 aa, Entamoeba histolytica
LYILDLYLKYFSKLEDLFILK

SEQ ID NO: 2688134 - protein, 19 aa, Entamoeba histolytica
LYILMLLGYLFKYIEKYPS

SEQ ID NO: 2688135 - protein, 19 aa, Entamoeba histolytica
LYINSFIICCFEGNYHPFE

SEQ ID NO: 2688136 - protein, 21 aa, Entamoeba histolytica
LYIPAVFCSIFGLSLDAKTPL

SEQ ID NO: 2688137 - protein, 19 aa, Entamoeba histolytica
LYIPRHCSVTHTLIAADDH

SEQ ID NO: 2688138 - protein, 21 aa, Entamoeba histolytica
LYKCMLGYTQKYYFSQFSAFY

SEQ ID NO: 2688139 - protein, 21 aa, Entamoeba histolytica
LYKGKCNTFLFNSEKERRREC

SEQ ID NO: 2688140 - protein, 21 aa, Entamoeba histolytica
LYKLFNKWISSGLFSSKKLLE

SEQ ID NO: 2688141 - protein, 19 aa, Entamoeba histolytica
LYKQIGIDPPRGCLLYGPP

SEQ ID NO: 2688142 - protein, 17 aa, Entamoeba histolytica
LYKRGNMTYQMFTINNV

SEQ ID NO: 2688143 - protein, 19 aa, Entamoeba histolytica
LYKTITIGTTDNWGISLTF

SEQ ID NO: 2688144 - protein, 31 aa, Entamoeba histolytica
LYLDDLWYETSLKVGDFIHLIFLEERTKNSL

SEQ ID NO: 2688145 - protein, 18 aa, Entamoeba histolytica
LYLDNSVLFWGSKGGDSH

SEQ ID NO: 2688146 - protein, 19 aa, Entamoeba histolytica
LYLENKFHAQFVIDQQNKR

SEQ ID NO: 2688147 - protein, 26 aa, Entamoeba histolytica
LYLISCQKISHVFSYLDRFFIKQQKA

SEQ ID NO: 2688148 - protein, 17 aa, Entamoeba histolytica
LYLKNIYGDGVMKIEPS

SEQ ID NO: 2688149 - protein, 27 aa, Entamoeba histolytica
LYLKSFSSKMIKFFGTQALKKLIVVSL

SEQ ID NO: 2688150 - protein, 32 aa, Entamoeba histolytica
LYLNKLRCFGYKIGVLRPAFISGNSVSGCSNT

SEQ ID NO: 2688151 - protein, 28 aa, Entamoeba histolytica
LYLPFNELVELCLPLPSTLTELLLDNNK

SEQ ID NO: 2688152 - protein, 19 aa, Entamoeba histolytica
LYLQHCMIHCYGFSPLPNA

SEQ ID NO: 2688153 - protein, 20 aa, Entamoeba histolytica
LYLQLLRKIFKYNPRIGFDF

SEQ ID NO: 2688154 - protein, 18 aa, Entamoeba histolytica
LYLRELPDSLIPKSMYNT

SEQ ID NO: 2688155 - protein, 18 aa, Entamoeba histolytica
LYLRILLRKTGDHLSKCL

SEQ ID NO: 2688156 - protein, 23 aa, Entamoeba histolytica
LYLRSLPFPLLHPSKEYLGSVNV

SEQ ID NO: 2688157 - protein, 18 aa, Entamoeba histolytica
LYLSSLIKICCVGASLAQ

SEQ ID NO: 2688158 - protein, 18 aa, Entamoeba histolytica
LYLSSSYCYSSLWEEKKH

SEQ ID NO: 2688159 - protein, 22 aa, Entamoeba histolytica
LYLWFCCAPHGPSIKFFVENIT

SEQ ID NO: 2688160 - protein, 25 aa, Entamoeba histolytica
LYMDCCSITSNIFSLCFKGNESDEI

SEQ ID NO: 2688161 - protein, 20 aa, Entamoeba histolytica
LYMTELPVGISINEINKKDI

SEQ ID NO: 2688162 - protein, 22 aa, Entamoeba histolytica
LYNDHLECYSLIHDQRCEEQLE

SEQ ID NO: 2688163 - protein, 18 aa, Entamoeba histolytica
LYNDIRLTSNPVLRSYSF

SEQ ID NO: 2688164 - protein, 25 aa, Entamoeba histolytica
LYNDPRLLNILLYLYNNGYVIKSAM

SEQ ID NO: 2688165 - protein, 30 aa, Entamoeba histolytica
LYNEFPVFDFWKHVCIVWTKCFYYTSEKKL

SEQ ID NO: 2688166 - protein, 24 aa, Entamoeba histolytica
LYNEYANRFLVDFAKNSLQEVLQN

SEQ ID NO: 2688167 - protein, 18 aa, Entamoeba histolytica
LYNGVSFDECILLMNDCF

SEQ ID NO: 2688168 - protein, 23 aa, Entamoeba histolytica
LYNKGCTTHGIFRETTNASIRDV

SEQ ID NO: 2688169 - protein, 23 aa, Entamoeba histolytica
LYNKGCTTHGIFRETTNASTKDV

SEQ ID NO: 2688170 - protein, 32 aa, Entamoeba histolytica; identical to SEQ ID NO: 2496149

SEQ ID NO: 2688171 - protein, 20 aa, Entamoeba histolytica
LYNKVEFIESLIVDYQINVN

SEQ ID NO: 2688172 - protein, 20 aa, Entamoeba histolytica
LYNLFDFCDSFDLPPPNMKL

SEQ ID NO: 2688173 - protein, 20 aa, Entamoeba histolytica
LYNYIAHHIELFKGKKVLEV

SEQ ID NO: 2688174 - protein, 18 aa, Entamoeba histolytica
LYPDECVEHFAVLCEILR

SEQ ID NO: 2688175 - protein, 29 aa, Entamoeba histolytica
LYPEECFDNFPVLCEILRAVTKKRCVTVG

SEQ ID NO: 2688176 - protein, 17 aa, Entamoeba histolytica
LYPHMKMVGLTDKITNL

SEQ ID NO: 2688177 - protein, 23 aa, Entamoeba histolytica
LYPKEPWWDGYFKSETEEEISKW

SEQ ID NO: 2688178 - protein, 18 aa, Entamoeba histolytica
LYPLPTIPSNLAIISSSL

SEQ ID NO: 2688179 - protein, 19 aa, Entamoeba histolytica
LYPNEFIIFLGELFPPHIV

SEQ ID NO: 2688180 - protein, 26 aa, Entamoeba histolytica
LYPSAMKRLLIPTGYPKMIDKPIEFM

SEQ ID NO: 2688181 - protein, 25 aa, Entamoeba histolytica
LYPSSKIYLIYLYKKIKIQHIESNE

SEQ ID NO: 2688182 - protein, 23 aa, Entamoeba histolytica
LYQFLIPIIFHYQEMYWFERMDM

SEQ ID NO: 2688183 - protein, 26 aa, Entamoeba histolytica
LYQILPTCDWEFEFPYFQLALCSVLS

SEQ ID NO: 2688184 - protein, 19 aa, Entamoeba histolytica
LYQKFLFNYLKIETHPEVR

SEQ ID NO: 2688185 - protein, 24 aa, Entamoeba histolytica
LYQKHGNNVTAMFRDGKLNYLQYT

SEQ ID NO: 2688186 - protein, 20 aa, Entamoeba histolytica
LYQLCEFDYIRRCVMKHEKI

SEQ ID NO: 2688187 - protein, 26 aa, Entamoeba histolytica
LYQQMQGIMLIKGVGPSITSIYNNIM

SEQ ID NO: 2688188 - protein, 18 aa, Entamoeba histolytica
LYQRVVDVLSCIDGYKIE

SEQ ID NO: 2688189 - protein, 24 aa, Entamoeba histolytica
LYQTELPEVLKGCQELISKHYETF

SEQ ID NO: 2688190 - protein, 19 aa, Entamoeba histolytica
LYQTIIYKDHRLFSKSINL

SEQ ID NO: 2688191 - protein, 20 aa, Entamoeba histolytica
LYRTLLLTIPKGGMKHLSRV

SEQ ID NO: 2688192 - protein, 17 aa, Entamoeba histolytica
LYSDITLIYRGYKLTDS

SEQ ID NO: 2688193 - protein, 17 aa, Entamoeba histolytica
LYSEAMYFIGNIMSMAQ

SEQ ID NO: 2688194 - protein, 36 aa, Entamoeba histolytica
LYSKCMYHSLLLIICRRGSYIFGVFVAESFEMKKDF

SEQ ID NO: 2688195 - protein, 23 aa, Entamoeba histolytica
LYSKRSRKTICFGKIKNEQVGES

SEQ ID NO: 2688196 - protein, 17 aa, Entamoeba histolytica
LYSLGVILYYMATKEFP

SEQ ID NO: 2688197 - protein, 19 aa, Entamoeba histolytica
LYSLIIRMLFIQKSSKSIT

SEQ ID NO: 2688198 - protein, 27 aa, Entamoeba histolytica
LYSNISFIRKCCFDLTSENDYFLTQLE

SEQ ID NO: 2688199 - protein, 22 aa, Entamoeba histolytica
LYSPEPSFWISYTVSSDTPSLD

SEQ ID NO: 2688200 - protein, 19 aa, Entamoeba histolytica
LYSPKLRKGNNFSETTSCI

SEQ ID NO: 2688201 - protein, 20 aa, Entamoeba histolytica
LYSSEMRGLFGGDWRRSCIL

SEQ ID NO: 2688202 - protein, 20 aa, Entamoeba histolytica
LYSSICLFSSIEPLFKQFIY

SEQ ID NO: 2688203 - protein, 20 aa, Entamoeba histolytica
LYSTDSQWNPAFVVENQGDH

SEQ ID NO: 2688204 - protein, 18 aa, Entamoeba histolytica
LYTEKGFNESLPKQTVPE

SEQ ID NO: 2688205 - protein, 18 aa, Entamoeba histolytica
LYTNHLLLFYTFIGDNFI

SEQ ID NO: 2688206 - protein, 30 aa, Entamoeba histolytica; identical to SEQ ID NO: 2496196

SEQ ID NO: 2688207 - protein, 29 aa, Entamoeba histolytica
LYTNVWNCPICLMKSYYYDLFIDSRLKYY

SEQ ID NO: 2688208 - protein, 20 aa, Entamoeba histolytica
LYTSPECVINYLIPHISIDE

SEQ ID NO: 2688209 - protein, 19 aa, Entamoeba histolytica
LYTTYGIPRFNEMIINRID

SEQ ID NO: 2688210 - protein, 19 aa, Entamoeba histolytica
LYVCNCIRLTKLEPPQTVT

SEQ ID NO: 2688211 - protein, 25 aa, Entamoeba histolytica
LYVLYSQGCLFRFIEKNDLSDLLIL

SEQ ID NO: 2688212 - protein, 23 aa, Entamoeba histolytica
LYVMACGFPPFVEGENDGNRMLF

SEQ ID NO: 2688213 - protein, 17 aa, Entamoeba histolytica
LYVNLVMEYNKEVCKTT

SEQ ID NO: 2688214 - protein, 19 aa, Entamoeba histolytica
LYWCSIGNLYYHTEQYSEA

SEQ ID NO: 2688215 - protein, 18 aa, Entamoeba histolytica
LYYAISNITACKDISLLQ

SEQ ID NO: 2688216 - protein, 18 aa, Entamoeba histolytica
LYYDDSIIDLWQFLGNVE

SEQ ID NO: 2688217 - protein, 25 aa, Entamoeba histolytica
LYYHKKCICSSCYLKTCPKCDLCLK

SEQ ID NO: 2688218 - protein, 17 aa, Entamoeba histolytica
LYYKWNQKITNWVAYSI

SEQ ID NO: 2688219 - protein, 17 aa, Entamoeba histolytica
LYYNCPLLSVDQLNTNK

SEQ ID NO: 2688220 - protein, 17 aa, Entamoeba histolytica
LYYPYLYEGEYNIFLSQ

SEQ ID NO: 2688221 - protein, 17 aa, Entamoeba histolytica
LYYRGAAVVTPVFSLRT

SEQ ID NO: 2688222 - protein, 17 aa, Entamoeba histolytica
MAAIFSVFVFEPSNESQ

SEQ ID NO: 2688223 - protein, 17 aa, Entamoeba histolytica
MAALSQCQPHYIRCIKP

SEQ ID NO: 2688224 - protein, 33 aa, Entamoeba histolytica
MADPFARMLILRFVFCRLVLLSLKLPGDADNFD

SEQ ID NO: 2688225 - protein, 24 aa, Entamoeba histolytica
MADWPTNDFRMFVGNLGKEVDDTM

SEQ ID NO: 2688226 - protein, 20 aa, Entamoeba histolytica
MAEYIKVVICKRRKTNDTRV

SEQ ID NO: 2688227 - protein, 17 aa, Entamoeba histolytica
MAFISMTLLSPIAVSQL

SEQ ID NO: 2688228 - protein, 18 aa, Entamoeba histolytica
MAFPLSAVGVILTDDLRK

SEQ ID NO: 2688229 - protein, 23 aa, Entamoeba histolytica
MAFWKRKSSGIINDEEINEEERL

SEQ ID NO: 2688230 - protein, 18 aa, Entamoeba histolytica
MAIDCASGMAYLESLRIV

SEQ ID NO: 2688231 - protein, 25 aa, Entamoeba histolytica
MAIVRLLYAMCLYQNDLLIEIIKQL

SEQ ID NO: 2688232 - protein, 17 aa, Entamoeba histolytica
MAKRLTAFSKTCQSLLN

SEQ ID NO: 2688233 - protein, 25 aa, Entamoeba histolytica
MALGSLPGVIPFLFEKLQKKKSFFL

SEQ ID NO: 2688234 - protein, 18 aa, Entamoeba histolytica
MAMARLSRVAPHEKDYHQ

SEQ ID NO: 2688235 - protein, 22 aa, Entamoeba histolytica
MAPMDAFLCIRGVKTLPMRMKV

SEQ ID NO: 2688236 - protein, 18 aa, Entamoeba histolytica
MARHCKRVTILEKDMLLA

SEQ ID NO: 2688237 - protein, 23 aa, Entamoeba histolytica
MATGKTCILHRWITNEFTNQTAT

SEQ ID NO: 2688238 - protein, 18 aa, Entamoeba histolytica
MAVLSSWRMKGFIDQKEE

SEQ ID NO: 2688239 - protein, 23 aa, Entamoeba histolytica
MCAWEREEYPIISSTFSMLIPHE

SEQ ID NO: 2688240 - protein, 23 aa, Entamoeba histolytica
MCDILAMKAHIIFTMLKSKDIYN

SEQ ID NO: 2688241 - protein, 19 aa, Entamoeba histolytica
MCDTSFLFQMHRRASDVHN

SEQ ID NO: 2688242 - protein, 19 aa, Entamoeba histolytica
MCDTSFLFQMRRRASDVHN

SEQ ID NO: 2688243 - protein, 17 aa, Entamoeba histolytica
MCEYMTFLLECHSKYNI

SEQ ID NO: 2688244 - protein, 20 aa, Entamoeba histolytica
MCHGCNRYYHEKCLLAFVST

SEQ ID NO: 2688245 - protein, 17 aa, Entamoeba histolytica
MCHYSSDIFEEFISLSV

SEQ ID NO: 2688246 - protein, 33 aa, Entamoeba histolytica
MCLKKEAKKRCKISEIFIHEWIKDNLCESEALD

SEQ ID NO: 2688247 - protein, 20 aa, Entamoeba histolytica
MCPIKNLIVRYIIREYVLDN

SEQ ID NO: 2688248 - protein, 20 aa, Entamoeba histolytica
MCQLSKKFICNKETEQYIER

SEQ ID NO: 2688249 - protein, 22 aa, Entamoeba histolytica
MCRVTGIPLSYLLPRGQQVKVI

SEQ ID NO: 2688250 - protein, 25 aa, Entamoeba histolytica
MDCGSCKNMVFPRTDPCIIVVVRHP

SEQ ID NO: 2688251 - protein, 18 aa, Entamoeba histolytica
MDCSALVTRLSNLTSLKC

SEQ ID NO: 2688252 - protein, 24 aa, Entamoeba histolytica
MDDEKYRIYSIFRNKQFHLQEWKR

SEQ ID NO: 2688253 - protein, 23 aa, Entamoeba histolytica
MDDIKLVFVHKSMRTEKVLDAIV

SEQ ID NO: 2688254 - protein, 24 aa, Entamoeba histolytica
MDDVTRLLCLPGYEGDIKSQYLIG

SEQ ID NO: 2688255 - protein, 25 aa, Entamoeba histolytica
MDDYKQCVWLLIGMKDLGGKIRKPG

SEQ ID NO: 2688256 - protein, 24 aa, Entamoeba histolytica
MDEIDEFCYLYFQKKKEMAIMLSD

SEQ ID NO: 2688257 - protein, 23 aa, Entamoeba histolytica
MDERIVRVIRQCLGSANPKIKQA

SEQ ID NO: 2688258 - protein, 23 aa, Entamoeba histolytica
MDEWKYSELEIMKQGGNAKFAAY

SEQ ID NO: 2688259 - protein, 17 aa, Entamoeba histolytica
MDGQSFCEECLHIHQEV

SEQ ID NO: 2688260 - protein, 17 aa, Entamoeba histolytica
MDIFNEFIIINDLYTVT

SEQ ID NO: 2688261 - protein, 17 aa, Entamoeba histolytica
MDIILKFENTTAKQAQN

SEQ ID NO: 2688262 - protein, 17 aa, Entamoeba histolytica
MDIKKTIIIGVKYVASC

SEQ ID NO: 2688263 - protein, 18 aa, Entamoeba histolytica
MDILKRKLEYGWNSIGEE

SEQ ID NO: 2688264 - protein, 24 aa, Entamoeba histolytica
MDITACDALTCLSFPTTLTKMIIN

SEQ ID NO: 2688265 - protein, 18 aa, Entamoeba histolytica
MDIVKSITFNGTIYDKIA

SEQ ID NO: 2688266 - protein, 23 aa, Entamoeba histolytica
MDIYQCNILPFSLSQIGDTFNII

SEQ ID NO: 2688267 - protein, 18 aa, Entamoeba histolytica
MDKANGIPDHTALRRKKA

SEQ ID NO: 2688268 - protein, 19 aa, Entamoeba histolytica
MDKDLAFLISSVSPLFYSM

SEQ ID NO: 2688269 - protein, 18 aa, Entamoeba histolytica
MDKFECNDILTNVHKEIL

SEQ ID NO: 2688270 - protein, 17 aa, Entamoeba histolytica
MDLFMKLQRTIIEQQTD

SEQ ID NO: 2688271 - protein, 24 aa, Entamoeba histolytica
MDLKYGMIGNEEWRKSVIEDCLDI

SEQ ID NO: 2688272 - protein, 26 aa, Entamoeba histolytica
MDMSEPLFSPEVVDLFIKIVKGSPDE

SEQ ID NO: 2688273 - protein, 22 aa, Entamoeba histolytica
MDNKFIKGRIVHVTYAKADPYS

SEQ ID NO: 2688274 - protein, 20 aa, Entamoeba histolytica
MDRAVCVYGKNLLFHTECLR

SEQ ID NO: 2688275 - protein, 17 aa, Entamoeba histolytica
MDSIIRRLKGKRIQTIV

SEQ ID NO: 2688276 - protein, 20 aa, Entamoeba histolytica
MDSLKEFVIMASRNCYFNPI

SEQ ID NO: 2688277 - protein, 18 aa, Entamoeba histolytica
MDSLRSALITVIGETNTQ

SEQ ID NO: 2688278 - protein, 17 aa, Entamoeba histolytica
MDTFCKLAHMFGTKLVD

SEQ ID NO: 2688279 - protein, 20 aa, Entamoeba histolytica
MDTFPFPHYIILHDLNTLPN

SEQ ID NO: 2688280 - protein, 28 aa, Entamoeba histolytica
MDVEKRVGVDILRLFSEYDFFRNDQVRE

SEQ ID NO: 2688281 - protein, 19 aa, Entamoeba histolytica
MDVLNVWDAIFAYGNNLEF

SEQ ID NO: 2688282 - protein, 24 aa, Entamoeba histolytica
MDYPKEQVYLFGFINEVEKIILIG

SEQ ID NO: 2688283 - protein, 20 aa, Entamoeba histolytica
MDYPPMRALFLITTKGIPPL

SEQ ID NO: 2688284 - protein, 23 aa, Entamoeba histolytica
MDYRMAAVELKREILVVDSANEL

SEQ ID NO: 2688285 - protein, 25 aa, Entamoeba histolytica
MEAVWKIKVEDLLAFVLVDDKGNDF

SEQ ID NO: 2688286 - protein, 22 aa, Entamoeba histolytica
MEDAICLSAVMLGKPHDDYSGD

SEQ ID NO: 2688287 - protein, 18 aa, Entamoeba histolytica
MEDCCVFSALQLLEDDSE

SEQ ID NO: 2688288 - protein, 19 aa, Entamoeba histolytica
MEDTCCVYETNIPFMEVIG

SEQ ID NO: 2688289 - protein, 29 aa, Entamoeba histolytica
MEDWIDCVWLIKTLETFKVIKFGFEEENN

SEQ ID NO: 2688290 - protein, 17 aa, Entamoeba histolytica
MEDWKILKDITVLKWAL

SEQ ID NO: 2688291 - protein, 26 aa, Entamoeba histolytica
MEDYECLRKSLYMDANFFVICYSIDK

SEQ ID NO: 2688292 - protein, 25 aa, Entamoeba histolytica
MEECRAEAVGLFLTYNPIVKEILNL

SEQ ID NO: 2688293 - protein, 20 aa, Entamoeba histolytica
MEEERVIPLSFEEKIELSKR

SEQ ID NO: 2688294 - protein, 21 aa, Entamoeba histolytica
MEEVMKLNLSESISYGVNVDM

SEQ ID NO: 2688295 - protein, 22 aa, Entamoeba histolytica
MEEYFKCLQGTIISEEEIMLCE

SEQ ID NO: 2688296 - protein, 17 aa, Entamoeba histolytica
MEFKYIIGEAFLIKNYP

SEQ ID NO: 2688297 - protein, 21 aa, Entamoeba histolytica
MEGMAPPSYPIIFDGLHSKSS

SEQ ID NO: 2688298 - protein, 18 aa, Entamoeba histolytica
MEGVKMELADCCFPLVKG

SEQ ID NO: 2688299 - protein, 21 aa, Entamoeba histolytica
MEHVKLCGLAVSLGTLDTLIE

SEQ ID NO: 2688300 - protein, 18 aa, Entamoeba histolytica
MEKCKPRNDKFVVKREHF

SEQ ID NO: 2688301 - protein, 19 aa, Entamoeba histolytica
MEKCSNCNKDIILGTFIYT

SEQ ID NO: 2688302 - protein, 23 aa, Entamoeba histolytica
MEKFPGKFSFSISHTTRKPRGKE

SEQ ID NO: 2688303 - protein, 26 aa, Entamoeba histolytica
MEKKWRFSNKYSKWVIQTPNGWMEFD

SEQ ID NO: 2688304 - protein, 20 aa, Entamoeba histolytica
MEKLIQRFKEVTVEKSKLEI

SEQ ID NO: 2688305 - protein, 20 aa, Entamoeba histolytica
MEKRCLEHCVSLKSLVIPTS

SEQ ID NO: 2688306 - protein, 22 aa, Entamoeba histolytica
MEKRFEICHNRRVDMDRYHDSV

SEQ ID NO: 2688307 - protein, 22 aa, Entamoeba histolytica
MEKRLPPSTFKTIKNLLINGGS

SEQ ID NO: 2688308 - protein, 23 aa, Entamoeba histolytica
MEKRPRLSAEFKDAEEVTLSPMK

SEQ ID NO: 2688309 - protein, 21 aa, Entamoeba histolytica
MEKRQALLILCESYKEYIDES

SEQ ID NO: 2688310 - protein, 19 aa, Entamoeba histolytica
MEKSCDSIEEIMRNTVNII

SEQ ID NO: 2688311 - protein, 35 aa, Entamoeba histolytica
MEKYFAVFGRFKSCILMVHRGRSKGFGFVEYETEE

SEQ ID NO: 2688312 - protein, 22 aa, Entamoeba histolytica
MELADCCFPLVKGVVASNKTEV

SEQ ID NO: 2688313 - protein, 21 aa, Entamoeba histolytica
MELAVPNWEWLICVSSKVMGN

SEQ ID NO: 2688314 - protein, 17 aa, Entamoeba histolytica
MELCCKLKQWAETLKGE

SEQ ID NO: 2688315 - protein, 26 aa, Entamoeba histolytica
MELCEKLRIVLEPSLASQMKGDYRTG

SEQ ID NO: 2688316 - protein, 19 aa, Entamoeba histolytica
MELDNCVVSLTLRDTCGQE

SEQ ID NO: 2688317 - protein, 23 aa, Entamoeba histolytica
MELKYLFCGTPIKTGLQLCEMNP

SEQ ID NO: 2688318 - protein, 17 aa, Entamoeba histolytica
MELSGKTAFLAKLLAFL

SEQ ID NO: 2688319 - protein, 23 aa, Entamoeba histolytica
MELVDLTSLCYFFIFLQPKYIVH

SEQ ID NO: 2688320 - protein, 27 aa, Entamoeba histolytica
MELVRAIKESVCYVALDYDAEMKKKAK

SEQ ID NO: 2688321 - protein, 21 aa, Entamoeba histolytica
MEMLGLLYVWVLKNLNKEMLK

SEQ ID NO: 2688322 - protein, 17 aa, Entamoeba histolytica
MEMMKIYFADPLENEPK

SEQ ID NO: 2688323 - protein, 18 aa, Entamoeba histolytica
MEMTRLSFVKSIEGRKDI

SEQ ID NO: 2688324 - protein, 25 aa, Entamoeba histolytica
MEMWGGATFDVCYSFLHESPWERLR

SEQ ID NO: 2688325 - protein, 17 aa, Entamoeba histolytica
MENGLLTQMIWKEILRN

SEQ ID NO: 2688326 - protein, 24 aa, Entamoeba histolytica
MEPEIAHGLELISFHSISKGFYGE

SEQ ID NO: 2688327 - protein, 17 aa, Entamoeba histolytica
MEPMKYKDFAALQPSPQ

SEQ ID NO: 2688328 - protein, 26 aa, Entamoeba histolytica
MEQFIDLCILLGCDYCETIKGVGPIT

SEQ ID NO: 2688329 - protein, 18 aa, Entamoeba histolytica
MERIKILTNTEEYLIEKI

SEQ ID NO: 2688330 - protein, 19 aa, Entamoeba histolytica
MESAGRWIGYSVHGEQCTT

SEQ ID NO: 2688331 - protein, 22 aa, Entamoeba histolytica
MESGWTISPFGSMPPTPLPQTP

SEQ ID NO: 2688332 - protein, 17 aa, Entamoeba histolytica
MESRIALVGRNGCGKTT

SEQ ID NO: 2688333 - protein, 24 aa, Entamoeba histolytica
MESVIRGFLIRRELSINNLLQRKN

SEQ ID NO: 2688334 - protein, 26 aa, Entamoeba histolytica
METKSLITHYKFGVIYVKPDQTEENA

SEQ ID NO: 2688335 - protein, 18 aa, Entamoeba histolytica
METNSMLDFLADVLRDVI

SEQ ID NO: 2688336 - protein, 21 aa, Entamoeba histolytica
METSELLESWSEAMKKLKFMV

SEQ ID NO: 2688337 - protein, 25 aa, Entamoeba histolytica
METYTRTDLFPWKEEMEELQTIRKW

SEQ ID NO: 2688338 - protein, 26 aa, Entamoeba histolytica
MEVKRKFPRIFGFDEMERIIKSISKE

SEQ ID NO: 2688339 - protein, 19 aa, Entamoeba histolytica
MEYCPKYINVFKEIDLNQN

SEQ ID NO: 2688340 - protein, 20 aa, Entamoeba histolytica
MEYCVVKYAKSLLCNPTLAT

SEQ ID NO: 2688341 - protein, 17 aa, Entamoeba histolytica
MEYFKEKYIIPGEFWLY

SEQ ID NO: 2688342 - protein, 18 aa, Entamoeba histolytica
MEYLQFLIKNSRLIKEQF

SEQ ID NO: 2688343 - protein, 25 aa, Entamoeba histolytica
MEYVKQYGMCWEVIHDRLVVYNEFR

SEQ ID NO: 2688344 - protein, 17 aa, Entamoeba histolytica
MFCCSVCYEEYTYKETF

SEQ ID NO: 2688345 - protein, 19 aa, Entamoeba histolytica
MFCDIKEICLCTDSQGVAI

SEQ ID NO: 2688346 - protein, 17 aa, Entamoeba histolytica
MFCSCGMDLSPNSISSE

SEQ ID NO: 2688347 - protein, 24 aa, Entamoeba histolytica
MFDRADELFLKRQVIVRYVLELMN

SEQ ID NO: 2688348 - protein, 21 aa, Entamoeba histolytica
MFEGFGMKGLDVMMQSLLELY

SEQ ID NO: 2688349 - protein, 21 aa, Entamoeba histolytica
MFEIGLRFFFTDVKILIDYAT

SEQ ID NO: 2688350 - protein, 20 aa, Entamoeba histolytica
MFELYLRKYNELYLAIFKKV

SEQ ID NO: 2688351 - protein, 26 aa, Entamoeba histolytica
MFEYQRIGVQFGLRKKGRLLIGDEMG

SEQ ID NO: 2688352 - protein, 24 aa, Entamoeba histolytica
MFFAFAAPMILCLCEALNEDIKNG

SEQ ID NO: 2688353 - protein, 19 aa, Entamoeba histolytica
MFFTSALTRLTNFHCTMND

SEQ ID NO: 2688354 - protein, 17 aa, Entamoeba histolytica
MFKMFSSSVNHTVSQIP

SEQ ID NO: 2688355 - protein, 19 aa, Entamoeba histolytica
MFKNEFRVNNNIDISDNFW

SEQ ID NO: 2688356 - protein, 25 aa, Entamoeba histolytica
MFLTVLRLDSLNLFSKFPYIDLLAL

SEQ ID NO: 2688357 - protein, 23 aa, Entamoeba histolytica
MFMECPEMFISMITNPVMDDQTT

SEQ ID NO: 2688358 - protein, 18 aa, Entamoeba histolytica
MFNCYQKPYPIVGPMLVP

SEQ ID NO: 2688359 - protein, 21 aa, Entamoeba histolytica
MFNKNPRWILFYELVLTTKEY

SEQ ID NO: 2688360 - protein, 20 aa, Entamoeba histolytica
MFNPRLHEVDLQKEVREVKK

SEQ ID NO: 2688361 - protein, 22 aa, Entamoeba histolytica
MFPMAPSFPPVIFPSYEEKEKT

SEQ ID NO: 2688362 - protein, 26 aa, Entamoeba histolytica
MFSCKNEWLFTFGYSVHWPEKSDIAV

SEQ ID NO: 2688363 - protein, 17 aa, Entamoeba histolytica
MFSHPQFNTDVIKPLNI

SEQ ID NO: 2688364 - protein, 25 aa, Entamoeba histolytica
MFSMKLKVIDSLCIDSKDGKIITSL

SEQ ID NO: 2688365 - protein, 21 aa, Entamoeba histolytica
MFSPRSRSEMRFREKRREEEQ

SEQ ID NO: 2688366 - protein, 31 aa, Entamoeba histolytica
MFVECTRLISNLCSFTPKPSYSIVTHFIEYL

SEQ ID NO: 2688367 - protein, 21 aa, Entamoeba histolytica
MGAICKVFLAELVSETQKVRD

SEQ ID NO: 2688368 - protein, 23 aa, Entamoeba histolytica
MGAIDCLRQLITMFSDMKEENCQ

SEQ ID NO: 2688369 - protein, 18 aa, Entamoeba histolytica
MGDLLKRFIEAKMETNPV

SEQ ID NO: 2688370 - protein, 24 aa, Entamoeba histolytica
MGECRRLYCPLANSVYATIREFGG

SEQ ID NO: 2688371 - protein, 20 aa, Entamoeba histolytica
MGFEFSRPQLRAETEKELTK

SEQ ID NO: 2688372 - protein, 20 aa, Entamoeba histolytica
MGFNEPIGYHQILYPKTTDV

SEQ ID NO: 2688373 - protein, 23 aa, Entamoeba histolytica
MGFPDYICIFALRKYKWNVEESI

SEQ ID NO: 2688374 - protein, 18 aa, Entamoeba histolytica
MGHKSSVEDLQWSPKEAD

SEQ ID NO: 2688375 - protein, 17 aa, Entamoeba histolytica
MGIDKPDVRFVIHHSLP

SEQ ID NO: 2688376 - protein, 26 aa, Entamoeba histolytica
MGIGAPRLVGFMSLGGGNVQQTVQTL

SEQ ID NO: 2688377 - protein, 17 aa, Entamoeba histolytica
MGIYQFNTWIGGMIGKV

SEQ ID NO: 2688378 - protein, 27 aa, Entamoeba histolytica
MGKAGAHSIGILDIAGFEIFRENSFEQ

SEQ ID NO: 2688379 - protein, 25 aa, Entamoeba histolytica
MGKPYRLSYKMAENVILKYNNNITL

SEQ ID NO: 2688380 - protein, 25 aa, Entamoeba histolytica
MGLLFNELFPGFGFEKKKTGINKEG

SEQ ID NO: 2688381 - protein, 25 aa, Entamoeba histolytica
MGLVEAFIIRMGKKYQLVAHQLIWN

SEQ ID NO: 2688382 - protein, 22 aa, Entamoeba histolytica
MGMKEFKEKLFSNELQESVRGM

SEQ ID NO: 2688383 - protein, 18 aa, Entamoeba histolytica
MGMVVVRNGTHYGIAGYY

SEQ ID NO: 2688384 - protein, 32 aa, Entamoeba histolytica
MGNGIEVFCGLSFAETTGFCCLNREKNLQIET

SEQ ID NO: 2688385 - protein, 21 aa, Entamoeba histolytica
MGNIEFVDFLLYNGARVEDKT

SEQ ID NO: 2688386 - protein, 20 aa, Entamoeba histolytica
MGNSFGAYFAKPVDKMDSWI

SEQ ID NO: 2688387 - protein, 19 aa, Entamoeba histolytica
MGPLFKMYADYCMNYHESD

SEQ ID NO: 2688388 - protein, 25 aa, Entamoeba histolytica
MGRTFKFLIELGIPAEHIRFRQHLK

SEQ ID NO: 2688389 - protein, 20 aa, Entamoeba histolytica
MGRTHLQDAVPIRFSQELRA

SEQ ID NO: 2688390 - protein, 24 aa, Entamoeba histolytica
MGRVYPLKLGYIGVVNRSQQDINN

SEQ ID NO: 2688391 - protein, 25 aa, Entamoeba histolytica
MGSIKKKKWGFSFFHREKKDKKDSA

SEQ ID NO: 2688392 - protein, 24 aa, Entamoeba histolytica
MGTGKTCILHRWISNEFVRQTATV

SEQ ID NO: 2688393 - protein, 20 aa, Entamoeba histolytica
MGVGKTCIVQRFCFHKYNDL

SEQ ID NO: 2688394 - protein, 20 aa, Entamoeba histolytica
MGVGKTCIVQRFCFHKYRDL

SEQ ID NO: 2688395 - protein, 18 aa, Entamoeba histolytica
MGYASILSSIGLQEKMIR

SEQ ID NO: 2688396 - protein, 20 aa, Entamoeba histolytica
MHAIQIKFVDQFGIEENGVD

SEQ ID NO: 2688397 - protein, 23 aa, Entamoeba histolytica
MHALPFEAFVKFFYESQGKVVPI

SEQ ID NO: 2688398 - protein, 20 aa, Entamoeba histolytica
MHCKERGIHVAGEINELCNI

SEQ ID NO: 2688399 - protein, 22 aa, Entamoeba histolytica
MHELSHLLIHFAYLQSDSSSGK

SEQ ID NO: 2688400 - protein, 18 aa, Entamoeba histolytica
MHGLIRLYNYGNIQEPNE

SEQ ID NO: 2688401 - protein, 20 aa, Entamoeba histolytica
MHHICMMRAKMAKYQRELLA

SEQ ID NO: 2688402 - protein, 19 aa, Entamoeba histolytica
MHIDIRWLFTDSYFQKTTL

SEQ ID NO: 2688403 - protein, 25 aa, Entamoeba histolytica
MHIKEIPKHIDGFWVEVNHIPFNAQ

SEQ ID NO: 2688404 - protein, 19 aa, Entamoeba histolytica
MHILFKIILKNTIHLSLSN

SEQ ID NO: 2688405 - protein, 20 aa, Entamoeba histolytica
MHKMCLTLIVLLRIAINHST

SEQ ID NO: 2688406 - protein, 25 aa, Entamoeba histolytica
MHLDLKPSNIFIFSLNPLDSVVAKL

SEQ ID NO: 2688407 - protein, 25 aa, Entamoeba histolytica
MHLKIVCGNLFFKDSQPMFWEVACI

SEQ ID NO: 2688408 - protein, 22 aa, Entamoeba histolytica
MHMICRDCLFQVIMAQTSRQDY

SEQ ID NO: 2688409 - protein, 19 aa, Entamoeba histolytica
MHPTLLGDFYFKGKELYPN

SEQ ID NO: 2688410 - protein, 28 aa, Entamoeba histolytica
MHRRALVILLCWTLDIPYSKASEINPKN

SEQ ID NO: 2688411 - protein, 26 aa, Entamoeba histolytica
MHSKLCTWLRLLGFDSKGSKDYEEKY

SEQ ID NO: 2688412 - protein, 19 aa, Entamoeba histolytica
MHTFCSLTGLSLIGALPVK

SEQ ID NO: 2688413 - protein, 18 aa, Entamoeba histolytica
MHVGRTFIQMTFDRLSSI

SEQ ID NO: 2688414 - protein, 20 aa, Entamoeba histolytica
MICLSYRPSISLKKLKDDLC

SEQ ID NO: 2688415 - protein, 19 aa, Entamoeba histolytica
MICQVVRFAIKECARITSN

SEQ ID NO: 2688416 - protein, 17 aa, Entamoeba histolytica
MIDDMFLSLISITISSS

SEQ ID NO: 2688417 - protein, 25 aa, Entamoeba histolytica
MIDGASAFDLLNYISSLPLEQALPP

SEQ ID NO: 2688418 - protein, 19 aa, Entamoeba histolytica
MIDKMGVLYDGHYSKVLEM

SEQ ID NO: 2688419 - protein, 24 aa, Entamoeba histolytica
MIDNKCAPAAIVLCEAAMKCNNYK

SEQ ID NO: 2688420 - protein, 23 aa, Entamoeba histolytica
MIDSIRKSLEWQRKSNENLELKT

SEQ ID NO: 2688421 - protein, 21 aa, Entamoeba histolytica
MIEEAWWYYIDVYRLLYPELP

SEQ ID NO: 2688422 - protein, 17 aa, Entamoeba histolytica
MIERKLKTIGGYGNETG

SEQ ID NO: 2688423 - protein, 19 aa, Entamoeba histolytica
MIERQRLLGAGFIFSASAP

SEQ ID NO: 2688424 - protein, 18 aa, Entamoeba histolytica
MIESICGSDELAKEYDEL

SEQ ID NO: 2688425 - protein, 20 aa, Entamoeba histolytica
MIFEFICGIPPFHEETPDAI

SEQ ID NO: 2688426 - protein, 19 aa, Entamoeba histolytica
MIFGKIKVISMYNIDGTKS

SEQ ID NO: 2688427 - protein, 18 aa, Entamoeba histolytica
MIFNFKKDVPIPHFDFKY

SEQ ID NO: 2688428 - protein, 23 aa, Entamoeba histolytica
MIGLCVIMAQIGMFIPCSEAHIS

SEQ ID NO: 2688429 - protein, 19 aa, Entamoeba histolytica
MIGLCVIMAQIGMFVPCSE

SEQ ID NO: 2688430 - protein, 19 aa, Entamoeba histolytica
MIGPFYCNFGRYISIGDNC

SEQ ID NO: 2688431 - protein, 23 aa, Entamoeba histolytica
MIHCGSRGLGHQVCQDFVDMCVS

SEQ ID NO: 2688432 - protein, 25 aa, Entamoeba histolytica
MIHEGDYVHGVECLYNEITKQVGHP

SEQ ID NO: 2688433 - protein, 19 aa, Entamoeba histolytica
MIICGDFCQLPPISRNGTT

SEQ ID NO: 2688434 - protein, 17 aa, Entamoeba histolytica
MIIDEVHLLHDTRGPVL

SEQ ID NO: 2688435 - protein, 25 aa, Entamoeba histolytica
MIIGNGKLLDWCIDNGIEYVDRQAI

SEQ ID NO: 2688436 - protein, 31 aa, Entamoeba histolytica
MIISLRFPKKVKISLCFIKTIPEAINIIVKP

SEQ ID NO: 2688437 - protein, 23 aa, Entamoeba histolytica
MIKGELFDGIDYIGVFDGHNGKD

SEQ ID NO: 2688438 - protein, 31 aa, Entamoeba histolytica
MIKHQPKHCSSFKKPKRVISVQRELKENECH

SEQ ID NO: 2688439 - protein, 21 aa, Entamoeba histolytica
MIKKNKIPVARCVNLTMETFS

SEQ ID NO: 2688440 - protein, 17 aa, Entamoeba histolytica
MIKRNVTDLSTIEFEYF

SEQ ID NO: 2688441 - protein, 24 aa, Entamoeba histolytica
MILDMKMYVAWAGDSRAVLCRGGK

SEQ ID NO: 2688442 - protein, 17 aa, Entamoeba histolytica
MILEYQRVFKRCVEGTL

SEQ ID NO: 2688443 - protein, 17 aa, Entamoeba histolytica
MILSASALHEEELKEIK

SEQ ID NO: 2688444 - protein, 30 aa, Entamoeba histolytica
MILTDCIHLKRIICSVQFLRKLEKVQIRCE

SEQ ID NO: 2688445 - protein, 17 aa, Entamoeba histolytica
MIMDIERSWKGLLENAF

SEQ ID NO: 2688446 - protein, 26 aa, Entamoeba histolytica
MINCLKGCCDKECKQQCTHLLSYIKE

SEQ ID NO: 2688447 - protein, 19 aa, Entamoeba histolytica
MINLSCEIHLYVDEWFCYN

SEQ ID NO: 2688448 - protein, 26 aa, Entamoeba histolytica
MINYNRVRILFKFIVSILKVKSYDNL

SEQ ID NO: 2688449 - protein, 22 aa, Entamoeba histolytica
MIPDSFKSFMTYVSNEVNKTSP

SEQ ID NO: 2688450 - protein, 21 aa, Entamoeba histolytica
MIPEEIGFDIEIKYWNCPEEG

SEQ ID NO: 2688451 - protein, 18 aa, Entamoeba histolytica
MIPLLFQFQYLLQNKIVY

SEQ ID NO: 2688452 - protein, 24 aa, Entamoeba histolytica
MIQETRLKSFSLKQVEDKIRPKIN

SEQ ID NO: 2688453 - protein, 19 aa, Entamoeba histolytica
MIQKGEGFIDDFVISRPYR

SEQ ID NO: 2688454 - protein, 19 aa, Entamoeba histolytica
MIQLEIENFCEFKASVAVL

SEQ ID NO: 2688455 - protein, 18 aa, Entamoeba histolytica
MIRNGTILKECLLLKNQM

SEQ ID NO: 2688456 - protein, 17 aa, Entamoeba histolytica
MIRRLKHDVLKELPPKI

SEQ ID NO: 2688457 - protein, 26 aa, Entamoeba histolytica
MISHNVVAMLLHYGVKPDLLFSKVEK

SEQ ID NO: 2688458 - protein, 17 aa, Entamoeba histolytica
MISICFFFVLKNMDDKT

SEQ ID NO: 2688459 - protein, 18 aa, Entamoeba histolytica
MISPTNVCISDFGSDFSK

SEQ ID NO: 2688460 - protein, 25 aa, Entamoeba histolytica
MISVIPKYCFKGCTSIQKIQLPFGI

SEQ ID NO: 2688461 - protein, 22 aa, Entamoeba histolytica
MIVNDWCGFVGMDTTATELSIV

SEQ ID NO: 2688462 - protein, 18 aa, Entamoeba histolytica
MIVPFKQNGGFDWKTSLN

SEQ ID NO: 2688463 - protein, 24 aa, Entamoeba histolytica
MIVRPRNLLYIAIDGVCPIAKMIQ

SEQ ID NO: 2688464 - protein, 25 aa, Entamoeba histolytica
MKAQCTDIRNALTIIVRNRVAYYLQ

SEQ ID NO: 2688465 - protein, 24 aa, Entamoeba histolytica
MKCFDCISCMIVLPLLLEMITTQS

SEQ ID NO: 2688466 - protein, 23 aa, Entamoeba histolytica
MKCILNTMLIPGLRELFIKYKQL

SEQ ID NO: 2688467 - protein, 19 aa, Entamoeba histolytica
MKCLIKYNDCDFIEDVDLC

SEQ ID NO: 2688468 - protein, 17 aa, Entamoeba histolytica
MKDEVFPSLSVSLISKT

SEQ ID NO: 2688469 - protein, 33 aa, Entamoeba histolytica
MKDGKDLLGEGCCCQECYSIFEEIDMKGHLYGM

SEQ ID NO: 2688470 - protein, 23 aa, Entamoeba histolytica
MKDKLLFGCLAEFTTEEEASKIS

SEQ ID NO: 2688471 - protein, 20 aa, Entamoeba histolytica
MKDRLKDGGYGISVSYLSKT

SEQ ID NO: 2688472 - protein, 17 aa, Entamoeba histolytica
MKDRWITIKNVRFNKYS

SEQ ID NO: 2688473 - protein, 23 aa, Entamoeba histolytica
MKDSRSEIVKELLLNNGNMLIFF

SEQ ID NO: 2688474 - protein, 25 aa, Entamoeba histolytica
MKEADKSLGCLLSFGTTTSPGIWLY

SEQ ID NO: 2688475 - protein, 32 aa, Entamoeba histolytica
MKEERLSLINGIKGALGIEKECNMNDIIEEVM

SEQ ID NO: 2688476 - protein, 28 aa, Entamoeba histolytica
MKEGGSWKSWKKRYFVLDNDTLYYYKEQ

SEQ ID NO: 2688477 - protein, 18 aa, Entamoeba histolytica
MKEIKKCQELQKVNQPNI

SEQ ID NO: 2688478 - protein, 22 aa, Entamoeba histolytica
MKEIKKYCKTLIQLHSIKGSDI

SEQ ID NO: 2688479 - protein, 21 aa, Entamoeba histolytica
MKEIYKNIFGDYTFDEKPLPS

SEQ ID NO: 2688480 - protein, 20 aa, Entamoeba histolytica
MKEIYSMYSNLERRQRELAE

SEQ ID NO: 2688481 - protein, 29 aa, Entamoeba histolytica
MKEKSIRLECVLNLPLKHYFKNHKRSYLF

SEQ ID NO: 2688482 - protein, 22 aa, Entamoeba histolytica
MKEKSRLVYEYGQMNKGNSEKI

SEQ ID NO: 2688483 - protein, 31 aa, Entamoeba histolytica; identical to SEQ ID NO: 2496502

SEQ ID NO: 2688484 - protein, 24 aa, Entamoeba histolytica
MKELGNPCIPYFGSFQNIFEKVLS

SEQ ID NO: 2688485 - protein, 17 aa, Entamoeba histolytica
MKELIAYSYFLFDETCN

SEQ ID NO: 2688486 - protein, 25 aa, Entamoeba histolytica
MKELKRIPTQLNFKGSSTSFSFIIS

SEQ ID NO: 2688487 - protein, 18 aa, Entamoeba histolytica
MKELNFIDTFRKLTTFND

SEQ ID NO: 2688488 - protein, 24 aa, Entamoeba histolytica
MKELPFVILRPAIIYGPGDVTGIA

SEQ ID NO: 2688489 - protein, 30 aa, Entamoeba histolytica; identical to SEQ ID NO: 2496507

SEQ ID NO: 2688490 - protein, 25 aa, Entamoeba histolytica
MKEQGILRHVFWDCYDIQLIDLLEK

SEQ ID NO: 2688491 - protein, 17 aa, Entamoeba histolytica
MKESCFVQVTREEINIF

SEQ ID NO: 2688492 - protein, 19 aa, Entamoeba histolytica
MKESHIFSDIPYSIIDVVY

SEQ ID NO: 2688493 - protein, 26 aa, Entamoeba histolytica
MKETEEYKKIISIIGDYAIHKATIAF

SEQ ID NO: 2688494 - protein, 19 aa, Entamoeba histolytica
MKETSYGFVCDLIVHSIQP

SEQ ID NO: 2688495 - protein, 17 aa, Entamoeba histolytica
MKFATDELKHWTGSKLE

SEQ ID NO: 2688496 - protein, 17 aa, Entamoeba histolytica
MKFETLFDFSEQIAKGL

SEQ ID NO: 2688497 - protein, 20 aa, Entamoeba histolytica
MKFGMVLWDSVFEAIAMEYP

SEQ ID NO: 2688498 - protein, 19 aa, Entamoeba histolytica
MKFVITFKLGSGLDVLPSN

SEQ ID NO: 2688499 - protein, 20 aa, Entamoeba histolytica
MKGDIGGLIRKEKMNTTEFN

SEQ ID NO: 2688500 - protein, 25 aa, Entamoeba histolytica
MKGDYRTGKKINMKKVIPYIASGFK

SEQ ID NO: 2688501 - protein, 23 aa, Entamoeba histolytica
MKGIEMKNLPALQQSVLNMIFNK

SEQ ID NO: 2688502 - protein, 18 aa, Entamoeba histolytica
MKGMKLLHTEGYLIFNTD

SEQ ID NO: 2688503 - protein, 19 aa, Entamoeba histolytica
MKGNNWRVIVVDKYCSIHL

SEQ ID NO: 2688504 - protein, 18 aa, Entamoeba histolytica
MKGVMALISVSSHVFGVF

SEQ ID NO: 2688505 - protein, 17 aa, Entamoeba histolytica
MKHGNVLNHYGAVPQTW

SEQ ID NO: 2688506 - protein, 21 aa, Entamoeba histolytica
MKHKHIVLVLNKCDLVPTWAT

SEQ ID NO: 2688507 - protein, 29 aa, Entamoeba histolytica
MKHLIVYDVNKRWGWKEIETSPFMYEYNG

SEQ ID NO: 2688508 - protein, 20 aa, Entamoeba histolytica
MKHPNLITMYGLYKEKDTIF

SEQ ID NO: 2688509 - protein, 26 aa, Entamoeba histolytica
MKHRSKGRFPVLTWYNKKNGSVIVRS

SEQ ID NO: 2688510 - protein, 22 aa, Entamoeba histolytica
MKIAKPNMKVIINNILVEDYEI

SEQ ID NO: 2688511 - protein, 18 aa, Entamoeba histolytica
MKICQRINDEISYLQSPI

SEQ ID NO: 2688512 - protein, 17 aa, Entamoeba histolytica
MKIFPQQIQTFLLNSVQ

SEQ ID NO: 2688513 - protein, 17 aa, Entamoeba histolytica
MKIIAQNAWKEFNTLNQ

SEQ ID NO: 2688514 - protein, 21 aa, Entamoeba histolytica
MKIIQRPVCHLNAIDVSGAKL

SEQ ID NO: 2688515 - protein, 17 aa, Entamoeba histolytica
MKIKEKYERIIWRTFQV

SEQ ID NO: 2688516 - protein, 18 aa, Entamoeba histolytica
MKILEFNSIRNIKILDGM

SEQ ID NO: 2688517 - protein, 23 aa, Entamoeba histolytica
MKINKCVMKTYLLLIKLLPHSQE

SEQ ID NO: 2688518 - protein, 18 aa, Entamoeba histolytica
MKINKEGNDKEIILEPKD

SEQ ID NO: 2688519 - protein, 25 aa, Entamoeba histolytica
MKIPQARASIVWVIGEYSQMVPKLG

SEQ ID NO: 2688520 - protein, 19 aa, Entamoeba histolytica
MKIRIERFIEQQSISSKTN

SEQ ID NO: 2688521 - protein, 36 aa, Entamoeba histolytica
MKKENNDILLLEFCKYCQLESLKIQNIGGCVDLTKD

SEQ ID NO: 2688522 - protein, 20 aa, Entamoeba histolytica
MKKGIKIRCDEMFAERFDEM

SEQ ID NO: 2688523 - protein, 25 aa, Entamoeba histolytica
MKKGIKIRCNEMFSEVFNETFDKMK

SEQ ID NO: 2688524 - protein, 30 aa, Entamoeba histolytica; identical to SEQ ID NO: 2496550

SEQ ID NO: 2688525 - protein, 21 aa, Entamoeba histolytica
MKKIISRLVGLNKPWHCPHGR

SEQ ID NO: 2688526 - protein, 22 aa, Entamoeba histolytica
MKKIKHLKYRSVNWDSEKIATI

SEQ ID NO: 2688527 - protein, 22 aa, Entamoeba histolytica
MKKKGGDALEMFVTNEIEEDQQ

SEQ ID NO: 2688528 - protein, 21 aa, Entamoeba histolytica
MKKKKYVSPIEKFRPKTKQDK

SEQ ID NO: 2688529 - protein, 17 aa, Entamoeba histolytica
MKKKLEVAIHQIEEMKT

SEQ ID NO: 2688530 - protein, 25 aa, Entamoeba histolytica
MKKMGEIDLMLAFAIVPNEELKLKN

SEQ ID NO: 2688531 - protein, 19 aa, Entamoeba histolytica
MKKPIQWYLEHLMEEQQYE

SEQ ID NO: 2688532 - protein, 18 aa, Entamoeba histolytica
MKKPIQWYLEHLMGEQQY

SEQ ID NO: 2688533 - protein, 18 aa, Entamoeba histolytica
MKKPWAEFEEVRKKAVGL

SEQ ID NO: 2688534 - protein, 18 aa, Entamoeba histolytica
MKKRDGVNEALSIISKFG

SEQ ID NO: 2688535 - protein, 18 aa, Entamoeba histolytica
MKKYLKKNNLREWLRVIS

SEQ ID NO: 2688536 - protein, 18 aa, Entamoeba histolytica
MKLAPIGVVAKAQMHPHV

SEQ ID NO: 2688537 - protein, 19 aa, Entamoeba histolytica
MKLDCDYLLNGINLFNCYK

SEQ ID NO: 2688538 - protein, 19 aa, Entamoeba histolytica
MKLEEKWKYRKIPLPTEDK

SEQ ID NO: 2688539 - protein, 19 aa, Entamoeba histolytica
MKLFESKFIEEAEPQYIKR

SEQ ID NO: 2688540 - protein, 25 aa, Entamoeba histolytica
MKLGECGMCSATIREIALLKMINHP

SEQ ID NO: 2688541 - protein, 18 aa, Entamoeba histolytica
MKLLHTEGYLIFNTDMFR

SEQ ID NO: 2688542 - protein, 19 aa, Entamoeba histolytica
MKLLKRCKIDIGRQKFDIN

SEQ ID NO: 2688543 - protein, 26 aa, Entamoeba histolytica
MKLLVWGEDSMFWLGKKTMELVIETT

SEQ ID NO: 2688544 - protein, 21 aa, Entamoeba histolytica
MKLPDWMAPSSYSVTILNKDF

SEQ ID NO: 2688545 - protein, 21 aa, Entamoeba histolytica
MKLPEDFDLLCIINSSNCMLT

SEQ ID NO: 2688546 - protein, 20 aa, Entamoeba histolytica
MKLQDELYLIFGKEKSVLGI

SEQ ID NO: 2688547 - protein, 21 aa, Entamoeba histolytica
MKLSVIVSYYLLDLFHSQILN

SEQ ID NO: 2688548 - protein, 26 aa, Entamoeba histolytica
MKLSWHGIPFSIRYIIWKYLLRYIPV

SEQ ID NO: 2688549 - protein, 20 aa, Entamoeba histolytica
MKLTEMSSMVAVTEAMNGVT

SEQ ID NO: 2688550 - protein, 22 aa, Entamoeba histolytica
MKLYGLIHARFILSPNGMKKMK

SEQ ID NO: 2688551 - protein, 20 aa, Entamoeba histolytica
MKMQSYRAALELFIHNHLPN

SEQ ID NO: 2688552 - protein, 17 aa, Entamoeba histolytica
MKNFFAIGMHQLMNTEN

SEQ ID NO: 2688553 - protein, 17 aa, Entamoeba histolytica
MKNGALLIFPQQQNSLF

SEQ ID NO: 2688554 - protein, 18 aa, Entamoeba histolytica
MKNLLLRQCIEDVAEGFA

SEQ ID NO: 2688555 - protein, 17 aa, Entamoeba histolytica
MKNNNGVLICSDGTIGI

SEQ ID NO: 2688556 - protein, 17 aa, Entamoeba histolytica
MKNYLPKISQIAEIMQH

SEQ ID NO: 2688557 - protein, 24 aa, Entamoeba histolytica
MKPIPRYPAPYPFGYDKDNRDQRY

SEQ ID NO: 2688558 - protein, 25 aa, Entamoeba histolytica
MKPIPRYPAPYPFGYDKDNRDQRYP

SEQ ID NO: 2688559 - protein, 22 aa, Entamoeba histolytica
MKPYFGDLLKWLLSLLNSNQKK

SEQ ID NO: 2688560 - protein, 17 aa, Entamoeba histolytica
MKQCTCFNPTLRPDCVE

SEQ ID NO: 2688561 - protein, 22 aa, Entamoeba histolytica
MKQENRCPFNYSYEHNSVFWTI

SEQ ID NO: 2688562 - protein, 24 aa, Entamoeba histolytica
MKQGRSSPVYKLMFRPVEDDSYFQ

SEQ ID NO: 2688563 - protein, 17 aa, Entamoeba histolytica
MKQIILRRKAIIAENEN

SEQ ID NO: 2688564 - protein, 18 aa, Entamoeba histolytica
MKQLKRMKSLFECYMDLH

SEQ ID NO: 2688565 - protein, 22 aa, Entamoeba histolytica
MKQWSVCVPKLNAKTMIREEVV

SEQ ID NO: 2688566 - protein, 26 aa, Entamoeba histolytica
MKRECLCGMCSLLVSVLMYSEVAKKK

SEQ ID NO: 2688567 - protein, 20 aa, Entamoeba histolytica
MKRFECREAVIEKLKEKGLY

SEQ ID NO: 2688568 - protein, 22 aa, Entamoeba histolytica
MKRFKHVHFMNEDFPKEVIEKI

SEQ ID NO: 2688569 - protein, 32 aa, Entamoeba histolytica
MKSHKTWFTRLLLSQAFQCFLSINSVNAEIME

SEQ ID NO: 2688570 - protein, 23 aa, Entamoeba histolytica
MKSITPRQVKVVIIDDNKQEFSS

SEQ ID NO: 2688571 - protein, 17 aa, Entamoeba histolytica
MKSKGIVMSIPMPGHPI

SEQ ID NO: 2688572 - protein, 22 aa, Entamoeba histolytica
MKSKKGKSFDCEIDIQCLGGVE

SEQ ID NO: 2688573 - protein, 26 aa, Entamoeba histolytica
MKSNCQYGKCAIHLKYCLRIIEEASE

SEQ ID NO: 2688574 - protein, 17 aa, Entamoeba histolytica
MKSPILISLLSGRELRD

SEQ ID NO: 2688575 - protein, 20 aa, Entamoeba histolytica
MKSRRVGGVTNNLIYIILSL

SEQ ID NO: 2688576 - protein, 17 aa, Entamoeba histolytica
MKTEIFSIINEQQKTTN

SEQ ID NO: 2688577 - protein, 17 aa, Entamoeba histolytica
MKTICDEISRLGSVPVF

SEQ ID NO: 2688578 - protein, 17 aa, Entamoeba histolytica
MKTIDAMNEADVAVVVV

SEQ ID NO: 2688579 - protein, 19 aa, Entamoeba histolytica
MKTSILLPQSFQYISLEQL

SEQ ID NO: 2688580 - protein, 20 aa, Entamoeba histolytica
MKTTHFAQFINFIKKISTKE

SEQ ID NO: 2688581 - protein, 25 aa, Entamoeba histolytica
MKTTKLCVMILKSLKLLKPENEFFS

SEQ ID NO: 2688582 - protein, 18 aa, Entamoeba histolytica
MKVFHPSISSLFFDVLQK

SEQ ID NO: 2688583 - protein, 20 aa, Entamoeba histolytica
MKVHIHPAFRWGNDLGTVEN

SEQ ID NO: 2688584 - protein, 24 aa, Entamoeba histolytica
MKVIDWKIQMDLMINKQSTKFETS

SEQ ID NO: 2688585 - protein, 19 aa, Entamoeba histolytica
MKVKPNWRNWKKIPKSERI

SEQ ID NO: 2688586 - protein, 20 aa, Entamoeba histolytica
MKVLFSKEFDGVDKINTQIV

SEQ ID NO: 2688587 - protein, 18 aa, Entamoeba histolytica
MKVLIDVLKGIQFLHRNN

SEQ ID NO: 2688588 - protein, 17 aa, Entamoeba histolytica
MKVLKGVALAGTDAVIK

SEQ ID NO: 2688589 - protein, 20 aa, Entamoeba histolytica
MKVLMSFGMRSVDNIIGTMN

SEQ ID NO: 2688590 - protein, 20 aa, Entamoeba histolytica
MKVPHPFGTFYKLQMKQAPE

SEQ ID NO: 2688591 - protein, 27 aa, Entamoeba histolytica
MKVYKFILSTRCSYFYQYFSLEKQPTI

SEQ ID NO: 2688592 - protein, 24 aa, Entamoeba histolytica
MKVYLDAVFLPRVRNDIYPFYQEG

SEQ ID NO: 2688593 - protein, 25 aa, Entamoeba histolytica
MKWWNDLWLNEGFASYMGDLFATAT

SEQ ID NO: 2688594 - protein, 21 aa, Entamoeba histolytica
MKYAAKTGGVYGCPPPMGGYP

SEQ ID NO: 2688595 - protein, 19 aa, Entamoeba histolytica
MKYDEAWNVLEFSTSGMDG

SEQ ID NO: 2688596 - protein, 20 aa, Entamoeba histolytica
MKYDEVWNVLEFSTSGMDGN

SEQ ID NO: 2688597 - protein, 21 aa, Entamoeba histolytica
MKYEGIEIFFMNGKSMYIIFN

SEQ ID NO: 2688598 - protein, 24 aa, Entamoeba histolytica
MKYHVLCKETAFIAVDKTTKKEVD

SEQ ID NO: 2688599 - protein, 20 aa, Entamoeba histolytica
MKYIAIEIRHRLKIQPNVLP

SEQ ID NO: 2688600 - protein, 24 aa, Entamoeba histolytica
MKYIEVLRLKGDFEKSIHESNVEK

SEQ ID NO: 2688601 - protein, 26 aa, Entamoeba histolytica
MKYIMCLCDRPTLVSICKGKIKTLSV

SEQ ID NO: 2688602 - protein, 17 aa, Entamoeba histolytica
MKYLITLSRKMIQMNGM

SEQ ID NO: 2688603 - protein, 19 aa, Entamoeba histolytica
MKYLNGKFAVFDIKRSVGK

SEQ ID NO: 2688604 - protein, 29 aa, Entamoeba histolytica
MKYSLTLYYQFCSLFDSLPLVCVVHRDIG

SEQ ID NO: 2688605 - protein, 20 aa, Entamoeba histolytica
MKYTKTRPYLEHLMQSINNI

SEQ ID NO: 2688606 - protein, 17 aa, Entamoeba histolytica
MLACGSGNFGMVKVLLE

SEQ ID NO: 2688607 - protein, 26 aa, Entamoeba histolytica
MLASVELRLAKILVEPFNSLLQSNIT

SEQ ID NO: 2688608 - protein, 23 aa, Entamoeba histolytica
MLCSRCGRPVYENGIKANQCVFH

SEQ ID NO: 2688609 - protein, 26 aa, Entamoeba histolytica
MLDFKFPDQRVRDFALKCLDAMDDAE

SEQ ID NO: 2688610 - protein, 24 aa, Entamoeba histolytica
MLDIGCGWGGLVREVGMIQEKNVL

SEQ ID NO: 2688611 - protein, 18 aa, Entamoeba histolytica
MLDKFRNEYIIQFYGAVF

SEQ ID NO: 2688612 - protein, 19 aa, Entamoeba histolytica
MLDKFRNEYIIQFYGAVFI

SEQ ID NO: 2688613 - protein, 24 aa, Entamoeba histolytica
MLDLRTVTNIAIFRIQSACCGLFR

SEQ ID NO: 2688614 - protein, 20 aa, Entamoeba histolytica
MLDPIILLYMKLVVNLTGEK

SEQ ID NO: 2688615 - protein, 17 aa, Entamoeba histolytica
MLEALGFQFKDSKNKIL

SEQ ID NO: 2688616 - protein, 19 aa, Entamoeba histolytica
MLEECRVFERFLQFIDRSI

SEQ ID NO: 2688617 - protein, 17 aa, Entamoeba histolytica
MLEFLRNIELSFQNVSP

SEQ ID NO: 2688618 - protein, 24 aa, Entamoeba histolytica
MLEGKKWGKKWVVMKKNCLMIFRN

SEQ ID NO: 2688619 - protein, 17 aa, Entamoeba histolytica
MLEKRLAGTETTYVQTI

SEQ ID NO: 2688620 - protein, 26 aa, Entamoeba histolytica
MLESEGGLIRTGIRPNRKTGRQAPTK

SEQ ID NO: 2688621 - protein, 23 aa, Entamoeba histolytica
MLEVQCYLMLGMREDAVEEIMHQ

SEQ ID NO: 2688622 - protein, 17 aa, Entamoeba histolytica
MLFKVPVITNREFVFDC

SEQ ID NO: 2688623 - protein, 17 aa, Entamoeba histolytica
MLGCSFAQACAIPRYEE

SEQ ID NO: 2688624 - protein, 34 aa, Entamoeba histolytica
MLGETYRISRLIKEHGLIPLVELVFGGRRRRFII

SEQ ID NO: 2688625 - protein, 23 aa, Entamoeba histolytica
MLGIDLKDVMAIGDAMNDVPMLD

SEQ ID NO: 2688626 - protein, 18 aa, Entamoeba histolytica
MLGYGAVWLGVYPEKDRM

SEQ ID NO: 2688627 - protein, 21 aa, Entamoeba histolytica
MLIDQCIKRIQFIHSKDFIHR

SEQ ID NO: 2688628 - protein, 17 aa, Entamoeba histolytica
MLIIDSVTSLFRVDFSG

SEQ ID NO: 2688629 - protein, 23 aa, Entamoeba histolytica
MLILKPFIQNGMIKQIYKSYSTS

SEQ ID NO: 2688630 - protein, 22 aa, Entamoeba histolytica
MLISIEIPKNLKIINGKNIEKK

SEQ ID NO: 2688631 - protein, 23 aa, Entamoeba histolytica
MLISIEIPKNLKIINGKNIEKKD

SEQ ID NO: 2688632 - protein, 23 aa, Entamoeba histolytica
MLKEAKRYAAILNRYKVLKAHGM

SEQ ID NO: 2688633 - protein, 28 aa, Entamoeba histolytica
MLKEIAQEIYIRWKVRKLLREQSYDVER

SEQ ID NO: 2688634 - protein, 20 aa, Entamoeba histolytica
MLKEIMEWDNSISQKMYEEF

SEQ ID NO: 2688635 - protein, 27 aa, Entamoeba histolytica
MLKKAMPIIFEAGTLLRANAHDVFAVI

SEQ ID NO: 2688636 - protein, 18 aa, Entamoeba histolytica
MLKMAEQSLKELDSGVQR

SEQ ID NO: 2688637 - protein, 26 aa, Entamoeba histolytica
MLKQLFPKYRLALENEIDKMNNGVIG

SEQ ID NO: 2688638 - protein, 19 aa, Entamoeba histolytica
MLKSDVCRLKRCVTQPSMI

SEQ ID NO: 2688639 - protein, 25 aa, Entamoeba histolytica
MLLDTVDGLYVWLGSKCSANTKKMS

SEQ ID NO: 2688640 - protein, 19 aa, Entamoeba histolytica
MLLEERFIFHSCTPETIHP

SEQ ID NO: 2688641 - protein, 25 aa, Entamoeba histolytica
MLLSFFISIATKFVPLGRVHMKSVN

SEQ ID NO: 2688642 - protein, 18 aa, Entamoeba histolytica
MLLSRTFSDNDIVEMLQE

SEQ ID NO: 2688643 - protein, 19 aa, Entamoeba histolytica
MLMITGEWSIEQLLEVLYQ

SEQ ID NO: 2688644 - protein, 25 aa, Entamoeba histolytica
MLNELSEIYLLFNIFGQLMNKPTSF

SEQ ID NO: 2688645 - protein, 20 aa, Entamoeba histolytica
MLNLMCKNELSILVEGSSLG

SEQ ID NO: 2688646 - protein, 18 aa, Entamoeba histolytica
MLNYNLLDTLGLDNSTFN

SEQ ID NO: 2688647 - protein, 18 aa, Entamoeba histolytica
MLPLETRLGITLYAIRKG

SEQ ID NO: 2688648 - protein, 18 aa, Entamoeba histolytica
MLPRSCGDDLYFVCRRPN

SEQ ID NO: 2688649 - protein, 18 aa, Entamoeba histolytica
MLPTELYETADIPETKEL

SEQ ID NO: 2688650 - protein, 20 aa, Entamoeba histolytica
MLPTRVESILAESVKSESYS

SEQ ID NO: 2688651 - protein, 20 aa, Entamoeba histolytica
MLQKELNSLVSITPNSRLTS

SEQ ID NO: 2688652 - protein, 27 aa, Entamoeba histolytica
MLQMDGIELIKSFVLNGGKFLGICAGA

SEQ ID NO: 2688653 - protein, 17 aa, Entamoeba histolytica
MLQRFTGNVVHIDFGDC

SEQ ID NO: 2688654 - protein, 21 aa, Entamoeba histolytica
MLQTKIKGLVKNVPKTSVNEQ

SEQ ID NO: 2688655 - protein, 17 aa, Entamoeba histolytica
MLQVRVSNQPALHLYEK

SEQ ID NO: 2688656 - protein, 33 aa, Entamoeba histolytica
MLRDVLRTYALYNWRIGYGQGMNDICSLIMEIT

SEQ ID NO: 2688657 - protein, 20 aa, Entamoeba histolytica
MLREHFKASQFIVVSLKSGM

SEQ ID NO: 2688658 - protein, 19 aa, Entamoeba histolytica
MLRMSKPIRLMLVLEAGEF

SEQ ID NO: 2688659 - protein, 26 aa, Entamoeba histolytica
MLSDGSYKLGPFLSTLFTVQDEDFED

SEQ ID NO: 2688660 - protein, 24 aa, Entamoeba histolytica
MLSNFPFVYMVDVFADFLKKYKKS

SEQ ID NO: 2688661 - protein, 18 aa, Entamoeba histolytica
MLSPFKNYLLHSSQNNIL

SEQ ID NO: 2688662 - protein, 22 aa, Entamoeba histolytica
MLTEIPYFRDILLAHFQCPYCH

SEQ ID NO: 2688663 - protein, 24 aa, Entamoeba histolytica
MLTKEIPIRKEVFIDNADGKKKVW

SEQ ID NO: 2688664 - protein, 18 aa, Entamoeba histolytica
MLVELLCRLPEDMKRLQL

SEQ ID NO: 2688665 - protein, 18 aa, Entamoeba histolytica
MLVYPYFRVRTYQAYVDD

SEQ ID NO: 2688666 - protein, 17 aa, Entamoeba histolytica
MLYGIDVNGIFVAVELH

SEQ ID NO: 2688667 - protein, 25 aa, Entamoeba histolytica
MLYSLKIKEAIKMGLISGYENICEE

SEQ ID NO: 2688668 - protein, 22 aa, Entamoeba histolytica
MMALDCLYSLISTHSSELILKL

SEQ ID NO: 2688669 - protein, 17 aa, Entamoeba histolytica
MMCTKQKNGKWCISETM

SEQ ID NO: 2688670 - protein, 17 aa, Entamoeba histolytica
MMDEVFETIEYTLSHPQ

SEQ ID NO: 2688671 - protein, 35 aa, Entamoeba histolytica
MMDHFMFKSHLCIVCELLSINLYDALKMNDYKGLP

SEQ ID NO: 2688672 - protein, 17 aa, Entamoeba histolytica
MMDLLEMKQYLGTIKDN

SEQ ID NO: 2688673 - protein, 29 aa, Entamoeba histolytica
MMEIRKIVLRKGCCLLPVECGGRIMEYME

SEQ ID NO: 2688674 - protein, 23 aa, Entamoeba histolytica
MMEQEFKLPLSYNQEICKKIIGG

SEQ ID NO: 2688675 - protein, 18 aa, Entamoeba histolytica
MMERGFLTGYTKLKQFIP

SEQ ID NO: 2688676 - protein, 22 aa, Entamoeba histolytica
MMESGWTISPFISLQSTPMPQT

SEQ ID NO: 2688677 - protein, 18 aa, Entamoeba histolytica
MMFGKNFNKNAYGFKGNP

SEQ ID NO: 2688678 - protein, 20 aa, Entamoeba histolytica
MMGGFRMMRGFGGGNMPMER

SEQ ID NO: 2688679 - protein, 24 aa, Entamoeba histolytica
MMILCASKLKLGVERYLKDYETLR

SEQ ID NO: 2688680 - protein, 17 aa, Entamoeba histolytica
MMILLLFNTHNILKISE

SEQ ID NO: 2688681 - protein, 22 aa, Entamoeba histolytica
MMIYCPQLLFKTRIKTSEIFEQ

SEQ ID NO: 2688682 - protein, 18 aa, Entamoeba histolytica
MMKDPYFNECWKYKHIEP

SEQ ID NO: 2688683 - protein, 26 aa, Entamoeba histolytica
MMKESGVMVSRLFQDLSIKVGPKTVT

SEQ ID NO: 2688684 - protein, 19 aa, Entamoeba histolytica
MMLHFLIRDNCSFKLYNNP

SEQ ID NO: 2688685 - protein, 17 aa, Entamoeba histolytica
MMLNKTFEGRKLLKERT

SEQ ID NO: 2688686 - protein, 24 aa, Entamoeba histolytica
MMPMQQPMGGMGMMNQPMPGMAPS

SEQ ID NO: 2688687 - protein, 18 aa, Entamoeba histolytica
MMRELTRSYLNIVRKSIE

SEQ ID NO: 2688688 - protein, 18 aa, Entamoeba histolytica
MMSDMFGKVVERLLPSDK

SEQ ID NO: 2688689 - protein, 19 aa, Entamoeba histolytica
MMSQFGGMMGMNINFNELK

SEQ ID NO: 2688690 - protein, 23 aa, Entamoeba histolytica
MNAKFAIVSACCYAISLRYAGTL

SEQ ID NO: 2688691 - protein, 23 aa, Entamoeba histolytica
MNANLMRNGADFAVYINTAGDFD

SEQ ID NO: 2688692 - protein, 20 aa, Entamoeba histolytica
MNCLSYCFFSKQLFNKVSNI

SEQ ID NO: 2688693 - protein, 17 aa, Entamoeba histolytica
MNCPGHCVMFASKKRSY

SEQ ID NO: 2688694 - protein, 23 aa, Entamoeba histolytica
MNDKRVYTLFGRFGNINRVIMGV

SEQ ID NO: 2688695 - protein, 25 aa, Entamoeba histolytica
MNEAMKLYYPYSIELSWLYNENERV

SEQ ID NO: 2688696 - protein, 19 aa, Entamoeba histolytica
MNECFKSTFFVELLDKTPS

SEQ ID NO: 2688697 - protein, 23 aa, Entamoeba histolytica
MNEFPEMFYPRILENDITNFKLH

SEQ ID NO: 2688698 - protein, 33 aa, Entamoeba histolytica
MNEHILRRIKLLYPHLWYDDICCVHTVCNNEFT

SEQ ID NO: 2688699 - protein, 20 aa, Entamoeba histolytica
MNEIICGRTKIDTISIRNVS

SEQ ID NO: 2688700 - protein, 22 aa, Entamoeba histolytica
MNEIYKKAIQYMALDIAKPPPP

SEQ ID NO: 2688701 - protein, 25 aa, Entamoeba histolytica
MNEVGAWKKFYGMNCADKFINYLQT

SEQ ID NO: 2688702 - protein, 22 aa, Entamoeba histolytica
MNEVYIIGCGKFIQLLQDSFQK

SEQ ID NO: 2688703 - protein, 19 aa, Entamoeba histolytica
MNFFNEWNNTSSQEVKKAD

SEQ ID NO: 2688704 - protein, 20 aa, Entamoeba histolytica
MNFICKVLLHINRNIKTVEK

SEQ ID NO: 2688705 - protein, 23 aa, Entamoeba histolytica
MNFKNIFLEMGFEEMKTDMYVES

SEQ ID NO: 2688706 - protein, 18 aa, Entamoeba histolytica
MNGFKCILSHPIKKDVFP

SEQ ID NO: 2688707 - protein, 17 aa, Entamoeba histolytica
MNGICPIQPMGSVQVGV

SEQ ID NO: 2688708 - protein, 24 aa, Entamoeba histolytica
MNGNLRWNLWDEVHKRIQEKKCST

SEQ ID NO: 2688709 - protein, 19 aa, Entamoeba histolytica
MNIENCVTCLAPSLRGYPF

SEQ ID NO: 2688710 - protein, 31 aa, Entamoeba histolytica
MNIENCVTCLAPSLRGYPFVYTYSIQHYSQL

SEQ ID NO: 2688711 - protein, 21 aa, Entamoeba histolytica
MNIGMCAEVTKSLSQLISITV

SEQ ID NO: 2688712 - protein, 23 aa, Entamoeba histolytica
MNIKCKEYYLLLSTSSNKLLHLL

SEQ ID NO: 2688713 - protein, 18 aa, Entamoeba histolytica
MNKASLYQFSFIRMTSGY

SEQ ID NO: 2688714 - protein, 17 aa, Entamoeba histolytica
MNKCSFPKTGTNTLVNP

SEQ ID NO: 2688715 - protein, 23 aa, Entamoeba histolytica
MNKFKKQAQELAEKVEDLEGQLE

SEQ ID NO: 2688716 - protein, 23 aa, Entamoeba histolytica
MNKICGVSGKMSLKLLQITEIGK

SEQ ID NO: 2688717 - protein, 24 aa, Entamoeba histolytica
MNKITRLGCLVVIFQMSIQLELEQ

SEQ ID NO: 2688718 - protein, 17 aa, Entamoeba histolytica
MNKKLFIHPTFKANTVT

SEQ ID NO: 2688719 - protein, 30 aa, Entamoeba histolytica
MNKKMIINLSIRRCGIIVLNEVKEVMKAEV

SEQ ID NO: 2688720 - protein, 19 aa, Entamoeba histolytica
MNKSKITKRDLVFAMCSNA

SEQ ID NO: 2688721 - protein, 33 aa, Entamoeba histolytica
MNLANIFICLGPALRGCPFCFNYATVHHSEIFC

SEQ ID NO: 2688722 - protein, 18 aa, Entamoeba histolytica
MNLELCRQLIKKVNCQGN

SEQ ID NO: 2688723 - protein, 19 aa, Entamoeba histolytica
MNLHLPQSMEARSEVMNIA

SEQ ID NO: 2688724 - protein, 17 aa, Entamoeba histolytica
MNLICLDVSCNLISLFP

SEQ ID NO: 2688725 - protein, 18 aa, Entamoeba histolytica
MNLLKFGLDFKFVTVIID

SEQ ID NO: 2688726 - protein, 17 aa, Entamoeba histolytica
MNLWDLKYKLIDWKSYF

SEQ ID NO: 2688727 - protein, 26 aa, Entamoeba histolytica
MNMGCDFTCMPSMFEPSGLVQQESFL

SEQ ID NO: 2688728 - protein, 18 aa, Entamoeba histolytica
MNMVVKYRSTLFRAVVEL

SEQ ID NO: 2688729 - protein, 24 aa, Entamoeba histolytica
MNNELPWWKTVFAIVMKYISTNCP

SEQ ID NO: 2688730 - protein, 17 aa, Entamoeba histolytica
MNNKFVFIEEVIYGLKK

SEQ ID NO: 2688731 - protein, 19 aa, Entamoeba histolytica
MNNKYSVLLAAARAAEERN

SEQ ID NO: 2688732 - protein, 23 aa, Entamoeba histolytica
MNPYPRLHFFSSSIAPVSNALSM

SEQ ID NO: 2688733 - protein, 30 aa, Entamoeba histolytica
MNQLCNLLLTYLCMYYKINVSTGFIQKQVR

SEQ ID NO: 2688734 - protein, 17 aa, Entamoeba histolytica
MNQLWIQYIDKIMELSH

SEQ ID NO: 2688735 - protein, 17 aa, Entamoeba histolytica
MNQNLSLMMTLYKQKID

SEQ ID NO: 2688736 - protein, 23 aa, Entamoeba histolytica
MNRKEINSRMGLKEIIESMKGDE

SEQ ID NO: 2688737 - protein, 19 aa, Entamoeba histolytica
MNRTILFMVALWRMNGYKC

SEQ ID NO: 2688738 - protein, 18 aa, Entamoeba histolytica
MNTCITLNTLEIVGRLLK

SEQ ID NO: 2688739 - protein, 19 aa, Entamoeba histolytica
MNTTRMKDCPYLLDNLNKW

SEQ ID NO: 2688740 - protein, 17 aa, Entamoeba histolytica
MNTWNDILCKLAIEAVT

SEQ ID NO: 2688741 - protein, 19 aa, Entamoeba histolytica
MNVALTRAKNALWVIGNSN

SEQ ID NO: 2688742 - protein, 25 aa, Entamoeba histolytica
MNVKFAVPVCGPYDCVSKYKYHIKL

SEQ ID NO: 2688743 - protein, 31 aa, Entamoeba histolytica
MNVTCDICMRKCCVGCSIHTTIAPTLIMGIE

SEQ ID NO: 2688744 - protein, 25 aa, Entamoeba histolytica
MNWMIEECLKHKVHFEFRGTRSAKY

SEQ ID NO: 2688745 - protein, 41 aa, Entamoeba histolytica
MNWVFNYYCGNAFSWKWGYKCHYAPLLCHFVDYFQPVEFTT

SEQ ID NO: 2688746 - protein, 20 aa, Entamoeba histolytica
MNYHARWNYIAKIKERLKIP

SEQ ID NO: 2688747 - protein, 17 aa, Entamoeba histolytica
MNYIPLIFLQTFSTEQK

SEQ ID NO: 2688748 - protein, 25 aa, Entamoeba histolytica
MNYLKELGCSTIFLSPIYKNHAIVT

SEQ ID NO: 2688749 - protein, 19 aa, Entamoeba histolytica
MNYSNGWEKKSLVTTSCIE

SEQ ID NO: 2688750 - protein, 24 aa, Entamoeba histolytica
MPAPKQVYSPLLVVTPMDTPMVEE

SEQ ID NO: 2688751 - protein, 23 aa, Entamoeba histolytica
MPAQIRYVKYFGELLSKQIYFVQ

SEQ ID NO: 2688752 - protein, 19 aa, Entamoeba histolytica
MPCLQCVEDCICIGLYYWT

SEQ ID NO: 2688753 - protein, 20 aa, Entamoeba histolytica
MPDIIKMLVKQVAEKGKTDK

SEQ ID NO: 2688754 - protein, 24 aa, Entamoeba histolytica
MPDIPFSNPFYFPMFNNRELPDSP

SEQ ID NO: 2688755 - protein, 23 aa, Entamoeba histolytica
MPEASCAVESLLKVSSGLEQDEF

SEQ ID NO: 2688756 - protein, 21 aa, Entamoeba histolytica
MPEILKQLTVLPVESPVLLSG

SEQ ID NO: 2688757 - protein, 17 aa, Entamoeba histolytica
MPGDFRMKAQINESNDD

SEQ ID NO: 2688758 - protein, 23 aa, Entamoeba histolytica
MPGKDPRVSRPFKKRNRIEGIAS

SEQ ID NO: 2688759 - protein, 24 aa, Entamoeba histolytica
MPINGDVWLKLSIQGKIHVKLETF

SEQ ID NO: 2688760 - protein, 36 aa, Entamoeba histolytica
MPISMWYPQFIEAMKCYARAIGFFRNEEEYYWANKS

SEQ ID NO: 2688761 - protein, 21 aa, Entamoeba histolytica
MPIYEYMLKLKIKKQTDLDSL

SEQ ID NO: 2688762 - protein, 20 aa, Entamoeba histolytica
MPKERIMVAYCGIHKIFMCP

SEQ ID NO: 2688763 - protein, 24 aa, Entamoeba histolytica
MPKEVLKIDNTMLYNECKSKNIPI

SEQ ID NO: 2688764 - protein, 20 aa, Entamoeba histolytica
MPKPNKKKAIVMVDTSKLEE

SEQ ID NO: 2688765 - protein, 18 aa, Entamoeba histolytica
MPLCCDGESDDKPNNDKI

SEQ ID NO: 2688766 - protein, 19 aa, Entamoeba histolytica
MPLLLKIMIESCWKQNPQD

SEQ ID NO: 2688767 - protein, 17 aa, Entamoeba histolytica
MPLLRKEWKDHMSREEA

SEQ ID NO: 2688768 - protein, 18 aa, Entamoeba histolytica
MPLNKIPLTDEVINDLYG

SEQ ID NO: 2688769 - protein, 31 aa, Entamoeba histolytica
MPLPNFGGMGGFNGMGGFNGMGGMDMQQTMN

SEQ ID NO: 2688770 - protein, 19 aa, Entamoeba histolytica
MPLTICFLGDNKTPALSVL

SEQ ID NO: 2688771 - protein, 23 aa, Entamoeba histolytica
MPPFCGGTTRTGDLCKNKKFTQC

SEQ ID NO: 2688772 - protein, 20 aa, Entamoeba histolytica
MPPPPPGMPGMPGMPPPPPG

SEQ ID NO: 2688773 - protein, 18 aa, Entamoeba histolytica
MPPPPSGEAPVPEHRERK

SEQ ID NO: 2688774 - protein, 34 aa, Entamoeba histolytica
MPRLTSCGHMYCWRCLLQFLVLCPAPHKCPVCNA

SEQ ID NO: 2688775 - protein, 23 aa, Entamoeba histolytica
MPSHPIAYEFIKQCGTPIAAPSA

SEQ ID NO: 2688776 - protein, 37 aa, Entamoeba histolytica
  misc_feature (36)..(37): Xaa can be any naturally occurring amino acid
MPSIGIYAYELFNFYGVKRIIRIGSAGAFDESLKLXX

SEQ ID NO: 2688777 - protein, 25 aa, Entamoeba histolytica
MPSPLLSRFDLIFVLVDNPDAEADK

SEQ ID NO: 2688778 - protein, 17 aa, Entamoeba histolytica
MPSSLPYPYHIPVNVPT

SEQ ID NO: 2688779 - protein, 22 aa, Entamoeba histolytica
MPVQRLPRYNLLLTDLLKRTPD

SEQ ID NO: 2688780 - protein, 25 aa, Entamoeba histolytica
MPVQRVPRYRLLLQDLLKNTPDGTL

SEQ ID NO: 2688781 - protein, 18 aa, Entamoeba histolytica
MPYADFDNILSLFNTENF

SEQ ID NO: 2688782 - protein, 17 aa, Entamoeba histolytica
MPYVIKMGQGFEGDTSL

SEQ ID NO: 2688783 - protein, 17 aa, Entamoeba histolytica
MPYYGTQQYPGYNQMGG

SEQ ID NO: 2688784 - protein, 23 aa, Entamoeba histolytica
MQCIIPKISKLVIESLIKNNTFD

SEQ ID NO: 2688785 - protein, 19 aa, Entamoeba histolytica
MQDLLVEYGYYFKEKNTTK

SEQ ID NO: 2688786 - protein, 19 aa, Entamoeba histolytica
MQGIAFKQSYLFTEEAQWL

SEQ ID NO: 2688787 - protein, 23 aa, Entamoeba histolytica
MQGKKEMLDYFDVIVLGDDPHVK

SEQ ID NO: 2688788 - protein, 19 aa, Entamoeba histolytica
MQKLLKDVCDFTCLGEGDC

SEQ ID NO: 2688789 - protein, 19 aa, Entamoeba histolytica
MQLANAFKVLQSLTFSLLP

SEQ ID NO: 2688790 - protein, 22 aa, Entamoeba histolytica
MQLSLEIYDLISPLCKVNKTNL

SEQ ID NO: 2688791 - protein, 19 aa, Entamoeba histolytica
MQPILPGCPEIDEQAQYIT

SEQ ID NO: 2688792 - protein, 25 aa, Entamoeba histolytica
MQRCQFRPMFNPVQVDGRFMQYPLQ

SEQ ID NO: 2688793 - protein, 18 aa, Entamoeba histolytica
MQRFPQMPIMPPNRQFPP

SEQ ID NO: 2688794 - protein, 20 aa, Entamoeba histolytica
MQRGYWLMMENVNFCNPTVL

SEQ ID NO: 2688795 - protein, 19 aa, Entamoeba histolytica
MQSSCLLLLSSCLAVNPTL

SEQ ID NO: 2688796 - protein, 19 aa, Entamoeba histolytica
MQSVIKIARLYQEKNQEGK

SEQ ID NO: 2688797 - protein, 19 aa, Entamoeba histolytica
MQSYRAALELFIHIHLPSF

SEQ ID NO: 2688798 - protein, 26 aa, Entamoeba histolytica
MQTVFFKLANVIPFEKAIVLLKEAVQ

SEQ ID NO: 2688799 - protein, 25 aa, Entamoeba histolytica
MQYIFRFFTCVNIGEYAGRIIFTTS

SEQ ID NO: 2688800 - protein, 20 aa, Entamoeba histolytica
MRALEELYALGAFNQKGELT

SEQ ID NO: 2688801 - protein, 17 aa, Entamoeba histolytica
MRCGNIFGIFFNNTTKS

SEQ ID NO: 2688802 - protein, 17 aa, Entamoeba histolytica
MREKRKAEKAASKEKKG

SEQ ID NO: 2688803 - protein, 26 aa, Entamoeba histolytica
MRERGGKKCICVLCDDKYYVEDGNNL

SEQ ID NO: 2688804 - protein, 17 aa, Entamoeba histolytica
MRFDDLFIWTLKLEHKI

SEQ ID NO: 2688805 - protein, 17 aa, Entamoeba histolytica
MRFDPYVFLSLAIPNKQ

SEQ ID NO: 2688806 - protein, 18 aa, Entamoeba histolytica
MRFLCKKGALFFSTLKRA

SEQ ID NO: 2688807 - protein, 30 aa, Entamoeba histolytica
MRFTECLSKRFKKGFLIYYYREMIYSKRNR

SEQ ID NO: 2688808 - protein, 18 aa, Entamoeba histolytica
MRGNNYFAFESMIDDLMI

SEQ ID NO: 2688809 - protein, 25 aa, Entamoeba histolytica
MRIAMNEFPQYVAIQLNDTHPTVGV

SEQ ID NO: 2688810 - protein, 22 aa, Entamoeba histolytica
MRILPPRIKLDIYLTEGTHQTE

SEQ ID NO: 2688811 - protein, 27 aa, Entamoeba histolytica
MRKDEIQFLIDFLIKYPNMKAVKNSDD

SEQ ID NO: 2688812 - protein, 24 aa, Entamoeba histolytica
MRKKPGKTSCVWASSQNKVLYSVK

SEQ ID NO: 2688813 - protein, 18 aa, Entamoeba histolytica
MRKRSGFCQNYSIIKDRY

SEQ ID NO: 2688814 - protein, 25 aa, Entamoeba histolytica
MRLDFLCVIRDYPLMIEINCPSIHN

SEQ ID NO: 2688815 - protein, 21 aa, Entamoeba histolytica
MRLVDLCKTGLAIHKSSMKLE

SEQ ID NO: 2688816 - protein, 20 aa, Entamoeba histolytica
MRMAVLKPKLRGDFSSIIEF

SEQ ID NO: 2688817 - protein, 17 aa, Entamoeba histolytica
MRMKVHMENGLKVAKFL

SEQ ID NO: 2688818 - protein, 19 aa, Entamoeba histolytica
MRMSEGIIILPRRKVLKQL

SEQ ID NO: 2688819 - protein, 19 aa, Entamoeba histolytica
MRNDPRLDPRLNYDTRYDR

SEQ ID NO: 2688820 - protein, 25 aa, Entamoeba histolytica
MRNDPRLDPRLNYDTRYDRLERGIQ

SEQ ID NO: 2688821 - protein, 18 aa, Entamoeba histolytica
MRNFGYFPICASGNKGAT

SEQ ID NO: 2688822 - protein, 18 aa, Entamoeba histolytica
MRNGNEWKDGMKEFEQGS

SEQ ID NO: 2688823 - protein, 21 aa, Entamoeba histolytica
MRNILGILLHICFDESQVDIV

SEQ ID NO: 2688824 - protein, 18 aa, Entamoeba histolytica
MRNVIGITMPPAYSTIQP

SEQ ID NO: 2688825 - protein, 17 aa, Entamoeba histolytica
MRQTLLFTYSGHQRKVQ

SEQ ID NO: 2688826 - protein, 20 aa, Entamoeba histolytica
MRRCIPLLPTSFDFIQLYNQ

SEQ ID NO: 2688827 - protein, 20 aa, Entamoeba histolytica
MRRMAEKYPDKEAMDKVFNE

SEQ ID NO: 2688828 - protein, 18 aa, Entamoeba histolytica
MRRVLKRLGYVSEDDIIQ

SEQ ID NO: 2688829 - protein, 22 aa, Entamoeba histolytica
MRSNIKIRKCVINKSNEKEKGI

SEQ ID NO: 2688830 - protein, 20 aa, Entamoeba histolytica
MRSQAKITIWLKHNDENNVK

SEQ ID NO: 2688831 - protein, 18 aa, Entamoeba histolytica
MRTALKGQVLRFLNRETI

SEQ ID NO: 2688832 - protein, 21 aa, Entamoeba histolytica
MRVGTDLKQDFTIFDAVPESE

SEQ ID NO: 2688833 - protein, 23 aa, Entamoeba histolytica
MRVKQCTLWDIIKKEFLLKNIVL

SEQ ID NO: 2688834 - protein, 22 aa, Entamoeba histolytica
MRWVVPYLYWFEVMVKERWIGK

SEQ ID NO: 2688835 - protein, 25 aa, Entamoeba histolytica
MSAKKIVFCMKKFLRQLEGIINIYL

SEQ ID NO: 2688836 - protein, 21 aa, Entamoeba histolytica
MSDCSIAWFTAIKSVLKHFMT

SEQ ID NO: 2688837 - protein, 25 aa, Entamoeba histolytica
MSDEMSKRVIVHYLMKLFEKNLDEK

SEQ ID NO: 2688838 - protein, 35 aa, Entamoeba histolytica
MSDIYPKLQWCGNMNITLFSFILFKMELHNMLCVY

SEQ ID NO: 2688839 - protein, 22 aa, Entamoeba histolytica
MSDKGLCCIDEFDKMTEMTRSV

SEQ ID NO: 2688840 - protein, 17 aa, Entamoeba histolytica
MSDLLCFDGGSSNLIGT

SEQ ID NO: 2688841 - protein, 27 aa, Entamoeba histolytica
MSDLVKLAGCKQGAMVMAVKKSKTLTD

SEQ ID NO: 2688842 - protein, 20 aa, Entamoeba histolytica
MSDQEWISAVLNHPVFCHSK

SEQ ID NO: 2688843 - protein, 18 aa, Entamoeba histolytica
MSDREIFQLITMNNYENS

SEQ ID NO: 2688844 - protein, 21 aa, Entamoeba histolytica
MSEEFDIPKLLKCKKCGGLLT

SEQ ID NO: 2688845 - protein, 26 aa, Entamoeba histolytica
MSEELWKEKIEVLKVHFKEGFEAENF

SEQ ID NO: 2688846 - protein, 26 aa, Entamoeba histolytica
MSEKSRAKCLGLGITVFEGLMLPETT

SEQ ID NO: 2688847 - protein, 18 aa, Entamoeba histolytica
MSEQELIDAFPILIKEEP

SEQ ID NO: 2688848 - protein, 25 aa, Entamoeba histolytica
MSERLRWESPLLFTNIFHAFQTLFS

SEQ ID NO: 2688849 - protein, 22 aa, Entamoeba histolytica
MSFCRSKFSSAVPMKQKTKMDY

SEQ ID NO: 2688850 - protein, 17 aa, Entamoeba histolytica
MSFGAAFYRGSDCCLLV

SEQ ID NO: 2688851 - protein, 25 aa, Entamoeba histolytica
MSFRGDEKKSIFGIFDGYGGIGAAR

SEQ ID NO: 2688852 - protein, 21 aa, Entamoeba histolytica
MSGEYDRWLSFAYTMINSKYD

SEQ ID NO: 2688853 - protein, 21 aa, Entamoeba histolytica
MSGIVGRAAKEYLAEKVNEKT

SEQ ID NO: 2688854 - protein, 19 aa, Entamoeba histolytica
MSGNVPMVIARATELFLVD

SEQ ID NO: 2688855 - protein, 18 aa, Entamoeba histolytica
MSGTTPFLLACGYGQKKM

SEQ ID NO: 2688856 - protein, 35 aa, Entamoeba histolytica
MSGVLMKEGYLLKRWKERFVVVKNSYLFYFVSEKS

SEQ ID NO: 2688857 - protein, 18 aa, Entamoeba histolytica
MSHGVKFTLLKPRKTHTG

SEQ ID NO: 2688858 - protein, 17 aa, Entamoeba histolytica
MSILPIIYKSEWIKYIQ

SEQ ID NO: 2688859 - protein, 26 aa, Entamoeba histolytica
MSKEMNWIRLGGKYICGYCRHSNEKF

SEQ ID NO: 2688860 - protein, 18 aa, Entamoeba histolytica
MSKGCALDSVKLSATSIF

SEQ ID NO: 2688861 - protein, 18 aa, Entamoeba histolytica
MSKKLPYVKQMLLENTMV

SEQ ID NO: 2688862 - protein, 17 aa, Entamoeba histolytica
MSKRSKRGFQLERIIHI

SEQ ID NO: 2688863 - protein, 21 aa, Entamoeba histolytica
MSKVKPTFCEFYPDYIDFGGK

SEQ ID NO: 2688864 - protein, 20 aa, Entamoeba histolytica
MSKYLRDRLLGMPITEMDRQ

SEQ ID NO: 2688865 - protein, 21 aa, Entamoeba histolytica
MSLDYYNDVVGFRRSLRKKEE

SEQ ID NO: 2688866 - protein, 23 aa, Entamoeba histolytica
MSLEMKNKFLLKMEGYSKFYHFE

SEQ ID NO: 2688867 - protein, 24 aa, Entamoeba histolytica
MSLFFEMIKPSTMYVIAREDENKI

SEQ ID NO: 2688868 - protein, 27 aa, Entamoeba histolytica
MSLFPQSFIQFLAWQRLMQIYSKLDAN

SEQ ID NO: 2688869 - protein, 19 aa, Entamoeba histolytica
MSLIPFFFQKYISKHTLVS

SEQ ID NO: 2688870 - protein, 28 aa, Entamoeba histolytica
MSLISDWKKLCLIKDELDYSNIFGDKIF

SEQ ID NO: 2688871 - protein, 19 aa, Entamoeba histolytica
MSLKEAEEICIIRMKDSTF

SEQ ID NO: 2688872 - protein, 24 aa, Entamoeba histolytica
MSLKICPLDLFLSIEKLFISFNLN

SEQ ID NO: 2688873 - protein, 24 aa, Entamoeba histolytica
MSLPPGIYSPLLVVTPMHIPMVED

SEQ ID NO: 2688874 - protein, 32 aa, Entamoeba histolytica; identical to SEQ ID NO: 2496912

SEQ ID NO: 2688875 - protein, 22 aa, Entamoeba histolytica
MSNAKIFNGFRLDNCHSVPLEA

SEQ ID NO: 2688876 - protein, 25 aa, Entamoeba histolytica
MSNEEMDLMLAFLIRDFGKLLVNES

SEQ ID NO: 2688877 - protein, 18 aa, Entamoeba histolytica
MSNGFYTYFARDMSRLDI

SEQ ID NO: 2688878 - protein, 18 aa, Entamoeba histolytica
MSPYHMYLFKALRNYFMT

SEQ ID NO: 2688879 - protein, 21 aa, Entamoeba histolytica
MSQGVLLPGHLYQTVIKEEIQ

SEQ ID NO: 2688880 - protein, 17 aa, Entamoeba histolytica
MSRKVERRWRLVGWGEV

SEQ ID NO: 2688881 - protein, 19 aa, Entamoeba histolytica
MSSGINFIEQCYRKSMKDF

SEQ ID NO: 2688882 - protein, 20 aa, Entamoeba histolytica
MSSLHFLQFLLQQNLEIEDI

SEQ ID NO: 2688883 - protein, 23 aa, Entamoeba histolytica
MSTNEIKLMYSLNHVQSIVAIPQ

SEQ ID NO: 2688884 - protein, 18 aa, Entamoeba histolytica
MSVIKCINRLYHLLQNTA

SEQ ID NO: 2688885 - protein, 23 aa, Entamoeba histolytica
MSVKEINKVFLVGGSSHIPAIES

SEQ ID NO: 2688886 - protein, 26 aa, Entamoeba histolytica
MSVLPPRSKSCLPYQFHDLMKSKGSP

SEQ ID NO: 2688887 - protein, 20 aa, Entamoeba histolytica
MSVNCFDFFETVQLIYSSVS

SEQ ID NO: 2688888 - protein, 18 aa, Entamoeba histolytica
MSVPDTALDETLRLVVFL

SEQ ID NO: 2688889 - protein, 19 aa, Entamoeba histolytica
MSVVFIGGGLFHAEAVAYN

SEQ ID NO: 2688890 - protein, 24 aa, Entamoeba histolytica
MSVYQCLIHILRIPNAKSIFLREN

SEQ ID NO: 2688891 - protein, 21 aa, Entamoeba histolytica
MSYELFTSCFSQLKTKSFNKD

SEQ ID NO: 2688892 - protein, 25 aa, Entamoeba histolytica
MTADPRFYELLKMYLPTRLEIQGGI

SEQ ID NO: 2688893 - protein, 17 aa, Entamoeba histolytica
MTAKQCHRPELVNKNIQ

SEQ ID NO: 2688894 - protein, 23 aa, Entamoeba histolytica
MTASVAWTILKLFLMSLPTPLLH

SEQ ID NO: 2688895 - protein, 18 aa, Entamoeba histolytica
MTAVCWNETGDIFYSAGA

SEQ ID NO: 2688896 - protein, 19 aa, Entamoeba histolytica
MTCKACQEAHTRGELSRVM

SEQ ID NO: 2688897 - protein, 24 aa, Entamoeba histolytica
MTCKCGYQFCWLCGVKYSSDHWTN

SEQ ID NO: 2688898 - protein, 18 aa, Entamoeba histolytica
MTCLHACGNLTPTLLRLS

SEQ ID NO: 2688899 - protein, 18 aa, Entamoeba histolytica
MTCPLCHKQNTIIFFNTN

SEQ ID NO: 2688900 - protein, 17 aa, Entamoeba histolytica
MTCSRCHGEWCWMCRGD

SEQ ID NO: 2688901 - protein, 25 aa, Entamoeba histolytica
MTCTAKLKGVCSFLDKMIIEGKKLL

SEQ ID NO: 2688902 - protein, 17 aa, Entamoeba histolytica
MTDCIAEIFAKAVREEI

SEQ ID NO: 2688903 - protein, 24 aa, Entamoeba histolytica
MTDKFGHYCILYLLRHVDDKMALK

SEQ ID NO: 2688904 - protein, 23 aa, Entamoeba histolytica
MTDKTILRRGYWMLSNISVSKFP

SEQ ID NO: 2688905 - protein, 24 aa, Entamoeba histolytica
MTDLTGYEWDRMRLSRELRKDHNL

SEQ ID NO: 2688906 - protein, 20 aa, Entamoeba histolytica
MTDTPKLRTIIDSMITHFTD

SEQ ID NO: 2688907 - protein, 22 aa, Entamoeba histolytica
MTEDFPLYYAIKKRNKDAIRIL

SEQ ID NO: 2688908 - protein, 17 aa, Entamoeba histolytica
MTEGFSFVLNLLIIPGN

SEQ ID NO: 2688909 - protein, 19 aa, Entamoeba histolytica
MTERSRLFGGRRDFTKTTG

SEQ ID NO: 2688910 - protein, 17 aa, Entamoeba histolytica
MTFCLKNESTFSLLNSL

SEQ ID NO: 2688911 - protein, 19 aa, Entamoeba histolytica
MTFTCPMWHPNIYPNGDVC

SEQ ID NO: 2688912 - protein, 20 aa, Entamoeba histolytica
MTFYGFKNKLGLLPKLWRNE

SEQ ID NO: 2688913 - protein, 18 aa, Entamoeba histolytica
MTGLRPTYEDSLELVPNF

SEQ ID NO: 2688914 - protein, 18 aa, Entamoeba histolytica
MTIDLPCYLSEWKYLERA

SEQ ID NO: 2688915 - protein, 25 aa, Entamoeba histolytica
MTIIANQAWIVMKIVDENWIIGKRS

SEQ ID NO: 2688916 - protein, 24 aa, Entamoeba histolytica
MTIIKATVDLVWRVWGAMMSAQPF

SEQ ID NO: 2688917 - protein, 25 aa, Entamoeba histolytica
MTILPNLFGKFTIVIHELLRSTFEN

SEQ ID NO: 2688918 - protein, 18 aa, Entamoeba histolytica
MTIRVGACGLNITGASRV

SEQ ID NO: 2688919 - protein, 27 aa, Entamoeba histolytica
MTISKEVPCQFAISLTGGYYVLIEPKN

SEQ ID NO: 2688920 - protein, 25 aa, Entamoeba histolytica
MTKCKRFDVEMLPELRVLKLSTSIV

SEQ ID NO: 2688921 - protein, 17 aa, Entamoeba histolytica
MTKKPKDKFFIDFYDGV

SEQ ID NO: 2688922 - protein, 17 aa, Entamoeba histolytica
MTLEEYKESTILIKAGT

SEQ ID NO: 2688923 - protein, 28 aa, Entamoeba histolytica
MTLFSCIDCYPLSIKYHIMIMKRYFGTA

SEQ ID NO: 2688924 - protein, 23 aa, Entamoeba histolytica
MTLKNRIGNSLRRMLDCSKSVRI

SEQ ID NO: 2688925 - protein, 17 aa, Entamoeba histolytica
MTLTYLVVIDCFALSFN

SEQ ID NO: 2688926 - protein, 18 aa, Entamoeba histolytica
MTMDRYEADWSMVERGWK

SEQ ID NO: 2688927 - protein, 21 aa, Entamoeba histolytica
MTMQKELYRIENVIDELQVQP

SEQ ID NO: 2688928 - protein, 19 aa, Entamoeba histolytica
MTMRTLHFFVWKKYILPNG

SEQ ID NO: 2688929 - protein, 17 aa, Entamoeba histolytica
MTNLKWVEVKKMIEKGI

SEQ ID NO: 2688930 - protein, 19 aa, Entamoeba histolytica
MTNPELFERVGVKAPKGVL

SEQ ID NO: 2688931 - protein, 26 aa, Entamoeba histolytica
MTPENFFFFRMPKFTPFDGKLLDPFK

SEQ ID NO: 2688932 - protein, 18 aa, Entamoeba histolytica
MTPIKESIQFCCKITEGV

SEQ ID NO: 2688933 - protein, 29 aa, Entamoeba histolytica
MTPNFFLDFFKTFEIFFSLGNTFFSDNPF

SEQ ID NO: 2688934 - protein, 18 aa, Entamoeba histolytica
MTPTRPETGYGYINYNNN

SEQ ID NO: 2688935 - protein, 17 aa, Entamoeba histolytica
MTRYNLRTIAWKIWLGV

SEQ ID NO: 2688936 - protein, 18 aa, Entamoeba histolytica
MTTCECLELGLTTCLTSM

SEQ ID NO: 2688937 - protein, 23 aa, Entamoeba histolytica
MTTLTCLFLDFIILAQPNQITTY

SEQ ID NO: 2688938 - protein, 18 aa, Entamoeba histolytica
MTTSPLLILNGFNQGGEQ

SEQ ID NO: 2688939 - protein, 26 aa, Entamoeba histolytica
MTVPLDFPSCFDFLQFTNYTLKSIVS

SEQ ID NO: 2688940 - protein, 23 aa, Entamoeba histolytica
MTVSELKIKIVRGSTFDTGSSRT

SEQ ID NO: 2688941 - protein, 20 aa, Entamoeba histolytica
MVCAVVARTLSIIWNIPLIG

SEQ ID NO: 2688942 - protein, 21 aa, Entamoeba histolytica
MVCQSCGPTSIVKKIQIPYVF

SEQ ID NO: 2688943 - protein, 19 aa, Entamoeba histolytica
MVDIAYKKSIEFKVDSLHK

SEQ ID NO: 2688944 - protein, 17 aa, Entamoeba histolytica
MVDSCTSASVASYSLIE

SEQ ID NO: 2688945 - protein, 18 aa, Entamoeba histolytica
MVEFFNRFIKTCLKYIGI

SEQ ID NO: 2688946 - protein, 24 aa, Entamoeba histolytica
MVELPLRHPQLFKNIGIKPPRGIL

SEQ ID NO: 2688947 - protein, 20 aa, Entamoeba histolytica
MVEQICKFLYTPNDVDTLLK

SEQ ID NO: 2688948 - protein, 17 aa, Entamoeba histolytica
MVFKGHTNAVMSLSLNP

SEQ ID NO: 2688949 - protein, 19 aa, Entamoeba histolytica
MVFPFCFPEGDSMINKKDG

SEQ ID NO: 2688950 - protein, 24 aa, Entamoeba histolytica
MVGKYRLNSVVNHRGTLNGGHYYS

SEQ ID NO: 2688951 - protein, 17 aa, Entamoeba histolytica
MVGLFFGMIAKYLERDN

SEQ ID NO: 2688952 - protein, 20 aa, Entamoeba histolytica
MVGSGRWIDESPFLTLIGVH

SEQ ID NO: 2688953 - protein, 22 aa, Entamoeba histolytica
MVHCGSRGLGHQVCQDYINLCM

SEQ ID NO: 2688954 - protein, 24 aa, Entamoeba histolytica
MVIDLAEGCLLDYVQNKGGKYPES

SEQ ID NO: 2688955 - protein, 54 aa, Entamoeba histolytica
MVKDGIPMEMRGRCSMGQKALASVIIRIALAKTFCSKCSVLALDEPTINLDEEN

SEQ ID NO: 2688956 - protein, 24 aa, Entamoeba histolytica
MVKRHCKALRKMHVIDGVDGKYNS

SEQ ID NO: 2688957 - protein, 24 aa, Entamoeba histolytica
MVLESLANSFGRYPPVRQAQNSHL

SEQ ID NO: 2688958 - protein, 17 aa, Entamoeba histolytica
MVLIKVIGKLSIDNENP

SEQ ID NO: 2688959 - protein, 17 aa, Entamoeba histolytica
MVLLKCVDLYKDLLNHL

SEQ ID NO: 2688960 - protein, 23 aa, Entamoeba histolytica
MVLPGQIHPGLGIGHEIEEMLMD

SEQ ID NO: 2688961 - protein, 17 aa, Entamoeba histolytica
MVLRMAVRCSKQFKLNG

SEQ ID NO: 2688962 - protein, 19 aa, Entamoeba histolytica
MVLVRLCLLHGQIYSPIYV

SEQ ID NO: 2688963 - protein, 17 aa, Entamoeba histolytica
MVMAPLFTKYVEDAIKN

SEQ ID NO: 2688964 - protein, 18 aa, Entamoeba histolytica
MVMDGARVILFFFDLTRV

SEQ ID NO: 2688965 - protein, 19 aa, Entamoeba histolytica
MVNQLLFFDCIKVLTEKIN

SEQ ID NO: 2688966 - protein, 29 aa, Entamoeba histolytica
MVPCHFEILRMELIDEIERRSKVYNFNNT

SEQ ID NO: 2688967 - protein, 23 aa, Entamoeba histolytica
MVPSKRLSLLSSVGTLAHRNLLE

SEQ ID NO: 2688968 - protein, 21 aa, Entamoeba histolytica
MVQRLRVAINAADEILKTLPQ

SEQ ID NO: 2688969 - protein, 20 aa, Entamoeba histolytica
MVSAAREFMGSTTIDNETKF

SEQ ID NO: 2688970 - protein, 19 aa, Entamoeba histolytica
MVSCGILQTLCELCTSTDS

SEQ ID NO: 2688971 - protein, 24 aa, Entamoeba histolytica
MVSKMFKARIIAFDYPGYGLNKNK

SEQ ID NO: 2688972 - protein, 17 aa, Entamoeba histolytica
MVVEYKGKKIIFKDTLS

SEQ ID NO: 2688973 - protein, 18 aa, Entamoeba histolytica
MVYIKNLIEQYLQYYYTY

SEQ ID NO: 2688974 - protein, 18 aa, Entamoeba histolytica
MVYMYLCTYSEKYPELSI

SEQ ID NO: 2688975 - protein, 21 aa, Entamoeba histolytica
MWECVGEVCGINLKDIVQEWT

SEQ ID NO: 2688976 - protein, 20 aa, Entamoeba histolytica
MWLKDLDAFVKKYPQWLEEE

SEQ ID NO: 2688977 - protein, 17 aa, Entamoeba histolytica
MWSFGCVAAELFLGIPL

SEQ ID NO: 2688978 - protein, 28 aa, Entamoeba histolytica
MWSIGCIIFECFIKRPPFQAATEAELLA

SEQ ID NO: 2688979 - protein, 29 aa, Entamoeba histolytica
MWSLGCITAEFFLGIPIFPGNSEYNQLYK

SEQ ID NO: 2688980 - protein, 29 aa, Entamoeba histolytica
MWSVGCIIAELFLGVPLFPADSEFDLIVR

SEQ ID NO: 2688981 - protein, 17 aa, Entamoeba histolytica
MWTGKACCHVLYDSTVD

SEQ ID NO: 2688982 - protein, 19 aa, Entamoeba histolytica
MWVIQRVGSNIGFILTLDE

SEQ ID NO: 2688983 - protein, 17 aa, Entamoeba histolytica
MYAECYLLCDQRKVNEK

SEQ ID NO: 2688984 - protein, 17 aa, Entamoeba histolytica
MYAQKFGAFELGRREIG

SEQ ID NO: 2688985 - protein, 23 aa, Entamoeba histolytica
MYCIQKGLIEFCSKKMEDFKSMK

SEQ ID NO: 2688986 - protein, 20 aa, Entamoeba histolytica
MYDETKFTGSVTTIVPPQFA

SEQ ID NO: 2688987 - protein, 21 aa, Entamoeba histolytica
MYECTSVPASIAFLNGNFITS

SEQ ID NO: 2688988 - protein, 21 aa, Entamoeba histolytica
MYFRNASCIILVFDVSNFQSF

SEQ ID NO: 2688989 - protein, 26 aa, Entamoeba histolytica
MYGQTNCWIHPDINYKLFEMKNGEIV

SEQ ID NO: 2688990 - protein, 18 aa, Entamoeba histolytica
MYIIPSFRKIVIQLVSQL

SEQ ID NO: 2688991 - protein, 17 aa, Entamoeba histolytica
MYKDHYCIVLEKMDMSL

SEQ ID NO: 2688992 - protein, 24 aa, Entamoeba histolytica
MYLCDIRCPTECIGKVFQVLDKRR

SEQ ID NO: 2688993 - protein, 21 aa, Entamoeba histolytica
MYLVDVCQRLNTKLPEVEQKE

SEQ ID NO: 2688994 - protein, 23 aa, Entamoeba histolytica
MYMRIAPELYLKELVVGGINRVY

SEQ ID NO: 2688995 - protein, 17 aa, Entamoeba histolytica
MYNKFFLYLNEEENDKE

SEQ ID NO: 2688996 - protein, 24 aa, Entamoeba histolytica
MYNVIEIRKQFAIDSVAREIEKMA

SEQ ID NO: 2688997 - protein, 17 aa, Entamoeba histolytica
MYPPRIRMFELDQLSQK

SEQ ID NO: 2688998 - protein, 38 aa, Entamoeba histolytica
MYQILSKYRLGNCPVKMIDFTKWIKSILKIEDTSFDLK

SEQ ID NO: 2688999 - protein, 17 aa, Entamoeba histolytica
MYSAFWLTTDGKVTFHQ

SEQ ID NO: 2689000 - protein, 17 aa, Entamoeba histolytica
MYSYCLDSLKVQTINNK

SEQ ID NO: 2689001 - protein, 17 aa, Entamoeba histolytica
MYTPLMLPDDWDKAEDK

SEQ ID NO: 2689002 - protein, 23 aa, Entamoeba histolytica
MYVEGIKFLPFELVTKNEEMKTI

SEQ ID NO: 2689003 - protein, 24 aa, Entamoeba histolytica
MYVLYCYYSTYPLSCSASIQLKAY

SEQ ID NO: 2689004 - protein, 25 aa, Entamoeba histolytica
MYVLYCYYSTYPLSCSASIQLKAYL

SEQ ID NO: 2689005 - protein, 17 aa, Entamoeba histolytica
MYYRDLSIISEIGLACI

SEQ ID NO: 2689006 - protein, 18 aa, Entamoeba histolytica
NAAATRTGLPDAIDQSTI

SEQ ID NO: 2689007 - protein, 35 aa, Entamoeba histolytica
NAAIDRLCGLGFGRSQCLQAYIACDKNEQLAANFL

SEQ ID NO: 2689008 - protein, 32 aa, Entamoeba histolytica
NAAKELFKKACWTIEINNHFYVTLKEYELLHL

SEQ ID NO: 2689009 - protein, 20 aa, Entamoeba histolytica
NACAELLFMAQENGSTEVPT

SEQ ID NO: 2689010 - protein, 27 aa, Entamoeba histolytica
NADAMYNYGLCFYKGFGNLKKNQIKAF

SEQ ID NO: 2689011 - protein, 27 aa, Entamoeba histolytica
NADMLYKLQPLFPNKSSQQILNRIKWV

SEQ ID NO: 2689012 - protein, 19 aa, Entamoeba histolytica
NADTFKPIIFEDSLHPGIV

SEQ ID NO: 2689013 - protein, 25 aa, Entamoeba histolytica
NAEEYRFEKGYGMGFGTRKHVFLDG

SEQ ID NO: 2689014 - protein, 24 aa, Entamoeba histolytica
NAEKCKACGALLPAKGIAKTKIGS

SEQ ID NO: 2689015 - protein, 22 aa, Entamoeba histolytica
NAEKILKSVIAFPVNSDDINEE

SEQ ID NO: 2689016 - protein, 17 aa, Entamoeba histolytica
NAFCTYKKVPINESVQA

SEQ ID NO: 2689017 - protein, 17 aa, Entamoeba histolytica
NAFHFYGYGDERNVVKQ

SEQ ID NO: 2689018 - protein, 19 aa, Entamoeba histolytica
NAFHYIPRVYGFKLASSDY

SEQ ID NO: 2689019 - protein, 19 aa, Entamoeba histolytica
NAFNLHSFILVYTSLSSLN

SEQ ID NO: 2689020 - protein, 24 aa, Entamoeba histolytica
NAGESLKGIALLPKRAVHVHDCEI

SEQ ID NO: 2689021 - protein, 18 aa, Entamoeba histolytica
NAGHIKGALNLWNEDLLL

SEQ ID NO: 2689022 - protein, 17 aa, Entamoeba histolytica
NAGINEYIGNLVIDENR

SEQ ID NO: 2689023 - protein, 20 aa, Entamoeba histolytica
NAGLIQWLIKLSDFNIFARK

SEQ ID NO: 2689024 - protein, 19 aa, Entamoeba histolytica
NAIAIICEKVMKIITIEST

SEQ ID NO: 2689025 - protein, 23 aa, Entamoeba histolytica
NAICTLFFIHYLLPFFKNYSDIS

SEQ ID NO: 2689026 - protein, 17 aa, Entamoeba histolytica
NAIKLTPIIIESIKYIV

SEQ ID NO: 2689027 - protein, 20 aa, Entamoeba histolytica
NAILDIFFLHCKKWGLNPNA

SEQ ID NO: 2689028 - protein, 29 aa, Entamoeba histolytica
NAIQCKLPLLRKLSCCEFIPSEYITNLTF

SEQ ID NO: 2689029 - protein, 23 aa, Entamoeba histolytica
NAIRVCDIKDRIISGYLQHYNDQ

SEQ ID NO: 2689030 - protein, 27 aa, Entamoeba histolytica
NAKDIYEHWGIIWASLRMLLEMTPGTL

SEQ ID NO: 2689031 - protein, 19 aa, Entamoeba histolytica
NAKEAMEFFAKRRSKINKG

SEQ ID NO: 2689032 - protein, 18 aa, Entamoeba histolytica
NAKVVHLIPAIKMPNDPK

SEQ ID NO: 2689033 - protein, 18 aa, Entamoeba histolytica
NALCKRLDCKIKELYFPR

SEQ ID NO: 2689034 - protein, 17 aa, Entamoeba histolytica
NALCLINPIDFVVEESK

SEQ ID NO: 2689035 - protein, 18 aa, Entamoeba histolytica
NALLYLLLKKGWTIQLTK

SEQ ID NO: 2689036 - protein, 24 aa, Entamoeba histolytica
NALYGIRITDDFRYIIINEDYLEQ

SEQ ID NO: 2689037 - protein, 19 aa, Entamoeba histolytica
NAMDVIHNGEWTLDSDKEF

SEQ ID NO: 2689038 - protein, 19 aa, Entamoeba histolytica
NAMHSYRIDLFVKQEGKIY

SEQ ID NO: 2689039 - protein, 21 aa, Entamoeba histolytica
NAMKSHRTWFTLLLLSQAFQC

SEQ ID NO: 2689040 - protein, 21 aa, Entamoeba histolytica
NAMKSHRTWFTLLLLSQSFRY

SEQ ID NO: 2689041 - protein, 21 aa, Entamoeba histolytica
NANIFSVSWKTPVSLDLSLPP

SEQ ID NO: 2689042 - protein, 28 aa, Entamoeba histolytica
NAPNLKLDFPRAFLVMELCDGGDLDTFL

SEQ ID NO: 2689043 - protein, 19 aa, Entamoeba histolytica
NAPTAWIIKDITLESNIEN

SEQ ID NO: 2689044 - protein, 27 aa, Entamoeba histolytica
NAQGFLKEMLLWFGWEEIESTPPATFI

SEQ ID NO: 2689045 - protein, 17 aa, Entamoeba histolytica
NAQGLKTDCIFTSLDGG

SEQ ID NO: 2689046 - protein, 26 aa, Entamoeba histolytica
NASILKHLLALCGRITNCPESKMDNY

SEQ ID NO: 2689047 - protein, 20 aa, Entamoeba histolytica
NASLRAKYVDRFQKEKRIRI

SEQ ID NO: 2689048 - protein, 18 aa, Entamoeba histolytica
NASSIFIILYVITLSLLF

SEQ ID NO: 2689049 - protein, 23 aa, Entamoeba histolytica
NATAEDGINCTIKFFESVGGITR

SEQ ID NO: 2689050 - protein, 18 aa, Entamoeba histolytica
NATKGCQKFMMIYQLNSG

SEQ ID NO: 2689051 - protein, 23 aa, Entamoeba histolytica
NATLFLLFAHALIDYIFYHSSYI

SEQ ID NO: 2689052 - protein, 19 aa, Entamoeba histolytica
NATSVLYLFVKSNFERDEN

SEQ ID NO: 2689053 - protein, 17 aa, Entamoeba histolytica
NATVWTMVIFNDIAVLT

SEQ ID NO: 2689054 - protein, 19 aa, Entamoeba histolytica
NAVKGFDVTGEWQIISCGD

SEQ ID NO: 2689055 - protein, 17 aa, Entamoeba histolytica
NAVLRGDMAKIVIGENS

SEQ ID NO: 2689056 - protein, 26 aa, Entamoeba histolytica
NAVPFSRLLSFFSFIRLKQPIICVSV

SEQ ID NO: 2689057 - protein, 17 aa, Entamoeba histolytica
NAVSGCWESIRSSIGKC

SEQ ID NO: 2689058 - protein, 23 aa, Entamoeba histolytica
NAYGECVKKLVSMYETCNEKQLI

SEQ ID NO: 2689059 - protein, 22 aa, Entamoeba histolytica
NAYGHIIYLILIKLNKEITNEP

SEQ ID NO: 2689060 - protein, 17 aa, Entamoeba histolytica
NAYIMPIHMMNAIVEEE

SEQ ID NO: 2689061 - protein, 18 aa, Entamoeba histolytica
NAYIMPIHMMNAIVEEES

SEQ ID NO: 2689062 - protein, 23 aa, Entamoeba histolytica
NAYKKRGSQQFILQQLTKIKDTL

SEQ ID NO: 2689063 - protein, 17 aa, Entamoeba histolytica
NAYLGLVHALAYKIANH

SEQ ID NO: 2689064 - protein, 19 aa, Entamoeba histolytica
NCCKLSSIHFPSSLTHIQS

SEQ ID NO: 2689065 - protein, 19 aa, Entamoeba histolytica
NCCSLTCVSLPSTIINIPM

SEQ ID NO: 2689066 - protein, 27 aa, Entamoeba histolytica
NCDFEALKLRPFFVGINFDQFQKKEVS

SEQ ID NO: 2689067 - protein, 18 aa, Entamoeba histolytica
NCEESPVLLKEMNYPPPL

SEQ ID NO: 2689068 - protein, 20 aa, Entamoeba histolytica
NCEKGFFYLVRAVKCFCGKT

SEQ ID NO: 2689069 - protein, 24 aa, Entamoeba histolytica
NCELCHIDFTFVRRRHHCRACGRC

SEQ ID NO: 2689070 - protein, 17 aa, Entamoeba histolytica
NCFFGCSSLERIDIPTS

SEQ ID NO: 2689071 - protein, 18 aa, Entamoeba histolytica
NCFIQCLITSKAFKEEEI

SEQ ID NO: 2689072 - protein, 19 aa, Entamoeba histolytica
NCGGLIKPDIVFFNESLPD

SEQ ID NO: 2689073 - protein, 20 aa, Entamoeba histolytica
NCGKTTFLKPLQSLPFDKQY

SEQ ID NO: 2689074 - protein, 20 aa, Entamoeba histolytica
NCIDSILCLMIQDNVSPQIG

SEQ ID NO: 2689075 - protein, 19 aa, Entamoeba histolytica
NCISYPSVMSVAGIISVYQ

SEQ ID NO: 2689076 - protein, 24 aa, Entamoeba histolytica
NCKFYSNGYCKLCENGEYVNNIQY

SEQ ID NO: 2689077 - protein, 24 aa, Entamoeba histolytica
NCLACGDTNYPRNCGFMDEINSIK

SEQ ID NO: 2689078 - protein, 24 aa, Entamoeba histolytica
NCLIPEIKNGWVLEPQKLAPIFLT

SEQ ID NO: 2689079 - protein, 25 aa, Entamoeba histolytica
NCLKCHKTCHYPCHVPSLISYFTNK

SEQ ID NO: 2689080 - protein, 17 aa, Entamoeba histolytica
NCLVVALVFDVEMNSKI

SEQ ID NO: 2689081 - protein, 22 aa, Entamoeba histolytica
NCMGQSPLLLGIRNKHKESVEI

SEQ ID NO: 2689082 - protein, 20 aa, Entamoeba histolytica
NCNQLLFKNLEDIIKKDSYG

SEQ ID NO: 2689083 - protein, 20 aa, Entamoeba histolytica
NCPQFRPQVLNPDFVTLFER

SEQ ID NO: 2689084 - protein, 26 aa, Entamoeba histolytica
NCQCPKCKDTTRKVCYKTNALLYETQ

SEQ ID NO: 2689085 - protein, 21 aa, Entamoeba histolytica
NCQEAMELFFRHGVNLEAQNK

SEQ ID NO: 2689086 - protein, 21 aa, Entamoeba histolytica
NCQTIKAAIIYKEPQLLKYEE

SEQ ID NO: 2689087 - protein, 20 aa, Entamoeba histolytica
NCRCEADGKECCPNRHNGCR

SEQ ID NO: 2689088 - protein, 23 aa, Entamoeba histolytica
NCRYCPRCGTGVIGDPNTPEIEC

SEQ ID NO: 2689089 - protein, 20 aa, Entamoeba histolytica
NCSGSCFILKTLFERMEQSK

SEQ ID NO: 2689090 - protein, 21 aa, Entamoeba histolytica
NCTGLQGFFIYNSVGGGTGSG

SEQ ID NO: 2689091 - protein, 18 aa, Entamoeba histolytica
NCTLPYYCLPNPFKRLGV

SEQ ID NO: 2689092 - protein, 18 aa, Entamoeba histolytica
NCTQQFPAILFGDTPFTG

SEQ ID NO: 2689093 - protein, 23 aa, Entamoeba histolytica
NCTSTLFFARLGAIKQQELRQYC

SEQ ID NO: 2689094 - protein, 25 aa, Entamoeba histolytica
NCVRAEGLQGIILTIEFTNCKFTDN

SEQ ID NO: 2689095 - protein, 19 aa, Entamoeba histolytica
NCVSLNWLDKICSRDPEKQ

SEQ ID NO: 2689096 - protein, 27 aa, Entamoeba histolytica
NCVTCLAPSLRGYPFVYTYSIQHYSQL

SEQ ID NO: 2689097 - protein, 24 aa, Entamoeba histolytica
NCVYGEGVSSVFKKFTGFLKCYTV

SEQ ID NO: 2689098 - protein, 23 aa, Entamoeba histolytica
NCYKCICCNVSINVKSVCEQTDL

SEQ ID NO: 2689099 - protein, 17 aa, Entamoeba histolytica
NCYLKEYVPIIPVLQEE

SEQ ID NO: 2689100 - protein, 21 aa, Entamoeba histolytica
NCYLKSLHIIERINRTISTPN

SEQ ID NO: 2689101 - protein, 24 aa, Entamoeba histolytica
NDARGCSYFYGYEAVVQFLESNEI

SEQ ID NO: 2689102 - protein, 24 aa, Entamoeba histolytica
NDARKRLQPDYVPEKVLAKKPFKQ

SEQ ID NO: 2689103 - protein, 19 aa, Entamoeba histolytica
NDARLLSTISRGYAQLAMY

SEQ ID NO: 2689104 - protein, 18 aa, Entamoeba histolytica
NDCLVLKYSPLVARSAEL

SEQ ID NO: 2689105 - protein, 20 aa, Entamoeba histolytica
NDCNHLVFRNGLLLMSSSKG

SEQ ID NO: 2689106 - protein, 24 aa, Entamoeba histolytica
NDCRYSGIIELVMKLMVYEEKDRM

SEQ ID NO: 2689107 - protein, 32 aa, Entamoeba histolytica
NDDILSWLGNSDFGFACYKPGKDESFFRKLSL

SEQ ID NO: 2689108 - protein, 27 aa, Entamoeba histolytica
NDDSIELYKRFDLESLKLQIQQEELEE

SEQ ID NO: 2689109 - protein, 25 aa, Entamoeba histolytica
NDDWFLETYCGFIISGNEVMFNKRL

SEQ ID NO: 2689110 - protein, 21 aa, Entamoeba histolytica
NDEFFCISHKNLITVYNRKFE

SEQ ID NO: 2689111 - protein, 19 aa, Entamoeba histolytica
NDEFIKQSLLLLFRSICND

SEQ ID NO: 2689112 - protein, 17 aa, Entamoeba histolytica
NDEGCLIERVLEVDPRG

SEQ ID NO: 2689113 - protein, 32 aa, Entamoeba histolytica
NDELKKAALEALEILNGKTIEKVCVDEIMQQR

SEQ ID NO: 2689114 - protein, 18 aa, Entamoeba histolytica
NDELKLKKYRIIVLETTH

SEQ ID NO: 2689115 - protein, 19 aa, Entamoeba histolytica
NDEVCQYNFPILAEIPSTY

SEQ ID NO: 2689116 - protein, 24 aa, Entamoeba histolytica
NDFICRYCHTCIHINCLSLLKKDC

SEQ ID NO: 2689117 - protein, 25 aa, Entamoeba histolytica
NDFINRIEWEKGIVWDSGTNQMNLT

SEQ ID NO: 2689118 - protein, 20 aa, Entamoeba histolytica
NDFKPEFQITPQYFSEQSIE

SEQ ID NO: 2689119 - protein, 17 aa, Entamoeba histolytica
NDFKSIKQIIGRKIDVN

SEQ ID NO: 2689120 - protein, 17 aa, Entamoeba histolytica
NDFLSGANPTNATNFPF

SEQ ID NO: 2689121 - protein, 22 aa, Entamoeba histolytica
NDFNRRLGCHLQQVYGDVALIK

SEQ ID NO: 2689122 - protein, 18 aa, Entamoeba histolytica
NDFVPYCDIAIFEYSNLI

SEQ ID NO: 2689123 - protein, 25 aa, Entamoeba histolytica
NDGLLNFCLSYGFKGDDNRPKASKE

SEQ ID NO: 2689124 - protein, 30 aa, Entamoeba histolytica
NDGYIKPGKLWKFTDLCTSVIDFKNVFSHI

SEQ ID NO: 2689125 - protein, 18 aa, Entamoeba histolytica
NDHLHLFSNTSVFTTVKT

SEQ ID NO: 2689126 - protein, 17 aa, Entamoeba histolytica
NDHVVGFDLAGPENGFM

SEQ ID NO: 2689127 - protein, 21 aa, Entamoeba histolytica
NDIDASWIFTFDTYDFRLFVG

SEQ ID NO: 2689128 - protein, 23 aa, Entamoeba histolytica
NDIFKKGDIVVCQNEIPLETTYE

SEQ ID NO: 2689129 - protein, 24 aa, Entamoeba histolytica
NDIFKKRLTECILKTNTCANELID

SEQ ID NO: 2689130 - protein, 26 aa, Entamoeba histolytica
NDIFTDLRSGLALIKLMEKLTGKTLD

SEQ ID NO: 2689131 - protein, 24 aa, Entamoeba histolytica
NDIIISGGFGKRTSVLAFISEQMC

SEQ ID NO: 2689132 - protein, 17 aa, Entamoeba histolytica
NDIKGEWIVLDSHELIN

SEQ ID NO: 2689133 - protein, 22 aa, Entamoeba histolytica
NDILKLKVTQFVYKDNQINNIK

SEQ ID NO: 2689134 - protein, 18 aa, Entamoeba histolytica
NDILSFILQDDFILVEYL

SEQ ID NO: 2689135 - protein, 23 aa, Entamoeba histolytica
NDIPFFVKNGFKGVARSMPTSAA

SEQ ID NO: 2689136 - protein, 23 aa, Entamoeba histolytica
NDIPPKFVVDGVTYYLHLKRRSR

SEQ ID NO: 2689137 - protein, 27 aa, Entamoeba histolytica
NDIRIMASLCLLELIQKFDIGVAYQEY

SEQ ID NO: 2689138 - protein, 17 aa, Entamoeba histolytica
NDIRYLGYVMIKQEEKG

SEQ ID NO: 2689139 - protein, 23 aa, Entamoeba histolytica
NDISKDRLKAVIGNVHRLGITNT

SEQ ID NO: 2689140 - protein, 23 aa, Entamoeba histolytica
NDITRIKNALIYYIQYNQPISST

SEQ ID NO: 2689141 - protein, 25 aa, Entamoeba histolytica
NDITWPEFKSLISTRGEQITINIKY

SEQ ID NO: 2689142 - protein, 21 aa, Entamoeba histolytica
NDIVPRLSFDSIKNIQPLINE

SEQ ID NO: 2689143 - protein, 25 aa, Entamoeba histolytica
NDIYKVGLCLIDFLMENTRIDEFIT

SEQ ID NO: 2689144 - protein, 25 aa, Entamoeba histolytica
NDKECSKILLADKEMWEEFKEFLKF

SEQ ID NO: 2689145 - protein, 35 aa, Entamoeba histolytica
NDKELPSQIVGGFLFLRLFCPAIASPENFGLLGVE

SEQ ID NO: 2689146 - protein, 20 aa, Entamoeba histolytica
NDKIKALALIVSSGPFNTYN

SEQ ID NO: 2689147 - protein, 25 aa, Entamoeba histolytica
NDKKKRGTTRNGYRRTLSTEKSSTN

SEQ ID NO: 2689148 - protein, 23 aa, Entamoeba histolytica
NDKLQILKSFDFDDVVFIIECGN

SEQ ID NO: 2689149 - protein, 24 aa, Entamoeba histolytica
NDKLRHFHCLCGIVDIVLTQPIDE

SEQ ID NO: 2689150 - protein, 17 aa, Entamoeba histolytica
NDKSFKGKEGCCVVFHF

SEQ ID NO: 2689151 - protein, 28 aa, Entamoeba histolytica
NDKSRLNWCIPPLVFALLKAGRIQESLR

SEQ ID NO: 2689152 - protein, 23 aa, Entamoeba histolytica
NDKVIKLLACIIEDACQLLQENR

SEQ ID NO: 2689153 - protein, 18 aa, Entamoeba histolytica
NDLFKYPTIQTIQNYLTN

SEQ ID NO: 2689154 - protein, 27 aa, Entamoeba histolytica
NDLHCGKYKLEVCFVKESSAVNITEPE

SEQ ID NO: 2689155 - protein, 20 aa, Entamoeba histolytica
NDLIKISFILKGIKRVFYVN

SEQ ID NO: 2689156 - protein, 19 aa, Entamoeba histolytica
NDLIPLFEFLLTFIENNTS

SEQ ID NO: 2689157 - protein, 21 aa, Entamoeba histolytica
NDLIRLFYIYLLNSNESNVLQ

SEQ ID NO: 2689158 - protein, 24 aa, Entamoeba histolytica
NDLKKAYRKLALKWHPDRNPNNKE

SEQ ID NO: 2689159 - protein, 17 aa, Entamoeba histolytica
NDLKSFKIVSGNYSLEI

SEQ ID NO: 2689160 - protein, 24 aa, Entamoeba histolytica
NDLLKIRFCQDISRGMEYLHQNDI

SEQ ID NO: 2689161 - protein, 17 aa, Entamoeba histolytica
NDLLLMWDVTKPKISTL

SEQ ID NO: 2689162 - protein, 21 aa, Entamoeba histolytica
NDLLRLCWGLMTVADFTVRRS

SEQ ID NO: 2689163 - protein, 20 aa, Entamoeba histolytica
NDLRLTLEYYSRTFNQPEKQ

SEQ ID NO: 2689164 - protein, 17 aa, Entamoeba histolytica
NDLYGPVNPILENGEEI

SEQ ID NO: 2689165 - protein, 17 aa, Entamoeba histolytica
NDMRMSIRMSREEPYNS

SEQ ID NO: 2689166 - protein, 17 aa, Entamoeba histolytica
NDMTCASIAAITPTLNN

SEQ ID NO: 2689167 - protein, 17 aa, Entamoeba histolytica
NDNCFRNSVNLMNISIP

SEQ ID NO: 2689168 - protein, 22 aa, Entamoeba histolytica
NDNCKLCGGAQVQRVLKTYEKK

SEQ ID NO: 2689169 - protein, 18 aa, Entamoeba histolytica
NDNLKLLLQNIIKNTSVA

SEQ ID NO: 2689170 - protein, 19 aa, Entamoeba histolytica
NDNLKVFFKQNIKDSIQRK

SEQ ID NO: 2689171 - protein, 17 aa, Entamoeba histolytica
NDPDFKWGISKGIRNSS

SEQ ID NO: 2689172 - protein, 32 aa, Entamoeba histolytica
NDPRIGCCMKGHPCCKRIDGQYVLTEDSKCIL

SEQ ID NO: 2689173 - protein, 17 aa, Entamoeba histolytica
NDPRVFTTTVNCFVNMK

SEQ ID NO: 2689174 - protein, 23 aa, Entamoeba histolytica
NDQRLQFYTSYVQRNINSLRKNI

SEQ ID NO: 2689175 - protein, 29 aa, Entamoeba histolytica
NDQSAWIYYRWLLGTGMKCYNELNKKEEW

SEQ ID NO: 2689176 - protein, 23 aa, Entamoeba histolytica
NDQSIFWKLYYKSTVYNNEHVLL

SEQ ID NO: 2689177 - protein, 25 aa, Entamoeba histolytica
NDQVREHIKRVCVIYSLEHSELQYN

SEQ ID NO: 2689178 - protein, 24 aa, Entamoeba histolytica
NDQVYALICLIELLKTQPCAKDSR

SEQ ID NO: 2689179 - protein, 28 aa, Entamoeba histolytica
NDRCPIMLVCQDCFWRCTVQGGCEYICN

SEQ ID NO: 2689180 - protein, 25 aa, Entamoeba histolytica
NDRFKIKLCDFGSCKCLNQKESYPT

SEQ ID NO: 2689181 - protein, 21 aa, Entamoeba histolytica
NDSDNCIIFSFKANKKEPIII

SEQ ID NO: 2689182 - protein, 19 aa, Entamoeba histolytica
NDSSCWSEGTFRGHTHNVT

SEQ ID NO: 2689183 - protein, 18 aa, Entamoeba histolytica
NDTFPVICCGDFNVNGRA

SEQ ID NO: 2689184 - protein, 17 aa, Entamoeba histolytica
NDTIRLAALHRIIQILS

SEQ ID NO: 2689185 - protein, 17 aa, Entamoeba histolytica
NDTRLARRILRDINYRG

SEQ ID NO: 2689186 - protein, 22 aa, Entamoeba histolytica
NDTRLARRILRDINYRGRTLDS

SEQ ID NO: 2689187 - protein, 22 aa, Entamoeba histolytica
NDTRLYQIGSFELGRGSMGIRA

SEQ ID NO: 2689188 - protein, 25 aa, Entamoeba histolytica
NDVCYLCGKTGHWARDCKEKRYRRR

SEQ ID NO: 2689189 - protein, 19 aa, Entamoeba histolytica
NDVDFVAAGIYCFQPYCVT

SEQ ID NO: 2689190 - protein, 31 aa, Entamoeba histolytica
NDVEPEFDLQFLRSVLQTNITIISEEYNKTK

SEQ ID NO: 2689191 - protein, 29 aa, Entamoeba histolytica
NDVFKIKDIWKHVCIVWTRCYNYIPPKKI

SEQ ID NO: 2689192 - protein, 27 aa, Entamoeba histolytica
NDVGSIKALWVAWKLGAKDYKINENGF

SEQ ID NO: 2689193 - protein, 22 aa, Entamoeba histolytica
NDVINFASTMLIKPSSDESIIF

SEQ ID NO: 2689194 - protein, 24 aa, Entamoeba histolytica
NDVKRFKQQFIYIISDKYKKPTIV

SEQ ID NO: 2689195 - protein, 20 aa, Entamoeba histolytica
NDVPADNIILVFGNHEKKII

SEQ ID NO: 2689196 - protein, 21 aa, Entamoeba histolytica
NDVSCLFKRVINATISVYNKN

SEQ ID NO: 2689197 - protein, 23 aa, Entamoeba histolytica
NDVVMGSLFIRLLHVKICRVEMN

SEQ ID NO: 2689198 - protein, 19 aa, Entamoeba histolytica
NDVWVCCGNGSIKAINNTE

SEQ ID NO: 2689199 - protein, 18 aa, Entamoeba histolytica
NDYAITLHYLFTATEPFI

SEQ ID NO: 2689200 - protein, 19 aa, Entamoeba histolytica
NDYIPCLLQIIATPQYKPL

SEQ ID NO: 2689201 - protein, 18 aa, Entamoeba histolytica
NDYQRKAIYNALNEDISL

SEQ ID NO: 2689202 - protein, 19 aa, Entamoeba histolytica
NDYSIALRIKYGDFVYSTA

SEQ ID NO: 2689203 - protein, 19 aa, Entamoeba histolytica
NDYSISLRIQLGDFVYSTS

SEQ ID NO: 2689204 - protein, 25 aa, Entamoeba histolytica
NDYSKMSPFYACSSVNRSDTTMDLE

SEQ ID NO: 2689205 - protein, 20 aa, Entamoeba histolytica
NDYWLLPSFITLPEITFIHS

SEQ ID NO: 2689206 - protein, 23 aa, Entamoeba histolytica
NEAEMAKYLLEIRDIIRENNRKN

SEQ ID NO: 2689207 - protein, 25 aa, Entamoeba histolytica
NEAKEPRFSLAINEGNEGSRLSHDH

SEQ ID NO: 2689208 - protein, 21 aa, Entamoeba histolytica
NEALCTVILGVGRLICYNPKV

SEQ ID NO: 2689209 - protein, 28 aa, Entamoeba histolytica
NEALIYRCISKVYNRVCANSSTQIYDSN

SEQ ID NO: 2689210 - protein, 19 aa, Entamoeba histolytica
NEAPRPVTIRVNTLKSRRR

SEQ ID NO: 2689211 - protein, 20 aa, Entamoeba histolytica
NEAYRQVVWMMHQLYHDCNM

SEQ ID NO: 2689212 - protein, 20 aa, Entamoeba histolytica
NECEQLRTIFGMGKVPIVAR

SEQ ID NO: 2689213 - protein, 19 aa, Entamoeba histolytica
NECKSLRTIAIPTSVVEIG

SEQ ID NO: 2689214 - protein, 21 aa, Entamoeba histolytica
NECTVEWNIKGEITPKEISNF

SEQ ID NO: 2689215 - protein, 18 aa, Entamoeba histolytica
NECYYDLGEWKEITISSE

SEQ ID NO: 2689216 - protein, 28 aa, Entamoeba histolytica
NEDDCFRVGVKFGMNGVHFYSNFYESDL

SEQ ID NO: 2689217 - protein, 24 aa, Entamoeba histolytica
NEDFLVLACDGIWDVLGNEDVVSI

SEQ ID NO: 2689218 - protein, 19 aa, Entamoeba histolytica
NEDIEICRMEKPLNYEYEE

SEQ ID NO: 2689219 - protein, 25 aa, Entamoeba histolytica
NEDIFKACIGCLWNLSIDPAVTPQM

SEQ ID NO: 2689220 - protein, 18 aa, Entamoeba histolytica
NEDLCKKIDSIFTQSNNS

SEQ ID NO: 2689221 - protein, 24 aa, Entamoeba histolytica
NEDLSRIMLFPNISTFGIQIKGIK

SEQ ID NO: 2689222 - protein, 20 aa, Entamoeba histolytica
NEDRAVFLFLNEFFRETYII

SEQ ID NO: 2689223 - protein, 24 aa, Entamoeba histolytica
NEDSVYLLRCQIINTCISFMEEYS

SEQ ID NO: 2689224 - protein, 22 aa, Entamoeba histolytica
NEEASLFAFCVALLSQYFKIEI

SEQ ID NO: 2689225 - protein, 20 aa, Entamoeba histolytica
NEEELWYFIEHVIEQRIDNF

SEQ ID NO: 2689226 - protein, 21 aa, Entamoeba histolytica
NEEFKCIKCKSGYYLNSNNKC

SEQ ID NO: 2689227 - protein, 25 aa, Entamoeba histolytica
NEEFKCPNLEFVGCTSMNRNESMGI

SEQ ID NO: 2689228 - protein, 20 aa, Entamoeba histolytica
NEEFKMFKNMIIDFYHNDVN

SEQ ID NO: 2689229 - protein, 22 aa, Entamoeba histolytica
NEEFPLPSSVPLTSQEDLNQTL

SEQ ID NO: 2689230 - protein, 17 aa, Entamoeba histolytica
NEEICCLTTSNKVNTLI

SEQ ID NO: 2689231 - protein, 28 aa, Entamoeba histolytica
NEEIKCSYLEGFMTLFVRPLLGRTGILK

SEQ ID NO: 2689232 - protein, 23 aa, Entamoeba histolytica
NEEIKEFFNQAGEVVHVEQVIDT

SEQ ID NO: 2689233 - protein, 22 aa, Entamoeba histolytica
NEEIKWRLIKRISQQKNRNVLL

SEQ ID NO: 2689234 - protein, 18 aa, Entamoeba histolytica
NEELRNLVFFKYPKWTGG

SEQ ID NO: 2689235 - protein, 25 aa, Entamoeba histolytica
NEERIRFVYEIKAIVYTKVSSFDSD

SEQ ID NO: 2689236 - protein, 20 aa, Entamoeba histolytica
NEETMSCRISSGLGSIQLPV

SEQ ID NO: 2689237 - protein, 22 aa, Entamoeba histolytica
NEEVLKLIPLFIGETQSGILLQ

SEQ ID NO: 2689238 - protein, 17 aa, Entamoeba histolytica
NEEYKRRKINDEDINTI

SEQ ID NO: 2689239 - protein, 21 aa, Entamoeba histolytica
NEFFLQRLLSTLLNFNHLTNS

SEQ ID NO: 2689240 - protein, 24 aa, Entamoeba histolytica
NEFKDYRMIFGLQKLFVDMLKGIN

SEQ ID NO: 2689241 - protein, 19 aa, Entamoeba histolytica
NEFKNMIEFYLKNSEEEDP

SEQ ID NO: 2689242 - protein, 24 aa, Entamoeba histolytica
NEFMVRCQCALRRISAQQKKYQTH

SEQ ID NO: 2689243 - protein, 17 aa, Entamoeba histolytica
NEFNIAMGKLVLGIYLM

SEQ ID NO: 2689244 - protein, 18 aa, Entamoeba histolytica
NEFRRIRQNYGYVDKSGR

SEQ ID NO: 2689245 - protein, 31 aa, Entamoeba histolytica
NEFYDKVCISSMRISICLRKVLDKYDSEVVI

SEQ ID NO: 2689246 - protein, 24 aa, Entamoeba histolytica
NEFYPKLCEWVGLSNYEVLYNSVE

SEQ ID NO: 2689247 - protein, 24 aa, Entamoeba histolytica
NEGICTNCGLVLYEQETYVNDIIS

SEQ ID NO: 2689248 - protein, 19 aa, Entamoeba histolytica
NEHFKCGIKNVIVQMEDDE

SEQ ID NO: 2689249 - protein, 22 aa, Entamoeba histolytica
NEHIILPIIVTFVSVTNKQLEF

SEQ ID NO: 2689250 - protein, 23 aa, Entamoeba histolytica
NEHLSIHVVVRFGKVSYYIHNST

SEQ ID NO: 2689251 - protein, 23 aa, Entamoeba histolytica
NEIAPRNGLLRVREFTLAEIEYF

SEQ ID NO: 2689252 - protein, 17 aa, Entamoeba histolytica
NEICALCMEYSKNELES

SEQ ID NO: 2689253 - protein, 21 aa, Entamoeba histolytica
NEIDWRNAFNAFDIIIGLFND

SEQ ID NO: 2689254 - protein, 22 aa, Entamoeba histolytica
NEIEKGCFNRCYSLRSIEIPTS

SEQ ID NO: 2689255 - protein, 23 aa, Entamoeba histolytica
NEIEKGCFNRCYSLRSIEIPTSV

SEQ ID NO: 2689256 - protein, 24 aa, Entamoeba histolytica
NEIELKTMLGKVVKSIEILTKQSR

SEQ ID NO: 2689257 - protein, 24 aa, Entamoeba histolytica
NEIERLIEWGRGITPINIDTNKQE

SEQ ID NO: 2689258 - protein, 19 aa, Entamoeba histolytica
NEIFFKQIYWFEINVLTTI

SEQ ID NO: 2689259 - protein, 21 aa, Entamoeba histolytica
NEIFLRLKKKLNISEHQTEYL

SEQ ID NO: 2689260 - protein, 21 aa, Entamoeba histolytica
NEIILRVLIERSFGEYHQVGA

SEQ ID NO: 2689261 - protein, 22 aa, Entamoeba histolytica
NEIIQRIRLLFVDLINTTLQSI

SEQ ID NO: 2689262 - protein, 21 aa, Entamoeba histolytica
NEIKDLLTWVHCLKPISVDKI

SEQ ID NO: 2689263 - protein, 22 aa, Entamoeba histolytica
NEIKIIIKQVFNAINYLHSNKI

SEQ ID NO: 2689264 - protein, 19 aa, Entamoeba histolytica
NEIKKLLIYPKMFDTNLKT

SEQ ID NO: 2689265 - protein, 19 aa, Entamoeba histolytica
NEIKMCVDDPLDLSKQESF

SEQ ID NO: 2689266 - protein, 18 aa, Entamoeba histolytica
NEIKPELFQATAPTTELQ

SEQ ID NO: 2689267 - protein, 19 aa, Entamoeba histolytica
NEILDCYNKFEISYLEAMK

SEQ ID NO: 2689268 - protein, 21 aa, Entamoeba histolytica
NEILPSLPWGKVFEKDVFESP

SEQ ID NO: 2689269 - protein, 25 aa, Entamoeba histolytica
NEILTIKLLLLFGDHLFSTPKISKQ

SEQ ID NO: 2689270 - protein, 22 aa, Entamoeba histolytica
NEILVLIHRLMYQRQGSQKERL

SEQ ID NO: 2689271 - protein, 20 aa, Entamoeba histolytica
NEINGFDIIKFLEKVSSVKY

SEQ ID NO: 2689272 - protein, 19 aa, Entamoeba histolytica
NEIPFKIIPIRNVPRMYMN

SEQ ID NO: 2689273 - protein, 26 aa, Entamoeba histolytica
NEIRRMEFCFVINRVNYYLTREEELL

SEQ ID NO: 2689274 - protein, 23 aa, Entamoeba histolytica
NEIRSYCFYKCASLKSIKMPTSV

SEQ ID NO: 2689275 - protein, 20 aa, Entamoeba histolytica
NEITMSYLIPALDKYLQDYE

SEQ ID NO: 2689276 - protein, 27 aa, Entamoeba histolytica
NEIVNILLRPCCFKFLHIPIQSGSTSV

SEQ ID NO: 2689277 - protein, 20 aa, Entamoeba histolytica
NEIVSSILFNGKLILTSEQI

SEQ ID NO: 2689278 - protein, 21 aa, Entamoeba histolytica
  misc_feature (16)..(21): Xaa can be any naturally occurring amino acid
NEKDEKIIIKDEINIXXXXXX

SEQ ID NO: 2689279 - protein, 18 aa, Entamoeba histolytica
NEKECYLILLSDFYRSVV

SEQ ID NO: 2689280 - protein, 22 aa, Entamoeba histolytica
NEKEIPKSILLLYSTTLRLFAI

SEQ ID NO: 2689281 - protein, 25 aa, Entamoeba histolytica
NEKELKYLLTTVMIRRLKHDVLKEL

SEQ ID NO: 2689282 - protein, 18 aa, Entamoeba histolytica
NEKESLLKEIDSLKEQLD

SEQ ID NO: 2689283 - protein, 20 aa, Entamoeba histolytica
NEKFPCFIEVVGIQSPGLTA

SEQ ID NO: 2689284 - protein, 17 aa, Entamoeba histolytica
NEKGCEILETFENRGPI

SEQ ID NO: 2689285 - protein, 18 aa, Entamoeba histolytica
NEKIKGKKNLAFVVMNES

SEQ ID NO: 2689286 - protein, 21 aa, Entamoeba histolytica
NEKIVYKWRFNSWPEGKYSHV

SEQ ID NO: 2689287 - protein, 22 aa, Entamoeba histolytica
NEKKILEEARIKEEAEAKAKEE

SEQ ID NO: 2689288 - protein, 28 aa, Entamoeba histolytica
NEKKRATTFQKRRHGLIKKAMELSILCD

SEQ ID NO: 2689289 - protein, 21 aa, Entamoeba histolytica
NEKKVSEKKVVKLITEHNEMV

SEQ ID NO: 2689290 - protein, 23 aa, Entamoeba histolytica
NEKLKLQLTESIEKNNELESVMK

SEQ ID NO: 2689291 - protein, 24 aa, Entamoeba histolytica
NEKLLIRYPDWRLLTPQEADQETE

SEQ ID NO: 2689292 - protein, 17 aa, Entamoeba histolytica
NEKRGSIQLHEMDDPCL

SEQ ID NO: 2689293 - protein, 22 aa, Entamoeba histolytica
NEKRYDVRIEVIERPEDEKKEE

SEQ ID NO: 2689294 - protein, 18 aa, Entamoeba histolytica
NEKSEFNGMIGITQPRRI

SEQ ID NO: 2689295 - protein, 18 aa, Entamoeba histolytica
NEKSLICIIQVFGDQEMV

SEQ ID NO: 2689296 - protein, 26 aa, Entamoeba histolytica
NEKSRALLTWLFDLMIEVAKNRETNK

SEQ ID NO: 2689297 - protein, 17 aa, Entamoeba histolytica
NEKWEMNYSNGWEKKSL

SEQ ID NO: 2689298 - protein, 26 aa, Entamoeba histolytica
NEKWLKTHLQHVIWKQSGYYFHNRNI

SEQ ID NO: 2689299 - protein, 28 aa, Entamoeba histolytica
NEKYMKSTICVARNIFTNGILVGSFEGI

SEQ ID NO: 2689300 - protein, 18 aa, Entamoeba histolytica
NELARLLIKYLKNGKIQS

SEQ ID NO: 2689301 - protein, 17 aa, Entamoeba histolytica
NELCQLEKMFSRIQEQS

SEQ ID NO: 2689302 - protein, 20 aa, Entamoeba histolytica
NELDRIGACNGFVEVIRKSS

SEQ ID NO: 2689303 - protein, 28 aa, Entamoeba histolytica
NELFIKNINEFICFALAIDHYQSDNVKM

SEQ ID NO: 2689304 - protein, 18 aa, Entamoeba histolytica
NELFTCNDLTLIEKRQLM

SEQ ID NO: 2689305 - protein, 23 aa, Entamoeba histolytica
NELGEFYAMVSFVNPDVLGSLSA

SEQ ID NO: 2689306 - protein, 20 aa, Entamoeba histolytica
NELGSYCFYGCSSLKSIIIP

SEQ ID NO: 2689307 - protein, 22 aa, Entamoeba histolytica
NELGSYCFYGCSSLKSIVIPST

SEQ ID NO: 2689308 - protein, 20 aa, Entamoeba histolytica
NELHGSVIFALKEDSKIPNL

SEQ ID NO: 2689309 - protein, 17 aa, Entamoeba histolytica
NELIGLLLPFLSEQLKS

SEQ ID NO: 2689310 - protein, 17 aa, Entamoeba histolytica
NELIKALPMLGFNCNKR

SEQ ID NO: 2689311 - protein, 24 aa, Entamoeba histolytica
NELINKFLFCLNGNTVHISPHEIN

SEQ ID NO: 2689312 - protein, 24 aa, Entamoeba histolytica
NELIYGCFIYCIFNPLKQPKFIDL

SEQ ID NO: 2689313 - protein, 18 aa, Entamoeba histolytica
NELKEIKNQLNLKLKEEE

SEQ ID NO: 2689314 - protein, 22 aa, Entamoeba histolytica
NELKGTLLESGRIYSNPKFSPK

SEQ ID NO: 2689315 - protein, 21 aa, Entamoeba histolytica
NELKISFNYILHPKVWYLIFI

SEQ ID NO: 2689316 - protein, 21 aa, Entamoeba histolytica
NELKKLHLIHCRINEKIEFPK

SEQ ID NO: 2689317 - protein, 19 aa, Entamoeba histolytica
NELKLAQKTMCSNMTVCAA

SEQ ID NO: 2689318 - protein, 18 aa, Entamoeba histolytica
NELKRIIKEVNLIYEERR

SEQ ID NO: 2689319 - protein, 17 aa, Entamoeba histolytica
NELKSAKFPGGLRLDED

SEQ ID NO: 2689320 - protein, 23 aa, Entamoeba histolytica
NELKTSPMRLALFKQPDFLNSPK

SEQ ID NO: 2689321 - protein, 19 aa, Entamoeba histolytica
NELLIPVPVQIPVQPVDYS

SEQ ID NO: 2689322 - protein, 18 aa, Entamoeba histolytica
NELLNLFSMEKIKRKVVI

SEQ ID NO: 2689323 - protein, 22 aa, Entamoeba histolytica
NELNFKGIQLFTITNGTKTFFA

SEQ ID NO: 2689324 - protein, 26 aa, Entamoeba histolytica
NELNRNEFLLALALLKNQKAGFAIPK

SEQ ID NO: 2689325 - protein, 17 aa, Entamoeba histolytica
NELPFPLIAHAILIGKH

SEQ ID NO: 2689326 - protein, 25 aa, Entamoeba histolytica
NELPIEIWLHVVPQIIARIQSEVGS

SEQ ID NO: 2689327 - protein, 17 aa, Entamoeba histolytica
NELPIVAIFPCDSTSFI

SEQ ID NO: 2689328 - protein, 26 aa, Entamoeba histolytica
NELPLSTKGSICIQYTIISSSSSTKT

SEQ ID NO: 2689329 - protein, 18 aa, Entamoeba histolytica
NELPMVYQEICKYFEQIS

SEQ ID NO: 2689330 - protein, 23 aa, Entamoeba histolytica
NELREYNVLYLKYVNEGIITISS

SEQ ID NO: 2689331 - protein, 17 aa, Entamoeba histolytica
NELRGCIGCFSPSRPLY

SEQ ID NO: 2689332 - protein, 26 aa, Entamoeba histolytica
NELSPECLDCLLPQVLKDDGISIPYR

SEQ ID NO: 2689333 - protein, 22 aa, Entamoeba histolytica
NELSRKFRLHCLLNSQKSKSQT

SEQ ID NO: 2689334 - protein, 17 aa, Entamoeba histolytica
NELWNIVVRKQCDMNKQ

SEQ ID NO: 2689335 - protein, 22 aa, Entamoeba histolytica
NELWSELIGWYLKGNKRNEAKQ

SEQ ID NO: 2689336 - protein, 26 aa, Entamoeba histolytica
NELYIFRSGKYFNYIKEYVLSKQLVI

SEQ ID NO: 2689337 - protein, 18 aa, Entamoeba histolytica
NELYKDLIKFGFDQIRDP

SEQ ID NO: 2689338 - protein, 23 aa, Entamoeba histolytica
NEMETRNGFTFNSPRETWKVSRP

SEQ ID NO: 2689339 - protein, 23 aa, Entamoeba histolytica
NEMGEIPLIIAIKHKQISTINIL

SEQ ID NO: 2689340 - protein, 33 aa, Entamoeba histolytica
NEMKRLLNEWQYKCMYLSYKNGSVIFTKDIVGN

SEQ ID NO: 2689341 - protein, 18 aa, Entamoeba histolytica
NEMLIILNYSLEWLNKEE

SEQ ID NO: 2689342 - protein, 20 aa, Entamoeba histolytica
NEMLNKVIISFKYDGKKTIK

SEQ ID NO: 2689343 - protein, 21 aa, Entamoeba histolytica
NEMVFWYKYFSFLFKSENQNS

SEQ ID NO: 2689344 - protein, 18 aa, Entamoeba histolytica
NENCIKFTFSLSPICDSY

SEQ ID NO: 2689345 - protein, 20 aa, Entamoeba histolytica
NENFKYLRMDGLVSSNKRPE

SEQ ID NO: 2689346 - protein, 22 aa, Entamoeba histolytica
NENNQRFARYVIFIKKPKRFVV

SEQ ID NO: 2689347 - protein, 21 aa, Entamoeba histolytica
NENRYRWGVDKAYDVKVVEIV

SEQ ID NO: 2689348 - protein, 20 aa, Entamoeba histolytica
NENWEFIPFDLSTTPLIGRN

SEQ ID NO: 2689349 - protein, 26 aa, Entamoeba histolytica
NENWNKRCCDICKKVQIEITPEAIID

SEQ ID NO: 2689350 - protein, 17 aa, Entamoeba histolytica
NEPEITRFSEIMKLLED

SEQ ID NO: 2689351 - protein, 23 aa, Entamoeba histolytica
NEPLIKRVIRVAGNLICLDLYEL

SEQ ID NO: 2689352 - protein, 25 aa, Entamoeba histolytica
NEPLNYRINFIGTFYVSKDNVKEKH

SEQ ID NO: 2689353 - protein, 21 aa, Entamoeba histolytica
NEPPFVYILLGWLTHLIVMNP

SEQ ID NO: 2689354 - protein, 25 aa, Entamoeba histolytica
NEPQKCCGCGQKIDMDRAVCVYGKN

SEQ ID NO: 2689355 - protein, 21 aa, Entamoeba histolytica
NEPRCFSVPIKSVQKVIQEKE

SEQ ID NO: 2689356 - protein, 22 aa, Entamoeba histolytica
NEQCCRDLYGALSHNIKSQYQL

SEQ ID NO: 2689357 - protein, 17 aa, Entamoeba histolytica
NEQLRAIVENHFKIGEQ

SEQ ID NO: 2689358 - protein, 33 aa, Entamoeba histolytica
NEQMKMKLIMIGESSVGKTCCMNRFVSDQFSEV

SEQ ID NO: 2689359 - protein, 23 aa, Entamoeba histolytica
NEQRLKLRLRIEQLSRRYQIPQL

SEQ ID NO: 2689360 - protein, 19 aa, Entamoeba histolytica
NEQVIPWIISHQEILIQDE

SEQ ID NO: 2689361 - protein, 24 aa, Entamoeba histolytica
NEQYRMHPGISILPNTLFYNRKII

SEQ ID NO: 2689362 - protein, 17 aa, Entamoeba histolytica
NERGIDISLTFKLNSYG

SEQ ID NO: 2689363 - protein, 19 aa, Entamoeba histolytica
NERIITVILGNLFLTTCQY

SEQ ID NO: 2689364 - protein, 22 aa, Entamoeba histolytica
NERIPFYIAKVIKSNRILLENI

SEQ ID NO: 2689365 - protein, 25 aa, Entamoeba histolytica
NERQAACVLYQLVSAITYLHKNNIA

SEQ ID NO: 2689366 - protein, 21 aa, Entamoeba histolytica
NESKFEFAQEMFLSSTSSFKE

SEQ ID NO: 2689367 - protein, 33 aa, Entamoeba histolytica
NESNKWWSYPICKLSFEEMFIRRVMNENTSFKW

SEQ ID NO: 2689368 - protein, 22 aa, Entamoeba histolytica
NESPFYFVLRHIELLRKNTIHS

SEQ ID NO: 2689369 - protein, 17 aa, Entamoeba histolytica
NESYEYILPNIKKICDF

SEQ ID NO: 2689370 - protein, 18 aa, Entamoeba histolytica
NESYQIYVLLLKQQPEHC

SEQ ID NO: 2689371 - protein, 28 aa, Entamoeba histolytica
NETEIIKFIMLLFESFILNKVKVQKSEG

SEQ ID NO: 2689372 - protein, 28 aa, Entamoeba histolytica
NETITLPLKRSELFFSKLTQGAKGVLLF

SEQ ID NO: 2689373 - protein, 26 aa, Entamoeba histolytica
NETLIFKEYFHDLAIKDDMVTSNTTD

SEQ ID NO: 2689374 - protein, 22 aa, Entamoeba histolytica
NETMTAFWLMKTIFIGLKRSKF

SEQ ID NO: 2689375 - protein, 27 aa, Entamoeba histolytica
NETNEFFYDCCCDMPLTYHYSELYLLT

SEQ ID NO: 2689376 - protein, 24 aa, Entamoeba histolytica
NETQIKLIVCQKIVTTDLLGTLWR

SEQ ID NO: 2689377 - protein, 19 aa, Entamoeba histolytica
NETRFCFVNSHLAAHQQFL

SEQ ID NO: 2689378 - protein, 28 aa, Entamoeba histolytica
NEVAKCRWIEQMFGKGWDMIEVKKDYLL

SEQ ID NO: 2689379 - protein, 20 aa, Entamoeba histolytica
NEVFCNTFIFRSYKDNNNKY

SEQ ID NO: 2689380 - protein, 21 aa, Entamoeba histolytica
NEVILPQFIDFIFNSQDDFIV

SEQ ID NO: 2689381 - protein, 27 aa, Entamoeba histolytica
NEVIYKRLIQMFKEINIPYIIAPGEAE

SEQ ID NO: 2689382 - protein, 21 aa, Entamoeba histolytica
NEVKKWKDIAVLKDVQQTQSV

SEQ ID NO: 2689383 - protein, 24 aa, Entamoeba histolytica
NEVLKEARFIDGFNKLIKSEENNL

SEQ ID NO: 2689384 - protein, 17 aa, Entamoeba histolytica
NEVLLKFQETSKSVEKD

SEQ ID NO: 2689385 - protein, 17 aa, Entamoeba histolytica
NEVLPKPRIEIIQISGI

SEQ ID NO: 2689386 - protein, 18 aa, Entamoeba histolytica
NEVMELKGNVRVFCRVRP

SEQ ID NO: 2689387 - protein, 18 aa, Entamoeba histolytica
NEVMGCLELAANSLQVLC

SEQ ID NO: 2689388 - protein, 21 aa, Entamoeba histolytica
NEVPEYCVLNKLDFAGFPVNI

SEQ ID NO: 2689389 - protein, 21 aa, Entamoeba histolytica
NEVRGEYKYLFDSIVPVNELK

SEQ ID NO: 2689390 - protein, 29 aa, Entamoeba histolytica
NEVVRWFAERADMIVLVFDAHKLDISDEF

SEQ ID NO: 2689391 - protein, 21 aa, Entamoeba histolytica
NEVYKSMAMLRLNPDEIRSLG

SEQ ID NO: 2689392 - protein, 21 aa, Entamoeba histolytica
NEVYPKYTFLVIDCPKPQNIP

SEQ ID NO: 2689393 - protein, 17 aa, Entamoeba histolytica
NEWKNKLICFGPKRCGP

SEQ ID NO: 2689394 - protein, 20 aa, Entamoeba histolytica
NEWLNIPLIILNNIETHCST

SEQ ID NO: 2689395 - protein, 17 aa, Entamoeba histolytica
NEWRMWIANTTKFGPIK

SEQ ID NO: 2689396 - protein, 19 aa, Entamoeba histolytica
NEWWAKNGYLVSLHDFGYL

SEQ ID NO: 2689397 - protein, 32 aa, Entamoeba histolytica
NEYCIDLSLPVQFCLPKVFKLTNMITDTMQIS

SEQ ID NO: 2689398 - protein, 23 aa, Entamoeba histolytica
NEYCPIVERIIRGEIQCDKMNIK

SEQ ID NO: 2689399 - protein, 23 aa, Entamoeba histolytica
NEYFALFWRCIKEYCDDNSEIRN

SEQ ID NO: 2689400 - protein, 18 aa, Entamoeba histolytica
NEYIIQFYGAVFIPNKIC

SEQ ID NO: 2689401 - protein, 20 aa, Entamoeba histolytica
NEYIKQCSIIGCNQKQKEFY

SEQ ID NO: 2689402 - protein, 23 aa, Entamoeba histolytica
NEYLICYNGAMICHGNEIVFESE

SEQ ID NO: 2689403 - protein, 25 aa, Entamoeba histolytica
NEYLRKLLIERGIIFSTESEKIEVE

SEQ ID NO: 2689404 - protein, 17 aa, Entamoeba histolytica
NEYLRRPITISIGKTGN

SEQ ID NO: 2689405 - protein, 20 aa, Entamoeba histolytica
NEYPDIFFAEQVVQNACATQ

SEQ ID NO: 2689406 - protein, 24 aa, Entamoeba histolytica
NEYQCFRGVSYQIGRLINKTNTLI

SEQ ID NO: 2689407 - protein, 17 aa, Entamoeba histolytica
NEYQFGIISRINEIERK

SEQ ID NO: 2689408 - protein, 30 aa, Entamoeba histolytica
NEYRIYVPTFICNCFKEIMNSHGIEYNVNP

SEQ ID NO: 2689409 - protein, 26 aa, Entamoeba histolytica
NEYVLKLKLYIPFILMKDKTLLVLSL

SEQ ID NO: 2689410 - protein, 26 aa, Entamoeba histolytica
NEYYKHKFRIITSIGSIVEKNSLMIG

SEQ ID NO: 2689411 - protein, 18 aa, Entamoeba histolytica
NFAIGCLVVCEYPSGKEL

SEQ ID NO: 2689412 - protein, 22 aa, Entamoeba histolytica
NFAPLIRKAIDIVRTTHSYHIL

SEQ ID NO: 2689413 - protein, 17 aa, Entamoeba histolytica
NFCCEICGISSTHSEPF

SEQ ID NO: 2689414 - protein, 24 aa, Entamoeba histolytica
NFCKMFVIHYDRLVFNNLMKQKSI

SEQ ID NO: 2689415 - protein, 21 aa, Entamoeba histolytica
NFCKMRELVKLASPPSIPFIG

SEQ ID NO: 2689416 - protein, 18 aa, Entamoeba histolytica
NFCNKLWNAFKFSTMNFR

SEQ ID NO: 2689417 - protein, 20 aa, Entamoeba histolytica
NFCYEIKTNDSIKCVLNDME

SEQ ID NO: 2689418 - protein, 23 aa, Entamoeba histolytica
NFDLYKPCFDYLLSCLATNDGTI

SEQ ID NO: 2689419 - protein, 24 aa, Entamoeba histolytica
NFDSLKQVTYWIGELKKENVDGII

SEQ ID NO: 2689420 - protein, 22 aa, Entamoeba histolytica
NFDSPSSFDWDLIIDTLKKIKA

SEQ ID NO: 2689421 - protein, 18 aa, Entamoeba histolytica
NFECYEQAILLAILNPFC

SEQ ID NO: 2689422 - protein, 17 aa, Entamoeba histolytica
NFEHKYDSLKLNMKKVP

SEQ ID NO: 2689423 - protein, 23 aa, Entamoeba histolytica
NFELKEFFERFGKVVDVVIMERY

SEQ ID NO: 2689424 - protein, 19 aa, Entamoeba histolytica
NFEPFKWIQPSNIYSFEEM

SEQ ID NO: 2689425 - protein, 25 aa, Entamoeba histolytica
NFETRYEILGGLLAFIRTMDREVEG

SEQ ID NO: 2689426 - protein, 26 aa, Entamoeba histolytica
NFFTYKRYKFGVLYAAVGQTKEMEFF

SEQ ID NO: 2689427 - protein, 26 aa, Entamoeba histolytica
NFFVFSLKNPHGIAPTRFSRKRLSTT

SEQ ID NO: 2689428 - protein, 19 aa, Entamoeba histolytica
NFGAFKFPLEIHTTKRKIN

SEQ ID NO: 2689429 - protein, 17 aa, Entamoeba histolytica
NFGDGLVEVVGFKSVIE

SEQ ID NO: 2689430 - protein, 17 aa, Entamoeba histolytica
NFHLRQILAGLRKNKKL

SEQ ID NO: 2689431 - protein, 24 aa, Entamoeba histolytica
NFIEKWNKICKVEERIIQQQERIK

SEQ ID NO: 2689432 - protein, 23 aa, Entamoeba histolytica
NFIELCCLILGEYGEYCEDILSL

SEQ ID NO: 2689433 - protein, 22 aa, Entamoeba histolytica
NFIKRRRFSTEIIQQLLQHIMA

SEQ ID NO: 2689434 - protein, 17 aa, Entamoeba histolytica
NFIQIFANVLLKIKIEK

SEQ ID NO: 2689435 - protein, 18 aa, Entamoeba histolytica
NFISLDWNNPRFFINKFH

SEQ ID NO: 2689436 - protein, 29 aa, Entamoeba histolytica
NFKTLAFCRRYVDKIGFAKWQMPFKFLVD

SEQ ID NO: 2689437 - protein, 17 aa, Entamoeba histolytica
NFLKSLPKGLAKCVDMN

SEQ ID NO: 2689438 - protein, 21 aa, Entamoeba histolytica
NFLLHSPLKYTGINLRTLTDI

SEQ ID NO: 2689439 - protein, 20 aa, Entamoeba histolytica
NFLNIPAIVFAKQVTLIEYD

SEQ ID NO: 2689440 - protein, 18 aa, Entamoeba histolytica
NFLTWAYDLNTFEKKGNE

SEQ ID NO: 2689441 - protein, 18 aa, Entamoeba histolytica
NFMMPIYLHDSLLRAQKF

SEQ ID NO: 2689442 - protein, 30 aa, Entamoeba histolytica
NFNEKCPYCSSILRKGEYYRFYQFDSLVSF

SEQ ID NO: 2689443 - protein, 26 aa, Entamoeba histolytica
NFPESNGRYIVKFGTLEVVGQYIDAN

SEQ ID NO: 2689444 - protein, 18 aa, Entamoeba histolytica
NFRHTIDLIKTLKYPHKF

SEQ ID NO: 2689445 - protein, 25 aa, Entamoeba histolytica
NFSEFLRNIFKPCFEATLHPEQHPN

SEQ ID NO: 2689446 - protein, 20 aa, Entamoeba histolytica
NFSKEILDSLLLSDSPAEEY

SEQ ID NO: 2689447 - protein, 24 aa, Entamoeba histolytica
NFSKFPFYFEVGGNIAQEIGDVEL

SEQ ID NO: 2689448 - protein, 20 aa, Entamoeba histolytica
NFSNPNCQEAMELFFRHGVN

SEQ ID NO: 2689449 - protein, 17 aa, Entamoeba histolytica
NFSYYFGDTTLYYYCVE

SEQ ID NO: 2689450 - protein, 24 aa, Entamoeba histolytica
NFTELKLLSFETIGSFNVDNLLFP

SEQ ID NO: 2689451 - protein, 28 aa, Entamoeba histolytica
NFTHKEIRLPFCIKILEILIEYLTDNEI

SEQ ID NO: 2689452 - protein, 24 aa, Entamoeba histolytica
NFTPKWAGLPSEVSYYIAHMHSAV

SEQ ID NO: 2689453 - protein, 18 aa, Entamoeba histolytica
NFTYVCLENVTIESCSID

SEQ ID NO: 2689454 - protein, 21 aa, Entamoeba histolytica
NFVACHFARILKKHLMTENNL

SEQ ID NO: 2689455 - protein, 24 aa, Entamoeba histolytica
NFVKCSLTTKVIEDMLFYKRYYEY

SEQ ID NO: 2689456 - protein, 18 aa, Entamoeba histolytica
NFVKTWENYFYKFLPPFP

SEQ ID NO: 2689457 - protein, 25 aa, Entamoeba histolytica
NFVNEFIRTNAFKEWQTKMEASGCI

SEQ ID NO: 2689458 - protein, 17 aa, Entamoeba histolytica
NFVTPRVLYFTNSFERF

SEQ ID NO: 2689459 - protein, 26 aa, Entamoeba histolytica
NFYKCNCFRDGESMSNHLTDFLKRVI

SEQ ID NO: 2689460 - protein, 20 aa, Entamoeba histolytica
NFYLSLLFLKYAQLFTPQYG

SEQ ID NO: 2689461 - protein, 41 aa, Entamoeba histolytica
NFYMDAISLITSWKHKPWICCFCKQVCYWEDVELNIRLQEI

SEQ ID NO: 2689462 - protein, 25 aa, Entamoeba histolytica
NFYRSCVGYCVASYVLGLADRHNDN

SEQ ID NO: 2689463 - protein, 24 aa, Entamoeba histolytica
NGCNGCKNPDILEAAKIFREAGIN

SEQ ID NO: 2689464 - protein, 19 aa, Entamoeba histolytica
NGDCCLGTIDSYGNTLLHY

SEQ ID NO: 2689465 - protein, 22 aa, Entamoeba histolytica
NGEIICKIFLELIDAIVILHKN

SEQ ID NO: 2689466 - protein, 24 aa, Entamoeba histolytica
NGENRGCILFCEVALGKQWETPKD

SEQ ID NO: 2689467 - protein, 25 aa, Entamoeba histolytica
NGEPCTLETVPFDVCVTDPDDEELE

SEQ ID NO: 2689468 - protein, 25 aa, Entamoeba histolytica
NGETHCKVSVYLRNRGEGAMDKEKY

SEQ ID NO: 2689469 - protein, 22 aa, Entamoeba histolytica
NGETMYKLVGIVIHNGDAHGGH

SEQ ID NO: 2689470 - protein, 19 aa, Entamoeba histolytica
NGFLHFLIDCAIEAHLEAY

SEQ ID NO: 2689471 - protein, 23 aa, Entamoeba histolytica
NGFPLCLLDGSTLTSIRTGGIGG

SEQ ID NO: 2689472 - protein, 17 aa, Entamoeba histolytica
NGFSIFAPKGRKLPITF

SEQ ID NO: 2689473 - protein, 23 aa, Entamoeba histolytica
NGGELFHRLDLEECINEEQTKFY

SEQ ID NO: 2689474 - protein, 25 aa, Entamoeba histolytica
NGGIIFDNYHIFKFKSIQKDEHICI

SEQ ID NO: 2689475 - protein, 28 aa, Entamoeba histolytica
NGGKIVGCIMSSYLLEKSRVVYQAREDR

SEQ ID NO: 2689476 - protein, 24 aa, Entamoeba histolytica
NGHCKLTDFGLCITVNEWEHEKIK

SEQ ID NO: 2689477 - protein, 17 aa, Entamoeba histolytica
NGHYLCHIIKKYHLKSV

SEQ ID NO: 2689478 - protein, 18 aa, Entamoeba histolytica
NGICECTILETSAKTSFN

SEQ ID NO: 2689479 - protein, 19 aa, Entamoeba histolytica
NGIEFFIDMVGILFTLIPY

SEQ ID NO: 2689480 - protein, 31 aa, Entamoeba histolytica
NGIEFIAPDCGICLLKDSIFAFGSFDKNISV

SEQ ID NO: 2689481 - protein, 23 aa, Entamoeba histolytica
NGIFPNEYVDLYFTIIKHSYSTF

SEQ ID NO: 2689482 - protein, 24 aa, Entamoeba histolytica
NGIGEIKALLAISIISLDSYYLSL

SEQ ID NO: 2689483 - protein, 19 aa, Entamoeba histolytica
NGIHYIEFLVELISSIPNN

SEQ ID NO: 2689484 - protein, 22 aa, Entamoeba histolytica
NGIIKIKFRCPNGKSVIHEFYP

SEQ ID NO: 2689485 - protein, 21 aa, Entamoeba histolytica
NGIKAIITCGTYLKKFKDTFS

SEQ ID NO: 2689486 - protein, 24 aa, Entamoeba histolytica
NGIKEYKLEISYIQYCILMKLHDN

SEQ ID NO: 2689487 - protein, 19 aa, Entamoeba histolytica
NGILYFCKGTTIEETTALL

SEQ ID NO: 2689488 - protein, 17 aa, Entamoeba histolytica
NGINCLHGGDGFDKKVF

SEQ ID NO: 2689489 - protein, 17 aa, Entamoeba histolytica
NGIPFSVHGCDPGWISV

SEQ ID NO: 2689490 - protein, 18 aa, Entamoeba histolytica
NGIPFSVHGCDPGWISVD

SEQ ID NO: 2689491 - protein, 18 aa, Entamoeba histolytica
NGIPKYWQIESIEIDGMK

SEQ ID NO: 2689492 - protein, 17 aa, Entamoeba histolytica
NGISVVHRTEALKKISP

SEQ ID NO: 2689493 - protein, 19 aa, Entamoeba histolytica
NGIVIPFQLAPVSSTIPSL

SEQ ID NO: 2689494 - protein, 21 aa, Entamoeba histolytica
NGKDSKWAWNNYVNQRALKQA

SEQ ID NO: 2689495 - protein, 23 aa, Entamoeba histolytica
NGKDTCIISVRFPNGKKIQRRFN

SEQ ID NO: 2689496 - protein, 22 aa, Entamoeba histolytica
NGKEFCATLVRLPCVVETHKSY

SEQ ID NO: 2689497 - protein, 17 aa, Entamoeba histolytica
NGKEIVGEWKLISTRTI

SEQ ID NO: 2689498 - protein, 21 aa, Entamoeba histolytica
NGKEVLCLKLHLNTISYLSII

SEQ ID NO: 2689499 - protein, 24 aa, Entamoeba histolytica
NGKFMPAIGLGTWLAAPGEVGKAV

SEQ ID NO: 2689500 - protein, 20 aa, Entamoeba histolytica
NGKHPVVWEEVFKKGNADKN

SEQ ID NO: 2689501 - protein, 20 aa, Entamoeba histolytica
NGKHPVVWEEVFKKGNDDKN

SEQ ID NO: 2689502 - protein, 25 aa, Entamoeba histolytica
NGKIQCLLCGLWVSENKLKIHQSQC

SEQ ID NO: 2689503 - protein, 30 aa, Entamoeba histolytica
NGKKKICDIFLEYNCCELLDEISVLRELNH

SEQ ID NO: 2689504 - protein, 21 aa, Entamoeba histolytica
NGKKKNVIIIFEFSLLDNVLM

SEQ ID NO: 2689505 - protein, 22 aa, Entamoeba histolytica
NGKLELKNCFKIEPKEDHLTFT

SEQ ID NO: 2689506 - protein, 27 aa, Entamoeba histolytica
NGKLEPRFIFEGEIFLAAGEKALLVPI

SEQ ID NO: 2689507 - protein, 25 aa, Entamoeba histolytica
NGKLQILEVLPFIKQKFEPNYIPYK

SEQ ID NO: 2689508 - protein, 19 aa, Entamoeba histolytica
NGKLWGVLTIYKLFDGESM

SEQ ID NO: 2689509 - protein, 24 aa, Entamoeba histolytica
NGKNNICPVCDVLMNGADYMNVTC

SEQ ID NO: 2689510 - protein, 22 aa, Entamoeba histolytica
NGKPDVVFILGFSHSSRFDCAA

SEQ ID NO: 2689511 - protein, 17 aa, Entamoeba histolytica
NGKTINPPVIWKVKNKR

SEQ ID NO: 2689512 - protein, 21 aa, Entamoeba histolytica
NGKVLELMEWVSIKEIAEIHN

SEQ ID NO: 2689513 - protein, 21 aa, Entamoeba histolytica
NGKWWKCNDKVVVEYNEKRIL

SEQ ID NO: 2689514 - protein, 18 aa, Entamoeba histolytica
NGKYCGIDVPEVYVIHSL

SEQ ID NO: 2689515 - protein, 18 aa, Entamoeba histolytica
NGLARLLIKEKLDEENYR

SEQ ID NO: 2689516 - protein, 26 aa, Entamoeba histolytica
NGLFLLGELLKYFGTQTHSYQLFNCC

SEQ ID NO: 2689517 - protein, 19 aa, Entamoeba histolytica
NGLICPEKNNFSIQLPRKY

SEQ ID NO: 2689518 - protein, 25 aa, Entamoeba histolytica
NGLKAWKLAKPLAEKGKEFDSQTKY

SEQ ID NO: 2689519 - protein, 17 aa, Entamoeba histolytica
NGLKKSFLVNTFMPSKA

SEQ ID NO: 2689520 - protein, 29 aa, Entamoeba histolytica
NGLLTQMIWKEILRNSVMMGANIQKFVYL

SEQ ID NO: 2689521 - protein, 17 aa, Entamoeba histolytica
NGLLYGFDQHAVHERIL

SEQ ID NO: 2689522 - protein, 23 aa, Entamoeba histolytica
NGLNKREVEVICQRMFKRDRKTG

SEQ ID NO: 2689523 - protein, 31 aa, Entamoeba histolytica
NGLPILMYRVKWLGKELFLSDELSSFFEKER

SEQ ID NO: 2689524 - protein, 20 aa, Entamoeba histolytica
NGLQRLPIDLTKLTNLNICD

SEQ ID NO: 2689525 - protein, 21 aa, Entamoeba histolytica
NGLSKEFLWTFILNNDTEYDE

SEQ ID NO: 2689526 - protein, 25 aa, Entamoeba histolytica
NGLSSFCVKGALTLLNNEITPIFVF

SEQ ID NO: 2689527 - protein, 23 aa, Entamoeba histolytica
NGLTDICAFNLFSNLQVIDLSNN

SEQ ID NO: 2689528 - protein, 27 aa, Entamoeba histolytica
NGLTYKGCGFHRVIKDFMIQGGDFTRH

SEQ ID NO: 2689529 - protein, 43 aa, Entamoeba histolytica
NGLVKRFEECWTLDKSCIYNDCLYPRQQLHLYPFLEKIVPAKL

SEQ ID NO: 2689530 - protein, 24 aa, Entamoeba histolytica
NGLYGIRITDDFRYIIINEGDLKQ

SEQ ID NO: 2689531 - protein, 23 aa, Entamoeba histolytica
NGMEYDCIAAIYKRNNVLYSTRL

SEQ ID NO: 2689532 - protein, 22 aa, Entamoeba histolytica
NGMGGAGGFPGGGFSFGGVDPM

SEQ ID NO: 2689533 - protein, 17 aa, Entamoeba histolytica
NGMISFNFCAKNLYNFD

SEQ ID NO: 2689534 - protein, 17 aa, Entamoeba histolytica
NGMIYWLTTGALKITQS

SEQ ID NO: 2689535 - protein, 21 aa, Entamoeba histolytica
NGMKEIGCIFGNTTQPNVIYH

SEQ ID NO: 2689536 - protein, 17 aa, Entamoeba histolytica
NGMKLVMNMVIKSINDF

SEQ ID NO: 2689537 - protein, 21 aa, Entamoeba histolytica
NGNESYKMIFGNYYHDKCVHC

SEQ ID NO: 2689538 - protein, 28 aa, Entamoeba histolytica
NGNLKISIPFIPKRLGNVNIQQINIYLS

SEQ ID NO: 2689539 - protein, 22 aa, Entamoeba histolytica
NGNLKQSHLFAMDKGVLSLFLT

SEQ ID NO: 2689540 - protein, 18 aa, Entamoeba histolytica
NGNLRSQIFSNIHDFIIL

SEQ ID NO: 2689541 - protein, 18 aa, Entamoeba histolytica
NGNQKFVMFSCKNEWLFT

SEQ ID NO: 2689542 - protein, 17 aa, Entamoeba histolytica
NGNRFKIGMTYTSNGWY

SEQ ID NO: 2689543 - protein, 26 aa, Entamoeba histolytica
NGNSDFKYLLGLLFQIYMNHHKSNLL

SEQ ID NO: 2689544 - protein, 24 aa, Entamoeba histolytica
NGNSYPINFGYIYPINDNVTLDYV

SEQ ID NO: 2689545 - protein, 25 aa, Entamoeba histolytica
NGNSYPINFGYIYPINDNVTLDYVS

SEQ ID NO: 2689546 - protein, 24 aa, Entamoeba histolytica
NGNYKCPLCQITLTEDDISRNDST

SEQ ID NO: 2689547 - protein, 19 aa, Entamoeba histolytica
NGPIVWKWGNDSIKQLNKF

SEQ ID NO: 2689548 - protein, 17 aa, Entamoeba histolytica
NGPKLYYWCIFKPKNKD

SEQ ID NO: 2689549 - protein, 21 aa, Entamoeba histolytica
NGPTHLEWYYLVKVHNKIQRI

SEQ ID NO: 2689550 - protein, 23 aa, Entamoeba histolytica
NGQSKGCCFIEFEDKKGAERACS

SEQ ID NO: 2689551 - protein, 23 aa, Entamoeba histolytica
NGQYYWKFGKYAVKSIRDLTVGI

SEQ ID NO: 2689552 - protein, 25 aa, Entamoeba histolytica
NGRSRRGLILFNDCILLTKKEEKLM

SEQ ID NO: 2689553 - protein, 20 aa, Entamoeba histolytica
NGRVYYCFIEAYISMSYLTN

SEQ ID NO: 2689554 - protein, 28 aa, Entamoeba histolytica
NGSHPFIKCCLELGILEYLIDYLKDNQT

SEQ ID NO: 2689555 - protein, 20 aa, Entamoeba histolytica
NGSLPMEITIGISQNQSTFQ

SEQ ID NO: 2689556 - protein, 24 aa, Entamoeba histolytica
NGSYKAAGIKVCISGINGKGIGCG

SEQ ID NO: 2689557 - protein, 18 aa, Entamoeba histolytica
NGTLSYNSYRCMQSDCEQ

SEQ ID NO: 2689558 - protein, 31 aa, Entamoeba histolytica
NGTMIIRIELPFGIWCDGCKNLIGKGTRFNA

SEQ ID NO: 2689559 - protein, 25 aa, Entamoeba histolytica
NGVELCALLEIIGETTIKCVTNPKM

SEQ ID NO: 2689560 - protein, 21 aa, Entamoeba histolytica
NGVEVPVHFPVKGMNNSVVEV

SEQ ID NO: 2689561 - protein, 23 aa, Entamoeba histolytica
NGVGICYELHPIVVLLKGRKIHG

SEQ ID NO: 2689562 - protein, 18 aa, Entamoeba histolytica
NGVKCGDCGCVLAGIRHI

SEQ ID NO: 2689563 - protein, 30 aa, Entamoeba histolytica
NGVNKRGCDRCMKKALAMNKIIIDDDISKR

SEQ ID NO: 2689564 - protein, 27 aa, Entamoeba histolytica
NGVNLRISSPVKRIQKLALILINEMEI

SEQ ID NO: 2689565 - protein, 18 aa, Entamoeba histolytica
NGWAYCQVGYRFGYVPIK

SEQ ID NO: 2689566 - protein, 20 aa, Entamoeba histolytica
NGWSGYRGGLDVKTGTTGVN

SEQ ID NO: 2689567 - protein, 18 aa, Entamoeba histolytica
NGYCKKGGSCTFSHDVSS

SEQ ID NO: 2689568 - protein, 20 aa, Entamoeba histolytica
NGYFKPKWFEINKLEWYKYN

SEQ ID NO: 2689569 - protein, 17 aa, Entamoeba histolytica
NGYFPTIIEILRDPRPL

SEQ ID NO: 2689570 - protein, 24 aa, Entamoeba histolytica
NGYFSLKYDVHWFIVDHWYLFSQL

SEQ ID NO: 2689571 - protein, 17 aa, Entamoeba histolytica
NGYGAKLANIFSTKFSI

SEQ ID NO: 2689572 - protein, 22 aa, Entamoeba histolytica
NGYILQPTCEVIYIEKYEKYND

SEQ ID NO: 2689573 - protein, 17 aa, Entamoeba histolytica
NGYMGFGAVEPMGGNIY

SEQ ID NO: 2689574 - protein, 18 aa, Entamoeba histolytica
NGYNHCIGSVYFTKFEKM

SEQ ID NO: 2689575 - protein, 22 aa, Entamoeba histolytica
NGYPSFPTMRIAIMSQDNQVSA

SEQ ID NO: 2689576 - protein, 22 aa, Entamoeba histolytica
NGYRLIDCARFYKNEKEIGEMG

SEQ ID NO: 2689577 - protein, 21 aa, Entamoeba histolytica
NGYTIKFYYSGMFMEGLMSEI

SEQ ID NO: 2689578 - protein, 23 aa, Entamoeba histolytica
NGYVCINCTQVVFLNTICAPQTI

SEQ ID NO: 2689579 - protein, 20 aa, Entamoeba histolytica
NHATIIFKKPVKRRCKYFNS

SEQ ID NO: 2689580 - protein, 24 aa, Entamoeba histolytica
NHETRLMCEYMTFLLECNNKYNMK

SEQ ID NO: 2689581 - protein, 29 aa, Entamoeba histolytica
NHFECPICGFCYCELPIQCKICNAILLLS

SEQ ID NO: 2689582 - protein, 22 aa, Entamoeba histolytica
NHFEMIRLNLIIIEKPADEDAV

SEQ ID NO: 2689583 - protein, 20 aa, Entamoeba histolytica
NHFGVGIAFIRKSRSFEDTH

SEQ ID NO: 2689584 - protein, 30 aa, Entamoeba histolytica
NHFHVPVYVCTGAYKICPNFPTNSNGFSLI

SEQ ID NO: 2689585 - protein, 17 aa, Entamoeba histolytica
NHFIFRRFYSVSKSLKI

SEQ ID NO: 2689586 - protein, 17 aa, Entamoeba histolytica
NHFLFAFDNTEDLSGHP

SEQ ID NO: 2689587 - protein, 27 aa, Entamoeba histolytica
NHIQIHLRLLFALNFKEGCDPLPQTYL

SEQ ID NO: 2689588 - protein, 18 aa, Entamoeba histolytica
NHKACTFQCSCCKDKTHI

SEQ ID NO: 2689589 - protein, 26 aa, Entamoeba histolytica
NHKQEHPFELTICGVGPSLKKYIDKH

SEQ ID NO: 2689590 - protein, 23 aa, Entamoeba histolytica
NHKRFGLMCSYLIEKLSKYELLN

SEQ ID NO: 2689591 - protein, 24 aa, Entamoeba histolytica
NHLAKFPLIVLCKKGIHVITTQSN

SEQ ID NO: 2689592 - protein, 26 aa, Entamoeba histolytica
NHLECTLFLLTCGINNLIAAQTRIEN

SEQ ID NO: 2689593 - protein, 20 aa, Entamoeba histolytica
NHLFFNFYNLCSLELPNSIV

SEQ ID NO: 2689594 - protein, 20 aa, Entamoeba histolytica
NHLKRFCKSIKLTSLTEINL

SEQ ID NO: 2689595 - protein, 25 aa, Entamoeba histolytica
NHLLIDILREFGYSFSTKVTDGKNG

SEQ ID NO: 2689596 - protein, 17 aa, Entamoeba histolytica
NHLLWKTWDSVLELAIP

SEQ ID NO: 2689597 - protein, 21 aa, Entamoeba histolytica
NHLLYRIKYYVPYYYYLENKK

SEQ ID NO: 2689598 - protein, 18 aa, Entamoeba histolytica
NHLTDFLKRVIVEHPELV

SEQ ID NO: 2689599 - protein, 18 aa, Entamoeba histolytica
NHLVPELIERGGDESLLF

SEQ ID NO: 2689600 - protein, 19 aa, Entamoeba histolytica
NHMETMKILLLQYFQCYTE

SEQ ID NO: 2689601 - protein, 23 aa, Entamoeba histolytica
NHPNILKLFGFFEDIKRWFLVLE

SEQ ID NO: 2689602 - protein, 22 aa, Entamoeba histolytica
NHQPEGRYCIIREGSYLKVINS

SEQ ID NO: 2689603 - protein, 17 aa, Entamoeba histolytica
NHQTAWLRKHLFRPNIL

SEQ ID NO: 2689604 - protein, 17 aa, Entamoeba histolytica
NHVKQFIGLAEFGGNNM

SEQ ID NO: 2689605 - protein, 24 aa, Entamoeba histolytica
NHYRSFSFNNFDVLFDIVVDSTKT

SEQ ID NO: 2689606 - protein, 22 aa, Entamoeba histolytica
NIADFPFGVGAVRVAFHGFDMD

SEQ ID NO: 2689607 - protein, 24 aa, Entamoeba histolytica
NIAPDYWLIGSLLMVALVNSVEGR

SEQ ID NO: 2689608 - protein, 17 aa, Entamoeba histolytica
NIAVCLTPSLLTFDDTD

SEQ ID NO: 2689609 - protein, 19 aa, Entamoeba histolytica
NICGRVCPHYCQGKCVKAR

SEQ ID NO: 2689610 - protein, 19 aa, Entamoeba histolytica
NICHDPCHCPHGIKDGEEV

SEQ ID NO: 2689611 - protein, 21 aa, Entamoeba histolytica
NICPICKYQINHFLPHQNEFK

SEQ ID NO: 2689612 - protein, 26 aa, Entamoeba histolytica
NIDDYRIEICKNLPPFMFEEDEDDFG

SEQ ID NO: 2689613 - protein, 26 aa, Entamoeba histolytica
NIDEEFARRLTVRKVSTGFSEEKKET

SEQ ID NO: 2689614 - protein, 21 aa, Entamoeba histolytica
NIDGTSCIFVIISIIITFSFF

SEQ ID NO: 2689615 - protein, 21 aa, Entamoeba histolytica
NIDNASSIFILLSTFTLTLLF

SEQ ID NO: 2689616 - protein, 26 aa, Entamoeba histolytica
NIDSNIFLKWKHRGNKTMWIPTPVCT

SEQ ID NO: 2689617 - protein, 24 aa, Entamoeba histolytica
NIDTQRWFECSNFDCPKNELRFGY

SEQ ID NO: 2689618 - protein, 21 aa, Entamoeba histolytica
NIEGFLVLIQREWVEMGHRFP

SEQ ID NO: 2689619 - protein, 23 aa, Entamoeba histolytica
NIEGKRIVSGVIDLAQHAGLDGS

SEQ ID NO: 2689620 - protein, 23 aa, Entamoeba histolytica
NIEKFKYIISYWIEHFSSDFTTQ

SEQ ID NO: 2689621 - protein, 21 aa, Entamoeba histolytica
NIELCSGYGEWLITKAEEKKD

SEQ ID NO: 2689622 - protein, 18 aa, Entamoeba histolytica
NIELEKESKVVVRKCQNI

SEQ ID NO: 2689623 - protein, 32 aa, Entamoeba histolytica
NIELPKHFLCFRFIKTPDLIELHWSKKHYDNE

SEQ ID NO: 2689624 - protein, 35 aa, Entamoeba histolytica
NIEPEFKSPIYIDAFKLSMPYLFDKLQTACDQLMI

SEQ ID NO: 2689625 - protein, 23 aa, Entamoeba histolytica
NIEYPLFPGENIISIIPETIHLH

SEQ ID NO: 2689626 - protein, 20 aa, Entamoeba histolytica
NIFPLYKWTTSIVNFSENIL

SEQ ID NO: 2689627 - protein, 24 aa, Entamoeba histolytica
NIGCTPLPLCVRINQKSKYRDLLK

SEQ ID NO: 2689628 - protein, 22 aa, Entamoeba histolytica
NIGLFPQFGFEVTFREDKEATQ

SEQ ID NO: 2689629 - protein, 19 aa, Entamoeba histolytica
NIGPFECFSTFVRKGVVFI

SEQ ID NO: 2689630 - protein, 24 aa, Entamoeba histolytica
NIGRCYICGIGGLEYVDEKYDFWK

SEQ ID NO: 2689631 - protein, 25 aa, Entamoeba histolytica
NIHKLYKLYCFEGHTAIQQLQEKQT

SEQ ID NO: 2689632 - protein, 24 aa, Entamoeba histolytica
NIHTEYQWQVSIFNNAQRKVLDEL

SEQ ID NO: 2689633 - protein, 19 aa, Entamoeba histolytica
NIHYELFGIIINKFINNDI

SEQ ID NO: 2689634 - protein, 26 aa, Entamoeba histolytica
NIIAYKRLGFKVVLCGHLDTVNIGSG

SEQ ID NO: 2689635 - protein, 19 aa, Entamoeba histolytica
NIICPKSLLQIQIDVSSYC

SEQ ID NO: 2689636 - protein, 19 aa, Entamoeba histolytica
NIIDVRSCFSRGHHFDLKK

SEQ ID NO: 2689637 - protein, 25 aa, Entamoeba histolytica
NIIERPVPDFPYRYNMPPIMMSHFY

SEQ ID NO: 2689638 - protein, 17 aa, Entamoeba histolytica
NIIIRIVEMMGGDVSKM

SEQ ID NO: 2689639 - protein, 23 aa, Entamoeba histolytica
NIIKEIQSAMLFSQEDINALNTI

SEQ ID NO: 2689640 - protein, 27 aa, Entamoeba histolytica
NIIKIYNCFFCYFNGSLQFWIVMEKCT

SEQ ID NO: 2689641 - protein, 23 aa, Entamoeba histolytica
NIILENMYQLWILAELDLFDPQH

SEQ ID NO: 2689642 - protein, 24 aa, Entamoeba histolytica
NIINKLCENCYAILYLTESQRKEV

SEQ ID NO: 2689643 - protein, 25 aa, Entamoeba histolytica
NIIPILCYHFYFQVYPIHPEYTYAH

SEQ ID NO: 2689644 - protein, 25 aa, Entamoeba histolytica
NIIQPRKTVGVGIGGMGMPQVTLAD

SEQ ID NO: 2689645 - protein, 17 aa, Entamoeba histolytica
NIIQWLFFGIPFTKDTI

SEQ ID NO: 2689646 - protein, 17 aa, Entamoeba histolytica
NIIRYDAIQDFLFHSLK

SEQ ID NO: 2689647 - protein, 20 aa, Entamoeba histolytica
NIISGLKFIPSKNINSLLPF

SEQ ID NO: 2689648 - protein, 23 aa, Entamoeba histolytica
NIISIIQMIEWYYQGLLNTITPF

SEQ ID NO: 2689649 - protein, 25 aa, Entamoeba histolytica
NIISPLIFCLPCNRLCIVSLKTEYY

SEQ ID NO: 2689650 - protein, 22 aa, Entamoeba histolytica
NIIVCGYKHFSMIWDVAGGGAF

SEQ ID NO: 2689651 - protein, 24 aa, Entamoeba histolytica
NIIYPKYLQYLSVATLKKRMYYSY

SEQ ID NO: 2689652 - protein, 22 aa, Entamoeba histolytica
NIKADALTGLLLSKKDVITLKD

SEQ ID NO: 2689653 - protein, 23 aa, Entamoeba histolytica
NIKEIKEEFNVGVDNILDSYIEI

SEQ ID NO: 2689654 - protein, 20 aa, Entamoeba histolytica
NIKICSMIKLEIESQNKQNI

SEQ ID NO: 2689655 - protein, 25 aa, Entamoeba histolytica
NIKIDDVSCLLSFDSIEKCKEWSQT

SEQ ID NO: 2689656 - protein, 20 aa, Entamoeba histolytica
NIKIKERVIFTIKGSGFGTS

SEQ ID NO: 2689657 - protein, 25 aa, Entamoeba histolytica
NIKIVASALLCLSIYAAELKTSLMP

SEQ ID NO: 2689658 - protein, 27 aa, Entamoeba histolytica
NIKKEWWFPLACSISGTEFRNLQNWFI

SEQ ID NO: 2689659 - protein, 27 aa, Entamoeba histolytica
NIKKNIKIENIVNAWSIINKAKDSMQI

SEQ ID NO: 2689660 - protein, 24 aa, Entamoeba histolytica
NIKKYAKEFTRFFSYSKKKPNFNV

SEQ ID NO: 2689661 - protein, 25 aa, Entamoeba histolytica
NIKLIDFGSACFENFTMNTYIQSRH

SEQ ID NO: 2689662 - protein, 25 aa, Entamoeba histolytica
NIKLIDFGSACFENSTLYSYIQSRH

SEQ ID NO: 2689663 - protein, 19 aa, Entamoeba histolytica
NIKPILIIYCEFSQKRGPL

SEQ ID NO: 2689664 - protein, 19 aa, Entamoeba histolytica
NILDLLKMVTAFMLEHKIL

SEQ ID NO: 2689665 - protein, 22 aa, Entamoeba histolytica
NILFKGRSKLVIGGALVAGGYS

SEQ ID NO: 2689666 - protein, 29 aa, Entamoeba histolytica
NILGTFVYKCECCQAILCGDCVKKRKYQK

SEQ ID NO: 2689667 - protein, 25 aa, Entamoeba histolytica
NILKDLKDGLVLIRLLRNLSGCDIP

SEQ ID NO: 2689668 - protein, 19 aa, Entamoeba histolytica
NILKLKSPIIVVGDIHGNF

SEQ ID NO: 2689669 - protein, 18 aa, Entamoeba histolytica
NILLIGFKHLEVIDLDVI

SEQ ID NO: 2689670 - protein, 17 aa, Entamoeba histolytica
NILNEFFDKPSEYFQTE

SEQ ID NO: 2689671 - protein, 18 aa, Entamoeba histolytica
NILPGWKDGTKIRFEGYG

SEQ ID NO: 2689672 - protein, 19 aa, Entamoeba histolytica
NILQFWRKHFTTYENFFEV

SEQ ID NO: 2689673 - protein, 23 aa, Entamoeba histolytica
NILRSGEISLHLKSFNKADFSSV

SEQ ID NO: 2689674 - protein, 20 aa, Entamoeba histolytica
NILRYCSFGSDKIERIELTK

SEQ ID NO: 2689675 - protein, 22 aa, Entamoeba histolytica
NILSYDICILINKFNDERKNFI

SEQ ID NO: 2689676 - protein, 23 aa, Entamoeba histolytica
NILTLIDCLKFPPEEPNTIDSLK

SEQ ID NO: 2689677 - protein, 18 aa, Entamoeba histolytica
NIMGKWSVYEKMIELKII

SEQ ID NO: 2689678 - protein, 17 aa, Entamoeba histolytica
NIMKLEEKWKYRKIPLP

SEQ ID NO: 2689679 - protein, 24 aa, Entamoeba histolytica
NINDIPSLIGIISHETMWQEQTEF

SEQ ID NO: 2689680 - protein, 23 aa, Entamoeba histolytica
NINEFRLVAIPNRNIEMNEMTVM

SEQ ID NO: 2689681 - protein, 17 aa, Entamoeba histolytica
NINELKNELIIIEQKLK

SEQ ID NO: 2689682 - protein, 25 aa, Entamoeba histolytica
NINFDISFNTCFTIDQEEWCVAVKQ

SEQ ID NO: 2689683 - protein, 24 aa, Entamoeba histolytica
NINGKKICSGVIDLAQFADLDGKT

SEQ ID NO: 2689684 - protein, 18 aa, Entamoeba histolytica
NINHLVEMGFLRDDAIKA

SEQ ID NO: 2689685 - protein, 18 aa, Entamoeba histolytica
NINIITGIFISHLFDENG

SEQ ID NO: 2689686 - protein, 23 aa, Entamoeba histolytica
NINIRYIPISGLSGENLIKPTTS

SEQ ID NO: 2689687 - protein, 18 aa, Entamoeba histolytica
NINKGLMCLIDLIQHKEN

SEQ ID NO: 2689688 - protein, 25 aa, Entamoeba histolytica
NINLLICCIDLFTPSSLIKGKLSYT

SEQ ID NO: 2689689 - protein, 18 aa, Entamoeba histolytica
NINLPKTHIVLHKFMHEL

SEQ ID NO: 2689690 - protein, 24 aa, Entamoeba histolytica
NINRFFPDINITFLLDRPTTVPLQ

SEQ ID NO: 2689691 - protein, 25 aa, Entamoeba histolytica
NINRLEIFWEQFLLSVLSFCLKENG

SEQ ID NO: 2689692 - protein, 18 aa, Entamoeba histolytica
NINSFVWEQHEVCVQLIV

SEQ ID NO: 2689693 - protein, 23 aa, Entamoeba histolytica
NIPESIKILSPRSLCENSLHSLI

SEQ ID NO: 2689694 - protein, 36 aa, Entamoeba histolytica
NIPFLKELISFPIDKIVLVFLCDLEMEKVYNAFPYF

SEQ ID NO: 2689695 - protein, 24 aa, Entamoeba histolytica
NIPIECGQLILTNIVQLPAEMNRP

SEQ ID NO: 2689696 - protein, 18 aa, Entamoeba histolytica
NIPKHIYANTSFKIQFDI

SEQ ID NO: 2689697 - protein, 21 aa, Entamoeba histolytica
NIPKNWRKVIQRIKNTAKQGV

SEQ ID NO: 2689698 - protein, 24 aa, Entamoeba histolytica
NIPMDLRVPYPFPKLQEFYNSIDI

SEQ ID NO: 2689699 - protein, 23 aa, Entamoeba histolytica
NIPMSCFYQCPLLKTLKIKNKTM

SEQ ID NO: 2689700 - protein, 17 aa, Entamoeba histolytica
NIPRDVSFLDISLNKLD

SEQ ID NO: 2689701 - protein, 18 aa, Entamoeba histolytica
NIPRLCVNASPTKPLSPR

SEQ ID NO: 2689702 - protein, 18 aa, Entamoeba histolytica
NIPYWIWDEHLEKNEEPI

SEQ ID NO: 2689703 - protein, 18 aa, Entamoeba histolytica
NIQHFKNCRDSMDNYWVK

SEQ ID NO: 2689704 - protein, 28 aa, Entamoeba histolytica
NIQKYIILCVLLRSIHPVYIEMTNALFK

SEQ ID NO: 2689705 - protein, 18 aa, Entamoeba histolytica
NIQLPKFDFNVVVFSNSS

SEQ ID NO: 2689706 - protein, 23 aa, Entamoeba histolytica
NIQRIQYGYLFTLQCLNNISINE

SEQ ID NO: 2689707 - protein, 17 aa, Entamoeba histolytica
NIQTCVGNLLQPKQKEE

SEQ ID NO: 2689708 - protein, 24 aa, Entamoeba histolytica
NIQYKFFIKCIQIASSKLNGFIEL

SEQ ID NO: 2689709 - protein, 26 aa, Entamoeba histolytica
NIREIFKKLCFIASQKKNGVGILMEM

SEQ ID NO: 2689710 - protein, 20 aa, Entamoeba histolytica
NIRIRWKTKRPVIRKRIEAF

SEQ ID NO: 2689711 - protein, 28 aa, Entamoeba histolytica
NIRQDICYACLPLEFLKKEEYLTLAMTK

SEQ ID NO: 2689712 - protein, 20 aa, Entamoeba histolytica
NIRTGDGFIIIYSITSLTSF

SEQ ID NO: 2689713 - protein, 18 aa, Entamoeba histolytica
NISERGGMDGGWFMLTEH

SEQ ID NO: 2689714 - protein, 25 aa, Entamoeba histolytica
NISFLRFFSIVAILNCENLKDYEIK

SEQ ID NO: 2689715 - protein, 20 aa, Entamoeba histolytica
NISIDLNRLTAIEKYTVEEL

SEQ ID NO: 2689716 - protein, 22 aa, Entamoeba histolytica
NISKGFKIEYSKVLGQVNITDM

SEQ ID NO: 2689717 - protein, 30 aa, Entamoeba histolytica
NISLPIVLCGGDWFIGLFVRQLSSINQRKK

SEQ ID NO: 2689718 - protein, 23 aa, Entamoeba histolytica
NISMFIHSIVLWKVSNTDSDTIE

SEQ ID NO: 2689719 - protein, 32 aa, Entamoeba histolytica
NISQRWLPEIKHFCPNAPFLLAATKTDLRDSE

SEQ ID NO: 2689720 - protein, 24 aa, Entamoeba histolytica
NISRCGQCFELFGPSLKPFTCMIA

SEQ ID NO: 2689721 - protein, 19 aa, Entamoeba histolytica
NISRRCSHNTFIRYLQNSI

SEQ ID NO: 2689722 - protein, 29 aa, Entamoeba histolytica
NISTCKGARFYNCPTLKTLSIKEAEVVIL

SEQ ID NO: 2689723 - protein, 22 aa, Entamoeba histolytica
NITCDIYAFSMVIWQIFTQRLL

SEQ ID NO: 2689724 - protein, 18 aa, Entamoeba histolytica
NITECPLLDPSSLKQLTQ

SEQ ID NO: 2689725 - protein, 27 aa, Entamoeba histolytica
NITEIGSFCFKDCLSLQSIVLPSSITS

SEQ ID NO: 2689726 - protein, 27 aa, Entamoeba histolytica
NITFLFSVSNGFVFGCHFGQIPKTGQH

SEQ ID NO: 2689727 - protein, 22 aa, Entamoeba histolytica
NITGKERKDCVVHIKYGNVKYP

SEQ ID NO: 2689728 - protein, 17 aa, Entamoeba histolytica
NITGLSLIQTLPVNDTT

SEQ ID NO: 2689729 - protein, 23 aa, Entamoeba histolytica
NITISCIQWKLNKINQIPSQIEI

SEQ ID NO: 2689730 - protein, 18 aa, Entamoeba histolytica
NITLRLKLVDSYQTATSS

SEQ ID NO: 2689731 - protein, 23 aa, Entamoeba histolytica
NITQLSLFYAHYMKGPTLPKLYQ

SEQ ID NO: 2689732 - protein, 31 aa, Entamoeba histolytica
NITSCSLHKFKLFRCNELKTLIIPTTITMLA

SEQ ID NO: 2689733 - protein, 25 aa, Entamoeba histolytica
NITYGWWDLNRSDCWVAQMRDADSV

SEQ ID NO: 2689734 - protein, 32 aa, Entamoeba histolytica
NITYTFPLSTLMSWGTDSSKTFKNTSTDHKMY

SEQ ID NO: 2689735 - protein, 18 aa, Entamoeba histolytica
NIVCDIFNNKPTKAFTMT

SEQ ID NO: 2689736 - protein, 25 aa, Entamoeba histolytica
NIVCICERWSLIFSHHEKVIIIDNE

SEQ ID NO: 2689737 - protein, 24 aa, Entamoeba histolytica
NIVEGIFRIPGERQLADNMKKTIE

SEQ ID NO: 2689738 - protein, 18 aa, Entamoeba histolytica
NIVFYGSLFKFRKPVHLD

SEQ ID NO: 2689739 - protein, 24 aa, Entamoeba histolytica
NIVLCGGSSMFPGMKQRFIKEITV

SEQ ID NO: 2689740 - protein, 25 aa, Entamoeba histolytica
NIVLCGGSSMFPGMKQRFIKEITVL

SEQ ID NO: 2689741 - protein, 24 aa, Entamoeba histolytica
NIVLQPKFVKLLLAISLVRRHPLK

SEQ ID NO: 2689742 - protein, 24 aa, Entamoeba histolytica
NIVRFYGVIVKKQFSMVMEYCSKG

SEQ ID NO: 2689743 - protein, 18 aa, Entamoeba histolytica
NIVRRELTRIYTVSTATE

SEQ ID NO: 2689744 - protein, 17 aa, Entamoeba histolytica
NIYCISEGIIKNEVIYK

SEQ ID NO: 2689745 - protein, 19 aa, Entamoeba histolytica
NIYERSFINPGEMVGSIAA

SEQ ID NO: 2689746 - protein, 18 aa, Entamoeba histolytica
NIYGDGVMKIEPSTTVID

SEQ ID NO: 2689747 - protein, 25 aa, Entamoeba histolytica
NIYHHIPSIFGLMILFDTNGFPLCL

SEQ ID NO: 2689748 - protein, 17 aa, Entamoeba histolytica
NIYKDCAVFCIADGCGM

SEQ ID NO: 2689749 - protein, 23 aa, Entamoeba histolytica
NIYSHLKYLLILNLKDFLNSNAI

SEQ ID NO: 2689750 - protein, 19 aa, Entamoeba histolytica
NKACDCFELAIKLKDTEPL

SEQ ID NO: 2689751 - protein, 27 aa, Entamoeba histolytica
NKAEFDRLSGLFQRNFGGFRNEVKDIF

SEQ ID NO: 2689752 - protein, 22 aa, Entamoeba histolytica
NKAFRIPYRLIVKSHENRNKSD

SEQ ID NO: 2689753 - protein, 19 aa, Entamoeba histolytica
NKAKSLSIYGVSEMGYKPE

SEQ ID NO: 2689754 - protein, 30 aa, Entamoeba histolytica; identical to SEQ ID NO: 2497947

SEQ ID NO: 2689755 - protein, 26 aa, Entamoeba histolytica
NKARWKCFVCSCCEPAAMNRNVFIKK

SEQ ID NO: 2689756 - protein, 26 aa, Entamoeba histolytica
NKCDLVPTWATARWVKVLSKEFPTIA

SEQ ID NO: 2689757 - protein, 18 aa, Entamoeba histolytica
NKCFRNIIYHNNITLQMS

SEQ ID NO: 2689758 - protein, 17 aa, Entamoeba histolytica
NKCIGCLQCIRVCPTKV

SEQ ID NO: 2689759 - protein, 24 aa, Entamoeba histolytica
NKCNLKLIMCEGISESLQSESITS

SEQ ID NO: 2689760 - protein, 20 aa, Entamoeba histolytica
NKCPSYIPPHFKTILRKIYH

SEQ ID NO: 2689761 - protein, 18 aa, Entamoeba histolytica
NKDCPIFYMRVKVQHSIN

SEQ ID NO: 2689762 - protein, 22 aa, Entamoeba histolytica
NKDCPVCSINLKIDEYLPKEMA

SEQ ID NO: 2689763 - protein, 21 aa, Entamoeba histolytica
NKDECSFEQGGYFIIKGSEKV

SEQ ID NO: 2689764 - protein, 25 aa, Entamoeba histolytica
NKDEIIRFGALNAMIDIGKCDETKK

SEQ ID NO: 2689765 - protein, 32 aa, Entamoeba histolytica
NKDELLEWATVCYKAALEFVGNSSIQCNSLTV

SEQ ID NO: 2689766 - protein, 24 aa, Entamoeba histolytica
NKDENCGYCHIGVVANIISKELTK

SEQ ID NO: 2689767 - protein, 24 aa, Entamoeba histolytica
NKDFIPLFSCICGNDFTKSLSRKL

SEQ ID NO: 2689768 - protein, 30 aa, Entamoeba histolytica
NKDGSGYDCYGKWRRLSEDKIEITELPIQI

SEQ ID NO: 2689769 - protein, 22 aa, Entamoeba histolytica
NKDKDCILYVLKMINANSSRYA

SEQ ID NO: 2689770 - protein, 17 aa, Entamoeba histolytica
NKDNTFEGFTFVQTNAM

SEQ ID NO: 2689771 - protein, 24 aa, Entamoeba histolytica
NKDNYKYWHRWALINFEVVNYYEN

SEQ ID NO: 2689772 - protein, 26 aa, Entamoeba histolytica
NKDQKELWIQLAIELNYEERDDIAIK

SEQ ID NO: 2689773 - protein, 21 aa, Entamoeba histolytica
NKDSFNWVKTNFFKKFKQNDD

SEQ ID NO: 2689774 - protein, 24 aa, Entamoeba histolytica
NKECFKKIRIEDETVLYDVLFGGA

SEQ ID NO: 2689775 - protein, 24 aa, Entamoeba histolytica
NKECGGCLYQSMGYQHQLEMKKTQ

SEQ ID NO: 2689776 - protein, 18 aa, Entamoeba histolytica
NKEFKEQVCYRIGEMIRR

SEQ ID NO: 2689777 - protein, 23 aa, Entamoeba histolytica
NKEFNSLTSYVVYSSGKINKDVV

SEQ ID NO: 2689778 - protein, 25 aa, Entamoeba histolytica
NKEGQFYLGNAFVEFVSEAEKDKFI

SEQ ID NO: 2689779 - protein, 28 aa, Entamoeba histolytica
NKEGVCAKCKGKVHLRQGLLCEYCNTIL

SEQ ID NO: 2689780 - protein, 19 aa, Entamoeba histolytica
NKEIIPLTYDFERFNIKLG

SEQ ID NO: 2689781 - protein, 24 aa, Entamoeba histolytica
NKEIKRPLFKLSLETKQSNIQSTR

SEQ ID NO: 2689782 - protein, 26 aa, Entamoeba histolytica
NKEKFKGLDFDEMMKQLDIPTESKTQ

SEQ ID NO: 2689783 - protein, 18 aa, Entamoeba histolytica
NKELPIVLADDITKLPGD

SEQ ID NO: 2689784 - protein, 19 aa, Entamoeba histolytica
NKELYDFGTKLQRHNIIKS

SEQ ID NO: 2689785 - protein, 19 aa, Entamoeba histolytica
NKEMLKEWIENEVPSRLET

SEQ ID NO: 2689786 - protein, 26 aa, Entamoeba histolytica
NKENLIRFVFPISRITLLPCNSKKDS

SEQ ID NO: 2689787 - protein, 22 aa, Entamoeba histolytica
NKESLTLFNTIVKWCGDESIDL

SEQ ID NO: 2689788 - protein, 20 aa, Entamoeba histolytica
NKEVVEYTELFKVKEEVTAL

SEQ ID NO: 2689789 - protein, 17 aa, Entamoeba histolytica
NKEYINYGGYFIEKGDE

SEQ ID NO: 2689790 - protein, 17 aa, Entamoeba histolytica
NKFAYAAESCNINGTFY

SEQ ID NO: 2689791 - protein, 28 aa, Entamoeba histolytica
NKFDNWEFFDIVFGIPMDCYDENQQCVN

SEQ ID NO: 2689792 - protein, 24 aa, Entamoeba histolytica
NKFHWHFKNFDGFALFQNGERILT

SEQ ID NO: 2689793 - protein, 25 aa, Entamoeba histolytica
NKFHWHFKNFDGFALFQNGERILTG

SEQ ID NO: 2689794 - protein, 19 aa, Entamoeba histolytica
NKFIFGVHGLFGLKVTKRF

SEQ ID NO: 2689795 - protein, 26 aa, Entamoeba histolytica
NKFIPFDRYSYLSIVIPEFKTILEMC

SEQ ID NO: 2689796 - protein, 22 aa, Entamoeba histolytica
NKFKEDFLPSLTKLRNEFEKEN

SEQ ID NO: 2689797 - protein, 18 aa, Entamoeba histolytica
NKFKGVSVETIIDNINAL

SEQ ID NO: 2689798 - protein, 28 aa, Entamoeba histolytica
NKFKLTFFFFQCFIKSCVVADKEIKEIE

SEQ ID NO: 2689799 - protein, 20 aa, Entamoeba histolytica
NKFLKTILKKGVSLQKGAEQ

SEQ ID NO: 2689800 - protein, 18 aa, Entamoeba histolytica
NKFNAIKNAVRIYGEGYM

SEQ ID NO: 2689801 - protein, 18 aa, Entamoeba histolytica
NKFPSCINTSSLNKTTLS

SEQ ID NO: 2689802 - protein, 17 aa, Entamoeba histolytica
NKFQFSDNWGIIKRDRE

SEQ ID NO: 2689803 - protein, 18 aa, Entamoeba histolytica
NKFRRVVVEESKAIEEEL

SEQ ID NO: 2689804 - protein, 19 aa, Entamoeba histolytica
NKFYTFWYSFKSWRDPPLD

SEQ ID NO: 2689805 - protein, 19 aa, Entamoeba histolytica
NKGDRDWLDKNTVVLSTKE

SEQ ID NO: 2689806 - protein, 20 aa, Entamoeba histolytica
NKGDRDWLDKNTVVLTTKEK

SEQ ID NO: 2689807 - protein, 17 aa, Entamoeba histolytica
NKGNCKIINRVGGTLTV

SEQ ID NO: 2689808 - protein, 17 aa, Entamoeba histolytica
NKGSFEMLDYWIEEYKR

SEQ ID NO: 2689809 - protein, 25 aa, Entamoeba histolytica
NKGVPGYEVLKNIYIELTPFSEANN

SEQ ID NO: 2689810 - protein, 18 aa, Entamoeba histolytica
NKHSFLLNFLGGLLGIKG

SEQ ID NO: 2689811 - protein, 22 aa, Entamoeba histolytica
NKHTIDFVIHFAALKAVGESVS

SEQ ID NO: 2689812 - protein, 17 aa, Entamoeba histolytica
NKIDELGLFNFSKLRAI

SEQ ID NO: 2689813 - protein, 24 aa, Entamoeba histolytica
NKIEDEFLMFLFYYAQGTELQLQA

SEQ ID NO: 2689814 - protein, 23 aa, Entamoeba histolytica
NKIEEKRVLVLAGNKTDLDERVI

SEQ ID NO: 2689815 - protein, 19 aa, Entamoeba histolytica
NKIENRMRMNPDFISIADI

SEQ ID NO: 2689816 - protein, 25 aa, Entamoeba histolytica
NKIESFKFEKCVGVVATVSLAEEQT

SEQ ID NO: 2689817 - protein, 24 aa, Entamoeba histolytica
NKIHCIRIRSSWVMTCAYAPSMKF

SEQ ID NO: 2689818 - protein, 17 aa, Entamoeba histolytica
NKIIEWPKSMKELTCLR

SEQ ID NO: 2689819 - protein, 17 aa, Entamoeba histolytica
NKIILVHNVLTIIDVLS

SEQ ID NO: 2689820 - protein, 22 aa, Entamoeba histolytica
NKIKDIYWNLEICNDNIDINIS

SEQ ID NO: 2689821 - protein, 21 aa, Entamoeba histolytica
NKIKMLIPLEILRAQKQKEKY

SEQ ID NO: 2689822 - protein, 21 aa, Entamoeba histolytica
NKILEEYICYFIIDKNLNENE

SEQ ID NO: 2689823 - protein, 18 aa, Entamoeba histolytica
NKILELFEGTGFQHVADT

SEQ ID NO: 2689824 - protein, 21 aa, Entamoeba histolytica
NKILFIPCWSVGNVGQLCADL

SEQ ID NO: 2689825 - protein, 24 aa, Entamoeba histolytica
NKILRLFLFGLYKMKVLSPPVLHI

SEQ ID NO: 2689826 - protein, 20 aa, Entamoeba histolytica
NKINCGWTITLLLDLIKEEE

SEQ ID NO: 2689827 - protein, 26 aa, Entamoeba histolytica
NKINELKLQFGDFVPRNVRTQIRDLT

SEQ ID NO: 2689828 - protein, 19 aa, Entamoeba histolytica
NKINFIIIFIITYSNTNIL

SEQ ID NO: 2689829 - protein, 23 aa, Entamoeba histolytica
NKIPEGQKIVIPKSVFSVSKMAF

SEQ ID NO: 2689830 - protein, 18 aa, Entamoeba histolytica
NKIPELIDFCVERDYYWK

SEQ ID NO: 2689831 - protein, 27 aa, Entamoeba histolytica
NKIPIEEILPLLPLDWELGEFKGVIKN

SEQ ID NO: 2689832 - protein, 20 aa, Entamoeba histolytica
NKIPIVYRVYQNVQQFIYEL

SEQ ID NO: 2689833 - protein, 22 aa, Entamoeba histolytica
NKIRLPFSYLLNQNKFKFIEIP

SEQ ID NO: 2689834 - protein, 17 aa, Entamoeba histolytica
NKIRRMLYIYAREHENM

SEQ ID NO: 2689835 - protein, 26 aa, Entamoeba histolytica
NKITSFKLPHFFIFTNILTNDVDKFK

SEQ ID NO: 2689836 - protein, 18 aa, Entamoeba histolytica
NKIYDCWSSLQLPIEVWT

SEQ ID NO: 2689837 - protein, 18 aa, Entamoeba histolytica
NKIYEMIRLYDLKLLNSM

SEQ ID NO: 2689838 - protein, 21 aa, Entamoeba histolytica
NKKELPKFIIVANKIDEEINR

SEQ ID NO: 2689839 - protein, 27 aa, Entamoeba histolytica
NKKGFKQICLENQLPEILSHVDVSSSI

SEQ ID NO: 2689840 - protein, 17 aa, Entamoeba histolytica
NKKGGILVSKGKLGLGI

SEQ ID NO: 2689841 - protein, 22 aa, Entamoeba histolytica
NKKGIRCVYRYGKGLIKTDDIH

SEQ ID NO: 2689842 - protein, 24 aa, Entamoeba histolytica
NKKGYVCAGILRTIIGKGEFPIPV

SEQ ID NO: 2689843 - protein, 26 aa, Entamoeba histolytica
NKKLFGILIEAEWKNNSFLVNIGIGI

SEQ ID NO: 2689844 - protein, 22 aa, Entamoeba histolytica
NKKLLKRITFCYKECYCTISND

SEQ ID NO: 2689845 - protein, 30 aa, Entamoeba histolytica
NKKLLKRITFCYKECYCTISNDGIIHNKRI

SEQ ID NO: 2689846 - protein, 30 aa, Entamoeba histolytica
NKKLLKRITFCYKECYCTISNDGIIHNKRL

SEQ ID NO: 2689847 - protein, 27 aa, Entamoeba histolytica
NKKLLKRITFCYKECYYAISNDGIIHN

SEQ ID NO: 2689848 - protein, 20 aa, Entamoeba histolytica
NKKMIAADVMSEFLFALFDC

SEQ ID NO: 2689849 - protein, 19 aa, Entamoeba histolytica
NKKMISWKKSFFDVSKPEE

SEQ ID NO: 2689850 - protein, 26 aa, Entamoeba histolytica
NKKNFLIRIAHGFHDLFIRTIKKLKI

SEQ ID NO: 2689851 - protein, 17 aa, Entamoeba histolytica
NKKSTVLFPSFKEQVNI

SEQ ID NO: 2689852 - protein, 25 aa, Entamoeba histolytica
NKKTLRVSFVLSFTFKPNPYLLYNT

SEQ ID NO: 2689853 - protein, 23 aa, Entamoeba histolytica
NKKTTRWRITFINGSTRLVPYAH

SEQ ID NO: 2689854 - protein, 17 aa, Entamoeba histolytica
NKKYIGYIDIDFNLLPM

SEQ ID NO: 2689855 - protein, 23 aa, Entamoeba histolytica
NKKYLTQLLKEFGDDVNELRMKA

SEQ ID NO: 2689856 - protein, 24 aa, Entamoeba histolytica
NKLDLFHCMRLKPLALPITVSQLY

SEQ ID NO: 2689857 - protein, 21 aa, Entamoeba histolytica
NKLEGLFRVPGKQDDIDGYKT

SEQ ID NO: 2689858 - protein, 23 aa, Entamoeba histolytica
NKLELKKLVYLYLMNYSRSQPER

SEQ ID NO: 2689859 - protein, 17 aa, Entamoeba histolytica
NKLFFRYLSLIQNSVYH

SEQ ID NO: 2689860 - protein, 17 aa, Entamoeba histolytica
NKLFKYQAALILFAMAS

SEQ ID NO: 2689861 - protein, 20 aa, Entamoeba histolytica
NKLFYCSYLPSGQARLSKKF

SEQ ID NO: 2689862 - protein, 17 aa, Entamoeba histolytica
NKLHSNFAFSGSLDGII

SEQ ID NO: 2689863 - protein, 30 aa, Entamoeba histolytica
NKLKDFIRLLILRHKHFLFEGTSQFSAILL

SEQ ID NO: 2689864 - protein, 23 aa, Entamoeba histolytica
NKLKELFSPYGNVINSTIKKSSK

SEQ ID NO: 2689865 - protein, 22 aa, Entamoeba histolytica
NKLKGIEGIKHLNQLKLLHNKF

SEQ ID NO: 2689866 - protein, 26 aa, Entamoeba histolytica
NKLKIKDIIPLFGIGIYSEGDNTFSV

SEQ ID NO: 2689867 - protein, 17 aa, Entamoeba histolytica
NKLKNGKSFVIDASDIV

SEQ ID NO: 2689868 - protein, 21 aa, Entamoeba histolytica
NKLKWRLNANPTISKEIKNQV

SEQ ID NO: 2689869 - protein, 20 aa, Entamoeba histolytica
NKLLRATQKFGFPPIPNPIL

SEQ ID NO: 2689870 - protein, 27 aa, Entamoeba histolytica
NKLPIDIAKDVSYDFGQKILTPDCPKE

SEQ ID NO: 2689871 - protein, 19 aa, Entamoeba histolytica
NKLPLSVNFGSTGFYYERR

SEQ ID NO: 2689872 - protein, 19 aa, Entamoeba histolytica
NKLRNNPSFVFKEVQYPNL

SEQ ID NO: 2689873 - protein, 21 aa, Entamoeba histolytica
NKLSICVAPSFFSQEITYMIT

SEQ ID NO: 2689874 - protein, 20 aa, Entamoeba histolytica
NKLSISWICGAVKGAKLYKI

SEQ ID NO: 2689875 - protein, 27 aa, Entamoeba histolytica
NKLVIEAIELKALVEHMILCHKDYPIC

SEQ ID NO: 2689876 - protein, 21 aa, Entamoeba histolytica
NKMKYHFFSSSLLFVYDIESY

SEQ ID NO: 2689877 - protein, 26 aa, Entamoeba histolytica
NKMMWLPTPVCTLILNNLLGPGNWEI

SEQ ID NO: 2689878 - protein, 26 aa, Entamoeba histolytica
NKMPVIWKLYIEWLIENGEITQMRRV

SEQ ID NO: 2689879 - protein, 20 aa, Entamoeba histolytica
NKMVPVYCVAFGAVPAVSSN

SEQ ID NO: 2689880 - protein, 17 aa, Entamoeba histolytica
NKNELCYFGDEDNGWLS

SEQ ID NO: 2689881 - protein, 18 aa, Entamoeba histolytica
NKNFFGFQIRFRDLARGG

SEQ ID NO: 2689882 - protein, 21 aa, Entamoeba histolytica
NKNGLKPSLFLFSNANNQYFG

SEQ ID NO: 2689883 - protein, 22 aa, Entamoeba histolytica
NKNIKFAYIFTGAKGGVVPYQG

SEQ ID NO: 2689884 - protein, 17 aa, Entamoeba histolytica
NKNLFNFEESAEEPTKE

SEQ ID NO: 2689885 - protein, 23 aa, Entamoeba histolytica
NKNPYWASLDFKTTSMFSSANLY

SEQ ID NO: 2689886 - protein, 24 aa, Entamoeba histolytica
NKNYCIIKIPIIGSNLGEMQIEQR

SEQ ID NO: 2689887 - protein, 23 aa, Entamoeba histolytica
NKPEMFWKMCNELRNCTEGKKPT

SEQ ID NO: 2689888 - protein, 27 aa, Entamoeba histolytica
NKPETQPNLWGGIALRNENSTEKIKGD

SEQ ID NO: 2689889 - protein, 22 aa, Entamoeba histolytica
NKPIGCILIFLPGIYEITTLQK

SEQ ID NO: 2689890 - protein, 17 aa, Entamoeba histolytica
NKPIKRIWGKISTKPFV

SEQ ID NO: 2689891 - protein, 23 aa, Entamoeba histolytica
NKPPRPEMQMSIQSVAEQSDNIG

SEQ ID NO: 2689892 - protein, 23 aa, Entamoeba histolytica
NKQDVAIEFGVEFSTSEIEQKAD

SEQ ID NO: 2689893 - protein, 19 aa, Entamoeba histolytica
NKRFDFPLKMKWNDKEMIL

SEQ ID NO: 2689894 - protein, 23 aa, Entamoeba histolytica
NKRLKAKLIQLKQLNGMLPTRVE

SEQ ID NO: 2689895 - protein, 22 aa, Entamoeba histolytica
NKRSTIGRIFFWLIKSELHIPE

SEQ ID NO: 2689896 - protein, 19 aa, Entamoeba histolytica
NKRSVKELCELLQKSEMKK

SEQ ID NO: 2689897 - protein, 23 aa, Entamoeba histolytica
NKSFPLKLNIIIVYDSNPKDSSL

SEQ ID NO: 2689898 - protein, 18 aa, Entamoeba histolytica
NKSHFVHRFVQLMRDYID

SEQ ID NO: 2689899 - protein, 19 aa, Entamoeba histolytica
NKSHFVHRFVQLMRDYIDS

SEQ ID NO: 2689900 - protein, 17 aa, Entamoeba histolytica
NKSHGFSSIKLIPYQED

SEQ ID NO: 2689901 - protein, 17 aa, Entamoeba histolytica
NKSIGVLLAPAINIQRH

SEQ ID NO: 2689902 - protein, 25 aa, Entamoeba histolytica
NKSIIKSNFTNIVFCDYVNSNESAD

SEQ ID NO: 2689903 - protein, 19 aa, Entamoeba histolytica
NKSIIPFKGKPRFLELQLN

SEQ ID NO: 2689904 - protein, 30 aa, Entamoeba histolytica
NKSIKFNCQWYITVHFDRYICTPIEEEQTM

SEQ ID NO: 2689905 - protein, 30 aa, Entamoeba histolytica
NKSIKFNCQWYITVHFDRYICTPIVEEQQK

SEQ ID NO: 2689906 - protein, 30 aa, Entamoeba histolytica
NKSIKFNCQWYITVHFDRYICTPIVEEQTM

SEQ ID NO: 2689907 - protein, 30 aa, Entamoeba histolytica
NKSIKFNCQWYITVHFDRYIITPTELKENE

SEQ ID NO: 2689908 - protein, 23 aa, Entamoeba histolytica
NKSIQQLTMRVHWLQLKETVSWE

SEQ ID NO: 2689909 - protein, 22 aa, Entamoeba histolytica
NKSKYHSWRTLFDSCYVSSNNI

SEQ ID NO: 2689910 - protein, 22 aa, Entamoeba histolytica
NKSLLQRWRFEREPFPLELNEY

SEQ ID NO: 2689911 - protein, 21 aa, Entamoeba histolytica
NKSSFLLHPIFNHPKNDFLSQ

SEQ ID NO: 2689912 - protein, 26 aa, Entamoeba histolytica
NKSWIKRLNIVISFLRDMRLIQRDIE

SEQ ID NO: 2689913 - protein, 25 aa, Entamoeba histolytica
NKTCPKRWFIKSGKEGGIKLFSNND

SEQ ID NO: 2689914 - protein, 41 aa, Entamoeba histolytica
NKTDIFLTLQFIKQFSFRLLEIITSVSMCRDIQKQQLLATI

SEQ ID NO: 2689915 - protein, 23 aa, Entamoeba histolytica
NKTEFKPVIKMEVQEQKVDENQE

SEQ ID NO: 2689916 - protein, 17 aa, Entamoeba histolytica
NKTIFKSMIEELSEELL

SEQ ID NO: 2689917 - protein, 25 aa, Entamoeba histolytica
NKTILRFEAIRVVSEMSYRYNELVS

SEQ ID NO: 2689918 - protein, 18 aa, Entamoeba histolytica
NKTILSFHQTKFDNEQKR

SEQ ID NO: 2689919 - protein, 23 aa, Entamoeba histolytica
NKTIRILEYYGYDDNVWKESSSE

SEQ ID NO: 2689920 - protein, 24 aa, Entamoeba histolytica
NKTKIPPPVYCRLIESLINDGQTS

SEQ ID NO: 2689921 - protein, 24 aa, Entamoeba histolytica
NKTLDRLFSLFGLVFQPIKMVLFN

SEQ ID NO: 2689922 - protein, 17 aa, Entamoeba histolytica
NKTLLYYPIDFDAKICS

SEQ ID NO: 2689923 - protein, 21 aa, Entamoeba histolytica
NKTPVYCMRWTPDGRRIVTGN

SEQ ID NO: 2689924 - protein, 23 aa, Entamoeba histolytica
NKTSIPLQLIWNSFETNCFENQT

SEQ ID NO: 2689925 - protein, 22 aa, Entamoeba histolytica
NKTSPKMSCCDTIPLHTSSIKI

SEQ ID NO: 2689926 - protein, 27 aa, Entamoeba histolytica
NKTTAQICLRWLVQNGIIAVPKSTNPN

SEQ ID NO: 2689927 - protein, 21 aa, Entamoeba histolytica
NKTTFCINWRVDYFKKTEHKI

SEQ ID NO: 2689928 - protein, 27 aa, Entamoeba histolytica
NKTVLKVFWFLGPRDLFVLPFVCRKFR

SEQ ID NO: 2689929 - protein, 20 aa, Entamoeba histolytica
NKVCLVIGEKGLLGRSKTKE

SEQ ID NO: 2689930 - protein, 21 aa, Entamoeba histolytica
NKVECKSSWIIWNVLQEYKFI

SEQ ID NO: 2689931 - protein, 27 aa, Entamoeba histolytica
NKVEWKLVVKKAENWLASKPAISEEIK

SEQ ID NO: 2689932 - protein, 25 aa, Entamoeba histolytica
NKVEWKLVVKKAENWLSSKPRLKED

SEQ ID NO: 2689933 - protein, 25 aa, Entamoeba histolytica
NKVFCSDLIKGCCRFNSNTTIGNIF

SEQ ID NO: 2689934 - protein, 22 aa, Entamoeba histolytica
NKVICPRMLIWKLEETHRIVLE

SEQ ID NO: 2689935 - protein, 17 aa, Entamoeba histolytica
NKVIEWVESSLITDFNT

SEQ ID NO: 2689936 - protein, 19 aa, Entamoeba histolytica
NKVKCIRDVIISIFCSLNV

SEQ ID NO: 2689937 - protein, 20 aa, Entamoeba histolytica
NKVKHCYLTYLCINKQCIVF

SEQ ID NO: 2689938 - protein, 20 aa, Entamoeba histolytica
NKVPKGYFNKEFIRQKCMTL

SEQ ID NO: 2689939 - protein, 27 aa, Entamoeba histolytica
NKWIIQFPKRFVEIKGDNTLFTYSNFL

SEQ ID NO: 2689940 - protein, 24 aa, Entamoeba histolytica
NKYCAMPLISQCFIYGESSDVFIT

SEQ ID NO: 2689941 - protein, 19 aa, Entamoeba histolytica
NKYDLKCAQIILRLLTKYI

SEQ ID NO: 2689942 - protein, 17 aa, Entamoeba histolytica
NKYECINYLNGNSTIPS

SEQ ID NO: 2689943 - protein, 23 aa, Entamoeba histolytica
NKYEVSILFILKSLFKLYQFTPQ

SEQ ID NO: 2689944 - protein, 19 aa, Entamoeba histolytica
NKYGLPLLPKENFEAIFTE

SEQ ID NO: 2689945 - protein, 21 aa, Entamoeba histolytica
NKYKMKRVVVVGSSNTDLIGY

SEQ ID NO: 2689946 - protein, 20 aa, Entamoeba histolytica
NKYLCSYMIQNIGKYQVQPK

SEQ ID NO: 2689947 - protein, 22 aa, Entamoeba histolytica
NKYRIEPSFVLAILCGIVSEQT

SEQ ID NO: 2689948 - protein, 22 aa, Entamoeba histolytica
NKYTDCIQEFLAPLNLFDTSNK

SEQ ID NO: 2689949 - protein, 19 aa, Entamoeba histolytica
NLADRVRTAPFFTLQEKVF

SEQ ID NO: 2689950 - protein, 18 aa, Entamoeba histolytica
NLAICLAPCILYDSKADI

SEQ ID NO: 2689951 - protein, 24 aa, Entamoeba histolytica
NLAPGCHMGRFIIWTESAFKKLNT

SEQ ID NO: 2689952 - protein, 23 aa, Entamoeba histolytica
NLASLPLEISIKVSLQEYYNNTL

SEQ ID NO: 2689953 - protein, 19 aa, Entamoeba histolytica
NLAVCIAISTLVEKDDVQT

SEQ ID NO: 2689954 - protein, 17 aa, Entamoeba histolytica
NLAYKYFSIKKICDLAE

SEQ ID NO: 2689955 - protein, 18 aa, Entamoeba histolytica
NLCGACVFMPLITNDFNP

SEQ ID NO: 2689956 - protein, 19 aa, Entamoeba histolytica
NLCGPRCYYCKQPIEDTAI

SEQ ID NO: 2689957 - protein, 17 aa, Entamoeba histolytica
NLCKEVMEYCFVNNDNQ

SEQ ID NO: 2689958 - protein, 21 aa, Entamoeba histolytica
NLDGTSGMFMFLTFVIHLFFF

SEQ ID NO: 2689959 - protein, 21 aa, Entamoeba histolytica
NLDGTSGMFMLLDFVIQLIFF

SEQ ID NO: 2689960 - protein, 19 aa, Entamoeba histolytica
NLDKFILLLLNRIELPIIK

SEQ ID NO: 2689961 - protein, 26 aa, Entamoeba histolytica
NLDVQVLLELGCKYIAEMIKGKSVEE

SEQ ID NO: 2689962 - protein, 19 aa, Entamoeba histolytica
NLEEMVIKLNNEIQEKNKQ

SEQ ID NO: 2689963 - protein, 24 aa, Entamoeba histolytica
NLELKSKQLFGFKVDKNCIKTVSV

SEQ ID NO: 2689964 - protein, 18 aa, Entamoeba histolytica
NLESPKCVFNNQTHINNS

SEQ ID NO: 2689965 - protein, 22 aa, Entamoeba histolytica
NLETLCMKYAMGITSTSMTAAE

SEQ ID NO: 2689966 - protein, 21 aa, Entamoeba histolytica
NLETWRQLWRVVERSQVVLMI

SEQ ID NO: 2689967 - protein, 18 aa, Entamoeba histolytica
NLEVLKLSNCEITKIPED

SEQ ID NO: 2689968 - protein, 25 aa, Entamoeba histolytica
NLFGNDVKKHFIAMLTFCDGKKPKV

SEQ ID NO: 2689969 - protein, 17 aa, Entamoeba histolytica
NLFKIIILGDSGVGKTS

SEQ ID NO: 2689970 - protein, 22 aa, Entamoeba histolytica
NLFLAKSILKFTSLSFTYDSSI

SEQ ID NO: 2689971 - protein, 19 aa, Entamoeba histolytica
NLFLPKTTCIFSRNPETNK

SEQ ID NO: 2689972 - protein, 25 aa, Entamoeba histolytica
NLFRIELFTSHSLCDGRTIFNCFDV

SEQ ID NO: 2689973 - protein, 17 aa, Entamoeba histolytica
NLFRVFIRGPTGANEIP

SEQ ID NO: 2689974 - protein, 18 aa, Entamoeba histolytica
NLGIIFCIKCSAIHRSLG

SEQ ID NO: 2689975 - protein, 19 aa, Entamoeba histolytica
NLHCQFKLILNNNEVVQLR

SEQ ID NO: 2689976 - protein, 18 aa, Entamoeba histolytica
NLHQLVGTFAKLYCICFE

SEQ ID NO: 2689977 - protein, 17 aa, Entamoeba histolytica
NLIAMAFPATGFSQQWR

SEQ ID NO: 2689978 - protein, 26 aa, Entamoeba histolytica
NLIKELKRVYPFASIIVLGNKLDLAY

SEQ ID NO: 2689979 - protein, 28 aa, Entamoeba histolytica
NLIKPTTSCKWCQESLLSVISEESAQFH

SEQ ID NO: 2689980 - protein, 18 aa, Entamoeba histolytica
NLIKTCNLIYKFDEISPQ

SEQ ID NO: 2689981 - protein, 19 aa, Entamoeba histolytica
NLIPSFPPATVYFIKPTQE

SEQ ID NO: 2689982 - protein, 19 aa, Entamoeba histolytica
NLIRVPVKLTKPVPRSKIF

SEQ ID NO: 2689983 - protein, 25 aa, Entamoeba histolytica
NLISISPFWHWNFALDLHEVSISRF

SEQ ID NO: 2689984 - protein, 17 aa, Entamoeba histolytica
NLISQWVAYEICRHEDI

SEQ ID NO: 2689985 - protein, 23 aa, Entamoeba histolytica
NLKEKITVLSLFIYDDFIDFSQF

SEQ ID NO: 2689986 - protein, 19 aa, Entamoeba histolytica
NLKEVQWFEFKALISTRGE

SEQ ID NO: 2689987 - protein, 23 aa, Entamoeba histolytica
NLKGETPLHISVKMGNIEFVDFL

SEQ ID NO: 2689988 - protein, 20 aa, Entamoeba histolytica
NLKNAIKEEGVDNTIPVIEE

SEQ ID NO: 2689989 - protein, 24 aa, Entamoeba histolytica
NLKNCKVELNGRYRHLMLFNNNNK

SEQ ID NO: 2689990 - protein, 22 aa, Entamoeba histolytica
NLKQKRRDGCLTLQESKSRRKI

SEQ ID NO: 2689991 - protein, 20 aa, Entamoeba histolytica
NLKRICLVDDFGKIFFDAFK

SEQ ID NO: 2689992 - protein, 22 aa, Entamoeba histolytica
NLKRRIDVAQHFALGKYSKDID

SEQ ID NO: 2689993 - protein, 24 aa, Entamoeba histolytica
NLLADIRSGITLRSAADRKLDTAA

SEQ ID NO: 2689994 - protein, 21 aa, Entamoeba histolytica
NLLCRNCNKILDIKWVGNVIC

SEQ ID NO: 2689995 - protein, 19 aa, Entamoeba histolytica
NLLDISVVYIVFDISNIDS

SEQ ID NO: 2689996 - protein, 19 aa, Entamoeba histolytica
NLLEFRNSLPTSNEESTVV

SEQ ID NO: 2689997 - protein, 25 aa, Entamoeba histolytica
NLLELHQWIPSIFEQCFVRQNINYI

SEQ ID NO: 2689998 - protein, 19 aa, Entamoeba histolytica
NLLFKFKYTIKALIFECIG

SEQ ID NO: 2689999 - protein, 22 aa, Entamoeba histolytica
NLLFLCFSKPMIVGLWSSTEIK

SEQ ID NO: 2690000 - protein, 25 aa, Entamoeba histolytica
NLLIDFCSEHGFFFNSIYSKKNPKT

SEQ ID NO: 2690001 - protein, 22 aa, Entamoeba histolytica
NLLIDLLDEFGFQFHTTLSRRS

SEQ ID NO: 2690002 - protein, 17 aa, Entamoeba histolytica
NLLIYDIIEICRKRECD

SEQ ID NO: 2690003 - protein, 26 aa, Entamoeba histolytica
NLLKIYFSGIIEFNFNPVTKICIEPP

SEQ ID NO: 2690004 - protein, 25 aa, Entamoeba histolytica
NLLKLKIELQREWLFDEIDINEYLG

SEQ ID NO: 2690005 - protein, 25 aa, Entamoeba histolytica
NLLKLNIELQREWLFDEIDINEYLG

SEQ ID NO: 2690006 - protein, 27 aa, Entamoeba histolytica
NLLKLNIELQREWLFDEIDINEYLGII

SEQ ID NO: 2690007 - protein, 17 aa, Entamoeba histolytica
NLLKYGSMIQHWKEFSF

SEQ ID NO: 2690008 - protein, 17 aa, Entamoeba histolytica
NLLNLRLRMPISDDLNP

SEQ ID NO: 2690009 - protein, 18 aa, Entamoeba histolytica
NLLPRGWHGLLSLTHMIL

SEQ ID NO: 2690010 - protein, 17 aa, Entamoeba histolytica
NLLPRIICIGNKEETHN

SEQ ID NO: 2690011 - protein, 25 aa, Entamoeba histolytica
NLLTIPLWTKYYLRYSFPKIAELNL

SEQ ID NO: 2690012 - protein, 26 aa, Entamoeba histolytica
NLMCESDCLISVAFANKVNSPIAIQC

SEQ ID NO: 2690013 - protein, 28 aa, Entamoeba histolytica
NLMDRIKYKLEIPIMWNEDSNTHEDEIF

SEQ ID NO: 2690014 - protein, 18 aa, Entamoeba histolytica
NLMKKCLVNTGINKEDIA

SEQ ID NO: 2690015 - protein, 25 aa, Entamoeba histolytica
NLMKKIYKIFGFKTEIALSTRNEKK

SEQ ID NO: 2690016 - protein, 24 aa, Entamoeba histolytica
NLMPCSSSSAFAFYEIVLNCDDKK

SEQ ID NO: 2690017 - protein, 20 aa, Entamoeba histolytica
NLMRKYRVAIREGKSKTFAR

SEQ ID NO: 2690018 - protein, 18 aa, Entamoeba histolytica
NLMYKYKRPFVLDLKIGT

SEQ ID NO: 2690019 - protein, 25 aa, Entamoeba histolytica
NLNDLRGGFEIGLTICKLELVKSFY

SEQ ID NO: 2690020 - protein, 27 aa, Entamoeba histolytica
NLNGIPTRLRIVLSRIKGSNNIEEVLK

SEQ ID NO: 2690021 - protein, 17 aa, Entamoeba histolytica
NLNIPLESIIMIKRLIY

SEQ ID NO: 2690022 - protein, 23 aa, Entamoeba histolytica
NLNKRLNAVLKILQSLEVIEMKN

SEQ ID NO: 2690023 - protein, 18 aa, Entamoeba histolytica
NLNREIHFSEFIASEPQI

SEQ ID NO: 2690024 - protein, 23 aa, Entamoeba histolytica
NLNRGVFGWGRKVMKKEKIKGYI

SEQ ID NO: 2690025 - protein, 19 aa, Entamoeba histolytica
NLNSAPRFLNLVYVSIPTT

SEQ ID NO: 2690026 - protein, 18 aa, Entamoeba histolytica
NLNSFNGFFDFKNIKLPP

SEQ ID NO: 2690027 - protein, 25 aa, Entamoeba histolytica
NLPIGINPWYIWQIIPNINENDKCF

SEQ ID NO: 2690028 - protein, 28 aa, Entamoeba histolytica
NLPKKSMVGIFFPNRAEWIIVSQALHRI

SEQ ID NO: 2690029 - protein, 31 aa, Entamoeba histolytica; identical to SEQ ID NO: 2498253

SEQ ID NO: 2690030 - protein, 18 aa, Entamoeba histolytica
NLPPKCPIHVIDYQINIH

SEQ ID NO: 2690031 - protein, 33 aa, Entamoeba histolytica
NLPRKKNDIEPWLKREFGEVIIKEQKEIKQENN

SEQ ID NO: 2690032 - protein, 18 aa, Entamoeba histolytica
NLPYSRFNVAFMQYTGIG

SEQ ID NO: 2690033 - protein, 17 aa, Entamoeba histolytica
NLQKWVGKSECELIYSV

SEQ ID NO: 2690034 - protein, 17 aa, Entamoeba histolytica
NLQLKCLFVSSRTGYGF

SEQ ID NO: 2690035 - protein, 17 aa, Entamoeba histolytica
NLQLRWFNKCTSIDNLN

SEQ ID NO: 2690036 - protein, 18 aa, Entamoeba histolytica
NLQQWLCISSLNEVESII

SEQ ID NO: 2690037 - protein, 18 aa, Entamoeba histolytica
NLQRLRSCCDKAYSTYQL

SEQ ID NO: 2690038 - protein, 25 aa, Entamoeba histolytica
NLQSCLKTGFPGLIRCEKIHNMLLK

SEQ ID NO: 2690039 - protein, 18 aa, Entamoeba histolytica
NLQTFYVRRCPSRLYKIT

SEQ ID NO: 2690040 - protein, 24 aa, Entamoeba histolytica
NLRAFELSLHFPEIVQRYRDMMTN

SEQ ID NO: 2690041 - protein, 25 aa, Entamoeba histolytica
NLRCVRGDIELVIAFFKKFTDNGSQ

SEQ ID NO: 2690042 - protein, 24 aa, Entamoeba histolytica
NLSCTVRVVGGWVRDKILKKNSHD

SEQ ID NO: 2690043 - protein, 20 aa, Entamoeba histolytica
NLSKNMLFCALQIKRTIEDR

SEQ ID NO: 2690044 - protein, 21 aa, Entamoeba histolytica
NLSNVKFFGSRLIVKHSKHDS

SEQ ID NO: 2690045 - protein, 18 aa, Entamoeba histolytica
NLSNWSIALKYFVIDISV

SEQ ID NO: 2690046 - protein, 20 aa, Entamoeba histolytica
NLSSAPRFLNLVYVSIPTTI

SEQ ID NO: 2690047 - protein, 20 aa, Entamoeba histolytica
NLSSAPRFLNLVYVTIPNSV

SEQ ID NO: 2690048 - protein, 25 aa, Entamoeba histolytica
NLSSLCACGIHCVINQNVDYNTISE

SEQ ID NO: 2690049 - protein, 19 aa, Entamoeba histolytica
NLSVCWTPTMFSVNNDELS

SEQ ID NO: 2690050 - protein, 18 aa, Entamoeba histolytica
NLTCSGYAKQLIDTVQTV

SEQ ID NO: 2690051 - protein, 21 aa, Entamoeba histolytica
NLTHLEVINSIFINPLSTMSS

SEQ ID NO: 2690052 - protein, 18 aa, Entamoeba histolytica
NLTIKICSILSQETEMTH

SEQ ID NO: 2690053 - protein, 21 aa, Entamoeba histolytica
NLTLILGLLWTLILKYQIAQN

SEQ ID NO: 2690054 - protein, 18 aa, Entamoeba histolytica
NLTMLFKIYCIDKTNVIS

SEQ ID NO: 2690055 - protein, 20 aa, Entamoeba histolytica
NLTSAPRFLNLVYVTIPNSV

SEQ ID NO: 2690056 - protein, 21 aa, Entamoeba histolytica
NLTSLNGFVYFDFIPIKMESI

SEQ ID NO: 2690057 - protein, 19 aa, Entamoeba histolytica
NLTTFPIQICNFSKLQALI

SEQ ID NO: 2690058 - protein, 20 aa, Entamoeba histolytica
NLVFEGCPVLGKTALPYSLT

SEQ ID NO: 2690059 - protein, 18 aa, Entamoeba histolytica
NLVRFGWETSKRIIEEKV

SEQ ID NO: 2690060 - protein, 18 aa, Entamoeba histolytica
NLVSCKMYNEVVFHSILN

SEQ ID NO: 2690061 - protein, 26 aa, Entamoeba histolytica
NLVSLISGICPCAFFETSALYNVQVN

SEQ ID NO: 2690062 - protein, 25 aa, Entamoeba histolytica
NLWMKESIIPWINFIKKRDNINTEA

SEQ ID NO: 2690063 - protein, 23 aa, Entamoeba histolytica
NLWQFDISNLVWRKLGDLENFKL

SEQ ID NO: 2690064 - protein, 21 aa, Entamoeba histolytica
NLWYYPKLKDGAIMATTLYGR

SEQ ID NO: 2690065 - protein, 19 aa, Entamoeba histolytica
NLYDFIKTIHLDFSNYDTT

SEQ ID NO: 2690066 - protein, 22 aa, Entamoeba histolytica
NLYGSKICPERIGSYIQLCSSE

SEQ ID NO: 2690067 - protein, 22 aa, Entamoeba histolytica
NLYIHFNECYNFIESNKNKGSI

SEQ ID NO: 2690068 - protein, 22 aa, Entamoeba histolytica
NLYKWRKVYELIQQVLNAKGQT

SEQ ID NO: 2690069 - protein, 17 aa, Entamoeba histolytica
NLYRLTIPFIKNLKNEI

SEQ ID NO: 2690070 - protein, 17 aa, Entamoeba histolytica
NMACTYYLKALVPSTSY

SEQ ID NO: 2690071 - protein, 21 aa, Entamoeba histolytica
NMAHLIFSVLVRRSIDLSEQF

SEQ ID NO: 2690072 - protein, 23 aa, Entamoeba histolytica
NMCDGCAVDFIPLIDVISQTFSS

SEQ ID NO: 2690073 - protein, 18 aa, Entamoeba histolytica
NMELSIVACREFSVRLGN

SEQ ID NO: 2690074 - protein, 19 aa, Entamoeba histolytica
NMGCCCMALGSSFSKTTDA

SEQ ID NO: 2690075 - protein, 17 aa, Entamoeba histolytica
NMHIWKSLNASFKTQVA

SEQ ID NO: 2690076 - protein, 23 aa, Entamoeba histolytica
NMIECGYSDFGYIMIMDLQGINL

SEQ ID NO: 2690077 - protein, 24 aa, Entamoeba histolytica
NMIERFNWIGSTIVNCFNECPKGD

SEQ ID NO: 2690078 - protein, 24 aa, Entamoeba histolytica
NMIPYPRLHFFSSSIAPVSSALSM

SEQ ID NO: 2690079 - protein, 18 aa, Entamoeba histolytica
NMKIKLLPYHSLPFAWIN

SEQ ID NO: 2690080 - protein, 25 aa, Entamoeba histolytica
NMLFDEAWFPYAHFHPFYASYHSMN

SEQ ID NO: 2690081 - protein, 21 aa, Entamoeba histolytica
NMLIHHFYLKKALFELKGHKF

SEQ ID NO: 2690082 - protein, 18 aa, Entamoeba histolytica
NMLIKYPILKGLFDNGEL

SEQ ID NO: 2690083 - protein, 23 aa, Entamoeba histolytica
NMLRIKRKVFVDILFCDMDPQAA

SEQ ID NO: 2690084 - protein, 23 aa, Entamoeba histolytica
NMMKCIATALPIHLRNFPNNPFY

SEQ ID NO: 2690085 - protein, 18 aa, Entamoeba histolytica
NMMKRGCDDFDKIHAINP

SEQ ID NO: 2690086 - protein, 25 aa, Entamoeba histolytica
NMNDFPSNIVYLFLFNDIIVETKVV

SEQ ID NO: 2690087 - protein, 25 aa, Entamoeba histolytica
NMNEAENFFRYQVINVDVFRFRCIA

SEQ ID NO: 2690088 - protein, 20 aa, Entamoeba histolytica
NMNQQWKELVFLYVQVDQVK

SEQ ID NO: 2690089 - protein, 33 aa, Entamoeba histolytica
NMPFPPFLTSSWMKKGFGFEDFMLKKLINAERM

SEQ ID NO: 2690090 - protein, 17 aa, Entamoeba histolytica
NMQGLALNSMTKTAVAR

SEQ ID NO: 2690091 - protein, 19 aa, Entamoeba histolytica
NMRNYRILYRSSKDGLSAR

SEQ ID NO: 2690092 - protein, 23 aa, Entamoeba histolytica
NMSCIVMKVIESCYEMKKDTTEI

SEQ ID NO: 2690093 - protein, 24 aa, Entamoeba histolytica
NMSFFPKEFCEMSQMKVLIMNNNK

SEQ ID NO: 2690094 - protein, 27 aa, Entamoeba histolytica
NMSLLCGVTLCGGAHAVGHELTSYYGL

SEQ ID NO: 2690095 - protein, 18 aa, Entamoeba histolytica
NMTICPGAKVLYIGAASG

SEQ ID NO: 2690096 - protein, 18 aa, Entamoeba histolytica
NMTRCCIKTDAGITKSKE

SEQ ID NO: 2690097 - protein, 19 aa, Entamoeba histolytica
NMTVCAAVEIVIKNGKVTG

SEQ ID NO: 2690098 - protein, 18 aa, Entamoeba histolytica
NMVTLWYRPPELLLGETR

SEQ ID NO: 2690099 - protein, 20 aa, Entamoeba histolytica
NNAICGKGNIMIIVMTEDSD

SEQ ID NO: 2690100 - protein, 25 aa, Entamoeba histolytica
NNALMSRCNLVILKRLENESINKII

SEQ ID NO: 2690101 - protein, 29 aa, Entamoeba histolytica
NNCEVRSSIEFLELLFVDLLFGDKEISFI

SEQ ID NO: 2690102 - protein, 17 aa, Entamoeba histolytica
NNCFVKDFLFEYTGNVR

SEQ ID NO: 2690103 - protein, 23 aa, Entamoeba histolytica
NNCIGCGSCALSCRDNSTTAIVK

SEQ ID NO: 2690104 - protein, 19 aa, Entamoeba histolytica
NNCMAKLYINYDCDEYCTD

SEQ ID NO: 2690105 - protein, 19 aa, Entamoeba histolytica
NNCPCRMRACCSTFTKYCK

SEQ ID NO: 2690106 - protein, 17 aa, Entamoeba histolytica
NNCQELLLYIALTHIYF

SEQ ID NO: 2690107 - protein, 17 aa, Entamoeba histolytica
NNCTWDYNLNCKTLTSL

SEQ ID NO: 2690108 - protein, 21 aa, Entamoeba histolytica
NNCVFREQYIQSIKFVEDQVR

SEQ ID NO: 2690109 - protein, 21 aa, Entamoeba histolytica
NNCYLRYNRDPVVKTIHYLEK

SEQ ID NO: 2690110 - protein, 25 aa, Entamoeba histolytica
NNDKESRRGISITIKQYCSTLILYP

SEQ ID NO: 2690111 - protein, 20 aa, Entamoeba histolytica
NNDNCYRYATNLIPVVIRYS

SEQ ID NO: 2690112 - protein, 20 aa, Entamoeba histolytica
NNDYWGRHRAAIAFLAAYTG

SEQ ID NO: 2690113 - protein, 27 aa, Entamoeba histolytica
NNECSPAFWKFMNLIGTKKPLKGWQNF

SEQ ID NO: 2690114 - protein, 22 aa, Entamoeba histolytica
NNEFKGRFFATPIKIGAETEES

SEQ ID NO: 2690115 - protein, 17 aa, Entamoeba histolytica
NNEICLHALAAIEKSPI

SEQ ID NO: 2690116 - protein, 28 aa, Entamoeba histolytica
NNELAYCYGCHRICTSIHPVYVYSCRNC

SEQ ID NO: 2690117 - protein, 31 aa, Entamoeba histolytica
NNELAYCYGCHRICTSMHPVYVYSCRSCGEL

SEQ ID NO: 2690118 - protein, 21 aa, Entamoeba histolytica
NNFHKGMVWDYSFNIDGTLLA

SEQ ID NO: 2690119 - protein, 23 aa, Entamoeba histolytica
NNFKEWFKEIIIKEINKKKSIKK

SEQ ID NO: 2690120 - protein, 17 aa, Entamoeba histolytica
NNFMLERIECQKGIEEW

SEQ ID NO: 2690121 - protein, 19 aa, Entamoeba histolytica
NNFNCLVFGGLNVYLKDKY

SEQ ID NO: 2690122 - protein, 23 aa, Entamoeba histolytica
NNFNRITYFPSISLVTNQSQRNL

SEQ ID NO: 2690123 - protein, 21 aa, Entamoeba histolytica
NNFQCRYCLKPYQPFLNDCEK

SEQ ID NO: 2690124 - protein, 21 aa, Entamoeba histolytica
NNFSKMITIEFMTDVIQTFYN

SEQ ID NO: 2690125 - protein, 21 aa, Entamoeba histolytica
NNFTFVLPMVYSLSFFIQKNT

SEQ ID NO: 2690126 - protein, 25 aa, Entamoeba histolytica
NNGDYRWAVTILNHLIFSNPKNEEA

SEQ ID NO: 2690127 - protein, 19 aa, Entamoeba histolytica
NNGGICLHDSKRLIGETVK

SEQ ID NO: 2690128 - protein, 24 aa, Entamoeba histolytica
NNGKISGCIRIRAKSQGVALSLGD

SEQ ID NO: 2690129 - protein, 18 aa, Entamoeba histolytica
NNGMGLTFNRHVLRQLLE

SEQ ID NO: 2690130 - protein, 20 aa, Entamoeba histolytica
NNGTWKWKIVHQKTKTYDVD

SEQ ID NO: 2690131 - protein, 24 aa, Entamoeba histolytica
NNIDELWTLLNFINPENFPSLENF

SEQ ID NO: 2690132 - protein, 22 aa, Entamoeba histolytica
NNIDGTSGMFMLLAFVIQLIFF

SEQ ID NO: 2690133 - protein, 18 aa, Entamoeba histolytica
NNIIKIDLNIDCLKEITV

SEQ ID NO: 2690134 - protein, 17 aa, Entamoeba histolytica
NNIIKLVTYNGTIYYIS

SEQ ID NO: 2690135 - protein, 20 aa, Entamoeba histolytica
NNIIWEFAKGLSPGVDLTRI

SEQ ID NO: 2690136 - protein, 25 aa, Entamoeba histolytica
NNIKKMLLEFVEFQGQFISFTNEDY

SEQ ID NO: 2690137 - protein, 25 aa, Entamoeba histolytica
NNIKRICNFGEFIVAVCANSAFVVN

SEQ ID NO: 2690138 - protein, 25 aa, Entamoeba histolytica
NNIKWFPLLGVIKLKYLDISNNPIT

SEQ ID NO: 2690139 - protein, 24 aa, Entamoeba histolytica
NNINWLLRICKYIEKESLKTEGNL

SEQ ID NO: 2690140 - protein, 23 aa, Entamoeba histolytica
NNISICYPTFVIIQIEKGEMSFR

SEQ ID NO: 2690141 - protein, 20 aa, Entamoeba histolytica
NNIYSMRTFTKCGGFTGVYE

SEQ ID NO: 2690142 - protein, 24 aa, Entamoeba histolytica
NNKAIECLKEMIVFDSINKKNELH

SEQ ID NO: 2690143 - protein, 22 aa, Entamoeba histolytica
NNKEIKCSFEINLNDASDETIQ

SEQ ID NO: 2690144 - protein, 29 aa, Entamoeba histolytica
NNKGVPFFWIRALNAVSLFLSYNTVEEDL

SEQ ID NO: 2690145 - protein, 19 aa, Entamoeba histolytica
NNKIRRIHKNIGFMTNLVE

SEQ ID NO: 2690146 - protein, 26 aa, Entamoeba histolytica
NNKIVSLPVLFPFQVTRLDLSQNLIS

SEQ ID NO: 2690147 - protein, 24 aa, Entamoeba histolytica
NNKKEIIELLPLYIELLEHWYNKN

SEQ ID NO: 2690148 - protein, 23 aa, Entamoeba histolytica
NNKLTEIPIFFTELTNLKKLDVS

SEQ ID NO: 2690149 - protein, 25 aa, Entamoeba histolytica
NNKSSYCIYDMKLATLQFIPFYHST

SEQ ID NO: 2690150 - protein, 17 aa, Entamoeba histolytica
NNLAPVIVFSFNRKELE

SEQ ID NO: 2690151 - protein, 26 aa, Entamoeba histolytica
NNLEMKIIQWEGGKLLYSPTSHYAQL

SEQ ID NO: 2690152 - protein, 23 aa, Entamoeba histolytica
NNLGELWTLLNYIEPKTFPSLEE

SEQ ID NO: 2690153 - protein, 22 aa, Entamoeba histolytica
NNLIKLSFCGVFVESVAKTMGL

SEQ ID NO: 2690154 - protein, 23 aa, Entamoeba histolytica
NNLKEFLKGVSINIRESGYDMIY

SEQ ID NO: 2690155 - protein, 18 aa, Entamoeba histolytica
NNLLKFFFIESSIKERTF

SEQ ID NO: 2690156 - protein, 23 aa, Entamoeba histolytica
NNLSELWSLFDFVYPGKLGTLPL

SEQ ID NO: 2690157 - protein, 24 aa, Entamoeba histolytica
NNMISIVLCCGIQPFSKIVKLSRS

SEQ ID NO: 2690158 - protein, 24 aa, Entamoeba histolytica
NNNLEMTSFLLSFDEIKRIINDKN

SEQ ID NO: 2690159 - protein, 23 aa, Entamoeba histolytica
NNNLFIVYLMRAFAHGYYRKPTF

SEQ ID NO: 2690160 - protein, 21 aa, Entamoeba histolytica
NNNSSRFGKFIEIQFSNGGKI

SEQ ID NO: 2690161 - protein, 24 aa, Entamoeba histolytica
NNPMKLKIGNHVIFGGSPATTFIA

SEQ ID NO: 2690162 - protein, 24 aa, Entamoeba histolytica
NNPMKSTVSDLLLLQPPAYITNNT

SEQ ID NO: 2690163 - protein, 24 aa, Entamoeba histolytica
NNQEIIRCASWLIHVCSTKNETIK

SEQ ID NO: 2690164 - protein, 20 aa, Entamoeba histolytica
NNQIEILKWIRGIAPEIIKK

SEQ ID NO: 2690165 - protein, 20 aa, Entamoeba histolytica
NNQLSYWPLDMVLRDKYKFS

SEQ ID NO: 2690166 - protein, 28 aa, Entamoeba histolytica
NNRCCLCGSIKGVLLCIKCNKYFCNGPV

SEQ ID NO: 2690167 - protein, 22 aa, Entamoeba histolytica
NNRDSLSKVYSWYGEVNEKTTQ

SEQ ID NO: 2690168 - protein, 23 aa, Entamoeba histolytica
NNRGTGCAFGMDVLNEFLNENNL

SEQ ID NO: 2690169 - protein, 21 aa, Entamoeba histolytica
NNRICVGADYSICVWDAELEE

SEQ ID NO: 2690170 - protein, 24 aa, Entamoeba histolytica
NNRITEIPLFIDSFEKLRQFDCSY

SEQ ID NO: 2690171 - protein, 24 aa, Entamoeba histolytica
NNRLIQCFGSFGWSGEGVKNLIPR

SEQ ID NO: 2690172 - protein, 18 aa, Entamoeba histolytica
NNSFPLNVSKYVITCNQK

SEQ ID NO: 2690173 - protein, 25 aa, Entamoeba histolytica
NNSILKKRCNAVIYLLIRGGLKNEL

SEQ ID NO: 2690174 - protein, 22 aa, Entamoeba histolytica
NNSLRKLLCNNINMLTISSPNL

SEQ ID NO: 2690175 - protein, 32 aa, Entamoeba histolytica
NNTKHPIVFVCPATRISMCLLPKKTCVKQPNL

SEQ ID NO: 2690176 - protein, 26 aa, Entamoeba histolytica
NNVEIMNTVLFEWAEVLQQIIDTPVQ

SEQ ID NO: 2690177 - protein, 18 aa, Entamoeba histolytica
NNVIPRKTKLSLISIPSL

SEQ ID NO: 2690178 - protein, 25 aa, Entamoeba histolytica
NNVPSCSTQLFGKCFGEDTFTVQSL

SEQ ID NO: 2690179 - protein, 24 aa, Entamoeba histolytica
NNVSCSRKQCSIRRTDDGEIFFED

SEQ ID NO: 2690180 - protein, 24 aa, Entamoeba histolytica
NNVSHPLCISKIFANILISQNIEQ

SEQ ID NO: 2690181 - protein, 25 aa, Entamoeba histolytica
NNVVIKLLLCQQVFRIINNKIIELQ

SEQ ID NO: 2690182 - protein, 17 aa, Entamoeba histolytica
NNWPKADVIQWCDPYVI

SEQ ID NO: 2690183 - protein, 19 aa, Entamoeba histolytica
NNWRSFFSGSAWKYDEERK

SEQ ID NO: 2690184 - protein, 24 aa, Entamoeba histolytica
NNYIKLASCLLKLKDYAGAVEAAK

SEQ ID NO: 2690185 - protein, 18 aa, Entamoeba histolytica
NNYKWLNICYERSDRENR

SEQ ID NO: 2690186 - protein, 24 aa, Entamoeba histolytica
NNYSPCPLCNGLLPPYDGPNKRHC

SEQ ID NO: 2690187 - protein, 21 aa, Entamoeba histolytica
NPAPLRLIALTQFNNMLIKIP

SEQ ID NO: 2690188 - protein, 21 aa, Entamoeba histolytica
NPCIYCVYKDGLSSIIKEGIY

SEQ ID NO: 2690189 - protein, 27 aa, Entamoeba histolytica
NPCVCAFPYIFGERGLGIDINNTVCLS

SEQ ID NO: 2690190 - protein, 19 aa, Entamoeba histolytica
NPEAERYNQVNNFGSQQYP

SEQ ID NO: 2690191 - protein, 21 aa, Entamoeba histolytica
NPEDFWRILIDNGNNIAEHEL

SEQ ID NO: 2690192 - protein, 18 aa, Entamoeba histolytica
NPEFKFEYENAIDVSAFT

SEQ ID NO: 2690193 - protein, 21 aa, Entamoeba histolytica
NPEFLKCLTGITYCYCVVTPQ

SEQ ID NO: 2690194 - protein, 21 aa, Entamoeba histolytica
NPEGKWEFFNLFQVIENPSNV

SEQ ID NO: 2690195 - protein, 17 aa, Entamoeba histolytica
NPEKCVFVQGNLVNASS

SEQ ID NO: 2690196 - protein, 18 aa, Entamoeba histolytica
NPELDEFIFLLSSKAGGC

SEQ ID NO: 2690197 - protein, 17 aa, Entamoeba histolytica
NPELITIPNQWKLVQEY

SEQ ID NO: 2690198 - protein, 19 aa, Entamoeba histolytica
NPELLRMMISNNPLMGMAG

SEQ ID NO: 2690199 - protein, 23 aa, Entamoeba histolytica
NPETRKKVYAYMRQSVYVKKTQE

SEQ ID NO: 2690200 - protein, 21 aa, Entamoeba histolytica
NPFFQKACTKIEFADFVSRVE

SEQ ID NO: 2690201 - protein, 17 aa, Entamoeba histolytica
NPFFRTICLTSFTEEQY

SEQ ID NO: 2690202 - protein, 18 aa, Entamoeba histolytica
NPFKGTWKEIIPLMEHAK

SEQ ID NO: 2690203 - protein, 19 aa, Entamoeba histolytica
NPFPDVMNFLDTFHGGHYK

SEQ ID NO: 2690204 - protein, 19 aa, Entamoeba histolytica
NPGIIKGIFSNYGKVSRMH

SEQ ID NO: 2690205 - protein, 23 aa, Entamoeba histolytica
NPHFPENIQIALKESFKQVNKGF

SEQ ID NO: 2690206 - protein, 25 aa, Entamoeba histolytica
NPIEIKEMYLSYLIGIIHGSLNSRG

SEQ ID NO: 2690207 - protein, 22 aa, Entamoeba histolytica
NPIELKETIKLVFSNIPETELF

SEQ ID NO: 2690208 - protein, 17 aa, Entamoeba histolytica
NPILKEYLTHFFQYIHF

SEQ ID NO: 2690209 - protein, 18 aa, Entamoeba histolytica
NPIMPSQPGFGLYGQPKP

SEQ ID NO: 2690210 - protein, 24 aa, Entamoeba histolytica
NPINLTNMIWKIPGNNRCAECGKL

SEQ ID NO: 2690211 - protein, 24 aa, Entamoeba histolytica
NPIPMNGCLYNLCQSQNLENNSFK

SEQ ID NO: 2690212 - protein, 21 aa, Entamoeba histolytica
NPIPQISIMFTRLVCLTNLLI

SEQ ID NO: 2690213 - protein, 19 aa, Entamoeba histolytica
NPISFDVFGMMLLVVENNS

SEQ ID NO: 2690214 - protein, 17 aa, Entamoeba histolytica
NPISTIIFLPLVNLQSF

SEQ ID NO: 2690215 - protein, 28 aa, Entamoeba histolytica
NPIVLGSTCYAFLQVCPNRFEFIHKHYI

SEQ ID NO: 2690216 - protein, 23 aa, Entamoeba histolytica
NPKESICGLFLLAQIFGDGEVMK

SEQ ID NO: 2690217 - protein, 22 aa, Entamoeba histolytica
NPKIQICCRFWYKTIDPKMVIV

SEQ ID NO: 2690218 - protein, 19 aa, Entamoeba histolytica
NPKKMKTILLKANSPEERT

SEQ ID NO: 2690219 - protein, 26 aa, Entamoeba histolytica
NPKLPCFNCPSLVYTEIDGIIHKLLS

SEQ ID NO: 2690220 - protein, 20 aa, Entamoeba histolytica
NPKMLKFILENGGRVEQLNG

SEQ ID NO: 2690221 - protein, 26 aa, Entamoeba histolytica
NPKSIPLKRIRFFTSHTIISDDVKNK

SEQ ID NO: 2690222 - protein, 19 aa, Entamoeba histolytica
NPKVSFTIVGKTLIVPEQF

SEQ ID NO: 2690223 - protein, 23 aa, Entamoeba histolytica
NPKYIARRMIRFATEDIGLADTN

SEQ ID NO: 2690224 - protein, 19 aa, Entamoeba histolytica
NPLFRGNTLFSRIYSLYLT

SEQ ID NO: 2690225 - protein, 18 aa, Entamoeba histolytica
NPLLRYSSQLPFRTPLTL

SEQ ID NO: 2690226 - protein, 17 aa, Entamoeba histolytica
NPLRIFKDLELVKEETR

SEQ ID NO: 2690227 - protein, 17 aa, Entamoeba histolytica
NPLSIGIKENPSIKHKN

SEQ ID NO: 2690228 - protein, 25 aa, Entamoeba histolytica
NPLWKVVSSYLFKRNECKIALNPFN

SEQ ID NO: 2690229 - protein, 17 aa, Entamoeba histolytica
NPLYIVAMPRSGSTFTH

SEQ ID NO: 2690230 - protein, 24 aa, Entamoeba histolytica
NPMAMKYGRIPQRVHVQDDMPDPV

SEQ ID NO: 2690231 - protein, 19 aa, Entamoeba histolytica
NPMHLFGLFASIGVQNHQF

SEQ ID NO: 2690232 - protein, 26 aa, Entamoeba histolytica
NPMVKWQVPDTFAFKYTELENELCIG

SEQ ID NO: 2690233 - protein, 17 aa, Entamoeba histolytica
NPMVRGVIQVCLVEPEL

SEQ ID NO: 2690234 - protein, 18 aa, Entamoeba histolytica
NPMYITTVGIDFRVKNIE

SEQ ID NO: 2690235 - protein, 21 aa, Entamoeba histolytica
NPNDFPFVVLVNKMDEDPSKH

SEQ ID NO: 2690236 - protein, 26 aa, Entamoeba histolytica
NPNFLFRSGTSFDIIFVDTELLQFES

SEQ ID NO: 2690237 - protein, 19 aa, Entamoeba histolytica
NPNLFDFYNPVFSTGSIVS

SEQ ID NO: 2690238 - protein, 19 aa, Entamoeba histolytica
NPNLIGFCVDYLCDNFEKN

SEQ ID NO: 2690239 - protein, 19 aa, Entamoeba histolytica
NPNSFYDKYFKGELDDEME

SEQ ID NO: 2690240 - protein, 24 aa, Entamoeba histolytica
NPNWLIEFLIGSSLRKGSQERAIE

SEQ ID NO: 2690241 - protein, 26 aa, Entamoeba histolytica
NPPSIYPHKRFYLKIQDIITQIGENN

SEQ ID NO: 2690242 - protein, 21 aa, Entamoeba histolytica
NPPSRAIVELQLKHGNGETKR

SEQ ID NO: 2690243 - protein, 17 aa, Entamoeba histolytica
NPPSWAEIIKYYRGSDL

SEQ ID NO: 2690244 - protein, 18 aa, Entamoeba histolytica
NPPVIWKVKNKRLAFLSF

SEQ ID NO: 2690245 - protein, 25 aa, Entamoeba histolytica
NPQEFKRIKECGGYTERGRVFGEYI

SEQ ID NO: 2690246 - protein, 30 aa, Entamoeba histolytica
NPQLRIPRTYKRFAGLMVQLLHKLSIHAAD

SEQ ID NO: 2690247 - protein, 21 aa, Entamoeba histolytica
NPQPTYGRPGTYKDNVVEQKQ

SEQ ID NO: 2690248 - protein, 17 aa, Entamoeba histolytica
NPQRVLTLFSILIHDKN

SEQ ID NO: 2690249 - protein, 18 aa, Entamoeba histolytica
NPQVKFVLIHEVNNLINN

SEQ ID NO: 2690250 - protein, 20 aa, Entamoeba histolytica
NPRKFKWTKAYRMTTGREMT

SEQ ID NO: 2690251 - protein, 19 aa, Entamoeba histolytica
NPRKIILYFDLLKVLLDNN

SEQ ID NO: 2690252 - protein, 25 aa, Entamoeba histolytica
NPRVRPTFIPGMHWDPAPGDYTSIR

SEQ ID NO: 2690253 - protein, 23 aa, Entamoeba histolytica
NPSGRLPTTFPITLSQPNLQSFP

SEQ ID NO: 2690254 - protein, 24 aa, Entamoeba histolytica
NPTLPTYRFESIVNLINADVAFID

SEQ ID NO: 2690255 - protein, 22 aa, Entamoeba histolytica
NPTPDVIFCLNTDHITKIKQTI

SEQ ID NO: 2690256 - protein, 19 aa, Entamoeba histolytica
NPVHFGLLCQELVKLVNEN

SEQ ID NO: 2690257 - protein, 20 aa, Entamoeba histolytica
NPVRGRACKHITCCDLKNVI

SEQ ID NO: 2690258 - protein, 21 aa, Entamoeba histolytica
NPVVYPFIMEFMGVVGSSIEF

SEQ ID NO: 2690259 - protein, 17 aa, Entamoeba histolytica
NPWIFWFESGKTSDKST

SEQ ID NO: 2690260 - protein, 19 aa, Entamoeba histolytica
NPYFLVPFLYPSQMMVLQN

SEQ ID NO: 2690261 - protein, 21 aa, Entamoeba histolytica
NPYWICPNGLIIIERDNKNYQ

SEQ ID NO: 2690262 - protein, 29 aa, Entamoeba histolytica
NQASAFVPFCFELKLVIIQQLICCNNLSI

SEQ ID NO: 2690263 - protein, 19 aa, Entamoeba histolytica
NQCFERRKAAEFEQVTAGY

SEQ ID NO: 2690264 - protein, 23 aa, Entamoeba histolytica
NQCIDLYELWFIKNEQVPQAILD

SEQ ID NO: 2690265 - protein, 17 aa, Entamoeba histolytica
NQCKPFDIKSERQKIQN

SEQ ID NO: 2690266 - protein, 25 aa, Entamoeba histolytica
NQCNISIKQLNTWFANYRSRTKKKF

SEQ ID NO: 2690267 - protein, 22 aa, Entamoeba histolytica
NQCWKLFNECVSEISLDNFPAN

SEQ ID NO: 2690268 - protein, 22 aa, Entamoeba histolytica
NQDIPRRKKCIINLKKTKNGFM

SEQ ID NO: 2690269 - protein, 19 aa, Entamoeba histolytica
NQDVFPVIIHRNAVFNVFA

SEQ ID NO: 2690270 - protein, 17 aa, Entamoeba histolytica
NQEAIGIIHEIAKTMKD

SEQ ID NO: 2690271 - protein, 24 aa, Entamoeba histolytica
NQEFKFDISKGILSRVERNPHLKW

SEQ ID NO: 2690272 - protein, 23 aa, Entamoeba histolytica
NQEFKSFCNEIIFKMQENKDKEY

SEQ ID NO: 2690273 - protein, 24 aa, Entamoeba histolytica
NQEKLEVLSSMGFDEIQAKTALRI

SEQ ID NO: 2690274 - protein, 23 aa, Entamoeba histolytica
NQELQKLLVFNGIFDVIFQAFDE

SEQ ID NO: 2690275 - protein, 19 aa, Entamoeba histolytica
NQFCRIFNPPTCNCNLLPV

SEQ ID NO: 2690276 - protein, 18 aa, Entamoeba histolytica
NQFFLLRGNHESFSVSSR

SEQ ID NO: 2690277 - protein, 17 aa, Entamoeba histolytica
NQFKIVFNPNGDPLYNE

SEQ ID NO: 2690278 - protein, 25 aa, Entamoeba histolytica
NQGEFLFILFIRRFVELLKNNGCKL

SEQ ID NO: 2690279 - protein, 21 aa, Entamoeba histolytica
NQGGSLGWVIRGQMCGAFQDV

SEQ ID NO: 2690280 - protein, 25 aa, Entamoeba histolytica
NQHIFKTGAPFSFRDSFSRVKDFPV

SEQ ID NO: 2690281 - protein, 24 aa, Entamoeba histolytica
NQIEILKNKMSRIIEECNNDEETL

SEQ ID NO: 2690282 - protein, 17 aa, Entamoeba histolytica
NQIEIMKRLLFGTYCST

SEQ ID NO: 2690283 - protein, 23 aa, Entamoeba histolytica
NQIESWCWFNGCMSLTAITLTTR

SEQ ID NO: 2690284 - protein, 19 aa, Entamoeba histolytica
NQIFKIVAGMLHLGNVEYS

SEQ ID NO: 2690285 - protein, 18 aa, Entamoeba histolytica
NQIFPSCETLQINVFNDS

SEQ ID NO: 2690286 - protein, 25 aa, Entamoeba histolytica
NQIKAFDLFKAAAFKKHPDSLYILG

SEQ ID NO: 2690287 - protein, 25 aa, Entamoeba histolytica
NQIKRQSSELMEIDNTFNFDNKKEE

SEQ ID NO: 2690288 - protein, 20 aa, Entamoeba histolytica
NQINCVRKGDINFTSNTHGS

SEQ ID NO: 2690289 - protein, 24 aa, Entamoeba histolytica
NQIPELPEKFSLLTNLEILELSCN

SEQ ID NO: 2690290 - protein, 22 aa, Entamoeba histolytica
NQIPLSIIIIFLLKQCTCSNEL

SEQ ID NO: 2690291 - protein, 24 aa, Entamoeba histolytica
NQIPNRRFTLWWSPTINRGSVYVG

SEQ ID NO: 2690292 - protein, 27 aa, Entamoeba histolytica
NQISEVCILKLLSVLNLHIKNVWKYPY

SEQ ID NO: 2690293 - protein, 20 aa, Entamoeba histolytica
NQISLRIAEFDKEIIQDNKE

SEQ ID NO: 2690294 - protein, 23 aa, Entamoeba histolytica
NQKAMRQTVCLEFMENTLGKKIK

SEQ ID NO: 2690295 - protein, 22 aa, Entamoeba histolytica
NQKEFLKPFVVIISDHPSVNVR

SEQ ID NO: 2690296 - protein, 17 aa, Entamoeba histolytica
NQKELLGDCLLQSQIQS

SEQ ID NO: 2690297 - protein, 17 aa, Entamoeba histolytica
NQKKYMVTFPFPYMNGR

SEQ ID NO: 2690298 - protein, 24 aa, Entamoeba histolytica
NQLFDFKVIYSLVIDKHNLKLSEF

SEQ ID NO: 2690299 - protein, 25 aa, Entamoeba histolytica
NQLFLERFLLCLIPISFNKKPQVIQ

SEQ ID NO: 2690300 - protein, 27 aa, Entamoeba histolytica
NQLGSEFFKKICSEHGILPDGSLSTNE

SEQ ID NO: 2690301 - protein, 17 aa, Entamoeba histolytica
NQLKWIVILNFFETPIE

SEQ ID NO: 2690302 - protein, 17 aa, Entamoeba histolytica
NQLNIIVIYSKKIHNVL

SEQ ID NO: 2690303 - protein, 22 aa, Entamoeba histolytica
NQLPFLFPGVPITYIVNPSNDP

SEQ ID NO: 2690304 - protein, 17 aa, Entamoeba histolytica
NQLPIAVESIYNYLYDK

SEQ ID NO: 2690305 - protein, 17 aa, Entamoeba histolytica
NQLPQRLLKVFETCQKI

SEQ ID NO: 2690306 - protein, 24 aa, Entamoeba histolytica
NQLRVLSPLICFLTSLVNLNLSRN

SEQ ID NO: 2690307 - protein, 25 aa, Entamoeba histolytica
NQLSCKNVELIWRCEIKQREYNKQR

SEQ ID NO: 2690308 - protein, 26 aa, Entamoeba histolytica
NQLSLSFIEICKFLEYYQQKARIVLS

SEQ ID NO: 2690309 - protein, 24 aa, Entamoeba histolytica
NQLTELPSFFSLLSNLNSLDIDHN

SEQ ID NO: 2690310 - protein, 26 aa, Entamoeba histolytica
NQMEIWPRIVKLYHYIGNESDILLDG

SEQ ID NO: 2690311 - protein, 20 aa, Entamoeba histolytica
NQMFCGCIAGIPAQFTTEKY

SEQ ID NO: 2690312 - protein, 20 aa, Entamoeba histolytica
NQMFSVDFGKIFIGSDEIQS

SEQ ID NO: 2690313 - protein, 19 aa, Entamoeba histolytica
NQMIYRFVTSYESFREQFF

SEQ ID NO: 2690314 - protein, 26 aa, Entamoeba histolytica
NQMKLSLYLNLALCYLKVDKLNKALD

SEQ ID NO: 2690315 - protein, 24 aa, Entamoeba histolytica
NQNKEVDEFLSAFTVVKQEEDNKK

SEQ ID NO: 2690316 - protein, 24 aa, Entamoeba histolytica
NQNLTEFIVCISKLLELDECIHVK

SEQ ID NO: 2690317 - protein, 23 aa, Entamoeba histolytica
NQPCSPMGFILPFFLSIYLRSIK

SEQ ID NO: 2690318 - protein, 21 aa, Entamoeba histolytica
NQPLCCKSALLSVVNVLLAER

SEQ ID NO: 2690319 - protein, 17 aa, Entamoeba histolytica
NQPLLSVVENLQPPIIN

SEQ ID NO: 2690320 - protein, 32 aa, Entamoeba histolytica
NQPTLRFSVQTSFRLLYKMIKILEYIHSKQIL

SEQ ID NO: 2690321 - protein, 24 aa, Entamoeba histolytica
NQQFKYSICFQWLSIPFHRKKEAL

SEQ ID NO: 2690322 - protein, 21 aa, Entamoeba histolytica
NQQPTPRFSVINEQQTHKPIK

SEQ ID NO: 2690323 - protein, 22 aa, Entamoeba histolytica
NQQTKKRVCFIVDEAIVSTLMT

SEQ ID NO: 2690324 - protein, 19 aa, Entamoeba histolytica
NQQYPGYPIQQSMNSQQPV

SEQ ID NO: 2690325 - protein, 18 aa, Entamoeba histolytica
NQRAVICDFGMSIIDQPP

SEQ ID NO: 2690326 - protein, 17 aa, Entamoeba histolytica
NQRCEICQQFGKMTHVF

SEQ ID NO: 2690327 - protein, 25 aa, Entamoeba histolytica
NQSCYSVLYYDYWPSNSYQNILQFI

SEQ ID NO: 2690328 - protein, 22 aa, Entamoeba histolytica
NQSRTSFKLMIYSMSDISMSQH

SEQ ID NO: 2690329 - protein, 19 aa, Entamoeba histolytica
NQSTCLMCFCGELNEETKV

SEQ ID NO: 2690330 - protein, 25 aa, Entamoeba histolytica
NQSVFTRREIDEWTDGIRFNPDIVV

SEQ ID NO: 2690331 - protein, 17 aa, Entamoeba histolytica
NQTCKDLQKALVEELYK

SEQ ID NO: 2690332 - protein, 20 aa, Entamoeba histolytica
NQTFNFLSTFIVKSQKEGTY

SEQ ID NO: 2690333 - protein, 24 aa, Entamoeba histolytica
NQTHFLECYGAFILESDSNSKRSQ

SEQ ID NO: 2690334 - protein, 24 aa, Entamoeba histolytica
NQTNNIFGGFSFNGFGTTDKKKDE

SEQ ID NO: 2690335 - protein, 26 aa, Entamoeba histolytica
NQVCHFLNVFKGCIQDITWLPGGLRM

SEQ ID NO: 2690336 - protein, 22 aa, Entamoeba histolytica
NQWLRRRRATAVSVIPKYQDYS

SEQ ID NO: 2690337 - protein, 19 aa, Entamoeba histolytica
NQYDCAVTIFAEVSKKEKK

SEQ ID NO: 2690338 - protein, 24 aa, Entamoeba histolytica
NQYKTRNVMKLIYLDLLGYNTQFA

SEQ ID NO: 2690339 - protein, 30 aa, Entamoeba histolytica
NQYWYWYPFTLCLSLSFIPTTIIGVTEDLK

SEQ ID NO: 2690340 - protein, 23 aa, Entamoeba histolytica
NRAEYNPFLLFCRDHRENVREKG

SEQ ID NO: 2690341 - protein, 24 aa, Entamoeba histolytica
NRAIKLRAEKVIREIDRKRKSLLN

SEQ ID NO: 2690342 - protein, 23 aa, Entamoeba histolytica
NRARAALDGIDFAKEKIAFYGTH

SEQ ID NO: 2690343 - protein, 17 aa, Entamoeba histolytica
NRAVALTALSAFKAKEY

SEQ ID NO: 2690344 - protein, 23 aa, Entamoeba histolytica
NRDFDLSIFCLRSKKLQTPSLFR

SEQ ID NO: 2690345 - protein, 18 aa, Entamoeba histolytica
NRDSRFDTTIAYINMNSH

SEQ ID NO: 2690346 - protein, 18 aa, Entamoeba histolytica
NREEFKKKVRRCVRKSIE

SEQ ID NO: 2690347 - protein, 17 aa, Entamoeba histolytica
NREGAELMVSYSQATFA

SEQ ID NO: 2690348 - protein, 26 aa, Entamoeba histolytica
NRETSFIFTCHGAFWVLSDGKVYIHQ

SEQ ID NO: 2690349 - protein, 30 aa, Entamoeba histolytica
NRFCTCIENKHCRVCGCHHTEHVNESCKYE

SEQ ID NO: 2690350 - protein, 28 aa, Entamoeba histolytica
NRFGPSDMKVAEKIFLGRRERTKEVRRA

SEQ ID NO: 2690351 - protein, 25 aa, Entamoeba histolytica
NRFKEPPEDGLFCDLLWSDPLQYDV

SEQ ID NO: 2690352 - protein, 21 aa, Entamoeba histolytica
NRFLDVAGFVPALSKVYITCA

SEQ ID NO: 2690353 - protein, 17 aa, Entamoeba histolytica
NRFNIVGDIHNIFNEVE

SEQ ID NO: 2690354 - protein, 17 aa, Entamoeba histolytica
NRFSLKRLDAVTDKVNL

SEQ ID NO: 2690355 - protein, 20 aa, Entamoeba histolytica
NRGVFGWGRKVMKKEKIKGY

SEQ ID NO: 2690356 - protein, 29 aa, Entamoeba histolytica
NRHIIVWDRRFTKGIKFFDLKANSLKRMT

SEQ ID NO: 2690357 - protein, 17 aa, Entamoeba histolytica
NRHLPIKIILIVEGLTF

SEQ ID NO: 2690358 - protein, 18 aa, Entamoeba histolytica
NRIHSFLYSGYWGNIIAR

SEQ ID NO: 2690359 - protein, 25 aa, Entamoeba histolytica
NRIIKKVRICRSVVYQFNAMKTINK

SEQ ID NO: 2690360 - protein, 20 aa, Entamoeba histolytica
NRIINVLLCLIRDNTEQAMF

SEQ ID NO: 2690361 - protein, 19 aa, Entamoeba histolytica
NRIKACITLSEKMNPDEFY

SEQ ID NO: 2690362 - protein, 23 aa, Entamoeba histolytica
NRIKISMGCSAFEKYVRNNQSVI

SEQ ID NO: 2690363 - protein, 20 aa, Entamoeba histolytica
NRIKLKFLRIEYSLYDRDDF

SEQ ID NO: 2690364 - protein, 36 aa, Entamoeba histolytica
NRILIALTNMCHLHGWKLDSSYTIPTQIVLPTGHSQ

SEQ ID NO: 2690365 - protein, 19 aa, Entamoeba histolytica
NRIMICLLGASSGVEGIGK

SEQ ID NO: 2690366 - protein, 17 aa, Entamoeba histolytica
NRISLKAGPNMFTNTFL

SEQ ID NO: 2690367 - protein, 23 aa, Entamoeba histolytica
NRKAEMLDYLGVAFGYTPQLSKF

SEQ ID NO: 2690368 - protein, 17 aa, Entamoeba histolytica
NRKELIDPALLRPGRFD

SEQ ID NO: 2690369 - protein, 30 aa, Entamoeba histolytica
NRKHHCRLCGRCVCSNCSKAKIPLNSKGEI

SEQ ID NO: 2690370 - protein, 24 aa, Entamoeba histolytica
NRKIFNYQEFDIFGGKNPYDNMTT

SEQ ID NO: 2690371 - protein, 22 aa, Entamoeba histolytica
NRKLWNELFYWNSFNTPLTKEL

SEQ ID NO: 2690372 - protein, 22 aa, Entamoeba histolytica
NRKRIFKNWGNDDVTSYLDTLC

SEQ ID NO: 2690373 - protein, 20 aa, Entamoeba histolytica
NRKRIVNEYLVKHKNHQLLI

SEQ ID NO: 2690374 - protein, 21 aa, Entamoeba histolytica
NRKRKYGAWIGGKMFASLSSF

SEQ ID NO: 2690375 - protein, 18 aa, Entamoeba histolytica
NRKTCDLDKVIQLALKFK

SEQ ID NO: 2690376 - protein, 24 aa, Entamoeba histolytica
NRKVDFNPLLGIVSVKAHCFGNIE

SEQ ID NO: 2690377 - protein, 17 aa, Entamoeba histolytica
NRKVIGISFHNQPSILN

SEQ ID NO: 2690378 - protein, 25 aa, Entamoeba histolytica
NRLEAFIFMIYRMIDLYSNQKNYSS

SEQ ID NO: 2690379 - protein, 25 aa, Entamoeba histolytica
NRLIKYNSIHMMTLKNFAMILGPLV

SEQ ID NO: 2690380 - protein, 19 aa, Entamoeba histolytica
NRLKMKWPSNESCINLNQQ

SEQ ID NO: 2690381 - protein, 21 aa, Entamoeba histolytica
NRLKVSPNLSMLSKISRLDIS

SEQ ID NO: 2690382 - protein, 22 aa, Entamoeba histolytica
NRLLFELFVTLIFNEREEDVAK

SEQ ID NO: 2690383 - protein, 24 aa, Entamoeba histolytica
NRLNRLPESLGRLISVTYLDARNN

SEQ ID NO: 2690384 - protein, 24 aa, Entamoeba histolytica
NRLQSFTIANNWLFSCNSNSLVNG

SEQ ID NO: 2690385 - protein, 27 aa, Entamoeba histolytica
NRMGLSRGRAGVITRASFEQTLEQFRR

SEQ ID NO: 2690386 - protein, 18 aa, Entamoeba histolytica
NRMLKITPFDLVNKIVMK

SEQ ID NO: 2690387 - protein, 21 aa, Entamoeba histolytica
NRMQIVPAVDGFVIDSAITKI

SEQ ID NO: 2690388 - protein, 17 aa, Entamoeba histolytica
NRMQIVPAVDGYVIDSA

SEQ ID NO: 2690389 - protein, 17 aa, Entamoeba histolytica
NRNDVEPEFDLQFLRSV

SEQ ID NO: 2690390 - protein, 23 aa, Entamoeba histolytica
NRNEIEGEFSLFGGEHDALFIEQ

SEQ ID NO: 2690391 - protein, 20 aa, Entamoeba histolytica
NRNGLKMFSAILLDNKPNSY

SEQ ID NO: 2690392 - protein, 19 aa, Entamoeba histolytica
NRNIICKQVKFTKQDRENL

SEQ ID NO: 2690393 - protein, 18 aa, Entamoeba histolytica
NRNIKWKVKEEIVDFDAC

SEQ ID NO: 2690394 - protein, 18 aa, Entamoeba histolytica
NRNKCKFVGTPGYTAPEV

SEQ ID NO: 2690395 - protein, 17 aa, Entamoeba histolytica
NRNLVCVHCSAGVGRTG

SEQ ID NO: 2690396 - protein, 19 aa, Entamoeba histolytica
NRNPLCIKKYIITERDIES

SEQ ID NO: 2690397 - protein, 25 aa, Entamoeba histolytica
NRPKASKEDMEWLKKVMDSIESDAK

SEQ ID NO: 2690398 - protein, 29 aa, Entamoeba histolytica
NRPKRDIIMGVAYLEWARNKYSQILKNTD

SEQ ID NO: 2690399 - protein, 25 aa, Entamoeba histolytica
NRPKRPPTPYFIYLNEHRASIKEEH

SEQ ID NO: 2690400 - protein, 25 aa, Entamoeba histolytica
NRPKRPPTPYFLYLNEHRASIKEEH

SEQ ID NO: 2690401 - protein, 21 aa, Entamoeba histolytica
NRPKRRFNRRPGYVNRNNRNR

SEQ ID NO: 2690402 - protein, 22 aa, Entamoeba histolytica
NRPKSFNARPVINHSDGTKQRF

SEQ ID NO: 2690403 - protein, 17 aa, Entamoeba histolytica
NRPLSFLSGYVICVSGY

SEQ ID NO: 2690404 - protein, 19 aa, Entamoeba histolytica
NRQFPYLFIDCRRQESFDL

SEQ ID NO: 2690405 - protein, 18 aa, Entamoeba histolytica
NRRGNMVLHLNVNYPTTL

SEQ ID NO: 2690406 - protein, 23 aa, Entamoeba histolytica
NRRRIGHNLFWFLKAEIHDARVT

SEQ ID NO: 2690407 - protein, 24 aa, Entamoeba histolytica
NRSFGRSWLSPRNLLQSPKFNTLC

SEQ ID NO: 2690408 - protein, 23 aa, Entamoeba histolytica
NRSKESWINNGLLYLLKKCGYNF

SEQ ID NO: 2690409 - protein, 25 aa, Entamoeba histolytica
NRSLRLIKLYGEFITMLNSIVPKKD

SEQ ID NO: 2690410 - protein, 20 aa, Entamoeba histolytica
NRSVKLFLLRWKKNNHYIID

SEQ ID NO: 2690411 - protein, 18 aa, Entamoeba histolytica
NRTDPIFIALEGCPKSDN

SEQ ID NO: 2690412 - protein, 21 aa, Entamoeba histolytica
NRTSYSYLPLAHVFEHEVTYI

SEQ ID NO: 2690413 - protein, 20 aa, Entamoeba histolytica
NRTVVKRTIFKCGHCMCDQC

SEQ ID NO: 2690414 - protein, 20 aa, Entamoeba histolytica
NRTYILGMVWTMILKYKINA

SEQ ID NO: 2690415 - protein, 21 aa, Entamoeba histolytica
NRTYILGMVWTMILKYKINAN

SEQ ID NO: 2690416 - protein, 19 aa, Entamoeba histolytica
NRVLAQISKICFVDTVSIP

SEQ ID NO: 2690417 - protein, 19 aa, Entamoeba histolytica
NRVNYYLTREEELLNNKSY

SEQ ID NO: 2690418 - protein, 21 aa, Entamoeba histolytica
NRWSSKCSREKKKDKFIEIQQ

SEQ ID NO: 2690419 - protein, 20 aa, Entamoeba histolytica
NRYFGHLKRLGITESDITAS

SEQ ID NO: 2690420 - protein, 23 aa, Entamoeba histolytica
NRYKSKVVQFIVCDETKSSGEII

SEQ ID NO: 2690421 - protein, 20 aa, Entamoeba histolytica
NRYPHFVWMLNFKGKKMTKK

SEQ ID NO: 2690422 - protein, 21 aa, Entamoeba histolytica
NRYYHEKCLLAFVSTNEAYCC

SEQ ID NO: 2690423 - protein, 20 aa, Entamoeba histolytica
NRYYIQIPFSQLDKYKEKFL

SEQ ID NO: 2690424 - protein, 24 aa, Entamoeba histolytica
NSADEMMLILSFLKSDYPITAQFY

SEQ ID NO: 2690425 - protein, 17 aa, Entamoeba histolytica
NSAICFATPRRDLRSNS

SEQ ID NO: 2690426 - protein, 24 aa, Entamoeba histolytica
NSAIQCLIHTTPLVQFFQKDDWKK

SEQ ID NO: 2690427 - protein, 19 aa, Entamoeba histolytica
NSAMIVCMILSRLSSTNLI

SEQ ID NO: 2690428 - protein, 30 aa, Entamoeba histolytica
NSAPMATLFFARLGPMMKEEILKKVCNQYG

SEQ ID NO: 2690429 - protein, 21 aa, Entamoeba histolytica
NSCCEVGYWLSPKFQHHGIMT

SEQ ID NO: 2690430 - protein, 17 aa, Entamoeba histolytica
NSCFEGCSSLKSIEIPT

SEQ ID NO: 2690431 - protein, 18 aa, Entamoeba histolytica
NSCGCDFVQTEAVQWSSV

SEQ ID NO: 2690432 - protein, 26 aa, Entamoeba histolytica
NSCNEYKIEILMSMMSNQWFWTEIEK

SEQ ID NO: 2690433 - protein, 25 aa, Entamoeba histolytica
NSDAVTCFEKALSIKYCVQNELYLA

SEQ ID NO: 2690434 - protein, 24 aa, Entamoeba histolytica
NSDEKDQVFGLIELNRCRKLFGQI

SEQ ID NO: 2690435 - protein, 24 aa, Entamoeba histolytica
NSDEWKKSIELVIKNADYHYLVNE

SEQ ID NO: 2690436 - protein, 24 aa, Entamoeba histolytica
NSDFMKGKCLYRLYDYDDDEAWMK

SEQ ID NO: 2690437 - protein, 27 aa, Entamoeba histolytica
NSDGLFIYEMEIEKEFIIYNYLIYYIL

SEQ ID NO: 2690438 - protein, 22 aa, Entamoeba histolytica
NSEAVGECLKALEIMAKSKIVV

SEQ ID NO: 2690439 - protein, 27 aa, Entamoeba histolytica
NSEEIMNFVALCLIKNSRQRATITQLK

SEQ ID NO: 2690440 - protein, 24 aa, Entamoeba histolytica
NSELNLANAVLFCILDLNNDGKIP

SEQ ID NO: 2690441 - protein, 17 aa, Entamoeba histolytica
NSELTNFMNLWADHANV

SEQ ID NO: 2690442 - protein, 18 aa, Entamoeba histolytica
NSEMINWIIEIIQGISVT

SEQ ID NO: 2690443 - protein, 27 aa, Entamoeba histolytica
NSEMINWIIEIIRGILITTYPPKKIYF

SEQ ID NO: 2690444 - protein, 30 aa, Entamoeba histolytica; identical to SEQ ID NO: 2498699

SEQ ID NO: 2690445 - protein, 22 aa, Entamoeba histolytica
NSETRIKYEFIIDPSAFHELQT

SEQ ID NO: 2690446 - protein, 24 aa, Entamoeba histolytica
NSEYERIRFLFLTSALLKAVDEHY

SEQ ID NO: 2690447 - protein, 31 aa, Entamoeba histolytica
NSEYMKWLKKRVVDLMAVFPSYMRIKRFIIV

SEQ ID NO: 2690448 - protein, 22 aa, Entamoeba histolytica
NSFCQNTKFLAAPALKILVRLC

SEQ ID NO: 2690449 - protein, 21 aa, Entamoeba histolytica
NSFECPVEIGISNMCGKRDSM

SEQ ID NO: 2690450 - protein, 19 aa, Entamoeba histolytica
NSFIKFISHQDIENEIDIQ

SEQ ID NO: 2690451 - protein, 18 aa, Entamoeba histolytica
NSFIPPKDVKILFRQNTT

SEQ ID NO: 2690452 - protein, 18 aa, Entamoeba histolytica
NSFLHCTKLKNVYVMNSN

SEQ ID NO: 2690453 - protein, 20 aa, Entamoeba histolytica
NSFNKPASTYGGYHDDPQPT

SEQ ID NO: 2690454 - protein, 23 aa, Entamoeba histolytica
NSFNQLICVIGFEDGVQLKIGER

SEQ ID NO: 2690455 - protein, 17 aa, Entamoeba histolytica
NSFSFGSFNGYFKPKWF

SEQ ID NO: 2690456 - protein, 32 aa, Entamoeba histolytica
NSFSKRLRKSEVRLDRKISCLHKVSSNNSIIN

SEQ ID NO: 2690457 - protein, 18 aa, Entamoeba histolytica
NSGCKHLLGTYALFQHLE

SEQ ID NO: 2690458 - protein, 22 aa, Entamoeba histolytica
NSGLMKWCLFMSEQIDKLDVKE

SEQ ID NO: 2690459 - protein, 22 aa, Entamoeba histolytica
NSGVFRPEMLRTMGVPEDITVI

SEQ ID NO: 2690460 - protein, 24 aa, Entamoeba histolytica
NSHFSLIIICFDKTSGFSDLNEVD

SEQ ID NO: 2690461 - protein, 24 aa, Entamoeba histolytica
NSHKLGDVFYQYELDNHKNDILKF

SEQ ID NO: 2690462 - protein, 25 aa, Entamoeba histolytica
NSHLKRLNFKQEIKWIQVYQDELYV

SEQ ID NO: 2690463 - protein, 19 aa, Entamoeba histolytica
NSHVIELIRNWSFGTSNNE

SEQ ID NO: 2690464 - protein, 17 aa, Entamoeba histolytica
NSICADDSFKMNISTVM

SEQ ID NO: 2690465 - protein, 19 aa, Entamoeba histolytica
NSICFKKGQLPTFIYRGCQ

SEQ ID NO: 2690466 - protein, 25 aa, Entamoeba histolytica
NSICPNISFSQIFAIIAKIEPPVNI

SEQ ID NO: 2690467 - protein, 25 aa, Entamoeba histolytica
NSIDEWTSRIDFSFLEHQKKHNSTT

SEQ ID NO: 2690468 - protein, 21 aa, Entamoeba histolytica
NSIERKGYWHRIVRKLKECLT

SEQ ID NO: 2690469 - protein, 18 aa, Entamoeba histolytica
NSIFEFELEHCINRYGII

SEQ ID NO: 2690470 - protein, 27 aa, Entamoeba histolytica
NSIFREGYLLFFRICDVYFEELSKNYQ

SEQ ID NO: 2690471 - protein, 25 aa, Entamoeba histolytica
NSIIKSFFPMNSMSPNLLDKVYSSV

SEQ ID NO: 2690472 - protein, 17 aa, Entamoeba histolytica
NSIKAIDVFQPDKYYFI

SEQ ID NO: 2690473 - protein, 23 aa, Entamoeba histolytica
NSIKIWDIRSITPLCTIPFSTKM

SEQ ID NO: 2690474 - protein, 24 aa, Entamoeba histolytica
NSIVPVVPEEAGATSGEDTATTSQ

SEQ ID NO: 2690475 - protein, 19 aa, Entamoeba histolytica
NSIVSSVLIRFLVEKYDQH

SEQ ID NO: 2690476 - protein, 17 aa, Entamoeba histolytica
NSKDFLCSHCLKSQSKI

SEQ ID NO: 2690477 - protein, 22 aa, Entamoeba histolytica
NSKELKMFIGLNENDMKFISNE

SEQ ID NO: 2690478 - protein, 19 aa, Entamoeba histolytica
NSKLLRFPIGINDTNESIN

SEQ ID NO: 2690479 - protein, 20 aa, Entamoeba histolytica
NSKMITCVMNILIDEVVAKK

SEQ ID NO: 2690480 - protein, 21 aa, Entamoeba histolytica
NSKPCPVINFNLDLSQTQNID

SEQ ID NO: 2690481 - protein, 17 aa, Entamoeba histolytica
NSKRSQIDYSFPGNYDV

SEQ ID NO: 2690482 - protein, 21 aa, Entamoeba histolytica
NSKVFLISLMNSMKNLCIIDG

SEQ ID NO: 2690483 - protein, 26 aa, Entamoeba histolytica
NSLDVLVCLQLDFSNYPPLKKRKENL

SEQ ID NO: 2690484 - protein, 22 aa, Entamoeba histolytica
NSLERFPAVKIPKTNEEVTEEK

SEQ ID NO: 2690485 - protein, 17 aa, Entamoeba histolytica
NSLFDFGSTPSQPKQQP

SEQ ID NO: 2690486 - protein, 24 aa, Entamoeba histolytica
NSLHGVGLGRSCDVELIRNIGRIG

SEQ ID NO: 2690487 - protein, 25 aa, Entamoeba histolytica
NSLHGVGLGRSCDVELIRNIGRIGN

SEQ ID NO: 2690488 - protein, 22 aa, Entamoeba histolytica
NSLIFERPRYWTLTNYLTTNEE

SEQ ID NO: 2690489 - protein, 18 aa, Entamoeba histolytica
NSLKCLRNKCFVNCYSLH

SEQ ID NO: 2690490 - protein, 17 aa, Entamoeba histolytica
NSLKFKFSKRSNHFIAF

SEQ ID NO: 2690491 - protein, 26 aa, Entamoeba histolytica
NSLKRNGYEIIQFLIKMIFTSPQNSI

SEQ ID NO: 2690492 - protein, 17 aa, Entamoeba histolytica
NSLLHFCQRFNTISISL

SEQ ID NO: 2690493 - protein, 19 aa, Entamoeba histolytica
NSLNELIELILNRKEYNGY

SEQ ID NO: 2690494 - protein, 18 aa, Entamoeba histolytica
NSLPLFFLKNKKIPIDSQ

SEQ ID NO: 2690495 - protein, 26 aa, Entamoeba histolytica
NSLRRMLDCSKSVRIVWPNLDDPSVP

SEQ ID NO: 2690496 - protein, 19 aa, Entamoeba histolytica
NSLTGSFIMLRYINPAIFS

SEQ ID NO: 2690497 - protein, 21 aa, Entamoeba histolytica
NSMIQCFVPLFQQNSNKLIMV

SEQ ID NO: 2690498 - protein, 19 aa, Entamoeba histolytica
NSMKILVGLGREFESQQEV

SEQ ID NO: 2690499 - protein, 25 aa, Entamoeba histolytica
NSMKKRRATLISGKEKHEFIETLGS

SEQ ID NO: 2690500 - protein, 23 aa, Entamoeba histolytica
NSMLQSERICFIATISSSISNAV

SEQ ID NO: 2690501 - protein, 19 aa, Entamoeba histolytica
NSMYELWILGALDEIGNIT

SEQ ID NO: 2690502 - protein, 17 aa, Entamoeba histolytica
NSMYIDFALNQNDENIN

SEQ ID NO: 2690503 - protein, 24 aa, Entamoeba histolytica
NSNEKIYGIGFLFILNDKKTKYDV

SEQ ID NO: 2690504 - protein, 19 aa, Entamoeba histolytica
NSNFSRIIFKLNIKKANTM

SEQ ID NO: 2690505 - protein, 33 aa, Entamoeba histolytica
NSNGLVLYSICNKLFKQLCCAVIYIEEKYEFVH

SEQ ID NO: 2690506 - protein, 19 aa, Entamoeba histolytica
NSNGRLCSLETDMEKDEQS

SEQ ID NO: 2690507 - protein, 28 aa, Entamoeba histolytica
NSNGVIFCKNCGIILDKSAIEYLPEEDK

SEQ ID NO: 2690508 - protein, 25 aa, Entamoeba histolytica
NSPFISFKLIMEGHIEVIEEIECAI

SEQ ID NO: 2690509 - protein, 21 aa, Entamoeba histolytica
NSPKKIPFVFHYDTQNVLISL

SEQ ID NO: 2690510 - protein, 21 aa, Entamoeba histolytica
NSPSEGCLFVFSKTQTNYFIS

SEQ ID NO: 2690511 - protein, 17 aa, Entamoeba histolytica
NSQCLYDKAILNLIIGD

SEQ ID NO: 2690512 - protein, 18 aa, Entamoeba histolytica
NSQLFSWYKGQQALELAE

SEQ ID NO: 2690513 - protein, 20 aa, Entamoeba histolytica
NSQLLFSYFVENERLAELIE

SEQ ID NO: 2690514 - protein, 25 aa, Entamoeba histolytica
NSQSKRCRELLPVLVNAEHTILLSG

SEQ ID NO: 2690515 - protein, 22 aa, Entamoeba histolytica
NSQSKWNIWSWWSQPNQEFTDA

SEQ ID NO: 2690516 - protein, 17 aa, Entamoeba histolytica
NSRGVKGIRTFHLTVDT

SEQ ID NO: 2690517 - protein, 17 aa, Entamoeba histolytica
NSRTEIKLSEMKRQLNV

SEQ ID NO: 2690518 - protein, 23 aa, Entamoeba histolytica
NSSFKNLFHRTTELCETIDKQWG

SEQ ID NO: 2690519 - protein, 18 aa, Entamoeba histolytica
NSSFVVKYFLDVTFKEPT

SEQ ID NO: 2690520 - protein, 20 aa, Entamoeba histolytica
NSSIIKIALINAIASKKTSL

SEQ ID NO: 2690521 - protein, 22 aa, Entamoeba histolytica
NSSKVLCLFDYYSTDILELSFK

SEQ ID NO: 2690522 - protein, 19 aa, Entamoeba histolytica
NSSLHHIYSIFKLNDRENQ

SEQ ID NO: 2690523 - protein, 25 aa, Entamoeba histolytica
NSSLIKILWNYNIKYKTIILSDEKS

SEQ ID NO: 2690524 - protein, 21 aa, Entamoeba histolytica
NSSLMLKAFFTMLKRFYPDRV

SEQ ID NO: 2690525 - protein, 25 aa, Entamoeba histolytica
NSSQRILSLIARLQFDMMEKETYPS

SEQ ID NO: 2690526 - protein, 22 aa, Entamoeba histolytica
NSSTKQPTTWSRKMSLERSPKK

SEQ ID NO: 2690527 - protein, 19 aa, Entamoeba histolytica
NSTAIIWNRYAVIADQNGI

SEQ ID NO: 2690528 - protein, 17 aa, Entamoeba histolytica
NSTECYVFLLTNLNAIC

SEQ ID NO: 2690529 - protein, 34 aa, Entamoeba histolytica
NSTGFKEPFCGWYHSHPSYKCWLSGIDVATEKLH

SEQ ID NO: 2690530 - protein, 18 aa, Entamoeba histolytica
NSTIGELENKLMLQENNI

SEQ ID NO: 2690531 - protein, 29 aa, Entamoeba histolytica
NSTISLMCVCPLFPGEFTYKVLLLSDCYI

SEQ ID NO: 2690532 - protein, 22 aa, Entamoeba histolytica
NSTKSNCLLLLLQLTSVDPSVS

SEQ ID NO: 2690533 - protein, 33 aa, Entamoeba histolytica
NSTRKKRIAIGIAKVMMKWCDRRIKLLDKVSCT

SEQ ID NO: 2690534 - protein, 22 aa, Entamoeba histolytica
NSTRSGIRLGMRKGTPSPSSTP

SEQ ID NO: 2690535 - protein, 19 aa, Entamoeba histolytica
NSTTHCFFHDKIISKLDSA

SEQ ID NO: 2690536 - protein, 21 aa, Entamoeba histolytica
NSVDDNVCWLLVGCKSDLVNS

SEQ ID NO: 2690537 - protein, 34 aa, Entamoeba histolytica
NSVFWKMARIIVPLCSDWEQWKSFSITNNISFRK

SEQ ID NO: 2690538 - protein, 17 aa, Entamoeba histolytica
NSWGTTWGENGYFNIAI

SEQ ID NO: 2690539 - protein, 22 aa, Entamoeba histolytica
NSYCRELLFPLVIDESNIGVDN

SEQ ID NO: 2690540 - protein, 19 aa, Entamoeba histolytica
NSYDIFAIITINKDINPTV

SEQ ID NO: 2690541 - protein, 24 aa, Entamoeba histolytica
NSYGVLRFRILSNIIINKQPQLDR

SEQ ID NO: 2690542 - protein, 19 aa, Entamoeba histolytica
NSYHFILISYFDLRDAKTV

SEQ ID NO: 2690543 - protein, 24 aa, Entamoeba histolytica
NSYIKELFNFRGLLKAQLDMAYRD

SEQ ID NO: 2690544 - protein, 18 aa, Entamoeba histolytica
NSYKRTPRLILLTKSLSN

SEQ ID NO: 2690545 - protein, 23 aa, Entamoeba histolytica
NSYPKMYIIHGFFNSQCFDRKYE

SEQ ID NO: 2690546 - protein, 28 aa, Entamoeba histolytica
NSYYLERLFCFYIPIITRCSVSVIDSTS

SEQ ID NO: 2690547 - protein, 24 aa, Entamoeba histolytica
NTALMKRTGYRQCNSNKMMKNGKG

SEQ ID NO: 2690548 - protein, 17 aa, Entamoeba histolytica
NTCIVGYLPYFKQTQVL

SEQ ID NO: 2690549 - protein, 25 aa, Entamoeba histolytica
NTCKLHYRMIEFNKPVKMNTFIANE

SEQ ID NO: 2690550 - protein, 26 aa, Entamoeba histolytica
NTDDFIYKFIRVCVMNNIGLSGPALD

SEQ ID NO: 2690551 - protein, 22 aa, Entamoeba histolytica
NTEGCPAFYKFLDLLGNKIELH

SEQ ID NO: 2690552 - protein, 26 aa, Entamoeba histolytica
NTEGRGVCLRFPRYIRSRDDKEVNDI

SEQ ID NO: 2690553 - protein, 24 aa, Entamoeba histolytica
NTELFNRPSIFLFIFDENNNVFGW

SEQ ID NO: 2690554 - protein, 18 aa, Entamoeba histolytica
NTELPINLLTQLKKLAIY

SEQ ID NO: 2690555 - protein, 26 aa, Entamoeba histolytica
NTFFYRRIRSNPSYYFVEGREMSIIS

SEQ ID NO: 2690556 - protein, 18 aa, Entamoeba histolytica
NTFLKYYTNFMVGYVSYG

SEQ ID NO: 2690557 - protein, 19 aa, Entamoeba histolytica
NTFPKKPKKAFVTVKDPDM

SEQ ID NO: 2690558 - protein, 18 aa, Entamoeba histolytica
NTFQLFLILSEFHQKQYQ

SEQ ID NO: 2690559 - protein, 23 aa, Entamoeba histolytica
NTFSLACELVRLAPTPLNPRIQD

SEQ ID NO: 2690560 - protein, 23 aa, Entamoeba histolytica
NTFTFKSSYFLAYSPINDVFYFN

SEQ ID NO: 2690561 - protein, 24 aa, Entamoeba histolytica
NTFYLFCLTYGYSPVYEILNKKYC

SEQ ID NO: 2690562 - protein, 24 aa, Entamoeba histolytica
NTGDCKCLLIKQDGFIQLTVEHRP

SEQ ID NO: 2690563 - protein, 17 aa, Entamoeba histolytica
NTGDCRCLLIGDDYFLP

SEQ ID NO: 2690564 - protein, 26 aa, Entamoeba histolytica
NTGKPLKPIMLWYSEHIYRETYITSN

SEQ ID NO: 2690565 - protein, 26 aa, Entamoeba histolytica
NTGNVLFRKSRVIRCKEIEEENERVK

SEQ ID NO: 2690566 - protein, 23 aa, Entamoeba histolytica
NTHCINFSSGVGMVEMIYESNGI

SEQ ID NO: 2690567 - protein, 17 aa, Entamoeba histolytica
NTHPIAVSSAYFAYPTY

SEQ ID NO: 2690568 - protein, 18 aa, Entamoeba histolytica
NTICSITQSIVWISLLLD

SEQ ID NO: 2690569 - protein, 17 aa, Entamoeba histolytica
NTIFAAGGDGCMSTWNI

SEQ ID NO: 2690570 - protein, 23 aa, Entamoeba histolytica
NTIFIAPPCCKVLTTKPHYIKLC

SEQ ID NO: 2690571 - protein, 25 aa, Entamoeba histolytica
NTIGMPLPFAMRLTIAVPVNERNYE

SEQ ID NO: 2690572 - protein, 18 aa, Entamoeba histolytica
NTIKLIAFKSIKDTDKKT

SEQ ID NO: 2690573 - protein, 18 aa, Entamoeba histolytica
NTIKMMVPEDITIMGTMM

SEQ ID NO: 2690574 - protein, 17 aa, Entamoeba histolytica
NTIKPVCVIGWSTPNIL

SEQ ID NO: 2690575 - protein, 25 aa, Entamoeba histolytica
NTILGKDVFQIFGGRKMKSTVAICI

SEQ ID NO: 2690576 - protein, 20 aa, Entamoeba histolytica
NTIQAGFIYCTRCVKNEDEY

SEQ ID NO: 2690577 - protein, 24 aa, Entamoeba histolytica
NTIQEFKSGIGRTILITTSLCARG

SEQ ID NO: 2690578 - protein, 25 aa, Entamoeba histolytica
NTISQRLPVPLLRRRNVSQERPELL

SEQ ID NO: 2690579 - protein, 20 aa, Entamoeba histolytica
NTISWEFDKGTLILFQLSSS

SEQ ID NO: 2690580 - protein, 26 aa, Entamoeba histolytica
NTIVKWCGDESIDLSQRIELIDIVIG

SEQ ID NO: 2690581 - protein, 17 aa, Entamoeba histolytica
NTIVPIIISRASMNPEI

SEQ ID NO: 2690582 - protein, 25 aa, Entamoeba histolytica
NTIVRKTTRLMLQKKPSIIVSIPSI

SEQ ID NO: 2690583 - protein, 17 aa, Entamoeba histolytica
NTIWRLVSEYNQIDSNL

SEQ ID NO: 2690584 - protein, 22 aa, Entamoeba histolytica
NTKGCLFPYLLDTKKFAATIYS

SEQ ID NO: 2690585 - protein, 21 aa, Entamoeba histolytica
NTKGFLCWHGTSWNNAESIMR

SEQ ID NO: 2690586 - protein, 27 aa, Entamoeba histolytica
NTKHEIMEVWHFIRLTGTTAFISDDFN

SEQ ID NO: 2690587 - protein, 19 aa, Entamoeba histolytica
NTKKFAYLLSRIFYNAQYF

SEQ ID NO: 2690588 - protein, 22 aa, Entamoeba histolytica
NTKLILRSKCPFIDTVTSGNDE

SEQ ID NO: 2690589 - protein, 25 aa, Entamoeba histolytica
NTKNFEDIAGFLLAKIYNCIGEDAF

SEQ ID NO: 2690590 - protein, 23 aa, Entamoeba histolytica
NTKSNDIVLVFKFTESTCFKQLI

SEQ ID NO: 2690591 - protein, 23 aa, Entamoeba histolytica
NTLCALRTLKLYINQSSYPTYLN

SEQ ID NO: 2690592 - protein, 24 aa, Entamoeba histolytica
NTLCTRILTAYARITSKKFLSTTL

SEQ ID NO: 2690593 - protein, 22 aa, Entamoeba histolytica
NTLDHCYYQFVEVKKEEFNKER

SEQ ID NO: 2690594 - protein, 20 aa, Entamoeba histolytica
NTLFFLRYLFIPFKETPSLF

SEQ ID NO: 2690595 - protein, 25 aa, Entamoeba histolytica
NTLHELWSLLQFLLPEIFNTKELDE

SEQ ID NO: 2690596 - protein, 24 aa, Entamoeba histolytica
NTLKDLLNKFGLAYTALPDAANKF

SEQ ID NO: 2690597 - protein, 24 aa, Entamoeba histolytica
NTLKESPESFCFLKQYTQLKSLSL

SEQ ID NO: 2690598 - protein, 17 aa, Entamoeba histolytica
NTLLPWNVYVYDGGNDV

SEQ ID NO: 2690599 - protein, 19 aa, Entamoeba histolytica
NTLLYCFCDSLLKHDVNVS

SEQ ID NO: 2690600 - protein, 21 aa, Entamoeba histolytica
NTLPIKIYQPITIQRKIINNV

SEQ ID NO: 2690601 - protein, 26 aa, Entamoeba histolytica
NTLPSSWRFWEVMAQDFCATSKESFH

SEQ ID NO: 2690602 - protein, 18 aa, Entamoeba histolytica
NTLQCRLKELKVWNMTKS

SEQ ID NO: 2690603 - protein, 19 aa, Entamoeba histolytica
NTLRGGFYDALGVVSQSFS

SEQ ID NO: 2690604 - protein, 21 aa, Entamoeba histolytica
NTLWILMDMCGVGSVKDLMKK

SEQ ID NO: 2690605 - protein, 22 aa, Entamoeba histolytica
NTLWYLCYFCQEVVKNVEKTQM

SEQ ID NO: 2690606 - protein, 17 aa, Entamoeba histolytica
NTMAPVRVFEGHKAPVW

SEQ ID NO: 2690607 - protein, 18 aa, Entamoeba histolytica
NTMKCWKIGDSTPTASFT

SEQ ID NO: 2690608 - protein, 28 aa, Entamoeba histolytica
NTMNKFEALICSFKLSAAVNEEKMGKIT

SEQ ID NO: 2690609 - protein, 22 aa, Entamoeba histolytica
NTMTYFFSCLMVDEFTDINCVE

SEQ ID NO: 2690610 - protein, 33 aa, Entamoeba histolytica
NTNEFKRVFSWKKGEEVLRINPLYLQYPKVSIF

SEQ ID NO: 2690611 - protein, 25 aa, Entamoeba histolytica
NTNGIKWNTLWFDVEKDSWSSNVAT

SEQ ID NO: 2690612 - protein, 25 aa, Entamoeba histolytica
NTNGRTASISGLWISILLAIRTGGD

SEQ ID NO: 2690613 - protein, 24 aa, Entamoeba histolytica
NTNKRRGFAVVEFASLASVEKALE

SEQ ID NO: 2690614 - protein, 23 aa, Entamoeba histolytica
NTNQEIFNTFSFDQPIENKIPTS

SEQ ID NO: 2690615 - protein, 26 aa, Entamoeba histolytica
NTNYFIELGHGFKIGMDGKGEFSTDF

SEQ ID NO: 2690616 - protein, 31 aa, Entamoeba histolytica
NTNYKSFCNYFKRVKIFKALISLSIGEINVE

SEQ ID NO: 2690617 - protein, 22 aa, Entamoeba histolytica
NTPAVYVKWNYKAEEFSLPITF

SEQ ID NO: 2690618 - protein, 18 aa, Entamoeba histolytica
NTPFRFMKMSKRIFSNKN

SEQ ID NO: 2690619 - protein, 22 aa, Entamoeba histolytica
NTPGEAFFTFLINKKEKRVKIN

SEQ ID NO: 2690620 - protein, 24 aa, Entamoeba histolytica
NTPIGLCWSFLFGEEGLQLNPKKV

SEQ ID NO: 2690621 - protein, 31 aa, Entamoeba histolytica
NTPISQQRILNWLMAFFDAHITLLITDQQFT

SEQ ID NO: 2690622 - protein, 24 aa, Entamoeba histolytica
NTPIWPQRLLQPMLSITMSNSTNE

SEQ ID NO: 2690623 - protein, 38 aa, Entamoeba histolytica
NTRAPGYIPNSLKFKFSKRSNHFIAFADFDSHENAVAL

SEQ ID NO: 2690624 - protein, 35 aa, Entamoeba histolytica
NTRDRRLPLIDVISFTLNICKAIQILHSRGFVHNH

SEQ ID NO: 2690625 - protein, 19 aa, Entamoeba histolytica
NTRSTVVRPVFKPDSEASN

SEQ ID NO: 2690626 - protein, 25 aa, Entamoeba histolytica
NTSFKRIKFIPTYLFVECDQHLIGK

SEQ ID NO: 2690627 - protein, 18 aa, Entamoeba histolytica
NTSFSLFIEREIIPKDYF

SEQ ID NO: 2690628 - protein, 22 aa, Entamoeba histolytica
NTSHFYPPFSMQGFAQLSQGQF

SEQ ID NO: 2690629 - protein, 17 aa, Entamoeba histolytica
NTSKAFVNRALSSCVPI

SEQ ID NO: 2690630 - protein, 26 aa, Entamoeba histolytica
NTSPRRFALQKGWKKTLYIYGDDQNN

SEQ ID NO: 2690631 - protein, 22 aa, Entamoeba histolytica
NTSRLTESIAVFKDIMTNEFLK

SEQ ID NO: 2690632 - protein, 23 aa, Entamoeba histolytica
NTSRNLPCLMVLKRHSLDQMILL

SEQ ID NO: 2690633 - protein, 22 aa, Entamoeba histolytica
NTTCLQKKCKLGIHCKTEKVLA

SEQ ID NO: 2690634 - protein, 18 aa, Entamoeba histolytica
NTVAAWRQGVEMPLNEVL

SEQ ID NO: 2690635 - protein, 18 aa, Entamoeba histolytica
NTVDCRRTLVLQYFGEVF

SEQ ID NO: 2690636 - protein, 19 aa, Entamoeba histolytica
NTVFWLLDLEDIFCPDKLY

SEQ ID NO: 2690637 - protein, 27 aa, Entamoeba histolytica
NTVLKEFKFPISDCGKLEDVESVRKVL

SEQ ID NO: 2690638 - protein, 24 aa, Entamoeba histolytica
NTVLNHWLEIEFSENGIIMPNILK

SEQ ID NO: 2690639 - protein, 24 aa, Entamoeba histolytica
NTVLNRWLEIEFSEHGFIMPDIIK

SEQ ID NO: 2690640 - protein, 23 aa, Entamoeba histolytica
NTVLNRWLEIEISNNRFSMPDSI

SEQ ID NO: 2690641 - protein, 28 aa, Entamoeba histolytica
NTVPFVGWCPCSFKCGINSQPATAVPGS

SEQ ID NO: 2690642 - protein, 21 aa, Entamoeba histolytica
NTWIATKLVELIPKYTTSHQH

SEQ ID NO: 2690643 - protein, 20 aa, Entamoeba histolytica
NTWTGAKSFNGYSLHGLFEN

SEQ ID NO: 2690644 - protein, 20 aa, Entamoeba histolytica
NTYIVVMKCEIRLKKDIINM

SEQ ID NO: 2690645 - protein, 17 aa, Entamoeba histolytica
NTYLFMPIFTKKEISNS

SEQ ID NO: 2690646 - protein, 27 aa, Entamoeba histolytica
NTYYKPAVKVFYVWGLSGIGKTKWVFD

SEQ ID NO: 2690647 - protein, 22 aa, Entamoeba histolytica
NTYYPFCEFQYLSIENIHEVRN

SEQ ID NO: 2690648 - protein, 18 aa, Entamoeba histolytica
NVACAKYKLYNDPRLLNI

SEQ ID NO: 2690649 - protein, 21 aa, Entamoeba histolytica
NVAELSFRGTSPLFSIAPSVE

SEQ ID NO: 2690650 - protein, 27 aa, Entamoeba histolytica
NVAKDSVLWCYKKDLAFSSNQKKRLKH

SEQ ID NO: 2690651 - protein, 21 aa, Entamoeba histolytica
NVALICQMNAIFGLLQQYPGL

SEQ ID NO: 2690652 - protein, 29 aa, Entamoeba histolytica
NVASGDAVDCWKKCLVILSSVDMLVAEKP

SEQ ID NO: 2690653 - protein, 20 aa, Entamoeba histolytica
NVCGCYFNLQEIIKAPNNTI

SEQ ID NO: 2690654 - protein, 25 aa, Entamoeba histolytica
NVCYSCCFRSRVLYNDFTCPLCRHK

SEQ ID NO: 2690655 - protein, 17 aa, Entamoeba histolytica
NVDEFGFQLKIFDDNIV

SEQ ID NO: 2690656 - protein, 23 aa, Entamoeba histolytica
NVDELFIRIATDIMKNIQPANTS

SEQ ID NO: 2690657 - protein, 27 aa, Entamoeba histolytica
NVDGLKVPVLLSDWGYEVMVTCSASQQ

SEQ ID NO: 2690658 - protein, 21 aa, Entamoeba histolytica
NVDLWNCKGAISYIDKLRLYI

SEQ ID NO: 2690659 - protein, 26 aa, Entamoeba histolytica
NVEREPACFPSYVLHNPQIISKSRNI

SEQ ID NO: 2690660 - protein, 18 aa, Entamoeba histolytica
NVFGCFIHSPILITNKPV

SEQ ID NO: 2690661 - protein, 18 aa, Entamoeba histolytica
NVFLKIGTLKAVSDDKVI

SEQ ID NO: 2690662 - protein, 30 aa, Entamoeba histolytica
NVFMKLNMVQCFICPSFITRSLKIIGSDSI

SEQ ID NO: 2690663 - protein, 19 aa, Entamoeba histolytica
NVFNTRINVIINEGILNKI

SEQ ID NO: 2690664 - protein, 18 aa, Entamoeba histolytica
NVGCWYYLGENFKVNKKE

SEQ ID NO: 2690665 - protein, 19 aa, Entamoeba histolytica
NVGKTCLLLTYTTNSFPDS

SEQ ID NO: 2690666 - protein, 19 aa, Entamoeba histolytica
NVGKTCLLLTYTTNSFPDT

SEQ ID NO: 2690667 - protein, 24 aa, Entamoeba histolytica
NVGLREMFRRVIYSRNFEELETFN

SEQ ID NO: 2690668 - protein, 18 aa, Entamoeba histolytica
NVGPSMKMTKLLKEIYIE

SEQ ID NO: 2690669 - protein, 17 aa, Entamoeba histolytica
NVHACDWDYGLIAIAFN

SEQ ID NO: 2690670 - protein, 26 aa, Entamoeba histolytica
NVHRLPFPVNLVWQLTVAMQKYCELQ

SEQ ID NO: 2690671 - protein, 20 aa, Entamoeba histolytica
NVIAEFKFLLEVFQMEENGP

SEQ ID NO: 2690672 - protein, 17 aa, Entamoeba histolytica
NVIARNIFTEWVKRENI

SEQ ID NO: 2690673 - protein, 18 aa, Entamoeba histolytica
NVICKLEPLTFEASQHPN

SEQ ID NO: 2690674 - protein, 17 aa, Entamoeba histolytica
NVIDCLYGTIVSLQCSS

SEQ ID NO: 2690675 - protein, 32 aa, Entamoeba histolytica
NVIIYSCLMGRIGVLIPFNFREDVEFFSKLEM

SEQ ID NO: 2690676 - protein, 17 aa, Entamoeba histolytica
NVIPLKIVDLPGFVEEQ

SEQ ID NO: 2690677 - protein, 24 aa, Entamoeba histolytica
NVIQEIYMRMSVTNFLELPPDVTA

SEQ ID NO: 2690678 - protein, 19 aa, Entamoeba histolytica
NVIQLRSTFIASRYLEFCR

SEQ ID NO: 2690679 - protein, 17 aa, Entamoeba histolytica
NVIRAMNVFRRGVVFNS

SEQ ID NO: 2690680 - protein, 18 aa, Entamoeba histolytica
NVIRKVLLYRGCEDDVRE

SEQ ID NO: 2690681 - protein, 23 aa, Entamoeba histolytica
NVISEIWGKLSIDQRGDLDSLFH

SEQ ID NO: 2690682 - protein, 19 aa, Entamoeba histolytica
NVISRSGLLEDIFEHIDVD

SEQ ID NO: 2690683 - protein, 24 aa, Entamoeba histolytica
NVKDLKPGDLVGVNKDTYLILEKL

SEQ ID NO: 2690684 - protein, 18 aa, Entamoeba histolytica
NVKIKVRVGRGIVVGGFQ

SEQ ID NO: 2690685 - protein, 29 aa, Entamoeba histolytica
NVKNKCFICGEVLDSAQFSSHFLHHQQSI

SEQ ID NO: 2690686 - protein, 23 aa, Entamoeba histolytica
NVKQLCEYREVVVDFKRYHKGNL

SEQ ID NO: 2690687 - protein, 24 aa, Entamoeba histolytica
NVKVSYCNIILYIPIKKFTVRVLN

SEQ ID NO: 2690688 - protein, 19 aa, Entamoeba histolytica
NVLEWSYIHIELWKDNELE

SEQ ID NO: 2690689 - protein, 23 aa, Entamoeba histolytica
NVLGVILCFDYQKSDTFANLMNW

SEQ ID NO: 2690690 - protein, 26 aa, Entamoeba histolytica
NVLHLFRAMTLHKAILMEGSPGVGKT

SEQ ID NO: 2690691 - protein, 27 aa, Entamoeba histolytica
NVLKIKDIWKYVCIVWTKCYNSLSPKK

SEQ ID NO: 2690692 - protein, 32 aa, Entamoeba histolytica
NVLKQGYSSFIIKLKMECLKKLMDDFEACVNS

SEQ ID NO: 2690693 - protein, 19 aa, Entamoeba histolytica
NVLLCIPKAIKYRHNIKIQ

SEQ ID NO: 2690694 - protein, 25 aa, Entamoeba histolytica
NVLMSEMRKVPGLIINELIQYYYEP

SEQ ID NO: 2690695 - protein, 19 aa, Entamoeba histolytica
NVLSLWEDYEFAPFSYQKE

SEQ ID NO: 2690696 - protein, 24 aa, Entamoeba histolytica
NVLSRAELFLPMFKESNKYVKQGE

SEQ ID NO: 2690697 - protein, 17 aa, Entamoeba histolytica
NVLTSWAETQHVVLRKG

SEQ ID NO: 2690698 - protein, 18 aa, Entamoeba histolytica
NVLVCSGNDGIIRVCGLK

SEQ ID NO: 2690699 - protein, 19 aa, Entamoeba histolytica
NVMIKIPIDQGIIKEIDNR

SEQ ID NO: 2690700 - protein, 23 aa, Entamoeba histolytica
NVMKVFSLIIYKTFADLGKDAES

SEQ ID NO: 2690701 - protein, 19 aa, Entamoeba histolytica
NVNAFLKKFYYTMKEPSYI

SEQ ID NO: 2690702 - protein, 18 aa, Entamoeba histolytica
NVNCICKYIELWPKAWGI

SEQ ID NO: 2690703 - protein, 17 aa, Entamoeba histolytica
NVNGGLFAICNTFFSEE

SEQ ID NO: 2690704 - protein, 19 aa, Entamoeba histolytica
NVNPFIKRIYYLMKEPQYL

SEQ ID NO: 2690705 - protein, 19 aa, Entamoeba histolytica
NVNRYGFFEVEGEKGELFI

SEQ ID NO: 2690706 - protein, 19 aa, Entamoeba histolytica
NVNVADWVILYLLEGNLYP

SEQ ID NO: 2690707 - protein, 18 aa, Entamoeba histolytica
NVNYRLISIIEHRGNQIR

SEQ ID NO: 2690708 - protein, 21 aa, Entamoeba histolytica
NVPIYSRHILKSVYDNYLDEE

SEQ ID NO: 2690709 - protein, 22 aa, Entamoeba histolytica
NVPKCKKFLTRIVAAMNKGDIF

SEQ ID NO: 2690710 - protein, 18 aa, Entamoeba histolytica
NVPLPQWPLFIAGTLGQD

SEQ ID NO: 2690711 - protein, 24 aa, Entamoeba histolytica
NVPLRQLLFTALRSVIPYACDVFV

SEQ ID NO: 2690712 - protein, 24 aa, Entamoeba histolytica
NVPPKCMLCGFSMNNNIYQLPHNI

SEQ ID NO: 2690713 - protein, 26 aa, Entamoeba histolytica
NVPPRYEHRIELIKSCQIALWDVCCQ

SEQ ID NO: 2690714 - protein, 18 aa, Entamoeba histolytica
NVQLYGGVFLKINGKALV

SEQ ID NO: 2690715 - protein, 18 aa, Entamoeba histolytica
NVRARYEHDIGLDDIKWL

SEQ ID NO: 2690716 - protein, 18 aa, Entamoeba histolytica
NVRCLKCMARDAQKAAEL

SEQ ID NO: 2690717 - protein, 25 aa, Entamoeba histolytica
NVRKLLKFESCTVIPSPVKTTKLTK

SEQ ID NO: 2690718 - protein, 18 aa, Entamoeba histolytica
NVRQMYQDGCTWTTHFSR

SEQ ID NO: 2690719 - protein, 19 aa, Entamoeba histolytica
NVSFERLNVLALLGNKISF

SEQ ID NO: 2690720 - protein, 23 aa, Entamoeba histolytica
NVSGDSFVPIVIYTLLKANLPHL

SEQ ID NO: 2690721 - protein, 29 aa, Entamoeba histolytica
NVSLNEYLFFKLCDFITILKSLRKSILLK

SEQ ID NO: 2690722 - protein, 27 aa, Entamoeba histolytica
NVTCDICMRKCCVGCSIHTTIAPTLIM

SEQ ID NO: 2690723 - protein, 25 aa, Entamoeba histolytica
NVTTIPLKLSFIIYFIENINTQQSV

SEQ ID NO: 2690724 - protein, 24 aa, Entamoeba histolytica
NVVDCPLRQLYEILQYTGTIESNL

SEQ ID NO: 2690725 - protein, 24 aa, Entamoeba histolytica
NVVEEFKKYLPLSLKIKSTDDCVL

SEQ ID NO: 2690726 - protein, 25 aa, Entamoeba histolytica
NVVEFSVSVLPQYAGKLYISLTLYN

SEQ ID NO: 2690727 - protein, 18 aa, Entamoeba histolytica
NVVIPECESNSISNEQPQ

SEQ ID NO: 2690728 - protein, 26 aa, Entamoeba histolytica
NVVKLSLHMYGCRVIQKIIEVLSPEE

SEQ ID NO: 2690729 - protein, 18 aa, Entamoeba histolytica
NVVPGCRKLMTNLPGHLD

SEQ ID NO: 2690730 - protein, 19 aa, Entamoeba histolytica
NVVYFRVLMMIPKRDSYFT

SEQ ID NO: 2690731 - protein, 24 aa, Entamoeba histolytica
NVYEISLFLGMLSKWCNITIERFS

SEQ ID NO: 2690732 - protein, 17 aa, Entamoeba histolytica
NVYGFNMTPMRAEVLKE

SEQ ID NO: 2690733 - protein, 26 aa, Entamoeba histolytica
NVYHIMLLHGLLYWRHRPNIEFKDML

SEQ ID NO: 2690734 - protein, 17 aa, Entamoeba histolytica
NVYKELEGALSVYTPYL

SEQ ID NO: 2690735 - protein, 17 aa, Entamoeba histolytica
NVYLRVYEMMGFIDELS

SEQ ID NO: 2690736 - protein, 19 aa, Entamoeba histolytica
NVYLTSHRAVMEMEYMNGG

SEQ ID NO: 2690737 - protein, 22 aa, Entamoeba histolytica
NVYLTSHRAVMEMEYMNGGDLF

SEQ ID NO: 2690738 - protein, 21 aa, Entamoeba histolytica
NVYQCKKCLKYYCDECDSFIH

SEQ ID NO: 2690739 - protein, 28 aa, Entamoeba histolytica
NVYRLFFYYYCFINDIFFNIRNDSISSI

SEQ ID NO: 2690740 - protein, 36 aa, Entamoeba histolytica; identical to SEQ ID NO: 2499020

SEQ ID NO: 2690741 - protein, 25 aa, Entamoeba histolytica
NWENFYRWFLPVKNVISGIFNGSKE

SEQ ID NO: 2690742 - protein, 20 aa, Entamoeba histolytica
NWFVLCEMRVYLARIETLSL

SEQ ID NO: 2690743 - protein, 19 aa, Entamoeba histolytica
NWIPNVNRMNCIIDDDINE

SEQ ID NO: 2690744 - protein, 27 aa, Entamoeba histolytica
NWIVAGRTWKCCLCGHINTELTERYLQ

SEQ ID NO: 2690745 - protein, 24 aa, Entamoeba histolytica
NWKQPECKECTSGIEIPQENLWLS

SEQ ID NO: 2690746 - protein, 20 aa, Entamoeba histolytica
NWLKEVLKCLIPNPPPKTHT

SEQ ID NO: 2690747 - protein, 23 aa, Entamoeba histolytica
NWNNCIFYIFDIEDIQKRFNISF

SEQ ID NO: 2690748 - protein, 25 aa, Entamoeba histolytica
NWNQCFRITESIGEEIIFHLFDRDT

SEQ ID NO: 2690749 - protein, 18 aa, Entamoeba histolytica
NWNRAVQISNEIKKEVDK

SEQ ID NO: 2690750 - protein, 26 aa, Entamoeba histolytica
NWRVFDCIYCGGLIYPDENEWICHTC

SEQ ID NO: 2690751 - protein, 19 aa, Entamoeba histolytica
NWRVSRINDDYAFCPTYPR

SEQ ID NO: 2690752 - protein, 18 aa, Entamoeba histolytica
NWSIKELLKNGPAVADSD

SEQ ID NO: 2690753 - protein, 17 aa, Entamoeba histolytica
NWTVVWVKQKGYPWWPA

SEQ ID NO: 2690754 - protein, 21 aa, Entamoeba histolytica
NWVKACLIRKYIPEHSRVLDF

SEQ ID NO: 2690755 - protein, 20 aa, Entamoeba histolytica
NWYFSLKLIKQISMARDFRY

SEQ ID NO: 2690756 - protein, 18 aa, Entamoeba histolytica
NWYSLYFINSMKEVMGSL

SEQ ID NO: 2690757 - protein, 20 aa, Entamoeba histolytica
NWYYRKDIHHFKKIGKEAWK

SEQ ID NO: 2690758 - protein, 17 aa, Entamoeba histolytica
NYAAVKLIRQAADIFRS

SEQ ID NO: 2690759 - protein, 17 aa, Entamoeba histolytica
NYCIAICVNISDFNQKY

SEQ ID NO: 2690760 - protein, 19 aa, Entamoeba histolytica
NYCVDPYHFIFSLLSDSIP

SEQ ID NO: 2690761 - protein, 23 aa, Entamoeba histolytica
NYDFECLEALRLGDLNDTLTRLF

SEQ ID NO: 2690762 - protein, 18 aa, Entamoeba histolytica
NYEIKMKVLIDVLKGIQF

SEQ ID NO: 2690763 - protein, 17 aa, Entamoeba histolytica
NYEKCFNARVSIGQLVI

SEQ ID NO: 2690764 - protein, 22 aa, Entamoeba histolytica
NYEKFMPALMQYYKQPQEKHLL

SEQ ID NO: 2690765 - protein, 20 aa, Entamoeba histolytica
NYETLRFLLSNVKYYAEEFG

SEQ ID NO: 2690766 - protein, 19 aa, Entamoeba histolytica
NYFHGWRVNKKQVISVNDH

SEQ ID NO: 2690767 - protein, 23 aa, Entamoeba histolytica
NYFKSGKSEAVIAPKVITTTHTF

SEQ ID NO: 2690768 - protein, 21 aa, Entamoeba histolytica
NYFRNAMAAIIMFDVSNKESF

SEQ ID NO: 2690769 - protein, 17 aa, Entamoeba histolytica
NYFSITVIKCSSCKEIL

SEQ ID NO: 2690770 - protein, 26 aa, Entamoeba histolytica
NYFVYCISDSYLKCSTSSVVSLRHLV

SEQ ID NO: 2690771 - protein, 25 aa, Entamoeba histolytica
NYGHLFRPIVFEGKKVGKLEVGYIL

SEQ ID NO: 2690772 - protein, 25 aa, Entamoeba histolytica
NYGMSFCIVEGFKSLVGLIQKYPVL

SEQ ID NO: 2690773 - protein, 25 aa, Entamoeba histolytica
NYGSKRIWNLISFIIGNKIIEAYRK

SEQ ID NO: 2690774 - protein, 18 aa, Entamoeba histolytica
NYHKRPSASYLLKHITEF

SEQ ID NO: 2690775 - protein, 17 aa, Entamoeba histolytica
NYHQKWNLILCGLHANQ

SEQ ID NO: 2690776 - protein, 19 aa, Entamoeba histolytica
NYIALRLLFEMKVQRNFIN

SEQ ID NO: 2690777 - protein, 22 aa, Entamoeba histolytica
NYIEEWRKVFNMDNKTWEELVE

SEQ ID NO: 2690778 - protein, 18 aa, Entamoeba histolytica
NYIKAVDLPPELAPLPPL

SEQ ID NO: 2690779 - protein, 18 aa, Entamoeba histolytica
NYILKGIIVHFGTVNIGH

SEQ ID NO: 2690780 - protein, 20 aa, Entamoeba histolytica
NYINLIRMFIDYVTPQELME

SEQ ID NO: 2690781 - protein, 23 aa, Entamoeba histolytica
NYIRLDREYPILSPIRLLFFNYI

SEQ ID NO: 2690782 - protein, 18 aa, Entamoeba histolytica
NYISIDLFEGNDVILKKI

SEQ ID NO: 2690783 - protein, 17 aa, Entamoeba histolytica
NYKGCIFFHSNSTLELE

SEQ ID NO: 2690784 - protein, 20 aa, Entamoeba histolytica
NYKVKWSWINIFSDEAYICS

SEQ ID NO: 2690785 - protein, 24 aa, Entamoeba histolytica
NYLDPRVSDLIKMIFDTDMMKNTL

SEQ ID NO: 2690786 - protein, 17 aa, Entamoeba histolytica
NYLELILRIFKKPYLTF

SEQ ID NO: 2690787 - protein, 19 aa, Entamoeba histolytica
NYLGYLIHRILSYDPTLEE

SEQ ID NO: 2690788 - protein, 19 aa, Entamoeba histolytica
NYLKKCLNLKTSEERKKVI

SEQ ID NO: 2690789 - protein, 23 aa, Entamoeba histolytica
NYLKKPLEPEVVFCNVPISHYVT

SEQ ID NO: 2690790 - protein, 20 aa, Entamoeba histolytica
NYLLLCGDFTIRGYGIKDFI

SEQ ID NO: 2690791 - protein, 23 aa, Entamoeba histolytica
NYLRFSKSFNIIGDFKERNRFNQ

SEQ ID NO: 2690792 - protein, 25 aa, Entamoeba histolytica
NYLRVTRIFNSLHAFGLKPYMVSLF

SEQ ID NO: 2690793 - protein, 19 aa, Entamoeba histolytica
NYLSARIYFLLAASYTNYK

SEQ ID NO: 2690794 - protein, 17 aa, Entamoeba histolytica
NYLSGLVETVFDKLNEM

SEQ ID NO: 2690795 - protein, 26 aa, Entamoeba histolytica
NYLSIGLERWFYCYQPYDIVISDNDD

SEQ ID NO: 2690796 - protein, 19 aa, Entamoeba histolytica
NYLSSLLTLFSIISNKLSN

SEQ ID NO: 2690797 - protein, 25 aa, Entamoeba histolytica
NYMCLGCLKNIPLRNLCLLGNPLPQ

SEQ ID NO: 2690798 - protein, 25 aa, Entamoeba histolytica
NYMKHIDCFGELYSNKASQTLLDQC

SEQ ID NO: 2690799 - protein, 22 aa, Entamoeba histolytica
NYMSGDIIIMVCFMSKGKINII

SEQ ID NO: 2690800 - protein, 18 aa, Entamoeba histolytica
NYNDFRMVVWGFDQNIRE

SEQ ID NO: 2690801 - protein, 19 aa, Entamoeba histolytica
NYNLCHLDALIKRHTKNIQ

SEQ ID NO: 2690802 - protein, 19 aa, Entamoeba histolytica
NYPIEYIIPCVKRIPTTDV

SEQ ID NO: 2690803 - protein, 22 aa, Entamoeba histolytica
NYQCAVEGILIALIAQHCTIEI

SEQ ID NO: 2690804 - protein, 18 aa, Entamoeba histolytica
NYQKRLDNIIKMESVIRG

SEQ ID NO: 2690805 - protein, 18 aa, Entamoeba histolytica
NYSFSYECSLLLGKNPTL

SEQ ID NO: 2690806 - protein, 23 aa, Entamoeba histolytica
NYSHCYGWLPLLYKITQEDFFAS

SEQ ID NO: 2690807 - protein, 25 aa, Entamoeba histolytica
NYSIHFRFLMYYSEENCVLLRNNHM

SEQ ID NO: 2690808 - protein, 28 aa, Entamoeba histolytica
NYSSIFLNKCAFELYLNKLYELMKKYSN

SEQ ID NO: 2690809 - protein, 25 aa, Entamoeba histolytica
NYTDIKRMDEAIWNEIYLHELDKCG

SEQ ID NO: 2690810 - protein, 18 aa, Entamoeba histolytica
NYTNRALCYLRINENELA

SEQ ID NO: 2690811 - protein, 22 aa, Entamoeba histolytica
NYYEQHPFYAFFYSEEKEQPEE

SEQ ID NO: 2690812 - protein, 21 aa, Entamoeba histolytica
NYYPQICFVHKNLFYDRVGEI

SEQ ID NO: 2690813 - protein, 24 aa, Entamoeba histolytica
PACVFKLKNLEIFEMERNEITEVT

SEQ ID NO: 2690814 - protein, 26 aa, Entamoeba histolytica
PAEKLRPLYWNRIVIDMNNDKSIWRE

SEQ ID NO: 2690815 - protein, 25 aa, Entamoeba histolytica
PAFLARAIEIYSIYHSIVKNIFKSS

SEQ ID NO: 2690816 - protein, 18 aa, Entamoeba histolytica
PAFRECLEHLATSQDDTK

SEQ ID NO: 2690817 - protein, 23 aa, Entamoeba histolytica
PAKEIKATEVIININKDNKQPEV

SEQ ID NO: 2690818 - protein, 20 aa, Entamoeba histolytica
PAKGKLRYEKERNYKEGDLV

SEQ ID NO: 2690819 - protein, 18 aa, Entamoeba histolytica
PALIKGLADIMYLIEKNI

SEQ ID NO: 2690820 - protein, 22 aa, Entamoeba histolytica
PANHIELKILHIFSSKGTFTCI

SEQ ID NO: 2690821 - protein, 28 aa, Entamoeba histolytica
PAPEEFFKPLASFIESWKNARKDNAKAK

SEQ ID NO: 2690822 - protein, 25 aa, Entamoeba histolytica
PAQMKKFLKQFGKLESYRFRGGAFI

SEQ ID NO: 2690823 - protein, 26 aa, Entamoeba histolytica
PAQRIIIGKECVPGFNSIESYLDYID

SEQ ID NO: 2690824 - protein, 19 aa, Entamoeba histolytica
PARDISLNDNCYHITPMEK

SEQ ID NO: 2690825 - protein, 17 aa, Entamoeba histolytica
PARNCFFMATYNYNYPI

SEQ ID NO: 2690826 - protein, 18 aa, Entamoeba histolytica
PASEVICELASFTKYFTI

SEQ ID NO: 2690827 - protein, 18 aa, Entamoeba histolytica
PASFNGLINGCLNNTPQF

SEQ ID NO: 2690828 - protein, 22 aa, Entamoeba histolytica
PASKEPTKWELFAKRKGIKKTK

SEQ ID NO: 2690829 - protein, 18 aa, Entamoeba histolytica
PASLPGLIRHAALNYSRP

SEQ ID NO: 2690830 - protein, 26 aa, Entamoeba histolytica
PASPFPRLLVSPSCFIIPYILNQKSD

SEQ ID NO: 2690831 - protein, 20 aa, Entamoeba histolytica
PASYLCRYFGISLAAATNTD

SEQ ID NO: 2690832 - protein, 26 aa, Entamoeba histolytica
PATFIFRGNSSFTRLLCYYMEEELQD

SEQ ID NO: 2690833 - protein, 23 aa, Entamoeba histolytica
PATGAQPYPAYNAQQPTLNLPNN

SEQ ID NO: 2690834 - protein, 19 aa, Entamoeba histolytica
PATPKLYIHRCGRVARAGR

SEQ ID NO: 2690835 - protein, 18 aa, Entamoeba histolytica
PAVFCSIFGLSLDTKTPL

SEQ ID NO: 2690836 - protein, 18 aa, Entamoeba histolytica
PAVIAALFSICTEQSLPS

SEQ ID NO: 2690837 - protein, 17 aa, Entamoeba histolytica
PAVKWWGMQDDWNLMVM

SEQ ID NO: 2690838 - protein, 20 aa, Entamoeba histolytica
PAVYVKWNYKAEEFSLPITF

SEQ ID NO: 2690839 - protein, 26 aa, Entamoeba histolytica
PCELLDCGKSYLLKFEVPGIDKKSLS

SEQ ID NO: 2690840 - protein, 19 aa, Entamoeba histolytica
PCGKRCSFNEIVIDSHFME

SEQ ID NO: 2690841 - protein, 24 aa, Entamoeba histolytica
PCGSCTKEYFGNELTRYVNVHCYK

SEQ ID NO: 2690842 - protein, 19 aa, Entamoeba histolytica
PCIDCHMRLVSIPDMDYDV

SEQ ID NO: 2690843 - protein, 24 aa, Entamoeba histolytica
PCIDGRSNITVTIIRQEGMQGPYK

SEQ ID NO: 2690844 - protein, 23 aa, Entamoeba histolytica
PCILKRKQGTLVLEIENYGVVNI

SEQ ID NO: 2690845 - protein, 23 aa, Entamoeba histolytica
PCIRGCVERVYPMKYKFKNEKGV

SEQ ID NO: 2690846 - protein, 24 aa, Entamoeba histolytica
PCKARCQAFRKEVILRTIKNHKDI

SEQ ID NO: 2690847 - protein, 30 aa, Entamoeba histolytica
PCKRTAGGGFGICWSNLLLGTFTVCEEGNL

SEQ ID NO: 2690848 - protein, 25 aa, Entamoeba histolytica
PCLFEIPQESPVVFSCRLNELKTFF

SEQ ID NO: 2690849 - protein, 17 aa, Entamoeba histolytica
PCLPPLNSIIYDEIAEI

SEQ ID NO: 2690850 - protein, 19 aa, Entamoeba histolytica
PCMQIASSVTSYGRTMIEL

SEQ ID NO: 2690851 - protein, 19 aa, Entamoeba histolytica
PCNGYRYGKGLYFANCASK

SEQ ID NO: 2690852 - protein, 26 aa, Entamoeba histolytica
PCPKCSVQVEKPCYCGKEKSKFSCGD

SEQ ID NO: 2690853 - protein, 21 aa, Entamoeba histolytica
PCTDCKLDGYGGHTTDIRIVC

SEQ ID NO: 2690854 - protein, 24 aa, Entamoeba histolytica
PCVCAFPYVFGDKGFKADIQNTVC

SEQ ID NO: 2690855 - protein, 22 aa, Entamoeba histolytica
PCVKACPCGAMLDSPEGVKTID

SEQ ID NO: 2690856 - protein, 18 aa, Entamoeba histolytica
PCVRCGKNIVGEIVEVDE

SEQ ID NO: 2690857 - protein, 17 aa, Entamoeba histolytica
PCVSPPLPVNSFSNDNY

SEQ ID NO: 2690858 - protein, 19 aa, Entamoeba histolytica
PCYLSEWKYLERAIGNIKT

SEQ ID NO: 2690859 - protein, 20 aa, Entamoeba histolytica
PDACLWKCYSLTSIQFPSNL

SEQ ID NO: 2690860 - protein, 17 aa, Entamoeba histolytica
PDALVEWIRNQKEVLIT

SEQ ID NO: 2690861 - protein, 22 aa, Entamoeba histolytica
PDAPMIFTLSFLGKDPISCVYS

SEQ ID NO: 2690862 - protein, 22 aa, Entamoeba histolytica
PDAYCDRSFTFAHGYLDTPRLH

SEQ ID NO: 2690863 - protein, 20 aa, Entamoeba histolytica
PDDEWAVAEWNRYKQRNDSI

SEQ ID NO: 2690864 - protein, 26 aa, Entamoeba histolytica
PDDFCCCSVCKIAYCEQHKNKLEIII

SEQ ID NO: 2690865 - protein, 17 aa, Entamoeba histolytica
PDDFFMYCLVSLHRFII

SEQ ID NO: 2690866 - protein, 18 aa, Entamoeba histolytica
PDDGYDYSQHFAERGNGI

SEQ ID NO: 2690867 - protein, 24 aa, Entamoeba histolytica
PDDKVCFHCGKLGHIGKNCPEQEV

SEQ ID NO: 2690868 - protein, 22 aa, Entamoeba histolytica
PDDQLIQWFWSIVESFSEEEKS

SEQ ID NO: 2690869 - protein, 18 aa, Entamoeba histolytica
PDELKQIFTTICTTEIVF

SEQ ID NO: 2690870 - protein, 24 aa, Entamoeba histolytica
PDELYCLRMLKSIGVCVVPGSGFG

SEQ ID NO: 2690871 - protein, 19 aa, Entamoeba histolytica
PDELYLFEPSKWYELPSTR

SEQ ID NO: 2690872 - protein, 21 aa, Entamoeba histolytica
PDERKTLAFIPFFTTTGHIVL

SEQ ID NO: 2690873 - protein, 19 aa, Entamoeba histolytica
PDESLRNIVSRELDKRLGE

SEQ ID NO: 2690874 - protein, 23 aa, Entamoeba histolytica
PDEWYDSMCHKKYSTIEEYQSVL

SEQ ID NO: 2690875 - protein, 20 aa, Entamoeba histolytica
PDFLDCFNYSLPTLMESIVT

SEQ ID NO: 2690876 - protein, 19 aa, Entamoeba histolytica
PDFLELFRVGGRVPETNYI

SEQ ID NO: 2690877 - protein, 21 aa, Entamoeba histolytica
PDFLLIRGACQGVYGQDWKNE

SEQ ID NO: 2690878 - protein, 25 aa, Entamoeba histolytica
PDFTYFPQWILDYLHIQPGDVATIF

SEQ ID NO: 2690879 - protein, 22 aa, Entamoeba histolytica
PDGHCELLYFGFLKPVDIEKFK

SEQ ID NO: 2690880 - protein, 23 aa, Entamoeba histolytica
PDGQPKISVMKIIIPPHTHLEKH

SEQ ID NO: 2690881 - protein, 23 aa, Entamoeba histolytica
PDGQVKLQFILPVDKDIKDGTKF

SEQ ID NO: 2690882 - protein, 22 aa, Entamoeba histolytica
PDGRPRNVYPIDLLKTRNPEAL

SEQ ID NO: 2690883 - protein, 18 aa, Entamoeba histolytica
PDGSSFPNGGLRQTYQAR

SEQ ID NO: 2690884 - protein, 28 aa, Entamoeba histolytica
PDGVLCFFPSYAYMNICISYWNEMKIFE

SEQ ID NO: 2690885 - protein, 24 aa, Entamoeba histolytica
PDHLFENCCFLKKIEIPTGITSIG

SEQ ID NO: 2690886 - protein, 26 aa, Entamoeba histolytica
PDIANGVIPLFKIMGAFEQHVEPPDN

SEQ ID NO: 2690887 - protein, 19 aa, Entamoeba histolytica
PDIEARMTLVKTLLNKVKN

SEQ ID NO: 2690888 - protein, 18 aa, Entamoeba histolytica
PDIIKILLNENADTTLVD

SEQ ID NO: 2690889 - protein, 19 aa, Entamoeba histolytica
PDIIKMLVKQVAEKGKTDK

SEQ ID NO: 2690890 - protein, 20 aa, Entamoeba histolytica
PDITLVPGIAKDYLIIRSKF

SEQ ID NO: 2690891 - protein, 17 aa, Entamoeba histolytica
PDIYTAVFFGWQNSPTT

SEQ ID NO: 2690892 - protein, 20 aa, Entamoeba histolytica
PDKFFLKLMERLDIPEDFEP

SEQ ID NO: 2690893 - protein, 17 aa, Entamoeba histolytica
PDKNWNVLREESRQLVG

SEQ ID NO: 2690894 - protein, 17 aa, Entamoeba histolytica
PDKRPMFDVVKSVIETI

SEQ ID NO: 2690895 - protein, 19 aa, Entamoeba histolytica
PDKRSTIGVEFATRSINYC

SEQ ID NO: 2690896 - protein, 19 aa, Entamoeba histolytica
PDLDMLVDLFKHFNEQAET

SEQ ID NO: 2690897 - protein, 21 aa, Entamoeba histolytica
PDLEARVGVLQANLRKSPVAP

SEQ ID NO: 2690898 - protein, 18 aa, Entamoeba histolytica
PDLIEHFNYWFWDYRSPY

SEQ ID NO: 2690899 - protein, 18 aa, Entamoeba histolytica
PDLLSLAFAPMPFIIGCT

SEQ ID NO: 2690900 - protein, 21 aa, Entamoeba histolytica
PDLYQRLKRINAIELLTDLAP

SEQ ID NO: 2690901 - protein, 23 aa, Entamoeba histolytica
PDMNEFYRNILLKQNTTIKDNFT

SEQ ID NO: 2690902 - protein, 18 aa, Entamoeba histolytica
PDNIPKPICEEFISQKSF

SEQ ID NO: 2690903 - protein, 21 aa, Entamoeba histolytica
PDPIIFLRACMSRIDLNGKWL

SEQ ID NO: 2690904 - protein, 20 aa, Entamoeba histolytica
PDPYFPYSSFERTIYKQRVD

SEQ ID NO: 2690905 - protein, 25 aa, Entamoeba histolytica
PDQIKTHPWFNGFNFDDLYKKKLTP

SEQ ID NO: 2690906 - protein, 18 aa, Entamoeba histolytica
PDRAALMFHQERFKKSSF

SEQ ID NO: 2690907 - protein, 20 aa, Entamoeba histolytica
PDRAKVRMKMLYSSTKARFR

SEQ ID NO: 2690908 - protein, 19 aa, Entamoeba histolytica
PDRNSIRLLECVLKNPELF

SEQ ID NO: 2690909 - protein, 21 aa, Entamoeba histolytica
PDSGKTAFIKRLIDDEFSETK

SEQ ID NO: 2690910 - protein, 17 aa, Entamoeba histolytica
PDSICFEQFDAVDHPTY

SEQ ID NO: 2690911 - protein, 25 aa, Entamoeba histolytica
PDSWRLRIGQFITFPNYQRKKLGRY

SEQ ID NO: 2690912 - protein, 20 aa, Entamoeba histolytica
PDSYGKECVDMFRANHRNER

SEQ ID NO: 2690913 - protein, 18 aa, Entamoeba histolytica
PDVFVCEKVEKMIQGGVK

SEQ ID NO: 2690914 - protein, 18 aa, Entamoeba histolytica
PDVLKKFISQVIHVLVAL

SEQ ID NO: 2690915 - protein, 22 aa, Entamoeba histolytica
PDWIYIRAAAIARKVYLNNGIG

SEQ ID NO: 2690916 - protein, 17 aa, Entamoeba histolytica
PDYIKRALIEQMENVPA

SEQ ID NO: 2690917 - protein, 20 aa, Entamoeba histolytica
PDYINLRPFTFTKIKDEEYC

SEQ ID NO: 2690918 - protein, 20 aa, Entamoeba histolytica
PDYNSEIPFFREVPQGKFNP

SEQ ID NO: 2690919 - protein, 26 aa, Entamoeba histolytica
PEADFYECYKLNSINVVMEYVNGEIR

SEQ ID NO: 2690920 - protein, 17 aa, Entamoeba histolytica
PEAILSWVQSSEKSSKE

SEQ ID NO: 2690921 - protein, 23 aa, Entamoeba histolytica
PEAKSAIQCGGMGGLLEQIRQGK

SEQ ID NO: 2690922 - protein, 23 aa, Entamoeba histolytica
PEARCIRVRYRLGGMQDGYVQDH

SEQ ID NO: 2690923 - protein, 18 aa, Entamoeba histolytica
PEARIHGVLLEKMVGFKY

SEQ ID NO: 2690924 - protein, 21 aa, Entamoeba histolytica
PEAYKVLCGIFERMIDPEDEK

SEQ ID NO: 2690925 - protein, 27 aa, Entamoeba histolytica
PECAEVFLQTLLNAFGFVPSEKGSDKF

SEQ ID NO: 2690926 - protein, 17 aa, Entamoeba histolytica
PECIIEWENQGAKKVVV

SEQ ID NO: 2690927 - protein, 18 aa, Entamoeba histolytica
PECLICLNNSVKQLFLVG

SEQ ID NO: 2690928 - protein, 21 aa, Entamoeba histolytica
PECPTACILFHSMSGLLTMFS

SEQ ID NO: 2690929 - protein, 21 aa, Entamoeba histolytica
PECVPRCGVCRVGYKCSVKGK

SEQ ID NO: 2690930 - protein, 20 aa, Entamoeba histolytica
PEDFLDMDITEIWQEMERLV

SEQ ID NO: 2690931 - protein, 19 aa, Entamoeba histolytica
PEDGIGLYLPSAKKWLDNG

SEQ ID NO: 2690932 - protein, 17 aa, Entamoeba histolytica
PEDGLFCDLLWSDPMDD

SEQ ID NO: 2690933 - protein, 19 aa, Entamoeba histolytica
PEDIKRIYESFEIILNALN

SEQ ID NO: 2690934 - protein, 22 aa, Entamoeba histolytica
PEDKCAKAASFISSKVIQKMGA

SEQ ID NO: 2690935 - protein, 26 aa, Entamoeba histolytica
PEDVIKAVMSATCHKESAIENHLSDE

SEQ ID NO: 2690936 - protein, 25 aa, Entamoeba histolytica
PEDYCKWTIRLVFGYNKMVSMGVDS

SEQ ID NO: 2690937 - protein, 23 aa, Entamoeba histolytica
PEEAAKFHLEYTLRILPHQQNTG

SEQ ID NO: 2690938 - protein, 18 aa, Entamoeba histolytica
PEECSICYGEMDNCYTIP

SEQ ID NO: 2690939 - protein, 23 aa, Entamoeba histolytica
PEEFKRKYLPNVQTKRVKSETKK

SEQ ID NO: 2690940 - protein, 30 aa, Entamoeba histolytica
PEEIEIAAICSRAGIYPNMLLSLVTSPPLF

SEQ ID NO: 2690941 - protein, 17 aa, Entamoeba histolytica
PEEISAIILNKVKKTII

SEQ ID NO: 2690942 - protein, 21 aa, Entamoeba histolytica
PEEISGMILKHMYDIAQMRLN

SEQ ID NO: 2690943 - protein, 17 aa, Entamoeba histolytica
PEEKLFILISEKLTFLK

SEQ ID NO: 2690944 - protein, 31 aa, Entamoeba histolytica
PEEKRINYISGYVDYDWDSLVSISFNKINFT

SEQ ID NO: 2690945 - protein, 26 aa, Entamoeba histolytica
PEELKGVAYQSGWFKPVGGILEESLY

SEQ ID NO: 2690946 - protein, 25 aa, Entamoeba histolytica
PEELLKDRFNLIVFGHEHCSQVEEG

SEQ ID NO: 2690947 - protein, 26 aa, Entamoeba histolytica
PEEQYKMPLSWIILKRVVQGRDWHYG

SEQ ID NO: 2690948 - protein, 18 aa, Entamoeba histolytica
PEEVHLIVCIAMRKILKF

SEQ ID NO: 2690949 - protein, 26 aa, Entamoeba histolytica
PEEYFRFLWELRLVFNSNLTQLEEVT

SEQ ID NO: 2690950 - protein, 23 aa, Entamoeba histolytica
PEEYKMVFCVRNDLKMGKGKIAA

SEQ ID NO: 2690951 - protein, 18 aa, Entamoeba histolytica
PEFEEFNENIELLIEFII

SEQ ID NO: 2690952 - protein, 19 aa, Entamoeba histolytica
PEFIKRLLYSLKDVIKQLT

SEQ ID NO: 2690953 - protein, 21 aa, Entamoeba histolytica
PEFINFCIERDYFIKLDAPTI

SEQ ID NO: 2690954 - protein, 21 aa, Entamoeba histolytica
PEFLMKRCIEKGVDPATLKDY

SEQ ID NO: 2690955 - protein, 30 aa, Entamoeba histolytica
PEFTIIPFSYCFYKPLPLNKFGNLVNYSNV

SEQ ID NO: 2690956 - protein, 20 aa, Entamoeba histolytica
PEFVPICLNELITYSDYITH

SEQ ID NO: 2690957 - protein, 22 aa, Entamoeba histolytica
PEGAASILCRYSSDEDKANRFH

SEQ ID NO: 2690958 - protein, 20 aa, Entamoeba histolytica
PEGALWSFAINSVIYFRLLS

SEQ ID NO: 2690959 - protein, 26 aa, Entamoeba histolytica
PEGDIRTSFKLSQPVFQVCSSKDSLI

SEQ ID NO: 2690960 - protein, 22 aa, Entamoeba histolytica
PEGDSLIHAIALWTRQVSFIKE

SEQ ID NO: 2690961 - protein, 24 aa, Entamoeba histolytica
PEGESCGLVKMLSLMAQITVALQD

SEQ ID NO: 2690962 - protein, 25 aa, Entamoeba histolytica
PEGLRQKIIFYLWTPEGCKIREKML

SEQ ID NO: 2690963 - protein, 23 aa, Entamoeba histolytica
PEGLTKLSSLIFLNLSENKIISV

SEQ ID NO: 2690964 - protein, 20 aa, Entamoeba histolytica
PEGNCLLRVISTLKRITTTT

SEQ ID NO: 2690965 - protein, 23 aa, Entamoeba histolytica
PEGPIASSFFSYNYCDFELVEDI

SEQ ID NO: 2690966 - protein, 18 aa, Entamoeba histolytica
PEHCIIKFVENNDIEFCS

SEQ ID NO: 2690967 - protein, 20 aa, Entamoeba histolytica
PEHIVKIIAMQYILLIEALT

SEQ ID NO: 2690968 - protein, 17 aa, Entamoeba histolytica
PEHPQYFAEIIVAGPSA

SEQ ID NO: 2690969 - protein, 18 aa, Entamoeba histolytica
PEHSRVLDFCGGKGGDYI

SEQ ID NO: 2690970 - protein, 23 aa, Entamoeba histolytica
PEIICFICISLASKIYEKRRRWV

SEQ ID NO: 2690971 - protein, 27 aa, Entamoeba histolytica
PEIIISFLRIIRLVTRYTKTNPDIIIP

SEQ ID NO: 2690972 - protein, 20 aa, Entamoeba histolytica
PEIILGLPYNNAIDMWSAGC

SEQ ID NO: 2690973 - protein, 21 aa, Entamoeba histolytica
PEIKYSIHIFTNISALSEGLL

SEQ ID NO: 2690974 - protein, 20 aa, Entamoeba histolytica
PEILAAGALAKIVNTGYTTL

SEQ ID NO: 2690975 - protein, 19 aa, Entamoeba histolytica
PEILSDFSGISFPKQSSFI

SEQ ID NO: 2690976 - protein, 22 aa, Entamoeba histolytica
PEIPVDTLFHFADVDGDGMIGG

SEQ ID NO: 2690977 - protein, 26 aa, Entamoeba histolytica
PEIPVESYINFPFPFCIIDPSRRSVQ

SEQ ID NO: 2690978 - protein, 36 aa, Entamoeba histolytica
PEIRKGSIYEDCIRRDFTINCLFYRIEDGMIEDYTN

SEQ ID NO: 2690979 - protein, 22 aa, Entamoeba histolytica
PEIVLGLPYSCAIDMWSVGCIA

SEQ ID NO: 2690980 - protein, 24 aa, Entamoeba histolytica
PEIVLKCLPVLPFEITEDYLKGRR

SEQ ID NO: 2690981 - protein, 22 aa, Entamoeba histolytica
PEIVSIFFKDINIIVSTEESAI

SEQ ID NO: 2690982 - protein, 21 aa, Entamoeba histolytica
PEIYPNFEFHGKYAKTTANHL

SEQ ID NO: 2690983 - protein, 21 aa, Entamoeba histolytica
PEKIDTMIIQAVSLLDDLDKE

SEQ ID NO: 2690984 - protein, 23 aa, Entamoeba histolytica
PEKIVGIDWGDQLIKVSFNNKNT

SEQ ID NO: 2690985 - protein, 18 aa, Entamoeba histolytica
PEKLEIMKNVFNPRFKYG

SEQ ID NO: 2690986 - protein, 23 aa, Entamoeba histolytica
PEKLKLVGPHLKNEFKNYVYLTS

SEQ ID NO: 2690987 - protein, 23 aa, Entamoeba histolytica
PEKSLPGLLIYKGDCMVKSLFGS

SEQ ID NO: 2690988 - protein, 20 aa, Entamoeba histolytica
PEKYGLCSNEQITLKNKRNL

SEQ ID NO: 2690989 - protein, 19 aa, Entamoeba histolytica
PELACQCISSLKKITKQCK

SEQ ID NO: 2690990 - protein, 19 aa, Entamoeba histolytica
PELADICLIGKKEEVQGKH

SEQ ID NO: 2690991 - protein, 28 aa, Entamoeba histolytica
PELCNKFKIPFLFFKSQHPLYKIKEIYS

SEQ ID NO: 2690992 - protein, 21 aa, Entamoeba histolytica
PELDLKISSYVAIEGQLKKEA

SEQ ID NO: 2690993 - protein, 20 aa, Entamoeba histolytica
PELDRFKRSQPRNVATDLFL

SEQ ID NO: 2690994 - protein, 23 aa, Entamoeba histolytica
PELHCCPDGWEFEQLSIKNKDCP

SEQ ID NO: 2690995 - protein, 24 aa, Entamoeba histolytica
PELHSGVHLTNWWTEQCDHELLVG

SEQ ID NO: 2690996 - protein, 26 aa, Entamoeba histolytica
PELHYIIPNELWKWVNKIVNKLQGNE

SEQ ID NO: 2690997 - protein, 19 aa, Entamoeba histolytica
PELIFGHLLTSSNYKDDDK

SEQ ID NO: 2690998 - protein, 21 aa, Entamoeba histolytica
PELIPYIPTLTKFLSYQKCNE

SEQ ID NO: 2690999 - protein, 23 aa, Entamoeba histolytica
PELKPNIIEILKKCAYDEDQEVR

SEQ ID NO: 2691000 - protein, 17 aa, Entamoeba histolytica
PELKVSFTYFDINGKDK

SEQ ID NO: 2691001 - protein, 17 aa, Entamoeba histolytica
PELPKLTQRELLTSQPK

SEQ ID NO: 2691002 - protein, 30 aa, Entamoeba histolytica; identical to SEQ ID NO: 2499307

SEQ ID NO: 2691003 - protein, 19 aa, Entamoeba histolytica
PELRQITGVLLRKKISVVW

SEQ ID NO: 2691004 - protein, 21 aa, Entamoeba histolytica
PELRVLKLSTSIVHLNIVDVD

SEQ ID NO: 2691005 - protein, 19 aa, Entamoeba histolytica
PELTLLYKIPETYIKDLLR

SEQ ID NO: 2691006 - protein, 18 aa, Entamoeba histolytica
PELVPGGGASEMHIATTL

SEQ ID NO: 2691007 - protein, 19 aa, Entamoeba histolytica
PEMIGHYLGEFSITYKPVT

SEQ ID NO: 2691008 - protein, 24 aa, Entamoeba histolytica
PEMLLSIGDYCFDFCVNLTSLAIP

SEQ ID NO: 2691009 - protein, 20 aa, Entamoeba histolytica
PEMLRTSLASVILHMKKIGI

SEQ ID NO: 2691010 - protein, 26 aa, Entamoeba histolytica
PEMSADFFPKVWALRDNRMLSAVTSK

SEQ ID NO: 2691011 - protein, 18 aa, Entamoeba histolytica
PEMTEFIIFNFSHKHPLV

SEQ ID NO: 2691012 - protein, 17 aa, Entamoeba histolytica
PENIIEIMLQYCSETEN

SEQ ID NO: 2691013 - protein, 18 aa, Entamoeba histolytica
PENILICADGYIRLTDFG

SEQ ID NO: 2691014 - protein, 19 aa, Entamoeba histolytica
PENIVREAIKNTSTLDEAR

SEQ ID NO: 2691015 - protein, 17 aa, Entamoeba histolytica
PENKPRYLMGVGYPVEM

SEQ ID NO: 2691016 - protein, 21 aa, Entamoeba histolytica
PENRVSWEVLVDGMKQIEDFG

SEQ ID NO: 2691017 - protein, 21 aa, Entamoeba histolytica
PENSIFCSAIFHFIDQNSFDK

SEQ ID NO: 2691018 - protein, 25 aa, Entamoeba histolytica
PEPDFPNRLAIYLSIALEPNELCKK

SEQ ID NO: 2691019 - protein, 19 aa, Entamoeba histolytica
PEPFGEVVWELQKCVTQIK

SEQ ID NO: 2691020 - protein, 27 aa, Entamoeba histolytica
PEPHLVKLLGELGCGFDCASLNEIKEV

SEQ ID NO: 2691021 - protein, 22 aa, Entamoeba histolytica
PEPIEAMILRYVKKKADWWTDV

SEQ ID NO: 2691022 - protein, 20 aa, Entamoeba histolytica
PEPMNLHLLLNLVSSIHTRQ

SEQ ID NO: 2691023 - protein, 27 aa, Entamoeba histolytica
PEPNLFVFKYLFMFLTKVMAESKINKM

SEQ ID NO: 2691024 - protein, 21 aa, Entamoeba histolytica
PEPSTVIIPRVLKRSEEVKQN

SEQ ID NO: 2691025 - protein, 19 aa, Entamoeba histolytica
PEQICCAASNLRPEDIIVD

SEQ ID NO: 2691026 - protein, 25 aa, Entamoeba histolytica
PEQVSWRLASSIFSRNEKRVTIIKK

SEQ ID NO: 2691027 - protein, 25 aa, Entamoeba histolytica
PEQYLCGLAHGVAKEPTRINLDVPM

SEQ ID NO: 2691028 - protein, 20 aa, Entamoeba histolytica
PERALQFWLDFLKVADIKTD

SEQ ID NO: 2691029 - protein, 24 aa, Entamoeba histolytica
PERDLRIIGKMSKLLIDMKIPQAR

SEQ ID NO: 2691030 - protein, 17 aa, Entamoeba histolytica
PERKPMLSASKRSSLPA

SEQ ID NO: 2691031 - protein, 19 aa, Entamoeba histolytica
PERNEYIFGSVINVSQMVS

SEQ ID NO: 2691032 - protein, 18 aa, Entamoeba histolytica
PERVPKAAAVVLDQTKPI

SEQ ID NO: 2691033 - protein, 25 aa, Entamoeba histolytica
PESCSPAFWKFLDLIGNKIELNGWS

SEQ ID NO: 2691034 - protein, 19 aa, Entamoeba histolytica
PESDGCGLFQPETERNIEN

SEQ ID NO: 2691035 - protein, 23 aa, Entamoeba histolytica
PESPVDFPGLFPYGLSVPPSPDC

SEQ ID NO: 2691036 - protein, 18 aa, Entamoeba histolytica
PESRCAIADLLYVVIDRM

SEQ ID NO: 2691037 - protein, 17 aa, Entamoeba histolytica
PESSILINSIEKYYEEA

SEQ ID NO: 2691038 - protein, 20 aa, Entamoeba histolytica
PESYLISGIFVFGIEYAQLK

SEQ ID NO: 2691039 - protein, 20 aa, Entamoeba histolytica
PETLGQLTLVALGLVPPSTN

SEQ ID NO: 2691040 - protein, 19 aa, Entamoeba histolytica
PEVAFACAAMNEIPEQYAY

SEQ ID NO: 2691041 - protein, 21 aa, Entamoeba histolytica
PEVEARWVIYQVVSALYYLHS

SEQ ID NO: 2691042 - protein, 24 aa, Entamoeba histolytica
PEVEMKFKYGIIQKELTNEEKGKV

SEQ ID NO: 2691043 - protein, 21 aa, Entamoeba histolytica
PEVHKKIVVMMYQSLIRDLNM

SEQ ID NO: 2691044 - protein, 20 aa, Entamoeba histolytica
PEVILGLHWGCPVDIWSHGC

SEQ ID NO: 2691045 - protein, 21 aa, Entamoeba histolytica
PEVILGLPYSTSIDMWSLGCI

SEQ ID NO: 2691046 - protein, 22 aa, Entamoeba histolytica
PEVLFRRSLFGYCIRTNSSSSD

SEQ ID NO: 2691047 - protein, 21 aa, Entamoeba histolytica
PEVLNSMLPYFSEIYGNPNSL

SEQ ID NO: 2691048 - protein, 20 aa, Entamoeba histolytica
PEVLRLKGTEFPDVTLEDAS

SEQ ID NO: 2691049 - protein, 20 aa, Entamoeba histolytica
PEWIPKELLTNIFIKKIISL

SEQ ID NO: 2691050 - protein, 17 aa, Entamoeba histolytica
PEWISLNLGIVICLECC

SEQ ID NO: 2691051 - protein, 21 aa, Entamoeba histolytica
PEYCKPFTFPIEDILQKFHLQ

SEQ ID NO: 2691052 - protein, 20 aa, Entamoeba histolytica
PEYCVQHLIHFLGYGEMVEN

SEQ ID NO: 2691053 - protein, 21 aa, Entamoeba histolytica
PEYIGKIPIQIIKTIAQHYGE

SEQ ID NO: 2691054 - protein, 18 aa, Entamoeba histolytica
PEYLAPEVVEGLDYNEYI

SEQ ID NO: 2691055 - protein, 21 aa, Entamoeba histolytica
PEYLFNVNFGDIFVVRSAGGV

SEQ ID NO: 2691056 - protein, 29 aa, Entamoeba histolytica
PFADKIWNIRFIKGLTWGRIFEDKESKQI

SEQ ID NO: 2691057 - protein, 18 aa, Entamoeba histolytica
PFALKIVLILIEQSATPP

SEQ ID NO: 2691058 - protein, 18 aa, Entamoeba histolytica
PFDGSPMKIIRGSYDLPK

SEQ ID NO: 2691059 - protein, 19 aa, Entamoeba histolytica
PFDLIPVRFDPKVEMNFNI

SEQ ID NO: 2691060 - protein, 21 aa, Entamoeba histolytica
PFDSEFELCSFIGKTTEKDKA

SEQ ID NO: 2691061 - protein, 25 aa, Entamoeba histolytica
PFEIKKPQWANGFEWKNEYDQQIVL

SEQ ID NO: 2691062 - protein, 34 aa, Entamoeba histolytica
PFFLDIFGSLLLKFNIYGGWTFIYQILYSVLKYN

SEQ ID NO: 2691063 - protein, 17 aa, Entamoeba histolytica
PFFSHLQTFWVYSQDNP

SEQ ID NO: 2691064 - protein, 17 aa, Entamoeba histolytica
PFGKCPKELLQLSDNNP

SEQ ID NO: 2691065 - protein, 37 aa, Entamoeba histolytica
PFGPHPIEVFALIAALRILCPLNFILLNPQYPLLNLP

SEQ ID NO: 2691066 - protein, 18 aa, Entamoeba histolytica
PFGPIIGVDIVYKPQTNE

SEQ ID NO: 2691067 - protein, 18 aa, Entamoeba histolytica
PFGTEMWDIEMINFCEMT

SEQ ID NO: 2691068 - protein, 20 aa, Entamoeba histolytica
PFHADTCIGDLLSLLITYIT

SEQ ID NO: 2691069 - protein, 23 aa, Entamoeba histolytica
PFHAEARVGITFTESELKEAQSK

SEQ ID NO: 2691070 - protein, 17 aa, Entamoeba histolytica
PFHPPKNGIMYFESKLL

SEQ ID NO: 2691071 - protein, 18 aa, Entamoeba histolytica
PFIDRKTIELHQMDILNE

SEQ ID NO: 2691072 - protein, 22 aa, Entamoeba histolytica
PFIEDILFELCFDSVKDIFIKK

SEQ ID NO: 2691073 - protein, 20 aa, Entamoeba histolytica
PFIIAGFKYLDKVFTDAQTF

SEQ ID NO: 2691074 - protein, 20 aa, Entamoeba histolytica
PFIIGCTYSTFLQMLEEVEI

SEQ ID NO: 2691075 - protein, 24 aa, Entamoeba histolytica
PFIKKGIESNDNFIILQSLVQLKK

SEQ ID NO: 2691076 - protein, 17 aa, Entamoeba histolytica
PFIKVPFFEAGKNLKNR

SEQ ID NO: 2691077 - protein, 18 aa, Entamoeba histolytica
PFILNNRTPILLIQNPDY

SEQ ID NO: 2691078 - protein, 24 aa, Entamoeba histolytica
PFIPSGRVIQMFPGKSVPKPISPD

SEQ ID NO: 2691079 - protein, 18 aa, Entamoeba histolytica
PFIQLCIERSIKASNEKR

SEQ ID NO: 2691080 - protein, 23 aa, Entamoeba histolytica
PFKIKIKGLHIISQPQTVFVFDA

SEQ ID NO: 2691081 - protein, 21 aa, Entamoeba histolytica
PFKKFDLLLCFVSQSEDTSIV

SEQ ID NO: 2691082 - protein, 18 aa, Entamoeba histolytica
PFLEKAAEYQLPYHIAKK

SEQ ID NO: 2691083 - protein, 20 aa, Entamoeba histolytica
PFLETLKLTFFSPLILCYIP

SEQ ID NO: 2691084 - protein, 18 aa, Entamoeba histolytica
PFLQMLRTYYCSMSIDKK

SEQ ID NO: 2691085 - protein, 17 aa, Entamoeba histolytica
PFLSKDILYEPIKELKE

SEQ ID NO: 2691086 - protein, 19 aa, Entamoeba histolytica
PFMGFQLSEFFEVVDNFHI

SEQ ID NO: 2691087 - protein, 19 aa, Entamoeba histolytica
PFMPKLQILTIRFTQKVIQ

SEQ ID NO: 2691088 - protein, 18 aa, Entamoeba histolytica
PFNDFFMRGLNVSLSSDD

SEQ ID NO: 2691089 - protein, 28 aa, Entamoeba histolytica
PFNFPDFFDCFSYSLPTMMEMLVNILSE

SEQ ID NO: 2691090 - protein, 21 aa, Entamoeba histolytica
PFNFSKLKLFNPFIPDFLVDI

SEQ ID NO: 2691091 - protein, 20 aa, Entamoeba histolytica
PFNIESLWLTPSMVDSILSN

SEQ ID NO: 2691092 - protein, 25 aa, Entamoeba histolytica
PFNRDILGSICCHLLNSPAFSGDQS

SEQ ID NO: 2691093 - protein, 18 aa, Entamoeba histolytica
PFPQIPIEEVKKNLPSGQ

SEQ ID NO: 2691094 - protein, 19 aa, Entamoeba histolytica
PFQIHKIFYFLYTVGYSST

SEQ ID NO: 2691095 - protein, 25 aa, Entamoeba histolytica
PFQLPEFQDGFSFSLPYLLEHCVRI

SEQ ID NO: 2691096 - protein, 18 aa, Entamoeba histolytica
PFQLPPMTPDSFRKAFEN

SEQ ID NO: 2691097 - protein, 22 aa, Entamoeba histolytica
PFQREMRGVISTAIDENIDALE

SEQ ID NO: 2691098 - protein, 18 aa, Entamoeba histolytica
PFRDCKLTSILKNSMLQS

SEQ ID NO: 2691099 - protein, 26 aa, Entamoeba histolytica
PFRMTGTFDGVISFDHNRFLFNGNAK

SEQ ID NO: 2691100 - protein, 22 aa, Entamoeba histolytica
PFSKECIDFVNGPVCLLSKYTA

SEQ ID NO: 2691101 - protein, 18 aa, Entamoeba histolytica
PFSLLQLPIIKNLSFFKK

SEQ ID NO: 2691102 - protein, 27 aa, Entamoeba histolytica
PFSQNFIRIGMNWKQADPSSCYIFDCM

SEQ ID NO: 2691103 - protein, 18 aa, Entamoeba histolytica
PFSSFSNSLSQFGNTINS

SEQ ID NO: 2691104 - protein, 17 aa, Entamoeba histolytica
PFTQLVRMNAALEEVLD

SEQ ID NO: 2691105 - protein, 20 aa, Entamoeba histolytica
PFVDPDIIKTALIDCNYDKN

SEQ ID NO: 2691106 - protein, 27 aa, Entamoeba histolytica
PFVEPLQCPGVFPFFIKTECSDQVNFI

SEQ ID NO: 2691107 - protein, 21 aa, Entamoeba histolytica
PFVKEVCALINLAHSKGEKVL

SEQ ID NO: 2691108 - protein, 17 aa, Entamoeba histolytica
PFVLGFGSTSSGYSKSG

SEQ ID NO: 2691109 - protein, 18 aa, Entamoeba histolytica
PFYGEALYQLKSWKELHA

SEQ ID NO: 2691110 - protein, 17 aa, Entamoeba histolytica
PFYRTISGFAVLIEKDW

SEQ ID NO: 2691111 - protein, 19 aa, Entamoeba histolytica
PFYSLKPFTTCTWFYIHSF

SEQ ID NO: 2691112 - protein, 23 aa, Entamoeba histolytica
PGDGYLKYYLYNWACPKVEPNKL

SEQ ID NO: 2691113 - protein, 18 aa, Entamoeba histolytica
PGDIPAIYAECKKAEEEL

SEQ ID NO: 2691114 - protein, 18 aa, Entamoeba histolytica
PGDKIGIFCETRYEWMAF

SEQ ID NO: 2691115 - protein, 19 aa, Entamoeba histolytica
PGEVCGCIFNSKQYKESER

SEQ ID NO: 2691116 - protein, 24 aa, Entamoeba histolytica
PGEYPWLAYIKFEIRIGEIKVAKE

SEQ ID NO: 2691117 - protein, 17 aa, Entamoeba histolytica
PGFDLKNCKAICCSHGP

SEQ ID NO: 2691118 - protein, 19 aa, Entamoeba histolytica
PGFYEEKLLQFIIENIEGK

SEQ ID NO: 2691119 - protein, 17 aa, Entamoeba histolytica
PGGEAHGGYSYCAVAAL

SEQ ID NO: 2691120 - protein, 19 aa, Entamoeba histolytica
PGGGFSFGGVDPMDIFEQF

SEQ ID NO: 2691121 - protein, 24 aa, Entamoeba histolytica
PGHSPGSCSFYFKDEEIVINGDTL

SEQ ID NO: 2691122 - protein, 18 aa, Entamoeba histolytica
PGIISIFLGNVIQTLIDS

SEQ ID NO: 2691123 - protein, 23 aa, Entamoeba histolytica
PGIVRERILIFVLRHKRSNEFGD

SEQ ID NO: 2691124 - protein, 19 aa, Entamoeba histolytica
PGKKVKCVKDIELIRRDYV

SEQ ID NO: 2691125 - protein, 25 aa, Entamoeba histolytica
PGKVVESFSIWGLPSKFRVTKPFNF

SEQ ID NO: 2691126 - protein, 24 aa, Entamoeba histolytica
PGLAKLEPLPGFSDSIKEKIPPIE

SEQ ID NO: 2691127 - protein, 20 aa, Entamoeba histolytica
PGLSERILSFLILNSSNVIN

SEQ ID NO: 2691128 - protein, 20 aa, Entamoeba histolytica
PGLSSSRVTSRFINKKEEAN

SEQ ID NO: 2691129 - protein, 26 aa, Entamoeba histolytica
PGMPPPPPGGFGFRPAAPKPNAYVTM

SEQ ID NO: 2691130 - protein, 24 aa, Entamoeba histolytica
PGNCFREVVAKFYLAEIICALEYL

SEQ ID NO: 2691131 - protein, 24 aa, Entamoeba histolytica
PGNREFMMRASFELPSIRDEETDK

SEQ ID NO: 2691132 - protein, 22 aa, Entamoeba histolytica
PGPLRAKLAIGESIKLGNGNVV

SEQ ID NO: 2691133 - protein, 20 aa, Entamoeba histolytica
PGPNRRGQIGSRHNLSPLEQ

SEQ ID NO: 2691134 - protein, 19 aa, Entamoeba histolytica
PGQMIRPVIHRATGNIVNI

SEQ ID NO: 2691135 - protein, 17 aa, Entamoeba histolytica
PGRFDCLIEVPKPDQKT

SEQ ID NO: 2691136 - protein, 19 aa, Entamoeba histolytica
PGSFISKRTGFTCDSRSTI

SEQ ID NO: 2691137 - protein, 19 aa, Entamoeba histolytica
PGSFKDLQTLAGNKGDRDW

SEQ ID NO: 2691138 - protein, 25 aa, Entamoeba histolytica
PGSFKELQTMAGNKGDRDWLDKNTV

SEQ ID NO: 2691139 - protein, 17 aa, Entamoeba histolytica
PGSGACWGKEIWMKNYI

SEQ ID NO: 2691140 - protein, 25 aa, Entamoeba histolytica
PGSGFGCKGFYRISVCQTPEYIQSI

SEQ ID NO: 2691141 - protein, 26 aa, Entamoeba histolytica
PGTFRSSSQFVLLMKRIVNFFREKLH

SEQ ID NO: 2691142 - protein, 24 aa, Entamoeba histolytica
PGTYEFPFSFILPHDLPPASYFGP

SEQ ID NO: 2691143 - protein, 21 aa, Entamoeba histolytica
PGVEMLYPHYIRYMYEVITKV

SEQ ID NO: 2691144 - protein, 17 aa, Entamoeba histolytica
PGVNRFPFEIVLPENCC

SEQ ID NO: 2691145 - protein, 18 aa, Entamoeba histolytica
PGYEIIKNVYFETEHFST

SEQ ID NO: 2691146 - protein, 23 aa, Entamoeba histolytica
PGYPEGWLPKGIHSIGTEIHENQ

SEQ ID NO: 2691147 - protein, 20 aa, Entamoeba histolytica
PHAFPSRMTIAMLVESMASK

SEQ ID NO: 2691148 - protein, 17 aa, Entamoeba histolytica
PHCHLVDEILRVYKKLY

SEQ ID NO: 2691149 - protein, 20 aa, Entamoeba histolytica
PHDFPFPPIFPLYQPSLRSQ

SEQ ID NO: 2691150 - protein, 20 aa, Entamoeba histolytica
PHDRCLISTGIAVQIPHSCY

SEQ ID NO: 2691151 - protein, 18 aa, Entamoeba histolytica
PHEELLRHSIPVIEHINS

SEQ ID NO: 2691152 - protein, 25 aa, Entamoeba histolytica
PHEKRTIFSPVMFPMAPSFPPVIFP

SEQ ID NO: 2691153 - protein, 17 aa, Entamoeba histolytica
PHFKKSLEEFNFTDDCP

SEQ ID NO: 2691154 - protein, 25 aa, Entamoeba histolytica
PHFLGQDILRLQGIFERAKQVKSIN

SEQ ID NO: 2691155 - protein, 25 aa, Entamoeba histolytica
PHGDVYRCLFKKTKAVVKFFSKADS

SEQ ID NO: 2691156 - protein, 25 aa, Entamoeba histolytica
PHGIPLDLLDRLLVIVTKQYTLQEL

SEQ ID NO: 2691157 - protein, 17 aa, Entamoeba histolytica
PHGPSIKFFVENITTMS

SEQ ID NO: 2691158 - protein, 21 aa, Entamoeba histolytica
PHHLRCLRKSLFISKQQHCHS

SEQ ID NO: 2691159 - protein, 17 aa, Entamoeba histolytica
PHICLCLHTKTAKIGYI

SEQ ID NO: 2691160 - protein, 18 aa, Entamoeba histolytica
PHINSFIGNGEFTETLSI

SEQ ID NO: 2691161 - protein, 19 aa, Entamoeba histolytica
PHIPCLPKIVQPFLSDEPM

SEQ ID NO: 2691162 - protein, 17 aa, Entamoeba histolytica
PHIRLFKDYSSGNYSVN

SEQ ID NO: 2691163 - protein, 17 aa, Entamoeba histolytica
PHKCLRTVEFYRQAPTE

SEQ ID NO: 2691164 - protein, 19 aa, Entamoeba histolytica
PHKDFRVIFTSNPINGEIS

SEQ ID NO: 2691165 - protein, 20 aa, Entamoeba histolytica
PHLKIGYKFDSLIHQCIIDI

SEQ ID NO: 2691166 - protein, 24 aa, Entamoeba histolytica
PHLSFKLVKFTTVLEEYWSVVVFH

SEQ ID NO: 2691167 - protein, 23 aa, Entamoeba histolytica
PHMLESFKFLLDRYKKVEDNKDK

SEQ ID NO: 2691168 - protein, 28 aa, Entamoeba histolytica
PHMLTIPSGLCWGCVMLTEVILPSCLRS

SEQ ID NO: 2691169 - protein, 21 aa, Entamoeba histolytica
PHPFYNKRSICLICANPKSYM

SEQ ID NO: 2691170 - protein, 24 aa, Entamoeba histolytica
PHPLRCLRKSLFITQQRQWDSVHI

SEQ ID NO: 2691171 - protein, 19 aa, Entamoeba histolytica
PHQIVLELVDFSNPLISLT

SEQ ID NO: 2691172 - protein, 18 aa, Entamoeba histolytica
PHQKRLIVNVTERKTIIP

SEQ ID NO: 2691173 - protein, 17 aa, Entamoeba histolytica
PHQRLRPIQALHHPFIT

SEQ ID NO: 2691174 - protein, 19 aa, Entamoeba histolytica
PHQRMEIVNLMSKIMDFTD

SEQ ID NO: 2691175 - protein, 27 aa, Entamoeba histolytica
PHSFICCARGPSIVKMYSFLTNQLLNS

SEQ ID NO: 2691176 - protein, 25 aa, Entamoeba histolytica
PHSSVTILLPHVWPAQQVITPQDQE

SEQ ID NO: 2691177 - protein, 18 aa, Entamoeba histolytica
PHTTDLVIGTLLNSSVGY

SEQ ID NO: 2691178 - protein, 35 aa, Entamoeba histolytica; identical to SEQ ID NO: 2499523

SEQ ID NO: 2691179 - protein, 29 aa, Entamoeba histolytica
PHVPTINIIIFWHRLHLFNGEVIEGITSF

SEQ ID NO: 2691180 - protein, 24 aa, Entamoeba histolytica
PHWDISIGGCADGNIVLYKMNNII

SEQ ID NO: 2691181 - protein, 17 aa, Entamoeba histolytica
PHYELRGEELMKAIVNE

SEQ ID NO: 2691182 - protein, 18 aa, Entamoeba histolytica
PHYWKEDYGFVSRGFVEN

SEQ ID NO: 2691183 - protein, 17 aa, Entamoeba histolytica
PIACPDKNWNVLREESR

SEQ ID NO: 2691184 - protein, 28 aa, Entamoeba histolytica
PIAERLKTRPAFVLFIKHFYIYVLQITP

SEQ ID NO: 2691185 - protein, 18 aa, Entamoeba histolytica
PIAGGLLVMYLLSLNEPM

SEQ ID NO: 2691186 - protein, 18 aa, Entamoeba histolytica
PIAHRPLWEQILKELKKA

SEQ ID NO: 2691187 - protein, 25 aa, Entamoeba histolytica
PIALLRGHSDWVFGSKFIDEDVLFS

SEQ ID NO: 2691188 - protein, 20 aa, Entamoeba histolytica
PICESKSFKPSYIVAIQWSK

SEQ ID NO: 2691189 - protein, 22 aa, Entamoeba histolytica
PICKDPRTADDMARSLQALRNL

SEQ ID NO: 2691190 - protein, 19 aa, Entamoeba histolytica
PIDHCFLIEDFIRQFVKVI

SEQ ID NO: 2691191 - protein, 18 aa, Entamoeba histolytica
PIDIFLQQVRIEIKETIH

SEQ ID NO: 2691192 - protein, 19 aa, Entamoeba histolytica
PIDIFNIINPLPFILSPIH

SEQ ID NO: 2691193 - protein, 24 aa, Entamoeba histolytica
PIDISLPLYHSFPLINSYMSEPFP

SEQ ID NO: 2691194 - protein, 17 aa, Entamoeba histolytica
PIDNIIYSYRFLQVNSL

SEQ ID NO: 2691195 - protein, 18 aa, Entamoeba histolytica
PIDYNIFEQILFNYWSFI

SEQ ID NO: 2691196 - protein, 21 aa, Entamoeba histolytica
PIEHTKHFVSFDFLDKEDRIE

SEQ ID NO: 2691197 - protein, 23 aa, Entamoeba histolytica
PIELSWYPGGIAYQLNASRGEIQ

SEQ ID NO: 2691198 - protein, 24 aa, Entamoeba histolytica
PIEMELIQFIKIIIKYFSKEIDFP

SEQ ID NO: 2691199 - protein, 21 aa, Entamoeba histolytica
PIEMSKALLLNTIENKESIKL

SEQ ID NO: 2691200 - protein, 19 aa, Entamoeba histolytica
PIEQCELTFMSIIESLQVD

SEQ ID NO: 2691201 - protein, 21 aa, Entamoeba histolytica
PIERMPMVISVDITKDLEEEI

SEQ ID NO: 2691202 - protein, 25 aa, Entamoeba histolytica
PIFIKNILVCLSLVHYSGITPLGGT

SEQ ID NO: 2691203 - protein, 18 aa, Entamoeba histolytica
PIFSRTYFSIAVTPINEP

SEQ ID NO: 2691204 - protein, 20 aa, Entamoeba histolytica
PIFTPCLLLPEKGEMGISPS

SEQ ID NO: 2691205 - protein, 25 aa, Entamoeba histolytica
PIFYDLAFCKLRRTLYAKALMIRYS

SEQ ID NO: 2691206 - protein, 19 aa, Entamoeba histolytica
PIGDSRIGVLINNKVDQFF

SEQ ID NO: 2691207 - protein, 23 aa, Entamoeba histolytica
PIGECKGKHVVLYDDIIRSGKTA

SEQ ID NO: 2691208 - protein, 26 aa, Entamoeba histolytica
PIGQGNVCYVEFGGPVPPQAPMGIGN

SEQ ID NO: 2691209 - protein, 19 aa, Entamoeba histolytica
PIHYWRYRCHVDMDEIIAD

SEQ ID NO: 2691210 - protein, 22 aa, Entamoeba histolytica
PIIKEEEPKCDITEVHTVPLPP

SEQ ID NO: 2691211 - protein, 21 aa, Entamoeba histolytica
PIIKRRCSFIKRVSSPRSLIK

SEQ ID NO: 2691212 - protein, 25 aa, Entamoeba histolytica
PIIVHCIRCVFYIGRNKTGLIKMFN

SEQ ID NO: 2691213 - protein, 24 aa, Entamoeba histolytica
PIKEHYKSFISYTLEHIREDDTSL

SEQ ID NO: 2691214 - protein, 17 aa, Entamoeba histolytica
PIKEYPLTMLLKKIEDI

SEQ ID NO: 2691215 - protein, 24 aa, Entamoeba histolytica
PIKKVWKYPHQIFIDSIQLTDLAS

SEQ ID NO: 2691216 - protein, 22 aa, Entamoeba histolytica
PIKNERSVGTIPQWTEEENQLL

SEQ ID NO: 2691217 - protein, 17 aa, Entamoeba histolytica
PIKRAQPSLPQRQPSNS

SEQ ID NO: 2691218 - protein, 20 aa, Entamoeba histolytica
PIKRIARLIALKIIKINPNE

SEQ ID NO: 2691219 - protein, 23 aa, Entamoeba histolytica
PIKSIKPLLLVSSIKELTISQCH

SEQ ID NO: 2691220 - protein, 24 aa, Entamoeba histolytica
PIKTKEVFIIIGRVIISLINNKRN

SEQ ID NO: 2691221 - protein, 29 aa, Entamoeba histolytica
PIKTQDAWKMARAVVKYDGIMCGMSSGAA

SEQ ID NO: 2691222 - protein, 23 aa, Entamoeba histolytica
PILHLKIPFHLKESLSEFDPSTC

SEQ ID NO: 2691223 - protein, 17 aa, Entamoeba histolytica
PILKRYPNATVIASTAA

SEQ ID NO: 2691224 - protein, 17 aa, Entamoeba histolytica
PILPNTFEKGVIKKGEE

SEQ ID NO: 2691225 - protein, 19 aa, Entamoeba histolytica
PILPPDLLSLAFAPMPFII

SEQ ID NO: 2691226 - protein, 23 aa, Entamoeba histolytica
PILPRLYMKQELCGLHGEEKKLK

SEQ ID NO: 2691227 - protein, 24 aa, Entamoeba histolytica
PILRFNPKCIVCVGDPMQLDPVLQ

SEQ ID NO: 2691228 - protein, 18 aa, Entamoeba histolytica
PILSIAIPFGDTIPKLPF

SEQ ID NO: 2691229 - protein, 22 aa, Entamoeba histolytica
PILSSTPFEFGLMVKQYFTQKI

SEQ ID NO: 2691230 - protein, 25 aa, Entamoeba histolytica
PIMALERRISRMFTFEKGNENIINA

SEQ ID NO: 2691231 - protein, 17 aa, Entamoeba histolytica
PIMFSVPREAEWGFVAA

SEQ ID NO: 2691232 - protein, 23 aa, Entamoeba histolytica
PIMMSHFYSIWTAFINKMEEGMI

SEQ ID NO: 2691233 - protein, 23 aa, Entamoeba histolytica
PINRIEGYGAFTISNNGDIICGA

SEQ ID NO: 2691234 - protein, 24 aa, Entamoeba histolytica
PINSARPNIHFFLYKPRLIGSKCV

SEQ ID NO: 2691235 - protein, 17 aa, Entamoeba histolytica
PINSSRPLPSIPQPKII

SEQ ID NO: 2691236 - protein, 25 aa, Entamoeba histolytica
PIPAILKPIPKWTGKQVFTQILPTI

SEQ ID NO: 2691237 - protein, 19 aa, Entamoeba histolytica
PIPGCYAPIKSVELSPNNE

SEQ ID NO: 2691238 - protein, 26 aa, Entamoeba histolytica
PIQCASIPIALKMRDLIALAETGTGK

SEQ ID NO: 2691239 - protein, 23 aa, Entamoeba histolytica
PIQCKICNAILLLSHHFARSYHF

SEQ ID NO: 2691240 - protein, 21 aa, Entamoeba histolytica
PIQIANFLNIHYELFGIIINK

SEQ ID NO: 2691241 - protein, 23 aa, Entamoeba histolytica
PIQLPSLLPPIQFVYEIVPNNTS

SEQ ID NO: 2691242 - protein, 26 aa, Entamoeba histolytica
PIQRIPRYGLLLKELIKTVPPQHDEY

SEQ ID NO: 2691243 - protein, 27 aa, Entamoeba histolytica
PIQRIPRYVLLISDLLRNISMVFGDAP

SEQ ID NO: 2691244 - protein, 20 aa, Entamoeba histolytica
PIQRIPRYVLLLESLLKCLP

SEQ ID NO: 2691245 - protein, 24 aa, Entamoeba histolytica
PIQRLPRYRLLLKDLLKHLRPSDV

SEQ ID NO: 2691246 - protein, 25 aa, Entamoeba histolytica
PIQRPPRYKLLLGAVRDNLPSWWNE

SEQ ID NO: 2691247 - protein, 18 aa, Entamoeba histolytica
PIQTFYLDDIISFTNYSI

SEQ ID NO: 2691248 - protein, 20 aa, Entamoeba histolytica
PIRSIFNCFHRTSVDYFTVN

SEQ ID NO: 2691249 - protein, 24 aa, Entamoeba histolytica
PIRSMREWATIPILGKLSKCQEHP

SEQ ID NO: 2691250 - protein, 22 aa, Entamoeba histolytica
PIRSWCFGWYSFQCSISENNSY

SEQ ID NO: 2691251 - protein, 25 aa, Entamoeba histolytica
PISEKRFEEQPGFKKHYDTITFLPN

SEQ ID NO: 2691252 - protein, 29 aa, Entamoeba histolytica
PISFALELYSRFYPIIPLKFTEGEFKWLG

SEQ ID NO: 2691253 - protein, 19 aa, Entamoeba histolytica
PISLQGRTCFTVIMDPSAI

SEQ ID NO: 2691254 - protein, 20 aa, Entamoeba histolytica
PISLTCFFKSSQMTESILIS

SEQ ID NO: 2691255 - protein, 18 aa, Entamoeba histolytica
PITIIWENGESLTINYNI

SEQ ID NO: 2691256 - protein, 17 aa, Entamoeba histolytica
PITIQFHKLKSYFQKDP

SEQ ID NO: 2691257 - protein, 17 aa, Entamoeba histolytica
PITPVIALTTLRITSPP

SEQ ID NO: 2691258 - protein, 32 aa, Entamoeba histolytica
PITSNPFFKVLRKEYLKADGFEKNFIATLFVN

SEQ ID NO: 2691259 - protein, 30 aa, Entamoeba histolytica
PITYAQFKLMWKNNMSFRHVLLKHHDINSI

SEQ ID NO: 2691260 - protein, 18 aa, Entamoeba histolytica
PIVESISLFYSVVYNSVG

SEQ ID NO: 2691261 - protein, 19 aa, Entamoeba histolytica
PIVKCLHNAIPKAFLDCHL

SEQ ID NO: 2691262 - protein, 17 aa, Entamoeba histolytica
PIYCFLFEDTILLISSD

SEQ ID NO: 2691263 - protein, 22 aa, Entamoeba histolytica
PIYEYLRYIIVPYLQKVTLCGK

SEQ ID NO: 2691264 - protein, 25 aa, Entamoeba histolytica
PIYNAAMLPPGWSIGQDYGEWYFID

SEQ ID NO: 2691265 - protein, 22 aa, Entamoeba histolytica
PKAEVKTEPAISYPLKTNHKKQ

SEQ ID NO: 2691266 - protein, 18 aa, Entamoeba histolytica
PKAPWSRCLILASRGVSA

SEQ ID NO: 2691267 - protein, 24 aa, Entamoeba histolytica
PKARNAQQLRIMLMEASVNISNIE

SEQ ID NO: 2691268 - protein, 33 aa, Entamoeba histolytica
PKAVPSLICQFNLRCLEFLKSYISRKEMYFMLC

SEQ ID NO: 2691269 - protein, 23 aa, Entamoeba histolytica
PKCAKCGKPLVGNFVTCGGRNWH

SEQ ID NO: 2691270 - protein, 19 aa, Entamoeba histolytica
PKCDLCLKPITGAYVRTDK

SEQ ID NO: 2691271 - protein, 20 aa, Entamoeba histolytica
PKCLTSQFNHIFIVVQPEIN

SEQ ID NO: 2691272 - protein, 18 aa, Entamoeba histolytica
PKCQAKYIDRCPICTSCE

SEQ ID NO: 2691273 - protein, 25 aa, Entamoeba histolytica
PKDEAHLIAFMAIRTFFAKKRPILI

SEQ ID NO: 2691274 - protein, 20 aa, Entamoeba histolytica
PKDECLKKYINVIKKLIHLK

SEQ ID NO: 2691275 - protein, 17 aa, Entamoeba histolytica
PKDEVVAVLNNMKSIKP

SEQ ID NO: 2691276 - protein, 20 aa, Entamoeba histolytica
PKDFVFEDLEGFKIPIDDEQ

SEQ ID NO: 2691277 - protein, 22 aa, Entamoeba histolytica
PKDFVFEDLEGFKIPSDDEQTL

SEQ ID NO: 2691278 - protein, 25 aa, Entamoeba histolytica
PKDIKKLMIEMCKHSFEKKSRGYME

SEQ ID NO: 2691279 - protein, 19 aa, Entamoeba histolytica
PKDKFFIDFYDGVNKLKEV

SEQ ID NO: 2691280 - protein, 18 aa, Entamoeba histolytica
PKDKIKEIVEMFGNDFDS

SEQ ID NO: 2691281 - protein, 19 aa, Entamoeba histolytica
PKDSGNCMSFAQPPPSKLK

SEQ ID NO: 2691282 - protein, 18 aa, Entamoeba histolytica
PKECCHFISATYSPKSFL

SEQ ID NO: 2691283 - protein, 18 aa, Entamoeba histolytica
PKEECLIRQTDYSNGMIG

SEQ ID NO: 2691284 - protein, 20 aa, Entamoeba histolytica
PKEEIPVLIEAIKETPPVPV

SEQ ID NO: 2691285 - protein, 19 aa, Entamoeba histolytica
PKEFASIIDNGKWKEKKEV

SEQ ID NO: 2691286 - protein, 19 aa, Entamoeba histolytica
PKEFWKALGEKEGKIKSAE

SEQ ID NO: 2691287 - protein, 24 aa, Entamoeba histolytica
PKEGNWEISYHMFNVGQGDCALLL

SEQ ID NO: 2691288 - protein, 24 aa, Entamoeba histolytica
PKEIKREFICCGPMYVVNDRVSLP

SEQ ID NO: 2691289 - protein, 23 aa, Entamoeba histolytica
PKEITSKLVEIWNGMNEEEKAKF

SEQ ID NO: 2691290 - protein, 19 aa, Entamoeba histolytica
PKEIVAKCSKVFSMDNVYI

SEQ ID NO: 2691291 - protein, 20 aa, Entamoeba histolytica
PKEIWRLGSDIISEIKADTL

SEQ ID NO: 2691292 - protein, 21 aa, Entamoeba histolytica
PKEIYVSLGKAFVLSDYETLK

SEQ ID NO: 2691293 - protein, 19 aa, Entamoeba histolytica
PKEKTGIVYIEAMTERKFA

SEQ ID NO: 2691294 - protein, 23 aa, Entamoeba histolytica
PKENYRCVIPLGVDPAKYDKAFP

SEQ ID NO: 2691295 - protein, 25 aa, Entamoeba histolytica
PKEQSRCTCSNPLYSFSVCAQCKKV

SEQ ID NO: 2691296 - protein, 23 aa, Entamoeba histolytica
PKERGDQILQCIYTNLKSVLSMN

SEQ ID NO: 2691297 - protein, 19 aa, Entamoeba histolytica
PKERITIDEIVRMLEGIES

SEQ ID NO: 2691298 - protein, 19 aa, Entamoeba histolytica
PKERITIDEIVRMLEKIKS

SEQ ID NO: 2691299 - protein, 19 aa, Entamoeba histolytica
PKESVKWLLSATINDDIET

SEQ ID NO: 2691300 - protein, 26 aa, Entamoeba histolytica
PKETDGRFLLDFDIVYNSSNFIEISL

SEQ ID NO: 2691301 - protein, 19 aa, Entamoeba histolytica
PKEVFLILHDCSGEKSKAK

SEQ ID NO: 2691302 - protein, 21 aa, Entamoeba histolytica
PKEVIISGSLIDFIESSATCG

SEQ ID NO: 2691303 - protein, 25 aa, Entamoeba histolytica
PKEVTKRKVEEAIPKTEDKTTKKVV

SEQ ID NO: 2691304 - protein, 25 aa, Entamoeba histolytica
PKEWNHSFLVPAFVGQKCIVKLMNK

SEQ ID NO: 2691305 - protein, 18 aa, Entamoeba histolytica
PKFPDFFTDEMKEFLPVI

SEQ ID NO: 2691306 - protein, 17 aa, Entamoeba histolytica
PKFPFTISKRVKSKTVH

SEQ ID NO: 2691307 - protein, 23 aa, Entamoeba histolytica
PKFQIDLSIAIFNIHINKRNKVI

SEQ ID NO: 2691308 - protein, 19 aa, Entamoeba histolytica
PKFRYKKVAPRQVSEPVPI

SEQ ID NO: 2691309 - protein, 21 aa, Entamoeba histolytica
PKFTLKYQIQIGRYYFVPTKA

SEQ ID NO: 2691310 - protein, 20 aa, Entamoeba histolytica
PKGIIPFQLPTMEDIKLFEG

SEQ ID NO: 2691311 - protein, 20 aa, Entamoeba histolytica
PKGILAYQFPPPISAIKLTP

SEQ ID NO: 2691312 - protein, 19 aa, Entamoeba histolytica
PKGKNFMFIHFSKEESAKE

SEQ ID NO: 2691313 - protein, 23 aa, Entamoeba histolytica
PKGKRYIDSFIYSFPLFLTKKEL

SEQ ID NO: 2691314 - protein, 25 aa, Entamoeba histolytica
PKGLKKFQIECCDRLDEILNIENSY

SEQ ID NO: 2691315 - protein, 21 aa, Entamoeba histolytica
PKGSDCYYMKFGVTPNTTSYE

SEQ ID NO: 2691316 - protein, 18 aa, Entamoeba histolytica
PKGVGALFIRAGKPITPL

SEQ ID NO: 2691317 - protein, 22 aa, Entamoeba histolytica
PKHGCKALPYVQVQSIKRNNDV

SEQ ID NO: 2691318 - protein, 17 aa, Entamoeba histolytica
PKHSYLLQQCYLNCLNK

SEQ ID NO: 2691319 - protein, 18 aa, Entamoeba histolytica
PKHTKEFTELIPSIQKTY

SEQ ID NO: 2691320 - protein, 17 aa, Entamoeba histolytica
PKHYTWHYVVRSYDSGK

SEQ ID NO: 2691321 - protein, 18 aa, Entamoeba histolytica
PKIASLILSIGFDRLESL

SEQ ID NO: 2691322 - protein, 24 aa, Entamoeba histolytica
PKIIEFKSPITIKNLFYLICNIIF

SEQ ID NO: 2691323 - protein, 24 aa, Entamoeba histolytica
PKIIHFKCPFDFSLLNDNEITKFN

SEQ ID NO: 2691324 - protein, 24 aa, Entamoeba histolytica
PKIKEMKRRIWYARHSEPYFEDEN

SEQ ID NO: 2691325 - protein, 27 aa, Entamoeba histolytica
PKIKNAGILLMRTGLFGSDSIATVGIY

SEQ ID NO: 2691326 - protein, 17 aa, Entamoeba histolytica
PKIMAIKKCQEIEIDPL

SEQ ID NO: 2691327 - protein, 19 aa, Entamoeba histolytica
PKIRVSLEVFNQLKQIQKQ

SEQ ID NO: 2691328 - protein, 28 aa, Entamoeba histolytica
PKKAFQRRSEFDFKDIIVLKIVNLKIIP

SEQ ID NO: 2691329 - protein, 17 aa, Entamoeba histolytica
PKKCISFGEDGRAVINQ

SEQ ID NO: 2691330 - protein, 25 aa, Entamoeba histolytica
PKKDFLRKFLFEPFPLESYFETVMA

SEQ ID NO: 2691331 - protein, 17 aa, Entamoeba histolytica
PKKDYLTLFDLEDIKPC

SEQ ID NO: 2691332 - protein, 21 aa, Entamoeba histolytica
PKKKRKASVGSVFKGIGEALT

SEQ ID NO: 2691333 - protein, 20 aa, Entamoeba histolytica
PKKLPPIFHLIRNPINNDIC

SEQ ID NO: 2691334 - protein, 18 aa, Entamoeba histolytica
PKKMDMHLVYDVCHNIAK

SEQ ID NO: 2691335 - protein, 17 aa, Entamoeba histolytica
PKKMRGSTSLVDGDGLK

SEQ ID NO: 2691336 - protein, 18 aa, Entamoeba histolytica
PKKNFCVETPKSKYQLNY

SEQ ID NO: 2691337 - protein, 23 aa, Entamoeba histolytica
PKKRSPCEMVKPNIIKRRQSNIK

SEQ ID NO: 2691338 - protein, 24 aa, Entamoeba histolytica
PKKRSTVNFCFPDLIEIDFGKDKM

SEQ ID NO: 2691339 - protein, 17 aa, Entamoeba histolytica
PKKSATDRLRFERRPRL

SEQ ID NO: 2691340 - protein, 20 aa, Entamoeba histolytica
PKKSPRIAIETEENKPNQKE

SEQ ID NO: 2691341 - protein, 19 aa, Entamoeba histolytica
PKKVLQILPILPKEKRSAI

SEQ ID NO: 2691342 - protein, 25 aa, Entamoeba histolytica
PKLASEERKSCPFPEHTKIPQRSKH

SEQ ID NO: 2691343 - protein, 20 aa, Entamoeba histolytica
PKLGPDILRILAKTFVEEDE

SEQ ID NO: 2691344 - protein, 18 aa, Entamoeba histolytica
PKLIKYLLFVPPISLPLN

SEQ ID NO: 2691345 - protein, 20 aa, Entamoeba histolytica
PKLISFGVVSSLTYKEKVPI

SEQ ID NO: 2691346 - protein, 17 aa, Entamoeba histolytica
PKLIVAIRIRGINGVSP

SEQ ID NO: 2691347 - protein, 17 aa, Entamoeba histolytica
PKLIWICYQQCLKKELL

SEQ ID NO: 2691348 - protein, 23 aa, Entamoeba histolytica
PKLKRTDGLFCLILTPTRELTQQ

SEQ ID NO: 2691349 - protein, 20 aa, Entamoeba histolytica
PKLLKSISILFPLLPELVPE

SEQ ID NO: 2691350 - protein, 19 aa, Entamoeba histolytica
PKLLRELLSENGIVYGEKI

SEQ ID NO: 2691351 - protein, 20 aa, Entamoeba histolytica
PKLMCPLFYLGFCPYGKKCK

SEQ ID NO: 2691352 - protein, 18 aa, Entamoeba histolytica
PKLPEIHHPIIMSLVDQL

SEQ ID NO: 2691353 - protein, 33 aa, Entamoeba histolytica
PKLPGDTFKSYYIPGYRFKPEFTEQRAKDLTRF

SEQ ID NO: 2691354 - protein, 24 aa, Entamoeba histolytica
PKLPKRKNELPKRKKQYKTKDTSK

SEQ ID NO: 2691355 - protein, 19 aa, Entamoeba histolytica
PKLSTNFTFSDIQKKYQWS

SEQ ID NO: 2691356 - protein, 17 aa, Entamoeba histolytica
PKLTNQFLYSRNDKKIK

SEQ ID NO: 2691357 - protein, 18 aa, Entamoeba histolytica
PKLVEMLLENEVEEDVSL

SEQ ID NO: 2691358 - protein, 19 aa, Entamoeba histolytica
PKMKIDIDTMFYLEESVIG

SEQ ID NO: 2691359 - protein, 21 aa, Entamoeba histolytica
PKMRIVFVGTFGVGKTSLIQQ

SEQ ID NO: 2691360 - protein, 22 aa, Entamoeba histolytica
PKNIYFGYSLCKGNRKLVNHFS

SEQ ID NO: 2691361 - protein, 23 aa, Entamoeba histolytica
PKNKEYINYGGYFIEKGDEEIKV

SEQ ID NO: 2691362 - protein, 22 aa, Entamoeba histolytica
PKNKMPFLSTQPIKPLANSDIT

SEQ ID NO: 2691363 - protein, 17 aa, Entamoeba histolytica
PKNLYIQQIIWLVVSTF

SEQ ID NO: 2691364 - protein, 23 aa, Entamoeba histolytica
PKNPCLFSRIFSLNFDNPYNLIE

SEQ ID NO: 2691365 - protein, 19 aa, Entamoeba histolytica
PKPGLADQHIVCIKSIGEI

SEQ ID NO: 2691366 - protein, 18 aa, Entamoeba histolytica
PKPILNDDVDLLWNSMKK

SEQ ID NO: 2691367 - protein, 24 aa, Entamoeba histolytica
PKPISPQSGVPMKPSYSIEPTSNN

SEQ ID NO: 2691368 - protein, 19 aa, Entamoeba histolytica
PKPKHIRTIVVKSFSGGVP

SEQ ID NO: 2691369 - protein, 19 aa, Entamoeba histolytica
PKPKNEWLQPVISKTPPEK

SEQ ID NO: 2691370 - protein, 17 aa, Entamoeba histolytica
PKPMGFSPSPVSPRKTH

SEQ ID NO: 2691371 - protein, 19 aa, Entamoeba histolytica
PKPNVLYCGRSLKEILESE

SEQ ID NO: 2691372 - protein, 20 aa, Entamoeba histolytica
PKPNVLYCGTKLKEILESEG

SEQ ID NO: 2691373 - protein, 21 aa, Entamoeba histolytica
PKPSFNIGIPYYFNKEMHLFS

SEQ ID NO: 2691374 - protein, 21 aa, Entamoeba histolytica
PKQIQRLAADFLDDYVFITVG

SEQ ID NO: 2691375 - protein, 21 aa, Entamoeba histolytica
PKQRRTGLFSATMPKELNKFV

SEQ ID NO: 2691376 - protein, 21 aa, Entamoeba histolytica
PKQRTPKCCFANDNGIFEERE

SEQ ID NO: 2691377 - protein, 24 aa, Entamoeba histolytica
PKRKARKSIWEDFRRDLKTKDKEV

SEQ ID NO: 2691378 - protein, 20 aa, Entamoeba histolytica
PKRKDIWYYFNKVIVLSKRQ

SEQ ID NO: 2691379 - protein, 19 aa, Entamoeba histolytica
PKRKITWDLAAQLIEYATA

SEQ ID NO: 2691380 - protein, 22 aa, Entamoeba histolytica
PKRKKLNERKALKSTKSKKVKK

SEQ ID NO: 2691381 - protein, 25 aa, Entamoeba histolytica
PKRLMLRRLVDVIVRLHKKRSLLLL

SEQ ID NO: 2691382 - protein, 18 aa, Entamoeba histolytica
PKRRIILTNKIEREPLFN

SEQ ID NO: 2691383 - protein, 24 aa, Entamoeba histolytica
PKRVPFELYTKFYLENKPNKPAIF

SEQ ID NO: 2691384 - protein, 26 aa, Entamoeba histolytica
PKSEFKFPWKLAEFISTGNRPVIIQE

SEQ ID NO: 2691385 - protein, 19 aa, Entamoeba histolytica
PKSESMALALMFIDNNDNT

SEQ ID NO: 2691386 - protein, 22 aa, Entamoeba histolytica
PKSHSFLFPGMTLFDTAIDVIS

SEQ ID NO: 2691387 - protein, 20 aa, Entamoeba histolytica
PKSILLKENITWNINKKEGE

SEQ ID NO: 2691388 - protein, 17 aa, Entamoeba histolytica
PKSPLILLAELDSMTIA

SEQ ID NO: 2691389 - protein, 22 aa, Entamoeba histolytica
PKSPRAIPSLIMDKRKSIKYYS

SEQ ID NO: 2691390 - protein, 21 aa, Entamoeba histolytica
PKSSAALFTFCEFNHLSCISL

SEQ ID NO: 2691391 - protein, 17 aa, Entamoeba histolytica
PKSSLVFDVPDGKMEGL

SEQ ID NO: 2691392 - protein, 19 aa, Entamoeba histolytica
PKSSREILFQIQIQKKERE

SEQ ID NO: 2691393 - protein, 20 aa, Entamoeba histolytica
PKSVESQQLYAYSEIINHAL

SEQ ID NO: 2691394 - protein, 17 aa, Entamoeba histolytica
PKSYTWGDVKQELESAY

SEQ ID NO: 2691395 - protein, 22 aa, Entamoeba histolytica
PKTFNAPTAFFVPRGVNEIYSL

SEQ ID NO: 2691396 - protein, 19 aa, Entamoeba histolytica
PKTIFKKQVMVRYLSDDIK

SEQ ID NO: 2691397 - protein, 18 aa, Entamoeba histolytica
PKTIKEFRSFLFTEDPTK

SEQ ID NO: 2691398 - protein, 19 aa, Entamoeba histolytica
PKTLDICSSLKRVFLHPIY

SEQ ID NO: 2691399 - protein, 22 aa, Entamoeba histolytica
PKTQESIKMSICQPTESVEITS

SEQ ID NO: 2691400 - protein, 24 aa, Entamoeba histolytica
PKTRIPHKRVRSIGATGKSTFYGE

SEQ ID NO: 2691401 - protein, 22 aa, Entamoeba histolytica
PKTSYFKTSIVFDEYCRKVPVL

SEQ ID NO: 2691402 - protein, 28 aa, Entamoeba histolytica
PKTTVNPIYSIPIFPIYPTPTINNIKSL

SEQ ID NO: 2691403 - protein, 19 aa, Entamoeba histolytica
PKTVFGHSIVSVLNPLIDV

SEQ ID NO: 2691404 - protein, 23 aa, Entamoeba histolytica
PKTVNLWIGANVMMEYSFDEAKK

SEQ ID NO: 2691405 - protein, 24 aa, Entamoeba histolytica
PKVIKKPKTVFVYSSLPTQFQGRR

SEQ ID NO: 2691406 - protein, 25 aa, Entamoeba histolytica
PKVKEVREKWPLKDIQVDGGISDKT

SEQ ID NO: 2691407 - protein, 23 aa, Entamoeba histolytica
PKVLCPPNGMFLGVTAIGLCDVM

SEQ ID NO: 2691408 - protein, 20 aa, Entamoeba histolytica
PKVLGIIMECCGKVKLCNSD

SEQ ID NO: 2691409 - protein, 30 aa, Entamoeba histolytica
PKYFLNDQCFEFYSRPLLYRVQPTVLSKNK

SEQ ID NO: 2691410 - protein, 26 aa, Entamoeba histolytica
PKYGDCIRWKGVLKVEYDKKKDKDAV

SEQ ID NO: 2691411 - protein, 17 aa, Entamoeba histolytica
PKYGVIFGSTFIARAEA

SEQ ID NO: 2691412 - protein, 23 aa, Entamoeba histolytica
PKYIVRRMIKISSEDIGLADVEA

SEQ ID NO: 2691413 - protein, 24 aa, Entamoeba histolytica
PKYLKELERHTALLEKWNPIFDLT

SEQ ID NO: 2691414 - protein, 21 aa, Entamoeba histolytica
PKYREIFLLMYRLYTSPECVI

SEQ ID NO: 2691415 - protein, 19 aa, Entamoeba histolytica
PKYSEYKRYLNYTFLNDKR

SEQ ID NO: 2691416 - protein, 18 aa, Entamoeba histolytica
PKYSFDFLSQENKSSYSL

SEQ ID NO: 2691417 - protein, 20 aa, Entamoeba histolytica
PKYVSCPVVNTFNISLTSTL

SEQ ID NO: 2691418 - protein, 19 aa, Entamoeba histolytica
PLAELKGKLLDKSGKVKKL

SEQ ID NO: 2691419 - protein, 21 aa, Entamoeba histolytica
PLAFCWTFWVDNFNDKNGTFE

SEQ ID NO: 2691420 - protein, 24 aa, Entamoeba histolytica
PLANPFSLNGFSFGTSTDKQKDTL

SEQ ID NO: 2691421 - protein, 20 aa, Entamoeba histolytica
PLCETEGLEFIPLNLPLEEM

SEQ ID NO: 2691422 - protein, 26 aa, Entamoeba histolytica
PLCHLPKDLCPYGPNAAKCTKAQTTE

SEQ ID NO: 2691423 - protein, 20 aa, Entamoeba histolytica
PLCIGHKIIKENVDLINNTS

SEQ ID NO: 2691424 - protein, 18 aa, Entamoeba histolytica
PLCKRLIYNEIHMKSKFI

SEQ ID NO: 2691425 - protein, 18 aa, Entamoeba histolytica
PLCQEFFNLIGKTIVLKG

SEQ ID NO: 2691426 - protein, 29 aa, Entamoeba histolytica
PLCTFKKEIPRTLIFSKFNIIETIPCPKT

SEQ ID NO: 2691427 - protein, 21 aa, Entamoeba histolytica
PLCTLRCSLQRFLSLKEEQTS

SEQ ID NO: 2691428 - protein, 22 aa, Entamoeba histolytica
PLDALMLLGYRCPYRAVRAYCV

SEQ ID NO: 2691429 - protein, 23 aa, Entamoeba histolytica
PLDIIKDIPISVAIVETHLIHLS

SEQ ID NO: 2691430 - protein, 24 aa, Entamoeba histolytica
PLDLSETTLICFIQSMFRSKLLIN

SEQ ID NO: 2691431 - protein, 18 aa, Entamoeba histolytica
PLEICSLTKLTFVDLSNN

SEQ ID NO: 2691432 - protein, 19 aa, Entamoeba histolytica
PLELRKLVIDGIFLSKIAK

SEQ ID NO: 2691433 - protein, 21 aa, Entamoeba histolytica
PLEMIYFDLAVGLREDETMEY

SEQ ID NO: 2691434 - protein, 20 aa, Entamoeba histolytica
PLEMSFCDIILCTVSTAANQ

SEQ ID NO: 2691435 - protein, 27 aa, Entamoeba histolytica
PLESIIMIKRLIYFEIISKEIVIEWIL

SEQ ID NO: 2691436 - protein, 19 aa, Entamoeba histolytica
PLESLCLQILLFGEKNPVQ

SEQ ID NO: 2691437 - protein, 18 aa, Entamoeba histolytica
PLFFDLYRSPTLSSSMKQ

SEQ ID NO: 2691438 - protein, 20 aa, Entamoeba histolytica
PLFIREIKPLLVSIDTIELG

SEQ ID NO: 2691439 - protein, 26 aa, Entamoeba histolytica
PLFKVSCYCGHEFCFGCGKERHEPAS

SEQ ID NO: 2691440 - protein, 24 aa, Entamoeba histolytica
PLFLGEGVSEIMSSTAYEKLWYII

SEQ ID NO: 2691441 - protein, 27 aa, Entamoeba histolytica
PLFNAQLKLKCCLELTEEDIKKIQGET

SEQ ID NO: 2691442 - protein, 20 aa, Entamoeba histolytica
PLFNEFRYVIFAIKIKENRL

SEQ ID NO: 2691443 - protein, 23 aa, Entamoeba histolytica
PLFNFNFPSHFNKINIPEDADDE

SEQ ID NO: 2691444 - protein, 17 aa, Entamoeba histolytica
PLFNQAIQMHLKRYEES

SEQ ID NO: 2691445 - protein, 17 aa, Entamoeba histolytica
PLFQYNVDSPQLIIDFF

SEQ ID NO: 2691446 - protein, 18 aa, Entamoeba histolytica
PLFRMKIPSATVVYRSRN

SEQ ID NO: 2691447 - protein, 22 aa, Entamoeba histolytica
PLFSELYQLVSISKNGATIRDI

SEQ ID NO: 2691448 - protein, 19 aa, Entamoeba histolytica
PLFSGDCKIGQLFQIFQIF

SEQ ID NO: 2691449 - protein, 26 aa, Entamoeba histolytica
PLFSRFRHISPPMLFFVTSNNQLVSV

SEQ ID NO: 2691450 - protein, 17 aa, Entamoeba histolytica
PLFTKIISLHAERNELQ

SEQ ID NO: 2691451 - protein, 32 aa, Entamoeba histolytica
PLGRFAVKLPLDYRVAKLVFFGLYFGVFTETA

SEQ ID NO: 2691452 - protein, 25 aa, Entamoeba histolytica
PLGRGDGIYNWVFGGLRNWNLRGLL

SEQ ID NO: 2691453 - protein, 19 aa, Entamoeba histolytica
PLGSDLMILEYQRVFKRCV

SEQ ID NO: 2691454 - protein, 18 aa, Entamoeba histolytica
PLHDCIIESIWISIDNLI

SEQ ID NO: 2691455 - protein, 18 aa, Entamoeba histolytica
PLHPCFVSLLDIDVSLAL

SEQ ID NO: 2691456 - protein, 20 aa, Entamoeba histolytica
PLHRRKRKFQNITYEKLLSE

SEQ ID NO: 2691457 - protein, 23 aa, Entamoeba histolytica
PLHTFMRKWLKSLYEINVENDMK

SEQ ID NO: 2691458 - protein, 25 aa, Entamoeba histolytica
PLHTKRIFSSLNWNFYEYEPNLESL

SEQ ID NO: 2691459 - protein, 20 aa, Entamoeba histolytica
PLHYFCLNFSNPNCEEAFSL

SEQ ID NO: 2691460 - protein, 20 aa, Entamoeba histolytica
PLICSFLIDGKLCFHTYPIV

SEQ ID NO: 2691461 - protein, 21 aa, Entamoeba histolytica
PLILPKSICTLTYSRSNTITI

SEQ ID NO: 2691462 - protein, 23 aa, Entamoeba histolytica
PLIPGIIEKVIHSFQCEDDYVDK

SEQ ID NO: 2691463 - protein, 24 aa, Entamoeba histolytica
PLIQREWWYPLATSISGTEFKELQ

SEQ ID NO: 2691464 - protein, 24 aa, Entamoeba histolytica
PLIRVEVSKALSLSGCSSDDFLIY

SEQ ID NO: 2691465 - protein, 17 aa, Entamoeba histolytica
PLISEIDIQLTIELCTR

SEQ ID NO: 2691466 - protein, 18 aa, Entamoeba histolytica
PLISMKLILEGHIKSIDE

SEQ ID NO: 2691467 - protein, 19 aa, Entamoeba histolytica
PLIYSFIIDGKLCFDTYPI

SEQ ID NO: 2691468 - protein, 24 aa, Entamoeba histolytica
PLKECPAPEQLPLKLGALVMLLKN

SEQ ID NO: 2691469 - protein, 17 aa, Entamoeba histolytica
PLKEIFLELTSPVPLQY

SEQ ID NO: 2691470 - protein, 20 aa, Entamoeba histolytica
PLKELFIRIENFIQKLIIFY

SEQ ID NO: 2691471 - protein, 18 aa, Entamoeba histolytica
PLKGCTPNIFSFDEDLQF

SEQ ID NO: 2691472 - protein, 20 aa, Entamoeba histolytica
PLKLNIIVFSKFLFNANDIY

SEQ ID NO: 2691473 - protein, 20 aa, Entamoeba histolytica
PLKNGFGLFKLTSGKQTTDI

SEQ ID NO: 2691474 - protein, 23 aa, Entamoeba histolytica
PLKTCVTCEPSIFEKELKGDEEF

SEQ ID NO: 2691475 - protein, 17 aa, Entamoeba histolytica
PLLAREGEIAWKTALKA

SEQ ID NO: 2691476 - protein, 20 aa, Entamoeba histolytica
PLLCSICNKPLVVVQSQNGE

SEQ ID NO: 2691477 - protein, 19 aa, Entamoeba histolytica
PLLDDIRMVPPMLKETKQN

SEQ ID NO: 2691478 - protein, 21 aa, Entamoeba histolytica
PLLDDLHPFYGDLLNVLYDRD

SEQ ID NO: 2691479 - protein, 22 aa, Entamoeba histolytica
PLLDPREAIELLDFRYPDPQIR

SEQ ID NO: 2691480 - protein, 28 aa, Entamoeba histolytica
PLLELCLKRKRPLVVISDTIDGDALTTL

SEQ ID NO: 2691481 - protein, 24 aa, Entamoeba histolytica
PLLELKKMYNILSARHAILKVRHN

SEQ ID NO: 2691482 - protein, 23 aa, Entamoeba histolytica
PLLFELCGISAMGNEEATRVIYI

SEQ ID NO: 2691483 - protein, 18 aa, Entamoeba histolytica
PLLFTFVRFEGFNRKYAR

SEQ ID NO: 2691484 - protein, 20 aa, Entamoeba histolytica
PLLQFRLYQLLFKLLSEKKY

SEQ ID NO: 2691485 - protein, 26 aa, Entamoeba histolytica
PLLVCLPKKYISSLIDKQYIYFCDAH

SEQ ID NO: 2691486 - protein, 18 aa, Entamoeba histolytica
PLLVEVYSAYDPKNLFST

SEQ ID NO: 2691487 - protein, 18 aa, Entamoeba histolytica
PLMGKLVSIIHCIFDDIT

SEQ ID NO: 2691488 - protein, 19 aa, Entamoeba histolytica
PLNDWCFISGSADRTVHLW

SEQ ID NO: 2691489 - protein, 19 aa, Entamoeba histolytica
PLNKAGMLQIFIRTYNNTL

SEQ ID NO: 2691490 - protein, 23 aa, Entamoeba histolytica
PLNNTPLGIALKAIKPTPEQLDK

SEQ ID NO: 2691491 - protein, 17 aa, Entamoeba histolytica
PLNPFKIVIAGAGRGPL

SEQ ID NO: 2691492 - protein, 19 aa, Entamoeba histolytica
PLNTRWNCEYKIINETTGL

SEQ ID NO: 2691493 - protein, 22 aa, Entamoeba histolytica
PLNVPFSLEYVVMVFCNSISIN

SEQ ID NO: 2691494 - protein, 19 aa, Entamoeba histolytica
PLPEAYCYGLLTLIEPTRH

SEQ ID NO: 2691495 - protein, 23 aa, Entamoeba histolytica
PLPKEVDGYFPVVFIGKEGLPKL

SEQ ID NO: 2691496 - protein, 17 aa, Entamoeba histolytica
PLPSLPRNYSQQSIEIA

SEQ ID NO: 2691497 - protein, 22 aa, Entamoeba histolytica
PLQEIFLPIFIEIVAQPNPLIT

SEQ ID NO: 2691498 - protein, 19 aa, Entamoeba histolytica
PLQEVARIVGMSATSVKKL

SEQ ID NO: 2691499 - protein, 19 aa, Entamoeba histolytica
PLQFKLWKEYYLRYDKPVV

SEQ ID NO: 2691500 - protein, 30 aa, Entamoeba histolytica; identical to SEQ ID NO: 2499863

SEQ ID NO: 2691501 - protein, 18 aa, Entamoeba histolytica
PLRKDPLFRMKIPSATVV

SEQ ID NO: 2691502 - protein, 23 aa, Entamoeba histolytica
PLRKRGEKGWLFGSKQTIFYYHF

SEQ ID NO: 2691503 - protein, 24 aa, Entamoeba histolytica
PLRMMRICRASFEKVIEALEKKLN

SEQ ID NO: 2691504 - protein, 31 aa, Entamoeba histolytica; identical to SEQ ID NO: 2499869

SEQ ID NO: 2691505 - protein, 18 aa, Entamoeba histolytica
PLSLKLMYNHHIKEVQVI

SEQ ID NO: 2691506 - protein, 22 aa, Entamoeba histolytica
PLSTMSGLIGWVPHSDTLHQLI

SEQ ID NO: 2691507 - protein, 24 aa, Entamoeba histolytica
PLSVYRPSTTFYLYPKLINKIEFA

SEQ ID NO: 2691508 - protein, 17 aa, Entamoeba histolytica
PLSYPQTDVFLICFSVV

SEQ ID NO: 2691509 - protein, 30 aa, Entamoeba histolytica; identical to SEQ ID NO: 2499878

SEQ ID NO: 2691510 - protein, 25 aa, Entamoeba histolytica
PLTFFFKIVYFISIASFGEVIQLKK

SEQ ID NO: 2691511 - protein, 18 aa, Entamoeba histolytica
PLTGKKKSRLRQDVSSKS

SEQ ID NO: 2691512 - protein, 19 aa, Entamoeba histolytica
PLTGWKWIGDCVITLTQMK

SEQ ID NO: 2691513 - protein, 20 aa, Entamoeba histolytica
PLTICPLSSKVSFTIHANYI

SEQ ID NO: 2691514 - protein, 27 aa, Entamoeba histolytica
PLTQIPGLIQFKGPMNLKHNRGSARFM

SEQ ID NO: 2691515 - protein, 17 aa, Entamoeba histolytica
PLTRQSFDINRTQSTKI

SEQ ID NO: 2691516 - protein, 24 aa, Entamoeba histolytica
PLTSKCVFTGSGMRADIKELTDQI

SEQ ID NO: 2691517 - protein, 17 aa, Entamoeba histolytica
PLTSSFYLGYNMLLNLM

SEQ ID NO: 2691518 - protein, 24 aa, Entamoeba histolytica
PLTYRLSDFTKLYVTIENNIVKME

SEQ ID NO: 2691519 - protein, 17 aa, Entamoeba histolytica
PLVGLKTSRCFSDEKLL

SEQ ID NO: 2691520 - protein, 19 aa, Entamoeba histolytica
PLVNCSTSSLPIEGHYNDI

SEQ ID NO: 2691521 - protein, 20 aa, Entamoeba histolytica
PLVRKIYGAAIGWCHKDDIF

SEQ ID NO: 2691522 - protein, 24 aa, Entamoeba histolytica
PLWGCGSYSGIIAYQITGVIKECI

SEQ ID NO: 2691523 - protein, 20 aa, Entamoeba histolytica
PLYEELCVLNHLPTEIFLTQ

SEQ ID NO: 2691524 - protein, 24 aa, Entamoeba histolytica
PLYEFWEHVCVVWTKCYYYTPQSV

SEQ ID NO: 2691525 - protein, 17 aa, Entamoeba histolytica
PLYELVQQYAIASCNDR

SEQ ID NO: 2691526 - protein, 26 aa, Entamoeba histolytica
PLYHKRRLLKLAEYLKQFNFTPQEKI

SEQ ID NO: 2691527 - protein, 26 aa, Entamoeba histolytica
PLYTYLFDLCYLPVIGNPGEDSYQRK

SEQ ID NO: 2691528 - protein, 19 aa, Entamoeba histolytica
PLYVPDTFFDMIFDESVMA

SEQ ID NO: 2691529 - protein, 25 aa, Entamoeba histolytica
PLYWKRDITTMMSLLFQPTFNNKQI

SEQ ID NO: 2691530 - protein, 17 aa, Entamoeba histolytica
PMDPGGYFIVKGVERVI

SEQ ID NO: 2691531 - protein, 22 aa, Entamoeba histolytica
PMDRGINSWFFLKEPEGSELGF

SEQ ID NO: 2691532 - protein, 18 aa, Entamoeba histolytica
PMELYNILSVLIKDIGTK

SEQ ID NO: 2691533 - protein, 17 aa, Entamoeba histolytica
PMFHYLQPYSNFISLID

SEQ ID NO: 2691534 - protein, 17 aa, Entamoeba histolytica
PMGAKVENFFTCTTHKF

SEQ ID NO: 2691535 - protein, 18 aa, Entamoeba histolytica
PMHQSFFVFEFCVYAIQF

SEQ ID NO: 2691536 - protein, 24 aa, Entamoeba histolytica
PMHSGGMLGGWKFSNFKDGVFSEV

SEQ ID NO: 2691537 - protein, 17 aa, Entamoeba histolytica
PMILFEYYETFIVKSSV

SEQ ID NO: 2691538 - protein, 25 aa, Entamoeba histolytica
PMKDEKCTVCSLIPSGAPTQQSENG

SEQ ID NO: 2691539 - protein, 21 aa, Entamoeba histolytica
PMKERLMFLISNLCRSQPFVD

SEQ ID NO: 2691540 - protein, 27 aa, Entamoeba histolytica
PMLPYILSGLCRFSEANDAGFIQYLGP

SEQ ID NO: 2691541 - protein, 19 aa, Entamoeba histolytica
PMLSRGELRCIGATTLEEY

SEQ ID NO: 2691542 - protein, 27 aa, Entamoeba histolytica
PMMRNCVGISHFFVFDVFDKALCFLDK

SEQ ID NO: 2691543 - protein, 20 aa, Entamoeba histolytica
PMNDFPIFFDIFKHFITIHF

SEQ ID NO: 2691544 - protein, 21 aa, Entamoeba histolytica
PMQGNCILFAIDQLYFESVKD

SEQ ID NO: 2691545 - protein, 24 aa, Entamoeba histolytica
PMRACKGKPLIRFRESDYEIKKKP

SEQ ID NO: 2691546 - protein, 24 aa, Entamoeba histolytica
PMRRPRRSPVAYHQMVPQQFRRQN

SEQ ID NO: 2691547 - protein, 17 aa, Entamoeba histolytica
PMRVCRYLKMILEGVRY

SEQ ID NO: 2691548 - protein, 19 aa, Entamoeba histolytica
PMSSISFLPLAHVFAIVLE

SEQ ID NO: 2691549 - protein, 17 aa, Entamoeba histolytica
PMTCQKVYCGYNKIYIL

SEQ ID NO: 2691550 - protein, 21 aa, Entamoeba histolytica
PMTNPELFERVGVKAPKGVLL

SEQ ID NO: 2691551 - protein, 30 aa, Entamoeba histolytica
PMVESLGAQWEEFISLFKYSTPEDLFDHLI

SEQ ID NO: 2691552 - protein, 24 aa, Entamoeba histolytica
PMYLSEFAKALVLIYYAQQNQPIS

SEQ ID NO: 2691553 - protein, 19 aa, Entamoeba histolytica
PNAERKCFVCGKTGHKSRD

SEQ ID NO: 2691554 - protein, 20 aa, Entamoeba histolytica
PNAFIGIAGVITFKNGQSIR

SEQ ID NO: 2691555 - protein, 21 aa, Entamoeba histolytica
PNAFNLHSFILVYTSLSSLND

SEQ ID NO: 2691556 - protein, 22 aa, Entamoeba histolytica
PNAFNLHSFILVYTSLSSLNDY

SEQ ID NO: 2691557 - protein, 22 aa, Entamoeba histolytica
PNAFNLHSFILVYTSLSSLNNY

SEQ ID NO: 2691558 - protein, 19 aa, Entamoeba histolytica
PNANGMYGIRIFRKKEMPI

SEQ ID NO: 2691559 - protein, 18 aa, Entamoeba histolytica
PNAPCLLIGTKIDIRDEQ

SEQ ID NO: 2691560 - protein, 23 aa, Entamoeba histolytica
PNAQVRYVTYCELSKLTSITTQF

SEQ ID NO: 2691561 - protein, 18 aa, Entamoeba histolytica
PNARVGVVWFDAHPDMNT

SEQ ID NO: 2691562 - protein, 24 aa, Entamoeba histolytica
PNASRKFIRFGLITIYEPEAKTKY

SEQ ID NO: 2691563 - protein, 20 aa, Entamoeba histolytica
PNATSLCLFNGKSQSQDVII

SEQ ID NO: 2691564 - protein, 25 aa, Entamoeba histolytica
PNATYCRDGFDLIQTLYFSKEYEGH

SEQ ID NO: 2691565 - protein, 25 aa, Entamoeba histolytica
PNAVREVRPALLNRRRNITTNNEHA

SEQ ID NO: 2691566 - protein, 22 aa, Entamoeba histolytica
PNCIPYSFCGKVIPQMIQIPSL

SEQ ID NO: 2691567 - protein, 17 aa, Entamoeba histolytica
PNCKNSILPDIIKKKEI

SEQ ID NO: 2691568 - protein, 19 aa, Entamoeba histolytica
PNCSEYNEEICCLTTSNKV

SEQ ID NO: 2691569 - protein, 21 aa, Entamoeba histolytica
PNCTIFDYFHFSLIRIPFNSL

SEQ ID NO: 2691570 - protein, 20 aa, Entamoeba histolytica
PNDIKQWAVNPLLYSPIQQE

SEQ ID NO: 2691571 - protein, 25 aa, Entamoeba histolytica
PNDLFLRVCQLRIKPDLDMLVDLFK

SEQ ID NO: 2691572 - protein, 21 aa, Entamoeba histolytica
PNDLPTTFWQRCNISHIESLA

SEQ ID NO: 2691573 - protein, 19 aa, Entamoeba histolytica
PNDYIYYVIDWMKKNEYIE

SEQ ID NO: 2691574 - protein, 19 aa, Entamoeba histolytica
PNDYLSIFVGMLNIIEQNK

SEQ ID NO: 2691575 - protein, 26 aa, Entamoeba histolytica
PNEAPCAGVAEVLRRYNEITPSVQMS

SEQ ID NO: 2691576 - protein, 24 aa, Entamoeba histolytica
PNEDLFGVFCIYDITMDKKLTENY

SEQ ID NO: 2691577 - protein, 31 aa, Entamoeba histolytica
PNEIDHTIQWARDRFEGFFKTEIEPVKNYKE

SEQ ID NO: 2691578 - protein, 22 aa, Entamoeba histolytica
PNEIFCLKEVLGTGSFGTVYHA

SEQ ID NO: 2691579 - protein, 23 aa, Entamoeba histolytica
PNELRYIGDYCFEDCPSLKEMNL

SEQ ID NO: 2691580 - protein, 24 aa, Entamoeba histolytica
PNEVTSLGYWCFSLCDDIQEIEIP

SEQ ID NO: 2691581 - protein, 17 aa, Entamoeba histolytica
PNFKTMFQLICSNDEIK

SEQ ID NO: 2691582 - protein, 19 aa, Entamoeba histolytica
PNGESNEALGFPLQLDTTN

SEQ ID NO: 2691583 - protein, 23 aa, Entamoeba histolytica
PNGEYLLKPCLAPREKAFYLKIQ

SEQ ID NO: 2691584 - protein, 18 aa, Entamoeba histolytica
PNGGMLYCLEYLNENIDW

SEQ ID NO: 2691585 - protein, 18 aa, Entamoeba histolytica
PNGIAELIEKCWDQDQSK

SEQ ID NO: 2691586 - protein, 25 aa, Entamoeba histolytica
PNGIILPNQCRLFITAIQGDDEFIL

SEQ ID NO: 2691587 - protein, 24 aa, Entamoeba histolytica
PNICAECGQPLGPQRITALGRSYH

SEQ ID NO: 2691588 - protein, 18 aa, Entamoeba histolytica
PNIETCLEHIEQIRKEYK

SEQ ID NO: 2691589 - protein, 18 aa, Entamoeba histolytica
PNIFRHLLEINLPLNVVT

SEQ ID NO: 2691590 - protein, 21 aa, Entamoeba histolytica
PNIIKCLYYNCPLLSVDQLNT

SEQ ID NO: 2691591 - protein, 18 aa, Entamoeba histolytica
PNIINIPLPFTSALTVDY

SEQ ID NO: 2691592 - protein, 20 aa, Entamoeba histolytica
PNIIPCCLVDGDVYGIEIFL

SEQ ID NO: 2691593 - protein, 19 aa, Entamoeba histolytica
PNIKTYLKLAQSFENTDPV

SEQ ID NO: 2691594 - protein, 17 aa, Entamoeba histolytica
PNIKWRWETIGFLPNSP

SEQ ID NO: 2691595 - protein, 27 aa, Entamoeba histolytica
PNILLKGSEIALPFGEIMQMEKVKDAV

SEQ ID NO: 2691596 - protein, 27 aa, Entamoeba histolytica
PNILMPILFEYFFKRKAFIEERQEKLL

SEQ ID NO: 2691597 - protein, 24 aa, Entamoeba histolytica
PNIPESRNIFIFQIFNSGYDQKRI

SEQ ID NO: 2691598 - protein, 37 aa, Entamoeba histolytica
PNISKLIFLQCVSNLLGIPREVPVIIPPSELIDLIQH

SEQ ID NO: 2691599 - protein, 19 aa, Entamoeba histolytica
PNIYVPVHMRRQADGDYNP

SEQ ID NO: 2691600 - protein, 24 aa, Entamoeba histolytica
PNKRCVVTLPFLRILEIQRGTDDC

SEQ ID NO: 2691601 - protein, 30 aa, Entamoeba histolytica; identical to SEQ ID NO: 2499970

SEQ ID NO: 2691602 - protein, 25 aa, Entamoeba histolytica
PNKTKIRFQLVIKFNSLENIKFDSK

SEQ ID NO: 2691603 - protein, 17 aa, Entamoeba histolytica
PNLKVQKLYAWNDTQIP

SEQ ID NO: 2691604 - protein, 19 aa, Entamoeba histolytica
PNLLEGWIKYLYGRLKDPS

SEQ ID NO: 2691605 - protein, 17 aa, Entamoeba histolytica
PNLLKIYVEDIVDKCVV

SEQ ID NO: 2691606 - protein, 17 aa, Entamoeba histolytica
PNNEFNKEVDFVYIVDR

SEQ ID NO: 2691607 - protein, 27 aa, Entamoeba histolytica
PNNEVPGKWSVCWDLINKPDINNPLSE

SEQ ID NO: 2691608 - protein, 26 aa, Entamoeba histolytica
PNNICIDESYIIFDLLLFKEIIEKGY

SEQ ID NO: 2691609 - protein, 20 aa, Entamoeba histolytica
PNNILNCYYIFIGPKDTPYE

SEQ ID NO: 2691610 - protein, 25 aa, Entamoeba histolytica
PNNKNCLLEALTIAGSLLKKIGGKV

SEQ ID NO: 2691611 - protein, 22 aa, Entamoeba histolytica
PNNQFWKAMKAYGLAYTGQLEK

SEQ ID NO: 2691612 - protein, 23 aa, Entamoeba histolytica
PNPEVRTSIRLEPVDVCCLLYSI

SEQ ID NO: 2691613 - protein, 19 aa, Entamoeba histolytica
PNPEYHPLGLASLTQLTFL

SEQ ID NO: 2691614 - protein, 17 aa, Entamoeba histolytica
PNPFANIFSNLVGSTQG

SEQ ID NO: 2691615 - protein, 22 aa, Entamoeba histolytica
PNPKKVRSIVRISKLEDTVDKT

SEQ ID NO: 2691616 - protein, 20 aa, Entamoeba histolytica
PNPLPFDMFILLFKSAVDDH

SEQ ID NO: 2691617 - protein, 29 aa, Entamoeba histolytica
PNPSKHFKGIPAFWHRIFIIENLSDESDM

SEQ ID NO: 2691618 - protein, 26 aa, Entamoeba histolytica
PNQCTSIGMFAFKWCESLTSLSIPSN

SEQ ID NO: 2691619 - protein, 17 aa, Entamoeba histolytica
PNQELCHLFGPQDGINC

SEQ ID NO: 2691620 - protein, 22 aa, Entamoeba histolytica
PNQIKRYFTIEGLNLINKTEFE

SEQ ID NO: 2691621 - protein, 26 aa, Entamoeba histolytica
PNQLFALRALFLCFFYIINEVSDEFR

SEQ ID NO: 2691622 - protein, 18 aa, Entamoeba histolytica
PNQLQCRSSCAYETVFAR

SEQ ID NO: 2691623 - protein, 18 aa, Entamoeba histolytica
PNQSCGYYNGSVTPNNWY

SEQ ID NO: 2691624 - protein, 22 aa, Entamoeba histolytica
PNQSPRLTIGMRGLSPRRRGNS

SEQ ID NO: 2691625 - protein, 26 aa, Entamoeba histolytica
PNRMIYSEFLKRYYFLGDKINRRASD

SEQ ID NO: 2691626 - protein, 20 aa, Entamoeba histolytica
PNRRSHIIELIHEILKANYF

SEQ ID NO: 2691627 - protein, 24 aa, Entamoeba histolytica
PNSDIPKILPLVTNIVPIIHSDAQ

SEQ ID NO: 2691628 - protein, 18 aa, Entamoeba histolytica
PNSIKQIFMYKVNNHSSI

SEQ ID NO: 2691629 - protein, 32 aa, Entamoeba histolytica
PNSLKTSLKILLRFQECQSFFKKTLENPNVRN

SEQ ID NO: 2691630 - protein, 23 aa, Entamoeba histolytica
PNSPRNCSFIYGYAAMSKFIENT

SEQ ID NO: 2691631 - protein, 23 aa, Entamoeba histolytica
PNSVFVLNCPWTGAELEAQLPGS

SEQ ID NO: 2691632 - protein, 17 aa, Entamoeba histolytica
PNTDLNNIIPWKTKSNT

SEQ ID NO: 2691633 - protein, 25 aa, Entamoeba histolytica
PNTFLCNACGLKALKKKKREQQMAT

SEQ ID NO: 2691634 - protein, 35 aa, Entamoeba histolytica
PNTHIMKINLTIPFWWKDDLFPYIVEHRSYSPSNE

SEQ ID NO: 2691635 - protein, 25 aa, Entamoeba histolytica
PNTMADVFKGLNFTNPFSNQTTQTS

SEQ ID NO: 2691636 - protein, 24 aa, Entamoeba histolytica
PNTNYKAIIIWGLPDKLSHYDAEL

SEQ ID NO: 2691637 - protein, 24 aa, Entamoeba histolytica
PNVFFDYLEDFFLYPDDPTEICEL

SEQ ID NO: 2691638 - protein, 27 aa, Entamoeba histolytica
PNVLFTMCGFEIRILPKCRSQEEEFSI

SEQ ID NO: 2691639 - protein, 19 aa, Entamoeba histolytica
PNVMVDKFFSFSLQSNLKL

SEQ ID NO: 2691640 - protein, 18 aa, Entamoeba histolytica
PNVPIILVGTKIDIRDDP

SEQ ID NO: 2691641 - protein, 23 aa, Entamoeba histolytica
PNWKKCILDALNHCSSIESGKDV

SEQ ID NO: 2691642 - protein, 19 aa, Entamoeba histolytica
PNYCGRCGNIACIMRVGTD

SEQ ID NO: 2691643 - protein, 29 aa, Entamoeba histolytica
PNYFKAYEIRLTIKGQIARFNELIQKHLT

SEQ ID NO: 2691644 - protein, 18 aa, Entamoeba histolytica
PNYIKFIQYPACLYYLEQ

SEQ ID NO: 2691645 - protein, 21 aa, Entamoeba histolytica
PNYLEPWLIVDFDSDIVVASV

SEQ ID NO: 2691646 - protein, 27 aa, Entamoeba histolytica
PNYVAKRFHCVIEICLNEGLAPVNALK

SEQ ID NO: 2691647 - protein, 27 aa, Entamoeba histolytica
PPAKHSVELIREIIEEVKIRGKSTREA

SEQ ID NO: 2691648 - protein, 17 aa, Entamoeba histolytica
PPALALSTCMQFNKDDM

SEQ ID NO: 2691649 - protein, 18 aa, Entamoeba histolytica
PPANCIFEIYIQHREFII

SEQ ID NO: 2691650 - protein, 19 aa, Entamoeba histolytica
PPANPLICPQFCLRFNDLD

SEQ ID NO: 2691651 - protein, 17 aa, Entamoeba histolytica
PPCPVQKGMYTKVKLTD

SEQ ID NO: 2691652 - protein, 19 aa, Entamoeba histolytica
PPEDSYCKIRNIICEVNEI

SEQ ID NO: 2691653 - protein, 24 aa, Entamoeba histolytica
PPEFPEKFKTALLPENIKKNRYSD

SEQ ID NO: 2691654 - protein, 24 aa, Entamoeba histolytica
PPEQSTMVYVESKFIPKEKRAKGL

SEQ ID NO: 2691655 - protein, 21 aa, Entamoeba histolytica
PPESPIRYEVPFENLWGKESQ

SEQ ID NO: 2691656 - protein, 22 aa, Entamoeba histolytica
PPETESQGLLSPFGENVNNPPN

SEQ ID NO: 2691657 - protein, 26 aa, Entamoeba histolytica
PPFAKSYCYNTSMLYHAEDLYFNQSS

SEQ ID NO: 2691658 - protein, 18 aa, Entamoeba histolytica
PPFFKALVKYVHKGKYSW

SEQ ID NO: 2691659 - protein, 17 aa, Entamoeba histolytica
PPGCGKTMIARAIANET

SEQ ID NO: 2691660 - protein, 25 aa, Entamoeba histolytica
PPGCGKTYCAKALANECKANFIAVK

SEQ ID NO: 2691661 - protein, 19 aa, Entamoeba histolytica
PPGDILFFLTGQEEIDSTC

SEQ ID NO: 2691662 - protein, 24 aa, Entamoeba histolytica
PPGIHRFPFSFILPQTHCPMLVLP

SEQ ID NO: 2691663 - protein, 26 aa, Entamoeba histolytica
PPGLKAGELKIIYKTTINRSGLVEVE

SEQ ID NO: 2691664 - protein, 20 aa, Entamoeba histolytica
PPHALSFILAYANHWNTEEK

SEQ ID NO: 2691665 - protein, 17 aa, Entamoeba histolytica
PPHPFAKPFSNRYSTSA

SEQ ID NO: 2691666 - protein, 19 aa, Entamoeba histolytica
PPIDCLHNEIELITNNVYQ

SEQ ID NO: 2691667 - protein, 17 aa, Entamoeba histolytica
PPIKLLSYENLYIPDKS

SEQ ID NO: 2691668 - protein, 17 aa, Entamoeba histolytica
PPINRLDVAGVDLSTSD

SEQ ID NO: 2691669 - protein, 18 aa, Entamoeba histolytica
PPIPVKKYVVSPVGQNLI

SEQ ID NO: 2691670 - protein, 20 aa, Entamoeba histolytica
PPKKELYGMYILVKGTPKNL

SEQ ID NO: 2691671 - protein, 17 aa, Entamoeba histolytica
PPKLSIGDFNEFTVQKR

SEQ ID NO: 2691672 - protein, 17 aa, Entamoeba histolytica
PPKQRIEISRKSFEESL

SEQ ID NO: 2691673 - protein, 23 aa, Entamoeba histolytica
PPKRKLFNKFVFKIVHPTTKSFE

SEQ ID NO: 2691674 - protein, 19 aa, Entamoeba histolytica
PPLCYKRRMSEIISVDEDQ

SEQ ID NO: 2691675 - protein, 17 aa, Entamoeba histolytica
PPLDIFKYLQIEEKQQI

SEQ ID NO: 2691676 - protein, 20 aa, Entamoeba histolytica
PPLIMKRSHILAEIDNETNS

SEQ ID NO: 2691677 - protein, 21 aa, Entamoeba histolytica
PPLLSRFDIILLLLDDRSKIW

SEQ ID NO: 2691678 - protein, 24 aa, Entamoeba histolytica
PPLPELKSLCLVNCPLEDNKQTIR

SEQ ID NO: 2691679 - protein, 18 aa, Entamoeba histolytica
PPLTCIPEVIELESDDIT

SEQ ID NO: 2691680 - protein, 18 aa, Entamoeba histolytica
PPMEIIVELIQKMGQPPH

SEQ ID NO: 2691681 - protein, 19 aa, Entamoeba histolytica
PPMYERVRVPSPIQKPELA

SEQ ID NO: 2691682 - protein, 17 aa, Entamoeba histolytica
PPNFEVMRIRKLNVNGT

SEQ ID NO: 2691683 - protein, 18 aa, Entamoeba histolytica
PPNLQYLSLPSIKQLNQL

SEQ ID NO: 2691684 - protein, 24 aa, Entamoeba histolytica
PPPCYTRERCGLGLLETEESNEID

SEQ ID NO: 2691685 - protein, 19 aa, Entamoeba histolytica
PPPMHKVSIALAVPPPISS

SEQ ID NO: 2691686 - protein, 17 aa, Entamoeba histolytica
PPPPPGMPGMPPPPPPG

SEQ ID NO: 2691687 - protein, 18 aa, Entamoeba histolytica
PPPPPGNSSIVMGQEENL

SEQ ID NO: 2691688 - protein, 19 aa, Entamoeba histolytica
PPPSCTKPTVSIAAPPPPM

SEQ ID NO: 2691689 - protein, 31 aa, Entamoeba histolytica
PPQKVEINIIWKLEGDNLIPAIMTIYDDKVV

SEQ ID NO: 2691690 - protein, 20 aa, Entamoeba histolytica
PPQLRTKLLGQMRLLNKESQ

SEQ ID NO: 2691691 - protein, 20 aa, Entamoeba histolytica
PPRGEFFCCGKIEKSSFTND

SEQ ID NO: 2691692 - protein, 17 aa, Entamoeba histolytica
PPRIRMFELDQLSQKFE

SEQ ID NO: 2691693 - protein, 25 aa, Entamoeba histolytica
PPRSPRGSLLPSTFKKLSQEKDHKR

SEQ ID NO: 2691694 - protein, 25 aa, Entamoeba histolytica
PPRVKRIGERWVILRTFDRFFEESP

SEQ ID NO: 2691695 - protein, 27 aa, Entamoeba histolytica
PPSHFTMFSQFMKLCYKIHTYSDINLM

SEQ ID NO: 2691696 - protein, 20 aa, Entamoeba histolytica
PPSLYCGSELYVFNLELNIT

SEQ ID NO: 2691697 - protein, 18 aa, Entamoeba histolytica
PPSVSWSINGDIIFSASE

SEQ ID NO: 2691698 - protein, 26 aa, Entamoeba histolytica
PPTDYVWKCVCIHQSIVFLMKLTELL

SEQ ID NO: 2691699 - protein, 17 aa, Entamoeba histolytica
PPTKKLIERQKKMRTET

SEQ ID NO: 2691700 - protein, 23 aa, Entamoeba histolytica
PPTKSSDIVPSFKLACNKEGPYS

SEQ ID NO: 2691701 - protein, 20 aa, Entamoeba histolytica
PPTLCYGCHSLSQISFPPYL

SEQ ID NO: 2691702 - protein, 19 aa, Entamoeba histolytica
PPTSNLRYSRSCRQRSSYR

SEQ ID NO: 2691703 - protein, 22 aa, Entamoeba histolytica
PPVANFCLWNLQPIQGSWMGAA

SEQ ID NO: 2691704 - protein, 21 aa, Entamoeba histolytica
PPVFYEMKNGALLIFPQQQNS

SEQ ID NO: 2691705 - protein, 18 aa, Entamoeba histolytica
PPVLHIVKQMYFEPMNIP

SEQ ID NO: 2691706 - protein, 23 aa, Entamoeba histolytica
PPVPAPRRGLMLGRRDTQQTTSS

SEQ ID NO: 2691707 - protein, 24 aa, Entamoeba histolytica
PPVPAPRRGLMLGRRGGINETSSE

SEQ ID NO: 2691708 - protein, 22 aa, Entamoeba histolytica
PPVYDKLSIIGFYIQQKQKSIP

SEQ ID NO: 2691709 - protein, 18 aa, Entamoeba histolytica
PQAFFKGLIFPLCQEKDV

SEQ ID NO: 2691710 - protein, 18 aa, Entamoeba histolytica
PQCITRLQIDSCNSIHEL

SEQ ID NO: 2691711 - protein, 23 aa, Entamoeba histolytica
PQCMSIRPSNEFITVATDNILNF

SEQ ID NO: 2691712 - protein, 31 aa, Entamoeba histolytica
PQCVAAWKKEALLCLIINYSLYPVSKQFNYF

SEQ ID NO: 2691713 - protein, 19 aa, Entamoeba histolytica
PQCVELWIIFAEKESYENS

SEQ ID NO: 2691714 - protein, 24 aa, Entamoeba histolytica
PQDESAVIEPCKYSYEGEVIENEE

SEQ ID NO: 2691715 - protein, 24 aa, Entamoeba histolytica
PQDESAVIEPCKYSYEGEVVENEE

SEQ ID NO: 2691716 - protein, 20 aa, Entamoeba histolytica
PQDIDPVVTKRANFLGERKP

SEQ ID NO: 2691717 - protein, 19 aa, Entamoeba histolytica
PQDKIEIGFEIVTDKCYQF

SEQ ID NO: 2691718 - protein, 23 aa, Entamoeba histolytica
PQDSNAFSKFVFNNPPQSQTNNT

SEQ ID NO: 2691719 - protein, 18 aa, Entamoeba histolytica
PQEFIKESITLVIQNQSV

SEQ ID NO: 2691720 - protein, 21 aa, Entamoeba histolytica
PQEFYFRRCSYHSAKDMNIPF

SEQ ID NO: 2691721 - protein, 30 aa, Entamoeba histolytica
PQEIPICVNCVSLLTKMWYPTGKNITVIER

SEQ ID NO: 2691722 - protein, 18 aa, Entamoeba histolytica
PQEQIRIQPTYGLEFQLG

SEQ ID NO: 2691723 - protein, 19 aa, Entamoeba histolytica
PQESFKFISPTPGNLITSG

SEQ ID NO: 2691724 - protein, 18 aa, Entamoeba histolytica
PQESIKHEFIKSLQPKKT

SEQ ID NO: 2691725 - protein, 20 aa, Entamoeba histolytica
PQFIGCAAYLGQIRTIYQHG

SEQ ID NO: 2691726 - protein, 28 aa, Entamoeba histolytica
PQFIHLYIDWVIKTGFNFISFETLFVSC

SEQ ID NO: 2691727 - protein, 17 aa, Entamoeba histolytica
PQFKPNDLYSIYQMSLN

SEQ ID NO: 2691728 - protein, 17 aa, Entamoeba histolytica
PQFLDFCTQLLCLNPEK

SEQ ID NO: 2691729 - protein, 18 aa, Entamoeba histolytica
PQFNEWKDARIQEGQLKK

SEQ ID NO: 2691730 - protein, 17 aa, Entamoeba histolytica
PQFSMMFDQMISNPELL

SEQ ID NO: 2691731 - protein, 22 aa, Entamoeba histolytica
PQFWVNLCQSQDDFRIVINREI

SEQ ID NO: 2691732 - protein, 22 aa, Entamoeba histolytica
PQFYRNSIRLFIGSNKFSNAST

SEQ ID NO: 2691733 - protein, 26 aa, Entamoeba histolytica
PQGQWPELMPFLLTDGSVAKLKTIGF

SEQ ID NO: 2691734 - protein, 29 aa, Entamoeba histolytica
PQIDFQIGSCLRVKQFSLPSLVLNKEKAQ

SEQ ID NO: 2691735 - protein, 19 aa, Entamoeba histolytica
PQIKDFISHLIVFDTSKRY

SEQ ID NO: 2691736 - protein, 18 aa, Entamoeba histolytica
PQITKALVKKIYSQLKLV

SEQ ID NO: 2691737 - protein, 17 aa, Entamoeba histolytica
PQKDIWGNPVQSQNTQP

SEQ ID NO: 2691738 - protein, 17 aa, Entamoeba histolytica
PQKEDLKGQPQQPPSQP

SEQ ID NO: 2691739 - protein, 18 aa, Entamoeba histolytica
PQKKWGFGSIKSSIVSGV

SEQ ID NO: 2691740 - protein, 31 aa, Entamoeba histolytica
PQKLRICEKCGLHPNICICQLIPKEKEHDNY

SEQ ID NO: 2691741 - protein, 17 aa, Entamoeba histolytica
PQKRLSEELHRIKEQIE

SEQ ID NO: 2691742 - protein, 19 aa, Entamoeba histolytica
PQKYFPVFRQNFHTRQTTL

SEQ ID NO: 2691743 - protein, 21 aa, Entamoeba histolytica
PQLDRIGIFILTFNDNNIQLL

SEQ ID NO: 2691744 - protein, 18 aa, Entamoeba histolytica
PQLLSWRLNGELSLLNLG

SEQ ID NO: 2691745 - protein, 23 aa, Entamoeba histolytica
PQLPEVWFNMGSLYIFHNQRDDA

SEQ ID NO: 2691746 - protein, 23 aa, Entamoeba histolytica
PQLPPPRRGASSANRSLNPTLSS

SEQ ID NO: 2691747 - protein, 25 aa, Entamoeba histolytica
PQLQEWTGLNFKEILFDSNIHEMNA

SEQ ID NO: 2691748 - protein, 20 aa, Entamoeba histolytica
PQLSQYLSFDECKLFDRIYT

SEQ ID NO: 2691749 - protein, 33 aa, Entamoeba histolytica
PQLVLFCCKSFSFKRFVKFDCVLIDVQKEENIN

SEQ ID NO: 2691750 - protein, 25 aa, Entamoeba histolytica
PQLYYYFRHCYGLEGSKITEPVWTC

SEQ ID NO: 2691751 - protein, 20 aa, Entamoeba histolytica
PQMRVVSRYGHFIMKISDII

SEQ ID NO: 2691752 - protein, 23 aa, Entamoeba histolytica
PQNKLPAVEAWIVNDKIECSEKA

SEQ ID NO: 2691753 - protein, 24 aa, Entamoeba histolytica
PQNKWMIQFPRIFHVCKGNKEEYT

SEQ ID NO: 2691754 - protein, 20 aa, Entamoeba histolytica
PQNLCVAGALFQNSINLPYS

SEQ ID NO: 2691755 - protein, 18 aa, Entamoeba histolytica
PQNYCKVAIINGFFDNIL

SEQ ID NO: 2691756 - protein, 18 aa, Entamoeba histolytica
PQPISMRNVIGITMPPAY

SEQ ID NO: 2691757 - protein, 17 aa, Entamoeba histolytica
PQPPKQRIEISRKSFEE

SEQ ID NO: 2691758 - protein, 21 aa, Entamoeba histolytica
PQPQKDIWGKPVQSQPGQQQN

SEQ ID NO: 2691759 - protein, 21 aa, Entamoeba histolytica
PQPQKDIWGNPVQQQNGTQNP

SEQ ID NO: 2691760 - protein, 22 aa, Entamoeba histolytica
PQPRPKRILGGWDNVINEVIEC

SEQ ID NO: 2691761 - protein, 22 aa, Entamoeba histolytica
PQQEYSQWLQLIYKTLIEINES

SEQ ID NO: 2691762 - protein, 23 aa, Entamoeba histolytica
PQQEYSQWLQLIYKTLIEINESY

SEQ ID NO: 2691763 - protein, 17 aa, Entamoeba histolytica
PQQKLKMIIDIKLSTIS

SEQ ID NO: 2691764 - protein, 18 aa, Entamoeba histolytica
PQQLDCLTQLIKPKTLTF

SEQ ID NO: 2691765 - protein, 26 aa, Entamoeba histolytica
PQQMSLSRLKGIFGEKIEIEKKLENR

SEQ ID NO: 2691766 - protein, 25 aa, Entamoeba histolytica
PQQNRIRISFIISWLDDNDVDKVSE

SEQ ID NO: 2691767 - protein, 18 aa, Entamoeba histolytica
PQSLIGNWEKEFKKWLGV

SEQ ID NO: 2691768 - protein, 21 aa, Entamoeba histolytica
PQSPSILLFYCEFSGTRAPAL

SEQ ID NO: 2691769 - protein, 24 aa, Entamoeba histolytica
PQSQLRYLQSFAFNGDLLPDVIEP

SEQ ID NO: 2691770 - protein, 27 aa, Entamoeba histolytica
PQSRYEILDFLGIGGFGVVRKVKRISD

SEQ ID NO: 2691771 - protein, 17 aa, Entamoeba histolytica
PQTAYLVLVEWDDLYIK

SEQ ID NO: 2691772 - protein, 18 aa, Entamoeba histolytica
PQTLAFVRFYVSQKMDES

SEQ ID NO: 2691773 - protein, 17 aa, Entamoeba histolytica
PQTLHLLAFDSLVDSAK

SEQ ID NO: 2691774 - protein, 25 aa, Entamoeba histolytica
PQTLIPRFYGMFRIKPQKDEEYRYV

SEQ ID NO: 2691775 - protein, 23 aa, Entamoeba histolytica
PQVDSLFLIHTFPFLEIFNNKLF

SEQ ID NO: 2691776 - protein, 19 aa, Entamoeba histolytica
PQVYYKPLLEFFKGTSQPN

SEQ ID NO: 2691777 - protein, 23 aa, Entamoeba histolytica
PQWKSCFESIPLLSLGFQSINLA

SEQ ID NO: 2691778 - protein, 21 aa, Entamoeba histolytica
PQYAGKLYISLTLYNQKEAIQ

SEQ ID NO: 2691779 - protein, 25 aa, Entamoeba histolytica
PQYTQLCDIWSFGVTIFVSMCGYYP

SEQ ID NO: 2691780 - protein, 18 aa, Entamoeba histolytica
PRALKILKGLGFAEDEMK

SEQ ID NO: 2691781 - protein, 18 aa, Entamoeba histolytica
PRALRIQLVNKFKSYFNK

SEQ ID NO: 2691782 - protein, 21 aa, Entamoeba histolytica
PRANGFIGRTRPTPKPEEPKQ

SEQ ID NO: 2691783 - protein, 18 aa, Entamoeba histolytica
PRASGIRFWEHLFPGSKT

SEQ ID NO: 2691784 - protein, 25 aa, Entamoeba histolytica
PRCGKQCVFEWQLLPQFIYATNLDI

SEQ ID NO: 2691785 - protein, 21 aa, Entamoeba histolytica
PRDIEEIDNILSLLRIEKHME

SEQ ID NO: 2691786 - protein, 18 aa, Entamoeba histolytica
PRDISVVPDIHIEENTQT

SEQ ID NO: 2691787 - protein, 28 aa, Entamoeba histolytica
PRDKKEIFVFRTPEVIVSKHFSSSYDIL

SEQ ID NO: 2691788 - protein, 28 aa, Entamoeba histolytica
PRDLFVLPFVCRKFRAALTSEVSNQIYK

SEQ ID NO: 2691789 - protein, 20 aa, Entamoeba histolytica
PRDLRDPRLMDSRFDPRYDN

SEQ ID NO: 2691790 - protein, 27 aa, Entamoeba histolytica
PREHVLCICILYGLINRLIKYNSIHMM

SEQ ID NO: 2691791 - protein, 21 aa, Entamoeba histolytica
PRFSGCQALPLPISFSHSNHK

SEQ ID NO: 2691792 - protein, 18 aa, Entamoeba histolytica
PRGAAYVRQEHIEPFRVF

SEQ ID NO: 2691793 - protein, 19 aa, Entamoeba histolytica
PRGGPRGAPMGGMMPPPPP

SEQ ID NO: 2691794 - protein, 19 aa, Entamoeba histolytica
PRGGPRGAPRGMPRGRGTA

SEQ ID NO: 2691795 - protein, 21 aa, Entamoeba histolytica
PRGRKECRCYGTVHKAIGNCL

SEQ ID NO: 2691796 - protein, 18 aa, Entamoeba histolytica
PRGSVIAMAVNASKKEDA

SEQ ID NO: 2691797 - protein, 20 aa, Entamoeba histolytica
PRHKNFRLFANMNPPTDVGK

SEQ ID NO: 2691798 - protein, 24 aa, Entamoeba histolytica
PRHTRACFVVDLYIGNKVQLTRDQ

SEQ ID NO: 2691799 - protein, 17 aa, Entamoeba histolytica
PRIEIIQISGIEMQDLE

SEQ ID NO: 2691800 - protein, 19 aa, Entamoeba histolytica
PRIKPQWWVNCKNMARRAV

SEQ ID NO: 2691801 - protein, 19 aa, Entamoeba histolytica
PRILTSHFNNVFFIIQPKI

SEQ ID NO: 2691802 - protein, 19 aa, Entamoeba histolytica
PRINQRWTVCSHGDGDGLC

SEQ ID NO: 2691803 - protein, 22 aa, Entamoeba histolytica
PRIRIVKKLAGGVCFTPTAKQS

SEQ ID NO: 2691804 - protein, 20 aa, Entamoeba histolytica
PRKELMNLIIEKMKASGDEM

SEQ ID NO: 2691805 - protein, 25 aa, Entamoeba histolytica
PRKINGCDYAFCKYCKAESDKGGDN

SEQ ID NO: 2691806 - protein, 22 aa, Entamoeba histolytica
PRKKPGKIYTVFYQTIQLKIEY

SEQ ID NO: 2691807 - protein, 20 aa, Entamoeba histolytica
PRKLLYIAIDGVAPRAKMNQ

SEQ ID NO: 2691808 - protein, 24 aa, Entamoeba histolytica
PRKSIPKAPLLNSLNTSSIDDVVS

SEQ ID NO: 2691809 - protein, 22 aa, Entamoeba histolytica
PRKSPEQFLRSSLFDESPSLLF

SEQ ID NO: 2691810 - protein, 29 aa, Entamoeba histolytica
PRKTHRGLRKVACVGAWHPARVSWTVARA

SEQ ID NO: 2691811 - protein, 20 aa, Entamoeba histolytica
PRKVEFLIDEYIPYMHLKEN

SEQ ID NO: 2691812 - protein, 18 aa, Entamoeba histolytica
PRKVPCLNLNSTKKTGIF

SEQ ID NO: 2691813 - protein, 21 aa, Entamoeba histolytica
PRLATLLRLCVLKEPETRPTL

SEQ ID NO: 2691814 - protein, 19 aa, Entamoeba histolytica
PRLDSLDMMDTRPPMDRPL

SEQ ID NO: 2691815 - protein, 20 aa, Entamoeba histolytica
PRLEFIDFVKQIAFCVPTQS

SEQ ID NO: 2691816 - protein, 21 aa, Entamoeba histolytica
PRLEQNYSLVCIELIKYIEQF

SEQ ID NO: 2691817 - protein, 20 aa, Entamoeba histolytica
PRLFKTPRLTSTEVQSKKRA

SEQ ID NO: 2691818 - protein, 19 aa, Entamoeba histolytica
PRLFTSHFNHIFVIVQPIS

SEQ ID NO: 2691819 - protein, 19 aa, Entamoeba histolytica
PRLFYCVSKTPNIKGEIPL

SEQ ID NO: 2691820 - protein, 17 aa, Entamoeba histolytica
PRLSIIEYNSQTPLKTQ

SEQ ID NO: 2691821 - protein, 21 aa, Entamoeba histolytica
PRLTVFKKIDGEGIFDVSMLF

SEQ ID NO: 2691822 - protein, 26 aa, Entamoeba histolytica
PRLYNLRLVTILPGFEVQSMVPKSFT

SEQ ID NO: 2691823 - protein, 24 aa, Entamoeba histolytica
PRMKKEWKDILEFLSPESQGLLSL

SEQ ID NO: 2691824 - protein, 42 aa, Entamoeba histolytica
PRNDIDEIKESFTAFKTEMDKMADIEETWRKMKSQTDEMKKL

SEQ ID NO: 2691825 - protein, 23 aa, Entamoeba histolytica
PRNLRKIIMDSCLVQIKQIVYST

SEQ ID NO: 2691826 - protein, 21 aa, Entamoeba histolytica
PRNTLTLSLSKRFSGIKLGSL

SEQ ID NO: 2691827 - protein, 26 aa, Entamoeba histolytica
PRNVGMWWKYDLKEYIIINRWCNCTI

SEQ ID NO: 2691828 - protein, 25 aa, Entamoeba histolytica
PRPLDGPEALTFLKKQAIRFNAICA

SEQ ID NO: 2691829 - protein, 19 aa, Entamoeba histolytica
PRPSELFFQHPSIQQLPKM

SEQ ID NO: 2691830 - protein, 24 aa, Entamoeba histolytica
PRPVAHGNGGLGISNLMMTAGEDI

SEQ ID NO: 2691831 - protein, 19 aa, Entamoeba histolytica
PRRGQLKQRPQSRVADNRP

SEQ ID NO: 2691832 - protein, 18 aa, Entamoeba histolytica
PRRLLIRIFGEGDAAWVV

SEQ ID NO: 2691833 - protein, 30 aa, Entamoeba histolytica; identical to SEQ ID NO: 2500175

SEQ ID NO: 2691834 - protein, 25 aa, Entamoeba histolytica
PRSEYKIILIKAIVRTAIDYGDVYT

SEQ ID NO: 2691835 - protein, 18 aa, Entamoeba histolytica
PRSFKARPLINHSDGTKQ

SEQ ID NO: 2691836 - protein, 18 aa, Entamoeba histolytica
PRSLKYLFEKVNAQMDTG

SEQ ID NO: 2691837 - protein, 20 aa, Entamoeba histolytica
PRSSDEIKRKTKIPKLSEKT

SEQ ID NO: 2691838 - protein, 27 aa, Entamoeba histolytica
PRSSRDWSDLATLYIMLKYRKWQLKDR

SEQ ID NO: 2691839 - protein, 18 aa, Entamoeba histolytica
PRSTRWWYSVTRANQIIR

SEQ ID NO: 2691840 - protein, 19 aa, Entamoeba histolytica
PRTGFVCSTSVFGQTMENM

SEQ ID NO: 2691841 - protein, 21 aa, Entamoeba histolytica
PRTLGEYLVSFVLPQWKSCFE

SEQ ID NO: 2691842 - protein, 17 aa, Entamoeba histolytica
PRTLTILKIENENNIVN

SEQ ID NO: 2691843 - protein, 23 aa, Entamoeba histolytica
PRTRGNSFYGRERPVFNGNKQCL

SEQ ID NO: 2691844 - protein, 19 aa, Entamoeba histolytica
PRTRGPIVDGFRCVEKGIY

SEQ ID NO: 2691845 - protein, 19 aa, Entamoeba histolytica
PRTRSEKDIVYFGMNHGDV

SEQ ID NO: 2691846 - protein, 17 aa, Entamoeba histolytica
PRTSRRNLISHIIVVGG

SEQ ID NO: 2691847 - protein, 17 aa, Entamoeba histolytica
PRVEVSVEELIRMSGKT

SEQ ID NO: 2691848 - protein, 18 aa, Entamoeba histolytica
PRVINILANAIFHNDAKV

SEQ ID NO: 2691849 - protein, 26 aa, Entamoeba histolytica
PRVNNGALCAIELIQRRGCPYFISFE

SEQ ID NO: 2691850 - protein, 19 aa, Entamoeba histolytica
PRYFYLFNDILIYGIGDSN

SEQ ID NO: 2691851 - protein, 17 aa, Entamoeba histolytica
PRYNLLFQDMIKRTPLV

SEQ ID NO: 2691852 - protein, 17 aa, Entamoeba histolytica
PRYPLLLNTLIKVTNEN

SEQ ID NO: 2691853 - protein, 20 aa, Entamoeba histolytica
PRYRKVSVGFVVYKTKEAAA

SEQ ID NO: 2691854 - protein, 22 aa, Entamoeba histolytica
PRYTMKGIPMVLNKVSLMKEPI

SEQ ID NO: 2691855 - protein, 19 aa, Entamoeba histolytica
PRYTYSLSSGVDVWRRKVN

SEQ ID NO: 2691856 - protein, 20 aa, Entamoeba histolytica
PRYYNCCMCCHSQLDNPRNY

SEQ ID NO: 2691857 - protein, 22 aa, Entamoeba histolytica
PSADCKECIVMLLEKDPEKRLT

SEQ ID NO: 2691858 - protein, 23 aa, Entamoeba histolytica
PSADMVIRIDFIRAIHLGRNSTN

SEQ ID NO: 2691859 - protein, 25 aa, Entamoeba histolytica
PSALKCSIMAAKIVRDAAISAGAPE

SEQ ID NO: 2691860 - protein, 18 aa, Entamoeba histolytica
PSCISFLIHPSRRSFETK

SEQ ID NO: 2691861 - protein, 17 aa, Entamoeba histolytica
PSCSICHPDRALVEIDH

SEQ ID NO: 2691862 - protein, 26 aa, Entamoeba histolytica
PSDESYRFYQLLLFNFSHFVADEDFN

SEQ ID NO: 2691863 - protein, 17 aa, Entamoeba histolytica
PSDIRSYKIIDSKINEP

SEQ ID NO: 2691864 - protein, 17 aa, Entamoeba histolytica
PSDLPSITFPDTSKFVI

SEQ ID NO: 2691865 - protein, 19 aa, Entamoeba histolytica
PSDSFPFLRLKNYQTSDLC

SEQ ID NO: 2691866 - protein, 19 aa, Entamoeba histolytica
PSEAELFLAGFAKSRKYYT

SEQ ID NO: 2691867 - protein, 29 aa, Entamoeba histolytica
PSEEKSMMPFGRYKRDITDIFSVMKSEKK

SEQ ID NO: 2691868 - protein, 24 aa, Entamoeba histolytica
PSEIKRTMIRKVVGLNKKFKSNQS

SEQ ID NO: 2691869 - protein, 24 aa, Entamoeba histolytica
PSENRLELVRGFTTFAAIYAEVTK

SEQ ID NO: 2691870 - protein, 29 aa, Entamoeba histolytica
PSFDIKPSSSFSLFGGDIINDTKKSDTQP

SEQ ID NO: 2691871 - protein, 22 aa, Entamoeba histolytica
PSFGTMEWNHLYLIFDANIDGT

SEQ ID NO: 2691872 - protein, 24 aa, Entamoeba histolytica
PSFILQCIEYLLSEDAQKKFPFIP

SEQ ID NO: 2691873 - protein, 28 aa, Entamoeba histolytica
PSFISKIGKWCFFKCSSLKSINIPTTIK

SEQ ID NO: 2691874 - protein, 19 aa, Entamoeba histolytica
PSFRQYKLLESFLEIMKIG

SEQ ID NO: 2691875 - protein, 17 aa, Entamoeba histolytica
PSFSFCSKCSNRVEMQD

SEQ ID NO: 2691876 - protein, 20 aa, Entamoeba histolytica
PSFWKKSFIDKLEGVYEVIP

SEQ ID NO: 2691877 - protein, 25 aa, Entamoeba histolytica
PSFYNVYQCFTLRPPLNQHNSSLNP

SEQ ID NO: 2691878 - protein, 18 aa, Entamoeba histolytica
PSGPRKGQSIQVPLNCDL

SEQ ID NO: 2691879 - protein, 20 aa, Entamoeba histolytica
PSGSFWTWKATALGKNMTSV

SEQ ID NO: 2691880 - protein, 27 aa, Entamoeba histolytica
PSHHNDIMFYRGYKFVVSLKVSGVALG

SEQ ID NO: 2691881 - protein, 22 aa, Entamoeba histolytica
PSHPRLYTVIGESTILNSVESS

SEQ ID NO: 2691882 - protein, 27 aa, Entamoeba histolytica
PSHSPRASPRFSPRISPRTSLNSPHGS

SEQ ID NO: 2691883 - protein, 24 aa, Entamoeba histolytica
PSHYLYCGMLIYLLQFNKESYFSL

SEQ ID NO: 2691884 - protein, 18 aa, Entamoeba histolytica
PSIFEAWAKKQGGSVKNW

SEQ ID NO: 2691885 - protein, 18 aa, Entamoeba histolytica
PSIFSCALQNQGIFFDSL

SEQ ID NO: 2691886 - protein, 19 aa, Entamoeba histolytica
PSIIKGKECVNGYFDCEHF

SEQ ID NO: 2691887 - protein, 18 aa, Entamoeba histolytica
PSIIPFIPSISEGKLPSV

SEQ ID NO: 2691888 - protein, 20 aa, Entamoeba histolytica
PSILKELYYAISNITACKDI

SEQ ID NO: 2691889 - protein, 18 aa, Entamoeba histolytica
PSILKPLYPNSLVPRKSV

SEQ ID NO: 2691890 - protein, 22 aa, Entamoeba histolytica
PSILSVTVPLLLSSGNTLLIRR

SEQ ID NO: 2691891 - protein, 20 aa, Entamoeba histolytica
PSINGGLIYCIGVLPKPIKC

SEQ ID NO: 2691892 - protein, 25 aa, Entamoeba histolytica
PSIQKGLFCLMHILLQYHDPQLCHC

SEQ ID NO: 2691893 - protein, 17 aa, Entamoeba histolytica
PSISLLFECVDLIHQNL

SEQ ID NO: 2691894 - protein, 26 aa, Entamoeba histolytica
PSIYFQRSPTFIIWGLYLGSVNSTYD

SEQ ID NO: 2691895 - protein, 24 aa, Entamoeba histolytica
PSKCVMSGPGLKTGEVLVPQEFTV

SEQ ID NO: 2691896 - protein, 21 aa, Entamoeba histolytica
PSKEEALEWQELIEKQKENVL

SEQ ID NO: 2691897 - protein, 19 aa, Entamoeba histolytica
PSKEIKAKEMAPITREMTI

SEQ ID NO: 2691898 - protein, 21 aa, Entamoeba histolytica
PSKEILSKLVEMWNGLTEEQK

SEQ ID NO: 2691899 - protein, 25 aa, Entamoeba histolytica
PSKFKRINCIALRGFSGSTEVLMLQ

SEQ ID NO: 2691900 - protein, 19 aa, Entamoeba histolytica
PSKKLIPLINAFQATHKIF

SEQ ID NO: 2691901 - protein, 28 aa, Entamoeba histolytica
PSKPCILPMIFRLFLRKDYTYEVFGLIC

SEQ ID NO: 2691902 - protein, 20 aa, Entamoeba histolytica
PSKSTNCIISAPPSVSSTPT

SEQ ID NO: 2691903 - protein, 22 aa, Entamoeba histolytica
PSKYCLTKTMELMRKYLMGKPK

SEQ ID NO: 2691904 - protein, 17 aa, Entamoeba histolytica
PSLDCLTEYLQTNKIPS

SEQ ID NO: 2691905 - protein, 28 aa, Entamoeba histolytica
PSLICHSYFNREACDLSYDIRRELERNI

SEQ ID NO: 2691906 - protein, 24 aa, Entamoeba histolytica
PSLISRFDLWLNKYYPFGQLKLKE

SEQ ID NO: 2691907 - protein, 19 aa, Entamoeba histolytica
PSLKSIELPPYLKKLSSSL

SEQ ID NO: 2691908 - protein, 17 aa, Entamoeba histolytica
PSLLKIDNFLVEFITPI

SEQ ID NO: 2691909 - protein, 20 aa, Entamoeba histolytica
PSLLVSMLFDGTFLQVMTDR

SEQ ID NO: 2691910 - protein, 19 aa, Entamoeba histolytica
PSLNKSGLVMCIEQVKNSD

SEQ ID NO: 2691911 - protein, 26 aa, Entamoeba histolytica
PSLRENWYCKGRSVIEMNKDALCGLV

SEQ ID NO: 2691912 - protein, 27 aa, Entamoeba histolytica
PSMWKCLYKQKFEKIRLDCYFDDLCQW

SEQ ID NO: 2691913 - protein, 18 aa, Entamoeba histolytica
PSNCIPIALEQIIKEIKE

SEQ ID NO: 2691914 - protein, 23 aa, Entamoeba histolytica
PSNEFYSKGSFIFFIKDNISVCE

SEQ ID NO: 2691915 - protein, 23 aa, Entamoeba histolytica
PSNENRLLFAQCLYRVAKYDECR

SEQ ID NO: 2691916 - protein, 23 aa, Entamoeba histolytica
PSNFTVLIHLRYLSLSSNNLTTF

SEQ ID NO: 2691917 - protein, 23 aa, Entamoeba histolytica
PSNGEAFSLLAACQYSKDPKKVN

SEQ ID NO: 2691918 - protein, 32 aa, Entamoeba histolytica; identical to SEQ ID NO: 2500278

SEQ ID NO: 2691919 - protein, 19 aa, Entamoeba histolytica
PSNILIDFNPFKVYVDKLS

SEQ ID NO: 2691920 - protein, 25 aa, Entamoeba histolytica
PSNKRGFVTTCCIAIIQTIPFTSSQ

SEQ ID NO: 2691921 - protein, 26 aa, Entamoeba histolytica
PSNNQMYWVRFGPRDNQLVSLDKIKP

SEQ ID NO: 2691922 - protein, 21 aa, Entamoeba histolytica
PSNSITCYKTLLPDFVLNQKI

SEQ ID NO: 2691923 - protein, 23 aa, Entamoeba histolytica
PSNTLLFLVMWKNFSILRSTWVS

SEQ ID NO: 2691924 - protein, 17 aa, Entamoeba histolytica
PSPQFVIEGDIVYTSVF

SEQ ID NO: 2691925 - protein, 24 aa, Entamoeba histolytica
PSPQRSYCFNQMIKKYIIDSPLFE

SEQ ID NO: 2691926 - protein, 17 aa, Entamoeba histolytica
PSPRKPRQTKDKSKITH

SEQ ID NO: 2691927 - protein, 24 aa, Entamoeba histolytica
PSQAFWKFMNLIASKVTLEGYQNY

SEQ ID NO: 2691928 - protein, 24 aa, Entamoeba histolytica
PSQFYKQFRIAKQLAQHQNGMVLP

SEQ ID NO: 2691929 - protein, 18 aa, Entamoeba histolytica
PSQGSFLVLRWGECKRHK

SEQ ID NO: 2691930 - protein, 19 aa, Entamoeba histolytica
PSQIRFIIHTSTNHLPTHT

SEQ ID NO: 2691931 - protein, 21 aa, Entamoeba histolytica
PSQSRSGACWFIDNQDGKTTM

SEQ ID NO: 2691932 - protein, 23 aa, Entamoeba histolytica
PSRRILDDMLPPFIGKYTRGLLL

SEQ ID NO: 2691933 - protein, 20 aa, Entamoeba histolytica
PSRRRYRKSTSFKRRYSSRS

SEQ ID NO: 2691934 - protein, 18 aa, Entamoeba histolytica
PSRSRKQCRERFLNNLSN

SEQ ID NO: 2691935 - protein, 17 aa, Entamoeba histolytica
PSSDGKIIYAFNGNNIF

SEQ ID NO: 2691936 - protein, 26 aa, Entamoeba histolytica
PSSEDKWKWLTVFRDAFYRSAKDKLI

SEQ ID NO: 2691937 - protein, 21 aa, Entamoeba histolytica
PSSFSKLFIRQSKNCKLPEIS

SEQ ID NO: 2691938 - protein, 19 aa, Entamoeba histolytica
PSSIEWCHMIGLNYVSCSS

SEQ ID NO: 2691939 - protein, 20 aa, Entamoeba histolytica
PSSIEWCHMIGLNYVSCSSY

SEQ ID NO: 2691940 - protein, 23 aa, Entamoeba histolytica
PSSIQRLSLRSNFFSSSISNLQL

SEQ ID NO: 2691941 - protein, 30 aa, Entamoeba histolytica
PSSITKIGAFCFKDCFGLVEFESLAEHIII

SEQ ID NO: 2691942 - protein, 20 aa, Entamoeba histolytica
PSSLLPKFSNTPPQEINPPI

SEQ ID NO: 2691943 - protein, 27 aa, Entamoeba histolytica
PSSMFTRCNIMFSRWCQSIPPNRTEDG

SEQ ID NO: 2691944 - protein, 19 aa, Entamoeba histolytica
PSSMKLALFQMCPKIHSLE

SEQ ID NO: 2691945 - protein, 25 aa, Entamoeba histolytica
PSSVGISPLPPAGMSGQQQNGQVSG

SEQ ID NO: 2691946 - protein, 18 aa, Entamoeba histolytica
PSSWKNIHEVIRQCSISQ

SEQ ID NO: 2691947 - protein, 18 aa, Entamoeba histolytica
PSSYKCILNLNENDTSDS

SEQ ID NO: 2691948 - protein, 19 aa, Entamoeba histolytica
PSTAFCVLLRLFQLNPTPD

SEQ ID NO: 2691949 - protein, 25 aa, Entamoeba histolytica
PSTCLSWDISCDIALLMCISNYGLG

SEQ ID NO: 2691950 - protein, 24 aa, Entamoeba histolytica
PSTEAQLLHCFEVIKYSFCDVQQR

SEQ ID NO: 2691951 - protein, 20 aa, Entamoeba histolytica
PSTMWASFSYLSLYVKGVMT

SEQ ID NO: 2691952 - protein, 20 aa, Entamoeba histolytica
PSTRRPLPSLPRNYSQQSIE

SEQ ID NO: 2691953 - protein, 31 aa, Entamoeba histolytica
PSTSVLACALTKFKGTAIATNYPLYSPSYKE

SEQ ID NO: 2691954 - protein, 28 aa, Entamoeba histolytica
PSVFHLAWLSFLLYKSFKDSSEKSDESL

SEQ ID NO: 2691955 - protein, 26 aa, Entamoeba histolytica
PSVLSIHRSCLWVCKQLRSLKISQQD

SEQ ID NO: 2691956 - protein, 24 aa, Entamoeba histolytica
PSVNGKESWSIKSIFLGKKSYLDV

SEQ ID NO: 2691957 - protein, 20 aa, Entamoeba histolytica
PSVPVWNHFMAFDCNHDDQV

SEQ ID NO: 2691958 - protein, 25 aa, Entamoeba histolytica
PSVTVEALTTFFSFTGNVTQVRLSD

SEQ ID NO: 2691959 - protein, 25 aa, Entamoeba histolytica
PSVTWDVLRLIIAFSQSAADGNINP

SEQ ID NO: 2691960 - protein, 21 aa, Entamoeba histolytica
PSWFIPMAMHPAAYKHYKDFI

SEQ ID NO: 2691961 - protein, 20 aa, Entamoeba histolytica
PSYHCKLFSEWILKQAERLG

SEQ ID NO: 2691962 - protein, 21 aa, Entamoeba histolytica
PTATEEKGIETIVDKKVTTEP

SEQ ID NO: 2691963 - protein, 20 aa, Entamoeba histolytica
PTCPEMLEDIFKASYTKSDE

SEQ ID NO: 2691964 - protein, 24 aa, Entamoeba histolytica
PTDCSYSYCLPLFIISYGVNQPVT

SEQ ID NO: 2691965 - protein, 19 aa, Entamoeba histolytica
PTDDCEVMLKWKRGKKQIN

SEQ ID NO: 2691966 - protein, 24 aa, Entamoeba histolytica
PTDKRFPPIRIKARDPAKLASQRI

SEQ ID NO: 2691967 - protein, 26 aa, Entamoeba histolytica
PTDPVFPGTIPIFLSRQHYKILHNIR

SEQ ID NO: 2691968 - protein, 25 aa, Entamoeba histolytica
PTDSISLRMFYDMYLFTYVVILKST

SEQ ID NO: 2691969 - protein, 25 aa, Entamoeba histolytica
PTEARIIVFSLWMKDMISLQEINVH

SEQ ID NO: 2691970 - protein, 22 aa, Entamoeba histolytica
PTEICELKLEIVTLLVQETNCQ

SEQ ID NO: 2691971 - protein, 24 aa, Entamoeba histolytica
PTEKKCLFVRKSIMPEKRYTCVAG

SEQ ID NO: 2691972 - protein, 19 aa, Entamoeba histolytica
PTENGHIFIQTSIKNDKVK

SEQ ID NO: 2691973 - protein, 19 aa, Entamoeba histolytica
PTEPPTEKKLIEGTHVPKP

SEQ ID NO: 2691974 - protein, 20 aa, Entamoeba histolytica
PTESWRFLIRPLEIKEREEI

SEQ ID NO: 2691975 - protein, 17 aa, Entamoeba histolytica
PTFARSVSKEGLTVPSF

SEQ ID NO: 2691976 - protein, 17 aa, Entamoeba histolytica
PTFKEIYKILEKVIEKI

SEQ ID NO: 2691977 - protein, 25 aa, Entamoeba histolytica
PTFLSNLIILKSRYFALTNAESIHL

SEQ ID NO: 2691978 - protein, 25 aa, Entamoeba histolytica
PTFSYTIRSSDEFAMTTFSTYAVVN

SEQ ID NO: 2691979 - protein, 19 aa, Entamoeba histolytica
PTFWYSLYQEFLFETKGLK

SEQ ID NO: 2691980 - protein, 23 aa, Entamoeba histolytica
PTGEEARSWWIMMQEDAKQMSAS

SEQ ID NO: 2691981 - protein, 18 aa, Entamoeba histolytica
PTGIIQANCCILGNPETG

SEQ ID NO: 2691982 - protein, 18 aa, Entamoeba histolytica
PTGKEVGTFMGIDVGGTN

SEQ ID NO: 2691983 - protein, 26 aa, Entamoeba histolytica
PTGYKGSCFYRVIKNTVIQGGDIVNG

SEQ ID NO: 2691984 - protein, 19 aa, Entamoeba histolytica
PTGYPVIVVDVGVYLPKGI

SEQ ID NO: 2691985 - protein, 24 aa, Entamoeba histolytica
PTHKFEVFNEGKYCLKHHLTKTYY

SEQ ID NO: 2691986 - protein, 18 aa, Entamoeba histolytica
PTIDEVLKKLTILDEDLK

SEQ ID NO: 2691987 - protein, 17 aa, Entamoeba histolytica
PTIEMLDNYISFIGDEI

SEQ ID NO: 2691988 - protein, 23 aa, Entamoeba histolytica
PTIIPKPKVESIEEIKTEEPSNN

SEQ ID NO: 2691989 - protein, 17 aa, Entamoeba histolytica
PTIKRRGLIDNFISCVC

SEQ ID NO: 2691990 - protein, 23 aa, Entamoeba histolytica
PTIKYLTCIVMIYIDISYVRYNI

SEQ ID NO: 2691991 - protein, 24 aa, Entamoeba histolytica
PTILKSQLFGSGMIKYTHHPHVIL

SEQ ID NO: 2691992 - protein, 22 aa, Entamoeba histolytica
PTILRPGGVTLEMLREVIPSTQ

SEQ ID NO: 2691993 - protein, 18 aa, Entamoeba histolytica
PTIPVSCTLYINNLDQSI

SEQ ID NO: 2691994 - protein, 32 aa, Entamoeba histolytica; identical to SEQ ID NO: 2500388

SEQ ID NO: 2691995 - protein, 25 aa, Entamoeba histolytica
PTITLRYANPYSFIPKNTYKLSITG

SEQ ID NO: 2691996 - protein, 23 aa, Entamoeba histolytica
PTIYKEFIWGYRLFVSTQEVLFQ

SEQ ID NO: 2691997 - protein, 18 aa, Entamoeba histolytica
PTKAFTMTLWLKAIFEQH

SEQ ID NO: 2691998 - protein, 22 aa, Entamoeba histolytica
PTKDGLIGIEFITPTPSKFKRI

SEQ ID NO: 2691999 - protein, 18 aa, Entamoeba histolytica
PTKIEIIGNYCFEGCCSL

SEQ ID NO: 2692000 - protein, 22 aa, Entamoeba histolytica
PTKLTFIGAHCFDDCTSLKEIE

SEQ ID NO: 2692001 - protein, 17 aa, Entamoeba histolytica
PTKSLHGHSHFISDLVL

SEQ ID NO: 2692002 - protein, 19 aa, Entamoeba histolytica
PTLCSQLFIKEIDNALIDS

SEQ ID NO: 2692003 - protein, 26 aa, Entamoeba histolytica
PTLDEWRRLQFCFVINRVNYYLTRQE

SEQ ID NO: 2692004 - protein, 17 aa, Entamoeba histolytica
PTLDKLPELSLPSNLPK

SEQ ID NO: 2692005 - protein, 24 aa, Entamoeba histolytica
PTLEFLASIDCFWETKKTFDYGCF

SEQ ID NO: 2692006 - protein, 20 aa, Entamoeba histolytica
PTLFTYWISFYEFRKVFIQF

SEQ ID NO: 2692007 - protein, 18 aa, Entamoeba histolytica
PTLHVIKGLSTVRFVTGE

SEQ ID NO: 2692008 - protein, 18 aa, Entamoeba histolytica
PTLLSRYINLIIRKNSMV

SEQ ID NO: 2692009 - protein, 21 aa, Entamoeba histolytica
PTLMKILIFMKNCLTAKDPEK

SEQ ID NO: 2692010 - protein, 22 aa, Entamoeba histolytica
PTLNPIYEWFLLNTFSIEDSSS

SEQ ID NO: 2692011 - protein, 26 aa, Entamoeba histolytica
PTLPPPRRKTSCFRESTGELISKVIE

SEQ ID NO: 2692012 - protein, 17 aa, Entamoeba histolytica
PTLQGLIEQYLQFYYTD

SEQ ID NO: 2692013 - protein, 18 aa, Entamoeba histolytica
PTMKTCLGKINMMIQDNE

SEQ ID NO: 2692014 - protein, 20 aa, Entamoeba histolytica
PTMLGIGVICSDEYTAENAF

SEQ ID NO: 2692015 - protein, 23 aa, Entamoeba histolytica
PTMMAGKLYKFIPENQNGRFFPF

SEQ ID NO: 2692016 - protein, 18 aa, Entamoeba histolytica
PTMRIEKINEWLNCIESC

SEQ ID NO: 2692017 - protein, 18 aa, Entamoeba histolytica
PTMSFDWTRQKTINNNCI

SEQ ID NO: 2692018 - protein, 20 aa, Entamoeba histolytica
PTNIRQSAGILFKNLFPIKG

SEQ ID NO: 2692019 - protein, 20 aa, Entamoeba histolytica
PTNKAPLLWNSHTHSKSLSI

SEQ ID NO: 2692020 - protein, 26 aa, Entamoeba histolytica
PTNLFTIQFFFQVARILKLDGVFCLL

SEQ ID NO: 2692021 - protein, 19 aa, Entamoeba histolytica
PTNPLMAAIAARANRGGSS

SEQ ID NO: 2692022 - protein, 21 aa, Entamoeba histolytica
PTNRRLTRSIAPIKLKKPKKG

SEQ ID NO: 2692023 - protein, 21 aa, Entamoeba histolytica
PTPISPCFSKKGAYKSDHIPI

SEQ ID NO: 2692024 - protein, 25 aa, Entamoeba histolytica
PTPKIPILPLWLGDIIHAHTAFSSN

SEQ ID NO: 2692025 - protein, 19 aa, Entamoeba histolytica
PTPLDFLRRFSRAADNTEK

SEQ ID NO: 2692026 - protein, 19 aa, Entamoeba histolytica
PTPLLHPISSFLSINPINV

SEQ ID NO: 2692027 - protein, 20 aa, Entamoeba histolytica
PTPLLLTYCKIMIKGCDLVE

SEQ ID NO: 2692028 - protein, 19 aa, Entamoeba histolytica
PTPRRSSSVSVKYVAPQQT

SEQ ID NO: 2692029 - protein, 18 aa, Entamoeba histolytica
PTQPEVGKGFNITTNGGV

SEQ ID NO: 2692030 - protein, 24 aa, Entamoeba histolytica
PTQRICRYELLLSSILKEIKDKEC

SEQ ID NO: 2692031 - protein, 24 aa, Entamoeba histolytica
PTQSIEIMSLLPFINANDFIIVSI

SEQ ID NO: 2692032 - protein, 19 aa, Entamoeba histolytica
PTQWKIVLDDPLLVSQAKT

SEQ ID NO: 2692033 - protein, 17 aa, Entamoeba histolytica
PTRTARFGTAFSDDGLV

SEQ ID NO: 2692034 - protein, 22 aa, Entamoeba histolytica
PTRTRILALVKMLIQVFPNDFK

SEQ ID NO: 2692035 - protein, 18 aa, Entamoeba histolytica
PTSIPVDVPIQMSPMYSQ

SEQ ID NO: 2692036 - protein, 25 aa, Entamoeba histolytica
PTSLACFQCIGTIYATDHPTLISLF

SEQ ID NO: 2692037 - protein, 25 aa, Entamoeba histolytica
PTSNAILLLRWVVDWLEKDKRILMS

SEQ ID NO: 2692038 - protein, 21 aa, Entamoeba histolytica
PTSNKSHTVFMKRYDSPIISL

SEQ ID NO: 2692039 - protein, 27 aa, Entamoeba histolytica
PTTCFSSVLPFPFSVPISSPTPSPSIC

SEQ ID NO: 2692040 - protein, 18 aa, Entamoeba histolytica
PTTEFKELIPSNDIDIDK

SEQ ID NO: 2692041 - protein, 18 aa, Entamoeba histolytica
PTTGTFLYNCEKERRKYD

SEQ ID NO: 2692042 - protein, 24 aa, Entamoeba histolytica
PTTKENRLDCTFDISIINENRGIK

SEQ ID NO: 2692043 - protein, 20 aa, Entamoeba histolytica
PTTLPLIDRMSCIQSSCFYD

SEQ ID NO: 2692044 - protein, 19 aa, Entamoeba histolytica
PTTNIKVRFIDGKQKVFKV

SEQ ID NO: 2692045 - protein, 29 aa, Entamoeba histolytica
PTTPTLLARATFFEPMYKKMRLFSQEAIN

SEQ ID NO: 2692046 - protein, 24 aa, Entamoeba histolytica
PTTPWKYEVIFGPSNDFLYKKNPS

SEQ ID NO: 2692047 - protein, 25 aa, Entamoeba histolytica
PTWVNRMAWYGSQFEKFFGAGPQTQ

SEQ ID NO: 2692048 - protein, 19 aa, Entamoeba histolytica
PTYEDVRRLCLTFRRMADT

SEQ ID NO: 2692049 - protein, 20 aa, Entamoeba histolytica
PTYLNWCLGILNKAPQRPSN

SEQ ID NO: 2692050 - protein, 23 aa, Entamoeba histolytica
PTYRTEKYWDYSKTVLSMWNIVS

SEQ ID NO: 2692051 - protein, 24 aa, Entamoeba histolytica
PVECKHLRVSVRMDDLSVFEPIEM

SEQ ID NO: 2692052 - protein, 20 aa, Entamoeba histolytica
PVECRKEYWSLISKSFQSKQ

SEQ ID NO: 2692053 - protein, 25 aa, Entamoeba histolytica
PVEDIKLLIELAVALAEHRVSISGT

SEQ ID NO: 2692054 - protein, 19 aa, Entamoeba histolytica
PVEDVKLVSVFVKNIPYGW

SEQ ID NO: 2692055 - protein, 26 aa, Entamoeba histolytica
PVERRRALCFTPLFTTAAHFQIDAIF

SEQ ID NO: 2692056 - protein, 17 aa, Entamoeba histolytica
PVFCGKYSIKREIEKAI

SEQ ID NO: 2692057 - protein, 17 aa, Entamoeba histolytica
PVFPLGEPKTFQDTISG

SEQ ID NO: 2692058 - protein, 20 aa, Entamoeba histolytica
PVFVELQIKFYLLARLLGVE

SEQ ID NO: 2692059 - protein, 23 aa, Entamoeba histolytica
PVFVRSDFRTEFIFDCPQLTQST

SEQ ID NO: 2692060 - protein, 18 aa, Entamoeba histolytica
PVGQQWVKMGYYMSIYNG

SEQ ID NO: 2692061 - protein, 21 aa, Entamoeba histolytica
PVGSIALCLEPLLSSIIKLLT

SEQ ID NO: 2692062 - protein, 17 aa, Entamoeba histolytica
PVGTLGKKDYRIYFEQE

SEQ ID NO: 2692063 - protein, 18 aa, Entamoeba histolytica
PVHIRKGKYRFPGTDLWY

SEQ ID NO: 2692064 - protein, 18 aa, Entamoeba histolytica
PVHSSLSPLRAFRYDQSD

SEQ ID NO: 2692065 - protein, 30 aa, Entamoeba histolytica
PVIADRKRLRIGFKLVFEFEKNEWFEETEL

SEQ ID NO: 2692066 - protein, 19 aa, Entamoeba histolytica
PVIESHGILTPRLSLIKQH

SEQ ID NO: 2692067 - protein, 22 aa, Entamoeba histolytica
PVKETPGWTVRTLIHHKLDIIH

SEQ ID NO: 2692068 - protein, 17 aa, Entamoeba histolytica
PVKEVLDGFQLEIRVGK

SEQ ID NO: 2692069 - protein, 21 aa, Entamoeba histolytica
PVKGNIYCKYAPKKTNPVKPT

SEQ ID NO: 2692070 - protein, 23 aa, Entamoeba histolytica
PVKKDCGLRTLFPEDEESTHCES

SEQ ID NO: 2692071 - protein, 21 aa, Entamoeba histolytica
PVKKDLYCIIWDTTVSNSSDS

SEQ ID NO: 2692072 - protein, 26 aa, Entamoeba histolytica
PVKLTKPVPRSKIFEVMEIIHKQSPI

SEQ ID NO: 2692073 - protein, 22 aa, Entamoeba histolytica
PVKMFYCGHIYHDSCHRENTCV

SEQ ID NO: 2692074 - protein, 28 aa, Entamoeba histolytica
PVKTPKCPTRFVFKNGYYANTEDGGIII

SEQ ID NO: 2692075 - protein, 31 aa, Entamoeba histolytica
PVLCFKGTEDDLWKRKSVIKKFVETIDKIEL

SEQ ID NO: 2692076 - protein, 23 aa, Entamoeba histolytica
PVLGWGCPDPYACVWDSNENWIK

SEQ ID NO: 2692077 - protein, 17 aa, Entamoeba histolytica
PVLLTCYTQLLSDNKAL

SEQ ID NO: 2692078 - protein, 26 aa, Entamoeba histolytica
PVLNPPYFKQIFSWLISNLESQPKYI

SEQ ID NO: 2692079 - protein, 23 aa, Entamoeba histolytica
PVLPYVMSALCRMVDSPNKAIRP

SEQ ID NO: 2692080 - protein, 18 aa, Entamoeba histolytica
PVLQRLLEIFNRYENEEV

SEQ ID NO: 2692081 - protein, 22 aa, Entamoeba histolytica
PVMRNVFERVVGIMKNFTIITL

SEQ ID NO: 2692082 - protein, 26 aa, Entamoeba histolytica
PVNASCDIWALGCLLYELYTSKMLFA

SEQ ID NO: 2692083 - protein, 22 aa, Entamoeba histolytica
PVNGRMRDLIVIDRTEQTESLR

SEQ ID NO: 2692084 - protein, 18 aa, Entamoeba histolytica
PVNKLFWDFVKTVKKRLS

SEQ ID NO: 2692085 - protein, 18 aa, Entamoeba histolytica
PVPAPRRGLTLGRRSTTN

SEQ ID NO: 2692086 - protein, 20 aa, Entamoeba histolytica
PVPHYKANQPFKCVPVKNLT

SEQ ID NO: 2692087 - protein, 22 aa, Entamoeba histolytica
PVPPKPRSGLMNESAPSSEDNE

SEQ ID NO: 2692088 - protein, 24 aa, Entamoeba histolytica
PVPQQPALAPFDFAKEEQKKQPVA

SEQ ID NO: 2692089 - protein, 31 aa, Entamoeba histolytica
PVQLKLLCHPLRIEFIEEFNNVFARNSNEKF

SEQ ID NO: 2692090 - protein, 24 aa, Entamoeba histolytica
PVQRADIFQVLGFITDATKLPNPY

SEQ ID NO: 2692091 - protein, 22 aa, Entamoeba histolytica
PVQRFFKYPKIFGNLLASVDPK

SEQ ID NO: 2692092 - protein, 23 aa, Entamoeba histolytica
PVQRLPRYNLLLNELLKHTPTDH

SEQ ID NO: 2692093 - protein, 24 aa, Entamoeba histolytica
PVQRVMRYPMLIKEIIKLTNKNHP

SEQ ID NO: 2692094 - protein, 26 aa, Entamoeba histolytica
PVQSRYVSCPVIFNLGGVPLSLPKTV

SEQ ID NO: 2692095 - protein, 17 aa, Entamoeba histolytica
PVSFKFEGFVNLKKLHI

SEQ ID NO: 2692096 - protein, 20 aa, Entamoeba histolytica
PVSKPCYKYALTLIKDIEIF

SEQ ID NO: 2692097 - protein, 26 aa, Entamoeba histolytica
PVSLQFELTCPIKVHISLEIAKGIKY

SEQ ID NO: 2692098 - protein, 26 aa, Entamoeba histolytica
PVSRKSSFALPAPRQSIRRSIVPPRQ

SEQ ID NO: 2692099 - protein, 31 aa, Entamoeba histolytica
PVSRLFEVFPRMNIKIREWLGLNPTTNLYSR

SEQ ID NO: 2692100 - protein, 17 aa, Entamoeba histolytica
PVSSLMFHPTEHLLATG

SEQ ID NO: 2692101 - protein, 24 aa, Entamoeba histolytica
PVTCAFPVLFGRNGGINLKPKDVV

SEQ ID NO: 2692102 - protein, 19 aa, Entamoeba histolytica
PVTEIKYQLLRDNKFLEKS

SEQ ID NO: 2692103 - protein, 23 aa, Entamoeba histolytica
PVTLEECFEAFEVEELMDENNKV

SEQ ID NO: 2692104 - protein, 35 aa, Entamoeba histolytica; identical to SEQ ID NO: 2500495

SEQ ID NO: 2692105 - protein, 25 aa, Entamoeba histolytica
PVVVKIKVLFMRDGVQAEENANVYI

SEQ ID NO: 2692106 - protein, 20 aa, Entamoeba histolytica
PWDGMLCDLVWSDFNSTTSG

SEQ ID NO: 2692107 - protein, 24 aa, Entamoeba histolytica
PWFKEYNIPAANDFAILNLISEGK

SEQ ID NO: 2692108 - protein, 25 aa, Entamoeba histolytica
PWFKEYNIPAANDFAILNLISEGKR

SEQ ID NO: 2692109 - protein, 20 aa, Entamoeba histolytica
PWIMETCNLLSFNDQASVAT

SEQ ID NO: 2692110 - protein, 19 aa, Entamoeba histolytica
PWIQKGIHPTIIISGFLDA

SEQ ID NO: 2692111 - protein, 30 aa, Entamoeba histolytica
PWNKGKQTIKGFCFGSSFETSALLIQIISR

SEQ ID NO: 2692112 - protein, 17 aa, Entamoeba histolytica
PWRAFKCNCGGRIYQEP

SEQ ID NO: 2692113 - protein, 20 aa, Entamoeba histolytica
PYAECKAEILPWEMKKSCPK

SEQ ID NO: 2692114 - protein, 18 aa, Entamoeba histolytica
PYAFQIRFAGVKGVLTVD

SEQ ID NO: 2692115 - protein, 22 aa, Entamoeba histolytica
PYCETCGKKIWVQKQAKKKAEE

SEQ ID NO: 2692116 - protein, 23 aa, Entamoeba histolytica
PYCEWCKEMRTLLIQLSEELPNV

SEQ ID NO: 2692117 - protein, 18 aa, Entamoeba histolytica
PYCIIVMNEVGAWKKFYG

SEQ ID NO: 2692118 - protein, 19 aa, Entamoeba histolytica
PYCSCGSIKQVVKDKSHIF

SEQ ID NO: 2692119 - protein, 27 aa, Entamoeba histolytica
PYDGFKTDIWCCGVMLFYMSIGMFPFN

SEQ ID NO: 2692120 - protein, 23 aa, Entamoeba histolytica
PYDIENGDLWVLVKHYKSADNDI

SEQ ID NO: 2692121 - protein, 18 aa, Entamoeba histolytica
PYDILLIVACWRAEKRHH

SEQ ID NO: 2692122 - protein, 22 aa, Entamoeba histolytica
PYEKALKALRCLSKRRHENSFI

SEQ ID NO: 2692123 - protein, 25 aa, Entamoeba histolytica
PYEMEYIIPCLQFRNHIVIILLVNS

SEQ ID NO: 2692124 - protein, 18 aa, Entamoeba histolytica
PYESQLLIDNCDMTIEND

SEQ ID NO: 2692125 - protein, 30 aa, Entamoeba histolytica; identical to SEQ ID NO: 2500521

SEQ ID NO: 2692126 - protein, 25 aa, Entamoeba histolytica
PYFEKEIYVSLPIEKIPLSPSINCE

SEQ ID NO: 2692127 - protein, 29 aa, Entamoeba histolytica
PYFKTSIFWKLCCVYDHIVVHTLIRYCST

SEQ ID NO: 2692128 - protein, 18 aa, Entamoeba histolytica
PYFLISGKVLNGYITDGI

SEQ ID NO: 2692129 - protein, 19 aa, Entamoeba histolytica
PYFQECFVLAYRLVTTPEK

SEQ ID NO: 2692130 - protein, 17 aa, Entamoeba histolytica
PYFRKMLFTGSAEKKGC

SEQ ID NO: 2692131 - protein, 18 aa, Entamoeba histolytica
PYGCPKISGIDFGDGVIE

SEQ ID NO: 2692132 - protein, 19 aa, Entamoeba histolytica
PYGCSVVLFKLNVVSNTCD

SEQ ID NO: 2692133 - protein, 17 aa, Entamoeba histolytica
PYGLRYLCKVINENSME

SEQ ID NO: 2692134 - protein, 28 aa, Entamoeba histolytica
PYGNKIDCWSCGVVLYSLLCGTFPFAGE

SEQ ID NO: 2692135 - protein, 17 aa, Entamoeba histolytica
PYGPWSIYMKDAEMYLG

SEQ ID NO: 2692136 - protein, 21 aa, Entamoeba histolytica
PYHIKVLLEFYSSRGKLIDLL

SEQ ID NO: 2692137 - protein, 23 aa, Entamoeba histolytica
PYHLKLCFCPLCQKGISVLLKER

SEQ ID NO: 2692138 - protein, 23 aa, Entamoeba histolytica
PYHLKLCFCPLCQKGMAVLAKEQ

SEQ ID NO: 2692139 - protein, 19 aa, Entamoeba histolytica
PYIHCQRFIQCFGSHGWSG

SEQ ID NO: 2692140 - protein, 19 aa, Entamoeba histolytica
PYIKHGILGADILRELGLE

SEQ ID NO: 2692141 - protein, 18 aa, Entamoeba histolytica
PYIPEHLLLLLSTSEACQ

SEQ ID NO: 2692142 - protein, 21 aa, Entamoeba histolytica
PYIRNAYDVSRIMLIGNVKNY

SEQ ID NO: 2692143 - protein, 22 aa, Entamoeba histolytica
PYKALEIYGNIISYIDHQQYIN

SEQ ID NO: 2692144 - protein, 23 aa, Entamoeba histolytica
PYKRAKLVAQWYLSGFAHAMKVV

SEQ ID NO: 2692145 - protein, 20 aa, Entamoeba histolytica
PYLDILKKWTKKEICQVVYD

SEQ ID NO: 2692146 - protein, 28 aa, Entamoeba histolytica
PYLDSGVYRMDLKFRDFLMQKMINGERT

SEQ ID NO: 2692147 - protein, 23 aa, Entamoeba histolytica
PYLHTLHFYKSITIHEVPKVFKI

SEQ ID NO: 2692148 - protein, 18 aa, Entamoeba histolytica
PYLPILPYESQFLIDNCD

SEQ ID NO: 2692149 - protein, 27 aa, Entamoeba histolytica
PYLQKIIPFEYFKGIFTQSLSLILFYY

SEQ ID NO: 2692150 - protein, 24 aa, Entamoeba histolytica
PYMEFPPLRALFLITTKGIPPLKN

SEQ ID NO: 2692151 - protein, 24 aa, Entamoeba histolytica
PYMELPPLRALFLITTKGIPPLKE

SEQ ID NO: 2692152 - protein, 23 aa, Entamoeba histolytica
PYMNGRLHLGHTFTVTKAEFAAR

SEQ ID NO: 2692153 - protein, 18 aa, Entamoeba histolytica
PYNLRLVQHSTISLGGPL

SEQ ID NO: 2692154 - protein, 20 aa, Entamoeba histolytica
PYPLHFFSLPILPSITHTPS

SEQ ID NO: 2692155 - protein, 21 aa, Entamoeba histolytica
PYQPRRGFFSSLYQLIFHPIK

SEQ ID NO: 2692156 - protein, 19 aa, Entamoeba histolytica
PYQRLLMRMSEGIAIVPKR

SEQ ID NO: 2692157 - protein, 18 aa, Entamoeba histolytica
PYQSIAFKIPNMEVELDE

SEQ ID NO: 2692158 - protein, 20 aa, Entamoeba histolytica
PYRDSRLTFMLKDSLGGNCK

SEQ ID NO: 2692159 - protein, 25 aa, Entamoeba histolytica
PYSGKTSLIRRFLCNSFVEEYSKTN

SEQ ID NO: 2692160 - protein, 17 aa, Entamoeba histolytica
PYSGVSVIYGIETNNYH

SEQ ID NO: 2692161 - protein, 22 aa, Entamoeba histolytica
PYSLEELYIFYIHLRPLIPNEL

SEQ ID NO: 2692162 - protein, 27 aa, Entamoeba histolytica
PYSSIELSHVSKLVGMEVHAVEKVISI

SEQ ID NO: 2692163 - protein, 26 aa, Entamoeba histolytica
PYSSSWDRLNFCVAFGNKCLSCSTST

SEQ ID NO: 2692164 - protein, 18 aa, Entamoeba histolytica
PYTGQVIMQPVSYTQPIY

SEQ ID NO: 2692165 - protein, 19 aa, Entamoeba histolytica
PYVKAEDTRAFFLELYDSL

SEQ ID NO: 2692166 - protein, 26 aa, Entamoeba histolytica
PYVRKTAVLCVLKLYCMDPVNIEQHG

SEQ ID NO: 2692167 - protein, 23 aa, Entamoeba histolytica
PYYCLPNPFKRLGVPQTVSLDQA

SEQ ID NO: 2692168 - protein, 24 aa, Entamoeba histolytica
PYYDMPPMRVLMLIAQNPPPKLKN

SEQ ID NO: 2692169 - protein, 17 aa, Entamoeba histolytica
PYYLRLSLNKETPKIEV

SEQ ID NO: 2692170 - protein, 20 aa, Entamoeba histolytica
PYYRPCLTGNISNVDKACEI

SEQ ID NO: 2692171 - protein, 18 aa, Entamoeba histolytica
PYYSYAFSVIQYILVKTN

SEQ ID NO: 2692172 - protein, 29 aa, Entamoeba histolytica
QAAPAFPESFPHLFGKQKIRCLIPCAIDQ

SEQ ID NO: 2692173 - protein, 21 aa, Entamoeba histolytica
QAAVTLAEWKSMKYKDLLVIC

SEQ ID NO: 2692174 - protein, 18 aa, Entamoeba histolytica
QADEELKQFEASLNTQRD

SEQ ID NO: 2692175 - protein, 32 aa, Entamoeba histolytica
QADPQVVYDLCRWIYMHGIEVEGIFRISGNNE

SEQ ID NO: 2692176 - protein, 33 aa, Entamoeba histolytica
QADPQVVYDLCRWIYMHGIEVEGIFRISGNNEY

SEQ ID NO: 2692177 - protein, 25 aa, Entamoeba histolytica
QAEELACLWGISFIETSAKKKSNIN

SEQ ID NO: 2692178 - protein, 25 aa, Entamoeba histolytica
QAFLNVLQPFVWQHILIPILPLFLS

SEQ ID NO: 2692179 - protein, 17 aa, Entamoeba histolytica
QAFQCFLSINSVNAEIM

SEQ ID NO: 2692180 - protein, 17 aa, Entamoeba histolytica
QAGRTLVALPFLQVVRI

SEQ ID NO: 2692181 - protein, 18 aa, Entamoeba histolytica
QAHAKLMMHQSVTLMDAV

SEQ ID NO: 2692182 - protein, 18 aa, Entamoeba histolytica
QAIDDCVCEFKILERHKK

SEQ ID NO: 2692183 - protein, 21 aa, Entamoeba histolytica
QAIMLPPVIPIGIPVTEFGNL

SEQ ID NO: 2692184 - protein, 26 aa, Entamoeba histolytica
QAIYSFWLYDFCDVYLEASKGIFRGP

SEQ ID NO: 2692185 - protein, 23 aa, Entamoeba histolytica
QAKEGITILRFGTEEEVNTFNKT

SEQ ID NO: 2692186 - protein, 23 aa, Entamoeba histolytica
QAKVFLTQFVLEFQGKFDEVLDT

SEQ ID NO: 2692187 - protein, 18 aa, Entamoeba histolytica
QALAHPFILGTAIEGYKI

SEQ ID NO: 2692188 - protein, 25 aa, Entamoeba histolytica
QALESACIVIGKMFMVIEVHCQPFF

SEQ ID NO: 2692189 - protein, 19 aa, Entamoeba histolytica
QALFHCKLFRDDVIKEKLD

SEQ ID NO: 2692190 - protein, 22 aa, Entamoeba histolytica
QALFVNCLIGLLIAVSKKTIGI

SEQ ID NO: 2692191 - protein, 23 aa, Entamoeba histolytica
QALKASIQFIRTGFVCVEILKLM

SEQ ID NO: 2692192 - protein, 22 aa, Entamoeba histolytica
QALRTALPVIFNVGNINCDGYL

SEQ ID NO: 2692193 - protein, 18 aa, Entamoeba histolytica
QALSFPKEYTSIGTEAYM

SEQ ID NO: 2692194 - protein, 29 aa, Entamoeba histolytica
QAMAAAFCSGCDFIRAEGFVFGHVADEGY

SEQ ID NO: 2692195 - protein, 20 aa, Entamoeba histolytica
QAMRRLFYRFQMVGESQIVG

SEQ ID NO: 2692196 - protein, 22 aa, Entamoeba histolytica
QAPEVWLNGTFPNAASDVYSFA

SEQ ID NO: 2692197 - protein, 18 aa, Entamoeba histolytica
QAPLPKRYGLLLRNYIRH

SEQ ID NO: 2692198 - protein, 23 aa, Entamoeba histolytica
QAQCKALGLWERWDEITKMYSDV

SEQ ID NO: 2692199 - protein, 22 aa, Entamoeba histolytica
QAQKQGFGFVKTARVVANAQIK

SEQ ID NO: 2692200 - protein, 27 aa, Entamoeba histolytica
QARYYYYLGRIQCIHLKYSDAYDSLTT

SEQ ID NO: 2692201 - protein, 23 aa, Entamoeba histolytica
QASHLKGNVLVKFATEAMAEEAI

SEQ ID NO: 2692202 - protein, 25 aa, Entamoeba histolytica
QASKDLKGRVSICGCGVLGNGKDLI

SEQ ID NO: 2692203 - protein, 27 aa, Entamoeba histolytica
QASPCFKELICRVTPVLVDGVSATDPI

SEQ ID NO: 2692204 - protein, 32 aa, Entamoeba histolytica
QATASKKKSGWRFPLPIYRSIEYLKKHGGVET

SEQ ID NO: 2692205 - protein, 26 aa, Entamoeba histolytica
QAYIRSVLPPELWKRIENVAFEPNPA

SEQ ID NO: 2692206 - protein, 21 aa, Entamoeba histolytica
QAYSAYERKIRWLNPKDTEKE

SEQ ID NO: 2692207 - protein, 19 aa, Entamoeba histolytica
QCAKSFLFKIKDENVFSMT

SEQ ID NO: 2692208 - protein, 27 aa, Entamoeba histolytica
QCDGLKLYPCLVIRGTRLYEMWRKGHY

SEQ ID NO: 2692209 - protein, 22 aa, Entamoeba histolytica
QCFSCKMFQVHIKKKTKKFECK

SEQ ID NO: 2692210 - protein, 20 aa, Entamoeba histolytica
QCGLDTIMIENMHDVPYLNS

SEQ ID NO: 2692211 - protein, 17 aa, Entamoeba histolytica
QCGLWELSAPNFISMCS

SEQ ID NO: 2692212 - protein, 21 aa, Entamoeba histolytica
QCGSLKFSEEMVSFDESHIIM

SEQ ID NO: 2692213 - protein, 27 aa, Entamoeba histolytica
QCIMKKLLLQKQMKGIWSCVKEVQSIC

SEQ ID NO: 2692214 - protein, 18 aa, Entamoeba histolytica
QCINPDCTYLHQLVSEKD

SEQ ID NO: 2692215 - protein, 19 aa, Entamoeba histolytica
QCIPFILLQARLSQILEGF

SEQ ID NO: 2692216 - protein, 19 aa, Entamoeba histolytica
QCIRILQAFIDSVAEKGWT

SEQ ID NO: 2692217 - protein, 18 aa, Entamoeba histolytica
QCIRVCPTKVLTSTHMKS

SEQ ID NO: 2692218 - protein, 27 aa, Entamoeba histolytica
QCLDDLKIQYIRPEGTFFIFPKVEASL

SEQ ID NO: 2692219 - protein, 23 aa, Entamoeba histolytica
QCLEPPFQMICYLSNSIFQGKKN

SEQ ID NO: 2692220 - protein, 17 aa, Entamoeba histolytica
QCLIPRIKISIKDAMYC

SEQ ID NO: 2692221 - protein, 17 aa, Entamoeba histolytica
QCMKDAKLRKKDISDVV

SEQ ID NO: 2692222 - protein, 18 aa, Entamoeba histolytica
QCNKEERIIMGYKKEKRV

SEQ ID NO: 2692223 - protein, 22 aa, Entamoeba histolytica
QCNLQHVCFSKFIAPGLKQLTI

SEQ ID NO: 2692224 - protein, 24 aa, Entamoeba histolytica
QCNNQRIIKCYGIASSWYSISSQL

SEQ ID NO: 2692225 - protein, 20 aa, Entamoeba histolytica
QCPKLKGIYLPKSLVLMKTQ

SEQ ID NO: 2692226 - protein, 19 aa, Entamoeba histolytica
QCRTIYQLTFDTHRDQLDP

SEQ ID NO: 2692227 - protein, 19 aa, Entamoeba histolytica
QCRVIGLDMGALIAGAQYR

SEQ ID NO: 2692228 - protein, 27 aa, Entamoeba histolytica
QCSNLKLSSIGYRIKSLIINQVGILTV

SEQ ID NO: 2692229 - protein, 26 aa, Entamoeba histolytica
QCSTPMRVGTLLLKKEVPLDSLENTM

SEQ ID NO: 2692230 - protein, 19 aa, Entamoeba histolytica
QCSTPSFGNLLIAETVCQI

SEQ ID NO: 2692231 - protein, 20 aa, Entamoeba histolytica
QCSVEAYDIFVAFLKMYKNI

SEQ ID NO: 2692232 - protein, 17 aa, Entamoeba histolytica
QCYGRIAPRSSLALKYG

SEQ ID NO: 2692233 - protein, 17 aa, Entamoeba histolytica
QCYLLDCENEMFLWLGN

SEQ ID NO: 2692234 - protein, 18 aa, Entamoeba histolytica
QDDFELLKVIGRGSFGKV

SEQ ID NO: 2692235 - protein, 26 aa, Entamoeba histolytica
QDDWRWSDLLQFKIIILIEGKMYEKA

SEQ ID NO: 2692236 - protein, 24 aa, Entamoeba histolytica
QDELRILTIRFLKNCIAACDINGI

SEQ ID NO: 2692237 - protein, 23 aa, Entamoeba histolytica
QDFDKELALFVCKSHRGEVGESK

SEQ ID NO: 2692238 - protein, 18 aa, Entamoeba histolytica
QDFLHICSVRVFPSNEPS

SEQ ID NO: 2692239 - protein, 23 aa, Entamoeba histolytica
QDFQLPVCIERSINKMACVQLQA

SEQ ID NO: 2692240 - protein, 25 aa, Entamoeba histolytica
QDFSCFALGTTKGFCVYGIEQTRLR

SEQ ID NO: 2692241 - protein, 25 aa, Entamoeba histolytica
QDFSCFALGTTKGFFVYGIEQTRLR

SEQ ID NO: 2692242 - protein, 18 aa, Entamoeba histolytica
QDGKCLGVLLTYCESSNY

SEQ ID NO: 2692243 - protein, 26 aa, Entamoeba histolytica
QDHLKRTPLHIACCCGNSYIIPLLIK

SEQ ID NO: 2692244 - protein, 17 aa, Entamoeba histolytica
QDIGNELGMSLDFAENE

SEQ ID NO: 2692245 - protein, 24 aa, Entamoeba histolytica
QDIGYCQKIGFLIGAIAKYCDESN

SEQ ID NO: 2692246 - protein, 31 aa, Entamoeba histolytica
QDIKITELRGGNGEEALKIKAQIKQIEEEND

SEQ ID NO: 2692247 - protein, 24 aa, Entamoeba histolytica
QDIKKESTIKCRIKSEELNKEKQI

SEQ ID NO: 2692248 - protein, 21 aa, Entamoeba histolytica
QDIKRVWDFILAKPEDKMFLF

SEQ ID NO: 2692249 - protein, 19 aa, Entamoeba histolytica
QDIPRRKKCIINLKKTKNG

SEQ ID NO: 2692250 - protein, 26 aa, Entamoeba histolytica
QDIQNELYESFSLCFSNELSQKQMKY

SEQ ID NO: 2692251 - protein, 22 aa, Entamoeba histolytica
QDIVSILGFRVNRVVVFLNNNV

SEQ ID NO: 2692252 - protein, 28 aa, Entamoeba histolytica
QDKCKLFGISFPCFSKRITNTIFINSSS

SEQ ID NO: 2692253 - protein, 24 aa, Entamoeba histolytica
QDKKYPVWVVLLFESSSVLKKIRI

SEQ ID NO: 2692254 - protein, 31 aa, Entamoeba histolytica; identical to SEQ ID NO: 2500653

SEQ ID NO: 2692255 - protein, 24 aa, Entamoeba histolytica
QDLGKSVVFDEMFFKMQKRLEKEI

SEQ ID NO: 2692256 - protein, 24 aa, Entamoeba histolytica
QDLKCKYLDLYLIHWPIALKVDAS

SEQ ID NO: 2692257 - protein, 17 aa, Entamoeba histolytica
QDLLREKGFIFISKFTD

SEQ ID NO: 2692258 - protein, 26 aa, Entamoeba histolytica
QDLYMKEGDGFILVFSLVSVATFNDL

SEQ ID NO: 2692259 - protein, 17 aa, Entamoeba histolytica
QDPEILVSISLPAEDGD

SEQ ID NO: 2692260 - protein, 17 aa, Entamoeba histolytica
QDRIRDFLNSNNGMTLK

SEQ ID NO: 2692261 - protein, 21 aa, Entamoeba histolytica
QDSLICIPHFAAPEHYLFAGI

SEQ ID NO: 2692262 - protein, 19 aa, Entamoeba histolytica
QDSYIPINIHSTLSTDSFS

SEQ ID NO: 2692263 - protein, 18 aa, Entamoeba histolytica
QDTGTAICHGHKGENVLV

SEQ ID NO: 2692264 - protein, 27 aa, Entamoeba histolytica
QDTLRLLTILFKFGKYYEVEHAISSGI

SEQ ID NO: 2692265 - protein, 25 aa, Entamoeba histolytica
QDTLRLLTILFKYGKYQEVEEAIVE

SEQ ID NO: 2692266 - protein, 23 aa, Entamoeba histolytica
QDTLWYLCSFLYEIQLNEEKTRM

SEQ ID NO: 2692267 - protein, 22 aa, Entamoeba histolytica
QDVFNQFHWKYTVVDEAHRLKN

SEQ ID NO: 2692268 - protein, 19 aa, Entamoeba histolytica
QDVLRLFVHYNKSYFQFIE

SEQ ID NO: 2692269 - protein, 19 aa, Entamoeba histolytica
QDVSALAFLYSKLQQPALR

SEQ ID NO: 2692270 - protein, 23 aa, Entamoeba histolytica
QDYKSDCWYPDIRTSDGGAEVTM

SEQ ID NO: 2692271 - protein, 18 aa, Entamoeba histolytica
QDYLQRLVSLSPRDVDLC

SEQ ID NO: 2692272 - protein, 21 aa, Entamoeba histolytica
QEAINRFALHDSLKYNFLVQQ

SEQ ID NO: 2692273 - protein, 24 aa, Entamoeba histolytica
QEALCIYLLMSHGVKFTLLKPRKT

SEQ ID NO: 2692274 - protein, 23 aa, Entamoeba histolytica
QEANELWKKYFFEQQTQKIKEME

SEQ ID NO: 2692275 - protein, 23 aa, Entamoeba histolytica
QEASISRRKLCPNLINQDIHLSL

SEQ ID NO: 2692276 - protein, 31 aa, Entamoeba histolytica
QEATYFHWILPFPFKRCYVSSSIFESRPNGS

SEQ ID NO: 2692277 - protein, 17 aa, Entamoeba histolytica
QECHEAIQIITTKTNEC

SEQ ID NO: 2692278 - protein, 18 aa, Entamoeba histolytica
QECLVWKYSYATAALELR

SEQ ID NO: 2692279 - protein, 22 aa, Entamoeba histolytica
QECSIKGNILLAEEEYKKFFIK

SEQ ID NO: 2692280 - protein, 17 aa, Entamoeba histolytica
QEDESLMFYGLLENQSE

SEQ ID NO: 2692281 - protein, 24 aa, Entamoeba histolytica
QEDGNTCCIIFYGWKPHLDIDLTE

SEQ ID NO: 2692282 - protein, 26 aa, Entamoeba histolytica
QEDIIKSGVLPLVIPLLAEQDIKTIT

SEQ ID NO: 2692283 - protein, 34 aa, Entamoeba histolytica
QEDLEPKAAMLLDCYDICYLWIGKEVSAIDKKFA

SEQ ID NO: 2692284 - protein, 22 aa, Entamoeba histolytica
QEDLMSFSFTSFDSIMSCRKGL

SEQ ID NO: 2692285 - protein, 17 aa, Entamoeba histolytica
QEDYKWVLLEDSNAQKD

SEQ ID NO: 2692286 - protein, 23 aa, Entamoeba histolytica
QEEELWLRRLNELADEKNTATPE

SEQ ID NO: 2692287 - protein, 23 aa, Entamoeba histolytica
QEEFWIVMEYCCYGSVADMMDIL

SEQ ID NO: 2692288 - protein, 24 aa, Entamoeba histolytica
QEEGWKGTPYYLAKEVVLENKVTF

SEQ ID NO: 2692289 - protein, 22 aa, Entamoeba histolytica
QEELDYKPGIYTQWEAAYKHED

SEQ ID NO: 2692290 - protein, 17 aa, Entamoeba histolytica
QEELLQLPHFILKNKEQ

SEQ ID NO: 2692291 - protein, 17 aa, Entamoeba histolytica
QEELPLYELISPEDTSD

SEQ ID NO: 2692292 - protein, 22 aa, Entamoeba histolytica
QEETKIKFIIKEVTSETPSSSE

SEQ ID NO: 2692293 - protein, 27 aa, Entamoeba histolytica
QEEVEGMPKYLWKQGVEDTVEIIEDKK

SEQ ID NO: 2692294 - protein, 23 aa, Entamoeba histolytica
QEFPIESVLLVWDCILVDPTGDF

SEQ ID NO: 2692295 - protein, 24 aa, Entamoeba histolytica
QEFVKEYFKFAGINDENIPIDMKV

SEQ ID NO: 2692296 - protein, 27 aa, Entamoeba histolytica
QEGIQGPYERYGMPIGTTGKRGDLYLI

SEQ ID NO: 2692297 - protein, 26 aa, Entamoeba histolytica
QEGKIKARWLRKNARRIDMENYTKEN

SEQ ID NO: 2692298 - protein, 23 aa, Entamoeba histolytica
QEGSGIPSFFNGLLGKSTSKKGS

SEQ ID NO: 2692299 - protein, 24 aa, Entamoeba histolytica
QEGYRARSAFKLIDVERDFHIFDG

SEQ ID NO: 2692300 - protein, 17 aa, Entamoeba histolytica
QEIARMALWKHEFLIQI

SEQ ID NO: 2692301 - protein, 31 aa, Entamoeba histolytica
QEICKEIVWTPSMRRLFCLIIECMKHKEPAL

SEQ ID NO: 2692302 - protein, 18 aa, Entamoeba histolytica
QEICYLRQIAYKIVSEEK

SEQ ID NO: 2692303 - protein, 21 aa, Entamoeba histolytica
QEIDSGFTLTANEIIERVKER

SEQ ID NO: 2692304 - protein, 24 aa, Entamoeba histolytica
QEIEFKVVQGIYWKGTKVGLFKEK

SEQ ID NO: 2692305 - protein, 17 aa, Entamoeba histolytica
QEIIKLKLKQYFHNILM

SEQ ID NO: 2692306 - protein, 24 aa, Entamoeba histolytica
QEIKEALCKYVIEPEYVVVYQNVM

SEQ ID NO: 2692307 - protein, 21 aa, Entamoeba histolytica
QEIKKIIPFGLIGKTEKQMTV

SEQ ID NO: 2692308 - protein, 22 aa, Entamoeba histolytica
QEIKKLPIDFERSTKVDTVVAA

SEQ ID NO: 2692309 - protein, 17 aa, Entamoeba histolytica
QEIKQIYIPLAEKQRPK

SEQ ID NO: 2692310 - protein, 25 aa, Entamoeba histolytica
QEIKRHFEEEFIKRQPMIDKAFTEK

SEQ ID NO: 2692311 - protein, 22 aa, Entamoeba histolytica
QEIKSCILSVINQWIRHYIADF

SEQ ID NO: 2692312 - protein, 17 aa, Entamoeba histolytica
QEIKSHPWFEGINWNTL

SEQ ID NO: 2692313 - protein, 18 aa, Entamoeba histolytica
QEIKTERKHLQPIHDKSL

SEQ ID NO: 2692314 - protein, 20 aa, Entamoeba histolytica
QEILGKMILIGFTHLLNLNQ

SEQ ID NO: 2692315 - protein, 22 aa, Entamoeba histolytica
QEILLKIPMIIQCGGDYFNQWI

SEQ ID NO: 2692316 - protein, 20 aa, Entamoeba histolytica
QEILSNLSLLVIFLISLQEK

SEQ ID NO: 2692317 - protein, 22 aa, Entamoeba histolytica
QEIMERVLFLWALRHPASGYVQ

SEQ ID NO: 2692318 - protein, 24 aa, Entamoeba histolytica
QEINLRLPLKDLLVFFESALIQTE

SEQ ID NO: 2692319 - protein, 25 aa, Entamoeba histolytica
QEINNLRIPFGFYKRTLPHYWKEDY

SEQ ID NO: 2692320 - protein, 21 aa, Entamoeba histolytica
QEIQWRNELDNVKRRLAAEER

SEQ ID NO: 2692321 - protein, 22 aa, Entamoeba histolytica
QEIRCYCNILMRALYSEVKEDE

SEQ ID NO: 2692322 - protein, 17 aa, Entamoeba histolytica
QEIRNTFFASIESVQSY

SEQ ID NO: 2692323 - protein, 17 aa, Entamoeba histolytica
QEISCLTLFESGCFLFK

SEQ ID NO: 2692324 - protein, 25 aa, Entamoeba histolytica
QEISTEMMNWLGLRNDQLGDIVPTF

SEQ ID NO: 2692325 - protein, 19 aa, Entamoeba histolytica
QEITDLIWLIENVSLNNIN

SEQ ID NO: 2692326 - protein, 21 aa, Entamoeba histolytica
QEKEIKRREEAQIILEEFNRK

SEQ ID NO: 2692327 - protein, 27 aa, Entamoeba histolytica
QEKGRLIPRFFSYCTSVAISRGINEEG

SEQ ID NO: 2692328 - protein, 19 aa, Entamoeba histolytica
QEKIIKEKVTILEEELEQI

SEQ ID NO: 2692329 - protein, 26 aa, Entamoeba histolytica
QEKLTVDMVNEWACEKGTSQRKNIRS

SEQ ID NO: 2692330 - protein, 22 aa, Entamoeba histolytica
QEKRDFERGIKIEELQQFLPLE

SEQ ID NO: 2692331 - protein, 18 aa, Entamoeba histolytica
QEKTCIVLPEYCVQHLIH

SEQ ID NO: 2692332 - protein, 21 aa, Entamoeba histolytica
QELADKLGIPFLETSAASNSN

SEQ ID NO: 2692333 - protein, 25 aa, Entamoeba histolytica
QELAKLRGLMFYEEIKARRQNKIKS

SEQ ID NO: 2692334 - protein, 17 aa, Entamoeba histolytica
QELCNLYPIDTLVMDTS

SEQ ID NO: 2692335 - protein, 18 aa, Entamoeba histolytica
QELENMIGYIDCIQSFAT

SEQ ID NO: 2692336 - protein, 19 aa, Entamoeba histolytica
QELENMIGYIDCIQSFATV

SEQ ID NO: 2692337 - protein, 24 aa, Entamoeba histolytica
QELKYPLNDLIPFFSKSLEQITLD

SEQ ID NO: 2692338 - protein, 17 aa, Entamoeba histolytica
QELLCKYFYSIQSISVY

SEQ ID NO: 2692339 - protein, 22 aa, Entamoeba histolytica
QELQIWKSETINTYLKNVFGKS

SEQ ID NO: 2692340 - protein, 24 aa, Entamoeba histolytica
QELYNCVYIALPYELHNPVIRMFP

SEQ ID NO: 2692341 - protein, 23 aa, Entamoeba histolytica
QEMPLCLELSKLLMLDDPQILKD

SEQ ID NO: 2692342 - protein, 21 aa, Entamoeba histolytica
QENMGLGIADFFSLVESASDG

SEQ ID NO: 2692343 - protein, 18 aa, Entamoeba histolytica
QENMGVIVGFVIENIIRE

SEQ ID NO: 2692344 - protein, 21 aa, Entamoeba histolytica
QENSIEFFAECEKFIDENTPK

SEQ ID NO: 2692345 - protein, 26 aa, Entamoeba histolytica
QENSWIIKPCHGFEEIYTCLNNMMLE

SEQ ID NO: 2692346 - protein, 20 aa, Entamoeba histolytica
QEPIELCSQPTGKLQNSVNG

SEQ ID NO: 2692347 - protein, 25 aa, Entamoeba histolytica
QEQFKRLGIPSNLIIPLYHKLVEQT

SEQ ID NO: 2692348 - protein, 18 aa, Entamoeba histolytica
QERFRSMVSSYYRDVNGI

SEQ ID NO: 2692349 - protein, 19 aa, Entamoeba histolytica
QERIQLHLDRKIKIKERQD

SEQ ID NO: 2692350 - protein, 21 aa, Entamoeba histolytica
QERKQFYAGQLVQFIGKGKRQ

SEQ ID NO: 2692351 - protein, 17 aa, Entamoeba histolytica
QERVITIEMVWEDVIKI

SEQ ID NO: 2692352 - protein, 17 aa, Entamoeba histolytica
QERYCFKLPSNDKPFQI

SEQ ID NO: 2692353 - protein, 19 aa, Entamoeba histolytica
QESFEQLEYLKGIIATKLF

SEQ ID NO: 2692354 - protein, 21 aa, Entamoeba histolytica
QESGAVFAICSNLIYNINDKE

SEQ ID NO: 2692355 - protein, 21 aa, Entamoeba histolytica
QESIKPFFLRRMKNEVEKSIP

SEQ ID NO: 2692356 - protein, 22 aa, Entamoeba histolytica
QESLYIPHIIDIKEGMSEEEKL

SEQ ID NO: 2692357 - protein, 24 aa, Entamoeba histolytica
QESPFKSIVPFALRGPLQRYQRES

SEQ ID NO: 2692358 - protein, 17 aa, Entamoeba histolytica
QESQCPPMQGFPQQPPM

SEQ ID NO: 2692359 - protein, 20 aa, Entamoeba histolytica
QESRIGIQIQREVDIQSQLN

SEQ ID NO: 2692360 - protein, 21 aa, Entamoeba histolytica
QETAAVVMARCASFKADAETG

SEQ ID NO: 2692361 - protein, 22 aa, Entamoeba histolytica
QETECCIKLLIQRHMIDAQSIP

SEQ ID NO: 2692362 - protein, 19 aa, Entamoeba histolytica
QETFLTIMLEYGQEVDSTE

SEQ ID NO: 2692363 - protein, 24 aa, Entamoeba histolytica
QETKVESFFDLFYPQELALNNDIN

SEQ ID NO: 2692364 - protein, 22 aa, Entamoeba histolytica
QETPCQMLFTFRFNTAEICKQF

SEQ ID NO: 2692365 - protein, 19 aa, Entamoeba histolytica
QETRFIFKVGDNLMQDMLT

SEQ ID NO: 2692366 - protein, 22 aa, Entamoeba histolytica
QETSDISLEFSITEEDVDEEVF

SEQ ID NO: 2692367 - protein, 17 aa, Entamoeba histolytica
QEVCNSCGCDFVQTEAV

SEQ ID NO: 2692368 - protein, 23 aa, Entamoeba histolytica
QEVKRMGIKYEEEMSIEENEIPF

SEQ ID NO: 2692369 - protein, 23 aa, Entamoeba histolytica
QEVKTMLDVIKFSSQFLPTTEIS

SEQ ID NO: 2692370 - protein, 32 aa, Entamoeba histolytica
QEVLKVCDGMRRMGYAKGNLEAIIQIITHLDQ

SEQ ID NO: 2692371 - protein, 24 aa, Entamoeba histolytica
QEVNEFQRNICKPIIETPEYFEQL

SEQ ID NO: 2692372 - protein, 19 aa, Entamoeba histolytica
QEVVFKRLVTFKHQSQKDL

SEQ ID NO: 2692373 - protein, 22 aa, Entamoeba histolytica
QEWLWCESWCNQKVKSKAKTID

SEQ ID NO: 2692374 - protein, 23 aa, Entamoeba histolytica
QEYKEKWIGKDYKLPGIAGNDSS

SEQ ID NO: 2692375 - protein, 25 aa, Entamoeba histolytica
QEYNGMKIWCFNAGHILGAAMFCIE

SEQ ID NO: 2692376 - protein, 17 aa, Entamoeba histolytica
QEYWAKKIVESDEKEKE

SEQ ID NO: 2692377 - protein, 20 aa, Entamoeba histolytica
QEYWECTLKALKFGENQGPQ

SEQ ID NO: 2692378 - protein, 27 aa, Entamoeba histolytica
QEYWELWNCKSTCAIQLIQTISPQQIV

SEQ ID NO: 2692379 - protein, 19 aa, Entamoeba histolytica
QFAEVINRIAGATNNIQYA

SEQ ID NO: 2692380 - protein, 24 aa, Entamoeba histolytica
QFANDEFHYFQGLVEFNEIYVKAL

SEQ ID NO: 2692381 - protein, 20 aa, Entamoeba histolytica
QFAQSSCKVVEPPHTLNKLP

SEQ ID NO: 2692382 - protein, 19 aa, Entamoeba histolytica
QFCEYCIIGNKTLDRLFSL

SEQ ID NO: 2692383 - protein, 21 aa, Entamoeba histolytica
QFDKNGICNISIFDDNTYIVV

SEQ ID NO: 2692384 - protein, 18 aa, Entamoeba histolytica
QFEFRKMNKLYAYRTNVA

SEQ ID NO: 2692385 - protein, 21 aa, Entamoeba histolytica
QFEKEKEIIIAHVGKNNQNDI

SEQ ID NO: 2692386 - protein, 19 aa, Entamoeba histolytica
QFEKLRYQLEINKYNIPEV

SEQ ID NO: 2692387 - protein, 19 aa, Entamoeba histolytica
QFELCLKLKILKDQNETLS

SEQ ID NO: 2692388 - protein, 23 aa, Entamoeba histolytica
QFFPVLFEKIIFRQIMVTPNELE

SEQ ID NO: 2692389 - protein, 18 aa, Entamoeba histolytica
QFFSHFHGIIQIEAISQF

SEQ ID NO: 2692390 - protein, 24 aa, Entamoeba histolytica
QFHDLKELFSIGGTPPQTHYIFLG

SEQ ID NO: 2692391 - protein, 29 aa, Entamoeba histolytica
QFHPCKHVLCLSCLILNLNESIKDKKIMK

SEQ ID NO: 2692392 - protein, 18 aa, Entamoeba histolytica
QFHSFAINDFISFENFKT

SEQ ID NO: 2692393 - protein, 24 aa, Entamoeba histolytica
QFICLKDLIIVSSSFKNIQIPKTL

SEQ ID NO: 2692394 - protein, 18 aa, Entamoeba histolytica
QFIELCREQPQIIESFIQ

SEQ ID NO: 2692395 - protein, 22 aa, Entamoeba histolytica
QFIFLKEFIDYNVQYIEEQSHK

SEQ ID NO: 2692396 - protein, 18 aa, Entamoeba histolytica
QFIFPSSFICLLSESDKK

SEQ ID NO: 2692397 - protein, 27 aa, Entamoeba histolytica
QFIGKGLCCLNQLKHLEIIGISDNKVD

SEQ ID NO: 2692398 - protein, 21 aa, Entamoeba histolytica
QFIIPCLNSFILEKDLEKENN

SEQ ID NO: 2692399 - protein, 18 aa, Entamoeba histolytica
QFIPFELTTDVVFATQSR

SEQ ID NO: 2692400 - protein, 18 aa, Entamoeba histolytica
QFIPTNICFIKLFHMNST

SEQ ID NO: 2692401 - protein, 18 aa, Entamoeba histolytica
QFIRPPVIIKVRTFTSNK

SEQ ID NO: 2692402 - protein, 17 aa, Entamoeba histolytica
QFKKCAYTLGVMNKIIE

SEQ ID NO: 2692403 - protein, 21 aa, Entamoeba histolytica
QFKMFSASVLFVYDSASKFED

SEQ ID NO: 2692404 - protein, 24 aa, Entamoeba histolytica
QFKSHCSQLLTAARVSMEDQSPLL

SEQ ID NO: 2692405 - protein, 25 aa, Entamoeba histolytica
QFKSNLPNTKWVFQREKGMSFLVND

SEQ ID NO: 2692406 - protein, 17 aa, Entamoeba histolytica
QFKSVFESVTIYKPESS

SEQ ID NO: 2692407 - protein, 26 aa, Entamoeba histolytica
QFLFCTICSIIPFPSIQSIFDKSYGT

SEQ ID NO: 2692408 - protein, 29 aa, Entamoeba histolytica
QFLHLFAMKKDKCFPIGDRLLDQPIELAK

SEQ ID NO: 2692409 - protein, 26 aa, Entamoeba histolytica
QFLIPKRFDCLVALNISATSIATNCI

SEQ ID NO: 2692410 - protein, 23 aa, Entamoeba histolytica
QFLPSEWPITIINLKNKVTTELQ

SEQ ID NO: 2692411 - protein, 18 aa, Entamoeba histolytica
QFMAEYNGLICFEFNGQI

SEQ ID NO: 2692412 - protein, 28 aa, Entamoeba histolytica
QFMKKCHGYWPELFCCQDGVVLTEGILK

SEQ ID NO: 2692413 - protein, 17 aa, Entamoeba histolytica
QFMQLIIQSLNVHDYLL

SEQ ID NO: 2692414 - protein, 18 aa, Entamoeba histolytica
QFNHVFIIVSPVVIKGVP

SEQ ID NO: 2692415 - protein, 27 aa, Entamoeba histolytica
QFNKGIPVFWFQVLKNSMLFDSANGSE

SEQ ID NO: 2692416 - protein, 22 aa, Entamoeba histolytica
QFQNGRFDGIINFGDDKLAIKV

SEQ ID NO: 2692417 - protein, 24 aa, Entamoeba histolytica
QFREKITRMCYVFAKDHTDKNYQQ

SEQ ID NO: 2692418 - protein, 24 aa, Entamoeba histolytica
QFRGTKYIDVREFYERDGELKPGQ

SEQ ID NO: 2692419 - protein, 33 aa, Entamoeba histolytica
QFSFIRMTSGYSFEEFFRLYSLLMSMSSSSSSE

SEQ ID NO: 2692420 - protein, 23 aa, Entamoeba histolytica
QFSIKIPVIEIWKHEMKIQSSIT

SEQ ID NO: 2692421 - protein, 21 aa, Entamoeba histolytica
QFTAISFDFVRTCLLHKREIE

SEQ ID NO: 2692422 - protein, 30 aa, Entamoeba histolytica
QFTIAQDPWIEWGKILNLRCMENQKNENDC

SEQ ID NO: 2692423 - protein, 37 aa, Entamoeba histolytica
QFTYMEASIFYKLEPSEFFGQAWAKAKLRHKAPNIIA

SEQ ID NO: 2692424 - protein, 27 aa, Entamoeba histolytica
QFVALKCGCVISKLALDEIKSINGNKC

SEQ ID NO: 2692425 - protein, 24 aa, Entamoeba histolytica
QFYTKGRGSLRLEKCKFDCNSQIL

SEQ ID NO: 2692426 - protein, 17 aa, Entamoeba histolytica
QGCKVVSMDFFIDIQHR

SEQ ID NO: 2692427 - protein, 21 aa, Entamoeba histolytica
QGCLGDCYFLAALASLSEFPE

SEQ ID NO: 2692428 - protein, 23 aa, Entamoeba histolytica
QGDKTLINWFKIRGIGNLIKELM

SEQ ID NO: 2692429 - protein, 18 aa, Entamoeba histolytica
QGEKEIREKTGIEAEIVK

SEQ ID NO: 2692430 - protein, 23 aa, Entamoeba histolytica
QGEKICIDRILKIDNDVIHNNFL

SEQ ID NO: 2692431 - protein, 17 aa, Entamoeba histolytica
QGEMVFKEKASVFYEGP

SEQ ID NO: 2692432 - protein, 22 aa, Entamoeba histolytica
QGEPLEIMGILIGQTKGDSFVI

SEQ ID NO: 2692433 - protein, 23 aa, Entamoeba histolytica
QGFHCVYSGMVLSYYLPIHCGIK

SEQ ID NO: 2692434 - protein, 18 aa, Entamoeba histolytica
QGGKSLFITFKLVLLQTS

SEQ ID NO: 2692435 - protein, 21 aa, Entamoeba histolytica
QGGKWSFLFECPRDYPNNPPK

SEQ ID NO: 2692436 - protein, 30 aa, Entamoeba histolytica
QGGSWKSWKKRWCVLTPTGMIFYFKDKKDV

SEQ ID NO: 2692437 - protein, 31 aa, Entamoeba histolytica; identical to SEQ ID NO: 2500829

SEQ ID NO: 2692438 - protein, 31 aa, Entamoeba histolytica
QGGSWKSWKRRWFVIKDRKMWYFAGKNDTEA

SEQ ID NO: 2692439 - protein, 23 aa, Entamoeba histolytica
QGGTCAIPGAFGCGKTVISQALS

SEQ ID NO: 2692440 - protein, 24 aa, Entamoeba histolytica
QGHSFEILDAVAFSKEVLPKYYKH

SEQ ID NO: 2692441 - protein, 24 aa, Entamoeba histolytica
QGHVYSLRDDFSWIEESVKKWESK

SEQ ID NO: 2692442 - protein, 23 aa, Entamoeba histolytica
QGIGFLFHCLSPLFDEIEKKKIK

SEQ ID NO: 2692443 - protein, 18 aa, Entamoeba histolytica
QGIGSVFQKLAHFLKTYC

SEQ ID NO: 2692444 - protein, 21 aa, Entamoeba histolytica
QGIKEKPCWITQHFKNQLNII

SEQ ID NO: 2692445 - protein, 19 aa, Entamoeba histolytica
QGILCDLLWSDPHDLPVDG

SEQ ID NO: 2692446 - protein, 19 aa, Entamoeba histolytica
QGIPKAVVPFVRKENIVCT

SEQ ID NO: 2692447 - protein, 18 aa, Entamoeba histolytica
QGIPYRWNDNDLQFYFQQ

SEQ ID NO: 2692448 - protein, 25 aa, Entamoeba histolytica
QGIRGWGCNIFPTLVSSKAKENEDR

SEQ ID NO: 2692449 - protein, 23 aa, Entamoeba histolytica
QGKKNLFFKTGFDNKKLYYYKDL

SEQ ID NO: 2692450 - protein, 21 aa, Entamoeba histolytica
QGLADLFGFYVLVFSTDEEAF

SEQ ID NO: 2692451 - protein, 39 aa, Entamoeba histolytica
QGLFFKPKEDWFFYAFSKFYFEAALKFSDKFPTLVNKDK

SEQ ID NO: 2692452 - protein, 32 aa, Entamoeba histolytica
QGLIWKKLKTLKCIKCKVNVIGAGIFEKKLFP

SEQ ID NO: 2692453 - protein, 20 aa, Entamoeba histolytica
QGLMHGWSYQSLIKETQKMN

SEQ ID NO: 2692454 - protein, 24 aa, Entamoeba histolytica
QGLPPEFEKFLSISRSLKFEEEPD

SEQ ID NO: 2692455 - protein, 22 aa, Entamoeba histolytica
QGLVPLLRLAWNHFDPNFIATF

SEQ ID NO: 2692456 - protein, 23 aa, Entamoeba histolytica
QGNCGSCYTFGSIAALEGRLLIE

SEQ ID NO: 2692457 - protein, 34 aa, Entamoeba histolytica
QGNKKIYGALCLFKKRKQLFISYLPMEVRTNTSL

SEQ ID NO: 2692458 - protein, 18 aa, Entamoeba histolytica
QGNVGLLIVNSKLFKNIL

SEQ ID NO: 2692459 - protein, 17 aa, Entamoeba histolytica
QGPDALVEWIRNQKEVL

SEQ ID NO: 2692460 - protein, 20 aa, Entamoeba histolytica
QGQVSDLWLQLSKKGQIHIQ

SEQ ID NO: 2692461 - protein, 35 aa, Entamoeba histolytica
QGRCKGKEGIFPRNHVQEFLKVFQFVCCSDYHAKN

SEQ ID NO: 2692462 - protein, 18 aa, Entamoeba histolytica
QGRVILKSNGLFINGNES

SEQ ID NO: 2692463 - protein, 18 aa, Entamoeba histolytica
QGSLFIYLFRLMLATGIP

SEQ ID NO: 2692464 - protein, 17 aa, Entamoeba histolytica
QGSRLGFEHPKGMFVLP

SEQ ID NO: 2692465 - protein, 23 aa, Entamoeba histolytica
QGTEEFFVFSLYNNKGFNPIKIE

SEQ ID NO: 2692466 - protein, 24 aa, Entamoeba histolytica
QGTSFPFYYCKNLKELIEQFEFEE

SEQ ID NO: 2692467 - protein, 30 aa, Entamoeba histolytica; identical to SEQ ID NO: 2500857

SEQ ID NO: 2692468 - protein, 26 aa, Entamoeba histolytica
QGVIYIWNFINEFKKEIEIEDSSFKS

SEQ ID NO: 2692469 - protein, 24 aa, Entamoeba histolytica
QHAFDSCIPILISILNKNTRGNGF

SEQ ID NO: 2692470 - protein, 17 aa, Entamoeba histolytica
QHFAERGNGIFIQSDGK

SEQ ID NO: 2692471 - protein, 17 aa, Entamoeba histolytica
QHFGYDFNYSKYGISVG

SEQ ID NO: 2692472 - protein, 19 aa, Entamoeba histolytica
QHLEKCIEAKIVKGYSEYH

SEQ ID NO: 2692473 - protein, 20 aa, Entamoeba histolytica
QHLEYLWSLVKGMNSERTTI

SEQ ID NO: 2692474 - protein, 23 aa, Entamoeba histolytica
QHLIKISKYLTGRVDLKEMGIKA

SEQ ID NO: 2692475 - protein, 18 aa, Entamoeba histolytica
QHLKEGGIIIIKENVGTD

SEQ ID NO: 2692476 - protein, 23 aa, Entamoeba histolytica
QHLQCKKCSTIIPEQKITQKHHC

SEQ ID NO: 2692477 - protein, 22 aa, Entamoeba histolytica
QHLTKLIIMNSLHCEQYNFYQF

SEQ ID NO: 2692478 - protein, 17 aa, Entamoeba histolytica
QHPCALMMSELSKSQDI

SEQ ID NO: 2692479 - protein, 21 aa, Entamoeba histolytica
QHPFFKGFNWDTIFEQTPPYL

SEQ ID NO: 2692480 - protein, 18 aa, Entamoeba histolytica
QHPFSIIKFIESHFTSKD

SEQ ID NO: 2692481 - protein, 18 aa, Entamoeba histolytica
QHPFYPLTMEFSTIPSNE

SEQ ID NO: 2692482 - protein, 25 aa, Entamoeba histolytica
QHPYRSIPFVKNFFASPPFLNSMFS

SEQ ID NO: 2692483 - protein, 23 aa, Entamoeba histolytica
QHQLQKEEECLIKEEENNQKLKM

SEQ ID NO: 2692484 - protein, 23 aa, Entamoeba histolytica
QHSKFTFIWIKDLFTYLDKKPFS

SEQ ID NO: 2692485 - protein, 24 aa, Entamoeba histolytica
QHSRICLCLDLPGGPFYSAPFILQ

SEQ ID NO: 2692486 - protein, 17 aa, Entamoeba histolytica
QHTDFGIELGVSSKGDS

SEQ ID NO: 2692487 - protein, 22 aa, Entamoeba histolytica
QHTKGVRCVEVWDKENMVSASF

SEQ ID NO: 2692488 - protein, 23 aa, Entamoeba histolytica
QHTKGVRCVEVWDKENMVSASFD

SEQ ID NO: 2692489 - protein, 24 aa, Entamoeba histolytica
QHTLRLPQMYNLCNYYIGFNAWST

SEQ ID NO: 2692490 - protein, 18 aa, Entamoeba histolytica
QHVFHFTPLLSKERCRTD

SEQ ID NO: 2692491 - protein, 27 aa, Entamoeba histolytica
QHVRGLKCLGIANSVEFFDICRIKDAL

SEQ ID NO: 2692492 - protein, 22 aa, Entamoeba histolytica
QHYHILVEFGLKLVVDSIECIS

SEQ ID NO: 2692493 - protein, 19 aa, Entamoeba histolytica
QHYLNCTLPYYCLPNPFKR

SEQ ID NO: 2692494 - protein, 24 aa, Entamoeba histolytica
QIAKFYTWINKWEKVIPDRRAVLL

SEQ ID NO: 2692495 - protein, 24 aa, Entamoeba histolytica
QIALKGEEGINCLLQTNQVSIEPK

SEQ ID NO: 2692496 - protein, 18 aa, Entamoeba histolytica
QICKNLSNEYLLSKESEQ

SEQ ID NO: 2692497 - protein, 19 aa, Entamoeba histolytica
QICVGSFFQRCVPIFNSLP

SEQ ID NO: 2692498 - protein, 32 aa, Entamoeba histolytica
QIDCKGDVLACSWCPDIHGMLAVGGEFGLKFF

SEQ ID NO: 2692499 - protein, 25 aa, Entamoeba histolytica
QIDELKLKLEIQRQSIDKLRMNTAA

SEQ ID NO: 2692500 - protein, 26 aa, Entamoeba histolytica
QIDGDDICFCLSRTHSFIQPKHVGTE

SEQ ID NO: 2692501 - protein, 23 aa, Entamoeba histolytica
QIDITANILLKWITYLKSEGIIL

SEQ ID NO: 2692502 - protein, 23 aa, Entamoeba histolytica
QIDREKVQLVSWLNKELLTDKKI

SEQ ID NO: 2692503 - protein, 17 aa, Entamoeba histolytica
QIDSIVAKGRFHLFTAK

SEQ ID NO: 2692504 - protein, 21 aa, Entamoeba histolytica
QIDVLARFKIRGMNFNHNPPI

SEQ ID NO: 2692505 - protein, 24 aa, Entamoeba histolytica
QIEAFVLKFPLIVKGISLEEREKI

SEQ ID NO: 2692506 - protein, 23 aa, Entamoeba histolytica
QIECLKAGIDIRNKYVTISNDDN

SEQ ID NO: 2692507 - protein, 18 aa, Entamoeba histolytica
QIEGIRISLNNGLAKMNE

SEQ ID NO: 2692508 - protein, 17 aa, Entamoeba histolytica
QIEGIRISLNSQLAKMN

SEQ ID NO: 2692509 - protein, 19 aa, Entamoeba histolytica
QIEGLRISLNNGLLKLDEI

SEQ ID NO: 2692510 - protein, 25 aa, Entamoeba histolytica
QIEISRIQYYLTLYSKTRLRKIHQM

SEQ ID NO: 2692511 - protein, 26 aa, Entamoeba histolytica
QIELYSHLPVMSRFVDFMKRENYFMC

SEQ ID NO: 2692512 - protein, 24 aa, Entamoeba histolytica
QIENRGIAFITFYDIRDAIKAHEE

SEQ ID NO: 2692513 - protein, 18 aa, Entamoeba histolytica
QIERCTTETYQLMKKIIP

SEQ ID NO: 2692514 - protein, 18 aa, Entamoeba histolytica
QIESLNCNTWFMSPPCQP

SEQ ID NO: 2692515 - protein, 19 aa, Entamoeba histolytica
QIETPILHYIYDTKMLKST

SEQ ID NO: 2692516 - protein, 22 aa, Entamoeba histolytica
QIFGFKGAIDILLNDSEGEIIV

SEQ ID NO: 2692517 - protein, 24 aa, Entamoeba histolytica
QIFKLACDHFCHPKVVLKDVPTND

SEQ ID NO: 2692518 - protein, 25 aa, Entamoeba histolytica
QIGFEMWYFLSVIILDRNFVQETYL

SEQ ID NO: 2692519 - protein, 17 aa, Entamoeba histolytica
QIGLIIYVANLHFDITE

SEQ ID NO: 2692520 - protein, 25 aa, Entamoeba histolytica
QIGPKINIIPGFWYTVLHNAGLFDY

SEQ ID NO: 2692521 - protein, 19 aa, Entamoeba histolytica
QIGVIFDKSIRIINIADKS

SEQ ID NO: 2692522 - protein, 17 aa, Entamoeba histolytica
QIHFGGHHWALYGNEKI

SEQ ID NO: 2692523 - protein, 33 aa, Entamoeba histolytica
QIHQCLPKDFSPVCGFMGMILMDQRPELKINDL

SEQ ID NO: 2692524 - protein, 26 aa, Entamoeba histolytica
QIHSYPQCLCDLTSIVDLDVSNNLMV

SEQ ID NO: 2692525 - protein, 18 aa, Entamoeba histolytica
QIIARPIPTISFQILDMR

SEQ ID NO: 2692526 - protein, 24 aa, Entamoeba histolytica
QIIFKCISFNLKIIQELSLQPNIL

SEQ ID NO: 2692527 - protein, 29 aa, Entamoeba histolytica
QIIGCVIPSIQISLFLQPECPWKQLKKLA

SEQ ID NO: 2692528 - protein, 19 aa, Entamoeba histolytica
QIIKACFAMTCVKETDREI

SEQ ID NO: 2692529 - protein, 19 aa, Entamoeba histolytica
QIIKEIKFENVIDASTKTV

SEQ ID NO: 2692530 - protein, 17 aa, Entamoeba histolytica
QIIKLLNEYSFKHRIII

SEQ ID NO: 2692531 - protein, 22 aa, Entamoeba histolytica
QIIRYKILDSLKCNCKEVNEII

SEQ ID NO: 2692532 - protein, 17 aa, Entamoeba histolytica
QIIWYKVNYSRYLLEKE

SEQ ID NO: 2692533 - protein, 21 aa, Entamoeba histolytica
QIKCCSMINSLVFLEYNYPNL

SEQ ID NO: 2692534 - protein, 17 aa, Entamoeba histolytica
QIKEAFETKVFDLNAIC

SEQ ID NO: 2692535 - protein, 25 aa, Entamoeba histolytica
QIKELKLKRIIGNKSGQLQIDETRK

SEQ ID NO: 2692536 - protein, 23 aa, Entamoeba histolytica
QIKNCILSIPFEEGGGCNMYIEG

SEQ ID NO: 2692537 - protein, 21 aa, Entamoeba histolytica
QIKRRSGIISVMQTSSQQNIP

SEQ ID NO: 2692538 - protein, 24 aa, Entamoeba histolytica
QIKYFWEIAKSLTLEQKKKLLIFV

SEQ ID NO: 2692539 - protein, 17 aa, Entamoeba histolytica
QILDISANVIAPKIAIL

SEQ ID NO: 2692540 - protein, 23 aa, Entamoeba histolytica
QILFVERFIKTWAICFRADGKKG

SEQ ID NO: 2692541 - protein, 25 aa, Entamoeba histolytica
QILHCAEILPTQAFTPIDTLKQTAI

SEQ ID NO: 2692542 - protein, 18 aa, Entamoeba histolytica
QILIPIIGNFGVGKTSLL

SEQ ID NO: 2692543 - protein, 23 aa, Entamoeba histolytica
QILKETQYMFSIPQVCDVFKGFE

SEQ ID NO: 2692544 - protein, 17 aa, Entamoeba histolytica
QILNCFYNGCATCKKKI

SEQ ID NO: 2692545 - protein, 19 aa, Entamoeba histolytica
QILPGNVFKCKKRMDGKKC

SEQ ID NO: 2692546 - protein, 17 aa, Entamoeba histolytica
QILRALRTLSHANIVHC

SEQ ID NO: 2692547 - protein, 25 aa, Entamoeba histolytica
QILSALKYIHKWQICHRDVKLENIL

SEQ ID NO: 2692548 - protein, 17 aa, Entamoeba histolytica
QILSRSEMAFIELKAKH

SEQ ID NO: 2692549 - protein, 18 aa, Entamoeba histolytica
QILVEYEELFGLNSDDAD

SEQ ID NO: 2692550 - protein, 26 aa, Entamoeba histolytica
QILYQRMMYQYPYYYYPYCYYPQPYN

SEQ ID NO: 2692551 - protein, 21 aa, Entamoeba histolytica
QIMCPECLMNGNINCLTEREI

SEQ ID NO: 2692552 - protein, 19 aa, Entamoeba histolytica
QINCRGSVELDEKEEYDKY

SEQ ID NO: 2692553 - protein, 23 aa, Entamoeba histolytica
QINEVFSGIGLELHKLKCVLVQS

SEQ ID NO: 2692554 - protein, 18 aa, Entamoeba histolytica
QINKFSVFEQMNFNEPDS

SEQ ID NO: 2692555 - protein, 19 aa, Entamoeba histolytica
QINLFKLKLEEFLQNNRYE

SEQ ID NO: 2692556 - protein, 20 aa, Entamoeba histolytica
QINVCLLLLIFSFYENSHER

SEQ ID NO: 2692557 - protein, 23 aa, Entamoeba histolytica
QIPCGGMVCDLLWSDPGSMFGWK

SEQ ID NO: 2692558 - protein, 25 aa, Entamoeba histolytica
QIPCYIPQYVNLQFKSLLKYIESNG

SEQ ID NO: 2692559 - protein, 20 aa, Entamoeba histolytica
QIPKEKKDGFVYVKNDENHF

SEQ ID NO: 2692560 - protein, 23 aa, Entamoeba histolytica
QIPLKCFSYCFGLSTFVNLGNLI

SEQ ID NO: 2692561 - protein, 24 aa, Entamoeba histolytica
QIPNGICSGCFHLTSVIMDDVVEC

SEQ ID NO: 2692562 - protein, 26 aa, Entamoeba histolytica
QIPVIHLLFPIALKYSLIQSSPKSIQ

SEQ ID NO: 2692563 - protein, 24 aa, Entamoeba histolytica
QIQEIRQFLGRFGLKGDTPKQQIQ

SEQ ID NO: 2692564 - protein, 18 aa, Entamoeba histolytica
QIQFLKRRLAALYNKFSI

SEQ ID NO: 2692565 - protein, 20 aa, Entamoeba histolytica
QIQIPPLKWINPITGTGKIT

SEQ ID NO: 2692566 - protein, 25 aa, Entamoeba histolytica
QIQYPEVYEDLSLSTLQYWIQHVKN

SEQ ID NO: 2692567 - protein, 19 aa, Entamoeba histolytica
QIRSGAFPHYFHIDCTETR

SEQ ID NO: 2692568 - protein, 18 aa, Entamoeba histolytica
QISCSGLDKYSFPITVNQ

SEQ ID NO: 2692569 - protein, 26 aa, Entamoeba histolytica
QISEKEMYYTFCLVDYVLCNSPSFRR

SEQ ID NO: 2692570 - protein, 18 aa, Entamoeba histolytica
QISIRYYLSNGILKRTIF

SEQ ID NO: 2692571 - protein, 22 aa, Entamoeba histolytica
QISKNCYESFQMMHTNPNYSLI

SEQ ID NO: 2692572 - protein, 39 aa, Entamoeba histolytica
QISKWSCVRCNSCGTDCCLLCDGEIIINPILKDVIRLRE

SEQ ID NO: 2692573 - protein, 24 aa, Entamoeba histolytica
QISMKYDRNCIFFFDEIGYQLYDE

SEQ ID NO: 2692574 - protein, 24 aa, Entamoeba histolytica
QISYCLKAEFLKSSKISQIIQIPP

SEQ ID NO: 2692575 - protein, 22 aa, Entamoeba histolytica
QITELLPLLLKGVGMHHSGLLP

SEQ ID NO: 2692576 - protein, 22 aa, Entamoeba histolytica
QIVCPLSHCFKLCVITKQPVVK

SEQ ID NO: 2692577 - protein, 18 aa, Entamoeba histolytica
QIVEPGMMYNCICLGNDG

SEQ ID NO: 2692578 - protein, 19 aa, Entamoeba histolytica
QIVSCKSFTILSHGYLLPE

SEQ ID NO: 2692579 - protein, 19 aa, Entamoeba histolytica
QIYFIYGTELFKITEELKI

SEQ ID NO: 2692580 - protein, 20 aa, Entamoeba histolytica
QIYFSYRFLALHSPEEKRVG

SEQ ID NO: 2692581 - protein, 23 aa, Entamoeba histolytica
QIYGYCINPLFVTMEYFNGGSLY

SEQ ID NO: 2692582 - protein, 17 aa, Entamoeba histolytica
QIYIYIESIKLFKNNQI

SEQ ID NO: 2692583 - protein, 21 aa, Entamoeba histolytica
QIYYLRILQLLLRNEENHHQS

SEQ ID NO: 2692584 - protein, 21 aa, Entamoeba histolytica
QKAFDGCELITSINIPPSVKI

SEQ ID NO: 2692585 - protein, 18 aa, Entamoeba histolytica
QKAICFLSGCYETKYTNG

SEQ ID NO: 2692586 - protein, 26 aa, Entamoeba histolytica
QKCIVDWKYDSCFGKSILSTLSNMLP

SEQ ID NO: 2692587 - protein, 17 aa, Entamoeba histolytica
QKDEWKVQFQQNTQQPN

SEQ ID NO: 2692588 - protein, 18 aa, Entamoeba histolytica
QKDEWKVQFQQNTQQPNT

SEQ ID NO: 2692589 - protein, 23 aa, Entamoeba histolytica
QKDIKDVTVFIGIDYTSSNVDSG

SEQ ID NO: 2692590 - protein, 17 aa, Entamoeba histolytica
QKDIPLIIVSDIYNKFF

SEQ ID NO: 2692591 - protein, 30 aa, Entamoeba histolytica
QKDSFQCIRCKLVIHKACDPYKHNIQAVCR

SEQ ID NO: 2692592 - protein, 25 aa, Entamoeba histolytica
QKEAFSIAPNGLWKIVLSTNIAETS

SEQ ID NO: 2692593 - protein, 28 aa, Entamoeba histolytica
QKEELQWCKAYLIGLLILCETRNSLSGL

SEQ ID NO: 2692594 - protein, 23 aa, Entamoeba histolytica
QKEENFGQIAYYFLLLSGFLQKP

SEQ ID NO: 2692595 - protein, 18 aa, Entamoeba histolytica
QKEIPSLIPTVPQQFIDS

SEQ ID NO: 2692596 - protein, 24 aa, Entamoeba histolytica
QKELPLLVIGSYYFRQRIQKNNII

SEQ ID NO: 2692597 - protein, 24 aa, Entamoeba histolytica
QKERGEEFWVIFGQLLNYSDTLPK

SEQ ID NO: 2692598 - protein, 32 aa, Entamoeba histolytica
QKETLKLATPFGLRVCCCIGGEPMQPQIEELS

SEQ ID NO: 2692599 - protein, 33 aa, Entamoeba histolytica
QKEVIKILMMEKAEYIKGFYFIKRTIESRKTIL

SEQ ID NO: 2692600 - protein, 22 aa, Entamoeba histolytica
QKFAKFNIYKGFSTYVSSDDFI

SEQ ID NO: 2692601 - protein, 19 aa, Entamoeba histolytica
QKFEIPVIRSLRPMRTDDS

SEQ ID NO: 2692602 - protein, 19 aa, Entamoeba histolytica
QKFFEDLEILFIDYSEAFP

SEQ ID NO: 2692603 - protein, 20 aa, Entamoeba histolytica
QKFFTAIGIHVFPFCLQFDV

SEQ ID NO: 2692604 - protein, 19 aa, Entamoeba histolytica
QKFLNKWIGIKSCLLTSTP

SEQ ID NO: 2692605 - protein, 20 aa, Entamoeba histolytica
QKFNMHYKIENCMFEEAQNL

SEQ ID NO: 2692606 - protein, 20 aa, Entamoeba histolytica
QKFYFFVLKSLQFIYQKEFV

SEQ ID NO: 2692607 - protein, 29 aa, Entamoeba histolytica
QKGIKIRCGEVFSVLFERIIDKVKIKEEK

SEQ ID NO: 2692608 - protein, 19 aa, Entamoeba histolytica
QKGNDCFVETPLPQPNYVI

SEQ ID NO: 2692609 - protein, 21 aa, Entamoeba histolytica
QKGTRKFIFCVDNEVYLREFL

SEQ ID NO: 2692610 - protein, 25 aa, Entamoeba histolytica
QKHACKIIDFAHAWDVTEEECNVDD

SEQ ID NO: 2692611 - protein, 18 aa, Entamoeba histolytica
QKHKSVIVECLKDRDHAI

SEQ ID NO: 2692612 - protein, 18 aa, Entamoeba histolytica
QKHLKHFHHMNAQDEGYE

SEQ ID NO: 2692613 - protein, 24 aa, Entamoeba histolytica
QKHLKYGTKPCIFFMQNGYCKKGG

SEQ ID NO: 2692614 - protein, 39 aa, Entamoeba histolytica
QKHNLCPYYYARWATVRSKLILCPYNFVTSVSIRHSSDI

SEQ ID NO: 2692615 - protein, 24 aa, Entamoeba histolytica
QKHVSKNTGIHCTIEINNGEIVLT

SEQ ID NO: 2692616 - protein, 24 aa, Entamoeba histolytica
QKIAAEIDLFFPGKALNYSFKYID

SEQ ID NO: 2692617 - protein, 17 aa, Entamoeba histolytica
QKICSLKTQIENESKKQ

SEQ ID NO: 2692618 - protein, 19 aa, Entamoeba histolytica
QKIEFLALKVMDILKNHKI

SEQ ID NO: 2692619 - protein, 21 aa, Entamoeba histolytica
QKIISERGIFYLNSIVTKEEF

SEQ ID NO: 2692620 - protein, 17 aa, Entamoeba histolytica
QKIKDKKETKSVTDSSD

SEQ ID NO: 2692621 - protein, 21 aa, Entamoeba histolytica
QKIPLFIAAGCDSTFKIVAYT

SEQ ID NO: 2692622 - protein, 25 aa, Entamoeba histolytica
QKKEMCFKEAFDMFTSVAHTFDPLK

SEQ ID NO: 2692623 - protein, 23 aa, Entamoeba histolytica
QKKHIKRKLLIVVENDEGLHLGS

SEQ ID NO: 2692624 - protein, 19 aa, Entamoeba histolytica
QKKIGELLFDLKKEEEQRK

SEQ ID NO: 2692625 - protein, 23 aa, Entamoeba histolytica
QKKIIQRIQCIIRICQHSIEQFM

SEQ ID NO: 2692626 - protein, 25 aa, Entamoeba histolytica
QKKILKDQLRLMATINITGLIQTLN

SEQ ID NO: 2692627 - protein, 17 aa, Entamoeba histolytica
QKKKCHIYRTLSAGTVE

SEQ ID NO: 2692628 - protein, 25 aa, Entamoeba histolytica
QKKKKRVNTDIVFPKLENFKCPVEY

SEQ ID NO: 2692629 - protein, 27 aa, Entamoeba histolytica
QKKWNRLKIQFWDSIIYRNEEEKRRNN

SEQ ID NO: 2692630 - protein, 23 aa, Entamoeba histolytica
QKLCYSARVSPYFTFSKTNESSK

SEQ ID NO: 2692631 - protein, 19 aa, Entamoeba histolytica
QKLEEIYFLTTQETTNTQH

SEQ ID NO: 2692632 - protein, 25 aa, Entamoeba histolytica
QKLGFKGSLKFASPNQHLGKKSIPI

SEQ ID NO: 2692633 - protein, 25 aa, Entamoeba histolytica
QKLIERYRVPKEFVIDSTKYVIDET

SEQ ID NO: 2692634 - protein, 20 aa, Entamoeba histolytica
QKLIQKFPMFIAKCNVIAGV

SEQ ID NO: 2692635 - protein, 17 aa, Entamoeba histolytica
QKLLLPINLLEYLLNPL

SEQ ID NO: 2692636 - protein, 22 aa, Entamoeba histolytica
QKLPIPICITESSQSNPNNNLK

SEQ ID NO: 2692637 - protein, 27 aa, Entamoeba histolytica
QKLRVIQIPQFRSGRMNEQLALGLEYL

SEQ ID NO: 2692638 - protein, 22 aa, Entamoeba histolytica
QKLSSGCVVIDCESVIKELIEN

SEQ ID NO: 2692639 - protein, 19 aa, Entamoeba histolytica
QKLTEAFKVFDPEEKGVID

SEQ ID NO: 2692640 - protein, 19 aa, Entamoeba histolytica
QKLTMCLEKSSGIIKYNQK

SEQ ID NO: 2692641 - protein, 17 aa, Entamoeba histolytica
QKMLLDGLYYLSGLFFC

SEQ ID NO: 2692642 - protein, 21 aa, Entamoeba histolytica
QKNEIGIVWIKNGSKEFGDEG

SEQ ID NO: 2692643 - protein, 24 aa, Entamoeba histolytica
QKNFKEMLDGFGLTADELAQNIKS

SEQ ID NO: 2692644 - protein, 19 aa, Entamoeba histolytica
QKNLLPIFTSFEVLTDNNE

SEQ ID NO: 2692645 - protein, 17 aa, Entamoeba histolytica
QKNLPLITIELCQRDTH

SEQ ID NO: 2692646 - protein, 19 aa, Entamoeba histolytica
QKNTCPILSEAVSLLNHKD

SEQ ID NO: 2692647 - protein, 23 aa, Entamoeba histolytica
QKPIFKISMFLFQQRDTKADKAI

SEQ ID NO: 2692648 - protein, 19 aa, Entamoeba histolytica
QKPKCETENAPIISTTKSP

SEQ ID NO: 2692649 - protein, 24 aa, Entamoeba histolytica
QKPKKEIDDIFSIETPTKPSNNET

SEQ ID NO: 2692650 - protein, 24 aa, Entamoeba histolytica
QKPNEFAVLFPRKTAKIIDDGNDI

SEQ ID NO: 2692651 - protein, 18 aa, Entamoeba histolytica
QKPTEFQHPSFISYQPIK

SEQ ID NO: 2692652 - protein, 18 aa, Entamoeba histolytica
QKPVALKSAISVFLSMNS

SEQ ID NO: 2692653 - protein, 19 aa, Entamoeba histolytica
QKQFCILNATDLITSTKGK

SEQ ID NO: 2692654 - protein, 23 aa, Entamoeba histolytica
QKQHKIESWEVGIEENEKEWHIT

SEQ ID NO: 2692655 - protein, 20 aa, Entamoeba histolytica
QKQIHVWPIIQFNITETVAI

SEQ ID NO: 2692656 - protein, 20 aa, Entamoeba histolytica
QKQKKCIFVKGFPNTWKIKD

SEQ ID NO: 2692657 - protein, 22 aa, Entamoeba histolytica
QKQQCKCCRRYFGNDCLNNQKC

SEQ ID NO: 2692658 - protein, 19 aa, Entamoeba histolytica
QKREKWRKERKEIYKRIYD

SEQ ID NO: 2692659 - protein, 20 aa, Entamoeba histolytica
QKRFGYFPKVFSRGQYSHQL

SEQ ID NO: 2692660 - protein, 28 aa, Entamoeba histolytica
QKRIGCASVKVFNAWGVLKCGVQLVHLE

SEQ ID NO: 2692661 - protein, 19 aa, Entamoeba histolytica
QKRIRVDAKIGKFIKPKVE

SEQ ID NO: 2692662 - protein, 20 aa, Entamoeba histolytica
QKRKRKILHRNIIKNELQNL

SEQ ID NO: 2692663 - protein, 22 aa, Entamoeba histolytica
QKRKSGLNLFAFKETGRLLNQL

SEQ ID NO: 2692664 - protein, 18 aa, Entamoeba histolytica
QKRLEEVKKKNQITSEKS

SEQ ID NO: 2692665 - protein, 20 aa, Entamoeba histolytica
QKRLHALIVQAFKDHQKDII

SEQ ID NO: 2692666 - protein, 21 aa, Entamoeba histolytica
QKRLPFKARYFISNSNYSQIC

SEQ ID NO: 2692667 - protein, 25 aa, Entamoeba histolytica
QKRPSIKPNDGFLLYLKMLNQQNLI

SEQ ID NO: 2692668 - protein, 17 aa, Entamoeba histolytica
QKRSCKLYYLTIDSSIL

SEQ ID NO: 2692669 - protein, 27 aa, Entamoeba histolytica
QKRVIKQKRNWGMLVFQLHQQHRRADL

SEQ ID NO: 2692670 - protein, 21 aa, Entamoeba histolytica
QKRWLFPNEVKSIGRRMKLIK

SEQ ID NO: 2692671 - protein, 30 aa, Entamoeba histolytica; identical to SEQ ID NO: 2501087

SEQ ID NO: 2692672 - protein, 20 aa, Entamoeba histolytica
QKSLMPLKYLNRMQSTIYPT

SEQ ID NO: 2692673 - protein, 19 aa, Entamoeba histolytica
QKSPKWCVDDILKKVHPQN

SEQ ID NO: 2692674 - protein, 20 aa, Entamoeba histolytica
QKSYIGIGTINGFYIFDINN

SEQ ID NO: 2692675 - protein, 24 aa, Entamoeba histolytica
QKSYLPRKVRLHSLHHKKVQHEEI

SEQ ID NO: 2692676 - protein, 18 aa, Entamoeba histolytica
QKTFLIKILKKVFVEETE

SEQ ID NO: 2692677 - protein, 23 aa, Entamoeba histolytica
QKTIKLARMNTSLSRNGTIDLSS

SEQ ID NO: 2692678 - protein, 18 aa, Entamoeba histolytica
QKTPCNLPKYDLLMEKEA

SEQ ID NO: 2692679 - protein, 21 aa, Entamoeba histolytica
QKVESFFDLFYTPALPENLNL

SEQ ID NO: 2692680 - protein, 26 aa, Entamoeba histolytica
QKVEWSECPYCVNSHIPKDLSLGKLL

SEQ ID NO: 2692681 - protein, 25 aa, Entamoeba histolytica
QKVFRPEQIIAMLLIQIKQFTEEYT

SEQ ID NO: 2692682 - protein, 19 aa, Entamoeba histolytica
QKVVDVIGECIKRKEEENK

SEQ ID NO: 2692683 - protein, 26 aa, Entamoeba histolytica
QKWKPVIKEYISFVIEQSKNLSWSEF

SEQ ID NO: 2692684 - protein, 29 aa, Entamoeba histolytica
QKYNEIFKFLWKIKCMSISIDKAYRNMFP

SEQ ID NO: 2692685 - protein, 26 aa, Entamoeba histolytica
QKYPYLPFFFHCRKSWSDLCQLNKEL

SEQ ID NO: 2692686 - protein, 17 aa, Entamoeba histolytica
QKYRILSLDGFSDNPIL

SEQ ID NO: 2692687 - protein, 23 aa, Entamoeba histolytica
QKYSILLNENWSHLIIPTQKALT

SEQ ID NO: 2692688 - protein, 20 aa, Entamoeba histolytica
QKYSYKEFVQFFDSFVNDLK

SEQ ID NO: 2692689 - protein, 23 aa, Entamoeba histolytica
QKYYQLEKMIAWNNPLTYNNYIH

SEQ ID NO: 2692690 - protein, 19 aa, Entamoeba histolytica
QKYYWKAKCLSKREEFKQA

SEQ ID NO: 2692691 - protein, 24 aa, Entamoeba histolytica
QLAELGNKCQIELFSVDHPFVPLW

SEQ ID NO: 2692692 - protein, 24 aa, Entamoeba histolytica
QLANEQFKNFKFIKESEFLYLLCS

SEQ ID NO: 2692693 - protein, 19 aa, Entamoeba histolytica
QLCAFKCVKELNDIITTVN

SEQ ID NO: 2692694 - protein, 17 aa, Entamoeba histolytica
QLCEMNPTMGLITFDDT

SEQ ID NO: 2692695 - protein, 24 aa, Entamoeba histolytica
QLCGTKFSALVLELNASDERGIDV

SEQ ID NO: 2692696 - protein, 17 aa, Entamoeba histolytica
QLCQEINSSISLDISEI

SEQ ID NO: 2692697 - protein, 19 aa, Entamoeba histolytica
QLDAIKISLNIGFSKMNEI

SEQ ID NO: 2692698 - protein, 31 aa, Entamoeba histolytica
QLDLGSLLIMPVQRTPRYVLLLNEVLKHTDK

SEQ ID NO: 2692699 - protein, 24 aa, Entamoeba histolytica
QLDLRVDGLFIKNVLFKDEAKDEI

SEQ ID NO: 2692700 - protein, 18 aa, Entamoeba histolytica
QLDNDFRKRLGLKPKTIK

SEQ ID NO: 2692701 - protein, 21 aa, Entamoeba histolytica
QLDPEIAEIIASKRKHKKNEG

SEQ ID NO: 2692702 - protein, 17 aa, Entamoeba histolytica
QLDRTIITSGDFTVYED

SEQ ID NO: 2692703 - protein, 18 aa, Entamoeba histolytica
QLDYIVSICNVHEYTLLE

SEQ ID NO: 2692704 - protein, 23 aa, Entamoeba histolytica
QLECFTFKIDYNFVNLDEVEHEV

SEQ ID NO: 2692705 - protein, 19 aa, Entamoeba histolytica
QLEGWANAMAKAFNGEKIE

SEQ ID NO: 2692706 - protein, 18 aa, Entamoeba histolytica
QLEIESFLSPIPSQPISK

SEQ ID NO: 2692707 - protein, 20 aa, Entamoeba histolytica
QLENLRRLNLFSNKIRNVPI

SEQ ID NO: 2692708 - protein, 21 aa, Entamoeba histolytica
QLEQYRLTILSSKEELKLTNN

SEQ ID NO: 2692709 - protein, 20 aa, Entamoeba histolytica
QLESRFQLISTIKNYLEQIF

SEQ ID NO: 2692710 - protein, 19 aa, Entamoeba histolytica
QLFCGCVATIPAQFTTEKY

SEQ ID NO: 2692711 - protein, 25 aa, Entamoeba histolytica
QLFFDKWFRKGIITKETYLASLQKI

SEQ ID NO: 2692712 - protein, 18 aa, Entamoeba histolytica
QLFGGFGGFGGFSGFSGF

SEQ ID NO: 2692713 - protein, 18 aa, Entamoeba histolytica
QLFNCCFIMNEAVKGLIE

SEQ ID NO: 2692714 - protein, 19 aa, Entamoeba histolytica
QLGGCLYIPAVFCSIFGLS

SEQ ID NO: 2692715 - protein, 20 aa, Entamoeba histolytica
QLGIGFGGSAEDIFKNDEKM

SEQ ID NO: 2692716 - protein, 20 aa, Entamoeba histolytica
QLGKKEIKPCVACYACQKTG

SEQ ID NO: 2692717 - protein, 22 aa, Entamoeba histolytica
QLGNSSFGFGVINDNKLQDKTV

SEQ ID NO: 2692718 - protein, 20 aa, Entamoeba histolytica
QLGTYFFKVFGNVSVIKYIK

SEQ ID NO: 2692719 - protein, 28 aa, Entamoeba histolytica
QLGVRAGIEFFNRFDVFNASYKIAGEDL

SEQ ID NO: 2692720 - protein, 22 aa, Entamoeba histolytica
QLHIIDSIALCKFFATMESKKG

SEQ ID NO: 2692721 - protein, 19 aa, Entamoeba histolytica
QLIALRLLHTIVSLQIEQC

SEQ ID NO: 2692722 - protein, 18 aa, Entamoeba histolytica
QLIDACGNLVDIGDYLIY

SEQ ID NO: 2692723 - protein, 24 aa, Entamoeba histolytica
QLIECFLTAIGCRIVDRQIAASSP

SEQ ID NO: 2692724 - protein, 26 aa, Entamoeba histolytica
QLIETLRFILVMDFPGKCGGLLQIIQ

SEQ ID NO: 2692725 - protein, 21 aa, Entamoeba histolytica
QLIICGGMAYTFLAASKNMKI

SEQ ID NO: 2692726 - protein, 18 aa, Entamoeba histolytica
QLILRCVNALKLPNDLIG

SEQ ID NO: 2692727 - protein, 17 aa, Entamoeba histolytica
QLIPFETLPSFISSVLL

SEQ ID NO: 2692728 - protein, 17 aa, Entamoeba histolytica
QLIPIVTKFQVCEEGVI

SEQ ID NO: 2692729 - protein, 19 aa, Entamoeba histolytica
QLIQALKFELHHNSELAMF

SEQ ID NO: 2692730 - protein, 23 aa, Entamoeba histolytica
QLIQEIFDRLCQLKRDGEERNKI

SEQ ID NO: 2692731 - protein, 21 aa, Entamoeba histolytica
QLIQELCCVFDERKGCNIKDV

SEQ ID NO: 2692732 - protein, 17 aa, Entamoeba histolytica
QLIRSSGKLVLLDKLLP

SEQ ID NO: 2692733 - protein, 19 aa, Entamoeba histolytica
QLIVFKYLLSFEINGDDLI

SEQ ID NO: 2692734 - protein, 27 aa, Entamoeba histolytica
QLKDAFKRSGLVCGVTCLIRYINGIKV

SEQ ID NO: 2692735 - protein, 18 aa, Entamoeba histolytica
QLKDYVVIDVFEKNIPKE

SEQ ID NO: 2692736 - protein, 22 aa, Entamoeba histolytica
QLKFVKYKKYRFMTIEPIKKNG

SEQ ID NO: 2692737 - protein, 23 aa, Entamoeba histolytica
QLKILTLTGGLVFFELKAPIETM

SEQ ID NO: 2692738 - protein, 20 aa, Entamoeba histolytica
QLKKWEIKYYKGLGTSKDSD

SEQ ID NO: 2692739 - protein, 19 aa, Entamoeba histolytica
QLKLKELFLTINNDIHGEY

SEQ ID NO: 2692740 - protein, 27 aa, Entamoeba histolytica
QLKPQIMKIQCEIAGPSIKIPIKDHPI

SEQ ID NO: 2692741 - protein, 26 aa, Entamoeba histolytica
QLKVDLKCSGLGRFKIMHQGLLNNKE

SEQ ID NO: 2692742 - protein, 20 aa, Entamoeba histolytica
QLKVFFKCFAQYLRQRVASR

SEQ ID NO: 2692743 - protein, 26 aa, Entamoeba histolytica
QLKVSPSSICRYMKKQEAREIYERIQ

SEQ ID NO: 2692744 - protein, 20 aa, Entamoeba histolytica
QLLEKFMFGPTIYYSEPFTN

SEQ ID NO: 2692745 - protein, 28 aa, Entamoeba histolytica
QLLERNSFEILYKFCEKDNPFLIKCFDV

SEQ ID NO: 2692746 - protein, 23 aa, Entamoeba histolytica
QLLGCFVPHHLCIDNAIHTFAGP

SEQ ID NO: 2692747 - protein, 17 aa, Entamoeba histolytica
QLLHLAASLLFVSNDES

SEQ ID NO: 2692748 - protein, 22 aa, Entamoeba histolytica
QLLLCSLNLFPEENVPEKYEDV

SEQ ID NO: 2692749 - protein, 18 aa, Entamoeba histolytica
QLLLHRQRLKEMIERAED

SEQ ID NO: 2692750 - protein, 24 aa, Entamoeba histolytica
QLLLPEQLKALGMNDFIQSPSYLT

SEQ ID NO: 2692751 - protein, 27 aa, Entamoeba histolytica
QLLNSFLRFHCCLLLLDYFGYINRIRE

SEQ ID NO: 2692752 - protein, 31 aa, Entamoeba histolytica
QLLPFMLTNQFKRDICWVFANLASENVKLRD

SEQ ID NO: 2692753 - protein, 18 aa, Entamoeba histolytica
QLLPGDWFGLFKTSSMSQ

SEQ ID NO: 2692754 - protein, 18 aa, Entamoeba histolytica
QLLSCVFILSEFDQKTNF

SEQ ID NO: 2692755 - protein, 18 aa, Entamoeba histolytica
QLLSSCLLIFKCLSAALS

SEQ ID NO: 2692756 - protein, 18 aa, Entamoeba histolytica
QLLYLIRNELELHLSKKH

SEQ ID NO: 2692757 - protein, 30 aa, Entamoeba histolytica
QLMDINIFKKCFNLRELSCANNRILDLSNV

SEQ ID NO: 2692758 - protein, 21 aa, Entamoeba histolytica
QLMICDTCYIGSKGLINLTKF

SEQ ID NO: 2692759 - protein, 25 aa, Entamoeba histolytica
QLMKLPNYFLRGCRSIELIDTKNVE

SEQ ID NO: 2692760 - protein, 17 aa, Entamoeba histolytica
QLMQDMQAIPPLPQQKM

SEQ ID NO: 2692761 - protein, 19 aa, Entamoeba histolytica
QLMYPRIHKIFSKAFSISS

SEQ ID NO: 2692762 - protein, 22 aa, Entamoeba histolytica
QLNCPSIMAGEVMEHLCDNTIP

SEQ ID NO: 2692763 - protein, 17 aa, Entamoeba histolytica
QLNCVNGVVKGNQFGVI

SEQ ID NO: 2692764 - protein, 34 aa, Entamoeba histolytica
QLNFKVKFTIIKAISGLAVGIGFNRFSRYTSVIL

SEQ ID NO: 2692765 - protein, 19 aa, Entamoeba histolytica
QLNKRKPGKKHLNIPKLEV

SEQ ID NO: 2692766 - protein, 20 aa, Entamoeba histolytica
QLNLSLLILRRVLVKRSDDG

SEQ ID NO: 2692767 - protein, 25 aa, Entamoeba histolytica
QLPCTLKELPVCTFFNCIELEKIEI

SEQ ID NO: 2692768 - protein, 31 aa, Entamoeba histolytica
QLPEELKTLFIHLLRLCYKIAQNEKINSMGS

SEQ ID NO: 2692769 - protein, 23 aa, Entamoeba histolytica
QLPEPLIPYEYYKQFIELPLKTT

SEQ ID NO: 2692770 - protein, 25 aa, Entamoeba histolytica
QLPHCEICNLPGTIGTFCPNSTCQT

SEQ ID NO: 2692771 - protein, 17 aa, Entamoeba histolytica
QLPSEFKASKYISCKII

SEQ ID NO: 2692772 - protein, 23 aa, Entamoeba histolytica
QLQCYILYVKMHFFPEMTEEAEL

SEQ ID NO: 2692773 - protein, 28 aa, Entamoeba histolytica
QLRRKEWINLNGIWKYQITDIIDGNKES

SEQ ID NO: 2692774 - protein, 25 aa, Entamoeba histolytica
QLRSLLFTFFLCYSQSHFEDSKKLY

SEQ ID NO: 2692775 - protein, 20 aa, Entamoeba histolytica
QLRSSGYGFGIFTIDDDVDD

SEQ ID NO: 2692776 - protein, 21 aa, Entamoeba histolytica
QLRTIIHGTIFKKEQVIFNFD

SEQ ID NO: 2692777 - protein, 21 aa, Entamoeba histolytica
QLSAIYGIIAINNFIQINGEK

SEQ ID NO: 2692778 - protein, 20 aa, Entamoeba histolytica
QLSELMGFIKIENINFAIVI

SEQ ID NO: 2692779 - protein, 20 aa, Entamoeba histolytica
QLSFSLPINILRYVQPLNQS

SEQ ID NO: 2692780 - protein, 23 aa, Entamoeba histolytica
QLSILNCRCVDAISLPSSITSLN

SEQ ID NO: 2692781 - protein, 18 aa, Entamoeba histolytica
QLSLPYVEVKNNFVKYEQ

SEQ ID NO: 2692782 - protein, 18 aa, Entamoeba histolytica
QLSPRIMLETSKSRPLTT

SEQ ID NO: 2692783 - protein, 21 aa, Entamoeba histolytica
QLSTLKALFVILTYDPQIPQT

SEQ ID NO: 2692784 - protein, 18 aa, Entamoeba histolytica
QLTAISFDQYFKLRTNDF

SEQ ID NO: 2692785 - protein, 18 aa, Entamoeba histolytica
QLTFIECRFHLICKKDEY

SEQ ID NO: 2692786 - protein, 18 aa, Entamoeba histolytica
QLTGAINYFDIIKHPMDL

SEQ ID NO: 2692787 - protein, 17 aa, Entamoeba histolytica
QLTIDFVQPVLISENNN

SEQ ID NO: 2692788 - protein, 18 aa, Entamoeba histolytica
QLTISCMNAVCYCCRSPN

SEQ ID NO: 2692789 - protein, 23 aa, Entamoeba histolytica
QLTKLVLCGCSISNLTDLLHCSL

SEQ ID NO: 2692790 - protein, 17 aa, Entamoeba histolytica
QLTKMPLCCDGESDDKP

SEQ ID NO: 2692791 - protein, 24 aa, Entamoeba histolytica
QLTPNCILPHLFLGSVESTTKPFL

SEQ ID NO: 2692792 - protein, 23 aa, Entamoeba histolytica
QLTRSQVEIVYGFFHNDFDKTSK

SEQ ID NO: 2692793 - protein, 23 aa, Entamoeba histolytica
QLTSELIKLPSLDQGTYKILFKK

SEQ ID NO: 2692794 - protein, 24 aa, Entamoeba histolytica
QLTSMPTQITPLIHPTDTSLTKLR

SEQ ID NO: 2692795 - protein, 18 aa, Entamoeba histolytica
QLTWSSKDNKVFINENSF

SEQ ID NO: 2692796 - protein, 20 aa, Entamoeba histolytica
QLVHCLRLIGFDYVFDVDAG

SEQ ID NO: 2692797 - protein, 22 aa, Entamoeba histolytica
QLVRQRLSSVSFIGRKTENGSG

SEQ ID NO: 2692798 - protein, 23 aa, Entamoeba histolytica
QLYASSLFSWLADLIYLNISGCT

SEQ ID NO: 2692799 - protein, 29 aa, Entamoeba histolytica
QLYHPFCQLLCGLLNFVKGITHFPVVLHF

SEQ ID NO: 2692800 - protein, 19 aa, Entamoeba histolytica
QLYHYGISVVQKCYYVPQL

SEQ ID NO: 2692801 - protein, 19 aa, Entamoeba histolytica
QLYLFEGCLLVFSNQKNGD

SEQ ID NO: 2692802 - protein, 26 aa, Entamoeba histolytica
QLYNHVCKLLEEFPENEMLVKINSIV

SEQ ID NO: 2692803 - protein, 26 aa, Entamoeba histolytica
QLYNYKCDIWSLGAMYYYLRTGMFPL

SEQ ID NO: 2692804 - protein, 25 aa, Entamoeba histolytica
QLYSLLKCSLFDFIPNFHLNKNDIP

SEQ ID NO: 2692805 - protein, 23 aa, Entamoeba histolytica
QMAYDYRCSLGMGRTGYAAAVLQ

SEQ ID NO: 2692806 - protein, 27 aa, Entamoeba histolytica
QMCQKQCRDANGFKCHCETEGHRRMME

SEQ ID NO: 2692807 - protein, 24 aa, Entamoeba histolytica
QMCQSENGVSCLIMCTEKRMDYYK

SEQ ID NO: 2692808 - protein, 18 aa, Entamoeba histolytica
QMDCYDKEIEIIECVNKL

SEQ ID NO: 2692809 - protein, 24 aa, Entamoeba histolytica
QMEGFKFKLVQRIDLEKKTERFIK

SEQ ID NO: 2692810 - protein, 18 aa, Entamoeba histolytica
QMEMCINKIQIQYTNISN

SEQ ID NO: 2692811 - protein, 18 aa, Entamoeba histolytica
QMEREIERLKGIMEDGKG

SEQ ID NO: 2692812 - protein, 25 aa, Entamoeba histolytica
QMEVLRYCLQAIKLYININIEDCFE

SEQ ID NO: 2692813 - protein, 24 aa, Entamoeba histolytica
QMFNVLCLMDYVCKRNVSFRYHLK

SEQ ID NO: 2692814 - protein, 23 aa, Entamoeba histolytica
QMGWREIAEILVKFRQVAEPADG

SEQ ID NO: 2692815 - protein, 24 aa, Entamoeba histolytica
QMIIPHIFYKFIIMLVNRSEVQPH

SEQ ID NO: 2692816 - protein, 22 aa, Entamoeba histolytica
QMILLFSDFFCRTCSYGCDTAL

SEQ ID NO: 2692817 - protein, 24 aa, Entamoeba histolytica
QMINKIFIHELIDWMTVNDKYQIP

SEQ ID NO: 2692818 - protein, 33 aa, Entamoeba histolytica
QMKARKMIAEWGFKFPYELNEYMKIYEKNKKAF

SEQ ID NO: 2692819 - protein, 18 aa, Entamoeba histolytica
QMKLNFLMDRSCKVKQDL

SEQ ID NO: 2692820 - protein, 25 aa, Entamoeba histolytica
QMLNTFYSFEWNNFINKCLDLCIRR

SEQ ID NO: 2692821 - protein, 19 aa, Entamoeba histolytica
QMLYNCLVYLMSQNVETPL

SEQ ID NO: 2692822 - protein, 25 aa, Entamoeba histolytica
QMNARPQFTVAQGLDITRQNIVSQQ

SEQ ID NO: 2692823 - protein, 24 aa, Entamoeba histolytica
QMNEVVMILRFLKKQSTHLPQIEF

SEQ ID NO: 2692824 - protein, 23 aa, Entamoeba histolytica
QMPQQIQQGFSFKPQPTQVPVSR

SEQ ID NO: 2692825 - protein, 26 aa, Entamoeba histolytica
QMQEISCGAPAKMISQFYITYWMMLN

SEQ ID NO: 2692826 - protein, 19 aa, Entamoeba histolytica
QMRKELKEALDDVINQKTQ

SEQ ID NO: 2692827 - protein, 24 aa, Entamoeba histolytica
QMSKYAVLVSDQWYSQLNKNVIVM

SEQ ID NO: 2692828 - protein, 17 aa, Entamoeba histolytica
QMTCTYLNIFIQQLYSW

SEQ ID NO: 2692829 - protein, 26 aa, Entamoeba histolytica
QMTLRLPKWENMILLLKKGVFHPKFV

SEQ ID NO: 2692830 - protein, 22 aa, Entamoeba histolytica
QMTPEVWDYLFAEKEMPENTTI

SEQ ID NO: 2692831 - protein, 26 aa, Entamoeba histolytica
QMYQDGCTWTTHFSRMYTSVHQLPTF

SEQ ID NO: 2692832 - protein, 17 aa, Entamoeba histolytica
QNARIHNNLGLSYQALN

SEQ ID NO: 2692833 - protein, 26 aa, Entamoeba histolytica
QNCVALNPKWCRCLLSTKDSGGRIGS

SEQ ID NO: 2692834 - protein, 24 aa, Entamoeba histolytica
QNDDIKYQIAWFFTNLAVSLDSET

SEQ ID NO: 2692835 - protein, 17 aa, Entamoeba histolytica
QNDMKHWSFEVVDDGHD

SEQ ID NO: 2692836 - protein, 18 aa, Entamoeba histolytica
QNDVFGWGISNEANDAYW

SEQ ID NO: 2692837 - protein, 25 aa, Entamoeba histolytica
QNEEMKHIIGFPIDFSNDVVGIHPS

SEQ ID NO: 2692838 - protein, 24 aa, Entamoeba histolytica
QNEILKKRIEEFENNKGDDIKTSV

SEQ ID NO: 2692839 - protein, 26 aa, Entamoeba histolytica
QNEKAPDWLVNWCFVEYVQYTHSMAS

SEQ ID NO: 2692840 - protein, 18 aa, Entamoeba histolytica
QNEMTIIANQAWIVMKIV

SEQ ID NO: 2692841 - protein, 19 aa, Entamoeba histolytica
QNFAMRLLQAVGLRDSQGV

SEQ ID NO: 2692842 - protein, 18 aa, Entamoeba histolytica
QNFLLSGYVNLRLWPDEE

SEQ ID NO: 2692843 - protein, 25 aa, Entamoeba histolytica
QNFTWVRAGCICMAVANRRLNTFAK

SEQ ID NO: 2692844 - protein, 27 aa, Entamoeba histolytica
QNGGKGFLVCWCGRIEKLFTVGFNKMS

SEQ ID NO: 2692845 - protein, 23 aa, Entamoeba histolytica
QNGIIPKECVGFISEMLKDISGI

SEQ ID NO: 2692846 - protein, 24 aa, Entamoeba histolytica
QNGMGSGFGRFLASGNIAMGGFGG

SEQ ID NO: 2692847 - protein, 24 aa, Entamoeba histolytica
QNGPCYKCLYPVMPSTTLNATAKT

SEQ ID NO: 2692848 - protein, 25 aa, Entamoeba histolytica
QNGQLRLDQKVQLFQAITPQGTKQF

SEQ ID NO: 2692849 - protein, 20 aa, Entamoeba histolytica
QNGVEIFKGCNILVDCSDNH

SEQ ID NO: 2692850 - protein, 17 aa, Entamoeba histolytica
QNICKFQDFELLETILS

SEQ ID NO: 2692851 - protein, 19 aa, Entamoeba histolytica
QNIITLFTFICYDSIEPDC

SEQ ID NO: 2692852 - protein, 22 aa, Entamoeba histolytica
QNIKEKSNVLVFDLGGGTFDVT

SEQ ID NO: 2692853 - protein, 23 aa, Entamoeba histolytica
QNIKRFAERVTELYEYKQRLQEY

SEQ ID NO: 2692854 - protein, 19 aa, Entamoeba histolytica
QNIKRGVVYGAYQSSSPIL

SEQ ID NO: 2692855 - protein, 17 aa, Entamoeba histolytica
QNIKTAFFQAFKEMQNQ

SEQ ID NO: 2692856 - protein, 17 aa, Entamoeba histolytica
QNITWSGGKLKPDIDDE

SEQ ID NO: 2692857 - protein, 20 aa, Entamoeba histolytica
QNKGKLLGFYVRCKNNFNGK

SEQ ID NO: 2692858 - protein, 24 aa, Entamoeba histolytica
QNKKKERLTLCRQEQKKSIQDMKL

SEQ ID NO: 2692859 - protein, 27 aa, Entamoeba histolytica
QNKLRPLWRYYYSGTNAIIFVVDSNDD

SEQ ID NO: 2692860 - protein, 35 aa, Entamoeba histolytica
QNKSTQMLLPFYRFKSQYLLLLKIYIDSVQSFDKN

SEQ ID NO: 2692861 - protein, 19 aa, Entamoeba histolytica
QNKVVKMIHDYAFSQTTSE

SEQ ID NO: 2692862 - protein, 30 aa, Entamoeba histolytica; identical to SEQ ID NO: 2501300

SEQ ID NO: 2692863 - protein, 21 aa, Entamoeba histolytica
QNLDSFSYFIYLREFVNCQNF

SEQ ID NO: 2692864 - protein, 26 aa, Entamoeba histolytica
QNLEIYKGIIPFKWLKEEENEEIIMS

SEQ ID NO: 2692865 - protein, 25 aa, Entamoeba histolytica
QNLLPIKLLHLFTAPFYLPPTSYLQ

SEQ ID NO: 2692866 - protein, 18 aa, Entamoeba histolytica
QNLNQVYGLVLVRDHSIH

SEQ ID NO: 2692867 - protein, 17 aa, Entamoeba histolytica
QNLPLLKRSISWHTGSI

SEQ ID NO: 2692868 - protein, 18 aa, Entamoeba histolytica
QNLVGRFAELWGMMEQEL

SEQ ID NO: 2692869 - protein, 26 aa, Entamoeba histolytica
QNLVPFTLYCCSILVMLNIPPSDYSI

SEQ ID NO: 2692870 - protein, 25 aa, Entamoeba histolytica
QNMARRSEILIARYALHKLYPDVEM

SEQ ID NO: 2692871 - protein, 17 aa, Entamoeba histolytica
QNMFYCAPELYLNQINE

SEQ ID NO: 2692872 - protein, 18 aa, Entamoeba histolytica
QNMKFLWTLTSDKSSFFF

SEQ ID NO: 2692873 - protein, 17 aa, Entamoeba histolytica
QNNGEWKGLLPIEEQPT

SEQ ID NO: 2692874 - protein, 18 aa, Entamoeba histolytica
QNNIRIIGLSLPISDSKS

SEQ ID NO: 2692875 - protein, 31 aa, Entamoeba histolytica
QNPDLLCTWYLDNTCCVWNVETRRLAWSIPS

SEQ ID NO: 2692876 - protein, 34 aa, Entamoeba histolytica; identical to SEQ ID NO: 2501324

SEQ ID NO: 2692877 - protein, 31 aa, Entamoeba histolytica; identical to SEQ ID NO: 2501326

SEQ ID NO: 2692878 - protein, 22 aa, Entamoeba histolytica
QNPRKRLGLVLQMQDEPYALEL

SEQ ID NO: 2692879 - protein, 20 aa, Entamoeba histolytica
QNPTFCYDLINGIIGLCGSS

SEQ ID NO: 2692880 - protein, 19 aa, Entamoeba histolytica
QNQVFGLVLVDAMLPRLSE

SEQ ID NO: 2692881 - protein, 22 aa, Entamoeba histolytica
QNSIKYNILYPLKKELIINKHQ

SEQ ID NO: 2692882 - protein, 24 aa, Entamoeba histolytica
QNTCNTLILKGCILALKECGIKVD

SEQ ID NO: 2692883 - protein, 35 aa, Entamoeba histolytica
QNTLKELWSLLHFLHPKKFISFEEFEKTYSVEGTE

SEQ ID NO: 2692884 - protein, 28 aa, Entamoeba histolytica
QNTQVCGFCCYFDCLFYGKAHLTTKPGQ

SEQ ID NO: 2692885 - protein, 30 aa, Entamoeba histolytica; identical to SEQ ID NO: 2474064

SEQ ID NO: 2692886 - protein, 18 aa, Entamoeba histolytica
QNVGLILFKIKREIRKQN

SEQ ID NO: 2692887 - protein, 26 aa, Entamoeba histolytica
QNVISFVQAFEWIRENAQEFVQLFYD

SEQ ID NO: 2692888 - protein, 18 aa, Entamoeba histolytica
QNVKICICYEIKNNSDFT

SEQ ID NO: 2692889 - protein, 23 aa, Entamoeba histolytica
QNVKWYFPIGVIFDALHNGSLPM

SEQ ID NO: 2692890 - protein, 18 aa, Entamoeba histolytica
QNVSCFDINEIIVIGLWD

SEQ ID NO: 2692891 - protein, 20 aa, Entamoeba histolytica
QNVVESFLKKNGFEVMVRAH

SEQ ID NO: 2692892 - protein, 28 aa, Entamoeba histolytica
QNWEEFCVQCSYQPFTISTYQKYPEYRE

SEQ ID NO: 2692893 - protein, 20 aa, Entamoeba histolytica
QNYPTMVMEVFGKNEGDDSD

SEQ ID NO: 2692894 - protein, 17 aa, Entamoeba histolytica
QNYPVKIGDQFMKFDRV

SEQ ID NO: 2692895 - protein, 24 aa, Entamoeba histolytica
QPAACCSVGKLLHLMVPVEHSFIS

SEQ ID NO: 2692896 - protein, 27 aa, Entamoeba histolytica
QPAIKIKEIFDAFCFGNADIQNILITC

SEQ ID NO: 2692897 - protein, 25 aa, Entamoeba histolytica
QPDVGEFRLIFAGRVLKDDEVLSTL

SEQ ID NO: 2692898 - protein, 21 aa, Entamoeba histolytica
QPECSKFGSIIIKTRRLVNQI

SEQ ID NO: 2692899 - protein, 27 aa, Entamoeba histolytica
QPFITSVLNICFEFLKIDPIKTKEVFI

SEQ ID NO: 2692900 - protein, 17 aa, Entamoeba histolytica
QPFKILMVGDEGVGKTC

SEQ ID NO: 2692901 - protein, 17 aa, Entamoeba histolytica
QPGKFIFSFDDLKMLLG

SEQ ID NO: 2692902 - protein, 31 aa, Entamoeba histolytica; identical to SEQ ID NO: 2501362

SEQ ID NO: 2692903 - protein, 18 aa, Entamoeba histolytica
QPGTCPVTPPSQSKRNIP

SEQ ID NO: 2692904 - protein, 17 aa, Entamoeba histolytica
QPHIDRIVFGSNFVNII

SEQ ID NO: 2692905 - protein, 18 aa, Entamoeba histolytica
QPIAPMSWILEGKEPTRE

SEQ ID NO: 2692906 - protein, 21 aa, Entamoeba histolytica
QPICEELKIDPVVSAELISKR

SEQ ID NO: 2692907 - protein, 22 aa, Entamoeba histolytica
QPIEIVLHLPILCEDKNVPYVF

SEQ ID NO: 2692908 - protein, 17 aa, Entamoeba histolytica
QPIEVAEAAMLLRNCEI

SEQ ID NO: 2692909 - protein, 18 aa, Entamoeba histolytica
QPIPSSLLPKFSNTPPQE

SEQ ID NO: 2692910 - protein, 18 aa, Entamoeba histolytica
QPIRFYVIKNKQVIARIA

SEQ ID NO: 2692911 - protein, 18 aa, Entamoeba histolytica
QPISTETINSWKNEESLT

SEQ ID NO: 2692912 - protein, 23 aa, Entamoeba histolytica
QPIYEVYGTLLLHLVTANTAHVQ

SEQ ID NO: 2692913 - protein, 23 aa, Entamoeba histolytica
QPKILATTLSAWIERLGGKITIR

SEQ ID NO: 2692914 - protein, 20 aa, Entamoeba histolytica
QPKLLNCCRQLMIKSSERTH

SEQ ID NO: 2692915 - protein, 27 aa, Entamoeba histolytica
QPKLPFKQRVSFEERKAFAIQLRQKKP

SEQ ID NO: 2692916 - protein, 21 aa, Entamoeba histolytica
QPKPFRAVPVQPKPVKIDVPI

SEQ ID NO: 2692917 - protein, 18 aa, Entamoeba histolytica
QPKRKVLKEKKGTKKTNM

SEQ ID NO: 2692918 - protein, 22 aa, Entamoeba histolytica
QPLEILCFDWDRIGDDDFLGKF

SEQ ID NO: 2692919 - protein, 18 aa, Entamoeba histolytica
QPLINVCETINFSKISVS

SEQ ID NO: 2692920 - protein, 18 aa, Entamoeba histolytica
QPLIPSFGTMEWNHLYLI

SEQ ID NO: 2692921 - protein, 17 aa, Entamoeba histolytica
QPLKFRADIEVSCFAIG

SEQ ID NO: 2692922 - protein, 23 aa, Entamoeba histolytica
QPLPLCFALALQNIDVWEFVYEG

SEQ ID NO: 2692923 - protein, 21 aa, Entamoeba histolytica
QPLSFPSYVKVEFHLQDLIRK

SEQ ID NO: 2692924 - protein, 24 aa, Entamoeba histolytica
QPNDKGLFICRAFSNNNSVGGFLS

SEQ ID NO: 2692925 - protein, 17 aa, Entamoeba histolytica
QPNKFVIHRTRESGYEL

SEQ ID NO: 2692926 - protein, 18 aa, Entamoeba histolytica
QPNNGMGGFGTFGQQPNN

SEQ ID NO: 2692927 - protein, 17 aa, Entamoeba histolytica
QPNRCCELLSEIFKEVC

SEQ ID NO: 2692928 - protein, 17 aa, Entamoeba histolytica
QPNVFNYFLSVSKQQIG

SEQ ID NO: 2692929 - protein, 23 aa, Entamoeba histolytica
QPPEEMKNMIALKEEQDFDKQVL

SEQ ID NO: 2692930 - protein, 17 aa, Entamoeba histolytica
QPPQIIELINDYKNYLS

SEQ ID NO: 2692931 - protein, 24 aa, Entamoeba histolytica
QPPSICISHIFSIITAITDFCNGL

SEQ ID NO: 2692932 - protein, 19 aa, Entamoeba histolytica
QPQKDIWGNPVQQQNGTQN

SEQ ID NO: 2692933 - protein, 19 aa, Entamoeba histolytica
QPQKDIWGNPVQSQNTQPQ

SEQ ID NO: 2692934 - protein, 22 aa, Entamoeba histolytica
QPQPQKDIWGKPVQSQPGQQQN

SEQ ID NO: 2692935 - protein, 20 aa, Entamoeba histolytica
QPRIFELLKQLELLIKKINP

SEQ ID NO: 2692936 - protein, 30 aa, Entamoeba histolytica; identical to SEQ ID NO: 2501411

SEQ ID NO: 2692937 - protein, 24 aa, Entamoeba histolytica
QPRQGPVVVCILDGFGIDKEGPGN

SEQ ID NO: 2692938 - protein, 29 aa, Entamoeba histolytica
QPRVNISSNISFVYCININVFDCIDSTCN

SEQ ID NO: 2692939 - protein, 21 aa, Entamoeba histolytica
QPSKEVLYIILLLTKNQIINN

SEQ ID NO: 2692940 - protein, 23 aa, Entamoeba histolytica
QPSKLRIGVQYLKLQWKGAKDLE

SEQ ID NO: 2692941 - protein, 26 aa, Entamoeba histolytica
QPSQFFSFVTFHLWAYGEYTINYNIT

SEQ ID NO: 2692942 - protein, 27 aa, Entamoeba histolytica
QPSTHWKCCVCCTKGIREREDVLRREV

SEQ ID NO: 2692943 - protein, 26 aa, Entamoeba histolytica
QPSTNMFSNIGFSFSISDDKQNSNTN

SEQ ID NO: 2692944 - protein, 26 aa, Entamoeba histolytica
QPSYEFSWFEGYAWQIIVCESCESHI

SEQ ID NO: 2692945 - protein, 22 aa, Entamoeba histolytica
QPTKAGCYAVSWNPVQSQIVSG

SEQ ID NO: 2692946 - protein, 22 aa, Entamoeba histolytica
QPVCPYKKVIVGSVQQPHIQQP

SEQ ID NO: 2692947 - protein, 25 aa, Entamoeba histolytica
QPVEMRKSSIPIFSKAPVMNKSGYF

SEQ ID NO: 2692948 - protein, 18 aa, Entamoeba histolytica
QPVGTIITYDFYKLIQKH

SEQ ID NO: 2692949 - protein, 18 aa, Entamoeba histolytica
QPVHRSMFSPIALPNQNE

SEQ ID NO: 2692950 - protein, 24 aa, Entamoeba histolytica
QPYYDYPELLGLLIELASNERNQD

SEQ ID NO: 2692951 - protein, 28 aa, Entamoeba histolytica
QQAEAYNRRAIIFLQNYNKFRDANEKIQ

SEQ ID NO: 2692952 - protein, 23 aa, Entamoeba histolytica
QQAEIILRLFLLDSVDSEHPSET

SEQ ID NO: 2692953 - protein, 23 aa, Entamoeba histolytica
QQAFSLLVLRVLFSTIGFCTEIN

SEQ ID NO: 2692954 - protein, 21 aa, Entamoeba histolytica
QQCKARWYSWLDPSIKKTEWT

SEQ ID NO: 2692955 - protein, 21 aa, Entamoeba histolytica
QQCKNQCKLMLIFHHSPQSPL

SEQ ID NO: 2692956 - protein, 20 aa, Entamoeba histolytica
QQDFCFIMILSLLGESELPC

SEQ ID NO: 2692957 - protein, 18 aa, Entamoeba histolytica
QQECVKSALELMLVSESI

SEQ ID NO: 2692958 - protein, 20 aa, Entamoeba histolytica
QQELKMVLHINDSIEQLIKE

SEQ ID NO: 2692959 - protein, 23 aa, Entamoeba histolytica
QQFIDRFKCSAVRGPQVQSRIKM

SEQ ID NO: 2692960 - protein, 18 aa, Entamoeba histolytica
QQFKELLGRCKVAEKRKE

SEQ ID NO: 2692961 - protein, 19 aa, Entamoeba histolytica
QQFWEGFKLLSSTTAEPYD

SEQ ID NO: 2692962 - protein, 17 aa, Entamoeba histolytica
QQFYGCSSLEEINVPAP

SEQ ID NO: 2692963 - protein, 18 aa, Entamoeba histolytica
QQGVYEWPEDVDVSDDCK

SEQ ID NO: 2692964 - protein, 23 aa, Entamoeba histolytica
QQHMPSFHFPRMGECKAYISFID

SEQ ID NO: 2692965 - protein, 17 aa, Entamoeba histolytica
QQIALAFMYGYGSVGFN

SEQ ID NO: 2692966 - protein, 17 aa, Entamoeba histolytica
QQIIKWLINTVKTNDFW

SEQ ID NO: 2692967 - protein, 20 aa, Entamoeba histolytica
QQIKLCCMVDFDPFGLDIFN

SEQ ID NO: 2692968 - protein, 18 aa, Entamoeba histolytica
QQIMIWLIKNGFKHVSEL

SEQ ID NO: 2692969 - protein, 24 aa, Entamoeba histolytica
QQIRRVGKIFAVLSEDRKKDILDL

SEQ ID NO: 2692970 - protein, 26 aa, Entamoeba histolytica
QQISLRMKWIRSRTNQSWDDFCKSNE

SEQ ID NO: 2692971 - protein, 22 aa, Entamoeba histolytica
QQKDVRHSVLIPKNPENMKKPT

SEQ ID NO: 2692972 - protein, 33 aa, Entamoeba histolytica
QQKEFTAAMFLPFVMQFLENFENFAKWKFVPFI

SEQ ID NO: 2692973 - protein, 21 aa, Entamoeba histolytica
QQKFCILPMLIQIHITLTIIN

SEQ ID NO: 2692974 - protein, 28 aa, Entamoeba histolytica
QQKLKDIYEFWGFLWSQMFKILEEHCDG

SEQ ID NO: 2692975 - protein, 25 aa, Entamoeba histolytica
QQKLWKLSDVIILWGNCSETTQQWA

SEQ ID NO: 2692976 - protein, 25 aa, Entamoeba histolytica
QQKYCPPNLFSIVFKGFDDVYRINS

SEQ ID NO: 2692977 - protein, 28 aa, Entamoeba histolytica
QQLESPLLREARLFRSPFIKSVHIYCQQ

SEQ ID NO: 2692978 - protein, 17 aa, Entamoeba histolytica
QQLFDWKKVFSEIIKGT

SEQ ID NO: 2692979 - protein, 17 aa, Entamoeba histolytica
QQLICNEEVFGLCDGIE

SEQ ID NO: 2692980 - protein, 25 aa, Entamoeba histolytica
QQLMKRLLLTYAIKHPASGYVQGMS

SEQ ID NO: 2692981 - protein, 23 aa, Entamoeba histolytica
QQLMRVYGALMWSLGKVMQTPEC

SEQ ID NO: 2692982 - protein, 22 aa, Entamoeba histolytica
QQLTLYEYELFKSIEAKEMLGN

SEQ ID NO: 2692983 - protein, 22 aa, Entamoeba histolytica
QQMLKTNPLIKLQNESQSQSTT

SEQ ID NO: 2692984 - protein, 25 aa, Entamoeba histolytica
QQNRLGQLLWDFGVPTAMSIWEASQ

SEQ ID NO: 2692985 - protein, 36 aa, Entamoeba histolytica
QQNTPRYILKLSVNYISEAKIEFCEGTTVENTMVLF

SEQ ID NO: 2692986 - protein, 28 aa, Entamoeba histolytica
QQPAIDWKLWCFHCKKPLDHGYVCSSCF

SEQ ID NO: 2692987 - protein, 26 aa, Entamoeba histolytica
QQPKCQLVIFKIYNIFCSKYLDNDFL

SEQ ID NO: 2692988 - protein, 19 aa, Entamoeba histolytica
QQQRSSLQIGDSVELSENQ

SEQ ID NO: 2692989 - protein, 24 aa, Entamoeba histolytica
QQQSSKLYYEWNIFESIYSKNPTD

SEQ ID NO: 2692990 - protein, 25 aa, Entamoeba histolytica
QQREFPTFPGAILFTTNCLMKPLPS

SEQ ID NO: 2692991 - protein, 23 aa, Entamoeba histolytica
QQRFLSYSFIPPFFKQEQIKEYL

SEQ ID NO: 2692992 - protein, 19 aa, Entamoeba histolytica
QQRIPAPIQPNFKQRNQQE

SEQ ID NO: 2692993 - protein, 31 aa, Entamoeba histolytica
QQRPWCLRFEYWKQILPMSASIVEKVNVLIK

SEQ ID NO: 2692994 - protein, 24 aa, Entamoeba histolytica
QQSDGSWFSSWWKTDKDEVNMMKK

SEQ ID NO: 2692995 - protein, 17 aa, Entamoeba histolytica
QQSFTWAVNALFSCLYE

SEQ ID NO: 2692996 - protein, 18 aa, Entamoeba histolytica
QQSNGFGGFGSFGQTNQQ

SEQ ID NO: 2692997 - protein, 24 aa, Entamoeba histolytica
QQTISLKCPISYQRIVIPARGLNC

SEQ ID NO: 2692998 - protein, 28 aa, Entamoeba histolytica
QQTLENLGFWPSILLHVVIKSVGEKKEP

SEQ ID NO: 2692999 - protein, 27 aa, Entamoeba histolytica
QQTLQCWKRSESALFLLFCSDPLMQKE

SEQ ID NO: 2693000 - protein, 24 aa, Entamoeba histolytica
QQVYYKIRCSLTFLDNDEETHDEL

SEQ ID NO: 2693001 - protein, 27 aa, Entamoeba histolytica
QQYEILRREFLSALAFVEPTFDLSSAL

SEQ ID NO: 2693002 - protein, 26 aa, Entamoeba histolytica
QQYIRSVLPPELWKRIEDVAFEPNVM

SEQ ID NO: 2693003 - protein, 17 aa, Entamoeba histolytica
QQYKLAYEVIPIKRNIE

SEQ ID NO: 2693004 - protein, 21 aa, Entamoeba histolytica
QQYPGYGINPEAERYNQVNNF

SEQ ID NO: 2693005 - protein, 18 aa, Entamoeba histolytica
QQYPKAFVTQAIITCCIK

SEQ ID NO: 2693006 - protein, 17 aa, Entamoeba histolytica
QQYRKWTKLGIQGNKLF

SEQ ID NO: 2693007 - protein, 22 aa, Entamoeba histolytica
QRAKVGIPLYFVYTPLCNEVNR

SEQ ID NO: 2693008 - protein, 17 aa, Entamoeba histolytica
QRAMLLLPLVGNEIERI

SEQ ID NO: 2693009 - protein, 24 aa, Entamoeba histolytica
QRAVKLAIRECIKKEIEIQESGLD

SEQ ID NO: 2693010 - protein, 22 aa, Entamoeba histolytica
QRCARCKDFLTTRDYLRDNIYC

SEQ ID NO: 2693011 - protein, 23 aa, Entamoeba histolytica
QRCDGRGSIYVMIRQGMFAMQSE

SEQ ID NO: 2693012 - protein, 19 aa, Entamoeba histolytica
QRCDSLKDGISRDWYVSSN

SEQ ID NO: 2693013 - protein, 20 aa, Entamoeba histolytica
QRCDSLKDGISRDWYVSSNT

SEQ ID NO: 2693014 - protein, 19 aa, Entamoeba histolytica
QRCSEELFNDLGINKTPTQ

SEQ ID NO: 2693015 - protein, 17 aa, Entamoeba histolytica
QRDIPIPLVSAGADKGN

SEQ ID NO: 2693016 - protein, 20 aa, Entamoeba histolytica
QRDSLEFATAMYTYNRGVFD

SEQ ID NO: 2693017 - protein, 25 aa, Entamoeba histolytica
QREHLRLQICSSFSYDESVLYTAGL

SEQ ID NO: 2693018 - protein, 18 aa, Entamoeba histolytica
QREKPVCLIAVSKTKPKE

SEQ ID NO: 2693019 - protein, 25 aa, Entamoeba histolytica
QRELEDLKRIVLLMLDHCPQTFNLL

SEQ ID NO: 2693020 - protein, 22 aa, Entamoeba histolytica
QRELERLKKEYIEQLNYQHDLE

SEQ ID NO: 2693021 - protein, 25 aa, Entamoeba histolytica
QRELKAEGLKSFFMTMSSEFHGEAD

SEQ ID NO: 2693022 - protein, 27 aa, Entamoeba histolytica
QRFADIAGDLCSAGLQIAEDMRTQADG

SEQ ID NO: 2693023 - protein, 25 aa, Entamoeba histolytica
QRFTDRRLAEFVPWNKEAIKVVHTR

SEQ ID NO: 2693024 - protein, 19 aa, Entamoeba histolytica
QRGFDWTGNIWGRKIEISM

SEQ ID NO: 2693025 - protein, 29 aa, Entamoeba histolytica
QRGRGLELLACIAKAIGKEQFRPYLNDCV

SEQ ID NO: 2693026 - protein, 23 aa, Entamoeba histolytica
QRHSVLFKTQFCLNVDDINNTGS

SEQ ID NO: 2693027 - protein, 21 aa, Entamoeba histolytica
QRIADEFSVAVVLTNQVVAQV

SEQ ID NO: 2693028 - protein, 18 aa, Entamoeba histolytica
QRICCSLIKVMESQNEEV

SEQ ID NO: 2693029 - protein, 32 aa, Entamoeba histolytica; identical to SEQ ID NO: 2501512

SEQ ID NO: 2693030 - protein, 17 aa, Entamoeba histolytica
QRIESLQQRTTKIQNKL

SEQ ID NO: 2693031 - protein, 27 aa, Entamoeba histolytica
QRIKCHRVFRVVFELIYQCNSEKHLTL

SEQ ID NO: 2693032 - protein, 19 aa, Entamoeba histolytica
QRIKQLFNHKIHQIESEIN

SEQ ID NO: 2693033 - protein, 17 aa, Entamoeba histolytica
QRILLPCGIDINKWYNT

SEQ ID NO: 2693034 - protein, 21 aa, Entamoeba histolytica
QRIPLTSLWMSQFPGKYPALT

SEQ ID NO: 2693035 - protein, 20 aa, Entamoeba histolytica
QRIPRYNLLLSDFLKHTDRN

SEQ ID NO: 2693036 - protein, 21 aa, Entamoeba histolytica
QRITHVFERLFNVALDVIEKV

SEQ ID NO: 2693037 - protein, 21 aa, Entamoeba histolytica
QRIVYLCLYDETISYTVINNL

SEQ ID NO: 2693038 - protein, 33 aa, Entamoeba histolytica
QRIYKWKDCGKIWRMRACCVIYVNFANKKESTC

SEQ ID NO: 2693039 - protein, 19 aa, Entamoeba histolytica
QRKGFGMKEAIIYHSEIFD

SEQ ID NO: 2693040 - protein, 25 aa, Entamoeba histolytica
QRKGYKKGNVQLVLFIGGTSKMPRI

SEQ ID NO: 2693041 - protein, 29 aa, Entamoeba histolytica
QRKIEFRSQWKYTICINSNDKKSICDARQ

SEQ ID NO: 2693042 - protein, 17 aa, Entamoeba histolytica
QRKRNVLTMEFMMNLIA

SEQ ID NO: 2693043 - protein, 23 aa, Entamoeba histolytica
QRLEFPKNHSISIMSENDKRSLL

SEQ ID NO: 2693044 - protein, 24 aa, Entamoeba histolytica
QRLFVGKSKKGFGYITDDPFIDDT

SEQ ID NO: 2693045 - protein, 21 aa, Entamoeba histolytica
QRLILIFQCVIRRVYLRFETE

SEQ ID NO: 2693046 - protein, 17 aa, Entamoeba histolytica
QRLKCSDQNLLPVGIYN

SEQ ID NO: 2693047 - protein, 20 aa, Entamoeba histolytica
QRLKTLTAQYIRLKELPSFF

SEQ ID NO: 2693048 - protein, 23 aa, Entamoeba histolytica
QRLKWFLEILGASYLLDKGASAF

SEQ ID NO: 2693049 - protein, 19 aa, Entamoeba histolytica
QRLLAAIVCKNNLVTNQLP

SEQ ID NO: 2693050 - protein, 18 aa, Entamoeba histolytica
QRLMRYPLLLKEIIKNTG

SEQ ID NO: 2693051 - protein, 19 aa, Entamoeba histolytica
QRLPRYKLLLTDLLRHYNW

SEQ ID NO: 2693052 - protein, 17 aa, Entamoeba histolytica
QRLPYFKKLFIECNGDD

SEQ ID NO: 2693053 - protein, 19 aa, Entamoeba histolytica
QRLRPIQALHHPFITREIF

SEQ ID NO: 2693054 - protein, 19 aa, Entamoeba histolytica
QRLTLRTNNEFQLPHSSIL

SEQ ID NO: 2693055 - protein, 21 aa, Entamoeba histolytica
QRLVQVKAMGGIVEDQEIDSF

SEQ ID NO: 2693056 - protein, 22 aa, Entamoeba histolytica
QRMKLVPRVKIFAGKAAIGYDM

SEQ ID NO: 2693057 - protein, 25 aa, Entamoeba histolytica
QRMMTCPFCRGEFTNSLTIKHTSRC

SEQ ID NO: 2693058 - protein, 19 aa, Entamoeba histolytica
QRNHFNFNFIKNSRKNLLA

SEQ ID NO: 2693059 - protein, 25 aa, Entamoeba histolytica
QRNIKYLKHIELMIENYRIELSKKK

SEQ ID NO: 2693060 - protein, 24 aa, Entamoeba histolytica
QRNIPREFYDSVSYDEYIHTKNSE

SEQ ID NO: 2693061 - protein, 26 aa, Entamoeba histolytica
QRNRKARIGVFAQHFVDQLNFKVNAI

SEQ ID NO: 2693062 - protein, 32 aa, Entamoeba histolytica
QRNSNAISFRYDWRTLLAVIRMHLPPIEYFVG

SEQ ID NO: 2693063 - protein, 18 aa, Entamoeba histolytica
QRPKRLEDIIGQESAIGI

SEQ ID NO: 2693064 - protein, 22 aa, Entamoeba histolytica
QRRIIDGISIITARDFSSNGSY

SEQ ID NO: 2693065 - protein, 19 aa, Entamoeba histolytica
QRRRGKLFKTQKEYYERIN

SEQ ID NO: 2693066 - protein, 33 aa, Entamoeba histolytica; identical to SEQ ID NO: 2501540

SEQ ID NO: 2693067 - protein, 25 aa, Entamoeba histolytica
QRSGRTEAYFPYKIPTRTIYGGKNI

SEQ ID NO: 2693068 - protein, 21 aa, Entamoeba histolytica
QRSPGLFAFQALVVAASSNKQ

SEQ ID NO: 2693069 - protein, 42 aa, Entamoeba histolytica
QRTLKSWVTFRNWAWWKLYVKARPMLKRRNFEEEGKKKDKEI

SEQ ID NO: 2693070 - protein, 19 aa, Entamoeba histolytica
QRTPFYPHCILFDEDQLIV

SEQ ID NO: 2693071 - protein, 17 aa, Entamoeba histolytica
QRTPKCCFANENGIFEE

SEQ ID NO: 2693072 - protein, 25 aa, Entamoeba histolytica
QRTQLFAPRVSKVVFGQRNTLGSIR

SEQ ID NO: 2693073 - protein, 21 aa, Entamoeba histolytica
QRVDLLSILLLYGADINIPNK

SEQ ID NO: 2693074 - protein, 17 aa, Entamoeba histolytica
QRVESGFDIELRAAVLH

SEQ ID NO: 2693075 - protein, 35 aa, Entamoeba histolytica
QRVFKKRIMQLYSRLIRRYPRMLSYYMEYANWCKS

SEQ ID NO: 2693076 - protein, 27 aa, Entamoeba histolytica
QRVGSSFRCLCHYIRLFCENPLCSDIF

SEQ ID NO: 2693077 - protein, 17 aa, Entamoeba histolytica
QRVLTLFSILIHDKNEN

SEQ ID NO: 2693078 - protein, 19 aa, Entamoeba histolytica
QRVQTEILRFGMVVEQIED

SEQ ID NO: 2693079 - protein, 20 aa, Entamoeba histolytica
QRWLHLKMKSPILISLLSGR

SEQ ID NO: 2693080 - protein, 19 aa, Entamoeba histolytica
QRYFCVHGGLSPSLKKVDQ

SEQ ID NO: 2693081 - protein, 25 aa, Entamoeba histolytica
QRYFIAYGGNVSFSFNSKVTHYITN

SEQ ID NO: 2693082 - protein, 18 aa, Entamoeba histolytica
QRYQLFSLYDKGILMDEE

SEQ ID NO: 2693083 - protein, 25 aa, Entamoeba histolytica
QRYVLKYFLTLCEDFDKKLKGDLIP

SEQ ID NO: 2693084 - protein, 19 aa, Entamoeba histolytica
QRYYNRFICINKKCFSIVE

SEQ ID NO: 2693085 - protein, 21 aa, Entamoeba histolytica
QSAAQPNAFASYSPQVNSPNQ

SEQ ID NO: 2693086 - protein, 27 aa, Entamoeba histolytica
QSAFGCCPCMKCNRYPLLPLGLYDNPG

SEQ ID NO: 2693087 - protein, 23 aa, Entamoeba histolytica
QSCITKSVLVTGRIPCCKTTHTM

SEQ ID NO: 2693088 - protein, 26 aa, Entamoeba histolytica
QSCSELIPLIPLPVFVCKQMVGNVVL

SEQ ID NO: 2693089 - protein, 17 aa, Entamoeba histolytica
QSDFKWSRQTDVGIQAF

SEQ ID NO: 2693090 - protein, 22 aa, Entamoeba histolytica
QSDIRIGVYGGRIGFAGEKVIL

SEQ ID NO: 2693091 - protein, 34 aa, Entamoeba histolytica
QSDKRKLKWEVILPFEIPYGFELLTKLIKMYTEN

SEQ ID NO: 2693092 - protein, 17 aa, Entamoeba histolytica
QSDRCQNSFFAKYISFK

SEQ ID NO: 2693093 - protein, 18 aa, Entamoeba histolytica
QSDRPAYCIDQIRQFGYF

SEQ ID NO: 2693094 - protein, 25 aa, Entamoeba histolytica
QSDVLLKKYSCIIIDEAHERSLNTD

SEQ ID NO: 2693095 - protein, 23 aa, Entamoeba histolytica
QSEFRFKLDGVISSRMDKVHSAF

SEQ ID NO: 2693096 - protein, 23 aa, Entamoeba histolytica
QSEFRFKLDGVISSRMEKVHSAF

SEQ ID NO: 2693097 - protein, 29 aa, Entamoeba histolytica
QSEGFEELRLEFCRLMIQYNIHENNYIEN

SEQ ID NO: 2693098 - protein, 24 aa, Entamoeba histolytica
QSEIAVLAICYFDGLNVQLNMDSK

SEQ ID NO: 2693099 - protein, 27 aa, Entamoeba histolytica
QSEIKFRYEFLITIFGEIFRRCKCLYI

SEQ ID NO: 2693100 - protein, 18 aa, Entamoeba histolytica
QSERVMLFVIRILTNLLA

SEQ ID NO: 2693101 - protein, 21 aa, Entamoeba histolytica
QSFEISMGMLQQASYFNHDRL

SEQ ID NO: 2693102 - protein, 22 aa, Entamoeba histolytica
QSFKAVFEFIMYKTLGSQEDHP

SEQ ID NO: 2693103 - protein, 22 aa, Entamoeba histolytica
QSFKHFFFFCREFNFLSKDDIA

SEQ ID NO: 2693104 - protein, 20 aa, Entamoeba histolytica
QSFKTWWNYIEYFDESHFQS

SEQ ID NO: 2693105 - protein, 21 aa, Entamoeba histolytica
QSFLCTPILIAAHRTLNLYSF

SEQ ID NO: 2693106 - protein, 27 aa, Entamoeba histolytica
QSFMLWQIRRMIGFAIVLTNFRLPIEQ

SEQ ID NO: 2693107 - protein, 24 aa, Entamoeba histolytica
QSFTRRILFNGAMYTVKCQIIVSD

SEQ ID NO: 2693108 - protein, 17 aa, Entamoeba histolytica
QSGAMKQDDICVGGSGS

SEQ ID NO: 2693109 - protein, 17 aa, Entamoeba histolytica
QSGDCTFEIENNLESQP

SEQ ID NO: 2693110 - protein, 26 aa, Entamoeba histolytica
QSGELKLIIEYGYLFPNIELIHITND

SEQ ID NO: 2693111 - protein, 17 aa, Entamoeba histolytica
QSGKICAIGIEKSFIGK

SEQ ID NO: 2693112 - protein, 29 aa, Entamoeba histolytica
QSGKLFVWEWDNWEYPKNALKGHPESIES

SEQ ID NO: 2693113 - protein, 26 aa, Entamoeba histolytica
QSGLKEIFELAAKVSMGLLDAVVSEA

SEQ ID NO: 2693114 - protein, 18 aa, Entamoeba histolytica
QSGQLFVFCKFFTSKLSL

SEQ ID NO: 2693115 - protein, 23 aa, Entamoeba histolytica
QSHCIECAYGYYLDSTYECNKYM

SEQ ID NO: 2693116 - protein, 18 aa, Entamoeba histolytica
QSHVCYLIDFGLSQRYLN

SEQ ID NO: 2693117 - protein, 18 aa, Entamoeba histolytica
QSHVVNSNLPISVSPVQT

SEQ ID NO: 2693118 - protein, 18 aa, Entamoeba histolytica
QSIARKGLINEIIVSSTQ

SEQ ID NO: 2693119 - protein, 17 aa, Entamoeba histolytica
QSIFIGLINRYAKIILK

SEQ ID NO: 2693120 - protein, 21 aa, Entamoeba histolytica
QSIHISQLFPRSKILPSKCFA

SEQ ID NO: 2693121 - protein, 24 aa, Entamoeba histolytica
QSIIKDQLQHVAHIQQLISEKSKD

SEQ ID NO: 2693122 - protein, 24 aa, Entamoeba histolytica
QSIKIMKIIHYFLSNGVSNELLGQ

SEQ ID NO: 2693123 - protein, 26 aa, Entamoeba histolytica
QSIKLKKSCFFNCLALKEACQTVPLY

SEQ ID NO: 2693124 - protein, 21 aa, Entamoeba histolytica
QSILCALKVTPPNSLALRSFN

SEQ ID NO: 2693125 - protein, 18 aa, Entamoeba histolytica
QSIPSFIQMCLKKYPESF

SEQ ID NO: 2693126 - protein, 17 aa, Entamoeba histolytica
QSISFSAKFCTNCGVLV

SEQ ID NO: 2693127 - protein, 26 aa, Entamoeba histolytica
QSISYRIGDSFGIISFQTEPKLCQYE

SEQ ID NO: 2693128 - protein, 23 aa, Entamoeba histolytica
QSKDVKIIISFESFCSYFADKNF

SEQ ID NO: 2693129 - protein, 20 aa, Entamoeba histolytica
QSKIRPLWRHYYEGTQGIVF

SEQ ID NO: 2693130 - protein, 21 aa, Entamoeba histolytica
QSKNRGVCLNELYESQVSFNK

SEQ ID NO: 2693131 - protein, 22 aa, Entamoeba histolytica
QSKWMGEQICKRGIEEGYKINI

SEQ ID NO: 2693132 - protein, 19 aa, Entamoeba histolytica
QSLDAFTGNLYTKFINIIS

SEQ ID NO: 2693133 - protein, 20 aa, Entamoeba histolytica
QSLDTWKNDFLSGANPTNAT

SEQ ID NO: 2693134 - protein, 17 aa, Entamoeba histolytica
QSLDWKLYFPNGKPAEM

SEQ ID NO: 2693135 - protein, 24 aa, Entamoeba histolytica
QSLEMKSRALLQFYLEIKPLPDED

SEQ ID NO: 2693136 - protein, 22 aa, Entamoeba histolytica
QSLKDLRFNRAPLLTDMQQIGT

SEQ ID NO: 2693137 - protein, 24 aa, Entamoeba histolytica
QSLLKIGDSFLQIFNQEDDIYNHV

SEQ ID NO: 2693138 - protein, 19 aa, Entamoeba histolytica
QSLPFAWTVPTLKHTLQLY

SEQ ID NO: 2693139 - protein, 28 aa, Entamoeba histolytica
QSLPFFMFEWNYLWFIHSLKFELAIRVF

SEQ ID NO: 2693140 - protein, 23 aa, Entamoeba histolytica
QSLPMICGILLDATFFVHNNRKL

SEQ ID NO: 2693141 - protein, 17 aa, Entamoeba histolytica
QSLRKMISFIFTELHFH

SEQ ID NO: 2693142 - protein, 19 aa, Entamoeba histolytica
QSMDYLRLFSLEQVIEKCQ

SEQ ID NO: 2693143 - protein, 26 aa, Entamoeba histolytica
QSMSLKLCFCPLCDKQQMLLERQPLQ

SEQ ID NO: 2693144 - protein, 19 aa, Entamoeba histolytica
QSNDVHSALPFPKQTKPNS

SEQ ID NO: 2693145 - protein, 19 aa, Entamoeba histolytica
QSNGCPLFVFQTNMHLNVL

SEQ ID NO: 2693146 - protein, 23 aa, Entamoeba histolytica
QSNGKGYRSAKMIDLDMIIGKYT

SEQ ID NO: 2693147 - protein, 23 aa, Entamoeba histolytica
QSNYCIFDDILFVTVHPIFNNPF

SEQ ID NO: 2693148 - protein, 38 aa, Entamoeba histolytica
QSPCCMLGSLPCHCCCYRCLSCFRIMLGDVKGDVNRMI

SEQ ID NO: 2693149 - protein, 21 aa, Entamoeba histolytica
QSPRISLVMHRIVKEMQEKVG

SEQ ID NO: 2693150 - protein, 22 aa, Entamoeba histolytica
QSPSKGGFWFWASKASDENEDE

SEQ ID NO: 2693151 - protein, 25 aa, Entamoeba histolytica
QSPSPFYLVCITIQLPIPHKEVIEE

SEQ ID NO: 2693152 - protein, 18 aa, Entamoeba histolytica
QSPVLEIFDNVRVSQFKQ

SEQ ID NO: 2693153 - protein, 28 aa, Entamoeba histolytica
QSQDDFRIVINREILQQMIAGFQQEANE

SEQ ID NO: 2693154 - protein, 18 aa, Entamoeba histolytica
QSQFDQLMFITGQYASSP

SEQ ID NO: 2693155 - protein, 29 aa, Entamoeba histolytica
QSQIECPFWLAPEIFKGEQWTKASDVYSY

SEQ ID NO: 2693156 - protein, 17 aa, Entamoeba histolytica
QSQPIILQPSIQNLSKQ

SEQ ID NO: 2693157 - protein, 28 aa, Entamoeba histolytica
QSQTQIMLYWSFVHLFTICLESHRDIDF

SEQ ID NO: 2693158 - protein, 25 aa, Entamoeba histolytica
QSREIAIQNIELWKQNDELKKAALE

SEQ ID NO: 2693159 - protein, 20 aa, Entamoeba histolytica
QSRWYRAPEVILGCQWTNKI

SEQ ID NO: 2693160 - protein, 23 aa, Entamoeba histolytica
QSSEKSSKELLSYLNKKNSCISN

SEQ ID NO: 2693161 - protein, 18 aa, Entamoeba histolytica
QSSFKVFIDSSIQHKHKT

SEQ ID NO: 2693162 - protein, 26 aa, Entamoeba histolytica
QSSMILKELFGTQITKIDETLIIKIE

SEQ ID NO: 2693163 - protein, 24 aa, Entamoeba histolytica
QSSRLLKKWLSSRMFSNYFNDGLI

SEQ ID NO: 2693164 - protein, 21 aa, Entamoeba histolytica
QSSRLVFYPKNSVQLFGVQNA

SEQ ID NO: 2693165 - protein, 24 aa, Entamoeba histolytica
QSSRSHSIFMMDLCGRNIGSNEQR

SEQ ID NO: 2693166 - protein, 18 aa, Entamoeba histolytica
QSSSILIFYCEYSGERGP

SEQ ID NO: 2693167 - protein, 21 aa, Entamoeba histolytica
QSTGCSIIQCLALKEQNNQVL

SEQ ID NO: 2693168 - protein, 22 aa, Entamoeba histolytica
QSTYPFCTFENLALDSIKDIKQ

SEQ ID NO: 2693169 - protein, 31 aa, Entamoeba histolytica; identical to SEQ ID NO: 2501651

SEQ ID NO: 2693170 - protein, 17 aa, Entamoeba histolytica
QSVIYPGIIKYFKDIKE

SEQ ID NO: 2693171 - protein, 24 aa, Entamoeba histolytica
QSVKPIVLFWALRITSILLCSSAD

SEQ ID NO: 2693172 - protein, 24 aa, Entamoeba histolytica
QSVREVLQFNWKRGVDDGAVASCI

SEQ ID NO: 2693173 - protein, 17 aa, Entamoeba histolytica
QSVVPLLELCLKRKRPL

SEQ ID NO: 2693174 - protein, 17 aa, Entamoeba histolytica
QSVVYFRNGLIQNDDVI

SEQ ID NO: 2693175 - protein, 33 aa, Entamoeba histolytica
QSYEEAIKFLTEWAEGCGVVLRKGSGNNKTMKD

SEQ ID NO: 2693176 - protein, 25 aa, Entamoeba histolytica
QSYERRKRIVGFPLSLKRLEVTYDQ

SEQ ID NO: 2693177 - protein, 27 aa, Entamoeba histolytica
QSYLIMPIQRIPRYVLLIKDMLKNSPP

SEQ ID NO: 2693178 - protein, 17 aa, Entamoeba histolytica
QSYLKGYNLYVANNAYA

SEQ ID NO: 2693179 - protein, 17 aa, Entamoeba histolytica
QSYYLERIFSLYLPMLF

SEQ ID NO: 2693180 - protein, 24 aa, Entamoeba histolytica
QSYYRKSNAVIMVYDISRKETFEQ

SEQ ID NO: 2693181 - protein, 18 aa, Entamoeba histolytica
QTAAIFLRQILKKYYQEE

SEQ ID NO: 2693182 - protein, 17 aa, Entamoeba histolytica
QTAQWKKAILDALNHCP

SEQ ID NO: 2693183 - protein, 25 aa, Entamoeba histolytica
QTEIFKHCWLVLELLRKSIQQTGAD

SEQ ID NO: 2693184 - protein, 23 aa, Entamoeba histolytica
QTELKVKALLIIRELNNLRVTTF

SEQ ID NO: 2693185 - protein, 18 aa, Entamoeba histolytica
QTEWKCKCKIKEEDIERA

SEQ ID NO: 2693186 - protein, 18 aa, Entamoeba histolytica
QTEYRGGAAKVILKAFQM

SEQ ID NO: 2693187 - protein, 20 aa, Entamoeba histolytica
QTFCPFRLVDEINQGMDPLN

SEQ ID NO: 2693188 - protein, 32 aa, Entamoeba histolytica; identical to SEQ ID NO: 2501670

SEQ ID NO: 2693189 - protein, 23 aa, Entamoeba histolytica
QTFPSTIRWFISKQIYSVGVTED

SEQ ID NO: 2693190 - protein, 25 aa, Entamoeba histolytica
QTGSSFPLSICEFEKAEKFIGLAHI

SEQ ID NO: 2693191 - protein, 17 aa, Entamoeba histolytica
QTICAKISMKNVKLPET

SEQ ID NO: 2693192 - protein, 23 aa, Entamoeba histolytica
QTIEIPYEYVIGIYPNKSISSHI

SEQ ID NO: 2693193 - protein, 25 aa, Entamoeba histolytica
QTILEYKLLLGFIPLFSSLNTIQNL

SEQ ID NO: 2693194 - protein, 17 aa, Entamoeba histolytica
QTIPFNIEYDAFCSDVL

SEQ ID NO: 2693195 - protein, 25 aa, Entamoeba histolytica
QTKCCPICKFEIIMTSSLKSTKKEM

SEQ ID NO: 2693196 - protein, 23 aa, Entamoeba histolytica
QTKFPLERLYIIQPENIDVNALN

SEQ ID NO: 2693197 - protein, 20 aa, Entamoeba histolytica
QTKIKLSFIVLSLLLSNYSV

SEQ ID NO: 2693198 - protein, 20 aa, Entamoeba histolytica
QTKKSLRFVQRFESSNKKNR

SEQ ID NO: 2693199 - protein, 25 aa, Entamoeba histolytica
QTKPPRLPCSLKRDSPPLPKISQRE

SEQ ID NO: 2693200 - protein, 17 aa, Entamoeba histolytica
QTKRTKCTERLVKINSL

SEQ ID NO: 2693201 - protein, 23 aa, Entamoeba histolytica
QTLKSICRTLRKFIEDFGKDEIS

SEQ ID NO: 2693202 - protein, 17 aa, Entamoeba histolytica
QTLMFSATFPKQIQRLA

SEQ ID NO: 2693203 - protein, 24 aa, Entamoeba histolytica
QTLRECDELRKVQIDIVSSSTQKD

SEQ ID NO: 2693204 - protein, 19 aa, Entamoeba histolytica
QTLRFCSKEIFRIKNYQII

SEQ ID NO: 2693205 - protein, 17 aa, Entamoeba histolytica
QTLRLTLFNEFLLCIKK

SEQ ID NO: 2693206 - protein, 17 aa, Entamoeba histolytica
QTLYCFEVVKRDPSSLP

SEQ ID NO: 2693207 - protein, 20 aa, Entamoeba histolytica
QTLYSVYLWIGKQTDQISRI

SEQ ID NO: 2693208 - protein, 19 aa, Entamoeba histolytica
QTNECRGFAFIKYQKTEDG

SEQ ID NO: 2693209 - protein, 17 aa, Entamoeba histolytica
QTNFPFQMEQILFEYFG

SEQ ID NO: 2693210 - protein, 19 aa, Entamoeba histolytica
QTNGFAFNFQQECKTNTIS

SEQ ID NO: 2693211 - protein, 19 aa, Entamoeba histolytica
QTNMCLLCGEANHRPATCE

SEQ ID NO: 2693212 - protein, 35 aa, Entamoeba histolytica
QTNWLRPLIIPLLKLKPYELLQHMIIITDDLPQLD

SEQ ID NO: 2693213 - protein, 22 aa, Entamoeba histolytica
QTPLLPLSCDFHLENNNLTVLN

SEQ ID NO: 2693214 - protein, 19 aa, Entamoeba histolytica
QTPVLCYYDGNNLYLPNGV

SEQ ID NO: 2693215 - protein, 25 aa, Entamoeba histolytica
QTQAMWDWLDLLLPALSQLPYLKTS

SEQ ID NO: 2693216 - protein, 24 aa, Entamoeba histolytica
QTQRIPQLLRFVSDLSPQESMVIN

SEQ ID NO: 2693217 - protein, 29 aa, Entamoeba histolytica
QTQRIPQLLRFVSDLSPQESMVINELLQT

SEQ ID NO: 2693218 - protein, 20 aa, Entamoeba histolytica
QTQYRIAMEIHESKNREKFL

SEQ ID NO: 2693219 - protein, 22 aa, Entamoeba histolytica
QTRIHFSRYGLAETIVDDAFTG

SEQ ID NO: 2693220 - protein, 21 aa, Entamoeba histolytica
QTRIKIGLNSKMPNRFPPVVF

SEQ ID NO: 2693221 - protein, 17 aa, Entamoeba histolytica
QTSIWGYIPVPKGNSGE

SEQ ID NO: 2693222 - protein, 23 aa, Entamoeba histolytica
QTSKVIFLPEIHSIPKPTTEEEM

SEQ ID NO: 2693223 - protein, 17 aa, Entamoeba histolytica
QTSLRYSIQLISLAMLK

SEQ ID NO: 2693224 - protein, 28 aa, Entamoeba histolytica
QTSNDHFCIFDLPAGSYEIFAYNDESLE

SEQ ID NO: 2693225 - protein, 24 aa, Entamoeba histolytica
QTTKCIFEQMLPIITLLMSDPFGN

SEQ ID NO: 2693226 - protein, 17 aa, Entamoeba histolytica
QTTPFVIGYLMKEYEYS

SEQ ID NO: 2693227 - protein, 18 aa, Entamoeba histolytica
QTTRLNEVLLKFQETSKS

SEQ ID NO: 2693228 - protein, 25 aa, Entamoeba histolytica
QTTSEATFTWVLPRILDKTQFTFVS

SEQ ID NO: 2693229 - protein, 17 aa, Entamoeba histolytica
QTVCGVQLMPPVPLPDI

SEQ ID NO: 2693230 - protein, 17 aa, Entamoeba histolytica
QTVLCTGNLCGKETYDI

SEQ ID NO: 2693231 - protein, 22 aa, Entamoeba histolytica
QTVLLSIKFKSQIHFDKREEMT

SEQ ID NO: 2693232 - protein, 18 aa, Entamoeba histolytica
QTVMNAIFLKWDLESLNS

SEQ ID NO: 2693233 - protein, 17 aa, Entamoeba histolytica
QTWKLESEIAMTFLMSD

SEQ ID NO: 2693234 - protein, 20 aa, Entamoeba histolytica
QTWNSRIIKDQSLALMNVYS

SEQ ID NO: 2693235 - protein, 24 aa, Entamoeba histolytica
QTYKGKMLFMSPFFLNKLQSYFSL

SEQ ID NO: 2693236 - protein, 17 aa, Entamoeba histolytica
QVADIDFIASIEILGKR

SEQ ID NO: 2693237 - protein, 17 aa, Entamoeba histolytica
QVALRVQLITKMKAYCN

SEQ ID NO: 2693238 - protein, 23 aa, Entamoeba histolytica
QVAPLDLCRYISILDSGNDIATN

SEQ ID NO: 2693239 - protein, 26 aa, Entamoeba histolytica
QVARILKLDGVFCLLTDSPIVVNIVN

SEQ ID NO: 2693240 - protein, 26 aa, Entamoeba histolytica
QVCCKPFKCVFERTIERSLPKQDEYF

SEQ ID NO: 2693241 - protein, 27 aa, Entamoeba histolytica
QVCRRLPWSKCVRRPSTRAVRLPDPQG

SEQ ID NO: 2693242 - protein, 23 aa, Entamoeba histolytica
QVECLRGKFGSCGGINCFHSSDS

SEQ ID NO: 2693243 - protein, 25 aa, Entamoeba histolytica
QVEDFWKHICIIWTKCTYHISKNEF

SEQ ID NO: 2693244 - protein, 23 aa, Entamoeba histolytica
QVEEMLKLLSLPVDEQGAQLPEK

SEQ ID NO: 2693245 - protein, 21 aa, Entamoeba histolytica
QVEKCKVALLKRNDEEVKTLA

SEQ ID NO: 2693246 - protein, 17 aa, Entamoeba histolytica
QVEKVFLAEKVDVIVSE

SEQ ID NO: 2693247 - protein, 22 aa, Entamoeba histolytica
QVELARALALRLENEHDPKRKA

SEQ ID NO: 2693248 - protein, 28 aa, Entamoeba histolytica
QVEMPEYWLEAGNPWEIVRQDVKYEIKF

SEQ ID NO: 2693249 - protein, 17 aa, Entamoeba histolytica
QVGIGMKQLNAVIGGEG

SEQ ID NO: 2693250 - protein, 24 aa, Entamoeba histolytica
QVIKNLYLLLGSVDFLGNPVGLVS

SEQ ID NO: 2693251 - protein, 24 aa, Entamoeba histolytica
QVILDCLKPVYIPLLSETMFDVNF

SEQ ID NO: 2693252 - protein, 23 aa, Entamoeba histolytica
QVIPKYCFSHCNALLSITLPTSI

SEQ ID NO: 2693253 - protein, 28 aa, Entamoeba histolytica
QVIQEKRQINPIQMEKIIQVKQKSPSET

SEQ ID NO: 2693254 - protein, 26 aa, Entamoeba histolytica
QVITTMIPKFILRCSIEVIQELFNFI

SEQ ID NO: 2693255 - protein, 17 aa, Entamoeba histolytica
QVIWYEVNYQDYLKEKA

SEQ ID NO: 2693256 - protein, 18 aa, Entamoeba histolytica
QVKCVSFDGDVFNGKGIV

SEQ ID NO: 2693257 - protein, 25 aa, Entamoeba histolytica
QVKEFLKREMNIRIGKIKEIGMNYI

SEQ ID NO: 2693258 - protein, 17 aa, Entamoeba histolytica
QVKMKLRSLLLKKKNNP

SEQ ID NO: 2693259 - protein, 25 aa, Entamoeba histolytica
QVKRLKWAMKAMYQACNIAYSSANK

SEQ ID NO: 2693260 - protein, 21 aa, Entamoeba histolytica
QVLCSLPPFVEYLKKVNPTDD

SEQ ID NO: 2693261 - protein, 17 aa, Entamoeba histolytica
QVLSGTFTYTWPPVTSE

SEQ ID NO: 2693262 - protein, 24 aa, Entamoeba histolytica
QVLSRLSYISALGMMTRLNSHFEK

SEQ ID NO: 2693263 - protein, 31 aa, Entamoeba histolytica; identical to SEQ ID NO: 2501757

SEQ ID NO: 2693264 - protein, 18 aa, Entamoeba histolytica
QVMNRLETVTARLEKLEG

SEQ ID NO: 2693265 - protein, 17 aa, Entamoeba histolytica
QVNELFHRLSVSDISSF

SEQ ID NO: 2693266 - protein, 27 aa, Entamoeba histolytica
QVNKKCKRAICSLRYSQWYNKRSNQIF

SEQ ID NO: 2693267 - protein, 25 aa, Entamoeba histolytica
QVNSALRPKAWQILLGYLPPNQFEW

SEQ ID NO: 2693268 - protein, 18 aa, Entamoeba histolytica
QVNTDFKFSIAEQNKEHN

SEQ ID NO: 2693269 - protein, 24 aa, Entamoeba histolytica
QVPIMTLLMHYARTQFTDPNLVEL

SEQ ID NO: 2693270 - protein, 23 aa, Entamoeba histolytica
QVQLTRYIPFIFKSTLTLEEKEY

SEQ ID NO: 2693271 - protein, 18 aa, Entamoeba histolytica
QVRRVIKNGHIKDKNIQK

SEQ ID NO: 2693272 - protein, 20 aa, Entamoeba histolytica
QVRYKFPIHFVLFSSYCSEI

SEQ ID NO: 2693273 - protein, 24 aa, Entamoeba histolytica
QVSDELIELIPIINEFQKSIEEMK

SEQ ID NO: 2693274 - protein, 18 aa, Entamoeba histolytica
QVTCYKCGQVGHKSVDCP

SEQ ID NO: 2693275 - protein, 23 aa, Entamoeba histolytica
QVTWSELNIPYSEETTLVKSSHT

SEQ ID NO: 2693276 - protein, 18 aa, Entamoeba histolytica
QVVIQFAMSCFEYSTNDN

SEQ ID NO: 2693277 - protein, 27 aa, Entamoeba histolytica
QVWPGALYIENEWGHKIVLLDDSNPYN

SEQ ID NO: 2693278 - protein, 23 aa, Entamoeba histolytica
QVYPEQRFFSYIFPTIQFTLTKI

SEQ ID NO: 2693279 - protein, 18 aa, Entamoeba histolytica
QVYSIYFGACYSFIQQDT

SEQ ID NO: 2693280 - protein, 19 aa, Entamoeba histolytica
QWCDDFIGFFTINSSIQST

SEQ ID NO: 2693281 - protein, 27 aa, Entamoeba histolytica
QWFEVPNEAFGRILPKMSMYIDHIPHS

SEQ ID NO: 2693282 - protein, 19 aa, Entamoeba histolytica
QWFQYTYLYVCLKRSPGGI

SEQ ID NO: 2693283 - protein, 18 aa, Entamoeba histolytica
QWIAICTINSHFLNELEK

SEQ ID NO: 2693284 - protein, 20 aa, Entamoeba histolytica
QWIDYCINTFYSYEHVSTIY

SEQ ID NO: 2693285 - protein, 24 aa, Entamoeba histolytica
QWKYWPYSLHCHRLMIYANSIGKG

SEQ ID NO: 2693286 - protein, 19 aa, Entamoeba histolytica
QWLQCLKIIRCDASNEVIP

SEQ ID NO: 2693287 - protein, 29 aa, Entamoeba histolytica
QWMSCYKCHCFFCWVCMQITNDHQHKPGQ

SEQ ID NO: 2693288 - protein, 22 aa, Entamoeba histolytica
QWNARYAALVALSLSVIPGKYI

SEQ ID NO: 2693289 - protein, 24 aa, Entamoeba histolytica
QWNEGLIDVMLLRLDMFPDEKDTI

SEQ ID NO: 2693290 - protein, 24 aa, Entamoeba histolytica
QWTSEIFDPAYFIVVIDSLKTISV

SEQ ID NO: 2693291 - protein, 18 aa, Entamoeba histolytica
QWVDEVVDGIPYWDTELF

SEQ ID NO: 2693292 - protein, 30 aa, Entamoeba histolytica
QWYSSLTFLKRLSCFSDKEIMLFNRIKNIF

SEQ ID NO: 2693293 - protein, 26 aa, Entamoeba histolytica
QYDDVLRINCQLIEIADGCERCRQRI

SEQ ID NO: 2693294 - protein, 17 aa, Entamoeba histolytica
QYEIPTFMTLFSKVIQC

SEQ ID NO: 2693295 - protein, 31 aa, Entamoeba histolytica
QYERGARSLWIWRKCKSYLFDDFKDILSLPK

SEQ ID NO: 2693296 - protein, 27 aa, Entamoeba histolytica
QYFERRGNIELAINFLERGRAAVNCPL

SEQ ID NO: 2693297 - protein, 17 aa, Entamoeba histolytica
QYFLEKYFSILYYRNND

SEQ ID NO: 2693298 - protein, 35 aa, Entamoeba histolytica
QYFPEPIVFKVLFEVYKRLYGITFCYNKSIKGWHQ

SEQ ID NO: 2693299 - protein, 19 aa, Entamoeba histolytica
QYGGWTISFEYIQSLGNII

SEQ ID NO: 2693300 - protein, 18 aa, Entamoeba histolytica
QYGIPKGIFFSMPVVCYG

SEQ ID NO: 2693301 - protein, 18 aa, Entamoeba histolytica
QYIAYTFFQIPEFRLELL

SEQ ID NO: 2693302 - protein, 25 aa, Entamoeba histolytica
QYIGSRLKNVSAFLKKNGFTSRRES

SEQ ID NO: 2693303 - protein, 17 aa, Entamoeba histolytica
QYIGYTWISNENVIIHF

SEQ ID NO: 2693304 - protein, 18 aa, Entamoeba histolytica
QYIKEIIQTIELGIGENG

SEQ ID NO: 2693305 - protein, 27 aa, Entamoeba histolytica
QYIKLKLRFENEIHLFKISPIDKLEKL

SEQ ID NO: 2693306 - protein, 33 aa, Entamoeba histolytica
QYIKQKKLECPLLFLWGNLYGNLQFVKEQNENG

SEQ ID NO: 2693307 - protein, 18 aa, Entamoeba histolytica
QYILSILCSVTYLQINTS

SEQ ID NO: 2693308 - protein, 19 aa, Entamoeba histolytica
QYINDVLKYMCLILSIQPI

SEQ ID NO: 2693309 - protein, 27 aa, Entamoeba histolytica
QYIQFAFRWFNCCLIREFPINLSLILW

SEQ ID NO: 2693310 - protein, 23 aa, Entamoeba histolytica
QYIRLKELPSFFSKFPSLINLDV

SEQ ID NO: 2693311 - protein, 17 aa, Entamoeba histolytica
QYKEYLLSFFSLNEIDE

SEQ ID NO: 2693312 - protein, 24 aa, Entamoeba histolytica
QYLFELLNILTLKLLEIHIPPHRN

SEQ ID NO: 2693313 - protein, 24 aa, Entamoeba histolytica
QYLIQRLYPIFDIFEIVEIGKQIE

SEQ ID NO: 2693314 - protein, 27 aa, Entamoeba histolytica
QYLIRYIYRQNIQFARNAVWALTTAIL

SEQ ID NO: 2693315 - protein, 23 aa, Entamoeba histolytica
QYLKRKFGNKVSWINEKTPSVES

SEQ ID NO: 2693316 - protein, 17 aa, Entamoeba histolytica
QYNALKLLFPHSKLFFC

SEQ ID NO: 2693317 - protein, 18 aa, Entamoeba histolytica
QYNFCGSSMIFYPTLEEQ

SEQ ID NO: 2693318 - protein, 18 aa, Entamoeba histolytica
QYNGGIFVTQFTLNGKYI

SEQ ID NO: 2693319 - protein, 19 aa, Entamoeba histolytica
QYNTLHFILLMRSLIITPF

SEQ ID NO: 2693320 - protein, 26 aa, Entamoeba histolytica
QYNYKCDLWSLGGLLYFLRTHTYPLS

SEQ ID NO: 2693321 - protein, 23 aa, Entamoeba histolytica
QYPAELLYTLQLITSIEGMRQTA

SEQ ID NO: 2693322 - protein, 27 aa, Entamoeba histolytica
QYPKGDVGLLLRWSDGEIKDIIPRGYA

SEQ ID NO: 2693323 - protein, 20 aa, Entamoeba histolytica
QYPLYAEKLLQCMRINSTNS

SEQ ID NO: 2693324 - protein, 18 aa, Entamoeba histolytica
QYQITEWMLRLFKESRGI

SEQ ID NO: 2693325 - protein, 19 aa, Entamoeba histolytica
QYQITEWMLRLFKESRGIK

SEQ ID NO: 2693326 - protein, 20 aa, Entamoeba histolytica
QYRKSCFERDFSSVYHGILD

SEQ ID NO: 2693327 - protein, 25 aa, Entamoeba histolytica
QYSRFPSHFQCCIEDFELGKIDIEI

SEQ ID NO: 2693328 - protein, 23 aa, Entamoeba histolytica
QYSRLNLTAIYIVNSFYIQALMN

SEQ ID NO: 2693329 - protein, 20 aa, Entamoeba histolytica
QYSYVKVFFLPKEDLSPDLF

SEQ ID NO: 2693330 - protein, 22 aa, Entamoeba histolytica
QYTKECDIWSIGIILYIILSGT

SEQ ID NO: 2693331 - protein, 20 aa, Entamoeba histolytica
QYYCKYCQRVLDKVLDEGQE

SEQ ID NO: 2693332 - protein, 21 aa, Entamoeba histolytica
QYYLPLCVYLAIQREDKTHSD

SEQ ID NO: 2693333 - protein, 29 aa, Entamoeba histolytica
QYYPKGENWQHVFTLGGIESDFLYKVNTT

SEQ ID NO: 2693334 - protein, 25 aa, Entamoeba histolytica
RAAVELADQVLICVGNIIGHYYTQI

SEQ ID NO: 2693335 - protein, 18 aa, Entamoeba histolytica
RACMSRIDLNGKWLQEKV

SEQ ID NO: 2693336 - protein, 28 aa, Entamoeba histolytica
RADIKSHQSFPCIPFFGVYLQDLTFIHE

SEQ ID NO: 2693337 - protein, 25 aa, Entamoeba histolytica
RADRTCKKFSVACSRKDMFKKLVIC

SEQ ID NO: 2693338 - protein, 19 aa, Entamoeba histolytica
RADSNLALSQKKLKAQPTE

SEQ ID NO: 2693339 - protein, 26 aa, Entamoeba histolytica
RADVYLRLPRNLSYQEKIWDHAAGYL

SEQ ID NO: 2693340 - protein, 22 aa, Entamoeba histolytica
RAEKSHPFYDLVVKRFKELYAE

SEQ ID NO: 2693341 - protein, 19 aa, Entamoeba histolytica
RAELLRRIRKNNGSLSIEN

SEQ ID NO: 2693342 - protein, 28 aa, Entamoeba histolytica
RAERFDCPSCIEMQGYISVLEEIIQKKN

SEQ ID NO: 2693343 - protein, 19 aa, Entamoeba histolytica
RAEVLEMIGDLPFAEIKPL

SEQ ID NO: 2693344 - protein, 22 aa, Entamoeba histolytica
RAFNSKVCCCSNVLIIVITEDG

SEQ ID NO: 2693345 - protein, 20 aa, Entamoeba histolytica
RAFSKTVLPLVEYIQTSMRP

SEQ ID NO: 2693346 - protein, 22 aa, Entamoeba histolytica
RAFYLCLEKLVPFIEELERYEM

SEQ ID NO: 2693347 - protein, 27 aa, Entamoeba histolytica
RAGRTRPGQCYRLYTEKGFNESLPKQT

SEQ ID NO: 2693348 - protein, 26 aa, Entamoeba histolytica
RAHSGWAIKIAEGILKRKNAFERLRK

SEQ ID NO: 2693349 - protein, 20 aa, Entamoeba histolytica
RAIDEPIVFREDSSIFVENY

SEQ ID NO: 2693350 - protein, 21 aa, Entamoeba histolytica
RAIEWCFQAIAFKELPKDHVK

SEQ ID NO: 2693351 - protein, 17 aa, Entamoeba histolytica
RAIKSGDKFIVKNGVFY

SEQ ID NO: 2693352 - protein, 20 aa, Entamoeba histolytica
RAKEFGLKYFEVSAKTGVGI

SEQ ID NO: 2693353 - protein, 18 aa, Entamoeba histolytica
RAKIFLENLLQKKYKEAL

SEQ ID NO: 2693354 - protein, 17 aa, Entamoeba histolytica
RAKKEWFEKQSIATQSS

SEQ ID NO: 2693355 - protein, 17 aa, Entamoeba histolytica
RAKMIKWNLGKLPNQLT

SEQ ID NO: 2693356 - protein, 18 aa, Entamoeba histolytica
RAKRAFNPAEWIEKKCTM

SEQ ID NO: 2693357 - protein, 19 aa, Entamoeba histolytica
RAKVIKVNSMLSGLHDLQL

SEQ ID NO: 2693358 - protein, 19 aa, Entamoeba histolytica
RALCYLRINENELALADSF

SEQ ID NO: 2693359 - protein, 17 aa, Entamoeba histolytica
RALEVLDPFESVVYSQG

SEQ ID NO: 2693360 - protein, 18 aa, Entamoeba histolytica
RALFEAWSDTNLLRKNNL

SEQ ID NO: 2693361 - protein, 25 aa, Entamoeba histolytica
RALGDLKCHPALTCEPEVLTFNRSN

SEQ ID NO: 2693362 - protein, 20 aa, Entamoeba histolytica
RALKMLDIFHEIKKHVITKV

SEQ ID NO: 2693363 - protein, 26 aa, Entamoeba histolytica
RALLDGSLMCYHRLLLKGNIETEKSQ

SEQ ID NO: 2693364 - protein, 18 aa, Entamoeba histolytica
RALLKVNHTKGLIKLTPK

SEQ ID NO: 2693365 - protein, 18 aa, Entamoeba histolytica
RALLPIISILVQRITHVF

SEQ ID NO: 2693366 - protein, 19 aa, Entamoeba histolytica
RALLRTCNKFGEFRKDDPS

SEQ ID NO: 2693367 - protein, 20 aa, Entamoeba histolytica
RALRCYLRALDYLDNDYRIP

SEQ ID NO: 2693368 - protein, 25 aa, Entamoeba histolytica
RALSRESLRALSCKSISECNPNGQC

SEQ ID NO: 2693369 - protein, 18 aa, Entamoeba histolytica
RALTLKFILTISEKELIQ

SEQ ID NO: 2693370 - protein, 19 aa, Entamoeba histolytica
RAMMLLMERCKVIIEGAGA

SEQ ID NO: 2693371 - protein, 19 aa, Entamoeba histolytica
RAMRNRALELFVPSLDDID

SEQ ID NO: 2693372 - protein, 28 aa, Entamoeba histolytica
RAMWLKYFNERGIRVIFYSALKENKLAE

SEQ ID NO: 2693373 - protein, 24 aa, Entamoeba histolytica
RANALKWIIQLLLHECPITEKIKI

SEQ ID NO: 2693374 - protein, 19 aa, Entamoeba histolytica
RANALKWVVDLIIHSPSLL

SEQ ID NO: 2693375 - protein, 18 aa, Entamoeba histolytica
RANIQFREIKCEKGVIDQ

SEQ ID NO: 2693376 - protein, 19 aa, Entamoeba histolytica
RANNLVIRRQFNLSNQSNW

SEQ ID NO: 2693377 - protein, 19 aa, Entamoeba histolytica
RANRQFELISLSTCLNEPI

SEQ ID NO: 2693378 - protein, 25 aa, Entamoeba histolytica
RAPIKCSHCGAVINPYCSVDYNSNL

SEQ ID NO: 2693379 - protein, 19 aa, Entamoeba histolytica
RAPNVCKMLARVDEISHWI

SEQ ID NO: 2693380 - protein, 19 aa, Entamoeba histolytica
RAPSQDVIPNFDIDPSNAL

SEQ ID NO: 2693381 - protein, 22 aa, Entamoeba histolytica
RAQDVPLIKGWYLEHIQKNYPV

SEQ ID NO: 2693382 - protein, 20 aa, Entamoeba histolytica
RAQFIPVCLNNSYEMFEIGL

SEQ ID NO: 2693383 - protein, 19 aa, Entamoeba histolytica
RAQGKFKILGEYPYKNYYN

SEQ ID NO: 2693384 - protein, 21 aa, Entamoeba histolytica
RAQILSMDYLHSAIQPNITAT

SEQ ID NO: 2693385 - protein, 25 aa, Entamoeba histolytica
RAQWASAEDFVFPGAIQYFGPSEVC

SEQ ID NO: 2693386 - protein, 18 aa, Entamoeba histolytica
RAQYTLTQMFPKAIQCIK

SEQ ID NO: 2693387 - protein, 17 aa, Entamoeba histolytica
RARFEEINIDLFKSTIE

SEQ ID NO: 2693388 - protein, 17 aa, Entamoeba histolytica
RARFEEINIDLFKSTIV

SEQ ID NO: 2693389 - protein, 21 aa, Entamoeba histolytica
RARMWECFTHATSTKAVHEEY

SEQ ID NO: 2693390 - protein, 24 aa, Entamoeba histolytica
RARNSAPCVIFFDELDALAPKRSE

SEQ ID NO: 2693391 - protein, 17 aa, Entamoeba histolytica
RASGIRFYEHICPGSKT

SEQ ID NO: 2693392 - protein, 18 aa, Entamoeba histolytica
RASLYDFLLRCFVYNPKD

SEQ ID NO: 2693393 - protein, 18 aa, Entamoeba histolytica
RASMKLGLDQAILSNINN

SEQ ID NO: 2693394 - protein, 29 aa, Entamoeba histolytica
RASSRELLKHKWFITNGIKVEEEVKKTNM

SEQ ID NO: 2693395 - protein, 24 aa, Entamoeba histolytica
RATEKDLRLSLQYNPEDNIIGSQK

SEQ ID NO: 2693396 - protein, 20 aa, Entamoeba histolytica
RATFCYAATVALNYSLACGV

SEQ ID NO: 2693397 - protein, 20 aa, Entamoeba histolytica
RATFCYAATVALNYSLTCGI

SEQ ID NO: 2693398 - protein, 25 aa, Entamoeba histolytica
RATGTLRVKKFLLFLRELIEEKQNN

SEQ ID NO: 2693399 - protein, 20 aa, Entamoeba histolytica
RATVIYCIIKCIKHYPKMFD

SEQ ID NO: 2693400 - protein, 17 aa, Entamoeba histolytica
RAVDVLYALCTPQSVRK

SEQ ID NO: 2693401 - protein, 27 aa, Entamoeba histolytica
RAVYICGDKGYMPAALLVGFTMQKHYL

SEQ ID NO: 2693402 - protein, 18 aa, Entamoeba histolytica
RAWKTVLEMLRDRGYITS

SEQ ID NO: 2693403 - protein, 24 aa, Entamoeba histolytica
RAWRKDHPPGFVARPIMKKGQPDL

SEQ ID NO: 2693404 - protein, 24 aa, Entamoeba histolytica
RAYETIKLLHIFYDIKYLTKRRNE

SEQ ID NO: 2693405 - protein, 20 aa, Entamoeba histolytica
RAYFVLSLHYGIRCLEKEKY

SEQ ID NO: 2693406 - protein, 18 aa, Entamoeba histolytica
RAYHVLRQNASLIVSFFT

SEQ ID NO: 2693407 - protein, 17 aa, Entamoeba histolytica
RAYHVYKTKELIEKYGS

SEQ ID NO: 2693408 - protein, 19 aa, Entamoeba histolytica
RCALGVQLCGIDFIKENEQ

SEQ ID NO: 2693409 - protein, 19 aa, Entamoeba histolytica
RCAQISSFMYAIPESNSLI

SEQ ID NO: 2693410 - protein, 20 aa, Entamoeba histolytica
RCCDCFSPDPDWAIINMGIL

SEQ ID NO: 2693411 - protein, 20 aa, Entamoeba histolytica
RCDIWKKCLGYNFEEEKYSK

SEQ ID NO: 2693412 - protein, 18 aa, Entamoeba histolytica
RCFRGCSSLTSINIEDVK

SEQ ID NO: 2693413 - protein, 22 aa, Entamoeba histolytica
RCGDCGCVLAGIRHIRPHQYGW

SEQ ID NO: 2693414 - protein, 22 aa, Entamoeba histolytica
RCHGEWCWMCRGDWKTHGSQTG

SEQ ID NO: 2693415 - protein, 22 aa, Entamoeba histolytica
RCIHGKKMLELLGGYDVLLILM

SEQ ID NO: 2693416 - protein, 21 aa, Entamoeba histolytica
RCIRKGRTRQRDVVQIKTSTE

SEQ ID NO: 2693417 - protein, 20 aa, Entamoeba histolytica
RCISCGCCASVCPVGAIIFN

SEQ ID NO: 2693418 - protein, 24 aa, Entamoeba histolytica
RCKEIRILFEYCDMGTFDQFIPSC

SEQ ID NO: 2693419 - protein, 27 aa, Entamoeba histolytica
RCKGKTKEEAICLVSKEAVVVIIQERE

SEQ ID NO: 2693420 - protein, 21 aa, Entamoeba histolytica
RCLLCKEIQDAFVQLVKTISK

SEQ ID NO: 2693421 - protein, 24 aa, Entamoeba histolytica
RCLSLIKKYIEVFRSIDKLEDQEW

SEQ ID NO: 2693422 - protein, 17 aa, Entamoeba histolytica
RCMKLTKIELPITVESI

SEQ ID NO: 2693423 - protein, 19 aa, Entamoeba histolytica
RCNCEELIRITALAKIAAR

SEQ ID NO: 2693424 - protein, 25 aa, Entamoeba histolytica
RCNQRLIKHFWIMRELSLTSFINCK

SEQ ID NO: 2693425 - protein, 20 aa, Entamoeba histolytica
RCQDRITFDISIGIPSETAK

SEQ ID NO: 2693426 - protein, 20 aa, Entamoeba histolytica
RCQNSFFAKYISFKQEPKED

SEQ ID NO: 2693427 - protein, 19 aa, Entamoeba histolytica
RCSEPFFESKFCIYCSSYG

SEQ ID NO: 2693428 - protein, 20 aa, Entamoeba histolytica
RCSEQSIKELIELLEDEKTR

SEQ ID NO: 2693429 - protein, 24 aa, Entamoeba histolytica
RCSHKFCLNCWNEYLLMNGTLSYN

SEQ ID NO: 2693430 - protein, 17 aa, Entamoeba histolytica
RCTFCQQASYLTNGIYN

SEQ ID NO: 2693431 - protein, 21 aa, Entamoeba histolytica
RCVDDFIFFCFLVGNDFLPHI

SEQ ID NO: 2693432 - protein, 19 aa, Entamoeba histolytica
RCVNALKLPNDLIGLPPPH

SEQ ID NO: 2693433 - protein, 20 aa, Entamoeba histolytica
RCYENPELVLSVTGNIDKVC

SEQ ID NO: 2693434 - protein, 20 aa, Entamoeba histolytica
RCYLPEGFFHPNVFPNGQIC

SEQ ID NO: 2693435 - protein, 17 aa, Entamoeba histolytica
RCYPGFQATIIYRVAHI

SEQ ID NO: 2693436 - protein, 25 aa, Entamoeba histolytica
RDAAKVFKKEAKVDYDAEASCIECI

SEQ ID NO: 2693437 - protein, 25 aa, Entamoeba histolytica
RDAFNRLNLPISITTGSLQFLHVKL

SEQ ID NO: 2693438 - protein, 26 aa, Entamoeba histolytica
RDAIPQVVFNLCWWIYTYGYLVEGIF

SEQ ID NO: 2693439 - protein, 18 aa, Entamoeba histolytica
RDCCHTLSSFIVLCQNEQ

SEQ ID NO: 2693440 - protein, 24 aa, Entamoeba histolytica
RDEAAKLCKYCCQYSITPYNTPIK

SEQ ID NO: 2693441 - protein, 18 aa, Entamoeba histolytica
RDEFENICSPLFKEAVDE

SEQ ID NO: 2693442 - protein, 24 aa, Entamoeba histolytica
RDEIKDLRLDIVDLKGELESKEQE

SEQ ID NO: 2693443 - protein, 18 aa, Entamoeba histolytica
RDEMKKKLEVAIHQIEEM

SEQ ID NO: 2693444 - protein, 18 aa, Entamoeba histolytica
RDEYSIRKDVNMLLVTYN

SEQ ID NO: 2693445 - protein, 18 aa, Entamoeba histolytica
RDFERGIHLEELQQFLPL

SEQ ID NO: 2693446 - protein, 20 aa, Entamoeba histolytica
RDFGGFSGFGMPQGGRYTFN

SEQ ID NO: 2693447 - protein, 22 aa, Entamoeba histolytica
RDFNGFSFRSPFISRLIAHEEI

SEQ ID NO: 2693448 - protein, 27 aa, Entamoeba histolytica
RDFTTNRVEGFFGHLKKIINHNNLPLY

SEQ ID NO: 2693449 - protein, 27 aa, Entamoeba histolytica
RDFTTNRVEGFFGHLKKIINHSQVPLY

SEQ ID NO: 2693450 - protein, 20 aa, Entamoeba histolytica
RDFVLRKLINGERMAMFSPT

SEQ ID NO: 2693451 - protein, 22 aa, Entamoeba histolytica
RDGCGRTPLHVAVVMNDAVSVK

SEQ ID NO: 2693452 - protein, 39 aa, Entamoeba histolytica
RDGEKCVELCPTFAKGYSRLSAALMKMGKLQEAKEAIDK

SEQ ID NO: 2693453 - protein, 19 aa, Entamoeba histolytica
RDGLSKKGVQNSIKNKSNV

SEQ ID NO: 2693454 - protein, 19 aa, Entamoeba histolytica
RDIAQLMVIAVSKAIKDTS

SEQ ID NO: 2693455 - protein, 20 aa, Entamoeba histolytica
RDIFLPFGMPMVVQSHKIHI

SEQ ID NO: 2693456 - protein, 20 aa, Entamoeba histolytica
RDIFYLRDYLQLAIETSGLL

SEQ ID NO: 2693457 - protein, 18 aa, Entamoeba histolytica
RDIMSYKKGYNCISYPSV

SEQ ID NO: 2693458 - protein, 21 aa, Entamoeba histolytica
RDIRKYQCCEQAILIGVLNLY

SEQ ID NO: 2693459 - protein, 17 aa, Entamoeba histolytica
RDITDIFSVMKSEKKYW

SEQ ID NO: 2693460 - protein, 18 aa, Entamoeba histolytica
RDIVKSVFRELFYNYTLS

SEQ ID NO: 2693461 - protein, 23 aa, Entamoeba histolytica
RDIYLEFCSIKGISYVSIDEPQK

SEQ ID NO: 2693462 - protein, 23 aa, Entamoeba histolytica
RDKEIYTSLSMEVFIGIGNKLGI

SEQ ID NO: 2693463 - protein, 25 aa, Entamoeba histolytica
RDKIPSELLFFFDYYIDKHVEKGVA

SEQ ID NO: 2693464 - protein, 21 aa, Entamoeba histolytica
RDKLIRYIGFDIIDLSPIIEQ

SEQ ID NO: 2693465 - protein, 23 aa, Entamoeba histolytica
RDKQGFAGFIIEITQYVQNHTKK

SEQ ID NO: 2693466 - protein, 23 aa, Entamoeba histolytica
RDKSLECVRWLQNYLQLPLEIIS

SEQ ID NO: 2693467 - protein, 28 aa, Entamoeba histolytica
RDKSVWLWKSYSGIDYECCSVLTGHSGD

SEQ ID NO: 2693468 - protein, 25 aa, Entamoeba histolytica
RDLDARKPCVVFATLASFSVGSISR

SEQ ID NO: 2693469 - protein, 24 aa, Entamoeba histolytica
RDLGDKKKTCLFSHRLDAENYNKR

SEQ ID NO: 2693470 - protein, 20 aa, Entamoeba histolytica
RDLKVSNIVLIRFNNFDVFP

SEQ ID NO: 2693471 - protein, 25 aa, Entamoeba histolytica
RDLNRAALTFNWLVGYAEQNGYTVH

SEQ ID NO: 2693472 - protein, 20 aa, Entamoeba histolytica
RDLQYLLGCLNLYKFHSDLS

SEQ ID NO: 2693473 - protein, 19 aa, Entamoeba histolytica
RDLRDPRLMDSRFDPRYDN

SEQ ID NO: 2693474 - protein, 23 aa, Entamoeba histolytica
RDLSFKQYNVFAPFNCTRGNFID

SEQ ID NO: 2693475 - protein, 19 aa, Entamoeba histolytica
RDLYCIYNPIKTCDDKNYW

SEQ ID NO: 2693476 - protein, 22 aa, Entamoeba histolytica
RDNDPFKSWTLWWKEKRNTYPS

SEQ ID NO: 2693477 - protein, 18 aa, Entamoeba histolytica
RDNELLKQEVQQEIIQST

SEQ ID NO: 2693478 - protein, 20 aa, Entamoeba histolytica
RDNIHIINNWTGLRCKEIIM

SEQ ID NO: 2693479 - protein, 26 aa, Entamoeba histolytica
RDPECLKEVFDLIKLVSQKNEIDADS

SEQ ID NO: 2693480 - protein, 23 aa, Entamoeba histolytica
RDQCAKGIIWALLTIKGVIQNEP

SEQ ID NO: 2693481 - protein, 21 aa, Entamoeba histolytica
RDQVYRFFYDLTIETHSSIDI

SEQ ID NO: 2693482 - protein, 18 aa, Entamoeba histolytica
RDRERLLRRFLFAENNEH

SEQ ID NO: 2693483 - protein, 18 aa, Entamoeba histolytica
RDRLRNEQKLSSRSDEFV

SEQ ID NO: 2693484 - protein, 18 aa, Entamoeba histolytica
RDRNCGKTRGKLFSLQQP

SEQ ID NO: 2693485 - protein, 22 aa, Entamoeba histolytica
RDRQLRIGRFHQHHVDQLPMDI

SEQ ID NO: 2693486 - protein, 17 aa, Entamoeba histolytica
RDSTVIWIYYHLINELE

SEQ ID NO: 2693487 - protein, 17 aa, Entamoeba histolytica
RDSWSPDLVKLVESCLM

SEQ ID NO: 2693488 - protein, 19 aa, Entamoeba histolytica
RDTIKSLYPTIPIICATSN

SEQ ID NO: 2693489 - protein, 21 aa, Entamoeba histolytica
RDTRSRRVLVTKLYSVQPSDG

SEQ ID NO: 2693490 - protein, 26 aa, Entamoeba histolytica
RDTSIWVCPICNSRYPLPPDSRTYSS

SEQ ID NO: 2693491 - protein, 18 aa, Entamoeba histolytica
RDTVICPKMPESLSILVK

SEQ ID NO: 2693492 - protein, 29 aa, Entamoeba histolytica
RDVGCIKTFFWKRFGFGTEEVITLKDIEQ

SEQ ID NO: 2693493 - protein, 24 aa, Entamoeba histolytica
RDVIVPFIFCENLEIVAKSQIILA

SEQ ID NO: 2693494 - protein, 19 aa, Entamoeba histolytica
RDVMLCVSGSLAYLHSKGY

SEQ ID NO: 2693495 - protein, 17 aa, Entamoeba histolytica
RDYIPVLIISYEQVRSH

SEQ ID NO: 2693496 - protein, 20 aa, Entamoeba histolytica
RDYTDLLLLLIHENNLNYID

SEQ ID NO: 2693497 - protein, 22 aa, Entamoeba histolytica
RDYYGVFPLRGKPLNAREIAPS

SEQ ID NO: 2693498 - protein, 20 aa, Entamoeba histolytica
REAINFGSYNYLGFGGRHPI

SEQ ID NO: 2693499 - protein, 27 aa, Entamoeba histolytica
REAMRFLQDILIEFGYFVEVEIETIDG

SEQ ID NO: 2693500 - protein, 23 aa, Entamoeba histolytica
RECLLDLLQRILVYDPKERLTPN

SEQ ID NO: 2693501 - protein, 22 aa, Entamoeba histolytica
RECRWLPSMLCSVYNKICITVG

SEQ ID NO: 2693502 - protein, 24 aa, Entamoeba histolytica
REDIKGSFKLSVRRERSKTAVIRL

SEQ ID NO: 2693503 - protein, 24 aa, Entamoeba histolytica
REEEKKPILPKYLIKKIERQEEIK

SEQ ID NO: 2693504 - protein, 22 aa, Entamoeba histolytica
REEEMKRKQELIGEQFEISQEE

SEQ ID NO: 2693505 - protein, 23 aa, Entamoeba histolytica
REEGRRLRGRWEVTNEKIKNYIK

SEQ ID NO: 2693506 - protein, 23 aa, Entamoeba histolytica
REEMADLIKIWPGISPIQVIGLL

SEQ ID NO: 2693507 - protein, 20 aa, Entamoeba histolytica
REETDLFPSEILDRTKDVRD

SEQ ID NO: 2693508 - protein, 17 aa, Entamoeba histolytica
REEVLAVSSGFEKVIND

SEQ ID NO: 2693509 - protein, 17 aa, Entamoeba histolytica
REFAFEYFNNAELSICN

SEQ ID NO: 2693510 - protein, 21 aa, Entamoeba histolytica
REFAHPEFALYYLFNKDTYCI

SEQ ID NO: 2693511 - protein, 17 aa, Entamoeba histolytica
REFELILKQCIELTPEN

SEQ ID NO: 2693512 - protein, 20 aa, Entamoeba histolytica
REFFNSRFIYGFNYLSIENV

SEQ ID NO: 2693513 - protein, 22 aa, Entamoeba histolytica
REFFTKMGLPDVRFKPAYNPYT

SEQ ID NO: 2693514 - protein, 22 aa, Entamoeba histolytica
REFKLEKTAPVSYSTYRNEQQK

SEQ ID NO: 2693515 - protein, 26 aa, Entamoeba histolytica
REFYGNPPLREWRKLNVVEINSGLHI

SEQ ID NO: 2693516 - protein, 17 aa, Entamoeba histolytica
REFYHQFILSRSSENVW

SEQ ID NO: 2693517 - protein, 19 aa, Entamoeba histolytica
REFYTYFKAVCSEEESKLR

SEQ ID NO: 2693518 - protein, 17 aa, Entamoeba histolytica
REGCFCNCTSLTSVTMT

SEQ ID NO: 2693519 - protein, 21 aa, Entamoeba histolytica
REGKKYIGEYIWLKNKEVLEM

SEQ ID NO: 2693520 - protein, 19 aa, Entamoeba histolytica
REGLPMSLLAGMRCSFDYS

SEQ ID NO: 2693521 - protein, 19 aa, Entamoeba histolytica
REGQFLKKFIVNSDGINSI

SEQ ID NO: 2693522 - protein, 24 aa, Entamoeba histolytica
REGYPGEINYLFLGDYVDRGKYGV

SEQ ID NO: 2693523 - protein, 22 aa, Entamoeba histolytica
REHCPYHFPPGLLIYKDDERHL

SEQ ID NO: 2693524 - protein, 17 aa, Entamoeba histolytica
REHFKASQFIVVSLKSG

SEQ ID NO: 2693525 - protein, 21 aa, Entamoeba histolytica
REHPDYYLSSVLHSFGGCCPP

SEQ ID NO: 2693526 - protein, 21 aa, Entamoeba histolytica
REHSKFPGIYIASGKEEQLLT

SEQ ID NO: 2693527 - protein, 33 aa, Entamoeba histolytica
REIECKNKLDRDLWLSTIETIRVLCIQSNEKYL

SEQ ID NO: 2693528 - protein, 20 aa, Entamoeba histolytica
REIERLKGIMEDGKGIKQIK

SEQ ID NO: 2693529 - protein, 19 aa, Entamoeba histolytica
REIFQLITMNNYENSNLVN

SEQ ID NO: 2693530 - protein, 24 aa, Entamoeba histolytica
REIFQPKVVRRKDRVSEDMMRIIK

SEQ ID NO: 2693531 - protein, 18 aa, Entamoeba histolytica
REIGFLAALLYSVTRETN

SEQ ID NO: 2693532 - protein, 17 aa, Entamoeba histolytica
REIIGGIDDIVGFNNAL

SEQ ID NO: 2693533 - protein, 24 aa, Entamoeba histolytica
REIIKNMRINSTVIRNTSSSPLIF

SEQ ID NO: 2693534 - protein, 20 aa, Entamoeba histolytica
REIITPLALELGGSGGGHFN

SEQ ID NO: 2693535 - protein, 17 aa, Entamoeba histolytica
REIKGMINDGLISVQRT

SEQ ID NO: 2693536 - protein, 22 aa, Entamoeba histolytica
REIKLRKAFEVFDQDKDGKIKA

SEQ ID NO: 2693537 - protein, 19 aa, Entamoeba histolytica
REILRLLLHKHRTIQTNEL

SEQ ID NO: 2693538 - protein, 17 aa, Entamoeba histolytica
REINGSVVVKISDYGLS

SEQ ID NO: 2693539 - protein, 22 aa, Entamoeba histolytica
REIRSICIPTNIVIIDSNAFVG

SEQ ID NO: 2693540 - protein, 26 aa, Entamoeba histolytica
REISSLLKLRHPFIIKLISVENKVDS

SEQ ID NO: 2693541 - protein, 26 aa, Entamoeba histolytica
REITGDLKIVLPMYCVDSVPDEDFDN

SEQ ID NO: 2693542 - protein, 18 aa, Entamoeba histolytica
REKDCLYIGCKRNGWNSN

SEQ ID NO: 2693543 - protein, 21 aa, Entamoeba histolytica
REKFITCGRISRMMMQYYPNG

SEQ ID NO: 2693544 - protein, 18 aa, Entamoeba histolytica
REKGIAELRKSRRERRLE

SEQ ID NO: 2693545 - protein, 17 aa, Entamoeba histolytica
REKGIYPIFVFDGKTKT

SEQ ID NO: 2693546 - protein, 18 aa, Entamoeba histolytica
REKIICFTEMWFVEREAS

SEQ ID NO: 2693547 - protein, 18 aa, Entamoeba histolytica
REKIMLVRIKSGDVQYIA

SEQ ID NO: 2693548 - protein, 25 aa, Entamoeba histolytica
REKKAIALKGARLAFFQAKSTVYNL

SEQ ID NO: 2693549 - protein, 21 aa, Entamoeba histolytica
REKNVPLIIEPDFIKVVGEKY

SEQ ID NO: 2693550 - protein, 30 aa, Entamoeba histolytica
RELANRCYWYRPNVLKRKWGSYRSIHNNQY

SEQ ID NO: 2693551 - protein, 17 aa, Entamoeba histolytica
RELEVWQEQLFQLKSTI

SEQ ID NO: 2693552 - protein, 26 aa, Entamoeba histolytica
RELFGYLSCKILQPYLSLKELKHKKL

SEQ ID NO: 2693553 - protein, 21 aa, Entamoeba histolytica
RELGTKIKLIEMIKNEKDIME

SEQ ID NO: 2693554 - protein, 17 aa, Entamoeba histolytica
RELHLIYFQAIETQEVV

SEQ ID NO: 2693555 - protein, 20 aa, Entamoeba histolytica
RELIGIKLPKSLKEINHTHI

SEQ ID NO: 2693556 - protein, 20 aa, Entamoeba histolytica
RELINGIMLLFLSFSNPEIV

SEQ ID NO: 2693557 - protein, 19 aa, Entamoeba histolytica
RELIPRPLFEEYFNNIKKL

SEQ ID NO: 2693558 - protein, 17 aa, Entamoeba histolytica
RELKISSSISVLNQTNE

SEQ ID NO: 2693559 - protein, 21 aa, Entamoeba histolytica
RELKKSFITLGNFQITNKQPN

SEQ ID NO: 2693560 - protein, 26 aa, Entamoeba histolytica
RELKLIEPLLCPISFDGDISISISHK

SEQ ID NO: 2693561 - protein, 18 aa, Entamoeba histolytica
RELLKPGTSVAHHKQSNA

SEQ ID NO: 2693562 - protein, 25 aa, Entamoeba histolytica
RELMAELYFLFAQTLLKCYVDNKCE

SEQ ID NO: 2693563 - protein, 22 aa, Entamoeba histolytica
RELNYGKSLLKFFDDVKLQTIA

SEQ ID NO: 2693564 - protein, 19 aa, Entamoeba histolytica
RELPHHYCFVIAQEIYVKV

SEQ ID NO: 2693565 - protein, 20 aa, Entamoeba histolytica
RELRLKSDRLSNVNEATRQV

SEQ ID NO: 2693566 - protein, 19 aa, Entamoeba histolytica
RELRLQRMLVETLPKEIEK

SEQ ID NO: 2693567 - protein, 23 aa, Entamoeba histolytica
RELSDCLIPMQFYQQYVSVGNTE

SEQ ID NO: 2693568 - protein, 17 aa, Entamoeba histolytica
RELSLCLTNQPESKFQI

SEQ ID NO: 2693569 - protein, 23 aa, Entamoeba histolytica
RELVYKLSFICNCIQQSEKSVNN

SEQ ID NO: 2693570 - protein, 26 aa, Entamoeba histolytica
REMAFKNFLQLAIKCIEIKNFNSFNS

SEQ ID NO: 2693571 - protein, 25 aa, Entamoeba histolytica
REMDLANAMWLKSWTSEIWLERRTN

SEQ ID NO: 2693572 - protein, 21 aa, Entamoeba histolytica
REMKGRITDFYVQRTEVEAIT

SEQ ID NO: 2693573 - protein, 20 aa, Entamoeba histolytica
REMLAAIDLRGYSVLHYAVF

SEQ ID NO: 2693574 - protein, 20 aa, Entamoeba histolytica
REMLFRCLSPSLPMSLLQIV

SEQ ID NO: 2693575 - protein, 17 aa, Entamoeba histolytica
REMSLDYYNDVVGFRRS

SEQ ID NO: 2693576 - protein, 25 aa, Entamoeba histolytica
RENCRCFECGTANPTWASVTYGIFL

SEQ ID NO: 2693577 - protein, 17 aa, Entamoeba histolytica
RENEKKVSEKKVVKLIT

SEQ ID NO: 2693578 - protein, 17 aa, Entamoeba histolytica
RENELSILRKKRRELFQ

SEQ ID NO: 2693579 - protein, 17 aa, Entamoeba histolytica
REPIKKILMEQFSLNDE

SEQ ID NO: 2693580 - protein, 21 aa, Entamoeba histolytica
REPPGAGLFCDLLWSDPIDES

SEQ ID NO: 2693581 - protein, 17 aa, Entamoeba histolytica
REPYSIVRFFLERLPLD

SEQ ID NO: 2693582 - protein, 25 aa, Entamoeba histolytica
REQLIKERESFLIKREEELHRKENE

SEQ ID NO: 2693583 - protein, 19 aa, Entamoeba histolytica
REQLLVIGLMPVNKMFKEK

SEQ ID NO: 2693584 - protein, 20 aa, Entamoeba histolytica
REQWSTLIYRDFFQHGFDGS

SEQ ID NO: 2693585 - protein, 24 aa, Entamoeba histolytica
REREEFYRKAGLKGLEKEMEREKR

SEQ ID NO: 2693586 - protein, 23 aa, Entamoeba histolytica
RERFKRNFNGGVGIIELLYKSNL

SEQ ID NO: 2693587 - protein, 18 aa, Entamoeba histolytica
RERIIKLKNRIEGIQEIT

SEQ ID NO: 2693588 - protein, 23 aa, Entamoeba histolytica
RESAFNSFLSWILIEKGIKLICR

SEQ ID NO: 2693589 - protein, 17 aa, Entamoeba histolytica
RESIIWNSVEGIKGEED

SEQ ID NO: 2693590 - protein, 18 aa, Entamoeba histolytica
RESISIIPREVEEEKSDD

SEQ ID NO: 2693591 - protein, 25 aa, Entamoeba histolytica
RESLDLLKLRYGKELTQDDIQLLVR

SEQ ID NO: 2693592 - protein, 18 aa, Entamoeba histolytica
RESLSRSVSRSSSNIDFV

SEQ ID NO: 2693593 - protein, 20 aa, Entamoeba histolytica
RESNEFKILYTRNQKYIFAF

SEQ ID NO: 2693594 - protein, 17 aa, Entamoeba histolytica
RESRENSGMIMSAMGGK

SEQ ID NO: 2693595 - protein, 18 aa, Entamoeba histolytica
RESYRSSLDIDRRSFSRD

SEQ ID NO: 2693596 - protein, 21 aa, Entamoeba histolytica
RETDARKSIRLFKKHQVAQLR

SEQ ID NO: 2693597 - protein, 22 aa, Entamoeba histolytica
RETILASLIKFSKVEQDEGLKK

SEQ ID NO: 2693598 - protein, 28 aa, Entamoeba histolytica
RETKKSKGCGFVKFVYRDDAVSCYNYHK

SEQ ID NO: 2693599 - protein, 19 aa, Entamoeba histolytica
RETMVLIKEAFLSRRMMEQ

SEQ ID NO: 2693600 - protein, 20 aa, Entamoeba histolytica
REVITHVSLYELDAANIKSP

SEQ ID NO: 2693601 - protein, 24 aa, Entamoeba histolytica
REVLKRYISLEVVSKIMNFIELLV

SEQ ID NO: 2693602 - protein, 19 aa, Entamoeba histolytica
REVNKYSKSLCLSGSKSST

SEQ ID NO: 2693603 - protein, 19 aa, Entamoeba histolytica
REVVVPVIKIDSGINDPNR

SEQ ID NO: 2693604 - protein, 20 aa, Entamoeba histolytica
REVYLIKELEKIAPKEKGIV

SEQ ID NO: 2693605 - protein, 24 aa, Entamoeba histolytica
REWTGRIKMNIIFDSDIDDQNVVC

SEQ ID NO: 2693606 - protein, 20 aa, Entamoeba histolytica
REYEKEIGIAKGVNELNETE

SEQ ID NO: 2693607 - protein, 17 aa, Entamoeba histolytica
REYFMIAAHMKRTDAEL

SEQ ID NO: 2693608 - protein, 20 aa, Entamoeba histolytica
REYFTYKTLEDIAMKVAFRV

SEQ ID NO: 2693609 - protein, 23 aa, Entamoeba histolytica
REYIKSGSLLKICRKDNRERYFY

SEQ ID NO: 2693610 - protein, 20 aa, Entamoeba histolytica
REYKMFSSSVLFVYDSTTTL

SEQ ID NO: 2693611 - protein, 17 aa, Entamoeba histolytica
REYRRLFDELNFIVTEN

SEQ ID NO: 2693612 - protein, 20 aa, Entamoeba histolytica
REYTELKKCMVFTPEGEGIE

SEQ ID NO: 2693613 - protein, 21 aa, Entamoeba histolytica
REYVSTVGVYILNYTDGTLTY

SEQ ID NO: 2693614 - protein, 22 aa, Entamoeba histolytica
RFAELEIPEFQPLTAKALNTLS

SEQ ID NO: 2693615 - protein, 18 aa, Entamoeba histolytica
RFAIPTVIRNELQKTKVI

SEQ ID NO: 2693616 - protein, 19 aa, Entamoeba histolytica
RFAPFLPTVLQIVLSRAQM

SEQ ID NO: 2693617 - protein, 21 aa, Entamoeba histolytica
RFARLRLEKRHNYVRQVGELA

SEQ ID NO: 2693618 - protein, 17 aa, Entamoeba histolytica
RFAYVLMPYVIKMGQGF

SEQ ID NO: 2693619 - protein, 23 aa, Entamoeba histolytica
RFCQRISKLNGYYILESVPMNID

SEQ ID NO: 2693620 - protein, 25 aa, Entamoeba histolytica
RFDDRIINFFPDYTNPIMFINCDGT

SEQ ID NO: 2693621 - protein, 18 aa, Entamoeba histolytica
RFDLRKGEEVRGLNMKLQ

SEQ ID NO: 2693622 - protein, 19 aa, Entamoeba histolytica
RFDNTVLHLLLAYIRKPVP

SEQ ID NO: 2693623 - protein, 18 aa, Entamoeba histolytica
RFDTELHCCNKWNKIEGI

SEQ ID NO: 2693624 - protein, 19 aa, Entamoeba histolytica
RFEFDYETLQRIKINDRYE

SEQ ID NO: 2693625 - protein, 23 aa, Entamoeba histolytica
RFEFPLPIEIIIDCYTNNTNEEV

SEQ ID NO: 2693626 - protein, 20 aa, Entamoeba histolytica
RFFFTDVKILIDYATKLVQN

SEQ ID NO: 2693627 - protein, 18 aa, Entamoeba histolytica
RFFHKINEEIGVAKIVVE

SEQ ID NO: 2693628 - protein, 21 aa, Entamoeba histolytica
RFFINKFHLYIINFFIKELTT

SEQ ID NO: 2693629 - protein, 19 aa, Entamoeba histolytica
RFFWNESLVSILQPYFAHW

SEQ ID NO: 2693630 - protein, 19 aa, Entamoeba histolytica
RFGGCGSVMTVIKSSLYKS

SEQ ID NO: 2693631 - protein, 31 aa, Entamoeba histolytica
RFGNDFMAKFSGAYCNLPLLEHMTFIDSPGV

SEQ ID NO: 2693632 - protein, 21 aa, Entamoeba histolytica
RFGRTGIAINFVLKNEMEELR

SEQ ID NO: 2693633 - protein, 25 aa, Entamoeba histolytica
RFHFFNRFRIKGIQHLLFYEVPTPT

SEQ ID NO: 2693634 - protein, 26 aa, Entamoeba histolytica
RFHLKGEVGDIVFVESIIASWAVVHV

SEQ ID NO: 2693635 - protein, 30 aa, Entamoeba histolytica
RFICLVLHALQIIRPTPIIILKKFEDTSVL

SEQ ID NO: 2693636 - protein, 19 aa, Entamoeba histolytica
RFIEGKTLFSYVNHVIGSK

SEQ ID NO: 2693637 - protein, 18 aa, Entamoeba histolytica
RFIEKKSMEGYYREKIEL

SEQ ID NO: 2693638 - protein, 17 aa, Entamoeba histolytica
RFIKIGNTLLLKSDSIG

SEQ ID NO: 2693639 - protein, 17 aa, Entamoeba histolytica
RFILKLASEPKEIELKY

SEQ ID NO: 2693640 - protein, 24 aa, Entamoeba histolytica
RFILLDEYFQLCFNNMIELQNYNI

SEQ ID NO: 2693641 - protein, 20 aa, Entamoeba histolytica
RFIPKNLKGEKVIGDELMMH

SEQ ID NO: 2693642 - protein, 18 aa, Entamoeba histolytica
RFIPTLWTEDCDLLTQHF

SEQ ID NO: 2693643 - protein, 20 aa, Entamoeba histolytica
RFISLSIAFYRGADCCGLVF

SEQ ID NO: 2693644 - protein, 17 aa, Entamoeba histolytica
RFITKIVQEIKEKRDVG

SEQ ID NO: 2693645 - protein, 19 aa, Entamoeba histolytica
RFKGNMERFHFNPISLTTK

SEQ ID NO: 2693646 - protein, 24 aa, Entamoeba histolytica
RFKLQYRFAKVCFVSSLTGDGVDE

SEQ ID NO: 2693647 - protein, 23 aa, Entamoeba histolytica
RFKMKNNEMISNFLVDEESPFFN

SEQ ID NO: 2693648 - protein, 17 aa, Entamoeba histolytica
RFKPKDHKLYQILPTCD

SEQ ID NO: 2693649 - protein, 19 aa, Entamoeba histolytica
RFKSIAKNFTTQFTNELYE

SEQ ID NO: 2693650 - protein, 24 aa, Entamoeba histolytica
RFKSLRRLHINYGFNVNEQSLELI

SEQ ID NO: 2693651 - protein, 25 aa, Entamoeba histolytica
RFLCPEILFRPELFISDDVLAKGLD

SEQ ID NO: 2693652 - protein, 23 aa, Entamoeba histolytica
RFLDVEISFNFHGMFHSATGTMK

SEQ ID NO: 2693653 - protein, 19 aa, Entamoeba histolytica
RFNELCSFSILTHTVSSKF

SEQ ID NO: 2693654 - protein, 26 aa, Entamoeba histolytica
RFNFLSPFAKNLMKTGGELVLIPSRF

SEQ ID NO: 2693655 - protein, 19 aa, Entamoeba histolytica
RFNPDIVVCGMQELEMSVD

SEQ ID NO: 2693656 - protein, 24 aa, Entamoeba histolytica
RFQKEKRIRIAILSVTAAGTGITL

SEQ ID NO: 2693657 - protein, 31 aa, Entamoeba histolytica
RFQMKGMEDDARMLLIRRAYDIAGCNPGKRI

SEQ ID NO: 2693658 - protein, 31 aa, Entamoeba histolytica; identical to SEQ ID NO: 2502189

SEQ ID NO: 2693659 - protein, 31 aa, Entamoeba histolytica; identical to SEQ ID NO: 2502190

SEQ ID NO: 2693660 - protein, 24 aa, Entamoeba histolytica
RFSEELGMRGNIFFNSIKYGDVHL

SEQ ID NO: 2693661 - protein, 29 aa, Entamoeba histolytica
RFSQELRAYNCIIKRGWERLERSKAAFEG

SEQ ID NO: 2693662 - protein, 18 aa, Entamoeba histolytica
RFSYGPRRERAMSLQSMI

SEQ ID NO: 2693663 - protein, 21 aa, Entamoeba histolytica
RFTGEVTPLPVIFKAGDDIRS

SEQ ID NO: 2693664 - protein, 18 aa, Entamoeba histolytica
RFTGNVVHIDFGDCFEVA

SEQ ID NO: 2693665 - protein, 20 aa, Entamoeba histolytica
RFTQKLREYIIFKANEQGVS

SEQ ID NO: 2693666 - protein, 19 aa, Entamoeba histolytica
RFVDVFCGKVVELFLDTLK

SEQ ID NO: 2693667 - protein, 20 aa, Entamoeba histolytica
RFVHGGSYFKKSAVIDEVVL

SEQ ID NO: 2693668 - protein, 26 aa, Entamoeba histolytica
RFVRELPGMLFCNSLAKDVLSKYQES

SEQ ID NO: 2693669 - protein, 17 aa, Entamoeba histolytica
RFVSYQWNDEITIFVML

SEQ ID NO: 2693670 - protein, 18 aa, Entamoeba histolytica
RFVTIPIDPFWVPTTEEE

SEQ ID NO: 2693671 - protein, 24 aa, Entamoeba histolytica
RFWYFKDSQGVGWNIKFKTDMDRL

SEQ ID NO: 2693672 - protein, 25 aa, Entamoeba histolytica
RFYDLMWEYNFSLRLRSEEENKEKC

SEQ ID NO: 2693673 - protein, 25 aa, Entamoeba histolytica
RFYIQEFILESGLSYYIRQTAINST

SEQ ID NO: 2693674 - protein, 25 aa, Entamoeba histolytica
RGAHSCYFCNFVAAVSFITQMNENS

SEQ ID NO: 2693675 - protein, 32 aa, Entamoeba histolytica
RGAMFPCSHCFHILCIKKEFAQHPTPFARSVT

SEQ ID NO: 2693676 - protein, 17 aa, Entamoeba histolytica
RGCIIDCTISLNKKPGI

SEQ ID NO: 2693677 - protein, 19 aa, Entamoeba histolytica
RGCIIDCTISLNKKPGILT

SEQ ID NO: 2693678 - protein, 17 aa, Entamoeba histolytica
RGDCGGHCMTNISRYIH

SEQ ID NO: 2693679 - protein, 20 aa, Entamoeba histolytica
RGDCTGKIFFDMYKQEEDKW

SEQ ID NO: 2693680 - protein, 21 aa, Entamoeba histolytica
RGDRIVVCGMNGPIVTQIRAL

SEQ ID NO: 2693681 - protein, 19 aa, Entamoeba histolytica
RGDVFGCYVSKRCVKKDNW

SEQ ID NO: 2693682 - protein, 20 aa, Entamoeba histolytica
RGFGEEEWAFHGSSIDSIQG

SEQ ID NO: 2693683 - protein, 17 aa, Entamoeba histolytica
RGFINNEEILFIKRMIV

SEQ ID NO: 2693684 - protein, 19 aa, Entamoeba histolytica
RGFVPLIIVCKQGKPILCK

SEQ ID NO: 2693685 - protein, 33 aa, Entamoeba histolytica
RGFVPTFKQKWIIKLKEMMLFTVEISEIKDKTI

SEQ ID NO: 2693686 - protein, 19 aa, Entamoeba histolytica
RGGILCNIAIEESHYQLLV

SEQ ID NO: 2693687 - protein, 18 aa, Entamoeba histolytica
RGGPRGAPMGGMMPPPPP

SEQ ID NO: 2693688 - protein, 22 aa, Entamoeba histolytica
RGGQSSVRFARLRLEKRHNYVR

SEQ ID NO: 2693689 - protein, 18 aa, Entamoeba histolytica
RGGRKLKGKLRAFDQHLN

SEQ ID NO: 2693690 - protein, 18 aa, Entamoeba histolytica
RGHFVRRTQEVQGMKTRK

SEQ ID NO: 2693691 - protein, 18 aa, Entamoeba histolytica
RGHISKIYAMHWASDSTH

SEQ ID NO: 2693692 - protein, 24 aa, Entamoeba histolytica
RGHTLRLLDHFVFHNHVCIVTELL

SEQ ID NO: 2693693 - protein, 17 aa, Entamoeba histolytica
RGIDISLTFKLNSYGLV

SEQ ID NO: 2693694 - protein, 18 aa, Entamoeba histolytica
RGIHKVTFYAMIRNSSGE

SEQ ID NO: 2693695 - protein, 20 aa, Entamoeba histolytica
RGIKRLSVLLSGYHLYHKLS

SEQ ID NO: 2693696 - protein, 26 aa, Entamoeba histolytica
RGIWGVPKLKPSEMERWADVGDVIVD

SEQ ID NO: 2693697 - protein, 22 aa, Entamoeba histolytica
RGKELKRHGLGNIHGVDVKKIR

SEQ ID NO: 2693698 - protein, 28 aa, Entamoeba histolytica
RGKFGIEVLCLLYALKVKYPRFIFICRG

SEQ ID NO: 2693699 - protein, 17 aa, Entamoeba histolytica
RGKIWRISMNKNGSFVI

SEQ ID NO: 2693700 - protein, 17 aa, Entamoeba histolytica
RGKKTSVFTTRSPHRPN

SEQ ID NO: 2693701 - protein, 17 aa, Entamoeba histolytica
RGKNFFGANEFSELVQQ

SEQ ID NO: 2693702 - protein, 19 aa, Entamoeba histolytica
RGKTLLLIETLDFRQRTFV

SEQ ID NO: 2693703 - protein, 28 aa, Entamoeba histolytica
RGKYGVEVLCLLYALKIKYPDNIHFIRG

SEQ ID NO: 2693704 - protein, 20 aa, Entamoeba histolytica
RGLHGVLFCFDITKKETFNC

SEQ ID NO: 2693705 - protein, 19 aa, Entamoeba histolytica
RGLQRKVIFIIDMSLSMNQ

SEQ ID NO: 2693706 - protein, 17 aa, Entamoeba histolytica
RGLRSLRQSEWDCDEEL

SEQ ID NO: 2693707 - protein, 18 aa, Entamoeba histolytica
RGLYLKRLDRFLEQTKWA

SEQ ID NO: 2693708 - protein, 37 aa, Entamoeba histolytica
RGNEAFKKKKMCLYNKCTVIKILVGWMKDATEKGESI

SEQ ID NO: 2693709 - protein, 20 aa, Entamoeba histolytica
RGNFSRILLLDERFLSILIH

SEQ ID NO: 2693710 - protein, 25 aa, Entamoeba histolytica
RGNILKKDLEAIASLIEETIGGMNL

SEQ ID NO: 2693711 - protein, 34 aa, Entamoeba histolytica
RGNKRMCFANERIKPFKNILCEWSQKKDIQLIYD

SEQ ID NO: 2693712 - protein, 20 aa, Entamoeba histolytica
RGNLEVIHPRGVILDIITEL

SEQ ID NO: 2693713 - protein, 26 aa, Entamoeba histolytica
RGNLQIIIKILLEFHTGLGDDKVIDL

SEQ ID NO: 2693714 - protein, 17 aa, Entamoeba histolytica
RGNMERFHFNPISLNQY

SEQ ID NO: 2693715 - protein, 17 aa, Entamoeba histolytica
RGNRMSGMLLANNTSIR

SEQ ID NO: 2693716 - protein, 18 aa, Entamoeba histolytica
RGNSVIVYGTIAGLKDED

SEQ ID NO: 2693717 - protein, 35 aa, Entamoeba histolytica; identical to SEQ ID NO: 2502259

SEQ ID NO: 2693718 - protein, 17 aa, Entamoeba histolytica
RGNVFGKEIIQFIKDKQ

SEQ ID NO: 2693719 - protein, 20 aa, Entamoeba histolytica
RGNVTWCYNSLQFKFELFKM

SEQ ID NO: 2693720 - protein, 20 aa, Entamoeba histolytica
RGNWDSNLLKRETFETLNES

SEQ ID NO: 2693721 - protein, 30 aa, Entamoeba histolytica
RGQDSILKRCWYKKRPAILKIYNTDMQSYF

SEQ ID NO: 2693722 - protein, 18 aa, Entamoeba histolytica
RGQHFTWDSEAKYYFQFC

SEQ ID NO: 2693723 - protein, 26 aa, Entamoeba histolytica
RGQLTFTVPKVYGWVDVELIHKKNVV

SEQ ID NO: 2693724 - protein, 19 aa, Entamoeba histolytica
RGQRLFLKHHLHSQTQSSQ

SEQ ID NO: 2693725 - protein, 19 aa, Entamoeba histolytica
RGRGGRKPPTKKLIERQKK

SEQ ID NO: 2693726 - protein, 21 aa, Entamoeba histolytica
RGSDCCVLCFDVTNRDSFNHL

SEQ ID NO: 2693727 - protein, 30 aa, Entamoeba histolytica
RGSEPLQLIIGGVFKKGNVDRLEWEKEEKE

SEQ ID NO: 2693728 - protein, 19 aa, Entamoeba histolytica
RGSGYGIGFIYLNKYNEII

SEQ ID NO: 2693729 - protein, 24 aa, Entamoeba histolytica
RGSQYKVECYLKRVSKSEFKLFSP

SEQ ID NO: 2693730 - protein, 27 aa, Entamoeba histolytica
RGSSSIIYLCVGGIVLKQINSDFKSLK

SEQ ID NO: 2693731 - protein, 18 aa, Entamoeba histolytica
RGTDWKWSDQDGGEGKTG

SEQ ID NO: 2693732 - protein, 21 aa, Entamoeba histolytica
RGTIKIDSWSTMEMPKDTYKE

SEQ ID NO: 2693733 - protein, 18 aa, Entamoeba histolytica
RGTTTAVITDISFTPSCD

SEQ ID NO: 2693734 - protein, 29 aa, Entamoeba histolytica
RGTYGQLFECFRKLFICKTDTDNKSQLII

SEQ ID NO: 2693735 - protein, 20 aa, Entamoeba histolytica
RGVEALQMVKYLRYVDFSKT

SEQ ID NO: 2693736 - protein, 25 aa, Entamoeba histolytica
RGVFEIKEIASLFGYSFNEMHLTGG

SEQ ID NO: 2693737 - protein, 17 aa, Entamoeba histolytica
RGVILDIITELLKKKDY

SEQ ID NO: 2693738 - protein, 20 aa, Entamoeba histolytica
RGVKGEREFLIFVESETDLK

SEQ ID NO: 2693739 - protein, 17 aa, Entamoeba histolytica
RGVKGIRTFHLTVDTEN

SEQ ID NO: 2693740 - protein, 20 aa, Entamoeba histolytica
RGVTSLSRCTFLILDEADRM

SEQ ID NO: 2693741 - protein, 18 aa, Entamoeba histolytica
RGVVSYKLYKVNNITTSI

SEQ ID NO: 2693742 - protein, 25 aa, Entamoeba histolytica
RGWDDPRMPTIMGFKRKGYSADAIN

SEQ ID NO: 2693743 - protein, 23 aa, Entamoeba histolytica
RGYHCLETVLLLLALKVKFPERI

SEQ ID NO: 2693744 - protein, 19 aa, Entamoeba histolytica
RGYQFRSSKMYQRTKNLKF

SEQ ID NO: 2693745 - protein, 20 aa, Entamoeba histolytica
RGYTAWDYTSPVFVVKDQLG

SEQ ID NO: 2693746 - protein, 20 aa, Entamoeba histolytica
RGYVNFSGFVFRKQGRDCLC

SEQ ID NO: 2693747 - protein, 18 aa, Entamoeba histolytica
RGYVTTCCIAVMQSSPFT

SEQ ID NO: 2693748 - protein, 19 aa, Entamoeba histolytica
RHCKSEAFNNIIPGNDTEK

SEQ ID NO: 2693749 - protein, 20 aa, Entamoeba histolytica
RHFHCLCGIVDIVLTQPIDE

SEQ ID NO: 2693750 - protein, 18 aa, Entamoeba histolytica
RHFSGFIMIGLQVFNSPQ

SEQ ID NO: 2693751 - protein, 19 aa, Entamoeba histolytica
RHGIIPVPLYTTLGKEAID

SEQ ID NO: 2693752 - protein, 23 aa, Entamoeba histolytica
RHGILGCLFKDKFNNKLIVVTDE

SEQ ID NO: 2693753 - protein, 17 aa, Entamoeba histolytica
RHGYPYTTDLNVFGYDY

SEQ ID NO: 2693754 - protein, 20 aa, Entamoeba histolytica
RHHCRFCGKCVCGDCSLIRL

SEQ ID NO: 2693755 - protein, 23 aa, Entamoeba histolytica
RHINEPFDRYSIHKNLNSLEVQH

SEQ ID NO: 2693756 - protein, 17 aa, Entamoeba histolytica
RHKSCDIVLSSLMISNF

SEQ ID NO: 2693757 - protein, 17 aa, Entamoeba histolytica
RHLCICKIALFMNKNKP

SEQ ID NO: 2693758 - protein, 26 aa, Entamoeba histolytica
RHLKTTIIVNMHIWKSLNASFKTQVA

SEQ ID NO: 2693759 - protein, 17 aa, Entamoeba histolytica
RHLRSAVLLGKSSLQLL

SEQ ID NO: 2693760 - protein, 19 aa, Entamoeba histolytica
RHLSFKMIGIMIILKNINK

SEQ ID NO: 2693761 - protein, 17 aa, Entamoeba histolytica
RHNDCDRFQDQMNNSKG

SEQ ID NO: 2693762 - protein, 25 aa, Entamoeba histolytica
RHNEYFRFKFAKGITTSCLLSDEEY

SEQ ID NO: 2693763 - protein, 19 aa, Entamoeba histolytica
RHNTVIFILAHEGYTNLRP

SEQ ID NO: 2693764 - protein, 24 aa, Entamoeba histolytica
RHPFIVHLYWSFATETCFYFIMDY

SEQ ID NO: 2693765 - protein, 21 aa, Entamoeba histolytica
RHPRYKTEICQTFHQTGTCKY

SEQ ID NO: 2693766 - protein, 19 aa, Entamoeba histolytica
RHVIPEFDNSDGFFHGYDY

SEQ ID NO: 2693767 - protein, 20 aa, Entamoeba histolytica
RHYRAPEIVLGLPYSCAIDM

SEQ ID NO: 2693768 - protein, 20 aa, Entamoeba histolytica
RHYRAPEVILGLPYSTSIDM

SEQ ID NO: 2693769 - protein, 26 aa, Entamoeba histolytica
RHYRAPEVILGLPYSTSIDMWSLGCI

SEQ ID NO: 2693770 - protein, 26 aa, Entamoeba histolytica
RHYRSPEVLLGIKYTTAIDMWSFGCI

SEQ ID NO: 2693771 - protein, 18 aa, Entamoeba histolytica
RHYYEGTQGIVFVVDSSD

SEQ ID NO: 2693772 - protein, 23 aa, Entamoeba histolytica
RIAEEFHLNIILRYYNGEKIVTN

SEQ ID NO: 2693773 - protein, 19 aa, Entamoeba histolytica
RIAGKDGKTKFSIENTTHT

SEQ ID NO: 2693774 - protein, 21 aa, Entamoeba histolytica
RIALAAQVRRVIKNGHIKDKN

SEQ ID NO: 2693775 - protein, 24 aa, Entamoeba histolytica
RIANTLPHHCDFILQNKEDDHGFL

SEQ ID NO: 2693776 - protein, 28 aa, Entamoeba histolytica
RIAQLRKSSICFRRRLIEAGCHVLGDTD

SEQ ID NO: 2693777 - protein, 24 aa, Entamoeba histolytica
RICEIKQKYLLKLYERVQYYSHVI

SEQ ID NO: 2693778 - protein, 19 aa, Entamoeba histolytica
RICRYELLFESILKEIHQE

SEQ ID NO: 2693779 - protein, 22 aa, Entamoeba histolytica
RICTEIYPFIPGGFRNGIVPIL

SEQ ID NO: 2693780 - protein, 21 aa, Entamoeba histolytica
RIDAAVLLGLIIQFRLTNNPI

SEQ ID NO: 2693781 - protein, 20 aa, Entamoeba histolytica
RIDEQRVVGLYCLQLDQKQV

SEQ ID NO: 2693782 - protein, 18 aa, Entamoeba histolytica
RIDGHGFLGSSFDFIIDA

SEQ ID NO: 2693783 - protein, 20 aa, Entamoeba histolytica
RIDMPSIFKYQIKGVEDVKC

SEQ ID NO: 2693784 - protein, 19 aa, Entamoeba histolytica
RIDNPSKCRRIQRISTNNK

SEQ ID NO: 2693785 - protein, 18 aa, Entamoeba histolytica
RIDNWKIQCNELKKQWYY

SEQ ID NO: 2693786 - protein, 18 aa, Entamoeba histolytica
RIDRINAVLTQIETRITV

SEQ ID NO: 2693787 - protein, 21 aa, Entamoeba histolytica
RIDSFCFFKCENLTSITLPSS

SEQ ID NO: 2693788 - protein, 19 aa, Entamoeba histolytica
RIDYMKSRALLGSTELREM

SEQ ID NO: 2693789 - protein, 18 aa, Entamoeba histolytica
RIECQKGIEEWRNACDHL

SEQ ID NO: 2693790 - protein, 21 aa, Entamoeba histolytica
RIECRDLQCFFSLSKDISRFE

SEQ ID NO: 2693791 - protein, 19 aa, Entamoeba histolytica
RIEGFDCVIQFAKSLNVRI

SEQ ID NO: 2693792 - protein, 19 aa, Entamoeba histolytica
RIEKEFKIDLDKSTIEIDG

SEQ ID NO: 2693793 - protein, 19 aa, Entamoeba histolytica
RIEKQKKKETIKMKKGGIT

SEQ ID NO: 2693794 - protein, 24 aa, Entamoeba histolytica
RIELLPEFYCCPEVFMNLNHLKGE

SEQ ID NO: 2693795 - protein, 21 aa, Entamoeba histolytica
RIEVWLRGSLKEVEMSLPKDD

SEQ ID NO: 2693796 - protein, 18 aa, Entamoeba histolytica
RIFGRVCKDFRVINENIM

SEQ ID NO: 2693797 - protein, 28 aa, Entamoeba histolytica
RIFINNFLIDVCLELGYLFESKYSRKSK

SEQ ID NO: 2693798 - protein, 21 aa, Entamoeba histolytica
RIFNSYTFKFCDELLKEEFKI

SEQ ID NO: 2693799 - protein, 21 aa, Entamoeba histolytica
RIFNTRILNVLINILNSREDK

SEQ ID NO: 2693800 - protein, 28 aa, Entamoeba histolytica
RIFVEMMQYLDIYVHRWGKLSEEVVTFM

SEQ ID NO: 2693801 - protein, 23 aa, Entamoeba histolytica
RIGARCFEGCLLTSFELPISVYE

SEQ ID NO: 2693802 - protein, 19 aa, Entamoeba histolytica
RIGGEGVIDLDELIRKTEE

SEQ ID NO: 2693803 - protein, 20 aa, Entamoeba histolytica
RIGGLLNKELKSVVRGHKRD

SEQ ID NO: 2693804 - protein, 17 aa, Entamoeba histolytica
RIGILYGTFKQDRVQVE

SEQ ID NO: 2693805 - protein, 18 aa, Entamoeba histolytica
RIGNGCFEGSQIEEITIP

SEQ ID NO: 2693806 - protein, 25 aa, Entamoeba histolytica
RIGQYKYNWVIRNYLRAIECSNKSD

SEQ ID NO: 2693807 - protein, 21 aa, Entamoeba histolytica
RIGTEILKLLKKHHCGDLIRV

SEQ ID NO: 2693808 - protein, 26 aa, Entamoeba histolytica
RIGVLRFSKSTVMIIADGCGWGIQPH

SEQ ID NO: 2693809 - protein, 19 aa, Entamoeba histolytica
RIGWDVFMGAVNFDLQYFP

SEQ ID NO: 2693810 - protein, 24 aa, Entamoeba histolytica
RIGWKEFFLHPYVRQCLELKGVSM

SEQ ID NO: 2693811 - protein, 20 aa, Entamoeba histolytica
RIHECTKLKNLFEHYISQHK

SEQ ID NO: 2693812 - protein, 36 aa, Entamoeba histolytica
RIHFKTVCKNECCVKWRKGICPWNKGKQTIKGFCFG

SEQ ID NO: 2693813 - protein, 26 aa, Entamoeba histolytica
RIIDHLEVIEGIPFVGYHTRKHTFGR

SEQ ID NO: 2693814 - protein, 30 aa, Entamoeba histolytica
RIIEGMPLLDCVKGQVAWDLHRLATPLHPC

SEQ ID NO: 2693815 - protein, 25 aa, Entamoeba histolytica
RIIELCIYLLLAVVIEKLPLPSTLF

SEQ ID NO: 2693816 - protein, 19 aa, Entamoeba histolytica
RIIENILIYLYNKGCTTHG

SEQ ID NO: 2693817 - protein, 18 aa, Entamoeba histolytica
RIIKYELWDAAGQERYRS

SEQ ID NO: 2693818 - protein, 18 aa, Entamoeba histolytica
RIILCDLDVRFENKKERI

SEQ ID NO: 2693819 - protein, 20 aa, Entamoeba histolytica
RIIPCDILKSVECKLRSERM

SEQ ID NO: 2693820 - protein, 20 aa, Entamoeba histolytica
RIISCGGVIRNGRVNGNLSL

SEQ ID NO: 2693821 - protein, 17 aa, Entamoeba histolytica
RIITLLLNEQFELRSSV

SEQ ID NO: 2693822 - protein, 17 aa, Entamoeba histolytica
RIKCIVCKIYPENIDDC

SEQ ID NO: 2693823 - protein, 22 aa, Entamoeba histolytica
RIKEDIDHCFERYKQLWEYVSA

SEQ ID NO: 2693824 - protein, 23 aa, Entamoeba histolytica
RIKELLIVCMFKGFDVLKLLNES

SEQ ID NO: 2693825 - protein, 19 aa, Entamoeba histolytica
RIKIKLMPWKEDNPVVKNS

SEQ ID NO: 2693826 - protein, 19 aa, Entamoeba histolytica
RIKISMFGFQASGKTCLYN

SEQ ID NO: 2693827 - protein, 19 aa, Entamoeba histolytica
RIKKLLKMRDTIVCQISRK

SEQ ID NO: 2693828 - protein, 22 aa, Entamoeba histolytica
RIKLPSIPFKCHSLSAVISIDF

SEQ ID NO: 2693829 - protein, 20 aa, Entamoeba histolytica
RIKNHLCGRGNIFEEGRKEW

SEQ ID NO: 2693830 - protein, 21 aa, Entamoeba histolytica
RIKQEVGKLFDIKTFADYNFN

SEQ ID NO: 2693831 - protein, 19 aa, Entamoeba histolytica
RIKRLGIEFRTNAKVDDIT

SEQ ID NO: 2693832 - protein, 20 aa, Entamoeba histolytica
RIKTDMLISIDVSLRSMEKR

SEQ ID NO: 2693833 - protein, 18 aa, Entamoeba histolytica
RILFSLRHSHFIALMQQK

SEQ ID NO: 2693834 - protein, 23 aa, Entamoeba histolytica
RILGRSEVMGVFEYHLKQLSLPY

SEQ ID NO: 2693835 - protein, 26 aa, Entamoeba histolytica
RILLLDERFLSILIHFYTEMPNVFGP

SEQ ID NO: 2693836 - protein, 26 aa, Entamoeba histolytica
RILNEIYRVVLRGCNPSSHPIYFSVN

SEQ ID NO: 2693837 - protein, 20 aa, Entamoeba histolytica
RILPFIKFLINREFEESRSR

SEQ ID NO: 2693838 - protein, 19 aa, Entamoeba histolytica
RILPSNRTDPIFIALEGCP

SEQ ID NO: 2693839 - protein, 18 aa, Entamoeba histolytica
RILTDGMNWINNRRTGIT

SEQ ID NO: 2693840 - protein, 22 aa, Entamoeba histolytica
RILTIDGCPLRNLELSLNSLDI

SEQ ID NO: 2693841 - protein, 18 aa, Entamoeba histolytica
RIMKESFILFKKYSEGPF

SEQ ID NO: 2693842 - protein, 18 aa, Entamoeba histolytica
RIMVCVLYPKIIKIDAAF

SEQ ID NO: 2693843 - protein, 18 aa, Entamoeba histolytica
RINALLSALTKFKVIKSS

SEQ ID NO: 2693844 - protein, 17 aa, Entamoeba histolytica
RINEFKKSLQILEDAKV

SEQ ID NO: 2693845 - protein, 19 aa, Entamoeba histolytica
RINPALFYLCEGRPLTQTK

SEQ ID NO: 2693846 - protein, 29 aa, Entamoeba histolytica
RINSIKDLPPMNGIKEAYCIVKVGKQNPV

SEQ ID NO: 2693847 - protein, 25 aa, Entamoeba histolytica
RINVDELFIALGRKLLQINHKGEDA

SEQ ID NO: 2693848 - protein, 18 aa, Entamoeba histolytica
RIPIDQFLIQPIQRLLRY

SEQ ID NO: 2693849 - protein, 17 aa, Entamoeba histolytica
RIPKVVEILKEFFNGKE

SEQ ID NO: 2693850 - protein, 20 aa, Entamoeba histolytica
RIPQLLRIISSLSPQENALI

SEQ ID NO: 2693851 - protein, 19 aa, Entamoeba histolytica
RIPRYKLLLNDLLKHTPQN

SEQ ID NO: 2693852 - protein, 27 aa, Entamoeba histolytica
RIPRYVMLVKDLCKWTQRNQWSNNLAL

SEQ ID NO: 2693853 - protein, 26 aa, Entamoeba histolytica
RIQCINNLHCALTFMERDMLVKNPGC

SEQ ID NO: 2693854 - protein, 24 aa, Entamoeba histolytica
RIQEHEFNMYKSLGGRKAMDQFLK

SEQ ID NO: 2693855 - protein, 32 aa, Entamoeba histolytica
RIQEKKCSTDVYWSIILKLIIYDLIRDYTDLL

SEQ ID NO: 2693856 - protein, 28 aa, Entamoeba histolytica
RIQQEINVHKALCKNEFIVPLIDSAIYS

SEQ ID NO: 2693857 - protein, 18 aa, Entamoeba histolytica
RIQSCANLNEFVVSMDDF

SEQ ID NO: 2693858 - protein, 25 aa, Entamoeba histolytica
RIQTILDIYRACFSISNECVYDHLL

SEQ ID NO: 2693859 - protein, 20 aa, Entamoeba histolytica
RIQYPVSLFEAILFDNSSTQ

SEQ ID NO: 2693860 - protein, 20 aa, Entamoeba histolytica
RIREEVGKLFDIQTFADKNF

SEQ ID NO: 2693861 - protein, 19 aa, Entamoeba histolytica
RIREEVGKSFDIKTFADKN

SEQ ID NO: 2693862 - protein, 23 aa, Entamoeba histolytica
RIREIVAVLCDFKARHEEGRSRQ

SEQ ID NO: 2693863 - protein, 28 aa, Entamoeba histolytica
RIRFRATSLLTYCLIKYPIKEESKDVFV

SEQ ID NO: 2693864 - protein, 18 aa, Entamoeba histolytica
RIRGRREAFYHAQQPVFD

SEQ ID NO: 2693865 - protein, 20 aa, Entamoeba histolytica
RIRIIETMKKCGKYLEYPTI

SEQ ID NO: 2693866 - protein, 20 aa, Entamoeba histolytica
RIRIKLQPWKEDNYLVKNSR

SEQ ID NO: 2693867 - protein, 27 aa, Entamoeba histolytica
RIRISMTDVMFCKKFLPERSLHRYETK

SEQ ID NO: 2693868 - protein, 23 aa, Entamoeba histolytica
RIRPPRYCPEQLICFDYLQSQGW

SEQ ID NO: 2693869 - protein, 22 aa, Entamoeba histolytica
RIRPTGKCIVEWGGFFTSEYQN

SEQ ID NO: 2693870 - protein, 27 aa, Entamoeba histolytica
RISDALKLLFPFSFTSIMPLFEGKNGI

SEQ ID NO: 2693871 - protein, 17 aa, Entamoeba histolytica
RISDIFTTLIKRINAMN

SEQ ID NO: 2693872 - protein, 18 aa, Entamoeba histolytica
RISDIFTTLIKRINSSNG

SEQ ID NO: 2693873 - protein, 20 aa, Entamoeba histolytica
RISGCNYIKCICGCGYCYKC

SEQ ID NO: 2693874 - protein, 29 aa, Entamoeba histolytica
RISGKQLLVLTGFLPILFNGRKFGIPLLI

SEQ ID NO: 2693875 - protein, 26 aa, Entamoeba histolytica
RISIQRLICIFAYFHVMIEMDEKTLQ

SEQ ID NO: 2693876 - protein, 20 aa, Entamoeba histolytica
RISKASSVLKGFKAKHKIAA

SEQ ID NO: 2693877 - protein, 17 aa, Entamoeba histolytica
RISKPKITVSLYLFPEV

SEQ ID NO: 2693878 - protein, 17 aa, Entamoeba histolytica
RISKRGCRCKGVCDKNC

SEQ ID NO: 2693879 - protein, 18 aa, Entamoeba histolytica
RISKSSINESIRIHQIPK

SEQ ID NO: 2693880 - protein, 20 aa, Entamoeba histolytica
RISPEFQNFCRYLRERQNQM

SEQ ID NO: 2693881 - protein, 18 aa, Entamoeba histolytica
RISPFINDIVNSFITKES

SEQ ID NO: 2693882 - protein, 17 aa, Entamoeba histolytica
RISPYYLADSFNHNSDI

SEQ ID NO: 2693883 - protein, 24 aa, Entamoeba histolytica
RISSCEFIQLNTCLAIPNPKNTIE

SEQ ID NO: 2693884 - protein, 33 aa, Entamoeba histolytica
RITEKGNYQYIVFKFNVVNGLYVSEIEINTPAV

SEQ ID NO: 2693885 - protein, 17 aa, Entamoeba histolytica
RITKGMNTMEEMLQIEE

SEQ ID NO: 2693886 - protein, 24 aa, Entamoeba histolytica
RITKVTRLSTGRVETSVHKLPSQP

SEQ ID NO: 2693887 - protein, 17 aa, Entamoeba histolytica
RITMKTIELIKSVKVVA

SEQ ID NO: 2693888 - protein, 18 aa, Entamoeba histolytica
RITMLMFYLGAYKILFPE

SEQ ID NO: 2693889 - protein, 19 aa, Entamoeba histolytica
RITNYIRERMNAINSDEDD

SEQ ID NO: 2693890 - protein, 19 aa, Entamoeba histolytica
RITPFPSKIIIVGTKLDIK

SEQ ID NO: 2693891 - protein, 21 aa, Entamoeba histolytica
RITQSQCPVSIDLHISLDGVV

SEQ ID NO: 2693892 - protein, 21 aa, Entamoeba histolytica
RITSDLILKITTEIFPSLHRD

SEQ ID NO: 2693893 - protein, 28 aa, Entamoeba histolytica
RIVECVFLFATECFKIYNIEPFPQIPIE

SEQ ID NO: 2693894 - protein, 17 aa, Entamoeba histolytica
RIVEYIHNYYVDPATNK

SEQ ID NO: 2693895 - protein, 19 aa, Entamoeba histolytica
RIVGLKTKQNFFVQQYNKD

SEQ ID NO: 2693896 - protein, 17 aa, Entamoeba histolytica
RIVKLWLTNESMFDWAL

SEQ ID NO: 2693897 - protein, 26 aa, Entamoeba histolytica
RIVQCIRLLPCLIFGRGDEECISYYT

SEQ ID NO: 2693898 - protein, 25 aa, Entamoeba histolytica
RIVQPPWFVCVICRRQFKDNDELQK

SEQ ID NO: 2693899 - protein, 19 aa, Entamoeba histolytica
RIVSEGVVTLGEYIGQDRC

SEQ ID NO: 2693900 - protein, 23 aa, Entamoeba histolytica
RIVTPRLALTTAEYFAYTCDMHV

SEQ ID NO: 2693901 - protein, 23 aa, Entamoeba histolytica
RIWHEECFVCNECGEHFGGEHKL

SEQ ID NO: 2693902 - protein, 17 aa, Entamoeba histolytica
RIWNCFNALVVGVFLGL

SEQ ID NO: 2693903 - protein, 18 aa, Entamoeba histolytica
RIYEELIIPRKKRSDPNQ

SEQ ID NO: 2693904 - protein, 17 aa, Entamoeba histolytica
RIYEMKSNKNASLGKLQ

SEQ ID NO: 2693905 - protein, 19 aa, Entamoeba histolytica
RIYESFEIILNALNLYESH

SEQ ID NO: 2693906 - protein, 21 aa, Entamoeba histolytica
RIYVDGCYDMFHWGHANVIRQ

SEQ ID NO: 2693907 - protein, 18 aa, Entamoeba histolytica
RKADGIVVALKQMEVNND

SEQ ID NO: 2693908 - protein, 21 aa, Entamoeba histolytica
RKADVWALGCILYKICYFDTP

SEQ ID NO: 2693909 - protein, 20 aa, Entamoeba histolytica
RKANPFSVTLDYPYEILQKQ

SEQ ID NO: 2693910 - protein, 17 aa, Entamoeba histolytica
RKANRVDMSKHFVNSKK

SEQ ID NO: 2693911 - protein, 17 aa, Entamoeba histolytica
RKASLYEIVMGRKGKKE

SEQ ID NO: 2693912 - protein, 17 aa, Entamoeba histolytica
RKCECPTPDIISNIVNG

SEQ ID NO: 2693913 - protein, 17 aa, Entamoeba histolytica
RKCFDKEIITQCIHPDT

SEQ ID NO: 2693914 - protein, 19 aa, Entamoeba histolytica
RKDEDFQKRIELIQDTEFP

SEQ ID NO: 2693915 - protein, 20 aa, Entamoeba histolytica
RKDENGIWRRRSLSNERNSP

SEQ ID NO: 2693916 - protein, 28 aa, Entamoeba histolytica
RKDIKMFKFVYAKVGITYPIWKDIFNVA

SEQ ID NO: 2693917 - protein, 17 aa, Entamoeba histolytica
RKDISKEVLDCFEESKE

SEQ ID NO: 2693918 - protein, 25 aa, Entamoeba histolytica
RKDLNRTAISFSWLIQLAEQNGISF

SEQ ID NO: 2693919 - protein, 23 aa, Entamoeba histolytica
RKDPGCISYSFVNEVTNTTHYIM

SEQ ID NO: 2693920 - protein, 22 aa, Entamoeba histolytica
RKDTDWDGLLAIIQNIYENELD

SEQ ID NO: 2693921 - protein, 20 aa, Entamoeba histolytica
RKDTYFFLLSKRMNAKVVHL

SEQ ID NO: 2693922 - protein, 27 aa, Entamoeba histolytica
RKDVIGIYLPNCIQFIISSASIETCGF

SEQ ID NO: 2693923 - protein, 22 aa, Entamoeba histolytica
RKDVISEFVRRSCDIVPCPLLL

SEQ ID NO: 2693924 - protein, 25 aa, Entamoeba histolytica
RKEEKSVKFIFSFVLAISKMVAKLE

SEQ ID NO: 2693925 - protein, 22 aa, Entamoeba histolytica
RKEFKRKINELINQYIQNTDNL

SEQ ID NO: 2693926 - protein, 19 aa, Entamoeba histolytica
RKEGKFFDSFDKAYGCCGF

SEQ ID NO: 2693927 - protein, 22 aa, Entamoeba histolytica
RKEGKRVICISPDIKTITEKEN

SEQ ID NO: 2693928 - protein, 18 aa, Entamoeba histolytica
RKEHSLLFILLIINYWLN

SEQ ID NO: 2693929 - protein, 18 aa, Entamoeba histolytica
RKEKELKKGIEEKAQEMN

SEQ ID NO: 2693930 - protein, 18 aa, Entamoeba histolytica
RKELEVMAKTCNRMDLTS

SEQ ID NO: 2693931 - protein, 30 aa, Entamoeba histolytica
RKELPQLQLIESRIKIHFQRIGTPQKAQIA

SEQ ID NO: 2693932 - protein, 17 aa, Entamoeba histolytica
RKEMTGIEKRTIHTVDN

SEQ ID NO: 2693933 - protein, 18 aa, Entamoeba histolytica
RKENCIRTIDIHPNSDKR

SEQ ID NO: 2693934 - protein, 17 aa, Entamoeba histolytica
RKENIQFMKKREQNQKK

SEQ ID NO: 2693935 - protein, 21 aa, Entamoeba histolytica
RKENTFHIIEKSFLRGEAYSE

SEQ ID NO: 2693936 - protein, 22 aa, Entamoeba histolytica
RKERLKQLALERIDLSKDPYFY

SEQ ID NO: 2693937 - protein, 24 aa, Entamoeba histolytica
RKESKEYLKSIGIDLSKISIDESI

SEQ ID NO: 2693938 - protein, 20 aa, Entamoeba histolytica
RKEVLMLMEYCPSSLVQILE

SEQ ID NO: 2693939 - protein, 17 aa, Entamoeba histolytica
RKEVSLLKGEGGIKRKK

SEQ ID NO: 2693940 - protein, 24 aa, Entamoeba histolytica
RKEYAKCYDEFISLSRQCLLTTQR

SEQ ID NO: 2693941 - protein, 21 aa, Entamoeba histolytica
RKFDRGAYILCQEIKTNRYKE

SEQ ID NO: 2693942 - protein, 20 aa, Entamoeba histolytica
RKFIECSKLLSTKQGMYAYL

SEQ ID NO: 2693943 - protein, 17 aa, Entamoeba histolytica
RKFLFGFVAHLIQYNEI

SEQ ID NO: 2693944 - protein, 18 aa, Entamoeba histolytica
RKFLKRIGLEQLTEQFIG

SEQ ID NO: 2693945 - protein, 19 aa, Entamoeba histolytica
RKFNDLVLLLADKINKSNM

SEQ ID NO: 2693946 - protein, 21 aa, Entamoeba histolytica
RKFSFHSFFILGMTKNQIIQH

SEQ ID NO: 2693947 - protein, 23 aa, Entamoeba histolytica
RKGDKSPSVWILTKDNIYFYNSY

SEQ ID NO: 2693948 - protein, 24 aa, Entamoeba histolytica
RKGEEYNVECPFCDGKEENTKEMY

SEQ ID NO: 2693949 - protein, 22 aa, Entamoeba histolytica
RKGEIIVAAVVYLLSREYSDKK

SEQ ID NO: 2693950 - protein, 18 aa, Entamoeba histolytica
RKGGLGLEEIIAVIMYSD

SEQ ID NO: 2693951 - protein, 29 aa, Entamoeba histolytica
RKGGMNQLWASKILQIFKFLNGKDTFEQH

SEQ ID NO: 2693952 - protein, 19 aa, Entamoeba histolytica
RKGIQKCLDGKNIQTKQSR

SEQ ID NO: 2693953 - protein, 18 aa, Entamoeba histolytica
RKGKEIISKMAKEGKECW

SEQ ID NO: 2693954 - protein, 26 aa, Entamoeba histolytica
RKGKYRFPGTDLWYNTIEEYKKLQKE

SEQ ID NO: 2693955 - protein, 21 aa, Entamoeba histolytica
RKGLGDFVIYVTIDDIWVVLT

SEQ ID NO: 2693956 - protein, 17 aa, Entamoeba histolytica
RKGLRKDENGIWRRRSL

SEQ ID NO: 2693957 - protein, 19 aa, Entamoeba histolytica
RKGNYVCIAEMIRGNKTLK

SEQ ID NO: 2693958 - protein, 18 aa, Entamoeba histolytica
RKGRREIMLASQRIVSVI

SEQ ID NO: 2693959 - protein, 24 aa, Entamoeba histolytica
RKGSFRVSVIFGDKNKWGHYSLTD

SEQ ID NO: 2693960 - protein, 20 aa, Entamoeba histolytica
RKGYKKGNVQLVLFVGGTSK

SEQ ID NO: 2693961 - protein, 18 aa, Entamoeba histolytica
RKGYKKGNVQLVLLIGGT

SEQ ID NO: 2693962 - protein, 19 aa, Entamoeba histolytica
RKGYSLSKTFGIYIKNRTN

SEQ ID NO: 2693963 - protein, 17 aa, Entamoeba histolytica
RKGYWIVLDELNLAPSE

SEQ ID NO: 2693964 - protein, 19 aa, Entamoeba histolytica
RKHAIKMGLIKTNEVKHKV

SEQ ID NO: 2693965 - protein, 25 aa, Entamoeba histolytica
RKHHCNYCGKVFCDKCLSYRIVLPK

SEQ ID NO: 2693966 - protein, 20 aa, Entamoeba histolytica
RKHRINIKLNPWKETNPVVQ

SEQ ID NO: 2693967 - protein, 27 aa, Entamoeba histolytica
RKHSIEVFKPGKFCLVHMKSAEMYCYT

SEQ ID NO: 2693968 - protein, 19 aa, Entamoeba histolytica
RKIDIWSAGVIIYIILTGR

SEQ ID NO: 2693969 - protein, 26 aa, Entamoeba histolytica
RKIEEIHFYQSLLQSFGYKFVFNKSP

SEQ ID NO: 2693970 - protein, 33 aa, Entamoeba histolytica
RKIEQTIDFDKGWYIIFGCTYQPAIERRYLMEI

SEQ ID NO: 2693971 - protein, 19 aa, Entamoeba histolytica
RKIFERWCTDKKNGVIIPG

SEQ ID NO: 2693972 - protein, 18 aa, Entamoeba histolytica
RKIIFESLARKIKETNEQ

SEQ ID NO: 2693973 - protein, 21 aa, Entamoeba histolytica
RKIINRMIHVMKGADRESSMA

SEQ ID NO: 2693974 - protein, 19 aa, Entamoeba histolytica
RKIITIPYISGFLGFREVE

SEQ ID NO: 2693975 - protein, 20 aa, Entamoeba histolytica
RKILRKCAKFNRKGNDSGGS

SEQ ID NO: 2693976 - protein, 17 aa, Entamoeba histolytica
RKIMAVWDSCTQRSKKE

SEQ ID NO: 2693977 - protein, 29 aa, Entamoeba histolytica
RKIMKEFLEDLLFEYGIIFIDSTNRVTTI

SEQ ID NO: 2693978 - protein, 32 aa, Entamoeba histolytica
RKKCGITKMEIMSLYEMMVWAELKNNNEIMPK

SEQ ID NO: 2693979 - protein, 21 aa, Entamoeba histolytica
RKKDRCINDFTFSVNIPLVEE

SEQ ID NO: 2693980 - protein, 20 aa, Entamoeba histolytica
RKKELQYSFYCMSRATMTAL

SEQ ID NO: 2693981 - protein, 20 aa, Entamoeba histolytica
RKKEMLMVARSLAKDMKAIC

SEQ ID NO: 2693982 - protein, 21 aa, Entamoeba histolytica
RKKEQIQWSIGLSLSLFGISF

SEQ ID NO: 2693983 - protein, 23 aa, Entamoeba histolytica
RKKEWRNALFEIKNNVAGRYKDF

SEQ ID NO: 2693984 - protein, 23 aa, Entamoeba histolytica
RKKHEECLYCCYLYNILSKSKKE

SEQ ID NO: 2693985 - protein, 20 aa, Entamoeba histolytica
RKKICIRMLQNGTIPIYNMI

SEQ ID NO: 2693986 - protein, 19 aa, Entamoeba histolytica
RKKIYSTALAQLVFLLLEP

SEQ ID NO: 2693987 - protein, 18 aa, Entamoeba histolytica
RKKKFRMISIDGGGSKCT

SEQ ID NO: 2693988 - protein, 19 aa, Entamoeba histolytica
RKKLTPLELFWLLNEFADL

SEQ ID NO: 2693989 - protein, 20 aa, Entamoeba histolytica
RKKREVLLEVLIKGMTSALL

SEQ ID NO: 2693990 - protein, 23 aa, Entamoeba histolytica
RKKRKSYVIFVQKRLDLVEQLQN

SEQ ID NO: 2693991 - protein, 25 aa, Entamoeba histolytica
RKKSLCEIEQMIVLLSQQIQLLQNK

SEQ ID NO: 2693992 - protein, 20 aa, Entamoeba histolytica
RKKTLCLMKSITEVRNKEIK

SEQ ID NO: 2693993 - protein, 18 aa, Entamoeba histolytica
RKKVCFESIVIYPEEEIK

SEQ ID NO: 2693994 - protein, 17 aa, Entamoeba histolytica
RKKYDNWNIPKCVLTLE

SEQ ID NO: 2693995 - protein, 21 aa, Entamoeba histolytica
RKLEIIKECTEHGYFVISEVG

SEQ ID NO: 2693996 - protein, 17 aa, Entamoeba histolytica
RKLEPEQAILVLQDLLR

SEQ ID NO: 2693997 - protein, 18 aa, Entamoeba histolytica
RKLEYGWNSIGEETKKGI

SEQ ID NO: 2693998 - protein, 19 aa, Entamoeba histolytica
RKLFSKAGEIERVKIVRES

SEQ ID NO: 2693999 - protein, 19 aa, Entamoeba histolytica
RKLGLEKIGECLANLYLIR

SEQ ID NO: 2694000 - protein, 19 aa, Entamoeba histolytica
RKLGMKFDIEKDVLMSLEP

SEQ ID NO: 2694001 - protein, 17 aa, Entamoeba histolytica
RKLKECLTKLITDETQQ

SEQ ID NO: 2694002 - protein, 20 aa, Entamoeba histolytica
RKLKKQIKRNIKKEAKEKQL

SEQ ID NO: 2694003 - protein, 24 aa, Entamoeba histolytica
RKLKMTNPHFIRCILPNTQKKQRY

SEQ ID NO: 2694004 - protein, 18 aa, Entamoeba histolytica
RKLLKKYIENLSMITAED

SEQ ID NO: 2694005 - protein, 18 aa, Entamoeba histolytica
RKLLSEINNINELTLIEL

SEQ ID NO: 2694006 - protein, 19 aa, Entamoeba histolytica
RKLLYYGLLIPINDEFPKK

SEQ ID NO: 2694007 - protein, 21 aa, Entamoeba histolytica
RKLPHCQYVGVYKRRKFEEKK

SEQ ID NO: 2694008 - protein, 25 aa, Entamoeba histolytica
RKLQDINIFSGRMFDPFNYIDDLLS

SEQ ID NO: 2694009 - protein, 20 aa, Entamoeba histolytica
RKLQGMVKHVIFPCPTGVTK

SEQ ID NO: 2694010 - protein, 18 aa, Entamoeba histolytica
RKLQHRFGVDTITTPMNP

SEQ ID NO: 2694011 - protein, 25 aa, Entamoeba histolytica
RKLQKRALRCYLRALDYLDNDYRIP

SEQ ID NO: 2694012 - protein, 25 aa, Entamoeba histolytica
RKLSDKLKGPWDWKEKFSTYERIKK

SEQ ID NO: 2694013 - protein, 19 aa, Entamoeba histolytica
RKLYVPKLTTLVTHPTATY

SEQ ID NO: 2694014 - protein, 22 aa, Entamoeba histolytica
RKMFERGMRICLSTDTPLHTHI

SEQ ID NO: 2694015 - protein, 17 aa, Entamoeba histolytica
RKMLNEVIVHNNYGEGD

SEQ ID NO: 2694016 - protein, 21 aa, Entamoeba histolytica
RKMMIEICLEYPSKDKLFSTL

SEQ ID NO: 2694017 - protein, 22 aa, Entamoeba histolytica
RKMNRCLFCSQPFISEKELELR

SEQ ID NO: 2694018 - protein, 23 aa, Entamoeba histolytica
RKNARKAIKLFRVYDTNRDGLLN

SEQ ID NO: 2694019 - protein, 19 aa, Entamoeba histolytica
RKNDALAIGECLGLDNVPV

SEQ ID NO: 2694020 - protein, 18 aa, Entamoeba histolytica
RKNECLRCPINPKHKFCE

SEQ ID NO: 2694021 - protein, 32 aa, Entamoeba histolytica
RKNELLEETIDLWKKLRERAGIIRDEQDKQTQ

SEQ ID NO: 2694022 - protein, 25 aa, Entamoeba histolytica
RKNFKECTTLTIAHRLHSIMDSNRV

SEQ ID NO: 2694023 - protein, 25 aa, Entamoeba histolytica
RKNFKKCTTLTIAHRLHSIMDSNRV

SEQ ID NO: 2694024 - protein, 18 aa, Entamoeba histolytica
RKNGSILRFVCPQLADYF

SEQ ID NO: 2694025 - protein, 17 aa, Entamoeba histolytica
RKNILGMVITKNNDIFG

SEQ ID NO: 2694026 - protein, 23 aa, Entamoeba histolytica
RKNKIRFEWLVNLFDTENNELKK

SEQ ID NO: 2694027 - protein, 19 aa, Entamoeba histolytica
RKNKKILGNEFLGVFSEEI

SEQ ID NO: 2694028 - protein, 20 aa, Entamoeba histolytica
RKNNNWTDLYWRDVMSDEAI

SEQ ID NO: 2694029 - protein, 20 aa, Entamoeba histolytica
RKNQELKEQIELLKQENMVL

SEQ ID NO: 2694030 - protein, 26 aa, Entamoeba histolytica
RKNRINKKLARPHEMIQFNDGNQVIS

SEQ ID NO: 2694031 - protein, 26 aa, Entamoeba histolytica
RKNSRPCPSCKTFIEKNGGCQWMSCY

SEQ ID NO: 2694032 - protein, 24 aa, Entamoeba histolytica
RKNTKGLNKIICWLKKTENTENQQ

SEQ ID NO: 2694033 - protein, 26 aa, Entamoeba histolytica
RKNVDARTKWHVMNAYTLHREQLDIM

SEQ ID NO: 2694034 - protein, 23 aa, Entamoeba histolytica
RKNVYCDLMKVGIVDPTKVVRNA

SEQ ID NO: 2694035 - protein, 20 aa, Entamoeba histolytica
RKPFPNIFYLEEFVPTFISI

SEQ ID NO: 2694036 - protein, 29 aa, Entamoeba histolytica
RKPSNLTLPKWFPTQPIPFDFKSNKIEDE

SEQ ID NO: 2694037 - protein, 21 aa, Entamoeba histolytica
RKPTFSLKAPYVVTTRILPYP

SEQ ID NO: 2694038 - protein, 19 aa, Entamoeba histolytica
RKQEYCLDSSLALKLSVIF

SEQ ID NO: 2694039 - protein, 24 aa, Entamoeba histolytica
RKQITKEGFAYRKTLSCETDQSLN

SEQ ID NO: 2694040 - protein, 26 aa, Entamoeba histolytica
RKQMAEFFRIMKFQRYFESGDALSGY

SEQ ID NO: 2694041 - protein, 20 aa, Entamoeba histolytica
RKQYIYSISDLLSFKSSAVP

SEQ ID NO: 2694042 - protein, 19 aa, Entamoeba histolytica
RKRALRLFGNYLGNSLYDT

SEQ ID NO: 2694043 - protein, 21 aa, Entamoeba histolytica
RKRFGRRFDHFERLRKKRARD

SEQ ID NO: 2694044 - protein, 24 aa, Entamoeba histolytica
RKRFWFEKFHWFLSSENFIIISGK

SEQ ID NO: 2694045 - protein, 20 aa, Entamoeba histolytica
RKRIPLRKNTLVWGLKSDFT

SEQ ID NO: 2694046 - protein, 17 aa, Entamoeba histolytica
RKRKGFDPKVFLVEQPN

SEQ ID NO: 2694047 - protein, 19 aa, Entamoeba histolytica
RKRNKYLMKIKNWIEEKCK

SEQ ID NO: 2694048 - protein, 21 aa, Entamoeba histolytica
RKSDIWALGCLLFETAIGTPP

SEQ ID NO: 2694049 - protein, 21 aa, Entamoeba histolytica
RKSIEDFVPKAIMHFLINQTC

SEQ ID NO: 2694050 - protein, 18 aa, Entamoeba histolytica
RKSKRTKQTIKMLLPETI

SEQ ID NO: 2694051 - protein, 18 aa, Entamoeba histolytica
RKSLMFMCPAMEINEIML

SEQ ID NO: 2694052 - protein, 17 aa, Entamoeba histolytica
RKSLMKLAMEQKMSDGK

SEQ ID NO: 2694053 - protein, 20 aa, Entamoeba histolytica
RKSNMNMHILFKIILKNTIH

SEQ ID NO: 2694054 - protein, 20 aa, Entamoeba histolytica
RKTEKSKRCKEKEEKQIKRQ

SEQ ID NO: 2694055 - protein, 18 aa, Entamoeba histolytica
RKTIKPRYFYLFNDILIY

SEQ ID NO: 2694056 - protein, 18 aa, Entamoeba histolytica
RKTLITKKVEPVKVHQLF

SEQ ID NO: 2694057 - protein, 20 aa, Entamoeba histolytica
RKTQSRLSVLIAQPQQSISI

SEQ ID NO: 2694058 - protein, 24 aa, Entamoeba histolytica
RKTSFEMIKHPFLETKVSKSEMAD

SEQ ID NO: 2694059 - protein, 19 aa, Entamoeba histolytica
RKTSTAFRVTSKIAPGDII

SEQ ID NO: 2694060 - protein, 28 aa, Entamoeba histolytica
RKTTIPKFVQLVGVACLHLCVKFQEITY

SEQ ID NO: 2694061 - protein, 21 aa, Entamoeba histolytica
RKTVIHWFLDFYNSECPYSIH

SEQ ID NO: 2694062 - protein, 19 aa, Entamoeba histolytica
RKVERRWRLVGWGEVVKGT

SEQ ID NO: 2694063 - protein, 20 aa, Entamoeba histolytica
RKVFEKCGRVLAITLSKTKD

SEQ ID NO: 2694064 - protein, 19 aa, Entamoeba histolytica
RKVFVTNFIKASSRLLNNY

SEQ ID NO: 2694065 - protein, 24 aa, Entamoeba histolytica
RKVGKTGIESINFRKLEEKLNIWK

SEQ ID NO: 2694066 - protein, 22 aa, Entamoeba histolytica
RKVIEGTIPLIVRIPFKNEEKF

SEQ ID NO: 2694067 - protein, 17 aa, Entamoeba histolytica
RKVLLYRGCEDDVREFV

SEQ ID NO: 2694068 - protein, 19 aa, Entamoeba histolytica
RKVVKRFGCDVTMTEMIMA

SEQ ID NO: 2694069 - protein, 25 aa, Entamoeba histolytica
RKVYEIRSSYKFAEKSIDTDFKEVH

SEQ ID NO: 2694070 - protein, 20 aa, Entamoeba histolytica
RKYCHGVFDQLYRATIGVDF

SEQ ID NO: 2694071 - protein, 19 aa, Entamoeba histolytica
RKYGNLYIWNAFISTFNVY

SEQ ID NO: 2694072 - protein, 20 aa, Entamoeba histolytica
RKYITWKAKEGNSIIQMPQL

SEQ ID NO: 2694073 - protein, 23 aa, Entamoeba histolytica
RKYKGQSGIIYCLSQKNTMDIAQ

SEQ ID NO: 2694074 - protein, 19 aa, Entamoeba histolytica
RKYKTIFIESSNVREFYKK

SEQ ID NO: 2694075 - protein, 31 aa, Entamoeba histolytica; identical to SEQ ID NO: 2502634

SEQ ID NO: 2694076 - protein, 17 aa, Entamoeba histolytica
RKYLTILKQLRTEIQNN

SEQ ID NO: 2694077 - protein, 17 aa, Entamoeba histolytica
RKYQHAMKIDIDQHASI

SEQ ID NO: 2694078 - protein, 19 aa, Entamoeba histolytica
RLACHTGKGAILFCVTRGR

SEQ ID NO: 2694079 - protein, 18 aa, Entamoeba histolytica
RLAHLPSSLISRASQIAT

SEQ ID NO: 2694080 - protein, 23 aa, Entamoeba histolytica
RLAKELKKKLAKDVENYENAIKD

SEQ ID NO: 2694081 - protein, 17 aa, Entamoeba histolytica
RLAMTGSIRRYLAEHPK

SEQ ID NO: 2694082 - protein, 20 aa, Entamoeba histolytica
RLCFSNCTSLKSLEFPSRLK

SEQ ID NO: 2694083 - protein, 19 aa, Entamoeba histolytica
RLCRIKYDKEHTISPTEVA

SEQ ID NO: 2694084 - protein, 31 aa, Entamoeba histolytica
RLDCDWKVDYILPRQKWEFFRDFSDSTLRKL

SEQ ID NO: 2694085 - protein, 17 aa, Entamoeba histolytica
RLDMIRPKLTWASIDVF

SEQ ID NO: 2694086 - protein, 18 aa, Entamoeba histolytica
RLDQIEMFLPVLLQMNQF

SEQ ID NO: 2694087 - protein, 19 aa, Entamoeba histolytica
RLDRHSLSLTFRKKKNNVI

SEQ ID NO: 2694088 - protein, 17 aa, Entamoeba histolytica
RLDSCVPDDVIVDTEYL

SEQ ID NO: 2694089 - protein, 18 aa, Entamoeba histolytica
RLDVDLCYQAKSAADIPS

SEQ ID NO: 2694090 - protein, 18 aa, Entamoeba histolytica
RLECCSYRGEIPCNFIKL

SEQ ID NO: 2694091 - protein, 17 aa, Entamoeba histolytica
RLEDILNGFRIIGDLGE

SEQ ID NO: 2694092 - protein, 20 aa, Entamoeba histolytica
RLEESKGERIEIEKERDRVI

SEQ ID NO: 2694093 - protein, 23 aa, Entamoeba histolytica
RLEFFDCQTFELIETYSLTVIET

SEQ ID NO: 2694094 - protein, 26 aa, Entamoeba histolytica
RLEGEWKVCEYNSKYEICNTYPTQLI

SEQ ID NO: 2694095 - protein, 19 aa, Entamoeba histolytica
RLEISKCQSIILNLPSSLK

SEQ ID NO: 2694096 - protein, 26 aa, Entamoeba histolytica
RLESKSSFKKLCFNLQSKISVGHALN

SEQ ID NO: 2694097 - protein, 24 aa, Entamoeba histolytica
RLEVCVKCGQTLSGNVLEALGKKY

SEQ ID NO: 2694098 - protein, 18 aa, Entamoeba histolytica
RLEVEAIVTVPNDFCKLA

SEQ ID NO: 2694099 - protein, 17 aa, Entamoeba histolytica
RLFECINNVIRFKDTKY

SEQ ID NO: 2694100 - protein, 18 aa, Entamoeba histolytica
RLFEDSKEPVGIYQNYVQ

SEQ ID NO: 2694101 - protein, 18 aa, Entamoeba histolytica
RLFIIKRVVKEDDLTQLI

SEQ ID NO: 2694102 - protein, 20 aa, Entamoeba histolytica
RLFIITSSFSFLEFLQTNPN

SEQ ID NO: 2694103 - protein, 18 aa, Entamoeba histolytica
RLFINFLGGDIVDLSTGK

SEQ ID NO: 2694104 - protein, 17 aa, Entamoeba histolytica
RLFKESRGIKMFSGSKE

SEQ ID NO: 2694105 - protein, 20 aa, Entamoeba histolytica
RLFNVALDVIEKVFGEKSSL

SEQ ID NO: 2694106 - protein, 26 aa, Entamoeba histolytica
RLFSKCGKCGRILLKVIGDQTYLSCP

SEQ ID NO: 2694107 - protein, 20 aa, Entamoeba histolytica
RLFVQPTLVSPMGIQKESIT

SEQ ID NO: 2694108 - protein, 18 aa, Entamoeba histolytica
RLFYCVSKTPNIKGEIPL

SEQ ID NO: 2694109 - protein, 20 aa, Entamoeba histolytica
RLGDMWKESLIELSGGQKSL

SEQ ID NO: 2694110 - protein, 21 aa, Entamoeba histolytica
RLGDMWKESLIELSGGQKSLL

SEQ ID NO: 2694111 - protein, 25 aa, Entamoeba histolytica
RLGILKRIIEVGIRMNDLNNWNGLV

SEQ ID NO: 2694112 - protein, 20 aa, Entamoeba histolytica
RLGKEIKISYMRAYETIKLL

SEQ ID NO: 2694113 - protein, 20 aa, Entamoeba histolytica
RLGSSLDWSREVFTMDEKRG

SEQ ID NO: 2694114 - protein, 18 aa, Entamoeba histolytica
RLGTCSLDTTVTVWSVET

SEQ ID NO: 2694115 - protein, 18 aa, Entamoeba histolytica
RLGVMKMIKIQTEYNQSI

SEQ ID NO: 2694116 - protein, 19 aa, Entamoeba histolytica
RLHEKRISITTNINDDVTL

SEQ ID NO: 2694117 - protein, 18 aa, Entamoeba histolytica
RLHKMKQYCEEFIGLMKG

SEQ ID NO: 2694118 - protein, 18 aa, Entamoeba histolytica
RLIECLSVIALELKGDYC

SEQ ID NO: 2694119 - protein, 18 aa, Entamoeba histolytica
RLIEKSQELVLFNLVYLE

SEQ ID NO: 2694120 - protein, 29 aa, Entamoeba histolytica
RLIGEKHSSLILCRFSEGVTEGYQLRGNE

SEQ ID NO: 2694121 - protein, 37 aa, Entamoeba histolytica
RLIGKLYIQGAVVFKLPLLCCKELLQVGNDLTIEALT

SEQ ID NO: 2694122 - protein, 18 aa, Entamoeba histolytica
RLIGKRMSSQDIKAKEFQ

SEQ ID NO: 2694123 - protein, 20 aa, Entamoeba histolytica
RLIHIKGKRNPFARLVECSW

SEQ ID NO: 2694124 - protein, 18 aa, Entamoeba histolytica
RLIIIKFLIDVANHCKIL

SEQ ID NO: 2694125 - protein, 18 aa, Entamoeba histolytica
RLIIPRGVVNISINSFKG

SEQ ID NO: 2694126 - protein, 21 aa, Entamoeba histolytica
RLIKCEYCSLMFPANQIQQHK

SEQ ID NO: 2694127 - protein, 19 aa, Entamoeba histolytica
RLIKELKQVASQFHVQSRD

SEQ ID NO: 2694128 - protein, 18 aa, Entamoeba histolytica
RLILVELLLKAGAEVDAT

SEQ ID NO: 2694129 - protein, 30 aa, Entamoeba histolytica; identical to SEQ ID NO: 2502684

SEQ ID NO: 2694130 - protein, 18 aa, Entamoeba histolytica
RLIVNKSLHLEDFVNELK

SEQ ID NO: 2694131 - protein, 21 aa, Entamoeba histolytica
RLKAISSQCNEIWICRGDMGV

SEQ ID NO: 2694132 - protein, 20 aa, Entamoeba histolytica
RLKDLYEIYLSERLKRIENI

SEQ ID NO: 2694133 - protein, 25 aa, Entamoeba histolytica
RLKEAKRDFAIDIFEDVALGKVTLA

SEQ ID NO: 2694134 - protein, 17 aa, Entamoeba histolytica
RLKEFISSGFIYDENDI

SEQ ID NO: 2694135 - protein, 25 aa, Entamoeba histolytica
RLKELKELYNILTIPKIPIRDDIKM

SEQ ID NO: 2694136 - protein, 19 aa, Entamoeba histolytica
RLKIADYGLSRAFGDDSTL

SEQ ID NO: 2694137 - protein, 18 aa, Entamoeba histolytica
RLKPSHLANKEIVTQLYI

SEQ ID NO: 2694138 - protein, 18 aa, Entamoeba histolytica
RLKTHTFDGVPLVLENSF

SEQ ID NO: 2694139 - protein, 17 aa, Entamoeba histolytica
RLKTLIENGVKLGERTF

SEQ ID NO: 2694140 - protein, 18 aa, Entamoeba histolytica
RLLAIKISKFSSFLLHYN

SEQ ID NO: 2694141 - protein, 18 aa, Entamoeba histolytica
RLLCTPDYVASEVINERL

SEQ ID NO: 2694142 - protein, 19 aa, Entamoeba histolytica
RLLDCVVIAMHHCNKSISI

SEQ ID NO: 2694143 - protein, 25 aa, Entamoeba histolytica
RLLFEELRKSLVRCIEDQNGNHVIQ

SEQ ID NO: 2694144 - protein, 19 aa, Entamoeba histolytica
RLLFNSCIWTETHNYEPTK

SEQ ID NO: 2694145 - protein, 18 aa, Entamoeba histolytica
RLLMLKGCQCDFPEFDNA

SEQ ID NO: 2694146 - protein, 17 aa, Entamoeba histolytica
RLLNEINPFEYLNSIDW

SEQ ID NO: 2694147 - protein, 19 aa, Entamoeba histolytica
RLLPPNVCISNATIQEVVQ

SEQ ID NO: 2694148 - protein, 19 aa, Entamoeba histolytica
RLLSLCKPTIFTNFINLDR

SEQ ID NO: 2694149 - protein, 18 aa, Entamoeba histolytica
RLLSVHPFGNKEEILTKS

SEQ ID NO: 2694150 - protein, 22 aa, Entamoeba histolytica
RLLTQPMKIDWTFYCHKCDGMA

SEQ ID NO: 2694151 - protein, 20 aa, Entamoeba histolytica
RLLWKYRYLVEKTKPGSLAR

SEQ ID NO: 2694152 - protein, 21 aa, Entamoeba histolytica
RLLYPELPRLEFIDFVKQIAF

SEQ ID NO: 2694153 - protein, 22 aa, Entamoeba histolytica
RLNDTFCLPIACFQFNQPEEFK

SEQ ID NO: 2694154 - protein, 29 aa, Entamoeba histolytica
RLNEQFLPIQLGPSFAERIQLEKAIFSYP

SEQ ID NO: 2694155 - protein, 17 aa, Entamoeba histolytica
RLNEVLLKFQETSKSVE

SEQ ID NO: 2694156 - protein, 18 aa, Entamoeba histolytica
RLNHIAIKYKHLYLTNTQ

SEQ ID NO: 2694157 - protein, 20 aa, Entamoeba histolytica
RLNIYKPWRATNEQMEMFHS

SEQ ID NO: 2694158 - protein, 19 aa, Entamoeba histolytica
RLNKKFQKRSDGPYQETES

SEQ ID NO: 2694159 - protein, 18 aa, Entamoeba histolytica
RLNLKRMVELCNGKESSY

SEQ ID NO: 2694160 - protein, 18 aa, Entamoeba histolytica
RLNLLKIQFKEGREIILF

SEQ ID NO: 2694161 - protein, 23 aa, Entamoeba histolytica
RLNMKQCNICFVNNGVRLKEIRG

SEQ ID NO: 2694162 - protein, 23 aa, Entamoeba histolytica
RLNPVEIPFFIPINQHSDAIFKP

SEQ ID NO: 2694163 - protein, 18 aa, Entamoeba histolytica
RLNQLAIKYKHLYLTNTQ

SEQ ID NO: 2694164 - protein, 17 aa, Entamoeba histolytica
RLNQPTLRFSVQTSFRL

SEQ ID NO: 2694165 - protein, 19 aa, Entamoeba histolytica
RLNREIIILITNLVIEKKM

SEQ ID NO: 2694166 - protein, 18 aa, Entamoeba histolytica
RLNSVTINGKFFGFRHIN

SEQ ID NO: 2694167 - protein, 26 aa, Entamoeba histolytica
RLNVLPIYEYKIWKTIPGIKRIVENL

SEQ ID NO: 2694168 - protein, 21 aa, Entamoeba histolytica
RLPEHCIVWASQIAWENPTIN

SEQ ID NO: 2694169 - protein, 18 aa, Entamoeba histolytica
RLPFELMQMDSFSAIPAQ

SEQ ID NO: 2694170 - protein, 20 aa, Entamoeba histolytica
RLPFPNICGRVCPHYCQGKC

SEQ ID NO: 2694171 - protein, 20 aa, Entamoeba histolytica
RLPKANKFVWLFPVHIGEAL

SEQ ID NO: 2694172 - protein, 23 aa, Entamoeba histolytica
RLPSTYIGRRLFSIYNDDDDDEY

SEQ ID NO: 2694173 - protein, 25 aa, Entamoeba histolytica
RLQFDLSPSSSFLFIPIEDDDILLM

SEQ ID NO: 2694174 - protein, 17 aa, Entamoeba histolytica
RLQFKGWDQRKIIDRET

SEQ ID NO: 2694175 - protein, 25 aa, Entamoeba histolytica
RLQFQYRMHPCLSEFSSQTFYDGVL

SEQ ID NO: 2694176 - protein, 19 aa, Entamoeba histolytica
RLQFSSLFVQSVKGCSNVM

SEQ ID NO: 2694177 - protein, 18 aa, Entamoeba histolytica
RLQIDSCNSIHELNLENY

SEQ ID NO: 2694178 - protein, 24 aa, Entamoeba histolytica
RLQIMKGMNTIEEMLQLEEWTNRK

SEQ ID NO: 2694179 - protein, 17 aa, Entamoeba histolytica
RLQLLSVNCEQSTAILL

SEQ ID NO: 2694180 - protein, 24 aa, Entamoeba histolytica
RLRDLAIEVCERYNGIIPSSVDKL

SEQ ID NO: 2694181 - protein, 19 aa, Entamoeba histolytica
RLRHKQEMKHKKSVLQRTN

SEQ ID NO: 2694182 - protein, 18 aa, Entamoeba histolytica
RLRNCLRVIEKIKLKEKT

SEQ ID NO: 2694183 - protein, 40 aa, Entamoeba histolytica
RLRRYERNKIALAFNELVEIAVKFGYEFGEKNTRKAQKTV

SEQ ID NO: 2694184 - protein, 17 aa, Entamoeba histolytica
RLSNMSVRDKIALFNQK

SEQ ID NO: 2694185 - protein, 20 aa, Entamoeba histolytica
RLSPQTALRMMRIFDTDFNG

SEQ ID NO: 2694186 - protein, 26 aa, Entamoeba histolytica
RLSQFKCIRKALKHSKKITIMINQNK

SEQ ID NO: 2694187 - protein, 17 aa, Entamoeba histolytica
RLTDGRGRTVDFKNTVV

SEQ ID NO: 2694188 - protein, 25 aa, Entamoeba histolytica
RLTFGNNPLKCFNLVILKHIEVIEE

SEQ ID NO: 2694189 - protein, 19 aa, Entamoeba histolytica
RLTHFACLYSKLIGANTEL

SEQ ID NO: 2694190 - protein, 18 aa, Entamoeba histolytica
RLTIKYKAKEVGSLVTCS

SEQ ID NO: 2694191 - protein, 18 aa, Entamoeba histolytica
RLTSIKFPYTTNLKRLKL

SEQ ID NO: 2694192 - protein, 20 aa, Entamoeba histolytica
RLTSSWNWCSMIERYIFYPF

SEQ ID NO: 2694193 - protein, 20 aa, Entamoeba histolytica
RLTTFEIPYALFVVLDAKKT

SEQ ID NO: 2694194 - protein, 18 aa, Entamoeba histolytica
RLVAYGSYEVFELHFDLI

SEQ ID NO: 2694195 - protein, 23 aa, Entamoeba histolytica
RLVCERARYEAMSKFNEEASKIY

SEQ ID NO: 2694196 - protein, 31 aa, Entamoeba histolytica
RLVGLNKPWHCPHGRQTIRHLWDLRRSYNEI

SEQ ID NO: 2694197 - protein, 24 aa, Entamoeba histolytica
RLVIKLCNQMNAIAMTKELTNLAG

SEQ ID NO: 2694198 - protein, 18 aa, Entamoeba histolytica
RLVNHFIAEFKRKYKKDI

SEQ ID NO: 2694199 - protein, 24 aa, Entamoeba histolytica
RLVRYSLDCLNRLSTNPKATPQLH

SEQ ID NO: 2694200 - protein, 19 aa, Entamoeba histolytica
RLWDLTKMESVRRFVGHES

SEQ ID NO: 2694201 - protein, 17 aa, Entamoeba histolytica
RLWKYNDTRVWEVCCLR

SEQ ID NO: 2694202 - protein, 26 aa, Entamoeba histolytica
RLYDDCNFKTFSWDIFKALCSTRGES

SEQ ID NO: 2694203 - protein, 18 aa, Entamoeba histolytica
RLYEFICKQYSTIVAPVS

SEQ ID NO: 2694204 - protein, 19 aa, Entamoeba histolytica
RLYEKKNIMGLIITDDDAV

SEQ ID NO: 2694205 - protein, 24 aa, Entamoeba histolytica
RLYFKCTRCKTIFTIKTDPKNSDY

SEQ ID NO: 2694206 - protein, 24 aa, Entamoeba histolytica
RLYFKDIKGVLLVFQIDRQESFDH

SEQ ID NO: 2694207 - protein, 18 aa, Entamoeba histolytica
RLYGRHLSSCSFRNKSIE

SEQ ID NO: 2694208 - protein, 19 aa, Entamoeba histolytica
RLYLRKGKGEARICKVYDS

SEQ ID NO: 2694209 - protein, 27 aa, Entamoeba histolytica
RLYNDYFYKRHEGLWEATARKRLPAMA

SEQ ID NO: 2694210 - protein, 24 aa, Entamoeba histolytica
RLYPGERVCQMIFMRMDGTAQYKG

SEQ ID NO: 2694211 - protein, 24 aa, Entamoeba histolytica
RLYQLPPYLPFSLRTLLINSNHLI

SEQ ID NO: 2694212 - protein, 20 aa, Entamoeba histolytica
RMALEGAKVLGVYEILPKIS

SEQ ID NO: 2694213 - protein, 20 aa, Entamoeba histolytica
RMCKDLKHIIYYRFNTNSIE

SEQ ID NO: 2694214 - protein, 18 aa, Entamoeba histolytica
RMENGSIRMIKKEGNRIV

SEQ ID NO: 2694215 - protein, 17 aa, Entamoeba histolytica
RMERVGGVLLQCIHSGF

SEQ ID NO: 2694216 - protein, 17 aa, Entamoeba histolytica
RMFEMIEFVELYNFNPI

SEQ ID NO: 2694217 - protein, 37 aa, Entamoeba histolytica
RMIFNKAKELFGIGAYQGAIDWMKEYLMMKGNNKEQR

SEQ ID NO: 2694218 - protein, 24 aa, Entamoeba histolytica
RMIKKEGNRIVLTWERNTGGLVET

SEQ ID NO: 2694219 - protein, 23 aa, Entamoeba histolytica
RMIKSSKGKIEWENDVKEYINKL

SEQ ID NO: 2694220 - protein, 20 aa, Entamoeba histolytica
RMKEAYQRKNIISIIQMIEW

SEQ ID NO: 2694221 - protein, 24 aa, Entamoeba histolytica
RMKNGLRMNKHFGLLRNINRVQNE

SEQ ID NO: 2694222 - protein, 18 aa, Entamoeba histolytica
RMKQLKFDIQQPNINTIK

SEQ ID NO: 2694223 - protein, 32 aa, Entamoeba histolytica; identical to SEQ ID NO: 2502775

SEQ ID NO: 2694224 - protein, 21 aa, Entamoeba histolytica
RMMACSVDGFVAYFEFNENEI

SEQ ID NO: 2694225 - protein, 23 aa, Entamoeba histolytica
RMMKLRRKARKVLRKKQQQASNK

SEQ ID NO: 2694226 - protein, 34 aa, Entamoeba histolytica
RMNRECWLVYDGKEPFVFTNYFHGWRVNKKQVIS

SEQ ID NO: 2694227 - protein, 28 aa, Entamoeba histolytica
RMRCTTGIKPNEPIKVFVTISNNTGKPL

SEQ ID NO: 2694228 - protein, 24 aa, Entamoeba histolytica
RMRDFTCTYATRFLGFKPSAAPMG

SEQ ID NO: 2694229 - protein, 28 aa, Entamoeba histolytica
RMRYLYIALEWLSQCSFYCKEKVKGPNG

SEQ ID NO: 2694230 - protein, 26 aa, Entamoeba histolytica
RMSNYMFINQLNFFAGYSYNDINNHP

SEQ ID NO: 2694231 - protein, 19 aa, Entamoeba histolytica
RMSPPPPIMTVRRDPMDYV

SEQ ID NO: 2694232 - protein, 23 aa, Entamoeba histolytica
RMSQRLATCLAEGMNEEEEIYKG

SEQ ID NO: 2694233 - protein, 23 aa, Entamoeba histolytica
RMSQRLVTCLAEGMNEEEEIYKG

SEQ ID NO: 2694234 - protein, 28 aa, Entamoeba histolytica
RMTENLMKRRAEFIINHFDELIKRTDSS

SEQ ID NO: 2694235 - protein, 17 aa, Entamoeba histolytica
RMVCGCFPNEINTSQTL

SEQ ID NO: 2694236 - protein, 18 aa, Entamoeba histolytica
RMVDPLVFGNLKSETEML

SEQ ID NO: 2694237 - protein, 19 aa, Entamoeba histolytica
RMVHFGISFVPSFQTSLTY

SEQ ID NO: 2694238 - protein, 23 aa, Entamoeba histolytica
RMVHLSKAFKYFVPSTELFFENY

SEQ ID NO: 2694239 - protein, 18 aa, Entamoeba histolytica
RMVKSSKNAMNFIEDLHK

SEQ ID NO: 2694240 - protein, 21 aa, Entamoeba histolytica
RMYRCSKCKREFEVEAQVETS

SEQ ID NO: 2694241 - protein, 18 aa, Entamoeba histolytica
RNACDHLSSCFERGAMIE

SEQ ID NO: 2694242 - protein, 17 aa, Entamoeba histolytica
RNACGGTAYGKPITIKD

SEQ ID NO: 2694243 - protein, 20 aa, Entamoeba histolytica
RNAIKSAFNLFLFPIYSQVN

SEQ ID NO: 2694244 - protein, 17 aa, Entamoeba histolytica
RNALTIIVRNRVAYYLQ

SEQ ID NO: 2694245 - protein, 26 aa, Entamoeba histolytica
RNAQYLNDYRFFSFESTGPEQKPVME

SEQ ID NO: 2694246 - protein, 20 aa, Entamoeba histolytica
RNARHLPEIRGMKERKNLVK

SEQ ID NO: 2694247 - protein, 18 aa, Entamoeba histolytica
RNATRKALTIKRNTQKKA

SEQ ID NO: 2694248 - protein, 23 aa, Entamoeba histolytica
RNCNVVLRWALLHGTYPIKKLRD

SEQ ID NO: 2694249 - protein, 21 aa, Entamoeba histolytica
RNCSYYFGYKAINEFLQTNNI

SEQ ID NO: 2694250 - protein, 23 aa, Entamoeba histolytica
RNDKLEWKRLIVVLENAPLEPVK

SEQ ID NO: 2694251 - protein, 30 aa, Entamoeba histolytica
RNDLPSLLLLPIKFLPQFYSLIKEYHKCLP

SEQ ID NO: 2694252 - protein, 18 aa, Entamoeba histolytica
RNDQLVHVLSLWKSLINN

SEQ ID NO: 2694253 - protein, 18 aa, Entamoeba histolytica
RNDVDFVQRILLMKQTNA

SEQ ID NO: 2694254 - protein, 21 aa, Entamoeba histolytica
RNEAKVIYEMICKKKAPRVSS

SEQ ID NO: 2694255 - protein, 21 aa, Entamoeba histolytica
RNECIDAGVLEEVLNKSNELC

SEQ ID NO: 2694256 - protein, 26 aa, Entamoeba histolytica
RNEFEPEKKFTIGVEFATRTIEYEGK

SEQ ID NO: 2694257 - protein, 19 aa, Entamoeba histolytica
RNELFRYRGIVQHKYIEFF

SEQ ID NO: 2694258 - protein, 22 aa, Entamoeba histolytica
RNELKSPLLSALHTLSELEDDK

SEQ ID NO: 2694259 - protein, 24 aa, Entamoeba histolytica
RNEMNEIFPYFLVDCKEIKPEHFS

SEQ ID NO: 2694260 - protein, 20 aa, Entamoeba histolytica
RNEMTLKYQTEFNLPEKQFV

SEQ ID NO: 2694261 - protein, 22 aa, Entamoeba histolytica
RNENRYRWGVDKAYDVKVVEIV

SEQ ID NO: 2694262 - protein, 19 aa, Entamoeba histolytica
RNEPFGVFIDFTHSRNSLE

SEQ ID NO: 2694263 - protein, 23 aa, Entamoeba histolytica
RNERFNYIIPIFNYLKENEDIVY

SEQ ID NO: 2694264 - protein, 26 aa, Entamoeba histolytica
RNETAPICILVFLPGMAEIEEMKSRL

SEQ ID NO: 2694265 - protein, 17 aa, Entamoeba histolytica
RNEVSILASQGVVRKVC

SEQ ID NO: 2694266 - protein, 23 aa, Entamoeba histolytica
RNEWFIKQFHPINLRERRMAKQR

SEQ ID NO: 2694267 - protein, 30 aa, Entamoeba histolytica; identical to SEQ ID NO: 2502809

SEQ ID NO: 2694268 - protein, 18 aa, Entamoeba histolytica
RNFLGGLFVDNHDMDRIM

SEQ ID NO: 2694269 - protein, 20 aa, Entamoeba histolytica
RNFLIYSVNDGCGWGVEPSY

SEQ ID NO: 2694270 - protein, 22 aa, Entamoeba histolytica
RNFPDLFPSFLSSSLLPDSLDY

SEQ ID NO: 2694271 - protein, 23 aa, Entamoeba histolytica
RNFSYEMLEIIQPDVIILGDCAG

SEQ ID NO: 2694272 - protein, 19 aa, Entamoeba histolytica
RNFYEMRKNILAKAEKTME

SEQ ID NO: 2694273 - protein, 24 aa, Entamoeba histolytica
RNGAFKIKLPRLIINTNDENLKYE

SEQ ID NO: 2694274 - protein, 20 aa, Entamoeba histolytica
RNGFEEWRNYYIPSPSEYFK

SEQ ID NO: 2694275 - protein, 31 aa, Entamoeba histolytica; identical to SEQ ID NO: 2502815

SEQ ID NO: 2694276 - protein, 19 aa, Entamoeba histolytica
RNGIECINILLDQEYVEPI

SEQ ID NO: 2694277 - protein, 21 aa, Entamoeba histolytica
RNGMVPLIRPSYINNSTQRQS

SEQ ID NO: 2694278 - protein, 18 aa, Entamoeba histolytica
RNHCGIHPMKFTKKDNEY

SEQ ID NO: 2694279 - protein, 18 aa, Entamoeba histolytica
RNIFKGVAVWITGRTHPS

SEQ ID NO: 2694280 - protein, 19 aa, Entamoeba histolytica
RNIFKKSKIDKILTVVGNY

SEQ ID NO: 2694281 - protein, 19 aa, Entamoeba histolytica
RNIQCIGALLKHLIRINPK

SEQ ID NO: 2694282 - protein, 24 aa, Entamoeba histolytica
RNIRMGKYFLEIDIMDLQNFDESL

SEQ ID NO: 2694283 - protein, 19 aa, Entamoeba histolytica
RNKEIFEMMYGFNQNCVSI

SEQ ID NO: 2694284 - protein, 18 aa, Entamoeba histolytica
RNKELCCGEYVKMDDTRF

SEQ ID NO: 2694285 - protein, 17 aa, Entamoeba histolytica
RNKELEDVCGIKGSIFC

SEQ ID NO: 2694286 - protein, 20 aa, Entamoeba histolytica
RNKKLFCYGTQIGNNPPLLR

SEQ ID NO: 2694287 - protein, 24 aa, Entamoeba histolytica
RNKNRIGHQFFWFLKAELHDNRVT

SEQ ID NO: 2694288 - protein, 21 aa, Entamoeba histolytica
RNKPFLMKSFSKKQMKKEEDR

SEQ ID NO: 2694289 - protein, 25 aa, Entamoeba histolytica
RNKSYQIYNCFKLATEVVGRLQSTA

SEQ ID NO: 2694290 - protein, 18 aa, Entamoeba histolytica
RNKVPLSVKHFFYSFCPF

SEQ ID NO: 2694291 - protein, 23 aa, Entamoeba histolytica
RNKVRLSPALAMMLNGMSQNEYG

SEQ ID NO: 2694292 - protein, 27 aa, Entamoeba histolytica
RNLKEVIETVKYLKCLKDKVKEVEELL

SEQ ID NO: 2694293 - protein, 24 aa, Entamoeba histolytica
RNLKGEIKQVSIIKLFGLLFEHCK

SEQ ID NO: 2694294 - protein, 22 aa, Entamoeba histolytica
RNLLLKKINIWLGDNHSQSISF

SEQ ID NO: 2694295 - protein, 21 aa, Entamoeba histolytica
RNLPDRYELYIPAVPSARSLN

SEQ ID NO: 2694296 - protein, 27 aa, Entamoeba histolytica
RNLQHLTELFISYGYCKVEHFMSMCPD

SEQ ID NO: 2694297 - protein, 35 aa, Entamoeba histolytica
RNLVFFKYPKWTGGLYCSPSIPGSRAGNNIAGAWA

SEQ ID NO: 2694298 - protein, 17 aa, Entamoeba histolytica
RNLYAVVVNSDFKILDG

SEQ ID NO: 2694299 - protein, 17 aa, Entamoeba histolytica
RNMPIILKRTKGINEYV

SEQ ID NO: 2694300 - protein, 23 aa, Entamoeba histolytica
RNMPQMVAAIIRKGKTSLGHKMF

SEQ ID NO: 2694301 - protein, 21 aa, Entamoeba histolytica
RNNCFFNCISLYEFDFRPSNK

SEQ ID NO: 2694302 - protein, 20 aa, Entamoeba histolytica
RNNCVELIALEALKKEESFK

SEQ ID NO: 2694303 - protein, 17 aa, Entamoeba histolytica
RNNELERSIAMSEKKKQ

SEQ ID NO: 2694304 - protein, 24 aa, Entamoeba histolytica
RNNELKVNLAFTICIGEKIKHFSA

SEQ ID NO: 2694305 - protein, 25 aa, Entamoeba histolytica
RNNFRIRYDYEISWGSQPDQILELK

SEQ ID NO: 2694306 - protein, 22 aa, Entamoeba histolytica
RNPENCALILKINRSNSLIEVE

SEQ ID NO: 2694307 - protein, 17 aa, Entamoeba histolytica
RNPKITLVCFDTFEDIM

SEQ ID NO: 2694308 - protein, 18 aa, Entamoeba histolytica
RNPLKTTTFGVGEMIYDA

SEQ ID NO: 2694309 - protein, 25 aa, Entamoeba histolytica
RNPMKRSPIKFPFTGKKGTLRIEDS

SEQ ID NO: 2694310 - protein, 18 aa, Entamoeba histolytica
RNPWGCCEWKGKWRDDDP

SEQ ID NO: 2694311 - protein, 30 aa, Entamoeba histolytica; identical to SEQ ID NO: 2502857

SEQ ID NO: 2694312 - protein, 21 aa, Entamoeba histolytica
RNQRICKFYQIGQCKFGDNCK

SEQ ID NO: 2694313 - protein, 25 aa, Entamoeba histolytica
RNREASFSNALAWLLIDRGYSLQLG

SEQ ID NO: 2694314 - protein, 19 aa, Entamoeba histolytica
RNRIIYSIHLLEDILGELG

SEQ ID NO: 2694315 - protein, 18 aa, Entamoeba histolytica
RNRIKWSDLIYEDSTYVN

SEQ ID NO: 2694316 - protein, 18 aa, Entamoeba histolytica
RNRKCIQEAVLIGILSKH

SEQ ID NO: 2694317 - protein, 17 aa, Entamoeba histolytica
RNRRYGDSYIFIGKDNA

SEQ ID NO: 2694318 - protein, 21 aa, Entamoeba histolytica
RNRTSPFAFIGNRFEFRAVGS

SEQ ID NO: 2694319 - protein, 19 aa, Entamoeba histolytica
RNRVKGLIVTLFTPKENKY

SEQ ID NO: 2694320 - protein, 18 aa, Entamoeba histolytica
RNSGCGLPYLEIPNEDMK

SEQ ID NO: 2694321 - protein, 20 aa, Entamoeba histolytica
RNSLEKISPFLVSETSEEAI

SEQ ID NO: 2694322 - protein, 19 aa, Entamoeba histolytica
RNSLEKLSPFLYANSPEEA

SEQ ID NO: 2694323 - protein, 20 aa, Entamoeba histolytica
RNSWGTGWGEKGYINMVIEG

SEQ ID NO: 2694324 - protein, 19 aa, Entamoeba histolytica
RNSYQWCDNPKFIISSTHP

SEQ ID NO: 2694325 - protein, 23 aa, Entamoeba histolytica
RNTESKSSFSLYCNDSHVVLNCY

SEQ ID NO: 2694326 - protein, 25 aa, Entamoeba histolytica
RNVFIKKQLELLIPIIEARISDGCV

SEQ ID NO: 2694327 - protein, 27 aa, Entamoeba histolytica
RNVGQCLSNFFKPEFFKGDNRLKTDDG

SEQ ID NO: 2694328 - protein, 24 aa, Entamoeba histolytica
RNVISWQYICRVIFYCLSVIYKKN

SEQ ID NO: 2694329 - protein, 18 aa, Entamoeba histolytica
RNVKETQIKFGLKQNQLK

SEQ ID NO: 2694330 - protein, 25 aa, Entamoeba histolytica
RNVKYGNCSQFVWSDNGGYAVLEKN

SEQ ID NO: 2694331 - protein, 20 aa, Entamoeba histolytica
RNVLLDWLFLVSQDEFATTI

SEQ ID NO: 2694332 - protein, 20 aa, Entamoeba histolytica
RNVTDLSTIEFEYFTLLLQQ

SEQ ID NO: 2694333 - protein, 20 aa, Entamoeba histolytica
RNVTKFLYGLREGLGQLLKK

SEQ ID NO: 2694334 - protein, 20 aa, Entamoeba histolytica
RNWMCREFKEIVYDPRDDID

SEQ ID NO: 2694335 - protein, 17 aa, Entamoeba histolytica
RNYCLKCLNGYKIENNK

SEQ ID NO: 2694336 - protein, 31 aa, Entamoeba histolytica
RNYQRSKEILKWFDDIDESFKQIGEMINNFE

SEQ ID NO: 2694337 - protein, 20 aa, Entamoeba histolytica
RPDEAVSWGKIKIDSENVKV

SEQ ID NO: 2694338 - protein, 27 aa, Entamoeba histolytica
RPDLFSISILLKFSYPICIETQIENKE

SEQ ID NO: 2694339 - protein, 23 aa, Entamoeba histolytica
RPEDILYAGLRMRVLKVRTTDEV

SEQ ID NO: 2694340 - protein, 19 aa, Entamoeba histolytica
RPEFERSLRDLNEVLKYNS

SEQ ID NO: 2694341 - protein, 22 aa, Entamoeba histolytica
RPEIKELALYYLTHPEDINLTL

SEQ ID NO: 2694342 - protein, 25 aa, Entamoeba histolytica
RPEKLPDVCYSWWVLTSLIILGKVD

SEQ ID NO: 2694343 - protein, 22 aa, Entamoeba histolytica
RPENRPRCCTFSMKGQFNSTFD

SEQ ID NO: 2694344 - protein, 20 aa, Entamoeba histolytica
RPERIAQIAERFGVDQTAVL

SEQ ID NO: 2694345 - protein, 17 aa, Entamoeba histolytica
RPFEFVSINLKKYLNNL

SEQ ID NO: 2694346 - protein, 23 aa, Entamoeba histolytica
RPGQTCTFIGILIAAPDTTRLSV

SEQ ID NO: 2694347 - protein, 26 aa, Entamoeba histolytica
RPIDEKETLCGRREVLLMNPNETTSD

SEQ ID NO: 2694348 - protein, 28 aa, Entamoeba histolytica
RPIFTQKEVRGEYKYLFDSIIPVNELKE

SEQ ID NO: 2694349 - protein, 17 aa, Entamoeba histolytica
RPIKEYLAKEVKGQKKE

SEQ ID NO: 2694350 - protein, 18 aa, Entamoeba histolytica
RPILSMKALYDYEASDST

SEQ ID NO: 2694351 - protein, 17 aa, Entamoeba histolytica
RPKKDLGAIAMAYGDVY

SEQ ID NO: 2694352 - protein, 24 aa, Entamoeba histolytica
RPKLPKEAVCSFFGDSSKNLFGIF

SEQ ID NO: 2694353 - protein, 20 aa, Entamoeba histolytica
RPKLTEVLTHLASRAANLET

SEQ ID NO: 2694354 - protein, 18 aa, Entamoeba histolytica
RPLGAGREVGRSCFILKY

SEQ ID NO: 2694355 - protein, 26 aa, Entamoeba histolytica
RPLILRFDVKYVLGLFFGYGLSHGMF

SEQ ID NO: 2694356 - protein, 19 aa, Entamoeba histolytica
RPLKEVKERAIIMEEKAII

SEQ ID NO: 2694357 - protein, 18 aa, Entamoeba histolytica
RPLLFIALMESDIELSQK

SEQ ID NO: 2694358 - protein, 25 aa, Entamoeba histolytica
RPLLGRTGILKDFNLIVGTDKTGMM

SEQ ID NO: 2694359 - protein, 18 aa, Entamoeba histolytica
RPLLPTLKFSEGVSEWKV

SEQ ID NO: 2694360 - protein, 19 aa, Entamoeba histolytica
RPLLTCEPITKCVRDLLVL

SEQ ID NO: 2694361 - protein, 20 aa, Entamoeba histolytica
RPNTFCLFGDDFAQIITVEG

SEQ ID NO: 2694362 - protein, 21 aa, Entamoeba histolytica
RPNVCGLILAGIADFKTVLNK

SEQ ID NO: 2694363 - protein, 17 aa, Entamoeba histolytica
RPPELLLGCTLYGSEID

SEQ ID NO: 2694364 - protein, 17 aa, Entamoeba histolytica
RPPELLLGETRYKGEVD

SEQ ID NO: 2694365 - protein, 25 aa, Entamoeba histolytica
RPQIEGYDSWVIFHLYDIVKQCDDP

SEQ ID NO: 2694366 - protein, 18 aa, Entamoeba histolytica
RPQLKRKYLTILKQLRTE

SEQ ID NO: 2694367 - protein, 24 aa, Entamoeba histolytica
RPRSIPIDNLHAFRGNTRTVLHSV

SEQ ID NO: 2694368 - protein, 20 aa, Entamoeba histolytica
RPSGRARIREAFNNRQELLS

SEQ ID NO: 2694369 - protein, 18 aa, Entamoeba histolytica
RPSLSEIFFSSESGTEGE

SEQ ID NO: 2694370 - protein, 17 aa, Entamoeba histolytica
RPSRTVIENELLPRQPY

SEQ ID NO: 2694371 - protein, 19 aa, Entamoeba histolytica
RPSSVPISFWKEFKDFLKV

SEQ ID NO: 2694372 - protein, 19 aa, Entamoeba histolytica
RPSVESIRGHPLIRLCRQH

SEQ ID NO: 2694373 - protein, 17 aa, Entamoeba histolytica
RPSVKINKQEFIVEIYP

SEQ ID NO: 2694374 - protein, 19 aa, Entamoeba histolytica
RPTENPLSIGIKENPSIKH

SEQ ID NO: 2694375 - protein, 17 aa, Entamoeba histolytica
RPTLKRTIPGAFSSTRN

SEQ ID NO: 2694376 - protein, 23 aa, Entamoeba histolytica
RPTPLCHYLFPAGGNGIYLVVDK

SEQ ID NO: 2694377 - protein, 18 aa, Entamoeba histolytica
RPVERWKDLIPIIKSFSI

SEQ ID NO: 2694378 - protein, 19 aa, Entamoeba histolytica
RPVILERPEDPIANELTNE

SEQ ID NO: 2694379 - protein, 20 aa, Entamoeba histolytica
RPVVRPQVKSAVRHDIPAET

SEQ ID NO: 2694380 - protein, 21 aa, Entamoeba histolytica
RPYGVSFLYAGWDRYFGYQLY

SEQ ID NO: 2694381 - protein, 20 aa, Entamoeba histolytica
RPYLNDCVEIVKALISIQHS

SEQ ID NO: 2694382 - protein, 18 aa, Entamoeba histolytica
RQASMIIDMFTKFNKDNN

SEQ ID NO: 2694383 - protein, 17 aa, Entamoeba histolytica
RQAVILVENEITDMECN

SEQ ID NO: 2694384 - protein, 20 aa, Entamoeba histolytica
RQDKPCCIKPFPSSSSICKP

SEQ ID NO: 2694385 - protein, 22 aa, Entamoeba histolytica
RQEEYYYLFQIVSYLYFAPFRQ

SEQ ID NO: 2694386 - protein, 25 aa, Entamoeba histolytica
RQEIDLRVGVAFTRLQTKFLKERFP

SEQ ID NO: 2694387 - protein, 21 aa, Entamoeba histolytica
RQELEMAMGSVPAGLSVTSDL

SEQ ID NO: 2694388 - protein, 19 aa, Entamoeba histolytica
RQESFPSISSIKMTKDGNT

SEQ ID NO: 2694389 - protein, 23 aa, Entamoeba histolytica
RQFPSLKYFWFKQNKPMMFIAAN

SEQ ID NO: 2694390 - protein, 23 aa, Entamoeba histolytica
RQGNRAPECFKRVRDLETKQECF

SEQ ID NO: 2694391 - protein, 21 aa, Entamoeba histolytica
RQGPVVVCILDGFGIDKEGPG

SEQ ID NO: 2694392 - protein, 20 aa, Entamoeba histolytica
RQGVEMPLNEVLQLTRIYQS

SEQ ID NO: 2694393 - protein, 22 aa, Entamoeba histolytica
RQIKKKVLKYIVTFRGDLSQIS

SEQ ID NO: 2694394 - protein, 24 aa, Entamoeba histolytica
RQISESYGLLSIIGVSNRATVIVD

SEQ ID NO: 2694395 - protein, 17 aa, Entamoeba histolytica
RQIVKSDHCSINFPSIG

SEQ ID NO: 2694396 - protein, 23 aa, Entamoeba histolytica
RQKASMKKLGFPTDMFPVISPIC

SEQ ID NO: 2694397 - protein, 27 aa, Entamoeba histolytica
RQKKLEYLFSQLIRYVPQFNKEAQIAL

SEQ ID NO: 2694398 - protein, 19 aa, Entamoeba histolytica
RQKPEVLKKIVKRRYGDVL

SEQ ID NO: 2694399 - protein, 18 aa, Entamoeba histolytica
RQKTPLIISRNYSKQPNL

SEQ ID NO: 2694400 - protein, 24 aa, Entamoeba histolytica
RQLDFLPYHFLLSVNCVETKPKLK

SEQ ID NO: 2694401 - protein, 20 aa, Entamoeba histolytica
RQLFREKLGVGICYDDEGHL

SEQ ID NO: 2694402 - protein, 19 aa, Entamoeba histolytica
RQLISFGIHPWHCGDETLC

SEQ ID NO: 2694403 - protein, 19 aa, Entamoeba histolytica
RQLKAFRAIQILKEEGAFE

SEQ ID NO: 2694404 - protein, 23 aa, Entamoeba histolytica
RQMAEYDYATAYEILYSNAHSCI

SEQ ID NO: 2694405 - protein, 25 aa, Entamoeba histolytica
RQMICMARALLKGAKILIMDEATAS

SEQ ID NO: 2694406 - protein, 25 aa, Entamoeba histolytica
RQMIETYCPIDFVMRGVGGKHGWSS

SEQ ID NO: 2694407 - protein, 17 aa, Entamoeba histolytica
RQMKQKGLMKINEVRQA

SEQ ID NO: 2694408 - protein, 23 aa, Entamoeba histolytica
RQMLHRILFLFAIKHPELNYTQG

SEQ ID NO: 2694409 - protein, 20 aa, Entamoeba histolytica
RQNNKLFLNDSIKVNKRIVP

SEQ ID NO: 2694410 - protein, 17 aa, Entamoeba histolytica
RQNSIKAIDVFQPDKYY

SEQ ID NO: 2694411 - protein, 17 aa, Entamoeba histolytica
RQNWCSELLKSCQPKVI

SEQ ID NO: 2694412 - protein, 21 aa, Entamoeba histolytica
RQQIKLLILIFWSLNTQKTED

SEQ ID NO: 2694413 - protein, 18 aa, Entamoeba histolytica
RQQLPPREGRRYGERKEH

SEQ ID NO: 2694414 - protein, 22 aa, Entamoeba histolytica
RQRCEKEIRSIFKHIRELLHIA

SEQ ID NO: 2694415 - protein, 20 aa, Entamoeba histolytica
RQSIDKLRMNTAALESEMNR

SEQ ID NO: 2694416 - protein, 21 aa, Entamoeba histolytica
RQSSELMEIDNTFNFDNKKEE

SEQ ID NO: 2694417 - protein, 17 aa, Entamoeba histolytica
RQSSILCDDKKHFMFTL

SEQ ID NO: 2694418 - protein, 18 aa, Entamoeba histolytica
RQTEVLKMTGNVIKMNLF

SEQ ID NO: 2694419 - protein, 20 aa, Entamoeba histolytica
RQTNSFLIVYSIVDEKTFET

SEQ ID NO: 2694420 - protein, 22 aa, Entamoeba histolytica
RQTRPELLVGICGEHGGEPSSI

SEQ ID NO: 2694421 - protein, 25 aa, Entamoeba histolytica
RQTSCKSRVILLLISALKYFTKNGE

SEQ ID NO: 2694422 - protein, 25 aa, Entamoeba histolytica
RQVKCTTSPILDEKVDLLSLRKLSD

SEQ ID NO: 2694423 - protein, 23 aa, Entamoeba histolytica
RQVSRFPFGYVVNNRLNDTFCLP

SEQ ID NO: 2694424 - protein, 19 aa, Entamoeba histolytica
RQYIIDLINTWNGSFPNEI

SEQ ID NO: 2694425 - protein, 21 aa, Entamoeba histolytica
RQYLEKIFKVFGYELPTDPVF

SEQ ID NO: 2694426 - protein, 25 aa, Entamoeba histolytica
RQYRCPEVMLGLHWGCPADVWSHAC

SEQ ID NO: 2694427 - protein, 20 aa, Entamoeba histolytica
RRAEEWYNKALILSENIERR

SEQ ID NO: 2694428 - protein, 19 aa, Entamoeba histolytica
RRAETMKRYGATVILHGVT

SEQ ID NO: 2694429 - protein, 18 aa, Entamoeba histolytica
RRCSERLYKITANDIPLI

SEQ ID NO: 2694430 - protein, 18 aa, Entamoeba histolytica
RRDAFRASKTMQERVLNH

SEQ ID NO: 2694431 - protein, 24 aa, Entamoeba histolytica
RRDKTRAGLRFSSRGADSSGNVSN

SEQ ID NO: 2694432 - protein, 24 aa, Entamoeba histolytica
RRDLMKEIYEEVSVKEEESDDDDD

SEQ ID NO: 2694433 - protein, 19 aa, Entamoeba histolytica
RREDLPIKWIKKAFSDVMT

SEQ ID NO: 2694434 - protein, 25 aa, Entamoeba histolytica
RREEMPCLFGTLFRDLNPSDLIKNE

SEQ ID NO: 2694435 - protein, 17 aa, Entamoeba histolytica
RREKRRSSEISIKKEKK

SEQ ID NO: 2694436 - protein, 18 aa, Entamoeba histolytica
RRELEIMKKIQHENVVSF

SEQ ID NO: 2694437 - protein, 24 aa, Entamoeba histolytica
RREMKQLDTVYLMKVIPHIRDMKD

SEQ ID NO: 2694438 - protein, 19 aa, Entamoeba histolytica
RREQYAVCLAFMIDGDIKV

SEQ ID NO: 2694439 - protein, 18 aa, Entamoeba histolytica
RREVIVFLSPENVNNKIR

SEQ ID NO: 2694440 - protein, 17 aa, Entamoeba histolytica
RRFCLVPLTAEQAKRVL

SEQ ID NO: 2694441 - protein, 25 aa, Entamoeba histolytica
RRFDKKLHSHFAYWMDSVLEIFETC

SEQ ID NO: 2694442 - protein, 21 aa, Entamoeba histolytica
RRFSLKTVLMLLNQMLKRLQF

SEQ ID NO: 2694443 - protein, 28 aa, Entamoeba histolytica
RRFSNFKFPECFCIIAERPFESLFKKIL

SEQ ID NO: 2694444 - protein, 17 aa, Entamoeba histolytica
RRFTDFRTQKAVQLSGG

SEQ ID NO: 2694445 - protein, 22 aa, Entamoeba histolytica
RRGGCDYCAMLSTSIECDASDA

SEQ ID NO: 2694446 - protein, 20 aa, Entamoeba histolytica
RRGGIICICSHGLKQVIEDF

SEQ ID NO: 2694447 - protein, 35 aa, Entamoeba histolytica
RRGIQILKMRYLIVYKYYPDKSVILALLRDSSVFR

SEQ ID NO: 2694448 - protein, 22 aa, Entamoeba histolytica
RRGNSFRQTLLWLTEELNKERK

SEQ ID NO: 2694449 - protein, 17 aa, Entamoeba histolytica
RRGSTMIHTTDFSNSDK

SEQ ID NO: 2694450 - protein, 20 aa, Entamoeba histolytica
RRGSTPINYCLDKSKQEKEK

SEQ ID NO: 2694451 - protein, 26 aa, Entamoeba histolytica
RRHHCRKCGKCICGECSKGRIPITPQ

SEQ ID NO: 2694452 - protein, 26 aa, Entamoeba histolytica
RRHHCRKCGRVLCAECTKRRVVIPHI

SEQ ID NO: 2694453 - protein, 20 aa, Entamoeba histolytica
RRHVGMIIRLSMIVFGFDTQ

SEQ ID NO: 2694454 - protein, 21 aa, Entamoeba histolytica
RRICPLFVTKGFDSISITSQS

SEQ ID NO: 2694455 - protein, 22 aa, Entamoeba histolytica
RRIEPKYYFPIIPTVLVNGADG

SEQ ID NO: 2694456 - protein, 21 aa, Entamoeba histolytica
RRIFKGSDCWIQRNIKKQLKY

SEQ ID NO: 2694457 - protein, 20 aa, Entamoeba histolytica
RRIHCPMASQPSTPVIRNQR

SEQ ID NO: 2694458 - protein, 17 aa, Entamoeba histolytica
RRIKQLGTAHYVFPSGT

SEQ ID NO: 2694459 - protein, 20 aa, Entamoeba histolytica
RRIREMYGMTEIRKNMNRMK

SEQ ID NO: 2694460 - protein, 20 aa, Entamoeba histolytica
RRISNKTLKSKFQEIDQSNS

SEQ ID NO: 2694461 - protein, 19 aa, Entamoeba histolytica
RRIVFGIPEERSRSKSSLA

SEQ ID NO: 2694462 - protein, 24 aa, Entamoeba histolytica
RRKATKCCFCQNDLVIGYNDGIIK

SEQ ID NO: 2694463 - protein, 21 aa, Entamoeba histolytica
RRKEIKKLIPPGYIERDVNGK

SEQ ID NO: 2694464 - protein, 19 aa, Entamoeba histolytica
RRKEILEQMELKFEIHVSN

SEQ ID NO: 2694465 - protein, 22 aa, Entamoeba histolytica
RRKEVEHKNGLLVLLNGLKNDI

SEQ ID NO: 2694466 - protein, 17 aa, Entamoeba histolytica
RRKHSIILPQHLTSITI

SEQ ID NO: 2694467 - protein, 29 aa, Entamoeba histolytica
RRKIELLCKGICKRTEYPCLQCMKDAKLR

SEQ ID NO: 2694468 - protein, 24 aa, Entamoeba histolytica
RRKIIIEFISWIFGEVKSMDEGLA

SEQ ID NO: 2694469 - protein, 17 aa, Entamoeba histolytica
RRKKCIINLKKTKNGFM

SEQ ID NO: 2694470 - protein, 21 aa, Entamoeba histolytica
RRKKFERPLESPKRSNSTVST

SEQ ID NO: 2694471 - protein, 17 aa, Entamoeba histolytica
RRKSTVCIVMAEEGLTE

SEQ ID NO: 2694472 - protein, 19 aa, Entamoeba histolytica
RRKSYCINKNITHKKSVDS

SEQ ID NO: 2694473 - protein, 22 aa, Entamoeba histolytica
RRKTDEFYRYKMPDLIHKIEGK

SEQ ID NO: 2694474 - protein, 21 aa, Entamoeba histolytica
RRKTTRFSAEFGKELQEALLR

SEQ ID NO: 2694475 - protein, 20 aa, Entamoeba histolytica
RRLDLCPANQRLLRKRLSIN

SEQ ID NO: 2694476 - protein, 26 aa, Entamoeba histolytica
RRLIGRLPEILKIYPQLIVVLQKVDV

SEQ ID NO: 2694477 - protein, 20 aa, Entamoeba histolytica
RRLKNMFSKTLQFKIKGNLG

SEQ ID NO: 2694478 - protein, 17 aa, Entamoeba histolytica
RRLNVHFRTKSSDAHMF

SEQ ID NO: 2694479 - protein, 23 aa, Entamoeba histolytica
RRLSAYEKGGWTFNFLKDSLSFY

SEQ ID NO: 2694480 - protein, 20 aa, Entamoeba histolytica
RRLSQHVLKMHRHFDALTEQ

SEQ ID NO: 2694481 - protein, 22 aa, Entamoeba histolytica
RRLWRREHPPGFIARPRTTKEG

SEQ ID NO: 2694482 - protein, 18 aa, Entamoeba histolytica
RRMIPVLLNNIVLKKTNT

SEQ ID NO: 2694483 - protein, 20 aa, Entamoeba histolytica
RRMKEGPFIFSVDRHTLVGY

SEQ ID NO: 2694484 - protein, 27 aa, Entamoeba histolytica
RRMKLIKSECTMKFPDYYIYTFEGECV

SEQ ID NO: 2694485 - protein, 20 aa, Entamoeba histolytica
RRNRIKWSDLIYEDSTYVNS

SEQ ID NO: 2694486 - protein, 17 aa, Entamoeba histolytica
RRNSEYMKWLKKRVVDL

SEQ ID NO: 2694487 - protein, 20 aa, Entamoeba histolytica
RRNSMEISISPILTSIIERI

SEQ ID NO: 2694488 - protein, 26 aa, Entamoeba histolytica
RRNTVKRKPTIMCTQPVFRPTINSSH

SEQ ID NO: 2694489 - protein, 24 aa, Entamoeba histolytica
RRPIQITCRFYQIGLLMLFNDNKE

SEQ ID NO: 2694490 - protein, 24 aa, Entamoeba histolytica
RRPKDYNPVLPFISGLSQLMEPGT

SEQ ID NO: 2694491 - protein, 25 aa, Entamoeba histolytica
RRPSGICGVALYLAGRLHGEPRTLE

SEQ ID NO: 2694492 - protein, 23 aa, Entamoeba histolytica
RRQIEIKTLHSFQKIKESTGQDV

SEQ ID NO: 2694493 - protein, 21 aa, Entamoeba histolytica
RRQSCALAIDEVHEIQKVIGV

SEQ ID NO: 2694494 - protein, 17 aa, Entamoeba histolytica
RRQSRSFQRAITPKHFG

SEQ ID NO: 2694495 - protein, 17 aa, Entamoeba histolytica
RRRAVDVLYALCTPQSV

SEQ ID NO: 2694496 - protein, 18 aa, Entamoeba histolytica
RRRDLPPITEVLAAKPIE

SEQ ID NO: 2694497 - protein, 21 aa, Entamoeba histolytica
RRREEFNKRENLPMANREEKE

SEQ ID NO: 2694498 - protein, 21 aa, Entamoeba histolytica
RRREMEFKKRIAMKKQQELKR

SEQ ID NO: 2694499 - protein, 18 aa, Entamoeba histolytica
RRRFKVVLYGVNQMLRYN

SEQ ID NO: 2694500 - protein, 17 aa, Entamoeba histolytica
RRRIEGGFFGYYLKEEW

SEQ ID NO: 2694501 - protein, 20 aa, Entamoeba histolytica
RRRIKEQSWDDVVRKTLIQK

SEQ ID NO: 2694502 - protein, 20 aa, Entamoeba histolytica
RRRLVKRLYIPLPDIEARMT

SEQ ID NO: 2694503 - protein, 22 aa, Entamoeba histolytica
RRRRLFLIEGRISGFSGKLVEP

SEQ ID NO: 2694504 - protein, 18 aa, Entamoeba histolytica
RRRTKDYILLAWYYSPAL

SEQ ID NO: 2694505 - protein, 18 aa, Entamoeba histolytica
RRRVFVIPYLLYQTMNRA

SEQ ID NO: 2694506 - protein, 20 aa, Entamoeba histolytica
RRRYCHCKREVYQRSYCFCI

SEQ ID NO: 2694507 - protein, 19 aa, Entamoeba histolytica
RRSEEILAPTVKRIYEELI

SEQ ID NO: 2694508 - protein, 18 aa, Entamoeba histolytica
RRSRRREMMEQKRNQISS

SEQ ID NO: 2694509 - protein, 18 aa, Entamoeba histolytica
RRSSFIPRTPVVASQELE

SEQ ID NO: 2694510 - protein, 17 aa, Entamoeba histolytica
RRSTICCHILCQACLSV

SEQ ID NO: 2694511 - protein, 22 aa, Entamoeba histolytica
RRTLLNEIRKNAGLEKDIQDME

SEQ ID NO: 2694512 - protein, 19 aa, Entamoeba histolytica
RRTRCKLVAETSAKTKEGI

SEQ ID NO: 2694513 - protein, 21 aa, Entamoeba histolytica
RRTYAPSICTLLLVSQNGNEK

SEQ ID NO: 2694514 - protein, 25 aa, Entamoeba histolytica
RRVKCSKNGLLACCSFDSTVSLWEL

SEQ ID NO: 2694515 - protein, 20 aa, Entamoeba histolytica
RRVTKELLTIIGKAHPQAIV

SEQ ID NO: 2694516 - protein, 18 aa, Entamoeba histolytica
RRWKDRGASVASMSFAEK

SEQ ID NO: 2694517 - protein, 22 aa, Entamoeba histolytica
RRWVKEIYYDTSLVCSKREFTI

SEQ ID NO: 2694518 - protein, 26 aa, Entamoeba histolytica
RRYDRLRYSIVMRLLDICSNFNIKES

SEQ ID NO: 2694519 - protein, 17 aa, Entamoeba histolytica
RRYGKGKILITGFHFEF

SEQ ID NO: 2694520 - protein, 23 aa, Entamoeba histolytica
RRYGNEIPPMISVIEQKAFDGCE

SEQ ID NO: 2694521 - protein, 21 aa, Entamoeba histolytica
RRYICSGPMFVVPNLKDKLKD

SEQ ID NO: 2694522 - protein, 21 aa, Entamoeba histolytica
RRYTILDAPGHRSFVPNMISA

SEQ ID NO: 2694523 - protein, 19 aa, Entamoeba histolytica
RRYYIGGDNYLVCCIKRFK

SEQ ID NO: 2694524 - protein, 17 aa, Entamoeba histolytica
RSCSYDSQDSCNFQRSY

SEQ ID NO: 2694525 - protein, 21 aa, Entamoeba histolytica
RSDMLAVQMIELFDRINKHAG

SEQ ID NO: 2694526 - protein, 25 aa, Entamoeba histolytica
RSDYFFCGTFNILLERDEVINRGNK

SEQ ID NO: 2694527 - protein, 17 aa, Entamoeba histolytica
RSEICYLGNLIADGYNG

SEQ ID NO: 2694528 - protein, 22 aa, Entamoeba histolytica
RSEKEIENFLTWAYDLNTFEKK

SEQ ID NO: 2694529 - protein, 23 aa, Entamoeba histolytica
RSENPRCLREMLIKVNEVIKGKE

SEQ ID NO: 2694530 - protein, 23 aa, Entamoeba histolytica
RSEYKEEICCLTTSNKVNTLIVN

SEQ ID NO: 2694531 - protein, 29 aa, Entamoeba histolytica
RSFEKYKIILKVSCCLYMGTDKLCNKEYF

SEQ ID NO: 2694532 - protein, 19 aa, Entamoeba histolytica
RSFGDLCHFSISFKSDKQC

SEQ ID NO: 2694533 - protein, 19 aa, Entamoeba histolytica
RSFHPTDLLEIIQRKLEKE

SEQ ID NO: 2694534 - protein, 27 aa, Entamoeba histolytica
RSFSTVCLLLSLWNVVDCPFRAMDEFD

SEQ ID NO: 2694535 - protein, 20 aa, Entamoeba histolytica
RSFYKAIALIGFINQKKLLN

SEQ ID NO: 2694536 - protein, 18 aa, Entamoeba histolytica
RSGAINVLQSRFIQSYVP

SEQ ID NO: 2694537 - protein, 17 aa, Entamoeba histolytica
RSGLGCRYDIDVTPIVQ

SEQ ID NO: 2694538 - protein, 23 aa, Entamoeba histolytica
RSIAEKMTPCLAWDSHDSLDKRM

SEQ ID NO: 2694539 - protein, 17 aa, Entamoeba histolytica
RSIANKILDAFSVLIEQ

SEQ ID NO: 2694540 - protein, 18 aa, Entamoeba histolytica
RSIKGCKLRSVNIVYTPA

SEQ ID NO: 2694541 - protein, 19 aa, Entamoeba histolytica
RSIPPHMFIDINALTAAFY

SEQ ID NO: 2694542 - protein, 19 aa, Entamoeba histolytica
RSIRAYQCALEFLEEDYRI

SEQ ID NO: 2694543 - protein, 17 aa, Entamoeba histolytica
RSIRMVFDDETFYRVNN

SEQ ID NO: 2694544 - protein, 26 aa, Entamoeba histolytica
RSISSRKTISWMPLCLNDFNEKAQIH

SEQ ID NO: 2694545 - protein, 24 aa, Entamoeba histolytica
RSIWPTYRPIVIDIIDCLCDKTNK

SEQ ID NO: 2694546 - protein, 27 aa, Entamoeba histolytica
RSKCSIVAPLPKRVWQKKVESPNYKHG

SEQ ID NO: 2694547 - protein, 28 aa, Entamoeba histolytica
RSKEDWFDWFRQIAMVFLKESPSQSLCY

SEQ ID NO: 2694548 - protein, 24 aa, Entamoeba histolytica
RSKEFLRCQFINFNRGLESYVERA

SEQ ID NO: 2694549 - protein, 20 aa, Entamoeba histolytica
RSKEVISLLGSYFHPMQFIN

SEQ ID NO: 2694550 - protein, 23 aa, Entamoeba histolytica
RSKGRIPAATWWNREKGVIMRSS

SEQ ID NO: 2694551 - protein, 19 aa, Entamoeba histolytica
RSKILLEVYNSMCGTQLKE

SEQ ID NO: 2694552 - protein, 22 aa, Entamoeba histolytica
RSKKERRVITIITPINAKDIKK

SEQ ID NO: 2694553 - protein, 25 aa, Entamoeba histolytica
RSKKTMKFRIPHSMELNDMKLGINE

SEQ ID NO: 2694554 - protein, 21 aa, Entamoeba histolytica
RSKLLYAHLMIIAGQKQMAHV

SEQ ID NO: 2694555 - protein, 17 aa, Entamoeba histolytica
RSKRFNEEYKRRKINDE

SEQ ID NO: 2694556 - protein, 20 aa, Entamoeba histolytica
RSKRPGIGMDNEFLGTLLKT

SEQ ID NO: 2694557 - protein, 20 aa, Entamoeba histolytica
RSKSCRTLKENEEADKMIEK

SEQ ID NO: 2694558 - protein, 20 aa, Entamoeba histolytica
RSLEGVFRISTDVNVIDNYM

SEQ ID NO: 2694559 - protein, 20 aa, Entamoeba histolytica
RSLESVDMYYVFPSVEDSKI

SEQ ID NO: 2694560 - protein, 24 aa, Entamoeba histolytica
RSLFERLYKCGVFVDMLKIQYRMH

SEQ ID NO: 2694561 - protein, 17 aa, Entamoeba histolytica
RSLGLDVDMLFKKYQHA

SEQ ID NO: 2694562 - protein, 18 aa, Entamoeba histolytica
RSLIPNYIRGASVVVIVY

SEQ ID NO: 2694563 - protein, 19 aa, Entamoeba histolytica
RSLKVLKQIIEPCEDQEGN

SEQ ID NO: 2694564 - protein, 26 aa, Entamoeba histolytica
RSLLLNEVIIPPGRIYKFDPKDPNAR

SEQ ID NO: 2694565 - protein, 19 aa, Entamoeba histolytica
RSLSFKLGEISGIINSQLV

SEQ ID NO: 2694566 - protein, 19 aa, Entamoeba histolytica
RSLSSIYYRNATVALLVYD

SEQ ID NO: 2694567 - protein, 22 aa, Entamoeba histolytica
RSLYDIPLPYCVINCQTMQVAI

SEQ ID NO: 2694568 - protein, 18 aa, Entamoeba histolytica
RSMCKIRVGSEAKDYILI

SEQ ID NO: 2694569 - protein, 19 aa, Entamoeba histolytica
RSMIAFKLDATEVGQSLIT

SEQ ID NO: 2694570 - protein, 20 aa, Entamoeba histolytica
RSNEKLLLGYGFVEENNPCD

SEQ ID NO: 2694571 - protein, 17 aa, Entamoeba histolytica
RSNNDLIEFCSELDNLK

SEQ ID NO: 2694572 - protein, 21 aa, Entamoeba histolytica
RSNNYIKECENFKLEIESNNE

SEQ ID NO: 2694573 - protein, 19 aa, Entamoeba histolytica
RSPASPVIPPLNVNVLNVD

SEQ ID NO: 2694574 - protein, 23 aa, Entamoeba histolytica
RSPFSNKYFPAFPEGGLPSDELR

SEQ ID NO: 2694575 - protein, 24 aa, Entamoeba histolytica
RSPLRKPKDVFVIRQIYSAILNLS

SEQ ID NO: 2694576 - protein, 26 aa, Entamoeba histolytica
RSPREICKRCICQFVHSTGKKIFTIK

SEQ ID NO: 2694577 - protein, 17 aa, Entamoeba histolytica
RSPSTVRCFLKCYGNDH

SEQ ID NO: 2694578 - protein, 20 aa, Entamoeba histolytica
RSQIDYSFPGNYDVKKGVSA

SEQ ID NO: 2694579 - protein, 24 aa, Entamoeba histolytica
RSQKVCKVAPVAGETKVWQYITLL

SEQ ID NO: 2694580 - protein, 26 aa, Entamoeba histolytica
RSRIVYKEKLIFVFKTENGFIGFYQS

SEQ ID NO: 2694581 - protein, 18 aa, Entamoeba histolytica
RSRKRRLSLMAQQKVKTQ

SEQ ID NO: 2694582 - protein, 25 aa, Entamoeba histolytica
RSRNVISWQYICRVIFYCLSVIHKK

SEQ ID NO: 2694583 - protein, 25 aa, Entamoeba histolytica
RSRQYLQCFCVSMIISIKDELMEKE

SEQ ID NO: 2694584 - protein, 25 aa, Entamoeba histolytica
RSRWTELDGLCSIILSPTRELAQQI

SEQ ID NO: 2694585 - protein, 17 aa, Entamoeba histolytica
RSSCVMCHGCNRYYHEK

SEQ ID NO: 2694586 - protein, 18 aa, Entamoeba histolytica
RSSGIGGIVHIISFSTKG

SEQ ID NO: 2694587 - protein, 25 aa, Entamoeba histolytica
RSSLAIKYGIDIGGGVIDEDYRGEI

SEQ ID NO: 2694588 - protein, 26 aa, Entamoeba histolytica
RSSPLEIVEAYNFVRCQSSWRNPTTG

SEQ ID NO: 2694589 - protein, 23 aa, Entamoeba histolytica
RSSQIKPSIGFLSDIRRMNVALT

SEQ ID NO: 2694590 - protein, 24 aa, Entamoeba histolytica
RSSRSHCIFTVFISKLENGIGKKV

SEQ ID NO: 2694591 - protein, 18 aa, Entamoeba histolytica
RSSSFPLSIKSMFENLTM

SEQ ID NO: 2694592 - protein, 19 aa, Entamoeba histolytica
RSSTVLIAYLMYKKMWRYK

SEQ ID NO: 2694593 - protein, 21 aa, Entamoeba histolytica
RSTCSCIRGDVTTFPKEIEAK

SEQ ID NO: 2694594 - protein, 21 aa, Entamoeba histolytica
RSTFWPLMNIDFYKRYQDTYF

SEQ ID NO: 2694595 - protein, 21 aa, Entamoeba histolytica
RSTKFVKILSHLAIPDYPDKL

SEQ ID NO: 2694596 - protein, 19 aa, Entamoeba histolytica
RSTLLKQKFFASIVDEAAQ

SEQ ID NO: 2694597 - protein, 18 aa, Entamoeba histolytica
RSTYVVKIIQDFCDSMTK

SEQ ID NO: 2694598 - protein, 22 aa, Entamoeba histolytica
RSVFPNHLLVIYKREKGMEEIK

SEQ ID NO: 2694599 - protein, 19 aa, Entamoeba histolytica
RSVFSLPAQLRSAAANRDD

SEQ ID NO: 2694600 - protein, 17 aa, Entamoeba histolytica
RSVLKEQILEPYTLFYN

SEQ ID NO: 2694601 - protein, 17 aa, Entamoeba histolytica
RSVMPVYFRGADCAIIV

SEQ ID NO: 2694602 - protein, 18 aa, Entamoeba histolytica
RSYCFCIISSHPSFTLFS

SEQ ID NO: 2694603 - protein, 17 aa, Entamoeba histolytica
RSYDFNEVVRWFAERAD

SEQ ID NO: 2694604 - protein, 18 aa, Entamoeba histolytica
RSYEFYKSKLLQSNEYYE

SEQ ID NO: 2694605 - protein, 19 aa, Entamoeba histolytica
RSYGSAGFETIGDRVRNRR

SEQ ID NO: 2694606 - protein, 19 aa, Entamoeba histolytica
RSYITDCLMLKEQIKTIKY

SEQ ID NO: 2694607 - protein, 21 aa, Entamoeba histolytica
RSYLFSIPMFHYLQPYSNFIS

SEQ ID NO: 2694608 - protein, 30 aa, Entamoeba histolytica; identical to SEQ ID NO: 2503194

SEQ ID NO: 2694609 - protein, 19 aa, Entamoeba histolytica
RSYLKMIIIHHFDIVEHEI

SEQ ID NO: 2694610 - protein, 19 aa, Entamoeba histolytica
RSYLLCLLLQYKYKTKHQE

SEQ ID NO: 2694611 - protein, 19 aa, Entamoeba histolytica
RTACERAKRTLSSAATANI

SEQ ID NO: 2694612 - protein, 22 aa, Entamoeba histolytica
RTARLCSYKFVDYFLNKVSNKV

SEQ ID NO: 2694613 - protein, 18 aa, Entamoeba histolytica
RTASEIIPAINKSIEQIQ

SEQ ID NO: 2694614 - protein, 19 aa, Entamoeba histolytica
RTATRLMLLAEQFALPVIT

SEQ ID NO: 2694615 - protein, 32 aa, Entamoeba histolytica
RTCKYFMRYGKVEKGLEIFKLFDRSPDKNDSP

SEQ ID NO: 2694616 - protein, 21 aa, Entamoeba histolytica
RTCSICGLQTSTLYSLECGHI

SEQ ID NO: 2694617 - protein, 21 aa, Entamoeba histolytica
RTDDMFPVKIDFDVDQTYSGM

SEQ ID NO: 2694618 - protein, 19 aa, Entamoeba histolytica
RTDDPGWTYALDLLLIRSI

SEQ ID NO: 2694619 - protein, 24 aa, Entamoeba histolytica
RTEIKLSEMKRQLNVSEELNEKRK

SEQ ID NO: 2694620 - protein, 20 aa, Entamoeba histolytica
RTELDGIYFFNLSDIKNSMI

SEQ ID NO: 2694621 - protein, 35 aa, Entamoeba histolytica
RTELTNMKFIIPNRIDIIPCKLKMDKEVRIIEEYY

SEQ ID NO: 2694622 - protein, 32 aa, Entamoeba histolytica
RTGEYFYFSFYEKFSYEIVFHVAPLLPDNEGS

SEQ ID NO: 2694623 - protein, 19 aa, Entamoeba histolytica
RTGKFYCNECGKKKRDASL

SEQ ID NO: 2694624 - protein, 18 aa, Entamoeba histolytica
RTGSCAELQPSLNVSLEP

SEQ ID NO: 2694625 - protein, 23 aa, Entamoeba histolytica
RTGVQCLIHPTSALFNMGVKSKY

SEQ ID NO: 2694626 - protein, 20 aa, Entamoeba histolytica
RTHISTACSKNWNLSKKEIK

SEQ ID NO: 2694627 - protein, 19 aa, Entamoeba histolytica
RTIAWKIWLGVLPLPVNSV

SEQ ID NO: 2694628 - protein, 17 aa, Entamoeba histolytica
RTIDLPNSLKFVGGGAF

SEQ ID NO: 2694629 - protein, 20 aa, Entamoeba histolytica
RTIFLMNFDKGNTMDIASDP

SEQ ID NO: 2694630 - protein, 26 aa, Entamoeba histolytica
RTIIPQHYRGVCGVIFVVDVTLRTSF

SEQ ID NO: 2694631 - protein, 18 aa, Entamoeba histolytica
RTIKWKKMLEQWKCDGKI

SEQ ID NO: 2694632 - protein, 22 aa, Entamoeba histolytica
RTIPEVKIRCVGIQRMKKICYA

SEQ ID NO: 2694633 - protein, 21 aa, Entamoeba histolytica
RTISGFAVLIEKDWLSFGHQF

SEQ ID NO: 2694634 - protein, 26 aa, Entamoeba histolytica
RTISPLKIKSCDLMQMHCNDCQFRHS

SEQ ID NO: 2694635 - protein, 18 aa, Entamoeba histolytica
RTKASCGCGEFLDLKKVV

SEQ ID NO: 2694636 - protein, 23 aa, Entamoeba histolytica
RTKPKLRGIYNFVKFLEQADNVH

SEQ ID NO: 2694637 - protein, 25 aa, Entamoeba histolytica
RTKVVKEYLNGLGLTYETKLTPHIF

SEQ ID NO: 2694638 - protein, 27 aa, Entamoeba histolytica
RTLEMWTCTEGFHLKKEFDSLKTVFNE

SEQ ID NO: 2694639 - protein, 21 aa, Entamoeba histolytica
RTLFKKVKGSCKVYKKYCNFL

SEQ ID NO: 2694640 - protein, 20 aa, Entamoeba histolytica
RTLKEVYLNPIIKLVNKEHA

SEQ ID NO: 2694641 - protein, 21 aa, Entamoeba histolytica
RTLKFSNIRFKDFENKKTCKV

SEQ ID NO: 2694642 - protein, 25 aa, Entamoeba histolytica
RTLKWSYSLLCGEIVLRREELKCPR

SEQ ID NO: 2694643 - protein, 17 aa, Entamoeba histolytica
RTLRFHARFLLVCLLTD

SEQ ID NO: 2694644 - protein, 28 aa, Entamoeba histolytica
RTLSEPRVTLFPCYWDKEEHIEMIEEKP

SEQ ID NO: 2694645 - protein, 19 aa, Entamoeba histolytica
RTLVREGILRKQCRKAVKE

SEQ ID NO: 2694646 - protein, 20 aa, Entamoeba histolytica
RTNATSVFYLFVRTNYEILG

SEQ ID NO: 2694647 - protein, 22 aa, Entamoeba histolytica
RTNDCVCRLALYSMIGDAVKLD

SEQ ID NO: 2694648 - protein, 19 aa, Entamoeba histolytica
RTNEELINFCCKKDNLKKI

SEQ ID NO: 2694649 - protein, 23 aa, Entamoeba histolytica
RTNKTTIKDVCFINETTNKEENK

SEQ ID NO: 2694650 - protein, 20 aa, Entamoeba histolytica
RTNLYAFLALARVMAKYGRQ

SEQ ID NO: 2694651 - protein, 26 aa, Entamoeba histolytica
RTNSRPCPACGTFIEKNGGCQWMCCY

SEQ ID NO: 2694652 - protein, 24 aa, Entamoeba histolytica
RTPEICTAFDSLLRLKHKTKESKN

SEQ ID NO: 2694653 - protein, 19 aa, Entamoeba histolytica
RTPEPWLKGLGCGDDEVLL

SEQ ID NO: 2694654 - protein, 24 aa, Entamoeba histolytica
RTPFKFTQHFAHVMGGKGSTQFGI

SEQ ID NO: 2694655 - protein, 18 aa, Entamoeba histolytica
RTPLTLQKRAQFHSSNQK

SEQ ID NO: 2694656 - protein, 22 aa, Entamoeba histolytica
RTPQPRKSYSIKQNDFLNTFNS

SEQ ID NO: 2694657 - protein, 18 aa, Entamoeba histolytica
RTRGPIVDGFRCVEKGIY

SEQ ID NO: 2694658 - protein, 25 aa, Entamoeba histolytica
RTRKLFKRPFRGHGLSNTSTILHTY

SEQ ID NO: 2694659 - protein, 19 aa, Entamoeba histolytica
RTRSNVCVELLQNEREIIL

SEQ ID NO: 2694660 - protein, 19 aa, Entamoeba histolytica
RTRSPLPLVNCIEKKVSEL

SEQ ID NO: 2694661 - protein, 19 aa, Entamoeba histolytica
RTRYYVMARLTPFKNEIQL

SEQ ID NO: 2694662 - protein, 18 aa, Entamoeba histolytica
RTSEADAVARIFSILCSF

SEQ ID NO: 2694663 - protein, 20 aa, Entamoeba histolytica
RTSHYGEFENGVFIGRFTQK

SEQ ID NO: 2694664 - protein, 25 aa, Entamoeba histolytica
RTSICSYEALTILSHLFFLQKDESF

SEQ ID NO: 2694665 - protein, 17 aa, Entamoeba histolytica
RTSIVPRYSLPVNKVIN

SEQ ID NO: 2694666 - protein, 19 aa, Entamoeba histolytica
RTSTEYDYPYSLRNTQRDY

SEQ ID NO: 2694667 - protein, 17 aa, Entamoeba histolytica
RTTYNYRVDMVKDGIPM

SEQ ID NO: 2694668 - protein, 24 aa, Entamoeba histolytica
RTVASKFRIGRQAQSAFMKVTKPT

SEQ ID NO: 2694669 - protein, 22 aa, Entamoeba histolytica
RTVIKSEEFILFVFDSYGNTAL

SEQ ID NO: 2694670 - protein, 20 aa, Entamoeba histolytica
RTVRFLKDYLDSNQLFEDQF

SEQ ID NO: 2694671 - protein, 19 aa, Entamoeba histolytica
RTVTVILERYLVVGLTAGQ

SEQ ID NO: 2694672 - protein, 18 aa, Entamoeba histolytica
RTYLRYLRGSVFCEKKLT

SEQ ID NO: 2694673 - protein, 17 aa, Entamoeba histolytica
RTYQLKIPKFIGNAPTG

SEQ ID NO: 2694674 - protein, 21 aa, Entamoeba histolytica
RTYRSHSPVIFSVLQSSITNT

SEQ ID NO: 2694675 - protein, 17 aa, Entamoeba histolytica
RVCRYLKMILEGVRVLH

SEQ ID NO: 2694676 - protein, 25 aa, Entamoeba histolytica
RVDLKKGEVVIKCYQCNNICHDPCH

SEQ ID NO: 2694677 - protein, 25 aa, Entamoeba histolytica
RVFRGHYPGAWCCRPSFSPDGQYIL

SEQ ID NO: 2694678 - protein, 26 aa, Entamoeba histolytica
RVFRGIRFSAKYGFKIEDNTLNAMTN

SEQ ID NO: 2694679 - protein, 26 aa, Entamoeba histolytica
RVFYLFHCPFCLKFTVLRNQLPEGTL

SEQ ID NO: 2694680 - protein, 20 aa, Entamoeba histolytica
RVGACGLNITGASRVVIFDE

SEQ ID NO: 2694681 - protein, 21 aa, Entamoeba histolytica
RVGKKVLQPICLSDFNEDGFV

SEQ ID NO: 2694682 - protein, 28 aa, Entamoeba histolytica
RVGKQCGICLVSGHKGTVLNLDYNPFND

SEQ ID NO: 2694683 - protein, 20 aa, Entamoeba histolytica
RVGLKYIYCGNVIDPEREAT

SEQ ID NO: 2694684 - protein, 20 aa, Entamoeba histolytica
RVGNDLKQDFTIFDAVPESE

SEQ ID NO: 2694685 - protein, 19 aa, Entamoeba histolytica
RVGSNIGFILTLDEINKVY

SEQ ID NO: 2694686 - protein, 19 aa, Entamoeba histolytica
RVGVPLNILTQNQIRKQLN

SEQ ID NO: 2694687 - protein, 23 aa, Entamoeba histolytica
RVICCGIIKERLIFVCKKGIYSI

SEQ ID NO: 2694688 - protein, 33 aa, Entamoeba histolytica
RVICKTIDFRFLRPLSIDFLRRFDKAANADEIK

SEQ ID NO: 2694689 - protein, 17 aa, Entamoeba histolytica
RVIEIRGNETFKLKEEV

SEQ ID NO: 2694690 - protein, 25 aa, Entamoeba histolytica
RVIEMFSIRYAECMNEKINELNITS

SEQ ID NO: 2694691 - protein, 28 aa, Entamoeba histolytica
RVIENIHMCLMKNGLNTKGIFRESTATA

SEQ ID NO: 2694692 - protein, 17 aa, Entamoeba histolytica
RVIGLKLNLSFDNGEVK

SEQ ID NO: 2694693 - protein, 18 aa, Entamoeba histolytica
RVIKDFIEENTFKPDSEC

SEQ ID NO: 2694694 - protein, 17 aa, Entamoeba histolytica
RVIKEFTDKTYILSLSI

SEQ ID NO: 2694695 - protein, 17 aa, Entamoeba histolytica
RVIRGGNILFIGKYLRI

SEQ ID NO: 2694696 - protein, 26 aa, Entamoeba histolytica
RVKGISFHPTRSWVLASLHNGKIQLW

SEQ ID NO: 2694697 - protein, 24 aa, Entamoeba histolytica
RVKIKELFKDALVIPSDSNNIVNG

SEQ ID NO: 2694698 - protein, 24 aa, Entamoeba histolytica
RVKNDILLSLGINEAVVFSQSFNR

SEQ ID NO: 2694699 - protein, 19 aa, Entamoeba histolytica
RVLKIPSRLKEFISSGFIY

SEQ ID NO: 2694700 - protein, 17 aa, Entamoeba histolytica
RVLLLSPLQRSEIINEE

SEQ ID NO: 2694701 - protein, 21 aa, Entamoeba histolytica
RVLPFSTFRMNLCDTTPYNAD

SEQ ID NO: 2694702 - protein, 20 aa, Entamoeba histolytica
RVLRLQSIIVSWINLMKEEI

SEQ ID NO: 2694703 - protein, 19 aa, Entamoeba histolytica
RVLRMFLYIHPKGYFQGLN

SEQ ID NO: 2694704 - protein, 24 aa, Entamoeba histolytica
RVLYWKNKIFHLIFNLEKERYKTV

SEQ ID NO: 2694705 - protein, 18 aa, Entamoeba histolytica
RVMRMCKHPNLVDYYDYF

SEQ ID NO: 2694706 - protein, 19 aa, Entamoeba histolytica
RVNEFPRFLRKMPKISNLI

SEQ ID NO: 2694707 - protein, 23 aa, Entamoeba histolytica
RVPTDLLGLMLYYIDLRVDAYLQ

SEQ ID NO: 2694708 - protein, 20 aa, Entamoeba histolytica
RVQCFEPLFNPQLCAMNCSG

SEQ ID NO: 2694709 - protein, 18 aa, Entamoeba histolytica
RVRCGSGFSSFNVATNGD

SEQ ID NO: 2694710 - protein, 20 aa, Entamoeba histolytica
RVRRAHSIDTTTLFEPQYQT

SEQ ID NO: 2694711 - protein, 18 aa, Entamoeba histolytica
RVRSLRNGLLNVIKEEDI

SEQ ID NO: 2694712 - protein, 20 aa, Entamoeba histolytica
RVSASVFRTTLQFLMSTTKG

SEQ ID NO: 2694713 - protein, 18 aa, Entamoeba histolytica
RVSGPWAEKIVIKALEEC

SEQ ID NO: 2694714 - protein, 29 aa, Entamoeba histolytica
RVSKCKGKLSPKFYMRRDKIYKKIKKEEE

SEQ ID NO: 2694715 - protein, 20 aa, Entamoeba histolytica
RVSPLVKRGNRMSGMLLANN

SEQ ID NO: 2694716 - protein, 18 aa, Entamoeba histolytica
RVSRVKSLLMDKIEGESI

SEQ ID NO: 2694717 - protein, 19 aa, Entamoeba histolytica
RVSTVNIMKTLGFVEKLKT

SEQ ID NO: 2694718 - protein, 17 aa, Entamoeba histolytica
RVTQNFFSAPNTLFSRL

SEQ ID NO: 2694719 - protein, 28 aa, Entamoeba histolytica
RVVDVGGYITKGRVNGVLAITRSIGDVR

SEQ ID NO: 2694720 - protein, 18 aa, Entamoeba histolytica
RVVIFRHALDDFKNECRT

SEQ ID NO: 2694721 - protein, 24 aa, Entamoeba histolytica
RVVKSTVCDLLMKCLTVNVADERI

SEQ ID NO: 2694722 - protein, 25 aa, Entamoeba histolytica
RVVQEDEVVLALRGILTARRQDTNI

SEQ ID NO: 2694723 - protein, 19 aa, Entamoeba histolytica
RVYYNGALGAIVMCDVTNK

SEQ ID NO: 2694724 - protein, 24 aa, Entamoeba histolytica
RWAPSARNLQEWRIVLTDQNQLHF

SEQ ID NO: 2694725 - protein, 19 aa, Entamoeba histolytica
RWDICVCASKGEPMQISFV

SEQ ID NO: 2694726 - protein, 20 aa, Entamoeba histolytica
RWISDQLMNHFEWISYQDVF

SEQ ID NO: 2694727 - protein, 17 aa, Entamoeba histolytica
RWNTLRKTLGYNLNIRP

SEQ ID NO: 2694728 - protein, 20 aa, Entamoeba histolytica
RWYNYLIYRIEKMEITKHEN

SEQ ID NO: 2694729 - protein, 21 aa, Entamoeba histolytica
RYADGEIKSAHILDPNVTLGT

SEQ ID NO: 2694730 - protein, 26 aa, Entamoeba histolytica
RYATNLIPVVIRYSRSINDNICLAAI

SEQ ID NO: 2694731 - protein, 18 aa, Entamoeba histolytica
RYCLGRAKIKTGDDHFIY

SEQ ID NO: 2694732 - protein, 24 aa, Entamoeba histolytica
RYCSEFLASSTLQFIELLKSNKRY

SEQ ID NO: 2694733 - protein, 18 aa, Entamoeba histolytica
RYDEIFGEFRSSFEKKIQ

SEQ ID NO: 2694734 - protein, 26 aa, Entamoeba histolytica
RYDKVLIRKTCGKWSQIEKVKVTICQ

SEQ ID NO: 2694735 - protein, 22 aa, Entamoeba histolytica
RYDNKIGLLISHNLKRERGSKK

SEQ ID NO: 2694736 - protein, 20 aa, Entamoeba histolytica
RYELFIKQLIKNMPNHHKER

SEQ ID NO: 2694737 - protein, 20 aa, Entamoeba histolytica
RYFFHFVKSTCPYIVEYNSN

SEQ ID NO: 2694738 - protein, 18 aa, Entamoeba histolytica
RYFGGLKFVTPGEISKEW

SEQ ID NO: 2694739 - protein, 20 aa, Entamoeba histolytica
RYFIHTLNPLADWFILTSAN

SEQ ID NO: 2694740 - protein, 18 aa, Entamoeba histolytica
RYFSKLYLEKGILQKLVE

SEQ ID NO: 2694741 - protein, 19 aa, Entamoeba histolytica
RYGGAKGFVNRPTFACIDK

SEQ ID NO: 2694742 - protein, 27 aa, Entamoeba histolytica
RYIFKSLTCYLNLFRIYIKHYRIIKTY

SEQ ID NO: 2694743 - protein, 19 aa, Entamoeba histolytica
RYILRAMAVASKFTESLAE

SEQ ID NO: 2694744 - protein, 26 aa, Entamoeba histolytica
RYIQEAICFHAAISKLICDAFYNKFN

SEQ ID NO: 2694745 - protein, 23 aa, Entamoeba histolytica
RYKLVKRRGGKRGGRGRPAAAVR

SEQ ID NO: 2694746 - protein, 27 aa, Entamoeba histolytica
RYKMEKLRNRKSCQFIPKKLSEDQQRR

SEQ ID NO: 2694747 - protein, 27 aa, Entamoeba histolytica
RYKQNGGYFLFTFINFYGIKPQIFYTS

SEQ ID NO: 2694748 - protein, 18 aa, Entamoeba histolytica
RYLIWSCSVINKKKTKLH

SEQ ID NO: 2694749 - protein, 21 aa, Entamoeba histolytica
RYLKKEFDFGVIVNVEKKDIA

SEQ ID NO: 2694750 - protein, 19 aa, Entamoeba histolytica
RYLYLTLWGDEVGNETQFK

SEQ ID NO: 2694751 - protein, 25 aa, Entamoeba histolytica
RYMAPEILFNPSLIGRESLGIHHCL

SEQ ID NO: 2694752 - protein, 17 aa, Entamoeba histolytica
RYMFERASMKLGLDQAI

SEQ ID NO: 2694753 - protein, 18 aa, Entamoeba histolytica
RYNCYLINESIHLLIDLL

SEQ ID NO: 2694754 - protein, 18 aa, Entamoeba histolytica
RYNPHIDFLTVPHPFYNK

SEQ ID NO: 2694755 - protein, 19 aa, Entamoeba histolytica
RYNPKLSVLDNIQMPPSLL

SEQ ID NO: 2694756 - protein, 19 aa, Entamoeba histolytica
RYPLIRTIEHIKHLLYQFK

SEQ ID NO: 2694757 - protein, 29 aa, Entamoeba histolytica
RYPLPECKRLPKGWGIGMDRGEMYFINWN

SEQ ID NO: 2694758 - protein, 19 aa, Entamoeba histolytica
RYQFLERMCDPCGKPPPEK

SEQ ID NO: 2694759 - protein, 17 aa, Entamoeba histolytica
RYQYLMEFVPVWSKGWE

SEQ ID NO: 2694760 - protein, 26 aa, Entamoeba histolytica
RYRETYCSVCTYNGYVYLFTLSEISR

SEQ ID NO: 2694761 - protein, 18 aa, Entamoeba histolytica
RYRHVSFEIGRVVASQWV

SEQ ID NO: 2694762 - protein, 19 aa, Entamoeba histolytica
RYRIISLLGNGAFGQVVKA

SEQ ID NO: 2694763 - protein, 19 aa, Entamoeba histolytica
RYRKMIGAEDVLVFTDIKK

SEQ ID NO: 2694764 - protein, 23 aa, Entamoeba histolytica
RYRNVSLPSLFVFSMKDQYIPFD

SEQ ID NO: 2694765 - protein, 22 aa, Entamoeba histolytica
RYRRFCSRRIKRIRQKVQLINK

SEQ ID NO: 2694766 - protein, 24 aa, Entamoeba histolytica
RYRYCSLTHKLFKKRVVCDVVGRL

SEQ ID NO: 2694767 - protein, 19 aa, Entamoeba histolytica
RYRYLKEITALILDTLDGD

SEQ ID NO: 2694768 - protein, 19 aa, Entamoeba histolytica
RYSNEFAIEELIYYYNLYR

SEQ ID NO: 2694769 - protein, 19 aa, Entamoeba histolytica
RYSPLPSKESRIFVTNQDN

SEQ ID NO: 2694770 - protein, 20 aa, Entamoeba histolytica
RYSPLPSKESRIFVTNQDNQ

SEQ ID NO: 2694771 - protein, 19 aa, Entamoeba histolytica
RYSQWYNKRSNQIFPSCET

SEQ ID NO: 2694772 - protein, 19 aa, Entamoeba histolytica
RYSRIFQMLLGIDYKENQY

SEQ ID NO: 2694773 - protein, 28 aa, Entamoeba histolytica
RYSVSINIVLRWFAKLEMTIPKDLPKDG

SEQ ID NO: 2694774 - protein, 18 aa, Entamoeba histolytica
RYTIGIYGVMGIKPKDLV

SEQ ID NO: 2694775 - protein, 26 aa, Entamoeba histolytica
RYTKSSFKTLRMEKITDILLNEKIII

SEQ ID NO: 2694776 - protein, 17 aa, Entamoeba histolytica
RYTRCEFTGDVLTIPVS

SEQ ID NO: 2694777 - protein, 25 aa, Entamoeba histolytica
RYTYPEGILSINFNFRVYTQQNTFI

SEQ ID NO: 2694778 - protein, 17 aa, Entamoeba histolytica
RYVQSICLIGVKKSDWK

SEQ ID NO: 2694779 - protein, 24 aa, Entamoeba histolytica
RYVRFQVIVNFGKFIQFIGKDLIN

SEQ ID NO: 2694780 - protein, 21 aa, Entamoeba histolytica
RYYALCVKYRSSPLLHLSWLN

SEQ ID NO: 2694781 - protein, 23 aa, Entamoeba histolytica
RYYAPWCGFCKMMSYDYKKLFRK

SEQ ID NO: 2694782 - protein, 19 aa, Entamoeba histolytica
RYYEYYRNPEILAFIRKIE

SEQ ID NO: 2694783 - protein, 18 aa, Entamoeba histolytica
RYYKIPINHLIKEDDTTQ

SEQ ID NO: 2694784 - protein, 23 aa, Entamoeba histolytica
RYYNRFPALVWYNNEYKNVLMRN

SEQ ID NO: 2694785 - protein, 17 aa, Entamoeba histolytica
SAAEINECSELIHETLK

SEQ ID NO: 2694786 - protein, 28 aa, Entamoeba histolytica
SAALKKIRIRKDVFYSLNLPIDIIQGEV

SEQ ID NO: 2694787 - protein, 24 aa, Entamoeba histolytica
SAARIIDEIVIWRHSHQIGAAANI

SEQ ID NO: 2694788 - protein, 20 aa, Entamoeba histolytica
SAAYLKCLINGIGNESKDIF

SEQ ID NO: 2694789 - protein, 17 aa, Entamoeba histolytica
SACKAFVAQKGYDLETI

SEQ ID NO: 2694790 - protein, 19 aa, Entamoeba histolytica
SADISIQPIEVCLVNDLQG

SEQ ID NO: 2694791 - protein, 30 aa, Entamoeba histolytica
SADKSAKLWAPKEGFALHGVLKGHTKAVIS

SEQ ID NO: 2694792 - protein, 23 aa, Entamoeba histolytica
SADKSIKVWGLQYGECIKTFKGH

SEQ ID NO: 2694793 - protein, 19 aa, Entamoeba histolytica
SADLGRPLWVETFANHFGV

SEQ ID NO: 2694794 - protein, 23 aa, Entamoeba histolytica
SAEERKPSMKFTMLEQEKEDLKK

SEQ ID NO: 2694795 - protein, 32 aa, Entamoeba histolytica
SAEIVCEHLCKFCKLLPIEVNEVMMKYLSKLE

SEQ ID NO: 2694796 - protein, 23 aa, Entamoeba histolytica
SAEKRKIILEAIRKMPLENVTLL

SEQ ID NO: 2694797 - protein, 18 aa, Entamoeba histolytica
SAELYLCRVNREIETMIL

SEQ ID NO: 2694798 - protein, 21 aa, Entamoeba histolytica
SAEQLKALLLQTHETTNRSVM

SEQ ID NO: 2694799 - protein, 18 aa, Entamoeba histolytica
SAFAALDWYHKYNIEKVN

SEQ ID NO: 2694800 - protein, 17 aa, Entamoeba histolytica
SAFEGCINLKIIDIPMC

SEQ ID NO: 2694801 - protein, 24 aa, Entamoeba histolytica
SAFFFARDFCHFVNLWDMRYQRCL

SEQ ID NO: 2694802 - protein, 25 aa, Entamoeba histolytica
SAFFGCAFNKIILPDNLEFIGELCF

SEQ ID NO: 2694803 - protein, 18 aa, Entamoeba histolytica
SAFGERIYGMYFALNAEL

SEQ ID NO: 2694804 - protein, 19 aa, Entamoeba histolytica
SAFNLFLFPIYSQVNKYII

SEQ ID NO: 2694805 - protein, 18 aa, Entamoeba histolytica
SAGFSRSNPYYIVQQNRV

SEQ ID NO: 2694806 - protein, 18 aa, Entamoeba histolytica
SAGGCLQMADWLSTLQNM

SEQ ID NO: 2694807 - protein, 20 aa, Entamoeba histolytica
SAGLLHGWNYQALIKEVIEY

SEQ ID NO: 2694808 - protein, 18 aa, Entamoeba histolytica
SAGNLLNLIRRIRPDTME

SEQ ID NO: 2694809 - protein, 27 aa, Entamoeba histolytica
SAGNVLRPHVFAAFRALYESNKKKGLK

SEQ ID NO: 2694810 - protein, 17 aa, Entamoeba histolytica
SAGRQRAVLALLRNNTK

SEQ ID NO: 2694811 - protein, 17 aa, Entamoeba histolytica
SAGYDRGVFEIKEIASL

SEQ ID NO: 2694812 - protein, 20 aa, Entamoeba histolytica
SAHCTTEWYWTHDSKALVFC

SEQ ID NO: 2694813 - protein, 24 aa, Entamoeba histolytica
SAHFICAWCKLAVDGKCIEKLPST

SEQ ID NO: 2694814 - protein, 27 aa, Entamoeba histolytica
SAIGEAVPVFGWICVEKTPAPYVADLI

SEQ ID NO: 2694815 - protein, 19 aa, Entamoeba histolytica
SAIKGRGAFMNGKQIHVSH

SEQ ID NO: 2694816 - protein, 17 aa, Entamoeba histolytica
SAILCFRISDGGKSMIM

SEQ ID NO: 2694817 - protein, 17 aa, Entamoeba histolytica
SAKQGLLLWCQKKCEPY

SEQ ID NO: 2694818 - protein, 20 aa, Entamoeba histolytica
SAKSCCEFMGQIVSVCPHGL

SEQ ID NO: 2694819 - protein, 18 aa, Entamoeba histolytica
SAKSSLCSVEERDKEVYV

SEQ ID NO: 2694820 - protein, 18 aa, Entamoeba histolytica
SAKYLPRFFKHNNFSSFV

SEQ ID NO: 2694821 - protein, 21 aa, Entamoeba histolytica
SALDRRGHWISVHMQCVEFIL

SEQ ID NO: 2694822 - protein, 25 aa, Entamoeba histolytica
SALEVGICKLEYHFCKQVSQMAVSI

SEQ ID NO: 2694823 - protein, 18 aa, Entamoeba histolytica
SALIRPGRIDRKIEFPLP

SEQ ID NO: 2694824 - protein, 25 aa, Entamoeba histolytica
SALKLHKEFGVLVIVTLGDKGCLIV

SEQ ID NO: 2694825 - protein, 25 aa, Entamoeba histolytica
SALKLKKLEPYYGYNPSIPLYYQRL

SEQ ID NO: 2694826 - protein, 18 aa, Entamoeba histolytica
SALSRINPQLVFNTKPKT

SEQ ID NO: 2694827 - protein, 19 aa, Entamoeba histolytica
SAMSRRAEYMYGTRLNESK

SEQ ID NO: 2694828 - protein, 18 aa, Entamoeba histolytica
SANKIWYGITLKGDDIAI

SEQ ID NO: 2694829 - protein, 19 aa, Entamoeba histolytica
SANKIWYGITLKGDDIAIL

SEQ ID NO: 2694830 - protein, 19 aa, Entamoeba histolytica
SAPIVELFNGMTNEAYGES

SEQ ID NO: 2694831 - protein, 17 aa, Entamoeba histolytica
SAPTLFTPRMNHLGYIA

SEQ ID NO: 2694832 - protein, 20 aa, Entamoeba histolytica
SAQLNISREIYLPDEMEANE

SEQ ID NO: 2694833 - protein, 17 aa, Entamoeba histolytica
SAQSYYLCSASRDGIIK

SEQ ID NO: 2694834 - protein, 21 aa, Entamoeba histolytica
SARDLLLMRRIIIDGKPCETL

SEQ ID NO: 2694835 - protein, 19 aa, Entamoeba histolytica
SARFGRKGVAIDFITTEEM

SEQ ID NO: 2694836 - protein, 26 aa, Entamoeba histolytica
SARQLRILFLMQSWDAVINFSDSALD

SEQ ID NO: 2694837 - protein, 17 aa, Entamoeba histolytica
SASECLECLQRKRQKEI

SEQ ID NO: 2694838 - protein, 21 aa, Entamoeba histolytica
SASIFLICFSVTSSVSYDNVI

SEQ ID NO: 2694839 - protein, 17 aa, Entamoeba histolytica
SASLLRAEIYGIKNELS

SEQ ID NO: 2694840 - protein, 29 aa, Entamoeba histolytica
SASLNCFSHFTYVRSGRRLLISDIQGVIH

SEQ ID NO: 2694841 - protein, 18 aa, Entamoeba histolytica
SASTDRKALIWDLYPIEK

SEQ ID NO: 2694842 - protein, 18 aa, Entamoeba histolytica
SASTEFMQTFMWTHTMFM

SEQ ID NO: 2694843 - protein, 24 aa, Entamoeba histolytica
SATDPRANIAIKYLDSFTFNKRDY

SEQ ID NO: 2694844 - protein, 30 aa, Entamoeba histolytica
SATDRLRFERRPRLRATFLEDSAHKRINDM

SEQ ID NO: 2694845 - protein, 26 aa, Entamoeba histolytica
SATELSQRCSMEWAKDEYEENKLQET

SEQ ID NO: 2694846 - protein, 26 aa, Entamoeba histolytica
SATFERIKPIKGFILLFEYNKQTINY

SEQ ID NO: 2694847 - protein, 17 aa, Entamoeba histolytica
SATFPSICTAWDRNGVR

SEQ ID NO: 2694848 - protein, 17 aa, Entamoeba histolytica
SATLGTNVQLLFDEFSK

SEQ ID NO: 2694849 - protein, 26 aa, Entamoeba histolytica
SATPERLSLFFIDFYRSQAIQQLLLA

SEQ ID NO: 2694850 - protein, 25 aa, Entamoeba histolytica
SATQLLKHPFIEWAPTSYFYKKYHH

SEQ ID NO: 2694851 - protein, 23 aa, Entamoeba histolytica
SAVLPFELIKNIIIPHHLSNILI

SEQ ID NO: 2694852 - protein, 18 aa, Entamoeba histolytica
SAVSPGLFDEIWNKYFNK

SEQ ID NO: 2694853 - protein, 20 aa, Entamoeba histolytica
SAYSKCIACSEAIKEAYTKN

SEQ ID NO: 2694854 - protein, 25 aa, Entamoeba histolytica
SCDFNEYYPLPLLHSLHLRFNKNNS

SEQ ID NO: 2694855 - protein, 20 aa, Entamoeba histolytica
SCDMKFAISLKELIQLAPKI

SEQ ID NO: 2694856 - protein, 25 aa, Entamoeba histolytica
SCELRRFRDGRLLYVVPSERLWMET

SEQ ID NO: 2694857 - protein, 19 aa, Entamoeba histolytica
SCFEDCSFLPTLQLESLPL

SEQ ID NO: 2694858 - protein, 18 aa, Entamoeba histolytica
SCFEKCTSLKHLALPTTM

SEQ ID NO: 2694859 - protein, 18 aa, Entamoeba histolytica
SCFEQCINLSILEIPSTI

SEQ ID NO: 2694860 - protein, 18 aa, Entamoeba histolytica
SCGWWEIQQPILQEQVDE

SEQ ID NO: 2694861 - protein, 19 aa, Entamoeba histolytica
SCIDGRLTSSWNWCSMIER

SEQ ID NO: 2694862 - protein, 23 aa, Entamoeba histolytica
SCIEGSRVLFCYNSENEPFNKFT

SEQ ID NO: 2694863 - protein, 26 aa, Entamoeba histolytica
SCIELKINGRYGVDMSMKTIVQKPTD

SEQ ID NO: 2694864 - protein, 28 aa, Entamoeba histolytica
SCITQITQGFKWVRSGGICEIVDNRQLK

SEQ ID NO: 2694865 - protein, 28 aa, Entamoeba histolytica
SCKESLTLECFMHWNYYESKENGIVIID

SEQ ID NO: 2694866 - protein, 20 aa, Entamoeba histolytica
SCKMNERWLNAMADCINNKK

SEQ ID NO: 2694867 - protein, 19 aa, Entamoeba histolytica
SCKVLRAQCSIVSHVLHSF

SEQ ID NO: 2694868 - protein, 18 aa, Entamoeba histolytica
SCLEQVTLEGIKIVNQKH

SEQ ID NO: 2694869 - protein, 23 aa, Entamoeba histolytica
SCLPKPNPELFIKAMNKLNASTQ

SEQ ID NO: 2694870 - protein, 19 aa, Entamoeba histolytica
SCNIFSCSMDQIGILEMSS

SEQ ID NO: 2694871 - protein, 21 aa, Entamoeba histolytica
SCNRAAGAMYLFPRITLPEKF

SEQ ID NO: 2694872 - protein, 22 aa, Entamoeba histolytica
SCNWKALMRRGTAYLNMDKLDK

SEQ ID NO: 2694873 - protein, 24 aa, Entamoeba histolytica
SCPFYKTCGIIRNIIHFYNEAFQA

SEQ ID NO: 2694874 - protein, 25 aa, Entamoeba histolytica
SCPKCTSLTEKTCYCGKNKVKIPCY

SEQ ID NO: 2694875 - protein, 20 aa, Entamoeba histolytica
SCPQLRVLFLSNNRGITNEV

SEQ ID NO: 2694876 - protein, 29 aa, Entamoeba histolytica
SCQNISLKIAAFVRRLADETGHLGTYNII

SEQ ID NO: 2694877 - protein, 23 aa, Entamoeba histolytica
SCRLNELKTFFVALIDNYYELFP

SEQ ID NO: 2694878 - protein, 24 aa, Entamoeba histolytica
SCRNPNCKGYHLLPYGKSYIINQS

SEQ ID NO: 2694879 - protein, 20 aa, Entamoeba histolytica
SCRPFLRTTLKNVINEINVC

SEQ ID NO: 2694880 - protein, 25 aa, Entamoeba histolytica
SCRTYLEKHFESFKELDEEQLIKQA

SEQ ID NO: 2694881 - protein, 30 aa, Entamoeba histolytica
SCRYWDVLHLSTFFPIIFRCSALSPDSLYI

SEQ ID NO: 2694882 - protein, 29 aa, Entamoeba histolytica
SCSIYRLKESWGLLSIDEINLFKQLDSLI

SEQ ID NO: 2694883 - protein, 17 aa, Entamoeba histolytica
SCSSCVIPISSSLKSFR

SEQ ID NO: 2694884 - protein, 21 aa, Entamoeba histolytica
SCTNYSQKTCVGKIFLEFTPF

SEQ ID NO: 2694885 - protein, 22 aa, Entamoeba histolytica
SCVGIWQNDRVEIIANDQGNRT

SEQ ID NO: 2694886 - protein, 18 aa, Entamoeba histolytica
SDAIWKIVTEVINSTTEL

SEQ ID NO: 2694887 - protein, 33 aa, Entamoeba histolytica
SDAKRFQEISEKIKAQNESIMKAEKEIEELKKF

SEQ ID NO: 2694888 - protein, 22 aa, Entamoeba histolytica
SDAPRFKWRGLMVDPSRNPLSP

SEQ ID NO: 2694889 - protein, 20 aa, Entamoeba histolytica
SDAWSVGCVLYCMIVGKKEG

SEQ ID NO: 2694890 - protein, 23 aa, Entamoeba histolytica
SDCAEILDIIDLVFHQEDEERGT

SEQ ID NO: 2694891 - protein, 19 aa, Entamoeba histolytica
SDCDKIFASCWINEDTVVL

SEQ ID NO: 2694892 - protein, 19 aa, Entamoeba histolytica
SDCLNGYEPICVSLERLTP

SEQ ID NO: 2694893 - protein, 21 aa, Entamoeba histolytica
SDCSKSYLHLVGYEEVTDSIK

SEQ ID NO: 2694894 - protein, 20 aa, Entamoeba histolytica
SDCYKNLCGPRCYYCKQPIE

SEQ ID NO: 2694895 - protein, 18 aa, Entamoeba histolytica
SDDALKCIDRMTLESIAS

SEQ ID NO: 2694896 - protein, 19 aa, Entamoeba histolytica
SDDEFRKQLSLLQKRQPTV

SEQ ID NO: 2694897 - protein, 18 aa, Entamoeba histolytica
SDDGNIIFYKLSPKKVDL

SEQ ID NO: 2694898 - protein, 23 aa, Entamoeba histolytica
SDDGVCKLADFGVSTKMGGTNKL

SEQ ID NO: 2694899 - protein, 21 aa, Entamoeba histolytica
SDDIFSFDDFTSVPAQTNQQE

SEQ ID NO: 2694900 - protein, 25 aa, Entamoeba histolytica
SDDIRKSALLCFGRTINKIDDLKSV

SEQ ID NO: 2694901 - protein, 25 aa, Entamoeba histolytica
SDDITVDMVIEWLCLNIPSRLLPNS

SEQ ID NO: 2694902 - protein, 25 aa, Entamoeba histolytica
SDDTFKPFFLKCAEGFNEVVGISEI

SEQ ID NO: 2694903 - protein, 17 aa, Entamoeba histolytica
SDEFKAMMMEFGERVSE

SEQ ID NO: 2694904 - protein, 26 aa, Entamoeba histolytica
SDEGFPFCLDCATSIVQRGKIEMYAR

SEQ ID NO: 2694905 - protein, 20 aa, Entamoeba histolytica
SDEIIPFNLILPTEKLSPSF

SEQ ID NO: 2694906 - protein, 24 aa, Entamoeba histolytica
SDEKKDVFVYAWKISNCNPEVQFA

SEQ ID NO: 2694907 - protein, 19 aa, Entamoeba histolytica
SDEMKLCRSICNSSGSQNE

SEQ ID NO: 2694908 - protein, 18 aa, Entamoeba histolytica
SDENLFFQIIDVLFIRKG

SEQ ID NO: 2694909 - protein, 19 aa, Entamoeba histolytica
SDENLPLWPQDKDIKNYTS

SEQ ID NO: 2694910 - protein, 24 aa, Entamoeba histolytica
SDEVKKLLQLMGIPCIEANCEAEG

SEQ ID NO: 2694911 - protein, 24 aa, Entamoeba histolytica
SDEVKRAAVLVLGFILNKRLDELC

SEQ ID NO: 2694912 - protein, 23 aa, Entamoeba histolytica
SDFIAEKVLEEFKKNYKKIGGLN

SEQ ID NO: 2694913 - protein, 28 aa, Entamoeba histolytica
SDFKEKDCGEGIGFELGYGMDSEDEIEG

SEQ ID NO: 2694914 - protein, 25 aa, Entamoeba histolytica
SDFKQWVLYIARYVKELYLKKNIHD

SEQ ID NO: 2694915 - protein, 22 aa, Entamoeba histolytica
SDFNNRVNLFISVRNYGVGQCV

SEQ ID NO: 2694916 - protein, 22 aa, Entamoeba histolytica
SDFTQAVFIKCFTNYVPSSSQE

SEQ ID NO: 2694917 - protein, 19 aa, Entamoeba histolytica
SDGEIKDIIPRGYAFPNSN

SEQ ID NO: 2694918 - protein, 27 aa, Entamoeba histolytica
SDGEKKKACGFVKFKRVEDAIRCVCDA

SEQ ID NO: 2694919 - protein, 28 aa, Entamoeba histolytica
SDGKAILRFKGINIPGGKALPKGYKMSK

SEQ ID NO: 2694920 - protein, 21 aa, Entamoeba histolytica
SDGKIIYAFNGNNIFLIDRIE

SEQ ID NO: 2694921 - protein, 25 aa, Entamoeba histolytica
SDGLRRSMCIKLEMREKFAKDLKIG

SEQ ID NO: 2694922 - protein, 17 aa, Entamoeba histolytica
SDGQLLLRPINSEPNSV

SEQ ID NO: 2694923 - protein, 21 aa, Entamoeba histolytica
SDGQSTCAWYDDFRSTDMKPN

SEQ ID NO: 2694924 - protein, 20 aa, Entamoeba histolytica
SDIAKSWSKTTEMRIPDSTN

SEQ ID NO: 2694925 - protein, 19 aa, Entamoeba histolytica
SDIICNSCIVVVPNSIRYN

SEQ ID NO: 2694926 - protein, 25 aa, Entamoeba histolytica
SDIKLLKILFYFPMIQTVQVQYHDL

SEQ ID NO: 2694927 - protein, 19 aa, Entamoeba histolytica
SDIKYCILFEQQLICYCKD

SEQ ID NO: 2694928 - protein, 17 aa, Entamoeba histolytica
SDIKYKDVIVFMRSIAY

SEQ ID NO: 2694929 - protein, 24 aa, Entamoeba histolytica
SDINELIFQFLIQLSIYRSMIAFK

SEQ ID NO: 2694930 - protein, 17 aa, Entamoeba histolytica
SDIPFDYVSFYFFRIFF

SEQ ID NO: 2694931 - protein, 21 aa, Entamoeba histolytica
SDIPKEFKIGSTHKGRVMYYS

SEQ ID NO: 2694932 - protein, 17 aa, Entamoeba histolytica
SDIPYPSSFLLFLKTVC

SEQ ID NO: 2694933 - protein, 17 aa, Entamoeba histolytica
SDIRRMNVALTRAKNAL

SEQ ID NO: 2694934 - protein, 18 aa, Entamoeba histolytica
SDISIGFEKGSIQCDWLF

SEQ ID NO: 2694935 - protein, 25 aa, Entamoeba histolytica
SDISSFNCIDFWEGIKREIIPNYII

SEQ ID NO: 2694936 - protein, 34 aa, Entamoeba histolytica
SDIWSLGVLIFVLFCNRFPFPPNKVFETLSQQKK

SEQ ID NO: 2694937 - protein, 18 aa, Entamoeba histolytica
SDKDLKRLSISQRNHFNF

SEQ ID NO: 2694938 - protein, 20 aa, Entamoeba histolytica
SDKFLQLFLLYVSKELTVDE

SEQ ID NO: 2694939 - protein, 21 aa, Entamoeba histolytica
SDKGSVVFLKGFINSIFYRKS

SEQ ID NO: 2694940 - protein, 18 aa, Entamoeba histolytica
SDKKWASRLIKRSMDAIA

SEQ ID NO: 2694941 - protein, 27 aa, Entamoeba histolytica
SDKRFVFTCFSAFWVLSDGTAYIHQGF

SEQ ID NO: 2694942 - protein, 21 aa, Entamoeba histolytica
SDKTPFCPICHSQISLVTSHR

SEQ ID NO: 2694943 - protein, 18 aa, Entamoeba histolytica
SDLCRFGTPIQLALNHVV

SEQ ID NO: 2694944 - protein, 25 aa, Entamoeba histolytica
SDLDSRIRYSIMSSFDERFDYYLSQ

SEQ ID NO: 2694945 - protein, 19 aa, Entamoeba histolytica
SDLIGKIRQGITCITTKNE

SEQ ID NO: 2694946 - protein, 25 aa, Entamoeba histolytica
SDLKGENIISYKLLHSLLVFQSAVL

SEQ ID NO: 2694947 - protein, 21 aa, Entamoeba histolytica
SDLKITMISSYNFTQTKDDNK

SEQ ID NO: 2694948 - protein, 22 aa, Entamoeba histolytica
SDLKRSDPYVVFMANKEKYKTK

SEQ ID NO: 2694949 - protein, 20 aa, Entamoeba histolytica
SDLLNIFIAKAYKFNEHIDT

SEQ ID NO: 2694950 - protein, 22 aa, Entamoeba histolytica
SDLMTFKGVILGITRYGISKMK

SEQ ID NO: 2694951 - protein, 21 aa, Entamoeba histolytica
SDLNAICFVAPSSHVKLTASQ

SEQ ID NO: 2694952 - protein, 22 aa, Entamoeba histolytica
SDLNPTPAISRFEIISNIIKKI

SEQ ID NO: 2694953 - protein, 22 aa, Entamoeba histolytica
SDLRDVFYFTDIFKTFSSNDLY

SEQ ID NO: 2694954 - protein, 21 aa, Entamoeba histolytica
SDLRESVGIMENCNGLILGSV

SEQ ID NO: 2694955 - protein, 28 aa, Entamoeba histolytica
SDLRGIITAIRFVICSSAQYDISSEVLL

SEQ ID NO: 2694956 - protein, 17 aa, Entamoeba histolytica
SDLRMVRLTELVFGNCI

SEQ ID NO: 2694957 - protein, 23 aa, Entamoeba histolytica
SDLVCMSSYYLFRKGIEPKWEDA

SEQ ID NO: 2694958 - protein, 21 aa, Entamoeba histolytica
SDLYFKSIYQFISENQYQIEN

SEQ ID NO: 2694959 - protein, 18 aa, Entamoeba histolytica
SDMEIDYNKFNAIAPKYF

SEQ ID NO: 2694960 - protein, 23 aa, Entamoeba histolytica
SDMKRKAICIQKLTYLEMLGQET

SEQ ID NO: 2694961 - protein, 17 aa, Entamoeba histolytica
SDMRQTLLFTYSGHQRK

SEQ ID NO: 2694962 - protein, 18 aa, Entamoeba histolytica
SDMSRQLVCCLLGCMQDV

SEQ ID NO: 2694963 - protein, 25 aa, Entamoeba histolytica
SDNFPREEIPTLLSVLKSLYEENKR

SEQ ID NO: 2694964 - protein, 27 aa, Entamoeba histolytica
SDNRWLLVQHPIYGLGYVPLSYVQCEK

SEQ ID NO: 2694965 - protein, 18 aa, Entamoeba histolytica
SDPEGWLGAETIDGSRGW

SEQ ID NO: 2694966 - protein, 32 aa, Entamoeba histolytica
SDPEILSKIAWLFSNFCRFKPSIPEQQLEPFI

SEQ ID NO: 2694967 - protein, 24 aa, Entamoeba histolytica
SDPINSLFLLFGTRFNKDVPCQKN

SEQ ID NO: 2694968 - protein, 24 aa, Entamoeba histolytica
SDPLPPRLFRKYLAYARANIHPQL

SEQ ID NO: 2694969 - protein, 23 aa, Entamoeba histolytica
SDPMGRAAMIGAIEKQKLVYIFN

SEQ ID NO: 2694970 - protein, 17 aa, Entamoeba histolytica
SDPPCPVQKGMYTKVKL

SEQ ID NO: 2694971 - protein, 20 aa, Entamoeba histolytica
SDPYIKLSINGQMHKTNVVY

SEQ ID NO: 2694972 - protein, 28 aa, Entamoeba histolytica
SDQFLIVACDGVWDFLRNEEVYSIVKKR

SEQ ID NO: 2694973 - protein, 20 aa, Entamoeba histolytica
SDQIRLLFHFIITSYNDSFI

SEQ ID NO: 2694974 - protein, 21 aa, Entamoeba histolytica
SDQQPKCTILYSHHSTERLET

SEQ ID NO: 2694975 - protein, 24 aa, Entamoeba histolytica
SDRCPPGGLGRLQFIIAKHGDASR

SEQ ID NO: 2694976 - protein, 21 aa, Entamoeba histolytica
SDRGNRLAVLQGFSSTTQIFD

SEQ ID NO: 2694977 - protein, 23 aa, Entamoeba histolytica
SDRKKCLLCGGINEPITKQDISL

SEQ ID NO: 2694978 - protein, 29 aa, Entamoeba histolytica
SDRTMASILLRWCHANKFCIIYNSENQEL

SEQ ID NO: 2694979 - protein, 23 aa, Entamoeba histolytica
SDRYLVLACDGVWDVMSDEKVYS

SEQ ID NO: 2694980 - protein, 25 aa, Entamoeba histolytica
SDSEEMKKFIALLVMKAGTKEKAIK

SEQ ID NO: 2694981 - protein, 20 aa, Entamoeba histolytica
SDSFKKLLINNGIVPMLIQK

SEQ ID NO: 2694982 - protein, 18 aa, Entamoeba histolytica
SDSHFFRDKIRPCQNDDE

SEQ ID NO: 2694983 - protein, 29 aa, Entamoeba histolytica
SDSICPANIFDFSKFRVLLYITSSYQPLI

SEQ ID NO: 2694984 - protein, 20 aa, Entamoeba histolytica
SDTKLLWLHYPQRSICQCAL

SEQ ID NO: 2694985 - protein, 26 aa, Entamoeba histolytica
SDTYKGVPAGETWVWYTNPNPRPKTE

SEQ ID NO: 2694986 - protein, 24 aa, Entamoeba histolytica
SDVATLISMCFAHHYDSRPDFNDI

SEQ ID NO: 2694987 - protein, 23 aa, Entamoeba histolytica
SDVDCKGVLCFVPKLCGEDVQES

SEQ ID NO: 2694988 - protein, 27 aa, Entamoeba histolytica
SDVGRYAVLCALQFSLTLCLPHDTISI

SEQ ID NO: 2694989 - protein, 19 aa, Entamoeba histolytica
SDVHPSCYATSLENVKSLS

SEQ ID NO: 2694990 - protein, 24 aa, Entamoeba histolytica
SDVIKITICGGSYPPDIDKVKSIS

SEQ ID NO: 2694991 - protein, 28 aa, Entamoeba histolytica
SDVPKFIVRGRMNKAFFKVRKIVAEQFC

SEQ ID NO: 2694992 - protein, 26 aa, Entamoeba histolytica
SDVSYEDRANWPFKVKRRDNGNAYIE

SEQ ID NO: 2694993 - protein, 21 aa, Entamoeba histolytica
SDWKDGVALVKLTEAVSAGQI

SEQ ID NO: 2694994 - protein, 19 aa, Entamoeba histolytica
SDWYVELFVDYVRNGKMPL

SEQ ID NO: 2694995 - protein, 19 aa, Entamoeba histolytica
SDYHKPYCIIVMNEVGAWK

SEQ ID NO: 2694996 - protein, 22 aa, Entamoeba histolytica
SDYKDKLLFNGIRNINNELNIV

SEQ ID NO: 2694997 - protein, 22 aa, Entamoeba histolytica
SDYKDWCLYWLGLNDQKPPIIG

SEQ ID NO: 2694998 - protein, 20 aa, Entamoeba histolytica
SDYLIPKIVEYVIEFMELGC

SEQ ID NO: 2694999 - protein, 23 aa, Entamoeba histolytica
SDYRKTKMSWIIKANMNSNIIRQ

SEQ ID NO: 2695000 - protein, 18 aa, Entamoeba histolytica
SEAFKALLNHNIPTELEI

SEQ ID NO: 2695001 - protein, 18 aa, Entamoeba histolytica
SEAFNKCTSLSEIIIPSS

SEQ ID NO: 2695002 - protein, 22 aa, Entamoeba histolytica
SEAHAKIHLRGVVTTEDVKIAL

SEQ ID NO: 2695003 - protein, 20 aa, Entamoeba histolytica
SEAIKAYFKAISLTPQLPEV

SEQ ID NO: 2695004 - protein, 25 aa, Entamoeba histolytica
SEAIKRGEGIFDRIDETERRRKIVI

SEQ ID NO: 2695005 - protein, 25 aa, Entamoeba histolytica
SEAIKRGEGIFDRIDETERRRKLVI

SEQ ID NO: 2695006 - protein, 20 aa, Entamoeba histolytica
SEAKGCTKEEFKIENTNDII

SEQ ID NO: 2695007 - protein, 17 aa, Entamoeba histolytica
SEAKKAKEELIKLAEQQ

SEQ ID NO: 2695008 - protein, 17 aa, Entamoeba histolytica
SECEDGLHTVCPSCYPY

SEQ ID NO: 2695009 - protein, 17 aa, Entamoeba histolytica
SECFKFNTVNSVILGHH

SEQ ID NO: 2695010 - protein, 25 aa, Entamoeba histolytica
SECFNLRFVPFPPSVHQLERFAFSR

SEQ ID NO: 2695011 - protein, 18 aa, Entamoeba histolytica
SECILMIDDAMVNLKENV

SEQ ID NO: 2695012 - protein, 20 aa, Entamoeba histolytica
SECPVCKSPLTVALLIDLCH

SEQ ID NO: 2695013 - protein, 19 aa, Entamoeba histolytica
SECQKLLTLLTELDKSNIT

SEQ ID NO: 2695014 - protein, 21 aa, Entamoeba histolytica
SECVKRVKHIPALTMTIVKEI

SEQ ID NO: 2695015 - protein, 19 aa, Entamoeba histolytica
SEDDIKPLCKLFDIECEEK

SEQ ID NO: 2695016 - protein, 26 aa, Entamoeba histolytica
SEDELRTVLMIAPWFPHKSIQQISLR

SEQ ID NO: 2695017 - protein, 18 aa, Entamoeba histolytica
SEDLPQWFEVPNEAFGRI

SEQ ID NO: 2695018 - protein, 23 aa, Entamoeba histolytica
SEDRKKDILDLISPSSTVIISNP

SEQ ID NO: 2695019 - protein, 19 aa, Entamoeba histolytica
SEDVDWKLAQKLCGLDKTA

SEQ ID NO: 2695020 - protein, 18 aa, Entamoeba histolytica
SEDWKWLNEKVIPTLQQE

SEQ ID NO: 2695021 - protein, 21 aa, Entamoeba histolytica
SEEAFRVMVRTIKLWTKKRGI

SEQ ID NO: 2695022 - protein, 22 aa, Entamoeba histolytica
SEEAVNIALGRVVEVKPLQSFQ

SEQ ID NO: 2695023 - protein, 27 aa, Entamoeba histolytica
SEECGYDFIPFKVLEKYNENYVVDGLH

SEQ ID NO: 2695024 - protein, 23 aa, Entamoeba histolytica
SEEHKDDIVALLIGPVADDLVDD

SEQ ID NO: 2695025 - protein, 18 aa, Entamoeba histolytica
SEEIHLPLSIPKEQKVIF

SEQ ID NO: 2695026 - protein, 24 aa, Entamoeba histolytica
SEEIKEMKASVILCINGDGKGARP

SEQ ID NO: 2695027 - protein, 18 aa, Entamoeba histolytica
SEEIKTFLFKIGLIVTDG

SEQ ID NO: 2695028 - protein, 23 aa, Entamoeba histolytica
SEEIVKVYAWEVAVSDVTEFVVG

SEQ ID NO: 2695029 - protein, 27 aa, Entamoeba histolytica
SEEIWKKFVEWCMKRTPSIAQSLLQKI

SEQ ID NO: 2695030 - protein, 19 aa, Entamoeba histolytica
SEELWKLRKKPNIWTYEEI

SEQ ID NO: 2695031 - protein, 21 aa, Entamoeba histolytica
SEENPRKALSLLGKSAKVLKR

SEQ ID NO: 2695032 - protein, 17 aa, Entamoeba histolytica
SEEVVTIVAALSVGNLF

SEQ ID NO: 2695033 - protein, 22 aa, Entamoeba histolytica
SEFELPGPLPLPKEFNKLNDDF

SEQ ID NO: 2695034 - protein, 17 aa, Entamoeba histolytica
SEFGFSMFNLQIGVKTI

SEQ ID NO: 2695035 - protein, 19 aa, Entamoeba histolytica
SEFGSFLSYCRNLKFDEEP

SEQ ID NO: 2695036 - protein, 24 aa, Entamoeba histolytica
SEFKISPDYSKCLFISSVEHSYKN

SEQ ID NO: 2695037 - protein, 24 aa, Entamoeba histolytica
SEFKQLRCVRLLLQKQGKVSDFFK

SEQ ID NO: 2695038 - protein, 20 aa, Entamoeba histolytica
SEFNGMIGITQPRRIAATAI

SEQ ID NO: 2695039 - protein, 17 aa, Entamoeba histolytica
SEFNLKKAKRFHIIQEM

SEQ ID NO: 2695040 - protein, 30 aa, Entamoeba histolytica
SEFPFNKTLWCSSLFYPVEFHEDKIFECIT

SEQ ID NO: 2695041 - protein, 23 aa, Entamoeba histolytica
SEFPTLLKLLLIESKTIFLSTND

SEQ ID NO: 2695042 - protein, 23 aa, Entamoeba histolytica
SEFYDYSVIFSKQFPTVNQRLKS

SEQ ID NO: 2695043 - protein, 21 aa, Entamoeba histolytica
SEGEILNCLILANYVVQNSPC

SEQ ID NO: 2695044 - protein, 18 aa, Entamoeba histolytica
SEGIDFGDDMARLVIVVG

SEQ ID NO: 2695045 - protein, 20 aa, Entamoeba histolytica
SEGILKYRSIYDVVTTIVHE

SEQ ID NO: 2695046 - protein, 23 aa, Entamoeba histolytica
SEGKLPSVQQLSALKSNLPSSNE

SEQ ID NO: 2695047 - protein, 27 aa, Entamoeba histolytica
SEGLNKLYTYLCDEIRANFDSELAENI

SEQ ID NO: 2695048 - protein, 24 aa, Entamoeba histolytica
SEGVFRLAGQAGLMKTMKSYMNSH

SEQ ID NO: 2695049 - protein, 26 aa, Entamoeba histolytica
SEHATRIKLLLNELNKQMSVYGQTSH

SEQ ID NO: 2695050 - protein, 22 aa, Entamoeba histolytica
SEHPTHFVKPCTTKGMKNDTEI

SEQ ID NO: 2695051 - protein, 22 aa, Entamoeba histolytica
SEHSYYGFVCLLQISTRSSDYI

SEQ ID NO: 2695052 - protein, 22 aa, Entamoeba histolytica
SEIDIIFDFARAYVVLDEVINA

SEQ ID NO: 2695053 - protein, 23 aa, Entamoeba histolytica
SEIDSVGIIKLWCETNHVDYVHR

SEQ ID NO: 2695054 - protein, 25 aa, Entamoeba histolytica
SEIEIERLIEWGRGLKLVDEKEINK

SEQ ID NO: 2695055 - protein, 26 aa, Entamoeba histolytica
SEIFVDLEGRKCKVTIEYARDSSTYI

SEQ ID NO: 2695056 - protein, 25 aa, Entamoeba histolytica
SEIGDFWFYGCSSLKSINIPTSVIE

SEQ ID NO: 2695057 - protein, 24 aa, Entamoeba histolytica
SEIGECCFFWCYSLRTINIPTSVN

SEQ ID NO: 2695058 - protein, 24 aa, Entamoeba histolytica
SEIGNKCFYGCLSLTTINIPTSVI

SEQ ID NO: 2695059 - protein, 17 aa, Entamoeba histolytica
SEIISAISIDTGIENGI

SEQ ID NO: 2695060 - protein, 39 aa, Entamoeba histolytica
SEIKDGRIIISLPFRLKYVCSFENIPFVKLGDIIPLSVI

SEQ ID NO: 2695061 - protein, 21 aa, Entamoeba histolytica
SEIKKLIQFGNGFGNILRLTG

SEQ ID NO: 2695062 - protein, 20 aa, Entamoeba histolytica
SEIKPTKLLETKEAIGEECI

SEQ ID NO: 2695063 - protein, 18 aa, Entamoeba histolytica
SEILGTIKINCKLSGMPE

SEQ ID NO: 2695064 - protein, 21 aa, Entamoeba histolytica
SEILKGLWYLHSEHHIVHRDL

SEQ ID NO: 2695065 - protein, 21 aa, Entamoeba histolytica
SEILKNVVISGISKVTVIDTY

SEQ ID NO: 2695066 - protein, 19 aa, Entamoeba histolytica
SEINGTYLNRIIIIKKQKI

SEQ ID NO: 2695067 - protein, 25 aa, Entamoeba histolytica
SEIPPKILSPIPMKEVVNNGNSSTK

SEQ ID NO: 2695068 - protein, 24 aa, Entamoeba histolytica
SEITLLRDCIKRLFNSITSLSNAV

SEQ ID NO: 2695069 - protein, 23 aa, Entamoeba histolytica
SEKAQHILYFWQGRDASLMDMGT

SEQ ID NO: 2695070 - protein, 24 aa, Entamoeba histolytica
SEKDILYTIKSCFIGDSSTIEDRK

SEQ ID NO: 2695071 - protein, 26 aa, Entamoeba histolytica
SEKELELRGVLSFTCSKCISQFQNSI

SEQ ID NO: 2695072 - protein, 21 aa, Entamoeba histolytica
SEKLKKLEMEECSGIDIDSDV

SEQ ID NO: 2695073 - protein, 22 aa, Entamoeba histolytica
SEKLLKEKKLSLILDLDGTIVF

SEQ ID NO: 2695074 - protein, 21 aa, Entamoeba histolytica
SEKLPRLFIYGDYQINQFDIF

SEQ ID NO: 2695075 - protein, 22 aa, Entamoeba histolytica
SEKLSGALIQDWKRLMDEKIHL

SEQ ID NO: 2695076 - protein, 21 aa, Entamoeba histolytica
SEKLVRYIFQLAMYDNSFDIR

SEQ ID NO: 2695077 - protein, 24 aa, Entamoeba histolytica
SEKPRPPFFDGFIDLLKRFKEQGG

SEQ ID NO: 2695078 - protein, 25 aa, Entamoeba histolytica
SEKQDWKSFLFPFAADIRPRANEWL

SEQ ID NO: 2695079 - protein, 30 aa, Entamoeba histolytica
SELDVLLDFVVCNMLFNWNLPSIVNPSDPL

SEQ ID NO: 2695080 - protein, 17 aa, Entamoeba histolytica
SELFFGMLLKRTLCDCG

SEQ ID NO: 2695081 - protein, 23 aa, Entamoeba histolytica
SELFKEMFEEGITYTDENATDEL

SEQ ID NO: 2695082 - protein, 22 aa, Entamoeba histolytica
SELHAMRAIFLIPNRPPPTLST

SEQ ID NO: 2695083 - protein, 19 aa, Entamoeba histolytica
SELHCYDFIQRRKHKITTS

SEQ ID NO: 2695084 - protein, 21 aa, Entamoeba histolytica
SELHDFLLFCLNYNYCEYEKV

SEQ ID NO: 2695085 - protein, 18 aa, Entamoeba histolytica
SELIMKGRYKEVFETQSF

SEQ ID NO: 2695086 - protein, 18 aa, Entamoeba histolytica
SELIPFGTYYRGQSQSQV

SEQ ID NO: 2695087 - protein, 21 aa, Entamoeba histolytica
SELKATIVAMFSYLTNNADDI

SEQ ID NO: 2695088 - protein, 20 aa, Entamoeba histolytica
SELKGMPFLIYVNKTDKKEF

SEQ ID NO: 2695089 - protein, 18 aa, Entamoeba histolytica
SELLKFINDKSFKGKEGC

SEQ ID NO: 2695090 - protein, 21 aa, Entamoeba histolytica
SELRITFKNQLSIPVKVSCLY

SEQ ID NO: 2695091 - protein, 23 aa, Entamoeba histolytica
SELSISLLRMMYALEFNYQLMAP

SEQ ID NO: 2695092 - protein, 19 aa, Entamoeba histolytica
SELWCVMMNELIKTIQTRM

SEQ ID NO: 2695093 - protein, 23 aa, Entamoeba histolytica
SELYCPQCHKFIQLPFGSPEILP

SEQ ID NO: 2695094 - protein, 21 aa, Entamoeba histolytica
SEMEGKFVIVDIVEECIALIL

SEQ ID NO: 2695095 - protein, 23 aa, Entamoeba histolytica
SEMFPKFIHCVVAMGYEKILVYL

SEQ ID NO: 2695096 - protein, 17 aa, Entamoeba histolytica
SEMIIQGNVTRNWIKNG

SEQ ID NO: 2695097 - protein, 24 aa, Entamoeba histolytica
SEMKICMICGKPICESGSCFNNHC

SEQ ID NO: 2695098 - protein, 17 aa, Entamoeba histolytica
SEMKNKDDVWAFKSKRE

SEQ ID NO: 2695099 - protein, 21 aa, Entamoeba histolytica
SEMPKKGMAIELAKKEAVSDG

SEQ ID NO: 2695100 - protein, 20 aa, Entamoeba histolytica
SEMRSGLTGLKFYNPETKSW

SEQ ID NO: 2695101 - protein, 23 aa, Entamoeba histolytica
SENLRVCGLLVARSVGDVKNKPI

SEQ ID NO: 2695102 - protein, 22 aa, Entamoeba histolytica
SENTLRCLFASILNERRVVVIG

SEQ ID NO: 2695103 - protein, 31 aa, Entamoeba histolytica
SENTSRPGVPGGQPLFGGFNPATFKLKKTTV

SEQ ID NO: 2695104 - protein, 26 aa, Entamoeba histolytica
SEPELTERFELFILKREIANAYTELN

SEQ ID NO: 2695105 - protein, 20 aa, Entamoeba histolytica
SEPFPWALISVGSIDCVVDI

SEQ ID NO: 2695106 - protein, 23 aa, Entamoeba histolytica
SEPKLGMIKTLWDTHRIRELWLL

SEQ ID NO: 2695107 - protein, 28 aa, Entamoeba histolytica
SEPKYSFARYWILDSIRAQHFMKTIQEL

SEQ ID NO: 2695108 - protein, 23 aa, Entamoeba histolytica
SEQCKIIGVYTCGDISLISKEVL

SEQ ID NO: 2695109 - protein, 17 aa, Entamoeba histolytica
SEQIISILLDYQNIQEM

SEQ ID NO: 2695110 - protein, 17 aa, Entamoeba histolytica
SEQKEVIENKQKTSKVE

SEQ ID NO: 2695111 - protein, 20 aa, Entamoeba histolytica
SEQQLAHVISQFRQRCLKKK

SEQ ID NO: 2695112 - protein, 26 aa, Entamoeba histolytica
SEQRYGKKVSVRNCLAWTDFMNNCEK

SEQ ID NO: 2695113 - protein, 18 aa, Entamoeba histolytica
SERAKKFAISDSDSDDDV

SEQ ID NO: 2695114 - protein, 24 aa, Entamoeba histolytica
SERFCSLGPVFFRGADCCILVCDV

SEQ ID NO: 2695115 - protein, 31 aa, Entamoeba histolytica
SERIREMIDWSKLKMSVKFQVSDRGNNVIVY

SEQ ID NO: 2695116 - protein, 20 aa, Entamoeba histolytica
SERRLALFRMKKVLTNYSAF

SEQ ID NO: 2695117 - protein, 24 aa, Entamoeba histolytica
SERRYIPELIGWIRKGYLIVKDSK

SEQ ID NO: 2695118 - protein, 23 aa, Entamoeba histolytica
SERSLPIRFSRGDLYMKDGSNEQ

SEQ ID NO: 2695119 - protein, 23 aa, Entamoeba histolytica
SESDFKYGFPMVVVGTKSDLVSQ

SEQ ID NO: 2695120 - protein, 17 aa, Entamoeba histolytica
SESDILISLMEKLSGKK

SEQ ID NO: 2695121 - protein, 19 aa, Entamoeba histolytica
SESDIVLSCLFFSILQSDK

SEQ ID NO: 2695122 - protein, 26 aa, Entamoeba histolytica
SESECASLIPPFMIDLLRKSRSTAAL

SEQ ID NO: 2695123 - protein, 22 aa, Entamoeba histolytica
SESERRCSAVLKKNTTIIKVSE

SEQ ID NO: 2695124 - protein, 22 aa, Entamoeba histolytica
SESKRSAGVLVDKSMLRILVVS

SEQ ID NO: 2695125 - protein, 20 aa, Entamoeba histolytica
SESLFEFYIHESKVLTVAAE

SEQ ID NO: 2695126 - protein, 29 aa, Entamoeba histolytica
SESLFNTSFKKMWDFKILTSFNETLELIL

SEQ ID NO: 2695127 - protein, 21 aa, Entamoeba histolytica
SESNFQLTLRFKFKNDNNIIR

SEQ ID NO: 2695128 - protein, 24 aa, Entamoeba histolytica
SESQYEMIKWIASTIKFSQKEIVL

SEQ ID NO: 2695129 - protein, 23 aa, Entamoeba histolytica
SESRFVIKLLDSIILQQQHQIAI

SEQ ID NO: 2695130 - protein, 27 aa, Entamoeba histolytica
SESVIPFTRFLRVFLPYTLVNSEEGNP

SEQ ID NO: 2695131 - protein, 21 aa, Entamoeba histolytica
SESWIKFTGLCYKSGKYKLAM

SEQ ID NO: 2695132 - protein, 19 aa, Entamoeba histolytica
SETCFECPSNLQVLNLSSY

SEQ ID NO: 2695133 - protein, 22 aa, Entamoeba histolytica
SETKSLLLICRNYYGKQCYLLN

SEQ ID NO: 2695134 - protein, 17 aa, Entamoeba histolytica
SETLLFIRNLPYSINDE

SEQ ID NO: 2695135 - protein, 24 aa, Entamoeba histolytica
SETRRRTVVLSIEITRLLNEFQNI

SEQ ID NO: 2695136 - protein, 23 aa, Entamoeba histolytica
SETSAQIFIEWCYCKSSPTLEKM

SEQ ID NO: 2695137 - protein, 25 aa, Entamoeba histolytica
SETYLFKFHYCDGTTTLHPMREDVL

SEQ ID NO: 2695138 - protein, 26 aa, Entamoeba histolytica
SEVARRSSDCFVICACDGVWDVFSNE

SEQ ID NO: 2695139 - protein, 26 aa, Entamoeba histolytica
SEVFWFFKDLMEIMGDWFKGGDDGVR

SEQ ID NO: 2695140 - protein, 22 aa, Entamoeba histolytica
SEVKCVDWSFGSNMVATCSRDK

SEQ ID NO: 2695141 - protein, 26 aa, Entamoeba histolytica
SEVQRKGGIFSNCLDEHVTHLIAYKK

SEQ ID NO: 2695142 - protein, 20 aa, Entamoeba histolytica
SEVRTCCSFISNNPYIKLVT

SEQ ID NO: 2695143 - protein, 24 aa, Entamoeba histolytica
SEVTRCVLSAIGNWGLKTSEPFFE

SEQ ID NO: 2695144 - protein, 18 aa, Entamoeba histolytica
SEVVGTCCICGQNCMDLE

SEQ ID NO: 2695145 - protein, 25 aa, Entamoeba histolytica
SEVYYKVCEELKKENGIIVLKYILS

SEQ ID NO: 2695146 - protein, 23 aa, Entamoeba histolytica
SEWSCICSECFKNGHHEGHEYQA

SEQ ID NO: 2695147 - protein, 22 aa, Entamoeba histolytica
SEYCLMIKKWFSSIKNGTEQVI

SEQ ID NO: 2695148 - protein, 19 aa, Entamoeba histolytica
SEYPDGIEIPAAMSTNQLI

SEQ ID NO: 2695149 - protein, 25 aa, Entamoeba histolytica
SEYSPSPNVDLCWDDPYPKEFTDLI

SEQ ID NO: 2695150 - protein, 18 aa, Entamoeba histolytica
SFASLWNTLQSWKPIEKE

SEQ ID NO: 2695151 - protein, 18 aa, Entamoeba histolytica
SFATPGLFTCHQSFVDGS

SEQ ID NO: 2695152 - protein, 20 aa, Entamoeba histolytica
SFAVSKKNPLQCSLGLMNGC

SEQ ID NO: 2695153 - protein, 18 aa, Entamoeba histolytica
SFCNQCVIEQILTGMREN

SEQ ID NO: 2695154 - protein, 20 aa, Entamoeba histolytica
SFCSCFYDDKLLFLGDKNGR

SEQ ID NO: 2695155 - protein, 24 aa, Entamoeba histolytica
SFDCKEIQNILSLTFQRSSIVCKR

SEQ ID NO: 2695156 - protein, 19 aa, Entamoeba histolytica
SFDKTVEFWDIRNLQQTAI

SEQ ID NO: 2695157 - protein, 19 aa, Entamoeba histolytica
SFDSMKEWIIISSQMHSLF

SEQ ID NO: 2695158 - protein, 25 aa, Entamoeba histolytica
SFEDKSGCCEYYFKAKYSDSCFPPF

SEQ ID NO: 2695159 - protein, 24 aa, Entamoeba histolytica
SFEDTEGWLFFGMSHSDPKVQFII

SEQ ID NO: 2695160 - protein, 21 aa, Entamoeba histolytica
SFEEYFQWFIGGLKNAMNKLI

SEQ ID NO: 2695161 - protein, 29 aa, Entamoeba histolytica
SFEHLGVKCVLEILPLNLDVSIVQRGSDG

SEQ ID NO: 2695162 - protein, 20 aa, Entamoeba histolytica
SFENKHLYCSLGNIQELDFG

SEQ ID NO: 2695163 - protein, 17 aa, Entamoeba histolytica
SFEQLLHDIAKYCNANA

SEQ ID NO: 2695164 - protein, 26 aa, Entamoeba histolytica
SFERKVLFLPLSVPKYAVIESTEDIN

SEQ ID NO: 2695165 - protein, 21 aa, Entamoeba histolytica
SFERRLWTCKLWDIEERLREA

SEQ ID NO: 2695166 - protein, 21 aa, Entamoeba histolytica
SFEVGECSMLLSLLGEEENKN

SEQ ID NO: 2695167 - protein, 23 aa, Entamoeba histolytica
SFEVPCQIALYLPIRGLSYEKKD

SEQ ID NO: 2695168 - protein, 22 aa, Entamoeba histolytica
SFFARCNFKKIVVFERNAYLGG

SEQ ID NO: 2695169 - protein, 19 aa, Entamoeba histolytica
SFFEKGVIIKSIIQIEHPA

SEQ ID NO: 2695170 - protein, 24 aa, Entamoeba histolytica
SFFFWMAYCPIKPKSEKLIQIVDK

SEQ ID NO: 2695171 - protein, 18 aa, Entamoeba histolytica
SFFMKSELIAHVKEKHQN

SEQ ID NO: 2695172 - protein, 18 aa, Entamoeba histolytica
SFFPLPIPLLRSNAGYIA

SEQ ID NO: 2695173 - protein, 19 aa, Entamoeba histolytica
SFFTFVTHYSFFRTAKRLV

SEQ ID NO: 2695174 - protein, 19 aa, Entamoeba histolytica
SFFTLPQFNEWKDARIQEG

SEQ ID NO: 2695175 - protein, 19 aa, Entamoeba histolytica
SFFYSRPVFKPSTIFNTSN

SEQ ID NO: 2695176 - protein, 17 aa, Entamoeba histolytica
SFGEFKEEIQIKLKEFL

SEQ ID NO: 2695177 - protein, 17 aa, Entamoeba histolytica
SFGKGCFYRCGCEEELK

SEQ ID NO: 2695178 - protein, 18 aa, Entamoeba histolytica
SFGNMKWEVFSICEKGSD

SEQ ID NO: 2695179 - protein, 20 aa, Entamoeba histolytica
SFGNRVMNFYSFLDYEEEIL

SEQ ID NO: 2695180 - protein, 19 aa, Entamoeba histolytica
SFHRKKGWKRLERKEPKVI

SEQ ID NO: 2695181 - protein, 19 aa, Entamoeba histolytica
SFIGRNFSKFSIKNIIILQ

SEQ ID NO: 2695182 - protein, 18 aa, Entamoeba histolytica
SFIICCFEGNYHPFEKED

SEQ ID NO: 2695183 - protein, 19 aa, Entamoeba histolytica
SFILMCLVKTQSSQFQNYI

SEQ ID NO: 2695184 - protein, 20 aa, Entamoeba histolytica
SFIMLRYINPAIFSPEKYGI

SEQ ID NO: 2695185 - protein, 17 aa, Entamoeba histolytica
SFIPLKFSLDKKNYIGG

SEQ ID NO: 2695186 - protein, 23 aa, Entamoeba histolytica
SFIPRLRQPFITSILTDVIDKDD

SEQ ID NO: 2695187 - protein, 17 aa, Entamoeba histolytica
SFIPSLQQWTGMQKYDV

SEQ ID NO: 2695188 - protein, 23 aa, Entamoeba histolytica
SFITNYFEIHFSKIHFISYKAKF

SEQ ID NO: 2695189 - protein, 17 aa, Entamoeba histolytica
SFKECNQTLLLNHLSLL

SEQ ID NO: 2695190 - protein, 22 aa, Entamoeba histolytica
SFKEDAIDIISRITTFKPQGMF

SEQ ID NO: 2695191 - protein, 24 aa, Entamoeba histolytica
SFKEGFKHLIYYFSDLYEKCSDIW

SEQ ID NO: 2695192 - protein, 20 aa, Entamoeba histolytica
SFKGCSAITEFDVPRDPNGD

SEQ ID NO: 2695193 - protein, 29 aa, Entamoeba histolytica
SFKKLRSLLMKEYRVITVFMGNPENKLLN

SEQ ID NO: 2695194 - protein, 18 aa, Entamoeba histolytica
SFKNLRYLTIILEEEVGW

SEQ ID NO: 2695195 - protein, 17 aa, Entamoeba histolytica
SFKSLRSLQHFGRTLGL

SEQ ID NO: 2695196 - protein, 22 aa, Entamoeba histolytica
SFKTQFNHCFIVVGFDVTQNNP

SEQ ID NO: 2695197 - protein, 22 aa, Entamoeba histolytica
SFKTQIATIIIFKGYSKENFSY

SEQ ID NO: 2695198 - protein, 17 aa, Entamoeba histolytica
SFKYQLFSISKYEEEGT

SEQ ID NO: 2695199 - protein, 18 aa, Entamoeba histolytica
SFLCALHGNDFFWVHGYN

SEQ ID NO: 2695200 - protein, 17 aa, Entamoeba histolytica
SFLCKKEVKLFCKTDLL

SEQ ID NO: 2695201 - protein, 19 aa, Entamoeba histolytica
SFLKKNGFEVMVRAHQTMN

SEQ ID NO: 2695202 - protein, 20 aa, Entamoeba histolytica
SFLNKRGLTIKGFQESLQEK

SEQ ID NO: 2695203 - protein, 19 aa, Entamoeba histolytica
SFLPISAYILAPVSHFSVY

SEQ ID NO: 2695204 - protein, 28 aa, Entamoeba histolytica
SFMPSTMLMPFIRRVIFFLAPTTELRTI

SEQ ID NO: 2695205 - protein, 18 aa, Entamoeba histolytica
SFNDGKVYLALAHVIILF

SEQ ID NO: 2695206 - protein, 18 aa, Entamoeba histolytica
SFNFKLFFEEETNRMRKI

SEQ ID NO: 2695207 - protein, 18 aa, Entamoeba histolytica
SFNGKSEYMTVCDNEFYQ

SEQ ID NO: 2695208 - protein, 18 aa, Entamoeba histolytica
SFNKCLKKLEDARLKKGF

SEQ ID NO: 2695209 - protein, 24 aa, Entamoeba histolytica
SFNKFIYCPIVLPYFLRLLTHCLS

SEQ ID NO: 2695210 - protein, 28 aa, Entamoeba histolytica
SFNPRTAGNFVDLTWVFEMLKSQHFIHP

SEQ ID NO: 2695211 - protein, 19 aa, Entamoeba histolytica
SFNTGFPLVAKVGTVHAGF

SEQ ID NO: 2695212 - protein, 24 aa, Entamoeba histolytica
SFNTIKFNGFFGINGESIRFSNLG

SEQ ID NO: 2695213 - protein, 20 aa, Entamoeba histolytica
SFNTLLKGKENILLMAFTKK

SEQ ID NO: 2695214 - protein, 19 aa, Entamoeba histolytica
SFNVKRLSTSFGSEFTDVI

SEQ ID NO: 2695215 - protein, 18 aa, Entamoeba histolytica
SFPKIPVYAFSKNVVEMS

SEQ ID NO: 2695216 - protein, 23 aa, Entamoeba histolytica
SFPLELKAKFETFIRPRKNQEIT

SEQ ID NO: 2695217 - protein, 21 aa, Entamoeba histolytica
SFPVETFYKWITRNKKYSDTR

SEQ ID NO: 2695218 - protein, 25 aa, Entamoeba histolytica
SFQEYMWLTQLEFVRTVRGQLVTIE

SEQ ID NO: 2695219 - protein, 19 aa, Entamoeba histolytica
SFQFNLSIEKTMRHKVTLG

SEQ ID NO: 2695220 - protein, 22 aa, Entamoeba histolytica
SFQKLPGPFLVVTPLSTLEHWR

SEQ ID NO: 2695221 - protein, 26 aa, Entamoeba histolytica
SFQLEPHLPFFFKYPILFEPHSFVLE

SEQ ID NO: 2695222 - protein, 31 aa, Entamoeba histolytica
SFQNAPCCLAEFYLRVSLEIAQGVCESLEFL

SEQ ID NO: 2695223 - protein, 28 aa, Entamoeba histolytica
SFQREVNWFKFDVCKYQCNVKCKPHSVI

SEQ ID NO: 2695224 - protein, 17 aa, Entamoeba histolytica
SFRKAGMTYGRLEPWSV

SEQ ID NO: 2695225 - protein, 23 aa, Entamoeba histolytica
SFRKRLMDIFNEFQKQAFSNYSA

SEQ ID NO: 2695226 - protein, 22 aa, Entamoeba histolytica
SFRPFECEPPFPCGEVIDKKPF

SEQ ID NO: 2695227 - protein, 30 aa, Entamoeba histolytica
SFSATNRSCLSCLISVRDIHLLTCGDLGIN

SEQ ID NO: 2695228 - protein, 18 aa, Entamoeba histolytica
SFSEFPIEKIIKTAQNLN

SEQ ID NO: 2695229 - protein, 19 aa, Entamoeba histolytica
SFSEILILFANVCNDMVQK

SEQ ID NO: 2695230 - protein, 26 aa, Entamoeba histolytica
SFSGGVPSFYSELTKWILSFNPLQQY

SEQ ID NO: 2695231 - protein, 42 aa, Entamoeba histolytica
SFSVQTCGNCGGTVIGGITCCACGIYICSNCRQTYTIDNGNY

SEQ ID NO: 2695232 - protein, 32 aa, Entamoeba histolytica
SFTNKAECLMNFKWRQGLILTNDIFSIKNIIT

SEQ ID NO: 2695233 - protein, 22 aa, Entamoeba histolytica
SFTNNHYNVWAGLYTTDSLKPL

SEQ ID NO: 2695234 - protein, 18 aa, Entamoeba histolytica
SFTPKKPRTGFVCSTSVF

SEQ ID NO: 2695235 - protein, 22 aa, Entamoeba histolytica
SFTRAFFRKTLAYFVIVESTIE

SEQ ID NO: 2695236 - protein, 24 aa, Entamoeba histolytica
SFVEAFTWLIAHDVLIRVRKYLCT

SEQ ID NO: 2695237 - protein, 19 aa, Entamoeba histolytica
SFVFPGKRNELFAIGLRKK

SEQ ID NO: 2695238 - protein, 23 aa, Entamoeba histolytica
SFVKKHYPYVTSYTRDDSTKEVT

SEQ ID NO: 2695239 - protein, 30 aa, Entamoeba histolytica
SFVNKPAGIPLCIEYNSFIRRLQHRAVNNY

SEQ ID NO: 2695240 - protein, 18 aa, Entamoeba histolytica
SFVVNSFLPISAYILAPV

SEQ ID NO: 2695241 - protein, 19 aa, Entamoeba histolytica
SFWNCKSLVKIRSSGKIHI

SEQ ID NO: 2695242 - protein, 23 aa, Entamoeba histolytica
SFYCKSICGTIIYTKLFIPHLFS

SEQ ID NO: 2695243 - protein, 27 aa, Entamoeba histolytica
SFYDFGIDILCNISFIIIGIVLHTNDQ

SEQ ID NO: 2695244 - protein, 19 aa, Entamoeba histolytica
SFYKFGRNVCELIKEKLVH

SEQ ID NO: 2695245 - protein, 25 aa, Entamoeba histolytica
SFYNHANCIIALFDLSNKDSLQNCK

SEQ ID NO: 2695246 - protein, 17 aa, Entamoeba histolytica
SFYPRHIQPLALNTQLH

SEQ ID NO: 2695247 - protein, 19 aa, Entamoeba histolytica
SFYVYSINIKREWSDDFDL

SEQ ID NO: 2695248 - protein, 20 aa, Entamoeba histolytica
SGAADCLGMAKLLEENATLK

SEQ ID NO: 2695249 - protein, 21 aa, Entamoeba histolytica
SGADIKWIVSEACTHTLRNDI

SEQ ID NO: 2695250 - protein, 17 aa, Entamoeba histolytica
SGALCTAILDWAANQHV

SEQ ID NO: 2695251 - protein, 17 aa, Entamoeba histolytica
SGALRFGAKEHFVNAII

SEQ ID NO: 2695252 - protein, 18 aa, Entamoeba histolytica
SGCTRISTYFLTNILQNT

SEQ ID NO: 2695253 - protein, 19 aa, Entamoeba histolytica
SGDEKGIFRIWDFRTMKTI

SEQ ID NO: 2695254 - protein, 18 aa, Entamoeba histolytica
SGDGFAIVYSITSLNTFL

SEQ ID NO: 2695255 - protein, 22 aa, Entamoeba histolytica
SGDIRTADQLYCLRKLEEKTSE

SEQ ID NO: 2695256 - protein, 21 aa, Entamoeba histolytica
SGDTIIPIIIYLLLHSSIPNI

SEQ ID NO: 2695257 - protein, 17 aa, Entamoeba histolytica
SGEEIPSLCCLPKTEIE

SEQ ID NO: 2695258 - protein, 25 aa, Entamoeba histolytica
SGEMAITIIRFILSDCMSTQLFNSS

SEQ ID NO: 2695259 - protein, 27 aa, Entamoeba histolytica
SGEYRWCYESWIVLGFEALGLNKNSDA

SEQ ID NO: 2695260 - protein, 20 aa, Entamoeba histolytica
SGFDIELRAAVLHEINEIMP

SEQ ID NO: 2695261 - protein, 17 aa, Entamoeba histolytica
SGFGGFERRPSGPRKGQ

SEQ ID NO: 2695262 - protein, 20 aa, Entamoeba histolytica
SGFLVLRRHVGMIIRLSMIV

SEQ ID NO: 2695263 - protein, 17 aa, Entamoeba histolytica
SGFNWGRIDIDKNSVQL

SEQ ID NO: 2695264 - protein, 24 aa, Entamoeba histolytica
SGFPHGGACTVVLRGPSKQLLGEM

SEQ ID NO: 2695265 - protein, 23 aa, Entamoeba histolytica
SGFPQEFSQFLVKLFEMLNDKES

SEQ ID NO: 2695266 - protein, 18 aa, Entamoeba histolytica
SGGAKIFSVFENNFRPTI

SEQ ID NO: 2695267 - protein, 17 aa, Entamoeba histolytica
SGGCASWLGKKVPNNSC

SEQ ID NO: 2695268 - protein, 23 aa, Entamoeba histolytica
SGGLKKIKCHVTRYFEMIYDDDS

SEQ ID NO: 2695269 - protein, 25 aa, Entamoeba histolytica
SGGLVACPFCVSSCQHYIHYQCFID

SEQ ID NO: 2695270 - protein, 23 aa, Entamoeba histolytica
SGHFLHIDFAHFLGNKLKVAGVI

SEQ ID NO: 2695271 - protein, 24 aa, Entamoeba histolytica
SGHLSKLGVLCFVPKLCGEDVQES

SEQ ID NO: 2695272 - protein, 23 aa, Entamoeba histolytica
SGHSAAVRTVCWGKEMLYSSGDD

SEQ ID NO: 2695273 - protein, 25 aa, Entamoeba histolytica
SGIAMMRIGGITYKLTKGTKPHFLE

SEQ ID NO: 2695274 - protein, 17 aa, Entamoeba histolytica
SGIDARYTRCEFTGDVL

SEQ ID NO: 2695275 - protein, 23 aa, Entamoeba histolytica
SGIKEILSSILIKNEIKVNTNVF

SEQ ID NO: 2695276 - protein, 23 aa, Entamoeba histolytica
SGILCISPLDFAEQMTLIQMESF

SEQ ID NO: 2695277 - protein, 17 aa, Entamoeba histolytica
SGILTFGPCYLVSEEAS

SEQ ID NO: 2695278 - protein, 19 aa, Entamoeba histolytica
SGIQYDYFIGRYINGNEQY

SEQ ID NO: 2695279 - protein, 19 aa, Entamoeba histolytica
SGIYSSCFCASQFPNCFAN

SEQ ID NO: 2695280 - protein, 18 aa, Entamoeba histolytica
SGKELLTLHDFKKKGHCN

SEQ ID NO: 2695281 - protein, 20 aa, Entamoeba histolytica
SGKKLVCTIPKKSKESKKSK

SEQ ID NO: 2695282 - protein, 24 aa, Entamoeba histolytica
SGKNVRLRYYLRVSVNKKYSSGLS

SEQ ID NO: 2695283 - protein, 25 aa, Entamoeba histolytica
SGKRGEQKFEFTIHINKNGMMEISA

SEQ ID NO: 2695284 - protein, 26 aa, Entamoeba histolytica
SGKRLGYRITKDFTVHYFSSIFSVPN

SEQ ID NO: 2695285 - protein, 27 aa, Entamoeba histolytica
SGKRQNKAWKRLVTKATFVGENFTRKP

SEQ ID NO: 2695286 - protein, 26 aa, Entamoeba histolytica
SGKSAILVALAICFGAKAQFTNRGKR

SEQ ID NO: 2695287 - protein, 27 aa, Entamoeba histolytica
SGKSAILVALAICFGAKATFTNRGKRV

SEQ ID NO: 2695288 - protein, 29 aa, Entamoeba histolytica
SGKTLAFLIPLIEFMYRSRWTELDGLCSI

SEQ ID NO: 2695289 - protein, 30 aa, Entamoeba histolytica
SGKYVSYKFSIRFPEIFYEMLSRDSGALNI

SEQ ID NO: 2695290 - protein, 21 aa, Entamoeba histolytica
SGLDMKIEIVAAYVSMNEKEK

SEQ ID NO: 2695291 - protein, 19 aa, Entamoeba histolytica
SGLHKCVIFYSFTDSDLVL

SEQ ID NO: 2695292 - protein, 19 aa, Entamoeba histolytica
SGLPELPAGAVRFEVECEI

SEQ ID NO: 2695293 - protein, 24 aa, Entamoeba histolytica
SGLRIPGFCLTIGKIKEIIQCLGM

SEQ ID NO: 2695294 - protein, 27 aa, Entamoeba histolytica
SGLVFDFNIKFGLYLKEIEEEEARDTM

SEQ ID NO: 2695295 - protein, 24 aa, Entamoeba histolytica
SGNAFKYLILLSHLFVCDEFNNPK

SEQ ID NO: 2695296 - protein, 21 aa, Entamoeba histolytica
SGNDFIIFPPFIHQIDNIQVT

SEQ ID NO: 2695297 - protein, 17 aa, Entamoeba histolytica
SGNIPGLLIRPADGKSK

SEQ ID NO: 2695298 - protein, 20 aa, Entamoeba histolytica
SGNRYEWYLTQFALQRHGII

SEQ ID NO: 2695299 - protein, 17 aa, Entamoeba histolytica
SGNWRKNQQFVLRVKEN

SEQ ID NO: 2695300 - protein, 23 aa, Entamoeba histolytica
SGNYRFVTSLAIKDIVSETHPQY

SEQ ID NO: 2695301 - protein, 19 aa, Entamoeba histolytica
SGQARLSKKFTEIYKEMYG

SEQ ID NO: 2695302 - protein, 19 aa, Entamoeba histolytica
SGQGTIWFMQREVLEKKKF

SEQ ID NO: 2695303 - protein, 19 aa, Entamoeba histolytica
SGQLLACKKIEVGESRINN

SEQ ID NO: 2695304 - protein, 18 aa, Entamoeba histolytica
SGRMRWSPMHRSEQFWTE

SEQ ID NO: 2695305 - protein, 31 aa, Entamoeba histolytica
SGRYTCCMLFLKEIYGSVVLELGQEKYEIDE

SEQ ID NO: 2695306 - protein, 23 aa, Entamoeba histolytica
SGSFSRRSCLVKTPGPKPPNMTN

SEQ ID NO: 2695307 - protein, 26 aa, Entamoeba histolytica
SGSLGHRAAKAFFRSLCEIILEQIDQ

SEQ ID NO: 2695308 - protein, 19 aa, Entamoeba histolytica
SGSMYGEGIKALRNMLQLF

SEQ ID NO: 2695309 - protein, 25 aa, Entamoeba histolytica
SGSNLLVECAWCVGEYIYYLTSEET

SEQ ID NO: 2695310 - protein, 19 aa, Entamoeba histolytica
SGTEFRNLQNWFIKVDKDK

SEQ ID NO: 2695311 - protein, 25 aa, Entamoeba histolytica
SGTFGIVYRAEWRGVDVAVKLMKTD

SEQ ID NO: 2695312 - protein, 24 aa, Entamoeba histolytica
SGTFKYLYDRGLSYRYNQIDGDPV

SEQ ID NO: 2695313 - protein, 32 aa, Entamoeba histolytica
SGTLTLKRPNFWKLRRKDCPWVKQKKSSLIEE

SEQ ID NO: 2695314 - protein, 17 aa, Entamoeba histolytica
SGTTFLHHLLACGEKAR

SEQ ID NO: 2695315 - protein, 21 aa, Entamoeba histolytica
SGTTLFFAYTFIIDGITTLTF

SEQ ID NO: 2695316 - protein, 17 aa, Entamoeba histolytica
SGTYISSIVKLVLKGNT

SEQ ID NO: 2695317 - protein, 22 aa, Entamoeba histolytica
SGVGKSSLLLRFSEDAFNPMYI

SEQ ID NO: 2695318 - protein, 17 aa, Entamoeba histolytica
SGVGKTGIFKRYITGKY

SEQ ID NO: 2695319 - protein, 21 aa, Entamoeba histolytica
SGVHAGYGFVEFVDSTTARFA

SEQ ID NO: 2695320 - protein, 30 aa, Entamoeba histolytica
SGVKDPKISECLMVLMGVDMNQFLNAQNTK

SEQ ID NO: 2695321 - protein, 17 aa, Entamoeba histolytica
SGVLLFVMVCGYPPFSR

SEQ ID NO: 2695322 - protein, 18 aa, Entamoeba histolytica
SGVLRVNGKITITRSIGD

SEQ ID NO: 2695323 - protein, 27 aa, Entamoeba histolytica
SGVTFVFINCVQYLKALVFMTKDPVSS

SEQ ID NO: 2695324 - protein, 21 aa, Entamoeba histolytica
SGYCQCVIFGKELCEPEKVKL

SEQ ID NO: 2695325 - protein, 21 aa, Entamoeba histolytica
SGYYECPLCSEPIQPSDLIID

SEQ ID NO: 2695326 - protein, 35 aa, Entamoeba histolytica
SGYYRVRLTNLLPFDKILGGLAWGISATCYPLEID

SEQ ID NO: 2695327 - protein, 19 aa, Entamoeba histolytica
SHAAIMFYSFYSFQINCDN

SEQ ID NO: 2695328 - protein, 25 aa, Entamoeba histolytica
SHAFPMVICDECHFIKTDSSKRSKE

SEQ ID NO: 2695329 - protein, 26 aa, Entamoeba histolytica
SHAIDLLKRIFLIASRPDRQNDREEA

SEQ ID NO: 2695330 - protein, 24 aa, Entamoeba histolytica
SHAQKFFKKKGMTLKMAGERTNHP

SEQ ID NO: 2695331 - protein, 20 aa, Entamoeba histolytica
SHCKKLKAAGYIECSALENQ

SEQ ID NO: 2695332 - protein, 20 aa, Entamoeba histolytica
SHCYCDGMTAMRLLKESTQH

SEQ ID NO: 2695333 - protein, 21 aa, Entamoeba histolytica
SHEAICAAFHRSNLQGTSLCY

SEQ ID NO: 2695334 - protein, 18 aa, Entamoeba histolytica
SHEDYFQRIYKWKDCGKI

SEQ ID NO: 2695335 - protein, 20 aa, Entamoeba histolytica
SHEHNSFVSSNGWNEEKTKK

SEQ ID NO: 2695336 - protein, 21 aa, Entamoeba histolytica
SHEVVAWLKRILKVEKTGHSG

SEQ ID NO: 2695337 - protein, 18 aa, Entamoeba histolytica
SHFFYHFLELYRTQCSSF

SEQ ID NO: 2695338 - protein, 20 aa, Entamoeba histolytica
SHFHIYRLSGFGTDTLKIKI

SEQ ID NO: 2695339 - protein, 17 aa, Entamoeba histolytica
SHFHLLEVMIKVLLPIS

SEQ ID NO: 2695340 - protein, 20 aa, Entamoeba histolytica
SHFIKGIVNKAIRSNEIQRL

SEQ ID NO: 2695341 - protein, 17 aa, Entamoeba histolytica
SHFNSVFVIVKKIPSEF

SEQ ID NO: 2695342 - protein, 22 aa, Entamoeba histolytica
SHFPYGPTAYFGLYNVVSRHET

SEQ ID NO: 2695343 - protein, 26 aa, Entamoeba histolytica
SHGGDYKDVMVCVGENKKTPSGSSLS

SEQ ID NO: 2695344 - protein, 24 aa, Entamoeba histolytica
SHGPHGMKECLPLILILRNRLNYA

SEQ ID NO: 2695345 - protein, 18 aa, Entamoeba histolytica
SHGVSLFGKTLCVNSSLT

SEQ ID NO: 2695346 - protein, 17 aa, Entamoeba histolytica
SHHLNLPLHFKVQEIIQ

SEQ ID NO: 2695347 - protein, 20 aa, Entamoeba histolytica
SHILSAPVYDDSYCMEHDLV

SEQ ID NO: 2695348 - protein, 27 aa, Entamoeba histolytica
SHIPIKGVVRPVLYTSLYNSTEFTQQQ

SEQ ID NO: 2695349 - protein, 30 aa, Entamoeba histolytica
SHIRFSAIIRFIGHLNLRGFVPSYFMITVI

SEQ ID NO: 2695350 - protein, 31 aa, Entamoeba histolytica
SHITLFKNGIKFICGMNGYIFISLNNESDYS

SEQ ID NO: 2695351 - protein, 21 aa, Entamoeba histolytica
SHIYMFKTLRSFVFDEKCPNP

SEQ ID NO: 2695352 - protein, 23 aa, Entamoeba histolytica
SHIYPDYCFKRIQLQETIVVYRP

SEQ ID NO: 2695353 - protein, 18 aa, Entamoeba histolytica
SHKPKVCDLKLTEEEFKY

SEQ ID NO: 2695354 - protein, 22 aa, Entamoeba histolytica
SHKSSIVSSCWENDNIFISFED

SEQ ID NO: 2695355 - protein, 29 aa, Entamoeba histolytica
SHLEDIYIKLPFYFERPFTDWTLSLLQKS

SEQ ID NO: 2695356 - protein, 25 aa, Entamoeba histolytica
SHLPELHILLSKFVMIRRLKEEVLS

SEQ ID NO: 2695357 - protein, 21 aa, Entamoeba histolytica
SHLPILLPVIQLIPFNRIPNS

SEQ ID NO: 2695358 - protein, 24 aa, Entamoeba histolytica
SHLPPKTVHWFKNFDNYEYSFYTS

SEQ ID NO: 2695359 - protein, 20 aa, Entamoeba histolytica
SHLYRSEFLYFCKRDRNCGK

SEQ ID NO: 2695360 - protein, 24 aa, Entamoeba histolytica
SHNGYGVAMGNAFDSVKEKSNFIT

SEQ ID NO: 2695361 - protein, 18 aa, Entamoeba histolytica
SHNPKPWNGLKFVDSDGL

SEQ ID NO: 2695362 - protein, 17 aa, Entamoeba histolytica
SHNYIIQYIPLFSKLFS

SEQ ID NO: 2695363 - protein, 24 aa, Entamoeba histolytica
SHPIECFIIRIDLSQRLNHLLIFT

SEQ ID NO: 2695364 - protein, 17 aa, Entamoeba histolytica
SHPKKVIIYRGSANTGD

SEQ ID NO: 2695365 - protein, 25 aa, Entamoeba histolytica
SHPNVSIPIAFLLMKDTIIALGGNK

SEQ ID NO: 2695366 - protein, 21 aa, Entamoeba histolytica
SHPPFIVSWGKEYWMKKDEYD

SEQ ID NO: 2695367 - protein, 28 aa, Entamoeba histolytica
SHPQGICNRTKFMLMDLIDLRDLNWAKQ

SEQ ID NO: 2695368 - protein, 20 aa, Entamoeba histolytica
SHPQRLGSIVPLITKVIEQI

SEQ ID NO: 2695369 - protein, 20 aa, Entamoeba histolytica
SHQIKLPVFTNFNATPINQD

SEQ ID NO: 2695370 - protein, 26 aa, Entamoeba histolytica
SHQIRRLTYQLIKFILQICYISDAST

SEQ ID NO: 2695371 - protein, 41 aa, Entamoeba histolytica
SHQYISLEGFLPIVYERKVFGVPMLIAFTYNYPLSPPELSC

SEQ ID NO: 2695372 - protein, 21 aa, Entamoeba histolytica
SHRGRGGYRNNYRNGEKRDYK

SEQ ID NO: 2695373 - protein, 19 aa, Entamoeba histolytica
SHRYIKLINFYSQEHPTLD

SEQ ID NO: 2695374 - protein, 17 aa, Entamoeba histolytica
SHSDLFLHVIIRKTDEL

SEQ ID NO: 2695375 - protein, 20 aa, Entamoeba histolytica
SHSLKSLILALKYMKTLPPS

SEQ ID NO: 2695376 - protein, 24 aa, Entamoeba histolytica
SHSPGVCNLRASPRVQTLINTPPA

SEQ ID NO: 2695377 - protein, 21 aa, Entamoeba histolytica
SHSPYSLGIIDIVKQVFKENN

SEQ ID NO: 2695378 - protein, 22 aa, Entamoeba histolytica
SHSQFSSSIAPPIITSPTPKTE

SEQ ID NO: 2695379 - protein, 21 aa, Entamoeba histolytica
SHSYEVLGFCTYNIDTSIMTI

SEQ ID NO: 2695380 - protein, 25 aa, Entamoeba histolytica
SHSYYQIAVEFERQGTPDTWRVFTG

SEQ ID NO: 2695381 - protein, 26 aa, Entamoeba histolytica
SHTRYCPKCGYAIIGTRKTPRIVCPQ

SEQ ID NO: 2695382 - protein, 24 aa, Entamoeba histolytica
SHVIKRWTMTKVDRLAKLEEVNMD

SEQ ID NO: 2695383 - protein, 20 aa, Entamoeba histolytica
SHYLICKKLIVIGLNSELPH

SEQ ID NO: 2695384 - protein, 18 aa, Entamoeba histolytica
SHYVCPRCHQGVCSVKCY

SEQ ID NO: 2695385 - protein, 24 aa, Entamoeba histolytica
SIACKVNQMILLRIINVNCCNILE

SEQ ID NO: 2695386 - protein, 24 aa, Entamoeba histolytica
SIADCPSHPLLDVIECSIQALMAN

SEQ ID NO: 2695387 - protein, 30 aa, Entamoeba histolytica
SIADRLLKQICHFICYYIIEEMLKRNKING

SEQ ID NO: 2695388 - protein, 32 aa, Entamoeba histolytica
SIAEVIVYPCLSRPELIPIYLSLIQVHHKTFH

SEQ ID NO: 2695389 - protein, 21 aa, Entamoeba histolytica
SIAFSCISTGLFGFPQNVASV

SEQ ID NO: 2695390 - protein, 27 aa, Entamoeba histolytica
SICNDEKIESYRFIPFLNSLIEMTQSP

SEQ ID NO: 2695391 - protein, 19 aa, Entamoeba histolytica
SICRYRISPTPVEIYDAVQ

SEQ ID NO: 2695392 - protein, 17 aa, Entamoeba histolytica
SICTYKLKQFNHEHVMV

SEQ ID NO: 2695393 - protein, 18 aa, Entamoeba histolytica
SICYGEMDNCYTIPGCGH

SEQ ID NO: 2695394 - protein, 25 aa, Entamoeba histolytica
SIDDFFTKLCIFFPNIIDLKHVTNQ

SEQ ID NO: 2695395 - protein, 23 aa, Entamoeba histolytica
SIDELRYGSVMIMADQDFDGSHI

SEQ ID NO: 2695396 - protein, 17 aa, Entamoeba histolytica
SIDFLNGKKVTLRLVSE

SEQ ID NO: 2695397 - protein, 23 aa, Entamoeba histolytica
SIDFYGKYFKHMSIFNELVELTS

SEQ ID NO: 2695398 - protein, 18 aa, Entamoeba histolytica
SIDLKKLAQDDVLGDAVA

SEQ ID NO: 2695399 - protein, 24 aa, Entamoeba histolytica
SIDLLLRAVPWTDYKAREEMADLI

SEQ ID NO: 2695400 - protein, 25 aa, Entamoeba histolytica
SIDLLPILPIEQWKSTSSFVKEEVS

SEQ ID NO: 2695401 - protein, 26 aa, Entamoeba histolytica
SIDPERRKLEGIKLFGDTEIPETSKK

SEQ ID NO: 2695402 - protein, 24 aa, Entamoeba histolytica
SIDPQISVFWGWKEGGKVKTIKRR

SEQ ID NO: 2695403 - protein, 19 aa, Entamoeba histolytica
SIDYHAFDLIFVNPKESKG

SEQ ID NO: 2695404 - protein, 25 aa, Entamoeba histolytica
SIDYYKVSPLIPFLLKQLGSSSCEA

SEQ ID NO: 2695405 - protein, 25 aa, Entamoeba histolytica
SIEDMRRVLLFPSISSYSIGIKGVK

SEQ ID NO: 2695406 - protein, 18 aa, Entamoeba histolytica
SIEIGRKRIDEMDKADEE

SEQ ID NO: 2695407 - protein, 25 aa, Entamoeba histolytica
SIEIILEHRCCTISFICHEDAVKWK

SEQ ID NO: 2695408 - protein, 24 aa, Entamoeba histolytica
SIEKCIDALMYVMLIHTYSFNQFK

SEQ ID NO: 2695409 - protein, 27 aa, Entamoeba histolytica
SIEKKKRLCCERCNSEVMFYELQRVID

SEQ ID NO: 2695410 - protein, 22 aa, Entamoeba histolytica
SIELFKHISVIQALVKSGLIKI

SEQ ID NO: 2695411 - protein, 26 aa, Entamoeba histolytica
SIENELPVIISFSIQRISDVFKEESI

SEQ ID NO: 2695412 - protein, 17 aa, Entamoeba histolytica
SIENELRSLLSLIELLL

SEQ ID NO: 2695413 - protein, 19 aa, Entamoeba histolytica
SIETLLCCNLIRKIDARET

SEQ ID NO: 2695414 - protein, 24 aa, Entamoeba histolytica
SIEVFTILTTRCGTFNDFVLIMGD

SEQ ID NO: 2695415 - protein, 19 aa, Entamoeba histolytica
SIFAPKGRKLPITFEGEYF

SEQ ID NO: 2695416 - protein, 19 aa, Entamoeba histolytica
SIFGNFSFDGFGTTDKKVD

SEQ ID NO: 2695417 - protein, 22 aa, Entamoeba histolytica
SIFIQAAYDWLLIDNKETNSDS

SEQ ID NO: 2695418 - protein, 24 aa, Entamoeba histolytica
SIFRKANAIIFLFPSDVGMEEMQK

SEQ ID NO: 2695419 - protein, 17 aa, Entamoeba histolytica
SIFSFIIDFIEKKIESD

SEQ ID NO: 2695420 - protein, 24 aa, Entamoeba histolytica
SIGFFPVLFISQTMRFEGCEWGYL

SEQ ID NO: 2695421 - protein, 28 aa, Entamoeba histolytica
SIGIYAYELFNFYGVKRIIRIGSAGAIS

SEQ ID NO: 2695422 - protein, 18 aa, Entamoeba histolytica
SIGKGCFSGCSSLSQITI

SEQ ID NO: 2695423 - protein, 23 aa, Entamoeba histolytica
SIGKLCFSECCLLTSMSIPSSMS

SEQ ID NO: 2695424 - protein, 17 aa, Entamoeba histolytica
SIGRGGAAFIFKGKLKT

SEQ ID NO: 2695425 - protein, 19 aa, Entamoeba histolytica
SIGVPFLHTTFRIRSVPDM

SEQ ID NO: 2695426 - protein, 22 aa, Entamoeba histolytica
SIGYCPFITKIPYLGQDGYFLK

SEQ ID NO: 2695427 - protein, 18 aa, Entamoeba histolytica
SIIDFLYNFFEQKMNTSC

SEQ ID NO: 2695428 - protein, 20 aa, Entamoeba histolytica
SIIEAIAWNVLPAELFMKLF

SEQ ID NO: 2695429 - protein, 17 aa, Entamoeba histolytica
SIIIFDIQHYFEIFSQY

SEQ ID NO: 2695430 - protein, 18 aa, Entamoeba histolytica
SIIKKIKHPFIISYYNDY

SEQ ID NO: 2695431 - protein, 18 aa, Entamoeba histolytica
SIIKSIINDVLFSIVTLY

SEQ ID NO: 2695432 - protein, 17 aa, Entamoeba histolytica
SIIKYSLDDYIWYNFVL

SEQ ID NO: 2695433 - protein, 33 aa, Entamoeba histolytica
SIINCIDIRFNLPLNLFRLDILYSNNIEIINLK

SEQ ID NO: 2695434 - protein, 18 aa, Entamoeba histolytica
SIIPIMWNELKIMNDFKA

SEQ ID NO: 2695435 - protein, 21 aa, Entamoeba histolytica
SIIREGWDNWFGIRGSVTVNN

SEQ ID NO: 2695436 - protein, 25 aa, Entamoeba histolytica
SIIRGYLTRRVFGIKLMTKRKAALM

SEQ ID NO: 2695437 - protein, 22 aa, Entamoeba histolytica
SIIRKPIYGIGWFRTHQNQSKV

SEQ ID NO: 2695438 - protein, 18 aa, Entamoeba histolytica
SIIRYILVYKSYFFNISY

SEQ ID NO: 2695439 - protein, 20 aa, Entamoeba histolytica
SIISGCMFIFSYVFSLSNTI

SEQ ID NO: 2695440 - protein, 25 aa, Entamoeba histolytica
SIIVKRALELGTIIMKRIIKEDKTK

SEQ ID NO: 2695441 - protein, 21 aa, Entamoeba histolytica
SIIVMRRIFSFAPFPFHPAVP

SEQ ID NO: 2695442 - protein, 22 aa, Entamoeba histolytica
SIKCISGGIPLQYQPVRRDTKV

SEQ ID NO: 2695443 - protein, 23 aa, Entamoeba histolytica
SIKDLLMNICIQYQYSNNCELQQ

SEQ ID NO: 2695444 - protein, 20 aa, Entamoeba histolytica
SIKDREWYCQTSCATNGDGL

SEQ ID NO: 2695445 - protein, 31 aa, Entamoeba histolytica
SIKEGMFIRPTPRRLNVTIVPPPTSNKSHTV

SEQ ID NO: 2695446 - protein, 19 aa, Entamoeba histolytica
SIKEIKRAFNLSLSDGDRI

SEQ ID NO: 2695447 - protein, 25 aa, Entamoeba histolytica
SIKEVMPYTLGFGLVNNGFSVFAPK

SEQ ID NO: 2695448 - protein, 23 aa, Entamoeba histolytica
SIKEVPYFKGIVYGIFNEVGENI

SEQ ID NO: 2695449 - protein, 17 aa, Entamoeba histolytica
SIKIWDIMPDGLTNDMS

SEQ ID NO: 2695450 - protein, 24 aa, Entamoeba histolytica
SIKKELFGIVKLYENGHIAIQPGK

SEQ ID NO: 2695451 - protein, 27 aa, Entamoeba histolytica
SIKKICDLAEALLLAVIEYLNKRKEYK

SEQ ID NO: 2695452 - protein, 36 aa, Entamoeba histolytica
SIKLEALKAIYFCIQRFELKYVYAYFTHIWESIEQN

SEQ ID NO: 2695453 - protein, 26 aa, Entamoeba histolytica
SIKNKAIKLFDRWCEAVNEDNEKIGI

SEQ ID NO: 2695454 - protein, 21 aa, Entamoeba histolytica
SIKNTLDWMTSIARTNYRTPI

SEQ ID NO: 2695455 - protein, 28 aa, Entamoeba histolytica
SIKQRCPTILPAHLLTLFDVTKTEEPQK

SEQ ID NO: 2695456 - protein, 25 aa, Entamoeba histolytica
SIKSNCFRHCNKLAFIELPSKLEVI

SEQ ID NO: 2695457 - protein, 23 aa, Entamoeba histolytica
SIKTMIKMICKIFPISDFWEHVC

SEQ ID NO: 2695458 - protein, 23 aa, Entamoeba histolytica
SIKTMIKMICKIFPRSNFWEHVC

SEQ ID NO: 2695459 - protein, 26 aa, Entamoeba histolytica
SIKVIEPIIAYMLFKKIIIREKRIYS

SEQ ID NO: 2695460 - protein, 21 aa, Entamoeba histolytica
SILAEICIKALFAANKSFENT

SEQ ID NO: 2695461 - protein, 26 aa, Entamoeba histolytica
SILENRLSIKILFSIIYQLIQENLLS

SEQ ID NO: 2695462 - protein, 18 aa, Entamoeba histolytica
SILGEAYVTTSLIDINQL

SEQ ID NO: 2695463 - protein, 25 aa, Entamoeba histolytica
SILIKLLLPYCDIVFGKPSKKTTTT

SEQ ID NO: 2695464 - protein, 25 aa, Entamoeba histolytica
SILIMPVQRIPRYVLLLKDLLKNTD

SEQ ID NO: 2695465 - protein, 17 aa, Entamoeba histolytica
SILKEKRIRIEAAENYL

SEQ ID NO: 2695466 - protein, 25 aa, Entamoeba histolytica
SILKKLKDLYCEKVKIDKNTTINPV

SEQ ID NO: 2695467 - protein, 24 aa, Entamoeba histolytica
SILLKRPKEGIKYIQEAIEIGGIQ

SEQ ID NO: 2695468 - protein, 18 aa, Entamoeba histolytica
SILNCGYLLLQLEDTVIY

SEQ ID NO: 2695469 - protein, 22 aa, Entamoeba histolytica
SILYPGKWWKCDYCQQVFGKNK

SEQ ID NO: 2695470 - protein, 17 aa, Entamoeba histolytica
SILYSRVRNNIVNKFHT

SEQ ID NO: 2695471 - protein, 33 aa, Entamoeba histolytica
SIMCHRAKILPWRTLRFNECVCTPYNADFDGDE

SEQ ID NO: 2695472 - protein, 22 aa, Entamoeba histolytica
SIMKERIILVIGYIVGIFYHAR

SEQ ID NO: 2695473 - protein, 24 aa, Entamoeba histolytica
SIMKPAELLFTINLIDKMNKIIEN

SEQ ID NO: 2695474 - protein, 23 aa, Entamoeba histolytica
SIMNFHCISVHFSVFNPSNKRGY

SEQ ID NO: 2695475 - protein, 24 aa, Entamoeba histolytica
SIMPEKRYTCVAGFLEVGESAEEC

SEQ ID NO: 2695476 - protein, 20 aa, Entamoeba histolytica
SIMYHIAPYLPWSDNNPQQL

SEQ ID NO: 2695477 - protein, 17 aa, Entamoeba histolytica
SINFCLQTPTLEYLQLK

SEQ ID NO: 2695478 - protein, 17 aa, Entamoeba histolytica
SINGGSPIKEYKQMLKI

SEQ ID NO: 2695479 - protein, 19 aa, Entamoeba histolytica
SINKLYGACKVELKSQLEN

SEQ ID NO: 2695480 - protein, 27 aa, Entamoeba histolytica
SINKNCLWYLIDFLHLISINKAINLMG

SEQ ID NO: 2695481 - protein, 20 aa, Entamoeba histolytica
SIPAIRGWVTKQGGSHKSWK

SEQ ID NO: 2695482 - protein, 18 aa, Entamoeba histolytica
SIPAWYHALSLIRLLCSD

SEQ ID NO: 2695483 - protein, 21 aa, Entamoeba histolytica
SIPKLQKFRGNDNMIKTLPSQ

SEQ ID NO: 2695484 - protein, 23 aa, Entamoeba histolytica
SIPPEIGSLLSLQYLNISENNLK

SEQ ID NO: 2695485 - protein, 18 aa, Entamoeba histolytica
SIPSHCFDSCYNLKSIIL

SEQ ID NO: 2695486 - protein, 17 aa, Entamoeba histolytica
SIPTIIIFNEGQYNSFL

SEQ ID NO: 2695487 - protein, 24 aa, Entamoeba histolytica
SIQEFRIDIILNHILFTGTLGVLS

SEQ ID NO: 2695488 - protein, 25 aa, Entamoeba histolytica
SIQEMWDRWICFIQQTTKSHWEITF

SEQ ID NO: 2695489 - protein, 28 aa, Entamoeba histolytica
SIQFCCKITEGVLLRMVLNDLMKQSQSK

SEQ ID NO: 2695490 - protein, 25 aa, Entamoeba histolytica
SIQKCFYVKLFLDLFSIPSVVLNSD

SEQ ID NO: 2695491 - protein, 22 aa, Entamoeba histolytica
SIQKEIIHFFILAIQTSAIHLI

SEQ ID NO: 2695492 - protein, 24 aa, Entamoeba histolytica
SIQLVDCFKLLNLHDEFSIDDGWV

SEQ ID NO: 2695493 - protein, 33 aa, Entamoeba histolytica
SIQQRYGIDFDLVFKIVKEFRVNKKKVGRATVV

SEQ ID NO: 2695494 - protein, 18 aa, Entamoeba histolytica
SIQSCFFNTISFSYNSQF

SEQ ID NO: 2695495 - protein, 19 aa, Entamoeba histolytica
SIQSIHCAFFIDCSLSAKR

SEQ ID NO: 2695496 - protein, 23 aa, Entamoeba histolytica
SIQWKSESLFVITSKGVILMKEQ

SEQ ID NO: 2695497 - protein, 24 aa, Entamoeba histolytica
SIRDFIKPFMLRRLKTDVQKELPP

SEQ ID NO: 2695498 - protein, 19 aa, Entamoeba histolytica
SIRKVGWIGNCICVNRLKK

SEQ ID NO: 2695499 - protein, 32 aa, Entamoeba histolytica; identical to SEQ ID NO: 2504301

SEQ ID NO: 2695500 - protein, 23 aa, Entamoeba histolytica
SIRSETILIIIVWFFHYKEKEVP

SEQ ID NO: 2695501 - protein, 23 aa, Entamoeba histolytica
SIRSVYMYAPYIKKYHILTSDQV

SEQ ID NO: 2695502 - protein, 30 aa, Entamoeba histolytica
SIRTWKKRYFVLKDRRIWYFSSCKDKAAKG

SEQ ID NO: 2695503 - protein, 17 aa, Entamoeba histolytica
SISEGKLPSVQQLSALK

SEQ ID NO: 2695504 - protein, 23 aa, Entamoeba histolytica
SISEVKCVNALFTYLITNISDFI

SEQ ID NO: 2695505 - protein, 20 aa, Entamoeba histolytica
SISFVVHFIKWIKINKDITK

SEQ ID NO: 2695506 - protein, 18 aa, Entamoeba histolytica
SISHVHGYISYNKDIGLF

SEQ ID NO: 2695507 - protein, 25 aa, Entamoeba histolytica
SISKTCWVGMNYLKKICQSVSFKIK

SEQ ID NO: 2695508 - protein, 22 aa, Entamoeba histolytica
SISLECFAGSLAFFSTTLNNVW

SEQ ID NO: 2695509 - protein, 22 aa, Entamoeba histolytica
SISLKFKLTFSTVVINLEEYFK

SEQ ID NO: 2695510 - protein, 18 aa, Entamoeba histolytica
SISNLNIMNFARRAIEKY

SEQ ID NO: 2695511 - protein, 24 aa, Entamoeba histolytica
SISNRISLSLSRIIEDEVHSLKEF

SEQ ID NO: 2695512 - protein, 17 aa, Entamoeba histolytica
SISPTAFNVFNLMNNFF

SEQ ID NO: 2695513 - protein, 18 aa, Entamoeba histolytica
SISQRNHFNFNFIKNSRK

SEQ ID NO: 2695514 - protein, 24 aa, Entamoeba histolytica
SISSFKPTKSIVLSGYSALGNASI

SEQ ID NO: 2695515 - protein, 17 aa, Entamoeba histolytica
SISSIGTKCFNKNDQLL

SEQ ID NO: 2695516 - protein, 21 aa, Entamoeba histolytica
SISSLSPRSSIRFASLNLTSK

SEQ ID NO: 2695517 - protein, 22 aa, Entamoeba histolytica
SITEVPLNWYLQQKKLLQNKEL

SEQ ID NO: 2695518 - protein, 23 aa, Entamoeba histolytica
SITGKLEICYKPDGDISGTLPYT

SEQ ID NO: 2695519 - protein, 19 aa, Entamoeba histolytica
SITIHEVPKVFKIIIHFDI

SEQ ID NO: 2695520 - protein, 20 aa, Entamoeba histolytica
SITLPWRISAVHSINKKVIC

SEQ ID NO: 2695521 - protein, 20 aa, Entamoeba histolytica
SITMRYGCYKSLKPIIECEC

SEQ ID NO: 2695522 - protein, 17 aa, Entamoeba histolytica
SITRYFQKPSYNNFEIT

SEQ ID NO: 2695523 - protein, 20 aa, Entamoeba histolytica
SITSFGYGCFKYCSSLTTIN

SEQ ID NO: 2695524 - protein, 26 aa, Entamoeba histolytica
SITTEYRKLFNISFDHFYSSIHNLVK

SEQ ID NO: 2695525 - protein, 24 aa, Entamoeba histolytica
SIVDIKIEFGWFYLNVLSTSPIHQ

SEQ ID NO: 2695526 - protein, 20 aa, Entamoeba histolytica
SIVFHALFRMRLIDMRHRVL

SEQ ID NO: 2695527 - protein, 24 aa, Entamoeba histolytica
SIVKGRARATFVSFDKKPVEEQQT

SEQ ID NO: 2695528 - protein, 19 aa, Entamoeba histolytica
SIVKRFEVMDGAPIKGEKI

SEQ ID NO: 2695529 - protein, 32 aa, Entamoeba histolytica
SIVKSVPVQVGWRVVIEWIKDINQLYSQSHDD

SEQ ID NO: 2695530 - protein, 24 aa, Entamoeba histolytica
SIVLQCLSCIISLVKAEITSSKGI

SEQ ID NO: 2695531 - protein, 30 aa, Entamoeba histolytica
SIVRRCHLTMPLCCSGGMLTKIANEYKKWK

SEQ ID NO: 2695532 - protein, 24 aa, Entamoeba histolytica
SIYCKKRGSTILIEKILVDKDIVL

SEQ ID NO: 2695533 - protein, 32 aa, Entamoeba histolytica
SIYEDIFPLLSLLYPRIESINTTYFILSMLSQ

SEQ ID NO: 2695534 - protein, 22 aa, Entamoeba histolytica
SIYKALPFFKDFILSIEQHKND

SEQ ID NO: 2695535 - protein, 24 aa, Entamoeba histolytica
SIYRIKKIFLSFDIHITNEIIDQL

SEQ ID NO: 2695536 - protein, 20 aa, Entamoeba histolytica
SKAAIALALFGGEQRVLVDK

SEQ ID NO: 2695537 - protein, 25 aa, Entamoeba histolytica
SKAELPFNLQVKLADYGFCRAINSG

SEQ ID NO: 2695538 - protein, 19 aa, Entamoeba histolytica
SKAFLESFLDQFPAFKKWK

SEQ ID NO: 2695539 - protein, 22 aa, Entamoeba histolytica
SKAGKFISCKVITHMTNDTVSM

SEQ ID NO: 2695540 - protein, 19 aa, Entamoeba histolytica
SKAIYDVEFLRAFIGNAKN

SEQ ID NO: 2695541 - protein, 19 aa, Entamoeba histolytica
SKALIRWINFVNNENVVSV

SEQ ID NO: 2695542 - protein, 24 aa, Entamoeba histolytica
SKANPFLVKKCRCFLNDNEKKEYN

SEQ ID NO: 2695543 - protein, 19 aa, Entamoeba histolytica
SKAQCSLELQMKGEVNKEG

SEQ ID NO: 2695544 - protein, 20 aa, Entamoeba histolytica
SKAQFLGYMTNHFLSVYTGK

SEQ ID NO: 2695545 - protein, 19 aa, Entamoeba histolytica
SKASIWFNAVLRGDMAKIV

SEQ ID NO: 2695546 - protein, 25 aa, Entamoeba histolytica
SKASTKLRKTICVRNIGNASDDKIQ

SEQ ID NO: 2695547 - protein, 19 aa, Entamoeba histolytica
SKCASAFMNLFEPFNTPIH

SEQ ID NO: 2695548 - protein, 19 aa, Entamoeba histolytica
SKCGDAYKRRGQVKLALGQ

SEQ ID NO: 2695549 - protein, 26 aa, Entamoeba histolytica
SKCICSFKRISFLKLFVNEEAKKWLN

SEQ ID NO: 2695550 - protein, 18 aa, Entamoeba histolytica
SKCKGGYHFELSKDDIGS

SEQ ID NO: 2695551 - protein, 25 aa, Entamoeba histolytica
SKCLSFKSISRIICRQFPQYENEIY

SEQ ID NO: 2695552 - protein, 22 aa, Entamoeba histolytica
SKDGIPECLKKAAEEREARERR

SEQ ID NO: 2695553 - protein, 21 aa, Entamoeba histolytica
SKDHIFNCAYFFVLKRKEGKF

SEQ ID NO: 2695554 - protein, 25 aa, Entamoeba histolytica
SKDILPQGFAPLLFYGLTPGLSERI

SEQ ID NO: 2695555 - protein, 18 aa, Entamoeba histolytica
SKDKTVEHILLFINKQLR

SEQ ID NO: 2695556 - protein, 29 aa, Entamoeba histolytica
SKDSLLRDWSLFYLRCIHHMSVQKLQKLL

SEQ ID NO: 2695557 - protein, 17 aa, Entamoeba histolytica
SKDSMTFVNKVRDKDLF

SEQ ID NO: 2695558 - protein, 24 aa, Entamoeba histolytica
SKEASKLPLWFSHYDHKANFDDYN

SEQ ID NO: 2695559 - protein, 17 aa, Entamoeba histolytica
SKECIFSTIIPEIDEPW

SEQ ID NO: 2695560 - protein, 20 aa, Entamoeba histolytica
SKEECYECEEGYKLEEGMCK

SEQ ID NO: 2695561 - protein, 23 aa, Entamoeba histolytica
SKEEIPLIILYINKIFPFSFCEN

SEQ ID NO: 2695562 - protein, 20 aa, Entamoeba histolytica
SKEFNKWAPKLNCVVYTGDG

SEQ ID NO: 2695563 - protein, 21 aa, Entamoeba histolytica
SKEIKVIIFIRVIKNENVVVL

SEQ ID NO: 2695564 - protein, 24 aa, Entamoeba histolytica
SKEKLRYGIVSFKGKGGMTSESPI

SEQ ID NO: 2695565 - protein, 24 aa, Entamoeba histolytica
SKEKSRLGKIFKINNYAFIMNVCM

SEQ ID NO: 2695566 - protein, 24 aa, Entamoeba histolytica
SKELKFNDSIIMRLCDVVLIENND

SEQ ID NO: 2695567 - protein, 20 aa, Entamoeba histolytica
SKELLLFMRVIVLERLNEVS

SEQ ID NO: 2695568 - protein, 25 aa, Entamoeba histolytica
SKESKLTSICLVSFSNTLVSNKDSD

SEQ ID NO: 2695569 - protein, 35 aa, Entamoeba histolytica
SKESYCCVLPCNDNRFIISWGQLKVNIDVSPSMIV

SEQ ID NO: 2695570 - protein, 18 aa, Entamoeba histolytica
SKEVEEFMLKNNIIKELI

SEQ ID NO: 2695571 - protein, 23 aa, Entamoeba histolytica
SKEVTTTVGIDFRMKRIECNGSP

SEQ ID NO: 2695572 - protein, 18 aa, Entamoeba histolytica
SKFERPWNAPKYLKQKKE

SEQ ID NO: 2695573 - protein, 23 aa, Entamoeba histolytica
SKFFASCVIGCWQIEHNTQNLVN

SEQ ID NO: 2695574 - protein, 19 aa, Entamoeba histolytica
SKFGCSRELFLFSRNILEG

SEQ ID NO: 2695575 - protein, 23 aa, Entamoeba histolytica
SKFIRLGGFVRLFNSLRSVKRVY

SEQ ID NO: 2695576 - protein, 26 aa, Entamoeba histolytica
SKFKDELRGALALSKLENTFVVPEKQ

SEQ ID NO: 2695577 - protein, 21 aa, Entamoeba histolytica
SKFKPKRFINPQSDSYISSTE

SEQ ID NO: 2695578 - protein, 25 aa, Entamoeba histolytica
SKFKRNAKELLCPKKTISSEQIISI

SEQ ID NO: 2695579 - protein, 18 aa, Entamoeba histolytica
SKFKTIKTIVFKPQCINK

SEQ ID NO: 2695580 - protein, 19 aa, Entamoeba histolytica
SKFSEASIHFIDRFQQPLN

SEQ ID NO: 2695581 - protein, 19 aa, Entamoeba histolytica
SKFSSLLLVLHKYTATSHP

SEQ ID NO: 2695582 - protein, 23 aa, Entamoeba histolytica
SKFTLLSCVLFSLIVQKNNDVLF

SEQ ID NO: 2695583 - protein, 17 aa, Entamoeba histolytica
SKGCMKLLHLLWNDQEE

SEQ ID NO: 2695584 - protein, 25 aa, Entamoeba histolytica
SKGEIDRVCNLCFSKATGKKLDDGA

SEQ ID NO: 2695585 - protein, 33 aa, Entamoeba histolytica
SKGFQRIQLLLCCFRLRHEMIFDEEVKQYLRDK

SEQ ID NO: 2695586 - protein, 20 aa, Entamoeba histolytica
SKGIINCIGLLPPSIHKIPT

SEQ ID NO: 2695587 - protein, 20 aa, Entamoeba histolytica
SKGINCKRVSLSRRERIENG

SEQ ID NO: 2695588 - protein, 20 aa, Entamoeba histolytica
SKGIPKWFIRKKYENEEIEM

SEQ ID NO: 2695589 - protein, 18 aa, Entamoeba histolytica
SKGITVSMHYNNTYDVKA

SEQ ID NO: 2695590 - protein, 19 aa, Entamoeba histolytica
SKGKGVFVGCEISKNNLPG

SEQ ID NO: 2695591 - protein, 19 aa, Entamoeba histolytica
SKGKIAHNTLLPWNVYVYD

SEQ ID NO: 2695592 - protein, 21 aa, Entamoeba histolytica
SKGKIIKGFIKAFSNNSNPDT

SEQ ID NO: 2695593 - protein, 18 aa, Entamoeba histolytica
SKGKLRWYSTTSKSDDKL

SEQ ID NO: 2695594 - protein, 17 aa, Entamoeba histolytica
SKGKWEKRAEKSSTKEG

SEQ ID NO: 2695595 - protein, 18 aa, Entamoeba histolytica
SKGSVKVIRKMYETTQSE

SEQ ID NO: 2695596 - protein, 19 aa, Entamoeba histolytica
SKHHVAYRLLKKCDDVQEM

SEQ ID NO: 2695597 - protein, 23 aa, Entamoeba histolytica
SKHKTVLCLNCFFGYDHFYINDT

SEQ ID NO: 2695598 - protein, 19 aa, Entamoeba histolytica
SKHSLILRLLYQAREMDVD

SEQ ID NO: 2695599 - protein, 19 aa, Entamoeba histolytica
SKIAQLIGQYEQLEAKKQE

SEQ ID NO: 2695600 - protein, 24 aa, Entamoeba histolytica
SKIFKRVKKSTVKCIFDSDVDGWD

SEQ ID NO: 2695601 - protein, 18 aa, Entamoeba histolytica
SKIGPKEIRDIVEGFKSI

SEQ ID NO: 2695602 - protein, 17 aa, Entamoeba histolytica
SKIGTFISTFTSSKPSS

SEQ ID NO: 2695603 - protein, 21 aa, Entamoeba histolytica
SKIGYDCFNFCTSLKSINIED

SEQ ID NO: 2695604 - protein, 19 aa, Entamoeba histolytica
SKIHFRVAQYYDLQAQEIE

SEQ ID NO: 2695605 - protein, 24 aa, Entamoeba histolytica
SKIIPMKYSYLFCIIHHYQDALTL

SEQ ID NO: 2695606 - protein, 18 aa, Entamoeba histolytica
SKIKEEEEVFAIGTTLLC

SEQ ID NO: 2695607 - protein, 20 aa, Entamoeba histolytica
SKIKPLMIVSTHYHQLCEEF

SEQ ID NO: 2695608 - protein, 17 aa, Entamoeba histolytica
SKIKRSTIVLTHTTQSV

SEQ ID NO: 2695609 - protein, 19 aa, Entamoeba histolytica
SKIKYPRIFNLILQTKEII

SEQ ID NO: 2695610 - protein, 24 aa, Entamoeba histolytica
SKILEGISLFPAVLTEILSGSLKE

SEQ ID NO: 2695611 - protein, 25 aa, Entamoeba histolytica
SKILQRKGGPWLKEILKDMIELQIE

SEQ ID NO: 2695612 - protein, 19 aa, Entamoeba histolytica
SKINQILDICCKRYHSGVS

SEQ ID NO: 2695613 - protein, 22 aa, Entamoeba histolytica
SKIRWQSFNGKIYVDYNSKLNE

SEQ ID NO: 2695614 - protein, 17 aa, Entamoeba histolytica
SKISRGQQVIWDVEQED

SEQ ID NO: 2695615 - protein, 17 aa, Entamoeba histolytica
SKIYRTPPIPSKRITHY

SEQ ID NO: 2695616 - protein, 19 aa, Entamoeba histolytica
SKKAMSFAMMLVENVKKSG

SEQ ID NO: 2695617 - protein, 19 aa, Entamoeba histolytica
SKKCSLCGFHYFYNPAAAV

SEQ ID NO: 2695618 - protein, 21 aa, Entamoeba histolytica
SKKEQLNWNRFIGGLDSKNGR

SEQ ID NO: 2695619 - protein, 21 aa, Entamoeba histolytica
SKKFLHYWKYILESLKGMKRT

SEQ ID NO: 2695620 - protein, 17 aa, Entamoeba histolytica
SKKKLKFDSFKRDNEKK

SEQ ID NO: 2695621 - protein, 27 aa, Entamoeba histolytica
SKKLKGGEGMFKFYYIPVGKTCELMTV

SEQ ID NO: 2695622 - protein, 23 aa, Entamoeba histolytica
SKKLKTLILRGNFGEISSIYNVT

SEQ ID NO: 2695623 - protein, 18 aa, Entamoeba histolytica
SKKLYGLIHARYIVTSAG

SEQ ID NO: 2695624 - protein, 21 aa, Entamoeba histolytica
SKKPTSLVFIREFRVPVNTMV

SEQ ID NO: 2695625 - protein, 31 aa, Entamoeba histolytica
SKKQLSVELVIPFERFTVVDWVDIEGLPAFG

SEQ ID NO: 2695626 - protein, 29 aa, Entamoeba histolytica
SKKRLEVVLFSLQIIKHWIYLFDSDDPQL

SEQ ID NO: 2695627 - protein, 19 aa, Entamoeba histolytica
SKKVLKALIKASRTSKKKN

SEQ ID NO: 2695628 - protein, 31 aa, Entamoeba histolytica
SKKVMGYLLLFPRLKINYHCFYNKLYNNKYN

SEQ ID NO: 2695629 - protein, 19 aa, Entamoeba histolytica
SKKWSCSVQNGFNVHFKIL

SEQ ID NO: 2695630 - protein, 23 aa, Entamoeba histolytica
SKLDELLRTVVISGIEGITKVII

SEQ ID NO: 2695631 - protein, 22 aa, Entamoeba histolytica
SKLETMASCLMQELQNPSNLDD

SEQ ID NO: 2695632 - protein, 26 aa, Entamoeba histolytica
SKLEVPRKWINELYGVFIPERDNVLQ

SEQ ID NO: 2695633 - protein, 19 aa, Entamoeba histolytica
SKLGEWNLYIAQNSNAFNY

SEQ ID NO: 2695634 - protein, 22 aa, Entamoeba histolytica
SKLGNGCFERCTSLSLINIPRG

SEQ ID NO: 2695635 - protein, 20 aa, Entamoeba histolytica
SKLGNYCFYECKSLTSISIP

SEQ ID NO: 2695636 - protein, 25 aa, Entamoeba histolytica
SKLKEFVKEIKLIIPNSTRINRGNI

SEQ ID NO: 2695637 - protein, 26 aa, Entamoeba histolytica
SKLKEFVKEIKLIIPNSTRINRGNIQ

SEQ ID NO: 2695638 - protein, 24 aa, Entamoeba histolytica
SKLKGELKDVCFDKVIAPVFENKY

SEQ ID NO: 2695639 - protein, 17 aa, Entamoeba histolytica
SKLKLEIIDMNKKIACF

SEQ ID NO: 2695640 - protein, 19 aa, Entamoeba histolytica
SKLLIGLVEACWADPKFFK

SEQ ID NO: 2695641 - protein, 19 aa, Entamoeba histolytica
SKLLKRTISMFRVLNVNGF

SEQ ID NO: 2695642 - protein, 19 aa, Entamoeba histolytica
SKLLLDVLNEFSLQCSLNE

SEQ ID NO: 2695643 - protein, 26 aa, Entamoeba histolytica
SKLLPFTMVGGFLFLRVICPSLAAPE

SEQ ID NO: 2695644 - protein, 25 aa, Entamoeba histolytica
SKLLPVIKNFLCKDSNIEVRKETFK

SEQ ID NO: 2695645 - protein, 21 aa, Entamoeba histolytica
SKLPFKPTLVFLPIVLNHLIH

SEQ ID NO: 2695646 - protein, 25 aa, Entamoeba histolytica
SKLSHCRIFCACFKMSSNIPKTIIR

SEQ ID NO: 2695647 - protein, 20 aa, Entamoeba histolytica
SKLSSPSFELFNNCPCFTAR

SEQ ID NO: 2695648 - protein, 24 aa, Entamoeba histolytica
SKLYPRLKLDQFELLWNNITTSLE

SEQ ID NO: 2695649 - protein, 25 aa, Entamoeba histolytica
SKMEMSVYCYFKLEEQFHGGVDIND

SEQ ID NO: 2695650 - protein, 17 aa, Entamoeba histolytica
SKMFPHTTDLVIGTLLN

SEQ ID NO: 2695651 - protein, 24 aa, Entamoeba histolytica
SKMGLIKSFWYYFLNKNEFTEKNI

SEQ ID NO: 2695652 - protein, 17 aa, Entamoeba histolytica
SKMGNIIEMFYKKKLDY

SEQ ID NO: 2695653 - protein, 23 aa, Entamoeba histolytica
SKMIEHISKLIGIMQFSSNKKKK

SEQ ID NO: 2695654 - protein, 23 aa, Entamoeba histolytica
SKMKEIYEFIGKVIGKIILDGVT

SEQ ID NO: 2695655 - protein, 19 aa, Entamoeba histolytica
SKMKMSVKFQVSDRGNSVI

SEQ ID NO: 2695656 - protein, 18 aa, Entamoeba histolytica
SKMKVLAVEYNWKLGGRN

SEQ ID NO: 2695657 - protein, 22 aa, Entamoeba histolytica
SKMPNRFPPVVFYTPKELGGLG

SEQ ID NO: 2695658 - protein, 23 aa, Entamoeba histolytica
SKMVGILIRRSFHNTGVDIVRIE

SEQ ID NO: 2695659 - protein, 31 aa, Entamoeba histolytica
SKNELESFIIFYLMMKLIRPFYLIQTNASAS

SEQ ID NO: 2695660 - protein, 31 aa, Entamoeba histolytica
SKNEYSLCIDFIRFCILSFTSLFPQDIDPVV

SEQ ID NO: 2695661 - protein, 30 aa, Entamoeba histolytica
SKNGFNLDLCEFIFWGMVRYCTDEELLEFM

SEQ ID NO: 2695662 - protein, 20 aa, Entamoeba histolytica
SKNGKIFDVHKCVVSQFHLP

SEQ ID NO: 2695663 - protein, 23 aa, Entamoeba histolytica
SKNILPEEIKPIIEQEEEDLRVE

SEQ ID NO: 2695664 - protein, 23 aa, Entamoeba histolytica
SKNILPEQFEPIIEKEEEDLRVE

SEQ ID NO: 2695665 - protein, 24 aa, Entamoeba histolytica
SKNILPEQIKPIIEQEEEKLRVED

SEQ ID NO: 2695666 - protein, 29 aa, Entamoeba histolytica
SKNLSWSEFEYCVVLPFKMMKDEQISVYI

SEQ ID NO: 2695667 - protein, 19 aa, Entamoeba histolytica
SKPFLGMAAAVERYKVVAS

SEQ ID NO: 2695668 - protein, 23 aa, Entamoeba histolytica
SKPFSWPSTDFISIREIQTAMGL

SEQ ID NO: 2695669 - protein, 20 aa, Entamoeba histolytica
SKPFSYGCLKNFPEQWRGLR

SEQ ID NO: 2695670 - protein, 19 aa, Entamoeba histolytica
SKPLKDRMKDSIKQINEKS

SEQ ID NO: 2695671 - protein, 19 aa, Entamoeba histolytica
SKPPVVAIDICKQKKDKQH

SEQ ID NO: 2695672 - protein, 20 aa, Entamoeba histolytica
SKPQTKFAIYNTEKINEEEK

SEQ ID NO: 2695673 - protein, 19 aa, Entamoeba histolytica
SKQFINWFEDIKVYITKKL

SEQ ID NO: 2695674 - protein, 19 aa, Entamoeba histolytica
SKQGIRFVFEDGSRIIFRL

SEQ ID NO: 2695675 - protein, 24 aa, Entamoeba histolytica
SKQIAFLCHVAYLALNGDYSGASL

SEQ ID NO: 2695676 - protein, 23 aa, Entamoeba histolytica
SKQIKIIFMLKHVVIPFNYTPWF

SEQ ID NO: 2695677 - protein, 21 aa, Entamoeba histolytica
SKQILPKFFKHSNICSFVRQL

SEQ ID NO: 2695678 - protein, 25 aa, Entamoeba histolytica
SKQKLRGTVPLDFASVKSCEIEDHP

SEQ ID NO: 2695679 - protein, 26 aa, Entamoeba histolytica
SKQLNITWRYSMKKILTKEARYENKN

SEQ ID NO: 2695680 - protein, 20 aa, Entamoeba histolytica
SKQTKHWSVSITKLQDTLNE

SEQ ID NO: 2695681 - protein, 18 aa, Entamoeba histolytica
SKQVFKYFNNVLFGGEMN

SEQ ID NO: 2695682 - protein, 19 aa, Entamoeba histolytica
SKQVIKYLSYYGININKIP

SEQ ID NO: 2695683 - protein, 25 aa, Entamoeba histolytica
SKQYKLLVKECMRELTNDLTSVEIK

SEQ ID NO: 2695684 - protein, 25 aa, Entamoeba histolytica
SKRDIRGVFELNLNVAELFRDLFSV

SEQ ID NO: 2695685 - protein, 21 aa, Entamoeba histolytica
SKRDRRSLCAEITLKVSKHGG

SEQ ID NO: 2695686 - protein, 22 aa, Entamoeba histolytica
SKREIDVMINFVDFIMTDARDI

SEQ ID NO: 2695687 - protein, 17 aa, Entamoeba histolytica
SKRGFGEEEWAFHGSSI

SEQ ID NO: 2695688 - protein, 25 aa, Entamoeba histolytica
SKRLPAPSCEGFVMDDPQHFIFTLK

SEQ ID NO: 2695689 - protein, 18 aa, Entamoeba histolytica
SKRMKILYLTGLLDQYQN

SEQ ID NO: 2695690 - protein, 17 aa, Entamoeba histolytica
SKRMKLYTTTSFLFAYS

SEQ ID NO: 2695691 - protein, 18 aa, Entamoeba histolytica
SKRNCDFEALKLRPFFVG

SEQ ID NO: 2695692 - protein, 21 aa, Entamoeba histolytica
SKRPRFDVIVSKLNDIIKDYS

SEQ ID NO: 2695693 - protein, 22 aa, Entamoeba histolytica
SKRRIIYCTKQPLPSVLRRQQI

SEQ ID NO: 2695694 - protein, 21 aa, Entamoeba histolytica
SKRSVECWMYPNLFHLDKSTG

SEQ ID NO: 2695695 - protein, 30 aa, Entamoeba histolytica
SKSDIWACGIMFYEMILRRSPFDGTLNESD

SEQ ID NO: 2695696 - protein, 22 aa, Entamoeba histolytica
SKSEGLAECYKSMIPTQLKFES

SEQ ID NO: 2695697 - protein, 26 aa, Entamoeba histolytica
SKSFKGKYYPYILGIRKDFLKNTSNT

SEQ ID NO: 2695698 - protein, 21 aa, Entamoeba histolytica
SKSFSLKKKRSVEDILKIFEN

SEQ ID NO: 2695699 - protein, 21 aa, Entamoeba histolytica
SKSILFPKIIFNININNVEMI

SEQ ID NO: 2695700 - protein, 25 aa, Entamoeba histolytica
SKSISIKLLYFIVSCRNDIKVFSQN

SEQ ID NO: 2695701 - protein, 27 aa, Entamoeba histolytica
SKSMYCTQCGMTIHQFCIDLCYEPCLE

SEQ ID NO: 2695702 - protein, 22 aa, Entamoeba histolytica
SKSPSSSVVFDFLTNTSPSNSP

SEQ ID NO: 2695703 - protein, 19 aa, Entamoeba histolytica
SKSQILLCNSIESAIKTIT

SEQ ID NO: 2695704 - protein, 18 aa, Entamoeba histolytica
SKSSVLSLVVGDFNVFKL

SEQ ID NO: 2695705 - protein, 25 aa, Entamoeba histolytica
SKSVSIPLPSEWESPILVNECSIDM

SEQ ID NO: 2695706 - protein, 18 aa, Entamoeba histolytica
SKSYVIWYHRKWSISKME

SEQ ID NO: 2695707 - protein, 19 aa, Entamoeba histolytica
SKTKVVYRYSFINDTPENR

SEQ ID NO: 2695708 - protein, 17 aa, Entamoeba histolytica
SKTPFDVWNDEEIKKEM

SEQ ID NO: 2695709 - protein, 27 aa, Entamoeba histolytica
SKTSLLYSRLDVVKKIIILGDYFVGKS

SEQ ID NO: 2695710 - protein, 18 aa, Entamoeba histolytica
SKTTFNRVFNLYNTYNGN

SEQ ID NO: 2695711 - protein, 28 aa, Entamoeba histolytica
SKTVSELYLRWAPLFWNFLRNPNIPFDK

SEQ ID NO: 2695712 - protein, 17 aa, Entamoeba histolytica
SKTWDHFQMRIYKRVLT

SEQ ID NO: 2695713 - protein, 25 aa, Entamoeba histolytica
SKTWFPDMPSHFILKENEPIKPLSI

SEQ ID NO: 2695714 - protein, 18 aa, Entamoeba histolytica
SKTYWPLVLDIATKNTVN

SEQ ID NO: 2695715 - protein, 23 aa, Entamoeba histolytica
SKVDIPYACKLLFQELMSMAVCP

SEQ ID NO: 2695716 - protein, 18 aa, Entamoeba histolytica
SKVFKPVKFMVGRCPLSE

SEQ ID NO: 2695717 - protein, 27 aa, Entamoeba histolytica
SKVFSHIWFLFEVIIHSLIKYLDKQHA

SEQ ID NO: 2695718 - protein, 20 aa, Entamoeba histolytica
SKVHPINFTPPIAKLEVNPK

SEQ ID NO: 2695719 - protein, 17 aa, Entamoeba histolytica
SKVKRINPALFYLCEGR

SEQ ID NO: 2695720 - protein, 18 aa, Entamoeba histolytica
SKVLEKYQLIGLSVGDCK

SEQ ID NO: 2695721 - protein, 23 aa, Entamoeba histolytica
SKVLEMICAFIGEDPHITSCAFI

SEQ ID NO: 2695722 - protein, 21 aa, Entamoeba histolytica
SKVWPCNLLPPSLPTPNIEYE

SEQ ID NO: 2695723 - protein, 18 aa, Entamoeba histolytica
SKWKMPIPPNNTLERVCA

SEQ ID NO: 2695724 - protein, 18 aa, Entamoeba histolytica
SKYAKLYHQLKKAVHDKN

SEQ ID NO: 2695725 - protein, 17 aa, Entamoeba histolytica
SKYARIGAVIDVLGTYS

SEQ ID NO: 2695726 - protein, 17 aa, Entamoeba histolytica
SKYFLLKEVTLPTSITS

SEQ ID NO: 2695727 - protein, 18 aa, Entamoeba histolytica
SKYGDIYFDKPIKRSTTT

SEQ ID NO: 2695728 - protein, 28 aa, Entamoeba histolytica
SKYKAEITEVRFIQSVIPFKVIERKERE

SEQ ID NO: 2695729 - protein, 19 aa, Entamoeba histolytica
SKYKHIITSLATMFKARTN

SEQ ID NO: 2695730 - protein, 19 aa, Entamoeba histolytica
SKYKSVVSVAEELLKEYNL

SEQ ID NO: 2695731 - protein, 23 aa, Entamoeba histolytica
SKYLEMMSFIITEADFIFDDTKK

SEQ ID NO: 2695732 - protein, 18 aa, Entamoeba histolytica
SKYLHVLQCPSHPKELDN

SEQ ID NO: 2695733 - protein, 25 aa, Entamoeba histolytica
SKYLKMSIKLATRITQFIANTKMFG

SEQ ID NO: 2695734 - protein, 17 aa, Entamoeba histolytica
SKYLPGRAPNSVKNRYF

SEQ ID NO: 2695735 - protein, 22 aa, Entamoeba histolytica
SKYMADIYLHYLTNGDFKSIDK

SEQ ID NO: 2695736 - protein, 21 aa, Entamoeba histolytica
SKYPLSIICIGVGDGPFGEME

SEQ ID NO: 2695737 - protein, 19 aa, Entamoeba histolytica
SKYRHVFGTEFKIDQQYSG

SEQ ID NO: 2695738 - protein, 19 aa, Entamoeba histolytica
SKYRHVFGTEFKNDQQYNG

SEQ ID NO: 2695739 - protein, 27 aa, Entamoeba histolytica
SKYYFFKRLPWILPIQLKRFTWDEKKI

SEQ ID NO: 2695740 - protein, 23 aa, Entamoeba histolytica
SLAIKYGIDIGGGVIDEDYRGEI

SEQ ID NO: 2695741 - protein, 19 aa, Entamoeba histolytica
SLAKTCCTLATGSRDNTVQ

SEQ ID NO: 2695742 - protein, 17 aa, Entamoeba histolytica
SLALFYFITAAETMRTI

SEQ ID NO: 2695743 - protein, 27 aa, Entamoeba histolytica
SLAMPDAHSGYGFSIGGVAAMRLDDPN

SEQ ID NO: 2695744 - protein, 22 aa, Entamoeba histolytica
SLCCTIIKPSVSPFLDSIYINA

SEQ ID NO: 2695745 - protein, 18 aa, Entamoeba histolytica
SLCITMTMLCYSQEVNIY

SEQ ID NO: 2695746 - protein, 26 aa, Entamoeba histolytica
SLCKVKRFSGKYCEVDGIYDCTTLTY

SEQ ID NO: 2695747 - protein, 22 aa, Entamoeba histolytica
SLCTRTPNIIQYYGYTQLTDSM

SEQ ID NO: 2695748 - protein, 19 aa, Entamoeba histolytica
SLCTVKLPASLSVLEEGVF

SEQ ID NO: 2695749 - protein, 20 aa, Entamoeba histolytica
SLDAEWSYNLYVYVVLEELN

SEQ ID NO: 2695750 - protein, 31 aa, Entamoeba histolytica
SLDALIGFVCEPCSDIATREAFIYTFRCYAD

SEQ ID NO: 2695751 - protein, 20 aa, Entamoeba histolytica
SLDESVGFYPVQRSKGSPSS

SEQ ID NO: 2695752 - protein, 24 aa, Entamoeba histolytica
SLDIDGTVCVLEILDTAGQEEYNS

SEQ ID NO: 2695753 - protein, 20 aa, Entamoeba histolytica
SLDVVESYGQIGVKLPSMNL

SEQ ID NO: 2695754 - protein, 21 aa, Entamoeba histolytica
SLEAFKLLFPQSMPIVQLPQN

SEQ ID NO: 2695755 - protein, 19 aa, Entamoeba histolytica
SLEDCAKYIFNYPTYLEKI

SEQ ID NO: 2695756 - protein, 27 aa, Entamoeba histolytica
SLEERACIIKRKYIRKQFVVPSDENWI

SEQ ID NO: 2695757 - protein, 23 aa, Entamoeba histolytica
SLEHCITSTYLLLSSMKPSPVDT

SEQ ID NO: 2695758 - protein, 20 aa, Entamoeba histolytica
SLEIIRFPLSLEHLNISKCK

SEQ ID NO: 2695759 - protein, 17 aa, Entamoeba histolytica
SLEIKWVNNVLFTPTEL

SEQ ID NO: 2695760 - protein, 26 aa, Entamoeba histolytica
SLEKAFYFKYLNDVRLEMKRIETENQ

SEQ ID NO: 2695761 - protein, 19 aa, Entamoeba histolytica
SLEKVELFKSVSTANKTKF

SEQ ID NO: 2695762 - protein, 28 aa, Entamoeba histolytica
SLEMVLRKPCKIEGNIPLIQKINEYHFK

SEQ ID NO: 2695763 - protein, 24 aa, Entamoeba histolytica
SLERKRFVGNDVVVVVFKEQLNKD

SEQ ID NO: 2695764 - protein, 19 aa, Entamoeba histolytica
SLERPCLVYEYFPKEYRIQ

SEQ ID NO: 2695765 - protein, 18 aa, Entamoeba histolytica
SLESIVFHALFRMRLIDM

SEQ ID NO: 2695766 - protein, 20 aa, Entamoeba histolytica
SLESLEWLNVLKKIMKNLQS

SEQ ID NO: 2695767 - protein, 17 aa, Entamoeba histolytica
SLFCGVSASSLLSTQFA

SEQ ID NO: 2695768 - protein, 24 aa, Entamoeba histolytica
SLFDCFPLAALIEGNGLGRFLCTH

SEQ ID NO: 2695769 - protein, 19 aa, Entamoeba histolytica
SLFIKGFGKDATRQEIIDA

SEQ ID NO: 2695770 - protein, 22 aa, Entamoeba histolytica
SLFKSGRFIQMIDIFINTIKIY

SEQ ID NO: 2695771 - protein, 19 aa, Entamoeba histolytica
SLFQFPKRLNYLTKMVMIN

SEQ ID NO: 2695772 - protein, 23 aa, Entamoeba histolytica
SLFRKHCGELPITAIIITHSHGD

SEQ ID NO: 2695773 - protein, 17 aa, Entamoeba histolytica
SLFWLFQSVMTMLQGFY

SEQ ID NO: 2695774 - protein, 21 aa, Entamoeba histolytica
SLGCIPNLRKMAFEFEKNIVN

SEQ ID NO: 2695775 - protein, 21 aa, Entamoeba histolytica
SLGIILLRFWFGYKEASSPEE

SEQ ID NO: 2695776 - protein, 19 aa, Entamoeba histolytica
SLGKSCFQSSFNITSITLS

SEQ ID NO: 2695777 - protein, 18 aa, Entamoeba histolytica
SLGKVMQTPECLRVYVSS

SEQ ID NO: 2695778 - protein, 17 aa, Entamoeba histolytica
SLGLKGHHILYLNEGRR

SEQ ID NO: 2695779 - protein, 24 aa, Entamoeba histolytica
SLGLLEIIGSLSLSDIPYPSSFLL

SEQ ID NO: 2695780 - protein, 19 aa, Entamoeba histolytica
SLGLPRRRRIEGGFFGYYL

SEQ ID NO: 2695781 - protein, 18 aa, Entamoeba histolytica
SLGLVASVSRKYIYQIIS

SEQ ID NO: 2695782 - protein, 23 aa, Entamoeba histolytica
SLGMLQVKLLRLWDPSKDLIKIC

SEQ ID NO: 2695783 - protein, 21 aa, Entamoeba histolytica
SLGNRCFRWCGDIQSINIPTN

SEQ ID NO: 2695784 - protein, 19 aa, Entamoeba histolytica
SLGNYCFSRCDGMQKIKIP

SEQ ID NO: 2695785 - protein, 18 aa, Entamoeba histolytica
SLGRFFCTHGGISPFLTR

SEQ ID NO: 2695786 - protein, 24 aa, Entamoeba histolytica
SLGRMPLKYFNMVITKHIDVIDEL

SEQ ID NO: 2695787 - protein, 24 aa, Entamoeba histolytica
SLGRSCRQLHGIVFGVEGEKYWED

SEQ ID NO: 2695788 - protein, 19 aa, Entamoeba histolytica
SLHGHSHFISDLVLSNDGQ

SEQ ID NO: 2695789 - protein, 22 aa, Entamoeba histolytica
SLHGVGLGRSCDVELIRNIGRI

SEQ ID NO: 2695790 - protein, 24 aa, Entamoeba histolytica
SLHKMYLLTFIVRFFIDNFKRIDS

SEQ ID NO: 2695791 - protein, 22 aa, Entamoeba histolytica
SLHKYFPLRFIPTLWTEDCDLL

SEQ ID NO: 2695792 - protein, 25 aa, Entamoeba histolytica
SLHTVEIKSGSFIDHLNKDELLFWV

SEQ ID NO: 2695793 - protein, 24 aa, Entamoeba histolytica
SLICCLKLPIDIVQKYLPEINSCV

SEQ ID NO: 2695794 - protein, 24 aa, Entamoeba histolytica
SLICSEPLISFSIVQIVINIFKKL

SEQ ID NO: 2695795 - protein, 19 aa, Entamoeba histolytica
SLIEGLKNALPVASSDKDE

SEQ ID NO: 2695796 - protein, 19 aa, Entamoeba histolytica
SLIHFQIKKLFYSTVDSVV

SEQ ID NO: 2695797 - protein, 26 aa, Entamoeba histolytica
SLIKENLSIKEIIKQVELESDDIEEI

SEQ ID NO: 2695798 - protein, 18 aa, Entamoeba histolytica
SLIKIAQVFMVLKVIQEA

SEQ ID NO: 2695799 - protein, 18 aa, Entamoeba histolytica
SLIKLHKRDIPFVSSIIN

SEQ ID NO: 2695800 - protein, 24 aa, Entamoeba histolytica
SLIKTMLTHVGKGFFELELLKKAY

SEQ ID NO: 2695801 - protein, 17 aa, Entamoeba histolytica
SLIPLKFSGIIRDLMAE

SEQ ID NO: 2695802 - protein, 24 aa, Entamoeba histolytica
SLIPNCVELLPILLSMKKLEILNI

SEQ ID NO: 2695803 - protein, 21 aa, Entamoeba histolytica
SLIQLKLLYFEGSTEHDKLYW

SEQ ID NO: 2695804 - protein, 18 aa, Entamoeba histolytica
SLIRKRGRKKSENTFLQD

SEQ ID NO: 2695805 - protein, 19 aa, Entamoeba histolytica
SLISHCLLIPLLPQGQYNK

SEQ ID NO: 2695806 - protein, 18 aa, Entamoeba histolytica
SLITGGLYFKLKEKHPDF

SEQ ID NO: 2695807 - protein, 18 aa, Entamoeba histolytica
SLITGGLYFKLKEKHPEF

SEQ ID NO: 2695808 - protein, 18 aa, Entamoeba histolytica
SLITLQFQPLIEWSINND

SEQ ID NO: 2695809 - protein, 21 aa, Entamoeba histolytica
SLKDTFGRKAFFGVKAVISPN

SEQ ID NO: 2695810 - protein, 18 aa, Entamoeba histolytica
SLKELKLNDYTSIALTSL

SEQ ID NO: 2695811 - protein, 25 aa, Entamoeba histolytica
SLKEMCKKCRVVMEIDSINNIKEFC

SEQ ID NO: 2695812 - protein, 19 aa, Entamoeba histolytica
SLKFPPNLIQLELSNVNKQ

SEQ ID NO: 2695813 - protein, 31 aa, Entamoeba histolytica
SLKGEMKPSLSLQKIMIAFGIDPITINCLIK

SEQ ID NO: 2695814 - protein, 18 aa, Entamoeba histolytica
SLKGIPIEMVFKEKGIEN

SEQ ID NO: 2695815 - protein, 20 aa, Entamoeba histolytica
SLKIEPRTSSIVPLSAGCTR

SEQ ID NO: 2695816 - protein, 23 aa, Entamoeba histolytica
SLKPGTLFVNVCPFMKLVTDQEI

SEQ ID NO: 2695817 - protein, 18 aa, Entamoeba histolytica
SLKRFKENVIQLLVATDV

SEQ ID NO: 2695818 - protein, 26 aa, Entamoeba histolytica
SLKRYYKIFFELHLIFAKAPKSEQTR

SEQ ID NO: 2695819 - protein, 22 aa, Entamoeba histolytica
SLKSIYPNYVIKTFELGDGGEG

SEQ ID NO: 2695820 - protein, 22 aa, Entamoeba histolytica
SLKTIMIPPGITIVQAVSISQE

SEQ ID NO: 2695821 - protein, 23 aa, Entamoeba histolytica
SLKTLICKLCYNLGTFLNLNITK

SEQ ID NO: 2695822 - protein, 19 aa, Entamoeba histolytica
SLLAGMRCSFDYSNDLYVY

SEQ ID NO: 2695823 - protein, 23 aa, Entamoeba histolytica
SLLCYGQLILRKEMTRVSINELL

SEQ ID NO: 2695824 - protein, 19 aa, Entamoeba histolytica
SLLDDLFVIMSYKNTKDGF

SEQ ID NO: 2695825 - protein, 18 aa, Entamoeba histolytica
SLLECCCQLIELRNSKII

SEQ ID NO: 2695826 - protein, 27 aa, Entamoeba histolytica
SLLEEIRSLLLQFKRGLLLLNGKYLED

SEQ ID NO: 2695827 - protein, 27 aa, Entamoeba histolytica
SLLEGMYFKSCKMINWSSVPKLIKYLL

SEQ ID NO: 2695828 - protein, 23 aa, Entamoeba histolytica
SLLFSCLNISYSNILKRKGSSSK

SEQ ID NO: 2695829 - protein, 20 aa, Entamoeba histolytica
SLLINYPFYNLFDWNDDMNT

SEQ ID NO: 2695830 - protein, 19 aa, Entamoeba histolytica
SLLKLTFNSGETFKLKVNN

SEQ ID NO: 2695831 - protein, 26 aa, Entamoeba histolytica
SLLREIPIEILINPNIQFVLNVKRAF

SEQ ID NO: 2695832 - protein, 17 aa, Entamoeba histolytica
SLLRGMISLGFEKMWTK

SEQ ID NO: 2695833 - protein, 24 aa, Entamoeba histolytica
SLLRKRSVKFIQLFAKTIKDLLNG

SEQ ID NO: 2695834 - protein, 18 aa, Entamoeba histolytica
SLLRNCKEYMKPKYNEVL

SEQ ID NO: 2695835 - protein, 24 aa, Entamoeba histolytica
SLLSETLFCLLLVCEPSQEVKELY

SEQ ID NO: 2695836 - protein, 19 aa, Entamoeba histolytica
SLLSLPSLKIIKVTSLSLT

SEQ ID NO: 2695837 - protein, 19 aa, Entamoeba histolytica
SLLSSSGRRKELLNFVLEG

SEQ ID NO: 2695838 - protein, 19 aa, Entamoeba histolytica
SLLTLPMIWNENRFKETIE

SEQ ID NO: 2695839 - protein, 22 aa, Entamoeba histolytica
SLMAAWMKYGLPQTQQEVINLH

SEQ ID NO: 2695840 - protein, 26 aa, Entamoeba histolytica
SLMAPMDAFLCARGMKTLPIRMQIHM

SEQ ID NO: 2695841 - protein, 20 aa, Entamoeba histolytica
SLMKKSLCQKELIQPEQFMN

SEQ ID NO: 2695842 - protein, 21 aa, Entamoeba histolytica
SLMLRVNIRNGKICHQKEFNM

SEQ ID NO: 2695843 - protein, 19 aa, Entamoeba histolytica
SLMTACIGMCSCLITEKKP

SEQ ID NO: 2695844 - protein, 19 aa, Entamoeba histolytica
SLNAARFVFDGSINGIESN

SEQ ID NO: 2695845 - protein, 19 aa, Entamoeba histolytica
SLNDFDIIIPSCSFDSILN

SEQ ID NO: 2695846 - protein, 25 aa, Entamoeba histolytica
SLNELEVSIVFKLEKNQVVSAEVIK

SEQ ID NO: 2695847 - protein, 24 aa, Entamoeba histolytica
SLNIDLWHVHSFMGRPKKEWLKPQ

SEQ ID NO: 2695848 - protein, 25 aa, Entamoeba histolytica
SLNIKESYWYLGLLYEYGAGVIQNS

SEQ ID NO: 2695849 - protein, 34 aa, Entamoeba histolytica
SLNKILPLLIKLHRTDLLPLFSIIMTACPKEFSS

SEQ ID NO: 2695850 - protein, 20 aa, Entamoeba histolytica
SLNKRKGCSLQIGYTTYSDK

SEQ ID NO: 2695851 - protein, 25 aa, Entamoeba histolytica
SLNLKKAYPLFGIKNFRSTCFANSV

SEQ ID NO: 2695852 - protein, 18 aa, Entamoeba histolytica
SLNMAGGDKKVISRLHEM

SEQ ID NO: 2695853 - protein, 22 aa, Entamoeba histolytica
SLNNCCGYFCPLAEDKTSMKKG

SEQ ID NO: 2695854 - protein, 26 aa, Entamoeba histolytica
SLNNVQWFFDWCSLNYEQTYILYGNH

SEQ ID NO: 2695855 - protein, 24 aa, Entamoeba histolytica
SLNNYCWFQNGSVVFNMNASLPII

SEQ ID NO: 2695856 - protein, 18 aa, Entamoeba histolytica
SLNPLLFHEVIKQSSSET

SEQ ID NO: 2695857 - protein, 17 aa, Entamoeba histolytica
SLNRISYYSQFEKIVTN

SEQ ID NO: 2695858 - protein, 19 aa, Entamoeba histolytica
SLNSLFKKCCMHPNDIVSM

SEQ ID NO: 2695859 - protein, 19 aa, Entamoeba histolytica
SLNTALEFVKKGKTPELQK

SEQ ID NO: 2695860 - protein, 23 aa, Entamoeba histolytica
SLNVARVLLINGIRTTQRNSFGH

SEQ ID NO: 2695861 - protein, 20 aa, Entamoeba histolytica
SLNVRIVGIDGFDLSVGNEK

SEQ ID NO: 2695862 - protein, 24 aa, Entamoeba histolytica
SLPCGHSFCDNCIINWVQHHHYCP

SEQ ID NO: 2695863 - protein, 17 aa, Entamoeba histolytica
SLPCKRNIPMEQFADYI

SEQ ID NO: 2695864 - protein, 19 aa, Entamoeba histolytica
SLPEVPDYISNIISLSQSS

SEQ ID NO: 2695865 - protein, 24 aa, Entamoeba histolytica
SLPHLCFYDCPLLQHVLLPTTLTL

SEQ ID NO: 2695866 - protein, 22 aa, Entamoeba histolytica
SLPISCCYLCNFLTSIQLPTTL

SEQ ID NO: 2695867 - protein, 23 aa, Entamoeba histolytica
SLPKETKMTISLYMTELPVGISI

SEQ ID NO: 2695868 - protein, 18 aa, Entamoeba histolytica
SLPKSVVYLSKIKLEQNS

SEQ ID NO: 2695869 - protein, 19 aa, Entamoeba histolytica
SLPLPITLLKFFKQPTQMT

SEQ ID NO: 2695870 - protein, 25 aa, Entamoeba histolytica
SLPNFYCVLFAFGLSFPLNNERSGI

SEQ ID NO: 2695871 - protein, 24 aa, Entamoeba histolytica
SLPPESIHYLGFIDFVHKILPIFI

SEQ ID NO: 2695872 - protein, 25 aa, Entamoeba histolytica
SLPPKGVVVRPSYNANFKIHSLGSS

SEQ ID NO: 2695873 - protein, 23 aa, Entamoeba histolytica
SLPQLPGKLIFPSSLTSLTTPYL

SEQ ID NO: 2695874 - protein, 22 aa, Entamoeba histolytica
SLQACICCNILDLLKKIYTKKY

SEQ ID NO: 2695875 - protein, 18 aa, Entamoeba histolytica
SLQHPRNIWTLKPYNEQT

SEQ ID NO: 2695876 - protein, 26 aa, Entamoeba histolytica
SLQRKSKSSLKRKSLSLIKKSISLKE

SEQ ID NO: 2695877 - protein, 17 aa, Entamoeba histolytica
SLQVGEYHLKFLIQPFL

SEQ ID NO: 2695878 - protein, 27 aa, Entamoeba histolytica
SLRFRFPSTCDLRFVLLSENKRQCEFY

SEQ ID NO: 2695879 - protein, 20 aa, Entamoeba histolytica
SLRKKLWMEHLGFKEHLSLL

SEQ ID NO: 2695880 - protein, 19 aa, Entamoeba histolytica
SLRKWTQMTEELTLNLDDE

SEQ ID NO: 2695881 - protein, 24 aa, Entamoeba histolytica
SLRRKSMQVLPSLFQPHRNTKKKE

SEQ ID NO: 2695882 - protein, 17 aa, Entamoeba histolytica
SLRRQELEMAMGSVPAG

SEQ ID NO: 2695883 - protein, 24 aa, Entamoeba histolytica
SLRVNELIKDFPLLRDEYNKILDQ

SEQ ID NO: 2695884 - protein, 18 aa, Entamoeba histolytica
SLSDDVIVFAFNRDTGTT

SEQ ID NO: 2695885 - protein, 20 aa, Entamoeba histolytica
SLSDLTVGALRDFYLDLDDL

SEQ ID NO: 2695886 - protein, 29 aa, Entamoeba histolytica
SLSFKCSCIETIKFIMVNTVIEYYNSLSI

SEQ ID NO: 2695887 - protein, 24 aa, Entamoeba histolytica
SLSFPDNLVWLGIDCLRGCSSLVS

SEQ ID NO: 2695888 - protein, 19 aa, Entamoeba histolytica
SLSHTWCCDVLLFVIRLLK

SEQ ID NO: 2695889 - protein, 23 aa, Entamoeba histolytica
SLSIDGTCIFKGIIHIERSDVLY

SEQ ID NO: 2695890 - protein, 29 aa, Entamoeba histolytica
SLSKIIKARIVSILSYWSTTILPLLPEKE

SEQ ID NO: 2695891 - protein, 17 aa, Entamoeba histolytica
SLSKLYNDACDNLATKD

SEQ ID NO: 2695892 - protein, 22 aa, Entamoeba histolytica
SLSKSNVCLLLINEDLIITETI

SEQ ID NO: 2695893 - protein, 28 aa, Entamoeba histolytica
SLSLDQWYIIILCFLDFSLQDISKTTTV

SEQ ID NO: 2695894 - protein, 17 aa, Entamoeba histolytica
SLSLPITLLRFAQPLKF

SEQ ID NO: 2695895 - protein, 34 aa, Entamoeba histolytica
SLSMSCSDKILKWEVLGIQGGILANHFEMIRLNL

SEQ ID NO: 2695896 - protein, 23 aa, Entamoeba histolytica
SLSPNCPIINQFIHNINRNHRKE

SEQ ID NO: 2695897 - protein, 17 aa, Entamoeba histolytica
SLSQFGFITCTYSRGDI

SEQ ID NO: 2695898 - protein, 17 aa, Entamoeba histolytica
SLSRLVLPISLEIISSL

SEQ ID NO: 2695899 - protein, 19 aa, Entamoeba histolytica
SLSSIEWDYLDYAFMRLNK

SEQ ID NO: 2695900 - protein, 19 aa, Entamoeba histolytica
SLSVCSVLMVNLWSHDVGR

SEQ ID NO: 2695901 - protein, 18 aa, Entamoeba histolytica
SLSVNIIYQLLSNFHTDE

SEQ ID NO: 2695902 - protein, 27 aa, Entamoeba histolytica
SLSYCIYAMLILPKLRDPDAFLQSVDN

SEQ ID NO: 2695903 - protein, 19 aa, Entamoeba histolytica
SLSYSIKFKLFKKLKKVMD

SEQ ID NO: 2695904 - protein, 23 aa, Entamoeba histolytica
SLTGFKLTIPFLDGSEVSKKIEN

SEQ ID NO: 2695905 - protein, 19 aa, Entamoeba histolytica
SLTIKMGKELSFFFDKNPY

SEQ ID NO: 2695906 - protein, 23 aa, Entamoeba histolytica
SLTKLCGILHNYVPSPLNDHCLN

SEQ ID NO: 2695907 - protein, 21 aa, Entamoeba histolytica
SLTKQRLVIEPSLNQLHQQYI

SEQ ID NO: 2695908 - protein, 22 aa, Entamoeba histolytica
SLTKRSKGILFFGPPGTGKTML

SEQ ID NO: 2695909 - protein, 28 aa, Entamoeba histolytica
SLTLKCPICRKTFKNEFKIVLLPVENKY

SEQ ID NO: 2695910 - protein, 20 aa, Entamoeba histolytica
SLTLRFQMLGVIPKVSSKQV

SEQ ID NO: 2695911 - protein, 20 aa, Entamoeba histolytica
SLTLWWNVMQNMPLLWNITD

SEQ ID NO: 2695912 - protein, 26 aa, Entamoeba histolytica
SLTNELKGSLLPPAVEVTMIQFKNPL

SEQ ID NO: 2695913 - protein, 19 aa, Entamoeba histolytica
SLTNHAFLIIGYDLSQPFS

SEQ ID NO: 2695914 - protein, 26 aa, Entamoeba histolytica
SLTRKEMKPDECEKSSCIKDQPQIQN

SEQ ID NO: 2695915 - protein, 17 aa, Entamoeba histolytica
SLTRLEITTSFNFSLPN

SEQ ID NO: 2695916 - protein, 18 aa, Entamoeba histolytica
SLTRLELGSAREFTPELS

SEQ ID NO: 2695917 - protein, 26 aa, Entamoeba histolytica
SLTRSIGIYKELKFNKLDLPVENEIY

SEQ ID NO: 2695918 - protein, 25 aa, Entamoeba histolytica
SLTSKIENYWGYFPLKEGFGTPQLF

SEQ ID NO: 2695919 - protein, 24 aa, Entamoeba histolytica
SLTSLLRFLSSFTRGLPKEYNEFT

SEQ ID NO: 2695920 - protein, 17 aa, Entamoeba histolytica
SLTSLSCHDYSLKQLLL

SEQ ID NO: 2695921 - protein, 18 aa, Entamoeba histolytica
SLTSMGDFCFSRCDNLTT

SEQ ID NO: 2695922 - protein, 19 aa, Entamoeba histolytica
SLVKSCYGSDIMFDVTELA

SEQ ID NO: 2695923 - protein, 26 aa, Entamoeba histolytica
SLVNVAFDFPISTLFLQELTYKASNL

SEQ ID NO: 2695924 - protein, 20 aa, Entamoeba histolytica
SLVSMVFGKRCHFIKSLGDG

SEQ ID NO: 2695925 - protein, 23 aa, Entamoeba histolytica
SLVSRLLWQFLMKIKDDMEKVEN

SEQ ID NO: 2695926 - protein, 17 aa, Entamoeba histolytica
SLYCISFIGELNKKIKE

SEQ ID NO: 2695927 - protein, 18 aa, Entamoeba histolytica
SLYFSRRSLEGVFRISTD

SEQ ID NO: 2695928 - protein, 33 aa, Entamoeba histolytica
SLYKNCNFVFERKECFNYLFAQMREGIQWIIQN

SEQ ID NO: 2695929 - protein, 18 aa, Entamoeba histolytica
SLYNCFYLQSIVLPQELI

SEQ ID NO: 2695930 - protein, 26 aa, Entamoeba histolytica
SLYPHLLEYYALWFSRLFTGDLGIWI

SEQ ID NO: 2695931 - protein, 27 aa, Entamoeba histolytica
SLYPSAMKRLLIPTGYPKMITQSIQFI

SEQ ID NO: 2695932 - protein, 20 aa, Entamoeba histolytica
SLYPTIPIICATSNQEEEDV

SEQ ID NO: 2695933 - protein, 22 aa, Entamoeba histolytica
SLYSMPIYLIVTLKRFIQNGDK

SEQ ID NO: 2695934 - protein, 28 aa, Entamoeba histolytica
SLYTQPIVFPSVFFFNGAGLQKVLIKNE

SEQ ID NO: 2695935 - protein, 28 aa, Entamoeba histolytica
SMCTLEFLPRRESYFWLLDALDMYKPVV

SEQ ID NO: 2695936 - protein, 28 aa, Entamoeba histolytica
SMDFFIDIQHRLRIAKQMCIDGKPLSSI

SEQ ID NO: 2695937 - protein, 23 aa, Entamoeba histolytica
SMDISKLTKYRVIEPLGQGTFGQ

SEQ ID NO: 2695938 - protein, 19 aa, Entamoeba histolytica
SMDPDLFKKVIGRMKIDSY

SEQ ID NO: 2695939 - protein, 22 aa, Entamoeba histolytica
SMFEHFCYRATAQISIAAKALQ

SEQ ID NO: 2695940 - protein, 20 aa, Entamoeba histolytica
SMGIKRQKASMVRALNPPSQ

SEQ ID NO: 2695941 - protein, 26 aa, Entamoeba histolytica
SMIYRRNDMTIVFAGLVEGSCLPIIK

SEQ ID NO: 2695942 - protein, 25 aa, Entamoeba histolytica
SMKDIKRITSILISLFLDKPSSAAR

SEQ ID NO: 2695943 - protein, 25 aa, Entamoeba histolytica
SMKDYMKASSFSLVSAKYTAGEFSH

SEQ ID NO: 2695944 - protein, 20 aa, Entamoeba histolytica
SMKLILEGHIKSIDEIDESI

SEQ ID NO: 2695945 - protein, 24 aa, Entamoeba histolytica
SMKQENRCPFNYSYEHNSVFWTIK

SEQ ID NO: 2695946 - protein, 23 aa, Entamoeba histolytica
SMKQRMVSFFLNLLDSMNLAVNF

SEQ ID NO: 2695947 - protein, 22 aa, Entamoeba histolytica
SMKVPHPFGTFYKLQMKQAPEH

SEQ ID NO: 2695948 - protein, 24 aa, Entamoeba histolytica
SMLLKIIQKLPICYQDELYYKKII

SEQ ID NO: 2695949 - protein, 18 aa, Entamoeba histolytica
SMLNRWKLMQNDQEIGNL

SEQ ID NO: 2695950 - protein, 19 aa, Entamoeba histolytica
SMLPEGWITGNSHNETYYI

SEQ ID NO: 2695951 - protein, 17 aa, Entamoeba histolytica
SMLPIIICTPFISSVQC

SEQ ID NO: 2695952 - protein, 25 aa, Entamoeba histolytica
SMNEEWDLRPLFSQLINSPSIQNSI

SEQ ID NO: 2695953 - protein, 21 aa, Entamoeba histolytica
SMNVELRILVLSSQHEDMLFR

SEQ ID NO: 2695954 - protein, 24 aa, Entamoeba histolytica
SMNVELRILVLSSQHEDMLFRIKF

SEQ ID NO: 2695955 - protein, 21 aa, Entamoeba histolytica
SMPLPRIKISNFVHSISPFQP

SEQ ID NO: 2695956 - protein, 18 aa, Entamoeba histolytica
SMQCSVYSYILIPNEFTL

SEQ ID NO: 2695957 - protein, 17 aa, Entamoeba histolytica
SMQEIYNEQVIDLIDKN

SEQ ID NO: 2695958 - protein, 21 aa, Entamoeba histolytica
SMQKCFLNTFLTLIVANKDGT

SEQ ID NO: 2695959 - protein, 19 aa, Entamoeba histolytica
SMRMAHDLLGVSELLTTED

SEQ ID NO: 2695960 - protein, 20 aa, Entamoeba histolytica
SMRSQARITIWIKTNEYTIL

SEQ ID NO: 2695961 - protein, 25 aa, Entamoeba histolytica
SMSLKGCSIYTFLNNPIIITKWYPF

SEQ ID NO: 2695962 - protein, 18 aa, Entamoeba histolytica
SMTLCLVLLLKNGRNIPW

SEQ ID NO: 2695963 - protein, 23 aa, Entamoeba histolytica
SMTLSFFPPYPFAKQIIINRLSS

SEQ ID NO: 2695964 - protein, 19 aa, Entamoeba histolytica
SMTRVVIFSVITRYLPEHA

SEQ ID NO: 2695965 - protein, 23 aa, Entamoeba histolytica
SMVKTGFENILWGDSTSQDINDE

SEQ ID NO: 2695966 - protein, 25 aa, Entamoeba histolytica
SMVPAKGSTGWVIDRINMFSHLTVF

SEQ ID NO: 2695967 - protein, 19 aa, Entamoeba histolytica
SMYEEYCGMVNKCAVLETE

SEQ ID NO: 2695968 - protein, 19 aa, Entamoeba histolytica
SMYGEGWAAKFKEENDEVD

SEQ ID NO: 2695969 - protein, 21 aa, Entamoeba histolytica
SMYSIRFGTMLYTLEHPNMAC

SEQ ID NO: 2695970 - protein, 18 aa, Entamoeba histolytica
SNAIRLANTFIHAHAVKD

SEQ ID NO: 2695971 - protein, 19 aa, Entamoeba histolytica
SNALLRCIISLQPQLCCFG

SEQ ID NO: 2695972 - protein, 17 aa, Entamoeba histolytica
SNCEVDDLIELLSKRVI

SEQ ID NO: 2695973 - protein, 18 aa, Entamoeba histolytica
SNCITVVRLHYLINNLFI

SEQ ID NO: 2695974 - protein, 19 aa, Entamoeba histolytica
SNCPPKPKHIRTIVVKSFS

SEQ ID NO: 2695975 - protein, 28 aa, Entamoeba histolytica
SNCTVALRFIEKVYKIKPLCSAENIVNG

SEQ ID NO: 2695976 - protein, 25 aa, Entamoeba histolytica
SNDAMKIIEKLGGIKALAKNTNLNN

SEQ ID NO: 2695977 - protein, 17 aa, Entamoeba histolytica
SNDFIPFAINKILNEFP

SEQ ID NO: 2695978 - protein, 24 aa, Entamoeba histolytica
SNDLMKYILAFGFNEDKTFIYTDY

SEQ ID NO: 2695979 - protein, 26 aa, Entamoeba histolytica
SNDWKKDCFYTVLNISVARCIKAFEV

SEQ ID NO: 2695980 - protein, 18 aa, Entamoeba histolytica
SNEALGFPLQLDTTNHPI

SEQ ID NO: 2695981 - protein, 19 aa, Entamoeba histolytica
SNEEMMLWIEGKKELSIPE

SEQ ID NO: 2695982 - protein, 18 aa, Entamoeba histolytica
SNEFFLDSHFHQIEELFI

SEQ ID NO: 2695983 - protein, 23 aa, Entamoeba histolytica
SNEGFTGDILWAILRIVNSVAFI

SEQ ID NO: 2695984 - protein, 18 aa, Entamoeba histolytica
SNEINLIKIHGWSTTLVN

SEQ ID NO: 2695985 - protein, 26 aa, Entamoeba histolytica
SNEIPSGCLPRSIDVILRGENVEQVR

SEQ ID NO: 2695986 - protein, 19 aa, Entamoeba histolytica
SNEKIVFSPHIGWATIEAR

SEQ ID NO: 2695987 - protein, 24 aa, Entamoeba histolytica
SNEKPKIVGIAFTFNIHQTSIGLV

SEQ ID NO: 2695988 - protein, 27 aa, Entamoeba histolytica
SNELFKEYACSFVIILGAVSYKDSESI

SEQ ID NO: 2695989 - protein, 20 aa, Entamoeba histolytica
SNELVLYRGLHFAAELGESI

SEQ ID NO: 2695990 - protein, 22 aa, Entamoeba histolytica
SNESSVLKSCCESLFTTIQSLS

SEQ ID NO: 2695991 - protein, 24 aa, Entamoeba histolytica
SNEVPIIYCVKDVFDVKKPEEVYN

SEQ ID NO: 2695992 - protein, 18 aa, Entamoeba histolytica
SNEWSRKYVIEILSHQSF

SEQ ID NO: 2695993 - protein, 18 aa, Entamoeba histolytica
SNEYGGVLFNLLVKPDGL

SEQ ID NO: 2695994 - protein, 23 aa, Entamoeba histolytica
SNFDHWDCLILLITIETIVFSLL

SEQ ID NO: 2695995 - protein, 18 aa, Entamoeba histolytica
SNFHISMKKFEFKKPNLM

SEQ ID NO: 2695996 - protein, 25 aa, Entamoeba histolytica
SNFKLSLKIGPSILNLVIQGGETYF

SEQ ID NO: 2695997 - protein, 23 aa, Entamoeba histolytica
SNFKRFFNLEGEYEKEIFPYNYY

SEQ ID NO: 2695998 - protein, 31 aa, Entamoeba histolytica
SNFNIKFYSCISWSIHCCIMAFEKASRYEQR

SEQ ID NO: 2695999 - protein, 24 aa, Entamoeba histolytica
SNFPEFTNGALISLDISCNRLTSI

SEQ ID NO: 2696000 - protein, 17 aa, Entamoeba histolytica
SNFPGQMPFSTRQQLPP

SEQ ID NO: 2696001 - protein, 17 aa, Entamoeba histolytica
SNFRLLEKYGNFYDDDY

SEQ ID NO: 2696002 - protein, 18 aa, Entamoeba histolytica
SNFTRLIVQLANIINNPQ

SEQ ID NO: 2696003 - protein, 24 aa, Entamoeba histolytica
SNFYMWQFAGEIALQLNAVKEARK

SEQ ID NO: 2696004 - protein, 19 aa, Entamoeba histolytica
SNGFEIPSIEGISLEVENP

SEQ ID NO: 2696005 - protein, 18 aa, Entamoeba histolytica
SNGFNFNLTGLFGSSTPS

SEQ ID NO: 2696006 - protein, 21 aa, Entamoeba histolytica
SNGHISKAFIVYDRLRKLQLF

SEQ ID NO: 2696007 - protein, 25 aa, Entamoeba histolytica
SNGHIWTIRCCVLPRLTRWWYEVKQ

SEQ ID NO: 2696008 - protein, 26 aa, Entamoeba histolytica
SNGMNPRQEWSLKVGQIVKNVAETIW

SEQ ID NO: 2696009 - protein, 21 aa, Entamoeba histolytica
SNGPVTWVLAEKRFIVYSQGK

SEQ ID NO: 2696010 - protein, 24 aa, Entamoeba histolytica
SNHELKRYLSFIKFNPWTYCGDML

SEQ ID NO: 2696011 - protein, 23 aa, Entamoeba histolytica
SNHRESRIYNRYCCFNLYWFIDT

SEQ ID NO: 2696012 - protein, 19 aa, Entamoeba histolytica
SNIEILKNTYLHSSTPLND

SEQ ID NO: 2696013 - protein, 17 aa, Entamoeba histolytica
SNIFLKWKHKGNKIMWL

SEQ ID NO: 2696014 - protein, 24 aa, Entamoeba histolytica
SNIGIIVQCCVRLLPKESITIIIN

SEQ ID NO: 2696015 - protein, 18 aa, Entamoeba histolytica
SNIIIRIVEMMGGDVSKM

SEQ ID NO: 2696016 - protein, 17 aa, Entamoeba histolytica
SNIILKSFCNIFNNKHV

SEQ ID NO: 2696017 - protein, 17 aa, Entamoeba histolytica
SNIKRRYCSDASDHIAT

SEQ ID NO: 2696018 - protein, 17 aa, Entamoeba histolytica
SNIKRWYYLHPIEHQRT

SEQ ID NO: 2696019 - protein, 24 aa, Entamoeba histolytica
SNILDAICFVMGIQNLSLVRVQTL

SEQ ID NO: 2696020 - protein, 25 aa, Entamoeba histolytica
SNILLKVKLPPLLLKLNSITLSSYN

SEQ ID NO: 2696021 - protein, 18 aa, Entamoeba histolytica
SNILRKIMNNIYYEVISL

SEQ ID NO: 2696022 - protein, 17 aa, Entamoeba histolytica
SNIPIDWQEPTPGQITE

SEQ ID NO: 2696023 - protein, 19 aa, Entamoeba histolytica
SNIPIKYTIEQFVDYFRHC

SEQ ID NO: 2696024 - protein, 20 aa, Entamoeba histolytica
SNIPRELRALMTNKKQSYVN

SEQ ID NO: 2696025 - protein, 28 aa, Entamoeba histolytica
SNIQLIDCRFPYEFAGGRIHGAINIWNE

SEQ ID NO: 2696026 - protein, 25 aa, Entamoeba histolytica
SNIWLFCFPDGLRLSEFPIEAELKP

SEQ ID NO: 2696027 - protein, 22 aa, Entamoeba histolytica
SNKCLICKQIFINTEKFKKHLE

SEQ ID NO: 2696028 - protein, 23 aa, Entamoeba histolytica
SNKFVLQCLLSLLTELSTILVKE

SEQ ID NO: 2696029 - protein, 28 aa, Entamoeba histolytica
SNKGCACLRSAAKVPILVNMTVKDRFTG

SEQ ID NO: 2696030 - protein, 20 aa, Entamoeba histolytica
SNKGRPILPNTFEKGVIKKG

SEQ ID NO: 2696031 - protein, 26 aa, Entamoeba histolytica
SNKIMVWECSLIKKVFIALIATTIAV

SEQ ID NO: 2696032 - protein, 26 aa, Entamoeba histolytica
SNKISILPSHLFKITSLKKLILSQNI

SEQ ID NO: 2696033 - protein, 18 aa, Entamoeba histolytica
SNKKGCVIWSVKYPTLCM

SEQ ID NO: 2696034 - protein, 27 aa, Entamoeba histolytica
SNKMILDKFAFCLYEEPSFEEFMKEQI

SEQ ID NO: 2696035 - protein, 19 aa, Entamoeba histolytica
SNKPKGEWINMKNQIENVD

SEQ ID NO: 2696036 - protein, 20 aa, Entamoeba histolytica
SNKVFNHFCEAAIKFAPTFK

SEQ ID NO: 2696037 - protein, 20 aa, Entamoeba histolytica
SNKVSHLFKIITMEKQGELI

SEQ ID NO: 2696038 - protein, 17 aa, Entamoeba histolytica
SNKWIPVYVQLYNSECL

SEQ ID NO: 2696039 - protein, 18 aa, Entamoeba histolytica
SNLIDVLKILPTKKVVAC

SEQ ID NO: 2696040 - protein, 17 aa, Entamoeba histolytica
SNLKSIYSYCGSKINVS

SEQ ID NO: 2696041 - protein, 24 aa, Entamoeba histolytica
SNLLFSSKMLNHFLNSEDESSGSN

SEQ ID NO: 2696042 - protein, 19 aa, Entamoeba histolytica
SNLLKRETFETLNESNVLI

SEQ ID NO: 2696043 - protein, 24 aa, Entamoeba histolytica
SNLLRCFRTLGLFAGNQPAACCSV

SEQ ID NO: 2696044 - protein, 21 aa, Entamoeba histolytica
SNLMDAISFVLGVKVGLLRGS

SEQ ID NO: 2696045 - protein, 18 aa, Entamoeba histolytica
SNLPYLRINLLVRPVPPK

SEQ ID NO: 2696046 - protein, 19 aa, Entamoeba histolytica
SNLQHLISFTFSASLSNPT

SEQ ID NO: 2696047 - protein, 19 aa, Entamoeba histolytica
SNLRSRRIVFNSPTQVNYI

SEQ ID NO: 2696048 - protein, 24 aa, Entamoeba histolytica
SNLSEIMKSLALIIGNLKGDEMAL

SEQ ID NO: 2696049 - protein, 18 aa, Entamoeba histolytica
SNLSICFAPSIITSPDIN

SEQ ID NO: 2696050 - protein, 24 aa, Entamoeba histolytica
SNLSKINFYYCNRIRSFKIPTKIT

SEQ ID NO: 2696051 - protein, 21 aa, Entamoeba histolytica
SNLSSAPRFLNLVYVSIPTTV

SEQ ID NO: 2696052 - protein, 18 aa, Entamoeba histolytica
SNLTIIDTPGFRLGGDET

SEQ ID NO: 2696053 - protein, 19 aa, Entamoeba histolytica
SNMILHQMVLLCIKDIFAI

SEQ ID NO: 2696054 - protein, 19 aa, Entamoeba histolytica
SNMKRELLARHGVGEHEIK

SEQ ID NO: 2696055 - protein, 24 aa, Entamoeba histolytica
SNNFFKRYVIQELIGRGSFGQVRK

SEQ ID NO: 2696056 - protein, 18 aa, Entamoeba histolytica
SNNFPVTFQNDFSQFSTF

SEQ ID NO: 2696057 - protein, 19 aa, Entamoeba histolytica
SNNKILIERCLSIDEENVI

SEQ ID NO: 2696058 - protein, 23 aa, Entamoeba histolytica
SNNKRLGGVYFDLYSRKGKKAGG

SEQ ID NO: 2696059 - protein, 19 aa, Entamoeba histolytica
SNNLHFFIGVYEFFILQHL

SEQ ID NO: 2696060 - protein, 18 aa, Entamoeba histolytica
SNNLSFEKEGLKQVNEEV

SEQ ID NO: 2696061 - protein, 25 aa, Entamoeba histolytica
SNNSACFACTRFLIENYKEVFDIVH

SEQ ID NO: 2696062 - protein, 23 aa, Entamoeba histolytica
SNNSCYECINAIKRKQEKKEVEN

SEQ ID NO: 2696063 - protein, 22 aa, Entamoeba histolytica
SNNVFAYKWIVLLFKRYISDNY

SEQ ID NO: 2696064 - protein, 27 aa, Entamoeba histolytica
SNPELFKVLKMIIGSSFTDEQLQQVVD

SEQ ID NO: 2696065 - protein, 30 aa, Entamoeba histolytica
SNPIFKLSAIRLIAELQLSIGKERSDVVIP

SEQ ID NO: 2696066 - protein, 18 aa, Entamoeba histolytica
SNPRILNENVLKRFRTLK

SEQ ID NO: 2696067 - protein, 30 aa, Entamoeba histolytica
SNPTFKSQVYTFVWCKQVSTFFNSPHPEEF

SEQ ID NO: 2696068 - protein, 23 aa, Entamoeba histolytica
SNQEELRIAYGIYQNTLLELLKF

SEQ ID NO: 2696069 - protein, 18 aa, Entamoeba histolytica
SNQFYSGELIDGRDESIL

SEQ ID NO: 2696070 - protein, 21 aa, Entamoeba histolytica
SNQIFPLLMIWSEFGDSSVQL

SEQ ID NO: 2696071 - protein, 19 aa, Entamoeba histolytica
SNQLKDRFIEIIRVLSQAE

SEQ ID NO: 2696072 - protein, 18 aa, Entamoeba histolytica
SNQSNWFINGRTASHKEV

SEQ ID NO: 2696073 - protein, 20 aa, Entamoeba histolytica
SNQWFWTEIEKFSYYQTNFT

SEQ ID NO: 2696074 - protein, 20 aa, Entamoeba histolytica
SNRKVDAFTLPTMFDSKSCY

SEQ ID NO: 2696075 - protein, 19 aa, Entamoeba histolytica
SNSADLFWSNKQPATQQQP

SEQ ID NO: 2696076 - protein, 17 aa, Entamoeba histolytica
SNSFSQFLIAKLINAER

SEQ ID NO: 2696077 - protein, 18 aa, Entamoeba histolytica
SNSFTFSKPQQWKLIDNI

SEQ ID NO: 2696078 - protein, 19 aa, Entamoeba histolytica
SNSILQIANSLFFVSINQP

SEQ ID NO: 2696079 - protein, 18 aa, Entamoeba histolytica
SNSITCYETLLPDFGPNQ

SEQ ID NO: 2696080 - protein, 17 aa, Entamoeba histolytica
SNTIALLKDELQTIEKR

SEQ ID NO: 2696081 - protein, 20 aa, Entamoeba histolytica
SNTIKLIFMKLLNEITEWGY

SEQ ID NO: 2696082 - protein, 24 aa, Entamoeba histolytica
SNTILSNIKMCLGSDLLGVVEASL

SEQ ID NO: 2696083 - protein, 29 aa, Entamoeba histolytica
SNTLDYISLFLLTCVTTLIGESTKFLKNV

SEQ ID NO: 2696084 - protein, 24 aa, Entamoeba histolytica
SNTPVKCLRWHKNASNIFISLFGN

SEQ ID NO: 2696085 - protein, 20 aa, Entamoeba histolytica
SNTSKLWNYVSFYAKEASVY

SEQ ID NO: 2696086 - protein, 39 aa, Entamoeba histolytica; identical to SEQ ID NO: 2504980

SEQ ID NO: 2696087 - protein, 20 aa, Entamoeba histolytica
SNTVLICIEQGFISTIFNKI

SEQ ID NO: 2696088 - protein, 17 aa, Entamoeba histolytica
SNTWTVDSFKMYLNNVF

SEQ ID NO: 2696089 - protein, 28 aa, Entamoeba histolytica
SNVAIKKMIEWGRGLKLINTEEINKLVS

SEQ ID NO: 2696090 - protein, 28 aa, Entamoeba histolytica
SNVDLGTACGRYFAVSVLSIIDGGDSDI

SEQ ID NO: 2696091 - protein, 26 aa, Entamoeba histolytica
SNVDLGTACGRYFSVSVLSIIDGGDS

SEQ ID NO: 2696092 - protein, 25 aa, Entamoeba histolytica
SNVKSWKKRWFVFTTDGNISYYTNR

SEQ ID NO: 2696093 - protein, 20 aa, Entamoeba histolytica
SNVSIFFIKTTFCFIQTIGI

SEQ ID NO: 2696094 - protein, 25 aa, Entamoeba histolytica
SNVSNKCFFATYLKREAPHLKVYHD

SEQ ID NO: 2696095 - protein, 19 aa, Entamoeba histolytica
SNVTLMFQQLVDLMLKNKI

SEQ ID NO: 2696096 - protein, 23 aa, Entamoeba histolytica
SNWRIAEGSLHILTCLHQNMNET

SEQ ID NO: 2696097 - protein, 24 aa, Entamoeba histolytica
SNYFRNAMGGVIMFDVSNRQSFEN

SEQ ID NO: 2696098 - protein, 18 aa, Entamoeba histolytica
SNYHLRVPNSMYYIKVSQ

SEQ ID NO: 2696099 - protein, 29 aa, Entamoeba histolytica
SNYKATVDPCRFMGCGPSSSTTSGYRRPG

SEQ ID NO: 2696100 - protein, 24 aa, Entamoeba histolytica
SNYNFERPFLWIARKLTGNPNLVF

SEQ ID NO: 2696101 - protein, 17 aa, Entamoeba histolytica
SNYPGTLPIQMGGIENK

SEQ ID NO: 2696102 - protein, 25 aa, Entamoeba histolytica
SNYPKLPILFVWMGDLFHTNELPVM

SEQ ID NO: 2696103 - protein, 25 aa, Entamoeba histolytica
SPAYKEFVEGLGWTIDIETHSGFVG

SEQ ID NO: 2696104 - protein, 25 aa, Entamoeba histolytica
SPAYKEFVEGLGWTLDIKTHSGFLG

SEQ ID NO: 2696105 - protein, 22 aa, Entamoeba histolytica
SPCAFLLFKEMILFMRAFVEQN

SEQ ID NO: 2696106 - protein, 20 aa, Entamoeba histolytica
SPCGCSDTILFKEIDEQIKS

SEQ ID NO: 2696107 - protein, 18 aa, Entamoeba histolytica
SPCLPESEASFAITTNGI

SEQ ID NO: 2696108 - protein, 18 aa, Entamoeba histolytica
SPDFKWLVSGSEDCSVRL

SEQ ID NO: 2696109 - protein, 28 aa, Entamoeba histolytica
SPDFSDLFFRRTFFYSFPSFAKAKEVVD

SEQ ID NO: 2696110 - protein, 26 aa, Entamoeba histolytica
SPDIAFNAILFVGRFAELEIPEFQPL

SEQ ID NO: 2696111 - protein, 24 aa, Entamoeba histolytica
SPDKRPRFRDCFKSLTEIYDSLQE

SEQ ID NO: 2696112 - protein, 26 aa, Entamoeba histolytica
SPDLLYIYLRNGRICVHINSTLTASS

SEQ ID NO: 2696113 - protein, 19 aa, Entamoeba histolytica
SPDVKEWVAKDVYETFICT

SEQ ID NO: 2696114 - protein, 25 aa, Entamoeba histolytica
SPEDKEKYLYVSRMLLYHRNIPLNE

SEQ ID NO: 2696115 - protein, 17 aa, Entamoeba histolytica
SPELFKTLKPLETKKPL

SEQ ID NO: 2696116 - protein, 20 aa, Entamoeba histolytica
SPESQGLLSLHFSNEQETMR

SEQ ID NO: 2696117 - protein, 24 aa, Entamoeba histolytica
SPEWKLKLRQAGIRKKDLQDETTR

SEQ ID NO: 2696118 - protein, 22 aa, Entamoeba histolytica
SPEYCLTCLYSPNVYNQNGLAF

SEQ ID NO: 2696119 - protein, 20 aa, Entamoeba histolytica
SPFDIKTFLWKDHPFQLPEF

SEQ ID NO: 2696120 - protein, 17 aa, Entamoeba histolytica
SPFILGELFCYFNKTTI

SEQ ID NO: 2696121 - protein, 24 aa, Entamoeba histolytica
SPFILTVFSAFWILSDGTCSIHQG

SEQ ID NO: 2696122 - protein, 17 aa, Entamoeba histolytica
SPFKEYSFHPIITTIPI

SEQ ID NO: 2696123 - protein, 23 aa, Entamoeba histolytica
SPFKLDLEVVKQLLVTASSCGSR

SEQ ID NO: 2696124 - protein, 19 aa, Entamoeba histolytica
SPFLRKCIGNSFYNKHLID

SEQ ID NO: 2696125 - protein, 18 aa, Entamoeba histolytica
SPFPPYLDSGVYRMDLKF

SEQ ID NO: 2696126 - protein, 18 aa, Entamoeba histolytica
SPFVLEIREIAKIQRNLI

SEQ ID NO: 2696127 - protein, 21 aa, Entamoeba histolytica
SPGKCYRLYTKDAFTKELPES

SEQ ID NO: 2696128 - protein, 23 aa, Entamoeba histolytica
SPHFPSSLQFLSCRYSNSLKFPP

SEQ ID NO: 2696129 - protein, 18 aa, Entamoeba histolytica
SPHLIPIVESGIGIGSET

SEQ ID NO: 2696130 - protein, 24 aa, Entamoeba histolytica
SPHLKSLIIKSCQASIDISKCHLK

SEQ ID NO: 2696131 - protein, 19 aa, Entamoeba histolytica
SPIAIQCGLLLSPNSNQYI

SEQ ID NO: 2696132 - protein, 31 aa, Entamoeba histolytica
SPICLHFALGKCFKGKECLYKHQLPQEEEEK

SEQ ID NO: 2696133 - protein, 17 aa, Entamoeba histolytica
SPIFHFLLPFLTSTTKE

SEQ ID NO: 2696134 - protein, 19 aa, Entamoeba histolytica
SPIGSPRLSDVVQQKIDER

SEQ ID NO: 2696135 - protein, 18 aa, Entamoeba histolytica
SPILEREPEEKIKMKEQI

SEQ ID NO: 2696136 - protein, 17 aa, Entamoeba histolytica
SPILLRVNYKGCIVIGY

SEQ ID NO: 2696137 - protein, 21 aa, Entamoeba histolytica
SPINDKWGFPKPFFSNDQEFN

SEQ ID NO: 2696138 - protein, 24 aa, Entamoeba histolytica
SPINSCWNCQIFLEDLSDEVVDKL

SEQ ID NO: 2696139 - protein, 18 aa, Entamoeba histolytica
SPIPASVVLAHFDNPIED

SEQ ID NO: 2696140 - protein, 19 aa, Entamoeba histolytica
SPIPHYYFLLRILREQENT

SEQ ID NO: 2696141 - protein, 30 aa, Entamoeba histolytica
SPIRMKVMGFIRSWVNWRFSDFDDIDMRTT

SEQ ID NO: 2696142 - protein, 23 aa, Entamoeba histolytica
SPIRRYADVMVHRLLAQAIGFDQ

SEQ ID NO: 2696143 - protein, 20 aa, Entamoeba histolytica
SPISAFSMPAPKQVYSPLLV

SEQ ID NO: 2696144 - protein, 23 aa, Entamoeba histolytica
SPISVKTLNYFGAKFTQTAQNMK

SEQ ID NO: 2696145 - protein, 20 aa, Entamoeba histolytica
SPKGNEPPAKVEGNSLQSKQ

SEQ ID NO: 2696146 - protein, 30 aa, Entamoeba histolytica
SPKIPGKYFIKYMRNIPMYFQWFTQQKQID

SEQ ID NO: 2696147 - protein, 18 aa, Entamoeba histolytica
SPKKTSFLIGKKTSKLNE

SEQ ID NO: 2696148 - protein, 23 aa, Entamoeba histolytica
SPKLSLPLHFMVASGMVDSQMVM

SEQ ID NO: 2696149 - protein, 22 aa, Entamoeba histolytica
SPKNSIGICVGFAAAQCALEIE

SEQ ID NO: 2696150 - protein, 27 aa, Entamoeba histolytica
SPKRIDDAFALPYGRYNVEVTQLINVV

SEQ ID NO: 2696151 - protein, 18 aa, Entamoeba histolytica
SPKYSYKSDAWSVGCVLY

SEQ ID NO: 2696152 - protein, 20 aa, Entamoeba histolytica
SPLEAFSIFIGSSNKTINST

SEQ ID NO: 2696153 - protein, 23 aa, Entamoeba histolytica
SPLIPCVIEDNILKEESKKKESI

SEQ ID NO: 2696154 - protein, 22 aa, Entamoeba histolytica
SPLKQRRLRNLTFASRDELSSG

SEQ ID NO: 2696155 - protein, 35 aa, Entamoeba histolytica
SPLLLFKAWMLRWWKIMYLRLLDLQKWKVIYGLYH

SEQ ID NO: 2696156 - protein, 25 aa, Entamoeba histolytica
SPLLQTLFKMMFIRNPVQRADIFQV

SEQ ID NO: 2696157 - protein, 24 aa, Entamoeba histolytica
SPLNKCCSCVSILSNITQLNQKKI

SEQ ID NO: 2696158 - protein, 26 aa, Entamoeba histolytica
SPLQGLKLEGEFLIFTKRQFKRTRDG

SEQ ID NO: 2696159 - protein, 19 aa, Entamoeba histolytica
SPLYPKLPLVAGRHGLDYK

SEQ ID NO: 2696160 - protein, 24 aa, Entamoeba histolytica
SPMKRSWRKSRIQSAIIDLPKLQQ

SEQ ID NO: 2696161 - protein, 20 aa, Entamoeba histolytica
SPNECSSGWSSSYSSNQSSP

SEQ ID NO: 2696162 - protein, 26 aa, Entamoeba histolytica
SPNFIPTVIVALVFNYLYPKETTEFR

SEQ ID NO: 2696163 - protein, 18 aa, Entamoeba histolytica
SPNKLIVIMGTNYGDIYS

SEQ ID NO: 2696164 - protein, 20 aa, Entamoeba histolytica
SPNPCMWDLVAYRIKFFPHP

SEQ ID NO: 2696165 - protein, 24 aa, Entamoeba histolytica
SPNQFKLLLDFVKTFFSSDQSNEE

SEQ ID NO: 2696166 - protein, 19 aa, Entamoeba histolytica
SPNTIILCKMLLKKKYDNS

SEQ ID NO: 2696167 - protein, 24 aa, Entamoeba histolytica
SPPCDLKHISICVIDEEIFLGCSN

SEQ ID NO: 2696168 - protein, 25 aa, Entamoeba histolytica
SPPFTKLRLFFTCFDHIIEGMTGFF

SEQ ID NO: 2696169 - protein, 24 aa, Entamoeba histolytica
SPPLFYQICNGIRPLPNVKTPYSQ

SEQ ID NO: 2696170 - protein, 22 aa, Entamoeba histolytica
SPPQVRYCYAFDYYMKVFNNTI

SEQ ID NO: 2696171 - protein, 30 aa, Entamoeba histolytica
SPQSNSLICWSEPLKGTAICVNNPVQFAQE

SEQ ID NO: 2696172 - protein, 18 aa, Entamoeba histolytica
SPRGCIEIDCPDKVIIKG

SEQ ID NO: 2696173 - protein, 20 aa, Entamoeba histolytica
SPRNRILAVIIINKLFTIDQ

SEQ ID NO: 2696174 - protein, 20 aa, Entamoeba histolytica
SPRYCLVAGIDNISFSQLDM

SEQ ID NO: 2696175 - protein, 24 aa, Entamoeba histolytica
SPSLLFCYCDKLLKRDSSSFKINS

SEQ ID NO: 2696176 - protein, 18 aa, Entamoeba histolytica
SPSPYARPPVYSQGTYSS

SEQ ID NO: 2696177 - protein, 18 aa, Entamoeba histolytica
SPSSFKPKLTISVNNSKG

SEQ ID NO: 2696178 - protein, 25 aa, Entamoeba histolytica
SPSSKLKLSFIIRMSKKLPYVKQML

SEQ ID NO: 2696179 - protein, 18 aa, Entamoeba histolytica
SPTEFQPVLSALRTNKYF

SEQ ID NO: 2696180 - protein, 25 aa, Entamoeba histolytica
SPTIDLSIRQACIFEYDVVGNKEQP

SEQ ID NO: 2696181 - protein, 17 aa, Entamoeba histolytica
SPTSPIISPRQKFTPRA

SEQ ID NO: 2696182 - protein, 17 aa, Entamoeba histolytica
SPVLKRNEIEPISLQET

SEQ ID NO: 2696183 - protein, 29 aa, Entamoeba histolytica
SPVVIKGVPLYRVCVCCKSAVQGFLPHFP

SEQ ID NO: 2696184 - protein, 18 aa, Entamoeba histolytica
SPVYCGSLFRIDDIILRI

SEQ ID NO: 2696185 - protein, 17 aa, Entamoeba histolytica
SPWIFWFESGKDSDRST

SEQ ID NO: 2696186 - protein, 29 aa, Entamoeba histolytica
SPYLDAIRIGMCFFWHSKVDLPFRVVIIG

SEQ ID NO: 2696187 - protein, 24 aa, Entamoeba histolytica
SPYMFDILSTLAFPDTESNPCYFV

SEQ ID NO: 2696188 - protein, 19 aa, Entamoeba histolytica
SPYRRTTWQGLPLAQLPKR

SEQ ID NO: 2696189 - protein, 23 aa, Entamoeba histolytica
SPYTRRLKLFWIAEKYFYQKKRE

SEQ ID NO: 2696190 - protein, 18 aa, Entamoeba histolytica
SQALFDFESESPFNSNSQ

SEQ ID NO: 2696191 - protein, 19 aa, Entamoeba histolytica
SQALSQWCDDFIGFFTINS

SEQ ID NO: 2696192 - protein, 19 aa, Entamoeba histolytica
SQASGFCYINDIVCAILEL

SEQ ID NO: 2696193 - protein, 18 aa, Entamoeba histolytica
SQCLENGIDPSLELIRIE

SEQ ID NO: 2696194 - protein, 19 aa, Entamoeba histolytica
SQCNEIWICRGDMGVQLGF

SEQ ID NO: 2696195 - protein, 23 aa, Entamoeba histolytica
SQDMCSPALFISKMDDYEIAKQL

SEQ ID NO: 2696196 - protein, 24 aa, Entamoeba histolytica
SQEFKKLFESYSICFLNGEDLTTS

SEQ ID NO: 2696197 - protein, 23 aa, Entamoeba histolytica
SQEFKSQLFLFFNNFFSKDSEAK

SEQ ID NO: 2696198 - protein, 19 aa, Entamoeba histolytica
SQEGVVPPVYDKLSIIGFY

SEQ ID NO: 2696199 - protein, 24 aa, Entamoeba histolytica
SQETSLRLLLRMIKILQFIHKEGI

SEQ ID NO: 2696200 - protein, 26 aa, Entamoeba histolytica
SQEVKELYKLFPTLFTYWISFYEFRK

SEQ ID NO: 2696201 - protein, 24 aa, Entamoeba histolytica
SQFHFLKKCRIEMEIKESWKKCFG

SEQ ID NO: 2696202 - protein, 19 aa, Entamoeba histolytica
SQFIRQCYKYRIKSQTISD

SEQ ID NO: 2696203 - protein, 17 aa, Entamoeba histolytica
SQFISVLCIGCKYQYSM

SEQ ID NO: 2696204 - protein, 24 aa, Entamoeba histolytica
SQFIVPQCRSIVGCSIHKDFCVCA

SEQ ID NO: 2696205 - protein, 22 aa, Entamoeba histolytica
SQFKNELPFIITQFKNEVLDAF

SEQ ID NO: 2696206 - protein, 23 aa, Entamoeba histolytica
SQFKQSAFELLLFIQELQKNGFD

SEQ ID NO: 2696207 - protein, 19 aa, Entamoeba histolytica
SQFSISVIETARFVIEEDT

SEQ ID NO: 2696208 - protein, 20 aa, Entamoeba histolytica
SQFWSYRWNFLLMASEGYII

SEQ ID NO: 2696209 - protein, 26 aa, Entamoeba histolytica
SQFYITYWMMLNWVCFGGDSLTQQMM

SEQ ID NO: 2696210 - protein, 19 aa, Entamoeba histolytica
SQGKFIVLMPIALQLFGKI

SEQ ID NO: 2696211 - protein, 17 aa, Entamoeba histolytica
SQGLLSFDIKDSNKSVN

SEQ ID NO: 2696212 - protein, 19 aa, Entamoeba histolytica
SQGVALSLGDKILMVQKQQ

SEQ ID NO: 2696213 - protein, 21 aa, Entamoeba histolytica
SQGYRNSPAFQVRSTQPQQSQ

SEQ ID NO: 2696214 - protein, 18 aa, Entamoeba histolytica
SQHGFDWNKRDPAYTGAI

SEQ ID NO: 2696215 - protein, 26 aa, Entamoeba histolytica
SQHPLYKIKEIYSFSKHAIRVYDHPD

SEQ ID NO: 2696216 - protein, 24 aa, Entamoeba histolytica
SQIEPKCFIQIEGIFSQPEDSNPN

SEQ ID NO: 2696217 - protein, 25 aa, Entamoeba histolytica
SQILIVCLDLLPSPFINDIPNQLVD

SEQ ID NO: 2696218 - protein, 27 aa, Entamoeba histolytica
SQILKDPKLVLVFKVNTPVDEKWGFAK

SEQ ID NO: 2696219 - protein, 19 aa, Entamoeba histolytica
SQILTRAEMAFVELKSKHH

SEQ ID NO: 2696220 - protein, 22 aa, Entamoeba histolytica
SQIPFSFPSILGLKDIVINDVL

SEQ ID NO: 2696221 - protein, 18 aa, Entamoeba histolytica
SQIPSFIIQTARPIPKLN

SEQ ID NO: 2696222 - protein, 21 aa, Entamoeba histolytica
SQKDCIVCINILEQGIKEKPC

SEQ ID NO: 2696223 - protein, 25 aa, Entamoeba histolytica
SQKERLNNILSFCGFENDDQVEKCK

SEQ ID NO: 2696224 - protein, 23 aa, Entamoeba histolytica
SQKEVKVLISFPAEKYVNGSIFL

SEQ ID NO: 2696225 - protein, 22 aa, Entamoeba histolytica
SQKIFERYYPLILIDDDENQTL

SEQ ID NO: 2696226 - protein, 17 aa, Entamoeba histolytica
SQKLFGFVQNIILTEEN

SEQ ID NO: 2696227 - protein, 18 aa, Entamoeba histolytica
SQKTMIFKPIEDIENEDA

SEQ ID NO: 2696228 - protein, 28 aa, Entamoeba histolytica
SQLAKPLELPQMFSMPFTIEDIQQLIQQ

SEQ ID NO: 2696229 - protein, 18 aa, Entamoeba histolytica
SQLEMKQRVLSLVHQINQ

SEQ ID NO: 2696230 - protein, 17 aa, Entamoeba histolytica
SQLFILLYQRLVENSQK

SEQ ID NO: 2696231 - protein, 18 aa, Entamoeba histolytica
SQLFNGDGLFYLIENDSS

SEQ ID NO: 2696232 - protein, 29 aa, Entamoeba histolytica
SQLIISLLKRFGKHYENWPKGVFQIFSTK

SEQ ID NO: 2696233 - protein, 25 aa, Entamoeba histolytica
SQLIKRLTGSFVELSLHMYGCRVVQ

SEQ ID NO: 2696234 - protein, 20 aa, Entamoeba histolytica
SQLIVFPSGYSILIDAGETA

SEQ ID NO: 2696235 - protein, 22 aa, Entamoeba histolytica
SQLKRRLPKEITFLHTEDMEKE

SEQ ID NO: 2696236 - protein, 17 aa, Entamoeba histolytica
SQLKYGLQNSFDGLVNS

SEQ ID NO: 2696237 - protein, 18 aa, Entamoeba histolytica
SQLLEIYKTWGKNVRPGI

SEQ ID NO: 2696238 - protein, 20 aa, Entamoeba histolytica
SQLLKGLLLKEGAMKISTLI

SEQ ID NO: 2696239 - protein, 17 aa, Entamoeba histolytica
SQLLVLAAACGAQIRLR

SEQ ID NO: 2696240 - protein, 19 aa, Entamoeba histolytica
SQLNPDLTRICFGNSRLSD

SEQ ID NO: 2696241 - protein, 21 aa, Entamoeba histolytica
SQLPMSIHVPALVVVGNEVIP

SEQ ID NO: 2696242 - protein, 34 aa, Entamoeba histolytica
SQLSAEVGDIFYVEKIIGSWAVVVVDQEQFIFPS

SEQ ID NO: 2696243 - protein, 20 aa, Entamoeba histolytica
SQLTMRCFIYPELHQKIINT

SEQ ID NO: 2696244 - protein, 19 aa, Entamoeba histolytica
SQLYFKQIHFDLHHKSFRN

SEQ ID NO: 2696245 - protein, 20 aa, Entamoeba histolytica
SQMFVHFPTRVELFNLVKRS

SEQ ID NO: 2696246 - protein, 22 aa, Entamoeba histolytica
SQMKCPFSISFLVSNQLACVAS

SEQ ID NO: 2696247 - protein, 24 aa, Entamoeba histolytica
SQMLCNYCGRLILRDYCPETLKCI

SEQ ID NO: 2696248 - protein, 24 aa, Entamoeba histolytica
SQNPPLCHRDLKVENVLFKNKKFL

SEQ ID NO: 2696249 - protein, 17 aa, Entamoeba histolytica
SQPCLNLLFIQNKLLNR

SEQ ID NO: 2696250 - protein, 17 aa, Entamoeba histolytica
SQPMFWEVACILQQKTY

SEQ ID NO: 2696251 - protein, 18 aa, Entamoeba histolytica
SQPRNVATDLFLKFIRVL

SEQ ID NO: 2696252 - protein, 23 aa, Entamoeba histolytica
SQQCPRAYVLSGSKSYTAVQLTS

SEQ ID NO: 2696253 - protein, 23 aa, Entamoeba histolytica
SQQFASLFFKCYETQFSSIISAT

SEQ ID NO: 2696254 - protein, 17 aa, Entamoeba histolytica
SQQIFPQLIHLKRLHLY

SEQ ID NO: 2696255 - protein, 21 aa, Entamoeba histolytica
SQQLLPYHSIFLFKTSKEWIS

SEQ ID NO: 2696256 - protein, 22 aa, Entamoeba histolytica
SQRCDWPLLHLYIISNNDNDGL

SEQ ID NO: 2696257 - protein, 19 aa, Entamoeba histolytica
SQRCFLLIVEKEAFFERLI

SEQ ID NO: 2696258 - protein, 23 aa, Entamoeba histolytica
SQRYKQKALMLLKQKKQHEQHRD

SEQ ID NO: 2696259 - protein, 32 aa, Entamoeba histolytica
SQSDIKTRIDFCSRNIITLLFIKYKVIEGLLQ

SEQ ID NO: 2696260 - protein, 17 aa, Entamoeba histolytica
SQSFFLIYPISGETING

SEQ ID NO: 2696261 - protein, 26 aa, Entamoeba histolytica
SQSIKLKKIYSIPCVIANKTFTFQQT

SEQ ID NO: 2696262 - protein, 17 aa, Entamoeba histolytica
SQSLCYCHLLSTDHFPL

SEQ ID NO: 2696263 - protein, 22 aa, Entamoeba histolytica
SQTHKVILGRCLNYEPKNRPLM

SEQ ID NO: 2696264 - protein, 22 aa, Entamoeba histolytica
SQTIYCEICFKVPIENPSKCEF

SEQ ID NO: 2696265 - protein, 17 aa, Entamoeba histolytica
SQTLKWVFVGGKGGVGK

SEQ ID NO: 2696266 - protein, 17 aa, Entamoeba histolytica
SQTMSFAGLIIISTELL

SEQ ID NO: 2696267 - protein, 17 aa, Entamoeba histolytica
SQVEIVYGFFHNDFDKT

SEQ ID NO: 2696268 - protein, 25 aa, Entamoeba histolytica
SQVKVLCIGYCLSILAIIPATNVKS

SEQ ID NO: 2696269 - protein, 17 aa, Entamoeba histolytica
SQVPIAPQLRVQFSNNI

SEQ ID NO: 2696270 - protein, 26 aa, Entamoeba histolytica
SQWGPGRPGWHIECSAMASNVFGDTL

SEQ ID NO: 2696271 - protein, 25 aa, Entamoeba histolytica
SQYFQFPFPICLIDSSQFIVQSMKD

SEQ ID NO: 2696272 - protein, 24 aa, Entamoeba histolytica
SQYICKLPSLNLWNITINPIPLKI

SEQ ID NO: 2696273 - protein, 25 aa, Entamoeba histolytica
SQYKEVIEIFKSCQLPNETDVKEDP

SEQ ID NO: 2696274 - protein, 21 aa, Entamoeba histolytica
SQYLMKYICSLYNVGVERGMR

SEQ ID NO: 2696275 - protein, 18 aa, Entamoeba histolytica
SRAAPRPVKHLVQQTTTA

SEQ ID NO: 2696276 - protein, 21 aa, Entamoeba histolytica
SRAFMKNHFIEILKKLQELGD

SEQ ID NO: 2696277 - protein, 22 aa, Entamoeba histolytica
SRAVLCRGGKAIQLSEDHKPNG

SEQ ID NO: 2696278 - protein, 20 aa, Entamoeba histolytica
SRCIQCFIQPLSDFLVGTES

SEQ ID NO: 2696279 - protein, 23 aa, Entamoeba histolytica
SRCKQHDMGVCPKHSGCNYLHVL

SEQ ID NO: 2696280 - protein, 20 aa, Entamoeba histolytica
SRCSDYFSLGSMIFEFICGI

SEQ ID NO: 2696281 - protein, 24 aa, Entamoeba histolytica
SRDLLDWLFSLLVHVSLFKDQNKM

SEQ ID NO: 2696282 - protein, 22 aa, Entamoeba histolytica
SRECPEPRKDNRKGGFKRSFNE

SEQ ID NO: 2696283 - protein, 20 aa, Entamoeba histolytica
SREGAIVGKGKFRLSNVEIK

SEQ ID NO: 2696284 - protein, 21 aa, Entamoeba histolytica
SREKIPHYWSYVLQNSGILKK

SEQ ID NO: 2696285 - protein, 17 aa, Entamoeba histolytica
SREKLFLLGALDAIIYA

SEQ ID NO: 2696286 - protein, 19 aa, Entamoeba histolytica
SRENSGMIMSAMGGKTNVR

SEQ ID NO: 2696287 - protein, 19 aa, Entamoeba histolytica
SRFAKALFNRFQQWPPNLY

SEQ ID NO: 2696288 - protein, 23 aa, Entamoeba histolytica
SRFEKMIICWINIMGNAIREECS

SEQ ID NO: 2696289 - protein, 18 aa, Entamoeba histolytica
SRFGNSFHLIREILKMTK

SEQ ID NO: 2696290 - protein, 21 aa, Entamoeba histolytica
SRFKYPWKIAEFVTSGKMLLK

SEQ ID NO: 2696291 - protein, 19 aa, Entamoeba histolytica
SRFLFPDYINLRPFTFTKI

SEQ ID NO: 2696292 - protein, 17 aa, Entamoeba histolytica
SRFNERFVLSLSDNKNS

SEQ ID NO: 2696293 - protein, 17 aa, Entamoeba histolytica
SRFTLLSKLGKGTYGVV

SEQ ID NO: 2696294 - protein, 19 aa, Entamoeba histolytica
SRGAGCMFNALAVQEFNQV

SEQ ID NO: 2696295 - protein, 18 aa, Entamoeba histolytica
SRGKGMSTLSSMWKQLPE

SEQ ID NO: 2696296 - protein, 18 aa, Entamoeba histolytica
SRHLHAMNRQRGEGGRFC

SEQ ID NO: 2696297 - protein, 20 aa, Entamoeba histolytica
SRHRCDFINCVLRFRHREYF

SEQ ID NO: 2696298 - protein, 19 aa, Entamoeba histolytica
SRHSLKHTISPTSSKPTRH

SEQ ID NO: 2696299 - protein, 21 aa, Entamoeba histolytica
SRICRKEFAKFCNYFEQKRDE

SEQ ID NO: 2696300 - protein, 27 aa, Entamoeba histolytica
SRIDAVSLLFVCKKGSPQFMLKYKTNV

SEQ ID NO: 2696301 - protein, 18 aa, Entamoeba histolytica
SRIGRSLELRFNEIKGGY

SEQ ID NO: 2696302 - protein, 17 aa, Entamoeba histolytica
SRIIFRLSGTGSVGATI

SEQ ID NO: 2696303 - protein, 25 aa, Entamoeba histolytica
SRIIREMFELAKSKAPAIIFIDEID

SEQ ID NO: 2696304 - protein, 20 aa, Entamoeba histolytica
SRIKLFRFTKNKKWRKGAVL

SEQ ID NO: 2696305 - protein, 20 aa, Entamoeba histolytica
SRIKSILTGLQFTQKDFERP

SEQ ID NO: 2696306 - protein, 24 aa, Entamoeba histolytica
SRIKWCQIPSHSKPSWEDYCQNEN

SEQ ID NO: 2696307 - protein, 26 aa, Entamoeba histolytica
SRILALIPPWVRVHRIQRDIPIPLVS

SEQ ID NO: 2696308 - protein, 19 aa, Entamoeba histolytica
SRILRSKLESILRSERLSQ

SEQ ID NO: 2696309 - protein, 24 aa, Entamoeba histolytica
SRILVSTDLCGRGIDIEKVNLVVN

SEQ ID NO: 2696310 - protein, 22 aa, Entamoeba histolytica
SRINDFPIIPLQYLFSSASKNY

SEQ ID NO: 2696311 - protein, 17 aa, Entamoeba histolytica
SRIPLSCNTMFQNESQF

SEQ ID NO: 2696312 - protein, 21 aa, Entamoeba histolytica
SRIRDTRMGKTEFVNDLLKDL

SEQ ID NO: 2696313 - protein, 20 aa, Entamoeba histolytica
SRIRLDIMPFAMKRFEEIVK

SEQ ID NO: 2696314 - protein, 19 aa, Entamoeba histolytica
SRIRRLARGSGRDIREVNE

SEQ ID NO: 2696315 - protein, 19 aa, Entamoeba histolytica
SRIWKEFLIDIISNQEKQL

SEQ ID NO: 2696316 - protein, 21 aa, Entamoeba histolytica
SRKCRELVQEWTFKFPNELEE

SEQ ID NO: 2696317 - protein, 22 aa, Entamoeba histolytica
SRKDMHIGFISNTFMKAMSIEK

SEQ ID NO: 2696318 - protein, 24 aa, Entamoeba histolytica
SRKESFEKIPIWLEECRKYSNPNT

SEQ ID NO: 2696319 - protein, 20 aa, Entamoeba histolytica
SRKKVEIIKNAFAVNHQFGS

SEQ ID NO: 2696320 - protein, 20 aa, Entamoeba histolytica
SRKNFYKSPFIVCTYNYILD

SEQ ID NO: 2696321 - protein, 21 aa, Entamoeba histolytica
SRKYWHFIKVMGRSASHIALE

SEQ ID NO: 2696322 - protein, 20 aa, Entamoeba histolytica
SRLADFYEMDKANGIPDHTA

SEQ ID NO: 2696323 - protein, 18 aa, Entamoeba histolytica
SRLCKKNTALLLDCKTHQ

SEQ ID NO: 2696324 - protein, 22 aa, Entamoeba histolytica
SRLDEFPIQFFIANINIIELNP

SEQ ID NO: 2696325 - protein, 25 aa, Entamoeba histolytica
SRLFPRVTPKLVVTIKRFLPNIRSF

SEQ ID NO: 2696326 - protein, 29 aa, Entamoeba histolytica
SRLNKFKILRDIAVGLAFIHSLAKIPHGN

SEQ ID NO: 2696327 - protein, 27 aa, Entamoeba histolytica
SRLPRMKKGLVKFKVTFNVDINGMLSV

SEQ ID NO: 2696328 - protein, 23 aa, Entamoeba histolytica
SRLRYILVVDALNFCFWPTEGFE

SEQ ID NO: 2696329 - protein, 28 aa, Entamoeba histolytica
SRLSKCRCALCRYQQLCEVLTQPPFPHE

SEQ ID NO: 2696330 - protein, 25 aa, Entamoeba histolytica
SRMIFKNNYFRLDPHLPIEVDIADA

SEQ ID NO: 2696331 - protein, 19 aa, Entamoeba histolytica
SRMKKSMIGTVSINENTEQ

SEQ ID NO: 2696332 - protein, 17 aa, Entamoeba histolytica
SRMTIAMLVESMASKVG

SEQ ID NO: 2696333 - protein, 20 aa, Entamoeba histolytica
SRNGLPVNIQYKYENIRFKS

SEQ ID NO: 2696334 - protein, 19 aa, Entamoeba histolytica
SRNGLSYNSLKEFEEMMYG

SEQ ID NO: 2696335 - protein, 18 aa, Entamoeba histolytica
SRNMVCLVYQLLQYFEEL

SEQ ID NO: 2696336 - protein, 29 aa, Entamoeba histolytica
SRNPLNCFFEISHLIAIDLYKYITSQYSM

SEQ ID NO: 2696337 - protein, 38 aa, Entamoeba histolytica
SRPDDIFIRILSICLIKFDSILPSEEWIYSNIPQNLKS

SEQ ID NO: 2696338 - protein, 22 aa, Entamoeba histolytica
SRPFSLKRGLSILSDSTEFSNS

SEQ ID NO: 2696339 - protein, 19 aa, Entamoeba histolytica
SRPIPNNKRRVIIDPLEQL

SEQ ID NO: 2696340 - protein, 20 aa, Entamoeba histolytica
SRPIPNNKRRVIIDPLEQLE

SEQ ID NO: 2696341 - protein, 17 aa, Entamoeba histolytica
SRPKTGFGTPTKKKSRV

SEQ ID NO: 2696342 - protein, 21 aa, Entamoeba histolytica
SRPQMAQILAPLVRSKLLYAH

SEQ ID NO: 2696343 - protein, 34 aa, Entamoeba histolytica
SRPSELYPQMQALRFPIFSSFHNFGIRYCNAKVT

SEQ ID NO: 2696344 - protein, 21 aa, Entamoeba histolytica
SRQEVVSMLPAILLDVHEGSS

SEQ ID NO: 2696345 - protein, 29 aa, Entamoeba histolytica
SRQITLIEWEMFKAIKPPELYAWNKKDKE

SEQ ID NO: 2696346 - protein, 25 aa, Entamoeba histolytica
SRRKEDWHPYLLFCKVKRDSVVNDG

SEQ ID NO: 2696347 - protein, 19 aa, Entamoeba histolytica
SRRRYRKSTSFKRRYSSRS

SEQ ID NO: 2696348 - protein, 18 aa, Entamoeba histolytica
SRRVKTEFLVQMNGVGNS

SEQ ID NO: 2696349 - protein, 19 aa, Entamoeba histolytica
SRSALTFYQHKIVDPSREA

SEQ ID NO: 2696350 - protein, 24 aa, Entamoeba histolytica
SRSFHPRDLLMLIWDKLKEDGDRV

SEQ ID NO: 2696351 - protein, 21 aa, Entamoeba histolytica
SRSIKGCKLRSVNIVYTPASN

SEQ ID NO: 2696352 - protein, 20 aa, Entamoeba histolytica
SRSSEFVFQPILTHSTSTLV

SEQ ID NO: 2696353 - protein, 20 aa, Entamoeba histolytica
SRSSIYLIFLGVNDKIITKR

SEQ ID NO: 2696354 - protein, 19 aa, Entamoeba histolytica
SRSSNILYRNSFKNDSPER

SEQ ID NO: 2696355 - protein, 19 aa, Entamoeba histolytica
SRSYSWLPLLYGLTKEDFF

SEQ ID NO: 2696356 - protein, 17 aa, Entamoeba histolytica
SRTEILEKAFSVAEENG

SEQ ID NO: 2696357 - protein, 23 aa, Entamoeba histolytica
SRTIKSYIYKQCEEKKLFIEGNA

SEQ ID NO: 2696358 - protein, 20 aa, Entamoeba histolytica
SRTKINPCYGINSLAVAISN

SEQ ID NO: 2696359 - protein, 26 aa, Entamoeba histolytica
SRTSLNLFCAFLMTRFGVENNIPSIS

SEQ ID NO: 2696360 - protein, 17 aa, Entamoeba histolytica
SRVFGRIIISSSLGKSF

SEQ ID NO: 2696361 - protein, 25 aa, Entamoeba histolytica
SRVFLKIMFQNLFEEMGMKEFKEKL

SEQ ID NO: 2696362 - protein, 19 aa, Entamoeba histolytica
SRVLVSTDLCGRGIDVAKV

SEQ ID NO: 2696363 - protein, 21 aa, Entamoeba histolytica
SRWGNSFRQTLRWLTEEPNKE

SEQ ID NO: 2696364 - protein, 17 aa, Entamoeba histolytica
SRYELMDGAPVKGESMP

SEQ ID NO: 2696365 - protein, 18 aa, Entamoeba histolytica
SRYFCVHGGISDRLATID

SEQ ID NO: 2696366 - protein, 25 aa, Entamoeba histolytica
SRYMKEYKDQLVIVQWIARDQKVGN

SEQ ID NO: 2696367 - protein, 25 aa, Entamoeba histolytica
SRYRGIPLYLEWAPEKVFDEEKVNK

SEQ ID NO: 2696368 - protein, 21 aa, Entamoeba histolytica
SRYVIWGGMVQTLLRALGNVS

SEQ ID NO: 2696369 - protein, 25 aa, Entamoeba histolytica
SRYVRFQVIVNFGKFIQFIGKDLIN

SEQ ID NO: 2696370 - protein, 19 aa, Entamoeba histolytica
SRYVVISALGSGTFGQVLK

SEQ ID NO: 2696371 - protein, 22 aa, Entamoeba histolytica
SSAEPFPFLLSTSITPSSPIIQ

SEQ ID NO: 2696372 - protein, 23 aa, Entamoeba histolytica
SSAHEFGLRLALHSLAENAARHK

SEQ ID NO: 2696373 - protein, 17 aa, Entamoeba histolytica
SSAIGILATDGILLAAK

SEQ ID NO: 2696374 - protein, 18 aa, Entamoeba histolytica
SSAMILGLVDRFEISCES

SEQ ID NO: 2696375 - protein, 24 aa, Entamoeba histolytica
SSARSLYAAALWYLDDWNEFDSIV

SEQ ID NO: 2696376 - protein, 28 aa, Entamoeba histolytica
SSCFCASQFPNCFANILSKNPQQSIEDA

SEQ ID NO: 2696377 - protein, 19 aa, Entamoeba histolytica
SSCFESCTNLLKIDLPSCL

SEQ ID NO: 2696378 - protein, 22 aa, Entamoeba histolytica
SSCKNNCLQLVKYIIEKFPHRL

SEQ ID NO: 2696379 - protein, 18 aa, Entamoeba histolytica
SSCPSCRSIEPFFDEQVK

SEQ ID NO: 2696380 - protein, 22 aa, Entamoeba histolytica
SSDAGWGCAIRATQMMIVNALV

SEQ ID NO: 2696381 - protein, 27 aa, Entamoeba histolytica
SSDALHLGHLIPFIFTKYLQDAFDCQL

SEQ ID NO: 2696382 - protein, 20 aa, Entamoeba histolytica
SSDCYEGYSNFIILEDQNTI

SEQ ID NO: 2696383 - protein, 21 aa, Entamoeba histolytica
SSDCYEGYSNFIILEDQNTIQ

SEQ ID NO: 2696384 - protein, 24 aa, Entamoeba histolytica
SSDKKPDECITCIDGNKIDQSLFA

SEQ ID NO: 2696385 - protein, 21 aa, Entamoeba histolytica
SSDLYVPIIHFLIATYQNHEI

SEQ ID NO: 2696386 - protein, 25 aa, Entamoeba histolytica
SSDPTRIATFSSYGDRVVVMDTRKP

SEQ ID NO: 2696387 - protein, 25 aa, Entamoeba histolytica
SSDTTKHFEILKAILPLRNQKDPKV

SEQ ID NO: 2696388 - protein, 21 aa, Entamoeba histolytica
SSEALNILLTKSFIMRNVNLM

SEQ ID NO: 2696389 - protein, 17 aa, Entamoeba histolytica
SSECLPLTIYLKYPDDV

SEQ ID NO: 2696390 - protein, 30 aa, Entamoeba histolytica
SSEDYCYLHDFYLLPSFRGQGLGHKLMDKV

SEQ ID NO: 2696391 - protein, 19 aa, Entamoeba histolytica
SSEICQFLDLVRIYGKNIN

SEQ ID NO: 2696392 - protein, 25 aa, Entamoeba histolytica
SSEIKIAVPSIRFFGNLLTYDDEIA

SEQ ID NO: 2696393 - protein, 25 aa, Entamoeba histolytica
SSEKIFKKRIEQMWGSIQTTSITLN

SEQ ID NO: 2696394 - protein, 18 aa, Entamoeba histolytica
SSELLKEIVIIMCDSPLN

SEQ ID NO: 2696395 - protein, 22 aa, Entamoeba histolytica
SSELVGALFLYLSSLEAPLFGH

SEQ ID NO: 2696396 - protein, 22 aa, Entamoeba histolytica
SSETFKLLLDYISITIGTIKTF

SEQ ID NO: 2696397 - protein, 23 aa, Entamoeba histolytica
SSFDYLSCLLELQGIRKEGKRVI

SEQ ID NO: 2696398 - protein, 27 aa, Entamoeba histolytica
SSFEVSRPGYGKVMWSKVDLTNVNLDI

SEQ ID NO: 2696399 - protein, 36 aa, Entamoeba histolytica
SSFGIKCSMTPKYLLLFYMKFMHLIGNICNIQKTDV

SEQ ID NO: 2696400 - protein, 24 aa, Entamoeba histolytica
SSFIEALVGFQFNVVESTIGTRRP

SEQ ID NO: 2696401 - protein, 21 aa, Entamoeba histolytica
SSFIFDLLLHFNHDLQAVEKF

SEQ ID NO: 2696402 - protein, 26 aa, Entamoeba histolytica
SSFIFRGNSAFTRLFFYYIESSSTKY

SEQ ID NO: 2696403 - protein, 17 aa, Entamoeba histolytica
SSFIPSVMLEYSPTTPN

SEQ ID NO: 2696404 - protein, 18 aa, Entamoeba histolytica
SSFIRPSITILTHGLSMV

SEQ ID NO: 2696405 - protein, 21 aa, Entamoeba histolytica
SSFKGIAMLVCRTRKSVIKYT

SEQ ID NO: 2696406 - protein, 17 aa, Entamoeba histolytica
SSFPRLGGNTTTNHSEV

SEQ ID NO: 2696407 - protein, 19 aa, Entamoeba histolytica
SSFQFIIVACDGFWNVFKY

SEQ ID NO: 2696408 - protein, 17 aa, Entamoeba histolytica
SSFSELPGMPFDNKSYQ

SEQ ID NO: 2696409 - protein, 18 aa, Entamoeba histolytica
SSFYEYSPELSLENIIKK

SEQ ID NO: 2696410 - protein, 23 aa, Entamoeba histolytica
SSGAYSRLYLVKKKTTGDIYAMK

SEQ ID NO: 2696411 - protein, 25 aa, Entamoeba histolytica
SSGEIKSEIPIHVFGTNKGSTNYKR

SEQ ID NO: 2696412 - protein, 17 aa, Entamoeba histolytica
SSGKFIRIPTRKASLNM

SEQ ID NO: 2696413 - protein, 24 aa, Entamoeba histolytica
SSGLLMSICCNLIYDPTDQFCQKN

SEQ ID NO: 2696414 - protein, 26 aa, Entamoeba histolytica
SSGVSYKFEKLYGYAEGDTAYDPLIG

SEQ ID NO: 2696415 - protein, 18 aa, Entamoeba histolytica
SSHDCARDGNLLCLILLL

SEQ ID NO: 2696416 - protein, 18 aa, Entamoeba histolytica
SSIARCSQPLCGLTGRKC

SEQ ID NO: 2696417 - protein, 19 aa, Entamoeba histolytica
SSICCPVIPDVKKYVQEKG

SEQ ID NO: 2696418 - protein, 23 aa, Entamoeba histolytica
SSICKCPLLKLYMDNNNISSITN

SEQ ID NO: 2696419 - protein, 17 aa, Entamoeba histolytica
SSICSNVVTCMRTLIEQ

SEQ ID NO: 2696420 - protein, 24 aa, Entamoeba histolytica
SSIDECWKGVLSHTSDVKELVPEF

SEQ ID NO: 2696421 - protein, 23 aa, Entamoeba histolytica
SSIDRLGSYIFWDCYNLKELEIP

SEQ ID NO: 2696422 - protein, 29 aa, Entamoeba histolytica
SSIDYSGIVPRLFYYLGNVRFNGITNTTI

SEQ ID NO: 2696423 - protein, 20 aa, Entamoeba histolytica
SSIELKVIILSSLLPQNNNM

SEQ ID NO: 2696424 - protein, 18 aa, Entamoeba histolytica
SSIFTWGDYYNFEAQISS

SEQ ID NO: 2696425 - protein, 18 aa, Entamoeba histolytica
SSIIFDIEKEFQIGTLES

SEQ ID NO: 2696426 - protein, 17 aa, Entamoeba histolytica
SSIIKIPSFPNLKRLSI

SEQ ID NO: 2696427 - protein, 18 aa, Entamoeba histolytica
SSIIKKGLINPIELISSL

SEQ ID NO: 2696428 - protein, 25 aa, Entamoeba histolytica
SSIKYQSIVCTFLIKYYPLIFRDTC

SEQ ID NO: 2696429 - protein, 25 aa, Entamoeba histolytica
SSILKRTILSDVFWLKSTSYPGRIW

SEQ ID NO: 2696430 - protein, 28 aa, Entamoeba histolytica
SSILPIPRVKFYATELLLAINALHKCNY

SEQ ID NO: 2696431 - protein, 26 aa, Entamoeba histolytica
SSIPERRLSPFDGQFFSKYDYPNRND

SEQ ID NO: 2696432 - protein, 22 aa, Entamoeba histolytica
SSIPFNIKHGIIQTDCTIFKLS

SEQ ID NO: 2696433 - protein, 32 aa, Entamoeba histolytica
SSIPKQETSLLFGIAFDRRLEKLKEQYAEQPV

SEQ ID NO: 2696434 - protein, 20 aa, Entamoeba histolytica
SSIPPIFSVCSMEIQDQLIS

SEQ ID NO: 2696435 - protein, 20 aa, Entamoeba histolytica
SSIPSCKRAFGLIKTTVEDI

SEQ ID NO: 2696436 - protein, 35 aa, Entamoeba histolytica
SSIQKEAELLFSRAKTLGLDDCIEEWNKDLQSDAK

SEQ ID NO: 2696437 - protein, 18 aa, Entamoeba histolytica
SSIQKGKLLHGYKIDMNA

SEQ ID NO: 2696438 - protein, 20 aa, Entamoeba histolytica
SSISKIGIECLFECTSLIEI

SEQ ID NO: 2696439 - protein, 19 aa, Entamoeba histolytica
SSISQIGNWCFYGCGCEEL

SEQ ID NO: 2696440 - protein, 24 aa, Entamoeba histolytica
SSITKLGDYCFEYCYSLQTINIPT

SEQ ID NO: 2696441 - protein, 17 aa, Entamoeba histolytica
SSITKLGDYCFKGSTSL

SEQ ID NO: 2696442 - protein, 28 aa, Entamoeba histolytica
SSITLIPYCCFDGCLSLENVELPNSILF

SEQ ID NO: 2696443 - protein, 19 aa, Entamoeba histolytica
SSITSFGVFCFYGCGCEEE

SEQ ID NO: 2696444 - protein, 19 aa, Entamoeba histolytica
SSITSFGYVCFKECTSLTS

SEQ ID NO: 2696445 - protein, 20 aa, Entamoeba histolytica
SSITVCLTKIQPFYEKYKIL

SEQ ID NO: 2696446 - protein, 17 aa, Entamoeba histolytica
SSITYEIKKCRRINKIK

SEQ ID NO: 2696447 - protein, 20 aa, Entamoeba histolytica
SSIVCAIALGLGTAPKVLGR

SEQ ID NO: 2696448 - protein, 25 aa, Entamoeba histolytica
SSKAEFAEDVWLKLMLSCIGETIPL

SEQ ID NO: 2696449 - protein, 20 aa, Entamoeba histolytica
SSKEYLSLTCCFAVQCNCPA

SEQ ID NO: 2696450 - protein, 25 aa, Entamoeba histolytica
SSKFPCPLCDVNLRTNDLLIKHIEA

SEQ ID NO: 2696451 - protein, 19 aa, Entamoeba histolytica
SSKGYKVACIFFNENSIHY

SEQ ID NO: 2696452 - protein, 22 aa, Entamoeba histolytica
SSKLKKKEFLSADEEIRQQIEY

SEQ ID NO: 2696453 - protein, 20 aa, Entamoeba histolytica
SSKLPKLLFNSTPSLQPIKL

SEQ ID NO: 2696454 - protein, 22 aa, Entamoeba histolytica
SSKNLFGIFYGYWLKVNKTYII

SEQ ID NO: 2696455 - protein, 25 aa, Entamoeba histolytica
SSKQGRLRLNLMGKRVDFSARTVIS

SEQ ID NO: 2696456 - protein, 23 aa, Entamoeba histolytica
SSKQVKRKSIFFSNSLFQEDDTF

SEQ ID NO: 2696457 - protein, 19 aa, Entamoeba histolytica
SSKRLFSFVQTSILVEKRV

SEQ ID NO: 2696458 - protein, 17 aa, Entamoeba histolytica
SSKRLYEYFTEIYNDWQ

SEQ ID NO: 2696459 - protein, 26 aa, Entamoeba histolytica
SSKVECPYWLAPEVISGNAFTQKSDV

SEQ ID NO: 2696460 - protein, 28 aa, Entamoeba histolytica
SSKYCMKYLRRYCKATPMTVHSYHIRIL

SEQ ID NO: 2696461 - protein, 24 aa, Entamoeba histolytica
SSLAIKYGIDIGGGVIDEDYRGEI

SEQ ID NO: 2696462 - protein, 17 aa, Entamoeba histolytica
SSLALFLLKRALKNRGD

SEQ ID NO: 2696463 - protein, 18 aa, Entamoeba histolytica
SSLALKYGIDVGAGVIDE

SEQ ID NO: 2696464 - protein, 24 aa, Entamoeba histolytica
SSLALRFQMLGVIPIVNIKEILLM

SEQ ID NO: 2696465 - protein, 18 aa, Entamoeba histolytica
SSLARLPSNIIEVLGQKK

SEQ ID NO: 2696466 - protein, 18 aa, Entamoeba histolytica
SSLEEINVPAPYWIVGKH

SEQ ID NO: 2696467 - protein, 21 aa, Entamoeba histolytica
SSLENGFLCFIDRYNQSGRRK

SEQ ID NO: 2696468 - protein, 25 aa, Entamoeba histolytica
SSLFREFHCSCGRTVNVKLKSLNSP

SEQ ID NO: 2696469 - protein, 19 aa, Entamoeba histolytica
SSLINCLSMIADALYTHSI

SEQ ID NO: 2696470 - protein, 36 aa, Entamoeba histolytica
SSLKIGKYECRVFCKESTEGFLFKTYHACGDNTFLV

SEQ ID NO: 2696471 - protein, 21 aa, Entamoeba histolytica
SSLKISIKPQFIVTNSTTKTL

SEQ ID NO: 2696472 - protein, 22 aa, Entamoeba histolytica
SSLKKSNPYSIIFNAAKGINEE

SEQ ID NO: 2696473 - protein, 19 aa, Entamoeba histolytica
SSLKLSFMEGDNIKVVDRM

SEQ ID NO: 2696474 - protein, 23 aa, Entamoeba histolytica
SSLKSIPKFCFFNNRKLSSVVLS

SEQ ID NO: 2696475 - protein, 23 aa, Entamoeba histolytica
SSLLFVFPMSGFIPICVEYLQQH

SEQ ID NO: 2696476 - protein, 18 aa, Entamoeba histolytica
SSLLKERLFLASDKYQIY

SEQ ID NO: 2696477 - protein, 18 aa, Entamoeba histolytica
SSLLNWLVGKKVTSVSSH

SEQ ID NO: 2696478 - protein, 26 aa, Entamoeba histolytica
SSLNELRRWNSLYGEGASTASTSLKY

SEQ ID NO: 2696479 - protein, 22 aa, Entamoeba histolytica
SSLNKLSLIHCINLTKTKGLTH

SEQ ID NO: 2696480 - protein, 25 aa, Entamoeba histolytica
SSLPKDYKSLVGIQRRKDNPNRRRL

SEQ ID NO: 2696481 - protein, 21 aa, Entamoeba histolytica
SSLPRPSLGMLTAKYFLMSNS

SEQ ID NO: 2696482 - protein, 23 aa, Entamoeba histolytica
SSLPYHFKRYFIHTLNPLADWFI

SEQ ID NO: 2696483 - protein, 29 aa, Entamoeba histolytica
SSLQVKYKVCLELSSYQGIFVLLKNFCIY

SEQ ID NO: 2696484 - protein, 17 aa, Entamoeba histolytica
SSLRILTIDGCPLRNLE

SEQ ID NO: 2696485 - protein, 18 aa, Entamoeba histolytica
SSLSPRFTRESFDLSTQK

SEQ ID NO: 2696486 - protein, 17 aa, Entamoeba histolytica
SSLTCVCSASMNEEAIK

SEQ ID NO: 2696487 - protein, 28 aa, Entamoeba histolytica
SSLTKLRQLCCSGCGIREIPDNLLNNFK

SEQ ID NO: 2696488 - protein, 18 aa, Entamoeba histolytica
SSLVPFLLSKSLRSKTGI

SEQ ID NO: 2696489 - protein, 17 aa, Entamoeba histolytica
SSLYFGMPGDEIDAPGN

SEQ ID NO: 2696490 - protein, 27 aa, Entamoeba histolytica
SSMGPRAQVKFPFELSPPIQKLTFGHQ

SEQ ID NO: 2696491 - protein, 17 aa, Entamoeba histolytica
SSMNSFLLYLIQESVIT

SEQ ID NO: 2696492 - protein, 24 aa, Entamoeba histolytica
SSMVKHVMMLLAFESPQKENEKTP

SEQ ID NO: 2696493 - protein, 19 aa, Entamoeba histolytica
SSNAFTFGGIRIVNKSLAN

SEQ ID NO: 2696494 - protein, 19 aa, Entamoeba histolytica
SSNCPIYLDLSKYSFIKEL

SEQ ID NO: 2696495 - protein, 24 aa, Entamoeba histolytica
SSNFRICALDPAPIITPGESSMVI

SEQ ID NO: 2696496 - protein, 17 aa, Entamoeba histolytica
SSNFVACHFARILKKHL

SEQ ID NO: 2696497 - protein, 20 aa, Entamoeba histolytica
SSNLGFRMQWICPFNASQKT

SEQ ID NO: 2696498 - protein, 23 aa, Entamoeba histolytica
SSNRICFEILYFFTKAVKIDCSY

SEQ ID NO: 2696499 - protein, 31 aa, Entamoeba histolytica
SSNVLATKEFISWIMFRMFHLFEKLNQFKEM

SEQ ID NO: 2696500 - protein, 24 aa, Entamoeba histolytica
SSPECVLYAAKIFPFGEQMIALCR

SEQ ID NO: 2696501 - protein, 20 aa, Entamoeba histolytica
SSPIYGQWIECVEIIRRQQP

SEQ ID NO: 2696502 - protein, 23 aa, Entamoeba histolytica
SSPKFIPLMNCVFAAQRIKTTID

SEQ ID NO: 2696503 - protein, 18 aa, Entamoeba histolytica
SSPLEIVEAYNFTDALKR

SEQ ID NO: 2696504 - protein, 19 aa, Entamoeba histolytica
SSPMKKKSTNFIGEEQVKL

SEQ ID NO: 2696505 - protein, 22 aa, Entamoeba histolytica
SSPNHRVYCCYPLIEIHSNKEI

SEQ ID NO: 2696506 - protein, 22 aa, Entamoeba histolytica
SSPNIYLATKFELFVYSMEGKE

SEQ ID NO: 2696507 - protein, 24 aa, Entamoeba histolytica
SSPNQSFCYFIDSKTLFDVWNDEE

SEQ ID NO: 2696508 - protein, 24 aa, Entamoeba histolytica
SSPNQSFCYFIDSKTPFDIWNDEE

SEQ ID NO: 2696509 - protein, 25 aa, Entamoeba histolytica
SSPNQSFCYFIDSKTPFDVWNDDEI

SEQ ID NO: 2696510 - protein, 25 aa, Entamoeba histolytica
SSPNQSFCYFIDSKTPFDVWNDEEI

SEQ ID NO: 2696511 - protein, 20 aa, Entamoeba histolytica
SSPSDCVLMLLFVINEYNMG

SEQ ID NO: 2696512 - protein, 30 aa, Entamoeba histolytica
SSPSDRFDPRWLTSHFNSIFLVVTPEKTTE

SEQ ID NO: 2696513 - protein, 26 aa, Entamoeba histolytica
SSPSTVLRCLFRLRPYTDMILKEMSG

SEQ ID NO: 2696514 - protein, 20 aa, Entamoeba histolytica
SSPVHRWEIVLKIKRLLDSS

SEQ ID NO: 2696515 - protein, 24 aa, Entamoeba histolytica
SSPVKAKSGLFVFIISFEPQELIN

SEQ ID NO: 2696516 - protein, 29 aa, Entamoeba histolytica
SSQNSKESFPWIQLSNFFIGRIFYTNAQT

SEQ ID NO: 2696517 - protein, 23 aa, Entamoeba histolytica
SSQPCAQGLCYTLSTYFDDSGEF

SEQ ID NO: 2696518 - protein, 25 aa, Entamoeba histolytica
SSQSLRFIPINPKHQGTYESIKDGK

SEQ ID NO: 2696519 - protein, 17 aa, Entamoeba histolytica
SSQSVVPLLELCLKRKR

SEQ ID NO: 2696520 - protein, 22 aa, Entamoeba histolytica
SSSADHSFIVWMRSKEQIFVEE

SEQ ID NO: 2696521 - protein, 19 aa, Entamoeba histolytica
SSSAVGITETTTHLGDTPS

SEQ ID NO: 2696522 - protein, 21 aa, Entamoeba histolytica
SSSELDSGFVSPMMSVTREIP

SEQ ID NO: 2696523 - protein, 18 aa, Entamoeba histolytica
SSSFNFRYEVLKKGESPT

SEQ ID NO: 2696524 - protein, 17 aa, Entamoeba histolytica
SSSFPCLQINANQLLLE

SEQ ID NO: 2696525 - protein, 18 aa, Entamoeba histolytica
SSSIAFQILKYLPPFYHC

SEQ ID NO: 2696526 - protein, 27 aa, Entamoeba histolytica
SSSILHCLKFLPTHFIIILSKIFQKIT

SEQ ID NO: 2696527 - protein, 18 aa, Entamoeba histolytica
SSSLISRLFRITEGIAGS

SEQ ID NO: 2696528 - protein, 20 aa, Entamoeba histolytica
SSSLLHILAYKYPNFTLPIY

SEQ ID NO: 2696529 - protein, 28 aa, Entamoeba histolytica
SSSPRSSPMLMQFTPRFSSGPSPYNPAT

SEQ ID NO: 2696530 - protein, 23 aa, Entamoeba histolytica
SSSTTKELFIWNATNGEHIKTIS

SEQ ID NO: 2696531 - protein, 18 aa, Entamoeba histolytica
SSSVFKYSFDYFEPKYSK

SEQ ID NO: 2696532 - protein, 24 aa, Entamoeba histolytica
SSSYELIEIADLVYDYVMENSHEM

SEQ ID NO: 2696533 - protein, 28 aa, Entamoeba histolytica
SSTDLLLLLERLLAFFGSIPPVRKNAQL

SEQ ID NO: 2696534 - protein, 22 aa, Entamoeba histolytica
SSTERKFIFLISLQLEIVSCQE

SEQ ID NO: 2696535 - protein, 22 aa, Entamoeba histolytica
SSTFRDGRAFAYIISKRRPDLL

SEQ ID NO: 2696536 - protein, 22 aa, Entamoeba histolytica
SSTGIFRLAGRADTVALYAKYP

SEQ ID NO: 2696537 - protein, 24 aa, Entamoeba histolytica
SSTKELPSLIIGKYHFKQSIKDHT

SEQ ID NO: 2696538 - protein, 19 aa, Entamoeba histolytica
SSTLRIFGNQTFLVVNSSH

SEQ ID NO: 2696539 - protein, 19 aa, Entamoeba histolytica
SSTPIRVCSYQSVKSTIDD

SEQ ID NO: 2696540 - protein, 17 aa, Entamoeba histolytica
SSTVFIGFITKFLYPTN

SEQ ID NO: 2696541 - protein, 29 aa, Entamoeba histolytica
SSVATFHLGMCYRKGIGVDENSIKSAEMY

SEQ ID NO: 2696542 - protein, 22 aa, Entamoeba histolytica
SSVDIKYLYKYIFPLIQIIIIN

SEQ ID NO: 2696543 - protein, 38 aa, Entamoeba histolytica; identical to SEQ ID NO: 2505484

SEQ ID NO: 2696544 - protein, 28 aa, Entamoeba histolytica
SSVFKRWKKRYCVLASNVIALFENAKDL

SEQ ID NO: 2696545 - protein, 22 aa, Entamoeba histolytica
SSVIEIGDWCFSECKSLRTITI

SEQ ID NO: 2696546 - protein, 19 aa, Entamoeba histolytica
SSVIFSFTLTEIVYLVELR

SEQ ID NO: 2696547 - protein, 19 aa, Entamoeba histolytica
SSVILESIPTIIIFNEGQY

SEQ ID NO: 2696548 - protein, 18 aa, Entamoeba histolytica
SSVLIRFLVEKYDQHSEQ

SEQ ID NO: 2696549 - protein, 23 aa, Entamoeba histolytica
SSVLKGFKAKHKIAATGTPMMNN

SEQ ID NO: 2696550 - protein, 27 aa, Entamoeba histolytica
SSVLNRPIMNWDLKGMFYLIDNGDNYV

SEQ ID NO: 2696551 - protein, 18 aa, Entamoeba histolytica
SSVPKLIKYLLFVPPISL

SEQ ID NO: 2696552 - protein, 23 aa, Entamoeba histolytica
SSVRWQMARNYILWVPLTAIANN

SEQ ID NO: 2696553 - protein, 18 aa, Entamoeba histolytica
SSVSKMFSIEGGFDVVFD

SEQ ID NO: 2696554 - protein, 19 aa, Entamoeba histolytica
SSVSLEFANRVAAECEQLY

SEQ ID NO: 2696555 - protein, 18 aa, Entamoeba histolytica
SSVSPGLFDEIWNKYFNK

SEQ ID NO: 2696556 - protein, 29 aa, Entamoeba histolytica
SSVSYPSNFPMVVSTGIAPMATPNLGQGH

SEQ ID NO: 2696557 - protein, 17 aa, Entamoeba histolytica
SSVTSLGERCFKGCTSL

SEQ ID NO: 2696558 - protein, 23 aa, Entamoeba histolytica
SSVTSLGEYCFKNCINLTSITIP

SEQ ID NO: 2696559 - protein, 18 aa, Entamoeba histolytica
SSWIIWNVLQEYKFIENV

SEQ ID NO: 2696560 - protein, 24 aa, Entamoeba histolytica
SSYDFIKGCLIFIPKTAISKLASF

SEQ ID NO: 2696561 - protein, 25 aa, Entamoeba histolytica
SSYDVRDVWNFPRLTQIKSETPMKK

SEQ ID NO: 2696562 - protein, 18 aa, Entamoeba histolytica
SSYFPFKNVTIAVVVFNS

SEQ ID NO: 2696563 - protein, 20 aa, Entamoeba histolytica
SSYGRWLTSCSTFQKKWNQE

SEQ ID NO: 2696564 - protein, 26 aa, Entamoeba histolytica
SSYNMLNRIVELWKQHGIYTQLNKLK

SEQ ID NO: 2696565 - protein, 25 aa, Entamoeba histolytica
SSYPDYNPLLFLCLSKPLYKQPQLS

SEQ ID NO: 2696566 - protein, 19 aa, Entamoeba histolytica
SSYQEVLESFIFNPISSTR

SEQ ID NO: 2696567 - protein, 20 aa, Entamoeba histolytica
SSYRHSYHGRSYDRSRSRSS

SEQ ID NO: 2696568 - protein, 25 aa, Entamoeba histolytica
SSYVCSGFVGNRCGMIILDSFQIQS

SEQ ID NO: 2696569 - protein, 17 aa, Entamoeba histolytica
SSYWNKLVVILSDSGVP

SEQ ID NO: 2696570 - protein, 19 aa, Entamoeba histolytica
STAPIIVCYFSFKKHTTTP

SEQ ID NO: 2696571 - protein, 25 aa, Entamoeba histolytica
STCLNEPIHSFVFLPSTSADEDVLF

SEQ ID NO: 2696572 - protein, 26 aa, Entamoeba histolytica
STCMKTKAGEVLKVIEKNVRIGWLYC

SEQ ID NO: 2696573 - protein, 19 aa, Entamoeba histolytica
STCNTDCMNFLKSNFNHTI

SEQ ID NO: 2696574 - protein, 19 aa, Entamoeba histolytica
STCPFPFSLPSTITSLHLS

SEQ ID NO: 2696575 - protein, 18 aa, Entamoeba histolytica
STDGFVFGVFSSSFQSSK

SEQ ID NO: 2696576 - protein, 19 aa, Entamoeba histolytica
STDLPLYFNGVSLEGKLNN

SEQ ID NO: 2696577 - protein, 29 aa, Entamoeba histolytica
STDNRLECLKRISTVIQMLNYAPIKKELQ

SEQ ID NO: 2696578 - protein, 23 aa, Entamoeba histolytica
STEDIKKAFEIFDKEKNGYISAS

SEQ ID NO: 2696579 - protein, 22 aa, Entamoeba histolytica
STEEYCRCLSTFICSTFTEMHG

SEQ ID NO: 2696580 - protein, 19 aa, Entamoeba histolytica
STEGISFKTIPLIQNELFC

SEQ ID NO: 2696581 - protein, 33 aa, Entamoeba histolytica
STEIKLFPSLIFKSSKCVFGGNITSSRGKTVVV

SEQ ID NO: 2696582 - protein, 23 aa, Entamoeba histolytica
STEKRLAYIEARDDVSIIAGDGT

SEQ ID NO: 2696583 - protein, 24 aa, Entamoeba histolytica
STELKLKALSAVAIDLSLTDSADP

SEQ ID NO: 2696584 - protein, 25 aa, Entamoeba histolytica
STELREMMVHFSLGMLQVKLLRLWD

SEQ ID NO: 2696585 - protein, 19 aa, Entamoeba histolytica
STEMLQRHGYPYTTDLNVF

SEQ ID NO: 2696586 - protein, 35 aa, Entamoeba histolytica
STEWKYKEAAIFVFGCIICKGWNPNNQQFNQQVKT

SEQ ID NO: 2696587 - protein, 30 aa, Entamoeba histolytica
STFFKAGSSELIWSPRANIVLCKAQTNIDS

SEQ ID NO: 2696588 - protein, 27 aa, Entamoeba histolytica
STFHQWKCQVTSIFFKQLEDVECLLLL

SEQ ID NO: 2696589 - protein, 17 aa, Entamoeba histolytica
STFLKQHLSVVVDTYQS

SEQ ID NO: 2696590 - protein, 17 aa, Entamoeba histolytica
STFPFVFTSVDIGYLVN

SEQ ID NO: 2696591 - protein, 31 aa, Entamoeba histolytica
STGGPETMAIRLTVVSGKQLKAMDLRSSDPY

SEQ ID NO: 2696592 - protein, 25 aa, Entamoeba histolytica
STGIPVKGGYCVRLKQGYAAFDKGA

SEQ ID NO: 2696593 - protein, 23 aa, Entamoeba histolytica
STGKCYYPTFYGYNAKTKKELYG

SEQ ID NO: 2696594 - protein, 26 aa, Entamoeba histolytica
STGKTMLCNLLFEYLDYYTPAAYIKE

SEQ ID NO: 2696595 - protein, 17 aa, Entamoeba histolytica
STHDFKALSACHSSVTE

SEQ ID NO: 2696596 - protein, 24 aa, Entamoeba histolytica
STHLDFPDEIFVAPSLDDKFSYHF

SEQ ID NO: 2696597 - protein, 20 aa, Entamoeba histolytica
STIIPEIDNPWYLKFNNSAI

SEQ ID NO: 2696598 - protein, 21 aa, Entamoeba histolytica
STIIPEIDNPWYLKFNNSAIY

SEQ ID NO: 2696599 - protein, 26 aa, Entamoeba histolytica
STIIPEIDSPWYLKFNNAAIYDDNTE

SEQ ID NO: 2696600 - protein, 17 aa, Entamoeba histolytica
STIKFIPLHHGLLTIDK

SEQ ID NO: 2696601 - protein, 26 aa, Entamoeba histolytica
STIKTMICPKGLLALVNSPRSSPKSN

SEQ ID NO: 2696602 - protein, 17 aa, Entamoeba histolytica
STIQLGDYCILKRDEIM

SEQ ID NO: 2696603 - protein, 21 aa, Entamoeba histolytica
STIRFKVHHVIMKKQESVKPV

SEQ ID NO: 2696604 - protein, 18 aa, Entamoeba histolytica
STISPGLFDEIWNKYFNK

SEQ ID NO: 2696605 - protein, 19 aa, Entamoeba histolytica
STIYKGRQVFFYKRAQIVV

SEQ ID NO: 2696606 - protein, 18 aa, Entamoeba histolytica
STKSFPNAKSMNIKCQNI

SEQ ID NO: 2696607 - protein, 17 aa, Entamoeba histolytica
STKSGVIQGDWRDGKNT

SEQ ID NO: 2696608 - protein, 24 aa, Entamoeba histolytica
STKYKHLESVIAFMENERENWEKW

SEQ ID NO: 2696609 - protein, 23 aa, Entamoeba histolytica
STLCLPSTLTFIGTRCFYECTSL

SEQ ID NO: 2696610 - protein, 20 aa, Entamoeba histolytica
STLDFLRFYITNYKLYLISC

SEQ ID NO: 2696611 - protein, 17 aa, Entamoeba histolytica
STLELKNSLSYYKRLDL

SEQ ID NO: 2696612 - protein, 21 aa, Entamoeba histolytica
STLFIPASCLMKMTPFEKQYW

SEQ ID NO: 2696613 - protein, 21 aa, Entamoeba histolytica
STLFRITYRNGFTYHLPHCSL

SEQ ID NO: 2696614 - protein, 33 aa, Entamoeba histolytica
STLFWMFKYVMDFLQPFYFCKGDIIMKALRKNG

SEQ ID NO: 2696615 - protein, 18 aa, Entamoeba histolytica
STLHAFAHWTWVHTKGAL

SEQ ID NO: 2696616 - protein, 18 aa, Entamoeba histolytica
STLIKLTIEKCYSLHKLP

SEQ ID NO: 2696617 - protein, 17 aa, Entamoeba histolytica
STLIVSECVKRVKHIPA

SEQ ID NO: 2696618 - protein, 24 aa, Entamoeba histolytica
STLKMSSLYPCLSPITQALIKSEC

SEQ ID NO: 2696619 - protein, 17 aa, Entamoeba histolytica
STLKRLTLEDCEVATYK

SEQ ID NO: 2696620 - protein, 18 aa, Entamoeba histolytica
STLKRNSILLSHVPLEIL

SEQ ID NO: 2696621 - protein, 25 aa, Entamoeba histolytica
STLLLRSALYYIQKMLKVFGIEEKQ

SEQ ID NO: 2696622 - protein, 22 aa, Entamoeba histolytica
STLMPSLLIIFRITQDRVGAKK

SEQ ID NO: 2696623 - protein, 18 aa, Entamoeba histolytica
STLNRVIIKLVIDLNTFK

SEQ ID NO: 2696624 - protein, 18 aa, Entamoeba histolytica
STLPAKEYHYLFISLNEK

SEQ ID NO: 2696625 - protein, 24 aa, Entamoeba histolytica
STLPVLDALLCYSFIDRSILNSLC

SEQ ID NO: 2696626 - protein, 22 aa, Entamoeba histolytica
STLRCVKRLLSTTACVEVVAKS

SEQ ID NO: 2696627 - protein, 25 aa, Entamoeba histolytica
STLREIKGIISIGCNKRKKISLPGL

SEQ ID NO: 2696628 - protein, 29 aa, Entamoeba histolytica
STLREVRVLRMLNHLNILKFIAYSPNTIV

SEQ ID NO: 2696629 - protein, 17 aa, Entamoeba histolytica
STLSLCTRPTLLKQKFF

SEQ ID NO: 2696630 - protein, 21 aa, Entamoeba histolytica
STLTFPDMRVVYASRTHNQLA

SEQ ID NO: 2696631 - protein, 19 aa, Entamoeba histolytica
STLTICTRPTLLKQKFFAS

SEQ ID NO: 2696632 - protein, 21 aa, Entamoeba histolytica
STLTLSYCKSLWLSTLTGLEN

SEQ ID NO: 2696633 - protein, 26 aa, Entamoeba histolytica
STLVLPRAITNIGLIDCFVSMARCSQ

SEQ ID NO: 2696634 - protein, 25 aa, Entamoeba histolytica
STLYICGFDEMLKIIKIETFVALND

SEQ ID NO: 2696635 - protein, 17 aa, Entamoeba histolytica
STMYLGRAMMVVYEKCI

SEQ ID NO: 2696636 - protein, 19 aa, Entamoeba histolytica
STNCLKTNLLIKTKNQGEF

SEQ ID NO: 2696637 - protein, 22 aa, Entamoeba histolytica
STNEAISFFHLIGRIIHTEPVY

SEQ ID NO: 2696638 - protein, 28 aa, Entamoeba histolytica
STNFKFVMKSVVAKIVCYGRYCIERNLY

SEQ ID NO: 2696639 - protein, 18 aa, Entamoeba histolytica
STNKIISFDCQRLGIKES

SEQ ID NO: 2696640 - protein, 26 aa, Entamoeba histolytica
STNNIYCLKQFFIILYYCFKSSKEVE

SEQ ID NO: 2696641 - protein, 20 aa, Entamoeba histolytica
STNYKRFWIQQISVVLLPQL

SEQ ID NO: 2696642 - protein, 25 aa, Entamoeba histolytica
STPIRYGVGCFRGCKILSQVEGAKQ

SEQ ID NO: 2696643 - protein, 19 aa, Entamoeba histolytica
STPNPKPFHQIKFQLNGKT

SEQ ID NO: 2696644 - protein, 22 aa, Entamoeba histolytica
STPRKGFIGRNRAKSGLVKTVP

SEQ ID NO: 2696645 - protein, 17 aa, Entamoeba histolytica
STPSLLVSMLFDGTFLQ

SEQ ID NO: 2696646 - protein, 23 aa, Entamoeba histolytica
STPVGRLKLTWEEVGNFSKKMKA

SEQ ID NO: 2696647 - protein, 25 aa, Entamoeba histolytica
STPYRLMKMPLRRYISSSKHNELFI

SEQ ID NO: 2696648 - protein, 34 aa, Entamoeba histolytica
STQIPILRWVELEYCIKYPLKILQIDQQHMPSFH

SEQ ID NO: 2696649 - protein, 24 aa, Entamoeba histolytica
STQKESPSFCSFELMKQKNFTPRE

SEQ ID NO: 2696650 - protein, 25 aa, Entamoeba histolytica
STQLGCHYKRIVFLPLSLESIQRVV

SEQ ID NO: 2696651 - protein, 23 aa, Entamoeba histolytica
STQMFNFISSFFVNMILNTESLE

SEQ ID NO: 2696652 - protein, 17 aa, Entamoeba histolytica
STQNVVWINASNKIHTN

SEQ ID NO: 2696653 - protein, 24 aa, Entamoeba histolytica
STQQRILAFLSIRKITPTTHQSVK

SEQ ID NO: 2696654 - protein, 25 aa, Entamoeba histolytica
STQYGLRFCGMRVFNKDTNIFVQHD

SEQ ID NO: 2696655 - protein, 23 aa, Entamoeba histolytica
STRFNVLRLIGLLISTAPQQCER

SEQ ID NO: 2696656 - protein, 19 aa, Entamoeba histolytica
STRGYGYDLADNFIDDGYD

SEQ ID NO: 2696657 - protein, 20 aa, Entamoeba histolytica
STRLRKALDNCFIVDEVNPL

SEQ ID NO: 2696658 - protein, 16 aa, Entamoeba histolytica
STRTYFSVCFYKDSCY

SEQ ID NO: 2696659 - protein, 25 aa, Entamoeba histolytica
STSEKKEWVCIICDEDGKFSSVGTK

SEQ ID NO: 2696660 - protein, 17 aa, Entamoeba histolytica
STSFCYEESVISGIQSD

SEQ ID NO: 2696661 - protein, 30 aa, Entamoeba histolytica
STSFFKQYIEVLTLFYSKLVIFLKLNNEHK

SEQ ID NO: 2696662 - protein, 27 aa, Entamoeba histolytica
STSFNLKTAVSWLFVNIILYSEDDNIG

SEQ ID NO: 2696663 - protein, 18 aa, Entamoeba histolytica
STSLKRNLLIAITELISL

SEQ ID NO: 2696664 - protein, 19 aa, Entamoeba histolytica
STSNSLVFNSIQRFETRRI

SEQ ID NO: 2696665 - protein, 19 aa, Entamoeba histolytica
STSPFTFDSNPSFNEVPTQ

SEQ ID NO: 2696666 - protein, 21 aa, Entamoeba histolytica
STSPFTFDSNPSFNEVPTQSQ

SEQ ID NO: 2696667 - protein, 21 aa, Entamoeba histolytica
STSPLFDFGDFSSSSAKPNQS

SEQ ID NO: 2696668 - protein, 17 aa, Entamoeba histolytica
STSSIIFNDIIYAITKI

SEQ ID NO: 2696669 - protein, 18 aa, Entamoeba histolytica
STSVLTEYGEFAAIVLIK

SEQ ID NO: 2696670 - protein, 23 aa, Entamoeba histolytica
STTEWANSVSRPLVKEVDPNFNR

SEQ ID NO: 2696671 - protein, 25 aa, Entamoeba histolytica
STTLKYIGCSCFKFCVSLHSIKFPS

SEQ ID NO: 2696672 - protein, 21 aa, Entamoeba histolytica
STTLRLFAILRHDYSNYLASY

SEQ ID NO: 2696673 - protein, 28 aa, Entamoeba histolytica
STTPKFFERMYCMFYPLDEQARCVLEEV

SEQ ID NO: 2696674 - protein, 19 aa, Entamoeba histolytica
STTRFKFVLYEESKELPVT

SEQ ID NO: 2696675 - protein, 24 aa, Entamoeba histolytica
STTSEVMAAISLKNNDEDSIVVSQ

SEQ ID NO: 2696676 - protein, 17 aa, Entamoeba histolytica
STTYLSICASLIQSPST

SEQ ID NO: 2696677 - protein, 19 aa, Entamoeba histolytica
STVIPRFFKHSNFSSFVRQ

SEQ ID NO: 2696678 - protein, 25 aa, Entamoeba histolytica
STVKQCILDWSFKSLFDQYAKGKSY

SEQ ID NO: 2696679 - protein, 23 aa, Entamoeba histolytica
STVKSGIPSGGFAASIPSISASL

SEQ ID NO: 2696680 - protein, 30 aa, Entamoeba histolytica; identical to SEQ ID NO: 2505621

SEQ ID NO: 2696681 - protein, 19 aa, Entamoeba histolytica
STVRMLCGIPSSGLGNLFM

SEQ ID NO: 2696682 - protein, 20 aa, Entamoeba histolytica
STWGNLWQYIGIERHAQYGY

SEQ ID NO: 2696683 - protein, 21 aa, Entamoeba histolytica
STYIGKSVFFTKFIVPDEYYI

SEQ ID NO: 2696684 - protein, 26 aa, Entamoeba histolytica
STYIWGYCDAHFKKNMTFEEAKQFIV

SEQ ID NO: 2696685 - protein, 19 aa, Entamoeba histolytica
STYPKLLPFIKLNLPHVPH

SEQ ID NO: 2696686 - protein, 17 aa, Entamoeba histolytica
SVAISGTIINSLKKYID

SEQ ID NO: 2696687 - protein, 17 aa, Entamoeba histolytica
SVASFPSLRCWDKFDSP

SEQ ID NO: 2696688 - protein, 23 aa, Entamoeba histolytica
SVAVFLCGLYYMKVIDEKLLVEL

SEQ ID NO: 2696689 - protein, 23 aa, Entamoeba histolytica
SVCEIKKIIPLNVQTILVSATYP

SEQ ID NO: 2696690 - protein, 18 aa, Entamoeba histolytica
SVCLAILSILSWESPKLV

SEQ ID NO: 2696691 - protein, 21 aa, Entamoeba histolytica
SVCVPRIPFDDSLLEIPRTLN

SEQ ID NO: 2696692 - protein, 31 aa, Entamoeba histolytica
SVDAFKTFYKITVGFNFLSNFIIIKDYAIYC

SEQ ID NO: 2696693 - protein, 26 aa, Entamoeba histolytica
SVDIKYGYEYIFPLIPIIIVNKEDYI

SEQ ID NO: 2696694 - protein, 20 aa, Entamoeba histolytica
SVDIKYLYKYIFPLIQIIII

SEQ ID NO: 2696695 - protein, 18 aa, Entamoeba histolytica
SVDIWSIGAIFGELAYGA

SEQ ID NO: 2696696 - protein, 26 aa, Entamoeba histolytica
SVDVCLSAFAGMISKIVKRRLLLMKN

SEQ ID NO: 2696697 - protein, 22 aa, Entamoeba histolytica
SVECTYAGTAFRGNARTFLQKT

SEQ ID NO: 2696698 - protein, 35 aa, Entamoeba histolytica; identical to SEQ ID NO: 2505648

SEQ ID NO: 2696699 - protein, 26 aa, Entamoeba histolytica
SVEIIPEHKCCFVSFVRHDDAMRFKV

SEQ ID NO: 2696700 - protein, 17 aa, Entamoeba histolytica
SVEKIGVLKTTEALQSF

SEQ ID NO: 2696701 - protein, 19 aa, Entamoeba histolytica
SVEKWDFERDIWRRDFYFW

SEQ ID NO: 2696702 - protein, 19 aa, Entamoeba histolytica
SVELIIEIFNLWKQFFHCF

SEQ ID NO: 2696703 - protein, 23 aa, Entamoeba histolytica
SVELKYCKVTSLSPLNQTKHLES

SEQ ID NO: 2696704 - protein, 17 aa, Entamoeba histolytica
SVELLHIVEGGIQRIEE

SEQ ID NO: 2696705 - protein, 19 aa, Entamoeba histolytica
SVELYKKGIEYLFYNHLIE

SEQ ID NO: 2696706 - protein, 17 aa, Entamoeba histolytica
SVEYAFKNKKGERYGDA

SEQ ID NO: 2696707 - protein, 17 aa, Entamoeba histolytica
SVEYFYPLCVMLLSYAD

SEQ ID NO: 2696708 - protein, 18 aa, Entamoeba histolytica
SVFFTKFIVPDEYYIYHS

SEQ ID NO: 2696709 - protein, 17 aa, Entamoeba histolytica
SVFPKWSIVDPCHSMSL

SEQ ID NO: 2696710 - protein, 22 aa, Entamoeba histolytica
SVFQWKEEFLKWSTIKPDAIKL

SEQ ID NO: 2696711 - protein, 19 aa, Entamoeba histolytica
SVFVPKEKTGIVYIEAMTE

SEQ ID NO: 2696712 - protein, 22 aa, Entamoeba histolytica
SVGKSSIVLRVCKDEYKEFQEN

SEQ ID NO: 2696713 - protein, 18 aa, Entamoeba histolytica
SVGVCFQLFMPYVKAEDT

SEQ ID NO: 2696714 - protein, 18 aa, Entamoeba histolytica
SVGYKYPPNYNEVLDQTY

SEQ ID NO: 2696715 - protein, 23 aa, Entamoeba histolytica
SVHMQCVEFILSLNKYQMDNNLI

SEQ ID NO: 2696716 - protein, 25 aa, Entamoeba histolytica
SVIDLIYRTMFPFNLDAQKVIEQIF

SEQ ID NO: 2696717 - protein, 18 aa, Entamoeba histolytica
SVIFEPPTSFSIINYCDD

SEQ ID NO: 2696718 - protein, 18 aa, Entamoeba histolytica
SVIFNYKLVSSYSKEIGL

SEQ ID NO: 2696719 - protein, 17 aa, Entamoeba histolytica
SVIGEWKDIIIPFKLKV

SEQ ID NO: 2696720 - protein, 18 aa, Entamoeba histolytica
SVIGTLFCILQSNPAAFP

SEQ ID NO: 2696721 - protein, 19 aa, Entamoeba histolytica
SVIIPYIYTQFKCDGMSTE

SEQ ID NO: 2696722 - protein, 17 aa, Entamoeba histolytica
SVILKRLPFPNICGRVC

SEQ ID NO: 2696723 - protein, 30 aa, Entamoeba histolytica
SVIMSKWMAFECITRMVGFYDLDRKDLDGV

SEQ ID NO: 2696724 - protein, 24 aa, Entamoeba histolytica
SVIYKLVDEFGFIQSLLDIFYDER

SEQ ID NO: 2696725 - protein, 25 aa, Entamoeba histolytica
SVKCSALRALMYVDLSAAVRYVIKK

SEQ ID NO: 2696726 - protein, 23 aa, Entamoeba histolytica
SVKDRVGFNIIYQAIKDGRLKPG

SEQ ID NO: 2696727 - protein, 18 aa, Entamoeba histolytica
SVKECIQFILQQSEDIQQ

SEQ ID NO: 2696728 - protein, 25 aa, Entamoeba histolytica
SVKNAWCCLCPKQVLDYKLSYHYLN

SEQ ID NO: 2696729 - protein, 25 aa, Entamoeba histolytica
SVKTRLPVSYSPVLYSDFPHWDISI

SEQ ID NO: 2696730 - protein, 25 aa, Entamoeba histolytica
SVKVFSKAAGIFVACIELADKCGLK

SEQ ID NO: 2696731 - protein, 22 aa, Entamoeba histolytica
SVKVLGDYCFKGCTSLTTINIP

SEQ ID NO: 2696732 - protein, 24 aa, Entamoeba histolytica
SVLEEYKEMFGLTLELYQKYWNDK

SEQ ID NO: 2696733 - protein, 19 aa, Entamoeba histolytica
SVLFYGFENVDLFIKYGSY

SEQ ID NO: 2696734 - protein, 19 aa, Entamoeba histolytica
SVLHYFSFFGKVRAITQDG

SEQ ID NO: 2696735 - protein, 17 aa, Entamoeba histolytica
SVLKKLRALYLQSNNLL

SEQ ID NO: 2696736 - protein, 19 aa, Entamoeba histolytica
SVLLCPHKTEFLMMLLENY

SEQ ID NO: 2696737 - protein, 17 aa, Entamoeba histolytica
SVLLHPYGPWSIYMKDA

SEQ ID NO: 2696738 - protein, 28 aa, Entamoeba histolytica
SVLLKSRYEATVTHFLWRSVKQADDLVK

SEQ ID NO: 2696739 - protein, 17 aa, Entamoeba histolytica
SVLRTYRRLGIATKLIR

SEQ ID NO: 2696740 - protein, 22 aa, Entamoeba histolytica
SVLTPEIIKFIPNRLHLLIQTL

SEQ ID NO: 2696741 - protein, 25 aa, Entamoeba histolytica
SVLVEWPSLTPFGFDKDLLKRLNSV

SEQ ID NO: 2696742 - protein, 19 aa, Entamoeba histolytica
SVMAVSFKTAITIWDVLSN

SEQ ID NO: 2696743 - protein, 18 aa, Entamoeba histolytica
SVMICLFTSVKHSHSRHR

SEQ ID NO: 2696744 - protein, 19 aa, Entamoeba histolytica
SVMKDRFPNRVIKEKLIKK

SEQ ID NO: 2696745 - protein, 26 aa, Entamoeba histolytica
SVMKEVMEEIRLLKKLKHKHIVRYIA

SEQ ID NO: 2696746 - protein, 22 aa, Entamoeba histolytica
SVMKYLLNKDIEGMKQYLEINW

SEQ ID NO: 2696747 - protein, 17 aa, Entamoeba histolytica
SVMPEAGGVAFISQSGA

SEQ ID NO: 2696748 - protein, 26 aa, Entamoeba histolytica
SVMSGITCSLRFPGQLNQDLKKLTVN

SEQ ID NO: 2696749 - protein, 26 aa, Entamoeba histolytica
SVMSGITCSLRFPGQLNQDLRKLAVN

SEQ ID NO: 2696750 - protein, 19 aa, Entamoeba histolytica
SVNDGCGWGVEPSYAARVA

SEQ ID NO: 2696751 - protein, 26 aa, Entamoeba histolytica
SVNNFPGAMPVNFGRTSFEIIQKNAY

SEQ ID NO: 2696752 - protein, 17 aa, Entamoeba histolytica
SVNSFVYESQRMNEENK

SEQ ID NO: 2696753 - protein, 20 aa, Entamoeba histolytica
SVPCVAIALGYDLLSVEKMM

SEQ ID NO: 2696754 - protein, 18 aa, Entamoeba histolytica
SVPGLCWITNAFKPSLVY

SEQ ID NO: 2696755 - protein, 22 aa, Entamoeba histolytica
SVPLMYCCEEVFNSINQVKDDT

SEQ ID NO: 2696756 - protein, 23 aa, Entamoeba histolytica
SVPLPDFLINKFVALAVRLYVRL

SEQ ID NO: 2696757 - protein, 18 aa, Entamoeba histolytica
SVPLPWAQVQQRIQAEEG

SEQ ID NO: 2696758 - protein, 26 aa, Entamoeba histolytica
SVPTLLRLLYKGYLGDFIVSQTIENK

SEQ ID NO: 2696759 - protein, 25 aa, Entamoeba histolytica
SVPYQEVFKKLGLPVVKFREPPQRQ

SEQ ID NO: 2696760 - protein, 22 aa, Entamoeba histolytica
SVQDLIRLSLRHPEYISVDEKA

SEQ ID NO: 2696761 - protein, 19 aa, Entamoeba histolytica
SVQICSALSLPTHFHNRAH

SEQ ID NO: 2696762 - protein, 22 aa, Entamoeba histolytica
SVQKTFLMRILKKVFIEEKTDG

SEQ ID NO: 2696763 - protein, 28 aa, Entamoeba histolytica
SVQNCVVKMNFAFLAALMKWKKEQDEIE

SEQ ID NO: 2696764 - protein, 26 aa, Entamoeba histolytica
SVQNQIPWEMNWKGFKVIRRKEFIQN

SEQ ID NO: 2696765 - protein, 19 aa, Entamoeba histolytica
SVRDWWYYPELTYVTDTSD

SEQ ID NO: 2696766 - protein, 19 aa, Entamoeba histolytica
SVRGAELLSKYVGETEKNI

SEQ ID NO: 2696767 - protein, 24 aa, Entamoeba histolytica
SVRKFTVMCLNTFGTLYKDGFCNQ

SEQ ID NO: 2696768 - protein, 21 aa, Entamoeba histolytica
SVRNTWWFPLLNTIPLDQYTR

SEQ ID NO: 2696769 - protein, 24 aa, Entamoeba histolytica
SVRPECLISLILFEVLLDNEAVLI

SEQ ID NO: 2696770 - protein, 18 aa, Entamoeba histolytica
SVRQCIKTDDGVVVVLNE

SEQ ID NO: 2696771 - protein, 46 aa, Entamoeba histolytica
SVRRLGRTFIRFCEELKFDLPFVDPCLYLQRFGEDLSFEKTGDVVR

SEQ ID NO: 2696772 - protein, 18 aa, Entamoeba histolytica
SVRSRSYSDIEITENDEQ

SEQ ID NO: 2696773 - protein, 24 aa, Entamoeba histolytica
SVSKIGDGCFEYCTSLTSITIPTS

SEQ ID NO: 2696774 - protein, 24 aa, Entamoeba histolytica
SVSKIGDGCFEYCTSLTTINIPTS

SEQ ID NO: 2696775 - protein, 21 aa, Entamoeba histolytica
SVSNFPFKFCSTSGGRSNLCS

SEQ ID NO: 2696776 - protein, 24 aa, Entamoeba histolytica
SVSPSGRYITVWQLIPLQYTQGVN

SEQ ID NO: 2696777 - protein, 24 aa, Entamoeba histolytica
SVTLCGIPFKYSIDKVNEFNIAMG

SEQ ID NO: 2696778 - protein, 23 aa, Entamoeba histolytica
SVTYTFHCPLSFSEIIPNELNGK

SEQ ID NO: 2696779 - protein, 17 aa, Entamoeba histolytica
SVVDDILAWAIKKGEMD

SEQ ID NO: 2696780 - protein, 23 aa, Entamoeba histolytica
SVVDLRLGNKLDYDDNTYELQKV

SEQ ID NO: 2696781 - protein, 27 aa, Entamoeba histolytica
SVVGKELFTGCCYPDCFCADKVFVIEW

SEQ ID NO: 2696782 - protein, 24 aa, Entamoeba histolytica
SVVKCTKCGVILHSKKCEEKYSKK

SEQ ID NO: 2696783 - protein, 18 aa, Entamoeba histolytica
SVVNEKEKFIAIITKKSV

SEQ ID NO: 2696784 - protein, 21 aa, Entamoeba histolytica
SVVPHREIIKFFSNILPIIEA

SEQ ID NO: 2696785 - protein, 19 aa, Entamoeba histolytica
SVVSTRWFGKLSLFDCSRS

SEQ ID NO: 2696786 - protein, 27 aa, Entamoeba histolytica
SVVTPSLCKIGGLLLCVVGEDVAFSLL

SEQ ID NO: 2696787 - protein, 17 aa, Entamoeba histolytica
SVWYEWLVTSPVLSRLH

SEQ ID NO: 2696788 - protein, 18 aa, Entamoeba histolytica
SVYLLLISSEFVRYTIKE

SEQ ID NO: 2696789 - protein, 18 aa, Entamoeba histolytica
SVYLRYGSIQTIRQLAVE

SEQ ID NO: 2696790 - protein, 20 aa, Entamoeba histolytica
SVYPQLMRELAMNISNNHFD

SEQ ID NO: 2696791 - protein, 20 aa, Entamoeba histolytica
SVYSRKDCFEIMYHVVPLLT

SEQ ID NO: 2696792 - protein, 24 aa, Entamoeba histolytica
SWDLTLKHLVDWKVFDKIKSTNKC

SEQ ID NO: 2696793 - protein, 25 aa, Entamoeba histolytica
SWECYPISCPIAFSVSQEKGIDHFI

SEQ ID NO: 2696794 - protein, 33 aa, Entamoeba histolytica
SWISGTEWLLRVLSGMLFVPLIQRVFETKEIKK

SEQ ID NO: 2696795 - protein, 21 aa, Entamoeba histolytica
SWKKISCLVDGVLEVLCQTPL

SEQ ID NO: 2696796 - protein, 26 aa, Entamoeba histolytica
SWKSYAMGIGCVLAGMYQIYINPKTP

SEQ ID NO: 2696797 - protein, 19 aa, Entamoeba histolytica
SWLPKEEWPLFNKSLVAFG

SEQ ID NO: 2696798 - protein, 27 aa, Entamoeba histolytica
SWMPCICNSFQLVCYEMTFIVPDPYVV

SEQ ID NO: 2696799 - protein, 22 aa, Entamoeba histolytica
SWQTLCPGFSMITEKAQRQFTE

SEQ ID NO: 2696800 - protein, 25 aa, Entamoeba histolytica
SWSEAMKKLKFMVELYSKEKEENTK

SEQ ID NO: 2696801 - protein, 17 aa, Entamoeba histolytica
SWSEFFAHPYVQRACEV

SEQ ID NO: 2696802 - protein, 22 aa, Entamoeba histolytica
SWSPKGEYLAVVTLKGNVIIWT

SEQ ID NO: 2696803 - protein, 26 aa, Entamoeba histolytica
SWVHYPRPYMDDVFKQLDPEKIKPFC

SEQ ID NO: 2696804 - protein, 29 aa, Entamoeba histolytica
SYAKFTCFFEMSQLYPLFIQNLTNSYMHT

SEQ ID NO: 2696805 - protein, 23 aa, Entamoeba histolytica
SYASDLQRSLCLALDDFYKNILH

SEQ ID NO: 2696806 - protein, 24 aa, Entamoeba histolytica
SYCKISIRFIEEVLKLILNSLDPK

SEQ ID NO: 2696807 - protein, 20 aa, Entamoeba histolytica
SYDSQDSCNFQRSYSNSPKR

SEQ ID NO: 2696808 - protein, 30 aa, Entamoeba histolytica
SYEELRMIILTDFFKHAFDGSGADNFYDAG

SEQ ID NO: 2696809 - protein, 18 aa, Entamoeba histolytica
SYEIAICQSIGRRGKMED

SEQ ID NO: 2696810 - protein, 18 aa, Entamoeba histolytica
SYEKHGSPRLYQDISNKN

SEQ ID NO: 2696811 - protein, 26 aa, Entamoeba histolytica
SYEPQNDCALWFIKVFPGNREFMMRA

SEQ ID NO: 2696812 - protein, 25 aa, Entamoeba histolytica
SYERTCDICFKRMCAENKDIISTQE

SEQ ID NO: 2696813 - protein, 19 aa, Entamoeba histolytica
SYESLEEFTQVDAFAAHTK

SEQ ID NO: 2696814 - protein, 22 aa, Entamoeba histolytica
SYFEEWDCLWKIKLTNEASSSQ

SEQ ID NO: 2696815 - protein, 28 aa, Entamoeba histolytica
SYFLGEICSGLWYLHFNKRLIHRDLKPA

SEQ ID NO: 2696816 - protein, 27 aa, Entamoeba histolytica
SYFRNRHVMCFCFDITKKASFSSISGW

SEQ ID NO: 2696817 - protein, 31 aa, Entamoeba histolytica
SYFTKDCSFDAWKILRRGTIVLYKMSAGEYQ

SEQ ID NO: 2696818 - protein, 19 aa, Entamoeba histolytica
SYFTQCFVYSFKLITTTTK

SEQ ID NO: 2696819 - protein, 18 aa, Entamoeba histolytica
SYFYQGQVSDLWLQLSKK

SEQ ID NO: 2696820 - protein, 19 aa, Entamoeba histolytica
SYGIHCARLAHLPSSLISR

SEQ ID NO: 2696821 - protein, 18 aa, Entamoeba histolytica
SYGLSIDEMHFFVSDMMN

SEQ ID NO: 2696822 - protein, 20 aa, Entamoeba histolytica
SYGRAGAKIDYTGYGCNNLI

SEQ ID NO: 2696823 - protein, 17 aa, Entamoeba histolytica
SYGRLILELSKTVPDGI

SEQ ID NO: 2696824 - protein, 22 aa, Entamoeba histolytica
SYGRTDLWGGSFAQLKASIKNV

SEQ ID NO: 2696825 - protein, 19 aa, Entamoeba histolytica
SYHIPYHYYNLIISSSPLN

SEQ ID NO: 2696826 - protein, 18 aa, Entamoeba histolytica
SYIISPFIHLMKQSICSC

SEQ ID NO: 2696827 - protein, 23 aa, Entamoeba histolytica
SYIKEIIKKYYLSGQNVFKQNPE

SEQ ID NO: 2696828 - protein, 25 aa, Entamoeba histolytica
SYILPNKLYGVFGMGESLEVAHLET

SEQ ID NO: 2696829 - protein, 18 aa, Entamoeba histolytica
SYILPRFGDVGIPVTVSM

SEQ ID NO: 2696830 - protein, 18 aa, Entamoeba histolytica
SYILSLFGSKAFPISGYD

SEQ ID NO: 2696831 - protein, 24 aa, Entamoeba histolytica
SYIPKEFIREYLLSTMINGQIASY

SEQ ID NO: 2696832 - protein, 18 aa, Entamoeba histolytica
SYIYNGFLSFAMIATAAE

SEQ ID NO: 2696833 - protein, 23 aa, Entamoeba histolytica
SYKKELLLFILTYVFYPNIIIPQ

SEQ ID NO: 2696834 - protein, 18 aa, Entamoeba histolytica
SYKPFAFGIGSGQSNPLR

SEQ ID NO: 2696835 - protein, 19 aa, Entamoeba histolytica
SYLDECIKHYLNIRKNLLM

SEQ ID NO: 2696836 - protein, 18 aa, Entamoeba histolytica
SYLDSSVVSTRWFGKLSL

SEQ ID NO: 2696837 - protein, 20 aa, Entamoeba histolytica
SYLEIIKIYSSFNVSTVPVI

SEQ ID NO: 2696838 - protein, 19 aa, Entamoeba histolytica
SYLFDDFKDILSLPKIHQE

SEQ ID NO: 2696839 - protein, 25 aa, Entamoeba histolytica
SYLHCEWAYPIKFTVIPRPVRKNNN

SEQ ID NO: 2696840 - protein, 18 aa, Entamoeba histolytica
SYLHLGVFLSVMNYLIHT

SEQ ID NO: 2696841 - protein, 19 aa, Entamoeba histolytica
SYLPAYKIEVVYIADRKTA

SEQ ID NO: 2696842 - protein, 17 aa, Entamoeba histolytica
SYLPQGLIDILRMYINN

SEQ ID NO: 2696843 - protein, 26 aa, Entamoeba histolytica
SYLQENSWIGIYDRFEMNMKNYINSA

SEQ ID NO: 2696844 - protein, 25 aa, Entamoeba histolytica
SYLRCLEISYTFFISFFLTPDNEIY

SEQ ID NO: 2696845 - protein, 25 aa, Entamoeba histolytica
SYLTCLKMVLVLGGDNTLGEDRIGL

SEQ ID NO: 2696846 - protein, 17 aa, Entamoeba histolytica
SYMDWKLNSSGKVEDDE

SEQ ID NO: 2696847 - protein, 18 aa, Entamoeba histolytica
SYMIQPRVKVSVIVKLIQ

SEQ ID NO: 2696848 - protein, 17 aa, Entamoeba histolytica
SYMRIKRFIIVKDNITD

SEQ ID NO: 2696849 - protein, 26 aa, Entamoeba histolytica
SYNKRVPKETICFVYNGDVIDPLLSL

SEQ ID NO: 2696850 - protein, 24 aa, Entamoeba histolytica
SYNQLKTIFDFVTFIQENIKSTSE

SEQ ID NO: 2696851 - protein, 26 aa, Entamoeba histolytica
SYPDIREALFSFIRIVIEYCSEMICE

SEQ ID NO: 2696852 - protein, 27 aa, Entamoeba histolytica
SYPGCIRLSPQTALRFMRIFDTSRTGH

SEQ ID NO: 2696853 - protein, 23 aa, Entamoeba histolytica
SYPSRHAVIHFFNFMKVNKQNIF

SEQ ID NO: 2696854 - protein, 22 aa, Entamoeba histolytica
SYQKRLDVIILLIKKLITDQSS

SEQ ID NO: 2696855 - protein, 26 aa, Entamoeba histolytica
SYQSFKEIWRELGMNKELLLESLTND

SEQ ID NO: 2696856 - protein, 23 aa, Entamoeba histolytica
SYRGNVFKGNYLLEKCLNIASKI

SEQ ID NO: 2696857 - protein, 18 aa, Entamoeba histolytica
SYRSIKLIMAPLKKGKGI

SEQ ID NO: 2696858 - protein, 19 aa, Entamoeba histolytica
SYSGTCPLTAFGVIFLKYN

SEQ ID NO: 2696859 - protein, 19 aa, Entamoeba histolytica
SYSILIICKYFKTPEDFIN

SEQ ID NO: 2696860 - protein, 18 aa, Entamoeba histolytica
SYSSGLFGGQSISSAKLR

SEQ ID NO: 2696861 - protein, 25 aa, Entamoeba histolytica
SYSTVCLLLALWNVVDCPFRAMDEF

SEQ ID NO: 2696862 - protein, 18 aa, Entamoeba histolytica
SYTFGQNVVESFLKKNGF

SEQ ID NO: 2696863 - protein, 19 aa, Entamoeba histolytica
SYTLKDWKDSITIHPITTG

SEQ ID NO: 2696864 - protein, 20 aa, Entamoeba histolytica
SYVDCVKGILFIHKITLKLQ

SEQ ID NO: 2696865 - protein, 19 aa, Entamoeba histolytica
SYVKAVLCEFEASMRLLNE

SEQ ID NO: 2696866 - protein, 17 aa, Entamoeba histolytica
SYVKVEFHLQDLIRKLI

SEQ ID NO: 2696867 - protein, 17 aa, Entamoeba histolytica
SYVLSAIVEKLKHDKEV

SEQ ID NO: 2696868 - protein, 19 aa, Entamoeba histolytica
SYVPVPGIDTVFITLLNQG

SEQ ID NO: 2696869 - protein, 25 aa, Entamoeba histolytica
SYVTSLGVCETCYYREMVKETSPFR

SEQ ID NO: 2696870 - protein, 24 aa, Entamoeba histolytica
SYYIMPCCTTRYVLDAKYSDFTDG

SEQ ID NO: 2696871 - protein, 20 aa, Entamoeba histolytica
SYYRGVMGIVLVYDITSRES

SEQ ID NO: 2696872 - protein, 21 aa, Entamoeba histolytica
SYYRRSFPRMKQFKREDELKI

SEQ ID NO: 2696873 - protein, 19 aa, Entamoeba histolytica
SYYSSPFVSTFQNTSLIPN

SEQ ID NO: 2696874 - protein, 23 aa, Entamoeba histolytica
TAACPPYHLAVVIGGTSAEKNLE

SEQ ID NO: 2696875 - protein, 29 aa, Entamoeba histolytica
TAAIWQVKWSHPRFGPVLASCSYDKQVLI

SEQ ID NO: 2696876 - protein, 18 aa, Entamoeba histolytica
TAALLRFHINTLVKPNIS

SEQ ID NO: 2696877 - protein, 18 aa, Entamoeba histolytica
TACGQPISVYAYEFCGYP

SEQ ID NO: 2696878 - protein, 19 aa, Entamoeba histolytica
TACKLWGYYNEHIDKNEPQ

SEQ ID NO: 2696879 - protein, 23 aa, Entamoeba histolytica
TADCKRCIQELLVKDPEKRLTDP

SEQ ID NO: 2696880 - protein, 17 aa, Entamoeba histolytica
TADPLNVQFVYEKFNYK

SEQ ID NO: 2696881 - protein, 23 aa, Entamoeba histolytica
TAERVGLIEACIVRLMKKNRKMQ

SEQ ID NO: 2696882 - protein, 19 aa, Entamoeba histolytica
TAFCSVKFATELAQNHQRD

SEQ ID NO: 2696883 - protein, 19 aa, Entamoeba histolytica
TAFDGSRIVGIGELSNSTL

SEQ ID NO: 2696884 - protein, 25 aa, Entamoeba histolytica
TAFLKGVMIESCIQSKFGVIGASIH

SEQ ID NO: 2696885 - protein, 19 aa, Entamoeba histolytica
TAFSKQIEEMFGREMTITV

SEQ ID NO: 2696886 - protein, 19 aa, Entamoeba histolytica
TAFSVTWPVTARQFVSLHD

SEQ ID NO: 2696887 - protein, 18 aa, Entamoeba histolytica
TAFYGISGVVIGNSYLLL

SEQ ID NO: 2696888 - protein, 24 aa, Entamoeba histolytica
TAGAALKWIRDIGILKDYNEISKI

SEQ ID NO: 2696889 - protein, 25 aa, Entamoeba histolytica
TAHPTYPLLLVGCIDGRILIINHSL

SEQ ID NO: 2696890 - protein, 18 aa, Entamoeba histolytica
TAIKRYPVVARWRNDVDF

SEQ ID NO: 2696891 - protein, 19 aa, Entamoeba histolytica
TAIKTVRCFGGVPQSSQMK

SEQ ID NO: 2696892 - protein, 20 aa, Entamoeba histolytica
TAIVYRFIINDIKHTSQQKG

SEQ ID NO: 2696893 - protein, 24 aa, Entamoeba histolytica
TAKEKRANKILKMMEGAKEINALD

SEQ ID NO: 2696894 - protein, 26 aa, Entamoeba histolytica
TALEACSGNGLLYCIVEDDETATKLI

SEQ ID NO: 2696895 - protein, 25 aa, Entamoeba histolytica
TALLKRLKDFMLIKVIQGSVHVPQN

SEQ ID NO: 2696896 - protein, 19 aa, Entamoeba histolytica
TALSIYPRACFKEKEIKKS

SEQ ID NO: 2696897 - protein, 19 aa, Entamoeba histolytica
TALSLQFSKRGHFLCVGEY

SEQ ID NO: 2696898 - protein, 24 aa, Entamoeba histolytica
TALTEWVFSPSFIFFKALSPEIIV

SEQ ID NO: 2696899 - protein, 20 aa, Entamoeba histolytica
TAMECLDIYISTLCCVEDSE

SEQ ID NO: 2696900 - protein, 23 aa, Entamoeba histolytica
TAMLWRVDPLVSMGAYSCAGAVS

SEQ ID NO: 2696901 - protein, 23 aa, Entamoeba histolytica
TANVREWVCRKIYEEFISVGSEK

SEQ ID NO: 2696902 - protein, 18 aa, Entamoeba histolytica
TAPIPMQVPLAVDSSNEP

SEQ ID NO: 2696903 - protein, 27 aa, Entamoeba histolytica
TAPKCSCIRSGVFAFKTTQDAVICVSI

SEQ ID NO: 2696904 - protein, 18 aa, Entamoeba histolytica
TAQKAEVVPVDLLDPEKI

SEQ ID NO: 2696905 - protein, 24 aa, Entamoeba histolytica
TAQKFVDELFCSISKIDLTRNQYD

SEQ ID NO: 2696906 - protein, 28 aa, Entamoeba histolytica
TAQTRVARYWPMFPRTFGLFKKLFEEES

SEQ ID NO: 2696907 - protein, 19 aa, Entamoeba histolytica
TARRFLKPNGIILPNQCRL

SEQ ID NO: 2696908 - protein, 25 aa, Entamoeba histolytica
TASGRRPRYIDPFTQEVHQSAPPVV

SEQ ID NO: 2696909 - protein, 19 aa, Entamoeba histolytica
TASIGGKGQIDWKNARQLL

SEQ ID NO: 2696910 - protein, 20 aa, Entamoeba histolytica
TASQKYIFGNIINLFGKDVK

SEQ ID NO: 2696911 - protein, 22 aa, Entamoeba histolytica
TASSIQPEWLFEASPKYFAQLD

SEQ ID NO: 2696912 - protein, 22 aa, Entamoeba histolytica
TATCLLRKVACEGVQAINTGLS

SEQ ID NO: 2696913 - protein, 19 aa, Entamoeba histolytica
TATEEKGIETIVDKKVTTE

SEQ ID NO: 2696914 - protein, 25 aa, Entamoeba histolytica
TATYFRNRHCILFMFDVTNSESFTH

SEQ ID NO: 2696915 - protein, 20 aa, Entamoeba histolytica
TAVIGNWCRVYQSVTLGAMS

SEQ ID NO: 2696916 - protein, 17 aa, Entamoeba histolytica
TAVLYSREPLFERPKEI

SEQ ID NO: 2696917 - protein, 21 aa, Entamoeba histolytica
TAVSIFACLTLFTHGDSFETI

SEQ ID NO: 2696918 - protein, 22 aa, Entamoeba histolytica
TAVSLRLPILTVVSHDDNYSDH

SEQ ID NO: 2696919 - protein, 23 aa, Entamoeba histolytica
TAVSRTYATLSFICVFDDNENEL

SEQ ID NO: 2696920 - protein, 19 aa, Entamoeba histolytica
TAVVKGAAYLAHLKQENAI

SEQ ID NO: 2696921 - protein, 21 aa, Entamoeba histolytica
TAYLVLVEWDDLYIKQPTWVL

SEQ ID NO: 2696922 - protein, 20 aa, Entamoeba histolytica
TCAFDCAVNLGYRGYAAKVI

SEQ ID NO: 2696923 - protein, 21 aa, Entamoeba histolytica
TCAICLSNISECCVTKCGHAF

SEQ ID NO: 2696924 - protein, 17 aa, Entamoeba histolytica
TCAVDCHKAMLWDSDAS

SEQ ID NO: 2696925 - protein, 23 aa, Entamoeba histolytica
TCDLKYRIGDNVFTAAQDFLTQN

SEQ ID NO: 2696926 - protein, 17 aa, Entamoeba histolytica
TCDNCYNPSPTEVIDMT

SEQ ID NO: 2696927 - protein, 28 aa, Entamoeba histolytica
TCEPCIMCAEALKQCGITKIIYGCSNAR

SEQ ID NO: 2696928 - protein, 18 aa, Entamoeba histolytica
TCFFKRFSSGEFNPNTAS

SEQ ID NO: 2696929 - protein, 18 aa, Entamoeba histolytica
TCFKSRCDSPSSPIPHLL

SEQ ID NO: 2696930 - protein, 18 aa, Entamoeba histolytica
TCGKKLYEDVIKRFDYLL

SEQ ID NO: 2696931 - protein, 24 aa, Entamoeba histolytica
TCHDRYGEMYNIFELNHLKTNKPL

SEQ ID NO: 2696932 - protein, 18 aa, Entamoeba histolytica
TCHFRPITMDSPHQLSIS

SEQ ID NO: 2696933 - protein, 23 aa, Entamoeba histolytica
TCHHGRISVFGVFDGHMGTSASD

SEQ ID NO: 2696934 - protein, 18 aa, Entamoeba histolytica
TCHKRVYFNERLTFAGKD

SEQ ID NO: 2696935 - protein, 21 aa, Entamoeba histolytica
TCHYCKKRKPVSFQCLKFPSH

SEQ ID NO: 2696936 - protein, 17 aa, Entamoeba histolytica
TCIEYCKKYSIIKRSRM

SEQ ID NO: 2696937 - protein, 24 aa, Entamoeba histolytica
TCKCADCISLGVPLEFTQKDMPKW

SEQ ID NO: 2696938 - protein, 23 aa, Entamoeba histolytica
TCKLHYCVIEFDKPIKMDTFIGT

SEQ ID NO: 2696939 - protein, 19 aa, Entamoeba histolytica
TCLCRTCRYNTTIKNLGWD

SEQ ID NO: 2696940 - protein, 19 aa, Entamoeba histolytica
TCLEHEFTLVIPHRTLTLT

SEQ ID NO: 2696941 - protein, 20 aa, Entamoeba histolytica
TCLERYSKNYVHYMKNISEK

SEQ ID NO: 2696942 - protein, 17 aa, Entamoeba histolytica
TCLHVGDPDTPGYIKAL

SEQ ID NO: 2696943 - protein, 17 aa, Entamoeba histolytica
TCLKEYPLLLRMVENDV

SEQ ID NO: 2696944 - protein, 17 aa, Entamoeba histolytica
TCLLLTYTTNSFPDSYV

SEQ ID NO: 2696945 - protein, 17 aa, Entamoeba histolytica
TCLLLTYTTNSFPDTYV

SEQ ID NO: 2696946 - protein, 20 aa, Entamoeba histolytica
TCLTYLCFAHNQILEIPPTI

SEQ ID NO: 2696947 - protein, 18 aa, Entamoeba histolytica
TCMLIRLSQNFFDTQHNP

SEQ ID NO: 2696948 - protein, 19 aa, Entamoeba histolytica
TCNELRKEWNFDEIGIICI

SEQ ID NO: 2696949 - protein, 17 aa, Entamoeba histolytica
TCPVCYEDGILVGERCS

SEQ ID NO: 2696950 - protein, 22 aa, Entamoeba histolytica
TCQKVYCGYNKIYILADKELKV

SEQ ID NO: 2696951 - protein, 20 aa, Entamoeba histolytica
TCQTFYHLLCLKRLGRENHL

SEQ ID NO: 2696952 - protein, 34 aa, Entamoeba histolytica
TCQTLVFNLTWSWVVSLRELRKSTLGVIPTPAAN

SEQ ID NO: 2696953 - protein, 19 aa, Entamoeba histolytica
TCQYFFPEMSADFFPKVWA

SEQ ID NO: 2696954 - protein, 32 aa, Entamoeba histolytica
TCVPEGQCVFVGGAIESLGKWDVSKAIKMTPT

SEQ ID NO: 2696955 - protein, 26 aa, Entamoeba histolytica
TCVPRCFKCGKPLDGKYLVVDDHNYH

SEQ ID NO: 2696956 - protein, 18 aa, Entamoeba histolytica
TCVVKFADCVVARIVAET

SEQ ID NO: 2696957 - protein, 24 aa, Entamoeba histolytica
TCWPAEAQNGLTLSMSYEATQELK

SEQ ID NO: 2696958 - protein, 20 aa, Entamoeba histolytica
TCYMNCILQSIAHSKLFQNF

SEQ ID NO: 2696959 - protein, 18 aa, Entamoeba histolytica
TCYQIDFSNILLNNYQKI

SEQ ID NO: 2696960 - protein, 23 aa, Entamoeba histolytica
TDAELWKRLADMFKEDGDMEQYY

SEQ ID NO: 2696961 - protein, 20 aa, Entamoeba histolytica
TDAVIKLHCTLFEKSTPGFY

SEQ ID NO: 2696962 - protein, 17 aa, Entamoeba histolytica
TDCCPAHSNVDVPVIKR

SEQ ID NO: 2696963 - protein, 27 aa, Entamoeba histolytica
TDDEVWFRKRMQVVNVLLPDGSTKKMM

SEQ ID NO: 2696964 - protein, 17 aa, Entamoeba histolytica
TDDFIWKLVRLLVNNGL

SEQ ID NO: 2696965 - protein, 19 aa, Entamoeba histolytica
TDEAIICGAHVSFKKKQCF

SEQ ID NO: 2696966 - protein, 19 aa, Entamoeba histolytica
TDECFKECYSLTSFNIPTT

SEQ ID NO: 2696967 - protein, 19 aa, Entamoeba histolytica
TDECFKECYSLTSMNIPIT

SEQ ID NO: 2696968 - protein, 33 aa, Entamoeba histolytica
TDECLEVRLTLLTACGKIYCEVPFTETTQKVLE

SEQ ID NO: 2696969 - protein, 19 aa, Entamoeba histolytica
TDEEIKNLLLFKENSNGST

SEQ ID NO: 2696970 - protein, 23 aa, Entamoeba histolytica
TDEFRKVFFSTVVKIRELLFSDE

SEQ ID NO: 2696971 - protein, 23 aa, Entamoeba histolytica
TDEIIKFLVGFIPDLAGYFNGDE

SEQ ID NO: 2696972 - protein, 22 aa, Entamoeba histolytica
TDEKPYCTLRCYNSALEHNITS

SEQ ID NO: 2696973 - protein, 25 aa, Entamoeba histolytica
TDELHLKAGAFVMINKNIDVERGLV

SEQ ID NO: 2696974 - protein, 18 aa, Entamoeba histolytica
TDFIPFECVEAIIHSPLW

SEQ ID NO: 2696975 - protein, 17 aa, Entamoeba histolytica
TDFKARIFNAFNKTLDP

SEQ ID NO: 2696976 - protein, 28 aa, Entamoeba histolytica
TDFKSYKGTHVIPEFHNFQAVIGPNGAG

SEQ ID NO: 2696977 - protein, 25 aa, Entamoeba histolytica
TDFNKKLCQEFISWISNNQKIAAFM

SEQ ID NO: 2696978 - protein, 24 aa, Entamoeba histolytica
TDFQSEGLFNLSLLINDGDGDIDK

SEQ ID NO: 2696979 - protein, 26 aa, Entamoeba histolytica
TDGILKECLLYGIGMHHAGLNDHDRE

SEQ ID NO: 2696980 - protein, 26 aa, Entamoeba histolytica
TDHIGAEYKAQVVVVNEEDFLNQSSD

SEQ ID NO: 2696981 - protein, 23 aa, Entamoeba histolytica
TDHKMYIFQFMFMINNDTDSTKK

SEQ ID NO: 2696982 - protein, 23 aa, Entamoeba histolytica
TDHKMYIFQFMFMINNDTDTPKK

SEQ ID NO: 2696983 - protein, 23 aa, Entamoeba histolytica
TDHKMYIFQFMFMINTDTDPPKK

SEQ ID NO: 2696984 - protein, 17 aa, Entamoeba histolytica
TDIDFTIHYSRMKEGEC

SEQ ID NO: 2696985 - protein, 29 aa, Entamoeba histolytica
TDIDLYFYPCVKCGNAASQVNSFITQANT

SEQ ID NO: 2696986 - protein, 25 aa, Entamoeba histolytica
TDIFKEGKHLFGLHDIVQKGIEINE

SEQ ID NO: 2696987 - protein, 24 aa, Entamoeba histolytica
TDIFLLCFSVVYHASYINVRDKWV

SEQ ID NO: 2696988 - protein, 20 aa, Entamoeba histolytica
TDIKMILTHQFKKTNIILLQ

SEQ ID NO: 2696989 - protein, 17 aa, Entamoeba histolytica
TDIKNCPKNKGASFSAV

SEQ ID NO: 2696990 - protein, 25 aa, Entamoeba histolytica
TDILWKKYSLCLVKQIVKKHNSFNN

SEQ ID NO: 2696991 - protein, 27 aa, Entamoeba histolytica
TDINKLRGCAMCSALSNRGYFLKQNQE

SEQ ID NO: 2696992 - protein, 31 aa, Entamoeba histolytica
TDINLSYKILKLCIEDGILINTSSPAVLAEQ

SEQ ID NO: 2696993 - protein, 17 aa, Entamoeba histolytica
TDISAMLRTPIYITSCN

SEQ ID NO: 2696994 - protein, 18 aa, Entamoeba histolytica
TDIWSTKNLKTFETQDLY

SEQ ID NO: 2696995 - protein, 24 aa, Entamoeba histolytica
TDKDWKLLLNYSRSMFRVLNKLLP

SEQ ID NO: 2696996 - protein, 24 aa, Entamoeba histolytica
TDKEIEKFLAWARSLSPIKPIEKV

SEQ ID NO: 2696997 - protein, 17 aa, Entamoeba histolytica
TDKICSSNENWKWKYLT

SEQ ID NO: 2696998 - protein, 24 aa, Entamoeba histolytica
TDKLLTIPALFPLLNIIKKQYISP

SEQ ID NO: 2696999 - protein, 24 aa, Entamoeba histolytica
TDKQLHCVHIFNMIERKLKTIGGY

SEQ ID NO: 2697000 - protein, 23 aa, Entamoeba histolytica
TDKRKPWTGILLFGPPGTGKSFL

SEQ ID NO: 2697001 - protein, 17 aa, Entamoeba histolytica
TDLATGCANTFVTADGE

SEQ ID NO: 2697002 - protein, 27 aa, Entamoeba histolytica
TDLDYSIAWRTMSDWGSIVSYNTSLNE

SEQ ID NO: 2697003 - protein, 19 aa, Entamoeba histolytica
TDLECALSIDISVDCDNGI

SEQ ID NO: 2697004 - protein, 19 aa, Entamoeba histolytica
TDLFQFFIMTLFKQINAQG

SEQ ID NO: 2697005 - protein, 23 aa, Entamoeba histolytica
TDLFRSLRVNWIITKVREGLKNH

SEQ ID NO: 2697006 - protein, 19 aa, Entamoeba histolytica
TDLGLRTMIFVHFNALISD

SEQ ID NO: 2697007 - protein, 23 aa, Entamoeba histolytica
TDLKKKVDILAYWVSQSLYESVQ

SEQ ID NO: 2697008 - protein, 22 aa, Entamoeba histolytica
TDLKRNILINAFQFDSGENDPN

SEQ ID NO: 2697009 - protein, 20 aa, Entamoeba histolytica
TDLLEPLGCIGDRQYSFKKN

SEQ ID NO: 2697010 - protein, 20 aa, Entamoeba histolytica
TDLLIHLGYSINFKKTRSTR

SEQ ID NO: 2697011 - protein, 24 aa, Entamoeba histolytica
TDLLLKRFLCSVLVTTIPKENKEF

SEQ ID NO: 2697012 - protein, 21 aa, Entamoeba histolytica
TDLLNMPSLVKKNYFEIFNMI

SEQ ID NO: 2697013 - protein, 24 aa, Entamoeba histolytica
TDLMCFYMIKGYKSFFQKRYFQFL

SEQ ID NO: 2697014 - protein, 17 aa, Entamoeba histolytica
TDLNLGLNEQVKITKFE

SEQ ID NO: 2697015 - protein, 18 aa, Entamoeba histolytica
TDLNMFGRLVSLLNDLCG

SEQ ID NO: 2697016 - protein, 25 aa, Entamoeba histolytica
TDLRFLLFPCHYESHWFTVIVCNKT

SEQ ID NO: 2697017 - protein, 17 aa, Entamoeba histolytica
TDLSIKWGVRGSRISHN

SEQ ID NO: 2697018 - protein, 28 aa, Entamoeba histolytica
TDLVCAWYLNNTCCVWSIESSQIIASFS

SEQ ID NO: 2697019 - protein, 24 aa, Entamoeba histolytica
TDMKEGMLYFLLNDFKNTLVGIQH

SEQ ID NO: 2697020 - protein, 25 aa, Entamoeba histolytica
TDMLDNYYKYFGMGITFIEESDKFK

SEQ ID NO: 2697021 - protein, 24 aa, Entamoeba histolytica
TDMLKHLLLTALCYSFKNDTFLLK

SEQ ID NO: 2697022 - protein, 24 aa, Entamoeba histolytica
TDNDCKRWFWELLQNAKDSIAHDP

SEQ ID NO: 2697023 - protein, 33 aa, Entamoeba histolytica
TDNMFEFWDWVGGRYSLWSAIGLTIMISIGEQG

SEQ ID NO: 2697024 - protein, 22 aa, Entamoeba histolytica
TDNQQPFGFGTTNNLSFNSFNG

SEQ ID NO: 2697025 - protein, 18 aa, Entamoeba histolytica
TDPKSFVILPSYVSSNPK

SEQ ID NO: 2697026 - protein, 23 aa, Entamoeba histolytica
TDPLKSVNFFNGYLEVIKQNCDA

SEQ ID NO: 2697027 - protein, 18 aa, Entamoeba histolytica
TDQCLYRIIKRSNEEKEI

SEQ ID NO: 2697028 - protein, 18 aa, Entamoeba histolytica
TDRFRLVEFYEFRDEIKK

SEQ ID NO: 2697029 - protein, 20 aa, Entamoeba histolytica
TDRFVSMIINHVSFQVIKNL

SEQ ID NO: 2697030 - protein, 19 aa, Entamoeba histolytica
TDRHLGLEMQFDYIQLDFQ

SEQ ID NO: 2697031 - protein, 19 aa, Entamoeba histolytica
TDRSFCSNINYLSGKGEIN

SEQ ID NO: 2697032 - protein, 17 aa, Entamoeba histolytica
TDSELKMIMGILKKYEE

SEQ ID NO: 2697033 - protein, 22 aa, Entamoeba histolytica
TDSVAWLISFGILNRIKTYILC

SEQ ID NO: 2697034 - protein, 18 aa, Entamoeba histolytica
TDTCLYKINGWGCIGKDS

SEQ ID NO: 2697035 - protein, 17 aa, Entamoeba histolytica
TDTFDVLNQINPVVIRL

SEQ ID NO: 2697036 - protein, 21 aa, Entamoeba histolytica
TDTLADCFAFLETKGYKKREI

SEQ ID NO: 2697037 - protein, 25 aa, Entamoeba histolytica
TDTLEFDGGIILFRLYSLIIRMLFI

SEQ ID NO: 2697038 - protein, 20 aa, Entamoeba histolytica
TDTYLPLPFMPKLQILTIRF

SEQ ID NO: 2697039 - protein, 18 aa, Entamoeba histolytica
TDVFSPKPSQSESIPPKI

SEQ ID NO: 2697040 - protein, 23 aa, Entamoeba histolytica
TDVICCTCCGALDTRLSGILEHI

SEQ ID NO: 2697041 - protein, 17 aa, Entamoeba histolytica
TDVIIGTVAFRLVDSNN

SEQ ID NO: 2697042 - protein, 25 aa, Entamoeba histolytica
TDVIKVCVIGAMKTSNMYLRIVALD

SEQ ID NO: 2697043 - protein, 20 aa, Entamoeba histolytica
TDVIPCTKLNQWMDDYDNYL

SEQ ID NO: 2697044 - protein, 21 aa, Entamoeba histolytica
TDVVWSIKCHEEFPIIASASE

SEQ ID NO: 2697045 - protein, 17 aa, Entamoeba histolytica
TDWDGNVLVVEYSEATE

SEQ ID NO: 2697046 - protein, 18 aa, Entamoeba histolytica
TDYFEHWNYLSLAANEDD

SEQ ID NO: 2697047 - protein, 25 aa, Entamoeba histolytica
TDYIVRFFGHFFVDKDLWIVMEICG

SEQ ID NO: 2697048 - protein, 33 aa, Entamoeba histolytica; identical to SEQ ID NO: 2506068

SEQ ID NO: 2697049 - protein, 19 aa, Entamoeba histolytica
TEAFVLHVFHYKELPKTLV

SEQ ID NO: 2697050 - protein, 19 aa, Entamoeba histolytica
TEALKIIVGILKFSEPYVI

SEQ ID NO: 2697051 - protein, 19 aa, Entamoeba histolytica
TEALKYCQEMNCICCDLKP

SEQ ID NO: 2697052 - protein, 18 aa, Entamoeba histolytica
TEALKYCQEMNCIHRDLK

SEQ ID NO: 2697053 - protein, 20 aa, Entamoeba histolytica
TEALNACANGLVMDIDQDLI

SEQ ID NO: 2697054 - protein, 20 aa, Entamoeba histolytica
TEAVIRGDIEYDRNLHQMHL

SEQ ID NO: 2697055 - protein, 24 aa, Entamoeba histolytica
TECARWYYHCDTIGIIVWQDMPSR

SEQ ID NO: 2697056 - protein, 20 aa, Entamoeba histolytica
TECLTMWKRLENKNNQIINS

SEQ ID NO: 2697057 - protein, 23 aa, Entamoeba histolytica
TECNNSGLLYFCKGTTIEETTTL

SEQ ID NO: 2697058 - protein, 23 aa, Entamoeba histolytica
TEDEIRGAYGMGTSDELAARVIV

SEQ ID NO: 2697059 - protein, 22 aa, Entamoeba histolytica
TEDEIRLFPLISPKLKNKEIIV

SEQ ID NO: 2697060 - protein, 20 aa, Entamoeba histolytica
TEDEIRPVILVDYVNDHFSP

SEQ ID NO: 2697061 - protein, 19 aa, Entamoeba histolytica
TEDGKLIFQEGILVEAVRK

SEQ ID NO: 2697062 - protein, 20 aa, Entamoeba histolytica
TEDLKVSSIHFGDKDNMFSV

SEQ ID NO: 2697063 - protein, 31 aa, Entamoeba histolytica
TEDVFTQMFWKLGMKSFDDFITKLEILPRKS

SEQ ID NO: 2697064 - protein, 20 aa, Entamoeba histolytica
TEDVSLPLGYVISIINNSNA

SEQ ID NO: 2697065 - protein, 26 aa, Entamoeba histolytica
TEEEFKYFKECIINVGLTYDDIKDLE

SEQ ID NO: 2697066 - protein, 20 aa, Entamoeba histolytica
TEEKGTEGIYSFSTDMDETD

SEQ ID NO: 2697067 - protein, 22 aa, Entamoeba histolytica
TEEKMRVSMCITENEKYIKRKK

SEQ ID NO: 2697068 - protein, 19 aa, Entamoeba histolytica
TEEPFSFGDGFNFDTIEKN

SEQ ID NO: 2697069 - protein, 22 aa, Entamoeba histolytica
TEESWPGVTQMINWSNRFPKFK

SEQ ID NO: 2697070 - protein, 28 aa, Entamoeba histolytica
TEETRECKDCGFVLMDVDDVKIQDLRPK

SEQ ID NO: 2697071 - protein, 19 aa, Entamoeba histolytica
TEETYQFYQALKIFGTDFE

SEQ ID NO: 2697072 - protein, 29 aa, Entamoeba histolytica
TEEVNLGFGVCKCIDFLKTHGGVDDGIKE

SEQ ID NO: 2697073 - protein, 19 aa, Entamoeba histolytica
TEFCLYQFTVPLNYGKEDE

SEQ ID NO: 2697074 - protein, 17 aa, Entamoeba histolytica
TEFDYEWMIPLKSIHSF

SEQ ID NO: 2697075 - protein, 17 aa, Entamoeba histolytica
TEFHWDRNRLFDRLICD

SEQ ID NO: 2697076 - protein, 19 aa, Entamoeba histolytica
TEFITQIGLLSLKDIIPIF

SEQ ID NO: 2697077 - protein, 17 aa, Entamoeba histolytica
TEFLSICQFLLPIELRY

SEQ ID NO: 2697078 - protein, 17 aa, Entamoeba histolytica
TEFPHLHRAPILSKDVL

SEQ ID NO: 2697079 - protein, 21 aa, Entamoeba histolytica
TEFPQLKIVWSYSPQMTTHIF

SEQ ID NO: 2697080 - protein, 21 aa, Entamoeba histolytica
TEFQHPSFISYQPIKREPIDP

SEQ ID NO: 2697081 - protein, 19 aa, Entamoeba histolytica
TEGETTFLHVLKYENEKLT

SEQ ID NO: 2697082 - protein, 18 aa, Entamoeba histolytica
TEGFAVKEEWLYDCISEM

SEQ ID NO: 2697083 - protein, 24 aa, Entamoeba histolytica
TEGICLSLLKGDFKLVIKHLPEIC

SEQ ID NO: 2697084 - protein, 25 aa, Entamoeba histolytica
TEGIFRVNAVYTWMNRVKELLNSGQ

SEQ ID NO: 2697085 - protein, 23 aa, Entamoeba histolytica
TEGLFRIPGNMSVVNNLKKEYNE

SEQ ID NO: 2697086 - protein, 24 aa, Entamoeba histolytica
TEGNIIRMFLFRWKNGQHYINNEK

SEQ ID NO: 2697087 - protein, 25 aa, Entamoeba histolytica
TEGVNFRAALQFGNLVDVDTVETND

SEQ ID NO: 2697088 - protein, 23 aa, Entamoeba histolytica
TEHQIKRLVLIYLESIDKMDKGE

SEQ ID NO: 2697089 - protein, 22 aa, Entamoeba histolytica
TEICGFIAISFLKLIPEKFTLP

SEQ ID NO: 2697090 - protein, 23 aa, Entamoeba histolytica
TEIEELKLVFEYNTIFVEQEIPG

SEQ ID NO: 2697091 - protein, 30 aa, Entamoeba histolytica
TEIELWKVLTNCYGKWIINQSVVSSWKDVM

SEQ ID NO: 2697092 - protein, 17 aa, Entamoeba histolytica
TEIFSIINEQQKTTNEL

SEQ ID NO: 2697093 - protein, 17 aa, Entamoeba histolytica
TEIGDRCFLQCSSLKSI

SEQ ID NO: 2697094 - protein, 19 aa, Entamoeba histolytica
TEIISAISYESLSPIYFSG

SEQ ID NO: 2697095 - protein, 19 aa, Entamoeba histolytica
TEIITLWYRPPEILLGATH

SEQ ID NO: 2697096 - protein, 23 aa, Entamoeba histolytica
TEIITPIVRRSRRSNYTPQSTPS

SEQ ID NO: 2697097 - protein, 21 aa, Entamoeba histolytica
TEIKGSRFVGVKKPGRGILIL

SEQ ID NO: 2697098 - protein, 21 aa, Entamoeba histolytica
TEIKKKSTAALRDEAALKQQS

SEQ ID NO: 2697099 - protein, 21 aa, Entamoeba histolytica
TEILLGITMSRCKILIDNREC

SEQ ID NO: 2697100 - protein, 26 aa, Entamoeba histolytica
TEIPQKWMYCFLFNDRLVETMPISID

SEQ ID NO: 2697101 - protein, 22 aa, Entamoeba histolytica
TEIPSYHKILLTGTPIQNNIDE

SEQ ID NO: 2697102 - protein, 25 aa, Entamoeba histolytica
TEISFKLKEMYYLLTQGGVAELELV

SEQ ID NO: 2697103 - protein, 20 aa, Entamoeba histolytica
TEIYKILKLNKEDYPFEYLF

SEQ ID NO: 2697104 - protein, 28 aa, Entamoeba histolytica
TEIYYNVWRIKERILCIGTSRQHAIENM

SEQ ID NO: 2697105 - protein, 23 aa, Entamoeba histolytica
TEKCEKCNGSGRVSETTEFNITI

SEQ ID NO: 2697106 - protein, 25 aa, Entamoeba histolytica
TEKFGFKTETIWKYNTFIYDLFCEF

SEQ ID NO: 2697107 - protein, 27 aa, Entamoeba histolytica
TEKKMVLDFTAPFKRISYVHALEEKFG

SEQ ID NO: 2697108 - protein, 25 aa, Entamoeba histolytica
TEKKRLFKKWEVILFRKQDRKKKSS

SEQ ID NO: 2697109 - protein, 17 aa, Entamoeba histolytica
TEKKWKIIITKRNKIEE

SEQ ID NO: 2697110 - protein, 21 aa, Entamoeba histolytica
TEKLEFDEMLFSNNHVLLEAL

SEQ ID NO: 2697111 - protein, 20 aa, Entamoeba histolytica
TEKLIILACDGIWDVLTNEQ

SEQ ID NO: 2697112 - protein, 18 aa, Entamoeba histolytica
TEKLKLYFRCFKTNKKGE

SEQ ID NO: 2697113 - protein, 17 aa, Entamoeba histolytica
TEKRVDPFTAFLQGDQK

SEQ ID NO: 2697114 - protein, 18 aa, Entamoeba histolytica
TELAKLIVDIAYCRLSSD

SEQ ID NO: 2697115 - protein, 17 aa, Entamoeba histolytica
TELCQYKYCSVVPLLER

SEQ ID NO: 2697116 - protein, 18 aa, Entamoeba histolytica
TELFKFIQRHFFKNQFDF

SEQ ID NO: 2697117 - protein, 25 aa, Entamoeba histolytica
TELFRTKANYDLRFNVKLSNDDNDD

SEQ ID NO: 2697118 - protein, 21 aa, Entamoeba histolytica
TELFRTKANYDLRFNVKLSNN

SEQ ID NO: 2697119 - protein, 25 aa, Entamoeba histolytica
TELFRTKANYDLRFNVKLSNNDNND

SEQ ID NO: 2697120 - protein, 23 aa, Entamoeba histolytica
TELIEIKLSFILLTLKNLNIKKV

SEQ ID NO: 2697121 - protein, 24 aa, Entamoeba histolytica
TELIEIKLSFILLTLKNLNIKKVP

SEQ ID NO: 2697122 - protein, 19 aa, Entamoeba histolytica
TELIRCFHPLQTTHDIYNF

SEQ ID NO: 2697123 - protein, 21 aa, Entamoeba histolytica
TELKIKAIENGCRVIYAHEEN

SEQ ID NO: 2697124 - protein, 22 aa, Entamoeba histolytica
TELKNGQCQLVLIDLNTMESKS

SEQ ID NO: 2697125 - protein, 20 aa, Entamoeba histolytica
TELKSSWEKCLSSLPKEQRK

SEQ ID NO: 2697126 - protein, 22 aa, Entamoeba histolytica
TELLKRWTGMRNFRIIFEKTIG

SEQ ID NO: 2697127 - protein, 24 aa, Entamoeba histolytica
TELLLRKAPFQALVREIAQVSKSD

SEQ ID NO: 2697128 - protein, 25 aa, Entamoeba histolytica
TELLTRLGCEIIPLNIKPTGDFPHI

SEQ ID NO: 2697129 - protein, 20 aa, Entamoeba histolytica
TELMKIYTLHMIAAGITSGK

SEQ ID NO: 2697130 - protein, 17 aa, Entamoeba histolytica
TELMNLIKVSSFCKEGI

SEQ ID NO: 2697131 - protein, 21 aa, Entamoeba histolytica
TELPCSGDIDLSCNQIVELDL

SEQ ID NO: 2697132 - protein, 19 aa, Entamoeba histolytica
TELQSLVIILTLKEINDEL

SEQ ID NO: 2697133 - protein, 17 aa, Entamoeba histolytica
TELRFVKVSEDYNKLKR

SEQ ID NO: 2697134 - protein, 20 aa, Entamoeba histolytica
TELRIKEILKNINDKQEKIE

SEQ ID NO: 2697135 - protein, 31 aa, Entamoeba histolytica
TELTDRILSMFKIKPTYTFNMLNLELKQPEQ

SEQ ID NO: 2697136 - protein, 19 aa, Entamoeba histolytica
TELYSHSSLDPKKHSPPSL

SEQ ID NO: 2697137 - protein, 39 aa, Entamoeba histolytica
TENNHCKFVWLFLLRNAFYKNCRMVLDLHEFNVNEFNIN

SEQ ID NO: 2697138 - protein, 24 aa, Entamoeba histolytica
TENTKRVIQFLAMTAGQSKKAGQL

SEQ ID NO: 2697139 - protein, 19 aa, Entamoeba histolytica
TEPFLQLATFYLHSTTENG

SEQ ID NO: 2697140 - protein, 18 aa, Entamoeba histolytica
TEPLFDIKSHSPLIKTTS

SEQ ID NO: 2697141 - protein, 21 aa, Entamoeba histolytica
TEPMVQITFMLEKYIVEHYFN

SEQ ID NO: 2697142 - protein, 20 aa, Entamoeba histolytica
TEPPFIPIIVLIKQELMKIN

SEQ ID NO: 2697143 - protein, 21 aa, Entamoeba histolytica
TEPYFRAPASFLPIRERREET

SEQ ID NO: 2697144 - protein, 20 aa, Entamoeba histolytica
TEQALKEGAETVSQGSTTTV

SEQ ID NO: 2697145 - protein, 24 aa, Entamoeba histolytica
TEQFFKVFLYPIIRHSIHQNKKLH

SEQ ID NO: 2697146 - protein, 23 aa, Entamoeba histolytica
TEQKRKKIVIGFQEINQITKENQ

SEQ ID NO: 2697147 - protein, 26 aa, Entamoeba histolytica
TEQLKKIEMEKCSKLNIESDVKGKEV

SEQ ID NO: 2697148 - protein, 23 aa, Entamoeba histolytica
TEQNIPPAQNWKLQLSEKLGSLR

SEQ ID NO: 2697149 - protein, 23 aa, Entamoeba histolytica
TEQYKAIIFIGPVWWWGLNAPIK

SEQ ID NO: 2697150 - protein, 17 aa, Entamoeba histolytica
TERCRRESPTHSVKNSP

SEQ ID NO: 2697151 - protein, 19 aa, Entamoeba histolytica
TERCSNCNKDNILGTFVYK

SEQ ID NO: 2697152 - protein, 25 aa, Entamoeba histolytica
TERFRCISESFFRGTDGCVLVCSVT

SEQ ID NO: 2697153 - protein, 25 aa, Entamoeba histolytica
TERTCPGRNVSSVPIRLRIYSSSVV

SEQ ID NO: 2697154 - protein, 24 aa, Entamoeba histolytica
TESFAEGLVHIIPSQAEILAGQQE

SEQ ID NO: 2697155 - protein, 24 aa, Entamoeba histolytica
TESHGFLYIIMEYMESGSLLNIVK

SEQ ID NO: 2697156 - protein, 25 aa, Entamoeba histolytica
TESIFKFDFSSLFGNYPPALKLHAQ

SEQ ID NO: 2697157 - protein, 24 aa, Entamoeba histolytica
TESKAWPDYVFLKGTSFSSSNKDK

SEQ ID NO: 2697158 - protein, 21 aa, Entamoeba histolytica
TESQKALSILFNLFTSKESNN

SEQ ID NO: 2697159 - protein, 20 aa, Entamoeba histolytica
TESTCFKQLILGPTPTDIEA

SEQ ID NO: 2697160 - protein, 23 aa, Entamoeba histolytica
TETCPLCTTGKPLNFGLLEGTKK

SEQ ID NO: 2697161 - protein, 25 aa, Entamoeba histolytica
TETDCLKCSFVVTTTLAFQFRVNVE

SEQ ID NO: 2697162 - protein, 33 aa, Entamoeba histolytica
TETDRVFEQINWRKMEMGIQFKAIDKGKYYVMY

SEQ ID NO: 2697163 - protein, 17 aa, Entamoeba histolytica
TETKEWGEFAHKPGIVY

SEQ ID NO: 2697164 - protein, 18 aa, Entamoeba histolytica
TETQWKIPRTFKLKQEQH

SEQ ID NO: 2697165 - protein, 18 aa, Entamoeba histolytica
TETVPIINSNPFNQIQNP

SEQ ID NO: 2697166 - protein, 23 aa, Entamoeba histolytica
TEVATEFLSFIASEAADVPKGSV

SEQ ID NO: 2697167 - protein, 20 aa, Entamoeba histolytica
TEVAYCCFKDAQGAQNALAK

SEQ ID NO: 2697168 - protein, 25 aa, Entamoeba histolytica
TEVDGFRISVDFARREEARDKTPGR

SEQ ID NO: 2697169 - protein, 24 aa, Entamoeba histolytica
TEVIPMKLSNTFGVIKGNEFCLFN

SEQ ID NO: 2697170 - protein, 23 aa, Entamoeba histolytica
TEVKEAFISLCQRLRKFAKPEMK

SEQ ID NO: 2697171 - protein, 18 aa, Entamoeba histolytica
TEVLLSLLTFLVSNLSTE

SEQ ID NO: 2697172 - protein, 20 aa, Entamoeba histolytica
TEVPEGISIKNIHDSINDVC

SEQ ID NO: 2697173 - protein, 25 aa, Entamoeba histolytica
TEWGYKSLRKLCRYYGKANNEEEFK

SEQ ID NO: 2697174 - protein, 18 aa, Entamoeba histolytica
TEYGKKCVMRAKIDMKHK

SEQ ID NO: 2697175 - protein, 17 aa, Entamoeba histolytica
TEYIPSAPVEKIIDVCQ

SEQ ID NO: 2697176 - protein, 22 aa, Entamoeba histolytica
TEYMPYHGYHIIDFNDVDPRFG

SEQ ID NO: 2697177 - protein, 23 aa, Entamoeba histolytica
TEYMQRLLRSCGYIYTTSQQMEL

SEQ ID NO: 2697178 - protein, 26 aa, Entamoeba histolytica
TEYRMLWFRFDIRKLYFLRHGDPREE

SEQ ID NO: 2697179 - protein, 26 aa, Entamoeba histolytica
TEYTNAFAFNLCINMCDSIDIISKMW

SEQ ID NO: 2697180 - protein, 23 aa, Entamoeba histolytica
TFAVPVKVPISFTKEINKKSNHV

SEQ ID NO: 2697181 - protein, 27 aa, Entamoeba histolytica
TFCGTPDYLAPEILKGVGHGPGVDWWS

SEQ ID NO: 2697182 - protein, 24 aa, Entamoeba histolytica
TFCGYRSLPYIVLDKISMAKTQDS

SEQ ID NO: 2697183 - protein, 25 aa, Entamoeba histolytica
TFCIPFEFFEDVLPLIITTLSKVEK

SEQ ID NO: 2697184 - protein, 17 aa, Entamoeba histolytica
TFCKLAHMFGTKLVDCV

SEQ ID NO: 2697185 - protein, 19 aa, Entamoeba histolytica
TFDDFKRRTDICMRRAFTV

SEQ ID NO: 2697186 - protein, 25 aa, Entamoeba histolytica
TFDQMKEWFVKKVIPQIISRKKQFQ

SEQ ID NO: 2697187 - protein, 17 aa, Entamoeba histolytica
TFEDAFCKTSNEDYKIF

SEQ ID NO: 2697188 - protein, 19 aa, Entamoeba histolytica
TFFKKFGYEKVVDQIMKAD

SEQ ID NO: 2697189 - protein, 24 aa, Entamoeba histolytica
TFFTCQRFKEPTLLTCEKGIYLLL

SEQ ID NO: 2697190 - protein, 19 aa, Entamoeba histolytica
TFGFFSFEVDPLFLVAQYL

SEQ ID NO: 2697191 - protein, 24 aa, Entamoeba histolytica
TFGGVCCGCPGLNDPKILSIGVPF

SEQ ID NO: 2697192 - protein, 18 aa, Entamoeba histolytica
TFGPGMIVSDDLKEQMRT

SEQ ID NO: 2697193 - protein, 18 aa, Entamoeba histolytica
TFGQVFKCVDLLDKEKEV

SEQ ID NO: 2697194 - protein, 18 aa, Entamoeba histolytica
TFGQVFKCYDHINNRFCA

SEQ ID NO: 2697195 - protein, 33 aa, Entamoeba histolytica
TFGRGHPRFRKPRIGGDGVYEFDILHYAGTVTY

SEQ ID NO: 2697196 - protein, 23 aa, Entamoeba histolytica
TFGSIIGSFALFFKSTGSSLTSS

SEQ ID NO: 2697197 - protein, 22 aa, Entamoeba histolytica
TFHIKLSSGAVYHFKTKTKELL

SEQ ID NO: 2697198 - protein, 23 aa, Entamoeba histolytica
TFIDLKGNIFVKRVFNRQINSIQ

SEQ ID NO: 2697199 - protein, 18 aa, Entamoeba histolytica
TFIHSCEIYISSFYITLK

SEQ ID NO: 2697200 - protein, 17 aa, Entamoeba histolytica
TFIKGMYTFLKLMGREP

SEQ ID NO: 2697201 - protein, 24 aa, Entamoeba histolytica
TFIKRIANDILQFLLTFNAIPENI

SEQ ID NO: 2697202 - protein, 18 aa, Entamoeba histolytica
TFILTSQYLHWSLFINIL

SEQ ID NO: 2697203 - protein, 19 aa, Entamoeba histolytica
TFIPLRLFIETPRTSSLRR

SEQ ID NO: 2697204 - protein, 19 aa, Entamoeba histolytica
TFIQMTFDRLSSIIPVKNF

SEQ ID NO: 2697205 - protein, 21 aa, Entamoeba histolytica
TFIYRGCQVLYQLYDEKNELE

SEQ ID NO: 2697206 - protein, 22 aa, Entamoeba histolytica
TFKQEFVKILTLKTQPSSWFFS

SEQ ID NO: 2697207 - protein, 22 aa, Entamoeba histolytica
TFKRLWKSQCEELENQSDDETE

SEQ ID NO: 2697208 - protein, 19 aa, Entamoeba histolytica
TFKWIKIIFEQNGFGEWVY

SEQ ID NO: 2697209 - protein, 21 aa, Entamoeba histolytica
TFKYIATKIVLLWLSTKIITV

SEQ ID NO: 2697210 - protein, 25 aa, Entamoeba histolytica
TFLRMFHYKKSCIHLPESIVSVELK

SEQ ID NO: 2697211 - protein, 17 aa, Entamoeba histolytica
TFMKGHQKMSGKNAQFN

SEQ ID NO: 2697212 - protein, 17 aa, Entamoeba histolytica
TFMKIALSIVQERKEEL

SEQ ID NO: 2697213 - protein, 18 aa, Entamoeba histolytica
TFNCSIKPHINRIEINNK

SEQ ID NO: 2697214 - protein, 23 aa, Entamoeba histolytica
TFNLKAVAGLVLFNQYWYWYPFT

SEQ ID NO: 2697215 - protein, 19 aa, Entamoeba histolytica
TFNLLFFIRTVFPVFHAPQ

SEQ ID NO: 2697216 - protein, 24 aa, Entamoeba histolytica
TFNYPHTVLNFGIGMKDFEKIEIN

SEQ ID NO: 2697217 - protein, 19 aa, Entamoeba histolytica
TFPKWKAKDLHTIFHTDER

SEQ ID NO: 2697218 - protein, 20 aa, Entamoeba histolytica
TFPSICTAWDRNGVRINTAV

SEQ ID NO: 2697219 - protein, 23 aa, Entamoeba histolytica
TFQGVLQLNGWFCNGTEIRFNLP

SEQ ID NO: 2697220 - protein, 23 aa, Entamoeba histolytica
TFRPELILPANKWYEIKHQNKVS

SEQ ID NO: 2697221 - protein, 17 aa, Entamoeba histolytica
TFRTWSALKKCNLIYDS

SEQ ID NO: 2697222 - protein, 24 aa, Entamoeba histolytica
TFSCDVYALGLIMWQTFTQKQLFP

SEQ ID NO: 2697223 - protein, 25 aa, Entamoeba histolytica
TFSEPFIMVVLKFIRLIYKSTPQFK

SEQ ID NO: 2697224 - protein, 25 aa, Entamoeba histolytica
TFSLGMSILHIFSGKKPYGGMNKQQ

SEQ ID NO: 2697225 - protein, 24 aa, Entamoeba histolytica
TFSLRPSNELALCLNEILPETDPP

SEQ ID NO: 2697226 - protein, 27 aa, Entamoeba histolytica
TFSMRIKEWYSWHFPELYNILNNDNTK

SEQ ID NO: 2697227 - protein, 18 aa, Entamoeba histolytica
TFSREFYTYFKAVCSEEE

SEQ ID NO: 2697228 - protein, 26 aa, Entamoeba histolytica
TFSVSFYGVSAWAYLNGVQKIKLLKY

SEQ ID NO: 2697229 - protein, 22 aa, Entamoeba histolytica
TFTIPVKLSLLITSPPYLTVLS

SEQ ID NO: 2697230 - protein, 19 aa, Entamoeba histolytica
TFTLKQLFISSVIHSSQIL

SEQ ID NO: 2697231 - protein, 17 aa, Entamoeba histolytica
TFVPYKFNFFASVNNTS

SEQ ID NO: 2697232 - protein, 25 aa, Entamoeba histolytica
TFYRVNNAFYLRPYLYEKKGKTWDD

SEQ ID NO: 2697233 - protein, 22 aa, Entamoeba histolytica
TGDGKSSLGNFILKKNAFDVND

SEQ ID NO: 2697234 - protein, 24 aa, Entamoeba histolytica
TGDIPEIIQNPSLGKEGNETQEEK

SEQ ID NO: 2697235 - protein, 21 aa, Entamoeba histolytica
TGDISAIIKYITKKGEGIHQG

SEQ ID NO: 2697236 - protein, 18 aa, Entamoeba histolytica
TGDISAIIKYITKKGKGM

SEQ ID NO: 2697237 - protein, 29 aa, Entamoeba histolytica
TGDISAIIRYITKKGAGMCKGDPSTKEDL

SEQ ID NO: 2697238 - protein, 20 aa, Entamoeba histolytica
TGDLCKNKKFTQCGNAETID

SEQ ID NO: 2697239 - protein, 21 aa, Entamoeba histolytica
TGEKSLSVELIFTMINGNRFK

SEQ ID NO: 2697240 - protein, 24 aa, Entamoeba histolytica
TGFQTRLGVMVARQLNALFSQKPN

SEQ ID NO: 2697241 - protein, 19 aa, Entamoeba histolytica
TGFSHCFCKGVSVGVKCHI

SEQ ID NO: 2697242 - protein, 26 aa, Entamoeba histolytica
TGGIVLFKWGQGKLRGEPINAVIKDH

SEQ ID NO: 2697243 - protein, 20 aa, Entamoeba histolytica
TGGLKCSWCGLVCHQCCVRK

SEQ ID NO: 2697244 - protein, 21 aa, Entamoeba histolytica
TGGYRGEGIIEIIRSIEETKE

SEQ ID NO: 2697245 - protein, 19 aa, Entamoeba histolytica
TGHLNIYEFIAIYRYLEIC

SEQ ID NO: 2697246 - protein, 17 aa, Entamoeba histolytica
TGHPSFVMSNSFSNQTL

SEQ ID NO: 2697247 - protein, 18 aa, Entamoeba histolytica
TGHSLGGAVAEIVTLLYR

SEQ ID NO: 2697248 - protein, 21 aa, Entamoeba histolytica
TGHTLRFLSLPTLLRDMLEKV

SEQ ID NO: 2697249 - protein, 18 aa, Entamoeba histolytica
TGIDWGMKPQKPVVSNEV

SEQ ID NO: 2697250 - protein, 20 aa, Entamoeba histolytica
TGIGCLTSLQLINLDLTDND

SEQ ID NO: 2697251 - protein, 23 aa, Entamoeba histolytica
TGIIKVWDILGVESLEVMRSKVT

SEQ ID NO: 2697252 - protein, 27 aa, Entamoeba histolytica
TGIPGFPVNFLQYFQLFPSVFNTSMNR

SEQ ID NO: 2697253 - protein, 26 aa, Entamoeba histolytica
TGIWEPCYLMLIGSILYIYKNTVDIF

SEQ ID NO: 2697254 - protein, 23 aa, Entamoeba histolytica
TGKKGMCKIDIAYKVFNKNKLMF

SEQ ID NO: 2697255 - protein, 25 aa, Entamoeba histolytica
TGKMKRRFFYLLQFNRELIYYKQQQ

SEQ ID NO: 2697256 - protein, 21 aa, Entamoeba histolytica
TGKNFKLRASFRIRSKTSNDN

SEQ ID NO: 2697257 - protein, 17 aa, Entamoeba histolytica
TGKNVLKCISSLFGIKC

SEQ ID NO: 2697258 - protein, 24 aa, Entamoeba histolytica
TGKSRGFGYLDFVDLEAANKFVEE

SEQ ID NO: 2697259 - protein, 24 aa, Entamoeba histolytica
TGLSCGHYYCKNCWREYIEEAMKR

SEQ ID NO: 2697260 - protein, 20 aa, Entamoeba histolytica
TGMRNFRIIFEKTIGDIDLV

SEQ ID NO: 2697261 - protein, 23 aa, Entamoeba histolytica
TGMYRYKYKVIQQIRMCKDLKHI

SEQ ID NO: 2697262 - protein, 17 aa, Entamoeba histolytica
TGNELWRSDIQNNISCV

SEQ ID NO: 2697263 - protein, 21 aa, Entamoeba histolytica
TGNFGIRVYLIPSFKNTSINL

SEQ ID NO: 2697264 - protein, 25 aa, Entamoeba histolytica
TGNGKSSLGNFILQKYVFKVGDSPN

SEQ ID NO: 2697265 - protein, 21 aa, Entamoeba histolytica
TGNLRLLLPDKYREFPEKMTQ

SEQ ID NO: 2697266 - protein, 22 aa, Entamoeba histolytica
TGQIEWWDKIYFNSDEITDYPH

SEQ ID NO: 2697267 - protein, 18 aa, Entamoeba histolytica
TGRYVCYVNPTLPTYRFE

SEQ ID NO: 2697268 - protein, 22 aa, Entamoeba histolytica
TGSEMNCGFVISRKSDNMKMAG

SEQ ID NO: 2697269 - protein, 23 aa, Entamoeba histolytica
TGSGCLSAAFGSRLQFGNEQGKG

SEQ ID NO: 2697270 - protein, 20 aa, Entamoeba histolytica
TGSLIFPKNNFRLFFSEKRL

SEQ ID NO: 2697271 - protein, 19 aa, Entamoeba histolytica
TGTQFKCYPLYDFGVSIID

SEQ ID NO: 2697272 - protein, 17 aa, Entamoeba histolytica
THALELLDFRFPDEQVR

SEQ ID NO: 2697273 - protein, 21 aa, Entamoeba histolytica
THCKIPHLEKKCEFFQIQRPV

SEQ ID NO: 2697274 - protein, 18 aa, Entamoeba histolytica
THDLLQCDCCNGGYKTEE

SEQ ID NO: 2697275 - protein, 18 aa, Entamoeba histolytica
THEVYHCIAIIPFDSYIF

SEQ ID NO: 2697276 - protein, 18 aa, Entamoeba histolytica
THEYLVYQTLLSITSCIS

SEQ ID NO: 2697277 - protein, 25 aa, Entamoeba histolytica
THGPSRKELLSSFFNSAITTLYTPL

SEQ ID NO: 2697278 - protein, 18 aa, Entamoeba histolytica
THHYNLFHQFNHVSPFDA

SEQ ID NO: 2697279 - protein, 24 aa, Entamoeba histolytica
THIRKICLNGGTTLVLFDKNPQYD

SEQ ID NO: 2697280 - protein, 31 aa, Entamoeba histolytica
THKDTVAEEIWKFAQMFSEFEIENHENGCDL

SEQ ID NO: 2697281 - protein, 18 aa, Entamoeba histolytica
THKLILWKMKREAETLEL

SEQ ID NO: 2697282 - protein, 23 aa, Entamoeba histolytica
THLKSIYETVCFEFIKFWQHALS

SEQ ID NO: 2697283 - protein, 20 aa, Entamoeba histolytica
THLRKFYLRSCDVLQHPSLP

SEQ ID NO: 2697284 - protein, 17 aa, Entamoeba histolytica
THPSPFLNRTIYSDDVL

SEQ ID NO: 2697285 - protein, 25 aa, Entamoeba histolytica
THRGELRKIFSIKKLHIGHICKSFG

SEQ ID NO: 2697286 - protein, 17 aa, Entamoeba histolytica
THRKCTRVVLKALEQLE

SEQ ID NO: 2697287 - protein, 23 aa, Entamoeba histolytica
THRLGGFEAPPGIISIFLGNVIQ

SEQ ID NO: 2697288 - protein, 17 aa, Entamoeba histolytica
THTINGYAFRKTSSTKM

SEQ ID NO: 2697289 - protein, 29 aa, Entamoeba histolytica
THTKIGEKMIKEWIKQPLIDKDKINKRLE

SEQ ID NO: 2697290 - protein, 30 aa, Entamoeba histolytica
THTKIGEKMIKEWIKQPLIDKDKINKRLEL

SEQ ID NO: 2697291 - protein, 25 aa, Entamoeba histolytica
THVFGFETECLWKYNRNVYTEFINL

SEQ ID NO: 2697292 - protein, 17 aa, Entamoeba histolytica
THVQKIVNFLVEVKKKV

SEQ ID NO: 2697293 - protein, 22 aa, Entamoeba histolytica
THYEIGELLGTFYRIEYDKNLY

SEQ ID NO: 2697294 - protein, 20 aa, Entamoeba histolytica
THYKRPALQSGDFVEFKYTK

SEQ ID NO: 2697295 - protein, 24 aa, Entamoeba histolytica
THYLELIWKIPDAHIIINSLKNGV

SEQ ID NO: 2697296 - protein, 26 aa, Entamoeba histolytica
THYSFFRTAKRLVLFDFVVKTIENKT

SEQ ID NO: 2697297 - protein, 29 aa, Entamoeba histolytica
TIAFKSSYCIPLILVRCFKIIDECEYQPT

SEQ ID NO: 2697298 - protein, 25 aa, Entamoeba histolytica
TIASLFKLYFRELPDSLVTEENTDL

SEQ ID NO: 2697299 - protein, 28 aa, Entamoeba histolytica
TICIDFISFCISNYPLIFPNDVDEKLNK

SEQ ID NO: 2697300 - protein, 24 aa, Entamoeba histolytica
TICLPRNKKVLFILMSVMDLLSSS

SEQ ID NO: 2697301 - protein, 18 aa, Entamoeba histolytica
TICQQPIRLHQQLIYTLP

SEQ ID NO: 2697302 - protein, 19 aa, Entamoeba histolytica
TICQQPIRLHQQLIYTLPS

SEQ ID NO: 2697303 - protein, 21 aa, Entamoeba histolytica
TICRKYLKNQLEVFIDDGEKL

SEQ ID NO: 2697304 - protein, 27 aa, Entamoeba histolytica
TIDDLYCNNCTFVPADIISSCQYSKNN

SEQ ID NO: 2697305 - protein, 22 aa, Entamoeba histolytica
TIDFIKIPTFYKVQYKWDSCVI

SEQ ID NO: 2697306 - protein, 23 aa, Entamoeba histolytica
TIDHCYYYFSKISFFSKDRYDRI

SEQ ID NO: 2697307 - protein, 22 aa, Entamoeba histolytica
TIDILFPVEIGYDIKGPQLMTE

SEQ ID NO: 2697308 - protein, 19 aa, Entamoeba histolytica
TIDIPMYFVYSQPDEDDCK

SEQ ID NO: 2697309 - protein, 26 aa, Entamoeba histolytica
TIDMLDCIELLLPLLSKLLRCKPIGQ

SEQ ID NO: 2697310 - protein, 18 aa, Entamoeba histolytica
TIDRACLMYCRYERFFQR

SEQ ID NO: 2697311 - protein, 22 aa, Entamoeba histolytica
TIDRKKKAFNIIDTNNEIIIQK

SEQ ID NO: 2697312 - protein, 18 aa, Entamoeba histolytica
TIDSLKVRGIEGVIIGLM

SEQ ID NO: 2697313 - protein, 18 aa, Entamoeba histolytica
TIDVCVYYSIKMLHSHYQ

SEQ ID NO: 2697314 - protein, 24 aa, Entamoeba histolytica
TIDYSNSCVITYLAKTIVNKASRD

SEQ ID NO: 2697315 - protein, 24 aa, Entamoeba histolytica
TIEALTILLKDVWKNLKDENEEEL

SEQ ID NO: 2697316 - protein, 18 aa, Entamoeba histolytica
TIEERVGDELMRFILAAG

SEQ ID NO: 2697317 - protein, 19 aa, Entamoeba histolytica
TIEFLSIFDGFFIQKVPKM

SEQ ID NO: 2697318 - protein, 25 aa, Entamoeba histolytica
TIEGFLGLIEYEWIMLGHKFQSRLR

SEQ ID NO: 2697319 - protein, 18 aa, Entamoeba histolytica
TIEHCLRIRINKTNDEAI

SEQ ID NO: 2697320 - protein, 19 aa, Entamoeba histolytica
TIEKQCLQKRVEYLEKEQT

SEQ ID NO: 2697321 - protein, 20 aa, Entamoeba histolytica
TIELTLRLFGNCPYSIILPK

SEQ ID NO: 2697322 - protein, 35 aa, Entamoeba histolytica
TIEMFKILLFPLEWVCISITLLPRILINQLTSPFP

SEQ ID NO: 2697323 - protein, 19 aa, Entamoeba histolytica
TIENCYRKTLTVDNRICVL

SEQ ID NO: 2697324 - protein, 35 aa, Entamoeba histolytica
TIENFKLLIFPLQWVCVCVPILPRILLEYLTSPFP

SEQ ID NO: 2697325 - protein, 18 aa, Entamoeba histolytica
TIENFWGFYEDFPNITSV

SEQ ID NO: 2697326 - protein, 30 aa, Entamoeba histolytica
TIEVFKKRRVVLMKILLRIHQIYKLDELKH

SEQ ID NO: 2697327 - protein, 23 aa, Entamoeba histolytica
TIFEERKNILLSIAAFLDTKYTC

SEQ ID NO: 2697328 - protein, 17 aa, Entamoeba histolytica
TIFELEYEDCFFPSDNE

SEQ ID NO: 2697329 - protein, 17 aa, Entamoeba histolytica
TIFIESSNVREFYKKIN

SEQ ID NO: 2697330 - protein, 25 aa, Entamoeba histolytica
TIFNLDCIPPIFRPIMSDLICLSPE

SEQ ID NO: 2697331 - protein, 22 aa, Entamoeba histolytica
TIFRSKIWKVFFGFLPENTALW

SEQ ID NO: 2697332 - protein, 25 aa, Entamoeba histolytica
TIGDIAMRAPMMWSLIELPKPPELF

SEQ ID NO: 2697333 - protein, 23 aa, Entamoeba histolytica
TIGGLRIIGRLAVGNRKGLLLPN

SEQ ID NO: 2697334 - protein, 19 aa, Entamoeba histolytica
TIGICLNGKPMIKKKFNKN

SEQ ID NO: 2697335 - protein, 17 aa, Entamoeba histolytica
TIGKFCVSQHDRVCAVL

SEQ ID NO: 2697336 - protein, 26 aa, Entamoeba histolytica
TIGKSNIGKIEWKDVDVRNINFDINV

SEQ ID NO: 2697337 - protein, 26 aa, Entamoeba histolytica
TIGNENARRIWLGRWTTADYPLPESG

SEQ ID NO: 2697338 - protein, 22 aa, Entamoeba histolytica
TIGNWCFYKCSSLTTINIPTSV

SEQ ID NO: 2697339 - protein, 26 aa, Entamoeba histolytica
TIHLCELRGTLDFSLPEEVIGTIYLE

SEQ ID NO: 2697340 - protein, 23 aa, Entamoeba histolytica
TIIAFRYLLAYYRQPEVKQCEVL

SEQ ID NO: 2697341 - protein, 22 aa, Entamoeba histolytica
TIIELPQLKALILNNNNINTIP

SEQ ID NO: 2697342 - protein, 18 aa, Entamoeba histolytica
TIIFKAKELLSFPNEVIN

SEQ ID NO: 2697343 - protein, 19 aa, Entamoeba histolytica
TIIIPRIKDSYVIQWVESN

SEQ ID NO: 2697344 - protein, 20 aa, Entamoeba histolytica
TIIKEYPIVTVFIKGLSSSV

SEQ ID NO: 2697345 - protein, 27 aa, Entamoeba histolytica
TIIKSNELWKKWIIQPQIDQVIKEITD

SEQ ID NO: 2697346 - protein, 27 aa, Entamoeba histolytica
TIINFVYKCAYSFINDISIIIPSVPID

SEQ ID NO: 2697347 - protein, 17 aa, Entamoeba histolytica
TIIPILLSELTKLKYSK

SEQ ID NO: 2697348 - protein, 31 aa, Entamoeba histolytica
TIITCRPVPLSTRPNLFMQNSYGYSPISAFS

SEQ ID NO: 2697349 - protein, 23 aa, Entamoeba histolytica
TIKCPVAGCDHSFGINDLIEDYE

SEQ ID NO: 2697350 - protein, 19 aa, Entamoeba histolytica
TIKEFMYQVLLKVGSDEEN

SEQ ID NO: 2697351 - protein, 22 aa, Entamoeba histolytica
TIKEVWRDGLQILNDSQVKIFS

SEQ ID NO: 2697352 - protein, 22 aa, Entamoeba histolytica
TIKFIDCTICFNKINFYPLQTL

SEQ ID NO: 2697353 - protein, 19 aa, Entamoeba histolytica
TIKGSGFGTSPIVFIGDKE

SEQ ID NO: 2697354 - protein, 17 aa, Entamoeba histolytica
TIKPCDRKIFVGALDIL

SEQ ID NO: 2697355 - protein, 26 aa, Entamoeba histolytica
TIKRKNGQIALEFVVGIFYDNSVVMM

SEQ ID NO: 2697356 - protein, 24 aa, Entamoeba histolytica
TIKVGGRALITVWAKEQKKFENEE

SEQ ID NO: 2697357 - protein, 19 aa, Entamoeba histolytica
TIKVGMCNVFLMHTSASLC

SEQ ID NO: 2697358 - protein, 18 aa, Entamoeba histolytica
TILDMYRHGLWCKDIIIT

SEQ ID NO: 2697359 - protein, 17 aa, Entamoeba histolytica
TILEGLKEWIVHKDKDA

SEQ ID NO: 2697360 - protein, 19 aa, Entamoeba histolytica
TILERRGIELYEYYMKLIL

SEQ ID NO: 2697361 - protein, 17 aa, Entamoeba histolytica
TILFWEVIENMIKSMYN

SEQ ID NO: 2697362 - protein, 21 aa, Entamoeba histolytica
TILGDRFLRFSPMIHNTNEEN

SEQ ID NO: 2697363 - protein, 25 aa, Entamoeba histolytica
TILKCLHCKCDICASERDDPKTIII

SEQ ID NO: 2697364 - protein, 22 aa, Entamoeba histolytica
TILKLPNVFNVFKIGNSEQLII

SEQ ID NO: 2697365 - protein, 25 aa, Entamoeba histolytica
TILLVSRMGYIYGFYSGDGTLFFQG

SEQ ID NO: 2697366 - protein, 26 aa, Entamoeba histolytica
TILLVSRMGYIYGFYSGDGTLFFQGR

SEQ ID NO: 2697367 - protein, 19 aa, Entamoeba histolytica
TILSFPFTYNGIFHIKEHP

SEQ ID NO: 2697368 - protein, 19 aa, Entamoeba histolytica
TILTKLRLDNCKVLELSSI

SEQ ID NO: 2697369 - protein, 18 aa, Entamoeba histolytica
TILYKLKIGDVVTTIPTI

SEQ ID NO: 2697370 - protein, 21 aa, Entamoeba histolytica
TIMIYKCLDSILNKRYEKEVL

SEQ ID NO: 2697371 - protein, 17 aa, Entamoeba histolytica
TIMNKGNILILFEGNEG

SEQ ID NO: 2697372 - protein, 17 aa, Entamoeba histolytica
TINENLDVFSFLLKDFR

SEQ ID NO: 2697373 - protein, 23 aa, Entamoeba histolytica
TINFFIKYAHRFTKLQSITGSIE

SEQ ID NO: 2697374 - protein, 18 aa, Entamoeba histolytica
TINGYAFRKTSSTKMNSQ

SEQ ID NO: 2697375 - protein, 26 aa, Entamoeba histolytica
TINIWDLKKMRCRSLVYDEGAINVTS

SEQ ID NO: 2697376 - protein, 18 aa, Entamoeba histolytica
TINLRMNLESQILEMESA

SEQ ID NO: 2697377 - protein, 23 aa, Entamoeba histolytica
TINQCYLMHLALQLCHSPKAIHL

SEQ ID NO: 2697378 - protein, 23 aa, Entamoeba histolytica
TIPLFCNFTGVFGYPLQATASKK

SEQ ID NO: 2697379 - protein, 23 aa, Entamoeba histolytica
TIPLPFDYPTYFSHCKIIKEKYK

SEQ ID NO: 2697380 - protein, 25 aa, Entamoeba histolytica
TIPMHTLRSRMCILPQEATMFSGTI

SEQ ID NO: 2697381 - protein, 19 aa, Entamoeba histolytica
TIPNQWKLVQEYEKKQKKD

SEQ ID NO: 2697382 - protein, 17 aa, Entamoeba histolytica
TIPRGEQTYAFVKFANE

SEQ ID NO: 2697383 - protein, 28 aa, Entamoeba histolytica
TIPRMCPEIPQAIAARMVSPEFPEPKNI

SEQ ID NO: 2697384 - protein, 29 aa, Entamoeba histolytica
TIQIKRWEIFGILACSFFNVQWDKKVERI

SEQ ID NO: 2697385 - protein, 17 aa, Entamoeba histolytica
TIQNIYNNIHLIAETLT

SEQ ID NO: 2697386 - protein, 25 aa, Entamoeba histolytica
TIRFWDIRSKECIDINKNIHTSSVS

SEQ ID NO: 2697387 - protein, 20 aa, Entamoeba histolytica
TIRGYGIKDFIQWIENQQVD

SEQ ID NO: 2697388 - protein, 23 aa, Entamoeba histolytica
TIRLEIWTCASVALISNFSESES

SEQ ID NO: 2697389 - protein, 25 aa, Entamoeba histolytica
TISEATCLFTVFPSVHILKEEKGIS

SEQ ID NO: 2697390 - protein, 23 aa, Entamoeba histolytica
TISLYKAHWDEMDLTRMHEAANE

SEQ ID NO: 2697391 - protein, 18 aa, Entamoeba histolytica
TISMFRVLNVNGFVSKQS

SEQ ID NO: 2697392 - protein, 26 aa, Entamoeba histolytica
TISPKEFKFAIGEFAPQFSGYQQHDS

SEQ ID NO: 2697393 - protein, 17 aa, Entamoeba histolytica
TITCYGISNLHVNINKN

SEQ ID NO: 2697394 - protein, 24 aa, Entamoeba histolytica
TITEMSEGLAIYLKHLPPYHNEDI

SEQ ID NO: 2697395 - protein, 26 aa, Entamoeba histolytica
TITLRFQNYYFFKEKVSFRVIRCLEP

SEQ ID NO: 2697396 - protein, 22 aa, Entamoeba histolytica
TITRCFRRHGAVTIDTPVFELK

SEQ ID NO: 2697397 - protein, 18 aa, Entamoeba histolytica
TITTIIIPIVLKLLTDKV

SEQ ID NO: 2697398 - protein, 18 aa, Entamoeba histolytica
TIVDKKVTTEPIKQEETF

SEQ ID NO: 2697399 - protein, 21 aa, Entamoeba histolytica
TIVECLKKHFGEEVEKIVWKI

SEQ ID NO: 2697400 - protein, 19 aa, Entamoeba histolytica
TIVKCIELLLTKEDLITED

SEQ ID NO: 2697401 - protein, 18 aa, Entamoeba histolytica
TIVKRICYLFNDSILFVR

SEQ ID NO: 2697402 - protein, 17 aa, Entamoeba histolytica
TIVLSLLYENGFKTLKL

SEQ ID NO: 2697403 - protein, 18 aa, Entamoeba histolytica
TIVPLLRLMVALKNAEEE

SEQ ID NO: 2697404 - protein, 27 aa, Entamoeba histolytica
TIVPMEVCHPVDWKPKMVKELEHVGYQ

SEQ ID NO: 2697405 - protein, 18 aa, Entamoeba histolytica
TIYEVSFCEVTRRINPYL

SEQ ID NO: 2697406 - protein, 25 aa, Entamoeba histolytica
TIYFKPNDQVIAWSQRDNGWFAAMI

SEQ ID NO: 2697407 - protein, 19 aa, Entamoeba histolytica
TIYGETALDIAMYNENNSL

SEQ ID NO: 2697408 - protein, 17 aa, Entamoeba histolytica
TIYKCKKGDRVAQLIIE

SEQ ID NO: 2697409 - protein, 26 aa, Entamoeba histolytica
TIYKRGVECKCFFFIENEWKEVTVDE

SEQ ID NO: 2697410 - protein, 18 aa, Entamoeba histolytica
TIYMDWVIEMLKVDRFIY

SEQ ID NO: 2697411 - protein, 24 aa, Entamoeba histolytica
TIYTLLIRRMRLCSFLILTKNDDE

SEQ ID NO: 2697412 - protein, 25 aa, Entamoeba histolytica
TKAECTDCAIAINPIFECQQLHGDI

SEQ ID NO: 2697413 - protein, 22 aa, Entamoeba histolytica
TKAKRLKHCCVIMKEQYNNQVP

SEQ ID NO: 2697414 - protein, 20 aa, Entamoeba histolytica
TKAKTAPRRGLVRMDGVIGL

SEQ ID NO: 2697415 - protein, 18 aa, Entamoeba histolytica
TKAVFALFTPQLGLRIRH

SEQ ID NO: 2697416 - protein, 18 aa, Entamoeba histolytica
TKAVLKLNFLNEVTEYLK

SEQ ID NO: 2697417 - protein, 19 aa, Entamoeba histolytica
TKAVLKLNFLNEVTEYLKV

SEQ ID NO: 2697418 - protein, 18 aa, Entamoeba histolytica
TKCKIEIEAEEFNQLPRT

SEQ ID NO: 2697419 - protein, 32 aa, Entamoeba histolytica
TKDCNKCGGSIDCVFIRLVVFIGNTRCSKTNN

SEQ ID NO: 2697420 - protein, 20 aa, Entamoeba histolytica
TKDDGFFCFILKSPLIKKPI

SEQ ID NO: 2697421 - protein, 27 aa, Entamoeba histolytica
TKDELEVVKRACDVLGSGIEESSINQE

SEQ ID NO: 2697422 - protein, 18 aa, Entamoeba histolytica
TKDGCLISDYEIIQPIPW

SEQ ID NO: 2697423 - protein, 17 aa, Entamoeba histolytica
TKDGFKFDFGTNETAKS

SEQ ID NO: 2697424 - protein, 23 aa, Entamoeba histolytica
TKDICYSLSWSYEGDVIVSMGKD

SEQ ID NO: 2697425 - protein, 28 aa, Entamoeba histolytica
TKDPKHFIFSLLNPNGIQPRAFYLQDNE

SEQ ID NO: 2697426 - protein, 18 aa, Entamoeba histolytica
TKDRESYRSIKLIMAPLK

SEQ ID NO: 2697427 - protein, 17 aa, Entamoeba histolytica
TKDYILLAWYYSPALAV

SEQ ID NO: 2697428 - protein, 33 aa, Entamoeba histolytica
TKEDAAIVICPFSFIKCQEYILSVMKGIYQAFE

SEQ ID NO: 2697429 - protein, 27 aa, Entamoeba histolytica
TKEDLEIDPALLLKHAQRVMVDEPEET

SEQ ID NO: 2697430 - protein, 26 aa, Entamoeba histolytica
TKEDYRCAIVLFQLCVEGLQSLNVNE

SEQ ID NO: 2697431 - protein, 24 aa, Entamoeba histolytica
TKEECEAWNSLIFDQVERVNALAK

SEQ ID NO: 2697432 - protein, 20 aa, Entamoeba histolytica
TKEEFRHWAKIIGLGCKTYG

SEQ ID NO: 2697433 - protein, 22 aa, Entamoeba histolytica
TKEEVEKVFSILGITMESDIDL

SEQ ID NO: 2697434 - protein, 24 aa, Entamoeba histolytica
TKEFIKLIYYFGLNPSTLKRNSIL

SEQ ID NO: 2697435 - protein, 17 aa, Entamoeba histolytica
TKELFCVANSLKTKEPI

SEQ ID NO: 2697436 - protein, 24 aa, Entamoeba histolytica
TKENTFKSIERWLSELKDNADPKI

SEQ ID NO: 2697437 - protein, 18 aa, Entamoeba histolytica
TKEPFSFGKSSSLITFGE

SEQ ID NO: 2697438 - protein, 18 aa, Entamoeba histolytica
TKEQVLVELQRVNNEMNK

SEQ ID NO: 2697439 - protein, 35 aa, Entamoeba histolytica
TKESKNTFLHWIIKVLRIVLIIGEKYKSNNENVYA

SEQ ID NO: 2697440 - protein, 19 aa, Entamoeba histolytica
TKEVALAWVDITLRLQKTF

SEQ ID NO: 2697441 - protein, 23 aa, Entamoeba histolytica
TKEVAQMSFLIWALNRKFSFSFQ

SEQ ID NO: 2697442 - protein, 21 aa, Entamoeba histolytica
TKEVRLPPIMLQEKQNKSNGI

SEQ ID NO: 2697443 - protein, 19 aa, Entamoeba histolytica
TKFAGIRIVNELAVKAPEV

SEQ ID NO: 2697444 - protein, 17 aa, Entamoeba histolytica
TKFGCLFAEVTSVEGDS

SEQ ID NO: 2697445 - protein, 21 aa, Entamoeba histolytica
TKFGKLRSFGDLCHFSISFKS

SEQ ID NO: 2697446 - protein, 20 aa, Entamoeba histolytica
TKFKEFSVINNFWTKQHDFI

SEQ ID NO: 2697447 - protein, 19 aa, Entamoeba histolytica
TKFKVGYNSSLFRKGNYVC

SEQ ID NO: 2697448 - protein, 20 aa, Entamoeba histolytica
TKGADLIFDSTCDKYETLMN

SEQ ID NO: 2697449 - protein, 21 aa, Entamoeba histolytica
TKGFFKPECNPAKVIGDATIL

SEQ ID NO: 2697450 - protein, 29 aa, Entamoeba histolytica
TKGGSKLLKEWLLRIEIDKYIIEERQSFQ

SEQ ID NO: 2697451 - protein, 21 aa, Entamoeba histolytica
TKGKIGYELIKKLPYGGMICN

SEQ ID NO: 2697452 - protein, 17 aa, Entamoeba histolytica
TKGSICVQYTIISNPSS

SEQ ID NO: 2697453 - protein, 19 aa, Entamoeba histolytica
TKHAIRWGVPVLSQQWLFD

SEQ ID NO: 2697454 - protein, 24 aa, Entamoeba histolytica
TKIFKRLFRVYAHMFYSHANHLKE

SEQ ID NO: 2697455 - protein, 20 aa, Entamoeba histolytica
TKIIGIDRMCRYFMCINNCL

SEQ ID NO: 2697456 - protein, 23 aa, Entamoeba histolytica
TKIKNIQNILSFLPDIYYETLKL

SEQ ID NO: 2697457 - protein, 29 aa, Entamoeba histolytica
TKILFTSSDWSCWGGYPGALMTYYSTELV

SEQ ID NO: 2697458 - protein, 18 aa, Entamoeba histolytica
TKILLDWKDLVLSELEGC

SEQ ID NO: 2697459 - protein, 17 aa, Entamoeba histolytica
TKIMPPIPCGTQPPQCN

SEQ ID NO: 2697460 - protein, 17 aa, Entamoeba histolytica
TKISETFIIKCKPGDKI

SEQ ID NO: 2697461 - protein, 25 aa, Entamoeba histolytica
TKITRSSLFLAYLIENPFNREICLL

SEQ ID NO: 2697462 - protein, 25 aa, Entamoeba histolytica
TKIYKRMFRVYAHMFYSHMEHLKEV

SEQ ID NO: 2697463 - protein, 21 aa, Entamoeba histolytica
TKKARDCLFNGDLDELEDAMA

SEQ ID NO: 2697464 - protein, 26 aa, Entamoeba histolytica
TKKCEGIECPICLQLTRNVMTTQCGH

SEQ ID NO: 2697465 - protein, 19 aa, Entamoeba histolytica
TKKCICVSTYLAKSTQAIS

SEQ ID NO: 2697466 - protein, 22 aa, Entamoeba histolytica
TKKGPLAKVWIAAHWEGKLTKQ

SEQ ID NO: 2697467 - protein, 24 aa, Entamoeba histolytica
TKKKEKRKDCILVAKTNEKFVDVF

SEQ ID NO: 2697468 - protein, 20 aa, Entamoeba histolytica
TKKKIVLVCQCSGKYRSCSY

SEQ ID NO: 2697469 - protein, 21 aa, Entamoeba histolytica
TKKKRWCILTKNKLFYFNCKP

SEQ ID NO: 2697470 - protein, 20 aa, Entamoeba histolytica
TKKKSRVIAIRNGSIERKRA

SEQ ID NO: 2697471 - protein, 23 aa, Entamoeba histolytica
TKKKSYCGANGFEYCEAKNALCG

SEQ ID NO: 2697472 - protein, 18 aa, Entamoeba histolytica
TKKMFFQAICNLIITIPK

SEQ ID NO: 2697473 - protein, 24 aa, Entamoeba histolytica
TKKQKRLSAHFGVEIGAEDQFFFE

SEQ ID NO: 2697474 - protein, 24 aa, Entamoeba histolytica
TKKQVFRYILGFTDFAFFQPTIFG

SEQ ID NO: 2697475 - protein, 20 aa, Entamoeba histolytica
TKKSKGFGFVLFVVPQDAVK

SEQ ID NO: 2697476 - protein, 17 aa, Entamoeba histolytica
TKKYPFQVIIKIFPKLQ

SEQ ID NO: 2697477 - protein, 20 aa, Entamoeba histolytica
TKLCNHPSLISKYLTEEKIS

SEQ ID NO: 2697478 - protein, 23 aa, Entamoeba histolytica
TKLDDFCTFGFLIKNLHEVDDFM

SEQ ID NO: 2697479 - protein, 21 aa, Entamoeba histolytica
TKLFIPHLFSLSANGFSYYVY

SEQ ID NO: 2697480 - protein, 18 aa, Entamoeba histolytica
TKLGETITPSFSLQGHKK

SEQ ID NO: 2697481 - protein, 24 aa, Entamoeba histolytica
TKLGQSCFKNCCSLTCVSLPSTII

SEQ ID NO: 2697482 - protein, 26 aa, Entamoeba histolytica
TKLLCGTEFFQYYAGMYDQFKIDGVS

SEQ ID NO: 2697483 - protein, 25 aa, Entamoeba histolytica
TKLLHLGFHKLPFIPKESAELYYFR

SEQ ID NO: 2697484 - protein, 17 aa, Entamoeba histolytica
TKLLLFIDSVIKKFNDD

SEQ ID NO: 2697485 - protein, 24 aa, Entamoeba histolytica
TKLPRKRLRDVSARLEYYKQLQTN

SEQ ID NO: 2697486 - protein, 20 aa, Entamoeba histolytica
TKLPTLPSFNGINNPFRCPN

SEQ ID NO: 2697487 - protein, 28 aa, Entamoeba histolytica
TKLTIYLRKLFYLCALKYPFDSVDIVHG

SEQ ID NO: 2697488 - protein, 28 aa, Entamoeba histolytica
TKMDFSLDGRYCYGWGKSISVIELESGS

SEQ ID NO: 2697489 - protein, 17 aa, Entamoeba histolytica
TKMELKDVFRGHNSSVF

SEQ ID NO: 2697490 - protein, 17 aa, Entamoeba histolytica
TKMPLCCDGESDDKPNN

SEQ ID NO: 2697491 - protein, 17 aa, Entamoeba histolytica
TKMRIIAAMTRQTHFLK

SEQ ID NO: 2697492 - protein, 29 aa, Entamoeba histolytica
TKMVRELYCGLIQLFCNLFEKEKNALQQI

SEQ ID NO: 2697493 - protein, 18 aa, Entamoeba histolytica
TKNEVFGGYCSDVPVVDD

SEQ ID NO: 2697494 - protein, 18 aa, Entamoeba histolytica
TKNFRFVTNLYQTVNAPK

SEQ ID NO: 2697495 - protein, 20 aa, Entamoeba histolytica
TKNPHCFQLLEKTKIPYEDD

SEQ ID NO: 2697496 - protein, 26 aa, Entamoeba histolytica
TKNTRFCLICNYISRILPPISSRCIK

SEQ ID NO: 2697497 - protein, 29 aa, Entamoeba histolytica
TKNYDWKRLPAWCDRVMFRVYQAYQLSIH

SEQ ID NO: 2697498 - protein, 18 aa, Entamoeba histolytica
TKNYLPIKLCCSEGESVD

SEQ ID NO: 2697499 - protein, 23 aa, Entamoeba histolytica
TKPAIRRLARRGGVKRINGAVYD

SEQ ID NO: 2697500 - protein, 28 aa, Entamoeba histolytica
TKPFQFLHCHILRGYLQITLKVEGFEFE

SEQ ID NO: 2697501 - protein, 26 aa, Entamoeba histolytica
TKPGVPRIWVDGCFDMFHWGHANVIR

SEQ ID NO: 2697502 - protein, 24 aa, Entamoeba histolytica
TKPPRLPCSLKRDSPPLPKISQRE

SEQ ID NO: 2697503 - protein, 26 aa, Entamoeba histolytica
TKQCFNCPICYKPLPTKEVVIDNKIL

SEQ ID NO: 2697504 - protein, 17 aa, Entamoeba histolytica
TKQEGWYLIIIKPDGGL

SEQ ID NO: 2697505 - protein, 27 aa, Entamoeba histolytica
TKQIDSYSGWNKFCNNIYDSLKEILKK

SEQ ID NO: 2697506 - protein, 20 aa, Entamoeba histolytica
TKQKFWYSRVNSYTSRTGDI

SEQ ID NO: 2697507 - protein, 18 aa, Entamoeba histolytica
TKQKLVFNTFTKTFDCLP

SEQ ID NO: 2697508 - protein, 20 aa, Entamoeba histolytica
TKQLLDRWKFKPKEFPLQLN

SEQ ID NO: 2697509 - protein, 19 aa, Entamoeba histolytica
TKQRTDVVIRFAQDTINDM

SEQ ID NO: 2697510 - protein, 24 aa, Entamoeba histolytica
TKQSDWRANIKIDSIQDTRKQQPT

SEQ ID NO: 2697511 - protein, 19 aa, Entamoeba histolytica
TKQSLPIKMSEYIQENKRT

SEQ ID NO: 2697512 - protein, 19 aa, Entamoeba histolytica
TKQTIKMLLPETIVLNNTV

SEQ ID NO: 2697513 - protein, 18 aa, Entamoeba histolytica
TKRAIYLGMLKNILELLN

SEQ ID NO: 2697514 - protein, 24 aa, Entamoeba histolytica
TKRCAECHAVLKQNEGTICRNCHE

SEQ ID NO: 2697515 - protein, 21 aa, Entamoeba histolytica
TKREMPVLFQFHQISSLMFPD

SEQ ID NO: 2697516 - protein, 18 aa, Entamoeba histolytica
TKRETFNAVTDWVAELKS

SEQ ID NO: 2697517 - protein, 30 aa, Entamoeba histolytica
TKRIFNEYIQLCFVKGISLLMKGYEEHLGI

SEQ ID NO: 2697518 - protein, 25 aa, Entamoeba histolytica
TKRLIGCSFKPSLVQQEKRMINYEI

SEQ ID NO: 2697519 - protein, 24 aa, Entamoeba histolytica
TKSEMFSIGMVRPSHHNDIMFYRG

SEQ ID NO: 2697520 - protein, 18 aa, Entamoeba histolytica
TKSFEIVKQFVIGNFDLI

SEQ ID NO: 2697521 - protein, 17 aa, Entamoeba histolytica
TKSFKSFYLPIYLDLNG

SEQ ID NO: 2697522 - protein, 24 aa, Entamoeba histolytica
TKSGEWKLGGLQYVTQLGQLGDFK

SEQ ID NO: 2697523 - protein, 24 aa, Entamoeba histolytica
TKSGISSFVIEWISKASAAQRAGR

SEQ ID NO: 2697524 - protein, 24 aa, Entamoeba histolytica
TKSIAFCMFEIVWKQITQIKNFTT

SEQ ID NO: 2697525 - protein, 31 aa, Entamoeba histolytica; identical to SEQ ID NO: 2506658

SEQ ID NO: 2697526 - protein, 27 aa, Entamoeba histolytica
TKSLFYHNFIKLCSSLLVQIPNASTML

SEQ ID NO: 2697527 - protein, 17 aa, Entamoeba histolytica
TKSNGFGDFLAPYATVQ

SEQ ID NO: 2697528 - protein, 17 aa, Entamoeba histolytica
TKSPCFFNRTKSPKIFS

SEQ ID NO: 2697529 - protein, 32 aa, Entamoeba histolytica; identical to SEQ ID NO: 2506661

SEQ ID NO: 2697530 - protein, 25 aa, Entamoeba histolytica
TKSRICSKLSLLLSYISQEDIIQTN

SEQ ID NO: 2697531 - protein, 20 aa, Entamoeba histolytica
TKSVTLFAAELMKYSQGNYE

SEQ ID NO: 2697532 - protein, 25 aa, Entamoeba histolytica
TKTFCSHCAYSKAGISRTVDVFNDP

SEQ ID NO: 2697533 - protein, 19 aa, Entamoeba histolytica
TKTILPYFFRTLKIDSSSQ

SEQ ID NO: 2697534 - protein, 20 aa, Entamoeba histolytica
TKTKLEGIFGNKPIMGGPAP

SEQ ID NO: 2697535 - protein, 20 aa, Entamoeba histolytica
TKTKLVYDILKKGSYKKGSD

SEQ ID NO: 2697536 - protein, 18 aa, Entamoeba histolytica
TKTLCDYSYEYSFITYGD

SEQ ID NO: 2697537 - protein, 19 aa, Entamoeba histolytica
TKTPAPFKIVTRNRAGEQL

SEQ ID NO: 2697538 - protein, 31 aa, Entamoeba histolytica
TKTSLPSLFCRYKLLPFYIDLFRSNMPEASC

SEQ ID NO: 2697539 - protein, 17 aa, Entamoeba histolytica
TKTVISFNHFTVKKDFP

SEQ ID NO: 2697540 - protein, 26 aa, Entamoeba histolytica
TKVDFILKCIKIIGSIPGIKLAVLGD

SEQ ID NO: 2697541 - protein, 22 aa, Entamoeba histolytica
TKVEIDLCPLCHLPKDLCPYGP

SEQ ID NO: 2697542 - protein, 17 aa, Entamoeba histolytica
TKVFELHFYPLLQQYLY

SEQ ID NO: 2697543 - protein, 21 aa, Entamoeba histolytica
TKYGKKYPEAMMNLFEDTVVK

SEQ ID NO: 2697544 - protein, 19 aa, Entamoeba histolytica
TKYIFKQIMEGLLYIHENN

SEQ ID NO: 2697545 - protein, 18 aa, Entamoeba histolytica
TKYKCSFHSNIKTRSFCC

SEQ ID NO: 2697546 - protein, 20 aa, Entamoeba histolytica
TKYKMGLRMIQLKKLDKAIE

SEQ ID NO: 2697547 - protein, 17 aa, Entamoeba histolytica
TKYKRIIKEKVFCITDT

SEQ ID NO: 2697548 - protein, 19 aa, Entamoeba histolytica
TKYSVYRIDPMMSLNEILE

SEQ ID NO: 2697549 - protein, 17 aa, Entamoeba histolytica
TKYTCVATHSLFSKSYL

SEQ ID NO: 2697550 - protein, 20 aa, Entamoeba histolytica
TKYYFCPISKIYRTPPIPSK

SEQ ID NO: 2697551 - protein, 24 aa, Entamoeba histolytica
TLACKRGFLPIAEYILIHSNGLAS

SEQ ID NO: 2697552 - protein, 24 aa, Entamoeba histolytica
TLAIELCKYLPNAIGEFRKLIPNL

SEQ ID NO: 2697553 - protein, 24 aa, Entamoeba histolytica
TLAKILAPNLCWSKNEGITGNIYT

SEQ ID NO: 2697554 - protein, 25 aa, Entamoeba histolytica
TLAKILAPNLCWSKNEGITGNIYTM

SEQ ID NO: 2697555 - protein, 25 aa, Entamoeba histolytica
TLAMEMSNDLAIVLVKRGLMEMIYK

SEQ ID NO: 2697556 - protein, 24 aa, Entamoeba histolytica
TLAQTIRLRLCLSKQETNGLFYLN

SEQ ID NO: 2697557 - protein, 22 aa, Entamoeba histolytica
TLARLIGGFLCNAAGEKETQVQ

SEQ ID NO: 2697558 - protein, 25 aa, Entamoeba histolytica
TLCFKRIKQFLPHSIEIYSEPTFLI

SEQ ID NO: 2697559 - protein, 28 aa, Entamoeba histolytica
TLCGTPTYFSPELFKGWNEYKKLSINNE

SEQ ID NO: 2697560 - protein, 17 aa, Entamoeba histolytica
TLCKECLEEYIMNLDLY

SEQ ID NO: 2697561 - protein, 25 aa, Entamoeba histolytica
TLCLQRLVKSPSFYLIQFIEKLEKA

SEQ ID NO: 2697562 - protein, 27 aa, Entamoeba histolytica
TLCSVPGCKAGLELFRSHIDNLPITAV

SEQ ID NO: 2697563 - protein, 19 aa, Entamoeba histolytica
TLCYKCHDIGILCNAITYL

SEQ ID NO: 2697564 - protein, 20 aa, Entamoeba histolytica
TLDHCYYQFVEVKKEEFNKE

SEQ ID NO: 2697565 - protein, 18 aa, Entamoeba histolytica
TLDRIAVINDRCKPGKCR

SEQ ID NO: 2697566 - protein, 25 aa, Entamoeba histolytica
TLDRKDVVEQLLLYQAMLHKNNLEM

SEQ ID NO: 2697567 - protein, 18 aa, Entamoeba histolytica
TLEARAEVATLMLTPTQI

SEQ ID NO: 2697568 - protein, 24 aa, Entamoeba histolytica
TLEECIKSTVLFPLSLSSITLDNC

SEQ ID NO: 2697569 - protein, 23 aa, Entamoeba histolytica
TLEEICSLNMSFNSHYLNTPNIG

SEQ ID NO: 2697570 - protein, 25 aa, Entamoeba histolytica
TLEFHYYLWKVFEFEMKKMNLDTNV

SEQ ID NO: 2697571 - protein, 24 aa, Entamoeba histolytica
TLEGFKERFYKGGEGVDHKELTIK

SEQ ID NO: 2697572 - protein, 21 aa, Entamoeba histolytica
TLELFCLFVEIGLTEEVLNTL

SEQ ID NO: 2697573 - protein, 19 aa, Entamoeba histolytica
TLEPMFNYDYRIHGTSLGY

SEQ ID NO: 2697574 - protein, 25 aa, Entamoeba histolytica
TLEQFSANCRFIFICNEVHLITPAI

SEQ ID NO: 2697575 - protein, 19 aa, Entamoeba histolytica
TLERLIEIYFRLKDIKHWK

SEQ ID NO: 2697576 - protein, 18 aa, Entamoeba histolytica
TLFDAYKTLLVCALEENK

SEQ ID NO: 2697577 - protein, 18 aa, Entamoeba histolytica
TLFDFGWVPVLADRKRKV

SEQ ID NO: 2697578 - protein, 19 aa, Entamoeba histolytica
TLFGKSCFFNCGCEEELKR

SEQ ID NO: 2697579 - protein, 24 aa, Entamoeba histolytica
TLFKLKRINEFGAQMLLMDYSQGK

SEQ ID NO: 2697580 - protein, 17 aa, Entamoeba histolytica
TLFRAVVELEMKKRDGV

SEQ ID NO: 2697581 - protein, 19 aa, Entamoeba histolytica
TLGNIPLEWYNELEHQGYD

SEQ ID NO: 2697582 - protein, 20 aa, Entamoeba histolytica
TLGQRRLDMDAAHDKYESIA

SEQ ID NO: 2697583 - protein, 19 aa, Entamoeba histolytica
TLGSMDCEGDVMKWVNTTL

SEQ ID NO: 2697584 - protein, 21 aa, Entamoeba histolytica
TLHCSAGLFVYESIKESKKIE

SEQ ID NO: 2697585 - protein, 19 aa, Entamoeba histolytica
TLHGQAFVFPLSINQNNNI

SEQ ID NO: 2697586 - protein, 27 aa, Entamoeba histolytica
TLHIPKDCYFYLTGHFQFEVLKGDVYV

SEQ ID NO: 2697587 - protein, 32 aa, Entamoeba histolytica
TLHLKRKDVIAIYLPNCVPFIIMEAVIESSGF

SEQ ID NO: 2697588 - protein, 19 aa, Entamoeba histolytica
TLHPFQNPFVFPMKSSSII

SEQ ID NO: 2697589 - protein, 19 aa, Entamoeba histolytica
TLIECPNDLNGMLDCAKIA

SEQ ID NO: 2697590 - protein, 21 aa, Entamoeba histolytica
TLIFREYELVFILRGHNDSVT

SEQ ID NO: 2697591 - protein, 19 aa, Entamoeba histolytica
TLIKELAAVLVIQNKDILA

SEQ ID NO: 2697592 - protein, 23 aa, Entamoeba histolytica
TLIKELITFGLFVPHNDELRSTE

SEQ ID NO: 2697593 - protein, 17 aa, Entamoeba histolytica
TLIKRFTRLPVKHVQEF

SEQ ID NO: 2697594 - protein, 18 aa, Entamoeba histolytica
TLINRMMEEYAQKYPFVC

SEQ ID NO: 2697595 - protein, 17 aa, Entamoeba histolytica
TLIRRLKRSLPKGESIF

SEQ ID NO: 2697596 - protein, 18 aa, Entamoeba histolytica
TLKCIKLIARYHANDSNQ

SEQ ID NO: 2697597 - protein, 22 aa, Entamoeba histolytica
TLKCSCDLYMHFINQTTLANDF

SEQ ID NO: 2697598 - protein, 23 aa, Entamoeba histolytica
TLKDFFLKLKINVHTDYHKEINN

SEQ ID NO: 2697599 - protein, 23 aa, Entamoeba histolytica
TLKEAYKIYYFFTTLINSRCKQK

SEQ ID NO: 2697600 - protein, 23 aa, Entamoeba histolytica
TLKEQWYKVKYDYINIPVSISRI

SEQ ID NO: 2697601 - protein, 20 aa, Entamoeba histolytica
TLKFSEGVSEWKVFDKHFTV

SEQ ID NO: 2697602 - protein, 23 aa, Entamoeba histolytica
TLKKRGSGLSGLSFKSESNESSV

SEQ ID NO: 2697603 - protein, 18 aa, Entamoeba histolytica
TLKLPVTIEHSSKKTPSL

SEQ ID NO: 2697604 - protein, 20 aa, Entamoeba histolytica
TLKMFCGAIGKGKGENKDWV

SEQ ID NO: 2697605 - protein, 23 aa, Entamoeba histolytica
TLKSISLIMKWMLSNDLKEDSSW

SEQ ID NO: 2697606 - protein, 21 aa, Entamoeba histolytica
TLKTWDVNKGYCLKTTVCFSS

SEQ ID NO: 2697607 - protein, 24 aa, Entamoeba histolytica
TLKVEGFEFERCVDDFIFFCFLVG

SEQ ID NO: 2697608 - protein, 19 aa, Entamoeba histolytica
TLKVLKTEVFNFLDKKKQV

SEQ ID NO: 2697609 - protein, 20 aa, Entamoeba histolytica
TLKYKTFEWLFWDVSGAAKF

SEQ ID NO: 2697610 - protein, 19 aa, Entamoeba histolytica
TLKYLKKFKLFDGKISTLS

SEQ ID NO: 2697611 - protein, 17 aa, Entamoeba histolytica
TLLCYNSEYARTEEGKQ

SEQ ID NO: 2697612 - protein, 25 aa, Entamoeba histolytica
TLLDCMNVIIGILVYYSNSFVNKLM

SEQ ID NO: 2697613 - protein, 19 aa, Entamoeba histolytica
TLLECKKISLSENIPENLA

SEQ ID NO: 2697614 - protein, 22 aa, Entamoeba histolytica
TLLEKRGVLVITKTLPISKSFK

SEQ ID NO: 2697615 - protein, 22 aa, Entamoeba histolytica
TLLKMEPSELVLTRSKKFRLMG

SEQ ID NO: 2697616 - protein, 26 aa, Entamoeba histolytica
TLLKSCLKLMIEPVIPFNKAIEFSQL

SEQ ID NO: 2697617 - protein, 19 aa, Entamoeba histolytica
TLLNTRLKQYFSQWKKMTS

SEQ ID NO: 2697618 - protein, 17 aa, Entamoeba histolytica
TLLNYLFNTKFRILNEV

SEQ ID NO: 2697619 - protein, 17 aa, Entamoeba histolytica
TLLPFISPFTMTPIELT

SEQ ID NO: 2697620 - protein, 25 aa, Entamoeba histolytica
TLLPFPSIIEDWFYLQPIPFTDNVT

SEQ ID NO: 2697621 - protein, 20 aa, Entamoeba histolytica
TLLYCLNINPVIRYINKPNE

SEQ ID NO: 2697622 - protein, 17 aa, Entamoeba histolytica
TLMKATTLFLSRNRTFT

SEQ ID NO: 2697623 - protein, 22 aa, Entamoeba histolytica
TLMYKFCLDVSKAMDYLQESQI

SEQ ID NO: 2697624 - protein, 20 aa, Entamoeba histolytica
TLNDVLLLWDEFILNSNKYL

SEQ ID NO: 2697625 - protein, 24 aa, Entamoeba histolytica
TLNEWRRMCFCFVINRVNSYLTRQ

SEQ ID NO: 2697626 - protein, 27 aa, Entamoeba histolytica
TLNEWRRMCFCFVINRVNYYLTRQELL

SEQ ID NO: 2697627 - protein, 23 aa, Entamoeba histolytica
TLNFCSLPKINECASKTVPVSNA

SEQ ID NO: 2697628 - protein, 22 aa, Entamoeba histolytica
TLNMRGLCRMPDLTQHSLITLD

SEQ ID NO: 2697629 - protein, 18 aa, Entamoeba histolytica
TLNSLGLEVYSFRELENK

SEQ ID NO: 2697630 - protein, 30 aa, Entamoeba histolytica; identical to SEQ ID NO: 2506770

SEQ ID NO: 2697631 - protein, 17 aa, Entamoeba histolytica
TLPDAKIAIRIQLTNKI

SEQ ID NO: 2697632 - protein, 25 aa, Entamoeba histolytica
TLPEGPKLMKFVIIHSSAKARKGLL

SEQ ID NO: 2697633 - protein, 17 aa, Entamoeba histolytica
TLPKIMAIKKCQEIEID

SEQ ID NO: 2697634 - protein, 24 aa, Entamoeba histolytica
TLPLLRKLRNIIGINNRIKVILIS

SEQ ID NO: 2697635 - protein, 19 aa, Entamoeba histolytica
TLPRSYRIKKFVVVDLPDV

SEQ ID NO: 2697636 - protein, 30 aa, Entamoeba histolytica
TLPSRNLKILAFYMNLFYVFTINSDVHKMQ

SEQ ID NO: 2697637 - protein, 26 aa, Entamoeba histolytica
TLQELLKIINIRAGVENVELSEQALL

SEQ ID NO: 2697638 - protein, 17 aa, Entamoeba histolytica
TLQKLRGTYAYCAPEIY

SEQ ID NO: 2697639 - protein, 34 aa, Entamoeba histolytica
TLQKVYNFVMGFGFDKFVLIDGIKKNEFTNLQQT

SEQ ID NO: 2697640 - protein, 27 aa, Entamoeba histolytica
TLQPLQCVSGFLVLRVICPAIMQPHKT

SEQ ID NO: 2697641 - protein, 19 aa, Entamoeba histolytica
TLRALQYIHEYGFIHRDIK

SEQ ID NO: 2697642 - protein, 29 aa, Entamoeba histolytica
TLRECFPTFLSFFALPLVSAIPYTAVSLR

SEQ ID NO: 2697643 - protein, 26 aa, Entamoeba histolytica
TLRFDYQKEFIKWCLKVPGYYPSWFV

SEQ ID NO: 2697644 - protein, 29 aa, Entamoeba histolytica
TLRKSSNPWFKWKLTTSFENHRIQLKIIR

SEQ ID NO: 2697645 - protein, 21 aa, Entamoeba histolytica
TLRLERIRKVFFNSKYICSQN

SEQ ID NO: 2697646 - protein, 20 aa, Entamoeba histolytica
TLRLERNLTDSWVFVSPFDR

SEQ ID NO: 2697647 - protein, 19 aa, Entamoeba histolytica
TLRNVKFVAEKDLINSFMD

SEQ ID NO: 2697648 - protein, 28 aa, Entamoeba histolytica
TLRRLMKFPPVFALRPLIDMAVSICDRT

SEQ ID NO: 2697649 - protein, 23 aa, Entamoeba histolytica
TLRSPCGLASFGCGSKLTAQTLN

SEQ ID NO: 2697650 - protein, 17 aa, Entamoeba histolytica
TLSECPEDFCEIVRKKC

SEQ ID NO: 2697651 - protein, 17 aa, Entamoeba histolytica
TLSFLIPLFEIIKRERE

SEQ ID NO: 2697652 - protein, 24 aa, Entamoeba histolytica
TLSLEIADIYTFVATLSEELETLK

SEQ ID NO: 2697653 - protein, 24 aa, Entamoeba histolytica
TLSLEQWKGIILKYENEKWLKTHL

SEQ ID NO: 2697654 - protein, 17 aa, Entamoeba histolytica
TLSLLGLNNKYALTLYV

SEQ ID NO: 2697655 - protein, 18 aa, Entamoeba histolytica
TLSQYPIYPWVICSYDSK

SEQ ID NO: 2697656 - protein, 23 aa, Entamoeba histolytica
TLSSFKRVFAIPIQKAQDGNASI

SEQ ID NO: 2697657 - protein, 20 aa, Entamoeba histolytica
TLTDILIKTEIGSVIKNSDN

SEQ ID NO: 2697658 - protein, 19 aa, Entamoeba histolytica
TLTGFKWIGNKAKEIVDTQ

SEQ ID NO: 2697659 - protein, 23 aa, Entamoeba histolytica
TLTGKLHIKVCLKQDNINNRVTF

SEQ ID NO: 2697660 - protein, 17 aa, Entamoeba histolytica
TLTICTRSTLLKQKFFA

SEQ ID NO: 2697661 - protein, 23 aa, Entamoeba histolytica
TLTKGGEILSIFDARPPLNAQAN

SEQ ID NO: 2697662 - protein, 19 aa, Entamoeba histolytica
TLTKLSINLCEEISKLDNL

SEQ ID NO: 2697663 - protein, 26 aa, Entamoeba histolytica
TLTMPLLMEIIWNCVMSNNLLNNQIT

SEQ ID NO: 2697664 - protein, 28 aa, Entamoeba histolytica
TLTNLFCTRILYLIVCITPVQYRLRIVS

SEQ ID NO: 2697665 - protein, 24 aa, Entamoeba histolytica
TLTRFEMEYCTIVSLLDISESNIT

SEQ ID NO: 2697666 - protein, 25 aa, Entamoeba histolytica
TLTRSLSVFLFPCFAVNNQINLTIF

SEQ ID NO: 2697667 - protein, 18 aa, Entamoeba histolytica
TLTSFKLLLSSCFRNEAM

SEQ ID NO: 2697668 - protein, 17 aa, Entamoeba histolytica
TLTSIIFNDCHYINKCS

SEQ ID NO: 2697669 - protein, 23 aa, Entamoeba histolytica
TLTSPPIKGAIEFITEMHEKNIP

SEQ ID NO: 2697670 - protein, 17 aa, Entamoeba histolytica
TLTYLRLQGITFTQPLT

SEQ ID NO: 2697671 - protein, 19 aa, Entamoeba histolytica
TLVDGWRMVDNNNQLIYIN

SEQ ID NO: 2697672 - protein, 25 aa, Entamoeba histolytica
TLVEDFCYHHSWLNIKIIRGSELLS

SEQ ID NO: 2697673 - protein, 19 aa, Entamoeba histolytica
TLVILRCYVLLSHCEGDYP

SEQ ID NO: 2697674 - protein, 24 aa, Entamoeba histolytica
TLVKPEYGEYYWVAKVEDEETENE

SEQ ID NO: 2697675 - protein, 26 aa, Entamoeba histolytica
TLVKSSHALRPFYITLLSSKSCLSLK

SEQ ID NO: 2697676 - protein, 17 aa, Entamoeba histolytica
TLVLDIAKQIAFGMNEI

SEQ ID NO: 2697677 - protein, 30 aa, Entamoeba histolytica
TLVQHAATLPRCGLVPRSLDVEIRSIVFFS

SEQ ID NO: 2697678 - protein, 23 aa, Entamoeba histolytica
TLVSSFFLFLACLDQKHFELIKD

SEQ ID NO: 2697679 - protein, 17 aa, Entamoeba histolytica
TLVYARIILFIIDKSNS

SEQ ID NO: 2697680 - protein, 21 aa, Entamoeba histolytica
TLWGKEVWMKTSVLRDDGTVE

SEQ ID NO: 2697681 - protein, 21 aa, Entamoeba histolytica
TLWKECLIYHTMLSRNPQRVL

SEQ ID NO: 2697682 - protein, 20 aa, Entamoeba histolytica
TLWYIFSFLRRVLEQQDINK

SEQ ID NO: 2697683 - protein, 19 aa, Entamoeba histolytica
TLYETNLKEIRCYLDQTET

SEQ ID NO: 2697684 - protein, 23 aa, Entamoeba histolytica
TLYKCMLGYTQKYYFSQFSAFYQ

SEQ ID NO: 2697685 - protein, 20 aa, Entamoeba histolytica
TLYRIYRMNPVDLVGSENGK

SEQ ID NO: 2697686 - protein, 24 aa, Entamoeba histolytica
TLYSHRFFPYYSFSLLAGINSKGK

SEQ ID NO: 2697687 - protein, 21 aa, Entamoeba histolytica
TLYTNCTKFIILDESDKLTKD

SEQ ID NO: 2697688 - protein, 19 aa, Entamoeba histolytica
TMAGSRLSEKLDLEDYEEL

SEQ ID NO: 2697689 - protein, 22 aa, Entamoeba histolytica
TMDIRSIAWRIFLGALHGICGN

SEQ ID NO: 2697690 - protein, 17 aa, Entamoeba histolytica
TMEIGGVLNFVCKQSGY

SEQ ID NO: 2697691 - protein, 20 aa, Entamoeba histolytica
TMEIKKPLFVIGLPRSGTTF

SEQ ID NO: 2697692 - protein, 25 aa, Entamoeba histolytica
TMERISEFLKVFVIALQRHGPQILL

SEQ ID NO: 2697693 - protein, 17 aa, Entamoeba histolytica
TMEYLFKLYDAVDQTIT

SEQ ID NO: 2697694 - protein, 30 aa, Entamoeba histolytica
TMFKVDNGFCYLSCPDCKKKIVEGSTFCEK

SEQ ID NO: 2697695 - protein, 28 aa, Entamoeba histolytica
TMFPDEYDFLGLEPNDLVAFKQLVEDAK

SEQ ID NO: 2697696 - protein, 24 aa, Entamoeba histolytica
TMKLKAVCGNLFIKDAQPMVWEIA

SEQ ID NO: 2697697 - protein, 25 aa, Entamoeba histolytica
TMKLKAVCGNLFIKDAQPMVWEIAV

SEQ ID NO: 2697698 - protein, 24 aa, Entamoeba histolytica
TMKLYFKYLHLERWFNMDQIILYD

SEQ ID NO: 2697699 - protein, 19 aa, Entamoeba histolytica
TMKSGFCPVKKALGKGIKM

SEQ ID NO: 2697700 - protein, 26 aa, Entamoeba histolytica
TMKSKGCGFVKFVNHVSAKKCLDASQ

SEQ ID NO: 2697701 - protein, 21 aa, Entamoeba histolytica
TMKTFRFERIETIFFEQKPIL

SEQ ID NO: 2697702 - protein, 24 aa, Entamoeba histolytica
TMLKLNRIDVIPSLYQRAIPFLSL

SEQ ID NO: 2697703 - protein, 22 aa, Entamoeba histolytica
TMLKRFYPDRVDLLKQMEELKK

SEQ ID NO: 2697704 - protein, 19 aa, Entamoeba histolytica
TMMSRSYYEGCNAVIVVFD

SEQ ID NO: 2697705 - protein, 23 aa, Entamoeba histolytica
TMNDCKECIVDGYIHDKIVNIVD

SEQ ID NO: 2697706 - protein, 27 aa, Entamoeba histolytica
TMNLPKYQLRCCFLRGFPGVQKFKTLE

SEQ ID NO: 2697707 - protein, 34 aa, Entamoeba histolytica
TMQRIVLDLIEFWLSQCPSEFCPNSIKGWKQDLC

SEQ ID NO: 2697708 - protein, 20 aa, Entamoeba histolytica
TMQTEDRMRTALKGQVLRFL

SEQ ID NO: 2697709 - protein, 23 aa, Entamoeba histolytica
TMRKRLIEILPKIPKSIDYFEQA

SEQ ID NO: 2697710 - protein, 17 aa, Entamoeba histolytica
TMRYPILILELLKNTPI

SEQ ID NO: 2697711 - protein, 17 aa, Entamoeba histolytica
TMTALCRNNYDLTREDI

SEQ ID NO: 2697712 - protein, 22 aa, Entamoeba histolytica
TMTDCFIRGNTIRYVSMAENNI

SEQ ID NO: 2697713 - protein, 23 aa, Entamoeba histolytica
TMTKIGLPVPQGFVITTEMCKQF

SEQ ID NO: 2697714 - protein, 25 aa, Entamoeba histolytica
TMTKIGLPVPQGFVITTEMCKQFIA

SEQ ID NO: 2697715 - protein, 18 aa, Entamoeba histolytica
TMVECVRAALTADKIATE

SEQ ID NO: 2697716 - protein, 18 aa, Entamoeba histolytica
TMVGNLKAAFQQRDSTQV

SEQ ID NO: 2697717 - protein, 20 aa, Entamoeba histolytica
TMVMMCLWIMMLKQKNIGSS

SEQ ID NO: 2697718 - protein, 17 aa, Entamoeba histolytica
TNADWKFSTNSSQTTRL

SEQ ID NO: 2697719 - protein, 22 aa, Entamoeba histolytica
TNAFKPSLVYRNFSNIYNDNGD

SEQ ID NO: 2697720 - protein, 19 aa, Entamoeba histolytica
TNALPPVPIKSYRRRKEKI

SEQ ID NO: 2697721 - protein, 17 aa, Entamoeba histolytica
TNCFEVIEFSNLTNSFN

SEQ ID NO: 2697722 - protein, 22 aa, Entamoeba histolytica
TNCKSIKSSLQFSSSQTTVTKE

SEQ ID NO: 2697723 - protein, 17 aa, Entamoeba histolytica
TNCSICRKQGVEGVNNL

SEQ ID NO: 2697724 - protein, 19 aa, Entamoeba histolytica
TNCSNANIFSVSWKTPVSL

SEQ ID NO: 2697725 - protein, 27 aa, Entamoeba histolytica
TNCTVMVVADGCGWGVTSARAAHIAVE

SEQ ID NO: 2697726 - protein, 18 aa, Entamoeba histolytica
TNDAERMWEMKLFVEEKV

SEQ ID NO: 2697727 - protein, 18 aa, Entamoeba histolytica
TNDFRVVQYYIHPQTSDL

SEQ ID NO: 2697728 - protein, 26 aa, Entamoeba histolytica
TNDIPKDRIVAVFLIDEDWQFEDLPF

SEQ ID NO: 2697729 - protein, 25 aa, Entamoeba histolytica
TNDLIYRKIFEIVINMQNKMEEIYE

SEQ ID NO: 2697730 - protein, 24 aa, Entamoeba histolytica
TNDPKANMNYCFTAARDFLGIPII

SEQ ID NO: 2697731 - protein, 18 aa, Entamoeba histolytica
TNDVFVCTLSGCSSPTLR

SEQ ID NO: 2697732 - protein, 19 aa, Entamoeba histolytica
TNEASFKSLDTWKKEFLNG

SEQ ID NO: 2697733 - protein, 17 aa, Entamoeba histolytica
TNEEIRNGLLEQRLEVF

SEQ ID NO: 2697734 - protein, 23 aa, Entamoeba histolytica
TNEERISCYLKVIECYISMGYIK

SEQ ID NO: 2697735 - protein, 27 aa, Entamoeba histolytica
TNEFIMLCCDILKFLFDTVPDLYQRLK

SEQ ID NO: 2697736 - protein, 26 aa, Entamoeba histolytica
TNEFPKCPICLEDVVMPRLTSCGHMY

SEQ ID NO: 2697737 - protein, 19 aa, Entamoeba histolytica
TNEIMLCLGPKTKVKKWNI

SEQ ID NO: 2697738 - protein, 26 aa, Entamoeba histolytica
TNEKRLRPSFRMSLNDGIFVKLLNGR

SEQ ID NO: 2697739 - protein, 25 aa, Entamoeba histolytica
TNELFLYKNFAKFGAIEQCNCLYEP

SEQ ID NO: 2697740 - protein, 23 aa, Entamoeba histolytica
TNEVADKLTIFWISQPKNLIQIC

SEQ ID NO: 2697741 - protein, 29 aa, Entamoeba histolytica
TNFIKSRFKTEEAICCVFALKEKVIVGST

SEQ ID NO: 2697742 - protein, 19 aa, Entamoeba histolytica
TNFMLCLTSVEPIENAEVT

SEQ ID NO: 2697743 - protein, 25 aa, Entamoeba histolytica
TNFNEIPCDVVASVFKKFLRNLPIH

SEQ ID NO: 2697744 - protein, 17 aa, Entamoeba histolytica
TNFPFNLTLNAPFDSYL

SEQ ID NO: 2697745 - protein, 22 aa, Entamoeba histolytica
TNFRKNRQSCFSPSSITQSIDY

SEQ ID NO: 2697746 - protein, 17 aa, Entamoeba histolytica
TNGELRKDLFLFELEKI

SEQ ID NO: 2697747 - protein, 26 aa, Entamoeba histolytica
TNGFELKLGYFPFESLSTLVYGHLKA

SEQ ID NO: 2697748 - protein, 18 aa, Entamoeba histolytica
TNGIDWKVNLLEINSSSF

SEQ ID NO: 2697749 - protein, 25 aa, Entamoeba histolytica
TNHFKSVRIPNCYEIILKDKHYSFV

SEQ ID NO: 2697750 - protein, 19 aa, Entamoeba histolytica
TNHFLAIFEFMVIRLGKDP

SEQ ID NO: 2697751 - protein, 17 aa, Entamoeba histolytica
TNHTFDISLCEELESFF

SEQ ID NO: 2697752 - protein, 19 aa, Entamoeba histolytica
TNICFIKLFHMNSTDWIID

SEQ ID NO: 2697753 - protein, 20 aa, Entamoeba histolytica
TNICKPRISSVPVTQKDFDV

SEQ ID NO: 2697754 - protein, 19 aa, Entamoeba histolytica
TNIGFVVKLLHHLQQLDVL

SEQ ID NO: 2697755 - protein, 24 aa, Entamoeba histolytica
TNIHIRYEGVNGWINTKYAIGSVI

SEQ ID NO: 2697756 - protein, 17 aa, Entamoeba histolytica
TNIKLVTTIGVHPTRTN

SEQ ID NO: 2697757 - protein, 17 aa, Entamoeba histolytica
TNILTPKFPDFFTDEMK

SEQ ID NO: 2697758 - protein, 17 aa, Entamoeba histolytica
TNIPWQLDTAIRRRFEK

SEQ ID NO: 2697759 - protein, 20 aa, Entamoeba histolytica
TNISELIPFCELNINQLCDE

SEQ ID NO: 2697760 - protein, 18 aa, Entamoeba histolytica
TNKFLKVMGERLLGNLTI

SEQ ID NO: 2697761 - protein, 24 aa, Entamoeba histolytica
TNKKIWKFICQVLSTHKMKVTLLR

SEQ ID NO: 2697762 - protein, 27 aa, Entamoeba histolytica
TNKLSWRVDGPQGALIQKMVDFFWNVG

SEQ ID NO: 2697763 - protein, 19 aa, Entamoeba histolytica
TNKLVIYWDVERNGKSEII

SEQ ID NO: 2697764 - protein, 26 aa, Entamoeba histolytica
TNKNSIEGAMKWKANIDDRVLFNNEK

SEQ ID NO: 2697765 - protein, 19 aa, Entamoeba histolytica
TNKSICPPLPPKAERFNQE

SEQ ID NO: 2697766 - protein, 20 aa, Entamoeba histolytica
TNKYECINYLNGNSTIPSTV

SEQ ID NO: 2697767 - protein, 21 aa, Entamoeba histolytica
TNKYECIYYLNGNSTIPSTVD

SEQ ID NO: 2697768 - protein, 23 aa, Entamoeba histolytica
TNKYRISKVIGYGAFGIVFLATN

SEQ ID NO: 2697769 - protein, 22 aa, Entamoeba histolytica
TNKYTLWYLCDFLVDVLNHQSV

SEQ ID NO: 2697770 - protein, 18 aa, Entamoeba histolytica
TNLAVCFAPVLTRPSDST

SEQ ID NO: 2697771 - protein, 17 aa, Entamoeba histolytica
TNLELVSGIALHSPKLF

SEQ ID NO: 2697772 - protein, 22 aa, Entamoeba histolytica
TNLFCLRVMTGCIILNDNISEL

SEQ ID NO: 2697773 - protein, 18 aa, Entamoeba histolytica
TNLIPISSLPEWAQKSLM

SEQ ID NO: 2697774 - protein, 21 aa, Entamoeba histolytica
TNLIPRRACSDFIENKESSQA

SEQ ID NO: 2697775 - protein, 18 aa, Entamoeba histolytica
TNLIQELQNASSQILGAI

SEQ ID NO: 2697776 - protein, 21 aa, Entamoeba histolytica
TNLKNCVIITNKIRENVYGKE

SEQ ID NO: 2697777 - protein, 28 aa, Entamoeba histolytica
TNLLELKFKMCLKENYISIDHFTLDHLT

SEQ ID NO: 2697778 - protein, 24 aa, Entamoeba histolytica
TNLLKEILNFKGYNHIKKESPDVI

SEQ ID NO: 2697779 - protein, 26 aa, Entamoeba histolytica
TNLPHKRLRDVAARVKYLKYIETHPT

SEQ ID NO: 2697780 - protein, 17 aa, Entamoeba histolytica
TNLRRCYSQLKDILATN

SEQ ID NO: 2697781 - protein, 26 aa, Entamoeba histolytica
TNLRRRLNQLAIKYKHLYLTNTQILL

SEQ ID NO: 2697782 - protein, 20 aa, Entamoeba histolytica
TNLSLISSRLIRLETNQKDM

SEQ ID NO: 2697783 - protein, 25 aa, Entamoeba histolytica
TNLSYFRMVYFSGIDELSTRGFLSK

SEQ ID NO: 2697784 - protein, 18 aa, Entamoeba histolytica
TNLWIRYSSVLKSIKTDK

SEQ ID NO: 2697785 - protein, 17 aa, Entamoeba histolytica
TNNALEFLINYSAGNVL

SEQ ID NO: 2697786 - protein, 22 aa, Entamoeba histolytica
TNNFSLRLKIIVVGDPSSGKTS

SEQ ID NO: 2697787 - protein, 17 aa, Entamoeba histolytica
TNNISFRKSEFISKQKD

SEQ ID NO: 2697788 - protein, 19 aa, Entamoeba histolytica
TNNPRRAPHPQGYYTQPPL

SEQ ID NO: 2697789 - protein, 22 aa, Entamoeba histolytica
TNPETPDTFALFVPENSKKNVP

SEQ ID NO: 2697790 - protein, 18 aa, Entamoeba histolytica
TNPFLVDLICSFIKKYKH

SEQ ID NO: 2697791 - protein, 23 aa, Entamoeba histolytica
TNPGMKVMFPKTLGKISKRGGNQ

SEQ ID NO: 2697792 - protein, 18 aa, Entamoeba histolytica
TNPITFPFGVSFRPFECE

SEQ ID NO: 2697793 - protein, 26 aa, Entamoeba histolytica
TNPLPILNYKCRAEVSNAESLNVKTE

SEQ ID NO: 2697794 - protein, 22 aa, Entamoeba histolytica
TNPRCGHSFCLSCVSEYANEKI

SEQ ID NO: 2697795 - protein, 21 aa, Entamoeba histolytica
TNPTLTWKDFYCEHKLNKQKR

SEQ ID NO: 2697796 - protein, 17 aa, Entamoeba histolytica
TNQCKIRDGAAVRIAKC

SEQ ID NO: 2697797 - protein, 20 aa, Entamoeba histolytica
TNQIGRLCEIGFPDGFISVA

SEQ ID NO: 2697798 - protein, 24 aa, Entamoeba histolytica
TNQLDCFKKFFVFDDGYSSLKEVG

SEQ ID NO: 2697799 - protein, 24 aa, Entamoeba histolytica
TNQMGICCRVVMKRLGNVLKENTS

SEQ ID NO: 2697800 - protein, 24 aa, Entamoeba histolytica
TNQNLKWKVKEDIVDFDACSLYPS

SEQ ID NO: 2697801 - protein, 17 aa, Entamoeba histolytica
TNQSGDCTFEIENNLES

SEQ ID NO: 2697802 - protein, 29 aa, Entamoeba histolytica
TNRPDCIDPAMLRPGRLDRLISVDLPNSD

SEQ ID NO: 2697803 - protein, 22 aa, Entamoeba histolytica
TNSEFIPYISIIQEEASSVSIP

SEQ ID NO: 2697804 - protein, 26 aa, Entamoeba histolytica
TNSEKRLCLLYVIDMIVKIDINRIYV

SEQ ID NO: 2697805 - protein, 23 aa, Entamoeba histolytica
TNSIYGCLGFKGSRFYCQKIAEW

SEQ ID NO: 2697806 - protein, 32 aa, Entamoeba histolytica
TNSIYPKLAFEIIKMYLKRLAEPILGIYYFDM

SEQ ID NO: 2697807 - protein, 23 aa, Entamoeba histolytica
TNTEILLGITMKRCKILVNHREC

SEQ ID NO: 2697808 - protein, 17 aa, Entamoeba histolytica
TNTEVISTMGFHDSKIL

SEQ ID NO: 2697809 - protein, 26 aa, Entamoeba histolytica
TNTIIEWSKRMTVCAGICYGKSNGCV

SEQ ID NO: 2697810 - protein, 24 aa, Entamoeba histolytica
TNTKEIPGILTMVVEDNYKKPLKK

SEQ ID NO: 2697811 - protein, 18 aa, Entamoeba histolytica
TNTLFFYLRDNFLKFHGD

SEQ ID NO: 2697812 - protein, 17 aa, Entamoeba histolytica
TNTNASCSVCYITDEFT

SEQ ID NO: 2697813 - protein, 21 aa, Entamoeba histolytica
TNTQILLGIRISRCKILVDNR

SEQ ID NO: 2697814 - protein, 21 aa, Entamoeba histolytica
TNTQILLGIRISRCQILVDNS

SEQ ID NO: 2697815 - protein, 24 aa, Entamoeba histolytica
TNTYSGILRLFGKVTPQSITKVSK

SEQ ID NO: 2697816 - protein, 24 aa, Entamoeba histolytica
TNVCLGFKENLLIEATHLSLQANK

SEQ ID NO: 2697817 - protein, 24 aa, Entamoeba histolytica
TNVSKIGNYCFKYCSSLQTIEIPT

SEQ ID NO: 2697818 - protein, 25 aa, Entamoeba histolytica
TNVSKIGNYCFKYCSSLQTIEIPTS

SEQ ID NO: 2697819 - protein, 27 aa, Entamoeba histolytica
TNVTMPYACKLLFQEMQSMNVVPRLSI

SEQ ID NO: 2697820 - protein, 17 aa, Entamoeba histolytica
TNWICLTYEGPKSKKLV

SEQ ID NO: 2697821 - protein, 24 aa, Entamoeba histolytica
TNYELKLAIGRFISESPFVLSQSP

SEQ ID NO: 2697822 - protein, 25 aa, Entamoeba histolytica
TNYKIKFTLGTIIKEIILIEGNTLS

SEQ ID NO: 2697823 - protein, 27 aa, Entamoeba histolytica
TNYKYRADFCLAATYALNGILATGIQQ

SEQ ID NO: 2697824 - protein, 17 aa, Entamoeba histolytica
TNYPGIGVIDGDLCDYF

SEQ ID NO: 2697825 - protein, 18 aa, Entamoeba histolytica
TPAKEKKKKFSIFKKKDK

SEQ ID NO: 2697826 - protein, 18 aa, Entamoeba histolytica
TPAPFWSEEEQLLLDENI

SEQ ID NO: 2697827 - protein, 24 aa, Entamoeba histolytica
TPAYVVFFLVRLVPEFMLHLQSGV

SEQ ID NO: 2697828 - protein, 18 aa, Entamoeba histolytica
TPDDWKKVIDDWKRMPSS

SEQ ID NO: 2697829 - protein, 18 aa, Entamoeba histolytica
TPDIPLATQIVHFKPKTI

SEQ ID NO: 2697830 - protein, 20 aa, Entamoeba histolytica
TPDYSSWPLLLQNFDQLEIK

SEQ ID NO: 2697831 - protein, 18 aa, Entamoeba histolytica
TPEALSFGGGTGHPSLSF

SEQ ID NO: 2697832 - protein, 22 aa, Entamoeba histolytica
TPEEAKTLIGMISQLEIMYTNF

SEQ ID NO: 2697833 - protein, 20 aa, Entamoeba histolytica
TPEELILATCPWKEIEQDGK

SEQ ID NO: 2697834 - protein, 21 aa, Entamoeba histolytica
TPELGRFSTIGGIGVLINELT

SEQ ID NO: 2697835 - protein, 25 aa, Entamoeba histolytica
TPELRHRGSLPIKVQSIALPITSTT

SEQ ID NO: 2697836 - protein, 30 aa, Entamoeba histolytica
TPELSPEHPPRFSITKAPALSEMELENKRS

SEQ ID NO: 2697837 - protein, 33 aa, Entamoeba histolytica
TPEQYRNICRLTHQYECGLVCDTLLQRLGDDGK

SEQ ID NO: 2697838 - protein, 25 aa, Entamoeba histolytica
TPERVCCYEAMMAGKMRLQDKDIEV

SEQ ID NO: 2697839 - protein, 23 aa, Entamoeba histolytica
TPEYRAPELINVYEYLPIGCKSD

SEQ ID NO: 2697840 - protein, 23 aa, Entamoeba histolytica
TPFHPKTRMEIHKIAWLDIDDIT

SEQ ID NO: 2697841 - protein, 32 aa, Entamoeba histolytica
TPFIPILRFRILKDIKQLPGLYILMLLGYLFK

SEQ ID NO: 2697842 - protein, 18 aa, Entamoeba histolytica
TPFIRFYNFYLFFYCNEY

SEQ ID NO: 2697843 - protein, 25 aa, Entamoeba histolytica
TPFIRLYSYYLFFYCSDFMNKTTSE

SEQ ID NO: 2697844 - protein, 19 aa, Entamoeba histolytica
TPFLEELCLNRCSNVSYHL

SEQ ID NO: 2697845 - protein, 23 aa, Entamoeba histolytica
TPFLHCIEHSFICFSSLKIFLNF

SEQ ID NO: 2697846 - protein, 24 aa, Entamoeba histolytica
TPFLNRIIHLIRLFSNPKDNKSLQ

SEQ ID NO: 2697847 - protein, 22 aa, Entamoeba histolytica
TPFSEFKFFSEIREKVLMGYRP

SEQ ID NO: 2697848 - protein, 21 aa, Entamoeba histolytica
TPFTCFSLHPGVYNSSLHNSY

SEQ ID NO: 2697849 - protein, 23 aa, Entamoeba histolytica
TPGTRLRISRSIGHSTEPLLSSH

SEQ ID NO: 2697850 - protein, 19 aa, Entamoeba histolytica
TPIDFIILPPLKLKNQQSQ

SEQ ID NO: 2697851 - protein, 17 aa, Entamoeba histolytica
TPIEFILPIDIQIQNKH

SEQ ID NO: 2697852 - protein, 25 aa, Entamoeba histolytica
TPIFYPKDRFGLIFYGSQNSTKSLA

SEQ ID NO: 2697853 - protein, 17 aa, Entamoeba histolytica
TPIHILIPFENWTIQGE

SEQ ID NO: 2697854 - protein, 24 aa, Entamoeba histolytica
TPIQCPRCEKTFCSKCLTKNHNGQ

SEQ ID NO: 2697855 - protein, 17 aa, Entamoeba histolytica
TPITGIWQTVWVEPVHD

SEQ ID NO: 2697856 - protein, 18 aa, Entamoeba histolytica
TPIYPTVETIIRIRIIVS

SEQ ID NO: 2697857 - protein, 21 aa, Entamoeba histolytica
TPKEMKISFIYSSKQCSRTNT

SEQ ID NO: 2697858 - protein, 26 aa, Entamoeba histolytica
TPKEYELFRFPSLKKELIINGVYIRL

SEQ ID NO: 2697859 - protein, 21 aa, Entamoeba histolytica
TPKGIRKWECISRKSKKLSGL

SEQ ID NO: 2697860 - protein, 23 aa, Entamoeba histolytica
TPKGRIVCGGIIRKIAIIKETLW

SEQ ID NO: 2697861 - protein, 17 aa, Entamoeba histolytica
TPKIISRITEWCRESKT

SEQ ID NO: 2697862 - protein, 18 aa, Entamoeba histolytica
TPKMVARQIIKTYFIQYN

SEQ ID NO: 2697863 - protein, 26 aa, Entamoeba histolytica
TPKMYFKSIDVYGSHHLSAFVTSGNI

SEQ ID NO: 2697864 - protein, 17 aa, Entamoeba histolytica
TPKNIKSCFTITDGSLR

SEQ ID NO: 2697865 - protein, 24 aa, Entamoeba histolytica
TPKRLRMANLAIICSHTVNGVAAI

SEQ ID NO: 2697866 - protein, 23 aa, Entamoeba histolytica
TPKRNVYWIGVNALLVKRINTEI

SEQ ID NO: 2697867 - protein, 23 aa, Entamoeba histolytica
TPKSLFCSEIGFLSANLYATTVF

SEQ ID NO: 2697868 - protein, 19 aa, Entamoeba histolytica
TPLEKVMYIFSSFKILEQM

SEQ ID NO: 2697869 - protein, 18 aa, Entamoeba histolytica
TPLFKVEYSFDINIDLFY

SEQ ID NO: 2697870 - protein, 19 aa, Entamoeba histolytica
TPLGIALKAIKPTPEQLDK

SEQ ID NO: 2697871 - protein, 25 aa, Entamoeba histolytica
TPLGKRFEMILKYLFPVPKSDSKRV

SEQ ID NO: 2697872 - protein, 19 aa, Entamoeba histolytica
TPLHIACLCGYKNIVENLE

SEQ ID NO: 2697873 - protein, 23 aa, Entamoeba histolytica
TPLHPEIKPIISINGDPLELDID

SEQ ID NO: 2697874 - protein, 17 aa, Entamoeba histolytica
TPLKRKAITPLLESKRR

SEQ ID NO: 2697875 - protein, 18 aa, Entamoeba histolytica
TPLLELSSLIVLKVKENK

SEQ ID NO: 2697876 - protein, 26 aa, Entamoeba histolytica
TPLLQHLRLNFLLDYFPNIETIESSI

SEQ ID NO: 2697877 - protein, 25 aa, Entamoeba histolytica
TPLMIYLCKLKKILSELPIASTVLH

SEQ ID NO: 2697878 - protein, 24 aa, Entamoeba histolytica
TPLNPRIQDLFTIILNVSLNMSYD

SEQ ID NO: 2697879 - protein, 18 aa, Entamoeba histolytica
TPLSNNCNQCFPNKSNDS

SEQ ID NO: 2697880 - protein, 27 aa, Entamoeba histolytica
TPLSTMKGWEKLRWEDILHIKTIVEDD

SEQ ID NO: 2697881 - protein, 23 aa, Entamoeba histolytica
TPMIACATIIPPCHSESEPSLNP

SEQ ID NO: 2697882 - protein, 19 aa, Entamoeba histolytica
TPMKGLLWWLSKIGFDGIC

SEQ ID NO: 2697883 - protein, 24 aa, Entamoeba histolytica
TPNCEELLSMLWRITSKSDDVSVE

SEQ ID NO: 2697884 - protein, 22 aa, Entamoeba histolytica
TPNEVLLEYEIVAFSDKITEEN

SEQ ID NO: 2697885 - protein, 24 aa, Entamoeba histolytica
TPNILPRHCSLIVCDKDWGRCVCN

SEQ ID NO: 2697886 - protein, 25 aa, Entamoeba histolytica
TPNRDLAAFILFRIVNLTLQNEVVF

SEQ ID NO: 2697887 - protein, 21 aa, Entamoeba histolytica
TPPEMISLIFSDLSVFTPSAV

SEQ ID NO: 2697888 - protein, 17 aa, Entamoeba histolytica
TPPIKIIDTPGFVNTRG

SEQ ID NO: 2697889 - protein, 25 aa, Entamoeba histolytica
TPQLLVEIIWILSRFSYTKEEVLTS

SEQ ID NO: 2697890 - protein, 24 aa, Entamoeba histolytica
TPQLSKFWTCSGYQPTYLRLTAND

SEQ ID NO: 2697891 - protein, 17 aa, Entamoeba histolytica
TPQNMKCDFTFGKYADQ

SEQ ID NO: 2697892 - protein, 20 aa, Entamoeba histolytica
TPQPKVGAVFEIQYQHLPNK

SEQ ID NO: 2697893 - protein, 25 aa, Entamoeba histolytica
TPRIVCPQCSFVYCYNCKEEYHEGY

SEQ ID NO: 2697894 - protein, 24 aa, Entamoeba histolytica
TPSKKVAPPIPHRSLPPKPLRSSV

SEQ ID NO: 2697895 - protein, 26 aa, Entamoeba histolytica
TPSLFKRVVTGFAYNLLSTHFYYSVL

SEQ ID NO: 2697896 - protein, 17 aa, Entamoeba histolytica
TPSSRVVPVKALPPKPS

SEQ ID NO: 2697897 - protein, 24 aa, Entamoeba histolytica
TPTHLELRLSIYGRSLDEWEKLAE

SEQ ID NO: 2697898 - protein, 24 aa, Entamoeba histolytica
TPVHNLCFYKNKLYGVIPSPTKSS

SEQ ID NO: 2697899 - protein, 17 aa, Entamoeba histolytica
TPYQYIVLIGLNRLSQI

SEQ ID NO: 2697900 - protein, 23 aa, Entamoeba histolytica
TQADIKCVNWNVKVPHIIALTLS

SEQ ID NO: 2697901 - protein, 25 aa, Entamoeba histolytica
TQAEGLLRMGLHPTIIADGYRTGLK

SEQ ID NO: 2697902 - protein, 17 aa, Entamoeba histolytica
TQAMSFDIAIIADAINV

SEQ ID NO: 2697903 - protein, 18 aa, Entamoeba histolytica
TQAYHILVIIADGQVDNE

SEQ ID NO: 2697904 - protein, 24 aa, Entamoeba histolytica
TQCGHLFCKSCLTIVLTSSDKTPF

SEQ ID NO: 2697905 - protein, 25 aa, Entamoeba histolytica
TQCHLDSFIKIIGLCVDTPKYFSGK

SEQ ID NO: 2697906 - protein, 19 aa, Entamoeba histolytica
TQCILWEFYQSISTTDPRI

SEQ ID NO: 2697907 - protein, 24 aa, Entamoeba histolytica
TQCNKLKIQKCKELTHLDLPSTLT

SEQ ID NO: 2697908 - protein, 19 aa, Entamoeba histolytica
TQCNLKKLRLERLKDILLI

SEQ ID NO: 2697909 - protein, 25 aa, Entamoeba histolytica
TQDLLSLDRQWLITFGSNIKNLLSM

SEQ ID NO: 2697910 - protein, 23 aa, Entamoeba histolytica
TQDLYLCLIWILKNVNREVLKRY

SEQ ID NO: 2697911 - protein, 22 aa, Entamoeba histolytica
TQEAKMGILFFEYNKVFFELMS

SEQ ID NO: 2697912 - protein, 17 aa, Entamoeba histolytica
TQEFELIKKKQIEKKKN

SEQ ID NO: 2697913 - protein, 18 aa, Entamoeba histolytica
TQEIHVLKETFGEQMLYK

SEQ ID NO: 2697914 - protein, 25 aa, Entamoeba histolytica
TQETLLKLIKFFSVENKYLITESGF

SEQ ID NO: 2697915 - protein, 18 aa, Entamoeba histolytica
TQFKCIICKGKPKEETIC

SEQ ID NO: 2697916 - protein, 22 aa, Entamoeba histolytica
TQFKTLLKMDGFSIETTEDLVV

SEQ ID NO: 2697917 - protein, 19 aa, Entamoeba histolytica
TQFNHAFIIVGFDVTQQNA

SEQ ID NO: 2697918 - protein, 19 aa, Entamoeba histolytica
TQFNHAFIVVGYDLNQPEN

SEQ ID NO: 2697919 - protein, 23 aa, Entamoeba histolytica
TQFPCVYHIPTYREVPPLFYQLP

SEQ ID NO: 2697920 - protein, 25 aa, Entamoeba histolytica
TQFTKLHAYKCDFKYVSLAVSNTGN

SEQ ID NO: 2697921 - protein, 18 aa, Entamoeba histolytica
TQGIMLINGVGPSITSIY

SEQ ID NO: 2697922 - protein, 19 aa, Entamoeba histolytica
TQGKVFTRYTLNNENSTLV

SEQ ID NO: 2697923 - protein, 19 aa, Entamoeba histolytica
TQHFTRFPVSLINDLAQCF

SEQ ID NO: 2697924 - protein, 23 aa, Entamoeba histolytica
TQIFQLKNQFLIEKKQMMEKQQQ

SEQ ID NO: 2697925 - protein, 22 aa, Entamoeba histolytica
TQIKMRLMEFVENLEIGMFNKL

SEQ ID NO: 2697926 - protein, 19 aa, Entamoeba histolytica
TQIKSFAFSNCRSLTKVEL

SEQ ID NO: 2697927 - protein, 19 aa, Entamoeba histolytica
TQILLGITVSRCKILVDNR

SEQ ID NO: 2697928 - protein, 25 aa, Entamoeba histolytica
TQIQCKCKRLFGKSLETYMKENEPD

SEQ ID NO: 2697929 - protein, 23 aa, Entamoeba histolytica
TQKESWLQCIGYDGKIFYVNCKT

SEQ ID NO: 2697930 - protein, 21 aa, Entamoeba histolytica
TQKKAAAIRRMEKRKATIKKQ

SEQ ID NO: 2697931 - protein, 29 aa, Entamoeba histolytica
TQKLIKFKWIDPFNEYGFYAFGAAVIEIV

SEQ ID NO: 2697932 - protein, 20 aa, Entamoeba histolytica
TQKYFAGSRPTFARCVNKAK

SEQ ID NO: 2697933 - protein, 24 aa, Entamoeba histolytica
TQKYGSVCASLFGDEPTRLVESIG

SEQ ID NO: 2697934 - protein, 24 aa, Entamoeba histolytica
TQLCLSYQLACNIIHRIMSAPGTI

SEQ ID NO: 2697935 - protein, 17 aa, Entamoeba histolytica
TQLDVAGFAIRKSSTKM

SEQ ID NO: 2697936 - protein, 17 aa, Entamoeba histolytica
TQLEVCVQLILQYTPSS

SEQ ID NO: 2697937 - protein, 23 aa, Entamoeba histolytica
TQLFEVIGYLFIYHSEYCEMYFE

SEQ ID NO: 2697938 - protein, 18 aa, Entamoeba histolytica
TQLKGINIYDGIKGEKER

SEQ ID NO: 2697939 - protein, 30 aa, Entamoeba histolytica
TQLKMELHLEWKRLACEVVNIPTGSFFSKS

SEQ ID NO: 2697940 - protein, 21 aa, Entamoeba histolytica
TQLKYEIQSFILKQQKADEQI

SEQ ID NO: 2697941 - protein, 25 aa, Entamoeba histolytica
TQLLDLEYFFFIKVIVASTMKLNGF

SEQ ID NO: 2697942 - protein, 20 aa, Entamoeba histolytica
TQLPHKFIKKPFKIPTINIL

SEQ ID NO: 2697943 - protein, 21 aa, Entamoeba histolytica
TQMGYGVFYSWLKLKEQEVRN

SEQ ID NO: 2697944 - protein, 22 aa, Entamoeba histolytica
TQNEVPYNFSLVKYKQPISYGA

SEQ ID NO: 2697945 - protein, 23 aa, Entamoeba histolytica
TQNEVPYNFSLVKYKQPISYGAY

SEQ ID NO: 2697946 - protein, 17 aa, Entamoeba histolytica
TQNEVRGEYKYLFDSIV

SEQ ID NO: 2697947 - protein, 23 aa, Entamoeba histolytica
TQNEVRGEYKYLFDSIVPVNELN

SEQ ID NO: 2697948 - protein, 19 aa, Entamoeba histolytica
TQNFICWSNEFNKKAIMIP

SEQ ID NO: 2697949 - protein, 27 aa, Entamoeba histolytica
TQNFLFDLCLEYGFWFESKPSRKSKKS

SEQ ID NO: 2697950 - protein, 19 aa, Entamoeba histolytica
TQNKIEVMANVIRKMSDKI

SEQ ID NO: 2697951 - protein, 19 aa, Entamoeba histolytica
TQNYFCFRSQYGKKLYVKI

SEQ ID NO: 2697952 - protein, 23 aa, Entamoeba histolytica
TQPEVVIRKGMNIEPMKPLHKKK

SEQ ID NO: 2697953 - protein, 19 aa, Entamoeba histolytica
TQPRLSVSLINKYITPQIC

SEQ ID NO: 2697954 - protein, 24 aa, Entamoeba histolytica
TQPSGPQYPGYNIQQADGKQNIPQ

SEQ ID NO: 2697955 - protein, 18 aa, Entamoeba histolytica
TQQIKLWAKLFCSPLEDP

SEQ ID NO: 2697956 - protein, 18 aa, Entamoeba histolytica
TQQKRVRRAHSIDTTTLF

SEQ ID NO: 2697957 - protein, 19 aa, Entamoeba histolytica
TQRFEPAFYAASLSSQCPQ

SEQ ID NO: 2697958 - protein, 19 aa, Entamoeba histolytica
TQRIFTLALDICFYGPYGI

SEQ ID NO: 2697959 - protein, 18 aa, Entamoeba histolytica
TQRIKRDKIRKERKVQHL

SEQ ID NO: 2697960 - protein, 22 aa, Entamoeba histolytica
TQRKSIKEISQFPQNSVLNQVH

SEQ ID NO: 2697961 - protein, 26 aa, Entamoeba histolytica
TQRQTCPICLKFFKYFIPLSSTIKKY

SEQ ID NO: 2697962 - protein, 19 aa, Entamoeba histolytica
TQRSFKRNRMNGEEKKQIN

SEQ ID NO: 2697963 - protein, 33 aa, Entamoeba histolytica; identical to SEQ ID NO: 2507119

SEQ ID NO: 2697964 - protein, 19 aa, Entamoeba histolytica
TQSGILLQRIIHKIAGTYL

SEQ ID NO: 2697965 - protein, 17 aa, Entamoeba histolytica
TQSPYVIFGERIVDLAV

SEQ ID NO: 2697966 - protein, 42 aa, Entamoeba histolytica
TQTAIECLRYVKEQRSRVVLTFLCLKELKTKDFFELDEEIKD

SEQ ID NO: 2697967 - protein, 19 aa, Entamoeba histolytica
TQTDLKFKLGINDHTGANT

SEQ ID NO: 2697968 - protein, 22 aa, Entamoeba histolytica
TQTELYPIVVMYEADQSFIFDS

SEQ ID NO: 2697969 - protein, 23 aa, Entamoeba histolytica
TQTIKYLYCRPTVSALEQPKKWW

SEQ ID NO: 2697970 - protein, 18 aa, Entamoeba histolytica
TQTLKFKIFEDIANGVAA

SEQ ID NO: 2697971 - protein, 22 aa, Entamoeba histolytica
TQVMPYTLGFGLVNNGFSIFAP

SEQ ID NO: 2697972 - protein, 23 aa, Entamoeba histolytica
TQVMPYTLGFGMVNNGFSIFAPK

SEQ ID NO: 2697973 - protein, 18 aa, Entamoeba histolytica
TQVMPYTLGFGMVNNKYD

SEQ ID NO: 2697974 - protein, 24 aa, Entamoeba histolytica
TQYERVTTVALKRGAAFENSINKV

SEQ ID NO: 2697975 - protein, 27 aa, Entamoeba histolytica
TQYGIDCPRFIVIQSHQEMMIFLNKHQ

SEQ ID NO: 2697976 - protein, 22 aa, Entamoeba histolytica
TQYPEREFYGGLEENKRKKFQR

SEQ ID NO: 2697977 - protein, 17 aa, Entamoeba histolytica
TQYRELESAFNPGNGEF

SEQ ID NO: 2697978 - protein, 20 aa, Entamoeba histolytica
TRAAEYVKFGHIPAGINAIV

SEQ ID NO: 2697979 - protein, 28 aa, Entamoeba histolytica
TRAGMGRCQGSYCTPRVMEILSKRLNIP

SEQ ID NO: 2697980 - protein, 21 aa, Entamoeba histolytica
TRAKDSIAIERDVLFEKTIQL

SEQ ID NO: 2697981 - protein, 19 aa, Entamoeba histolytica
TRALLRRLTHLQIVPENGE

SEQ ID NO: 2697982 - protein, 19 aa, Entamoeba histolytica
TRASRLITTVIRWVAENDS

SEQ ID NO: 2697983 - protein, 21 aa, Entamoeba histolytica
TRDEFLLFLSRRVQKGTIPNI

SEQ ID NO: 2697984 - protein, 21 aa, Entamoeba histolytica
TRDGIFFHIDFGHFLGNFKSK

SEQ ID NO: 2697985 - protein, 20 aa, Entamoeba histolytica
TREAGIYLFIIFYKEGKLFR

SEQ ID NO: 2697986 - protein, 21 aa, Entamoeba histolytica
TREAQICNGLLYLLRSSGYSF

SEQ ID NO: 2697987 - protein, 26 aa, Entamoeba histolytica
TREEKEIERSLGMMLLRGDCIQGYTV

SEQ ID NO: 2697988 - protein, 19 aa, Entamoeba histolytica
TREILPIGLAGELEVRSPI

SEQ ID NO: 2697989 - protein, 22 aa, Entamoeba histolytica
TREKEDFLSVDFEHMEMNVVVD

SEQ ID NO: 2697990 - protein, 22 aa, Entamoeba histolytica
TRELAIQIAEEFTQCSCGKFKV

SEQ ID NO: 2697991 - protein, 18 aa, Entamoeba histolytica
TRELIKERCIVGRIIEKK

SEQ ID NO: 2697992 - protein, 25 aa, Entamoeba histolytica
TRELPLFKKNIESIDIIQKDIKLKT

SEQ ID NO: 2697993 - protein, 20 aa, Entamoeba histolytica
TRFDFTRFKSLRRLHINYGF

SEQ ID NO: 2697994 - protein, 17 aa, Entamoeba histolytica
TRFIVDTGYSFKSTFSS

SEQ ID NO: 2697995 - protein, 17 aa, Entamoeba histolytica
TRFLTCASCGFFWKMSC

SEQ ID NO: 2697996 - protein, 17 aa, Entamoeba histolytica
TRFSRGFSGEMKGETTK

SEQ ID NO: 2697997 - protein, 21 aa, Entamoeba histolytica
TRFTVTRIVFRDGTSKFMIDE

SEQ ID NO: 2697998 - protein, 18 aa, Entamoeba histolytica
TRFVELKFDNKNTLKFYT

SEQ ID NO: 2697999 - protein, 20 aa, Entamoeba histolytica
TRFYAAELLIGLKYLHDAGI

SEQ ID NO: 2698000 - protein, 25 aa, Entamoeba histolytica
TRGMTHKKLCLRFTQDAIIKRLNKT

SEQ ID NO: 2698001 - protein, 24 aa, Entamoeba histolytica
TRGNEMSEIISFYDKLFVFDDKTG

SEQ ID NO: 2698002 - protein, 18 aa, Entamoeba histolytica
TRHMMVLERLVHSINIDD

SEQ ID NO: 2698003 - protein, 17 aa, Entamoeba histolytica
TRHSIQLELSETVKKLK

SEQ ID NO: 2698004 - protein, 19 aa, Entamoeba histolytica
TRIDQLCKVIENYYLGVIQ

SEQ ID NO: 2698005 - protein, 20 aa, Entamoeba histolytica
TRIIFLSPFNSFVSCWKSQV

SEQ ID NO: 2698006 - protein, 26 aa, Entamoeba histolytica
TRIIRIFLDNELKQFLKEVINIVQKH

SEQ ID NO: 2698007 - protein, 20 aa, Entamoeba histolytica
TRIKALLAALASFKVIKASI

SEQ ID NO: 2698008 - protein, 17 aa, Entamoeba histolytica
TRIKSFISTGNFETNTT

SEQ ID NO: 2698009 - protein, 19 aa, Entamoeba histolytica
TRINALLAALANFKVIKRS

SEQ ID NO: 2698010 - protein, 19 aa, Entamoeba histolytica
TRINALLAALASFKVIKAS

SEQ ID NO: 2698011 - protein, 17 aa, Entamoeba histolytica
TRINVIINEGILNKITM

SEQ ID NO: 2698012 - protein, 21 aa, Entamoeba histolytica
TRIPFPVCITQARSFLQNFTD

SEQ ID NO: 2698013 - protein, 18 aa, Entamoeba histolytica
TRIPKVVEILKEFFNGKE

SEQ ID NO: 2698014 - protein, 18 aa, Entamoeba histolytica
TRIQKELILHAIDSVNPK

SEQ ID NO: 2698015 - protein, 17 aa, Entamoeba histolytica
TRITIKMNDRPSLKLQI

SEQ ID NO: 2698016 - protein, 18 aa, Entamoeba histolytica
TRIVKALHITIIFEQQLY

SEQ ID NO: 2698017 - protein, 19 aa, Entamoeba histolytica
TRIVLRMFFINFIKLLKVN

SEQ ID NO: 2698018 - protein, 25 aa, Entamoeba histolytica
TRIVMQYKKIHIMGSYANIKIARDA

SEQ ID NO: 2698019 - protein, 22 aa, Entamoeba histolytica
TRKCPKCNATIEKNRGCNHMTC

SEQ ID NO: 2698020 - protein, 22 aa, Entamoeba histolytica
TRKCSIRFSGCGSYINEMKLST

SEQ ID NO: 2698021 - protein, 24 aa, Entamoeba histolytica
TRKDAMAVFHFLFRYDTGSHPPFI

SEQ ID NO: 2698022 - protein, 22 aa, Entamoeba histolytica
TRKILKEPRVINILANAIFHND

SEQ ID NO: 2698023 - protein, 18 aa, Entamoeba histolytica
TRKLFFMNVQHRLYQPKE

SEQ ID NO: 2698024 - protein, 18 aa, Entamoeba histolytica
TRKSLKIKRTKLISQKKA

SEQ ID NO: 2698025 - protein, 19 aa, Entamoeba histolytica
TRKSLKIKRTKLISQKKAA

SEQ ID NO: 2698026 - protein, 19 aa, Entamoeba histolytica
TRLARRILRDINYRGRTLD

SEQ ID NO: 2698027 - protein, 22 aa, Entamoeba histolytica
TRLIFPPSLKIIGIGCFDNMNS

SEQ ID NO: 2698028 - protein, 17 aa, Entamoeba histolytica
TRLKNKYPYPIQRAIIK

SEQ ID NO: 2698029 - protein, 17 aa, Entamoeba histolytica
TRLKRFASKYHYNEEDD

SEQ ID NO: 2698030 - protein, 18 aa, Entamoeba histolytica
TRLLFPMTSYYSTLLSQG

SEQ ID NO: 2698031 - protein, 17 aa, Entamoeba histolytica
TRLQFRAKISKLDFDTL

SEQ ID NO: 2698032 - protein, 21 aa, Entamoeba histolytica
TRLSEWGFGKEHFKEISDKFD

SEQ ID NO: 2698033 - protein, 17 aa, Entamoeba histolytica
TRLSFVKSIEGRKDIAI

SEQ ID NO: 2698034 - protein, 20 aa, Entamoeba histolytica
TRLSQLTGLTFISKTEPEFT

SEQ ID NO: 2698035 - protein, 20 aa, Entamoeba histolytica
TRLSSMKIVLKFNIDNPIND

SEQ ID NO: 2698036 - protein, 27 aa, Entamoeba histolytica
TRLTFGNSPLKCFNLVILKHIEIIDEI

SEQ ID NO: 2698037 - protein, 25 aa, Entamoeba histolytica
TRLYPIECYPFFPIESSSQFDYSKS

SEQ ID NO: 2698038 - protein, 24 aa, Entamoeba histolytica
TRNDKKTAIALIFNTLSSYIIQTN

SEQ ID NO: 2698039 - protein, 18 aa, Entamoeba histolytica
TRNELIDKIISIEEMVMK

SEQ ID NO: 2698040 - protein, 18 aa, Entamoeba histolytica
TRNLIGVTILYGPDSSAP

SEQ ID NO: 2698041 - protein, 19 aa, Entamoeba histolytica
TRNVLKQFLEQVIRDSVTY

SEQ ID NO: 2698042 - protein, 19 aa, Entamoeba histolytica
TRNYIPLSHFKWKKQIKEK

SEQ ID NO: 2698043 - protein, 19 aa, Entamoeba histolytica
TRPFKRMTYADAIKYCNDH

SEQ ID NO: 2698044 - protein, 20 aa, Entamoeba histolytica
TRPKTDFIPKVVRLTLDNDP

SEQ ID NO: 2698045 - protein, 20 aa, Entamoeba histolytica
TRPTTNISILSKYDILLNGL

SEQ ID NO: 2698046 - protein, 20 aa, Entamoeba histolytica
TRQTFWYSRVNSYTSRTGDI

SEQ ID NO: 2698047 - protein, 18 aa, Entamoeba histolytica
TRRDCLIKTKYYDSFLFD

SEQ ID NO: 2698048 - protein, 28 aa, Entamoeba histolytica
TRRHHCRRCGKVFCGSCCVDSVLMKDLG

SEQ ID NO: 2698049 - protein, 21 aa, Entamoeba histolytica
TRRLIELLLIRGYSFNRTADF

SEQ ID NO: 2698050 - protein, 18 aa, Entamoeba histolytica
TRRTLPNIIQKLIEQGLD

SEQ ID NO: 2698051 - protein, 22 aa, Entamoeba histolytica
TRSIMLKQKFFASIVDEAAQSL

SEQ ID NO: 2698052 - protein, 25 aa, Entamoeba histolytica
TRSMYCMYHYYAGMTMLIKNKPSDA

SEQ ID NO: 2698053 - protein, 25 aa, Entamoeba histolytica
TRTFVLSFIFRNIIQSISINSFDSS

SEQ ID NO: 2698054 - protein, 25 aa, Entamoeba histolytica
TRVGVSWKSIFSWCSEQEKLIESTS

SEQ ID NO: 2698055 - protein, 18 aa, Entamoeba histolytica
TRVLKKIAAVMPRNKQEF

SEQ ID NO: 2698056 - protein, 19 aa, Entamoeba histolytica
TRWFPSAKRSKYILNIPFS

SEQ ID NO: 2698057 - protein, 33 aa, Entamoeba histolytica
TRYAAFRYIELRTESIWKFLIPFTSRILDCLED

SEQ ID NO: 2698058 - protein, 21 aa, Entamoeba histolytica
TRYCHSCQHRIPLILNKFPQQ

SEQ ID NO: 2698059 - protein, 24 aa, Entamoeba histolytica
TRYLPEHAIKFLISIAQQITTFSE

SEQ ID NO: 2698060 - protein, 23 aa, Entamoeba histolytica
TRYPRTDIIQSFCYGFVELVTSC

SEQ ID NO: 2698061 - protein, 25 aa, Entamoeba histolytica
TSAPWLQILLFRLLSTIDLETTTQK

SEQ ID NO: 2698062 - protein, 23 aa, Entamoeba histolytica
TSARAGGFIASRFLTGVPPQEFF

SEQ ID NO: 2698063 - protein, 19 aa, Entamoeba histolytica
TSARLTVDFHKTLKSDTKE

SEQ ID NO: 2698064 - protein, 17 aa, Entamoeba histolytica
TSAVLNYILRPSLDEQE

SEQ ID NO: 2698065 - protein, 24 aa, Entamoeba histolytica
TSCEFCPFEDFIAIGRYNGVSTIP

SEQ ID NO: 2698066 - protein, 25 aa, Entamoeba histolytica
TSDIGRRICPLFVTKGFDRIAITSQ

SEQ ID NO: 2698067 - protein, 18 aa, Entamoeba histolytica
TSDMKQPHIDRIVFGSNF

SEQ ID NO: 2698068 - protein, 19 aa, Entamoeba histolytica
TSDVCCLHSTYDFIQSVQY

SEQ ID NO: 2698069 - protein, 24 aa, Entamoeba histolytica
TSECLMIPLLKVERCWAYANELQP

SEQ ID NO: 2698070 - protein, 26 aa, Entamoeba histolytica
TSECLMIPLLKVERCWAYANELQPVD

SEQ ID NO: 2698071 - protein, 24 aa, Entamoeba histolytica
TSEDLWKNLIIISIDIKDYRQAIS

SEQ ID NO: 2698072 - protein, 25 aa, Entamoeba histolytica
TSEFLKDGGVLLGFDLTATQLIGYN

SEQ ID NO: 2698073 - protein, 22 aa, Entamoeba histolytica
TSEGCLKDTIMFVYIKVQIEGE

SEQ ID NO: 2698074 - protein, 23 aa, Entamoeba histolytica
TSEGIPYMFPIPYKDESSYLIYF

SEQ ID NO: 2698075 - protein, 17 aa, Entamoeba histolytica
TSEGNFRISNGTLLTAK

SEQ ID NO: 2698076 - protein, 19 aa, Entamoeba histolytica
TSEINKFMEHYKIQQRDQP

SEQ ID NO: 2698077 - protein, 23 aa, Entamoeba histolytica
TSELPKRVISVFSAVRQAILYDG

SEQ ID NO: 2698078 - protein, 18 aa, Entamoeba histolytica
TSELPLLLNHGISPVNVK

SEQ ID NO: 2698079 - protein, 25 aa, Entamoeba histolytica
TSELSGLVKDIACVSCISGQHPDNI

SEQ ID NO: 2698080 - protein, 17 aa, Entamoeba histolytica
TSERCMVQLLQFMSNKN

SEQ ID NO: 2698081 - protein, 21 aa, Entamoeba histolytica
TSETIIYPAFKNWISGHRDLP

SEQ ID NO: 2698082 - protein, 18 aa, Entamoeba histolytica
TSEYLRTLMRAVAQLTGG

SEQ ID NO: 2698083 - protein, 22 aa, Entamoeba histolytica
TSEYLRTLMRAVAQLTGGQYAA

SEQ ID NO: 2698084 - protein, 24 aa, Entamoeba histolytica
TSFESFILPFGKFFVIPKNINGPL

SEQ ID NO: 2698085 - protein, 23 aa, Entamoeba histolytica
TSFGKGCFYNCGCEEELKKNKSI

SEQ ID NO: 2698086 - protein, 23 aa, Entamoeba histolytica
TSFGYGCFYGCGCVEELLKKNAR

SEQ ID NO: 2698087 - protein, 17 aa, Entamoeba histolytica
TSFKFTTVQYIFKKTLI

SEQ ID NO: 2698088 - protein, 30 aa, Entamoeba histolytica
TSFKKNSFTPFCFPRLNLLDLSNNEIMTLE

SEQ ID NO: 2698089 - protein, 17 aa, Entamoeba histolytica
TSFKRLLYSPIIDGSKE

SEQ ID NO: 2698090 - protein, 20 aa, Entamoeba histolytica
TSFNDCLVVLGIDGHSYVKK

SEQ ID NO: 2698091 - protein, 17 aa, Entamoeba histolytica
TSFNLKTLFMMLTVPRR

SEQ ID NO: 2698092 - protein, 23 aa, Entamoeba histolytica
TSFNLKYIQEWTGHKSHTIIFDS

SEQ ID NO: 2698093 - protein, 18 aa, Entamoeba histolytica
TSFQPCRPISSAISPDQI

SEQ ID NO: 2698094 - protein, 17 aa, Entamoeba histolytica
TSFQSFVDTTSWYTSIF

SEQ ID NO: 2698095 - protein, 22 aa, Entamoeba histolytica
TSFRLGKIDIPVAVIQDDVFSL

SEQ ID NO: 2698096 - protein, 22 aa, Entamoeba histolytica
TSFRNGCFYGCGCEEELKKNKS

SEQ ID NO: 2698097 - protein, 17 aa, Entamoeba histolytica
TSFTFKCHGKFDKGSLD

SEQ ID NO: 2698098 - protein, 22 aa, Entamoeba histolytica
TSGEFHQPFCIIVMKENGAWKS

SEQ ID NO: 2698099 - protein, 17 aa, Entamoeba histolytica
TSGEIISSIPFKKLISY

SEQ ID NO: 2698100 - protein, 22 aa, Entamoeba histolytica
TSGIPLTLCKSTIEFQQPKKKG

SEQ ID NO: 2698101 - protein, 30 aa, Entamoeba histolytica; identical to SEQ ID NO: 2507273

SEQ ID NO: 2698102 - protein, 19 aa, Entamoeba histolytica
TSGRGALMFVRAVEPDTFP

SEQ ID NO: 2698103 - protein, 22 aa, Entamoeba histolytica
TSGVGCKGVLCYVPKLCNEDVQ

SEQ ID NO: 2698104 - protein, 17 aa, Entamoeba histolytica
TSGVIAMNCLNYIQQYQ

SEQ ID NO: 2698105 - protein, 24 aa, Entamoeba histolytica
TSHTNCWNHLFPTQPHGSCIVQTP

SEQ ID NO: 2698106 - protein, 20 aa, Entamoeba histolytica
TSIDLSKLVIRSIKEDCVEH

SEQ ID NO: 2698107 - protein, 19 aa, Entamoeba histolytica
TSIIEFGFDCFSCCDSLSS

SEQ ID NO: 2698108 - protein, 19 aa, Entamoeba histolytica
TSIISRYGGAKGFVNRPTF

SEQ ID NO: 2698109 - protein, 22 aa, Entamoeba histolytica
TSILRKVLNKVLPLVKSSQLIE

SEQ ID NO: 2698110 - protein, 19 aa, Entamoeba histolytica
TSIPKRILPSAINPLIGGR

SEQ ID NO: 2698111 - protein, 18 aa, Entamoeba histolytica
TSIQKIQLPFGIDTIDDE

SEQ ID NO: 2698112 - protein, 25 aa, Entamoeba histolytica
TSIRKLVPEAWGFMCPVHTPDGAPC

SEQ ID NO: 2698113 - protein, 23 aa, Entamoeba histolytica
TSISERRNAILLFALLNNDSIKR

SEQ ID NO: 2698114 - protein, 19 aa, Entamoeba histolytica
TSITSIGMYCFSHCTSLSS

SEQ ID NO: 2698115 - protein, 18 aa, Entamoeba histolytica
TSKFYYFLVVALIKEYAD

SEQ ID NO: 2698116 - protein, 23 aa, Entamoeba histolytica
TSKKKGRLSFIFKQNGTKSQNEH

SEQ ID NO: 2698117 - protein, 27 aa, Entamoeba histolytica
TSKLFNKRRVSICVAPKFSIPSRASPA

SEQ ID NO: 2698118 - protein, 28 aa, Entamoeba histolytica
TSKQLPKMIEIMILLILENGMDFKGIFR

SEQ ID NO: 2698119 - protein, 17 aa, Entamoeba histolytica
TSKRYGWSSIHKHPYIK

SEQ ID NO: 2698120 - protein, 17 aa, Entamoeba histolytica
TSKYCLKTQQSIQKINW

SEQ ID NO: 2698121 - protein, 18 aa, Entamoeba histolytica
TSLDWNVINKDRLGTCSL

SEQ ID NO: 2698122 - protein, 17 aa, Entamoeba histolytica
TSLFILLVALGIDEDTE

SEQ ID NO: 2698123 - protein, 29 aa, Entamoeba histolytica
TSLISIYKSAKWIGVEAIWKTKTKEFKSS

SEQ ID NO: 2698124 - protein, 26 aa, Entamoeba histolytica
TSLKLSCLHIAVYFDKFDFVEKLIDQ

SEQ ID NO: 2698125 - protein, 17 aa, Entamoeba histolytica
TSLLCGVMANRRKDIAD

SEQ ID NO: 2698126 - protein, 23 aa, Entamoeba histolytica
TSLLFNFFIKLSFDEEYENGYIL

SEQ ID NO: 2698127 - protein, 26 aa, Entamoeba histolytica
TSLLLSVYGAFWITNSFILKLSTIIN

SEQ ID NO: 2698128 - protein, 25 aa, Entamoeba histolytica
TSLLPMVYKLWFKYVRLEETVENFD

SEQ ID NO: 2698129 - protein, 20 aa, Entamoeba histolytica
TSLLRSLLMYNPDDRMSAEK

SEQ ID NO: 2698130 - protein, 17 aa, Entamoeba histolytica
TSLLSLQTHCFDQCSSL

SEQ ID NO: 2698131 - protein, 21 aa, Entamoeba histolytica
TSLLVCKMLSLLQPTSDQLNQ

SEQ ID NO: 2698132 - protein, 22 aa, Entamoeba histolytica
TSLLYFPFIIPVDYKMKFLHKE

SEQ ID NO: 2698133 - protein, 19 aa, Entamoeba histolytica
TSLNILPIYSIGNIQLDSA

SEQ ID NO: 2698134 - protein, 17 aa, Entamoeba histolytica
TSLNLERFAPWRESNEE

SEQ ID NO: 2698135 - protein, 24 aa, Entamoeba histolytica
TSLPEFPHAFTISACTGSIEWDGL

SEQ ID NO: 2698136 - protein, 22 aa, Entamoeba histolytica
TSLPTCCFNKCFALEKINLENL

SEQ ID NO: 2698137 - protein, 19 aa, Entamoeba histolytica
TSLSKPYCVKRSEFELFLK

SEQ ID NO: 2698138 - protein, 18 aa, Entamoeba histolytica
TSLTCLIIGSAGNRAIDM

SEQ ID NO: 2698139 - protein, 17 aa, Entamoeba histolytica
TSLVKRYCEGMFLEEMM

SEQ ID NO: 2698140 - protein, 23 aa, Entamoeba histolytica
TSMFGVKCAESVIRDLIGHPVVN

SEQ ID NO: 2698141 - protein, 28 aa, Entamoeba histolytica
TSMTFSDLWDIFDIILINVEGEYKEIYE

SEQ ID NO: 2698142 - protein, 17 aa, Entamoeba histolytica
TSNEIIQILTLLKDNLC

SEQ ID NO: 2698143 - protein, 25 aa, Entamoeba histolytica
TSNELSIFLDMLFKKSINEPKFASL

SEQ ID NO: 2698144 - protein, 24 aa, Entamoeba histolytica
TSNFMIMRGMKLFYFIINSSFPFG

SEQ ID NO: 2698145 - protein, 21 aa, Entamoeba histolytica
TSNFWKWLRKDWIESHGGLQA

SEQ ID NO: 2698146 - protein, 30 aa, Entamoeba histolytica
TSNGFSFGNIDFGKGFNFGTFSSVEKTSQK

SEQ ID NO: 2698147 - protein, 17 aa, Entamoeba histolytica
TSNGIALPFTISSIKYD

SEQ ID NO: 2698148 - protein, 18 aa, Entamoeba histolytica
TSNGWYIMQCEPMKNGIT

SEQ ID NO: 2698149 - protein, 17 aa, Entamoeba histolytica
TSNGYSTTACFPIFEGE

SEQ ID NO: 2698150 - protein, 25 aa, Entamoeba histolytica
TSNHLFKNLNWVGSIFGNPTIIFDY

SEQ ID NO: 2698151 - protein, 18 aa, Entamoeba histolytica
TSNILLIDCEGSASIFTL

SEQ ID NO: 2698152 - protein, 18 aa, Entamoeba histolytica
TSNIPIDFIYQLTSLTKI

SEQ ID NO: 2698153 - protein, 18 aa, Entamoeba histolytica
TSNIVMYWLEQRVISASD

SEQ ID NO: 2698154 - protein, 25 aa, Entamoeba histolytica
TSNMYLRIVALDFSYFLLKKANNKT

SEQ ID NO: 2698155 - protein, 29 aa, Entamoeba histolytica
TSNNPFTCFPFFVPRRNWFVKAIFLTELE

SEQ ID NO: 2698156 - protein, 34 aa, Entamoeba histolytica
TSNVIKECIPYGQLRAFPWNSLALMTTTGAKGSK

SEQ ID NO: 2698157 - protein, 25 aa, Entamoeba histolytica
TSPFDEFFKLIFLQYPPRIVQSLKR

SEQ ID NO: 2698158 - protein, 22 aa, Entamoeba histolytica
TSPKGNEPPAKVEGNSLQSKQV

SEQ ID NO: 2698159 - protein, 20 aa, Entamoeba histolytica
TSPNRWKKAFLDGLSHSPYF

SEQ ID NO: 2698160 - protein, 28 aa, Entamoeba histolytica
TSPPQIRYCYYFYYYLSVFPREVPFKPI

SEQ ID NO: 2698161 - protein, 20 aa, Entamoeba histolytica
TSPRRLRALSRESLRALSCK

SEQ ID NO: 2698162 - protein, 22 aa, Entamoeba histolytica
TSPRVAVCHEVSPTLGNVEELS

SEQ ID NO: 2698163 - protein, 24 aa, Entamoeba histolytica
TSPSRVACLHWLKIFKNYTSPKGI

SEQ ID NO: 2698164 - protein, 24 aa, Entamoeba histolytica
TSQETFKFLFFVADIHNQGFITKT

SEQ ID NO: 2698165 - protein, 24 aa, Entamoeba histolytica
TSQFSDLEWDRICDDIVIPPRDSN

SEQ ID NO: 2698166 - protein, 21 aa, Entamoeba histolytica
TSQIHFCNLPTGVAMITVDKT

SEQ ID NO: 2698167 - protein, 19 aa, Entamoeba histolytica
TSQLEMKQRVLSLVHQINQ

SEQ ID NO: 2698168 - protein, 18 aa, Entamoeba histolytica
TSQMHVGMIISPKWVRMS

SEQ ID NO: 2698169 - protein, 19 aa, Entamoeba histolytica
TSQYLHWSLFINILLHLIQ

SEQ ID NO: 2698170 - protein, 21 aa, Entamoeba histolytica
TSRGKCKSCGDVISQGEIKVG

SEQ ID NO: 2698171 - protein, 18 aa, Entamoeba histolytica
TSRMARKNIEYLINKEYF

SEQ ID NO: 2698172 - protein, 22 aa, Entamoeba histolytica
TSRMLRLIIMSTNITNQLIQNC

SEQ ID NO: 2698173 - protein, 23 aa, Entamoeba histolytica
TSRSLYELLSWNIFESTFIPVIM

SEQ ID NO: 2698174 - protein, 17 aa, Entamoeba histolytica
TSRSVGVTPSFKLESKK

SEQ ID NO: 2698175 - protein, 25 aa, Entamoeba histolytica
TSSAKLCKRYMKYLMKKYLKKNNLR

SEQ ID NO: 2698176 - protein, 21 aa, Entamoeba histolytica
TSSCFYGYPGSFCELKENNDG

SEQ ID NO: 2698177 - protein, 19 aa, Entamoeba histolytica
TSSGFGLSSFGGFNTSSSG

SEQ ID NO: 2698178 - protein, 20 aa, Entamoeba histolytica
TSSILLFISLGSRVKKDEDI

SEQ ID NO: 2698179 - protein, 25 aa, Entamoeba histolytica
TSSKLKPVSVIDILFGEREFGKKNH

SEQ ID NO: 2698180 - protein, 29 aa, Entamoeba histolytica
TSSKPTIRCFKCLECFTSISSVIRHWKVC

SEQ ID NO: 2698181 - protein, 20 aa, Entamoeba histolytica
TSSSGIQWAYFVTHRLFVYK

SEQ ID NO: 2698182 - protein, 17 aa, Entamoeba histolytica
TSTDCALELQELTQLQS

SEQ ID NO: 2698183 - protein, 33 aa, Entamoeba histolytica
TSTIYDIFNTISFMIKYLHSVIMEHSDMFIQHY

SEQ ID NO: 2698184 - protein, 23 aa, Entamoeba histolytica
TSTNLCVCFSPSLFRSPDNDMTR

SEQ ID NO: 2698185 - protein, 25 aa, Entamoeba histolytica
TSTRRLPVKLISKFVGTRTPVQVRT

SEQ ID NO: 2698186 - protein, 18 aa, Entamoeba histolytica
TSTTCFYCGSGLKNLLYI

SEQ ID NO: 2698187 - protein, 19 aa, Entamoeba histolytica
TSVCTFKPIETFPFFIPQR

SEQ ID NO: 2698188 - protein, 30 aa, Entamoeba histolytica; identical to SEQ ID NO: 2507365

SEQ ID NO: 2698189 - protein, 17 aa, Entamoeba histolytica
TSVGIGLVMFGMQDKAD

SEQ ID NO: 2698190 - protein, 28 aa, Entamoeba histolytica
TSVGSILYRYCIGIGTLIIISQNYLNCH

SEQ ID NO: 2698191 - protein, 19 aa, Entamoeba histolytica
TSVITIGNWCFYKCSSLTT

SEQ ID NO: 2698192 - protein, 20 aa, Entamoeba histolytica
TSVKSFNSITSFQFSPEEEG

SEQ ID NO: 2698193 - protein, 17 aa, Entamoeba histolytica
TSVPNCSSDVFLSQDQT

SEQ ID NO: 2698194 - protein, 23 aa, Entamoeba histolytica
TSVSELGEYCFINCTSLTSIDIP

SEQ ID NO: 2698195 - protein, 20 aa, Entamoeba histolytica
TSVTYIGNWCFAYCESLKSI

SEQ ID NO: 2698196 - protein, 27 aa, Entamoeba histolytica
TSYESWRIMRKGSIIVLKEQRIFGRVC

SEQ ID NO: 2698197 - protein, 17 aa, Entamoeba histolytica
TSYKTPIKYQVEKKQLI

SEQ ID NO: 2698198 - protein, 19 aa, Entamoeba histolytica
TSYLAQCRTIYQLTFDTHR

SEQ ID NO: 2698199 - protein, 20 aa, Entamoeba histolytica
TSYLAQCRTIYQLTFDTHRD

SEQ ID NO: 2698200 - protein, 32 aa, Entamoeba histolytica
TSYLQWLCECQTKCIKGVIIMEKERSNINQFI

SEQ ID NO: 2698201 - protein, 24 aa, Entamoeba histolytica
TTACLESNCSCFQGGNFCSPLCTC

SEQ ID NO: 2698202 - protein, 24 aa, Entamoeba histolytica
TTAQEFFYLILIETFPVPLQLVCM

SEQ ID NO: 2698203 - protein, 23 aa, Entamoeba histolytica
TTCKINEVILFYRTISYTIQFSD

SEQ ID NO: 2698204 - protein, 17 aa, Entamoeba histolytica
TTDIKIKAPTLIAYLPS

SEQ ID NO: 2698205 - protein, 22 aa, Entamoeba histolytica
TTDTDFAIKVPRKQSISTDKTI

SEQ ID NO: 2698206 - protein, 26 aa, Entamoeba histolytica
TTEAVKIISYKVCGWNNPEMEMLEPE

SEQ ID NO: 2698207 - protein, 24 aa, Entamoeba histolytica
TTEHWKFLHNYILHRDCILDLACS

SEQ ID NO: 2698208 - protein, 28 aa, Entamoeba histolytica
TTEIPKEVCSLGFGCFEQTLLEQLSIPN

SEQ ID NO: 2698209 - protein, 25 aa, Entamoeba histolytica
TTELLYRFICKLINRSYVRFNNEIY

SEQ ID NO: 2698210 - protein, 19 aa, Entamoeba histolytica
TTEPRFIVYSYKFETRDGR

SEQ ID NO: 2698211 - protein, 18 aa, Entamoeba histolytica
TTFESVLHYFSFFGKVRA

SEQ ID NO: 2698212 - protein, 22 aa, Entamoeba histolytica
TTFIFRHGHPVLTSFNSTQHLL

SEQ ID NO: 2698213 - protein, 17 aa, Entamoeba histolytica
TTFIKFIVHLSYAEEVQ

SEQ ID NO: 2698214 - protein, 25 aa, Entamoeba histolytica
TTFKKHLGCFKMRVEEVTGDTNIPK

SEQ ID NO: 2698215 - protein, 17 aa, Entamoeba histolytica
TTFKTEVLLSLLTFLVS

SEQ ID NO: 2698216 - protein, 29 aa, Entamoeba histolytica
TTFLGIVVLRTGTSFACMYCNIGDCRALV

SEQ ID NO: 2698217 - protein, 20 aa, Entamoeba histolytica
TTFLYPRLLNYKGDIKKIQN

SEQ ID NO: 2698218 - protein, 22 aa, Entamoeba histolytica
TTFNKTLYLFAIFKLSIDLFSE

SEQ ID NO: 2698219 - protein, 19 aa, Entamoeba histolytica
TTFPSLSVNIIYQLLSNFH

SEQ ID NO: 2698220 - protein, 27 aa, Entamoeba histolytica
TTFYSACDYVLFFLIRCEPYTTMFIKM

SEQ ID NO: 2698221 - protein, 21 aa, Entamoeba histolytica
TTFYSFCQRSFIQAFLFIFRN

SEQ ID NO: 2698222 - protein, 19 aa, Entamoeba histolytica
TTGSNPFGNFTTSNTTPTT

SEQ ID NO: 2698223 - protein, 26 aa, Entamoeba histolytica
TTHEPCLMCGMALLHSRFGRVFFIHQ

SEQ ID NO: 2698224 - protein, 24 aa, Entamoeba histolytica
TTIDCMRFFFSLCDVDNDNALNQK

SEQ ID NO: 2698225 - protein, 23 aa, Entamoeba histolytica
TTIEEAIKLISYDSENIGSEKSN

SEQ ID NO: 2698226 - protein, 24 aa, Entamoeba histolytica
TTIKCAWIGTSTRIFFEKNLNVNI

SEQ ID NO: 2698227 - protein, 22 aa, Entamoeba histolytica
TTIKDPYAYLVPIDKLDIDEEI

SEQ ID NO: 2698228 - protein, 17 aa, Entamoeba histolytica
TTIKRKMLNEVIVHNNY

SEQ ID NO: 2698229 - protein, 18 aa, Entamoeba histolytica
TTILPLLMIKSILPRIES

SEQ ID NO: 2698230 - protein, 24 aa, Entamoeba histolytica
TTIPKSVCCSLNMVYDIDNSMING

SEQ ID NO: 2698231 - protein, 18 aa, Entamoeba histolytica
TTITSCFAQMELIRTALK

SEQ ID NO: 2698232 - protein, 17 aa, Entamoeba histolytica
TTIYPLLVEQRRFIEEH

SEQ ID NO: 2698233 - protein, 18 aa, Entamoeba histolytica
TTKCIRCVARMGKFSSDR

SEQ ID NO: 2698234 - protein, 23 aa, Entamoeba histolytica
TTKEYVSTVGVYILNYTDGTLTY

SEQ ID NO: 2698235 - protein, 25 aa, Entamoeba histolytica
TTKGAMCETCMTLSALENVDSNGLQ

SEQ ID NO: 2698236 - protein, 17 aa, Entamoeba histolytica
TTKIHKNEFIWFLNNER

SEQ ID NO: 2698237 - protein, 22 aa, Entamoeba histolytica
TTKKEIRLCFACYYPYQTNKGK

SEQ ID NO: 2698238 - protein, 17 aa, Entamoeba histolytica
TTKKFRFVLEMFNSNPI

SEQ ID NO: 2698239 - protein, 21 aa, Entamoeba histolytica
TTKKIFQRWIEIIDTQTDSKL

SEQ ID NO: 2698240 - protein, 21 aa, Entamoeba histolytica
TTKLCKGVGFVTYMDSSDAYK

SEQ ID NO: 2698241 - protein, 23 aa, Entamoeba histolytica
TTKPHYIKLCVGDVVTEKGIQFQ

SEQ ID NO: 2698242 - protein, 23 aa, Entamoeba histolytica
TTKRYSSGITLLLKYKPLKDITD

SEQ ID NO: 2698243 - protein, 17 aa, Entamoeba histolytica
TTLCLPSLLTLIQISNC

SEQ ID NO: 2698244 - protein, 17 aa, Entamoeba histolytica
TTLEIWIPVYVINNSII

SEQ ID NO: 2698245 - protein, 23 aa, Entamoeba histolytica
TTLFEMKQFPVIILKDNPVIFLL

SEQ ID NO: 2698246 - protein, 17 aa, Entamoeba histolytica
TTLHSFAGIGLGDQSVD

SEQ ID NO: 2698247 - protein, 23 aa, Entamoeba histolytica
TTLIKRKRIEFIKSIKDKMDIID

SEQ ID NO: 2698248 - protein, 18 aa, Entamoeba histolytica
TTLLWAIPKTGRMHQIRV

SEQ ID NO: 2698249 - protein, 19 aa, Entamoeba histolytica
TTLNIPTSIDFHFFSHRGK

SEQ ID NO: 2698250 - protein, 18 aa, Entamoeba histolytica
TTLNNVWANKCTKQILCI

SEQ ID NO: 2698251 - protein, 28 aa, Entamoeba histolytica
TTLPGKYSWLKYAEKIYNVLFETEDEKM

SEQ ID NO: 2698252 - protein, 25 aa, Entamoeba histolytica
TTLSKAKFVVCYKGNLSGAMEKLFK

SEQ ID NO: 2698253 - protein, 18 aa, Entamoeba histolytica
TTLTQMVHCFQQTMNQEI

SEQ ID NO: 2698254 - protein, 17 aa, Entamoeba histolytica
TTMMLIRRLYEKKEKIE

SEQ ID NO: 2698255 - protein, 24 aa, Entamoeba histolytica
TTNEYLRLLCVIFIIIKHDSDNAL

SEQ ID NO: 2698256 - protein, 23 aa, Entamoeba histolytica
TTNKAGWCFEDFEGSGSIKPKIY

SEQ ID NO: 2698257 - protein, 20 aa, Entamoeba histolytica
TTPFYTVVNVYPFKDGRKQN

SEQ ID NO: 2698258 - protein, 24 aa, Entamoeba histolytica
TTPIYFKILVRLIKEGGIEILKEY

SEQ ID NO: 2698259 - protein, 17 aa, Entamoeba histolytica
TTPRVISIHQRLLNEKK

SEQ ID NO: 2698260 - protein, 18 aa, Entamoeba histolytica
TTQDAVICVSILNNKNEN

SEQ ID NO: 2698261 - protein, 23 aa, Entamoeba histolytica
TTQLREGIKIVYFEERNYEDIEI

SEQ ID NO: 2698262 - protein, 24 aa, Entamoeba histolytica
TTQPQFGTNSSFAGFNTNQTSGTT

SEQ ID NO: 2698263 - protein, 23 aa, Entamoeba histolytica
TTQREMFFYMSLLSQQLPIESQF

SEQ ID NO: 2698264 - protein, 17 aa, Entamoeba histolytica
TTRIALYGMSYKKNEEM

SEQ ID NO: 2698265 - protein, 23 aa, Entamoeba histolytica
TTRKSSHFQPKLVGTKRKHPQFA

SEQ ID NO: 2698266 - protein, 24 aa, Entamoeba histolytica
TTRTKAVLWSRQFSSFNVIKFNEK

SEQ ID NO: 2698267 - protein, 17 aa, Entamoeba histolytica
TTSCVDLTFGDSEFISI

SEQ ID NO: 2698268 - protein, 23 aa, Entamoeba histolytica
TTSELFINASWIFSVICRSLKVE

SEQ ID NO: 2698269 - protein, 23 aa, Entamoeba histolytica
TTSGTYWNCWLQKNCQDLMNEMI

SEQ ID NO: 2698270 - protein, 24 aa, Entamoeba histolytica
TTSLDHVFKVWVLVTRQTIKTKGG

SEQ ID NO: 2698271 - protein, 29 aa, Entamoeba histolytica
TTSLIWGESIRKLLCHKIKPKIRETSPTQ

SEQ ID NO: 2698272 - protein, 25 aa, Entamoeba histolytica
TTTFYRLCCYIQAYFDTIINAPPNS

SEQ ID NO: 2698273 - protein, 18 aa, Entamoeba histolytica
TTTHLGDTPSPVTTQPGA

SEQ ID NO: 2698274 - protein, 17 aa, Entamoeba histolytica
TTTKLYDLFKLWSNSDP

SEQ ID NO: 2698275 - protein, 18 aa, Entamoeba histolytica
TTVECDRYLLGHDYPMIK

SEQ ID NO: 2698276 - protein, 17 aa, Entamoeba histolytica
TTVRLIIMSAMMDVEKI

SEQ ID NO: 2698277 - protein, 26 aa, Entamoeba histolytica
TTVSVYEWKDGLFLETERKVFNKGRI

SEQ ID NO: 2698278 - protein, 24 aa, Entamoeba histolytica
TTWAGQCLILANFLILPVQRLPRY

SEQ ID NO: 2698279 - protein, 29 aa, Entamoeba histolytica
TTYFNFRQECLWKYTAQIYDEFMNTFDCL

SEQ ID NO: 2698280 - protein, 36 aa, Entamoeba histolytica; identical to SEQ ID NO: 2507477

SEQ ID NO: 2698281 - protein, 19 aa, Entamoeba histolytica
TTYRLYFNNCLLNPDDTIA

SEQ ID NO: 2698282 - protein, 25 aa, Entamoeba histolytica
TVADEIKKFFGYDPKCVQLKKKYEA

SEQ ID NO: 2698283 - protein, 17 aa, Entamoeba histolytica
TVAWLLKKGASPMVENC

SEQ ID NO: 2698284 - protein, 17 aa, Entamoeba histolytica
TVCPCKARCQAFRKEVI

SEQ ID NO: 2698285 - protein, 18 aa, Entamoeba histolytica
TVDAIVCYKILSMMFEKD

SEQ ID NO: 2698286 - protein, 26 aa, Entamoeba histolytica
TVDDYCLYFYLTFFIMKENVFDDNEV

SEQ ID NO: 2698287 - protein, 25 aa, Entamoeba histolytica
TVDDYCLYFYLTFFIMKETHFEDNE

SEQ ID NO: 2698288 - protein, 28 aa, Entamoeba histolytica
TVDEWRRMCFCFVINRVNYYLTREEELL

SEQ ID NO: 2698289 - protein, 28 aa, Entamoeba histolytica
TVDEWRRMCFCFVINRVNYYLTRQEELL

SEQ ID NO: 2698290 - protein, 25 aa, Entamoeba histolytica
TVDFGESFVSIFPFYNGTYIFNASD

SEQ ID NO: 2698291 - protein, 26 aa, Entamoeba histolytica
TVDFYYYKDIHCIELDHSIGDINQKI

SEQ ID NO: 2698292 - protein, 18 aa, Entamoeba histolytica
TVDIPIYHYFTGCQEEIE

SEQ ID NO: 2698293 - protein, 27 aa, Entamoeba histolytica
TVDKLLRCLFMKELSFESEKKYDIYVN

SEQ ID NO: 2698294 - protein, 19 aa, Entamoeba histolytica
TVDVWDWQSIVGIQPSIQN

SEQ ID NO: 2698295 - protein, 18 aa, Entamoeba histolytica
TVDWKTNLDFIIQICTGM

SEQ ID NO: 2698296 - protein, 24 aa, Entamoeba histolytica
TVEDKWRLIPAFVKARGLVRQHID

SEQ ID NO: 2698297 - protein, 18 aa, Entamoeba histolytica
TVEEFRKLLPRLSKKVDI

SEQ ID NO: 2698298 - protein, 25 aa, Entamoeba histolytica
TVEGETYCGIKIYRLYFKCTRCKTI

SEQ ID NO: 2698299 - protein, 17 aa, Entamoeba histolytica
TVELPRIVVKNNVNITI

SEQ ID NO: 2698300 - protein, 18 aa, Entamoeba histolytica
TVENCYRKNINVDGKVCV

SEQ ID NO: 2698301 - protein, 19 aa, Entamoeba histolytica
TVETIIRIRIIVSPLKTVK

SEQ ID NO: 2698302 - protein, 25 aa, Entamoeba histolytica
TVFEFAVKGLEIFGMKEHLDFDVVQ

SEQ ID NO: 2698303 - protein, 24 aa, Entamoeba histolytica
TVFSKEIPLNFLLEVHDKIVATQD

SEQ ID NO: 2698304 - protein, 23 aa, Entamoeba histolytica
TVGEFKKLGFLKEKFRTPVKKDC

SEQ ID NO: 2698305 - protein, 17 aa, Entamoeba histolytica
TVGKTCMLMCYTSNDFP

SEQ ID NO: 2698306 - protein, 26 aa, Entamoeba histolytica
TVHIELRSGFIFIYEMIKSSNMKLID

SEQ ID NO: 2698307 - protein, 18 aa, Entamoeba histolytica
TVICYKVSYKTYKQKKCN

SEQ ID NO: 2698308 - protein, 23 aa, Entamoeba histolytica
TVILKRKIGQMLLNTDKVFTDSD

SEQ ID NO: 2698309 - protein, 23 aa, Entamoeba histolytica
TVINYILSFLFYFIQKNAIIDCA

SEQ ID NO: 2698310 - protein, 26 aa, Entamoeba histolytica
TVIQCLSHTPLIRDFFLSQSFKEDTT

SEQ ID NO: 2698311 - protein, 18 aa, Entamoeba histolytica
TVITRAARQFEFRKMNKL

SEQ ID NO: 2698312 - protein, 24 aa, Entamoeba histolytica
TVIWPSPKLSSGVVEPYNAVLNTH

SEQ ID NO: 2698313 - protein, 24 aa, Entamoeba histolytica
TVKAESTDDFFLFGYNNYTNNPIY

SEQ ID NO: 2698314 - protein, 19 aa, Entamoeba histolytica
TVKEMTRITGIQANQRNKI

SEQ ID NO: 2698315 - protein, 24 aa, Entamoeba histolytica
TVKGTCLICKNSLFDGQPVTIYPC

SEQ ID NO: 2698316 - protein, 20 aa, Entamoeba histolytica
TVKIIGKECFKGCTSLSSIT

SEQ ID NO: 2698317 - protein, 22 aa, Entamoeba histolytica
TVKKIYPVLMMFRSELTLPSMS

SEQ ID NO: 2698318 - protein, 23 aa, Entamoeba histolytica
TVKKLKEIQSIFIEQLNKDPSSI

SEQ ID NO: 2698319 - protein, 23 aa, Entamoeba histolytica
TVKLCKVSILIDPMDIVRGNETE

SEQ ID NO: 2698320 - protein, 18 aa, Entamoeba histolytica
TVKLSNFGFAAILTSAHP

SEQ ID NO: 2698321 - protein, 17 aa, Entamoeba histolytica
TVKPRKITKVSMVKDKK

SEQ ID NO: 2698322 - protein, 18 aa, Entamoeba histolytica
TVKSCLKNTFNDINFLCT

SEQ ID NO: 2698323 - protein, 25 aa, Entamoeba histolytica
TVKVSLRIAELLWKKGVQCDSVIFT

SEQ ID NO: 2698324 - protein, 22 aa, Entamoeba histolytica
TVKYIPEFEISKDYYGLLYCNL

SEQ ID NO: 2698325 - protein, 23 aa, Entamoeba histolytica
TVLEEYWSVVVFHVVVESSNGSY

SEQ ID NO: 2698326 - protein, 18 aa, Entamoeba histolytica
TVLLKIIPINNIIEIILF

SEQ ID NO: 2698327 - protein, 31 aa, Entamoeba histolytica
TVLQRLLYTRVFKYIWPPSINTIEKMNLKEV

SEQ ID NO: 2698328 - protein, 17 aa, Entamoeba histolytica
TVLREIYITDIPSFCNN

SEQ ID NO: 2698329 - protein, 21 aa, Entamoeba histolytica
TVMIEIFYRGLGVSFVEGEVL

SEQ ID NO: 2698330 - protein, 25 aa, Entamoeba histolytica
TVNGEIISGWLISKAVCINEFNIIP

SEQ ID NO: 2698331 - protein, 22 aa, Entamoeba histolytica
TVNIIKEFLLQCGLHPHENVAK

SEQ ID NO: 2698332 - protein, 25 aa, Entamoeba histolytica
TVNNVICPYFFFPLTTFNEYNTAGW

SEQ ID NO: 2698333 - protein, 17 aa, Entamoeba histolytica
TVNPVIAESLNFVHQLK

SEQ ID NO: 2698334 - protein, 23 aa, Entamoeba histolytica
TVNYKKVCEILSLMVKNKWYEPK

SEQ ID NO: 2698335 - protein, 24 aa, Entamoeba histolytica
TVPCPWLDGKHVVFGQVVEGYDVV

SEQ ID NO: 2698336 - protein, 25 aa, Entamoeba histolytica
TVPRELPCNAKVLYPFKSCDSKTLS

SEQ ID NO: 2698337 - protein, 17 aa, Entamoeba histolytica
TVREIDHLFVAGQQQPQ

SEQ ID NO: 2698338 - protein, 23 aa, Entamoeba histolytica
TVRKYKFGVVCVKPGQDENAIFG

SEQ ID NO: 2698339 - protein, 26 aa, Entamoeba histolytica
TVRLEDCLACSGCITSAETVLIEQQG

SEQ ID NO: 2698340 - protein, 24 aa, Entamoeba histolytica
TVRMLKEKFCYVGYDLAVENRLGT

SEQ ID NO: 2698341 - protein, 19 aa, Entamoeba histolytica
TVSIIGDECFKGCSSLTSV

SEQ ID NO: 2698342 - protein, 20 aa, Entamoeba histolytica
TVSLPTHRVFALNHLSTISI

SEQ ID NO: 2698343 - protein, 32 aa, Entamoeba histolytica
TVSPEERSLFCYCPNIVAFPLASVSPRSTSSD

SEQ ID NO: 2698344 - protein, 22 aa, Entamoeba histolytica
TVSRKIRLNFVIEAPKIDIGEV

SEQ ID NO: 2698345 - protein, 26 aa, Entamoeba histolytica
TVSTREAICAWDWKMRCIEGEDRFGT

SEQ ID NO: 2698346 - protein, 17 aa, Entamoeba histolytica
TVTGCIQYLVKAANDQV

SEQ ID NO: 2698347 - protein, 26 aa, Entamoeba histolytica
TVVFAELYWTPGVLRQAEDRVHRIGQ

SEQ ID NO: 2698348 - protein, 25 aa, Entamoeba histolytica
TVVNLFFFEDCDSFIGSFSSIATTT

SEQ ID NO: 2698349 - protein, 17 aa, Entamoeba histolytica
TVVRLHYLINNLFIDLI

SEQ ID NO: 2698350 - protein, 28 aa, Entamoeba histolytica
TVVTLPCELCIGSKLKTYIFIDNEVVSF

SEQ ID NO: 2698351 - protein, 25 aa, Entamoeba histolytica
TVYEGICYSTPLPTRSFFYDESIGI

SEQ ID NO: 2698352 - protein, 25 aa, Entamoeba histolytica
TVYHIARYLVYWGKAKIIEAIQLDD

SEQ ID NO: 2698353 - protein, 21 aa, Entamoeba histolytica
TVYYQWEWEEVKGVFFSSRWT

SEQ ID NO: 2698354 - protein, 20 aa, Entamoeba histolytica
TWDQCFYALYLTVKDINCYT

SEQ ID NO: 2698355 - protein, 24 aa, Entamoeba histolytica
TWDSEAKYYFQFCPCEKHKQWIVN

SEQ ID NO: 2698356 - protein, 20 aa, Entamoeba histolytica
TWGDSFEFYNVTPGTMATFT

SEQ ID NO: 2698357 - protein, 29 aa, Entamoeba histolytica
TWGNTLIPFSFRNGGSFFIIIGGEKSTKP

SEQ ID NO: 2698358 - protein, 21 aa, Entamoeba histolytica
TWNDILCKLAIEAVTICAGGD

SEQ ID NO: 2698359 - protein, 17 aa, Entamoeba histolytica
TWNSIIFDQVERLKNIA

SEQ ID NO: 2698360 - protein, 26 aa, Entamoeba histolytica
TWNSLWRYIGIEKHATYGFYWMLGAA

SEQ ID NO: 2698361 - protein, 23 aa, Entamoeba histolytica
TWVFEMLKSQHFIHPSEFSSIPP

SEQ ID NO: 2698362 - protein, 26 aa, Entamoeba histolytica
TWVLNPRATSIGIDICKYLNNTIKIV

SEQ ID NO: 2698363 - protein, 18 aa, Entamoeba histolytica
TYALRSLALFYFITAAET

SEQ ID NO: 2698364 - protein, 23 aa, Entamoeba histolytica
TYAVPFKPIHFISMINEIPNVDI

SEQ ID NO: 2698365 - protein, 18 aa, Entamoeba histolytica
TYDCPLSYTIDELNLMKG

SEQ ID NO: 2698366 - protein, 25 aa, Entamoeba histolytica
TYDSVEVFPGKGLNVIIGPNGAGKS

SEQ ID NO: 2698367 - protein, 20 aa, Entamoeba histolytica
TYFANCLQWILPSMGDDIYL

SEQ ID NO: 2698368 - protein, 24 aa, Entamoeba histolytica
TYFIFGRIDGCLDLLEFKNKSFTF

SEQ ID NO: 2698369 - protein, 18 aa, Entamoeba histolytica
TYFIHFTGDFVIPKYSFS

SEQ ID NO: 2698370 - protein, 22 aa, Entamoeba histolytica
TYFPCELSEYALLYKRYCAQSV

SEQ ID NO: 2698371 - protein, 22 aa, Entamoeba histolytica
TYFPTKCHRFLKLLNDKGILKM

SEQ ID NO: 2698372 - protein, 19 aa, Entamoeba histolytica
TYFRTAKRLIVVDLQGVIN

SEQ ID NO: 2698373 - protein, 24 aa, Entamoeba histolytica
TYGCRVIQKACEFISGEELGIIAE

SEQ ID NO: 2698374 - protein, 23 aa, Entamoeba histolytica
TYGCYESALFIIRRNGMKEYIPK

SEQ ID NO: 2698375 - protein, 23 aa, Entamoeba histolytica
TYGCYESALFIIRRNGMKEYVPK

SEQ ID NO: 2698376 - protein, 19 aa, Entamoeba histolytica
TYGELKKVIKLMGGSLVKD

SEQ ID NO: 2698377 - protein, 25 aa, Entamoeba histolytica
TYGIQCLKNGMSMICKRKEVDGVRL

SEQ ID NO: 2698378 - protein, 29 aa, Entamoeba histolytica
TYGKDICFRKGDEMICFSTSDNRWLLVQH

SEQ ID NO: 2698379 - protein, 18 aa, Entamoeba histolytica
TYHQLLADRYHCGLQDAR

SEQ ID NO: 2698380 - protein, 23 aa, Entamoeba histolytica
TYIDGGVVKLFFPMNKKIKAPIK

SEQ ID NO: 2698381 - protein, 24 aa, Entamoeba histolytica
TYIESEFFFFFIFTNNGEKFKFKR

SEQ ID NO: 2698382 - protein, 24 aa, Entamoeba histolytica
TYIKRIAIEFIGNVPTLVVGTSPE

SEQ ID NO: 2698383 - protein, 18 aa, Entamoeba histolytica
TYILFFLKAVRLVPEVAG

SEQ ID NO: 2698384 - protein, 17 aa, Entamoeba histolytica
TYIPIDIYDGTTVGPYN

SEQ ID NO: 2698385 - protein, 24 aa, Entamoeba histolytica
TYIPTRFLFCYGTCQFNGTEVEDV

SEQ ID NO: 2698386 - protein, 17 aa, Entamoeba histolytica
TYISSIVKLVLKGNTLF

SEQ ID NO: 2698387 - protein, 21 aa, Entamoeba histolytica
TYKDTMAEEVWGFNQMFSEFE

SEQ ID NO: 2698388 - protein, 23 aa, Entamoeba histolytica
TYKHIPHCFIQFQNMFISLETPF

SEQ ID NO: 2698389 - protein, 22 aa, Entamoeba histolytica
TYKNPFNVIGVLPEDDNDTIHK

SEQ ID NO: 2698390 - protein, 17 aa, Entamoeba histolytica
TYLDFLQRTLCWDPDLR

SEQ ID NO: 2698391 - protein, 17 aa, Entamoeba histolytica
TYLKMPSIFKLSISSFN

SEQ ID NO: 2698392 - protein, 18 aa, Entamoeba histolytica
TYLNIFIQQLYSWLQDFL

SEQ ID NO: 2698393 - protein, 17 aa, Entamoeba histolytica
TYLSICASLIQSPSTAV

SEQ ID NO: 2698394 - protein, 17 aa, Entamoeba histolytica
TYLSTDIFRRILEDYFG

SEQ ID NO: 2698395 - protein, 24 aa, Entamoeba histolytica
TYMRMLECVEKIGEAAECRTDAER

SEQ ID NO: 2698396 - protein, 17 aa, Entamoeba histolytica
TYPELKVSFTYFDINGK

SEQ ID NO: 2698397 - protein, 22 aa, Entamoeba histolytica
TYPSPKCIRFSPSQKQTFAVCS

SEQ ID NO: 2698398 - protein, 20 aa, Entamoeba histolytica
TYQEGAFCDLEILNKNPALF

SEQ ID NO: 2698399 - protein, 26 aa, Entamoeba histolytica
TYQEWFKMLWYKGLFTYYREDLHLSE

SEQ ID NO: 2698400 - protein, 17 aa, Entamoeba histolytica
TYQFIGALIAIEIPVSA

SEQ ID NO: 2698401 - protein, 18 aa, Entamoeba histolytica
TYQIPFELPPPIHEALTG

SEQ ID NO: 2698402 - protein, 24 aa, Entamoeba histolytica
TYQNCYWREIVSLMGYSNEEYIIT

SEQ ID NO: 2698403 - protein, 17 aa, Entamoeba histolytica
TYRDIYRFIKVNHKCLD

SEQ ID NO: 2698404 - protein, 17 aa, Entamoeba histolytica
TYRRCIKVTNDGEEIEG

SEQ ID NO: 2698405 - protein, 17 aa, Entamoeba histolytica
TYSCLKCENRRCLENIL

SEQ ID NO: 2698406 - protein, 32 aa, Entamoeba histolytica
TYSNEIFIGLALLRFGIHLEDVINYLKPSNLN

SEQ ID NO: 2698407 - protein, 22 aa, Entamoeba histolytica
TYVCYESALFIIRRNGMKEYIP

SEQ ID NO: 2698408 - protein, 22 aa, Entamoeba histolytica
TYVFASNVFDIYGINLPDTSTG

SEQ ID NO: 2698409 - protein, 19 aa, Entamoeba histolytica
TYVLWKPMTEKIAFSYTER

SEQ ID NO: 2698410 - protein, 18 aa, Entamoeba histolytica
TYYQASGCSSKISEHATR

SEQ ID NO: 2698411 - protein, 22 aa, Entamoeba histolytica
VAACIIKLFLRELSDCLIPMQF

SEQ ID NO: 2698412 - protein, 22 aa, Entamoeba histolytica
VAAECFKFSDSYPIEQEDVNLT

SEQ ID NO: 2698413 - protein, 25 aa, Entamoeba histolytica
VAAPPGIWCKYFQPSKLLLHSTAPK

SEQ ID NO: 2698414 - protein, 17 aa, Entamoeba histolytica
VACCKIINDNYIKVESS

SEQ ID NO: 2698415 - protein, 25 aa, Entamoeba histolytica
VACIPFKASCALVDNNVEWVPVEQL

SEQ ID NO: 2698416 - protein, 32 aa, Entamoeba histolytica; identical to SEQ ID NO: 2507627

SEQ ID NO: 2698417 - protein, 18 aa, Entamoeba histolytica
VACLLDYIIDSFPKHCID

SEQ ID NO: 2698418 - protein, 17 aa, Entamoeba histolytica
VACLYDLNNHQFVPSNK

SEQ ID NO: 2698419 - protein, 42 aa, Entamoeba histolytica
VACVHCKAGRGRTGLVCSCVLMGLGICSNAKEAMEFFAKRRS

SEQ ID NO: 2698420 - protein, 23 aa, Entamoeba histolytica
VADCGVEFIHIIAAQAKDVAANT

SEQ ID NO: 2698421 - protein, 19 aa, Entamoeba histolytica
VADILLLELTIAFYKINFY

SEQ ID NO: 2698422 - protein, 18 aa, Entamoeba histolytica
VAEARIKLVESRKKQEEA

SEQ ID NO: 2698423 - protein, 26 aa, Entamoeba histolytica
VAEEDGLKCGICWDTSSDVVSTACGH

SEQ ID NO: 2698424 - protein, 23 aa, Entamoeba histolytica
VAEFFRYFLDECYSYLQNILSTT

SEQ ID NO: 2698425 - protein, 24 aa, Entamoeba histolytica
VAEFFRYFLDECYSYLQNILSTTS

SEQ ID NO: 2698426 - protein, 27 aa, Entamoeba histolytica
VAELISRLCAECIVGDTTLAQNIIEEA

SEQ ID NO: 2698427 - protein, 25 aa, Entamoeba histolytica
VAENIYRVVLYFARSLENENTSDET

SEQ ID NO: 2698428 - protein, 21 aa, Entamoeba histolytica
VAERYLDCKNFYYKGIEVTIS

SEQ ID NO: 2698429 - protein, 23 aa, Entamoeba histolytica
VAFDCLKKHGVIIYMEPQDFLMK

SEQ ID NO: 2698430 - protein, 32 aa, Entamoeba histolytica; identical to SEQ ID NO: 2507641

SEQ ID NO: 2698431 - protein, 23 aa, Entamoeba histolytica
VAFMCGGLGCLLSEIQDCQPDHL

SEQ ID NO: 2698432 - protein, 18 aa, Entamoeba histolytica
VAFQELFGAFSSKRRIFI

SEQ ID NO: 2698433 - protein, 19 aa, Entamoeba histolytica
VAFQELFGAFSSKRRIFIE

SEQ ID NO: 2698434 - protein, 17 aa, Entamoeba histolytica
VAGCYSGVCTMIDIGTV

SEQ ID NO: 2698435 - protein, 17 aa, Entamoeba histolytica
VAGEAFKCRICGVKIHP

SEQ ID NO: 2698436 - protein, 25 aa, Entamoeba histolytica
VAGHVYTCEFERAFQNWSVDPRDLF

SEQ ID NO: 2698437 - protein, 23 aa, Entamoeba histolytica
VAGRSRSGTIAISYFMKKKQLSL

SEQ ID NO: 2698438 - protein, 25 aa, Entamoeba histolytica
VAHDGAIWDLQWHPVGHLLASCAHD

SEQ ID NO: 2698439 - protein, 19 aa, Entamoeba histolytica
VAHDISLLIPEIWSKMIRY

SEQ ID NO: 2698440 - protein, 19 aa, Entamoeba histolytica
VAHDISLLIPEIWSKMRRY

SEQ ID NO: 2698441 - protein, 24 aa, Entamoeba histolytica
VAHDISLLIPEIWSRMRRYEQEPK

SEQ ID NO: 2698442 - protein, 17 aa, Entamoeba histolytica
VAIKCGDQWIARENKIL

SEQ ID NO: 2698443 - protein, 17 aa, Entamoeba histolytica
VAILRYELNLEDEDEGE

SEQ ID NO: 2698444 - protein, 17 aa, Entamoeba histolytica
VAIREGKSKTFARDYII

SEQ ID NO: 2698445 - protein, 18 aa, Entamoeba histolytica
VAIRFNASIIDGRVNGSR

SEQ ID NO: 2698446 - protein, 21 aa, Entamoeba histolytica
VAIRLKIYSPYVVDLTLVDLP

SEQ ID NO: 2698447 - protein, 17 aa, Entamoeba histolytica
VAISRGINEEGIFRISS

SEQ ID NO: 2698448 - protein, 18 aa, Entamoeba histolytica
VAIVGKDTPFRFITDKEL

SEQ ID NO: 2698449 - protein, 23 aa, Entamoeba histolytica
VAIYLPNCCEYIYSQLAALCGGY

SEQ ID NO: 2698450 - protein, 24 aa, Entamoeba histolytica
VAKEAIKMIFSFNENNVFGESSEL

SEQ ID NO: 2698451 - protein, 22 aa, Entamoeba histolytica
VAKFKKACAGVITRKRMNYIIK

SEQ ID NO: 2698452 - protein, 20 aa, Entamoeba histolytica
VAKGLGAKVYYYSTTGKHED

SEQ ID NO: 2698453 - protein, 24 aa, Entamoeba histolytica
VAKIKKYRRALLFNYDKETDMVEL

SEQ ID NO: 2698454 - protein, 19 aa, Entamoeba histolytica
VAKKVVKKAKRHDAVDEYL

SEQ ID NO: 2698455 - protein, 25 aa, Entamoeba histolytica
VAKKYGAVCVIGIGYPLPLSKVTHD

SEQ ID NO: 2698456 - protein, 19 aa, Entamoeba histolytica
VAKLCCALNVFPNTTTLKQ

SEQ ID NO: 2698457 - protein, 19 aa, Entamoeba histolytica
VAKPVLKRVVKEFNNGYDL

SEQ ID NO: 2698458 - protein, 19 aa, Entamoeba histolytica
VAKTACYGRFCLERYLEGE

SEQ ID NO: 2698459 - protein, 17 aa, Entamoeba histolytica
VAKVVVGDVCINNMLIE

SEQ ID NO: 2698460 - protein, 20 aa, Entamoeba histolytica
VALAVRLYVRLMKKAGLVYG

SEQ ID NO: 2698461 - protein, 21 aa, Entamoeba histolytica
VALEMIKTQFLAVFEGSLNLY

SEQ ID NO: 2698462 - protein, 19 aa, Entamoeba histolytica
VALIKFCESFLFFVYSQNI

SEQ ID NO: 2698463 - protein, 22 aa, Entamoeba histolytica
VALIRCVVTYGKEKPLRSPYAH

SEQ ID NO: 2698464 - protein, 17 aa, Entamoeba histolytica
VALKIIRKNERMVKLSQ

SEQ ID NO: 2698465 - protein, 26 aa, Entamoeba histolytica
VALKTEIRTLLSILSLLCITQKDINE

SEQ ID NO: 2698466 - protein, 24 aa, Entamoeba histolytica
VALKVLRNRLAYFRQGMLEIAVLQ

SEQ ID NO: 2698467 - protein, 19 aa, Entamoeba histolytica
VALLNCLTTLIGEPYADIG

SEQ ID NO: 2698468 - protein, 24 aa, Entamoeba histolytica
VALSRLKSLDGLYIEGSVIKERIK

SEQ ID NO: 2698469 - protein, 23 aa, Entamoeba histolytica
VALSSLRKSIYFEMTPMVLNEVI

SEQ ID NO: 2698470 - protein, 18 aa, Entamoeba histolytica
VAMGIHAIGGMLNGGERV

SEQ ID NO: 2698471 - protein, 18 aa, Entamoeba histolytica
VANEIKEKLVKIEEYDNL

SEQ ID NO: 2698472 - protein, 21 aa, Entamoeba histolytica
VANGECVVSFEIEDDESDEDK

SEQ ID NO: 2698473 - protein, 20 aa, Entamoeba histolytica
VAPADKVNAVFLHFQSVLSI

SEQ ID NO: 2698474 - protein, 19 aa, Entamoeba histolytica
VAPSFFSQEITYMITTEKN

SEQ ID NO: 2698475 - protein, 21 aa, Entamoeba histolytica
VAQAECIIEIGIEALEEPFEL

SEQ ID NO: 2698476 - protein, 17 aa, Entamoeba histolytica
VAQGMMERGFLTGYTKL

SEQ ID NO: 2698477 - protein, 26 aa, Entamoeba histolytica
VAQLYKLGKNEIMCDWLRNEENKGRT

SEQ ID NO: 2698478 - protein, 23 aa, Entamoeba histolytica
VARGAALVGYELFKEGINKQTDT

SEQ ID NO: 2698479 - protein, 19 aa, Entamoeba histolytica
VARLYHWKHPNIVGFEGCW

SEQ ID NO: 2698480 - protein, 17 aa, Entamoeba histolytica
VASMNIALGVPRIKEII

SEQ ID NO: 2698481 - protein, 18 aa, Entamoeba histolytica
VASRIPIALLSRVLEYLT

SEQ ID NO: 2698482 - protein, 24 aa, Entamoeba histolytica
VASYYRGVLGIAMIYDVTSKDSFD

SEQ ID NO: 2698483 - protein, 22 aa, Entamoeba histolytica
VATDLFLKFIRVLESKVELHTN

SEQ ID NO: 2698484 - protein, 23 aa, Entamoeba histolytica
VATERLMNVLAFCGLEQTIKSEF

SEQ ID NO: 2698485 - protein, 19 aa, Entamoeba histolytica
VAVAKRLQDNFDHPEINIE

SEQ ID NO: 2698486 - protein, 20 aa, Entamoeba histolytica
VAVGKSCLLLQFQDKRFQPI

SEQ ID NO: 2698487 - protein, 30 aa, Entamoeba histolytica
VAYKCFKLGDFNMAFIIYSCIIRASYKHSD

SEQ ID NO: 2698488 - protein, 19 aa, Entamoeba histolytica
VAYLTCQKALYVYSDDNSK

SEQ ID NO: 2698489 - protein, 18 aa, Entamoeba histolytica
VAYSIPYDECVVLRKTNR

SEQ ID NO: 2698490 - protein, 26 aa, Entamoeba histolytica
VAYTNAIDWWGLGVLIYEMLYGTVPF

SEQ ID NO: 2698491 - protein, 21 aa, Entamoeba histolytica
VCAIFKLRNLISGIYLWISNE

SEQ ID NO: 2698492 - protein, 21 aa, Entamoeba histolytica
VCAKAPRMASVLFNNFNEENS

SEQ ID NO: 2698493 - protein, 18 aa, Entamoeba histolytica
VCAKQASIIKEMGFNEPI

SEQ ID NO: 2698494 - protein, 17 aa, Entamoeba histolytica
VCALIKEPFTFTINSVY

SEQ ID NO: 2698495 - protein, 23 aa, Entamoeba histolytica
VCAVLNKFASLIIKNISLIPLKF

SEQ ID NO: 2698496 - protein, 22 aa, Entamoeba histolytica
VCCSNPAKLFGIYPEKGCLGIG

SEQ ID NO: 2698497 - protein, 18 aa, Entamoeba histolytica
VCCVMPNYQKIGSLASLN

SEQ ID NO: 2698498 - protein, 23 aa, Entamoeba histolytica
VCCYIPRPSCLTETYVIINPILR

SEQ ID NO: 2698499 - protein, 27 aa, Entamoeba histolytica
VCDECKNDKSCYSCQFENIRIEMNKKY

SEQ ID NO: 2698500 - protein, 19 aa, Entamoeba histolytica
VCDEFRSTCSCIRGDVTTF

SEQ ID NO: 2698501 - protein, 27 aa, Entamoeba histolytica
VCDQIKKRKNGILALREPVFEWVESVM

SEQ ID NO: 2698502 - protein, 20 aa, Entamoeba histolytica
VCFHIDFYVRMFILVKSSVA

SEQ ID NO: 2698503 - protein, 23 aa, Entamoeba histolytica
VCGIDINLGCGMWFSTKGEMGQA

SEQ ID NO: 2698504 - protein, 22 aa, Entamoeba histolytica
VCGKGNIAFIVLRNGGECFGCY

SEQ ID NO: 2698505 - protein, 31 aa, Entamoeba histolytica
VCGKSGGAICRCVWCSLLVHNACQPKLLNCC

SEQ ID NO: 2698506 - protein, 17 aa, Entamoeba histolytica
VCGNILCSLGEKGLVKC

SEQ ID NO: 2698507 - protein, 20 aa, Entamoeba histolytica
VCGSDLFIAPEILKKLYNGT

SEQ ID NO: 2698508 - protein, 19 aa, Entamoeba histolytica
VCGTLKMRLVQWELYQRKR

SEQ ID NO: 2698509 - protein, 18 aa, Entamoeba histolytica
VCIMQIFLTSPIYRLKNT

SEQ ID NO: 2698510 - protein, 17 aa, Entamoeba histolytica
VCIQSAAAPGYFGSVNA

SEQ ID NO: 2698511 - protein, 17 aa, Entamoeba histolytica
VCIVSLFSTSAIHRLHK

SEQ ID NO: 2698512 - protein, 20 aa, Entamoeba histolytica
VCKMFSLRMDMTRIEKDLLE

SEQ ID NO: 2698513 - protein, 18 aa, Entamoeba histolytica
VCKMKIEKMNIGFEARVI

SEQ ID NO: 2698514 - protein, 21 aa, Entamoeba histolytica
VCKQGKPILCKVLVSVSVDIN

SEQ ID NO: 2698515 - protein, 21 aa, Entamoeba histolytica
VCKTDALLKRAIREIENIKDK

SEQ ID NO: 2698516 - protein, 28 aa, Entamoeba histolytica
VCKVCKEKISGKFAWRENGFICGNCVMK

SEQ ID NO: 2698517 - protein, 17 aa, Entamoeba histolytica
VCLNELYESQVSFNKTM

SEQ ID NO: 2698518 - protein, 18 aa, Entamoeba histolytica
VCLRIFNDLFETFIEKGD

SEQ ID NO: 2698519 - protein, 20 aa, Entamoeba histolytica
VCMPQVLKILIPYLPTQIES

SEQ ID NO: 2698520 - protein, 17 aa, Entamoeba histolytica
VCNKGSFEMLDYWIEEY

SEQ ID NO: 2698521 - protein, 19 aa, Entamoeba histolytica
VCNKTLFSNDFICRYCHTC

SEQ ID NO: 2698522 - protein, 22 aa, Entamoeba histolytica
VCQIQIPPLFPTVLNITAFGKC

SEQ ID NO: 2698523 - protein, 18 aa, Entamoeba histolytica
VCQTCSGIHREFGHRVKS

SEQ ID NO: 2698524 - protein, 21 aa, Entamoeba histolytica
VCRCGFCDGHFSIPNIPKVLP

SEQ ID NO: 2698525 - protein, 24 aa, Entamoeba histolytica
VCRETLRALNFIHGLHCIHRDIKS

SEQ ID NO: 2698526 - protein, 26 aa, Entamoeba histolytica
VCSALKEMKCPRLLQPHQITGLDFGV

SEQ ID NO: 2698527 - protein, 22 aa, Entamoeba histolytica
VCSVTLPLQILIQLMKNPTDEN

SEQ ID NO: 2698528 - protein, 28 aa, Entamoeba histolytica
VCTCGNKIPHLFKFAGDMLGLTQFNELS

SEQ ID NO: 2698529 - protein, 26 aa, Entamoeba histolytica
VCTDFCKTDNSIFCVGLSNGDVVLYN

SEQ ID NO: 2698530 - protein, 19 aa, Entamoeba histolytica
VCTKCSKPFPTPSFFQKDG

SEQ ID NO: 2698531 - protein, 18 aa, Entamoeba histolytica
VCTLKRGNLKIIVKNEDI

SEQ ID NO: 2698532 - protein, 19 aa, Entamoeba histolytica
VCTNSGISKFDLKSKSALK

SEQ ID NO: 2698533 - protein, 27 aa, Entamoeba histolytica
VCVCICSDGSFLPLLVCLPKKYISSLI

SEQ ID NO: 2698534 - protein, 19 aa, Entamoeba histolytica
VCYESALFLIRRNGMKEYI

SEQ ID NO: 2698535 - protein, 18 aa, Entamoeba histolytica
VDAAIPYISTIEIEGDVV

SEQ ID NO: 2698536 - protein, 18 aa, Entamoeba histolytica
VDAEIAFYVSAQVEDIPF

SEQ ID NO: 2698537 - protein, 17 aa, Entamoeba histolytica
VDAIEFWSDRFSDGDVP

SEQ ID NO: 2698538 - protein, 27 aa, Entamoeba histolytica
VDAKYKYLQLCMTLRSYGMNIYHGGIE

SEQ ID NO: 2698539 - protein, 24 aa, Entamoeba histolytica
VDALVSLSKYVGWVSTDILIASNF

SEQ ID NO: 2698540 - protein, 18 aa, Entamoeba histolytica
VDATAFVKKVIGAFKDCS

SEQ ID NO: 2698541 - protein, 31 aa, Entamoeba histolytica; identical to SEQ ID NO: 2507751

SEQ ID NO: 2698542 - protein, 17 aa, Entamoeba histolytica
VDCGFKVVAEKVEGTVA

SEQ ID NO: 2698543 - protein, 24 aa, Entamoeba histolytica
VDCGVFMLYFIRKFMEYTPSDGTK

SEQ ID NO: 2698544 - protein, 18 aa, Entamoeba histolytica
VDCPFRAMDEFDVYMDSM

SEQ ID NO: 2698545 - protein, 31 aa, Entamoeba histolytica
VDCVMKCPIDCRSDLFGTINLIGAASKLKGM

SEQ ID NO: 2698546 - protein, 21 aa, Entamoeba histolytica
VDDAKRAFIIGNLKDMTSNAK

SEQ ID NO: 2698547 - protein, 23 aa, Entamoeba histolytica
VDDIKIATAFMKTMVLLYNLQTV

SEQ ID NO: 2698548 - protein, 20 aa, Entamoeba histolytica
VDDILAWAIKKGEMDLNKSG

SEQ ID NO: 2698549 - protein, 19 aa, Entamoeba histolytica
VDDLIWPLLEKKLKISGET

SEQ ID NO: 2698550 - protein, 26 aa, Entamoeba histolytica
VDDLKTLLFVKLCGKAEKVIQPEVKG

SEQ ID NO: 2698551 - protein, 17 aa, Entamoeba histolytica
VDEFRGHFMLDGHNENV

SEQ ID NO: 2698552 - protein, 19 aa, Entamoeba histolytica
VDEFRGRFMMDGHNESLKY

SEQ ID NO: 2698553 - protein, 22 aa, Entamoeba histolytica
VDELIKSCSLFLEDSSEEVCSA

SEQ ID NO: 2698554 - protein, 27 aa, Entamoeba histolytica
VDELLKIPNFLERFSLDDVADTFRPLF

SEQ ID NO: 2698555 - protein, 25 aa, Entamoeba histolytica
VDENYHITEYLALGATLAVSYVENI

SEQ ID NO: 2698556 - protein, 17 aa, Entamoeba histolytica
VDETFQMIVKRSRENKI

SEQ ID NO: 2698557 - protein, 19 aa, Entamoeba histolytica
VDETLIGRLWSHFSQEFYP

SEQ ID NO: 2698558 - protein, 25 aa, Entamoeba histolytica
VDEWRRMCFCFVINRVNYYLTRQEL

SEQ ID NO: 2698559 - protein, 26 aa, Entamoeba histolytica
VDEWRRMHFCFVINRVNYYLTREEEL

SEQ ID NO: 2698560 - protein, 24 aa, Entamoeba histolytica
VDFDTIVCWFGEFFNDPKIIDEMR

SEQ ID NO: 2698561 - protein, 17 aa, Entamoeba histolytica
VDFGKIFIGSDEIQSGS

SEQ ID NO: 2698562 - protein, 20 aa, Entamoeba histolytica
VDFICSFGRILEILILNKEM

SEQ ID NO: 2698563 - protein, 25 aa, Entamoeba histolytica
VDFINVRDIFKFLSVHWDVLSHLEQ

SEQ ID NO: 2698564 - protein, 17 aa, Entamoeba histolytica
VDFISVLNSYEYFYEVN

SEQ ID NO: 2698565 - protein, 20 aa, Entamoeba histolytica
VDFIVPEGFMPRIIDGNHIV

SEQ ID NO: 2698566 - protein, 17 aa, Entamoeba histolytica
VDFKKKEFIVDGTHIVS

SEQ ID NO: 2698567 - protein, 17 aa, Entamoeba histolytica
VDFKPKILNIRNKTVKM

SEQ ID NO: 2698568 - protein, 20 aa, Entamoeba histolytica
VDFREFFKGNFCVDILSKKF

SEQ ID NO: 2698569 - protein, 24 aa, Entamoeba histolytica
VDFRVFCFYFEFLMNAFKNKSSVI

SEQ ID NO: 2698570 - protein, 25 aa, Entamoeba histolytica
VDFYEYLVFCWMKILVVDKKKTFHQ

SEQ ID NO: 2698571 - protein, 27 aa, Entamoeba histolytica
VDGDDRLWLKLGKEYTISKEKSSNVIV

SEQ ID NO: 2698572 - protein, 20 aa, Entamoeba histolytica
VDGMSAWINMYYAFDQKYNI

SEQ ID NO: 2698573 - protein, 26 aa, Entamoeba histolytica
VDGNVKLTLGLVWTLILRFAISELSA

SEQ ID NO: 2698574 - protein, 21 aa, Entamoeba histolytica
VDGRSNLAFVVLTSDKWVFGC

SEQ ID NO: 2698575 - protein, 26 aa, Entamoeba histolytica
VDGWYDPRFPTIQGLIRRGLTLEAMK

SEQ ID NO: 2698576 - protein, 23 aa, Entamoeba histolytica
VDHETREVLPIGIAGELEIKSPF

SEQ ID NO: 2698577 - protein, 18 aa, Entamoeba histolytica
VDHFKRLVYENENGTPSQ

SEQ ID NO: 2698578 - protein, 23 aa, Entamoeba histolytica
VDHPFVPLWACKDEEIKPIYEEF

SEQ ID NO: 2698579 - protein, 19 aa, Entamoeba histolytica
VDIGEKILHIHSMILKTTP

SEQ ID NO: 2698580 - protein, 24 aa, Entamoeba histolytica
VDIIPGTVYFKACLHQNFEHSTLF

SEQ ID NO: 2698581 - protein, 20 aa, Entamoeba histolytica
VDIKILILFQSIIRGYLTRR

SEQ ID NO: 2698582 - protein, 18 aa, Entamoeba histolytica
VDIKTGKSLNVFSSSTNQ

SEQ ID NO: 2698583 - protein, 24 aa, Entamoeba histolytica
VDIMPTPRIRPSLSQIKENETSNT

SEQ ID NO: 2698584 - protein, 21 aa, Entamoeba histolytica
VDINTALTLIETWKNVSEATY

SEQ ID NO: 2698585 - protein, 23 aa, Entamoeba histolytica
VDIPECPEVNGFVRALCEMSGYM

SEQ ID NO: 2698586 - protein, 17 aa, Entamoeba histolytica
VDITLRLQKTFLAAVES

SEQ ID NO: 2698587 - protein, 30 aa, Entamoeba histolytica
VDKDLWMKYPLMKFLALYVINISEVNDDLI

SEQ ID NO: 2698588 - protein, 19 aa, Entamoeba histolytica
VDKEFKKWLEQQNISMYGE

SEQ ID NO: 2698589 - protein, 26 aa, Entamoeba histolytica
VDKFKVYKIPLPPTMEMPSQSTNKME

SEQ ID NO: 2698590 - protein, 24 aa, Entamoeba histolytica
VDKIYTQRIILFVGSPLNINSDEA

SEQ ID NO: 2698591 - protein, 18 aa, Entamoeba histolytica
VDKKCFEGELVIPTIEEE

SEQ ID NO: 2698592 - protein, 32 aa, Entamoeba histolytica
VDKNSSFIQMCWKEIFEILYIASLDEDIAVIK

SEQ ID NO: 2698593 - protein, 25 aa, Entamoeba histolytica
VDKRVEITPALLLCHFNVEIKAIYP

SEQ ID NO: 2698594 - protein, 24 aa, Entamoeba histolytica
VDLCATDKGILIWSLYDLIEVNIE

SEQ ID NO: 2698595 - protein, 26 aa, Entamoeba histolytica
VDLDYGVFICDLCASLHTTCNHTKQS

SEQ ID NO: 2698596 - protein, 26 aa, Entamoeba histolytica
VDLIETCIRRSLIYPVVRNWELSMKT

SEQ ID NO: 2698597 - protein, 31 aa, Entamoeba histolytica
VDLIPEEHRELFLYVCSKIHILRQNHLEQVS

SEQ ID NO: 2698598 - protein, 20 aa, Entamoeba histolytica
VDLIRQCINIPFKRPSVESI

SEQ ID NO: 2698599 - protein, 21 aa, Entamoeba histolytica
VDLKDGIRVINFFELLSGKTL

SEQ ID NO: 2698600 - protein, 25 aa, Entamoeba histolytica
VDLKDGIRVINFFELLSGKTLKEKY

SEQ ID NO: 2698601 - protein, 23 aa, Entamoeba histolytica
VDLKDKWRNLEFSRLRNNKQKSN

SEQ ID NO: 2698602 - protein, 23 aa, Entamoeba histolytica
VDLKKGEVVIKCYQCNNICHDPC

SEQ ID NO: 2698603 - protein, 31 aa, Entamoeba histolytica
VDLKNVICLQEFRLVNSMFSKPVSFLFPTSL

SEQ ID NO: 2698604 - protein, 19 aa, Entamoeba histolytica
VDLNPPFTLKMANGIKNED

SEQ ID NO: 2698605 - protein, 17 aa, Entamoeba histolytica
VDLPEWVRRYSKKRKDE

SEQ ID NO: 2698606 - protein, 18 aa, Entamoeba histolytica
VDLPPELAPLPPLPPKVH

SEQ ID NO: 2698607 - protein, 18 aa, Entamoeba histolytica
VDLREIITPLALELGGSG

SEQ ID NO: 2698608 - protein, 24 aa, Entamoeba histolytica
VDLYSFKESYDFINEVEKEEYHLM

SEQ ID NO: 2698609 - protein, 29 aa, Entamoeba histolytica
VDMWSVGCVFLEIFKHRPVFHGKTENEQL

SEQ ID NO: 2698610 - protein, 24 aa, Entamoeba histolytica
VDNSCSRMFLDLSMIDIVIDLSNE

SEQ ID NO: 2698611 - protein, 18 aa, Entamoeba histolytica
VDPFTAFLQGDQKIDTEF

SEQ ID NO: 2698612 - protein, 20 aa, Entamoeba histolytica
VDPHSSFVFLFDIVNPDTNP

SEQ ID NO: 2698613 - protein, 17 aa, Entamoeba histolytica
VDPKAFVDRILKLKEGK

SEQ ID NO: 2698614 - protein, 18 aa, Entamoeba histolytica
VDPKAFVDRILKLKEGKK

SEQ ID NO: 2698615 - protein, 22 aa, Entamoeba histolytica
VDPNFNRTVLINTKFDNRVKEL

SEQ ID NO: 2698616 - protein, 18 aa, Entamoeba histolytica
VDQPNFFKKENKVSRKGF

SEQ ID NO: 2698617 - protein, 23 aa, Entamoeba histolytica
VDRAIEIYPSFRIPAELAKPSGK

SEQ ID NO: 2698618 - protein, 25 aa, Entamoeba histolytica
VDREFYKELKPTIGVDIKNKTININ

SEQ ID NO: 2698619 - protein, 27 aa, Entamoeba histolytica
VDRFDMCLKVVFRLICVHVALCTKMEE

SEQ ID NO: 2698620 - protein, 29 aa, Entamoeba histolytica
VDRGSFGVECVLTLFSFMIIYPNSVFLAR

SEQ ID NO: 2698621 - protein, 27 aa, Entamoeba histolytica
VDRLNRICRVFKPIITKDWKTLRHDML

SEQ ID NO: 2698622 - protein, 21 aa, Entamoeba histolytica
VDRPKWCKIQDEFEGKETEAF

SEQ ID NO: 2698623 - protein, 25 aa, Entamoeba histolytica
VDSARLLFKNDLKGVEQFIKTFMKG

SEQ ID NO: 2698624 - protein, 22 aa, Entamoeba histolytica
VDSESSAHVYLRMKDGDTIETL

SEQ ID NO: 2698625 - protein, 18 aa, Entamoeba histolytica
VDSFRKVKLIGMGNVGRV

SEQ ID NO: 2698626 - protein, 26 aa, Entamoeba histolytica
VDSISRMCLELEPLYYELLDNNINLE

SEQ ID NO: 2698627 - protein, 18 aa, Entamoeba histolytica
VDTAVTMLKRHLFPYGGH

SEQ ID NO: 2698628 - protein, 18 aa, Entamoeba histolytica
VDTEFKMNNLIQFYGQSK

SEQ ID NO: 2698629 - protein, 19 aa, Entamoeba histolytica
VDTLLKFIIIKSQMPHFAS

SEQ ID NO: 2698630 - protein, 17 aa, Entamoeba histolytica
VDTTSWYTSIFDITHTS

SEQ ID NO: 2698631 - protein, 25 aa, Entamoeba histolytica
VDTWRNFCEVFRYLPVSALIEGKIL

SEQ ID NO: 2698632 - protein, 24 aa, Entamoeba histolytica
VDVAVEYCWFFFDVIIKSLTLYLE

SEQ ID NO: 2698633 - protein, 21 aa, Entamoeba histolytica
VDVCLIKIIPYLIKLYPEEEE

SEQ ID NO: 2698634 - protein, 24 aa, Entamoeba histolytica
VDVDLPICFVIGVAKHPRTHEKVL

SEQ ID NO: 2698635 - protein, 17 aa, Entamoeba histolytica
VDVFCGKVVKLFLDTLK

SEQ ID NO: 2698636 - protein, 18 aa, Entamoeba histolytica
VDVFLIQKVDNFVPDQIM

SEQ ID NO: 2698637 - protein, 19 aa, Entamoeba histolytica
VDVHKILPLFATIGDDAEI

SEQ ID NO: 2698638 - protein, 24 aa, Entamoeba histolytica
VDVIKEVKQTIGFNHLITIETKEQ

SEQ ID NO: 2698639 - protein, 29 aa, Entamoeba histolytica
VDVLGYPDCKCCLLEGVLYLARARKSNFL

SEQ ID NO: 2698640 - protein, 18 aa, Entamoeba histolytica
VDVSYNFYTLLQLNGISC

SEQ ID NO: 2698641 - protein, 26 aa, Entamoeba histolytica
VDVTIWRPPQVLIFQLKRFEFTEKYE

SEQ ID NO: 2698642 - protein, 26 aa, Entamoeba histolytica
VDVTLCKYCDFIYIAVTEDENYKKHI

SEQ ID NO: 2698643 - protein, 25 aa, Entamoeba histolytica
VDWVDIEGLPAFGLVIDSGETLRFS

SEQ ID NO: 2698644 - protein, 21 aa, Entamoeba histolytica
VDYPNSSWCFGLCSLQYTIED

SEQ ID NO: 2698645 - protein, 24 aa, Entamoeba histolytica
VEACKADDYKGCPKKRFDYSTNTG

SEQ ID NO: 2698646 - protein, 24 aa, Entamoeba histolytica
VEAIKEIEQLLILFSPQVFSLKTI

SEQ ID NO: 2698647 - protein, 17 aa, Entamoeba histolytica
VEALFEMSSDIKTKYKD

SEQ ID NO: 2698648 - protein, 25 aa, Entamoeba histolytica
VEALKRILMCYGIYDMETMYVQGMN

SEQ ID NO: 2698649 - protein, 25 aa, Entamoeba histolytica
VEAPFRTSINMGMFRGSYKDFQYVV

SEQ ID NO: 2698650 - protein, 23 aa, Entamoeba histolytica
VEASKFDAVWGIKMEESDERAND

SEQ ID NO: 2698651 - protein, 19 aa, Entamoeba histolytica
VEASLDEWEFCKTFAENGI

SEQ ID NO: 2698652 - protein, 23 aa, Entamoeba histolytica
VECKDFIRRCLVADPTRRMNIEG

SEQ ID NO: 2698653 - protein, 20 aa, Entamoeba histolytica
VECLKLYNCRNWKFQELSHL

SEQ ID NO: 2698654 - protein, 18 aa, Entamoeba histolytica
VEDLKFIDWKCIVGKLTV

SEQ ID NO: 2698655 - protein, 25 aa, Entamoeba histolytica
VEDQRKCGVCSPSSMPSSSDETITY

SEQ ID NO: 2698656 - protein, 17 aa, Entamoeba histolytica
VEDTLYILRGIREKYEN

SEQ ID NO: 2698657 - protein, 23 aa, Entamoeba histolytica
VEDYKFRYNRAIERMSDLEKNDN

SEQ ID NO: 2698658 - protein, 28 aa, Entamoeba histolytica
VEEAPKCVFCKKAVKQKDSFQCIRCKLV

SEQ ID NO: 2698659 - protein, 18 aa, Entamoeba histolytica
VEEIKTSPFFSVQKAMDD

SEQ ID NO: 2698660 - protein, 17 aa, Entamoeba histolytica
VEEKLAIVKTIFLKINE

SEQ ID NO: 2698661 - protein, 24 aa, Entamoeba histolytica
VEELELRLGKMNGLSQSEDVIGGI

SEQ ID NO: 2698662 - protein, 20 aa, Entamoeba histolytica
VEELKRLIEVSTNNYNETHQ

SEQ ID NO: 2698663 - protein, 19 aa, Entamoeba histolytica
VEENNLYPLLSFKPDTVVQ

SEQ ID NO: 2698664 - protein, 18 aa, Entamoeba histolytica
VEEVPSFHSIDILQQQGI

SEQ ID NO: 2698665 - protein, 20 aa, Entamoeba histolytica
VEFFNTIVLLYAIGQMAING

SEQ ID NO: 2698666 - protein, 25 aa, Entamoeba histolytica
VEFKESEEGWFFGCWQPKDILSGKK

SEQ ID NO: 2698667 - protein, 28 aa, Entamoeba histolytica
VEFPDKFRKFGMEPSKGVLFFGPPGCGK

SEQ ID NO: 2698668 - protein, 28 aa, Entamoeba histolytica
VEFPLKGDDCYLCLKGVNHFATMAPMLD

SEQ ID NO: 2698669 - protein, 20 aa, Entamoeba histolytica
VEFSPGHQFVALKCGCVISK

SEQ ID NO: 2698670 - protein, 20 aa, Entamoeba histolytica
VEGEIPRYGATRISEGVDLI

SEQ ID NO: 2698671 - protein, 27 aa, Entamoeba histolytica
VEGESKKFFGLIPYWIAQLIEIENNIQ

SEQ ID NO: 2698672 - protein, 17 aa, Entamoeba histolytica
VEGIFRMNARVGRIEEM

SEQ ID NO: 2698673 - protein, 17 aa, Entamoeba histolytica
VEGIYVIFNLIIQYHCP

SEQ ID NO: 2698674 - protein, 24 aa, Entamoeba histolytica
VEGLNIKRIKCMIESLSKGILILD

SEQ ID NO: 2698675 - protein, 19 aa, Entamoeba histolytica
VEGLQGIILTMDFYTCKFT

SEQ ID NO: 2698676 - protein, 20 aa, Entamoeba histolytica
VEGYDSMGFEFSRPQLRAET

SEQ ID NO: 2698677 - protein, 18 aa, Entamoeba histolytica
VEHLLLPYIKTMLIPQQS

SEQ ID NO: 2698678 - protein, 19 aa, Entamoeba histolytica
VEHLTLFKYIMKLSYKISA

SEQ ID NO: 2698679 - protein, 23 aa, Entamoeba histolytica
VEHQFVGAILFTLSTNKQAFITK

SEQ ID NO: 2698680 - protein, 36 aa, Entamoeba histolytica
VEIAKKFKPTLVFGVPRFYEKLLFRAKEIRGNSMII

SEQ ID NO: 2698681 - protein, 24 aa, Entamoeba histolytica
VEIAKTWLKQSWAHNISSSFLAMN

SEQ ID NO: 2698682 - protein, 26 aa, Entamoeba histolytica
VEIFYNIFIELCIRYYSIVSLESKKL

SEQ ID NO: 2698683 - protein, 23 aa, Entamoeba histolytica
VEIGSEKGIVWILSEQGDFALIE

SEQ ID NO: 2698684 - protein, 17 aa, Entamoeba histolytica
VEIGYDIKGPQLMTERS

SEQ ID NO: 2698685 - protein, 21 aa, Entamoeba histolytica
VEIKAIYPIRDVIYFNRKSLK

SEQ ID NO: 2698686 - protein, 24 aa, Entamoeba histolytica
VEIKRKPLDGRKVIKRKKKETEEN

SEQ ID NO: 2698687 - protein, 21 aa, Entamoeba histolytica
VEILKLPVIDSYNFPLINYLE

SEQ ID NO: 2698688 - protein, 21 aa, Entamoeba histolytica
VEILLKLISLQGIANDIKTKI

SEQ ID NO: 2698689 - protein, 25 aa, Entamoeba histolytica
VEILRLKMKANYGLERYEECYESFL

SEQ ID NO: 2698690 - protein, 17 aa, Entamoeba histolytica
VEIPFLMVNTINTIFNE

SEQ ID NO: 2698691 - protein, 18 aa, Entamoeba histolytica
VEKFFFFLLETINRVKSF

SEQ ID NO: 2698692 - protein, 17 aa, Entamoeba histolytica
VEKIKLHFDLRVVDGSD

SEQ ID NO: 2698693 - protein, 29 aa, Entamoeba histolytica
VEKIKSFLPDGIKLFQFNALTQKEDIQSS

SEQ ID NO: 2698694 - protein, 20 aa, Entamoeba histolytica
VEKKAVVITEKWILVDEKEK

SEQ ID NO: 2698695 - protein, 24 aa, Entamoeba histolytica
VEKKCLKKRMTFIPLNKIAPQMPN

SEQ ID NO: 2698696 - protein, 27 aa, Entamoeba histolytica
VEKKYGIKVPFMYGTMVECVRAALTAD

SEQ ID NO: 2698697 - protein, 25 aa, Entamoeba histolytica
VEKLQTLPYFCCISAAQGLGLDKLK

SEQ ID NO: 2698698 - protein, 32 aa, Entamoeba histolytica
VEKMFHCMYEKGCYCKGIFRESQNASIRKVEE

SEQ ID NO: 2698699 - protein, 19 aa, Entamoeba histolytica
VEKMISYGILDILKELTKK

SEQ ID NO: 2698700 - protein, 20 aa, Entamoeba histolytica
VEKNSGFGFVEYAKHEDAIN

SEQ ID NO: 2698701 - protein, 28 aa, Entamoeba histolytica
VEKQPCYFVPELMRLTGMSDDMRADNQF

SEQ ID NO: 2698702 - protein, 25 aa, Entamoeba histolytica
VEKQRFLKMCESIMEYLEKHKEYGK

SEQ ID NO: 2698703 - protein, 23 aa, Entamoeba histolytica
VEKSGYQSYPWVRYMTFAGDYCF

SEQ ID NO: 2698704 - protein, 22 aa, Entamoeba histolytica
VEKVQQRKGFLSRRSETQSQTN

SEQ ID NO: 2698705 - protein, 17 aa, Entamoeba histolytica
VELARKLFPEKLDQFNP

SEQ ID NO: 2698706 - protein, 23 aa, Entamoeba histolytica
VELECGKLGYKVNWNHHKRKKEQ

SEQ ID NO: 2698707 - protein, 24 aa, Entamoeba histolytica
VELEQLRMSFNYICSLPNELSMLS

SEQ ID NO: 2698708 - protein, 30 aa, Entamoeba histolytica
VELFHEQRVCFSLKGAKIIMVSSEEYNLPP

SEQ ID NO: 2698709 - protein, 18 aa, Entamoeba histolytica
VELFIPCLSILNESIQKQ

SEQ ID NO: 2698710 - protein, 28 aa, Entamoeba histolytica
VELIEQLLIEFILEFTLKIRQDEPTKQI

SEQ ID NO: 2698711 - protein, 19 aa, Entamoeba histolytica
VELISYYSFFFGGFSNSIL

SEQ ID NO: 2698712 - protein, 17 aa, Entamoeba histolytica
VELKLKNCNSIQHGSFH

SEQ ID NO: 2698713 - protein, 17 aa, Entamoeba histolytica
VELKSNVIIFTNIPPDQ

SEQ ID NO: 2698714 - protein, 19 aa, Entamoeba histolytica
VELLKIRYEMIHKYFEDKS

SEQ ID NO: 2698715 - protein, 19 aa, Entamoeba histolytica
VELLLRNGALVNFQTEGGQ

SEQ ID NO: 2698716 - protein, 27 aa, Entamoeba histolytica
VELPIANGRLKFDLEILTDATPMTIKD

SEQ ID NO: 2698717 - protein, 23 aa, Entamoeba histolytica
VELPLRHPQLFQAIGIKPPKGVL

SEQ ID NO: 2698718 - protein, 29 aa, Entamoeba histolytica
VELSNALFGFDGWSCCITNLNVDYVDVDK

SEQ ID NO: 2698719 - protein, 19 aa, Entamoeba histolytica
VELSSDLFANYVIQKAIEF

SEQ ID NO: 2698720 - protein, 24 aa, Entamoeba histolytica
VELTWTCSSLFLPQQYLSYLTTQQ

SEQ ID NO: 2698721 - protein, 17 aa, Entamoeba histolytica
VEMCKELLAKAEAKKVE

SEQ ID NO: 2698722 - protein, 24 aa, Entamoeba histolytica
VEMCNLKDLSICIFKKSKFNLYLS

SEQ ID NO: 2698723 - protein, 26 aa, Entamoeba histolytica
VEMKISEPMGIVLYSFKGESPNELDV

SEQ ID NO: 2698724 - protein, 17 aa, Entamoeba histolytica
VEMNPWYTIAFKGVPDS

SEQ ID NO: 2698725 - protein, 19 aa, Entamoeba histolytica
VENDMYWYAAIGVCDQYIS

SEQ ID NO: 2698726 - protein, 19 aa, Entamoeba histolytica
VENKGFFYRAEFVEVATGA

SEQ ID NO: 2698727 - protein, 25 aa, Entamoeba histolytica
VENSPYCKDCFIAKFAKICARCGKP

SEQ ID NO: 2698728 - protein, 17 aa, Entamoeba histolytica
VEPEGNCLLRVISTLKR

SEQ ID NO: 2698729 - protein, 18 aa, Entamoeba histolytica
VEPFKLLFKREPVALNNV

SEQ ID NO: 2698730 - protein, 20 aa, Entamoeba histolytica
VEPFYFYVLCEFNYNEQWKS

SEQ ID NO: 2698731 - protein, 29 aa, Entamoeba histolytica
VEPHRCFIKEGMLMKVCRKTIKPRYFYLF

SEQ ID NO: 2698732 - protein, 26 aa, Entamoeba histolytica
VEPQLFLLRWVRILFCQMFNTNELYY

SEQ ID NO: 2698733 - protein, 25 aa, Entamoeba histolytica
VEPSRKCFRLINGVMVERTASEIIP

SEQ ID NO: 2698734 - protein, 25 aa, Entamoeba histolytica
VEQIVKWYCIEWIVRDNLIQQLNHS

SEQ ID NO: 2698735 - protein, 25 aa, Entamoeba histolytica
VERIKERLGYVAFDYKEESTLASLS

SEQ ID NO: 2698736 - protein, 21 aa, Entamoeba histolytica
VERLLKCWTLYNFDGGYQQGM

SEQ ID NO: 2698737 - protein, 17 aa, Entamoeba histolytica
VERSVETPNRFDNGFTA

SEQ ID NO: 2698738 - protein, 17 aa, Entamoeba histolytica
VERVVGADIVLRKQIEQ

SEQ ID NO: 2698739 - protein, 17 aa, Entamoeba histolytica
VERYQSFVFKLNNDINI

SEQ ID NO: 2698740 - protein, 22 aa, Entamoeba histolytica
VESFLKMYKDFFFDKQSNLVSI

SEQ ID NO: 2698741 - protein, 18 aa, Entamoeba histolytica
VESFLNYSVQIEHQHYPI

SEQ ID NO: 2698742 - protein, 20 aa, Entamoeba histolytica
VESIIASWAVVHVNDKKYVF

SEQ ID NO: 2698743 - protein, 25 aa, Entamoeba histolytica
VESIIDWNTCLIKEAIKKIKNMNKM

SEQ ID NO: 2698744 - protein, 24 aa, Entamoeba histolytica
VESLRPALFEGWGKKQGGSVKTWK

SEQ ID NO: 2698745 - protein, 18 aa, Entamoeba histolytica
VESNFRMQLRIFISTLCK

SEQ ID NO: 2698746 - protein, 19 aa, Entamoeba histolytica
VESNYALACSSPIELFIQS

SEQ ID NO: 2698747 - protein, 17 aa, Entamoeba histolytica
VESRIGIFDNDHKFISG

SEQ ID NO: 2698748 - protein, 17 aa, Entamoeba histolytica
VESTLEYSIINFSNSEF

SEQ ID NO: 2698749 - protein, 25 aa, Entamoeba histolytica
VETLKPLVCIGSCYALCKPSQFPVG

SEQ ID NO: 2698750 - protein, 19 aa, Entamoeba histolytica
VETLPRRPTQSIPNKKKMS

SEQ ID NO: 2698751 - protein, 19 aa, Entamoeba histolytica
VETMLKHQMIANIKNRNNN

SEQ ID NO: 2698752 - protein, 17 aa, Entamoeba histolytica
VETPNRFDNGFTAQRSD

SEQ ID NO: 2698753 - protein, 18 aa, Entamoeba histolytica
VETQPSYEFSWFEGYAWQ

SEQ ID NO: 2698754 - protein, 19 aa, Entamoeba histolytica
VETVRQCYELMTYHNDEII

SEQ ID NO: 2698755 - protein, 18 aa, Entamoeba histolytica
VETVYRYLERKDLLKILD

SEQ ID NO: 2698756 - protein, 23 aa, Entamoeba histolytica
VEVKKRLGYKSVQEIKSHPWFEG

SEQ ID NO: 2698757 - protein, 18 aa, Entamoeba histolytica
VEVLRRICELPPENTPNA

SEQ ID NO: 2698758 - protein, 24 aa, Entamoeba histolytica
VEVQKGYFLFSFNPMVRGVIQVCL

SEQ ID NO: 2698759 - protein, 17 aa, Entamoeba histolytica
VEYCKHYGIKIQAFQEI

SEQ ID NO: 2698760 - protein, 17 aa, Entamoeba histolytica
VEYEELFGLNSDDADPA

SEQ ID NO: 2698761 - protein, 23 aa, Entamoeba histolytica
VEYINGFGFRNIREWIKKIKTPY

SEQ ID NO: 2698762 - protein, 22 aa, Entamoeba histolytica
VEYKPKCIKKYHSKYPVDAQPH

SEQ ID NO: 2698763 - protein, 21 aa, Entamoeba histolytica
VEYLVGLIFPLKYSGEIRPYF

SEQ ID NO: 2698764 - protein, 29 aa, Entamoeba histolytica
VEYPVRAFAEFKGMVLAGVGNILRLYDIG

SEQ ID NO: 2698765 - protein, 18 aa, Entamoeba histolytica
VEYSQLTMRCFIYPELHQ

SEQ ID NO: 2698766 - protein, 27 aa, Entamoeba histolytica
VFCGSVLRTEVIFRMFKSMELKATVLH

SEQ ID NO: 2698767 - protein, 19 aa, Entamoeba histolytica
VFCPCGGRPYTLNENNIQN

SEQ ID NO: 2698768 - protein, 18 aa, Entamoeba histolytica
VFDAKRLIGRRFSDPAIQ

SEQ ID NO: 2698769 - protein, 24 aa, Entamoeba histolytica
VFDFSKKNFDCWIEVKTTNTISEL

SEQ ID NO: 2698770 - protein, 20 aa, Entamoeba histolytica
VFDILKYSTKFHVQFQLYSI

SEQ ID NO: 2698771 - protein, 17 aa, Entamoeba histolytica
VFDLQWLFDELPILTKI

SEQ ID NO: 2698772 - protein, 17 aa, Entamoeba histolytica
VFDRMKLDWEKVTVDQS

SEQ ID NO: 2698773 - protein, 38 aa, Entamoeba histolytica
VFDTIKYRHLWSYILHIIRLFISFSFKNPKLPCFNCPS

SEQ ID NO: 2698774 - protein, 24 aa, Entamoeba histolytica
VFEGHKAPVWSINFSKTDPNIFAT

SEQ ID NO: 2698775 - protein, 18 aa, Entamoeba histolytica
VFEKDVFESPDFTSIDIV

SEQ ID NO: 2698776 - protein, 39 aa, Entamoeba histolytica
VFEKISLIGAGGFGEVWKVRHKLMRFISAAKIIKLNKSS

SEQ ID NO: 2698777 - protein, 18 aa, Entamoeba histolytica
VFEKLHKNHGCWIKKIGE

SEQ ID NO: 2698778 - protein, 22 aa, Entamoeba histolytica
VFELCCGLCEKIQLMNIEINEP

SEQ ID NO: 2698779 - protein, 18 aa, Entamoeba histolytica
VFEPYGIPANILDALRQT

SEQ ID NO: 2698780 - protein, 20 aa, Entamoeba histolytica
VFERRSDILSVVFSPLRYIS

SEQ ID NO: 2698781 - protein, 28 aa, Entamoeba histolytica
VFEVEKFPSIFPERRCLNSVITKSVKRQ

SEQ ID NO: 2698782 - protein, 21 aa, Entamoeba histolytica
VFFLCQMDQLFYIFADFDNRD

SEQ ID NO: 2698783 - protein, 18 aa, Entamoeba histolytica
VFFSSRWTPYRRAENKLL

SEQ ID NO: 2698784 - protein, 22 aa, Entamoeba histolytica
VFGESLEKYGLLKGTEQKIPKQ

SEQ ID NO: 2698785 - protein, 18 aa, Entamoeba histolytica
VFGGDPFFDFVGDNKSKV

SEQ ID NO: 2698786 - protein, 20 aa, Entamoeba histolytica
VFGKRCHFIKSLGDGSTIVH

SEQ ID NO: 2698787 - protein, 17 aa, Entamoeba histolytica
VFGLAFIVYQLFNETQC

SEQ ID NO: 2698788 - protein, 20 aa, Entamoeba histolytica
VFGPCMQRFNREFPSHRKLN

SEQ ID NO: 2698789 - protein, 19 aa, Entamoeba histolytica
VFGQWGFLIYYILLKGGSV

SEQ ID NO: 2698790 - protein, 23 aa, Entamoeba histolytica
VFGSNKRPGLTFINTKVDPPTQF

SEQ ID NO: 2698791 - protein, 17 aa, Entamoeba histolytica
VFHCTLLYHFPNDILSF

SEQ ID NO: 2698792 - protein, 23 aa, Entamoeba histolytica
VFIIECGNSVWVGLNTNQLNVID

SEQ ID NO: 2698793 - protein, 18 aa, Entamoeba histolytica
VFILEPLVVRLCQEIKND

SEQ ID NO: 2698794 - protein, 18 aa, Entamoeba histolytica
VFIMNSITPFVINDKSFV

SEQ ID NO: 2698795 - protein, 19 aa, Entamoeba histolytica
VFINKCVGFEVGIEEFWRR

SEQ ID NO: 2698796 - protein, 20 aa, Entamoeba histolytica
VFINKCVGFEVGIEEFWRRY

SEQ ID NO: 2698797 - protein, 26 aa, Entamoeba histolytica
VFKETMKLCYKIVCHSEINAMNAKNL

SEQ ID NO: 2698798 - protein, 28 aa, Entamoeba histolytica
VFKLTAFGSRAGIFVKAICMFLTTITTP

SEQ ID NO: 2698799 - protein, 24 aa, Entamoeba histolytica
VFKNELILFYMFYVMVGEESQLKA

SEQ ID NO: 2698800 - protein, 18 aa, Entamoeba histolytica
VFKNIPVALFLYNKGSSL

SEQ ID NO: 2698801 - protein, 20 aa, Entamoeba histolytica
VFKSNLEQIKCLIQNQQPPV

SEQ ID NO: 2698802 - protein, 27 aa, Entamoeba histolytica
VFLKFGKEIVRSCCLKYVDSKGNLIKV

SEQ ID NO: 2698803 - protein, 18 aa, Entamoeba histolytica
VFLQLIIKEIPLSSWKEY

SEQ ID NO: 2698804 - protein, 28 aa, Entamoeba histolytica
VFLQQRRIKVIDMCWVKGDIPVVLTHAK

SEQ ID NO: 2698805 - protein, 18 aa, Entamoeba histolytica
VFMLRGNHETRLMCEYMT

SEQ ID NO: 2698806 - protein, 23 aa, Entamoeba histolytica
VFNEPKFRVAVLPAVGSGIEREN

SEQ ID NO: 2698807 - protein, 18 aa, Entamoeba histolytica
VFNKCIRLILVELLLKAG

SEQ ID NO: 2698808 - protein, 18 aa, Entamoeba histolytica
VFNPSLICHSYFNREACD

SEQ ID NO: 2698809 - protein, 26 aa, Entamoeba histolytica
VFPIKDIWKHVCIVWTECENSLPPKK

SEQ ID NO: 2698810 - protein, 34 aa, Entamoeba histolytica
VFPIKDSWKHVCIVWTRCFFNYIPEKKIEKGKKE

SEQ ID NO: 2698811 - protein, 18 aa, Entamoeba histolytica
VFPKNMFKPKRRHQNELL

SEQ ID NO: 2698812 - protein, 17 aa, Entamoeba histolytica
VFQKKWMGYEWENKIIV

SEQ ID NO: 2698813 - protein, 17 aa, Entamoeba histolytica
VFQMYPREINVLHFEEV

SEQ ID NO: 2698814 - protein, 24 aa, Entamoeba histolytica
VFQNYRFNELLSFNYSFFERAVLT

SEQ ID NO: 2698815 - protein, 18 aa, Entamoeba histolytica
VFRGVFMLEGNYYIVNEE

SEQ ID NO: 2698816 - protein, 17 aa, Entamoeba histolytica
VFRMERSEFNMLPRWKK

SEQ ID NO: 2698817 - protein, 23 aa, Entamoeba histolytica
VFSIGCVLFEMISGKLFLQLSNN

SEQ ID NO: 2698818 - protein, 25 aa, Entamoeba histolytica
VFSLESKGRMKGMKKFDIEQPERAF

SEQ ID NO: 2698819 - protein, 24 aa, Entamoeba histolytica
VFSPCDSLLFSSRRLFDMRQKNPI

SEQ ID NO: 2698820 - protein, 24 aa, Entamoeba histolytica
VFSSQCLGCKVLTITPNNIYHHIP

SEQ ID NO: 2698821 - protein, 28 aa, Entamoeba histolytica
VFTIKDIWKRVCIVWTKCPNSFGKEKDK

SEQ ID NO: 2698822 - protein, 23 aa, Entamoeba histolytica
VFTYNEFEYFLPYLYIVCYYSHL

SEQ ID NO: 2698823 - protein, 23 aa, Entamoeba histolytica
VFVGSLVPFTFVLKENGFLIQFS

SEQ ID NO: 2698824 - protein, 23 aa, Entamoeba histolytica
VFVKKWKKRYVVWKDDKLFFFEK

SEQ ID NO: 2698825 - protein, 24 aa, Entamoeba histolytica
VFVLKGCSPIPGAIIYDYDTEEEL

SEQ ID NO: 2698826 - protein, 23 aa, Entamoeba histolytica
VFYELDLGLNHVIRKVAEPIDPT

SEQ ID NO: 2698827 - protein, 21 aa, Entamoeba histolytica
VFYLTKTVWLFEGEKISHLNE

SEQ ID NO: 2698828 - protein, 23 aa, Entamoeba histolytica
VFYNHGWRVDGLLGVSRSIGDES

SEQ ID NO: 2698829 - protein, 20 aa, Entamoeba histolytica
VGAELKLPDIILGAVPSADL

SEQ ID NO: 2698830 - protein, 19 aa, Entamoeba histolytica
VGAGVGYASFCCKGAKEIV

SEQ ID NO: 2698831 - protein, 17 aa, Entamoeba histolytica
VGAMSGKLANKGGVAYR

SEQ ID NO: 2698832 - protein, 29 aa, Entamoeba histolytica
VGAPACPITACRVRFCISAAHTDEDIEKA

SEQ ID NO: 2698833 - protein, 19 aa, Entamoeba histolytica
VGCGQCSSACNFGAIKPVS

SEQ ID NO: 2698834 - protein, 26 aa, Entamoeba histolytica
VGCIAAEFFLGIPLFAGTSEYNLLFK

SEQ ID NO: 2698835 - protein, 24 aa, Entamoeba histolytica
VGCRERSRFGIKVAGTRCAGVMTA

SEQ ID NO: 2698836 - protein, 19 aa, Entamoeba histolytica
VGCVLYCMIVGKKEGPFNQ

SEQ ID NO: 2698837 - protein, 20 aa, Entamoeba histolytica
VGDCRLFHYSLRECKVKKIV

SEQ ID NO: 2698838 - protein, 18 aa, Entamoeba histolytica
VGDDYILYNFSVVHDKFP

SEQ ID NO: 2698839 - protein, 19 aa, Entamoeba histolytica
VGDELMRFILAAGKQAFPQ

SEQ ID NO: 2698840 - protein, 17 aa, Entamoeba histolytica
VGDERYIRFSFNERNRI

SEQ ID NO: 2698841 - protein, 19 aa, Entamoeba histolytica
VGEKVFIRGEENCIFCNEC

SEQ ID NO: 2698842 - protein, 18 aa, Entamoeba histolytica
VGELKRYGPDKGNVPKFL

SEQ ID NO: 2698843 - protein, 23 aa, Entamoeba histolytica
VGEMLKMKSIDIESGQRLYRVAM

SEQ ID NO: 2698844 - protein, 18 aa, Entamoeba histolytica
VGESCFLGDFRAKSITVP

SEQ ID NO: 2698845 - protein, 27 aa, Entamoeba histolytica
VGEYHLKFLIQPFLHWPDTMMTVIEEL

SEQ ID NO: 2698846 - protein, 17 aa, Entamoeba histolytica
VGFISGGISSLVEDLKL

SEQ ID NO: 2698847 - protein, 17 aa, Entamoeba histolytica
VGFSVGLERIMIILEEK

SEQ ID NO: 2698848 - protein, 19 aa, Entamoeba histolytica
VGGCCYCKESGNAYIGFNM

SEQ ID NO: 2698849 - protein, 19 aa, Entamoeba histolytica
VGGGFNLKGDLIVVTQQWL

SEQ ID NO: 2698850 - protein, 20 aa, Entamoeba histolytica
VGGGIPKLLFEATKGSKNTH

SEQ ID NO: 2698851 - protein, 25 aa, Entamoeba histolytica
VGGMGDRAIFVFGFHALQFLYLDPH

SEQ ID NO: 2698852 - protein, 18 aa, Entamoeba histolytica
VGGTSLWKASAALKNTSY

SEQ ID NO: 2698853 - protein, 21 aa, Entamoeba histolytica
VGGYDYLLSMKIWTLTYEKAK

SEQ ID NO: 2698854 - protein, 20 aa, Entamoeba histolytica
VGIKYVFKLLPIVYDSSIFK

SEQ ID NO: 2698855 - protein, 20 aa, Entamoeba histolytica
VGIRSIDVGEQFEIQDKHID

SEQ ID NO: 2698856 - protein, 17 aa, Entamoeba histolytica
VGKGMSGIVGRAAKEYL

SEQ ID NO: 2698857 - protein, 21 aa, Entamoeba histolytica
VGKGSRSSLKILTHGLNPDEC

SEQ ID NO: 2698858 - protein, 22 aa, Entamoeba histolytica
VGKKGVCAMLASQLSVCLDNHA

SEQ ID NO: 2698859 - protein, 29 aa, Entamoeba histolytica
VGKLPRVFKLLPSFEEWIPLLQMTNPSQW

SEQ ID NO: 2698860 - protein, 22 aa, Entamoeba histolytica
VGKSGINVLEFNKKIMEMRKGQ

SEQ ID NO: 2698861 - protein, 29 aa, Entamoeba histolytica
VGKSYLLLMERLFRLLKMIDKNSGVNKMT

SEQ ID NO: 2698862 - protein, 22 aa, Entamoeba histolytica
VGKTALIRRFMYGETISNYEPT

SEQ ID NO: 2698863 - protein, 24 aa, Entamoeba histolytica
VGKTSDVSYLWSLGIILLRFWFGY

SEQ ID NO: 2698864 - protein, 27 aa, Entamoeba histolytica
VGLEIAEFPLLFGVSLIDGERIIYSHY

SEQ ID NO: 2698865 - protein, 22 aa, Entamoeba histolytica
VGLLPDWMESIGIKIVSQKATL

SEQ ID NO: 2698866 - protein, 20 aa, Entamoeba histolytica
VGLNRLYHLIANNLDLMIQV

SEQ ID NO: 2698867 - protein, 26 aa, Entamoeba histolytica
VGLRASYKCGYNYFAPELLEKKQPTA

SEQ ID NO: 2698868 - protein, 19 aa, Entamoeba histolytica
VGLSSCYSTLCDEFIDIRG

SEQ ID NO: 2698869 - protein, 19 aa, Entamoeba histolytica
VGLSSLFYKNSRYVQLCTK

SEQ ID NO: 2698870 - protein, 26 aa, Entamoeba histolytica
VGLTLELRHILKWDQADIQALMERCE

SEQ ID NO: 2698871 - protein, 24 aa, Entamoeba histolytica
VGLVKELLSFLQLSDIQFKQDVVI

SEQ ID NO: 2698872 - protein, 20 aa, Entamoeba histolytica
VGMIKMFNPRLHEVDLQKEV

SEQ ID NO: 2698873 - protein, 26 aa, Entamoeba histolytica
VGMLNIANMFSMWKNNLIEITDQFKI

SEQ ID NO: 2698874 - protein, 18 aa, Entamoeba histolytica
VGMNKLHSNFAFSGSLDG

SEQ ID NO: 2698875 - protein, 24 aa, Entamoeba histolytica
VGNKYKLICVSNRICIGDVVKITT

SEQ ID NO: 2698876 - protein, 18 aa, Entamoeba histolytica
VGNLLKVVFIPNYSVSLA

SEQ ID NO: 2698877 - protein, 17 aa, Entamoeba histolytica
VGPSWFIPMAMHPAAYK

SEQ ID NO: 2698878 - protein, 18 aa, Entamoeba histolytica
VGQYEYIIQFSISKKSGS

SEQ ID NO: 2698879 - protein, 17 aa, Entamoeba histolytica
VGRDYYGVFPLRGKPLN

SEQ ID NO: 2698880 - protein, 22 aa, Entamoeba histolytica
VGRELYPLPVIEEFDKQQKMTK

SEQ ID NO: 2698881 - protein, 21 aa, Entamoeba histolytica
VGSDLTIISMIMKYGISDKKE

SEQ ID NO: 2698882 - protein, 19 aa, Entamoeba histolytica
VGSLQCPKSIRSIKLSHSS

SEQ ID NO: 2698883 - protein, 18 aa, Entamoeba histolytica
VGSYFCVVLSKGKLYSWG

SEQ ID NO: 2698884 - protein, 17 aa, Entamoeba histolytica
VGSYKLAIAQVVNDCIG

SEQ ID NO: 2698885 - protein, 17 aa, Entamoeba histolytica
VGTDTIFCFSNFSKQFL

SEQ ID NO: 2698886 - protein, 27 aa, Entamoeba histolytica
VGTFAKLYCICFEVIPSSMFTRCNIMF

SEQ ID NO: 2698887 - protein, 18 aa, Entamoeba histolytica
VGTIWFDKMIHICCEKDY

SEQ ID NO: 2698888 - protein, 25 aa, Entamoeba histolytica
VGTKAFEFAKGWFGTAVASMTVKES

SEQ ID NO: 2698889 - protein, 17 aa, Entamoeba histolytica
VGTRSRKQCRERFINHI

SEQ ID NO: 2698890 - protein, 24 aa, Entamoeba histolytica
VGTYQCKLCLTTHLTEANYLAHTQ

SEQ ID NO: 2698891 - protein, 18 aa, Entamoeba histolytica
VGVAAVLIASKFEEYSYV

SEQ ID NO: 2698892 - protein, 18 aa, Entamoeba histolytica
VGVIPLDFSNPLRYELQK

SEQ ID NO: 2698893 - protein, 29 aa, Entamoeba histolytica
VGVKKSGWRFPLPIYRCLEYLEKNDGLKT

SEQ ID NO: 2698894 - protein, 20 aa, Entamoeba histolytica
VGVLSRCFEPYMSGYVDLEN

SEQ ID NO: 2698895 - protein, 18 aa, Entamoeba histolytica
VGVSGKLKELIEKREAHK

SEQ ID NO: 2698896 - protein, 19 aa, Entamoeba histolytica
VGYDGSITYTKWVEVKKKT

SEQ ID NO: 2698897 - protein, 24 aa, Entamoeba histolytica
VGYEIKRQLNLRVGVQILAAANKQ

SEQ ID NO: 2698898 - protein, 19 aa, Entamoeba histolytica
VGYLSELIGDIVVFSEHAQ

SEQ ID NO: 2698899 - protein, 19 aa, Entamoeba histolytica
VGYNSSLFRKGNYVCIAEM

SEQ ID NO: 2698900 - protein, 20 aa, Entamoeba histolytica
VGYYNRFPTIQSYKLLTEKI

SEQ ID NO: 2698901 - protein, 18 aa, Entamoeba histolytica
VHAAFVLSELVLIPNTKV

SEQ ID NO: 2698902 - protein, 20 aa, Entamoeba histolytica
VHDWWFYPWLTEIVEDPSEK

SEQ ID NO: 2698903 - protein, 25 aa, Entamoeba histolytica
VHHISDVVFGRAFNVAMSQKPPCSY

SEQ ID NO: 2698904 - protein, 30 aa, Entamoeba histolytica; identical to SEQ ID NO: 2508174

SEQ ID NO: 2698905 - protein, 26 aa, Entamoeba histolytica
VHKPISWLIGRKVKRGTDWKWSDQDG

SEQ ID NO: 2698906 - protein, 33 aa, Entamoeba histolytica
VHLGICGRKGHIGILEWKTQKLINEFHVEEQCY

SEQ ID NO: 2698907 - protein, 17 aa, Entamoeba histolytica
VHLINGKVIPNCLGNIW

SEQ ID NO: 2698908 - protein, 17 aa, Entamoeba histolytica
VHLNLNCDMKEDPDVYL

SEQ ID NO: 2698909 - protein, 24 aa, Entamoeba histolytica
VHLNVLKSLIGFLVQITEKSDLNK

SEQ ID NO: 2698910 - protein, 17 aa, Entamoeba histolytica
VHNPRLGMDQLLITPIS

SEQ ID NO: 2698911 - protein, 28 aa, Entamoeba histolytica
VHPLPSRPWKGTRLRATELLKSEDFEGI

SEQ ID NO: 2698912 - protein, 18 aa, Entamoeba histolytica
VHPNFRLIGTRTLHKGGM

SEQ ID NO: 2698913 - protein, 18 aa, Entamoeba histolytica
VHPPKRGKKTSVFTTRSP

SEQ ID NO: 2698914 - protein, 26 aa, Entamoeba histolytica
VHQIYLRIIQEIILFYSQKTWNLSQY

SEQ ID NO: 2698915 - protein, 17 aa, Entamoeba histolytica
VHRDLALRNVLYIHDKL

SEQ ID NO: 2698916 - protein, 21 aa, Entamoeba histolytica
VHRQKLVNGRLVIEDKERKYT

SEQ ID NO: 2698917 - protein, 18 aa, Entamoeba histolytica
VHSALPFPKQTKPNSTSS

SEQ ID NO: 2698918 - protein, 17 aa, Entamoeba histolytica
VHSKGYIHRDIKPDNFI

SEQ ID NO: 2698919 - protein, 20 aa, Entamoeba histolytica
VHSLAKWKRLQLHELKIPIG

SEQ ID NO: 2698920 - protein, 20 aa, Entamoeba histolytica
VHTVPLPPSTVPSFVPPPPP

SEQ ID NO: 2698921 - protein, 32 aa, Entamoeba histolytica
VHVLHAWFHMKILRLFTDSVLHYGLPTKYDLI

SEQ ID NO: 2698922 - protein, 19 aa, Entamoeba histolytica
VHVLSLWKSLINNIKSEIS

SEQ ID NO: 2698923 - protein, 27 aa, Entamoeba histolytica
VHVYGEIIGNICFEWKEYRDKIITKIR

SEQ ID NO: 2698924 - protein, 17 aa, Entamoeba histolytica
VHYAESDYIVFVYSVNN

SEQ ID NO: 2698925 - protein, 24 aa, Entamoeba histolytica
VHYNCSEHAYSYCLTKLSYLNGYT

SEQ ID NO: 2698926 - protein, 20 aa, Entamoeba histolytica
VIAAINISKGFKIEYSKVLG

SEQ ID NO: 2698927 - protein, 20 aa, Entamoeba histolytica
VIANETFRIFGTMNPGGDFG

SEQ ID NO: 2698928 - protein, 17 aa, Entamoeba histolytica
VIARLKYLRVLDISHCD

SEQ ID NO: 2698929 - protein, 23 aa, Entamoeba histolytica
VIASKAALCARVDALADNADSSM

SEQ ID NO: 2698930 - protein, 18 aa, Entamoeba histolytica
VICAFGFGPDASFVEGTP

SEQ ID NO: 2698931 - protein, 17 aa, Entamoeba histolytica
VICHPILDRWSENVNTL

SEQ ID NO: 2698932 - protein, 22 aa, Entamoeba histolytica
VICLPFYSFIVRYLYVRHENIT

SEQ ID NO: 2698933 - protein, 17 aa, Entamoeba histolytica
VICRLTSYNYMYIIPSF

SEQ ID NO: 2698934 - protein, 24 aa, Entamoeba histolytica
VICSGCGEKGHFFFNCPHKDSRKV

SEQ ID NO: 2698935 - protein, 17 aa, Entamoeba histolytica
VICVRLMDQIIKADQKV

SEQ ID NO: 2698936 - protein, 18 aa, Entamoeba histolytica
VIDDEIFETKLPYWAQPN

SEQ ID NO: 2698937 - protein, 19 aa, Entamoeba histolytica
VIDDWKRMPSSNIIDGSIV

SEQ ID NO: 2698938 - protein, 22 aa, Entamoeba histolytica
VIDKALKYGFLDDEDVNEFQEE

SEQ ID NO: 2698939 - protein, 23 aa, Entamoeba histolytica
VIDKIKPGVINWSMFARPKNGRS

SEQ ID NO: 2698940 - protein, 19 aa, Entamoeba histolytica
VIDPFERINTFQLMDMIAK

SEQ ID NO: 2698941 - protein, 17 aa, Entamoeba histolytica
VIDRKTVCYKCHDQISA

SEQ ID NO: 2698942 - protein, 19 aa, Entamoeba histolytica
VIEAKKALFCFIAEDCDND

SEQ ID NO: 2698943 - protein, 22 aa, Entamoeba histolytica
VIEAKKALFCFIAEDCDNDKYT

SEQ ID NO: 2698944 - protein, 18 aa, Entamoeba histolytica
VIEAKKALYCFIAEDCDN

SEQ ID NO: 2698945 - protein, 21 aa, Entamoeba histolytica
VIECIKCLNKLISLPQTCGSI

SEQ ID NO: 2698946 - protein, 21 aa, Entamoeba histolytica
VIECYISMGYIKSGEIINERI

SEQ ID NO: 2698947 - protein, 25 aa, Entamoeba histolytica
VIEFIKKYVQLFSRDGLKYAVEKIK

SEQ ID NO: 2698948 - protein, 24 aa, Entamoeba histolytica
VIEIGNKCFFECYSLTSIAIPTNV

SEQ ID NO: 2698949 - protein, 21 aa, Entamoeba histolytica
VIEIGNKCFYECKSIQSITIP

SEQ ID NO: 2698950 - protein, 27 aa, Entamoeba histolytica
VIEIGYECFRWCLSLKSIEIPTNVSKI

SEQ ID NO: 2698951 - protein, 19 aa, Entamoeba histolytica
VIEKCFKFATQNERQQILE

SEQ ID NO: 2698952 - protein, 17 aa, Entamoeba histolytica
VIEKCPHSLEVRYTTIY

SEQ ID NO: 2698953 - protein, 24 aa, Entamoeba histolytica
VIEKRFTQELSLFKNRKITLLPKT

SEQ ID NO: 2698954 - protein, 23 aa, Entamoeba histolytica
VIEPLMKHLRVCQDDTNAILKVL

SEQ ID NO: 2698955 - protein, 19 aa, Entamoeba histolytica
VIESRAFMGCSHLKSISLP

SEQ ID NO: 2698956 - protein, 21 aa, Entamoeba histolytica
VIETNTFIYVTFSFVTEIIIQ

SEQ ID NO: 2698957 - protein, 20 aa, Entamoeba histolytica
VIEVDKCFSVAFQITNAFMN

SEQ ID NO: 2698958 - protein, 22 aa, Entamoeba histolytica
VIEYPDPSILGFGQRGHVDVLS

SEQ ID NO: 2698959 - protein, 18 aa, Entamoeba histolytica
VIFDEGWSTIGNQAVDRA

SEQ ID NO: 2698960 - protein, 25 aa, Entamoeba histolytica
VIGCSCFKGCLSLGSINIPSSIIKL

SEQ ID NO: 2698961 - protein, 20 aa, Entamoeba histolytica
VIGDAAFWGCCSIRRVLFPS

SEQ ID NO: 2698962 - protein, 32 aa, Entamoeba histolytica
VIGIAICTYCLPLIRKEKINNLIVDYVKTFPN

SEQ ID NO: 2698963 - protein, 22 aa, Entamoeba histolytica
VIGKNSELMWCKLIGTDPVVFG

SEQ ID NO: 2698964 - protein, 18 aa, Entamoeba histolytica
VIGSWAICKVGDKKYIMP

SEQ ID NO: 2698965 - protein, 23 aa, Entamoeba histolytica
VIHVLWLRVLYNISLPDDDNCFI

SEQ ID NO: 2698966 - protein, 17 aa, Entamoeba histolytica
VIICGSALLVLDIHCRL

SEQ ID NO: 2698967 - protein, 20 aa, Entamoeba histolytica
VIICRCGDSPIYVLTTDDEI

SEQ ID NO: 2698968 - protein, 18 aa, Entamoeba histolytica
VIIEDGWQNYIIMSEEST

SEQ ID NO: 2698969 - protein, 22 aa, Entamoeba histolytica
VIIEGWRIALKAAQEKLETMQF

SEQ ID NO: 2698970 - protein, 17 aa, Entamoeba histolytica
VIIKLVIDLNTFKSNSE

SEQ ID NO: 2698971 - protein, 18 aa, Entamoeba histolytica
VIILKYDILNPFSEQICE

SEQ ID NO: 2698972 - protein, 18 aa, Entamoeba histolytica
VIINAGRALSDLIPYIMK

SEQ ID NO: 2698973 - protein, 21 aa, Entamoeba histolytica
VIISCGGLKGIVNDTNSTEIK

SEQ ID NO: 2698974 - protein, 20 aa, Entamoeba histolytica
VIKAFGCVVGDNFGDCKVGV

SEQ ID NO: 2698975 - protein, 20 aa, Entamoeba histolytica
VIKCKRLLRNDGEIIPNIGR

SEQ ID NO: 2698976 - protein, 20 aa, Entamoeba histolytica
VIKDHCTLMMGIQIQMLLGI

SEQ ID NO: 2698977 - protein, 22 aa, Entamoeba histolytica
VIKFIHEFRSILPVTNQEYNEI

SEQ ID NO: 2698978 - protein, 21 aa, Entamoeba histolytica
VIKGELKSKVLDYNINGIVVL

SEQ ID NO: 2698979 - protein, 23 aa, Entamoeba histolytica
VIKIANIILSKGVTISESNLSTP

SEQ ID NO: 2698980 - protein, 22 aa, Entamoeba histolytica
VIKLQCLIRGHFVRRTQEVQGM

SEQ ID NO: 2698981 - protein, 33 aa, Entamoeba histolytica; identical to SEQ ID NO: 2508240

SEQ ID NO: 2698982 - protein, 19 aa, Entamoeba histolytica
VILEKSVLMEFGKRLDAVV

SEQ ID NO: 2698983 - protein, 17 aa, Entamoeba histolytica
VILGAAIEFERLAKNDI

SEQ ID NO: 2698984 - protein, 19 aa, Entamoeba histolytica
VILKEKRIAHSKTLRTFLG

SEQ ID NO: 2698985 - protein, 26 aa, Entamoeba histolytica
VILVGNVKGLFCFNRNNHSLDIVRYG

SEQ ID NO: 2698986 - protein, 17 aa, Entamoeba histolytica
VILYEMITGTVLNIQKT

SEQ ID NO: 2698987 - protein, 17 aa, Entamoeba histolytica
VIMCLNKLIDIFTLLGR

SEQ ID NO: 2698988 - protein, 18 aa, Entamoeba histolytica
VIMSNLFGMFNNHRIKTV

SEQ ID NO: 2698989 - protein, 21 aa, Entamoeba histolytica
VINCSKGFFDSLVDFLTLPSN

SEQ ID NO: 2698990 - protein, 27 aa, Entamoeba histolytica
VINEGSQCLLCIGAPGYGLVIYKPPFA

SEQ ID NO: 2698991 - protein, 21 aa, Entamoeba histolytica
VINGEFLFKSTSEIGIDLPNG

SEQ ID NO: 2698992 - protein, 28 aa, Entamoeba histolytica
VINGTSWPACPTIRCISLPKEIEKGEEI

SEQ ID NO: 2698993 - protein, 21 aa, Entamoeba histolytica
VINHIGCSFFGHYYSYVKCDD

SEQ ID NO: 2698994 - protein, 18 aa, Entamoeba histolytica
VINKRIGEKYQIITKGKE

SEQ ID NO: 2698995 - protein, 18 aa, Entamoeba histolytica
VINTYLIVCDQAVDRDVV

SEQ ID NO: 2698996 - protein, 24 aa, Entamoeba histolytica
VIPALKVCTVLFKYIRILYNDIKD

SEQ ID NO: 2698997 - protein, 18 aa, Entamoeba histolytica
VIPIKLLTREVPIKEEPL

SEQ ID NO: 2698998 - protein, 25 aa, Entamoeba histolytica
VIPKSFEFGWEWMIEKLLQENIIVP

SEQ ID NO: 2698999 - protein, 23 aa, Entamoeba histolytica
VIPRLYLMCTIGSICIAKNEIQI

SEQ ID NO: 2699000 - protein, 25 aa, Entamoeba histolytica
VIPSKACYGLFCVNNVLTISKTYLN

SEQ ID NO: 2699001 - protein, 22 aa, Entamoeba histolytica
VIPSNCETFCYLIVSYSFGFNI

SEQ ID NO: 2699002 - protein, 31 aa, Entamoeba histolytica
VIPSPEKRSKCWLATQILRVDFISVLNSYEY

SEQ ID NO: 2699003 - protein, 17 aa, Entamoeba histolytica
VIPTVYGTRGYMKEFKK

SEQ ID NO: 2699004 - protein, 17 aa, Entamoeba histolytica
VIQAKLQFDSYFYLTIK

SEQ ID NO: 2699005 - protein, 19 aa, Entamoeba histolytica
VIQCHGGMRTVEFKVVELT

SEQ ID NO: 2699006 - protein, 25 aa, Entamoeba histolytica
VIQFRKSICKFIKHRDGTAPSPDDV

SEQ ID NO: 2699007 - protein, 17 aa, Entamoeba histolytica
VIQGDWRDGKNTMIIKD

SEQ ID NO: 2699008 - protein, 33 aa, Entamoeba histolytica
VIQIPEDFIKLKLTVSIPEATAFISLTENEPIF

SEQ ID NO: 2699009 - protein, 19 aa, Entamoeba histolytica
VIQLFQYFGLNWKSINSFK

SEQ ID NO: 2699010 - protein, 17 aa, Entamoeba histolytica
VIREKPGKTTMMIVDKE

SEQ ID NO: 2699011 - protein, 24 aa, Entamoeba histolytica
VIRHLKAAGIGLIPGYGQYQAIRM

SEQ ID NO: 2699012 - protein, 25 aa, Entamoeba histolytica
VIRKNFWSYNCFTVYLTCSNLVEYL

SEQ ID NO: 2699013 - protein, 23 aa, Entamoeba histolytica
VIRLKELWLPNTTNINMIQSIVK

SEQ ID NO: 2699014 - protein, 17 aa, Entamoeba histolytica
VIRNGRVNGNLSLTRAI

SEQ ID NO: 2699015 - protein, 18 aa, Entamoeba histolytica
VIRRDVFDLPLKRKEPIL

SEQ ID NO: 2699016 - protein, 23 aa, Entamoeba histolytica
VIRTLCGCFEDISSMSIEQIKKE

SEQ ID NO: 2699017 - protein, 18 aa, Entamoeba histolytica
VIRTYQFIGALIAIEIPV

SEQ ID NO: 2699018 - protein, 20 aa, Entamoeba histolytica
VISDVPFRHEIITFIETDKY

SEQ ID NO: 2699019 - protein, 17 aa, Entamoeba histolytica
VISELFFGMLLKRTLCD

SEQ ID NO: 2699020 - protein, 28 aa, Entamoeba histolytica
VISGRIGKMSLRFPWNKLDSQPVVVEIN

SEQ ID NO: 2699021 - protein, 24 aa, Entamoeba histolytica
VISHICLFTSCAIDLPQDISNYRK

SEQ ID NO: 2699022 - protein, 17 aa, Entamoeba histolytica
VISLLPKYEEFIIPHYT

SEQ ID NO: 2699023 - protein, 17 aa, Entamoeba histolytica
VISLRGGITEEKEFRTY

SEQ ID NO: 2699024 - protein, 19 aa, Entamoeba histolytica
VITDVPFRHGIITFIETDK

SEQ ID NO: 2699025 - protein, 34 aa, Entamoeba histolytica
VITELLSLIVLNPFKYSVCLKEFPLSNYHSLEPF

SEQ ID NO: 2699026 - protein, 20 aa, Entamoeba histolytica
VITPPIYHDIFFNKRQSMYF

SEQ ID NO: 2699027 - protein, 19 aa, Entamoeba histolytica
VITSRNWMQYGLKLIDQKK

SEQ ID NO: 2699028 - protein, 24 aa, Entamoeba histolytica
VITYPEFYIQLSIDRYEGYYNYLL

SEQ ID NO: 2699029 - protein, 19 aa, Entamoeba histolytica
VIVASTMKLNGFLESMMKD

SEQ ID NO: 2699030 - protein, 18 aa, Entamoeba histolytica
VIVGDGAVGKTCMLISYT

SEQ ID NO: 2699031 - protein, 24 aa, Entamoeba histolytica
VIVPRTKGGFSYGYVDSMKQENRC

SEQ ID NO: 2699032 - protein, 17 aa, Entamoeba histolytica
VIVRNGTRTLLLSNKKE

SEQ ID NO: 2699033 - protein, 18 aa, Entamoeba histolytica
VIVSFFLSLCHHQLLKIG

SEQ ID NO: 2699034 - protein, 17 aa, Entamoeba histolytica
VIVYGEIDTPAHTASWN

SEQ ID NO: 2699035 - protein, 25 aa, Entamoeba histolytica
VIWERHPIEALKIFCANDNALTQEQ

SEQ ID NO: 2699036 - protein, 23 aa, Entamoeba histolytica
VIWPSPKLSSGVVEPYNAVLNTH

SEQ ID NO: 2699037 - protein, 18 aa, Entamoeba histolytica
VIWSVKYPTLCMTVEEGN

SEQ ID NO: 2699038 - protein, 25 aa, Entamoeba histolytica
VIYKLEGEKSILIYQVDSLKNDMSS

SEQ ID NO: 2699039 - protein, 21 aa, Entamoeba histolytica
VIYLEERWSIDMTSDIEETLE

SEQ ID NO: 2699040 - protein, 18 aa, Entamoeba histolytica
VKACSQLIEGCEKESAVA

SEQ ID NO: 2699041 - protein, 24 aa, Entamoeba histolytica
VKADQHVFLALSFAGKSNPGDKGS

SEQ ID NO: 2699042 - protein, 21 aa, Entamoeba histolytica
VKAERLEMEIGTKKSIIQDID

SEQ ID NO: 2699043 - protein, 23 aa, Entamoeba histolytica
VKAISSICKKVCCYKDKIKEWIK

SEQ ID NO: 2699044 - protein, 21 aa, Entamoeba histolytica
VKAQCPICKSYFCTNCLCEYH

SEQ ID NO: 2699045 - protein, 17 aa, Entamoeba histolytica
VKAQNGMLWQRTFFRWL

SEQ ID NO: 2699046 - protein, 18 aa, Entamoeba histolytica
VKASVKILKANVSQSVEF

SEQ ID NO: 2699047 - protein, 18 aa, Entamoeba histolytica
VKATCFIDFGFNSTECYV

SEQ ID NO: 2699048 - protein, 18 aa, Entamoeba histolytica
VKAWKPNTKMVYLESPAN

SEQ ID NO: 2699049 - protein, 22 aa, Entamoeba histolytica
VKCHICSSPLLGGCTGGLKCSW

SEQ ID NO: 2699050 - protein, 18 aa, Entamoeba histolytica
VKCIDILNRVELFCTSNE

SEQ ID NO: 2699051 - protein, 26 aa, Entamoeba histolytica
VKCKKRGQTAWAHRQMIIYNGEFILF

SEQ ID NO: 2699052 - protein, 17 aa, Entamoeba histolytica
VKCSPSIFSCALQNQGI

SEQ ID NO: 2699053 - protein, 25 aa, Entamoeba histolytica
VKDAKVCILSCPFEPPKTKTTTNMN

SEQ ID NO: 2699054 - protein, 19 aa, Entamoeba histolytica
VKDCIKKRWEALIQENHNP

SEQ ID NO: 2699055 - protein, 22 aa, Entamoeba histolytica
VKDIAIKCMTSFAPYITSALSV

SEQ ID NO: 2699056 - protein, 26 aa, Entamoeba histolytica
VKDIFTTPCLPFIGTYLTDYTFLDDG

SEQ ID NO: 2699057 - protein, 23 aa, Entamoeba histolytica
VKDKDGVLYYCYTYTVKNKDGQD

SEQ ID NO: 2699058 - protein, 29 aa, Entamoeba histolytica
VKDKREIGKSISFVWKLILEDGEYELQYF

SEQ ID NO: 2699059 - protein, 18 aa, Entamoeba histolytica
VKDLEVIEREWLLTNKSW

SEQ ID NO: 2699060 - protein, 21 aa, Entamoeba histolytica
VKDLHKLYLMLVEKANIQLQV

SEQ ID NO: 2699061 - protein, 18 aa, Entamoeba histolytica
VKDMWLKDLDAFVKKYPQ

SEQ ID NO: 2699062 - protein, 25 aa, Entamoeba histolytica
VKDNVKCGILLRDNDDILSWLGNSD

SEQ ID NO: 2699063 - protein, 20 aa, Entamoeba histolytica
VKDQMIDVVTQIEKQQIETE

SEQ ID NO: 2699064 - protein, 21 aa, Entamoeba histolytica
VKDSLELFGTLVSWIDISFST

SEQ ID NO: 2699065 - protein, 23 aa, Entamoeba histolytica
VKEFLKREMNIRIGKIKEIGMNY

SEQ ID NO: 2699066 - protein, 24 aa, Entamoeba histolytica
VKEGGKWKSWKRRFFVFEQTTLSY

SEQ ID NO: 2699067 - protein, 17 aa, Entamoeba histolytica
VKEIIYLRNFAKSEVDE

SEQ ID NO: 2699068 - protein, 21 aa, Entamoeba histolytica
VKEIKNETIIPVKEEKKDEVV

SEQ ID NO: 2699069 - protein, 20 aa, Entamoeba histolytica
VKEITKWLSNNIIKLTKLKQ

SEQ ID NO: 2699070 - protein, 18 aa, Entamoeba histolytica
VKEIVDFLYRCMTNEHLV

SEQ ID NO: 2699071 - protein, 19 aa, Entamoeba histolytica
VKEKKRDVLKFVESRKLNS

SEQ ID NO: 2699072 - protein, 22 aa, Entamoeba histolytica
VKELKEQMSEFITKKEMDKIKK

SEQ ID NO: 2699073 - protein, 29 aa, Entamoeba histolytica
VKELSGELVFECWDWDRMNSDDLLGTVKV

SEQ ID NO: 2699074 - protein, 21 aa, Entamoeba histolytica
VKEMIIRGGHNIWPAEINDTL

SEQ ID NO: 2699075 - protein, 20 aa, Entamoeba histolytica
VKEMRIAIINGIKDNINDFS

SEQ ID NO: 2699076 - protein, 30 aa, Entamoeba histolytica; identical to SEQ ID NO: 2508342

SEQ ID NO: 2699077 - protein, 22 aa, Entamoeba histolytica
VKESLKNGLSFIDEIPTLRESI

SEQ ID NO: 2699078 - protein, 21 aa, Entamoeba histolytica
VKEVCFALSFVCVVEEIQDLK

SEQ ID NO: 2699079 - protein, 18 aa, Entamoeba histolytica
VKEVERLEQEKAKIKDQF

SEQ ID NO: 2699080 - protein, 22 aa, Entamoeba histolytica
VKEVMSLKGIYIVQLITEFMYK

SEQ ID NO: 2699081 - protein, 22 aa, Entamoeba histolytica
VKEYERALELFEVIRKVDGQDN

SEQ ID NO: 2699082 - protein, 20 aa, Entamoeba histolytica
VKFIRPLIEVPVVFIQEWTK

SEQ ID NO: 2699083 - protein, 19 aa, Entamoeba histolytica
VKFMYHCIMRGGECGCILA

SEQ ID NO: 2699084 - protein, 19 aa, Entamoeba histolytica
VKFQLIRNIPPPIVPEVHG

SEQ ID NO: 2699085 - protein, 17 aa, Entamoeba histolytica
VKFSGVLQFHYKEFARQ

SEQ ID NO: 2699086 - protein, 21 aa, Entamoeba histolytica
VKFSVSLLCPHCLNHSIKKED

SEQ ID NO: 2699087 - protein, 20 aa, Entamoeba histolytica
VKGDLEAFLARENRFALLGR

SEQ ID NO: 2699088 - protein, 18 aa, Entamoeba histolytica
VKGFKEFIKRQSIIKDLN

SEQ ID NO: 2699089 - protein, 23 aa, Entamoeba histolytica
VKGGTLIRYGNKLKMLEIAQVPS

SEQ ID NO: 2699090 - protein, 23 aa, Entamoeba histolytica
VKGIECIKMKLGEPDASGRAAPV

SEQ ID NO: 2699091 - protein, 21 aa, Entamoeba histolytica
VKGIECIKMKLGESDESGRAA

SEQ ID NO: 2699092 - protein, 26 aa, Entamoeba histolytica
VKGIEEYSHLIILFKFHLNKNHAYHP

SEQ ID NO: 2699093 - protein, 18 aa, Entamoeba histolytica
VKGIPIFVSNPINDRKSK

SEQ ID NO: 2699094 - protein, 24 aa, Entamoeba histolytica
VKGKCDLNDIMLLIHLRGNKKSTY

SEQ ID NO: 2699095 - protein, 23 aa, Entamoeba histolytica
VKGKDPRFKITRKKTNKKGRNQQ

SEQ ID NO: 2699096 - protein, 18 aa, Entamoeba histolytica
VKGKIVLDVGCGTGILSM

SEQ ID NO: 2699097 - protein, 20 aa, Entamoeba histolytica
VKGLQLCFGLDKQFRSIGIF

SEQ ID NO: 2699098 - protein, 29 aa, Entamoeba histolytica
VKGMNWPKADPIGWCDPFCVFTNNGKEYK

SEQ ID NO: 2699099 - protein, 17 aa, Entamoeba histolytica
VKGNGTLHVVGNFDEVE

SEQ ID NO: 2699100 - protein, 24 aa, Entamoeba histolytica
VKGRQIRVEPCYKNYDKIKQKKAE

SEQ ID NO: 2699101 - protein, 26 aa, Entamoeba histolytica
VKGSCKVYKKYCNFLMRNNREEEIKN

SEQ ID NO: 2699102 - protein, 26 aa, Entamoeba histolytica
VKGTFKLFIKIAMKCCELGDFNIGFI

SEQ ID NO: 2699103 - protein, 17 aa, Entamoeba histolytica
VKGTLLANVREIEEPIA

SEQ ID NO: 2699104 - protein, 25 aa, Entamoeba histolytica
VKHFFYSFCPFSVVDSSIFVFLNSI

SEQ ID NO: 2699105 - protein, 18 aa, Entamoeba histolytica
VKHFNAALRDARRSVSDI

SEQ ID NO: 2699106 - protein, 17 aa, Entamoeba histolytica
VKHGVQLFKTAHVYSFA

SEQ ID NO: 2699107 - protein, 23 aa, Entamoeba histolytica
VKIATKVIQDFLLKGVVGTSVAN

SEQ ID NO: 2699108 - protein, 24 aa, Entamoeba histolytica
VKIDKCPKCGGDELVCKIKTKTMM

SEQ ID NO: 2699109 - protein, 33 aa, Entamoeba histolytica
VKIFSLIIHRFRMYFKKEIEIITKHIYFFFIKS

SEQ ID NO: 2699110 - protein, 17 aa, Entamoeba histolytica
VKIIKSIFTIGSEFLGP

SEQ ID NO: 2699111 - protein, 19 aa, Entamoeba histolytica
VKIILGVLVYTIIKDFFSE

SEQ ID NO: 2699112 - protein, 24 aa, Entamoeba histolytica
VKIKGKNVNLVWKIIFEGLMFEAR

SEQ ID NO: 2699113 - protein, 17 aa, Entamoeba histolytica
VKIKVHVGRGIVVGGFQ

SEQ ID NO: 2699114 - protein, 21 aa, Entamoeba histolytica
VKIPLKELVLFFDSIISEVRF

SEQ ID NO: 2699115 - protein, 17 aa, Entamoeba histolytica
VKIPMFFVDSCPCKGMD

SEQ ID NO: 2699116 - protein, 25 aa, Entamoeba histolytica
VKIRKESCIILLNKQEFMFGNTKEK

SEQ ID NO: 2699117 - protein, 25 aa, Entamoeba histolytica
VKISLRTSRRPELGDKFSSRHGQKG

SEQ ID NO: 2699118 - protein, 17 aa, Entamoeba histolytica
VKISRYFTKEDITALSR

SEQ ID NO: 2699119 - protein, 26 aa, Entamoeba histolytica
VKITSKRAPKRIPIKRYNSASKIDLC

SEQ ID NO: 2699120 - protein, 22 aa, Entamoeba histolytica
VKIWTPELIQLFINLGNKRVNS

SEQ ID NO: 2699121 - protein, 29 aa, Entamoeba histolytica
VKIYNSCCVYKSFYLCEILHFIKTNKDLL

SEQ ID NO: 2699122 - protein, 22 aa, Entamoeba histolytica
VKKAEIMHLVLLNGEPPSVISQ

SEQ ID NO: 2699123 - protein, 17 aa, Entamoeba histolytica
VKKECRKNIRINGEPLV

SEQ ID NO: 2699124 - protein, 22 aa, Entamoeba histolytica
VKKEIKDTYSIIDLTKEINKKD

SEQ ID NO: 2699125 - protein, 34 aa, Entamoeba histolytica
VKKELCSSLLQTAYCRKEKRCFVQVSGVNESQME

SEQ ID NO: 2699126 - protein, 27 aa, Entamoeba histolytica
VKKEPKKWWKYAFNVILEDVRKKNQPH

SEQ ID NO: 2699127 - protein, 20 aa, Entamoeba histolytica
VKKERANVLLFEYAQNKRNY

SEQ ID NO: 2699128 - protein, 17 aa, Entamoeba histolytica
VKKERKLKEVKKIDSKF

SEQ ID NO: 2699129 - protein, 26 aa, Entamoeba histolytica
VKKFVPNCVTLFPSLRTSEDEFERCR

SEQ ID NO: 2699130 - protein, 27 aa, Entamoeba histolytica
VKKIFPVSFEFVCRTTKDNDFRFELQM

SEQ ID NO: 2699131 - protein, 31 aa, Entamoeba histolytica
VKKIKMRIEEKFKECCFVKLLSDRCTSLIEQ

SEQ ID NO: 2699132 - protein, 25 aa, Entamoeba histolytica
VKKIKRYQIGKVYRRDQPYMTRGRQ

SEQ ID NO: 2699133 - protein, 23 aa, Entamoeba histolytica
VKKIVLFLRKFLRQLEGVVSNYA

SEQ ID NO: 2699134 - protein, 17 aa, Entamoeba histolytica
VKKLFKTNGIRVTDEDL

SEQ ID NO: 2699135 - protein, 24 aa, Entamoeba histolytica
VKKPECELETPSAPIIPSNNETPE

SEQ ID NO: 2699136 - protein, 24 aa, Entamoeba histolytica
VKKPKHIIEWLELFDDFTNRTYEE

SEQ ID NO: 2699137 - protein, 19 aa, Entamoeba histolytica
VKKPLNYNNLYDILGGINE

SEQ ID NO: 2699138 - protein, 21 aa, Entamoeba histolytica
VKKQRKAGIAWRKEEDQKLLR

SEQ ID NO: 2699139 - protein, 25 aa, Entamoeba histolytica
VKKRKEYRVAFRFNGQTNEVISVPS

SEQ ID NO: 2699140 - protein, 17 aa, Entamoeba histolytica
VKKRKSWTEEEDLILIE

SEQ ID NO: 2699141 - protein, 27 aa, Entamoeba histolytica
VKKSGMIIRCPFISMEVIKKVVNSFKV

SEQ ID NO: 2699142 - protein, 24 aa, Entamoeba histolytica
VKKSGWRVPNFVYRSIQCLRKHDA

SEQ ID NO: 2699143 - protein, 17 aa, Entamoeba histolytica
VKKSMWELGIPVTTIHN

SEQ ID NO: 2699144 - protein, 28 aa, Entamoeba histolytica
VKKSRWRVPNIIYRCIGFLKTHDAINVE

SEQ ID NO: 2699145 - protein, 21 aa, Entamoeba histolytica
VKKVYDVWCTIGRVESDTVKT

SEQ ID NO: 2699146 - protein, 22 aa, Entamoeba histolytica
VKLAECGLIHCDLNEFNLILSD

SEQ ID NO: 2699147 - protein, 23 aa, Entamoeba histolytica
VKLEAICYEVTYSQFLEFQKEKI

SEQ ID NO: 2699148 - protein, 23 aa, Entamoeba histolytica
VKLEIKPSNAFELIQLTNDEIIS

SEQ ID NO: 2699149 - protein, 23 aa, Entamoeba histolytica
VKLGVSISNGMFKTAIDNAVVYK

SEQ ID NO: 2699150 - protein, 17 aa, Entamoeba histolytica
VKLILGLLYTLYRKYRL

SEQ ID NO: 2699151 - protein, 17 aa, Entamoeba histolytica
VKLKETGHRVLIFSQMV

SEQ ID NO: 2699152 - protein, 22 aa, Entamoeba histolytica
VKLKIKKYCNIIELIEKTQLSL

SEQ ID NO: 2699153 - protein, 17 aa, Entamoeba histolytica
VKLLGDIVEAWKEIEIK

SEQ ID NO: 2699154 - protein, 24 aa, Entamoeba histolytica
VKLTKPVPRSKIFEVMEIIHKQSP

SEQ ID NO: 2699155 - protein, 17 aa, Entamoeba histolytica
VKMIHDYAFSQTTSEQS

SEQ ID NO: 2699156 - protein, 19 aa, Entamoeba histolytica
VKMITHLIDMYIKERRQKK

SEQ ID NO: 2699157 - protein, 26 aa, Entamoeba histolytica
VKMKALKRVVSGGAYGEYCGLIGKRQ

SEQ ID NO: 2699158 - protein, 19 aa, Entamoeba histolytica
VKMLMGFFRALMVWETSLK

SEQ ID NO: 2699159 - protein, 18 aa, Entamoeba histolytica
VKMMGGLKRRAISSEQFI

SEQ ID NO: 2699160 - protein, 18 aa, Entamoeba histolytica
VKMPFTIKNRDWVNMRSW

SEQ ID NO: 2699161 - protein, 23 aa, Entamoeba histolytica
VKMSNELYVQWTLQAANNGSSIA

SEQ ID NO: 2699162 - protein, 19 aa, Entamoeba histolytica
VKNARAWLQGVKLSKQKRV

SEQ ID NO: 2699163 - protein, 19 aa, Entamoeba histolytica
VKNAVKYVGCDDESRCIAW

SEQ ID NO: 2699164 - protein, 18 aa, Entamoeba histolytica
VKNDMIINLPTFIVEVFE

SEQ ID NO: 2699165 - protein, 22 aa, Entamoeba histolytica
VKNGGVVMNLFGTKRVNGQIMV

SEQ ID NO: 2699166 - protein, 28 aa, Entamoeba histolytica
VKNGKKVTHWIWYVFPVIQGLWGGRNND

SEQ ID NO: 2699167 - protein, 22 aa, Entamoeba histolytica
VKNHLTFFHKAFYEEKFTTLTT

SEQ ID NO: 2699168 - protein, 22 aa, Entamoeba histolytica
VKNKMFKWTLAKVSPRILFQMG

SEQ ID NO: 2699169 - protein, 19 aa, Entamoeba histolytica
VKNLFSILLREYKVIRNVE

SEQ ID NO: 2699170 - protein, 18 aa, Entamoeba histolytica
VKNQPTLVLFPVSTIAQM

SEQ ID NO: 2699171 - protein, 20 aa, Entamoeba histolytica
VKNSEIYKVITFDKKDSMTY

SEQ ID NO: 2699172 - protein, 23 aa, Entamoeba histolytica
VKNSVELISFFSVSKGFYGECGK

SEQ ID NO: 2699173 - protein, 22 aa, Entamoeba histolytica
VKNYKFGVLYAKPGQKTEDEMY

SEQ ID NO: 2699174 - protein, 27 aa, Entamoeba histolytica
VKPFPKALEILKFLKQKGLKVAIATSS

SEQ ID NO: 2699175 - protein, 24 aa, Entamoeba histolytica
VKPKRSETLVAFFKSSKDNSGAST

SEQ ID NO: 2699176 - protein, 20 aa, Entamoeba histolytica
VKPLDCFQFERVGFFCCDSD

SEQ ID NO: 2699177 - protein, 25 aa, Entamoeba histolytica
VKPQSRRISLSSGIQSLSFDDECQL

SEQ ID NO: 2699178 - protein, 24 aa, Entamoeba histolytica
VKPSSMGLKSSAAQIVAQRKKLPK

SEQ ID NO: 2699179 - protein, 23 aa, Entamoeba histolytica
VKPSSSNRYSMAFLKSPITSPQN

SEQ ID NO: 2699180 - protein, 24 aa, Entamoeba histolytica
VKPYQIKDSWGIDDFYHSLMDLTI

SEQ ID NO: 2699181 - protein, 26 aa, Entamoeba histolytica
VKPYRKEYTEGITHFKNQTAARKTGD

SEQ ID NO: 2699182 - protein, 18 aa, Entamoeba histolytica
VKQCDILLYRGAWQEWEI

SEQ ID NO: 2699183 - protein, 25 aa, Entamoeba histolytica
VKQCPEFRPQMMNSDFIVLFERASE

SEQ ID NO: 2699184 - protein, 27 aa, Entamoeba histolytica
VKQFIFRMCCEVEKRLHKSNVMGTLMT

SEQ ID NO: 2699185 - protein, 18 aa, Entamoeba histolytica
VKQLFKQNAFEVSSNAVL

SEQ ID NO: 2699186 - protein, 26 aa, Entamoeba histolytica
VKREHFDMALGEMKPAFGVDKDDQIP

SEQ ID NO: 2699187 - protein, 17 aa, Entamoeba histolytica
VKRENVHLLNLPFYQTG

SEQ ID NO: 2699188 - protein, 17 aa, Entamoeba histolytica
VKRERISTFNGLNQKEI

SEQ ID NO: 2699189 - protein, 19 aa, Entamoeba histolytica
VKRIICIDDNPSAWKKLEN

SEQ ID NO: 2699190 - protein, 17 aa, Entamoeba histolytica
VKRIICIQMLCDECLDV

SEQ ID NO: 2699191 - protein, 19 aa, Entamoeba histolytica
VKRIIRIGSAGAFDESLKL

SEQ ID NO: 2699192 - protein, 18 aa, Entamoeba histolytica
VKRIIRIGSAGAISSKLD

SEQ ID NO: 2699193 - protein, 18 aa, Entamoeba histolytica
VKRILKMNKQSIGIVGAT

SEQ ID NO: 2699194 - protein, 17 aa, Entamoeba histolytica
VKRLYEFICKQYSTIVA

SEQ ID NO: 2699195 - protein, 17 aa, Entamoeba histolytica
VKRYWKFDNTELQPFTN

SEQ ID NO: 2699196 - protein, 17 aa, Entamoeba histolytica
VKSAQFILKLLKNAVDN

SEQ ID NO: 2699197 - protein, 19 aa, Entamoeba histolytica
VKSCKICQSDRRIIEIDHC

SEQ ID NO: 2699198 - protein, 21 aa, Entamoeba histolytica
VKSDECEFILEPYHINPFQDS

SEQ ID NO: 2699199 - protein, 25 aa, Entamoeba histolytica
VKSKEELKCFDGIEYHYTAFSDNQC

SEQ ID NO: 2699200 - protein, 18 aa, Entamoeba histolytica
VKSLGFRCFYRCYDIQSI

SEQ ID NO: 2699201 - protein, 25 aa, Entamoeba histolytica
VKSPHSRIQEKACFTLQSMLDNLGE

SEQ ID NO: 2699202 - protein, 29 aa, Entamoeba histolytica
VKSQLRLVVPWKRQLGLKVDQTKMSCLNK

SEQ ID NO: 2699203 - protein, 18 aa, Entamoeba histolytica
VKSRGRWIDSPDVMNYGS

SEQ ID NO: 2699204 - protein, 21 aa, Entamoeba histolytica
VKSSHSIRDDFNFSNPQNSLR

SEQ ID NO: 2699205 - protein, 23 aa, Entamoeba histolytica
VKSSLPNVGTIVIPQPISTETIN

SEQ ID NO: 2699206 - protein, 25 aa, Entamoeba histolytica
VKSVFRELFYNYTLSPLITNAEKYI

SEQ ID NO: 2699207 - protein, 21 aa, Entamoeba histolytica
VKSYDCFDRESIICCLPLEKN

SEQ ID NO: 2699208 - protein, 22 aa, Entamoeba histolytica
VKSYLCDLMTAFPNEEAKEERI

SEQ ID NO: 2699209 - protein, 22 aa, Entamoeba histolytica
VKTAELMTGATLESRRINIEST

SEQ ID NO: 2699210 - protein, 22 aa, Entamoeba histolytica
VKTFQIVSSLGYPEADTALYEC

SEQ ID NO: 2699211 - protein, 18 aa, Entamoeba histolytica
VKTIKRRWFVLTTNKLFY

SEQ ID NO: 2699212 - protein, 25 aa, Entamoeba histolytica
VKTKFEISNGLYLPVTINKPKTVNL

SEQ ID NO: 2699213 - protein, 24 aa, Entamoeba histolytica
VKTLCQSCIFWFRLKASVTNALGI

SEQ ID NO: 2699214 - protein, 22 aa, Entamoeba histolytica
VKTLRYGKSLLRPAGLSSASKI

SEQ ID NO: 2699215 - protein, 18 aa, Entamoeba histolytica
VKTNLFGWNIIIKHYCNQ

SEQ ID NO: 2699216 - protein, 26 aa, Entamoeba histolytica
VKTPMCVKMDCQLMLLRHWTLYDSLF

SEQ ID NO: 2699217 - protein, 20 aa, Entamoeba histolytica
VKTTEGFIFGSYHQNTLKIT

SEQ ID NO: 2699218 - protein, 18 aa, Entamoeba histolytica
VKVIKRGAPPVGDGEVVI

SEQ ID NO: 2699219 - protein, 19 aa, Entamoeba histolytica
VKVLKRLVSSLPDTNKYTL

SEQ ID NO: 2699220 - protein, 22 aa, Entamoeba histolytica
VKVSCLYPEFTGVKIKTFPVSI

SEQ ID NO: 2699221 - protein, 18 aa, Entamoeba histolytica
VKVTEPFNPVASNTPYSP

SEQ ID NO: 2699222 - protein, 21 aa, Entamoeba histolytica
VKVVIRIKVERIEYGTTIAIS

SEQ ID NO: 2699223 - protein, 17 aa, Entamoeba histolytica
VKWKIRGGNQYMRTLWG

SEQ ID NO: 2699224 - protein, 26 aa, Entamoeba histolytica
VKWKNGTVCQYRWGGENAYDLQVVPK

SEQ ID NO: 2699225 - protein, 27 aa, Entamoeba histolytica
VKWNMKDMNLFYGICFSKDPSILSIRS

SEQ ID NO: 2699226 - protein, 21 aa, Entamoeba histolytica
VKYAKSLLCNPTLATTGMSMA

SEQ ID NO: 2699227 - protein, 23 aa, Entamoeba histolytica
VKYCLALNHLFDFSKGGEITKDH

SEQ ID NO: 2699228 - protein, 23 aa, Entamoeba histolytica
VKYCQPQKLIIRRKEEKGYQYSL

SEQ ID NO: 2699229 - protein, 19 aa, Entamoeba histolytica
VKYGEVLKIYSTFNKTLKP

SEQ ID NO: 2699230 - protein, 30 aa, Entamoeba histolytica; identical to SEQ ID NO: 2508502

SEQ ID NO: 2699231 - protein, 17 aa, Entamoeba histolytica
VKYKAKVPGIYDVQVLL

SEQ ID NO: 2699232 - protein, 17 aa, Entamoeba histolytica
VKYPRRVTLLRGNHETR

SEQ ID NO: 2699233 - protein, 22 aa, Entamoeba histolytica
VKYSELQPLGIVFNKEQDADEF

SEQ ID NO: 2699234 - protein, 17 aa, Entamoeba histolytica
VKYSKAIVTARPCIHLL

SEQ ID NO: 2699235 - protein, 18 aa, Entamoeba histolytica
VKYYCQMCQKQCRDANGF

SEQ ID NO: 2699236 - protein, 17 aa, Entamoeba histolytica
VLADFLVSSGLKLQSIV

SEQ ID NO: 2699237 - protein, 19 aa, Entamoeba histolytica
VLAILCYKIPCYYICDKRF

SEQ ID NO: 2699238 - protein, 17 aa, Entamoeba histolytica
VLCPHCLTKLVSVDNCY

SEQ ID NO: 2699239 - protein, 18 aa, Entamoeba histolytica
VLCTKGIDNWRVFDCIYC

SEQ ID NO: 2699240 - protein, 29 aa, Entamoeba histolytica
VLDEAYCIECIPSDFWQRLGDLNDTIKSF

SEQ ID NO: 2699241 - protein, 17 aa, Entamoeba histolytica
VLDIKFSPTNDVVAVGD

SEQ ID NO: 2699242 - protein, 17 aa, Entamoeba histolytica
VLDILEKYLSYKKYTYE

SEQ ID NO: 2699243 - protein, 30 aa, Entamoeba histolytica
VLDLKEAIKFFGSICQYKIPKGARALKKTL

SEQ ID NO: 2699244 - protein, 25 aa, Entamoeba histolytica
VLDMVCTKCGLLESNFIRSLSKTNE

SEQ ID NO: 2699245 - protein, 17 aa, Entamoeba histolytica
VLECFIEGASILYDIRE

SEQ ID NO: 2699246 - protein, 21 aa, Entamoeba histolytica
VLEDMAIHLLKLLKEKYSSQI

SEQ ID NO: 2699247 - protein, 27 aa, Entamoeba histolytica
VLEECYIFASSLLKFTINYNTGANVWE

SEQ ID NO: 2699248 - protein, 21 aa, Entamoeba histolytica
VLEEPKPIIIQPIEQSKPIEQ

SEQ ID NO: 2699249 - protein, 24 aa, Entamoeba histolytica
VLEIINKRCKALMEIDIYNGVVHE

SEQ ID NO: 2699250 - protein, 32 aa, Entamoeba histolytica
VLEKEEFVNCFPLRVKALQLINSVMGKNSMVR

SEQ ID NO: 2699251 - protein, 25 aa, Entamoeba histolytica
VLEKVCNSKPSAFVIQHFGGDGFGI

SEQ ID NO: 2699252 - protein, 19 aa, Entamoeba histolytica
VLELLLWMFEKELTENPPE

SEQ ID NO: 2699253 - protein, 19 aa, Entamoeba histolytica
VLENSFRFIEKVTRETKAV

SEQ ID NO: 2699254 - protein, 19 aa, Entamoeba histolytica
VLEPNFRHGPAIDIQLKPI

SEQ ID NO: 2699255 - protein, 23 aa, Entamoeba histolytica
VLERYKKIIGIVWKKYGVTKGFE

SEQ ID NO: 2699256 - protein, 17 aa, Entamoeba histolytica
VLESGAYFNVDIHDNGI

SEQ ID NO: 2699257 - protein, 18 aa, Entamoeba histolytica
VLESMKCPTICYFYGACH

SEQ ID NO: 2699258 - protein, 17 aa, Entamoeba histolytica
VLFCKVPKTPSIEKSVK

SEQ ID NO: 2699259 - protein, 17 aa, Entamoeba histolytica
VLFFETSAKAKINITET

SEQ ID NO: 2699260 - protein, 25 aa, Entamoeba histolytica
VLFGRLCTCLALIKAQRVNETETVE

SEQ ID NO: 2699261 - protein, 25 aa, Entamoeba histolytica
VLFILDEFLQWGFVEKISVSNVRTN

SEQ ID NO: 2699262 - protein, 18 aa, Entamoeba histolytica
VLFKYIRILYNDIKDLPE

SEQ ID NO: 2699263 - protein, 26 aa, Entamoeba histolytica
VLFLPLSCPKHIIKEIIKDYFFSQEW

SEQ ID NO: 2699264 - protein, 19 aa, Entamoeba histolytica
VLFPNCDQSFIINNQYLPI

SEQ ID NO: 2699265 - protein, 23 aa, Entamoeba histolytica
VLFYFPNLYEIMKFESVSKSCQI

SEQ ID NO: 2699266 - protein, 22 aa, Entamoeba histolytica
VLGCPNFEGGLIVAAQKGCGAK

SEQ ID NO: 2699267 - protein, 17 aa, Entamoeba histolytica
VLGWLRIIFYPRNYHRT

SEQ ID NO: 2699268 - protein, 23 aa, Entamoeba histolytica
VLHFPLERIHDLMFMTINLPTTN

SEQ ID NO: 2699269 - protein, 29 aa, Entamoeba histolytica
VLHGGCWHEEFLRMSCVILGEYPQLLGAL

SEQ ID NO: 2699270 - protein, 17 aa, Entamoeba histolytica
VLHSSLGPMTCKKKSNY

SEQ ID NO: 2699271 - protein, 26 aa, Entamoeba histolytica
VLIEEMKIISSPRFKVSEIPNTLRNL

SEQ ID NO: 2699272 - protein, 22 aa, Entamoeba histolytica
VLIEHQTCLISTVAMKMIQEST

SEQ ID NO: 2699273 - protein, 21 aa, Entamoeba histolytica
VLIGPNCNLIGISHTTCEKIR

SEQ ID NO: 2699274 - protein, 27 aa, Entamoeba histolytica
VLIKMVNRFKRIFVRDSNPHLPVHSSL

SEQ ID NO: 2699275 - protein, 30 aa, Entamoeba histolytica
VLINGCIRLQKFPFLSRFYHNLKFRSIPTT

SEQ ID NO: 2699276 - protein, 19 aa, Entamoeba histolytica
VLINIIFNRYIGSTIATSK

SEQ ID NO: 2699277 - protein, 19 aa, Entamoeba histolytica
VLIQCVRFAAEYEKTKLNG

SEQ ID NO: 2699278 - protein, 17 aa, Entamoeba histolytica
VLIRINDLLSFDGNEGV

SEQ ID NO: 2699279 - protein, 25 aa, Entamoeba histolytica
VLISKDFLGLRVLKGINLITPTTME

SEQ ID NO: 2699280 - protein, 18 aa, Entamoeba histolytica
VLITKSVFYFDSCCWGWR

SEQ ID NO: 2699281 - protein, 23 aa, Entamoeba histolytica
VLKDGRFSQTYGIVLKHHSIEEG

SEQ ID NO: 2699282 - protein, 25 aa, Entamoeba histolytica
VLKEMLPCFKYLYGHFEGLLEVCHS

SEQ ID NO: 2699283 - protein, 27 aa, Entamoeba histolytica
VLKFYNIAVEWLRQSLFSERILPDSEK

SEQ ID NO: 2699284 - protein, 18 aa, Entamoeba histolytica
VLKGHTKAVISAEFSPIE

SEQ ID NO: 2699285 - protein, 19 aa, Entamoeba histolytica
VLKHIKPIVEFGGIEPNPS

SEQ ID NO: 2699286 - protein, 22 aa, Entamoeba histolytica
VLKKERCKNCGSSEHTTKDCLE

SEQ ID NO: 2699287 - protein, 20 aa, Entamoeba histolytica
VLKLCKTEYLTYRTFLQQQL

SEQ ID NO: 2699288 - protein, 17 aa, Entamoeba histolytica
VLKNMKFDEALLEGFQS

SEQ ID NO: 2699289 - protein, 17 aa, Entamoeba histolytica
VLKRKWGSYGSIHNNQY

SEQ ID NO: 2699290 - protein, 17 aa, Entamoeba histolytica
VLKRKWGSYGSITNEYF

SEQ ID NO: 2699291 - protein, 17 aa, Entamoeba histolytica
VLKRKWGSYRSIHNNQY

SEQ ID NO: 2699292 - protein, 18 aa, Entamoeba histolytica
VLLDPSVGGNEKFHDTMA

SEQ ID NO: 2699293 - protein, 24 aa, Entamoeba histolytica
VLLESFKAVILMLHKENIDDPFVK

SEQ ID NO: 2699294 - protein, 22 aa, Entamoeba histolytica
VLLFEECIKLVLTLSTLHPSHL

SEQ ID NO: 2699295 - protein, 25 aa, Entamoeba histolytica
VLLFVMVCGYPPFSRTNNQYIESIL

SEQ ID NO: 2699296 - protein, 21 aa, Entamoeba histolytica
VLLKPIHLMSIYHYVALTNNN

SEQ ID NO: 2699297 - protein, 17 aa, Entamoeba histolytica
VLLKVFNGIVLNQLQDT

SEQ ID NO: 2699298 - protein, 21 aa, Entamoeba histolytica
VLLKYRGNLLVDEKELKCGKI

SEQ ID NO: 2699299 - protein, 18 aa, Entamoeba histolytica
VLLPQLSQYLSFDECKLF

SEQ ID NO: 2699300 - protein, 20 aa, Entamoeba histolytica
VLLSYFFYRGKIVDLLFKLA

SEQ ID NO: 2699301 - protein, 23 aa, Entamoeba histolytica
VLMEMPKQIPVMLKQTFNQYILK

SEQ ID NO: 2699302 - protein, 25 aa, Entamoeba histolytica
VLNAKRILSLMAMLVTLMRELNGIY

SEQ ID NO: 2699303 - protein, 35 aa, Entamoeba histolytica
VLNELPIELILKVFFYCFSHHPSIYALQVINEKLF

SEQ ID NO: 2699304 - protein, 24 aa, Entamoeba histolytica
VLNGFPGQVVDTWLGLSKKGEIHI

SEQ ID NO: 2699305 - protein, 19 aa, Entamoeba histolytica
VLNHYRLSQQLTLDQQHFL

SEQ ID NO: 2699306 - protein, 23 aa, Entamoeba histolytica
VLNKCFIEHLPLSISKLTNLERL

SEQ ID NO: 2699307 - protein, 19 aa, Entamoeba histolytica
VLNKWPVIATYFINETSVI

SEQ ID NO: 2699308 - protein, 20 aa, Entamoeba histolytica
VLPCTHVICRDCIMSLIQSQ

SEQ ID NO: 2699309 - protein, 21 aa, Entamoeba histolytica
VLPDSMLLFGEFEKRINNYNK

SEQ ID NO: 2699310 - protein, 25 aa, Entamoeba histolytica
VLPFGEDRIKGINGLREMKEIDILE

SEQ ID NO: 2699311 - protein, 24 aa, Entamoeba histolytica
VLPHNLCSITQKFDKFVIKQLQKT

SEQ ID NO: 2699312 - protein, 24 aa, Entamoeba histolytica
VLPKKDKLVGLYVHSTNKNELCYF

SEQ ID NO: 2699313 - protein, 18 aa, Entamoeba histolytica
VLPLTRFDDEIIFIMFTL

SEQ ID NO: 2699314 - protein, 17 aa, Entamoeba histolytica
VLPPHLCIGTIYDLFVK

SEQ ID NO: 2699315 - protein, 19 aa, Entamoeba histolytica
VLPTIKLLLQNGTPIIKSA

SEQ ID NO: 2699316 - protein, 19 aa, Entamoeba histolytica
VLQEYKFIENVICFPNEIF

SEQ ID NO: 2699317 - protein, 24 aa, Entamoeba histolytica
VLQHGACLGVGLAGIATENYELYQ

SEQ ID NO: 2699318 - protein, 18 aa, Entamoeba histolytica
VLQIYYKNVFIFNHETII

SEQ ID NO: 2699319 - protein, 20 aa, Entamoeba histolytica
VLQLVNWIPLLSTINLTQFI

SEQ ID NO: 2699320 - protein, 32 aa, Entamoeba histolytica
VLRDLPCLTSLDCSKCHFDISDIISRPPINLQ

SEQ ID NO: 2699321 - protein, 18 aa, Entamoeba histolytica
VLRDMCWSIFFVIIHVQC

SEQ ID NO: 2699322 - protein, 17 aa, Entamoeba histolytica
VLRRVLRMFLYIHPKGY

SEQ ID NO: 2699323 - protein, 18 aa, Entamoeba histolytica
VLRTLYNILVKRIGNRKI

SEQ ID NO: 2699324 - protein, 20 aa, Entamoeba histolytica
VLRYSEPIVRSHSPRSSQSP

SEQ ID NO: 2699325 - protein, 28 aa, Entamoeba histolytica
VLSAFRPEDISAMLLRRFKEIASDAMGR

SEQ ID NO: 2699326 - protein, 26 aa, Entamoeba histolytica
VLSECFSCCYIAGEIKCSSEIMRKLM

SEQ ID NO: 2699327 - protein, 23 aa, Entamoeba histolytica
VLSEYKSEMVLSILQSIVKIEST

SEQ ID NO: 2699328 - protein, 25 aa, Entamoeba histolytica
VLSILAANCGLEFQKAALCIFAEMT

SEQ ID NO: 2699329 - protein, 25 aa, Entamoeba histolytica
VLSKALRFPMGLQFEELQSYMKATD

SEQ ID NO: 2699330 - protein, 24 aa, Entamoeba histolytica
VLSKSPGGALVFFSSYNMLNRIVE

SEQ ID NO: 2699331 - protein, 18 aa, Entamoeba histolytica
VLSLWKKKYETLQLQWNS

SEQ ID NO: 2699332 - protein, 18 aa, Entamoeba histolytica
VLSNKLLFSLPVPYEQHG

SEQ ID NO: 2699333 - protein, 17 aa, Entamoeba histolytica
VLSQIYQFIVFQRSNGL

SEQ ID NO: 2699334 - protein, 17 aa, Entamoeba histolytica
VLSRILALIPPWVRVHR

SEQ ID NO: 2699335 - protein, 22 aa, Entamoeba histolytica
VLSSAKVKGMFGVSDTELSSFT

SEQ ID NO: 2699336 - protein, 35 aa, Entamoeba histolytica
VLTDFFRFNFSFRLIEILTLVALCRDEQKKSVLLI

SEQ ID NO: 2699337 - protein, 17 aa, Entamoeba histolytica
VLTFVMSLIPFFFQKYI

SEQ ID NO: 2699338 - protein, 23 aa, Entamoeba histolytica
VLTLNCSYFRTFKTHQIMEQVKY

SEQ ID NO: 2699339 - protein, 17 aa, Entamoeba histolytica
VLTLVITFTSIRRISSL

SEQ ID NO: 2699340 - protein, 17 aa, Entamoeba histolytica
VLTRAKDSIAIERDVLF

SEQ ID NO: 2699341 - protein, 25 aa, Entamoeba histolytica
VLVIGRFLICANVGDSEVLVISEGK

SEQ ID NO: 2699342 - protein, 23 aa, Entamoeba histolytica
VLVKRSDDGLSIVSILDTSQIYS

SEQ ID NO: 2699343 - protein, 24 aa, Entamoeba histolytica
VLVNEIRGALRLPSLPEKMSALEE

SEQ ID NO: 2699344 - protein, 27 aa, Entamoeba histolytica
VLVQFKIDISQVFKFKNQIGGFETKEK

SEQ ID NO: 2699345 - protein, 17 aa, Entamoeba histolytica
VLVSLPISVVTLIDKIN

SEQ ID NO: 2699346 - protein, 22 aa, Entamoeba histolytica
VLWSDGSLSWYSSDLKQEKNYQ

SEQ ID NO: 2699347 - protein, 25 aa, Entamoeba histolytica
VLYGKGAGCGPTLFQAFETRKENEV

SEQ ID NO: 2699348 - protein, 26 aa, Entamoeba histolytica
VLYGKGAGCGPTLYLAHKIQKSIKPE

SEQ ID NO: 2699349 - protein, 20 aa, Entamoeba histolytica
VLYPKIIKIDAAFISPSSTG

SEQ ID NO: 2699350 - protein, 20 aa, Entamoeba histolytica
VMAREVIKYLYKVDMSEMKI

SEQ ID NO: 2699351 - protein, 25 aa, Entamoeba histolytica
VMDKTSFEHIVDWELEIKQVAPEAT

SEQ ID NO: 2699352 - protein, 24 aa, Entamoeba histolytica
VMDLNNWVACGAFVLQSRAIYQDL

SEQ ID NO: 2699353 - protein, 25 aa, Entamoeba histolytica
VMDTSYRVVYLFKENEYLQTNEIFQ

SEQ ID NO: 2699354 - protein, 25 aa, Entamoeba histolytica
VMEFCPGGDLACLIREVGRLSEVTV

SEQ ID NO: 2699355 - protein, 19 aa, Entamoeba histolytica
VMEFLTGIMNMRYGDFQKF

SEQ ID NO: 2699356 - protein, 18 aa, Entamoeba histolytica
VMEKCEFKQRNDINENLY

SEQ ID NO: 2699357 - protein, 19 aa, Entamoeba histolytica
VMFILELFNELSIDSFNSF

SEQ ID NO: 2699358 - protein, 18 aa, Entamoeba histolytica
VMFKETLLSYYTLSKVLY

SEQ ID NO: 2699359 - protein, 28 aa, Entamoeba histolytica
VMFTRKQSLCLISCMLFGLYSLKLRKDS

SEQ ID NO: 2699360 - protein, 19 aa, Entamoeba histolytica
VMGGKGSTQFGIFEDLCLR

SEQ ID NO: 2699361 - protein, 23 aa, Entamoeba histolytica
VMIAACDTFRAGAVDQLAVHAQK

SEQ ID NO: 2699362 - protein, 17 aa, Entamoeba histolytica
VMILLDILQKEKNYKEM

SEQ ID NO: 2699363 - protein, 25 aa, Entamoeba histolytica
VMIYCSDERCSFIGIHNPQVNSNNR

SEQ ID NO: 2699364 - protein, 20 aa, Entamoeba histolytica
VMKALCIFIANTIFTETEYA

SEQ ID NO: 2699365 - protein, 29 aa, Entamoeba histolytica
VMKEHMKPMYFKLADFLIHVIKKTVENEN

SEQ ID NO: 2699366 - protein, 24 aa, Entamoeba histolytica
VMKPLKMYLEAVTVLEKRVKILDE

SEQ ID NO: 2699367 - protein, 27 aa, Entamoeba histolytica
VMLPNIMKRIAYCFNDEKGIEERIQIG

SEQ ID NO: 2699368 - protein, 25 aa, Entamoeba histolytica
VMLTNCRICGCSKAGLHCGGKEIRC

SEQ ID NO: 2699369 - protein, 28 aa, Entamoeba histolytica
VMMSECFDHRFCLHLGEGQWHNEKLREF

SEQ ID NO: 2699370 - protein, 19 aa, Entamoeba histolytica
VMMSLELMDCLPFKEVLFH

SEQ ID NO: 2699371 - protein, 20 aa, Entamoeba histolytica
VMMSLELMDCLPFKEVLFHS

SEQ ID NO: 2699372 - protein, 23 aa, Entamoeba histolytica
VMNEWRILARVSHCYCDGMTAMR

SEQ ID NO: 2699373 - protein, 18 aa, Entamoeba histolytica
VMNFYSFLDYEEEILFSF

SEQ ID NO: 2699374 - protein, 18 aa, Entamoeba histolytica
VMNILKYLIQQFESNTPI

SEQ ID NO: 2699375 - protein, 26 aa, Entamoeba histolytica
VMNNIRLKSVLKRMIITRLYPYLWQP

SEQ ID NO: 2699376 - protein, 18 aa, Entamoeba histolytica
VMNNLRLYIAALKTLGEN

SEQ ID NO: 2699377 - protein, 18 aa, Entamoeba histolytica
VMRSLKIIFEKFSDEETK

SEQ ID NO: 2699378 - protein, 36 aa, Entamoeba histolytica
VMSCEGGWWYGRSGCSMGYFPGEYVEVSGPINKEAK

SEQ ID NO: 2699379 - protein, 19 aa, Entamoeba histolytica
VMSQPFVLDREHLLSDKAS

SEQ ID NO: 2699380 - protein, 20 aa, Entamoeba histolytica
VMVKERWIGKEIKEIMKEEF

SEQ ID NO: 2699381 - protein, 31 aa, Entamoeba histolytica
VMVLTWGNLKGEFRAVPGYDVSTPKTFNAPT

SEQ ID NO: 2699382 - protein, 24 aa, Entamoeba histolytica
VMVPECQNLLSGCIKLSNQIAPFC

SEQ ID NO: 2699383 - protein, 22 aa, Entamoeba histolytica
VMYNEGRICFVSQNGIEFFSVY

SEQ ID NO: 2699384 - protein, 20 aa, Entamoeba histolytica
VMYNLVEWREYRNFQYSRFP

SEQ ID NO: 2699385 - protein, 21 aa, Entamoeba histolytica
VMYPTRIALMRGNHESRQVTQ

SEQ ID NO: 2699386 - protein, 18 aa, Entamoeba histolytica
VMYQMFQLKGGSVAEENK

SEQ ID NO: 2699387 - protein, 23 aa, Entamoeba histolytica
VNAFGSKTTFGFRESDDTETTPK

SEQ ID NO: 2699388 - protein, 17 aa, Entamoeba histolytica
VNAHLDGGVIINEPCGG

SEQ ID NO: 2699389 - protein, 23 aa, Entamoeba histolytica
VNAIKEERDELVKQIKKIEEEKR

SEQ ID NO: 2699390 - protein, 18 aa, Entamoeba histolytica
VNAILKDQERLFRRSQQL

SEQ ID NO: 2699391 - protein, 18 aa, Entamoeba histolytica
VNAKGRWIGRTIVDVFVH

SEQ ID NO: 2699392 - protein, 19 aa, Entamoeba histolytica
VNALPSLLIENSKEEMWET

SEQ ID NO: 2699393 - protein, 18 aa, Entamoeba histolytica
VNARVSILGEAYVTTSLI

SEQ ID NO: 2699394 - protein, 25 aa, Entamoeba histolytica
VNASLESCGDCFGRVTMNKKAFVQV

SEQ ID NO: 2699395 - protein, 19 aa, Entamoeba histolytica
VNATQRLSLNKIINRLYDS

SEQ ID NO: 2699396 - protein, 20 aa, Entamoeba histolytica
VNAVFLHFQSVLSINKELLK

SEQ ID NO: 2699397 - protein, 19 aa, Entamoeba histolytica
VNCFDFFNNILLIYSAVSD

SEQ ID NO: 2699398 - protein, 24 aa, Entamoeba histolytica
VNCKEELLCPLGYIEKNDLLDIMM

SEQ ID NO: 2699399 - protein, 31 aa, Entamoeba histolytica
VNCNSPLTSICKFCKFCESQFLVGSLNGGVY

SEQ ID NO: 2699400 - protein, 20 aa, Entamoeba histolytica
VNDFIEKILHQFKDTEICLT

SEQ ID NO: 2699401 - protein, 19 aa, Entamoeba histolytica
VNDIMKFKGLISDLSDDQK

SEQ ID NO: 2699402 - protein, 18 aa, Entamoeba histolytica
VNDLKLIQEYSMKDETFA

SEQ ID NO: 2699403 - protein, 17 aa, Entamoeba histolytica
VNDRETFNWGEKTVEVR

SEQ ID NO: 2699404 - protein, 27 aa, Entamoeba histolytica
VNDRVSLPTVWKYFFLFSDILVVTEVI

SEQ ID NO: 2699405 - protein, 18 aa, Entamoeba histolytica
VNDSRYVIWGGMVQTLLR

SEQ ID NO: 2699406 - protein, 18 aa, Entamoeba histolytica
VNDVCWSKSNPEWIGAAM

SEQ ID NO: 2699407 - protein, 17 aa, Entamoeba histolytica
VNDYKRLNVALKRAKSG

SEQ ID NO: 2699408 - protein, 19 aa, Entamoeba histolytica
VNDYKRLNVALTRAKSGLI

SEQ ID NO: 2699409 - protein, 21 aa, Entamoeba histolytica
VNEATKLPAMQKVMNDFEKQN

SEQ ID NO: 2699410 - protein, 25 aa, Entamoeba histolytica
VNEICFWVASLILSFPDLNNRAKMM

SEQ ID NO: 2699411 - protein, 19 aa, Entamoeba histolytica
VNEKMKIRIERFIEQQSIS

SEQ ID NO: 2699412 - protein, 19 aa, Entamoeba histolytica
VNENLEFLSLYIAGKITKK

SEQ ID NO: 2699413 - protein, 18 aa, Entamoeba histolytica
VNEVIKRYVEAITQNLVP

SEQ ID NO: 2699414 - protein, 17 aa, Entamoeba histolytica
VNFIFSRTKGQSFFVAT

SEQ ID NO: 2699415 - protein, 20 aa, Entamoeba histolytica
VNFRGFRMLLTICYDTRFPM

SEQ ID NO: 2699416 - protein, 18 aa, Entamoeba histolytica
VNGATFKKQPFVGLENLG

SEQ ID NO: 2699417 - protein, 17 aa, Entamoeba histolytica
VNGCECFSCKSNQSRAY

SEQ ID NO: 2699418 - protein, 26 aa, Entamoeba histolytica
VNGCICPSKFVIRCYSSKCVEKEINE

SEQ ID NO: 2699419 - protein, 23 aa, Entamoeba histolytica
VNGEFLCCVCGAMNPTFITYKNF

SEQ ID NO: 2699420 - protein, 23 aa, Entamoeba histolytica
VNGEIICKIFLELIDAIVILHKN

SEQ ID NO: 2699421 - protein, 19 aa, Entamoeba histolytica
VNGGIGAICDTFLKQPNIQ

SEQ ID NO: 2699422 - protein, 19 aa, Entamoeba histolytica
VNGIKVKLQIWDTAGQERF

SEQ ID NO: 2699423 - protein, 19 aa, Entamoeba histolytica
VNGKLTKKVNGMERKIEKM

SEQ ID NO: 2699424 - protein, 20 aa, Entamoeba histolytica
VNGLLKRYFYLMKEPSYIDW

SEQ ID NO: 2699425 - protein, 22 aa, Entamoeba histolytica
VNGRCPLCKQLIPTHDLKQIKN

SEQ ID NO: 2699426 - protein, 24 aa, Entamoeba histolytica
VNGRDIIKIGVPIIQLSSIDIETI

SEQ ID NO: 2699427 - protein, 27 aa, Entamoeba histolytica
VNGRQVFTFDRCRSNCSSSRNHHKDQL

SEQ ID NO: 2699428 - protein, 28 aa, Entamoeba histolytica
VNGVIALLRFCGKYSKLSHKPLIDDSHC

SEQ ID NO: 2699429 - protein, 20 aa, Entamoeba histolytica
VNGYNALHICCECNCFNVAK

SEQ ID NO: 2699430 - protein, 19 aa, Entamoeba histolytica
VNHKCDLFDLFLKNPKFDN

SEQ ID NO: 2699431 - protein, 23 aa, Entamoeba histolytica
VNHPNFLALKGIVLTPLALLVDY

SEQ ID NO: 2699432 - protein, 17 aa, Entamoeba histolytica
VNIAWKTFYDLMKPQVS

SEQ ID NO: 2699433 - protein, 20 aa, Entamoeba histolytica
VNICKKRSVIAADFLAIMAQ

SEQ ID NO: 2699434 - protein, 18 aa, Entamoeba histolytica
VNIFNSSLNFLRMNVQSF

SEQ ID NO: 2699435 - protein, 25 aa, Entamoeba histolytica
VNIFSCLDGELLVTFSGHRTGVRIL

SEQ ID NO: 2699436 - protein, 26 aa, Entamoeba histolytica
VNIGYKNGDKWISVPWKLTELKKNIE

SEQ ID NO: 2699437 - protein, 31 aa, Entamoeba histolytica
VNIIRRSLLLLSRYPLPLFKDLEPEVEEMRE

SEQ ID NO: 2699438 - protein, 22 aa, Entamoeba histolytica
VNIKSKWELIAFSQNAIISGNG

SEQ ID NO: 2699439 - protein, 25 aa, Entamoeba histolytica
VNINICVIPPLPLLKPLPFPPSITV

SEQ ID NO: 2699440 - protein, 20 aa, Entamoeba histolytica
VNIPRLCVNASPTKPLSPRK

SEQ ID NO: 2699441 - protein, 27 aa, Entamoeba histolytica
VNKASECYDLLYGQEMVETVRQCYELM

SEQ ID NO: 2699442 - protein, 21 aa, Entamoeba histolytica
VNKELFSRCFISVEKVLQVTQ

SEQ ID NO: 2699443 - protein, 24 aa, Entamoeba histolytica
VNKEYKVVGWYAGMANGEPLASDI

SEQ ID NO: 2699444 - protein, 27 aa, Entamoeba histolytica
VNKGYCLKTTVCFSSCNCMMMGGMGNL

SEQ ID NO: 2699445 - protein, 34 aa, Entamoeba histolytica
VNKHFCAEEPTFACPFCGLDMGSSSKLQKHVSHA

SEQ ID NO: 2699446 - protein, 17 aa, Entamoeba histolytica
VNKILSYCRCDKEDLKD

SEQ ID NO: 2699447 - protein, 26 aa, Entamoeba histolytica
VNKKCKSAVESLRYNPGFCGCDEITS

SEQ ID NO: 2699448 - protein, 20 aa, Entamoeba histolytica
VNKPLPSDRVHQMCEDSLLV

SEQ ID NO: 2699449 - protein, 17 aa, Entamoeba histolytica
VNKPLSIRFRPTKEQEI

SEQ ID NO: 2699450 - protein, 22 aa, Entamoeba histolytica
VNKRIATILKIFSTQNILCSNT

SEQ ID NO: 2699451 - protein, 21 aa, Entamoeba histolytica
VNKRTKRKYTRRIKKENEYDK

SEQ ID NO: 2699452 - protein, 28 aa, Entamoeba histolytica
VNKVKPFLRQCGFSDIYSIPISGFSGLN

SEQ ID NO: 2699453 - protein, 22 aa, Entamoeba histolytica
VNKYCLFGGAGLFSDVQTMAEK

SEQ ID NO: 2699454 - protein, 19 aa, Entamoeba histolytica
VNLAIGLLYGHLGVKSEDS

SEQ ID NO: 2699455 - protein, 21 aa, Entamoeba histolytica
VNLDISIIIERGYCDVYPDGI

SEQ ID NO: 2699456 - protein, 18 aa, Entamoeba histolytica
VNLFIPHITSIFIETYNS

SEQ ID NO: 2699457 - protein, 17 aa, Entamoeba histolytica
VNLFQRSSLDMAKEFSS

SEQ ID NO: 2699458 - protein, 21 aa, Entamoeba histolytica
VNLKISGFVPIEGRTEMVDIL

SEQ ID NO: 2699459 - protein, 19 aa, Entamoeba histolytica
VNLLEINSSSFFNVFIQEL

SEQ ID NO: 2699460 - protein, 18 aa, Entamoeba histolytica
VNLLSIFPKEEESFVIRM

SEQ ID NO: 2699461 - protein, 23 aa, Entamoeba histolytica
VNLSRYIIMKAFEKFDQNKTTLK

SEQ ID NO: 2699462 - protein, 21 aa, Entamoeba histolytica
VNLTFSHQIFKIFYDEFQQLY

SEQ ID NO: 2699463 - protein, 17 aa, Entamoeba histolytica
VNMPMGIFMARLDFIIA

SEQ ID NO: 2699464 - protein, 23 aa, Entamoeba histolytica
VNNFKIFNCIDVTDLLKEGKNII

SEQ ID NO: 2699465 - protein, 18 aa, Entamoeba histolytica
VNNKEILNIAAIYEKENI

SEQ ID NO: 2699466 - protein, 22 aa, Entamoeba histolytica
VNNKYPTFPFSLGMLENESKAK

SEQ ID NO: 2699467 - protein, 25 aa, Entamoeba histolytica
VNNQEMYKSVALQFLTRELPLFKKN

SEQ ID NO: 2699468 - protein, 17 aa, Entamoeba histolytica
VNPLSFILTSSINELVL

SEQ ID NO: 2699469 - protein, 25 aa, Entamoeba histolytica
VNPQIRWVVCPQCLELFTKKLKNTK

SEQ ID NO: 2699470 - protein, 19 aa, Entamoeba histolytica
VNPRMTIIRSFDINKPGTL

SEQ ID NO: 2699471 - protein, 24 aa, Entamoeba histolytica
VNPSLKFYACDIAPKAVDAVNADE

SEQ ID NO: 2699472 - protein, 23 aa, Entamoeba histolytica
VNPSVIAPLHFLAKLKIMVVKDI

SEQ ID NO: 2699473 - protein, 24 aa, Entamoeba histolytica
VNPTWVPLCAELLKGTGVKVCTVI

SEQ ID NO: 2699474 - protein, 25 aa, Entamoeba histolytica
VNPVKAQVCGHIFSKQAIYNLIGRN

SEQ ID NO: 2699475 - protein, 17 aa, Entamoeba histolytica
VNPWLTTPFSIIKFVYH

SEQ ID NO: 2699476 - protein, 24 aa, Entamoeba histolytica
VNRDRLSQILIYFINNKLQDASNL

SEQ ID NO: 2699477 - protein, 24 aa, Entamoeba histolytica
VNRLPRKYLEIALTELYSHSSLDP

SEQ ID NO: 2699478 - protein, 25 aa, Entamoeba histolytica
VNRSKEFFKYILSFITDNEIVIGEG

SEQ ID NO: 2699479 - protein, 27 aa, Entamoeba histolytica
VNSCYILDCYSEMYMWVGTRVIKDRRQ

SEQ ID NO: 2699480 - protein, 25 aa, Entamoeba histolytica
VNSEPTDVVYICFDNAQSAHQFIQK

SEQ ID NO: 2699481 - protein, 18 aa, Entamoeba histolytica
VNSFLKKFFYTMREPSYI

SEQ ID NO: 2699482 - protein, 18 aa, Entamoeba histolytica
VNSITPVVLWGALEHHSN

SEQ ID NO: 2699483 - protein, 25 aa, Entamoeba histolytica
VNSLGDLCFYGCKSLQSINIPTSVS

SEQ ID NO: 2699484 - protein, 19 aa, Entamoeba histolytica
VNSLGNYCFYECNDIQESE

SEQ ID NO: 2699485 - protein, 19 aa, Entamoeba histolytica
VNSNLPISVSPVQTNKHLG

SEQ ID NO: 2699486 - protein, 28 aa, Entamoeba histolytica
VNSSRYFVKEGFLTKQCRKTPKPRYFIL

SEQ ID NO: 2699487 - protein, 17 aa, Entamoeba histolytica
VNVKKGLSHIVIISDGA

SEQ ID NO: 2699488 - protein, 23 aa, Entamoeba histolytica
VNVLDIYTGCIIMHKKENISEDI

SEQ ID NO: 2699489 - protein, 18 aa, Entamoeba histolytica
VNVLIGFRSLKGIMQCDN

SEQ ID NO: 2699490 - protein, 17 aa, Entamoeba histolytica
VNVLINIIFNRYIGSTI

SEQ ID NO: 2699491 - protein, 17 aa, Entamoeba histolytica
VNVPFPFFVNVLQTSVW

SEQ ID NO: 2699492 - protein, 24 aa, Entamoeba histolytica
VNYALKADELFKFEGNDNYSVKMI

SEQ ID NO: 2699493 - protein, 19 aa, Entamoeba histolytica
VNYHFERKTFAAIIPGQSR

SEQ ID NO: 2699494 - protein, 20 aa, Entamoeba histolytica
VNYKEVMKDYGLGPNGAIVT

SEQ ID NO: 2699495 - protein, 34 aa, Entamoeba histolytica
VNYKGWNILLAVCYDLRFPVWLRNTLENHYDILI

SEQ ID NO: 2699496 - protein, 17 aa, Entamoeba histolytica
VNYKLLLNRSLWLKEWF

SEQ ID NO: 2699497 - protein, 31 aa, Entamoeba histolytica
VNYLGWKINLAICYDLRFPNWLRNSKEDPYD

SEQ ID NO: 2699498 - protein, 24 aa, Entamoeba histolytica
VNYYISCVIFYITHIRNSKRVRSL

SEQ ID NO: 2699499 - protein, 17 aa, Entamoeba histolytica
VNYYLTRQEELLSDKSY

SEQ ID NO: 2699500 - protein, 20 aa, Entamoeba histolytica
VPAQPALYLLMKTFSVCVPR

SEQ ID NO: 2699501 - protein, 23 aa, Entamoeba histolytica
VPCCSVPVRLPSVGFDNLEVQGN

SEQ ID NO: 2699502 - protein, 22 aa, Entamoeba histolytica
VPCFYRIETLDLFLRVLNQKTK

SEQ ID NO: 2699503 - protein, 29 aa, Entamoeba histolytica
VPDGILCFFPSYSYMNICISYWDEMKIIE

SEQ ID NO: 2699504 - protein, 22 aa, Entamoeba histolytica
VPDKIICVRLIKGDAFEKQNDK

SEQ ID NO: 2699505 - protein, 18 aa, Entamoeba histolytica
VPEDITIMGTMMYQNDLI

SEQ ID NO: 2699506 - protein, 18 aa, Entamoeba histolytica
VPEKIEFIKFLQTQCEYQ

SEQ ID NO: 2699507 - protein, 22 aa, Entamoeba histolytica
VPELAIRFGCHRIGFICNSPVL

SEQ ID NO: 2699508 - protein, 18 aa, Entamoeba histolytica
VPEMRKLISSSLDEKNKD

SEQ ID NO: 2699509 - protein, 22 aa, Entamoeba histolytica
VPEPYYLFNRFVLFNRELIGIK

SEQ ID NO: 2699510 - protein, 19 aa, Entamoeba histolytica
VPFFEAGKNLKNRRLLLYH

SEQ ID NO: 2699511 - protein, 22 aa, Entamoeba histolytica
VPFKSSLKFTKIVAENCKVLDS

SEQ ID NO: 2699512 - protein, 23 aa, Entamoeba histolytica
VPFLKSICLTPTITESKPPVVAI

SEQ ID NO: 2699513 - protein, 24 aa, Entamoeba histolytica
VPFRELKFGGTIKRNTATLVPTVK

SEQ ID NO: 2699514 - protein, 19 aa, Entamoeba histolytica
VPFVINLFMGNTCENCKFA

SEQ ID NO: 2699515 - protein, 18 aa, Entamoeba histolytica
VPHFTRYSVIDEDNNTQE

SEQ ID NO: 2699516 - protein, 31 aa, Entamoeba histolytica
VPHPEALNFGDRWLNACEWVIRNISQSSPER

SEQ ID NO: 2699517 - protein, 22 aa, Entamoeba histolytica
VPHPFWLPKFQNGISYSLPIFC

SEQ ID NO: 2699518 - protein, 22 aa, Entamoeba histolytica
VPHRSAAIPQVFLDRLNTGRIQ

SEQ ID NO: 2699519 - protein, 19 aa, Entamoeba histolytica
VPHSLKDCIAWAREKYDIN

SEQ ID NO: 2699520 - protein, 21 aa, Entamoeba histolytica
VPIDKSLLIIRGIAENKFELK

SEQ ID NO: 2699521 - protein, 23 aa, Entamoeba histolytica
VPIEGFEPIPVRFILSKENPYNF

SEQ ID NO: 2699522 - protein, 18 aa, Entamoeba histolytica
VPIELGQFFMAINIESFR

SEQ ID NO: 2699523 - protein, 20 aa, Entamoeba histolytica
VPIEVCIRSPSLELSQSLYE

SEQ ID NO: 2699524 - protein, 26 aa, Entamoeba histolytica
VPIISIFLKDVISFKEMESFLNGNIN

SEQ ID NO: 2699525 - protein, 18 aa, Entamoeba histolytica
VPIKSYRRRKEKIRKIRE

SEQ ID NO: 2699526 - protein, 19 aa, Entamoeba histolytica
VPINYAFDGVQNLYFHGGN

SEQ ID NO: 2699527 - protein, 23 aa, Entamoeba histolytica
VPIPCASHLTLLHLLEGRKEEMS

SEQ ID NO: 2699528 - protein, 23 aa, Entamoeba histolytica
VPISFWKEFKDFLKVNELTLNDL

SEQ ID NO: 2699529 - protein, 23 aa, Entamoeba histolytica
VPKNAKHLACRIFYQSKTQTIAD

SEQ ID NO: 2699530 - protein, 28 aa, Entamoeba histolytica
VPKVGPCLDCIISLFPPQKTFPMCTIAS

SEQ ID NO: 2699531 - protein, 17 aa, Entamoeba histolytica
VPKYCFQIEYRLLCEVF

SEQ ID NO: 2699532 - protein, 20 aa, Entamoeba histolytica
VPLALRYNSLLIYSQQINSN

SEQ ID NO: 2699533 - protein, 27 aa, Entamoeba histolytica
VPLEFTKELLLAHAYHAIELFRKAKMT

SEQ ID NO: 2699534 - protein, 20 aa, Entamoeba histolytica
VPLESLLCIECNKISTLTIG

SEQ ID NO: 2699535 - protein, 17 aa, Entamoeba histolytica
VPLEYVFPFIKNLFQTH

SEQ ID NO: 2699536 - protein, 17 aa, Entamoeba histolytica
VPLIKTFEDAFCKTSNE

SEQ ID NO: 2699537 - protein, 17 aa, Entamoeba histolytica
VPLLSEVSKLLIKLNNK

SEQ ID NO: 2699538 - protein, 18 aa, Entamoeba histolytica
VPLNRVEPNIARMKNIAN

SEQ ID NO: 2699539 - protein, 25 aa, Entamoeba histolytica
VPLTLPAFHFYRWDHEYEGQQMSKI

SEQ ID NO: 2699540 - protein, 24 aa, Entamoeba histolytica
VPMERLIEIGIAFQSAVDNLFGRN

SEQ ID NO: 2699541 - protein, 18 aa, Entamoeba histolytica
VPMQNDFLAPFITPESAS

SEQ ID NO: 2699542 - protein, 22 aa, Entamoeba histolytica
VPNELYLSLIPKFTSFSTPFTS

SEQ ID NO: 2699543 - protein, 25 aa, Entamoeba histolytica
VPNVRIHLCHAISLISSKYPNFIQI

SEQ ID NO: 2699544 - protein, 25 aa, Entamoeba histolytica
VPNWVRRYGHKIGYSALKQFNEKNN

SEQ ID NO: 2699545 - protein, 17 aa, Entamoeba histolytica
VPPEFLKTLGNIFTDLM

SEQ ID NO: 2699546 - protein, 26 aa, Entamoeba histolytica
VPPKKVPVGGVSLFGGFNPAKVSLRK

SEQ ID NO: 2699547 - protein, 20 aa, Entamoeba histolytica
VPPLTIPIQSSFTYKPQSLY

SEQ ID NO: 2699548 - protein, 23 aa, Entamoeba histolytica
VPQACIPLRIQIINKMKAYHNKF

SEQ ID NO: 2699549 - protein, 19 aa, Entamoeba histolytica
VPQCLIKKANGLEHINGVE

SEQ ID NO: 2699550 - protein, 21 aa, Entamoeba histolytica
VPQGKGTLVMLKKPYEQNQLT

SEQ ID NO: 2699551 - protein, 18 aa, Entamoeba histolytica
VPQRNFKVSPRVSQKPLP

SEQ ID NO: 2699552 - protein, 24 aa, Entamoeba histolytica
VPQSSRSPSSFNFYSKKFIPTTKR

SEQ ID NO: 2699553 - protein, 18 aa, Entamoeba histolytica
VPQTRLQFRAKISKLDFD

SEQ ID NO: 2699554 - protein, 21 aa, Entamoeba histolytica
VPQYKIDSMRVYQNGIQNIIT

SEQ ID NO: 2699555 - protein, 20 aa, Entamoeba histolytica
VPRASHRAMQELLERIDNII

SEQ ID NO: 2699556 - protein, 18 aa, Entamoeba histolytica
VPREAEWGFVAANNVSTT

SEQ ID NO: 2699557 - protein, 19 aa, Entamoeba histolytica
VPREKFPAIFSAVDKLDKV

SEQ ID NO: 2699558 - protein, 17 aa, Entamoeba histolytica
VPRRKTDEFYRYKMPDL

SEQ ID NO: 2699559 - protein, 39 aa, Entamoeba histolytica
VPRTNNCLLRAFFYWSGCYFLRLNLMKKAEFMFRQCCEV

SEQ ID NO: 2699560 - protein, 17 aa, Entamoeba histolytica
VPRTVTVILERYLVVGL

SEQ ID NO: 2699561 - protein, 21 aa, Entamoeba histolytica
VPSHRSAAFKNVFSLQTFNTC

SEQ ID NO: 2699562 - protein, 18 aa, Entamoeba histolytica
VPSPEHMELPIVQSDSVR

SEQ ID NO: 2699563 - protein, 22 aa, Entamoeba histolytica
VPSRLETLIKIMTRFCLLYSYF

SEQ ID NO: 2699564 - protein, 17 aa, Entamoeba histolytica
VPSYFNTYVNTFEYHPP

SEQ ID NO: 2699565 - protein, 25 aa, Entamoeba histolytica
VPTHPIRLGLALNFSVFYYEIMNDA

SEQ ID NO: 2699566 - protein, 22 aa, Entamoeba histolytica
VPVEICIKPTLLNGTINIECFQ

SEQ ID NO: 2699567 - protein, 23 aa, Entamoeba histolytica
VPVSALCLWNLVPSSNSWMNSRV

SEQ ID NO: 2699568 - protein, 17 aa, Entamoeba histolytica
VPYTFGFLERKQINEAM

SEQ ID NO: 2699569 - protein, 17 aa, Entamoeba histolytica
VQAFKELIEEYLKPQVE

SEQ ID NO: 2699570 - protein, 20 aa, Entamoeba histolytica
VQALGPNGCISRLQVMDSIP

SEQ ID NO: 2699571 - protein, 18 aa, Entamoeba histolytica
VQCNMCSLYCPHAAIRCF

SEQ ID NO: 2699572 - protein, 22 aa, Entamoeba histolytica
VQCQKYPYLFGHNQAMQEWIES

SEQ ID NO: 2699573 - protein, 17 aa, Entamoeba histolytica
VQCQYCGKMIYEKYEMQ

SEQ ID NO: 2699574 - protein, 19 aa, Entamoeba histolytica
VQENLALKPDYDYNEQMYA

SEQ ID NO: 2699575 - protein, 18 aa, Entamoeba histolytica
VQEQVFRNWVNSLVSQKG

SEQ ID NO: 2699576 - protein, 23 aa, Entamoeba histolytica
VQERACFMLAIVRQFESLREQGI

SEQ ID NO: 2699577 - protein, 23 aa, Entamoeba histolytica
VQFFNNRFNIVGDIHNIFNEVEC

SEQ ID NO: 2699578 - protein, 23 aa, Entamoeba histolytica
VQFFNNRFNIVGDIHNMFNEVEC

SEQ ID NO: 2699579 - protein, 20 aa, Entamoeba histolytica
VQFFRSAFIYAKIKTANVRE

SEQ ID NO: 2699580 - protein, 28 aa, Entamoeba histolytica
VQFLSSVEFCLFPSFFTGLASFKDQKKS

SEQ ID NO: 2699581 - protein, 25 aa, Entamoeba histolytica
VQFQFRVCDLLETFCKAECNNKEFI

SEQ ID NO: 2699582 - protein, 25 aa, Entamoeba histolytica
VQHEFNLIIPMLLSRTFSDNDIVEM

SEQ ID NO: 2699583 - protein, 17 aa, Entamoeba histolytica
VQINPHKLLGCVGQHDF

SEQ ID NO: 2699584 - protein, 18 aa, Entamoeba histolytica
VQIPKVFDRVTVCFNYWY

SEQ ID NO: 2699585 - protein, 25 aa, Entamoeba histolytica
VQIVFCCYNYKGVVADVIVSPNLPL

SEQ ID NO: 2699586 - protein, 20 aa, Entamoeba histolytica
VQIYDLWRDIILGGELNELV

SEQ ID NO: 2699587 - protein, 17 aa, Entamoeba histolytica
VQKKSTRGYGYDLADNF

SEQ ID NO: 2699588 - protein, 24 aa, Entamoeba histolytica
VQKLWDIVKFYLFRENDTHTRFVY

SEQ ID NO: 2699589 - protein, 26 aa, Entamoeba histolytica
VQKNARTVCFEWLDHFYEVLSNNALK

SEQ ID NO: 2699590 - protein, 20 aa, Entamoeba histolytica
VQKNGVWRIDFEDFEQQIIS

SEQ ID NO: 2699591 - protein, 17 aa, Entamoeba histolytica
VQLCIEPSELILNQCKE

SEQ ID NO: 2699592 - protein, 22 aa, Entamoeba histolytica
VQLKILRIVHCDSLKLKINYIN

SEQ ID NO: 2699593 - protein, 24 aa, Entamoeba histolytica
VQLQSLPLGMLWMNCMRNEMQSYL

SEQ ID NO: 2699594 - protein, 27 aa, Entamoeba histolytica
VQLSKSFRSKKNWKYNQKIFAIKKASE

SEQ ID NO: 2699595 - protein, 17 aa, Entamoeba histolytica
VQLWDTAGQEKFRNITT

SEQ ID NO: 2699596 - protein, 23 aa, Entamoeba histolytica
VQMCSSVQKWSYDIVDEIISGTK

SEQ ID NO: 2699597 - protein, 17 aa, Entamoeba histolytica
VQNDCINYVLTQVMKLS

SEQ ID NO: 2699598 - protein, 26 aa, Entamoeba histolytica
VQNSNFRVVKWLYSLVGQLFNQPNYV

SEQ ID NO: 2699599 - protein, 25 aa, Entamoeba histolytica
VQPNALCSYGVFILLTPKTKFIWKG

SEQ ID NO: 2699600 - protein, 25 aa, Entamoeba histolytica
VQRGEWKVPLPIYRAIQYLLEGDNL

SEQ ID NO: 2699601 - protein, 23 aa, Entamoeba histolytica
VQRIMRYPMLIKEVIKQTPHNHP

SEQ ID NO: 2699602 - protein, 26 aa, Entamoeba histolytica
VQRIPRYRLLLQELLKTLPPQHSEYN

SEQ ID NO: 2699603 - protein, 27 aa, Entamoeba histolytica
VQRLPRYKLLLADLLKYTPACHPDHEN

SEQ ID NO: 2699604 - protein, 23 aa, Entamoeba histolytica
VQRLPRYKLLLEDLIRNTPEGHC

SEQ ID NO: 2699605 - protein, 26 aa, Entamoeba histolytica
VQSRNEFWCVFKGTNYEFSRYGTLCI

SEQ ID NO: 2699606 - protein, 17 aa, Entamoeba histolytica
VQSRWSILNEEYRISKR

SEQ ID NO: 2699607 - protein, 17 aa, Entamoeba histolytica
VQSTIGMLEECRVFERF

SEQ ID NO: 2699608 - protein, 25 aa, Entamoeba histolytica
VQSWRYCLYYGWLLINSPTTLSFAF

SEQ ID NO: 2699609 - protein, 24 aa, Entamoeba histolytica
VQTWLKNKESMLIEEKKRVLTAMK

SEQ ID NO: 2699610 - protein, 19 aa, Entamoeba histolytica
VQVEGGFTFIIIDYFSLGQ

SEQ ID NO: 2699611 - protein, 18 aa, Entamoeba histolytica
VQVSFVFTSIGLVVRNHG

SEQ ID NO: 2699612 - protein, 23 aa, Entamoeba histolytica
VQWESLQSYVLYRSISLRNKYDL

SEQ ID NO: 2699613 - protein, 24 aa, Entamoeba histolytica
VQYPDDWACDGLDIIHYVSDEELQ

SEQ ID NO: 2699614 - protein, 17 aa, Entamoeba histolytica
VQYRLRIVSKLTNNITF

SEQ ID NO: 2699615 - protein, 24 aa, Entamoeba histolytica
VQYRSPNSLILPPLHDSTAPIVTH

SEQ ID NO: 2699616 - protein, 29 aa, Entamoeba histolytica
VRAESLRPVLGFDLLEYLSKLPIDESEEK

SEQ ID NO: 2699617 - protein, 24 aa, Entamoeba histolytica
VRAYIKVPIFKGVLTQMQYQEFLS

SEQ ID NO: 2699618 - protein, 18 aa, Entamoeba histolytica
VRCALCHDHYTAVMCRRH

SEQ ID NO: 2699619 - protein, 17 aa, Entamoeba histolytica
VRCPCGRSIHDDRNGPA

SEQ ID NO: 2699620 - protein, 22 aa, Entamoeba histolytica
VRCWYCGLADKKKLIRCGCGKY

SEQ ID NO: 2699621 - protein, 26 aa, Entamoeba histolytica
VRDIHLLTCGDLGINCDDYVRRCIHS

SEQ ID NO: 2699622 - protein, 17 aa, Entamoeba histolytica
VRDVFRLARENAPSIVF

SEQ ID NO: 2699623 - protein, 20 aa, Entamoeba histolytica
VRDWVISSILSFFSTENRVK

SEQ ID NO: 2699624 - protein, 18 aa, Entamoeba histolytica
VREEELVIAPGFLPQKQE

SEQ ID NO: 2699625 - protein, 24 aa, Entamoeba histolytica
VREKCKTCCRVIFASDYNYKTEKQ

SEQ ID NO: 2699626 - protein, 26 aa, Entamoeba histolytica
VREPRGYIIDGVFPFLIDKEEEESQY

SEQ ID NO: 2699627 - protein, 20 aa, Entamoeba histolytica
VREQKLNISKSIREITRESK

SEQ ID NO: 2699628 - protein, 18 aa, Entamoeba histolytica
VRFDPKVEMNFNIELNTK

SEQ ID NO: 2699629 - protein, 26 aa, Entamoeba histolytica
VRFIELRAAIFNFHFDIGGEFDVKEL

SEQ ID NO: 2699630 - protein, 20 aa, Entamoeba histolytica
VRFITGVGKHSSRRGFSVIK

SEQ ID NO: 2699631 - protein, 26 aa, Entamoeba histolytica
VRFNKYSSFITLDFGLIKRLEITDSE

SEQ ID NO: 2699632 - protein, 18 aa, Entamoeba histolytica
VRGIKLGLHFPRNHKNVS

SEQ ID NO: 2699633 - protein, 24 aa, Entamoeba histolytica
VRGIPIRCGSIWKKVERLDELMEL

SEQ ID NO: 2699634 - protein, 25 aa, Entamoeba histolytica
VRGKGNMVFLFLRKGIYTCQALVMK

SEQ ID NO: 2699635 - protein, 21 aa, Entamoeba histolytica
VRGLAIRCMSNFEVDTVREHL

SEQ ID NO: 2699636 - protein, 21 aa, Entamoeba histolytica
VRGLCFHPNRPLVVSGGDDCV

SEQ ID NO: 2699637 - protein, 31 aa, Entamoeba histolytica
VRGLMDCWSTLRLCVEHQFGGVNSQQKKDSM

SEQ ID NO: 2699638 - protein, 20 aa, Entamoeba histolytica
VRHCGLPKDIVHSILKGLAD

SEQ ID NO: 2699639 - protein, 17 aa, Entamoeba histolytica
VRIAPQFLDSILNQIHS

SEQ ID NO: 2699640 - protein, 20 aa, Entamoeba histolytica
VRIASFVKRILIMMLNCDSS

SEQ ID NO: 2699641 - protein, 25 aa, Entamoeba histolytica
VRIHACGVWGELCSVYCNEIKQVLP

SEQ ID NO: 2699642 - protein, 29 aa, Entamoeba histolytica
VRILDHFLFNRHICIVFELLGMNLYDVLR

SEQ ID NO: 2699643 - protein, 25 aa, Entamoeba histolytica
VRILDLILMEGWEIVFSIFSAILHY

SEQ ID NO: 2699644 - protein, 26 aa, Entamoeba histolytica
VRKAAIDCWDVIAIIVREYAMTLDNP

SEQ ID NO: 2699645 - protein, 23 aa, Entamoeba histolytica
VRKEDLFPLLIQFLQSEDPQYKI

SEQ ID NO: 2699646 - protein, 26 aa, Entamoeba histolytica
VRKIFKRLFRVYAHMFYNHMEHLEQL

SEQ ID NO: 2699647 - protein, 37 aa, Entamoeba histolytica
VRKILSKYCNYIFTKRVDFSFQLLKNIIKLCSSENDK

SEQ ID NO: 2699648 - protein, 22 aa, Entamoeba histolytica
VRKIRITRPIIYSFIKGINNYR

SEQ ID NO: 2699649 - protein, 24 aa, Entamoeba histolytica
VRKNRYIILPADFEKAYKKVVRKQ

SEQ ID NO: 2699650 - protein, 25 aa, Entamoeba histolytica
VRKVKRISDGTLWAMKKINISKARA

SEQ ID NO: 2699651 - protein, 25 aa, Entamoeba histolytica
VRLCDIRATKTCSSAVKFFVNSDDY

SEQ ID NO: 2699652 - protein, 20 aa, Entamoeba histolytica
VRLFSGELFGSYYSKTVPCE

SEQ ID NO: 2699653 - protein, 18 aa, Entamoeba histolytica
VRLGVNRRTGEKKAIKIF

SEQ ID NO: 2699654 - protein, 18 aa, Entamoeba histolytica
VRLIDFGSACFQDSPLYT

SEQ ID NO: 2699655 - protein, 17 aa, Entamoeba histolytica
VRLIRKLLEGLIVSITN

SEQ ID NO: 2699656 - protein, 22 aa, Entamoeba histolytica
  misc_feature (21)..(22): Xaa can be any naturally occurring amino acid
VRLKMKDCGDVNAMEEFITFXX

SEQ ID NO: 2699657 - protein, 22 aa, Entamoeba histolytica
VRLKSIRELENFPPYQTAVQMF

SEQ ID NO: 2699658 - protein, 17 aa, Entamoeba histolytica
VRLPSKFLFPKYTFYES

SEQ ID NO: 2699659 - protein, 21 aa, Entamoeba histolytica
VRLTEIIKLLKTMMDYVESAK

SEQ ID NO: 2699660 - protein, 26 aa, Entamoeba histolytica
VRLVKSCGRFVYSTCSLNPYEDEAVV

SEQ ID NO: 2699661 - protein, 19 aa, Entamoeba histolytica
VRLVPEFMLHLQSGVFDKP

SEQ ID NO: 2699662 - protein, 18 aa, Entamoeba histolytica
VRLWSLDYPSCIMSFNEH

SEQ ID NO: 2699663 - protein, 18 aa, Entamoeba histolytica
VRMGNTIVEAVVFGPLEG

SEQ ID NO: 2699664 - protein, 23 aa, Entamoeba histolytica
VRMSPTFCTVCRSSIVSSALGVL

SEQ ID NO: 2699665 - protein, 19 aa, Entamoeba histolytica
VRNGLTFLDIIILQLKALY

SEQ ID NO: 2699666 - protein, 27 aa, Entamoeba histolytica
VRNRILYIYRVIRPFRLIEIDVIPNIF

SEQ ID NO: 2699667 - protein, 19 aa, Entamoeba histolytica
VRPKTGHCFVDFKDDTSMR

SEQ ID NO: 2699668 - protein, 19 aa, Entamoeba histolytica
VRPPQQYGLDFQIQKQTPR

SEQ ID NO: 2699669 - protein, 18 aa, Entamoeba histolytica
VRQDFSLSDTEDVVQCYK

SEQ ID NO: 2699670 - protein, 27 aa, Entamoeba histolytica
VRQEIDLRTGAAFTRFQTTLLKNKSKA

SEQ ID NO: 2699671 - protein, 17 aa, Entamoeba histolytica
VRQSELLIVLSNEANGM

SEQ ID NO: 2699672 - protein, 24 aa, Entamoeba histolytica
VRRDNCLLVKYVIENVLNKILLDS

SEQ ID NO: 2699673 - protein, 22 aa, Entamoeba histolytica
VRREECYTLKAPIKIVSEQKHK

SEQ ID NO: 2699674 - protein, 22 aa, Entamoeba histolytica
VRRICEQIAQFVGFEYHSILEI

SEQ ID NO: 2699675 - protein, 22 aa, Entamoeba histolytica
VRRICEQIAQFVGFEYHSVLEI

SEQ ID NO: 2699676 - protein, 22 aa, Entamoeba histolytica
VRRIREGCFYDCTSLTTINIPT

SEQ ID NO: 2699677 - protein, 22 aa, Entamoeba histolytica
VRRKGIRKRGKIDVVTENPIPK

SEQ ID NO: 2699678 - protein, 29 aa, Entamoeba histolytica
VRRKHHCRFCGSCICSDCSRNKVKNGNSY

SEQ ID NO: 2699679 - protein, 21 aa, Entamoeba histolytica
VRRKSNEIIGIYDGLLDFPGE

SEQ ID NO: 2699680 - protein, 24 aa, Entamoeba histolytica
VRRMFSILAKNGWWEKLGGMDGLM

SEQ ID NO: 2699681 - protein, 29 aa, Entamoeba histolytica
VRRMSVSVKQRYKVIEGKQRIQPNFVSAK

SEQ ID NO: 2699682 - protein, 26 aa, Entamoeba histolytica
VRRRHHCRACGRCICGECSKWKMPIP

SEQ ID NO: 2699683 - protein, 17 aa, Entamoeba histolytica
VRSELGAYFVKNNDRPT

SEQ ID NO: 2699684 - protein, 19 aa, Entamoeba histolytica
VRSNVTWKCRSIGAYYGEP

SEQ ID NO: 2699685 - protein, 19 aa, Entamoeba histolytica
VRTAPFFTLQEKVFIAYQL

SEQ ID NO: 2699686 - protein, 21 aa, Entamoeba histolytica
VRTLQAATHFKYVTGPSPITG

SEQ ID NO: 2699687 - protein, 20 aa, Entamoeba histolytica
VRTLQSWLKEIQRYCDPDVD

SEQ ID NO: 2699688 - protein, 29 aa, Entamoeba histolytica
VRVAYEATRILCNLINFKSEYANTIMKDP

SEQ ID NO: 2699689 - protein, 24 aa, Entamoeba histolytica
VRVCGSAKELGSWTEGYTMTYKDG

SEQ ID NO: 2699690 - protein, 17 aa, Entamoeba histolytica
VRVFPYIVSEPITKFYV

SEQ ID NO: 2699691 - protein, 23 aa, Entamoeba histolytica
VRVIDFGSACFSTYTLYTYIQSR

SEQ ID NO: 2699692 - protein, 21 aa, Entamoeba histolytica
VRVKLPLSIKSLYLYCSSIRI

SEQ ID NO: 2699693 - protein, 21 aa, Entamoeba histolytica
VRVKVLQMWQMLVEHRCIPLE

SEQ ID NO: 2699694 - protein, 18 aa, Entamoeba histolytica
VRVLIGICKKYFEHLKLQ

SEQ ID NO: 2699695 - protein, 24 aa, Entamoeba histolytica
VRVRPCFKTEVAERCCSVDEEKES

SEQ ID NO: 2699696 - protein, 22 aa, Entamoeba histolytica
VRYAKLRDAIIIASDNVLDKNL

SEQ ID NO: 2699697 - protein, 23 aa, Entamoeba histolytica
VRYLKEHWECSGMGQQETNIIGE

SEQ ID NO: 2699698 - protein, 31 aa, Entamoeba histolytica
VRYTAARKFLFPNSYKFISFMMFKENPCTIQ

SEQ ID NO: 2699699 - protein, 21 aa, Entamoeba histolytica
VSAKLLKALEIPACCYDDFLV

SEQ ID NO: 2699700 - protein, 23 aa, Entamoeba histolytica
VSAKNTIKIMGWRMDLNVPMIRT

SEQ ID NO: 2699701 - protein, 18 aa, Entamoeba histolytica
VSALGYNYHPQCFVANVN

SEQ ID NO: 2699702 - protein, 23 aa, Entamoeba histolytica
VSASPYLPVIETFKRISVSKYPY

SEQ ID NO: 2699703 - protein, 25 aa, Entamoeba histolytica
VSCETYGGGVWTTWFDRDLGICGRV

SEQ ID NO: 2699704 - protein, 24 aa, Entamoeba histolytica
VSDCGGRIGPFIDHLYPDLRNASI

SEQ ID NO: 2699705 - protein, 17 aa, Entamoeba histolytica
VSDELKGNLGINALKKS

SEQ ID NO: 2699706 - protein, 26 aa, Entamoeba histolytica
VSDMPRCAYCRAFMSKEMNWIRLGGK

SEQ ID NO: 2699707 - protein, 20 aa, Entamoeba histolytica
VSDPSFIPQYDWFLSSVCNN

SEQ ID NO: 2699708 - protein, 26 aa, Entamoeba histolytica
VSDRMIYKLGYVERVMEVLKRRRNQV

SEQ ID NO: 2699709 - protein, 24 aa, Entamoeba histolytica
VSEDCNICIWNIPEDCPSGNIHEA

SEQ ID NO: 2699710 - protein, 24 aa, Entamoeba histolytica
VSEKFKFGVLYGTLGQLTENEFYN

SEQ ID NO: 2699711 - protein, 34 aa, Entamoeba histolytica
VSEKNKQKFGFWLEDKEGVIFKFTKTTENNEKEY

SEQ ID NO: 2699712 - protein, 22 aa, Entamoeba histolytica
VSELKSYINRCLSVDNIQLRLK

SEQ ID NO: 2699713 - protein, 23 aa, Entamoeba histolytica
VSELWKQQIETFLKEKKEEMTEI

SEQ ID NO: 2699714 - protein, 23 aa, Entamoeba histolytica
VSEMFKKWAIQRNAFIDKFDSTR

SEQ ID NO: 2699715 - protein, 18 aa, Entamoeba histolytica
VSEMSYRYNELVSTVRID

SEQ ID NO: 2699716 - protein, 23 aa, Entamoeba histolytica
VSENGEYCCFEYESWNTVSKSHF

SEQ ID NO: 2699717 - protein, 20 aa, Entamoeba histolytica
VSERCKCQWILELVSFSIED

SEQ ID NO: 2699718 - protein, 31 aa, Entamoeba histolytica
VSEVPQIHLIWNCQEPIKMNIYIDNGINIQV

SEQ ID NO: 2699719 - protein, 19 aa, Entamoeba histolytica
VSFGGQCLHYINPQYPIFN

SEQ ID NO: 2699720 - protein, 20 aa, Entamoeba histolytica
VSFHPCIRIGKWEQQKVLSF

SEQ ID NO: 2699721 - protein, 17 aa, Entamoeba histolytica
VSFLYAGWDRYFGYQLY

SEQ ID NO: 2699722 - protein, 27 aa, Entamoeba histolytica
VSFNLKCMGELPGPYIKYFVQSIGPAG

SEQ ID NO: 2699723 - protein, 18 aa, Entamoeba histolytica
VSFVFGVKELNQFLDDNN

SEQ ID NO: 2699724 - protein, 17 aa, Entamoeba histolytica
VSGAAKFRGLWKSYYPN

SEQ ID NO: 2699725 - protein, 21 aa, Entamoeba histolytica
VSGCPLKILRMAGGKKESQKL

SEQ ID NO: 2699726 - protein, 17 aa, Entamoeba histolytica
VSGDWWVKALGNGEGGN

SEQ ID NO: 2699727 - protein, 20 aa, Entamoeba histolytica
VSGFDKFLFIKYVKKNRIPP

SEQ ID NO: 2699728 - protein, 23 aa, Entamoeba histolytica
VSGIERENWFVALGITKFDLIHA

SEQ ID NO: 2699729 - protein, 20 aa, Entamoeba histolytica
VSGMSIVDCTFLTKQKIEAY

SEQ ID NO: 2699730 - protein, 21 aa, Entamoeba histolytica
VSGPLEVLINWAVTPENLESN

SEQ ID NO: 2699731 - protein, 26 aa, Entamoeba histolytica
VSGTLRFLLKEVINSKILEQFIHENG

SEQ ID NO: 2699732 - protein, 21 aa, Entamoeba histolytica
VSHGAWIKTSILGLLEMEPTM

SEQ ID NO: 2699733 - protein, 25 aa, Entamoeba histolytica
VSHPFWLPKFANAFYYTLPLLIQQM

SEQ ID NO: 2699734 - protein, 26 aa, Entamoeba histolytica
VSIAEKSGSIFIPRGISVASLDHQRE

SEQ ID NO: 2699735 - protein, 25 aa, Entamoeba histolytica
VSIALKRKQSCIFFLYCSDPLQQKR

SEQ ID NO: 2699736 - protein, 19 aa, Entamoeba histolytica
VSIATCITLSISRKPPSSK

SEQ ID NO: 2699737 - protein, 17 aa, Entamoeba histolytica
VSIENALEYGIKHFAVN

SEQ ID NO: 2699738 - protein, 17 aa, Entamoeba histolytica
VSIIGDECFKGCSSLTS

SEQ ID NO: 2699739 - protein, 18 aa, Entamoeba histolytica
VSILSSVITSFAFSIQQE

SEQ ID NO: 2699740 - protein, 20 aa, Entamoeba histolytica
VSISRIMGYKERWENEYNNK

SEQ ID NO: 2699741 - protein, 27 aa, Entamoeba histolytica
VSIVPFKMKECMNSLVVATKENIIIGN

SEQ ID NO: 2699742 - protein, 18 aa, Entamoeba histolytica
VSIVPSCLTFNRKSSKEQ

SEQ ID NO: 2699743 - protein, 24 aa, Entamoeba histolytica
VSKDCVQPFPPFLIPSHTQPILPV

SEQ ID NO: 2699744 - protein, 23 aa, Entamoeba histolytica
VSKEDALEFARRHSLIYTETSAK

SEQ ID NO: 2699745 - protein, 22 aa, Entamoeba histolytica
VSKEKVCLTFDKAVFSRNISNK

SEQ ID NO: 2699746 - protein, 23 aa, Entamoeba histolytica
VSKIGNKCFSWCSSLTSINIPSS

SEQ ID NO: 2699747 - protein, 26 aa, Entamoeba histolytica
VSKIKGKYCFISFYNGVTILCYRMNV

SEQ ID NO: 2699748 - protein, 17 aa, Entamoeba histolytica
VSKKCATAIIFTTINPF

SEQ ID NO: 2699749 - protein, 21 aa, Entamoeba histolytica
VSKQCRSPSEFGVSINDKRLK

SEQ ID NO: 2699750 - protein, 25 aa, Entamoeba histolytica
VSKTKEANCGFEFQEEKEQPKGHKL

SEQ ID NO: 2699751 - protein, 17 aa, Entamoeba histolytica
VSKYLIKSCEIQSSLGR

SEQ ID NO: 2699752 - protein, 17 aa, Entamoeba histolytica
VSLAKVFGLTLNVPQTT

SEQ ID NO: 2699753 - protein, 19 aa, Entamoeba histolytica
VSLASWKLTSKDKMFQIIT

SEQ ID NO: 2699754 - protein, 18 aa, Entamoeba histolytica
VSLCKKKPNPSLKIMIVG

SEQ ID NO: 2699755 - protein, 17 aa, Entamoeba histolytica
VSLFGINQHATFNVEKK

SEQ ID NO: 2699756 - protein, 17 aa, Entamoeba histolytica
VSLISKTLRSFRLDSYN

SEQ ID NO: 2699757 - protein, 22 aa, Entamoeba histolytica
VSLKDQMCFVLFKNDITITKIE

SEQ ID NO: 2699758 - protein, 23 aa, Entamoeba histolytica
VSLKDQMCFVLFKNDITITKIEM

SEQ ID NO: 2699759 - protein, 23 aa, Entamoeba histolytica
VSLKNCKTEEVIPFQQKVEEEAN

SEQ ID NO: 2699760 - protein, 29 aa, Entamoeba histolytica
VSLKYNIAIQCAESLYIFHSLGFTHKRIE

SEQ ID NO: 2699761 - protein, 17 aa, Entamoeba histolytica
VSLLGKWFNILIEHKRM

SEQ ID NO: 2699762 - protein, 22 aa, Entamoeba histolytica
VSLLINSMCEFAMMLENVVEVY

SEQ ID NO: 2699763 - protein, 25 aa, Entamoeba histolytica
VSLLMKGKCLSSYAVTATLRKNLRN

SEQ ID NO: 2699764 - protein, 20 aa, Entamoeba histolytica
VSLLSDYWIRYESKNQITFS

SEQ ID NO: 2699765 - protein, 22 aa, Entamoeba histolytica
VSLNNFIIFCFVNEPSAKQPHF

SEQ ID NO: 2699766 - protein, 33 aa, Entamoeba histolytica
VSLRFIFKKQEFFIPVVLLLRVYGGMSDREIFQ

SEQ ID NO: 2699767 - protein, 18 aa, Entamoeba histolytica
VSLSPRDVDLCLKAVEVL

SEQ ID NO: 2699768 - protein, 17 aa, Entamoeba histolytica
VSLTLSKFFPISIINTM

SEQ ID NO: 2699769 - protein, 19 aa, Entamoeba histolytica
VSMAYGLECNMAVQVAEAI

SEQ ID NO: 2699770 - protein, 25 aa, Entamoeba histolytica
VSMEELYTMFGWPLAKKYGTLHDAF

SEQ ID NO: 2699771 - protein, 20 aa, Entamoeba histolytica
VSNDCSFIKILRVLSKSDNN

SEQ ID NO: 2699772 - protein, 30 aa, Entamoeba histolytica; identical to SEQ ID NO: 2509111

SEQ ID NO: 2699773 - protein, 24 aa, Entamoeba histolytica
VSNVCLKPQPLMALIQSNKTSGYV

SEQ ID NO: 2699774 - protein, 17 aa, Entamoeba histolytica
VSPPLPVNSFSNDNYNE

SEQ ID NO: 2699775 - protein, 19 aa, Entamoeba histolytica
VSQKYIFGNIINLFGKDVK

SEQ ID NO: 2699776 - protein, 20 aa, Entamoeba histolytica
VSQKYIFGNIINLFGKDVKK

SEQ ID NO: 2699777 - protein, 24 aa, Entamoeba histolytica
VSQLGGVCIIGFVRKEMENKIKQF

SEQ ID NO: 2699778 - protein, 17 aa, Entamoeba histolytica
VSQRFVYNSAIISGDYC

SEQ ID NO: 2699779 - protein, 23 aa, Entamoeba histolytica
VSQRLKAAHLIRSLITPENYVIV

SEQ ID NO: 2699780 - protein, 19 aa, Entamoeba histolytica
VSQRLRGNMEHVSYEADLE

SEQ ID NO: 2699781 - protein, 19 aa, Entamoeba histolytica
VSQTEVFQNYGIQEGIILD

SEQ ID NO: 2699782 - protein, 25 aa, Entamoeba histolytica
VSQVKKRLAEVMSRDIEQLRAEAEK

SEQ ID NO: 2699783 - protein, 24 aa, Entamoeba histolytica
VSRAYYPGARWVLQEDLLHLHYKR

SEQ ID NO: 2699784 - protein, 17 aa, Entamoeba histolytica
VSRIDSFCFFKCENLTS

SEQ ID NO: 2699785 - protein, 20 aa, Entamoeba histolytica
VSRKERRIQVASLMLAGRIF

SEQ ID NO: 2699786 - protein, 18 aa, Entamoeba histolytica
VSRYGHFIMKISDIISSP

SEQ ID NO: 2699787 - protein, 18 aa, Entamoeba histolytica
VSSAGFLPPHASEIEAAL

SEQ ID NO: 2699788 - protein, 26 aa, Entamoeba histolytica
VSSCLRVFECLYKKSTSYMISFINSH

SEQ ID NO: 2699789 - protein, 17 aa, Entamoeba histolytica
VSSEIYPPLEIIDNKES

SEQ ID NO: 2699790 - protein, 24 aa, Entamoeba histolytica
VSSHLHQWIDLIFGYKSTGNEALN

SEQ ID NO: 2699791 - protein, 19 aa, Entamoeba histolytica
VSSKDRWTLPGKVKDFISI

SEQ ID NO: 2699792 - protein, 17 aa, Entamoeba histolytica
VSSKYSGYYGIRNEEEP

SEQ ID NO: 2699793 - protein, 25 aa, Entamoeba histolytica
VSSLELPDAFKIWDEDSYREYLQES

SEQ ID NO: 2699794 - protein, 20 aa, Entamoeba histolytica
VSSLGFLLPHFINAVKELDG

SEQ ID NO: 2699795 - protein, 23 aa, Entamoeba histolytica
VSSMVRPHISSVININDNTSVED

SEQ ID NO: 2699796 - protein, 19 aa, Entamoeba histolytica
VSSNCRESIKMVKKTPLLQ

SEQ ID NO: 2699797 - protein, 24 aa, Entamoeba histolytica
VSSPKLEEILLFFNEEINICGKVP

SEQ ID NO: 2699798 - protein, 25 aa, Entamoeba histolytica
VSSSYEILGGLALDDDQFIAIKKQY

SEQ ID NO: 2699799 - protein, 18 aa, Entamoeba histolytica
VSSVELYPLPTIPSNLAI

SEQ ID NO: 2699800 - protein, 25 aa, Entamoeba histolytica
VSTACGHIFCRSCMCELFKNKETVE

SEQ ID NO: 2699801 - protein, 21 aa, Entamoeba histolytica
VSTDLCGRGIDVAKVNLVVNF

SEQ ID NO: 2699802 - protein, 21 aa, Entamoeba histolytica
VSTEGLWDPSIEKVKKACIGA

SEQ ID NO: 2699803 - protein, 17 aa, Entamoeba histolytica
VSTGFIQKQVRLMLGKK

SEQ ID NO: 2699804 - protein, 29 aa, Entamoeba histolytica
VSTLFYYMRLCVLSYGKWVYIQGDKDDNI

SEQ ID NO: 2699805 - protein, 27 aa, Entamoeba histolytica
VSTLMNFKVCFIKSLSLQVSTDNGTNW

SEQ ID NO: 2699806 - protein, 19 aa, Entamoeba histolytica
VSTLRLGFVPLSPIEESFN

SEQ ID NO: 2699807 - protein, 25 aa, Entamoeba histolytica
VSTPLKIECGWVLINALEKVDSMGL

SEQ ID NO: 2699808 - protein, 17 aa, Entamoeba histolytica
VSTRIPVKISNYKLVIA

SEQ ID NO: 2699809 - protein, 25 aa, Entamoeba histolytica
VSTSFIPYFSCLCGNDFTKSFNQKL

SEQ ID NO: 2699810 - protein, 18 aa, Entamoeba histolytica
VSTVGVYILNYIDGTLTY

SEQ ID NO: 2699811 - protein, 21 aa, Entamoeba histolytica
VSVEEIVMFGNMIKDFLHSLH

SEQ ID NO: 2699812 - protein, 21 aa, Entamoeba histolytica
VSVFPKWSIVDPCHSMSLPDN

SEQ ID NO: 2699813 - protein, 17 aa, Entamoeba histolytica
VSVGMKWALVCRPKEML

SEQ ID NO: 2699814 - protein, 23 aa, Entamoeba histolytica
VSVIRQEMRVISKFYPNDFDEVF

SEQ ID NO: 2699815 - protein, 18 aa, Entamoeba histolytica
VSVSPHYLALGGTDDLIR

SEQ ID NO: 2699816 - protein, 19 aa, Entamoeba histolytica
VSYCKICMDKEKGISRGTG

SEQ ID NO: 2699817 - protein, 27 aa, Entamoeba histolytica
VSYLLLHGLMCPLLAPRISKKLCSLLT

SEQ ID NO: 2699818 - protein, 18 aa, Entamoeba histolytica
VSYLSAYCGNIQSMVKLN

SEQ ID NO: 2699819 - protein, 24 aa, Entamoeba histolytica
VSYPYQRYAVWYGGSVMAELPVFV

SEQ ID NO: 2699820 - protein, 30 aa, Entamoeba histolytica
VSYQEAINFCVIKTLYLYETYIKDIIKSPT

SEQ ID NO: 2699821 - protein, 19 aa, Entamoeba histolytica
VSYQKLLKCYVINELQKKP

SEQ ID NO: 2699822 - protein, 21 aa, Entamoeba histolytica
VTAAMCRRLTEDLLVEYINPL

SEQ ID NO: 2699823 - protein, 20 aa, Entamoeba histolytica
VTAAVLKSFMRGMIEPVVDI

SEQ ID NO: 2699824 - protein, 20 aa, Entamoeba histolytica
VTAFKYIVCEPYSYTTEFNM

SEQ ID NO: 2699825 - protein, 24 aa, Entamoeba histolytica
VTALTVLCGTTFDLTNHPNIKSMN

SEQ ID NO: 2699826 - protein, 21 aa, Entamoeba histolytica
VTARPCIHLLNQREYEGVVEL

SEQ ID NO: 2699827 - protein, 17 aa, Entamoeba histolytica
VTCFAKPLIPISSINPN

SEQ ID NO: 2699828 - protein, 25 aa, Entamoeba histolytica
VTCQHKLPKEERIEADGTTKEVHVV

SEQ ID NO: 2699829 - protein, 19 aa, Entamoeba histolytica
VTDFEWYLKLLSRLSTQQL

SEQ ID NO: 2699830 - protein, 23 aa, Entamoeba histolytica
VTDGKPIVHVCCIPKTSNILLID

SEQ ID NO: 2699831 - protein, 26 aa, Entamoeba histolytica
VTDKAMRIVQSWGILFPQEFKVYTEM

SEQ ID NO: 2699832 - protein, 17 aa, Entamoeba histolytica
VTDLPIFFHSHNTSGTI

SEQ ID NO: 2699833 - protein, 23 aa, Entamoeba histolytica
VTEELYLHPSIFQKYLVTPANKY

SEQ ID NO: 2699834 - protein, 17 aa, Entamoeba histolytica
VTEEPTRIIARNAGIDG

SEQ ID NO: 2699835 - protein, 29 aa, Entamoeba histolytica
VTEEQCIICGFPSSTHCPDCTTPYCCSLH

SEQ ID NO: 2699836 - protein, 19 aa, Entamoeba histolytica
VTEISFCAHSDFAHTRKFI

SEQ ID NO: 2699837 - protein, 25 aa, Entamoeba histolytica
VTEKAMRILQTWGPLYPNELYDYQL

SEQ ID NO: 2699838 - protein, 22 aa, Entamoeba histolytica
VTEKCKFVDRIVLKLQETPENV

SEQ ID NO: 2699839 - protein, 25 aa, Entamoeba histolytica
VTEKSMKIVQSWGQMFPDDLYEYSQ

SEQ ID NO: 2699840 - protein, 17 aa, Entamoeba histolytica
VTELRLSHCDKLQAIYF

SEQ ID NO: 2699841 - protein, 24 aa, Entamoeba histolytica
VTEYFKFVFCENGLVTYQDGVCIG

SEQ ID NO: 2699842 - protein, 18 aa, Entamoeba histolytica
VTFFPKTYGFIVMEKDNL

SEQ ID NO: 2699843 - protein, 19 aa, Entamoeba histolytica
VTFNQVKGIFGFQPHHNLG

SEQ ID NO: 2699844 - protein, 18 aa, Entamoeba histolytica
VTFQNDFSQFSTFDPQVN

SEQ ID NO: 2699845 - protein, 26 aa, Entamoeba histolytica
VTFSCGHSFCLVCVRQIFRKDNICPT

SEQ ID NO: 2699846 - protein, 17 aa, Entamoeba histolytica
VTFSIEYLTHMEIQDDE

SEQ ID NO: 2699847 - protein, 22 aa, Entamoeba histolytica
VTGKVLLKVCYKVEQTNEIPTV

SEQ ID NO: 2699848 - protein, 18 aa, Entamoeba histolytica
VTGPRGSLTREFQHPKVD

SEQ ID NO: 2699849 - protein, 18 aa, Entamoeba histolytica
VTHGYPFNTITFYDTQHW

SEQ ID NO: 2699850 - protein, 22 aa, Entamoeba histolytica
VTHREMNDVISFQGHKNEVVCC

SEQ ID NO: 2699851 - protein, 19 aa, Entamoeba histolytica
VTICAGGDLMKAKGKEDID

SEQ ID NO: 2699852 - protein, 17 aa, Entamoeba histolytica
VTICYYDDINFSKFPNL

SEQ ID NO: 2699853 - protein, 17 aa, Entamoeba histolytica
VTIFVSMCGYYPFDGNS

SEQ ID NO: 2699854 - protein, 21 aa, Entamoeba histolytica
VTIPSQLKYVGYWGSTLLAKL

SEQ ID NO: 2699855 - protein, 17 aa, Entamoeba histolytica
VTIRSGTHWANEQNLVV

SEQ ID NO: 2699856 - protein, 18 aa, Entamoeba histolytica
VTITICFNTVITVGLTGS

SEQ ID NO: 2699857 - protein, 26 aa, Entamoeba histolytica
VTIYFKNSRELLQFPIREKMFHSIVM

SEQ ID NO: 2699858 - protein, 25 aa, Entamoeba histolytica
VTKCGHAFCKKCLDDALNFNEKCPY

SEQ ID NO: 2699859 - protein, 32 aa, Entamoeba histolytica
VTKDEFSFIVDFLKEFPTVSSMKLSQEQIDEK

SEQ ID NO: 2699860 - protein, 24 aa, Entamoeba histolytica
VTKFLYQQVEPFILLKYQLEKDER

SEQ ID NO: 2699861 - protein, 28 aa, Entamoeba histolytica
VTKLLCGTEFFQYYAGMYDQFKIDGVSV

SEQ ID NO: 2699862 - protein, 17 aa, Entamoeba histolytica
VTKRANFLGERKPQQIN

SEQ ID NO: 2699863 - protein, 23 aa, Entamoeba histolytica
VTLELKNGFKYTGILDRCDRMMN

SEQ ID NO: 2699864 - protein, 19 aa, Entamoeba histolytica
VTLGPKGRTVIIDQPYGNA

SEQ ID NO: 2699865 - protein, 24 aa, Entamoeba histolytica
VTLHNCGWNSLYFNNHDQPRQVSR

SEQ ID NO: 2699866 - protein, 28 aa, Entamoeba histolytica
VTLLDFLVDICLDLGYFFETTRMRNSLS

SEQ ID NO: 2699867 - protein, 25 aa, Entamoeba histolytica
VTLLPRCYSELVDLPTPFICGISTY

SEQ ID NO: 2699868 - protein, 20 aa, Entamoeba histolytica
VTLPMCRRMATIARQMNVCE

SEQ ID NO: 2699869 - protein, 20 aa, Entamoeba histolytica
VTLPQRFQSISKFQHPYMQP

SEQ ID NO: 2699870 - protein, 18 aa, Entamoeba histolytica
VTLTPKLYYSLYIEIQTI

SEQ ID NO: 2699871 - protein, 18 aa, Entamoeba histolytica
VTLYKYWWDGLKEKVDIE

SEQ ID NO: 2699872 - protein, 24 aa, Entamoeba histolytica
VTMNAAMCALLFSGVDMKGIVVGM

SEQ ID NO: 2699873 - protein, 30 aa, Entamoeba histolytica
VTNFHYSWKNGLAFCALIHSFHPEAIDFNS

SEQ ID NO: 2699874 - protein, 21 aa, Entamoeba histolytica
VTNKKDLYCFIKKSVNGSTFM

SEQ ID NO: 2699875 - protein, 22 aa, Entamoeba histolytica
VTNKYTITYILKLNTECNNSGL

SEQ ID NO: 2699876 - protein, 22 aa, Entamoeba histolytica
VTNKYTITYILKLNTEGAANNG

SEQ ID NO: 2699877 - protein, 19 aa, Entamoeba histolytica
VTNQISMFFAFAAPMILCL

SEQ ID NO: 2699878 - protein, 22 aa, Entamoeba histolytica
VTNSFEWFKDCGDYFFNWFNMV

SEQ ID NO: 2699879 - protein, 18 aa, Entamoeba histolytica
VTNTFCSKNLPILASIRR

SEQ ID NO: 2699880 - protein, 18 aa, Entamoeba histolytica
VTNTLLFADFECFTSGEF

SEQ ID NO: 2699881 - protein, 18 aa, Entamoeba histolytica
VTPLLPLFDRFHKVSQTS

SEQ ID NO: 2699882 - protein, 21 aa, Entamoeba histolytica
VTPRSGVVCRICEATVLAEHL

SEQ ID NO: 2699883 - protein, 20 aa, Entamoeba histolytica
VTPSKFCSAISIPTDKGKAV

SEQ ID NO: 2699884 - protein, 19 aa, Entamoeba histolytica
VTQFFKFEHFILIEIFTQI

SEQ ID NO: 2699885 - protein, 25 aa, Entamoeba histolytica
VTQMKALEIIHRIMLDGPQQACTTR

SEQ ID NO: 2699886 - protein, 26 aa, Entamoeba histolytica
VTRCSSEKAIIIGVFKICVNRYRETT

SEQ ID NO: 2699887 - protein, 23 aa, Entamoeba histolytica
VTRFAPHIFRCYNPTKISPFIHF

SEQ ID NO: 2699888 - protein, 23 aa, Entamoeba histolytica
VTRIPAKIPFIKKIAKPIYNGAK

SEQ ID NO: 2699889 - protein, 17 aa, Entamoeba histolytica
VTRLSNLTSLKCGKISQ

SEQ ID NO: 2699890 - protein, 21 aa, Entamoeba histolytica
VTRQYLRVISIEFDDGRVIEC

SEQ ID NO: 2699891 - protein, 23 aa, Entamoeba histolytica
VTRTVSVKGYFAAGLVEKAMYTY

SEQ ID NO: 2699892 - protein, 28 aa, Entamoeba histolytica
VTSAPTFFKYFMAFIRKIVIENSDYLFV

SEQ ID NO: 2699893 - protein, 25 aa, Entamoeba histolytica
VTSFRWQYIKYLFKMSYNALHYTHL

SEQ ID NO: 2699894 - protein, 23 aa, Entamoeba histolytica
VTSGRIKLRLAYLEHPMALTEVN

SEQ ID NO: 2699895 - protein, 20 aa, Entamoeba histolytica
VTSRNCKRVVLQFPEGLISQ

SEQ ID NO: 2699896 - protein, 22 aa, Entamoeba histolytica
VTSYYPHCHHYPFDLTGVDPSR

SEQ ID NO: 2699897 - protein, 25 aa, Entamoeba histolytica
VTTEPIKQEETFGGQTIPKEKPTTQ

SEQ ID NO: 2699898 - protein, 18 aa, Entamoeba histolytica
VTTEPIKQEETVSGQTVP

SEQ ID NO: 2699899 - protein, 23 aa, Entamoeba histolytica
VTTEPYIKWDYDFRIQKIGDHYR

SEQ ID NO: 2699900 - protein, 24 aa, Entamoeba histolytica
VTTHRIPKEFIFFIDEIGYQLTPT

SEQ ID NO: 2699901 - protein, 31 aa, Entamoeba histolytica; identical to SEQ ID NO: 2509253

SEQ ID NO: 2699902 - protein, 24 aa, Entamoeba histolytica
VTTNKSGLWLGFEIECSECKKVFT

SEQ ID NO: 2699903 - protein, 24 aa, Entamoeba histolytica
VTTPERLLELLGILFDPTIPEGML

SEQ ID NO: 2699904 - protein, 17 aa, Entamoeba histolytica
VTVCIIGNNLIDFKDVL

SEQ ID NO: 2699905 - protein, 20 aa, Entamoeba histolytica
VTVDIPIYHYFTGCQEEIEI

SEQ ID NO: 2699906 - protein, 19 aa, Entamoeba histolytica
VTVEVCIRSTNTLIPDMLL

SEQ ID NO: 2699907 - protein, 19 aa, Entamoeba histolytica
VTVGVCFMKGVGVKKDVNA

SEQ ID NO: 2699908 - protein, 18 aa, Entamoeba histolytica
VTVMWDWPKESIQRLNNV

SEQ ID NO: 2699909 - protein, 17 aa, Entamoeba histolytica
VTWCGPCKMISPIFIEL

SEQ ID NO: 2699910 - protein, 20 aa, Entamoeba histolytica
VTYAPLLIRCMAFLLRCRLL

SEQ ID NO: 2699911 - protein, 26 aa, Entamoeba histolytica
VTYEKPRRRFSLSIKKGSRSSSRKRE

SEQ ID NO: 2699912 - protein, 26 aa, Entamoeba histolytica
VTYSFMPPRSFNIVFQPPLRIIKKQK

SEQ ID NO: 2699913 - protein, 19 aa, Entamoeba histolytica
VVALPRSGSTFTHTLLSAD

SEQ ID NO: 2699914 - protein, 18 aa, Entamoeba histolytica
VVANVFKKFLREMKEKVF

SEQ ID NO: 2699915 - protein, 20 aa, Entamoeba histolytica
VVAPTITVPLFFNDSESPFM

SEQ ID NO: 2699916 - protein, 20 aa, Entamoeba histolytica
VVATRFIRQLGLYSYENDQH

SEQ ID NO: 2699917 - protein, 27 aa, Entamoeba histolytica
VVCEKYILKPCRFLRLREKEQVEFPCI

SEQ ID NO: 2699918 - protein, 17 aa, Entamoeba histolytica
VVCGFDYIINQLKQLNN

SEQ ID NO: 2699919 - protein, 26 aa, Entamoeba histolytica
VVCKSCIKPFPPFIEDKWYCHSIEFS

SEQ ID NO: 2699920 - protein, 18 aa, Entamoeba histolytica
VVCPKIIIEPSIITIDQI

SEQ ID NO: 2699921 - protein, 24 aa, Entamoeba histolytica
VVCPSINGGLIYCIGVLPKPIKCK

SEQ ID NO: 2699922 - protein, 17 aa, Entamoeba histolytica
VVCSFPVAGEAFKCRIC

SEQ ID NO: 2699923 - protein, 29 aa, Entamoeba histolytica
VVCVDCNTNSSLIFFDFIDIVIDLRSDYS

SEQ ID NO: 2699924 - protein, 23 aa, Entamoeba histolytica
VVDCIRMEVSYMRMFHHPNIISF

SEQ ID NO: 2699925 - protein, 20 aa, Entamoeba histolytica
VVDGIVWWCTPYDFVKSFNI

SEQ ID NO: 2699926 - protein, 18 aa, Entamoeba histolytica
VVDHETREILPIGLAGEL

SEQ ID NO: 2699927 - protein, 31 aa, Entamoeba histolytica
VVDRLKKRPSFILFIKYYFNHVLQLEINETS

SEQ ID NO: 2699928 - protein, 18 aa, Entamoeba histolytica
VVDSANWKINDVNYVLAI

SEQ ID NO: 2699929 - protein, 20 aa, Entamoeba histolytica
VVEEAFRVLIKMEPNDHFGI

SEQ ID NO: 2699930 - protein, 30 aa, Entamoeba histolytica
VVEGLDYNEYIDWWGLGILIYEMLFTQSPF

SEQ ID NO: 2699931 - protein, 17 aa, Entamoeba histolytica
VVEKCGINNIPIVSEQW

SEQ ID NO: 2699932 - protein, 24 aa, Entamoeba histolytica
VVEKSGYQSYPWVRYMTFAGDYCF

SEQ ID NO: 2699933 - protein, 18 aa, Entamoeba histolytica
VVELGKEKEEEIAMLIGG

SEQ ID NO: 2699934 - protein, 33 aa, Entamoeba histolytica
VVELMKYNGGYNWWKRNSLTVFIDKKLYKDPEE

SEQ ID NO: 2699935 - protein, 22 aa, Entamoeba histolytica
VVEMVVRISFIYSQILTLWEVK

SEQ ID NO: 2699936 - protein, 24 aa, Entamoeba histolytica
VVEMWKKQEIIDGFIDLDGMSVGA

SEQ ID NO: 2699937 - protein, 24 aa, Entamoeba histolytica
VVEPRGSNGFGFDSCFVPEGYDKT

SEQ ID NO: 2699938 - protein, 19 aa, Entamoeba histolytica
VVEQLMVLVRLCLLHGQIY

SEQ ID NO: 2699939 - protein, 20 aa, Entamoeba histolytica
VVEVYLKLGKEIGNIEEKRF

SEQ ID NO: 2699940 - protein, 17 aa, Entamoeba histolytica
VVEYCKFINSLTLPLSI

SEQ ID NO: 2699941 - protein, 23 aa, Entamoeba histolytica
VVFASAIDGWGFDLVAISEIYAK

SEQ ID NO: 2699942 - protein, 17 aa, Entamoeba histolytica
VVFRQKYTVFVIDHSKR

SEQ ID NO: 2699943 - protein, 17 aa, Entamoeba histolytica
VVFWEILTKGIIPYSSI

SEQ ID NO: 2699944 - protein, 19 aa, Entamoeba histolytica
VVGGHEVHIPSFLKKKQLQ

SEQ ID NO: 2699945 - protein, 20 aa, Entamoeba histolytica
VVGGRLVFWFPSIFPEDRGK

SEQ ID NO: 2699946 - protein, 17 aa, Entamoeba histolytica
VVGISFYHVESFEIKAV

SEQ ID NO: 2699947 - protein, 19 aa, Entamoeba histolytica
VVGNGFLILYSIISKQSFV

SEQ ID NO: 2699948 - protein, 17 aa, Entamoeba histolytica
VVHEILLFLYHSLLFEN

SEQ ID NO: 2699949 - protein, 17 aa, Entamoeba histolytica
VVHIRFRVGSISECSNI

SEQ ID NO: 2699950 - protein, 26 aa, Entamoeba histolytica
VVHPKTNCVICFNMSIYFQSDEIVER

SEQ ID NO: 2699951 - protein, 24 aa, Entamoeba histolytica
VVIDARGSIPGWLAGTAKKDDAGR

SEQ ID NO: 2699952 - protein, 19 aa, Entamoeba histolytica
VVILRCKWQSVPSGYSIYV

SEQ ID NO: 2699953 - protein, 29 aa, Entamoeba histolytica
VVINPYKFFPIYTPFIVSKYQGRRREDVA

SEQ ID NO: 2699954 - protein, 17 aa, Entamoeba histolytica
VVIPIMLKRSQFKVQLF

SEQ ID NO: 2699955 - protein, 19 aa, Entamoeba histolytica
VVIQMEYCSGSNLSRIIES

SEQ ID NO: 2699956 - protein, 17 aa, Entamoeba histolytica
VVITEKWILVDEKEKGK

SEQ ID NO: 2699957 - protein, 17 aa, Entamoeba histolytica
VVKCFKSGRFIEDIDKL

SEQ ID NO: 2699958 - protein, 22 aa, Entamoeba histolytica
VVKELWKKYDKDHHADEVVKEE

SEQ ID NO: 2699959 - protein, 20 aa, Entamoeba histolytica
VVKNSCVWLNSALSGKTKRV

SEQ ID NO: 2699960 - protein, 23 aa, Entamoeba histolytica
VVKVRLHTGYGFVDFENAAAREK

SEQ ID NO: 2699961 - protein, 32 aa, Entamoeba histolytica; identical to SEQ ID NO: 2509311

SEQ ID NO: 2699962 - protein, 17 aa, Entamoeba histolytica
VVLCKITIPTSVSEIGY

SEQ ID NO: 2699963 - protein, 17 aa, Entamoeba histolytica
VVLEGLKMMPPENVTLL

SEQ ID NO: 2699964 - protein, 25 aa, Entamoeba histolytica
VVLELPRPLLTPGYEAVIHIHTSQE

SEQ ID NO: 2699965 - protein, 20 aa, Entamoeba histolytica
VVLKCYKHSIFFFEDETRCS

SEQ ID NO: 2699966 - protein, 21 aa, Entamoeba histolytica
VVLKPKVKTGVLPHKRKGGLK

SEQ ID NO: 2699967 - protein, 38 aa, Entamoeba histolytica
VVLLREVCREFGIPETLRLEIWKLFLQPKKEIVEEKTT

SEQ ID NO: 2699968 - protein, 18 aa, Entamoeba histolytica
VVLQFPEGLISQGVGLQQ

SEQ ID NO: 2699969 - protein, 17 aa, Entamoeba histolytica
VVLSYFISLPNEVLQVI

SEQ ID NO: 2699970 - protein, 17 aa, Entamoeba histolytica
VVLYVFFNTKIQNEISE

SEQ ID NO: 2699971 - protein, 17 aa, Entamoeba histolytica
VVMGLPYSHPIDMWSLG

SEQ ID NO: 2699972 - protein, 20 aa, Entamoeba histolytica
VVMSFDLKTRAIRFGAYKNQ

SEQ ID NO: 2699973 - protein, 23 aa, Entamoeba histolytica
VVNEIRPDLSPVLNKFLNYQVIY

SEQ ID NO: 2699974 - protein, 30 aa, Entamoeba histolytica
VVNKCKHIFCSYCAQKAWLNGNYKCPLCQI

SEQ ID NO: 2699975 - protein, 17 aa, Entamoeba histolytica
VVPLLELCLKRKRPLVV

SEQ ID NO: 2699976 - protein, 18 aa, Entamoeba histolytica
VVPQCINFLSKFVGNDLY

SEQ ID NO: 2699977 - protein, 18 aa, Entamoeba histolytica
VVPVKALPPKPSQKEVDE

SEQ ID NO: 2699978 - protein, 25 aa, Entamoeba histolytica
VVRREWCPLSKEIGYYCIDLILSDP

SEQ ID NO: 2699979 - protein, 19 aa, Entamoeba histolytica
VVSAIVLKAIEIEIQRRLN

SEQ ID NO: 2699980 - protein, 18 aa, Entamoeba histolytica
VVSCGYCNEGSQHVYPFE

SEQ ID NO: 2699981 - protein, 25 aa, Entamoeba histolytica
VVSGSIEALIRWAVNPNIDNNIKFI

SEQ ID NO: 2699982 - protein, 25 aa, Entamoeba histolytica
VVSKFVVNCLQPFYDNGKIQDRDRF

SEQ ID NO: 2699983 - protein, 24 aa, Entamoeba histolytica
VVSKTCPLLKCEKQLIPKANNEII

SEQ ID NO: 2699984 - protein, 27 aa, Entamoeba histolytica
VVSLFLFEFLRVFQCQLVIPIHVVCNE

SEQ ID NO: 2699985 - protein, 26 aa, Entamoeba histolytica
VVSLLMKGKCLSSYAVTATLRKNLSN

SEQ ID NO: 2699986 - protein, 18 aa, Entamoeba histolytica
VVSMLAEVLSIICMSLSK

SEQ ID NO: 2699987 - protein, 17 aa, Entamoeba histolytica
VVSMSGTEFYTCKEGVL

SEQ ID NO: 2699988 - protein, 18 aa, Entamoeba histolytica
VVTLPCESLTGYKRMNKS

SEQ ID NO: 2699989 - protein, 24 aa, Entamoeba histolytica
VVVDCGYGMCQVVPIYNGYMMEHA

SEQ ID NO: 2699990 - protein, 25 aa, Entamoeba histolytica
VVVELPYVRRIYGVDELIEIKRKQD

SEQ ID NO: 2699991 - protein, 19 aa, Entamoeba histolytica
VVVINSFFLIKKSRELWIP

SEQ ID NO: 2699992 - protein, 24 aa, Entamoeba histolytica
VVVPHKMLRIYSGFYDIYGEDEEF

SEQ ID NO: 2699993 - protein, 18 aa, Entamoeba histolytica
VVWEFNRLNITYTVMSKR

SEQ ID NO: 2699994 - protein, 19 aa, Entamoeba histolytica
VVYCQYLDKLARLFDYLWK

SEQ ID NO: 2699995 - protein, 17 aa, Entamoeba histolytica
VVYDITKKTSFESVEKW

SEQ ID NO: 2699996 - protein, 19 aa, Entamoeba histolytica
VVYEVCKKVNEFIDEEAAK

SEQ ID NO: 2699997 - protein, 18 aa, Entamoeba histolytica
VWDRKKKKFVMASGGLDQ

SEQ ID NO: 2699998 - protein, 25 aa, Entamoeba histolytica
VWDVQYCPLEYYMLSSSYDKTARLW

SEQ ID NO: 2699999 - protein, 20 aa, Entamoeba histolytica
VWFEPKDVWEIKGADLSLSL

SEQ ID NO: 2700000 - protein, 19 aa, Entamoeba histolytica
VWNEYYFRNASNILRVPQT

SEQ ID NO: 2700001 - protein, 26 aa, Entamoeba histolytica
VWQMKEFKRKILSIMCKCINDEELDE

SEQ ID NO: 2700002 - protein, 22 aa, Entamoeba histolytica
VWRQCCYLCPSPLNKCKIDDVI

SEQ ID NO: 2700003 - protein, 19 aa, Entamoeba histolytica
VWSLGILLFKCFTSQYPFE

SEQ ID NO: 2700004 - protein, 19 aa, Entamoeba histolytica
VWVQCLVDLHFLMIQEILN

SEQ ID NO: 2700005 - protein, 28 aa, Entamoeba histolytica
VWVQVACPRLSIDWGEDFRQVLITPYEA

SEQ ID NO: 2700006 - protein, 20 aa, Entamoeba histolytica
VWYLANSRLRHSLTGHSGKV

SEQ ID NO: 2700007 - protein, 20 aa, Entamoeba histolytica
VYCCDTFGFQLYEGKQIECY

SEQ ID NO: 2700008 - protein, 22 aa, Entamoeba histolytica
VYDCGNEMFMWKGKKCSRKEWE

SEQ ID NO: 2700009 - protein, 20 aa, Entamoeba histolytica
VYDCLIKYASYRQYRIPIVF

SEQ ID NO: 2700010 - protein, 23 aa, Entamoeba histolytica
VYDEFRIKMKLFHNSPIIELNEI

SEQ ID NO: 2700011 - protein, 23 aa, Entamoeba histolytica
VYDKQFCEIFKKNVLNLVNDLKT

SEQ ID NO: 2700012 - protein, 23 aa, Entamoeba histolytica
VYDLCKRKTKLLLAVAKKKKSME

SEQ ID NO: 2700013 - protein, 29 aa, Entamoeba histolytica
VYEAKAGIHGIVYPYTWIFNGVNKLVFTD

SEQ ID NO: 2700014 - protein, 17 aa, Entamoeba histolytica
VYEGLYWILFKNQSNDF

SEQ ID NO: 2700015 - protein, 25 aa, Entamoeba histolytica
VYEITETFLSSGFYTGCEVPSVSEL

SEQ ID NO: 2700016 - protein, 19 aa, Entamoeba histolytica
VYEKGCDFDKMIKIIQERN

SEQ ID NO: 2700017 - protein, 18 aa, Entamoeba histolytica
VYEPPPGYSVFMEQKTEQ

SEQ ID NO: 2700018 - protein, 18 aa, Entamoeba histolytica
VYESEQFQVAKKEGEKKT

SEQ ID NO: 2700019 - protein, 17 aa, Entamoeba histolytica
VYFIWCGHFITQQIDVI

SEQ ID NO: 2700020 - protein, 21 aa, Entamoeba histolytica
VYFMKGSLPWQGIKGKKVDKN

SEQ ID NO: 2700021 - protein, 20 aa, Entamoeba histolytica
VYFRGADCAIIVYDVTRRET

SEQ ID NO: 2700022 - protein, 22 aa, Entamoeba histolytica
VYGRELKVNWSYTAQQENQGNY

SEQ ID NO: 2700023 - protein, 17 aa, Entamoeba histolytica
VYKCCGMNGVPTMENLK

SEQ ID NO: 2700024 - protein, 20 aa, Entamoeba histolytica
VYKGEMVLEGIGERISQWVK

SEQ ID NO: 2700025 - protein, 23 aa, Entamoeba histolytica
VYKRGIKYVMHFGEELPTSLSLT

SEQ ID NO: 2700026 - protein, 21 aa, Entamoeba histolytica
VYKYLKYLLSNTCRYCTSEFS

SEQ ID NO: 2700027 - protein, 25 aa, Entamoeba histolytica
VYLREFLKRIFDAIHAQQQLNLPKT

SEQ ID NO: 2700028 - protein, 25 aa, Entamoeba histolytica
VYLSQWNFDECIKIHDNVRHLLNKN

SEQ ID NO: 2700029 - protein, 19 aa, Entamoeba histolytica
VYNEFRLTVDAVIERYLQI

SEQ ID NO: 2700030 - protein, 25 aa, Entamoeba histolytica
VYNKICITVGLGFDSFVVMRHGDSS

SEQ ID NO: 2700031 - protein, 21 aa, Entamoeba histolytica
VYNLTAGKTLPQWLSQKKKKE

SEQ ID NO: 2700032 - protein, 18 aa, Entamoeba histolytica
VYNTIHLFHHFFPCANVF

SEQ ID NO: 2700033 - protein, 17 aa, Entamoeba histolytica
VYPHFLGQDILRLQGIF

SEQ ID NO: 2700034 - protein, 17 aa, Entamoeba histolytica
VYQFCRTFVLILSPNPI

SEQ ID NO: 2700035 - protein, 25 aa, Entamoeba histolytica
VYQHIKRLSVQNVIATIGRCTIIDI

SEQ ID NO: 2700036 - protein, 20 aa, Entamoeba histolytica
VYQIKTRLLFPMTSYYSTLL

SEQ ID NO: 2700037 - protein, 18 aa, Entamoeba histolytica
VYQLIPFQPLIKTQAKYH

SEQ ID NO: 2700038 - protein, 37 aa, Entamoeba histolytica
VYRKMFIKHLWEVFTTSLFNFLWPPIIERNEGDVVFE

SEQ ID NO: 2700039 - protein, 25 aa, Entamoeba histolytica
VYRSKCGKYAIKRCNSQRLASTLRE

SEQ ID NO: 2700040 - protein, 23 aa, Entamoeba histolytica
VYSFAITAWEIFYQDEPYKEFKS

SEQ ID NO: 2700041 - protein, 17 aa, Entamoeba histolytica
VYSIYQCCDKCFNTTDT

SEQ ID NO: 2700042 - protein, 17 aa, Entamoeba histolytica
VYTMVFLGVNGVGKSTS

SEQ ID NO: 2700043 - protein, 25 aa, Entamoeba histolytica
VYVISIAPGELWKTLYSNLILFLNH

SEQ ID NO: 2700044 - protein, 24 aa, Entamoeba histolytica
VYWEHKKGWAVGGINGRYGMFPLA

SEQ ID NO: 2700045 - protein, 19 aa, Entamoeba histolytica
VYWGKAKVIEAVFLDDVYI

SEQ ID NO: 2700046 - protein, 20 aa, Entamoeba histolytica
VYWKLVWQINALTGWGKTIN

SEQ ID NO: 2700047 - protein, 20 aa, Entamoeba histolytica
VYWKLVWQINALTGWSKTIN

SEQ ID NO: 2700048 - protein, 18 aa, Entamoeba histolytica
VYYNGALGGLVMCDVTNN

SEQ ID NO: 2700049 - protein, 17 aa, Entamoeba histolytica
WAEEIVRYHSEELKKAG

SEQ ID NO: 2700050 - protein, 21 aa, Entamoeba histolytica
WAFGCVVAEMVMRKPLFRGDN

SEQ ID NO: 2700051 - protein, 17 aa, Entamoeba histolytica
WAIPAIHRTGLLGRFSP

SEQ ID NO: 2700052 - protein, 17 aa, Entamoeba histolytica
WAKGIECNFETFTYQSV

SEQ ID NO: 2700053 - protein, 17 aa, Entamoeba histolytica
WAKIIGLGCKTYGVFCF

SEQ ID NO: 2700054 - protein, 19 aa, Entamoeba histolytica
WANAMAKAFNGEKIEKLLE

SEQ ID NO: 2700055 - protein, 17 aa, Entamoeba histolytica
WANVQLSGAYVINDVET

SEQ ID NO: 2700056 - protein, 24 aa, Entamoeba histolytica
WAPNIPWFRDYIPTVIQAKKKTRE

SEQ ID NO: 2700057 - protein, 26 aa, Entamoeba histolytica
WCANDAKLFRKFLREAAIKNPKNALP

SEQ ID NO: 2700058 - protein, 19 aa, Entamoeba histolytica
WCCDVLLFVIRLLKEAKGI

SEQ ID NO: 2700059 - protein, 22 aa, Entamoeba histolytica
WCDRRIKLLDKVSCTLAKAYLG

SEQ ID NO: 2700060 - protein, 17 aa, Entamoeba histolytica
WCFCNICRSVSKQYNID

SEQ ID NO: 2700061 - protein, 17 aa, Entamoeba histolytica
WCFYGCGCEELLKKNAR

SEQ ID NO: 2700062 - protein, 18 aa, Entamoeba histolytica
WCGIACASLEFKLYSEAL

SEQ ID NO: 2700063 - protein, 17 aa, Entamoeba histolytica
WCGLVCHQCCVRKAPIQ

SEQ ID NO: 2700064 - protein, 20 aa, Entamoeba histolytica
WCGNLIVVEFSETIESKRNR

SEQ ID NO: 2700065 - protein, 21 aa, Entamoeba histolytica
WCGPCKMISPIFIELAQDYPL

SEQ ID NO: 2700066 - protein, 24 aa, Entamoeba histolytica
WCISRQLWWGHRIPAYLIKSKKEK

SEQ ID NO: 2700067 - protein, 25 aa, Entamoeba histolytica
WCLKVPGYYPSWFVGIRQKDSHELI

SEQ ID NO: 2700068 - protein, 18 aa, Entamoeba histolytica
WCQNKFVRLCIGNQLTET

SEQ ID NO: 2700069 - protein, 23 aa, Entamoeba histolytica
WCQNKYIRLCIGKDFTQDKMIEF

SEQ ID NO: 2700070 - protein, 17 aa, Entamoeba histolytica
WCSMIERYIFYPFFLVT

SEQ ID NO: 2700071 - protein, 17 aa, Entamoeba histolytica
WDAIFAFGHQLKLVDSL

SEQ ID NO: 2700072 - protein, 20 aa, Entamoeba histolytica
WDASDPWISQILSLQQTNNQ

SEQ ID NO: 2700073 - protein, 17 aa, Entamoeba histolytica
WDCSCDIELLQLIIENG

SEQ ID NO: 2700074 - protein, 18 aa, Entamoeba histolytica
WDDNKFIIRQNVTPKQLS

SEQ ID NO: 2700075 - protein, 20 aa, Entamoeba histolytica
WDELEMAKVISVLETVDSPF

SEQ ID NO: 2700076 - protein, 25 aa, Entamoeba histolytica
WDESNICDNCVPLTVNTSRAGIGSS

SEQ ID NO: 2700077 - protein, 23 aa, Entamoeba histolytica
WDFKHDIGHGVGHYSFVHEYPPM

SEQ ID NO: 2700078 - protein, 20 aa, Entamoeba histolytica
WDFVSFYPKYTKLIFTLFCN

SEQ ID NO: 2700079 - protein, 21 aa, Entamoeba histolytica
WDFVSFYPKYTKLIFTLFCNI

SEQ ID NO: 2700080 - protein, 21 aa, Entamoeba histolytica
WDGTCCTLVRSHFQKSVTTFC

SEQ ID NO: 2700081 - protein, 20 aa, Entamoeba histolytica
WDINDGFAVCVLMKKTADQS

SEQ ID NO: 2700082 - protein, 23 aa, Entamoeba histolytica
WDKKPFNCITCLNHIPSCSCPTL

SEQ ID NO: 2700083 - protein, 18 aa, Entamoeba histolytica
WDKLEFDGNCTIEQFCQE

SEQ ID NO: 2700084 - protein, 23 aa, Entamoeba histolytica
WDLINGLHPILFFTRDDYHDKDL

SEQ ID NO: 2700085 - protein, 17 aa, Entamoeba histolytica
WDLVAYRIKFFPHPVTG

SEQ ID NO: 2700086 - protein, 24 aa, Entamoeba histolytica
WDMAHSRCKLSCPTGSAVSGLTLM

SEQ ID NO: 2700087 - protein, 21 aa, Entamoeba histolytica
WDNFVKLVYERGILCEILGNE

SEQ ID NO: 2700088 - protein, 17 aa, Entamoeba histolytica
WDNMTLLVVKFKSFNPQ

SEQ ID NO: 2700089 - protein, 20 aa, Entamoeba histolytica
WDPMGLFLGAVRSYLYSPHA

SEQ ID NO: 2700090 - protein, 22 aa, Entamoeba histolytica
WDRLGYLCNIFQVPLRPMQLQI

SEQ ID NO: 2700091 - protein, 17 aa, Entamoeba histolytica
WDSLVSISFNKINFTEI

SEQ ID NO: 2700092 - protein, 17 aa, Entamoeba histolytica
WDTKTFCSHCAYSKAGI

SEQ ID NO: 2700093 - protein, 26 aa, Entamoeba histolytica
WDTLSALKFSFCSEKFNLHKFVIQNN

SEQ ID NO: 2700094 - protein, 18 aa, Entamoeba histolytica
WDTRGFIIHSCELGELLQ

SEQ ID NO: 2700095 - protein, 19 aa, Entamoeba histolytica
WDWVNEKVQGYGLHVDNPS

SEQ ID NO: 2700096 - protein, 19 aa, Entamoeba histolytica
WDYRYSGIEKKECGGKIIR

SEQ ID NO: 2700097 - protein, 18 aa, Entamoeba histolytica
WEASKCVQCNMCSLYCPH

SEQ ID NO: 2700098 - protein, 20 aa, Entamoeba histolytica
WECLIPGKKGTIWENGYYPV

SEQ ID NO: 2700099 - protein, 24 aa, Entamoeba histolytica
WEEAWEIIQKGFTLRHTSATLSND

SEQ ID NO: 2700100 - protein, 20 aa, Entamoeba histolytica
WEEEERKRLFQINPYSQQGP

SEQ ID NO: 2700101 - protein, 20 aa, Entamoeba histolytica
WEEVKGVFFSSRWTPYRRAE

SEQ ID NO: 2700102 - protein, 17 aa, Entamoeba histolytica
WEIKGADLSLSLQYKAG

SEQ ID NO: 2700103 - protein, 25 aa, Entamoeba histolytica
WEILKQLRPGMSLERITMPTHVMEP

SEQ ID NO: 2700104 - protein, 17 aa, Entamoeba histolytica
WEINGKITYALEGTVMT

SEQ ID NO: 2700105 - protein, 20 aa, Entamoeba histolytica
WEISLMNSIVCKRLHELNNE

SEQ ID NO: 2700106 - protein, 25 aa, Entamoeba histolytica
WEKEFKKCLNLIFLNSFSVEGQNLK

SEQ ID NO: 2700107 - protein, 17 aa, Entamoeba histolytica
WEKKSLVTTSCIEDGYY

SEQ ID NO: 2700108 - protein, 23 aa, Entamoeba histolytica
WELFERRCRELPTADILGYKTKQ

SEQ ID NO: 2700109 - protein, 21 aa, Entamoeba histolytica
WENAIHWDVPVKITAKEMIEP

SEQ ID NO: 2700110 - protein, 20 aa, Entamoeba histolytica
WENYFYKFLPPFPRHLIQPH

SEQ ID NO: 2700111 - protein, 22 aa, Entamoeba histolytica
WEPRTCSTFRDISFGSPCNCIA

SEQ ID NO: 2700112 - protein, 21 aa, Entamoeba histolytica
WEQLRAIAICNVFDQYDVINA

SEQ ID NO: 2700113 - protein, 22 aa, Entamoeba histolytica
WEQLRAIAICNVFDQYDVINAV

SEQ ID NO: 2700114 - protein, 28 aa, Entamoeba histolytica
WERLRLLRKRIPNILFQMLLRGRNAVGY

SEQ ID NO: 2700115 - protein, 22 aa, Entamoeba histolytica
WERRISMVTTMAFIKNGQFEDA

SEQ ID NO: 2700116 - protein, 21 aa, Entamoeba histolytica
WESSHFNLLQVMGLQVQSTEQ

SEQ ID NO: 2700117 - protein, 18 aa, Entamoeba histolytica
WETLASTLKRFVRELPGM

SEQ ID NO: 2700118 - protein, 30 aa, Entamoeba histolytica
WETTSGTLLKEFRRGMNPAHVYCVALSDDG

SEQ ID NO: 2700119 - protein, 20 aa, Entamoeba histolytica
WEVLSGISISSDFECVYRKK

SEQ ID NO: 2700120 - protein, 18 aa, Entamoeba histolytica
WFADLFIDVFPVRLVIRI

SEQ ID NO: 2700121 - protein, 21 aa, Entamoeba histolytica
WFEETELSKTVSYIFNEPIYY

SEQ ID NO: 2700122 - protein, 17 aa, Entamoeba histolytica
WFGGILLGPDRFKDIIM

SEQ ID NO: 2700123 - protein, 17 aa, Entamoeba histolytica
WFGKLSLFDCSRSLEYL

SEQ ID NO: 2700124 - protein, 26 aa, Entamoeba histolytica
WFIHSLKFELAIRVFDVILLEGFTAM

SEQ ID NO: 2700125 - protein, 17 aa, Entamoeba histolytica
WFKGGDDGVRWISKRCE

SEQ ID NO: 2700126 - protein, 19 aa, Entamoeba histolytica
WFMEQGVKSFLAIRQYYPS

SEQ ID NO: 2700127 - protein, 21 aa, Entamoeba histolytica
WFMTKQGFIWSTLLQTLINIE

SEQ ID NO: 2700128 - protein, 20 aa, Entamoeba histolytica
WFPFPDHHNPSLIVLCHIVD

SEQ ID NO: 2700129 - protein, 26 aa, Entamoeba histolytica
WFPPQWKVNFAKRLPIGNVKKYPPGN

SEQ ID NO: 2700130 - protein, 20 aa, Entamoeba histolytica
WFTQLCKKDSIQLVSIPIGG

SEQ ID NO: 2700131 - protein, 22 aa, Entamoeba histolytica
WFVYCKSSLVPKVKQIISLMII

SEQ ID NO: 2700132 - protein, 24 aa, Entamoeba histolytica
WFYKDGKEVIGYVFMRKLVSALSV

SEQ ID NO: 2700133 - protein, 27 aa, Entamoeba histolytica
WFYKSTPSLFCVQSFCHISTNKQCYIN

SEQ ID NO: 2700134 - protein, 23 aa, Entamoeba histolytica
WGAMPQRVLNCLDDVRDEMWKLG

SEQ ID NO: 2700135 - protein, 19 aa, Entamoeba histolytica
WGEKRIRSTNELNINSEVI

SEQ ID NO: 2700136 - protein, 18 aa, Entamoeba histolytica
WGLELSERQIEIICENEN

SEQ ID NO: 2700137 - protein, 21 aa, Entamoeba histolytica
WGLLIKYVILKGGKVEILCPR

SEQ ID NO: 2700138 - protein, 17 aa, Entamoeba histolytica
WGMEYKGMLVSRDAYMN

SEQ ID NO: 2700139 - protein, 19 aa, Entamoeba histolytica
WGQILKFIGGYLKVNTETP

SEQ ID NO: 2700140 - protein, 21 aa, Entamoeba histolytica
WGRDKPCLVSSLSELENGPYA

SEQ ID NO: 2700141 - protein, 19 aa, Entamoeba histolytica
WGTLGYIVGEIWDSASNIN

SEQ ID NO: 2700142 - protein, 18 aa, Entamoeba histolytica
WGVASCKAAEIAIDTVFS

SEQ ID NO: 2700143 - protein, 21 aa, Entamoeba histolytica
WGVFQECHKVWAKTKEVALAW

SEQ ID NO: 2700144 - protein, 26 aa, Entamoeba histolytica
WGVMPKRVIDCLAEVKKSMWELGIPV

SEQ ID NO: 2700145 - protein, 17 aa, Entamoeba histolytica
WGVTSARAAHIAVETVL

SEQ ID NO: 2700146 - protein, 18 aa, Entamoeba histolytica
WGVWGQVLGSSYVSKEAS

SEQ ID NO: 2700147 - protein, 24 aa, Entamoeba histolytica
WGYGIRYQYGMFKQGIVGGYQVEM

SEQ ID NO: 2700148 - protein, 21 aa, Entamoeba histolytica
WGYGIRYQYGMFKQQISHGYQ

SEQ ID NO: 2700149 - protein, 23 aa, Entamoeba histolytica
WGYGIRYQYGMFKQQISHGYQIE

SEQ ID NO: 2700150 - protein, 25 aa, Entamoeba histolytica
WHAKRCHMKEMWGVKIADERNDKGL

SEQ ID NO: 2700151 - protein, 23 aa, Entamoeba histolytica
WHEFTKRKLEVFKLSEKAIPIYG

SEQ ID NO: 2700152 - protein, 18 aa, Entamoeba histolytica
WHGLLSLTHMILLYYFPD

SEQ ID NO: 2700153 - protein, 17 aa, Entamoeba histolytica
WHPERKFVKKLTNQTRY

SEQ ID NO: 2700154 - protein, 19 aa, Entamoeba histolytica
WHQVRYMVGALFAIGQGAN

SEQ ID NO: 2700155 - protein, 17 aa, Entamoeba histolytica
WHRRTKYYAQGKTKEKI

SEQ ID NO: 2700156 - protein, 19 aa, Entamoeba histolytica
WHSGMEFEEALELMKKCIK

SEQ ID NO: 2700157 - protein, 22 aa, Entamoeba histolytica
WHSKVDLPFRVVIIGAGGCTLT

SEQ ID NO: 2700158 - protein, 17 aa, Entamoeba histolytica
WHYLIRKLIKQAHPQEL

SEQ ID NO: 2700159 - protein, 20 aa, Entamoeba histolytica
WIAEEICIICTGETYKNIAN

SEQ ID NO: 2700160 - protein, 17 aa, Entamoeba histolytica
WIAICAFAAQTRSAYQM

SEQ ID NO: 2700161 - protein, 17 aa, Entamoeba histolytica
WIALCAFAAQTRTAYQL

SEQ ID NO: 2700162 - protein, 19 aa, Entamoeba histolytica
WIALCQLVLDLVYKAVDNP

SEQ ID NO: 2700163 - protein, 21 aa, Entamoeba histolytica
WICRGDMGVQLGFVGMAKFVR

SEQ ID NO: 2700164 - protein, 19 aa, Entamoeba histolytica
WIDVQLRWGDFDQHNIESY

SEQ ID NO: 2700165 - protein, 17 aa, Entamoeba histolytica
WIEEKCKPFPTDPIIPY

SEQ ID NO: 2700166 - protein, 17 aa, Entamoeba histolytica
WIELQLMSPTSNTLQPL

SEQ ID NO: 2700167 - protein, 25 aa, Entamoeba histolytica
WIERLNGQCCWFEVIINGVVRIPKL

SEQ ID NO: 2700168 - protein, 17 aa, Entamoeba histolytica
WIEVILGEYIEYYYNKS

SEQ ID NO: 2700169 - protein, 20 aa, Entamoeba histolytica
WIGIKSCLLTSTPMVASIQY

SEQ ID NO: 2700170 - protein, 17 aa, Entamoeba histolytica
WIGYSVHGEQCTTNNAL

SEQ ID NO: 2700171 - protein, 17 aa, Entamoeba histolytica
WIKKDAGHFIFTLINHQ

SEQ ID NO: 2700172 - protein, 17 aa, Entamoeba histolytica
WINIEMDKVRTLREQSD

SEQ ID NO: 2700173 - protein, 18 aa, Entamoeba histolytica
WINQGLVKYCQPQKLIIR

SEQ ID NO: 2700174 - protein, 21 aa, Entamoeba histolytica
WIPEILNLPLLNTIKLNNCEC

SEQ ID NO: 2700175 - protein, 17 aa, Entamoeba histolytica
WIPQRERVDDYTKQEMK

SEQ ID NO: 2700176 - protein, 23 aa, Entamoeba histolytica
WIPSECIKYGMYRDFTTNRVEGF

SEQ ID NO: 2700177 - protein, 18 aa, Entamoeba histolytica
WIRNCFFGDVDIANVIIK

SEQ ID NO: 2700178 - protein, 17 aa, Entamoeba histolytica
WISGEWNELTAGGCFNS

SEQ ID NO: 2700179 - protein, 19 aa, Entamoeba histolytica
WISHFPVNIFNSSLNFLRM

SEQ ID NO: 2700180 - protein, 18 aa, Entamoeba histolytica
WISSGLFSSKKLLEVIES

SEQ ID NO: 2700181 - protein, 17 aa, Entamoeba histolytica
WIVAPIVKTTTRIIKDN

SEQ ID NO: 2700182 - protein, 23 aa, Entamoeba histolytica
WIVLCPSSVIPIFSEAATQATLL

SEQ ID NO: 2700183 - protein, 17 aa, Entamoeba histolytica
WIVSEACTHTLRNDINA

SEQ ID NO: 2700184 - protein, 17 aa, Entamoeba histolytica
WIYTYGYLVEGIFRVSG

SEQ ID NO: 2700185 - protein, 17 aa, Entamoeba histolytica
WKCKCKIKEEDIERAEN

SEQ ID NO: 2700186 - protein, 22 aa, Entamoeba histolytica
WKCSQCGKKVNARQKCIIEYPP

SEQ ID NO: 2700187 - protein, 22 aa, Entamoeba histolytica
WKDNELELILSITSSLIVDDVF

SEQ ID NO: 2700188 - protein, 25 aa, Entamoeba histolytica
WKEALKVCVELGLQKEALNCCSSCN

SEQ ID NO: 2700189 - protein, 17 aa, Entamoeba histolytica
WKEKIKDFEVMNLMIKE

SEQ ID NO: 2700190 - protein, 17 aa, Entamoeba histolytica
WKEKVVVVGVDMSSDEY

SEQ ID NO: 2700191 - protein, 19 aa, Entamoeba histolytica
WKELVFLYVQVDQVKAIET

SEQ ID NO: 2700192 - protein, 25 aa, Entamoeba histolytica
WKEQTEILKSILFFIFKEKKEKIIN

SEQ ID NO: 2700193 - protein, 17 aa, Entamoeba histolytica
WKERGRGDIKILRHPKT

SEQ ID NO: 2700194 - protein, 21 aa, Entamoeba histolytica
WKGTCNEKKGLFNITCATTSM

SEQ ID NO: 2700195 - protein, 20 aa, Entamoeba histolytica
WKGVNFLLCICNDIRFPAFL

SEQ ID NO: 2700196 - protein, 23 aa, Entamoeba histolytica
WKGVWKVVCGIIKEGSIEERKEY

SEQ ID NO: 2700197 - protein, 18 aa, Entamoeba histolytica
WKHPNIVGFEGCWIFDNR

SEQ ID NO: 2700198 - protein, 17 aa, Entamoeba histolytica
WKIDRLIAEMKLCYEEI

SEQ ID NO: 2700199 - protein, 17 aa, Entamoeba histolytica
WKIRGGNQYMRTLWGKE

SEQ ID NO: 2700200 - protein, 20 aa, Entamoeba histolytica
WKKEGFCSKHGHQFKGSAIE

SEQ ID NO: 2700201 - protein, 32 aa, Entamoeba histolytica
WKKFKLQIDKKCSLCIEVKRVKTLSLTYKRLL

SEQ ID NO: 2700202 - protein, 18 aa, Entamoeba histolytica
WKKINTFIKSNMSKYSDS

SEQ ID NO: 2700203 - protein, 30 aa, Entamoeba histolytica
WKKNMPTVRPCFAVKCNPEPHLVKLLGELG

SEQ ID NO: 2700204 - protein, 29 aa, Entamoeba histolytica
WKKQNEWYLSYLKRNCCENDVSLIWNCLG

SEQ ID NO: 2700205 - protein, 17 aa, Entamoeba histolytica
WKKTLYIYGDDQNNDIF

SEQ ID NO: 2700206 - protein, 21 aa, Entamoeba histolytica
WKLESEIAMTFLMSDKTVEFV

SEQ ID NO: 2700207 - protein, 22 aa, Entamoeba histolytica
WKLNEKEIKKMGSMVAASSFYL

SEQ ID NO: 2700208 - protein, 20 aa, Entamoeba histolytica
WKLTNKCIQQAKQRDSNEQY

SEQ ID NO: 2700209 - protein, 17 aa, Entamoeba histolytica
WKLVRLLVNNGLSPNEQ

SEQ ID NO: 2700210 - protein, 19 aa, Entamoeba histolytica
WKLYHEFEEKCGTTESLME

SEQ ID NO: 2700211 - protein, 20 aa, Entamoeba histolytica
WKNEGTSQWVVIKKNKNIQM

SEQ ID NO: 2700212 - protein, 20 aa, Entamoeba histolytica
WKNGMTYNRVGTLYYIYADD

SEQ ID NO: 2700213 - protein, 21 aa, Entamoeba histolytica
WKNKLICFGPKRCGPNILINL

SEQ ID NO: 2700214 - protein, 23 aa, Entamoeba histolytica
WKNLVDGIIVCWINGEQCGNAVA

SEQ ID NO: 2700215 - protein, 21 aa, Entamoeba histolytica
WKNNLIEITDQFKIICENLVN

SEQ ID NO: 2700216 - protein, 22 aa, Entamoeba histolytica
WKNRIKRYHWETFKINENNDKL

SEQ ID NO: 2700217 - protein, 34 aa, Entamoeba histolytica
WKNSIELFSTGSFLFCISWAFGITNSGTSSWFHE

SEQ ID NO: 2700218 - protein, 17 aa, Entamoeba histolytica
WKPKMVKELEHVGYQPN

SEQ ID NO: 2700219 - protein, 21 aa, Entamoeba histolytica
WKQFFHCFNCKGKAKMENLFK

SEQ ID NO: 2700220 - protein, 21 aa, Entamoeba histolytica
WKQYIEWLKEKDLIIEINENI

SEQ ID NO: 2700221 - protein, 25 aa, Entamoeba histolytica
WKRKYCTKCWMPLTYSSFKTQLING

SEQ ID NO: 2700222 - protein, 22 aa, Entamoeba histolytica
WKRRWVVLCRGFLFYYNNPKDE

SEQ ID NO: 2700223 - protein, 24 aa, Entamoeba histolytica
WKRVRKCLMITFLSIDTLVHVNYI

SEQ ID NO: 2700224 - protein, 17 aa, Entamoeba histolytica
WKSFSITNNISFRKSEF

SEQ ID NO: 2700225 - protein, 20 aa, Entamoeba histolytica
WKSKELMRSKDIQYEEANEK

SEQ ID NO: 2700226 - protein, 20 aa, Entamoeba histolytica
WKSKMGNIIEMFYKKKLDYK

SEQ ID NO: 2700227 - protein, 18 aa, Entamoeba histolytica
WKSLEKLYINYCGITSFK

SEQ ID NO: 2700228 - protein, 26 aa, Entamoeba histolytica
WKSQECIDLLTLILYKGEYSFFKDIH

SEQ ID NO: 2700229 - protein, 18 aa, Entamoeba histolytica
WKTAMKKYGYEKLDEIST

SEQ ID NO: 2700230 - protein, 18 aa, Entamoeba histolytica
WKTDDLLNYFKQYSPSKV

SEQ ID NO: 2700231 - protein, 33 aa, Entamoeba histolytica
WKTKRPVIRKRIEAFVKCPVNFIFSRTKGQSFF

SEQ ID NO: 2700232 - protein, 29 aa, Entamoeba histolytica
WKTSLNRKKEWRVIGALFNDNFEIGIDEY

SEQ ID NO: 2700233 - protein, 18 aa, Entamoeba histolytica
WKTWDSVLELAIPKLINS

SEQ ID NO: 2700234 - protein, 23 aa, Entamoeba histolytica
WKTYKSRISVVGALLLNESLTHV

SEQ ID NO: 2700235 - protein, 34 aa, Entamoeba histolytica; identical to SEQ ID NO: 2509661

SEQ ID NO: 2700236 - protein, 17 aa, Entamoeba histolytica
WKVCQNPTFDGIRIQST

SEQ ID NO: 2700237 - protein, 17 aa, Entamoeba histolytica
WKVIYGLYHLQYNKSSI

SEQ ID NO: 2700238 - protein, 22 aa, Entamoeba histolytica
WKVSRPNFATVRKYENRKVILE

SEQ ID NO: 2700239 - protein, 20 aa, Entamoeba histolytica
WKYLEDFSISLSHLLPDVSI

SEQ ID NO: 2700240 - protein, 17 aa, Entamoeba histolytica
WKYLTHLSSYLTPTALG

SEQ ID NO: 2700241 - protein, 21 aa, Entamoeba histolytica
WKYNDTRVWEVCCLRGHSSIV

SEQ ID NO: 2700242 - protein, 20 aa, Entamoeba histolytica
WKYNKIELKSHILEEEQINN

SEQ ID NO: 2700243 - protein, 25 aa, Entamoeba histolytica
WLAELCYLVNGALVLKGEFIQEIGE

SEQ ID NO: 2700244 - protein, 17 aa, Entamoeba histolytica
WLASLVLNEPVSLTSVP

SEQ ID NO: 2700245 - protein, 23 aa, Entamoeba histolytica
WLCEKGIESINFFSGGINFHSRR

SEQ ID NO: 2700246 - protein, 19 aa, Entamoeba histolytica
WLCKTVPNLSRKAKEQFDI

SEQ ID NO: 2700247 - protein, 17 aa, Entamoeba histolytica
WLDYVLLDCCERMVYLT

SEQ ID NO: 2700248 - protein, 19 aa, Entamoeba histolytica
WLEENGVNCTVLENGMKEK

SEQ ID NO: 2700249 - protein, 38 aa, Entamoeba histolytica; identical to SEQ ID NO: 2392232

SEQ ID NO: 2700250 - protein, 18 aa, Entamoeba histolytica
WLENEFSEHYIIMPDIAK

SEQ ID NO: 2700251 - protein, 17 aa, Entamoeba histolytica
WLENEISEHYIIMPDII

SEQ ID NO: 2700252 - protein, 18 aa, Entamoeba histolytica
WLFDCLKEGRVISINKYV

SEQ ID NO: 2700253 - protein, 24 aa, Entamoeba histolytica
WLFETIRLSVDMRISCFEQNNQIH

SEQ ID NO: 2700254 - protein, 22 aa, Entamoeba histolytica
WLFPEIYVLDGGFKNFYKRNKE

SEQ ID NO: 2700255 - protein, 17 aa, Entamoeba histolytica
WLFTDSYFQKTTLLDSE

SEQ ID NO: 2700256 - protein, 24 aa, Entamoeba histolytica
WLGVLPTPISINWVEVIKQNREKY

SEQ ID NO: 2700257 - protein, 22 aa, Entamoeba histolytica
WLIKVWSMVCLARLIEQETTKR

SEQ ID NO: 2700258 - protein, 19 aa, Entamoeba histolytica
WLKDCIKEFSNFFQTKEFL

SEQ ID NO: 2700259 - protein, 18 aa, Entamoeba histolytica
WLKEQAVVSLNRLMKTHR

SEQ ID NO: 2700260 - protein, 30 aa, Entamoeba histolytica
WLKHIKKIIKGVCELCSSIINGNSVLVHCS

SEQ ID NO: 2700261 - protein, 21 aa, Entamoeba histolytica
WLKQRFPKIIVDCQPSSQEKY

SEQ ID NO: 2700262 - protein, 17 aa, Entamoeba histolytica
WLKRILKVEKTGHSGTL

SEQ ID NO: 2700263 - protein, 25 aa, Entamoeba histolytica
WLKSTSYPGRIWVHKRFLMNEAENM

SEQ ID NO: 2700264 - protein, 20 aa, Entamoeba histolytica
WLLDLEDIFCPDKLYNDISD

SEQ ID NO: 2700265 - protein, 17 aa, Entamoeba histolytica
WLLLFKFIDHPLKLNNI

SEQ ID NO: 2700266 - protein, 20 aa, Entamoeba histolytica
WLMEDPFQFTRVEGTLSRIQ

SEQ ID NO: 2700267 - protein, 18 aa, Entamoeba histolytica
WLNEKVIPTLQQEVERDA

SEQ ID NO: 2700268 - protein, 19 aa, Entamoeba histolytica
WLNVACILGSSYGKRKISH

SEQ ID NO: 2700269 - protein, 22 aa, Entamoeba histolytica
WLPKEHWNYFSKDTILFAKYLC

SEQ ID NO: 2700270 - protein, 18 aa, Entamoeba histolytica
WLRHNLLATLGLSIGFSS

SEQ ID NO: 2700271 - protein, 20 aa, Entamoeba histolytica
WLRKHLFRPNILLSAVEKHV

SEQ ID NO: 2700272 - protein, 18 aa, Entamoeba histolytica
WLSLCKKPEVQINKIIEQ

SEQ ID NO: 2700273 - protein, 26 aa, Entamoeba histolytica
WLSPELKEILKAAGVKPKHLADPTIV

SEQ ID NO: 2700274 - protein, 17 aa, Entamoeba histolytica
WLSTVRLGGVGDERYIR

SEQ ID NO: 2700275 - protein, 20 aa, Entamoeba histolytica
WLVHGYCLAPALVLSLNIAS

SEQ ID NO: 2700276 - protein, 18 aa, Entamoeba histolytica
WLYAMKMQSYRAALELFI

SEQ ID NO: 2700277 - protein, 17 aa, Entamoeba histolytica
WLYDSISSMKVMDYKTY

SEQ ID NO: 2700278 - protein, 19 aa, Entamoeba histolytica
WMCVKDGWICFKNSQLLSG

SEQ ID NO: 2700279 - protein, 20 aa, Entamoeba histolytica
WMFYCCSEEISLYDYNPSTQ

SEQ ID NO: 2700280 - protein, 17 aa, Entamoeba histolytica
WMIPKRTIESYDLVTDD

SEQ ID NO: 2700281 - protein, 17 aa, Entamoeba histolytica
WMKCQYDPLFGYPNLVR

SEQ ID NO: 2700282 - protein, 21 aa, Entamoeba histolytica
WMLKRGEGERIGLSMRMAHDL

SEQ ID NO: 2700283 - protein, 19 aa, Entamoeba histolytica
WMSRQCILILPGHEHYVMS

SEQ ID NO: 2700284 - protein, 18 aa, Entamoeba histolytica
WNCVNARIPLSLEYLKQH

SEQ ID NO: 2700285 - protein, 20 aa, Entamoeba histolytica
WNDKEMILNGIVLHSGTTEM

SEQ ID NO: 2700286 - protein, 17 aa, Entamoeba histolytica
WNELVSFLEQLNYEDYC

SEQ ID NO: 2700287 - protein, 17 aa, Entamoeba histolytica
WNGLKFVDSDGLFIVPK

SEQ ID NO: 2700288 - protein, 18 aa, Entamoeba histolytica
WNHCFFVVSEKLCYTLRE

SEQ ID NO: 2700289 - protein, 17 aa, Entamoeba histolytica
WNHLYLIFDANIDGTLT

SEQ ID NO: 2700290 - protein, 17 aa, Entamoeba histolytica
WNIFLQITFGLRYLHSI

SEQ ID NO: 2700291 - protein, 23 aa, Entamoeba histolytica
WNIGIKGPILLKEIDYSNRVYTK

SEQ ID NO: 2700292 - protein, 24 aa, Entamoeba histolytica
WNIKKSINCAISIKRDSSVLYSFG

SEQ ID NO: 2700293 - protein, 19 aa, Entamoeba histolytica
WNISDWNAKYVFLNIGTND

SEQ ID NO: 2700294 - protein, 17 aa, Entamoeba histolytica
WNITFKTVEGILNENDF

SEQ ID NO: 2700295 - protein, 18 aa, Entamoeba histolytica
WNIVKSIFFNSKVIKDLF

SEQ ID NO: 2700296 - protein, 18 aa, Entamoeba histolytica
WNKGDCVIDSEFLVYNKT

SEQ ID NO: 2700297 - protein, 17 aa, Entamoeba histolytica
WNKLVDIVDDWQELSKI

SEQ ID NO: 2700298 - protein, 17 aa, Entamoeba histolytica
WNMCFLFNDLFVVSKAI

SEQ ID NO: 2700299 - protein, 22 aa, Entamoeba histolytica
WNMLIHHFYLKKALFELKEHKF

SEQ ID NO: 2700300 - protein, 17 aa, Entamoeba histolytica
WNNNIIWEFAKGLSPGV

SEQ ID NO: 2700301 - protein, 17 aa, Entamoeba histolytica
WNQAWEIVVQTFAYTNH

SEQ ID NO: 2700302 - protein, 25 aa, Entamoeba histolytica
WNTFYGLDCGKNFIEYLSNFKNPIC

SEQ ID NO: 2700303 - protein, 25 aa, Entamoeba histolytica
WNTFYGLNCGKEFIEYLSNFKNPIC

SEQ ID NO: 2700304 - protein, 17 aa, Entamoeba histolytica
WNTLLSESREDIFVPRL

SEQ ID NO: 2700305 - protein, 21 aa, Entamoeba histolytica
WNTVHFSEFFYSKNTPTLDNY

SEQ ID NO: 2700306 - protein, 25 aa, Entamoeba histolytica
WNVLPRPLFYKLFRQDLLIASLYRN

SEQ ID NO: 2700307 - protein, 22 aa, Entamoeba histolytica
WPESYRYLCYSLYSECEKTTTL

SEQ ID NO: 2700308 - protein, 18 aa, Entamoeba histolytica
WPIPLHKGSGEFMMTLNE

SEQ ID NO: 2700309 - protein, 17 aa, Entamoeba histolytica
WPKPPACLGDDETYFSF

SEQ ID NO: 2700310 - protein, 21 aa, Entamoeba histolytica
WPMTHSKEFKKLGIRPSHGVL

SEQ ID NO: 2700311 - protein, 21 aa, Entamoeba histolytica
WPPNLYFKGYSTFDVSNIHKY

SEQ ID NO: 2700312 - protein, 20 aa, Entamoeba histolytica
WPQAIQQFALGFMFHPLQIN

SEQ ID NO: 2700313 - protein, 17 aa, Entamoeba histolytica
WPTEGFEYDDLTKGLSR

SEQ ID NO: 2700314 - protein, 18 aa, Entamoeba histolytica
WPTVKPLPGAMRILNYFK

SEQ ID NO: 2700315 - protein, 18 aa, Entamoeba histolytica
WQFDVTLRGLRKVLVTDE

SEQ ID NO: 2700316 - protein, 20 aa, Entamoeba histolytica
WQFEIIKECIFNTETYVEYC

SEQ ID NO: 2700317 - protein, 24 aa, Entamoeba histolytica
WQKMVYEGLQWAFANRPEQIQNNS

SEQ ID NO: 2700318 - protein, 17 aa, Entamoeba histolytica
WQLFRNLDLPAIQATKC

SEQ ID NO: 2700319 - protein, 21 aa, Entamoeba histolytica
WQLGCVYTQMILRTPPFKGHS

SEQ ID NO: 2700320 - protein, 25 aa, Entamoeba histolytica
WQLIDYDLRKTLGSMDCEGDVMKWV

SEQ ID NO: 2700321 - protein, 19 aa, Entamoeba histolytica
WQLVYKCIYNVYSKPFEEY

SEQ ID NO: 2700322 - protein, 18 aa, Entamoeba histolytica
WQNIPIHWYFGSQRRYTD

SEQ ID NO: 2700323 - protein, 17 aa, Entamoeba histolytica
WQQRELERLKKEYIEQL

SEQ ID NO: 2700324 - protein, 18 aa, Entamoeba histolytica
WQSSSPYRSLLLNEVIIP

SEQ ID NO: 2700325 - protein, 18 aa, Entamoeba histolytica
WQSVPSGYSIYVTGSSSE

SEQ ID NO: 2700326 - protein, 20 aa, Entamoeba histolytica
WQTEAKKWCRPVTLYSIHHM

SEQ ID NO: 2700327 - protein, 25 aa, Entamoeba histolytica
WRECYKKYKPIMFNGFWEFLEEFKR

SEQ ID NO: 2700328 - protein, 17 aa, Entamoeba histolytica
WREEMPEVQTIRKWLKC

SEQ ID NO: 2700329 - protein, 22 aa, Entamoeba histolytica
WRIASISLKCDIRIVDNELKEV

SEQ ID NO: 2700330 - protein, 19 aa, Entamoeba histolytica
WRIIRENLNIFVNNNEVIK

SEQ ID NO: 2700331 - protein, 19 aa, Entamoeba histolytica
WRIRARLIYLNSKYKGLLE

SEQ ID NO: 2700332 - protein, 20 aa, Entamoeba histolytica
WRISEKKLKLLQNENDQLRV

SEQ ID NO: 2700333 - protein, 18 aa, Entamoeba histolytica
WRKVEVLLIDEISMISGD

SEQ ID NO: 2700334 - protein, 20 aa, Entamoeba histolytica
WRKVSVKDIVLYRNQPLHEI

SEQ ID NO: 2700335 - protein, 17 aa, Entamoeba histolytica
WRKYAVDSLHKLIEKKG

SEQ ID NO: 2700336 - protein, 19 aa, Entamoeba histolytica
WRLVEYYCVDPSKRVIKDF

SEQ ID NO: 2700337 - protein, 18 aa, Entamoeba histolytica
WRNFICYKTDKFICYLSE

SEQ ID NO: 2700338 - protein, 17 aa, Entamoeba histolytica
WRNVYGFNMTPMRAEVL

SEQ ID NO: 2700339 - protein, 17 aa, Entamoeba histolytica
WRNYKKQKVVLLDDIDK

SEQ ID NO: 2700340 - protein, 17 aa, Entamoeba histolytica
WRPSISVKQILLGIQEL

SEQ ID NO: 2700341 - protein, 17 aa, Entamoeba histolytica
WRPSSYYPKIKINRDNN

SEQ ID NO: 2700342 - protein, 20 aa, Entamoeba histolytica
WRSWQLKSWNKLSDNIIEKH

SEQ ID NO: 2700343 - protein, 18 aa, Entamoeba histolytica
WRVLNSTFSRMLLFIDKT

SEQ ID NO: 2700344 - protein, 19 aa, Entamoeba histolytica
WRWCTEVFDYLNIAALIDG

SEQ ID NO: 2700345 - protein, 17 aa, Entamoeba histolytica
WRYDEINAPTCFEVGVR

SEQ ID NO: 2700346 - protein, 21 aa, Entamoeba histolytica
WSASEIAAFVSYIATYAKKNE

SEQ ID NO: 2700347 - protein, 26 aa, Entamoeba histolytica
WSCPSYDIPFEYYNTLILTKQPSPSE

SEQ ID NO: 2700348 - protein, 34 aa, Entamoeba histolytica
WSCVKGLKNVLCIKVTQIGSVFGYFHSKEHPAVT

SEQ ID NO: 2700349 - protein, 20 aa, Entamoeba histolytica
WSEAVGWMVHSHQYNIIKAL

SEQ ID NO: 2700350 - protein, 18 aa, Entamoeba histolytica
WSEEDGRCGKFNVGKQNI

SEQ ID NO: 2700351 - protein, 20 aa, Entamoeba histolytica
WSEKEMELINNLKSVYQSAI

SEQ ID NO: 2700352 - protein, 24 aa, Entamoeba histolytica
WSFCECPRLSIIEYNSQTPLKTQI

SEQ ID NO: 2700353 - protein, 28 aa, Entamoeba histolytica
WSFGCMAAELFVGIPIFPGNSEYNMLFK

SEQ ID NO: 2700354 - protein, 20 aa, Entamoeba histolytica
WSFIVMELIETGCLLDYLYK

SEQ ID NO: 2700355 - protein, 22 aa, Entamoeba histolytica
WSIRPYKQYLCTIISSQTIHLS

SEQ ID NO: 2700356 - protein, 18 aa, Entamoeba histolytica
WSKSVMDMGYEVLVVSQF

SEQ ID NO: 2700357 - protein, 19 aa, Entamoeba histolytica
WSKTTEMRIPDSTNDGNII

SEQ ID NO: 2700358 - protein, 22 aa, Entamoeba histolytica
WSLGCMLFQFLTGEFPFRGKSD

SEQ ID NO: 2700359 - protein, 17 aa, Entamoeba histolytica
WSLGCVFVELFSHTVLF

SEQ ID NO: 2700360 - protein, 18 aa, Entamoeba histolytica
WSNAFKSNILIDTVNSNT

SEQ ID NO: 2700361 - protein, 17 aa, Entamoeba histolytica
WSPDSRMLVSASKDSTV

SEQ ID NO: 2700362 - protein, 20 aa, Entamoeba histolytica
WSQDPKNRWGCEELIEKIQK

SEQ ID NO: 2700363 - protein, 20 aa, Entamoeba histolytica
WSQLLRKYWSGYSTISPKEF

SEQ ID NO: 2700364 - protein, 17 aa, Entamoeba histolytica
WSSGVLLFVMVCGYPPF

SEQ ID NO: 2700365 - protein, 17 aa, Entamoeba histolytica
WSSIPIIVTEKIELSNV

SEQ ID NO: 2700366 - protein, 24 aa, Entamoeba histolytica
WSSVPQGMCGKCYVKDLINDFWKR

SEQ ID NO: 2700367 - protein, 29 aa, Entamoeba histolytica
WSVSITLPLGVEITWKYYVQQENIIIRDE

SEQ ID NO: 2700368 - protein, 21 aa, Entamoeba histolytica
WSYSYCLPLFIVSYRNHSEVD

SEQ ID NO: 2700369 - protein, 19 aa, Entamoeba histolytica
WTAPEAAARGIFTIKNDVW

SEQ ID NO: 2700370 - protein, 18 aa, Entamoeba histolytica
WTATWPQAIQQFALGFMF

SEQ ID NO: 2700371 - protein, 27 aa, Entamoeba histolytica
WTDALKRYGFENIPVDTFLTLGSLAEG

SEQ ID NO: 2700372 - protein, 27 aa, Entamoeba histolytica
WTDALKRYGLENIPVDTFLTLGSLAEG

SEQ ID NO: 2700373 - protein, 17 aa, Entamoeba histolytica
WTDHLQVARFVKYLWTQ

SEQ ID NO: 2700374 - protein, 21 aa, Entamoeba histolytica
WTDIYLFDYRKLMISGNYSQA

SEQ ID NO: 2700375 - protein, 18 aa, Entamoeba histolytica
WTDRRGVHEPNYYGSYTQ

SEQ ID NO: 2700376 - protein, 19 aa, Entamoeba histolytica
WTDRRGVHEPNYYGSYTQS

SEQ ID NO: 2700377 - protein, 18 aa, Entamoeba histolytica
WTEIEKFSYYQTNFTSQL

SEQ ID NO: 2700378 - protein, 21 aa, Entamoeba histolytica
WTELSQCQLIFDSTIEYDPDE

SEQ ID NO: 2700379 - protein, 18 aa, Entamoeba histolytica
WTEMKSFKKVCNIEGDGD

SEQ ID NO: 2700380 - protein, 25 aa, Entamoeba histolytica
WTFNFLKDSLSFYGFEIHEKKIKKG

SEQ ID NO: 2700381 - protein, 25 aa, Entamoeba histolytica
WTIDSFKMYLNNIFYNAGISQVNAM

SEQ ID NO: 2700382 - protein, 19 aa, Entamoeba histolytica
WTIEQEGKKVYCGVLKQRT

SEQ ID NO: 2700383 - protein, 17 aa, Entamoeba histolytica
WTINKFMTKQEKFISQN

SEQ ID NO: 2700384 - protein, 21 aa, Entamoeba histolytica
WTKDKIKQFIESFGVIVFSIK

SEQ ID NO: 2700385 - protein, 21 aa, Entamoeba histolytica
WTKKGNLTPLINRADGDDPAR

SEQ ID NO: 2700386 - protein, 21 aa, Entamoeba histolytica
WTNPDGRRLLVINGVTIDPLN

SEQ ID NO: 2700387 - protein, 21 aa, Entamoeba histolytica
WTPFLRCLFEIERLRQIASGW

SEQ ID NO: 2700388 - protein, 28 aa, Entamoeba histolytica
WTPKEYELFRFPSLKKELIINGVYIRLF

SEQ ID NO: 2700389 - protein, 26 aa, Entamoeba histolytica
WTPKEYELFRFPSLQNELVLGGVYIR

SEQ ID NO: 2700390 - protein, 17 aa, Entamoeba histolytica
WTPVLFDMTTFLMKMKE

SEQ ID NO: 2700391 - protein, 19 aa, Entamoeba histolytica
WTRCYCCTPEKKLVRQIES

SEQ ID NO: 2700392 - protein, 17 aa, Entamoeba histolytica
WTRCYNYIPPKKIDEGK

SEQ ID NO: 2700393 - protein, 17 aa, Entamoeba histolytica
WTRNYCIAICVNISDFN

SEQ ID NO: 2700394 - protein, 18 aa, Entamoeba histolytica
WTSLSGFVRYLETKGIVE

SEQ ID NO: 2700395 - protein, 20 aa, Entamoeba histolytica
WTTKCIRCVARMGKFSSDRS

SEQ ID NO: 2700396 - protein, 26 aa, Entamoeba histolytica
WTVDSFKMYLNNVFYNAGISQVNAID

SEQ ID NO: 2700397 - protein, 26 aa, Entamoeba histolytica
WTVDSFKMYLNNVFYNAGISQVNAMD

SEQ ID NO: 2700398 - protein, 22 aa, Entamoeba histolytica
WVAESWYGRFIYAFNKREGLRL

SEQ ID NO: 2700399 - protein, 17 aa, Entamoeba histolytica
WVCGSLIQKINAKRKKY

SEQ ID NO: 2700400 - protein, 23 aa, Entamoeba histolytica
WVCLCNAASYILEFHEYYEINTY

SEQ ID NO: 2700401 - protein, 17 aa, Entamoeba histolytica
WVCNLIMTWPAFSNKAQ

SEQ ID NO: 2700402 - protein, 17 aa, Entamoeba histolytica
WVEEGSIGLSMIKGLGF

SEQ ID NO: 2700403 - protein, 27 aa, Entamoeba histolytica
WVEQCCKSDGKHIIFIAGNKIDLENRV

SEQ ID NO: 2700404 - protein, 22 aa, Entamoeba histolytica
WVFQQLFFVKFLFPLLENPLFI

SEQ ID NO: 2700405 - protein, 17 aa, Entamoeba histolytica
WVICSYDSKDFRLSDIQ

SEQ ID NO: 2700406 - protein, 19 aa, Entamoeba histolytica
WVIGKSVIRGRDWKWKDQD

SEQ ID NO: 2700407 - protein, 26 aa, Entamoeba histolytica
WVIPDPLCLMCYLFPEIITHTDVVET

SEQ ID NO: 2700408 - protein, 21 aa, Entamoeba histolytica
WVKEDWFQKKFIFIPQYQGDG

SEQ ID NO: 2700409 - protein, 25 aa, Entamoeba histolytica
WVKGKDPRFKITRKKTNKKGRNQQE

SEQ ID NO: 2700410 - protein, 20 aa, Entamoeba histolytica
WVLVLRKLYKTNTLSNIYER

SEQ ID NO: 2700411 - protein, 19 aa, Entamoeba histolytica
WVNYCYWITCDNVIYLWHH

SEQ ID NO: 2700412 - protein, 32 aa, Entamoeba histolytica
WVPEEKIVLFKAIVKLCHKIMVHSSKNLMNEK

SEQ ID NO: 2700413 - protein, 19 aa, Entamoeba histolytica
WVPRFGMGSAKQIKKKTEG

SEQ ID NO: 2700414 - protein, 17 aa, Entamoeba histolytica
WVSGKMKGIDPVNPAQS

SEQ ID NO: 2700415 - protein, 23 aa, Entamoeba histolytica
WVVKREEFNWSEVTRCVLSAIGN

SEQ ID NO: 2700416 - protein, 18 aa, Entamoeba histolytica
WVYLYLQLLRKIFKYNPR

SEQ ID NO: 2700417 - protein, 19 aa, Entamoeba histolytica
WWCTPYDFVKSFNIDYVVH

SEQ ID NO: 2700418 - protein, 20 aa, Entamoeba histolytica
WWEKEGFFKPEYSKRSGKKF

SEQ ID NO: 2700419 - protein, 18 aa, Entamoeba histolytica
WWIYTYGYLVEGIFRVSG

SEQ ID NO: 2700420 - protein, 26 aa, Entamoeba histolytica
WWKESICLSCAIHAPCDGVLVSPYDK

SEQ ID NO: 2700421 - protein, 22 aa, Entamoeba histolytica
WWKRNSLTVFLNKKIYKDPNET

SEQ ID NO: 2700422 - protein, 17 aa, Entamoeba histolytica
WWRNRTAIISITPEQRG

SEQ ID NO: 2700423 - protein, 18 aa, Entamoeba histolytica
WWTIVEMANNIFGDDGWS

SEQ ID NO: 2700424 - protein, 27 aa, Entamoeba histolytica
WWTLGVLMYEFLYGCNPFAASSIQETY

SEQ ID NO: 2700425 - protein, 31 aa, Entamoeba histolytica
WYCFPLLIEIAMNWKLKIYDSILQIIQLTTI

SEQ ID NO: 2700426 - protein, 24 aa, Entamoeba histolytica
WYCHSIEFSDFLIRKLINGDRTAI

SEQ ID NO: 2700427 - protein, 17 aa, Entamoeba histolytica
WYDGPLIEAMKNGDMFL

SEQ ID NO: 2700428 - protein, 17 aa, Entamoeba histolytica
WYFQKRIVHCKTQEERL

SEQ ID NO: 2700429 - protein, 25 aa, Entamoeba histolytica
WYGREIKMSPSLICINKNREYLTPF

SEQ ID NO: 2700430 - protein, 18 aa, Entamoeba histolytica
WYHNVMISQFFTYENATT

SEQ ID NO: 2700431 - protein, 19 aa, Entamoeba histolytica
WYIKPTLLADNSFKISSIL

SEQ ID NO: 2700432 - protein, 20 aa, Entamoeba histolytica
WYISGDYPMYVQAFAGNTYN

SEQ ID NO: 2700433 - protein, 17 aa, Entamoeba histolytica
WYKECYPNLDGLDSTKE

SEQ ID NO: 2700434 - protein, 17 aa, Entamoeba histolytica
WYLHFTKKLIHRDLKPA

SEQ ID NO: 2700435 - protein, 20 aa, Entamoeba histolytica
WYLILCELSKILQQHKIHKN

SEQ ID NO: 2700436 - protein, 19 aa, Entamoeba histolytica
WYLYLVDIVNDFDIKMIDI

SEQ ID NO: 2700437 - protein, 17 aa, Entamoeba histolytica
WYPERFSSYGLFPNTEN

SEQ ID NO: 2700438 - protein, 20 aa, Entamoeba histolytica
WYRPPEILLGATHYEASVDI

SEQ ID NO: 2700439 - protein, 20 aa, Entamoeba histolytica
WYSKAIIYMHEYFKQFFTEY

SEQ ID NO: 2700440 - protein, 17 aa, Entamoeba histolytica
WYSKNFIFESCSIEAPQ

SEQ ID NO: 2700441 - protein, 19 aa, Entamoeba histolytica
WYTSHSLKERERIIREVSN

SEQ ID NO: 2700442 - protein, 18 aa, Entamoeba histolytica
WYVSCERVAQGMMERGFL

SEQ ID NO: 2700443 - protein, 17 aa, Entamoeba histolytica
WYYGGGLYMGKKMPEVC

SEQ ID NO: 2700444 - protein, 25 aa, Entamoeba histolytica
YAASLSSQCPQGFSTSKRERMIKKL

SEQ ID NO: 2700445 - protein, 18 aa, Entamoeba histolytica
YAASRLVAYGSYEVFELH

SEQ ID NO: 2700446 - protein, 18 aa, Entamoeba histolytica
YADFFLNGLIQLQSTISI

SEQ ID NO: 2700447 - protein, 20 aa, Entamoeba histolytica
YADIIKLHFEKPFEQEEGDV

SEQ ID NO: 2700448 - protein, 24 aa, Entamoeba histolytica
YADSLPRWVVTAAPLNQSTVLASD

SEQ ID NO: 2700449 - protein, 24 aa, Entamoeba histolytica
YADTDCFMICFSIADEDSFERIKT

SEQ ID NO: 2700450 - protein, 27 aa, Entamoeba histolytica
YAEELDCSIFRSLVCTPFSKSHRKILL

SEQ ID NO: 2700451 - protein, 20 aa, Entamoeba histolytica
YAEGEHIVMIVMKKPTKANI

SEQ ID NO: 2700452 - protein, 19 aa, Entamoeba histolytica
YAELCLKAVNLLKQLSYKL

SEQ ID NO: 2700453 - protein, 17 aa, Entamoeba histolytica
YAEMKGIKPQSKQESSK

SEQ ID NO: 2700454 - protein, 21 aa, Entamoeba histolytica
YAEPFRFFLSFTPTKFPCFNQ

SEQ ID NO: 2700455 - protein, 23 aa, Entamoeba histolytica
YAGDSPLHYAVCIALNNIEAGRS

SEQ ID NO: 2700456 - protein, 17 aa, Entamoeba histolytica
YAHVSLKSHGIKLINKI

SEQ ID NO: 2700457 - protein, 18 aa, Entamoeba histolytica
YAIHLALYAAFYPNYFTT

SEQ ID NO: 2700458 - protein, 25 aa, Entamoeba histolytica
YAIHRIRAFYMRKVKYCSQSYHDKL

SEQ ID NO: 2700459 - protein, 17 aa, Entamoeba histolytica
YAINCLKQIDSVRTAQD

SEQ ID NO: 2700460 - protein, 22 aa, Entamoeba histolytica
YAKEDLHSFIPIFDSKKVQLIP

SEQ ID NO: 2700461 - protein, 21 aa, Entamoeba histolytica
YAKKLEVLKNMKFDEALLEGF

SEQ ID NO: 2700462 - protein, 23 aa, Entamoeba histolytica
YAKKVPRKRVIIMDEAKSNKIKK

SEQ ID NO: 2700463 - protein, 17 aa, Entamoeba histolytica
YAKVFAMLSQVEKHIKH

SEQ ID NO: 2700464 - protein, 18 aa, Entamoeba histolytica
YAKYFAEVHPELYSSDDV

SEQ ID NO: 2700465 - protein, 22 aa, Entamoeba histolytica
YALAITMWELFYERLPFEEFLK

SEQ ID NO: 2700466 - protein, 17 aa, Entamoeba histolytica
YALCKPSQFPVGGCCYC

SEQ ID NO: 2700467 - protein, 17 aa, Entamoeba histolytica
YALDLLLIRSIATKGYK

SEQ ID NO: 2700468 - protein, 17 aa, Entamoeba histolytica
YALRLIERPPLKYLFQT

SEQ ID NO: 2700469 - protein, 26 aa, Entamoeba histolytica
YANESKWWGDDGFKEVCVTVKEYIKM

SEQ ID NO: 2700470 - protein, 25 aa, Entamoeba histolytica
YAPSMKFVACGGLDNIVSIYSIAPK

SEQ ID NO: 2700471 - protein, 23 aa, Entamoeba histolytica
YAQKYPFVCFAKITWEDSNKPFP

SEQ ID NO: 2700472 - protein, 24 aa, Entamoeba histolytica
YAQPMCLVAAFLRLTLSENKVYKM

SEQ ID NO: 2700473 - protein, 18 aa, Entamoeba histolytica
YARAIRRIRMTKKDTFIA

SEQ ID NO: 2700474 - protein, 28 aa, Entamoeba histolytica
YASAWDFYGLHASPIISGMGHFEITFYT

SEQ ID NO: 2700475 - protein, 23 aa, Entamoeba histolytica
YASTEFIQIFAFTGNLLCQSTYI

SEQ ID NO: 2700476 - protein, 27 aa, Entamoeba histolytica
YASYRQYRIPIVFGKSINKEIVDEKIF

SEQ ID NO: 2700477 - protein, 23 aa, Entamoeba histolytica
YAYGELFYLLNLYSDNIKWFFID

SEQ ID NO: 2700478 - protein, 20 aa, Entamoeba histolytica
YCAEFVKGKMAPECNTNARL

SEQ ID NO: 2700479 - protein, 20 aa, Entamoeba histolytica
YCAPEIYFSQPFTYKSDIFS

SEQ ID NO: 2700480 - protein, 18 aa, Entamoeba histolytica
YCAVAALALLGRIDEIDI

SEQ ID NO: 2700481 - protein, 24 aa, Entamoeba histolytica
YCDAQCVKYGLAMIEGGTTGTKGN

SEQ ID NO: 2700482 - protein, 17 aa, Entamoeba histolytica
YCDFELVEDILFAFTLD

SEQ ID NO: 2700483 - protein, 24 aa, Entamoeba histolytica
YCDFKRIRLEALFQTSSFEVIYYS

SEQ ID NO: 2700484 - protein, 19 aa, Entamoeba histolytica
YCEKFAFLSRDCILEKKVK

SEQ ID NO: 2700485 - protein, 17 aa, Entamoeba histolytica
YCEKMGKKGEQWEAEFH

SEQ ID NO: 2700486 - protein, 18 aa, Entamoeba histolytica
YCESLLCYGQLILRKEMT

SEQ ID NO: 2700487 - protein, 17 aa, Entamoeba histolytica
YCEVPYDAIQVVSQLFD

SEQ ID NO: 2700488 - protein, 25 aa, Entamoeba histolytica
YCEYYCLRNVLVLREGFLKYKKMMK

SEQ ID NO: 2700489 - protein, 17 aa, Entamoeba histolytica
YCFHHYNPIKGRAGDKS

SEQ ID NO: 2700490 - protein, 22 aa, Entamoeba histolytica
YCFKDCKKLELITLHEGIEYEK

SEQ ID NO: 2700491 - protein, 21 aa, Entamoeba histolytica
YCFNCQVNFCIDHSSLHVKRK

SEQ ID NO: 2700492 - protein, 25 aa, Entamoeba histolytica
YCFQIEYRLLCEVFTDSIIGNSNIV

SEQ ID NO: 2700493 - protein, 33 aa, Entamoeba histolytica
YCGSLFRIDDIILRIGGIIPFCSLLHFGFSYEK

SEQ ID NO: 2700494 - protein, 21 aa, Entamoeba histolytica
YCGVCDKHFISQAVYLKHCTQ

SEQ ID NO: 2700495 - protein, 20 aa, Entamoeba histolytica
YCHRDIKIENVLIFNGEYKL

SEQ ID NO: 2700496 - protein, 20 aa, Entamoeba histolytica
YCIKCGTPMIGEPGITMVRC

SEQ ID NO: 2700497 - protein, 17 aa, Entamoeba histolytica
YCKKCGTKLMQRKVFTT

SEQ ID NO: 2700498 - protein, 21 aa, Entamoeba histolytica
YCKRLSAPLVSIVLSNSSKHD

SEQ ID NO: 2700499 - protein, 18 aa, Entamoeba histolytica
YCLFEESRHLNLLREEFD

SEQ ID NO: 2700500 - protein, 27 aa, Entamoeba histolytica
YCLRVKKGQPPYCCFEYIDEDSYGKTN

SEQ ID NO: 2700501 - protein, 19 aa, Entamoeba histolytica
YCNECGKKKRDASLCETSR

SEQ ID NO: 2700502 - protein, 30 aa, Entamoeba histolytica
YCNKELPLVHCPYFFFRWMNYTYKQTDLFN

SEQ ID NO: 2700503 - protein, 20 aa, Entamoeba histolytica
YCNNISFKISDLYQKFFEDL

SEQ ID NO: 2700504 - protein, 26 aa, Entamoeba histolytica
YCNQKSIWLKLFKECEKDLESYHKAK

SEQ ID NO: 2700505 - protein, 17 aa, Entamoeba histolytica
YCNSEAVLLNYRKVSSN

SEQ ID NO: 2700506 - protein, 23 aa, Entamoeba histolytica
YCNYPIQLGCRLSRATTIKYNHN

SEQ ID NO: 2700507 - protein, 24 aa, Entamoeba histolytica
YCPETLKCIFFMKTDKVLLSDEKL

SEQ ID NO: 2700508 - protein, 28 aa, Entamoeba histolytica
YCPEYQKIKEIILRSKIVFDCNKDTIEN

SEQ ID NO: 2700509 - protein, 17 aa, Entamoeba histolytica
YCPICYDGIVVTHTINY

SEQ ID NO: 2700510 - protein, 29 aa, Entamoeba histolytica
YCPNTRLERWWFIITDVRNQFVLNATHGY

SEQ ID NO: 2700511 - protein, 25 aa, Entamoeba histolytica
YCQELKQPLLPLFIKGIKSGNEELM

SEQ ID NO: 2700512 - protein, 19 aa, Entamoeba histolytica
YCQEMNCICCDLKPENIMI

SEQ ID NO: 2700513 - protein, 17 aa, Entamoeba histolytica
YCQTCVQRVFQGKGKKG

SEQ ID NO: 2700514 - protein, 21 aa, Entamoeba histolytica
YCRMEKLRAGLRTINEESETI

SEQ ID NO: 2700515 - protein, 19 aa, Entamoeba histolytica
YCSDVPIILVGSCAEVRKT

SEQ ID NO: 2700516 - protein, 20 aa, Entamoeba histolytica
YCSIRYKLGKVRSLIKEKEQ

SEQ ID NO: 2700517 - protein, 17 aa, Entamoeba histolytica
YCSYKIGKQVYYYNSYQ

SEQ ID NO: 2700518 - protein, 21 aa, Entamoeba histolytica
YCTGIPILFVGSGQHYTDLKL

SEQ ID NO: 2700519 - protein, 21 aa, Entamoeba histolytica
YCTNCVKIISSWLTTRGDTFT

SEQ ID NO: 2700520 - protein, 17 aa, Entamoeba histolytica
YCVATYILGIGDRHSDN

SEQ ID NO: 2700521 - protein, 18 aa, Entamoeba histolytica
YCVDELFIENELCVSQED

SEQ ID NO: 2700522 - protein, 22 aa, Entamoeba histolytica
YCVKRSEFELFLKYIKDRQNDL

SEQ ID NO: 2700523 - protein, 21 aa, Entamoeba histolytica
YCYDCKITFSRFFFTSNKQKT

SEQ ID NO: 2700524 - protein, 23 aa, Entamoeba histolytica
YCYDEITMCQPLSSVAISYMFID

SEQ ID NO: 2700525 - protein, 19 aa, Entamoeba histolytica
YCYHSFGWDENGIVCYCRV

SEQ ID NO: 2700526 - protein, 20 aa, Entamoeba histolytica
YCYNCRKQLLPTPIIKLPIT

SEQ ID NO: 2700527 - protein, 23 aa, Entamoeba histolytica
YCYTCQCVICSVCQRDIHRKHNI

SEQ ID NO: 2700528 - protein, 25 aa, Entamoeba histolytica
YCYTEERCCKFVRFLIENVQNHNIN

SEQ ID NO: 2700529 - protein, 18 aa, Entamoeba histolytica
YDAIQDFLFHSLKSSLER

SEQ ID NO: 2700530 - protein, 22 aa, Entamoeba histolytica
YDARVAHDYILWAQLIDIRQRL

SEQ ID NO: 2700531 - protein, 23 aa, Entamoeba histolytica
YDCVIKKLALKIAIMSEENNGNY

SEQ ID NO: 2700532 - protein, 20 aa, Entamoeba histolytica
YDCWSKMERKLIKGLDLLSE

SEQ ID NO: 2700533 - protein, 20 aa, Entamoeba histolytica
YDCWSSLQLPIEVWTGKYTC

SEQ ID NO: 2700534 - protein, 22 aa, Entamoeba histolytica
YDDASCGMGLIFGTGTNGCYIE

SEQ ID NO: 2700535 - protein, 23 aa, Entamoeba histolytica
YDDASCGMGLIFGTGTNGCYIEK

SEQ ID NO: 2700536 - protein, 24 aa, Entamoeba histolytica
YDDKESFKNVVNWYQETQRYSNLQ

SEQ ID NO: 2700537 - protein, 25 aa, Entamoeba histolytica
YDDLGCLWWDVLKGDYITKLTGHEN

SEQ ID NO: 2700538 - protein, 18 aa, Entamoeba histolytica
YDDLRLDAVNRMPIPENL

SEQ ID NO: 2700539 - protein, 20 aa, Entamoeba histolytica
YDDRFNLFLTNAIQHINEND

SEQ ID NO: 2700540 - protein, 21 aa, Entamoeba histolytica
YDEFLQFYGVFNLKTYKYVCS

SEQ ID NO: 2700541 - protein, 25 aa, Entamoeba histolytica
YDEIAIKFRPSWYYNEVSKQLEWID

SEQ ID NO: 2700542 - protein, 24 aa, Entamoeba histolytica
YDEIKKFFIQYCGIEELNIWSKME

SEQ ID NO: 2700543 - protein, 26 aa, Entamoeba histolytica
YDEKVDIWSLGIMCMEMADGNPPYMD

SEQ ID NO: 2700544 - protein, 20 aa, Entamoeba histolytica
YDFDSLKLFCCVNKKCEGAT

SEQ ID NO: 2700545 - protein, 22 aa, Entamoeba histolytica
YDFTNDYTICIDFISFCISNYP

SEQ ID NO: 2700546 - protein, 24 aa, Entamoeba histolytica
YDFYCLGIIPPQRVQTEILRFGMV

SEQ ID NO: 2700547 - protein, 17 aa, Entamoeba histolytica
YDGKKTIKIIEDVLEES

SEQ ID NO: 2700548 - protein, 19 aa, Entamoeba histolytica
YDGKNCFDCSWDKDCCGCI

SEQ ID NO: 2700549 - protein, 23 aa, Entamoeba histolytica
YDGPFKRCCENVLRILRDNKDFV

SEQ ID NO: 2700550 - protein, 17 aa, Entamoeba histolytica
YDGRFLAKYGIINIVKK

SEQ ID NO: 2700551 - protein, 17 aa, Entamoeba histolytica
YDGRSFGNMKWEVFSIC

SEQ ID NO: 2700552 - protein, 24 aa, Entamoeba histolytica
YDHECDIWSLGVITYVLLSGYLPF

SEQ ID NO: 2700553 - protein, 17 aa, Entamoeba histolytica
YDHINNRFCALKILKNK

SEQ ID NO: 2700554 - protein, 23 aa, Entamoeba histolytica
YDIEFIKGLGIGCVLSVGKKPIH

SEQ ID NO: 2700555 - protein, 22 aa, Entamoeba histolytica
YDIKVLINIILRYHGIKLTDGK

SEQ ID NO: 2700556 - protein, 19 aa, Entamoeba histolytica
YDILNPFSEQICEKIVTEE

SEQ ID NO: 2700557 - protein, 18 aa, Entamoeba histolytica
YDINLCVKNDVPPIPPFI

SEQ ID NO: 2700558 - protein, 23 aa, Entamoeba histolytica
YDIPCLIKSYGIVHIVTHYQEYY

SEQ ID NO: 2700559 - protein, 19 aa, Entamoeba histolytica
YDIPELKPVPYVSQKPISY

SEQ ID NO: 2700560 - protein, 20 aa, Entamoeba histolytica
YDIPLGVLFSLSSSSGYITI

SEQ ID NO: 2700561 - protein, 19 aa, Entamoeba histolytica
YDIYSCSYCSTKYKKYLFY

SEQ ID NO: 2700562 - protein, 19 aa, Entamoeba histolytica
YDKAGGYGIQSGFTFISRI

SEQ ID NO: 2700563 - protein, 21 aa, Entamoeba histolytica
YDKDRGVACQMSKKMAIGDGI

SEQ ID NO: 2700564 - protein, 17 aa, Entamoeba histolytica
YDKGWRIRTEFKRYQIQ

SEQ ID NO: 2700565 - protein, 19 aa, Entamoeba histolytica
YDKLPWILRCRIQHTKCKY

SEQ ID NO: 2700566 - protein, 17 aa, Entamoeba histolytica
YDKSLLNYEIFDQVEGT

SEQ ID NO: 2700567 - protein, 19 aa, Entamoeba histolytica
YDKVYTFCCPSQIEFDEWM

SEQ ID NO: 2700568 - protein, 18 aa, Entamoeba histolytica
YDLADNFIDDGYDYSLPR

SEQ ID NO: 2700569 - protein, 18 aa, Entamoeba histolytica
YDLAESLLQSSTKTDELV

SEQ ID NO: 2700570 - protein, 25 aa, Entamoeba histolytica
YDLEPSLKLLVEFQNSIPIVLKKYK

SEQ ID NO: 2700571 - protein, 30 aa, Entamoeba histolytica; identical to SEQ ID NO: 2510035

SEQ ID NO: 2700572 - protein, 18 aa, Entamoeba histolytica
YDLGNSFKKVIERIEEYD

SEQ ID NO: 2700573 - protein, 25 aa, Entamoeba histolytica
YDLIVEVLETLPLIEDNSSRSALEF

SEQ ID NO: 2700574 - protein, 19 aa, Entamoeba histolytica
YDLKATCLNEKYIKENVLN

SEQ ID NO: 2700575 - protein, 19 aa, Entamoeba histolytica
YDLRPKNRIQMVHNLHLAM

SEQ ID NO: 2700576 - protein, 17 aa, Entamoeba histolytica
YDNCGTPVNGRMRDLIV

SEQ ID NO: 2700577 - protein, 28 aa, Entamoeba histolytica
YDNEIRACVPPEKYAVALHDYDSSTETE

SEQ ID NO: 2700578 - protein, 17 aa, Entamoeba histolytica
YDNLVGIFGANKIPCVG

SEQ ID NO: 2700579 - protein, 20 aa, Entamoeba histolytica
YDNPVFLDQDVFVFDEQMQQ

SEQ ID NO: 2700580 - protein, 24 aa, Entamoeba histolytica
YDNRKICHLFGINPSMKFGTINLE

SEQ ID NO: 2700581 - protein, 18 aa, Entamoeba histolytica
YDNRRLCTLFGIEQRLIL

SEQ ID NO: 2700582 - protein, 17 aa, Entamoeba histolytica
YDPCYLLPLTYHTLDRA

SEQ ID NO: 2700583 - protein, 24 aa, Entamoeba histolytica
YDPMKRWTPSQALYHPFLTGQQFT

SEQ ID NO: 2700584 - protein, 17 aa, Entamoeba histolytica
YDPTCLKEYPLLLRMVE

SEQ ID NO: 2700585 - protein, 27 aa, Entamoeba histolytica
YDREFLKDQFLLDGFDFPSQYNDIMSG

SEQ ID NO: 2700586 - protein, 21 aa, Entamoeba histolytica
YDRSIRTWGIEAQQLLLNSHI

SEQ ID NO: 2700587 - protein, 19 aa, Entamoeba histolytica
YDSCFGDALVKCVELMTPL

SEQ ID NO: 2700588 - protein, 17 aa, Entamoeba histolytica
YDSFNFEKLKICEFNEK

SEQ ID NO: 2700589 - protein, 20 aa, Entamoeba histolytica
YDSKACKWLNSFKELLTQFF

SEQ ID NO: 2700590 - protein, 19 aa, Entamoeba histolytica
YDSLFNVKRIICIQMLCDE

SEQ ID NO: 2700591 - protein, 19 aa, Entamoeba histolytica
YDSTICFVVSHLAAHQEFW

SEQ ID NO: 2700592 - protein, 19 aa, Entamoeba histolytica
YDSTIRFVGVYGKGNNRVI

SEQ ID NO: 2700593 - protein, 25 aa, Entamoeba histolytica
YDSVPIPIGIEVKGGKFEILINDGE

SEQ ID NO: 2700594 - protein, 20 aa, Entamoeba histolytica
YDTIVSLPFICQSQELFKKI

SEQ ID NO: 2700595 - protein, 17 aa, Entamoeba histolytica
YDTLEFSNEWNIAMFVC

SEQ ID NO: 2700596 - protein, 19 aa, Entamoeba histolytica
YDVEFLRAFIGNAKNFNPI

SEQ ID NO: 2700597 - protein, 17 aa, Entamoeba histolytica
YDVGEIAAKIAQLYYHY

SEQ ID NO: 2700598 - protein, 18 aa, Entamoeba histolytica
YDVLDRYPSLSIVDEIQT

SEQ ID NO: 2700599 - protein, 17 aa, Entamoeba histolytica
YDYLRITEKGNYQYIVF

SEQ ID NO: 2700600 - protein, 17 aa, Entamoeba histolytica
YDYPMKPPFFFTDPSPD

SEQ ID NO: 2700601 - protein, 17 aa, Entamoeba histolytica
YDYTGAHLWGVYADGST

SEQ ID NO: 2700602 - protein, 19 aa, Entamoeba histolytica
YDYYYLKTMVRYSLVTDRY

SEQ ID NO: 2700603 - protein, 17 aa, Entamoeba histolytica
YEALKIIISNPCLSEIE

SEQ ID NO: 2700604 - protein, 25 aa, Entamoeba histolytica
YEALNALRLLLVFGDENDLDTKNYY

SEQ ID NO: 2700605 - protein, 17 aa, Entamoeba histolytica
YEAPGFDNMTLIVAVFD

SEQ ID NO: 2700606 - protein, 18 aa, Entamoeba histolytica
YEAPWTVYSVSWSNRNDK

SEQ ID NO: 2700607 - protein, 20 aa, Entamoeba histolytica
YECEEGYKLEEGMCKYHDTN

SEQ ID NO: 2700608 - protein, 21 aa, Entamoeba histolytica
YECIIGCKKDPLFGPVIVFGM

SEQ ID NO: 2700609 - protein, 17 aa, Entamoeba histolytica
YECKYDGVEFLCDNSNV

SEQ ID NO: 2700610 - protein, 21 aa, Entamoeba histolytica
YEDAIKCLLIIIECYNKPVAL

SEQ ID NO: 2700611 - protein, 17 aa, Entamoeba histolytica
YEDCVWVNKMAIIVGTE

SEQ ID NO: 2700612 - protein, 22 aa, Entamoeba histolytica
YEDDCVYGLFRILQLLHKEKDG

SEQ ID NO: 2700613 - protein, 18 aa, Entamoeba histolytica
YEDFDIINDIGFVEKQRF

SEQ ID NO: 2700614 - protein, 32 aa, Entamoeba histolytica
YEDGYCKKGKIGVTQPRRVACMSIARRVSEEV

SEQ ID NO: 2700615 - protein, 19 aa, Entamoeba histolytica
YEDIWKRKEVEEELDENDK

SEQ ID NO: 2700616 - protein, 25 aa, Entamoeba histolytica
YEDKRKEYALCFNVTVQLLQFQNDE

SEQ ID NO: 2700617 - protein, 33 aa, Entamoeba histolytica
YEDMYSTIFPSRWKVGEALVLEFVSSTKVAFSM

SEQ ID NO: 2700618 - protein, 38 aa, Entamoeba histolytica
YEEALVKFLDSWLCIFSSELFIGKSFKCEVFDDNDEEN

SEQ ID NO: 2700619 - protein, 24 aa, Entamoeba histolytica
YEEASAISEMIGFRAYYRNRDNQF

SEQ ID NO: 2700620 - protein, 22 aa, Entamoeba histolytica
YEECFEILTSECWNNPPEGMTQ

SEQ ID NO: 2700621 - protein, 24 aa, Entamoeba histolytica
YEEECPWKDIGKLLSYFEEKKSLD

SEQ ID NO: 2700622 - protein, 24 aa, Entamoeba histolytica
YEEEEIRLLQTLQLEYLIDNKVNS

SEQ ID NO: 2700623 - protein, 24 aa, Entamoeba histolytica
YEEFLHLFYCYSIHTQKDFFKIQV

SEQ ID NO: 2700624 - protein, 39 aa, Entamoeba histolytica
YEEGIKYSIPLWLAIHFKQIGLCKIVIPHWLSLEQLKET

SEQ ID NO: 2700625 - protein, 24 aa, Entamoeba histolytica
YEEHPRYLLRKNIVADDMENGICW

SEQ ID NO: 2700626 - protein, 18 aa, Entamoeba histolytica
YEEIGIKPPKGVILYGPP

SEQ ID NO: 2700627 - protein, 21 aa, Entamoeba histolytica
YEELYFPSLIIVDYLNVINLE

SEQ ID NO: 2700628 - protein, 25 aa, Entamoeba histolytica
YEENEFYTIFGTYFKKNAKWSINKN

SEQ ID NO: 2700629 - protein, 24 aa, Entamoeba histolytica
YEESCFRHCNKLTINEVFSNLKSI

SEQ ID NO: 2700630 - protein, 25 aa, Entamoeba histolytica
YEEWTHFKCQLEFWNKMPNELSEAP

SEQ ID NO: 2700631 - protein, 19 aa, Entamoeba histolytica
YEFCEGGNLYKYIDEQSTP

SEQ ID NO: 2700632 - protein, 23 aa, Entamoeba histolytica
YEFCGYPYHDTCIKCNGCNKPLR

SEQ ID NO: 2700633 - protein, 21 aa, Entamoeba histolytica
YEFELFITIKCITKINDKIMI

SEQ ID NO: 2700634 - protein, 24 aa, Entamoeba histolytica
YEFISKISAIKCRSTNVLLNKLSE

SEQ ID NO: 2700635 - protein, 18 aa, Entamoeba histolytica
YEFKSMHGLVTLNLKPQD

SEQ ID NO: 2700636 - protein, 19 aa, Entamoeba histolytica
YEGGLRFVLSTANLIPLDY

SEQ ID NO: 2700637 - protein, 22 aa, Entamoeba histolytica
YEGRCAFPSNFDSTYCYALGYT

SEQ ID NO: 2700638 - protein, 28 aa, Entamoeba histolytica
YEHLKSWKFSSEAVIFDFGKFNNGEIIK

SEQ ID NO: 2700639 - protein, 25 aa, Entamoeba histolytica
YEHLNEFRIQLDMDRRMYSISKKSK

SEQ ID NO: 2700640 - protein, 23 aa, Entamoeba histolytica
YEHNPRLHLTWFNKMAAENRKNL

SEQ ID NO: 2700641 - protein, 25 aa, Entamoeba histolytica
YEIDGMIKKDGCQDLLIKFEEDEGR

SEQ ID NO: 2700642 - protein, 18 aa, Entamoeba histolytica
YEIPSAVEYCLVRRMRKE

SEQ ID NO: 2700643 - protein, 17 aa, Entamoeba histolytica
YEIPSFQKIQVKEHELV

SEQ ID NO: 2700644 - protein, 19 aa, Entamoeba histolytica
YEIRIFKERGNLLMNELAD

SEQ ID NO: 2700645 - protein, 18 aa, Entamoeba histolytica
YEITDAFLTLLDNNHLTV

SEQ ID NO: 2700646 - protein, 17 aa, Entamoeba histolytica
YEKALKLYNDWDKSKAL

SEQ ID NO: 2700647 - protein, 17 aa, Entamoeba histolytica
YEKEFKEATKLGDQLAL

SEQ ID NO: 2700648 - protein, 26 aa, Entamoeba histolytica
YEKFKDSMKWTCIDASQSKEEVALEI

SEQ ID NO: 2700649 - protein, 20 aa, Entamoeba histolytica
YEKFMPALVQYYKQAREKHL

SEQ ID NO: 2700650 - protein, 36 aa, Entamoeba histolytica
YEKMVRVSGKFFLKWRITELKPEYLNSGDVFIIDKI

SEQ ID NO: 2700651 - protein, 19 aa, Entamoeba histolytica
YEKNLPFNKKVVEYQNELA

SEQ ID NO: 2700652 - protein, 25 aa, Entamoeba histolytica
YEKQDFNRFLTLIIKACDMVDKKIK

SEQ ID NO: 2700653 - protein, 18 aa, Entamoeba histolytica
YEKYHFVEVFNGDFNEQV

SEQ ID NO: 2700654 - protein, 27 aa, Entamoeba histolytica
YELARKLQICCPYGTPIESLDSEWIKS

SEQ ID NO: 2700655 - protein, 21 aa, Entamoeba histolytica
YELFLVKMLPFFKDLINKKIL

SEQ ID NO: 2700656 - protein, 26 aa, Entamoeba histolytica
YELIGSCFSLPLSHSILTQRGLDIYK

SEQ ID NO: 2700657 - protein, 17 aa, Entamoeba histolytica
YELKSGTSYVEVHDTSK

SEQ ID NO: 2700658 - protein, 22 aa, Entamoeba histolytica
YELNCACPIDYVYKKGMGAQLI

SEQ ID NO: 2700659 - protein, 17 aa, Entamoeba histolytica
YELRFSAFEKCHTPQYI

SEQ ID NO: 2700660 - protein, 28 aa, Entamoeba histolytica
YELTLFTGIEMKDFLGSAWTKKDKYERC

SEQ ID NO: 2700661 - protein, 23 aa, Entamoeba histolytica
YELYDPVTVMFFYRKKHIQVDLG

SEQ ID NO: 2700662 - protein, 17 aa, Entamoeba histolytica
YELYTSKMLFAIADVGE

SEQ ID NO: 2700663 - protein, 25 aa, Entamoeba histolytica
YEMDNRPASALPFKISAAKLDALSG

SEQ ID NO: 2700664 - protein, 26 aa, Entamoeba histolytica
YEMDNRPASALPFKISAAKLDALSGQ

SEQ ID NO: 2700665 - protein, 17 aa, Entamoeba histolytica
YEMLISRIKIIQKEYQN

SEQ ID NO: 2700666 - protein, 17 aa, Entamoeba histolytica
YEMLKSIGYNTSLKSTR

SEQ ID NO: 2700667 - protein, 18 aa, Entamoeba histolytica
YEMLLCQMIQKYLYFISQ

SEQ ID NO: 2700668 - protein, 23 aa, Entamoeba histolytica
YEMLRLAIEKQIRKFGLPYTADV

SEQ ID NO: 2700669 - protein, 19 aa, Entamoeba histolytica
YEMSQRFYLTQQMVIEETQ

SEQ ID NO: 2700670 - protein, 23 aa, Entamoeba histolytica
YEMYRTVCYDFYVKEGEYYRIIN

SEQ ID NO: 2700671 - protein, 23 aa, Entamoeba histolytica
YENSPVIFKNGFDVHIVNNHYHH

SEQ ID NO: 2700672 - protein, 20 aa, Entamoeba histolytica
YEPAPPRRLLIRIFGEGDAA

SEQ ID NO: 2700673 - protein, 34 aa, Entamoeba histolytica; identical to SEQ ID NO: 2510147

SEQ ID NO: 2700674 - protein, 23 aa, Entamoeba histolytica
YEPFGCYINHPFKKEGWNGDIHS

SEQ ID NO: 2700675 - protein, 26 aa, Entamoeba histolytica
YEPILKRNPHLFLMGFNQPGDLFRFE

SEQ ID NO: 2700676 - protein, 17 aa, Entamoeba histolytica
YEQAALWLKWDKTPETR

SEQ ID NO: 2700677 - protein, 22 aa, Entamoeba histolytica
YEQAMFKERFCDFYDNSNNIKK

SEQ ID NO: 2700678 - protein, 23 aa, Entamoeba histolytica
YEQVFQAVAALKCKKEGEEEEFA

SEQ ID NO: 2700679 - protein, 17 aa, Entamoeba histolytica
YEREWSTLITTGVDSKI

SEQ ID NO: 2700680 - protein, 22 aa, Entamoeba histolytica
YERFIRPAAMRFTKAHVTHPEL

SEQ ID NO: 2700681 - protein, 17 aa, Entamoeba histolytica
YERIKFKMNNEVCVGLW

SEQ ID NO: 2700682 - protein, 19 aa, Entamoeba histolytica
YERLEICYSDHLPVRCIAI

SEQ ID NO: 2700683 - protein, 30 aa, Entamoeba histolytica; identical to SEQ ID NO: 2510157

SEQ ID NO: 2700684 - protein, 17 aa, Entamoeba histolytica
YESFKQEQLHIIVVIQF

SEQ ID NO: 2700685 - protein, 18 aa, Entamoeba histolytica
YESIPSKLRNTMFEYQRI

SEQ ID NO: 2700686 - protein, 23 aa, Entamoeba histolytica
YESKFPIPFLSLISHCLLIPLLP

SEQ ID NO: 2700687 - protein, 25 aa, Entamoeba histolytica
YESYKYKLNCLKQIKKCLNKTKDTY

SEQ ID NO: 2700688 - protein, 20 aa, Entamoeba histolytica
YETFCSIAIMKITKRGVAKK

SEQ ID NO: 2700689 - protein, 20 aa, Entamoeba histolytica
YETFLYLGIEAGRTQLEAEL

SEQ ID NO: 2700690 - protein, 17 aa, Entamoeba histolytica
YETKWLLLQRHSPDASQ

SEQ ID NO: 2700691 - protein, 25 aa, Entamoeba histolytica
YETMKYCTYKFPQLKNHLNFVEYIQ

SEQ ID NO: 2700692 - protein, 20 aa, Entamoeba histolytica
YEVLWNIGLVEYYKTEVGLT

SEQ ID NO: 2700693 - protein, 20 aa, Entamoeba histolytica
YEVRSKLTVLCGKENRVNII

SEQ ID NO: 2700694 - protein, 19 aa, Entamoeba histolytica
YEVSCAFKINDPTKQSIIC

SEQ ID NO: 2700695 - protein, 20 aa, Entamoeba histolytica
YEVSFEFSSVLPFSIPTYQF

SEQ ID NO: 2700696 - protein, 22 aa, Entamoeba histolytica
YEVVKMRSILYGLLEKIEILTM

SEQ ID NO: 2700697 - protein, 20 aa, Entamoeba histolytica
YEVWCKYGGATNQRIIIDMK

SEQ ID NO: 2700698 - protein, 17 aa, Entamoeba histolytica
YEWENVFLACGITREEI

SEQ ID NO: 2700699 - protein, 21 aa, Entamoeba histolytica
YEWNFPMALVTGIYIPPLTME

SEQ ID NO: 2700700 - protein, 24 aa, Entamoeba histolytica
YEYHPGKHLFPFCIPLKNFPHSVN

SEQ ID NO: 2700701 - protein, 20 aa, Entamoeba histolytica
YEYKRKIFVGKQAILPDVRK

SEQ ID NO: 2700702 - protein, 33 aa, Entamoeba histolytica
YEYLILKEYYFACAVCLVMYKQHHLAIELLLKH

SEQ ID NO: 2700703 - protein, 19 aa, Entamoeba histolytica
YEYLIPKVDGIECKAQREI

SEQ ID NO: 2700704 - protein, 22 aa, Entamoeba histolytica
YEYSELYIAYQYYYFYDKDVDF

SEQ ID NO: 2700705 - protein, 17 aa, Entamoeba histolytica
YEYTIKLLNMFIEEDKQ

SEQ ID NO: 2700706 - protein, 20 aa, Entamoeba histolytica
YFADRKIFCAGRVEEDDMKR

SEQ ID NO: 2700707 - protein, 17 aa, Entamoeba histolytica
YFAEIIVAGPSADFELI

SEQ ID NO: 2700708 - protein, 24 aa, Entamoeba histolytica
YFAYKEQYYEIAFNMQHENAPIGS

SEQ ID NO: 2700709 - protein, 18 aa, Entamoeba histolytica
YFCFKRKDIDHVGSVINS

SEQ ID NO: 2700710 - protein, 25 aa, Entamoeba histolytica
YFDDLCQWTKLNAINHIEIITMERL

SEQ ID NO: 2700711 - protein, 23 aa, Entamoeba histolytica
YFDKYLREITMNKGMVKMSLPLA

SEQ ID NO: 2700712 - protein, 19 aa, Entamoeba histolytica
YFDPCLIELELLKKEIGSY

SEQ ID NO: 2700713 - protein, 18 aa, Entamoeba histolytica
YFDTIPPSVSWSINGDII

SEQ ID NO: 2700714 - protein, 27 aa, Entamoeba histolytica
YFEIISKEIVIEWILTKIGNIFNGIHY

SEQ ID NO: 2700715 - protein, 27 aa, Entamoeba histolytica
YFESGDALSGYFCKGLFSFLNEQENFI

SEQ ID NO: 2700716 - protein, 22 aa, Entamoeba histolytica
YFETISPLIIQKRVIAYNRFNR

SEQ ID NO: 2700717 - protein, 26 aa, Entamoeba histolytica
YFEVGRSSIILRFVLDKFVERYEPTL

SEQ ID NO: 2700718 - protein, 17 aa, Entamoeba histolytica
YFFEKKIKQMKIKDIEE

SEQ ID NO: 2700719 - protein, 17 aa, Entamoeba histolytica
YFFKRDILKQMEGTWPE

SEQ ID NO: 2700720 - protein, 17 aa, Entamoeba histolytica
YFFKTDELFFNQNEPQK

SEQ ID NO: 2700721 - protein, 23 aa, Entamoeba histolytica
YFGRKISSFILFPNQIITIKTES

SEQ ID NO: 2700722 - protein, 26 aa, Entamoeba histolytica
YFHDKRVDGSLTFSQANIFSGSTLIY

SEQ ID NO: 2700723 - protein, 19 aa, Entamoeba histolytica
YFHHGRMNSLFTWAFEKEL

SEQ ID NO: 2700724 - protein, 18 aa, Entamoeba histolytica
YFHPTKPWILSCSDDRTI

SEQ ID NO: 2700725 - protein, 17 aa, Entamoeba histolytica
YFHSVCFDFNEVLIDYV

SEQ ID NO: 2700726 - protein, 18 aa, Entamoeba histolytica
YFHYYLKYFAIRDKVSAR

SEQ ID NO: 2700727 - protein, 17 aa, Entamoeba histolytica
YFIDLYQPLLVYKQIQE

SEQ ID NO: 2700728 - protein, 19 aa, Entamoeba histolytica
YFIDYGIKSSLQFKTYGQT

SEQ ID NO: 2700729 - protein, 17 aa, Entamoeba histolytica
YFIIKWSHHCSFNSSNI

SEQ ID NO: 2700730 - protein, 18 aa, Entamoeba histolytica
YFIKVAQCCIDLYDLNMG

SEQ ID NO: 2700731 - protein, 18 aa, Entamoeba histolytica
YFILKVNEINGGRKATVG

SEQ ID NO: 2700732 - protein, 25 aa, Entamoeba histolytica
YFIQRKIIKGKRMFIGIIGELINGY

SEQ ID NO: 2700733 - protein, 24 aa, Entamoeba histolytica
YFKCNGRYSLLLGKILSDCDLINQ

SEQ ID NO: 2700734 - protein, 21 aa, Entamoeba histolytica
YFKDICLFKQVVFISRKYKHF

SEQ ID NO: 2700735 - protein, 17 aa, Entamoeba histolytica
YFKEVIEYLKGINADTQ

SEQ ID NO: 2700736 - protein, 24 aa, Entamoeba histolytica
YFKTICQYNLYPVHFLVFLKMVHS

SEQ ID NO: 2700737 - protein, 28 aa, Entamoeba histolytica
YFLHLKFPRLVSHLFPFFNDLTHQKRSL

SEQ ID NO: 2700738 - protein, 17 aa, Entamoeba histolytica
YFLKELFLFEQYLPSYL

SEQ ID NO: 2700739 - protein, 22 aa, Entamoeba histolytica
YFLKSWPHLCFFAKDKTTNKYV

SEQ ID NO: 2700740 - protein, 18 aa, Entamoeba histolytica
YFLPYLYIVCYYSHLSIP

SEQ ID NO: 2700741 - protein, 26 aa, Entamoeba histolytica
YFLQSEYYKIGLFGLNGKYYESQLSL

SEQ ID NO: 2700742 - protein, 17 aa, Entamoeba histolytica
YFLVPVVRGSFTEEDYQ

SEQ ID NO: 2700743 - protein, 21 aa, Entamoeba histolytica
YFMFIGGCWCIIITDEKIGVD

SEQ ID NO: 2700744 - protein, 30 aa, Entamoeba histolytica; identical to SEQ ID NO: 2510229

SEQ ID NO: 2700745 - protein, 19 aa, Entamoeba histolytica
YFNECWKYKHIEPEYISNI

SEQ ID NO: 2700746 - protein, 23 aa, Entamoeba histolytica
YFNFRQECCFKYGDHIYNEVMKT

SEQ ID NO: 2700747 - protein, 21 aa, Entamoeba histolytica
YFNFSCVDLSYFLDQPIEKSL

SEQ ID NO: 2700748 - protein, 18 aa, Entamoeba histolytica
YFNGGSLFQYISKNHNIP

SEQ ID NO: 2700749 - protein, 18 aa, Entamoeba histolytica
YFNIPRQYFYLIKNGKLK

SEQ ID NO: 2700750 - protein, 18 aa, Entamoeba histolytica
YFPENCKKKVTAKQLLAV

SEQ ID NO: 2700751 - protein, 17 aa, Entamoeba histolytica
YFPEWSSYYSYPQNYNQ

SEQ ID NO: 2700752 - protein, 21 aa, Entamoeba histolytica
YFPKRLKVIKKLIPLIKTFDE

SEQ ID NO: 2700753 - protein, 26 aa, Entamoeba histolytica
YFPLQSRLSLFITFYNEYSKLFLIDY

SEQ ID NO: 2700754 - protein, 27 aa, Entamoeba histolytica
YFPPRGEHFCCGKIEKSSCINGVYNTN

SEQ ID NO: 2700755 - protein, 20 aa, Entamoeba histolytica
YFQNICWIYCNLVCSNIMAR

SEQ ID NO: 2700756 - protein, 19 aa, Entamoeba histolytica
YFQSCFDFIDHAFSQNEKV

SEQ ID NO: 2700757 - protein, 23 aa, Entamoeba histolytica
YFRIPLPDILHWINIDISSQSGK

SEQ ID NO: 2700758 - protein, 20 aa, Entamoeba histolytica
YFRNGHGFLIVYSVTDRNSF

SEQ ID NO: 2700759 - protein, 26 aa, Entamoeba histolytica
YFSAYRIDHILGFFRIWSIPAGHRTG

SEQ ID NO: 2700760 - protein, 24 aa, Entamoeba histolytica
YFSCSLQPSHLVLIPYNAFTAVLH

SEQ ID NO: 2700761 - protein, 20 aa, Entamoeba histolytica
YFSFESFNLLTSISLTGKTF

SEQ ID NO: 2700762 - protein, 17 aa, Entamoeba histolytica
YFSLGSMIFEFICGIPP

SEQ ID NO: 2700763 - protein, 17 aa, Entamoeba histolytica
YFSLSIDGTTHFLELEI

SEQ ID NO: 2700764 - protein, 19 aa, Entamoeba histolytica
YFVKLLLAFHDVKRKRRGK

SEQ ID NO: 2700765 - protein, 18 aa, Entamoeba histolytica
YFYHLFPECCGGYIRMED

SEQ ID NO: 2700766 - protein, 18 aa, Entamoeba histolytica
YFYWKYTEPSVMSLHEMY

SEQ ID NO: 2700767 - protein, 20 aa, Entamoeba histolytica
YGAACTGALSSIVERYCTKE

SEQ ID NO: 2700768 - protein, 27 aa, Entamoeba histolytica
YGAEHLLRLVAKLPQICYEIHFDKMDE

SEQ ID NO: 2700769 - protein, 29 aa, Entamoeba histolytica
YGAKLMVPGLLRYSKGITMNEIVVLMTSK

SEQ ID NO: 2700770 - protein, 24 aa, Entamoeba histolytica
YGALFCILDQFLVSGIKTITRYIL

SEQ ID NO: 2700771 - protein, 21 aa, Entamoeba histolytica
YGANRGVIVYGEIDTPAHTAS

SEQ ID NO: 2700772 - protein, 23 aa, Entamoeba histolytica
YGANRGVIVYGEIDTPAHTASWN

SEQ ID NO: 2700773 - protein, 18 aa, Entamoeba histolytica
YGANWKYEHPLEIRCVGV

SEQ ID NO: 2700774 - protein, 19 aa, Entamoeba histolytica
YGATFKKLAAEQEKMRELA

SEQ ID NO: 2700775 - protein, 19 aa, Entamoeba histolytica
YGCLAKFALVQPIKRIPKL

SEQ ID NO: 2700776 - protein, 19 aa, Entamoeba histolytica
YGDEIKLAPFMGTLTALSS

SEQ ID NO: 2700777 - protein, 18 aa, Entamoeba histolytica
YGDFQKFVLQFISNCHDK

SEQ ID NO: 2700778 - protein, 25 aa, Entamoeba histolytica
YGDKSVCVLSTFFFENMRRANDPNV

SEQ ID NO: 2700779 - protein, 17 aa, Entamoeba histolytica
YGDSYIFIGKDNAKYFT

SEQ ID NO: 2700780 - protein, 20 aa, Entamoeba histolytica
YGDTAIKWACYASNTQLKTQ

SEQ ID NO: 2700781 - protein, 18 aa, Entamoeba histolytica
YGDYLFKENLDFSYKLLR

SEQ ID NO: 2700782 - protein, 26 aa, Entamoeba histolytica
YGEIWLGFYSHLIVSFILTIDEQNVK

SEQ ID NO: 2700783 - protein, 20 aa, Entamoeba histolytica
YGELPPNLINAIAANDRLQE

SEQ ID NO: 2700784 - protein, 21 aa, Entamoeba histolytica
YGELPPNLINAIAANYKLHEE

SEQ ID NO: 2700785 - protein, 25 aa, Entamoeba histolytica
YGFAPRISFLTSRTVQLEIKDPINK

SEQ ID NO: 2700786 - protein, 19 aa, Entamoeba histolytica
YGFDTKFKAKVCKIKDSSS

SEQ ID NO: 2700787 - protein, 17 aa, Entamoeba histolytica
YGFGEWKEEQKLEVQKL

SEQ ID NO: 2700788 - protein, 25 aa, Entamoeba histolytica
YGFIKRVCPFVQSYYRSLIQTKQMK

SEQ ID NO: 2700789 - protein, 21 aa, Entamoeba histolytica
YGFKGNPFVFPIPNEEPSVPY

SEQ ID NO: 2700790 - protein, 17 aa, Entamoeba histolytica
YGFRGEALYCISNMGEV

SEQ ID NO: 2700791 - protein, 18 aa, Entamoeba histolytica
YGGIAIEVPTRFEDKWQI

SEQ ID NO: 2700792 - protein, 19 aa, Entamoeba histolytica
YGGNGFKFDIKEEITTMEN

SEQ ID NO: 2700793 - protein, 30 aa, Entamoeba histolytica
YGHEIERLYKIAICLSEKVEIEQEKIGMYL

SEQ ID NO: 2700794 - protein, 20 aa, Entamoeba histolytica
YGHPGIVIDAIFLSNGCNGC

SEQ ID NO: 2700795 - protein, 20 aa, Entamoeba histolytica
YGICIQMEYCTGGDLSKIIK

SEQ ID NO: 2700796 - protein, 19 aa, Entamoeba histolytica
YGIEVDWWSLGVVVYEMLS

SEQ ID NO: 2700797 - protein, 17 aa, Entamoeba histolytica
YGIKSIRSIFGPKTDLD

SEQ ID NO: 2700798 - protein, 17 aa, Entamoeba histolytica
YGIPKGIFFSMPVVCYG

SEQ ID NO: 2700799 - protein, 17 aa, Entamoeba histolytica
YGIRIFRKKEMPIVGPL

SEQ ID NO: 2700800 - protein, 25 aa, Entamoeba histolytica
YGKDLRDAFELCIRFKNKGKRASEK

SEQ ID NO: 2700801 - protein, 18 aa, Entamoeba histolytica
YGKDVMKIAEEYHFELEL

SEQ ID NO: 2700802 - protein, 22 aa, Entamoeba histolytica
YGKFKAADALSKISRQRSNTSN

SEQ ID NO: 2700803 - protein, 18 aa, Entamoeba histolytica
YGKFMGVSYYQFTPFIEH

SEQ ID NO: 2700804 - protein, 23 aa, Entamoeba histolytica
YGKLLGLKGHSLYKEKSKQYKLL

SEQ ID NO: 2700805 - protein, 17 aa, Entamoeba histolytica
YGKNSMCRIEYNSPKLL

SEQ ID NO: 2700806 - protein, 30 aa, Entamoeba histolytica
YGKPAIPYLKFFLKEMCQIFEEEEEIDDTK

SEQ ID NO: 2700807 - protein, 25 aa, Entamoeba histolytica
YGKRTTVLCYLLFRLRTISYPKPQL

SEQ ID NO: 2700808 - protein, 21 aa, Entamoeba histolytica
YGKSRTVLEFVAGAKRNRKFN

SEQ ID NO: 2700809 - protein, 17 aa, Entamoeba histolytica
YGLAAEIYTHFTSPIRR

SEQ ID NO: 2700810 - protein, 22 aa, Entamoeba histolytica
YGLDLPSRWNLFDSNQQTQYRI

SEQ ID NO: 2700811 - protein, 28 aa, Entamoeba histolytica
YGLEPPKLWLKNDILNFMIHKLGISDKQ

SEQ ID NO: 2700812 - protein, 17 aa, Entamoeba histolytica
YGLRSCFHFPGRYYLVQ

SEQ ID NO: 2700813 - protein, 24 aa, Entamoeba histolytica
YGMDGLYDLYAIVVHLGKTKFSGH

SEQ ID NO: 2700814 - protein, 17 aa, Entamoeba histolytica
YGNIYGYITIKFHYNKF

SEQ ID NO: 2700815 - protein, 23 aa, Entamoeba histolytica
YGNKLILGLLYTLYRIYRMNPVD

SEQ ID NO: 2700816 - protein, 27 aa, Entamoeba histolytica
YGNRGRFDGRRGLNHIGRRHMNHNNRR

SEQ ID NO: 2700817 - protein, 18 aa, Entamoeba histolytica
YGNVLLLSSYCATLTGII

SEQ ID NO: 2700818 - protein, 19 aa, Entamoeba histolytica
YGNVNVWKHCVALFEFMAT

SEQ ID NO: 2700819 - protein, 18 aa, Entamoeba histolytica
YGNYLFSVIIRLDHTRYS

SEQ ID NO: 2700820 - protein, 18 aa, Entamoeba histolytica
YGPTRVKRYWKFDNTELQ

SEQ ID NO: 2700821 - protein, 34 aa, Entamoeba histolytica
YGQINGAPRFDQMPPGYNQMGGMPYYGTQQYPGY

SEQ ID NO: 2700822 - protein, 29 aa, Entamoeba histolytica
YGQYQIVRIWGCIFARALSSEVQENTDRI

SEQ ID NO: 2700823 - protein, 20 aa, Entamoeba histolytica
YGRKNILGMVITKNNDIFGS

SEQ ID NO: 2700824 - protein, 26 aa, Entamoeba histolytica
YGSDAAVFKKEFPSSDFIIFGPGTVE

SEQ ID NO: 2700825 - protein, 23 aa, Entamoeba histolytica
YGSGLLPKIILVVIEELTTETKK

SEQ ID NO: 2700826 - protein, 21 aa, Entamoeba histolytica
YGSRCRFIHVLPGELSPAPDC

SEQ ID NO: 2700827 - protein, 18 aa, Entamoeba histolytica
YGTDMSMKTIVHLPSDSI

SEQ ID NO: 2700828 - protein, 19 aa, Entamoeba histolytica
YGTNESLQWLLKHDANTKI

SEQ ID NO: 2700829 - protein, 17 aa, Entamoeba histolytica
YGTNVLNIFSWAMPCKR

SEQ ID NO: 2700830 - protein, 17 aa, Entamoeba histolytica
YGTRLLVRQEFTPVYQI

SEQ ID NO: 2700831 - protein, 22 aa, Entamoeba histolytica
YGTSWKLLLKVICEKEKENNKE

SEQ ID NO: 2700832 - protein, 26 aa, Entamoeba histolytica
YGVELFLLLCSLKVVFPSQFIILRGN

SEQ ID NO: 2700833 - protein, 19 aa, Entamoeba histolytica
YGVGCKRDFFIKVKNRFEK

SEQ ID NO: 2700834 - protein, 17 aa, Entamoeba histolytica
YGVIFGSTFIARAEAKN

SEQ ID NO: 2700835 - protein, 17 aa, Entamoeba histolytica
YGVPINYAFDGVQNLYF

SEQ ID NO: 2700836 - protein, 17 aa, Entamoeba histolytica
YGVSFLYAGWDRYFGYQ

SEQ ID NO: 2700837 - protein, 25 aa, Entamoeba histolytica
YGVTSIGVFEYVKLGLDYLKLNNYT

SEQ ID NO: 2700838 - protein, 17 aa, Entamoeba histolytica
YGYEIPRDFEVKGIGKD

SEQ ID NO: 2700839 - protein, 24 aa, Entamoeba histolytica
YGYHLPKRANAIMTVGEKKKKKEN

SEQ ID NO: 2700840 - protein, 25 aa, Entamoeba histolytica
YGYKDLKVHVLISVYSHQMYVDFSY

SEQ ID NO: 2700841 - protein, 23 aa, Entamoeba histolytica
YGYNELRVPFGIENENIPLDYNF

SEQ ID NO: 2700842 - protein, 20 aa, Entamoeba histolytica
YHAIELFRKAKMTWFGVEVC

SEQ ID NO: 2700843 - protein, 21 aa, Entamoeba histolytica
YHCIMRGGECGCILADEMGLG

SEQ ID NO: 2700844 - protein, 19 aa, Entamoeba histolytica
YHDSLKYVFFPGGSGNYCG

SEQ ID NO: 2700845 - protein, 26 aa, Entamoeba histolytica
YHENDLFDRFGRFCIIPIQNIMNENT

SEQ ID NO: 2700846 - protein, 18 aa, Entamoeba histolytica
YHFDLFLKLMVKMKLCVK

SEQ ID NO: 2700847 - protein, 24 aa, Entamoeba histolytica
YHFMFPIEPFKVIAMIKPQEKCFG

SEQ ID NO: 2700848 - protein, 22 aa, Entamoeba histolytica
YHGIKLLLYLLKHQSYSSEVEL

SEQ ID NO: 2700849 - protein, 18 aa, Entamoeba histolytica
YHGSRLTNFVGILSTGLR

SEQ ID NO: 2700850 - protein, 25 aa, Entamoeba histolytica
YHIKCNIEGFKVMKLISEASFNLFK

SEQ ID NO: 2700851 - protein, 17 aa, Entamoeba histolytica
YHIRKARKTLIFVELRD

SEQ ID NO: 2700852 - protein, 18 aa, Entamoeba histolytica
YHIYDICYYCELKSIHLL

SEQ ID NO: 2700853 - protein, 17 aa, Entamoeba histolytica
YHKKLTVIYSMKDKHEE

SEQ ID NO: 2700854 - protein, 27 aa, Entamoeba histolytica
YHLLPQIEILPENKFAIKYLDKDDISK

SEQ ID NO: 2700855 - protein, 18 aa, Entamoeba histolytica
YHLLYYLLSLFVSSYSDN

SEQ ID NO: 2700856 - protein, 19 aa, Entamoeba histolytica
YHLSRLISRLIIKCKNIEY

SEQ ID NO: 2700857 - protein, 23 aa, Entamoeba histolytica
YHMIYWYISILFSMSYEHLNEFR

SEQ ID NO: 2700858 - protein, 29 aa, Entamoeba histolytica
YHNKFLPSLEMYYCLCFMDYAVKRNSNFR

SEQ ID NO: 2700859 - protein, 18 aa, Entamoeba histolytica
YHNTICDLFEQMKEFKTM

SEQ ID NO: 2700860 - protein, 30 aa, Entamoeba histolytica; identical to SEQ ID NO: 2510350

SEQ ID NO: 2700861 - protein, 18 aa, Entamoeba histolytica
YHPIIVLFYGLPRYPHEF

SEQ ID NO: 2700862 - protein, 21 aa, Entamoeba histolytica
YHQIRLFKFTFWVTSVDIEEI

SEQ ID NO: 2700863 - protein, 19 aa, Entamoeba histolytica
YHQLCEEFEERGDVKLSHM

SEQ ID NO: 2700864 - protein, 25 aa, Entamoeba histolytica
YHQQCFGCTTCSRKLGASFVTVDNQ

SEQ ID NO: 2700865 - protein, 17 aa, Entamoeba histolytica
YHRDWKRIEQHVKTKTV

SEQ ID NO: 2700866 - protein, 22 aa, Entamoeba histolytica
YHRLEIIINKWFIQKWKLQPNK

SEQ ID NO: 2700867 - protein, 18 aa, Entamoeba histolytica
YHRLFYPIIDRIMEVFQP

SEQ ID NO: 2700868 - protein, 21 aa, Entamoeba histolytica
YHSECFVCTKCSKPFPTPSFF

SEQ ID NO: 2700869 - protein, 22 aa, Entamoeba histolytica
YHSEPYFLSLTFKNDIAKDGTE

SEQ ID NO: 2700870 - protein, 21 aa, Entamoeba histolytica
YHSGEKFRVLSLDGGGVKCIY

SEQ ID NO: 2700871 - protein, 18 aa, Entamoeba histolytica
YHSHLCIVTELLGKNLYQ

SEQ ID NO: 2700872 - protein, 21 aa, Entamoeba histolytica
YHSIFLFKTSKEWISCLTNSD

SEQ ID NO: 2700873 - protein, 18 aa, Entamoeba histolytica
YHSNPFTTLYALRVLDTF

SEQ ID NO: 2700874 - protein, 26 aa, Entamoeba histolytica
YHTKCFRCCCCAKILEGNKLANCERL

SEQ ID NO: 2700875 - protein, 17 aa, Entamoeba histolytica
YHTSVQWYCNDTMMITR

SEQ ID NO: 2700876 - protein, 17 aa, Entamoeba histolytica
YHYCYPDKIIPSISGVN

SEQ ID NO: 2700877 - protein, 19 aa, Entamoeba histolytica
YHYIELLAANCLTKMNSDQ

SEQ ID NO: 2700878 - protein, 18 aa, Entamoeba histolytica
YHYSELYLLTLFEEYNIL

SEQ ID NO: 2700879 - protein, 21 aa, Entamoeba histolytica
YHYTFYINLFLPHMLNGDLNI

SEQ ID NO: 2700880 - protein, 19 aa, Entamoeba histolytica
YIAYCKAYCIPRLTENASN

SEQ ID NO: 2700881 - protein, 17 aa, Entamoeba histolytica
YICELKEKYQIDCENEM

SEQ ID NO: 2700882 - protein, 26 aa, Entamoeba histolytica
YICQMYWKGIEWCCISTFRGIPDWDW

SEQ ID NO: 2700883 - protein, 21 aa, Entamoeba histolytica
YICSLPEIMDLSSPSIKLVVE

SEQ ID NO: 2700884 - protein, 23 aa, Entamoeba histolytica
YICWDPMGLFLGAVRSYLYSPHA

SEQ ID NO: 2700885 - protein, 18 aa, Entamoeba histolytica
YICYKRKNLDDELIDVTN

SEQ ID NO: 2700886 - protein, 24 aa, Entamoeba histolytica
YIDEKLYLAICKFTNQLYSLSKVI

SEQ ID NO: 2700887 - protein, 17 aa, Entamoeba histolytica
YIDKFYMVLRFTEEESK

SEQ ID NO: 2700888 - protein, 26 aa, Entamoeba histolytica
YIDLLIILFVQWKFGPDQWKILKDDL

SEQ ID NO: 2700889 - protein, 18 aa, Entamoeba histolytica
YIEAEWWSKLIARFPSSK

SEQ ID NO: 2700890 - protein, 19 aa, Entamoeba histolytica
YIEKKFIKKECQLNIENEI

SEQ ID NO: 2700891 - protein, 18 aa, Entamoeba histolytica
YIEMILFYIQVFRTPTLT

SEQ ID NO: 2700892 - protein, 23 aa, Entamoeba histolytica
YIEPKTFPSLEEFDHEFNSLDKS

SEQ ID NO: 2700893 - protein, 22 aa, Entamoeba histolytica
YIEYLKLLPFNIALNSYNKSEK

SEQ ID NO: 2700894 - protein, 19 aa, Entamoeba histolytica
YIFCGDLLSSEAFNMIDSG

SEQ ID NO: 2700895 - protein, 17 aa, Entamoeba histolytica
YIFYPFFLVTDFEGFEG

SEQ ID NO: 2700896 - protein, 18 aa, Entamoeba histolytica
YIGEGTFGIVRRVIEKET

SEQ ID NO: 2700897 - protein, 17 aa, Entamoeba histolytica
YIGFDIIDLSPIIEQSI

SEQ ID NO: 2700898 - protein, 18 aa, Entamoeba histolytica
YIGHCIDLTFFWDSYKSA

SEQ ID NO: 2700899 - protein, 18 aa, Entamoeba histolytica
YIGNHSICDCTQLTSITL

SEQ ID NO: 2700900 - protein, 23 aa, Entamoeba histolytica
YIGTEGWISCQITFMKIYYDDIQ

SEQ ID NO: 2700901 - protein, 18 aa, Entamoeba histolytica
YIGYGIDFNTWVANNNKH

SEQ ID NO: 2700902 - protein, 17 aa, Entamoeba histolytica
YIHHVFSTSGIDIHIFN

SEQ ID NO: 2700903 - protein, 18 aa, Entamoeba histolytica
YIHSFIQWLAIKYESETL

SEQ ID NO: 2700904 - protein, 18 aa, Entamoeba histolytica
YIHSLGCIHRDLKPDNVL

SEQ ID NO: 2700905 - protein, 18 aa, Entamoeba histolytica
YIHSSLPYHFKRYFIHTL

SEQ ID NO: 2700906 - protein, 26 aa, Entamoeba histolytica
YIIHMPCGPSFHFKLFNLMKPKDIKG

SEQ ID NO: 2700907 - protein, 20 aa, Entamoeba histolytica
YIIICSHANLALDIKGGSDK

SEQ ID NO: 2700908 - protein, 17 aa, Entamoeba histolytica
YIIKTFELMIKNKEVIF

SEQ ID NO: 2700909 - protein, 25 aa, Entamoeba histolytica
YIILCKQCLEQCLLFPMNKEIGMVL

SEQ ID NO: 2700910 - protein, 21 aa, Entamoeba histolytica
YIIPFPYSLFIPKSYKEIAAF

SEQ ID NO: 2700911 - protein, 27 aa, Entamoeba histolytica
YIIPTEIKGLYGIFGLGDGFVIGSNKN

SEQ ID NO: 2700912 - protein, 19 aa, Entamoeba histolytica
YIISSCLLIGYIYKTVEEG

SEQ ID NO: 2700913 - protein, 25 aa, Entamoeba histolytica
YIISSVPFIFSRSTIVYKGYYTGID

SEQ ID NO: 2700914 - protein, 25 aa, Entamoeba histolytica
YIKDKEWFDVFQLKGYTSMTYSNDW

SEQ ID NO: 2700915 - protein, 28 aa, Entamoeba histolytica
YIKEQKFKCPIEFCECIANCLLPKEKRL

SEQ ID NO: 2700916 - protein, 24 aa, Entamoeba histolytica
YIKFEKEIKMYGGISHQGYPDIDC

SEQ ID NO: 2700917 - protein, 23 aa, Entamoeba histolytica
YIKHPYLSRRGNDLIIDKKALLK

SEQ ID NO: 2700918 - protein, 20 aa, Entamoeba histolytica
YIKHSFVMKSFQSIPNLNIL

SEQ ID NO: 2700919 - protein, 19 aa, Entamoeba histolytica
YIKIEKFICNSIAFHLTIN

SEQ ID NO: 2700920 - protein, 22 aa, Entamoeba histolytica
YIKKLFDCFKEFNAEKVCETIM

SEQ ID NO: 2700921 - protein, 23 aa, Entamoeba histolytica
YIKKVIVHPLVLLSISDHQTRAS

SEQ ID NO: 2700922 - protein, 17 aa, Entamoeba histolytica
YIKNSFYEIRIFKERGN

SEQ ID NO: 2700923 - protein, 25 aa, Entamoeba histolytica
YIKQKNILMGISFLEGIEKLCGKFF

SEQ ID NO: 2700924 - protein, 19 aa, Entamoeba histolytica
YIKSCPDLGSGNDIKLGTN

SEQ ID NO: 2700925 - protein, 18 aa, Entamoeba histolytica
YIKSVCLINETTIGYCCF

SEQ ID NO: 2700926 - protein, 18 aa, Entamoeba histolytica
YILCDTPKMVARQIIKTY

SEQ ID NO: 2700927 - protein, 22 aa, Entamoeba histolytica
YILKMRTSVQIFREVNNKYPTF

SEQ ID NO: 2700928 - protein, 17 aa, Entamoeba histolytica
YILLSAIVKKYLRETTE

SEQ ID NO: 2700929 - protein, 17 aa, Entamoeba histolytica
YILQYKPIESVQEYFER

SEQ ID NO: 2700930 - protein, 17 aa, Entamoeba histolytica
YILRAMAVASKFTESLA

SEQ ID NO: 2700931 - protein, 18 aa, Entamoeba histolytica
YILSDKFLNFFQPGETLN

SEQ ID NO: 2700932 - protein, 18 aa, Entamoeba histolytica
YILVYKSYFFNISYKPNE

SEQ ID NO: 2700933 - protein, 33 aa, Entamoeba histolytica
YIMVLCLNMLFCFDKEMEYVFSIEVNHPTGITA

SEQ ID NO: 2700934 - protein, 25 aa, Entamoeba histolytica
YINIPELIEPVAISFENMCDGCAVD

SEQ ID NO: 2700935 - protein, 23 aa, Entamoeba histolytica
YINKVELIKVFGKTIVDALLDYK

SEQ ID NO: 2700936 - protein, 19 aa, Entamoeba histolytica
YINNHLVKMMGGLKRRAIS

SEQ ID NO: 2700937 - protein, 18 aa, Entamoeba histolytica
YINQGVKCSKGMEAKDQR

SEQ ID NO: 2700938 - protein, 19 aa, Entamoeba histolytica
YINYWSAALKYRFNIGERT

SEQ ID NO: 2700939 - protein, 23 aa, Entamoeba histolytica
YINYWSAALKYRFNIGERTVKMV

SEQ ID NO: 2700940 - protein, 24 aa, Entamoeba histolytica
YIPFTNNYFFKWQFNDTITCKLGI

SEQ ID NO: 2700941 - protein, 19 aa, Entamoeba histolytica
YIPGSRMVHLSKAFKYFVP

SEQ ID NO: 2700942 - protein, 23 aa, Entamoeba histolytica
YIPHKRNGFAMLKSYVTYSEYNM

SEQ ID NO: 2700943 - protein, 20 aa, Entamoeba histolytica
YIPKELYRLTNYIIDHYQQS

SEQ ID NO: 2700944 - protein, 24 aa, Entamoeba histolytica
YIPPSQRISIHFGKIEKEQKEFTT

SEQ ID NO: 2700945 - protein, 19 aa, Entamoeba histolytica
YIPPSYLQENSWIGIYDRF

SEQ ID NO: 2700946 - protein, 26 aa, Entamoeba histolytica
YIPTCPFPIDFNLILQRLINDNYYRT

SEQ ID NO: 2700947 - protein, 17 aa, Entamoeba histolytica
YIPTIGVDVHPMLFNTN

SEQ ID NO: 2700948 - protein, 18 aa, Entamoeba histolytica
YIPVVQCLIDRYYIENDC

SEQ ID NO: 2700949 - protein, 17 aa, Entamoeba histolytica
YIQGLPFIAQTALSNLI

SEQ ID NO: 2700950 - protein, 17 aa, Entamoeba histolytica
YIQLIFKLLRITWKNKK

SEQ ID NO: 2700951 - protein, 22 aa, Entamoeba histolytica
YIQMKRIESIAIGNGVINLIQS

SEQ ID NO: 2700952 - protein, 17 aa, Entamoeba histolytica
YIQPAIEVSGLLVLDHS

SEQ ID NO: 2700953 - protein, 28 aa, Entamoeba histolytica
YIQQEGRIKARWMRKNARRIDMEQYTKT

SEQ ID NO: 2700954 - protein, 17 aa, Entamoeba histolytica
YIQWSREKFTQFIPSFI

SEQ ID NO: 2700955 - protein, 19 aa, Entamoeba histolytica
YIRKCVRLNQNIDVVLFNR

SEQ ID NO: 2700956 - protein, 26 aa, Entamoeba histolytica
YIRLFSYELIRGLAYLHSLNIIHQDI

SEQ ID NO: 2700957 - protein, 24 aa, Entamoeba histolytica
YIRRVVPPELWKRIEDVAFEPNVV

SEQ ID NO: 2700958 - protein, 26 aa, Entamoeba histolytica
YIRSDLREVLKINPKIYPSSYPSDPS

SEQ ID NO: 2700959 - protein, 24 aa, Entamoeba histolytica
YIRSVLPPELWKRIEDVAFEPNVV

SEQ ID NO: 2700960 - protein, 19 aa, Entamoeba histolytica
YIRVTTICRLFTSISSEGL

SEQ ID NO: 2700961 - protein, 18 aa, Entamoeba histolytica
YISFKRGVIDDLEITEIE

SEQ ID NO: 2700962 - protein, 25 aa, Entamoeba histolytica
YISIGDNCIINFNCTILEGGPVTIG

SEQ ID NO: 2700963 - protein, 26 aa, Entamoeba histolytica
YISMNFRFTEPLWKKYENKIKEGIMC

SEQ ID NO: 2700964 - protein, 25 aa, Entamoeba histolytica
YISRKEMYFMLCLIDHIISNYEPFR

SEQ ID NO: 2700965 - protein, 26 aa, Entamoeba histolytica
YISVMPEFRRSIFIDCPLFKSKKKPS

SEQ ID NO: 2700966 - protein, 24 aa, Entamoeba histolytica
YITAYFLLFIDIEFVKPYIRNAYD

SEQ ID NO: 2700967 - protein, 26 aa, Entamoeba histolytica
YITCLELFPFDCNSVLIGSSNGFVKV

SEQ ID NO: 2700968 - protein, 18 aa, Entamoeba histolytica
YITIYDCLIGYLYSFQTC

SEQ ID NO: 2700969 - protein, 26 aa, Entamoeba histolytica
YITKEEFQADMLLVFDNALLFNHPDS

SEQ ID NO: 2700970 - protein, 19 aa, Entamoeba histolytica
YITTVGIDFRVKNIELDNK

SEQ ID NO: 2700971 - protein, 19 aa, Entamoeba histolytica
YIVEGEFEKAFVYALEEPV

SEQ ID NO: 2700972 - protein, 24 aa, Entamoeba histolytica
YIVKLNYLRDVVVARFLDEASSRY

SEQ ID NO: 2700973 - protein, 18 aa, Entamoeba histolytica
YIVSEPITKFYVNELIQL

SEQ ID NO: 2700974 - protein, 18 aa, Entamoeba histolytica
YIVVSGFSKKGERTISLF

SEQ ID NO: 2700975 - protein, 17 aa, Entamoeba histolytica
YIYCSKIVNEIISTEQT

SEQ ID NO: 2700976 - protein, 26 aa, Entamoeba histolytica
YIYDDLKYIYVWIGKKCNDFKKTKAK

SEQ ID NO: 2700977 - protein, 17 aa, Entamoeba histolytica
YIYLYIHGEHSYFQYTT

SEQ ID NO: 2700978 - protein, 20 aa, Entamoeba histolytica
YIYQCLKTTMFEEPFPIERK

SEQ ID NO: 2700979 - protein, 25 aa, Entamoeba histolytica
YIYRSELRIGDAITQMTKSLGVTVN

SEQ ID NO: 2700980 - protein, 17 aa, Entamoeba histolytica
YIYSIIPSVCPLLVHPN

SEQ ID NO: 2700981 - protein, 34 aa, Entamoeba histolytica
YKAGEWTPEDFLWQGKCVVVARGDQCVVKFVDSN

SEQ ID NO: 2700982 - protein, 18 aa, Entamoeba histolytica
YKAIKFEGIVGQWAKEGV

SEQ ID NO: 2700983 - protein, 24 aa, Entamoeba histolytica
YKAMLACLFPILKQVIYEEECKEI

SEQ ID NO: 2700984 - protein, 17 aa, Entamoeba histolytica
YKAMQAMNNKVFDGQPI

SEQ ID NO: 2700985 - protein, 18 aa, Entamoeba histolytica
YKCGQVGHKSVDCPENTE

SEQ ID NO: 2700986 - protein, 19 aa, Entamoeba histolytica
YKCKSYCEVVNRLLNIYDS

SEQ ID NO: 2700987 - protein, 28 aa, Entamoeba histolytica
YKDCKTCPDCLQLGIPCEKHNDSYFPFV

SEQ ID NO: 2700988 - protein, 29 aa, Entamoeba histolytica
YKDLMVYENYRFLAGKSHEGRERITTIIV

SEQ ID NO: 2700989 - protein, 24 aa, Entamoeba histolytica
YKDNPGILLLCFQVYKEIVRNSKD

SEQ ID NO: 2700990 - protein, 20 aa, Entamoeba histolytica
YKDPFELINEVVCDDELSTI

SEQ ID NO: 2700991 - protein, 18 aa, Entamoeba histolytica
YKECSCHTIAGLFKSFVR

SEQ ID NO: 2700992 - protein, 24 aa, Entamoeba histolytica
YKEDEWKLIFSVVSQCIEEEYQKT

SEQ ID NO: 2700993 - protein, 19 aa, Entamoeba histolytica
YKEDGEWWYGENNGKRGYF

SEQ ID NO: 2700994 - protein, 22 aa, Entamoeba histolytica
YKEIIDEKLIIGSKGITVSMHY

SEQ ID NO: 2700995 - protein, 19 aa, Entamoeba histolytica
YKEKEFLKENDVFKPKENS

SEQ ID NO: 2700996 - protein, 24 aa, Entamoeba histolytica
YKEKEFPITLLMKLNSFSFGSFNG

SEQ ID NO: 2700997 - protein, 25 aa, Entamoeba histolytica
YKEKHILPFEVIRFQVYEIIIENDI

SEQ ID NO: 2700998 - protein, 21 aa, Entamoeba histolytica
YKELIHICCCIIKYVNYNVLL

SEQ ID NO: 2700999 - protein, 23 aa, Entamoeba histolytica
YKELKRTIPEFQIPKHGYLMEWA

SEQ ID NO: 2701000 - protein, 32 aa, Entamoeba histolytica
YKESINFVVDLLIELGYCITFFETSGRNKTLK

SEQ ID NO: 2701001 - protein, 19 aa, Entamoeba histolytica
YKESTILIKAGTRIILEII

SEQ ID NO: 2701002 - protein, 21 aa, Entamoeba histolytica
YKESVLLPFLVDGRLVHIVDK

SEQ ID NO: 2701003 - protein, 21 aa, Entamoeba histolytica
YKETKADALLDKKSKKGKKDI

SEQ ID NO: 2701004 - protein, 17 aa, Entamoeba histolytica
YKEVIDCVSSYFNKIDY

SEQ ID NO: 2701005 - protein, 24 aa, Entamoeba histolytica
YKFFKELFFGKSQTQFYVFRDNVT

SEQ ID NO: 2701006 - protein, 18 aa, Entamoeba histolytica
YKFFKLFLSSHNFHKRIQ

SEQ ID NO: 2701007 - protein, 21 aa, Entamoeba histolytica
YKFKDSFKIKEYVPYPQPFWD

SEQ ID NO: 2701008 - protein, 21 aa, Entamoeba histolytica
YKFLPEFLVGLHYNFHTLLYP

SEQ ID NO: 2701009 - protein, 25 aa, Entamoeba histolytica
YKGDENEGIIGFHLNSIVVKNSMSI

SEQ ID NO: 2701010 - protein, 18 aa, Entamoeba histolytica
YKGECRNCHLSLYSTKGK

SEQ ID NO: 2701011 - protein, 21 aa, Entamoeba histolytica
YKGLMKCQIYHQFKAFVLPPS

SEQ ID NO: 2701012 - protein, 19 aa, Entamoeba histolytica
YKGNIIMPLGLWDEYFILE

SEQ ID NO: 2701013 - protein, 20 aa, Entamoeba histolytica
YKGVKEWICEKYFNTIQDFM

SEQ ID NO: 2701014 - protein, 17 aa, Entamoeba histolytica
YKHGMKISAKYQKQCAL

SEQ ID NO: 2701015 - protein, 18 aa, Entamoeba histolytica
YKHIEWLCGFTGSNATIV

SEQ ID NO: 2701016 - protein, 27 aa, Entamoeba histolytica
YKIARTIPFTRALECVSLLNEIDRSKR

SEQ ID NO: 2701017 - protein, 18 aa, Entamoeba histolytica
YKICRRCQEYISSEMSSF

SEQ ID NO: 2701018 - protein, 18 aa, Entamoeba histolytica
YKIDSLKVYQNGTFTIVT

SEQ ID NO: 2701019 - protein, 17 aa, Entamoeba histolytica
YKIEIQGNNFIAHVGNN

SEQ ID NO: 2701020 - protein, 17 aa, Entamoeba histolytica
YKIEVVYIADRKTAEGI

SEQ ID NO: 2701021 - protein, 21 aa, Entamoeba histolytica
YKIHQVFGGKLKYILNGGAPL

SEQ ID NO: 2701022 - protein, 19 aa, Entamoeba histolytica
YKIIVSVKVCNRDLKNAIK

SEQ ID NO: 2701023 - protein, 19 aa, Entamoeba histolytica
YKINGWGCIGKDSYIDYLF

SEQ ID NO: 2701024 - protein, 18 aa, Entamoeba histolytica
YKINQVFDVTKMELIGVM

SEQ ID NO: 2701025 - protein, 17 aa, Entamoeba histolytica
YKINVVCKSCIKPFPPF

SEQ ID NO: 2701026 - protein, 29 aa, Entamoeba histolytica
YKIPETYIKDLLRLGAEMLPQDYLQRLVS

SEQ ID NO: 2701027 - protein, 19 aa, Entamoeba histolytica
YKIPLKINQQPILLKRIEF

SEQ ID NO: 2701028 - protein, 20 aa, Entamoeba histolytica
YKIPMVEPLSTFLNEMVNLS

SEQ ID NO: 2701029 - protein, 18 aa, Entamoeba histolytica
YKKAMDLIDGALDMAKLQ

SEQ ID NO: 2701030 - protein, 20 aa, Entamoeba histolytica
YKKDWDCFNSVDVEMTDKQM

SEQ ID NO: 2701031 - protein, 23 aa, Entamoeba histolytica
YKKEGKRRCVIGDIGCARCITKK

SEQ ID NO: 2701032 - protein, 23 aa, Entamoeba histolytica
YKKELNSLISITPRIPVYSFWIN

SEQ ID NO: 2701033 - protein, 17 aa, Entamoeba histolytica
YKKFEIADQPWINTSPT

SEQ ID NO: 2701034 - protein, 23 aa, Entamoeba histolytica
YKKFKISAFLITPVQRLPRYKLL

SEQ ID NO: 2701035 - protein, 21 aa, Entamoeba histolytica
YKKGGLKEGLKQGGKTLAKNV

SEQ ID NO: 2701036 - protein, 19 aa, Entamoeba histolytica
YKKGIEYLFYNHLIEVGYK

SEQ ID NO: 2701037 - protein, 20 aa, Entamoeba histolytica
YKKGNVQLVLFVGGTSKMPR

SEQ ID NO: 2701038 - protein, 22 aa, Entamoeba histolytica
YKKKGFNSSLFGKIIKLTVTNF

SEQ ID NO: 2701039 - protein, 26 aa, Entamoeba histolytica
YKKLADACEGYFKAQLVMIKATDTLY

SEQ ID NO: 2701040 - protein, 22 aa, Entamoeba histolytica
YKKLDEINHLILIKNWTEALES

SEQ ID NO: 2701041 - protein, 24 aa, Entamoeba histolytica
YKKMKGECWINVYNLKTFKLIHKT

SEQ ID NO: 2701042 - protein, 20 aa, Entamoeba histolytica
YKKPKCLPKQYIKVKTISKY

SEQ ID NO: 2701043 - protein, 21 aa, Entamoeba histolytica
YKKSVSPAFCELLKKKRSCSP

SEQ ID NO: 2701044 - protein, 27 aa, Entamoeba histolytica
YKKTSPISLYLTQCLSVIFEPPTSFSI

SEQ ID NO: 2701045 - protein, 17 aa, Entamoeba histolytica
YKKVAIELNNDGITVDL

SEQ ID NO: 2701046 - protein, 17 aa, Entamoeba histolytica
YKKYLFFIERLITITPK

SEQ ID NO: 2701047 - protein, 17 aa, Entamoeba histolytica
YKLEKKPVHKFKISKKK

SEQ ID NO: 2701048 - protein, 19 aa, Entamoeba histolytica
YKLEYRWFNQLSEKQKLLF

SEQ ID NO: 2701049 - protein, 21 aa, Entamoeba histolytica
YKLFPRVMIYFKQVEDSDKVS

SEQ ID NO: 2701050 - protein, 24 aa, Entamoeba histolytica
YKLIKNKIFLLLNIKNAQSVIKIN

SEQ ID NO: 2701051 - protein, 17 aa, Entamoeba histolytica
YKLKRFIEDQVNIYKAT

SEQ ID NO: 2701052 - protein, 20 aa, Entamoeba histolytica
YKLLCSQALHKSLIKGNMEL

SEQ ID NO: 2701053 - protein, 17 aa, Entamoeba histolytica
YKLLERILYIESTPYNK

SEQ ID NO: 2701054 - protein, 17 aa, Entamoeba histolytica
YKLLESITIPSPIFEII

SEQ ID NO: 2701055 - protein, 31 aa, Entamoeba histolytica
YKLLLNRSLWLKEWFVFLNFFHNKCVHQIEN

SEQ ID NO: 2701056 - protein, 20 aa, Entamoeba histolytica
YKLLLTDLLRHYNWEHPDYY

SEQ ID NO: 2701057 - protein, 19 aa, Entamoeba histolytica
YKLLRNEFLQKSQIFEPKA

SEQ ID NO: 2701058 - protein, 19 aa, Entamoeba histolytica
YKLMFRPVEDDSYFQQSVT

SEQ ID NO: 2701059 - protein, 26 aa, Entamoeba histolytica
YKLMLERHSHFFKKNESKFEFAQEMF

SEQ ID NO: 2701060 - protein, 18 aa, Entamoeba histolytica
YKLNVLFFHCKLLAFHIS

SEQ ID NO: 2701061 - protein, 21 aa, Entamoeba histolytica
YKLRHLLFIINQIDRPDEIDC

SEQ ID NO: 2701062 - protein, 23 aa, Entamoeba histolytica
YKLSMKLGNEFAKFHVGCVKMIK

SEQ ID NO: 2701063 - protein, 16 aa, Entamoeba histolytica
YKMKVIRHVELMFNLL

SEQ ID NO: 2701064 - protein, 18 aa, Entamoeba histolytica
YKMMKDPFANYVLQRMFT

SEQ ID NO: 2701065 - protein, 21 aa, Entamoeba histolytica
YKNAVPLAHRVVPYSNPLYHL

SEQ ID NO: 2701066 - protein, 25 aa, Entamoeba histolytica
YKNIIKGHFNFKEVLTLSDIEAAAL

SEQ ID NO: 2701067 - protein, 20 aa, Entamoeba histolytica
YKNIKNWHGEVSRYCGSYDI

SEQ ID NO: 2701068 - protein, 23 aa, Entamoeba histolytica
YKNLPMQLLYSLQFSGQVHQITK

SEQ ID NO: 2701069 - protein, 22 aa, Entamoeba histolytica
YKNNGYEIVLFFLSQTLITNDI

SEQ ID NO: 2701070 - protein, 31 aa, Entamoeba histolytica
YKNQLPYLFPGVPLTFIDHFPRDENVKSVID

SEQ ID NO: 2701071 - protein, 17 aa, Entamoeba histolytica
YKNRFIIKDKKKEEESK

SEQ ID NO: 2701072 - protein, 20 aa, Entamoeba histolytica
YKNRSYRDVEWVKGKDLSEV

SEQ ID NO: 2701073 - protein, 19 aa, Entamoeba histolytica
YKPDIKVFYIYGNSGIGKT

SEQ ID NO: 2701074 - protein, 31 aa, Entamoeba histolytica
YKPFANSGLFKWKYMTHWTIDYGITTSKNGD

SEQ ID NO: 2701075 - protein, 25 aa, Entamoeba histolytica
YKPIETKPSFGMLMRFTHNTKTSQI

SEQ ID NO: 2701076 - protein, 20 aa, Entamoeba histolytica
YKPLFIKKVGTVVKIVEGKS

SEQ ID NO: 2701077 - protein, 25 aa, Entamoeba histolytica
YKPLKVPGVCLICKQKNIRYAYHTV

SEQ ID NO: 2701078 - protein, 17 aa, Entamoeba histolytica
YKPLNILTVEFPSLTSK

SEQ ID NO: 2701079 - protein, 24 aa, Entamoeba histolytica
YKPLQQIACIFLRQSISHTNMDVS

SEQ ID NO: 2701080 - protein, 18 aa, Entamoeba histolytica
YKPYFTTIDDLYCNNCTF

SEQ ID NO: 2701081 - protein, 18 aa, Entamoeba histolytica
YKQWSCLFHSFNESDEQH

SEQ ID NO: 2701082 - protein, 29 aa, Entamoeba histolytica
YKRGVDRFKTFICVGSTYIGKSVFFTKFI

SEQ ID NO: 2701083 - protein, 21 aa, Entamoeba histolytica
YKRRGQVKLALGQTQSALEDF

SEQ ID NO: 2701084 - protein, 19 aa, Entamoeba histolytica
YKSCVFEINSIVHQLDALI

SEQ ID NO: 2701085 - protein, 32 aa, Entamoeba histolytica
YKSDKSLQHAMSWLFLNMCRGSIINYNEVSQY

SEQ ID NO: 2701086 - protein, 22 aa, Entamoeba histolytica
YKSEKRKPWWIIRTYSNNNEGK

SEQ ID NO: 2701087 - protein, 23 aa, Entamoeba histolytica
YKSIAFPCISTGIFGYNNNSACP

SEQ ID NO: 2701088 - protein, 33 aa, Entamoeba histolytica
YKSKWTCSEIFRLLPGMCQSLLLRIIFLTERIS

SEQ ID NO: 2701089 - protein, 18 aa, Entamoeba histolytica
YKSNVKFYDDDKVTHLQF

SEQ ID NO: 2701090 - protein, 17 aa, Entamoeba histolytica
YKSPRLIVNKSLHLEDF

SEQ ID NO: 2701091 - protein, 17 aa, Entamoeba histolytica
YKSRKQYIYSISDLLSF

SEQ ID NO: 2701092 - protein, 28 aa, Entamoeba histolytica
YKSWKCMRCNNCSIFPLLSSHEQELLKP

SEQ ID NO: 2701093 - protein, 19 aa, Entamoeba histolytica
YKTIFPYEVYESLIKVLHD

SEQ ID NO: 2701094 - protein, 18 aa, Entamoeba histolytica
YKTIKSKIFVASMPSQVQ

SEQ ID NO: 2701095 - protein, 20 aa, Entamoeba histolytica
YKTLEDIAMKVAFRVSSADE

SEQ ID NO: 2701096 - protein, 17 aa, Entamoeba histolytica
YKTPIKYQVEKKQLIEH

SEQ ID NO: 2701097 - protein, 18 aa, Entamoeba histolytica
YKTSFYVSVIFDGRDEWE

SEQ ID NO: 2701098 - protein, 21 aa, Entamoeba histolytica
YKVHLIFEYLDACIESSQQIV

SEQ ID NO: 2701099 - protein, 17 aa, Entamoeba histolytica
YKVIPYPIKNGIYKIKS

SEQ ID NO: 2701100 - protein, 23 aa, Entamoeba histolytica
YKVKPCGIISSLISYTGELQEMG

SEQ ID NO: 2701101 - protein, 18 aa, Entamoeba histolytica
YKVLKAHGMKVVSFADTD

SEQ ID NO: 2701102 - protein, 19 aa, Entamoeba histolytica
YKVLVCASTNVAVDRVLES

SEQ ID NO: 2701103 - protein, 20 aa, Entamoeba histolytica
YKVVDEYALNLITELIIIKQ

SEQ ID NO: 2701104 - protein, 20 aa, Entamoeba histolytica
YKVVEAIKSYLNFVYPNGGY

SEQ ID NO: 2701105 - protein, 18 aa, Entamoeba histolytica
YKWSARFIETSALKDIGI

SEQ ID NO: 2701106 - protein, 21 aa, Entamoeba histolytica
YKYCLFEESRHLNLLREEFDK

SEQ ID NO: 2701107 - protein, 21 aa, Entamoeba histolytica
YKYGKKSILFIGDLIADKNEL

SEQ ID NO: 2701108 - protein, 18 aa, Entamoeba histolytica
YKYIPGIIENDGKKLELI

SEQ ID NO: 2701109 - protein, 18 aa, Entamoeba histolytica
YKYPPIRPLNPILADINE

SEQ ID NO: 2701110 - protein, 17 aa, Entamoeba histolytica
YLAAFGIGKLVIVDNDI

SEQ ID NO: 2701111 - protein, 23 aa, Entamoeba histolytica
YLAELTHAVSIYAEGILAMETTF

SEQ ID NO: 2701112 - protein, 25 aa, Entamoeba histolytica
YLAHCLKTTIFVSIIFQPQNTLDLF

SEQ ID NO: 2701113 - protein, 17 aa, Entamoeba histolytica
YLAILIDSSGSWKKISC

SEQ ID NO: 2701114 - protein, 18 aa, Entamoeba histolytica
YLALNWKSTGAGVIGCIP

SEQ ID NO: 2701115 - protein, 17 aa, Entamoeba histolytica
YLANRWGLELSERQIEI

SEQ ID NO: 2701116 - protein, 26 aa, Entamoeba histolytica
YLARAPKSCAVFETMKYTEEIIKQTG

SEQ ID NO: 2701117 - protein, 18 aa, Entamoeba histolytica
YLAYARANIHPQLNEEAK

SEQ ID NO: 2701118 - protein, 19 aa, Entamoeba histolytica
YLCAAWGQKVGSYYGRGTA

SEQ ID NO: 2701119 - protein, 22 aa, Entamoeba histolytica
YLCCKCLQKMILSEVNFFEGEK

SEQ ID NO: 2701120 - protein, 18 aa, Entamoeba histolytica
YLCKAVQMPISYQLEEKG

SEQ ID NO: 2701121 - protein, 19 aa, Entamoeba histolytica
YLCNNCLKESVAVSLTNGT

SEQ ID NO: 2701122 - protein, 19 aa, Entamoeba histolytica
YLCPHCSTVTNIFSSNGGK

SEQ ID NO: 2701123 - protein, 18 aa, Entamoeba histolytica
YLCTILMALSSKSISTNE

SEQ ID NO: 2701124 - protein, 27 aa, Entamoeba histolytica
YLDFLFKMKRINMITAQNIIDNVIDNI

SEQ ID NO: 2701125 - protein, 18 aa, Entamoeba histolytica
YLDGKSLILKNELKIKIL

SEQ ID NO: 2701126 - protein, 19 aa, Entamoeba histolytica
YLDIHLCEVHDSFFKVSSL

SEQ ID NO: 2701127 - protein, 32 aa, Entamoeba histolytica
YLDKFKRYFRRIVNVAKNFPFVLVVEETAITD

SEQ ID NO: 2701128 - protein, 32 aa, Entamoeba histolytica; identical to SEQ ID NO: 2510653

SEQ ID NO: 2701129 - protein, 25 aa, Entamoeba histolytica
YLDTPRLHLKWFEKIAEEQSVRQHY

SEQ ID NO: 2701130 - protein, 27 aa, Entamoeba histolytica
YLEERASSLVLKFLRKYEQIPFEMYSG

SEQ ID NO: 2701131 - protein, 20 aa, Entamoeba histolytica
YLEGFSICFASNVLFIIIEL

SEQ ID NO: 2701132 - protein, 17 aa, Entamoeba histolytica
YLEGMNWVFNYYCGNAF

SEQ ID NO: 2701133 - protein, 20 aa, Entamoeba histolytica
YLEHDVYCLFEHLMDIVNIW

SEQ ID NO: 2701134 - protein, 24 aa, Entamoeba histolytica
YLENFPRELIEMIKKCKLNSQSKV

SEQ ID NO: 2701135 - protein, 23 aa, Entamoeba histolytica
YLETCCVYAEYILMLHEQPQEAS

SEQ ID NO: 2701136 - protein, 18 aa, Entamoeba histolytica
YLFLNGLNKEGLFRLSST

SEQ ID NO: 2701137 - protein, 18 aa, Entamoeba histolytica
YLFPNSFFTDMQKFIIKR

SEQ ID NO: 2701138 - protein, 20 aa, Entamoeba histolytica
YLFPPTRADFKMQVKFDESD

SEQ ID NO: 2701139 - protein, 18 aa, Entamoeba histolytica
YLFQFPFALLDLNIYKHH

SEQ ID NO: 2701140 - protein, 18 aa, Entamoeba histolytica
YLGACIYTSIKSFHWQFL

SEQ ID NO: 2701141 - protein, 18 aa, Entamoeba histolytica
YLGVKNVLCGVDLNHSDI

SEQ ID NO: 2701142 - protein, 18 aa, Entamoeba histolytica
YLHECFDFENLKQFVSKY

SEQ ID NO: 2701143 - protein, 29 aa, Entamoeba histolytica
YLHFRGFNYQRLDGAMGREARQRAMDHFN

SEQ ID NO: 2701144 - protein, 43 aa, Entamoeba histolytica; identical to SEQ ID NO: 2510674

SEQ ID NO: 2701145 - protein, 18 aa, Entamoeba histolytica
YLHSAGIVHRDIKPSNLL

SEQ ID NO: 2701146 - protein, 18 aa, Entamoeba histolytica
YLHTFEILNAYKGDVESL

SEQ ID NO: 2701147 - protein, 18 aa, Entamoeba histolytica
YLIDIALKRQSFDNITVT

SEQ ID NO: 2701148 - protein, 25 aa, Entamoeba histolytica
YLIDMKKIMIAGKMCYISDPNESFL

SEQ ID NO: 2701149 - protein, 25 aa, Entamoeba histolytica
YLIGRGAKTMHCFEITDESPFVHSL

SEQ ID NO: 2701150 - protein, 24 aa, Entamoeba histolytica
YLIHKCIRCNKKIIGESYLCKTCS

SEQ ID NO: 2701151 - protein, 18 aa, Entamoeba histolytica
YLIKIFNAFIKSNCDEIT

SEQ ID NO: 2701152 - protein, 20 aa, Entamoeba histolytica
YLIKSCEIQSSLGRIELTAT

SEQ ID NO: 2701153 - protein, 18 aa, Entamoeba histolytica
YLIKTPMRCEMMCKIASL

SEQ ID NO: 2701154 - protein, 25 aa, Entamoeba histolytica
YLIMPIQRLPRYVLLLNELKKHTWN

SEQ ID NO: 2701155 - protein, 19 aa, Entamoeba histolytica
YLINYDDLPSFAFKSKEIK

SEQ ID NO: 2701156 - protein, 25 aa, Entamoeba histolytica
YLIPLTVPCIYQFVNEFTIQSNVDS

SEQ ID NO: 2701157 - protein, 18 aa, Entamoeba histolytica
YLKESMNILEWQNKGEEW

SEQ ID NO: 2701158 - protein, 18 aa, Entamoeba histolytica
YLKEYYPQNLVQFHKIGV

SEQ ID NO: 2701159 - protein, 17 aa, Entamoeba histolytica
YLKEYYPQNLVRFHKIG

SEQ ID NO: 2701160 - protein, 30 aa, Entamoeba histolytica
YLKHWIPRLSELFPSVTFYQSECDVSPLVY

SEQ ID NO: 2701161 - protein, 21 aa, Entamoeba histolytica
YLKKICQSVSFKIKGNNIKPM

SEQ ID NO: 2701162 - protein, 18 aa, Entamoeba histolytica
YLKSPECSCYSDLQLSSD

SEQ ID NO: 2701163 - protein, 24 aa, Entamoeba histolytica
YLKVREFRTAIQFVNSTLTRSLSV

SEQ ID NO: 2701164 - protein, 27 aa, Entamoeba histolytica
YLLDCENEMFLWLGNKCQVKVRQRINK

SEQ ID NO: 2701165 - protein, 21 aa, Entamoeba histolytica
YLLEHCVRILQDLVISIKDKK

SEQ ID NO: 2701166 - protein, 17 aa, Entamoeba histolytica
YLLEKGCECCERDPETY

SEQ ID NO: 2701167 - protein, 18 aa, Entamoeba histolytica
YLLEKGCSYMKELGVSSI

SEQ ID NO: 2701168 - protein, 21 aa, Entamoeba histolytica
YLLGIVPNWRVLNSTFSRMLL

SEQ ID NO: 2701169 - protein, 19 aa, Entamoeba histolytica
YLLINKCNFKFSNENESTV

SEQ ID NO: 2701170 - protein, 21 aa, Entamoeba histolytica
YLLIQIVFYFSLFYSTSSAVL

SEQ ID NO: 2701171 - protein, 18 aa, Entamoeba histolytica
YLLKIPLEQPMFFIINEL

SEQ ID NO: 2701172 - protein, 22 aa, Entamoeba histolytica
YLLKITSLLFSIKLIPKEYNHL

SEQ ID NO: 2701173 - protein, 18 aa, Entamoeba histolytica
YLLKRKKVAITLSNLQTH

SEQ ID NO: 2701174 - protein, 24 aa, Entamoeba histolytica
YLLKSKYWITIFIDIAVSLVSSKE

SEQ ID NO: 2701175 - protein, 24 aa, Entamoeba histolytica
YLLLKYGFECVRAYAEADPVIIEK

SEQ ID NO: 2701176 - protein, 25 aa, Entamoeba histolytica
YLLLSWKRLIEITSIRSYPLDSSFK

SEQ ID NO: 2701177 - protein, 17 aa, Entamoeba histolytica
YLLNPLLIQFIKMPWYS

SEQ ID NO: 2701178 - protein, 19 aa, Entamoeba histolytica
YLLPKGIPFITFLRNDIII

SEQ ID NO: 2701179 - protein, 20 aa, Entamoeba histolytica
YLLPSNKLSPVFIKQNEETP

SEQ ID NO: 2701180 - protein, 19 aa, Entamoeba histolytica
YLLPYLQFRINQINCKITI

SEQ ID NO: 2701181 - protein, 18 aa, Entamoeba histolytica
YLLRVEKIFHRDLKLENF

SEQ ID NO: 2701182 - protein, 17 aa, Entamoeba histolytica
YLLSNTCRYCTSEFSTI

SEQ ID NO: 2701183 - protein, 20 aa, Entamoeba histolytica
YLLTAQWCKPFFDNPTLKYV

SEQ ID NO: 2701184 - protein, 20 aa, Entamoeba histolytica
YLLTEAFPGLLVTSQERKNL

SEQ ID NO: 2701185 - protein, 19 aa, Entamoeba histolytica
YLLVIPLPIIQNYIGDNCK

SEQ ID NO: 2701186 - protein, 17 aa, Entamoeba histolytica
YLMDLLRLHGYFYNSYY

SEQ ID NO: 2701187 - protein, 27 aa, Entamoeba histolytica
YLMDYRNWTALMFAQFLMYNKVNKKQA

SEQ ID NO: 2701188 - protein, 20 aa, Entamoeba histolytica
YLMKCMNFDGAFGCIPGAES

SEQ ID NO: 2701189 - protein, 22 aa, Entamoeba histolytica
YLMKGYHMLGLFDGHGGDTVSK

SEQ ID NO: 2701190 - protein, 17 aa, Entamoeba histolytica
YLMKRVVELTQQNALIN

SEQ ID NO: 2701191 - protein, 19 aa, Entamoeba histolytica
YLMTCPICGKQKYCCEECY

SEQ ID NO: 2701192 - protein, 23 aa, Entamoeba histolytica
YLNDAMCLPLIELTNRLGTASQK

SEQ ID NO: 2701193 - protein, 20 aa, Entamoeba histolytica
YLNDLVIRSVLDLSGLLTEK

SEQ ID NO: 2701194 - protein, 25 aa, Entamoeba histolytica
YLNEILKIFDIKTSIMFGKADQQER

SEQ ID NO: 2701195 - protein, 31 aa, Entamoeba histolytica
YLNSLSECRAFYWDDMRLRKPNTMVVPMEKV

SEQ ID NO: 2701196 - protein, 28 aa, Entamoeba histolytica
YLPEGNVKCLIKMKLALFYFQNAKHELA

SEQ ID NO: 2701197 - protein, 18 aa, Entamoeba histolytica
YLPESSESILLPMYQLQS

SEQ ID NO: 2701198 - protein, 33 aa, Entamoeba histolytica
YLPIGCKSDVWAFGCLIYKCLTLHTPFEDSPMK

SEQ ID NO: 2701199 - protein, 25 aa, Entamoeba histolytica
YLPIKEIKCVVIINHKCTQIIEQTL

SEQ ID NO: 2701200 - protein, 32 aa, Entamoeba histolytica
YLPIVTCKRKAFSMDNPEDFMIFPVKTPKCPT

SEQ ID NO: 2701201 - protein, 18 aa, Entamoeba histolytica
YLPLLPLSLMEVHENTSS

SEQ ID NO: 2701202 - protein, 25 aa, Entamoeba histolytica
YLPMGVEMTDWFPLIGNGVESLGIG

SEQ ID NO: 2701203 - protein, 19 aa, Entamoeba histolytica
YLPNTRFTVTRIVFRDGTS

SEQ ID NO: 2701204 - protein, 18 aa, Entamoeba histolytica
YLPPQYYLSFIAINKRYQ

SEQ ID NO: 2701205 - protein, 17 aa, Entamoeba histolytica
YLPSIGCPRGGYINEER

SEQ ID NO: 2701206 - protein, 25 aa, Entamoeba histolytica
YLQEGCLKQFIKYLIVREIEECFRT

SEQ ID NO: 2701207 - protein, 20 aa, Entamoeba histolytica
YLQESKLKILISHSEKVLPI

SEQ ID NO: 2701208 - protein, 18 aa, Entamoeba histolytica
YLQISYDYFNSVFGPFKR

SEQ ID NO: 2701209 - protein, 18 aa, Entamoeba histolytica
YLQITLKVEGFEFERCVD

SEQ ID NO: 2701210 - protein, 17 aa, Entamoeba histolytica
YLRDYFSNILLDAPSKP

SEQ ID NO: 2701211 - protein, 18 aa, Entamoeba histolytica
YLRIDAIRNVQLLCKSFF

SEQ ID NO: 2701212 - protein, 20 aa, Entamoeba histolytica
YLRIIFDISHSFQREELVIV

SEQ ID NO: 2701213 - protein, 23 aa, Entamoeba histolytica
YLRKTDMIHFLKYLQYWKQPNYI

SEQ ID NO: 2701214 - protein, 17 aa, Entamoeba histolytica
YLRMDGLVSSNKRPEYI

SEQ ID NO: 2701215 - protein, 19 aa, Entamoeba histolytica
YLRTLMRAVAQLTGGQYAA

SEQ ID NO: 2701216 - protein, 22 aa, Entamoeba histolytica
YLRYKFMERDGVNSFPELTNDV

SEQ ID NO: 2701217 - protein, 17 aa, Entamoeba histolytica
YLSFEINKSVNEHQTHT

SEQ ID NO: 2701218 - protein, 24 aa, Entamoeba histolytica
YLSGLKYSAMPPFKRFHDLEQLSG

SEQ ID NO: 2701219 - protein, 17 aa, Entamoeba histolytica
YLSKLEVPRKWINELYG

SEQ ID NO: 2701220 - protein, 18 aa, Entamoeba histolytica
YLSLKFVHYCGYSFEEES

SEQ ID NO: 2701221 - protein, 28 aa, Entamoeba histolytica
YLSQFLLTCVTTLIGESVTFLKNEESLL

SEQ ID NO: 2701222 - protein, 18 aa, Entamoeba histolytica
YLSRIDGFVNLRVSFLEG

SEQ ID NO: 2701223 - protein, 34 aa, Entamoeba histolytica
YLSSFPKKEVIGFKKLEYIFLLRQCGAKIVKDKK

SEQ ID NO: 2701224 - protein, 26 aa, Entamoeba histolytica
YLSSLIDVLHLLPLIYDKEYARQLLF

SEQ ID NO: 2701225 - protein, 18 aa, Entamoeba histolytica
YLSVPIIISYGKRIPENE

SEQ ID NO: 2701226 - protein, 17 aa, Entamoeba histolytica
YLSYYGININKIPFNKC

SEQ ID NO: 2701227 - protein, 18 aa, Entamoeba histolytica
YLTASCIMRGKVSTHDVE

SEQ ID NO: 2701228 - protein, 20 aa, Entamoeba histolytica
YLTDRLYPMLSEQHSRDLIK

SEQ ID NO: 2701229 - protein, 25 aa, Entamoeba histolytica
YLTIEMKTAIAILLDYALQHHEILP

SEQ ID NO: 2701230 - protein, 21 aa, Entamoeba histolytica
YLTNCYDPSQLLGLLSVISTF

SEQ ID NO: 2701231 - protein, 21 aa, Entamoeba histolytica
YLTNYRLIWRTSNESLGSMAQ

SEQ ID NO: 2701232 - protein, 21 aa, Entamoeba histolytica
YLTRLSNLFFDDDLIAKNELN

SEQ ID NO: 2701233 - protein, 24 aa, Entamoeba histolytica
YLTSLRFLLHYFKFSNTIVNSSQS

SEQ ID NO: 2701234 - protein, 18 aa, Entamoeba histolytica
YLTVIKLEIENIDNENIS

SEQ ID NO: 2701235 - protein, 28 aa, Entamoeba histolytica
YLVCWDLRHTIANIGWRVPTHSAITEIV

SEQ ID NO: 2701236 - protein, 18 aa, Entamoeba histolytica
YLVDLALFKQSLDNVTVS

SEQ ID NO: 2701237 - protein, 19 aa, Entamoeba histolytica
YLVFIGFTRCHLPISGVSA

SEQ ID NO: 2701238 - protein, 25 aa, Entamoeba histolytica
YLVIPECPCCILFDEWMNFNKEAVC

SEQ ID NO: 2701239 - protein, 17 aa, Entamoeba histolytica
YLVKVVQIPKVFDRVTV

SEQ ID NO: 2701240 - protein, 24 aa, Entamoeba histolytica
YLVNRGDYSLAMIMNEKISCSEMK

SEQ ID NO: 2701241 - protein, 18 aa, Entamoeba histolytica
YLVRQSLKGKIQRTSIEK

SEQ ID NO: 2701242 - protein, 19 aa, Entamoeba histolytica
YLVSFVLPQWKSCFESIPL

SEQ ID NO: 2701243 - protein, 20 aa, Entamoeba histolytica
YLWVVWDRALELCLLQINNH

SEQ ID NO: 2701244 - protein, 24 aa, Entamoeba histolytica
YLYCFKLDSFICSFATYDKLDYIP

SEQ ID NO: 2701245 - protein, 17 aa, Entamoeba histolytica
YLYELLVSIFFPQQQLK

SEQ ID NO: 2701246 - protein, 17 aa, Entamoeba histolytica
YLYGCDDKSMIGLIAYR

SEQ ID NO: 2701247 - protein, 21 aa, Entamoeba histolytica
YLYIVCYYSHLSIPPLSHKGD

SEQ ID NO: 2701248 - protein, 18 aa, Entamoeba histolytica
YLYLESMENIKSITIPST

SEQ ID NO: 2701249 - protein, 24 aa, Entamoeba histolytica
YLYYKRFYSSISFKNISYSEEDCF

SEQ ID NO: 2701250 - protein, 25 aa, Entamoeba histolytica
YMAPELYRRLPYGNKIDCWSCGVVL

SEQ ID NO: 2701251 - protein, 38 aa, Entamoeba histolytica
YMAPELYRRLPYGNKIDCWSCGVVLYSLLCGTFPFAGE

SEQ ID NO: 2701252 - protein, 17 aa, Entamoeba histolytica
YMEICYYLKELLKALDY

SEQ ID NO: 2701253 - protein, 22 aa, Entamoeba histolytica
YMEKYRMIGDNFVWLSGLLSTF

SEQ ID NO: 2701254 - protein, 23 aa, Entamoeba histolytica
YMEKYRMIGDNFVWLSGLLSTFQ

SEQ ID NO: 2701255 - protein, 25 aa, Entamoeba histolytica
YMELYKKSLGYTFLPIITKNEIKEM

SEQ ID NO: 2701256 - protein, 18 aa, Entamoeba histolytica
YMIIGCLDNVAAFTESFL

SEQ ID NO: 2701257 - protein, 26 aa, Entamoeba histolytica
YMKCSYCLNCGAFICDNQECFISHKL

SEQ ID NO: 2701258 - protein, 31 aa, Entamoeba histolytica
YMKMFKGLCYNRIKTKCVIPYNSERMILLET

SEQ ID NO: 2701259 - protein, 26 aa, Entamoeba histolytica
YMLIIKIYGLLKCTNFTPNNIIEMLP

SEQ ID NO: 2701260 - protein, 17 aa, Entamoeba histolytica
YMLVIRQIHDIYNEYYL

SEQ ID NO: 2701261 - protein, 18 aa, Entamoeba histolytica
YMNNVAKFDTVWAQEHSR

SEQ ID NO: 2701262 - protein, 23 aa, Entamoeba histolytica
YMRLKSLDFGNGEVIFLSEYLKR

SEQ ID NO: 2701263 - protein, 23 aa, Entamoeba histolytica
YMSEPFPFIPLLLDENYRISGIV

SEQ ID NO: 2701264 - protein, 27 aa, Entamoeba histolytica
YMTEQRIQIRLAREVNILKNGIESSKF

SEQ ID NO: 2701265 - protein, 24 aa, Entamoeba histolytica
YMTKTCKIYRALFSSITKKDIIEA

SEQ ID NO: 2701266 - protein, 30 aa, Entamoeba histolytica; identical to SEQ ID NO: 2510787

SEQ ID NO: 2701267 - protein, 22 aa, Entamoeba histolytica
YMVKSIYFGTAFCTVPLAIQLG

SEQ ID NO: 2701268 - protein, 23 aa, Entamoeba histolytica
YMVNRLNVLLLQHIQKCLPGLKQ

SEQ ID NO: 2701269 - protein, 19 aa, Entamoeba histolytica
YMYFYKMLWLLLEKFDHKI

SEQ ID NO: 2701270 - protein, 17 aa, Entamoeba histolytica
YMYLTLWGDEISNQTQF

SEQ ID NO: 2701271 - protein, 20 aa, Entamoeba histolytica
YNAPNSEVWNLAKTMSDAYE

SEQ ID NO: 2701272 - protein, 17 aa, Entamoeba histolytica
YNCATEINLYRGEKDQK

SEQ ID NO: 2701273 - protein, 22 aa, Entamoeba histolytica
YNCDKLILFDGGFKIINEDEII

SEQ ID NO: 2701274 - protein, 18 aa, Entamoeba histolytica
YNCKSLHFTSHFFDHLMC

SEQ ID NO: 2701275 - protein, 28 aa, Entamoeba histolytica
YNDEIWLMKPCTGSVLFDIIFNIDNISQ

SEQ ID NO: 2701276 - protein, 29 aa, Entamoeba histolytica
YNDFEFKKEIGWLVTNCILSIKSPKDLLT

SEQ ID NO: 2701277 - protein, 18 aa, Entamoeba histolytica
YNDLPLTSGMIFEDLNYR

SEQ ID NO: 2701278 - protein, 26 aa, Entamoeba histolytica
YNDRLKEAVLFAYRFPQKAEDVRSML

SEQ ID NO: 2701279 - protein, 23 aa, Entamoeba histolytica
YNDYQCFIKHWIIYIKDKEWFDV

SEQ ID NO: 2701280 - protein, 17 aa, Entamoeba histolytica
YNECYDFNNNLRQLDLA

SEQ ID NO: 2701281 - protein, 21 aa, Entamoeba histolytica
YNEDRICVATNIEGADLFAVF

SEQ ID NO: 2701282 - protein, 23 aa, Entamoeba histolytica
YNEKCDLFSIGVILYEMITGTVL

SEQ ID NO: 2701283 - protein, 18 aa, Entamoeba histolytica
YNELCSNISDFIFNPYLV

SEQ ID NO: 2701284 - protein, 18 aa, Entamoeba histolytica
YNELFFNVLVSYAHATSS

SEQ ID NO: 2701285 - protein, 18 aa, Entamoeba histolytica
YNEPSGKGNLLFVNCVYP

SEQ ID NO: 2701286 - protein, 24 aa, Entamoeba histolytica
YNFDSPSSFDWDLIIDTLKKIKAK

SEQ ID NO: 2701287 - protein, 24 aa, Entamoeba histolytica
YNFEECVHKLLSLKLREGEEKILV

SEQ ID NO: 2701288 - protein, 26 aa, Entamoeba histolytica
YNFIKLCKIEYYLHCIIYRVIKDYAI

SEQ ID NO: 2701289 - protein, 23 aa, Entamoeba histolytica
YNFKDLRPLYQYDTGMNNKGLIA

SEQ ID NO: 2701290 - protein, 23 aa, Entamoeba histolytica
YNGETRTRFTVNFIQVLDNIASG

SEQ ID NO: 2701291 - protein, 29 aa, Entamoeba histolytica
YNGKDFSRIFCIQRLVKVSIIDKEGLEGT

SEQ ID NO: 2701292 - protein, 25 aa, Entamoeba histolytica
YNGKFLKLKYVLSVRIMSKSHINPQ

SEQ ID NO: 2701293 - protein, 17 aa, Entamoeba histolytica
YNGLKFLIFDSPTDDNV

SEQ ID NO: 2701294 - protein, 17 aa, Entamoeba histolytica
YNGPLVILPEANVIEVS

SEQ ID NO: 2701295 - protein, 22 aa, Entamoeba histolytica
YNGRALIIINHFVFKLMKNIEH

SEQ ID NO: 2701296 - protein, 23 aa, Entamoeba histolytica
YNGREIPLRVSLNTQEGEIFQLN

SEQ ID NO: 2701297 - protein, 20 aa, Entamoeba histolytica
YNGSEPVLFTITGDNFGDEP

SEQ ID NO: 2701298 - protein, 19 aa, Entamoeba histolytica
YNHEYLISMANGWNPQDVE

SEQ ID NO: 2701299 - protein, 25 aa, Entamoeba histolytica
YNHFKSIRNDISWLSVIYPNSIYYV

SEQ ID NO: 2701300 - protein, 31 aa, Entamoeba histolytica
YNHLIEVGYKLIIPLCYFQQIQVSSLLIPLQ

SEQ ID NO: 2701301 - protein, 22 aa, Entamoeba histolytica
YNHQYCYGKTCSCLTQKNQQHT

SEQ ID NO: 2701302 - protein, 21 aa, Entamoeba histolytica
YNIAVCLGLSTFVSKNDIQTI

SEQ ID NO: 2701303 - protein, 21 aa, Entamoeba histolytica
YNIFELLKFDELFVNTSVLLE

SEQ ID NO: 2701304 - protein, 18 aa, Entamoeba histolytica
YNIGEVVVFEVFDHDTVG

SEQ ID NO: 2701305 - protein, 17 aa, Entamoeba histolytica
YNIIDGIEFYLRKNNET

SEQ ID NO: 2701306 - protein, 25 aa, Entamoeba histolytica
YNILQRLQNIFARIIGIAFQQQNVS

SEQ ID NO: 2701307 - protein, 17 aa, Entamoeba histolytica
YNIRYSLDFIPPTRKVN

SEQ ID NO: 2701308 - protein, 17 aa, Entamoeba histolytica
YNKCYVLGYGQCRRDPP

SEQ ID NO: 2701309 - protein, 19 aa, Entamoeba histolytica
YNKIIRLYMDHDVKDVFQD

SEQ ID NO: 2701310 - protein, 17 aa, Entamoeba histolytica
YNKRITRDDLVVCWYSR

SEQ ID NO: 2701311 - protein, 17 aa, Entamoeba histolytica
YNKSIPSICYSRGNLMK

SEQ ID NO: 2701312 - protein, 21 aa, Entamoeba histolytica
YNKVYFKSFPIIFGKQLTCSE

SEQ ID NO: 2701313 - protein, 23 aa, Entamoeba histolytica
YNLCFLIGRGFLFDCDVILHLYD

SEQ ID NO: 2701314 - protein, 22 aa, Entamoeba histolytica
YNLDPQCDICGVHCHNIDQHKQ

SEQ ID NO: 2701315 - protein, 23 aa, Entamoeba histolytica
YNLDPQCDICGVHCHNIDQHKQW

SEQ ID NO: 2701316 - protein, 22 aa, Entamoeba histolytica
YNLKEKFWYCFEQRNNVFDYKQ

SEQ ID NO: 2701317 - protein, 17 aa, Entamoeba histolytica
YNLKLILRSDVREENIF

SEQ ID NO: 2701318 - protein, 24 aa, Entamoeba histolytica
YNLLFKMIDMLGMLPNEMLENGTR

SEQ ID NO: 2701319 - protein, 17 aa, Entamoeba histolytica
YNLLLSDFLKHTDRNDP

SEQ ID NO: 2701320 - protein, 18 aa, Entamoeba histolytica
YNLNYSFRTSLEPLNKTP

SEQ ID NO: 2701321 - protein, 18 aa, Entamoeba histolytica
YNLQRKKVQFIRIDGETK

SEQ ID NO: 2701322 - protein, 17 aa, Entamoeba histolytica
YNLWKPSNKPVIVSIKE

SEQ ID NO: 2701323 - protein, 18 aa, Entamoeba histolytica
YNMPPIMMSHFYSIWTAF

SEQ ID NO: 2701324 - protein, 19 aa, Entamoeba histolytica
YNMPQGIQQYGQINGAPRF

SEQ ID NO: 2701325 - protein, 17 aa, Entamoeba histolytica
YNNIHLIAETLTEPAPA

SEQ ID NO: 2701326 - protein, 23 aa, Entamoeba histolytica
YNNIVSALAFLKECTQYANDSVR

SEQ ID NO: 2701327 - protein, 24 aa, Entamoeba histolytica
YNNKKCWPKDCRMRLMRHDVNLGR

SEQ ID NO: 2701328 - protein, 24 aa, Entamoeba histolytica
YNNWVKACLIRKYIPEHSRVLDFC

SEQ ID NO: 2701329 - protein, 18 aa, Entamoeba histolytica
YNPFSIKSKKIFPKLTNQ

SEQ ID NO: 2701330 - protein, 24 aa, Entamoeba histolytica
YNPHVRYGAALALGIAGCASNDST

SEQ ID NO: 2701331 - protein, 18 aa, Entamoeba histolytica
YNPIKSFLLFKEVTTQLL

SEQ ID NO: 2701332 - protein, 17 aa, Entamoeba histolytica
YNPIKTCDDKNYWCTAK

SEQ ID NO: 2701333 - protein, 24 aa, Entamoeba histolytica
YNPQLVNWLFLWKHSLPLPLSNSS

SEQ ID NO: 2701334 - protein, 24 aa, Entamoeba histolytica
YNPSKLCYMTSVLVQLLSIEEFQT

SEQ ID NO: 2701335 - protein, 27 aa, Entamoeba histolytica
YNQFAITIRYAWISSQFVPSKKDKEEY

SEQ ID NO: 2701336 - protein, 22 aa, Entamoeba histolytica
YNQIPGWPALLIPFIQQLSSLK

SEQ ID NO: 2701337 - protein, 18 aa, Entamoeba histolytica
YNQKIFAIKKASELGLTK

SEQ ID NO: 2701338 - protein, 23 aa, Entamoeba histolytica
YNRSEGYYAFSILLKGIELNLFT

SEQ ID NO: 2701339 - protein, 25 aa, Entamoeba histolytica
YNRYHVNNIFGLRWGYEGLVPELSE

SEQ ID NO: 2701340 - protein, 18 aa, Entamoeba histolytica
YNRYSWIGLFDINECDNR

SEQ ID NO: 2701341 - protein, 25 aa, Entamoeba histolytica
YNSCPKVIVLYCYNSAPLLNKEVHH

SEQ ID NO: 2701342 - protein, 19 aa, Entamoeba histolytica
YNSIYNCIEQFNLYKKLPY

SEQ ID NO: 2701343 - protein, 24 aa, Entamoeba histolytica
YNSKEGRWKYLRILSNDGNFDTIN

SEQ ID NO: 2701344 - protein, 28 aa, Entamoeba histolytica
YNSKNCCIGIICPYQYQTQLIKFINKNI

SEQ ID NO: 2701345 - protein, 25 aa, Entamoeba histolytica
YNSLQFKFELFKMLYREMTMGLTGP

SEQ ID NO: 2701346 - protein, 25 aa, Entamoeba histolytica
YNSNLWTCCFCLTRNQLQYQNLPEL

SEQ ID NO: 2701347 - protein, 28 aa, Entamoeba histolytica
YNSYHIRILLKFFKSRGKLTHLITNLSD

SEQ ID NO: 2701348 - protein, 17 aa, Entamoeba histolytica
YNSYRCMQSDCEQHLSL

SEQ ID NO: 2701349 - protein, 23 aa, Entamoeba histolytica
YNTFFLDLLRAMLNTKEFLNPPL

SEQ ID NO: 2701350 - protein, 25 aa, Entamoeba histolytica
YNTFIYDLFCEFFNTIPLAALFKCS

SEQ ID NO: 2701351 - protein, 17 aa, Entamoeba histolytica
YNTIHLFHHFFPCANVF

SEQ ID NO: 2701352 - protein, 17 aa, Entamoeba histolytica
YNTKKIPSYGFIKNDPG

SEQ ID NO: 2701353 - protein, 21 aa, Entamoeba histolytica
YNVDCGYCLINTIVVVREEYV

SEQ ID NO: 2701354 - protein, 17 aa, Entamoeba histolytica
YNVELIKAPAKYDHFHI

SEQ ID NO: 2701355 - protein, 17 aa, Entamoeba histolytica
YNVTDVVRCCHPSYDKK

SEQ ID NO: 2701356 - protein, 22 aa, Entamoeba histolytica
YNYALELLKKFSAVSSKTKIVV

SEQ ID NO: 2701357 - protein, 24 aa, Entamoeba histolytica
YNYGDPCPCTEVGFKKVVDCKQSN

SEQ ID NO: 2701358 - protein, 27 aa, Entamoeba histolytica
YPCFISCYNSLCLFSGSSIPIEHTTSL

SEQ ID NO: 2701359 - protein, 19 aa, Entamoeba histolytica
YPDGTLKPAEGEKLNKPAT

SEQ ID NO: 2701360 - protein, 17 aa, Entamoeba histolytica
YPDLVPNASKLICTAVN

SEQ ID NO: 2701361 - protein, 18 aa, Entamoeba histolytica
YPDVSVPIIFLLMRDTVI

SEQ ID NO: 2701362 - protein, 25 aa, Entamoeba histolytica
YPECKTVLAECCLYLTRAKKSTAVY

SEQ ID NO: 2701363 - protein, 18 aa, Entamoeba histolytica
YPEISFRGDITILLMRQY

SEQ ID NO: 2701364 - protein, 20 aa, Entamoeba histolytica
YPELLELILKSSLNKSIKQS

SEQ ID NO: 2701365 - protein, 21 aa, Entamoeba histolytica
YPEQLPFRFHVPTLRTAMNRG

SEQ ID NO: 2701366 - protein, 26 aa, Entamoeba histolytica
YPERKLYYFICSAIILKNGDQIVEKQ

SEQ ID NO: 2701367 - protein, 24 aa, Entamoeba histolytica
YPEVDAAFKKLLVNKRINQFIPSS

SEQ ID NO: 2701368 - protein, 27 aa, Entamoeba histolytica
YPFECISTQCPISFKLIKEESEYRNFL

SEQ ID NO: 2701369 - protein, 20 aa, Entamoeba histolytica
YPFFKMIRNWINALGDLANI

SEQ ID NO: 2701370 - protein, 18 aa, Entamoeba histolytica
YPFFRIISIATENDEIPL

SEQ ID NO: 2701371 - protein, 24 aa, Entamoeba histolytica
YPFMIYALRLFKILYEMNIANEFI

SEQ ID NO: 2701372 - protein, 18 aa, Entamoeba histolytica
YPGIPILMLTATATERVK

SEQ ID NO: 2701373 - protein, 19 aa, Entamoeba histolytica
YPGRCCGNVVIPETNIKNE

SEQ ID NO: 2701374 - protein, 23 aa, Entamoeba histolytica
YPGSEVQLGLLLFMIQEDSESNK

SEQ ID NO: 2701375 - protein, 20 aa, Entamoeba histolytica
YPHLLDIWDSIPLEEYLKDF

SEQ ID NO: 2701376 - protein, 19 aa, Entamoeba histolytica
YPHLTWEIPSLTVSSDEIK

SEQ ID NO: 2701377 - protein, 23 aa, Entamoeba histolytica
YPHPWDIADTITIGKRPNIIQEV

SEQ ID NO: 2701378 - protein, 23 aa, Entamoeba histolytica
YPHPWDIADTITIGKRTNIIKEV

SEQ ID NO: 2701379 - protein, 21 aa, Entamoeba histolytica
YPICYCCMTNALLFNPQGVFD

SEQ ID NO: 2701380 - protein, 25 aa, Entamoeba histolytica
YPIHCICTIPPPSFMDVIQSLKTQN

SEQ ID NO: 2701381 - protein, 26 aa, Entamoeba histolytica
YPKEVKRFPYVWGQDFIHSYWPDRPT

SEQ ID NO: 2701382 - protein, 17 aa, Entamoeba histolytica
YPKGFVIDKETELPAIG

SEQ ID NO: 2701383 - protein, 18 aa, Entamoeba histolytica
YPKINEMISILSSNSTLP

SEQ ID NO: 2701384 - protein, 24 aa, Entamoeba histolytica
YPKIYNILCAINYILEISNNQIER

SEQ ID NO: 2701385 - protein, 25 aa, Entamoeba histolytica
YPKKRDFYTFFSFKDKSKTAGWRLD

SEQ ID NO: 2701386 - protein, 17 aa, Entamoeba histolytica
YPKMIDKPIEFMFEHLM

SEQ ID NO: 2701387 - protein, 17 aa, Entamoeba histolytica
YPKMITQSIQFIFEHLM

SEQ ID NO: 2701388 - protein, 22 aa, Entamoeba histolytica
YPKNKFHYFIAVSMLLEHRDII

SEQ ID NO: 2701389 - protein, 23 aa, Entamoeba histolytica
YPLHPRLGKILYLSQQKGIEEIG

SEQ ID NO: 2701390 - protein, 26 aa, Entamoeba histolytica
YPLLHPEIYKHLGIEPPRGILLHGPP

SEQ ID NO: 2701391 - protein, 23 aa, Entamoeba histolytica
YPLLKKYKHLIGHFGTAWQNQQR

SEQ ID NO: 2701392 - protein, 20 aa, Entamoeba histolytica
YPLLLKEIIKNTGPRHPDQP

SEQ ID NO: 2701393 - protein, 22 aa, Entamoeba histolytica
YPLQHCRAFEVFMIGIILEKIR

SEQ ID NO: 2701394 - protein, 25 aa, Entamoeba histolytica
YPLWMLCLYDACGKVSKVLENTVID

SEQ ID NO: 2701395 - protein, 18 aa, Entamoeba histolytica
YPMLFGVTLDNGERRVYF

SEQ ID NO: 2701396 - protein, 17 aa, Entamoeba histolytica
YPNAFEFTPLLIKDLAV

SEQ ID NO: 2701397 - protein, 23 aa, Entamoeba histolytica
YPNGCPCGIDFQEVVLKAIKNDI

SEQ ID NO: 2701398 - protein, 19 aa, Entamoeba histolytica
YPNIPIITVILNYPEYCLA

SEQ ID NO: 2701399 - protein, 20 aa, Entamoeba histolytica
YPNNCFEIGDDFQFTKQFLW

SEQ ID NO: 2701400 - protein, 18 aa, Entamoeba histolytica
YPNQWKKISTFIPNRTDA

SEQ ID NO: 2701401 - protein, 20 aa, Entamoeba histolytica
YPPFVTMKWEEVIEYQKKLN

SEQ ID NO: 2701402 - protein, 18 aa, Entamoeba histolytica
YPPLLAPFLPPPLPTHLS

SEQ ID NO: 2701403 - protein, 17 aa, Entamoeba histolytica
YPQFCCVNNQVIVQGEN

SEQ ID NO: 2701404 - protein, 18 aa, Entamoeba histolytica
YPQFLWRYSSLSNKVLPE

SEQ ID NO: 2701405 - protein, 24 aa, Entamoeba histolytica
YPRMPWHDIHCMVNGTILNDLQYH

SEQ ID NO: 2701406 - protein, 22 aa, Entamoeba histolytica
YPSEAVVPIILRSFDKTTFISE

SEQ ID NO: 2701407 - protein, 17 aa, Entamoeba histolytica
YPSHCLVLLTNSLYFNP

SEQ ID NO: 2701408 - protein, 26 aa, Entamoeba histolytica
YPSKVWSSAILRHFFQHAFDGSGSDG

SEQ ID NO: 2701409 - protein, 17 aa, Entamoeba histolytica
YPSLNYMEICYYLKELL

SEQ ID NO: 2701410 - protein, 20 aa, Entamoeba histolytica
YPSLRYFECSAVNGKNIEEI

SEQ ID NO: 2701411 - protein, 23 aa, Entamoeba histolytica
YPSPNIQCPFLLNSSKINQTLQS

SEQ ID NO: 2701412 - protein, 22 aa, Entamoeba histolytica
YPTGARYAAPVVREQPPPPLSS

SEQ ID NO: 2701413 - protein, 23 aa, Entamoeba histolytica
YPTSFKITYHFRSFILNIKTKSN

SEQ ID NO: 2701414 - protein, 20 aa, Entamoeba histolytica
YPVAKYHAGMKSEERETIQK

SEQ ID NO: 2701415 - protein, 29 aa, Entamoeba histolytica
YPVATYCRGKLVFKDGMFVGEKGYGKRVK

SEQ ID NO: 2701416 - protein, 19 aa, Entamoeba histolytica
YPVDTIPLGIDYHFQSFFN

SEQ ID NO: 2701417 - protein, 19 aa, Entamoeba histolytica
YPVKIGDQFMKFDRVLCDV

SEQ ID NO: 2701418 - protein, 19 aa, Entamoeba histolytica
YPVKVSIEMKRMYSNIQRF

SEQ ID NO: 2701419 - protein, 18 aa, Entamoeba histolytica
YPYEHLVKIYSGILHLHL

SEQ ID NO: 2701420 - protein, 20 aa, Entamoeba histolytica
YPYENCIRVDPHEDHMTGFF

SEQ ID NO: 2701421 - protein, 19 aa, Entamoeba histolytica
YPYEYFHQILTLFLNTRPL

SEQ ID NO: 2701422 - protein, 18 aa, Entamoeba histolytica
YQAALILFAMASRTEVYA

SEQ ID NO: 2701423 - protein, 18 aa, Entamoeba histolytica
YQALKIFGTDFEKIQKRL

SEQ ID NO: 2701424 - protein, 30 aa, Entamoeba histolytica
YQCHLKTDFKSIVFLVESFLNYSVQIEHQH

SEQ ID NO: 2701425 - protein, 18 aa, Entamoeba histolytica
YQCKCTELIKTRKQNQNQ

SEQ ID NO: 2701426 - protein, 27 aa, Entamoeba histolytica
YQCNNICHDPCHCRHVFEDGEEKVACY

SEQ ID NO: 2701427 - protein, 22 aa, Entamoeba histolytica
YQDAFVFRRRFDKKLHSHFAYW

SEQ ID NO: 2701428 - protein, 17 aa, Entamoeba histolytica
YQDIKTTYFEKINIEMP

SEQ ID NO: 2701429 - protein, 20 aa, Entamoeba histolytica
YQDIPDLLSLNLSNNNINLT

SEQ ID NO: 2701430 - protein, 19 aa, Entamoeba histolytica
YQEKRDFERGIHLEELQQF

SEQ ID NO: 2701431 - protein, 19 aa, Entamoeba histolytica
YQESWDRQPSNIVGREIYN

SEQ ID NO: 2701432 - protein, 17 aa, Entamoeba histolytica
YQFEYLSSLTISCCELY

SEQ ID NO: 2701433 - protein, 18 aa, Entamoeba histolytica
YQFWKIKEPYQMIDCSLI

SEQ ID NO: 2701434 - protein, 17 aa, Entamoeba histolytica
YQFYSAHEIDTKNHLQI

SEQ ID NO: 2701435 - protein, 20 aa, Entamoeba histolytica
YQHDVCGYVFAFYVQKLIHH

SEQ ID NO: 2701436 - protein, 24 aa, Entamoeba histolytica
YQIFIKSNFLKLIKPYDIDEFISN

SEQ ID NO: 2701437 - protein, 18 aa, Entamoeba histolytica
YQIGFMIYLMVKNKREVV

SEQ ID NO: 2701438 - protein, 23 aa, Entamoeba histolytica
YQIKSVLSILGYEVYLPSVIKEK

SEQ ID NO: 2701439 - protein, 17 aa, Entamoeba histolytica
YQIKTTLTFEGITESVK

SEQ ID NO: 2701440 - protein, 34 aa, Entamoeba histolytica
YQILNKYRLGNCPVKMAHFAKWIKSSLKINNADF

SEQ ID NO: 2701441 - protein, 17 aa, Entamoeba histolytica
YQKGSIVYNDFIKLFGK

SEQ ID NO: 2701442 - protein, 31 aa, Entamoeba histolytica
YQKLGELCVQCWRGTVNYNEIKLKLKEYTDS

SEQ ID NO: 2701443 - protein, 25 aa, Entamoeba histolytica
YQKRVYEIFNRFFGDNVNFTQCDLP

SEQ ID NO: 2701444 - protein, 20 aa, Entamoeba histolytica
YQLEMLKYLIHCHNEAECAE

SEQ ID NO: 2701445 - protein, 24 aa, Entamoeba histolytica
YQLFKKDGEVYGFWINKETISYGL

SEQ ID NO: 2701446 - protein, 22 aa, Entamoeba histolytica
YQLLCSLPSLSFLNLSFEIIDM

SEQ ID NO: 2701447 - protein, 19 aa, Entamoeba histolytica
YQLLLSKRLLYKGFQAEDE

SEQ ID NO: 2701448 - protein, 19 aa, Entamoeba histolytica
YQLRNGIIPSSSFISLKSK

SEQ ID NO: 2701449 - protein, 18 aa, Entamoeba histolytica
YQMRIYKRVLSMKTTPET

SEQ ID NO: 2701450 - protein, 17 aa, Entamoeba histolytica
YQMVGRLIGKCLSEKIS

SEQ ID NO: 2701451 - protein, 22 aa, Entamoeba histolytica
YQNASACVFVYDITKNDSLLSL

SEQ ID NO: 2701452 - protein, 17 aa, Entamoeba histolytica
YQNDLLFKVYLQKYNTH

SEQ ID NO: 2701453 - protein, 19 aa, Entamoeba histolytica
YQNEWCFINLFNNQISYVD

SEQ ID NO: 2701454 - protein, 35 aa, Entamoeba histolytica
YQNIKGRKRTYPIWRRVNYYDYSWGMTINDFPELK

SEQ ID NO: 2701455 - protein, 18 aa, Entamoeba histolytica
YQNITGILPWDTISNPHE

SEQ ID NO: 2701456 - protein, 18 aa, Entamoeba histolytica
YQPILIPRILWLLQQYEE

SEQ ID NO: 2701457 - protein, 17 aa, Entamoeba histolytica
YQPKLAHLLSRLLKEDG

SEQ ID NO: 2701458 - protein, 17 aa, Entamoeba histolytica
YQPNPLLDRIFWKKPTN

SEQ ID NO: 2701459 - protein, 24 aa, Entamoeba histolytica
YQPRSFAKLCHWTETTELLYNISQ

SEQ ID NO: 2701460 - protein, 18 aa, Entamoeba histolytica
YQQGVMIYLLVKSGFEVR

SEQ ID NO: 2701461 - protein, 17 aa, Entamoeba histolytica
YQQGYIGPMGYWPDAVC

SEQ ID NO: 2701462 - protein, 24 aa, Entamoeba histolytica
YQQKGIQCSFALKRNISKEDIEKC

SEQ ID NO: 2701463 - protein, 20 aa, Entamoeba histolytica
YQQPCWFWGISKFDIEQSDI

SEQ ID NO: 2701464 - protein, 20 aa, Entamoeba histolytica
YQQTFKWIGFCKNQILKQPN

SEQ ID NO: 2701465 - protein, 17 aa, Entamoeba histolytica
YQRAWRFTENEFIIFNR

SEQ ID NO: 2701466 - protein, 25 aa, Entamoeba histolytica
YQRVFKRCVEGTLKNSIKLLETTRI

SEQ ID NO: 2701467 - protein, 22 aa, Entamoeba histolytica
YQSFLCTPILIAAHRTLNLYSF

SEQ ID NO: 2701468 - protein, 26 aa, Entamoeba histolytica
YQSGDRIGLWIKFQLEPSAYATMLFR

SEQ ID NO: 2701469 - protein, 21 aa, Entamoeba histolytica
YQSGTSLRCCPVDYTHFTIVS

SEQ ID NO: 2701470 - protein, 18 aa, Entamoeba histolytica
YQSHILRLALSQYHFHPE

SEQ ID NO: 2701471 - protein, 17 aa, Entamoeba histolytica
YQSSCAINGDGLYEGLD

SEQ ID NO: 2701472 - protein, 19 aa, Entamoeba histolytica
YQTKCKFDLLQTSNLKSKT

SEQ ID NO: 2701473 - protein, 18 aa, Entamoeba histolytica
YQTLFEWSIKERNISKEI

SEQ ID NO: 2701474 - protein, 26 aa, Entamoeba histolytica
YQTSCLPPDMSVGWSKNKLVFINHSF

SEQ ID NO: 2701475 - protein, 20 aa, Entamoeba histolytica
YQTVEIRPSVLFNKYEEECP

SEQ ID NO: 2701476 - protein, 27 aa, Entamoeba histolytica
YQVSLPFCGQFAMKLMACVRMIKEIEL

SEQ ID NO: 2701477 - protein, 17 aa, Entamoeba histolytica
YQWLLQALFGIKIAYRC

SEQ ID NO: 2701478 - protein, 18 aa, Entamoeba histolytica
YQYLRSLLIFSRSYPKNL

SEQ ID NO: 2701479 - protein, 18 aa, Entamoeba histolytica
YQYPPQYYPLSIQIQPLN

SEQ ID NO: 2701480 - protein, 18 aa, Entamoeba histolytica
YRAIEIILGLPYSCAIDM

SEQ ID NO: 2701481 - protein, 25 aa, Entamoeba histolytica
YRAKGRFPVISWVGPMNQCLSRSAQ

SEQ ID NO: 2701482 - protein, 19 aa, Entamoeba histolytica
YRALYICHLGGFVADSTLL

SEQ ID NO: 2701483 - protein, 24 aa, Entamoeba histolytica
YRASSDLDQSCLVLQQFLQQLMTF

SEQ ID NO: 2701484 - protein, 20 aa, Entamoeba histolytica
YRATIGVDFAVKFTTVDERD

SEQ ID NO: 2701485 - protein, 20 aa, Entamoeba histolytica
YRDECRKASAACILQRAIRS

SEQ ID NO: 2701486 - protein, 22 aa, Entamoeba histolytica
YRDFPKKLKIERLLNNQYDEKT

SEQ ID NO: 2701487 - protein, 17 aa, Entamoeba histolytica
YRDLSIISEIGLACIVK

SEQ ID NO: 2701488 - protein, 20 aa, Entamoeba histolytica
YRDTDCFVIVFSYVDKDTLI

SEQ ID NO: 2701489 - protein, 17 aa, Entamoeba histolytica
YRECERDELKIPLQNSL

SEQ ID NO: 2701490 - protein, 17 aa, Entamoeba histolytica
YREEFIPIIEVSRLLTM

SEQ ID NO: 2701491 - protein, 17 aa, Entamoeba histolytica
YREEWKGDWQSRITVDK

SEQ ID NO: 2701492 - protein, 21 aa, Entamoeba histolytica
YRELGMFKGLFKTATVGAPGL

SEQ ID NO: 2701493 - protein, 24 aa, Entamoeba histolytica
YRELIPRPMFEGIFAKVKQMAIGF

SEQ ID NO: 2701494 - protein, 23 aa, Entamoeba histolytica
YREQWCVLELLYSIKQIFPQIIS

SEQ ID NO: 2701495 - protein, 24 aa, Entamoeba histolytica
YRERIRGKMFEWVPNIAKEDVKQT

SEQ ID NO: 2701496 - protein, 19 aa, Entamoeba histolytica
YRFFTTFNYLYAIDNFFDY

SEQ ID NO: 2701497 - protein, 21 aa, Entamoeba histolytica
YRFGPESTFCGKSFKEIFKEK

SEQ ID NO: 2701498 - protein, 32 aa, Entamoeba histolytica
YRFHPSVKMAKRFFPHIQNMDGFFVCKLKVNV

SEQ ID NO: 2701499 - protein, 19 aa, Entamoeba histolytica
YRFKISGHERSNIVKDFFE

SEQ ID NO: 2701500 - protein, 18 aa, Entamoeba histolytica
YRFSESGNIREPLYSMSK

SEQ ID NO: 2701501 - protein, 21 aa, Entamoeba histolytica
YRGDICGFTGHPTRTKTGELS

SEQ ID NO: 2701502 - protein, 19 aa, Entamoeba histolytica
YRGEIPCNFIKLHSTVSMT

SEQ ID NO: 2701503 - protein, 19 aa, Entamoeba histolytica
YRGKPELIDISSFKTQFNH

SEQ ID NO: 2701504 - protein, 18 aa, Entamoeba histolytica
YRGNMERFRFNPIPLDDY

SEQ ID NO: 2701505 - protein, 33 aa, Entamoeba histolytica
YRGQLPYIRPVGCMRCALHVLGMFDNGNDIWLG

SEQ ID NO: 2701506 - protein, 21 aa, Entamoeba histolytica
YRGSSGIIVCYDVSENSSLDV

SEQ ID NO: 2701507 - protein, 17 aa, Entamoeba histolytica
YRGYKLTDSSLFSTIGY

SEQ ID NO: 2701508 - protein, 20 aa, Entamoeba histolytica
YRHGLWCKDIIITLTDIIDQ

SEQ ID NO: 2701509 - protein, 18 aa, Entamoeba histolytica
YRIKFPHLKYCNIENSTR

SEQ ID NO: 2701510 - protein, 19 aa, Entamoeba histolytica
YRIKFPHLKYCNIENSTRN

SEQ ID NO: 2701511 - protein, 17 aa, Entamoeba histolytica
YRIKKEKTYAISKNEEY

SEQ ID NO: 2701512 - protein, 17 aa, Entamoeba histolytica
YRIKKFVVVDLPDVECA

SEQ ID NO: 2701513 - protein, 17 aa, Entamoeba histolytica
YRILSLDGFSDNPILQI

SEQ ID NO: 2701514 - protein, 19 aa, Entamoeba histolytica
YRILVSMEHACYPRYTAPP

SEQ ID NO: 2701515 - protein, 18 aa, Entamoeba histolytica
YRIPKRVESLWDQCKDYP

SEQ ID NO: 2701516 - protein, 17 aa, Entamoeba histolytica
YRISGIVNQRDRIDQNI

SEQ ID NO: 2701517 - protein, 21 aa, Entamoeba histolytica
YRISQLIKEYGLIPLVELVFG

SEQ ID NO: 2701518 - protein, 19 aa, Entamoeba histolytica
YRISRLIKEHDLIPLVELV

SEQ ID NO: 2701519 - protein, 23 aa, Entamoeba histolytica
YRKEALRMICYLASNKFNKEAMQ

SEQ ID NO: 2701520 - protein, 21 aa, Entamoeba histolytica
YRKGSRIFSKGFGFVKVDNKE

SEQ ID NO: 2701521 - protein, 19 aa, Entamoeba histolytica
YRKIMSLNEGIIFQDQNIQ

SEQ ID NO: 2701522 - protein, 19 aa, Entamoeba histolytica
YRKSTSFKRRYSSRSRSRS

SEQ ID NO: 2701523 - protein, 18 aa, Entamoeba histolytica
YRKTLTVDNRICVLDILD

SEQ ID NO: 2701524 - protein, 21 aa, Entamoeba histolytica
YRKWTKLGIQGNKLFKPVCQT

SEQ ID NO: 2701525 - protein, 21 aa, Entamoeba histolytica
YRLGNSQPYRIVEQQMNQQNI

SEQ ID NO: 2701526 - protein, 21 aa, Entamoeba histolytica
YRLKESFEFEWENNIKLPPHK

SEQ ID NO: 2701527 - protein, 18 aa, Entamoeba histolytica
YRLLKKCDDVQEMQPLLP

SEQ ID NO: 2701528 - protein, 17 aa, Entamoeba histolytica
YRLNEDNNIIILFNKSG

SEQ ID NO: 2701529 - protein, 20 aa, Entamoeba histolytica
YRLQATLQIVPLKIKEDSEK

SEQ ID NO: 2701530 - protein, 20 aa, Entamoeba histolytica
YRLQYKPVLPKHIADIDNIT

SEQ ID NO: 2701531 - protein, 17 aa, Entamoeba histolytica
YRLTIPFIKNLKNEITI

SEQ ID NO: 2701532 - protein, 17 aa, Entamoeba histolytica
YRMIDLYSNQKNYSSLC

SEQ ID NO: 2701533 - protein, 18 aa, Entamoeba histolytica
YRMKVYDSTICFVVSHLA

SEQ ID NO: 2701534 - protein, 17 aa, Entamoeba histolytica
YRNAQGVIIVYDVNDIG

SEQ ID NO: 2701535 - protein, 18 aa, Entamoeba histolytica
YRNDLKRADSNLALSQKK

SEQ ID NO: 2701536 - protein, 23 aa, Entamoeba histolytica
YRNELRTFLSFVDFVKDLSDSEL

SEQ ID NO: 2701537 - protein, 23 aa, Entamoeba histolytica
YRNLIKYNSYRFGYKGKAKSIKF

SEQ ID NO: 2701538 - protein, 20 aa, Entamoeba histolytica
YRNLLCRTVNNEGIYRLPFP

SEQ ID NO: 2701539 - protein, 20 aa, Entamoeba histolytica
YRNPEILAFIRKIEIRCLTM

SEQ ID NO: 2701540 - protein, 18 aa, Entamoeba histolytica
YRNRMDYTFGDGYIGGPL

SEQ ID NO: 2701541 - protein, 17 aa, Entamoeba histolytica
YRNSLFIGIQKPSLTIT

SEQ ID NO: 2701542 - protein, 21 aa, Entamoeba histolytica
YRPELPLILCASHCGEQHEVI

SEQ ID NO: 2701543 - protein, 25 aa, Entamoeba histolytica
YRPSYIPLSVCRVAQVPLGAVDVSE

SEQ ID NO: 2701544 - protein, 21 aa, Entamoeba histolytica
YRPTYYSPRRSRSISPRDFHR

SEQ ID NO: 2701545 - protein, 22 aa, Entamoeba histolytica
YRPVPLEHYVFCKKKEELPSKL

SEQ ID NO: 2701546 - protein, 25 aa, Entamoeba histolytica
YRQELCSMFPPLVIESLINKYHINT

SEQ ID NO: 2701547 - protein, 19 aa, Entamoeba histolytica
YRQLLEIGFDETKYHEQLG

SEQ ID NO: 2701548 - protein, 17 aa, Entamoeba histolytica
YRQMHQRMFVEVTDEIQ

SEQ ID NO: 2701549 - protein, 19 aa, Entamoeba histolytica
YRQYLNDIFSILIQKKRNL

SEQ ID NO: 2701550 - protein, 20 aa, Entamoeba histolytica
YRRFIMGGFVRLQGHPNKFN

SEQ ID NO: 2701551 - protein, 22 aa, Entamoeba histolytica
YRRLREFFQDRTVIINYLEIPQ

SEQ ID NO: 2701552 - protein, 23 aa, Entamoeba histolytica
YRRRLPIGYTRLFSYELARALGY

SEQ ID NO: 2701553 - protein, 18 aa, Entamoeba histolytica
YRRSAVLYFGNFHETTVV

SEQ ID NO: 2701554 - protein, 21 aa, Entamoeba histolytica
YRSELKLNQLTFPRLKTIRCS

SEQ ID NO: 2701555 - protein, 20 aa, Entamoeba histolytica
YRSIACWEKAVEEIKTLETK

SEQ ID NO: 2701556 - protein, 20 aa, Entamoeba histolytica
YRSILKQSIELYPFEETLSL

SEQ ID NO: 2701557 - protein, 17 aa, Entamoeba histolytica
YRSPYWEDIKRLVLKPI

SEQ ID NO: 2701558 - protein, 28 aa, Entamoeba histolytica
YRTKPCKYFFETGVCRKGEHCNFSHDLS

SEQ ID NO: 2701559 - protein, 20 aa, Entamoeba histolytica
YRTLDELIMRIPMKLSDNPL

SEQ ID NO: 2701560 - protein, 21 aa, Entamoeba histolytica
YRTLFKWYDGPLIEAMKNGDM

SEQ ID NO: 2701561 - protein, 17 aa, Entamoeba histolytica
YRTNNMVLITSYFPSRS

SEQ ID NO: 2701562 - protein, 20 aa, Entamoeba histolytica
YRTQCSSFSKTLFTNPVLTD

SEQ ID NO: 2701563 - protein, 19 aa, Entamoeba histolytica
YRTTKGFCDLIYQEWISSG

SEQ ID NO: 2701564 - protein, 20 aa, Entamoeba histolytica
YRVDAIKEMLTKEFGQAIIE

SEQ ID NO: 2701565 - protein, 28 aa, Entamoeba histolytica
YRVHICFSSSCSLILFYYLPNNYPFEEI

SEQ ID NO: 2701566 - protein, 19 aa, Entamoeba histolytica
YRVKMNFPNSISMTHLTMY

SEQ ID NO: 2701567 - protein, 19 aa, Entamoeba histolytica
YRVNIMRPAFIVADSTKGI

SEQ ID NO: 2701568 - protein, 20 aa, Entamoeba histolytica
YRVVRECAPNAFIIGNIGSV

SEQ ID NO: 2701569 - protein, 20 aa, Entamoeba histolytica
YRYIKKLCKSFNIQYQNEIV

SEQ ID NO: 2701570 - protein, 20 aa, Entamoeba histolytica
YRYLEICYALFNAYNGSGPE

SEQ ID NO: 2701571 - protein, 19 aa, Entamoeba histolytica
YRYLERKDLLKILDDELIE

SEQ ID NO: 2701572 - protein, 17 aa, Entamoeba histolytica
YRYSLESTFKYLCQFLT

SEQ ID NO: 2701573 - protein, 17 aa, Entamoeba histolytica
YSALKVWTQQLCPTYPP

SEQ ID NO: 2701574 - protein, 25 aa, Entamoeba histolytica
YSAYPSCGFDWCRVNTDLVCAWYLN

SEQ ID NO: 2701575 - protein, 19 aa, Entamoeba histolytica
YSCAIDMWSFGCVAAELFL

SEQ ID NO: 2701576 - protein, 23 aa, Entamoeba histolytica
YSCDLEGLTLILASMKLYQPILI

SEQ ID NO: 2701577 - protein, 18 aa, Entamoeba histolytica
YSCEILITLLCMKVNNPN

SEQ ID NO: 2701578 - protein, 34 aa, Entamoeba histolytica
YSCSIDMWSFGCVIAELLLGIPIFPGENEYNQLV

SEQ ID NO: 2701579 - protein, 19 aa, Entamoeba histolytica
YSDFPHWDISIGGCADGNI

SEQ ID NO: 2701580 - protein, 23 aa, Entamoeba histolytica
YSDKRIGYLALMLLLDETQEVLT

SEQ ID NO: 2701581 - protein, 18 aa, Entamoeba histolytica
YSDSRIIGFDSRMKEKAF

SEQ ID NO: 2701582 - protein, 17 aa, Entamoeba histolytica
YSEEFKIAMNFQSKEIT

SEQ ID NO: 2701583 - protein, 21 aa, Entamoeba histolytica
YSEFEVFYLFQGILELVKEFY

SEQ ID NO: 2701584 - protein, 26 aa, Entamoeba histolytica
YSEHLRKVCSVKPLGPKFISTSSDRS

SEQ ID NO: 2701585 - protein, 21 aa, Entamoeba histolytica
YSEKEPMVLKLLERNIQQEIK

SEQ ID NO: 2701586 - protein, 21 aa, Entamoeba histolytica
YSESSIKPIFLRKASTSVSVN

SEQ ID NO: 2701587 - protein, 17 aa, Entamoeba histolytica
YSFHPIITTIPIHLMLS

SEQ ID NO: 2701588 - protein, 21 aa, Entamoeba histolytica
YSFMYKWIILLFRRDFPHMAC

SEQ ID NO: 2701589 - protein, 23 aa, Entamoeba histolytica
YSFRYIYEVCFFNSFQKRLIMKN

SEQ ID NO: 2701590 - protein, 19 aa, Entamoeba histolytica
YSFSEFPIEKIIKTAQSLN

SEQ ID NO: 2701591 - protein, 25 aa, Entamoeba histolytica
YSFSVCAQCKKVIYRKDKESETRRR

SEQ ID NO: 2701592 - protein, 23 aa, Entamoeba histolytica
YSGDCGKIFKYKRHNSRDLLFYG

SEQ ID NO: 2701593 - protein, 20 aa, Entamoeba histolytica
YSGGISELLLPSSLKNIRLE

SEQ ID NO: 2701594 - protein, 24 aa, Entamoeba histolytica
YSGHCLKCKKSFKQSYFIDNVRDG

SEQ ID NO: 2701595 - protein, 23 aa, Entamoeba histolytica
YSGHQRISYDILNLLKTTVLMDD

SEQ ID NO: 2701596 - protein, 17 aa, Entamoeba histolytica
YSGIEKKECGGKIIRIY

SEQ ID NO: 2701597 - protein, 25 aa, Entamoeba histolytica
YSGLAEKALKCSQIEVINQNNIDYM

SEQ ID NO: 2701598 - protein, 20 aa, Entamoeba histolytica
YSIEFFPNIETFHIYNEYDE

SEQ ID NO: 2701599 - protein, 22 aa, Entamoeba histolytica
YSIELPSKIIIQLCNEVLNEIS

SEQ ID NO: 2701600 - protein, 20 aa, Entamoeba histolytica
YSIIKKNDCEIHLKRRATIL

SEQ ID NO: 2701601 - protein, 17 aa, Entamoeba histolytica
YSIKINRPIWVLNDAVY

SEQ ID NO: 2701602 - protein, 20 aa, Entamoeba histolytica
YSIPVLYAPQFDRINKKQDM

SEQ ID NO: 2701603 - protein, 24 aa, Entamoeba histolytica
YSIRSVYNFAPFIKHYFIVTMGQT

SEQ ID NO: 2701604 - protein, 24 aa, Entamoeba histolytica
YSIVLKVRLDLAKNIGCENEYPLL

SEQ ID NO: 2701605 - protein, 25 aa, Entamoeba histolytica
YSIVPEKKIVFSFKGNDKIIPIMKE

SEQ ID NO: 2701606 - protein, 27 aa, Entamoeba histolytica
YSIYLATCGKLVFFAIKPSSPNKCPLK

SEQ ID NO: 2701607 - protein, 17 aa, Entamoeba histolytica
YSKAIVTARPCIHLLNQ

SEQ ID NO: 2701608 - protein, 23 aa, Entamoeba histolytica
YSKDLAIEVIRQLQILFTEMSIG

SEQ ID NO: 2701609 - protein, 17 aa, Entamoeba histolytica
YSKDYIEHIGFILDICK

SEQ ID NO: 2701610 - protein, 17 aa, Entamoeba histolytica
YSKGLGWHVSIIDILPN

SEQ ID NO: 2701611 - protein, 26 aa, Entamoeba histolytica
YSKKPCKDYFKRALELNKNYAPALIG

SEQ ID NO: 2701612 - protein, 18 aa, Entamoeba histolytica
YSKMLRHHVHVITENEIL

SEQ ID NO: 2701613 - protein, 17 aa, Entamoeba histolytica
YSKRERLQYCGLVNNAI

SEQ ID NO: 2701614 - protein, 18 aa, Entamoeba histolytica
YSLACGVEQCWGAHMIGH

SEQ ID NO: 2701615 - protein, 23 aa, Entamoeba histolytica
YSLCAARSPLIILVRDDTGALFG

SEQ ID NO: 2701616 - protein, 24 aa, Entamoeba histolytica
YSLCHKNILLPFSLIKIHLNNLYN

SEQ ID NO: 2701617 - protein, 19 aa, Entamoeba histolytica
YSLDEISQWCSSNNIEFTI

SEQ ID NO: 2701618 - protein, 20 aa, Entamoeba histolytica
YSLESTFKYLCQFLTNVGIL

SEQ ID NO: 2701619 - protein, 17 aa, Entamoeba histolytica
YSLFHIVWLQSFDEKLV

SEQ ID NO: 2701620 - protein, 19 aa, Entamoeba histolytica
YSLIQNRAFIYSAKNSLYT

SEQ ID NO: 2701621 - protein, 20 aa, Entamoeba histolytica
YSLLCGTFPFAGEDQELVSN

SEQ ID NO: 2701622 - protein, 22 aa, Entamoeba histolytica
YSLLKKNIKVIINHPEMNENSI

SEQ ID NO: 2701623 - protein, 21 aa, Entamoeba histolytica
YSLMVALKLSRIVFYIYQPQA

SEQ ID NO: 2701624 - protein, 18 aa, Entamoeba histolytica
YSLQHFNDFFKFVKEEKQ

SEQ ID NO: 2701625 - protein, 17 aa, Entamoeba histolytica
YSLYQEFLFETKGLKEQ

SEQ ID NO: 2701626 - protein, 19 aa, Entamoeba histolytica
YSMQLPEVLCRVMNTYEHN

SEQ ID NO: 2701627 - protein, 25 aa, Entamoeba histolytica
YSNAIPWELFSIIKLTDDDTTSSSR

SEQ ID NO: 2701628 - protein, 18 aa, Entamoeba histolytica
YSNEFAIEELIYYYNLYR

SEQ ID NO: 2701629 - protein, 17 aa, Entamoeba histolytica
YSNEFPLTGEMSGLDNI

SEQ ID NO: 2701630 - protein, 30 aa, Entamoeba histolytica
YSNPVFKHCMSLFWCDFLRANATNIVENTM

SEQ ID NO: 2701631 - protein, 18 aa, Entamoeba histolytica
YSNWGFPKPLFLDGTEVC

SEQ ID NO: 2701632 - protein, 18 aa, Entamoeba histolytica
YSPLSFTPIIGIKPFSFS

SEQ ID NO: 2701633 - protein, 25 aa, Entamoeba histolytica
YSQELKELIPVIPKKSMGYIEMKLM

SEQ ID NO: 2701634 - protein, 24 aa, Entamoeba histolytica
YSQFLKKNYPVLVEYYEKNKNRKE

SEQ ID NO: 2701635 - protein, 17 aa, Entamoeba histolytica
YSQILSTLWQMSLIDMK

SEQ ID NO: 2701636 - protein, 18 aa, Entamoeba histolytica
YSQLKLVPPENGKYVSNE

SEQ ID NO: 2701637 - protein, 18 aa, Entamoeba histolytica
YSQLPSFYEDGSLNMIKV

SEQ ID NO: 2701638 - protein, 17 aa, Entamoeba histolytica
YSQPHPMSRMSANQPIL

SEQ ID NO: 2701639 - protein, 17 aa, Entamoeba histolytica
YSQVPWILSPVLHTSYK

SEQ ID NO: 2701640 - protein, 24 aa, Entamoeba histolytica
YSQVPWILSPVLRTTRRMFSHKEL

SEQ ID NO: 2701641 - protein, 23 aa, Entamoeba histolytica
YSRAMKIIKHIGWWGNGKLDDGL

SEQ ID NO: 2701642 - protein, 27 aa, Entamoeba histolytica
YSREMLEGMSGKFGRMLRDMEEDETSF

SEQ ID NO: 2701643 - protein, 18 aa, Entamoeba histolytica
YSRKLFPNIETFHIYNKK

SEQ ID NO: 2701644 - protein, 31 aa, Entamoeba histolytica
YSRRLYSLFRGWLEMHAEYFSRECPFLLEKI

SEQ ID NO: 2701645 - protein, 27 aa, Entamoeba histolytica
YSRSLIRHNFLYGKERLMTSIIEGKSN

SEQ ID NO: 2701646 - protein, 17 aa, Entamoeba histolytica
YSSASIFLICFSVTSSV

SEQ ID NO: 2701647 - protein, 28 aa, Entamoeba histolytica
YSSDAFKVCVCKKCGLIGHSGYCKFCES

SEQ ID NO: 2701648 - protein, 18 aa, Entamoeba histolytica
YSSFPCFNLLTDSQQLLL

SEQ ID NO: 2701649 - protein, 19 aa, Entamoeba histolytica
YSSIYYKQLLIDLLKEKEK

SEQ ID NO: 2701650 - protein, 25 aa, Entamoeba histolytica
YSSLCIRFNQVLGMMEKYLERVNQN

SEQ ID NO: 2701651 - protein, 22 aa, Entamoeba histolytica
YSSMVDIFFRGAKGCVIVYDIT

SEQ ID NO: 2701652 - protein, 20 aa, Entamoeba histolytica
YSSRNWGRCILQHFFQHAFD

SEQ ID NO: 2701653 - protein, 26 aa, Entamoeba histolytica
YSSSLNKMLLCYGTDYLQEIPLETIN

SEQ ID NO: 2701654 - protein, 18 aa, Entamoeba histolytica
YSSWLYSFINAIYPQSLE

SEQ ID NO: 2701655 - protein, 21 aa, Entamoeba histolytica
YSTRNPLDFTVEIAADEEEDL

SEQ ID NO: 2701656 - protein, 18 aa, Entamoeba histolytica
YSTSISMPTSIPKRILPS

SEQ ID NO: 2701657 - protein, 21 aa, Entamoeba histolytica
YSTSKPLGIICLFNEQKQARV

SEQ ID NO: 2701658 - protein, 19 aa, Entamoeba histolytica
YSTTFDWGNIVDRNNNVAK

SEQ ID NO: 2701659 - protein, 18 aa, Entamoeba histolytica
YSTYRIVYETVKKQQTAQ

SEQ ID NO: 2701660 - protein, 24 aa, Entamoeba histolytica
YSVDPCIPWHISAFHPDYLMDTTP

SEQ ID NO: 2701661 - protein, 17 aa, Entamoeba histolytica
YSVKMPFTIKNRDWVNM

SEQ ID NO: 2701662 - protein, 23 aa, Entamoeba histolytica
YSYARKYFYLSIYSNAIKGLTIN

SEQ ID NO: 2701663 - protein, 26 aa, Entamoeba histolytica
YSYEKGIAFPCCISLNNCCGYFCPLA

SEQ ID NO: 2701664 - protein, 24 aa, Entamoeba histolytica
YSYGIILWELIYRVIYQKYQRPFQ

SEQ ID NO: 2701665 - protein, 24 aa, Entamoeba histolytica
YSYPCDIYSLGMTMYFSFTKIDPY

SEQ ID NO: 2701666 - protein, 19 aa, Entamoeba histolytica
YTCVATHSLFSKSYLQSTN

SEQ ID NO: 2701667 - protein, 22 aa, Entamoeba histolytica
YTCYYLRITHCPTLTTCTIPQT

SEQ ID NO: 2701668 - protein, 25 aa, Entamoeba histolytica
YTDAGRCTRPLFTVSNNNGHYTLNL

SEQ ID NO: 2701669 - protein, 24 aa, Entamoeba histolytica
YTDTDCFMICFSIAEEESFERIKT

SEQ ID NO: 2701670 - protein, 29 aa, Entamoeba histolytica
YTELILKFITFYLNLFFSRIELVDEEGWK

SEQ ID NO: 2701671 - protein, 18 aa, Entamoeba histolytica
YTGAHLWGVYADGSTSQH

SEQ ID NO: 2701672 - protein, 17 aa, Entamoeba histolytica
YTGLKALVLDSVTTSIV

SEQ ID NO: 2701673 - protein, 20 aa, Entamoeba histolytica
YTIACGFQPFRSENETEDGK

SEQ ID NO: 2701674 - protein, 21 aa, Entamoeba histolytica
YTIEFKQISGIGVPEGTEVIL

SEQ ID NO: 2701675 - protein, 52 aa, Entamoeba histolytica
YTISPRFGHEAPITRVLLVNELPRYVTPQSPFHFYNLFSLYGSIIKVNVLSE

SEQ ID NO: 2701676 - protein, 26 aa, Entamoeba histolytica
YTKAGAFCGSCVRPGGHEEKKYYLED

SEQ ID NO: 2701677 - protein, 21 aa, Entamoeba histolytica
YTKDRIFFKIAKDWDLLYVVG

SEQ ID NO: 2701678 - protein, 17 aa, Entamoeba histolytica
YTKHKYEPLFLFDSEDS

SEQ ID NO: 2701679 - protein, 22 aa, Entamoeba histolytica
YTKHQFGGLIIPIRGMDLGKDK

SEQ ID NO: 2701680 - protein, 17 aa, Entamoeba histolytica
YTKPLIFELENKELGLK

SEQ ID NO: 2701681 - protein, 19 aa, Entamoeba histolytica
YTKQFPYSVSFVSKYQSKG

SEQ ID NO: 2701682 - protein, 18 aa, Entamoeba histolytica
YTKSNTWTGAKSFNGYSL

SEQ ID NO: 2701683 - protein, 20 aa, Entamoeba histolytica
YTLFVKPVFEIYQKTSKIRD

SEQ ID NO: 2701684 - protein, 17 aa, Entamoeba histolytica
YTLGFGMVNNKYDVFAP

SEQ ID NO: 2701685 - protein, 25 aa, Entamoeba histolytica
YTLLKRITIIKSYWRNIKENEKERF

SEQ ID NO: 2701686 - protein, 26 aa, Entamoeba histolytica
YTLNIWKSTYLINFSKFIQTNTNQKS

SEQ ID NO: 2701687 - protein, 17 aa, Entamoeba histolytica
YTLPRLDLDSIKSKKIS

SEQ ID NO: 2701688 - protein, 24 aa, Entamoeba histolytica
YTMPVLRKDSTFVFHLSINGEIKY

SEQ ID NO: 2701689 - protein, 25 aa, Entamoeba histolytica
YTNLRPVHRLDRMTSGILLLAKTIQ

SEQ ID NO: 2701690 - protein, 23 aa, Entamoeba histolytica
YTNLVGKECVVWINEMAHDGINY

SEQ ID NO: 2701691 - protein, 30 aa, Entamoeba histolytica
YTNVILYRRIIRLVKNIKLNNFIVPIELQE

SEQ ID NO: 2701692 - protein, 25 aa, Entamoeba histolytica
YTPEFSLLNSFSIRDVIDVSFSSNT

SEQ ID NO: 2701693 - protein, 18 aa, Entamoeba histolytica
YTPFNLINCYQKYHEQID

SEQ ID NO: 2701694 - protein, 19 aa, Entamoeba histolytica
YTPITSCGWWEIQQPILQE

SEQ ID NO: 2701695 - protein, 23 aa, Entamoeba histolytica
YTPKELGGLGMLSMGHVLIPQSD

SEQ ID NO: 2701696 - protein, 24 aa, Entamoeba histolytica
YTPLEFIGNGAFGLVVKVERDGVI

SEQ ID NO: 2701697 - protein, 23 aa, Entamoeba histolytica
YTPMGKSKLSFIVSEDNILIRYD

SEQ ID NO: 2701698 - protein, 18 aa, Entamoeba histolytica
YTPNEIAEFVHLPKSLSK

SEQ ID NO: 2701699 - protein, 22 aa, Entamoeba histolytica
YTPQKREFVSFEAPTIPTEKEV

SEQ ID NO: 2701700 - protein, 17 aa, Entamoeba histolytica
YTPVLPIEKDLVVLELL

SEQ ID NO: 2701701 - protein, 28 aa, Entamoeba histolytica
YTQDFKKRFSLLLGFEFKSMNAVDAFKL

SEQ ID NO: 2701702 - protein, 17 aa, Entamoeba histolytica
YTREEFDDVCNRLRIAV

SEQ ID NO: 2701703 - protein, 17 aa, Entamoeba histolytica
YTRIIEGTKSFETVFKE

SEQ ID NO: 2701704 - protein, 18 aa, Entamoeba histolytica
YTRNDLFMTINFVNTKLL

SEQ ID NO: 2701705 - protein, 20 aa, Entamoeba histolytica
YTRRYGKGKILITGFHFEFD

SEQ ID NO: 2701706 - protein, 19 aa, Entamoeba histolytica
YTRYLCSIISGYIQSYYTI

SEQ ID NO: 2701707 - protein, 24 aa, Entamoeba histolytica
YTSDEIKILLSIAKCYLAKSPASF

SEQ ID NO: 2701708 - protein, 26 aa, Entamoeba histolytica
YTSFLIKEGTAFIVVKNRVPYISIST

SEQ ID NO: 2701709 - protein, 20 aa, Entamoeba histolytica
YTSRHCVFLCRHGFRLDYTD

SEQ ID NO: 2701710 - protein, 18 aa, Entamoeba histolytica
YTSYVIDCLKLCSIEINQ

SEQ ID NO: 2701711 - protein, 26 aa, Entamoeba histolytica
YTTFNQKCSYPFGYGLSYTQFEYSNF

SEQ ID NO: 2701712 - protein, 25 aa, Entamoeba histolytica
YTTLKLNICDFFPEHLRVRGIDVKK

SEQ ID NO: 2701713 - protein, 47 aa, Entamoeba histolytica
YTYHYQECREIMDFLYKRLCEDGKNWREIYKSLLVLDNILKNGSEEA

SEQ ID NO: 2701714 - protein, 20 aa, Entamoeba histolytica
YTYNPIDEWQIFPRITEQRF

SEQ ID NO: 2701715 - protein, 22 aa, Entamoeba histolytica
YVCGRTGNMLLLLDPHFVQKAH

SEQ ID NO: 2701716 - protein, 19 aa, Entamoeba histolytica
YVDEMKYTRIIEGTKSFET

SEQ ID NO: 2701717 - protein, 21 aa, Entamoeba histolytica
YVDLLCESMADKSVSFNQMNL

SEQ ID NO: 2701718 - protein, 29 aa, Entamoeba histolytica
YVDLNYGCFLCCACGRAHTLFPTIRNTSN

SEQ ID NO: 2701719 - protein, 27 aa, Entamoeba histolytica
YVDPSCPEGIDVVWLWVNGSDPTFRKQ

SEQ ID NO: 2701720 - protein, 24 aa, Entamoeba histolytica
YVDRVIACVGFLYTRSNFSYYFGD

SEQ ID NO: 2701721 - protein, 19 aa, Entamoeba histolytica
YVECYLINDMLWLVTELMD

SEQ ID NO: 2701722 - protein, 19 aa, Entamoeba histolytica
YVETRWYRAPEILLGSQRY

SEQ ID NO: 2701723 - protein, 19 aa, Entamoeba histolytica
YVFPFIKNLFQTHCKDQVF

SEQ ID NO: 2701724 - protein, 24 aa, Entamoeba histolytica
YVGPCGKRALLIAKNRVTALTDFT

SEQ ID NO: 2701725 - protein, 28 aa, Entamoeba histolytica
YVHMKECYVHFEDAWKSAVDLYGLSSIH

SEQ ID NO: 2701726 - protein, 23 aa, Entamoeba histolytica
YVHTRLCFKLFKYIIYTKVPSFF

SEQ ID NO: 2701727 - protein, 20 aa, Entamoeba histolytica
YVICIPRIYSRWKEEGYINN

SEQ ID NO: 2701728 - protein, 20 aa, Entamoeba histolytica
YVIDCLKLCSIEINQRYLYQ

SEQ ID NO: 2701729 - protein, 19 aa, Entamoeba histolytica
YVIFGERIVDLAVSRLMNN

SEQ ID NO: 2701730 - protein, 26 aa, Entamoeba histolytica
YVIKMKRIKSISGFGVDYQTWKDISL

SEQ ID NO: 2701731 - protein, 19 aa, Entamoeba histolytica
YVIVGEVAVGKSCLLLQFQ

SEQ ID NO: 2701732 - protein, 17 aa, Entamoeba histolytica
YVIWYKVNYSKYLKEKE

SEQ ID NO: 2701733 - protein, 17 aa, Entamoeba histolytica
YVIWYKVSYSRYLKEKE

SEQ ID NO: 2701734 - protein, 26 aa, Entamoeba histolytica
YVKIVTDFFPSLPLTIFQICNVYREL

SEQ ID NO: 2701735 - protein, 26 aa, Entamoeba histolytica
YVKTEFNKRLALWFTQQDIWNRMDVG

SEQ ID NO: 2701736 - protein, 18 aa, Entamoeba histolytica
YVLDILCDTGCGYQGDEL

SEQ ID NO: 2701737 - protein, 18 aa, Entamoeba histolytica
YVLEVLRSKDIVGIDENF

SEQ ID NO: 2701738 - protein, 24 aa, Entamoeba histolytica
YVLKGGEIYRMFEISKLNPKGLFW

SEQ ID NO: 2701739 - protein, 23 aa, Entamoeba histolytica
YVLLCGYPPFFASVLGIKYEGGV

SEQ ID NO: 2701740 - protein, 23 aa, Entamoeba histolytica
YVLLCGYPPFFGDTLGEILSAVC

SEQ ID NO: 2701741 - protein, 23 aa, Entamoeba histolytica
YVLNETLKGLVYLHSIKIIHHDI

SEQ ID NO: 2701742 - protein, 17 aa, Entamoeba histolytica
YVLPVLITKSVFYFDSC

SEQ ID NO: 2701743 - protein, 17 aa, Entamoeba histolytica
YVLQACGGFSKTVDSLF

SEQ ID NO: 2701744 - protein, 30 aa, Entamoeba histolytica
YVQKIFKLRIANFYSVYVYKGYDEDPDFFW

SEQ ID NO: 2701745 - protein, 30 aa, Entamoeba histolytica
YVQWATCVTDLFKTAGIALADEFAKVLFGP

SEQ ID NO: 2701746 - protein, 23 aa, Entamoeba histolytica
YVRALKSTVFVLGLSKESKTKSE

SEQ ID NO: 2701747 - protein, 17 aa, Entamoeba histolytica
YVREKLPFLELAKHPGD

SEQ ID NO: 2701748 - protein, 18 aa, Entamoeba histolytica
YVRLERLVLSWLDIMATM

SEQ ID NO: 2701749 - protein, 23 aa, Entamoeba histolytica
YVRRCSLMALGKVFKDKVITTRP

SEQ ID NO: 2701750 - protein, 18 aa, Entamoeba histolytica
YVSCSSYRIPVARIAAAQ

SEQ ID NO: 2701751 - protein, 29 aa, Entamoeba histolytica
YVSILIMFPLWEWNKLLVHSIEIPSNIDS

SEQ ID NO: 2701752 - protein, 24 aa, Entamoeba histolytica
YVSSFKTIIKYVVFTVSDEKYLDE

SEQ ID NO: 2701753 - protein, 19 aa, Entamoeba histolytica
YVSTVGVYILNYIDGTLTY

SEQ ID NO: 2701754 - protein, 18 aa, Entamoeba histolytica
YVSTVGVYVLNYIDGTLT

SEQ ID NO: 2701755 - protein, 17 aa, Entamoeba histolytica
YVTGERRDYCFINVSTK

SEQ ID NO: 2701756 - protein, 21 aa, Entamoeba histolytica
YVVADGCGWGVASCKAAEIAI

SEQ ID NO: 2701757 - protein, 20 aa, Entamoeba histolytica
YVVGCRSCIDKKKITQGTRV

SEQ ID NO: 2701758 - protein, 29 aa, Entamoeba histolytica
YVVIRKIMIPFPICSLKNWDCSCDITLLQ

SEQ ID NO: 2701759 - protein, 17 aa, Entamoeba histolytica
YVYHDLTKCVARLHVCF

SEQ ID NO: 2701760 - protein, 19 aa, Entamoeba histolytica
YVYRFLISSLHRIIISPND

SEQ ID NO: 2701761 - protein, 24 aa, Entamoeba histolytica
YVYRSSLRSGEFVEFMKNSYKRTP

SEQ ID NO: 2701762 - protein, 18 aa, Entamoeba histolytica
YVYYQIFFSKGISLEKQV

SEQ ID NO: 2701763 - protein, 19 aa, Entamoeba histolytica
YWEDIKRLVLKPIQSKAIM

SEQ ID NO: 2701764 - protein, 21 aa, Entamoeba histolytica
YWEQAIFKYLRCDPQDHYFLL

SEQ ID NO: 2701765 - protein, 18 aa, Entamoeba histolytica
YWFKSRTSFVKELEEKYG

SEQ ID NO: 2701766 - protein, 24 aa, Entamoeba histolytica
YWISCSETSFILLARGIHKVTFYA

SEQ ID NO: 2701767 - protein, 26 aa, Entamoeba histolytica
YWKLHCLEHSKKQIIDFIKKIEGDLI

SEQ ID NO: 2701768 - protein, 25 aa, Entamoeba histolytica
YWLDVESRMSWIICGITGSGEEIPS

SEQ ID NO: 2701769 - protein, 20 aa, Entamoeba histolytica
YWPLDMVLRDKYKFSEHDSK

SEQ ID NO: 2701770 - protein, 22 aa, Entamoeba histolytica
YWSEKKIQPSVDEWRRMHFCFV

SEQ ID NO: 2701771 - protein, 18 aa, Entamoeba histolytica
YWWDGLKEKVDIERWSYE

SEQ ID NO: 2701772 - protein, 23 aa, Entamoeba histolytica
YYADCKVGTDWYRFDDEKVTKLE

SEQ ID NO: 2701773 - protein, 18 aa, Entamoeba histolytica
YYALLSFIPRSPLNSYSS

SEQ ID NO: 2701774 - protein, 20 aa, Entamoeba histolytica
YYASRASYFINIIDKALKLE

SEQ ID NO: 2701775 - protein, 17 aa, Entamoeba histolytica
YYCELKSIHLLSLINKK

SEQ ID NO: 2701776 - protein, 23 aa, Entamoeba histolytica
YYCGWVGRVYLSMLINKQDLDAL

SEQ ID NO: 2701777 - protein, 31 aa, Entamoeba histolytica
YYDACGELRLWNCQLYLPFPIEDKLNPIDPK

SEQ ID NO: 2701778 - protein, 24 aa, Entamoeba histolytica
YYDISGCYILKPSAYGIWENIQHF

SEQ ID NO: 2701779 - protein, 26 aa, Entamoeba histolytica
YYDKGCKNLQYIFGKKKLCFPQDGRW

SEQ ID NO: 2701780 - protein, 30 aa, Entamoeba histolytica
YYDLVELPELFKSNFIEICNILKTNSLTSI

SEQ ID NO: 2701781 - protein, 22 aa, Entamoeba histolytica
YYEKECHYNCCLSSPSTVLRCL

SEQ ID NO: 2701782 - protein, 18 aa, Entamoeba histolytica
YYEKELEGAFRQCAGVTE

SEQ ID NO: 2701783 - protein, 24 aa, Entamoeba histolytica
YYELPWKQINEFISCIYNIQNIST

SEQ ID NO: 2701784 - protein, 24 aa, Entamoeba histolytica
YYEMKQWRFVIQICSNLINKITDQ

SEQ ID NO: 2701785 - protein, 25 aa, Entamoeba histolytica
YYETLKLLIHYLRLIADASAINKMN

SEQ ID NO: 2701786 - protein, 28 aa, Entamoeba histolytica
YYEVYIFISNIFKPLVISEFLNLYNEFL

SEQ ID NO: 2701787 - protein, 17 aa, Entamoeba histolytica
YYFDSLLNPIEWKNDWY

SEQ ID NO: 2701788 - protein, 17 aa, Entamoeba histolytica
YYFGYSIMVLNKYSTNE

SEQ ID NO: 2701789 - protein, 21 aa, Entamoeba histolytica
YYFKKCYVSSVALLKMVMHAK

SEQ ID NO: 2701790 - protein, 25 aa, Entamoeba histolytica
YYFRSIKLFELFLWNKCHDECKTLL

SEQ ID NO: 2701791 - protein, 24 aa, Entamoeba histolytica
YYFYREWYDAMKWDYSNQVDDLLY

SEQ ID NO: 2701792 - protein, 17 aa, Entamoeba histolytica
YYGFRFDTIKALNEVFE

SEQ ID NO: 2701793 - protein, 17 aa, Entamoeba histolytica
YYGINGIIIDNFTDEQI

SEQ ID NO: 2701794 - protein, 26 aa, Entamoeba histolytica
YYGKGEGSSLFGLKPFDIEITISTNQ

SEQ ID NO: 2701795 - protein, 24 aa, Entamoeba histolytica
YYGPTRVKGYWKFDNTELQPFTNE

SEQ ID NO: 2701796 - protein, 27 aa, Entamoeba histolytica
YYHDKCVHCYKCNQRIYSTSKYYNHKG

SEQ ID NO: 2701797 - protein, 25 aa, Entamoeba histolytica
YYICSCTEKILFICESCNERMGMDN

SEQ ID NO: 2701798 - protein, 24 aa, Entamoeba histolytica
YYIHKGVWFLMNFVREEFSNAQSE

SEQ ID NO: 2701799 - protein, 18 aa, Entamoeba histolytica
YYIPAAINLMKVGGFIDA

SEQ ID NO: 2701800 - protein, 22 aa, Entamoeba histolytica
YYIQNYWEAIGGWKMMSGDKKK

SEQ ID NO: 2701801 - protein, 21 aa, Entamoeba histolytica
YYKGYIFNILFDVPQELALLR

SEQ ID NO: 2701802 - protein, 20 aa, Entamoeba histolytica
YYKPFICIQPLISSSPSYSC

SEQ ID NO: 2701803 - protein, 21 aa, Entamoeba histolytica
YYKQFLAFMIYYIEQIPNNTD

SEQ ID NO: 2701804 - protein, 18 aa, Entamoeba histolytica
YYLDEHWQPLEYILKKYQ

SEQ ID NO: 2701805 - protein, 28 aa, Entamoeba histolytica
YYLEASYPFWILRLVWKKQNKSFNVIRK

SEQ ID NO: 2701806 - protein, 29 aa, Entamoeba histolytica
YYLERIFSLYLPMLFGYQIYIPSKSVYQQ

SEQ ID NO: 2701807 - protein, 20 aa, Entamoeba histolytica
YYLFTLKCKQYLIKTMIRYV

SEQ ID NO: 2701808 - protein, 25 aa, Entamoeba histolytica
YYLKLRMLYDTARGMSFLHENNILH

SEQ ID NO: 2701809 - protein, 18 aa, Entamoeba histolytica
YYLNCYVPSISKNPLFTS

SEQ ID NO: 2701810 - protein, 18 aa, Entamoeba histolytica
YYLSNGILKRTIFAVKKR

SEQ ID NO: 2701811 - protein, 19 aa, Entamoeba histolytica
YYLSPEICEGIPYDYKSDM

SEQ ID NO: 2701812 - protein, 17 aa, Entamoeba histolytica
YYLVKWKDYSILECSWV

SEQ ID NO: 2701813 - protein, 18 aa, Entamoeba histolytica
YYMSIEYLIGRSLMNSIC

SEQ ID NO: 2701814 - protein, 19 aa, Entamoeba histolytica
YYNASFLSFFQRPMKIQSI

SEQ ID NO: 2701815 - protein, 17 aa, Entamoeba histolytica
YYNGFQWYFQKRIVHCK

SEQ ID NO: 2701816 - protein, 27 aa, Entamoeba histolytica
YYNNGFLPTCLDLFFQSHPKMPNVPLS

SEQ ID NO: 2701817 - protein, 25 aa, Entamoeba histolytica
YYPAKSEQDIICGVSATMMNKRSKN

SEQ ID NO: 2701818 - protein, 24 aa, Entamoeba histolytica
YYPSWKKDRIGISIDEYKLVHQKL

SEQ ID NO: 2701819 - protein, 19 aa, Entamoeba histolytica
YYPTVPFDYCDIGEIREDS

SEQ ID NO: 2701820 - protein, 24 aa, Entamoeba histolytica
YYQLCGVVLYVFFDERLKNHITDV

SEQ ID NO: 2701821 - protein, 29 aa, Entamoeba histolytica
YYQSHAHMMLPVWCALHGQTVELFHEQRV

SEQ ID NO: 2701822 - protein, 20 aa, Entamoeba histolytica
YYRGDFCSVFNCIKGSSLKE

SEQ ID NO: 2701823 - protein, 21 aa, Entamoeba histolytica
YYRKCSERCASLTHGEPLMEL

SEQ ID NO: 2701824 - protein, 18 aa, Entamoeba histolytica
YYRLNTLRTKVFPSISNK

SEQ ID NO: 2701825 - protein, 25 aa, Entamoeba histolytica
YYRPPEVMVGYPFDGSFDNWSSGVT

SEQ ID NO: 2701826 - protein, 25 aa, Entamoeba histolytica
YYSCNEFLATLVVDLFGPKGAVDFM

SEQ ID NO: 2701827 - protein, 18 aa, Entamoeba histolytica
YYSIISVLRLCVFNNIYL

SEQ ID NO: 2701828 - protein, 17 aa, Entamoeba histolytica
YYSRSYSWLPLLYGLTK

SEQ ID NO: 2701829 - protein, 17 aa, Entamoeba histolytica
YYTFPSIYFQRSPTFII

SEQ ID NO: 2701830 - protein, 17 aa, Entamoeba histolytica
YYTGVIFEAVMVVGNTS

SEQ ID NO: 2701831 - protein, 23 aa, Entamoeba histolytica
YYTPEYIVDFFLKGIESIQYYER

SEQ ID NO: 2701832 - protein, 20 aa, Entamoeba histolytica
YYVDCPKEVVIFNQSYLITY

SEQ ID NO: 2701833 - protein, 17 aa, Entamoeba histolytica
YYVPRFHEEYLKDISTN

SEQ ID NO: 2701834 - protein, 22 aa, Entamoeba histolytica
YYVQAHCAIIMFDVTSRDTYKN

SEQ ID NO: 2701835 - protein, 22 aa, Entamoeba histolytica
YYYEGCQSWDWYYPYYYAPFAK

SEQ ID NO: 2701836 - protein, 24 aa, Entamoeba histolytica
YYYHFLSWPYLMYVAETINKKIVG

SEQ ID NO: 2701837 - protein, 22 aa, Entamoeba histolytica
YYYYPYCYYPQPYNINGDSPYF

SEQ ID NO: 2701838 - protein, 18 aa, Entamoeba histolytica
ESSLSFNLNDSFFLFGEN

SEQ ID NO: 2701839 - protein, 19 aa, Entamoeba histolytica
RRPYSVILFDEIEKAHPQV

SEQ ID NO: 2701840 - protein, 19 aa, Entamoeba histolytica
KSIPLKRIRFFTSHTIISD

SEQ ID NO: 2701841 - protein, 19 aa, Entamoeba histolytica
PVDGGVCILSRFPIVSQHQ

SEQ ID NO: 2701842 - protein, 23 aa, Entamoeba histolytica
PINARLDYIWGIKNGRERKELKA

SEQ ID NO: 2701843 - protein, 17 aa, Entamoeba histolytica
FKEGLKKVAALLASGAK

SEQ ID NO: 2701844 - protein, 19 aa, Entamoeba histolytica
FLKQCIKSGALIVTGPFKI

SEQ ID NO: 2701845 - protein, 17 aa, Entamoeba histolytica
HMYREFGGRINGFKHNE

SEQ ID NO: 2701846 - protein, 22 aa, Entamoeba histolytica
IKKMIPCIVNIFIVGDDIQKEF

SEQ ID NO: 2701847 - protein, 18 aa, Entamoeba histolytica
IMLVCQDCFWRCTVQGGC

SEQ ID NO: 2701848 - protein, 23 aa, Entamoeba histolytica
IRKELRGTCEFVMGKNTLIRKAI

SEQ ID NO: 2701849 - protein, 20 aa, Entamoeba histolytica
KDIPSLLVINRIKLTGINPD

SEQ ID NO: 2701850 - protein, 18 aa, Entamoeba histolytica
KVGKTGIESINFRKLEEK

SEQ ID NO: 2701851 - protein, 23 aa, Entamoeba histolytica
LPHIKGNVGFIFTKGDLYQLKAK

SEQ ID NO: 2701852 - protein, 17 aa, Entamoeba histolytica
SLAIKYGIDIGGGVIDE

SEQ ID NO: 2701853 - protein, 17 aa, Entamoeba histolytica
SPLEIVEAYNFVRCQSS

SEQ ID NO: 2701854 - protein, 24 aa, Entamoeba histolytica
TNYKSFCNCFKRVKIFKALISLSI

SEQ ID NO: 2701855 - protein, 17 aa, Entamoeba histolytica
VEAYNFVRCQSSWRNPT

SEQ ID NO: 2701856 - protein, 20 aa, Entamoeba histolytica
VVLARPGFRVSRRKRMQDKI

SEQ ID NO: 2701857 - protein, 25 aa, Entamoeba histolytica
AAGEKALLVPILFANAINWGSIFFI

SEQ ID NO: 2701858 - protein, 23 aa, Entamoeba histolytica
DESYRFYQLLLFNFSHFVADEDF

SEQ ID NO: 2701859 - protein, 18 aa, Entamoeba histolytica
EAKRYAAILNRYKVLKAH

SEQ ID NO: 2701860 - protein, 19 aa, Entamoeba histolytica
ESIGQVFIREGWGCLTMNS

SEQ ID NO: 2701861 - protein, 19 aa, Entamoeba histolytica
EWRRMCFCFVINRVNYYLT

SEQ ID NO: 2701862 - protein, 19 aa, Entamoeba histolytica
FNCQWYITVHFDRYICTPI

SEQ ID NO: 2701863 - protein, 17 aa, Entamoeba histolytica
FPSLIFKSSKCVFGGNI

SEQ ID NO: 2701864 - protein, 17 aa, Entamoeba histolytica
FVKLVSWYDNEWGYSNR

SEQ ID NO: 2701865 - protein, 19 aa, Entamoeba histolytica
GKGSFKYAWVLDNLKAERE

SEQ ID NO: 2701866 - protein, 17 aa, Entamoeba histolytica
GLHGWAFTLEKFAKMWS

SEQ ID NO: 2701867 - protein, 20 aa, Entamoeba histolytica
HKEPHMWLRRGLFFCHRDIN

SEQ ID NO: 2701868 - protein, 22 aa, Entamoeba histolytica
HKKKWRMCHSFKDYKKKEMKKA

SEQ ID NO: 2701869 - protein, 21 aa, Entamoeba histolytica
ILFANAINWGSIFFIASNSDD

SEQ ID NO: 2701870 - protein, 20 aa, Entamoeba histolytica
IRMWTCNIFPTLVSSEVKED

SEQ ID NO: 2701871 - protein, 26 aa, Entamoeba histolytica
ITYTFPLSTLMSWGTDSSKTFKNTST

SEQ ID NO: 2701872 - protein, 23 aa, Entamoeba histolytica
KDFSRIFCIQRLVKVSIIDKEGL

SEQ ID NO: 2701873 - protein, 20 aa, Entamoeba histolytica
KLEYCVSCGIHGRVVRVRSR

SEQ ID NO: 2701874 - protein, 17 aa, Entamoeba histolytica
KTKCPINKLTIIESKEV

SEQ ID NO: 2701875 - protein, 17 aa, Entamoeba histolytica
LEPRFIYEGEIFLAAGE

SEQ ID NO: 2701876 - protein, 20 aa, Entamoeba histolytica
LLNPHFVKLVSWYDNEWGYS

SEQ ID NO: 2701877 - protein, 24 aa, Entamoeba histolytica
LPYLCKKLQVPYCIVKGKARLGQL

SEQ ID NO: 2701878 - protein, 22 aa, Entamoeba histolytica
NETRVAWKIAIERTNGPTLLIM

SEQ ID NO: 2701879 - protein, 18 aa, Entamoeba histolytica
NFRVCFIKSISLQVSIDN

SEQ ID NO: 2701880 - protein, 18 aa, Entamoeba histolytica
NVALTRAKRGLIIIGNIP

SEQ ID NO: 2701881 - protein, 18 aa, Entamoeba histolytica
QTPECLRVYVSSFWDQPF

SEQ ID NO: 2701882 - protein, 20 aa, Entamoeba histolytica
RFIYEGEIFLAAGEKALLVP

SEQ ID NO: 2701883 - protein, 19 aa, Entamoeba histolytica
RKVACVGAWHPARVSWTVA

SEQ ID NO: 2701884 - protein, 19 aa, Entamoeba histolytica
RMMYKLGYVDRVMDVLKRR

SEQ ID NO: 2701885 - protein, 18 aa, Entamoeba histolytica
SSKSCLSLKFANNGKLEP

SEQ ID NO: 2701886 - protein, 18 aa, Entamoeba histolytica
TTSSICFNPPTPLTHLDS

SEQ ID NO: 2701887 - protein, 24 aa, Entamoeba histolytica
TYTFPLSTLMSWGTDSSKTFKNTS

SEQ ID NO: 2701888 - protein, 25 aa, Entamoeba histolytica
TYTFPLSTLMSWGTDSSKTFKNTST

SEQ ID NO: 2701889 - protein, 17 aa, Entamoeba histolytica
YEQFKIPILMDVKDLVC

SEQ ID NO: 2701890 - protein, 18 aa, Entamoeba histolytica
YYPGARWGITRRLVASSL

SEQ ID NO: 2701891 - protein, 24 aa, Entamoeba histolytica
ADPQVVYDLCRWIYMHGIEVEGIF

SEQ ID NO: 2701892 - protein, 20 aa, Entamoeba histolytica
AEMLCCVCGALIEVNPSSMC

SEQ ID NO: 2701893 - protein, 17 aa, Entamoeba histolytica
AERADMIVLVFDAHKLD

SEQ ID NO: 2701894 - protein, 19 aa, Entamoeba histolytica
AVGKTCLLLAFSKGEIPTA

SEQ ID NO: 2701895 - protein, 17 aa, Entamoeba histolytica
AVPMVRAGVCFEAVHPC

SEQ ID NO: 2701896 - protein, 24 aa, Entamoeba histolytica
DALHLGHLIPFIFTKYLQDAFDCQ

SEQ ID NO: 2701897 - protein, 22 aa, Entamoeba histolytica
DFSRIFCIQRLVKVSIIDKEGL

SEQ ID NO: 2701898 - protein, 23 aa, Entamoeba histolytica
DHLLRYKFLLAFEREMLHLEDQY

SEQ ID NO: 2701899 - protein, 19 aa, Entamoeba histolytica
DNRPASALPFKISAAKLDA

SEQ ID NO: 2701900 - protein, 17 aa, Entamoeba histolytica
DSPWYLKFNNSAIYDDN

SEQ ID NO: 2701901 - protein, 18 aa, Entamoeba histolytica
DYWSIGCILFEMVCGFPP

SEQ ID NO: 2701902 - protein, 17 aa, Entamoeba histolytica
EDIKIFITQFVKRCVNE

SEQ ID NO: 2701903 - protein, 20 aa, Entamoeba histolytica
ELKAKRYVECTSKDYETTHN

SEQ ID NO: 2701904 - protein, 18 aa, Entamoeba histolytica
EMVCGFPPFLSDDAVQTC

SEQ ID NO: 2701905 - protein, 22 aa, Entamoeba histolytica
EPEVFPGLVYRMASPKVTLLVF

SEQ ID NO: 2701906 - protein, 22 aa, Entamoeba histolytica
EYFRFLWELRLVFNKEMTQLQE

SEQ ID NO: 2701907 - protein, 17 aa, Entamoeba histolytica
FKKFSLQFEDIFVDYSK

SEQ ID NO: 2701908 - protein, 20 aa, Entamoeba histolytica
FLSYGTVCFVKEKLCENDDG

SEQ ID NO: 2701909 - protein, 18 aa, Entamoeba histolytica
FNVVNGLYVSEIEINTPA

SEQ ID NO: 2701910 - protein, 19 aa, Entamoeba histolytica
FSYMPPLRMKTSVIPSYSC

SEQ ID NO: 2701911 - protein, 22 aa, Entamoeba histolytica
GDLPRLLKHLSIVRKTNENEIS

SEQ ID NO: 2701912 - protein, 17 aa, Entamoeba histolytica
GECKFTFKEMQTLNVKR

SEQ ID NO: 2701913 - protein, 20 aa, Entamoeba histolytica
GEKMIKEWIKQPLIDKDKIN

SEQ ID NO: 2701914 - protein, 17 aa, Entamoeba histolytica
GIGWTCYVMIDEVGQET

SEQ ID NO: 2701915 - protein, 25 aa, Entamoeba histolytica
GKVIPNCLGNIWVYVRDWSEEDGRC

SEQ ID NO: 2701916 - protein, 22 aa, Entamoeba histolytica
GYGEMYLDCILRDVRNMFTPIE

SEQ ID NO: 2701917 - protein, 24 aa, Entamoeba histolytica
HCNDFRLTPMWKYLTQLQIKEQFE

SEQ ID NO: 2701918 - protein, 18 aa, Entamoeba histolytica
HPREAIEVFCEIDKTMTE

SEQ ID NO: 2701919 - protein, 17 aa, Entamoeba histolytica
HRGLRHYWGLRVRGQHT

SEQ ID NO: 2701920 - protein, 17 aa, Entamoeba histolytica
HWLPRFGIEVDLIDTSD

SEQ ID NO: 2701921 - protein, 18 aa, Entamoeba histolytica
IDDAFALPYGRYNVEVTQ

SEQ ID NO: 2701922 - protein, 22 aa, Entamoeba histolytica
IERIDIKTGFCFVVCETEEDAK

SEQ ID NO: 2701923 - protein, 21 aa, Entamoeba histolytica
IKDGFKYGCDFVVYKNHPQYC

SEQ ID NO: 2701924 - protein, 21 aa, Entamoeba histolytica
IKDIWKHVCIVWTKCYSLIQQ

SEQ ID NO: 2701925 - protein, 19 aa, Entamoeba histolytica
IKETMLISSHFIKTLSIEE

SEQ ID NO: 2701926 - protein, 18 aa, Entamoeba histolytica
ILKSVYWKLVWQINALTG

SEQ ID NO: 2701927 - protein, 21 aa, Entamoeba histolytica
ILVANAINWGSIFFIASNSDD

SEQ ID NO: 2701928 - protein, 24 aa, Entamoeba histolytica
INELKLQFGDFIPRNVRTQIKDLT

SEQ ID NO: 2701929 - protein, 18 aa, Entamoeba histolytica
ISIKSSQISLCIPSKKNG

SEQ ID NO: 2701930 - protein, 24 aa, Entamoeba histolytica
ISSCLSIALDSCWKLNKEIELIIQ

SEQ ID NO: 2701931 - protein, 20 aa, Entamoeba histolytica
ITEKGNYQYIVFKFNVVNGL

SEQ ID NO: 2701932 - protein, 18 aa, Entamoeba histolytica
IVFWEIFRRVVFGSYTKP

SEQ ID NO: 2701933 - protein, 21 aa, Entamoeba histolytica
KAICCSHGPVLRTHIKENIER

SEQ ID NO: 2701934 - protein, 26 aa, Entamoeba histolytica
KAKVIPDCVSSIWVCCVDKRYENGRN

SEQ ID NO: 2701935 - protein, 21 aa, Entamoeba histolytica
KALLVPILVANAINWGSIFFI

SEQ ID NO: 2701936 - protein, 17 aa, Entamoeba histolytica
KCIDDCFGIFSKYKRLF

SEQ ID NO: 2701937 - protein, 20 aa, Entamoeba histolytica
KEFYPKGAAIVMPKDNNTYT

SEQ ID NO: 2701938 - protein, 21 aa, Entamoeba histolytica
KFPSPRLGLIEVIKGDPAKQN

SEQ ID NO: 2701939 - protein, 19 aa, Entamoeba histolytica
KRCKKFLAGTTWFYCEPES

SEQ ID NO: 2701940 - protein, 20 aa, Entamoeba histolytica
KSSHALRPFYITLLSSKSCL

SEQ ID NO: 2701941 - protein, 23 aa, Entamoeba histolytica
KYDYVCALKVIFKRQLQQYRMEI

SEQ ID NO: 2701942 - protein, 24 aa, Entamoeba histolytica
LANELHCSWCLISAKTGDGVSNVF

SEQ ID NO: 2701943 - protein, 18 aa, Entamoeba histolytica
LDEPAAFAGRIYRMVKLG

SEQ ID NO: 2701944 - protein, 17 aa, Entamoeba histolytica
LELAWSQIQNFLIKVLN

SEQ ID NO: 2701945 - protein, 19 aa, Entamoeba histolytica
LHLEWKRLACEVVNIPTGS

SEQ ID NO: 2701946 - protein, 20 aa, Entamoeba histolytica
LKQKALCLFYERYPEAVSEV

SEQ ID NO: 2701947 - protein, 20 aa, Entamoeba histolytica
LLEKRLQQTLTYLISSHTNI

SEQ ID NO: 2701948 - protein, 18 aa, Entamoeba histolytica
LLRCCSDCANALLYLSQH

SEQ ID NO: 2701949 - protein, 17 aa, Entamoeba histolytica
LMFLRYLFVPFLKHPYI

SEQ ID NO: 2701950 - protein, 18 aa, Entamoeba histolytica
LPLFLGREGKEFKEDGTF

SEQ ID NO: 2701951 - protein, 17 aa, Entamoeba histolytica
LQQTLTYLISSHTNIQQ

SEQ ID NO: 2701952 - protein, 18 aa, Entamoeba histolytica
LYECICLVFLEGAKNDIE

SEQ ID NO: 2701953 - protein, 21 aa, Entamoeba histolytica
MEFKFSVTMFPVFPPEYNFLV

SEQ ID NO: 2701954 - protein, 22 aa, Entamoeba histolytica
NETEPSVDCPFEPNNTEPNKVS

SEQ ID NO: 2701955 - protein, 24 aa, Entamoeba histolytica
NGCRGFGLNVSRTFISQILESLNI

SEQ ID NO: 2701956 - protein, 17 aa, Entamoeba histolytica
NHIWKRRHFPLFSHIVK

SEQ ID NO: 2701957 - protein, 18 aa, Entamoeba histolytica
NKHHLCWTDRRGVHEPNY

SEQ ID NO: 2701958 - protein, 18 aa, Entamoeba histolytica
NLLFLIAHGLMFGPNQTV

SEQ ID NO: 2701959 - protein, 21 aa, Entamoeba histolytica
NQLTFPLCFTIFGATHYSLKN

SEQ ID NO: 2701960 - protein, 17 aa, Entamoeba histolytica
NSTIPKSQPASVIKSRT

SEQ ID NO: 2701961 - protein, 18 aa, Entamoeba histolytica
NTQMSFSRIDPAARAAGI

SEQ ID NO: 2701962 - protein, 21 aa, Entamoeba histolytica
NYQYIVFKFNVVNGLYVSEIE

SEQ ID NO: 2701963 - protein, 19 aa, Entamoeba histolytica
PAEMGHVWVIPKDCQIGQE

SEQ ID NO: 2701964 - protein, 20 aa, Entamoeba histolytica
PIKHPELFESLGIAQPKGVL

SEQ ID NO: 2701965 - protein, 17 aa, Entamoeba histolytica
PNYPYFAQLCESYNQCL

SEQ ID NO: 2701966 - protein, 20 aa, Entamoeba histolytica
PPKRSRRTPIRMKKDDDDLS

SEQ ID NO: 2701967 - protein, 17 aa, Entamoeba histolytica
PPNKRWGALLPVGLIPP

SEQ ID NO: 2701968 - protein, 18 aa, Entamoeba histolytica
PSLLKYEFMWTFSSDDSD

SEQ ID NO: 2701969 - protein, 19 aa, Entamoeba histolytica
PSRCTVCYLRCIFGCIENY

SEQ ID NO: 2701970 - protein, 24 aa, Entamoeba histolytica
PTVKWQVPDTFAFKYKELENELCI

SEQ ID NO: 2701971 - protein, 23 aa, Entamoeba histolytica
QETWRHVLGINVPWCVNCWQRMY

SEQ ID NO: 2701972 - protein, 24 aa, Entamoeba histolytica
QFSNGKWRSEWTISVGSKVTCEGR

SEQ ID NO: 2701973 - protein, 23 aa, Entamoeba histolytica
QMIFKRLFRVYAHIYLHHLNQIT

SEQ ID NO: 2701974 - protein, 17 aa, Entamoeba histolytica
RFFSGHFFKMYDPGIED

SEQ ID NO: 2701975 - protein, 24 aa, Entamoeba histolytica
RFNYKLRLGRGFTLKELRAAKIDK

SEQ ID NO: 2701976 - protein, 20 aa, Entamoeba histolytica
RKIGKFFCCHGGISPEIKKI

SEQ ID NO: 2701977 - protein, 18 aa, Entamoeba histolytica
RKTVCTMERREKRRSSEI

SEQ ID NO: 2701978 - protein, 19 aa, Entamoeba histolytica
RLKIKLTVEKEVFKNTVIQ

SEQ ID NO: 2701979 - protein, 18 aa, Entamoeba histolytica
RMWTCNIFPTLVSSEVKE

SEQ ID NO: 2701980 - protein, 20 aa, Entamoeba histolytica
RRLSYNSDILWAINTIEKQL

SEQ ID NO: 2701981 - protein, 18 aa, Entamoeba histolytica
RSGKICAICIEKNFNGKS

SEQ ID NO: 2701982 - protein, 17 aa, Entamoeba histolytica
RSMLNHRIDLWKQEANK

SEQ ID NO: 2701983 - protein, 19 aa, Entamoeba histolytica
SICDKIMCRIGAGDNIVEG

SEQ ID NO: 2701984 - protein, 17 aa, Entamoeba histolytica
SIMAAKIVRDAAIAAGA

SEQ ID NO: 2701985 - protein, 19 aa, Entamoeba histolytica
SLKTFQCMRCMKLTKIELP

SEQ ID NO: 2701986 - protein, 19 aa, Entamoeba histolytica
SRLSIGLMWWMLTREILRY

SEQ ID NO: 2701987 - protein, 17 aa, Entamoeba histolytica
SSFKVCIDFGRMIENHR

SEQ ID NO: 2701988 - protein, 18 aa, Entamoeba histolytica
TEHKAGVYSVTWGSDSKT

SEQ ID NO: 2701989 - protein, 17 aa, Entamoeba histolytica
TKLFPSLIFKSSKCVFG

SEQ ID NO: 2701990 - protein, 18 aa, Entamoeba histolytica
TKLFPSLIFKSSKCVFGG

SEQ ID NO: 2701991 - protein, 17 aa, Entamoeba histolytica
TKLPLFLGREGKEFKED

SEQ ID NO: 2701992 - protein, 23 aa, Entamoeba histolytica
TLDELHFWPSFYLHAVLFNKTDP

SEQ ID NO: 2701993 - protein, 22 aa, Entamoeba histolytica
TLEQRIRGAIGFDSQIFGQNMW

SEQ ID NO: 2701994 - protein, 24 aa, Entamoeba histolytica
TQRPKGCGFVKFMTHEDAKLCVEE

SEQ ID NO: 2701995 - protein, 18 aa, Entamoeba histolytica
TRKLFKRPFRGHGLSNTS

SEQ ID NO: 2701996 - protein, 18 aa, Entamoeba histolytica
TSTFCGTAAYLAPEILLG

SEQ ID NO: 2701997 - protein, 23 aa, Entamoeba histolytica
VEDKLRVGLLYALKYEDKAQDII

SEQ ID NO: 2701998 - protein, 17 aa, Entamoeba histolytica
VFNLCWWIYTYGYLVEG

SEQ ID NO: 2701999 - protein, 24 aa, Entamoeba histolytica
VIMKLCGWIIGRACLVLPSLYLGL

SEQ ID NO: 2702000 - protein, 21 aa, Entamoeba histolytica
VNCLKLKLLDEGKLLTRMIEK

SEQ ID NO: 2702001 - protein, 17 aa, Entamoeba histolytica
VRCAKYLYTYICADKAK

SEQ ID NO: 2702002 - protein, 19 aa, Entamoeba histolytica
VSKERLLSFMFKRKTNEKT

SEQ ID NO: 2702003 - protein, 18 aa, Entamoeba histolytica
VSLFTHWLPRFGIEVDLI

SEQ ID NO: 2702004 - protein, 19 aa, Entamoeba histolytica
WKRRHFPLFSHIVKTMDLR

SEQ ID NO: 2702005 - protein, 19 aa, Entamoeba histolytica
YHRVLEFLLIFLVNLNDSI

SEQ ID NO: 2702006 - protein, 18 aa, Entamoeba histolytica
YLTYIIETCVPFLESITC

SEQ ID NO: 2702007 - protein, 18 aa, Entamoeba histolytica
YNEFHVFESLFSLFENYL

SEQ ID NO: 2702008 - protein, 18 aa, Entamoeba histolytica
YVEKEKKEQLGLKHPNDL

SEQ ID NO: 2702009 - protein, 20 aa, Entamoeba histolytica
AAQICIKFSIASGHSVIPKS

SEQ ID NO: 2702010 - protein, 18 aa, Entamoeba histolytica
AAYVRFLMKLFRILGRSE

SEQ ID NO: 2702011 - protein, 18 aa, Entamoeba histolytica
ACPITACRVRFCISAAHT

SEQ ID NO: 2702012 - protein, 17 aa, Entamoeba histolytica
ACPTIRCISLPKEIEKG

SEQ ID NO: 2702013 - protein, 17 aa, Entamoeba histolytica
ACVLKFYLAPKFDEEDE

SEQ ID NO: 2702014 - protein, 17 aa, Entamoeba histolytica
ADGCGWGVTSARAAHIA

SEQ ID NO: 2702015 - protein, 17 aa, Entamoeba histolytica
ADGKSKCTILYSHDSTE

SEQ ID NO: 2702016 - protein, 17 aa, Entamoeba histolytica
ADISGAVIFSGLLEISV

SEQ ID NO: 2702017 - protein, 24 aa, Entamoeba histolytica
ADKIWNIRFIKGLTWGRIFEDKES

SEQ ID NO: 2702018 - protein, 18 aa, Entamoeba histolytica
ADNKFCFDCGKGGATFVV

SEQ ID NO: 2702019 - protein, 24 aa, Entamoeba histolytica
ADPRLPKPLFAWNLPKGYESVLKK

SEQ ID NO: 2702020 - protein, 19 aa, Entamoeba histolytica
ADQLECAQVLFDHVRMSYN

SEQ ID NO: 2702021 - protein, 24 aa, Entamoeba histolytica
ADRLLKQICHFICYYIIEEMLKRN

SEQ ID NO: 2702022 - protein, 18 aa, Entamoeba histolytica
ADVWSAGVVFFVMATKEY

SEQ ID NO: 2702023 - protein, 18 aa, Entamoeba histolytica
AECGQPLGPQRITALGRS

SEQ ID NO: 2702024 - protein, 24 aa, Entamoeba histolytica
AEEIWKFAQMFSEFEIENHENGCD

SEQ ID NO: 2702025 - protein, 19 aa, Entamoeba histolytica
AEELWNYVELFASLDLENG

SEQ ID NO: 2702026 - protein, 23 aa, Entamoeba histolytica
AEFEYCVLFPFNVLKMTNTKVMI

SEQ ID NO: 2702027 - protein, 18 aa, Entamoeba histolytica
AEFMFRQCCEVPIMKKTA

SEQ ID NO: 2702028 - protein, 23 aa, Entamoeba histolytica
AEGIPICEWPMWINSQIEHTEIR

SEQ ID NO: 2702029 - protein, 20 aa, Entamoeba histolytica
AEIRLSYGWVECVGHADRGD

SEQ ID NO: 2702030 - protein, 19 aa, Entamoeba histolytica
AEKALKCSQIEVINQNNID

SEQ ID NO: 2702031 - protein, 23 aa, Entamoeba histolytica
AEKLRPLYWNRIVIDMNNDKSIW

SEQ ID NO: 2702032 - protein, 17 aa, Entamoeba histolytica
AELYWTPGVLRQAEDRV

SEQ ID NO: 2702033 - protein, 18 aa, Entamoeba histolytica
AEMAKYLLEIRDIIRENN

SEQ ID NO: 2702034 - protein, 23 aa, Entamoeba histolytica
AENIYRVVLYFARSLENENTSDE

SEQ ID NO: 2702035 - protein, 21 aa, Entamoeba histolytica
AESLRPVLGFDLLEYLSKLPI

SEQ ID NO: 2702036 - protein, 17 aa, Entamoeba histolytica
AFAGMISKIVKRRLLLM

SEQ ID NO: 2702037 - protein, 20 aa, Entamoeba histolytica
AFCRRYVDKIGFAKWQMPFK

SEQ ID NO: 2702038 - protein, 20 aa, Entamoeba histolytica
AFCSGCDFIRAEGFVFGHVA

SEQ ID NO: 2702039 - protein, 27 aa, Entamoeba histolytica
AFDLANHFCEWCGFDCNWDSYPNEETQ

SEQ ID NO: 2702040 - protein, 18 aa, Entamoeba histolytica
AFEPFDFNKFEEVKPVPQ

SEQ ID NO: 2702041 - protein, 23 aa, Entamoeba histolytica
AFKAKEYRLVYKLLHDLIQTNHV

SEQ ID NO: 2702042 - protein, 17 aa, Entamoeba histolytica
AFLQILIPFEWQGVLIP

SEQ ID NO: 2702043 - protein, 21 aa, Entamoeba histolytica
AFLSYGTVCFVKEKLCENDDG

SEQ ID NO: 2702044 - protein, 18 aa, Entamoeba histolytica
AFNLPVIISKGILKTLEV

SEQ ID NO: 2702045 - protein, 20 aa, Entamoeba histolytica
AFPNLRLVGISAYANLFESC

SEQ ID NO: 2702046 - protein, 19 aa, Entamoeba histolytica
AGDVIKILSKEGDWWIGEL

SEQ ID NO: 2702047 - protein, 17 aa, Entamoeba histolytica
AGKWPFWLSPRQVMVCT

SEQ ID NO: 2702048 - protein, 19 aa, Entamoeba histolytica
AHCQARFALFKAVEKSGAV

SEQ ID NO: 2702049 - protein, 17 aa, Entamoeba histolytica
AHRACMKYCKPGMYEFE

SEQ ID NO: 2702050 - protein, 20 aa, Entamoeba histolytica
AHRFCVCPNPAFAQQLQKYK

SEQ ID NO: 2702051 - protein, 20 aa, Entamoeba histolytica
AIEYAPLWLPQSIQKCQLCG

SEQ ID NO: 2702052 - protein, 18 aa, Entamoeba histolytica
AIEYKTKILFIFETKSGV

SEQ ID NO: 2702053 - protein, 20 aa, Entamoeba histolytica
AIMYCFRYAFSLLDEGEQNN

SEQ ID NO: 2702054 - protein, 24 aa, Entamoeba histolytica
AIPKFKVIMKLAIEKVRLKGLMLL

SEQ ID NO: 2702055 - protein, 17 aa, Entamoeba histolytica
AITNIGLIDCFVSMARC

SEQ ID NO: 2702056 - protein, 20 aa, Entamoeba histolytica
AKDMYLLYFWQGRSCAVIDK

SEQ ID NO: 2702057 - protein, 24 aa, Entamoeba histolytica
AKELKRRVPLLIGEVWFGGCERRI

SEQ ID NO: 2702058 - protein, 21 aa, Entamoeba histolytica
AKEPRFSLAINEGNEGSRLSH

SEQ ID NO: 2702059 - protein, 19 aa, Entamoeba histolytica
AKFCTNCGVLVKSTSSNNL

SEQ ID NO: 2702060 - protein, 19 aa, Entamoeba histolytica
AKHPVCLYVSGSNTQVIAF

SEQ ID NO: 2702061 - protein, 25 aa, Entamoeba histolytica
AKIYSCKSCGFIMFAIPKKGLEKKF

SEQ ID NO: 2702062 - protein, 18 aa, Entamoeba histolytica
AKKFKPTLVFGVPRFYEK

SEQ ID NO: 2702063 - protein, 26 aa, Entamoeba histolytica
AKLFKPRHLFCGYYIFIEFIVTSSSL

SEQ ID NO: 2702064 - protein, 19 aa, Entamoeba histolytica
AKPDMSTFVFVRILTNVDN

SEQ ID NO: 2702065 - protein, 21 aa, Entamoeba histolytica
AKPRGAIGYQFMKETIKLLTL

SEQ ID NO: 2702066 - protein, 19 aa, Entamoeba histolytica
AKSMLRMVQEFRQKRICGQ

SEQ ID NO: 2702067 - protein, 17 aa, Entamoeba histolytica
AKTKNKRCCVSRLSELY

SEQ ID NO: 2702068 - protein, 23 aa, Entamoeba histolytica
AKYKYLQLCMTLRSYGMNIYHGG

SEQ ID NO: 2702069 - protein, 21 aa, Entamoeba histolytica
ALAAKCVFKLLKVLESGKMKE

SEQ ID NO: 2702070 - protein, 17 aa, Entamoeba histolytica
ALCLLFVKGEFNIEYNP

SEQ ID NO: 2702071 - protein, 18 aa, Entamoeba histolytica
ALELGTIIMKRIIKEDKT

SEQ ID NO: 2702072 - protein, 23 aa, Entamoeba histolytica
ALFKCSLGSFLLCHGGISPKLNV

SEQ ID NO: 2702073 - protein, 20 aa, Entamoeba histolytica
ALKEMKCPRLLQPHQITGLD

SEQ ID NO: 2702074 - protein, 23 aa, Entamoeba histolytica
ALKHPFCCLSVLNLLVALRQHTF

SEQ ID NO: 2702075 - protein, 22 aa, Entamoeba histolytica
ALMLKLKTMRAASNYDANEDDD

SEQ ID NO: 2702076 - protein, 19 aa, Entamoeba histolytica
ALNALRLLLVFGDENDLDT

SEQ ID NO: 2702077 - protein, 18 aa, Entamoeba histolytica
ALNFIKFLKEMVVYIKQY

SEQ ID NO: 2702078 - protein, 25 aa, Entamoeba histolytica
ALTNMCHLHGWKLDSSYTIPTQIVL

SEQ ID NO: 2702079 - protein, 18 aa, Entamoeba histolytica
ALVGFQFNVVESTIGTRR

SEQ ID NO: 2702080 - protein, 19 aa, Entamoeba histolytica
AMEKGYCCKVTRFPQSGDS

SEQ ID NO: 2702081 - protein, 24 aa, Entamoeba histolytica
AMFPCSHCFHILCIKKEFAQHPTP

SEQ ID NO: 2702082 - protein, 24 aa, Entamoeba histolytica
AMLVDGICSIYCSKGIYHICGYCD

SEQ ID NO: 2702083 - protein, 24 aa, Entamoeba histolytica
AMRFLQDILIEFGYFVEVEIETID

SEQ ID NO: 2702084 - protein, 20 aa, Entamoeba histolytica
AMYNYGLCFYKGFGNLKKNQ

SEQ ID NO: 2702085 - protein, 18 aa, Entamoeba histolytica
ANEVFKIFSQYLKTHTLT

SEQ ID NO: 2702086 - protein, 17 aa, Entamoeba histolytica
ANFLAVALKTRTAEKSS

SEQ ID NO: 2702087 - protein, 19 aa, Entamoeba histolytica
ANGVIPLFKIMGAFEQHVE

SEQ ID NO: 2702088 - protein, 23 aa, Entamoeba histolytica
ANKFCCREFYGVLSFNIKSQYQL

SEQ ID NO: 2702089 - protein, 18 aa, Entamoeba histolytica
APHDGAFCDLLWSDPEPE

SEQ ID NO: 2702090 - protein, 19 aa, Entamoeba histolytica
APHFCDYVWRDLLGNKTFL

SEQ ID NO: 2702091 - protein, 23 aa, Entamoeba histolytica
APHKCPVCNALIYSPFTICDIVI

SEQ ID NO: 2702092 - protein, 25 aa, Entamoeba histolytica
APKCSCIRSGVFAFKTTQDAVICVS

SEQ ID NO: 2702093 - protein, 22 aa, Entamoeba histolytica
APLPIEFKWKIPITKKKTGLFS

SEQ ID NO: 2702094 - protein, 19 aa, Entamoeba histolytica
APPRLRSIPDLGFVDSEIP

SEQ ID NO: 2702095 - protein, 22 aa, Entamoeba histolytica
APQWLMKRLNLVDGDYIDLQTV

SEQ ID NO: 2702096 - protein, 18 aa, Entamoeba histolytica
AQEIFKIYPSVIVHLLDK

SEQ ID NO: 2702097 - protein, 19 aa, Entamoeba histolytica
AQICIKFSIASGHSVIPKS

SEQ ID NO: 2702098 - protein, 18 aa, Entamoeba histolytica
AQVKFPFELSPPIQKLTF

SEQ ID NO: 2702099 - protein, 21 aa, Entamoeba histolytica
ARAEIYYVQMLKEIEFLVGTD

SEQ ID NO: 2702100 - protein, 20 aa, Entamoeba histolytica
ARAPKSCAVFETMKYTEEII

SEQ ID NO: 2702101 - protein, 17 aa, Entamoeba histolytica
ARASIVWVIGEYSQMVP

SEQ ID NO: 2702102 - protein, 20 aa, Entamoeba histolytica
ARFYNCPTLKTLSIKEAEVV

SEQ ID NO: 2702103 - protein, 19 aa, Entamoeba histolytica
ARGAAPCVLFFDELDSIAQ

SEQ ID NO: 2702104 - protein, 18 aa, Entamoeba histolytica
ARGPSIVKMYSFLTNQLL

SEQ ID NO: 2702105 - protein, 17 aa, Entamoeba histolytica
ARRLTVRKVSTGFSEEK

SEQ ID NO: 2702106 - protein, 18 aa, Entamoeba histolytica
ARSLKWLCQCIYYNELII

SEQ ID NO: 2702107 - protein, 21 aa, Entamoeba histolytica
ARSLWIWRKCKSYLFDDFKDI

SEQ ID NO: 2702108 - protein, 18 aa, Entamoeba histolytica
ARVCIACKLCINILIITN

SEQ ID NO: 2702109 - protein, 19 aa, Entamoeba histolytica
ARVSILAFQFFKQVYKLFE

SEQ ID NO: 2702110 - protein, 17 aa, Entamoeba histolytica
ASCFAHWFQPLSQTTAR

SEQ ID NO: 2702111 - protein, 17 aa, Entamoeba histolytica
ASCLLKLKDYAGAVEAA

SEQ ID NO: 2702112 - protein, 18 aa, Entamoeba histolytica
ASIAAMLDCEWIKKNSVY

SEQ ID NO: 2702113 - protein, 17 aa, Entamoeba histolytica
ASISGLWISILLAIRTG

SEQ ID NO: 2702114 - protein, 27 aa, Entamoeba histolytica
ASKKKSGWRFPLPIYRSIEYLKKHGGV

SEQ ID NO: 2702115 - protein, 21 aa, Entamoeba histolytica
ASQFPNCFANILSKNPQQSIE

SEQ ID NO: 2702116 - protein, 19 aa, Entamoeba histolytica
ASVELRLAKILVEPFNSLL

SEQ ID NO: 2702117 - protein, 18 aa, Entamoeba histolytica
ASVILLRYFNPIGAHKSG

SEQ ID NO: 2702118 - protein, 21 aa, Entamoeba histolytica
ASWKIECFWLSSRRNCYIKGG

SEQ ID NO: 2702119 - protein, 24 aa, Entamoeba histolytica
ATELSQRCSMEWAKDEYEENKLQE

SEQ ID NO: 2702120 - protein, 21 aa, Entamoeba histolytica
ATFYPRLHIIHSFINSDNKET

SEQ ID NO: 2702121 - protein, 18 aa, Entamoeba histolytica
ATLYPEWVCASVGNQIQA

SEQ ID NO: 2702122 - protein, 25 aa, Entamoeba histolytica
ATNRSCLSCLISVRDIHLLTCGDLG

SEQ ID NO: 2702123 - protein, 19 aa, Entamoeba histolytica
ATPLLIQWTYQAMIHEFLG

SEQ ID NO: 2702124 - protein, 18 aa, Entamoeba histolytica
ATRIKLLLNELNKQMSVY

SEQ ID NO: 2702125 - protein, 17 aa, Entamoeba histolytica
ATRISMCLLPKKTCVKQ

SEQ ID NO: 2702126 - protein, 18 aa, Entamoeba histolytica
ATTFQKRRHGLIKKAMEL

SEQ ID NO: 2702127 - protein, 26 aa, Entamoeba histolytica
ATTMCPKCRELLCEECLMKGIKENGC

SEQ ID NO: 2702128 - protein, 22 aa, Entamoeba histolytica
ATVDPCRFMGCGPSSSTTSGYR

SEQ ID NO: 2702129 - protein, 17 aa, Entamoeba histolytica
ATVRPSLLLARNQLEQK

SEQ ID NO: 2702130 - protein, 18 aa, Entamoeba histolytica
AVARIFSILCSFKPYPIV

SEQ ID NO: 2702131 - protein, 21 aa, Entamoeba histolytica
AVEILRINPLFSIKPPIGPKD

SEQ ID NO: 2702132 - protein, 17 aa, Entamoeba histolytica
AVESLRYNPGFCGCDEI

SEQ ID NO: 2702133 - protein, 18 aa, Entamoeba histolytica
AVGCPWTPFDLSTTPLAS

SEQ ID NO: 2702134 - protein, 17 aa, Entamoeba histolytica
AVIRGWRGGILCNIAIE

SEQ ID NO: 2702135 - protein, 18 aa, Entamoeba histolytica
AVLCVLKLYCMDPVNIEQ

SEQ ID NO: 2702136 - protein, 18 aa, Entamoeba histolytica
AYCRKLKCSITEDVQDIV

SEQ ID NO: 2702137 - protein, 20 aa, Entamoeba histolytica
AYIVPRSRFLPVKACNDLFI

SEQ ID NO: 2702138 - protein, 22 aa, Entamoeba histolytica
AYNRRAIIFLQNYNKFRDANEK

SEQ ID NO: 2702139 - protein, 18 aa, Entamoeba histolytica
AYPFCLPASLSLPKKNYS

SEQ ID NO: 2702140 - protein, 20 aa, Entamoeba histolytica
AYPFCLPVPLSLPKKNYNKL

SEQ ID NO: 2702141 - protein, 18 aa, Entamoeba histolytica
AYRKLALKWHPDRNPNNK

SEQ ID NO: 2702142 - protein, 17 aa, Entamoeba histolytica
CAFFFKIGACRHGDSCT

SEQ ID NO: 2702143 - protein, 17 aa, Entamoeba histolytica
CAICIEKSFNGKSEYIT

SEQ ID NO: 2702144 - protein, 20 aa, Entamoeba histolytica
CASLALKITKIWMQKSINKE

SEQ ID NO: 2702145 - protein, 20 aa, Entamoeba histolytica
CAWYLNNTCCVWSIESSQII

SEQ ID NO: 2702146 - protein, 20 aa, Entamoeba histolytica
CCLKTGIIYTNWLKTGIVII

SEQ ID NO: 2702147 - protein, 18 aa, Entamoeba histolytica
CCYKCKQPLTLEEIKLKR

SEQ ID NO: 2702148 - protein, 22 aa, Entamoeba histolytica
CDAQCVKYGLAMIEGGTTGTKG

SEQ ID NO: 2702149 - protein, 19 aa, Entamoeba histolytica
CDEISRLGSVPVFVSNWHD

SEQ ID NO: 2702150 - protein, 19 aa, Entamoeba histolytica
CDYVLFFLIRCEPYTTMFI

SEQ ID NO: 2702151 - protein, 19 aa, Entamoeba histolytica
CDYWSVGCILFEMLAGYPP

SEQ ID NO: 2702152 - protein, 25 aa, Entamoeba histolytica
CEHLCKFCKLLPIEVNEVMMKYLSK

SEQ ID NO: 2702153 - protein, 17 aa, Entamoeba histolytica
CELFRIDLFGSIVYSIL

SEQ ID NO: 2702154 - protein, 19 aa, Entamoeba histolytica
CESRNRLIILLPWLEQRLS

SEQ ID NO: 2702155 - protein, 17 aa, Entamoeba histolytica
CEYYCLRDVLVLREGFL

SEQ ID NO: 2702156 - protein, 20 aa, Entamoeba histolytica
CFISKLIIRRCKFIEGILLP

SEQ ID NO: 2702157 - protein, 19 aa, Entamoeba histolytica
CFLCLKCGMIHKNFLKKLG

SEQ ID NO: 2702158 - protein, 18 aa, Entamoeba histolytica
CFNCGKPGHMSRECPEPR

SEQ ID NO: 2702159 - protein, 25 aa, Entamoeba histolytica
CFPLLIEIAMNWKLKIYDSILQIIQ

SEQ ID NO: 2702160 - protein, 18 aa, Entamoeba histolytica
CFSCCYIAGEIKCSSEIM

SEQ ID NO: 2702161 - protein, 18 aa, Entamoeba histolytica
CFWVASLILSFPDLNNRA

SEQ ID NO: 2702162 - protein, 21 aa, Entamoeba histolytica
CGAKQSYKHIFGISKQAKDLR

SEQ ID NO: 2702163 - protein, 18 aa, Entamoeba histolytica
CGANIYPGHGMMFVRNDA

SEQ ID NO: 2702164 - protein, 20 aa, Entamoeba histolytica
CGCFPRRHFDNFIKVCPINA

SEQ ID NO: 2702165 - protein, 17 aa, Entamoeba histolytica
CGEGIGFELGYGMDSED

SEQ ID NO: 2702166 - protein, 17 aa, Entamoeba histolytica
CGFDEMLKIIKIETFVA

SEQ ID NO: 2702167 - protein, 18 aa, Entamoeba histolytica
CGFHRVIKDFMIQGGDFT

SEQ ID NO: 2702168 - protein, 17 aa, Entamoeba histolytica
CGGRIGPFIDHLYPDLR

SEQ ID NO: 2702169 - protein, 21 aa, Entamoeba histolytica
CGKIWRMRACCVIYVNFANKK

SEQ ID NO: 2702170 - protein, 21 aa, Entamoeba histolytica
CGKYKLEVCFVKESSAVNITE

SEQ ID NO: 2702171 - protein, 18 aa, Entamoeba histolytica
CGPSFHFKLFNLMKPKDI

SEQ ID NO: 2702172 - protein, 17 aa, Entamoeba histolytica
CGSFGASLFSAWMKTSS

SEQ ID NO: 2702173 - protein, 17 aa, Entamoeba histolytica
CGTEFFQYYAGMYDQFK

SEQ ID NO: 2702174 - protein, 17 aa, Entamoeba histolytica
CGVTLCGGAHAVGHELT

SEQ ID NO: 2702175 - protein, 18 aa, Entamoeba histolytica
CGVWGELCSVYCNEIKQV

SEQ ID NO: 2702176 - protein, 25 aa, Entamoeba histolytica
CHCCCYRCLSCFRIMLGDVKGDVNR

SEQ ID NO: 2702177 - protein, 21 aa, Entamoeba histolytica
CHCVECLYWLAPEVIETSTFE

SEQ ID NO: 2702178 - protein, 17 aa, Entamoeba histolytica
CHGYWPELFCCQDGVVL

SEQ ID NO: 2702179 - protein, 21 aa, Entamoeba histolytica
CHRVFRVVFELIYQCNSEKHL

SEQ ID NO: 2702180 - protein, 23 aa, Entamoeba histolytica
CIAAEFFLGIPLFAGTSEYNLLF

SEQ ID NO: 2702181 - protein, 25 aa, Entamoeba histolytica
CIDLSLPVQFCLPKVFKLTNMITDT

SEQ ID NO: 2702182 - protein, 20 aa, Entamoeba histolytica
CIECIPSDFWQRLGDLNDTI

SEQ ID NO: 2702183 - protein, 21 aa, Entamoeba histolytica
CIELLMKCWIIYDLDKGYQQG

SEQ ID NO: 2702184 - protein, 25 aa, Entamoeba histolytica
CIHCGLCVCNGCYRGRFIFNGVNKR

SEQ ID NO: 2702185 - protein, 17 aa, Entamoeba histolytica
CIIKRKYIRKQFVVPSD

SEQ ID NO: 2702186 - protein, 22 aa, Entamoeba histolytica
CIKTKRFADALVMTENNKEMHS

SEQ ID NO: 2702187 - protein, 18 aa, Entamoeba histolytica
CILAEMFLGKPLFPGSST

SEQ ID NO: 2702188 - protein, 18 aa, Entamoeba histolytica
CKAPFPRGQFYNLDGKPV

SEQ ID NO: 2702189 - protein, 19 aa, Entamoeba histolytica
CKCGYQFCWLCGVKYSSDH

SEQ ID NO: 2702190 - protein, 23 aa, Entamoeba histolytica
CKEIVWTPSMRRLFCLIIECMKH

SEQ ID NO: 2702191 - protein, 22 aa, Entamoeba histolytica
CKEKISGKFAWRENGFICGNCV

SEQ ID NO: 2702192 - protein, 24 aa, Entamoeba histolytica
CKEVPKSFIFCIGNFGGILDLYKS

SEQ ID NO: 2702193 - protein, 18 aa, Entamoeba histolytica
CKGARFYNCPTLKTLSIK

SEQ ID NO: 2702194 - protein, 17 aa, Entamoeba histolytica
CKISEIFIHEWIKDNLC

SEQ ID NO: 2702195 - protein, 17 aa, Entamoeba histolytica
CKLFLTRLFELIHFPSL

SEQ ID NO: 2702196 - protein, 19 aa, Entamoeba histolytica
CKLLEEFPENEMLVKINSI

SEQ ID NO: 2702197 - protein, 18 aa, Entamoeba histolytica
CKLLESLFIPSSVQSYGS

SEQ ID NO: 2702198 - protein, 17 aa, Entamoeba histolytica
CKLNELELVFGTDCSMI

SEQ ID NO: 2702199 - protein, 18 aa, Entamoeba histolytica
CKMDCTIPLILDSYSLVK

SEQ ID NO: 2702200 - protein, 25 aa, Entamoeba histolytica
CKRRKCIRASIVFSEYQKICKLQLV

SEQ ID NO: 2702201 - protein, 17 aa, Entamoeba histolytica
CKRYMKYLMKKYLKKNN

SEQ ID NO: 2702202 - protein, 24 aa, Entamoeba histolytica
CKSFSFKRFVKFDCVLIDVQKEEN

SEQ ID NO: 2702203 - protein, 18 aa, Entamoeba histolytica
CLCQQLVPFLGYFELPYS

SEQ ID NO: 2702204 - protein, 18 aa, Entamoeba histolytica
CLFTVFPSVHILKEEKGI

SEQ ID NO: 2702205 - protein, 24 aa, Entamoeba histolytica
CLKSGWRYPVPFFRSIQYLRYNGG

SEQ ID NO: 2702206 - protein, 19 aa, Entamoeba histolytica
CLLHCNLHFGKFYDFFDHI

SEQ ID NO: 2702207 - protein, 27 aa, Entamoeba histolytica
CLLIYKFMYCGAPYKVYGCYDEKFNVF

SEQ ID NO: 2702208 - protein, 17 aa, Entamoeba histolytica
CLLKMVLIDSVKFFPHQ

SEQ ID NO: 2702209 - protein, 24 aa, Entamoeba histolytica
CLMGRIGVLIPFNFREDVEFFSKL

SEQ ID NO: 2702210 - protein, 19 aa, Entamoeba histolytica
CLRKILYMNANFFVICYSI

SEQ ID NO: 2702211 - protein, 19 aa, Entamoeba histolytica
CLRKSLYMDANFFVICYSI

SEQ ID NO: 2702212 - protein, 23 aa, Entamoeba histolytica
CLSKRFKKGFLIYYYREMIYSKR

SEQ ID NO: 2702213 - protein, 19 aa, Entamoeba histolytica
CLSWKQLKKVIGLKVLEKI

SEQ ID NO: 2702214 - protein, 25 aa, Entamoeba histolytica
CLYCAEPNCMRCCPTQLDAKRMVHA

SEQ ID NO: 2702215 - protein, 20 aa, Entamoeba histolytica
CMDCQAIGPVYVVIDFGTFV

SEQ ID NO: 2702216 - protein, 21 aa, Entamoeba histolytica
CMKTKAGEVLKVIEKNVRIGW

SEQ ID NO: 2702217 - protein, 24 aa, Entamoeba histolytica
CMYEKGCYCKGIFRESQNASIRKV

SEQ ID NO: 2702218 - protein, 23 aa, Entamoeba histolytica
CMYNKGCFCKGIFRESSNASIRQ

SEQ ID NO: 2702219 - protein, 17 aa, Entamoeba histolytica
CNARPSVCPCWSVEPKL

SEQ ID NO: 2702220 - protein, 18 aa, Entamoeba histolytica
CNIALFVLRERIRKALQL

SEQ ID NO: 2702221 - protein, 18 aa, Entamoeba histolytica
CNICIWNIPEDCPSGNIH

SEQ ID NO: 2702222 - protein, 17 aa, Entamoeba histolytica
CNISIKQLNTWFANYRS

SEQ ID NO: 2702223 - protein, 17 aa, Entamoeba histolytica
CPCCRKSLNRLASYSSP

SEQ ID NO: 2702224 - protein, 19 aa, Entamoeba histolytica
CPFCSLKFCSLECKEKMNN

SEQ ID NO: 2702225 - protein, 19 aa, Entamoeba histolytica
CPICLKFFKYFIPLSSTIK

SEQ ID NO: 2702226 - protein, 17 aa, Entamoeba histolytica
CPICYKPLPTKEVVIDN

SEQ ID NO: 2702227 - protein, 17 aa, Entamoeba histolytica
CPIDCRSDLFGTINLIG

SEQ ID NO: 2702228 - protein, 21 aa, Entamoeba histolytica
CPIVKLKSMRFIKCSSLKSVD

SEQ ID NO: 2702229 - protein, 19 aa, Entamoeba histolytica
CPKCKDTTRKVCYKTNALL

SEQ ID NO: 2702230 - protein, 17 aa, Entamoeba histolytica
CPWLDGKHVVFGQVVEG

SEQ ID NO: 2702231 - protein, 21 aa, Entamoeba histolytica
CPYYYARWATVRSKLILCPYN

SEQ ID NO: 2702232 - protein, 19 aa, Entamoeba histolytica
CQFHLLRLLYYKNLSIPIE

SEQ ID NO: 2702233 - protein, 17 aa, Entamoeba histolytica
CQLFHAIPQPKPRKEGI

SEQ ID NO: 2702234 - protein, 19 aa, Entamoeba histolytica
CQRCKQMLYSHIDLSKTIN

SEQ ID NO: 2702235 - protein, 17 aa, Entamoeba histolytica
CRFPYEFAGGRIHGAIN

SEQ ID NO: 2702236 - protein, 19 aa, Entamoeba histolytica
CRGKLVFKDGMFVGEKGYG

SEQ ID NO: 2702237 - protein, 23 aa, Entamoeba histolytica
CRREIQMLPKLIIRKEEFLRAED

SEQ ID NO: 2702238 - protein, 20 aa, Entamoeba histolytica
CRSMLLSIFSKFTFPEANQI

SEQ ID NO: 2702239 - protein, 18 aa, Entamoeba histolytica
CRSSCAYETVFARNFIGI

SEQ ID NO: 2702240 - protein, 19 aa, Entamoeba histolytica
CRTYLEKHFESFKELDEEQ

SEQ ID NO: 2702241 - protein, 22 aa, Entamoeba histolytica
CSCRRKCLLKYFGETTFKPNKR

SEQ ID NO: 2702242 - protein, 17 aa, Entamoeba histolytica
CSILKYIIEHETINLNK

SEQ ID NO: 2702243 - protein, 26 aa, Entamoeba histolytica
CSIYRLKESWGLLSIDEINLFKQLDS

SEQ ID NO: 2702244 - protein, 18 aa, Entamoeba histolytica
CSLLPINVERVVKNGLEN

SEQ ID NO: 2702245 - protein, 21 aa, Entamoeba histolytica
CSLYYKMVMSIGVEEEEMDFS

SEQ ID NO: 2702246 - protein, 19 aa, Entamoeba histolytica
CSMGQKALASVIIRIALAK

SEQ ID NO: 2702247 - protein, 18 aa, Entamoeba histolytica
CSPAFWKFLDLIGNKIEL

SEQ ID NO: 2702248 - protein, 18 aa, Entamoeba histolytica
CSQFKLKFLNIFEQAANG

SEQ ID NO: 2702249 - protein, 19 aa, Entamoeba histolytica
CSSFKKPKRVISVQRELKE

SEQ ID NO: 2702250 - protein, 17 aa, Entamoeba histolytica
CSYCLNCGAFICDNQEC

SEQ ID NO: 2702251 - protein, 19 aa, Entamoeba histolytica
CSYFEVIIPFLLFADCRLI

SEQ ID NO: 2702252 - protein, 19 aa, Entamoeba histolytica
CTICSIIPFPSIQSIFDKS

SEQ ID NO: 2702253 - protein, 19 aa, Entamoeba histolytica
CTSKCCCFYVSLNHQQLPM

SEQ ID NO: 2702254 - protein, 19 aa, Entamoeba histolytica
CTVALRFIEKVYKIKPLCS

SEQ ID NO: 2702255 - protein, 18 aa, Entamoeba histolytica
CVAAELFLGIPLFPGENE

SEQ ID NO: 2702256 - protein, 17 aa, Entamoeba histolytica
CVHCYKCNQRIYSTSKY

SEQ ID NO: 2702257 - protein, 22 aa, Entamoeba histolytica
CVKWRKGICPWNKGKQTIKGFC

SEQ ID NO: 2702258 - protein, 19 aa, Entamoeba histolytica
CVPPEKYAVALHDYDSSTE

SEQ ID NO: 2702259 - protein, 21 aa, Entamoeba histolytica
CVVCGCPLLFTGHLFDPPEDS

SEQ ID NO: 2702260 - protein, 17 aa, Entamoeba histolytica
CVVVKFLAMNGIIMEKM

SEQ ID NO: 2702261 - protein, 17 aa, Entamoeba histolytica
CVVWRSNIQIVKEGIEQ

SEQ ID NO: 2702262 - protein, 17 aa, Entamoeba histolytica
CWELCKIRCQLAMEDQF

SEQ ID NO: 2702263 - protein, 22 aa, Entamoeba histolytica
CWSTLRLCVEHQFGGVNSQQKK

SEQ ID NO: 2702264 - protein, 17 aa, Entamoeba histolytica
CYACSPKESFYCVIKDG

SEQ ID NO: 2702265 - protein, 19 aa, Entamoeba histolytica
CYERSVIFIDEIDSLLSAR

SEQ ID NO: 2702266 - protein, 19 aa, Entamoeba histolytica
CYFVPELMRLTGMSDDMRA

SEQ ID NO: 2702267 - protein, 22 aa, Entamoeba histolytica
CYGKILAIVIRWVMYRYGKTIE

SEQ ID NO: 2702268 - protein, 19 aa, Entamoeba histolytica
CYGLYFAHCMALPQYKDVV

SEQ ID NO: 2702269 - protein, 20 aa, Entamoeba histolytica
CYLHDFYLLPSFRGQGLGHK

SEQ ID NO: 2702270 - protein, 18 aa, Entamoeba histolytica
CYTFYFKDCQIITLSAYE

SEQ ID NO: 2702271 - protein, 24 aa, Entamoeba histolytica
DAFSHFFLRCNKITIGKGVITELR

SEQ ID NO: 2702272 - protein, 20 aa, Entamoeba histolytica
DAGRCTRPLFTVSNNNGHYT

SEQ ID NO: 2702273 - protein, 24 aa, Entamoeba histolytica
DAIIRLRFVPNFFGSGNFVSILSI

SEQ ID NO: 2702274 - protein, 23 aa, Entamoeba histolytica
DALHLGHLIPFIFTKYLQDAFDC

SEQ ID NO: 2702275 - protein, 20 aa, Entamoeba histolytica
DALKMYKDRVNLLEQQLQEK

SEQ ID NO: 2702276 - protein, 21 aa, Entamoeba histolytica
DALSAYCRYLPPAGTLFQPLV

SEQ ID NO: 2702277 - protein, 20 aa, Entamoeba histolytica
DARTKWHVMNAYTLHREQLD

SEQ ID NO: 2702278 - protein, 19 aa, Entamoeba histolytica
DAVDCWKKCLVILSSVDML

SEQ ID NO: 2702279 - protein, 20 aa, Entamoeba histolytica
DCCLELPLNLILPVLYFAFN

SEQ ID NO: 2702280 - protein, 17 aa, Entamoeba histolytica
DCENEMFLWLGNKCQVK

SEQ ID NO: 2702281 - protein, 19 aa, Entamoeba histolytica
DCIRWKGVLKVEYDKKKDK

SEQ ID NO: 2702282 - protein, 18 aa, Entamoeba histolytica
DCKCCLLEGVLYLARARK

SEQ ID NO: 2702283 - protein, 21 aa, Entamoeba histolytica
DCNRIRFIPSTSFIIIQQSFL

SEQ ID NO: 2702284 - protein, 18 aa, Entamoeba histolytica
DDDFPLKCCQLKFELPKF

SEQ ID NO: 2702285 - protein, 22 aa, Entamoeba histolytica
DDFRKAAAVQIVMLGGEYIGNK

SEQ ID NO: 2702286 - protein, 19 aa, Entamoeba histolytica
DDHPFELFSQFGITQVIQE

SEQ ID NO: 2702287 - protein, 17 aa, Entamoeba histolytica
DDICFCLSRTHSFIQPK

SEQ ID NO: 2702288 - protein, 22 aa, Entamoeba histolytica
DDIRKSALLCFGRTINKIDDLK

SEQ ID NO: 2702289 - protein, 18 aa, Entamoeba histolytica
DDKRTCCFTKSYTKIVEG

SEQ ID NO: 2702290 - protein, 19 aa, Entamoeba histolytica
DDLCQWTKLNAINHIEIIT

SEQ ID NO: 2702291 - protein, 17 aa, Entamoeba histolytica
DDLFKLLLEWCDREEES

SEQ ID NO: 2702292 - protein, 21 aa, Entamoeba histolytica
DDLRQDCLILRAFKLFDNLWR

SEQ ID NO: 2702293 - protein, 22 aa, Entamoeba histolytica
DDYCLYFYLTFFIMKENVFDDN

SEQ ID NO: 2702294 - protein, 17 aa, Entamoeba histolytica
DEAHLIAFMAIRTFFAK

SEQ ID NO: 2702295 - protein, 18 aa, Entamoeba histolytica
DEALRLLQHYPLKNFNDL

SEQ ID NO: 2702296 - protein, 18 aa, Entamoeba histolytica
DEHYCGMSFRGDEKKSIF

SEQ ID NO: 2702297 - protein, 19 aa, Entamoeba histolytica
DEIEIRPGFNFRDSKNQQT

SEQ ID NO: 2702298 - protein, 20 aa, Entamoeba histolytica
DEIIRFGALNAMIDIGKCDE

SEQ ID NO: 2702299 - protein, 20 aa, Entamoeba histolytica
DEIRRYGEFFGMIEENMKKE

SEQ ID NO: 2702300 - protein, 17 aa, Entamoeba histolytica
DEIRVQLPFPLREKYHL

SEQ ID NO: 2702301 - protein, 20 aa, Entamoeba histolytica
DEKCTVCSLIPSGAPTQQSE

SEQ ID NO: 2702302 - protein, 18 aa, Entamoeba histolytica
DELLEWATVCYKAALEFV

SEQ ID NO: 2702303 - protein, 18 aa, Entamoeba histolytica
DELMFKRWTKYINDSVEG

SEQ ID NO: 2702304 - protein, 23 aa, Entamoeba histolytica
DELRTVLMIAPWFPHKSIQQISL

SEQ ID NO: 2702305 - protein, 19 aa, Entamoeba histolytica
DENCGYCHIGVVANIISKE

SEQ ID NO: 2702306 - protein, 19 aa, Entamoeba histolytica
DEPFRWEGCSWEWCWDSVD

SEQ ID NO: 2702307 - protein, 20 aa, Entamoeba histolytica
DETLRLVVFLNNISAEYKKY

SEQ ID NO: 2702308 - protein, 24 aa, Entamoeba histolytica
DEVWFRKRMQVVNVLLPDGSTKKM

SEQ ID NO: 2702309 - protein, 17 aa, Entamoeba histolytica
DEWTSRIDFSFLEHQKK

SEQ ID NO: 2702310 - protein, 23 aa, Entamoeba histolytica
DFCCCSVCKIAYCEQHKNKLEII

SEQ ID NO: 2702311 - protein, 18 aa, Entamoeba histolytica
DFICCLCVSMLVEIKKQL

SEQ ID NO: 2702312 - protein, 18 aa, Entamoeba histolytica
DFIDLLLEKKVEEKEKKP

SEQ ID NO: 2702313 - protein, 18 aa, Entamoeba histolytica
DFIRFCILSFTSLFPQDI

SEQ ID NO: 2702314 - protein, 24 aa, Entamoeba histolytica
DFITACTNIRCAIFNLQRISRFEV

SEQ ID NO: 2702315 - protein, 24 aa, Entamoeba histolytica
DFRFPDEQVRLFALKCLDAMKDYE

SEQ ID NO: 2702316 - protein, 18 aa, Entamoeba histolytica
DGCGWGFRSKKASSNAVS

SEQ ID NO: 2702317 - protein, 22 aa, Entamoeba histolytica
DGDEFPFHISVPIDLPPTIKND

SEQ ID NO: 2702318 - protein, 18 aa, Entamoeba histolytica
DGEGCWWGCVIKGDHVID

SEQ ID NO: 2702319 - protein, 17 aa, Entamoeba histolytica
DGKEFLGYHLRADWEVN

SEQ ID NO: 2702320 - protein, 17 aa, Entamoeba histolytica
DGKEVIGYVFMRKLVSA

SEQ ID NO: 2702321 - protein, 25 aa, Entamoeba histolytica
DGKYWRHIYKSLLLIYYIIINGTPE

SEQ ID NO: 2702322 - protein, 22 aa, Entamoeba histolytica
DGLKLYPCLVIRGTRLYEMWRK

SEQ ID NO: 2702323 - protein, 19 aa, Entamoeba histolytica
DGLRRSMCIKLEMREKFAK

SEQ ID NO: 2702324 - protein, 19 aa, Entamoeba histolytica
DGNCVVCGCYYTHHKYSTY

SEQ ID NO: 2702325 - protein, 18 aa, Entamoeba histolytica
DHPYVLKCCGGFFASPYN

SEQ ID NO: 2702326 - protein, 22 aa, Entamoeba histolytica
DIFKEGKHLFGLHDIVQKGIEI

SEQ ID NO: 2702327 - protein, 26 aa, Entamoeba histolytica
DIGLLLRLILCLSKSLSYDGDKRINI

SEQ ID NO: 2702328 - protein, 19 aa, Entamoeba histolytica
DIIKKKLDEILLQPKDDFL

SEQ ID NO: 2702329 - protein, 17 aa, Entamoeba histolytica
DIILRIGGIIPFCSLLH

SEQ ID NO: 2702330 - protein, 17 aa, Entamoeba histolytica
DIIPHLLTLISLQNIIS

SEQ ID NO: 2702331 - protein, 21 aa, Entamoeba histolytica
DIKHLYKFINIRKLIVIELDS

SEQ ID NO: 2702332 - protein, 20 aa, Entamoeba histolytica
DILDRIKLSLSIDPTNQTIK

SEQ ID NO: 2702333 - protein, 18 aa, Entamoeba histolytica
DILILARCWLKFSYVYSF

SEQ ID NO: 2702334 - protein, 18 aa, Entamoeba histolytica
DILPQGFAPLLFYGLTPG

SEQ ID NO: 2702335 - protein, 18 aa, Entamoeba histolytica
DINWKYVTPRSFISASND

SEQ ID NO: 2702336 - protein, 17 aa, Entamoeba histolytica
DIPFEYYNTLILTKQPS

SEQ ID NO: 2702337 - protein, 19 aa, Entamoeba histolytica
DIQCIPDMYIVGIDSDTTA

SEQ ID NO: 2702338 - protein, 19 aa, Entamoeba histolytica
DIQRYILINAFQFDSGEND

SEQ ID NO: 2702339 - protein, 24 aa, Entamoeba histolytica
DIRIMASLCLLELIQKFDIGVAYQ

SEQ ID NO: 2702340 - protein, 18 aa, Entamoeba histolytica
DISQVFKFKNQIGGFETK

SEQ ID NO: 2702341 - protein, 22 aa, Entamoeba histolytica
DIYEVHGLLPLFTKIYQFVGKE

SEQ ID NO: 2702342 - protein, 23 aa, Entamoeba histolytica
DIYKVGLCLIDFLMENTRIDEFI

SEQ ID NO: 2702343 - protein, 18 aa, Entamoeba histolytica
DKELALFVCKSHRGEVGE

SEQ ID NO: 2702344 - protein, 17 aa, Entamoeba histolytica
DKESFKNVVNWYQETQR

SEQ ID NO: 2702345 - protein, 24 aa, Entamoeba histolytica
DKHGWTLLHYAAWFNKSHICSMLM

SEQ ID NO: 2702346 - protein, 18 aa, Entamoeba histolytica
DKKIKCFFRLEQTLKKKN

SEQ ID NO: 2702347 - protein, 18 aa, Entamoeba histolytica
DKLLINWFKIRSIGNLVK

SEQ ID NO: 2702348 - protein, 20 aa, Entamoeba histolytica
DKQKAAGIIIDWDDNGDEED

SEQ ID NO: 2702349 - protein, 23 aa, Entamoeba histolytica
DKREIGKSISFVWKLILEDGEYE

SEQ ID NO: 2702350 - protein, 27 aa, Entamoeba histolytica
DKRKLKWEVILPFEIPYGFELLTKLIK

SEQ ID NO: 2702351 - protein, 18 aa, Entamoeba histolytica
DKTLINWFKIRGIGNLIK

SEQ ID NO: 2702352 - protein, 18 aa, Entamoeba histolytica
DLAKREGFEFIETSTKSN

SEQ ID NO: 2702353 - protein, 18 aa, Entamoeba histolytica
DLECLTFIRDVWKSSSVR

SEQ ID NO: 2702354 - protein, 24 aa, Entamoeba histolytica
DLFVLPFVCRKFRAALTSEVSNQI

SEQ ID NO: 2702355 - protein, 20 aa, Entamoeba histolytica
DLIELCRLFCLAGASKEKTK

SEQ ID NO: 2702356 - protein, 26 aa, Entamoeba histolytica
DLIELWRCIIKYSLFQLIPWLGICVK

SEQ ID NO: 2702357 - protein, 23 aa, Entamoeba histolytica
DLIKSDFCSFVFSESDNSSESKR

SEQ ID NO: 2702358 - protein, 19 aa, Entamoeba histolytica
DLIYRKIFEIVINMQNKME

SEQ ID NO: 2702359 - protein, 19 aa, Entamoeba histolytica
DLKDGLILIRFLTNLSGKE

SEQ ID NO: 2702360 - protein, 24 aa, Entamoeba histolytica
DLKTEFSDGILFARILNYYKPNII

SEQ ID NO: 2702361 - protein, 20 aa, Entamoeba histolytica
DLKYIYVWIGKKCNDFKKTK

SEQ ID NO: 2702362 - protein, 18 aa, Entamoeba histolytica
DLLKLRYGKELTQDDIQL

SEQ ID NO: 2702363 - protein, 20 aa, Entamoeba histolytica
DLLLLLERLLAFFGSIPPVR

SEQ ID NO: 2702364 - protein, 24 aa, Entamoeba histolytica
DLMEIEICFFKGLEMRSKYQDERQ

SEQ ID NO: 2702365 - protein, 21 aa, Entamoeba histolytica
DLNRTAISFSWLIQLAEQNGI

SEQ ID NO: 2702366 - protein, 18 aa, Entamoeba histolytica
DLPPMNGIKEAYCIVKVG

SEQ ID NO: 2702367 - protein, 18 aa, Entamoeba histolytica
DLPRNCCIQSFLIDTGKD

SEQ ID NO: 2702368 - protein, 22 aa, Entamoeba histolytica
DLPSCVKFSCDFRQSVLELLLW

SEQ ID NO: 2702369 - protein, 18 aa, Entamoeba histolytica
DLTLKHLVDWKVFDKIKS

SEQ ID NO: 2702370 - protein, 18 aa, Entamoeba histolytica
DMKICKKIVKETLTFSYQ

SEQ ID NO: 2702371 - protein, 19 aa, Entamoeba histolytica
DMLDCIELLLPLLSKLLRC

SEQ ID NO: 2702372 - protein, 20 aa, Entamoeba histolytica
DNCVEFWKIMTFITMKYIQI

SEQ ID NO: 2702373 - protein, 21 aa, Entamoeba histolytica
DNDCKRWFWELLQNAKDSIAH

SEQ ID NO: 2702374 - protein, 25 aa, Entamoeba histolytica
DNDFPYDWIASIPIPIQNDIENENL

SEQ ID NO: 2702375 - protein, 17 aa, Entamoeba histolytica
DNFWKIICEEIGNHNPL

SEQ ID NO: 2702376 - protein, 18 aa, Entamoeba histolytica
DNIELLIGFMKRNKVDVR

SEQ ID NO: 2702377 - protein, 23 aa, Entamoeba histolytica
DNIKWIFELAMKFTELEDIQNAV

SEQ ID NO: 2702378 - protein, 21 aa, Entamoeba histolytica
DNLKTKFVYYSRDWEDFLKSN

SEQ ID NO: 2702379 - protein, 17 aa, Entamoeba histolytica
DNRFIISWGQLKVNIDV

SEQ ID NO: 2702380 - protein, 23 aa, Entamoeba histolytica
DNRLECLKRISTVIQMLNYAPIK

SEQ ID NO: 2702381 - protein, 17 aa, Entamoeba histolytica
DPAQCWAEGPGVEGGCK

SEQ ID NO: 2702382 - protein, 22 aa, Entamoeba histolytica
DPFKVLRLHTAAVRAVDVHKIL

SEQ ID NO: 2702383 - protein, 19 aa, Entamoeba histolytica
DPLLFRFLQIFKEIRELSG

SEQ ID NO: 2702384 - protein, 18 aa, Entamoeba histolytica
DPLYCFKCIVEGNIETIE

SEQ ID NO: 2702385 - protein, 24 aa, Entamoeba histolytica
DQIGLKSDELFPFGDTLTTKNDSE

SEQ ID NO: 2702386 - protein, 22 aa, Entamoeba histolytica
DQSRIVGYYGLFPALINLKQSF

SEQ ID NO: 2702387 - protein, 19 aa, Entamoeba histolytica
DRFDPRWLTSHFNSIFLVV

SEQ ID NO: 2702388 - protein, 18 aa, Entamoeba histolytica
DRFFRLNPKLPYQIDLDY

SEQ ID NO: 2702389 - protein, 17 aa, Entamoeba histolytica
DRIKEMIKRGASPYQYY

SEQ ID NO: 2702390 - protein, 23 aa, Entamoeba histolytica
DRIKYKLEIPIMWNEDSNTHEDE

SEQ ID NO: 2702391 - protein, 19 aa, Entamoeba histolytica
DRLLRVGIIDFIRTYTWDK

SEQ ID NO: 2702392 - protein, 20 aa, Entamoeba histolytica
DRLRYSIVMRLLDICSNFNI

SEQ ID NO: 2702393 - protein, 20 aa, Entamoeba histolytica
DRSFVDWLLCKTINGERASL

SEQ ID NO: 2702394 - protein, 17 aa, Entamoeba histolytica
DRTCKKFSVACSRKDMF

SEQ ID NO: 2702395 - protein, 18 aa, Entamoeba histolytica
DSEAYLYLLHHLNNNCSL

SEQ ID NO: 2702396 - protein, 17 aa, Entamoeba histolytica
DSFIFVFKRIRIIMFKD

SEQ ID NO: 2702397 - protein, 22 aa, Entamoeba histolytica
DSIGVICKFCLNNIQPYLLTQL

SEQ ID NO: 2702398 - protein, 17 aa, Entamoeba histolytica
DSLCVYDSYFIFYERIV

SEQ ID NO: 2702399 - protein, 19 aa, Entamoeba histolytica
DSLGNYCFKEFSSLTTINI

SEQ ID NO: 2702400 - protein, 18 aa, Entamoeba histolytica
DSLPRWVVTAAPLNQSTV

SEQ ID NO: 2702401 - protein, 19 aa, Entamoeba histolytica
DSMKCCIKGYVVHKSRINE

SEQ ID NO: 2702402 - protein, 20 aa, Entamoeba histolytica
DSTGKICLCIGKKYMKVVDL

SEQ ID NO: 2702403 - protein, 19 aa, Entamoeba histolytica
DSVLWCYKKDLAFSSNQKK

SEQ ID NO: 2702404 - protein, 23 aa, Entamoeba histolytica
DSWGVAGVLCYLFGTPITKKSMV

SEQ ID NO: 2702405 - protein, 21 aa, Entamoeba histolytica
DSWRLRIGQFITFPNYQRKKL

SEQ ID NO: 2702406 - protein, 34 aa, Entamoeba histolytica
DTIKYRHLWSYILHIIRLFISFSFKNPKLPCFNC

SEQ ID NO: 2702407 - protein, 17 aa, Entamoeba histolytica
DTINCWDISTGVPSKRI

SEQ ID NO: 2702408 - protein, 19 aa, Entamoeba histolytica
DTLKPQGWVCAMQISSVLQ

SEQ ID NO: 2702409 - protein, 23 aa, Entamoeba histolytica
DTLRLLTILFKFGKYYEVEHAIS

SEQ ID NO: 2702410 - protein, 22 aa, Entamoeba histolytica
DTMSRWLLCYGKNMFSIRLLDE

SEQ ID NO: 2702411 - protein, 17 aa, Entamoeba histolytica
DTSTCLLCLVNIIKLST

SEQ ID NO: 2702412 - protein, 20 aa, Entamoeba histolytica
DTVDGLYVWLGSKCSANTKK

SEQ ID NO: 2702413 - protein, 19 aa, Entamoeba histolytica
DTVRFKNEFILGTNGIKVG

SEQ ID NO: 2702414 - protein, 24 aa, Entamoeba histolytica
DTYKGVPAGETWVWYTNPNPRPKT

SEQ ID NO: 2702415 - protein, 20 aa, Entamoeba histolytica
DVALECYNRLKAAYEKRKLE

SEQ ID NO: 2702416 - protein, 18 aa, Entamoeba histolytica
DVGLIVCFLLRYEIFEPY

SEQ ID NO: 2702417 - protein, 23 aa, Entamoeba histolytica
DVGLIVCFLLRYEIFEPYHAFFI

SEQ ID NO: 2702418 - protein, 25 aa, Entamoeba histolytica
DVGRYAVLCALQFSLTLCLPHDTIS

SEQ ID NO: 2702419 - protein, 19 aa, Entamoeba histolytica
DVKISYGLVKKVLEQQALL

SEQ ID NO: 2702420 - protein, 17 aa, Entamoeba histolytica
DVSCPWCYVGRKRMLNA

SEQ ID NO: 2702421 - protein, 18 aa, Entamoeba histolytica
DWNLPNSIRCCADVIQES

SEQ ID NO: 2702422 - protein, 17 aa, Entamoeba histolytica
DYCDLLLIALERSHNKP

SEQ ID NO: 2702423 - protein, 24 aa, Entamoeba histolytica
DYIFCVAHAFGFWKPQLNEGESAY

SEQ ID NO: 2702424 - protein, 22 aa, Entamoeba histolytica
DYKFKLVGVLVHLGTLDSGHYY

SEQ ID NO: 2702425 - protein, 20 aa, Entamoeba histolytica
DYKQCVWLLIGMKDLGGKIR

SEQ ID NO: 2702426 - protein, 18 aa, Entamoeba histolytica
DYLSLLSIENFCLIILKR

SEQ ID NO: 2702427 - protein, 19 aa, Entamoeba histolytica
DYNTAMAFVQSWLNVTSQN

SEQ ID NO: 2702428 - protein, 18 aa, Entamoeba histolytica
DYQLRPNFLITLVEAPSL

SEQ ID NO: 2702429 - protein, 18 aa, Entamoeba histolytica
DYRIEICKNLPPFMFEED

SEQ ID NO: 2702430 - protein, 23 aa, Entamoeba histolytica
DYVRRCIHSMGINQIQIIKVNHH

SEQ ID NO: 2702431 - protein, 19 aa, Entamoeba histolytica
DYYRVCSSEELILKDQERK

SEQ ID NO: 2702432 - protein, 26 aa, Entamoeba histolytica
DYYVIRTNWYWRHQIRIMRFGKEHFY

SEQ ID NO: 2702433 - protein, 20 aa, Entamoeba histolytica
EADKSLGCLLSFGTTTSPGI

SEQ ID NO: 2702434 - protein, 22 aa, Entamoeba histolytica
EAIKRGEGIFDRIDETERRRKL

SEQ ID NO: 2702435 - protein, 23 aa, Entamoeba histolytica
EAKDRFRLLYTFLRKNKNKKTIV

SEQ ID NO: 2702436 - protein, 17 aa, Entamoeba histolytica
EAKIEFCEGTTVENTMV

SEQ ID NO: 2702437 - protein, 17 aa, Entamoeba histolytica
EAKRYAAILNRYKVLKA

SEQ ID NO: 2702438 - protein, 18 aa, Entamoeba histolytica
EAPCAGVAEVLRRYNEIT

SEQ ID NO: 2702439 - protein, 18 aa, Entamoeba histolytica
EATFTWVLPRILDKTQFT

SEQ ID NO: 2702440 - protein, 19 aa, Entamoeba histolytica
EAWRCWKANIPWKVPGLPE

SEQ ID NO: 2702441 - protein, 22 aa, Entamoeba histolytica
ECFDHRFCLHLGEGQWHNEKLR

SEQ ID NO: 2702442 - protein, 19 aa, Entamoeba histolytica
ECIAFKKAIKYFGYTTARG

SEQ ID NO: 2702443 - protein, 17 aa, Entamoeba histolytica
ECLCGMCSLLVSVLMYS

SEQ ID NO: 2702444 - protein, 17 aa, Entamoeba histolytica
ECLLPITCCVAEKVLEQ

SEQ ID NO: 2702445 - protein, 22 aa, Entamoeba histolytica
ECLMNFKWRQGLILTNDIFSIK

SEQ ID NO: 2702446 - protein, 26 aa, Entamoeba histolytica
ECPWKQLKKLALRNCGITKIPPKVFN

SEQ ID NO: 2702447 - protein, 20 aa, Entamoeba histolytica
ECSECKKVFTYRAYQERDMK

SEQ ID NO: 2702448 - protein, 21 aa, Entamoeba histolytica
ECYPISCPIAFSVSQEKGIDH

SEQ ID NO: 2702449 - protein, 17 aa, Entamoeba histolytica
EDCKMALSIRNRISTIG

SEQ ID NO: 2702450 - protein, 25 aa, Entamoeba histolytica
EDDCFRVGVKFGMNGVHFYSNFYES

SEQ ID NO: 2702451 - protein, 17 aa, Entamoeba histolytica
EDFLVLACDGIWDVLGN

SEQ ID NO: 2702452 - protein, 26 aa, Entamoeba histolytica
EDGKNWREIYKSLLVLDNILKNGSEE

SEQ ID NO: 2702453 - protein, 24 aa, Entamoeba histolytica
EDIIKSGVLPLVIPLLAEQDIKTI

SEQ ID NO: 2702454 - protein, 36 aa, Entamoeba histolytica
EDIYRIVKEMIKGTCLEKYLTPEIIKDCKHYEKEEV

SEQ ID NO: 2702455 - protein, 17 aa, Entamoeba histolytica
EDKSGCCEYYFKAKYSD

SEQ ID NO: 2702456 - protein, 18 aa, Entamoeba histolytica
EDLFGVFCIYDITMDKKL

SEQ ID NO: 2702457 - protein, 18 aa, Entamoeba histolytica
EDRIKGINGLREMKEIDI

SEQ ID NO: 2702458 - protein, 19 aa, Entamoeba histolytica
EDWHPYLLFCKVKRDSVVN

SEQ ID NO: 2702459 - protein, 23 aa, Entamoeba histolytica
EDYRCAIVLFQLCVEGLQSLNVN

SEQ ID NO: 2702460 - protein, 18 aa, Entamoeba histolytica
EECRDFRSSLARVRQEEF

SEQ ID NO: 2702461 - protein, 23 aa, Entamoeba histolytica
EEDGLKCGICWDTSSDVVSTACG

SEQ ID NO: 2702462 - protein, 18 aa, Entamoeba histolytica
EEEFPYQIVFGVIQKDPT

SEQ ID NO: 2702463 - protein, 33 aa, Entamoeba histolytica; identical to SEQ ID NO: 2512296

SEQ ID NO: 2702464 - protein, 17 aa, Entamoeba histolytica
EEFTTFCGKNIIFPFNQ

SEQ ID NO: 2702465 - protein, 20 aa, Entamoeba histolytica
EEFVNCFPLRVKALQLINSV

SEQ ID NO: 2702466 - protein, 18 aa, Entamoeba histolytica
EEIFNFIVCPSRPNCDEQ

SEQ ID NO: 2702467 - protein, 24 aa, Entamoeba histolytica
EEIWKKFVEWCMKRTPSIAQSLLQ

SEQ ID NO: 2702468 - protein, 17 aa, Entamoeba histolytica
EEKTGKVVKLWQPSLSD

SEQ ID NO: 2702469 - protein, 24 aa, Entamoeba histolytica
EELKGVAYQSGWFKPVGGILEESL

SEQ ID NO: 2702470 - protein, 26 aa, Entamoeba histolytica
EELKTLFIHLLRLCYKIAQNEKINSM

SEQ ID NO: 2702471 - protein, 21 aa, Entamoeba histolytica
EEMKHIIGFPIDFSNDVVGIH

SEQ ID NO: 2702472 - protein, 21 aa, Entamoeba histolytica
EEMKKFIALLVMKAGTKEKAI

SEQ ID NO: 2702473 - protein, 23 aa, Entamoeba histolytica
EEQYKMPLSWIILKRVVQGRDWH

SEQ ID NO: 2702474 - protein, 19 aa, Entamoeba histolytica
EERCLFCIDILLKYFEILT

SEQ ID NO: 2702475 - protein, 18 aa, Entamoeba histolytica
EESKELLIEIGFNKYAVQ

SEQ ID NO: 2702476 - protein, 17 aa, Entamoeba histolytica
EESRLSGNFKREYEDNG

SEQ ID NO: 2702477 - protein, 26 aa, Entamoeba histolytica
EETRECKDCGFVLMDVDDVKIQDLRP

SEQ ID NO: 2702478 - protein, 20 aa, Entamoeba histolytica
EETRIKILMLLKNITKCNDH

SEQ ID NO: 2702479 - protein, 26 aa, Entamoeba histolytica
EETYNCSFCPFTFCVECYKRLCLTLG

SEQ ID NO: 2702480 - protein, 18 aa, Entamoeba histolytica
EEVIKYAKFISGTVAQQP

SEQ ID NO: 2702481 - protein, 19 aa, Entamoeba histolytica
EEWLNRINPLYPFLQPELQ

SEQ ID NO: 2702482 - protein, 21 aa, Entamoeba histolytica
EFDRLSGLFQRNFGGFRNEVK

SEQ ID NO: 2702483 - protein, 17 aa, Entamoeba histolytica
EFEPEKKFTIGVEFATR

SEQ ID NO: 2702484 - protein, 20 aa, Entamoeba histolytica
EFEPRFLFKVIEKEANQMVG

SEQ ID NO: 2702485 - protein, 18 aa, Entamoeba histolytica
EFFKLIFLQYPPRIVQSL

SEQ ID NO: 2702486 - protein, 19 aa, Entamoeba histolytica
EFICKTCDFIIIFIDISVE

SEQ ID NO: 2702487 - protein, 20 aa, Entamoeba histolytica
EFKFPWKLAEFISTGNRPVI

SEQ ID NO: 2702488 - protein, 20 aa, Entamoeba histolytica
EFLKRVALLITCCVDNQTKF

SEQ ID NO: 2702489 - protein, 20 aa, Entamoeba histolytica
EFNLLLIRSVFDFLTTLKDS

SEQ ID NO: 2702490 - protein, 22 aa, Entamoeba histolytica
EFVKEYFKFAGINDENIPIDMK

SEQ ID NO: 2702491 - protein, 18 aa, Entamoeba histolytica
EGAMKWKANIDDRVLFNN

SEQ ID NO: 2702492 - protein, 17 aa, Entamoeba histolytica
EGKICCFKLPELAEEAK

SEQ ID NO: 2702493 - protein, 25 aa, Entamoeba histolytica
EGKMIRKIMKWMLKCLICQEQIFDM

SEQ ID NO: 2702494 - protein, 23 aa, Entamoeba histolytica
EGKQIEALVCWKQAIDITPFHAS

SEQ ID NO: 2702495 - protein, 22 aa, Entamoeba histolytica
EGKRVVGVLLGFIRKGIVDVMN

SEQ ID NO: 2702496 - protein, 18 aa, Entamoeba histolytica
EGLLRMGLHPTIIADGYR

SEQ ID NO: 2702497 - protein, 19 aa, Entamoeba histolytica
EGRGVCLRFPRYIRSRDDK

SEQ ID NO: 2702498 - protein, 25 aa, Entamoeba histolytica
EGYILKRWVARYVLVKRNYLIYFVS

SEQ ID NO: 2702499 - protein, 17 aa, Entamoeba histolytica
EGYPFRIAVVFQSPQQL

SEQ ID NO: 2702500 - protein, 17 aa, Entamoeba histolytica
EHFCYRATAQISIAAKA

SEQ ID NO: 2702501 - protein, 19 aa, Entamoeba histolytica
EHFMYPILIVRVSRIIDNS

SEQ ID NO: 2702502 - protein, 25 aa, Entamoeba histolytica
EHLGVKCVLEILPLNLDVSIVQRGS

SEQ ID NO: 2702503 - protein, 23 aa, Entamoeba histolytica
EHPAFKCLYSFREIRNYQSEQES

SEQ ID NO: 2702504 - protein, 20 aa, Entamoeba histolytica
EHPHKVFLIDGFPRNEENKN

SEQ ID NO: 2702505 - protein, 23 aa, Entamoeba histolytica
EHQKSIPGWGNWVGEGIEKKVKK

SEQ ID NO: 2702506 - protein, 22 aa, Entamoeba histolytica
EIAEFPLLFGVSLIDGERIIYS

SEQ ID NO: 2702507 - protein, 23 aa, Entamoeba histolytica
EIAQEIYIRWKVRKLLREQSYDV

SEQ ID NO: 2702508 - protein, 17 aa, Entamoeba histolytica
EICNGLWYLHFTKKLIH

SEQ ID NO: 2702509 - protein, 20 aa, Entamoeba histolytica
EICSGLWYLHFNKHLLHRDL

SEQ ID NO: 2702510 - protein, 20 aa, Entamoeba histolytica
EICSGLWYLHFNKRLIHRDL

SEQ ID NO: 2702511 - protein, 19 aa, Entamoeba histolytica
EIFCKGCVNKEKIDRIKNE

SEQ ID NO: 2702512 - protein, 18 aa, Entamoeba histolytica
EIFELAAKVSMGLLDAVV

SEQ ID NO: 2702513 - protein, 18 aa, Entamoeba histolytica
EIFIPLEIYCKLIDLSIN

SEQ ID NO: 2702514 - protein, 22 aa, Entamoeba histolytica
EIGYECFRWCLSLKSIEIPTNV

SEQ ID NO: 2702515 - protein, 23 aa, Entamoeba histolytica
EIHLKRRATILIALLLDYIDTPK

SEQ ID NO: 2702516 - protein, 22 aa, Entamoeba histolytica
EIHLYNRFQIISSLPYKTNYHF

SEQ ID NO: 2702517 - protein, 17 aa, Entamoeba histolytica
EIIKSCFVIINILPQYF

SEQ ID NO: 2702518 - protein, 18 aa, Entamoeba histolytica
EIILRLFLLDSVDSEHPS

SEQ ID NO: 2702519 - protein, 19 aa, Entamoeba histolytica
EIISGWLISKAVCINEFNI

SEQ ID NO: 2702520 - protein, 22 aa, Entamoeba histolytica
EIKEILNGFGLRQPMETRIIVG

SEQ ID NO: 2702521 - protein, 23 aa, Entamoeba histolytica
EIKFRYEFLITIFGEIFRRCKCL

SEQ ID NO: 2702522 - protein, 23 aa, Entamoeba histolytica
EIKKEDKGSCLILIELENKEKVK

SEQ ID NO: 2702523 - protein, 19 aa, Entamoeba histolytica
EIKRIGLECPKVWIKNPVL

SEQ ID NO: 2702524 - protein, 17 aa, Entamoeba histolytica
EILIARYALHKLYPDVE

SEQ ID NO: 2702525 - protein, 23 aa, Entamoeba histolytica
EILRREFLSALAFVEPTFDLSSA

SEQ ID NO: 2702526 - protein, 18 aa, Entamoeba histolytica
EIMIWRPIELEMKSVEEI

SEQ ID NO: 2702527 - protein, 22 aa, Entamoeba histolytica
EINNLRIPFGFYKRTLPHYWKE

SEQ ID NO: 2702528 - protein, 19 aa, Entamoeba histolytica
EINYFLSLKTHEEYETSNE

SEQ ID NO: 2702529 - protein, 19 aa, Entamoeba histolytica
EIPSGKFNNEWAITLYNST

SEQ ID NO: 2702530 - protein, 22 aa, Entamoeba histolytica
EIPTLKLPIMFNSTDNRLECLK

SEQ ID NO: 2702531 - protein, 32 aa, Entamoeba histolytica; identical to SEQ ID NO: 2393289

SEQ ID NO: 2702532 - protein, 19 aa, Entamoeba histolytica
EIQRRVIGHLSRVSSHSTM

SEQ ID NO: 2702533 - protein, 20 aa, Entamoeba histolytica
EIRIKIVFGIFSLIGLDDRI

SEQ ID NO: 2702534 - protein, 19 aa, Entamoeba histolytica
EIRILFEYCDMGTFDQFIP

SEQ ID NO: 2702535 - protein, 22 aa, Entamoeba histolytica
EISEPFLFLGIGMKDGCCYGYK

SEQ ID NO: 2702536 - protein, 18 aa, Entamoeba histolytica
EISHLIAIDLYKYITSQY

SEQ ID NO: 2702537 - protein, 19 aa, Entamoeba histolytica
EISHWIGTMILMFPDVEMR

SEQ ID NO: 2702538 - protein, 18 aa, Entamoeba histolytica
EISLFLGMLSKWCNITIE

SEQ ID NO: 2702539 - protein, 23 aa, Entamoeba histolytica
EISTEMMNWLGLRNDQLGDIVPT

SEQ ID NO: 2702540 - protein, 19 aa, Entamoeba histolytica
EITETFLSSGFYTGCEVPS

SEQ ID NO: 2702541 - protein, 20 aa, Entamoeba histolytica
EIVQWPVLHPELFKRYGQPP

SEQ ID NO: 2702542 - protein, 21 aa, Entamoeba histolytica
EIWLMKPCTGSVLFDIIFNID

SEQ ID NO: 2702543 - protein, 18 aa, Entamoeba histolytica
EIWRELGMNKELLLESLT

SEQ ID NO: 2702544 - protein, 19 aa, Entamoeba histolytica
EIYYIIASCVIKRKLYLLF

SEQ ID NO: 2702545 - protein, 20 aa, Entamoeba histolytica
EKAFYFKYLNDVRLEMKRIE

SEQ ID NO: 2702546 - protein, 21 aa, Entamoeba histolytica
EKAKAFAIAVEWYRALRSICW

SEQ ID NO: 2702547 - protein, 19 aa, Entamoeba histolytica
EKCKTCCRVIFASDYNYKT

SEQ ID NO: 2702548 - protein, 23 aa, Entamoeba histolytica
EKCPYCSSILRKGEYYRFYQFDS

SEQ ID NO: 2702549 - protein, 19 aa, Entamoeba histolytica
EKDNFICFLISFGMTSSPP

SEQ ID NO: 2702550 - protein, 22 aa, Entamoeba histolytica
EKEIKAGLTFSFAVEQIAIDKG

SEQ ID NO: 2702551 - protein, 17 aa, Entamoeba histolytica
EKFFKVFVPVFIQCFHD

SEQ ID NO: 2702552 - protein, 24 aa, Entamoeba histolytica
EKFFQVYSSWDWLRTPVMLGTNDD

SEQ ID NO: 2702553 - protein, 20 aa, Entamoeba histolytica
EKHLRLLWIALIPCLNVSSL

SEQ ID NO: 2702554 - protein, 19 aa, Entamoeba histolytica
EKIKIALELSRYNHLHDLR

SEQ ID NO: 2702555 - protein, 19 aa, Entamoeba histolytica
EKITGLCYVKENIIVGTPS

SEQ ID NO: 2702556 - protein, 19 aa, Entamoeba histolytica
EKKFGLDLHQFFTSMPEKP

SEQ ID NO: 2702557 - protein, 20 aa, Entamoeba histolytica
EKKGILSFMYQILSKYRLGN

SEQ ID NO: 2702558 - protein, 22 aa, Entamoeba histolytica
EKRCCKRIKLLHAQYYIDIQNN

SEQ ID NO: 2702559 - protein, 18 aa, Entamoeba histolytica
EKRCHFLSCSGSFGDLTK

SEQ ID NO: 2702560 - protein, 19 aa, Entamoeba histolytica
EKRIIGWLNNIYVIEKNKE

SEQ ID NO: 2702561 - protein, 22 aa, Entamoeba histolytica
EKRLRPSFRMSLNDGIFVKLLN

SEQ ID NO: 2702562 - protein, 22 aa, Entamoeba histolytica
EKRQINPIQMEKIIQVKQKSPS

SEQ ID NO: 2702563 - protein, 18 aa, Entamoeba histolytica
EKSLPGLLIYKGDCMVKS

SEQ ID NO: 2702564 - protein, 22 aa, Entamoeba histolytica
EKYILKPCRFLRLREKEQVEFP

SEQ ID NO: 2702565 - protein, 23 aa, Entamoeba histolytica
ELCLKRKRPLVVISDTIDGDALT

SEQ ID NO: 2702566 - protein, 19 aa, Entamoeba histolytica
ELEYCIKYPLKILQIDQQH

SEQ ID NO: 2702567 - protein, 21 aa, Entamoeba histolytica
ELFYHFRISEIIDIWSEIILC

SEQ ID NO: 2702568 - protein, 17 aa, Entamoeba histolytica
ELHRGVIYEGMIGMYLG

SEQ ID NO: 2702569 - protein, 21 aa, Entamoeba histolytica
ELICCCSHLFPFYIKTGEHDE

SEQ ID NO: 2702570 - protein, 18 aa, Entamoeba histolytica
ELILRGCSCFKMGTKLKT

SEQ ID NO: 2702571 - protein, 18 aa, Entamoeba histolytica
ELKDVCFDKVIAPVFENK

SEQ ID NO: 2702572 - protein, 17 aa, Entamoeba histolytica
ELLRSIYSYGFEKPSAI

SEQ ID NO: 2702573 - protein, 17 aa, Entamoeba histolytica
ELLYRFICKLINRSYVR

SEQ ID NO: 2702574 - protein, 19 aa, Entamoeba histolytica
ELMKIIGMSIVMERNRDLM

SEQ ID NO: 2702575 - protein, 18 aa, Entamoeba histolytica
ELPELFKSNFIEICNILK

SEQ ID NO: 2702576 - protein, 17 aa, Entamoeba histolytica
ELPIEFIGLYLLVKTIL

SEQ ID NO: 2702577 - protein, 18 aa, Entamoeba histolytica
ELQWCKAYLIGLLILCET

SEQ ID NO: 2702578 - protein, 21 aa, Entamoeba histolytica
ELREMMVHFSLGMLQVKLLRL

SEQ ID NO: 2702579 - protein, 19 aa, Entamoeba histolytica
ELRMIILTDFFKHAFDGSG

SEQ ID NO: 2702580 - protein, 21 aa, Entamoeba histolytica
ELSGELVFECWDWDRMNSDDL

SEQ ID NO: 2702581 - protein, 20 aa, Entamoeba histolytica
ELTERFELFILKREIANAYT

SEQ ID NO: 2702582 - protein, 17 aa, Entamoeba histolytica
ELYRRAANMGSWKQVLI

SEQ ID NO: 2702583 - protein, 18 aa, Entamoeba histolytica
ELYSRFYPIIPLKFTEGE

SEQ ID NO: 2702584 - protein, 19 aa, Entamoeba histolytica
EMDLMLAFLIRDFGKLLVN

SEQ ID NO: 2702585 - protein, 17 aa, Entamoeba histolytica
EMEPGKDWLLFPNMGAY

SEQ ID NO: 2702586 - protein, 17 aa, Entamoeba histolytica
EMEYCTIVSLLDISESN

SEQ ID NO: 2702587 - protein, 23 aa, Entamoeba histolytica
EMFPELLQRILLANKISFEKSKE

SEQ ID NO: 2702588 - protein, 17 aa, Entamoeba histolytica
EMKEMIEAIVLPMTQKE

SEQ ID NO: 2702589 - protein, 24 aa, Entamoeba histolytica
EMLKEFRRLGGIIGVVSFSDEQNI

SEQ ID NO: 2702590 - protein, 24 aa, Entamoeba histolytica
EMNKDALCGLVYSITTDYIVIGER

SEQ ID NO: 2702591 - protein, 21 aa, Entamoeba histolytica
EMPEALFIFPRLFKIEIAILY

SEQ ID NO: 2702592 - protein, 18 aa, Entamoeba histolytica
EMYYTFCLVDYVLCNSPS

SEQ ID NO: 2702593 - protein, 22 aa, Entamoeba histolytica
ENELPVIISFSIQRISDVFKEE

SEQ ID NO: 2702594 - protein, 23 aa, Entamoeba histolytica
ENILCFAGAFLISGNCGENEESR

SEQ ID NO: 2702595 - protein, 25 aa, Entamoeba histolytica
ENIRMFIKACFVEKQWSAENTQYTQ

SEQ ID NO: 2702596 - protein, 20 aa, Entamoeba histolytica
ENLIRFVFPISRITLLPCNS

SEQ ID NO: 2702597 - protein, 22 aa, Entamoeba histolytica
ENMLYCCFIHWIGHLFVQQKLD

SEQ ID NO: 2702598 - protein, 27 aa, Entamoeba histolytica
ENNDILLLEFCKYCQLESLKIQNIGGC

SEQ ID NO: 2702599 - protein, 18 aa, Entamoeba histolytica
ENRCGIGLVKPEPKKLEF

SEQ ID NO: 2702600 - protein, 18 aa, Entamoeba histolytica
ENRLDCTFDISIINENRG

SEQ ID NO: 2702601 - protein, 18 aa, Entamoeba histolytica
EPFIWYYYCVGFYGEKAF

SEQ ID NO: 2702602 - protein, 19 aa, Entamoeba histolytica
EPHLPFFFKYPILFEPHSF

SEQ ID NO: 2702603 - protein, 21 aa, Entamoeba histolytica
EPRTMFKFILEFLKLSLQNED

SEQ ID NO: 2702604 - protein, 24 aa, Entamoeba histolytica
EPTFACPFCGLDMGSSSKLQKHVS

SEQ ID NO: 2702605 - protein, 23 aa, Entamoeba histolytica
EQECLCMALLMRHGVNFVLLKPR

SEQ ID NO: 2702606 - protein, 25 aa, Entamoeba histolytica
EQFWEIKGSIEWNRIGVAYELSFKH

SEQ ID NO: 2702607 - protein, 20 aa, Entamoeba histolytica
EQILDILITFCFYQINIPIN

SEQ ID NO: 2702608 - protein, 25 aa, Entamoeba histolytica
EQQVLSLRCPISFQTIEIPVRGKRC

SEQ ID NO: 2702609 - protein, 20 aa, Entamoeba histolytica
EQRVCFSLKGAKIIMVSSEE

SEQ ID NO: 2702610 - protein, 19 aa, Entamoeba histolytica
EQTEILKSILFFIFKEKKE

SEQ ID NO: 2702611 - protein, 19 aa, Entamoeba histolytica
EQVCYRIGEMIRRGGIKCT

SEQ ID NO: 2702612 - protein, 22 aa, Entamoeba histolytica
EQWWYPLCMSLRIEEFRPLQEW

SEQ ID NO: 2702613 - protein, 23 aa, Entamoeba histolytica
EQYLCGLAHGVAKEPTRINLDVP

SEQ ID NO: 2702614 - protein, 24 aa, Entamoeba histolytica
ERAEKENKWILAYVFKENDLECLT

SEQ ID NO: 2702615 - protein, 23 aa, Entamoeba histolytica
ERAYTLKLCRAIQKSGCNVLLIQ

SEQ ID NO: 2702616 - protein, 24 aa, Entamoeba histolytica
ERIAEYFMPFVFDFIDNFERITDI

SEQ ID NO: 2702617 - protein, 17 aa, Entamoeba histolytica
ERIFSLYLPMLFGYQIY

SEQ ID NO: 2702618 - protein, 21 aa, Entamoeba histolytica
ERIIKIFLIRWENNFHYVPDE

SEQ ID NO: 2702619 - protein, 23 aa, Entamoeba histolytica
ERIKELQKDAGVSFDQHFMDEDF

SEQ ID NO: 2702620 - protein, 19 aa, Entamoeba histolytica
ERKECFNYLFAQMREGIQW

SEQ ID NO: 2702621 - protein, 21 aa, Entamoeba histolytica
ERKLYYFICSAIILKNGDQIV

SEQ ID NO: 2702622 - protein, 19 aa, Entamoeba histolytica
ERKSRILFVRNICFNTNEE

SEQ ID NO: 2702623 - protein, 24 aa, Entamoeba histolytica
ERKVFGVPMLIAFTYNYPLSPPEL

SEQ ID NO: 2702624 - protein, 19 aa, Entamoeba histolytica
ERLNNILSFCGFENDDQVE

SEQ ID NO: 2702625 - protein, 23 aa, Entamoeba histolytica
ERRRALCFTPLFTTAAHFQIDAI

SEQ ID NO: 2702626 - protein, 20 aa, Entamoeba histolytica
ERTAAVLACEWVDEVVDGIV

SEQ ID NO: 2702627 - protein, 21 aa, Entamoeba histolytica
ESERKKRMVILYERKLDSMRE

SEQ ID NO: 2702628 - protein, 17 aa, Entamoeba histolytica
ESICLSCAIHAPCDGVL

SEQ ID NO: 2702629 - protein, 17 aa, Entamoeba histolytica
ESIRFILERLIPFNQQL

SEQ ID NO: 2702630 - protein, 19 aa, Entamoeba histolytica
ESKSSFKKLCFNLQSKISV

SEQ ID NO: 2702631 - protein, 22 aa, Entamoeba histolytica
ESLKIVGAFVFLRLINPVLLTP

SEQ ID NO: 2702632 - protein, 19 aa, Entamoeba histolytica
ESLKNLLAMCLKKEAKKRC

SEQ ID NO: 2702633 - protein, 20 aa, Entamoeba histolytica
ESMKFLKINPCFTRNFNKNQ

SEQ ID NO: 2702634 - protein, 20 aa, Entamoeba histolytica
ESPLLREARLFRSPFIKSVH

SEQ ID NO: 2702635 - protein, 18 aa, Entamoeba histolytica
ESRIYNRYCCFNLYWFID

SEQ ID NO: 2702636 - protein, 19 aa, Entamoeba histolytica
ESTEGFLFKTYHACGDNTF

SEQ ID NO: 2702637 - protein, 21 aa, Entamoeba histolytica
ESTIVCLRWLMGAEFIVESCK

SEQ ID NO: 2702638 - protein, 22 aa, Entamoeba histolytica
ESVKLFCPRCGDLYIPMPPHDS

SEQ ID NO: 2702639 - protein, 18 aa, Entamoeba histolytica
ESYLKYKVIWIVCGTMAD

SEQ ID NO: 2702640 - protein, 17 aa, Entamoeba histolytica
ETCCVYAEYILMLHEQP

SEQ ID NO: 2702641 - protein, 22 aa, Entamoeba histolytica
ETDGRFLLDFDIVYNSSNFIEI

SEQ ID NO: 2702642 - protein, 19 aa, Entamoeba histolytica
ETIFNWRQVNGLKHDDYTR

SEQ ID NO: 2702643 - protein, 23 aa, Entamoeba histolytica
ETKPTECLGCFFSGIINIDSSAS

SEQ ID NO: 2702644 - protein, 27 aa, Entamoeba histolytica
ETLKEIARYCNMYQFFCYECKEDKVIV

SEQ ID NO: 2702645 - protein, 18 aa, Entamoeba histolytica
ETMAIRLTVVSGKQLKAM

SEQ ID NO: 2702646 - protein, 17 aa, Entamoeba histolytica
ETPKLVNRFSFFSIFKE

SEQ ID NO: 2702647 - protein, 18 aa, Entamoeba histolytica
ETQIKLIVCQKIVTTDLL

SEQ ID NO: 2702648 - protein, 21 aa, Entamoeba histolytica
ETRTNEVFVVYNLCDVVVENE

SEQ ID NO: 2702649 - protein, 24 aa, Entamoeba histolytica
ETTEFRLGAVFSFLNMLQPYFTHL

SEQ ID NO: 2702650 - protein, 17 aa, Entamoeba histolytica
ETYIKDLLRLGAEMLPQ

SEQ ID NO: 2702651 - protein, 18 aa, Entamoeba histolytica
EVACKRLGIEVNKTKKEK

SEQ ID NO: 2702652 - protein, 21 aa, Entamoeba histolytica
EVAYRIPILTIWIHDMLSSLE

SEQ ID NO: 2702653 - protein, 18 aa, Entamoeba histolytica
EVLFYLLAHKICYPERVF

SEQ ID NO: 2702654 - protein, 19 aa, Entamoeba histolytica
EVNSLGDICFRWCDDIQSI

SEQ ID NO: 2702655 - protein, 19 aa, Entamoeba histolytica
EVQSRFAVQMDELPSSLKD

SEQ ID NO: 2702656 - protein, 21 aa, Entamoeba histolytica
EVYHWAVKLKKQFETLWKNAF

SEQ ID NO: 2702657 - protein, 20 aa, Entamoeba histolytica
EWATVCYKAALEFVGNSSIQ

SEQ ID NO: 2702658 - protein, 18 aa, Entamoeba histolytica
EWFCRVCSYRLGITKLDI

SEQ ID NO: 2702659 - protein, 21 aa, Entamoeba histolytica
EWSECPYCVNSHIPKDLSLGK

SEQ ID NO: 2702660 - protein, 17 aa, Entamoeba histolytica
EYFCFKYNKSLLNDFKY

SEQ ID NO: 2702661 - protein, 23 aa, Entamoeba histolytica
EYLRKLLIERGIIFSTESEKIEV

SEQ ID NO: 2702662 - protein, 19 aa, Entamoeba histolytica
EYRMLWFRFDIRKLYFLRH

SEQ ID NO: 2702663 - protein, 21 aa, Entamoeba histolytica
EYYFACAVCLVMYKQHHLAIE

SEQ ID NO: 2702664 - protein, 19 aa, Entamoeba histolytica
FADDLRLMIQIAKYGVGVY

SEQ ID NO: 2702665 - protein, 18 aa, Entamoeba histolytica
FAEDVWLKLMLSCIGETI

SEQ ID NO: 2702666 - protein, 18 aa, Entamoeba histolytica
FAERADMIVLVFDAHKLD

SEQ ID NO: 2702667 - protein, 17 aa, Entamoeba histolytica
FAKEIIGIFPFDQSVLI

SEQ ID NO: 2702668 - protein, 17 aa, Entamoeba histolytica
FALFKAVEKSGAVEVVG

SEQ ID NO: 2702669 - protein, 17 aa, Entamoeba histolytica
FALNCWDVLVNILEMKK

SEQ ID NO: 2702670 - protein, 18 aa, Entamoeba histolytica
FALQKGWKKTLYIYGDDQ

SEQ ID NO: 2702671 - protein, 19 aa, Entamoeba histolytica
FAQRCGYNFTIRGTRSSIY

SEQ ID NO: 2702672 - protein, 26 aa, Entamoeba histolytica
FARMLILRFVFCRLVLLSLKLPGDAD

SEQ ID NO: 2702673 - protein, 21 aa, Entamoeba histolytica
FCFCPKCLHKGIFTPMQFSLD

SEQ ID NO: 2702674 - protein, 20 aa, Entamoeba histolytica
FCFDCGKGGATFVVSNFNIF

SEQ ID NO: 2702675 - protein, 19 aa, Entamoeba histolytica
FCFFFVCLFLLYKTYPTQF

SEQ ID NO: 2702676 - protein, 22 aa, Entamoeba histolytica
FCGFSRQLSLYGFKKFDNEYRF

SEQ ID NO: 2702677 - protein, 21 aa, Entamoeba histolytica
FCKKELFLLCGTILTSGDNTR

SEQ ID NO: 2702678 - protein, 19 aa, Entamoeba histolytica
FCNCFKRVKIFKALISLSI

SEQ ID NO: 2702679 - protein, 21 aa, Entamoeba histolytica
FCVQCSYQPFTISTYQKYPEY

SEQ ID NO: 2702680 - protein, 22 aa, Entamoeba histolytica
FCYSCLRIGSFYTNPECRNVDF

SEQ ID NO: 2702681 - protein, 17 aa, Entamoeba histolytica
FDIFIKVLIKWITNSKD

SEQ ID NO: 2702682 - protein, 22 aa, Entamoeba histolytica
FDIKGKCILPKFQFEISPKKFL

SEQ ID NO: 2702683 - protein, 23 aa, Entamoeba histolytica
FDIKPSSSFSLFGGDIINDTKKS

SEQ ID NO: 2702684 - protein, 17 aa, Entamoeba histolytica
FDKGWYIIFGCTYQPAI

SEQ ID NO: 2702685 - protein, 19 aa, Entamoeba histolytica
FDKILGGLAWGISATCYPL

SEQ ID NO: 2702686 - protein, 17 aa, Entamoeba histolytica
FDLCYLPVIGNPGEDSY

SEQ ID NO: 2702687 - protein, 22 aa, Entamoeba histolytica
FDLFGGLCLKCLDSVKYFETIS

SEQ ID NO: 2702688 - protein, 19 aa, Entamoeba histolytica
FDLGIDIPNEFIVKEKKDL

SEQ ID NO: 2702689 - protein, 19 aa, Entamoeba histolytica
FDLHPPAVPAWELSEQRLP

SEQ ID NO: 2702690 - protein, 18 aa, Entamoeba histolytica
FDLIYKWLRREGKSILKL

SEQ ID NO: 2702691 - protein, 17 aa, Entamoeba histolytica
FDLYELFFPLNDTSKKM

SEQ ID NO: 2702692 - protein, 18 aa, Entamoeba histolytica
FDMCLKVVFRLICVHVAL

SEQ ID NO: 2702693 - protein, 25 aa, Entamoeba histolytica
FDPGKGAKCIYVWLGKSSNKMEKGK

SEQ ID NO: 2702694 - protein, 18 aa, Entamoeba histolytica
FDPSYVFLCDEFGMNLIG

SEQ ID NO: 2702695 - protein, 18 aa, Entamoeba histolytica
FDSLFGIDIKDWIISFID

SEQ ID NO: 2702696 - protein, 17 aa, Entamoeba histolytica
FDYQKEFIKWCLKVPGY

SEQ ID NO: 2702697 - protein, 17 aa, Entamoeba histolytica
FEAKECYKRSFTKEDKT

SEQ ID NO: 2702698 - protein, 20 aa, Entamoeba histolytica
FEALICSFKLSAAVNEEKMG

SEQ ID NO: 2702699 - protein, 18 aa, Entamoeba histolytica
FECFCDICIAPLLEEFCL

SEQ ID NO: 2702700 - protein, 25 aa, Entamoeba histolytica
FECPICGFCYCELPIQCKICNAILL

SEQ ID NO: 2702701 - protein, 18 aa, Entamoeba histolytica
FEDTEGWLFFGMSHSDPK

SEQ ID NO: 2702702 - protein, 17 aa, Entamoeba histolytica
FEECIKLVLTLSTLHPS

SEQ ID NO: 2702703 - protein, 17 aa, Entamoeba histolytica
FEELISWITPLQYQFFE

SEQ ID NO: 2702704 - protein, 19 aa, Entamoeba histolytica
FEELRLEFCRLMIQYNIHE

SEQ ID NO: 2702705 - protein, 19 aa, Entamoeba histolytica
FEFAVKGLEIFGMKEHLDF

SEQ ID NO: 2702706 - protein, 17 aa, Entamoeba histolytica
FEFFEDVLPLIITTLSK

SEQ ID NO: 2702707 - protein, 22 aa, Entamoeba histolytica
FEIKFKFGSMVICSPPIDCLHN

SEQ ID NO: 2702708 - protein, 17 aa, Entamoeba histolytica
FEILDAVAFSKEVLPKY

SEQ ID NO: 2702709 - protein, 18 aa, Entamoeba histolytica
FEIPYGFELLTKLIKMYT

SEQ ID NO: 2702710 - protein, 19 aa, Entamoeba histolytica
FEISNGLYLPVTINKPKTV

SEQ ID NO: 2702711 - protein, 17 aa, Entamoeba histolytica
FELELMYKDGWERSCDV

SEQ ID NO: 2702712 - protein, 17 aa, Entamoeba histolytica
FELFSQFGITQVIQEQN

SEQ ID NO: 2702713 - protein, 19 aa, Entamoeba histolytica
FELKLGYFPFESLSTLVYG

SEQ ID NO: 2702714 - protein, 18 aa, Entamoeba histolytica
FELQKKWYFPIIQSIKPQ

SEQ ID NO: 2702715 - protein, 19 aa, Entamoeba histolytica
FEMGNGWLKVFELLLEKMP

SEQ ID NO: 2702716 - protein, 20 aa, Entamoeba histolytica
FEMWYFLSVIILDRNFVQET

SEQ ID NO: 2702717 - protein, 24 aa, Entamoeba histolytica
FEQINWRKMEMGIQFKAIDKGKYY

SEQ ID NO: 2702718 - protein, 24 aa, Entamoeba histolytica
FEQMVKCFLKFVDVFKLYSSFVNN

SEQ ID NO: 2702719 - protein, 18 aa, Entamoeba histolytica
FEQWAIIFDECARKLFNM

SEQ ID NO: 2702720 - protein, 18 aa, Entamoeba histolytica
FERPFLWIARKLTGNPNL

SEQ ID NO: 2702721 - protein, 18 aa, Entamoeba histolytica
FETFKKLRVGAVLYLLYG

SEQ ID NO: 2702722 - protein, 23 aa, Entamoeba histolytica
FEVSRPGYGKVMWSKVDLTNVNL

SEQ ID NO: 2702723 - protein, 24 aa, Entamoeba histolytica
FEYLSKWPEMCFIARDCNGRVEGY

SEQ ID NO: 2702724 - protein, 22 aa, Entamoeba histolytica
FFECGYELYGYCLVFELHIMNL

SEQ ID NO: 2702725 - protein, 18 aa, Entamoeba histolytica
FFFLKRNIIVGIYFNTPL

SEQ ID NO: 2702726 - protein, 17 aa, Entamoeba histolytica
FFGLIPYWIAQLIEIEN

SEQ ID NO: 2702727 - protein, 18 aa, Entamoeba histolytica
FFIPVVLLLRVYGGMSDR

SEQ ID NO: 2702728 - protein, 18 aa, Entamoeba histolytica
FFIRKGRTSTHFSYNVKK

SEQ ID NO: 2702729 - protein, 17 aa, Entamoeba histolytica
FFKKSIKPMIVQQEHTE

SEQ ID NO: 2702730 - protein, 22 aa, Entamoeba histolytica
FFKPKEDWFFYAFSKFYFEAAL

SEQ ID NO: 2702731 - protein, 17 aa, Entamoeba histolytica
FFLPFFLKDDIKEYMLW

SEQ ID NO: 2702732 - protein, 20 aa, Entamoeba histolytica
FFPSYAYMNICISYWNEMKI

SEQ ID NO: 2702733 - protein, 19 aa, Entamoeba histolytica
FFPSYSYMNICISYWDEMK

SEQ ID NO: 2702734 - protein, 27 aa, Entamoeba histolytica
FFRFNFSFRLIEILTLVALCRDEQKKS

SEQ ID NO: 2702735 - protein, 17 aa, Entamoeba histolytica
FFSDVDCAIFVTSLAEY

SEQ ID NO: 2702736 - protein, 22 aa, Entamoeba histolytica
FFSWNAWNGWIPNWCVNKATKT

SEQ ID NO: 2702737 - protein, 24 aa, Entamoeba histolytica
FFTYKRYKFGVLYAAPGQTKEMEF

SEQ ID NO: 2702738 - protein, 24 aa, Entamoeba histolytica
FFTYKRYKFGVLYAAVGQTKEMEF

SEQ ID NO: 2702739 - protein, 19 aa, Entamoeba histolytica
FGCIICKGWNPNNQQFNQQ

SEQ ID NO: 2702740 - protein, 25 aa, Entamoeba histolytica
FGCMAAELFVGIPIFPGNSEYNMLF

SEQ ID NO: 2702741 - protein, 20 aa, Entamoeba histolytica
FGEKWPGYEFEVHGLVCKNG

SEQ ID NO: 2702742 - protein, 23 aa, Entamoeba histolytica
FGELPKDITGLCALQHRKDNPQR

SEQ ID NO: 2702743 - protein, 26 aa, Entamoeba histolytica
FGEVWKVRHKLMRFISAAKIIKLNKS

SEQ ID NO: 2702744 - protein, 20 aa, Entamoeba histolytica
FGIKWLKMMFAREFLLADSV

SEQ ID NO: 2702745 - protein, 17 aa, Entamoeba histolytica
FGIWLKKLQIVLTEDSK

SEQ ID NO: 2702746 - protein, 17 aa, Entamoeba histolytica
FGKGFNFGTFSSVEKTS

SEQ ID NO: 2702747 - protein, 18 aa, Entamoeba histolytica
FGKLLGCGSFGKVFQVIT

SEQ ID NO: 2702748 - protein, 24 aa, Entamoeba histolytica
FGPSDMKVAEKIFLGRRERTKEVR

SEQ ID NO: 2702749 - protein, 19 aa, Entamoeba histolytica
FGSWPHAGCGIGLERITML

SEQ ID NO: 2702750 - protein, 27 aa, Entamoeba histolytica
FGTRWLRLLFDREFHVMDVLNVWDAIF

SEQ ID NO: 2702751 - protein, 20 aa, Entamoeba histolytica
FHALIWLEEVLKNWDGTLLI

SEQ ID NO: 2702752 - protein, 18 aa, Entamoeba histolytica
FHDKRVDGSLTFSQANIF

SEQ ID NO: 2702753 - protein, 20 aa, Entamoeba histolytica
FHLGMCYRKGIGVDENSIKS

SEQ ID NO: 2702754 - protein, 19 aa, Entamoeba histolytica
FHLKGEVGDIVFVESIIAS

SEQ ID NO: 2702755 - protein, 18 aa, Entamoeba histolytica
FHLTEGFLFYPNSEYIPF

SEQ ID NO: 2702756 - protein, 17 aa, Entamoeba histolytica
FHPTRSWVLASLHNGKI

SEQ ID NO: 2702757 - protein, 17 aa, Entamoeba histolytica
FHSGYDFGYLLRLLTCE

SEQ ID NO: 2702758 - protein, 23 aa, Entamoeba histolytica
FHVASGLSICWGNLFGHIGMKTA

SEQ ID NO: 2702759 - protein, 23 aa, Entamoeba histolytica
FICSVYLGRKCILIFKDKTSPLQ

SEQ ID NO: 2702760 - protein, 21 aa, Entamoeba histolytica
FIELRAAIFNFHFDIGGEFDV

SEQ ID NO: 2702761 - protein, 18 aa, Entamoeba histolytica
FIESGCLKEIIKIIKSNP

SEQ ID NO: 2702762 - protein, 17 aa, Entamoeba histolytica
FIFRMCCEVEKRLHKSN

SEQ ID NO: 2702763 - protein, 17 aa, Entamoeba histolytica
FIHEFRSILPVTNQEYN

SEQ ID NO: 2702764 - protein, 17 aa, Entamoeba histolytica
FIIINGVIDMMKNDILL

SEQ ID NO: 2702765 - protein, 18 aa, Entamoeba histolytica
FIILLKFLIVKEIIEDYK

SEQ ID NO: 2702766 - protein, 20 aa, Entamoeba histolytica
FIIRRLKEINVRDISNGVSS

SEQ ID NO: 2702767 - protein, 20 aa, Entamoeba histolytica
FIKQFSFRLLEIITSVSMCR

SEQ ID NO: 2702768 - protein, 17 aa, Entamoeba histolytica
FINDLVLAKKRVEKGVP

SEQ ID NO: 2702769 - protein, 18 aa, Entamoeba histolytica
FIQSCVFHPLKPMIAIAT

SEQ ID NO: 2702770 - protein, 17 aa, Entamoeba histolytica
FIRLLILRHKHFLFEGT

SEQ ID NO: 2702771 - protein, 20 aa, Entamoeba histolytica
FIRQKCMTLGDVVGVSLKDQ

SEQ ID NO: 2702772 - protein, 17 aa, Entamoeba histolytica
FISNIFKPLVISEFLNL

SEQ ID NO: 2702773 - protein, 21 aa, Entamoeba histolytica
FIYKFIRVCVMNNIGLSGPAL

SEQ ID NO: 2702774 - protein, 18 aa, Entamoeba histolytica
FIYSIPFFFHLKKLKIGY

SEQ ID NO: 2702775 - protein, 17 aa, Entamoeba histolytica
FKDTDWIGAIRMYSSAL

SEQ ID NO: 2702776 - protein, 17 aa, Entamoeba histolytica
FKECCFVKLLSDRCTSL

SEQ ID NO: 2702777 - protein, 17 aa, Entamoeba histolytica
FKFNEAFAVAKTKGSDE

SEQ ID NO: 2702778 - protein, 17 aa, Entamoeba histolytica
FKFPYELNEYMKIYEKN

SEQ ID NO: 2702779 - protein, 19 aa, Entamoeba histolytica
FKGIPAFWHRIFIIENLSD

SEQ ID NO: 2702780 - protein, 22 aa, Entamoeba histolytica
FKGKEWKLCLLFNDILLIAKID

SEQ ID NO: 2702781 - protein, 17 aa, Entamoeba histolytica
FKGMLLVSAKTGFHVEE

SEQ ID NO: 2702782 - protein, 19 aa, Entamoeba histolytica
FKGSLKFASPNQHLGKKSI

SEQ ID NO: 2702783 - protein, 23 aa, Entamoeba histolytica
FKIKDIWKHVCIVWTRCYNYIPP

SEQ ID NO: 2702784 - protein, 24 aa, Entamoeba histolytica
FKIKDIWKRVCIVWTKCFNHFSKD

SEQ ID NO: 2702785 - protein, 17 aa, Entamoeba histolytica
FKIKLCDFGSCKCLNQK

SEQ ID NO: 2702786 - protein, 24 aa, Entamoeba histolytica
FKKLPIKIPVYFISFLKKKFGATE

SEQ ID NO: 2702787 - protein, 21 aa, Entamoeba histolytica
FKKRIMQLYSRLIRRYPRMLS

SEQ ID NO: 2702788 - protein, 21 aa, Entamoeba histolytica
FKKRRVVLMKILLRIHQIYKL

SEQ ID NO: 2702789 - protein, 18 aa, Entamoeba histolytica
FKKVCPFCHIEQVVKENC

SEQ ID NO: 2702790 - protein, 17 aa, Entamoeba histolytica
FKLAFSEAYKIKVRSFK

SEQ ID NO: 2702791 - protein, 20 aa, Entamoeba histolytica
FKLKGCPVSAILTQNLLAIS

SEQ ID NO: 2702792 - protein, 17 aa, Entamoeba histolytica
FKLLLDFVKTFFSSDQS

SEQ ID NO: 2702793 - protein, 20 aa, Entamoeba histolytica
FKLSMPYLFDKLQTACDQLM

SEQ ID NO: 2702794 - protein, 23 aa, Entamoeba histolytica
FKLTFFFFQCFIKSCVVADKEIK

SEQ ID NO: 2702795 - protein, 17 aa, Entamoeba histolytica
FKMGIDLAFNTHFHLPC

SEQ ID NO: 2702796 - protein, 20 aa, Entamoeba histolytica
FKMKECMNSLVVATKENIII

SEQ ID NO: 2702797 - protein, 18 aa, Entamoeba histolytica
FKNIIKFICECYNMKIFA

SEQ ID NO: 2702798 - protein, 17 aa, Entamoeba histolytica
FKPLASFIESWKNARKD

SEQ ID NO: 2702799 - protein, 19 aa, Entamoeba histolytica
FKPTLVFGVPRFYEKLLFR

SEQ ID NO: 2702800 - protein, 20 aa, Entamoeba histolytica
FKRINCIALRGFSGSTEVLM

SEQ ID NO: 2702801 - protein, 21 aa, Entamoeba histolytica
FKRVFSWKKGEEVLRINPLYL

SEQ ID NO: 2702802 - protein, 23 aa, Entamoeba histolytica
FKRWKKRYCVLASNVIALFENAK

SEQ ID NO: 2702803 - protein, 20 aa, Entamoeba histolytica
FKSHCSQLLTAARVSMEDQS

SEQ ID NO: 2702804 - protein, 21 aa, Entamoeba histolytica
FKSHLCIVCELLSINLYDALK

SEQ ID NO: 2702805 - protein, 17 aa, Entamoeba histolytica
FKSSLKFTKIVAENCKV

SEQ ID NO: 2702806 - protein, 24 aa, Entamoeba histolytica
FKTDWRDGYAMKFIFADDHPFELF

SEQ ID NO: 2702807 - protein, 19 aa, Entamoeba histolytica
FKTFYKITVGFNFLSNFII

SEQ ID NO: 2702808 - protein, 22 aa, Entamoeba histolytica
FKTPNWRKALLDAFNHCNLIES

SEQ ID NO: 2702809 - protein, 19 aa, Entamoeba histolytica
FKVAVIFSYVGRGYFGLMY

SEQ ID NO: 2702810 - protein, 17 aa, Entamoeba histolytica
FKVICVYGGVDIQGQIN

SEQ ID NO: 2702811 - protein, 21 aa, Entamoeba histolytica
FKVRVPNHFKRNGVFYTGTIQ

SEQ ID NO: 2702812 - protein, 19 aa, Entamoeba histolytica
FKWRYCFIDDINIKDRLQE

SEQ ID NO: 2702813 - protein, 22 aa, Entamoeba histolytica
FKYHCERCGFVVCDSCSKNRKI

SEQ ID NO: 2702814 - protein, 17 aa, Entamoeba histolytica
FKYLKKVQIKSLYNKRH

SEQ ID NO: 2702815 - protein, 17 aa, Entamoeba histolytica
FKYSVCLKEFPLSNYHS

SEQ ID NO: 2702816 - protein, 18 aa, Entamoeba histolytica
FKYVMDFLQPFYFCKGDI

SEQ ID NO: 2702817 - protein, 18 aa, Entamoeba histolytica
FLARAIEIYSIYHSIVKN

SEQ ID NO: 2702818 - protein, 18 aa, Entamoeba histolytica
FLESGLIYELFNYLDYPF

SEQ ID NO: 2702819 - protein, 19 aa, Entamoeba histolytica
FLEYDLEWFPPQWKVNFAK

SEQ ID NO: 2702820 - protein, 17 aa, Entamoeba histolytica
FLFDCIGDIISYYSLNN

SEQ ID NO: 2702821 - protein, 19 aa, Entamoeba histolytica
FLFILFIRRFVELLKNNGC

SEQ ID NO: 2702822 - protein, 20 aa, Entamoeba histolytica
FLFPNSYKFISFMMFKENPC

SEQ ID NO: 2702823 - protein, 17 aa, Entamoeba histolytica
FLIDVCLELGYLFESKY

SEQ ID NO: 2702824 - protein, 20 aa, Entamoeba histolytica
FLLCTRAGGFGINLSEADTV

SEQ ID NO: 2702825 - protein, 28 aa, Entamoeba histolytica
FLNTLLYEWYELRKLKAIDCRKIKSLIN

SEQ ID NO: 2702826 - protein, 23 aa, Entamoeba histolytica
FLNTLLYEWYELRKLKAIDYRVL

SEQ ID NO: 2702827 - protein, 17 aa, Entamoeba histolytica
FLPDGIKLFQFNALTQK

SEQ ID NO: 2702828 - protein, 18 aa, Entamoeba histolytica
FLPFVMQFLENFENFAKW

SEQ ID NO: 2702829 - protein, 19 aa, Entamoeba histolytica
FLPQVLICLLNWLTTVNDD

SEQ ID NO: 2702830 - protein, 17 aa, Entamoeba histolytica
FLRQCGFSDIYSIPISG

SEQ ID NO: 2702831 - protein, 24 aa, Entamoeba histolytica
FLSAKKKWDGIVNMTVPLDFPSCF

SEQ ID NO: 2702832 - protein, 18 aa, Entamoeba histolytica
FLTAIGCRIVDRQIAASS

SEQ ID NO: 2702833 - protein, 17 aa, Entamoeba histolytica
FLTCLYKTITIGTTDNW

SEQ ID NO: 2702834 - protein, 19 aa, Entamoeba histolytica
FLVDICLDLGYFFETTRMR

SEQ ID NO: 2702835 - protein, 26 aa, Entamoeba histolytica
FMFCARLQIFKTWFEDIIKKEIPLLK

SEQ ID NO: 2702836 - protein, 17 aa, Entamoeba histolytica
FMKLKITPFSGGFIFMY

SEQ ID NO: 2702837 - protein, 18 aa, Entamoeba histolytica
FNAILFVGRFAELEIPEF

SEQ ID NO: 2702838 - protein, 18 aa, Entamoeba histolytica
FNCQWYITVHFDRYICTP

SEQ ID NO: 2702839 - protein, 18 aa, Entamoeba histolytica
FNCQWYITVHFDRYIITP

SEQ ID NO: 2702840 - protein, 26 aa, Entamoeba histolytica
FNELVEIAVKFGYEFGEKNTRKAQKT

SEQ ID NO: 2702841 - protein, 17 aa, Entamoeba histolytica
FNEWNTTIGKDFSQIDI

SEQ ID NO: 2702842 - protein, 17 aa, Entamoeba histolytica
FNIKFGLYLKEIEEEEA

SEQ ID NO: 2702843 - protein, 19 aa, Entamoeba histolytica
FNIPCSFDPLTLNKQINRP

SEQ ID NO: 2702844 - protein, 17 aa, Entamoeba histolytica
FNKLYGLLDSFYKISKK

SEQ ID NO: 2702845 - protein, 23 aa, Entamoeba histolytica
FNKTLWCSSLFYPVEFHEDKIFE

SEQ ID NO: 2702846 - protein, 18 aa, Entamoeba histolytica
FNKYSSFITLDFGLIKRL

SEQ ID NO: 2702847 - protein, 18 aa, Entamoeba histolytica
FNLTDWYIGYLIQLYKNG

SEQ ID NO: 2702848 - protein, 17 aa, Entamoeba histolytica
FNNRVNLFISVRNYGVG

SEQ ID NO: 2702849 - protein, 19 aa, Entamoeba histolytica
FNYKCCLCVGLHSDKTITT

SEQ ID NO: 2702850 - protein, 23 aa, Entamoeba histolytica
FPERHLYYFISMCIIKEYSDIII

SEQ ID NO: 2702851 - protein, 23 aa, Entamoeba histolytica
FPERVIHHVCQWLGNRKPSIIKG

SEQ ID NO: 2702852 - protein, 17 aa, Entamoeba histolytica
FPFEWCNICIDSLPYSL

SEQ ID NO: 2702853 - protein, 17 aa, Entamoeba histolytica
FPHSKLFFCRIHIERSL

SEQ ID NO: 2702854 - protein, 18 aa, Entamoeba histolytica
FPIAFLMRQHMLLLGRSE

SEQ ID NO: 2702855 - protein, 19 aa, Entamoeba histolytica
FPICNNSLPWSWKMKPSQF

SEQ ID NO: 2702856 - protein, 17 aa, Entamoeba histolytica
FPLCLIVTKQLSVETMK

SEQ ID NO: 2702857 - protein, 20 aa, Entamoeba histolytica
FPLFLCDAGLIIISRFPIVE

SEQ ID NO: 2702858 - protein, 17 aa, Entamoeba histolytica
FPLILIWALNQWRKEKS

SEQ ID NO: 2702859 - protein, 24 aa, Entamoeba histolytica
FPLKGDDCYLCLKGVNHFATMAPM

SEQ ID NO: 2702860 - protein, 18 aa, Entamoeba histolytica
FPLLSLLYPRIESINTTY

SEQ ID NO: 2702861 - protein, 21 aa, Entamoeba histolytica
FPRAICLNCVMNLKQVSEVEN

SEQ ID NO: 2702862 - protein, 20 aa, Entamoeba histolytica
FPREEIPTLLSVLKSLYEEN

SEQ ID NO: 2702863 - protein, 18 aa, Entamoeba histolytica
FPTFLSFFALPLVSAIPY

SEQ ID NO: 2702864 - protein, 18 aa, Entamoeba histolytica
FPTFPGAILFTTNCLMKP

SEQ ID NO: 2702865 - protein, 19 aa, Entamoeba histolytica
FPVQREFVAQLFLLIGVKQ

SEQ ID NO: 2702866 - protein, 17 aa, Entamoeba histolytica
FQDGFSFSLPYLLEHCV

SEQ ID NO: 2702867 - protein, 18 aa, Entamoeba histolytica
FQECQSFFKKTLENPNVR

SEQ ID NO: 2702868 - protein, 20 aa, Entamoeba histolytica
FQFAFRWFNCFLLREMSLEK

SEQ ID NO: 2702869 - protein, 18 aa, Entamoeba histolytica
FQFRVCDLLETFCKAECN

SEQ ID NO: 2702870 - protein, 22 aa, Entamoeba histolytica
FQIIKSRMTSIIIGKIKTFLVY

SEQ ID NO: 2702871 - protein, 19 aa, Entamoeba histolytica
FQKCHGCALVFDRTSQESF

SEQ ID NO: 2702872 - protein, 19 aa, Entamoeba histolytica
FRCCCCAKILEGNKLANCE

SEQ ID NO: 2702873 - protein, 18 aa, Entamoeba histolytica
FRCLCHYIRLFCENPLCS

SEQ ID NO: 2702874 - protein, 23 aa, Entamoeba histolytica
FRFPDEQVRLFALKCLDAMKDYE

SEQ ID NO: 2702875 - protein, 17 aa, Entamoeba histolytica
FRFPSLKKELIINGVYI

SEQ ID NO: 2702876 - protein, 23 aa, Entamoeba histolytica
FRFPSTCDLRFVLLSENKRQCEF

SEQ ID NO: 2702877 - protein, 23 aa, Entamoeba histolytica
FRGIRFSAKYGFKIEDNTLNAMT

SEQ ID NO: 2702878 - protein, 20 aa, Entamoeba histolytica
FRIKECLRKLIVGKKFEAKE

SEQ ID NO: 2702879 - protein, 19 aa, Entamoeba histolytica
FRKECKGVFATSLEEEGEY

SEQ ID NO: 2702880 - protein, 19 aa, Entamoeba histolytica
FRKSFKLPFSRNSLGINLD

SEQ ID NO: 2702881 - protein, 19 aa, Entamoeba histolytica
FRLLEIITSVSMCRDIQKQ

SEQ ID NO: 2702882 - protein, 19 aa, Entamoeba histolytica
FRLTREILDPMGVLKYDGP

SEQ ID NO: 2702883 - protein, 19 aa, Entamoeba histolytica
FRNGERFFFGKNVDDDEAI

SEQ ID NO: 2702884 - protein, 17 aa, Entamoeba histolytica
FRPEQIIAMLLIQIKQF

SEQ ID NO: 2702885 - protein, 18 aa, Entamoeba histolytica
FRPKFGKIHLVNGKIVEE

SEQ ID NO: 2702886 - protein, 21 aa, Entamoeba histolytica
FRQECLWKYTAQIYDEFMNTF

SEQ ID NO: 2702887 - protein, 23 aa, Entamoeba histolytica
FRSKGRIPAICWRGAGNQTISRS

SEQ ID NO: 2702888 - protein, 19 aa, Entamoeba histolytica
FRSKKNWKYNQKIFAIKKA

SEQ ID NO: 2702889 - protein, 21 aa, Entamoeba histolytica
FRSQWKYTICINSNDKKSICD

SEQ ID NO: 2702890 - protein, 23 aa, Entamoeba histolytica
FRTFWFYCVVLKFVIKEEYNEIY

SEQ ID NO: 2702891 - protein, 19 aa, Entamoeba histolytica
FRTPSSIFRRNSIFTRIIR

SEQ ID NO: 2702892 - protein, 19 aa, Entamoeba histolytica
FRTSINMGMFRGSYKDFQY

SEQ ID NO: 2702893 - protein, 19 aa, Entamoeba histolytica
FRWFNCCLIREFPINLSLI

SEQ ID NO: 2702894 - protein, 18 aa, Entamoeba histolytica
FSDIWKFIERNAVIYPEQ

SEQ ID NO: 2702895 - protein, 18 aa, Entamoeba histolytica
FSEELGMRGNIFFNSIKY

SEQ ID NO: 2702896 - protein, 19 aa, Entamoeba histolytica
FSFLLCFMAEIILENKDKL

SEQ ID NO: 2702897 - protein, 19 aa, Entamoeba histolytica
FSIGIEGRFGNTIFLVEKG

SEQ ID NO: 2702898 - protein, 21 aa, Entamoeba histolytica
FSILCSFKPYPIVTSNNTIQF

SEQ ID NO: 2702899 - protein, 17 aa, Entamoeba histolytica
FSIPVARNFFKQLLSGV

SEQ ID NO: 2702900 - protein, 20 aa, Entamoeba histolytica
FSIRFPEIFYEMLSRDSGAL

SEQ ID NO: 2702901 - protein, 18 aa, Entamoeba histolytica
FSKAAGIFVACIELADKC

SEQ ID NO: 2702902 - protein, 22 aa, Entamoeba histolytica
FSKCGKCGRILLKVIGDQTYLS

SEQ ID NO: 2702903 - protein, 17 aa, Entamoeba histolytica
FSKIFSFFIHKLCKHQQ

SEQ ID NO: 2702904 - protein, 23 aa, Entamoeba histolytica
FSLKRAGSKFVINQPAVYKLPSS

SEQ ID NO: 2702905 - protein, 21 aa, Entamoeba histolytica
FSLKYGFKYLYYIIPKIISLS

SEQ ID NO: 2702906 - protein, 22 aa, Entamoeba histolytica
FSLLLHEVMLEFNISWNNSHEE

SEQ ID NO: 2702907 - protein, 20 aa, Entamoeba histolytica
FSLTVIDHWVCMKPQQLPLE

SEQ ID NO: 2702908 - protein, 23 aa, Entamoeba histolytica
FSLYRKYCICRSVSDESNNFKTG

SEQ ID NO: 2702909 - protein, 22 aa, Entamoeba histolytica
FSMRIKEWYSWHFPELYNILNN

SEQ ID NO: 2702910 - protein, 20 aa, Entamoeba histolytica
FSRIFCIQRLVKVSIIDKEG

SEQ ID NO: 2702911 - protein, 17 aa, Entamoeba histolytica
FSRRLCTGLSLDWNTSF

SEQ ID NO: 2702912 - protein, 17 aa, Entamoeba histolytica
FSSELFIGKSFKCEVFD

SEQ ID NO: 2702913 - protein, 17 aa, Entamoeba histolytica
FTFFLPFFLKDDIKEYM

SEQ ID NO: 2702914 - protein, 26 aa, Entamoeba histolytica
FTHKEIRLPFCIKILEILIEYLTDNE

SEQ ID NO: 2702915 - protein, 25 aa, Entamoeba histolytica
FTIKDIWKRVCIVWNKCDIDEVRGI

SEQ ID NO: 2702916 - protein, 24 aa, Entamoeba histolytica
FTKDCSFDAWKILRRGTIVLYKMS

SEQ ID NO: 2702917 - protein, 21 aa, Entamoeba histolytica
FTSSDWSCWGGYPGALMTYYS

SEQ ID NO: 2702918 - protein, 17 aa, Entamoeba histolytica
FTTCTWFYIHSFPEYQT

SEQ ID NO: 2702919 - protein, 22 aa, Entamoeba histolytica
FTTNRVEGFFGHLKKIINHNNL

SEQ ID NO: 2702920 - protein, 22 aa, Entamoeba histolytica
FTTNRVEGFFGHLKKIINHSQV

SEQ ID NO: 2702921 - protein, 17 aa, Entamoeba histolytica
FVAQLFLLIGVKQNEDL

SEQ ID NO: 2702922 - protein, 17 aa, Entamoeba histolytica
FVCICCNTLFFAEKNIL

SEQ ID NO: 2702923 - protein, 17 aa, Entamoeba histolytica
FVDYLFLAMMVQIREPI

SEQ ID NO: 2702924 - protein, 18 aa, Entamoeba histolytica
FVEGLGWTIDIETHSGFV

SEQ ID NO: 2702925 - protein, 17 aa, Entamoeba histolytica
FVEGLGWTLDIKTHSGF

SEQ ID NO: 2702926 - protein, 21 aa, Entamoeba histolytica
FVGSYARCWAIGLDPKRSAEI

SEQ ID NO: 2702927 - protein, 19 aa, Entamoeba histolytica
FVKEIKLIIPNSTRINRGN

SEQ ID NO: 2702928 - protein, 18 aa, Entamoeba histolytica
FVMGYSFRSSFTNGNNHS

SEQ ID NO: 2702929 - protein, 18 aa, Entamoeba histolytica
FVMVCGYPPFSRTNNQYI

SEQ ID NO: 2702930 - protein, 18 aa, Entamoeba histolytica
FWMFKYVMDFLQPFYFCK

SEQ ID NO: 2702931 - protein, 18 aa, Entamoeba histolytica
FYADLCVSLSIFISSNFT

SEQ ID NO: 2702932 - protein, 18 aa, Entamoeba histolytica
FYDYSVIFSKQFPTVNQR

SEQ ID NO: 2702933 - protein, 23 aa, Entamoeba histolytica
FYEYQCGLAMMLFTMIGRNELFR

SEQ ID NO: 2702934 - protein, 17 aa, Entamoeba histolytica
FYGVLSFNIKSQYQLYL

SEQ ID NO: 2702935 - protein, 18 aa, Entamoeba histolytica
FYGVSAWAYLNGVQKIKL

SEQ ID NO: 2702936 - protein, 21 aa, Entamoeba histolytica
FYLKSEWKFADDLRLMIQIAK

SEQ ID NO: 2702937 - protein, 21 aa, Entamoeba histolytica
FYPKDRFGLIFYGSQNSTKSL

SEQ ID NO: 2702938 - protein, 19 aa, Entamoeba histolytica
FYQYARWAWEKVKELSQNI

SEQ ID NO: 2702939 - protein, 19 aa, Entamoeba histolytica
FYSCISWSIHCCIMAFEKA

SEQ ID NO: 2702940 - protein, 17 aa, Entamoeba histolytica
FYTKFGFKRIKTIPKAY

SEQ ID NO: 2702941 - protein, 18 aa, Entamoeba histolytica
FYYYCFINDIFFNIRNDS

SEQ ID NO: 2702942 - protein, 18 aa, Entamoeba histolytica
GAALKWIRDIGILKDYNE

SEQ ID NO: 2702943 - protein, 18 aa, Entamoeba histolytica
GAFCFKDCFGLVEFESLA

SEQ ID NO: 2702944 - protein, 23 aa, Entamoeba histolytica
GAICRCVWCSLLVHNACQPKLLN

SEQ ID NO: 2702945 - protein, 17 aa, Entamoeba histolytica
GAIKCWKEIIKKRYDNR

SEQ ID NO: 2702946 - protein, 22 aa, Entamoeba histolytica
GAINCFFYPIIPFKWIADETVT

SEQ ID NO: 2702947 - protein, 20 aa, Entamoeba histolytica
GCDRCMKKALAMNKIIIDDD

SEQ ID NO: 2702948 - protein, 18 aa, Entamoeba histolytica
GCFKHWFESGAYEMKILF

SEQ ID NO: 2702949 - protein, 18 aa, Entamoeba histolytica
GCIGCTVVSNTFSPTTQL

SEQ ID NO: 2702950 - protein, 24 aa, Entamoeba histolytica
GCITAEFFLGIPIFPGNSEYNQLY

SEQ ID NO: 2702951 - protein, 19 aa, Entamoeba histolytica
GCVVAELFLGIPLFAGSSE

SEQ ID NO: 2702952 - protein, 24 aa, Entamoeba histolytica
GDDRLWLKLGKEYTISKEKSSNVI

SEQ ID NO: 2702953 - protein, 19 aa, Entamoeba histolytica
GDIFLLKEVKAFIDKKEKM

SEQ ID NO: 2702954 - protein, 19 aa, Entamoeba histolytica
GDIVPLRFFLKNLQLTPTL

SEQ ID NO: 2702955 - protein, 22 aa, Entamoeba histolytica
GDLPRLLKHLSIVREVSEGNYD

SEQ ID NO: 2702956 - protein, 17 aa, Entamoeba histolytica
GDVFYQYELDNHKNDIL

SEQ ID NO: 2702957 - protein, 19 aa, Entamoeba histolytica
GDVRYGINMLQSFVKCGVT

SEQ ID NO: 2702958 - protein, 22 aa, Entamoeba histolytica
GDVVLCSLSWCEIKQQRQCEHA

SEQ ID NO: 2702959 - protein, 21 aa, Entamoeba histolytica
GDYRWAVTILNHLIFSNPKNE

SEQ ID NO: 2702960 - protein, 17 aa, Entamoeba histolytica
GECMFMFINSQKLDNWK

SEQ ID NO: 2702961 - protein, 19 aa, Entamoeba histolytica
GEDYYLIWFKRELFSSKGR

SEQ ID NO: 2702962 - protein, 18 aa, Entamoeba histolytica
GEEGINCLLQTNQVSIEP

SEQ ID NO: 2702963 - protein, 22 aa, Entamoeba histolytica
GEGFLQCLHRLLSTRIGYESFV

SEQ ID NO: 2702964 - protein, 18 aa, Entamoeba histolytica
GEGMFKFYYIPVGKTCEL

SEQ ID NO: 2702965 - protein, 17 aa, Entamoeba histolytica
GEGSSLFGLKPFDIEIT

SEQ ID NO: 2702966 - protein, 19 aa, Entamoeba histolytica
GEGWRPLYQRTFTTFAKLW

SEQ ID NO: 2702967 - protein, 17 aa, Entamoeba histolytica
GEILDFIGESKWNIIRI

SEQ ID NO: 2702968 - protein, 22 aa, Entamoeba histolytica
GEKKKACGFVKFKRVEDAIRCV

SEQ ID NO: 2702969 - protein, 23 aa, Entamoeba histolytica
GEMELRAFLVFDVYKEVKKEEKV

SEQ ID NO: 2702970 - protein, 20 aa, Entamoeba histolytica
GETLVAFVIVKSGSSFTNLE

SEQ ID NO: 2702971 - protein, 19 aa, Entamoeba histolytica
GEVLLRIQWEGDVLPVQPE

SEQ ID NO: 2702972 - protein, 17 aa, Entamoeba histolytica
GFFRINFNVPRETEEGT

SEQ ID NO: 2702973 - protein, 17 aa, Entamoeba histolytica
GFISRSLPHFALHSRTP

SEQ ID NO: 2702974 - protein, 20 aa, Entamoeba histolytica
GFKGSLKFASPNQHLGKKSI

SEQ ID NO: 2702975 - protein, 22 aa, Entamoeba histolytica
GFLKEMLLWFGWEEIESTPPAT

SEQ ID NO: 2702976 - protein, 17 aa, Entamoeba histolytica
GFLPIVYERKVFGVPML

SEQ ID NO: 2702977 - protein, 26 aa, Entamoeba histolytica
GFRKLETQTGFCFRHESFIAGHPELL

SEQ ID NO: 2702978 - protein, 22 aa, Entamoeba histolytica
GGDYKDVMVCVGENKKTPSGSS

SEQ ID NO: 2702979 - protein, 20 aa, Entamoeba histolytica
GGGFGICWSNLLLGTFTVCE

SEQ ID NO: 2702980 - protein, 24 aa, Entamoeba histolytica
GGITCCACGIYICSNCRQTYTIDN

SEQ ID NO: 2702981 - protein, 19 aa, Entamoeba histolytica
GGWRMRISIAKAIYMHPDL

SEQ ID NO: 2702982 - protein, 22 aa, Entamoeba histolytica
GHIIWNWYNRWLVLTKEQLYYY

SEQ ID NO: 2702983 - protein, 20 aa, Entamoeba histolytica
GHWYLFIVCCQMYKKGEEKS

SEQ ID NO: 2702984 - protein, 24 aa, Entamoeba histolytica
GIAICTYCLPLIRKEKINNLIVDY

SEQ ID NO: 2702985 - protein, 18 aa, Entamoeba histolytica
GICCVHIALYLGLPESVD

SEQ ID NO: 2702986 - protein, 19 aa, Entamoeba histolytica
GICWECWKIYFPDEKWPDL

SEQ ID NO: 2702987 - protein, 17 aa, Entamoeba histolytica
GICYRLFTENTFKYDLL

SEQ ID NO: 2702988 - protein, 21 aa, Entamoeba histolytica
GIDCPRFIVIQSHQEMMIFLN

SEQ ID NO: 2702989 - protein, 17 aa, Entamoeba histolytica
GIFPRNHVQEFLKVFQF

SEQ ID NO: 2702990 - protein, 17 aa, Entamoeba histolytica
GIHLVIFGTRWLRLLFD

SEQ ID NO: 2702991 - protein, 22 aa, Entamoeba histolytica
GILKECLLYGIGMHHAGLNDHD

SEQ ID NO: 2702992 - protein, 21 aa, Entamoeba histolytica
GIQCLKFPFTLSIHQQPLQFF

SEQ ID NO: 2702993 - protein, 20 aa, Entamoeba histolytica
GIQGPYERYGMPIGTTGKRG

SEQ ID NO: 2702994 - protein, 18 aa, Entamoeba histolytica
GIVPRLFYYLGNVRFNGI

SEQ ID NO: 2702995 - protein, 18 aa, Entamoeba histolytica
GKAPLMWRYDEINAPTCF

SEQ ID NO: 2702996 - protein, 26 aa, Entamoeba histolytica
GKDLLGEGCCCQECYSIFEEIDMKGH

SEQ ID NO: 2702997 - protein, 19 aa, Entamoeba histolytica
GKEPFVFTNYFHGWRVNKK

SEQ ID NO: 2702998 - protein, 21 aa, Entamoeba histolytica
GKFCLWFSYVCDFLMIYENYI

SEQ ID NO: 2702999 - protein, 17 aa, Entamoeba histolytica
GKFKVICVYGGVDIQGQ

SEQ ID NO: 2703000 - protein, 17 aa, Entamoeba histolytica
GKFMSCCMMYRGDVSSR

SEQ ID NO: 2703001 - protein, 19 aa, Entamoeba histolytica
GKFPSVIICDYCRRQKYDN

SEQ ID NO: 2703002 - protein, 21 aa, Entamoeba histolytica
GKICQCIKCGYQGNADVVLPK

SEQ ID NO: 2703003 - protein, 17 aa, Entamoeba histolytica
GKIPFIIRRRLPNGSYE

SEQ ID NO: 2703004 - protein, 27 aa, Entamoeba histolytica
GKKCKRCGICFDVECAKTYAGQMESWF

SEQ ID NO: 2703005 - protein, 17 aa, Entamoeba histolytica
GKKGVMMLFTFDCNDTH

SEQ ID NO: 2703006 - protein, 17 aa, Entamoeba histolytica
GKKIGVEWKELPEEQKK

SEQ ID NO: 2703007 - protein, 18 aa, Entamoeba histolytica
GKKLPIPEIVPFRLTREI

SEQ ID NO: 2703008 - protein, 21 aa, Entamoeba histolytica
GKLCERCFALAKTIRSAVFEK

SEQ ID NO: 2703009 - protein, 25 aa, Entamoeba histolytica
GKLEPRFIFEGEIFLAAGEKALLVP

SEQ ID NO: 2703010 - protein, 17 aa, Entamoeba histolytica
GKLGLGIRQYYYIKGKN

SEQ ID NO: 2703011 - protein, 19 aa, Entamoeba histolytica
GKLLFGERFLRVDPILPGQ

SEQ ID NO: 2703012 - protein, 20 aa, Entamoeba histolytica
GKLLLVWKWTPSVILNIECK

SEQ ID NO: 2703013 - protein, 23 aa, Entamoeba histolytica
GKRLRPLSLLLFFIGGGGKIEEQ

SEQ ID NO: 2703014 - protein, 24 aa, Entamoeba histolytica
GKSAILVALAICFGAKATFTNRGK

SEQ ID NO: 2703015 - protein, 19 aa, Entamoeba histolytica
GKVIPNCLGNIWVCVKDWS

SEQ ID NO: 2703016 - protein, 20 aa, Entamoeba histolytica
GKVIPNCLGNIWVCVRDWSE

SEQ ID NO: 2703017 - protein, 24 aa, Entamoeba histolytica
GKVIPNCLGNIWVCVRDWSEEDGR

SEQ ID NO: 2703018 - protein, 24 aa, Entamoeba histolytica
GKVIPNCLGNIWVYVRDWSEEDGR

SEQ ID NO: 2703019 - protein, 25 aa, Entamoeba histolytica
GKVIPNCLGNIWVYVRDWSEEDVGN

SEQ ID NO: 2703020 - protein, 19 aa, Entamoeba histolytica
GKYLFTLGMISSWNNGEIE

SEQ ID NO: 2703021 - protein, 21 aa, Entamoeba histolytica
GKYTPYCQYMFYDCLEILPDN

SEQ ID NO: 2703022 - protein, 22 aa, Entamoeba histolytica
GLGCALDLLKRIDIDFKLNGCR

SEQ ID NO: 2703023 - protein, 17 aa, Entamoeba histolytica
GLIKSFWYYFLNKNEFT

SEQ ID NO: 2703024 - protein, 18 aa, Entamoeba histolytica
GLIQFKGPMNLKHNRGSA

SEQ ID NO: 2703025 - protein, 23 aa, Entamoeba histolytica
GLKFWLRILHCCGNPSSISDNKV

SEQ ID NO: 2703026 - protein, 20 aa, Entamoeba histolytica
GLKICRFISFERLEEMPFDQ

SEQ ID NO: 2703027 - protein, 23 aa, Entamoeba histolytica
GLLDKIMFCYGVGYKKARKENGP

SEQ ID NO: 2703028 - protein, 17 aa, Entamoeba histolytica
GLMSACFLVYMLDSLNA

SEQ ID NO: 2703029 - protein, 20 aa, Entamoeba histolytica
GLPQMIFECIKKCPLTSRRP

SEQ ID NO: 2703030 - protein, 24 aa, Entamoeba histolytica
GLVCSCVLMGLGICSNAKEAMEFF

SEQ ID NO: 2703031 - protein, 19 aa, Entamoeba histolytica
GLWTVRHGHDFRRRQPKKD

SEQ ID NO: 2703032 - protein, 25 aa, Entamoeba histolytica
GMPPPPPGGFGFRPAAPVINGLVDT

SEQ ID NO: 2703033 - protein, 26 aa, Entamoeba histolytica
GMPPPPPGGFGFRPAAPVINGLVDTL

SEQ ID NO: 2703034 - protein, 19 aa, Entamoeba histolytica
GNEAFRIVVQVGRNNDKQR

SEQ ID NO: 2703035 - protein, 20 aa, Entamoeba histolytica
GNEAFRIVVQVGRNNDKQRV

SEQ ID NO: 2703036 - protein, 17 aa, Entamoeba histolytica
GNGLLYCIVEDDETATK

SEQ ID NO: 2703037 - protein, 19 aa, Entamoeba histolytica
GNIKEGIDLVGIFDGHNGS

SEQ ID NO: 2703038 - protein, 24 aa, Entamoeba histolytica
GNKIDCWSCGVVLYSLLCGTFPFA

SEQ ID NO: 2703039 - protein, 19 aa, Entamoeba histolytica
GNLKGEFRAVPGYDVSTPK

SEQ ID NO: 2703040 - protein, 18 aa, Entamoeba histolytica
GNMVFLFLRKGIYTCQAL

SEQ ID NO: 2703041 - protein, 22 aa, Entamoeba histolytica
GNVLRPHVFAAFRALYESNKKK

SEQ ID NO: 2703042 - protein, 19 aa, Entamoeba histolytica
GNYKCPLCQITLTEDDISR

SEQ ID NO: 2703043 - protein, 18 aa, Entamoeba histolytica
GPELLTMWFGESEANVRN

SEQ ID NO: 2703044 - protein, 19 aa, Entamoeba histolytica
GQKVSFCICKIRKGKCPGG

SEQ ID NO: 2703045 - protein, 24 aa, Entamoeba histolytica
GQLFECFRKLFICKTDTDNKSQLI

SEQ ID NO: 2703046 - protein, 18 aa, Entamoeba histolytica
GQTAWAHRQMIIYNGEFI

SEQ ID NO: 2703047 - protein, 17 aa, Entamoeba histolytica
GQVKLQFILPVDKDIKD

SEQ ID NO: 2703048 - protein, 17 aa, Entamoeba histolytica
GRCALCFGYNNKKPIYI

SEQ ID NO: 2703049 - protein, 18 aa, Entamoeba histolytica
GRCVCNLSDLAPVLVNGV

SEQ ID NO: 2703050 - protein, 25 aa, Entamoeba histolytica
GRGHPRFRKPRIGGDGVYEFDILHY

SEQ ID NO: 2703051 - protein, 17 aa, Entamoeba histolytica
GRIGPFIDHLYPDLRNA

SEQ ID NO: 2703052 - protein, 21 aa, Entamoeba histolytica
GRLCTCLALIKAQRVNETETV

SEQ ID NO: 2703053 - protein, 17 aa, Entamoeba histolytica
GRPIPFWLYKLHGLGTE

SEQ ID NO: 2703054 - protein, 18 aa, Entamoeba histolytica
GRTFKFLIELGIPAEHIR

SEQ ID NO: 2703055 - protein, 17 aa, Entamoeba histolytica
GRVIQMFPGKSVPKPIS

SEQ ID NO: 2703056 - protein, 18 aa, Entamoeba histolytica
GSALVFCSAFSSFPRDTE

SEQ ID NO: 2703057 - protein, 23 aa, Entamoeba histolytica
GSFLFCISWAFGITNSGTSSWFH

SEQ ID NO: 2703058 - protein, 20 aa, Entamoeba histolytica
GSIEALIRWAVNPNIDNNIK

SEQ ID NO: 2703059 - protein, 22 aa, Entamoeba histolytica
GSKRIWNLISFIIGNKIIEAYR

SEQ ID NO: 2703060 - protein, 19 aa, Entamoeba histolytica
GSLPGVIPFLFEKLQKKKS

SEQ ID NO: 2703061 - protein, 18 aa, Entamoeba histolytica
GSNGFGFDSCFVPEGYDK

SEQ ID NO: 2703062 - protein, 19 aa, Entamoeba histolytica
GSNKRPGLTFINTKVDPPT

SEQ ID NO: 2703063 - protein, 27 aa, Entamoeba histolytica
GSVKNWKKRWFVLKPTRLWYFKAKNST

SEQ ID NO: 2703064 - protein, 18 aa, Entamoeba histolytica
GSVLRTEVIFRMFKSMEL

SEQ ID NO: 2703065 - protein, 20 aa, Entamoeba histolytica
GSWKSWKRRFFVLKDRKLWY

SEQ ID NO: 2703066 - protein, 24 aa, Entamoeba histolytica
GSWKSWKRRWFVIKDRKMWYFAGK

SEQ ID NO: 2703067 - protein, 24 aa, Entamoeba histolytica
GTFPKNFPFILGVIVKKGEEDKES

SEQ ID NO: 2703068 - protein, 25 aa, Entamoeba histolytica
GTMIIRIELPFGIWCDGCKNLIGKG

SEQ ID NO: 2703069 - protein, 22 aa, Entamoeba histolytica
GTWIQKFCMWIRGGVDGLTKFL

SEQ ID NO: 2703070 - protein, 17 aa, Entamoeba histolytica
GVAEVLRRYNEITPSVQ

SEQ ID NO: 2703071 - protein, 18 aa, Entamoeba histolytica
GVCIIGFVRKEMENKIKQ

SEQ ID NO: 2703072 - protein, 18 aa, Entamoeba histolytica
GVCQFCISPPKTNMDGNV

SEQ ID NO: 2703073 - protein, 20 aa, Entamoeba histolytica
GVCYWKIPSMYSGQIIYDIL

SEQ ID NO: 2703074 - protein, 28 aa, Entamoeba histolytica
GVDPMYYFQIFKLFFKKYINSYEPLLNM

SEQ ID NO: 2703075 - protein, 23 aa, Entamoeba histolytica
GVDRFKTFICVGSTYIGKSVFFT

SEQ ID NO: 2703076 - protein, 20 aa, Entamoeba histolytica
GVECKCFFFIENEWKEVTVD

SEQ ID NO: 2703077 - protein, 20 aa, Entamoeba histolytica
GVECVLTLFSFMIIYPNSVF

SEQ ID NO: 2703078 - protein, 23 aa, Entamoeba histolytica
GVELCALLEIIGETTIKCVTNPK

SEQ ID NO: 2703079 - protein, 18 aa, Entamoeba histolytica
GVEVLCLLYALKIKYPDN

SEQ ID NO: 2703080 - protein, 21 aa, Entamoeba histolytica
GVIFCKNCGIILDKSAIEYLP

SEQ ID NO: 2703081 - protein, 22 aa, Entamoeba histolytica
GVNFRAALQFGNLVDVDTVETN

SEQ ID NO: 2703082 - protein, 22 aa, Entamoeba histolytica
GVPVYINHLWRKCYGDESCKNY

SEQ ID NO: 2703083 - protein, 19 aa, Entamoeba histolytica
GVSSFKVFMVYDFFVTDGL

SEQ ID NO: 2703084 - protein, 18 aa, Entamoeba histolytica
GVSYKFEKLYGYAEGDTA

SEQ ID NO: 2703085 - protein, 18 aa, Entamoeba histolytica
GWEKLRWEDILHIKTIVE

SEQ ID NO: 2703086 - protein, 26 aa, Entamoeba histolytica
GWWYGRSGCSMGYFPGEYVEVSGPIN

SEQ ID NO: 2703087 - protein, 19 aa, Entamoeba histolytica
GYAAIPMMYIRNTIIRLMS

SEQ ID NO: 2703088 - protein, 18 aa, Entamoeba histolytica
GYFMFYRFVGNYIASSSN

SEQ ID NO: 2703089 - protein, 19 aa, Entamoeba histolytica
GYPWWPAKIIIMDKLNEKT

SEQ ID NO: 2703090 - protein, 18 aa, Entamoeba histolytica
GYQSYPWVRYMTFAGDYC

SEQ ID NO: 2703091 - protein, 24 aa, Entamoeba histolytica
GYYYKGCQSWDWYYPYLYAPFAED

SEQ ID NO: 2703092 - protein, 22 aa, Entamoeba histolytica
HACKIIDFAHAWDVTEEECNVD

SEQ ID NO: 2703093 - protein, 25 aa, Entamoeba histolytica
HASKCRGFCGYTCIDCHKSFKTEPE

SEQ ID NO: 2703094 - protein, 20 aa, Entamoeba histolytica
HCKFVWLFLLRNAFYKNCRM

SEQ ID NO: 2703095 - protein, 24 aa, Entamoeba histolytica
HCNDFRLTPMWNYLTQLQIKEQFE

SEQ ID NO: 2703096 - protein, 19 aa, Entamoeba histolytica
HCRRCGKVFCGSCCVDSVL

SEQ ID NO: 2703097 - protein, 17 aa, Entamoeba histolytica
HDIAIKIALRIGIEDLS

SEQ ID NO: 2703098 - protein, 17 aa, Entamoeba histolytica
HDLKELFSIGGTPPQTH

SEQ ID NO: 2703099 - protein, 22 aa, Entamoeba histolytica
HDTKLPAVFFIFSRKLVMDYAK

SEQ ID NO: 2703100 - protein, 19 aa, Entamoeba histolytica
HEECIKKICINNNENYIDL

SEQ ID NO: 2703101 - protein, 17 aa, Entamoeba histolytica
HEPCLMCGMALLHSRFG

SEQ ID NO: 2703102 - protein, 18 aa, Entamoeba histolytica
HGCKRILFKFNKFDETVE

SEQ ID NO: 2703103 - protein, 17 aa, Entamoeba histolytica
HGEWCWMCRGDWKTHGT

SEQ ID NO: 2703104 - protein, 19 aa, Entamoeba histolytica
HHIPSIFGLMILFDTNGFP

SEQ ID NO: 2703105 - protein, 22 aa, Entamoeba histolytica
HHQKRFKVFIAHDGIFNTEEQY

SEQ ID NO: 2703106 - protein, 22 aa, Entamoeba histolytica
HIELRSGFIFIYEMIKSSNMKL

SEQ ID NO: 2703107 - protein, 19 aa, Entamoeba histolytica
HIFCSYCAQKAWLNGNYKC

SEQ ID NO: 2703108 - protein, 21 aa, Entamoeba histolytica
HIKGYLQKRIELIEKEIEKDI

SEQ ID NO: 2703109 - protein, 17 aa, Entamoeba histolytica
HIKRVCVIYSLEHSELQ

SEQ ID NO: 2703110 - protein, 19 aa, Entamoeba histolytica
HIPKFCGVSSLTIRSFISS

SEQ ID NO: 2703111 - protein, 21 aa, Entamoeba histolytica
HIRFLVCIKFLKATKCSGLPV

SEQ ID NO: 2703112 - protein, 23 aa, Entamoeba histolytica
HKKRLSFLGRKSFSKRNSTENTG

SEQ ID NO: 2703113 - protein, 18 aa, Entamoeba histolytica
HKMEILPLIIIVTTLFEM

SEQ ID NO: 2703114 - protein, 18 aa, Entamoeba histolytica
HKTTRLVRVSSLTFGSKT

SEQ ID NO: 2703115 - protein, 26 aa, Entamoeba histolytica
HKTWFTRLLLSQAFQCFLSINSVNAE

SEQ ID NO: 2703116 - protein, 21 aa, Entamoeba histolytica
HLAWLSFLLYKSFKDSSEKSD

SEQ ID NO: 2703117 - protein, 21 aa, Entamoeba histolytica
HLCELRGTLDFSLPEEVIGTI

SEQ ID NO: 2703118 - protein, 18 aa, Entamoeba histolytica
HLFCKSCLTIVLTSSDKT

SEQ ID NO: 2703119 - protein, 19 aa, Entamoeba histolytica
HLIDCLKYIYSVKEQCELL

SEQ ID NO: 2703120 - protein, 19 aa, Entamoeba histolytica
HLIVYDVNKRWGWKEIETS

SEQ ID NO: 2703121 - protein, 20 aa, Entamoeba histolytica
HLKRTGGIYVTRFPPEPNGY

SEQ ID NO: 2703122 - protein, 18 aa, Entamoeba histolytica
HLLALCGRITNCPESKMD

SEQ ID NO: 2703123 - protein, 17 aa, Entamoeba histolytica
HLLRGCGYLGSLAIICA

SEQ ID NO: 2703124 - protein, 19 aa, Entamoeba histolytica
HLVPRGSVCDFTFIPYSSI

SEQ ID NO: 2703125 - protein, 24 aa, Entamoeba histolytica
HLYKCPSCGFGVCSDCLKKGPTCR

SEQ ID NO: 2703126 - protein, 24 aa, Entamoeba histolytica
HNTLKCPACLGVTGGLFSRFKRGE

SEQ ID NO: 2703127 - protein, 25 aa, Entamoeba histolytica
HPKLFWRYILELLLLCELKVVKVYC

SEQ ID NO: 2703128 - protein, 18 aa, Entamoeba histolytica
HPLRCLRKSLFITQQRQW

SEQ ID NO: 2703129 - protein, 25 aa, Entamoeba histolytica
HPQGICNRTKFMLMDLIDLRDLNWA

SEQ ID NO: 2703130 - protein, 17 aa, Entamoeba histolytica
HPSRIIFISGIDRNEYE

SEQ ID NO: 2703131 - protein, 24 aa, Entamoeba histolytica
HQIDELYLRMAITSFEDLQPDLVA

SEQ ID NO: 2703132 - protein, 17 aa, Entamoeba histolytica
HQMKASSLFFVLDDIGN

SEQ ID NO: 2703133 - protein, 23 aa, Entamoeba histolytica
HRALCSRLSLFISSIQIQILPLS

SEQ ID NO: 2703134 - protein, 21 aa, Entamoeba histolytica
HRFRMYFKKEIEIITKHIYFF

SEQ ID NO: 2703135 - protein, 18 aa, Entamoeba histolytica
HRLPFPVNLVWQLTVAMQ

SEQ ID NO: 2703136 - protein, 19 aa, Entamoeba histolytica
HSFCKECIFEYILTSMKEN

SEQ ID NO: 2703137 - protein, 17 aa, Entamoeba histolytica
HSFEILDAVAFSKEVLP

SEQ ID NO: 2703138 - protein, 18 aa, Entamoeba histolytica
HSGYDFGYMLKLLTCEKL

SEQ ID NO: 2703139 - protein, 19 aa, Entamoeba histolytica
HSKCKFPYPKIIKTPFQSM

SEQ ID NO: 2703140 - protein, 27 aa, Entamoeba histolytica
HSLGGLYFRLAIPILFNRNIFNNSNYI

SEQ ID NO: 2703141 - protein, 18 aa, Entamoeba histolytica
HSRRGIGIFSKFSKSNDL

SEQ ID NO: 2703142 - protein, 24 aa, Entamoeba histolytica
HTCPQRIGIMLSFFLEALTRNDKV

SEQ ID NO: 2703143 - protein, 24 aa, Entamoeba histolytica
HTIQWARDRFEGFFKTEIEPVKNY

SEQ ID NO: 2703144 - protein, 17 aa, Entamoeba histolytica
HTLRLLDHFVFHNHVCI

SEQ ID NO: 2703145 - protein, 23 aa, Entamoeba histolytica
HTRYCPKCGYAIIGTRKTPRIVC

SEQ ID NO: 2703146 - protein, 17 aa, Entamoeba histolytica
HVSRIIIIFNMVYPEDL

SEQ ID NO: 2703147 - protein, 24 aa, Entamoeba histolytica
HWICPHSRYYCCVCHQIVADQPQR

SEQ ID NO: 2703148 - protein, 17 aa, Entamoeba histolytica
HYCDRAGIIVIRVGSTF

SEQ ID NO: 2703149 - protein, 21 aa, Entamoeba histolytica
HYCPSCKHLLEAGWMDNCLHT

SEQ ID NO: 2703150 - protein, 17 aa, Entamoeba histolytica
HYFCFGISSLIKLLQSV

SEQ ID NO: 2703151 - protein, 19 aa, Entamoeba histolytica
HYLMNWKKSLLLVSHDTSF

SEQ ID NO: 2703152 - protein, 17 aa, Entamoeba histolytica
HYLYCGMLIYLLQFNKE

SEQ ID NO: 2703153 - protein, 17 aa, Entamoeba histolytica
HYRMIEFNKPVKMNTFI

SEQ ID NO: 2703154 - protein, 18 aa, Entamoeba histolytica
IAAELILGIPIFPGSSEY

SEQ ID NO: 2703155 - protein, 17 aa, Entamoeba histolytica
IAAFVRRLADETGHLGT

SEQ ID NO: 2703156 - protein, 21 aa, Entamoeba histolytica
IAALIIRYSIQFNLLLSYLKP

SEQ ID NO: 2703157 - protein, 20 aa, Entamoeba histolytica
IADACLRSSAAVGYYPPYQG

SEQ ID NO: 2703158 - protein, 27 aa, Entamoeba histolytica
IADRKRLRIGFKLVFEFEKNEWFEETE

SEQ ID NO: 2703159 - protein, 17 aa, Entamoeba histolytica
IAFMAIRTFFAKKRPIL

SEQ ID NO: 2703160 - protein, 20 aa, Entamoeba histolytica
IAIKFRPSWYYNEVSKQLEW

SEQ ID NO: 2703161 - protein, 25 aa, Entamoeba histolytica
IAKYCNANAFFKYDCFEDKIMVSSA

SEQ ID NO: 2703162 - protein, 17 aa, Entamoeba histolytica
IAQAIYIRWKTKKLINE

SEQ ID NO: 2703163 - protein, 22 aa, Entamoeba histolytica
IAQDPWIEWGKILNLRCMENQK

SEQ ID NO: 2703164 - protein, 23 aa, Entamoeba histolytica
IARECECFGCFGIPLDIAVQRGE

SEQ ID NO: 2703165 - protein, 19 aa, Entamoeba histolytica
ICATLPVLCEGGIAENEHL

SEQ ID NO: 2703166 - protein, 22 aa, Entamoeba histolytica
ICFSSSCSLILFYYLPNNYPFE

SEQ ID NO: 2703167 - protein, 19 aa, Entamoeba histolytica
ICGGGCVEMELSLAVEEAA

SEQ ID NO: 2703168 - protein, 20 aa, Entamoeba histolytica
ICKAHGLGVMFTCKFYDRFI

SEQ ID NO: 2703169 - protein, 18 aa, Entamoeba histolytica
ICLYFDCTFLKKSYLTTK

SEQ ID NO: 2703170 - protein, 17 aa, Entamoeba histolytica
ICNFGEFIVAVCANSAF

SEQ ID NO: 2703171 - protein, 20 aa, Entamoeba histolytica
ICNNNIWLAMPMFNQIGIVS

SEQ ID NO: 2703172 - protein, 18 aa, Entamoeba histolytica
ICQFNLRCLEFLKSYISR

SEQ ID NO: 2703173 - protein, 21 aa, Entamoeba histolytica
ICSCTEKILFICESCNERMGM

SEQ ID NO: 2703174 - protein, 20 aa, Entamoeba histolytica
ICVNCVSLLTKMWYPTGKNI

SEQ ID NO: 2703175 - protein, 19 aa, Entamoeba histolytica
IDAALDFRNVSIIAHYIKE

SEQ ID NO: 2703176 - protein, 20 aa, Entamoeba histolytica
IDCMRFFFSLCDVDNDNALN

SEQ ID NO: 2703177 - protein, 24 aa, Entamoeba histolytica
IDCVWLIKTLETFKVIKFGFEEEN

SEQ ID NO: 2703178 - protein, 19 aa, Entamoeba histolytica
IDDAFALPYGRYNVEVTQL

SEQ ID NO: 2703179 - protein, 25 aa, Entamoeba histolytica
IDEIKESFTAFKTEMDKMADIEETW

SEQ ID NO: 2703180 - protein, 18 aa, Entamoeba histolytica
IDIIKVFKIMWAKNSPKK

SEQ ID NO: 2703181 - protein, 24 aa, Entamoeba histolytica
IDIPRCPKCGGLIKLDVVLFGEQL

SEQ ID NO: 2703182 - protein, 18 aa, Entamoeba histolytica
IDKCPKCGGDELVCKIKT

SEQ ID NO: 2703183 - protein, 17 aa, Entamoeba histolytica
IDKKCSLCIEVKRVKTL

SEQ ID NO: 2703184 - protein, 19 aa, Entamoeba histolytica
IDLCILLGCDYCETIKGVG

SEQ ID NO: 2703185 - protein, 20 aa, Entamoeba histolytica
IDLLKRIFLIASRPDRQNDR

SEQ ID NO: 2703186 - protein, 20 aa, Entamoeba histolytica
IDLLPILPIEQWKSTSSFVK

SEQ ID NO: 2703187 - protein, 17 aa, Entamoeba histolytica
IDLLTLILYKGEYSFFK

SEQ ID NO: 2703188 - protein, 17 aa, Entamoeba histolytica
IDLWKKLRERAGIIRDE

SEQ ID NO: 2703189 - protein, 18 aa, Entamoeba histolytica
IDMKKIMIAGKMCYISDP

SEQ ID NO: 2703190 - protein, 19 aa, Entamoeba histolytica
IDPALLLKHAQRVMVDEPE

SEQ ID NO: 2703191 - protein, 18 aa, Entamoeba histolytica
IDPAMLRPGRLDRLISVD

SEQ ID NO: 2703192 - protein, 17 aa, Entamoeba histolytica
IDPQISVFWGWKEGGKV

SEQ ID NO: 2703193 - protein, 18 aa, Entamoeba histolytica
IDRIKIFLTKTLNGKANL

SEQ ID NO: 2703194 - protein, 17 aa, Entamoeba histolytica
IDSKFNYKELFGDVKNR

SEQ ID NO: 2703195 - protein, 19 aa, Entamoeba histolytica
IDSKFNYKELFGDVKNRKH

SEQ ID NO: 2703196 - protein, 21 aa, Entamoeba histolytica
IDWFGRFGIEVGDFKTSFNDG

SEQ ID NO: 2703197 - protein, 17 aa, Entamoeba histolytica
IECEKCGWVMFQSDKKS

SEQ ID NO: 2703198 - protein, 18 aa, Entamoeba histolytica
IECGWVLINALEKVDSMG

SEQ ID NO: 2703199 - protein, 18 aa, Entamoeba histolytica
IECLYQIHCDEFFQCELE

SEQ ID NO: 2703200 - protein, 18 aa, Entamoeba histolytica
IEECLKHKVHFEFRGTRS

SEQ ID NO: 2703201 - protein, 17 aa, Entamoeba histolytica
IEEILPLLPLDWELGEF

SEQ ID NO: 2703202 - protein, 19 aa, Entamoeba histolytica
IEEMKRKVVCITFSTKEKT

SEQ ID NO: 2703203 - protein, 22 aa, Entamoeba histolytica
IEESLRLKVKYALKLSTGKRDL

SEQ ID NO: 2703204 - protein, 19 aa, Entamoeba histolytica
IEFFIAMACLNHYILFKKL

SEQ ID NO: 2703205 - protein, 21 aa, Entamoeba histolytica
IEFRKRFAFIDYMMFEYRKNI

SEQ ID NO: 2703206 - protein, 18 aa, Entamoeba histolytica
IEGILDYLISVTMFDSKR

SEQ ID NO: 2703207 - protein, 23 aa, Entamoeba histolytica
IEGKFNCCWKVTVKDIRIIVWQM

SEQ ID NO: 2703208 - protein, 17 aa, Entamoeba histolytica
IEGWRIALKAAQEKLET

SEQ ID NO: 2703209 - protein, 17 aa, Entamoeba histolytica
IEIAQAIYIRWKTKKLI

SEQ ID NO: 2703210 - protein, 17 aa, Entamoeba histolytica
IEICSNCYHLLGEMDLS

SEQ ID NO: 2703211 - protein, 17 aa, Entamoeba histolytica
IEIKLSFILLTLKNLNI

SEQ ID NO: 2703212 - protein, 20 aa, Entamoeba histolytica
IEIPKLPWGLGMANKTIRGG

SEQ ID NO: 2703213 - protein, 23 aa, Entamoeba histolytica
IEKEIYSIISIIWERGINDCTNK

SEQ ID NO: 2703214 - protein, 18 aa, Entamoeba histolytica
IEKTKMGIQLDRKKTDTG

SEQ ID NO: 2703215 - protein, 19 aa, Entamoeba histolytica
IELCIYLLLAVVIEKLPLP

SEQ ID NO: 2703216 - protein, 18 aa, Entamoeba histolytica
IELGHGFKIGMDGKGEFS

SEQ ID NO: 2703217 - protein, 19 aa, Entamoeba histolytica
IELKIPFGLNQPSNVQSFL

SEQ ID NO: 2703218 - protein, 18 aa, Entamoeba histolytica
IELNQIWETLPFYLDEDK

SEQ ID NO: 2703219 - protein, 25 aa, Entamoeba histolytica
IEMFKILLFPLEWVCISITLLPRIL

SEQ ID NO: 2703220 - protein, 18 aa, Entamoeba histolytica
IEMFLDFNIVDWNCTGNY

SEQ ID NO: 2703221 - protein, 18 aa, Entamoeba histolytica
IEMFSIRYAECMNEKINE

SEQ ID NO: 2703222 - protein, 18 aa, Entamoeba histolytica
IEMNGGVVFGMFGVKRVN

SEQ ID NO: 2703223 - protein, 28 aa, Entamoeba histolytica
IEPEFKSPIYIDAFKLSMPYLFDKLQTA

SEQ ID NO: 2703224 - protein, 19 aa, Entamoeba histolytica
IEPFKSFKIQHEIECMAFS

SEQ ID NO: 2703225 - protein, 21 aa, Entamoeba histolytica
IEPLPRFAIGIAQTRGVRENM

SEQ ID NO: 2703226 - protein, 25 aa, Entamoeba histolytica
IERLYKIAICLSEKVEIEQEKIGMY

SEQ ID NO: 2703227 - protein, 23 aa, Entamoeba histolytica
IERMKEYFLSFFIKQEPSFDTKT

SEQ ID NO: 2703228 - protein, 18 aa, Entamoeba histolytica
IERYRVPKEFVIDSTKYV

SEQ ID NO: 2703229 - protein, 17 aa, Entamoeba histolytica
IESFKFEKCVGVVATVS

SEQ ID NO: 2703230 - protein, 17 aa, Entamoeba histolytica
IETLRFILVMDFPGKCG

SEQ ID NO: 2703231 - protein, 20 aa, Entamoeba histolytica
IEVFCGLSFAETTGFCCLNR

SEQ ID NO: 2703232 - protein, 19 aa, Entamoeba histolytica
IFDECARKLFNMSADEMNV

SEQ ID NO: 2703233 - protein, 18 aa, Entamoeba histolytica
IFDGCSWGWVGDGLQPGF

SEQ ID NO: 2703234 - protein, 23 aa, Entamoeba histolytica
IFGSLLLKFNIYGGWTFIYQILY

SEQ ID NO: 2703235 - protein, 24 aa, Entamoeba histolytica
IFHFFKSDIELFKWNIEQTEYLSK

SEQ ID NO: 2703236 - protein, 24 aa, Entamoeba histolytica
IFIDLSWRLDIVLAYKNVYKLIQP

SEQ ID NO: 2703237 - protein, 18 aa, Entamoeba histolytica
IFIELCIRYYSIVSLESK

SEQ ID NO: 2703238 - protein, 17 aa, Entamoeba histolytica
IFKARCISFDYPGYGLN

SEQ ID NO: 2703239 - protein, 17 aa, Entamoeba histolytica
IFKFLWKIKCMSISIDK

SEQ ID NO: 2703240 - protein, 21 aa, Entamoeba histolytica
IFKRLFRVYAHMFYNHMEHLE

SEQ ID NO: 2703241 - protein, 24 aa, Entamoeba histolytica
IFKYNPRIGFDFACSEISFASLLG

SEQ ID NO: 2703242 - protein, 19 aa, Entamoeba histolytica
IFLRMDIRTELICLGAEKF

SEQ ID NO: 2703243 - protein, 20 aa, Entamoeba histolytica
IFNIPFTWKEHDVLEYFKEF

SEQ ID NO: 2703244 - protein, 25 aa, Entamoeba histolytica
IFPSRWKVGEALVLEFVSSTKVAFS

SEQ ID NO: 2703245 - protein, 23 aa, Entamoeba histolytica
IFREGYLLFFRICDVYFEELSKN

SEQ ID NO: 2703246 - protein, 19 aa, Entamoeba histolytica
IFRLLPGMCQSLLLRIIFL

SEQ ID NO: 2703247 - protein, 18 aa, Entamoeba histolytica
IFRQIAFDIISFIINQSV

SEQ ID NO: 2703248 - protein, 18 aa, Entamoeba histolytica
IFSLTRFNLITGLLSIEL

SEQ ID NO: 2703249 - protein, 18 aa, Entamoeba histolytica
IFSSITIYFGRDIDQQNR

SEQ ID NO: 2703250 - protein, 23 aa, Entamoeba histolytica
IFTDLRSGLALIKLMEKLTGKTL

SEQ ID NO: 2703251 - protein, 17 aa, Entamoeba histolytica
IFYVEKIIGSWAVVVVD

SEQ ID NO: 2703252 - protein, 19 aa, Entamoeba histolytica
IGAPRLVGFMSLGGGNVQQ

SEQ ID NO: 2703253 - protein, 19 aa, Entamoeba histolytica
IGCDCCFYIRSNCPCHVPS

SEQ ID NO: 2703254 - protein, 17 aa, Entamoeba histolytica
IGCLFAFENNKFSVFTE

SEQ ID NO: 2703255 - protein, 18 aa, Entamoeba histolytica
IGDEGFLIAKFCKQPKNL

SEQ ID NO: 2703256 - protein, 22 aa, Entamoeba histolytica
IGFRGSYEFSDWVYDFKLFTES

SEQ ID NO: 2703257 - protein, 19 aa, Entamoeba histolytica
IGFYFSIQSIKEWEWISVG

SEQ ID NO: 2703258 - protein, 17 aa, Entamoeba histolytica
IGGKISIESTWNCNIKK

SEQ ID NO: 2703259 - protein, 28 aa, Entamoeba histolytica
IGHSLGGLYLRFAIPILFKRGIFNNLNW

SEQ ID NO: 2703260 - protein, 19 aa, Entamoeba histolytica
IGIIADGCGWGFRSKKASS

SEQ ID NO: 2703261 - protein, 17 aa, Entamoeba histolytica
IGKIEWKDVDVRNINFD

SEQ ID NO: 2703262 - protein, 17 aa, Entamoeba histolytica
IGKIEWKKNIFDLLEKQ

SEQ ID NO: 2703263 - protein, 17 aa, Entamoeba histolytica
IGLCWSFLFGEEGLQLN

SEQ ID NO: 2703264 - protein, 17 aa, Entamoeba histolytica
IGMEECITVFTLSSIID

SEQ ID NO: 2703265 - protein, 17 aa, Entamoeba histolytica
IGQGNVCYVEFGGPVPP

SEQ ID NO: 2703266 - protein, 18 aa, Entamoeba histolytica
IGSFCVLDSIKIESSPTF

SEQ ID NO: 2703267 - protein, 18 aa, Entamoeba histolytica
IGVQFGLRKKGRLLIGDE

SEQ ID NO: 2703268 - protein, 19 aa, Entamoeba histolytica
IHFYYRFLIILTNHRMYIY

SEQ ID NO: 2703269 - protein, 20 aa, Entamoeba histolytica
IHIVWRKRRVIVFTDENRGL

SEQ ID NO: 2703270 - protein, 17 aa, Entamoeba histolytica
IHLIDALIRFIRKKELQ

SEQ ID NO: 2703271 - protein, 17 aa, Entamoeba histolytica
IHLKRFGNSNGYSRDKI

SEQ ID NO: 2703272 - protein, 17 aa, Entamoeba histolytica
IHLLFPIALKYSLIQSS

SEQ ID NO: 2703273 - protein, 19 aa, Entamoeba histolytica
IHLLTCGDLGINCDDYVRR

SEQ ID NO: 2703274 - protein, 23 aa, Entamoeba histolytica
IHPLATPCLFSFNANNYYFSLSI

SEQ ID NO: 2703275 - protein, 19 aa, Entamoeba histolytica
IHQCLPKDFSPVCGFMGMI

SEQ ID NO: 2703276 - protein, 19 aa, Entamoeba histolytica
IICAIGFKKIEGITVDQRS

SEQ ID NO: 2703277 - protein, 26 aa, Entamoeba histolytica
IICFKRMSRGYACCHCIEEHQDITDE

SEQ ID NO: 2703278 - protein, 18 aa, Entamoeba histolytica
IICRRGSYIFGVFVAESF

SEQ ID NO: 2703279 - protein, 21 aa, Entamoeba histolytica
IIDHLEVIEGIPFVGYHTRKH

SEQ ID NO: 2703280 - protein, 18 aa, Entamoeba histolytica
IIDLLGKVYFSFELNNSL

SEQ ID NO: 2703281 - protein, 17 aa, Entamoeba histolytica
IIECIILIGSIINVFMN

SEQ ID NO: 2703282 - protein, 17 aa, Entamoeba histolytica
IIEFDFGKKLALLSGKK

SEQ ID NO: 2703283 - protein, 19 aa, Entamoeba histolytica
IIEKGCSIQKLLARNNEIS

SEQ ID NO: 2703284 - protein, 18 aa, Entamoeba histolytica
IIELLPLYIELLEHWYNK

SEQ ID NO: 2703285 - protein, 17 aa, Entamoeba histolytica
IIFAFNFFKGIGLVELA

SEQ ID NO: 2703286 - protein, 18 aa, Entamoeba histolytica
IIIDESWRKYAVDSLHKL

SEQ ID NO: 2703287 - protein, 17 aa, Entamoeba histolytica
IIKCSYCSTPFFVGTEK

SEQ ID NO: 2703288 - protein, 19 aa, Entamoeba histolytica
IIKFIMLLFESFILNKVKV

SEQ ID NO: 2703289 - protein, 18 aa, Entamoeba histolytica
IIKGVCELCSSIINGNSV

SEQ ID NO: 2703290 - protein, 24 aa, Entamoeba histolytica
IIKSNELWKKWIIQPQIDQVIKEI

SEQ ID NO: 2703291 - protein, 20 aa, Entamoeba histolytica
IIKVLRIVLIIGEKYKSNNE

SEQ ID NO: 2703292 - protein, 23 aa, Entamoeba histolytica
IILKEYFVHYSFMISYYAPCELN

SEQ ID NO: 2703293 - protein, 19 aa, Entamoeba histolytica
IILPRGLTFFDCLSIQKSW

SEQ ID NO: 2703294 - protein, 25 aa, Entamoeba histolytica
IINFVYKCAYSFINDISIIIPSVPI

SEQ ID NO: 2703295 - protein, 23 aa, Entamoeba histolytica
IIPGEFWLYYVIDVNKHKEEYLK

SEQ ID NO: 2703296 - protein, 17 aa, Entamoeba histolytica
IIPIFVFDGATLPSKKG

SEQ ID NO: 2703297 - protein, 18 aa, Entamoeba histolytica
IIPLKMRCNEVFGVPLSV

SEQ ID NO: 2703298 - protein, 17 aa, Entamoeba histolytica
IIPLMGICDDEFIKMIM

SEQ ID NO: 2703299 - protein, 17 aa, Entamoeba histolytica
IIQRICLYWLRYDESTE

SEQ ID NO: 2703300 - protein, 18 aa, Entamoeba histolytica
IIRCASWLIHVCSTKNET

SEQ ID NO: 2703301 - protein, 20 aa, Entamoeba histolytica
IISCYCYGKLIPKYSKSLSL

SEQ ID NO: 2703302 - protein, 22 aa, Entamoeba histolytica
IISFLRIIRLVTRYTKTNPDII

SEQ ID NO: 2703303 - protein, 18 aa, Entamoeba histolytica
IISYVPWWTIVEMANNIF

SEQ ID NO: 2703304 - protein, 18 aa, Entamoeba histolytica
IITAIRFVICSSAQYDIS

SEQ ID NO: 2703305 - protein, 22 aa, Entamoeba histolytica
IIVHCIRCVFYIGRNKTGLIKM

SEQ ID NO: 2703306 - protein, 17 aa, Entamoeba histolytica
IIYDIFKYLPIKRQIVL

SEQ ID NO: 2703307 - protein, 17 aa, Entamoeba histolytica
IKAAIVLYKETPPIIEI

SEQ ID NO: 2703308 - protein, 18 aa, Entamoeba histolytica
IKAGLTFSFAVEQIAIDK

SEQ ID NO: 2703309 - protein, 17 aa, Entamoeba histolytica
IKCKEYYLLLSTSSNKL

SEQ ID NO: 2703310 - protein, 18 aa, Entamoeba histolytica
IKCLLQLKMNDVLTAENE

SEQ ID NO: 2703311 - protein, 22 aa, Entamoeba histolytica
IKCSSCKEILEGVCDCVLQLIS

SEQ ID NO: 2703312 - protein, 17 aa, Entamoeba histolytica
IKDLLRLGAEMLPQDYL

SEQ ID NO: 2703313 - protein, 17 aa, Entamoeba histolytica
IKDSWGIDDFYHSLMDL

SEQ ID NO: 2703314 - protein, 18 aa, Entamoeba histolytica
IKEGTAFIVVKNRVPYIS

SEQ ID NO: 2703315 - protein, 23 aa, Entamoeba histolytica
IKELKRVYPFASIIVLGNKLDLA

SEQ ID NO: 2703316 - protein, 21 aa, Entamoeba histolytica
IKESYWYLGLLYEYGAGVIQN

SEQ ID NO: 2703317 - protein, 17 aa, Entamoeba histolytica
IKFCLDAAKGIEYLHSN

SEQ ID NO: 2703318 - protein, 20 aa, Entamoeba histolytica
IKGFPSILAVDVFKEYTQLK

SEQ ID NO: 2703319 - protein, 18 aa, Entamoeba histolytica
IKGKRFNSDLVRFNVFKD

SEQ ID NO: 2703320 - protein, 17 aa, Entamoeba histolytica
IKGSFKLSVRRERSKTA

SEQ ID NO: 2703321 - protein, 17 aa, Entamoeba histolytica
IKHFCPNAPFLLAATKT

SEQ ID NO: 2703322 - protein, 22 aa, Entamoeba histolytica
IKIKEIFDAFCFGNADIQNILI

SEQ ID NO: 2703323 - protein, 17 aa, Entamoeba histolytica
IKINFSFEIKQIKNKLI

SEQ ID NO: 2703324 - protein, 21 aa, Entamoeba histolytica
IKKDCYKTMMFWNQPNELDAV

SEQ ID NO: 2703325 - protein, 18 aa, Entamoeba histolytica
IKKFKVAVIFSYVGRGYF

SEQ ID NO: 2703326 - protein, 18 aa, Entamoeba histolytica
IKKGMGLERFFRITTDMS

SEQ ID NO: 2703327 - protein, 19 aa, Entamoeba histolytica
IKKMIEWGRGLKLINTEEI

SEQ ID NO: 2703328 - protein, 22 aa, Entamoeba histolytica
IKKMLLEFVEFQGQFISFTNED

SEQ ID NO: 2703329 - protein, 18 aa, Entamoeba histolytica
IKKPKLRAVMSILKGDVK

SEQ ID NO: 2703330 - protein, 18 aa, Entamoeba histolytica
IKLAFKFGCHAIDQLLNK

SEQ ID NO: 2703331 - protein, 20 aa, Entamoeba histolytica
IKLFPSLIFKSSKCVFGGNI

SEQ ID NO: 2703332 - protein, 17 aa, Entamoeba histolytica
IKLKEMMLFTVEISEIK

SEQ ID NO: 2703333 - protein, 22 aa, Entamoeba histolytica
IKLKKSCFFNCLALKEACQTVP

SEQ ID NO: 2703334 - protein, 25 aa, Entamoeba histolytica
IKLNPRVANFFACRAQYYNKAKKPN

SEQ ID NO: 2703335 - protein, 17 aa, Entamoeba histolytica
IKLRFTVRYDLLLTIFC

SEQ ID NO: 2703336 - protein, 17 aa, Entamoeba histolytica
IKMKLLFPPKVDSEEWK

SEQ ID NO: 2703337 - protein, 22 aa, Entamoeba histolytica
IKMKRIKSISGFGVDYQTWKDI

SEQ ID NO: 2703338 - protein, 18 aa, Entamoeba histolytica
IKMSPSLICINKNREYLT

SEQ ID NO: 2703339 - protein, 19 aa, Entamoeba histolytica
IKNAMSFMFASLYEKIINI

SEQ ID NO: 2703340 - protein, 17 aa, Entamoeba histolytica
IKNCRGIYLKTIVRMKH

SEQ ID NO: 2703341 - protein, 20 aa, Entamoeba histolytica
IKNINEFICFALAIDHYQSD

SEQ ID NO: 2703342 - protein, 20 aa, Entamoeba histolytica
IKPMMMRCAKPMMMECAKPM

SEQ ID NO: 2703343 - protein, 17 aa, Entamoeba histolytica
IKREWSDDFDLFFQNKE

SEQ ID NO: 2703344 - protein, 23 aa, Entamoeba histolytica
IKRFWPGALTIIFPRNEAVPNEV

SEQ ID NO: 2703345 - protein, 22 aa, Entamoeba histolytica
IKRKCYIEYIFAYSVVDMNVMA

SEQ ID NO: 2703346 - protein, 17 aa, Entamoeba histolytica
IKSCVWASGSMIYPITD

SEQ ID NO: 2703347 - protein, 19 aa, Entamoeba histolytica
IKSEIPIHVFGTNKGSTNY

SEQ ID NO: 2703348 - protein, 20 aa, Entamoeba histolytica
IKSLRSSECINIFTKDIDPS

SEQ ID NO: 2703349 - protein, 19 aa, Entamoeba histolytica
IKTLIKINVFNAYYDLVEL

SEQ ID NO: 2703350 - protein, 21 aa, Entamoeba histolytica
IKVEGFWPIIMAKALTNANIE

SEQ ID NO: 2703351 - protein, 23 aa, Entamoeba histolytica
IKYGSYKKPTSWLKNSLGLNRKT

SEQ ID NO: 2703352 - protein, 18 aa, Entamoeba histolytica
IKYIYELILSPPLSDRFT

SEQ ID NO: 2703353 - protein, 21 aa, Entamoeba histolytica
IKYSIPLWLAIHFKQIGLCKI

SEQ ID NO: 2703354 - protein, 22 aa, Entamoeba histolytica
ILARCWLKFSYVYSFYSSEEGK

SEQ ID NO: 2703355 - protein, 17 aa, Entamoeba histolytica
ILDAVAFSKEVLPKYYK

SEQ ID NO: 2703356 - protein, 17 aa, Entamoeba histolytica
ILGCWDIKTNDCVIDSV

SEQ ID NO: 2703357 - protein, 18 aa, Entamoeba histolytica
ILHLKFDIGLLLRLILCL

SEQ ID NO: 2703358 - protein, 18 aa, Entamoeba histolytica
ILICYSRLYKGSDQTIIN

SEQ ID NO: 2703359 - protein, 17 aa, Entamoeba histolytica
ILKEYYFACAVCLVMYK

SEQ ID NO: 2703360 - protein, 17 aa, Entamoeba histolytica
ILKKICDPYAININELK

SEQ ID NO: 2703361 - protein, 21 aa, Entamoeba histolytica
ILKKRCNAVIYLLIRGGLKNE

SEQ ID NO: 2703362 - protein, 20 aa, Entamoeba histolytica
ILKNSWKLVLSIFDFNSSNR

SEQ ID NO: 2703363 - protein, 17 aa, Entamoeba histolytica
ILKWEVLGIQGGILANH

SEQ ID NO: 2703364 - protein, 17 aa, Entamoeba histolytica
ILLPFDFVACDKFGEDA

SEQ ID NO: 2703365 - protein, 17 aa, Entamoeba histolytica
ILMCYGIYDMETMYVQG

SEQ ID NO: 2703366 - protein, 18 aa, Entamoeba histolytica
ILMPILFEYFFKRKAFIE

SEQ ID NO: 2703367 - protein, 18 aa, Entamoeba histolytica
ILPIPFIVNYSFIIEIIG

SEQ ID NO: 2703368 - protein, 18 aa, Entamoeba histolytica
ILPNKLYGVFGMGESLEV

SEQ ID NO: 2703369 - protein, 18 aa, Entamoeba histolytica
ILPSHLFKITSLKKLILS

SEQ ID NO: 2703370 - protein, 21 aa, Entamoeba histolytica
ILRRIKLLYPHLWYDDICCVH

SEQ ID NO: 2703371 - protein, 18 aa, Entamoeba histolytica
ILSKEGDWWIGELNGQTG

SEQ ID NO: 2703372 - protein, 23 aa, Entamoeba histolytica
ILSKYRLGNCPVKMIDFTKWIKS

SEQ ID NO: 2703373 - protein, 18 aa, Entamoeba histolytica
ILSLIARLQFDMMEKETY

SEQ ID NO: 2703374 - protein, 17 aa, Entamoeba histolytica
ILVKRIIPLMGICDDEF

SEQ ID NO: 2703375 - protein, 22 aa, Entamoeba histolytica
ILYCIRKNFFLWLLENKPSSAL

SEQ ID NO: 2703376 - protein, 20 aa, Entamoeba histolytica
ILYRYCIGIGTLIIISQNYL

SEQ ID NO: 2703377 - protein, 18 aa, Entamoeba histolytica
IMEMCIDIPFVLRKPFGK

SEQ ID NO: 2703378 - protein, 23 aa, Entamoeba histolytica
IMGRRADYMWGLGYRKALMMEKL

SEQ ID NO: 2703379 - protein, 17 aa, Entamoeba histolytica
IMKEFLEDLLFEYGIIF

SEQ ID NO: 2703380 - protein, 18 aa, Entamoeba histolytica
IMLYWSFVHLFTICLESH

SEQ ID NO: 2703381 - protein, 18 aa, Entamoeba histolytica
IMSSYLLEKSRVVYQARE

SEQ ID NO: 2703382 - protein, 20 aa, Entamoeba histolytica
IMTRFCLLYSYFPLQETIDV

SEQ ID NO: 2703383 - protein, 17 aa, Entamoeba histolytica
INALNFIICLSDSHERV

SEQ ID NO: 2703384 - protein, 28 aa, Entamoeba histolytica
INDFCNYEWSLTCELSFLESLYQYGNNM

SEQ ID NO: 2703385 - protein, 20 aa, Entamoeba histolytica
INEFNHQYILFSYGKHDRYK

SEQ ID NO: 2703386 - protein, 21 aa, Entamoeba histolytica
INEFPKLQWFFLLNCTSPKQE

SEQ ID NO: 2703387 - protein, 23 aa, Entamoeba histolytica
INELKIQFGDFIPRNVRTQIKDL

SEQ ID NO: 2703388 - protein, 23 aa, Entamoeba histolytica
INELKLQFGDFIPRNVRTQIKDL

SEQ ID NO: 2703389 - protein, 22 aa, Entamoeba histolytica
INELKLQFGDFVPRNVRTQIRD

SEQ ID NO: 2703390 - protein, 19 aa, Entamoeba histolytica
INEWNEIRKWVGLSPCVGC

SEQ ID NO: 2703391 - protein, 18 aa, Entamoeba histolytica
INGFGFRNIREWIKKIKT

SEQ ID NO: 2703392 - protein, 17 aa, Entamoeba histolytica
INGRYGVDMSMKTIVQK

SEQ ID NO: 2703393 - protein, 18 aa, Entamoeba histolytica
INIIIFWHRLHLFNGEVI

SEQ ID NO: 2703394 - protein, 18 aa, Entamoeba histolytica
INIIWKLEGDNLIPAIMT

SEQ ID NO: 2703395 - protein, 17 aa, Entamoeba histolytica
INKCAFVAMKVMKKYHP

SEQ ID NO: 2703396 - protein, 19 aa, Entamoeba histolytica
INLRLPLKDLLVFFESALI

SEQ ID NO: 2703397 - protein, 18 aa, Entamoeba histolytica
INLSIRRCGIIVLNEVKE

SEQ ID NO: 2703398 - protein, 19 aa, Entamoeba histolytica
INQMKVLIINSIQKAKEEI

SEQ ID NO: 2703399 - protein, 18 aa, Entamoeba histolytica
INSLKLMFCRYLKLENPL

SEQ ID NO: 2703400 - protein, 17 aa, Entamoeba histolytica
INVSFVRFEMDFDNYND

SEQ ID NO: 2703401 - protein, 19 aa, Entamoeba histolytica
IPEIVPFRLTREILDPMGV

SEQ ID NO: 2703402 - protein, 18 aa, Entamoeba histolytica
IPENPIPVIEVKPVPTTT

SEQ ID NO: 2703403 - protein, 18 aa, Entamoeba histolytica
IPEQNEFFLTKGSKSDFD

SEQ ID NO: 2703404 - protein, 17 aa, Entamoeba histolytica
IPFEFFEDVLPLIITTL

SEQ ID NO: 2703405 - protein, 17 aa, Entamoeba histolytica
IPFKLKVFFYSKQTQEA

SEQ ID NO: 2703406 - protein, 22 aa, Entamoeba histolytica
IPFSYCFYKPLPLNKFGNLVNY

SEQ ID NO: 2703407 - protein, 23 aa, Entamoeba histolytica
IPGFPVNFLQYFQLFPSVFNTSM

SEQ ID NO: 2703408 - protein, 18 aa, Entamoeba histolytica
IPHEGAFCDLMWSDPDES

SEQ ID NO: 2703409 - protein, 20 aa, Entamoeba histolytica
IPIKGVVRPVLYTSLYNSTE

SEQ ID NO: 2703410 - protein, 21 aa, Entamoeba histolytica
IPILCYHFYFQVYPIHPEYTY

SEQ ID NO: 2703411 - protein, 24 aa, Entamoeba histolytica
IPILRFRILKDIKQLPGLYILMLL

SEQ ID NO: 2703412 - protein, 20 aa, Entamoeba histolytica
IPKFLVKVLVDFASTTFTIK

SEQ ID NO: 2703413 - protein, 18 aa, Entamoeba histolytica
IPKGLLATVGWEINGKIT

SEQ ID NO: 2703414 - protein, 20 aa, Entamoeba histolytica
IPKRFDCLVALNISATSIAT

SEQ ID NO: 2703415 - protein, 22 aa, Entamoeba histolytica
IPLDCPWYICYFMGRPQAHFVC

SEQ ID NO: 2703416 - protein, 17 aa, Entamoeba histolytica
IPLFSCICGNDFTKSLS

SEQ ID NO: 2703417 - protein, 19 aa, Entamoeba histolytica
IPLPSEWESPILVNECSID

SEQ ID NO: 2703418 - protein, 21 aa, Entamoeba histolytica
IPNCLGNIWVYVRDWSEEDGR

SEQ ID NO: 2703419 - protein, 22 aa, Entamoeba histolytica
IPPSQRISIHFGKIEKEQKEFT

SEQ ID NO: 2703420 - protein, 17 aa, Entamoeba histolytica
IPRYRLLLQELLKTLPP

SEQ ID NO: 2703421 - protein, 19 aa, Entamoeba histolytica
IPSGLCWGCVMLTEVILPS

SEQ ID NO: 2703422 - protein, 19 aa, Entamoeba histolytica
IPTERYCIIVPFEFNLEKL

SEQ ID NO: 2703423 - protein, 18 aa, Entamoeba histolytica
IPVARNFFKQLLSGVKYC

SEQ ID NO: 2703424 - protein, 17 aa, Entamoeba histolytica
IPYFSCLCGNDFTKSFN

SEQ ID NO: 2703425 - protein, 25 aa, Entamoeba histolytica
IPYLLCIICQVPVILPNYFDTIKEK

SEQ ID NO: 2703426 - protein, 17 aa, Entamoeba histolytica
IPYQLIESLGFDGNNIV

SEQ ID NO: 2703427 - protein, 18 aa, Entamoeba histolytica
IQAAKYWRQMIIKEMGQK

SEQ ID NO: 2703428 - protein, 20 aa, Entamoeba histolytica
IQCKCKRLFGKSLETYMKEN

SEQ ID NO: 2703429 - protein, 26 aa, Entamoeba histolytica
IQCKLPLLRKLSCCEFIPSEYITNLT

SEQ ID NO: 2703430 - protein, 18 aa, Entamoeba histolytica
IQCQILSLIGDFIIDQLL

SEQ ID NO: 2703431 - protein, 17 aa, Entamoeba histolytica
IQDCLNLLVSSWKNTES

SEQ ID NO: 2703432 - protein, 19 aa, Entamoeba histolytica
IQDSLRWNYSFSGIKFSEN

SEQ ID NO: 2703433 - protein, 19 aa, Entamoeba histolytica
IQFAFRWFNCCLIREFPIN

SEQ ID NO: 2703434 - protein, 18 aa, Entamoeba histolytica
IQGPYERYGMPIGTTGKR

SEQ ID NO: 2703435 - protein, 20 aa, Entamoeba histolytica
IQHFGRLGAFLFYLMSKTSE

SEQ ID NO: 2703436 - protein, 21 aa, Entamoeba histolytica
IQIHLRLLFALNFKEGCDPLP

SEQ ID NO: 2703437 - protein, 17 aa, Entamoeba histolytica
IQIIPWKNITSITISTT

SEQ ID NO: 2703438 - protein, 17 aa, Entamoeba histolytica
IQKKMLCKRNCSNKQKK

SEQ ID NO: 2703439 - protein, 17 aa, Entamoeba histolytica
IQKVCLNICSLLFEKID

SEQ ID NO: 2703440 - protein, 17 aa, Entamoeba histolytica
IQLGPSFAERIQLEKAI

SEQ ID NO: 2703441 - protein, 23 aa, Entamoeba histolytica
IQNELYESFSLCFSNELSQKQMK

SEQ ID NO: 2703442 - protein, 19 aa, Entamoeba histolytica
IQNSWIFGVGYGFHIRGED

SEQ ID NO: 2703443 - protein, 18 aa, Entamoeba histolytica
IQPRCCYECLISLECLKN

SEQ ID NO: 2703444 - protein, 17 aa, Entamoeba histolytica
IQPRISFIEVDIVKEVK

SEQ ID NO: 2703445 - protein, 27 aa, Entamoeba histolytica
IQQRYGIDFDLVFKIVKEFRVNKKKVG

SEQ ID NO: 2703446 - protein, 19 aa, Entamoeba histolytica
IQREWWYPLATSISGTEFK

SEQ ID NO: 2703447 - protein, 23 aa, Entamoeba histolytica
IRDLPIEIGELFNLEDLNLNNNQ

SEQ ID NO: 2703448 - protein, 17 aa, Entamoeba histolytica
IRENGGYVINDRTNGIL

SEQ ID NO: 2703449 - protein, 20 aa, Entamoeba histolytica
IRILSICLIKFDSILPSEEW

SEQ ID NO: 2703450 - protein, 17 aa, Entamoeba histolytica
IRKALKHSKKITIMINQ

SEQ ID NO: 2703451 - protein, 22 aa, Entamoeba histolytica
IRKIVLRKGCCLLPVECGGRIM

SEQ ID NO: 2703452 - protein, 17 aa, Entamoeba histolytica
IRMGKYFLEIDIMDLQN

SEQ ID NO: 2703453 - protein, 18 aa, Entamoeba histolytica
IRMRCLKCQKSSEVWTLR

SEQ ID NO: 2703454 - protein, 25 aa, Entamoeba histolytica
IRPVGCMRCALHVLGMFDNGNDIWL

SEQ ID NO: 2703455 - protein, 19 aa, Entamoeba histolytica
IRTLLSILSLLCITQKDIN

SEQ ID NO: 2703456 - protein, 18 aa, Entamoeba histolytica
IRVQLPFPLREKYHLLIT

SEQ ID NO: 2703457 - protein, 17 aa, Entamoeba histolytica
IRYVFKIPFNSLITLLA

SEQ ID NO: 2703458 - protein, 19 aa, Entamoeba histolytica
ISDIPRFGSLIIERMTIAE

SEQ ID NO: 2703459 - protein, 19 aa, Entamoeba histolytica
ISDMIWLKKLRVVSIECVI

SEQ ID NO: 2703460 - protein, 22 aa, Entamoeba histolytica
ISEFGEALDLFFYVLQQSAERV

SEQ ID NO: 2703461 - protein, 22 aa, Entamoeba histolytica
ISELRTAAFYVYFTIYQNYVID

SEQ ID NO: 2703462 - protein, 19 aa, Entamoeba histolytica
ISEPMGIVLYSFKGESPNE

SEQ ID NO: 2703463 - protein, 20 aa, Entamoeba histolytica
ISFKGSIPFLRKTSPMHLTH

SEQ ID NO: 2703464 - protein, 21 aa, Entamoeba histolytica
ISFKLKEMYYLLTQGGVAELE

SEQ ID NO: 2703465 - protein, 18 aa, Entamoeba histolytica
ISFLPRFSMFDFKLLASS

SEQ ID NO: 2703466 - protein, 20 aa, Entamoeba histolytica
ISFRYDWRTLLAVIRMHLPP

SEQ ID NO: 2703467 - protein, 18 aa, Entamoeba histolytica
ISGKQLLVLTGFLPILFN

SEQ ID NO: 2703468 - protein, 19 aa, Entamoeba histolytica
ISILLKFSYPICIETQIEN

SEQ ID NO: 2703469 - protein, 19 aa, Entamoeba histolytica
ISIPCVYLYPCVIPQEALN

SEQ ID NO: 2703470 - protein, 24 aa, Entamoeba histolytica
ISIQRLICIFAYFHVMIEMDEKTL

SEQ ID NO: 2703471 - protein, 17 aa, Entamoeba histolytica
ISIYKSAKWIGVEAIWK

SEQ ID NO: 2703472 - protein, 18 aa, Entamoeba histolytica
ISKLIAIAKFLSSLCIGG

SEQ ID NO: 2703473 - protein, 20 aa, Entamoeba histolytica
ISLIGAGGFGEVWKVRHKLM

SEQ ID NO: 2703474 - protein, 19 aa, Entamoeba histolytica
ISLITSWKHKPWICCFCKQ

SEQ ID NO: 2703475 - protein, 21 aa, Entamoeba histolytica
ISLKRNVCCTLSEEYEGISDL

SEQ ID NO: 2703476 - protein, 26 aa, Entamoeba histolytica
ISLRFPKKVKISLCFIKTIPEAINII

SEQ ID NO: 2703477 - protein, 17 aa, Entamoeba histolytica
ISMTDVMFCKKFLPERS

SEQ ID NO: 2703478 - protein, 21 aa, Entamoeba histolytica
ISRLEEYVKFFAATIKQSAPI

SEQ ID NO: 2703479 - protein, 21 aa, Entamoeba histolytica
ISRLQQFLDYYLKEVIELLPN

SEQ ID NO: 2703480 - protein, 18 aa, Entamoeba histolytica
ISRRAELTLSGFDEKCNG

SEQ ID NO: 2703481 - protein, 24 aa, Entamoeba histolytica
ISSGLKWVRFGAMCMAIANRRLNT

SEQ ID NO: 2703482 - protein, 19 aa, Entamoeba histolytica
ISSLLKLRHPFIIKLISVE

SEQ ID NO: 2703483 - protein, 20 aa, Entamoeba histolytica
ISSMRISICLRKVLDKYDSE

SEQ ID NO: 2703484 - protein, 21 aa, Entamoeba histolytica
ISTLIPLRFGAERCILIGDPQ

SEQ ID NO: 2703485 - protein, 22 aa, Entamoeba histolytica
ISYRIGDSFGIISFQTEPKLCQ

SEQ ID NO: 2703486 - protein, 17 aa, Entamoeba histolytica
ISYYNTRIEVLKTNIEM

SEQ ID NO: 2703487 - protein, 25 aa, Entamoeba histolytica
ITCDYCLPELLSLVAECITNDSMNS

SEQ ID NO: 2703488 - protein, 27 aa, Entamoeba histolytica
ITDKYRLAYLIACLRTFLKESIQRKII

SEQ ID NO: 2703489 - protein, 23 aa, Entamoeba histolytica
ITFAGNCLMSFPVALTNISSLSS

SEQ ID NO: 2703490 - protein, 18 aa, Entamoeba histolytica
ITFHFDLRLSNLLFNSIY

SEQ ID NO: 2703491 - protein, 19 aa, Entamoeba histolytica
ITGDLKIVLPMYCVDSVPD

SEQ ID NO: 2703492 - protein, 25 aa, Entamoeba histolytica
ITIEVSLCFACQFHLLRLLYYKNLS

SEQ ID NO: 2703493 - protein, 17 aa, Entamoeba histolytica
ITIPILFGLYLLKTGIR

SEQ ID NO: 2703494 - protein, 19 aa, Entamoeba histolytica
ITIRYAWISSQFVPSKKDK

SEQ ID NO: 2703495 - protein, 21 aa, Entamoeba histolytica
ITLIEWEMFKAIKPPELYAWN

SEQ ID NO: 2703496 - protein, 23 aa, Entamoeba histolytica
ITLPLKRSELFFSKLTQGAKGVL

SEQ ID NO: 2703497 - protein, 17 aa, Entamoeba histolytica
ITMAHCFRRNRENPEVE

SEQ ID NO: 2703498 - protein, 19 aa, Entamoeba histolytica
ITQGFKWVRSGGICEIVDN

SEQ ID NO: 2703499 - protein, 19 aa, Entamoeba histolytica
ITQICCADCEALLKDALIN

SEQ ID NO: 2703500 - protein, 23 aa, Entamoeba histolytica
ITSIPIKLSFTMGFAETHHYSHP

SEQ ID NO: 2703501 - protein, 19 aa, Entamoeba histolytica
ITVDMVIEWLCLNIPSRLL

SEQ ID NO: 2703502 - protein, 18 aa, Entamoeba histolytica
ITVGFPIKGYKEALVLDI

SEQ ID NO: 2703503 - protein, 18 aa, Entamoeba histolytica
ITVRIFNIPFTWKEHDVL

SEQ ID NO: 2703504 - protein, 20 aa, Entamoeba histolytica
IVACREFSVRLGNGFTTPPI

SEQ ID NO: 2703505 - protein, 17 aa, Entamoeba histolytica
IVAPLPKRVWQKKVESP

SEQ ID NO: 2703506 - protein, 17 aa, Entamoeba histolytica
IVDEWKSKVIIIDAKTG

SEQ ID NO: 2703507 - protein, 18 aa, Entamoeba histolytica
IVEEIKAAIVLYKETPPI

SEQ ID NO: 2703508 - protein, 17 aa, Entamoeba histolytica
IVFPSVFFFNGAGLQKV

SEQ ID NO: 2703509 - protein, 18 aa, Entamoeba histolytica
IVLFKWGQGKLRGEPINA

SEQ ID NO: 2703510 - protein, 17 aa, Entamoeba histolytica
IVLNGMMLISGRESSIV

SEQ ID NO: 2703511 - protein, 18 aa, Entamoeba histolytica
IVLVFLCDLEMEKVYNAF

SEQ ID NO: 2703512 - protein, 20 aa, Entamoeba histolytica
IVNILLRPCCFKFLHIPIQS

SEQ ID NO: 2703513 - protein, 20 aa, Entamoeba histolytica
IVQRFRLSFLALFKIITELC

SEQ ID NO: 2703514 - protein, 19 aa, Entamoeba histolytica
IVSKCFFLKVGKTFIKRYF

SEQ ID NO: 2703515 - protein, 21 aa, Entamoeba histolytica
IVSLPVLFPFQVTRLDLSQNL

SEQ ID NO: 2703516 - protein, 23 aa, Entamoeba histolytica
IVVKRLISAIGYLHSMNIVHRDL

SEQ ID NO: 2703517 - protein, 17 aa, Entamoeba histolytica
IWACGIMFYEMILRRSP

SEQ ID NO: 2703518 - protein, 17 aa, Entamoeba histolytica
IWALGCLLYELYTSKML

SEQ ID NO: 2703519 - protein, 19 aa, Entamoeba histolytica
IWEELKFKKCKIVDHDYII

SEQ ID NO: 2703520 - protein, 20 aa, Entamoeba histolytica
IWKSTYLINFSKFIQTNTNQ

SEQ ID NO: 2703521 - protein, 18 aa, Entamoeba histolytica
IWLFCFPDGLRLSEFPIE

SEQ ID NO: 2703522 - protein, 17 aa, Entamoeba histolytica
IWPRIVKLYHYIGNESD

SEQ ID NO: 2703523 - protein, 18 aa, Entamoeba histolytica
IWRYPPQYFYILLNPRFV

SEQ ID NO: 2703524 - protein, 19 aa, Entamoeba histolytica
IYAYELFNFYGVKRIIRIG

SEQ ID NO: 2703525 - protein, 19 aa, Entamoeba histolytica
IYEAKRFIGRRVKPNEIEN

SEQ ID NO: 2703526 - protein, 18 aa, Entamoeba histolytica
IYIKLPFYFERPFTDWTL

SEQ ID NO: 2703527 - protein, 17 aa, Entamoeba histolytica
IYKHWGLIWYTYHRTLK

SEQ ID NO: 2703528 - protein, 24 aa, Entamoeba histolytica
IYKMMKWWFDKGIDGFRMDVINLI

SEQ ID NO: 2703529 - protein, 20 aa, Entamoeba histolytica
IYKRMFRVYAHMFYSHMEHL

SEQ ID NO: 2703530 - protein, 19 aa, Entamoeba histolytica
IYKSAKWIGVEAIWKTKTK

SEQ ID NO: 2703531 - protein, 19 aa, Entamoeba histolytica
IYLPNCIQFIISSASIETC

SEQ ID NO: 2703532 - protein, 17 aa, Entamoeba histolytica
IYMRMSVTNFLELPPDV

SEQ ID NO: 2703533 - protein, 18 aa, Entamoeba histolytica
IYNCFFCYFNGSLQFWIV

SEQ ID NO: 2703534 - protein, 18 aa, Entamoeba histolytica
IYPHKRFYLKIQDIITQI

SEQ ID NO: 2703535 - protein, 17 aa, Entamoeba histolytica
IYRKTYCGFALSNAFDS

SEQ ID NO: 2703536 - protein, 17 aa, Entamoeba histolytica
IYTFASLICKIFTNQLP

SEQ ID NO: 2703537 - protein, 17 aa, Entamoeba histolytica
IYVPTFICNCFKEIMNS

SEQ ID NO: 2703538 - protein, 17 aa, Entamoeba histolytica
IYYWKYYLNLVLPQQMS

SEQ ID NO: 2703539 - protein, 17 aa, Entamoeba histolytica
KAAAVQIVMLGGEFIAQ

SEQ ID NO: 2703540 - protein, 23 aa, Entamoeba histolytica
KAAIDCWDVIAIIVREYAMTLDN

SEQ ID NO: 2703541 - protein, 20 aa, Entamoeba histolytica
KAALEALEILNGKTIEKVCV

SEQ ID NO: 2703542 - protein, 20 aa, Entamoeba histolytica
KADAIVAVFSFDDYKSFEDT

SEQ ID NO: 2703543 - protein, 20 aa, Entamoeba histolytica
KAESTDDFFLFGYNNYTNNP

SEQ ID NO: 2703544 - protein, 17 aa, Entamoeba histolytica
KAFKDTDWIGAIRMYSS

SEQ ID NO: 2703545 - protein, 22 aa, Entamoeba histolytica
KAFYDFLRRILVWNPHQRLRPI

SEQ ID NO: 2703546 - protein, 19 aa, Entamoeba histolytica
KAGFVLPNLRLFRGDNSNI

SEQ ID NO: 2703547 - protein, 19 aa, Entamoeba histolytica
KAIKLFDRWCEAVNEDNEK

SEQ ID NO: 2703548 - protein, 21 aa, Entamoeba histolytica
KAILRFKGINIPGGKALPKGY

SEQ ID NO: 2703549 - protein, 20 aa, Entamoeba histolytica
KALELCKSVTRRLFNSQCPL

SEQ ID NO: 2703550 - protein, 21 aa, Entamoeba histolytica
KALELWYNFYYLFEGIFNHSL

SEQ ID NO: 2703551 - protein, 19 aa, Entamoeba histolytica
KALIPRVDVLYEFYEFSNQ

SEQ ID NO: 2703552 - protein, 17 aa, Entamoeba histolytica
KALPFLQIRSINFGNGD

SEQ ID NO: 2703553 - protein, 20 aa, Entamoeba histolytica
KALRPLAWKIFLKIIKPQAS

SEQ ID NO: 2703554 - protein, 19 aa, Entamoeba histolytica
KAMWPRKGFYLGNFDIDYR

SEQ ID NO: 2703555 - protein, 18 aa, Entamoeba histolytica
KAPDWLVNWCFVEYVQYT

SEQ ID NO: 2703556 - protein, 20 aa, Entamoeba histolytica
KAPMILKCFLTFAERLNIDD

SEQ ID NO: 2703557 - protein, 17 aa, Entamoeba histolytica
KARCISFDYPGYGLNKN

SEQ ID NO: 2703558 - protein, 23 aa, Entamoeba histolytica
KARQAAPCVLFFDELDSIGRARG

SEQ ID NO: 2703559 - protein, 22 aa, Entamoeba histolytica
KASECYDLLYGQEMVETVRQCY

SEQ ID NO: 2703560 - protein, 18 aa, Entamoeba histolytica
KAVYCTVCNIYLHEKKCI

SEQ ID NO: 2703561 - protein, 18 aa, Entamoeba histolytica
KCDLGDFVLLCLQTLNKD

SEQ ID NO: 2703562 - protein, 17 aa, Entamoeba histolytica
KCDNCGKQLGGKFGLKG

SEQ ID NO: 2703563 - protein, 18 aa, Entamoeba histolytica
KCECCQAILCGDCVKKRK

SEQ ID NO: 2703564 - protein, 18 aa, Entamoeba histolytica
KCGIKFCSAGSVIALMTD

SEQ ID NO: 2703565 - protein, 19 aa, Entamoeba histolytica
KCIKIIGDIMYWEAALPYE

SEQ ID NO: 2703566 - protein, 20 aa, Entamoeba histolytica
KCKKMCSVVRNFDKINSIHY

SEQ ID NO: 2703567 - protein, 20 aa, Entamoeba histolytica
KCLHCKCDICASERDDPKTI

SEQ ID NO: 2703568 - protein, 17 aa, Entamoeba histolytica
KCLWERRYSLLKTNPHA

SEQ ID NO: 2703569 - protein, 17 aa, Entamoeba histolytica
KCLYIPYVGNLVLEAVQ

SEQ ID NO: 2703570 - protein, 19 aa, Entamoeba histolytica
KCMGCGMCATKCTFGVLVK

SEQ ID NO: 2703571 - protein, 19 aa, Entamoeba histolytica
KCMGELPGPYIKYFVQSIG

SEQ ID NO: 2703572 - protein, 19 aa, Entamoeba histolytica
KCNKTCHYPCGIAGDVKDG

SEQ ID NO: 2703573 - protein, 19 aa, Entamoeba histolytica
KCPNLEFVGCTSMNRNESM

SEQ ID NO: 2703574 - protein, 19 aa, Entamoeba histolytica
KCRCALCRYQQLCEVLTQP

SEQ ID NO: 2703575 - protein, 18 aa, Entamoeba histolytica
KCSGCTKLVMMLRQMGYA

SEQ ID NO: 2703576 - protein, 18 aa, Entamoeba histolytica
KCYRCLCCASVFHIDCKP

SEQ ID NO: 2703577 - protein, 17 aa, Entamoeba histolytica
KCYTRLFEIINLKFHKA

SEQ ID NO: 2703578 - protein, 23 aa, Entamoeba histolytica
KDAKVCILSCPFEPPKTKTTTNM

SEQ ID NO: 2703579 - protein, 18 aa, Entamoeba histolytica
KDCSFMFMDVLKIIQTND

SEQ ID NO: 2703580 - protein, 23 aa, Entamoeba histolytica
KDDEPPIVYGFRPYMKEFIRKID

SEQ ID NO: 2703581 - protein, 23 aa, Entamoeba histolytica
KDEHICIINEGFPVKIHLCENKE

SEQ ID NO: 2703582 - protein, 25 aa, Entamoeba histolytica
KDEVFRKFICCGPMYFIENVNTPPS

SEQ ID NO: 2703583 - protein, 23 aa, Entamoeba histolytica
KDFLRRRACLMMYPMCKEYPDAL

SEQ ID NO: 2703584 - protein, 24 aa, Entamoeba histolytica
KDFSPVCGFMGMILMDQRPELKIN

SEQ ID NO: 2703585 - protein, 20 aa, Entamoeba histolytica
KDHRGLCVMTGYTIGDGMRL

SEQ ID NO: 2703586 - protein, 20 aa, Entamoeba histolytica
KDICFRKGDEMICFSTSDNR

SEQ ID NO: 2703587 - protein, 21 aa, Entamoeba histolytica
KDICRICLKGGVAVVGVGFPA

SEQ ID NO: 2703588 - protein, 17 aa, Entamoeba histolytica
KDIHCIELDHSIGDINQ

SEQ ID NO: 2703589 - protein, 19 aa, Entamoeba histolytica
KDIIRWLMCVDGKRVCKLV

SEQ ID NO: 2703590 - protein, 20 aa, Entamoeba histolytica
KDILLRISILIKTIQPMANS

SEQ ID NO: 2703591 - protein, 20 aa, Entamoeba histolytica
KDIWKHVCIVWTECENSLPP

SEQ ID NO: 2703592 - protein, 17 aa, Entamoeba histolytica
KDLFFGCCIILKSKEIL

SEQ ID NO: 2703593 - protein, 20 aa, Entamoeba histolytica
KDLKDGLVLIRLLRNLSGCD

SEQ ID NO: 2703594 - protein, 17 aa, Entamoeba histolytica
KDLKVHVLISVYSHQMY

SEQ ID NO: 2703595 - protein, 20 aa, Entamoeba histolytica
KDLRDAFELCIRFKNKGKRA

SEQ ID NO: 2703596 - protein, 19 aa, Entamoeba histolytica
KDMFKKLVICILVTIKDGV

SEQ ID NO: 2703597 - protein, 24 aa, Entamoeba histolytica
KDQKELWIQLAIELNYEERDDIAI

SEQ ID NO: 2703598 - protein, 19 aa, Entamoeba histolytica
KDQRVCLVKTLYRPVPLEH

SEQ ID NO: 2703599 - protein, 18 aa, Entamoeba histolytica
KDRFNLIVFGHEHCSQVE

SEQ ID NO: 2703600 - protein, 24 aa, Entamoeba histolytica
KDTLFYYRMMWNLNVGPSYSLPPK

SEQ ID NO: 2703601 - protein, 25 aa, Entamoeba histolytica
KDVRLRPRYLMKFLDTDGDWVTLTD

SEQ ID NO: 2703602 - protein, 25 aa, Entamoeba histolytica
KDYLNCLFIRYFPRAICLNCVMNLK

SEQ ID NO: 2703603 - protein, 21 aa, Entamoeba histolytica
KDYMKASSFSLVSAKYTAGEF

SEQ ID NO: 2703604 - protein, 19 aa, Entamoeba histolytica
KDYRMIFGLQKLFVDMLKG

SEQ ID NO: 2703605 - protein, 18 aa, Entamoeba histolytica
KEAFEYCLRYEKEYKEGE

SEQ ID NO: 2703606 - protein, 23 aa, Entamoeba histolytica
KEAIKFFGSICQYKIPKGARALK

SEQ ID NO: 2703607 - protein, 19 aa, Entamoeba histolytica
KEALLCLIINYSLYPVSKQ

SEQ ID NO: 2703608 - protein, 20 aa, Entamoeba histolytica
KECACAAAIIKEYLRELPDP

SEQ ID NO: 2703609 - protein, 19 aa, Entamoeba histolytica
KECLTSVIIELCIKLLDIN

SEQ ID NO: 2703610 - protein, 19 aa, Entamoeba histolytica
KEEIKDVILVGGPTKLCCF

SEQ ID NO: 2703611 - protein, 25 aa, Entamoeba histolytica
KEFDCIKPICYKACQMMLSNIDVEV

SEQ ID NO: 2703612 - protein, 21 aa, Entamoeba histolytica
KEFKFPISDCGKLEDVESVRK

SEQ ID NO: 2703613 - protein, 20 aa, Entamoeba histolytica
KEFLEDLLFEYGIIFIDSTN

SEQ ID NO: 2703614 - protein, 17 aa, Entamoeba histolytica
KEFTEAVVSLLMKGKCL

SEQ ID NO: 2703615 - protein, 32 aa, Entamoeba histolytica
KEGENKECVQIIQLLNAHRRALDWMERSTNEL

SEQ ID NO: 2703616 - protein, 17 aa, Entamoeba histolytica
KEGRWKYLRILSNDGNF

SEQ ID NO: 2703617 - protein, 26 aa, Entamoeba histolytica
KEIEELKKFVQQMSVVKDQMIDVVTQ

SEQ ID NO: 2703618 - protein, 19 aa, Entamoeba histolytica
KEIERSLGMMLLRGDCIQG

SEQ ID NO: 2703619 - protein, 17 aa, Entamoeba histolytica
KEIGLCFQVTDEPHVYE

SEQ ID NO: 2703620 - protein, 17 aa, Entamoeba histolytica
KEIKAGLTFSFAVEQIA

SEQ ID NO: 2703621 - protein, 17 aa, Entamoeba histolytica
KEIRMWIKKALERREKR

SEQ ID NO: 2703622 - protein, 20 aa, Entamoeba histolytica
KEIWIGLYFWYWHSDGRDYQ

SEQ ID NO: 2703623 - protein, 18 aa, Entamoeba histolytica
KEIYSILGNDIFVILRNI

SEQ ID NO: 2703624 - protein, 20 aa, Entamoeba histolytica
KEKRIRIAILSVTAAGTGIT

SEQ ID NO: 2703625 - protein, 23 aa, Entamoeba histolytica
KEKSFRMFIELGKKILPPPQLRT

SEQ ID NO: 2703626 - protein, 18 aa, Entamoeba histolytica
KELCKGYVDLAHYADLNG

SEQ ID NO: 2703627 - protein, 17 aa, Entamoeba histolytica
KELEGIPLLIYINKDDL

SEQ ID NO: 2703628 - protein, 17 aa, Entamoeba histolytica
KELFKYVLMYLTEGEVI

SEQ ID NO: 2703629 - protein, 17 aa, Entamoeba histolytica
KELKAKLSREVKSLIDE

SEQ ID NO: 2703630 - protein, 21 aa, Entamoeba histolytica
KELKYLLTTVMIRRLKHDVLK

SEQ ID NO: 2703631 - protein, 20 aa, Entamoeba histolytica
KELLIEIGFNKYAVQKQEIA

SEQ ID NO: 2703632 - protein, 19 aa, Entamoeba histolytica
KELLLFIRIQWIFIHLCNC

SEQ ID NO: 2703633 - protein, 20 aa, Entamoeba histolytica
KELMKLGAKFIYLSNGSFMQ

SEQ ID NO: 2703634 - protein, 21 aa, Entamoeba histolytica
KELPETLVFHLKRFVYNDQFE

SEQ ID NO: 2703635 - protein, 20 aa, Entamoeba histolytica
KELYKNGGIFFVTTRILISD

SEQ ID NO: 2703636 - protein, 17 aa, Entamoeba histolytica
KEMIEAIVLPMTQKEKF

SEQ ID NO: 2703637 - protein, 19 aa, Entamoeba histolytica
KEMIKRGASPYQYYDSWDQ

SEQ ID NO: 2703638 - protein, 21 aa, Entamoeba histolytica
KEMLPCFKYLYGHFEGLLEVC

SEQ ID NO: 2703639 - protein, 20 aa, Entamoeba histolytica
KENRFAVGIDSRMKEFINDL

SEQ ID NO: 2703640 - protein, 25 aa, Entamoeba histolytica
KEQRSRVVLTFLCLKELKTKDFFEL

SEQ ID NO: 2703641 - protein, 19 aa, Entamoeba histolytica
KERVLKMVLVWCKKCDSLW

SEQ ID NO: 2703642 - protein, 18 aa, Entamoeba histolytica
KESFAYKKFLGIVVSLGN

SEQ ID NO: 2703643 - protein, 19 aa, Entamoeba histolytica
KESIIPWINFIKKRDNINT

SEQ ID NO: 2703644 - protein, 22 aa, Entamoeba histolytica
KESLTLECFMHWNYYESKENGI

SEQ ID NO: 2703645 - protein, 20 aa, Entamoeba histolytica
KESREELGWFINIPKQQFIG

SEQ ID NO: 2703646 - protein, 17 aa, Entamoeba histolytica
KESRRGISITIKQYCST

SEQ ID NO: 2703647 - protein, 20 aa, Entamoeba histolytica
KEVIDSFEFYADRLLDLYTL

SEQ ID NO: 2703648 - protein, 22 aa, Entamoeba histolytica
KEVKRFPYVWGQDFIHSYWPDR

SEQ ID NO: 2703649 - protein, 18 aa, Entamoeba histolytica
KEVLGTIGIDIFKTKYAK

SEQ ID NO: 2703650 - protein, 20 aa, Entamoeba histolytica
KEVYGNGIAQCFIKEFGKFE

SEQ ID NO: 2703651 - protein, 17 aa, Entamoeba histolytica
KEWWFPLACSISGTEFR

SEQ ID NO: 2703652 - protein, 18 aa, Entamoeba histolytica
KEYACSFVIILGAVSYKD

SEQ ID NO: 2703653 - protein, 21 aa, Entamoeba histolytica
KEYCWCYKRKGTTRSSLVIFN

SEQ ID NO: 2703654 - protein, 17 aa, Entamoeba histolytica
KEYYLPFVFLDGKADQQ

SEQ ID NO: 2703655 - protein, 24 aa, Entamoeba histolytica
KFAEMIVSYLLRFGNDIDSWNSGN

SEQ ID NO: 2703656 - protein, 18 aa, Entamoeba histolytica
KFCSFDWWCQAIESGEKL

SEQ ID NO: 2703657 - protein, 19 aa, Entamoeba histolytica
KFDISKGILSRVERNPHLK

SEQ ID NO: 2703658 - protein, 19 aa, Entamoeba histolytica
KFFERMYCMFYPLDEQARC

SEQ ID NO: 2703659 - protein, 17 aa, Entamoeba histolytica
KFIPWGLSPSPTFSRSP

SEQ ID NO: 2703660 - protein, 24 aa, Entamoeba histolytica
KFKDELRGALALSKLENTFVVPEK

SEQ ID NO: 2703661 - protein, 20 aa, Entamoeba histolytica
KFKKSSLKRTVKVSSPKKKV

SEQ ID NO: 2703662 - protein, 21 aa, Entamoeba histolytica
KFKWIDPFNEYGFYAFGAAVI

SEQ ID NO: 2703663 - protein, 18 aa, Entamoeba histolytica
KFTCQWIELFSHRSLLLS

SEQ ID NO: 2703664 - protein, 17 aa, Entamoeba histolytica
KFTSLYCVFPLVGSEAI

SEQ ID NO: 2703665 - protein, 20 aa, Entamoeba histolytica
KFVPNCVTLFPSLRTSEDEF

SEQ ID NO: 2703666 - protein, 20 aa, Entamoeba histolytica
KFYFEAALKFSDKFPTLVNK

SEQ ID NO: 2703667 - protein, 20 aa, Entamoeba histolytica
KGCACLRSAAKVPILVNMTV

SEQ ID NO: 2703668 - protein, 17 aa, Entamoeba histolytica
KGCGFHRVIKDFMIQGG

SEQ ID NO: 2703669 - protein, 21 aa, Entamoeba histolytica
KGDVLACSWCPDIHGMLAVGG

SEQ ID NO: 2703670 - protein, 17 aa, Entamoeba histolytica
KGEITFRILKEFIEEGK

SEQ ID NO: 2703671 - protein, 22 aa, Entamoeba histolytica
KGELRPELILAINGLLQDLNHP

SEQ ID NO: 2703672 - protein, 20 aa, Entamoeba histolytica
KGFYEWKKSLMLSGKAKKMT

SEQ ID NO: 2703673 - protein, 20 aa, Entamoeba histolytica
KGGEIYRMFEISKLNPKGLF

SEQ ID NO: 2703674 - protein, 18 aa, Entamoeba histolytica
KGGQCIYAIVDYLQSEEF

SEQ ID NO: 2703675 - protein, 18 aa, Entamoeba histolytica
KGILPWIINFNCHSSLKE

SEQ ID NO: 2703676 - protein, 17 aa, Entamoeba histolytica
KGKTCVLMMVGLQGAGK

SEQ ID NO: 2703677 - protein, 17 aa, Entamoeba histolytica
KGLCASTLYYWIKSSEH

SEQ ID NO: 2703678 - protein, 19 aa, Entamoeba histolytica
KGLQLKFFFSIMEAEMSDI

SEQ ID NO: 2703679 - protein, 19 aa, Entamoeba histolytica
KGLRFGARIFSLFPEASKA

SEQ ID NO: 2703680 - protein, 20 aa, Entamoeba histolytica
KGRFPVISWVGPMNQCLSRS

SEQ ID NO: 2703681 - protein, 20 aa, Entamoeba histolytica
KGTELFQGKGIPLGISKRIK

SEQ ID NO: 2703682 - protein, 17 aa, Entamoeba histolytica
KGTHVIPEFHNFQAVIG

SEQ ID NO: 2703683 - protein, 17 aa, Entamoeba histolytica
KGTVPIDRIKIFLTKTL

SEQ ID NO: 2703684 - protein, 17 aa, Entamoeba histolytica
KGVMMLFTFDCNDTHDQ

SEQ ID NO: 2703685 - protein, 18 aa, Entamoeba histolytica
KGVPLYRVCVCCKSAVQG

SEQ ID NO: 2703686 - protein, 22 aa, Entamoeba histolytica
KHFRIVAVLLKYWLKIRNLNCP

SEQ ID NO: 2703687 - protein, 28 aa, Entamoeba histolytica
KHHCRKCGLCICSNCSKQTIIINGKKER

SEQ ID NO: 2703688 - protein, 22 aa, Entamoeba histolytica
KHLLRLYGRMNLLLSQIDKKQQ

SEQ ID NO: 2703689 - protein, 17 aa, Entamoeba histolytica
KHLWEVFTTSLFNFLWP

SEQ ID NO: 2703690 - protein, 17 aa, Entamoeba histolytica
KHYEKEEVVKLLQTMGL

SEQ ID NO: 2703691 - protein, 17 aa, Entamoeba histolytica
KIATGLIFIKWGYSDIV

SEQ ID NO: 2703692 - protein, 21 aa, Entamoeba histolytica
KIDFKCIIYGKGFHVGITCDY

SEQ ID NO: 2703693 - protein, 22 aa, Entamoeba histolytica
KIFKRLFRVYAHMFYSHANHLK

SEQ ID NO: 2703694 - protein, 25 aa, Entamoeba histolytica
KIGDACLRSAAAVGYYPPYQGYADG

SEQ ID NO: 2703695 - protein, 17 aa, Entamoeba histolytica
KIGNWCFYDCKSLTSIN

SEQ ID NO: 2703696 - protein, 22 aa, Entamoeba histolytica
KIGRPESILNFMIKYDLNKKDF

SEQ ID NO: 2703697 - protein, 18 aa, Entamoeba histolytica
KIHYCLAIEDTLYSKYQS

SEQ ID NO: 2703698 - protein, 18 aa, Entamoeba histolytica
KIIGSWAVVVVDQEQFIF

SEQ ID NO: 2703699 - protein, 17 aa, Entamoeba histolytica
KIIGWCEEWNKIDIQMN

SEQ ID NO: 2703700 - protein, 25 aa, Entamoeba histolytica
KIIKARIVSILSYWSTTILPLLPEK

SEQ ID NO: 2703701 - protein, 18 aa, Entamoeba histolytica
KIISSPRFKVSEIPNTLR

SEQ ID NO: 2703702 - protein, 18 aa, Entamoeba histolytica
KIITSLGCCTLVADTDDD

SEQ ID NO: 2703703 - protein, 21 aa, Entamoeba histolytica
KIKARWLRKNARRIDMENYTK

SEQ ID NO: 2703704 - protein, 20 aa, Entamoeba histolytica
KIKARWLRKNARRLDIEHYT

SEQ ID NO: 2703705 - protein, 20 aa, Entamoeba histolytica
KIKEVYTLCDWKVLEIINEK

SEQ ID NO: 2703706 - protein, 19 aa, Entamoeba histolytica
KIKGKYCFISFYNGVTILC

SEQ ID NO: 2703707 - protein, 17 aa, Entamoeba histolytica
KIKRYQIGKVYRRDQPY

SEQ ID NO: 2703708 - protein, 21 aa, Entamoeba histolytica
KIKSRWLRKNARRIDMETYTR

SEQ ID NO: 2703709 - protein, 18 aa, Entamoeba histolytica
KILKRNISPLFSLKLQDN

SEQ ID NO: 2703710 - protein, 22 aa, Entamoeba histolytica
KIMLEQCPLCWIDSVEKDKLKE

SEQ ID NO: 2703711 - protein, 21 aa, Entamoeba histolytica
KIPCLNSIVNIDCEFNETIIL

SEQ ID NO: 2703712 - protein, 22 aa, Entamoeba histolytica
KIQCLLCGLWVSENKLKIHQSQ

SEQ ID NO: 2703713 - protein, 21 aa, Entamoeba histolytica
KIRCGEVFSVLFERIIDKVKI

SEQ ID NO: 2703714 - protein, 19 aa, Entamoeba histolytica
KIRFDAGVTDLIWRNQTNF

SEQ ID NO: 2703715 - protein, 18 aa, Entamoeba histolytica
KIRKIRINIDFSMKFQLK

SEQ ID NO: 2703716 - protein, 25 aa, Entamoeba histolytica
KIRTETYSGISLRVIFPAFGGDAKT

SEQ ID NO: 2703717 - protein, 18 aa, Entamoeba histolytica
KISECLMVLMGVDMNQFL

SEQ ID NO: 2703718 - protein, 28 aa, Entamoeba histolytica
KISFGVNVKAMFLFRECVQRCISQKLEI

SEQ ID NO: 2703719 - protein, 19 aa, Entamoeba histolytica
KISYLLGVTHQFNYSHFQY

SEQ ID NO: 2703720 - protein, 18 aa, Entamoeba histolytica
KITEGVLLRMVLNDLMKQ

SEQ ID NO: 2703721 - protein, 23 aa, Entamoeba histolytica
KITFPFREIIAFSYIQTKTTTTI

SEQ ID NO: 2703722 - protein, 23 aa, Entamoeba histolytica
KITRSSLFLAYLIENPFNREICL

SEQ ID NO: 2703723 - protein, 20 aa, Entamoeba histolytica
KITVGFNFLSNFIIIKDYAI

SEQ ID NO: 2703724 - protein, 17 aa, Entamoeba histolytica
KIVGCIMSSYLLEKSRV

SEQ ID NO: 2703725 - protein, 19 aa, Entamoeba histolytica
KIYFSGIIEFNFNPVTKIC

SEQ ID NO: 2703726 - protein, 19 aa, Entamoeba histolytica
KKACWTIEINNHFYVTLKE

SEQ ID NO: 2703727 - protein, 20 aa, Entamoeba histolytica
KKALNEWILKSLIKNIQKKR

SEQ ID NO: 2703728 - protein, 21 aa, Entamoeba histolytica
KKAYKKLALKWHPDRNINNQQ

SEQ ID NO: 2703729 - protein, 18 aa, Entamoeba histolytica
KKCKSAVESLRYNPGFCG

SEQ ID NO: 2703730 - protein, 18 aa, Entamoeba histolytica
KKCVNAFILSHNELTIKE

SEQ ID NO: 2703731 - protein, 19 aa, Entamoeba histolytica
KKCWGESVIKELEKTDIIE

SEQ ID NO: 2703732 - protein, 18 aa, Entamoeba histolytica
KKDLEAIASLIEETIGGM

SEQ ID NO: 2703733 - protein, 21 aa, Entamoeba histolytica
KKEIPRTLIFSKFNIIETIPC

SEQ ID NO: 2703734 - protein, 22 aa, Entamoeba histolytica
KKEKLPCPFTYLQLSEMCGWND

SEQ ID NO: 2703735 - protein, 20 aa, Entamoeba histolytica
KKENCQFILFRLTKSDGLFI

SEQ ID NO: 2703736 - protein, 20 aa, Entamoeba histolytica
KKFLCVCWCGQAAPDNLKTK

SEQ ID NO: 2703737 - protein, 17 aa, Entamoeba histolytica
KKFTIGVEFATRTIEYE

SEQ ID NO: 2703738 - protein, 26 aa, Entamoeba histolytica
KKHLYKIKWFLPSLRELFRKNNRRYS

SEQ ID NO: 2703739 - protein, 24 aa, Entamoeba histolytica
KKISCAVLYCWCVSLLLEKLNNTE

SEQ ID NO: 2703740 - protein, 24 aa, Entamoeba histolytica
KKISLWVVCELLRIVVSSNLQEFD

SEQ ID NO: 2703741 - protein, 20 aa, Entamoeba histolytica
KKKGHCNLLGNPVPFDPLKH

SEQ ID NO: 2703742 - protein, 20 aa, Entamoeba histolytica
KKKHCYAFLFSDELVFAKEQ

SEQ ID NO: 2703743 - protein, 21 aa, Entamoeba histolytica
KKKKIIICWKLTKEVKERNEY

SEQ ID NO: 2703744 - protein, 22 aa, Entamoeba histolytica
KKKRLSGLSSLFVKRKPDRSVT

SEQ ID NO: 2703745 - protein, 22 aa, Entamoeba histolytica
KKKWKLRFVIVNGSTLYYYKTE

SEQ ID NO: 2703746 - protein, 20 aa, Entamoeba histolytica
KKLDGIVLEGEWKKGFDAGN

SEQ ID NO: 2703747 - protein, 19 aa, Entamoeba histolytica
KKLKYKAEFVFKDENDMTW

SEQ ID NO: 2703748 - protein, 18 aa, Entamoeba histolytica
KKLRFGVGQYEYIIQFSI

SEQ ID NO: 2703749 - protein, 17 aa, Entamoeba histolytica
KKLTLIILYRGVVVTDV

SEQ ID NO: 2703750 - protein, 22 aa, Entamoeba histolytica
KKMFECLSEIPIYVGLEKAGFC

SEQ ID NO: 2703751 - protein, 17 aa, Entamoeba histolytica
KKMLCKRNCSNKQKKEN

SEQ ID NO: 2703752 - protein, 23 aa, Entamoeba histolytica
KKNFLIRIAHGFHDLFIRTIKKL

SEQ ID NO: 2703753 - protein, 17 aa, Entamoeba histolytica
KKNVELFGVLDEDDRKS

SEQ ID NO: 2703754 - protein, 20 aa, Entamoeba histolytica
KKPDECITCIDGNKIDQSLF

SEQ ID NO: 2703755 - protein, 18 aa, Entamoeba histolytica
KKPMRICRMNGSGSSEYL

SEQ ID NO: 2703756 - protein, 17 aa, Entamoeba histolytica
KKRDFYTFFSFKDKSKT

SEQ ID NO: 2703757 - protein, 18 aa, Entamoeba histolytica
KKRIEEFENNKGDDIKTS

SEQ ID NO: 2703758 - protein, 18 aa, Entamoeba histolytica
KKRIPICTYFNQVTHGAI

SEQ ID NO: 2703759 - protein, 20 aa, Entamoeba histolytica
KKRLCCERCNSEVMFYELQR

SEQ ID NO: 2703760 - protein, 21 aa, Entamoeba histolytica
KKRLFKKWEVILFRKQDRKKK

SEQ ID NO: 2703761 - protein, 18 aa, Entamoeba histolytica
KKRMLIKLTLKDYIFARH

SEQ ID NO: 2703762 - protein, 17 aa, Entamoeba histolytica
KKRWCILTKNKLFYFNC

SEQ ID NO: 2703763 - protein, 18 aa, Entamoeba histolytica
KKRWCVLTPTGMIFYFKD

SEQ ID NO: 2703764 - protein, 23 aa, Entamoeba histolytica
KKRWELPRSGILTMKNGIGIIKD

SEQ ID NO: 2703765 - protein, 17 aa, Entamoeba histolytica
KKSECNFIPQSVTALTV

SEQ ID NO: 2703766 - protein, 20 aa, Entamoeba histolytica
KKSKGCAFVSFKTPLEAQKC

SEQ ID NO: 2703767 - protein, 25 aa, Entamoeba histolytica
KKSSWRFPIPVFRSLQYLLTHEGKE

SEQ ID NO: 2703768 - protein, 20 aa, Entamoeba histolytica
KKVFCVLGGYGLFDSTQIQI

SEQ ID NO: 2703769 - protein, 17 aa, Entamoeba histolytica
KKWLCLMKEEEQIELLA

SEQ ID NO: 2703770 - protein, 21 aa, Entamoeba histolytica
KKWRFSNKYSKWVIQTPNGWM

SEQ ID NO: 2703771 - protein, 19 aa, Entamoeba histolytica
KKWWKYAFNVILEDVRKKN

SEQ ID NO: 2703772 - protein, 23 aa, Entamoeba histolytica
KKYGIKVPFMYGTMVECVRAALT

SEQ ID NO: 2703773 - protein, 26 aa, Entamoeba histolytica
KKYKMTVFIPMHFPRFSTMQGNRCKE

SEQ ID NO: 2703774 - protein, 19 aa, Entamoeba histolytica
KLAKIICAIGFKKIEGITV

SEQ ID NO: 2703775 - protein, 21 aa, Entamoeba histolytica
KLCTWLRLLGFDSKGSKDYEE

SEQ ID NO: 2703776 - protein, 24 aa, Entamoeba histolytica
KLDCKEGLCFKHEFFQRAHPELLE

SEQ ID NO: 2703777 - protein, 20 aa, Entamoeba histolytica
KLEDICFQFSMKIHSLTIPQ

SEQ ID NO: 2703778 - protein, 20 aa, Entamoeba histolytica
KLENVCRVFSASIISSEEEK

SEQ ID NO: 2703779 - protein, 24 aa, Entamoeba histolytica
KLEPRFIFEGEIFLAAGEKALLVP

SEQ ID NO: 2703780 - protein, 20 aa, Entamoeba histolytica
KLEPSEFFGQAWAKAKLRHK

SEQ ID NO: 2703781 - protein, 18 aa, Entamoeba histolytica
KLFGISFPCFSKRITNTI

SEQ ID NO: 2703782 - protein, 19 aa, Entamoeba histolytica
KLGFPYELLLQINKEVAGL

SEQ ID NO: 2703783 - protein, 18 aa, Entamoeba histolytica
KLGIRFIVIRSLSDVPSE

SEQ ID NO: 2703784 - protein, 17 aa, Entamoeba histolytica
KLGYRLIQIAIRYEDYV

SEQ ID NO: 2703785 - protein, 22 aa, Entamoeba histolytica
KLHHVYRYKVDYSFYLKHREDN

SEQ ID NO: 2703786 - protein, 21 aa, Entamoeba histolytica
KLIDFGSACFENFTMNTYIQS

SEQ ID NO: 2703787 - protein, 17 aa, Entamoeba histolytica
KLIKFKWIDPFNEYGFY

SEQ ID NO: 2703788 - protein, 18 aa, Entamoeba histolytica
KLIMIGESSVGKTCCMNR

SEQ ID NO: 2703789 - protein, 23 aa, Entamoeba histolytica
KLKDIYEFWGFLWSQMFKILEEH

SEQ ID NO: 2703790 - protein, 19 aa, Entamoeba histolytica
KLKECKGIEVISCNILPSF

SEQ ID NO: 2703791 - protein, 19 aa, Entamoeba histolytica
KLKIGNHVIFGGSPATTFI

SEQ ID NO: 2703792 - protein, 19 aa, Entamoeba histolytica
KLKKGRWSGMRVYDAEKEG

SEQ ID NO: 2703793 - protein, 21 aa, Entamoeba histolytica
KLKLRFENEIHLFKISPIDKL

SEQ ID NO: 2703794 - protein, 18 aa, Entamoeba histolytica
KLLFNYVALGVKLMNASN

SEQ ID NO: 2703795 - protein, 19 aa, Entamoeba histolytica
KLLHEYGILYSFRKSPFRS

SEQ ID NO: 2703796 - protein, 17 aa, Entamoeba histolytica
KLLPVIINFMSLKICPL

SEQ ID NO: 2703797 - protein, 25 aa, Entamoeba histolytica
KLLQRLLGLIVFRIDIHISKRDIRG

SEQ ID NO: 2703798 - protein, 19 aa, Entamoeba histolytica
KLLRCLFMKELSFESEKKY

SEQ ID NO: 2703799 - protein, 17 aa, Entamoeba histolytica
KLMEAFCNKQGLNMSSV

SEQ ID NO: 2703800 - protein, 24 aa, Entamoeba histolytica
KLNMVQCFICPSFITRSLKIIGSD

SEQ ID NO: 2703801 - protein, 23 aa, Entamoeba histolytica
KLPCFNCPSLVYTEIDGIIHKLL

SEQ ID NO: 2703802 - protein, 18 aa, Entamoeba histolytica
KLQICCPYGTPIESLDSE

SEQ ID NO: 2703803 - protein, 18 aa, Entamoeba histolytica
KLRHCTRLVLKDFYSPLL

SEQ ID NO: 2703804 - protein, 23 aa, Entamoeba histolytica
KLRLCCLPKVPYFVEMHASEFIL

SEQ ID NO: 2703805 - protein, 23 aa, Entamoeba histolytica
KLSLKRPIPLVGFCTYFEADISN

SEQ ID NO: 2703806 - protein, 20 aa, Entamoeba histolytica
KLSNGKLWFTIGILNENEEL

SEQ ID NO: 2703807 - protein, 19 aa, Entamoeba histolytica
KLSSLEIKLIMTLRVDFSK

SEQ ID NO: 2703808 - protein, 18 aa, Entamoeba histolytica
KLSTEVKALLNIRIHLLL

SEQ ID NO: 2703809 - protein, 18 aa, Entamoeba histolytica
KLSTEVKALLNIRIHLWL

SEQ ID NO: 2703810 - protein, 18 aa, Entamoeba histolytica
KLSTSLCNEQDELQKSKS

SEQ ID NO: 2703811 - protein, 19 aa, Entamoeba histolytica
KLTEIKGIEFIKESNGMII

SEQ ID NO: 2703812 - protein, 19 aa, Entamoeba histolytica
KLVDEFGFIQSLLDIFYDE

SEQ ID NO: 2703813 - protein, 22 aa, Entamoeba histolytica
KLVSNELWEWILLPKEKFQKRK

SEQ ID NO: 2703814 - protein, 26 aa, Entamoeba histolytica
KLWLEMSIVRPRHCTIAFTGSINLNS

SEQ ID NO: 2703815 - protein, 23 aa, Entamoeba histolytica
KLYIKTSCMPFFIMVNQHDLISF

SEQ ID NO: 2703816 - protein, 18 aa, Entamoeba histolytica
KMILPILKFIHGIVSIEL

SEQ ID NO: 2703817 - protein, 19 aa, Entamoeba histolytica
KMKDLRLAAEIQKKKLGDK

SEQ ID NO: 2703818 - protein, 19 aa, Entamoeba histolytica
KMKELLEGIFLRLFSFKMI

SEQ ID NO: 2703819 - protein, 17 aa, Entamoeba histolytica
KMLMGFFRALMVWETSL

SEQ ID NO: 2703820 - protein, 23 aa, Entamoeba histolytica
KMSQLLCCICGDGSSFPLYCVVN

SEQ ID NO: 2703821 - protein, 26 aa, Entamoeba histolytica
KMVRVSGKFFLKWRITELKPEYLNSG

SEQ ID NO: 2703822 - protein, 20 aa, Entamoeba histolytica
KMVYEGLQWAFANRPEQIQN

SEQ ID NO: 2703823 - protein, 19 aa, Entamoeba histolytica
KNCCIGIICPYQYQTQLIK

SEQ ID NO: 2703824 - protein, 18 aa, Entamoeba histolytica
KNEPVICLGQEKLKEQQL

SEQ ID NO: 2703825 - protein, 19 aa, Entamoeba histolytica
KNGQIALEFVVGIFYDNSV

SEQ ID NO: 2703826 - protein, 20 aa, Entamoeba histolytica
KNGWRLPLGNSFKFLNEIIS

SEQ ID NO: 2703827 - protein, 23 aa, Entamoeba histolytica
KNIKIENIVNAWSIINKAKDSMQ

SEQ ID NO: 2703828 - protein, 20 aa, Entamoeba histolytica
KNILVCLSLVHYSGITPLGG

SEQ ID NO: 2703829 - protein, 21 aa, Entamoeba histolytica
KNKKDHIVLCFSSVVDRSQFK

SEQ ID NO: 2703830 - protein, 18 aa, Entamoeba histolytica
KNKLDVIFLHFPDVQSMN

SEQ ID NO: 2703831 - protein, 19 aa, Entamoeba histolytica
KNKRCCVSRLSELYKEMND

SEQ ID NO: 2703832 - protein, 19 aa, Entamoeba histolytica
KNKWCYRDLTFKMAHPSSH

SEQ ID NO: 2703833 - protein, 22 aa, Entamoeba histolytica
KNPDAWGKWNIMRGINLHKTQC

SEQ ID NO: 2703834 - protein, 17 aa, Entamoeba histolytica
KNVNLVWKIIFEGLMFE

SEQ ID NO: 2703835 - protein, 19 aa, Entamoeba histolytica
KNVRPGISFEQFVAQLYKL

SEQ ID NO: 2703836 - protein, 17 aa, Entamoeba histolytica
KNYGIKCILTYNSVSAS

SEQ ID NO: 2703837 - protein, 18 aa, Entamoeba histolytica
KNYPTGFSYFMHKVSIEL

SEQ ID NO: 2703838 - protein, 18 aa, Entamoeba histolytica
KPCPYCKTVSPKIVLNDS

SEQ ID NO: 2703839 - protein, 19 aa, Entamoeba histolytica
KPFKCVFERTIERSLPKQD

SEQ ID NO: 2703840 - protein, 21 aa, Entamoeba histolytica
KPGKDALHWGVLRPFDSSYPG

SEQ ID NO: 2703841 - protein, 19 aa, Entamoeba histolytica
KPILRRVCVNLKEECEKYS

SEQ ID NO: 2703842 - protein, 17 aa, Entamoeba histolytica
KPISWLIGRKVKRGTDW

SEQ ID NO: 2703843 - protein, 23 aa, Entamoeba histolytica
KPIYRLVERIGFIRRNIGIKTEK

SEQ ID NO: 2703844 - protein, 17 aa, Entamoeba histolytica
KPKIVGIAFTFNIHQTS

SEQ ID NO: 2703845 - protein, 22 aa, Entamoeba histolytica
KPLELPQMFSMPFTIEDIQQLI

SEQ ID NO: 2703846 - protein, 18 aa, Entamoeba histolytica
KPPCLVIVNGIKEGIDYN

SEQ ID NO: 2703847 - protein, 22 aa, Entamoeba histolytica
KPPRLPCSLKRDSPPLPKISQR

SEQ ID NO: 2703848 - protein, 21 aa, Entamoeba histolytica
KPQEWNHKCVMCVSKMGKFSS

SEQ ID NO: 2703849 - protein, 21 aa, Entamoeba histolytica
KPRKDCVCGLDLLHEPKRDKL

SEQ ID NO: 2703850 - protein, 23 aa, Entamoeba histolytica
KQETSLLFGIAFDRRLEKLKEQY

SEQ ID NO: 2703851 - protein, 21 aa, Entamoeba histolytica
KQGRLRLNLMGKRVDFSARTV

SEQ ID NO: 2703852 - protein, 24 aa, Entamoeba histolytica
KQIGICWKELLIVPSEVVDPNSFG

SEQ ID NO: 2703853 - protein, 20 aa, Entamoeba histolytica
KQKWIIKLKEMMLFTVEISE

SEQ ID NO: 2703854 - protein, 26 aa, Entamoeba histolytica
KQLEWKWGICMAIGFQEFIECKLKGT

SEQ ID NO: 2703855 - protein, 20 aa, Entamoeba histolytica
KQLLVLTGFLPILFNGRKFG

SEQ ID NO: 2703856 - protein, 21 aa, Entamoeba histolytica
KQLRCNGVLEGIRITRMGYPN

SEQ ID NO: 2703857 - protein, 18 aa, Entamoeba histolytica
KQLRCVRLLLQKQGKVSD

SEQ ID NO: 2703858 - protein, 18 aa, Entamoeba histolytica
KQLSISLLDWCLTQPAGM

SEQ ID NO: 2703859 - protein, 18 aa, Entamoeba histolytica
KQNFRLVLINGKYYLQAE

SEQ ID NO: 2703860 - protein, 17 aa, Entamoeba histolytica
KQNRWFPKYSIYPVDEI

SEQ ID NO: 2703861 - protein, 23 aa, Entamoeba histolytica
KQYDCIWIQWSILYLRDDDLIDM

SEQ ID NO: 2703862 - protein, 17 aa, Entamoeba histolytica
KQYGYRARSAFKLVQMN

SEQ ID NO: 2703863 - protein, 19 aa, Entamoeba histolytica
KRATHIVCHNFGRTIKMLK

SEQ ID NO: 2703864 - protein, 25 aa, Entamoeba histolytica
KRAYKEYKIYLKGEDISKVTEEPSN

SEQ ID NO: 2703865 - protein, 21 aa, Entamoeba histolytica
KRDIIMGVAYLEWARNKYSQI

SEQ ID NO: 2703866 - protein, 17 aa, Entamoeba histolytica
KREEVWENLEVLKLSNC

SEQ ID NO: 2703867 - protein, 24 aa, Entamoeba histolytica
KRERKVCLIRMDYDIVSKGIEQRH

SEQ ID NO: 2703868 - protein, 20 aa, Entamoeba histolytica
KRFICTLCLLFHPKFNLGKC

SEQ ID NO: 2703869 - protein, 18 aa, Entamoeba histolytica
KRFNSDLVRFNVFKDTME

SEQ ID NO: 2703870 - protein, 21 aa, Entamoeba histolytica
KRGEQKFEFTIHINKNGMMEI

SEQ ID NO: 2703871 - protein, 20 aa, Entamoeba histolytica
KRGTICWSPKGNLLAIGTTA

SEQ ID NO: 2703872 - protein, 19 aa, Entamoeba histolytica
KRICHFCATASRLRTMKFD

SEQ ID NO: 2703873 - protein, 21 aa, Entamoeba histolytica
KRILSLMAMLVTLMRELNGIY

SEQ ID NO: 2703874 - protein, 20 aa, Entamoeba histolytica
KRISDGIIYLHVGDFRFDST

SEQ ID NO: 2703875 - protein, 19 aa, Entamoeba histolytica
KRKAFSMDNPEDFMIFPVK

SEQ ID NO: 2703876 - protein, 17 aa, Entamoeba histolytica
KRKEEWHPYLLFCKEHR

SEQ ID NO: 2703877 - protein, 17 aa, Entamoeba histolytica
KRKEYRVAFRFNGQTNE

SEQ ID NO: 2703878 - protein, 23 aa, Entamoeba histolytica
KRKPVVGCFFELLVLKTQGVIDL

SEQ ID NO: 2703879 - protein, 21 aa, Entamoeba histolytica
KRLRPLSLLLFFIGGGGKIEE

SEQ ID NO: 2703880 - protein, 18 aa, Entamoeba histolytica
KRLSCFSDKEIMLFNRIK

SEQ ID NO: 2703881 - protein, 19 aa, Entamoeba histolytica
KRNSLTVFLNKKIYKDPNE

SEQ ID NO: 2703882 - protein, 24 aa, Entamoeba histolytica
KRSGIGVVCPHGQYSPIFFQFLDC

SEQ ID NO: 2703883 - protein, 25 aa, Entamoeba histolytica
KRSGIGVVCPHGQYSPIFFQFLDCV

SEQ ID NO: 2703884 - protein, 20 aa, Entamoeba histolytica
KRSKITLPFFNVIRISTEKE

SEQ ID NO: 2703885 - protein, 20 aa, Entamoeba histolytica
KRTPLHIACCCGNSYIIPLL

SEQ ID NO: 2703886 - protein, 17 aa, Entamoeba histolytica
KRYCIILENGLKALGFN

SEQ ID NO: 2703887 - protein, 20 aa, Entamoeba histolytica
KRYECITMFFQLLIKLIQKK

SEQ ID NO: 2703888 - protein, 17 aa, Entamoeba histolytica
KRYLSFIKFNPWTYCGD

SEQ ID NO: 2703889 - protein, 20 aa, Entamoeba histolytica
KSAILVALAICFGAKAQFTN

SEQ ID NO: 2703890 - protein, 18 aa, Entamoeba histolytica
KSCLKLMIEPVIPFNKAI

SEQ ID NO: 2703891 - protein, 25 aa, Entamoeba histolytica
KSDKSLQHAMSWLFLNMCRGSIINY

SEQ ID NO: 2703892 - protein, 20 aa, Entamoeba histolytica
KSFCDFFKRRGHTQLIEEFS

SEQ ID NO: 2703893 - protein, 20 aa, Entamoeba histolytica
KSFEFGWEWMIEKLLQENII

SEQ ID NO: 2703894 - protein, 21 aa, Entamoeba histolytica
KSFKILLFFKNEYGGISSRQS

SEQ ID NO: 2703895 - protein, 18 aa, Entamoeba histolytica
KSFYKGCLMGGVHGGIYN

SEQ ID NO: 2703896 - protein, 20 aa, Entamoeba histolytica
KSHCWFKGFDWEGLFKKKLT

SEQ ID NO: 2703897 - protein, 19 aa, Entamoeba histolytica
KSHCWFKGFDWEGLFQKKL

SEQ ID NO: 2703898 - protein, 19 aa, Entamoeba histolytica
KSICKEGFFLFTHNYTTIE

SEQ ID NO: 2703899 - protein, 19 aa, Entamoeba histolytica
KSIFKPMKWNPIGDNSSNA

SEQ ID NO: 2703900 - protein, 25 aa, Entamoeba histolytica
KSILRRLPHVFFYKRVFSGNDTDFQ

SEQ ID NO: 2703901 - protein, 19 aa, Entamoeba histolytica
KSKEWKVDTLILKKYPALV

SEQ ID NO: 2703902 - protein, 19 aa, Entamoeba histolytica
KSKSSLKRKSLSLIKKSIS

SEQ ID NO: 2703903 - protein, 18 aa, Entamoeba histolytica
KSLCFEVVYDKQFVFFCK

SEQ ID NO: 2703904 - protein, 17 aa, Entamoeba histolytica
KSLGYTFLPIITKNEIK

SEQ ID NO: 2703905 - protein, 17 aa, Entamoeba histolytica
KSLSWPTILYVIGSIVK

SEQ ID NO: 2703906 - protein, 21 aa, Entamoeba histolytica
KSNCFRHCNKLAFIELPSKLE

SEQ ID NO: 2703907 - protein, 25 aa, Entamoeba histolytica
KSPIPIRLPYSMAIKLFPLPTELHN

SEQ ID NO: 2703908 - protein, 26 aa, Entamoeba histolytica
KSPIYQHGCSWAWKLMDGNAPLSFNE

SEQ ID NO: 2703909 - protein, 26 aa, Entamoeba histolytica
KSRCSEFKRKLSLVGKKIGEETECQI

SEQ ID NO: 2703910 - protein, 18 aa, Entamoeba histolytica
KSRLVFAEICWKKPHLLL

SEQ ID NO: 2703911 - protein, 19 aa, Entamoeba histolytica
KSSHALRPFYITLLSSKSC

SEQ ID NO: 2703912 - protein, 20 aa, Entamoeba histolytica
KSSKLLAQWIVLCPSSVIPI

SEQ ID NO: 2703913 - protein, 19 aa, Entamoeba histolytica
KSTILEIGYFYTITLEEIC

SEQ ID NO: 2703914 - protein, 20 aa, Entamoeba histolytica
KSTPSLFCVQSFCHISTNKQ

SEQ ID NO: 2703915 - protein, 18 aa, Entamoeba histolytica
KSTYGTGCFVVKNIGDTI

SEQ ID NO: 2703916 - protein, 18 aa, Entamoeba histolytica
KSVEELRSTFGIINDFTK

SEQ ID NO: 2703917 - protein, 20 aa, Entamoeba histolytica
KSVGISINWGIRFENDDDVK

SEQ ID NO: 2703918 - protein, 24 aa, Entamoeba histolytica
KSWIKRLNIVISFLRDMRLIQRDI

SEQ ID NO: 2703919 - protein, 18 aa, Entamoeba histolytica
KSYKGTHVIPEFHNFQAV

SEQ ID NO: 2703920 - protein, 22 aa, Entamoeba histolytica
KSYYIPGYRFKPEFTEQRAKDL

SEQ ID NO: 2703921 - protein, 20 aa, Entamoeba histolytica
KTCKIYRALFSSITKKDIIE

SEQ ID NO: 2703922 - protein, 24 aa, Entamoeba histolytica
KTCLCSVCGGVMCLSSLQNKWSCF

SEQ ID NO: 2703923 - protein, 22 aa, Entamoeba histolytica
KTCPDCLQLGIPCEKHNDSYFP

SEQ ID NO: 2703924 - protein, 20 aa, Entamoeba histolytica
KTDIWCCGVMLFYMSIGMFP

SEQ ID NO: 2703925 - protein, 20 aa, Entamoeba histolytica
KTECPFRINLNYRANTNTWN

SEQ ID NO: 2703926 - protein, 18 aa, Entamoeba histolytica
KTEMLDFKESLQIEQKKE

SEQ ID NO: 2703927 - protein, 17 aa, Entamoeba histolytica
KTGDFKPSPGFKMPCKE

SEQ ID NO: 2703928 - protein, 20 aa, Entamoeba histolytica
KTGICFKHEFFIRDTPEFLD

SEQ ID NO: 2703929 - protein, 26 aa, Entamoeba histolytica
KTIDFRFLRPLSIDFLRRFDKAANAD

SEQ ID NO: 2703930 - protein, 17 aa, Entamoeba histolytica
KTKEANCGFEFQEEKEQ

SEQ ID NO: 2703931 - protein, 18 aa, Entamoeba histolytica
KTKEVFIIIGRVIISLIN

SEQ ID NO: 2703932 - protein, 18 aa, Entamoeba histolytica
KTKIEFIDIASFTIISTV

SEQ ID NO: 2703933 - protein, 18 aa, Entamoeba histolytica
KTKRVCILYPSFSDIYYA

SEQ ID NO: 2703934 - protein, 22 aa, Entamoeba histolytica
KTLLNDVPVCFVLNKADLSSQM

SEQ ID NO: 2703935 - protein, 17 aa, Entamoeba histolytica
KTLLNTRMHLWLEYYTI

SEQ ID NO: 2703936 - protein, 18 aa, Entamoeba histolytica
KTLQCYDLSPAVMTTALY

SEQ ID NO: 2703937 - protein, 17 aa, Entamoeba histolytica
KTMICPKGLLALVNSPR

SEQ ID NO: 2703938 - protein, 19 aa, Entamoeba histolytica
KTMIEIICNIFPFYKFWEH

SEQ ID NO: 2703939 - protein, 17 aa, Entamoeba histolytica
KTMLCNLLFEYLDYYTP

SEQ ID NO: 2703940 - protein, 31 aa, Entamoeba histolytica
KTNLSCFIKLFQRFGEIYSIWGSSNGKIFFV

SEQ ID NO: 2703941 - protein, 17 aa, Entamoeba histolytica
KTRSTRIIVKMKRVSSL

SEQ ID NO: 2703942 - protein, 22 aa, Entamoeba histolytica
KTTCPRCKYLFCRKCGENWHEG

SEQ ID NO: 2703943 - protein, 17 aa, Entamoeba histolytica
KTTFCFIQTIGIQCLKF

SEQ ID NO: 2703944 - protein, 18 aa, Entamoeba histolytica
KTTIIVNMHIWKSLNASF

SEQ ID NO: 2703945 - protein, 18 aa, Entamoeba histolytica
KTTRCLLFYLMYFLGHSQ

SEQ ID NO: 2703946 - protein, 23 aa, Entamoeba histolytica
KVCFKCGKPGHIGRDCSQPDDKV

SEQ ID NO: 2703947 - protein, 20 aa, Entamoeba histolytica
KVCLNICSLLFEKIDEYKMT

SEQ ID NO: 2703948 - protein, 18 aa, Entamoeba histolytica
KVEGFWPIVMAKALANAD

SEQ ID NO: 2703949 - protein, 19 aa, Entamoeba histolytica
KVGKTGIESINFRKLEEKL

SEQ ID NO: 2703950 - protein, 22 aa, Entamoeba histolytica
KVGPCLDCIISLFPPQKTFPMC

SEQ ID NO: 2703951 - protein, 19 aa, Entamoeba histolytica
KVIEPIIAYMLFKKIIIRE

SEQ ID NO: 2703952 - protein, 19 aa, Entamoeba histolytica
KVILRFVFNLIQIAFTSQH

SEQ ID NO: 2703953 - protein, 20 aa, Entamoeba histolytica
KVIPKREEKILCKIFPLYFS

SEQ ID NO: 2703954 - protein, 24 aa, Entamoeba histolytica
KVIPNCLGNIWVYVRDWSEEDGRC

SEQ ID NO: 2703955 - protein, 27 aa, Entamoeba histolytica
KVISEALCAISFIALKMKFNFVHYYPE

SEQ ID NO: 2703956 - protein, 18 aa, Entamoeba histolytica
KVNMCALNIKMGYDNLYE

SEQ ID NO: 2703957 - protein, 21 aa, Entamoeba histolytica
KVPGYYPSWFVGIRQKDSHEL

SEQ ID NO: 2703958 - protein, 19 aa, Entamoeba histolytica
KVREFRTAIQFVNSTLTRS

SEQ ID NO: 2703959 - protein, 17 aa, Entamoeba histolytica
KVSFFNAMVDKFYSSII

SEQ ID NO: 2703960 - protein, 18 aa, Entamoeba histolytica
KVVKEYLNGLGLTYETKL

SEQ ID NO: 2703961 - protein, 22 aa, Entamoeba histolytica
KVYEIRSSYKFAEKSIDTDFKE

SEQ ID NO: 2703962 - protein, 24 aa, Entamoeba histolytica
KVYVLREFRCCFILYYGDSTIVSK

SEQ ID NO: 2703963 - protein, 23 aa, Entamoeba histolytica
KWIRCGDIVQCLWVDASDMPSRR

SEQ ID NO: 2703964 - protein, 20 aa, Entamoeba histolytica
KWLKTHLQHVIWKQSGYYFH

SEQ ID NO: 2703965 - protein, 22 aa, Entamoeba histolytica
KWLWEILHSYSIELKKKFLFFS

SEQ ID NO: 2703966 - protein, 20 aa, Entamoeba histolytica
KWRKLGMSDLCDFEGVQKWY

SEQ ID NO: 2703967 - protein, 22 aa, Entamoeba histolytica
KYCSVKGWKLSSLEIKLIMTLR

SEQ ID NO: 2703968 - protein, 20 aa, Entamoeba histolytica
KYFWEIAKSLTLEQKKKLLI

SEQ ID NO: 2703969 - protein, 24 aa, Entamoeba histolytica
KYHLKYCFFNKLGFLIEIPSFSTS

SEQ ID NO: 2703970 - protein, 21 aa, Entamoeba histolytica
KYKIVVERCILFDKAEQQMVK

SEQ ID NO: 2703971 - protein, 19 aa, Entamoeba histolytica
KYKSIICELYFELHPIFNK

SEQ ID NO: 2703972 - protein, 23 aa, Entamoeba histolytica
KYLERFSSFLLNFIKLPTPNVLP

SEQ ID NO: 2703973 - protein, 22 aa, Entamoeba histolytica
KYLLLNGICVALKMGNPDYEKT

SEQ ID NO: 2703974 - protein, 20 aa, Entamoeba histolytica
KYPELSILCVNTFYKDCRDS

SEQ ID NO: 2703975 - protein, 23 aa, Entamoeba histolytica
KYPKLKIGITLSKYSSHQYISLE

SEQ ID NO: 2703976 - protein, 19 aa, Entamoeba histolytica
KYQLPSCGFDWCNQNPDLL
